United States Patent 8,614,309 (DOUBLE-STRANDED RNA DIRECTED TO CASP2 AND METHODS OF USE THEREOF) - sequence listing, part 2

SEQ ID NO: 26349 - RNA, 21 nt, Artificial Sequence
  RNA Oligomer
auaacauaggugaguagugac

SEQ ID NO: 26350 - RNA, 21 nt, Artificial Sequence
  RNA Oligomer
gauugcuaugauuaugaugcc

SEQ ID NO: 26351 - RNA, 21 nt, Artificial Sequence
  RNA Oligomer
cagugccuuuuaguuauuuug

SEQ ID NO: 26352 - RNA, 21 nt, Artificial Sequence
  RNA Oligomer
aaaaacagugagaaccauccu

SEQ ID NO: 26353 - RNA, 21 nt, Artificial Sequence
  RNA Oligomer
uagcuugcugucuaaaauucu

SEQ ID NO: 26354 - RNA, 21 nt, Artificial Sequence
  RNA Oligomer
aagaacuuuuaucaacccuuc

SEQ ID NO: 26355 - RNA, 21 nt, Artificial Sequence
  RNA Oligomer
aaugcaagugaaauccaaggg

SEQ ID NO: 26356 - RNA, 21 nt, Artificial Sequence
  RNA Oligomer
uggauuuugcaagacauuagg

SEQ ID NO: 26357 - RNA, 21 nt, Artificial Sequence
  RNA Oligomer
uuucucaaagacaagcaaugu

SEQ ID NO: 26358 - RNA, 21 nt, Artificial Sequence
  RNA Oligomer
aaaaccauaguucagaaaucc

SEQ ID NO: 26359 - RNA, 21 nt, Artificial Sequence
  RNA Oligomer
cagugcaaggaaugauaagcc

SEQ ID NO: 26360 - RNA, 21 nt, Artificial Sequence
  RNA Oligomer
ucuuccaaaaucaccaguucc

SEQ ID NO: 26361 - RNA, 21 nt, Artificial Sequence
  RNA Oligomer
uccuucuugaguauugccugg

SEQ ID NO: 26362 - RNA, 21 nt, Artificial Sequence
  RNA Oligomer
aaauacauacagucucuugcu

SEQ ID NO: 26363 - RNA, 21 nt, Artificial Sequence
  RNA Oligomer
auacagucucuugcuuuucug

SEQ ID NO: 26364 - RNA, 21 nt, Artificial Sequence
  RNA Oligomer
uagaaaaacaagaagacacac

SEQ ID NO: 26365 - RNA, 21 nt, Artificial Sequence
  RNA Oligomer
aaacaagaagacacacagcac

SEQ ID NO: 26366 - RNA, 21 nt, Artificial Sequence
  RNA Oligomer
cacauuggaaauagcugcagg

SEQ ID NO: 26367 - RNA, 21 nt, Artificial Sequence
  RNA Oligomer
acaauauccaucacucuuugc

SEQ ID NO: 26368 - RNA, 21 nt, Artificial Sequence
  RNA Oligomer
aagguacucugcauuagauuc

SEQ ID NO: 26369 - RNA, 21 nt, Artificial Sequence
  RNA Oligomer
uuuugagguuguugcugaugu

SEQ ID NO: 26370 - RNA, 21 nt, Artificial Sequence
  RNA Oligomer
aaauauauuacguaaggccag

SEQ ID NO: 26371 - RNA, 21 nt, Artificial Sequence
  RNA Oligomer
auauuacguaaggccagauuc

SEQ ID NO: 26372 - RNA, 21 nt, Artificial Sequence
  RNA Oligomer
auugcuaugauuaugaugcca

SEQ ID NO: 26373 - RNA, 21 nt, Artificial Sequence
  RNA Oligomer
augauuaugaugccagacuuc

SEQ ID NO: 26374 - RNA, 21 nt, Artificial Sequence
  RNA Oligomer
uauucagucuuuccuauaccu

SEQ ID NO: 26375 - RNA, 21 nt, Artificial Sequence
  RNA Oligomer
uagaggaagaauuacaugcca

SEQ ID NO: 26376 - RNA, 21 nt, Artificial Sequence
  RNA Oligomer
uuuauguuugccuuuacuucc

SEQ ID NO: 26377 - RNA, 21 nt, Artificial Sequence
  RNA Oligomer
uuggauuuugcaagacauuag

SEQ ID NO: 26378 - RNA, 21 nt, Artificial Sequence
  RNA Oligomer
gauaaaaugguguucucuucc

SEQ ID NO: 26379 - RNA, 21 nt, Artificial Sequence
  RNA Oligomer
uuugaguuccuuucccagccc

SEQ ID NO: 26380 - RNA, 21 nt, Artificial Sequence
  RNA Oligomer
uacacauggcaugauuaggac

SEQ ID NO: 26381 - RNA, 21 nt, Artificial Sequence
  RNA Oligomer
aagccacauaugaaucacuga

SEQ ID NO: 26382 - RNA, 21 nt, Artificial Sequence
  RNA Oligomer
aucuuccaaaaucaccaguuc

SEQ ID NO: 26383 - RNA, 21 nt, Artificial Sequence
  RNA Oligomer
cuucuugaguauugccugggu

SEQ ID NO: 26384 - RNA, 21 nt, Artificial Sequence
  RNA Oligomer
aucgaauaggaaucacaagug

SEQ ID NO: 26385 - RNA, 21 nt, Artificial Sequence
  RNA Oligomer
uagaggacaugaaggaaggca

SEQ ID NO: 26386 - RNA, 21 nt, Artificial Sequence
  RNA Oligomer
aaaauacauacagucucuugc

SEQ ID NO: 26387 - RNA, 21 nt, Artificial Sequence
  RNA Oligomer
caaagcaagcaguguaagugc

SEQ ID NO: 26388 - RNA, 21 nt, Artificial Sequence
  RNA Oligomer
acgauuuggaauggaaauagc

SEQ ID NO: 26389 - RNA, 21 nt, Artificial Sequence
  RNA Oligomer
cgauuuggaauggaaauagcc

SEQ ID NO: 26390 - RNA, 21 nt, Artificial Sequence
  RNA Oligomer
gauuacgaacaauauccauca

SEQ ID NO: 26391 - RNA, 21 nt, Artificial Sequence
  RNA Oligomer
uuaaaugcuuuuaccacgugg

SEQ ID NO: 26392 - RNA, 21 nt, Artificial Sequence
  RNA Oligomer
ugcauuagauucuggauauug

SEQ ID NO: 26393 - RNA, 21 nt, Artificial Sequence
  RNA Oligomer
uuuauaaaagccaucaucccu

SEQ ID NO: 26394 - RNA, 21 nt, Artificial Sequence
  RNA Oligomer
uauaaaagccaucaucccuua

SEQ ID NO: 26395 - RNA, 21 nt, Artificial Sequence
  RNA Oligomer
auaaaagccaucaucccuuaa

SEQ ID NO: 26396 - RNA, 21 nt, Artificial Sequence
  RNA Oligomer
aucagcaguaaagaaguuuag

SEQ ID NO: 26397 - RNA, 21 nt, Artificial Sequence
  RNA Oligomer
uaguuuggaucuguuaaaagg

SEQ ID NO: 26398 - RNA, 21 nt, Artificial Sequence
  RNA Oligomer
aaaggucaggucuggaaaugc

SEQ ID NO: 26399 - RNA, 21 nt, Artificial Sequence
  RNA Oligomer
auuaugccaaaaccaucagag

SEQ ID NO: 26400 - RNA, 21 nt, Artificial Sequence
  RNA Oligomer
guuaacuccaaagacuucucu

SEQ ID NO: 26401 - RNA, 21 nt, Artificial Sequence
  RNA Oligomer
gcaaccaguuauaaauaaacg

SEQ ID NO: 26402 - RNA, 21 nt, Artificial Sequence
  RNA Oligomer
aaaagacaaucuacaauggug

SEQ ID NO: 26403 - RNA, 21 nt, Artificial Sequence
  RNA Oligomer
agcaacacccucauccaaugg

SEQ ID NO: 26404 - RNA, 21 nt, Artificial Sequence
  RNA Oligomer
acagaaaaacagugagaacca

SEQ ID NO: 26405 - RNA, 21 nt, Artificial Sequence
  RNA Oligomer
agaaccauccuaaauuucagc

SEQ ID NO: 26406 - RNA, 21 nt, Artificial Sequence
  RNA Oligomer
uaaugaugaaucuucacaccu

SEQ ID NO: 26407 - RNA, 21 nt, Artificial Sequence
  RNA Oligomer
ucgaucaucuaugcauuguuc

SEQ ID NO: 26408 - RNA, 21 nt, Artificial Sequence
  RNA Oligomer
gaagcuacuuauuuacacuag

SEQ ID NO: 26409 - RNA, 21 nt, Artificial Sequence
  RNA Oligomer
gaucaagaacuuuuaucaacc

SEQ ID NO: 26410 - RNA, 21 nt, Artificial Sequence
  RNA Oligomer
acuuuuaucaacccuucuuug

SEQ ID NO: 26411 - RNA, 21 nt, Artificial Sequence
  RNA Oligomer
cuuuuaucaacccuucuuugc

SEQ ID NO: 26412 - RNA, 21 nt, Artificial Sequence
  RNA Oligomer
aauuacaugccagcucuauag

SEQ ID NO: 26413 - RNA, 21 nt, Artificial Sequence
  RNA Oligomer
auuacaugccagcucuauaga

SEQ ID NO: 26414 - RNA, 21 nt, Artificial Sequence
  RNA Oligomer
cagauauaccuaauaaagccu

SEQ ID NO: 26415 - RNA, 21 nt, Artificial Sequence
  RNA Oligomer
ucaagacuucugcaccacugg

SEQ ID NO: 26416 - RNA, 21 nt, Artificial Sequence
  RNA Oligomer
cacuaaccugagauaaaaugg

SEQ ID NO: 26417 - RNA, 21 nt, Artificial Sequence
  RNA Oligomer
uuucuaguguuuugaguuccu

SEQ ID NO: 26418 - RNA, 21 nt, Artificial Sequence
  RNA Oligomer
augauaagcccuaacacguag

SEQ ID NO: 26419 - RNA, 21 nt, Artificial Sequence
  RNA Oligomer
aaagccacauaugaaucacug

SEQ ID NO: 26420 - RNA, 21 nt, Artificial Sequence
  RNA Oligomer
accaguuccaaaaauacauac

SEQ ID NO: 26421 - RNA, 21 nt, Artificial Sequence
  RNA Oligomer
acauacagucucuugcuuuuc

SEQ ID NO: 26422 - RNA, 21 nt, Artificial Sequence
  RNA Oligomer
aacauaaggguagauuacguc

SEQ ID NO: 26423 - RNA, 21 nt, Artificial Sequence
  RNA Oligomer
caagauuacgaacaauaucca

SEQ ID NO: 26424 - RNA, 21 nt, Artificial Sequence
  RNA Oligomer
aacaauauccaucacucuuug

SEQ ID NO: 26425 - RNA, 21 nt, Artificial Sequence
  RNA Oligomer
caucuguuguaaacucauucu

SEQ ID NO: 26426 - RNA, 21 nt, Artificial Sequence
  RNA Oligomer
uguaaacucauucuuucuacc

SEQ ID NO: 26427 - RNA, 21 nt, Artificial Sequence
  RNA Oligomer
guaaacucauucuuucuaccu

SEQ ID NO: 26428 - RNA, 21 nt, Artificial Sequence
  RNA Oligomer
cuuucuaccuuaaguaaacug

SEQ ID NO: 26429 - RNA, 21 nt, Artificial Sequence
  RNA Oligomer
uauuaugccaaaaccaucaga

SEQ ID NO: 26430 - RNA, 21 nt, Artificial Sequence
  RNA Oligomer
aacauaggugaguagugacau

SEQ ID NO: 26431 - RNA, 21 nt, Artificial Sequence
  RNA Oligomer
auaggugaguagugacauuuu

SEQ ID NO: 26432 - RNA, 21 nt, Artificial Sequence
  RNA Oligomer
uaggugaguagugacauuuuc

SEQ ID NO: 26433 - RNA, 21 nt, Artificial Sequence
  RNA Oligomer
augucguccaacuuuuuguau

SEQ ID NO: 26434 - RNA, 21 nt, Artificial Sequence
  RNA Oligomer
cagugcaaagauauuaucuga

SEQ ID NO: 26435 - RNA, 21 nt, Artificial Sequence
  RNA Oligomer
uuuugauaugugggaagauca

SEQ ID NO: 26436 - RNA, 21 nt, Artificial Sequence
  RNA Oligomer
uugcuaugauuaugaugccag

SEQ ID NO: 26437 - RNA, 21 nt, Artificial Sequence
  RNA Oligomer
gugagaaccauccuaaauuuc

SEQ ID NO: 26438 - RNA, 21 nt, Artificial Sequence
  RNA Oligomer
uuccguaauuuucgaucaucu

SEQ ID NO: 26439 - RNA, 21 nt, Artificial Sequence
  RNA Oligomer
uuucgaucaucuaugcauugu

SEQ ID NO: 26440 - RNA, 21 nt, Artificial Sequence
  RNA Oligomer
acuaagacagauauagaagcu

SEQ ID NO: 26441 - RNA, 21 nt, Artificial Sequence
  RNA Oligomer
uucuuggcugcuucugaauag

SEQ ID NO: 26442 - RNA, 21 nt, Artificial Sequence
  RNA Oligomer
aucccuccauuuuuauucagu

SEQ ID NO: 26443 - RNA, 21 nt, Artificial Sequence
  RNA Oligomer
gaagaauuacaugccagcucu

SEQ ID NO: 26444 - RNA, 21 nt, Artificial Sequence
  RNA Oligomer
aagaauuacaugccagcucua

SEQ ID NO: 26445 - RNA, 21 nt, Artificial Sequence
  RNA Oligomer
augccagcucuauagauacgu

SEQ ID NO: 26446 - RNA, 21 nt, Artificial Sequence
  RNA Oligomer
aguuccucucaguaaauaucu

SEQ ID NO: 26447 - RNA, 21 nt, Artificial Sequence
  RNA Oligomer
ucagauauaccuaauaaagcc

SEQ ID NO: 26448 - RNA, 21 nt, Artificial Sequence
  RNA Oligomer
uuccuuucacuuaacucagcc

SEQ ID NO: 26449 - RNA, 21 nt, Artificial Sequence
  RNA Oligomer
ggauuuugcaagacauuaggu

SEQ ID NO: 26450 - RNA, 21 nt, Artificial Sequence
  RNA Oligomer
aguaugucagucaauuucuca

SEQ ID NO: 26451 - RNA, 21 nt, Artificial Sequence
  RNA Oligomer
aauguuucccucagucacggu

SEQ ID NO: 26452 - RNA, 21 nt, Artificial Sequence
  RNA Oligomer
accauaguucagaaauccagc

SEQ ID NO: 26453 - RNA, 21 nt, Artificial Sequence
  RNA Oligomer
aggacaaacuugaucaccagc

SEQ ID NO: 26454 - RNA, 21 nt, Artificial Sequence
  RNA Oligomer
aucucuucccaccguacacca

SEQ ID NO: 26455 - RNA, 21 nt, Artificial Sequence
  RNA Oligomer
aacccaaguauucccaaagcc

SEQ ID NO: 26456 - RNA, 21 nt, Artificial Sequence
  RNA Oligomer
ccuucuugaguauugccuggg

SEQ ID NO: 26457 - RNA, 21 nt, Artificial Sequence
  RNA Oligomer
aaguuucccaaucuccaucgu

SEQ ID NO: 26458 - RNA, 21 nt, Artificial Sequence
  RNA Oligomer
ucgaauaggaaucacaagugu

SEQ ID NO: 26459 - RNA, 21 nt, Artificial Sequence
  RNA Oligomer
aaucaccaguuccaaaaauac

SEQ ID NO: 26460 - RNA, 21 nt, Artificial Sequence
  RNA Oligomer
caguuccaaaaauacauacag

SEQ ID NO: 26461 - RNA, 21 nt, Artificial Sequence
  RNA Oligomer
acauaaggguagauuacgucu

SEQ ID NO: 26462 - RNA, 21 nt, Artificial Sequence
  RNA Oligomer
cacagcagacaaauagaaggg

SEQ ID NO: 26463 - RNA, 21 nt, Artificial Sequence
  RNA Oligomer
uaaguccaagauuacgaacaa

SEQ ID NO: 26464 - RNA, 21 nt, Artificial Sequence
  RNA Oligomer
ggauauugauugauuuugagg

SEQ ID NO: 26465 - RNA, 21 nt, Artificial Sequence
  RNA Oligomer
cuauuaugccaaaaccaucag

SEQ ID NO: 26466 - RNA, 21 nt, Artificial Sequence
  RNA Oligomer
cauuuuuuucuauaggucagc

SEQ ID NO: 26467 - RNA, 21 nt, Artificial Sequence
  RNA Oligomer
ucuauaggucagcauuuuacc

SEQ ID NO: 26468 - RNA, 21 nt, Artificial Sequence
  RNA Oligomer
aacuccaaagacuucucuaga

SEQ ID NO: 26469 - RNA, 21 nt, Artificial Sequence
  RNA Oligomer
aaagacuucucuagaccagcc

SEQ ID NO: 26470 - RNA, 21 nt, Artificial Sequence
  RNA Oligomer
uuuccuuaucuuuuccacuga

SEQ ID NO: 26471 - RNA, 21 nt, Artificial Sequence
  RNA Oligomer
aaugucguccaacuuuuugua

SEQ ID NO: 26472 - RNA, 21 nt, Artificial Sequence
  RNA Oligomer
uccaacuuuuuguauccuugc

SEQ ID NO: 26473 - RNA, 21 nt, Artificial Sequence
  RNA Oligomer
uauuacguaaggccagauuca

SEQ ID NO: 26474 - RNA, 21 nt, Artificial Sequence
  RNA Oligomer
ugggaagaucaugcauaaggc

SEQ ID NO: 26475 - RNA, 21 nt, Artificial Sequence
  RNA Oligomer
aaaggguacuaucagcacaga

SEQ ID NO: 26476 - RNA, 21 nt, Artificial Sequence
  RNA Oligomer
cacauaaugaugaaucuucac

SEQ ID NO: 26477 - RNA, 21 nt, Artificial Sequence
  RNA Oligomer
cauaaugaugaaucuucacac

SEQ ID NO: 26478 - RNA, 21 nt, Artificial Sequence
  RNA Oligomer
gcuugcugucuaaaauucugg

SEQ ID NO: 26479 - RNA, 21 nt, Artificial Sequence
  RNA Oligomer
ucaagaacuuuuaucaacccu

SEQ ID NO: 26480 - RNA, 21 nt, Artificial Sequence
  RNA Oligomer
agaacuuuuaucaacccuucu

SEQ ID NO: 26481 - RNA, 21 nt, Artificial Sequence
  RNA Oligomer
uuuuccuuucacuuaacucag

SEQ ID NO: 26482 - RNA, 21 nt, Artificial Sequence
  RNA Oligomer
acaaggcuagucucaaucuca

SEQ ID NO: 26483 - RNA, 21 nt, Artificial Sequence
  RNA Oligomer
augucagucaauuucucaaag

SEQ ID NO: 26484 - RNA, 21 nt, Artificial Sequence
  RNA Oligomer
aaaccauaguucagaaaucca

SEQ ID NO: 26485 - RNA, 21 nt, Artificial Sequence
  RNA Oligomer
uuuugaguuccuuucccagcc

SEQ ID NO: 26486 - RNA, 21 nt, Artificial Sequence
  RNA Oligomer
gaagauaccaucugagauuug

SEQ ID NO: 26487 - RNA, 21 nt, Artificial Sequence
  RNA Oligomer
aucugagauuugaagggcuga

SEQ ID NO: 26488 - RNA, 21 nt, Artificial Sequence
  RNA Oligomer
auuugaagggcugaggaaucu

SEQ ID NO: 26489 - RNA, 21 nt, Artificial Sequence
  RNA Oligomer
uucaaucccagugaucuucca

SEQ ID NO: 26490 - RNA, 21 nt, Artificial Sequence
  RNA Oligomer
aaacccaaguauucccaaagc

SEQ ID NO: 26491 - RNA, 21 nt, Artificial Sequence
  RNA Oligomer
ccacauaugaaucacugagcc

SEQ ID NO: 26492 - RNA, 21 nt, Artificial Sequence
  RNA Oligomer
cacauaugaaucacugagcca

SEQ ID NO: 26493 - RNA, 21 nt, Artificial Sequence
  RNA Oligomer
uuccaaaaucaccaguuccaa

SEQ ID NO: 26494 - RNA, 21 nt, Artificial Sequence
  RNA Oligomer
aaagcauccaguggucaagcc

SEQ ID NO: 26495 - RNA, 21 nt, Artificial Sequence
  RNA Oligomer
uaagugcuguuauuggaaaga

SEQ ID NO: 26496 - RNA, 21 nt, Artificial Sequence
  RNA Oligomer
gaaagauacgauuuggaaugg

SEQ ID NO: 26497 - RNA, 21 nt, Artificial Sequence
  RNA Oligomer
aaagauacgauuuggaaugga

SEQ ID NO: 26498 - RNA, 21 nt, Artificial Sequence
  RNA Oligomer
uaaacauaaggguagauuacg

SEQ ID NO: 26499 - RNA, 21 nt, Artificial Sequence
  RNA Oligomer
agauuacgucucuuauaacac

SEQ ID NO: 26500 - RNA, 21 nt, Artificial Sequence
  RNA Oligomer
gaaaaacaagaagacacacag

SEQ ID NO: 26501 - RNA, 21 nt, Artificial Sequence
  RNA Oligomer
aaaacaagaagacacacagca

SEQ ID NO: 26502 - RNA, 21 nt, Artificial Sequence
  RNA Oligomer
ugaagaauucauaguaagagg

SEQ ID NO: 26503 - RNA, 21 nt, Artificial Sequence
  RNA Oligomer
uacgaacaauauccaucacuc

SEQ ID NO: 26504 - RNA, 21 nt, Artificial Sequence
  RNA Oligomer
acgaacaauauccaucacucu

SEQ ID NO: 26505 - RNA, 21 nt, Artificial Sequence
  RNA Oligomer
uuaacuccaaagacuucucua

SEQ ID NO: 26506 - RNA, 21 nt, Artificial Sequence
  RNA Oligomer
uaacuccaaagacuucucuag

SEQ ID NO: 26507 - RNA, 21 nt, Artificial Sequence
  RNA Oligomer
aagacuucucuagaccagccu

SEQ ID NO: 26508 - RNA, 21 nt, Artificial Sequence
  RNA Oligomer
aaguaaaagagcaguauccag

SEQ ID NO: 26509 - RNA, 21 nt, Artificial Sequence
  RNA Oligomer
uuugcauaacauaggugagua

SEQ ID NO: 26510 - RNA, 21 nt, Artificial Sequence
  RNA Oligomer
gucguccaacuuuuuguaucc

SEQ ID NO: 26511 - RNA, 21 nt, Artificial Sequence
  RNA Oligomer
augaaagcaacacccucaucc

SEQ ID NO: 26512 - RNA, 21 nt, Artificial Sequence
  RNA Oligomer
auauauuacguaaggccagau

SEQ ID NO: 26513 - RNA, 21 nt, Artificial Sequence
  RNA Oligomer
gaaccauccuaaauuucagca

SEQ ID NO: 26514 - RNA, 21 nt, Artificial Sequence
  RNA Oligomer
augaugaaucuucacaccucu

SEQ ID NO: 26515 - RNA, 21 nt, Artificial Sequence
  RNA Oligomer
uuuccguaauuuucgaucauc

SEQ ID NO: 26516 - RNA, 21 nt, Artificial Sequence
  RNA Oligomer
uucaaauuuauaccugcagac

SEQ ID NO: 26517 - RNA, 21 nt, Artificial Sequence
  RNA Oligomer
auuuauaccugcagacuauuc

SEQ ID NO: 26518 - RNA, 21 nt, Artificial Sequence
  RNA Oligomer
uuuauaccugcagacuauuca

SEQ ID NO: 26519 - RNA, 21 nt, Artificial Sequence
  RNA Oligomer
uuauaccugcagacuauucau

SEQ ID NO: 26520 - RNA, 21 nt, Artificial Sequence
  RNA Oligomer
agacuaagacagauauagaag

SEQ ID NO: 26521 - RNA, 21 nt, Artificial Sequence
  RNA Oligomer
uuuuaucaacccuucuuugcu

SEQ ID NO: 26522 - RNA, 21 nt, Artificial Sequence
  RNA Oligomer
auucagucuuuccuauaccua

SEQ ID NO: 26523 - RNA, 21 nt, Artificial Sequence
  RNA Oligomer
aggaagaauuacaugccagcu

SEQ ID NO: 26524 - RNA, 21 nt, Artificial Sequence
  RNA Oligomer
uucacuuaacucagcccuuga

SEQ ID NO: 26525 - RNA, 21 nt, Artificial Sequence
  RNA Oligomer
ugggaaaauaagagucaggga

SEQ ID NO: 26526 - RNA, 21 nt, Artificial Sequence
  RNA Oligomer
ucaauuucucaaagacaagca

SEQ ID NO: 26527 - RNA, 21 nt, Artificial Sequence
  RNA Oligomer
aguguuuugaguuccuuuccc

SEQ ID NO: 26528 - RNA, 21 nt, Artificial Sequence
  RNA Oligomer
uguuuugaguuccuuucccag

SEQ ID NO: 26529 - RNA, 21 nt, Artificial Sequence
  RNA Oligomer
gacaaacuugaucaccagcac

SEQ ID NO: 26530 - RNA, 21 nt, Artificial Sequence
  RNA Oligomer
uuuucaaucccagugaucuuc

SEQ ID NO: 26531 - RNA, 21 nt, Artificial Sequence
  RNA Oligomer
uauucccaaagccacauauga

SEQ ID NO: 26532 - RNA, 21 nt, Artificial Sequence
  RNA Oligomer
auaucgaauaggaaucacaag

SEQ ID NO: 26533 - RNA, 21 nt, Artificial Sequence
  RNA Oligomer
auacauacagucucuugcuuu

SEQ ID NO: 26534 - RNA, 21 nt, Artificial Sequence
  RNA Oligomer
aagugcuguuauuggaaagau

SEQ ID NO: 26535 - RNA, 21 nt, Artificial Sequence
  RNA Oligomer
uuacgaacaauauccaucacu

SEQ ID NO: 26536 - RNA, 21 nt, Artificial Sequence
  RNA Oligomer
aauauccaucacucuuugcuu

SEQ ID NO: 26537 - RNA, 21 nt, Artificial Sequence
  RNA Oligomer
aauucauaguaagaggaagug

SEQ ID NO: 26538 - RNA, 21 nt, Artificial Sequence
  RNA Oligomer
gaugguguuaaaugcuuuuac

SEQ ID NO: 26539 - RNA, 21 nt, Artificial Sequence
  RNA Oligomer
aaaagccaucaucccuuaaca

SEQ ID NO: 26540 - RNA, 21 nt, Artificial Sequence
  RNA Oligomer
aauacaggaaacauaucagca

SEQ ID NO: 26541 - RNA, 21 nt, Artificial Sequence
  RNA Oligomer
uuaugccaaaaccaucagagu

SEQ ID NO: 26542 - RNA, 21 nt, Artificial Sequence
  RNA Oligomer
acuaugagccaggauaaacac

SEQ ID NO: 26543 - RNA, 21 nt, Artificial Sequence
  RNA Oligomer
aacuuuaaucaaccaaugcuc

SEQ ID NO: 26544 - RNA, 21 nt, Artificial Sequence
  RNA Oligomer
acuuuaaucaaccaaugcuca

SEQ ID NO: 26545 - RNA, 21 nt, Artificial Sequence
  RNA Oligomer
uuaaucaaccaaugcucaagu

SEQ ID NO: 26546 - RNA, 21 nt, Artificial Sequence
  RNA Oligomer
uaaucaaccaaugcucaagua

SEQ ID NO: 26547 - RNA, 21 nt, Artificial Sequence
  RNA Oligomer
ucaaguaaaagagcaguaucc

SEQ ID NO: 26548 - RNA, 21 nt, Artificial Sequence
  RNA Oligomer
caaguaaaagagcaguaucca

SEQ ID NO: 26549 - RNA, 21 nt, Artificial Sequence
  RNA Oligomer
ucuuuuccacugauacuguag

SEQ ID NO: 26550 - RNA, 21 nt, Artificial Sequence
  RNA Oligomer
ucaaugucguccaacuuuuug

SEQ ID NO: 26551 - RNA, 21 nt, Artificial Sequence
  RNA Oligomer
uaccuuugcaaccaguuauaa

SEQ ID NO: 26552 - RNA, 21 nt, Artificial Sequence
  RNA Oligomer
uggauugcuaugauuaugaug

SEQ ID NO: 26553 - RNA, 21 nt, Artificial Sequence
  RNA Oligomer
aaaaaugccaaacucagugcc

SEQ ID NO: 26554 - RNA, 21 nt, Artificial Sequence
  RNA Oligomer
uaugauuaugaugccagacuu

SEQ ID NO: 26555 - RNA, 21 nt, Artificial Sequence
  RNA Oligomer
gaaaaacagugagaaccaucc

SEQ ID NO: 26556 - RNA, 21 nt, Artificial Sequence
  RNA Oligomer
aaccauccuaaauuucagcaa

SEQ ID NO: 26557 - RNA, 21 nt, Artificial Sequence
  RNA Oligomer
acaugccagcucuauagauac

SEQ ID NO: 26558 - RNA, 21 nt, Artificial Sequence
  RNA Oligomer
uucuaguguuuugaguuccuu

SEQ ID NO: 26559 - RNA, 21 nt, Artificial Sequence
  RNA Oligomer
guguuuugaguuccuuuccca

SEQ ID NO: 26560 - RNA, 21 nt, Artificial Sequence
  RNA Oligomer
acacauggcaugauuaggaca

SEQ ID NO: 26561 - RNA, 21 nt, Artificial Sequence
  RNA Oligomer
gagcauuuucaaucccaguga

SEQ ID NO: 26562 - RNA, 21 nt, Artificial Sequence
  RNA Oligomer
ugagauuugaagggcugagga

SEQ ID NO: 26563 - RNA, 21 nt, Artificial Sequence
  RNA Oligomer
aaucucuucccaccguacacc

SEQ ID NO: 26564 - RNA, 21 nt, Artificial Sequence
  RNA Oligomer
gaggaggugcuaaauggauuc

SEQ ID NO: 26565 - RNA, 21 nt, Artificial Sequence
  RNA Oligomer
caaagcauccaguggucaagc

SEQ ID NO: 26566 - RNA, 21 nt, Artificial Sequence
  RNA Oligomer
guuccaaaaauacauacaguc

SEQ ID NO: 26567 - RNA, 21 nt, Artificial Sequence
  RNA Oligomer
ccaaaaauacauacagucucu

SEQ ID NO: 26568 - RNA, 21 nt, Artificial Sequence
  RNA Oligomer
cucgguacaguuguagaaugg

SEQ ID NO: 26569 - RNA, 21 nt, Artificial Sequence
  RNA Oligomer
uagaauggcagcaauaacacc

SEQ ID NO: 26570 - RNA, 21 nt, Artificial Sequence
  RNA Oligomer
aaccaaagcaagcaguguaag

SEQ ID NO: 26571 - RNA, 21 nt, Artificial Sequence
  RNA Oligomer
uuggaaagauacgauuuggaa

SEQ ID NO: 26572 - RNA, 21 nt, Artificial Sequence
  RNA Oligomer
aaacauaaggguagauuacgu

SEQ ID NO: 26573 - RNA, 21 nt, Artificial Sequence
  RNA Oligomer
gcuuuucugaagaauucauag

SEQ ID NO: 26574 - RNA, 21 nt, Artificial Sequence
  RNA Oligomer
gaagaauucauaguaagagga

SEQ ID NO: 26575 - RNA, 21 nt, Artificial Sequence
  RNA Oligomer
auauccaucacucuuugcuug

SEQ ID NO: 26576 - RNA, 21 nt, Artificial Sequence
  RNA Oligomer
auuuccacacacaaacaccug

SEQ ID NO: 26577 - RNA, 21 nt, Artificial Sequence
  RNA Oligomer
uuccacacacaaacaccugcc

SEQ ID NO: 26578 - RNA, 21 nt, Artificial Sequence
  RNA Oligomer
aaagccaucaucccuuaacau

SEQ ID NO: 26579 - RNA, 21 nt, Artificial Sequence
  RNA Oligomer
uuaaaaggaauacaguucgcc

SEQ ID NO: 26580 - RNA, 21 nt, Artificial Sequence
  RNA Oligomer
uaaaaggaauacaguucgccc

SEQ ID NO: 26581 - RNA, 21 nt, Artificial Sequence
  RNA Oligomer
augccaaaaccaucagagugc

SEQ ID NO: 26582 - RNA, 21 nt, Artificial Sequence
  RNA Oligomer
uucuauaggucagcauuuuac

SEQ ID NO: 26583 - RNA, 21 nt, Artificial Sequence
  RNA Oligomer
auggcauuuucuauuuucggu

SEQ ID NO: 26584 - RNA, 21 nt, Artificial Sequence
  RNA Oligomer
aaaaucauaaugcucucugug

SEQ ID NO: 26585 - RNA, 21 nt, Artificial Sequence
  RNA Oligomer
ggaaagagguuugaaaaaugc

SEQ ID NO: 26586 - RNA, 21 nt, Artificial Sequence
  RNA Oligomer
auuaugaugccagacuucuug

SEQ ID NO: 26587 - RNA, 21 nt, Artificial Sequence
  RNA Oligomer
ucucugcccuaugauuuuccg

SEQ ID NO: 26588 - RNA, 21 nt, Artificial Sequence
  RNA Oligomer
auaccugcagacuauucauuu

SEQ ID NO: 26589 - RNA, 21 nt, Artificial Sequence
  RNA Oligomer
gacuaagacagauauagaagc

SEQ ID NO: 26590 - RNA, 21 nt, Artificial Sequence
  RNA Oligomer
cuugcugucuaaaauucuggu

SEQ ID NO: 26591 - RNA, 21 nt, Artificial Sequence
  RNA Oligomer
uugcugucuaaaauucugguu

SEQ ID NO: 26592 - RNA, 21 nt, Artificial Sequence
  RNA Oligomer
agaggaagaauuacaugccag

SEQ ID NO: 26593 - RNA, 21 nt, Artificial Sequence
  RNA Oligomer
gaggaagaauuacaugccagc

SEQ ID NO: 26594 - RNA, 21 nt, Artificial Sequence
  RNA Oligomer
auuucaugugacccacuuccu

SEQ ID NO: 26595 - RNA, 21 nt, Artificial Sequence
  RNA Oligomer
cucagauauaccuaauaaagc

SEQ ID NO: 26596 - RNA, 21 nt, Artificial Sequence
  RNA Oligomer
uccuuucacuuaacucagccc

SEQ ID NO: 26597 - RNA, 21 nt, Artificial Sequence
  RNA Oligomer
uuucacuuaacucagcccuug

SEQ ID NO: 26598 - RNA, 21 nt, Artificial Sequence
  RNA Oligomer
gaaacucuuuagugugaaacc

SEQ ID NO: 26599 - RNA, 21 nt, Artificial Sequence
  RNA Oligomer
aaacucuuuagugugaaacca

SEQ ID NO: 26600 - RNA, 21 nt, Artificial Sequence
  RNA Oligomer
uuccaguaugucagucaauuu

SEQ ID NO: 26601 - RNA, 21 nt, Artificial Sequence
  RNA Oligomer
aagcaauguuucccucaguca

SEQ ID NO: 26602 - RNA, 21 nt, Artificial Sequence
  RNA Oligomer
aaccauaguucagaaauccag

SEQ ID NO: 26603 - RNA, 21 nt, Artificial Sequence
  RNA Oligomer
uugaguuccuuucccagcccu

SEQ ID NO: 26604 - RNA, 21 nt, Artificial Sequence
  RNA Oligomer
aagauaccaucugagauuuga

SEQ ID NO: 26605 - RNA, 21 nt, Artificial Sequence
  RNA Oligomer
aaaccaaagcaagcaguguaa

SEQ ID NO: 26606 - RNA, 21 nt, Artificial Sequence
  RNA Oligomer
agccauacgaaauguauuauc

SEQ ID NO: 26607 - RNA, 21 nt, Artificial Sequence
  RNA Oligomer
acgucucuuauaacacaauag

SEQ ID NO: 26608 - RNA, 21 nt, Artificial Sequence
  RNA Oligomer
acaagaagacacacagcacag

SEQ ID NO: 26609 - RNA, 21 nt, Artificial Sequence
  RNA Oligomer
gaaccuccacauuggaaauag

SEQ ID NO: 26610 - RNA, 21 nt, Artificial Sequence
  RNA Oligomer
acauuggaaauagcugcaggg

SEQ ID NO: 26611 - RNA, 21 nt, Artificial Sequence
  RNA Oligomer
uguuaaaugcuuuuaccacgu

SEQ ID NO: 26612 - RNA, 21 nt, Artificial Sequence
  RNA Oligomer
gaauacaggaaacauaucagc

SEQ ID NO: 26613 - RNA, 21 nt, Artificial Sequence
  RNA Oligomer
ucagcaguaaagaaguuuagu

SEQ ID NO: 26614 - RNA, 21 nt, Artificial Sequence
  RNA Oligomer
uaagaggaagugcaucuauac

SEQ ID NO: 26615 - RNA, 21 nt, Artificial Sequence
  RNA Oligomer
uggcauuuucuauuuucggug

SEQ ID NO: 26616 - RNA, 21 nt, Artificial Sequence
  RNA Oligomer
cuuuaacaaaaagagcauggu

SEQ ID NO: 26617 - RNA, 21 nt, Artificial Sequence
  RNA Oligomer
agacuucucuagaccagccug

SEQ ID NO: 26618 - RNA, 21 nt, Artificial Sequence
  RNA Oligomer
uuuuccuuaucuuuuccacug

SEQ ID NO: 26619 - RNA, 21 nt, Artificial Sequence
  RNA Oligomer
ugaaagcaacacccucaucca

SEQ ID NO: 26620 - RNA, 21 nt, Artificial Sequence
  RNA Oligomer
gccuuuagaaaaacaaagccu

SEQ ID NO: 26621 - RNA, 21 nt, Artificial Sequence
  RNA Oligomer
aaugaugaaucuucacaccuc

SEQ ID NO: 26622 - RNA, 21 nt, Artificial Sequence
  RNA Oligomer
cucucugcccuaugauuuucc

SEQ ID NO: 26623 - RNA, 21 nt, Artificial Sequence
  RNA Oligomer
gauuuuccguaauuuucgauc

SEQ ID NO: 26624 - RNA, 21 nt, Artificial Sequence
  RNA Oligomer
uguucaaauuuauaccugcag

SEQ ID NO: 26625 - RNA, 21 nt, Artificial Sequence
  RNA Oligomer
uaucccuccauuuuuauucag

SEQ ID NO: 26626 - RNA, 21 nt, Artificial Sequence
  RNA Oligomer
uuauguuugccuuuacuucca

SEQ ID NO: 26627 - RNA, 21 nt, Artificial Sequence
  RNA Oligomer
uuuccuuucacuuaacucagc

SEQ ID NO: 26628 - RNA, 21 nt, Artificial Sequence
  RNA Oligomer
ccaguaugucagucaauuucu

SEQ ID NO: 26629 - RNA, 21 nt, Artificial Sequence
  RNA Oligomer
uguuucccucagucacggugu

SEQ ID NO: 26630 - RNA, 21 nt, Artificial Sequence
  RNA Oligomer
aaacuuuccuaacuguaccca

SEQ ID NO: 26631 - RNA, 21 nt, Artificial Sequence
  RNA Oligomer
caucugagauuugaagggcug

SEQ ID NO: 26632 - RNA, 21 nt, Artificial Sequence
  RNA Oligomer
uucuccuucuugaguauugcc

SEQ ID NO: 26633 - RNA, 21 nt, Artificial Sequence
  RNA Oligomer
aggaaucacaaguguguagag

SEQ ID NO: 26634 - RNA, 21 nt, Artificial Sequence
  RNA Oligomer
guagaauggcagcaauaacac

SEQ ID NO: 26635 - RNA, 21 nt, Artificial Sequence
  RNA Oligomer
gccauacgaaauguauuaucu

SEQ ID NO: 26636 - RNA, 21 nt, Artificial Sequence
  RNA Oligomer
uuugcugucauuuccacacac

SEQ ID NO: 26637 - RNA, 21 nt, Artificial Sequence
  RNA Oligomer
uuuccacacacaaacaccugc

SEQ ID NO: 26638 - RNA, 21 nt, Artificial Sequence
  RNA Oligomer
guuaaaugcuuuuaccacgug

SEQ ID NO: 26639 - RNA, 21 nt, Artificial Sequence
  RNA Oligomer
auuuugagguuguugcugaug

SEQ ID NO: 26640 - RNA, 21 nt, Artificial Sequence
  RNA Oligomer
caaagcacuuauuuucaucug

SEQ ID NO: 26641 - RNA, 21 nt, Artificial Sequence
  RNA Oligomer
agcacuuauuuucaucuguug

SEQ ID NO: 26642 - RNA, 21 nt, Artificial Sequence
  RNA Oligomer
uaugccaaaaccaucagagug

SEQ ID NO: 26643 - RNA, 21 nt, Artificial Sequence
  RNA Oligomer
caggauaaacacauuacucuc

SEQ ID NO: 26644 - RNA, 21 nt, Artificial Sequence
  RNA Oligomer
gauaaacacauuacucucuuc

SEQ ID NO: 26645 - RNA, 21 nt, Artificial Sequence
  RNA Oligomer
caaaaagagcaugguuaacuc

SEQ ID NO: 26646 - RNA, 21 nt, Artificial Sequence
  RNA Oligomer
agaaaaucauaaugcucucug

SEQ ID NO: 26647 - RNA, 21 nt, Artificial Sequence
  RNA Oligomer
gaaaaucauaaugcucucugu

SEQ ID NO: 26648 - RNA, 21 nt, Artificial Sequence
  RNA Oligomer
auaccaugacucuacucaaug

SEQ ID NO: 26649 - RNA, 21 nt, Artificial Sequence
  RNA Oligomer
uaccaugacucuacucaaugu

SEQ ID NO: 26650 - RNA, 21 nt, Artificial Sequence
  RNA Oligomer
ucguccaacuuuuuguauccu

SEQ ID NO: 26651 - RNA, 21 nt, Artificial Sequence
  RNA Oligomer
cauguuuaauaaggaaagagg

SEQ ID NO: 26652 - RNA, 21 nt, Artificial Sequence
  RNA Oligomer
gugcaucuauacaaguuuucu

SEQ ID NO: 26653 - RNA, 21 nt, Artificial Sequence
  RNA Oligomer
cucauucccuuuuuacauuuc

SEQ ID NO: 26654 - RNA, 21 nt, Artificial Sequence
  RNA Oligomer
uucaugugacccacuuccuca

SEQ ID NO: 26655 - RNA, 21 nt, Artificial Sequence
  RNA Oligomer
guuuuuccuuucacuuaacuc

SEQ ID NO: 26656 - RNA, 21 nt, Artificial Sequence
  RNA Oligomer
uccaaaaacaacagaauaacc

SEQ ID NO: 26657 - RNA, 21 nt, Artificial Sequence
  RNA Oligomer
aaaacaacagaauaaccacac

SEQ ID NO: 26658 - RNA, 21 nt, Artificial Sequence
  RNA Oligomer
caauguuucccucagucacgg

SEQ ID NO: 26659 - RNA, 21 nt, Artificial Sequence
  RNA Oligomer
cugcaggaagauaccaucuga

SEQ ID NO: 26660 - RNA, 21 nt, Artificial Sequence
  RNA Oligomer
aaaacccaaguauucccaaag

SEQ ID NO: 26661 - RNA, 21 nt, Artificial Sequence
  RNA Oligomer
aagauacgauuuggaauggaa

SEQ ID NO: 26662 - RNA, 21 nt, Artificial Sequence
  RNA Oligomer
agcacagcagacaaauagaag

SEQ ID NO: 26663 - RNA, 21 nt, Artificial Sequence
  RNA Oligomer
auacaggaaacauaucagcag

SEQ ID NO: 26664 - RNA, 21 nt, Artificial Sequence
  RNA Oligomer
guuaaaaggaauacaguucgc

SEQ ID NO: 26665 - RNA, 21 nt, Artificial Sequence
  RNA Oligomer
aaaaggaauacaguucgccca

SEQ ID NO: 26666 - RNA, 21 nt, Artificial Sequence
  RNA Oligomer
aaggucaggucuggaaaugca

SEQ ID NO: 26667 - RNA, 21 nt, Artificial Sequence
  RNA Oligomer
aauugcuuuuaacuacucagg

SEQ ID NO: 26668 - RNA, 21 nt, Artificial Sequence
  RNA Oligomer
auugcuuuuaacuacucaggu

SEQ ID NO: 26669 - RNA, 21 nt, Artificial Sequence
  RNA Oligomer
gagccaggauaaacacauuac

SEQ ID NO: 26670 - RNA, 21 nt, Artificial Sequence
  RNA Oligomer
guaccuaaacuuuaaucaacc

SEQ ID NO: 26671 - RNA, 21 nt, Artificial Sequence
  RNA Oligomer
guccaacuuuuuguauccuug

SEQ ID NO: 26672 - RNA, 21 nt, Artificial Sequence
  RNA Oligomer
aaaaugccaaacucagugccu

SEQ ID NO: 26673 - RNA, 21 nt, Artificial Sequence
  RNA Oligomer
cucugcccuaugauuuuccgu

SEQ ID NO: 26674 - RNA, 21 nt, Artificial Sequence
  RNA Oligomer
uaagacagauauagaagcuac

SEQ ID NO: 26675 - RNA, 21 nt, Artificial Sequence
  RNA Oligomer
agugcaucuauacaaguuuuc

SEQ ID NO: 26676 - RNA, 21 nt, Artificial Sequence
  RNA Oligomer
cugucuaaaauucugguuucu

SEQ ID NO: 26677 - RNA, 21 nt, Artificial Sequence
  RNA Oligomer
uugccuuuacuuccaaaaaac

SEQ ID NO: 26678 - RNA, 21 nt, Artificial Sequence
  RNA Oligomer
uuucaugugacccacuuccuc

SEQ ID NO: 26679 - RNA, 21 nt, Artificial Sequence
  RNA Oligomer
caaaaacaacagaauaaccac

SEQ ID NO: 26680 - RNA, 21 nt, Artificial Sequence
  RNA Oligomer
aacaacagaauaaccacacug

SEQ ID NO: 26681 - RNA, 21 nt, Artificial Sequence
  RNA Oligomer
acccaaguauucccaaagcca

SEQ ID NO: 26682 - RNA, 21 nt, Artificial Sequence
  RNA Oligomer
uuucccaaucuccaucguaca

SEQ ID NO: 26683 - RNA, 21 nt, Artificial Sequence
  RNA Oligomer
gguacuuuucaauuucuuugg

SEQ ID NO: 26684 - RNA, 21 nt, Artificial Sequence
  RNA Oligomer
ucacucuuugcuuggcuuugc

SEQ ID NO: 26685 - RNA, 21 nt, Artificial Sequence
  RNA Oligomer
agaauacaggaaacauaucag

SEQ ID NO: 26686 - RNA, 21 nt, Artificial Sequence
  RNA Oligomer
ugccaaaaccaucagagugcu

SEQ ID NO: 26687 - RNA, 21 nt, Artificial Sequence
  RNA Oligomer
aggauaaacacauuacucucu

SEQ ID NO: 26688 - RNA, 21 nt, Artificial Sequence
  RNA Oligomer
agcaccguauaccaugacucu

SEQ ID NO: 26689 - RNA, 21 nt, Artificial Sequence
  RNA Oligomer
uugaugugauauuaugcagcc

SEQ ID NO: 26690 - RNA, 21 nt, Artificial Sequence
  RNA Oligomer
gaaaauauauuacguaaggcc

SEQ ID NO: 26691 - RNA, 21 nt, Artificial Sequence
  RNA Oligomer
ugaugaaucuucacaccucuc

SEQ ID NO: 26692 - RNA, 21 nt, Artificial Sequence
  RNA Oligomer
ccauuuuuauucagucuuucc

SEQ ID NO: 26693 - RNA, 21 nt, Artificial Sequence
  RNA Oligomer
auacguauguauccaagacau

SEQ ID NO: 26694 - RNA, 21 nt, Artificial Sequence
  RNA Oligomer
cauuucaugugacccacuucc

SEQ ID NO: 26695 - RNA, 21 nt, Artificial Sequence
  RNA Oligomer
acauuaggucaugcauguugc

SEQ ID NO: 26696 - RNA, 21 nt, Artificial Sequence
  RNA Oligomer
uuucccucagucacgguguaa

SEQ ID NO: 26697 - RNA, 21 nt, Artificial Sequence
  RNA Oligomer
ucacgguguaagaaaaaaacu

SEQ ID NO: 26698 - RNA, 21 nt, Artificial Sequence
  RNA Oligomer
uaccaagccaagcugcuuucg

SEQ ID NO: 26699 - RNA, 21 nt, Artificial Sequence
  RNA Oligomer
auaacaccagggagguaaacc

SEQ ID NO: 26700 - RNA, 21 nt, Artificial Sequence
  RNA Oligomer
acauaucagcaguaaagaagu

SEQ ID NO: 26701 - RNA, 21 nt, Artificial Sequence
  RNA Oligomer
aggaagugcaucuauacaagu

SEQ ID NO: 26702 - RNA, 21 nt, Artificial Sequence
  RNA Oligomer
gaaaaaugccuauuugaugug

SEQ ID NO: 26703 - RNA, 21 nt, Artificial Sequence
  RNA Oligomer
aaauuucagcaaggauuugag

SEQ ID NO: 26704 - RNA, 21 nt, Artificial Sequence
  RNA Oligomer
caacccuucuuugcuuauugc

SEQ ID NO: 26705 - RNA, 21 nt, Artificial Sequence
  RNA Oligomer
uuuagugugaaaccacaaggc

SEQ ID NO: 26706 - RNA, 21 nt, Artificial Sequence
  RNA Oligomer
aaacaacagaauaaccacacu

SEQ ID NO: 26707 - RNA, 21 nt, Artificial Sequence
  RNA Oligomer
cgguguaagaaaaaaacuuuc

SEQ ID NO: 26708 - RNA, 21 nt, Artificial Sequence
  RNA Oligomer
aacuuuccuaacuguacccau

SEQ ID NO: 26709 - RNA, 21 nt, Artificial Sequence
  RNA Oligomer
uccuaacuguacccaucauuc

SEQ ID NO: 26710 - RNA, 21 nt, Artificial Sequence
  RNA Oligomer
acauucaaaaccauaguucag

SEQ ID NO: 26711 - RNA, 21 nt, Artificial Sequence
  RNA Oligomer
aguacaaacagaaaaaaccca

SEQ ID NO: 26712 - RNA, 21 nt, Artificial Sequence
  RNA Oligomer
aaguguguagaggacaugaag

SEQ ID NO: 26713 - RNA, 21 nt, Artificial Sequence
  RNA Oligomer
uugagguuguugcugaugucu

SEQ ID NO: 26714 - RNA, 21 nt, Artificial Sequence
  RNA Oligomer
gauaaguugaaggagcgugug

SEQ ID NO: 26715 - RNA, 21 nt, Artificial Sequence
  RNA Oligomer
uuugaugugauauuaugcagc

SEQ ID NO: 26716 - RNA, 21 nt, Artificial Sequence
  RNA Oligomer
aucaugcauaaggcuccuuuu

SEQ ID NO: 26717 - RNA, 21 nt, Artificial Sequence
  RNA Oligomer
uacuaucagcacagaaaaaca

SEQ ID NO: 26718 - RNA, 21 nt, Artificial Sequence
  RNA Oligomer
uaucagcacagaaaaacagug

SEQ ID NO: 26719 - RNA, 21 nt, Artificial Sequence
  RNA Oligomer
aaaaccucauucccuuuuuac

SEQ ID NO: 26720 - RNA, 21 nt, Artificial Sequence
  RNA Oligomer
cuuuccuaacuguacccauca

SEQ ID NO: 26721 - RNA, 21 nt, Artificial Sequence
  RNA Oligomer
auuaggacaaacuugaucacc

SEQ ID NO: 26722 - RNA, 21 nt, Artificial Sequence
  RNA Oligomer
ucucuccaguugacugcauug

SEQ ID NO: 26723 - RNA, 21 nt, Artificial Sequence
  RNA Oligomer
auucuccuucuugaguauugc

SEQ ID NO: 26724 - RNA, 21 nt, Artificial Sequence
  RNA Oligomer
acaaguguguagaggacauga

SEQ ID NO: 26725 - RNA, 21 nt, Artificial Sequence
  RNA Oligomer
aaccuccacauuggaaauagc

SEQ ID NO: 26726 - RNA, 21 nt, Artificial Sequence
  RNA Oligomer
cuugcuuuucugaagaauuca

SEQ ID NO: 26727 - RNA, 21 nt, Artificial Sequence
  RNA Oligomer
uugcugucauuuccacacaca

SEQ ID NO: 26728 - RNA, 21 nt, Artificial Sequence
  RNA Oligomer
caaaugagcaagguacucugc

SEQ ID NO: 26729 - RNA, 21 nt, Artificial Sequence
  RNA Oligomer
uuugagguuguugcugauguc

SEQ ID NO: 26730 - RNA, 21 nt, Artificial Sequence
  RNA Oligomer
aaagccuuugaaaaaggaugu

SEQ ID NO: 26731 - RNA, 21 nt, Artificial Sequence
  RNA Oligomer
ucccuccauuuuuauucaguc

SEQ ID NO: 26732 - RNA, 21 nt, Artificial Sequence
  RNA Oligomer
aacaaaaaccucauucccuuu

SEQ ID NO: 26733 - RNA, 21 nt, Artificial Sequence
  RNA Oligomer
aagaagacacacagcacagca

SEQ ID NO: 26734 - RNA, 21 nt, Artificial Sequence
  RNA Oligomer
cuuuucaauuucuuuggcugc

SEQ ID NO: 26735 - RNA, 21 nt, Artificial Sequence
  RNA Oligomer
uguuaaaaggaauacaguucg

SEQ ID NO: 26736 - RNA, 21 nt, Artificial Sequence
  RNA Oligomer
ucaucuguuguaaacucauuc

SEQ ID NO: 26737 - RNA, 21 nt, Artificial Sequence
  RNA Oligomer
aaacuggaggagucagcugug

SEQ ID NO: 26738 - RNA, 21 nt, Artificial Sequence
  RNA Oligomer
ucagcuguguuaauaugguca

SEQ ID NO: 26739 - RNA, 21 nt, Artificial Sequence
  RNA Oligomer
uaggcuauaaaaguagaguuc

SEQ ID NO: 26740 - RNA, 21 nt, Artificial Sequence
  RNA Oligomer
guagugacauuuuccuuaucu

SEQ ID NO: 26741 - RNA, 21 nt, Artificial Sequence
  RNA Oligomer
gacauuuuccuuaucuuuucc

SEQ ID NO: 26742 - RNA, 21 nt, Artificial Sequence
  RNA Oligomer
acuuuuuguauccuugcuugg

SEQ ID NO: 26743 - RNA, 21 nt, Artificial Sequence
  RNA Oligomer
gauauuaugcagccauuaaga

SEQ ID NO: 26744 - RNA, 21 nt, Artificial Sequence
  RNA Oligomer
cuaucagcacagaaaaacagu

SEQ ID NO: 26745 - RNA, 21 nt, Artificial Sequence
  RNA Oligomer
uuaucaacccuucuuugcuua

SEQ ID NO: 26746 - RNA, 21 nt, Artificial Sequence
  RNA Oligomer
aagcugcaauacuucuauugg

SEQ ID NO: 26747 - RNA, 21 nt, Artificial Sequence
  RNA Oligomer
aucacaaguguguagaggaca

SEQ ID NO: 26748 - RNA, 21 nt, Artificial Sequence
  RNA Oligomer
uugauuuugagguuguugcug

SEQ ID NO: 26749 - RNA, 21 nt, Artificial Sequence
  RNA Oligomer
uaguuuugggagcagggaggu

SEQ ID NO: 26750 - RNA, 21 nt, Artificial Sequence
  RNA Oligomer
aagacaaucuacaauggugcg

SEQ ID NO: 26751 - RNA, 21 nt, Artificial Sequence
  RNA Oligomer
acuaucagcacagaaaaacag

SEQ ID NO: 26752 - RNA, 21 nt, Artificial Sequence
  RNA Oligomer
aagacagauauagaagcuacu

SEQ ID NO: 26753 - RNA, 21 nt, Artificial Sequence
  RNA Oligomer
uaucaacccuucuuugcuuau

SEQ ID NO: 26754 - RNA, 21 nt, Artificial Sequence
  RNA Oligomer
ucaacccuucuuugcuuauug

SEQ ID NO: 26755 - RNA, 21 nt, Artificial Sequence
  RNA Oligomer
uuagugugaaaccacaaggcu

SEQ ID NO: 26756 - RNA, 21 nt, Artificial Sequence
  RNA Oligomer
aaggguguugucuacacaugg

SEQ ID NO: 26757 - RNA, 21 nt, Artificial Sequence
  RNA Oligomer
aaucacaaguguguagaggac

SEQ ID NO: 26758 - RNA, 21 nt, Artificial Sequence
  RNA Oligomer
gugcuguuauuggaaagauac

SEQ ID NO: 26759 - RNA, 21 nt, Artificial Sequence
  RNA Oligomer
uuggaauggaaauagccauac

SEQ ID NO: 26760 - RNA, 21 nt, Artificial Sequence
  RNA Oligomer
aaggacagaaggagaacuugg

SEQ ID NO: 26761 - RNA, 21 nt, Artificial Sequence
  RNA Oligomer
gaauugcuuuuaacuacucag

SEQ ID NO: 26762 - RNA, 21 nt, Artificial Sequence
  RNA Oligomer
uuuuaacuacucagguagagc

SEQ ID NO: 26763 - RNA, 21 nt, Artificial Sequence
  RNA Oligomer
aggcuauaaaaguagaguuca

SEQ ID NO: 26764 - RNA, 21 nt, Artificial Sequence
  RNA Oligomer
cuccaaagacuucucuagacc

SEQ ID NO: 26765 - RNA, 21 nt, Artificial Sequence
  RNA Oligomer
uccaaagacuucucuagacca

SEQ ID NO: 26766 - RNA, 21 nt, Artificial Sequence
  RNA Oligomer
caaagacuucucuagaccagc

SEQ ID NO: 26767 - RNA, 21 nt, Artificial Sequence
  RNA Oligomer
ucugugagaaaaucauaaugc

SEQ ID NO: 26768 - RNA, 21 nt, Artificial Sequence
  RNA Oligomer
cauuuuccuuaucuuuuccac

SEQ ID NO: 26769 - RNA, 21 nt, Artificial Sequence
  RNA Oligomer
aacuuuuuguauccuugcuug

SEQ ID NO: 26770 - RNA, 21 nt, Artificial Sequence
  RNA Oligomer
uugaaggagcguguguucugu

SEQ ID NO: 26771 - RNA, 21 nt, Artificial Sequence
  RNA Oligomer
ugaaggagcguguguucugug

SEQ ID NO: 26772 - RNA, 21 nt, Artificial Sequence
  RNA Oligomer
ucacuuuagaaauggcuuggc

SEQ ID NO: 26773 - RNA, 21 nt, Artificial Sequence
  RNA Oligomer
aaugccaaacucagugccuuu

SEQ ID NO: 26774 - RNA, 21 nt, Artificial Sequence
  RNA Oligomer
gaaucuucacaccucucugcc

SEQ ID NO: 26775 - RNA, 21 nt, Artificial Sequence
  RNA Oligomer
aaucuucacaccucucugccc

SEQ ID NO: 26776 - RNA, 21 nt, Artificial Sequence
  RNA Oligomer
gauaucccuccauuuuuauuc

SEQ ID NO: 26777 - RNA, 21 nt, Artificial Sequence
  RNA Oligomer
agucuuuccuauaccuauucu

SEQ ID NO: 26778 - RNA, 21 nt, Artificial Sequence
  RNA Oligomer
uucgacuuccaaaaacaacag

SEQ ID NO: 26779 - RNA, 21 nt, Artificial Sequence
  RNA Oligomer
uaacaaggaaacucuuuagug

SEQ ID NO: 26780 - RNA, 21 nt, Artificial Sequence
  RNA Oligomer
aacaaggaaacucuuuagugu

SEQ ID NO: 26781 - RNA, 21 nt, Artificial Sequence
  RNA Oligomer
uaaccugagauaaaauggugu

SEQ ID NO: 26782 - RNA, 21 nt, Artificial Sequence
  RNA Oligomer
gauuaggacaaacuugaucac

SEQ ID NO: 26783 - RNA, 21 nt, Artificial Sequence
  RNA Oligomer
uaacagauggcaaagaaguga

SEQ ID NO: 26784 - RNA, 21 nt, Artificial Sequence
  RNA Oligomer
aaauggauucuccuucuugag

SEQ ID NO: 26785 - RNA, 21 nt, Artificial Sequence
  RNA Oligomer
ucgguacaguuguagaauggc

SEQ ID NO: 26786 - RNA, 21 nt, Artificial Sequence
  RNA Oligomer
aauggcagcaauaacaccagg

SEQ ID NO: 26787 - RNA, 21 nt, Artificial Sequence
  RNA Oligomer
uauuggaaagauacgauuugg

SEQ ID NO: 26788 - RNA, 21 nt, Artificial Sequence
  RNA Oligomer
guacuuuucaauuucuuuggc

SEQ ID NO: 26789 - RNA, 21 nt, Artificial Sequence
  RNA Oligomer
uggaucuguuaaaaggaauac

SEQ ID NO: 26790 - RNA, 21 nt, Artificial Sequence
  RNA Oligomer
uuuugggagcagggagguugu

SEQ ID NO: 26791 - RNA, 21 nt, Artificial Sequence
  RNA Oligomer
uuuguauccuugcuuggguuu

SEQ ID NO: 26792 - RNA, 21 nt, Artificial Sequence
  RNA Oligomer
aagccuuugaaaaaggaugua

SEQ ID NO: 26793 - RNA, 21 nt, Artificial Sequence
  RNA Oligomer
augaaucuucacaccucucug

SEQ ID NO: 26794 - RNA, 21 nt, Artificial Sequence
  RNA Oligomer
cuuauugcacaaugcaaguga

SEQ ID NO: 26795 - RNA, 21 nt, Artificial Sequence
  RNA Oligomer
acccacuuccucagauauacc

SEQ ID NO: 26796 - RNA, 21 nt, Artificial Sequence
  RNA Oligomer
uaaagccuuuaucagugguca

SEQ ID NO: 26797 - RNA, 21 nt, Artificial Sequence
  RNA Oligomer
auagcucaagacuucugcacc

SEQ ID NO: 26798 - RNA, 21 nt, Artificial Sequence
  RNA Oligomer
auuuugcaagacauuagguca

SEQ ID NO: 26799 - RNA, 21 nt, Artificial Sequence
  RNA Oligomer
ugauuaggacaaacuugauca

SEQ ID NO: 26800 - RNA, 21 nt, Artificial Sequence
  RNA Oligomer
auaugaaucacugagccaggc

SEQ ID NO: 26801 - RNA, 21 nt, Artificial Sequence
  RNA Oligomer
gaaucacaaguguguagagga

SEQ ID NO: 26802 - RNA, 21 nt, Artificial Sequence
  RNA Oligomer
uuucggcaaagcauccagugg

SEQ ID NO: 26803 - RNA, 21 nt, Artificial Sequence
  RNA Oligomer
cagaaacgagugggaaaacaa

SEQ ID NO: 26804 - RNA, 21 nt, Artificial Sequence
  RNA Oligomer
ccaagagacauguuaggauaa

SEQ ID NO: 26805 - RNA, 21 nt, Artificial Sequence
  RNA Oligomer
ccggagauucuucuuuaauuu

SEQ ID NO: 26806 - RNA, 21 nt, Artificial Sequence
  RNA Oligomer
cuguaccuugacgagaaugaa

SEQ ID NO: 26807 - RNA, 21 nt, Artificial Sequence
  RNA Oligomer
ggaagaacuaccagaaacgag

SEQ ID NO: 26808 - RNA, 21 nt, Artificial Sequence
  RNA Oligomer
guaccuugacgagaaugaaaa

SEQ ID NO: 26809 - RNA, 21 nt, Artificial Sequence
  RNA Oligomer
uccacaaaagagaaaaacguc

SEQ ID NO: 26810 - RNA, 21 nt, Artificial Sequence
  RNA Oligomer
gguuggugaaucagaaugcaa

SEQ ID NO: 26811 - RNA, 21 nt, Artificial Sequence
  RNA Oligomer
augcuguaccuugacgagaau

SEQ ID NO: 26812 - RNA, 21 nt, Artificial Sequence
  RNA Oligomer
cuguuaacucuaagauuccua

SEQ ID NO: 26813 - RNA, 21 nt, Artificial Sequence
  RNA Oligomer
cccggagauucuucuuuaauu

SEQ ID NO: 26814 - RNA, 21 nt, Artificial Sequence
  RNA Oligomer
cuugacgagaaugaaaagguu

SEQ ID NO: 26815 - RNA, 21 nt, Artificial Sequence
  RNA Oligomer
caacucuguuaacucuaagau

SEQ ID NO: 26816 - RNA, 21 nt, Artificial Sequence
  RNA Oligomer
ugcaagcaggugggaaaguuu

SEQ ID NO: 26817 - RNA, 21 nt, Artificial Sequence
  RNA Oligomer
gcaacagccaacucgaaauuc

SEQ ID NO: 26818 - RNA, 21 nt, Artificial Sequence
  RNA Oligomer
acccggagauucuucuuuaau

SEQ ID NO: 26819 - RNA, 21 nt, Artificial Sequence
  RNA Oligomer
ugcuguaccuugacgagaaug

SEQ ID NO: 26820 - RNA, 21 nt, Artificial Sequence
  RNA Oligomer
ccauguggacgcucuuucaau

SEQ ID NO: 26821 - RNA, 21 nt, Artificial Sequence
  RNA Oligomer
cgagaaugaaaagguuguauu

SEQ ID NO: 26822 - RNA, 21 nt, Artificial Sequence
  RNA Oligomer
acucuaagauuccuaaggcau

SEQ ID NO: 26823 - RNA, 21 nt, Artificial Sequence
  RNA Oligomer
ugaccagaguuuuuccaugug

SEQ ID NO: 26824 - RNA, 21 nt, Artificial Sequence
  RNA Oligomer
gcuaguaacuuuuggccauga

SEQ ID NO: 26825 - RNA, 21 nt, Artificial Sequence
  RNA Oligomer
ugcuaguaacuuuuggccaug

SEQ ID NO: 26826 - RNA, 21 nt, Artificial Sequence
  RNA Oligomer
gcaagcaggugggaaaguuuu

SEQ ID NO: 26827 - RNA, 21 nt, Artificial Sequence
  RNA Oligomer
uugaacuugcagggagaauaa

SEQ ID NO: 26828 - RNA, 21 nt, Artificial Sequence
  RNA Oligomer
cagaacucagugcuaucucga

SEQ ID NO: 26829 - RNA, 21 nt, Artificial Sequence
  RNA Oligomer
cuaagauuccuaaggcaugcu

SEQ ID NO: 26830 - RNA, 21 nt, Artificial Sequence
  RNA Oligomer
ucaacucuguuaacucuaaga

SEQ ID NO: 26831 - RNA, 21 nt, Artificial Sequence
  RNA Oligomer
ccaaacacaaacagcggaaac

SEQ ID NO: 26832 - RNA, 21 nt, Artificial Sequence
  RNA Oligomer
cacaaaagagaaaaacgucaa

SEQ ID NO: 26833 - RNA, 21 nt, Artificial Sequence
  RNA Oligomer
ggugaaucagaaugcaagcag

SEQ ID NO: 26834 - RNA, 21 nt, Artificial Sequence
  RNA Oligomer
agguuggugaaucagaaugca

SEQ ID NO: 26835 - RNA, 21 nt, Artificial Sequence
  RNA Oligomer
cucgaugcuguaccuugacga

SEQ ID NO: 26836 - RNA, 21 nt, Artificial Sequence
  RNA Oligomer
gcuaucucgaugcuguaccuu

SEQ ID NO: 26837 - RNA, 21 nt, Artificial Sequence
  RNA Oligomer
gccuuuuacugccacggagaa

SEQ ID NO: 26838 - RNA, 21 nt, Artificial Sequence
  RNA Oligomer
acuuuuggccaugauggaaaa

SEQ ID NO: 26839 - RNA, 21 nt, Artificial Sequence
  RNA Oligomer
agagacauguuaggauaagca

SEQ ID NO: 26840 - RNA, 21 nt, Artificial Sequence
  RNA Oligomer
agaaugcaagcaggugggaaa

SEQ ID NO: 26841 - RNA, 21 nt, Artificial Sequence
  RNA Oligomer
ccagguuggugaaucagaaug

SEQ ID NO: 26842 - RNA, 21 nt, Artificial Sequence
  RNA Oligomer
gaaaucauaaaaccugcaaca

SEQ ID NO: 26843 - RNA, 21 nt, Artificial Sequence
  RNA Oligomer
aacccggagauucuucuuuaa

SEQ ID NO: 26844 - RNA, 21 nt, Artificial Sequence
  RNA Oligomer
ggacuucuugaacuugcaggg

SEQ ID NO: 26845 - RNA, 21 nt, Artificial Sequence
  RNA Oligomer
agaacucagugcuaucucgau

SEQ ID NO: 26846 - RNA, 21 nt, Artificial Sequence
  RNA Oligomer
gcugaucaucugaacuccacu

SEQ ID NO: 26847 - RNA, 21 nt, Artificial Sequence
  RNA Oligomer
uucuugaacuugcagggagaa

SEQ ID NO: 26848 - RNA, 21 nt, Artificial Sequence
  RNA Oligomer
acaaaagagaaaaacgucaag

SEQ ID NO: 26849 - RNA, 21 nt, Artificial Sequence
  RNA Oligomer
cuaguaacuuuuggccaugau

SEQ ID NO: 26850 - RNA, 21 nt, Artificial Sequence
  RNA Oligomer
cuucuugaacuugcagggaga

SEQ ID NO: 26851 - RNA, 21 nt, Artificial Sequence
  RNA Oligomer
acauguuaggauaagcagguc

SEQ ID NO: 26852 - RNA, 21 nt, Artificial Sequence
  RNA Oligomer
ggugggaaaguuuugauguca

SEQ ID NO: 26853 - RNA, 21 nt, Artificial Sequence
  RNA Oligomer
gaaugcaagcaggugggaaag

SEQ ID NO: 26854 - RNA, 21 nt, Artificial Sequence
  RNA Oligomer
ugaaaucauaaaaccugcaac

SEQ ID NO: 26855 - RNA, 21 nt, Artificial Sequence
  RNA Oligomer
gacgagaaugaaaagguugua

SEQ ID NO: 26856 - RNA, 21 nt, Artificial Sequence
  RNA Oligomer
cuuugaccagaguuuuuccau

SEQ ID NO: 26857 - RNA, 21 nt, Artificial Sequence
  RNA Oligomer
agagaaaaacgucaagccaaa

SEQ ID NO: 26858 - RNA, 21 nt, Artificial Sequence
  RNA Oligomer
uguuaggauaagcaggucuuu

SEQ ID NO: 26859 - RNA, 21 nt, Artificial Sequence
  RNA Oligomer
auguuaggauaagcaggucuu

SEQ ID NO: 26860 - RNA, 21 nt, Artificial Sequence
  RNA Oligomer
gagacauguuaggauaagcag

SEQ ID NO: 26861 - RNA, 21 nt, Artificial Sequence
  RNA Oligomer
gcaggugggaaaguuuugaug

SEQ ID NO: 26862 - RNA, 21 nt, Artificial Sequence
  RNA Oligomer
agcaggugggaaaguuuugau

SEQ ID NO: 26863 - RNA, 21 nt, Artificial Sequence
  RNA Oligomer
ucagaaugcaagcagguggga

SEQ ID NO: 26864 - RNA, 21 nt, Artificial Sequence
  RNA Oligomer
cucuguuaacucuaagauucc

SEQ ID NO: 26865 - RNA, 21 nt, Artificial Sequence
  RNA Oligomer
ccucuggcugaucaucugaac

SEQ ID NO: 26866 - RNA, 21 nt, Artificial Sequence
  RNA Oligomer
ccuuuuacugccacggagaau

SEQ ID NO: 26867 - RNA, 21 nt, Artificial Sequence
  RNA Oligomer
ccuuuguacguggacuucagu

SEQ ID NO: 26868 - RNA, 21 nt, Artificial Sequence
  RNA Oligomer
cccuuuguacguggacuucag

SEQ ID NO: 26869 - RNA, 21 nt, Artificial Sequence
  RNA Oligomer
ccacaaaagagaaaaacguca

SEQ ID NO: 26870 - RNA, 21 nt, Artificial Sequence
  RNA Oligomer
acacagcuggucacagauaag

SEQ ID NO: 26871 - RNA, 21 nt, Artificial Sequence
  RNA Oligomer
ggaggaggcaaagaaaaggaa

SEQ ID NO: 26872 - RNA, 21 nt, Artificial Sequence
  RNA Oligomer
gugggaaaguuuugaugucac

SEQ ID NO: 26873 - RNA, 21 nt, Artificial Sequence
  RNA Oligomer
cagaugcaagaugcuuuagga

SEQ ID NO: 26874 - RNA, 21 nt, Artificial Sequence
  RNA Oligomer
guauuaaagaacuaucaggac

SEQ ID NO: 26875 - RNA, 21 nt, Artificial Sequence
  RNA Oligomer
acgagaaugaaaagguuguau

SEQ ID NO: 26876 - RNA, 21 nt, Artificial Sequence
  RNA Oligomer
agacuuuuggacaccagguug

SEQ ID NO: 26877 - RNA, 21 nt, Artificial Sequence
  RNA Oligomer
gaagaaucuuuggaagaacua

SEQ ID NO: 26878 - RNA, 21 nt, Artificial Sequence
  RNA Oligomer
aggacaugguuguggaggguu

SEQ ID NO: 26879 - RNA, 21 nt, Artificial Sequence
  RNA Oligomer
cucuggcugaucaucugaacu

SEQ ID NO: 26880 - RNA, 21 nt, Artificial Sequence
  RNA Oligomer
ggguggaaugacuggauugug

SEQ ID NO: 26881 - RNA, 21 nt, Artificial Sequence
  RNA Oligomer
gugucgcuaguacagcaaaau

SEQ ID NO: 26882 - RNA, 21 nt, Artificial Sequence
  RNA Oligomer
gacaugguuguggaggguugu

SEQ ID NO: 26883 - RNA, 21 nt, Artificial Sequence
  RNA Oligomer
cuaucaggacaugguugugga

SEQ ID NO: 26884 - RNA, 21 nt, Artificial Sequence
  RNA Oligomer
caggugggaaaguuuugaugu

SEQ ID NO: 26885 - RNA, 21 nt, Artificial Sequence
  RNA Oligomer
gccaaacacaaacagcggaaa

SEQ ID NO: 26886 - RNA, 21 nt, Artificial Sequence
  RNA Oligomer
ugaucaucugaacuccacuaa

SEQ ID NO: 26887 - RNA, 21 nt, Artificial Sequence
  RNA Oligomer
ugaaucagaaugcaagcaggu

SEQ ID NO: 26888 - RNA, 21 nt, Artificial Sequence
  RNA Oligomer
gcuuuaggaaacaauagcagu

SEQ ID NO: 26889 - RNA, 21 nt, Artificial Sequence
  RNA Oligomer
ugaagaaucuuuggaagaacu

SEQ ID NO: 26890 - RNA, 21 nt, Artificial Sequence
  RNA Oligomer
ucgcuaguacagcaaaauuaa

SEQ ID NO: 26891 - RNA, 21 nt, Artificial Sequence
  RNA Oligomer
ugucgcuaguacagcaaaauu

SEQ ID NO: 26892 - RNA, 21 nt, Artificial Sequence
  RNA Oligomer
aacuccacuaaucaugccauu

SEQ ID NO: 26893 - RNA, 21 nt, Artificial Sequence
  RNA Oligomer
ucaucugaacuccacuaauca

SEQ ID NO: 26894 - RNA, 21 nt, Artificial Sequence
  RNA Oligomer
ccucuccacaaaagagaaaaa

SEQ ID NO: 26895 - RNA, 21 nt, Artificial Sequence
  RNA Oligomer
agauaaggccauugcuaguaa

SEQ ID NO: 26896 - RNA, 21 nt, Artificial Sequence
  RNA Oligomer
cgcuaguacagcaaaauuaaa

SEQ ID NO: 26897 - RNA, 21 nt, Artificial Sequence
  RNA Oligomer
ggugucgcuaguacagcaaaa

SEQ ID NO: 26898 - RNA, 21 nt, Artificial Sequence
  RNA Oligomer
ggccauugcuaguaacuuuug

SEQ ID NO: 26899 - RNA, 21 nt, Artificial Sequence
  RNA Oligomer
aggccauugcuaguaacuuuu

SEQ ID NO: 26900 - RNA, 21 nt, Artificial Sequence
  RNA Oligomer
gaacagaugcaagaugcuuua

SEQ ID NO: 26901 - RNA, 21 nt, Artificial Sequence
  RNA Oligomer
gagcuucagguuuuccgagaa

SEQ ID NO: 26902 - RNA, 21 nt, Artificial Sequence
  RNA Oligomer
cuaccagaaacgagugggaaa

SEQ ID NO: 26903 - RNA, 21 nt, Artificial Sequence
  RNA Oligomer
uccacuaaucaugccauuguu

SEQ ID NO: 26904 - RNA, 21 nt, Artificial Sequence
  RNA Oligomer
ccuuuuccucuggcugaucau

SEQ ID NO: 26905 - RNA, 21 nt, Artificial Sequence
  RNA Oligomer
gcaguuuccaucaccgaauua

SEQ ID NO: 26906 - RNA, 21 nt, Artificial Sequence
  RNA Oligomer
gugggaaaacaacccggagau

SEQ ID NO: 26907 - RNA, 21 nt, Artificial Sequence
  RNA Oligomer
gggugucgcuaguacagcaaa

SEQ ID NO: 26908 - RNA, 21 nt, Artificial Sequence
  RNA Oligomer
ucccgacagaacucagugcua

SEQ ID NO: 26909 - RNA, 21 nt, Artificial Sequence
  RNA Oligomer
gacguuggucaacucuguuaa

SEQ ID NO: 26910 - RNA, 21 nt, Artificial Sequence
  RNA Oligomer
gaucaucugaacuccacuaau

SEQ ID NO: 26911 - RNA, 21 nt, Artificial Sequence
  RNA Oligomer
ccagguccuuugaccagaguu

SEQ ID NO: 26912 - RNA, 21 nt, Artificial Sequence
  RNA Oligomer
cccuacaugcuagaccuguau

SEQ ID NO: 26913 - RNA, 21 nt, Artificial Sequence
  RNA Oligomer
aggaacggacauucgguccuu

SEQ ID NO: 26914 - RNA, 21 nt, Artificial Sequence
  RNA Oligomer
caaacagcggaaacgccuuaa

SEQ ID NO: 26915 - RNA, 21 nt, Artificial Sequence
  RNA Oligomer
gaaaaacgucaagccaaacac

SEQ ID NO: 26916 - RNA, 21 nt, Artificial Sequence
  RNA Oligomer
uccucuccacaaaagagaaaa

SEQ ID NO: 26917 - RNA, 21 nt, Artificial Sequence
  RNA Oligomer
ucacagauaaggccauugcua

SEQ ID NO: 26918 - RNA, 21 nt, Artificial Sequence
  RNA Oligomer
ugaacacagcuggucacagau

SEQ ID NO: 26919 - RNA, 21 nt, Artificial Sequence
  RNA Oligomer
agcaguuuccaucaccgaauu

SEQ ID NO: 26920 - RNA, 21 nt, Artificial Sequence
  RNA Oligomer
ccagaaacgagugggaaaaca

SEQ ID NO: 26921 - RNA, 21 nt, Artificial Sequence
  RNA Oligomer
cuuuggaagaacuaccagaaa

SEQ ID NO: 26922 - RNA, 21 nt, Artificial Sequence
  RNA Oligomer
cgcagcuuccaccaugaagaa

SEQ ID NO: 26923 - RNA, 21 nt, Artificial Sequence
  RNA Oligomer
gucgcuaguacagcaaaauua

SEQ ID NO: 26924 - RNA, 21 nt, Artificial Sequence
  RNA Oligomer
ccagaguuuuuccauguggac

SEQ ID NO: 26925 - RNA, 21 nt, Artificial Sequence
  RNA Oligomer
cagugcuaucucgaugcugua

SEQ ID NO: 26926 - RNA, 21 nt, Artificial Sequence
  RNA Oligomer
ccgacagaacucagugcuauc

SEQ ID NO: 26927 - RNA, 21 nt, Artificial Sequence
  RNA Oligomer
cugaucaucugaacuccacua

SEQ ID NO: 26928 - RNA, 21 nt, Artificial Sequence
  RNA Oligomer
gcuguaagagacacccuuugu

SEQ ID NO: 26929 - RNA, 21 nt, Artificial Sequence
  RNA Oligomer
acgucaagccaaacacaaaca

SEQ ID NO: 26930 - RNA, 21 nt, Artificial Sequence
  RNA Oligomer
gggcauccucuccacaaaaga

SEQ ID NO: 26931 - RNA, 21 nt, Artificial Sequence
  RNA Oligomer
ggagaaacaaggugucuccaa

SEQ ID NO: 26932 - RNA, 21 nt, Artificial Sequence
  RNA Oligomer
caaccauggauucguggugga

SEQ ID NO: 26933 - RNA, 21 nt, Artificial Sequence
  RNA Oligomer
cagacuuuuggacaccagguu

SEQ ID NO: 26934 - RNA, 21 nt, Artificial Sequence
  RNA Oligomer
gaccagacuuuuggacaccag

SEQ ID NO: 26935 - RNA, 21 nt, Artificial Sequence
  RNA Oligomer
gcuucagguuuuccgagaaca

SEQ ID NO: 26936 - RNA, 21 nt, Artificial Sequence
  RNA Oligomer
ggaguuuaucaccucagcaga

SEQ ID NO: 26937 - RNA, 21 nt, Artificial Sequence
  RNA Oligomer
cggaggaguuuaucaccucag

SEQ ID NO: 26938 - RNA, 21 nt, Artificial Sequence
  RNA Oligomer
ucuuuggaagaacuaccagaa

SEQ ID NO: 26939 - RNA, 21 nt, Artificial Sequence
  RNA Oligomer
caccaugaagaaucuuuggaa

SEQ ID NO: 26940 - RNA, 21 nt, Artificial Sequence
  RNA Oligomer
ugggugucgcuaguacagcaa

SEQ ID NO: 26941 - RNA, 21 nt, Artificial Sequence
  RNA Oligomer
aagaacuaucaggacaugguu

SEQ ID NO: 26942 - RNA, 21 nt, Artificial Sequence
  RNA Oligomer
ccacuaaucaugccauuguuc

SEQ ID NO: 26943 - RNA, 21 nt, Artificial Sequence
  RNA Oligomer
gaacuccacuaaucaugccau

SEQ ID NO: 26944 - RNA, 21 nt, Artificial Sequence
  RNA Oligomer
guaucacgccuuuuacugcca

SEQ ID NO: 26945 - RNA, 21 nt, Artificial Sequence
  RNA Oligomer
ccagcuguaagagacacccuu

SEQ ID NO: 26946 - RNA, 21 nt, Artificial Sequence
  RNA Oligomer
cucuccacaaaagagaaaaac

SEQ ID NO: 26947 - RNA, 21 nt, Artificial Sequence
  RNA Oligomer
cagauaaggccauugcuagua

SEQ ID NO: 26948 - RNA, 21 nt, Artificial Sequence
  RNA Oligomer
uccaagagacauguuaggaua

SEQ ID NO: 26949 - RNA, 21 nt, Artificial Sequence
  RNA Oligomer
ggugucuccaagagacauguu

SEQ ID NO: 26950 - RNA, 21 nt, Artificial Sequence
  RNA Oligomer
cugcaacagccaacucgaaau

SEQ ID NO: 26951 - RNA, 21 nt, Artificial Sequence
  RNA Oligomer
ccugcaacagccaacucgaaa

SEQ ID NO: 26952 - RNA, 21 nt, Artificial Sequence
  RNA Oligomer
agaacagaugcaagaugcuuu

SEQ ID NO: 26953 - RNA, 21 nt, Artificial Sequence
  RNA Oligomer
cgagaacagaugcaagaugcu

SEQ ID NO: 26954 - RNA, 21 nt, Artificial Sequence
  RNA Oligomer
accagaaacgagugggaaaac

SEQ ID NO: 26955 - RNA, 21 nt, Artificial Sequence
  RNA Oligomer
cccgacagaacucagugcuau

SEQ ID NO: 26956 - RNA, 21 nt, Artificial Sequence
  RNA Oligomer
cccuuuuccucuggcugauca

SEQ ID NO: 26957 - RNA, 21 nt, Artificial Sequence
  RNA Oligomer
acgccuuaaguccagcuguaa

SEQ ID NO: 26958 - RNA, 21 nt, Artificial Sequence
  RNA Oligomer
acaaacagcggaaacgccuua

SEQ ID NO: 26959 - RNA, 21 nt, Artificial Sequence
  RNA Oligomer
gagaaaaacgucaagccaaac

SEQ ID NO: 26960 - RNA, 21 nt, Artificial Sequence
  RNA Oligomer
gaacacagcuggucacagaua

SEQ ID NO: 26961 - RNA, 21 nt, Artificial Sequence
  RNA Oligomer
ugcaacagccaacucgaaauu

SEQ ID NO: 26962 - RNA, 21 nt, Artificial Sequence
  RNA Oligomer
ggaaacaauagcaguuuccau

SEQ ID NO: 26963 - RNA, 21 nt, Artificial Sequence
  RNA Oligomer
ucagcagagcuucagguuuuc

SEQ ID NO: 26964 - RNA, 21 nt, Artificial Sequence
  RNA Oligomer
uggaagaacuaccagaaacga

SEQ ID NO: 26965 - RNA, 21 nt, Artificial Sequence
  RNA Oligomer
ccaugaagaaucuuuggaaga

SEQ ID NO: 26966 - RNA, 21 nt, Artificial Sequence
  RNA Oligomer
ccuacaugcuagaccuguauc

SEQ ID NO: 26967 - RNA, 21 nt, Artificial Sequence
  RNA Oligomer
gaguuuuuccauguggacgcu

SEQ ID NO: 26968 - RNA, 21 nt, Artificial Sequence
  RNA Oligomer
uggucaacucuguuaacucua

SEQ ID NO: 26969 - RNA, 21 nt, Artificial Sequence
  RNA Oligomer
cauuguucagacguuggucaa

SEQ ID NO: 26970 - RNA, 21 nt, Artificial Sequence
  RNA Oligomer
ucaugccauuguucagacguu

SEQ ID NO: 26971 - RNA, 21 nt, Artificial Sequence
  RNA Oligomer
ugaacuccacuaaucaugcca

SEQ ID NO: 26972 - RNA, 21 nt, Artificial Sequence
  RNA Oligomer
cuggucacagauaaggccauu

SEQ ID NO: 26973 - RNA, 21 nt, Artificial Sequence
  RNA Oligomer
agaaacaaggugucuccaaga

SEQ ID NO: 26974 - RNA, 21 nt, Artificial Sequence
  RNA Oligomer
caagaugcuuuaggaaacaau

SEQ ID NO: 26975 - RNA, 21 nt, Artificial Sequence
  RNA Oligomer
ugggaaaacaacccggagauu

SEQ ID NO: 26976 - RNA, 21 nt, Artificial Sequence
  RNA Oligomer
gcagcuuccaccaugaagaau

SEQ ID NO: 26977 - RNA, 21 nt, Artificial Sequence
  RNA Oligomer
gcauguucggccugaaacaga

SEQ ID NO: 26978 - RNA, 21 nt, Artificial Sequence
  RNA Oligomer
cucagcauguucggccugaaa

SEQ ID NO: 26979 - RNA, 21 nt, Artificial Sequence
  RNA Oligomer
ccuugacgagaaugaaaaggu

SEQ ID NO: 26980 - RNA, 21 nt, Artificial Sequence
  RNA Oligomer
gacagaacucagugcuaucuc

SEQ ID NO: 26981 - RNA, 21 nt, Artificial Sequence
  RNA Oligomer
cgacagaacucagugcuaucu

SEQ ID NO: 26982 - RNA, 21 nt, Artificial Sequence
  RNA Oligomer
ggucaacucuguuaacucuaa

SEQ ID NO: 26983 - RNA, 21 nt, Artificial Sequence
  RNA Oligomer
cauccucuccacaaaagagaa

SEQ ID NO: 26984 - RNA, 21 nt, Artificial Sequence
  RNA Oligomer
gcauccucuccacaaaagaga

SEQ ID NO: 26985 - RNA, 21 nt, Artificial Sequence
  RNA Oligomer
ccauugcuaguaacuuuuggc

SEQ ID NO: 26986 - RNA, 21 nt, Artificial Sequence
  RNA Oligomer
accagguuggugaaucagaau

SEQ ID NO: 26987 - RNA, 21 nt, Artificial Sequence
  RNA Oligomer
ccagacuuuuggacaccaggu

SEQ ID NO: 26988 - RNA, 21 nt, Artificial Sequence
  RNA Oligomer
gcagagcuucagguuuuccga

SEQ ID NO: 26989 - RNA, 21 nt, Artificial Sequence
  RNA Oligomer
caacccggagauucuucuuua

SEQ ID NO: 26990 - RNA, 21 nt, Artificial Sequence
  RNA Oligomer
ggaaaacaacccggagauucu

SEQ ID NO: 26991 - RNA, 21 nt, Artificial Sequence
  RNA Oligomer
gucaacucuguuaacucuaag

SEQ ID NO: 26992 - RNA, 21 nt, Artificial Sequence
  RNA Oligomer
gccauuguucagacguugguc

SEQ ID NO: 26993 - RNA, 21 nt, Artificial Sequence
  RNA Oligomer
cagguccuuugaccagaguuu

SEQ ID NO: 26994 - RNA, 21 nt, Artificial Sequence
  RNA Oligomer
acacccuuuguacguggacuu

SEQ ID NO: 26995 - RNA, 21 nt, Artificial Sequence
  RNA Oligomer
agacacccuuuguacguggac

SEQ ID NO: 26996 - RNA, 21 nt, Artificial Sequence
  RNA Oligomer
cagcuguaagagacacccuuu

SEQ ID NO: 26997 - RNA, 21 nt, Artificial Sequence
  RNA Oligomer
agcaggucuuugcaccaagau

SEQ ID NO: 26998 - RNA, 21 nt, Artificial Sequence
  RNA Oligomer
acaaggugucuccaagagaca

SEQ ID NO: 26999 - RNA, 21 nt, Artificial Sequence
  RNA Oligomer
ccgugaccagacuuuuggaca

SEQ ID NO: 27000 - RNA, 21 nt, Artificial Sequence
  RNA Oligomer
ucauaaaaccugcaacagcca

SEQ ID NO: 27001 - RNA, 21 nt, Artificial Sequence
  RNA Oligomer
ucagguuuuccgagaacagau

SEQ ID NO: 27002 - RNA, 21 nt, Artificial Sequence
  RNA Oligomer
agcuucagguuuuccgagaac

SEQ ID NO: 27003 - RNA, 21 nt, Artificial Sequence
  RNA Oligomer
gcagggagaauaacuugcgca

SEQ ID NO: 27004 - RNA, 21 nt, Artificial Sequence
  RNA Oligomer
agcuuccaccaugaagaaucu

SEQ ID NO: 27005 - RNA, 21 nt, Artificial Sequence
  RNA Oligomer
cagacguuggucaacucuguu

SEQ ID NO: 27006 - RNA, 21 nt, Artificial Sequence
  RNA Oligomer
agguccuuugaccagaguuuu

SEQ ID NO: 27007 - RNA, 21 nt, Artificial Sequence
  RNA Oligomer
gagacacccuuuguacgugga

SEQ ID NO: 27008 - RNA, 21 nt, Artificial Sequence
  RNA Oligomer
ggaaacgccuuaaguccagcu

SEQ ID NO: 27009 - RNA, 21 nt, Artificial Sequence
  RNA Oligomer
ggcauccucuccacaaaagag

SEQ ID NO: 27010 - RNA, 21 nt, Artificial Sequence
  RNA Oligomer
gucacagauaaggccauugcu

SEQ ID NO: 27011 - RNA, 21 nt, Artificial Sequence
  RNA Oligomer
cuccaagagacauguuaggau

SEQ ID NO: 27012 - RNA, 21 nt, Artificial Sequence
  RNA Oligomer
ggacaccagguuggugaauca

SEQ ID NO: 27013 - RNA, 21 nt, Artificial Sequence
  RNA Oligomer
aguuuccaucaccgaauuaau

SEQ ID NO: 27014 - RNA, 21 nt, Artificial Sequence
  RNA Oligomer
aggaaacaauagcaguuucca

SEQ ID NO: 27015 - RNA, 21 nt, Artificial Sequence
  RNA Oligomer
gcaagaugcuuuaggaaacaa

SEQ ID NO: 27016 - RNA, 21 nt, Artificial Sequence
  RNA Oligomer
ccgagaacagaugcaagaugc

SEQ ID NO: 27017 - RNA, 21 nt, Artificial Sequence
  RNA Oligomer
gaggaguuuaucaccucagca

SEQ ID NO: 27018 - RNA, 21 nt, Artificial Sequence
  RNA Oligomer
ggaggaguuuaucaccucagc

SEQ ID NO: 27019 - RNA, 21 nt, Artificial Sequence
  RNA Oligomer
ggucuccuaaaggucgaccau

SEQ ID NO: 27020 - RNA, 21 nt, Artificial Sequence
  RNA Oligomer
acguuggucaacucuguuaac

SEQ ID NO: 27021 - RNA, 21 nt, Artificial Sequence
  RNA Oligomer
gguccuuugaccagaguuuuu

SEQ ID NO: 27022 - RNA, 21 nt, Artificial Sequence
  RNA Oligomer
uggucacagauaaggccauug

SEQ ID NO: 27023 - RNA, 21 nt, Artificial Sequence
  RNA Oligomer
ggaggagaaacaaggugucuc

SEQ ID NO: 27024 - RNA, 21 nt, Artificial Sequence
  RNA Oligomer
ccauggauucgugguggaagu

SEQ ID NO: 27025 - RNA, 21 nt, Artificial Sequence
  RNA Oligomer
ugaccagacuuuuggacacca

SEQ ID NO: 27026 - RNA, 21 nt, Artificial Sequence
  RNA Oligomer
accucagcagagcuucagguu

SEQ ID NO: 27027 - RNA, 21 nt, Artificial Sequence
  RNA Oligomer
acggaggaguuuaucaccuca

SEQ ID NO: 27028 - RNA, 21 nt, Artificial Sequence
  RNA Oligomer
cacggaggaguuuaucaccuc

SEQ ID NO: 27029 - RNA, 21 nt, Artificial Sequence
  RNA Oligomer
gaaaacaacccggagauucuu

SEQ ID NO: 27030 - RNA, 21 nt, Artificial Sequence
  RNA Oligomer
gggaaaacaacccggagauuc

SEQ ID NO: 27031 - RNA, 21 nt, Artificial Sequence
  RNA Oligomer
gaaucuuuggaagaacuacca

SEQ ID NO: 27032 - RNA, 21 nt, Artificial Sequence
  RNA Oligomer
cuccuaaaggucgaccauggu

SEQ ID NO: 27033 - RNA, 21 nt, Artificial Sequence
  RNA Oligomer
agacguuggucaacucuguua

SEQ ID NO: 27034 - RNA, 21 nt, Artificial Sequence
  RNA Oligomer
ccauuguucagacguugguca

SEQ ID NO: 27035 - RNA, 21 nt, Artificial Sequence
  RNA Oligomer
aagggcauccucuccacaaaa

SEQ ID NO: 27036 - RNA, 21 nt, Artificial Sequence
  RNA Oligomer
gcaggucuuugcaccaagaug

SEQ ID NO: 27037 - RNA, 21 nt, Artificial Sequence
  RNA Oligomer
gcccacuuggaggagaaacaa

SEQ ID NO: 27038 - RNA, 21 nt, Artificial Sequence
  RNA Oligomer
aaccauggauucgugguggaa

SEQ ID NO: 27039 - RNA, 21 nt, Artificial Sequence
  RNA Oligomer
caguuuccaucaccgaauuaa

SEQ ID NO: 27040 - RNA, 21 nt, Artificial Sequence
  RNA Oligomer
agaugcaagaugcuuuaggaa

SEQ ID NO: 27041 - RNA, 21 nt, Artificial Sequence
  RNA Oligomer
uuccgagaacagaugcaagau

SEQ ID NO: 27042 - RNA, 21 nt, Artificial Sequence
  RNA Oligomer
accaugaagaaucuuuggaag

SEQ ID NO: 27043 - RNA, 21 nt, Artificial Sequence
  RNA Oligomer
gcuuccaccaugaagaaucuu

SEQ ID NO: 27044 - RNA, 21 nt, Artificial Sequence
  RNA Oligomer
cgcucuuucaauggacguguc

SEQ ID NO: 27045 - RNA, 21 nt, Artificial Sequence
  RNA Oligomer
ggacgcucuuucaauggacgu

SEQ ID NO: 27046 - RNA, 21 nt, Artificial Sequence
  RNA Oligomer
ugcuaucucgaugcuguaccu

SEQ ID NO: 27047 - RNA, 21 nt, Artificial Sequence
  RNA Oligomer
aggucuuugcaccaagaugaa

SEQ ID NO: 27048 - RNA, 21 nt, Artificial Sequence
  RNA Oligomer
caccagguuggugaaucagaa

SEQ ID NO: 27049 - RNA, 21 nt, Artificial Sequence
  RNA Oligomer
acgcuguucccagcgugaaaa

SEQ ID NO: 27050 - RNA, 21 nt, Artificial Sequence
  RNA Oligomer
cucagcagagcuucagguuuu

SEQ ID NO: 27051 - RNA, 21 nt, Artificial Sequence
  RNA Oligomer
ccacggaggaguuuaucaccu

SEQ ID NO: 27052 - RNA, 21 nt, Artificial Sequence
  RNA Oligomer
ccaccaugaagaaucuuugga

SEQ ID NO: 27053 - RNA, 21 nt, Artificial Sequence
  RNA Oligomer
ggcugaucaucugaacuccac

SEQ ID NO: 27054 - RNA, 21 nt, Artificial Sequence
  RNA Oligomer
uggcugaucaucugaacucca

SEQ ID NO: 27055 - RNA, 21 nt, Artificial Sequence
  RNA Oligomer
guacguggacuucagugacgu

SEQ ID NO: 27056 - RNA, 21 nt, Artificial Sequence
  RNA Oligomer
ggccaugauggaaaagggcau

SEQ ID NO: 27057 - RNA, 21 nt, Artificial Sequence
  RNA Oligomer
gugucuccaagagacauguua

SEQ ID NO: 27058 - RNA, 21 nt, Artificial Sequence
  RNA Oligomer
acaauagcaguuuccaucacc

SEQ ID NO: 27059 - RNA, 21 nt, Artificial Sequence
  RNA Oligomer
ccucagcagagcuucagguuu

SEQ ID NO: 27060 - RNA, 21 nt, Artificial Sequence
  RNA Oligomer
uccauguggacgcucuuucaa

SEQ ID NO: 27061 - RNA, 21 nt, Artificial Sequence
  RNA Oligomer
cacccuuuguacguggacuuc

SEQ ID NO: 27062 - RNA, 21 nt, Artificial Sequence
  RNA Oligomer
gccuuaaguccagcuguaaga

SEQ ID NO: 27063 - RNA, 21 nt, Artificial Sequence
  RNA Oligomer
agccaaacacaaacagcggaa

SEQ ID NO: 27064 - RNA, 21 nt, Artificial Sequence
  RNA Oligomer
gccaugauggaaaagggcauc

SEQ ID NO: 27065 - RNA, 21 nt, Artificial Sequence
  RNA Oligomer
agaugaacacagcuggucaca

SEQ ID NO: 27066 - RNA, 21 nt, Artificial Sequence
  RNA Oligomer
caagaugaacacagcugguca

SEQ ID NO: 27067 - RNA, 21 nt, Artificial Sequence
  RNA Oligomer
gggaaaguuuugaugucaccc

SEQ ID NO: 27068 - RNA, 21 nt, Artificial Sequence
  RNA Oligomer
ugccacggagaaugcccuuuu

SEQ ID NO: 27069 - RNA, 21 nt, Artificial Sequence
  RNA Oligomer
cgccuuaaguccagcuguaag

SEQ ID NO: 27070 - RNA, 21 nt, Artificial Sequence
  RNA Oligomer
gaaaagggcauccucuccaca

SEQ ID NO: 27071 - RNA, 21 nt, Artificial Sequence
  RNA Oligomer
cacuuggaggagaaacaaggu

SEQ ID NO: 27072 - RNA, 21 nt, Artificial Sequence
  RNA Oligomer
ugggaaaguuuugaugucacc

SEQ ID NO: 27073 - RNA, 21 nt, Artificial Sequence
  RNA Oligomer
ccuuaaguccagcuguaagag

SEQ ID NO: 27074 - RNA, 21 nt, Artificial Sequence
  RNA Oligomer
ccaugauggaaaagggcaucc

SEQ ID NO: 27075 - RNA, 21 nt, Artificial Sequence
  RNA Oligomer
gcaccaagaugaacacagcug

SEQ ID NO: 27076 - RNA, 21 nt, Artificial Sequence
  RNA Oligomer
acgcucuuucaauggacgugu

SEQ ID NO: 27077 - RNA, 21 nt, Artificial Sequence
  RNA Oligomer
cuguaagagacacccuuugua

SEQ ID NO: 27078 - RNA, 21 nt, Artificial Sequence
  RNA Oligomer
ccaagaugaacacagcugguc

SEQ ID NO: 27079 - RNA, 21 nt, Artificial Sequence
  RNA Oligomer
accaagaugaacacagcuggu

SEQ ID NO: 27080 - RNA, 21 nt, Artificial Sequence
  RNA Oligomer
ugcaccaagaugaacacagcu

SEQ ID NO: 27081 - RNA, 21 nt, Artificial Sequence
  RNA Oligomer
ugcaagaugcuuuaggaaaca

SEQ ID NO: 27082 - RNA, 21 nt, Artificial Sequence
  RNA Oligomer
gcucuuucaauggacgugucc

SEQ ID NO: 27083 - RNA, 21 nt, Artificial Sequence
  RNA Oligomer
gaaugcccuuuuccucuggcu

SEQ ID NO: 27084 - RNA, 21 nt, Artificial Sequence
  RNA Oligomer
ggagaaugcccuuuuccucug

SEQ ID NO: 27085 - RNA, 21 nt, Artificial Sequence
  RNA Oligomer
cgucaagccaaacacaaacag

SEQ ID NO: 27086 - RNA, 21 nt, Artificial Sequence
  RNA Oligomer
cccacuuggaggagaaacaag

SEQ ID NO: 27087 - RNA, 21 nt, Artificial Sequence
  RNA Oligomer
ugcuuuaggaaacaauagcag

SEQ ID NO: 27088 - RNA, 21 nt, Artificial Sequence
  RNA Oligomer
cggagaaugcccuuuuccucu

SEQ ID NO: 27089 - RNA, 21 nt, Artificial Sequence
  RNA Oligomer
ugcccuuuuccucuggcugau

SEQ ID NO: 27090 - RNA, 21 nt, Artificial Sequence
  RNA Oligomer
uuguuuucccacucguuucug

SEQ ID NO: 27091 - RNA, 21 nt, Artificial Sequence
  RNA Oligomer
uuauccuaacaugucucuugg

SEQ ID NO: 27092 - RNA, 21 nt, Artificial Sequence
  RNA Oligomer
aaauuaaagaagaaucuccgg

SEQ ID NO: 27093 - RNA, 21 nt, Artificial Sequence
  RNA Oligomer
uucauucucgucaagguacag

SEQ ID NO: 27094 - RNA, 21 nt, Artificial Sequence
  RNA Oligomer
cucguuucugguaguucuucc

SEQ ID NO: 27095 - RNA, 21 nt, Artificial Sequence
  RNA Oligomer
uuuucauucucgucaagguac

SEQ ID NO: 27096 - RNA, 21 nt, Artificial Sequence
  RNA Oligomer
gacguuuuucucuuuugugga

SEQ ID NO: 27097 - RNA, 21 nt, Artificial Sequence
  RNA Oligomer
uugcauucugauucaccaacc

SEQ ID NO: 27098 - RNA, 21 nt, Artificial Sequence
  RNA Oligomer
auucucgucaagguacagcau

SEQ ID NO: 27099 - RNA, 21 nt, Artificial Sequence
  RNA Oligomer
uaggaaucuuagaguuaacag

SEQ ID NO: 27100 - RNA, 21 nt, Artificial Sequence
  RNA Oligomer
aauuaaagaagaaucuccggg

SEQ ID NO: 27101 - RNA, 21 nt, Artificial Sequence
  RNA Oligomer
aaccuuuucauucucgucaag

SEQ ID NO: 27102 - RNA, 21 nt, Artificial Sequence
  RNA Oligomer
aucuuagaguuaacagaguug

SEQ ID NO: 27103 - RNA, 21 nt, Artificial Sequence
  RNA Oligomer
aaacuuucccaccugcuugca

SEQ ID NO: 27104 - RNA, 21 nt, Artificial Sequence
  RNA Oligomer
gaauuucgaguuggcuguugc

SEQ ID NO: 27105 - RNA, 21 nt, Artificial Sequence
  RNA Oligomer
auuaaagaagaaucuccgggu

SEQ ID NO: 27106 - RNA, 21 nt, Artificial Sequence
  RNA Oligomer
cauucucgucaagguacagca

SEQ ID NO: 27107 - RNA, 21 nt, Artificial Sequence
  RNA Oligomer
auugaaagagcguccacaugg

SEQ ID NO: 27108 - RNA, 21 nt, Artificial Sequence
  RNA Oligomer
aauacaaccuuuucauucucg

SEQ ID NO: 27109 - RNA, 21 nt, Artificial Sequence
  RNA Oligomer
augccuuaggaaucuuagagu

SEQ ID NO: 27110 - RNA, 21 nt, Artificial Sequence
  RNA Oligomer
cacauggaaaaacucugguca

SEQ ID NO: 27111 - RNA, 21 nt, Artificial Sequence
  RNA Oligomer
ucauggccaaaaguuacuagc

SEQ ID NO: 27112 - RNA, 21 nt, Artificial Sequence
  RNA Oligomer
cauggccaaaaguuacuagca

SEQ ID NO: 27113 - RNA, 21 nt, Artificial Sequence
  RNA Oligomer
aaaacuuucccaccugcuugc

SEQ ID NO: 27114 - RNA, 21 nt, Artificial Sequence
  RNA Oligomer
uuauucucccugcaaguucaa

SEQ ID NO: 27115 - RNA, 21 nt, Artificial Sequence
  RNA Oligomer
ucgagauagcacugaguucug

SEQ ID NO: 27116 - RNA, 21 nt, Artificial Sequence
  RNA Oligomer
agcaugccuuaggaaucuuag

SEQ ID NO: 27117 - RNA, 21 nt, Artificial Sequence
  RNA Oligomer
ucuuagaguuaacagaguuga

SEQ ID NO: 27118 - RNA, 21 nt, Artificial Sequence
  RNA Oligomer
guuuccgcuguuuguguuugg

SEQ ID NO: 27119 - RNA, 21 nt, Artificial Sequence
  RNA Oligomer
uugacguuuuucucuuuugug

SEQ ID NO: 27120 - RNA, 21 nt, Artificial Sequence
  RNA Oligomer
cugcuugcauucugauucacc

SEQ ID NO: 27121 - RNA, 21 nt, Artificial Sequence
  RNA Oligomer
ugcauucugauucaccaaccu

SEQ ID NO: 27122 - RNA, 21 nt, Artificial Sequence
  RNA Oligomer
ucgucaagguacagcaucgag

SEQ ID NO: 27123 - RNA, 21 nt, Artificial Sequence
  RNA Oligomer
aagguacagcaucgagauagc

SEQ ID NO: 27124 - RNA, 21 nt, Artificial Sequence
  RNA Oligomer
uucuccguggcaguaaaaggc

SEQ ID NO: 27125 - RNA, 21 nt, Artificial Sequence
  RNA Oligomer
uuuuccaucauggccaaaagu

SEQ ID NO: 27126 - RNA, 21 nt, Artificial Sequence
  RNA Oligomer
ugcuuauccuaacaugucucu

SEQ ID NO: 27127 - RNA, 21 nt, Artificial Sequence
  RNA Oligomer
uuucccaccugcuugcauucu

SEQ ID NO: 27128 - RNA, 21 nt, Artificial Sequence
  RNA Oligomer
cauucugauucaccaaccugg

SEQ ID NO: 27129 - RNA, 21 nt, Artificial Sequence
  RNA Oligomer
uguugcagguuuuaugauuuc

SEQ ID NO: 27130 - RNA, 21 nt, Artificial Sequence
  RNA Oligomer
uuaaagaagaaucuccggguu

SEQ ID NO: 27131 - RNA, 21 nt, Artificial Sequence
  RNA Oligomer
cccugcaaguucaagaagucc

SEQ ID NO: 27132 - RNA, 21 nt, Artificial Sequence
  RNA Oligomer
aucgagauagcacugaguucu

SEQ ID NO: 27133 - RNA, 21 nt, Artificial Sequence
  RNA Oligomer
aguggaguucagaugaucagc

SEQ ID NO: 27134 - RNA, 21 nt, Artificial Sequence
  RNA Oligomer
uucucccugcaaguucaagaa

SEQ ID NO: 27135 - RNA, 21 nt, Artificial Sequence
  RNA Oligomer
cuugacguuuuucucuuuugu

SEQ ID NO: 27136 - RNA, 21 nt, Artificial Sequence
  RNA Oligomer
aucauggccaaaaguuacuag

SEQ ID NO: 27137 - RNA, 21 nt, Artificial Sequence
  RNA Oligomer
ucucccugcaaguucaagaag

SEQ ID NO: 27138 - RNA, 21 nt, Artificial Sequence
  RNA Oligomer
gaccugcuuauccuaacaugu

SEQ ID NO: 27139 - RNA, 21 nt, Artificial Sequence
  RNA Oligomer
ugacaucaaaacuuucccacc

SEQ ID NO: 27140 - RNA, 21 nt, Artificial Sequence
  RNA Oligomer
cuuucccaccugcuugcauuc

SEQ ID NO: 27141 - RNA, 21 nt, Artificial Sequence
  RNA Oligomer
guugcagguuuuaugauuuca

SEQ ID NO: 27142 - RNA, 21 nt, Artificial Sequence
  RNA Oligomer
uacaaccuuuucauucucguc

SEQ ID NO: 27143 - RNA, 21 nt, Artificial Sequence
  RNA Oligomer
auggaaaaacucuggucaaag

SEQ ID NO: 27144 - RNA, 21 nt, Artificial Sequence
  RNA Oligomer
uuuggcuugacguuuuucucu

SEQ ID NO: 27145 - RNA, 21 nt, Artificial Sequence
  RNA Oligomer
aaagaccugcuuauccuaaca

SEQ ID NO: 27146 - RNA, 21 nt, Artificial Sequence
  RNA Oligomer
aagaccugcuuauccuaacau

SEQ ID NO: 27147 - RNA, 21 nt, Artificial Sequence
  RNA Oligomer
cugcuuauccuaacaugucuc

SEQ ID NO: 27148 - RNA, 21 nt, Artificial Sequence
  RNA Oligomer
caucaaaacuuucccaccugc

SEQ ID NO: 27149 - RNA, 21 nt, Artificial Sequence
  RNA Oligomer
aucaaaacuuucccaccugcu

SEQ ID NO: 27150 - RNA, 21 nt, Artificial Sequence
  RNA Oligomer
ucccaccugcuugcauucuga

SEQ ID NO: 27151 - RNA, 21 nt, Artificial Sequence
  RNA Oligomer
ggaaucuuagaguuaacagag

SEQ ID NO: 27152 - RNA, 21 nt, Artificial Sequence
  RNA Oligomer
guucagaugaucagccagagg

SEQ ID NO: 27153 - RNA, 21 nt, Artificial Sequence
  RNA Oligomer
auucuccguggcaguaaaagg

SEQ ID NO: 27154 - RNA, 21 nt, Artificial Sequence
  RNA Oligomer
acugaaguccacguacaaagg

SEQ ID NO: 27155 - RNA, 21 nt, Artificial Sequence
  RNA Oligomer
cugaaguccacguacaaaggg

SEQ ID NO: 27156 - RNA, 21 nt, Artificial Sequence
  RNA Oligomer
ugacguuuuucucuuuugugg

SEQ ID NO: 27157 - RNA, 21 nt, Artificial Sequence
  RNA Oligomer
cuuaucugugaccagcugugu

SEQ ID NO: 27158 - RNA, 21 nt, Artificial Sequence
  RNA Oligomer
uuccuuuucuuugccuccucc

SEQ ID NO: 27159 - RNA, 21 nt, Artificial Sequence
  RNA Oligomer
gugacaucaaaacuuucccac

SEQ ID NO: 27160 - RNA, 21 nt, Artificial Sequence
  RNA Oligomer
uccuaaagcaucuugcaucug

SEQ ID NO: 27161 - RNA, 21 nt, Artificial Sequence
  RNA Oligomer
guccugauaguucuuuaauac

SEQ ID NO: 27162 - RNA, 21 nt, Artificial Sequence
  RNA Oligomer
auacaaccuuuucauucucgu

SEQ ID NO: 27163 - RNA, 21 nt, Artificial Sequence
  RNA Oligomer
caaccugguguccaaaagucu

SEQ ID NO: 27164 - RNA, 21 nt, Artificial Sequence
  RNA Oligomer
uaguucuuccaaagauucuuc

SEQ ID NO: 27165 - RNA, 21 nt, Artificial Sequence
  RNA Oligomer
aacccuccacaaccauguccu

SEQ ID NO: 27166 - RNA, 21 nt, Artificial Sequence
  RNA Oligomer
aguucagaugaucagccagag

SEQ ID NO: 27167 - RNA, 21 nt, Artificial Sequence
  RNA Oligomer
cacaauccagucauuccaccc

SEQ ID NO: 27168 - RNA, 21 nt, Artificial Sequence
  RNA Oligomer
auuuugcuguacuagcgacac

SEQ ID NO: 27169 - RNA, 21 nt, Artificial Sequence
  RNA Oligomer
acaacccuccacaaccauguc

SEQ ID NO: 27170 - RNA, 21 nt, Artificial Sequence
  RNA Oligomer
uccacaaccauguccugauag

SEQ ID NO: 27171 - RNA, 21 nt, Artificial Sequence
  RNA Oligomer
acaucaaaacuuucccaccug

SEQ ID NO: 27172 - RNA, 21 nt, Artificial Sequence
  RNA Oligomer
uuuccgcuguuuguguuuggc

SEQ ID NO: 27173 - RNA, 21 nt, Artificial Sequence
  RNA Oligomer
uuaguggaguucagaugauca

SEQ ID NO: 27174 - RNA, 21 nt, Artificial Sequence
  RNA Oligomer
accugcuugcauucugauuca

SEQ ID NO: 27175 - RNA, 21 nt, Artificial Sequence
  RNA Oligomer
acugcuauuguuuccuaaagc

SEQ ID NO: 27176 - RNA, 21 nt, Artificial Sequence
  RNA Oligomer
aguucuuccaaagauucuuca

SEQ ID NO: 27177 - RNA, 21 nt, Artificial Sequence
  RNA Oligomer
uuaauuuugcuguacuagcga

SEQ ID NO: 27178 - RNA, 21 nt, Artificial Sequence
  RNA Oligomer
aauuuugcuguacuagcgaca

SEQ ID NO: 27179 - RNA, 21 nt, Artificial Sequence
  RNA Oligomer
aauggcaugauuaguggaguu

SEQ ID NO: 27180 - RNA, 21 nt, Artificial Sequence
  RNA Oligomer
ugauuaguggaguucagauga

SEQ ID NO: 27181 - RNA, 21 nt, Artificial Sequence
  RNA Oligomer
uuuuucucuuuuguggagagg

SEQ ID NO: 27182 - RNA, 21 nt, Artificial Sequence
  RNA Oligomer
uuacuagcaauggccuuaucu

SEQ ID NO: 27183 - RNA, 21 nt, Artificial Sequence
  RNA Oligomer
uuuaauuuugcuguacuagcg

SEQ ID NO: 27184 - RNA, 21 nt, Artificial Sequence
  RNA Oligomer
uuuugcuguacuagcgacacc

SEQ ID NO: 27185 - RNA, 21 nt, Artificial Sequence
  RNA Oligomer
caaaaguuacuagcaauggcc

SEQ ID NO: 27186 - RNA, 21 nt, Artificial Sequence
  RNA Oligomer
aaaaguuacuagcaauggccu

SEQ ID NO: 27187 - RNA, 21 nt, Artificial Sequence
  RNA Oligomer
uaaagcaucuugcaucuguuc

SEQ ID NO: 27188 - RNA, 21 nt, Artificial Sequence
  RNA Oligomer
uucucggaaaaccugaagcuc

SEQ ID NO: 27189 - RNA, 21 nt, Artificial Sequence
  RNA Oligomer
uuucccacucguuucugguag

SEQ ID NO: 27190 - RNA, 21 nt, Artificial Sequence
  RNA Oligomer
aacaauggcaugauuagugga

SEQ ID NO: 27191 - RNA, 21 nt, Artificial Sequence
  RNA Oligomer
augaucagccagaggaaaagg

SEQ ID NO: 27192 - RNA, 21 nt, Artificial Sequence
  RNA Oligomer
uaauucggugauggaaacugc

SEQ ID NO: 27193 - RNA, 21 nt, Artificial Sequence
  RNA Oligomer
aucuccggguuguuuucccac

SEQ ID NO: 27194 - RNA, 21 nt, Artificial Sequence
  RNA Oligomer
uuugcuguacuagcgacaccc

SEQ ID NO: 27195 - RNA, 21 nt, Artificial Sequence
  RNA Oligomer
uagcacugaguucugucggga

SEQ ID NO: 27196 - RNA, 21 nt, Artificial Sequence
  RNA Oligomer
uuaacagaguugaccaacguc

SEQ ID NO: 27197 - RNA, 21 nt, Artificial Sequence
  RNA Oligomer
auuaguggaguucagaugauc

SEQ ID NO: 27198 - RNA, 21 nt, Artificial Sequence
  RNA Oligomer
aacucuggucaaaggaccugg

SEQ ID NO: 27199 - RNA, 21 nt, Artificial Sequence
  RNA Oligomer
auacaggucuagcauguaggg

SEQ ID NO: 27200 - RNA, 21 nt, Artificial Sequence
  RNA Oligomer
aaggaccgaauguccguuccu

SEQ ID NO: 27201 - RNA, 21 nt, Artificial Sequence
  RNA Oligomer
uuaaggcguuuccgcuguuug

SEQ ID NO: 27202 - RNA, 21 nt, Artificial Sequence
  RNA Oligomer
guguuuggcuugacguuuuuc

SEQ ID NO: 27203 - RNA, 21 nt, Artificial Sequence
  RNA Oligomer
uuuucucuuuuguggagagga

SEQ ID NO: 27204 - RNA, 21 nt, Artificial Sequence
  RNA Oligomer
uagcaauggccuuaucuguga

SEQ ID NO: 27205 - RNA, 21 nt, Artificial Sequence
  RNA Oligomer
aucugugaccagcuguguuca

SEQ ID NO: 27206 - RNA, 21 nt, Artificial Sequence
  RNA Oligomer
aauucggugauggaaacugcu

SEQ ID NO: 27207 - RNA, 21 nt, Artificial Sequence
  RNA Oligomer
uguuuucccacucguuucugg

SEQ ID NO: 27208 - RNA, 21 nt, Artificial Sequence
  RNA Oligomer
uuucugguaguucuuccaaag

SEQ ID NO: 27209 - RNA, 21 nt, Artificial Sequence
  RNA Oligomer
uucuucaugguggaagcugcg

SEQ ID NO: 27210 - RNA, 21 nt, Artificial Sequence
  RNA Oligomer
uaauuuugcuguacuagcgac

SEQ ID NO: 27211 - RNA, 21 nt, Artificial Sequence
  RNA Oligomer
guccacauggaaaaacucugg

SEQ ID NO: 27212 - RNA, 21 nt, Artificial Sequence
  RNA Oligomer
uacagcaucgagauagcacug

SEQ ID NO: 27213 - RNA, 21 nt, Artificial Sequence
  RNA Oligomer
gauagcacugaguucugucgg

SEQ ID NO: 27214 - RNA, 21 nt, Artificial Sequence
  RNA Oligomer
uaguggaguucagaugaucag

SEQ ID NO: 27215 - RNA, 21 nt, Artificial Sequence
  RNA Oligomer
acaaagggugucucuuacagc

SEQ ID NO: 27216 - RNA, 21 nt, Artificial Sequence
  RNA Oligomer
uguuuguguuuggcuugacgu

SEQ ID NO: 27217 - RNA, 21 nt, Artificial Sequence
  RNA Oligomer
ucuuuuguggagaggaugccc

SEQ ID NO: 27218 - RNA, 21 nt, Artificial Sequence
  RNA Oligomer
uuggagacaccuuguuucucc

SEQ ID NO: 27219 - RNA, 21 nt, Artificial Sequence
  RNA Oligomer
uccaccacgaauccaugguug

SEQ ID NO: 27220 - RNA, 21 nt, Artificial Sequence
  RNA Oligomer
aaccugguguccaaaagucug

SEQ ID NO: 27221 - RNA, 21 nt, Artificial Sequence
  RNA Oligomer
cugguguccaaaagucugguc

SEQ ID NO: 27222 - RNA, 21 nt, Artificial Sequence
  RNA Oligomer
uguucucggaaaaccugaagc

SEQ ID NO: 27223 - RNA, 21 nt, Artificial Sequence
  RNA Oligomer
ucugcugaggugauaaacucc

SEQ ID NO: 27224 - RNA, 21 nt, Artificial Sequence
  RNA Oligomer
cugaggugauaaacuccuccg

SEQ ID NO: 27225 - RNA, 21 nt, Artificial Sequence
  RNA Oligomer
uucugguaguucuuccaaaga

SEQ ID NO: 27226 - RNA, 21 nt, Artificial Sequence
  RNA Oligomer
uuccaaagauucuucauggug

SEQ ID NO: 27227 - RNA, 21 nt, Artificial Sequence
  RNA Oligomer
uugcuguacuagcgacaccca

SEQ ID NO: 27228 - RNA, 21 nt, Artificial Sequence
  RNA Oligomer
aaccauguccugauaguucuu

SEQ ID NO: 27229 - RNA, 21 nt, Artificial Sequence
  RNA Oligomer
gaacaauggcaugauuagugg

SEQ ID NO: 27230 - RNA, 21 nt, Artificial Sequence
  RNA Oligomer
auggcaugauuaguggaguuc

SEQ ID NO: 27231 - RNA, 21 nt, Artificial Sequence
  RNA Oligomer
uggcaguaaaaggcgugauac

SEQ ID NO: 27232 - RNA, 21 nt, Artificial Sequence
  RNA Oligomer
aagggugucucuuacagcugg

SEQ ID NO: 27233 - RNA, 21 nt, Artificial Sequence
  RNA Oligomer
guuuuucucuuuuguggagag

SEQ ID NO: 27234 - RNA, 21 nt, Artificial Sequence
  RNA Oligomer
uacuagcaauggccuuaucug

SEQ ID NO: 27235 - RNA, 21 nt, Artificial Sequence
  RNA Oligomer
uauccuaacaugucucuugga

SEQ ID NO: 27236 - RNA, 21 nt, Artificial Sequence
  RNA Oligomer
aacaugucucuuggagacacc

SEQ ID NO: 27237 - RNA, 21 nt, Artificial Sequence
  RNA Oligomer
auuucgaguuggcuguugcag

SEQ ID NO: 27238 - RNA, 21 nt, Artificial Sequence
  RNA Oligomer
uuucgaguuggcuguugcagg

SEQ ID NO: 27239 - RNA, 21 nt, Artificial Sequence
  RNA Oligomer
aaagcaucuugcaucuguucu

SEQ ID NO: 27240 - RNA, 21 nt, Artificial Sequence
  RNA Oligomer
agcaucuugcaucuguucucg

SEQ ID NO: 27241 - RNA, 21 nt, Artificial Sequence
  RNA Oligomer
guuuucccacucguuucuggu

SEQ ID NO: 27242 - RNA, 21 nt, Artificial Sequence
  RNA Oligomer
auagcacugaguucugucggg

SEQ ID NO: 27243 - RNA, 21 nt, Artificial Sequence
  RNA Oligomer
ugaucagccagaggaaaaggg

SEQ ID NO: 27244 - RNA, 21 nt, Artificial Sequence
  RNA Oligomer
uuacagcuggacuuaaggcgu

SEQ ID NO: 27245 - RNA, 21 nt, Artificial Sequence
  RNA Oligomer
uaaggcguuuccgcuguuugu

SEQ ID NO: 27246 - RNA, 21 nt, Artificial Sequence
  RNA Oligomer
guuuggcuugacguuuuucuc

SEQ ID NO: 27247 - RNA, 21 nt, Artificial Sequence
  RNA Oligomer
uaucugugaccagcuguguuc

SEQ ID NO: 27248 - RNA, 21 nt, Artificial Sequence
  RNA Oligomer
aauuucgaguuggcuguugca

SEQ ID NO: 27249 - RNA, 21 nt, Artificial Sequence
  RNA Oligomer
auggaaacugcuauuguuucc

SEQ ID NO: 27250 - RNA, 21 nt, Artificial Sequence
  RNA Oligomer
gaaaaccugaagcucugcuga

SEQ ID NO: 27251 - RNA, 21 nt, Artificial Sequence
  RNA Oligomer
ucguuucugguaguucuucca

SEQ ID NO: 27252 - RNA, 21 nt, Artificial Sequence
  RNA Oligomer
ucuuccaaagauucuucaugg

SEQ ID NO: 27253 - RNA, 21 nt, Artificial Sequence
  RNA Oligomer
gauacaggucuagcauguagg

SEQ ID NO: 27254 - RNA, 21 nt, Artificial Sequence
  RNA Oligomer
agcguccacauggaaaaacuc

SEQ ID NO: 27255 - RNA, 21 nt, Artificial Sequence
  RNA Oligomer
uagaguuaacagaguugacca

SEQ ID NO: 27256 - RNA, 21 nt, Artificial Sequence
  RNA Oligomer
uugaccaacgucugaacaaug

SEQ ID NO: 27257 - RNA, 21 nt, Artificial Sequence
  RNA Oligomer
aacgucugaacaauggcauga

SEQ ID NO: 27258 - RNA, 21 nt, Artificial Sequence
  RNA Oligomer
uggcaugauuaguggaguuca

SEQ ID NO: 27259 - RNA, 21 nt, Artificial Sequence
  RNA Oligomer
aauggccuuaucugugaccag

SEQ ID NO: 27260 - RNA, 21 nt, Artificial Sequence
  RNA Oligomer
ucuuggagacaccuuguuucu

SEQ ID NO: 27261 - RNA, 21 nt, Artificial Sequence
  RNA Oligomer
auuguuuccuaaagcaucuug

SEQ ID NO: 27262 - RNA, 21 nt, Artificial Sequence
  RNA Oligomer
aaucuccggguuguuuuccca

SEQ ID NO: 27263 - RNA, 21 nt, Artificial Sequence
  RNA Oligomer
auucuucaugguggaagcugc

SEQ ID NO: 27264 - RNA, 21 nt, Artificial Sequence
  RNA Oligomer
ucuguuucaggccgaacaugc

SEQ ID NO: 27265 - RNA, 21 nt, Artificial Sequence
  RNA Oligomer
uuucaggccgaacaugcugag

SEQ ID NO: 27266 - RNA, 21 nt, Artificial Sequence
  RNA Oligomer
accuuuucauucucgucaagg

SEQ ID NO: 27267 - RNA, 21 nt, Artificial Sequence
  RNA Oligomer
gagauagcacugaguucuguc

SEQ ID NO: 27268 - RNA, 21 nt, Artificial Sequence
  RNA Oligomer
agauagcacugaguucugucg

SEQ ID NO: 27269 - RNA, 21 nt, Artificial Sequence
  RNA Oligomer
uuagaguuaacagaguugacc

SEQ ID NO: 27270 - RNA, 21 nt, Artificial Sequence
  RNA Oligomer
uucucuuuuguggagaggaug

SEQ ID NO: 27271 - RNA, 21 nt, Artificial Sequence
  RNA Oligomer
ucucuuuuguggagaggaugc

SEQ ID NO: 27272 - RNA, 21 nt, Artificial Sequence
  RNA Oligomer
gccaaaaguuacuagcaaugg

SEQ ID NO: 27273 - RNA, 21 nt, Artificial Sequence
  RNA Oligomer
auucugauucaccaaccuggu

SEQ ID NO: 27274 - RNA, 21 nt, Artificial Sequence
  RNA Oligomer
accugguguccaaaagucugg

SEQ ID NO: 27275 - RNA, 21 nt, Artificial Sequence
  RNA Oligomer
ucggaaaaccugaagcucugc

SEQ ID NO: 27276 - RNA, 21 nt, Artificial Sequence
  RNA Oligomer
uaaagaagaaucuccggguug

SEQ ID NO: 27277 - RNA, 21 nt, Artificial Sequence
  RNA Oligomer
agaaucuccggguuguuuucc

SEQ ID NO: 27278 - RNA, 21 nt, Artificial Sequence
  RNA Oligomer
cuuagaguuaacagaguugac

SEQ ID NO: 27279 - RNA, 21 nt, Artificial Sequence
  RNA Oligomer
gaccaacgucugaacaauggc

SEQ ID NO: 27280 - RNA, 21 nt, Artificial Sequence
  RNA Oligomer
aaacucuggucaaaggaccug

SEQ ID NO: 27281 - RNA, 21 nt, Artificial Sequence
  RNA Oligomer
aaguccacguacaaagggugu

SEQ ID NO: 27282 - RNA, 21 nt, Artificial Sequence
  RNA Oligomer
guccacguacaaagggugucu

SEQ ID NO: 27283 - RNA, 21 nt, Artificial Sequence
  RNA Oligomer
aaagggugucucuuacagcug

SEQ ID NO: 27284 - RNA, 21 nt, Artificial Sequence
  RNA Oligomer
aucuuggugcaaagaccugcu

SEQ ID NO: 27285 - RNA, 21 nt, Artificial Sequence
  RNA Oligomer
ugucucuuggagacaccuugu

SEQ ID NO: 27286 - RNA, 21 nt, Artificial Sequence
  RNA Oligomer
uguccaaaagucuggucacgg

SEQ ID NO: 27287 - RNA, 21 nt, Artificial Sequence
  RNA Oligomer
uggcuguugcagguuuuauga

SEQ ID NO: 27288 - RNA, 21 nt, Artificial Sequence
  RNA Oligomer
aucuguucucggaaaaccuga

SEQ ID NO: 27289 - RNA, 21 nt, Artificial Sequence
  RNA Oligomer
guucucggaaaaccugaagcu

SEQ ID NO: 27290 - RNA, 21 nt, Artificial Sequence
  RNA Oligomer
ugcgcaaguuauucucccugc

SEQ ID NO: 27291 - RNA, 21 nt, Artificial Sequence
  RNA Oligomer
agauucuucaugguggaagcu

SEQ ID NO: 27292 - RNA, 21 nt, Artificial Sequence
  RNA Oligomer
aacagaguugaccaacgucug

SEQ ID NO: 27293 - RNA, 21 nt, Artificial Sequence
  RNA Oligomer
aaaacucuggucaaaggaccu

SEQ ID NO: 27294 - RNA, 21 nt, Artificial Sequence
  RNA Oligomer
uccacguacaaagggugucuc

SEQ ID NO: 27295 - RNA, 21 nt, Artificial Sequence
  RNA Oligomer
agcuggacuuaaggcguuucc

SEQ ID NO: 27296 - RNA, 21 nt, Artificial Sequence
  RNA Oligomer
cucuuuuguggagaggaugcc

SEQ ID NO: 27297 - RNA, 21 nt, Artificial Sequence
  RNA Oligomer
agcaauggccuuaucugugac

SEQ ID NO: 27298 - RNA, 21 nt, Artificial Sequence
  RNA Oligomer
auccuaacaugucucuuggag

SEQ ID NO: 27299 - RNA, 21 nt, Artificial Sequence
  RNA Oligomer
ugauucaccaaccuggugucc

SEQ ID NO: 27300 - RNA, 21 nt, Artificial Sequence
  RNA Oligomer
auuaauucggugauggaaacu

SEQ ID NO: 27301 - RNA, 21 nt, Artificial Sequence
  RNA Oligomer
uggaaacugcuauuguuuccu

SEQ ID NO: 27302 - RNA, 21 nt, Artificial Sequence
  RNA Oligomer
uuguuuccuaaagcaucuugc

SEQ ID NO: 27303 - RNA, 21 nt, Artificial Sequence
  RNA Oligomer
gcaucuugcaucuguucucgg

SEQ ID NO: 27304 - RNA, 21 nt, Artificial Sequence
  RNA Oligomer
ugcugaggugauaaacuccuc

SEQ ID NO: 27305 - RNA, 21 nt, Artificial Sequence
  RNA Oligomer
gcugaggugauaaacuccucc

SEQ ID NO: 27306 - RNA, 21 nt, Artificial Sequence
  RNA Oligomer
auggucgaccuuuaggagacc

SEQ ID NO: 27307 - RNA, 21 nt, Artificial Sequence
  RNA Oligomer
guuaacagaguugaccaacgu

SEQ ID NO: 27308 - RNA, 21 nt, Artificial Sequence
  RNA Oligomer
aaaaacucuggucaaaggacc

SEQ ID NO: 27309 - RNA, 21 nt, Artificial Sequence
  RNA Oligomer
caauggccuuaucugugacca

SEQ ID NO: 27310 - RNA, 21 nt, Artificial Sequence
  RNA Oligomer
gagacaccuuguuucuccucc

SEQ ID NO: 27311 - RNA, 21 nt, Artificial Sequence
  RNA Oligomer
acuuccaccacgaauccaugg

SEQ ID NO: 27312 - RNA, 21 nt, Artificial Sequence
  RNA Oligomer
ugguguccaaaagucugguca

SEQ ID NO: 27313 - RNA, 21 nt, Artificial Sequence
  RNA Oligomer
aaccugaagcucugcugaggu

SEQ ID NO: 27314 - RNA, 21 nt, Artificial Sequence
  RNA Oligomer
ugaggugauaaacuccuccgu

SEQ ID NO: 27315 - RNA, 21 nt, Artificial Sequence
  RNA Oligomer
gaggugauaaacuccuccgug

SEQ ID NO: 27316 - RNA, 21 nt, Artificial Sequence
  RNA Oligomer
aagaaucuccggguuguuuuc

SEQ ID NO: 27317 - RNA, 21 nt, Artificial Sequence
  RNA Oligomer
gaaucuccggguuguuuuccc

SEQ ID NO: 27318 - RNA, 21 nt, Artificial Sequence
  RNA Oligomer
ugguaguucuuccaaagauuc

SEQ ID NO: 27319 - RNA, 21 nt, Artificial Sequence
  RNA Oligomer
accauggucgaccuuuaggag

SEQ ID NO: 27320 - RNA, 21 nt, Artificial Sequence
  RNA Oligomer
uaacagaguugaccaacgucu

SEQ ID NO: 27321 - RNA, 21 nt, Artificial Sequence
  RNA Oligomer
ugaccaacgucugaacaaugg

SEQ ID NO: 27322 - RNA, 21 nt, Artificial Sequence
  RNA Oligomer
uuuuguggagaggaugcccuu

SEQ ID NO: 27323 - RNA, 21 nt, Artificial Sequence
  RNA Oligomer
caucuuggugcaaagaccugc

SEQ ID NO: 27324 - RNA, 21 nt, Artificial Sequence
  RNA Oligomer
uuguuucuccuccaagugggc

SEQ ID NO: 27325 - RNA, 21 nt, Artificial Sequence
  RNA Oligomer
uuccaccacgaauccaugguu

SEQ ID NO: 27326 - RNA, 21 nt, Artificial Sequence
  RNA Oligomer
uuaauucggugauggaaacug

SEQ ID NO: 27327 - RNA, 21 nt, Artificial Sequence
  RNA Oligomer
uuccuaaagcaucuugcaucu

SEQ ID NO: 27328 - RNA, 21 nt, Artificial Sequence
  RNA Oligomer
aucuugcaucuguucucggaa

SEQ ID NO: 27329 - RNA, 21 nt, Artificial Sequence
  RNA Oligomer
cuuccaaagauucuucauggu

SEQ ID NO: 27330 - RNA, 21 nt, Artificial Sequence
  RNA Oligomer
aagauucuucaugguggaagc

SEQ ID NO: 27331 - RNA, 21 nt, Artificial Sequence
  RNA Oligomer
gacacguccauugaaagagcg

SEQ ID NO: 27332 - RNA, 21 nt, Artificial Sequence
  RNA Oligomer
acguccauugaaagagcgucc

SEQ ID NO: 27333 - RNA, 21 nt, Artificial Sequence
  RNA Oligomer
agguacagcaucgagauagca

SEQ ID NO: 27334 - RNA, 21 nt, Artificial Sequence
  RNA Oligomer
uucaucuuggugcaaagaccu

SEQ ID NO: 27335 - RNA, 21 nt, Artificial Sequence
  RNA Oligomer
uucugauucaccaaccuggug

SEQ ID NO: 27336 - RNA, 21 nt, Artificial Sequence
  RNA Oligomer
uuuucacgcugggaacagcgu

SEQ ID NO: 27337 - RNA, 21 nt, Artificial Sequence
  RNA Oligomer
aaaaccugaagcucugcugag

SEQ ID NO: 27338 - RNA, 21 nt, Artificial Sequence
  RNA Oligomer
aggugauaaacuccuccgugg

SEQ ID NO: 27339 - RNA, 21 nt, Artificial Sequence
  RNA Oligomer
uccaaagauucuucauggugg

SEQ ID NO: 27340 - RNA, 21 nt, Artificial Sequence
  RNA Oligomer
guggaguucagaugaucagcc

SEQ ID NO: 27341 - RNA, 21 nt, Artificial Sequence
  RNA Oligomer
uggaguucagaugaucagcca

SEQ ID NO: 27342 - RNA, 21 nt, Artificial Sequence
  RNA Oligomer
acgucacugaaguccacguac

SEQ ID NO: 27343 - RNA, 21 nt, Artificial Sequence
  RNA Oligomer
augcccuuuuccaucauggcc

SEQ ID NO: 27344 - RNA, 21 nt, Artificial Sequence
  RNA Oligomer
uaacaugucucuuggagacac

SEQ ID NO: 27345 - RNA, 21 nt, Artificial Sequence
  RNA Oligomer
ggugauggaaacugcuauugu

SEQ ID NO: 27346 - RNA, 21 nt, Artificial Sequence
  RNA Oligomer
aaaccugaagcucugcugagg

SEQ ID NO: 27347 - RNA, 21 nt, Artificial Sequence
  RNA Oligomer
uugaaagagcguccacaugga

SEQ ID NO: 27348 - RNA, 21 nt, Artificial Sequence
  RNA Oligomer
gaaguccacguacaaagggug

SEQ ID NO: 27349 - RNA, 21 nt, Artificial Sequence
  RNA Oligomer
ucuuacagcuggacuuaaggc

SEQ ID NO: 27350 - RNA, 21 nt, Artificial Sequence
  RNA Oligomer
uuccgcuguuuguguuuggcu

SEQ ID NO: 27351 - RNA, 21 nt, Artificial Sequence
  RNA Oligomer
gaugcccuuuuccaucauggc

SEQ ID NO: 27352 - RNA, 21 nt, Artificial Sequence
  RNA Oligomer
ugugaccagcuguguucaucu

SEQ ID NO: 27353 - RNA, 21 nt, Artificial Sequence
  RNA Oligomer
ugaccagcuguguucaucuug

SEQ ID NO: 27354 - RNA, 21 nt, Artificial Sequence
  RNA Oligomer
gggugacaucaaaacuuuccc

SEQ ID NO: 27355 - RNA, 21 nt, Artificial Sequence
  RNA Oligomer
aaaagggcauucuccguggca

SEQ ID NO: 27356 - RNA, 21 nt, Artificial Sequence
  RNA Oligomer
cuuacagcuggacuuaaggcg

SEQ ID NO: 27357 - RNA, 21 nt, Artificial Sequence
  RNA Oligomer
uguggagaggaugcccuuuuc

SEQ ID NO: 27358 - RNA, 21 nt, Artificial Sequence
  RNA Oligomer
accuuguuucuccuccaagug

SEQ ID NO: 27359 - RNA, 21 nt, Artificial Sequence
  RNA Oligomer
ggugacaucaaaacuuuccca

SEQ ID NO: 27360 - RNA, 21 nt, Artificial Sequence
  RNA Oligomer
cucuuacagcuggacuuaagg

SEQ ID NO: 27361 - RNA, 21 nt, Artificial Sequence
  RNA Oligomer
ggaugcccuuuuccaucaugg

SEQ ID NO: 27362 - RNA, 21 nt, Artificial Sequence
  RNA Oligomer
cagcuguguucaucuuggugc

SEQ ID NO: 27363 - RNA, 21 nt, Artificial Sequence
  RNA Oligomer
acacguccauugaaagagcgu

SEQ ID NO: 27364 - RNA, 21 nt, Artificial Sequence
  RNA Oligomer
uacaaagggugucucuuacag

SEQ ID NO: 27365 - RNA, 21 nt, Artificial Sequence
  RNA Oligomer
gaccagcuguguucaucuugg

SEQ ID NO: 27366 - RNA, 21 nt, Artificial Sequence
  RNA Oligomer
accagcuguguucaucuuggu

SEQ ID NO: 27367 - RNA, 21 nt, Artificial Sequence
  RNA Oligomer
agcuguguucaucuuggugca

SEQ ID NO: 27368 - RNA, 21 nt, Artificial Sequence
  RNA Oligomer
uguuuccuaaagcaucuugca

SEQ ID NO: 27369 - RNA, 21 nt, Artificial Sequence
  RNA Oligomer
ggacacguccauugaaagagc

SEQ ID NO: 27370 - RNA, 21 nt, Artificial Sequence
  RNA Oligomer
agccagaggaaaagggcauuc

SEQ ID NO: 27371 - RNA, 21 nt, Artificial Sequence
  RNA Oligomer
cagaggaaaagggcauucucc

SEQ ID NO: 27372 - RNA, 21 nt, Artificial Sequence
  RNA Oligomer
cuguuuguguuuggcuugacg

SEQ ID NO: 27373 - RNA, 21 nt, Artificial Sequence
  RNA Oligomer
cuuguuucuccuccaaguggg

SEQ ID NO: 27374 - RNA, 21 nt, Artificial Sequence
  RNA Oligomer
cugcuauuguuuccuaaagca

SEQ ID NO: 27375 - RNA, 21 nt, Artificial Sequence
  RNA Oligomer
agaggaaaagggcauucuccg

SEQ ID NO: 27376 - RNA, 21 nt, Artificial Sequence
  RNA Oligomer
aucagccagaggaaaagggca

SEQ ID NO: 27377 - RNA, 21 nt, Artificial Sequence
  RNA Oligomer
ggacuugugcuacuauauuuu

SEQ ID NO: 27378 - RNA, 21 nt, Artificial Sequence
  RNA Oligomer
agaaaaaaggugcuguagaaa

SEQ ID NO: 27379 - RNA, 21 nt, Artificial Sequence
  RNA Oligomer
ggagaucuagauacaggcuug

SEQ ID NO: 27380 - RNA, 21 nt, Artificial Sequence
  RNA Oligomer
ucauuuuacuucauccuccaa

SEQ ID NO: 27381 - RNA, 21 nt, Artificial Sequence
  RNA Oligomer
agaucuagauacaggcuugaa

SEQ ID NO: 27382 - RNA, 21 nt, Artificial Sequence
  RNA Oligomer
gccuuuucauuuuacuucauc

SEQ ID NO: 27383 - RNA, 21 nt, Artificial Sequence
  RNA Oligomer
ugaaccuuucucauggauuuu

SEQ ID NO: 27384 - RNA, 21 nt, Artificial Sequence
  RNA Oligomer
gucagcuacauaaacaguuuu

SEQ ID NO: 27385 - RNA, 21 nt, Artificial Sequence
  RNA Oligomer
gcagcggaguuuuaaacuuua

SEQ ID NO: 27386 - RNA, 21 nt, Artificial Sequence
  RNA Oligomer
ugucagcuacauaaacaguuu

SEQ ID NO: 27387 - RNA, 21 nt, Artificial Sequence
  RNA Oligomer
ggcuuagaaaacacaaagaca

SEQ ID NO: 27388 - RNA, 21 nt, Artificial Sequence
  RNA Oligomer
gcaccagguguuaauuuugau

SEQ ID NO: 27389 - RNA, 21 nt, Artificial Sequence
  RNA Oligomer
cuaauuacagugcagaacaaa

SEQ ID NO: 27390 - RNA, 21 nt, Artificial Sequence
  RNA Oligomer
ggcuaauuacagugcagaaca

SEQ ID NO: 27391 - RNA, 21 nt, Artificial Sequence
  RNA Oligomer
gcagauugagauaaagaaguu

SEQ ID NO: 27392 - RNA, 21 nt, Artificial Sequence
  RNA Oligomer
uccuaaaauguuuuucccugu

SEQ ID NO: 27393 - RNA, 21 nt, Artificial Sequence
  RNA Oligomer
guggauucaaagaacuuagau

SEQ ID NO: 27394 - RNA, 21 nt, Artificial Sequence
  RNA Oligomer
gagaucuagauacaggcuuga

SEQ ID NO: 27395 - RNA, 21 nt, Artificial Sequence
  RNA Oligomer
ucagcuacauaaacaguuuug

SEQ ID NO: 27396 - RNA, 21 nt, Artificial Sequence
  RNA Oligomer
ccuauuauggauacugguuuu

SEQ ID NO: 27397 - RNA, 21 nt, Artificial Sequence
  RNA Oligomer
cuaaaauguuuuucccugugu

SEQ ID NO: 27398 - RNA, 21 nt, Artificial Sequence
  RNA Oligomer
ccuaaaauguuuuucccugug

SEQ ID NO: 27399 - RNA, 21 nt, Artificial Sequence
  RNA Oligomer
gcuacuacucacauucauuua

SEQ ID NO: 27400 - RNA, 21 nt, Artificial Sequence
  RNA Oligomer
gugguaauuguggcuaaauau

SEQ ID NO: 27401 - RNA, 21 nt, Artificial Sequence
  RNA Oligomer
gggugguaauuguggcuaaau

SEQ ID NO: 27402 - RNA, 21 nt, Artificial Sequence
  RNA Oligomer
cucaauuguggagaagaaaaa

SEQ ID NO: 27403 - RNA, 21 nt, Artificial Sequence
  RNA Oligomer
ccagugguacaucuauggauu

SEQ ID NO: 27404 - RNA, 21 nt, Artificial Sequence
  RNA Oligomer
cagcggaguuuuaaacuuuaa

SEQ ID NO: 27405 - RNA, 21 nt, Artificial Sequence
  RNA Oligomer
gguugugaaaaugucugcuau

SEQ ID NO: 27406 - RNA, 21 nt, Artificial Sequence
  RNA Oligomer
ggagugaccagcaacuuugau

SEQ ID NO: 27407 - RNA, 21 nt, Artificial Sequence
  RNA Oligomer
ucaucauuccucagcuacuac

SEQ ID NO: 27408 - RNA, 21 nt, Artificial Sequence
  RNA Oligomer
cgggugguaauuguggcuaaa

SEQ ID NO: 27409 - RNA, 21 nt, Artificial Sequence
  RNA Oligomer
caaaaaagcuuuuacgaggua

SEQ ID NO: 27410 - RNA, 21 nt, Artificial Sequence
  RNA Oligomer
aagaaaaaaggugcuguagaa

SEQ ID NO: 27411 - RNA, 21 nt, Artificial Sequence
  RNA Oligomer
uucauuuuacuucauccucca

SEQ ID NO: 27412 - RNA, 21 nt, Artificial Sequence
  RNA Oligomer
gcuaauuacagugcagaacaa

SEQ ID NO: 27413 - RNA, 21 nt, Artificial Sequence
  RNA Oligomer
ugggcuaauuacagugcagaa

SEQ ID NO: 27414 - RNA, 21 nt, Artificial Sequence
  RNA Oligomer
caauucuucuugccgcaauua

SEQ ID NO: 27415 - RNA, 21 nt, Artificial Sequence
  RNA Oligomer
ccaaucucucaugugcgcuuc

SEQ ID NO: 27416 - RNA, 21 nt, Artificial Sequence
  RNA Oligomer
ugguugugaaaaugucugcua

SEQ ID NO: 27417 - RNA, 21 nt, Artificial Sequence
  RNA Oligomer
gcagucugccuuucguuguaa

SEQ ID NO: 27418 - RNA, 21 nt, Artificial Sequence
  RNA Oligomer
cagcuacauaaacaguuuugu

SEQ ID NO: 27419 - RNA, 21 nt, Artificial Sequence
  RNA Oligomer
gaccagcaacuuugauguuug

SEQ ID NO: 27420 - RNA, 21 nt, Artificial Sequence
  RNA Oligomer
gugaccagcaacuuugauguu

SEQ ID NO: 27421 - RNA, 21 nt, Artificial Sequence
  RNA Oligomer
ugaacaucuuaggucuuuuca

SEQ ID NO: 27422 - RNA, 21 nt, Artificial Sequence
  RNA Oligomer
agacauuagaauaccuagguu

SEQ ID NO: 27423 - RNA, 21 nt, Artificial Sequence
  RNA Oligomer
gcuuagaaaacacaaagacau

SEQ ID NO: 27424 - RNA, 21 nt, Artificial Sequence
  RNA Oligomer
gaagaaaaaaggugcuguaga

SEQ ID NO: 27425 - RNA, 21 nt, Artificial Sequence
  RNA Oligomer
gcaaaacugggcuaauuacag

SEQ ID NO: 27426 - RNA, 21 nt, Artificial Sequence
  RNA Oligomer
ccuuuucauuuuacuucaucc

SEQ ID NO: 27427 - RNA, 21 nt, Artificial Sequence
  RNA Oligomer
gggucucaaaaauaugcuuau

SEQ ID NO: 27428 - RNA, 21 nt, Artificial Sequence
  RNA Oligomer
gucccuggccuugaauaucau

SEQ ID NO: 27429 - RNA, 21 nt, Artificial Sequence
  RNA Oligomer
agcagcggaguuuuaaacuuu

SEQ ID NO: 27430 - RNA, 21 nt, Artificial Sequence
  RNA Oligomer
ggagaguguucuuuauucaau

SEQ ID NO: 27431 - RNA, 21 nt, Artificial Sequence
  RNA Oligomer
guaaacaggcuuuagucauua

SEQ ID NO: 27432 - RNA, 21 nt, Artificial Sequence
  RNA Oligomer
aaccuuucucauggauuuuug

SEQ ID NO: 27433 - RNA, 21 nt, Artificial Sequence
  RNA Oligomer
uggacuugugcuacuauauuu

SEQ ID NO: 27434 - RNA, 21 nt, Artificial Sequence
  RNA Oligomer
cugaacaucuuaggucuuuuc

SEQ ID NO: 27435 - RNA, 21 nt, Artificial Sequence
  RNA Oligomer
gaggugcauguugguauuuaa

SEQ ID NO: 27436 - RNA, 21 nt, Artificial Sequence
  RNA Oligomer
cacaaagacauuagaauaccu

SEQ ID NO: 27437 - RNA, 21 nt, Artificial Sequence
  RNA Oligomer
aggcuuagaaaacacaaagac

SEQ ID NO: 27438 - RNA, 21 nt, Artificial Sequence
  RNA Oligomer
cuggagaucuagauacaggcu

SEQ ID NO: 27439 - RNA, 21 nt, Artificial Sequence
  RNA Oligomer
gguguggcugucaguacuuuu

SEQ ID NO: 27440 - RNA, 21 nt, Artificial Sequence
  RNA Oligomer
caacuuugauguuugcacuaa

SEQ ID NO: 27441 - RNA, 21 nt, Artificial Sequence
  RNA Oligomer
ugaccagcaacuuugauguuu

SEQ ID NO: 27442 - RNA, 21 nt, Artificial Sequence
  RNA Oligomer
ggugguaauuguggcuaaaua

SEQ ID NO: 27443 - RNA, 21 nt, Artificial Sequence
  RNA Oligomer
gcgggugguaauuguggcuaa

SEQ ID NO: 27444 - RNA, 21 nt, Artificial Sequence
  RNA Oligomer
gcauguugguauuuaaaguag

SEQ ID NO: 27445 - RNA, 21 nt, Artificial Sequence
  RNA Oligomer
acaaaaaagcuuuuacgaggu

SEQ ID NO: 27446 - RNA, 21 nt, Artificial Sequence
  RNA Oligomer
aggugcauguugguauuuaaa

SEQ ID NO: 27447 - RNA, 21 nt, Artificial Sequence
  RNA Oligomer
gaggcuuagaaaacacaaaga

SEQ ID NO: 27448 - RNA, 21 nt, Artificial Sequence
  RNA Oligomer
gguguuaauuuugauccggug

SEQ ID NO: 27449 - RNA, 21 nt, Artificial Sequence
  RNA Oligomer
gggcuaauuacagugcagaac

SEQ ID NO: 27450 - RNA, 21 nt, Artificial Sequence
  RNA Oligomer
ucccuggccuugaauaucauu

SEQ ID NO: 27451 - RNA, 21 nt, Artificial Sequence
  RNA Oligomer
ugaagcagauugagauaaaga

SEQ ID NO: 27452 - RNA, 21 nt, Artificial Sequence
  RNA Oligomer
cuugaagcagauugagauaaa

SEQ ID NO: 27453 - RNA, 21 nt, Artificial Sequence
  RNA Oligomer
gcacuugaagcagauugagau

SEQ ID NO: 27454 - RNA, 21 nt, Artificial Sequence
  RNA Oligomer
uggguccugcagaucauauuu

SEQ ID NO: 27455 - RNA, 21 nt, Artificial Sequence
  RNA Oligomer
caaucucucaugugcgcuucu

SEQ ID NO: 27456 - RNA, 21 nt, Artificial Sequence
  RNA Oligomer
cccaaucucucaugugcgcuu

SEQ ID NO: 27457 - RNA, 21 nt, Artificial Sequence
  RNA Oligomer
uggagaguguucuuuauucaa

SEQ ID NO: 27458 - RNA, 21 nt, Artificial Sequence
  RNA Oligomer
guaaucauugaugcuugaaug

SEQ ID NO: 27459 - RNA, 21 nt, Artificial Sequence
  RNA Oligomer
cuauuauggauacugguuuug

SEQ ID NO: 27460 - RNA, 21 nt, Artificial Sequence
  RNA Oligomer
gcacacuuuuuuuuucuccua

SEQ ID NO: 27461 - RNA, 21 nt, Artificial Sequence
  RNA Oligomer
agcuacuacucacauucauuu

SEQ ID NO: 27462 - RNA, 21 nt, Artificial Sequence
  RNA Oligomer
ccacuugcacaauaucauuac

SEQ ID NO: 27463 - RNA, 21 nt, Artificial Sequence
  RNA Oligomer
guccuuaagucccugcuaaaa

SEQ ID NO: 27464 - RNA, 21 nt, Artificial Sequence
  RNA Oligomer
aguaguggauucaaagaacuu

SEQ ID NO: 27465 - RNA, 21 nt, Artificial Sequence
  RNA Oligomer
caaagacauuagaauaccuag

SEQ ID NO: 27466 - RNA, 21 nt, Artificial Sequence
  RNA Oligomer
ugaggcuuagaaaacacaaag

SEQ ID NO: 27467 - RNA, 21 nt, Artificial Sequence
  RNA Oligomer
ccagguguuaauuuugauccg

SEQ ID NO: 27468 - RNA, 21 nt, Artificial Sequence
  RNA Oligomer
gugcaccagguguuaauuuug

SEQ ID NO: 27469 - RNA, 21 nt, Artificial Sequence
  RNA Oligomer
gaaagugcaccagguguuaau

SEQ ID NO: 27470 - RNA, 21 nt, Artificial Sequence
  RNA Oligomer
guagaaagugcaccagguguu

SEQ ID NO: 27471 - RNA, 21 nt, Artificial Sequence
  RNA Oligomer
aaagaaguucaaguacgguau

SEQ ID NO: 27472 - RNA, 21 nt, Artificial Sequence
  RNA Oligomer
gagauaaagaaguucaaguac

SEQ ID NO: 27473 - RNA, 21 nt, Artificial Sequence
  RNA Oligomer
gaagcagauugagauaaagaa

SEQ ID NO: 27474 - RNA, 21 nt, Artificial Sequence
  RNA Oligomer
cacuugaagcagauugagaua

SEQ ID NO: 27475 - RNA, 21 nt, Artificial Sequence
  RNA Oligomer
agagaaacugaacaagaaaga

SEQ ID NO: 27476 - RNA, 21 nt, Artificial Sequence
  RNA Oligomer
acggucauguucagcuucauu

SEQ ID NO: 27477 - RNA, 21 nt, Artificial Sequence
  RNA Oligomer
ggcugucaguacuuuucauuu

SEQ ID NO: 27478 - RNA, 21 nt, Artificial Sequence
  RNA Oligomer
cuuugauguuugcacuaagau

SEQ ID NO: 27479 - RNA, 21 nt, Artificial Sequence
  RNA Oligomer
cuauuaugaguuuagcagucu

SEQ ID NO: 27480 - RNA, 21 nt, Artificial Sequence
  RNA Oligomer
guaacugguauucuuggguuu

SEQ ID NO: 27481 - RNA, 21 nt, Artificial Sequence
  RNA Oligomer
ccaucacuuuuucaucauucc

SEQ ID NO: 27482 - RNA, 21 nt, Artificial Sequence
  RNA Oligomer
ggcccacagaauaagauuuuc

SEQ ID NO: 27483 - RNA, 21 nt, Artificial Sequence
  RNA Oligomer
aggcccacagaauaagauuuu

SEQ ID NO: 27484 - RNA, 21 nt, Artificial Sequence
  RNA Oligomer
ugauacauagauaagggcuuu

SEQ ID NO: 27485 - RNA, 21 nt, Artificial Sequence
  RNA Oligomer
guaguggauucaaagaacuua

SEQ ID NO: 27486 - RNA, 21 nt, Artificial Sequence
  RNA Oligomer
acacaaagacauuagaauacc

SEQ ID NO: 27487 - RNA, 21 nt, Artificial Sequence
  RNA Oligomer
ucaugaggcuuagaaaacaca

SEQ ID NO: 27488 - RNA, 21 nt, Artificial Sequence
  RNA Oligomer
cuuauucaugaggcuuagaaa

SEQ ID NO: 27489 - RNA, 21 nt, Artificial Sequence
  RNA Oligomer
agguguuaauuuugauccggu

SEQ ID NO: 27490 - RNA, 21 nt, Artificial Sequence
  RNA Oligomer
aaagugcaccagguguuaauu

SEQ ID NO: 27491 - RNA, 21 nt, Artificial Sequence
  RNA Oligomer
gggaagcaccaucucuaacuc

SEQ ID NO: 27492 - RNA, 21 nt, Artificial Sequence
  RNA Oligomer
ugggucucaaaaauaugcuua

SEQ ID NO: 27493 - RNA, 21 nt, Artificial Sequence
  RNA Oligomer
caguauccucuucaagucuau

SEQ ID NO: 27494 - RNA, 21 nt, Artificial Sequence
  RNA Oligomer
gguccugcagaucauauuugu

SEQ ID NO: 27495 - RNA, 21 nt, Artificial Sequence
  RNA Oligomer
cuggagaguguucuuuauuca

SEQ ID NO: 27496 - RNA, 21 nt, Artificial Sequence
  RNA Oligomer
ucauguguucuggagaguguu

SEQ ID NO: 27497 - RNA, 21 nt, Artificial Sequence
  RNA Oligomer
uggcugucaguacuuuucauu

SEQ ID NO: 27498 - RNA, 21 nt, Artificial Sequence
  RNA Oligomer
gugaaaaugcugaguaugaca

SEQ ID NO: 27499 - RNA, 21 nt, Artificial Sequence
  RNA Oligomer
gaggauucaguaguacacaua

SEQ ID NO: 27500 - RNA, 21 nt, Artificial Sequence
  RNA Oligomer
cauuaaugugagagacuuaga

SEQ ID NO: 27501 - RNA, 21 nt, Artificial Sequence
  RNA Oligomer
ggcuuuagucauuaaugugag

SEQ ID NO: 27502 - RNA, 21 nt, Artificial Sequence
  RNA Oligomer
guauaaacucacaaacacaga

SEQ ID NO: 27503 - RNA, 21 nt, Artificial Sequence
  RNA Oligomer
gucgaagaguuuguuuuguuu

SEQ ID NO: 27504 - RNA, 21 nt, Artificial Sequence
  RNA Oligomer
ucacuuuuucaucauuccuca

SEQ ID NO: 27505 - RNA, 21 nt, Artificial Sequence
  RNA Oligomer
ccauccacuugcacaauauca

SEQ ID NO: 27506 - RNA, 21 nt, Artificial Sequence
  RNA Oligomer
gcccacagaauaagauuuucc

SEQ ID NO: 27507 - RNA, 21 nt, Artificial Sequence
  RNA Oligomer
caaggcccacagaauaagauu

SEQ ID NO: 27508 - RNA, 21 nt, Artificial Sequence
  RNA Oligomer
caauggacuugugcuacuaua

SEQ ID NO: 27509 - RNA, 21 nt, Artificial Sequence
  RNA Oligomer
caagaaaaagacagaggauug

SEQ ID NO: 27510 - RNA, 21 nt, Artificial Sequence
  RNA Oligomer
agagaggugcauguugguauu

SEQ ID NO: 27511 - RNA, 21 nt, Artificial Sequence
  RNA Oligomer
caugaggcuuagaaaacacaa

SEQ ID NO: 27512 - RNA, 21 nt, Artificial Sequence
  RNA Oligomer
gugggucucaaaaauaugcuu

SEQ ID NO: 27513 - RNA, 21 nt, Artificial Sequence
  RNA Oligomer
acaucuauggauucagcuuga

SEQ ID NO: 27514 - RNA, 21 nt, Artificial Sequence
  RNA Oligomer
guacaucuauggauucagcuu

SEQ ID NO: 27515 - RNA, 21 nt, Artificial Sequence
  RNA Oligomer
ugcgaaccuacaucaucagua

SEQ ID NO: 27516 - RNA, 21 nt, Artificial Sequence
  RNA Oligomer
acagcagcggaguuuuaaacu

SEQ ID NO: 27517 - RNA, 21 nt, Artificial Sequence
  RNA Oligomer
aagaaguucaaguacgguauu

SEQ ID NO: 27518 - RNA, 21 nt, Artificial Sequence
  RNA Oligomer
gaacucaagguugcccaaacu

SEQ ID NO: 27519 - RNA, 21 nt, Artificial Sequence
  RNA Oligomer
ccugcagaucauauuuguguc

SEQ ID NO: 27520 - RNA, 21 nt, Artificial Sequence
  RNA Oligomer
guugugaaaaugucugcuaug

SEQ ID NO: 27521 - RNA, 21 nt, Artificial Sequence
  RNA Oligomer
uucuggagaguguucuuuauu

SEQ ID NO: 27522 - RNA, 21 nt, Artificial Sequence
  RNA Oligomer
agaucauguguucuggagagu

SEQ ID NO: 27523 - RNA, 21 nt, Artificial Sequence
  RNA Oligomer
cugucaguacuuuucauuuuc

SEQ ID NO: 27524 - RNA, 21 nt, Artificial Sequence
  RNA Oligomer
caucuaccaguuucuccaaau

SEQ ID NO: 27525 - RNA, 21 nt, Artificial Sequence
  RNA Oligomer
acuuugauguuugcacuaaga

SEQ ID NO: 27526 - RNA, 21 nt, Artificial Sequence
  RNA Oligomer
aacuuugauguuugcacuaag

SEQ ID NO: 27527 - RNA, 21 nt, Artificial Sequence
  RNA Oligomer
ugaauuuugcaguaacuggua

SEQ ID NO: 27528 - RNA, 21 nt, Artificial Sequence
  RNA Oligomer
caggcuuuagucauuaaugug

SEQ ID NO: 27529 - RNA, 21 nt, Artificial Sequence
  RNA Oligomer
cacuuuuucaucauuccucag

SEQ ID NO: 27530 - RNA, 21 nt, Artificial Sequence
  RNA Oligomer
accaucacuuuuucaucauuc

SEQ ID NO: 27531 - RNA, 21 nt, Artificial Sequence
  RNA Oligomer
aauggacuugugcuacuauau

SEQ ID NO: 27532 - RNA, 21 nt, Artificial Sequence
  RNA Oligomer
caacaagaaaaagacagagga

SEQ ID NO: 27533 - RNA, 21 nt, Artificial Sequence
  RNA Oligomer
ccuaagaaugguucuguguau

SEQ ID NO: 27534 - RNA, 21 nt, Artificial Sequence
  RNA Oligomer
acauuagaauaccuagguuca

SEQ ID NO: 27535 - RNA, 21 nt, Artificial Sequence
  RNA Oligomer
gacauuagaauaccuagguuc

SEQ ID NO: 27536 - RNA, 21 nt, Artificial Sequence
  RNA Oligomer
caccagguguuaauuuugauc

SEQ ID NO: 27537 - RNA, 21 nt, Artificial Sequence
  RNA Oligomer
gguacaucuauggauucagcu

SEQ ID NO: 27538 - RNA, 21 nt, Artificial Sequence
  RNA Oligomer
gugguacaucuauggauucag

SEQ ID NO: 27539 - RNA, 21 nt, Artificial Sequence
  RNA Oligomer
caucaucaguauccucuucaa

SEQ ID NO: 27540 - RNA, 21 nt, Artificial Sequence
  RNA Oligomer
acaucaucaguauccucuuca

SEQ ID NO: 27541 - RNA, 21 nt, Artificial Sequence
  RNA Oligomer
cagcagcggaguuuuaaacuu

SEQ ID NO: 27542 - RNA, 21 nt, Artificial Sequence
  RNA Oligomer
aaguacgguauugaagagcau

SEQ ID NO: 27543 - RNA, 21 nt, Artificial Sequence
  RNA Oligomer
caaguacgguauugaagagca

SEQ ID NO: 27544 - RNA, 21 nt, Artificial Sequence
  RNA Oligomer
gaaacugaacaagaaagagga

SEQ ID NO: 27545 - RNA, 21 nt, Artificial Sequence
  RNA Oligomer
guccugcagaucauauuugug

SEQ ID NO: 27546 - RNA, 21 nt, Artificial Sequence
  RNA Oligomer
cuggguccugcagaucauauu

SEQ ID NO: 27547 - RNA, 21 nt, Artificial Sequence
  RNA Oligomer
ucccaaucucucaugugcgcu

SEQ ID NO: 27548 - RNA, 21 nt, Artificial Sequence
  RNA Oligomer
uguucuggagaguguucuuua

SEQ ID NO: 27549 - RNA, 21 nt, Artificial Sequence
  RNA Oligomer
gcugucaguacuuuucauuuu

SEQ ID NO: 27550 - RNA, 21 nt, Artificial Sequence
  RNA Oligomer
uacggucauguucagcuucau

SEQ ID NO: 27551 - RNA, 21 nt, Artificial Sequence
  RNA Oligomer
acacuuuucuucuugcaugca

SEQ ID NO: 27552 - RNA, 21 nt, Artificial Sequence
  RNA Oligomer
agaagauuggugaaaaugcug

SEQ ID NO: 27553 - RNA, 21 nt, Artificial Sequence
  RNA Oligomer
gaagacaucuaccaguuucuc

SEQ ID NO: 27554 - RNA, 21 nt, Artificial Sequence
  RNA Oligomer
uaacugguauucuuggguuuu

SEQ ID NO: 27555 - RNA, 21 nt, Artificial Sequence
  RNA Oligomer
gccuaaaugaauuuugcagua

SEQ ID NO: 27556 - RNA, 21 nt, Artificial Sequence
  RNA Oligomer
gcuuuagucauuaaugugaga

SEQ ID NO: 27557 - RNA, 21 nt, Artificial Sequence
  RNA Oligomer
ugucgaagaguuuguuuuguu

SEQ ID NO: 27558 - RNA, 21 nt, Artificial Sequence
  RNA Oligomer
auccacuugcacaauaucauu

SEQ ID NO: 27559 - RNA, 21 nt, Artificial Sequence
  RNA Oligomer
agaaugguucuguguauguga

SEQ ID NO: 27560 - RNA, 21 nt, Artificial Sequence
  RNA Oligomer
cuaagaaugguucuguguaug

SEQ ID NO: 27561 - RNA, 21 nt, Artificial Sequence
  RNA Oligomer
ggugauacauagauaagggcu

SEQ ID NO: 27562 - RNA, 21 nt, Artificial Sequence
  RNA Oligomer
gagaggugcauguugguauuu

SEQ ID NO: 27563 - RNA, 21 nt, Artificial Sequence
  RNA Oligomer
gugguacucaacagccuuauu

SEQ ID NO: 27564 - RNA, 21 nt, Artificial Sequence
  RNA Oligomer
cagugguacaucuauggauuc

SEQ ID NO: 27565 - RNA, 21 nt, Artificial Sequence
  RNA Oligomer
cuucuugcugauccaguggua

SEQ ID NO: 27566 - RNA, 21 nt, Artificial Sequence
  RNA Oligomer
cagauugagauaaagaaguuc

SEQ ID NO: 27567 - RNA, 21 nt, Artificial Sequence
  RNA Oligomer
gagaaacugaacaagaaagag

SEQ ID NO: 27568 - RNA, 21 nt, Artificial Sequence
  RNA Oligomer
ggguccugcagaucauauuug

SEQ ID NO: 27569 - RNA, 21 nt, Artificial Sequence
  RNA Oligomer
gucuuucccaaucucucaugu

SEQ ID NO: 27570 - RNA, 21 nt, Artificial Sequence
  RNA Oligomer
uguguucuggagaguguucuu

SEQ ID NO: 27571 - RNA, 21 nt, Artificial Sequence
  RNA Oligomer
ugacauuccauguuaaacuac

SEQ ID NO: 27572 - RNA, 21 nt, Artificial Sequence
  RNA Oligomer
cacuuuucuucuugcaugcau

SEQ ID NO: 27573 - RNA, 21 nt, Artificial Sequence
  RNA Oligomer
ggugaaaaugcugaguaugac

SEQ ID NO: 27574 - RNA, 21 nt, Artificial Sequence
  RNA Oligomer
gauuggugaaaaugcugagua

SEQ ID NO: 27575 - RNA, 21 nt, Artificial Sequence
  RNA Oligomer
agauuggugaaaaugcugagu

SEQ ID NO: 27576 - RNA, 21 nt, Artificial Sequence
  RNA Oligomer
cacagaagauuggugaaaaug

SEQ ID NO: 27577 - RNA, 21 nt, Artificial Sequence
  RNA Oligomer
aagguguggcugucaguacuu

SEQ ID NO: 27578 - RNA, 21 nt, Artificial Sequence
  RNA Oligomer
guuucuccaaaugccuuuuuu

SEQ ID NO: 27579 - RNA, 21 nt, Artificial Sequence
  RNA Oligomer
aguuucuccaaaugccuuuuu

SEQ ID NO: 27580 - RNA, 21 nt, Artificial Sequence
  RNA Oligomer
gcaagagagguugaaagagga

SEQ ID NO: 27581 - RNA, 21 nt, Artificial Sequence
  RNA Oligomer
acaggcuuuagucauuaaugu

SEQ ID NO: 27582 - RNA, 21 nt, Artificial Sequence
  RNA Oligomer
gugaaugagcgggugguaauu

SEQ ID NO: 27583 - RNA, 21 nt, Artificial Sequence
  RNA Oligomer
ugguucuguguaugugaauga

SEQ ID NO: 27584 - RNA, 21 nt, Artificial Sequence
  RNA Oligomer
gugcauguugguauuuaaagu

SEQ ID NO: 27585 - RNA, 21 nt, Artificial Sequence
  RNA Oligomer
agaggugcauguugguauuua

SEQ ID NO: 27586 - RNA, 21 nt, Artificial Sequence
  RNA Oligomer
ucaguauccucuucaagucua

SEQ ID NO: 27587 - RNA, 21 nt, Artificial Sequence
  RNA Oligomer
guggcugucaguacuuuucau

SEQ ID NO: 27588 - RNA, 21 nt, Artificial Sequence
  RNA Oligomer
acuuuucuucuugcaugcaug

SEQ ID NO: 27589 - RNA, 21 nt, Artificial Sequence
  RNA Oligomer
caagagagguugaaagaggau

SEQ ID NO: 27590 - RNA, 21 nt, Artificial Sequence
  RNA Oligomer
ugugugucgaagaguuuguuu

SEQ ID NO: 27591 - RNA, 21 nt, Artificial Sequence
  RNA Oligomer
cuacucacauucauuuaaugg

SEQ ID NO: 27592 - RNA, 21 nt, Artificial Sequence
  RNA Oligomer
caucacuuuuucaucauuccu

SEQ ID NO: 27593 - RNA, 21 nt, Artificial Sequence
  RNA Oligomer
uccacuugcacaauaucauua

SEQ ID NO: 27594 - RNA, 21 nt, Artificial Sequence
  RNA Oligomer
acaagaaaaagacagaggauu

SEQ ID NO: 27595 - RNA, 21 nt, Artificial Sequence
  RNA Oligomer
gaaugguucuguguaugugaa

SEQ ID NO: 27596 - RNA, 21 nt, Artificial Sequence
  RNA Oligomer
gauacauagauaagggcuuuu

SEQ ID NO: 27597 - RNA, 21 nt, Artificial Sequence
  RNA Oligomer
gugauacauagauaagggcuu

SEQ ID NO: 27598 - RNA, 21 nt, Artificial Sequence
  RNA Oligomer
ggugguacucaacagccuuau

SEQ ID NO: 27599 - RNA, 21 nt, Artificial Sequence
  RNA Oligomer
ccaaagacugugggucucaaa

SEQ ID NO: 27600 - RNA, 21 nt, Artificial Sequence
  RNA Oligomer
ggccuugaauaucauugaacu

SEQ ID NO: 27601 - RNA, 21 nt, Artificial Sequence
  RNA Oligomer
acacuugcaaaagagaucccu

SEQ ID NO: 27602 - RNA, 21 nt, Artificial Sequence
  RNA Oligomer
gaagagaaacugaacaagaaa

SEQ ID NO: 27603 - RNA, 21 nt, Artificial Sequence
  RNA Oligomer
gcuaugacaagucuuucccaa

SEQ ID NO: 27604 - RNA, 21 nt, Artificial Sequence
  RNA Oligomer
cggucauguucagcuucauug

SEQ ID NO: 27605 - RNA, 21 nt, Artificial Sequence
  RNA Oligomer
auguuaaacuacggucauguu

SEQ ID NO: 27606 - RNA, 21 nt, Artificial Sequence
  RNA Oligomer
gccuuuuuuaaaacucaucac

SEQ ID NO: 27607 - RNA, 21 nt, Artificial Sequence
  RNA Oligomer
agaggauucaguaguacacau

SEQ ID NO: 27608 - RNA, 21 nt, Artificial Sequence
  RNA Oligomer
gaaagaggauucaguaguaca

SEQ ID NO: 27609 - RNA, 21 nt, Artificial Sequence
  RNA Oligomer
caguaacugguauucuugggu

SEQ ID NO: 27610 - RNA, 21 nt, Artificial Sequence
  RNA Oligomer
gaauuuugcaguaacugguau

SEQ ID NO: 27611 - RNA, 21 nt, Artificial Sequence
  RNA Oligomer
uuaguacuguaaacaggcuuu

SEQ ID NO: 27612 - RNA, 21 nt, Artificial Sequence
  RNA Oligomer
cauuauauaauuccugcugug

SEQ ID NO: 27613 - RNA, 21 nt, Artificial Sequence
  RNA Oligomer
cgaagaguuuguuuuguuugu

SEQ ID NO: 27614 - RNA, 21 nt, Artificial Sequence
  RNA Oligomer
agcuaaagucagggaaucaag

SEQ ID NO: 27615 - RNA, 21 nt, Artificial Sequence
  RNA Oligomer
cguauauucuuuuuccaucca

SEQ ID NO: 27616 - RNA, 21 nt, Artificial Sequence
  RNA Oligomer
gacaaggcccacagaauaaga

SEQ ID NO: 27617 - RNA, 21 nt, Artificial Sequence
  RNA Oligomer
agcgggugguaauuguggcua

SEQ ID NO: 27618 - RNA, 21 nt, Artificial Sequence
  RNA Oligomer
gguucuguguaugugaaugag

SEQ ID NO: 27619 - RNA, 21 nt, Artificial Sequence
  RNA Oligomer
uaagaaugguucuguguaugu

SEQ ID NO: 27620 - RNA, 21 nt, Artificial Sequence
  RNA Oligomer
acauagauaagggcuuuuucu

SEQ ID NO: 27621 - RNA, 21 nt, Artificial Sequence
  RNA Oligomer
gaguuccauuaggugauacau

SEQ ID NO: 27622 - RNA, 21 nt, Artificial Sequence
  RNA Oligomer
agaguuccauuaggugauaca

SEQ ID NO: 27623 - RNA, 21 nt, Artificial Sequence
  RNA Oligomer
gaacuugccuuuucauuuuac

SEQ ID NO: 27624 - RNA, 21 nt, Artificial Sequence
  RNA Oligomer
caagucuaucuuugagguggc

SEQ ID NO: 27625 - RNA, 21 nt, Artificial Sequence
  RNA Oligomer
auccucuucaagucuaucuuu

SEQ ID NO: 27626 - RNA, 21 nt, Artificial Sequence
  RNA Oligomer
gcccaaacugauggugucaau

SEQ ID NO: 27627 - RNA, 21 nt, Artificial Sequence
  RNA Oligomer
ggaagagaaacugaacaagaa

SEQ ID NO: 27628 - RNA, 21 nt, Artificial Sequence
  RNA Oligomer
ugcuaugacaagucuuuccca

SEQ ID NO: 27629 - RNA, 21 nt, Artificial Sequence
  RNA Oligomer
aacuacggucauguucagcuu

SEQ ID NO: 27630 - RNA, 21 nt, Artificial Sequence
  RNA Oligomer
aguaacugguauucuuggguu

SEQ ID NO: 27631 - RNA, 21 nt, Artificial Sequence
  RNA Oligomer
uaguacuguaaacaggcuuua

SEQ ID NO: 27632 - RNA, 21 nt, Artificial Sequence
  RNA Oligomer
gugggccaauaugguguuuac

SEQ ID NO: 27633 - RNA, 21 nt, Artificial Sequence
  RNA Oligomer
gugugggccaauaugguguuu

SEQ ID NO: 27634 - RNA, 21 nt, Artificial Sequence
  RNA Oligomer
uaaugcacauaugguguucaa

SEQ ID NO: 27635 - RNA, 21 nt, Artificial Sequence
  RNA Oligomer
acaagcagauacaguauaaac

SEQ ID NO: 27636 - RNA, 21 nt, Artificial Sequence
  RNA Oligomer
ucgaagaguuuguuuuguuug

SEQ ID NO: 27637 - RNA, 21 nt, Artificial Sequence
  RNA Oligomer
gugugucgaagaguuuguuuu

SEQ ID NO: 27638 - RNA, 21 nt, Artificial Sequence
  RNA Oligomer
gacagaggauuguccuuaagu

SEQ ID NO: 27639 - RNA, 21 nt, Artificial Sequence
  RNA Oligomer
uaagaguuccauuaggugaua

SEQ ID NO: 27640 - RNA, 21 nt, Artificial Sequence
  RNA Oligomer
ugagcaaaacugggcuaauua

SEQ ID NO: 27641 - RNA, 21 nt, Artificial Sequence
  RNA Oligomer
ugcuuauuucaauggcugcuc

SEQ ID NO: 27642 - RNA, 21 nt, Artificial Sequence
  RNA Oligomer
gucuaucuuugagguggccuu

SEQ ID NO: 27643 - RNA, 21 nt, Artificial Sequence
  RNA Oligomer
gcaugucagcuacauaaacag

SEQ ID NO: 27644 - RNA, 21 nt, Artificial Sequence
  RNA Oligomer
gcaguaacugguauucuuggg

SEQ ID NO: 27645 - RNA, 21 nt, Artificial Sequence
  RNA Oligomer
gaguuuguuuuguuugucaug

SEQ ID NO: 27646 - RNA, 21 nt, Artificial Sequence
  RNA Oligomer
gagcuaaagucagggaaucaa

SEQ ID NO: 27647 - RNA, 21 nt, Artificial Sequence
  RNA Oligomer
guauauucuuuuuccauccac

SEQ ID NO: 27648 - RNA, 21 nt, Artificial Sequence
  RNA Oligomer
ccaugcauuugcaaauacgua

SEQ ID NO: 27649 - RNA, 21 nt, Artificial Sequence
  RNA Oligomer
gucccugcuaaaacauuccau

SEQ ID NO: 27650 - RNA, 21 nt, Artificial Sequence
  RNA Oligomer
acagugcagaacaaaaucgaa

SEQ ID NO: 27651 - RNA, 21 nt, Artificial Sequence
  RNA Oligomer
cuggccuugaauaucauugaa

SEQ ID NO: 27652 - RNA, 21 nt, Artificial Sequence
  RNA Oligomer
ggguuuuccuacuuaauacac

SEQ ID NO: 27653 - RNA, 21 nt, Artificial Sequence
  RNA Oligomer
ugugggccaauaugguguuua

SEQ ID NO: 27654 - RNA, 21 nt, Artificial Sequence
  RNA Oligomer
gcagauacaguauaaacucac

SEQ ID NO: 27655 - RNA, 21 nt, Artificial Sequence
  RNA Oligomer
acguauauucuuuuuccaucc

SEQ ID NO: 27656 - RNA, 21 nt, Artificial Sequence
  RNA Oligomer
ggacaugcacuugaagcagau

SEQ ID NO: 27657 - RNA, 21 nt, Artificial Sequence
  RNA Oligomer
agcacacuuuuuuuuucuccu

SEQ ID NO: 27658 - RNA, 21 nt, Artificial Sequence
  RNA Oligomer
ccaggugucaauggacuugug

SEQ ID NO: 27659 - RNA, 21 nt, Artificial Sequence
  RNA Oligomer
gccugaugaccuggagaucua

SEQ ID NO: 27660 - RNA, 21 nt, Artificial Sequence
  RNA Oligomer
uggccuugaauaucauugaac

SEQ ID NO: 27661 - RNA, 21 nt, Artificial Sequence
  RNA Oligomer
aaccaucuucaucaucuucau

SEQ ID NO: 27662 - RNA, 21 nt, Artificial Sequence
  RNA Oligomer
ggauucagcuugagugcuguu

SEQ ID NO: 27663 - RNA, 21 nt, Artificial Sequence
  RNA Oligomer
aaaggaagagaaacugaacaa

SEQ ID NO: 27664 - RNA, 21 nt, Artificial Sequence
  RNA Oligomer
gcaugcaugucagcuacauaa

SEQ ID NO: 27665 - RNA, 21 nt, Artificial Sequence
  RNA Oligomer
gcaacuuugauguuugcacua

SEQ ID NO: 27666 - RNA, 21 nt, Artificial Sequence
  RNA Oligomer
uguuuuucccuguguauccua

SEQ ID NO: 27667 - RNA, 21 nt, Artificial Sequence
  RNA Oligomer
ggcaaacuccuugacaagguu

SEQ ID NO: 27668 - RNA, 21 nt, Artificial Sequence
  RNA Oligomer
gcacaauaucauuaccaucac

SEQ ID NO: 27669 - RNA, 21 nt, Artificial Sequence
  RNA Oligomer
uccaugcauuugcaaauacgu

SEQ ID NO: 27670 - RNA, 21 nt, Artificial Sequence
  RNA Oligomer
caguuuaaaauucagacaagg

SEQ ID NO: 27671 - RNA, 21 nt, Artificial Sequence
  RNA Oligomer
ccuggccuugaauaucauuga

SEQ ID NO: 27672 - RNA, 21 nt, Artificial Sequence
  RNA Oligomer
accaucuucaucaucuucaug

SEQ ID NO: 27673 - RNA, 21 nt, Artificial Sequence
  RNA Oligomer
caauguggacaugcacuugaa

SEQ ID NO: 27674 - RNA, 21 nt, Artificial Sequence
  RNA Oligomer
caugcaugucagcuacauaaa

SEQ ID NO: 27675 - RNA, 21 nt, Artificial Sequence
  RNA Oligomer
gugagagacuuagaaaaaaug

SEQ ID NO: 27676 - RNA, 21 nt, Artificial Sequence
  RNA Oligomer
gaugaccuggagaucuagaua

SEQ ID NO: 27677 - RNA, 21 nt, Artificial Sequence
  RNA Oligomer
ugaugaccuggagaucuagau

SEQ ID NO: 27678 - RNA, 21 nt, Artificial Sequence
  RNA Oligomer
gccaaagacugugggucucaa

SEQ ID NO: 27679 - RNA, 21 nt, Artificial Sequence
  RNA Oligomer
caucuucaucaucuucaugcu

SEQ ID NO: 27680 - RNA, 21 nt, Artificial Sequence
  RNA Oligomer
gcgaaccuacaucaucaguau

SEQ ID NO: 27681 - RNA, 21 nt, Artificial Sequence
  RNA Oligomer
ugccuuucguuguaacacuca

SEQ ID NO: 27682 - RNA, 21 nt, Artificial Sequence
  RNA Oligomer
ggagaugagcagucugccuuu

SEQ ID NO: 27683 - RNA, 21 nt, Artificial Sequence
  RNA Oligomer
ggccaauaugguguuuacauu

SEQ ID NO: 27684 - RNA, 21 nt, Artificial Sequence
  RNA Oligomer
ucagcuacuacucacauucau

SEQ ID NO: 27685 - RNA, 21 nt, Artificial Sequence
  RNA Oligomer
ccucagcuacuacucacauuc

SEQ ID NO: 27686 - RNA, 21 nt, Artificial Sequence
  RNA Oligomer
ccacucaauuguggagaagaa

SEQ ID NO: 27687 - RNA, 21 nt, Artificial Sequence
  RNA Oligomer
ccugaugaccuggagaucuag

SEQ ID NO: 27688 - RNA, 21 nt, Artificial Sequence
  RNA Oligomer
acaauucuucuugccgcaauu

SEQ ID NO: 27689 - RNA, 21 nt, Artificial Sequence
  RNA Oligomer
agacugugggucucaaaaaua

SEQ ID NO: 27690 - RNA, 21 nt, Artificial Sequence
  RNA Oligomer
aggaagagaaacugaacaaga

SEQ ID NO: 27691 - RNA, 21 nt, Artificial Sequence
  RNA Oligomer
cuaugacaagucuuucccaau

SEQ ID NO: 27692 - RNA, 21 nt, Artificial Sequence
  RNA Oligomer
gccuuucguuguaacacucag

SEQ ID NO: 27693 - RNA, 21 nt, Artificial Sequence
  RNA Oligomer
cugccuuucguuguaacacuc

SEQ ID NO: 27694 - RNA, 21 nt, Artificial Sequence
  RNA Oligomer
guugaagacaucuaccaguuu

SEQ ID NO: 27695 - RNA, 21 nt, Artificial Sequence
  RNA Oligomer
gcagucuuuuggagugaccag

SEQ ID NO: 27696 - RNA, 21 nt, Artificial Sequence
  RNA Oligomer
cagauacaguauaaacucaca

SEQ ID NO: 27697 - RNA, 21 nt, Artificial Sequence
  RNA Oligomer
aucacuuauaugugugucgaa

SEQ ID NO: 27698 - RNA, 21 nt, Artificial Sequence
  RNA Oligomer
cagcuacuacucacauucauu

SEQ ID NO: 27699 - RNA, 21 nt, Artificial Sequence
  RNA Oligomer
gguacucaacagccuuauuca

SEQ ID NO: 27700 - RNA, 21 nt, Artificial Sequence
  RNA Oligomer
cacucaauuguggagaagaaa

SEQ ID NO: 27701 - RNA, 21 nt, Artificial Sequence
  RNA Oligomer
caaagacugugggucucaaaa

SEQ ID NO: 27702 - RNA, 21 nt, Artificial Sequence
  RNA Oligomer
gcugauccagugguacaucua

SEQ ID NO: 27703 - RNA, 21 nt, Artificial Sequence
  RNA Oligomer
ccaaacagcagcggaguuuua

SEQ ID NO: 27704 - RNA, 21 nt, Artificial Sequence
  RNA Oligomer
cucagcaaccugguugugaaa

SEQ ID NO: 27705 - RNA, 21 nt, Artificial Sequence
  RNA Oligomer
gaacuauauguugaagacauc

SEQ ID NO: 27706 - RNA, 21 nt, Artificial Sequence
  RNA Oligomer
ccagcaacuuugauguuugca

SEQ ID NO: 27707 - RNA, 21 nt, Artificial Sequence
  RNA Oligomer
ggacuauuaaaugugccuaaa

SEQ ID NO: 27708 - RNA, 21 nt, Artificial Sequence
  RNA Oligomer
gccaauaugguguuuacauua

SEQ ID NO: 27709 - RNA, 21 nt, Artificial Sequence
  RNA Oligomer
gggccaauaugguguuuacau

SEQ ID NO: 27710 - RNA, 21 nt, Artificial Sequence
  RNA Oligomer
gcacauaugguguucaaauuu

SEQ ID NO: 27711 - RNA, 21 nt, Artificial Sequence
  RNA Oligomer
acaaucacuuauauguguguc

SEQ ID NO: 27712 - RNA, 21 nt, Artificial Sequence
  RNA Oligomer
agauuuuccaugcauuugcaa

SEQ ID NO: 27713 - RNA, 21 nt, Artificial Sequence
  RNA Oligomer
gucaauggacuugugcuacua

SEQ ID NO: 27714 - RNA, 21 nt, Artificial Sequence
  RNA Oligomer
cuuaagucccugcuaaaacau

SEQ ID NO: 27715 - RNA, 21 nt, Artificial Sequence
  RNA Oligomer
gguauuuaaaguaguggauuc

SEQ ID NO: 27716 - RNA, 21 nt, Artificial Sequence
  RNA Oligomer
ugaccuggagaucuagauaca

SEQ ID NO: 27717 - RNA, 21 nt, Artificial Sequence
  RNA Oligomer
gugagcaaaacugggcuaauu

SEQ ID NO: 27718 - RNA, 21 nt, Artificial Sequence
  RNA Oligomer
gaaacaauucuucuugccgca

SEQ ID NO: 27719 - RNA, 21 nt, Artificial Sequence
  RNA Oligomer
gcgacagaaacaauucuucuu

SEQ ID NO: 27720 - RNA, 21 nt, Artificial Sequence
  RNA Oligomer
ucuuggguuuuccuacuuaau

SEQ ID NO: 27721 - RNA, 21 nt, Artificial Sequence
  RNA Oligomer
gucauuaaugugagagacuua

SEQ ID NO: 27722 - RNA, 21 nt, Artificial Sequence
  RNA Oligomer
gaaucaagccaugcuuaauau

SEQ ID NO: 27723 - RNA, 21 nt, Artificial Sequence
  RNA Oligomer
uuccauccacuugcacaauau

SEQ ID NO: 27724 - RNA, 21 nt, Artificial Sequence
  RNA Oligomer
acuuugaagguaagcuuucua

SEQ ID NO: 27725 - RNA, 21 nt, Artificial Sequence
  RNA Oligomer
cccugcuaaaacauuccauug

SEQ ID NO: 27726 - RNA, 21 nt, Artificial Sequence
  RNA Oligomer
ccauuaggugauacauagaua

SEQ ID NO: 27727 - RNA, 21 nt, Artificial Sequence
  RNA Oligomer
guacucaacagccuuauucau

SEQ ID NO: 27728 - RNA, 21 nt, Artificial Sequence
  RNA Oligomer
cuccaaggaguucaaucacuu

SEQ ID NO: 27729 - RNA, 21 nt, Artificial Sequence
  RNA Oligomer
cgaaccuacaucaucaguauc

SEQ ID NO: 27730 - RNA, 21 nt, Artificial Sequence
  RNA Oligomer
cuaguccaucagaucaugugu

SEQ ID NO: 27731 - RNA, 21 nt, Artificial Sequence
  RNA Oligomer
gcauguaauguagaccuaguc

SEQ ID NO: 27732 - RNA, 21 nt, Artificial Sequence
  RNA Oligomer
guacuguaaacaggcuuuagu

SEQ ID NO: 27733 - RNA, 21 nt, Artificial Sequence
  RNA Oligomer
agguaagcuuucuaggccuga

SEQ ID NO: 27734 - RNA, 21 nt, Artificial Sequence
  RNA Oligomer
ugcacuuugaagguaagcuuu

SEQ ID NO: 27735 - RNA, 21 nt, Artificial Sequence
  RNA Oligomer
ucccugcuaaaacauuccauu

SEQ ID NO: 27736 - RNA, 21 nt, Artificial Sequence
  RNA Oligomer
agugagcaaaacugggcuaau

SEQ ID NO: 27737 - RNA, 21 nt, Artificial Sequence
  RNA Oligomer
accuacaucaucaguauccuc

SEQ ID NO: 27738 - RNA, 21 nt, Artificial Sequence
  RNA Oligomer
gacaugcacuugaagcagauu

SEQ ID NO: 27739 - RNA, 21 nt, Artificial Sequence
  RNA Oligomer
ugaaaaugucugcuaugacaa

SEQ ID NO: 27740 - RNA, 21 nt, Artificial Sequence
  RNA Oligomer
guccaucagaucauguguucu

SEQ ID NO: 27741 - RNA, 21 nt, Artificial Sequence
  RNA Oligomer
ucacagaagauuggugaaaau

SEQ ID NO: 27742 - RNA, 21 nt, Artificial Sequence
  RNA Oligomer
cuauauguugaagacaucuac

SEQ ID NO: 27743 - RNA, 21 nt, Artificial Sequence
  RNA Oligomer
ucaguaguacacauacaacua

SEQ ID NO: 27744 - RNA, 21 nt, Artificial Sequence
  RNA Oligomer
guggacuauuaaaugugccua

SEQ ID NO: 27745 - RNA, 21 nt, Artificial Sequence
  RNA Oligomer
ggauauagcaguaaugcuauu

SEQ ID NO: 27746 - RNA, 21 nt, Artificial Sequence
  RNA Oligomer
gcaaguaaagcacacuuuuuu

SEQ ID NO: 27747 - RNA, 21 nt, Artificial Sequence
  RNA Oligomer
ggugugggccaauaugguguu

SEQ ID NO: 27748 - RNA, 21 nt, Artificial Sequence
  RNA Oligomer
ugguguucaaauuugaaccuu

SEQ ID NO: 27749 - RNA, 21 nt, Artificial Sequence
  RNA Oligomer
ugcacauaugguguucaaauu

SEQ ID NO: 27750 - RNA, 21 nt, Artificial Sequence
  RNA Oligomer
gcacuuugaagguaagcuuuc

SEQ ID NO: 27751 - RNA, 21 nt, Artificial Sequence
  RNA Oligomer
ggucuuuucaacaagaaaaag

SEQ ID NO: 27752 - RNA, 21 nt, Artificial Sequence
  RNA Oligomer
gaccuggagaucuagauacag

SEQ ID NO: 27753 - RNA, 21 nt, Artificial Sequence
  RNA Oligomer
cgacagaaacaauucuucuug

SEQ ID NO: 27754 - RNA, 21 nt, Artificial Sequence
  RNA Oligomer
ggaaagagcgacccuuaccau

SEQ ID NO: 27755 - RNA, 21 nt, Artificial Sequence
  RNA Oligomer
ugagguggccuucuugcugau

SEQ ID NO: 27756 - RNA, 21 nt, Artificial Sequence
  RNA Oligomer
cccaaacugauggugucaaug

SEQ ID NO: 27757 - RNA, 21 nt, Artificial Sequence
  RNA Oligomer
guaacacucagcaaccugguu

SEQ ID NO: 27758 - RNA, 21 nt, Artificial Sequence
  RNA Oligomer
gcuucauugcauguaauguag

SEQ ID NO: 27759 - RNA, 21 nt, Artificial Sequence
  RNA Oligomer
guucagcuucauugcauguaa

SEQ ID NO: 27760 - RNA, 21 nt, Artificial Sequence
  RNA Oligomer
uguugaagacaucuaccaguu

SEQ ID NO: 27761 - RNA, 21 nt, Artificial Sequence
  RNA Oligomer
agguugaaagaggauucagua

SEQ ID NO: 27762 - RNA, 21 nt, Artificial Sequence
  RNA Oligomer
agcaacuuugauguuugcacu

SEQ ID NO: 27763 - RNA, 21 nt, Artificial Sequence
  RNA Oligomer
cuguguauccuauuauggaua

SEQ ID NO: 27764 - RNA, 21 nt, Artificial Sequence
  RNA Oligomer
ugggccaauaugguguuuaca

SEQ ID NO: 27765 - RNA, 21 nt, Artificial Sequence
  RNA Oligomer
caguauaaacucacaaacaca

SEQ ID NO: 27766 - RNA, 21 nt, Artificial Sequence
  RNA Oligomer
cacuuauaugugugucgaaga

SEQ ID NO: 27767 - RNA, 21 nt, Artificial Sequence
  RNA Oligomer
uccucagcuacuacucacauu

SEQ ID NO: 27768 - RNA, 21 nt, Artificial Sequence
  RNA Oligomer
ucaauggacuugugcuacuau

SEQ ID NO: 27769 - RNA, 21 nt, Artificial Sequence
  RNA Oligomer
uguccuuaagucccugcuaaa

SEQ ID NO: 27770 - RNA, 21 nt, Artificial Sequence
  RNA Oligomer
cuuaggucuuuucaacaagaa

SEQ ID NO: 27771 - RNA, 21 nt, Artificial Sequence
  RNA Oligomer
gccuuauucaugaggcuuaga

SEQ ID NO: 27772 - RNA, 21 nt, Artificial Sequence
  RNA Oligomer
agauacaggcuugaaagcauc

SEQ ID NO: 27773 - RNA, 21 nt, Artificial Sequence
  RNA Oligomer
acagaaacaauucuucuugcc

SEQ ID NO: 27774 - RNA, 21 nt, Artificial Sequence
  RNA Oligomer
caggucugagugccugaacuu

SEQ ID NO: 27775 - RNA, 21 nt, Artificial Sequence
  RNA Oligomer
cuacaucaucaguauccucuu

SEQ ID NO: 27776 - RNA, 21 nt, Artificial Sequence
  RNA Oligomer
acacucagcaaccugguugug

SEQ ID NO: 27777 - RNA, 21 nt, Artificial Sequence
  RNA Oligomer
uucagcuucauugcauguaau

SEQ ID NO: 27778 - RNA, 21 nt, Artificial Sequence
  RNA Oligomer
ucauguucagcuucauugcau

SEQ ID NO: 27779 - RNA, 21 nt, Artificial Sequence
  RNA Oligomer
ugaagacaucuaccaguuucu

SEQ ID NO: 27780 - RNA, 21 nt, Artificial Sequence
  RNA Oligomer
uggaaugcaagagagguugaa

SEQ ID NO: 27781 - RNA, 21 nt, Artificial Sequence
  RNA Oligomer
uggagugaccagcaacuuuga

SEQ ID NO: 27782 - RNA, 21 nt, Artificial Sequence
  RNA Oligomer
agcaguaaugcuauuacugaa

SEQ ID NO: 27783 - RNA, 21 nt, Artificial Sequence
  RNA Oligomer
ggcaaguaaagcacacuuuuu

SEQ ID NO: 27784 - RNA, 21 nt, Artificial Sequence
  RNA Oligomer
gcaaacuccuugacaagguuc

SEQ ID NO: 27785 - RNA, 21 nt, Artificial Sequence
  RNA Oligomer
cucagcuacuacucacauuca

SEQ ID NO: 27786 - RNA, 21 nt, Artificial Sequence
  RNA Oligomer
ucagacaaggcccacagaaua

SEQ ID NO: 27787 - RNA, 21 nt, Artificial Sequence
  RNA Oligomer
uugcacuuugaagguaagcuu

SEQ ID NO: 27788 - RNA, 21 nt, Artificial Sequence
  RNA Oligomer
ggauuguccuuaagucccugc

SEQ ID NO: 27789 - RNA, 21 nt, Artificial Sequence
  RNA Oligomer
agacagaggauuguccuuaag

SEQ ID NO: 27790 - RNA, 21 nt, Artificial Sequence
  RNA Oligomer
cugaaauaauucuggccagga

SEQ ID NO: 27791 - RNA, 21 nt, Artificial Sequence
  RNA Oligomer
aggaguucaaucacuuggcgu

SEQ ID NO: 27792 - RNA, 21 nt, Artificial Sequence
  RNA Oligomer
ucaagauuccacucaauugug

SEQ ID NO: 27793 - RNA, 21 nt, Artificial Sequence
  RNA Oligomer
ggcgacagaaacaauucuucu

SEQ ID NO: 27794 - RNA, 21 nt, Artificial Sequence
  RNA Oligomer
gacugugggucucaaaaauau

SEQ ID NO: 27795 - RNA, 21 nt, Artificial Sequence
  RNA Oligomer
gcugcgaaccuacaucaucag

SEQ ID NO: 27796 - RNA, 21 nt, Artificial Sequence
  RNA Oligomer
gaaguucaaguacgguauuga

SEQ ID NO: 27797 - RNA, 21 nt, Artificial Sequence
  RNA Oligomer
ccaaacugauggugucaaugu

SEQ ID NO: 27798 - RNA, 21 nt, Artificial Sequence
  RNA Oligomer
ggcgugaggaaaguaccaaac

SEQ ID NO: 27799 - RNA, 21 nt, Artificial Sequence
  RNA Oligomer
agaccuaguccaucagaucau

SEQ ID NO: 27800 - RNA, 21 nt, Artificial Sequence
  RNA Oligomer
guagaccuaguccaucagauc

SEQ ID NO: 27801 - RNA, 21 nt, Artificial Sequence
  RNA Oligomer
uccauguuaaacuacggucau

SEQ ID NO: 27802 - RNA, 21 nt, Artificial Sequence
  RNA Oligomer
agcagucuuuuggagugacca

SEQ ID NO: 27803 - RNA, 21 nt, Artificial Sequence
  RNA Oligomer
ugguauucuuggguuuuccua

SEQ ID NO: 27804 - RNA, 21 nt, Artificial Sequence
  RNA Oligomer
uggacuauuaaaugugccuaa

SEQ ID NO: 27805 - RNA, 21 nt, Artificial Sequence
  RNA Oligomer
ucauugaugcuugaaugauag

SEQ ID NO: 27806 - RNA, 21 nt, Artificial Sequence
  RNA Oligomer
aggauauagcaguaaugcuau

SEQ ID NO: 27807 - RNA, 21 nt, Artificial Sequence
  RNA Oligomer
uccuauuauggauacugguuu

SEQ ID NO: 27808 - RNA, 21 nt, Artificial Sequence
  RNA Oligomer
guguauccuauuauggauacu

SEQ ID NO: 27809 - RNA, 21 nt, Artificial Sequence
  RNA Oligomer
ccuguguauccuauuauggau

SEQ ID NO: 27810 - RNA, 21 nt, Artificial Sequence
  RNA Oligomer
uggcaaguaaagcacacuuuu

SEQ ID NO: 27811 - RNA, 21 nt, Artificial Sequence
  RNA Oligomer
acaguauaaacucacaaacac

SEQ ID NO: 27812 - RNA, 21 nt, Artificial Sequence
  RNA Oligomer
cacaauaucauuaccaucacu

SEQ ID NO: 27813 - RNA, 21 nt, Artificial Sequence
  RNA Oligomer
ccuccaggugucaauggacuu

SEQ ID NO: 27814 - RNA, 21 nt, Artificial Sequence
  RNA Oligomer
gaagguaagcuuucuaggccu

SEQ ID NO: 27815 - RNA, 21 nt, Artificial Sequence
  RNA Oligomer
acagccuuauucaugaggcuu

SEQ ID NO: 27816 - RNA, 21 nt, Artificial Sequence
  RNA Oligomer
uccacucaauuguggagaaga

SEQ ID NO: 27817 - RNA, 21 nt, Artificial Sequence
  RNA Oligomer
cugggcuaauuacagugcaga

SEQ ID NO: 27818 - RNA, 21 nt, Artificial Sequence
  RNA Oligomer
aaacaauucuucuugccgcaa

SEQ ID NO: 27819 - RNA, 21 nt, Artificial Sequence
  RNA Oligomer
ggugucccuggccuugaauau

SEQ ID NO: 27820 - RNA, 21 nt, Artificial Sequence
  RNA Oligomer
cugauccagugguacaucuau

SEQ ID NO: 27821 - RNA, 21 nt, Artificial Sequence
  RNA Oligomer
guugcugcgaaccuacaucau

SEQ ID NO: 27822 - RNA, 21 nt, Artificial Sequence
  RNA Oligomer
ugauggugucaauguggacau

SEQ ID NO: 27823 - RNA, 21 nt, Artificial Sequence
  RNA Oligomer
accaaacagcagcggaguuuu

SEQ ID NO: 27824 - RNA, 21 nt, Artificial Sequence
  RNA Oligomer
aggcgugaggaaaguaccaaa

SEQ ID NO: 27825 - RNA, 21 nt, Artificial Sequence
  RNA Oligomer
augagcagucugccuuucguu

SEQ ID NO: 27826 - RNA, 21 nt, Artificial Sequence
  RNA Oligomer
accuaguccaucagaucaugu

SEQ ID NO: 27827 - RNA, 21 nt, Artificial Sequence
  RNA Oligomer
gaccuaguccaucagaucaug

SEQ ID NO: 27828 - RNA, 21 nt, Artificial Sequence
  RNA Oligomer
aaaugcugaguaugacacuuu

SEQ ID NO: 27829 - RNA, 21 nt, Artificial Sequence
  RNA Oligomer
gcuuagaguggacuauuaaau

SEQ ID NO: 27830 - RNA, 21 nt, Artificial Sequence
  RNA Oligomer
cuguaaacaggcuuuagucau

SEQ ID NO: 27831 - RNA, 21 nt, Artificial Sequence
  RNA Oligomer
cuccuuuuuuuaggauauagc

SEQ ID NO: 27832 - RNA, 21 nt, Artificial Sequence
  RNA Oligomer
cccuguguauccuauuaugga

SEQ ID NO: 27833 - RNA, 21 nt, Artificial Sequence
  RNA Oligomer
uaauuccugcuguggcaagua

SEQ ID NO: 27834 - RNA, 21 nt, Artificial Sequence
  RNA Oligomer
ggaaucaagccaugcuuaaua

SEQ ID NO: 27835 - RNA, 21 nt, Artificial Sequence
  RNA Oligomer
uccauccacuugcacaauauc

SEQ ID NO: 27836 - RNA, 21 nt, Artificial Sequence
  RNA Oligomer
ggugucaauggacuugugcua

SEQ ID NO: 27837 - RNA, 21 nt, Artificial Sequence
  RNA Oligomer
ccuuaagucccugcuaaaaca

SEQ ID NO: 27838 - RNA, 21 nt, Artificial Sequence
  RNA Oligomer
aagacagaggauuguccuuaa

SEQ ID NO: 27839 - RNA, 21 nt, Artificial Sequence
  RNA Oligomer
agaaaaagacagaggauuguc

SEQ ID NO: 27840 - RNA, 21 nt, Artificial Sequence
  RNA Oligomer
uucaaucacuuggcgugacuu

SEQ ID NO: 27841 - RNA, 21 nt, Artificial Sequence
  RNA Oligomer
cccuaagaaugguucugugua

SEQ ID NO: 27842 - RNA, 21 nt, Artificial Sequence
  RNA Oligomer
guucaaucacuuggcgugacu

SEQ ID NO: 27843 - RNA, 21 nt, Artificial Sequence
  RNA Oligomer
ccuuauucaugaggcuuagaa

SEQ ID NO: 27844 - RNA, 21 nt, Artificial Sequence
  RNA Oligomer
cucaacagccuuauucaugag

SEQ ID NO: 27845 - RNA, 21 nt, Artificial Sequence
  RNA Oligomer
uccaaggaguucaaucacuug

SEQ ID NO: 27846 - RNA, 21 nt, Artificial Sequence
  RNA Oligomer
gaggugguacucaacagccuu

SEQ ID NO: 27847 - RNA, 21 nt, Artificial Sequence
  RNA Oligomer
ucaauggcugcuccucaccaa

SEQ ID NO: 27848 - RNA, 21 nt, Artificial Sequence
  RNA Oligomer
ccucuucaagucuaucuuuga

SEQ ID NO: 27849 - RNA, 21 nt, Artificial Sequence
  RNA Oligomer
cugcgaaccuacaucaucagu

SEQ ID NO: 27850 - RNA, 21 nt, Artificial Sequence
  RNA Oligomer
gguugcugcgaaccuacauca

SEQ ID NO: 27851 - RNA, 21 nt, Artificial Sequence
  RNA Oligomer
cagucugccuuucguuguaac

SEQ ID NO: 27852 - RNA, 21 nt, Artificial Sequence
  RNA Oligomer
ucagaucauguguucuggaga

SEQ ID NO: 27853 - RNA, 21 nt, Artificial Sequence
  RNA Oligomer
uguaauguagaccuaguccau

SEQ ID NO: 27854 - RNA, 21 nt, Artificial Sequence
  RNA Oligomer
ucagcuucauugcauguaaug

SEQ ID NO: 27855 - RNA, 21 nt, Artificial Sequence
  RNA Oligomer
gaaaaugcugaguaugacacu

SEQ ID NO: 27856 - RNA, 21 nt, Artificial Sequence
  RNA Oligomer
gucuuuuggagugaccagcaa

SEQ ID NO: 27857 - RNA, 21 nt, Artificial Sequence
  RNA Oligomer
ugcuuagaguggacuauuaaa

SEQ ID NO: 27858 - RNA, 21 nt, Artificial Sequence
  RNA Oligomer
gggaaucaagccaugcuuaau

SEQ ID NO: 27859 - RNA, 21 nt, Artificial Sequence
  RNA Oligomer
ucagggaaucaagccaugcuu

SEQ ID NO: 27860 - RNA, 21 nt, Artificial Sequence
  RNA Oligomer
agccuuauucaugaggcuuag

SEQ ID NO: 27861 - RNA, 21 nt, Artificial Sequence
  RNA Oligomer
cgggaagcaccaucucuaacu

SEQ ID NO: 27862 - RNA, 21 nt, Artificial Sequence
  RNA Oligomer
uaagggaaagagcgacccuua

SEQ ID NO: 27863 - RNA, 21 nt, Artificial Sequence
  RNA Oligomer
agcuuuuacgagguaucagca

SEQ ID NO: 27864 - RNA, 21 nt, Artificial Sequence
  RNA Oligomer
aaguucaaguacgguauugaa

SEQ ID NO: 27865 - RNA, 21 nt, Artificial Sequence
  RNA Oligomer
caaacagcagcggaguuuuaa

SEQ ID NO: 27866 - RNA, 21 nt, Artificial Sequence
  RNA Oligomer
ggugucaauguggacaugcac

SEQ ID NO: 27867 - RNA, 21 nt, Artificial Sequence
  RNA Oligomer
cucaagguugcccaaacugau

SEQ ID NO: 27868 - RNA, 21 nt, Artificial Sequence
  RNA Oligomer
ugugaaaaugucugcuaugac

SEQ ID NO: 27869 - RNA, 21 nt, Artificial Sequence
  RNA Oligomer
ccauguuaaacuacggucaug

SEQ ID NO: 27870 - RNA, 21 nt, Artificial Sequence
  RNA Oligomer
caguaguacacauacaacuaa

SEQ ID NO: 27871 - RNA, 21 nt, Artificial Sequence
  RNA Oligomer
cugguauucuuggguuuuccu

SEQ ID NO: 27872 - RNA, 21 nt, Artificial Sequence
  RNA Oligomer
aaacuccuugacaagguucaa

SEQ ID NO: 27873 - RNA, 21 nt, Artificial Sequence
  RNA Oligomer
cagggaaucaagccaugcuua

SEQ ID NO: 27874 - RNA, 21 nt, Artificial Sequence
  RNA Oligomer
gaguucaaucacuuggcguga

SEQ ID NO: 27875 - RNA, 21 nt, Artificial Sequence
  RNA Oligomer
ggaguucaaucacuuggcgug

SEQ ID NO: 27876 - RNA, 21 nt, Artificial Sequence
  RNA Oligomer
cagccuuauucaugaggcuua

SEQ ID NO: 27877 - RNA, 21 nt, Artificial Sequence
  RNA Oligomer
aaaauauaguagcacaagucc

SEQ ID NO: 27878 - RNA, 21 nt, Artificial Sequence
  RNA Oligomer
uuucuacagcaccuuuuuucu

SEQ ID NO: 27879 - RNA, 21 nt, Artificial Sequence
  RNA Oligomer
caagccuguaucuagaucucc

SEQ ID NO: 27880 - RNA, 21 nt, Artificial Sequence
  RNA Oligomer
uuggaggaugaaguaaaauga

SEQ ID NO: 27881 - RNA, 21 nt, Artificial Sequence
  RNA Oligomer
uucaagccuguaucuagaucu

SEQ ID NO: 27882 - RNA, 21 nt, Artificial Sequence
  RNA Oligomer
gaugaaguaaaaugaaaaggc

SEQ ID NO: 27883 - RNA, 21 nt, Artificial Sequence
  RNA Oligomer
aaaauccaugagaaagguuca

SEQ ID NO: 27884 - RNA, 21 nt, Artificial Sequence
  RNA Oligomer
aaaacuguuuauguagcugac

SEQ ID NO: 27885 - RNA, 21 nt, Artificial Sequence
  RNA Oligomer
uaaaguuuaaaacuccgcugc

SEQ ID NO: 27886 - RNA, 21 nt, Artificial Sequence
  RNA Oligomer
aaacuguuuauguagcugaca

SEQ ID NO: 27887 - RNA, 21 nt, Artificial Sequence
  RNA Oligomer
ugucuuuguguuuucuaagcc

SEQ ID NO: 27888 - RNA, 21 nt, Artificial Sequence
  RNA Oligomer
aucaaaauuaacaccuggugc

SEQ ID NO: 27889 - RNA, 21 nt, Artificial Sequence
  RNA Oligomer
uuuguucugcacuguaauuag

SEQ ID NO: 27890 - RNA, 21 nt, Artificial Sequence
  RNA Oligomer
uguucugcacuguaauuagcc

SEQ ID NO: 27891 - RNA, 21 nt, Artificial Sequence
  RNA Oligomer
aacuucuuuaucucaaucugc

SEQ ID NO: 27892 - RNA, 21 nt, Artificial Sequence
  RNA Oligomer
acagggaaaaacauuuuagga

SEQ ID NO: 27893 - RNA, 21 nt, Artificial Sequence
  RNA Oligomer
aucuaaguucuuugaauccac

SEQ ID NO: 27894 - RNA, 21 nt, Artificial Sequence
  RNA Oligomer
ucaagccuguaucuagaucuc

SEQ ID NO: 27895 - RNA, 21 nt, Artificial Sequence
  RNA Oligomer
caaaacuguuuauguagcuga

SEQ ID NO: 27896 - RNA, 21 nt, Artificial Sequence
  RNA Oligomer
aaaaccaguauccauaauagg

SEQ ID NO: 27897 - RNA, 21 nt, Artificial Sequence
  RNA Oligomer
acacagggaaaaacauuuuag

SEQ ID NO: 27898 - RNA, 21 nt, Artificial Sequence
  RNA Oligomer
cacagggaaaaacauuuuagg

SEQ ID NO: 27899 - RNA, 21 nt, Artificial Sequence
  RNA Oligomer
uaaaugaaugugaguaguagc

SEQ ID NO: 27900 - RNA, 21 nt, Artificial Sequence
  RNA Oligomer
auauuuagccacaauuaccac

SEQ ID NO: 27901 - RNA, 21 nt, Artificial Sequence
  RNA Oligomer
auuuagccacaauuaccaccc

SEQ ID NO: 27902 - RNA, 21 nt, Artificial Sequence
  RNA Oligomer
uuuuucuucuccacaauugag

SEQ ID NO: 27903 - RNA, 21 nt, Artificial Sequence
  RNA Oligomer
aauccauagauguaccacugg

SEQ ID NO: 27904 - RNA, 21 nt, Artificial Sequence
  RNA Oligomer
uuaaaguuuaaaacuccgcug

SEQ ID NO: 27905 - RNA, 21 nt, Artificial Sequence
  RNA Oligomer
auagcagacauuuucacaacc

SEQ ID NO: 27906 - RNA, 21 nt, Artificial Sequence
  RNA Oligomer
aucaaaguugcuggucacucc

SEQ ID NO: 27907 - RNA, 21 nt, Artificial Sequence
  RNA Oligomer
guaguagcugaggaaugauga

SEQ ID NO: 27908 - RNA, 21 nt, Artificial Sequence
  Chemically synthesized
uuuagccacaauuaccacccg

SEQ ID NO: 27909 - RNA, 21 nt, Artificial Sequence
  Chemically synthesized
uaccucguaaaagcuuuuuug

SEQ ID NO: 27910 - RNA, 21 nt, Artificial Sequence
  Chemically synthesized
uucuacagcaccuuuuuucuu

SEQ ID NO: 27911 - RNA, 21 nt, Artificial Sequence
  RNA Oligomer
uggaggaugaaguaaaaugaa

SEQ ID NO: 27912 - RNA, 21 nt, Artificial Sequence
  RNA Oligomer
uuguucugcacuguaauuagc

SEQ ID NO: 27913 - RNA, 21 nt, Artificial Sequence
  RNA Oligomer
uucugcacuguaauuagccca

SEQ ID NO: 27914 - RNA, 21 nt, Artificial Sequence
  RNA Oligomer
uaauugcggcaagaagaauug

SEQ ID NO: 27915 - RNA, 21 nt, Artificial Sequence
  RNA Oligomer
gaagcgcacaugagagauugg

SEQ ID NO: 27916 - RNA, 21 nt, Artificial Sequence
  RNA Oligomer
uagcagacauuuucacaacca

SEQ ID NO: 27917 - RNA, 21 nt, Artificial Sequence
  RNA Oligomer
uuacaacgaaaggcagacugc

SEQ ID NO: 27918 - RNA, 21 nt, Artificial Sequence
  RNA Oligomer
acaaaacuguuuauguagcug

SEQ ID NO: 27919 - RNA, 21 nt, Artificial Sequence
  RNA Oligomer
caaacaucaaaguugcugguc

SEQ ID NO: 27920 - RNA, 21 nt, Artificial Sequence
  RNA Oligomer
aacaucaaaguugcuggucac

SEQ ID NO: 27921 - RNA, 21 nt, Artificial Sequence
  RNA Oligomer
ugaaaagaccuaagauguuca

SEQ ID NO: 27922 - RNA, 21 nt, Artificial Sequence
  RNA Oligomer
aaccuagguauucuaaugucu

SEQ ID NO: 27923 - RNA, 21 nt, Artificial Sequence
  RNA Oligomer
augucuuuguguuuucuaagc

SEQ ID NO: 27924 - RNA, 21 nt, Artificial Sequence
  RNA Oligomer
ucuacagcaccuuuuuucuuc

SEQ ID NO: 27925 - RNA, 21 nt, Artificial Sequence
  RNA Oligomer
cuguaauuagcccaguuuugc

SEQ ID NO: 27926 - RNA, 21 nt, Artificial Sequence
  RNA Oligomer
ggaugaaguaaaaugaaaagg

SEQ ID NO: 27927 - RNA, 21 nt, Artificial Sequence
  RNA Oligomer
auaagcauauuuuugagaccc

SEQ ID NO: 27928 - RNA, 21 nt, Artificial Sequence
  RNA Oligomer
augauauucaaggccagggac

SEQ ID NO: 27929 - RNA, 21 nt, Artificial Sequence
  RNA Oligomer
aaaguuuaaaacuccgcugcu

SEQ ID NO: 27930 - RNA, 21 nt, Artificial Sequence
  RNA Oligomer
auugaauaaagaacacucucc

SEQ ID NO: 27931 - RNA, 21 nt, Artificial Sequence
  RNA Oligomer
uaaugacuaaagccuguuuac

SEQ ID NO: 27932 - RNA, 21 nt, Artificial Sequence
  RNA Oligomer
caaaaauccaugagaaagguu

SEQ ID NO: 27933 - RNA, 21 nt, Artificial Sequence
  RNA Oligomer
aaauauaguagcacaagucca

SEQ ID NO: 27934 - RNA, 21 nt, Artificial Sequence
  RNA Oligomer
gaaaagaccuaagauguucag

SEQ ID NO: 27935 - RNA, 21 nt, Artificial Sequence
  RNA Oligomer
uuaaauaccaacaugcaccuc

SEQ ID NO: 27936 - RNA, 21 nt, Artificial Sequence
  RNA Oligomer
agguauucuaaugucuuugug

SEQ ID NO: 27937 - RNA, 21 nt, Artificial Sequence
  RNA Oligomer
gucuuuguguuuucuaagccu

SEQ ID NO: 27938 - RNA, 21 nt, Artificial Sequence
  RNA Oligomer
agccuguaucuagaucuccag

SEQ ID NO: 27939 - RNA, 21 nt, Artificial Sequence
  RNA Oligomer
aaaaguacugacagccacacc

SEQ ID NO: 27940 - RNA, 21 nt, Artificial Sequence
  RNA Oligomer
uuagugcaaacaucaaaguug

SEQ ID NO: 27941 - RNA, 21 nt, Artificial Sequence
  RNA Oligomer
aaacaucaaaguugcugguca

SEQ ID NO: 27942 - RNA, 21 nt, Artificial Sequence
  RNA Oligomer
uauuuagccacaauuaccacc

SEQ ID NO: 27943 - RNA, 21 nt, Artificial Sequence
  RNA Oligomer
uuagccacaauuaccacccgc

SEQ ID NO: 27944 - RNA, 21 nt, Artificial Sequence
  RNA Oligomer
cuacuuuaaauaccaacaugc

SEQ ID NO: 27945 - RNA, 21 nt, Artificial Sequence
  RNA Oligomer
accucguaaaagcuuuuuugu

SEQ ID NO: 27946 - RNA, 21 nt, Artificial Sequence
  RNA Oligomer
uuuaaauaccaacaugcaccu

SEQ ID NO: 27947 - RNA, 21 nt, Artificial Sequence
  RNA Oligomer
ucuuuguguuuucuaagccuc

SEQ ID NO: 27948 - RNA, 21 nt, Artificial Sequence
  RNA Oligomer
caccggaucaaaauuaacacc

SEQ ID NO: 27949 - RNA, 21 nt, Artificial Sequence
  RNA Oligomer
guucugcacuguaauuagccc

SEQ ID NO: 27950 - RNA, 21 nt, Artificial Sequence
  RNA Oligomer
aaugauauucaaggccaggga

SEQ ID NO: 27951 - RNA, 21 nt, Artificial Sequence
  RNA Oligomer
ucuuuaucucaaucugcuuca

SEQ ID NO: 27952 - RNA, 21 nt, Artificial Sequence
  RNA Oligomer
uuuaucucaaucugcuucaag

SEQ ID NO: 27953 - RNA, 21 nt, Artificial Sequence
  RNA Oligomer
aucucaaucugcuucaagugc

SEQ ID NO: 27954 - RNA, 21 nt, Artificial Sequence
  RNA Oligomer
aaauaugaucugcaggaccca

SEQ ID NO: 27955 - RNA, 21 nt, Artificial Sequence
  RNA Oligomer
agaagcgcacaugagagauug

SEQ ID NO: 27956 - RNA, 21 nt, Artificial Sequence
  RNA Oligomer
aagcgcacaugagagauuggg

SEQ ID NO: 27957 - RNA, 21 nt, Artificial Sequence
  RNA Oligomer
uugaauaaagaacacucucca

SEQ ID NO: 27958 - RNA, 21 nt, Artificial Sequence
  RNA Oligomer
cauucaagcaucaaugauuac

SEQ ID NO: 27959 - RNA, 21 nt, Artificial Sequence
  RNA Oligomer
caaaaccaguauccauaauag

SEQ ID NO: 27960 - RNA, 21 nt, Artificial Sequence
  RNA Oligomer
uaggagaaaaaaaaagugugc

SEQ ID NO: 27961 - RNA, 21 nt, Artificial Sequence
  RNA Oligomer
aaaugaaugugaguaguagcu

SEQ ID NO: 27962 - RNA, 21 nt, Artificial Sequence
  RNA Oligomer
guaaugauauugugcaagugg

SEQ ID NO: 27963 - RNA, 21 nt, Artificial Sequence
  RNA Oligomer
uuuuagcagggacuuaaggac

SEQ ID NO: 27964 - RNA, 21 nt, Artificial Sequence
  RNA Oligomer
aaguucuuugaauccacuacu

SEQ ID NO: 27965 - RNA, 21 nt, Artificial Sequence
  RNA Oligomer
cuagguauucuaaugucuuug

SEQ ID NO: 27966 - RNA, 21 nt, Artificial Sequence
  RNA Oligomer
cuuuguguuuucuaagccuca

SEQ ID NO: 27967 - RNA, 21 nt, Artificial Sequence
  RNA Oligomer
cggaucaaaauuaacaccugg

SEQ ID NO: 27968 - RNA, 21 nt, Artificial Sequence
  RNA Oligomer
caaaauuaacaccuggugcac

SEQ ID NO: 27969 - RNA, 21 nt, Artificial Sequence
  RNA Oligomer
auuaacaccuggugcacuuuc

SEQ ID NO: 27970 - RNA, 21 nt, Artificial Sequence
  RNA Oligomer
aacaccuggugcacuuucuac

SEQ ID NO: 27971 - RNA, 21 nt, Artificial Sequence
  RNA Oligomer
auaccguacuugaacuucuuu

SEQ ID NO: 27972 - RNA, 21 nt, Artificial Sequence
  RNA Oligomer
guacuugaacuucuuuaucuc

SEQ ID NO: 27973 - RNA, 21 nt, Artificial Sequence
  RNA Oligomer
uucuuuaucucaaucugcuuc

SEQ ID NO: 27974 - RNA, 21 nt, Artificial Sequence
  RNA Oligomer
uaucucaaucugcuucaagug

SEQ ID NO: 27975 - RNA, 21 nt, Artificial Sequence
  RNA Oligomer
ucuuucuuguucaguuucucu

SEQ ID NO: 27976 - RNA, 21 nt, Artificial Sequence
  RNA Oligomer
aaugaagcugaacaugaccgu

SEQ ID NO: 27977 - RNA, 21 nt, Artificial Sequence
  RNA Oligomer
aaaugaaaaguacugacagcc

SEQ ID NO: 27978 - RNA, 21 nt, Artificial Sequence
  RNA Oligomer
aucuuagugcaaacaucaaag

SEQ ID NO: 27979 - RNA, 21 nt, Artificial Sequence
  RNA Oligomer
agacugcuaaacucauaauag

SEQ ID NO: 27980 - RNA, 21 nt, Artificial Sequence
  RNA Oligomer
aaacccaagaauaccaguuac

SEQ ID NO: 27981 - RNA, 21 nt, Artificial Sequence
  RNA Oligomer
ggaaugaugaaaaagugaugg

SEQ ID NO: 27982 - RNA, 21 nt, Artificial Sequence
  RNA Oligomer
gaaaaucuuauucugugggcc

SEQ ID NO: 27983 - RNA, 21 nt, Artificial Sequence
  RNA Oligomer
aaaaucuuauucugugggccu

SEQ ID NO: 27984 - RNA, 21 nt, Artificial Sequence
  RNA Oligomer
aaagcccuuaucuauguauca

SEQ ID NO: 27985 - RNA, 21 nt, Artificial Sequence
  RNA Oligomer
uaaguucuuugaauccacuac

SEQ ID NO: 27986 - RNA, 21 nt, Artificial Sequence
  RNA Oligomer
gguauucuaaugucuuugugu

SEQ ID NO: 27987 - RNA, 21 nt, Artificial Sequence
  RNA Oligomer
uguguuuucuaagccucauga

SEQ ID NO: 27988 - RNA, 21 nt, Artificial Sequence
  RNA Oligomer
uuucuaagccucaugaauaag

SEQ ID NO: 27989 - RNA, 21 nt, Artificial Sequence
  RNA Oligomer
accggaucaaaauuaacaccu

SEQ ID NO: 27990 - RNA, 21 nt, Artificial Sequence
  RNA Oligomer
aauuaacaccuggugcacuuu

SEQ ID NO: 27991 - RNA, 21 nt, Artificial Sequence
  RNA Oligomer
gaguuagagauggugcuuccc

SEQ ID NO: 27992 - RNA, 21 nt, Artificial Sequence
  RNA Oligomer
uaagcauauuuuugagaccca

SEQ ID NO: 27993 - RNA, 21 nt, Artificial Sequence
  RNA Oligomer
auagacuugaagaggauacug

SEQ ID NO: 27994 - RNA, 21 nt, Artificial Sequence
  RNA Oligomer
acaaauaugaucugcaggacc

SEQ ID NO: 27995 - RNA, 21 nt, Artificial Sequence
  RNA Oligomer
ugaauaaagaacacucuccag

SEQ ID NO: 27996 - RNA, 21 nt, Artificial Sequence
  RNA Oligomer
aacacucuccagaacacauga

SEQ ID NO: 27997 - RNA, 21 nt, Artificial Sequence
  RNA Oligomer
aaugaaaaguacugacagcca

SEQ ID NO: 27998 - RNA, 21 nt, Artificial Sequence
  RNA Oligomer
ugucauacucagcauuuucac

SEQ ID NO: 27999 - RNA, 21 nt, Artificial Sequence
  RNA Oligomer
uauguguacuacugaauccuc

SEQ ID NO: 28000 - RNA, 21 nt, Artificial Sequence
  RNA Oligomer
ucuaagucucucacauuaaug

SEQ ID NO: 28001 - RNA, 21 nt, Artificial Sequence
  RNA Oligomer
cucacauuaaugacuaaagcc

SEQ ID NO: 28002 - RNA, 21 nt, Artificial Sequence
  RNA Oligomer
ucuguguuugugaguuuauac

SEQ ID NO: 28003 - RNA, 21 nt, Artificial Sequence
  RNA Oligomer
aaacaaaacaaacucuucgac

SEQ ID NO: 28004 - RNA, 21 nt, Artificial Sequence
  RNA Oligomer
ugaggaaugaugaaaaaguga

SEQ ID NO: 28005 - RNA, 21 nt, Artificial Sequence
  RNA Oligomer
ugauauugugcaaguggaugg

SEQ ID NO: 28006 - RNA, 21 nt, Artificial Sequence
  RNA Oligomer
ggaaaaucuuauucugugggc

SEQ ID NO: 28007 - RNA, 21 nt, Artificial Sequence
  RNA Oligomer
aaucuuauucugugggccuug

SEQ ID NO: 28008 - RNA, 21 nt, Artificial Sequence
  RNA Oligomer
uauaguagcacaaguccauug

SEQ ID NO: 28009 - RNA, 21 nt, Artificial Sequence
  RNA Oligomer
caauccucugucuuuuucuug

SEQ ID NO: 28010 - RNA, 21 nt, Artificial Sequence
  RNA Oligomer
aauaccaacaugcaccucucu

SEQ ID NO: 28011 - RNA, 21 nt, Artificial Sequence
  RNA Oligomer
uuguguuuucuaagccucaug

SEQ ID NO: 28012 - RNA, 21 nt, Artificial Sequence
  RNA Oligomer
aagcauauuuuugagacccac

SEQ ID NO: 28013 - RNA, 21 nt, Artificial Sequence
  RNA Oligomer
ucaagcugaauccauagaugu

SEQ ID NO: 28014 - RNA, 21 nt, Artificial Sequence
  RNA Oligomer
aagcugaauccauagauguac

SEQ ID NO: 28015 - RNA, 21 nt, Artificial Sequence
  RNA Oligomer
uacugaugauguagguucgca

SEQ ID NO: 28016 - RNA, 21 nt, Artificial Sequence
  RNA Oligomer
aguuuaaaacuccgcugcugu

SEQ ID NO: 28017 - RNA, 21 nt, Artificial Sequence
  RNA Oligomer
aauaccguacuugaacuucuu

SEQ ID NO: 28018 - RNA, 21 nt, Artificial Sequence
  RNA Oligomer
aguuugggcaaccuugaguuc

SEQ ID NO: 28019 - RNA, 21 nt, Artificial Sequence
  RNA Oligomer
gacacaaauaugaucugcagg

SEQ ID NO: 28020 - RNA, 21 nt, Artificial Sequence
  RNA Oligomer
cauagcagacauuuucacaac

SEQ ID NO: 28021 - RNA, 21 nt, Artificial Sequence
  RNA Oligomer
aauaaagaacacucuccagaa

SEQ ID NO: 28022 - RNA, 21 nt, Artificial Sequence
  RNA Oligomer
acucuccagaacacaugaucu

SEQ ID NO: 28023 - RNA, 21 nt, Artificial Sequence
  RNA Oligomer
gaaaaugaaaaguacugacag

SEQ ID NO: 28024 - RNA, 21 nt, Artificial Sequence
  RNA Oligomer
auuuggagaaacugguagaug

SEQ ID NO: 28025 - RNA, 21 nt, Artificial Sequence
  RNA Oligomer
ucuuagugcaaacaucaaagu

SEQ ID NO: 28026 - RNA, 21 nt, Artificial Sequence
  RNA Oligomer
cuuagugcaaacaucaaaguu

SEQ ID NO: 28027 - RNA, 21 nt, Artificial Sequence
  RNA Oligomer
uaccaguuacugcaaaauuca

SEQ ID NO: 28028 - RNA, 21 nt, Artificial Sequence
  RNA Oligomer
cacauuaaugacuaaagccug

SEQ ID NO: 28029 - RNA, 21 nt, Artificial Sequence
  RNA Oligomer
cugaggaaugaugaaaaagug

SEQ ID NO: 28030 - RNA, 21 nt, Artificial Sequence
  RNA Oligomer
gaaugaugaaaaagugauggu

SEQ ID NO: 28031 - RNA, 21 nt, Artificial Sequence
  RNA Oligomer
auauaguagcacaaguccauu

SEQ ID NO: 28032 - RNA, 21 nt, Artificial Sequence
  RNA Oligomer
uccucugucuuuuucuuguug

SEQ ID NO: 28033 - RNA, 21 nt, Artificial Sequence
  RNA Oligomer
auacacagaaccauucuuagg

SEQ ID NO: 28034 - RNA, 21 nt, Artificial Sequence
  RNA Oligomer
ugaaccuagguauucuaaugu

SEQ ID NO: 28035 - RNA, 21 nt, Artificial Sequence
  RNA Oligomer
gaaccuagguauucuaauguc

SEQ ID NO: 28036 - RNA, 21 nt, Artificial Sequence
  RNA Oligomer
gaucaaaauuaacaccuggug

SEQ ID NO: 28037 - RNA, 21 nt, Artificial Sequence
  RNA Oligomer
agcugaauccauagauguacc

SEQ ID NO: 28038 - RNA, 21 nt, Artificial Sequence
  RNA Oligomer
cugaauccauagauguaccac

SEQ ID NO: 28039 - RNA, 21 nt, Artificial Sequence
  RNA Oligomer
uugaagaggauacugaugaug

SEQ ID NO: 28040 - RNA, 21 nt, Artificial Sequence
  RNA Oligomer
ugaagaggauacugaugaugu

SEQ ID NO: 28041 - RNA, 21 nt, Artificial Sequence
  RNA Oligomer
aaguuuaaaacuccgcugcug

SEQ ID NO: 28042 - RNA, 21 nt, Artificial Sequence
  RNA Oligomer
augcucuucaauaccguacuu

SEQ ID NO: 28043 - RNA, 21 nt, Artificial Sequence
  RNA Oligomer
ugcucuucaauaccguacuug

SEQ ID NO: 28044 - RNA, 21 nt, Artificial Sequence
  RNA Oligomer
uccucuuucuuguucaguuuc

SEQ ID NO: 28045 - RNA, 21 nt, Artificial Sequence
  RNA Oligomer
cacaaauaugaucugcaggac

SEQ ID NO: 28046 - RNA, 21 nt, Artificial Sequence
  RNA Oligomer
aauaugaucugcaggacccag

SEQ ID NO: 28047 - RNA, 21 nt, Artificial Sequence
  RNA Oligomer
agcgcacaugagagauuggga

SEQ ID NO: 28048 - RNA, 21 nt, Artificial Sequence
  RNA Oligomer
uaaagaacacucuccagaaca

SEQ ID NO: 28049 - RNA, 21 nt, Artificial Sequence
  RNA Oligomer
aaaaugaaaaguacugacagc

SEQ ID NO: 28050 - RNA, 21 nt, Artificial Sequence
  RNA Oligomer
augaagcugaacaugaccgua

SEQ ID NO: 28051 - RNA, 21 nt, Artificial Sequence
  RNA Oligomer
ugcaugcaagaagaaaagugu

SEQ ID NO: 28052 - RNA, 21 nt, Artificial Sequence
  RNA Oligomer
cagcauuuucaccaaucuucu

SEQ ID NO: 28053 - RNA, 21 nt, Artificial Sequence
  RNA Oligomer
gagaaacugguagaugucuuc

SEQ ID NO: 28054 - RNA, 21 nt, Artificial Sequence
  RNA Oligomer
aaaacccaagaauaccaguua

SEQ ID NO: 28055 - RNA, 21 nt, Artificial Sequence
  RNA Oligomer
uacugcaaaauucauuuaggc

SEQ ID NO: 28056 - RNA, 21 nt, Artificial Sequence
  RNA Oligomer
ucucacauuaaugacuaaagc

SEQ ID NO: 28057 - RNA, 21 nt, Artificial Sequence
  RNA Oligomer
aacaaaacaaacucuucgaca

SEQ ID NO: 28058 - RNA, 21 nt, Artificial Sequence
  RNA Oligomer
aaugauauugugcaaguggau

SEQ ID NO: 28059 - RNA, 21 nt, Artificial Sequence
  RNA Oligomer
ucacauacacagaaccauucu

SEQ ID NO: 28060 - RNA, 21 nt, Artificial Sequence
  RNA Oligomer
cauacacagaaccauucuuag

SEQ ID NO: 28061 - RNA, 21 nt, Artificial Sequence
  RNA Oligomer
agcccuuaucuauguaucacc

SEQ ID NO: 28062 - RNA, 21 nt, Artificial Sequence
  RNA Oligomer
aaauaccaacaugcaccucuc

SEQ ID NO: 28063 - RNA, 21 nt, Artificial Sequence
  RNA Oligomer
aauaaggcuguugaguaccac

SEQ ID NO: 28064 - RNA, 21 nt, Artificial Sequence
  RNA Oligomer
gaauccauagauguaccacug

SEQ ID NO: 28065 - RNA, 21 nt, Artificial Sequence
  RNA Oligomer
uaccacuggaucagcaagaag

SEQ ID NO: 28066 - RNA, 21 nt, Artificial Sequence
  RNA Oligomer
gaacuucuuuaucucaaucug

SEQ ID NO: 28067 - RNA, 21 nt, Artificial Sequence
  RNA Oligomer
cucuuucuuguucaguuucuc

SEQ ID NO: 28068 - RNA, 21 nt, Artificial Sequence
  RNA Oligomer
caaauaugaucugcaggaccc

SEQ ID NO: 28069 - RNA, 21 nt, Artificial Sequence
  RNA Oligomer
acaugagagauugggaaagac

SEQ ID NO: 28070 - RNA, 21 nt, Artificial Sequence
  RNA Oligomer
aagaacacucuccagaacaca

SEQ ID NO: 28071 - RNA, 21 nt, Artificial Sequence
  RNA Oligomer
guaguuuaacauggaauguca

SEQ ID NO: 28072 - RNA, 21 nt, Artificial Sequence
  RNA Oligomer
augcaugcaagaagaaaagug

SEQ ID NO: 28073 - RNA, 21 nt, Artificial Sequence
  RNA Oligomer
gucauacucagcauuuucacc

SEQ ID NO: 28074 - RNA, 21 nt, Artificial Sequence
  RNA Oligomer
uacucagcauuuucaccaauc

SEQ ID NO: 28075 - RNA, 21 nt, Artificial Sequence
  RNA Oligomer
acucagcauuuucaccaaucu

SEQ ID NO: 28076 - RNA, 21 nt, Artificial Sequence
  RNA Oligomer
cauuuucaccaaucuucugug

SEQ ID NO: 28077 - RNA, 21 nt, Artificial Sequence
  RNA Oligomer
aaguacugacagccacaccuu

SEQ ID NO: 28078 - RNA, 21 nt, Artificial Sequence
  RNA Oligomer
aaaaaaggcauuuggagaaac

SEQ ID NO: 28079 - RNA, 21 nt, Artificial Sequence
  RNA Oligomer
aaaaaggcauuuggagaaacu

SEQ ID NO: 28080 - RNA, 21 nt, Artificial Sequence
  RNA Oligomer
uccucuuucaaccucucuugc

SEQ ID NO: 28081 - RNA, 21 nt, Artificial Sequence
  RNA Oligomer
acauuaaugacuaaagccugu

SEQ ID NO: 28082 - RNA, 21 nt, Artificial Sequence
  RNA Oligomer
aauuaccacccgcucauucac

SEQ ID NO: 28083 - RNA, 21 nt, Artificial Sequence
  RNA Oligomer
ucauucacauacacagaacca

SEQ ID NO: 28084 - RNA, 21 nt, Artificial Sequence
  RNA Oligomer
acuuuaaauaccaacaugcac

SEQ ID NO: 28085 - RNA, 21 nt, Artificial Sequence
  RNA Oligomer
uaaauaccaacaugcaccucu

SEQ ID NO: 28086 - RNA, 21 nt, Artificial Sequence
  RNA Oligomer
uagacuugaagaggauacuga

SEQ ID NO: 28087 - RNA, 21 nt, Artificial Sequence
  RNA Oligomer
augaaaaguacugacagccac

SEQ ID NO: 28088 - RNA, 21 nt, Artificial Sequence
  RNA Oligomer
caugcaugcaagaagaaaagu

SEQ ID NO: 28089 - RNA, 21 nt, Artificial Sequence
  RNA Oligomer
auccucuuucaaccucucuug

SEQ ID NO: 28090 - RNA, 21 nt, Artificial Sequence
  RNA Oligomer
aaacaaacucuucgacacaca

SEQ ID NO: 28091 - RNA, 21 nt, Artificial Sequence
  RNA Oligomer
ccauuaaaugaaugugaguag

SEQ ID NO: 28092 - RNA, 21 nt, Artificial Sequence
  RNA Oligomer
aggaaugaugaaaaagugaug

SEQ ID NO: 28093 - RNA, 21 nt, Artificial Sequence
  RNA Oligomer
uaaugauauugugcaagugga

SEQ ID NO: 28094 - RNA, 21 nt, Artificial Sequence
  RNA Oligomer
aauccucugucuuuuucuugu

SEQ ID NO: 28095 - RNA, 21 nt, Artificial Sequence
  RNA Oligomer
uucacauacacagaaccauuc

SEQ ID NO: 28096 - RNA, 21 nt, Artificial Sequence
  RNA Oligomer
aaaagcccuuaucuauguauc

SEQ ID NO: 28097 - RNA, 21 nt, Artificial Sequence
  RNA Oligomer
aagcccuuaucuauguaucac

SEQ ID NO: 28098 - RNA, 21 nt, Artificial Sequence
  RNA Oligomer
auaaggcuguugaguaccacc

SEQ ID NO: 28099 - RNA, 21 nt, Artificial Sequence
  RNA Oligomer
uuugagacccacagucuuugg

SEQ ID NO: 28100 - RNA, 21 nt, Artificial Sequence
  RNA Oligomer
aguucaaugauauucaaggcc

SEQ ID NO: 28101 - RNA, 21 nt, Artificial Sequence
  RNA Oligomer
agggaucucuuuugcaagugu

SEQ ID NO: 28102 - RNA, 21 nt, Artificial Sequence
  RNA Oligomer
uuucuuguucaguuucucuuc

SEQ ID NO: 28103 - RNA, 21 nt, Artificial Sequence
  RNA Oligomer
uugggaaagacuugucauagc

SEQ ID NO: 28104 - RNA, 21 nt, Artificial Sequence
  RNA Oligomer
caaugaagcugaacaugaccg

SEQ ID NO: 28105 - RNA, 21 nt, Artificial Sequence
  RNA Oligomer
aacaugaccguaguuuaacau

SEQ ID NO: 28106 - RNA, 21 nt, Artificial Sequence
  RNA Oligomer
gugaugaguuuuaaaaaaggc

SEQ ID NO: 28107 - RNA, 21 nt, Artificial Sequence
  RNA Oligomer
auguguacuacugaauccucu

SEQ ID NO: 28108 - RNA, 21 nt, Artificial Sequence
  RNA Oligomer
uguacuacugaauccucuuuc

SEQ ID NO: 28109 - RNA, 21 nt, Artificial Sequence
  RNA Oligomer
acccaagaauaccaguuacug

SEQ ID NO: 28110 - RNA, 21 nt, Artificial Sequence
  RNA Oligomer
auaccaguuacugcaaaauuc

SEQ ID NO: 28111 - RNA, 21 nt, Artificial Sequence
  RNA Oligomer
aaagccuguuuacaguacuaa

SEQ ID NO: 28112 - RNA, 21 nt, Artificial Sequence
  RNA Oligomer
cacagcaggaauuauauaaug

SEQ ID NO: 28113 - RNA, 21 nt, Artificial Sequence
  RNA Oligomer
acaaacaaaacaaacucuucg

SEQ ID NO: 28114 - RNA, 21 nt, Artificial Sequence
  RNA Oligomer
cuugauucccugacuuuagcu

SEQ ID NO: 28115 - RNA, 21 nt, Artificial Sequence
  RNA Oligomer
uggauggaaaaagaauauacg

SEQ ID NO: 28116 - RNA, 21 nt, Artificial Sequence
  RNA Oligomer
ucuuauucugugggccuuguc

SEQ ID NO: 28117 - RNA, 21 nt, Artificial Sequence
  RNA Oligomer
uagccacaauuaccacccgcu

SEQ ID NO: 28118 - RNA, 21 nt, Artificial Sequence
  RNA Oligomer
cucauucacauacacagaacc

SEQ ID NO: 28119 - RNA, 21 nt, Artificial Sequence
  RNA Oligomer
acauacacagaaccauucuua

SEQ ID NO: 28120 - RNA, 21 nt, Artificial Sequence
  RNA Oligomer
agaaaaagcccuuaucuaugu

SEQ ID NO: 28121 - RNA, 21 nt, Artificial Sequence
  RNA Oligomer
auguaucaccuaauggaacuc

SEQ ID NO: 28122 - RNA, 21 nt, Artificial Sequence
  RNA Oligomer
uguaucaccuaauggaacucu

SEQ ID NO: 28123 - RNA, 21 nt, Artificial Sequence
  RNA Oligomer
guaaaaugaaaaggcaaguuc

SEQ ID NO: 28124 - RNA, 21 nt, Artificial Sequence
  RNA Oligomer
gccaccucaaagauagacuug

SEQ ID NO: 28125 - RNA, 21 nt, Artificial Sequence
  RNA Oligomer
aaagauagacuugaagaggau

SEQ ID NO: 28126 - RNA, 21 nt, Artificial Sequence
  RNA Oligomer
auugacaccaucaguuugggc

SEQ ID NO: 28127 - RNA, 21 nt, Artificial Sequence
  RNA Oligomer
uucuuguucaguuucucuucc

SEQ ID NO: 28128 - RNA, 21 nt, Artificial Sequence
  RNA Oligomer
ugggaaagacuugucauagca

SEQ ID NO: 28129 - RNA, 21 nt, Artificial Sequence
  RNA Oligomer
aagcugaacaugaccguaguu

SEQ ID NO: 28130 - RNA, 21 nt, Artificial Sequence
  RNA Oligomer
aacccaagaauaccaguuacu

SEQ ID NO: 28131 - RNA, 21 nt, Artificial Sequence
  RNA Oligomer
uaaagccuguuuacaguacua

SEQ ID NO: 28132 - RNA, 21 nt, Artificial Sequence
  RNA Oligomer
guaaacaccauauuggcccac

SEQ ID NO: 28133 - RNA, 21 nt, Artificial Sequence
  RNA Oligomer
aaacaccauauuggcccacac

SEQ ID NO: 28134 - RNA, 21 nt, Artificial Sequence
  RNA Oligomer
uugaacaccauaugugcauua

SEQ ID NO: 28135 - RNA, 21 nt, Artificial Sequence
  RNA Oligomer
guuuauacuguaucugcuugu

SEQ ID NO: 28136 - RNA, 21 nt, Artificial Sequence
  RNA Oligomer
caaacaaaacaaacucuucga

SEQ ID NO: 28137 - RNA, 21 nt, Artificial Sequence
  RNA Oligomer
aaaacaaacucuucgacacac

SEQ ID NO: 28138 - RNA, 21 nt, Artificial Sequence
  RNA Oligomer
acuuaaggacaauccucuguc

SEQ ID NO: 28139 - RNA, 21 nt, Artificial Sequence
  RNA Oligomer
uaucaccuaauggaacucuua

SEQ ID NO: 28140 - RNA, 21 nt, Artificial Sequence
  RNA Oligomer
uaauuagcccaguuuugcuca

SEQ ID NO: 28141 - RNA, 21 nt, Artificial Sequence
  RNA Oligomer
gagcagccauugaaauaagca

SEQ ID NO: 28142 - RNA, 21 nt, Artificial Sequence
  RNA Oligomer
aaggccaccucaaagauagac

SEQ ID NO: 28143 - RNA, 21 nt, Artificial Sequence
  RNA Oligomer
cuguuuauguagcugacaugc

SEQ ID NO: 28144 - RNA, 21 nt, Artificial Sequence
  RNA Oligomer
cccaagaauaccaguuacugc

SEQ ID NO: 28145 - RNA, 21 nt, Artificial Sequence
  RNA Oligomer
caugacaaacaaaacaaacuc

SEQ ID NO: 28146 - RNA, 21 nt, Artificial Sequence
  RNA Oligomer
uugauucccugacuuuagcuc

SEQ ID NO: 28147 - RNA, 21 nt, Artificial Sequence
  RNA Oligomer
guggauggaaaaagaauauac

SEQ ID NO: 28148 - RNA, 21 nt, Artificial Sequence
  RNA Oligomer
uacguauuugcaaaugcaugg

SEQ ID NO: 28149 - RNA, 21 nt, Artificial Sequence
  RNA Oligomer
auggaauguuuuagcagggac

SEQ ID NO: 28150 - RNA, 21 nt, Artificial Sequence
  RNA Oligomer
uucgauuuuguucugcacugu

SEQ ID NO: 28151 - RNA, 21 nt, Artificial Sequence
  RNA Oligomer
uucaaugauauucaaggccag

SEQ ID NO: 28152 - RNA, 21 nt, Artificial Sequence
  RNA Oligomer
guguauuaaguaggaaaaccc

SEQ ID NO: 28153 - RNA, 21 nt, Artificial Sequence
  RNA Oligomer
uaaacaccauauuggcccaca

SEQ ID NO: 28154 - RNA, 21 nt, Artificial Sequence
  RNA Oligomer
gugaguuuauacuguaucugc

SEQ ID NO: 28155 - RNA, 21 nt, Artificial Sequence
  RNA Oligomer
ggauggaaaaagaauauacgu

SEQ ID NO: 28156 - RNA, 21 nt, Artificial Sequence
  RNA Oligomer
aucugcuucaagugcaugucc

SEQ ID NO: 28157 - RNA, 21 nt, Artificial Sequence
  RNA Oligomer
aggagaaaaaaaaagugugcu

SEQ ID NO: 28158 - RNA, 21 nt, Artificial Sequence
  RNA Oligomer
cacaaguccauugacaccugg

SEQ ID NO: 28159 - RNA, 21 nt, Artificial Sequence
  RNA Oligomer
uagaucuccaggucaucaggc

SEQ ID NO: 28160 - RNA, 21 nt, Artificial Sequence
  RNA Oligomer
guucaaugauauucaaggcca

SEQ ID NO: 28161 - RNA, 21 nt, Artificial Sequence
  RNA Oligomer
augaagaugaugaagaugguu

SEQ ID NO: 28162 - RNA, 21 nt, Artificial Sequence
  RNA Oligomer
aacagcacucaagcugaaucc

SEQ ID NO: 28163 - RNA, 21 nt, Artificial Sequence
  RNA Oligomer
uuguucaguuucucuuccuuu

SEQ ID NO: 28164 - RNA, 21 nt, Artificial Sequence
  RNA Oligomer
uuauguagcugacaugcaugc

SEQ ID NO: 28165 - RNA, 21 nt, Artificial Sequence
  RNA Oligomer
uagugcaaacaucaaaguugc

SEQ ID NO: 28166 - RNA, 21 nt, Artificial Sequence
  RNA Oligomer
uaggauacacagggaaaaaca

SEQ ID NO: 28167 - RNA, 21 nt, Artificial Sequence
  RNA Oligomer
aaccuugucaaggaguuugcc

SEQ ID NO: 28168 - RNA, 21 nt, Artificial Sequence
  RNA Oligomer
gugaugguaaugauauugugc

SEQ ID NO: 28169 - RNA, 21 nt, Artificial Sequence
  RNA Oligomer
acguauuugcaaaugcaugga

SEQ ID NO: 28170 - RNA, 21 nt, Artificial Sequence
  RNA Oligomer
ccuugucugaauuuuaaacug

SEQ ID NO: 28171 - RNA, 21 nt, Artificial Sequence
  RNA Oligomer
ucaaugauauucaaggccagg

SEQ ID NO: 28172 - RNA, 21 nt, Artificial Sequence
  RNA Oligomer
caugaagaugaugaagauggu

SEQ ID NO: 28173 - RNA, 21 nt, Artificial Sequence
  RNA Oligomer
uucaagugcauguccacauug

SEQ ID NO: 28174 - RNA, 21 nt, Artificial Sequence
  RNA Oligomer
uuuauguagcugacaugcaug

SEQ ID NO: 28175 - RNA, 21 nt, Artificial Sequence
  RNA Oligomer
cauuuuuucuaagucucucac

SEQ ID NO: 28176 - RNA, 21 nt, Artificial Sequence
  RNA Oligomer
uaucuagaucuccaggucauc

SEQ ID NO: 28177 - RNA, 21 nt, Artificial Sequence
  RNA Oligomer
aucuagaucuccaggucauca

SEQ ID NO: 28178 - RNA, 21 nt, Artificial Sequence
  RNA Oligomer
uugagacccacagucuuuggc

SEQ ID NO: 28179 - RNA, 21 nt, Artificial Sequence
  RNA Oligomer
agcaugaagaugaugaagaug

SEQ ID NO: 28180 - RNA, 21 nt, Artificial Sequence
  RNA Oligomer
auacugaugauguagguucgc

SEQ ID NO: 28181 - RNA, 21 nt, Artificial Sequence
  RNA Oligomer
ugaguguuacaacgaaaggca

SEQ ID NO: 28182 - RNA, 21 nt, Artificial Sequence
  RNA Oligomer
aaaggcagacugcucaucucc

SEQ ID NO: 28183 - RNA, 21 nt, Artificial Sequence
  RNA Oligomer
aauguaaacaccauauuggcc

SEQ ID NO: 28184 - RNA, 21 nt, Artificial Sequence
  RNA Oligomer
augaaugugaguaguagcuga

SEQ ID NO: 28185 - RNA, 21 nt, Artificial Sequence
  RNA Oligomer
gaaugugaguaguagcugagg

SEQ ID NO: 28186 - RNA, 21 nt, Artificial Sequence
  RNA Oligomer
uucuucuccacaauugagugg

SEQ ID NO: 28187 - RNA, 21 nt, Artificial Sequence
  RNA Oligomer
cuagaucuccaggucaucagg

SEQ ID NO: 28188 - RNA, 21 nt, Artificial Sequence
  RNA Oligomer
aauugcggcaagaagaauugu

SEQ ID NO: 28189 - RNA, 21 nt, Artificial Sequence
  RNA Oligomer
uauuuuugagacccacagucu

SEQ ID NO: 28190 - RNA, 21 nt, Artificial Sequence
  RNA Oligomer
ucuuguucaguuucucuuccu

SEQ ID NO: 28191 - RNA, 21 nt, Artificial Sequence
  RNA Oligomer
auugggaaagacuugucauag

SEQ ID NO: 28192 - RNA, 21 nt, Artificial Sequence
  RNA Oligomer
cugaguguuacaacgaaaggc

SEQ ID NO: 28193 - RNA, 21 nt, Artificial Sequence
  RNA Oligomer
gaguguuacaacgaaaggcag

SEQ ID NO: 28194 - RNA, 21 nt, Artificial Sequence
  RNA Oligomer
aaacugguagaugucuucaac

SEQ ID NO: 28195 - RNA, 21 nt, Artificial Sequence
  RNA Oligomer
cuggucacuccaaaagacugc

SEQ ID NO: 28196 - RNA, 21 nt, Artificial Sequence
  RNA Oligomer
ugugaguuuauacuguaucug

SEQ ID NO: 28197 - RNA, 21 nt, Artificial Sequence
  RNA Oligomer
uucgacacacauauaagugau

SEQ ID NO: 28198 - RNA, 21 nt, Artificial Sequence
  RNA Oligomer
aaugaaugugaguaguagcug

SEQ ID NO: 28199 - RNA, 21 nt, Artificial Sequence
  RNA Oligomer
ugaauaaggcuguugaguacc

SEQ ID NO: 28200 - RNA, 21 nt, Artificial Sequence
  RNA Oligomer
uuucuucuccacaauugagug

SEQ ID NO: 28201 - RNA, 21 nt, Artificial Sequence
  RNA Oligomer
uuuugagacccacagucuuug

SEQ ID NO: 28202 - RNA, 21 nt, Artificial Sequence
  RNA Oligomer
uagauguaccacuggaucagc

SEQ ID NO: 28203 - RNA, 21 nt, Artificial Sequence
  RNA Oligomer
uaaaacuccgcugcuguuugg

SEQ ID NO: 28204 - RNA, 21 nt, Artificial Sequence
  RNA Oligomer
uuucacaaccagguugcugag

SEQ ID NO: 28205 - RNA, 21 nt, Artificial Sequence
  RNA Oligomer
gaugucuucaacauauaguuc

SEQ ID NO: 28206 - RNA, 21 nt, Artificial Sequence
  RNA Oligomer
ugcaaacaucaaaguugcugg

SEQ ID NO: 28207 - RNA, 21 nt, Artificial Sequence
  RNA Oligomer
uuuaggcacauuuaauagucc

SEQ ID NO: 28208 - RNA, 21 nt, Artificial Sequence
  RNA Oligomer
uaauguaaacaccauauuggc

SEQ ID NO: 28209 - RNA, 21 nt, Artificial Sequence
  RNA Oligomer
auguaaacaccauauuggccc

SEQ ID NO: 28210 - RNA, 21 nt, Artificial Sequence
  RNA Oligomer
aaauuugaacaccauaugugc

SEQ ID NO: 28211 - RNA, 21 nt, Artificial Sequence
  RNA Oligomer
gacacacauauaagugauugu

SEQ ID NO: 28212 - RNA, 21 nt, Artificial Sequence
  RNA Oligomer
uugcaaaugcauggaaaaucu

SEQ ID NO: 28213 - RNA, 21 nt, Artificial Sequence
  RNA Oligomer
uaguagcacaaguccauugac

SEQ ID NO: 28214 - RNA, 21 nt, Artificial Sequence
  RNA Oligomer
auguuuuagcagggacuuaag

SEQ ID NO: 28215 - RNA, 21 nt, Artificial Sequence
  RNA Oligomer
gaauccacuacuuuaaauacc

SEQ ID NO: 28216 - RNA, 21 nt, Artificial Sequence
  RNA Oligomer
uguaucuagaucuccagguca

SEQ ID NO: 28217 - RNA, 21 nt, Artificial Sequence
  RNA Oligomer
aauuagcccaguuuugcucac

SEQ ID NO: 28218 - RNA, 21 nt, Artificial Sequence
  RNA Oligomer
ugcggcaagaagaauuguuuc

SEQ ID NO: 28219 - RNA, 21 nt, Artificial Sequence
  RNA Oligomer
aagaagaauuguuucugucgc

SEQ ID NO: 28220 - RNA, 21 nt, Artificial Sequence
  RNA Oligomer
auuaaguaggaaaacccaaga

SEQ ID NO: 28221 - RNA, 21 nt, Artificial Sequence
  RNA Oligomer
uaagucucucacauuaaugac

SEQ ID NO: 28222 - RNA, 21 nt, Artificial Sequence
  RNA Oligomer
auauuaagcauggcuugauuc

SEQ ID NO: 28223 - RNA, 21 nt, Artificial Sequence
  RNA Oligomer
auauugugcaaguggauggaa

SEQ ID NO: 28224 - RNA, 21 nt, Artificial Sequence
  RNA Oligomer
uagaaagcuuaccuucaaagu

SEQ ID NO: 28225 - RNA, 21 nt, Artificial Sequence
  RNA Oligomer
caauggaauguuuuagcaggg

SEQ ID NO: 28226 - RNA, 21 nt, Artificial Sequence
  RNA Oligomer
uaucuauguaucaccuaaugg

SEQ ID NO: 28227 - RNA, 21 nt, Artificial Sequence
  RNA Oligomer
augaauaaggcuguugaguac

SEQ ID NO: 28228 - RNA, 21 nt, Artificial Sequence
  RNA Oligomer
aagugauugaacuccuuggag

SEQ ID NO: 28229 - RNA, 21 nt, Artificial Sequence
  RNA Oligomer
gauacugaugauguagguucg

SEQ ID NO: 28230 - RNA, 21 nt, Artificial Sequence
  RNA Oligomer
acacaugaucugauggacuag

SEQ ID NO: 28231 - RNA, 21 nt, Artificial Sequence
  RNA Oligomer
gacuaggucuacauuacaugc

SEQ ID NO: 28232 - RNA, 21 nt, Artificial Sequence
  RNA Oligomer
acuaaagccuguuuacaguac

SEQ ID NO: 28233 - RNA, 21 nt, Artificial Sequence
  RNA Oligomer
ucaggccuagaaagcuuaccu

SEQ ID NO: 28234 - RNA, 21 nt, Artificial Sequence
  RNA Oligomer
aaagcuuaccuucaaagugca

SEQ ID NO: 28235 - RNA, 21 nt, Artificial Sequence
  RNA Oligomer
aauggaauguuuuagcaggga

SEQ ID NO: 28236 - RNA, 21 nt, Artificial Sequence
  RNA Oligomer
auuagcccaguuuugcucacu

SEQ ID NO: 28237 - RNA, 21 nt, Artificial Sequence
  RNA Oligomer
gaggauacugaugauguaggu

SEQ ID NO: 28238 - RNA, 21 nt, Artificial Sequence
  RNA Oligomer
aaucugcuucaagugcauguc

SEQ ID NO: 28239 - RNA, 21 nt, Artificial Sequence
  RNA Oligomer
uugucauagcagacauuuuca

SEQ ID NO: 28240 - RNA, 21 nt, Artificial Sequence
  RNA Oligomer
agaacacaugaucugauggac

SEQ ID NO: 28241 - RNA, 21 nt, Artificial Sequence
  RNA Oligomer
auuuucaccaaucuucuguga

SEQ ID NO: 28242 - RNA, 21 nt, Artificial Sequence
  RNA Oligomer
guagaugucuucaacauauag

SEQ ID NO: 28243 - RNA, 21 nt, Artificial Sequence
  RNA Oligomer
uaguuguauguguacuacuga

SEQ ID NO: 28244 - RNA, 21 nt, Artificial Sequence
  RNA Oligomer
uaggcacauuuaauaguccac

SEQ ID NO: 28245 - RNA, 21 nt, Artificial Sequence
  RNA Oligomer
aauagcauuacugcuauaucc

SEQ ID NO: 28246 - RNA, 21 nt, Artificial Sequence
  RNA Oligomer
aaaaaagugugcuuuacuugc

SEQ ID NO: 28247 - RNA, 21 nt, Artificial Sequence
  RNA Oligomer
aacaccauauuggcccacacc

SEQ ID NO: 28248 - RNA, 21 nt, Artificial Sequence
  RNA Oligomer
aagguucaaauuugaacacca

SEQ ID NO: 28249 - RNA, 21 nt, Artificial Sequence
  RNA Oligomer
aauuugaacaccauaugugca

SEQ ID NO: 28250 - RNA, 21 nt, Artificial Sequence
  RNA Oligomer
gaaagcuuaccuucaaagugc

SEQ ID NO: 28251 - RNA, 21 nt, Artificial Sequence
  RNA Oligomer
cuuuuucuuguugaaaagacc

SEQ ID NO: 28252 - RNA, 21 nt, Artificial Sequence
  RNA Oligomer
cuguaucuagaucuccagguc

SEQ ID NO: 28253 - RNA, 21 nt, Artificial Sequence
  RNA Oligomer
caagaagaauuguuucugucg

SEQ ID NO: 28254 - RNA, 21 nt, Artificial Sequence
  RNA Oligomer
augguaagggucgcucuuucc

SEQ ID NO: 28255 - RNA, 21 nt, Artificial Sequence
  RNA Oligomer
aucagcaagaaggccaccuca

SEQ ID NO: 28256 - RNA, 21 nt, Artificial Sequence
  RNA Oligomer
cauugacaccaucaguuuggg

SEQ ID NO: 28257 - RNA, 21 nt, Artificial Sequence
  RNA Oligomer
aaccagguugcugaguguuac

SEQ ID NO: 28258 - RNA, 21 nt, Artificial Sequence
  RNA Oligomer
cuacauuacaugcaaugaagc

SEQ ID NO: 28259 - RNA, 21 nt, Artificial Sequence
  RNA Oligomer
uuacaugcaaugaagcugaac

SEQ ID NO: 28260 - RNA, 21 nt, Artificial Sequence
  RNA Oligomer
aacugguagaugucuucaaca

SEQ ID NO: 28261 - RNA, 21 nt, Artificial Sequence
  RNA Oligomer
uacugaauccucuuucaaccu

SEQ ID NO: 28262 - RNA, 21 nt, Artificial Sequence
  RNA Oligomer
agugcaaacaucaaaguugcu

SEQ ID NO: 28263 - RNA, 21 nt, Artificial Sequence
  RNA Oligomer
uauccauaauaggauacacag

SEQ ID NO: 28264 - RNA, 21 nt, Artificial Sequence
  RNA Oligomer
uguaaacaccauauuggccca

SEQ ID NO: 28265 - RNA, 21 nt, Artificial Sequence
  RNA Oligomer
uguguuugugaguuuauacug

SEQ ID NO: 28266 - RNA, 21 nt, Artificial Sequence
  RNA Oligomer
ucuucgacacacauauaagug

SEQ ID NO: 28267 - RNA, 21 nt, Artificial Sequence
  RNA Oligomer
aaugugaguaguagcugagga

SEQ ID NO: 28268 - RNA, 21 nt, Artificial Sequence
  RNA Oligomer
auaguagcacaaguccauuga

SEQ ID NO: 28269 - RNA, 21 nt, Artificial Sequence
  RNA Oligomer
uuuagcagggacuuaaggaca

SEQ ID NO: 28270 - RNA, 21 nt, Artificial Sequence
  RNA Oligomer
uucuuguugaaaagaccuaag

SEQ ID NO: 28271 - RNA, 21 nt, Artificial Sequence
  RNA Oligomer
ucuaagccucaugaauaaggc

SEQ ID NO: 28272 - RNA, 21 nt, Artificial Sequence
  RNA Oligomer
gaugcuuucaagccuguaucu

SEQ ID NO: 28273 - RNA, 21 nt, Artificial Sequence
  RNA Oligomer
ggcaagaagaauuguuucugu

SEQ ID NO: 28274 - RNA, 21 nt, Artificial Sequence
  RNA Oligomer
aaguucaggcacucagaccug

SEQ ID NO: 28275 - RNA, 21 nt, Artificial Sequence
  RNA Oligomer
aagaggauacugaugauguag

SEQ ID NO: 28276 - RNA, 21 nt, Artificial Sequence
  RNA Oligomer
cacaaccagguugcugagugu

SEQ ID NO: 28277 - RNA, 21 nt, Artificial Sequence
  RNA Oligomer
auuacaugcaaugaagcugaa

SEQ ID NO: 28278 - RNA, 21 nt, Artificial Sequence
  RNA Oligomer
augcaaugaagcugaacauga

SEQ ID NO: 28279 - RNA, 21 nt, Artificial Sequence
  RNA Oligomer
agaaacugguagaugucuuca

SEQ ID NO: 28280 - RNA, 21 nt, Artificial Sequence
  RNA Oligomer
uucaaccucucuugcauucca

SEQ ID NO: 28281 - RNA, 21 nt, Artificial Sequence
  RNA Oligomer
ucaaaguugcuggucacucca

SEQ ID NO: 28282 - RNA, 21 nt, Artificial Sequence
  RNA Oligomer
uucaguaauagcauuacugcu

SEQ ID NO: 28283 - RNA, 21 nt, Artificial Sequence
  RNA Oligomer
aaaaagugugcuuuacuugcc

SEQ ID NO: 28284 - RNA, 21 nt, Artificial Sequence
  RNA Oligomer
gaaccuugucaaggaguuugc

SEQ ID NO: 28285 - RNA, 21 nt, Artificial Sequence
  RNA Oligomer
ugaaugugaguaguagcugag

SEQ ID NO: 28286 - RNA, 21 nt, Artificial Sequence
  RNA Oligomer
uauucugugggccuugucuga

SEQ ID NO: 28287 - RNA, 21 nt, Artificial Sequence
  RNA Oligomer
aagcuuaccuucaaagugcaa

SEQ ID NO: 28288 - RNA, 21 nt, Artificial Sequence
  RNA Oligomer
gcagggacuuaaggacaaucc

SEQ ID NO: 28289 - RNA, 21 nt, Artificial Sequence
  RNA Oligomer
cuuaaggacaauccucugucu

SEQ ID NO: 28290 - RNA, 21 nt, Artificial Sequence
  RNA Oligomer
uccuggccagaauuauuucag

SEQ ID NO: 28291 - RNA, 21 nt, Artificial Sequence
  RNA Oligomer
acgccaagugauugaacuccu

SEQ ID NO: 28292 - RNA, 21 nt, Artificial Sequence
  RNA Oligomer
cacaauugaguggaaucuuga

SEQ ID NO: 28293 - RNA, 21 nt, Artificial Sequence
  RNA Oligomer
agaagaauuguuucugucgcc

SEQ ID NO: 28294 - RNA, 21 nt, Artificial Sequence
  RNA Oligomer
auauuuuugagacccacaguc

SEQ ID NO: 28295 - RNA, 21 nt, Artificial Sequence
  RNA Oligomer
cugaugauguagguucgcagc

SEQ ID NO: 28296 - RNA, 21 nt, Artificial Sequence
  RNA Oligomer
ucaauaccguacuugaacuuc

SEQ ID NO: 28297 - RNA, 21 nt, Artificial Sequence
  RNA Oligomer
acauugacaccaucaguuugg

SEQ ID NO: 28298 - RNA, 21 nt, Artificial Sequence
  RNA Oligomer
guuugguacuuuccucacgcc

SEQ ID NO: 28299 - RNA, 21 nt, Artificial Sequence
  RNA Oligomer
augaucugauggacuaggucu

SEQ ID NO: 28300 - RNA, 21 nt, Artificial Sequence
  RNA Oligomer
gaucugauggacuaggucuac

SEQ ID NO: 28301 - RNA, 21 nt, Artificial Sequence
  RNA Oligomer
augaccguaguuuaacaugga

SEQ ID NO: 28302 - RNA, 21 nt, Artificial Sequence
  RNA Oligomer
uggucacuccaaaagacugcu

SEQ ID NO: 28303 - RNA, 21 nt, Artificial Sequence
  RNA Oligomer
uaggaaaacccaagaauacca

SEQ ID NO: 28304 - RNA, 21 nt, Artificial Sequence
  RNA Oligomer
uuaggcacauuuaauagucca

SEQ ID NO: 28305 - RNA, 21 nt, Artificial Sequence
  RNA Oligomer
cuaucauucaagcaucaauga

SEQ ID NO: 28306 - RNA, 21 nt, Artificial Sequence
  RNA Oligomer
auagcauuacugcuauauccu

SEQ ID NO: 28307 - RNA, 21 nt, Artificial Sequence
  RNA Oligomer
aaaccaguauccauaauagga

SEQ ID NO: 28308 - RNA, 21 nt, Artificial Sequence
  RNA Oligomer
aguauccauaauaggauacac

SEQ ID NO: 28309 - RNA, 21 nt, Artificial Sequence
  RNA Oligomer
auccauaauaggauacacagg

SEQ ID NO: 28310 - RNA, 21 nt, Artificial Sequence
  RNA Oligomer
aaaagugugcuuuacuugcca

SEQ ID NO: 28311 - RNA, 21 nt, Artificial Sequence
  RNA Oligomer
guguuugugaguuuauacugu

SEQ ID NO: 28312 - RNA, 21 nt, Artificial Sequence
  RNA Oligomer
agugaugguaaugauauugug

SEQ ID NO: 28313 - RNA, 21 nt, Artificial Sequence
  RNA Oligomer
aaguccauugacaccuggagg

SEQ ID NO: 28314 - RNA, 21 nt, Artificial Sequence
  RNA Oligomer
aggccuagaaagcuuaccuuc

SEQ ID NO: 28315 - RNA, 21 nt, Artificial Sequence
  RNA Oligomer
aagccucaugaauaaggcugu

SEQ ID NO: 28316 - RNA, 21 nt, Artificial Sequence
  RNA Oligomer
ucuucuccacaauugagugga

SEQ ID NO: 28317 - RNA, 21 nt, Artificial Sequence
  RNA Oligomer
ucugcacuguaauuagcccag

SEQ ID NO: 28318 - RNA, 21 nt, Artificial Sequence
  RNA Oligomer
uugcggcaagaagaauuguuu

SEQ ID NO: 28319 - RNA, 21 nt, Artificial Sequence
  RNA Oligomer
auauucaaggccagggacacc

SEQ ID NO: 28320 - RNA, 21 nt, Artificial Sequence
  RNA Oligomer
auagauguaccacuggaucag

SEQ ID NO: 28321 - RNA, 21 nt, Artificial Sequence
  RNA Oligomer
augauguagguucgcagcaac

SEQ ID NO: 28322 - RNA, 21 nt, Artificial Sequence
  RNA Oligomer
auguccacauugacaccauca

SEQ ID NO: 28323 - RNA, 21 nt, Artificial Sequence
  RNA Oligomer
aaaacuccgcugcuguuuggu

SEQ ID NO: 28324 - RNA, 21 nt, Artificial Sequence
  RNA Oligomer
uuugguacuuuccucacgccu

SEQ ID NO: 28325 - RNA, 21 nt, Artificial Sequence
  RNA Oligomer
aacgaaaggcagacugcucau

SEQ ID NO: 28326 - RNA, 21 nt, Artificial Sequence
  RNA Oligomer
acaugaucugauggacuaggu

SEQ ID NO: 28327 - RNA, 21 nt, Artificial Sequence
  RNA Oligomer
caugaucugauggacuagguc

SEQ ID NO: 28328 - RNA, 21 nt, Artificial Sequence
  RNA Oligomer
aaagugucauacucagcauuu

SEQ ID NO: 28329 - RNA, 21 nt, Artificial Sequence
  RNA Oligomer
auuuaauaguccacucuaagc

SEQ ID NO: 28330 - RNA, 21 nt, Artificial Sequence
  RNA Oligomer
augacuaaagccuguuuacag

SEQ ID NO: 28331 - RNA, 21 nt, Artificial Sequence
  RNA Oligomer
gcuauauccuaaaaaaaggag

SEQ ID NO: 28332 - RNA, 21 nt, Artificial Sequence
  RNA Oligomer
uccauaauaggauacacaggg

SEQ ID NO: 28333 - RNA, 21 nt, Artificial Sequence
  RNA Oligomer
uacuugccacagcaggaauua

SEQ ID NO: 28334 - RNA, 21 nt, Artificial Sequence
  RNA Oligomer
uauuaagcauggcuugauucc

SEQ ID NO: 28335 - RNA, 21 nt, Artificial Sequence
  RNA Oligomer
gauauugugcaaguggaugga

SEQ ID NO: 28336 - RNA, 21 nt, Artificial Sequence
  RNA Oligomer
uagcacaaguccauugacacc

SEQ ID NO: 28337 - RNA, 21 nt, Artificial Sequence
  RNA Oligomer
uguuuuagcagggacuuaagg

SEQ ID NO: 28338 - RNA, 21 nt, Artificial Sequence
  RNA Oligomer
uuaaggacaauccucugucuu

SEQ ID NO: 28339 - RNA, 21 nt, Artificial Sequence
  RNA Oligomer
gacaauccucugucuuuuucu

SEQ ID NO: 28340 - RNA, 21 nt, Artificial Sequence
  RNA Oligomer
aagucacgccaagugauugaa

SEQ ID NO: 28341 - RNA, 21 nt, Artificial Sequence
  RNA Oligomer
uacacagaaccauucuuaggg

SEQ ID NO: 28342 - RNA, 21 nt, Artificial Sequence
  RNA Oligomer
agucacgccaagugauugaac

SEQ ID NO: 28343 - RNA, 21 nt, Artificial Sequence
  RNA Oligomer
uucuaagccucaugaauaagg

SEQ ID NO: 28344 - RNA, 21 nt, Artificial Sequence
  RNA Oligomer
cucaugaauaaggcuguugag

SEQ ID NO: 28345 - RNA, 21 nt, Artificial Sequence
  RNA Oligomer
caagugauugaacuccuugga

SEQ ID NO: 28346 - RNA, 21 nt, Artificial Sequence
  RNA Oligomer
aaggcuguugaguaccaccuc

SEQ ID NO: 28347 - RNA, 21 nt, Artificial Sequence
  RNA Oligomer
uuggugaggagcagccauuga

SEQ ID NO: 28348 - RNA, 21 nt, Artificial Sequence
  RNA Oligomer
ucaaagauagacuugaagagg

SEQ ID NO: 28349 - RNA, 21 nt, Artificial Sequence
  RNA Oligomer
acugaugauguagguucgcag

SEQ ID NO: 28350 - RNA, 21 nt, Artificial Sequence
  RNA Oligomer
ugauguagguucgcagcaacc

SEQ ID NO: 28351 - RNA, 21 nt, Artificial Sequence
  RNA Oligomer
guuacaacgaaaggcagacug

SEQ ID NO: 28352 - RNA, 21 nt, Artificial Sequence
  RNA Oligomer
ucuccagaacacaugaucuga

SEQ ID NO: 28353 - RNA, 21 nt, Artificial Sequence
  RNA Oligomer
auggacuaggucuacauuaca

SEQ ID NO: 28354 - RNA, 21 nt, Artificial Sequence
  RNA Oligomer
cauuacaugcaaugaagcuga

SEQ ID NO: 28355 - RNA, 21 nt, Artificial Sequence
  RNA Oligomer
agugucauacucagcauuuuc

SEQ ID NO: 28356 - RNA, 21 nt, Artificial Sequence
  RNA Oligomer
uugcuggucacuccaaaagac

SEQ ID NO: 28357 - RNA, 21 nt, Artificial Sequence
  RNA Oligomer
uuuaauaguccacucuaagca

SEQ ID NO: 28358 - RNA, 21 nt, Artificial Sequence
  RNA Oligomer
auuaagcauggcuugauuccc

SEQ ID NO: 28359 - RNA, 21 nt, Artificial Sequence
  RNA Oligomer
aagcauggcuugauucccuga

SEQ ID NO: 28360 - RNA, 21 nt, Artificial Sequence
  RNA Oligomer
cuaagccucaugaauaaggcu

SEQ ID NO: 28361 - RNA, 21 nt, Artificial Sequence
  RNA Oligomer
aguuagagauggugcuucccg

SEQ ID NO: 28362 - RNA, 21 nt, Artificial Sequence
  RNA Oligomer
uaagggucgcucuuucccuua

SEQ ID NO: 28363 - RNA, 21 nt, Artificial Sequence
  RNA Oligomer
ugcugauaccucguaaaagcu

SEQ ID NO: 28364 - RNA, 21 nt, Artificial Sequence
  RNA Oligomer
uucaauaccguacuugaacuu

SEQ ID NO: 28365 - RNA, 21 nt, Artificial Sequence
  RNA Oligomer
uuaaaacuccgcugcuguuug

SEQ ID NO: 28366 - RNA, 21 nt, Artificial Sequence
  RNA Oligomer
gugcauguccacauugacacc

SEQ ID NO: 28367 - RNA, 21 nt, Artificial Sequence
  RNA Oligomer
aucaguuugggcaaccuugag

SEQ ID NO: 28368 - RNA, 21 nt, Artificial Sequence
  RNA Oligomer
gucauagcagacauuuucaca

SEQ ID NO: 28369 - RNA, 21 nt, Artificial Sequence
  RNA Oligomer
caugaccguaguuuaacaugg

SEQ ID NO: 28370 - RNA, 21 nt, Artificial Sequence
  RNA Oligomer
uuaguuguauguguacuacug

SEQ ID NO: 28371 - RNA, 21 nt, Artificial Sequence
  RNA Oligomer
aggaaaacccaagaauaccag

SEQ ID NO: 28372 - RNA, 21 nt, Artificial Sequence
  RNA Oligomer
uugaaccuugucaaggaguuu

SEQ ID NO: 28373 - RNA, 21 nt, Artificial Sequence
  RNA Oligomer
uaagcauggcuugauucccug

SEQ ID NO: 28374 - RNA, 21 nt, Artificial Sequence
  RNA Oligomer
ucacgccaagugauugaacuc

SEQ ID NO: 28375 - RNA, 21 nt, Artificial Sequence
  RNA Oligomer
cacgccaagugauugaacucc

SEQ ID NO: 28376 - RNA, 21 nt, Artificial Sequence
  RNA Oligomer
uaagccucaugaauaaggcug

SEQ ID NO: 28377 - RNA, 21 nt, Artificial Sequence
  RNA Oligomer
gaaucaugacagucagcaaca

SEQ ID NO: 28378 - RNA, 21 nt, Artificial Sequence
  RNA Oligomer
ugcaccucauuccaacuccua

SEQ ID NO: 28379 - RNA, 21 nt, Artificial Sequence
  RNA Oligomer
cgaaucaugacagucagcaac

SEQ ID NO: 28380 - RNA, 21 nt, Artificial Sequence
  RNA Oligomer
gcaccucauuccaacuccuac

SEQ ID NO: 28381 - RNA, 21 nt, Artificial Sequence
  RNA Oligomer
acccugcaccucauuccaacu

SEQ ID NO: 28382 - RNA, 21 nt, Artificial Sequence
  RNA Oligomer
cugcaccucauuccaacuccu

SEQ ID NO: 28383 - RNA, 21 nt, Artificial Sequence
  RNA Oligomer
agcguaucacugagaccgagu

SEQ ID NO: 28384 - RNA, 21 nt, Artificial Sequence
  RNA Oligomer
ggaaacagcguaucacugaga

SEQ ID NO: 28385 - RNA, 21 nt, Artificial Sequence
  RNA Oligomer
ggaugucuacagcgaccucaa

SEQ ID NO: 28386 - RNA, 21 nt, Artificial Sequence
  RNA Oligomer
gaaacagcguaucacugagac

SEQ ID NO: 28387 - RNA, 21 nt, Artificial Sequence
  RNA Oligomer
cggaaacagcguaucacugag

SEQ ID NO: 28388 - RNA, 21 nt, Artificial Sequence
  RNA Oligomer
cgauugcaguugcucuacggu

SEQ ID NO: 28389 - RNA, 21 nt, Artificial Sequence
  RNA Oligomer
agcccgaaucaugacagucag

SEQ ID NO: 28390 - RNA, 21 nt, Artificial Sequence
  RNA Oligomer
acugagaccgagucgccuuau

SEQ ID NO: 28391 - RNA, 21 nt, Artificial Sequence
  RNA Oligomer
ccggaaacagcguaucacuga

SEQ ID NO: 28392 - RNA, 21 nt, Artificial Sequence
  RNA Oligomer
acagcguaucacugagaccga

SEQ ID NO: 28393 - RNA, 21 nt, Artificial Sequence
  RNA Oligomer
uggugcugacagugcucauug

SEQ ID NO: 28394 - RNA, 21 nt, Artificial Sequence
  RNA Oligomer
acccggaaacagcguaucacu

SEQ ID NO: 28395 - RNA, 21 nt, Artificial Sequence
  RNA Oligomer
caugacagucagcaacaugau

SEQ ID NO: 28396 - RNA, 21 nt, Artificial Sequence
  RNA Oligomer
gucuacagcgaccucaacaca

SEQ ID NO: 28397 - RNA, 21 nt, Artificial Sequence
  RNA Oligomer
ugagaccgagucgccuuauca

SEQ ID NO: 28398 - RNA, 21 nt, Artificial Sequence
  RNA Oligomer
cccgaaucaugacagucagca

SEQ ID NO: 28399 - RNA, 21 nt, Artificial Sequence
  RNA Oligomer
gagcgauugcaguugcucuac

SEQ ID NO: 28400 - RNA, 21 nt, Artificial Sequence
  RNA Oligomer
agagcgauugcaguugcucua

SEQ ID NO: 28401 - RNA, 21 nt, Artificial Sequence
  RNA Oligomer
uguugcugacugucaugauuc

SEQ ID NO: 28402 - RNA, 21 nt, Artificial Sequence
  RNA Oligomer
uaggaguuggaaugaggugca

SEQ ID NO: 28403 - RNA, 21 nt, Artificial Sequence
  RNA Oligomer
guugcugacugucaugauucg

SEQ ID NO: 28404 - RNA, 21 nt, Artificial Sequence
  RNA Oligomer
guaggaguuggaaugaggugc

SEQ ID NO: 28405 - RNA, 21 nt, Artificial Sequence
  RNA Oligomer
aguuggaaugaggugcagggu

SEQ ID NO: 28406 - RNA, 21 nt, Artificial Sequence
  RNA Oligomer
aggaguuggaaugaggugcag

SEQ ID NO: 28407 - RNA, 21 nt, Artificial Sequence
  RNA Oligomer
acucggucucagugauacgcu

SEQ ID NO: 28408 - RNA, 21 nt, Artificial Sequence
  RNA Oligomer
ucucagugauacgcuguuucc

SEQ ID NO: 28409 - RNA, 21 nt, Artificial Sequence
  RNA Oligomer
uugaggucgcuguagacaucc

SEQ ID NO: 28410 - RNA, 21 nt, Artificial Sequence
  RNA Oligomer
gucucagugauacgcuguuuc

SEQ ID NO: 28411 - RNA, 21 nt, Artificial Sequence
  RNA Oligomer
cucagugauacgcuguuuccg

SEQ ID NO: 28412 - RNA, 21 nt, Artificial Sequence
  RNA Oligomer
accguagagcaacugcaaucg

SEQ ID NO: 28413 - RNA, 21 nt, Artificial Sequence
  RNA Oligomer
cugacugucaugauucgggcu

SEQ ID NO: 28414 - RNA, 21 nt, Artificial Sequence
  RNA Oligomer
auaaggcgacucggucucagu

SEQ ID NO: 28415 - RNA, 21 nt, Artificial Sequence
  RNA Oligomer
ucagugauacgcuguuuccgg

SEQ ID NO: 28416 - RNA, 21 nt, Artificial Sequence
  RNA Oligomer
ucggucucagugauacgcugu

SEQ ID NO: 28417 - RNA, 21 nt, Artificial Sequence
  RNA Oligomer
caaugagcacugucagcacca

SEQ ID NO: 28418 - RNA, 21 nt, Artificial Sequence
  RNA Oligomer
agugauacgcuguuuccgggu

SEQ ID NO: 28419 - RNA, 21 nt, Artificial Sequence
  RNA Oligomer
aucauguugcugacugucaug

SEQ ID NO: 28420 - RNA, 21 nt, Artificial Sequence
  RNA Oligomer
uguguugaggucgcuguagac

SEQ ID NO: 28421 - RNA, 21 nt, Artificial Sequence
  RNA Oligomer
ugauaaggcgacucggucuca

SEQ ID NO: 28422 - RNA, 21 nt, Artificial Sequence
  RNA Oligomer
ugcugacugucaugauucggg

SEQ ID NO: 28423 - RNA, 21 nt, Artificial Sequence
  RNA Oligomer
guagagcaacugcaaucgcuc

SEQ ID NO: 28424 - RNA, 21 nt, Artificial Sequence
  RNA Oligomer
uagagcaacugcaaucgcucu

SEQ ID NO: 28425 - RNA, 21 nt, Artificial Sequence
  RNA Oligomer
ucacaucucauuuuuccguaa

SEQ ID NO: 28426 - RNA, 21 nt, Artificial Sequence
  RNA Oligomer
cacaucucauuuuuccguaaa

SEQ ID NO: 28427 - RNA, 21 nt, Artificial Sequence
  RNA Oligomer
gaacauuaagaagggcaaaaa

SEQ ID NO: 28428 - RNA, 21 nt, Artificial Sequence
  RNA Oligomer
gagaacauuaagaagggcaaa

SEQ ID NO: 28429 - RNA, 21 nt, Artificial Sequence
  RNA Oligomer
agagaacauuaagaagggcaa

SEQ ID NO: 28430 - RNA, 21 nt, Artificial Sequence
  RNA Oligomer
uucacaucucauuuuuccgua

SEQ ID NO: 28431 - RNA, 21 nt, Artificial Sequence
  RNA Oligomer
cgagcuaaauucuguggagua

SEQ ID NO: 28432 - RNA, 21 nt, Artificial Sequence
  RNA Oligomer
agaacauuaagaagggcaaaa

SEQ ID NO: 28433 - RNA, 21 nt, Artificial Sequence
  RNA Oligomer
cgaguaauaugccugcuauuu

SEQ ID NO: 28434 - RNA, 21 nt, Artificial Sequence
  RNA Oligomer
gaacugauucacaucucauuu

SEQ ID NO: 28435 - RNA, 21 nt, Artificial Sequence
  RNA Oligomer
gccugcuauuugaaguguaau

SEQ ID NO: 28436 - RNA, 21 nt, Artificial Sequence
  RNA Oligomer
acgaguaauaugccugcuauu

SEQ ID NO: 28437 - RNA, 21 nt, Artificial Sequence
  RNA Oligomer
agauagcaucuuauacgagua

SEQ ID NO: 28438 - RNA, 21 nt, Artificial Sequence
  RNA Oligomer
cagcaccagaauguauauuaa

SEQ ID NO: 28439 - RNA, 21 nt, Artificial Sequence
  RNA Oligomer
acagcaccagaauguauauua

SEQ ID NO: 28440 - RNA, 21 nt, Artificial Sequence
  RNA Oligomer
gccuaucaaguuugagcuuuc

SEQ ID NO: 28441 - RNA, 21 nt, Artificial Sequence
  RNA Oligomer
acauuaagaagggcaaaaagu

SEQ ID NO: 28442 - RNA, 21 nt, Artificial Sequence
  RNA Oligomer
cgaaugacacuguucaggaau

SEQ ID NO: 28443 - RNA, 21 nt, Artificial Sequence
  RNA Oligomer
ccagaauguauauuaaggugu

SEQ ID NO: 28444 - RNA, 21 nt, Artificial Sequence
  RNA Oligomer
caggaagauguacggagacau

SEQ ID NO: 28445 - RNA, 21 nt, Artificial Sequence
  RNA Oligomer
gcccagacccaacuaugauua

SEQ ID NO: 28446 - RNA, 21 nt, Artificial Sequence
  RNA Oligomer
cggcgaggucaugaagaagaa

SEQ ID NO: 28447 - RNA, 21 nt, Artificial Sequence
  RNA Oligomer
cuaaauucuguggaguaugua

SEQ ID NO: 28448 - RNA, 21 nt, Artificial Sequence
  RNA Oligomer
gaagacauaccgagcuaaauu

SEQ ID NO: 28449 - RNA, 21 nt, Artificial Sequence
  RNA Oligomer
ggcugauuucuagguaggaaa

SEQ ID NO: 28450 - RNA, 21 nt, Artificial Sequence
  RNA Oligomer
aggaaaauuuuagcgugcuca

SEQ ID NO: 28451 - RNA, 21 nt, Artificial Sequence
  RNA Oligomer
gaaggaaaauuuuagcgugcu

SEQ ID NO: 28452 - RNA, 21 nt, Artificial Sequence
  RNA Oligomer
guaauaugccugcuauuugaa

SEQ ID NO: 28453 - RNA, 21 nt, Artificial Sequence
  RNA Oligomer
gcaucuuauacgaguaauaug

SEQ ID NO: 28454 - RNA, 21 nt, Artificial Sequence
  RNA Oligomer
gcagaaagguuaguaucauca

SEQ ID NO: 28455 - RNA, 21 nt, Artificial Sequence
  RNA Oligomer
agagagugagagacauuaacu

SEQ ID NO: 28456 - RNA, 21 nt, Artificial Sequence
  RNA Oligomer
agacauaccgagcuaaauucu

SEQ ID NO: 28457 - RNA, 21 nt, Artificial Sequence
  RNA Oligomer
gaccuggaagagaacauuaag

SEQ ID NO: 28458 - RNA, 21 nt, Artificial Sequence
  RNA Oligomer
agcaccagaauguauauuaag

SEQ ID NO: 28459 - RNA, 21 nt, Artificial Sequence
  RNA Oligomer
ucccacccaauucaaaacauu

SEQ ID NO: 28460 - RNA, 21 nt, Artificial Sequence
  RNA Oligomer
cucauuagacuggaacuugaa

SEQ ID NO: 28461 - RNA, 21 nt, Artificial Sequence
  RNA Oligomer
ccgagcuaaauucuguggagu

SEQ ID NO: 28462 - RNA, 21 nt, Artificial Sequence
  RNA Oligomer
ugaagacauaccgagcuaaau

SEQ ID NO: 28463 - RNA, 21 nt, Artificial Sequence
  RNA Oligomer
cuaucaaguuugagcuuucug

SEQ ID NO: 28464 - RNA, 21 nt, Artificial Sequence
  RNA Oligomer
ccuaucaaguuugagcuuucu

SEQ ID NO: 28465 - RNA, 21 nt, Artificial Sequence
  RNA Oligomer
ugaccaaaaguuacauguuug

SEQ ID NO: 28466 - RNA, 21 nt, Artificial Sequence
  RNA Oligomer
ggacaguuuauuuguugagag

SEQ ID NO: 28467 - RNA, 21 nt, Artificial Sequence
  RNA Oligomer
ugaccuggaagagaacauuaa

SEQ ID NO: 28468 - RNA, 21 nt, Artificial Sequence
  RNA Oligomer
cugaccuggaagagaacauua

SEQ ID NO: 28469 - RNA, 21 nt, Artificial Sequence
  RNA Oligomer
gcugaccuggaagagaacauu

SEQ ID NO: 28470 - RNA, 21 nt, Artificial Sequence
  RNA Oligomer
aaggaaaauuuuagcgugcuc

SEQ ID NO: 28471 - RNA, 21 nt, Artificial Sequence
  RNA Oligomer
ccugcuauuugaaguguaauu

SEQ ID NO: 28472 - RNA, 21 nt, Artificial Sequence
  RNA Oligomer
gauagcaucuuauacgaguaa

SEQ ID NO: 28473 - RNA, 21 nt, Artificial Sequence
  RNA Oligomer
ugacaguggaacuacauuagu

SEQ ID NO: 28474 - RNA, 21 nt, Artificial Sequence
  RNA Oligomer
uguuaagacuugacaguggaa

SEQ ID NO: 28475 - RNA, 21 nt, Artificial Sequence
  RNA Oligomer
ugaagaauguuaagacuugac

SEQ ID NO: 28476 - RNA, 21 nt, Artificial Sequence
  RNA Oligomer
gcaugaagccagagagugaga

SEQ ID NO: 28477 - RNA, 21 nt, Artificial Sequence
  RNA Oligomer
augaagacauaccgagcuaaa

SEQ ID NO: 28478 - RNA, 21 nt, Artificial Sequence
  RNA Oligomer
gcugauuucuagguaggaaau

SEQ ID NO: 28479 - RNA, 21 nt, Artificial Sequence
  RNA Oligomer
cugauucgaaugacacuguuc

SEQ ID NO: 28480 - RNA, 21 nt, Artificial Sequence
  RNA Oligomer
ucugauucgaaugacacuguu

SEQ ID NO: 28481 - RNA, 21 nt, Artificial Sequence
  RNA Oligomer
cgaagcugaccuggaagagaa

SEQ ID NO: 28482 - RNA, 21 nt, Artificial Sequence
  RNA Oligomer
cugcuauuugaaguguaauug

SEQ ID NO: 28483 - RNA, 21 nt, Artificial Sequence
  RNA Oligomer
gcaccagaauguauauuaagg

SEQ ID NO: 28484 - RNA, 21 nt, Artificial Sequence
  RNA Oligomer
gaagaauguuaagacuugaca

SEQ ID NO: 28485 - RNA, 21 nt, Artificial Sequence
  RNA Oligomer
gguuugaagaauguuaagacu

SEQ ID NO: 28486 - RNA, 21 nt, Artificial Sequence
  RNA Oligomer
ugauuucaguagcacaaguua

SEQ ID NO: 28487 - RNA, 21 nt, Artificial Sequence
  RNA Oligomer
ugaacugauucacaucucauu

SEQ ID NO: 28488 - RNA, 21 nt, Artificial Sequence
  RNA Oligomer
agcuaaauucuguggaguaug

SEQ ID NO: 28489 - RNA, 21 nt, Artificial Sequence
  RNA Oligomer
gagcuaaauucuguggaguau

SEQ ID NO: 28490 - RNA, 21 nt, Artificial Sequence
  RNA Oligomer
caugaagacauaccgagcuaa

SEQ ID NO: 28491 - RNA, 21 nt, Artificial Sequence
  RNA Oligomer
ggcaggcugauuucuagguag

SEQ ID NO: 28492 - RNA, 21 nt, Artificial Sequence
  RNA Oligomer
uggcaggcugauuucuaggua

SEQ ID NO: 28493 - RNA, 21 nt, Artificial Sequence
  RNA Oligomer
agcagaaagguuaguaucauc

SEQ ID NO: 28494 - RNA, 21 nt, Artificial Sequence
  RNA Oligomer
ugguuugaagaauguuaagac

SEQ ID NO: 28495 - RNA, 21 nt, Artificial Sequence
  RNA Oligomer
aggaagauguacggagacaug

SEQ ID NO: 28496 - RNA, 21 nt, Artificial Sequence
  RNA Oligomer
accgacuggaagacacguuug

SEQ ID NO: 28497 - RNA, 21 nt, Artificial Sequence
  RNA Oligomer
accgagcuaaauucuguggag

SEQ ID NO: 28498 - RNA, 21 nt, Artificial Sequence
  RNA Oligomer
gugaccaaaaguuacauguuu

SEQ ID NO: 28499 - RNA, 21 nt, Artificial Sequence
  RNA Oligomer
cggacaguuuauuuguugaga

SEQ ID NO: 28500 - RNA, 21 nt, Artificial Sequence
  RNA Oligomer
gacacuguucaggaaucggaa

SEQ ID NO: 28501 - RNA, 21 nt, Artificial Sequence
  RNA Oligomer
gaaguguaauugagaaggaaa

SEQ ID NO: 28502 - RNA, 21 nt, Artificial Sequence
  RNA Oligomer
ucagauagcaucuuauacgag

SEQ ID NO: 28503 - RNA, 21 nt, Artificial Sequence
  RNA Oligomer
cagcagaaagguuaguaucau

SEQ ID NO: 28504 - RNA, 21 nt, Artificial Sequence
  RNA Oligomer
cagaauguauauuaaggugug

SEQ ID NO: 28505 - RNA, 21 nt, Artificial Sequence
  RNA Oligomer
gaauguuaagacuugacagug

SEQ ID NO: 28506 - RNA, 21 nt, Artificial Sequence
  RNA Oligomer
agauguacggagacauggcau

SEQ ID NO: 28507 - RNA, 21 nt, Artificial Sequence
  RNA Oligomer
caucuuugaaucgcuguacua

SEQ ID NO: 28508 - RNA, 21 nt, Artificial Sequence
  RNA Oligomer
gcuaaauucuguggaguaugu

SEQ ID NO: 28509 - RNA, 21 nt, Artificial Sequence
  RNA Oligomer
gacaguuuauuuguugagagu

SEQ ID NO: 28510 - RNA, 21 nt, Artificial Sequence
  RNA Oligomer
gcaggcugauuucuagguagg

SEQ ID NO: 28511 - RNA, 21 nt, Artificial Sequence
  RNA Oligomer
acacuguucaggaaucggaau

SEQ ID NO: 28512 - RNA, 21 nt, Artificial Sequence
  RNA Oligomer
ccuggaagagaacauuaagaa

SEQ ID NO: 28513 - RNA, 21 nt, Artificial Sequence
  RNA Oligomer
gaguaauaugccugcuauuug

SEQ ID NO: 28514 - RNA, 21 nt, Artificial Sequence
  RNA Oligomer
cagaaagguuaguaucaucag

SEQ ID NO: 28515 - RNA, 21 nt, Artificial Sequence
  RNA Oligomer
augauuucaguagcacaaguu

SEQ ID NO: 28516 - RNA, 21 nt, Artificial Sequence
  RNA Oligomer
gaccaaaaguuacauguuugc

SEQ ID NO: 28517 - RNA, 21 nt, Artificial Sequence
  RNA Oligomer
guaggaaaugugguagccuca

SEQ ID NO: 28518 - RNA, 21 nt, Artificial Sequence
  RNA Oligomer
ucgaaugacacuguucaggaa

SEQ ID NO: 28519 - RNA, 21 nt, Artificial Sequence
  RNA Oligomer
ugaaguguaauugagaaggaa

SEQ ID NO: 28520 - RNA, 21 nt, Artificial Sequence
  RNA Oligomer
gcuauuugaaguguaauugag

SEQ ID NO: 28521 - RNA, 21 nt, Artificial Sequence
  RNA Oligomer
ccguaaaaaugauuucaguag

SEQ ID NO: 28522 - RNA, 21 nt, Artificial Sequence
  RNA Oligomer
guacggagacauggcaugaag

SEQ ID NO: 28523 - RNA, 21 nt, Artificial Sequence
  RNA Oligomer
acaucuuugaaucgcuguacu

SEQ ID NO: 28524 - RNA, 21 nt, Artificial Sequence
  RNA Oligomer
cgaggucaugaagaagaacau

SEQ ID NO: 28525 - RNA, 21 nt, Artificial Sequence
  RNA Oligomer
ucggacaguuuauuuguugag

SEQ ID NO: 28526 - RNA, 21 nt, Artificial Sequence
  RNA Oligomer
caggcugauuucuagguagga

SEQ ID NO: 28527 - RNA, 21 nt, Artificial Sequence
  RNA Oligomer
ggaaauucugcucagauagaa

SEQ ID NO: 28528 - RNA, 21 nt, Artificial Sequence
  RNA Oligomer
agaauguauauuaaggugugg

SEQ ID NO: 28529 - RNA, 21 nt, Artificial Sequence
  RNA Oligomer
uucccacccaauucaaaacau

SEQ ID NO: 28530 - RNA, 21 nt, Artificial Sequence
  RNA Oligomer
cugauucacaucucauuuuuc

SEQ ID NO: 28531 - RNA, 21 nt, Artificial Sequence
  RNA Oligomer
aggcugauuucuagguaggaa

SEQ ID NO: 28532 - RNA, 21 nt, Artificial Sequence
  RNA Oligomer
agguaggaaaugugguagccu

SEQ ID NO: 28533 - RNA, 21 nt, Artificial Sequence
  RNA Oligomer
ggaagagaacauuaagaaggg

SEQ ID NO: 28534 - RNA, 21 nt, Artificial Sequence
  RNA Oligomer
cguaaaaaugauuucaguagc

SEQ ID NO: 28535 - RNA, 21 nt, Artificial Sequence
  RNA Oligomer
caacuaugauuagagccaacu

SEQ ID NO: 28536 - RNA, 21 nt, Artificial Sequence
  RNA Oligomer
gacaucuuugaaucgcuguac

SEQ ID NO: 28537 - RNA, 21 nt, Artificial Sequence
  RNA Oligomer
ugccugcuauuugaaguguaa

SEQ ID NO: 28538 - RNA, 21 nt, Artificial Sequence
  RNA Oligomer
ugagagugugaccaaaaguua

SEQ ID NO: 28539 - RNA, 21 nt, Artificial Sequence
  RNA Oligomer
cuggaagagaacauuaagaag

SEQ ID NO: 28540 - RNA, 21 nt, Artificial Sequence
  RNA Oligomer
cacugguuugaagaauguuaa

SEQ ID NO: 28541 - RNA, 21 nt, Artificial Sequence
  RNA Oligomer
cccggagacaaugacaucuuu

SEQ ID NO: 28542 - RNA, 21 nt, Artificial Sequence
  RNA Oligomer
gaagaagaacaugauguucau

SEQ ID NO: 28543 - RNA, 21 nt, Artificial Sequence
  RNA Oligomer
caagagacugagucaaguugu

SEQ ID NO: 28544 - RNA, 21 nt, Artificial Sequence
  RNA Oligomer
aucaagagacugagucaaguu

SEQ ID NO: 28545 - RNA, 21 nt, Artificial Sequence
  RNA Oligomer
caauucaaaacauugugccau

SEQ ID NO: 28546 - RNA, 21 nt, Artificial Sequence
  RNA Oligomer
gggcaaaaagugcauccguac

SEQ ID NO: 28547 - RNA, 21 nt, Artificial Sequence
  RNA Oligomer
gacacugguuugaagaauguu

SEQ ID NO: 28548 - RNA, 21 nt, Artificial Sequence
  RNA Oligomer
agacacugguuugaagaaugu

SEQ ID NO: 28549 - RNA, 21 nt, Artificial Sequence
  RNA Oligomer
agcucugacauucugauucga

SEQ ID NO: 28550 - RNA, 21 nt, Artificial Sequence
  RNA Oligomer
cacccggguuaccaaugacaa

SEQ ID NO: 28551 - RNA, 21 nt, Artificial Sequence
  RNA Oligomer
gacuugacaguggaacuacau

SEQ ID NO: 28552 - RNA, 21 nt, Artificial Sequence
  RNA Oligomer
cagacacugguuugaagaaug

SEQ ID NO: 28553 - RNA, 21 nt, Artificial Sequence
  RNA Oligomer
caaaacauugugccaugucaa

SEQ ID NO: 28554 - RNA, 21 nt, Artificial Sequence
  RNA Oligomer
ggcgaggucaugaagaagaac

SEQ ID NO: 28555 - RNA, 21 nt, Artificial Sequence
  RNA Oligomer
gccucacuuuuaaugaacaaa

SEQ ID NO: 28556 - RNA, 21 nt, Artificial Sequence
  RNA Oligomer
ggaaaugugguagccucacuu

SEQ ID NO: 28557 - RNA, 21 nt, Artificial Sequence
  RNA Oligomer
gucaaaacagauuguuugcaa

SEQ ID NO: 28558 - RNA, 21 nt, Artificial Sequence
  RNA Oligomer
gacauucugauucgaaugaca

SEQ ID NO: 28559 - RNA, 21 nt, Artificial Sequence
  RNA Oligomer
ggaaaauuuuagcgugcucac

SEQ ID NO: 28560 - RNA, 21 nt, Artificial Sequence
  RNA Oligomer
acauuaguacacagcaccaga

SEQ ID NO: 28561 - RNA, 21 nt, Artificial Sequence
  RNA Oligomer
caagggccucuucugugacuu

SEQ ID NO: 28562 - RNA, 21 nt, Artificial Sequence
  RNA Oligomer
acacugguuugaagaauguua

SEQ ID NO: 28563 - RNA, 21 nt, Artificial Sequence
  RNA Oligomer
gcuguacuacaggaagaugua

SEQ ID NO: 28564 - RNA, 21 nt, Artificial Sequence
  RNA Oligomer
gcaugaagacauaccgagcua

SEQ ID NO: 28565 - RNA, 21 nt, Artificial Sequence
  RNA Oligomer
gugcauccguacucccaaaau

SEQ ID NO: 28566 - RNA, 21 nt, Artificial Sequence
  RNA Oligomer
ugacuguuuuucggacaguuu

SEQ ID NO: 28567 - RNA, 21 nt, Artificial Sequence
  RNA Oligomer
uugugccaugucaaacaaaua

SEQ ID NO: 28568 - RNA, 21 nt, Artificial Sequence
  RNA Oligomer
cgcuguacuacaggaagaugu

SEQ ID NO: 28569 - RNA, 21 nt, Artificial Sequence
  RNA Oligomer
gaagaacaugauguucaucaa

SEQ ID NO: 28570 - RNA, 21 nt, Artificial Sequence
  RNA Oligomer
cguucaaagcaugaaauggau

SEQ ID NO: 28571 - RNA, 21 nt, Artificial Sequence
  RNA Oligomer
augccugcuauuugaagugua

SEQ ID NO: 28572 - RNA, 21 nt, Artificial Sequence
  RNA Oligomer
acacagcaccagaauguauau

SEQ ID NO: 28573 - RNA, 21 nt, Artificial Sequence
  RNA Oligomer
cauugugccaugucaaacaaa

SEQ ID NO: 28574 - RNA, 21 nt, Artificial Sequence
  RNA Oligomer
acauugugccaugucaaacaa

SEQ ID NO: 28575 - RNA, 21 nt, Artificial Sequence
  RNA Oligomer
agugagagacauuaacucauu

SEQ ID NO: 28576 - RNA, 21 nt, Artificial Sequence
  RNA Oligomer
ggucaugaagaagaacaugau

SEQ ID NO: 28577 - RNA, 21 nt, Artificial Sequence
  RNA Oligomer
gcgaggucaugaagaagaaca

SEQ ID NO: 28578 - RNA, 21 nt, Artificial Sequence
  RNA Oligomer
agccucacuuuuaaugaacaa

SEQ ID NO: 28579 - RNA, 21 nt, Artificial Sequence
  RNA Oligomer
gccuguaacaagccagauuuu

SEQ ID NO: 28580 - RNA, 21 nt, Artificial Sequence
  RNA Oligomer
ggcaagugaauuugccuguaa

SEQ ID NO: 28581 - RNA, 21 nt, Artificial Sequence
  RNA Oligomer
cggaauccugucgauuagacu

SEQ ID NO: 28582 - RNA, 21 nt, Artificial Sequence
  RNA Oligomer
ggaaucggaauccugucgauu

SEQ ID NO: 28583 - RNA, 21 nt, Artificial Sequence
  RNA Oligomer
agucaaguuguuccuuaaguc

SEQ ID NO: 28584 - RNA, 21 nt, Artificial Sequence
  RNA Oligomer
ccaucaagagacugagucaag

SEQ ID NO: 28585 - RNA, 21 nt, Artificial Sequence
  RNA Oligomer
auacgaguaauaugccugcua

SEQ ID NO: 28586 - RNA, 21 nt, Artificial Sequence
  RNA Oligomer
ggguuaccaaugacaacgccu

SEQ ID NO: 28587 - RNA, 21 nt, Artificial Sequence
  RNA Oligomer
gggaaaagauucccacccaau

SEQ ID NO: 28588 - RNA, 21 nt, Artificial Sequence
  RNA Oligomer
gugagagacauuaacucauua

SEQ ID NO: 28589 - RNA, 21 nt, Artificial Sequence
  RNA Oligomer
ugaaucgcuguacuacaggaa

SEQ ID NO: 28590 - RNA, 21 nt, Artificial Sequence
  RNA Oligomer
caaaacagauuguuugcaaag

SEQ ID NO: 28591 - RNA, 21 nt, Artificial Sequence
  RNA Oligomer
ugaucguucaaagcaugaaau

SEQ ID NO: 28592 - RNA, 21 nt, Artificial Sequence
  RNA Oligomer
ggaauccugucgauuagacug

SEQ ID NO: 28593 - RNA, 21 nt, Artificial Sequence
  RNA Oligomer
auguauauuaagguguggcuu

SEQ ID NO: 28594 - RNA, 21 nt, Artificial Sequence
  RNA Oligomer
ggaacuacauuaguacacagc

SEQ ID NO: 28595 - RNA, 21 nt, Artificial Sequence
  RNA Oligomer
caguggaacuacauuaguaca

SEQ ID NO: 28596 - RNA, 21 nt, Artificial Sequence
  RNA Oligomer
ccaugucaaacaaauagucua

SEQ ID NO: 28597 - RNA, 21 nt, Artificial Sequence
  RNA Oligomer
cacccaauucaaaacauugug

SEQ ID NO: 28598 - RNA, 21 nt, Artificial Sequence
  RNA Oligomer
uugaacugauucacaucucau

SEQ ID NO: 28599 - RNA, 21 nt, Artificial Sequence
  RNA Oligomer
ccauuacaacugucccggaga

SEQ ID NO: 28600 - RNA, 21 nt, Artificial Sequence
  RNA Oligomer
gcaagugaauuugccuguaac

SEQ ID NO: 28601 - RNA, 21 nt, Artificial Sequence
  RNA Oligomer
cugagucaaguuguuccuuaa

SEQ ID NO: 28602 - RNA, 21 nt, Artificial Sequence
  RNA Oligomer
guaucaucagauagcaucuua

SEQ ID NO: 28603 - RNA, 21 nt, Artificial Sequence
  RNA Oligomer
cuacauuaguacacagcacca

SEQ ID NO: 28604 - RNA, 21 nt, Artificial Sequence
  RNA Oligomer
gaacuacauuaguacacagca

SEQ ID NO: 28605 - RNA, 21 nt, Artificial Sequence
  RNA Oligomer
gccaugucaaacaaauagucu

SEQ ID NO: 28606 - RNA, 21 nt, Artificial Sequence
  RNA Oligomer
cuugaacugauucacaucuca

SEQ ID NO: 28607 - RNA, 21 nt, Artificial Sequence
  RNA Oligomer
cuacaggaagauguacggaga

SEQ ID NO: 28608 - RNA, 21 nt, Artificial Sequence
  RNA Oligomer
ggagacaaugacaucuuugaa

SEQ ID NO: 28609 - RNA, 21 nt, Artificial Sequence
  RNA Oligomer
ucaagaccugugccugccauu

SEQ ID NO: 28610 - RNA, 21 nt, Artificial Sequence
  RNA Oligomer
gaaaugugguagccucacuuu

SEQ ID NO: 28611 - RNA, 21 nt, Artificial Sequence
  RNA Oligomer
agcuuguggcaagugaauuug

SEQ ID NO: 28612 - RNA, 21 nt, Artificial Sequence
  RNA Oligomer
cgauuagacuggacagcuugu

SEQ ID NO: 28613 - RNA, 21 nt, Artificial Sequence
  RNA Oligomer
ucgauuagacuggacagcuug

SEQ ID NO: 28614 - RNA, 21 nt, Artificial Sequence
  RNA Oligomer
ugacauucugauucgaaugac

SEQ ID NO: 28615 - RNA, 21 nt, Artificial Sequence
  RNA Oligomer
gucaaguuguuccuuaaguca

SEQ ID NO: 28616 - RNA, 21 nt, Artificial Sequence
  RNA Oligomer
gccaucaagagacugagucaa

SEQ ID NO: 28617 - RNA, 21 nt, Artificial Sequence
  RNA Oligomer
gaaagguuaguaucaucagau

SEQ ID NO: 28618 - RNA, 21 nt, Artificial Sequence
  RNA Oligomer
caccagaauguauauuaaggu

SEQ ID NO: 28619 - RNA, 21 nt, Artificial Sequence
  RNA Oligomer
uggaacuacauuaguacacag

SEQ ID NO: 28620 - RNA, 21 nt, Artificial Sequence
  RNA Oligomer
acaguggaacuacauuaguac

SEQ ID NO: 28621 - RNA, 21 nt, Artificial Sequence
  RNA Oligomer
cccagacacugguuugaagaa

SEQ ID NO: 28622 - RNA, 21 nt, Artificial Sequence
  RNA Oligomer
ccaauucaaaacauugugcca

SEQ ID NO: 28623 - RNA, 21 nt, Artificial Sequence
  RNA Oligomer
cccaauucaaaacauugugcc

SEQ ID NO: 28624 - RNA, 21 nt, Artificial Sequence
  RNA Oligomer
cccacccaauucaaaacauug

SEQ ID NO: 28625 - RNA, 21 nt, Artificial Sequence
  RNA Oligomer
aaagauucccacccaauucaa

SEQ ID NO: 28626 - RNA, 21 nt, Artificial Sequence
  RNA Oligomer
ggaaaagauucccacccaauu

SEQ ID NO: 28627 - RNA, 21 nt, Artificial Sequence
  RNA Oligomer
agagugagagacauuaacuca

SEQ ID NO: 28628 - RNA, 21 nt, Artificial Sequence
  RNA Oligomer
aucgcuguacuacaggaagau

SEQ ID NO: 28629 - RNA, 21 nt, Artificial Sequence
  RNA Oligomer
caaugacaucuuugaaucgcu

SEQ ID NO: 28630 - RNA, 21 nt, Artificial Sequence
  RNA Oligomer
caugaagaagaacaugauguu

SEQ ID NO: 28631 - RNA, 21 nt, Artificial Sequence
  RNA Oligomer
gcaaaaagugcauccguacuc

SEQ ID NO: 28632 - RNA, 21 nt, Artificial Sequence
  RNA Oligomer
gaaauucugcucagauagaau

SEQ ID NO: 28633 - RNA, 21 nt, Artificial Sequence
  RNA Oligomer
ugccuguaacaagccagauuu

SEQ ID NO: 28634 - RNA, 21 nt, Artificial Sequence
  RNA Oligomer
caagugaauuugccuguaaca

SEQ ID NO: 28635 - RNA, 21 nt, Artificial Sequence
  RNA Oligomer
aggaaucggaauccugucgau

SEQ ID NO: 28636 - RNA, 21 nt, Artificial Sequence
  RNA Oligomer
acauucugauucgaaugacac

SEQ ID NO: 28637 - RNA, 21 nt, Artificial Sequence
  RNA Oligomer
aaguuguuccuuaagucagaa

SEQ ID NO: 28638 - RNA, 21 nt, Artificial Sequence
  RNA Oligomer
ugagucaaguuguuccuuaag

SEQ ID NO: 28639 - RNA, 21 nt, Artificial Sequence
  RNA Oligomer
guuaguaucaucagauagcau

SEQ ID NO: 28640 - RNA, 21 nt, Artificial Sequence
  RNA Oligomer
gguuaguaucaucagauagca

SEQ ID NO: 28641 - RNA, 21 nt, Artificial Sequence
  RNA Oligomer
guacacagcaccagaauguau

SEQ ID NO: 28642 - RNA, 21 nt, Artificial Sequence
  RNA Oligomer
guggaacuacauuaguacaca

SEQ ID NO: 28643 - RNA, 21 nt, Artificial Sequence
  RNA Oligomer
gugccaugucaaacaaauagu

SEQ ID NO: 28644 - RNA, 21 nt, Artificial Sequence
  RNA Oligomer
agacauggcaugaagccagag

SEQ ID NO: 28645 - RNA, 21 nt, Artificial Sequence
  RNA Oligomer
cccagacccaacuaugauuag

SEQ ID NO: 28646 - RNA, 21 nt, Artificial Sequence
  RNA Oligomer
ucgcuguacuacaggaagaug

SEQ ID NO: 28647 - RNA, 21 nt, Artificial Sequence
  RNA Oligomer
ucccggagacaaugacaucuu

SEQ ID NO: 28648 - RNA, 21 nt, Artificial Sequence
  RNA Oligomer
gaacaugauguucaucaagac

SEQ ID NO: 28649 - RNA, 21 nt, Artificial Sequence
  RNA Oligomer
ggcaaaaagugcauccguacu

SEQ ID NO: 28650 - RNA, 21 nt, Artificial Sequence
  RNA Oligomer
agggcaaaaagugcauccgua

SEQ ID NO: 28651 - RNA, 21 nt, Artificial Sequence
  RNA Oligomer
auggaaauucugcucagauag

SEQ ID NO: 28652 - RNA, 21 nt, Artificial Sequence
  RNA Oligomer
uccuuaagucagaacagcaga

SEQ ID NO: 28653 - RNA, 21 nt, Artificial Sequence
  RNA Oligomer
caaguuguuccuuaagucaga

SEQ ID NO: 28654 - RNA, 21 nt, Artificial Sequence
  RNA Oligomer
ccagccaucaagagacugagu

SEQ ID NO: 28655 - RNA, 21 nt, Artificial Sequence
  RNA Oligomer
gacagcuaggaugugcauucu

SEQ ID NO: 28656 - RNA, 21 nt, Artificial Sequence
  RNA Oligomer
uacgaguaauaugccugcuau

SEQ ID NO: 28657 - RNA, 21 nt, Artificial Sequence
  RNA Oligomer
ccagcagaaagguuaguauca

SEQ ID NO: 28658 - RNA, 21 nt, Artificial Sequence
  RNA Oligomer
aguacacagcaccagaaugua

SEQ ID NO: 28659 - RNA, 21 nt, Artificial Sequence
  RNA Oligomer
ccacccaauucaaaacauugu

SEQ ID NO: 28660 - RNA, 21 nt, Artificial Sequence
  RNA Oligomer
acauggcaugaagccagagag

SEQ ID NO: 28661 - RNA, 21 nt, Artificial Sequence
  RNA Oligomer
gagacauggcaugaagccaga

SEQ ID NO: 28662 - RNA, 21 nt, Artificial Sequence
  RNA Oligomer
ccggagacaaugacaucuuug

SEQ ID NO: 28663 - RNA, 21 nt, Artificial Sequence
  RNA Oligomer
gucaugaagaagaacaugaug

SEQ ID NO: 28664 - RNA, 21 nt, Artificial Sequence
  RNA Oligomer
agugcauccguacucccaaaa

SEQ ID NO: 28665 - RNA, 21 nt, Artificial Sequence
  RNA Oligomer
ugauuucuagguaggaaaugu

SEQ ID NO: 28666 - RNA, 21 nt, Artificial Sequence
  RNA Oligomer
guggcaagugaauuugccugu

SEQ ID NO: 28667 - RNA, 21 nt, Artificial Sequence
  RNA Oligomer
gaaucggaauccugucgauua

SEQ ID NO: 28668 - RNA, 21 nt, Artificial Sequence
  RNA Oligomer
agagacugagucaaguuguuc

SEQ ID NO: 28669 - RNA, 21 nt, Artificial Sequence
  RNA Oligomer
accagaauguauauuaaggug

SEQ ID NO: 28670 - RNA, 21 nt, Artificial Sequence
  RNA Oligomer
gacaguggaacuacauuagua

SEQ ID NO: 28671 - RNA, 21 nt, Artificial Sequence
  RNA Oligomer
ugccaugucaaacaaauaguc

SEQ ID NO: 28672 - RNA, 21 nt, Artificial Sequence
  RNA Oligomer
ccagacccaacuaugauuaga

SEQ ID NO: 28673 - RNA, 21 nt, Artificial Sequence
  RNA Oligomer
ggcccagacccaacuaugauu

SEQ ID NO: 28674 - RNA, 21 nt, Artificial Sequence
  RNA Oligomer
ccaaaaguuacauguuugcac

SEQ ID NO: 28675 - RNA, 21 nt, Artificial Sequence
  RNA Oligomer
ugugaccaaaaguuacauguu

SEQ ID NO: 28676 - RNA, 21 nt, Artificial Sequence
  RNA Oligomer
gagugugaccaaaaguuacau

SEQ ID NO: 28677 - RNA, 21 nt, Artificial Sequence
  RNA Oligomer
uggcaagugaauuugccugua

SEQ ID NO: 28678 - RNA, 21 nt, Artificial Sequence
  RNA Oligomer
gucgauuagacuggacagcuu

SEQ ID NO: 28679 - RNA, 21 nt, Artificial Sequence
  RNA Oligomer
gcauucuccagccaucaagag

SEQ ID NO: 28680 - RNA, 21 nt, Artificial Sequence
  RNA Oligomer
ugcauucuccagccaucaaga

SEQ ID NO: 28681 - RNA, 21 nt, Artificial Sequence
  RNA Oligomer
gaagcugaccuggaagagaac

SEQ ID NO: 28682 - RNA, 21 nt, Artificial Sequence
  RNA Oligomer
gugccugccauuacaacuguc

SEQ ID NO: 28683 - RNA, 21 nt, Artificial Sequence
  RNA Oligomer
gaccugugccugccauuacaa

SEQ ID NO: 28684 - RNA, 21 nt, Artificial Sequence
  RNA Oligomer
caagaccugugccugccauua

SEQ ID NO: 28685 - RNA, 21 nt, Artificial Sequence
  RNA Oligomer
ccagcaugaagacauaccgag

SEQ ID NO: 28686 - RNA, 21 nt, Artificial Sequence
  RNA Oligomer
agccuaucaaguuugagcuuu

SEQ ID NO: 28687 - RNA, 21 nt, Artificial Sequence
  RNA Oligomer
accaaaaguuacauguuugca

SEQ ID NO: 28688 - RNA, 21 nt, Artificial Sequence
  RNA Oligomer
uaagaagggcaaaaagugcau

SEQ ID NO: 28689 - RNA, 21 nt, Artificial Sequence
  RNA Oligomer
guucaaagcaugaaauggaua

SEQ ID NO: 28690 - RNA, 21 nt, Artificial Sequence
  RNA Oligomer
cuguaacaagccagauuuuuu

SEQ ID NO: 28691 - RNA, 21 nt, Artificial Sequence
  RNA Oligomer
ccuguaacaagccagauuuuu

SEQ ID NO: 28692 - RNA, 21 nt, Artificial Sequence
  RNA Oligomer
ccugucgauuagacuggacag

SEQ ID NO: 28693 - RNA, 21 nt, Artificial Sequence
  RNA Oligomer
uccugucgauuagacuggaca

SEQ ID NO: 28694 - RNA, 21 nt, Artificial Sequence
  RNA Oligomer
caggaaucggaauccugucga

SEQ ID NO: 28695 - RNA, 21 nt, Artificial Sequence
  RNA Oligomer
ucugacauucugauucgaaug

SEQ ID NO: 28696 - RNA, 21 nt, Artificial Sequence
  RNA Oligomer
caaagauggugcucccugcau

SEQ ID NO: 28697 - RNA, 21 nt, Artificial Sequence
  RNA Oligomer
gacugagucaaguuguuccuu

SEQ ID NO: 28698 - RNA, 21 nt, Artificial Sequence
  RNA Oligomer
agugacagcuaggaugugcau

SEQ ID NO: 28699 - RNA, 21 nt, Artificial Sequence
  RNA Oligomer
accagcagaaagguuaguauc

SEQ ID NO: 28700 - RNA, 21 nt, Artificial Sequence
  RNA Oligomer
agauucccacccaauucaaaa

SEQ ID NO: 28701 - RNA, 21 nt, Artificial Sequence
  RNA Oligomer
aagccuaucaaguuugagcuu

SEQ ID NO: 28702 - RNA, 21 nt, Artificial Sequence
  RNA Oligomer
caagccuaucaaguuugagcu

SEQ ID NO: 28703 - RNA, 21 nt, Artificial Sequence
  RNA Oligomer
uccuuggcaggcugauuucua

SEQ ID NO: 28704 - RNA, 21 nt, Artificial Sequence
  RNA Oligomer
cugcucagauagaaugacagu

SEQ ID NO: 28705 - RNA, 21 nt, Artificial Sequence
  RNA Oligomer
auauggaaauucugcucagau

SEQ ID NO: 28706 - RNA, 21 nt, Artificial Sequence
  RNA Oligomer
ucaaagcaugaaauggauacu

SEQ ID NO: 28707 - RNA, 21 nt, Artificial Sequence
  RNA Oligomer
cuguucaggaaucggaauccu

SEQ ID NO: 28708 - RNA, 21 nt, Artificial Sequence
  RNA Oligomer
agacugagucaaguuguuccu

SEQ ID NO: 28709 - RNA, 21 nt, Artificial Sequence
  RNA Oligomer
agcugaccuggaagagaacau

SEQ ID NO: 28710 - RNA, 21 nt, Artificial Sequence
  RNA Oligomer
agccaucaagagacugaguca

SEQ ID NO: 28711 - RNA, 21 nt, Artificial Sequence
  RNA Oligomer
ucaaaacauugugccauguca

SEQ ID NO: 28712 - RNA, 21 nt, Artificial Sequence
  RNA Oligomer
ccaacuaugauuagagccaac

SEQ ID NO: 28713 - RNA, 21 nt, Artificial Sequence
  RNA Oligomer
cccaacuaugauuagagccaa

SEQ ID NO: 28714 - RNA, 21 nt, Artificial Sequence
  RNA Oligomer
agccagagagugagagacauu

SEQ ID NO: 28715 - RNA, 21 nt, Artificial Sequence
  RNA Oligomer
ugccauuacaacugucccgga

SEQ ID NO: 28716 - RNA, 21 nt, Artificial Sequence
  RNA Oligomer
ugacggcgaggucaugaagaa

SEQ ID NO: 28717 - RNA, 21 nt, Artificial Sequence
  RNA Oligomer
gugugaccaaaaguuacaugu

SEQ ID NO: 28718 - RNA, 21 nt, Artificial Sequence
  RNA Oligomer
gacuguuuuucggacaguuua

SEQ ID NO: 28719 - RNA, 21 nt, Artificial Sequence
  RNA Oligomer
augacuguuuuucggacaguu

SEQ ID NO: 28720 - RNA, 21 nt, Artificial Sequence
  RNA Oligomer
ugugguagccucacuuuuaau

SEQ ID NO: 28721 - RNA, 21 nt, Artificial Sequence
  RNA Oligomer
gaaaagauucccacccaauuc

SEQ ID NO: 28722 - RNA, 21 nt, Artificial Sequence
  RNA Oligomer
cggagacaaugacaucuuuga

SEQ ID NO: 28723 - RNA, 21 nt, Artificial Sequence
  RNA Oligomer
uggcccagacccaacuaugau

SEQ ID NO: 28724 - RNA, 21 nt, Artificial Sequence
  RNA Oligomer
uccaagccuaucaaguuugag

SEQ ID NO: 28725 - RNA, 21 nt, Artificial Sequence
  RNA Oligomer
cuguuuuucggacaguuuauu

SEQ ID NO: 28726 - RNA, 21 nt, Artificial Sequence
  RNA Oligomer
guagccucacuuuuaaugaac

SEQ ID NO: 28727 - RNA, 21 nt, Artificial Sequence
  RNA Oligomer
gcagacucagcucugacauuc

SEQ ID NO: 28728 - RNA, 21 nt, Artificial Sequence
  RNA Oligomer
ugacaucuuugaaucgcugua

SEQ ID NO: 28729 - RNA, 21 nt, Artificial Sequence
  RNA Oligomer
cugcaccagcaugaagacaua

SEQ ID NO: 28730 - RNA, 21 nt, Artificial Sequence
  RNA Oligomer
acuguuuuucggacaguuuau

SEQ ID NO: 28731 - RNA, 21 nt, Artificial Sequence
  RNA Oligomer
gcucugacauucugauucgaa

SEQ ID NO: 28732 - RNA, 21 nt, Artificial Sequence
  RNA Oligomer
cuguuccaagaccugugggau

SEQ ID NO: 28733 - RNA, 21 nt, Artificial Sequence
  RNA Oligomer
ccagacacugguuugaagaau

SEQ ID NO: 28734 - RNA, 21 nt, Artificial Sequence
  RNA Oligomer
gcugcaccagcaugaagacau

SEQ ID NO: 28735 - RNA, 21 nt, Artificial Sequence
  RNA Oligomer
gguagccucacuuuuaaugaa

SEQ ID NO: 28736 - RNA, 21 nt, Artificial Sequence
  RNA Oligomer
ugguagccucacuuuuaauga

SEQ ID NO: 28737 - RNA, 21 nt, Artificial Sequence
  RNA Oligomer
cagugacagcuaggaugugca

SEQ ID NO: 28738 - RNA, 21 nt, Artificial Sequence
  RNA Oligomer
cucagcucugacauucugauu

SEQ ID NO: 28739 - RNA, 21 nt, Artificial Sequence
  RNA Oligomer
gaagccagagagugagagaca

SEQ ID NO: 28740 - RNA, 21 nt, Artificial Sequence
  RNA Oligomer
agacaaugacaucuuugaauc

SEQ ID NO: 28741 - RNA, 21 nt, Artificial Sequence
  RNA Oligomer
cucugacauucugauucgaau

SEQ ID NO: 28742 - RNA, 21 nt, Artificial Sequence
  RNA Oligomer
gagacaaugacaucuuugaau

SEQ ID NO: 28743 - RNA, 21 nt, Artificial Sequence
  RNA Oligomer
cagacccaacuaugauuagag

SEQ ID NO: 28744 - RNA, 21 nt, Artificial Sequence
  RNA Oligomer
gaggucaugaagaagaacaug

SEQ ID NO: 28745 - RNA, 21 nt, Artificial Sequence
  RNA Oligomer
gacucagcucugacauucuga

SEQ ID NO: 28746 - RNA, 21 nt, Artificial Sequence
  RNA Oligomer
cuuccagagcagcugcaagua

SEQ ID NO: 28747 - RNA, 21 nt, Artificial Sequence
  RNA Oligomer
uuacggaaaaaugagauguga

SEQ ID NO: 28748 - RNA, 21 nt, Artificial Sequence
  RNA Oligomer
uuuacggaaaaaugagaugug

SEQ ID NO: 28749 - RNA, 21 nt, Artificial Sequence
  RNA Oligomer
uuuuugcccuucuuaauguuc

SEQ ID NO: 28750 - RNA, 21 nt, Artificial Sequence
  RNA Oligomer
uuugcccuucuuaauguucuc

SEQ ID NO: 28751 - RNA, 21 nt, Artificial Sequence
  RNA Oligomer
uugcccuucuuaauguucucu

SEQ ID NO: 28752 - RNA, 21 nt, Artificial Sequence
  RNA Oligomer
uacggaaaaaugagaugugaa

SEQ ID NO: 28753 - RNA, 21 nt, Artificial Sequence
  RNA Oligomer
uacuccacagaauuuagcucg

SEQ ID NO: 28754 - RNA, 21 nt, Artificial Sequence
  RNA Oligomer
uuuugcccuucuuaauguucu

SEQ ID NO: 28755 - RNA, 21 nt, Artificial Sequence
  RNA Oligomer
aaauagcaggcauauuacucg

SEQ ID NO: 28756 - RNA, 21 nt, Artificial Sequence
  RNA Oligomer
aaaugagaugugaaucaguuc

SEQ ID NO: 28757 - RNA, 21 nt, Artificial Sequence
  RNA Oligomer
auuacacuucaaauagcaggc

SEQ ID NO: 28758 - RNA, 21 nt, Artificial Sequence
  RNA Oligomer
aauagcaggcauauuacucgu

SEQ ID NO: 28759 - RNA, 21 nt, Artificial Sequence
  RNA Oligomer
uacucguauaagaugcuaucu

SEQ ID NO: 28760 - RNA, 21 nt, Artificial Sequence
  RNA Oligomer
uuaauauacauucuggugcug

SEQ ID NO: 28761 - RNA, 21 nt, Artificial Sequence
  RNA Oligomer
uaauauacauucuggugcugu

SEQ ID NO: 28762 - RNA, 21 nt, Artificial Sequence
  RNA Oligomer
gaaagcucaaacuugauaggc

SEQ ID NO: 28763 - RNA, 21 nt, Artificial Sequence
  RNA Oligomer
acuuuuugcccuucuuaaugu

SEQ ID NO: 28764 - RNA, 21 nt, Artificial Sequence
  RNA Oligomer
auuccugaacagugucauucg

SEQ ID NO: 28765 - RNA, 21 nt, Artificial Sequence
  RNA Oligomer
acaccuuaauauacauucugg

SEQ ID NO: 28766 - RNA, 21 nt, Artificial Sequence
  RNA Oligomer
augucuccguacaucuuccug

SEQ ID NO: 28767 - RNA, 21 nt, Artificial Sequence
  RNA Oligomer
uaaucauaguugggucugggc

SEQ ID NO: 28768 - RNA, 21 nt, Artificial Sequence
  RNA Oligomer
uucuucuucaugaccucgccg

SEQ ID NO: 28769 - RNA, 21 nt, Artificial Sequence
  RNA Oligomer
uacauacuccacagaauuuag

SEQ ID NO: 28770 - RNA, 21 nt, Artificial Sequence
  RNA Oligomer
aauuuagcucgguaugucuuc

SEQ ID NO: 28771 - RNA, 21 nt, Artificial Sequence
  RNA Oligomer
uuuccuaccuagaaaucagcc

SEQ ID NO: 28772 - RNA, 21 nt, Artificial Sequence
  RNA Oligomer
ugagcacgcuaaaauuuuccu

SEQ ID NO: 28773 - RNA, 21 nt, Artificial Sequence
  RNA Oligomer
agcacgcuaaaauuuuccuuc

SEQ ID NO: 28774 - RNA, 21 nt, Artificial Sequence
  RNA Oligomer
uucaaauagcaggcauauuac

SEQ ID NO: 28775 - RNA, 21 nt, Artificial Sequence
  RNA Oligomer
cauauuacucguauaagaugc

SEQ ID NO: 28776 - RNA, 21 nt, Artificial Sequence
  RNA Oligomer
ugaugauacuaaccuuucugc

SEQ ID NO: 28777 - RNA, 21 nt, Artificial Sequence
  RNA Oligomer
aguuaaugucucucacucucu

SEQ ID NO: 28778 - RNA, 21 nt, Artificial Sequence
  RNA Oligomer
agaauuuagcucgguaugucu

SEQ ID NO: 28779 - RNA, 21 nt, Artificial Sequence
  RNA Oligomer
cuuaauguucucuuccagguc

SEQ ID NO: 28780 - RNA, 21 nt, Artificial Sequence
  RNA Oligomer
cuuaauauacauucuggugcu

SEQ ID NO: 28781 - RNA, 21 nt, Artificial Sequence
  RNA Oligomer
aauguuuugaauuggguggga

SEQ ID NO: 28782 - RNA, 21 nt, Artificial Sequence
  RNA Oligomer
uucaaguuccagucuaaugag

SEQ ID NO: 28783 - RNA, 21 nt, Artificial Sequence
  RNA Oligomer
acuccacagaauuuagcucgg

SEQ ID NO: 28784 - RNA, 21 nt, Artificial Sequence
  RNA Oligomer
auuuagcucgguaugucuuca

SEQ ID NO: 28785 - RNA, 21 nt, Artificial Sequence
  RNA Oligomer
cagaaagcucaaacuugauag

SEQ ID NO: 28786 - RNA, 21 nt, Artificial Sequence
  RNA Oligomer
agaaagcucaaacuugauagg

SEQ ID NO: 28787 - RNA, 21 nt, Artificial Sequence
  RNA Oligomer
caaacauguaacuuuugguca

SEQ ID NO: 28788 - RNA, 21 nt, Artificial Sequence
  RNA Oligomer
cucucaacaaauaaacugucc

SEQ ID NO: 28789 - RNA, 21 nt, Artificial Sequence
  RNA Oligomer
uuaauguucucuuccagguca

SEQ ID NO: 28790 - RNA, 21 nt, Artificial Sequence
  RNA Oligomer
uaauguucucuuccaggucag

SEQ ID NO: 28791 - RNA, 21 nt, Artificial Sequence
  RNA Oligomer
aauguucucuuccaggucagc

SEQ ID NO: 28792 - RNA, 21 nt, Artificial Sequence
  RNA Oligomer
gagcacgcuaaaauuuuccuu

SEQ ID NO: 28793 - RNA, 21 nt, Artificial Sequence
  RNA Oligomer
aauuacacuucaaauagcagg

SEQ ID NO: 28794 - RNA, 21 nt, Artificial Sequence
  RNA Oligomer
uuacucguauaagaugcuauc

SEQ ID NO: 28795 - RNA, 21 nt, Artificial Sequence
  RNA Oligomer
acuaauguaguuccacuguca

SEQ ID NO: 28796 - RNA, 21 nt, Artificial Sequence
  RNA Oligomer
uuccacugucaagucuuaaca

SEQ ID NO: 28797 - RNA, 21 nt, Artificial Sequence
  RNA Oligomer
gucaagucuuaacauucuuca

SEQ ID NO: 28798 - RNA, 21 nt, Artificial Sequence
  RNA Oligomer
ucucacucucuggcuucaugc

SEQ ID NO: 28799 - RNA, 21 nt, Artificial Sequence
  RNA Oligomer
uuuagcucgguaugucuucau

SEQ ID NO: 28800 - RNA, 21 nt, Artificial Sequence
  RNA Oligomer
auuuccuaccuagaaaucagc

SEQ ID NO: 28801 - RNA, 21 nt, Artificial Sequence
  RNA Oligomer
gaacagugucauucgaaucag

SEQ ID NO: 28802 - RNA, 21 nt, Artificial Sequence
  RNA Oligomer
aacagugucauucgaaucaga

SEQ ID NO: 28803 - RNA, 21 nt, Artificial Sequence
  RNA Oligomer
uucucuuccaggucagcuucg

SEQ ID NO: 28804 - RNA, 21 nt, Artificial Sequence
  RNA Oligomer
caauuacacuucaaauagcag

SEQ ID NO: 28805 - RNA, 21 nt, Artificial Sequence
  RNA Oligomer
ccuuaauauacauucuggugc

SEQ ID NO: 28806 - RNA, 21 nt, Artificial Sequence
  RNA Oligomer
ugucaagucuuaacauucuuc

SEQ ID NO: 28807 - RNA, 21 nt, Artificial Sequence
  RNA Oligomer
agucuuaacauucuucaaacc

SEQ ID NO: 28808 - RNA, 21 nt, Artificial Sequence
  RNA Oligomer
uaacuugugcuacugaaauca

SEQ ID NO: 28809 - RNA, 21 nt, Artificial Sequence
  RNA Oligomer
aaugagaugugaaucaguuca

SEQ ID NO: 28810 - RNA, 21 nt, Artificial Sequence
  RNA Oligomer
cauacuccacagaauuuagcu

SEQ ID NO: 28811 - RNA, 21 nt, Artificial Sequence
  RNA Oligomer
auacuccacagaauuuagcuc

SEQ ID NO: 28812 - RNA, 21 nt, Artificial Sequence
  RNA Oligomer
uuagcucgguaugucuucaug

SEQ ID NO: 28813 - RNA, 21 nt, Artificial Sequence
  RNA Oligomer
cuaccuagaaaucagccugcc

SEQ ID NO: 28814 - RNA, 21 nt, Artificial Sequence
  RNA Oligomer
uaccuagaaaucagccugcca

SEQ ID NO: 28815 - RNA, 21 nt, Artificial Sequence
  RNA Oligomer
gaugauacuaaccuuucugcu

SEQ ID NO: 28816 - RNA, 21 nt, Artificial Sequence
  RNA Oligomer
gucuuaacauucuucaaacca

SEQ ID NO: 28817 - RNA, 21 nt, Artificial Sequence
  RNA Oligomer
caugucuccguacaucuuccu

SEQ ID NO: 28818 - RNA, 21 nt, Artificial Sequence
  RNA Oligomer
caaacgugucuuccagucggu

SEQ ID NO: 28819 - RNA, 21 nt, Artificial Sequence
  RNA Oligomer
cuccacagaauuuagcucggu

SEQ ID NO: 28820 - RNA, 21 nt, Artificial Sequence
  RNA Oligomer
aaacauguaacuuuuggucac

SEQ ID NO: 28821 - RNA, 21 nt, Artificial Sequence
  RNA Oligomer
ucucaacaaauaaacuguccg

SEQ ID NO: 28822 - RNA, 21 nt, Artificial Sequence
  RNA Oligomer
uuccgauuccugaacaguguc

SEQ ID NO: 28823 - RNA, 21 nt, Artificial Sequence
  RNA Oligomer
uuuccuucucaauuacacuuc

SEQ ID NO: 28824 - RNA, 21 nt, Artificial Sequence
  RNA Oligomer
cucguauaagaugcuaucuga

SEQ ID NO: 28825 - RNA, 21 nt, Artificial Sequence
  RNA Oligomer
augauacuaaccuuucugcug

SEQ ID NO: 28826 - RNA, 21 nt, Artificial Sequence
  RNA Oligomer
cacaccuuaauauacauucug

SEQ ID NO: 28827 - RNA, 21 nt, Artificial Sequence
  RNA Oligomer
cacugucaagucuuaacauuc

SEQ ID NO: 28828 - RNA, 21 nt, Artificial Sequence
  RNA Oligomer
augccaugucuccguacaucu

SEQ ID NO: 28829 - RNA, 21 nt, Artificial Sequence
  RNA Oligomer
uaguacagcgauucaaagaug

SEQ ID NO: 28830 - RNA, 21 nt, Artificial Sequence
  RNA Oligomer
acauacuccacagaauuuagc

SEQ ID NO: 28831 - RNA, 21 nt, Artificial Sequence
  RNA Oligomer
acucucaacaaauaaacuguc

SEQ ID NO: 28832 - RNA, 21 nt, Artificial Sequence
  RNA Oligomer
ccuaccuagaaaucagccugc

SEQ ID NO: 28833 - RNA, 21 nt, Artificial Sequence
  RNA Oligomer
auuccgauuccugaacagugu

SEQ ID NO: 28834 - RNA, 21 nt, Artificial Sequence
  RNA Oligomer
uucuuaauguucucuuccagg

SEQ ID NO: 28835 - RNA, 21 nt, Artificial Sequence
  RNA Oligomer
caaauagcaggcauauuacuc

SEQ ID NO: 28836 - RNA, 21 nt, Artificial Sequence
  RNA Oligomer
cugaugauacuaaccuuucug

SEQ ID NO: 28837 - RNA, 21 nt, Artificial Sequence
  RNA Oligomer
aacuugugcuacugaaaucau

SEQ ID NO: 28838 - RNA, 21 nt, Artificial Sequence
  RNA Oligomer
gcaaacauguaacuuuugguc

SEQ ID NO: 28839 - RNA, 21 nt, Artificial Sequence
  RNA Oligomer
ugaggcuaccacauuuccuac

SEQ ID NO: 28840 - RNA, 21 nt, Artificial Sequence
  RNA Oligomer
uuccugaacagugucauucga

SEQ ID NO: 28841 - RNA, 21 nt, Artificial Sequence
  RNA Oligomer
uuccuucucaauuacacuuca

SEQ ID NO: 28842 - RNA, 21 nt, Artificial Sequence
  RNA Oligomer
cucaauuacacuucaaauagc

SEQ ID NO: 28843 - RNA, 21 nt, Artificial Sequence
  RNA Oligomer
cuacugaaaucauuuuuacgg

SEQ ID NO: 28844 - RNA, 21 nt, Artificial Sequence
  RNA Oligomer
cuucaugccaugucuccguac

SEQ ID NO: 28845 - RNA, 21 nt, Artificial Sequence
  RNA Oligomer
aguacagcgauucaaagaugu

SEQ ID NO: 28846 - RNA, 21 nt, Artificial Sequence
  RNA Oligomer
auguucuucuucaugaccucg

SEQ ID NO: 28847 - RNA, 21 nt, Artificial Sequence
  RNA Oligomer
cucaacaaauaaacuguccga

SEQ ID NO: 28848 - RNA, 21 nt, Artificial Sequence
  RNA Oligomer
uccuaccuagaaaucagccug

SEQ ID NO: 28849 - RNA, 21 nt, Artificial Sequence
  RNA Oligomer
uucuaucugagcagaauuucc

SEQ ID NO: 28850 - RNA, 21 nt, Artificial Sequence
  RNA Oligomer
ccacaccuuaauauacauucu

SEQ ID NO: 28851 - RNA, 21 nt, Artificial Sequence
  RNA Oligomer
auguuuugaauugggugggaa

SEQ ID NO: 28852 - RNA, 21 nt, Artificial Sequence
  RNA Oligomer
gaaaaaugagaugugaaucag

SEQ ID NO: 28853 - RNA, 21 nt, Artificial Sequence
  RNA Oligomer
uuccuaccuagaaaucagccu

SEQ ID NO: 28854 - RNA, 21 nt, Artificial Sequence
  RNA Oligomer
aggcuaccacauuuccuaccu

SEQ ID NO: 28855 - RNA, 21 nt, Artificial Sequence
  RNA Oligomer
cccuucuuaauguucucuucc

SEQ ID NO: 28856 - RNA, 21 nt, Artificial Sequence
  RNA Oligomer
gcuacugaaaucauuuuuacg

SEQ ID NO: 28857 - RNA, 21 nt, Artificial Sequence
  RNA Oligomer
aguuggcucuaaucauaguug

SEQ ID NO: 28858 - RNA, 21 nt, Artificial Sequence
  RNA Oligomer
guacagcgauucaaagauguc

SEQ ID NO: 28859 - RNA, 21 nt, Artificial Sequence
  RNA Oligomer
uuacacuucaaauagcaggca

SEQ ID NO: 28860 - RNA, 21 nt, Artificial Sequence
  RNA Oligomer
uaacuuuuggucacacucuca

SEQ ID NO: 28861 - RNA, 21 nt, Artificial Sequence
  RNA Oligomer
cuucuuaauguucucuuccag

SEQ ID NO: 28862 - RNA, 21 nt, Artificial Sequence
  RNA Oligomer
uuaacauucuucaaaccagug

SEQ ID NO: 28863 - RNA, 21 nt, Artificial Sequence
  RNA Oligomer
aaagaugucauugucuccggg

SEQ ID NO: 28864 - RNA, 21 nt, Artificial Sequence
  RNA Oligomer
augaacaucauguucuucuuc

SEQ ID NO: 28865 - RNA, 21 nt, Artificial Sequence
  RNA Oligomer
acaacuugacucagucucuug

SEQ ID NO: 28866 - RNA, 21 nt, Artificial Sequence
  RNA Oligomer
aacuugacucagucucuugau

SEQ ID NO: 28867 - RNA, 21 nt, Artificial Sequence
  RNA Oligomer
auggcacaauguuuugaauug

SEQ ID NO: 28868 - RNA, 21 nt, Artificial Sequence
  RNA Oligomer
guacggaugcacuuuuugccc

SEQ ID NO: 28869 - RNA, 21 nt, Artificial Sequence
  RNA Oligomer
aacauucuucaaaccaguguc

SEQ ID NO: 28870 - RNA, 21 nt, Artificial Sequence
  RNA Oligomer
acauucuucaaaccagugucu

SEQ ID NO: 28871 - RNA, 21 nt, Artificial Sequence
  RNA Oligomer
ucgaaucagaaugucagagcu

SEQ ID NO: 28872 - RNA, 21 nt, Artificial Sequence
  RNA Oligomer
uugucauugguaacccgggug

SEQ ID NO: 28873 - RNA, 21 nt, Artificial Sequence
  RNA Oligomer
auguaguuccacugucaaguc

SEQ ID NO: 28874 - RNA, 21 nt, Artificial Sequence
  RNA Oligomer
cauucuucaaaccagugucug

SEQ ID NO: 28875 - RNA, 21 nt, Artificial Sequence
  RNA Oligomer
uugacauggcacaauguuuug

SEQ ID NO: 28876 - RNA, 21 nt, Artificial Sequence
  RNA Oligomer
guucuucuucaugaccucgcc

SEQ ID NO: 28877 - RNA, 21 nt, Artificial Sequence
  RNA Oligomer
uuuguucauuaaaagugaggc

SEQ ID NO: 28878 - RNA, 21 nt, Artificial Sequence
  RNA Oligomer
aagugaggcuaccacauuucc

SEQ ID NO: 28879 - RNA, 21 nt, Artificial Sequence
  RNA Oligomer
uugcaaacaaucuguuuugac

SEQ ID NO: 28880 - RNA, 21 nt, Artificial Sequence
  RNA Oligomer
ugucauucgaaucagaauguc

SEQ ID NO: 28881 - RNA, 21 nt, Artificial Sequence
  RNA Oligomer
gugagcacgcuaaaauuuucc

SEQ ID NO: 28882 - RNA, 21 nt, Artificial Sequence
  RNA Oligomer
ucuggugcuguguacuaaugu

SEQ ID NO: 28883 - RNA, 21 nt, Artificial Sequence
  RNA Oligomer
aagucacagaagaggcccuug

SEQ ID NO: 28884 - RNA, 21 nt, Artificial Sequence
  RNA Oligomer
uaacauucuucaaaccagugu

SEQ ID NO: 28885 - RNA, 21 nt, Artificial Sequence
  RNA Oligomer
uacaucuuccuguaguacagc

SEQ ID NO: 28886 - RNA, 21 nt, Artificial Sequence
  RNA Oligomer
uagcucgguaugucuucaugc

SEQ ID NO: 28887 - RNA, 21 nt, Artificial Sequence
  RNA Oligomer
auuuugggaguacggaugcac

SEQ ID NO: 28888 - RNA, 21 nt, Artificial Sequence
  RNA Oligomer
aaacuguccgaaaaacaguca

SEQ ID NO: 28889 - RNA, 21 nt, Artificial Sequence
  RNA Oligomer
uauuuguuugacauggcacaa

SEQ ID NO: 28890 - RNA, 21 nt, Artificial Sequence
  RNA Oligomer
acaucuuccuguaguacagcg

SEQ ID NO: 28891 - RNA, 21 nt, Artificial Sequence
  RNA Oligomer
uugaugaacaucauguucuuc

SEQ ID NO: 28892 - RNA, 21 nt, Artificial Sequence
  RNA Oligomer
auccauuucaugcuuugaacg

SEQ ID NO: 28893 - RNA, 21 nt, Artificial Sequence
  RNA Oligomer
uacacuucaaauagcaggcau

SEQ ID NO: 28894 - RNA, 21 nt, Artificial Sequence
  RNA Oligomer
auauacauucuggugcugugu

SEQ ID NO: 28895 - RNA, 21 nt, Artificial Sequence
  RNA Oligomer
uuuguuugacauggcacaaug

SEQ ID NO: 28896 - RNA, 21 nt, Artificial Sequence
  RNA Oligomer
uuguuugacauggcacaaugu

SEQ ID NO: 28897 - RNA, 21 nt, Artificial Sequence
  RNA Oligomer
aaugaguuaaugucucucacu

SEQ ID NO: 28898 - RNA, 21 nt, Artificial Sequence
  RNA Oligomer
aucauguucuucuucaugacc

SEQ ID NO: 28899 - RNA, 21 nt, Artificial Sequence
  RNA Oligomer
uguucuucuucaugaccucgc

SEQ ID NO: 28900 - RNA, 21 nt, Artificial Sequence
  RNA Oligomer
uuguucauuaaaagugaggcu

SEQ ID NO: 28901 - RNA, 21 nt, Artificial Sequence
  RNA Oligomer
aaaaucuggcuuguuacaggc

SEQ ID NO: 28902 - RNA, 21 nt, Artificial Sequence
  RNA Oligomer
uuacaggcaaauucacuugcc

SEQ ID NO: 28903 - RNA, 21 nt, Artificial Sequence
  RNA Oligomer
agucuaaucgacaggauuccg

SEQ ID NO: 28904 - RNA, 21 nt, Artificial Sequence
  RNA Oligomer
aaucgacaggauuccgauucc

SEQ ID NO: 28905 - RNA, 21 nt, Artificial Sequence
  RNA Oligomer
gacuuaaggaacaacuugacu

SEQ ID NO: 28906 - RNA, 21 nt, Artificial Sequence
  RNA Oligomer
cuugacucagucucuugaugg

SEQ ID NO: 28907 - RNA, 21 nt, Artificial Sequence
  RNA Oligomer
uagcaggcauauuacucguau

SEQ ID NO: 28908 - RNA, 21 nt, Artificial Sequence
  RNA Oligomer
aggcguugucauugguaaccc

SEQ ID NO: 28909 - RNA, 21 nt, Artificial Sequence
  RNA Oligomer
auugggugggaaucuuuuccc

SEQ ID NO: 28910 - RNA, 21 nt, Artificial Sequence
  RNA Oligomer
uaaugaguuaaugucucucac

SEQ ID NO: 28911 - RNA, 21 nt, Artificial Sequence
  RNA Oligomer
uuccuguaguacagcgauuca

SEQ ID NO: 28912 - RNA, 21 nt, Artificial Sequence
  RNA Oligomer
cuuugcaaacaaucuguuuug

SEQ ID NO: 28913 - RNA, 21 nt, Artificial Sequence
  RNA Oligomer
auuucaugcuuugaacgauca

SEQ ID NO: 28914 - RNA, 21 nt, Artificial Sequence
  RNA Oligomer
cagucuaaucgacaggauucc

SEQ ID NO: 28915 - RNA, 21 nt, Artificial Sequence
  RNA Oligomer
aagccacaccuuaauauacau

SEQ ID NO: 28916 - RNA, 21 nt, Artificial Sequence
  RNA Oligomer
gcuguguacuaauguaguucc

SEQ ID NO: 28917 - RNA, 21 nt, Artificial Sequence
  RNA Oligomer
uguacuaauguaguuccacug

SEQ ID NO: 28918 - RNA, 21 nt, Artificial Sequence
  RNA Oligomer
uagacuauuuguuugacaugg

SEQ ID NO: 28919 - RNA, 21 nt, Artificial Sequence
  RNA Oligomer
cacaauguuuugaauugggug

SEQ ID NO: 28920 - RNA, 21 nt, Artificial Sequence
  RNA Oligomer
augagaugugaaucaguucaa

SEQ ID NO: 28921 - RNA, 21 nt, Artificial Sequence
  RNA Oligomer
ucuccgggacaguuguaaugg

SEQ ID NO: 28922 - RNA, 21 nt, Artificial Sequence
  RNA Oligomer
guuacaggcaaauucacuugc

SEQ ID NO: 28923 - RNA, 21 nt, Artificial Sequence
  RNA Oligomer
uuaaggaacaacuugacucag

SEQ ID NO: 28924 - RNA, 21 nt, Artificial Sequence
  RNA Oligomer
uaagaugcuaucugaugauac

SEQ ID NO: 28925 - RNA, 21 nt, Artificial Sequence
  RNA Oligomer
uggugcuguguacuaauguag

SEQ ID NO: 28926 - RNA, 21 nt, Artificial Sequence
  RNA Oligomer
ugcuguguacuaauguaguuc

SEQ ID NO: 28927 - RNA, 21 nt, Artificial Sequence
  RNA Oligomer
agacuauuuguuugacauggc

SEQ ID NO: 28928 - RNA, 21 nt, Artificial Sequence
  RNA Oligomer
ugagaugugaaucaguucaag

SEQ ID NO: 28929 - RNA, 21 nt, Artificial Sequence
  RNA Oligomer
ucuccguacaucuuccuguag

SEQ ID NO: 28930 - RNA, 21 nt, Artificial Sequence
  RNA Oligomer
uucaaagaugucauugucucc

SEQ ID NO: 28931 - RNA, 21 nt, Artificial Sequence
  RNA Oligomer
aauggcaggcacaggucuuga

SEQ ID NO: 28932 - RNA, 21 nt, Artificial Sequence
  RNA Oligomer
aaagugaggcuaccacauuuc

SEQ ID NO: 28933 - RNA, 21 nt, Artificial Sequence
  RNA Oligomer
caaauucacuugccacaagcu

SEQ ID NO: 28934 - RNA, 21 nt, Artificial Sequence
  RNA Oligomer
acaagcuguccagucuaaucg

SEQ ID NO: 28935 - RNA, 21 nt, Artificial Sequence
  RNA Oligomer
caagcuguccagucuaaucga

SEQ ID NO: 28936 - RNA, 21 nt, Artificial Sequence
  RNA Oligomer
gucauucgaaucagaauguca

SEQ ID NO: 28937 - RNA, 21 nt, Artificial Sequence
  RNA Oligomer
ugacuuaaggaacaacuugac

SEQ ID NO: 28938 - RNA, 21 nt, Artificial Sequence
  RNA Oligomer
uugacucagucucuugauggc

SEQ ID NO: 28939 - RNA, 21 nt, Artificial Sequence
  RNA Oligomer
aucugaugauacuaaccuuuc

SEQ ID NO: 28940 - RNA, 21 nt, Artificial Sequence
  RNA Oligomer
accuuaauauacauucuggug

SEQ ID NO: 28941 - RNA, 21 nt, Artificial Sequence
  RNA Oligomer
cuguguacuaauguaguucca

SEQ ID NO: 28942 - RNA, 21 nt, Artificial Sequence
  RNA Oligomer
guacuaauguaguuccacugu

SEQ ID NO: 28943 - RNA, 21 nt, Artificial Sequence
  RNA Oligomer
uucuucaaaccagugucuggg

SEQ ID NO: 28944 - RNA, 21 nt, Artificial Sequence
  RNA Oligomer
uggcacaauguuuugaauugg

SEQ ID NO: 28945 - RNA, 21 nt, Artificial Sequence
  RNA Oligomer
ggcacaauguuuugaauuggg

SEQ ID NO: 28946 - RNA, 21 nt, Artificial Sequence
  RNA Oligomer
caauguuuugaauuggguggg

SEQ ID NO: 28947 - RNA, 21 nt, Artificial Sequence
  RNA Oligomer
uugaauugggugggaaucuuu

SEQ ID NO: 28948 - RNA, 21 nt, Artificial Sequence
  RNA Oligomer
aauugggugggaaucuuuucc

SEQ ID NO: 28949 - RNA, 21 nt, Artificial Sequence
  RNA Oligomer
ugaguuaaugucucucacucu

SEQ ID NO: 28950 - RNA, 21 nt, Artificial Sequence
  RNA Oligomer
aucuuccuguaguacagcgau

SEQ ID NO: 28951 - RNA, 21 nt, Artificial Sequence
  RNA Oligomer
agcgauucaaagaugucauug

SEQ ID NO: 28952 - RNA, 21 nt, Artificial Sequence
  RNA Oligomer
aacaucauguucuucuucaug

SEQ ID NO: 28953 - RNA, 21 nt, Artificial Sequence
  RNA Oligomer
gaguacggaugcacuuuuugc

SEQ ID NO: 28954 - RNA, 21 nt, Artificial Sequence
  RNA Oligomer
auucuaucugagcagaauuuc

SEQ ID NO: 28955 - RNA, 21 nt, Artificial Sequence
  RNA Oligomer
aaaucuggcuuguuacaggca

SEQ ID NO: 28956 - RNA, 21 nt, Artificial Sequence
  RNA Oligomer
uguuacaggcaaauucacuug

SEQ ID NO: 28957 - RNA, 21 nt, Artificial Sequence
  RNA Oligomer
aucgacaggauuccgauuccu

SEQ ID NO: 28958 - RNA, 21 nt, Artificial Sequence
  RNA Oligomer
gugucauucgaaucagaaugu

SEQ ID NO: 28959 - RNA, 21 nt, Artificial Sequence
  RNA Oligomer
uucugacuuaaggaacaacuu

SEQ ID NO: 28960 - RNA, 21 nt, Artificial Sequence
  RNA Oligomer
cuuaaggaacaacuugacuca

SEQ ID NO: 28961 - RNA, 21 nt, Artificial Sequence
  RNA Oligomer
augcuaucugaugauacuaac

SEQ ID NO: 28962 - RNA, 21 nt, Artificial Sequence
  RNA Oligomer
ugcuaucugaugauacuaacc

SEQ ID NO: 28963 - RNA, 21 nt, Artificial Sequence
  RNA Oligomer
auacauucuggugcuguguac

SEQ ID NO: 28964 - RNA, 21 nt, Artificial Sequence
  RNA Oligomer
uguguacuaauguaguuccac

SEQ ID NO: 28965 - RNA, 21 nt, Artificial Sequence
  RNA Oligomer
acuauuuguuugacauggcac

SEQ ID NO: 28966 - RNA, 21 nt, Artificial Sequence
  RNA Oligomer
cucuggcuucaugccaugucu

SEQ ID NO: 28967 - RNA, 21 nt, Artificial Sequence
  RNA Oligomer
cuaaucauaguugggucuggg

SEQ ID NO: 28968 - RNA, 21 nt, Artificial Sequence
  RNA Oligomer
caucuuccuguaguacagcga

SEQ ID NO: 28969 - RNA, 21 nt, Artificial Sequence
  RNA Oligomer
aagaugucauugucuccggga

SEQ ID NO: 28970 - RNA, 21 nt, Artificial Sequence
  RNA Oligomer
gucuugaugaacaucauguuc

SEQ ID NO: 28971 - RNA, 21 nt, Artificial Sequence
  RNA Oligomer
aguacggaugcacuuuuugcc

SEQ ID NO: 28972 - RNA, 21 nt, Artificial Sequence
  RNA Oligomer
uacggaugcacuuuuugcccu

SEQ ID NO: 28973 - RNA, 21 nt, Artificial Sequence
  RNA Oligomer
cuaucugagcagaauuuccau

SEQ ID NO: 28974 - RNA, 21 nt, Artificial Sequence
  RNA Oligomer
ucugcuguucugacuuaagga

SEQ ID NO: 28975 - RNA, 21 nt, Artificial Sequence
  RNA Oligomer
ucugacuuaaggaacaacuug

SEQ ID NO: 28976 - RNA, 21 nt, Artificial Sequence
  RNA Oligomer
acucagucucuugauggcugg

SEQ ID NO: 28977 - RNA, 21 nt, Artificial Sequence
  RNA Oligomer
agaaugcacauccuagcuguc

SEQ ID NO: 28978 - RNA, 21 nt, Artificial Sequence
  RNA Oligomer
auagcaggcauauuacucgua

SEQ ID NO: 28979 - RNA, 21 nt, Artificial Sequence
  RNA Oligomer
ugauacuaaccuuucugcugg

SEQ ID NO: 28980 - RNA, 21 nt, Artificial Sequence
  RNA Oligomer
uacauucuggugcuguguacu

SEQ ID NO: 28981 - RNA, 21 nt, Artificial Sequence
  RNA Oligomer
acaauguuuugaauugggugg

SEQ ID NO: 28982 - RNA, 21 nt, Artificial Sequence
  RNA Oligomer
cucucuggcuucaugccaugu

SEQ ID NO: 28983 - RNA, 21 nt, Artificial Sequence
  RNA Oligomer
ucuggcuucaugccaugucuc

SEQ ID NO: 28984 - RNA, 21 nt, Artificial Sequence
  RNA Oligomer
caaagaugucauugucuccgg

SEQ ID NO: 28985 - RNA, 21 nt, Artificial Sequence
  RNA Oligomer
caucauguucuucuucaugac

SEQ ID NO: 28986 - RNA, 21 nt, Artificial Sequence
  RNA Oligomer
uuuugggaguacggaugcacu

SEQ ID NO: 28987 - RNA, 21 nt, Artificial Sequence
  RNA Oligomer
acauuuccuaccuagaaauca

SEQ ID NO: 28988 - RNA, 21 nt, Artificial Sequence
  RNA Oligomer
acaggcaaauucacuugccac

SEQ ID NO: 28989 - RNA, 21 nt, Artificial Sequence
  RNA Oligomer
uaaucgacaggauuccgauuc

SEQ ID NO: 28990 - RNA, 21 nt, Artificial Sequence
  RNA Oligomer
gaacaacuugacucagucucu

SEQ ID NO: 28991 - RNA, 21 nt, Artificial Sequence
  RNA Oligomer
caccuuaauauacauucuggu

SEQ ID NO: 28992 - RNA, 21 nt, Artificial Sequence
  RNA Oligomer
uacuaauguaguuccacuguc

SEQ ID NO: 28993 - RNA, 21 nt, Artificial Sequence
  RNA Oligomer
gacuauuuguuugacauggca

SEQ ID NO: 28994 - RNA, 21 nt, Artificial Sequence
  RNA Oligomer
ucuaaucauaguugggucugg

SEQ ID NO: 28995 - RNA, 21 nt, Artificial Sequence
  RNA Oligomer
aaucauaguugggucugggcc

SEQ ID NO: 28996 - RNA, 21 nt, Artificial Sequence
  RNA Oligomer
gugcaaacauguaacuuuugg

SEQ ID NO: 28997 - RNA, 21 nt, Artificial Sequence
  RNA Oligomer
aacauguaacuuuuggucaca

SEQ ID NO: 28998 - RNA, 21 nt, Artificial Sequence
  RNA Oligomer
auguaacuuuuggucacacuc

SEQ ID NO: 28999 - RNA, 21 nt, Artificial Sequence
  RNA Oligomer
uacaggcaaauucacuugcca

SEQ ID NO: 29000 - RNA, 21 nt, Artificial Sequence
  RNA Oligomer
aagcuguccagucuaaucgac

SEQ ID NO: 29001 - RNA, 21 nt, Artificial Sequence
  RNA Oligomer
cucuugauggcuggagaaugc

SEQ ID NO: 29002 - RNA, 21 nt, Artificial Sequence
  RNA Oligomer
ucuugauggcuggagaaugca

SEQ ID NO: 29003 - RNA, 21 nt, Artificial Sequence
  RNA Oligomer
guucucuuccaggucagcuuc

SEQ ID NO: 29004 - RNA, 21 nt, Artificial Sequence
  RNA Oligomer
gacaguuguaauggcaggcac

SEQ ID NO: 29005 - RNA, 21 nt, Artificial Sequence
  RNA Oligomer
uuguaauggcaggcacagguc

SEQ ID NO: 29006 - RNA, 21 nt, Artificial Sequence
  RNA Oligomer
uaauggcaggcacaggucuug

SEQ ID NO: 29007 - RNA, 21 nt, Artificial Sequence
  RNA Oligomer
cucgguaugucuucaugcugg

SEQ ID NO: 29008 - RNA, 21 nt, Artificial Sequence
  RNA Oligomer
aaagcucaaacuugauaggcu

SEQ ID NO: 29009 - RNA, 21 nt, Artificial Sequence
  RNA Oligomer
ugcaaacauguaacuuuuggu

SEQ ID NO: 29010 - RNA, 21 nt, Artificial Sequence
  RNA Oligomer
augcacuuuuugcccuucuua

SEQ ID NO: 29011 - RNA, 21 nt, Artificial Sequence
  RNA Oligomer
uauccauuucaugcuuugaac

SEQ ID NO: 29012 - RNA, 21 nt, Artificial Sequence
  RNA Oligomer
aaaaaaucuggcuuguuacag

SEQ ID NO: 29013 - RNA, 21 nt, Artificial Sequence
  RNA Oligomer
aaaaaucuggcuuguuacagg

SEQ ID NO: 29014 - RNA, 21 nt, Artificial Sequence
  RNA Oligomer
cuguccagucuaaucgacagg

SEQ ID NO: 29015 - RNA, 21 nt, Artificial Sequence
  RNA Oligomer
uguccagucuaaucgacagga

SEQ ID NO: 29016 - RNA, 21 nt, Artificial Sequence
  RNA Oligomer
ucgacaggauuccgauuccug

SEQ ID NO: 29017 - RNA, 21 nt, Artificial Sequence
  RNA Oligomer
cauucgaaucagaaugucaga

SEQ ID NO: 29018 - RNA, 21 nt, Artificial Sequence
  RNA Oligomer
augcagggagcaccaucuuug

SEQ ID NO: 29019 - RNA, 21 nt, Artificial Sequence
  RNA Oligomer
aaggaacaacuugacucaguc

SEQ ID NO: 29020 - RNA, 21 nt, Artificial Sequence
  RNA Oligomer
augcacauccuagcugucacu

SEQ ID NO: 29021 - RNA, 21 nt, Artificial Sequence
  RNA Oligomer
gauacuaaccuuucugcuggu

SEQ ID NO: 29022 - RNA, 21 nt, Artificial Sequence
  RNA Oligomer
uuuugaauugggugggaaucu

SEQ ID NO: 29023 - RNA, 21 nt, Artificial Sequence
  RNA Oligomer
aagcucaaacuugauaggcuu

SEQ ID NO: 29024 - RNA, 21 nt, Artificial Sequence
  RNA Oligomer
agcucaaacuugauaggcuug

SEQ ID NO: 29025 - RNA, 21 nt, Artificial Sequence
  RNA Oligomer
uagaaaucagccugccaagga

SEQ ID NO: 29026 - RNA, 21 nt, Artificial Sequence
  RNA Oligomer
acugucauucuaucugagcag

SEQ ID NO: 29027 - RNA, 21 nt, Artificial Sequence
  RNA Oligomer
aucugagcagaauuuccauau

SEQ ID NO: 29028 - RNA, 21 nt, Artificial Sequence
  RNA Oligomer
aguauccauuucaugcuuuga

SEQ ID NO: 29029 - RNA, 21 nt, Artificial Sequence
  RNA Oligomer
aggauuccgauuccugaacag

SEQ ID NO: 29030 - RNA, 21 nt, Artificial Sequence
  RNA Oligomer
aggaacaacuugacucagucu

SEQ ID NO: 29031 - RNA, 21 nt, Artificial Sequence
  RNA Oligomer
auguucucuuccaggucagcu

SEQ ID NO: 29032 - RNA, 21 nt, Artificial Sequence
  RNA Oligomer
ugacucagucucuugauggcu

SEQ ID NO: 29033 - RNA, 21 nt, Artificial Sequence
  RNA Oligomer
ugacauggcacaauguuuuga

SEQ ID NO: 29034 - RNA, 21 nt, Artificial Sequence
  RNA Oligomer
guuggcucuaaucauaguugg

SEQ ID NO: 29035 - RNA, 21 nt, Artificial Sequence
  RNA Oligomer
uuggcucuaaucauaguuggg

SEQ ID NO: 29036 - RNA, 21 nt, Artificial Sequence
  RNA Oligomer
aaugucucucacucucuggcu

SEQ ID NO: 29037 - RNA, 21 nt, Artificial Sequence
  RNA Oligomer
uccgggacaguuguaauggca

SEQ ID NO: 29038 - RNA, 21 nt, Artificial Sequence
  RNA Oligomer
uucuucaugaccucgccguca

SEQ ID NO: 29039 - RNA, 21 nt, Artificial Sequence
  RNA Oligomer
acauguaacuuuuggucacac

SEQ ID NO: 29040 - RNA, 21 nt, Artificial Sequence
  RNA Oligomer
uaaacuguccgaaaaacaguc

SEQ ID NO: 29041 - RNA, 21 nt, Artificial Sequence
  RNA Oligomer
aacuguccgaaaaacagucau

SEQ ID NO: 29042 - RNA, 21 nt, Artificial Sequence
  RNA Oligomer
auuaaaagugaggcuaccaca

SEQ ID NO: 29043 - RNA, 21 nt, Artificial Sequence
  RNA Oligomer
gaauugggugggaaucuuuuc

SEQ ID NO: 29044 - RNA, 21 nt, Artificial Sequence
  RNA Oligomer
ucaaagaugucauugucuccg

SEQ ID NO: 29045 - RNA, 21 nt, Artificial Sequence
  RNA Oligomer
aucauaguugggucugggcca

SEQ ID NO: 29046 - RNA, 21 nt, Artificial Sequence
  RNA Oligomer
cucaaacuugauaggcuugga

SEQ ID NO: 29047 - RNA, 21 nt, Artificial Sequence
  RNA Oligomer
aauaaacuguccgaaaaacag

SEQ ID NO: 29048 - RNA, 21 nt, Artificial Sequence
  RNA Oligomer
guucauuaaaagugaggcuac

SEQ ID NO: 29049 - RNA, 21 nt, Artificial Sequence
  RNA Oligomer
gaaugucagagcugagucugc

SEQ ID NO: 29050 - RNA, 21 nt, Artificial Sequence
  RNA Oligomer
uacagcgauucaaagauguca

SEQ ID NO: 29051 - RNA, 21 nt, Artificial Sequence
  RNA Oligomer
uaugucuucaugcuggugcag

SEQ ID NO: 29052 - RNA, 21 nt, Artificial Sequence
  RNA Oligomer
auaaacuguccgaaaaacagu

SEQ ID NO: 29053 - RNA, 21 nt, Artificial Sequence
  RNA Oligomer
uucgaaucagaaugucagagc

SEQ ID NO: 29054 - RNA, 21 nt, Artificial Sequence
  RNA Oligomer
aucccacaggucuuggaacag

SEQ ID NO: 29055 - RNA, 21 nt, Artificial Sequence
  RNA Oligomer
auucuucaaaccagugucugg

SEQ ID NO: 29056 - RNA, 21 nt, Artificial Sequence
  RNA Oligomer
augucuucaugcuggugcagc

SEQ ID NO: 29057 - RNA, 21 nt, Artificial Sequence
  RNA Oligomer
uucauuaaaagugaggcuacc

SEQ ID NO: 29058 - RNA, 21 nt, Artificial Sequence
  RNA Oligomer
ucauuaaaagugaggcuacca

SEQ ID NO: 29059 - RNA, 21 nt, Artificial Sequence
  RNA Oligomer
ugcacauccuagcugucacug

SEQ ID NO: 29060 - RNA, 21 nt, Artificial Sequence
  RNA Oligomer
aaucagaaugucagagcugag

SEQ ID NO: 29061 - RNA, 21 nt, Artificial Sequence
  RNA Oligomer
ugucucucacucucuggcuuc

SEQ ID NO: 29062 - RNA, 21 nt, Artificial Sequence
  RNA Oligomer
gauucaaagaugucauugucu

SEQ ID NO: 29063 - RNA, 21 nt, Artificial Sequence
  RNA Oligomer
auucgaaucagaaugucagag

SEQ ID NO: 29064 - RNA, 21 nt, Artificial Sequence
  RNA Oligomer
auucaaagaugucauugucuc

SEQ ID NO: 29065 - RNA, 21 nt, Artificial Sequence
  RNA Oligomer
cucuaaucauaguugggucug

SEQ ID NO: 29066 - RNA, 21 nt, Artificial Sequence
  RNA Oligomer
cauguucuucuucaugaccuc

SEQ ID NO: 29067 - RNA, 21 nt, Artificial Sequence
  RNA Oligomer
ucagaaugucagagcugaguc

SEQ ID NO: 29068 - RNA, 21 nt, Artificial Sequence
  RNA Oligomer
uacuugcagcugcucuggaag

SEQ ID NO: 29069 - RNA, 21 nt, Artificial Sequence
  RNA Oligomer
ggaaacucccuguaaacuaaa

SEQ ID NO: 29070 - RNA, 21 nt, Artificial Sequence
  RNA Oligomer
ggaagaagauaaacaccugaa

SEQ ID NO: 29071 - RNA, 21 nt, Artificial Sequence
  RNA Oligomer
gcaucuucugaggucaauuaa

SEQ ID NO: 29072 - RNA, 21 nt, Artificial Sequence
  RNA Oligomer
gaagaagauaaacaccugaaa

SEQ ID NO: 29073 - RNA, 21 nt, Artificial Sequence
  RNA Oligomer
aacuaaaagcuucaggguuau

SEQ ID NO: 29074 - RNA, 21 nt, Artificial Sequence
  RNA Oligomer
ccaaaaguaaggaagaagaua

SEQ ID NO: 29075 - RNA, 21 nt, Artificial Sequence
  RNA Oligomer
acauaaccuuuuuuacugccu

SEQ ID NO: 29076 - RNA, 21 nt, Artificial Sequence
  RNA Oligomer
aaacuaaaagcuucaggguua

SEQ ID NO: 29077 - RNA, 21 nt, Artificial Sequence
  RNA Oligomer
gaaacucccuguaaacuaaaa

SEQ ID NO: 29078 - RNA, 21 nt, Artificial Sequence
  RNA Oligomer
gugcaucuucugaggucaauu

SEQ ID NO: 29079 - RNA, 21 nt, Artificial Sequence
  RNA Oligomer
ugauugauagucaggaacuuu

SEQ ID NO: 29080 - RNA, 21 nt, Artificial Sequence
  RNA Oligomer
ccaugagaauugcagugauuu

SEQ ID NO: 29081 - RNA, 21 nt, Artificial Sequence
  RNA Oligomer
cgaggaguugaauggugcaua

SEQ ID NO: 29082 - RNA, 21 nt, Artificial Sequence
  RNA Oligomer
gguuguccagcaauuaauaaa

SEQ ID NO: 29083 - RNA, 21 nt, Artificial Sequence
  RNA Oligomer
ggguuaugucuauguucauuc

SEQ ID NO: 29084 - RNA, 21 nt, Artificial Sequence
  RNA Oligomer
caggguuaugucuauguucau

SEQ ID NO: 29085 - RNA, 21 nt, Artificial Sequence
  RNA Oligomer
agcauuccgaugugauugaua

SEQ ID NO: 29086 - RNA, 21 nt, Artificial Sequence
  RNA Oligomer
gagcauuccgaugugauugau

SEQ ID NO: 29087 - RNA, 21 nt, Artificial Sequence
  RNA Oligomer
gcaaugagcauuccgauguga

SEQ ID NO: 29088 - RNA, 21 nt, Artificial Sequence
  RNA Oligomer
ggaguugaauggugcauacaa

SEQ ID NO: 29089 - RNA, 21 nt, Artificial Sequence
  RNA Oligomer
gauguagaugacacugaugau

SEQ ID NO: 29090 - RNA, 21 nt, Artificial Sequence
  RNA Oligomer
gaugauguagaugacacugau

SEQ ID NO: 29091 - RNA, 21 nt, Artificial Sequence
  RNA Oligomer
uguaucuauuugagucuggaa

SEQ ID NO: 29092 - RNA, 21 nt, Artificial Sequence
  RNA Oligomer
ugcaucuucugaggucaauua

SEQ ID NO: 29093 - RNA, 21 nt, Artificial Sequence
  RNA Oligomer
aggaagaagauaaacaccuga

SEQ ID NO: 29094 - RNA, 21 nt, Artificial Sequence
  RNA Oligomer
accaugagaauugcagugauu

SEQ ID NO: 29095 - RNA, 21 nt, Artificial Sequence
  RNA Oligomer
gguuaugucuauguucauucu

SEQ ID NO: 29096 - RNA, 21 nt, Artificial Sequence
  RNA Oligomer
cuucaggguuaugucuauguu

SEQ ID NO: 29097 - RNA, 21 nt, Artificial Sequence
  RNA Oligomer
gcuucaggguuaugucuaugu

SEQ ID NO: 29098 - RNA, 21 nt, Artificial Sequence
  RNA Oligomer
guaucuauuugagucuggaaa

SEQ ID NO: 29099 - RNA, 21 nt, Artificial Sequence
  RNA Oligomer
guguaucuauuugagucugga

SEQ ID NO: 29100 - RNA, 21 nt, Artificial Sequence
  RNA Oligomer
gaaagagaacaugaaaugcuu

SEQ ID NO: 29101 - RNA, 21 nt, Artificial Sequence
  RNA Oligomer
ugaggucaauuaaaaggagaa

SEQ ID NO: 29102 - RNA, 21 nt, Artificial Sequence
  RNA Oligomer
gaagauaugcugguuguagac

SEQ ID NO: 29103 - RNA, 21 nt, Artificial Sequence
  RNA Oligomer
caugaagauaugcugguugua

SEQ ID NO: 29104 - RNA, 21 nt, Artificial Sequence
  RNA Oligomer
gaugugauugauagucaggaa

SEQ ID NO: 29105 - RNA, 21 nt, Artificial Sequence
  RNA Oligomer
caaugagcauuccgaugugau

SEQ ID NO: 29106 - RNA, 21 nt, Artificial Sequence
  RNA Oligomer
acacauaugauggccgaggug

SEQ ID NO: 29107 - RNA, 21 nt, Artificial Sequence
  RNA Oligomer
gcagcauuuaaauucugggag

SEQ ID NO: 29108 - RNA, 21 nt, Artificial Sequence
  RNA Oligomer
cucaguuuauugguugaaugu

SEQ ID NO: 29109 - RNA, 21 nt, Artificial Sequence
  RNA Oligomer
gaggucaauuaaaaggagaaa

SEQ ID NO: 29110 - RNA, 21 nt, Artificial Sequence
  RNA Oligomer
ccgaugugauugauagucagg

SEQ ID NO: 29111 - RNA, 21 nt, Artificial Sequence
  RNA Oligomer
ccgaggugauagugugguuua

SEQ ID NO: 29112 - RNA, 21 nt, Artificial Sequence
  RNA Oligomer
ucugaugauguagaugacacu

SEQ ID NO: 29113 - RNA, 21 nt, Artificial Sequence
  RNA Oligomer
gacucugaugauguagaugac

SEQ ID NO: 29114 - RNA, 21 nt, Artificial Sequence
  RNA Oligomer
cgacucugaugauguagauga

SEQ ID NO: 29115 - RNA, 21 nt, Artificial Sequence
  RNA Oligomer
aacgacucugaugauguagau

SEQ ID NO: 29116 - RNA, 21 nt, Artificial Sequence
  RNA Oligomer
gcagcagcauuuaaauucugg

SEQ ID NO: 29117 - RNA, 21 nt, Artificial Sequence
  RNA Oligomer
gugauugauagucaggaacuu

SEQ ID NO: 29118 - RNA, 21 nt, Artificial Sequence
  RNA Oligomer
gcauuccgaugugauugauag

SEQ ID NO: 29119 - RNA, 21 nt, Artificial Sequence
  RNA Oligomer
aggaguugaauggugcauaca

SEQ ID NO: 29120 - RNA, 21 nt, Artificial Sequence
  RNA Oligomer
gaggaguugaauggugcauac

SEQ ID NO: 29121 - RNA, 21 nt, Artificial Sequence
  RNA Oligomer
cgaggugauagugugguuuau

SEQ ID NO: 29122 - RNA, 21 nt, Artificial Sequence
  RNA Oligomer
gccgaggugauagugugguuu

SEQ ID NO: 29123 - RNA, 21 nt, Artificial Sequence
  RNA Oligomer
gcauuuaaauucugggagggc

SEQ ID NO: 29124 - RNA, 21 nt, Artificial Sequence
  RNA Oligomer
aggguuaugucuauguucauu

SEQ ID NO: 29125 - RNA, 21 nt, Artificial Sequence
  RNA Oligomer
caguuuauugguugaaugugu

SEQ ID NO: 29126 - RNA, 21 nt, Artificial Sequence
  RNA Oligomer
gcaaaaugaaagagaacauga

SEQ ID NO: 29127 - RNA, 21 nt, Artificial Sequence
  RNA Oligomer
uagugcaucuucugaggucaa

SEQ ID NO: 29128 - RNA, 21 nt, Artificial Sequence
  RNA Oligomer
cgaugugauugauagucagga

SEQ ID NO: 29129 - RNA, 21 nt, Artificial Sequence
  RNA Oligomer
accugaacgcgccuucugauu

SEQ ID NO: 29130 - RNA, 21 nt, Artificial Sequence
  RNA Oligomer
acauaugauggccgaggugau

SEQ ID NO: 29131 - RNA, 21 nt, Artificial Sequence
  RNA Oligomer
acgacucugaugauguagaug

SEQ ID NO: 29132 - RNA, 21 nt, Artificial Sequence
  RNA Oligomer
ugcuucuuucucaguuuauug

SEQ ID NO: 29133 - RNA, 21 nt, Artificial Sequence
  RNA Oligomer
uaccaugagaauugcagugau

SEQ ID NO: 29134 - RNA, 21 nt, Artificial Sequence
  RNA Oligomer
gcgaggaguugaauggugcau

SEQ ID NO: 29135 - RNA, 21 nt, Artificial Sequence
  RNA Oligomer
guagaugacacugaugauucu

SEQ ID NO: 29136 - RNA, 21 nt, Artificial Sequence
  RNA Oligomer
gugauuaucuuuuuguggugu

SEQ ID NO: 29137 - RNA, 21 nt, Artificial Sequence
  RNA Oligomer
cuauuugagucuggaaauaac

SEQ ID NO: 29138 - RNA, 21 nt, Artificial Sequence
  RNA Oligomer
ucucaguuuauugguugaaug

SEQ ID NO: 29139 - RNA, 21 nt, Artificial Sequence
  RNA Oligomer
cugaggucaauuaaaaggaga

SEQ ID NO: 29140 - RNA, 21 nt, Artificial Sequence
  RNA Oligomer
ugaagauaugcugguuguaga

SEQ ID NO: 29141 - RNA, 21 nt, Artificial Sequence
  RNA Oligomer
auggaaagcgaggaguugaau

SEQ ID NO: 29142 - RNA, 21 nt, Artificial Sequence
  RNA Oligomer
agcagcauuuaaauucuggga

SEQ ID NO: 29143 - RNA, 21 nt, Artificial Sequence
  RNA Oligomer
caauugcuuauuuguuuuccc

SEQ ID NO: 29144 - RNA, 21 nt, Artificial Sequence
  RNA Oligomer
ugugauuaucuuuuuguggug

SEQ ID NO: 29145 - RNA, 21 nt, Artificial Sequence
  RNA Oligomer
gcaaacaaaauacuuuuaccc

SEQ ID NO: 29146 - RNA, 21 nt, Artificial Sequence
  RNA Oligomer
uaguuuaguuuguggcuucau

SEQ ID NO: 29147 - RNA, 21 nt, Artificial Sequence
  RNA Oligomer
agcgaggaguugaauggugca

SEQ ID NO: 29148 - RNA, 21 nt, Artificial Sequence
  RNA Oligomer
ggacaucaccucacacaugga

SEQ ID NO: 29149 - RNA, 21 nt, Artificial Sequence
  RNA Oligomer
aaauucugggagggcuugguu

SEQ ID NO: 29150 - RNA, 21 nt, Artificial Sequence
  RNA Oligomer
agcaaaaugaaagagaacaug

SEQ ID NO: 29151 - RNA, 21 nt, Artificial Sequence
  RNA Oligomer
uuaguuuaguuuguggcuuca

SEQ ID NO: 29152 - RNA, 21 nt, Artificial Sequence
  RNA Oligomer
agucaggaacuuuccaaaguc

SEQ ID NO: 29153 - RNA, 21 nt, Artificial Sequence
  RNA Oligomer
guaaacuaaaagcuucagggu

SEQ ID NO: 29154 - RNA, 21 nt, Artificial Sequence
  RNA Oligomer
cccaaaaguaaggaagaagau

SEQ ID NO: 29155 - RNA, 21 nt, Artificial Sequence
  RNA Oligomer
acaucaccucacacauggaaa

SEQ ID NO: 29156 - RNA, 21 nt, Artificial Sequence
  RNA Oligomer
acgguuguccagcaauuaaua

SEQ ID NO: 29157 - RNA, 21 nt, Artificial Sequence
  RNA Oligomer
cccuguaaacuaaaagcuuca

SEQ ID NO: 29158 - RNA, 21 nt, Artificial Sequence
  RNA Oligomer
agccaugaagauaugcugguu

SEQ ID NO: 29159 - RNA, 21 nt, Artificial Sequence
  RNA Oligomer
ccugccagcaaccgaaguuuu

SEQ ID NO: 29160 - RNA, 21 nt, Artificial Sequence
  RNA Oligomer
ccauucugaugaaucugauga

SEQ ID NO: 29161 - RNA, 21 nt, Artificial Sequence
  RNA Oligomer
cucccuguaaacuaaaagcuu

SEQ ID NO: 29162 - RNA, 21 nt, Artificial Sequence
  RNA Oligomer
cgaggacaucaccucacacau

SEQ ID NO: 29163 - RNA, 21 nt, Artificial Sequence
  RNA Oligomer
accauucugaugaaucugaug

SEQ ID NO: 29164 - RNA, 21 nt, Artificial Sequence
  RNA Oligomer
cccacaguagacacauaugau

SEQ ID NO: 29165 - RNA, 21 nt, Artificial Sequence
  RNA Oligomer
ugaugaacuggucacugauuu

SEQ ID NO: 29166 - RNA, 21 nt, Artificial Sequence
  RNA Oligomer
ucugaugaacuggucacugau

SEQ ID NO: 29167 - RNA, 21 nt, Artificial Sequence
  RNA Oligomer
cccacgguuguccagcaauua

SEQ ID NO: 29168 - RNA, 21 nt, Artificial Sequence
  RNA Oligomer
agacgaggacaucaccucaca

SEQ ID NO: 29169 - RNA, 21 nt, Artificial Sequence
  RNA Oligomer
caccauucugaugaaucugau

SEQ ID NO: 29170 - RNA, 21 nt, Artificial Sequence
  RNA Oligomer
ggaugaccagagugcugaaac

SEQ ID NO: 29171 - RNA, 21 nt, Artificial Sequence
  RNA Oligomer
cugaugaacuggucacugauu

SEQ ID NO: 29172 - RNA, 21 nt, Artificial Sequence
  RNA Oligomer
cgguuguccagcaauuaauaa

SEQ ID NO: 29173 - RNA, 21 nt, Artificial Sequence
  RNA Oligomer
cacgguuguccagcaauuaau

SEQ ID NO: 29174 - RNA, 21 nt, Artificial Sequence
  RNA Oligomer
ccuguaaacuaaaagcuucag

SEQ ID NO: 29175 - RNA, 21 nt, Artificial Sequence
  RNA Oligomer
gcuucauggaaacucccugua

SEQ ID NO: 29176 - RNA, 21 nt, Artificial Sequence
  RNA Oligomer
ccaugaagauaugcugguugu

SEQ ID NO: 29177 - RNA, 21 nt, Artificial Sequence
  RNA Oligomer
gccaugaauuucacagccaug

SEQ ID NO: 29178 - RNA, 21 nt, Artificial Sequence
  RNA Oligomer
agccaugaauuucacagccau

SEQ ID NO: 29179 - RNA, 21 nt, Artificial Sequence
  RNA Oligomer
ugaauuccacagccaugaauu

SEQ ID NO: 29180 - RNA, 21 nt, Artificial Sequence
  RNA Oligomer
guagacacauaugauggccga

SEQ ID NO: 29181 - RNA, 21 nt, Artificial Sequence
  RNA Oligomer
cauucugaugaaucugaugaa

SEQ ID NO: 29182 - RNA, 21 nt, Artificial Sequence
  RNA Oligomer
ccacgguuguccagcaauuaa

SEQ ID NO: 29183 - RNA, 21 nt, Artificial Sequence
  RNA Oligomer
ugucugcagcagcauuuaaau

SEQ ID NO: 29184 - RNA, 21 nt, Artificial Sequence
  RNA Oligomer
cuucauggaaacucccuguaa

SEQ ID NO: 29185 - RNA, 21 nt, Artificial Sequence
  RNA Oligomer
ugaauuagauagugcaucuuc

SEQ ID NO: 29186 - RNA, 21 nt, Artificial Sequence
  RNA Oligomer
gccaugaagauaugcugguug

SEQ ID NO: 29187 - RNA, 21 nt, Artificial Sequence
  RNA Oligomer
ucaggaacuuuccaaagucag

SEQ ID NO: 29188 - RNA, 21 nt, Artificial Sequence
  RNA Oligomer
gucaggaacuuuccaaaguca

SEQ ID NO: 29189 - RNA, 21 nt, Artificial Sequence
  RNA Oligomer
gauagucaggaacuuuccaaa

SEQ ID NO: 29190 - RNA, 21 nt, Artificial Sequence
  RNA Oligomer
agaauugcagugauuugcuuu

SEQ ID NO: 29191 - RNA, 21 nt, Artificial Sequence
  RNA Oligomer
acacauggaaagcgaggaguu

SEQ ID NO: 29192 - RNA, 21 nt, Artificial Sequence
  RNA Oligomer
accugccagcaaccgaaguuu

SEQ ID NO: 29193 - RNA, 21 nt, Artificial Sequence
  RNA Oligomer
gucugaugagucucaccauuc

SEQ ID NO: 29194 - RNA, 21 nt, Artificial Sequence
  RNA Oligomer
ucccacgguuguccagcaauu

SEQ ID NO: 29195 - RNA, 21 nt, Artificial Sequence
  RNA Oligomer
uggaaacucccuguaaacuaa

SEQ ID NO: 29196 - RNA, 21 nt, Artificial Sequence
  RNA Oligomer
ucauggaaacucccuguaaac

SEQ ID NO: 29197 - RNA, 21 nt, Artificial Sequence
  RNA Oligomer
gagagcaaugagcauuccgau

SEQ ID NO: 29198 - RNA, 21 nt, Artificial Sequence
  RNA Oligomer
accagagugcugaaacccaca

SEQ ID NO: 29199 - RNA, 21 nt, Artificial Sequence
  RNA Oligomer
gaugaacuggucacugauuuu

SEQ ID NO: 29200 - RNA, 21 nt, Artificial Sequence
  RNA Oligomer
gucucaccauucugaugaauc

SEQ ID NO: 29201 - RNA, 21 nt, Artificial Sequence
  RNA Oligomer
cagucugaugagucucaccau

SEQ ID NO: 29202 - RNA, 21 nt, Artificial Sequence
  RNA Oligomer
gucugcagcagcauuuaaauu

SEQ ID NO: 29203 - RNA, 21 nt, Artificial Sequence
  RNA Oligomer
gcuuauuuguuuucccacggu

SEQ ID NO: 29204 - RNA, 21 nt, Artificial Sequence
  RNA Oligomer
gaaucugaugaacuggucacu

SEQ ID NO: 29205 - RNA, 21 nt, Artificial Sequence
  RNA Oligomer
gagucucaccauucugaugaa

SEQ ID NO: 29206 - RNA, 21 nt, Artificial Sequence
  RNA Oligomer
acacugaugauucucaccagu

SEQ ID NO: 29207 - RNA, 21 nt, Artificial Sequence
  RNA Oligomer
cuuauuuguuuucccacgguu

SEQ ID NO: 29208 - RNA, 21 nt, Artificial Sequence
  RNA Oligomer
cucacuuugcauuuagucaaa

SEQ ID NO: 29209 - RNA, 21 nt, Artificial Sequence
  RNA Oligomer
gaauuagauagugcaucuucu

SEQ ID NO: 29210 - RNA, 21 nt, Artificial Sequence
  RNA Oligomer
cagccaugaauuucacagcca

SEQ ID NO: 29211 - RNA, 21 nt, Artificial Sequence
  RNA Oligomer
cgugaauuccacagccaugaa

SEQ ID NO: 29212 - RNA, 21 nt, Artificial Sequence
  RNA Oligomer
ggaugucugcagcagcauuua

SEQ ID NO: 29213 - RNA, 21 nt, Artificial Sequence
  RNA Oligomer
gacacauaugauggccgaggu

SEQ ID NO: 29214 - RNA, 21 nt, Artificial Sequence
  RNA Oligomer
ccacaguagacacauaugaug

SEQ ID NO: 29215 - RNA, 21 nt, Artificial Sequence
  RNA Oligomer
cacuuugcauuuagucaaaag

SEQ ID NO: 29216 - RNA, 21 nt, Artificial Sequence
  RNA Oligomer
uccgaugugauugauagucag

SEQ ID NO: 29217 - RNA, 21 nt, Artificial Sequence
  RNA Oligomer
agcaaugagcauuccgaugug

SEQ ID NO: 29218 - RNA, 21 nt, Artificial Sequence
  RNA Oligomer
cuggaugaccagagugcugaa

SEQ ID NO: 29219 - RNA, 21 nt, Artificial Sequence
  RNA Oligomer
gaauggugcauacaaggccau

SEQ ID NO: 29220 - RNA, 21 nt, Artificial Sequence
  RNA Oligomer
cucaccauucugaugaaucug

SEQ ID NO: 29221 - RNA, 21 nt, Artificial Sequence
  RNA Oligomer
ccagucugaugagucucacca

SEQ ID NO: 29222 - RNA, 21 nt, Artificial Sequence
  RNA Oligomer
cacugaugauucucaccaguc

SEQ ID NO: 29223 - RNA, 21 nt, Artificial Sequence
  RNA Oligomer
gacacugaugauucucaccag

SEQ ID NO: 29224 - RNA, 21 nt, Artificial Sequence
  RNA Oligomer
cugcagcagcauuuaaauucu

SEQ ID NO: 29225 - RNA, 21 nt, Artificial Sequence
  RNA Oligomer
ugcuuauuuguuuucccacgg

SEQ ID NO: 29226 - RNA, 21 nt, Artificial Sequence
  RNA Oligomer
ggcuucauggaaacucccugu

SEQ ID NO: 29227 - RNA, 21 nt, Artificial Sequence
  RNA Oligomer
gaauugcagugauuugcuuuu

SEQ ID NO: 29228 - RNA, 21 nt, Artificial Sequence
  RNA Oligomer
ugauagucaggaacuuuccaa

SEQ ID NO: 29229 - RNA, 21 nt, Artificial Sequence
  RNA Oligomer
gagaauugcagugauuugcuu

SEQ ID NO: 29230 - RNA, 21 nt, Artificial Sequence
  RNA Oligomer
cucacuaccaugagaauugca

SEQ ID NO: 29231 - RNA, 21 nt, Artificial Sequence
  RNA Oligomer
ucacacauggaaagcgaggag

SEQ ID NO: 29232 - RNA, 21 nt, Artificial Sequence
  RNA Oligomer
caccucacacauggaaagcga

SEQ ID NO: 29233 - RNA, 21 nt, Artificial Sequence
  RNA Oligomer
gaaaacucacuaccaugagaa

SEQ ID NO: 29234 - RNA, 21 nt, Artificial Sequence
  RNA Oligomer
gccagcaaccgaaguuuucac

SEQ ID NO: 29235 - RNA, 21 nt, Artificial Sequence
  RNA Oligomer
agucucaccauucugaugaau

SEQ ID NO: 29236 - RNA, 21 nt, Artificial Sequence
  RNA Oligomer
cugaugauucucaccagucug

SEQ ID NO: 29237 - RNA, 21 nt, Artificial Sequence
  RNA Oligomer
ugcagcagcauuuaaauucug

SEQ ID NO: 29238 - RNA, 21 nt, Artificial Sequence
  RNA Oligomer
acaugaaaugcuucuuucuca

SEQ ID NO: 29239 - RNA, 21 nt, Artificial Sequence
  RNA Oligomer
ugaauuucacagccaugaaga

SEQ ID NO: 29240 - RNA, 21 nt, Artificial Sequence
  RNA Oligomer
ggaacuuuccaaagucagccg

SEQ ID NO: 29241 - RNA, 21 nt, Artificial Sequence
  RNA Oligomer
cagccacaagcaguccagauu

SEQ ID NO: 29242 - RNA, 21 nt, Artificial Sequence
  RNA Oligomer
cacuaccaugagaauugcagu

SEQ ID NO: 29243 - RNA, 21 nt, Artificial Sequence
  RNA Oligomer
acagacgaggacaucaccuca

SEQ ID NO: 29244 - RNA, 21 nt, Artificial Sequence
  RNA Oligomer
gaugauucucaccagucugau

SEQ ID NO: 29245 - RNA, 21 nt, Artificial Sequence
  RNA Oligomer
gaauuucacagccaugaagau

SEQ ID NO: 29246 - RNA, 21 nt, Artificial Sequence
  RNA Oligomer
cuaccaugagaauugcaguga

SEQ ID NO: 29247 - RNA, 21 nt, Artificial Sequence
  RNA Oligomer
gaugagucucaccauucugau

SEQ ID NO: 29248 - RNA, 21 nt, Artificial Sequence
  RNA Oligomer
cugaugagucucaccauucug

SEQ ID NO: 29249 - RNA, 21 nt, Artificial Sequence
  RNA Oligomer
caccagucugaugagucucac

SEQ ID NO: 29250 - RNA, 21 nt, Artificial Sequence
  RNA Oligomer
ugagaauugcagugauuugcu

SEQ ID NO: 29251 - RNA, 21 nt, Artificial Sequence
  RNA Oligomer
gaaacgagucagcuggaugac

SEQ ID NO: 29252 - RNA, 21 nt, Artificial Sequence
  RNA Oligomer
ugaauggugcauacaaggcca

SEQ ID NO: 29253 - RNA, 21 nt, Artificial Sequence
  RNA Oligomer
ggucacugauuuucccacgga

SEQ ID NO: 29254 - RNA, 21 nt, Artificial Sequence
  RNA Oligomer
gugaauuccacagccaugaau

SEQ ID NO: 29255 - RNA, 21 nt, Artificial Sequence
  RNA Oligomer
agccgugaauuccacagccau

SEQ ID NO: 29256 - RNA, 21 nt, Artificial Sequence
  RNA Oligomer
ccgugaauuccacagccauga

SEQ ID NO: 29257 - RNA, 21 nt, Artificial Sequence
  RNA Oligomer
aaaacucacuaccaugagaau

SEQ ID NO: 29258 - RNA, 21 nt, Artificial Sequence
  RNA Oligomer
gucacugauuuucccacggac

SEQ ID NO: 29259 - RNA, 21 nt, Artificial Sequence
  RNA Oligomer
caugaauuucacagccaugaa

SEQ ID NO: 29260 - RNA, 21 nt, Artificial Sequence
  RNA Oligomer
acagccacaagcaguccagau

SEQ ID NO: 29261 - RNA, 21 nt, Artificial Sequence
  RNA Oligomer
aggaugucugcagcagcauuu

SEQ ID NO: 29262 - RNA, 21 nt, Artificial Sequence
  RNA Oligomer
ccaugaauuucacagccauga

SEQ ID NO: 29263 - RNA, 21 nt, Artificial Sequence
  RNA Oligomer
gaauuccacagccaugaauuu

SEQ ID NO: 29264 - RNA, 21 nt, Artificial Sequence
  RNA Oligomer
gaaaugcuucuuucucaguuu

SEQ ID NO: 29265 - RNA, 21 nt, Artificial Sequence
  RNA Oligomer
gaggaugucugcagcagcauu

SEQ ID NO: 29266 - RNA, 21 nt, Artificial Sequence
  RNA Oligomer
caugaaaugcuucuuucucag

SEQ ID NO: 29267 - RNA, 21 nt, Artificial Sequence
  RNA Oligomer
agagaacaugaaaugcuucuu

SEQ ID NO: 29268 - RNA, 21 nt, Artificial Sequence
  RNA Oligomer
agauagugcaucuucugaggu

SEQ ID NO: 29269 - RNA, 21 nt, Artificial Sequence
  RNA Oligomer
ccacagccaugaauuucacag

SEQ ID NO: 29270 - RNA, 21 nt, Artificial Sequence
  RNA Oligomer
gaacaugaaaugcuucuuucu

SEQ ID NO: 29271 - RNA, 21 nt, Artificial Sequence
  RNA Oligomer
gagaacaugaaaugcuucuuu

SEQ ID NO: 29272 - RNA, 21 nt, Artificial Sequence
  RNA Oligomer
uccacagccaugaauuucaca

SEQ ID NO: 29273 - RNA, 21 nt, Artificial Sequence
  RNA Oligomer
gaacuuuccaaagucagccgu

SEQ ID NO: 29274 - RNA, 21 nt, Artificial Sequence
  RNA Oligomer
ugaaacccacagccacaagca

SEQ ID NO: 29275 - RNA, 21 nt, Artificial Sequence
  RNA Oligomer
cuuuccaaagucagccgugaa

SEQ ID NO: 29276 - RNA, 21 nt, Artificial Sequence
  RNA Oligomer
ugaaaugcuucuuucucaguu

SEQ ID NO: 29277 - RNA, 21 nt, Artificial Sequence
  RNA Oligomer
agaacaugaaaugcuucuuuc

SEQ ID NO: 29278 - RNA, 21 nt, Artificial Sequence
  RNA Oligomer
uuccaaagucagccgugaauu

SEQ ID NO: 29279 - RNA, 21 nt, Artificial Sequence
  RNA Oligomer
uuuaguuuacagggaguuucc

SEQ ID NO: 29280 - RNA, 21 nt, Artificial Sequence
  RNA Oligomer
uucagguguuuaucuucuucc

SEQ ID NO: 29281 - RNA, 21 nt, Artificial Sequence
  RNA Oligomer
uuaauugaccucagaagaugc

SEQ ID NO: 29282 - RNA, 21 nt, Artificial Sequence
  RNA Oligomer
uuucagguguuuaucuucuuc

SEQ ID NO: 29283 - RNA, 21 nt, Artificial Sequence
  RNA Oligomer
auaacccugaagcuuuuaguu

SEQ ID NO: 29284 - RNA, 21 nt, Artificial Sequence
  RNA Oligomer
uaucuucuuccuuacuuuugg

SEQ ID NO: 29285 - RNA, 21 nt, Artificial Sequence
  RNA Oligomer
aggcaguaaaaaagguuaugu

SEQ ID NO: 29286 - RNA, 21 nt, Artificial Sequence
  RNA Oligomer
uaacccugaagcuuuuaguuu

SEQ ID NO: 29287 - RNA, 21 nt, Artificial Sequence
  RNA Oligomer
uuuuaguuuacagggaguuuc

SEQ ID NO: 29288 - RNA, 21 nt, Artificial Sequence
  RNA Oligomer
aauugaccucagaagaugcac

SEQ ID NO: 29289 - RNA, 21 nt, Artificial Sequence
  RNA Oligomer
aaaguuccugacuaucaauca

SEQ ID NO: 29290 - RNA, 21 nt, Artificial Sequence
  RNA Oligomer
aaaucacugcaauucucaugg

SEQ ID NO: 29291 - RNA, 21 nt, Artificial Sequence
  RNA Oligomer
uaugcaccauucaacuccucg

SEQ ID NO: 29292 - RNA, 21 nt, Artificial Sequence
  RNA Oligomer
uuuauuaauugcuggacaacc

SEQ ID NO: 29293 - RNA, 21 nt, Artificial Sequence
  RNA Oligomer
gaaugaacauagacauaaccc

SEQ ID NO: 29294 - RNA, 21 nt, Artificial Sequence
  RNA Oligomer
augaacauagacauaacccug

SEQ ID NO: 29295 - RNA, 21 nt, Artificial Sequence
  RNA Oligomer
uaucaaucacaucggaaugcu

SEQ ID NO: 29296 - RNA, 21 nt, Artificial Sequence
  RNA Oligomer
aucaaucacaucggaaugcuc

SEQ ID NO: 29297 - RNA, 21 nt, Artificial Sequence
  RNA Oligomer
ucacaucggaaugcucauugc

SEQ ID NO: 29298 - RNA, 21 nt, Artificial Sequence
  RNA Oligomer
uuguaugcaccauucaacucc

SEQ ID NO: 29299 - RNA, 21 nt, Artificial Sequence
  RNA Oligomer
aucaucagugucaucuacauc

SEQ ID NO: 29300 - RNA, 21 nt, Artificial Sequence
  RNA Oligomer
aucagugucaucuacaucauc

SEQ ID NO: 29301 - RNA, 21 nt, Artificial Sequence
  RNA Oligomer
uuccagacucaaauagauaca

SEQ ID NO: 29302 - RNA, 21 nt, Artificial Sequence
  RNA Oligomer
uaauugaccucagaagaugca

SEQ ID NO: 29303 - RNA, 21 nt, Artificial Sequence
  RNA Oligomer
ucagguguuuaucuucuuccu

SEQ ID NO: 29304 - RNA, 21 nt, Artificial Sequence
  RNA Oligomer
aaucacugcaauucucauggu

SEQ ID NO: 29305 - RNA, 21 nt, Artificial Sequence
  RNA Oligomer
agaaugaacauagacauaacc

SEQ ID NO: 29306 - RNA, 21 nt, Artificial Sequence
  RNA Oligomer
aacauagacauaacccugaag

SEQ ID NO: 29307 - RNA, 21 nt, Artificial Sequence
  RNA Oligomer
acauagacauaacccugaagc

SEQ ID NO: 29308 - RNA, 21 nt, Artificial Sequence
  RNA Oligomer
uuuccagacucaaauagauac

SEQ ID NO: 29309 - RNA, 21 nt, Artificial Sequence
  RNA Oligomer
uccagacucaaauagauacac

SEQ ID NO: 29310 - RNA, 21 nt, Artificial Sequence
  RNA Oligomer
aagcauuucauguucucuuuc

SEQ ID NO: 29311 - RNA, 21 nt, Artificial Sequence
  RNA Oligomer
uucuccuuuuaauugaccuca

SEQ ID NO: 29312 - RNA, 21 nt, Artificial Sequence
  RNA Oligomer
gucuacaaccagcauaucuuc

SEQ ID NO: 29313 - RNA, 21 nt, Artificial Sequence
  RNA Oligomer
uacaaccagcauaucuucaug

SEQ ID NO: 29314 - RNA, 21 nt, Artificial Sequence
  RNA Oligomer
uuccugacuaucaaucacauc

SEQ ID NO: 29315 - RNA, 21 nt, Artificial Sequence
  RNA Oligomer
aucacaucggaaugcucauug

SEQ ID NO: 29316 - RNA, 21 nt, Artificial Sequence
  RNA Oligomer
caccucggccaucauaugugu

SEQ ID NO: 29317 - RNA, 21 nt, Artificial Sequence
  RNA Oligomer
cucccagaauuuaaaugcugc

SEQ ID NO: 29318 - RNA, 21 nt, Artificial Sequence
  RNA Oligomer
acauucaaccaauaaacugag

SEQ ID NO: 29319 - RNA, 21 nt, Artificial Sequence
  RNA Oligomer
uuucuccuuuuaauugaccuc

SEQ ID NO: 29320 - RNA, 21 nt, Artificial Sequence
  RNA Oligomer
ccugacuaucaaucacaucgg

SEQ ID NO: 29321 - RNA, 21 nt, Artificial Sequence
  RNA Oligomer
uaaaccacacuaucaccucgg

SEQ ID NO: 29322 - RNA, 21 nt, Artificial Sequence
  RNA Oligomer
agugucaucuacaucaucaga

SEQ ID NO: 29323 - RNA, 21 nt, Artificial Sequence
  RNA Oligomer
gucaucuacaucaucagaguc

SEQ ID NO: 29324 - RNA, 21 nt, Artificial Sequence
  RNA Oligomer
ucaucuacaucaucagagucg

SEQ ID NO: 29325 - RNA, 21 nt, Artificial Sequence
  RNA Oligomer
aucuacaucaucagagucguu

SEQ ID NO: 29326 - RNA, 21 nt, Artificial Sequence
  RNA Oligomer
ccagaauuuaaaugcugcugc

SEQ ID NO: 29327 - RNA, 21 nt, Artificial Sequence
  RNA Oligomer
aaguuccugacuaucaaucac

SEQ ID NO: 29328 - RNA, 21 nt, Artificial Sequence
  RNA Oligomer
cuaucaaucacaucggaaugc

SEQ ID NO: 29329 - RNA, 21 nt, Artificial Sequence
  RNA Oligomer
uguaugcaccauucaacuccu

SEQ ID NO: 29330 - RNA, 21 nt, Artificial Sequence
  RNA Oligomer
guaugcaccauucaacuccuc

SEQ ID NO: 29331 - RNA, 21 nt, Artificial Sequence
  RNA Oligomer
auaaaccacacuaucaccucg

SEQ ID NO: 29332 - RNA, 21 nt, Artificial Sequence
  RNA Oligomer
aaaccacacuaucaccucggc

SEQ ID NO: 29333 - RNA, 21 nt, Artificial Sequence
  RNA Oligomer
gcccucccagaauuuaaaugc

SEQ ID NO: 29334 - RNA, 21 nt, Artificial Sequence
  RNA Oligomer
aaugaacauagacauaacccu

SEQ ID NO: 29335 - RNA, 21 nt, Artificial Sequence
  RNA Oligomer
acacauucaaccaauaaacug

SEQ ID NO: 29336 - RNA, 21 nt, Artificial Sequence
  RNA Oligomer
ucauguucucuuucauuuugc

SEQ ID NO: 29337 - RNA, 21 nt, Artificial Sequence
  RNA Oligomer
uugaccucagaagaugcacua

SEQ ID NO: 29338 - RNA, 21 nt, Artificial Sequence
  RNA Oligomer
uccugacuaucaaucacaucg

SEQ ID NO: 29339 - RNA, 21 nt, Artificial Sequence
  RNA Oligomer
aaucagaaggcgcguucaggu

SEQ ID NO: 29340 - RNA, 21 nt, Artificial Sequence
  RNA Oligomer
aucaccucggccaucauaugu

SEQ ID NO: 29341 - RNA, 21 nt, Artificial Sequence
  RNA Oligomer
caucuacaucaucagagucgu

SEQ ID NO: 29342 - RNA, 21 nt, Artificial Sequence
  RNA Oligomer
caauaaacugagaaagaagca

SEQ ID NO: 29343 - RNA, 21 nt, Artificial Sequence
  RNA Oligomer
aucacugcaauucucauggua

SEQ ID NO: 29344 - RNA, 21 nt, Artificial Sequence
  RNA Oligomer
augcaccauucaacuccucgc

SEQ ID NO: 29345 - RNA, 21 nt, Artificial Sequence
  RNA Oligomer
agaaucaucagugucaucuac

SEQ ID NO: 29346 - RNA, 21 nt, Artificial Sequence
  RNA Oligomer
acaccacaaaaagauaaucac

SEQ ID NO: 29347 - RNA, 21 nt, Artificial Sequence
  RNA Oligomer
guuauuuccagacucaaauag

SEQ ID NO: 29348 - RNA, 21 nt, Artificial Sequence
  RNA Oligomer
cauucaaccaauaaacugaga

SEQ ID NO: 29349 - RNA, 21 nt, Artificial Sequence
  RNA Oligomer
ucuccuuuuaauugaccucag

SEQ ID NO: 29350 - RNA, 21 nt, Artificial Sequence
  RNA Oligomer
ucuacaaccagcauaucuuca

SEQ ID NO: 29351 - RNA, 21 nt, Artificial Sequence
  RNA Oligomer
auucaacuccucgcuuuccau

SEQ ID NO: 29352 - RNA, 21 nt, Artificial Sequence
  RNA Oligomer
ucccagaauuuaaaugcugcu

SEQ ID NO: 29353 - RNA, 21 nt, Artificial Sequence
  RNA Oligomer
gggaaaacaaauaagcaauug

SEQ ID NO: 29354 - RNA, 21 nt, Artificial Sequence
  RNA Oligomer
caccacaaaaagauaaucaca

SEQ ID NO: 29355 - RNA, 21 nt, Artificial Sequence
  RNA Oligomer
ggguaaaaguauuuuguuugc

SEQ ID NO: 29356 - RNA, 21 nt, Artificial Sequence
  RNA Oligomer
augaagccacaaacuaaacua

SEQ ID NO: 29357 - RNA, 21 nt, Artificial Sequence
  RNA Oligomer
ugcaccauucaacuccucgcu

SEQ ID NO: 29358 - RNA, 21 nt, Artificial Sequence
  RNA Oligomer
uccaugugugaggugaugucc

SEQ ID NO: 29359 - RNA, 21 nt, Artificial Sequence
  RNA Oligomer
aaccaagcccucccagaauuu

SEQ ID NO: 29360 - RNA, 21 nt, Artificial Sequence
  RNA Oligomer
cauguucucuuucauuuugcu

SEQ ID NO: 29361 - RNA, 21 nt, Artificial Sequence
  RNA Oligomer
ugaagccacaaacuaaacuaa

SEQ ID NO: 29362 - RNA, 21 nt, Artificial Sequence
  RNA Oligomer
gacuuuggaaaguuccugacu

SEQ ID NO: 29363 - RNA, 21 nt, Artificial Sequence
  RNA Oligomer
acccugaagcuuuuaguuuac

SEQ ID NO: 29364 - RNA, 21 nt, Artificial Sequence
  RNA Oligomer
aucuucuuccuuacuuuuggg

SEQ ID NO: 29365 - RNA, 21 nt, Artificial Sequence
  RNA Oligomer
uuuccaugugugaggugaugu

SEQ ID NO: 29366 - RNA, 21 nt, Artificial Sequence
  RNA Oligomer
uauuaauugcuggacaaccgu

SEQ ID NO: 29367 - RNA, 21 nt, Artificial Sequence
  RNA Oligomer
ugaagcuuuuaguuuacaggg

SEQ ID NO: 29368 - RNA, 21 nt, Artificial Sequence
  RNA Oligomer
aaccagcauaucuucauggcu

SEQ ID NO: 29369 - RNA, 21 nt, Artificial Sequence
  RNA Oligomer
aaaacuucgguugcuggcagg

SEQ ID NO: 29370 - RNA, 21 nt, Artificial Sequence
  RNA Oligomer
ucaucagauucaucagaaugg

SEQ ID NO: 29371 - RNA, 21 nt, Artificial Sequence
  RNA Oligomer
aagcuuuuaguuuacagggag

SEQ ID NO: 29372 - RNA, 21 nt, Artificial Sequence
  RNA Oligomer
augugugaggugauguccucg

SEQ ID NO: 29373 - RNA, 21 nt, Artificial Sequence
  RNA Oligomer
caucagauucaucagaauggu

SEQ ID NO: 29374 - RNA, 21 nt, Artificial Sequence
  RNA Oligomer
aucauaugugucuacuguggg

SEQ ID NO: 29375 - RNA, 21 nt, Artificial Sequence
  RNA Oligomer
aaaucagugaccaguucauca

SEQ ID NO: 29376 - RNA, 21 nt, Artificial Sequence
  RNA Oligomer
aucagugaccaguucaucaga

SEQ ID NO: 29377 - RNA, 21 nt, Artificial Sequence
  RNA Oligomer
uaauugcuggacaaccguggg

SEQ ID NO: 29378 - RNA, 21 nt, Artificial Sequence
  RNA Oligomer
ugugaggugauguccucgucu

SEQ ID NO: 29379 - RNA, 21 nt, Artificial Sequence
  RNA Oligomer
aucagauucaucagaauggug

SEQ ID NO: 29380 - RNA, 21 nt, Artificial Sequence
  RNA Oligomer
guuucagcacucuggucaucc

SEQ ID NO: 29381 - RNA, 21 nt, Artificial Sequence
  RNA Oligomer
aaucagugaccaguucaucag

SEQ ID NO: 29382 - RNA, 21 nt, Artificial Sequence
  RNA Oligomer
uuauuaauugcuggacaaccg

SEQ ID NO: 29383 - RNA, 21 nt, Artificial Sequence
  RNA Oligomer
auuaauugcuggacaaccgug

SEQ ID NO: 29384 - RNA, 21 nt, Artificial Sequence
  RNA Oligomer
cugaagcuuuuaguuuacagg

SEQ ID NO: 29385 - RNA, 21 nt, Artificial Sequence
  RNA Oligomer
uacagggaguuuccaugaagc

SEQ ID NO: 29386 - RNA, 21 nt, Artificial Sequence
  RNA Oligomer
acaaccagcauaucuucaugg

SEQ ID NO: 29387 - RNA, 21 nt, Artificial Sequence
  RNA Oligomer
cauggcugugaaauucauggc

SEQ ID NO: 29388 - RNA, 21 nt, Artificial Sequence
  RNA Oligomer
auggcugugaaauucauggcu

SEQ ID NO: 29389 - RNA, 21 nt, Artificial Sequence
  RNA Oligomer
aauucauggcuguggaauuca

SEQ ID NO: 29390 - RNA, 21 nt, Artificial Sequence
  RNA Oligomer
ucggccaucauaugugucuac

SEQ ID NO: 29391 - RNA, 21 nt, Artificial Sequence
  RNA Oligomer
uucaucagauucaucagaaug

SEQ ID NO: 29392 - RNA, 21 nt, Artificial Sequence
  RNA Oligomer
uuaauugcuggacaaccgugg

SEQ ID NO: 29393 - RNA, 21 nt, Artificial Sequence
  RNA Oligomer
auuuaaaugcugcugcagaca

SEQ ID NO: 29394 - RNA, 21 nt, Artificial Sequence
  RNA Oligomer
uuacagggaguuuccaugaag

SEQ ID NO: 29395 - RNA, 21 nt, Artificial Sequence
  RNA Oligomer
gaagaugcacuaucuaauuca

SEQ ID NO: 29396 - RNA, 21 nt, Artificial Sequence
  RNA Oligomer
caaccagcauaucuucauggc

SEQ ID NO: 29397 - RNA, 21 nt, Artificial Sequence
  RNA Oligomer
cugacuuuggaaaguuccuga

SEQ ID NO: 29398 - RNA, 21 nt, Artificial Sequence
  RNA Oligomer
ugacuuuggaaaguuccugac

SEQ ID NO: 29399 - RNA, 21 nt, Artificial Sequence
  RNA Oligomer
uuuggaaaguuccugacuauc

SEQ ID NO: 29400 - RNA, 21 nt, Artificial Sequence
  RNA Oligomer
aaagcaaaucacugcaauucu

SEQ ID NO: 29401 - RNA, 21 nt, Artificial Sequence
  RNA Oligomer
aacuccucgcuuuccaugugu

SEQ ID NO: 29402 - RNA, 21 nt, Artificial Sequence
  RNA Oligomer
aaacuucgguugcuggcaggu

SEQ ID NO: 29403 - RNA, 21 nt, Artificial Sequence
  RNA Oligomer
gaauggugagacucaucagac

SEQ ID NO: 29404 - RNA, 21 nt, Artificial Sequence
  RNA Oligomer
aauugcuggacaaccguggga

SEQ ID NO: 29405 - RNA, 21 nt, Artificial Sequence
  RNA Oligomer
uuaguuuacagggaguuucca

SEQ ID NO: 29406 - RNA, 21 nt, Artificial Sequence
  RNA Oligomer
guuuacagggaguuuccauga

SEQ ID NO: 29407 - RNA, 21 nt, Artificial Sequence
  RNA Oligomer
aucggaaugcucauugcucuc

SEQ ID NO: 29408 - RNA, 21 nt, Artificial Sequence
  RNA Oligomer
uguggguuucagcacucuggu

SEQ ID NO: 29409 - RNA, 21 nt, Artificial Sequence
  RNA Oligomer
aaaaucagugaccaguucauc

SEQ ID NO: 29410 - RNA, 21 nt, Artificial Sequence
  RNA Oligomer
gauucaucagaauggugagac

SEQ ID NO: 29411 - RNA, 21 nt, Artificial Sequence
  RNA Oligomer
auggugagacucaucagacug

SEQ ID NO: 29412 - RNA, 21 nt, Artificial Sequence
  RNA Oligomer
aauuuaaaugcugcugcagac

SEQ ID NO: 29413 - RNA, 21 nt, Artificial Sequence
  RNA Oligomer
accgugggaaaacaaauaagc

SEQ ID NO: 29414 - RNA, 21 nt, Artificial Sequence
  RNA Oligomer
agugaccaguucaucagauuc

SEQ ID NO: 29415 - RNA, 21 nt, Artificial Sequence
  RNA Oligomer
uucaucagaauggugagacuc

SEQ ID NO: 29416 - RNA, 21 nt, Artificial Sequence
  RNA Oligomer
acuggugagaaucaucagugu

SEQ ID NO: 29417 - RNA, 21 nt, Artificial Sequence
  RNA Oligomer
aaccgugggaaaacaaauaag

SEQ ID NO: 29418 - RNA, 21 nt, Artificial Sequence
  RNA Oligomer
uuugacuaaaugcaaagugag

SEQ ID NO: 29419 - RNA, 21 nt, Artificial Sequence
  RNA Oligomer
agaagaugcacuaucuaauuc

SEQ ID NO: 29420 - RNA, 21 nt, Artificial Sequence
  RNA Oligomer
uggcugugaaauucauggcug

SEQ ID NO: 29421 - RNA, 21 nt, Artificial Sequence
  RNA Oligomer
uucauggcuguggaauucacg

SEQ ID NO: 29422 - RNA, 21 nt, Artificial Sequence
  RNA Oligomer
uaaaugcugcugcagacaucc

SEQ ID NO: 29423 - RNA, 21 nt, Artificial Sequence
  RNA Oligomer
accucggccaucauauguguc

SEQ ID NO: 29424 - RNA, 21 nt, Artificial Sequence
  RNA Oligomer
caucauaugugucuacugugg

SEQ ID NO: 29425 - RNA, 21 nt, Artificial Sequence
  RNA Oligomer
cuuuugacuaaaugcaaagug

SEQ ID NO: 29426 - RNA, 21 nt, Artificial Sequence
  RNA Oligomer
cugacuaucaaucacaucgga

SEQ ID NO: 29427 - RNA, 21 nt, Artificial Sequence
  RNA Oligomer
cacaucggaaugcucauugcu

SEQ ID NO: 29428 - RNA, 21 nt, Artificial Sequence
  RNA Oligomer
uucagcacucuggucauccag

SEQ ID NO: 29429 - RNA, 21 nt, Artificial Sequence
  RNA Oligomer
auggccuuguaugcaccauuc

SEQ ID NO: 29430 - RNA, 21 nt, Artificial Sequence
  RNA Oligomer
cagauucaucagaauggugag

SEQ ID NO: 29431 - RNA, 21 nt, Artificial Sequence
  RNA Oligomer
uggugagacucaucagacugg

SEQ ID NO: 29432 - RNA, 21 nt, Artificial Sequence
  RNA Oligomer
gacuggugagaaucaucagug

SEQ ID NO: 29433 - RNA, 21 nt, Artificial Sequence
  RNA Oligomer
cuggugagaaucaucaguguc

SEQ ID NO: 29434 - RNA, 21 nt, Artificial Sequence
  RNA Oligomer
agaauuuaaaugcugcugcag

SEQ ID NO: 29435 - RNA, 21 nt, Artificial Sequence
  RNA Oligomer
ccgugggaaaacaaauaagca

SEQ ID NO: 29436 - RNA, 21 nt, Artificial Sequence
  RNA Oligomer
acagggaguuuccaugaagcc

SEQ ID NO: 29437 - RNA, 21 nt, Artificial Sequence
  RNA Oligomer
aaaagcaaaucacugcaauuc

SEQ ID NO: 29438 - RNA, 21 nt, Artificial Sequence
  RNA Oligomer
uuggaaaguuccugacuauca

SEQ ID NO: 29439 - RNA, 21 nt, Artificial Sequence
  RNA Oligomer
aagcaaaucacugcaauucuc

SEQ ID NO: 29440 - RNA, 21 nt, Artificial Sequence
  RNA Oligomer
ugcaauucucaugguagugag

SEQ ID NO: 29441 - RNA, 21 nt, Artificial Sequence
  RNA Oligomer
cuccucgcuuuccauguguga

SEQ ID NO: 29442 - RNA, 21 nt, Artificial Sequence
  RNA Oligomer
ucgcuuuccaugugugaggug

SEQ ID NO: 29443 - RNA, 21 nt, Artificial Sequence
  RNA Oligomer
uucucaugguagugaguuuuc

SEQ ID NO: 29444 - RNA, 21 nt, Artificial Sequence
  RNA Oligomer
gugaaaacuucgguugcuggc

SEQ ID NO: 29445 - RNA, 21 nt, Artificial Sequence
  RNA Oligomer
auucaucagaauggugagacu

SEQ ID NO: 29446 - RNA, 21 nt, Artificial Sequence
  RNA Oligomer
cagacuggugagaaucaucag

SEQ ID NO: 29447 - RNA, 21 nt, Artificial Sequence
  RNA Oligomer
cagaauuuaaaugcugcugca

SEQ ID NO: 29448 - RNA, 21 nt, Artificial Sequence
  RNA Oligomer
ugagaaagaagcauuucaugu

SEQ ID NO: 29449 - RNA, 21 nt, Artificial Sequence
  RNA Oligomer
ucuucauggcugugaaauuca

SEQ ID NO: 29450 - RNA, 21 nt, Artificial Sequence
  RNA Oligomer
cggcugacuuuggaaaguucc

SEQ ID NO: 29451 - RNA, 21 nt, Artificial Sequence
  RNA Oligomer
aaucuggacugcuuguggcug

SEQ ID NO: 29452 - RNA, 21 nt, Artificial Sequence
  RNA Oligomer
acugcaauucucaugguagug

SEQ ID NO: 29453 - RNA, 21 nt, Artificial Sequence
  RNA Oligomer
ugaggugauguccucgucugu

SEQ ID NO: 29454 - RNA, 21 nt, Artificial Sequence
  RNA Oligomer
aucagacuggugagaaucauc

SEQ ID NO: 29455 - RNA, 21 nt, Artificial Sequence
  RNA Oligomer
aucuucauggcugugaaauuc

SEQ ID NO: 29456 - RNA, 21 nt, Artificial Sequence
  RNA Oligomer
ucacugcaauucucaugguag

SEQ ID NO: 29457 - RNA, 21 nt, Artificial Sequence
  RNA Oligomer
aucagaauggugagacucauc

SEQ ID NO: 29458 - RNA, 21 nt, Artificial Sequence
  RNA Oligomer
cagaauggugagacucaucag

SEQ ID NO: 29459 - RNA, 21 nt, Artificial Sequence
  RNA Oligomer
gugagacucaucagacuggug

SEQ ID NO: 29460 - RNA, 21 nt, Artificial Sequence
  RNA Oligomer
agcaaaucacugcaauucuca

SEQ ID NO: 29461 - RNA, 21 nt, Artificial Sequence
  RNA Oligomer
gucauccagcugacucguuuc

SEQ ID NO: 29462 - RNA, 21 nt, Artificial Sequence
  RNA Oligomer
uggccuuguaugcaccauuca

SEQ ID NO: 29463 - RNA, 21 nt, Artificial Sequence
  RNA Oligomer
uccgugggaaaaucagugacc

SEQ ID NO: 29464 - RNA, 21 nt, Artificial Sequence
  RNA Oligomer
auucauggcuguggaauucac

SEQ ID NO: 29465 - RNA, 21 nt, Artificial Sequence
  RNA Oligomer
auggcuguggaauucacggcu

SEQ ID NO: 29466 - RNA, 21 nt, Artificial Sequence
  RNA Oligomer
ucauggcuguggaauucacgg

SEQ ID NO: 29467 - RNA, 21 nt, Artificial Sequence
  RNA Oligomer
auucucaugguagugaguuuu

SEQ ID NO: 29468 - RNA, 21 nt, Artificial Sequence
  RNA Oligomer
guccgugggaaaaucagugac

SEQ ID NO: 29469 - RNA, 21 nt, Artificial Sequence
  RNA Oligomer
uucauggcugugaaauucaug

SEQ ID NO: 29470 - RNA, 21 nt, Artificial Sequence
  RNA Oligomer
aucuggacugcuuguggcugu

SEQ ID NO: 29471 - RNA, 21 nt, Artificial Sequence
  RNA Oligomer
aaaugcugcugcagacauccu

SEQ ID NO: 29472 - RNA, 21 nt, Artificial Sequence
  RNA Oligomer
ucauggcugugaaauucaugg

SEQ ID NO: 29473 - RNA, 21 nt, Artificial Sequence
  RNA Oligomer
aaauucauggcuguggaauuc

SEQ ID NO: 29474 - RNA, 21 nt, Artificial Sequence
  RNA Oligomer
aaacugagaaagaagcauuuc

SEQ ID NO: 29475 - RNA, 21 nt, Artificial Sequence
  RNA Oligomer
aaugcugcugcagacauccuc

SEQ ID NO: 29476 - RNA, 21 nt, Artificial Sequence
  RNA Oligomer
cugagaaagaagcauuucaug

SEQ ID NO: 29477 - RNA, 21 nt, Artificial Sequence
  RNA Oligomer
aagaagcauuucauguucucu

SEQ ID NO: 29478 - RNA, 21 nt, Artificial Sequence
  RNA Oligomer
accucagaagaugcacuaucu

SEQ ID NO: 29479 - RNA, 21 nt, Artificial Sequence
  RNA Oligomer
cugugaaauucauggcugugg

SEQ ID NO: 29480 - RNA, 21 nt, Artificial Sequence
  RNA Oligomer
agaaagaagcauuucauguuc

SEQ ID NO: 29481 - RNA, 21 nt, Artificial Sequence
  RNA Oligomer
aaagaagcauuucauguucuc

SEQ ID NO: 29482 - RNA, 21 nt, Artificial Sequence
  RNA Oligomer
ugugaaauucauggcugugga

SEQ ID NO: 29483 - RNA, 21 nt, Artificial Sequence
  RNA Oligomer
acggcugacuuuggaaaguuc

SEQ ID NO: 29484 - RNA, 21 nt, Artificial Sequence
  RNA Oligomer
ugcuuguggcuguggguuuca

SEQ ID NO: 29485 - RNA, 21 nt, Artificial Sequence
  RNA Oligomer
uucacggcugacuuuggaaag

SEQ ID NO: 29486 - RNA, 21 nt, Artificial Sequence
  RNA Oligomer
aacugagaaagaagcauuuca

SEQ ID NO: 29487 - RNA, 21 nt, Artificial Sequence
  RNA Oligomer
gaaagaagcauuucauguucu

SEQ ID NO: 29488 - RNA, 21 nt, Artificial Sequence
  RNA Oligomer
aauucacggcugacuuuggaa

SEQ ID NO: 29489 - RNA, 21 nt, Artificial Sequence
  RNA Oligomer
cuggccuuuuucauuuaucua

SEQ ID NO: 29490 - RNA, 21 nt, Artificial Sequence
  RNA Oligomer
agauggagugagagagguuuu

SEQ ID NO: 29491 - RNA, 21 nt, Artificial Sequence
  RNA Oligomer
aaagauggagugagagagguu

SEQ ID NO: 29492 - RNA, 21 nt, Artificial Sequence
  RNA Oligomer
gggugggcaguuuuuugaaaa

SEQ ID NO: 29493 - RNA, 21 nt, Artificial Sequence
  RNA Oligomer
ggugggcaguuuuuugaaaau

SEQ ID NO: 29494 - RNA, 21 nt, Artificial Sequence
  RNA Oligomer
uccuuuugacacugcucuaac

SEQ ID NO: 29495 - RNA, 21 nt, Artificial Sequence
  RNA Oligomer
gcaauuagacacuuuggaaga

SEQ ID NO: 29496 - RNA, 21 nt, Artificial Sequence
  RNA Oligomer
acacuuuggaagauggcauaa

SEQ ID NO: 29497 - RNA, 21 nt, Artificial Sequence
  RNA Oligomer
gacacuuuggaagauggcaua

SEQ ID NO: 29498 - RNA, 21 nt, Artificial Sequence
  RNA Oligomer
ggauuuccuaauacugucauc

SEQ ID NO: 29499 - RNA, 21 nt, Artificial Sequence
  RNA Oligomer
gggcaguuuuuugaaaauggg

SEQ ID NO: 29500 - RNA, 21 nt, Artificial Sequence
  RNA Oligomer
ccuuuugacacugcucuaaca

SEQ ID NO: 29501 - RNA, 21 nt, Artificial Sequence
  RNA Oligomer
acuggccuuuuucauuuaucu

SEQ ID NO: 29502 - RNA, 21 nt, Artificial Sequence
  RNA Oligomer
ugauuacuggccuuuuucauu

SEQ ID NO: 29503 - RNA, 21 nt, Artificial Sequence
  RNA Oligomer
gugagagagguuuuugaaaug

SEQ ID NO: 29504 - RNA, 21 nt, Artificial Sequence
  RNA Oligomer
cacagugcucuuuucuccuca

SEQ ID NO: 29505 - RNA, 21 nt, Artificial Sequence
  RNA Oligomer
uaauucacagugcucuuuucu

SEQ ID NO: 29506 - RNA, 21 nt, Artificial Sequence
  RNA Oligomer
aggcaauuagacacuuuggaa

SEQ ID NO: 29507 - RNA, 21 nt, Artificial Sequence
  RNA Oligomer
ccuaauacugucauccucaaa

SEQ ID NO: 29508 - RNA, 21 nt, Artificial Sequence
  RNA Oligomer
ccaggcgcuaauucaaggaau

SEQ ID NO: 29509 - RNA, 21 nt, Artificial Sequence
  RNA Oligomer
gcacucagucucucuucucuc

SEQ ID NO: 29510 - RNA, 21 nt, Artificial Sequence
  RNA Oligomer
cuaauucacagugcucuuuuc

SEQ ID NO: 29511 - RNA, 21 nt, Artificial Sequence
  RNA Oligomer
gcauaaccugucucaccugga

SEQ ID NO: 29512 - RNA, 21 nt, Artificial Sequence
  RNA Oligomer
ccugaggcaauuagacacuuu

SEQ ID NO: 29513 - RNA, 21 nt, Artificial Sequence
  RNA Oligomer
ccagaaaagcccaaguucaug

SEQ ID NO: 29514 - RNA, 21 nt, Artificial Sequence
  RNA Oligomer
accagaaaagcccaaguucau

SEQ ID NO: 29515 - RNA, 21 nt, Artificial Sequence
  RNA Oligomer
gcaguuuuuugaaaaugggcu

SEQ ID NO: 29516 - RNA, 21 nt, Artificial Sequence
  RNA Oligomer
ggcaguuuuuugaaaaugggc

SEQ ID NO: 29517 - RNA, 21 nt, Artificial Sequence
  RNA Oligomer
gugggcaguuuuuugaaaaug

SEQ ID NO: 29518 - RNA, 21 nt, Artificial Sequence
  RNA Oligomer
gcgguuaauuuugaagugcug

SEQ ID NO: 29519 - RNA, 21 nt, Artificial Sequence
  RNA Oligomer
acagcccuuaugcgguuaauu

SEQ ID NO: 29520 - RNA, 21 nt, Artificial Sequence
  RNA Oligomer
gaagaaaaaaucugggugccu

SEQ ID NO: 29521 - RNA, 21 nt, Artificial Sequence
  RNA Oligomer
gagagguuuuugaaauggcua

SEQ ID NO: 29522 - RNA, 21 nt, Artificial Sequence
  RNA Oligomer
agacacuuuggaagauggcau

SEQ ID NO: 29523 - RNA, 21 nt, Artificial Sequence
  RNA Oligomer
agaaaagcccaaguucaugca

SEQ ID NO: 29524 - RNA, 21 nt, Artificial Sequence
  RNA Oligomer
acagauuuuguuggcauagcu

SEQ ID NO: 29525 - RNA, 21 nt, Artificial Sequence
  RNA Oligomer
gccuauuaucugucagcugca

SEQ ID NO: 29526 - RNA, 21 nt, Artificial Sequence
  RNA Oligomer
ggaauuucuuaacuucuugcu

SEQ ID NO: 29527 - RNA, 21 nt, Artificial Sequence
  RNA Oligomer
caggcgcuaauucaaggaauu

SEQ ID NO: 29528 - RNA, 21 nt, Artificial Sequence
  RNA Oligomer
cacagcccuuaugcgguuaau

SEQ ID NO: 29529 - RNA, 21 nt, Artificial Sequence
  RNA Oligomer
gucuugugaaaccuugcugca

SEQ ID NO: 29530 - RNA, 21 nt, Artificial Sequence
  RNA Oligomer
cugggugccuugucuugugaa

SEQ ID NO: 29531 - RNA, 21 nt, Artificial Sequence
  RNA Oligomer
agaaaaaaucugggugccuug

SEQ ID NO: 29532 - RNA, 21 nt, Artificial Sequence
  RNA Oligomer
ggaagaaaaaaucugggugcc

SEQ ID NO: 29533 - RNA, 21 nt, Artificial Sequence
  RNA Oligomer
gcaagcuagacgugggaagaa

SEQ ID NO: 29534 - RNA, 21 nt, Artificial Sequence
  RNA Oligomer
agagagguuuuugaaauggcu

SEQ ID NO: 29535 - RNA, 21 nt, Artificial Sequence
  RNA Oligomer
cugguugggaauaagaaggau

SEQ ID NO: 29536 - RNA, 21 nt, Artificial Sequence
  RNA Oligomer
uggcacucagucucucuucuc

SEQ ID NO: 29537 - RNA, 21 nt, Artificial Sequence
  RNA Oligomer
caauuagacacuuuggaagau

SEQ ID NO: 29538 - RNA, 21 nt, Artificial Sequence
  RNA Oligomer
caguuuuuugaaaaugggcuc

SEQ ID NO: 29539 - RNA, 21 nt, Artificial Sequence
  RNA Oligomer
ugggcaguuuuuugaaaaugg

SEQ ID NO: 29540 - RNA, 21 nt, Artificial Sequence
  RNA Oligomer
cgguuaauuuugaagugcugu

SEQ ID NO: 29541 - RNA, 21 nt, Artificial Sequence
  RNA Oligomer
ugggugccuugucuugugaaa

SEQ ID NO: 29542 - RNA, 21 nt, Artificial Sequence
  RNA Oligomer
gggaagaaaaaaucugggugc

SEQ ID NO: 29543 - RNA, 21 nt, Artificial Sequence
  RNA Oligomer
aagcuagacgugggaagaaaa

SEQ ID NO: 29544 - RNA, 21 nt, Artificial Sequence
  RNA Oligomer
caagcuagacgugggaagaaa

SEQ ID NO: 29545 - RNA, 21 nt, Artificial Sequence
  RNA Oligomer
cggaaugaugagcacacaagg

SEQ ID NO: 29546 - RNA, 21 nt, Artificial Sequence
  RNA Oligomer
ggaucuucggaaugaugagca

SEQ ID NO: 29547 - RNA, 21 nt, Artificial Sequence
  RNA Oligomer
cuacuaauagaauaaaggcag

SEQ ID NO: 29548 - RNA, 21 nt, Artificial Sequence
  RNA Oligomer
aaaaucugggugccuugucuu

SEQ ID NO: 29549 - RNA, 21 nt, Artificial Sequence
  RNA Oligomer
ugggaagaaaaaaucugggug

SEQ ID NO: 29550 - RNA, 21 nt, Artificial Sequence
  RNA Oligomer
agacgugggaagaaaaaaucu

SEQ ID NO: 29551 - RNA, 21 nt, Artificial Sequence
  RNA Oligomer
cuagacgugggaagaaaaaau

SEQ ID NO: 29552 - RNA, 21 nt, Artificial Sequence
  RNA Oligomer
agcuagacgugggaagaaaaa

SEQ ID NO: 29553 - RNA, 21 nt, Artificial Sequence
  RNA Oligomer
gguuuuugaaauggcuacgag

SEQ ID NO: 29554 - RNA, 21 nt, Artificial Sequence
  RNA Oligomer
uucggaaugaugagcacacaa

SEQ ID NO: 29555 - RNA, 21 nt, Artificial Sequence
  RNA Oligomer
ccugguugggaauaagaagga

SEQ ID NO: 29556 - RNA, 21 nt, Artificial Sequence
  RNA Oligomer
ggcacucagucucucuucucu

SEQ ID NO: 29557 - RNA, 21 nt, Artificial Sequence
  RNA Oligomer
ugcucuuuucuccucacugua

SEQ ID NO: 29558 - RNA, 21 nt, Artificial Sequence
  RNA Oligomer
ggcaauuagacacuuuggaag

SEQ ID NO: 29559 - RNA, 21 nt, Artificial Sequence
  RNA Oligomer
uccuaauacugucauccucaa

SEQ ID NO: 29560 - RNA, 21 nt, Artificial Sequence
  RNA Oligomer
cuauuaucugucagcugcaag

SEQ ID NO: 29561 - RNA, 21 nt, Artificial Sequence
  RNA Oligomer
ugcgguuaauuuugaagugcu

SEQ ID NO: 29562 - RNA, 21 nt, Artificial Sequence
  RNA Oligomer
gugggaagaaaaaaucugggu

SEQ ID NO: 29563 - RNA, 21 nt, Artificial Sequence
  RNA Oligomer
gcuagacgugggaagaaaaaa

SEQ ID NO: 29564 - RNA, 21 nt, Artificial Sequence
  RNA Oligomer
agguuuuugaaauggcuacga

SEQ ID NO: 29565 - RNA, 21 nt, Artificial Sequence
  RNA Oligomer
cugaggcaauuagacacuuug

SEQ ID NO: 29566 - RNA, 21 nt, Artificial Sequence
  RNA Oligomer
cagauuuuguuggcauagcuc

SEQ ID NO: 29567 - RNA, 21 nt, Artificial Sequence
  RNA Oligomer
gguuaauuuugaagugcuguu

SEQ ID NO: 29568 - RNA, 21 nt, Artificial Sequence
  RNA Oligomer
gguugggaauaagaaggaucu

SEQ ID NO: 29569 - RNA, 21 nt, Artificial Sequence
  RNA Oligomer
ugguugggaauaagaaggauc

SEQ ID NO: 29570 - RNA, 21 nt, Artificial Sequence
  RNA Oligomer
gcucuuuucuccucacuguau

SEQ ID NO: 29571 - RNA, 21 nt, Artificial Sequence
  RNA Oligomer
cucaaagaaaguguauugguu

SEQ ID NO: 29572 - RNA, 21 nt, Artificial Sequence
  RNA Oligomer
cuuaacuucuugcuucuuucu

SEQ ID NO: 29573 - RNA, 21 nt, Artificial Sequence
  RNA Oligomer
ucuuaacuucuugcuucuuuc

SEQ ID NO: 29574 - RNA, 21 nt, Artificial Sequence
  RNA Oligomer
aaaucagaagucaucuugcua

SEQ ID NO: 29575 - RNA, 21 nt, Artificial Sequence
  RNA Oligomer
ugcaagcuagacgugggaaga

SEQ ID NO: 29576 - RNA, 21 nt, Artificial Sequence
  RNA Oligomer
caaagaccaaagauggaguga

SEQ ID NO: 29577 - RNA, 21 nt, Artificial Sequence
  RNA Oligomer
cugauaaaagauggccauauu

SEQ ID NO: 29578 - RNA, 21 nt, Artificial Sequence
  RNA Oligomer
accaggcgcuaauucaaggaa

SEQ ID NO: 29579 - RNA, 21 nt, Artificial Sequence
  RNA Oligomer
uaauacugucauccucaaaga

SEQ ID NO: 29580 - RNA, 21 nt, Artificial Sequence
  RNA Oligomer
caccaggcgcuaauucaagga

SEQ ID NO: 29581 - RNA, 21 nt, Artificial Sequence
  RNA Oligomer
cgacagcccugauaguuuaga

SEQ ID NO: 29582 - RNA, 21 nt, Artificial Sequence
  RNA Oligomer
ucgacagcccugauaguuuag

SEQ ID NO: 29583 - RNA, 21 nt, Artificial Sequence
  RNA Oligomer
gcugacuaaacuuuuuuucug

SEQ ID NO: 29584 - RNA, 21 nt, Artificial Sequence
  RNA Oligomer
gucgguucucucguuagucca

SEQ ID NO: 29585 - RNA, 21 nt, Artificial Sequence
  RNA Oligomer
guuucacgccugaggcaauua

SEQ ID NO: 29586 - RNA, 21 nt, Artificial Sequence
  RNA Oligomer
ccaguucccagagguguaugu

SEQ ID NO: 29587 - RNA, 21 nt, Artificial Sequence
  RNA Oligomer
caguauuuagaagccaacuau

SEQ ID NO: 29588 - RNA, 21 nt, Artificial Sequence
  RNA Oligomer
ccaucauccugguugggaaua

SEQ ID NO: 29589 - RNA, 21 nt, Artificial Sequence
  RNA Oligomer
cccaucauccugguugggaau

SEQ ID NO: 29590 - RNA, 21 nt, Artificial Sequence
  RNA Oligomer
ggacuuaagcaucuggcucua

SEQ ID NO: 29591 - RNA, 21 nt, Artificial Sequence
  RNA Oligomer
ugccuugucuugugaaaccuu

SEQ ID NO: 29592 - RNA, 21 nt, Artificial Sequence
  RNA Oligomer
agaccaaagauggagugagag

SEQ ID NO: 29593 - RNA, 21 nt, Artificial Sequence
  RNA Oligomer
ggcuuuacuccguaacagauu

SEQ ID NO: 29594 - RNA, 21 nt, Artificial Sequence
  RNA Oligomer
gccaacuaugauuauuaacga

SEQ ID NO: 29595 - RNA, 21 nt, Artificial Sequence
  RNA Oligomer
gcacagcccuuaugcgguuaa

SEQ ID NO: 29596 - RNA, 21 nt, Artificial Sequence
  RNA Oligomer
gcaaagaccaaagauggagug

SEQ ID NO: 29597 - RNA, 21 nt, Artificial Sequence
  RNA Oligomer
ggaauugguuucacgccugag

SEQ ID NO: 29598 - RNA, 21 nt, Artificial Sequence
  RNA Oligomer
gaaaaugggcucaaccagaaa

SEQ ID NO: 29599 - RNA, 21 nt, Artificial Sequence
  RNA Oligomer
guaacagauuuuguuggcaua

SEQ ID NO: 29600 - RNA, 21 nt, Artificial Sequence
  RNA Oligomer
cgcuaauucaaggaauuucuu

SEQ ID NO: 29601 - RNA, 21 nt, Artificial Sequence
  RNA Oligomer
ccagcugacuaaacuuuuuuu

SEQ ID NO: 29602 - RNA, 21 nt, Artificial Sequence
  RNA Oligomer
cguaacagauuuuguuggcau

SEQ ID NO: 29603 - RNA, 21 nt, Artificial Sequence
  RNA Oligomer
gguccuuuugacacugcucua

SEQ ID NO: 29604 - RNA, 21 nt, Artificial Sequence
  RNA Oligomer
gccuugucuugugaaaccuug

SEQ ID NO: 29605 - RNA, 21 nt, Artificial Sequence
  RNA Oligomer
ccaaagauggagugagagagg

SEQ ID NO: 29606 - RNA, 21 nt, Artificial Sequence
  RNA Oligomer
cuuaagcaucuggcucuaauu

SEQ ID NO: 29607 - RNA, 21 nt, Artificial Sequence
  RNA Oligomer
gacuuaagcaucuggcucuaa

SEQ ID NO: 29608 - RNA, 21 nt, Artificial Sequence
  RNA Oligomer
uucugauaaaagauggccaua

SEQ ID NO: 29609 - RNA, 21 nt, Artificial Sequence
  RNA Oligomer
cuuuacuccguaacagauuuu

SEQ ID NO: 29610 - RNA, 21 nt, Artificial Sequence
  RNA Oligomer
gcuuuacuccguaacagauuu

SEQ ID NO: 29611 - RNA, 21 nt, Artificial Sequence
  RNA Oligomer
cuaacauguccugccuauuau

SEQ ID NO: 29612 - RNA, 21 nt, Artificial Sequence
  RNA Oligomer
gcgcuaauucaaggaauuucu

SEQ ID NO: 29613 - RNA, 21 nt, Artificial Sequence
  RNA Oligomer
guauuuagaagccaacuauga

SEQ ID NO: 29614 - RNA, 21 nt, Artificial Sequence
  RNA Oligomer
gugccuugucuugugaaaccu

SEQ ID NO: 29615 - RNA, 21 nt, Artificial Sequence
  RNA Oligomer
ucauccugguugggaauaaga

SEQ ID NO: 29616 - RNA, 21 nt, Artificial Sequence
  RNA Oligomer
cucuaauucacagugcucuuu

SEQ ID NO: 29617 - RNA, 21 nt, Artificial Sequence
  RNA Oligomer
gcucuaauucacagugcucuu

SEQ ID NO: 29618 - RNA, 21 nt, Artificial Sequence
  RNA Oligomer
ccguaacagauuuuguuggca

SEQ ID NO: 29619 - RNA, 21 nt, Artificial Sequence
  RNA Oligomer
ggguccuuuugacacugcucu

SEQ ID NO: 29620 - RNA, 21 nt, Artificial Sequence
  RNA Oligomer
gcccuuaugcgguuaauuuug

SEQ ID NO: 29621 - RNA, 21 nt, Artificial Sequence
  RNA Oligomer
agcccuuaugcgguuaauuuu

SEQ ID NO: 29622 - RNA, 21 nt, Artificial Sequence
  RNA Oligomer
cagcccuuaugcgguuaauuu

SEQ ID NO: 29623 - RNA, 21 nt, Artificial Sequence
  RNA Oligomer
ccguuuugucacuuuuucuga

SEQ ID NO: 29624 - RNA, 21 nt, Artificial Sequence
  RNA Oligomer
ucccguuuugucacuuuuucu

SEQ ID NO: 29625 - RNA, 21 nt, Artificial Sequence
  RNA Oligomer
ccuuaugcgguuaauuuugaa

SEQ ID NO: 29626 - RNA, 21 nt, Artificial Sequence
  RNA Oligomer
agcaaagaccaaagauggagu

SEQ ID NO: 29627 - RNA, 21 nt, Artificial Sequence
  RNA Oligomer
cucucuucucuccagcugacu

SEQ ID NO: 29628 - RNA, 21 nt, Artificial Sequence
  RNA Oligomer
gucucucuucucuccagcuga

SEQ ID NO: 29629 - RNA, 21 nt, Artificial Sequence
  RNA Oligomer
cagucucucuucucuccagcu

SEQ ID NO: 29630 - RNA, 21 nt, Artificial Sequence
  RNA Oligomer
ucuaauucacagugcucuuuu

SEQ ID NO: 29631 - RNA, 21 nt, Artificial Sequence
  RNA Oligomer
ugaaaaugggcucaaccagaa

SEQ ID NO: 29632 - RNA, 21 nt, Artificial Sequence
  RNA Oligomer
guccuuuugacacugcucuaa

SEQ ID NO: 29633 - RNA, 21 nt, Artificial Sequence
  RNA Oligomer
ugcugcaagcacagcccuuau

SEQ ID NO: 29634 - RNA, 21 nt, Artificial Sequence
  RNA Oligomer
ucggauucguugccugagcaa

SEQ ID NO: 29635 - RNA, 21 nt, Artificial Sequence
  RNA Oligomer
cagugcucuuuucuccucacu

SEQ ID NO: 29636 - RNA, 21 nt, Artificial Sequence
  RNA Oligomer
acagugcucuuuucuccucac

SEQ ID NO: 29637 - RNA, 21 nt, Artificial Sequence
  RNA Oligomer
ucaccuggacuuaagcaucug

SEQ ID NO: 29638 - RNA, 21 nt, Artificial Sequence
  RNA Oligomer
aaauucccguuuugucacuuu

SEQ ID NO: 29639 - RNA, 21 nt, Artificial Sequence
  RNA Oligomer
gggcuuuacuccguaacagau

SEQ ID NO: 29640 - RNA, 21 nt, Artificial Sequence
  RNA Oligomer
cugccuauuaucugucagcug

SEQ ID NO: 29641 - RNA, 21 nt, Artificial Sequence
  RNA Oligomer
agcacagcccuuaugcgguua

SEQ ID NO: 29642 - RNA, 21 nt, Artificial Sequence
  RNA Oligomer
gggugccuugucuugugaaac

SEQ ID NO: 29643 - RNA, 21 nt, Artificial Sequence
  RNA Oligomer
gaauaagaaggaucuucggaa

SEQ ID NO: 29644 - RNA, 21 nt, Artificial Sequence
  RNA Oligomer
ggaauaagaaggaucuucgga

SEQ ID NO: 29645 - RNA, 21 nt, Artificial Sequence
  RNA Oligomer
gguuucacgccugaggcaauu

SEQ ID NO: 29646 - RNA, 21 nt, Artificial Sequence
  RNA Oligomer
ugguuucacgccugaggcaau

SEQ ID NO: 29647 - RNA, 21 nt, Artificial Sequence
  RNA Oligomer
cccguuuugucacuuuuucug

SEQ ID NO: 29648 - RNA, 21 nt, Artificial Sequence
  RNA Oligomer
uaaauucccguuuugucacuu

SEQ ID NO: 29649 - RNA, 21 nt, Artificial Sequence
  RNA Oligomer
cuucagggcuuuacuccguaa

SEQ ID NO: 29650 - RNA, 21 nt, Artificial Sequence
  RNA Oligomer
aggguccuuuugacacugcuc

SEQ ID NO: 29651 - RNA, 21 nt, Artificial Sequence
  RNA Oligomer
caggguccuuuugacacugcu

SEQ ID NO: 29652 - RNA, 21 nt, Artificial Sequence
  RNA Oligomer
gaaaccuugcugcaagcacag

SEQ ID NO: 29653 - RNA, 21 nt, Artificial Sequence
  RNA Oligomer
aagaaggaucuucggaaugau

SEQ ID NO: 29654 - RNA, 21 nt, Artificial Sequence
  RNA Oligomer
gggaauaagaaggaucuucgg

SEQ ID NO: 29655 - RNA, 21 nt, Artificial Sequence
  RNA Oligomer
caagcauuucugucccaacgu

SEQ ID NO: 29656 - RNA, 21 nt, Artificial Sequence
  RNA Oligomer
cauccggaagaaacuggugau

SEQ ID NO: 29657 - RNA, 21 nt, Artificial Sequence
  RNA Oligomer
guguaugugcccacaguguuu

SEQ ID NO: 29658 - RNA, 21 nt, Artificial Sequence
  RNA Oligomer
aggaauugguuucacgccuga

SEQ ID NO: 29659 - RNA, 21 nt, Artificial Sequence
  RNA Oligomer
uggauuuccuaauacugucau

SEQ ID NO: 29660 - RNA, 21 nt, Artificial Sequence
  RNA Oligomer
guuuuuugaaaaugggcucaa

SEQ ID NO: 29661 - RNA, 21 nt, Artificial Sequence
  RNA Oligomer
acuucagggcuuuacuccgua

SEQ ID NO: 29662 - RNA, 21 nt, Artificial Sequence
  RNA Oligomer
ggcgcuaauucaaggaauuuc

SEQ ID NO: 29663 - RNA, 21 nt, Artificial Sequence
  RNA Oligomer
cccuuaugcgguuaauuuuga

SEQ ID NO: 29664 - RNA, 21 nt, Artificial Sequence
  RNA Oligomer
uggcucuaauucacagugcuc

SEQ ID NO: 29665 - RNA, 21 nt, Artificial Sequence
  RNA Oligomer
gccugaggcaauuagacacuu

SEQ ID NO: 29666 - RNA, 21 nt, Artificial Sequence
  RNA Oligomer
agggcuuuacuccguaacaga

SEQ ID NO: 29667 - RNA, 21 nt, Artificial Sequence
  RNA Oligomer
aggcgcuaauucaaggaauuu

SEQ ID NO: 29668 - RNA, 21 nt, Artificial Sequence
  RNA Oligomer
ucagaagucaucuugcuacca

SEQ ID NO: 29669 - RNA, 21 nt, Artificial Sequence
  RNA Oligomer
uccagcugacuaaacuuuuuu

SEQ ID NO: 29670 - RNA, 21 nt, Artificial Sequence
  RNA Oligomer
ucuccagcugacuaaacuuuu

SEQ ID NO: 29671 - RNA, 21 nt, Artificial Sequence
  RNA Oligomer
ccugucucaccuggacuuaag

SEQ ID NO: 29672 - RNA, 21 nt, Artificial Sequence
  RNA Oligomer
aaccugucucaccuggacuua

SEQ ID NO: 29673 - RNA, 21 nt, Artificial Sequence
  RNA Oligomer
gucauccucaaagaaagugua

SEQ ID NO: 29674 - RNA, 21 nt, Artificial Sequence
  RNA Oligomer
ucaaccagaaaagcccaaguu

SEQ ID NO: 29675 - RNA, 21 nt, Artificial Sequence
  RNA Oligomer
guccugccuauuaucugucag

SEQ ID NO: 29676 - RNA, 21 nt, Artificial Sequence
  RNA Oligomer
ggcucuaauucacagugcucu

SEQ ID NO: 29677 - RNA, 21 nt, Artificial Sequence
  RNA Oligomer
gcaucuggcucuaauucacag

SEQ ID NO: 29678 - RNA, 21 nt, Artificial Sequence
  RNA Oligomer
guaugugcccacaguguuuga

SEQ ID NO: 29679 - RNA, 21 nt, Artificial Sequence
  RNA Oligomer
gaagauggcauaaccugucuc

SEQ ID NO: 29680 - RNA, 21 nt, Artificial Sequence
  RNA Oligomer
cgccugaggcaauuagacacu

SEQ ID NO: 29681 - RNA, 21 nt, Artificial Sequence
  RNA Oligomer
ucagggcuuuacuccguaaca

SEQ ID NO: 29682 - RNA, 21 nt, Artificial Sequence
  RNA Oligomer
ccugccuauuaucugucagcu

SEQ ID NO: 29683 - RNA, 21 nt, Artificial Sequence
  RNA Oligomer
uaacauguccugccuauuauc

SEQ ID NO: 29684 - RNA, 21 nt, Artificial Sequence
  RNA Oligomer
ggagcuagccaagaugaagca

SEQ ID NO: 29685 - RNA, 21 nt, Artificial Sequence
  RNA Oligomer
gucaagcauuucugucccaac

SEQ ID NO: 29686 - RNA, 21 nt, Artificial Sequence
  RNA Oligomer
agucaagcauuucugucccaa

SEQ ID NO: 29687 - RNA, 21 nt, Artificial Sequence
  RNA Oligomer
uggcauaaccugucucaccug

SEQ ID NO: 29688 - RNA, 21 nt, Artificial Sequence
  RNA Oligomer
cguuuugucacuuuuucugau

SEQ ID NO: 29689 - RNA, 21 nt, Artificial Sequence
  RNA Oligomer
ucauccucaaagaaaguguau

SEQ ID NO: 29690 - RNA, 21 nt, Artificial Sequence
  RNA Oligomer
cucuggugagucaccacuuca

SEQ ID NO: 29691 - RNA, 21 nt, Artificial Sequence
  RNA Oligomer
acuucuugcuucuuucuagaa

SEQ ID NO: 29692 - RNA, 21 nt, Artificial Sequence
  RNA Oligomer
ccaucgacagcccugauaguu

SEQ ID NO: 29693 - RNA, 21 nt, Artificial Sequence
  RNA Oligomer
ugauguguuuuuccaucgaca

SEQ ID NO: 29694 - RNA, 21 nt, Artificial Sequence
  RNA Oligomer
ccuggacuuaagcaucuggcu

SEQ ID NO: 29695 - RNA, 21 nt, Artificial Sequence
  RNA Oligomer
gguguaugugcccacaguguu

SEQ ID NO: 29696 - RNA, 21 nt, Artificial Sequence
  RNA Oligomer
ccucaaagaaaguguauuggu

SEQ ID NO: 29697 - RNA, 21 nt, Artificial Sequence
  RNA Oligomer
ucuugcuucuuucuagaaaga

SEQ ID NO: 29698 - RNA, 21 nt, Artificial Sequence
  RNA Oligomer
agaaggaucuucggaaugaug

SEQ ID NO: 29699 - RNA, 21 nt, Artificial Sequence
  RNA Oligomer
guugggaauaagaaggaucuu

SEQ ID NO: 29700 - RNA, 21 nt, Artificial Sequence
  RNA Oligomer
uccggaagaaacuggugauug

SEQ ID NO: 29701 - RNA, 21 nt, Artificial Sequence
  RNA Oligomer
cagcugacuaaacuuuuuuuc

SEQ ID NO: 29702 - RNA, 21 nt, Artificial Sequence
  RNA Oligomer
cuccagcugacuaaacuuuuu

SEQ ID NO: 29703 - RNA, 21 nt, Artificial Sequence
  RNA Oligomer
acacaccaggcgcuaauucaa

SEQ ID NO: 29704 - RNA, 21 nt, Artificial Sequence
  RNA Oligomer
cucuucucuccagcugacuaa

SEQ ID NO: 29705 - RNA, 21 nt, Artificial Sequence
  RNA Oligomer
acugucauccucaaagaaagu

SEQ ID NO: 29706 - RNA, 21 nt, Artificial Sequence
  RNA Oligomer
ucuucucuccagcugacuaaa

SEQ ID NO: 29707 - RNA, 21 nt, Artificial Sequence
  RNA Oligomer
gaccaguucccagagguguau

SEQ ID NO: 29708 - RNA, 21 nt, Artificial Sequence
  RNA Oligomer
caaccagaaaagcccaaguuc

SEQ ID NO: 29709 - RNA, 21 nt, Artificial Sequence
  RNA Oligomer
gcuagccaagaugaagcagga

SEQ ID NO: 29710 - RNA, 21 nt, Artificial Sequence
  RNA Oligomer
cuagccaagaugaagcaggag

SEQ ID NO: 29711 - RNA, 21 nt, Artificial Sequence
  RNA Oligomer
cucaaccagaaaagcccaagu

SEQ ID NO: 29712 - RNA, 21 nt, Artificial Sequence
  RNA Oligomer
ggcucaaccagaaaagcccaa

SEQ ID NO: 29713 - RNA, 21 nt, Artificial Sequence
  RNA Oligomer
gcucaaccagaaaagcccaag

SEQ ID NO: 29714 - RNA, 21 nt, Artificial Sequence
  RNA Oligomer
uagauaaaugaaaaaggccag

SEQ ID NO: 29715 - RNA, 21 nt, Artificial Sequence
  RNA Oligomer
aaaaccucucucacuccaucu

SEQ ID NO: 29716 - RNA, 21 nt, Artificial Sequence
  RNA Oligomer
aaccucucucacuccaucuuu

SEQ ID NO: 29717 - RNA, 21 nt, Artificial Sequence
  RNA Oligomer
uuuucaaaaaacugcccaccc

SEQ ID NO: 29718 - RNA, 21 nt, Artificial Sequence
  RNA Oligomer
auuuucaaaaaacugcccacc

SEQ ID NO: 29719 - RNA, 21 nt, Artificial Sequence
  RNA Oligomer
guuagagcagugucaaaagga

SEQ ID NO: 29720 - RNA, 21 nt, Artificial Sequence
  RNA Oligomer
ucuuccaaagugucuaauugc

SEQ ID NO: 29721 - RNA, 21 nt, Artificial Sequence
  RNA Oligomer
uuaugccaucuuccaaagugu

SEQ ID NO: 29722 - RNA, 21 nt, Artificial Sequence
  RNA Oligomer
uaugccaucuuccaaaguguc

SEQ ID NO: 29723 - RNA, 21 nt, Artificial Sequence
  RNA Oligomer
gaugacaguauuaggaaaucc

SEQ ID NO: 29724 - RNA, 21 nt, Artificial Sequence
  RNA Oligomer
cccauuuucaaaaaacugccc

SEQ ID NO: 29725 - RNA, 21 nt, Artificial Sequence
  RNA Oligomer
uguuagagcagugucaaaagg

SEQ ID NO: 29726 - RNA, 21 nt, Artificial Sequence
  RNA Oligomer
agauaaaugaaaaaggccagu

SEQ ID NO: 29727 - RNA, 21 nt, Artificial Sequence
  RNA Oligomer
aaugaaaaaggccaguaauca

SEQ ID NO: 29728 - RNA, 21 nt, Artificial Sequence
  RNA Oligomer
cauuucaaaaaccucucucac

SEQ ID NO: 29729 - RNA, 21 nt, Artificial Sequence
  RNA Oligomer
ugaggagaaaagagcacugug

SEQ ID NO: 29730 - RNA, 21 nt, Artificial Sequence
  RNA Oligomer
agaaaagagcacugugaauua

SEQ ID NO: 29731 - RNA, 21 nt, Artificial Sequence
  RNA Oligomer
uuccaaagugucuaauugccu

SEQ ID NO: 29732 - RNA, 21 nt, Artificial Sequence
  RNA Oligomer
uuugaggaugacaguauuagg

SEQ ID NO: 29733 - RNA, 21 nt, Artificial Sequence
  RNA Oligomer
auuccuugaauuagcgccugg

SEQ ID NO: 29734 - RNA, 21 nt, Artificial Sequence
  RNA Oligomer
gagagaagagagacugagugc

SEQ ID NO: 29735 - RNA, 21 nt, Artificial Sequence
  RNA Oligomer
gaaaagagcacugugaauuag

SEQ ID NO: 29736 - RNA, 21 nt, Artificial Sequence
  RNA Oligomer
uccaggugagacagguuaugc

SEQ ID NO: 29737 - RNA, 21 nt, Artificial Sequence
  RNA Oligomer
aaagugucuaauugccucagg

SEQ ID NO: 29738 - RNA, 21 nt, Artificial Sequence
  RNA Oligomer
caugaacuugggcuuuucugg

SEQ ID NO: 29739 - RNA, 21 nt, Artificial Sequence
  RNA Oligomer
augaacuugggcuuuucuggu

SEQ ID NO: 29740 - RNA, 21 nt, Artificial Sequence
  RNA Oligomer
agcccauuuucaaaaaacugc

SEQ ID NO: 29741 - RNA, 21 nt, Artificial Sequence
  RNA Oligomer
gcccauuuucaaaaaacugcc

SEQ ID NO: 29742 - RNA, 21 nt, Artificial Sequence
  RNA Oligomer
cauuuucaaaaaacugcccac

SEQ ID NO: 29743 - RNA, 21 nt, Artificial Sequence
  RNA Oligomer
cagcacuucaaaauuaaccgc

SEQ ID NO: 29744 - RNA, 21 nt, Artificial Sequence
  RNA Oligomer
aauuaaccgcauaagggcugu

SEQ ID NO: 29745 - RNA, 21 nt, Artificial Sequence
  RNA Oligomer
aggcacccagauuuuuucuuc

SEQ ID NO: 29746 - RNA, 21 nt, Artificial Sequence
  RNA Oligomer
uagccauuucaaaaaccucuc

SEQ ID NO: 29747 - RNA, 21 nt, Artificial Sequence
  RNA Oligomer
augccaucuuccaaagugucu

SEQ ID NO: 29748 - RNA, 21 nt, Artificial Sequence
  RNA Oligomer
ugcaugaacuugggcuuuucu

SEQ ID NO: 29749 - RNA, 21 nt, Artificial Sequence
  RNA Oligomer
agcuaugccaacaaaaucugu

SEQ ID NO: 29750 - RNA, 21 nt, Artificial Sequence
  RNA Oligomer
ugcagcugacagauaauaggc

SEQ ID NO: 29751 - RNA, 21 nt, Artificial Sequence
  RNA Oligomer
agcaagaaguuaagaaauucc

SEQ ID NO: 29752 - RNA, 21 nt, Artificial Sequence
  RNA Oligomer
aauuccuugaauuagcgccug

SEQ ID NO: 29753 - RNA, 21 nt, Artificial Sequence
  RNA Oligomer
auuaaccgcauaagggcugug

SEQ ID NO: 29754 - RNA, 21 nt, Artificial Sequence
  RNA Oligomer
ugcagcaagguuucacaagac

SEQ ID NO: 29755 - RNA, 21 nt, Artificial Sequence
  RNA Oligomer
uucacaagacaaggcacccag

SEQ ID NO: 29756 - RNA, 21 nt, Artificial Sequence
  RNA Oligomer
caaggcacccagauuuuuucu

SEQ ID NO: 29757 - RNA, 21 nt, Artificial Sequence
  RNA Oligomer
ggcacccagauuuuuucuucc

SEQ ID NO: 29758 - RNA, 21 nt, Artificial Sequence
  RNA Oligomer
uucuucccacgucuagcuugc

SEQ ID NO: 29759 - RNA, 21 nt, Artificial Sequence
  RNA Oligomer
agccauuucaaaaaccucucu

SEQ ID NO: 29760 - RNA, 21 nt, Artificial Sequence
  RNA Oligomer
auccuucuuauucccaaccag

SEQ ID NO: 29761 - RNA, 21 nt, Artificial Sequence
  RNA Oligomer
gagaagagagacugagugcca

SEQ ID NO: 29762 - RNA, 21 nt, Artificial Sequence
  RNA Oligomer
aucuuccaaagugucuaauug

SEQ ID NO: 29763 - RNA, 21 nt, Artificial Sequence
  RNA Oligomer
gagcccauuuucaaaaaacug

SEQ ID NO: 29764 - RNA, 21 nt, Artificial Sequence
  RNA Oligomer
ccauuuucaaaaaacugccca

SEQ ID NO: 29765 - RNA, 21 nt, Artificial Sequence
  RNA Oligomer
acagcacuucaaaauuaaccg

SEQ ID NO: 29766 - RNA, 21 nt, Artificial Sequence
  RNA Oligomer
uuucacaagacaaggcaccca

SEQ ID NO: 29767 - RNA, 21 nt, Artificial Sequence
  RNA Oligomer
gcacccagauuuuuucuuccc

SEQ ID NO: 29768 - RNA, 21 nt, Artificial Sequence
  RNA Oligomer
uuuucuucccacgucuagcuu

SEQ ID NO: 29769 - RNA, 21 nt, Artificial Sequence
  RNA Oligomer
uuucuucccacgucuagcuug

SEQ ID NO: 29770 - RNA, 21 nt, Artificial Sequence
  RNA Oligomer
ccuugugugcucaucauuccg

SEQ ID NO: 29771 - RNA, 21 nt, Artificial Sequence
  RNA Oligomer
ugcucaucauuccgaagaucc

SEQ ID NO: 29772 - RNA, 21 nt, Artificial Sequence
  RNA Oligomer
cugccuuuauucuauuaguag

SEQ ID NO: 29773 - RNA, 21 nt, Artificial Sequence
  RNA Oligomer
aagacaaggcacccagauuuu

SEQ ID NO: 29774 - RNA, 21 nt, Artificial Sequence
  RNA Oligomer
cacccagauuuuuucuuccca

SEQ ID NO: 29775 - RNA, 21 nt, Artificial Sequence
  RNA Oligomer
agauuuuuucuucccacgucu

SEQ ID NO: 29776 - RNA, 21 nt, Artificial Sequence
  RNA Oligomer
auuuuuucuucccacgucuag

SEQ ID NO: 29777 - RNA, 21 nt, Artificial Sequence
  RNA Oligomer
uuuuucuucccacgucuagcu

SEQ ID NO: 29778 - RNA, 21 nt, Artificial Sequence
  RNA Oligomer
cucguagccauuucaaaaacc

SEQ ID NO: 29779 - RNA, 21 nt, Artificial Sequence
  RNA Oligomer
uugugugcucaucauuccgaa

SEQ ID NO: 29780 - RNA, 21 nt, Artificial Sequence
  RNA Oligomer
uccuucuuauucccaaccagg

SEQ ID NO: 29781 - RNA, 21 nt, Artificial Sequence
  RNA Oligomer
agagaagagagacugagugcc

SEQ ID NO: 29782 - RNA, 21 nt, Artificial Sequence
  RNA Oligomer
uacagugaggagaaaagagca

SEQ ID NO: 29783 - RNA, 21 nt, Artificial Sequence
  RNA Oligomer
cuuccaaagugucuaauugcc

SEQ ID NO: 29784 - RNA, 21 nt, Artificial Sequence
  RNA Oligomer
uugaggaugacaguauuagga

SEQ ID NO: 29785 - RNA, 21 nt, Artificial Sequence
  RNA Oligomer
cuugcagcugacagauaauag

SEQ ID NO: 29786 - RNA, 21 nt, Artificial Sequence
  RNA Oligomer
agcacuucaaaauuaaccgca

SEQ ID NO: 29787 - RNA, 21 nt, Artificial Sequence
  RNA Oligomer
acccagauuuuuucuucccac

SEQ ID NO: 29788 - RNA, 21 nt, Artificial Sequence
  RNA Oligomer
uuuuuucuucccacgucuagc

SEQ ID NO: 29789 - RNA, 21 nt, Artificial Sequence
  RNA Oligomer
ucguagccauuucaaaaaccu

SEQ ID NO: 29790 - RNA, 21 nt, Artificial Sequence
  RNA Oligomer
caaagugucuaauugccucag

SEQ ID NO: 29791 - RNA, 21 nt, Artificial Sequence
  RNA Oligomer
gagcuaugccaacaaaaucug

SEQ ID NO: 29792 - RNA, 21 nt, Artificial Sequence
  RNA Oligomer
aacagcacuucaaaauuaacc

SEQ ID NO: 29793 - RNA, 21 nt, Artificial Sequence
  RNA Oligomer
agauccuucuuauucccaacc

SEQ ID NO: 29794 - RNA, 21 nt, Artificial Sequence
  RNA Oligomer
gauccuucuuauucccaacca

SEQ ID NO: 29795 - RNA, 21 nt, Artificial Sequence
  RNA Oligomer
auacagugaggagaaaagagc

SEQ ID NO: 29796 - RNA, 21 nt, Artificial Sequence
  RNA Oligomer
aaccaauacacuuucuuugag

SEQ ID NO: 29797 - RNA, 21 nt, Artificial Sequence
  RNA Oligomer
agaaagaagcaagaaguuaag

SEQ ID NO: 29798 - RNA, 21 nt, Artificial Sequence
  RNA Oligomer
gaaagaagcaagaaguuaaga

SEQ ID NO: 29799 - RNA, 21 nt, Artificial Sequence
  RNA Oligomer
uagcaagaugacuucugauuu

SEQ ID NO: 29800 - RNA, 21 nt, Artificial Sequence
  RNA Oligomer
ucuucccacgucuagcuugca

SEQ ID NO: 29801 - RNA, 21 nt, Artificial Sequence
  RNA Oligomer
ucacuccaucuuuggucuuug

SEQ ID NO: 29802 - RNA, 21 nt, Artificial Sequence
  RNA Oligomer
aauauggccaucuuuuaucag

SEQ ID NO: 29803 - RNA, 21 nt, Artificial Sequence
  RNA Oligomer
uuccuugaauuagcgccuggu

SEQ ID NO: 29804 - RNA, 21 nt, Artificial Sequence
  RNA Oligomer
ucuuugaggaugacaguauua

SEQ ID NO: 29805 - RNA, 21 nt, Artificial Sequence
  RNA Oligomer
uccuugaauuagcgccuggug

SEQ ID NO: 29806 - RNA, 21 nt, Artificial Sequence
  RNA Oligomer
ucuaaacuaucagggcugucg

SEQ ID NO: 29807 - RNA, 21 nt, Artificial Sequence
  RNA Oligomer
cuaaacuaucagggcugucga

SEQ ID NO: 29808 - RNA, 21 nt, Artificial Sequence
  RNA Oligomer
cagaaaaaaaguuuagucagc

SEQ ID NO: 29809 - RNA, 21 nt, Artificial Sequence
  RNA Oligomer
uggacuaacgagagaaccgac

SEQ ID NO: 29810 - RNA, 21 nt, Artificial Sequence
  RNA Oligomer
uaauugccucaggcgugaaac

SEQ ID NO: 29811 - RNA, 21 nt, Artificial Sequence
  RNA Oligomer
acauacaccucugggaacugg

SEQ ID NO: 29812 - RNA, 21 nt, Artificial Sequence
  RNA Oligomer
auaguuggcuucuaaauacug

SEQ ID NO: 29813 - RNA, 21 nt, Artificial Sequence
  RNA Oligomer
uauucccaaccaggaugaugg

SEQ ID NO: 29814 - RNA, 21 nt, Artificial Sequence
  RNA Oligomer
auucccaaccaggaugauggg

SEQ ID NO: 29815 - RNA, 21 nt, Artificial Sequence
  RNA Oligomer
uagagccagaugcuuaagucc

SEQ ID NO: 29816 - RNA, 21 nt, Artificial Sequence
  RNA Oligomer
aagguuucacaagacaaggca

SEQ ID NO: 29817 - RNA, 21 nt, Artificial Sequence
  RNA Oligomer
cucucacuccaucuuuggucu

SEQ ID NO: 29818 - RNA, 21 nt, Artificial Sequence
  RNA Oligomer
aaucuguuacggaguaaagcc

SEQ ID NO: 29819 - RNA, 21 nt, Artificial Sequence
  RNA Oligomer
ucguuaauaaucauaguuggc

SEQ ID NO: 29820 - RNA, 21 nt, Artificial Sequence
  RNA Oligomer
uuaaccgcauaagggcugugc

SEQ ID NO: 29821 - RNA, 21 nt, Artificial Sequence
  RNA Oligomer
cacuccaucuuuggucuuugc

SEQ ID NO: 29822 - RNA, 21 nt, Artificial Sequence
  RNA Oligomer
cucaggcgugaaaccaauucc

SEQ ID NO: 29823 - RNA, 21 nt, Artificial Sequence
  RNA Oligomer
uuucugguugagcccauuuuc

SEQ ID NO: 29824 - RNA, 21 nt, Artificial Sequence
  RNA Oligomer
uaugccaacaaaaucuguuac

SEQ ID NO: 29825 - RNA, 21 nt, Artificial Sequence
  RNA Oligomer
aagaaauuccuugaauuagcg

SEQ ID NO: 29826 - RNA, 21 nt, Artificial Sequence
  RNA Oligomer
aaaaaaaguuuagucagcugg

SEQ ID NO: 29827 - RNA, 21 nt, Artificial Sequence
  RNA Oligomer
augccaacaaaaucuguuacg

SEQ ID NO: 29828 - RNA, 21 nt, Artificial Sequence
  RNA Oligomer
uagagcagugucaaaaggacc

SEQ ID NO: 29829 - RNA, 21 nt, Artificial Sequence
  RNA Oligomer
caagguuucacaagacaaggc

SEQ ID NO: 29830 - RNA, 21 nt, Artificial Sequence
  RNA Oligomer
ccucucucacuccaucuuugg

SEQ ID NO: 29831 - RNA, 21 nt, Artificial Sequence
  RNA Oligomer
aauuagagccagaugcuuaag

SEQ ID NO: 29832 - RNA, 21 nt, Artificial Sequence
  RNA Oligomer
uuagagccagaugcuuaaguc

SEQ ID NO: 29833 - RNA, 21 nt, Artificial Sequence
  RNA Oligomer
uauggccaucuuuuaucagaa

SEQ ID NO: 29834 - RNA, 21 nt, Artificial Sequence
  RNA Oligomer
aaaaucuguuacggaguaaag

SEQ ID NO: 29835 - RNA, 21 nt, Artificial Sequence
  RNA Oligomer
aaaucuguuacggaguaaagc

SEQ ID NO: 29836 - RNA, 21 nt, Artificial Sequence
  RNA Oligomer
auaauaggcaggacauguuag

SEQ ID NO: 29837 - RNA, 21 nt, Artificial Sequence
  RNA Oligomer
agaaauuccuugaauuagcgc

SEQ ID NO: 29838 - RNA, 21 nt, Artificial Sequence
  RNA Oligomer
ucauaguuggcuucuaaauac

SEQ ID NO: 29839 - RNA, 21 nt, Artificial Sequence
  RNA Oligomer
agguuucacaagacaaggcac

SEQ ID NO: 29840 - RNA, 21 nt, Artificial Sequence
  RNA Oligomer
ucuuauucccaaccaggauga

SEQ ID NO: 29841 - RNA, 21 nt, Artificial Sequence
  RNA Oligomer
aaagagcacugugaauuagag

SEQ ID NO: 29842 - RNA, 21 nt, Artificial Sequence
  RNA Oligomer
aagagcacugugaauuagagc

SEQ ID NO: 29843 - RNA, 21 nt, Artificial Sequence
  RNA Oligomer
ugccaacaaaaucuguuacgg

SEQ ID NO: 29844 - RNA, 21 nt, Artificial Sequence
  RNA Oligomer
agagcagugucaaaaggaccc

SEQ ID NO: 29845 - RNA, 21 nt, Artificial Sequence
  RNA Oligomer
caaaauuaaccgcauaagggc

SEQ ID NO: 29846 - RNA, 21 nt, Artificial Sequence
  RNA Oligomer
aaaauuaaccgcauaagggcu

SEQ ID NO: 29847 - RNA, 21 nt, Artificial Sequence
  RNA Oligomer
aaauuaaccgcauaagggcug

SEQ ID NO: 29848 - RNA, 21 nt, Artificial Sequence
  RNA Oligomer
ucagaaaaagugacaaaacgg

SEQ ID NO: 29849 - RNA, 21 nt, Artificial Sequence
  RNA Oligomer
agaaaaagugacaaaacggga

SEQ ID NO: 29850 - RNA, 21 nt, Artificial Sequence
  RNA Oligomer
uucaaaauuaaccgcauaagg

SEQ ID NO: 29851 - RNA, 21 nt, Artificial Sequence
  RNA Oligomer
acuccaucuuuggucuuugcu

SEQ ID NO: 29852 - RNA, 21 nt, Artificial Sequence
  RNA Oligomer
agucagcuggagagaagagag

SEQ ID NO: 29853 - RNA, 21 nt, Artificial Sequence
  RNA Oligomer
ucagcuggagagaagagagac

SEQ ID NO: 29854 - RNA, 21 nt, Artificial Sequence
  RNA Oligomer
agcuggagagaagagagacug

SEQ ID NO: 29855 - RNA, 21 nt, Artificial Sequence
  RNA Oligomer
aaaagagcacugugaauuaga

SEQ ID NO: 29856 - RNA, 21 nt, Artificial Sequence
  RNA Oligomer
uucugguugagcccauuuuca

SEQ ID NO: 29857 - RNA, 21 nt, Artificial Sequence
  RNA Oligomer
uuagagcagugucaaaaggac

SEQ ID NO: 29858 - RNA, 21 nt, Artificial Sequence
  RNA Oligomer
auaagggcugugcuugcagca

SEQ ID NO: 29859 - RNA, 21 nt, Artificial Sequence
  RNA Oligomer
uugcucaggcaacgaauccga

SEQ ID NO: 29860 - RNA, 21 nt, Artificial Sequence
  RNA Oligomer
agugaggagaaaagagcacug

SEQ ID NO: 29861 - RNA, 21 nt, Artificial Sequence
  RNA Oligomer
gugaggagaaaagagcacugu

SEQ ID NO: 29862 - RNA, 21 nt, Artificial Sequence
  RNA Oligomer
cagaugcuuaaguccagguga

SEQ ID NO: 29863 - RNA, 21 nt, Artificial Sequence
  RNA Oligomer
aaagugacaaaacgggaauuu

SEQ ID NO: 29864 - RNA, 21 nt, Artificial Sequence
  RNA Oligomer
aucuguuacggaguaaagccc

SEQ ID NO: 29865 - RNA, 21 nt, Artificial Sequence
  RNA Oligomer
cagcugacagauaauaggcag

SEQ ID NO: 29866 - RNA, 21 nt, Artificial Sequence
  RNA Oligomer
uaaccgcauaagggcugugcu

SEQ ID NO: 29867 - RNA, 21 nt, Artificial Sequence
  RNA Oligomer
guuucacaagacaaggcaccc

SEQ ID NO: 29868 - RNA, 21 nt, Artificial Sequence
  RNA Oligomer
uuccgaagauccuucuuauuc

SEQ ID NO: 29869 - RNA, 21 nt, Artificial Sequence
  RNA Oligomer
uccgaagauccuucuuauucc

SEQ ID NO: 29870 - RNA, 21 nt, Artificial Sequence
  RNA Oligomer
aauugccucaggcgugaaacc

SEQ ID NO: 29871 - RNA, 21 nt, Artificial Sequence
  RNA Oligomer
auugccucaggcgugaaacca

SEQ ID NO: 29872 - RNA, 21 nt, Artificial Sequence
  RNA Oligomer
cagaaaaagugacaaaacggg

SEQ ID NO: 29873 - RNA, 21 nt, Artificial Sequence
  RNA Oligomer
aagugacaaaacgggaauuua

SEQ ID NO: 29874 - RNA, 21 nt, Artificial Sequence
  RNA Oligomer
uuacggaguaaagcccugaag

SEQ ID NO: 29875 - RNA, 21 nt, Artificial Sequence
  RNA Oligomer
gagcagugucaaaaggacccu

SEQ ID NO: 29876 - RNA, 21 nt, Artificial Sequence
  RNA Oligomer
agcagugucaaaaggacccug

SEQ ID NO: 29877 - RNA, 21 nt, Artificial Sequence
  RNA Oligomer
cugugcuugcagcaagguuuc

SEQ ID NO: 29878 - RNA, 21 nt, Artificial Sequence
  RNA Oligomer
aucauuccgaagauccuucuu

SEQ ID NO: 29879 - RNA, 21 nt, Artificial Sequence
  RNA Oligomer
ccgaagauccuucuuauuccc

SEQ ID NO: 29880 - RNA, 21 nt, Artificial Sequence
  RNA Oligomer
acguugggacagaaaugcuug

SEQ ID NO: 29881 - RNA, 21 nt, Artificial Sequence
  RNA Oligomer
aucaccaguuucuuccggaug

SEQ ID NO: 29882 - RNA, 21 nt, Artificial Sequence
  RNA Oligomer
aaacacugugggcacauacac

SEQ ID NO: 29883 - RNA, 21 nt, Artificial Sequence
  RNA Oligomer
ucaggcgugaaaccaauuccu

SEQ ID NO: 29884 - RNA, 21 nt, Artificial Sequence
  RNA Oligomer
augacaguauuaggaaaucca

SEQ ID NO: 29885 - RNA, 21 nt, Artificial Sequence
  RNA Oligomer
uugagcccauuuucaaaaaac

SEQ ID NO: 29886 - RNA, 21 nt, Artificial Sequence
  RNA Oligomer
uacggaguaaagcccugaagu

SEQ ID NO: 29887 - RNA, 21 nt, Artificial Sequence
  RNA Oligomer
gaaauuccuugaauuagcgcc

SEQ ID NO: 29888 - RNA, 21 nt, Artificial Sequence
  RNA Oligomer
ucaaaauuaaccgcauaaggg

SEQ ID NO: 29889 - RNA, 21 nt, Artificial Sequence
  RNA Oligomer
gagcacugugaauuagagcca

SEQ ID NO: 29890 - RNA, 21 nt, Artificial Sequence
  RNA Oligomer
aagugucuaauugccucaggc

SEQ ID NO: 29891 - RNA, 21 nt, Artificial Sequence
  RNA Oligomer
ucuguuacggaguaaagcccu

SEQ ID NO: 29892 - RNA, 21 nt, Artificial Sequence
  RNA Oligomer
aaauuccuugaauuagcgccu

SEQ ID NO: 29893 - RNA, 21 nt, Artificial Sequence
  RNA Oligomer
ugguagcaagaugacuucuga

SEQ ID NO: 29894 - RNA, 21 nt, Artificial Sequence
  RNA Oligomer
aaaaaaguuuagucagcugga

SEQ ID NO: 29895 - RNA, 21 nt, Artificial Sequence
  RNA Oligomer
aaaaguuuagucagcuggaga

SEQ ID NO: 29896 - RNA, 21 nt, Artificial Sequence
  RNA Oligomer
cuuaaguccaggugagacagg

SEQ ID NO: 29897 - RNA, 21 nt, Artificial Sequence
  RNA Oligomer
uaaguccaggugagacagguu

SEQ ID NO: 29898 - RNA, 21 nt, Artificial Sequence
  RNA Oligomer
uacacuuucuuugaggaugac

SEQ ID NO: 29899 - RNA, 21 nt, Artificial Sequence
  RNA Oligomer
aacuugggcuuuucugguuga

SEQ ID NO: 29900 - RNA, 21 nt, Artificial Sequence
  RNA Oligomer
cugacagauaauaggcaggac

SEQ ID NO: 29901 - RNA, 21 nt, Artificial Sequence
  RNA Oligomer
agagcacugugaauuagagcc

SEQ ID NO: 29902 - RNA, 21 nt, Artificial Sequence
  RNA Oligomer
cugugaauuagagccagaugc

SEQ ID NO: 29903 - RNA, 21 nt, Artificial Sequence
  RNA Oligomer
ucaaacacugugggcacauac

SEQ ID NO: 29904 - RNA, 21 nt, Artificial Sequence
  RNA Oligomer
gagacagguuaugccaucuuc

SEQ ID NO: 29905 - RNA, 21 nt, Artificial Sequence
  RNA Oligomer
agugucuaauugccucaggcg

SEQ ID NO: 29906 - RNA, 21 nt, Artificial Sequence
  RNA Oligomer
uguuacggaguaaagcccuga

SEQ ID NO: 29907 - RNA, 21 nt, Artificial Sequence
  RNA Oligomer
agcugacagauaauaggcagg

SEQ ID NO: 29908 - RNA, 21 nt, Artificial Sequence
  RNA Oligomer
gauaauaggcaggacauguua

SEQ ID NO: 29909 - RNA, 21 nt, Artificial Sequence
  RNA Oligomer
ugcuucaucuuggcuagcucc

SEQ ID NO: 29910 - RNA, 21 nt, Artificial Sequence
  RNA Oligomer
guugggacagaaaugcuugac

SEQ ID NO: 29911 - RNA, 21 nt, Artificial Sequence
  RNA Oligomer
uugggacagaaaugcuugacu

SEQ ID NO: 29912 - RNA, 21 nt, Artificial Sequence
  RNA Oligomer
caggugagacagguuaugcca

SEQ ID NO: 29913 - RNA, 21 nt, Artificial Sequence
  RNA Oligomer
aucagaaaaagugacaaaacg

SEQ ID NO: 29914 - RNA, 21 nt, Artificial Sequence
  RNA Oligomer
auacacuuucuuugaggauga

SEQ ID NO: 29915 - RNA, 21 nt, Artificial Sequence
  RNA Oligomer
ugaaguggugacucaccagag

SEQ ID NO: 29916 - RNA, 21 nt, Artificial Sequence
  RNA Oligomer
uucuagaaagaagcaagaagu

SEQ ID NO: 29917 - RNA, 21 nt, Artificial Sequence
  RNA Oligomer
aacuaucagggcugucgaugg

SEQ ID NO: 29918 - RNA, 21 nt, Artificial Sequence
  RNA Oligomer
ugucgauggaaaaacacauca

SEQ ID NO: 29919 - RNA, 21 nt, Artificial Sequence
  RNA Oligomer
agccagaugcuuaaguccagg

SEQ ID NO: 29920 - RNA, 21 nt, Artificial Sequence
  RNA Oligomer
aacacugugggcacauacacc

SEQ ID NO: 29921 - RNA, 21 nt, Artificial Sequence
  RNA Oligomer
accaauacacuuucuuugagg

SEQ ID NO: 29922 - RNA, 21 nt, Artificial Sequence
  RNA Oligomer
ucuuucuagaaagaagcaaga

SEQ ID NO: 29923 - RNA, 21 nt, Artificial Sequence
  RNA Oligomer
caucauuccgaagauccuucu

SEQ ID NO: 29924 - RNA, 21 nt, Artificial Sequence
  RNA Oligomer
aagauccuucuuauucccaac

SEQ ID NO: 29925 - RNA, 21 nt, Artificial Sequence
  RNA Oligomer
caaucaccaguuucuuccgga

SEQ ID NO: 29926 - RNA, 21 nt, Artificial Sequence
  RNA Oligomer
gaaaaaaaguuuagucagcug

SEQ ID NO: 29927 - RNA, 21 nt, Artificial Sequence
  RNA Oligomer
aaaaaguuuagucagcuggag

SEQ ID NO: 29928 - RNA, 21 nt, Artificial Sequence
  RNA Oligomer
uugaauuagcgccuggugugu

SEQ ID NO: 29929 - RNA, 21 nt, Artificial Sequence
  RNA Oligomer
uuagucagcuggagagaagag

SEQ ID NO: 29930 - RNA, 21 nt, Artificial Sequence
  RNA Oligomer
acuuucuuugaggaugacagu

SEQ ID NO: 29931 - RNA, 21 nt, Artificial Sequence
  RNA Oligomer
uuuagucagcuggagagaaga

SEQ ID NO: 29932 - RNA, 21 nt, Artificial Sequence
  RNA Oligomer
auacaccucugggaacugguc

SEQ ID NO: 29933 - RNA, 21 nt, Artificial Sequence
  RNA Oligomer
gaacuugggcuuuucugguug

SEQ ID NO: 29934 - RNA, 21 nt, Artificial Sequence
  RNA Oligomer
uccugcuucaucuuggcuagc

SEQ ID NO: 29935 - RNA, 21 nt, Artificial Sequence
  RNA Oligomer
cuccugcuucaucuuggcuag

SEQ ID NO: 29936 - RNA, 21 nt, Artificial Sequence
  RNA Oligomer
acuugggcuuuucugguugag

SEQ ID NO: 29937 - RNA, 21 nt, Artificial Sequence
  RNA Oligomer
uugggcuuuucugguugagcc

SEQ ID NO: 29938 - RNA, 21 nt, Artificial Sequence
  RNA Oligomer
cuugggcuuuucugguugagc

SEQ ID NO: 29939 - RNA, 21 nt, Artificial Sequence
  RNA Oligomer
ccacaacuaauuucacccaag

SEQ ID NO: 29940 - RNA, 21 nt, Artificial Sequence
  RNA Oligomer
gggucaucaaucggaacucaa

SEQ ID NO: 29941 - RNA, 21 nt, Artificial Sequence
  RNA Oligomer
acaacuaauuucacccaaggu

SEQ ID NO: 29942 - RNA, 21 nt, Artificial Sequence
  RNA Oligomer
accacaacuaauuucacccaa

SEQ ID NO: 29943 - RNA, 21 nt, Artificial Sequence
  RNA Oligomer
ccaaugucuuugucuggcaua

SEQ ID NO: 29944 - RNA, 21 nt, Artificial Sequence
  RNA Oligomer
caagguuuuaagcacguucuu

SEQ ID NO: 29945 - RNA, 21 nt, Artificial Sequence
  RNA Oligomer
ccauuuugggacauucuaauc

SEQ ID NO: 29946 - RNA, 21 nt, Artificial Sequence
  RNA Oligomer
gcaacaguucaagcgcuucau

SEQ ID NO: 29947 - RNA, 21 nt, Artificial Sequence
  RNA Oligomer
ccaagguuuuaagcacguucu

SEQ ID NO: 29948 - RNA, 21 nt, Artificial Sequence
  RNA Oligomer
ccaaguguucuguaagaagau

SEQ ID NO: 29949 - RNA, 21 nt, Artificial Sequence
  RNA Oligomer
gaaguauuacuggugguucuu

SEQ ID NO: 29950 - RNA, 21 nt, Artificial Sequence
  RNA Oligomer
cccaagguuuuaagcacguuc

SEQ ID NO: 29951 - RNA, 21 nt, Artificial Sequence
  RNA Oligomer
gccaucguccucacagucuua

SEQ ID NO: 29952 - RNA, 21 nt, Artificial Sequence
  RNA Oligomer
caucucuuucauguucuccua

SEQ ID NO: 29953 - RNA, 21 nt, Artificial Sequence
  RNA Oligomer
ccuugaacaauuugugcggcu

SEQ ID NO: 29954 - RNA, 21 nt, Artificial Sequence
  RNA Oligomer
gguuuuaagcacguucuuuca

SEQ ID NO: 29955 - RNA, 21 nt, Artificial Sequence
  RNA Oligomer
cacaacuaauuucacccaagg

SEQ ID NO: 29956 - RNA, 21 nt, Artificial Sequence
  RNA Oligomer
ccaccauuaugagaacuucua

SEQ ID NO: 29957 - RNA, 21 nt, Artificial Sequence
  RNA Oligomer
gaaaccuuccucaaccgcuac

SEQ ID NO: 29958 - RNA, 21 nt, Artificial Sequence
  RNA Oligomer
caacaguucaagcgcuucauu

SEQ ID NO: 29959 - RNA, 21 nt, Artificial Sequence
  RNA Oligomer
ccagacggugcaacaguucaa

SEQ ID NO: 29960 - RNA, 21 nt, Artificial Sequence
  RNA Oligomer
cccucuguuguucgugacuau

SEQ ID NO: 29961 - RNA, 21 nt, Artificial Sequence
  RNA Oligomer
cuugaacaauuugugcggcua

SEQ ID NO: 29962 - RNA, 21 nt, Artificial Sequence
  RNA Oligomer
cccuggcgucuacaugagaaa

SEQ ID NO: 29963 - RNA, 21 nt, Artificial Sequence
  RNA Oligomer
agaaaccuuccucaaccgcua

SEQ ID NO: 29964 - RNA, 21 nt, Artificial Sequence
  RNA Oligomer
cuccuacaucuugcucaccau

SEQ ID NO: 29965 - RNA, 21 nt, Artificial Sequence
  RNA Oligomer
gcaucucuuucauguucuccu

SEQ ID NO: 29966 - RNA, 21 nt, Artificial Sequence
  RNA Oligomer
gcagccagcaucucuuucaug

SEQ ID NO: 29967 - RNA, 21 nt, Artificial Sequence
  RNA Oligomer
gguaacgucauuccagcccuu

SEQ ID NO: 29968 - RNA, 21 nt, Artificial Sequence
  RNA Oligomer
gacccucuguugcuucccuuu

SEQ ID NO: 29969 - RNA, 21 nt, Artificial Sequence
  RNA Oligomer
ucaccucuguucuuccuauuu

SEQ ID NO: 29970 - RNA, 21 nt, Artificial Sequence
  RNA Oligomer
gacucacuucucccaccauua

SEQ ID NO: 29971 - RNA, 21 nt, Artificial Sequence
  RNA Oligomer
ccaucauguaugucuuugccu

SEQ ID NO: 29972 - RNA, 21 nt, Artificial Sequence
  RNA Oligomer
cuaugguuccucgcauuccug

SEQ ID NO: 29973 - RNA, 21 nt, Artificial Sequence
  RNA Oligomer
caggaccacuaugcuguacau

SEQ ID NO: 29974 - RNA, 21 nt, Artificial Sequence
  RNA Oligomer
ggaguggcauaaguuugaggu

SEQ ID NO: 29975 - RNA, 21 nt, Artificial Sequence
  RNA Oligomer
ccaccucuacauccugcucua

SEQ ID NO: 29976 - RNA, 21 nt, Artificial Sequence
  RNA Oligomer
ggaaaagucucgccuuauguu

SEQ ID NO: 29977 - RNA, 21 nt, Artificial Sequence
  RNA Oligomer
gaaauccgaaauaccacccug

SEQ ID NO: 29978 - RNA, 21 nt, Artificial Sequence
  RNA Oligomer
agaaauccgaaauaccacccu

SEQ ID NO: 29979 - RNA, 21 nt, Artificial Sequence
  RNA Oligomer
caauuugugcggcuacgggau

SEQ ID NO: 29980 - RNA, 21 nt, Artificial Sequence
  RNA Oligomer
gaacaauuugugcggcuacgg

SEQ ID NO: 29981 - RNA, 21 nt, Artificial Sequence
  RNA Oligomer
agagcgagaggaccauguguu

SEQ ID NO: 29982 - RNA, 21 nt, Artificial Sequence
  RNA Oligomer
cucaccucuguucuuccuauu

SEQ ID NO: 29983 - RNA, 21 nt, Artificial Sequence
  RNA Oligomer
caccauuaugagaacuucuag

SEQ ID NO: 29984 - RNA, 21 nt, Artificial Sequence
  RNA Oligomer
aguguucuguaagaagaucua

SEQ ID NO: 29985 - RNA, 21 nt, Artificial Sequence
  RNA Oligomer
cccuuuugccuccauccucaa

SEQ ID NO: 29986 - RNA, 21 nt, Artificial Sequence
  RNA Oligomer
ggcauaaguuugaggugucag

SEQ ID NO: 29987 - RNA, 21 nt, Artificial Sequence
  RNA Oligomer
cuggccaucauguaugucuuu

SEQ ID NO: 29988 - RNA, 21 nt, Artificial Sequence
  RNA Oligomer
ggcaagaagguaacgucauuc

SEQ ID NO: 29989 - RNA, 21 nt, Artificial Sequence
  RNA Oligomer
cgacauugagacugaguugac

SEQ ID NO: 29990 - RNA, 21 nt, Artificial Sequence
  RNA Oligomer
cgagaucuccaacaacugccu

SEQ ID NO: 29991 - RNA, 21 nt, Artificial Sequence
  RNA Oligomer
gcuguuuaacuuggaggaaga

SEQ ID NO: 29992 - RNA, 21 nt, Artificial Sequence
  RNA Oligomer
ccucuguuguucgugacuauu

SEQ ID NO: 29993 - RNA, 21 nt, Artificial Sequence
  RNA Oligomer
caaugucuuugucuggcauaa

SEQ ID NO: 29994 - RNA, 21 nt, Artificial Sequence
  RNA Oligomer
cggagcaaugacacuguacug

SEQ ID NO: 29995 - RNA, 21 nt, Artificial Sequence
  RNA Oligomer
ucccggagcaaugacacugua

SEQ ID NO: 29996 - RNA, 21 nt, Artificial Sequence
  RNA Oligomer
ccauuaugagaacuucuaggc

SEQ ID NO: 29997 - RNA, 21 nt, Artificial Sequence
  RNA Oligomer
gcacaucuacaucacccagcu

SEQ ID NO: 29998 - RNA, 21 nt, Artificial Sequence
  RNA Oligomer
caggaguggcauaaguuugag

SEQ ID NO: 29999 - RNA, 21 nt, Artificial Sequence
  RNA Oligomer
cauguaugucuuugccuccca

SEQ ID NO: 30000 - RNA, 21 nt, Artificial Sequence
  RNA Oligomer
ggccaucauguaugucuuugc

SEQ ID NO: 30001 - RNA, 21 nt, Artificial Sequence
  RNA Oligomer
ccuggccaucauguaugucuu

SEQ ID NO: 30002 - RNA, 21 nt, Artificial Sequence
  RNA Oligomer
ccagcaucucuuucauguucu

SEQ ID NO: 30003 - RNA, 21 nt, Artificial Sequence
  RNA Oligomer
aggaaaagucucgccuuaugu

SEQ ID NO: 30004 - RNA, 21 nt, Artificial Sequence
  RNA Oligomer
ugaccuggugcugcuguuuaa

SEQ ID NO: 30005 - RNA, 21 nt, Artificial Sequence
  RNA Oligomer
ccggaugagaaauuucaagag

SEQ ID NO: 30006 - RNA, 21 nt, Artificial Sequence
  RNA Oligomer
cuguuguucgugacuauuuug

SEQ ID NO: 30007 - RNA, 21 nt, Artificial Sequence
  RNA Oligomer
cauguguugguugaagaugug

SEQ ID NO: 30008 - RNA, 21 nt, Artificial Sequence
  RNA Oligomer
gcgauuugaugggugguacaa

SEQ ID NO: 30009 - RNA, 21 nt, Artificial Sequence
  RNA Oligomer
gcauaaguuugaggugucagu

SEQ ID NO: 30010 - RNA, 21 nt, Artificial Sequence
  RNA Oligomer
uggcauaaguuugagguguca

SEQ ID NO: 30011 - RNA, 21 nt, Artificial Sequence
  RNA Oligomer
guggcauaaguuugagguguc

SEQ ID NO: 30012 - RNA, 21 nt, Artificial Sequence
  RNA Oligomer
gggcuuugaguacaagucagg

SEQ ID NO: 30013 - RNA, 21 nt, Artificial Sequence
  RNA Oligomer
guaacgucauuccagcccuug

SEQ ID NO: 30014 - RNA, 21 nt, Artificial Sequence
  RNA Oligomer
uggcaagaagguaacgucauu

SEQ ID NO: 30015 - RNA, 21 nt, Artificial Sequence
  RNA Oligomer
cugcuguuuaacuuggaggaa

SEQ ID NO: 30016 - RNA, 21 nt, Artificial Sequence
  RNA Oligomer
cgugacuauuuugagggcagu

SEQ ID NO: 30017 - RNA, 21 nt, Artificial Sequence
  RNA Oligomer
aaugucuuugucuggcauaaa

SEQ ID NO: 30018 - RNA, 21 nt, Artificial Sequence
  RNA Oligomer
ugcagcccaaugucuuugucu

SEQ ID NO: 30019 - RNA, 21 nt, Artificial Sequence
  RNA Oligomer
caaagugcugaagauguggau

SEQ ID NO: 30020 - RNA, 21 nt, Artificial Sequence
  RNA Oligomer
ccuggcgucuacaugagaaau

SEQ ID NO: 30021 - RNA, 21 nt, Artificial Sequence
  RNA Oligomer
ccauuuacagaaacccacucg

SEQ ID NO: 30022 - RNA, 21 nt, Artificial Sequence
  RNA Oligomer
gggacuagagugagaaguagg

SEQ ID NO: 30023 - RNA, 21 nt, Artificial Sequence
  RNA Oligomer
ccaguugagcagagguuugag

SEQ ID NO: 30024 - RNA, 21 nt, Artificial Sequence
  RNA Oligomer
ugggaggugcagcgauuugau

SEQ ID NO: 30025 - RNA, 21 nt, Artificial Sequence
  RNA Oligomer
ugaguacaagucagggcagug

SEQ ID NO: 30026 - RNA, 21 nt, Artificial Sequence
  RNA Oligomer
gccaucauguaugucuuugcc

SEQ ID NO: 30027 - RNA, 21 nt, Artificial Sequence
  RNA Oligomer
agaaguauuacuggugguucu

SEQ ID NO: 30028 - RNA, 21 nt, Artificial Sequence
  RNA Oligomer
caagaagguaacgucauucca

SEQ ID NO: 30029 - RNA, 21 nt, Artificial Sequence
  RNA Oligomer
gcaagaagguaacgucauucc

SEQ ID NO: 30030 - RNA, 21 nt, Artificial Sequence
  RNA Oligomer
ggugcugcuguuuaacuugga

SEQ ID NO: 30031 - RNA, 21 nt, Artificial Sequence
  RNA Oligomer
caacuucguccuguccagcaa

SEQ ID NO: 30032 - RNA, 21 nt, Artificial Sequence
  RNA Oligomer
ggaugagaaauuucaagaggc

SEQ ID NO: 30033 - RNA, 21 nt, Artificial Sequence
  RNA Oligomer
ucuguuguucgugacuauuuu

SEQ ID NO: 30034 - RNA, 21 nt, Artificial Sequence
  RNA Oligomer
cucuguuguucgugacuauuu

SEQ ID NO: 30035 - RNA, 21 nt, Artificial Sequence
  RNA Oligomer
cugcagcccaaugucuuuguc

SEQ ID NO: 30036 - RNA, 21 nt, Artificial Sequence
  RNA Oligomer
ccggagcaaugacacuguacu

SEQ ID NO: 30037 - RNA, 21 nt, Artificial Sequence
  RNA Oligomer
ugguugaagaugugcgggauu

SEQ ID NO: 30038 - RNA, 21 nt, Artificial Sequence
  RNA Oligomer
cuauguaugcaaugcuccuca

SEQ ID NO: 30039 - RNA, 21 nt, Artificial Sequence
  RNA Oligomer
agcuaugcagauggcguguac

SEQ ID NO: 30040 - RNA, 21 nt, Artificial Sequence
  RNA Oligomer
cgauuugaugggugguacaac

SEQ ID NO: 30041 - RNA, 21 nt, Artificial Sequence
  RNA Oligomer
gccaaguguucuguaagaaga

SEQ ID NO: 30042 - RNA, 21 nt, Artificial Sequence
  RNA Oligomer
cucaucauccaugguagcuuu

SEQ ID NO: 30043 - RNA, 21 nt, Artificial Sequence
  RNA Oligomer
caccucuacauccugcucuau

SEQ ID NO: 30044 - RNA, 21 nt, Artificial Sequence
  RNA Oligomer
guccucacagucuuacacagu

SEQ ID NO: 30045 - RNA, 21 nt, Artificial Sequence
  RNA Oligomer
ucguccucacagucuuacaca

SEQ ID NO: 30046 - RNA, 21 nt, Artificial Sequence
  RNA Oligomer
uccuacaucuugcucaccaug

SEQ ID NO: 30047 - RNA, 21 nt, Artificial Sequence
  RNA Oligomer
ggagguuuggcaagaagguaa

SEQ ID NO: 30048 - RNA, 21 nt, Artificial Sequence
  RNA Oligomer
acauugagacugaguugacac

SEQ ID NO: 30049 - RNA, 21 nt, Artificial Sequence
  RNA Oligomer
cauguacgacuuugaugggaa

SEQ ID NO: 30050 - RNA, 21 nt, Artificial Sequence
  RNA Oligomer
guggucuucaugaaaggcucu

SEQ ID NO: 30051 - RNA, 21 nt, Artificial Sequence
  RNA Oligomer
gguggucuucaugaaaggcuc

SEQ ID NO: 30052 - RNA, 21 nt, Artificial Sequence
  RNA Oligomer
cuguuuaacuuggaggaagag

SEQ ID NO: 30053 - RNA, 21 nt, Artificial Sequence
  RNA Oligomer
ccuggugcugcuguuuaacuu

SEQ ID NO: 30054 - RNA, 21 nt, Artificial Sequence
  RNA Oligomer
gaccuggugcugcuguuuaac

SEQ ID NO: 30055 - RNA, 21 nt, Artificial Sequence
  RNA Oligomer
ucgugacuauuuugagggcag

SEQ ID NO: 30056 - RNA, 21 nt, Artificial Sequence
  RNA Oligomer
ccaguagucucccuuccaaau

SEQ ID NO: 30057 - RNA, 21 nt, Artificial Sequence
  RNA Oligomer
gcaugucuguauguguguugg

SEQ ID NO: 30058 - RNA, 21 nt, Artificial Sequence
  RNA Oligomer
agcugaccugacaaguacuau

SEQ ID NO: 30059 - RNA, 21 nt, Artificial Sequence
  RNA Oligomer
ccucaccucuguucuuccuau

SEQ ID NO: 30060 - RNA, 21 nt, Artificial Sequence
  RNA Oligomer
agcgauuugaugggugguaca

SEQ ID NO: 30061 - RNA, 21 nt, Artificial Sequence
  RNA Oligomer
ugccaaguguucuguaagaag

SEQ ID NO: 30062 - RNA, 21 nt, Artificial Sequence
  RNA Oligomer
agccagcaucucuuucauguu

SEQ ID NO: 30063 - RNA, 21 nt, Artificial Sequence
  RNA Oligomer
agcgacauugagacugaguug

SEQ ID NO: 30064 - RNA, 21 nt, Artificial Sequence
  RNA Oligomer
ugacaugggaagauuuucacu

SEQ ID NO: 30065 - RNA, 21 nt, Artificial Sequence
  RNA Oligomer
cugacaugggaagauuuucac

SEQ ID NO: 30066 - RNA, 21 nt, Artificial Sequence
  RNA Oligomer
auguacgacuuugaugggaau

SEQ ID NO: 30067 - RNA, 21 nt, Artificial Sequence
  RNA Oligomer
gcauguacgacuuugauggga

SEQ ID NO: 30068 - RNA, 21 nt, Artificial Sequence
  RNA Oligomer
cgcauguacgacuuugauggg

SEQ ID NO: 30069 - RNA, 21 nt, Artificial Sequence
  RNA Oligomer
gcugcuguuuaacuuggagga

SEQ ID NO: 30070 - RNA, 21 nt, Artificial Sequence
  RNA Oligomer
cuggugcugcuguuuaacuug

SEQ ID NO: 30071 - RNA, 21 nt, Artificial Sequence
  RNA Oligomer
guaugaccuggugcugcuguu

SEQ ID NO: 30072 - RNA, 21 nt, Artificial Sequence
  RNA Oligomer
auggaagcuuuggaauggcaa

SEQ ID NO: 30073 - RNA, 21 nt, Artificial Sequence
  RNA Oligomer
gagaaauuucaagaggcucca

SEQ ID NO: 30074 - RNA, 21 nt, Artificial Sequence
  RNA Oligomer
cggaugagaaauuucaagagg

SEQ ID NO: 30075 - RNA, 21 nt, Artificial Sequence
  RNA Oligomer
uccggaugagaaauuucaaga

SEQ ID NO: 30076 - RNA, 21 nt, Artificial Sequence
  RNA Oligomer
gacuauuuugagggcagugga

SEQ ID NO: 30077 - RNA, 21 nt, Artificial Sequence
  RNA Oligomer
gugacuauuuugagggcagug

SEQ ID NO: 30078 - RNA, 21 nt, Artificial Sequence
  RNA Oligomer
accaucguccuugaacaauuu

SEQ ID NO: 30079 - RNA, 21 nt, Artificial Sequence
  RNA Oligomer
gcaaugacacuguacuggagg

SEQ ID NO: 30080 - RNA, 21 nt, Artificial Sequence
  RNA Oligomer
gagcaaugacacuguacugga

SEQ ID NO: 30081 - RNA, 21 nt, Artificial Sequence
  RNA Oligomer
caucgccaccuaccagaacau

SEQ ID NO: 30082 - RNA, 21 nt, Artificial Sequence
  RNA Oligomer
gggucuucuuuggcuaucacg

SEQ ID NO: 30083 - RNA, 21 nt, Artificial Sequence
  RNA Oligomer
gcagcgauuugauggguggua

SEQ ID NO: 30084 - RNA, 21 nt, Artificial Sequence
  RNA Oligomer
ggucuucaagucauccgucag

SEQ ID NO: 30085 - RNA, 21 nt, Artificial Sequence
  RNA Oligomer
gaggugucaguguuaguggga

SEQ ID NO: 30086 - RNA, 21 nt, Artificial Sequence
  RNA Oligomer
cagaugugccagauacccaaa

SEQ ID NO: 30087 - RNA, 21 nt, Artificial Sequence
  RNA Oligomer
cagcaucucuuucauguucuc

SEQ ID NO: 30088 - RNA, 21 nt, Artificial Sequence
  RNA Oligomer
ggaacugacaugggaagauuu

SEQ ID NO: 30089 - RNA, 21 nt, Artificial Sequence
  RNA Oligomer
gugcugcuguuuaacuuggag

SEQ ID NO: 30090 - RNA, 21 nt, Artificial Sequence
  RNA Oligomer
agaaauuucaagaggcuccag

SEQ ID NO: 30091 - RNA, 21 nt, Artificial Sequence
  RNA Oligomer
gaugagaaauuucaagaggcu

SEQ ID NO: 30092 - RNA, 21 nt, Artificial Sequence
  RNA Oligomer
cuauuuugagggcaguggauu

SEQ ID NO: 30093 - RNA, 21 nt, Artificial Sequence
  RNA Oligomer
cucccucuguuguucgugacu

SEQ ID NO: 30094 - RNA, 21 nt, Artificial Sequence
  RNA Oligomer
caagaaggagauugaagaaau

SEQ ID NO: 30095 - RNA, 21 nt, Artificial Sequence
  RNA Oligomer
ccaucguccuugaacaauuug

SEQ ID NO: 30096 - RNA, 21 nt, Artificial Sequence
  RNA Oligomer
gguugaagaugugcgggauuu

SEQ ID NO: 30097 - RNA, 21 nt, Artificial Sequence
  RNA Oligomer
cuacaaagugcugaagaugug

SEQ ID NO: 30098 - RNA, 21 nt, Artificial Sequence
  RNA Oligomer
gaccuuagcaacaccaucuca

SEQ ID NO: 30099 - RNA, 21 nt, Artificial Sequence
  RNA Oligomer
caacaaccucauggagcacag

SEQ ID NO: 30100 - RNA, 21 nt, Artificial Sequence
  RNA Oligomer
cacaucuacaucacccagcug

SEQ ID NO: 30101 - RNA, 21 nt, Artificial Sequence
  RNA Oligomer
ccuuuugccuccauccucaaa

SEQ ID NO: 30102 - RNA, 21 nt, Artificial Sequence
  RNA Oligomer
ucaucauccaugguagcuuug

SEQ ID NO: 30103 - RNA, 21 nt, Artificial Sequence
  RNA Oligomer
gaauguguaccuguucuccau

SEQ ID NO: 30104 - RNA, 21 nt, Artificial Sequence
  RNA Oligomer
gagguuuggcaagaagguaac

SEQ ID NO: 30105 - RNA, 21 nt, Artificial Sequence
  RNA Oligomer
cggagguuuggcaagaaggua

SEQ ID NO: 30106 - RNA, 21 nt, Artificial Sequence
  RNA Oligomer
gcgacauugagacugaguuga

SEQ ID NO: 30107 - RNA, 21 nt, Artificial Sequence
  RNA Oligomer
ggacaaggaggaacugacaug

SEQ ID NO: 30108 - RNA, 21 nt, Artificial Sequence
  RNA Oligomer
ucccucuguuguucgugacua

SEQ ID NO: 30109 - RNA, 21 nt, Artificial Sequence
  RNA Oligomer
uugguugaagaugugcgggau

SEQ ID NO: 30110 - RNA, 21 nt, Artificial Sequence
  RNA Oligomer
ggaccauguguugguugaaga

SEQ ID NO: 30111 - RNA, 21 nt, Artificial Sequence
  RNA Oligomer
acgugcuuucagaccugguga

SEQ ID NO: 30112 - RNA, 21 nt, Artificial Sequence
  RNA Oligomer
cagcgauuugaugggugguac

SEQ ID NO: 30113 - RNA, 21 nt, Artificial Sequence
  RNA Oligomer
ugaguggcuggcugacaucau

SEQ ID NO: 30114 - RNA, 21 nt, Artificial Sequence
  RNA Oligomer
guugaagaugugcgggauuuc

SEQ ID NO: 30115 - RNA, 21 nt, Artificial Sequence
  RNA Oligomer
agaacaucgcuguguaugagu

SEQ ID NO: 30116 - RNA, 21 nt, Artificial Sequence
  RNA Oligomer
accucuguucuuccuauuucu

SEQ ID NO: 30117 - RNA, 21 nt, Artificial Sequence
  RNA Oligomer
auccgucagcugccaaguguu

SEQ ID NO: 30118 - RNA, 21 nt, Artificial Sequence
  RNA Oligomer
cucuauguccugcucaucauc

SEQ ID NO: 30119 - RNA, 21 nt, Artificial Sequence
  RNA Oligomer
ugucuuugccucccaccacuu

SEQ ID NO: 30120 - RNA, 21 nt, Artificial Sequence
  RNA Oligomer
gccagcaucucuuucauguuc

SEQ ID NO: 30121 - RNA, 21 nt, Artificial Sequence
  RNA Oligomer
aaggaggaacugacaugggaa

SEQ ID NO: 30122 - RNA, 21 nt, Artificial Sequence
  RNA Oligomer
ccaagaaggagauugaagaaa

SEQ ID NO: 30123 - RNA, 21 nt, Artificial Sequence
  RNA Oligomer
cagcaucuccucagaguucgu

SEQ ID NO: 30124 - RNA, 21 nt, Artificial Sequence
  RNA Oligomer
cccaauaccuauguaugcaau

SEQ ID NO: 30125 - RNA, 21 nt, Artificial Sequence
  RNA Oligomer
gcccaauaccuauguaugcaa

SEQ ID NO: 30126 - RNA, 21 nt, Artificial Sequence
  RNA Oligomer
acaaccucauggagcacagau

SEQ ID NO: 30127 - RNA, 21 nt, Artificial Sequence
  RNA Oligomer
ccucuguucuuccuauuucug

SEQ ID NO: 30128 - RNA, 21 nt, Artificial Sequence
  RNA Oligomer
acagaugugccagauacccaa

SEQ ID NO: 30129 - RNA, 21 nt, Artificial Sequence
  RNA Oligomer
gggucuccauuuugggacauu

SEQ ID NO: 30130 - RNA, 21 nt, Artificial Sequence
  RNA Oligomer
gaggaccauguguugguugaa

SEQ ID NO: 30131 - RNA, 21 nt, Artificial Sequence
  RNA Oligomer
ccaucuaugguuccucgcauu

SEQ ID NO: 30132 - RNA, 21 nt, Artificial Sequence
  RNA Oligomer
acccuggcccaauaccuaugu

SEQ ID NO: 30133 - RNA, 21 nt, Artificial Sequence
  RNA Oligomer
aacuaauuucacccaagguuu

SEQ ID NO: 30134 - RNA, 21 nt, Artificial Sequence
  RNA Oligomer
ccacaccucaccucuguucuu

SEQ ID NO: 30135 - RNA, 21 nt, Artificial Sequence
  RNA Oligomer
cugccaaguguucuguaagaa

SEQ ID NO: 30136 - RNA, 21 nt, Artificial Sequence
  RNA Oligomer
aaguuugaggugucaguguua

SEQ ID NO: 30137 - RNA, 21 nt, Artificial Sequence
  RNA Oligomer
agugugggccauguggugaau

SEQ ID NO: 30138 - RNA, 21 nt, Artificial Sequence
  RNA Oligomer
gaagauguggaugcacugcug

SEQ ID NO: 30139 - RNA, 21 nt, Artificial Sequence
  RNA Oligomer
guagucucccuuccaaauaaa

SEQ ID NO: 30140 - RNA, 21 nt, Artificial Sequence
  RNA Oligomer
cuaauuucacccaagguuuua

SEQ ID NO: 30141 - RNA, 21 nt, Artificial Sequence
  RNA Oligomer
agccauuuacagaaacccacu

SEQ ID NO: 30142 - RNA, 21 nt, Artificial Sequence
  RNA Oligomer
gaacugacaugggaagauuuu

SEQ ID NO: 30143 - RNA, 21 nt, Artificial Sequence
  RNA Oligomer
aggaacugacaugggaagauu

SEQ ID NO: 30144 - RNA, 21 nt, Artificial Sequence
  RNA Oligomer
gcugagauccuucaucgagau

SEQ ID NO: 30145 - RNA, 21 nt, Artificial Sequence
  RNA Oligomer
ggacauccugguggucuucau

SEQ ID NO: 30146 - RNA, 21 nt, Artificial Sequence
  RNA Oligomer
gcccuguacaaccaggacuua

SEQ ID NO: 30147 - RNA, 21 nt, Artificial Sequence
  RNA Oligomer
ggcaucuuagaacccucccua

SEQ ID NO: 30148 - RNA, 21 nt, Artificial Sequence
  RNA Oligomer
gaaacaaaucucagaagacaa

SEQ ID NO: 30149 - RNA, 21 nt, Artificial Sequence
  RNA Oligomer
uagggacuagagugagaagua

SEQ ID NO: 30150 - RNA, 21 nt, Artificial Sequence
  RNA Oligomer
ggaaaaggccugucagcucau

SEQ ID NO: 30151 - RNA, 21 nt, Artificial Sequence
  RNA Oligomer
cuguaagaagaucuacuucau

SEQ ID NO: 30152 - RNA, 21 nt, Artificial Sequence
  RNA Oligomer
uacuacgccuuugccgcacau

SEQ ID NO: 30153 - RNA, 21 nt, Artificial Sequence
  RNA Oligomer
ggugcaacaguucaagcgcuu

SEQ ID NO: 30154 - RNA, 21 nt, Artificial Sequence
  RNA Oligomer
ccaggauaugaucugucccuc

SEQ ID NO: 30155 - RNA, 21 nt, Artificial Sequence
  RNA Oligomer
cccuggcccaauaccuaugua

SEQ ID NO: 30156 - RNA, 21 nt, Artificial Sequence
  RNA Oligomer
caacuaauuucacccaagguu

SEQ ID NO: 30157 - RNA, 21 nt, Artificial Sequence
  RNA Oligomer
gccauuuacagaaacccacuc

SEQ ID NO: 30158 - RNA, 21 nt, Artificial Sequence
  RNA Oligomer
ggacccauggcaagccauuua

SEQ ID NO: 30159 - RNA, 21 nt, Artificial Sequence
  RNA Oligomer
ccaccaggaguggcauaaguu

SEQ ID NO: 30160 - RNA, 21 nt, Artificial Sequence
  RNA Oligomer
cuguaccuugauggaccauuu

SEQ ID NO: 30161 - RNA, 21 nt, Artificial Sequence
  RNA Oligomer
cagggcuuugaguacaaguca

SEQ ID NO: 30162 - RNA, 21 nt, Artificial Sequence
  RNA Oligomer
ccagggcuuugaguacaaguc

SEQ ID NO: 30163 - RNA, 21 nt, Artificial Sequence
  RNA Oligomer
ccaugguagcuuugcccugau

SEQ ID NO: 30164 - RNA, 21 nt, Artificial Sequence
  RNA Oligomer
ccagaaguauuacuggugguu

SEQ ID NO: 30165 - RNA, 21 nt, Artificial Sequence
  RNA Oligomer
cucuuucauguucuccuacau

SEQ ID NO: 30166 - RNA, 21 nt, Artificial Sequence
  RNA Oligomer
ggaggaacugacaugggaaga

SEQ ID NO: 30167 - RNA, 21 nt, Artificial Sequence
  RNA Oligomer
ccacagaaggucaacuucguc

SEQ ID NO: 30168 - RNA, 21 nt, Artificial Sequence
  RNA Oligomer
cccaaugucuuugucuggcau

SEQ ID NO: 30169 - RNA, 21 nt, Artificial Sequence
  RNA Oligomer
ggagauugaagaaauccgaaa

SEQ ID NO: 30170 - RNA, 21 nt, Artificial Sequence
  RNA Oligomer
ugaccgcuacugguuugagaa

SEQ ID NO: 30171 - RNA, 21 nt, Artificial Sequence
  RNA Oligomer
gaccauguguugguugaagau

SEQ ID NO: 30172 - RNA, 21 nt, Artificial Sequence
  RNA Oligomer
ccagcuuccugcagaaaacac

SEQ ID NO: 30173 - RNA, 21 nt, Artificial Sequence
  RNA Oligomer
cgaguuccucaacauucgcau

SEQ ID NO: 30174 - RNA, 21 nt, Artificial Sequence
  RNA Oligomer
gcaaaugccuugcaggaggua

SEQ ID NO: 30175 - RNA, 21 nt, Artificial Sequence
  RNA Oligomer
gaauguggaaaaggccuguca

SEQ ID NO: 30176 - RNA, 21 nt, Artificial Sequence
  RNA Oligomer
cagaagguucugaaccggagu

SEQ ID NO: 30177 - RNA, 21 nt, Artificial Sequence
  RNA Oligomer
ccuggccucuuccaugaugau

SEQ ID NO: 30178 - RNA, 21 nt, Artificial Sequence
  RNA Oligomer
ccugcgagaaaccuuccucaa

SEQ ID NO: 30179 - RNA, 21 nt, Artificial Sequence
  RNA Oligomer
cacagcagccagcaucucuuu

SEQ ID NO: 30180 - RNA, 21 nt, Artificial Sequence
  RNA Oligomer
ggauuccaggacaaggaggaa

SEQ ID NO: 30181 - RNA, 21 nt, Artificial Sequence
  RNA Oligomer
cugacaaggauggcaauggcu

SEQ ID NO: 30182 - RNA, 21 nt, Artificial Sequence
  RNA Oligomer
ggaggcauggaagcuuuggaa

SEQ ID NO: 30183 - RNA, 21 nt, Artificial Sequence
  RNA Oligomer
gaaugggcuguucuccaagaa

SEQ ID NO: 30184 - RNA, 21 nt, Artificial Sequence
  RNA Oligomer
gcaccaucguccuugaacaau

SEQ ID NO: 30185 - RNA, 21 nt, Artificial Sequence
  RNA Oligomer
agcaccaucguccuugaacaa

SEQ ID NO: 30186 - RNA, 21 nt, Artificial Sequence
  RNA Oligomer
cgagaggaccauguguugguu

SEQ ID NO: 30187 - RNA, 21 nt, Artificial Sequence
  RNA Oligomer
cccagcuuccugcagaaaaca

SEQ ID NO: 30188 - RNA, 21 nt, Artificial Sequence
  RNA Oligomer
ugcccagcuuccugcagaaaa

SEQ ID NO: 30189 - RNA, 21 nt, Artificial Sequence
  RNA Oligomer
ccaauaccuauguaugcaaug

SEQ ID NO: 30190 - RNA, 21 nt, Artificial Sequence
  RNA Oligomer
ccuuagcaacaccaucucaag

SEQ ID NO: 30191 - RNA, 21 nt, Artificial Sequence
  RNA Oligomer
acccaagguuuuaagcacguu

SEQ ID NO: 30192 - RNA, 21 nt, Artificial Sequence
  RNA Oligomer
ccgagaccuuagcaacaccau

SEQ ID NO: 30193 - RNA, 21 nt, Artificial Sequence
  RNA Oligomer
gcaucuuagaacccucccuac

SEQ ID NO: 30194 - RNA, 21 nt, Artificial Sequence
  RNA Oligomer
ccauagucagucaccaugugu

SEQ ID NO: 30195 - RNA, 21 nt, Artificial Sequence
  RNA Oligomer
gccauagucagucaccaugug

SEQ ID NO: 30196 - RNA, 21 nt, Artificial Sequence
  RNA Oligomer
agcugccaaguguucuguaag

SEQ ID NO: 30197 - RNA, 21 nt, Artificial Sequence
  RNA Oligomer
agggucuccauuuugggacau

SEQ ID NO: 30198 - RNA, 21 nt, Artificial Sequence
  RNA Oligomer
agggccuacuacuacgccuuu

SEQ ID NO: 30199 - RNA, 21 nt, Artificial Sequence
  RNA Oligomer
ugggaagauuuucacuucaug

SEQ ID NO: 30200 - RNA, 21 nt, Artificial Sequence
  RNA Oligomer
ccugguggucuucaugaaagg

SEQ ID NO: 30201 - RNA, 21 nt, Artificial Sequence
  RNA Oligomer
gcccaaugucuuugucuggca

SEQ ID NO: 30202 - RNA, 21 nt, Artificial Sequence
  RNA Oligomer
cuggucgcuguuaucaacauu

SEQ ID NO: 30203 - RNA, 21 nt, Artificial Sequence
  RNA Oligomer
caccaucguccuugaacaauu

SEQ ID NO: 30204 - RNA, 21 nt, Artificial Sequence
  RNA Oligomer
cccuguacaaccaggacuuau

SEQ ID NO: 30205 - RNA, 21 nt, Artificial Sequence
  RNA Oligomer
ccuggcccaauaccuauguau

SEQ ID NO: 30206 - RNA, 21 nt, Artificial Sequence
  RNA Oligomer
acguucuuucaucagacccug

SEQ ID NO: 30207 - RNA, 21 nt, Artificial Sequence
  RNA Oligomer
cgagaccuuagcaacaccauc

SEQ ID NO: 30208 - RNA, 21 nt, Artificial Sequence
  RNA Oligomer
ggccauagucagucaccaugu

SEQ ID NO: 30209 - RNA, 21 nt, Artificial Sequence
  RNA Oligomer
gggugguacaacaaccucaug

SEQ ID NO: 30210 - RNA, 21 nt, Artificial Sequence
  RNA Oligomer
ugccucagccuucucugauuu

SEQ ID NO: 30211 - RNA, 21 nt, Artificial Sequence
  RNA Oligomer
ugggugguacaacaaccucau

SEQ ID NO: 30212 - RNA, 21 nt, Artificial Sequence
  RNA Oligomer
ucagcucaucaacaggcagga

SEQ ID NO: 30213 - RNA, 21 nt, Artificial Sequence
  RNA Oligomer
ccucaggaccacuaugcugua

SEQ ID NO: 30214 - RNA, 21 nt, Artificial Sequence
  RNA Oligomer
guucuguaagaagaucuacuu

SEQ ID NO: 30215 - RNA, 21 nt, Artificial Sequence
  RNA Oligomer
ggcucuagcauggacacuucu

SEQ ID NO: 30216 - RNA, 21 nt, Artificial Sequence
  RNA Oligomer
gcucuauguccugcucaucau

SEQ ID NO: 30217 - RNA, 21 nt, Artificial Sequence
  RNA Oligomer
ggccauguggugaauguguac

SEQ ID NO: 30218 - RNA, 21 nt, Artificial Sequence
  RNA Oligomer
caagcgcuucauugagaacua

SEQ ID NO: 30219 - RNA, 21 nt, Artificial Sequence
  RNA Oligomer
agaaguuccaacgcagcuguc

SEQ ID NO: 30220 - RNA, 21 nt, Artificial Sequence
  RNA Oligomer
gggaagauuuucacuucaugc

SEQ ID NO: 30221 - RNA, 21 nt, Artificial Sequence
  RNA Oligomer
augggaagauuuucacuucau

SEQ ID NO: 30222 - RNA, 21 nt, Artificial Sequence
  RNA Oligomer
ccugaggaaaagucucgccuu

SEQ ID NO: 30223 - RNA, 21 nt, Artificial Sequence
  RNA Oligomer
aggagauugaagaaauccgaa

SEQ ID NO: 30224 - RNA, 21 nt, Artificial Sequence
  RNA Oligomer
ccgcuacugguuugagaacac

SEQ ID NO: 30225 - RNA, 21 nt, Artificial Sequence
  RNA Oligomer
ugcccuguacaaccaggacuu

SEQ ID NO: 30226 - RNA, 21 nt, Artificial Sequence
  RNA Oligomer
ccacugaaguuuucccgcaca

SEQ ID NO: 30227 - RNA, 21 nt, Artificial Sequence
  RNA Oligomer
gccaucuaugguuccucgcau

SEQ ID NO: 30228 - RNA, 21 nt, Artificial Sequence
  RNA Oligomer
accuuagcaacaccaucucaa

SEQ ID NO: 30229 - RNA, 21 nt, Artificial Sequence
  RNA Oligomer
gccucagccuucucugauuuc

SEQ ID NO: 30230 - RNA, 21 nt, Artificial Sequence
  RNA Oligomer
guucgaccucaggaccacuau

SEQ ID NO: 30231 - RNA, 21 nt, Artificial Sequence
  RNA Oligomer
accuugauggaccauuuggag

SEQ ID NO: 30232 - RNA, 21 nt, Artificial Sequence
  RNA Oligomer
agcuguaccuugauggaccau

SEQ ID NO: 30233 - RNA, 21 nt, Artificial Sequence
  RNA Oligomer
cccagaaguauuacugguggu

SEQ ID NO: 30234 - RNA, 21 nt, Artificial Sequence
  RNA Oligomer
gggccauguggugaaugugua

SEQ ID NO: 30235 - RNA, 21 nt, Artificial Sequence
  RNA Oligomer
cuccauuuugggacauucuaa

SEQ ID NO: 30236 - RNA, 21 nt, Artificial Sequence
  RNA Oligomer
agcagccagcaucucuuucau

SEQ ID NO: 30237 - RNA, 21 nt, Artificial Sequence
  RNA Oligomer
ggauaugaucugucccucucc

SEQ ID NO: 30238 - RNA, 21 nt, Artificial Sequence
  RNA Oligomer
cuacaucagccaggauaugau

SEQ ID NO: 30239 - RNA, 21 nt, Artificial Sequence
  RNA Oligomer
gaggaacugacaugggaagau

SEQ ID NO: 30240 - RNA, 21 nt, Artificial Sequence
  RNA Oligomer
cuucaucgagaucuccaacaa

SEQ ID NO: 30241 - RNA, 21 nt, Artificial Sequence
  RNA Oligomer
caggaugcugagauccuucau

SEQ ID NO: 30242 - RNA, 21 nt, Artificial Sequence
  RNA Oligomer
ugaggaaaagucucgccuuau

SEQ ID NO: 30243 - RNA, 21 nt, Artificial Sequence
  RNA Oligomer
gacauccugguggucuucaug

SEQ ID NO: 30244 - RNA, 21 nt, Artificial Sequence
  RNA Oligomer
gccuccacagaaggucaacuu

SEQ ID NO: 30245 - RNA, 21 nt, Artificial Sequence
  RNA Oligomer
cggcuccggaugagaaauuuc

SEQ ID NO: 30246 - RNA, 21 nt, Artificial Sequence
  RNA Oligomer
gagauugaagaaauccgaaau

SEQ ID NO: 30247 - RNA, 21 nt, Artificial Sequence
  RNA Oligomer
cuguucuccaagaaggagauu

SEQ ID NO: 30248 - RNA, 21 nt, Artificial Sequence
  RNA Oligomer
ccauguguugguugaagaugu

SEQ ID NO: 30249 - RNA, 21 nt, Artificial Sequence
  RNA Oligomer
ggaacucaagugucuccagag

SEQ ID NO: 30250 - RNA, 21 nt, Artificial Sequence
  RNA Oligomer
gcagaaaacacucccggagua

SEQ ID NO: 30251 - RNA, 21 nt, Artificial Sequence
  RNA Oligomer
ugcagaaaacacucccggagu

SEQ ID NO: 30252 - RNA, 21 nt, Artificial Sequence
  RNA Oligomer
gcacguucuuucaucagaccc

SEQ ID NO: 30253 - RNA, 21 nt, Artificial Sequence
  RNA Oligomer
gagcauggaugcuggcaucuu

SEQ ID NO: 30254 - RNA, 21 nt, Artificial Sequence
  RNA Oligomer
gcuuccagacuucagaaacaa

SEQ ID NO: 30255 - RNA, 21 nt, Artificial Sequence
  RNA Oligomer
gugguacaacaaccucaugga

SEQ ID NO: 30256 - RNA, 21 nt, Artificial Sequence
  RNA Oligomer
accuuguuccagguggccaua

SEQ ID NO: 30257 - RNA, 21 nt, Artificial Sequence
  RNA Oligomer
cccaccauuaugagaacuucu

SEQ ID NO: 30258 - RNA, 21 nt, Artificial Sequence
  RNA Oligomer
ggacucacuucucccaccauu

SEQ ID NO: 30259 - RNA, 21 nt, Artificial Sequence
  RNA Oligomer
cacaucuucuuccugguccca

SEQ ID NO: 30260 - RNA, 21 nt, Artificial Sequence
  RNA Oligomer
gccucuuccaugaugaugggu

SEQ ID NO: 30261 - RNA, 21 nt, Artificial Sequence
  RNA Oligomer
uccauuuugggacauucuaau

SEQ ID NO: 30262 - RNA, 21 nt, Artificial Sequence
  RNA Oligomer
guggacuuccaucgccucauu

SEQ ID NO: 30263 - RNA, 21 nt, Artificial Sequence
  RNA Oligomer
gucuccauuuugggacauucu

SEQ ID NO: 30264 - RNA, 21 nt, Artificial Sequence
  RNA Oligomer
uuucauguucuccuacaucuu

SEQ ID NO: 30265 - RNA, 21 nt, Artificial Sequence
  RNA Oligomer
guucaagcgcuucauugagaa

SEQ ID NO: 30266 - RNA, 21 nt, Artificial Sequence
  RNA Oligomer
gugcaacaguucaagcgcuuc

SEQ ID NO: 30267 - RNA, 21 nt, Artificial Sequence
  RNA Oligomer
gucauuccagcccuugcuguu

SEQ ID NO: 30268 - RNA, 21 nt, Artificial Sequence
  RNA Oligomer
ccucauuuccaaggaugaguu

SEQ ID NO: 30269 - RNA, 21 nt, Artificial Sequence
  RNA Oligomer
uggccucauuuccaaggauga

SEQ ID NO: 30270 - RNA, 21 nt, Artificial Sequence
  RNA Oligomer
cgccuuauguuccgcauguac

SEQ ID NO: 30271 - RNA, 21 nt, Artificial Sequence
  RNA Oligomer
cugaggaaaagucucgccuua

SEQ ID NO: 30272 - RNA, 21 nt, Artificial Sequence
  RNA Oligomer
ggcucuccugaggaaaagucu

SEQ ID NO: 30273 - RNA, 21 nt, Artificial Sequence
  RNA Oligomer
acagaaggucaacuucguccu

SEQ ID NO: 30274 - RNA, 21 nt, Artificial Sequence
  RNA Oligomer
gaggcauggaagcuuuggaau

SEQ ID NO: 30275 - RNA, 21 nt, Artificial Sequence
  RNA Oligomer
ccagagcaucgugucugagaa

SEQ ID NO: 30276 - RNA, 21 nt, Artificial Sequence
  RNA Oligomer
ccggcuccggaugagaaauuu

SEQ ID NO: 30277 - RNA, 21 nt, Artificial Sequence
  RNA Oligomer
ggucgcuguuaucaacauuga

SEQ ID NO: 30278 - RNA, 21 nt, Artificial Sequence
  RNA Oligomer
cgugcuggucgcuguuaucaa

SEQ ID NO: 30279 - RNA, 21 nt, Artificial Sequence
  RNA Oligomer
cugguuugagaacaccaggaa

SEQ ID NO: 30280 - RNA, 21 nt, Artificial Sequence
  RNA Oligomer
cacugggcuugucucccauua

SEQ ID NO: 30281 - RNA, 21 nt, Artificial Sequence
  RNA Oligomer
ugagcacccaagccuacaaag

SEQ ID NO: 30282 - RNA, 21 nt, Artificial Sequence
  RNA Oligomer
caaucggaacucaagugucuc

SEQ ID NO: 30283 - RNA, 21 nt, Artificial Sequence
  RNA Oligomer
cagaaaacacucccggaguau

SEQ ID NO: 30284 - RNA, 21 nt, Artificial Sequence
  RNA Oligomer
caguagucucccuuccaaaua

SEQ ID NO: 30285 - RNA, 21 nt, Artificial Sequence
  RNA Oligomer
cacccaagguuuuaagcacgu

SEQ ID NO: 30286 - RNA, 21 nt, Artificial Sequence
  RNA Oligomer
gacccauggcaagccauuuac

SEQ ID NO: 30287 - RNA, 21 nt, Artificial Sequence
  RNA Oligomer
agacuucagaaacaaaucuca

SEQ ID NO: 30288 - RNA, 21 nt, Artificial Sequence
  RNA Oligomer
ccagacuucagaaacaaaucu

SEQ ID NO: 30289 - RNA, 21 nt, Artificial Sequence
  RNA Oligomer
gaaaccucugcuuccagacuu

SEQ ID NO: 30290 - RNA, 21 nt, Artificial Sequence
  RNA Oligomer
guggccauagucagucaccau

SEQ ID NO: 30291 - RNA, 21 nt, Artificial Sequence
  RNA Oligomer
cucccaccauuaugagaacuu

SEQ ID NO: 30292 - RNA, 21 nt, Artificial Sequence
  RNA Oligomer
ggcaugaccaagaauguggaa

SEQ ID NO: 30293 - RNA, 21 nt, Artificial Sequence
  RNA Oligomer
ccaggaguggcauaaguuuga

SEQ ID NO: 30294 - RNA, 21 nt, Artificial Sequence
  RNA Oligomer
ccaaagcuguaccuugaugga

SEQ ID NO: 30295 - RNA, 21 nt, Artificial Sequence
  RNA Oligomer
cccuauuauuuucaucauggg

SEQ ID NO: 30296 - RNA, 21 nt, Artificial Sequence
  RNA Oligomer
cucaucaccuuccugcgagaa

SEQ ID NO: 30297 - RNA, 21 nt, Artificial Sequence
  RNA Oligomer
ggucuccauuuugggacauuc

SEQ ID NO: 30298 - RNA, 21 nt, Artificial Sequence
  RNA Oligomer
ggaugcugagauccuucaucg

SEQ ID NO: 30299 - RNA, 21 nt, Artificial Sequence
  RNA Oligomer
ucgccuuauguuccgcaugua

SEQ ID NO: 30300 - RNA, 21 nt, Artificial Sequence
  RNA Oligomer
ggacauguuuguggaguccau

SEQ ID NO: 30301 - RNA, 21 nt, Artificial Sequence
  RNA Oligomer
gcaccuccuggagaccuuuuu

SEQ ID NO: 30302 - RNA, 21 nt, Artificial Sequence
  RNA Oligomer
gucgcuguuaucaacauugac

SEQ ID NO: 30303 - RNA, 21 nt, Artificial Sequence
  RNA Oligomer
ugguuugagaacaccaggaau

SEQ ID NO: 30304 - RNA, 21 nt, Artificial Sequence
  RNA Oligomer
uggugaccgcuacugguuuga

SEQ ID NO: 30305 - RNA, 21 nt, Artificial Sequence
  RNA Oligomer
ggacuuauccuggcuagagcu

SEQ ID NO: 30306 - RNA, 21 nt, Artificial Sequence
  RNA Oligomer
cuggcccaauaccuauguaug

SEQ ID NO: 30307 - RNA, 21 nt, Artificial Sequence
  RNA Oligomer
agaccuuagcaacaccaucuc

SEQ ID NO: 30308 - RNA, 21 nt, Artificial Sequence
  RNA Oligomer
ggcaagccauuuacagaaacc

SEQ ID NO: 30309 - RNA, 21 nt, Artificial Sequence
  RNA Oligomer
ugcuggcaucuuagaacccuc

SEQ ID NO: 30310 - RNA, 21 nt, Artificial Sequence
  RNA Oligomer
ucagaaacaaaucucagaaga

SEQ ID NO: 30311 - RNA, 21 nt, Artificial Sequence
  RNA Oligomer
uccagacuucagaaacaaauc

SEQ ID NO: 30312 - RNA, 21 nt, Artificial Sequence
  RNA Oligomer
ccuucucugauuucccaccuc

SEQ ID NO: 30313 - RNA, 21 nt, Artificial Sequence
  RNA Oligomer
accacuaugcuguacaucugu

SEQ ID NO: 30314 - RNA, 21 nt, Artificial Sequence
  RNA Oligomer
uggcucuagcauggacacuuc

SEQ ID NO: 30315 - RNA, 21 nt, Artificial Sequence
  RNA Oligomer
gcuguaccuugauggaccauu

SEQ ID NO: 30316 - RNA, 21 nt, Artificial Sequence
  RNA Oligomer
guauuacuggugguucuucca

SEQ ID NO: 30317 - RNA, 21 nt, Artificial Sequence
  RNA Oligomer
cucuuccaugaugaugggucu

SEQ ID NO: 30318 - RNA, 21 nt, Artificial Sequence
  RNA Oligomer
cucacagucuuacacagugug

SEQ ID NO: 30319 - RNA, 21 nt, Artificial Sequence
  RNA Oligomer
gagaaguuccaacgcagcugu

SEQ ID NO: 30320 - RNA, 21 nt, Artificial Sequence
  RNA Oligomer
caggauaugaucugucccucu

SEQ ID NO: 30321 - RNA, 21 nt, Artificial Sequence
  RNA Oligomer
cuccaacaacugccuguccaa

SEQ ID NO: 30322 - RNA, 21 nt, Artificial Sequence
  RNA Oligomer
gggaauggccucauuuccaag

SEQ ID NO: 30323 - RNA, 21 nt, Artificial Sequence
  RNA Oligomer
auguuccgcauguacgacuuu

SEQ ID NO: 30324 - RNA, 21 nt, Artificial Sequence
  RNA Oligomer
guccauguucucucuggcuga

SEQ ID NO: 30325 - RNA, 21 nt, Artificial Sequence
  RNA Oligomer
gaguccauguucucucuggcu

SEQ ID NO: 30326 - RNA, 21 nt, Artificial Sequence
  RNA Oligomer
ccaggacauguuuguggaguc

SEQ ID NO: 30327 - RNA, 21 nt, Artificial Sequence
  RNA Oligomer
ggaaugggcuguucuccaaga

SEQ ID NO: 30328 - RNA, 21 nt, Artificial Sequence
  RNA Oligomer
uucagcaccaucguccuugaa

SEQ ID NO: 30329 - RNA, 21 nt, Artificial Sequence
  RNA Oligomer
ccaggacuuauccuggcuaga

SEQ ID NO: 30330 - RNA, 21 nt, Artificial Sequence
  RNA Oligomer
ccuguacaaccaggacuuauc

SEQ ID NO: 30331 - RNA, 21 nt, Artificial Sequence
  RNA Oligomer
gccuacaaagugcugaagaug

SEQ ID NO: 30332 - RNA, 21 nt, Artificial Sequence
  RNA Oligomer
gugagcacccaagccuacaaa

SEQ ID NO: 30333 - RNA, 21 nt, Artificial Sequence
  RNA Oligomer
guauacaggauaccggccauu

SEQ ID NO: 30334 - RNA, 21 nt, Artificial Sequence
  RNA Oligomer
uggcaagccauuuacagaaac

SEQ ID NO: 30335 - RNA, 21 nt, Artificial Sequence
  RNA Oligomer
cagaaacaaaucucagaagac

SEQ ID NO: 30336 - RNA, 21 nt, Artificial Sequence
  RNA Oligomer
cagacuucagaaacaaaucuc

SEQ ID NO: 30337 - RNA, 21 nt, Artificial Sequence
  RNA Oligomer
cuuccagacuucagaaacaaa

SEQ ID NO: 30338 - RNA, 21 nt, Artificial Sequence
  RNA Oligomer
guacaucugugagcggcacuu

SEQ ID NO: 30339 - RNA, 21 nt, Artificial Sequence
  RNA Oligomer
cacuaugcuguacaucuguga

SEQ ID NO: 30340 - RNA, 21 nt, Artificial Sequence
  RNA Oligomer
ccacuaugcuguacaucugug

SEQ ID NO: 30341 - RNA, 21 nt, Artificial Sequence
  RNA Oligomer
ggaccacuaugcuguacaucu

SEQ ID NO: 30342 - RNA, 21 nt, Artificial Sequence
  RNA Oligomer
ggacauucuaaucccugagcc

SEQ ID NO: 30343 - RNA, 21 nt, Artificial Sequence
  RNA Oligomer
ccucacagucuuacacagugu

SEQ ID NO: 30344 - RNA, 21 nt, Artificial Sequence
  RNA Oligomer
ucaucaccuuccugcgagaaa

SEQ ID NO: 30345 - RNA, 21 nt, Artificial Sequence
  RNA Oligomer
cuccuacaucagccaggauau

SEQ ID NO: 30346 - RNA, 21 nt, Artificial Sequence
  RNA Oligomer
gccugaagucaucaaggaccu

SEQ ID NO: 30347 - RNA, 21 nt, Artificial Sequence
  RNA Oligomer
ggaggugccugaagucaucaa

SEQ ID NO: 30348 - RNA, 21 nt, Artificial Sequence
  RNA Oligomer
gaagauuuucacuucaugcug

SEQ ID NO: 30349 - RNA, 21 nt, Artificial Sequence
  RNA Oligomer
ggaagauuuucacuucaugcu

SEQ ID NO: 30350 - RNA, 21 nt, Artificial Sequence
  RNA Oligomer
uuccgcauguacgacuuugau

SEQ ID NO: 30351 - RNA, 21 nt, Artificial Sequence
  RNA Oligomer
uggcaauggcuaccuguccuu

SEQ ID NO: 30352 - RNA, 21 nt, Artificial Sequence
  RNA Oligomer
ccauguucucucuggcugaca

SEQ ID NO: 30353 - RNA, 21 nt, Artificial Sequence
  RNA Oligomer
gcuccggaugagaaauuucaa

SEQ ID NO: 30354 - RNA, 21 nt, Artificial Sequence
  RNA Oligomer
ggcuccggaugagaaauuuca

SEQ ID NO: 30355 - RNA, 21 nt, Artificial Sequence
  RNA Oligomer
gcagcccaaugucuuugucug

SEQ ID NO: 30356 - RNA, 21 nt, Artificial Sequence
  RNA Oligomer
uggucgcuguuaucaacauug

SEQ ID NO: 30357 - RNA, 21 nt, Artificial Sequence
  RNA Oligomer
gcuguucuccaagaaggagau

SEQ ID NO: 30358 - RNA, 21 nt, Artificial Sequence
  RNA Oligomer
ccaagccuacaaagugcugaa

SEQ ID NO: 30359 - RNA, 21 nt, Artificial Sequence
  RNA Oligomer
cggaacucaagugucuccaga

SEQ ID NO: 30360 - RNA, 21 nt, Artificial Sequence
  RNA Oligomer
ucggaacucaagugucuccag

SEQ ID NO: 30361 - RNA, 21 nt, Artificial Sequence
  RNA Oligomer
cgucuacaugagaaaugccag

SEQ ID NO: 30362 - RNA, 21 nt, Artificial Sequence
  RNA Oligomer
uagucucccuuccaaauaaau

SEQ ID NO: 30363 - RNA, 21 nt, Artificial Sequence
  RNA Oligomer
cuucagaaacaaaucucagaa

SEQ ID NO: 30364 - RNA, 21 nt, Artificial Sequence
  RNA Oligomer
gacuucagaaacaaaucucag

SEQ ID NO: 30365 - RNA, 21 nt, Artificial Sequence
  RNA Oligomer
cugccucagccuucucugauu

SEQ ID NO: 30366 - RNA, 21 nt, Artificial Sequence
  RNA Oligomer
cugucagcucaucaacaggca

SEQ ID NO: 30367 - RNA, 21 nt, Artificial Sequence
  RNA Oligomer
cuggugucugugcacaucuac

SEQ ID NO: 30368 - RNA, 21 nt, Artificial Sequence
  RNA Oligomer
ccuggugucugugcacaucua

SEQ ID NO: 30369 - RNA, 21 nt, Artificial Sequence
  RNA Oligomer
ccucaaagaccuggucuucaa

SEQ ID NO: 30370 - RNA, 21 nt, Artificial Sequence
  RNA Oligomer
caccaggaguggcauaaguuu

SEQ ID NO: 30371 - RNA, 21 nt, Artificial Sequence
  RNA Oligomer
cuggucccagcaaucaucuau

SEQ ID NO: 30372 - RNA, 21 nt, Artificial Sequence
  RNA Oligomer
ccuggucccagcaaucaucua

SEQ ID NO: 30373 - RNA, 21 nt, Artificial Sequence
  RNA Oligomer
ccugauccuggccaucaugua

SEQ ID NO: 30374 - RNA, 21 nt, Artificial Sequence
  RNA Oligomer
ugggacauucuaaucccugag

SEQ ID NO: 30375 - RNA, 21 nt, Artificial Sequence
  RNA Oligomer
guggugaauguguaccuguuc

SEQ ID NO: 30376 - RNA, 21 nt, Artificial Sequence
  RNA Oligomer
ccauguggugaauguguaccu

SEQ ID NO: 30377 - RNA, 21 nt, Artificial Sequence
  RNA Oligomer
caccuuccugcgagaaaccuu

SEQ ID NO: 30378 - RNA, 21 nt, Artificial Sequence
  RNA Oligomer
agguaacgucauuccagcccu

SEQ ID NO: 30379 - RNA, 21 nt, Artificial Sequence
  RNA Oligomer
gacugaguugacaccucagag

SEQ ID NO: 30380 - RNA, 21 nt, Artificial Sequence
  RNA Oligomer
gcagcgacauugagacugagu

SEQ ID NO: 30381 - RNA, 21 nt, Artificial Sequence
  RNA Oligomer
gccaggauaugaucugucccu

SEQ ID NO: 30382 - RNA, 21 nt, Artificial Sequence
  RNA Oligomer
ccuccuacaucagccaggaua

SEQ ID NO: 30383 - RNA, 21 nt, Artificial Sequence
  RNA Oligomer
uccuucaucgagaucuccaac

SEQ ID NO: 30384 - RNA, 21 nt, Artificial Sequence
  RNA Oligomer
caaggaugaguucaucaggau

SEQ ID NO: 30385 - RNA, 21 nt, Artificial Sequence
  RNA Oligomer
cuggcugacaaggauggcaau

SEQ ID NO: 30386 - RNA, 21 nt, Artificial Sequence
  RNA Oligomer
guggaguccauguucucucug

SEQ ID NO: 30387 - RNA, 21 nt, Artificial Sequence
  RNA Oligomer
gaccuuuuucaggcaccuuuu

SEQ ID NO: 30388 - RNA, 21 nt, Artificial Sequence
  RNA Oligomer
gaaggucaacuucguccuguc

SEQ ID NO: 30389 - RNA, 21 nt, Artificial Sequence
  RNA Oligomer
gcauggaagcuuuggaauggc

SEQ ID NO: 30390 - RNA, 21 nt, Artificial Sequence
  RNA Oligomer
gagcaucgugucugagaagcu

SEQ ID NO: 30391 - RNA, 21 nt, Artificial Sequence
  RNA Oligomer
aggaaugggcuguucuccaag

SEQ ID NO: 30392 - RNA, 21 nt, Artificial Sequence
  RNA Oligomer
gcuacugguuugagaacacca

SEQ ID NO: 30393 - RNA, 21 nt, Artificial Sequence
  RNA Oligomer
cgcuacugguuugagaacacc

SEQ ID NO: 30394 - RNA, 21 nt, Artificial Sequence
  RNA Oligomer
caaccaggacuuauccuggcu

SEQ ID NO: 30395 - RNA, 21 nt, Artificial Sequence
  RNA Oligomer
cuacaugagaaaugccagcug

SEQ ID NO: 30396 - RNA, 21 nt, Artificial Sequence
  RNA Oligomer
gcgucuacaugagaaaugcca

SEQ ID NO: 30397 - RNA, 21 nt, Artificial Sequence
  RNA Oligomer
acucccggaguauacaggaua

SEQ ID NO: 30398 - RNA, 21 nt, Artificial Sequence
  RNA Oligomer
ucuuuggcuaucacgugcuuu

SEQ ID NO: 30399 - RNA, 21 nt, Artificial Sequence
  RNA Oligomer
uucuuuggcuaucacgugcuu

SEQ ID NO: 30400 - RNA, 21 nt, Artificial Sequence
  RNA Oligomer
ccugagaaaccgcacaguguu

SEQ ID NO: 30401 - RNA, 21 nt, Artificial Sequence
  RNA Oligomer
uccaguagucucccuuccaaa

SEQ ID NO: 30402 - RNA, 21 nt, Artificial Sequence
  RNA Oligomer
ggcccaauaccuauguaugca

SEQ ID NO: 30403 - RNA, 21 nt, Artificial Sequence
  RNA Oligomer
ucaucagacccuggcccaaua

SEQ ID NO: 30404 - RNA, 21 nt, Artificial Sequence
  RNA Oligomer
gcaaagugaaaccucugcuuc

SEQ ID NO: 30405 - RNA, 21 nt, Artificial Sequence
  RNA Oligomer
gccuucucugauuucccaccu

SEQ ID NO: 30406 - RNA, 21 nt, Artificial Sequence
  RNA Oligomer
caugaccaagaauguggaaaa

SEQ ID NO: 30407 - RNA, 21 nt, Artificial Sequence
  RNA Oligomer
gcaugaccaagaauguggaaa

SEQ ID NO: 30408 - RNA, 21 nt, Artificial Sequence
  RNA Oligomer
gaagguucugaaccggagucu

SEQ ID NO: 30409 - RNA, 21 nt, Artificial Sequence
  RNA Oligomer
ucaggaccacuaugcuguaca

SEQ ID NO: 30410 - RNA, 21 nt, Artificial Sequence
  RNA Oligomer
accuggugucugugcacaucu

SEQ ID NO: 30411 - RNA, 21 nt, Artificial Sequence
  RNA Oligomer
guguucuguaagaagaucuac

SEQ ID NO: 30412 - RNA, 21 nt, Artificial Sequence
  RNA Oligomer
cuagcauggacacuucugguu

SEQ ID NO: 30413 - RNA, 21 nt, Artificial Sequence
  RNA Oligomer
cccaaagcuguaccuugaugg

SEQ ID NO: 30414 - RNA, 21 nt, Artificial Sequence
  RNA Oligomer
gggacauucuaaucccugagc

SEQ ID NO: 30415 - RNA, 21 nt, Artificial Sequence
  RNA Oligomer
cagaaguauuacuggugguuc

SEQ ID NO: 30416 - RNA, 21 nt, Artificial Sequence
  RNA Oligomer
uccuggccucuuccaugauga

SEQ ID NO: 30417 - RNA, 21 nt, Artificial Sequence
  RNA Oligomer
agcguccucucuugccucuuu

SEQ ID NO: 30418 - RNA, 21 nt, Artificial Sequence
  RNA Oligomer
uggacuuccaucgccucauug

SEQ ID NO: 30419 - RNA, 21 nt, Artificial Sequence
  RNA Oligomer
acaguucaagcgcuucauuga

SEQ ID NO: 30420 - RNA, 21 nt, Artificial Sequence
  RNA Oligomer
ugagacugaguugacaccuca

SEQ ID NO: 30421 - RNA, 21 nt, Artificial Sequence
  RNA Oligomer
cugagauccuucaucgagauc

SEQ ID NO: 30422 - RNA, 21 nt, Artificial Sequence
  RNA Oligomer
ugaguucaucaggaugcugag

SEQ ID NO: 30423 - RNA, 21 nt, Artificial Sequence
  RNA Oligomer
gccucauuuccaaggaugagu

SEQ ID NO: 30424 - RNA, 21 nt, Artificial Sequence
  RNA Oligomer
gaauggccucauuuccaagga

SEQ ID NO: 30425 - RNA, 21 nt, Artificial Sequence
  RNA Oligomer
ugaaaggcucuccugaggaaa

SEQ ID NO: 30426 - RNA, 21 nt, Artificial Sequence
  RNA Oligomer
agaccuuuuucaggcaccuuu

SEQ ID NO: 30427 - RNA, 21 nt, Artificial Sequence
  RNA Oligomer
ccuccacagaaggucaacuuc

SEQ ID NO: 30428 - RNA, 21 nt, Artificial Sequence
  RNA Oligomer
cagagcaucgugucugagaag

SEQ ID NO: 30429 - RNA, 21 nt, Artificial Sequence
  RNA Oligomer
gaacaccaggaaugggcuguu

SEQ ID NO: 30430 - RNA, 21 nt, Artificial Sequence
  RNA Oligomer
agccuacaaagugcugaagau

SEQ ID NO: 30431 - RNA, 21 nt, Artificial Sequence
  RNA Oligomer
cacccaagccuacaaagugcu

SEQ ID NO: 30432 - RNA, 21 nt, Artificial Sequence
  RNA Oligomer
agaaaacacucccggaguaua

SEQ ID NO: 30433 - RNA, 21 nt, Artificial Sequence
  RNA Oligomer
cuaccagaacaucgcugugua

SEQ ID NO: 30434 - RNA, 21 nt, Artificial Sequence
  RNA Oligomer
guaaggaugcagugggagcau

SEQ ID NO: 30435 - RNA, 21 nt, Artificial Sequence
  RNA Oligomer
gacaagcugaccugacaagua

SEQ ID NO: 30436 - RNA, 21 nt, Artificial Sequence
  RNA Oligomer
cucugcuuccagacuucagaa

SEQ ID NO: 30437 - RNA, 21 nt, Artificial Sequence
  RNA Oligomer
ucccaccauuaugagaacuuc

SEQ ID NO: 30438 - RNA, 21 nt, Artificial Sequence
  RNA Oligomer
cacuucucccaccauuaugag

SEQ ID NO: 30439 - RNA, 21 nt, Artificial Sequence
  RNA Oligomer
cuugggugaaauuaguugugg

SEQ ID NO: 30440 - RNA, 21 nt, Artificial Sequence
  RNA Oligomer
uugaguuccgauugaugaccc

SEQ ID NO: 30441 - RNA, 21 nt, Artificial Sequence
  RNA Oligomer
accuugggugaaauuaguugu

SEQ ID NO: 30442 - RNA, 21 nt, Artificial Sequence
  RNA Oligomer
uugggugaaauuaguuguggu

SEQ ID NO: 30443 - RNA, 21 nt, Artificial Sequence
  RNA Oligomer
uaugccagacaaagacauugg

SEQ ID NO: 30444 - RNA, 21 nt, Artificial Sequence
  RNA Oligomer
aagaacgugcuuaaaaccuug

SEQ ID NO: 30445 - RNA, 21 nt, Artificial Sequence
  RNA Oligomer
gauuagaaugucccaaaaugg

SEQ ID NO: 30446 - RNA, 21 nt, Artificial Sequence
  RNA Oligomer
augaagcgcuugaacuguugc

SEQ ID NO: 30447 - RNA, 21 nt, Artificial Sequence
  RNA Oligomer
agaacgugcuuaaaaccuugg

SEQ ID NO: 30448 - RNA, 21 nt, Artificial Sequence
  RNA Oligomer
aucuucuuacagaacacuugg

SEQ ID NO: 30449 - RNA, 21 nt, Artificial Sequence
  RNA Oligomer
aagaaccaccaguaauacuuc

SEQ ID NO: 30450 - RNA, 21 nt, Artificial Sequence
  RNA Oligomer
gaacgugcuuaaaaccuuggg

SEQ ID NO: 30451 - RNA, 21 nt, Artificial Sequence
  RNA Oligomer
uaagacugugaggacgauggc

SEQ ID NO: 30452 - RNA, 21 nt, Artificial Sequence
  RNA Oligomer
uaggagaacaugaaagagaug

SEQ ID NO: 30453 - RNA, 21 nt, Artificial Sequence
  RNA Oligomer
agccgcacaaauuguucaagg

SEQ ID NO: 30454 - RNA, 21 nt, Artificial Sequence
  RNA Oligomer
ugaaagaacgugcuuaaaacc

SEQ ID NO: 30455 - RNA, 21 nt, Artificial Sequence
  RNA Oligomer
ccuugggugaaauuaguugug

SEQ ID NO: 30456 - RNA, 21 nt, Artificial Sequence
  RNA Oligomer
uagaaguucucauaauggugg

SEQ ID NO: 30457 - RNA, 21 nt, Artificial Sequence
  RNA Oligomer
guagcgguugaggaagguuuc

SEQ ID NO: 30458 - RNA, 21 nt, Artificial Sequence
  RNA Oligomer
aaugaagcgcuugaacuguug

SEQ ID NO: 30459 - RNA, 21 nt, Artificial Sequence
  RNA Oligomer
uugaacuguugcaccgucugg

SEQ ID NO: 30460 - RNA, 21 nt, Artificial Sequence
  RNA Oligomer
auagucacgaacaacagaggg

SEQ ID NO: 30461 - RNA, 21 nt, Artificial Sequence
  RNA Oligomer
uagccgcacaaauuguucaag

SEQ ID NO: 30462 - RNA, 21 nt, Artificial Sequence
  RNA Oligomer
uuucucauguagacgccaggg

SEQ ID NO: 30463 - RNA, 21 nt, Artificial Sequence
  RNA Oligomer
uagcgguugaggaagguuucu

SEQ ID NO: 30464 - RNA, 21 nt, Artificial Sequence
  RNA Oligomer
auggugagcaagauguaggag

SEQ ID NO: 30465 - RNA, 21 nt, Artificial Sequence
  RNA Oligomer
aggagaacaugaaagagaugc

SEQ ID NO: 30466 - RNA, 21 nt, Artificial Sequence
  RNA Oligomer
caugaaagagaugcuggcugc

SEQ ID NO: 30467 - RNA, 21 nt, Artificial Sequence
  RNA Oligomer
aagggcuggaaugacguuacc

SEQ ID NO: 30468 - RNA, 21 nt, Artificial Sequence
  RNA Oligomer
aaagggaagcaacagaggguc

SEQ ID NO: 30469 - RNA, 21 nt, Artificial Sequence
  RNA Oligomer
aaauaggaagaacagagguga

SEQ ID NO: 30470 - RNA, 21 nt, Artificial Sequence
  RNA Oligomer
uaauggugggagaagugaguc

SEQ ID NO: 30471 - RNA, 21 nt, Artificial Sequence
  RNA Oligomer
aggcaaagacauacaugaugg

SEQ ID NO: 30472 - RNA, 21 nt, Artificial Sequence
  RNA Oligomer
caggaaugcgaggaaccauag

SEQ ID NO: 30473 - RNA, 21 nt, Artificial Sequence
  RNA Oligomer
auguacagcauagugguccug

SEQ ID NO: 30474 - RNA, 21 nt, Artificial Sequence
  RNA Oligomer
accucaaacuuaugccacucc

SEQ ID NO: 30475 - RNA, 21 nt, Artificial Sequence
  RNA Oligomer
uagagcaggauguagaggugg

SEQ ID NO: 30476 - RNA, 21 nt, Artificial Sequence
  RNA Oligomer
aacauaaggcgagacuuuucc

SEQ ID NO: 30477 - RNA, 21 nt, Artificial Sequence
  RNA Oligomer
cagggugguauuucggauuuc

SEQ ID NO: 30478 - RNA, 21 nt, Artificial Sequence
  RNA Oligomer
agggugguauuucggauuucu

SEQ ID NO: 30479 - RNA, 21 nt, Artificial Sequence
  RNA Oligomer
aucccguagccgcacaaauug

SEQ ID NO: 30480 - RNA, 21 nt, Artificial Sequence
  RNA Oligomer
ccguagccgcacaaauuguuc

SEQ ID NO: 30481 - RNA, 21 nt, Artificial Sequence
  RNA Oligomer
aacacaugguccucucgcucu

SEQ ID NO: 30482 - RNA, 21 nt, Artificial Sequence
  RNA Oligomer
aauaggaagaacagaggugag

SEQ ID NO: 30483 - RNA, 21 nt, Artificial Sequence
  RNA Oligomer
cuagaaguucucauaauggug

SEQ ID NO: 30484 - RNA, 21 nt, Artificial Sequence
  RNA Oligomer
uagaucuucuuacagaacacu

SEQ ID NO: 30485 - RNA, 21 nt, Artificial Sequence
  RNA Oligomer
uugaggauggaggcaaaaggg

SEQ ID NO: 30486 - RNA, 21 nt, Artificial Sequence
  RNA Oligomer
cugacaccucaaacuuaugcc

SEQ ID NO: 30487 - RNA, 21 nt, Artificial Sequence
  RNA Oligomer
aaagacauacaugauggccag

SEQ ID NO: 30488 - RNA, 21 nt, Artificial Sequence
  RNA Oligomer
gaaugacguuaccuucuugcc

SEQ ID NO: 30489 - RNA, 21 nt, Artificial Sequence
  RNA Oligomer
gucaacucagucucaaugucg

SEQ ID NO: 30490 - RNA, 21 nt, Artificial Sequence
  RNA Oligomer
aggcaguuguuggagaucucg

SEQ ID NO: 30491 - RNA, 21 nt, Artificial Sequence
  RNA Oligomer
ucuuccuccaaguuaaacagc

SEQ ID NO: 30492 - RNA, 21 nt, Artificial Sequence
  RNA Oligomer
aauagucacgaacaacagagg

SEQ ID NO: 30493 - RNA, 21 nt, Artificial Sequence
  RNA Oligomer
uuaugccagacaaagacauug

SEQ ID NO: 30494 - RNA, 21 nt, Artificial Sequence
  RNA Oligomer
caguacagugucauugcuccg

SEQ ID NO: 30495 - RNA, 21 nt, Artificial Sequence
  RNA Oligomer
uacagugucauugcuccggga

SEQ ID NO: 30496 - RNA, 21 nt, Artificial Sequence
  RNA Oligomer
gccuagaaguucucauaaugg

SEQ ID NO: 30497 - RNA, 21 nt, Artificial Sequence
  RNA Oligomer
agcugggugauguagaugugc

SEQ ID NO: 30498 - RNA, 21 nt, Artificial Sequence
  RNA Oligomer
cucaaacuuaugccacuccug

SEQ ID NO: 30499 - RNA, 21 nt, Artificial Sequence
  RNA Oligomer
ugggaggcaaagacauacaug

SEQ ID NO: 30500 - RNA, 21 nt, Artificial Sequence
  RNA Oligomer
gcaaagacauacaugauggcc

SEQ ID NO: 30501 - RNA, 21 nt, Artificial Sequence
  RNA Oligomer
aagacauacaugauggccagg

SEQ ID NO: 30502 - RNA, 21 nt, Artificial Sequence
  RNA Oligomer
agaacaugaaagagaugcugg

SEQ ID NO: 30503 - RNA, 21 nt, Artificial Sequence
  RNA Oligomer
acauaaggcgagacuuuuccu

SEQ ID NO: 30504 - RNA, 21 nt, Artificial Sequence
  RNA Oligomer
uuaaacagcagcaccagguca

SEQ ID NO: 30505 - RNA, 21 nt, Artificial Sequence
  RNA Oligomer
cucuugaaauuucucauccgg

SEQ ID NO: 30506 - RNA, 21 nt, Artificial Sequence
  RNA Oligomer
caaaauagucacgaacaacag

SEQ ID NO: 30507 - RNA, 21 nt, Artificial Sequence
  RNA Oligomer
cacaucuucaaccaacacaug

SEQ ID NO: 30508 - RNA, 21 nt, Artificial Sequence
  RNA Oligomer
uuguaccacccaucaaaucgc

SEQ ID NO: 30509 - RNA, 21 nt, Artificial Sequence
  RNA Oligomer
acugacaccucaaacuuaugc

SEQ ID NO: 30510 - RNA, 21 nt, Artificial Sequence
  RNA Oligomer
ugacaccucaaacuuaugcca

SEQ ID NO: 30511 - RNA, 21 nt, Artificial Sequence
  RNA Oligomer
gacaccucaaacuuaugccac

SEQ ID NO: 30512 - RNA, 21 nt, Artificial Sequence
  RNA Oligomer
ccugacuuguacucaaagccc

SEQ ID NO: 30513 - RNA, 21 nt, Artificial Sequence
  RNA Oligomer
caagggcuggaaugacguuac

SEQ ID NO: 30514 - RNA, 21 nt, Artificial Sequence
  RNA Oligomer
aaugacguuaccuucuugcca

SEQ ID NO: 30515 - RNA, 21 nt, Artificial Sequence
  RNA Oligomer
uuccuccaaguuaaacagcag

SEQ ID NO: 30516 - RNA, 21 nt, Artificial Sequence
  RNA Oligomer
acugcccucaaaauagucacg

SEQ ID NO: 30517 - RNA, 21 nt, Artificial Sequence
  RNA Oligomer
uuuaugccagacaaagacauu

SEQ ID NO: 30518 - RNA, 21 nt, Artificial Sequence
  RNA Oligomer
agacaaagacauugggcugca

SEQ ID NO: 30519 - RNA, 21 nt, Artificial Sequence
  RNA Oligomer
auccacaucuucagcacuuug

SEQ ID NO: 30520 - RNA, 21 nt, Artificial Sequence
  RNA Oligomer
auuucucauguagacgccagg

SEQ ID NO: 30521 - RNA, 21 nt, Artificial Sequence
  RNA Oligomer
cgaguggguuucuguaaaugg

SEQ ID NO: 30522 - RNA, 21 nt, Artificial Sequence
  RNA Oligomer
ccuacuucucacucuaguccc

SEQ ID NO: 30523 - RNA, 21 nt, Artificial Sequence
  RNA Oligomer
cucaaaccucugcucaacugg

SEQ ID NO: 30524 - RNA, 21 nt, Artificial Sequence
  RNA Oligomer
aucaaaucgcugcaccuccca

SEQ ID NO: 30525 - RNA, 21 nt, Artificial Sequence
  RNA Oligomer
cacugcccugacuuguacuca

SEQ ID NO: 30526 - RNA, 21 nt, Artificial Sequence
  RNA Oligomer
ggcaaagacauacaugauggc

SEQ ID NO: 30527 - RNA, 21 nt, Artificial Sequence
  RNA Oligomer
agaaccaccaguaauacuucu

SEQ ID NO: 30528 - RNA, 21 nt, Artificial Sequence
  RNA Oligomer
uggaaugacguuaccuucuug

SEQ ID NO: 30529 - RNA, 21 nt, Artificial Sequence
  RNA Oligomer
ggaaugacguuaccuucuugc

SEQ ID NO: 30530 - RNA, 21 nt, Artificial Sequence
  RNA Oligomer
uccaaguuaaacagcagcacc

SEQ ID NO: 30531 - RNA, 21 nt, Artificial Sequence
  RNA Oligomer
uugcuggacaggacgaaguug

SEQ ID NO: 30532 - RNA, 21 nt, Artificial Sequence
  RNA Oligomer
gccucuugaaauuucucaucc

SEQ ID NO: 30533 - RNA, 21 nt, Artificial Sequence
  RNA Oligomer
aaaauagucacgaacaacaga

SEQ ID NO: 30534 - RNA, 21 nt, Artificial Sequence
  RNA Oligomer
aaauagucacgaacaacagag

SEQ ID NO: 30535 - RNA, 21 nt, Artificial Sequence
  RNA Oligomer
gacaaagacauugggcugcag

SEQ ID NO: 30536 - RNA, 21 nt, Artificial Sequence
  RNA Oligomer
aguacagugucauugcuccgg

SEQ ID NO: 30537 - RNA, 21 nt, Artificial Sequence
  RNA Oligomer
aaucccgcacaucuucaacca

SEQ ID NO: 30538 - RNA, 21 nt, Artificial Sequence
  RNA Oligomer
ugaggagcauugcauacauag

SEQ ID NO: 30539 - RNA, 21 nt, Artificial Sequence
  RNA Oligomer
guacacgccaucugcauagcu

SEQ ID NO: 30540 - RNA, 21 nt, Artificial Sequence
  RNA Oligomer
guuguaccacccaucaaaucg

SEQ ID NO: 30541 - RNA, 21 nt, Artificial Sequence
  RNA Oligomer
ucuucuuacagaacacuuggc

SEQ ID NO: 30542 - RNA, 21 nt, Artificial Sequence
  RNA Oligomer
aaagcuaccauggaugaugag

SEQ ID NO: 30543 - RNA, 21 nt, Artificial Sequence
  RNA Oligomer
auagagcaggauguagaggug

SEQ ID NO: 30544 - RNA, 21 nt, Artificial Sequence
  RNA Oligomer
acuguguaagacugugaggac

SEQ ID NO: 30545 - RNA, 21 nt, Artificial Sequence
  RNA Oligomer
uguguaagacugugaggacga

SEQ ID NO: 30546 - RNA, 21 nt, Artificial Sequence
  RNA Oligomer
cauggugagcaagauguagga

SEQ ID NO: 30547 - RNA, 21 nt, Artificial Sequence
  RNA Oligomer
uuaccuucuugccaaaccucc

SEQ ID NO: 30548 - RNA, 21 nt, Artificial Sequence
  RNA Oligomer
gugucaacucagucucaaugu

SEQ ID NO: 30549 - RNA, 21 nt, Artificial Sequence
  RNA Oligomer
uucccaucaaagucguacaug

SEQ ID NO: 30550 - RNA, 21 nt, Artificial Sequence
  RNA Oligomer
agagccuuucaugaagaccac

SEQ ID NO: 30551 - RNA, 21 nt, Artificial Sequence
  RNA Oligomer
gagccuuucaugaagaccacc

SEQ ID NO: 30552 - RNA, 21 nt, Artificial Sequence
  RNA Oligomer
cucuuccuccaaguuaaacag

SEQ ID NO: 30553 - RNA, 21 nt, Artificial Sequence
  RNA Oligomer
aaguuaaacagcagcaccagg

SEQ ID NO: 30554 - RNA, 21 nt, Artificial Sequence
  RNA Oligomer
guuaaacagcagcaccagguc

SEQ ID NO: 30555 - RNA, 21 nt, Artificial Sequence
  RNA Oligomer
cugcccucaaaauagucacga

SEQ ID NO: 30556 - RNA, 21 nt, Artificial Sequence
  RNA Oligomer
auuuggaagggagacuacugg

SEQ ID NO: 30557 - RNA, 21 nt, Artificial Sequence
  RNA Oligomer
ccaacacacauacagacaugc

SEQ ID NO: 30558 - RNA, 21 nt, Artificial Sequence
  RNA Oligomer
auaguacuugucaggucagcu

SEQ ID NO: 30559 - RNA, 21 nt, Artificial Sequence
  RNA Oligomer
auaggaagaacagaggugagg

SEQ ID NO: 30560 - RNA, 21 nt, Artificial Sequence
  RNA Oligomer
uguaccacccaucaaaucgcu

SEQ ID NO: 30561 - RNA, 21 nt, Artificial Sequence
  RNA Oligomer
cuucuuacagaacacuuggca

SEQ ID NO: 30562 - RNA, 21 nt, Artificial Sequence
  RNA Oligomer
aacaugaaagagaugcuggcu

SEQ ID NO: 30563 - RNA, 21 nt, Artificial Sequence
  RNA Oligomer
caacucagucucaaugucgcu

SEQ ID NO: 30564 - RNA, 21 nt, Artificial Sequence
  RNA Oligomer
agugaaaaucuucccauguca

SEQ ID NO: 30565 - RNA, 21 nt, Artificial Sequence
  RNA Oligomer
gugaaaaucuucccaugucag

SEQ ID NO: 30566 - RNA, 21 nt, Artificial Sequence
  RNA Oligomer
auucccaucaaagucguacau

SEQ ID NO: 30567 - RNA, 21 nt, Artificial Sequence
  RNA Oligomer
ucccaucaaagucguacaugc

SEQ ID NO: 30568 - RNA, 21 nt, Artificial Sequence
  RNA Oligomer
cccaucaaagucguacaugcg

SEQ ID NO: 30569 - RNA, 21 nt, Artificial Sequence
  RNA Oligomer
uccuccaaguuaaacagcagc

SEQ ID NO: 30570 - RNA, 21 nt, Artificial Sequence
  RNA Oligomer
caaguuaaacagcagcaccag

SEQ ID NO: 30571 - RNA, 21 nt, Artificial Sequence
  RNA Oligomer
aacagcagcaccaggucauac

SEQ ID NO: 30572 - RNA, 21 nt, Artificial Sequence
  RNA Oligomer
uugccauuccaaagcuuccau

SEQ ID NO: 30573 - RNA, 21 nt, Artificial Sequence
  RNA Oligomer
uggagccucuugaaauuucuc

SEQ ID NO: 30574 - RNA, 21 nt, Artificial Sequence
  RNA Oligomer
ccucuugaaauuucucauccg

SEQ ID NO: 30575 - RNA, 21 nt, Artificial Sequence
  RNA Oligomer
ucuugaaauuucucauccgga

SEQ ID NO: 30576 - RNA, 21 nt, Artificial Sequence
  RNA Oligomer
uccacugcccucaaaauaguc

SEQ ID NO: 30577 - RNA, 21 nt, Artificial Sequence
  RNA Oligomer
cacugcccucaaaauagucac

SEQ ID NO: 30578 - RNA, 21 nt, Artificial Sequence
  RNA Oligomer
aaauuguucaaggacgauggu

SEQ ID NO: 30579 - RNA, 21 nt, Artificial Sequence
  RNA Oligomer
ccuccaguacagugucauugc

SEQ ID NO: 30580 - RNA, 21 nt, Artificial Sequence
  RNA Oligomer
uccaguacagugucauugcuc

SEQ ID NO: 30581 - RNA, 21 nt, Artificial Sequence
  RNA Oligomer
auguucugguagguggcgaug

SEQ ID NO: 30582 - RNA, 21 nt, Artificial Sequence
  RNA Oligomer
cgugauagccaaagaagaccc

SEQ ID NO: 30583 - RNA, 21 nt, Artificial Sequence
  RNA Oligomer
uaccacccaucaaaucgcugc

SEQ ID NO: 30584 - RNA, 21 nt, Artificial Sequence
  RNA Oligomer
cugacggaugacuugaagacc

SEQ ID NO: 30585 - RNA, 21 nt, Artificial Sequence
  RNA Oligomer
ucccacuaacacugacaccuc

SEQ ID NO: 30586 - RNA, 21 nt, Artificial Sequence
  RNA Oligomer
uuuggguaucuggcacaucug

SEQ ID NO: 30587 - RNA, 21 nt, Artificial Sequence
  RNA Oligomer
gagaacaugaaagagaugcug

SEQ ID NO: 30588 - RNA, 21 nt, Artificial Sequence
  RNA Oligomer
aaaucuucccaugucaguucc

SEQ ID NO: 30589 - RNA, 21 nt, Artificial Sequence
  RNA Oligomer
cuccaaguuaaacagcagcac

SEQ ID NO: 30590 - RNA, 21 nt, Artificial Sequence
  RNA Oligomer
cuggagccucuugaaauuucu

SEQ ID NO: 30591 - RNA, 21 nt, Artificial Sequence
  RNA Oligomer
agccucuugaaauuucucauc

SEQ ID NO: 30592 - RNA, 21 nt, Artificial Sequence
  RNA Oligomer
aauccacugcccucaaaauag

SEQ ID NO: 30593 - RNA, 21 nt, Artificial Sequence
  RNA Oligomer
agucacgaacaacagagggag

SEQ ID NO: 30594 - RNA, 21 nt, Artificial Sequence
  RNA Oligomer
auuucuucaaucuccuucuug

SEQ ID NO: 30595 - RNA, 21 nt, Artificial Sequence
  RNA Oligomer
caaauuguucaaggacgaugg

SEQ ID NO: 30596 - RNA, 21 nt, Artificial Sequence
  RNA Oligomer
aaaucccgcacaucuucaacc

SEQ ID NO: 30597 - RNA, 21 nt, Artificial Sequence
  RNA Oligomer
cacaucuucagcacuuuguag

SEQ ID NO: 30598 - RNA, 21 nt, Artificial Sequence
  RNA Oligomer
ugagaugguguugcuaagguc

SEQ ID NO: 30599 - RNA, 21 nt, Artificial Sequence
  RNA Oligomer
cugugcuccaugagguuguug

SEQ ID NO: 30600 - RNA, 21 nt, Artificial Sequence
  RNA Oligomer
cagcugggugauguagaugug

SEQ ID NO: 30601 - RNA, 21 nt, Artificial Sequence
  RNA Oligomer
uuugaggauggaggcaaaagg

SEQ ID NO: 30602 - RNA, 21 nt, Artificial Sequence
  RNA Oligomer
caaagcuaccauggaugauga

SEQ ID NO: 30603 - RNA, 21 nt, Artificial Sequence
  RNA Oligomer
auggagaacagguacacauuc

SEQ ID NO: 30604 - RNA, 21 nt, Artificial Sequence
  RNA Oligomer
guuaccuucuugccaaaccuc

SEQ ID NO: 30605 - RNA, 21 nt, Artificial Sequence
  RNA Oligomer
uaccuucuugccaaaccuccg

SEQ ID NO: 30606 - RNA, 21 nt, Artificial Sequence
  RNA Oligomer
ucaacucagucucaaugucgc

SEQ ID NO: 30607 - RNA, 21 nt, Artificial Sequence
  RNA Oligomer
caugucaguuccuccuugucc

SEQ ID NO: 30608 - RNA, 21 nt, Artificial Sequence
  RNA Oligomer
uagucacgaacaacagaggga

SEQ ID NO: 30609 - RNA, 21 nt, Artificial Sequence
  RNA Oligomer
aucccgcacaucuucaaccaa

SEQ ID NO: 30610 - RNA, 21 nt, Artificial Sequence
  RNA Oligomer
ucuucaaccaacacauggucc

SEQ ID NO: 30611 - RNA, 21 nt, Artificial Sequence
  RNA Oligomer
ucaccaggucugaaagcacgu

SEQ ID NO: 30612 - RNA, 21 nt, Artificial Sequence
  RNA Oligomer
guaccacccaucaaaucgcug

SEQ ID NO: 30613 - RNA, 21 nt, Artificial Sequence
  RNA Oligomer
augaugucagccagccacuca

SEQ ID NO: 30614 - RNA, 21 nt, Artificial Sequence
  RNA Oligomer
gaaaucccgcacaucuucaac

SEQ ID NO: 30615 - RNA, 21 nt, Artificial Sequence
  RNA Oligomer
acucauacacagcgauguucu

SEQ ID NO: 30616 - RNA, 21 nt, Artificial Sequence
  RNA Oligomer
agaaauaggaagaacagaggu

SEQ ID NO: 30617 - RNA, 21 nt, Artificial Sequence
  RNA Oligomer
aacacuuggcagcugacggau

SEQ ID NO: 30618 - RNA, 21 nt, Artificial Sequence
  RNA Oligomer
gaugaugagcaggacauagag

SEQ ID NO: 30619 - RNA, 21 nt, Artificial Sequence
  RNA Oligomer
aaguggugggaggcaaagaca

SEQ ID NO: 30620 - RNA, 21 nt, Artificial Sequence
  RNA Oligomer
gaacaugaaagagaugcuggc

SEQ ID NO: 30621 - RNA, 21 nt, Artificial Sequence
  RNA Oligomer
uucccaugucaguuccuccuu

SEQ ID NO: 30622 - RNA, 21 nt, Artificial Sequence
  RNA Oligomer
uuucuucaaucuccuucuugg

SEQ ID NO: 30623 - RNA, 21 nt, Artificial Sequence
  RNA Oligomer
acgaacucugaggagaugcug

SEQ ID NO: 30624 - RNA, 21 nt, Artificial Sequence
  RNA Oligomer
auugcauacauagguauuggg

SEQ ID NO: 30625 - RNA, 21 nt, Artificial Sequence
  RNA Oligomer
uugcauacauagguauugggc

SEQ ID NO: 30626 - RNA, 21 nt, Artificial Sequence
  RNA Oligomer
aucugugcuccaugagguugu

SEQ ID NO: 30627 - RNA, 21 nt, Artificial Sequence
  RNA Oligomer
cagaaauaggaagaacagagg

SEQ ID NO: 30628 - RNA, 21 nt, Artificial Sequence
  RNA Oligomer
uuggguaucuggcacaucugu

SEQ ID NO: 30629 - RNA, 21 nt, Artificial Sequence
  RNA Oligomer
aaugucccaaaauggagaccc

SEQ ID NO: 30630 - RNA, 21 nt, Artificial Sequence
  RNA Oligomer
uucaaccaacacaugguccuc

SEQ ID NO: 30631 - RNA, 21 nt, Artificial Sequence
  RNA Oligomer
aaugcgaggaaccauagaugg

SEQ ID NO: 30632 - RNA, 21 nt, Artificial Sequence
  RNA Oligomer
acauagguauugggccagggu

SEQ ID NO: 30633 - RNA, 21 nt, Artificial Sequence
  RNA Oligomer
aaaccuugggugaaauuaguu

SEQ ID NO: 30634 - RNA, 21 nt, Artificial Sequence
  RNA Oligomer
aagaacagaggugaggugugg

SEQ ID NO: 30635 - RNA, 21 nt, Artificial Sequence
  RNA Oligomer
uucuuacagaacacuuggcag

SEQ ID NO: 30636 - RNA, 21 nt, Artificial Sequence
  RNA Oligomer
uaacacugacaccucaaacuu

SEQ ID NO: 30637 - RNA, 21 nt, Artificial Sequence
  RNA Oligomer
auucaccacauggcccacacu

SEQ ID NO: 30638 - RNA, 21 nt, Artificial Sequence
  RNA Oligomer
cagcagugcauccacaucuuc

SEQ ID NO: 30639 - RNA, 21 nt, Artificial Sequence
  RNA Oligomer
uuuauuuggaagggagacuac

SEQ ID NO: 30640 - RNA, 21 nt, Artificial Sequence
  RNA Oligomer
uaaaaccuugggugaaauuag

SEQ ID NO: 30641 - RNA, 21 nt, Artificial Sequence
  RNA Oligomer
aguggguuucuguaaauggcu

SEQ ID NO: 30642 - RNA, 21 nt, Artificial Sequence
  RNA Oligomer
aaaaucuucccaugucaguuc

SEQ ID NO: 30643 - RNA, 21 nt, Artificial Sequence
  RNA Oligomer
aaucuucccaugucaguuccu

SEQ ID NO: 30644 - RNA, 21 nt, Artificial Sequence
  RNA Oligomer
aucucgaugaaggaucucagc

SEQ ID NO: 30645 - RNA, 21 nt, Artificial Sequence
  RNA Oligomer
augaagaccaccaggaugucc

SEQ ID NO: 30646 - RNA, 21 nt, Artificial Sequence
  RNA Oligomer
uaaguccugguuguacagggc

SEQ ID NO: 30647 - RNA, 21 nt, Artificial Sequence
  RNA Oligomer
uagggaggguucuaagaugcc

SEQ ID NO: 30648 - RNA, 21 nt, Artificial Sequence
  RNA Oligomer
uugucuucugagauuuguuuc

SEQ ID NO: 30649 - RNA, 21 nt, Artificial Sequence
  RNA Oligomer
uacuucucacucuagucccua

SEQ ID NO: 30650 - RNA, 21 nt, Artificial Sequence
  RNA Oligomer
augagcugacaggccuuuucc

SEQ ID NO: 30651 - RNA, 21 nt, Artificial Sequence
  RNA Oligomer
augaaguagaucuucuuacag

SEQ ID NO: 30652 - RNA, 21 nt, Artificial Sequence
  RNA Oligomer
augugcggcaaaggcguagua

SEQ ID NO: 30653 - RNA, 21 nt, Artificial Sequence
  RNA Oligomer
aagcgcuugaacuguugcacc

SEQ ID NO: 30654 - RNA, 21 nt, Artificial Sequence
  RNA Oligomer
gagggacagaucauauccugg

SEQ ID NO: 30655 - RNA, 21 nt, Artificial Sequence
  RNA Oligomer
uacauagguauugggccaggg

SEQ ID NO: 30656 - RNA, 21 nt, Artificial Sequence
  RNA Oligomer
aaccuugggugaaauuaguug

SEQ ID NO: 30657 - RNA, 21 nt, Artificial Sequence
  RNA Oligomer
gaguggguuucuguaaauggc

SEQ ID NO: 30658 - RNA, 21 nt, Artificial Sequence
  RNA Oligomer
uaaauggcuugccaugggucc

SEQ ID NO: 30659 - RNA, 21 nt, Artificial Sequence
  RNA Oligomer
aacuuaugccacuccuggugg

SEQ ID NO: 30660 - RNA, 21 nt, Artificial Sequence
  RNA Oligomer
aaaugguccaucaagguacag

SEQ ID NO: 30661 - RNA, 21 nt, Artificial Sequence
  RNA Oligomer
ugacuuguacucaaagcccug

SEQ ID NO: 30662 - RNA, 21 nt, Artificial Sequence
  RNA Oligomer
gacuuguacucaaagcccugg

SEQ ID NO: 30663 - RNA, 21 nt, Artificial Sequence
  RNA Oligomer
aucagggcaaagcuaccaugg

SEQ ID NO: 30664 - RNA, 21 nt, Artificial Sequence
  RNA Oligomer
aaccaccaguaauacuucugg

SEQ ID NO: 30665 - RNA, 21 nt, Artificial Sequence
  RNA Oligomer
auguaggagaacaugaaagag

SEQ ID NO: 30666 - RNA, 21 nt, Artificial Sequence
  RNA Oligomer
ucuucccaugucaguuccucc

SEQ ID NO: 30667 - RNA, 21 nt, Artificial Sequence
  RNA Oligomer
gacgaaguugaccuucugugg

SEQ ID NO: 30668 - RNA, 21 nt, Artificial Sequence
  RNA Oligomer
augccagacaaagacauuggg

SEQ ID NO: 30669 - RNA, 21 nt, Artificial Sequence
  RNA Oligomer
uuucggauuucuucaaucucc

SEQ ID NO: 30670 - RNA, 21 nt, Artificial Sequence
  RNA Oligomer
uucucaaaccaguagcgguca

SEQ ID NO: 30671 - RNA, 21 nt, Artificial Sequence
  RNA Oligomer
aucuucaaccaacacaugguc

SEQ ID NO: 30672 - RNA, 21 nt, Artificial Sequence
  RNA Oligomer
guguuuucugcaggaagcugg

SEQ ID NO: 30673 - RNA, 21 nt, Artificial Sequence
  RNA Oligomer
augcgaauguugaggaacucg

SEQ ID NO: 30674 - RNA, 21 nt, Artificial Sequence
  RNA Oligomer
uaccuccugcaaggcauuugc

SEQ ID NO: 30675 - RNA, 21 nt, Artificial Sequence
  RNA Oligomer
ugacaggccuuuuccacauuc

SEQ ID NO: 30676 - RNA, 21 nt, Artificial Sequence
  RNA Oligomer
acuccgguucagaaccuucug

SEQ ID NO: 30677 - RNA, 21 nt, Artificial Sequence
  RNA Oligomer
aucaucauggaagaggccagg

SEQ ID NO: 30678 - RNA, 21 nt, Artificial Sequence
  RNA Oligomer
uugaggaagguuucucgcagg

SEQ ID NO: 30679 - RNA, 21 nt, Artificial Sequence
  RNA Oligomer
aaagagaugcuggcugcugug

SEQ ID NO: 30680 - RNA, 21 nt, Artificial Sequence
  RNA Oligomer
uuccuccuuguccuggaaucc

SEQ ID NO: 30681 - RNA, 21 nt, Artificial Sequence
  RNA Oligomer
agccauugccauccuugucag

SEQ ID NO: 30682 - RNA, 21 nt, Artificial Sequence
  RNA Oligomer
uuccaaagcuuccaugccucc

SEQ ID NO: 30683 - RNA, 21 nt, Artificial Sequence
  RNA Oligomer
uucuuggagaacagcccauuc

SEQ ID NO: 30684 - RNA, 21 nt, Artificial Sequence
  RNA Oligomer
auuguucaaggacgauggugc

SEQ ID NO: 30685 - RNA, 21 nt, Artificial Sequence
  RNA Oligomer
uuguucaaggacgauggugcu

SEQ ID NO: 30686 - RNA, 21 nt, Artificial Sequence
  RNA Oligomer
aaccaacacaugguccucucg

SEQ ID NO: 30687 - RNA, 21 nt, Artificial Sequence
  RNA Oligomer
uguuuucugcaggaagcuggg

SEQ ID NO: 30688 - RNA, 21 nt, Artificial Sequence
  RNA Oligomer
uuuucugcaggaagcugggca

SEQ ID NO: 30689 - RNA, 21 nt, Artificial Sequence
  RNA Oligomer
cauugcauacauagguauugg

SEQ ID NO: 30690 - RNA, 21 nt, Artificial Sequence
  RNA Oligomer
cuugagaugguguugcuaagg

SEQ ID NO: 30691 - RNA, 21 nt, Artificial Sequence
  RNA Oligomer
aacgugcuuaaaaccuugggu

SEQ ID NO: 30692 - RNA, 21 nt, Artificial Sequence
  RNA Oligomer
augguguugcuaaggucucgg

SEQ ID NO: 30693 - RNA, 21 nt, Artificial Sequence
  RNA Oligomer
guagggaggguucuaagaugc

SEQ ID NO: 30694 - RNA, 21 nt, Artificial Sequence
  RNA Oligomer
acacauggugacugacuaugg

SEQ ID NO: 30695 - RNA, 21 nt, Artificial Sequence
  RNA Oligomer
cacauggugacugacuauggc

SEQ ID NO: 30696 - RNA, 21 nt, Artificial Sequence
  RNA Oligomer
cuuacagaacacuuggcagcu

SEQ ID NO: 30697 - RNA, 21 nt, Artificial Sequence
  RNA Oligomer
augucccaaaauggagacccu

SEQ ID NO: 30698 - RNA, 21 nt, Artificial Sequence
  RNA Oligomer
aaaggcguaguaguaggcccu

SEQ ID NO: 30699 - RNA, 21 nt, Artificial Sequence
  RNA Oligomer
caugaagugaaaaucuuccca

SEQ ID NO: 30700 - RNA, 21 nt, Artificial Sequence
  RNA Oligomer
ccuuucaugaagaccaccagg

SEQ ID NO: 30701 - RNA, 21 nt, Artificial Sequence
  RNA Oligomer
ugccagacaaagacauugggc

SEQ ID NO: 30702 - RNA, 21 nt, Artificial Sequence
  RNA Oligomer
aauguugauaacagcgaccag

SEQ ID NO: 30703 - RNA, 21 nt, Artificial Sequence
  RNA Oligomer
aauuguucaaggacgauggug

SEQ ID NO: 30704 - RNA, 21 nt, Artificial Sequence
  RNA Oligomer
auaaguccugguuguacaggg

SEQ ID NO: 30705 - RNA, 21 nt, Artificial Sequence
  RNA Oligomer
auacauagguauugggccagg

SEQ ID NO: 30706 - RNA, 21 nt, Artificial Sequence
  RNA Oligomer
cagggucugaugaaagaacgu

SEQ ID NO: 30707 - RNA, 21 nt, Artificial Sequence
  RNA Oligomer
gaugguguugcuaaggucucg

SEQ ID NO: 30708 - RNA, 21 nt, Artificial Sequence
  RNA Oligomer
acauggugacugacuauggcc

SEQ ID NO: 30709 - RNA, 21 nt, Artificial Sequence
  RNA Oligomer
caugagguuguuguaccaccc

SEQ ID NO: 30710 - RNA, 21 nt, Artificial Sequence
  RNA Oligomer
aaaucagagaaggcugaggca

SEQ ID NO: 30711 - RNA, 21 nt, Artificial Sequence
  RNA Oligomer
augagguuguuguaccaccca

SEQ ID NO: 30712 - RNA, 21 nt, Artificial Sequence
  RNA Oligomer
uccugccuguugaugagcuga

SEQ ID NO: 30713 - RNA, 21 nt, Artificial Sequence
  RNA Oligomer
uacagcauagugguccugagg

SEQ ID NO: 30714 - RNA, 21 nt, Artificial Sequence
  RNA Oligomer
aaguagaucuucuuacagaac

SEQ ID NO: 30715 - RNA, 21 nt, Artificial Sequence
  RNA Oligomer
agaaguguccaugcuagagcc

SEQ ID NO: 30716 - RNA, 21 nt, Artificial Sequence
  RNA Oligomer
augaugagcaggacauagagc

SEQ ID NO: 30717 - RNA, 21 nt, Artificial Sequence
  RNA Oligomer
guacacauucaccacauggcc

SEQ ID NO: 30718 - RNA, 21 nt, Artificial Sequence
  RNA Oligomer
uaguucucaaugaagcgcuug

SEQ ID NO: 30719 - RNA, 21 nt, Artificial Sequence
  RNA Oligomer
gacagcugcguuggaacuucu

SEQ ID NO: 30720 - RNA, 21 nt, Artificial Sequence
  RNA Oligomer
gcaugaagugaaaaucuuccc

SEQ ID NO: 30721 - RNA, 21 nt, Artificial Sequence
  RNA Oligomer
augaagugaaaaucuucccau

SEQ ID NO: 30722 - RNA, 21 nt, Artificial Sequence
  RNA Oligomer
aaggcgagacuuuuccucagg

SEQ ID NO: 30723 - RNA, 21 nt, Artificial Sequence
  RNA Oligomer
uucggauuucuucaaucuccu

SEQ ID NO: 30724 - RNA, 21 nt, Artificial Sequence
  RNA Oligomer
guguucucaaaccaguagcgg

SEQ ID NO: 30725 - RNA, 21 nt, Artificial Sequence
  RNA Oligomer
aaguccugguuguacagggca

SEQ ID NO: 30726 - RNA, 21 nt, Artificial Sequence
  RNA Oligomer
ugugcgggaaaacuucagugg

SEQ ID NO: 30727 - RNA, 21 nt, Artificial Sequence
  RNA Oligomer
augcgaggaaccauagauggc

SEQ ID NO: 30728 - RNA, 21 nt, Artificial Sequence
  RNA Oligomer
uugagaugguguugcuaaggu

SEQ ID NO: 30729 - RNA, 21 nt, Artificial Sequence
  RNA Oligomer
gaaaucagagaaggcugaggc

SEQ ID NO: 30730 - RNA, 21 nt, Artificial Sequence
  RNA Oligomer
auagugguccugaggucgaac

SEQ ID NO: 30731 - RNA, 21 nt, Artificial Sequence
  RNA Oligomer
cuccaaaugguccaucaaggu

SEQ ID NO: 30732 - RNA, 21 nt, Artificial Sequence
  RNA Oligomer
augguccaucaagguacagcu

SEQ ID NO: 30733 - RNA, 21 nt, Artificial Sequence
  RNA Oligomer
accaccaguaauacuucuggg

SEQ ID NO: 30734 - RNA, 21 nt, Artificial Sequence
  RNA Oligomer
uacacauucaccacauggccc

SEQ ID NO: 30735 - RNA, 21 nt, Artificial Sequence
  RNA Oligomer
uuagaaugucccaaaauggag

SEQ ID NO: 30736 - RNA, 21 nt, Artificial Sequence
  RNA Oligomer
augaaagagaugcuggcugcu

SEQ ID NO: 30737 - RNA, 21 nt, Artificial Sequence
  RNA Oligomer
ggagagggacagaucauaucc

SEQ ID NO: 30738 - RNA, 21 nt, Artificial Sequence
  RNA Oligomer
aucauauccuggcugauguag

SEQ ID NO: 30739 - RNA, 21 nt, Artificial Sequence
  RNA Oligomer
aucuucccaugucaguuccuc

SEQ ID NO: 30740 - RNA, 21 nt, Artificial Sequence
  RNA Oligomer
uuguuggagaucucgaugaag

SEQ ID NO: 30741 - RNA, 21 nt, Artificial Sequence
  RNA Oligomer
augaaggaucucagcauccug

SEQ ID NO: 30742 - RNA, 21 nt, Artificial Sequence
  RNA Oligomer
auaaggcgagacuuuuccuca

SEQ ID NO: 30743 - RNA, 21 nt, Artificial Sequence
  RNA Oligomer
caugaagaccaccaggauguc

SEQ ID NO: 30744 - RNA, 21 nt, Artificial Sequence
  RNA Oligomer
aaguugaccuucuguggaggc

SEQ ID NO: 30745 - RNA, 21 nt, Artificial Sequence
  RNA Oligomer
gaaauuucucauccggagccg

SEQ ID NO: 30746 - RNA, 21 nt, Artificial Sequence
  RNA Oligomer
auuucggauuucuucaaucuc

SEQ ID NO: 30747 - RNA, 21 nt, Artificial Sequence
  RNA Oligomer
aaucuccuucuuggagaacag

SEQ ID NO: 30748 - RNA, 21 nt, Artificial Sequence
  RNA Oligomer
acaucuucaaccaacacaugg

SEQ ID NO: 30749 - RNA, 21 nt, Artificial Sequence
  RNA Oligomer
cucuggagacacuugaguucc

SEQ ID NO: 30750 - RNA, 21 nt, Artificial Sequence
  RNA Oligomer
uacuccgggaguguuuucugc

SEQ ID NO: 30751 - RNA, 21 nt, Artificial Sequence
  RNA Oligomer
acuccgggaguguuuucugca

SEQ ID NO: 30752 - RNA, 21 nt, Artificial Sequence
  RNA Oligomer
gggucugaugaaagaacgugc

SEQ ID NO: 30753 - RNA, 21 nt, Artificial Sequence
  RNA Oligomer
aagaugccagcauccaugcuc

SEQ ID NO: 30754 - RNA, 21 nt, Artificial Sequence
  RNA Oligomer
uuguuucugaagucuggaagc

SEQ ID NO: 30755 - RNA, 21 nt, Artificial Sequence
  RNA Oligomer
uccaugagguuguuguaccac

SEQ ID NO: 30756 - RNA, 21 nt, Artificial Sequence
  RNA Oligomer
uauggccaccuggaacaaggu

SEQ ID NO: 30757 - RNA, 21 nt, Artificial Sequence
  RNA Oligomer
agaaguucucauaaugguggg

SEQ ID NO: 30758 - RNA, 21 nt, Artificial Sequence
  RNA Oligomer
aauggugggagaagugagucc

SEQ ID NO: 30759 - RNA, 21 nt, Artificial Sequence
  RNA Oligomer
ugggaccaggaagaagaugug

SEQ ID NO: 30760 - RNA, 21 nt, Artificial Sequence
  RNA Oligomer
acccaucaucauggaagaggc

SEQ ID NO: 30761 - RNA, 21 nt, Artificial Sequence
  RNA Oligomer
auuagaaugucccaaaaugga

SEQ ID NO: 30762 - RNA, 21 nt, Artificial Sequence
  RNA Oligomer
aaugaggcgauggaaguccac

SEQ ID NO: 30763 - RNA, 21 nt, Artificial Sequence
  RNA Oligomer
agaaugucccaaaauggagac

SEQ ID NO: 30764 - RNA, 21 nt, Artificial Sequence
  RNA Oligomer
aagauguaggagaacaugaaa

SEQ ID NO: 30765 - RNA, 21 nt, Artificial Sequence
  RNA Oligomer
uucucaaugaagcgcuugaac

SEQ ID NO: 30766 - RNA, 21 nt, Artificial Sequence
  RNA Oligomer
gaagcgcuugaacuguugcac

SEQ ID NO: 30767 - RNA, 21 nt, Artificial Sequence
  RNA Oligomer
aacagcaagggcuggaaugac

SEQ ID NO: 30768 - RNA, 21 nt, Artificial Sequence
  RNA Oligomer
aacucauccuuggaaaugagg

SEQ ID NO: 30769 - RNA, 21 nt, Artificial Sequence
  RNA Oligomer
ucauccuuggaaaugaggcca

SEQ ID NO: 30770 - RNA, 21 nt, Artificial Sequence
  RNA Oligomer
guacaugcggaacauaaggcg

SEQ ID NO: 30771 - RNA, 21 nt, Artificial Sequence
  RNA Oligomer
uaaggcgagacuuuuccucag

SEQ ID NO: 30772 - RNA, 21 nt, Artificial Sequence
  RNA Oligomer
agacuuuuccucaggagagcc

SEQ ID NO: 30773 - RNA, 21 nt, Artificial Sequence
  RNA Oligomer
aggacgaaguugaccuucugu

SEQ ID NO: 30774 - RNA, 21 nt, Artificial Sequence
  RNA Oligomer
auuccaaagcuuccaugccuc

SEQ ID NO: 30775 - RNA, 21 nt, Artificial Sequence
  RNA Oligomer
uucucagacacgaugcucugg

SEQ ID NO: 30776 - RNA, 21 nt, Artificial Sequence
  RNA Oligomer
aaauuucucauccggagccgg

SEQ ID NO: 30777 - RNA, 21 nt, Artificial Sequence
  RNA Oligomer
ucaauguugauaacagcgacc

SEQ ID NO: 30778 - RNA, 21 nt, Artificial Sequence
  RNA Oligomer
uugauaacagcgaccagcacg

SEQ ID NO: 30779 - RNA, 21 nt, Artificial Sequence
  RNA Oligomer
uuccugguguucucaaaccag

SEQ ID NO: 30780 - RNA, 21 nt, Artificial Sequence
  RNA Oligomer
uaaugggagacaagcccagug

SEQ ID NO: 30781 - RNA, 21 nt, Artificial Sequence
  RNA Oligomer
cuuuguaggcuugggugcuca

SEQ ID NO: 30782 - RNA, 21 nt, Artificial Sequence
  RNA Oligomer
gagacacuugaguuccgauug

SEQ ID NO: 30783 - RNA, 21 nt, Artificial Sequence
  RNA Oligomer
auacuccgggaguguuuucug

SEQ ID NO: 30784 - RNA, 21 nt, Artificial Sequence
  RNA Oligomer
uauuuggaagggagacuacug

SEQ ID NO: 30785 - RNA, 21 nt, Artificial Sequence
  RNA Oligomer
acgugcuuaaaaccuugggug

SEQ ID NO: 30786 - RNA, 21 nt, Artificial Sequence
  RNA Oligomer
guaaauggcuugccauggguc

SEQ ID NO: 30787 - RNA, 21 nt, Artificial Sequence
  RNA Oligomer
ugagauuuguuucugaagucu

SEQ ID NO: 30788 - RNA, 21 nt, Artificial Sequence
  RNA Oligomer
agauuuguuucugaagucugg

SEQ ID NO: 30789 - RNA, 21 nt, Artificial Sequence
  RNA Oligomer
aagucuggaagcagagguuuc

SEQ ID NO: 30790 - RNA, 21 nt, Artificial Sequence
  RNA Oligomer
auggugacugacuauggccac

SEQ ID NO: 30791 - RNA, 21 nt, Artificial Sequence
  RNA Oligomer
aaguucucauaauggugggag

SEQ ID NO: 30792 - RNA, 21 nt, Artificial Sequence
  RNA Oligomer
uuccacauucuuggucaugcc

SEQ ID NO: 30793 - RNA, 21 nt, Artificial Sequence
  RNA Oligomer
ucaaacuuaugccacuccugg

SEQ ID NO: 30794 - RNA, 21 nt, Artificial Sequence
  RNA Oligomer
uccaucaagguacagcuuugg

SEQ ID NO: 30795 - RNA, 21 nt, Artificial Sequence
  RNA Oligomer
cccaugaugaaaauaauaggg

SEQ ID NO: 30796 - RNA, 21 nt, Artificial Sequence
  RNA Oligomer
uucucgcaggaaggugaugag

SEQ ID NO: 30797 - RNA, 21 nt, Artificial Sequence
  RNA Oligomer
gaaugucccaaaauggagacc

SEQ ID NO: 30798 - RNA, 21 nt, Artificial Sequence
  RNA Oligomer
cgaugaaggaucucagcaucc

SEQ ID NO: 30799 - RNA, 21 nt, Artificial Sequence
  RNA Oligomer
uacaugcggaacauaaggcga

SEQ ID NO: 30800 - RNA, 21 nt, Artificial Sequence
  RNA Oligomer
auggacuccacaaacaugucc

SEQ ID NO: 30801 - RNA, 21 nt, Artificial Sequence
  RNA Oligomer
aaaaaggucuccaggaggugc

SEQ ID NO: 30802 - RNA, 21 nt, Artificial Sequence
  RNA Oligomer
gucaauguugauaacagcgac

SEQ ID NO: 30803 - RNA, 21 nt, Artificial Sequence
  RNA Oligomer
auuccugguguucucaaacca

SEQ ID NO: 30804 - RNA, 21 nt, Artificial Sequence
  RNA Oligomer
ucaaaccaguagcggucacca

SEQ ID NO: 30805 - RNA, 21 nt, Artificial Sequence
  RNA Oligomer
agcucuagccaggauaagucc

SEQ ID NO: 30806 - RNA, 21 nt, Artificial Sequence
  RNA Oligomer
cauacauagguauugggccag

SEQ ID NO: 30807 - RNA, 21 nt, Artificial Sequence
  RNA Oligomer
gagaugguguugcuaaggucu

SEQ ID NO: 30808 - RNA, 21 nt, Artificial Sequence
  RNA Oligomer
gguuucuguaaauggcuugcc

SEQ ID NO: 30809 - RNA, 21 nt, Artificial Sequence
  RNA Oligomer
gaggguucuaagaugccagca

SEQ ID NO: 30810 - RNA, 21 nt, Artificial Sequence
  RNA Oligomer
ucuucugagauuuguuucuga

SEQ ID NO: 30811 - RNA, 21 nt, Artificial Sequence
  RNA Oligomer
gauuuguuucugaagucugga

SEQ ID NO: 30812 - RNA, 21 nt, Artificial Sequence
  RNA Oligomer
gaggugggaaaucagagaagg

SEQ ID NO: 30813 - RNA, 21 nt, Artificial Sequence
  RNA Oligomer
acagauguacagcauaguggu

SEQ ID NO: 30814 - RNA, 21 nt, Artificial Sequence
  RNA Oligomer
gaaguguccaugcuagagcca

SEQ ID NO: 30815 - RNA, 21 nt, Artificial Sequence
  RNA Oligomer
aaugguccaucaagguacagc

SEQ ID NO: 30816 - RNA, 21 nt, Artificial Sequence
  RNA Oligomer
uggaagaaccaccaguaauac

SEQ ID NO: 30817 - RNA, 21 nt, Artificial Sequence
  RNA Oligomer
agacccaucaucauggaagag

SEQ ID NO: 30818 - RNA, 21 nt, Artificial Sequence
  RNA Oligomer
cacacuguguaagacugugag

SEQ ID NO: 30819 - RNA, 21 nt, Artificial Sequence
  RNA Oligomer
acagcugcguuggaacuucuc

SEQ ID NO: 30820 - RNA, 21 nt, Artificial Sequence
  RNA Oligomer
agagggacagaucauauccug

SEQ ID NO: 30821 - RNA, 21 nt, Artificial Sequence
  RNA Oligomer
uuggacaggcaguuguuggag

SEQ ID NO: 30822 - RNA, 21 nt, Artificial Sequence
  RNA Oligomer
cuuggaaaugaggccauuccc

SEQ ID NO: 30823 - RNA, 21 nt, Artificial Sequence
  RNA Oligomer
aaagucguacaugcggaacau

SEQ ID NO: 30824 - RNA, 21 nt, Artificial Sequence
  RNA Oligomer
ucagccagagagaacauggac

SEQ ID NO: 30825 - RNA, 21 nt, Artificial Sequence
  RNA Oligomer
agccagagagaacauggacuc

SEQ ID NO: 30826 - RNA, 21 nt, Artificial Sequence
  RNA Oligomer
gacuccacaaacauguccugg

SEQ ID NO: 30827 - RNA, 21 nt, Artificial Sequence
  RNA Oligomer
ucuuggagaacagcccauucc

SEQ ID NO: 30828 - RNA, 21 nt, Artificial Sequence
  RNA Oligomer
uucaaggacgauggugcugaa

SEQ ID NO: 30829 - RNA, 21 nt, Artificial Sequence
  RNA Oligomer
ucuagccaggauaaguccugg

SEQ ID NO: 30830 - RNA, 21 nt, Artificial Sequence
  RNA Oligomer
gauaaguccugguuguacagg

SEQ ID NO: 30831 - RNA, 21 nt, Artificial Sequence
  RNA Oligomer
caucuucagcacuuuguaggc

SEQ ID NO: 30832 - RNA, 21 nt, Artificial Sequence
  RNA Oligomer
uuuguaggcuugggugcucac

SEQ ID NO: 30833 - RNA, 21 nt, Artificial Sequence
  RNA Oligomer
aauggccgguauccuguauac

SEQ ID NO: 30834 - RNA, 21 nt, Artificial Sequence
  RNA Oligomer
guuucuguaaauggcuugcca

SEQ ID NO: 30835 - RNA, 21 nt, Artificial Sequence
  RNA Oligomer
gucuucugagauuuguuucug

SEQ ID NO: 30836 - RNA, 21 nt, Artificial Sequence
  RNA Oligomer
gagauuuguuucugaagucug

SEQ ID NO: 30837 - RNA, 21 nt, Artificial Sequence
  RNA Oligomer
uuuguuucugaagucuggaag

SEQ ID NO: 30838 - RNA, 21 nt, Artificial Sequence
  RNA Oligomer
aagugccgcucacagauguac

SEQ ID NO: 30839 - RNA, 21 nt, Artificial Sequence
  RNA Oligomer
ucacagauguacagcauagug

SEQ ID NO: 30840 - RNA, 21 nt, Artificial Sequence
  RNA Oligomer
cacagauguacagcauagugg

SEQ ID NO: 30841 - RNA, 21 nt, Artificial Sequence
  RNA Oligomer
agauguacagcauaguggucc

SEQ ID NO: 30842 - RNA, 21 nt, Artificial Sequence
  RNA Oligomer
ggcucagggauuagaaugucc

SEQ ID NO: 30843 - RNA, 21 nt, Artificial Sequence
  RNA Oligomer
acacuguguaagacugugagg

SEQ ID NO: 30844 - RNA, 21 nt, Artificial Sequence
  RNA Oligomer
uuucucgcaggaaggugauga

SEQ ID NO: 30845 - RNA, 21 nt, Artificial Sequence
  RNA Oligomer
auauccuggcugauguaggag

SEQ ID NO: 30846 - RNA, 21 nt, Artificial Sequence
  RNA Oligomer
agguccuugaugacuucaggc

SEQ ID NO: 30847 - RNA, 21 nt, Artificial Sequence
  RNA Oligomer
uugaugacuucaggcaccucc

SEQ ID NO: 30848 - RNA, 21 nt, Artificial Sequence
  RNA Oligomer
cagcaugaagugaaaaucuuc

SEQ ID NO: 30849 - RNA, 21 nt, Artificial Sequence
  RNA Oligomer
agcaugaagugaaaaucuucc

SEQ ID NO: 30850 - RNA, 21 nt, Artificial Sequence
  RNA Oligomer
aucaaagucguacaugcggaa

SEQ ID NO: 30851 - RNA, 21 nt, Artificial Sequence
  RNA Oligomer
aaggacagguagccauugcca

SEQ ID NO: 30852 - RNA, 21 nt, Artificial Sequence
  RNA Oligomer
ugucagccagagagaacaugg

SEQ ID NO: 30853 - RNA, 21 nt, Artificial Sequence
  RNA Oligomer
uugaaauuucucauccggagc

SEQ ID NO: 30854 - RNA, 21 nt, Artificial Sequence
  RNA Oligomer
ugaaauuucucauccggagcc

SEQ ID NO: 30855 - RNA, 21 nt, Artificial Sequence
  RNA Oligomer
cagacaaagacauugggcugc

SEQ ID NO: 30856 - RNA, 21 nt, Artificial Sequence
  RNA Oligomer
caauguugauaacagcgacca

SEQ ID NO: 30857 - RNA, 21 nt, Artificial Sequence
  RNA Oligomer
aucuccuucuuggagaacagc

SEQ ID NO: 30858 - RNA, 21 nt, Artificial Sequence
  RNA Oligomer
uucagcacuuuguaggcuugg

SEQ ID NO: 30859 - RNA, 21 nt, Artificial Sequence
  RNA Oligomer
ucuggagacacuugaguuccg

SEQ ID NO: 30860 - RNA, 21 nt, Artificial Sequence
  RNA Oligomer
cuggagacacuugaguuccga

SEQ ID NO: 30861 - RNA, 21 nt, Artificial Sequence
  RNA Oligomer
cuggcauuucucauguagacg

SEQ ID NO: 30862 - RNA, 21 nt, Artificial Sequence
  RNA Oligomer
auuuauuuggaagggagacua

SEQ ID NO: 30863 - RNA, 21 nt, Artificial Sequence
  RNA Oligomer
uucugagauuuguuucugaag

SEQ ID NO: 30864 - RNA, 21 nt, Artificial Sequence
  RNA Oligomer
cugagauuuguuucugaaguc

SEQ ID NO: 30865 - RNA, 21 nt, Artificial Sequence
  RNA Oligomer
aaucagagaaggcugaggcag

SEQ ID NO: 30866 - RNA, 21 nt, Artificial Sequence
  RNA Oligomer
ugccuguugaugagcugacag

SEQ ID NO: 30867 - RNA, 21 nt, Artificial Sequence
  RNA Oligomer
guagaugugcacagacaccag

SEQ ID NO: 30868 - RNA, 21 nt, Artificial Sequence
  RNA Oligomer
uagaugugcacagacaccagg

SEQ ID NO: 30869 - RNA, 21 nt, Artificial Sequence
  RNA Oligomer
uugaagaccaggucuuugagg

SEQ ID NO: 30870 - RNA, 21 nt, Artificial Sequence
  RNA Oligomer
aaacuuaugccacuccuggug

SEQ ID NO: 30871 - RNA, 21 nt, Artificial Sequence
  RNA Oligomer
auagaugauugcugggaccag

SEQ ID NO: 30872 - RNA, 21 nt, Artificial Sequence
  RNA Oligomer
uagaugauugcugggaccagg

SEQ ID NO: 30873 - RNA, 21 nt, Artificial Sequence
  RNA Oligomer
uacaugauggccaggaucagg

SEQ ID NO: 30874 - RNA, 21 nt, Artificial Sequence
  RNA Oligomer
cucagggauuagaauguccca

SEQ ID NO: 30875 - RNA, 21 nt, Artificial Sequence
  RNA Oligomer
gaacagguacacauucaccac

SEQ ID NO: 30876 - RNA, 21 nt, Artificial Sequence
  RNA Oligomer
agguacacauucaccacaugg

SEQ ID NO: 30877 - RNA, 21 nt, Artificial Sequence
  RNA Oligomer
aagguuucucgcaggaaggug

SEQ ID NO: 30878 - RNA, 21 nt, Artificial Sequence
  RNA Oligomer
agggcuggaaugacguuaccu

SEQ ID NO: 30879 - RNA, 21 nt, Artificial Sequence
  RNA Oligomer
cucugaggugucaacucaguc

SEQ ID NO: 30880 - RNA, 21 nt, Artificial Sequence
  RNA Oligomer
acucagucucaaugucgcugc

SEQ ID NO: 30881 - RNA, 21 nt, Artificial Sequence
  RNA Oligomer
agggacagaucauauccuggc

SEQ ID NO: 30882 - RNA, 21 nt, Artificial Sequence
  RNA Oligomer
uauccuggcugauguaggagg

SEQ ID NO: 30883 - RNA, 21 nt, Artificial Sequence
  RNA Oligomer
guuggagaucucgaugaagga

SEQ ID NO: 30884 - RNA, 21 nt, Artificial Sequence
  RNA Oligomer
auccugaugaacucauccuug

SEQ ID NO: 30885 - RNA, 21 nt, Artificial Sequence
  RNA Oligomer
auugccauccuugucagccag

SEQ ID NO: 30886 - RNA, 21 nt, Artificial Sequence
  RNA Oligomer
cagagagaacauggacuccac

SEQ ID NO: 30887 - RNA, 21 nt, Artificial Sequence
  RNA Oligomer
aaaaggugccugaaaaagguc

SEQ ID NO: 30888 - RNA, 21 nt, Artificial Sequence
  RNA Oligomer
gacaggacgaaguugaccuuc

SEQ ID NO: 30889 - RNA, 21 nt, Artificial Sequence
  RNA Oligomer
gccauuccaaagcuuccaugc

SEQ ID NO: 30890 - RNA, 21 nt, Artificial Sequence
  RNA Oligomer
agcuucucagacacgaugcuc

SEQ ID NO: 30891 - RNA, 21 nt, Artificial Sequence
  RNA Oligomer
cuuggagaacagcccauuccu

SEQ ID NO: 30892 - RNA, 21 nt, Artificial Sequence
  RNA Oligomer
ugguguucucaaaccaguagc

SEQ ID NO: 30893 - RNA, 21 nt, Artificial Sequence
  RNA Oligomer
gguguucucaaaccaguagcg

SEQ ID NO: 30894 - RNA, 21 nt, Artificial Sequence
  RNA Oligomer
agccaggauaaguccugguug

SEQ ID NO: 30895 - RNA, 21 nt, Artificial Sequence
  RNA Oligomer
cagcuggcauuucucauguag

SEQ ID NO: 30896 - RNA, 21 nt, Artificial Sequence
  RNA Oligomer
uggcauuucucauguagacgc

SEQ ID NO: 30897 - RNA, 21 nt, Artificial Sequence
  RNA Oligomer
uauccuguauacuccgggagu

SEQ ID NO: 30898 - RNA, 21 nt, Artificial Sequence
  RNA Oligomer
aaagcacgugauagccaaaga

SEQ ID NO: 30899 - RNA, 21 nt, Artificial Sequence
  RNA Oligomer
aagcacgugauagccaaagaa

SEQ ID NO: 30900 - RNA, 21 nt, Artificial Sequence
  RNA Oligomer
aacacugugcgguuucucagg

SEQ ID NO: 30901 - RNA, 21 nt, Artificial Sequence
  RNA Oligomer
uuuggaagggagacuacugga

SEQ ID NO: 30902 - RNA, 21 nt, Artificial Sequence
  RNA Oligomer
ugcauacauagguauugggcc

SEQ ID NO: 30903 - RNA, 21 nt, Artificial Sequence
  RNA Oligomer
uauugggccagggucugauga

SEQ ID NO: 30904 - RNA, 21 nt, Artificial Sequence
  RNA Oligomer
gaagcagagguuucacuuugc

SEQ ID NO: 30905 - RNA, 21 nt, Artificial Sequence
  RNA Oligomer
aggugggaaaucagagaaggc

SEQ ID NO: 30906 - RNA, 21 nt, Artificial Sequence
  RNA Oligomer
uuuuccacauucuuggucaug

SEQ ID NO: 30907 - RNA, 21 nt, Artificial Sequence
  RNA Oligomer
uuuccacauucuuggucaugc

SEQ ID NO: 30908 - RNA, 21 nt, Artificial Sequence
  RNA Oligomer
agacuccgguucagaaccuuc

SEQ ID NO: 30909 - RNA, 21 nt, Artificial Sequence
  RNA Oligomer
uguacagcauagugguccuga

SEQ ID NO: 30910 - RNA, 21 nt, Artificial Sequence
  RNA Oligomer
agaugugcacagacaccaggu

SEQ ID NO: 30911 - RNA, 21 nt, Artificial Sequence
  RNA Oligomer
guagaucuucuuacagaacac

SEQ ID NO: 30912 - RNA, 21 nt, Artificial Sequence
  RNA Oligomer
aaccagaaguguccaugcuag

SEQ ID NO: 30913 - RNA, 21 nt, Artificial Sequence
  RNA Oligomer
ccaucaagguacagcuuuggg

SEQ ID NO: 30914 - RNA, 21 nt, Artificial Sequence
  RNA Oligomer
gcucagggauuagaauguccc

SEQ ID NO: 30915 - RNA, 21 nt, Artificial Sequence
  RNA Oligomer
gaaccaccaguaauacuucug

SEQ ID NO: 30916 - RNA, 21 nt, Artificial Sequence
  RNA Oligomer
ucaucauggaagaggccagga

SEQ ID NO: 30917 - RNA, 21 nt, Artificial Sequence
  RNA Oligomer
aaagaggcaagagaggacgcu

SEQ ID NO: 30918 - RNA, 21 nt, Artificial Sequence
  RNA Oligomer
caaugaggcgauggaagucca

SEQ ID NO: 30919 - RNA, 21 nt, Artificial Sequence
  RNA Oligomer
ucaaugaagcgcuugaacugu

SEQ ID NO: 30920 - RNA, 21 nt, Artificial Sequence
  RNA Oligomer
ugaggugucaacucagucuca

SEQ ID NO: 30921 - RNA, 21 nt, Artificial Sequence
  RNA Oligomer
gaucucgaugaaggaucucag

SEQ ID NO: 30922 - RNA, 21 nt, Artificial Sequence
  RNA Oligomer
cucagcauccugaugaacuca

SEQ ID NO: 30923 - RNA, 21 nt, Artificial Sequence
  RNA Oligomer
acucauccuuggaaaugaggc

SEQ ID NO: 30924 - RNA, 21 nt, Artificial Sequence
  RNA Oligomer
uccuuggaaaugaggccauuc

SEQ ID NO: 30925 - RNA, 21 nt, Artificial Sequence
  RNA Oligomer
uuuccucaggagagccuuuca

SEQ ID NO: 30926 - RNA, 21 nt, Artificial Sequence
  RNA Oligomer
aaaggugccugaaaaaggucu

SEQ ID NO: 30927 - RNA, 21 nt, Artificial Sequence
  RNA Oligomer
gaaguugaccuucuguggagg

SEQ ID NO: 30928 - RNA, 21 nt, Artificial Sequence
  RNA Oligomer
cuucucagacacgaugcucug

SEQ ID NO: 30929 - RNA, 21 nt, Artificial Sequence
  RNA Oligomer
aacagcccauuccugguguuc

SEQ ID NO: 30930 - RNA, 21 nt, Artificial Sequence
  RNA Oligomer
aucuucagcacuuuguaggcu

SEQ ID NO: 30931 - RNA, 21 nt, Artificial Sequence
  RNA Oligomer
agcacuuuguaggcuugggug

SEQ ID NO: 30932 - RNA, 21 nt, Artificial Sequence
  RNA Oligomer
uauacuccgggaguguuuucu

SEQ ID NO: 30933 - RNA, 21 nt, Artificial Sequence
  RNA Oligomer
uacacagcgauguucugguag

SEQ ID NO: 30934 - RNA, 21 nt, Artificial Sequence
  RNA Oligomer
augcucccacugcauccuuac

SEQ ID NO: 30935 - RNA, 21 nt, Artificial Sequence
  RNA Oligomer
uacuugucaggucagcuuguc

SEQ ID NO: 30936 - RNA, 21 nt, Artificial Sequence
  RNA Oligomer
uucugaagucuggaagcagag

SEQ ID NO: 30937 - RNA, 21 nt, Artificial Sequence
  RNA Oligomer
gaaguucucauaaugguggga

SEQ ID NO: 30938 - RNA, 21 nt, Artificial Sequence
  RNA Oligomer
cucauaauggugggagaagug

SEQ ID NO: 30939 - RNA, 23 nt, Artificial Sequence
  RNA Oligomer
ccaguaauuagauguagaaucuu

SEQ ID NO: 30940 - RNA, 23 nt, Artificial Sequence
  RNA Oligomer
accaguaauuagauguagaaucu

SEQ ID NO: 30941 - RNA, 23 nt, Artificial Sequence
  RNA Oligomer
uaccaguaauuagauguagaauc

SEQ ID NO: 30942 - RNA, 23 nt, Artificial Sequence
  RNA Oligomer
guaccaguaauuagauguagaau

SEQ ID NO: 30943 - RNA, 23 nt, Artificial Sequence
  RNA Oligomer
gguaccaguaauuagauguagaa

SEQ ID NO: 30944 - RNA, 23 nt, Artificial Sequence
  RNA Oligomer
ccaagaauuaaaccaagacaaag

SEQ ID NO: 30945 - RNA, 23 nt, Artificial Sequence
  RNA Oligomer
cccaagaauuaaaccaagacaaa

SEQ ID NO: 30946 - RNA, 23 nt, Artificial Sequence
  RNA Oligomer
acccaagaauuaaaccaagacaa

SEQ ID NO: 30947 - RNA, 23 nt, Artificial Sequence
  RNA Oligomer
uacccaagaauuaaaccaagaca

SEQ ID NO: 30948 - RNA, 23 nt, Artificial Sequence
  RNA Oligomer
guacccaagaauuaaaccaagac

SEQ ID NO: 30949 - RNA, 23 nt, Artificial Sequence
  RNA Oligomer
uguacccaagaauuaaaccaaga

SEQ ID NO: 30950 - RNA, 23 nt, Artificial Sequence
  RNA Oligomer
ggauccaaguuuaaaaagaaaug

SEQ ID NO: 30951 - RNA, 23 nt, Artificial Sequence
  RNA Oligomer
aggauccaaguuuaaaaagaaau

SEQ ID NO: 30952 - RNA, 23 nt, Artificial Sequence
  RNA Oligomer
caggauccaaguuuaaaaagaaa

SEQ ID NO: 30953 - RNA, 23 nt, Artificial Sequence
  RNA Oligomer
ucaggauccaaguuuaaaaagaa

SEQ ID NO: 30954 - RNA, 23 nt, Artificial Sequence
  RNA Oligomer
cucaggauccaaguuuaaaaaga

SEQ ID NO: 30955 - RNA, 23 nt, Artificial Sequence
  RNA Oligomer
caagaauuaaaccaagacaaagg

SEQ ID NO: 30956 - RNA, 23 nt, Artificial Sequence
  RNA Oligomer
ccaacuaaauuacugccuuucuu

SEQ ID NO: 30957 - RNA, 23 nt, Artificial Sequence
  RNA Oligomer
cccaacuaaauuacugccuuucu

SEQ ID NO: 30958 - RNA, 23 nt, Artificial Sequence
  RNA Oligomer
gcccaacuaaauuacugccuuuc

SEQ ID NO: 30959 - RNA, 23 nt, Artificial Sequence
  RNA Oligomer
agcccaacuaaauuacugccuuu

SEQ ID NO: 30960 - RNA, 23 nt, Artificial Sequence
  RNA Oligomer
cagcccaacuaaauuacugccuu

SEQ ID NO: 30961 - RNA, 23 nt, Artificial Sequence
  RNA Oligomer
ggauugaagaauucaccauuaga

SEQ ID NO: 30962 - RNA, 23 nt, Artificial Sequence
  RNA Oligomer
aggauugaagaauucaccauuag

SEQ ID NO: 30963 - RNA, 23 nt, Artificial Sequence
  RNA Oligomer
aaggauugaagaauucaccauua

SEQ ID NO: 30964 - RNA, 23 nt, Artificial Sequence
  RNA Oligomer
gaaggauugaagaauucaccauu

SEQ ID NO: 30965 - RNA, 23 nt, Artificial Sequence
  RNA Oligomer
ugaaggauugaagaauucaccau

SEQ ID NO: 30966 - RNA, 23 nt, Artificial Sequence
  RNA Oligomer
ggacuguacccaagaauuaaacc

SEQ ID NO: 30967 - RNA, 23 nt, Artificial Sequence
  RNA Oligomer
gggacuguacccaagaauuaaac

SEQ ID NO: 30968 - RNA, 23 nt, Artificial Sequence
  RNA Oligomer
ugggacuguacccaagaauuaaa

SEQ ID NO: 30969 - RNA, 23 nt, Artificial Sequence
  RNA Oligomer
cugggacuguacccaagaauuaa

SEQ ID NO: 30970 - RNA, 23 nt, Artificial Sequence
  RNA Oligomer
gcugggacuguacccaagaauua

SEQ ID NO: 30971 - RNA, 23 nt, Artificial Sequence
  RNA Oligomer
ccacagggaagacgaagaugaaa

SEQ ID NO: 30972 - RNA, 23 nt, Artificial Sequence
  RNA Oligomer
uccacagggaagacgaagaugaa

SEQ ID NO: 30973 - RNA, 23 nt, Artificial Sequence
  RNA Oligomer
auccacagggaagacgaagauga

SEQ ID NO: 30974 - RNA, 23 nt, Artificial Sequence
  RNA Oligomer
cauccacagggaagacgaagaug

SEQ ID NO: 30975 - RNA, 23 nt, Artificial Sequence
  RNA Oligomer
ucauccacagggaagacgaagau

SEQ ID NO: 30976 - RNA, 23 nt, Artificial Sequence
  RNA Oligomer
ucccaucauacccauccaaguca

SEQ ID NO: 30977 - RNA, 23 nt, Artificial Sequence
  RNA Oligomer
gucccaucauacccauccaaguc

SEQ ID NO: 30978 - RNA, 23 nt, Artificial Sequence
  RNA Oligomer
ugucccaucauacccauccaagu

SEQ ID NO: 30979 - RNA, 23 nt, Artificial Sequence
  RNA Oligomer
cugucccaucauacccauccaag

SEQ ID NO: 30980 - RNA, 23 nt, Artificial Sequence
  RNA Oligomer
ucugucccaucauacccauccaa

SEQ ID NO: 30981 - RNA, 23 nt, Artificial Sequence
  RNA Oligomer
gcguugaccaagacucauaccag

SEQ ID NO: 30982 - RNA, 23 nt, Artificial Sequence
  RNA Oligomer
cgcguugaccaagacucauacca

SEQ ID NO: 30983 - RNA, 23 nt, Artificial Sequence
  RNA Oligomer
gcgcguugaccaagacucauacc

SEQ ID NO: 30984 - RNA, 23 nt, Artificial Sequence
  RNA Oligomer
agcgcguugaccaagacucauac

SEQ ID NO: 30985 - RNA, 23 nt, Artificial Sequence
  RNA Oligomer
gagcgcguugaccaagacucaua

SEQ ID NO: 30986 - RNA, 23 nt, Artificial Sequence
  RNA Oligomer
acaccuuacuuccacccuucaga

SEQ ID NO: 30987 - RNA, 23 nt, Artificial Sequence
  RNA Oligomer
gacaccuuacuuccacccuucag

SEQ ID NO: 30988 - RNA, 23 nt, Artificial Sequence
  RNA Oligomer
agacaccuuacuuccacccuuca

SEQ ID NO: 30989 - RNA, 23 nt, Artificial Sequence
  RNA Oligomer
aagacaccuuacuuccacccuuc

SEQ ID NO: 30990 - RNA, 23 nt, Artificial Sequence
  RNA Oligomer
aaagacaccuuacuuccacccuu

SEQ ID NO: 30991 - RNA, 23 nt, Artificial Sequence
  RNA Oligomer
cgguaccaguaauuagauguaga

SEQ ID NO: 30992 - RNA, 23 nt, Artificial Sequence
  RNA Oligomer
acgguaccaguaauuagauguag

SEQ ID NO: 30993 - RNA, 23 nt, Artificial Sequence
  RNA Oligomer
uacgguaccaguaauuagaugua

SEQ ID NO: 30994 - RNA, 23 nt, Artificial Sequence
  RNA Oligomer
cgcugagggagaaagagaagaaa

SEQ ID NO: 30995 - RNA, 23 nt, Artificial Sequence
  RNA Oligomer
ccgcugagggagaaagagaagaa

SEQ ID NO: 30996 - RNA, 23 nt, Artificial Sequence
  RNA Oligomer
uccgcugagggagaaagagaaga

SEQ ID NO: 30997 - RNA, 23 nt, Artificial Sequence
  RNA Oligomer
uuccgcugagggagaaagagaag

SEQ ID NO: 30998 - RNA, 23 nt, Artificial Sequence
  RNA Oligomer
guuccgcugagggagaaagagaa

SEQ ID NO: 30999 - RNA, 23 nt, Artificial Sequence
  RNA Oligomer
ggaucugacucuugcugaacuuc

SEQ ID NO: 31000 - RNA, 23 nt, Artificial Sequence
  RNA Oligomer
uggaucugacucuugcugaacuu

SEQ ID NO: 31001 - RNA, 23 nt, Artificial Sequence
  RNA Oligomer
auggaucugacucuugcugaacu

SEQ ID NO: 31002 - RNA, 23 nt, Artificial Sequence
  RNA Oligomer
gauggaucugacucuugcugaac

SEQ ID NO: 31003 - RNA, 23 nt, Artificial Sequence
  RNA Oligomer
ggauggaucugacucuugcugaa

SEQ ID NO: 31004 - RNA, 23 nt, Artificial Sequence
  RNA Oligomer
gcaaaaauuucacaagacuuauu

SEQ ID NO: 31005 - RNA, 23 nt, Artificial Sequence
  RNA Oligomer
ggcaaaaauuucacaagacuuau

SEQ ID NO: 31006 - RNA, 23 nt, Artificial Sequence
  RNA Oligomer
uggcaaaaauuucacaagacuua

SEQ ID NO: 31007 - RNA, 23 nt, Artificial Sequence
  RNA Oligomer
uuggcaaaaauuucacaagacuu

SEQ ID NO: 31008 - RNA, 23 nt, Artificial Sequence
  RNA Oligomer
uuuggcaaaaauuucacaagacu

SEQ ID NO: 31009 - RNA, 23 nt, Artificial Sequence
  RNA Oligomer
uuuuggcaaaaauuucacaagac

SEQ ID NO: 31010 - RNA, 23 nt, Artificial Sequence
  RNA Oligomer
cuguacccaagaauuaaaccaag

SEQ ID NO: 31011 - RNA, 23 nt, Artificial Sequence
  RNA Oligomer
acuguacccaagaauuaaaccaa

SEQ ID NO: 31012 - RNA, 23 nt, Artificial Sequence
  RNA Oligomer
gacuguacccaagaauuaaacca

SEQ ID NO: 31013 - RNA, 23 nt, Artificial Sequence
  RNA Oligomer
ggagucauuuaugcgcuuuggga

SEQ ID NO: 31014 - RNA, 23 nt, Artificial Sequence
  RNA Oligomer
aggagucauuuaugcgcuuuggg

SEQ ID NO: 31015 - RNA, 23 nt, Artificial Sequence
  RNA Oligomer
aaggagucauuuaugcgcuuugg

SEQ ID NO: 31016 - RNA, 23 nt, Artificial Sequence
  RNA Oligomer
aaaggagucauuuaugcgcuuug

SEQ ID NO: 31017 - RNA, 23 nt, Artificial Sequence
  RNA Oligomer
uaaaggagucauuuaugcgcuuu

SEQ ID NO: 31018 - RNA, 23 nt, Artificial Sequence
  RNA Oligomer
guccaaguguguaaguuuuuggu

SEQ ID NO: 31019 - RNA, 23 nt, Artificial Sequence
  RNA Oligomer
cguccaaguguguaaguuuuugg

SEQ ID NO: 31020 - RNA, 23 nt, Artificial Sequence
  RNA Oligomer
acguccaaguguguaaguuuuug

SEQ ID NO: 31021 - RNA, 23 nt, Artificial Sequence
  RNA Oligomer
aacguccaaguguguaaguuuuu

SEQ ID NO: 31022 - RNA, 23 nt, Artificial Sequence
  RNA Oligomer
caacguccaaguguguaaguuuu

SEQ ID NO: 31023 - RNA, 23 nt, Artificial Sequence
  RNA Oligomer
gggagaauuugaccuuguacaga

SEQ ID NO: 31024 - RNA, 23 nt, Artificial Sequence
  RNA Oligomer
agggagaauuugaccuuguacag

SEQ ID NO: 31025 - RNA, 23 nt, Artificial Sequence
  RNA Oligomer
gagggagaauuugaccuuguaca

SEQ ID NO: 31026 - RNA, 23 nt, Artificial Sequence
  RNA Oligomer
ggagggagaauuugaccuuguac

SEQ ID NO: 31027 - RNA, 23 nt, Artificial Sequence
  RNA Oligomer
uggagggagaauuugaccuugua

SEQ ID NO: 31028 - RNA, 23 nt, Artificial Sequence
  RNA Oligomer
ggacaaacuugcguaaaacuggc

SEQ ID NO: 31029 - RNA, 23 nt, Artificial Sequence
  RNA Oligomer
aggacaaacuugcguaaaacugg

SEQ ID NO: 31030 - RNA, 23 nt, Artificial Sequence
  RNA Oligomer
aaggacaaacuugcguaaaacug

SEQ ID NO: 31031 - RNA, 23 nt, Artificial Sequence
  RNA Oligomer
aaaggacaaacuugcguaaaacu

SEQ ID NO: 31032 - RNA, 23 nt, Artificial Sequence
  RNA Oligomer
aaaaggacaaacuugcguaaaac

SEQ ID NO: 31033 - RNA, 23 nt, Artificial Sequence
  RNA Oligomer
ccauccaagucagcuucugugac

SEQ ID NO: 31034 - RNA, 23 nt, Artificial Sequence
  RNA Oligomer
cccauccaagucagcuucuguga

SEQ ID NO: 31035 - RNA, 23 nt, Artificial Sequence
  RNA Oligomer
acccauccaagucagcuucugug

SEQ ID NO: 31036 - RNA, 23 nt, Artificial Sequence
  RNA Oligomer
uacccauccaagucagcuucugu

SEQ ID NO: 31037 - RNA, 23 nt, Artificial Sequence
  RNA Oligomer
auacccauccaagucagcuucug

SEQ ID NO: 31038 - RNA, 23 nt, Artificial Sequence
  RNA Oligomer
gaauaagcguaauucagaagugg

SEQ ID NO: 31039 - RNA, 23 nt, Artificial Sequence
  RNA Oligomer
ugaauaagcguaauucagaagug

SEQ ID NO: 31040 - RNA, 23 nt, Artificial Sequence
  RNA Oligomer
uugaauaagcguaauucagaagu

SEQ ID NO: 31041 - RNA, 23 nt, Artificial Sequence
  RNA Oligomer
uuugaauaagcguaauucagaag

SEQ ID NO: 31042 - RNA, 23 nt, Artificial Sequence
  RNA Oligomer
guuugaauaagcguaauucagaa

SEQ ID NO: 31043 - RNA, 23 nt, Artificial Sequence
  RNA Oligomer
ggaaauugaacagaugaauaauu

SEQ ID NO: 31044 - RNA, 23 nt, Artificial Sequence
  RNA Oligomer
aggaaauugaacagaugaauaau

SEQ ID NO: 31045 - RNA, 23 nt, Artificial Sequence
  RNA Oligomer
gaggaaauugaacagaugaauaa

SEQ ID NO: 31046 - RNA, 23 nt, Artificial Sequence
  RNA Oligomer
ggaggaaauugaacagaugaaua

SEQ ID NO: 31047 - RNA, 23 nt, Artificial Sequence
  RNA Oligomer
uggaggaaauugaacagaugaau

SEQ ID NO: 31048 - RNA, 23 nt, Artificial Sequence
  RNA Oligomer
ggagaacgguguuaauaguccua

SEQ ID NO: 31049 - RNA, 23 nt, Artificial Sequence
  RNA Oligomer
aggagaacgguguuaauaguccu

SEQ ID NO: 31050 - RNA, 23 nt, Artificial Sequence
  RNA Oligomer
aaggagaacgguguuaauagucc

SEQ ID NO: 31051 - RNA, 23 nt, Artificial Sequence
  RNA Oligomer
aaaggagaacgguguuaauaguc

SEQ ID NO: 31052 - RNA, 23 nt, Artificial Sequence
  RNA Oligomer
gaaaggagaacgguguuaauagu

SEQ ID NO: 31053 - RNA, 23 nt, Artificial Sequence
  RNA Oligomer
agaaaggagaacgguguuaauag

SEQ ID NO: 31054 - RNA, 23 nt, Artificial Sequence
  RNA Oligomer
aagaaaggagaacgguguuaaua

SEQ ID NO: 31055 - RNA, 23 nt, Artificial Sequence
  RNA Oligomer
gaagaaaggagaacgguguuaau

SEQ ID NO: 31056 - RNA, 23 nt, Artificial Sequence
  RNA Oligomer
cgaagaaaggagaacgguguuaa

SEQ ID NO: 31057 - RNA, 23 nt, Artificial Sequence
  RNA Oligomer
gucuuuuguaucucagaaauuag

SEQ ID NO: 31058 - RNA, 23 nt, Artificial Sequence
  RNA Oligomer
ugucuuuuguaucucagaaauua

SEQ ID NO: 31059 - RNA, 23 nt, Artificial Sequence
  RNA Oligomer
uugucuuuuguaucucagaaauu

SEQ ID NO: 31060 - RNA, 23 nt, Artificial Sequence
  RNA Oligomer
auugucuuuuguaucucagaaau

SEQ ID NO: 31061 - RNA, 23 nt, Artificial Sequence
  RNA Oligomer
uauugucuuuuguaucucagaaa

SEQ ID NO: 31062 - RNA, 23 nt, Artificial Sequence
  RNA Oligomer
ggaagacgaagaugaaaucgaau

SEQ ID NO: 31063 - RNA, 23 nt, Artificial Sequence
  RNA Oligomer
gggaagacgaagaugaaaucgaa

SEQ ID NO: 31064 - RNA, 23 nt, Artificial Sequence
  RNA Oligomer
agggaagacgaagaugaaaucga

SEQ ID NO: 31065 - RNA, 23 nt, Artificial Sequence
  RNA Oligomer
cagggaagacgaagaugaaaucg

SEQ ID NO: 31066 - RNA, 23 nt, Artificial Sequence
  RNA Oligomer
acagggaagacgaagaugaaauc

SEQ ID NO: 31067 - RNA, 23 nt, Artificial Sequence
  RNA Oligomer
ccaaguguguaaguuuuuggugg

SEQ ID NO: 31068 - RNA, 23 nt, Artificial Sequence
  RNA Oligomer
uccaaguguguaaguuuuuggug

SEQ ID NO: 31069 - RNA, 23 nt, Artificial Sequence
  RNA Oligomer
gccacacagaaaucguuaaguuc

SEQ ID NO: 31070 - RNA, 23 nt, Artificial Sequence
  RNA Oligomer
ggccacacagaaaucguuaaguu

SEQ ID NO: 31071 - RNA, 23 nt, Artificial Sequence
  RNA Oligomer
aggccacacagaaaucguuaagu

SEQ ID NO: 31072 - RNA, 23 nt, Artificial Sequence
  RNA Oligomer
caggccacacagaaaucguuaag

SEQ ID NO: 31073 - RNA, 23 nt, Artificial Sequence
  RNA Oligomer
gcaggccacacagaaaucguuaa

SEQ ID NO: 31074 - RNA, 23 nt, Artificial Sequence
  RNA Oligomer
ggcuccacaugugcuugaugugu

SEQ ID NO: 31075 - RNA, 23 nt, Artificial Sequence
  RNA Oligomer
aggcuccacaugugcuugaugug

SEQ ID NO: 31076 - RNA, 23 nt, Artificial Sequence
  RNA Oligomer
gaggcuccacaugugcuugaugu

SEQ ID NO: 31077 - RNA, 23 nt, Artificial Sequence
  RNA Oligomer
agaggcuccacaugugcuugaug

SEQ ID NO: 31078 - RNA, 23 nt, Artificial Sequence
  RNA Oligomer
cagaggcuccacaugugcuugau

SEQ ID NO: 31079 - RNA, 23 nt, Artificial Sequence
  RNA Oligomer
cccaucauacccauccaagucag

SEQ ID NO: 31080 - RNA, 23 nt, Artificial Sequence
  RNA Oligomer
cucugucccaucauacccaucca

SEQ ID NO: 31081 - RNA, 23 nt, Artificial Sequence
  RNA Oligomer
ccaucucugucccaucauaccca

SEQ ID NO: 31082 - RNA, 23 nt, Artificial Sequence
  RNA Oligomer
accaucucugucccaucauaccc

SEQ ID NO: 31083 - RNA, 23 nt, Artificial Sequence
  RNA Oligomer
gaccaucucugucccaucauacc

SEQ ID NO: 31084 - RNA, 23 nt, Artificial Sequence
  RNA Oligomer
agaccaucucugucccaucauac

SEQ ID NO: 31085 - RNA, 23 nt, Artificial Sequence
  RNA Oligomer
gagaccaucucugucccaucaua

SEQ ID NO: 31086 - RNA, 23 nt, Artificial Sequence
  RNA Oligomer
caacuaaauuacugccuuucuua

SEQ ID NO: 31087 - RNA, 23 nt, Artificial Sequence
  RNA Oligomer
ccaugaaaacgaaagaauuccuc

SEQ ID NO: 31088 - RNA, 23 nt, Artificial Sequence
  RNA Oligomer
accaugaaaacgaaagaauuccu

SEQ ID NO: 31089 - RNA, 23 nt, Artificial Sequence
  RNA Oligomer
aaccaugaaaacgaaagaauucc

SEQ ID NO: 31090 - RNA, 23 nt, Artificial Sequence
  RNA Oligomer
gaaccaugaaaacgaaagaauuc

SEQ ID NO: 31091 - RNA, 23 nt, Artificial Sequence
  RNA Oligomer
agaaccaugaaaacgaaagaauu

SEQ ID NO: 31092 - RNA, 23 nt, Artificial Sequence
  RNA Oligomer
ggcugcuucacaaacuaaaggcu

SEQ ID NO: 31093 - RNA, 23 nt, Artificial Sequence
  RNA Oligomer
gggcugcuucacaaacuaaaggc

SEQ ID NO: 31094 - RNA, 23 nt, Artificial Sequence
  RNA Oligomer
ggggcugcuucacaaacuaaagg

SEQ ID NO: 31095 - RNA, 23 nt, Artificial Sequence
  RNA Oligomer
uggggcugcuucacaaacuaaag

SEQ ID NO: 31096 - RNA, 23 nt, Artificial Sequence
  RNA Oligomer
cuggggcugcuucacaaacuaaa

SEQ ID NO: 31097 - RNA, 23 nt, Artificial Sequence
  RNA Oligomer
cucuacagcaaaaagaaaaucua

SEQ ID NO: 31098 - RNA, 23 nt, Artificial Sequence
  RNA Oligomer
gcucuacagcaaaaagaaaaucu

SEQ ID NO: 31099 - RNA, 23 nt, Artificial Sequence
  RNA Oligomer
agcucuacagcaaaaagaaaauc

SEQ ID NO: 31100 - RNA, 23 nt, Artificial Sequence
  RNA Oligomer
cagcucuacagcaaaaagaaaau

SEQ ID NO: 31101 - RNA, 23 nt, Artificial Sequence
  RNA Oligomer
gcagcucuacagcaaaaagaaaa

SEQ ID NO: 31102 - RNA, 23 nt, Artificial Sequence
  RNA Oligomer
ucgaagaaaggagaacgguguua

SEQ ID NO: 31103 - RNA, 23 nt, Artificial Sequence
  RNA Oligomer
ggcugaauuuuaaucuguauuua

SEQ ID NO: 31104 - RNA, 23 nt, Artificial Sequence
  RNA Oligomer
aggcugaauuuuaaucuguauuu

SEQ ID NO: 31105 - RNA, 23 nt, Artificial Sequence
  RNA Oligomer
uaggcugaauuuuaaucuguauu

SEQ ID NO: 31106 - RNA, 23 nt, Artificial Sequence
  RNA Oligomer
guaggcugaauuuuaaucuguau

SEQ ID NO: 31107 - RNA, 23 nt, Artificial Sequence
  RNA Oligomer
uguaggcugaauuuuaaucugua

SEQ ID NO: 31108 - RNA, 23 nt, Artificial Sequence
  RNA Oligomer
gaaugaaggauugaagaauucac

SEQ ID NO: 31109 - RNA, 23 nt, Artificial Sequence
  RNA Oligomer
agaaugaaggauugaagaauuca

SEQ ID NO: 31110 - RNA, 23 nt, Artificial Sequence
  RNA Oligomer
gagaaugaaggauugaagaauuc

SEQ ID NO: 31111 - RNA, 23 nt, Artificial Sequence
  RNA Oligomer
agagaaugaaggauugaagaauu

SEQ ID NO: 31112 - RNA, 23 nt, Artificial Sequence
  RNA Oligomer
aagagaaugaaggauugaagaau

SEQ ID NO: 31113 - RNA, 23 nt, Artificial Sequence
  RNA Oligomer
ggauuaugaaccucagaaugaug

SEQ ID NO: 31114 - RNA, 23 nt, Artificial Sequence
  RNA Oligomer
gggauuaugaaccucagaaugau

SEQ ID NO: 31115 - RNA, 23 nt, Artificial Sequence
  RNA Oligomer
ugggauuaugaaccucagaauga

SEQ ID NO: 31116 - RNA, 23 nt, Artificial Sequence
  RNA Oligomer
uugggauuaugaaccucagaaug

SEQ ID NO: 31117 - RNA, 23 nt, Artificial Sequence
  RNA Oligomer
uuugggauuaugaaccucagaau

SEQ ID NO: 31118 - RNA, 23 nt, Artificial Sequence
  RNA Oligomer
gcauaaugaauaaaggagucauu

SEQ ID NO: 31119 - RNA, 23 nt, Artificial Sequence
  RNA Oligomer
ggcauaaugaauaaaggagucau

SEQ ID NO: 31120 - RNA, 23 nt, Artificial Sequence
  RNA Oligomer
gggcauaaugaauaaaggaguca

SEQ ID NO: 31121 - RNA, 23 nt, Artificial Sequence
  RNA Oligomer
ugggcauaaugaauaaaggaguc

SEQ ID NO: 31122 - RNA, 23 nt, Artificial Sequence
  RNA Oligomer
augggcauaaugaauaaaggagu

SEQ ID NO: 31123 - RNA, 23 nt, Artificial Sequence
  RNA Oligomer
acacagaaaucguuaaguuccug

SEQ ID NO: 31124 - RNA, 23 nt, Artificial Sequence
  RNA Oligomer
cacacagaaaucguuaaguuccu

SEQ ID NO: 31125 - RNA, 23 nt, Artificial Sequence
  RNA Oligomer
ccacacagaaaucguuaaguucc

SEQ ID NO: 31126 - RNA, 23 nt, Artificial Sequence
  RNA Oligomer
uuggagggagaauuugaccuugu

SEQ ID NO: 31127 - RNA, 23 nt, Artificial Sequence
  RNA Oligomer
uuuggagggagaauuugaccuug

SEQ ID NO: 31128 - RNA, 23 nt, Artificial Sequence
  RNA Oligomer
cuuuggagggagaauuugaccuu

SEQ ID NO: 31129 - RNA, 23 nt, Artificial Sequence
  RNA Oligomer
cauacccauccaagucagcuucu

SEQ ID NO: 31130 - RNA, 23 nt, Artificial Sequence
  RNA Oligomer
gcgaauguuugauguucuucaac

SEQ ID NO: 31131 - RNA, 23 nt, Artificial Sequence
  RNA Oligomer
agcgaauguuugauguucuucaa

SEQ ID NO: 31132 - RNA, 23 nt, Artificial Sequence
  RNA Oligomer
gagcgaauguuugauguucuuca

SEQ ID NO: 31133 - RNA, 23 nt, Artificial Sequence
  RNA Oligomer
ugagcgaauguuugauguucuuc

SEQ ID NO: 31134 - RNA, 23 nt, Artificial Sequence
  RNA Oligomer
augagcgaauguuugauguucuu

SEQ ID NO: 31135 - RNA, 23 nt, Artificial Sequence
  RNA Oligomer
ucagcccaacuaaauuacugccu

SEQ ID NO: 31136 - RNA, 23 nt, Artificial Sequence
  RNA Oligomer
ggagaaccaugaaaacgaaagaa

SEQ ID NO: 31137 - RNA, 23 nt, Artificial Sequence
  RNA Oligomer
aggagaaccaugaaaacgaaaga

SEQ ID NO: 31138 - RNA, 23 nt, Artificial Sequence
  RNA Oligomer
caggagaaccaugaaaacgaaag

SEQ ID NO: 31139 - RNA, 23 nt, Artificial Sequence
  RNA Oligomer
ucaggagaaccaugaaaacgaaa

SEQ ID NO: 31140 - RNA, 23 nt, Artificial Sequence
  RNA Oligomer
uucaggagaaccaugaaaacgaa

SEQ ID NO: 31141 - RNA, 23 nt, Artificial Sequence
  RNA Oligomer
gcacccagagaacauuuauucca

SEQ ID NO: 31142 - RNA, 23 nt, Artificial Sequence
  RNA Oligomer
agcacccagagaacauuuauucc

SEQ ID NO: 31143 - RNA, 23 nt, Artificial Sequence
  RNA Oligomer
cagcacccagagaacauuuauuc

SEQ ID NO: 31144 - RNA, 23 nt, Artificial Sequence
  RNA Oligomer
gcagcacccagagaacauuuauu

SEQ ID NO: 31145 - RNA, 23 nt, Artificial Sequence
  RNA Oligomer
agcagcacccagagaacauuuau

SEQ ID NO: 31146 - RNA, 23 nt, Artificial Sequence
  RNA Oligomer
caccuuacuuccacccuucagaa

SEQ ID NO: 31147 - RNA, 23 nt, Artificial Sequence
  RNA Oligomer
gccuuauuuuggacaaacuaauc

SEQ ID NO: 31148 - RNA, 23 nt, Artificial Sequence
  RNA Oligomer
ugccuuauuuuggacaaacuaau

SEQ ID NO: 31149 - RNA, 23 nt, Artificial Sequence
  RNA Oligomer
uugccuuauuuuggacaaacuaa

SEQ ID NO: 31150 - RNA, 23 nt, Artificial Sequence
  RNA Oligomer
uuugccuuauuuuggacaaacua

SEQ ID NO: 31151 - RNA, 23 nt, Artificial Sequence
  RNA Oligomer
auuugccuuauuuuggacaaacu

SEQ ID NO: 31152 - RNA, 23 nt, Artificial Sequence
  RNA Oligomer
ccagagcagugaagauaucuugc

SEQ ID NO: 31153 - RNA, 23 nt, Artificial Sequence
  RNA Oligomer
accagagcagugaagauaucuug

SEQ ID NO: 31154 - RNA, 23 nt, Artificial Sequence
  RNA Oligomer
aaccagagcagugaagauaucuu

SEQ ID NO: 31155 - RNA, 23 nt, Artificial Sequence
  RNA Oligomer
gaaccagagcagugaagauaucu

SEQ ID NO: 31156 - RNA, 23 nt, Artificial Sequence
  RNA Oligomer
agaaccagagcagugaagauauc

SEQ ID NO: 31157 - RNA, 23 nt, Artificial Sequence
  RNA Oligomer
uccuucaaaugcagaucuuuucc

SEQ ID NO: 31158 - RNA, 23 nt, Artificial Sequence
  RNA Oligomer
guccuucaaaugcagaucuuuuc

SEQ ID NO: 31159 - RNA, 23 nt, Artificial Sequence
  RNA Oligomer
aguccuucaaaugcagaucuuuu

SEQ ID NO: 31160 - RNA, 23 nt, Artificial Sequence
  RNA Oligomer
gaguccuucaaaugcagaucuuu

SEQ ID NO: 31161 - RNA, 23 nt, Artificial Sequence
  RNA Oligomer
ggaguccuucaaaugcagaucuu

SEQ ID NO: 31162 - RNA, 23 nt, Artificial Sequence
  RNA Oligomer
ccaguuacuccagaaacaauaug

SEQ ID NO: 31163 - RNA, 23 nt, Artificial Sequence
  RNA Oligomer
uccaguuacuccagaaacaauau

SEQ ID NO: 31164 - RNA, 23 nt, Artificial Sequence
  RNA Oligomer
uuccaguuacuccagaaacaaua

SEQ ID NO: 31165 - RNA, 23 nt, Artificial Sequence
  RNA Oligomer
guuccaguuacuccagaaacaau

SEQ ID NO: 31166 - RNA, 23 nt, Artificial Sequence
  RNA Oligomer
aguuccaguuacuccagaaacaa

SEQ ID NO: 31167 - RNA, 23 nt, Artificial Sequence
  RNA Oligomer
caaauugaaucaagagcagaaug

SEQ ID NO: 31168 - RNA, 23 nt, Artificial Sequence
  RNA Oligomer
acaaauugaaucaagagcagaau

SEQ ID NO: 31169 - RNA, 23 nt, Artificial Sequence
  RNA Oligomer
aacaaauugaaucaagagcagaa

SEQ ID NO: 31170 - RNA, 23 nt, Artificial Sequence
  RNA Oligomer
aaacaaauugaaucaagagcaga

SEQ ID NO: 31171 - RNA, 23 nt, Artificial Sequence
  RNA Oligomer
gaaacaaauugaaucaagagcag

SEQ ID NO: 31172 - RNA, 23 nt, Artificial Sequence
  RNA Oligomer
agaaacaaauugaaucaagagca

SEQ ID NO: 31173 - RNA, 23 nt, Artificial Sequence
  RNA Oligomer
ggcugugucaaaaguagaagaac

SEQ ID NO: 31174 - RNA, 23 nt, Artificial Sequence
  RNA Oligomer
uggcugugucaaaaguagaagaa

SEQ ID NO: 31175 - RNA, 23 nt, Artificial Sequence
  RNA Oligomer
cuggcugugucaaaaguagaaga

SEQ ID NO: 31176 - RNA, 23 nt, Artificial Sequence
  RNA Oligomer
ccuggcugugucaaaaguagaag

SEQ ID NO: 31177 - RNA, 23 nt, Artificial Sequence
  RNA Oligomer
uccuggcugugucaaaaguagaa

SEQ ID NO: 31178 - RNA, 23 nt, Artificial Sequence
  RNA Oligomer
ccagcaaaaacagagggagcucg

SEQ ID NO: 31179 - RNA, 23 nt, Artificial Sequence
  RNA Oligomer
uccagcaaaaacagagggagcuc

SEQ ID NO: 31180 - RNA, 23 nt, Artificial Sequence
  RNA Oligomer
uuccagcaaaaacagagggagcu

SEQ ID NO: 31181 - RNA, 23 nt, Artificial Sequence
  RNA Oligomer
guuccagcaaaaacagagggagc

SEQ ID NO: 31182 - RNA, 23 nt, Artificial Sequence
  RNA Oligomer
uguuccagcaaaaacagagggag

SEQ ID NO: 31183 - RNA, 23 nt, Artificial Sequence
  RNA Oligomer
ggaagcuaagcuaaaaaaaguga

SEQ ID NO: 31184 - RNA, 23 nt, Artificial Sequence
  RNA Oligomer
aggaagcuaagcuaaaaaaagug

SEQ ID NO: 31185 - RNA, 23 nt, Artificial Sequence
  RNA Oligomer
caggaagcuaagcuaaaaaaagu

SEQ ID NO: 31186 - RNA, 23 nt, Artificial Sequence
  RNA Oligomer
ucaggaagcuaagcuaaaaaaag

SEQ ID NO: 31187 - RNA, 23 nt, Artificial Sequence
  RNA Oligomer
aucaggaagcuaagcuaaaaaaa

SEQ ID NO: 31188 - RNA, 23 nt, Artificial Sequence
  RNA Oligomer
ccguguaucucaguaacaaugag

SEQ ID NO: 31189 - RNA, 23 nt, Artificial Sequence
  RNA Oligomer
accguguaucucaguaacaauga

SEQ ID NO: 31190 - RNA, 23 nt, Artificial Sequence
  RNA Oligomer
uaccguguaucucaguaacaaug

SEQ ID NO: 31191 - RNA, 23 nt, Artificial Sequence
  RNA Oligomer
uuaccguguaucucaguaacaau

SEQ ID NO: 31192 - RNA, 23 nt, Artificial Sequence
  RNA Oligomer
cuuaccguguaucucaguaacaa

SEQ ID NO: 31193 - RNA, 23 nt, Artificial Sequence
  RNA Oligomer
cuacgguaccaguaauuagaugu

SEQ ID NO: 31194 - RNA, 23 nt, Artificial Sequence
  RNA Oligomer
gcuacgguaccaguaauuagaug

SEQ ID NO: 31195 - RNA, 23 nt, Artificial Sequence
  RNA Oligomer
gcgugaugaaauaaagcaucuac

SEQ ID NO: 31196 - RNA, 23 nt, Artificial Sequence
  RNA Oligomer
agcgugaugaaauaaagcaucua

SEQ ID NO: 31197 - RNA, 23 nt, Artificial Sequence
  RNA Oligomer
uagcgugaugaaauaaagcaucu

SEQ ID NO: 31198 - RNA, 23 nt, Artificial Sequence
  RNA Oligomer
uuagcgugaugaaauaaagcauc

SEQ ID NO: 31199 - RNA, 23 nt, Artificial Sequence
  RNA Oligomer
uuuagcgugaugaaauaaagcau

SEQ ID NO: 31200 - RNA, 23 nt, Artificial Sequence
  RNA Oligomer
gaagagaaugaaggauugaagaa

SEQ ID NO: 31201 - RNA, 23 nt, Artificial Sequence
  RNA Oligomer
agaagagaaugaaggauugaaga

SEQ ID NO: 31202 - RNA, 23 nt, Artificial Sequence
  RNA Oligomer
uagaagagaaugaaggauugaag

SEQ ID NO: 31203 - RNA, 23 nt, Artificial Sequence
  RNA Oligomer
acaguuugguguaaauguaaaug

SEQ ID NO: 31204 - RNA, 23 nt, Artificial Sequence
  RNA Oligomer
uacaguuugguguaaauguaaau

SEQ ID NO: 31205 - RNA, 23 nt, Artificial Sequence
  RNA Oligomer
guacaguuugguguaaauguaaa

SEQ ID NO: 31206 - RNA, 23 nt, Artificial Sequence
  RNA Oligomer
gguacaguuugguguaaauguaa

SEQ ID NO: 31207 - RNA, 23 nt, Artificial Sequence
  RNA Oligomer
ugguacaguuugguguaaaugua

SEQ ID NO: 31208 - RNA, 23 nt, Artificial Sequence
  RNA Oligomer
ugaccuuguacagagaauuauuu

SEQ ID NO: 31209 - RNA, 23 nt, Artificial Sequence
  RNA Oligomer
uugaccuuguacagagaauuauu

SEQ ID NO: 31210 - RNA, 23 nt, Artificial Sequence
  RNA Oligomer
uuugaccuuguacagagaauuau

SEQ ID NO: 31211 - RNA, 23 nt, Artificial Sequence
  RNA Oligomer
auuugaccuuguacagagaauua

SEQ ID NO: 31212 - RNA, 23 nt, Artificial Sequence
  RNA Oligomer
aauuugaccuuguacagagaauu

SEQ ID NO: 31213 - RNA, 23 nt, Artificial Sequence
  RNA Oligomer
cugguaaaaggacaaacuugcgu

SEQ ID NO: 31214 - RNA, 23 nt, Artificial Sequence
  RNA Oligomer
ccugguaaaaggacaaacuugcg

SEQ ID NO: 31215 - RNA, 23 nt, Artificial Sequence
  RNA Oligomer
uccugguaaaaggacaaacuugc

SEQ ID NO: 31216 - RNA, 23 nt, Artificial Sequence
  RNA Oligomer
cuccugguaaaaggacaaacuug

SEQ ID NO: 31217 - RNA, 23 nt, Artificial Sequence
  RNA Oligomer
ccuccugguaaaaggacaaacuu

SEQ ID NO: 31218 - RNA, 23 nt, Artificial Sequence
  RNA Oligomer
gcccaaaucuccagaauaaccca

SEQ ID NO: 31219 - RNA, 23 nt, Artificial Sequence
  RNA Oligomer
agcccaaaucuccagaauaaccc

SEQ ID NO: 31220 - RNA, 23 nt, Artificial Sequence
  RNA Oligomer
cagcccaaaucuccagaauaacc

SEQ ID NO: 31221 - RNA, 23 nt, Artificial Sequence
  RNA Oligomer
acagcccaaaucuccagaauaac

SEQ ID NO: 31222 - RNA, 23 nt, Artificial Sequence
  RNA Oligomer
aacagcccaaaucuccagaauaa

SEQ ID NO: 31223 - RNA, 23 nt, Artificial Sequence
  RNA Oligomer
ucauacccauccaagucagcuuc

SEQ ID NO: 31224 - RNA, 23 nt, Artificial Sequence
  RNA Oligomer
gagaaccaugaaaacgaaagaau

SEQ ID NO: 31225 - RNA, 23 nt, Artificial Sequence
  RNA Oligomer
cacccagagaacauuuauuccaa

SEQ ID NO: 31226 - RNA, 23 nt, Artificial Sequence
  RNA Oligomer
cuacagcaaaaagaaaaucuacc

SEQ ID NO: 31227 - RNA, 23 nt, Artificial Sequence
  RNA Oligomer
ucuacagcaaaaagaaaaucuac

SEQ ID NO: 31228 - RNA, 23 nt, Artificial Sequence
  RNA Oligomer
cugcagcuaagaaacaaauugaa

SEQ ID NO: 31229 - RNA, 23 nt, Artificial Sequence
  RNA Oligomer
gcugcagcuaagaaacaaauuga

SEQ ID NO: 31230 - RNA, 23 nt, Artificial Sequence
  RNA Oligomer
agcugcagcuaagaaacaaauug

SEQ ID NO: 31231 - RNA, 23 nt, Artificial Sequence
  RNA Oligomer
gagcugcagcuaagaaacaaauu

SEQ ID NO: 31232 - RNA, 23 nt, Artificial Sequence
  RNA Oligomer
ggagcugcagcuaagaaacaaau

SEQ ID NO: 31233 - RNA, 23 nt, Artificial Sequence
  RNA Oligomer
aggagcugcagcuaagaaacaaa

SEQ ID NO: 31234 - RNA, 23 nt, Artificial Sequence
  RNA Oligomer
aaucaggaagcuaagcuaaaaaa

SEQ ID NO: 31235 - RNA, 23 nt, Artificial Sequence
  RNA Oligomer
gaaucaggaagcuaagcuaaaaa

SEQ ID NO: 31236 - RNA, 23 nt, Artificial Sequence
  RNA Oligomer
gcgacaacagcaacaaguugcug

SEQ ID NO: 31237 - RNA, 23 nt, Artificial Sequence
  RNA Oligomer
agcgacaacagcaacaaguugcu

SEQ ID NO: 31238 - RNA, 23 nt, Artificial Sequence
  RNA Oligomer
cagcgacaacagcaacaaguugc

SEQ ID NO: 31239 - RNA, 23 nt, Artificial Sequence
  RNA Oligomer
ucagcgacaacagcaacaaguug

SEQ ID NO: 31240 - RNA, 23 nt, Artificial Sequence
  RNA Oligomer
aucagcgacaacagcaacaaguu

SEQ ID NO: 31241 - RNA, 23 nt, Artificial Sequence
  RNA Oligomer
cccguaauauuugucaagaucau

SEQ ID NO: 31242 - RNA, 23 nt, Artificial Sequence
  RNA Oligomer
acccguaauauuugucaagauca

SEQ ID NO: 31243 - RNA, 23 nt, Artificial Sequence
  RNA Oligomer
uacccguaauauuugucaagauc

SEQ ID NO: 31244 - RNA, 23 nt, Artificial Sequence
  RNA Oligomer
uuacccguaauauuugucaagau

SEQ ID NO: 31245 - RNA, 23 nt, Artificial Sequence
  RNA Oligomer
cuuacccguaauauuugucaaga

SEQ ID NO: 31246 - RNA, 23 nt, Artificial Sequence
  RNA Oligomer
augaaggauugaagaauucacca

SEQ ID NO: 31247 - RNA, 23 nt, Artificial Sequence
  RNA Oligomer
aaugaaggauugaagaauucacc

SEQ ID NO: 31248 - RNA, 23 nt, Artificial Sequence
  RNA Oligomer
uuuuuggcaaaaauuucacaaga

SEQ ID NO: 31249 - RNA, 23 nt, Artificial Sequence
  RNA Oligomer
cacacagaauuuuagucaaugaa

SEQ ID NO: 31250 - RNA, 23 nt, Artificial Sequence
  RNA Oligomer
ccacacagaauuuuagucaauga

SEQ ID NO: 31251 - RNA, 23 nt, Artificial Sequence
  RNA Oligomer
uccacacagaauuuuagucaaug

SEQ ID NO: 31252 - RNA, 23 nt, Artificial Sequence
  RNA Oligomer
uuccacacagaauuuuagucaau

SEQ ID NO: 31253 - RNA, 23 nt, Artificial Sequence
  RNA Oligomer
cuuccacacagaauuuuagucaa

SEQ ID NO: 31254 - RNA, 23 nt, Artificial Sequence
  RNA Oligomer
acuuccacacagaauuuuaguca

SEQ ID NO: 31255 - RNA, 23 nt, Artificial Sequence
  RNA Oligomer
auaaaggagucauuuaugcgcuu

SEQ ID NO: 31256 - RNA, 23 nt, Artificial Sequence
  RNA Oligomer
gaugggcauaaugaauaaaggag

SEQ ID NO: 31257 - RNA, 23 nt, Artificial Sequence
  RNA Oligomer
acaacguccaaguguguaaguuu

SEQ ID NO: 31258 - RNA, 23 nt, Artificial Sequence
  RNA Oligomer
aacaacguccaaguguguaaguu

SEQ ID NO: 31259 - RNA, 23 nt, Artificial Sequence
  RNA Oligomer
accuuguacagagaauuauuuau

SEQ ID NO: 31260 - RNA, 23 nt, Artificial Sequence
  RNA Oligomer
gaccuuguacagagaauuauuua

SEQ ID NO: 31261 - RNA, 23 nt, Artificial Sequence
  RNA Oligomer
gaaugagggugaaauucaacccc

SEQ ID NO: 31262 - RNA, 23 nt, Artificial Sequence
  RNA Oligomer
ggaaugagggugaaauucaaccc

SEQ ID NO: 31263 - RNA, 23 nt, Artificial Sequence
  RNA Oligomer
uggaaugagggugaaauucaacc

SEQ ID NO: 31264 - RNA, 23 nt, Artificial Sequence
  RNA Oligomer
auggaaugagggugaaauucaac

SEQ ID NO: 31265 - RNA, 23 nt, Artificial Sequence
  RNA Oligomer
cauggaaugagggugaaauucaa

SEQ ID NO: 31266 - RNA, 23 nt, Artificial Sequence
  RNA Oligomer
gcguaaaacuggcucagagcgua

SEQ ID NO: 31267 - RNA, 23 nt, Artificial Sequence
  RNA Oligomer
ugcguaaaacuggcucagagcgu

SEQ ID NO: 31268 - RNA, 23 nt, Artificial Sequence
  RNA Oligomer
uugcguaaaacuggcucagagcg

SEQ ID NO: 31269 - RNA, 23 nt, Artificial Sequence
  RNA Oligomer
cuugcguaaaacuggcucagagc

SEQ ID NO: 31270 - RNA, 23 nt, Artificial Sequence
  RNA Oligomer
acuugcguaaaacuggcucagag

SEQ ID NO: 31271 - RNA, 23 nt, Artificial Sequence
  RNA Oligomer
ccagaauccauauuuacaugugg

SEQ ID NO: 31272 - RNA, 23 nt, Artificial Sequence
  RNA Oligomer
uccagaauccauauuuacaugug

SEQ ID NO: 31273 - RNA, 23 nt, Artificial Sequence
  RNA Oligomer
auccagaauccauauuuacaugu

SEQ ID NO: 31274 - RNA, 23 nt, Artificial Sequence
  RNA Oligomer
aauccagaauccauauuuacaug

SEQ ID NO: 31275 - RNA, 23 nt, Artificial Sequence
  RNA Oligomer
aaauccagaauccauauuuacau

SEQ ID NO: 31276 - RNA, 23 nt, Artificial Sequence
  RNA Oligomer
gccaaauauucagaagcuuuuau

SEQ ID NO: 31277 - RNA, 23 nt, Artificial Sequence
  RNA Oligomer
ggccaaauauucagaagcuuuua

SEQ ID NO: 31278 - RNA, 23 nt, Artificial Sequence
  RNA Oligomer
gggccaaauauucagaagcuuuu

SEQ ID NO: 31279 - RNA, 23 nt, Artificial Sequence
  RNA Oligomer
ugggccaaauauucagaagcuuu

SEQ ID NO: 31280 - RNA, 23 nt, Artificial Sequence
  RNA Oligomer
augggccaaauauucagaagcuu

SEQ ID NO: 31281 - RNA, 23 nt, Artificial Sequence
  RNA Oligomer
cuaaauuacugccuuucuuaucu

SEQ ID NO: 31282 - RNA, 23 nt, Artificial Sequence
  RNA Oligomer
acuaaauuacugccuuucuuauc

SEQ ID NO: 31283 - RNA, 23 nt, Artificial Sequence
  RNA Oligomer
aacuaaauuacugccuuucuuau

SEQ ID NO: 31284 - RNA, 23 nt, Artificial Sequence
  RNA Oligomer
gaacauuuauuccaauagccagg

SEQ ID NO: 31285 - RNA, 23 nt, Artificial Sequence
  RNA Oligomer
agaacauuuauuccaauagccag

SEQ ID NO: 31286 - RNA, 23 nt, Artificial Sequence
  RNA Oligomer
gagaacauuuauuccaauagcca

SEQ ID NO: 31287 - RNA, 23 nt, Artificial Sequence
  RNA Oligomer
agagaacauuuauuccaauagcc

SEQ ID NO: 31288 - RNA, 23 nt, Artificial Sequence
  RNA Oligomer
cagagaacauuuauuccaauagc

SEQ ID NO: 31289 - RNA, 23 nt, Artificial Sequence
  RNA Oligomer
cagcagcacccagagaacauuua

SEQ ID NO: 31290 - RNA, 23 nt, Artificial Sequence
  RNA Oligomer
ccagaaucaacagcagcacccag

SEQ ID NO: 31291 - RNA, 23 nt, Artificial Sequence
  RNA Oligomer
cccagaaucaacagcagcaccca

SEQ ID NO: 31292 - RNA, 23 nt, Artificial Sequence
  RNA Oligomer
gcccagaaucaacagcagcaccc

SEQ ID NO: 31293 - RNA, 23 nt, Artificial Sequence
  RNA Oligomer
ugcccagaaucaacagcagcacc

SEQ ID NO: 31294 - RNA, 23 nt, Artificial Sequence
  RNA Oligomer
cugcccagaaucaacagcagcac

SEQ ID NO: 31295 - RNA, 23 nt, Artificial Sequence
  RNA Oligomer
agagcgcguugaccaagacucau

SEQ ID NO: 31296 - RNA, 23 nt, Artificial Sequence
  RNA Oligomer
gcagcaaguucaauauauuccau

SEQ ID NO: 31297 - RNA, 23 nt, Artificial Sequence
  RNA Oligomer
ggcagcaaguucaauauauucca

SEQ ID NO: 31298 - RNA, 23 nt, Artificial Sequence
  RNA Oligomer
uggcagcaaguucaauauauucc

SEQ ID NO: 31299 - RNA, 23 nt, Artificial Sequence
  RNA Oligomer
guggcagcaaguucaauauauuc

SEQ ID NO: 31300 - RNA, 23 nt, Artificial Sequence
  RNA Oligomer
cguggcagcaaguucaauauauu

SEQ ID NO: 31301 - RNA, 23 nt, Artificial Sequence
  RNA Oligomer
agaagaaagugcguccguucuca

SEQ ID NO: 31302 - RNA, 23 nt, Artificial Sequence
  RNA Oligomer
gagaagaaagugcguccguucuc

SEQ ID NO: 31303 - RNA, 23 nt, Artificial Sequence
  RNA Oligomer
agagaagaaagugcguccguucu

SEQ ID NO: 31304 - RNA, 23 nt, Artificial Sequence
  RNA Oligomer
aagagaagaaagugcguccguuc

SEQ ID NO: 31305 - RNA, 23 nt, Artificial Sequence
  RNA Oligomer
aaagagaagaaagugcguccguu

SEQ ID NO: 31306 - RNA, 23 nt, Artificial Sequence
  RNA Oligomer
ccaaggcucugcuucuguaccuc

SEQ ID NO: 31307 - RNA, 23 nt, Artificial Sequence
  RNA Oligomer
gccaaggcucugcuucuguaccu

SEQ ID NO: 31308 - RNA, 23 nt, Artificial Sequence
  RNA Oligomer
agccaaggcucugcuucuguacc

SEQ ID NO: 31309 - RNA, 23 nt, Artificial Sequence
  RNA Oligomer
aagccaaggcucugcuucuguac

SEQ ID NO: 31310 - RNA, 23 nt, Artificial Sequence
  RNA Oligomer
caagccaaggcucugcuucugua

SEQ ID NO: 31311 - RNA, 23 nt, Artificial Sequence
  RNA Oligomer
ugauuggaguccuucaaaugcag

SEQ ID NO: 31312 - RNA, 23 nt, Artificial Sequence
  RNA Oligomer
cugauuggaguccuucaaaugca

SEQ ID NO: 31313 - RNA, 23 nt, Artificial Sequence
  RNA Oligomer
ccugauuggaguccuucaaaugc

SEQ ID NO: 31314 - RNA, 23 nt, Artificial Sequence
  RNA Oligomer
cccugauuggaguccuucaaaug

SEQ ID NO: 31315 - RNA, 23 nt, Artificial Sequence
  RNA Oligomer
gcccugauuggaguccuucaaau

SEQ ID NO: 31316 - RNA, 23 nt, Artificial Sequence
  RNA Oligomer
ucuggggcugcuucacaaacuaa

SEQ ID NO: 31317 - RNA, 23 nt, Artificial Sequence
  RNA Oligomer
ggaagaagaaggcagcucuacag

SEQ ID NO: 31318 - RNA, 23 nt, Artificial Sequence
  RNA Oligomer
uggaagaagaaggcagcucuaca

SEQ ID NO: 31319 - RNA, 23 nt, Artificial Sequence
  RNA Oligomer
guggaagaagaaggcagcucuac

SEQ ID NO: 31320 - RNA, 23 nt, Artificial Sequence
  RNA Oligomer
uguggaagaagaaggcagcucua

SEQ ID NO: 31321 - RNA, 23 nt, Artificial Sequence
  RNA Oligomer
cuguggaagaagaaggcagcucu

SEQ ID NO: 31322 - RNA, 23 nt, Artificial Sequence
  RNA Oligomer
ggauaagcguguuaaugagcuga

SEQ ID NO: 31323 - RNA, 23 nt, Artificial Sequence
  RNA Oligomer
uggauaagcguguuaaugagcug

SEQ ID NO: 31324 - RNA, 23 nt, Artificial Sequence
  RNA Oligomer
auggauaagcguguuaaugagcu

SEQ ID NO: 31325 - RNA, 23 nt, Artificial Sequence
  RNA Oligomer
cauggauaagcguguuaaugagc

SEQ ID NO: 31326 - RNA, 23 nt, Artificial Sequence
  RNA Oligomer
ucauggauaagcguguuaaugag

SEQ ID NO: 31327 - RNA, 23 nt, Artificial Sequence
  RNA Oligomer
cagagggaguguuugaauaagcg

SEQ ID NO: 31328 - RNA, 23 nt, Artificial Sequence
  RNA Oligomer
acagagggaguguuugaauaagc

SEQ ID NO: 31329 - RNA, 23 nt, Artificial Sequence
  RNA Oligomer
aacagagggaguguuugaauaag

SEQ ID NO: 31330 - RNA, 23 nt, Artificial Sequence
  RNA Oligomer
caacagagggaguguuugaauaa

SEQ ID NO: 31331 - RNA, 23 nt, Artificial Sequence
  RNA Oligomer
acaacagagggaguguuugaaua

SEQ ID NO: 31332 - RNA, 23 nt, Artificial Sequence
  RNA Oligomer
caacaacagagggaguguuugaa

SEQ ID NO: 31333 - RNA, 23 nt, Artificial Sequence
  RNA Oligomer
acaacaacagagggaguguuuga

SEQ ID NO: 31334 - RNA, 23 nt, Artificial Sequence
  RNA Oligomer
uacaacaacagagggaguguuug

SEQ ID NO: 31335 - RNA, 23 nt, Artificial Sequence
  RNA Oligomer
cuacaacaacagagggaguguuu

SEQ ID NO: 31336 - RNA, 23 nt, Artificial Sequence
  RNA Oligomer
gcuacaacaacagagggaguguu

SEQ ID NO: 31337 - RNA, 23 nt, Artificial Sequence
  RNA Oligomer
agaaucaggaagcuaagcuaaaa

SEQ ID NO: 31338 - RNA, 23 nt, Artificial Sequence
  RNA Oligomer
acaacaagaucagcgacaacagc

SEQ ID NO: 31339 - RNA, 23 nt, Artificial Sequence
  RNA Oligomer
aacaacaagaucagcgacaacag

SEQ ID NO: 31340 - RNA, 23 nt, Artificial Sequence
  RNA Oligomer
aaacaacaagaucagcgacaaca

SEQ ID NO: 31341 - RNA, 23 nt, Artificial Sequence
  RNA Oligomer
gaaacaacaagaucagcgacaac

SEQ ID NO: 31342 - RNA, 23 nt, Artificial Sequence
  RNA Oligomer
ugaaacaacaagaucagcgacaa

SEQ ID NO: 31343 - RNA, 23 nt, Artificial Sequence
  RNA Oligomer
cgcuuaaaguuuuugaaacaaca

SEQ ID NO: 31344 - RNA, 23 nt, Artificial Sequence
  RNA Oligomer
gcgcuuaaaguuuuugaaacaac

SEQ ID NO: 31345 - RNA, 23 nt, Artificial Sequence
  RNA Oligomer
agcgcuuaaaguuuuugaaacaa

SEQ ID NO: 31346 - RNA, 23 nt, Artificial Sequence
  RNA Oligomer
cagcgcuuaaaguuuuugaaaca

SEQ ID NO: 31347 - RNA, 23 nt, Artificial Sequence
  RNA Oligomer
acagcgcuuaaaguuuuugaaac

SEQ ID NO: 31348 - RNA, 23 nt, Artificial Sequence
  RNA Oligomer
cuaaggaacagcgcuuaaaguuu

SEQ ID NO: 31349 - RNA, 23 nt, Artificial Sequence
  RNA Oligomer
acuaaggaacagcgcuuaaaguu

SEQ ID NO: 31350 - RNA, 23 nt, Artificial Sequence
  RNA Oligomer
aacuaaggaacagcgcuuaaagu

SEQ ID NO: 31351 - RNA, 23 nt, Artificial Sequence
  RNA Oligomer
caacuaaggaacagcgcuuaaag

SEQ ID NO: 31352 - RNA, 23 nt, Artificial Sequence
  RNA Oligomer
gcaacuaaggaacagcgcuuaaa

SEQ ID NO: 31353 - RNA, 23 nt, Artificial Sequence
  RNA Oligomer
gcaacagauugaagcccagcaac

SEQ ID NO: 31354 - RNA, 23 nt, Artificial Sequence
  RNA Oligomer
agcaacagauugaagcccagcaa

SEQ ID NO: 31355 - RNA, 23 nt, Artificial Sequence
  RNA Oligomer
cagcaacagauugaagcccagca

SEQ ID NO: 31356 - RNA, 23 nt, Artificial Sequence
  RNA Oligomer
gcagcaacagauugaagcccagc

SEQ ID NO: 31357 - RNA, 23 nt, Artificial Sequence
  RNA Oligomer
agcagcaacagauugaagcccag

SEQ ID NO: 31358 - RNA, 23 nt, Artificial Sequence
  RNA Oligomer
gccagcagcaacagauugaagcc

SEQ ID NO: 31359 - RNA, 23 nt, Artificial Sequence
  RNA Oligomer
cgccagcagcaacagauugaagc

SEQ ID NO: 31360 - RNA, 23 nt, Artificial Sequence
  RNA Oligomer
ucgccagcagcaacagauugaag

SEQ ID NO: 31361 - RNA, 23 nt, Artificial Sequence
  RNA Oligomer
cucgccagcagcaacagauugaa

SEQ ID NO: 31362 - RNA, 23 nt, Artificial Sequence
  RNA Oligomer
ucucgccagcagcaacagauuga

SEQ ID NO: 31363 - RNA, 23 nt, Artificial Sequence
  RNA Oligomer
uuauugucuuuuguaucucagaa

SEQ ID NO: 31364 - RNA, 23 nt, Artificial Sequence
  RNA Oligomer
gaguuuuuguagcaucuuaagaa

SEQ ID NO: 31365 - RNA, 23 nt, Artificial Sequence
  RNA Oligomer
ugaguuuuuguagcaucuuaaga

SEQ ID NO: 31366 - RNA, 23 nt, Artificial Sequence
  RNA Oligomer
augaguuuuuguagcaucuuaag

SEQ ID NO: 31367 - RNA, 23 nt, Artificial Sequence
  RNA Oligomer
uaugaguuuuuguagcaucuuaa

SEQ ID NO: 31368 - RNA, 23 nt, Artificial Sequence
  RNA Oligomer
auaugaguuuuuguagcaucuua

SEQ ID NO: 31369 - RNA, 23 nt, Artificial Sequence
  RNA Oligomer
gcacugcacacuuguauauuguc

SEQ ID NO: 31370 - RNA, 23 nt, Artificial Sequence
  RNA Oligomer
ggcacugcacacuuguauauugu

SEQ ID NO: 31371 - RNA, 23 nt, Artificial Sequence
  RNA Oligomer
aggcacugcacacuuguauauug

SEQ ID NO: 31372 - RNA, 23 nt, Artificial Sequence
  RNA Oligomer
aaggcacugcacacuuguauauu

SEQ ID NO: 31373 - RNA, 23 nt, Artificial Sequence
  RNA Oligomer
gaaggcacugcacacuuguauau

SEQ ID NO: 31374 - RNA, 23 nt, Artificial Sequence
  RNA Oligomer
ccuggugaauaucgaagaaagga

SEQ ID NO: 31375 - RNA, 23 nt, Artificial Sequence
  RNA Oligomer
uccuggugaauaucgaagaaagg

SEQ ID NO: 31376 - RNA, 23 nt, Artificial Sequence
  RNA Oligomer
uuccuggugaauaucgaagaaag

SEQ ID NO: 31377 - RNA, 23 nt, Artificial Sequence
  RNA Oligomer
guuccuggugaauaucgaagaaa

SEQ ID NO: 31378 - RNA, 23 nt, Artificial Sequence
  RNA Oligomer
aguuccuggugaauaucgaagaa

SEQ ID NO: 31379 - RNA, 23 nt, Artificial Sequence
  RNA Oligomer
cuagaagagaaugaaggauugaa

SEQ ID NO: 31380 - RNA, 23 nt, Artificial Sequence
  RNA Oligomer
ucuagaagagaaugaaggauuga

SEQ ID NO: 31381 - RNA, 23 nt, Artificial Sequence
  RNA Oligomer
cucuagaagagaaugaaggauug

SEQ ID NO: 31382 - RNA, 23 nt, Artificial Sequence
  RNA Oligomer
gaagaugaaaucgaaugguggug

SEQ ID NO: 31383 - RNA, 23 nt, Artificial Sequence
  RNA Oligomer
cgaagaugaaaucgaaugguggu

SEQ ID NO: 31384 - RNA, 23 nt, Artificial Sequence
  RNA Oligomer
acgaagaugaaaucgaauggugg

SEQ ID NO: 31385 - RNA, 23 nt, Artificial Sequence
  RNA Oligomer
gacgaagaugaaaucgaauggug

SEQ ID NO: 31386 - RNA, 23 nt, Artificial Sequence
  RNA Oligomer
agacgaagaugaaaucgaauggu

SEQ ID NO: 31387 - RNA, 23 nt, Artificial Sequence
  RNA Oligomer
agaugggcauaaugaauaaagga

SEQ ID NO: 31388 - RNA, 23 nt, Artificial Sequence
  RNA Oligomer
aagaugggcauaaugaauaaagg

SEQ ID NO: 31389 - RNA, 23 nt, Artificial Sequence
  RNA Oligomer
gaagaugggcauaaugaauaaag

SEQ ID NO: 31390 - RNA, 23 nt, Artificial Sequence
  RNA Oligomer
agaagaugggcauaaugaauaaa

SEQ ID NO: 31391 - RNA, 23 nt, Artificial Sequence
  RNA Oligomer
gagaagaugggcauaaugaauaa

SEQ ID NO: 31392 - RNA, 23 nt, Artificial Sequence
  RNA Oligomer
guaaguuuuugguggagucagga

SEQ ID NO: 31393 - RNA, 23 nt, Artificial Sequence
  RNA Oligomer
uguaaguuuuugguggagucagg

SEQ ID NO: 31394 - RNA, 23 nt, Artificial Sequence
  RNA Oligomer
guguaaguuuuugguggagucag

SEQ ID NO: 31395 - RNA, 23 nt, Artificial Sequence
  RNA Oligomer
uguguaaguuuuugguggaguca

SEQ ID NO: 31396 - RNA, 23 nt, Artificial Sequence
  RNA Oligomer
guguguaaguuuuugguggaguc

SEQ ID NO: 31397 - RNA, 23 nt, Artificial Sequence
  RNA Oligomer
aguguguaaguuuuugguggagu

SEQ ID NO: 31398 - RNA, 23 nt, Artificial Sequence
  RNA Oligomer
aaguguguaaguuuuugguggag

SEQ ID NO: 31399 - RNA, 23 nt, Artificial Sequence
  RNA Oligomer
ugcaggccacacagaaaucguua

SEQ ID NO: 31400 - RNA, 23 nt, Artificial Sequence
  RNA Oligomer
cggcucuucacaaugcugugugu

SEQ ID NO: 31401 - RNA, 23 nt, Artificial Sequence
  RNA Oligomer
acggcucuucacaaugcugugug

SEQ ID NO: 31402 - RNA, 23 nt, Artificial Sequence
  RNA Oligomer
cacggcucuucacaaugcugugu

SEQ ID NO: 31403 - RNA, 23 nt, Artificial Sequence
  RNA Oligomer
ucacggcucuucacaaugcugug

SEQ ID NO: 31404 - RNA, 23 nt, Artificial Sequence
  RNA Oligomer
aucacggcucuucacaaugcugu

SEQ ID NO: 31405 - RNA, 23 nt, Artificial Sequence
  RNA Oligomer
ccuuguacagagaauuauuuaug

SEQ ID NO: 31406 - RNA, 23 nt, Artificial Sequence
  RNA Oligomer
ccaguagaaauccagaauccaua

SEQ ID NO: 31407 - RNA, 23 nt, Artificial Sequence
  RNA Oligomer
cccaguagaaauccagaauccau

SEQ ID NO: 31408 - RNA, 23 nt, Artificial Sequence
  RNA Oligomer
gcccaguagaaauccagaaucca

SEQ ID NO: 31409 - RNA, 23 nt, Artificial Sequence
  RNA Oligomer
agcccaguagaaauccagaaucc

SEQ ID NO: 31410 - RNA, 23 nt, Artificial Sequence
  RNA Oligomer
aagcccaguagaaauccagaauc

SEQ ID NO: 31411 - RNA, 23 nt, Artificial Sequence
  RNA Oligomer
uacgaaagaaacugucuaacgca

SEQ ID NO: 31412 - RNA, 23 nt, Artificial Sequence
  RNA Oligomer
uuacgaaagaaacugucuaacgc

SEQ ID NO: 31413 - RNA, 23 nt, Artificial Sequence
  RNA Oligomer
cuuacgaaagaaacugucuaacg

SEQ ID NO: 31414 - RNA, 23 nt, Artificial Sequence
  RNA Oligomer
ccuuacgaaagaaacugucuaac

SEQ ID NO: 31415 - RNA, 23 nt, Artificial Sequence
  RNA Oligomer
gccuuacgaaagaaacugucuaa

SEQ ID NO: 31416 - RNA, 23 nt, Artificial Sequence
  RNA Oligomer
cggauaaugagcgaauguuugau

SEQ ID NO: 31417 - RNA, 23 nt, Artificial Sequence
  RNA Oligomer
gcggauaaugagcgaauguuuga

SEQ ID NO: 31418 - RNA, 23 nt, Artificial Sequence
  RNA Oligomer
ugcggauaaugagcgaauguuug

SEQ ID NO: 31419 - RNA, 23 nt, Artificial Sequence
  RNA Oligomer
uugcggauaaugagcgaauguuu

SEQ ID NO: 31420 - RNA, 23 nt, Artificial Sequence
  RNA Oligomer
guugcggauaaugagcgaauguu

SEQ ID NO: 31421 - RNA, 23 nt, Artificial Sequence
  RNA Oligomer
gcugcccagaaucaacagcagca

SEQ ID NO: 31422 - RNA, 23 nt, Artificial Sequence
  RNA Oligomer
gaccaagacucauaccagagggc

SEQ ID NO: 31423 - RNA, 23 nt, Artificial Sequence
  RNA Oligomer
ugaccaagacucauaccagaggg

SEQ ID NO: 31424 - RNA, 23 nt, Artificial Sequence
  RNA Oligomer
uugaccaagacucauaccagagg

SEQ ID NO: 31425 - RNA, 23 nt, Artificial Sequence
  RNA Oligomer
guugaccaagacucauaccagag

SEQ ID NO: 31426 - RNA, 23 nt, Artificial Sequence
  RNA Oligomer
cguugaccaagacucauaccaga

SEQ ID NO: 31427 - RNA, 23 nt, Artificial Sequence
  RNA Oligomer
ccguggcagcaaguucaauauau

SEQ ID NO: 31428 - RNA, 23 nt, Artificial Sequence
  RNA Oligomer
gggaacuaaaccaaaaccagcag

SEQ ID NO: 31429 - RNA, 23 nt, Artificial Sequence
  RNA Oligomer
ugggaacuaaaccaaaaccagca

SEQ ID NO: 31430 - RNA, 23 nt, Artificial Sequence
  RNA Oligomer
augggaacuaaaccaaaaccagc

SEQ ID NO: 31431 - RNA, 23 nt, Artificial Sequence
  RNA Oligomer
caugggaacuaaaccaaaaccag

SEQ ID NO: 31432 - RNA, 23 nt, Artificial Sequence
  RNA Oligomer
ccaugggaacuaaaccaaaacca

SEQ ID NO: 31433 - RNA, 23 nt, Artificial Sequence
  RNA Oligomer
cuacaaaaccaaaacagauuaau

SEQ ID NO: 31434 - RNA, 23 nt, Artificial Sequence
  RNA Oligomer
ccuacaaaaccaaaacagauuaa

SEQ ID NO: 31435 - RNA, 23 nt, Artificial Sequence
  RNA Oligomer
uccuacaaaaccaaaacagauua

SEQ ID NO: 31436 - RNA, 23 nt, Artificial Sequence
  RNA Oligomer
uuccuacaaaaccaaaacagauu

SEQ ID NO: 31437 - RNA, 23 nt, Artificial Sequence
  RNA Oligomer
guuccuacaaaaccaaaacagau

SEQ ID NO: 31438 - RNA, 23 nt, Artificial Sequence
  RNA Oligomer
uguuccuacaaaaccaaaacaga

SEQ ID NO: 31439 - RNA, 23 nt, Artificial Sequence
  RNA Oligomer
cuguuccuacaaaaccaaaacag

SEQ ID NO: 31440 - RNA, 23 nt, Artificial Sequence
  RNA Oligomer
cgagagugauugccauuuggcug

SEQ ID NO: 31441 - RNA, 23 nt, Artificial Sequence
  RNA Oligomer
gcgagagugauugccauuuggcu

SEQ ID NO: 31442 - RNA, 23 nt, Artificial Sequence
  RNA Oligomer
ggcgagagugauugccauuuggc

SEQ ID NO: 31443 - RNA, 23 nt, Artificial Sequence
  RNA Oligomer
cggcgagagugauugccauuugg

SEQ ID NO: 31444 - RNA, 23 nt, Artificial Sequence
  RNA Oligomer
ccggcgagagugauugccauuug

SEQ ID NO: 31445 - RNA, 23 nt, Artificial Sequence
  RNA Oligomer
ccaagaugaugccgauguuucuu

SEQ ID NO: 31446 - RNA, 23 nt, Artificial Sequence
  RNA Oligomer
uccaagaugaugccgauguuucu

SEQ ID NO: 31447 - RNA, 23 nt, Artificial Sequence
  RNA Oligomer
guccaagaugaugccgauguuuc

SEQ ID NO: 31448 - RNA, 23 nt, Artificial Sequence
  RNA Oligomer
gguccaagaugaugccgauguuu

SEQ ID NO: 31449 - RNA, 23 nt, Artificial Sequence
  RNA Oligomer
ggguccaagaugaugccgauguu

SEQ ID NO: 31450 - RNA, 23 nt, Artificial Sequence
  RNA Oligomer
gguugcaaauaaaaauguggcua

SEQ ID NO: 31451 - RNA, 23 nt, Artificial Sequence
  RNA Oligomer
agguugcaaauaaaaauguggcu

SEQ ID NO: 31452 - RNA, 23 nt, Artificial Sequence
  RNA Oligomer
cagguugcaaauaaaaauguggc

SEQ ID NO: 31453 - RNA, 23 nt, Artificial Sequence
  RNA Oligomer
ucagguugcaaauaaaaaugugg

SEQ ID NO: 31454 - RNA, 23 nt, Artificial Sequence
  RNA Oligomer
cucagguugcaaauaaaaaugug

SEQ ID NO: 31455 - RNA, 23 nt, Artificial Sequence
  RNA Oligomer
agagcagugaagauaucuugcgg

SEQ ID NO: 31456 - RNA, 23 nt, Artificial Sequence
  RNA Oligomer
cagagcagugaagauaucuugcg

SEQ ID NO: 31457 - RNA, 23 nt, Artificial Sequence
  RNA Oligomer
uggaguccuucaaaugcagaucu

SEQ ID NO: 31458 - RNA, 23 nt, Artificial Sequence
  RNA Oligomer
ccagaaacaauaugcagagacgu

SEQ ID NO: 31459 - RNA, 23 nt, Artificial Sequence
  RNA Oligomer
uccagaaacaauaugcagagacg

SEQ ID NO: 31460 - RNA, 23 nt, Artificial Sequence
  RNA Oligomer
cuccagaaacaauaugcagagac

SEQ ID NO: 31461 - RNA, 23 nt, Artificial Sequence
  RNA Oligomer
acuccagaaacaauaugcagaga

SEQ ID NO: 31462 - RNA, 23 nt, Artificial Sequence
  RNA Oligomer
uacuccagaaacaauaugcagag

SEQ ID NO: 31463 - RNA, 23 nt, Artificial Sequence
  RNA Oligomer
ggccugaauugcuggugaagcca

SEQ ID NO: 31464 - RNA, 23 nt, Artificial Sequence
  RNA Oligomer
aggccugaauugcuggugaagcc

SEQ ID NO: 31465 - RNA, 23 nt, Artificial Sequence
  RNA Oligomer
aaggccugaauugcuggugaagc

SEQ ID NO: 31466 - RNA, 23 nt, Artificial Sequence
  RNA Oligomer
caaggccugaauugcuggugaag

SEQ ID NO: 31467 - RNA, 23 nt, Artificial Sequence
  RNA Oligomer
ucaaggccugaauugcuggugaa

SEQ ID NO: 31468 - RNA, 23 nt, Artificial Sequence
  RNA Oligomer
gaaaaucuaccaguuucaucuga

SEQ ID NO: 31469 - RNA, 23 nt, Artificial Sequence
  RNA Oligomer
agaaaaucuaccaguuucaucug

SEQ ID NO: 31470 - RNA, 23 nt, Artificial Sequence
  RNA Oligomer
aagaaaaucuaccaguuucaucu

SEQ ID NO: 31471 - RNA, 23 nt, Artificial Sequence
  RNA Oligomer
aaagaaaaucuaccaguuucauc

SEQ ID NO: 31472 - RNA, 23 nt, Artificial Sequence
  RNA Oligomer
aaaagaaaaucuaccaguuucau

SEQ ID NO: 31473 - RNA, 23 nt, Artificial Sequence
  RNA Oligomer
gcguaauucagaaguggcaguca

SEQ ID NO: 31474 - RNA, 23 nt, Artificial Sequence
  RNA Oligomer
agcguaauucagaaguggcaguc

SEQ ID NO: 31475 - RNA, 23 nt, Artificial Sequence
  RNA Oligomer
aagcguaauucagaaguggcagu

SEQ ID NO: 31476 - RNA, 23 nt, Artificial Sequence
  RNA Oligomer
uaagcguaauucagaaguggcag

SEQ ID NO: 31477 - RNA, 23 nt, Artificial Sequence
  RNA Oligomer
auaagcguaauucagaaguggca

SEQ ID NO: 31478 - RNA, 23 nt, Artificial Sequence
  RNA Oligomer
guguuugaauaagcguaauucag

SEQ ID NO: 31479 - RNA, 23 nt, Artificial Sequence
  RNA Oligomer
aguguuugaauaagcguaauuca

SEQ ID NO: 31480 - RNA, 23 nt, Artificial Sequence
  RNA Oligomer
gaguguuugaauaagcguaauuc

SEQ ID NO: 31481 - RNA, 23 nt, Artificial Sequence
  RNA Oligomer
ggaguguuugaauaagcguaauu

SEQ ID NO: 31482 - RNA, 23 nt, Artificial Sequence
  RNA Oligomer
gggaguguuugaauaagcguaau

SEQ ID NO: 31483 - RNA, 23 nt, Artificial Sequence
  RNA Oligomer
agagggaguguuugaauaagcgu

SEQ ID NO: 31484 - RNA, 23 nt, Artificial Sequence
  RNA Oligomer
ccaagcuacaacaacagagggag

SEQ ID NO: 31485 - RNA, 23 nt, Artificial Sequence
  RNA Oligomer
gccaagcuacaacaacagaggga

SEQ ID NO: 31486 - RNA, 23 nt, Artificial Sequence
  RNA Oligomer
ugccaagcuacaacaacagaggg

SEQ ID NO: 31487 - RNA, 23 nt, Artificial Sequence
  RNA Oligomer
augccaagcuacaacaacagagg

SEQ ID NO: 31488 - RNA, 23 nt, Artificial Sequence
  RNA Oligomer
aaugccaagcuacaacaacagag

SEQ ID NO: 31489 - RNA, 23 nt, Artificial Sequence
  RNA Oligomer
ugcagcuaagaaacaaauugaau

SEQ ID NO: 31490 - RNA, 23 nt, Artificial Sequence
  RNA Oligomer
caaaaguagaagaacugaccagg

SEQ ID NO: 31491 - RNA, 23 nt, Artificial Sequence
  RNA Oligomer
ucaaaaguagaagaacugaccag

SEQ ID NO: 31492 - RNA, 23 nt, Artificial Sequence
  RNA Oligomer
gucaaaaguagaagaacugacca

SEQ ID NO: 31493 - RNA, 23 nt, Artificial Sequence
  RNA Oligomer
ugucaaaaguagaagaacugacc

SEQ ID NO: 31494 - RNA, 23 nt, Artificial Sequence
  RNA Oligomer
gugucaaaaguagaagaacugac

SEQ ID NO: 31495 - RNA, 23 nt, Artificial Sequence
  RNA Oligomer
ugugucaaaaguagaagaacuga

SEQ ID NO: 31496 - RNA, 23 nt, Artificial Sequence
  RNA Oligomer
cugugucaaaaguagaagaacug

SEQ ID NO: 31497 - RNA, 23 nt, Artificial Sequence
  RNA Oligomer
gcugugucaaaaguagaagaacu

SEQ ID NO: 31498 - RNA, 23 nt, Artificial Sequence
  RNA Oligomer
guggaggaaauugaacagaugaa

SEQ ID NO: 31499 - RNA, 23 nt, Artificial Sequence
  RNA Oligomer
uguggaggaaauugaacagauga

SEQ ID NO: 31500 - RNA, 23 nt, Artificial Sequence
  RNA Oligomer
uuguggaggaaauugaacagaug

SEQ ID NO: 31501 - RNA, 23 nt, Artificial Sequence
  RNA Oligomer
ggagaaacuuaaaaggcuaaaag

SEQ ID NO: 31502 - RNA, 23 nt, Artificial Sequence
  RNA Oligomer
aggagaaacuuaaaaggcuaaaa

SEQ ID NO: 31503 - RNA, 23 nt, Artificial Sequence
  RNA Oligomer
caggagaaacuuaaaaggcuaaa

SEQ ID NO: 31504 - RNA, 23 nt, Artificial Sequence
  RNA Oligomer
gcaggagaaacuuaaaaggcuaa

SEQ ID NO: 31505 - RNA, 23 nt, Artificial Sequence
  RNA Oligomer
agcaggagaaacuuaaaaggcua

SEQ ID NO: 31506 - RNA, 23 nt, Artificial Sequence
  RNA Oligomer
aacagcgcuuaaaguuuuugaaa

SEQ ID NO: 31507 - RNA, 23 nt, Artificial Sequence
  RNA Oligomer
ucugacucuugcugaacuucagg

SEQ ID NO: 31508 - RNA, 23 nt, Artificial Sequence
  RNA Oligomer
aucugacucuugcugaacuucag

SEQ ID NO: 31509 - RNA, 23 nt, Artificial Sequence
  RNA Oligomer
gaucugacucuugcugaacuuca

SEQ ID NO: 31510 - RNA, 23 nt, Artificial Sequence
  RNA Oligomer
cuaagcuacgguaccaguaauua

SEQ ID NO: 31511 - RNA, 23 nt, Artificial Sequence
  RNA Oligomer
acuaagcuacgguaccaguaauu

SEQ ID NO: 31512 - RNA, 23 nt, Artificial Sequence
  RNA Oligomer
aacuaagcuacgguaccaguaau

SEQ ID NO: 31513 - RNA, 23 nt, Artificial Sequence
  RNA Oligomer
aaacuaagcuacgguaccaguaa

SEQ ID NO: 31514 - RNA, 23 nt, Artificial Sequence
  RNA Oligomer
gaaacuaagcuacgguaccagua

SEQ ID NO: 31515 - RNA, 23 nt, Artificial Sequence
  RNA Oligomer
cuggugaauaucgaagaaaggag

SEQ ID NO: 31516 - RNA, 23 nt, Artificial Sequence
  RNA Oligomer
gauugaagaauucaccauuagag

SEQ ID NO: 31517 - RNA, 23 nt, Artificial Sequence
  RNA Oligomer
ucucuagaagagaaugaaggauu

SEQ ID NO: 31518 - RNA, 23 nt, Artificial Sequence
  RNA Oligomer
gucucuagaagagaaugaaggau

SEQ ID NO: 31519 - RNA, 23 nt, Artificial Sequence
  RNA Oligomer
ccaugaccuacagugacaugcag

SEQ ID NO: 31520 - RNA, 23 nt, Artificial Sequence
  RNA Oligomer
gccaugaccuacagugacaugca

SEQ ID NO: 31521 - RNA, 23 nt, Artificial Sequence
  RNA Oligomer
ugccaugaccuacagugacaugc

SEQ ID NO: 31522 - RNA, 23 nt, Artificial Sequence
  RNA Oligomer
uugccaugaccuacagugacaug

SEQ ID NO: 31523 - RNA, 23 nt, Artificial Sequence
  RNA Oligomer
uuugccaugaccuacagugacau

SEQ ID NO: 31524 - RNA, 23 nt, Artificial Sequence
  RNA Oligomer
cucauguaacaacguccaagugu

SEQ ID NO: 31525 - RNA, 23 nt, Artificial Sequence
  RNA Oligomer
ccucauguaacaacguccaagug

SEQ ID NO: 31526 - RNA, 23 nt, Artificial Sequence
  RNA Oligomer
gccucauguaacaacguccaagu

SEQ ID NO: 31527 - RNA, 23 nt, Artificial Sequence
  RNA Oligomer
ugccucauguaacaacguccaag

SEQ ID NO: 31528 - RNA, 23 nt, Artificial Sequence
  RNA Oligomer
cugccucauguaacaacguccaa

SEQ ID NO: 31529 - RNA, 23 nt, Artificial Sequence
  RNA Oligomer
gcugccucauguaacaacgucca

SEQ ID NO: 31530 - RNA, 23 nt, Artificial Sequence
  RNA Oligomer
gugcaggccacacagaaaucguu

SEQ ID NO: 31531 - RNA, 23 nt, Artificial Sequence
  RNA Oligomer
ggagaauuugaccuuguacagag

SEQ ID NO: 31532 - RNA, 23 nt, Artificial Sequence
  RNA Oligomer
ccagaggcuccacaugugcuuga

SEQ ID NO: 31533 - RNA, 23 nt, Artificial Sequence
  RNA Oligomer
uccagaggcuccacaugugcuug

SEQ ID NO: 31534 - RNA, 23 nt, Artificial Sequence
  RNA Oligomer
auccagaggcuccacaugugcuu

SEQ ID NO: 31535 - RNA, 23 nt, Artificial Sequence
  RNA Oligomer
ucucugucccaucauacccaucc

SEQ ID NO: 31536 - RNA, 23 nt, Artificial Sequence
  RNA Oligomer
aucucugucccaucauacccauc

SEQ ID NO: 31537 - RNA, 23 nt, Artificial Sequence
  RNA Oligomer
caucucugucccaucauacccau

SEQ ID NO: 31538 - RNA, 23 nt, Artificial Sequence
  RNA Oligomer
ccgaaaccagagugaugcugacc

SEQ ID NO: 31539 - RNA, 23 nt, Artificial Sequence
  RNA Oligomer
accgaaaccagagugaugcugac

SEQ ID NO: 31540 - RNA, 23 nt, Artificial Sequence
  RNA Oligomer
uaccgaaaccagagugaugcuga

SEQ ID NO: 31541 - RNA, 23 nt, Artificial Sequence
  RNA Oligomer
uuaccgaaaccagagugaugcug

SEQ ID NO: 31542 - RNA, 23 nt, Artificial Sequence
  RNA Oligomer
cuuaccgaaaccagagugaugcu

SEQ ID NO: 31543 - RNA, 23 nt, Artificial Sequence
  RNA Oligomer
gcaaguucaauauauuccaugua

SEQ ID NO: 31544 - RNA, 23 nt, Artificial Sequence
  RNA Oligomer
agcaaguucaauauauuccaugu

SEQ ID NO: 31545 - RNA, 23 nt, Artificial Sequence
  RNA Oligomer
cagcaaguucaauauauuccaug

SEQ ID NO: 31546 - RNA, 23 nt, Artificial Sequence
  RNA Oligomer
cccggcgagagugauugccauuu

SEQ ID NO: 31547 - RNA, 23 nt, Artificial Sequence
  RNA Oligomer
ugcaaauaaaaauguggcuaaag

SEQ ID NO: 31548 - RNA, 23 nt, Artificial Sequence
  RNA Oligomer
uugcaaauaaaaauguggcuaaa

SEQ ID NO: 31549 - RNA, 23 nt, Artificial Sequence
  RNA Oligomer
guugcaaauaaaaauguggcuaa

SEQ ID NO: 31550 - RNA, 23 nt, Artificial Sequence
  RNA Oligomer
gcucagguugcaaauaaaaaugu

SEQ ID NO: 31551 - RNA, 23 nt, Artificial Sequence
  RNA Oligomer
ugcucagguugcaaauaaaaaug

SEQ ID NO: 31552 - RNA, 23 nt, Artificial Sequence
  RNA Oligomer
augcucagguugcaaauaaaaau

SEQ ID NO: 31553 - RNA, 23 nt, Artificial Sequence
  RNA Oligomer
gaugcucagguugcaaauaaaaa

SEQ ID NO: 31554 - RNA, 23 nt, Artificial Sequence
  RNA Oligomer
ggaugcucagguugcaaauaaaa

SEQ ID NO: 31555 - RNA, 23 nt, Artificial Sequence
  RNA Oligomer
cgugguggaucugugcaaagaac

SEQ ID NO: 31556 - RNA, 23 nt, Artificial Sequence
  RNA Oligomer
acgugguggaucugugcaaagaa

SEQ ID NO: 31557 - RNA, 23 nt, Artificial Sequence
  RNA Oligomer
gacgugguggaucugugcaaaga

SEQ ID NO: 31558 - RNA, 23 nt, Artificial Sequence
  RNA Oligomer
agacgugguggaucugugcaaag

SEQ ID NO: 31559 - RNA, 23 nt, Artificial Sequence
  RNA Oligomer
gagacgugguggaucugugcaaa

SEQ ID NO: 31560 - RNA, 23 nt, Artificial Sequence
  RNA Oligomer
agagacgugguggaucugugcaa

SEQ ID NO: 31561 - RNA, 23 nt, Artificial Sequence
  RNA Oligomer
cgaugaaaauacagacacugccc

SEQ ID NO: 31562 - RNA, 23 nt, Artificial Sequence
  RNA Oligomer
ccgaugaaaauacagacacugcc

SEQ ID NO: 31563 - RNA, 23 nt, Artificial Sequence
  RNA Oligomer
gccgaugaaaauacagacacugc

SEQ ID NO: 31564 - RNA, 23 nt, Artificial Sequence
  RNA Oligomer
ggccgaugaaaauacagacacug

SEQ ID NO: 31565 - RNA, 23 nt, Artificial Sequence
  RNA Oligomer
gggccgaugaaaauacagacacu

SEQ ID NO: 31566 - RNA, 23 nt, Artificial Sequence
  RNA Oligomer
cgucuacuaugccucggaugccc

SEQ ID NO: 31567 - RNA, 23 nt, Artificial Sequence
  RNA Oligomer
ucgucuacuaugccucggaugcc

SEQ ID NO: 31568 - RNA, 23 nt, Artificial Sequence
  RNA Oligomer
gucgucuacuaugccucggaugc

SEQ ID NO: 31569 - RNA, 23 nt, Artificial Sequence
  RNA Oligomer
agucgucuacuaugccucggaug

SEQ ID NO: 31570 - RNA, 23 nt, Artificial Sequence
  RNA Oligomer
cagucgucuacuaugccucggau

SEQ ID NO: 31571 - RNA, 23 nt, Artificial Sequence
  RNA Oligomer
caaaaagaaaaucuaccaguuuc

SEQ ID NO: 31572 - RNA, 23 nt, Artificial Sequence
  RNA Oligomer
gcaaaaagaaaaucuaccaguuu

SEQ ID NO: 31573 - RNA, 23 nt, Artificial Sequence
  RNA Oligomer
agcaaaaagaaaaucuaccaguu

SEQ ID NO: 31574 - RNA, 23 nt, Artificial Sequence
  RNA Oligomer
cagcaaaaagaaaaucuaccagu

SEQ ID NO: 31575 - RNA, 23 nt, Artificial Sequence
  RNA Oligomer
acagcaaaaagaaaaucuaccag

SEQ ID NO: 31576 - RNA, 23 nt, Artificial Sequence
  RNA Oligomer
gaagaaggcagcucuacagcaaa

SEQ ID NO: 31577 - RNA, 23 nt, Artificial Sequence
  RNA Oligomer
agaagaaggcagcucuacagcaa

SEQ ID NO: 31578 - RNA, 23 nt, Artificial Sequence
  RNA Oligomer
aagaagaaggcagcucuacagca

SEQ ID NO: 31579 - RNA, 23 nt, Artificial Sequence
  RNA Oligomer
gaagaagaaggcagcucuacagc

SEQ ID NO: 31580 - RNA, 23 nt, Artificial Sequence
  RNA Oligomer
aacaacagagggaguguuugaau

SEQ ID NO: 31581 - RNA, 23 nt, Artificial Sequence
  RNA Oligomer
ucacagaaguuccaguuacucca

SEQ ID NO: 31582 - RNA, 23 nt, Artificial Sequence
  RNA Oligomer
uucacagaaguuccaguuacucc

SEQ ID NO: 31583 - RNA, 23 nt, Artificial Sequence
  RNA Oligomer
cuucacagaaguuccaguuacuc

SEQ ID NO: 31584 - RNA, 23 nt, Artificial Sequence
  RNA Oligomer
acuucacagaaguuccaguuacu

SEQ ID NO: 31585 - RNA, 23 nt, Artificial Sequence
  RNA Oligomer
cacuucacagaaguuccaguuac

SEQ ID NO: 31586 - RNA, 23 nt, Artificial Sequence
  RNA Oligomer
gaauaauuuguuccagcaaaaac

SEQ ID NO: 31587 - RNA, 23 nt, Artificial Sequence
  RNA Oligomer
ugaauaauuuguuccagcaaaaa

SEQ ID NO: 31588 - RNA, 23 nt, Artificial Sequence
  RNA Oligomer
augaauaauuuguuccagcaaaa

SEQ ID NO: 31589 - RNA, 23 nt, Artificial Sequence
  RNA Oligomer
gaugaauaauuuguuccagcaaa

SEQ ID NO: 31590 - RNA, 23 nt, Artificial Sequence
  RNA Oligomer
agaugaauaauuuguuccagcaa

SEQ ID NO: 31591 - RNA, 23 nt, Artificial Sequence
  RNA Oligomer
cuaaaagaaauagcugagaauca

SEQ ID NO: 31592 - RNA, 23 nt, Artificial Sequence
  RNA Oligomer
gcuaaaagaaauagcugagaauc

SEQ ID NO: 31593 - RNA, 23 nt, Artificial Sequence
  RNA Oligomer
ggcuaaaagaaauagcugagaau

SEQ ID NO: 31594 - RNA, 23 nt, Artificial Sequence
  RNA Oligomer
aggcuaaaagaaauagcugagaa

SEQ ID NO: 31595 - RNA, 23 nt, Artificial Sequence
  RNA Oligomer
aaggcuaaaagaaauagcugaga

SEQ ID NO: 31596 - RNA, 23 nt, Artificial Sequence
  RNA Oligomer
acagauugaagcccagcaacaau

SEQ ID NO: 31597 - RNA, 23 nt, Artificial Sequence
  RNA Oligomer
aacagauugaagcccagcaacaa

SEQ ID NO: 31598 - RNA, 23 nt, Artificial Sequence
  RNA Oligomer
caacagauugaagcccagcaaca

SEQ ID NO: 31599 - RNA, 23 nt, Artificial Sequence
  RNA Oligomer
gaaacuugcuacagacuuacccg

SEQ ID NO: 31600 - RNA, 23 nt, Artificial Sequence
  RNA Oligomer
agaaacuugcuacagacuuaccc

SEQ ID NO: 31601 - RNA, 23 nt, Artificial Sequence
  RNA Oligomer
uagaaacuugcuacagacuuacc

SEQ ID NO: 31602 - RNA, 23 nt, Artificial Sequence
  RNA Oligomer
uuagaaacuugcuacagacuuac

SEQ ID NO: 31603 - RNA, 23 nt, Artificial Sequence
  RNA Oligomer
auuagaaacuugcuacagacuua

SEQ ID NO: 31604 - RNA, 23 nt, Artificial Sequence
  RNA Oligomer
aucgaagaaaggagaacgguguu

SEQ ID NO: 31605 - RNA, 23 nt, Artificial Sequence
  RNA Oligomer
uaucgaagaaaggagaacggugu

SEQ ID NO: 31606 - RNA, 23 nt, Artificial Sequence
  RNA Oligomer
agcuacgguaccaguaauuagau

SEQ ID NO: 31607 - RNA, 23 nt, Artificial Sequence
  RNA Oligomer
gaauaucgaagaaaggagaacgg

SEQ ID NO: 31608 - RNA, 23 nt, Artificial Sequence
  RNA Oligomer
ugaauaucgaagaaaggagaacg

SEQ ID NO: 31609 - RNA, 23 nt, Artificial Sequence
  RNA Oligomer
gugaauaucgaagaaaggagaac

SEQ ID NO: 31610 - RNA, 23 nt, Artificial Sequence
  RNA Oligomer
ggugaauaucgaagaaaggagaa

SEQ ID NO: 31611 - RNA, 23 nt, Artificial Sequence
  RNA Oligomer
uggugaauaucgaagaaaggaga

SEQ ID NO: 31612 - RNA, 23 nt, Artificial Sequence
  RNA Oligomer
cgacaauccuguuuucuacaaga

SEQ ID NO: 31613 - RNA, 23 nt, Artificial Sequence
  RNA Oligomer
gcgacaauccuguuuucuacaag

SEQ ID NO: 31614 - RNA, 23 nt, Artificial Sequence
  RNA Oligomer
agcgacaauccuguuuucuacaa

SEQ ID NO: 31615 - RNA, 23 nt, Artificial Sequence
  RNA Oligomer
cagcgacaauccuguuuucuaca

SEQ ID NO: 31616 - RNA, 23 nt, Artificial Sequence
  RNA Oligomer
acagcgacaauccuguuuucuac

SEQ ID NO: 31617 - RNA, 23 nt, Artificial Sequence
  RNA Oligomer
agauaaguauacagcgacaaucc

SEQ ID NO: 31618 - RNA, 23 nt, Artificial Sequence
  RNA Oligomer
cagauaaguauacagcgacaauc

SEQ ID NO: 31619 - RNA, 23 nt, Artificial Sequence
  RNA Oligomer
ucagauaaguauacagcgacaau

SEQ ID NO: 31620 - RNA, 23 nt, Artificial Sequence
  RNA Oligomer
cucagauaaguauacagcgacaa

SEQ ID NO: 31621 - RNA, 23 nt, Artificial Sequence
  RNA Oligomer
acucagauaaguauacagcgaca

SEQ ID NO: 31622 - RNA, 23 nt, Artificial Sequence
  RNA Oligomer
cacucagauaaguauacagcgac

SEQ ID NO: 31623 - RNA, 23 nt, Artificial Sequence
  RNA Oligomer
gcacucagauaaguauacagcga

SEQ ID NO: 31624 - RNA, 23 nt, Artificial Sequence
  RNA Oligomer
ggacauuuagcgugaugaaauaa

SEQ ID NO: 31625 - RNA, 23 nt, Artificial Sequence
  RNA Oligomer
aggacauuuagcgugaugaaaua

SEQ ID NO: 31626 - RNA, 23 nt, Artificial Sequence
  RNA Oligomer
gaggacauuuagcgugaugaaau

SEQ ID NO: 31627 - RNA, 23 nt, Artificial Sequence
  RNA Oligomer
agaggacauuuagcgugaugaaa

SEQ ID NO: 31628 - RNA, 23 nt, Artificial Sequence
  RNA Oligomer
uagaggacauuuagcgugaugaa

SEQ ID NO: 31629 - RNA, 23 nt, Artificial Sequence
  RNA Oligomer
cacagaauuuuagucaaugaaga

SEQ ID NO: 31630 - RNA, 23 nt, Artificial Sequence
  RNA Oligomer
acacagaauuuuagucaaugaag

SEQ ID NO: 31631 - RNA, 23 nt, Artificial Sequence
  RNA Oligomer
guaacuugcugggacuguaccca

SEQ ID NO: 31632 - RNA, 23 nt, Artificial Sequence
  RNA Oligomer
cguaacuugcugggacuguaccc

SEQ ID NO: 31633 - RNA, 23 nt, Artificial Sequence
  RNA Oligomer
acguaacuugcugggacuguacc

SEQ ID NO: 31634 - RNA, 23 nt, Artificial Sequence
  RNA Oligomer
cacguaacuugcugggacuguac

SEQ ID NO: 31635 - RNA, 23 nt, Artificial Sequence
  RNA Oligomer
ccacguaacuugcugggacugua

SEQ ID NO: 31636 - RNA, 23 nt, Artificial Sequence
  RNA Oligomer
cacagggaagacgaagaugaaau

SEQ ID NO: 31637 - RNA, 23 nt, Artificial Sequence
  RNA Oligomer
uaacaacguccaaguguguaagu

SEQ ID NO: 31638 - RNA, 23 nt, Artificial Sequence
  RNA Oligomer
guaacaacguccaaguguguaag

SEQ ID NO: 31639 - RNA, 23 nt, Artificial Sequence
  RNA Oligomer
uguaacaacguccaaguguguaa

SEQ ID NO: 31640 - RNA, 23 nt, Artificial Sequence
  RNA Oligomer
ucauguaacaacguccaagugug

SEQ ID NO: 31641 - RNA, 23 nt, Artificial Sequence
  RNA Oligomer
ugcugccucauguaacaacgucc

SEQ ID NO: 31642 - RNA, 23 nt, Artificial Sequence
  RNA Oligomer
gugcugccucauguaacaacguc

SEQ ID NO: 31643 - RNA, 23 nt, Artificial Sequence
  RNA Oligomer
ggacuccauuacauugugcugcc

SEQ ID NO: 31644 - RNA, 23 nt, Artificial Sequence
  RNA Oligomer
uggacuccauuacauugugcugc

SEQ ID NO: 31645 - RNA, 23 nt, Artificial Sequence
  RNA Oligomer
auggacuccauuacauugugcug

SEQ ID NO: 31646 - RNA, 23 nt, Artificial Sequence
  RNA Oligomer
gauggacuccauuacauugugcu

SEQ ID NO: 31647 - RNA, 23 nt, Artificial Sequence
  RNA Oligomer
ggauggacuccauuacauugugc

SEQ ID NO: 31648 - RNA, 23 nt, Artificial Sequence
  RNA Oligomer
uggauggacuccauuacauugug

SEQ ID NO: 31649 - RNA, 23 nt, Artificial Sequence
  RNA Oligomer
aaauguaaaugcugcugauagug

SEQ ID NO: 31650 - RNA, 23 nt, Artificial Sequence
  RNA Oligomer
uaaauguaaaugcugcugauagu

SEQ ID NO: 31651 - RNA, 23 nt, Artificial Sequence
  RNA Oligomer
guaaauguaaaugcugcugauag

SEQ ID NO: 31652 - RNA, 23 nt, Artificial Sequence
  RNA Oligomer
uguaaauguaaaugcugcugaua

SEQ ID NO: 31653 - RNA, 23 nt, Artificial Sequence
  RNA Oligomer
guguaaauguaaaugcugcugau

SEQ ID NO: 31654 - RNA, 23 nt, Artificial Sequence
  RNA Oligomer
ucauggaaugagggugaaauuca

SEQ ID NO: 31655 - RNA, 23 nt, Artificial Sequence
  RNA Oligomer
ccaaauauucagaagcuuuuaua

SEQ ID NO: 31656 - RNA, 23 nt, Artificial Sequence
  RNA Oligomer
gaaacguaguucuauuacagagc

SEQ ID NO: 31657 - RNA, 23 nt, Artificial Sequence
  RNA Oligomer
agaaacguaguucuauuacagag

SEQ ID NO: 31658 - RNA, 23 nt, Artificial Sequence
  RNA Oligomer
aagaaacguaguucuauuacaga

SEQ ID NO: 31659 - RNA, 23 nt, Artificial Sequence
  RNA Oligomer
aaagaaacguaguucuauuacag

SEQ ID NO: 31660 - RNA, 23 nt, Artificial Sequence
  RNA Oligomer
uaaagaaacguaguucuauuaca

SEQ ID NO: 31661 - RNA, 23 nt, Artificial Sequence
  RNA Oligomer
agccuuacgaaagaaacugucua

SEQ ID NO: 31662 - RNA, 23 nt, Artificial Sequence
  RNA Oligomer
cuaauccuuaccgaaaccagagu

SEQ ID NO: 31663 - RNA, 23 nt, Artificial Sequence
  RNA Oligomer
ucuaauccuuaccgaaaccagag

SEQ ID NO: 31664 - RNA, 23 nt, Artificial Sequence
  RNA Oligomer
aucuaauccuuaccgaaaccaga

SEQ ID NO: 31665 - RNA, 23 nt, Artificial Sequence
  RNA Oligomer
uaucuaauccuuaccgaaaccag

SEQ ID NO: 31666 - RNA, 23 nt, Artificial Sequence
  RNA Oligomer
uuaucuaauccuuaccgaaacca

SEQ ID NO: 31667 - RNA, 23 nt, Artificial Sequence
  RNA Oligomer
cucagcccaacuaaauuacugcc

SEQ ID NO: 31668 - RNA, 23 nt, Artificial Sequence
  RNA Oligomer
ggcgccaggaaaaaacuuccagc

SEQ ID NO: 31669 - RNA, 23 nt, Artificial Sequence
  RNA Oligomer
aggcgccaggaaaaaacuuccag

SEQ ID NO: 31670 - RNA, 23 nt, Artificial Sequence
  RNA Oligomer
caggcgccaggaaaaaacuucca

SEQ ID NO: 31671 - RNA, 23 nt, Artificial Sequence
  RNA Oligomer
gcaggcgccaggaaaaaacuucc

SEQ ID NO: 31672 - RNA, 23 nt, Artificial Sequence
  RNA Oligomer
agcaggcgccaggaaaaaacuuc

SEQ ID NO: 31673 - RNA, 23 nt, Artificial Sequence
  RNA Oligomer
ccuuauuuuggacaaacuaauca

SEQ ID NO: 31674 - RNA, 23 nt, Artificial Sequence
  RNA Oligomer
gguggaucugugcaaagaacccg

SEQ ID NO: 31675 - RNA, 23 nt, Artificial Sequence
  RNA Oligomer
ugguggaucugugcaaagaaccc

SEQ ID NO: 31676 - RNA, 23 nt, Artificial Sequence
  RNA Oligomer
gugguggaucugugcaaagaacc

SEQ ID NO: 31677 - RNA, 23 nt, Artificial Sequence
  RNA Oligomer
uuggaguccuucaaaugcagauc

SEQ ID NO: 31678 - RNA, 23 nt, Artificial Sequence
  RNA Oligomer
auuggaguccuucaaaugcagau

SEQ ID NO: 31679 - RNA, 23 nt, Artificial Sequence
  RNA Oligomer
ggggccgaugaaaauacagacac

SEQ ID NO: 31680 - RNA, 23 nt, Artificial Sequence
  RNA Oligomer
aggggccgaugaaaauacagaca

SEQ ID NO: 31681 - RNA, 23 nt, Artificial Sequence
  RNA Oligomer
aguuucaucugauggaaaucuuc

SEQ ID NO: 31682 - RNA, 23 nt, Artificial Sequence
  RNA Oligomer
caguuucaucugauggaaaucuu

SEQ ID NO: 31683 - RNA, 23 nt, Artificial Sequence
  RNA Oligomer
ccaguuucaucugauggaaaucu

SEQ ID NO: 31684 - RNA, 23 nt, Artificial Sequence
  RNA Oligomer
accaguuucaucugauggaaauc

SEQ ID NO: 31685 - RNA, 23 nt, Artificial Sequence
  RNA Oligomer
uaccaguuucaucugauggaaau

SEQ ID NO: 31686 - RNA, 23 nt, Artificial Sequence
  RNA Oligomer
gcguguuaaugagcugagggacc

SEQ ID NO: 31687 - RNA, 23 nt, Artificial Sequence
  RNA Oligomer
agcguguuaaugagcugagggac

SEQ ID NO: 31688 - RNA, 23 nt, Artificial Sequence
  RNA Oligomer
aagcguguuaaugagcugaggga

SEQ ID NO: 31689 - RNA, 23 nt, Artificial Sequence
  RNA Oligomer
uaagcguguuaaugagcugaggg

SEQ ID NO: 31690 - RNA, 23 nt, Artificial Sequence
  RNA Oligomer
auaagcguguuaaugagcugagg

SEQ ID NO: 31691 - RNA, 23 nt, Artificial Sequence
  RNA Oligomer
gucauggauaagcguguuaauga

SEQ ID NO: 31692 - RNA, 23 nt, Artificial Sequence
  RNA Oligomer
agucauggauaagcguguuaaug

SEQ ID NO: 31693 - RNA, 23 nt, Artificial Sequence
  RNA Oligomer
cagucauggauaagcguguuaau

SEQ ID NO: 31694 - RNA, 23 nt, Artificial Sequence
  RNA Oligomer
gcagucauggauaagcguguuaa

SEQ ID NO: 31695 - RNA, 23 nt, Artificial Sequence
  RNA Oligomer
aauaagcguaauucagaaguggc

SEQ ID NO: 31696 - RNA, 23 nt, Artificial Sequence
  RNA Oligomer
gagggaguguuugaauaagcgua

SEQ ID NO: 31697 - RNA, 23 nt, Artificial Sequence
  RNA Oligomer
agcuacaacaacagagggagugu

SEQ ID NO: 31698 - RNA, 23 nt, Artificial Sequence
  RNA Oligomer
aagcuacaacaacagagggagug

SEQ ID NO: 31699 - RNA, 23 nt, Artificial Sequence
  RNA Oligomer
caagcuacaacaacagagggagu

SEQ ID NO: 31700 - RNA, 23 nt, Artificial Sequence
  RNA Oligomer
cacagaaguuccaguuacuccag

SEQ ID NO: 31701 - RNA, 23 nt, Artificial Sequence
  RNA Oligomer
cagaugaauaauuuguuccagca

SEQ ID NO: 31702 - RNA, 23 nt, Artificial Sequence
  RNA Oligomer
acagaagagacuaagcaauggga

SEQ ID NO: 31703 - RNA, 23 nt, Artificial Sequence
  RNA Oligomer
aacagaagagacuaagcaauggg

SEQ ID NO: 31704 - RNA, 23 nt, Artificial Sequence
  RNA Oligomer
gaacagaagagacuaagcaaugg

SEQ ID NO: 31705 - RNA, 23 nt, Artificial Sequence
  RNA Oligomer
ggaacagaagagacuaagcaaug

SEQ ID NO: 31706 - RNA, 23 nt, Artificial Sequence
  RNA Oligomer
uggaacagaagagacuaagcaau

SEQ ID NO: 31707 - RNA, 23 nt, Artificial Sequence
  RNA Oligomer
guggaacagaagagacuaagcaa

SEQ ID NO: 31708 - RNA, 23 nt, Artificial Sequence
  RNA Oligomer
cguggaacagaagagacuaagca

SEQ ID NO: 31709 - RNA, 23 nt, Artificial Sequence
  RNA Oligomer
acguggaacagaagagacuaagc

SEQ ID NO: 31710 - RNA, 23 nt, Artificial Sequence
  RNA Oligomer
cacguggaacagaagagacuaag

SEQ ID NO: 31711 - RNA, 23 nt, Artificial Sequence
  RNA Oligomer
ccacguggaacagaagagacuaa

SEQ ID NO: 31712 - RNA, 23 nt, Artificial Sequence
  RNA Oligomer
guaacaaugagcagcacuucaca

SEQ ID NO: 31713 - RNA, 23 nt, Artificial Sequence
  RNA Oligomer
aguaacaaugagcagcacuucac

SEQ ID NO: 31714 - RNA, 23 nt, Artificial Sequence
  RNA Oligomer
caguaacaaugagcagcacuuca

SEQ ID NO: 31715 - RNA, 23 nt, Artificial Sequence
  RNA Oligomer
ucaguaacaaugagcagcacuuc

SEQ ID NO: 31716 - RNA, 23 nt, Artificial Sequence
  RNA Oligomer
cucaguaacaaugagcagcacuu

SEQ ID NO: 31717 - RNA, 23 nt, Artificial Sequence
  RNA Oligomer
gcuaaaaaaagugagagcacuua

SEQ ID NO: 31718 - RNA, 23 nt, Artificial Sequence
  RNA Oligomer
agcuaaaaaaagugagagcacuu

SEQ ID NO: 31719 - RNA, 23 nt, Artificial Sequence
  RNA Oligomer
aagcuaaaaaaagugagagcacu

SEQ ID NO: 31720 - RNA, 23 nt, Artificial Sequence
  RNA Oligomer
uaagcuaaaaaaagugagagcac

SEQ ID NO: 31721 - RNA, 23 nt, Artificial Sequence
  RNA Oligomer
cuaagcuaaaaaaagugagagca

SEQ ID NO: 31722 - RNA, 23 nt, Artificial Sequence
  RNA Oligomer
gcuaagcuaaaaaaagugagagc

SEQ ID NO: 31723 - RNA, 23 nt, Artificial Sequence
  RNA Oligomer
agcuaagcuaaaaaaagugagag

SEQ ID NO: 31724 - RNA, 23 nt, Artificial Sequence
  RNA Oligomer
aagcuaagcuaaaaaaagugaga

SEQ ID NO: 31725 - RNA, 23 nt, Artificial Sequence
  RNA Oligomer
gaagcuaagcuaaaaaaagugag

SEQ ID NO: 31726 - RNA, 23 nt, Artificial Sequence
  RNA Oligomer
uugaaacaacaagaucagcgaca

SEQ ID NO: 31727 - RNA, 23 nt, Artificial Sequence
  RNA Oligomer
uuugaaacaacaagaucagcgac

SEQ ID NO: 31728 - RNA, 23 nt, Artificial Sequence
  RNA Oligomer
uuuugaaacaacaagaucagcga

SEQ ID NO: 31729 - RNA, 23 nt, Artificial Sequence
  RNA Oligomer
gaacagcgcuuaaaguuuuugaa

SEQ ID NO: 31730 - RNA, 23 nt, Artificial Sequence
  RNA Oligomer
ggaacagcgcuuaaaguuuuuga

SEQ ID NO: 31731 - RNA, 23 nt, Artificial Sequence
  RNA Oligomer
aggaacagcgcuuaaaguuuuug

SEQ ID NO: 31732 - RNA, 23 nt, Artificial Sequence
  RNA Oligomer
aaggaacagcgcuuaaaguuuuu

SEQ ID NO: 31733 - RNA, 23 nt, Artificial Sequence
  RNA Oligomer
uaaggaacagcgcuuaaaguuuu

SEQ ID NO: 31734 - RNA, 23 nt, Artificial Sequence
  RNA Oligomer
cugacuuuaaaaacaguuguaau

SEQ ID NO: 31735 - RNA, 23 nt, Artificial Sequence
  RNA Oligomer
gcugacuuuaaaaacaguuguaa

SEQ ID NO: 31736 - RNA, 23 nt, Artificial Sequence
  RNA Oligomer
agcugacuuuaaaaacaguugua

SEQ ID NO: 31737 - RNA, 23 nt, Artificial Sequence
  RNA Oligomer
uagcugacuuuaaaaacaguugu

SEQ ID NO: 31738 - RNA, 23 nt, Artificial Sequence
  RNA Oligomer
auagcugacuuuaaaaacaguug

SEQ ID NO: 31739 - RNA, 23 nt, Artificial Sequence
  RNA Oligomer
uauaugaguuuuuguagcaucuu

SEQ ID NO: 31740 - RNA, 23 nt, Artificial Sequence
  RNA Oligomer
uuaguugguugucagugaacaau

SEQ ID NO: 31741 - RNA, 23 nt, Artificial Sequence
  RNA Oligomer
guuaguugguugucagugaacaa

SEQ ID NO: 31742 - RNA, 23 nt, Artificial Sequence
  RNA Oligomer
uguuaguugguugucagugaaca

SEQ ID NO: 31743 - RNA, 23 nt, Artificial Sequence
  RNA Oligomer
cuguuaguugguugucagugaac

SEQ ID NO: 31744 - RNA, 23 nt, Artificial Sequence
  RNA Oligomer
acuguuaguugguugucagugaa

SEQ ID NO: 31745 - RNA, 23 nt, Artificial Sequence
  RNA Oligomer
gaagaacuguuaguugguuguca

SEQ ID NO: 31746 - RNA, 23 nt, Artificial Sequence
  RNA Oligomer
ugaagaacuguuaguugguuguc

SEQ ID NO: 31747 - RNA, 23 nt, Artificial Sequence
  RNA Oligomer
gugaagaacuguuaguugguugu

SEQ ID NO: 31748 - RNA, 23 nt, Artificial Sequence
  RNA Oligomer
agugaagaacuguuaguugguug

SEQ ID NO: 31749 - RNA, 23 nt, Artificial Sequence
  RNA Oligomer
cagugaagaacuguuaguugguu

SEQ ID NO: 31750 - RNA, 23 nt, Artificial Sequence
  RNA Oligomer
gcacacuuguauauugucaguga

SEQ ID NO: 31751 - RNA, 23 nt, Artificial Sequence
  RNA Oligomer
ugcacacuuguauauugucagug

SEQ ID NO: 31752 - RNA, 23 nt, Artificial Sequence
  RNA Oligomer
cugcacacuuguauauugucagu

SEQ ID NO: 31753 - RNA, 23 nt, Artificial Sequence
  RNA Oligomer
acugcacacuuguauauugucag

SEQ ID NO: 31754 - RNA, 23 nt, Artificial Sequence
  RNA Oligomer
cacugcacacuuguauauuguca

SEQ ID NO: 31755 - RNA, 23 nt, Artificial Sequence
  RNA Oligomer
gucuaguaaauaggaucauuuau

SEQ ID NO: 31756 - RNA, 23 nt, Artificial Sequence
  RNA Oligomer
ugucuaguaaauaggaucauuua

SEQ ID NO: 31757 - RNA, 23 nt, Artificial Sequence
  RNA Oligomer
cugucuaguaaauaggaucauuu

SEQ ID NO: 31758 - RNA, 23 nt, Artificial Sequence
  RNA Oligomer
ccugucuaguaaauaggaucauu

SEQ ID NO: 31759 - RNA, 23 nt, Artificial Sequence
  RNA Oligomer
uccugucuaguaaauaggaucau

SEQ ID NO: 31760 - RNA, 23 nt, Artificial Sequence
  RNA Oligomer
agaauccugucuaguaaauagga

SEQ ID NO: 31761 - RNA, 23 nt, Artificial Sequence
  RNA Oligomer
aagaauccugucuaguaaauagg

SEQ ID NO: 31762 - RNA, 23 nt, Artificial Sequence
  RNA Oligomer
caagaauccugucuaguaaauag

SEQ ID NO: 31763 - RNA, 23 nt, Artificial Sequence
  RNA Oligomer
acaagaauccugucuaguaaaua

SEQ ID NO: 31764 - RNA, 23 nt, Artificial Sequence
  RNA Oligomer
uacaagaauccugucuaguaaau

SEQ ID NO: 31765 - RNA, 23 nt, Artificial Sequence
  RNA Oligomer
uacagcgacaauccuguuuucua

SEQ ID NO: 31766 - RNA, 23 nt, Artificial Sequence
  RNA Oligomer
gauaaguauacagcgacaauccu

SEQ ID NO: 31767 - RNA, 23 nt, Artificial Sequence
  RNA Oligomer
gcgaugaagaaugucucuagaag

SEQ ID NO: 31768 - RNA, 23 nt, Artificial Sequence
  RNA Oligomer
agcgaugaagaaugucucuagaa

SEQ ID NO: 31769 - RNA, 23 nt, Artificial Sequence
  RNA Oligomer
aagcgaugaagaaugucucuaga

SEQ ID NO: 31770 - RNA, 23 nt, Artificial Sequence
  RNA Oligomer
aaagcgaugaagaaugucucuag

SEQ ID NO: 31771 - RNA, 23 nt, Artificial Sequence
  RNA Oligomer
gaaagcgaugaagaaugucucua

SEQ ID NO: 31772 - RNA, 23 nt, Artificial Sequence
  RNA Oligomer
ugacaauguagcuugaaagcgau

SEQ ID NO: 31773 - RNA, 23 nt, Artificial Sequence
  RNA Oligomer
augacaauguagcuugaaagcga

SEQ ID NO: 31774 - RNA, 23 nt, Artificial Sequence
  RNA Oligomer
aaugacaauguagcuugaaagcg

SEQ ID NO: 31775 - RNA, 23 nt, Artificial Sequence
  RNA Oligomer
uaaugacaauguagcuugaaagc

SEQ ID NO: 31776 - RNA, 23 nt, Artificial Sequence
  RNA Oligomer
uuaaugacaauguagcuugaaag

SEQ ID NO: 31777 - RNA, 23 nt, Artificial Sequence
  RNA Oligomer
gagucauuuaugcgcuuugggau

SEQ ID NO: 31778 - RNA, 23 nt, Artificial Sequence
  RNA Oligomer
aggagaagaugggcauaaugaau

SEQ ID NO: 31779 - RNA, 23 nt, Artificial Sequence
  RNA Oligomer
caggagaagaugggcauaaugaa

SEQ ID NO: 31780 - RNA, 23 nt, Artificial Sequence
  RNA Oligomer
ucaggagaagaugggcauaauga

SEQ ID NO: 31781 - RNA, 23 nt, Artificial Sequence
  RNA Oligomer
uucaggagaagaugggcauaaug

SEQ ID NO: 31782 - RNA, 23 nt, Artificial Sequence
  RNA Oligomer
guucaggagaagaugggcauaau

SEQ ID NO: 31783 - RNA, 23 nt, Artificial Sequence
  RNA Oligomer
gaggaaggcuacacucagugcuc

SEQ ID NO: 31784 - RNA, 23 nt, Artificial Sequence
  RNA Oligomer
ggaggaaggcuacacucagugcu

SEQ ID NO: 31785 - RNA, 23 nt, Artificial Sequence
  RNA Oligomer
uggaggaaggcuacacucagugc

SEQ ID NO: 31786 - RNA, 23 nt, Artificial Sequence
  RNA Oligomer
auggaggaaggcuacacucagug

SEQ ID NO: 31787 - RNA, 23 nt, Artificial Sequence
  RNA Oligomer
aauggaggaaggcuacacucagu

SEQ ID NO: 31788 - RNA, 23 nt, Artificial Sequence
  RNA Oligomer
caaguguguaaguuuuuggugga

SEQ ID NO: 31789 - RNA, 23 nt, Artificial Sequence
  RNA Oligomer
ugguguaaauguaaaugcugcug

SEQ ID NO: 31790 - RNA, 23 nt, Artificial Sequence
  RNA Oligomer
uugguguaaauguaaaugcugcu

SEQ ID NO: 31791 - RNA, 23 nt, Artificial Sequence
  RNA Oligomer
uuugguguaaauguaaaugcugc

SEQ ID NO: 31792 - RNA, 23 nt, Artificial Sequence
  RNA Oligomer
guuugguguaaauguaaaugcug

SEQ ID NO: 31793 - RNA, 23 nt, Artificial Sequence
  RNA Oligomer
aguuugguguaaauguaaaugcu

SEQ ID NO: 31794 - RNA, 23 nt, Artificial Sequence
  RNA Oligomer
caguuugguguaaauguaaaugc

SEQ ID NO: 31795 - RNA, 23 nt, Artificial Sequence
  RNA Oligomer
ucguuaaguuccugguacaguuu

SEQ ID NO: 31796 - RNA, 23 nt, Artificial Sequence
  RNA Oligomer
aucguuaaguuccugguacaguu

SEQ ID NO: 31797 - RNA, 23 nt, Artificial Sequence
  RNA Oligomer
aaucguuaaguuccugguacagu

SEQ ID NO: 31798 - RNA, 23 nt, Artificial Sequence
  RNA Oligomer
aaaucguuaaguuccugguacag

SEQ ID NO: 31799 - RNA, 23 nt, Artificial Sequence
  RNA Oligomer
gaaaucguuaaguuccugguaca

SEQ ID NO: 31800 - RNA, 23 nt, Artificial Sequence
  RNA Oligomer
gaauuugaccuuguacagagaau

SEQ ID NO: 31801 - RNA, 23 nt, Artificial Sequence
  RNA Oligomer
gagaauuugaccuuguacagaga

SEQ ID NO: 31802 - RNA, 23 nt, Artificial Sequence
  RNA Oligomer
cgucuuuggagggagaauuugac

SEQ ID NO: 31803 - RNA, 23 nt, Artificial Sequence
  RNA Oligomer
ucgucuuuggagggagaauuuga

SEQ ID NO: 31804 - RNA, 23 nt, Artificial Sequence
  RNA Oligomer
uucgucuuuggagggagaauuug

SEQ ID NO: 31805 - RNA, 23 nt, Artificial Sequence
  RNA Oligomer
auucgucuuuggagggagaauuu

SEQ ID NO: 31806 - RNA, 23 nt, Artificial Sequence
  RNA Oligomer
gauucgucuuuggagggagaauu

SEQ ID NO: 31807 - RNA, 23 nt, Artificial Sequence
  RNA Oligomer
cuccacaugugcuugauguguac

SEQ ID NO: 31808 - RNA, 23 nt, Artificial Sequence
  RNA Oligomer
gcuccacaugugcuugaugugua

SEQ ID NO: 31809 - RNA, 23 nt, Artificial Sequence
  RNA Oligomer
cgauuuggaagucagaggaacga

SEQ ID NO: 31810 - RNA, 23 nt, Artificial Sequence
  RNA Oligomer
acgauuuggaagucagaggaacg

SEQ ID NO: 31811 - RNA, 23 nt, Artificial Sequence
  RNA Oligomer
aacgauuuggaagucagaggaac

SEQ ID NO: 31812 - RNA, 23 nt, Artificial Sequence
  RNA Oligomer
caacgauuuggaagucagaggaa

SEQ ID NO: 31813 - RNA, 23 nt, Artificial Sequence
  RNA Oligomer
ucaacgauuuggaagucagagga

SEQ ID NO: 31814 - RNA, 23 nt, Artificial Sequence
  RNA Oligomer
ucagaaagcccaguagaaaucca

SEQ ID NO: 31815 - RNA, 23 nt, Artificial Sequence
  RNA Oligomer
cucagaaagcccaguagaaaucc

SEQ ID NO: 31816 - RNA, 23 nt, Artificial Sequence
  RNA Oligomer
gcucagaaagcccaguagaaauc

SEQ ID NO: 31817 - RNA, 23 nt, Artificial Sequence
  RNA Oligomer
agcucagaaagcccaguagaaau

SEQ ID NO: 31818 - RNA, 23 nt, Artificial Sequence
  RNA Oligomer
cagcucagaaagcccaguagaaa

SEQ ID NO: 31819 - RNA, 23 nt, Artificial Sequence
  RNA Oligomer
gaaacugucuaacgcaccaaggc

SEQ ID NO: 31820 - RNA, 23 nt, Artificial Sequence
  RNA Oligomer
agaaacugucuaacgcaccaagg

SEQ ID NO: 31821 - RNA, 23 nt, Artificial Sequence
  RNA Oligomer
aagaaacugucuaacgcaccaag

SEQ ID NO: 31822 - RNA, 23 nt, Artificial Sequence
  RNA Oligomer
aaagaaacugucuaacgcaccaa

SEQ ID NO: 31823 - RNA, 23 nt, Artificial Sequence
  RNA Oligomer
gaaagaaacugucuaacgcacca

SEQ ID NO: 31824 - RNA, 23 nt, Artificial Sequence
  RNA Oligomer
gagugaugcugaccuagaagccu

SEQ ID NO: 31825 - RNA, 23 nt, Artificial Sequence
  RNA Oligomer
agagugaugcugaccuagaagcc

SEQ ID NO: 31826 - RNA, 23 nt, Artificial Sequence
  RNA Oligomer
cagagugaugcugaccuagaagc

SEQ ID NO: 31827 - RNA, 23 nt, Artificial Sequence
  RNA Oligomer
ccagagugaugcugaccuagaag

SEQ ID NO: 31828 - RNA, 23 nt, Artificial Sequence
  RNA Oligomer
accagagugaugcugaccuagaa

SEQ ID NO: 31829 - RNA, 23 nt, Artificial Sequence
  RNA Oligomer
ggauaaugagcgaauguuugaug

SEQ ID NO: 31830 - RNA, 23 nt, Artificial Sequence
  RNA Oligomer
cuaucucccagcauaccuucggu

SEQ ID NO: 31831 - RNA, 23 nt, Artificial Sequence
  RNA Oligomer
gcuaucucccagcauaccuucgg

SEQ ID NO: 31832 - RNA, 23 nt, Artificial Sequence
  RNA Oligomer
ugcuaucucccagcauaccuucg

SEQ ID NO: 31833 - RNA, 23 nt, Artificial Sequence
  RNA Oligomer
cugcuaucucccagcauaccuuc

SEQ ID NO: 31834 - RNA, 23 nt, Artificial Sequence
  RNA Oligomer
gcugcuaucucccagcauaccuu

SEQ ID NO: 31835 - RNA, 23 nt, Artificial Sequence
  RNA Oligomer
gcaguugucaacaguuguuccgu

SEQ ID NO: 31836 - RNA, 23 nt, Artificial Sequence
  RNA Oligomer
agcaguugucaacaguuguuccg

SEQ ID NO: 31837 - RNA, 23 nt, Artificial Sequence
  RNA Oligomer
cagcaguugucaacaguuguucc

SEQ ID NO: 31838 - RNA, 23 nt, Artificial Sequence
  RNA Oligomer
ucagcaguugucaacaguuguuc

SEQ ID NO: 31839 - RNA, 23 nt, Artificial Sequence
  RNA Oligomer
cucagcaguugucaacaguuguu

SEQ ID NO: 31840 - RNA, 23 nt, Artificial Sequence
  RNA Oligomer
gaagauaucuugcgggaugcuca

SEQ ID NO: 31841 - RNA, 23 nt, Artificial Sequence
  RNA Oligomer
ugaagauaucuugcgggaugcuc

SEQ ID NO: 31842 - RNA, 23 nt, Artificial Sequence
  RNA Oligomer
gugaagauaucuugcgggaugcu

SEQ ID NO: 31843 - RNA, 23 nt, Artificial Sequence
  RNA Oligomer
agugaagauaucuugcgggaugc

SEQ ID NO: 31844 - RNA, 23 nt, Artificial Sequence
  RNA Oligomer
cagugaagauaucuugcgggaug

SEQ ID NO: 31845 - RNA, 23 nt, Artificial Sequence
  RNA Oligomer
ccuuugguacucugaggaagaac

SEQ ID NO: 31846 - RNA, 23 nt, Artificial Sequence
  RNA Oligomer
uccuuugguacucugaggaagaa

SEQ ID NO: 31847 - RNA, 23 nt, Artificial Sequence
  RNA Oligomer
uuccuuugguacucugaggaaga

SEQ ID NO: 31848 - RNA, 23 nt, Artificial Sequence
  RNA Oligomer
cuuccuuugguacucugaggaag

SEQ ID NO: 31849 - RNA, 23 nt, Artificial Sequence
  RNA Oligomer
ccuuccuuugguacucugaggaa

SEQ ID NO: 31850 - RNA, 23 nt, Artificial Sequence
  RNA Oligomer
ugcguccguucucaauguuugau

SEQ ID NO: 31851 - RNA, 23 nt, Artificial Sequence
  RNA Oligomer
gugcguccguucucaauguuuga

SEQ ID NO: 31852 - RNA, 23 nt, Artificial Sequence
  RNA Oligomer
agugcguccguucucaauguuug

SEQ ID NO: 31853 - RNA, 23 nt, Artificial Sequence
  RNA Oligomer
aagugcguccguucucaauguuu

SEQ ID NO: 31854 - RNA, 23 nt, Artificial Sequence
  RNA Oligomer
aaagugcguccguucucaauguu

SEQ ID NO: 31855 - RNA, 23 nt, Artificial Sequence
  RNA Oligomer
ggaaugcucuggaucaaguugau

SEQ ID NO: 31856 - RNA, 23 nt, Artificial Sequence
  RNA Oligomer
gggaaugcucuggaucaaguuga

SEQ ID NO: 31857 - RNA, 23 nt, Artificial Sequence
  RNA Oligomer
ugggaaugcucuggaucaaguug

SEQ ID NO: 31858 - RNA, 23 nt, Artificial Sequence
  RNA Oligomer
cugggaaugcucuggaucaaguu

SEQ ID NO: 31859 - RNA, 23 nt, Artificial Sequence
  RNA Oligomer
acugggaaugcucuggaucaagu

SEQ ID NO: 31860 - RNA, 23 nt, Artificial Sequence
  RNA Oligomer
ccuucaaaugcagaucuuuuccc

SEQ ID NO: 31861 - RNA, 23 nt, Artificial Sequence
  RNA Oligomer
ggcccugauuggaguccuucaaa

SEQ ID NO: 31862 - RNA, 23 nt, Artificial Sequence
  RNA Oligomer
cuaccaguuucaucugauggaaa

SEQ ID NO: 31863 - RNA, 23 nt, Artificial Sequence
  RNA Oligomer
caguuacuccagaaacaauaugc

SEQ ID NO: 31864 - RNA, 23 nt, Artificial Sequence
  RNA Oligomer
ggcagucauggauaagcguguua

SEQ ID NO: 31865 - RNA, 23 nt, Artificial Sequence
  RNA Oligomer
agggaguguuugaauaagcguaa

SEQ ID NO: 31866 - RNA, 23 nt, Artificial Sequence
  RNA Oligomer
cuuguggaggaaauugaacagau

SEQ ID NO: 31867 - RNA, 23 nt, Artificial Sequence
  RNA Oligomer
ucucaguaacaaugagcagcacu

SEQ ID NO: 31868 - RNA, 23 nt, Artificial Sequence
  RNA Oligomer
aucucaguaacaaugagcagcac

SEQ ID NO: 31869 - RNA, 23 nt, Artificial Sequence
  RNA Oligomer
uaucucaguaacaaugagcagca

SEQ ID NO: 31870 - RNA, 23 nt, Artificial Sequence
  RNA Oligomer
gagcaggagaaacuuaaaaggcu

SEQ ID NO: 31871 - RNA, 23 nt, Artificial Sequence
  RNA Oligomer
ugagcaggagaaacuuaaaaggc

SEQ ID NO: 31872 - RNA, 23 nt, Artificial Sequence
  RNA Oligomer
cugagcaggagaaacuuaaaagg

SEQ ID NO: 31873 - RNA, 23 nt, Artificial Sequence
  RNA Oligomer
gcugagcaggagaaacuuaaaag

SEQ ID NO: 31874 - RNA, 23 nt, Artificial Sequence
  RNA Oligomer
ugcugagcaggagaaacuuaaaa

SEQ ID NO: 31875 - RNA, 23 nt, Artificial Sequence
  RNA Oligomer
cguguaucucaguaacaaugagc

SEQ ID NO: 31876 - RNA, 23 nt, Artificial Sequence
  RNA Oligomer
aggauggaucugacucuugcuga

SEQ ID NO: 31877 - RNA, 23 nt, Artificial Sequence
  RNA Oligomer
uaggauggaucugacucuugcug

SEQ ID NO: 31878 - RNA, 23 nt, Artificial Sequence
  RNA Oligomer
cuaggauggaucugacucuugcu

SEQ ID NO: 31879 - RNA, 23 nt, Artificial Sequence
  RNA Oligomer
ccuaggauggaucugacucuugc

SEQ ID NO: 31880 - RNA, 23 nt, Artificial Sequence
  RNA Oligomer
uccuaggauggaucugacucuug

SEQ ID NO: 31881 - RNA, 23 nt, Artificial Sequence
  RNA Oligomer
guccuaggauggaucugacucuu

SEQ ID NO: 31882 - RNA, 23 nt, Artificial Sequence
  RNA Oligomer
aguccuaggauggaucugacucu

SEQ ID NO: 31883 - RNA, 23 nt, Artificial Sequence
  RNA Oligomer
ccguaauauuugucaagaucaua

SEQ ID NO: 31884 - RNA, 23 nt, Artificial Sequence
  RNA Oligomer
acuuacccguaauauuugucaag

SEQ ID NO: 31885 - RNA, 23 nt, Artificial Sequence
  RNA Oligomer
cucagaaauuagaaacuugcuac

SEQ ID NO: 31886 - RNA, 23 nt, Artificial Sequence
  RNA Oligomer
ucucagaaauuagaaacuugcua

SEQ ID NO: 31887 - RNA, 23 nt, Artificial Sequence
  RNA Oligomer
aucucagaaauuagaaacuugcu

SEQ ID NO: 31888 - RNA, 23 nt, Artificial Sequence
  RNA Oligomer
uaucucagaaauuagaaacuugc

SEQ ID NO: 31889 - RNA, 23 nt, Artificial Sequence
  RNA Oligomer
guaucucagaaauuagaaacuug

SEQ ID NO: 31890 - RNA, 23 nt, Artificial Sequence
  RNA Oligomer
auaucgaagaaaggagaacggug

SEQ ID NO: 31891 - RNA, 23 nt, Artificial Sequence
  RNA Oligomer
uugaaacuaagcuacgguaccag

SEQ ID NO: 31892 - RNA, 23 nt, Artificial Sequence
  RNA Oligomer
auugaaacuaagcuacgguacca

SEQ ID NO: 31893 - RNA, 23 nt, Artificial Sequence
  RNA Oligomer
uauugaaacuaagcuacgguacc

SEQ ID NO: 31894 - RNA, 23 nt, Artificial Sequence
  RNA Oligomer
auauugaaacuaagcuacgguac

SEQ ID NO: 31895 - RNA, 23 nt, Artificial Sequence
  RNA Oligomer
aauauugaaacuaagcuacggua

SEQ ID NO: 31896 - RNA, 23 nt, Artificial Sequence
  RNA Oligomer
ggaucauuuauugggcaguuggg

SEQ ID NO: 31897 - RNA, 23 nt, Artificial Sequence
  RNA Oligomer
aggaucauuuauugggcaguugg

SEQ ID NO: 31898 - RNA, 23 nt, Artificial Sequence
  RNA Oligomer
uaggaucauuuauugggcaguug

SEQ ID NO: 31899 - RNA, 23 nt, Artificial Sequence
  RNA Oligomer
auaggaucauuuauugggcaguu

SEQ ID NO: 31900 - RNA, 23 nt, Artificial Sequence
  RNA Oligomer
aauaggaucauuuauugggcagu

SEQ ID NO: 31901 - RNA, 23 nt, Artificial Sequence
  RNA Oligomer
ugaaauaaagcaucuacgucagc

SEQ ID NO: 31902 - RNA, 23 nt, Artificial Sequence
  RNA Oligomer
augaaauaaagcaucuacgucag

SEQ ID NO: 31903 - RNA, 23 nt, Artificial Sequence
  RNA Oligomer
gaugaaauaaagcaucuacguca

SEQ ID NO: 31904 - RNA, 23 nt, Artificial Sequence
  RNA Oligomer
ugaugaaauaaagcaucuacguc

SEQ ID NO: 31905 - RNA, 23 nt, Artificial Sequence
  RNA Oligomer
gugaugaaauaaagcaucuacgu

SEQ ID NO: 31906 - RNA, 23 nt, Artificial Sequence
  RNA Oligomer
auuuagcgugaugaaauaaagca

SEQ ID NO: 31907 - RNA, 23 nt, Artificial Sequence
  RNA Oligomer
cgaugaagaaugucucuagaaga

SEQ ID NO: 31908 - RNA, 23 nt, Artificial Sequence
  RNA Oligomer
ugaaagcgaugaagaaugucucu

SEQ ID NO: 31909 - RNA, 23 nt, Artificial Sequence
  RNA Oligomer
uugaaagcgaugaagaaugucuc

SEQ ID NO: 31910 - RNA, 23 nt, Artificial Sequence
  RNA Oligomer
cuugaaagcgaugaagaaugucu

SEQ ID NO: 31911 - RNA, 23 nt, Artificial Sequence
  RNA Oligomer
gcuugaaagcgaugaagaauguc

SEQ ID NO: 31912 - RNA, 23 nt, Artificial Sequence
  RNA Oligomer
agcuugaaagcgaugaagaaugu

SEQ ID NO: 31913 - RNA, 23 nt, Artificial Sequence
  RNA Oligomer
uuuaaugacaauguagcuugaaa

SEQ ID NO: 31914 - RNA, 23 nt, Artificial Sequence
  RNA Oligomer
cucuguuaagaagaaguaauacg

SEQ ID NO: 31915 - RNA, 23 nt, Artificial Sequence
  RNA Oligomer
ucucuguuaagaagaaguaauac

SEQ ID NO: 31916 - RNA, 23 nt, Artificial Sequence
  RNA Oligomer
aucucuguuaagaagaaguaaua

SEQ ID NO: 31917 - RNA, 23 nt, Artificial Sequence
  RNA Oligomer
aaucucuguuaagaagaaguaau

SEQ ID NO: 31918 - RNA, 23 nt, Artificial Sequence
  RNA Oligomer
uaaucucuguuaagaagaaguaa

SEQ ID NO: 31919 - RNA, 23 nt, Artificial Sequence
  RNA Oligomer
ucucaggauccaaguuuaaaaag

SEQ ID NO: 31920 - RNA, 23 nt, Artificial Sequence
  RNA Oligomer
aucucaggauccaaguuuaaaaa

SEQ ID NO: 31921 - RNA, 23 nt, Artificial Sequence
  RNA Oligomer
gaucucaggauccaaguuuaaaa

SEQ ID NO: 31922 - RNA, 23 nt, Artificial Sequence
  RNA Oligomer
aguucaggagaagaugggcauaa

SEQ ID NO: 31923 - RNA, 23 nt, Artificial Sequence
  RNA Oligomer
gugcucccaauuucuuuauggag

SEQ ID NO: 31924 - RNA, 23 nt, Artificial Sequence
  RNA Oligomer
agugcucccaauuucuuuaugga

SEQ ID NO: 31925 - RNA, 23 nt, Artificial Sequence
  RNA Oligomer
cagugcucccaauuucuuuaugg

SEQ ID NO: 31926 - RNA, 23 nt, Artificial Sequence
  RNA Oligomer
ucagugcucccaauuucuuuaug

SEQ ID NO: 31927 - RNA, 23 nt, Artificial Sequence
  RNA Oligomer
cucagugcucccaauuucuuuau

SEQ ID NO: 31928 - RNA, 23 nt, Artificial Sequence
  RNA Oligomer
aggaaauggaggaaggcuacacu

SEQ ID NO: 31929 - RNA, 23 nt, Artificial Sequence
  RNA Oligomer
gaggaaauggaggaaggcuacac

SEQ ID NO: 31930 - RNA, 23 nt, Artificial Sequence
  RNA Oligomer
cgaggaaauggaggaaggcuaca

SEQ ID NO: 31931 - RNA, 23 nt, Artificial Sequence
  RNA Oligomer
gcgaggaaauggaggaaggcuac

SEQ ID NO: 31932 - RNA, 23 nt, Artificial Sequence
  RNA Oligomer
ugcgaggaaauggaggaaggcua

SEQ ID NO: 31933 - RNA, 23 nt, Artificial Sequence
  RNA Oligomer
cagauaagugcgaggaaauggag

SEQ ID NO: 31934 - RNA, 23 nt, Artificial Sequence
  RNA Oligomer
gcagauaagugcgaggaaaugga

SEQ ID NO: 31935 - RNA, 23 nt, Artificial Sequence
  RNA Oligomer
ugcagauaagugcgaggaaaugg

SEQ ID NO: 31936 - RNA, 23 nt, Artificial Sequence
  RNA Oligomer
cugcagauaagugcgaggaaaug

SEQ ID NO: 31937 - RNA, 23 nt, Artificial Sequence
  RNA Oligomer
gcugcagauaagugcgaggaaau

SEQ ID NO: 31938 - RNA, 23 nt, Artificial Sequence
  RNA Oligomer
auguaacaacguccaagugugua

SEQ ID NO: 31939 - RNA, 23 nt, Artificial Sequence
  RNA Oligomer
cauguaacaacguccaagugugu

SEQ ID NO: 31940 - RNA, 23 nt, Artificial Sequence
  RNA Oligomer
acaugugcuugauguguaccugg

SEQ ID NO: 31941 - RNA, 23 nt, Artificial Sequence
  RNA Oligomer
cacaugugcuugauguguaccug

SEQ ID NO: 31942 - RNA, 23 nt, Artificial Sequence
  RNA Oligomer
ccacaugugcuugauguguaccu

SEQ ID NO: 31943 - RNA, 23 nt, Artificial Sequence
  RNA Oligomer
uccacaugugcuugauguguacc

SEQ ID NO: 31944 - RNA, 23 nt, Artificial Sequence
  RNA Oligomer
cccagaagaaccaaauccagagg

SEQ ID NO: 31945 - RNA, 23 nt, Artificial Sequence
  RNA Oligomer
acccagaagaaccaaauccagag

SEQ ID NO: 31946 - RNA, 23 nt, Artificial Sequence
  RNA Oligomer
aacccagaagaaccaaauccaga

SEQ ID NO: 31947 - RNA, 23 nt, Artificial Sequence
  RNA Oligomer
uaacccagaagaaccaaauccag

SEQ ID NO: 31948 - RNA, 23 nt, Artificial Sequence
  RNA Oligomer
auaacccagaagaaccaaaucca

SEQ ID NO: 31949 - RNA, 23 nt, Artificial Sequence
  RNA Oligomer
caacagcccaaaucuccagaaua

SEQ ID NO: 31950 - RNA, 23 nt, Artificial Sequence
  RNA Oligomer
acaacagcccaaaucuccagaau

SEQ ID NO: 31951 - RNA, 23 nt, Artificial Sequence
  RNA Oligomer
gacaacagcccaaaucuccagaa

SEQ ID NO: 31952 - RNA, 23 nt, Artificial Sequence
  RNA Oligomer
gccuugauuaugagccugaggga

SEQ ID NO: 31953 - RNA, 23 nt, Artificial Sequence
  RNA Oligomer
ggccuugauuaugagccugaggg

SEQ ID NO: 31954 - RNA, 23 nt, Artificial Sequence
  RNA Oligomer
aggccuugauuaugagccugagg

SEQ ID NO: 31955 - RNA, 23 nt, Artificial Sequence
  RNA Oligomer
caggccuugauuaugagccugag

SEQ ID NO: 31956 - RNA, 23 nt, Artificial Sequence
  RNA Oligomer
ccaggccuugauuaugagccuga

SEQ ID NO: 31957 - RNA, 23 nt, Artificial Sequence
  RNA Oligomer
ggaaugccaguacagagaacagu

SEQ ID NO: 31958 - RNA, 23 nt, Artificial Sequence
  RNA Oligomer
gggaaugccaguacagagaacag

SEQ ID NO: 31959 - RNA, 23 nt, Artificial Sequence
  RNA Oligomer
ggggaaugccaguacagagaaca

SEQ ID NO: 31960 - RNA, 23 nt, Artificial Sequence
  RNA Oligomer
uggggaaugccaguacagagaac

SEQ ID NO: 31961 - RNA, 23 nt, Artificial Sequence
  RNA Oligomer
guggggaaugccaguacagagaa

SEQ ID NO: 31962 - RNA, 23 nt, Artificial Sequence
  RNA Oligomer
gaaauccagaauccauauuuaca

SEQ ID NO: 31963 - RNA, 23 nt, Artificial Sequence
  RNA Oligomer
agaaauccagaauccauauuuac

SEQ ID NO: 31964 - RNA, 23 nt, Artificial Sequence
  RNA Oligomer
uagaaauccagaauccauauuua

SEQ ID NO: 31965 - RNA, 23 nt, Artificial Sequence
  RNA Oligomer
guagaaauccagaauccauauuu

SEQ ID NO: 31966 - RNA, 23 nt, Artificial Sequence
  RNA Oligomer
aguagaaauccagaauccauauu

SEQ ID NO: 31967 - RNA, 23 nt, Artificial Sequence
  RNA Oligomer
agaaagcccaguagaaauccaga

SEQ ID NO: 31968 - RNA, 23 nt, Artificial Sequence
  RNA Oligomer
cagaaagcccaguagaaauccag

SEQ ID NO: 31969 - RNA, 23 nt, Artificial Sequence
  RNA Oligomer
ccagcucagaaagcccaguagaa

SEQ ID NO: 31970 - RNA, 23 nt, Artificial Sequence
  RNA Oligomer
aaacugucuaacgcaccaaggcc

SEQ ID NO: 31971 - RNA, 23 nt, Artificial Sequence
  RNA Oligomer
aagccuuacgaaagaaacugucu

SEQ ID NO: 31972 - RNA, 23 nt, Artificial Sequence
  RNA Oligomer
gaagccuuacgaaagaaacuguc

SEQ ID NO: 31973 - RNA, 23 nt, Artificial Sequence
  RNA Oligomer
ccuuaccgaaaccagagugaugc

SEQ ID NO: 31974 - RNA, 23 nt, Artificial Sequence
  RNA Oligomer
uccuuaccgaaaccagagugaug

SEQ ID NO: 31975 - RNA, 23 nt, Artificial Sequence
  RNA Oligomer
auccuuaccgaaaccagagugau

SEQ ID NO: 31976 - RNA, 23 nt, Artificial Sequence
  RNA Oligomer
aauccuuaccgaaaccagaguga

SEQ ID NO: 31977 - RNA, 23 nt, Artificial Sequence
  RNA Oligomer
uaauccuuaccgaaaccagagug

SEQ ID NO: 31978 - RNA, 23 nt, Artificial Sequence
  RNA Oligomer
ccuuucuuaucuaauccuuaccg

SEQ ID NO: 31979 - RNA, 23 nt, Artificial Sequence
  RNA Oligomer
gccuuucuuaucuaauccuuacc

SEQ ID NO: 31980 - RNA, 23 nt, Artificial Sequence
  RNA Oligomer
ugccuuucuuaucuaauccuuac

SEQ ID NO: 31981 - RNA, 23 nt, Artificial Sequence
  RNA Oligomer
cugccuuucuuaucuaauccuua

SEQ ID NO: 31982 - RNA, 23 nt, Artificial Sequence
  RNA Oligomer
acugccuuucuuaucuaauccuu

SEQ ID NO: 31983 - RNA, 23 nt, Artificial Sequence
  RNA Oligomer
uacugccuuucuuaucuaauccu

SEQ ID NO: 31984 - RNA, 23 nt, Artificial Sequence
  RNA Oligomer
acagcagcacccagagaacauuu

SEQ ID NO: 31985 - RNA, 23 nt, Artificial Sequence
  RNA Oligomer
guauaugguaagccuguaauugc

SEQ ID NO: 31986 - RNA, 23 nt, Artificial Sequence
  RNA Oligomer
uguauaugguaagccuguaauug

SEQ ID NO: 31987 - RNA, 23 nt, Artificial Sequence
  RNA Oligomer
guguauaugguaagccuguaauu

SEQ ID NO: 31988 - RNA, 23 nt, Artificial Sequence
  RNA Oligomer
aguguauaugguaagccuguaau

SEQ ID NO: 31989 - RNA, 23 nt, Artificial Sequence
  RNA Oligomer
aaguguauaugguaagccuguaa

SEQ ID NO: 31990 - RNA, 23 nt, Artificial Sequence
  RNA Oligomer
ccaagaccagacccuuucuccag

SEQ ID NO: 31991 - RNA, 23 nt, Artificial Sequence
  RNA Oligomer
gccaagaccagacccuuucucca

SEQ ID NO: 31992 - RNA, 23 nt, Artificial Sequence
  RNA Oligomer
ggccaagaccagacccuuucucc

SEQ ID NO: 31993 - RNA, 23 nt, Artificial Sequence
  RNA Oligomer
uggccaagaccagacccuuucuc

SEQ ID NO: 31994 - RNA, 23 nt, Artificial Sequence
  RNA Oligomer
uuggccaagaccagacccuuucu

SEQ ID NO: 31995 - RNA, 23 nt, Artificial Sequence
  RNA Oligomer
ggaacuaaaccaaaaccagcagg

SEQ ID NO: 31996 - RNA, 23 nt, Artificial Sequence
  RNA Oligomer
gcaaauaaaaauguggcuaaagu

SEQ ID NO: 31997 - RNA, 23 nt, Artificial Sequence
  RNA Oligomer
gagcagugaagauaucuugcggg

SEQ ID NO: 31998 - RNA, 23 nt, Artificial Sequence
  RNA Oligomer
aagaaccagagcagugaagauau

SEQ ID NO: 31999 - RNA, 23 nt, Artificial Sequence
  RNA Oligomer
guggaucugugcaaagaacccgg

SEQ ID NO: 32000 - RNA, 23 nt, Artificial Sequence
  RNA Oligomer
cucaauguuugaugcaguagacc

SEQ ID NO: 32001 - RNA, 23 nt, Artificial Sequence
  RNA Oligomer
ucucaauguuugaugcaguagac

SEQ ID NO: 32002 - RNA, 23 nt, Artificial Sequence
  RNA Oligomer
uucucaauguuugaugcaguaga

SEQ ID NO: 32003 - RNA, 23 nt, Artificial Sequence
  RNA Oligomer
guucucaauguuugaugcaguag

SEQ ID NO: 32004 - RNA, 23 nt, Artificial Sequence
  RNA Oligomer
cguucucaauguuugaugcagua

SEQ ID NO: 32005 - RNA, 23 nt, Artificial Sequence
  RNA Oligomer
gggagaaagagaagaaagugcgu

SEQ ID NO: 32006 - RNA, 23 nt, Artificial Sequence
  RNA Oligomer
agggagaaagagaagaaagugcg

SEQ ID NO: 32007 - RNA, 23 nt, Artificial Sequence
  RNA Oligomer
gagggagaaagagaagaaagugc

SEQ ID NO: 32008 - RNA, 23 nt, Artificial Sequence
  RNA Oligomer
ugagggagaaagagaagaaagug

SEQ ID NO: 32009 - RNA, 23 nt, Artificial Sequence
  RNA Oligomer
cugagggagaaagagaagaaagu

SEQ ID NO: 32010 - RNA, 23 nt, Artificial Sequence
  RNA Oligomer
cacugggaaugcucuggaucaag

SEQ ID NO: 32011 - RNA, 23 nt, Artificial Sequence
  RNA Oligomer
gcacugggaaugcucuggaucaa

SEQ ID NO: 32012 - RNA, 23 nt, Artificial Sequence
  RNA Oligomer
agcacugggaaugcucuggauca

SEQ ID NO: 32013 - RNA, 23 nt, Artificial Sequence
  RNA Oligomer
aagcacugggaaugcucuggauc

SEQ ID NO: 32014 - RNA, 23 nt, Artificial Sequence
  RNA Oligomer
aaagcacugggaaugcucuggau

SEQ ID NO: 32015 - RNA, 23 nt, Artificial Sequence
  RNA Oligomer
aggcucuaaaauccauccaguug

SEQ ID NO: 32016 - RNA, 23 nt, Artificial Sequence
  RNA Oligomer
aaggcucuaaaauccauccaguu

SEQ ID NO: 32017 - RNA, 23 nt, Artificial Sequence
  RNA Oligomer
aaaggcucuaaaauccauccagu

SEQ ID NO: 32018 - RNA, 23 nt, Artificial Sequence
  RNA Oligomer
uaaaggcucuaaaauccauccag

SEQ ID NO: 32019 - RNA, 23 nt, Artificial Sequence
  RNA Oligomer
cuaaaggcucuaaaauccaucca

SEQ ID NO: 32020 - RNA, 23 nt, Artificial Sequence
  RNA Oligomer
acuaaaggcucuaaaauccaucc

SEQ ID NO: 32021 - RNA, 23 nt, Artificial Sequence
  RNA Oligomer
aacuaaaggcucuaaaauccauc

SEQ ID NO: 32022 - RNA, 23 nt, Artificial Sequence
  RNA Oligomer
aaacuaaaggcucuaaaauccau

SEQ ID NO: 32023 - RNA, 23 nt, Artificial Sequence
  RNA Oligomer
agaaacaauaugcagagacgugg

SEQ ID NO: 32024 - RNA, 23 nt, Artificial Sequence
  RNA Oligomer
cagaaacaauaugcagagacgug

SEQ ID NO: 32025 - RNA, 23 nt, Artificial Sequence
  RNA Oligomer
gaggggccgaugaaaauacagac

SEQ ID NO: 32026 - RNA, 23 nt, Artificial Sequence
  RNA Oligomer
agaggggccgaugaaaauacaga

SEQ ID NO: 32027 - RNA, 23 nt, Artificial Sequence
  RNA Oligomer
aguuacuccagaaacaauaugca

SEQ ID NO: 32028 - RNA, 23 nt, Artificial Sequence
  RNA Oligomer
uucaucugauggaaaucuucccc

SEQ ID NO: 32029 - RNA, 23 nt, Artificial Sequence
  RNA Oligomer
uuucaucugauggaaaucuuccc

SEQ ID NO: 32030 - RNA, 23 nt, Artificial Sequence
  RNA Oligomer
guuucaucugauggaaaucuucc

SEQ ID NO: 32031 - RNA, 23 nt, Artificial Sequence
  RNA Oligomer
guguuaaugagcugagggaccgg

SEQ ID NO: 32032 - RNA, 23 nt, Artificial Sequence
  RNA Oligomer
cguguuaaugagcugagggaccg

SEQ ID NO: 32033 - RNA, 23 nt, Artificial Sequence
  RNA Oligomer
guaauucagaaguggcagucaug

SEQ ID NO: 32034 - RNA, 23 nt, Artificial Sequence
  RNA Oligomer
cguaauucagaaguggcagucau

SEQ ID NO: 32035 - RNA, 23 nt, Artificial Sequence
  RNA Oligomer
gaaugccaagcuacaacaacaga

SEQ ID NO: 32036 - RNA, 23 nt, Artificial Sequence
  RNA Oligomer
gcagcuaagaaacaaauugaauc

SEQ ID NO: 32037 - RNA, 23 nt, Artificial Sequence
  RNA Oligomer
gccacguggaacagaagagacua

SEQ ID NO: 32038 - RNA, 23 nt, Artificial Sequence
  RNA Oligomer
ggccacguggaacagaagagacu

SEQ ID NO: 32039 - RNA, 23 nt, Artificial Sequence
  RNA Oligomer
aggccacguggaacagaagagac

SEQ ID NO: 32040 - RNA, 23 nt, Artificial Sequence
  RNA Oligomer
aaggccacguggaacagaagaga

SEQ ID NO: 32041 - RNA, 23 nt, Artificial Sequence
  RNA Oligomer
gagaaucaggaagcuaagcuaaa

SEQ ID NO: 32042 - RNA, 23 nt, Artificial Sequence
  RNA Oligomer
ugagaaucaggaagcuaagcuaa

SEQ ID NO: 32043 - RNA, 23 nt, Artificial Sequence
  RNA Oligomer
cugagaaucaggaagcuaagcua

SEQ ID NO: 32044 - RNA, 23 nt, Artificial Sequence
  RNA Oligomer
gcuggcaacuaaggaacagcgcu

SEQ ID NO: 32045 - RNA, 23 nt, Artificial Sequence
  RNA Oligomer
ugcuggcaacuaaggaacagcgc

SEQ ID NO: 32046 - RNA, 23 nt, Artificial Sequence
  RNA Oligomer
uugcuggcaacuaaggaacagcg

SEQ ID NO: 32047 - RNA, 23 nt, Artificial Sequence
  RNA Oligomer
auugcuggcaacuaaggaacagc

SEQ ID NO: 32048 - RNA, 23 nt, Artificial Sequence
  RNA Oligomer
aauugcuggcaacuaaggaacag

SEQ ID NO: 32049 - RNA, 23 nt, Artificial Sequence
  RNA Oligomer
agacuuacccguaauauuuguca

SEQ ID NO: 32050 - RNA, 23 nt, Artificial Sequence
  RNA Oligomer
cagacuuacccguaauauuuguc

SEQ ID NO: 32051 - RNA, 23 nt, Artificial Sequence
  RNA Oligomer
acagacuuacccguaauauuugu

SEQ ID NO: 32052 - RNA, 23 nt, Artificial Sequence
  RNA Oligomer
uacagacuuacccguaauauuug

SEQ ID NO: 32053 - RNA, 23 nt, Artificial Sequence
  RNA Oligomer
cuacagacuuacccguaauauuu

SEQ ID NO: 32054 - RNA, 23 nt, Artificial Sequence
  RNA Oligomer
agaacuguuaguugguugucagu

SEQ ID NO: 32055 - RNA, 23 nt, Artificial Sequence
  RNA Oligomer
aagaacuguuaguugguugucag

SEQ ID NO: 32056 - RNA, 23 nt, Artificial Sequence
  RNA Oligomer
cauuuagcgugaugaaauaaagc

SEQ ID NO: 32057 - RNA, 23 nt, Artificial Sequence
  RNA Oligomer
acauuuagcgugaugaaauaaag

SEQ ID NO: 32058 - RNA, 23 nt, Artificial Sequence
  RNA Oligomer
gacauuuagcgugaugaaauaaa

SEQ ID NO: 32059 - RNA, 23 nt, Artificial Sequence
  RNA Oligomer
uugaagaauucaccauuagagga

SEQ ID NO: 32060 - RNA, 23 nt, Artificial Sequence
  RNA Oligomer
auugaagaauucaccauuagagg

SEQ ID NO: 32061 - RNA, 23 nt, Artificial Sequence
  RNA Oligomer
caaaggagcuuggccugaaacuu

SEQ ID NO: 32062 - RNA, 23 nt, Artificial Sequence
  RNA Oligomer
acaaaggagcuuggccugaaacu

SEQ ID NO: 32063 - RNA, 23 nt, Artificial Sequence
  RNA Oligomer
gacaaaggagcuuggccugaaac

SEQ ID NO: 32064 - RNA, 23 nt, Artificial Sequence
  RNA Oligomer
agacaaaggagcuuggccugaaa

SEQ ID NO: 32065 - RNA, 23 nt, Artificial Sequence
  RNA Oligomer
aagacaaaggagcuuggccugaa

SEQ ID NO: 32066 - RNA, 23 nt, Artificial Sequence
  RNA Oligomer
uuaaugauaaggagggauauguu

SEQ ID NO: 32067 - RNA, 23 nt, Artificial Sequence
  RNA Oligomer
cuuaaugauaaggagggauaugu

SEQ ID NO: 32068 - RNA, 23 nt, Artificial Sequence
  RNA Oligomer
ccuuaaugauaaggagggauaug

SEQ ID NO: 32069 - RNA, 23 nt, Artificial Sequence
  RNA Oligomer
gccuuaaugauaaggagggauau

SEQ ID NO: 32070 - RNA, 23 nt, Artificial Sequence
  RNA Oligomer
cgccuuaaugauaaggagggaua

SEQ ID NO: 32071 - RNA, 23 nt, Artificial Sequence
  RNA Oligomer
gaaggagacugcaugacaaucau

SEQ ID NO: 32072 - RNA, 23 nt, Artificial Sequence
  RNA Oligomer
agaaggagacugcaugacaauca

SEQ ID NO: 32073 - RNA, 23 nt, Artificial Sequence
  RNA Oligomer
aagaaggagacugcaugacaauc

SEQ ID NO: 32074 - RNA, 23 nt, Artificial Sequence
  RNA Oligomer
aaagaaggagacugcaugacaau

SEQ ID NO: 32075 - RNA, 23 nt, Artificial Sequence
  RNA Oligomer
gaaagaaggagacugcaugacaa

SEQ ID NO: 32076 - RNA, 23 nt, Artificial Sequence
  RNA Oligomer
uuaugcgcuuugggauuaugaac

SEQ ID NO: 32077 - RNA, 23 nt, Artificial Sequence
  RNA Oligomer
uuuaugcgcuuugggauuaugaa

SEQ ID NO: 32078 - RNA, 23 nt, Artificial Sequence
  RNA Oligomer
auuuaugcgcuuugggauuauga

SEQ ID NO: 32079 - RNA, 23 nt, Artificial Sequence
  RNA Oligomer
cauuuaugcgcuuugggauuaug

SEQ ID NO: 32080 - RNA, 23 nt, Artificial Sequence
  RNA Oligomer
ucauuuaugcgcuuugggauuau

SEQ ID NO: 32081 - RNA, 23 nt, Artificial Sequence
  RNA Oligomer
gacuccauuacauugugcugccu

SEQ ID NO: 32082 - RNA, 23 nt, Artificial Sequence
  RNA Oligomer
gucuuuggagggagaauuugacc

SEQ ID NO: 32083 - RNA, 23 nt, Artificial Sequence
  RNA Oligomer
uaaaaggacaaacuugcguaaaa

SEQ ID NO: 32084 - RNA, 23 nt, Artificial Sequence
  RNA Oligomer
uacauguggagcccgaaaaggag

SEQ ID NO: 32085 - RNA, 23 nt, Artificial Sequence
  RNA Oligomer
uuacauguggagcccgaaaagga

SEQ ID NO: 32086 - RNA, 23 nt, Artificial Sequence
  RNA Oligomer
uuuacauguggagcccgaaaagg

SEQ ID NO: 32087 - RNA, 23 nt, Artificial Sequence
  RNA Oligomer
auuuacauguggagcccgaaaag

SEQ ID NO: 32088 - RNA, 23 nt, Artificial Sequence
  RNA Oligomer
uauuuacauguggagcccgaaaa

SEQ ID NO: 32089 - RNA, 23 nt, Artificial Sequence
  RNA Oligomer
ggagaccaucucugucccaucau

SEQ ID NO: 32090 - RNA, 23 nt, Artificial Sequence
  RNA Oligomer
aaugggccaaauauucagaagcu

SEQ ID NO: 32091 - RNA, 23 nt, Artificial Sequence
  RNA Oligomer
uaaugggccaaauauucagaagc

SEQ ID NO: 32092 - RNA, 23 nt, Artificial Sequence
  RNA Oligomer
cuaaugggccaaauauucagaag

SEQ ID NO: 32093 - RNA, 23 nt, Artificial Sequence
  RNA Oligomer
gaauguuugauguucuucaacga

SEQ ID NO: 32094 - RNA, 23 nt, Artificial Sequence
  RNA Oligomer
cgaauguuugauguucuucaacg

SEQ ID NO: 32095 - RNA, 23 nt, Artificial Sequence
  RNA Oligomer
acguaguucuauuacagagccag

SEQ ID NO: 32096 - RNA, 23 nt, Artificial Sequence
  RNA Oligomer
aacguaguucuauuacagagcca

SEQ ID NO: 32097 - RNA, 23 nt, Artificial Sequence
  RNA Oligomer
aaacguaguucuauuacagagcc

SEQ ID NO: 32098 - RNA, 23 nt, Artificial Sequence
  RNA Oligomer
ccucuaaagaaacguaguucuau

SEQ ID NO: 32099 - RNA, 23 nt, Artificial Sequence
  RNA Oligomer
gccucuaaagaaacguaguucua

SEQ ID NO: 32100 - RNA, 23 nt, Artificial Sequence
  RNA Oligomer
ggccucuaaagaaacguaguucu

SEQ ID NO: 32101 - RNA, 23 nt, Artificial Sequence
  RNA Oligomer
aggccucuaaagaaacguaguuc

SEQ ID NO: 32102 - RNA, 23 nt, Artificial Sequence
  RNA Oligomer
aaggccucuaaagaaacguaguu

SEQ ID NO: 32103 - RNA, 23 nt, Artificial Sequence
  RNA Oligomer
aaugagcgaauguuugauguucu

SEQ ID NO: 32104 - RNA, 23 nt, Artificial Sequence
  RNA Oligomer
agaagccuuacgaaagaaacugu

SEQ ID NO: 32105 - RNA, 23 nt, Artificial Sequence
  RNA Oligomer
uagaagccuuacgaaagaaacug

SEQ ID NO: 32106 - RNA, 23 nt, Artificial Sequence
  RNA Oligomer
cuagaagccuuacgaaagaaacu

SEQ ID NO: 32107 - RNA, 23 nt, Artificial Sequence
  RNA Oligomer
ccuagaagccuuacgaaagaaac

SEQ ID NO: 32108 - RNA, 23 nt, Artificial Sequence
  RNA Oligomer
accuagaagccuuacgaaagaaa

SEQ ID NO: 32109 - RNA, 23 nt, Artificial Sequence
  RNA Oligomer
aguugcggauaaugagcgaaugu

SEQ ID NO: 32110 - RNA, 23 nt, Artificial Sequence
  RNA Oligomer
accguggcagcaaguucaauaua

SEQ ID NO: 32111 - RNA, 23 nt, Artificial Sequence
  RNA Oligomer
gaccguggcagcaaguucaauau

SEQ ID NO: 32112 - RNA, 23 nt, Artificial Sequence
  RNA Oligomer
agaccguggcagcaaguucaaua

SEQ ID NO: 32113 - RNA, 23 nt, Artificial Sequence
  RNA Oligomer
ccguucucaauguuugaugcagu

SEQ ID NO: 32114 - RNA, 23 nt, Artificial Sequence
  RNA Oligomer
uccguucucaauguuugaugcag

SEQ ID NO: 32115 - RNA, 23 nt, Artificial Sequence
  RNA Oligomer
guccguucucaauguuugaugca

SEQ ID NO: 32116 - RNA, 23 nt, Artificial Sequence
  RNA Oligomer
cguccguucucaauguuugaugc

SEQ ID NO: 32117 - RNA, 23 nt, Artificial Sequence
  RNA Oligomer
gcguccguucucaauguuugaug

SEQ ID NO: 32118 - RNA, 23 nt, Artificial Sequence
  RNA Oligomer
gaaagugcguccguucucaaugu

SEQ ID NO: 32119 - RNA, 23 nt, Artificial Sequence
  RNA Oligomer
gcugagggagaaagagaagaaag

SEQ ID NO: 32120 - RNA, 23 nt, Artificial Sequence
  RNA Oligomer
ugcucuggaucaaguugaugaug

SEQ ID NO: 32121 - RNA, 23 nt, Artificial Sequence
  RNA Oligomer
augcucuggaucaaguugaugau

SEQ ID NO: 32122 - RNA, 23 nt, Artificial Sequence
  RNA Oligomer
aaugcucuggaucaaguugauga

SEQ ID NO: 32123 - RNA, 23 nt, Artificial Sequence
  RNA Oligomer
gaaugcucuggaucaaguugaug

SEQ ID NO: 32124 - RNA, 23 nt, Artificial Sequence
  RNA Oligomer
cucugcuucuguaccucaaagca

SEQ ID NO: 32125 - RNA, 23 nt, Artificial Sequence
  RNA Oligomer
gcucugcuucuguaccucaaagc

SEQ ID NO: 32126 - RNA, 23 nt, Artificial Sequence
  RNA Oligomer
ggcucugcuucuguaccucaaag

SEQ ID NO: 32127 - RNA, 23 nt, Artificial Sequence
  RNA Oligomer
aggcucugcuucuguaccucaaa

SEQ ID NO: 32128 - RNA, 23 nt, Artificial Sequence
  RNA Oligomer
aaggcucugcuucuguaccucaa

SEQ ID NO: 32129 - RNA, 23 nt, Artificial Sequence
  RNA Oligomer
gauuggaguccuucaaaugcaga

SEQ ID NO: 32130 - RNA, 23 nt, Artificial Sequence
  RNA Oligomer
cggguccaagaugaugccgaugu

SEQ ID NO: 32131 - RNA, 23 nt, Artificial Sequence
  RNA Oligomer
ucggguccaagaugaugccgaug

SEQ ID NO: 32132 - RNA, 23 nt, Artificial Sequence
  RNA Oligomer
uucggguccaagaugaugccgau

SEQ ID NO: 32133 - RNA, 23 nt, Artificial Sequence
  RNA Oligomer
agaaguggcagucauggauaagc

SEQ ID NO: 32134 - RNA, 23 nt, Artificial Sequence
  RNA Oligomer
cagaaguggcagucauggauaag

SEQ ID NO: 32135 - RNA, 23 nt, Artificial Sequence
  RNA Oligomer
ucagaaguggcagucauggauaa

SEQ ID NO: 32136 - RNA, 23 nt, Artificial Sequence
  RNA Oligomer
uucagaaguggcagucauggaua

SEQ ID NO: 32137 - RNA, 23 nt, Artificial Sequence
  RNA Oligomer
auucagaaguggcagucauggau

SEQ ID NO: 32138 - RNA, 23 nt, Artificial Sequence
  RNA Oligomer
agaaugccaagcuacaacaacag

SEQ ID NO: 32139 - RNA, 23 nt, Artificial Sequence
  RNA Oligomer
gagaaacuuaaaaggcuaaaaga

SEQ ID NO: 32140 - RNA, 23 nt, Artificial Sequence
  RNA Oligomer
uugcugagcaggagaaacuuaaa

SEQ ID NO: 32141 - RNA, 23 nt, Artificial Sequence
  RNA Oligomer
guugcugagcaggagaaacuuaa

SEQ ID NO: 32142 - RNA, 23 nt, Artificial Sequence
  RNA Oligomer
guguaucucaguaacaaugagca

SEQ ID NO: 32143 - RNA, 23 nt, Artificial Sequence
  RNA Oligomer
ccagcagcaacagauugaagccc

SEQ ID NO: 32144 - RNA, 23 nt, Artificial Sequence
  RNA Oligomer
gguguuaauaguccuaggaugga

SEQ ID NO: 32145 - RNA, 23 nt, Artificial Sequence
  RNA Oligomer
cgguguuaauaguccuaggaugg

SEQ ID NO: 32146 - RNA, 23 nt, Artificial Sequence
  RNA Oligomer
acgguguuaauaguccuaggaug

SEQ ID NO: 32147 - RNA, 23 nt, Artificial Sequence
  RNA Oligomer
aacgguguuaauaguccuaggau

SEQ ID NO: 32148 - RNA, 23 nt, Artificial Sequence
  RNA Oligomer
gaacgguguuaauaguccuagga

SEQ ID NO: 32149 - RNA, 23 nt, Artificial Sequence
  RNA Oligomer
agaacgguguuaauaguccuagg

SEQ ID NO: 32150 - RNA, 23 nt, Artificial Sequence
  RNA Oligomer
gacuuacccguaauauuugucaa

SEQ ID NO: 32151 - RNA, 23 nt, Artificial Sequence
  RNA Oligomer
cuuguuuguaggcugaauuuuaa

SEQ ID NO: 32152 - RNA, 23 nt, Artificial Sequence
  RNA Oligomer
ucuuguuuguaggcugaauuuua

SEQ ID NO: 32153 - RNA, 23 nt, Artificial Sequence
  RNA Oligomer
aucuuguuuguaggcugaauuuu

SEQ ID NO: 32154 - RNA, 23 nt, Artificial Sequence
  RNA Oligomer
aaucuuguuuguaggcugaauuu

SEQ ID NO: 32155 - RNA, 23 nt, Artificial Sequence
  RNA Oligomer
gaaucuuguuuguaggcugaauu

SEQ ID NO: 32156 - RNA, 23 nt, Artificial Sequence
  RNA Oligomer
agauguagaaucuuguuuguagg

SEQ ID NO: 32157 - RNA, 23 nt, Artificial Sequence
  RNA Oligomer
uagauguagaaucuuguuuguag

SEQ ID NO: 32158 - RNA, 23 nt, Artificial Sequence
  RNA Oligomer
uuagauguagaaucuuguuugua

SEQ ID NO: 32159 - RNA, 23 nt, Artificial Sequence
  RNA Oligomer
auuagauguagaaucuuguuugu

SEQ ID NO: 32160 - RNA, 23 nt, Artificial Sequence
  RNA Oligomer
aauuagauguagaaucuuguuug

SEQ ID NO: 32161 - RNA, 23 nt, Artificial Sequence
  RNA Oligomer
gucagugaacaauaacuuuauua

SEQ ID NO: 32162 - RNA, 23 nt, Artificial Sequence
  RNA Oligomer
ugucagugaacaauaacuuuauu

SEQ ID NO: 32163 - RNA, 23 nt, Artificial Sequence
  RNA Oligomer
uugucagugaacaauaacuuuau

SEQ ID NO: 32164 - RNA, 23 nt, Artificial Sequence
  RNA Oligomer
guugucagugaacaauaacuuua

SEQ ID NO: 32165 - RNA, 23 nt, Artificial Sequence
  RNA Oligomer
gguugucagugaacaauaacuuu

SEQ ID NO: 32166 - RNA, 23 nt, Artificial Sequence
  RNA Oligomer
cgaaggcacugcacacuuguaua

SEQ ID NO: 32167 - RNA, 23 nt, Artificial Sequence
  RNA Oligomer
ucgaaggcacugcacacuuguau

SEQ ID NO: 32168 - RNA, 23 nt, Artificial Sequence
  RNA Oligomer
aaaaguuccuggugaauaucgaa

SEQ ID NO: 32169 - RNA, 23 nt, Artificial Sequence
  RNA Oligomer
uaaaaguuccuggugaauaucga

SEQ ID NO: 32170 - RNA, 23 nt, Artificial Sequence
  RNA Oligomer
guaaaaguuccuggugaauaucg

SEQ ID NO: 32171 - RNA, 23 nt, Artificial Sequence
  RNA Oligomer
uguaaaaguuccuggugaauauc

SEQ ID NO: 32172 - RNA, 23 nt, Artificial Sequence
  RNA Oligomer
guguaaaaguuccuggugaauau

SEQ ID NO: 32173 - RNA, 23 nt, Artificial Sequence
  RNA Oligomer
uuagaggacauuuagcgugauga

SEQ ID NO: 32174 - RNA, 23 nt, Artificial Sequence
  RNA Oligomer
auuagaggacauuuagcgugaug

SEQ ID NO: 32175 - RNA, 23 nt, Artificial Sequence
  RNA Oligomer
cauuagaggacauuuagcgugau

SEQ ID NO: 32176 - RNA, 23 nt, Artificial Sequence
  RNA Oligomer
uccacguaacuugcugggacugu

SEQ ID NO: 32177 - RNA, 23 nt, Artificial Sequence
  RNA Oligomer
uuccacguaacuugcugggacug

SEQ ID NO: 32178 - RNA, 23 nt, Artificial Sequence
  RNA Oligomer
guuccacguaacuugcugggacu

SEQ ID NO: 32179 - RNA, 23 nt, Artificial Sequence
  RNA Oligomer
ugauaaggagggauauguuccac

SEQ ID NO: 32180 - RNA, 23 nt, Artificial Sequence
  RNA Oligomer
augauaaggagggauauguucca

SEQ ID NO: 32181 - RNA, 23 nt, Artificial Sequence
  RNA Oligomer
aaugauaaggagggauauguucc

SEQ ID NO: 32182 - RNA, 23 nt, Artificial Sequence
  RNA Oligomer
uaaugauaaggagggauauguuc

SEQ ID NO: 32183 - RNA, 23 nt, Artificial Sequence
  RNA Oligomer
uuaugaaccucagaaugaugaug

SEQ ID NO: 32184 - RNA, 23 nt, Artificial Sequence
  RNA Oligomer
auuaugaaccucagaaugaugau

SEQ ID NO: 32185 - RNA, 23 nt, Artificial Sequence
  RNA Oligomer
gauuaugaaccucagaaugauga

SEQ ID NO: 32186 - RNA, 23 nt, Artificial Sequence
  RNA Oligomer
ggagaagaugggcauaaugaaua

SEQ ID NO: 32187 - RNA, 23 nt, Artificial Sequence
  RNA Oligomer
caauuucuuuauggaguucagga

SEQ ID NO: 32188 - RNA, 23 nt, Artificial Sequence
  RNA Oligomer
ccaauuucuuuauggaguucagg

SEQ ID NO: 32189 - RNA, 23 nt, Artificial Sequence
  RNA Oligomer
cccaauuucuuuauggaguucag

SEQ ID NO: 32190 - RNA, 23 nt, Artificial Sequence
  RNA Oligomer
ucccaauuucuuuauggaguuca

SEQ ID NO: 32191 - RNA, 23 nt, Artificial Sequence
  RNA Oligomer
cucccaauuucuuuauggaguuc

SEQ ID NO: 32192 - RNA, 23 nt, Artificial Sequence
  RNA Oligomer
ggaaauggaggaaggcuacacuc

SEQ ID NO: 32193 - RNA, 23 nt, Artificial Sequence
  RNA Oligomer
gguguaaauguaaaugcugcuga

SEQ ID NO: 32194 - RNA, 23 nt, Artificial Sequence
  RNA Oligomer
cucauggaaugagggugaaauuc

SEQ ID NO: 32195 - RNA, 23 nt, Artificial Sequence
  RNA Oligomer
gcucauggaaugagggugaaauu

SEQ ID NO: 32196 - RNA, 23 nt, Artificial Sequence
  RNA Oligomer
cgcucauggaaugagggugaaau

SEQ ID NO: 32197 - RNA, 23 nt, Artificial Sequence
  RNA Oligomer
ugcuugauguguaccuggaggag

SEQ ID NO: 32198 - RNA, 23 nt, Artificial Sequence
  RNA Oligomer
gugcuugauguguaccuggagga

SEQ ID NO: 32199 - RNA, 23 nt, Artificial Sequence
  RNA Oligomer
ugugcuugauguguaccuggagg

SEQ ID NO: 32200 - RNA, 23 nt, Artificial Sequence
  RNA Oligomer
augugcuugauguguaccuggag

SEQ ID NO: 32201 - RNA, 23 nt, Artificial Sequence
  RNA Oligomer
caugugcuugauguguaccugga

SEQ ID NO: 32202 - RNA, 23 nt, Artificial Sequence
  RNA Oligomer
uucaacgauuuggaagucagagg

SEQ ID NO: 32203 - RNA, 23 nt, Artificial Sequence
  RNA Oligomer
cuucaacgauuuggaagucagag

SEQ ID NO: 32204 - RNA, 23 nt, Artificial Sequence
  RNA Oligomer
ucuucaacgauuuggaagucaga

SEQ ID NO: 32205 - RNA, 23 nt, Artificial Sequence
  RNA Oligomer
uucuucaacgauuuggaagucag

SEQ ID NO: 32206 - RNA, 23 nt, Artificial Sequence
  RNA Oligomer
ccaguacagagaacagugacaug

SEQ ID NO: 32207 - RNA, 23 nt, Artificial Sequence
  RNA Oligomer
gccaguacagagaacagugacau

SEQ ID NO: 32208 - RNA, 23 nt, Artificial Sequence
  RNA Oligomer
ugccaguacagagaacagugaca

SEQ ID NO: 32209 - RNA, 23 nt, Artificial Sequence
  RNA Oligomer
augccaguacagagaacagugac

SEQ ID NO: 32210 - RNA, 23 nt, Artificial Sequence
  RNA Oligomer
aaugccaguacagagaacaguga

SEQ ID NO: 32211 - RNA, 23 nt, Artificial Sequence
  RNA Oligomer
uguggggaaugccaguacagaga

SEQ ID NO: 32212 - RNA, 23 nt, Artificial Sequence
  RNA Oligomer
ccuaaugggccaaauauucagaa

SEQ ID NO: 32213 - RNA, 23 nt, Artificial Sequence
  RNA Oligomer
cuaaagaaacguaguucuauuac

SEQ ID NO: 32214 - RNA, 23 nt, Artificial Sequence
  RNA Oligomer
uuacugccuuucuuaucuaaucc

SEQ ID NO: 32215 - RNA, 23 nt, Artificial Sequence
  RNA Oligomer
auuacugccuuucuuaucuaauc

SEQ ID NO: 32216 - RNA, 23 nt, Artificial Sequence
  RNA Oligomer
aauuacugccuuucuuaucuaau

SEQ ID NO: 32217 - RNA, 23 nt, Artificial Sequence
  RNA Oligomer
aaauuacugccuuucuuaucuaa

SEQ ID NO: 32218 - RNA, 23 nt, Artificial Sequence
  RNA Oligomer
uaaauuacugccuuucuuaucua

SEQ ID NO: 32219 - RNA, 23 nt, Artificial Sequence
  RNA Oligomer
uucuccagguucuaagcaagaaa

SEQ ID NO: 32220 - RNA, 23 nt, Artificial Sequence
  RNA Oligomer
uuucuccagguucuaagcaagaa

SEQ ID NO: 32221 - RNA, 23 nt, Artificial Sequence
  RNA Oligomer
cuuucuccagguucuaagcaaga

SEQ ID NO: 32222 - RNA, 23 nt, Artificial Sequence
  RNA Oligomer
ccuuucuccagguucuaagcaag

SEQ ID NO: 32223 - RNA, 23 nt, Artificial Sequence
  RNA Oligomer
cccuuucuccagguucuaagcaa

SEQ ID NO: 32224 - RNA, 23 nt, Artificial Sequence
  RNA Oligomer
cggaaguucucagcaguugucaa

SEQ ID NO: 32225 - RNA, 23 nt, Artificial Sequence
  RNA Oligomer
acggaaguucucagcaguuguca

SEQ ID NO: 32226 - RNA, 23 nt, Artificial Sequence
  RNA Oligomer
gacggaaguucucagcaguuguc

SEQ ID NO: 32227 - RNA, 23 nt, Artificial Sequence
  RNA Oligomer
agacggaaguucucagcaguugu

SEQ ID NO: 32228 - RNA, 23 nt, Artificial Sequence
  RNA Oligomer
cagacggaaguucucagcaguug

SEQ ID NO: 32229 - RNA, 23 nt, Artificial Sequence
  RNA Oligomer
ccagacggaaguucucagcaguu

SEQ ID NO: 32230 - RNA, 23 nt, Artificial Sequence
  RNA Oligomer
gccagacggaaguucucagcagu

SEQ ID NO: 32231 - RNA, 23 nt, Artificial Sequence
  RNA Oligomer
agccagacggaaguucucagcag

SEQ ID NO: 32232 - RNA, 23 nt, Artificial Sequence
  RNA Oligomer
gaagaaccagagcagugaagaua

SEQ ID NO: 32233 - RNA, 23 nt, Artificial Sequence
  RNA Oligomer
ggaagaaccagagcagugaagau

SEQ ID NO: 32234 - RNA, 23 nt, Artificial Sequence
  RNA Oligomer
aggaagaaccagagcagugaaga

SEQ ID NO: 32235 - RNA, 23 nt, Artificial Sequence
  RNA Oligomer
gaggaagaaccagagcagugaag

SEQ ID NO: 32236 - RNA, 23 nt, Artificial Sequence
  RNA Oligomer
ugaggaagaaccagagcagugaa

SEQ ID NO: 32237 - RNA, 23 nt, Artificial Sequence
  RNA Oligomer
cugaggaagaaccagagcaguga

SEQ ID NO: 32238 - RNA, 23 nt, Artificial Sequence
  RNA Oligomer
agaaagugcguccguucucaaug

SEQ ID NO: 32239 - RNA, 23 nt, Artificial Sequence
  RNA Oligomer
aagaaagugcguccguucucaau

SEQ ID NO: 32240 - RNA, 23 nt, Artificial Sequence
  RNA Oligomer
gaagaaagugcguccguucucaa

SEQ ID NO: 32241 - RNA, 23 nt, Artificial Sequence
  RNA Oligomer
cugcuucuguaccucaaagcacu

SEQ ID NO: 32242 - RNA, 23 nt, Artificial Sequence
  RNA Oligomer
ucugcuucuguaccucaaagcac

SEQ ID NO: 32243 - RNA, 23 nt, Artificial Sequence
  RNA Oligomer
guccuggcugugucaaaaguaga

SEQ ID NO: 32244 - RNA, 23 nt, Artificial Sequence
  RNA Oligomer
cguccuggcugugucaaaaguag

SEQ ID NO: 32245 - RNA, 23 nt, Artificial Sequence
  RNA Oligomer
ucguccuggcugugucaaaagua

SEQ ID NO: 32246 - RNA, 23 nt, Artificial Sequence
  RNA Oligomer
gaacuucaggaaauggcaucucg

SEQ ID NO: 32247 - RNA, 23 nt, Artificial Sequence
  RNA Oligomer
ugaacuucaggaaauggcaucuc

SEQ ID NO: 32248 - RNA, 23 nt, Artificial Sequence
  RNA Oligomer
cugaacuucaggaaauggcaucu

SEQ ID NO: 32249 - RNA, 23 nt, Artificial Sequence
  RNA Oligomer
gcugaacuucaggaaauggcauc

SEQ ID NO: 32250 - RNA, 23 nt, Artificial Sequence
  RNA Oligomer
ugcugaacuucaggaaauggcau

SEQ ID NO: 32251 - RNA, 23 nt, Artificial Sequence
  RNA Oligomer
guguuaauaguccuaggauggau

SEQ ID NO: 32252 - RNA, 23 nt, Artificial Sequence
  RNA Oligomer
gagaacgguguuaauaguccuag

SEQ ID NO: 32253 - RNA, 23 nt, Artificial Sequence
  RNA Oligomer
aauuagaaacuugcuacagacuu

SEQ ID NO: 32254 - RNA, 23 nt, Artificial Sequence
  RNA Oligomer
gaaauuagaaacuugcuacagac

SEQ ID NO: 32255 - RNA, 23 nt, Artificial Sequence
  RNA Oligomer
agaaauuagaaacuugcuacaga

SEQ ID NO: 32256 - RNA, 23 nt, Artificial Sequence
  RNA Oligomer
cagaaauuagaaacuugcuacag

SEQ ID NO: 32257 - RNA, 23 nt, Artificial Sequence
  RNA Oligomer
ucagaaauuagaaacuugcuaca

SEQ ID NO: 32258 - RNA, 23 nt, Artificial Sequence
  RNA Oligomer
agaaucuuguuuguaggcugaau

SEQ ID NO: 32259 - RNA, 23 nt, Artificial Sequence
  RNA Oligomer
uagaaucuuguuuguaggcugaa

SEQ ID NO: 32260 - RNA, 23 nt, Artificial Sequence
  RNA Oligomer
guagaaucuuguuuguaggcuga

SEQ ID NO: 32261 - RNA, 23 nt, Artificial Sequence
  RNA Oligomer
auguagaaucuuguuuguaggcu

SEQ ID NO: 32262 - RNA, 23 nt, Artificial Sequence
  RNA Oligomer
acacuuguauauugucagugaag

SEQ ID NO: 32263 - RNA, 23 nt, Artificial Sequence
  RNA Oligomer
cacacuuguauauugucagugaa

SEQ ID NO: 32264 - RNA, 23 nt, Artificial Sequence
  RNA Oligomer
ugcuccuaaaccaguccuccugc

SEQ ID NO: 32265 - RNA, 23 nt, Artificial Sequence
  RNA Oligomer
cugcuccuaaaccaguccuccug

SEQ ID NO: 32266 - RNA, 23 nt, Artificial Sequence
  RNA Oligomer
gcugcuccuaaaccaguccuccu

SEQ ID NO: 32267 - RNA, 23 nt, Artificial Sequence
  RNA Oligomer
agcugcuccuaaaccaguccucc

SEQ ID NO: 32268 - RNA, 23 nt, Artificial Sequence
  RNA Oligomer
cagcugcuccuaaaccaguccuc

SEQ ID NO: 32269 - RNA, 23 nt, Artificial Sequence
  RNA Oligomer
ugaguguuuucagcagcugcucc

SEQ ID NO: 32270 - RNA, 23 nt, Artificial Sequence
  RNA Oligomer
uugaguguuuucagcagcugcuc

SEQ ID NO: 32271 - RNA, 23 nt, Artificial Sequence
  RNA Oligomer
guugaguguuuucagcagcugcu

SEQ ID NO: 32272 - RNA, 23 nt, Artificial Sequence
  RNA Oligomer
uguugaguguuuucagcagcugc

SEQ ID NO: 32273 - RNA, 23 nt, Artificial Sequence
  RNA Oligomer
cuguugaguguuuucagcagcug

SEQ ID NO: 32274 - RNA, 23 nt, Artificial Sequence
  RNA Oligomer
aaguuccuggugaauaucgaaga

SEQ ID NO: 32275 - RNA, 23 nt, Artificial Sequence
  RNA Oligomer
gcaguugggaaaucagcucucug

SEQ ID NO: 32276 - RNA, 23 nt, Artificial Sequence
  RNA Oligomer
ggcaguugggaaaucagcucucu

SEQ ID NO: 32277 - RNA, 23 nt, Artificial Sequence
  RNA Oligomer
gggcaguugggaaaucagcucuc

SEQ ID NO: 32278 - RNA, 23 nt, Artificial Sequence
  RNA Oligomer
ugggcaguugggaaaucagcucu

SEQ ID NO: 32279 - RNA, 23 nt, Artificial Sequence
  RNA Oligomer
uugggcaguugggaaaucagcuc

SEQ ID NO: 32280 - RNA, 23 nt, Artificial Sequence
  RNA Oligomer
gaucauuuauugggcaguuggga

SEQ ID NO: 32281 - RNA, 23 nt, Artificial Sequence
  RNA Oligomer
gaauccugucuaguaaauaggau

SEQ ID NO: 32282 - RNA, 23 nt, Artificial Sequence
  RNA Oligomer
gguguaaaaguuccuggugaaua

SEQ ID NO: 32283 - RNA, 23 nt, Artificial Sequence
  RNA Oligomer
ugguguaaaaguuccuggugaau

SEQ ID NO: 32284 - RNA, 23 nt, Artificial Sequence
  RNA Oligomer
augguguaaaaguuccuggugaa

SEQ ID NO: 32285 - RNA, 23 nt, Artificial Sequence
  RNA Oligomer
gauguuucuuaccguguaucuca

SEQ ID NO: 32286 - RNA, 23 nt, Artificial Sequence
  RNA Oligomer
cgauguuucuuaccguguaucuc

SEQ ID NO: 32287 - RNA, 23 nt, Artificial Sequence
  RNA Oligomer
ccgauguuucuuaccguguaucu

SEQ ID NO: 32288 - RNA, 23 nt, Artificial Sequence
  RNA Oligomer
gccgauguuucuuaccguguauc

SEQ ID NO: 32289 - RNA, 23 nt, Artificial Sequence
  RNA Oligomer
ugccgauguuucuuaccguguau

SEQ ID NO: 32290 - RNA, 23 nt, Artificial Sequence
  RNA Oligomer
aacuuccacacagaauuuuaguc

SEQ ID NO: 32291 - RNA, 23 nt, Artificial Sequence
  RNA Oligomer
aaaggagcuuggccugaaacuuc

SEQ ID NO: 32292 - RNA, 23 nt, Artificial Sequence
  RNA Oligomer
ugaaccucagaaugaugaugagc

SEQ ID NO: 32293 - RNA, 23 nt, Artificial Sequence
  RNA Oligomer
augaaccucagaaugaugaugag

SEQ ID NO: 32294 - RNA, 23 nt, Artificial Sequence
  RNA Oligomer
uaugaaccucagaaugaugauga

SEQ ID NO: 32295 - RNA, 23 nt, Artificial Sequence
  RNA Oligomer
ugcucccaauuucuuuauggagu

SEQ ID NO: 32296 - RNA, 23 nt, Artificial Sequence
  RNA Oligomer
gacauugugaguggaccaagauc

SEQ ID NO: 32297 - RNA, 23 nt, Artificial Sequence
  RNA Oligomer
ggacauugugaguggaccaagau

SEQ ID NO: 32298 - RNA, 23 nt, Artificial Sequence
  RNA Oligomer
gggacauugugaguggaccaaga

SEQ ID NO: 32299 - RNA, 23 nt, Artificial Sequence
  RNA Oligomer
agggacauugugaguggaccaag

SEQ ID NO: 32300 - RNA, 23 nt, Artificial Sequence
  RNA Oligomer
cagggacauugugaguggaccaa

SEQ ID NO: 32301 - RNA, 23 nt, Artificial Sequence
  RNA Oligomer
gugcgaggaaauggaggaaggcu

SEQ ID NO: 32302 - RNA, 23 nt, Artificial Sequence
  RNA Oligomer
agugcgaggaaauggaggaaggc

SEQ ID NO: 32303 - RNA, 23 nt, Artificial Sequence
  RNA Oligomer
aagugcgaggaaauggaggaagg

SEQ ID NO: 32304 - RNA, 23 nt, Artificial Sequence
  RNA Oligomer
uaagugcgaggaaauggaggaag

SEQ ID NO: 32305 - RNA, 23 nt, Artificial Sequence
  RNA Oligomer
auaagugcgaggaaauggaggaa

SEQ ID NO: 32306 - RNA, 23 nt, Artificial Sequence
  RNA Oligomer
uguaaaugcugcugauagugaug

SEQ ID NO: 32307 - RNA, 23 nt, Artificial Sequence
  RNA Oligomer
auguaaaugcugcugauagugau

SEQ ID NO: 32308 - RNA, 23 nt, Artificial Sequence
  RNA Oligomer
aauguaaaugcugcugauaguga

SEQ ID NO: 32309 - RNA, 23 nt, Artificial Sequence
  RNA Oligomer
ucgcucauggaaugagggugaaa

SEQ ID NO: 32310 - RNA, 23 nt, Artificial Sequence
  RNA Oligomer
ggaagucagaggaacgaaguucg

SEQ ID NO: 32311 - RNA, 23 nt, Artificial Sequence
  RNA Oligomer
uggaagucagaggaacgaaguuc

SEQ ID NO: 32312 - RNA, 23 nt, Artificial Sequence
  RNA Oligomer
uuggaagucagaggaacgaaguu

SEQ ID NO: 32313 - RNA, 23 nt, Artificial Sequence
  RNA Oligomer
uuuggaagucagaggaacgaagu

SEQ ID NO: 32314 - RNA, 23 nt, Artificial Sequence
  RNA Oligomer
auuuggaagucagaggaacgaag

SEQ ID NO: 32315 - RNA, 23 nt, Artificial Sequence
  RNA Oligomer
cccaaaucuccagaauaacccag

SEQ ID NO: 32316 - RNA, 23 nt, Artificial Sequence
  RNA Oligomer
ucuaaagaaacguaguucuauua

SEQ ID NO: 32317 - RNA, 23 nt, Artificial Sequence
  RNA Oligomer
cucuaaagaaacguaguucuauu

SEQ ID NO: 32318 - RNA, 23 nt, Artificial Sequence
  RNA Oligomer
uaaugagcgaauguuugauguuc

SEQ ID NO: 32319 - RNA, 23 nt, Artificial Sequence
  RNA Oligomer
auaaugagcgaauguuugauguu

SEQ ID NO: 32320 - RNA, 23 nt, Artificial Sequence
  RNA Oligomer
cagaccguggcagcaaguucaau

SEQ ID NO: 32321 - RNA, 23 nt, Artificial Sequence
  RNA Oligomer
agaaaguccaccugcugcugccg

SEQ ID NO: 32322 - RNA, 23 nt, Artificial Sequence
  RNA Oligomer
aagaaaguccaccugcugcugcc

SEQ ID NO: 32323 - RNA, 23 nt, Artificial Sequence
  RNA Oligomer
caagaaaguccaccugcugcugc

SEQ ID NO: 32324 - RNA, 23 nt, Artificial Sequence
  RNA Oligomer
gcaagaaaguccaccugcugcug

SEQ ID NO: 32325 - RNA, 23 nt, Artificial Sequence
  RNA Oligomer
agcaagaaaguccaccugcugcu

SEQ ID NO: 32326 - RNA, 23 nt, Artificial Sequence
  RNA Oligomer
caaaacagauuaauuugccuuau

SEQ ID NO: 32327 - RNA, 23 nt, Artificial Sequence
  RNA Oligomer
ccaaaacagauuaauuugccuua

SEQ ID NO: 32328 - RNA, 23 nt, Artificial Sequence
  RNA Oligomer
accaaaacagauuaauuugccuu

SEQ ID NO: 32329 - RNA, 23 nt, Artificial Sequence
  RNA Oligomer
aaccaaaacagauuaauuugccu

SEQ ID NO: 32330 - RNA, 23 nt, Artificial Sequence
  RNA Oligomer
aaaccaaaacagauuaauuugcc

SEQ ID NO: 32331 - RNA, 23 nt, Artificial Sequence
  RNA Oligomer
uugguacucugaggaagaaccag

SEQ ID NO: 32332 - RNA, 23 nt, Artificial Sequence
  RNA Oligomer
uuugguacucugaggaagaacca

SEQ ID NO: 32333 - RNA, 23 nt, Artificial Sequence
  RNA Oligomer
cuuugguacucugaggaagaacc

SEQ ID NO: 32334 - RNA, 23 nt, Artificial Sequence
  RNA Oligomer
caauguuugaugcaguagaccag

SEQ ID NO: 32335 - RNA, 23 nt, Artificial Sequence
  RNA Oligomer
ucaauguuugaugcaguagacca

SEQ ID NO: 32336 - RNA, 23 nt, Artificial Sequence
  RNA Oligomer
gggugaaauucaacccccuugcu

SEQ ID NO: 32337 - RNA, 23 nt, Artificial Sequence
  RNA Oligomer
agggugaaauucaacccccuugc

SEQ ID NO: 32338 - RNA, 23 nt, Artificial Sequence
  RNA Oligomer
gagggugaaauucaacccccuug

SEQ ID NO: 32339 - RNA, 23 nt, Artificial Sequence
  RNA Oligomer
ugagggugaaauucaacccccuu

SEQ ID NO: 32340 - RNA, 23 nt, Artificial Sequence
  RNA Oligomer
augagggugaaauucaacccccu

SEQ ID NO: 32341 - RNA, 23 nt, Artificial Sequence
  RNA Oligomer
acccagagaacauuuauuccaau

SEQ ID NO: 32342 - RNA, 23 nt, Artificial Sequence
  RNA Oligomer
cacccagagaacauuuauuccaa

SEQ ID NO: 32343 - RNA, 23 nt, Artificial Sequence
  RNA Oligomer
gcacccagagaacauuuauucca

SEQ ID NO: 32344 - RNA, 23 nt, Artificial Sequence
  RNA Oligomer
agcacccagagaacauuuauucc

SEQ ID NO: 32345 - RNA, 23 nt, Artificial Sequence
  RNA Oligomer
cagcacccagagaacauuuauuc

SEQ ID NO: 32346 - RNA, 23 nt, Artificial Sequence
  RNA Oligomer
aaugagggugaaauucaaccccc

SEQ ID NO: 32347 - RNA, 23 nt, Artificial Sequence
  RNA Oligomer
gaaugagggugaaauucaacccc

SEQ ID NO: 32348 - RNA, 23 nt, Artificial Sequence
  RNA Oligomer
agaauuugaccuuguacagagaa

SEQ ID NO: 32349 - RNA, 23 nt, Artificial Sequence
  RNA Oligomer
cuguuaagaagaaguaauacgau

SEQ ID NO: 32350 - RNA, 23 nt, Artificial Sequence
  RNA Oligomer
gaaguaauacgauuauuuuuggc

SEQ ID NO: 32351 - RNA, 23 nt, Artificial Sequence
  RNA Oligomer
gagaauuauuuaugagguugaug

SEQ ID NO: 32352 - RNA, 23 nt, Artificial Sequence
  RNA Oligomer
cagagaauuauuuaugagguuga

SEQ ID NO: 32353 - RNA, 23 nt, Artificial Sequence
  RNA Oligomer
acagagaauuauuuaugagguug

SEQ ID NO: 32354 - RNA, 23 nt, Artificial Sequence
  RNA Oligomer
caauauauuccauguauacgcaa

SEQ ID NO: 32355 - RNA, 23 nt, Artificial Sequence
  RNA Oligomer
gaauuauuuaugagguugaugac

SEQ ID NO: 32356 - RNA, 23 nt, Artificial Sequence
  RNA Oligomer
guacagagaauuauuuaugaggu

SEQ ID NO: 32357 - RNA, 23 nt, Artificial Sequence
  RNA Oligomer
gaaggcagcucuacagcaaaaag

SEQ ID NO: 32358 - RNA, 23 nt, Artificial Sequence
  RNA Oligomer
auauuuacauguggagcccgaaa

SEQ ID NO: 32359 - RNA, 23 nt, Artificial Sequence
  RNA Oligomer
ucaaaugcagaucuuuucccaag

SEQ ID NO: 32360 - RNA, 23 nt, Artificial Sequence
  RNA Oligomer
agaaggcagcucuacagcaaaaa

SEQ ID NO: 32361 - RNA, 23 nt, Artificial Sequence
  RNA Oligomer
ggucucucugguuccugaaucau

SEQ ID NO: 32362 - RNA, 23 nt, Artificial Sequence
  RNA Oligomer
uucuuaucuaauccuuaccgaaa

SEQ ID NO: 32363 - RNA, 23 nt, Artificial Sequence
  RNA Oligomer
aggcagcucuacagcaaaaagaa

SEQ ID NO: 32364 - RNA, 23 nt, Artificial Sequence
  RNA Oligomer
gcuaagaaacaaauugaaucaag

SEQ ID NO: 32365 - RNA, 23 nt, Artificial Sequence
  RNA Oligomer
agaagagacuaagcaaugggaaa

SEQ ID NO: 32366 - RNA, 23 nt, Artificial Sequence
  RNA Oligomer
cucgaaggcacugcacacuugua

SEQ ID NO: 32367 - RNA, 23 nt, Artificial Sequence
  RNA Oligomer
cuagauucgucuuuggagggaga

SEQ ID NO: 32368 - RNA, 23 nt, Artificial Sequence
  RNA Oligomer
gcuuuacugcuagauucgucuuu

SEQ ID NO: 32369 - RNA, 23 nt, Artificial Sequence
  RNA Oligomer
acaaacuaaucagccaccuucag

SEQ ID NO: 32370 - RNA, 23 nt, Artificial Sequence
  RNA Oligomer
cgggaugcucagguugcaaauaa

SEQ ID NO: 32371 - RNA, 23 nt, Artificial Sequence
  RNA Oligomer
ggagaaagagaagaaagugcguc

SEQ ID NO: 32372 - RNA, 23 nt, Artificial Sequence
  RNA Oligomer
cagaagagacuaagcaaugggaa

SEQ ID NO: 32373 - RNA, 23 nt, Artificial Sequence
  RNA Oligomer
ugaaauauugaaacuaagcuacg

SEQ ID NO: 32374 - RNA, 23 nt, Artificial Sequence
  RNA Oligomer
gucauuuaugcgcuuugggauua

SEQ ID NO: 32375 - RNA, 23 nt, Artificial Sequence
  RNA Oligomer
gucucucugguuccugaaucauu

SEQ ID NO: 32376 - RNA, 23 nt, Artificial Sequence
  RNA Oligomer
ccauuuggcugaaguguggugug

SEQ ID NO: 32377 - RNA, 23 nt, Artificial Sequence
  RNA Oligomer
uucaaaugcagaucuuuucccaa

SEQ ID NO: 32378 - RNA, 23 nt, Artificial Sequence
  RNA Oligomer
uucacaaacuaaaggcucuaaaa

SEQ ID NO: 32379 - RNA, 23 nt, Artificial Sequence
  RNA Oligomer
cuauaaggagcugcagcuaagaa

SEQ ID NO: 32380 - RNA, 23 nt, Artificial Sequence
  RNA Oligomer
gaguucaggagaagaugggcaua

SEQ ID NO: 32381 - RNA, 23 nt, Artificial Sequence
  RNA Oligomer
cugcugcagauaagugcgaggaa

SEQ ID NO: 32382 - RNA, 23 nt, Artificial Sequence
  RNA Oligomer
uagauucgucuuuggagggagaa

SEQ ID NO: 32383 - RNA, 23 nt, Artificial Sequence
  RNA Oligomer
guaaaacuggcucagagcguauc

SEQ ID NO: 32384 - RNA, 23 nt, Artificial Sequence
  RNA Oligomer
ccagagggccacacuuuucaagu

SEQ ID NO: 32385 - RNA, 23 nt, Artificial Sequence
  RNA Oligomer
gcugcaguaggucccuauaucca

SEQ ID NO: 32386 - RNA, 23 nt, Artificial Sequence
  RNA Oligomer
aaauuagaaacuugcuacagacu

SEQ ID NO: 32387 - RNA, 23 nt, Artificial Sequence
  RNA Oligomer
ugcuagauucgucuuuggaggga

SEQ ID NO: 32388 - RNA, 23 nt, Artificial Sequence
  RNA Oligomer
ccaucauacccauccaagucagc

SEQ ID NO: 32389 - RNA, 23 nt, Artificial Sequence
  RNA Oligomer
gaaagagaagaaagugcguccgu

SEQ ID NO: 32390 - RNA, 23 nt, Artificial Sequence
  RNA Oligomer
acaauaugcagagacguggugga

SEQ ID NO: 32391 - RNA, 23 nt, Artificial Sequence
  RNA Oligomer
ggcagcucuacagcaaaaagaaa

SEQ ID NO: 32392 - RNA, 23 nt, Artificial Sequence
  RNA Oligomer
caccaugacaaucagucugcagu

SEQ ID NO: 32393 - RNA, 23 nt, Artificial Sequence
  RNA Oligomer
uaaaccaguccuccugccagaaa

SEQ ID NO: 32394 - RNA, 23 nt, Artificial Sequence
  RNA Oligomer
guaaaaggacaaacuugcguaaa

SEQ ID NO: 32395 - RNA, 23 nt, Artificial Sequence
  RNA Oligomer
gguaaaaggacaaacuugcguaa

SEQ ID NO: 32396 - RNA, 23 nt, Artificial Sequence
  RNA Oligomer
cucauaccagagggccacacuuu

SEQ ID NO: 32397 - RNA, 23 nt, Artificial Sequence
  RNA Oligomer
ucaaguugaugauggagagguuc

SEQ ID NO: 32398 - RNA, 23 nt, Artificial Sequence
  RNA Oligomer
caauaugcagagacgugguggau

SEQ ID NO: 32399 - RNA, 23 nt, Artificial Sequence
  RNA Oligomer
aggucccuauauccagucgucua

SEQ ID NO: 32400 - RNA, 23 nt, Artificial Sequence
  RNA Oligomer
gcaaugggaaacuuguggaggaa

SEQ ID NO: 32401 - RNA, 23 nt, Artificial Sequence
  RNA Oligomer
uguuuguaggcugaauuuuaauc

SEQ ID NO: 32402 - RNA, 23 nt, Artificial Sequence
  RNA Oligomer
ccauuagaggacauuuagcguga

SEQ ID NO: 32403 - RNA, 23 nt, Artificial Sequence
  RNA Oligomer
acaauguagcuugaaagcgauga

SEQ ID NO: 32404 - RNA, 23 nt, Artificial Sequence
  RNA Oligomer
gaaaugguguaaaaguuccuggu

SEQ ID NO: 32405 - RNA, 23 nt, Artificial Sequence
  RNA Oligomer
ccuugauuaugagccugagggag

SEQ ID NO: 32406 - RNA, 23 nt, Artificial Sequence
  RNA Oligomer
ucagaagcuuuuauaucagagga

SEQ ID NO: 32407 - RNA, 23 nt, Artificial Sequence
  RNA Oligomer
ggaaguucucagcaguugucaac

SEQ ID NO: 32408 - RNA, 23 nt, Artificial Sequence
  RNA Oligomer
cuaaaccaguccuccugccagaa

SEQ ID NO: 32409 - RNA, 23 nt, Artificial Sequence
  RNA Oligomer
ucauuuauugggcaguugggaaa

SEQ ID NO: 32410 - RNA, 23 nt, Artificial Sequence
  RNA Oligomer
caauguagcuugaaagcgaugaa

SEQ ID NO: 32411 - RNA, 23 nt, Artificial Sequence
  RNA Oligomer
uuacugcuagauucgucuuugga

SEQ ID NO: 32412 - RNA, 23 nt, Artificial Sequence
  RNA Oligomer
cagaagcuuuuauaucagaggac

SEQ ID NO: 32413 - RNA, 23 nt, Artificial Sequence
  RNA Oligomer
ugaugauggagagguuccgcuga

SEQ ID NO: 32414 - RNA, 23 nt, Artificial Sequence
  RNA Oligomer
ucacaaacuaaaggcucuaaaau

SEQ ID NO: 32415 - RNA, 23 nt, Artificial Sequence
  RNA Oligomer
cguaauauuugucaagaucauag

SEQ ID NO: 32416 - RNA, 23 nt, Artificial Sequence
  RNA Oligomer
ccaaauccagaggcuccacaugu

SEQ ID NO: 32417 - RNA, 23 nt, Artificial Sequence
  RNA Oligomer
guacagagaacagugacaugcca

SEQ ID NO: 32418 - RNA, 23 nt, Artificial Sequence
  RNA Oligomer
gaaucaacagcagcacccagaga

SEQ ID NO: 32419 - RNA, 23 nt, Artificial Sequence
  RNA Oligomer
guucucagcaguugucaacaguu

SEQ ID NO: 32420 - RNA, 23 nt, Artificial Sequence
  RNA Oligomer
gcacuucacagaaguuccaguua

SEQ ID NO: 32421 - RNA, 23 nt, Artificial Sequence
  RNA Oligomer
agaauuaaaccaagacaaaggag

SEQ ID NO: 32422 - RNA, 23 nt, Artificial Sequence
  RNA Oligomer
ggcaguccagaaccugaaacaga

SEQ ID NO: 32423 - RNA, 23 nt, Artificial Sequence
  RNA Oligomer
caacagcagcacccagagaacau

SEQ ID NO: 32424 - RNA, 23 nt, Artificial Sequence
  RNA Oligomer
accuuacuuccacccuucagaaa

SEQ ID NO: 32425 - RNA, 23 nt, Artificial Sequence
  RNA Oligomer
cccagccuuccaaagacaccuua

SEQ ID NO: 32426 - RNA, 23 nt, Artificial Sequence
  RNA Oligomer
ucaagagcagaaugccaagcuac

SEQ ID NO: 32427 - RNA, 23 nt, Artificial Sequence
  RNA Oligomer
acaaguugcugagcaggagaaac

SEQ ID NO: 32428 - RNA, 23 nt, Artificial Sequence
  RNA Oligomer
gaaaucagcucucuguccuguug

SEQ ID NO: 32429 - RNA, 23 nt, Artificial Sequence
  RNA Oligomer
gaagacgaagaugaaaucgaaug

SEQ ID NO: 32430 - RNA, 23 nt, Artificial Sequence
  RNA Oligomer
gcuacacucagugcucccaauuu

SEQ ID NO: 32431 - RNA, 23 nt, Artificial Sequence
  RNA Oligomer
uaaguuuuugguggagucaggag

SEQ ID NO: 32432 - RNA, 23 nt, Artificial Sequence
  RNA Oligomer
ucaacagcagcacccagagaaca

SEQ ID NO: 32433 - RNA, 23 nt, Artificial Sequence
  RNA Oligomer
ccaaagacaccuuacuuccaccc

SEQ ID NO: 32434 - RNA, 23 nt, Artificial Sequence
  RNA Oligomer
gugauugccauuuggcugaagug

SEQ ID NO: 32435 - RNA, 23 nt, Artificial Sequence
  RNA Oligomer
gagugauugccauuuggcugaag

SEQ ID NO: 32436 - RNA, 23 nt, Artificial Sequence
  RNA Oligomer
gcagugaagauaucuugcgggau

SEQ ID NO: 32437 - RNA, 23 nt, Artificial Sequence
  RNA Oligomer
cccaccuuccuuugguacucuga

SEQ ID NO: 32438 - RNA, 23 nt, Artificial Sequence
  RNA Oligomer
aaaauacagacacugcccaacau

SEQ ID NO: 32439 - RNA, 23 nt, Artificial Sequence
  RNA Oligomer
ugaaaauacagacacugcccaac

SEQ ID NO: 32440 - RNA, 23 nt, Artificial Sequence
  RNA Oligomer
caggcagcuagagaugcucaaga

SEQ ID NO: 32441 - RNA, 23 nt, Artificial Sequence
  RNA Oligomer
ggaaacuuguggaggaaauugaa

SEQ ID NO: 32442 - RNA, 23 nt, Artificial Sequence
  RNA Oligomer
cuaaaaaaagugagagcacuuaa

SEQ ID NO: 32443 - RNA, 23 nt, Artificial Sequence
  RNA Oligomer
ugcugggacuguacccaagaauu

SEQ ID NO: 32444 - RNA, 23 nt, Artificial Sequence
  RNA Oligomer
ugaugaugagcugcccaugaaag

SEQ ID NO: 32445 - RNA, 23 nt, Artificial Sequence
  RNA Oligomer
ggaguucaggagaagaugggcau

SEQ ID NO: 32446 - RNA, 23 nt, Artificial Sequence
  RNA Oligomer
gguggucucucugguuccugaau

SEQ ID NO: 32447 - RNA, 23 nt, Artificial Sequence
  RNA Oligomer
ccacucagcccaacuaaauuacu

SEQ ID NO: 32448 - RNA, 23 nt, Artificial Sequence
  RNA Oligomer
ggccacacuuuucaaguguauau

SEQ ID NO: 32449 - RNA, 23 nt, Artificial Sequence
  RNA Oligomer
ccagccuuccaaagacaccuuac

SEQ ID NO: 32450 - RNA, 23 nt, Artificial Sequence
  RNA Oligomer
ugauugccauuuggcugaagugu

SEQ ID NO: 32451 - RNA, 23 nt, Artificial Sequence
  RNA Oligomer
agugauugccauuuggcugaagu

SEQ ID NO: 32452 - RNA, 23 nt, Artificial Sequence
  RNA Oligomer
caguaauuagauguagaaucuug

SEQ ID NO: 32453 - RNA, 23 nt, Artificial Sequence
  RNA Oligomer
agaauucaccauuagaggacauu

SEQ ID NO: 32454 - RNA, 23 nt, Artificial Sequence
  RNA Oligomer
ggagggauauguuccacguaacu

SEQ ID NO: 32455 - RNA, 23 nt, Artificial Sequence
  RNA Oligomer
acaaacuugcguaaaacuggcuc

SEQ ID NO: 32456 - RNA, 23 nt, Artificial Sequence
  RNA Oligomer
gaacguccaguugcggauaauga

SEQ ID NO: 32457 - RNA, 23 nt, Artificial Sequence
  RNA Oligomer
gggaugcucagguugcaaauaaa

SEQ ID NO: 32458 - RNA, 23 nt, Artificial Sequence
  RNA Oligomer
gcgggaugcucagguugcaaaua

SEQ ID NO: 32459 - RNA, 23 nt, Artificial Sequence
  RNA Oligomer
caagaugaugccgauguuucuua

SEQ ID NO: 32460 - RNA, 23 nt, Artificial Sequence
  RNA Oligomer
cuucacaaacuaaaggcucuaaa

SEQ ID NO: 32461 - RNA, 23 nt, Artificial Sequence
  RNA Oligomer
aagaaggcagcucuacagcaaaa

SEQ ID NO: 32462 - RNA, 23 nt, Artificial Sequence
  RNA Oligomer
ccguguagcacucagauaaguau

SEQ ID NO: 32463 - RNA, 23 nt, Artificial Sequence
  RNA Oligomer
cuuuauggaguucaggagaagau

SEQ ID NO: 32464 - RNA, 23 nt, Artificial Sequence
  RNA Oligomer
acacucagugcucccaauuucuu

SEQ ID NO: 32465 - RNA, 23 nt, Artificial Sequence
  RNA Oligomer
ugcugauagugauggauggacuc

SEQ ID NO: 32466 - RNA, 23 nt, Artificial Sequence
  RNA Oligomer
gcugcugauagugauggauggac

SEQ ID NO: 32467 - RNA, 23 nt, Artificial Sequence
  RNA Oligomer
caaacuugcguaaaacuggcuca

SEQ ID NO: 32468 - RNA, 23 nt, Artificial Sequence
  RNA Oligomer
gaggguccuaaugggccaaauau

SEQ ID NO: 32469 - RNA, 23 nt, Artificial Sequence
  RNA Oligomer
gaaagaauuccucggccacucag

SEQ ID NO: 32470 - RNA, 23 nt, Artificial Sequence
  RNA Oligomer
cccagagaacauuuauuccaaua

SEQ ID NO: 32471 - RNA, 23 nt, Artificial Sequence
  RNA Oligomer
gggccacacuuuucaaguguaua

SEQ ID NO: 32472 - RNA, 23 nt, Artificial Sequence
  RNA Oligomer
ccuuacuuccacccuucagaaaa

SEQ ID NO: 32473 - RNA, 23 nt, Artificial Sequence
  RNA Oligomer
agaccagacccuuucuccagguu

SEQ ID NO: 32474 - RNA, 23 nt, Artificial Sequence
  RNA Oligomer
ccuccuguuccuacaaaaccaaa

SEQ ID NO: 32475 - RNA, 23 nt, Artificial Sequence
  RNA Oligomer
gggaaacuuguggaggaaauuga

SEQ ID NO: 32476 - RNA, 23 nt, Artificial Sequence
  RNA Oligomer
ugggaaacuuguggaggaaauug

SEQ ID NO: 32477 - RNA, 23 nt, Artificial Sequence
  RNA Oligomer
caaugggaaacuuguggaggaaa

SEQ ID NO: 32478 - RNA, 23 nt, Artificial Sequence
  RNA Oligomer
gaaugucucuagaagagaaugaa

SEQ ID NO: 32479 - RNA, 23 nt, Artificial Sequence
  RNA Oligomer
cuugcugggacuguacccaagaa

SEQ ID NO: 32480 - RNA, 23 nt, Artificial Sequence
  RNA Oligomer
gagggauauguuccacguaacuu

SEQ ID NO: 32481 - RNA, 23 nt, Artificial Sequence
  RNA Oligomer
gcaugacaaucauccacagggaa

SEQ ID NO: 32482 - RNA, 23 nt, Artificial Sequence
  RNA Oligomer
agaucucaggauccaaguuuaaa

SEQ ID NO: 32483 - RNA, 23 nt, Artificial Sequence
  RNA Oligomer
caagaucucaggauccaaguuua

SEQ ID NO: 32484 - RNA, 23 nt, Artificial Sequence
  RNA Oligomer
gacaugcagacugcugcagauaa

SEQ ID NO: 32485 - RNA, 23 nt, Artificial Sequence
  RNA Oligomer
ggcucuucacaaugcugugugug

SEQ ID NO: 32486 - RNA, 23 nt, Artificial Sequence
  RNA Oligomer
agaggguccuaaugggccaaaua

SEQ ID NO: 32487 - RNA, 23 nt, Artificial Sequence
  RNA Oligomer
gcugaccuagaagccuuacgaaa

SEQ ID NO: 32488 - RNA, 23 nt, Artificial Sequence
  RNA Oligomer
ccguccaugggaacuaaaccaaa

SEQ ID NO: 32489 - RNA, 23 nt, Artificial Sequence
  RNA Oligomer
guggcugcaguaggucccuauau

SEQ ID NO: 32490 - RNA, 23 nt, Artificial Sequence
  RNA Oligomer
gcagaaugccaagcuacaacaac

SEQ ID NO: 32491 - RNA, 23 nt, Artificial Sequence
  RNA Oligomer
gaaacuuguggaggaaauugaac

SEQ ID NO: 32492 - RNA, 23 nt, Artificial Sequence
  RNA Oligomer
caacagcaacaaguugcugagca

SEQ ID NO: 32493 - RNA, 23 nt, Artificial Sequence
  RNA Oligomer
ggcaacuaaggaacagcgcuuaa

SEQ ID NO: 32494 - RNA, 23 nt, Artificial Sequence
  RNA Oligomer
caagaucauagcugacuuuaaaa

SEQ ID NO: 32495 - RNA, 23 nt, Artificial Sequence
  RNA Oligomer
guguuuucagcagcugcuccuaa

SEQ ID NO: 32496 - RNA, 23 nt, Artificial Sequence
  RNA Oligomer
cguguagcacucagauaaguaua

SEQ ID NO: 32497 - RNA, 23 nt, Artificial Sequence
  RNA Oligomer
gaauucaccauuagaggacauuu

SEQ ID NO: 32498 - RNA, 23 nt, Artificial Sequence
  RNA Oligomer
gucaaugaagaauuaaucucugu

SEQ ID NO: 32499 - RNA, 23 nt, Artificial Sequence
  RNA Oligomer
caaucauccacagggaagacgaa

SEQ ID NO: 32500 - RNA, 23 nt, Artificial Sequence
  RNA Oligomer
uccauuacauugugcugccucau

SEQ ID NO: 32501 - RNA, 23 nt, Artificial Sequence
  RNA Oligomer
uccugguacaguuugguguaaau

SEQ ID NO: 32502 - RNA, 23 nt, Artificial Sequence
  RNA Oligomer
cguaaaacuggcucagagcguau

SEQ ID NO: 32503 - RNA, 23 nt, Artificial Sequence
  RNA Oligomer
gaagcuuuuauaucagaggacca

SEQ ID NO: 32504 - RNA, 23 nt, Artificial Sequence
  RNA Oligomer
ucggccacucagcccaacuaaau

SEQ ID NO: 32505 - RNA, 23 nt, Artificial Sequence
  RNA Oligomer
ccuguaauugcugcugcccagaa

SEQ ID NO: 32506 - RNA, 23 nt, Artificial Sequence
  RNA Oligomer
ccaguugcggauaaugagcgaau

SEQ ID NO: 32507 - RNA, 23 nt, Artificial Sequence
  RNA Oligomer
cagccuuccaaagacaccuuacu

SEQ ID NO: 32508 - RNA, 23 nt, Artificial Sequence
  RNA Oligomer
cuccagguucuaagcaagaaagu

SEQ ID NO: 32509 - RNA, 23 nt, Artificial Sequence
  RNA Oligomer
aaucagccaccuucagacauuaa

SEQ ID NO: 32510 - RNA, 23 nt, Artificial Sequence
  RNA Oligomer
gcuucacaaacuaaaggcucuaa

SEQ ID NO: 32511 - RNA, 23 nt, Artificial Sequence
  RNA Oligomer
gcaguaggucccuauauccaguc

SEQ ID NO: 32512 - RNA, 23 nt, Artificial Sequence
  RNA Oligomer
gccaccaugacaaucagucugca

SEQ ID NO: 32513 - RNA, 23 nt, Artificial Sequence
  RNA Oligomer
agaucagcgacaacagcaacaag

SEQ ID NO: 32514 - RNA, 23 nt, Artificial Sequence
  RNA Oligomer
gucaagaucauagcugacuuuaa

SEQ ID NO: 32515 - RNA, 23 nt, Artificial Sequence
  RNA Oligomer
ugcuacagacuuacccguaauau

SEQ ID NO: 32516 - RNA, 23 nt, Artificial Sequence
  RNA Oligomer
ugaaacuaagcuacgguaccagu

SEQ ID NO: 32517 - RNA, 23 nt, Artificial Sequence
  RNA Oligomer
acuuguauauugucagugaagaa

SEQ ID NO: 32518 - RNA, 23 nt, Artificial Sequence
  RNA Oligomer
ggccugaaacuuccacacagaau

SEQ ID NO: 32519 - RNA, 23 nt, Artificial Sequence
  RNA Oligomer
ccaagaucucaggauccaaguuu

SEQ ID NO: 32520 - RNA, 23 nt, Artificial Sequence
  RNA Oligomer
ggcuacacucagugcucccaauu

SEQ ID NO: 32521 - RNA, 23 nt, Artificial Sequence
  RNA Oligomer
uuacauugugcugccucauguaa

SEQ ID NO: 32522 - RNA, 23 nt, Artificial Sequence
  RNA Oligomer
cguuaaguuccugguacaguuug

SEQ ID NO: 32523 - RNA, 23 nt, Artificial Sequence
  RNA Oligomer
ugguaaaaggacaaacuugcgua

SEQ ID NO: 32524 - RNA, 23 nt, Artificial Sequence
  RNA Oligomer
cagaauaacccagaagaaccaaa

SEQ ID NO: 32525 - RNA, 23 nt, Artificial Sequence
  RNA Oligomer
cgaaaccagagugaugcugaccu

SEQ ID NO: 32526 - RNA, 23 nt, Artificial Sequence
  RNA Oligomer
ggccacucagcccaacuaaauua

SEQ ID NO: 32527 - RNA, 23 nt, Artificial Sequence
  RNA Oligomer
cggccacucagcccaacuaaauu

SEQ ID NO: 32528 - RNA, 23 nt, Artificial Sequence
  RNA Oligomer
ccagagaacauuuauuccaauag

SEQ ID NO: 32529 - RNA, 23 nt, Artificial Sequence
  RNA Oligomer
gccuuccaaagacaccuuacuuc

SEQ ID NO: 32530 - RNA, 23 nt, Artificial Sequence
  RNA Oligomer
gagugcugcuaucucccagcaua

SEQ ID NO: 32531 - RNA, 23 nt, Artificial Sequence
  RNA Oligomer
agacauuaagccagacggaaguu

SEQ ID NO: 32532 - RNA, 23 nt, Artificial Sequence
  RNA Oligomer
ggcugagcuugaucgccucuaua

SEQ ID NO: 32533 - RNA, 23 nt, Artificial Sequence
  RNA Oligomer
ccaugacaaucagucugcagugg

SEQ ID NO: 32534 - RNA, 23 nt, Artificial Sequence
  RNA Oligomer
ccaccaugacaaucagucugcag

SEQ ID NO: 32535 - RNA, 23 nt, Artificial Sequence
  RNA Oligomer
agagcacuuaaaggccacgugga

SEQ ID NO: 32536 - RNA, 23 nt, Artificial Sequence
  RNA Oligomer
cauagcugacuuuaaaaacaguu

SEQ ID NO: 32537 - RNA, 23 nt, Artificial Sequence
  RNA Oligomer
uugucaagaucauagcugacuuu

SEQ ID NO: 32538 - RNA, 23 nt, Artificial Sequence
  RNA Oligomer
uugcuacagacuuacccguaaua

SEQ ID NO: 32539 - RNA, 23 nt, Artificial Sequence
  RNA Oligomer
cuuguauauugucagugaagaac

SEQ ID NO: 32540 - RNA, 23 nt, Artificial Sequence
  RNA Oligomer
ucagcagcugcuccuaaaccagu

SEQ ID NO: 32541 - RNA, 23 nt, Artificial Sequence
  RNA Oligomer
gcucucuguccuguugaguguuu

SEQ ID NO: 32542 - RNA, 23 nt, Artificial Sequence
  RNA Oligomer
cccguguagcacucagauaagua

SEQ ID NO: 32543 - RNA, 23 nt, Artificial Sequence
  RNA Oligomer
gacaauguagcuugaaagcgaug

SEQ ID NO: 32544 - RNA, 23 nt, Artificial Sequence
  RNA Oligomer
gaaacuuccacacagaauuuuag

SEQ ID NO: 32545 - RNA, 23 nt, Artificial Sequence
  RNA Oligomer
ugaaacuuccacacagaauuuua

SEQ ID NO: 32546 - RNA, 23 nt, Artificial Sequence
  RNA Oligomer
uggccugaaacuuccacacagaa

SEQ ID NO: 32547 - RNA, 23 nt, Artificial Sequence
  RNA Oligomer
aagaucucaggauccaaguuuaa

SEQ ID NO: 32548 - RNA, 23 nt, Artificial Sequence
  RNA Oligomer
accaagaucucaggauccaaguu

SEQ ID NO: 32549 - RNA, 23 nt, Artificial Sequence
  RNA Oligomer
aggcuacacucagugcucccaau

SEQ ID NO: 32550 - RNA, 23 nt, Artificial Sequence
  RNA Oligomer
ugcugcagauaagugcgaggaaa

SEQ ID NO: 32551 - RNA, 23 nt, Artificial Sequence
  RNA Oligomer
cugguacaguuugguguaaaugu

SEQ ID NO: 32552 - RNA, 23 nt, Artificial Sequence
  RNA Oligomer
ccugguacaguuugguguaaaug

SEQ ID NO: 32553 - RNA, 23 nt, Artificial Sequence
  RNA Oligomer
agguggucucucugguuccugaa

SEQ ID NO: 32554 - RNA, 23 nt, Artificial Sequence
  RNA Oligomer
aggguccuaaugggccaaauauu

SEQ ID NO: 32555 - RNA, 23 nt, Artificial Sequence
  RNA Oligomer
ugauguucuucaacgauuuggaa

SEQ ID NO: 32556 - RNA, 23 nt, Artificial Sequence
  RNA Oligomer
ugcugaccuagaagccuuacgaa

SEQ ID NO: 32557 - RNA, 23 nt, Artificial Sequence
  RNA Oligomer
cgaaagaauuccucggccacuca

SEQ ID NO: 32558 - RNA, 23 nt, Artificial Sequence
  RNA Oligomer
guaauugcugcugcccagaauca

SEQ ID NO: 32559 - RNA, 23 nt, Artificial Sequence
  RNA Oligomer
ucauaccagagggccacacuuuu

SEQ ID NO: 32560 - RNA, 23 nt, Artificial Sequence
  RNA Oligomer
caggaaaaaacuuccagcaggcu

SEQ ID NO: 32561 - RNA, 23 nt, Artificial Sequence
  RNA Oligomer
caaagacaccuuacuuccacccu

SEQ ID NO: 32562 - RNA, 23 nt, Artificial Sequence
  RNA Oligomer
cuaaucagccaccuucagacauu

SEQ ID NO: 32563 - RNA, 23 nt, Artificial Sequence
  RNA Oligomer
ccaccuuccuuugguacucugag

SEQ ID NO: 32564 - RNA, 23 nt, Artificial Sequence
  RNA Oligomer
ccuauauccagucgucuacuaug

SEQ ID NO: 32565 - RNA, 23 nt, Artificial Sequence
  RNA Oligomer
gcugagcuugaucgccucuauaa

SEQ ID NO: 32566 - RNA, 23 nt, Artificial Sequence
  RNA Oligomer
caacaaguugcugagcaggagaa

SEQ ID NO: 32567 - RNA, 23 nt, Artificial Sequence
  RNA Oligomer
ucaagaucauagcugacuuuaaa

SEQ ID NO: 32568 - RNA, 23 nt, Artificial Sequence
  RNA Oligomer
aguauacagcgacaauccuguuu

SEQ ID NO: 32569 - RNA, 23 nt, Artificial Sequence
  RNA Oligomer
gugucccguguagcacucagaua

SEQ ID NO: 32570 - RNA, 23 nt, Artificial Sequence
  RNA Oligomer
ggauauguuccacguaacuugcu

SEQ ID NO: 32571 - RNA, 23 nt, Artificial Sequence
  RNA Oligomer
ggaccaagaucucaggauccaag

SEQ ID NO: 32572 - RNA, 23 nt, Artificial Sequence
  RNA Oligomer
ugacaugcagacugcugcagaua

SEQ ID NO: 32573 - RNA, 23 nt, Artificial Sequence
  RNA Oligomer
gugacaugcagacugcugcagau

SEQ ID NO: 32574 - RNA, 23 nt, Artificial Sequence
  RNA Oligomer
gccuccugguaaaaggacaaacu

SEQ ID NO: 32575 - RNA, 23 nt, Artificial Sequence
  RNA Oligomer
cugccuccugguaaaaggacaaa

SEQ ID NO: 32576 - RNA, 23 nt, Artificial Sequence
  RNA Oligomer
caacagcaggcgccaggaaaaaa

SEQ ID NO: 32577 - RNA, 23 nt, Artificial Sequence
  RNA Oligomer
caccuucagacauuaagccagac

SEQ ID NO: 32578 - RNA, 23 nt, Artificial Sequence
  RNA Oligomer
ccaccuucagacauuaagccaga

SEQ ID NO: 32579 - RNA, 23 nt, Artificial Sequence
  RNA Oligomer
acuaaucagccaccuucagacau

SEQ ID NO: 32580 - RNA, 23 nt, Artificial Sequence
  RNA Oligomer
ccaccuccuguuccuacaaaacc

SEQ ID NO: 32581 - RNA, 23 nt, Artificial Sequence
  RNA Oligomer
cugcuucacaaacuaaaggcucu

SEQ ID NO: 32582 - RNA, 23 nt, Artificial Sequence
  RNA Oligomer
gcugcuucacaaacuaaaggcuc

SEQ ID NO: 32583 - RNA, 23 nt, Artificial Sequence
  RNA Oligomer
agaaauagcugagaaucaggaag

SEQ ID NO: 32584 - RNA, 23 nt, Artificial Sequence
  RNA Oligomer
aaagaaauagcugagaaucagga

SEQ ID NO: 32585 - RNA, 23 nt, Artificial Sequence
  RNA Oligomer
cgacaacagcaacaaguugcuga

SEQ ID NO: 32586 - RNA, 23 nt, Artificial Sequence
  RNA Oligomer
caagaucagcgacaacagcaaca

SEQ ID NO: 32587 - RNA, 23 nt, Artificial Sequence
  RNA Oligomer
gcaacaauugcuggcaacuaagg

SEQ ID NO: 32588 - RNA, 23 nt, Artificial Sequence
  RNA Oligomer
gcgccuuaaugauaaggagggau

SEQ ID NO: 32589 - RNA, 23 nt, Artificial Sequence
  RNA Oligomer
gaaugaugaugagcugcccauga

SEQ ID NO: 32590 - RNA, 23 nt, Artificial Sequence
  RNA Oligomer
auagugauggauggacuccauua

SEQ ID NO: 32591 - RNA, 23 nt, Artificial Sequence
  RNA Oligomer
cagaaaucguuaaguuccuggua

SEQ ID NO: 32592 - RNA, 23 nt, Artificial Sequence
  RNA Oligomer
agaauaacccagaagaaccaaau

SEQ ID NO: 32593 - RNA, 23 nt, Artificial Sequence
  RNA Oligomer
cagaggguccuaaugggccaaau

SEQ ID NO: 32594 - RNA, 23 nt, Artificial Sequence
  RNA Oligomer
cguaguucuauuacagagccaga

SEQ ID NO: 32595 - RNA, 23 nt, Artificial Sequence
  RNA Oligomer
acgaaagaaacugucuaacgcac

SEQ ID NO: 32596 - RNA, 23 nt, Artificial Sequence
  RNA Oligomer
auguuugauguucuucaacgauu

SEQ ID NO: 32597 - RNA, 23 nt, Artificial Sequence
  RNA Oligomer
ucaguucaggagaaccaugaaaa

SEQ ID NO: 32598 - RNA, 23 nt, Artificial Sequence
  RNA Oligomer
caaguguauaugguaagccugua

SEQ ID NO: 32599 - RNA, 23 nt, Artificial Sequence
  RNA Oligomer
cgccaggaaaaaacuuccagcag

SEQ ID NO: 32600 - RNA, 23 nt, Artificial Sequence
  RNA Oligomer
agagugcugcuaucucccagcau

SEQ ID NO: 32601 - RNA, 23 nt, Artificial Sequence
  RNA Oligomer
gacauuaagccagacggaaguuc

SEQ ID NO: 32602 - RNA, 23 nt, Artificial Sequence
  RNA Oligomer
ccuguuccuacaaaaccaaaaca

SEQ ID NO: 32603 - RNA, 23 nt, Artificial Sequence
  RNA Oligomer
cuccuguuccuacaaaaccaaaa

SEQ ID NO: 32604 - RNA, 23 nt, Artificial Sequence
  RNA Oligomer
accuccuguuccuacaaaaccaa

SEQ ID NO: 32605 - RNA, 23 nt, Artificial Sequence
  RNA Oligomer
caaagaacccggcgagagugauu

SEQ ID NO: 32606 - RNA, 23 nt, Artificial Sequence
  RNA Oligomer
ccggaugguuccuuggucauuca

SEQ ID NO: 32607 - RNA, 23 nt, Artificial Sequence
  RNA Oligomer
cccuauauccagucgucuacuau

SEQ ID NO: 32608 - RNA, 23 nt, Artificial Sequence
  RNA Oligomer
ucccuauauccagucgucuacua

SEQ ID NO: 32609 - RNA, 23 nt, Artificial Sequence
  RNA Oligomer
uguggcugcaguaggucccuaua

SEQ ID NO: 32610 - RNA, 23 nt, Artificial Sequence
  RNA Oligomer
agaugcucaagaacggcaggauc

SEQ ID NO: 32611 - RNA, 23 nt, Artificial Sequence
  RNA Oligomer
agagaugcucaagaacggcagga

SEQ ID NO: 32612 - RNA, 23 nt, Artificial Sequence
  RNA Oligomer
cagcaacaaguugcugagcagga

SEQ ID NO: 32613 - RNA, 23 nt, Artificial Sequence
  RNA Oligomer
uggcaacuaaggaacagcgcuua

SEQ ID NO: 32614 - RNA, 23 nt, Artificial Sequence
  RNA Oligomer
ucauagcugacuuuaaaaacagu

SEQ ID NO: 32615 - RNA, 23 nt, Artificial Sequence
  RNA Oligomer
ugucaagaucauagcugacuuua

SEQ ID NO: 32616 - RNA, 23 nt, Artificial Sequence
  RNA Oligomer
guauacagcgacaauccuguuuu

SEQ ID NO: 32617 - RNA, 23 nt, Artificial Sequence
  RNA Oligomer
guagcuugaaagcgaugaagaau

SEQ ID NO: 32618 - RNA, 23 nt, Artificial Sequence
  RNA Oligomer
uguagcuugaaagcgaugaagaa

SEQ ID NO: 32619 - RNA, 23 nt, Artificial Sequence
  RNA Oligomer
gaaccucagaaugaugaugagcu

SEQ ID NO: 32620 - RNA, 23 nt, Artificial Sequence
  RNA Oligomer
ugauggauggacuccauuacauu

SEQ ID NO: 32621 - RNA, 23 nt, Artificial Sequence
  RNA Oligomer
cucagagcguaucgcucauggaa

SEQ ID NO: 32622 - RNA, 23 nt, Artificial Sequence
  RNA Oligomer
ccauauuuacauguggagcccga

SEQ ID NO: 32623 - RNA, 23 nt, Artificial Sequence
  RNA Oligomer
uucaguucaggagaaccaugaaa

SEQ ID NO: 32624 - RNA, 23 nt, Artificial Sequence
  RNA Oligomer
gcaguccagaaccugaaacagag

SEQ ID NO: 32625 - RNA, 23 nt, Artificial Sequence
  RNA Oligomer
cacuuuucaaguguauaugguaa

SEQ ID NO: 32626 - RNA, 23 nt, Artificial Sequence
  RNA Oligomer
agccuuccaaagacaccuuacuu

SEQ ID NO: 32627 - RNA, 23 nt, Artificial Sequence
  RNA Oligomer
acccuuucuccagguucuaagca

SEQ ID NO: 32628 - RNA, 23 nt, Artificial Sequence
  RNA Oligomer
caagagcagaaugccaagcuaca

SEQ ID NO: 32629 - RNA, 23 nt, Artificial Sequence
  RNA Oligomer
accaggcagcuagagaugcucaa

SEQ ID NO: 32630 - RNA, 23 nt, Artificial Sequence
  RNA Oligomer
cucguccuggcugugucaaaagu

SEQ ID NO: 32631 - RNA, 23 nt, Artificial Sequence
  RNA Oligomer
agcaaaaacagagggagcucguc

SEQ ID NO: 32632 - RNA, 23 nt, Artificial Sequence
  RNA Oligomer
gcagcacuucacagaaguuccag

SEQ ID NO: 32633 - RNA, 23 nt, Artificial Sequence
  RNA Oligomer
gcacuuaaaggccacguggaaca

SEQ ID NO: 32634 - RNA, 23 nt, Artificial Sequence
  RNA Oligomer
ccgucacaucgcugucucugauu

SEQ ID NO: 32635 - RNA, 23 nt, Artificial Sequence
  RNA Oligomer
agaaaggaccagugccgucacau

SEQ ID NO: 32636 - RNA, 23 nt, Artificial Sequence
  RNA Oligomer
guguagcacucagauaaguauac

SEQ ID NO: 32637 - RNA, 23 nt, Artificial Sequence
  RNA Oligomer
gaaauaaagcaucuacgucagca

SEQ ID NO: 32638 - RNA, 23 nt, Artificial Sequence
  RNA Oligomer
agaaugucucuagaagagaauga

SEQ ID NO: 32639 - RNA, 23 nt, Artificial Sequence
  RNA Oligomer
gaagaaugucucuagaagagaau

SEQ ID NO: 32640 - RNA, 23 nt, Artificial Sequence
  RNA Oligomer
cuuugggauuaugaaccucagaa

SEQ ID NO: 32641 - RNA, 23 nt, Artificial Sequence
  RNA Oligomer
gcuuugggauuaugaaccucaga

SEQ ID NO: 32642 - RNA, 23 nt, Artificial Sequence
  RNA Oligomer
cacucagugcucccaauuucuuu

SEQ ID NO: 32643 - RNA, 23 nt, Artificial Sequence
  RNA Oligomer
gaaauggaggaaggcuacacuca

SEQ ID NO: 32644 - RNA, 23 nt, Artificial Sequence
  RNA Oligomer
gaccuacagugacaugcagacug

SEQ ID NO: 32645 - RNA, 23 nt, Artificial Sequence
  RNA Oligomer
acagaaaucguuaaguuccuggu

SEQ ID NO: 32646 - RNA, 23 nt, Artificial Sequence
  RNA Oligomer
ucgcuucuuccuucgucaugaac

SEQ ID NO: 32647 - RNA, 23 nt, Artificial Sequence
  RNA Oligomer
agauucgucuuuggagggagaau

SEQ ID NO: 32648 - RNA, 23 nt, Artificial Sequence
  RNA Oligomer
ccagaauaacccagaagaaccaa

SEQ ID NO: 32649 - RNA, 23 nt, Artificial Sequence
  RNA Oligomer
ucuaacgcaccaaggccucuaaa

SEQ ID NO: 32650 - RNA, 23 nt, Artificial Sequence
  RNA Oligomer
ugaugcugaccuagaagccuuac

SEQ ID NO: 32651 - RNA, 23 nt, Artificial Sequence
  RNA Oligomer
aauguuugauguucuucaacgau

SEQ ID NO: 32652 - RNA, 23 nt, Artificial Sequence
  RNA Oligomer
gccacucagcccaacuaaauuac

SEQ ID NO: 32653 - RNA, 23 nt, Artificial Sequence
  RNA Oligomer
cuguaauugcugcugcccagaau

SEQ ID NO: 32654 - RNA, 23 nt, Artificial Sequence
  RNA Oligomer
gccacacuuuucaaguguauaug

SEQ ID NO: 32655 - RNA, 23 nt, Artificial Sequence
  RNA Oligomer
agggccacacuuuucaaguguau

SEQ ID NO: 32656 - RNA, 23 nt, Artificial Sequence
  RNA Oligomer
gcgccaggaaaaaacuuccagca

SEQ ID NO: 32657 - RNA, 23 nt, Artificial Sequence
  RNA Oligomer
cagcaggcgccaggaaaaaacuu

SEQ ID NO: 32658 - RNA, 23 nt, Artificial Sequence
  RNA Oligomer
ccagacccuuucuccagguucua

SEQ ID NO: 32659 - RNA, 23 nt, Artificial Sequence
  RNA Oligomer
cguccaugggaacuaaaccaaaa

SEQ ID NO: 32660 - RNA, 23 nt, Artificial Sequence
  RNA Oligomer
ugcgggaugcucagguugcaaau

SEQ ID NO: 32661 - RNA, 23 nt, Artificial Sequence
  RNA Oligomer
agagugauugccauuuggcugaa

SEQ ID NO: 32662 - RNA, 23 nt, Artificial Sequence
  RNA Oligomer
uggcccugauuggaguccuucaa

SEQ ID NO: 32663 - RNA, 23 nt, Artificial Sequence
  RNA Oligomer
caaacuaaaggcucuaaaaucca

SEQ ID NO: 32664 - RNA, 23 nt, Artificial Sequence
  RNA Oligomer
ugguuccuuggucauucaggcuu

SEQ ID NO: 32665 - RNA, 23 nt, Artificial Sequence
  RNA Oligomer
cggaugguuccuuggucauucag

SEQ ID NO: 32666 - RNA, 23 nt, Artificial Sequence
  RNA Oligomer
ugccggaugguuccuuggucauu

SEQ ID NO: 32667 - RNA, 23 nt, Artificial Sequence
  RNA Oligomer
agcagaaugccaagcuacaacaa

SEQ ID NO: 32668 - RNA, 23 nt, Artificial Sequence
  RNA Oligomer
ccucuauaaggagcugcagcuaa

SEQ ID NO: 32669 - RNA, 23 nt, Artificial Sequence
  RNA Oligomer
ugagcagcacuucacagaaguuc

SEQ ID NO: 32670 - RNA, 23 nt, Artificial Sequence
  RNA Oligomer
agacuaagcaaugggaaacuugu

SEQ ID NO: 32671 - RNA, 23 nt, Artificial Sequence
  RNA Oligomer
ugagagcacuuaaaggccacgug

SEQ ID NO: 32672 - RNA, 23 nt, Artificial Sequence
  RNA Oligomer
gcaacaaguugcugagcaggaga

SEQ ID NO: 32673 - RNA, 23 nt, Artificial Sequence
  RNA Oligomer
cugacucuugcugaacuucagga

SEQ ID NO: 32674 - RNA, 23 nt, Artificial Sequence
  RNA Oligomer
gcuacagacuuacccguaauauu

SEQ ID NO: 32675 - RNA, 23 nt, Artificial Sequence
  RNA Oligomer
gaacuguuaguugguugucagug

SEQ ID NO: 32676 - RNA, 23 nt, Artificial Sequence
  RNA Oligomer
guagcacucagauaaguauacag

SEQ ID NO: 32677 - RNA, 23 nt, Artificial Sequence
  RNA Oligomer
gccugaaacuuccacacagaauu

SEQ ID NO: 32678 - RNA, 23 nt, Artificial Sequence
  RNA Oligomer
aaggagggauauguuccacguaa

SEQ ID NO: 32679 - RNA, 23 nt, Artificial Sequence
  RNA Oligomer
uaaggagggauauguuccacgua

SEQ ID NO: 32680 - RNA, 23 nt, Artificial Sequence
  RNA Oligomer
cuacagugacaugcagacugcug

SEQ ID NO: 32681 - RNA, 23 nt, Artificial Sequence
  RNA Oligomer
agaaaucguuaaguuccugguac

SEQ ID NO: 32682 - RNA, 23 nt, Artificial Sequence
  RNA Oligomer
gcaucacggcucuucacaaugcu

SEQ ID NO: 32683 - RNA, 23 nt, Artificial Sequence
  RNA Oligomer
aaguucgcuucuuccuucgucau

SEQ ID NO: 32684 - RNA, 23 nt, Artificial Sequence
  RNA Oligomer
cgaaguucgcuucuuccuucguc

SEQ ID NO: 32685 - RNA, 23 nt, Artificial Sequence
  RNA Oligomer
ggucucucugccuccugguaaaa

SEQ ID NO: 32686 - RNA, 23 nt, Artificial Sequence
  RNA Oligomer
caguagaaauccagaauccauau

SEQ ID NO: 32687 - RNA, 23 nt, Artificial Sequence
  RNA Oligomer
gaaagcccaguagaaauccagaa

SEQ ID NO: 32688 - RNA, 23 nt, Artificial Sequence
  RNA Oligomer
ggguccuaaugggccaaauauuc

SEQ ID NO: 32689 - RNA, 23 nt, Artificial Sequence
  RNA Oligomer
cuaacgcaccaaggccucuaaag

SEQ ID NO: 32690 - RNA, 23 nt, Artificial Sequence
  RNA Oligomer
gucuaacgcaccaaggccucuaa

SEQ ID NO: 32691 - RNA, 23 nt, Artificial Sequence
  RNA Oligomer
guuugauguucuucaacgauuug

SEQ ID NO: 32692 - RNA, 23 nt, Artificial Sequence
  RNA Oligomer
gugaugcugaccuagaagccuua

SEQ ID NO: 32693 - RNA, 23 nt, Artificial Sequence
  RNA Oligomer
gaaaccagagugaugcugaccua

SEQ ID NO: 32694 - RNA, 23 nt, Artificial Sequence
  RNA Oligomer
ccuguuucuucaguucaggagaa

SEQ ID NO: 32695 - RNA, 23 nt, Artificial Sequence
  RNA Oligomer
ccagaaccugaaacagagccugu

SEQ ID NO: 32696 - RNA, 23 nt, Artificial Sequence
  RNA Oligomer
acucauaccagagggccacacuu

SEQ ID NO: 32697 - RNA, 23 nt, Artificial Sequence
  RNA Oligomer
cagacccuuucuccagguucuaa

SEQ ID NO: 32698 - RNA, 23 nt, Artificial Sequence
  RNA Oligomer
uccguccaugggaacuaaaccaa

SEQ ID NO: 32699 - RNA, 23 nt, Artificial Sequence
  RNA Oligomer
ggacaaacuaaucagccaccuuc

SEQ ID NO: 32700 - RNA, 23 nt, Artificial Sequence
  RNA Oligomer
uugcgggaugcucagguugcaaa

SEQ ID NO: 32701 - RNA, 23 nt, Artificial Sequence
  RNA Oligomer
ugcuucacaaacuaaaggcucua

SEQ ID NO: 32702 - RNA, 23 nt, Artificial Sequence
  RNA Oligomer
agagacuaagcaaugggaaacuu

SEQ ID NO: 32703 - RNA, 23 nt, Artificial Sequence
  RNA Oligomer
gagcacuuaaaggccacguggaa

SEQ ID NO: 32704 - RNA, 23 nt, Artificial Sequence
  RNA Oligomer
aguugcugagcaggagaaacuua

SEQ ID NO: 32705 - RNA, 23 nt, Artificial Sequence
  RNA Oligomer
cucucuguccuguugaguguuuu

SEQ ID NO: 32706 - RNA, 23 nt, Artificial Sequence
  RNA Oligomer
ggaaaucagcucucuguccuguu

SEQ ID NO: 32707 - RNA, 23 nt, Artificial Sequence
  RNA Oligomer
ucccguguagcacucagauaagu

SEQ ID NO: 32708 - RNA, 23 nt, Artificial Sequence
  RNA Oligomer
ccaaguuuaaaaagaaauggugu

SEQ ID NO: 32709 - RNA, 23 nt, Artificial Sequence
  RNA Oligomer
gugauggauggacuccauuacau

SEQ ID NO: 32710 - RNA, 23 nt, Artificial Sequence
  RNA Oligomer
gcuugauguguaccuggaggagu

SEQ ID NO: 32711 - RNA, 23 nt, Artificial Sequence
  RNA Oligomer
ccaaggccucuaaagaaacguag

SEQ ID NO: 32712 - RNA, 23 nt, Artificial Sequence
  RNA Oligomer
accaaggccucuaaagaaacgua

SEQ ID NO: 32713 - RNA, 23 nt, Artificial Sequence
  RNA Oligomer
gaccuagaagccuuacgaaagaa

SEQ ID NO: 32714 - RNA, 23 nt, Artificial Sequence
  RNA Oligomer
ucaaguguauaugguaagccugu

SEQ ID NO: 32715 - RNA, 23 nt, Artificial Sequence
  RNA Oligomer
acacuuuucaaguguauauggua

SEQ ID NO: 32716 - RNA, 23 nt, Artificial Sequence
  RNA Oligomer
ccacacuuuucaaguguauaugg

SEQ ID NO: 32717 - RNA, 23 nt, Artificial Sequence
  RNA Oligomer
gagggccacacuuuucaagugua

SEQ ID NO: 32718 - RNA, 23 nt, Artificial Sequence
  RNA Oligomer
gccaggaaaaaacuuccagcagg

SEQ ID NO: 32719 - RNA, 23 nt, Artificial Sequence
  RNA Oligomer
gccaccuucagacauuaagccag

SEQ ID NO: 32720 - RNA, 23 nt, Artificial Sequence
  RNA Oligomer
guaccaccuccuguuccuacaaa

SEQ ID NO: 32721 - RNA, 23 nt, Artificial Sequence
  RNA Oligomer
ggcuaaaguaccaccuccuguuc

SEQ ID NO: 32722 - RNA, 23 nt, Artificial Sequence
  RNA Oligomer
agcagugaagauaucuugcggga

SEQ ID NO: 32723 - RNA, 23 nt, Artificial Sequence
  RNA Oligomer
agaaguuccaguuacuccagaaa

SEQ ID NO: 32724 - RNA, 23 nt, Artificial Sequence
  RNA Oligomer
gccucuauaaggagcugcagcua

SEQ ID NO: 32725 - RNA, 23 nt, Artificial Sequence
  RNA Oligomer
gacaaucagucugcaguggcuga

SEQ ID NO: 32726 - RNA, 23 nt, Artificial Sequence
  RNA Oligomer
agcacuucacagaaguuccaguu

SEQ ID NO: 32727 - RNA, 23 nt, Artificial Sequence
  RNA Oligomer
caaugagcagcacuucacagaag

SEQ ID NO: 32728 - RNA, 23 nt, Artificial Sequence
  RNA Oligomer
acaaugagcagcacuucacagaa

SEQ ID NO: 32729 - RNA, 23 nt, Artificial Sequence
  RNA Oligomer
cgucacaucgcugucucugauug

SEQ ID NO: 32730 - RNA, 23 nt, Artificial Sequence
  RNA Oligomer
gggaaaucagcucucuguccugu

SEQ ID NO: 32731 - RNA, 23 nt, Artificial Sequence
  RNA Oligomer
acaauccuguuuucuacaagaau

SEQ ID NO: 32732 - RNA, 23 nt, Artificial Sequence
  RNA Oligomer
ugaagaaugucucuagaagagaa

SEQ ID NO: 32733 - RNA, 23 nt, Artificial Sequence
  RNA Oligomer
guuucuuaccguguaucucagua

SEQ ID NO: 32734 - RNA, 23 nt, Artificial Sequence
  RNA Oligomer
caagacaaaggagcuuggccuga

SEQ ID NO: 32735 - RNA, 23 nt, Artificial Sequence
  RNA Oligomer
ccauuacauugugcugccucaug

SEQ ID NO: 32736 - RNA, 23 nt, Artificial Sequence
  RNA Oligomer
cgcuucuuccuucgucaugaacg

SEQ ID NO: 32737 - RNA, 23 nt, Artificial Sequence
  RNA Oligomer
gaaggcaucacggcucuucacaa

SEQ ID NO: 32738 - RNA, 23 nt, Artificial Sequence
  RNA Oligomer
acgaaguucgcuucuuccuucgu

SEQ ID NO: 32739 - RNA, 23 nt, Artificial Sequence
  RNA Oligomer
ugcuuuacugcuagauucgucuu

SEQ ID NO: 32740 - RNA, 23 nt, Artificial Sequence
  RNA Oligomer
ggaacgaaguucgcuucuuccuu

SEQ ID NO: 32741 - RNA, 23 nt, Artificial Sequence
  RNA Oligomer
aggucucucugccuccugguaaa

SEQ ID NO: 32742 - RNA, 23 nt, Artificial Sequence
  RNA Oligomer
gguccuaaugggccaaauauuca

SEQ ID NO: 32743 - RNA, 23 nt, Artificial Sequence
  RNA Oligomer
acgcaccaaggccucuaaagaaa

SEQ ID NO: 32744 - RNA, 23 nt, Artificial Sequence
  RNA Oligomer
aggaaaaaacuuccagcaggcug

SEQ ID NO: 32745 - RNA, 23 nt, Artificial Sequence
  RNA Oligomer
agguucuaagcaagaaaguccac

SEQ ID NO: 32746 - RNA, 23 nt, Artificial Sequence
  RNA Oligomer
uggacaaacuaaucagccaccuu

SEQ ID NO: 32747 - RNA, 23 nt, Artificial Sequence
  RNA Oligomer
acagaaguuccaguuacuccaga

SEQ ID NO: 32748 - RNA, 23 nt, Artificial Sequence
  RNA Oligomer
cagcacuucacagaaguuccagu

SEQ ID NO: 32749 - RNA, 23 nt, Artificial Sequence
  RNA Oligomer
gaacagaugaauaauuuguucca

SEQ ID NO: 32750 - RNA, 23 nt, Artificial Sequence
  RNA Oligomer
caauugcuggcaacuaaggaaca

SEQ ID NO: 32751 - RNA, 23 nt, Artificial Sequence
  RNA Oligomer
gacucuugcugaacuucaggaaa

SEQ ID NO: 32752 - RNA, 23 nt, Artificial Sequence
  RNA Oligomer
uccuguuuucuacaagaauccug

SEQ ID NO: 32753 - RNA, 23 nt, Artificial Sequence
  RNA Oligomer
cugaaacuuccacacagaauuuu

SEQ ID NO: 32754 - RNA, 23 nt, Artificial Sequence
  RNA Oligomer
guggaccaagaucucaggaucca

SEQ ID NO: 32755 - RNA, 23 nt, Artificial Sequence
  RNA Oligomer
aagauucuacaucuaauuacugg

SEQ ID NO: 32756 - RNA, 23 nt, Artificial Sequence
  RNA Oligomer
agauucuacaucuaauuacuggu

SEQ ID NO: 32757 - RNA, 23 nt, Artificial Sequence
  RNA Oligomer
gauucuacaucuaauuacuggua

SEQ ID NO: 32758 - RNA, 23 nt, Artificial Sequence
  RNA Oligomer
auucuacaucuaauuacugguac

SEQ ID NO: 32759 - RNA, 23 nt, Artificial Sequence
  RNA Oligomer
uucuacaucuaauuacugguacc

SEQ ID NO: 32760 - RNA, 23 nt, Artificial Sequence
  RNA Oligomer
cuuugucuugguuuaauucuugg

SEQ ID NO: 32761 - RNA, 23 nt, Artificial Sequence
  RNA Oligomer
uuugucuugguuuaauucuuggg

SEQ ID NO: 32762 - RNA, 23 nt, Artificial Sequence
  RNA Oligomer
uugucuugguuuaauucuugggu

SEQ ID NO: 32763 - RNA, 23 nt, Artificial Sequence
  RNA Oligomer
ugucuugguuuaauucuugggua

SEQ ID NO: 32764 - RNA, 23 nt, Artificial Sequence
  RNA Oligomer
gucuugguuuaauucuuggguac

SEQ ID NO: 32765 - RNA, 23 nt, Artificial Sequence
  RNA Oligomer
ucuugguuuaauucuuggguaca

SEQ ID NO: 32766 - RNA, 23 nt, Artificial Sequence
  RNA Oligomer
cauuucuuuuuaaacuuggaucc

SEQ ID NO: 32767 - RNA, 23 nt, Artificial Sequence
  RNA Oligomer
auuucuuuuuaaacuuggauccu

SEQ ID NO: 32768 - RNA, 23 nt, Artificial Sequence
  RNA Oligomer
uuucuuuuuaaacuuggauccug

SEQ ID NO: 32769 - RNA, 23 nt, Artificial Sequence
  RNA Oligomer
uucuuuuuaaacuuggauccuga

SEQ ID NO: 32770 - RNA, 23 nt, Artificial Sequence
  RNA Oligomer
ucuuuuuaaacuuggauccugag

SEQ ID NO: 32771 - RNA, 23 nt, Artificial Sequence
  RNA Oligomer
ccuuugucuugguuuaauucuug

SEQ ID NO: 32772 - RNA, 23 nt, Artificial Sequence
  RNA Oligomer
aagaaaggcaguaauuuaguugg

SEQ ID NO: 32773 - RNA, 23 nt, Artificial Sequence
  RNA Oligomer
agaaaggcaguaauuuaguuggg

SEQ ID NO: 32774 - RNA, 23 nt, Artificial Sequence
  RNA Oligomer
gaaaggcaguaauuuaguugggc

SEQ ID NO: 32775 - RNA, 23 nt, Artificial Sequence
  RNA Oligomer
aaaggcaguaauuuaguugggcu

SEQ ID NO: 32776 - RNA, 23 nt, Artificial Sequence
  RNA Oligomer
aaggcaguaauuuaguugggcug

SEQ ID NO: 32777 - RNA, 23 nt, Artificial Sequence
  RNA Oligomer
ucuaauggugaauucuucaaucc

SEQ ID NO: 32778 - RNA, 23 nt, Artificial Sequence
  RNA Oligomer
cuaauggugaauucuucaauccu

SEQ ID NO: 32779 - RNA, 23 nt, Artificial Sequence
  RNA Oligomer
uaauggugaauucuucaauccuu

SEQ ID NO: 32780 - RNA, 23 nt, Artificial Sequence
  RNA Oligomer
aauggugaauucuucaauccuuc

SEQ ID NO: 32781 - RNA, 23 nt, Artificial Sequence
  RNA Oligomer
auggugaauucuucaauccuuca

SEQ ID NO: 32782 - RNA, 23 nt, Artificial Sequence
  RNA Oligomer
gguuuaauucuuggguacagucc

SEQ ID NO: 32783 - RNA, 23 nt, Artificial Sequence
  RNA Oligomer
guuuaauucuuggguacaguccc

SEQ ID NO: 32784 - RNA, 23 nt, Artificial Sequence
  RNA Oligomer
uuuaauucuuggguacaguccca

SEQ ID NO: 32785 - RNA, 23 nt, Artificial Sequence
  RNA Oligomer
uuaauucuuggguacagucccag

SEQ ID NO: 32786 - RNA, 23 nt, Artificial Sequence
  RNA Oligomer
uaauucuuggguacagucccagc

SEQ ID NO: 32787 - RNA, 23 nt, Artificial Sequence
  RNA Oligomer
uuucaucuucgucuucccugugg

SEQ ID NO: 32788 - RNA, 23 nt, Artificial Sequence
  RNA Oligomer
uucaucuucgucuucccugugga

SEQ ID NO: 32789 - RNA, 23 nt, Artificial Sequence
  RNA Oligomer
ucaucuucgucuucccuguggau

SEQ ID NO: 32790 - RNA, 23 nt, Artificial Sequence
  RNA Oligomer
caucuucgucuucccuguggaug

SEQ ID NO: 32791 - RNA, 23 nt, Artificial Sequence
  RNA Oligomer
aucuucgucuucccuguggauga

SEQ ID NO: 32792 - RNA, 23 nt, Artificial Sequence
  RNA Oligomer
ugacuuggauggguaugauggga

SEQ ID NO: 32793 - RNA, 23 nt, Artificial Sequence
  RNA Oligomer
gacuuggauggguaugaugggac

SEQ ID NO: 32794 - RNA, 23 nt, Artificial Sequence
  RNA Oligomer
acuuggauggguaugaugggaca

SEQ ID NO: 32795 - RNA, 23 nt, Artificial Sequence
  RNA Oligomer
cuuggauggguaugaugggacag

SEQ ID NO: 32796 - RNA, 23 nt, Artificial Sequence
  RNA Oligomer
uuggauggguaugaugggacaga

SEQ ID NO: 32797 - RNA, 23 nt, Artificial Sequence
  RNA Oligomer
cugguaugagucuuggucaacgc

SEQ ID NO: 32798 - RNA, 23 nt, Artificial Sequence
  RNA Oligomer
ugguaugagucuuggucaacgcg

SEQ ID NO: 32799 - RNA, 23 nt, Artificial Sequence
  RNA Oligomer
gguaugagucuuggucaacgcgc

SEQ ID NO: 32800 - RNA, 23 nt, Artificial Sequence
  RNA Oligomer
guaugagucuuggucaacgcgcu

SEQ ID NO: 32801 - RNA, 23 nt, Artificial Sequence
  RNA Oligomer
uaugagucuuggucaacgcgcuc

SEQ ID NO: 32802 - RNA, 23 nt, Artificial Sequence
  RNA Oligomer
ucugaaggguggaaguaaggugu

SEQ ID NO: 32803 - RNA, 23 nt, Artificial Sequence
  RNA Oligomer
cugaaggguggaaguaagguguc

SEQ ID NO: 32804 - RNA, 23 nt, Artificial Sequence
  RNA Oligomer
ugaaggguggaaguaaggugucu

SEQ ID NO: 32805 - RNA, 23 nt, Artificial Sequence
  RNA Oligomer
gaaggguggaaguaaggugucuu

SEQ ID NO: 32806 - RNA, 23 nt, Artificial Sequence
  RNA Oligomer
aaggguggaaguaaggugucuuu

SEQ ID NO: 32807 - RNA, 23 nt, Artificial Sequence
  RNA Oligomer
ucuacaucuaauuacugguaccg

SEQ ID NO: 32808 - RNA, 23 nt, Artificial Sequence
  RNA Oligomer
cuacaucuaauuacugguaccgu

SEQ ID NO: 32809 - RNA, 23 nt, Artificial Sequence
  RNA Oligomer
uacaucuaauuacugguaccgua

SEQ ID NO: 32810 - RNA, 23 nt, Artificial Sequence
  RNA Oligomer
uuucuucucuuucucccucagcg

SEQ ID NO: 32811 - RNA, 23 nt, Artificial Sequence
  RNA Oligomer
uucuucucuuucucccucagcgg

SEQ ID NO: 32812 - RNA, 23 nt, Artificial Sequence
  RNA Oligomer
ucuucucuuucucccucagcgga

SEQ ID NO: 32813 - RNA, 23 nt, Artificial Sequence
  RNA Oligomer
cuucucuuucucccucagcggaa

SEQ ID NO: 32814 - RNA, 23 nt, Artificial Sequence
  RNA Oligomer
uucucuuucucccucagcggaac

SEQ ID NO: 32815 - RNA, 23 nt, Artificial Sequence
  RNA Oligomer
gaaguucagcaagagucagaucc

SEQ ID NO: 32816 - RNA, 23 nt, Artificial Sequence
  RNA Oligomer
aaguucagcaagagucagaucca

SEQ ID NO: 32817 - RNA, 23 nt, Artificial Sequence
  RNA Oligomer
aguucagcaagagucagauccau

SEQ ID NO: 32818 - RNA, 23 nt, Artificial Sequence
  RNA Oligomer
guucagcaagagucagauccauc

SEQ ID NO: 32819 - RNA, 23 nt, Artificial Sequence
  RNA Oligomer
uucagcaagagucagauccaucc

SEQ ID NO: 32820 - RNA, 23 nt, Artificial Sequence
  RNA Oligomer
aauaagucuugugaaauuuuugc

SEQ ID NO: 32821 - RNA, 23 nt, Artificial Sequence
  RNA Oligomer
auaagucuugugaaauuuuugcc

SEQ ID NO: 32822 - RNA, 23 nt, Artificial Sequence
  RNA Oligomer
uaagucuugugaaauuuuugcca

SEQ ID NO: 32823 - RNA, 23 nt, Artificial Sequence
  RNA Oligomer
aagucuugugaaauuuuugccaa

SEQ ID NO: 32824 - RNA, 23 nt, Artificial Sequence
  RNA Oligomer
agucuugugaaauuuuugccaaa

SEQ ID NO: 32825 - RNA, 23 nt, Artificial Sequence
  RNA Oligomer
gucuugugaaauuuuugccaaaa

SEQ ID NO: 32826 - RNA, 23 nt, Artificial Sequence
  RNA Oligomer
cuugguuuaauucuuggguacag

SEQ ID NO: 32827 - RNA, 23 nt, Artificial Sequence
  RNA Oligomer
uugguuuaauucuuggguacagu

SEQ ID NO: 32828 - RNA, 23 nt, Artificial Sequence
  RNA Oligomer
ugguuuaauucuuggguacaguc

SEQ ID NO: 32829 - RNA, 23 nt, Artificial Sequence
  RNA Oligomer
ucccaaagcgcauaaaugacucc

SEQ ID NO: 32830 - RNA, 23 nt, Artificial Sequence
  RNA Oligomer
cccaaagcgcauaaaugacuccu

SEQ ID NO: 32831 - RNA, 23 nt, Artificial Sequence
  RNA Oligomer
ccaaagcgcauaaaugacuccuu

SEQ ID NO: 32832 - RNA, 23 nt, Artificial Sequence
  RNA Oligomer
caaagcgcauaaaugacuccuuu

SEQ ID NO: 32833 - RNA, 23 nt, Artificial Sequence
  RNA Oligomer
aaagcgcauaaaugacuccuuua

SEQ ID NO: 32834 - RNA, 23 nt, Artificial Sequence
  RNA Oligomer
accaaaaacuuacacacuuggac

SEQ ID NO: 32835 - RNA, 23 nt, Artificial Sequence
  RNA Oligomer
ccaaaaacuuacacacuuggacg

SEQ ID NO: 32836 - RNA, 23 nt, Artificial Sequence
  RNA Oligomer
caaaaacuuacacacuuggacgu

SEQ ID NO: 32837 - RNA, 23 nt, Artificial Sequence
  RNA Oligomer
aaaaacuuacacacuuggacguu

SEQ ID NO: 32838 - RNA, 23 nt, Artificial Sequence
  RNA Oligomer
aaaacuuacacacuuggacguug

SEQ ID NO: 32839 - RNA, 23 nt, Artificial Sequence
  RNA Oligomer
ucuguacaaggucaaauucuccc

SEQ ID NO: 32840 - RNA, 23 nt, Artificial Sequence
  RNA Oligomer
cuguacaaggucaaauucucccu

SEQ ID NO: 32841 - RNA, 23 nt, Artificial Sequence
  RNA Oligomer
uguacaaggucaaauucucccuc

SEQ ID NO: 32842 - RNA, 23 nt, Artificial Sequence
  RNA Oligomer
guacaaggucaaauucucccucc

SEQ ID NO: 32843 - RNA, 23 nt, Artificial Sequence
  RNA Oligomer
uacaaggucaaauucucccucca

SEQ ID NO: 32844 - RNA, 23 nt, Artificial Sequence
  RNA Oligomer
gccaguuuuacgcaaguuugucc

SEQ ID NO: 32845 - RNA, 23 nt, Artificial Sequence
  RNA Oligomer
ccaguuuuacgcaaguuuguccu

SEQ ID NO: 32846 - RNA, 23 nt, Artificial Sequence
  RNA Oligomer
caguuuuacgcaaguuuguccuu

SEQ ID NO: 32847 - RNA, 23 nt, Artificial Sequence
  RNA Oligomer
aguuuuacgcaaguuuguccuuu

SEQ ID NO: 32848 - RNA, 23 nt, Artificial Sequence
  RNA Oligomer
guuuuacgcaaguuuguccuuuu

SEQ ID NO: 32849 - RNA, 23 nt, Artificial Sequence
  RNA Oligomer
gucacagaagcugacuuggaugg

SEQ ID NO: 32850 - RNA, 23 nt, Artificial Sequence
  RNA Oligomer
ucacagaagcugacuuggauggg

SEQ ID NO: 32851 - RNA, 23 nt, Artificial Sequence
  RNA Oligomer
cacagaagcugacuuggaugggu

SEQ ID NO: 32852 - RNA, 23 nt, Artificial Sequence
  RNA Oligomer
acagaagcugacuuggaugggua

SEQ ID NO: 32853 - RNA, 23 nt, Artificial Sequence
  RNA Oligomer
cagaagcugacuuggauggguau

SEQ ID NO: 32854 - RNA, 23 nt, Artificial Sequence
  RNA Oligomer
ccacuucugaauuacgcuuauuc

SEQ ID NO: 32855 - RNA, 23 nt, Artificial Sequence
  RNA Oligomer
cacuucugaauuacgcuuauuca

SEQ ID NO: 32856 - RNA, 23 nt, Artificial Sequence
  RNA Oligomer
acuucugaauuacgcuuauucaa

SEQ ID NO: 32857 - RNA, 23 nt, Artificial Sequence
  RNA Oligomer
cuucugaauuacgcuuauucaaa

SEQ ID NO: 32858 - RNA, 23 nt, Artificial Sequence
  RNA Oligomer
uucugaauuacgcuuauucaaac

SEQ ID NO: 32859 - RNA, 23 nt, Artificial Sequence
  RNA Oligomer
aauuauucaucuguucaauuucc

SEQ ID NO: 32860 - RNA, 23 nt, Artificial Sequence
  RNA Oligomer
auuauucaucuguucaauuuccu

SEQ ID NO: 32861 - RNA, 23 nt, Artificial Sequence
  RNA Oligomer
uuauucaucuguucaauuuccuc

SEQ ID NO: 32862 - RNA, 23 nt, Artificial Sequence
  RNA Oligomer
uauucaucuguucaauuuccucc

SEQ ID NO: 32863 - RNA, 23 nt, Artificial Sequence
  RNA Oligomer
auucaucuguucaauuuccucca

SEQ ID NO: 32864 - RNA, 23 nt, Artificial Sequence
  RNA Oligomer
uaggacuauuaacaccguucucc

SEQ ID NO: 32865 - RNA, 23 nt, Artificial Sequence
  RNA Oligomer
aggacuauuaacaccguucuccu

SEQ ID NO: 32866 - RNA, 23 nt, Artificial Sequence
  RNA Oligomer
ggacuauuaacaccguucuccuu

SEQ ID NO: 32867 - RNA, 23 nt, Artificial Sequence
  RNA Oligomer
gacuauuaacaccguucuccuuu

SEQ ID NO: 32868 - RNA, 23 nt, Artificial Sequence
  RNA Oligomer
acuauuaacaccguucuccuuuc

SEQ ID NO: 32869 - RNA, 23 nt, Artificial Sequence
  RNA Oligomer
cuauuaacaccguucuccuuucu

SEQ ID NO: 32870 - RNA, 23 nt, Artificial Sequence
  RNA Oligomer
uauuaacaccguucuccuuucuu

SEQ ID NO: 32871 - RNA, 23 nt, Artificial Sequence
  RNA Oligomer
auuaacaccguucuccuuucuuc

SEQ ID NO: 32872 - RNA, 23 nt, Artificial Sequence
  RNA Oligomer
uuaacaccguucuccuuucuucg

SEQ ID NO: 32873 - RNA, 23 nt, Artificial Sequence
  RNA Oligomer
cuaauuucugagauacaaaagac

SEQ ID NO: 32874 - RNA, 23 nt, Artificial Sequence
  RNA Oligomer
uaauuucugagauacaaaagaca

SEQ ID NO: 32875 - RNA, 23 nt, Artificial Sequence
  RNA Oligomer
aauuucugagauacaaaagacaa

SEQ ID NO: 32876 - RNA, 23 nt, Artificial Sequence
  RNA Oligomer
auuucugagauacaaaagacaau

SEQ ID NO: 32877 - RNA, 23 nt, Artificial Sequence
  RNA Oligomer
uuucugagauacaaaagacaaua

SEQ ID NO: 32878 - RNA, 23 nt, Artificial Sequence
  RNA Oligomer
auucgauuucaucuucgucuucc

SEQ ID NO: 32879 - RNA, 23 nt, Artificial Sequence
  RNA Oligomer
uucgauuucaucuucgucuuccc

SEQ ID NO: 32880 - RNA, 23 nt, Artificial Sequence
  RNA Oligomer
ucgauuucaucuucgucuucccu

SEQ ID NO: 32881 - RNA, 23 nt, Artificial Sequence
  RNA Oligomer
cgauuucaucuucgucuucccug

SEQ ID NO: 32882 - RNA, 23 nt, Artificial Sequence
  RNA Oligomer
gauuucaucuucgucuucccugu

SEQ ID NO: 32883 - RNA, 23 nt, Artificial Sequence
  RNA Oligomer
ccaccaaaaacuuacacacuugg

SEQ ID NO: 32884 - RNA, 23 nt, Artificial Sequence
  RNA Oligomer
caccaaaaacuuacacacuugga

SEQ ID NO: 32885 - RNA, 23 nt, Artificial Sequence
  RNA Oligomer
gaacuuaacgauuucuguguggc

SEQ ID NO: 32886 - RNA, 23 nt, Artificial Sequence
  RNA Oligomer
aacuuaacgauuucuguguggcc

SEQ ID NO: 32887 - RNA, 23 nt, Artificial Sequence
  RNA Oligomer
acuuaacgauuucuguguggccu

SEQ ID NO: 32888 - RNA, 23 nt, Artificial Sequence
  RNA Oligomer
cuuaacgauuucuguguggccug

SEQ ID NO: 32889 - RNA, 23 nt, Artificial Sequence
  RNA Oligomer
uuaacgauuucuguguggccugc

SEQ ID NO: 32890 - RNA, 23 nt, Artificial Sequence
  RNA Oligomer
acacaucaagcacauguggagcc

SEQ ID NO: 32891 - RNA, 23 nt, Artificial Sequence
  RNA Oligomer
cacaucaagcacauguggagccu

SEQ ID NO: 32892 - RNA, 23 nt, Artificial Sequence
  RNA Oligomer
acaucaagcacauguggagccuc

SEQ ID NO: 32893 - RNA, 23 nt, Artificial Sequence
  RNA Oligomer
caucaagcacauguggagccucu

SEQ ID NO: 32894 - RNA, 23 nt, Artificial Sequence
  RNA Oligomer
aucaagcacauguggagccucug

SEQ ID NO: 32895 - RNA, 23 nt, Artificial Sequence
  RNA Oligomer
cugacuuggauggguaugauggg

SEQ ID NO: 32896 - RNA, 23 nt, Artificial Sequence
  RNA Oligomer
uggauggguaugaugggacagag

SEQ ID NO: 32897 - RNA, 23 nt, Artificial Sequence
  RNA Oligomer
uggguaugaugggacagagaugg

SEQ ID NO: 32898 - RNA, 23 nt, Artificial Sequence
  RNA Oligomer
ggguaugaugggacagagauggu

SEQ ID NO: 32899 - RNA, 23 nt, Artificial Sequence
  RNA Oligomer
gguaugaugggacagagaugguc

SEQ ID NO: 32900 - RNA, 23 nt, Artificial Sequence
  RNA Oligomer
guaugaugggacagagauggucu

SEQ ID NO: 32901 - RNA, 23 nt, Artificial Sequence
  RNA Oligomer
uaugaugggacagagauggucuc

SEQ ID NO: 32902 - RNA, 23 nt, Artificial Sequence
  RNA Oligomer
uaagaaaggcaguaauuuaguug

SEQ ID NO: 32903 - RNA, 23 nt, Artificial Sequence
  RNA Oligomer
gaggaauucuuucguuuucaugg

SEQ ID NO: 32904 - RNA, 23 nt, Artificial Sequence
  RNA Oligomer
aggaauucuuucguuuucauggu

SEQ ID NO: 32905 - RNA, 23 nt, Artificial Sequence
  RNA Oligomer
ggaauucuuucguuuucaugguu

SEQ ID NO: 32906 - RNA, 23 nt, Artificial Sequence
  RNA Oligomer
gaauucuuucguuuucaugguuc

SEQ ID NO: 32907 - RNA, 23 nt, Artificial Sequence
  RNA Oligomer
aauucuuucguuuucaugguucu

SEQ ID NO: 32908 - RNA, 23 nt, Artificial Sequence
  RNA Oligomer
agccuuuaguuugugaagcagcc

SEQ ID NO: 32909 - RNA, 23 nt, Artificial Sequence
  RNA Oligomer
gccuuuaguuugugaagcagccc

SEQ ID NO: 32910 - RNA, 23 nt, Artificial Sequence
  RNA Oligomer
ccuuuaguuugugaagcagcccc

SEQ ID NO: 32911 - RNA, 23 nt, Artificial Sequence
  RNA Oligomer
cuuuaguuugugaagcagcccca

SEQ ID NO: 32912 - RNA, 23 nt, Artificial Sequence
  RNA Oligomer
uuuaguuugugaagcagccccag

SEQ ID NO: 32913 - RNA, 23 nt, Artificial Sequence
  RNA Oligomer
uagauuuucuuuuugcuguagag

SEQ ID NO: 32914 - RNA, 23 nt, Artificial Sequence
  RNA Oligomer
agauuuucuuuuugcuguagagc

SEQ ID NO: 32915 - RNA, 23 nt, Artificial Sequence
  RNA Oligomer
gauuuucuuuuugcuguagagcu

SEQ ID NO: 32916 - RNA, 23 nt, Artificial Sequence
  RNA Oligomer
auuuucuuuuugcuguagagcug

SEQ ID NO: 32917 - RNA, 23 nt, Artificial Sequence
  RNA Oligomer
uuuucuuuuugcuguagagcugc

SEQ ID NO: 32918 - RNA, 23 nt, Artificial Sequence
  RNA Oligomer
uaacaccguucuccuuucuucga

SEQ ID NO: 32919 - RNA, 23 nt, Artificial Sequence
  RNA Oligomer
uaaauacagauuaaaauucagcc

SEQ ID NO: 32920 - RNA, 23 nt, Artificial Sequence
  RNA Oligomer
aaauacagauuaaaauucagccu

SEQ ID NO: 32921 - RNA, 23 nt, Artificial Sequence
  RNA Oligomer
aauacagauuaaaauucagccua

SEQ ID NO: 32922 - RNA, 23 nt, Artificial Sequence
  RNA Oligomer
auacagauuaaaauucagccuac

SEQ ID NO: 32923 - RNA, 23 nt, Artificial Sequence
  RNA Oligomer
uacagauuaaaauucagccuaca

SEQ ID NO: 32924 - RNA, 23 nt, Artificial Sequence
  RNA Oligomer
gugaauucuucaauccuucauuc

SEQ ID NO: 32925 - RNA, 23 nt, Artificial Sequence
  RNA Oligomer
ugaauucuucaauccuucauucu

SEQ ID NO: 32926 - RNA, 23 nt, Artificial Sequence
  RNA Oligomer
gaauucuucaauccuucauucuc

SEQ ID NO: 32927 - RNA, 23 nt, Artificial Sequence
  RNA Oligomer
aauucuucaauccuucauucucu

SEQ ID NO: 32928 - RNA, 23 nt, Artificial Sequence
  RNA Oligomer
auucuucaauccuucauucucuu

SEQ ID NO: 32929 - RNA, 23 nt, Artificial Sequence
  RNA Oligomer
caucauucugagguucauaaucc

SEQ ID NO: 32930 - RNA, 23 nt, Artificial Sequence
  RNA Oligomer
aucauucugagguucauaauccc

SEQ ID NO: 32931 - RNA, 23 nt, Artificial Sequence
  RNA Oligomer
ucauucugagguucauaauccca

SEQ ID NO: 32932 - RNA, 23 nt, Artificial Sequence
  RNA Oligomer
cauucugagguucauaaucccaa

SEQ ID NO: 32933 - RNA, 23 nt, Artificial Sequence
  RNA Oligomer
auucugagguucauaaucccaaa

SEQ ID NO: 32934 - RNA, 23 nt, Artificial Sequence
  RNA Oligomer
aaugacuccuuuauucauuaugc

SEQ ID NO: 32935 - RNA, 23 nt, Artificial Sequence
  RNA Oligomer
augacuccuuuauucauuaugcc

SEQ ID NO: 32936 - RNA, 23 nt, Artificial Sequence
  RNA Oligomer
ugacuccuuuauucauuaugccc

SEQ ID NO: 32937 - RNA, 23 nt, Artificial Sequence
  RNA Oligomer
gacuccuuuauucauuaugccca

SEQ ID NO: 32938 - RNA, 23 nt, Artificial Sequence
  RNA Oligomer
acuccuuuauucauuaugcccau

SEQ ID NO: 32939 - RNA, 23 nt, Artificial Sequence
  RNA Oligomer
caggaacuuaacgauuucugugu

SEQ ID NO: 32940 - RNA, 23 nt, Artificial Sequence
  RNA Oligomer
aggaacuuaacgauuucugugug

SEQ ID NO: 32941 - RNA, 23 nt, Artificial Sequence
  RNA Oligomer
ggaacuuaacgauuucugugugg

SEQ ID NO: 32942 - RNA, 23 nt, Artificial Sequence
  RNA Oligomer
acaaggucaaauucucccuccaa

SEQ ID NO: 32943 - RNA, 23 nt, Artificial Sequence
  RNA Oligomer
caaggucaaauucucccuccaaa

SEQ ID NO: 32944 - RNA, 23 nt, Artificial Sequence
  RNA Oligomer
aaggucaaauucucccuccaaag

SEQ ID NO: 32945 - RNA, 23 nt, Artificial Sequence
  RNA Oligomer
agaagcugacuuggauggguaug

SEQ ID NO: 32946 - RNA, 23 nt, Artificial Sequence
  RNA Oligomer
guugaagaacaucaaacauucgc

SEQ ID NO: 32947 - RNA, 23 nt, Artificial Sequence
  RNA Oligomer
uugaagaacaucaaacauucgcu

SEQ ID NO: 32948 - RNA, 23 nt, Artificial Sequence
  RNA Oligomer
ugaagaacaucaaacauucgcuc

SEQ ID NO: 32949 - RNA, 23 nt, Artificial Sequence
  RNA Oligomer
gaagaacaucaaacauucgcuca

SEQ ID NO: 32950 - RNA, 23 nt, Artificial Sequence
  RNA Oligomer
aagaacaucaaacauucgcucau

SEQ ID NO: 32951 - RNA, 23 nt, Artificial Sequence
  RNA Oligomer
aggcaguaauuuaguugggcuga

SEQ ID NO: 32952 - RNA, 23 nt, Artificial Sequence
  RNA Oligomer
uucuuucguuuucaugguucucc

SEQ ID NO: 32953 - RNA, 23 nt, Artificial Sequence
  RNA Oligomer
ucuuucguuuucaugguucuccu

SEQ ID NO: 32954 - RNA, 23 nt, Artificial Sequence
  RNA Oligomer
cuuucguuuucaugguucuccug

SEQ ID NO: 32955 - RNA, 23 nt, Artificial Sequence
  RNA Oligomer
uuucguuuucaugguucuccuga

SEQ ID NO: 32956 - RNA, 23 nt, Artificial Sequence
  RNA Oligomer
uucguuuucaugguucuccugaa

SEQ ID NO: 32957 - RNA, 23 nt, Artificial Sequence
  RNA Oligomer
uggaauaaauguucucugggugc

SEQ ID NO: 32958 - RNA, 23 nt, Artificial Sequence
  RNA Oligomer
ggaauaaauguucucugggugcu

SEQ ID NO: 32959 - RNA, 23 nt, Artificial Sequence
  RNA Oligomer
gaauaaauguucucugggugcug

SEQ ID NO: 32960 - RNA, 23 nt, Artificial Sequence
  RNA Oligomer
aauaaauguucucugggugcugc

SEQ ID NO: 32961 - RNA, 23 nt, Artificial Sequence
  RNA Oligomer
auaaauguucucugggugcugcu

SEQ ID NO: 32962 - RNA, 23 nt, Artificial Sequence
  RNA Oligomer
uucugaaggguggaaguaaggug

SEQ ID NO: 32963 - RNA, 23 nt, Artificial Sequence
  RNA Oligomer
gauuaguuuguccaaaauaaggc

SEQ ID NO: 32964 - RNA, 23 nt, Artificial Sequence
  RNA Oligomer
auuaguuuguccaaaauaaggca

SEQ ID NO: 32965 - RNA, 23 nt, Artificial Sequence
  RNA Oligomer
uuaguuuguccaaaauaaggcaa

SEQ ID NO: 32966 - RNA, 23 nt, Artificial Sequence
  RNA Oligomer
uaguuuguccaaaauaaggcaaa

SEQ ID NO: 32967 - RNA, 23 nt, Artificial Sequence
  RNA Oligomer
aguuuguccaaaauaaggcaaau

SEQ ID NO: 32968 - RNA, 23 nt, Artificial Sequence
  RNA Oligomer
gcaagauaucuucacugcucugg

SEQ ID NO: 32969 - RNA, 23 nt, Artificial Sequence
  RNA Oligomer
caagauaucuucacugcucuggu

SEQ ID NO: 32970 - RNA, 23 nt, Artificial Sequence
  RNA Oligomer
aagauaucuucacugcucugguu

SEQ ID NO: 32971 - RNA, 23 nt, Artificial Sequence
  RNA Oligomer
agauaucuucacugcucugguuc

SEQ ID NO: 32972 - RNA, 23 nt, Artificial Sequence
  RNA Oligomer
gauaucuucacugcucugguucu

SEQ ID NO: 32973 - RNA, 23 nt, Artificial Sequence
  RNA Oligomer
ggaaaagaucugcauuugaagga

SEQ ID NO: 32974 - RNA, 23 nt, Artificial Sequence
  RNA Oligomer
gaaaagaucugcauuugaaggac

SEQ ID NO: 32975 - RNA, 23 nt, Artificial Sequence
  RNA Oligomer
aaaagaucugcauuugaaggacu

SEQ ID NO: 32976 - RNA, 23 nt, Artificial Sequence
  RNA Oligomer
aaagaucugcauuugaaggacuc

SEQ ID NO: 32977 - RNA, 23 nt, Artificial Sequence
  RNA Oligomer
aagaucugcauuugaaggacucc

SEQ ID NO: 32978 - RNA, 23 nt, Artificial Sequence
  RNA Oligomer
cauauuguuucuggaguaacugg

SEQ ID NO: 32979 - RNA, 23 nt, Artificial Sequence
  RNA Oligomer
auauuguuucuggaguaacugga

SEQ ID NO: 32980 - RNA, 23 nt, Artificial Sequence
  RNA Oligomer
uauuguuucuggaguaacuggaa

SEQ ID NO: 32981 - RNA, 23 nt, Artificial Sequence
  RNA Oligomer
auuguuucuggaguaacuggaac

SEQ ID NO: 32982 - RNA, 23 nt, Artificial Sequence
  RNA Oligomer
uuguuucuggaguaacuggaacu

SEQ ID NO: 32983 - RNA, 23 nt, Artificial Sequence
  RNA Oligomer
cauucugcucuugauucaauuug

SEQ ID NO: 32984 - RNA, 23 nt, Artificial Sequence
  RNA Oligomer
auucugcucuugauucaauuugu

SEQ ID NO: 32985 - RNA, 23 nt, Artificial Sequence
  RNA Oligomer
uucugcucuugauucaauuuguu

SEQ ID NO: 32986 - RNA, 23 nt, Artificial Sequence
  RNA Oligomer
ucugcucuugauucaauuuguuu

SEQ ID NO: 32987 - RNA, 23 nt, Artificial Sequence
  RNA Oligomer
cugcucuugauucaauuuguuuc

SEQ ID NO: 32988 - RNA, 23 nt, Artificial Sequence
  RNA Oligomer
ugcucuugauucaauuuguuucu

SEQ ID NO: 32989 - RNA, 23 nt, Artificial Sequence
  RNA Oligomer
guucuucuacuuuugacacagcc

SEQ ID NO: 32990 - RNA, 23 nt, Artificial Sequence
  RNA Oligomer
uucuucuacuuuugacacagcca

SEQ ID NO: 32991 - RNA, 23 nt, Artificial Sequence
  RNA Oligomer
ucuucuacuuuugacacagccag

SEQ ID NO: 32992 - RNA, 23 nt, Artificial Sequence
  RNA Oligomer
cuucuacuuuugacacagccagg

SEQ ID NO: 32993 - RNA, 23 nt, Artificial Sequence
  RNA Oligomer
uucuacuuuugacacagccagga

SEQ ID NO: 32994 - RNA, 23 nt, Artificial Sequence
  RNA Oligomer
cgagcucccucuguuuuugcugg

SEQ ID NO: 32995 - RNA, 23 nt, Artificial Sequence
  RNA Oligomer
gagcucccucuguuuuugcugga

SEQ ID NO: 32996 - RNA, 23 nt, Artificial Sequence
  RNA Oligomer
agcucccucuguuuuugcuggaa

SEQ ID NO: 32997 - RNA, 23 nt, Artificial Sequence
  RNA Oligomer
gcucccucuguuuuugcuggaac

SEQ ID NO: 32998 - RNA, 23 nt, Artificial Sequence
  RNA Oligomer
cucccucuguuuuugcuggaaca

SEQ ID NO: 32999 - RNA, 23 nt, Artificial Sequence
  RNA Oligomer
ucacuuuuuuuagcuuagcuucc

SEQ ID NO: 33000 - RNA, 23 nt, Artificial Sequence
  RNA Oligomer
cacuuuuuuuagcuuagcuuccu

SEQ ID NO: 33001 - RNA, 23 nt, Artificial Sequence
  RNA Oligomer
acuuuuuuuagcuuagcuuccug

SEQ ID NO: 33002 - RNA, 23 nt, Artificial Sequence
  RNA Oligomer
cuuuuuuuagcuuagcuuccuga

SEQ ID NO: 33003 - RNA, 23 nt, Artificial Sequence
  RNA Oligomer
uuuuuuuagcuuagcuuccugau

SEQ ID NO: 33004 - RNA, 23 nt, Artificial Sequence
  RNA Oligomer
cucauuguuacugagauacacgg

SEQ ID NO: 33005 - RNA, 23 nt, Artificial Sequence
  RNA Oligomer
ucauuguuacugagauacacggu

SEQ ID NO: 33006 - RNA, 23 nt, Artificial Sequence
  RNA Oligomer
cauuguuacugagauacacggua

SEQ ID NO: 33007 - RNA, 23 nt, Artificial Sequence
  RNA Oligomer
auuguuacugagauacacgguaa

SEQ ID NO: 33008 - RNA, 23 nt, Artificial Sequence
  RNA Oligomer
uuguuacugagauacacgguaag

SEQ ID NO: 33009 - RNA, 23 nt, Artificial Sequence
  RNA Oligomer
acaucuaauuacugguaccguag

SEQ ID NO: 33010 - RNA, 23 nt, Artificial Sequence
  RNA Oligomer
caucuaauuacugguaccguagc

SEQ ID NO: 33011 - RNA, 23 nt, Artificial Sequence
  RNA Oligomer
guagaugcuuuauuucaucacgc

SEQ ID NO: 33012 - RNA, 23 nt, Artificial Sequence
  RNA Oligomer
uagaugcuuuauuucaucacgcu

SEQ ID NO: 33013 - RNA, 23 nt, Artificial Sequence
  RNA Oligomer
agaugcuuuauuucaucacgcua

SEQ ID NO: 33014 - RNA, 23 nt, Artificial Sequence
  RNA Oligomer
gaugcuuuauuucaucacgcuaa

SEQ ID NO: 33015 - RNA, 23 nt, Artificial Sequence
  RNA Oligomer
augcuuuauuucaucacgcuaaa

SEQ ID NO: 33016 - RNA, 23 nt, Artificial Sequence
  RNA Oligomer
uucuucaauccuucauucucuuc

SEQ ID NO: 33017 - RNA, 23 nt, Artificial Sequence
  RNA Oligomer
ucuucaauccuucauucucuucu

SEQ ID NO: 33018 - RNA, 23 nt, Artificial Sequence
  RNA Oligomer
cuucaauccuucauucucuucua

SEQ ID NO: 33019 - RNA, 23 nt, Artificial Sequence
  RNA Oligomer
cauuuacauuuacaccaaacugu

SEQ ID NO: 33020 - RNA, 23 nt, Artificial Sequence
  RNA Oligomer
auuuacauuuacaccaaacugua

SEQ ID NO: 33021 - RNA, 23 nt, Artificial Sequence
  RNA Oligomer
uuuacauuuacaccaaacuguac

SEQ ID NO: 33022 - RNA, 23 nt, Artificial Sequence
  RNA Oligomer
uuacauuuacaccaaacuguacc

SEQ ID NO: 33023 - RNA, 23 nt, Artificial Sequence
  RNA Oligomer
uacauuuacaccaaacuguacca

SEQ ID NO: 33024 - RNA, 23 nt, Artificial Sequence
  RNA Oligomer
aaauaauucucuguacaagguca

SEQ ID NO: 33025 - RNA, 23 nt, Artificial Sequence
  RNA Oligomer
aauaauucucuguacaaggucaa

SEQ ID NO: 33026 - RNA, 23 nt, Artificial Sequence
  RNA Oligomer
auaauucucuguacaaggucaaa

SEQ ID NO: 33027 - RNA, 23 nt, Artificial Sequence
  RNA Oligomer
uaauucucuguacaaggucaaau

SEQ ID NO: 33028 - RNA, 23 nt, Artificial Sequence
  RNA Oligomer
aauucucuguacaaggucaaauu

SEQ ID NO: 33029 - RNA, 23 nt, Artificial Sequence
  RNA Oligomer
acgcaaguuuguccuuuuaccag

SEQ ID NO: 33030 - RNA, 23 nt, Artificial Sequence
  RNA Oligomer
cgcaaguuuguccuuuuaccagg

SEQ ID NO: 33031 - RNA, 23 nt, Artificial Sequence
  RNA Oligomer
gcaaguuuguccuuuuaccagga

SEQ ID NO: 33032 - RNA, 23 nt, Artificial Sequence
  RNA Oligomer
caaguuuguccuuuuaccaggag

SEQ ID NO: 33033 - RNA, 23 nt, Artificial Sequence
  RNA Oligomer
aaguuuguccuuuuaccaggagg

SEQ ID NO: 33034 - RNA, 23 nt, Artificial Sequence
  RNA Oligomer
uggguuauucuggagauuugggc

SEQ ID NO: 33035 - RNA, 23 nt, Artificial Sequence
  RNA Oligomer
ggguuauucuggagauuugggcu

SEQ ID NO: 33036 - RNA, 23 nt, Artificial Sequence
  RNA Oligomer
gguuauucuggagauuugggcug

SEQ ID NO: 33037 - RNA, 23 nt, Artificial Sequence
  RNA Oligomer
guuauucuggagauuugggcugu

SEQ ID NO: 33038 - RNA, 23 nt, Artificial Sequence
  RNA Oligomer
uuauucuggagauuugggcuguu

SEQ ID NO: 33039 - RNA, 23 nt, Artificial Sequence
  RNA Oligomer
gaagcugacuuggauggguauga

SEQ ID NO: 33040 - RNA, 23 nt, Artificial Sequence
  RNA Oligomer
auucuuucguuuucaugguucuc

SEQ ID NO: 33041 - RNA, 23 nt, Artificial Sequence
  RNA Oligomer
uuggaauaaauguucucugggug

SEQ ID NO: 33042 - RNA, 23 nt, Artificial Sequence
  RNA Oligomer
gguagauuuucuuuuugcuguag

SEQ ID NO: 33043 - RNA, 23 nt, Artificial Sequence
  RNA Oligomer
guagauuuucuuuuugcuguaga

SEQ ID NO: 33044 - RNA, 23 nt, Artificial Sequence
  RNA Oligomer
uucaauuuguuucuuagcugcag

SEQ ID NO: 33045 - RNA, 23 nt, Artificial Sequence
  RNA Oligomer
ucaauuuguuucuuagcugcagc

SEQ ID NO: 33046 - RNA, 23 nt, Artificial Sequence
  RNA Oligomer
caauuuguuucuuagcugcagcu

SEQ ID NO: 33047 - RNA, 23 nt, Artificial Sequence
  RNA Oligomer
aauuuguuucuuagcugcagcuc

SEQ ID NO: 33048 - RNA, 23 nt, Artificial Sequence
  RNA Oligomer
auuuguuucuuagcugcagcucc

SEQ ID NO: 33049 - RNA, 23 nt, Artificial Sequence
  RNA Oligomer
uuuguuucuuagcugcagcuccu

SEQ ID NO: 33050 - RNA, 23 nt, Artificial Sequence
  RNA Oligomer
uuuuuuagcuuagcuuccugauu

SEQ ID NO: 33051 - RNA, 23 nt, Artificial Sequence
  RNA Oligomer
uuuuuagcuuagcuuccugauuc

SEQ ID NO: 33052 - RNA, 23 nt, Artificial Sequence
  RNA Oligomer
cagcaacuuguugcuguugucgc

SEQ ID NO: 33053 - RNA, 23 nt, Artificial Sequence
  RNA Oligomer
agcaacuuguugcuguugucgcu

SEQ ID NO: 33054 - RNA, 23 nt, Artificial Sequence
  RNA Oligomer
gcaacuuguugcuguugucgcug

SEQ ID NO: 33055 - RNA, 23 nt, Artificial Sequence
  RNA Oligomer
caacuuguugcuguugucgcuga

SEQ ID NO: 33056 - RNA, 23 nt, Artificial Sequence
  RNA Oligomer
aacuuguugcuguugucgcugau

SEQ ID NO: 33057 - RNA, 23 nt, Artificial Sequence
  RNA Oligomer
augaucuugacaaauauuacggg

SEQ ID NO: 33058 - RNA, 23 nt, Artificial Sequence
  RNA Oligomer
ugaucuugacaaauauuacgggu

SEQ ID NO: 33059 - RNA, 23 nt, Artificial Sequence
  RNA Oligomer
gaucuugacaaauauuacgggua

SEQ ID NO: 33060 - RNA, 23 nt, Artificial Sequence
  RNA Oligomer
aucuugacaaauauuacggguaa

SEQ ID NO: 33061 - RNA, 23 nt, Artificial Sequence
  RNA Oligomer
ucuugacaaauauuacggguaag

SEQ ID NO: 33062 - RNA, 23 nt, Artificial Sequence
  RNA Oligomer
uggugaauucuucaauccuucau

SEQ ID NO: 33063 - RNA, 23 nt, Artificial Sequence
  RNA Oligomer
ggugaauucuucaauccuucauu

SEQ ID NO: 33064 - RNA, 23 nt, Artificial Sequence
  RNA Oligomer
ucuugugaaauuuuugccaaaaa

SEQ ID NO: 33065 - RNA, 23 nt, Artificial Sequence
  RNA Oligomer
uucauugacuaaaauucugugug

SEQ ID NO: 33066 - RNA, 23 nt, Artificial Sequence
  RNA Oligomer
ucauugacuaaaauucugugugg

SEQ ID NO: 33067 - RNA, 23 nt, Artificial Sequence
  RNA Oligomer
cauugacuaaaauucugugugga

SEQ ID NO: 33068 - RNA, 23 nt, Artificial Sequence
  RNA Oligomer
auugacuaaaauucuguguggaa

SEQ ID NO: 33069 - RNA, 23 nt, Artificial Sequence
  RNA Oligomer
uugacuaaaauucuguguggaag

SEQ ID NO: 33070 - RNA, 23 nt, Artificial Sequence
  RNA Oligomer
ugacuaaaauucuguguggaagu

SEQ ID NO: 33071 - RNA, 23 nt, Artificial Sequence
  RNA Oligomer
aagcgcauaaaugacuccuuuau

SEQ ID NO: 33072 - RNA, 23 nt, Artificial Sequence
  RNA Oligomer
cuccuuuauucauuaugcccauc

SEQ ID NO: 33073 - RNA, 23 nt, Artificial Sequence
  RNA Oligomer
aaacuuacacacuuggacguugu

SEQ ID NO: 33074 - RNA, 23 nt, Artificial Sequence
  RNA Oligomer
aacuuacacacuuggacguuguu

SEQ ID NO: 33075 - RNA, 23 nt, Artificial Sequence
  RNA Oligomer
auaaauaauucucuguacaaggu

SEQ ID NO: 33076 - RNA, 23 nt, Artificial Sequence
  RNA Oligomer
uaaauaauucucuguacaagguc

SEQ ID NO: 33077 - RNA, 23 nt, Artificial Sequence
  RNA Oligomer
gggguugaauuucacccucauuc

SEQ ID NO: 33078 - RNA, 23 nt, Artificial Sequence
  RNA Oligomer
ggguugaauuucacccucauucc

SEQ ID NO: 33079 - RNA, 23 nt, Artificial Sequence
  RNA Oligomer
gguugaauuucacccucauucca

SEQ ID NO: 33080 - RNA, 23 nt, Artificial Sequence
  RNA Oligomer
guugaauuucacccucauuccau

SEQ ID NO: 33081 - RNA, 23 nt, Artificial Sequence
  RNA Oligomer
uugaauuucacccucauuccaug

SEQ ID NO: 33082 - RNA, 23 nt, Artificial Sequence
  RNA Oligomer
uacgcucugagccaguuuuacgc

SEQ ID NO: 33083 - RNA, 23 nt, Artificial Sequence
  RNA Oligomer
acgcucugagccaguuuuacgca

SEQ ID NO: 33084 - RNA, 23 nt, Artificial Sequence
  RNA Oligomer
cgcucugagccaguuuuacgcaa

SEQ ID NO: 33085 - RNA, 23 nt, Artificial Sequence
  RNA Oligomer
gcucugagccaguuuuacgcaag

SEQ ID NO: 33086 - RNA, 23 nt, Artificial Sequence
  RNA Oligomer
cucugagccaguuuuacgcaagu

SEQ ID NO: 33087 - RNA, 23 nt, Artificial Sequence
  RNA Oligomer
ccacauguaaauauggauucugg

SEQ ID NO: 33088 - RNA, 23 nt, Artificial Sequence
  RNA Oligomer
cacauguaaauauggauucugga

SEQ ID NO: 33089 - RNA, 23 nt, Artificial Sequence
  RNA Oligomer
acauguaaauauggauucuggau

SEQ ID NO: 33090 - RNA, 23 nt, Artificial Sequence
  RNA Oligomer
cauguaaauauggauucuggauu

SEQ ID NO: 33091 - RNA, 23 nt, Artificial Sequence
  RNA Oligomer
auguaaauauggauucuggauuu

SEQ ID NO: 33092 - RNA, 23 nt, Artificial Sequence
  RNA Oligomer
auaaaagcuucugaauauuuggc

SEQ ID NO: 33093 - RNA, 23 nt, Artificial Sequence
  RNA Oligomer
uaaaagcuucugaauauuuggcc

SEQ ID NO: 33094 - RNA, 23 nt, Artificial Sequence
  RNA Oligomer
aaaagcuucugaauauuuggccc

SEQ ID NO: 33095 - RNA, 23 nt, Artificial Sequence
  RNA Oligomer
aaagcuucugaauauuuggccca

SEQ ID NO: 33096 - RNA, 23 nt, Artificial Sequence
  RNA Oligomer
aagcuucugaauauuuggcccau

SEQ ID NO: 33097 - RNA, 23 nt, Artificial Sequence
  RNA Oligomer
agauaagaaaggcaguaauuuag

SEQ ID NO: 33098 - RNA, 23 nt, Artificial Sequence
  RNA Oligomer
gauaagaaaggcaguaauuuagu

SEQ ID NO: 33099 - RNA, 23 nt, Artificial Sequence
  RNA Oligomer
auaagaaaggcaguaauuuaguu

SEQ ID NO: 33100 - RNA, 23 nt, Artificial Sequence
  RNA Oligomer
ccuggcuauuggaauaaauguuc

SEQ ID NO: 33101 - RNA, 23 nt, Artificial Sequence
  RNA Oligomer
cuggcuauuggaauaaauguucu

SEQ ID NO: 33102 - RNA, 23 nt, Artificial Sequence
  RNA Oligomer
uggcuauuggaauaaauguucuc

SEQ ID NO: 33103 - RNA, 23 nt, Artificial Sequence
  RNA Oligomer
ggcuauuggaauaaauguucucu

SEQ ID NO: 33104 - RNA, 23 nt, Artificial Sequence
  RNA Oligomer
gcuauuggaauaaauguucucug

SEQ ID NO: 33105 - RNA, 23 nt, Artificial Sequence
  RNA Oligomer
uaaauguucucugggugcugcug

SEQ ID NO: 33106 - RNA, 23 nt, Artificial Sequence
  RNA Oligomer
cugggugcugcuguugauucugg

SEQ ID NO: 33107 - RNA, 23 nt, Artificial Sequence
  RNA Oligomer
ugggugcugcuguugauucuggg

SEQ ID NO: 33108 - RNA, 23 nt, Artificial Sequence
  RNA Oligomer
gggugcugcuguugauucugggc

SEQ ID NO: 33109 - RNA, 23 nt, Artificial Sequence
  RNA Oligomer
ggugcugcuguugauucugggca

SEQ ID NO: 33110 - RNA, 23 nt, Artificial Sequence
  RNA Oligomer
gugcugcuguugauucugggcag

SEQ ID NO: 33111 - RNA, 23 nt, Artificial Sequence
  RNA Oligomer
augagucuuggucaacgcgcucu

SEQ ID NO: 33112 - RNA, 23 nt, Artificial Sequence
  RNA Oligomer
auggaauauauugaacuugcugc

SEQ ID NO: 33113 - RNA, 23 nt, Artificial Sequence
  RNA Oligomer
uggaauauauugaacuugcugcc

SEQ ID NO: 33114 - RNA, 23 nt, Artificial Sequence
  RNA Oligomer
ggaauauauugaacuugcugcca

SEQ ID NO: 33115 - RNA, 23 nt, Artificial Sequence
  RNA Oligomer
gaauauauugaacuugcugccac

SEQ ID NO: 33116 - RNA, 23 nt, Artificial Sequence
  RNA Oligomer
aauauauugaacuugcugccacg

SEQ ID NO: 33117 - RNA, 23 nt, Artificial Sequence
  RNA Oligomer
ugagaacggacgcacuuucuucu

SEQ ID NO: 33118 - RNA, 23 nt, Artificial Sequence
  RNA Oligomer
gagaacggacgcacuuucuucuc

SEQ ID NO: 33119 - RNA, 23 nt, Artificial Sequence
  RNA Oligomer
agaacggacgcacuuucuucucu

SEQ ID NO: 33120 - RNA, 23 nt, Artificial Sequence
  RNA Oligomer
gaacggacgcacuuucuucucuu

SEQ ID NO: 33121 - RNA, 23 nt, Artificial Sequence
  RNA Oligomer
aacggacgcacuuucuucucuuu

SEQ ID NO: 33122 - RNA, 23 nt, Artificial Sequence
  RNA Oligomer
gagguacagaagcagagccuugg

SEQ ID NO: 33123 - RNA, 23 nt, Artificial Sequence
  RNA Oligomer
agguacagaagcagagccuuggc

SEQ ID NO: 33124 - RNA, 23 nt, Artificial Sequence
  RNA Oligomer
gguacagaagcagagccuuggcu

SEQ ID NO: 33125 - RNA, 23 nt, Artificial Sequence
  RNA Oligomer
guacagaagcagagccuuggcuu

SEQ ID NO: 33126 - RNA, 23 nt, Artificial Sequence
  RNA Oligomer
uacagaagcagagccuuggcuug

SEQ ID NO: 33127 - RNA, 23 nt, Artificial Sequence
  RNA Oligomer
cugcauuugaaggacuccaauca

SEQ ID NO: 33128 - RNA, 23 nt, Artificial Sequence
  RNA Oligomer
ugcauuugaaggacuccaaucag

SEQ ID NO: 33129 - RNA, 23 nt, Artificial Sequence
  RNA Oligomer
gcauuugaaggacuccaaucagg

SEQ ID NO: 33130 - RNA, 23 nt, Artificial Sequence
  RNA Oligomer
cauuugaaggacuccaaucaggg

SEQ ID NO: 33131 - RNA, 23 nt, Artificial Sequence
  RNA Oligomer
auuugaaggacuccaaucagggc

SEQ ID NO: 33132 - RNA, 23 nt, Artificial Sequence
  RNA Oligomer
uuaguuugugaagcagccccaga

SEQ ID NO: 33133 - RNA, 23 nt, Artificial Sequence
  RNA Oligomer
cuguagagcugccuucuucuucc

SEQ ID NO: 33134 - RNA, 23 nt, Artificial Sequence
  RNA Oligomer
uguagagcugccuucuucuucca

SEQ ID NO: 33135 - RNA, 23 nt, Artificial Sequence
  RNA Oligomer
guagagcugccuucuucuuccac

SEQ ID NO: 33136 - RNA, 23 nt, Artificial Sequence
  RNA Oligomer
uagagcugccuucuucuuccaca

SEQ ID NO: 33137 - RNA, 23 nt, Artificial Sequence
  RNA Oligomer
agagcugccuucuucuuccacag

SEQ ID NO: 33138 - RNA, 23 nt, Artificial Sequence
  RNA Oligomer
ucagcucauuaacacgcuuaucc

SEQ ID NO: 33139 - RNA, 23 nt, Artificial Sequence
  RNA Oligomer
cagcucauuaacacgcuuaucca

SEQ ID NO: 33140 - RNA, 23 nt, Artificial Sequence
  RNA Oligomer
agcucauuaacacgcuuauccau

SEQ ID NO: 33141 - RNA, 23 nt, Artificial Sequence
  RNA Oligomer
gcucauuaacacgcuuauccaug

SEQ ID NO: 33142 - RNA, 23 nt, Artificial Sequence
  RNA Oligomer
cucauuaacacgcuuauccauga

SEQ ID NO: 33143 - RNA, 23 nt, Artificial Sequence
  RNA Oligomer
cgcuuauucaaacacucccucug

SEQ ID NO: 33144 - RNA, 23 nt, Artificial Sequence
  RNA Oligomer
gcuuauucaaacacucccucugu

SEQ ID NO: 33145 - RNA, 23 nt, Artificial Sequence
  RNA Oligomer
cuuauucaaacacucccucuguu

SEQ ID NO: 33146 - RNA, 23 nt, Artificial Sequence
  RNA Oligomer
uuauucaaacacucccucuguug

SEQ ID NO: 33147 - RNA, 23 nt, Artificial Sequence
  RNA Oligomer
uauucaaacacucccucuguugu

SEQ ID NO: 33148 - RNA, 23 nt, Artificial Sequence
  RNA Oligomer
uucaaacacucccucuguuguug

SEQ ID NO: 33149 - RNA, 23 nt, Artificial Sequence
  RNA Oligomer
ucaaacacucccucuguuguugu

SEQ ID NO: 33150 - RNA, 23 nt, Artificial Sequence
  RNA Oligomer
caaacacucccucuguuguugua

SEQ ID NO: 33151 - RNA, 23 nt, Artificial Sequence
  RNA Oligomer
aaacacucccucuguuguuguag

SEQ ID NO: 33152 - RNA, 23 nt, Artificial Sequence
  RNA Oligomer
aacacucccucuguuguuguagc

SEQ ID NO: 33153 - RNA, 23 nt, Artificial Sequence
  RNA Oligomer
uuuuagcuuagcuuccugauucu

SEQ ID NO: 33154 - RNA, 23 nt, Artificial Sequence
  RNA Oligomer
gcuguugucgcugaucuuguugu

SEQ ID NO: 33155 - RNA, 23 nt, Artificial Sequence
  RNA Oligomer
cuguugucgcugaucuuguuguu

SEQ ID NO: 33156 - RNA, 23 nt, Artificial Sequence
  RNA Oligomer
uguugucgcugaucuuguuguuu

SEQ ID NO: 33157 - RNA, 23 nt, Artificial Sequence
  RNA Oligomer
guugucgcugaucuuguuguuuc

SEQ ID NO: 33158 - RNA, 23 nt, Artificial Sequence
  RNA Oligomer
uugucgcugaucuuguuguuuca

SEQ ID NO: 33159 - RNA, 23 nt, Artificial Sequence
  RNA Oligomer
uguuguuucaaaaacuuuaagcg

SEQ ID NO: 33160 - RNA, 23 nt, Artificial Sequence
  RNA Oligomer
guuguuucaaaaacuuuaagcgc

SEQ ID NO: 33161 - RNA, 23 nt, Artificial Sequence
  RNA Oligomer
uuguuucaaaaacuuuaagcgcu

SEQ ID NO: 33162 - RNA, 23 nt, Artificial Sequence
  RNA Oligomer
uguuucaaaaacuuuaagcgcug

SEQ ID NO: 33163 - RNA, 23 nt, Artificial Sequence
  RNA Oligomer
guuucaaaaacuuuaagcgcugu

SEQ ID NO: 33164 - RNA, 23 nt, Artificial Sequence
  RNA Oligomer
aaacuuuaagcgcuguuccuuag

SEQ ID NO: 33165 - RNA, 23 nt, Artificial Sequence
  RNA Oligomer
aacuuuaagcgcuguuccuuagu

SEQ ID NO: 33166 - RNA, 23 nt, Artificial Sequence
  RNA Oligomer
acuuuaagcgcuguuccuuaguu

SEQ ID NO: 33167 - RNA, 23 nt, Artificial Sequence
  RNA Oligomer
cuuuaagcgcuguuccuuaguug

SEQ ID NO: 33168 - RNA, 23 nt, Artificial Sequence
  RNA Oligomer
uuuaagcgcuguuccuuaguugc

SEQ ID NO: 33169 - RNA, 23 nt, Artificial Sequence
  RNA Oligomer
guugcugggcuucaaucuguugc

SEQ ID NO: 33170 - RNA, 23 nt, Artificial Sequence
  RNA Oligomer
uugcugggcuucaaucuguugcu

SEQ ID NO: 33171 - RNA, 23 nt, Artificial Sequence
  RNA Oligomer
ugcugggcuucaaucuguugcug

SEQ ID NO: 33172 - RNA, 23 nt, Artificial Sequence
  RNA Oligomer
gcugggcuucaaucuguugcugc

SEQ ID NO: 33173 - RNA, 23 nt, Artificial Sequence
  RNA Oligomer
cugggcuucaaucuguugcugcu

SEQ ID NO: 33174 - RNA, 23 nt, Artificial Sequence
  RNA Oligomer
ggcuucaaucuguugcugcuggc

SEQ ID NO: 33175 - RNA, 23 nt, Artificial Sequence
  RNA Oligomer
gcuucaaucuguugcugcuggcg

SEQ ID NO: 33176 - RNA, 23 nt, Artificial Sequence
  RNA Oligomer
cuucaaucuguugcugcuggcga

SEQ ID NO: 33177 - RNA, 23 nt, Artificial Sequence
  RNA Oligomer
uucaaucuguugcugcuggcgag

SEQ ID NO: 33178 - RNA, 23 nt, Artificial Sequence
  RNA Oligomer
ucaaucuguugcugcuggcgaga

SEQ ID NO: 33179 - RNA, 23 nt, Artificial Sequence
  RNA Oligomer
uucugagauacaaaagacaauaa

SEQ ID NO: 33180 - RNA, 23 nt, Artificial Sequence
  RNA Oligomer
uucuuaagaugcuacaaaaacuc

SEQ ID NO: 33181 - RNA, 23 nt, Artificial Sequence
  RNA Oligomer
ucuuaagaugcuacaaaaacuca

SEQ ID NO: 33182 - RNA, 23 nt, Artificial Sequence
  RNA Oligomer
cuuaagaugcuacaaaaacucau

SEQ ID NO: 33183 - RNA, 23 nt, Artificial Sequence
  RNA Oligomer
uuaagaugcuacaaaaacucaua

SEQ ID NO: 33184 - RNA, 23 nt, Artificial Sequence
  RNA Oligomer
uaagaugcuacaaaaacucauau

SEQ ID NO: 33185 - RNA, 23 nt, Artificial Sequence
  RNA Oligomer
gacaauauacaagugugcagugc

SEQ ID NO: 33186 - RNA, 23 nt, Artificial Sequence
  RNA Oligomer
acaauauacaagugugcagugcc

SEQ ID NO: 33187 - RNA, 23 nt, Artificial Sequence
  RNA Oligomer
caauauacaagugugcagugccu

SEQ ID NO: 33188 - RNA, 23 nt, Artificial Sequence
  RNA Oligomer
aauauacaagugugcagugccuu

SEQ ID NO: 33189 - RNA, 23 nt, Artificial Sequence
  RNA Oligomer
auauacaagugugcagugccuuc

SEQ ID NO: 33190 - RNA, 23 nt, Artificial Sequence
  RNA Oligomer
uccuuucuucgauauucaccagg

SEQ ID NO: 33191 - RNA, 23 nt, Artificial Sequence
  RNA Oligomer
ccuuucuucgauauucaccagga

SEQ ID NO: 33192 - RNA, 23 nt, Artificial Sequence
  RNA Oligomer
cuuucuucgauauucaccaggaa

SEQ ID NO: 33193 - RNA, 23 nt, Artificial Sequence
  RNA Oligomer
uuucuucgauauucaccaggaac

SEQ ID NO: 33194 - RNA, 23 nt, Artificial Sequence
  RNA Oligomer
uucuucgauauucaccaggaacu

SEQ ID NO: 33195 - RNA, 23 nt, Artificial Sequence
  RNA Oligomer
uucaauccuucauucucuucuag

SEQ ID NO: 33196 - RNA, 23 nt, Artificial Sequence
  RNA Oligomer
ucaauccuucauucucuucuaga

SEQ ID NO: 33197 - RNA, 23 nt, Artificial Sequence
  RNA Oligomer
caauccuucauucucuucuagag

SEQ ID NO: 33198 - RNA, 23 nt, Artificial Sequence
  RNA Oligomer
caccaccauucgauuucaucuuc

SEQ ID NO: 33199 - RNA, 23 nt, Artificial Sequence
  RNA Oligomer
accaccauucgauuucaucuucg

SEQ ID NO: 33200 - RNA, 23 nt, Artificial Sequence
  RNA Oligomer
ccaccauucgauuucaucuucgu

SEQ ID NO: 33201 - RNA, 23 nt, Artificial Sequence
  RNA Oligomer
caccauucgauuucaucuucguc

SEQ ID NO: 33202 - RNA, 23 nt, Artificial Sequence
  RNA Oligomer
accauucgauuucaucuucgucu

SEQ ID NO: 33203 - RNA, 23 nt, Artificial Sequence
  RNA Oligomer
uccuuuauucauuaugcccaucu

SEQ ID NO: 33204 - RNA, 23 nt, Artificial Sequence
  RNA Oligomer
ccuuuauucauuaugcccaucuu

SEQ ID NO: 33205 - RNA, 23 nt, Artificial Sequence
  RNA Oligomer
cuuuauucauuaugcccaucuuc

SEQ ID NO: 33206 - RNA, 23 nt, Artificial Sequence
  RNA Oligomer
uuuauucauuaugcccaucuucu

SEQ ID NO: 33207 - RNA, 23 nt, Artificial Sequence
  RNA Oligomer
uuauucauuaugcccaucuucuc

SEQ ID NO: 33208 - RNA, 23 nt, Artificial Sequence
  RNA Oligomer
uccugacuccaccaaaaacuuac

SEQ ID NO: 33209 - RNA, 23 nt, Artificial Sequence
  RNA Oligomer
ccugacuccaccaaaaacuuaca

SEQ ID NO: 33210 - RNA, 23 nt, Artificial Sequence
  RNA Oligomer
cugacuccaccaaaaacuuacac

SEQ ID NO: 33211 - RNA, 23 nt, Artificial Sequence
  RNA Oligomer
ugacuccaccaaaaacuuacaca

SEQ ID NO: 33212 - RNA, 23 nt, Artificial Sequence
  RNA Oligomer
gacuccaccaaaaacuuacacac

SEQ ID NO: 33213 - RNA, 23 nt, Artificial Sequence
  RNA Oligomer
acuccaccaaaaacuuacacacu

SEQ ID NO: 33214 - RNA, 23 nt, Artificial Sequence
  RNA Oligomer
cuccaccaaaaacuuacacacuu

SEQ ID NO: 33215 - RNA, 23 nt, Artificial Sequence
  RNA Oligomer
uaacgauuucuguguggccugca

SEQ ID NO: 33216 - RNA, 23 nt, Artificial Sequence
  RNA Oligomer
acacacagcauugugaagagccg

SEQ ID NO: 33217 - RNA, 23 nt, Artificial Sequence
  RNA Oligomer
cacacagcauugugaagagccgu

SEQ ID NO: 33218 - RNA, 23 nt, Artificial Sequence
  RNA Oligomer
acacagcauugugaagagccgug

SEQ ID NO: 33219 - RNA, 23 nt, Artificial Sequence
  RNA Oligomer
cacagcauugugaagagccguga

SEQ ID NO: 33220 - RNA, 23 nt, Artificial Sequence
  RNA Oligomer
acagcauugugaagagccgugau

SEQ ID NO: 33221 - RNA, 23 nt, Artificial Sequence
  RNA Oligomer
cauaaauaauucucuguacaagg

SEQ ID NO: 33222 - RNA, 23 nt, Artificial Sequence
  RNA Oligomer
uauggauucuggauuucuacugg

SEQ ID NO: 33223 - RNA, 23 nt, Artificial Sequence
  RNA Oligomer
auggauucuggauuucuacuggg

SEQ ID NO: 33224 - RNA, 23 nt, Artificial Sequence
  RNA Oligomer
uggauucuggauuucuacugggc

SEQ ID NO: 33225 - RNA, 23 nt, Artificial Sequence
  RNA Oligomer
ggauucuggauuucuacugggcu

SEQ ID NO: 33226 - RNA, 23 nt, Artificial Sequence
  RNA Oligomer
gauucuggauuucuacugggcuu

SEQ ID NO: 33227 - RNA, 23 nt, Artificial Sequence
  RNA Oligomer
ugcguuagacaguuucuuucgua

SEQ ID NO: 33228 - RNA, 23 nt, Artificial Sequence
  RNA Oligomer
gcguuagacaguuucuuucguaa

SEQ ID NO: 33229 - RNA, 23 nt, Artificial Sequence
  RNA Oligomer
cguuagacaguuucuuucguaag

SEQ ID NO: 33230 - RNA, 23 nt, Artificial Sequence
  RNA Oligomer
guuagacaguuucuuucguaagg

SEQ ID NO: 33231 - RNA, 23 nt, Artificial Sequence
  RNA Oligomer
uuagacaguuucuuucguaaggc

SEQ ID NO: 33232 - RNA, 23 nt, Artificial Sequence
  RNA Oligomer
aucaaacauucgcucauuauccg

SEQ ID NO: 33233 - RNA, 23 nt, Artificial Sequence
  RNA Oligomer
ucaaacauucgcucauuauccgc

SEQ ID NO: 33234 - RNA, 23 nt, Artificial Sequence
  RNA Oligomer
caaacauucgcucauuauccgca

SEQ ID NO: 33235 - RNA, 23 nt, Artificial Sequence
  RNA Oligomer
aaacauucgcucauuauccgcaa

SEQ ID NO: 33236 - RNA, 23 nt, Artificial Sequence
  RNA Oligomer
aacauucgcucauuauccgcaac

SEQ ID NO: 33237 - RNA, 23 nt, Artificial Sequence
  RNA Oligomer
ugcugcuguugauucugggcagc

SEQ ID NO: 33238 - RNA, 23 nt, Artificial Sequence
  RNA Oligomer
gcccucugguaugagucuugguc

SEQ ID NO: 33239 - RNA, 23 nt, Artificial Sequence
  RNA Oligomer
cccucugguaugagucuugguca

SEQ ID NO: 33240 - RNA, 23 nt, Artificial Sequence
  RNA Oligomer
ccucugguaugagucuuggucaa

SEQ ID NO: 33241 - RNA, 23 nt, Artificial Sequence
  RNA Oligomer
cucugguaugagucuuggucaac

SEQ ID NO: 33242 - RNA, 23 nt, Artificial Sequence
  RNA Oligomer
ucugguaugagucuuggucaacg

SEQ ID NO: 33243 - RNA, 23 nt, Artificial Sequence
  RNA Oligomer
auauauugaacuugcugccacgg

SEQ ID NO: 33244 - RNA, 23 nt, Artificial Sequence
  RNA Oligomer
cugcugguuuugguuuaguuccc

SEQ ID NO: 33245 - RNA, 23 nt, Artificial Sequence
  RNA Oligomer
ugcugguuuugguuuaguuccca

SEQ ID NO: 33246 - RNA, 23 nt, Artificial Sequence
  RNA Oligomer
gcugguuuugguuuaguucccau

SEQ ID NO: 33247 - RNA, 23 nt, Artificial Sequence
  RNA Oligomer
cugguuuugguuuaguucccaug

SEQ ID NO: 33248 - RNA, 23 nt, Artificial Sequence
  RNA Oligomer
ugguuuugguuuaguucccaugg

SEQ ID NO: 33249 - RNA, 23 nt, Artificial Sequence
  RNA Oligomer
auuaaucuguuuugguuuuguag

SEQ ID NO: 33250 - RNA, 23 nt, Artificial Sequence
  RNA Oligomer
uuaaucuguuuugguuuuguagg

SEQ ID NO: 33251 - RNA, 23 nt, Artificial Sequence
  RNA Oligomer
uaaucuguuuugguuuuguagga

SEQ ID NO: 33252 - RNA, 23 nt, Artificial Sequence
  RNA Oligomer
aaucuguuuugguuuuguaggaa

SEQ ID NO: 33253 - RNA, 23 nt, Artificial Sequence
  RNA Oligomer
aucuguuuugguuuuguaggaac

SEQ ID NO: 33254 - RNA, 23 nt, Artificial Sequence
  RNA Oligomer
ucuguuuugguuuuguaggaaca

SEQ ID NO: 33255 - RNA, 23 nt, Artificial Sequence
  RNA Oligomer
cuguuuugguuuuguaggaacag

SEQ ID NO: 33256 - RNA, 23 nt, Artificial Sequence
  RNA Oligomer
cagccaaauggcaaucacucucg

SEQ ID NO: 33257 - RNA, 23 nt, Artificial Sequence
  RNA Oligomer
agccaaauggcaaucacucucgc

SEQ ID NO: 33258 - RNA, 23 nt, Artificial Sequence
  RNA Oligomer
gccaaauggcaaucacucucgcc

SEQ ID NO: 33259 - RNA, 23 nt, Artificial Sequence
  RNA Oligomer
ccaaauggcaaucacucucgccg

SEQ ID NO: 33260 - RNA, 23 nt, Artificial Sequence
  RNA Oligomer
caaauggcaaucacucucgccgg

SEQ ID NO: 33261 - RNA, 23 nt, Artificial Sequence
  RNA Oligomer
aagaaacaucggcaucaucuugg

SEQ ID NO: 33262 - RNA, 23 nt, Artificial Sequence
  RNA Oligomer
agaaacaucggcaucaucuugga

SEQ ID NO: 33263 - RNA, 23 nt, Artificial Sequence
  RNA Oligomer
gaaacaucggcaucaucuuggac

SEQ ID NO: 33264 - RNA, 23 nt, Artificial Sequence
  RNA Oligomer
aaacaucggcaucaucuuggacc

SEQ ID NO: 33265 - RNA, 23 nt, Artificial Sequence
  RNA Oligomer
aacaucggcaucaucuuggaccc

SEQ ID NO: 33266 - RNA, 23 nt, Artificial Sequence
  RNA Oligomer
uagccacauuuuuauuugcaacc

SEQ ID NO: 33267 - RNA, 23 nt, Artificial Sequence
  RNA Oligomer
agccacauuuuuauuugcaaccu

SEQ ID NO: 33268 - RNA, 23 nt, Artificial Sequence
  RNA Oligomer
gccacauuuuuauuugcaaccug

SEQ ID NO: 33269 - RNA, 23 nt, Artificial Sequence
  RNA Oligomer
ccacauuuuuauuugcaaccuga

SEQ ID NO: 33270 - RNA, 23 nt, Artificial Sequence
  RNA Oligomer
cacauuuuuauuugcaaccugag

SEQ ID NO: 33271 - RNA, 23 nt, Artificial Sequence
  RNA Oligomer
ccgcaagauaucuucacugcucu

SEQ ID NO: 33272 - RNA, 23 nt, Artificial Sequence
  RNA Oligomer
cgcaagauaucuucacugcucug

SEQ ID NO: 33273 - RNA, 23 nt, Artificial Sequence
  RNA Oligomer
agaucugcauuugaaggacucca

SEQ ID NO: 33274 - RNA, 23 nt, Artificial Sequence
  RNA Oligomer
acgucucugcauauuguuucugg

SEQ ID NO: 33275 - RNA, 23 nt, Artificial Sequence
  RNA Oligomer
cgucucugcauauuguuucugga

SEQ ID NO: 33276 - RNA, 23 nt, Artificial Sequence
  RNA Oligomer
gucucugcauauuguuucuggag

SEQ ID NO: 33277 - RNA, 23 nt, Artificial Sequence
  RNA Oligomer
ucucugcauauuguuucuggagu

SEQ ID NO: 33278 - RNA, 23 nt, Artificial Sequence
  RNA Oligomer
cucugcauauuguuucuggagua

SEQ ID NO: 33279 - RNA, 23 nt, Artificial Sequence
  RNA Oligomer
uggcuucaccagcaauucaggcc

SEQ ID NO: 33280 - RNA, 23 nt, Artificial Sequence
  RNA Oligomer
ggcuucaccagcaauucaggccu

SEQ ID NO: 33281 - RNA, 23 nt, Artificial Sequence
  RNA Oligomer
gcuucaccagcaauucaggccuu

SEQ ID NO: 33282 - RNA, 23 nt, Artificial Sequence
  RNA Oligomer
cuucaccagcaauucaggccuug

SEQ ID NO: 33283 - RNA, 23 nt, Artificial Sequence
  RNA Oligomer
uucaccagcaauucaggccuuga

SEQ ID NO: 33284 - RNA, 23 nt, Artificial Sequence
  RNA Oligomer
ucagaugaaacugguagauuuuc

SEQ ID NO: 33285 - RNA, 23 nt, Artificial Sequence
  RNA Oligomer
cagaugaaacugguagauuuucu

SEQ ID NO: 33286 - RNA, 23 nt, Artificial Sequence
  RNA Oligomer
agaugaaacugguagauuuucuu

SEQ ID NO: 33287 - RNA, 23 nt, Artificial Sequence
  RNA Oligomer
gaugaaacugguagauuuucuuu

SEQ ID NO: 33288 - RNA, 23 nt, Artificial Sequence
  RNA Oligomer
augaaacugguagauuuucuuuu

SEQ ID NO: 33289 - RNA, 23 nt, Artificial Sequence
  RNA Oligomer
ugacugccacuucugaauuacgc

SEQ ID NO: 33290 - RNA, 23 nt, Artificial Sequence
  RNA Oligomer
gacugccacuucugaauuacgcu

SEQ ID NO: 33291 - RNA, 23 nt, Artificial Sequence
  RNA Oligomer
acugccacuucugaauuacgcuu

SEQ ID NO: 33292 - RNA, 23 nt, Artificial Sequence
  RNA Oligomer
cugccacuucugaauuacgcuua

SEQ ID NO: 33293 - RNA, 23 nt, Artificial Sequence
  RNA Oligomer
ugccacuucugaauuacgcuuau

SEQ ID NO: 33294 - RNA, 23 nt, Artificial Sequence
  RNA Oligomer
cugaauuacgcuuauucaaacac

SEQ ID NO: 33295 - RNA, 23 nt, Artificial Sequence
  RNA Oligomer
ugaauuacgcuuauucaaacacu

SEQ ID NO: 33296 - RNA, 23 nt, Artificial Sequence
  RNA Oligomer
gaauuacgcuuauucaaacacuc

SEQ ID NO: 33297 - RNA, 23 nt, Artificial Sequence
  RNA Oligomer
aauuacgcuuauucaaacacucc

SEQ ID NO: 33298 - RNA, 23 nt, Artificial Sequence
  RNA Oligomer
auuacgcuuauucaaacacuccc

SEQ ID NO: 33299 - RNA, 23 nt, Artificial Sequence
  RNA Oligomer
acgcuuauucaaacacucccucu

SEQ ID NO: 33300 - RNA, 23 nt, Artificial Sequence
  RNA Oligomer
cucccucuguuguuguagcuugg

SEQ ID NO: 33301 - RNA, 23 nt, Artificial Sequence
  RNA Oligomer
ucccucuguuguuguagcuuggc

SEQ ID NO: 33302 - RNA, 23 nt, Artificial Sequence
  RNA Oligomer
cccucuguuguuguagcuuggca

SEQ ID NO: 33303 - RNA, 23 nt, Artificial Sequence
  RNA Oligomer
ccucuguuguuguagcuuggcau

SEQ ID NO: 33304 - RNA, 23 nt, Artificial Sequence
  RNA Oligomer
cucuguuguuguagcuuggcauu

SEQ ID NO: 33305 - RNA, 23 nt, Artificial Sequence
  RNA Oligomer
auucaauuuguuucuuagcugca

SEQ ID NO: 33306 - RNA, 23 nt, Artificial Sequence
  RNA Oligomer
ccuggucaguucuucuacuuuug

SEQ ID NO: 33307 - RNA, 23 nt, Artificial Sequence
  RNA Oligomer
cuggucaguucuucuacuuuuga

SEQ ID NO: 33308 - RNA, 23 nt, Artificial Sequence
  RNA Oligomer
uggucaguucuucuacuuuugac

SEQ ID NO: 33309 - RNA, 23 nt, Artificial Sequence
  RNA Oligomer
ggucaguucuucuacuuuugaca

SEQ ID NO: 33310 - RNA, 23 nt, Artificial Sequence
  RNA Oligomer
gucaguucuucuacuuuugacac

SEQ ID NO: 33311 - RNA, 23 nt, Artificial Sequence
  RNA Oligomer
ucaguucuucuacuuuugacaca

SEQ ID NO: 33312 - RNA, 23 nt, Artificial Sequence
  RNA Oligomer
caguucuucuacuuuugacacag

SEQ ID NO: 33313 - RNA, 23 nt, Artificial Sequence
  RNA Oligomer
aguucuucuacuuuugacacagc

SEQ ID NO: 33314 - RNA, 23 nt, Artificial Sequence
  RNA Oligomer
uucaucuguucaauuuccuccac

SEQ ID NO: 33315 - RNA, 23 nt, Artificial Sequence
  RNA Oligomer
ucaucuguucaauuuccuccaca

SEQ ID NO: 33316 - RNA, 23 nt, Artificial Sequence
  RNA Oligomer
caucuguucaauuuccuccacaa

SEQ ID NO: 33317 - RNA, 23 nt, Artificial Sequence
  RNA Oligomer
cuuuuagccuuuuaaguuucucc

SEQ ID NO: 33318 - RNA, 23 nt, Artificial Sequence
  RNA Oligomer
uuuuagccuuuuaaguuucuccu

SEQ ID NO: 33319 - RNA, 23 nt, Artificial Sequence
  RNA Oligomer
uuuagccuuuuaaguuucuccug

SEQ ID NO: 33320 - RNA, 23 nt, Artificial Sequence
  RNA Oligomer
uuagccuuuuaaguuucuccugc

SEQ ID NO: 33321 - RNA, 23 nt, Artificial Sequence
  RNA Oligomer
uagccuuuuaaguuucuccugcu

SEQ ID NO: 33322 - RNA, 23 nt, Artificial Sequence
  RNA Oligomer
uuucaaaaacuuuaagcgcuguu

SEQ ID NO: 33323 - RNA, 23 nt, Artificial Sequence
  RNA Oligomer
ccugaaguucagcaagagucaga

SEQ ID NO: 33324 - RNA, 23 nt, Artificial Sequence
  RNA Oligomer
cugaaguucagcaagagucagau

SEQ ID NO: 33325 - RNA, 23 nt, Artificial Sequence
  RNA Oligomer
ugaaguucagcaagagucagauc

SEQ ID NO: 33326 - RNA, 23 nt, Artificial Sequence
  RNA Oligomer
uaauuacugguaccguagcuuag

SEQ ID NO: 33327 - RNA, 23 nt, Artificial Sequence
  RNA Oligomer
aauuacugguaccguagcuuagu

SEQ ID NO: 33328 - RNA, 23 nt, Artificial Sequence
  RNA Oligomer
auuacugguaccguagcuuaguu

SEQ ID NO: 33329 - RNA, 23 nt, Artificial Sequence
  RNA Oligomer
uuacugguaccguagcuuaguuu

SEQ ID NO: 33330 - RNA, 23 nt, Artificial Sequence
  RNA Oligomer
uacugguaccguagcuuaguuuc

SEQ ID NO: 33331 - RNA, 23 nt, Artificial Sequence
  RNA Oligomer
cuccuuucuucgauauucaccag

SEQ ID NO: 33332 - RNA, 23 nt, Artificial Sequence
  RNA Oligomer
cucuaauggugaauucuucaauc

SEQ ID NO: 33333 - RNA, 23 nt, Artificial Sequence
  RNA Oligomer
aauccuucauucucuucuagaga

SEQ ID NO: 33334 - RNA, 23 nt, Artificial Sequence
  RNA Oligomer
auccuucauucucuucuagagac

SEQ ID NO: 33335 - RNA, 23 nt, Artificial Sequence
  RNA Oligomer
cugcaugucacuguaggucaugg

SEQ ID NO: 33336 - RNA, 23 nt, Artificial Sequence
  RNA Oligomer
ugcaugucacuguaggucauggc

SEQ ID NO: 33337 - RNA, 23 nt, Artificial Sequence
  RNA Oligomer
gcaugucacuguaggucauggca

SEQ ID NO: 33338 - RNA, 23 nt, Artificial Sequence
  RNA Oligomer
caugucacuguaggucauggcaa

SEQ ID NO: 33339 - RNA, 23 nt, Artificial Sequence
  RNA Oligomer
augucacuguaggucauggcaaa

SEQ ID NO: 33340 - RNA, 23 nt, Artificial Sequence
  RNA Oligomer
acacuuggacguuguuacaugag

SEQ ID NO: 33341 - RNA, 23 nt, Artificial Sequence
  RNA Oligomer
cacuuggacguuguuacaugagg

SEQ ID NO: 33342 - RNA, 23 nt, Artificial Sequence
  RNA Oligomer
acuuggacguuguuacaugaggc

SEQ ID NO: 33343 - RNA, 23 nt, Artificial Sequence
  RNA Oligomer
cuuggacguuguuacaugaggca

SEQ ID NO: 33344 - RNA, 23 nt, Artificial Sequence
  RNA Oligomer
uuggacguuguuacaugaggcag

SEQ ID NO: 33345 - RNA, 23 nt, Artificial Sequence
  RNA Oligomer
uggacguuguuacaugaggcagc

SEQ ID NO: 33346 - RNA, 23 nt, Artificial Sequence
  RNA Oligomer
aacgauuucuguguggccugcac

SEQ ID NO: 33347 - RNA, 23 nt, Artificial Sequence
  RNA Oligomer
cucuguacaaggucaaauucucc

SEQ ID NO: 33348 - RNA, 23 nt, Artificial Sequence
  RNA Oligomer
ucaagcacauguggagccucugg

SEQ ID NO: 33349 - RNA, 23 nt, Artificial Sequence
  RNA Oligomer
caagcacauguggagccucugga

SEQ ID NO: 33350 - RNA, 23 nt, Artificial Sequence
  RNA Oligomer
aagcacauguggagccucuggau

SEQ ID NO: 33351 - RNA, 23 nt, Artificial Sequence
  RNA Oligomer
ggauggguaugaugggacagaga

SEQ ID NO: 33352 - RNA, 23 nt, Artificial Sequence
  RNA Oligomer
gauggguaugaugggacagagau

SEQ ID NO: 33353 - RNA, 23 nt, Artificial Sequence
  RNA Oligomer
auggguaugaugggacagagaug

SEQ ID NO: 33354 - RNA, 23 nt, Artificial Sequence
  RNA Oligomer
ggucagcaucacucugguuucgg

SEQ ID NO: 33355 - RNA, 23 nt, Artificial Sequence
  RNA Oligomer
gucagcaucacucugguuucggu

SEQ ID NO: 33356 - RNA, 23 nt, Artificial Sequence
  RNA Oligomer
ucagcaucacucugguuucggua

SEQ ID NO: 33357 - RNA, 23 nt, Artificial Sequence
  RNA Oligomer
cagcaucacucugguuucgguaa

SEQ ID NO: 33358 - RNA, 23 nt, Artificial Sequence
  RNA Oligomer
agcaucacucugguuucgguaag

SEQ ID NO: 33359 - RNA, 23 nt, Artificial Sequence
  RNA Oligomer
uacauggaauauauugaacuugc

SEQ ID NO: 33360 - RNA, 23 nt, Artificial Sequence
  RNA Oligomer
acauggaauauauugaacuugcu

SEQ ID NO: 33361 - RNA, 23 nt, Artificial Sequence
  RNA Oligomer
cauggaauauauugaacuugcug

SEQ ID NO: 33362 - RNA, 23 nt, Artificial Sequence
  RNA Oligomer
aaauggcaaucacucucgccggg

SEQ ID NO: 33363 - RNA, 23 nt, Artificial Sequence
  RNA Oligomer
cuuuagccacauuuuuauuugca

SEQ ID NO: 33364 - RNA, 23 nt, Artificial Sequence
  RNA Oligomer
uuuagccacauuuuuauuugcaa

SEQ ID NO: 33365 - RNA, 23 nt, Artificial Sequence
  RNA Oligomer
uuagccacauuuuuauuugcaac

SEQ ID NO: 33366 - RNA, 23 nt, Artificial Sequence
  RNA Oligomer
acauuuuuauuugcaaccugagc

SEQ ID NO: 33367 - RNA, 23 nt, Artificial Sequence
  RNA Oligomer
cauuuuuauuugcaaccugagca

SEQ ID NO: 33368 - RNA, 23 nt, Artificial Sequence
  RNA Oligomer
auuuuuauuugcaaccugagcau

SEQ ID NO: 33369 - RNA, 23 nt, Artificial Sequence
  RNA Oligomer
uuuuuauuugcaaccugagcauc

SEQ ID NO: 33370 - RNA, 23 nt, Artificial Sequence
  RNA Oligomer
uuuuauuugcaaccugagcaucc

SEQ ID NO: 33371 - RNA, 23 nt, Artificial Sequence
  RNA Oligomer
guucuuugcacagauccaccacg

SEQ ID NO: 33372 - RNA, 23 nt, Artificial Sequence
  RNA Oligomer
uucuuugcacagauccaccacgu

SEQ ID NO: 33373 - RNA, 23 nt, Artificial Sequence
  RNA Oligomer
ucuuugcacagauccaccacguc

SEQ ID NO: 33374 - RNA, 23 nt, Artificial Sequence
  RNA Oligomer
cuuugcacagauccaccacgucu

SEQ ID NO: 33375 - RNA, 23 nt, Artificial Sequence
  RNA Oligomer
uuugcacagauccaccacgucuc

SEQ ID NO: 33376 - RNA, 23 nt, Artificial Sequence
  RNA Oligomer
uugcacagauccaccacgucucu

SEQ ID NO: 33377 - RNA, 23 nt, Artificial Sequence
  RNA Oligomer
gggcagugucuguauuuucaucg

SEQ ID NO: 33378 - RNA, 23 nt, Artificial Sequence
  RNA Oligomer
ggcagugucuguauuuucaucgg

SEQ ID NO: 33379 - RNA, 23 nt, Artificial Sequence
  RNA Oligomer
gcagugucuguauuuucaucggc

SEQ ID NO: 33380 - RNA, 23 nt, Artificial Sequence
  RNA Oligomer
cagugucuguauuuucaucggcc

SEQ ID NO: 33381 - RNA, 23 nt, Artificial Sequence
  RNA Oligomer
agugucuguauuuucaucggccc

SEQ ID NO: 33382 - RNA, 23 nt, Artificial Sequence
  RNA Oligomer
gggcauccgaggcauaguagacg

SEQ ID NO: 33383 - RNA, 23 nt, Artificial Sequence
  RNA Oligomer
ggcauccgaggcauaguagacga

SEQ ID NO: 33384 - RNA, 23 nt, Artificial Sequence
  RNA Oligomer
gcauccgaggcauaguagacgac

SEQ ID NO: 33385 - RNA, 23 nt, Artificial Sequence
  RNA Oligomer
cauccgaggcauaguagacgacu

SEQ ID NO: 33386 - RNA, 23 nt, Artificial Sequence
  RNA Oligomer
auccgaggcauaguagacgacug

SEQ ID NO: 33387 - RNA, 23 nt, Artificial Sequence
  RNA Oligomer
gaaacugguagauuuucuuuuug

SEQ ID NO: 33388 - RNA, 23 nt, Artificial Sequence
  RNA Oligomer
aaacugguagauuuucuuuuugc

SEQ ID NO: 33389 - RNA, 23 nt, Artificial Sequence
  RNA Oligomer
aacugguagauuuucuuuuugcu

SEQ ID NO: 33390 - RNA, 23 nt, Artificial Sequence
  RNA Oligomer
acugguagauuuucuuuuugcug

SEQ ID NO: 33391 - RNA, 23 nt, Artificial Sequence
  RNA Oligomer
cugguagauuuucuuuuugcugu

SEQ ID NO: 33392 - RNA, 23 nt, Artificial Sequence
  RNA Oligomer
uuugcuguagagcugccuucuuc

SEQ ID NO: 33393 - RNA, 23 nt, Artificial Sequence
  RNA Oligomer
uugcuguagagcugccuucuucu

SEQ ID NO: 33394 - RNA, 23 nt, Artificial Sequence
  RNA Oligomer
ugcuguagagcugccuucuucuu

SEQ ID NO: 33395 - RNA, 23 nt, Artificial Sequence
  RNA Oligomer
gcuguagagcugccuucuucuuc

SEQ ID NO: 33396 - RNA, 23 nt, Artificial Sequence
  RNA Oligomer
auucaaacacucccucuguuguu

SEQ ID NO: 33397 - RNA, 23 nt, Artificial Sequence
  RNA Oligomer
uggaguaacuggaacuucuguga

SEQ ID NO: 33398 - RNA, 23 nt, Artificial Sequence
  RNA Oligomer
ggaguaacuggaacuucugugaa

SEQ ID NO: 33399 - RNA, 23 nt, Artificial Sequence
  RNA Oligomer
gaguaacuggaacuucugugaag

SEQ ID NO: 33400 - RNA, 23 nt, Artificial Sequence
  RNA Oligomer
aguaacuggaacuucugugaagu

SEQ ID NO: 33401 - RNA, 23 nt, Artificial Sequence
  RNA Oligomer
guaacuggaacuucugugaagug

SEQ ID NO: 33402 - RNA, 23 nt, Artificial Sequence
  RNA Oligomer
guuuuugcuggaacaaauuauuc

SEQ ID NO: 33403 - RNA, 23 nt, Artificial Sequence
  RNA Oligomer
uuuuugcuggaacaaauuauuca

SEQ ID NO: 33404 - RNA, 23 nt, Artificial Sequence
  RNA Oligomer
uuuugcuggaacaaauuauucau

SEQ ID NO: 33405 - RNA, 23 nt, Artificial Sequence
  RNA Oligomer
uuugcuggaacaaauuauucauc

SEQ ID NO: 33406 - RNA, 23 nt, Artificial Sequence
  RNA Oligomer
uugcuggaacaaauuauucaucu

SEQ ID NO: 33407 - RNA, 23 nt, Artificial Sequence
  RNA Oligomer
ugauucucagcuauuucuuuuag

SEQ ID NO: 33408 - RNA, 23 nt, Artificial Sequence
  RNA Oligomer
gauucucagcuauuucuuuuagc

SEQ ID NO: 33409 - RNA, 23 nt, Artificial Sequence
  RNA Oligomer
auucucagcuauuucuuuuagcc

SEQ ID NO: 33410 - RNA, 23 nt, Artificial Sequence
  RNA Oligomer
uucucagcuauuucuuuuagccu

SEQ ID NO: 33411 - RNA, 23 nt, Artificial Sequence
  RNA Oligomer
ucucagcuauuucuuuuagccuu

SEQ ID NO: 33412 - RNA, 23 nt, Artificial Sequence
  RNA Oligomer
auuguugcugggcuucaaucugu

SEQ ID NO: 33413 - RNA, 23 nt, Artificial Sequence
  RNA Oligomer
uuguugcugggcuucaaucuguu

SEQ ID NO: 33414 - RNA, 23 nt, Artificial Sequence
  RNA Oligomer
uguugcugggcuucaaucuguug

SEQ ID NO: 33415 - RNA, 23 nt, Artificial Sequence
  RNA Oligomer
cggguaagucuguagcaaguuuc

SEQ ID NO: 33416 - RNA, 23 nt, Artificial Sequence
  RNA Oligomer
ggguaagucuguagcaaguuucu

SEQ ID NO: 33417 - RNA, 23 nt, Artificial Sequence
  RNA Oligomer
gguaagucuguagcaaguuucua

SEQ ID NO: 33418 - RNA, 23 nt, Artificial Sequence
  RNA Oligomer
guaagucuguagcaaguuucuaa

SEQ ID NO: 33419 - RNA, 23 nt, Artificial Sequence
  RNA Oligomer
uaagucuguagcaaguuucuaau

SEQ ID NO: 33420 - RNA, 23 nt, Artificial Sequence
  RNA Oligomer
aacaccguucuccuuucuucgau

SEQ ID NO: 33421 - RNA, 23 nt, Artificial Sequence
  RNA Oligomer
acaccguucuccuuucuucgaua

SEQ ID NO: 33422 - RNA, 23 nt, Artificial Sequence
  RNA Oligomer
aucuaauuacugguaccguagcu

SEQ ID NO: 33423 - RNA, 23 nt, Artificial Sequence
  RNA Oligomer
ccguucuccuuucuucgauauuc

SEQ ID NO: 33424 - RNA, 23 nt, Artificial Sequence
  RNA Oligomer
cguucuccuuucuucgauauuca

SEQ ID NO: 33425 - RNA, 23 nt, Artificial Sequence
  RNA Oligomer
guucuccuuucuucgauauucac

SEQ ID NO: 33426 - RNA, 23 nt, Artificial Sequence
  RNA Oligomer
uucuccuuucuucgauauucacc

SEQ ID NO: 33427 - RNA, 23 nt, Artificial Sequence
  RNA Oligomer
ucuccuuucuucgauauucacca

SEQ ID NO: 33428 - RNA, 23 nt, Artificial Sequence
  RNA Oligomer
ucuuguagaaaacaggauugucg

SEQ ID NO: 33429 - RNA, 23 nt, Artificial Sequence
  RNA Oligomer
cuuguagaaaacaggauugucgc

SEQ ID NO: 33430 - RNA, 23 nt, Artificial Sequence
  RNA Oligomer
uuguagaaaacaggauugucgcu

SEQ ID NO: 33431 - RNA, 23 nt, Artificial Sequence
  RNA Oligomer
uguagaaaacaggauugucgcug

SEQ ID NO: 33432 - RNA, 23 nt, Artificial Sequence
  RNA Oligomer
guagaaaacaggauugucgcugu

SEQ ID NO: 33433 - RNA, 23 nt, Artificial Sequence
  RNA Oligomer
ggauugucgcuguauacuuaucu

SEQ ID NO: 33434 - RNA, 23 nt, Artificial Sequence
  RNA Oligomer
gauugucgcuguauacuuaucug

SEQ ID NO: 33435 - RNA, 23 nt, Artificial Sequence
  RNA Oligomer
auugucgcuguauacuuaucuga

SEQ ID NO: 33436 - RNA, 23 nt, Artificial Sequence
  RNA Oligomer
uugucgcuguauacuuaucugag

SEQ ID NO: 33437 - RNA, 23 nt, Artificial Sequence
  RNA Oligomer
ugucgcuguauacuuaucugagu

SEQ ID NO: 33438 - RNA, 23 nt, Artificial Sequence
  RNA Oligomer
gucgcuguauacuuaucugagug

SEQ ID NO: 33439 - RNA, 23 nt, Artificial Sequence
  RNA Oligomer
ucgcuguauacuuaucugagugc

SEQ ID NO: 33440 - RNA, 23 nt, Artificial Sequence
  RNA Oligomer
uuauuucaucacgcuaaaugucc

SEQ ID NO: 33441 - RNA, 23 nt, Artificial Sequence
  RNA Oligomer
uauuucaucacgcuaaauguccu

SEQ ID NO: 33442 - RNA, 23 nt, Artificial Sequence
  RNA Oligomer
auuucaucacgcuaaauguccuc

SEQ ID NO: 33443 - RNA, 23 nt, Artificial Sequence
  RNA Oligomer
uuucaucacgcuaaauguccucu

SEQ ID NO: 33444 - RNA, 23 nt, Artificial Sequence
  RNA Oligomer
uucaucacgcuaaauguccucua

SEQ ID NO: 33445 - RNA, 23 nt, Artificial Sequence
  RNA Oligomer
ucuucauugacuaaaauucugug

SEQ ID NO: 33446 - RNA, 23 nt, Artificial Sequence
  RNA Oligomer
cuucauugacuaaaauucugugu

SEQ ID NO: 33447 - RNA, 23 nt, Artificial Sequence
  RNA Oligomer
uggguacagucccagcaaguuac

SEQ ID NO: 33448 - RNA, 23 nt, Artificial Sequence
  RNA Oligomer
ggguacagucccagcaaguuacg

SEQ ID NO: 33449 - RNA, 23 nt, Artificial Sequence
  RNA Oligomer
gguacagucccagcaaguuacgu

SEQ ID NO: 33450 - RNA, 23 nt, Artificial Sequence
  RNA Oligomer
guacagucccagcaaguuacgug

SEQ ID NO: 33451 - RNA, 23 nt, Artificial Sequence
  RNA Oligomer
uacagucccagcaaguuacgugg

SEQ ID NO: 33452 - RNA, 23 nt, Artificial Sequence
  RNA Oligomer
auuucaucuucgucuucccugug

SEQ ID NO: 33453 - RNA, 23 nt, Artificial Sequence
  RNA Oligomer
acuuacacacuuggacguuguua

SEQ ID NO: 33454 - RNA, 23 nt, Artificial Sequence
  RNA Oligomer
cuuacacacuuggacguuguuac

SEQ ID NO: 33455 - RNA, 23 nt, Artificial Sequence
  RNA Oligomer
uuacacacuuggacguuguuaca

SEQ ID NO: 33456 - RNA, 23 nt, Artificial Sequence
  RNA Oligomer
cacacuuggacguuguuacauga

SEQ ID NO: 33457 - RNA, 23 nt, Artificial Sequence
  RNA Oligomer
ggacguuguuacaugaggcagca

SEQ ID NO: 33458 - RNA, 23 nt, Artificial Sequence
  RNA Oligomer
gacguuguuacaugaggcagcac

SEQ ID NO: 33459 - RNA, 23 nt, Artificial Sequence
  RNA Oligomer
ggcagcacaauguaauggagucc

SEQ ID NO: 33460 - RNA, 23 nt, Artificial Sequence
  RNA Oligomer
gcagcacaauguaauggagucca

SEQ ID NO: 33461 - RNA, 23 nt, Artificial Sequence
  RNA Oligomer
cagcacaauguaauggaguccau

SEQ ID NO: 33462 - RNA, 23 nt, Artificial Sequence
  RNA Oligomer
agcacaauguaauggaguccauc

SEQ ID NO: 33463 - RNA, 23 nt, Artificial Sequence
  RNA Oligomer
gcacaauguaauggaguccaucc

SEQ ID NO: 33464 - RNA, 23 nt, Artificial Sequence
  RNA Oligomer
cacaauguaauggaguccaucca

SEQ ID NO: 33465 - RNA, 23 nt, Artificial Sequence
  RNA Oligomer
cacuaucagcagcauuuacauuu

SEQ ID NO: 33466 - RNA, 23 nt, Artificial Sequence
  RNA Oligomer
acuaucagcagcauuuacauuua

SEQ ID NO: 33467 - RNA, 23 nt, Artificial Sequence
  RNA Oligomer
cuaucagcagcauuuacauuuac

SEQ ID NO: 33468 - RNA, 23 nt, Artificial Sequence
  RNA Oligomer
uaucagcagcauuuacauuuaca

SEQ ID NO: 33469 - RNA, 23 nt, Artificial Sequence
  RNA Oligomer
aucagcagcauuuacauuuacac

SEQ ID NO: 33470 - RNA, 23 nt, Artificial Sequence
  RNA Oligomer
ugaauuucacccucauuccauga

SEQ ID NO: 33471 - RNA, 23 nt, Artificial Sequence
  RNA Oligomer
uauaaaagcuucugaauauuugg

SEQ ID NO: 33472 - RNA, 23 nt, Artificial Sequence
  RNA Oligomer
gcucuguaauagaacuacguuuc

SEQ ID NO: 33473 - RNA, 23 nt, Artificial Sequence
  RNA Oligomer
cucuguaauagaacuacguuucu

SEQ ID NO: 33474 - RNA, 23 nt, Artificial Sequence
  RNA Oligomer
ucuguaauagaacuacguuucuu

SEQ ID NO: 33475 - RNA, 23 nt, Artificial Sequence
  RNA Oligomer
cuguaauagaacuacguuucuuu

SEQ ID NO: 33476 - RNA, 23 nt, Artificial Sequence
  RNA Oligomer
uguaauagaacuacguuucuuua

SEQ ID NO: 33477 - RNA, 23 nt, Artificial Sequence
  RNA Oligomer
uagacaguuucuuucguaaggcu

SEQ ID NO: 33478 - RNA, 23 nt, Artificial Sequence
  RNA Oligomer
acucugguuucgguaaggauuag

SEQ ID NO: 33479 - RNA, 23 nt, Artificial Sequence
  RNA Oligomer
cucugguuucgguaaggauuaga

SEQ ID NO: 33480 - RNA, 23 nt, Artificial Sequence
  RNA Oligomer
ucugguuucgguaaggauuagau

SEQ ID NO: 33481 - RNA, 23 nt, Artificial Sequence
  RNA Oligomer
cugguuucgguaaggauuagaua

SEQ ID NO: 33482 - RNA, 23 nt, Artificial Sequence
  RNA Oligomer
ugguuucgguaaggauuagauaa

SEQ ID NO: 33483 - RNA, 23 nt, Artificial Sequence
  RNA Oligomer
ggcaguaauuuaguugggcugag

SEQ ID NO: 33484 - RNA, 23 nt, Artificial Sequence
  RNA Oligomer
gcuggaaguuuuuuccuggcgcc

SEQ ID NO: 33485 - RNA, 23 nt, Artificial Sequence
  RNA Oligomer
cuggaaguuuuuuccuggcgccu

SEQ ID NO: 33486 - RNA, 23 nt, Artificial Sequence
  RNA Oligomer
uggaaguuuuuuccuggcgccug

SEQ ID NO: 33487 - RNA, 23 nt, Artificial Sequence
  RNA Oligomer
ggaaguuuuuuccuggcgccugc

SEQ ID NO: 33488 - RNA, 23 nt, Artificial Sequence
  RNA Oligomer
gaaguuuuuuccuggcgccugcu

SEQ ID NO: 33489 - RNA, 23 nt, Artificial Sequence
  RNA Oligomer
ugauuaguuuguccaaaauaagg

SEQ ID NO: 33490 - RNA, 23 nt, Artificial Sequence
  RNA Oligomer
cggguucuuugcacagauccacc

SEQ ID NO: 33491 - RNA, 23 nt, Artificial Sequence
  RNA Oligomer
ggguucuuugcacagauccacca

SEQ ID NO: 33492 - RNA, 23 nt, Artificial Sequence
  RNA Oligomer
gguucuuugcacagauccaccac

SEQ ID NO: 33493 - RNA, 23 nt, Artificial Sequence
  RNA Oligomer
gaucugcauuugaaggacuccaa

SEQ ID NO: 33494 - RNA, 23 nt, Artificial Sequence
  RNA Oligomer
aucugcauuugaaggacuccaau

SEQ ID NO: 33495 - RNA, 23 nt, Artificial Sequence
  RNA Oligomer
gugucuguauuuucaucggcccc

SEQ ID NO: 33496 - RNA, 23 nt, Artificial Sequence
  RNA Oligomer
ugucuguauuuucaucggccccu

SEQ ID NO: 33497 - RNA, 23 nt, Artificial Sequence
  RNA Oligomer
gaagauuuccaucagaugaaacu

SEQ ID NO: 33498 - RNA, 23 nt, Artificial Sequence
  RNA Oligomer
aagauuuccaucagaugaaacug

SEQ ID NO: 33499 - RNA, 23 nt, Artificial Sequence
  RNA Oligomer
agauuuccaucagaugaaacugg

SEQ ID NO: 33500 - RNA, 23 nt, Artificial Sequence
  RNA Oligomer
gauuuccaucagaugaaacuggu

SEQ ID NO: 33501 - RNA, 23 nt, Artificial Sequence
  RNA Oligomer
auuuccaucagaugaaacuggua

SEQ ID NO: 33502 - RNA, 23 nt, Artificial Sequence
  RNA Oligomer
ggucccucagcucauuaacacgc

SEQ ID NO: 33503 - RNA, 23 nt, Artificial Sequence
  RNA Oligomer
gucccucagcucauuaacacgcu

SEQ ID NO: 33504 - RNA, 23 nt, Artificial Sequence
  RNA Oligomer
ucccucagcucauuaacacgcuu

SEQ ID NO: 33505 - RNA, 23 nt, Artificial Sequence
  RNA Oligomer
cccucagcucauuaacacgcuua

SEQ ID NO: 33506 - RNA, 23 nt, Artificial Sequence
  RNA Oligomer
ccucagcucauuaacacgcuuau

SEQ ID NO: 33507 - RNA, 23 nt, Artificial Sequence
  RNA Oligomer
ucauuaacacgcuuauccaugac

SEQ ID NO: 33508 - RNA, 23 nt, Artificial Sequence
  RNA Oligomer
cauuaacacgcuuauccaugacu

SEQ ID NO: 33509 - RNA, 23 nt, Artificial Sequence
  RNA Oligomer
auuaacacgcuuauccaugacug

SEQ ID NO: 33510 - RNA, 23 nt, Artificial Sequence
  RNA Oligomer
uuaacacgcuuauccaugacugc

SEQ ID NO: 33511 - RNA, 23 nt, Artificial Sequence
  RNA Oligomer
gccacuucugaauuacgcuuauu

SEQ ID NO: 33512 - RNA, 23 nt, Artificial Sequence
  RNA Oligomer
uacgcuuauucaaacacucccuc

SEQ ID NO: 33513 - RNA, 23 nt, Artificial Sequence
  RNA Oligomer
acacucccucuguuguuguagcu

SEQ ID NO: 33514 - RNA, 23 nt, Artificial Sequence
  RNA Oligomer
cacucccucuguuguuguagcuu

SEQ ID NO: 33515 - RNA, 23 nt, Artificial Sequence
  RNA Oligomer
acucccucuguuguuguagcuug

SEQ ID NO: 33516 - RNA, 23 nt, Artificial Sequence
  RNA Oligomer
cuggaguaacuggaacuucugug

SEQ ID NO: 33517 - RNA, 23 nt, Artificial Sequence
  RNA Oligomer
ugcuggaacaaauuauucaucug

SEQ ID NO: 33518 - RNA, 23 nt, Artificial Sequence
  RNA Oligomer
ucccauugcuuagucucuucugu

SEQ ID NO: 33519 - RNA, 23 nt, Artificial Sequence
  RNA Oligomer
cccauugcuuagucucuucuguu

SEQ ID NO: 33520 - RNA, 23 nt, Artificial Sequence
  RNA Oligomer
ccauugcuuagucucuucuguuc

SEQ ID NO: 33521 - RNA, 23 nt, Artificial Sequence
  RNA Oligomer
cauugcuuagucucuucuguucc

SEQ ID NO: 33522 - RNA, 23 nt, Artificial Sequence
  RNA Oligomer
auugcuuagucucuucuguucca

SEQ ID NO: 33523 - RNA, 23 nt, Artificial Sequence
  RNA Oligomer
uugcuuagucucuucuguuccac

SEQ ID NO: 33524 - RNA, 23 nt, Artificial Sequence
  RNA Oligomer
ugcuuagucucuucuguuccacg

SEQ ID NO: 33525 - RNA, 23 nt, Artificial Sequence
  RNA Oligomer
gcuuagucucuucuguuccacgu

SEQ ID NO: 33526 - RNA, 23 nt, Artificial Sequence
  RNA Oligomer
cuuagucucuucuguuccacgug

SEQ ID NO: 33527 - RNA, 23 nt, Artificial Sequence
  RNA Oligomer
uuagucucuucuguuccacgugg

SEQ ID NO: 33528 - RNA, 23 nt, Artificial Sequence
  RNA Oligomer
ugugaagugcugcucauuguuac

SEQ ID NO: 33529 - RNA, 23 nt, Artificial Sequence
  RNA Oligomer
gugaagugcugcucauuguuacu

SEQ ID NO: 33530 - RNA, 23 nt, Artificial Sequence
  RNA Oligomer
ugaagugcugcucauuguuacug

SEQ ID NO: 33531 - RNA, 23 nt, Artificial Sequence
  RNA Oligomer
gaagugcugcucauuguuacuga

SEQ ID NO: 33532 - RNA, 23 nt, Artificial Sequence
  RNA Oligomer
aagugcugcucauuguuacugag

SEQ ID NO: 33533 - RNA, 23 nt, Artificial Sequence
  RNA Oligomer
uaagugcucucacuuuuuuuagc

SEQ ID NO: 33534 - RNA, 23 nt, Artificial Sequence
  RNA Oligomer
aagugcucucacuuuuuuuagcu

SEQ ID NO: 33535 - RNA, 23 nt, Artificial Sequence
  RNA Oligomer
agugcucucacuuuuuuuagcuu

SEQ ID NO: 33536 - RNA, 23 nt, Artificial Sequence
  RNA Oligomer
gugcucucacuuuuuuuagcuua

SEQ ID NO: 33537 - RNA, 23 nt, Artificial Sequence
  RNA Oligomer
ugcucucacuuuuuuuagcuuag

SEQ ID NO: 33538 - RNA, 23 nt, Artificial Sequence
  RNA Oligomer
gcucucacuuuuuuuagcuuagc

SEQ ID NO: 33539 - RNA, 23 nt, Artificial Sequence
  RNA Oligomer
cucucacuuuuuuuagcuuagcu

SEQ ID NO: 33540 - RNA, 23 nt, Artificial Sequence
  RNA Oligomer
ucucacuuuuuuuagcuuagcuu

SEQ ID NO: 33541 - RNA, 23 nt, Artificial Sequence
  RNA Oligomer
cucacuuuuuuuagcuuagcuuc

SEQ ID NO: 33542 - RNA, 23 nt, Artificial Sequence
  RNA Oligomer
ugucgcugaucuuguuguuucaa

SEQ ID NO: 33543 - RNA, 23 nt, Artificial Sequence
  RNA Oligomer
gucgcugaucuuguuguuucaaa

SEQ ID NO: 33544 - RNA, 23 nt, Artificial Sequence
  RNA Oligomer
ucgcugaucuuguuguuucaaaa

SEQ ID NO: 33545 - RNA, 23 nt, Artificial Sequence
  RNA Oligomer
uucaaaaacuuuaagcgcuguuc

SEQ ID NO: 33546 - RNA, 23 nt, Artificial Sequence
  RNA Oligomer
ucaaaaacuuuaagcgcuguucc

SEQ ID NO: 33547 - RNA, 23 nt, Artificial Sequence
  RNA Oligomer
caaaaacuuuaagcgcuguuccu

SEQ ID NO: 33548 - RNA, 23 nt, Artificial Sequence
  RNA Oligomer
aaaaacuuuaagcgcuguuccuu

SEQ ID NO: 33549 - RNA, 23 nt, Artificial Sequence
  RNA Oligomer
aaaacuuuaagcgcuguuccuua

SEQ ID NO: 33550 - RNA, 23 nt, Artificial Sequence
  RNA Oligomer
auuacaacuguuuuuaaagucag

SEQ ID NO: 33551 - RNA, 23 nt, Artificial Sequence
  RNA Oligomer
uuacaacuguuuuuaaagucagc

SEQ ID NO: 33552 - RNA, 23 nt, Artificial Sequence
  RNA Oligomer
uacaacuguuuuuaaagucagcu

SEQ ID NO: 33553 - RNA, 23 nt, Artificial Sequence
  RNA Oligomer
acaacuguuuuuaaagucagcua

SEQ ID NO: 33554 - RNA, 23 nt, Artificial Sequence
  RNA Oligomer
caacuguuuuuaaagucagcuau

SEQ ID NO: 33555 - RNA, 23 nt, Artificial Sequence
  RNA Oligomer
aagaugcuacaaaaacucauaua

SEQ ID NO: 33556 - RNA, 23 nt, Artificial Sequence
  RNA Oligomer
auuguucacugacaaccaacuaa

SEQ ID NO: 33557 - RNA, 23 nt, Artificial Sequence
  RNA Oligomer
uuguucacugacaaccaacuaac

SEQ ID NO: 33558 - RNA, 23 nt, Artificial Sequence
  RNA Oligomer
uguucacugacaaccaacuaaca

SEQ ID NO: 33559 - RNA, 23 nt, Artificial Sequence
  RNA Oligomer
guucacugacaaccaacuaacag

SEQ ID NO: 33560 - RNA, 23 nt, Artificial Sequence
  RNA Oligomer
uucacugacaaccaacuaacagu

SEQ ID NO: 33561 - RNA, 23 nt, Artificial Sequence
  RNA Oligomer
ugacaaccaacuaacaguucuuc

SEQ ID NO: 33562 - RNA, 23 nt, Artificial Sequence
  RNA Oligomer
gacaaccaacuaacaguucuuca

SEQ ID NO: 33563 - RNA, 23 nt, Artificial Sequence
  RNA Oligomer
acaaccaacuaacaguucuucac

SEQ ID NO: 33564 - RNA, 23 nt, Artificial Sequence
  RNA Oligomer
caaccaacuaacaguucuucacu

SEQ ID NO: 33565 - RNA, 23 nt, Artificial Sequence
  RNA Oligomer
aaccaacuaacaguucuucacug

SEQ ID NO: 33566 - RNA, 23 nt, Artificial Sequence
  RNA Oligomer
ucacugacaauauacaagugugc

SEQ ID NO: 33567 - RNA, 23 nt, Artificial Sequence
  RNA Oligomer
cacugacaauauacaagugugca

SEQ ID NO: 33568 - RNA, 23 nt, Artificial Sequence
  RNA Oligomer
acugacaauauacaagugugcag

SEQ ID NO: 33569 - RNA, 23 nt, Artificial Sequence
  RNA Oligomer
cugacaauauacaagugugcagu

SEQ ID NO: 33570 - RNA, 23 nt, Artificial Sequence
  RNA Oligomer
ugacaauauacaagugugcagug

SEQ ID NO: 33571 - RNA, 23 nt, Artificial Sequence
  RNA Oligomer
auaaaugauccuauuuacuagac

SEQ ID NO: 33572 - RNA, 23 nt, Artificial Sequence
  RNA Oligomer
uaaaugauccuauuuacuagaca

SEQ ID NO: 33573 - RNA, 23 nt, Artificial Sequence
  RNA Oligomer
aaaugauccuauuuacuagacag

SEQ ID NO: 33574 - RNA, 23 nt, Artificial Sequence
  RNA Oligomer
aaugauccuauuuacuagacagg

SEQ ID NO: 33575 - RNA, 23 nt, Artificial Sequence
  RNA Oligomer
augauccuauuuacuagacagga

SEQ ID NO: 33576 - RNA, 23 nt, Artificial Sequence
  RNA Oligomer
uccuauuuacuagacaggauucu

SEQ ID NO: 33577 - RNA, 23 nt, Artificial Sequence
  RNA Oligomer
ccuauuuacuagacaggauucuu

SEQ ID NO: 33578 - RNA, 23 nt, Artificial Sequence
  RNA Oligomer
cuauuuacuagacaggauucuug

SEQ ID NO: 33579 - RNA, 23 nt, Artificial Sequence
  RNA Oligomer
uauuuacuagacaggauucuugu

SEQ ID NO: 33580 - RNA, 23 nt, Artificial Sequence
  RNA Oligomer
auuuacuagacaggauucuugua

SEQ ID NO: 33581 - RNA, 23 nt, Artificial Sequence
  RNA Oligomer
uagaaaacaggauugucgcugua

SEQ ID NO: 33582 - RNA, 23 nt, Artificial Sequence
  RNA Oligomer
aggauugucgcuguauacuuauc

SEQ ID NO: 33583 - RNA, 23 nt, Artificial Sequence
  RNA Oligomer
cuucuagagacauucuucaucgc

SEQ ID NO: 33584 - RNA, 23 nt, Artificial Sequence
  RNA Oligomer
uucuagagacauucuucaucgcu

SEQ ID NO: 33585 - RNA, 23 nt, Artificial Sequence
  RNA Oligomer
ucuagagacauucuucaucgcuu

SEQ ID NO: 33586 - RNA, 23 nt, Artificial Sequence
  RNA Oligomer
cuagagacauucuucaucgcuuu

SEQ ID NO: 33587 - RNA, 23 nt, Artificial Sequence
  RNA Oligomer
uagagacauucuucaucgcuuuc

SEQ ID NO: 33588 - RNA, 23 nt, Artificial Sequence
  RNA Oligomer
aucgcuuucaagcuacauuguca

SEQ ID NO: 33589 - RNA, 23 nt, Artificial Sequence
  RNA Oligomer
ucgcuuucaagcuacauugucau

SEQ ID NO: 33590 - RNA, 23 nt, Artificial Sequence
  RNA Oligomer
cgcuuucaagcuacauugucauu

SEQ ID NO: 33591 - RNA, 23 nt, Artificial Sequence
  RNA Oligomer
gcuuucaagcuacauugucauua

SEQ ID NO: 33592 - RNA, 23 nt, Artificial Sequence
  RNA Oligomer
cuuucaagcuacauugucauuaa

SEQ ID NO: 33593 - RNA, 23 nt, Artificial Sequence
  RNA Oligomer
aucccaaagcgcauaaaugacuc

SEQ ID NO: 33594 - RNA, 23 nt, Artificial Sequence
  RNA Oligomer
auucauuaugcccaucuucuccu

SEQ ID NO: 33595 - RNA, 23 nt, Artificial Sequence
  RNA Oligomer
uucauuaugcccaucuucuccug

SEQ ID NO: 33596 - RNA, 23 nt, Artificial Sequence
  RNA Oligomer
ucauuaugcccaucuucuccuga

SEQ ID NO: 33597 - RNA, 23 nt, Artificial Sequence
  RNA Oligomer
cauuaugcccaucuucuccugaa

SEQ ID NO: 33598 - RNA, 23 nt, Artificial Sequence
  RNA Oligomer
auuaugcccaucuucuccugaac

SEQ ID NO: 33599 - RNA, 23 nt, Artificial Sequence
  RNA Oligomer
gagcacugaguguagccuuccuc

SEQ ID NO: 33600 - RNA, 23 nt, Artificial Sequence
  RNA Oligomer
agcacugaguguagccuuccucc

SEQ ID NO: 33601 - RNA, 23 nt, Artificial Sequence
  RNA Oligomer
gcacugaguguagccuuccucca

SEQ ID NO: 33602 - RNA, 23 nt, Artificial Sequence
  RNA Oligomer
cacugaguguagccuuccuccau

SEQ ID NO: 33603 - RNA, 23 nt, Artificial Sequence
  RNA Oligomer
acugaguguagccuuccuccauu

SEQ ID NO: 33604 - RNA, 23 nt, Artificial Sequence
  RNA Oligomer
uccaccaaaaacuuacacacuug

SEQ ID NO: 33605 - RNA, 23 nt, Artificial Sequence
  RNA Oligomer
cagcagcauuuacauuuacacca

SEQ ID NO: 33606 - RNA, 23 nt, Artificial Sequence
  RNA Oligomer
agcagcauuuacauuuacaccaa

SEQ ID NO: 33607 - RNA, 23 nt, Artificial Sequence
  RNA Oligomer
gcagcauuuacauuuacaccaaa

SEQ ID NO: 33608 - RNA, 23 nt, Artificial Sequence
  RNA Oligomer
cagcauuuacauuuacaccaaac

SEQ ID NO: 33609 - RNA, 23 nt, Artificial Sequence
  RNA Oligomer
agcauuuacauuuacaccaaacu

SEQ ID NO: 33610 - RNA, 23 nt, Artificial Sequence
  RNA Oligomer
gcauuuacauuuacaccaaacug

SEQ ID NO: 33611 - RNA, 23 nt, Artificial Sequence
  RNA Oligomer
aaacuguaccaggaacuuaacga

SEQ ID NO: 33612 - RNA, 23 nt, Artificial Sequence
  RNA Oligomer
aacuguaccaggaacuuaacgau

SEQ ID NO: 33613 - RNA, 23 nt, Artificial Sequence
  RNA Oligomer
acuguaccaggaacuuaacgauu

SEQ ID NO: 33614 - RNA, 23 nt, Artificial Sequence
  RNA Oligomer
cuguaccaggaacuuaacgauuu

SEQ ID NO: 33615 - RNA, 23 nt, Artificial Sequence
  RNA Oligomer
uguaccaggaacuuaacgauuuc

SEQ ID NO: 33616 - RNA, 23 nt, Artificial Sequence
  RNA Oligomer
auucucuguacaaggucaaauuc

SEQ ID NO: 33617 - RNA, 23 nt, Artificial Sequence
  RNA Oligomer
ucucuguacaaggucaaauucuc

SEQ ID NO: 33618 - RNA, 23 nt, Artificial Sequence
  RNA Oligomer
gucaaauucucccuccaaagacg

SEQ ID NO: 33619 - RNA, 23 nt, Artificial Sequence
  RNA Oligomer
ucaaauucucccuccaaagacga

SEQ ID NO: 33620 - RNA, 23 nt, Artificial Sequence
  RNA Oligomer
caaauucucccuccaaagacgaa

SEQ ID NO: 33621 - RNA, 23 nt, Artificial Sequence
  RNA Oligomer
aaauucucccuccaaagacgaau

SEQ ID NO: 33622 - RNA, 23 nt, Artificial Sequence
  RNA Oligomer
aauucucccuccaaagacgaauc

SEQ ID NO: 33623 - RNA, 23 nt, Artificial Sequence
  RNA Oligomer
guacacaucaagcacauguggag

SEQ ID NO: 33624 - RNA, 23 nt, Artificial Sequence
  RNA Oligomer
uacacaucaagcacauguggagc

SEQ ID NO: 33625 - RNA, 23 nt, Artificial Sequence
  RNA Oligomer
ucguuccucugacuuccaaaucg

SEQ ID NO: 33626 - RNA, 23 nt, Artificial Sequence
  RNA Oligomer
cguuccucugacuuccaaaucgu

SEQ ID NO: 33627 - RNA, 23 nt, Artificial Sequence
  RNA Oligomer
guuccucugacuuccaaaucguu

SEQ ID NO: 33628 - RNA, 23 nt, Artificial Sequence
  RNA Oligomer
uuccucugacuuccaaaucguug

SEQ ID NO: 33629 - RNA, 23 nt, Artificial Sequence
  RNA Oligomer
uccucugacuuccaaaucguuga

SEQ ID NO: 33630 - RNA, 23 nt, Artificial Sequence
  RNA Oligomer
uggauuucuacugggcuuucuga

SEQ ID NO: 33631 - RNA, 23 nt, Artificial Sequence
  RNA Oligomer
ggauuucuacugggcuuucugag

SEQ ID NO: 33632 - RNA, 23 nt, Artificial Sequence
  RNA Oligomer
gauuucuacugggcuuucugagc

SEQ ID NO: 33633 - RNA, 23 nt, Artificial Sequence
  RNA Oligomer
auuucuacugggcuuucugagcu

SEQ ID NO: 33634 - RNA, 23 nt, Artificial Sequence
  RNA Oligomer
uuucuacugggcuuucugagcug

SEQ ID NO: 33635 - RNA, 23 nt, Artificial Sequence
  RNA Oligomer
gccuuggugcguuagacaguuuc

SEQ ID NO: 33636 - RNA, 23 nt, Artificial Sequence
  RNA Oligomer
ccuuggugcguuagacaguuucu

SEQ ID NO: 33637 - RNA, 23 nt, Artificial Sequence
  RNA Oligomer
cuuggugcguuagacaguuucuu

SEQ ID NO: 33638 - RNA, 23 nt, Artificial Sequence
  RNA Oligomer
uuggugcguuagacaguuucuuu

SEQ ID NO: 33639 - RNA, 23 nt, Artificial Sequence
  RNA Oligomer
uggugcguuagacaguuucuuuc

SEQ ID NO: 33640 - RNA, 23 nt, Artificial Sequence
  RNA Oligomer
aggcuucuaggucagcaucacuc

SEQ ID NO: 33641 - RNA, 23 nt, Artificial Sequence
  RNA Oligomer
ggcuucuaggucagcaucacucu

SEQ ID NO: 33642 - RNA, 23 nt, Artificial Sequence
  RNA Oligomer
gcuucuaggucagcaucacucug

SEQ ID NO: 33643 - RNA, 23 nt, Artificial Sequence
  RNA Oligomer
cuucuaggucagcaucacucugg

SEQ ID NO: 33644 - RNA, 23 nt, Artificial Sequence
  RNA Oligomer
uucuaggucagcaucacucuggu

SEQ ID NO: 33645 - RNA, 23 nt, Artificial Sequence
  RNA Oligomer
caucaaacauucgcucauuaucc

SEQ ID NO: 33646 - RNA, 23 nt, Artificial Sequence
  RNA Oligomer
accgaagguaugcugggagauag

SEQ ID NO: 33647 - RNA, 23 nt, Artificial Sequence
  RNA Oligomer
ccgaagguaugcugggagauagc

SEQ ID NO: 33648 - RNA, 23 nt, Artificial Sequence
  RNA Oligomer
cgaagguaugcugggagauagca

SEQ ID NO: 33649 - RNA, 23 nt, Artificial Sequence
  RNA Oligomer
gaagguaugcugggagauagcag

SEQ ID NO: 33650 - RNA, 23 nt, Artificial Sequence
  RNA Oligomer
aagguaugcugggagauagcagc

SEQ ID NO: 33651 - RNA, 23 nt, Artificial Sequence
  RNA Oligomer
acggaacaacuguugacaacugc

SEQ ID NO: 33652 - RNA, 23 nt, Artificial Sequence
  RNA Oligomer
cggaacaacuguugacaacugcu

SEQ ID NO: 33653 - RNA, 23 nt, Artificial Sequence
  RNA Oligomer
ggaacaacuguugacaacugcug

SEQ ID NO: 33654 - RNA, 23 nt, Artificial Sequence
  RNA Oligomer
gaacaacuguugacaacugcuga

SEQ ID NO: 33655 - RNA, 23 nt, Artificial Sequence
  RNA Oligomer
aacaacuguugacaacugcugag

SEQ ID NO: 33656 - RNA, 23 nt, Artificial Sequence
  RNA Oligomer
ugagcaucccgcaagauaucuuc

SEQ ID NO: 33657 - RNA, 23 nt, Artificial Sequence
  RNA Oligomer
gagcaucccgcaagauaucuuca

SEQ ID NO: 33658 - RNA, 23 nt, Artificial Sequence
  RNA Oligomer
agcaucccgcaagauaucuucac

SEQ ID NO: 33659 - RNA, 23 nt, Artificial Sequence
  RNA Oligomer
gcaucccgcaagauaucuucacu

SEQ ID NO: 33660 - RNA, 23 nt, Artificial Sequence
  RNA Oligomer
caucccgcaagauaucuucacug

SEQ ID NO: 33661 - RNA, 23 nt, Artificial Sequence
  RNA Oligomer
guucuuccucagaguaccaaagg

SEQ ID NO: 33662 - RNA, 23 nt, Artificial Sequence
  RNA Oligomer
uucuuccucagaguaccaaagga

SEQ ID NO: 33663 - RNA, 23 nt, Artificial Sequence
  RNA Oligomer
ucuuccucagaguaccaaaggaa

SEQ ID NO: 33664 - RNA, 23 nt, Artificial Sequence
  RNA Oligomer
cuuccucagaguaccaaaggaag

SEQ ID NO: 33665 - RNA, 23 nt, Artificial Sequence
  RNA Oligomer
uuccucagaguaccaaaggaagg

SEQ ID NO: 33666 - RNA, 23 nt, Artificial Sequence
  RNA Oligomer
aucaaacauugagaacggacgca

SEQ ID NO: 33667 - RNA, 23 nt, Artificial Sequence
  RNA Oligomer
ucaaacauugagaacggacgcac

SEQ ID NO: 33668 - RNA, 23 nt, Artificial Sequence
  RNA Oligomer
caaacauugagaacggacgcacu

SEQ ID NO: 33669 - RNA, 23 nt, Artificial Sequence
  RNA Oligomer
aaacauugagaacggacgcacuu

SEQ ID NO: 33670 - RNA, 23 nt, Artificial Sequence
  RNA Oligomer
aacauugagaacggacgcacuuu

SEQ ID NO: 33671 - RNA, 23 nt, Artificial Sequence
  RNA Oligomer
aucaacuugauccagagcauucc

SEQ ID NO: 33672 - RNA, 23 nt, Artificial Sequence
  RNA Oligomer
ucaacuugauccagagcauuccc

SEQ ID NO: 33673 - RNA, 23 nt, Artificial Sequence
  RNA Oligomer
caacuugauccagagcauuccca

SEQ ID NO: 33674 - RNA, 23 nt, Artificial Sequence
  RNA Oligomer
aacuugauccagagcauucccag

SEQ ID NO: 33675 - RNA, 23 nt, Artificial Sequence
  RNA Oligomer
acuugauccagagcauucccagu

SEQ ID NO: 33676 - RNA, 23 nt, Artificial Sequence
  RNA Oligomer
gggaaaagaucugcauuugaagg

SEQ ID NO: 33677 - RNA, 23 nt, Artificial Sequence
  RNA Oligomer
uuugaaggacuccaaucagggcc

SEQ ID NO: 33678 - RNA, 23 nt, Artificial Sequence
  RNA Oligomer
uuuccaucagaugaaacugguag

SEQ ID NO: 33679 - RNA, 23 nt, Artificial Sequence
  RNA Oligomer
gcauauuguuucuggaguaacug

SEQ ID NO: 33680 - RNA, 23 nt, Artificial Sequence
  RNA Oligomer
uaacacgcuuauccaugacugcc

SEQ ID NO: 33681 - RNA, 23 nt, Artificial Sequence
  RNA Oligomer
uuacgcuuauucaaacacucccu

SEQ ID NO: 33682 - RNA, 23 nt, Artificial Sequence
  RNA Oligomer
aucuguucaauuuccuccacaag

SEQ ID NO: 33683 - RNA, 23 nt, Artificial Sequence
  RNA Oligomer
agugcugcucauuguuacugaga

SEQ ID NO: 33684 - RNA, 23 nt, Artificial Sequence
  RNA Oligomer
gugcugcucauuguuacugagau

SEQ ID NO: 33685 - RNA, 23 nt, Artificial Sequence
  RNA Oligomer
ugcugcucauuguuacugagaua

SEQ ID NO: 33686 - RNA, 23 nt, Artificial Sequence
  RNA Oligomer
agccuuuuaaguuucuccugcuc

SEQ ID NO: 33687 - RNA, 23 nt, Artificial Sequence
  RNA Oligomer
gccuuuuaaguuucuccugcuca

SEQ ID NO: 33688 - RNA, 23 nt, Artificial Sequence
  RNA Oligomer
ccuuuuaaguuucuccugcucag

SEQ ID NO: 33689 - RNA, 23 nt, Artificial Sequence
  RNA Oligomer
cuuuuaaguuucuccugcucagc

SEQ ID NO: 33690 - RNA, 23 nt, Artificial Sequence
  RNA Oligomer
uuuuaaguuucuccugcucagca

SEQ ID NO: 33691 - RNA, 23 nt, Artificial Sequence
  RNA Oligomer
gcucauuguuacugagauacacg

SEQ ID NO: 33692 - RNA, 23 nt, Artificial Sequence
  RNA Oligomer
ucagcaagagucagauccauccu

SEQ ID NO: 33693 - RNA, 23 nt, Artificial Sequence
  RNA Oligomer
cagcaagagucagauccauccua

SEQ ID NO: 33694 - RNA, 23 nt, Artificial Sequence
  RNA Oligomer
agcaagagucagauccauccuag

SEQ ID NO: 33695 - RNA, 23 nt, Artificial Sequence
  RNA Oligomer
gcaagagucagauccauccuagg

SEQ ID NO: 33696 - RNA, 23 nt, Artificial Sequence
  RNA Oligomer
caagagucagauccauccuagga

SEQ ID NO: 33697 - RNA, 23 nt, Artificial Sequence
  RNA Oligomer
aagagucagauccauccuaggac

SEQ ID NO: 33698 - RNA, 22 nt, Artificial Sequence
  RNA Oligomer
agagucagauccauccuaggac

SEQ ID NO: 33699 - RNA, 23 nt, Artificial Sequence
  RNA Oligomer
uaugaucuugacaaauauuacgg

SEQ ID NO: 33700 - RNA, 23 nt, Artificial Sequence
  RNA Oligomer
cuugacaaauauuacggguaagu

SEQ ID NO: 33701 - RNA, 23 nt, Artificial Sequence
  RNA Oligomer
guagcaaguuucuaauuucugag

SEQ ID NO: 33702 - RNA, 23 nt, Artificial Sequence
  RNA Oligomer
uagcaaguuucuaauuucugaga

SEQ ID NO: 33703 - RNA, 23 nt, Artificial Sequence
  RNA Oligomer
agcaaguuucuaauuucugagau

SEQ ID NO: 33704 - RNA, 23 nt, Artificial Sequence
  RNA Oligomer
gcaaguuucuaauuucugagaua

SEQ ID NO: 33705 - RNA, 23 nt, Artificial Sequence
  RNA Oligomer
caaguuucuaauuucugagauac

SEQ ID NO: 33706 - RNA, 23 nt, Artificial Sequence
  RNA Oligomer
caccguucuccuuucuucgauau

SEQ ID NO: 33707 - RNA, 23 nt, Artificial Sequence
  RNA Oligomer
cugguaccguagcuuaguuucaa

SEQ ID NO: 33708 - RNA, 23 nt, Artificial Sequence
  RNA Oligomer
ugguaccguagcuuaguuucaau

SEQ ID NO: 33709 - RNA, 23 nt, Artificial Sequence
  RNA Oligomer
gguaccguagcuuaguuucaaua

SEQ ID NO: 33710 - RNA, 23 nt, Artificial Sequence
  RNA Oligomer
guaccguagcuuaguuucaauau

SEQ ID NO: 33711 - RNA, 23 nt, Artificial Sequence
  RNA Oligomer
uaccguagcuuaguuucaauauu

SEQ ID NO: 33712 - RNA, 23 nt, Artificial Sequence
  RNA Oligomer
cccaacugcccaauaaaugaucc

SEQ ID NO: 33713 - RNA, 23 nt, Artificial Sequence
  RNA Oligomer
ccaacugcccaauaaaugauccu

SEQ ID NO: 33714 - RNA, 23 nt, Artificial Sequence
  RNA Oligomer
caacugcccaauaaaugauccua

SEQ ID NO: 33715 - RNA, 23 nt, Artificial Sequence
  RNA Oligomer
aacugcccaauaaaugauccuau

SEQ ID NO: 33716 - RNA, 23 nt, Artificial Sequence
  RNA Oligomer
acugcccaauaaaugauccuauu

SEQ ID NO: 33717 - RNA, 23 nt, Artificial Sequence
  RNA Oligomer
gcugacguagaugcuuuauuuca

SEQ ID NO: 33718 - RNA, 23 nt, Artificial Sequence
  RNA Oligomer
cugacguagaugcuuuauuucau

SEQ ID NO: 33719 - RNA, 23 nt, Artificial Sequence
  RNA Oligomer
ugacguagaugcuuuauuucauc

SEQ ID NO: 33720 - RNA, 23 nt, Artificial Sequence
  RNA Oligomer
gacguagaugcuuuauuucauca

SEQ ID NO: 33721 - RNA, 23 nt, Artificial Sequence
  RNA Oligomer
acguagaugcuuuauuucaucac

SEQ ID NO: 33722 - RNA, 23 nt, Artificial Sequence
  RNA Oligomer
ugcuuuauuucaucacgcuaaau

SEQ ID NO: 33723 - RNA, 23 nt, Artificial Sequence
  RNA Oligomer
ucuucuagagacauucuucaucg

SEQ ID NO: 33724 - RNA, 23 nt, Artificial Sequence
  RNA Oligomer
agagacauucuucaucgcuuuca

SEQ ID NO: 33725 - RNA, 23 nt, Artificial Sequence
  RNA Oligomer
gagacauucuucaucgcuuucaa

SEQ ID NO: 33726 - RNA, 23 nt, Artificial Sequence
  RNA Oligomer
agacauucuucaucgcuuucaag

SEQ ID NO: 33727 - RNA, 23 nt, Artificial Sequence
  RNA Oligomer
gacauucuucaucgcuuucaagc

SEQ ID NO: 33728 - RNA, 23 nt, Artificial Sequence
  RNA Oligomer
acauucuucaucgcuuucaagcu

SEQ ID NO: 33729 - RNA, 23 nt, Artificial Sequence
  RNA Oligomer
uuucaagcuacauugucauuaaa

SEQ ID NO: 33730 - RNA, 23 nt, Artificial Sequence
  RNA Oligomer
cguauuacuucuucuuaacagag

SEQ ID NO: 33731 - RNA, 23 nt, Artificial Sequence
  RNA Oligomer
guauuacuucuucuuaacagaga

SEQ ID NO: 33732 - RNA, 23 nt, Artificial Sequence
  RNA Oligomer
uauuacuucuucuuaacagagau

SEQ ID NO: 33733 - RNA, 23 nt, Artificial Sequence
  RNA Oligomer
auuacuucuucuuaacagagauu

SEQ ID NO: 33734 - RNA, 23 nt, Artificial Sequence
  RNA Oligomer
uuacuucuucuuaacagagauua

SEQ ID NO: 33735 - RNA, 23 nt, Artificial Sequence
  RNA Oligomer
cuuuuuaaacuuggauccugaga

SEQ ID NO: 33736 - RNA, 23 nt, Artificial Sequence
  RNA Oligomer
uuuuuaaacuuggauccugagau

SEQ ID NO: 33737 - RNA, 23 nt, Artificial Sequence
  RNA Oligomer
uuuuaaacuuggauccugagauc

SEQ ID NO: 33738 - RNA, 23 nt, Artificial Sequence
  RNA Oligomer
uuaugcccaucuucuccugaacu

SEQ ID NO: 33739 - RNA, 23 nt, Artificial Sequence
  RNA Oligomer
cuccauaaagaaauugggagcac

SEQ ID NO: 33740 - RNA, 23 nt, Artificial Sequence
  RNA Oligomer
uccauaaagaaauugggagcacu

SEQ ID NO: 33741 - RNA, 23 nt, Artificial Sequence
  RNA Oligomer
ccauaaagaaauugggagcacug

SEQ ID NO: 33742 - RNA, 23 nt, Artificial Sequence
  RNA Oligomer
cauaaagaaauugggagcacuga

SEQ ID NO: 33743 - RNA, 23 nt, Artificial Sequence
  RNA Oligomer
auaaagaaauugggagcacugag

SEQ ID NO: 33744 - RNA, 23 nt, Artificial Sequence
  RNA Oligomer
aguguagccuuccuccauuuccu

SEQ ID NO: 33745 - RNA, 23 nt, Artificial Sequence
  RNA Oligomer
guguagccuuccuccauuuccuc

SEQ ID NO: 33746 - RNA, 23 nt, Artificial Sequence
  RNA Oligomer
uguagccuuccuccauuuccucg

SEQ ID NO: 33747 - RNA, 23 nt, Artificial Sequence
  RNA Oligomer
guagccuuccuccauuuccucgc

SEQ ID NO: 33748 - RNA, 23 nt, Artificial Sequence
  RNA Oligomer
uagccuuccuccauuuccucgca

SEQ ID NO: 33749 - RNA, 23 nt, Artificial Sequence
  RNA Oligomer
cuccauuuccucgcacuuaucug

SEQ ID NO: 33750 - RNA, 23 nt, Artificial Sequence
  RNA Oligomer
uccauuuccucgcacuuaucugc

SEQ ID NO: 33751 - RNA, 23 nt, Artificial Sequence
  RNA Oligomer
ccauuuccucgcacuuaucugca

SEQ ID NO: 33752 - RNA, 23 nt, Artificial Sequence
  RNA Oligomer
cauuuccucgcacuuaucugcag

SEQ ID NO: 33753 - RNA, 23 nt, Artificial Sequence
  RNA Oligomer
auuuccucgcacuuaucugcagc

SEQ ID NO: 33754 - RNA, 23 nt, Artificial Sequence
  RNA Oligomer
uacacacuuggacguuguuacau

SEQ ID NO: 33755 - RNA, 23 nt, Artificial Sequence
  RNA Oligomer
acacacuuggacguuguuacaug

SEQ ID NO: 33756 - RNA, 23 nt, Artificial Sequence
  RNA Oligomer
ccagguacacaucaagcacaugu

SEQ ID NO: 33757 - RNA, 23 nt, Artificial Sequence
  RNA Oligomer
cagguacacaucaagcacaugug

SEQ ID NO: 33758 - RNA, 23 nt, Artificial Sequence
  RNA Oligomer
agguacacaucaagcacaugugg

SEQ ID NO: 33759 - RNA, 23 nt, Artificial Sequence
  RNA Oligomer
gguacacaucaagcacaugugga

SEQ ID NO: 33760 - RNA, 23 nt, Artificial Sequence
  RNA Oligomer
ccucuggauuugguucuucuggg

SEQ ID NO: 33761 - RNA, 23 nt, Artificial Sequence
  RNA Oligomer
cucuggauuugguucuucugggu

SEQ ID NO: 33762 - RNA, 23 nt, Artificial Sequence
  RNA Oligomer
ucuggauuugguucuucuggguu

SEQ ID NO: 33763 - RNA, 23 nt, Artificial Sequence
  RNA Oligomer
cuggauuugguucuucuggguua

SEQ ID NO: 33764 - RNA, 23 nt, Artificial Sequence
  RNA Oligomer
uggauuugguucuucuggguuau

SEQ ID NO: 33765 - RNA, 23 nt, Artificial Sequence
  RNA Oligomer
uauucuggagauuugggcuguug

SEQ ID NO: 33766 - RNA, 23 nt, Artificial Sequence
  RNA Oligomer
auucuggagauuugggcuguugu

SEQ ID NO: 33767 - RNA, 23 nt, Artificial Sequence
  RNA Oligomer
uucuggagauuugggcuguuguc

SEQ ID NO: 33768 - RNA, 23 nt, Artificial Sequence
  RNA Oligomer
ucccucaggcucauaaucaaggc

SEQ ID NO: 33769 - RNA, 23 nt, Artificial Sequence
  RNA Oligomer
cccucaggcucauaaucaaggcc

SEQ ID NO: 33770 - RNA, 23 nt, Artificial Sequence
  RNA Oligomer
ccucaggcucauaaucaaggccu

SEQ ID NO: 33771 - RNA, 23 nt, Artificial Sequence
  RNA Oligomer
cucaggcucauaaucaaggccug

SEQ ID NO: 33772 - RNA, 23 nt, Artificial Sequence
  RNA Oligomer
ucaggcucauaaucaaggccugg

SEQ ID NO: 33773 - RNA, 23 nt, Artificial Sequence
  RNA Oligomer
acuguucucuguacuggcauucc

SEQ ID NO: 33774 - RNA, 23 nt, Artificial Sequence
  RNA Oligomer
cuguucucuguacuggcauuccc

SEQ ID NO: 33775 - RNA, 23 nt, Artificial Sequence
  RNA Oligomer
uguucucuguacuggcauucccc

SEQ ID NO: 33776 - RNA, 23 nt, Artificial Sequence
  RNA Oligomer
guucucuguacuggcauucccca

SEQ ID NO: 33777 - RNA, 23 nt, Artificial Sequence
  RNA Oligomer
uucucuguacuggcauuccccac

SEQ ID NO: 33778 - RNA, 23 nt, Artificial Sequence
  RNA Oligomer
uguaaauauggauucuggauuuc

SEQ ID NO: 33779 - RNA, 23 nt, Artificial Sequence
  RNA Oligomer
guaaauauggauucuggauuucu

SEQ ID NO: 33780 - RNA, 23 nt, Artificial Sequence
  RNA Oligomer
uaaauauggauucuggauuucua

SEQ ID NO: 33781 - RNA, 23 nt, Artificial Sequence
  RNA Oligomer
aaauauggauucuggauuucuac

SEQ ID NO: 33782 - RNA, 23 nt, Artificial Sequence
  RNA Oligomer
aauauggauucuggauuucuacu

SEQ ID NO: 33783 - RNA, 23 nt, Artificial Sequence
  RNA Oligomer
ucuggauuucuacugggcuuucu

SEQ ID NO: 33784 - RNA, 23 nt, Artificial Sequence
  RNA Oligomer
cuggauuucuacugggcuuucug

SEQ ID NO: 33785 - RNA, 23 nt, Artificial Sequence
  RNA Oligomer
uucuacugggcuuucugagcugg

SEQ ID NO: 33786 - RNA, 23 nt, Artificial Sequence
  RNA Oligomer
ggccuuggugcguuagacaguuu

SEQ ID NO: 33787 - RNA, 23 nt, Artificial Sequence
  RNA Oligomer
agacaguuucuuucguaaggcuu

SEQ ID NO: 33788 - RNA, 23 nt, Artificial Sequence
  RNA Oligomer
gacaguuucuuucguaaggcuuc

SEQ ID NO: 33789 - RNA, 23 nt, Artificial Sequence
  RNA Oligomer
gcaucacucugguuucgguaagg

SEQ ID NO: 33790 - RNA, 23 nt, Artificial Sequence
  RNA Oligomer
caucacucugguuucgguaagga

SEQ ID NO: 33791 - RNA, 23 nt, Artificial Sequence
  RNA Oligomer
aucacucugguuucgguaaggau

SEQ ID NO: 33792 - RNA, 23 nt, Artificial Sequence
  RNA Oligomer
ucacucugguuucgguaaggauu

SEQ ID NO: 33793 - RNA, 23 nt, Artificial Sequence
  RNA Oligomer
cacucugguuucgguaaggauua

SEQ ID NO: 33794 - RNA, 23 nt, Artificial Sequence
  RNA Oligomer
cgguaaggauuagauaagaaagg

SEQ ID NO: 33795 - RNA, 23 nt, Artificial Sequence
  RNA Oligomer
gguaaggauuagauaagaaaggc

SEQ ID NO: 33796 - RNA, 23 nt, Artificial Sequence
  RNA Oligomer
guaaggauuagauaagaaaggca

SEQ ID NO: 33797 - RNA, 23 nt, Artificial Sequence
  RNA Oligomer
uaaggauuagauaagaaaggcag

SEQ ID NO: 33798 - RNA, 23 nt, Artificial Sequence
  RNA Oligomer
aaggauuagauaagaaaggcagu

SEQ ID NO: 33799 - RNA, 23 nt, Artificial Sequence
  RNA Oligomer
aggauuagauaagaaaggcagua

SEQ ID NO: 33800 - RNA, 23 nt, Artificial Sequence
  RNA Oligomer
aaauguucucugggugcugcugu

SEQ ID NO: 33801 - RNA, 23 nt, Artificial Sequence
  RNA Oligomer
gcaauuacaggcuuaccauauac

SEQ ID NO: 33802 - RNA, 23 nt, Artificial Sequence
  RNA Oligomer
caauuacaggcuuaccauauaca

SEQ ID NO: 33803 - RNA, 23 nt, Artificial Sequence
  RNA Oligomer
aauuacaggcuuaccauauacac

SEQ ID NO: 33804 - RNA, 23 nt, Artificial Sequence
  RNA Oligomer
auuacaggcuuaccauauacacu

SEQ ID NO: 33805 - RNA, 23 nt, Artificial Sequence
  RNA Oligomer
uuacaggcuuaccauauacacuu

SEQ ID NO: 33806 - RNA, 23 nt, Artificial Sequence
  RNA Oligomer
cuggagaaagggucuggucuugg

SEQ ID NO: 33807 - RNA, 23 nt, Artificial Sequence
  RNA Oligomer
uggagaaagggucuggucuuggc

SEQ ID NO: 33808 - RNA, 23 nt, Artificial Sequence
  RNA Oligomer
ggagaaagggucuggucuuggcc

SEQ ID NO: 33809 - RNA, 23 nt, Artificial Sequence
  RNA Oligomer
gagaaagggucuggucuuggcca

SEQ ID NO: 33810 - RNA, 23 nt, Artificial Sequence
  RNA Oligomer
agaaagggucuggucuuggccaa

SEQ ID NO: 33811 - RNA, 23 nt, Artificial Sequence
  RNA Oligomer
ccugcugguuuugguuuaguucc

SEQ ID NO: 33812 - RNA, 23 nt, Artificial Sequence
  RNA Oligomer
acuuuagccacauuuuuauuugc

SEQ ID NO: 33813 - RNA, 23 nt, Artificial Sequence
  RNA Oligomer
cccgcaagauaucuucacugcuc

SEQ ID NO: 33814 - RNA, 23 nt, Artificial Sequence
  RNA Oligomer
auaucuucacugcucugguucuu

SEQ ID NO: 33815 - RNA, 23 nt, Artificial Sequence
  RNA Oligomer
ccggguucuuugcacagauccac

SEQ ID NO: 33816 - RNA, 23 nt, Artificial Sequence
  RNA Oligomer
ggucuacugcaucaaacauugag

SEQ ID NO: 33817 - RNA, 23 nt, Artificial Sequence
  RNA Oligomer
gucuacugcaucaaacauugaga

SEQ ID NO: 33818 - RNA, 23 nt, Artificial Sequence
  RNA Oligomer
ucuacugcaucaaacauugagaa

SEQ ID NO: 33819 - RNA, 23 nt, Artificial Sequence
  RNA Oligomer
cuacugcaucaaacauugagaac

SEQ ID NO: 33820 - RNA, 23 nt, Artificial Sequence
  RNA Oligomer
uacugcaucaaacauugagaacg

SEQ ID NO: 33821 - RNA, 23 nt, Artificial Sequence
  RNA Oligomer
acgcacuuucuucucuuucuccc

SEQ ID NO: 33822 - RNA, 23 nt, Artificial Sequence
  RNA Oligomer
cgcacuuucuucucuuucucccu

SEQ ID NO: 33823 - RNA, 23 nt, Artificial Sequence
  RNA Oligomer
gcacuuucuucucuuucucccuc

SEQ ID NO: 33824 - RNA, 23 nt, Artificial Sequence
  RNA Oligomer
cacuuucuucucuuucucccuca

SEQ ID NO: 33825 - RNA, 23 nt, Artificial Sequence
  RNA Oligomer
acuuucuucucuuucucccucag

SEQ ID NO: 33826 - RNA, 23 nt, Artificial Sequence
  RNA Oligomer
cuugauccagagcauucccagug

SEQ ID NO: 33827 - RNA, 23 nt, Artificial Sequence
  RNA Oligomer
uugauccagagcauucccagugc

SEQ ID NO: 33828 - RNA, 23 nt, Artificial Sequence
  RNA Oligomer
ugauccagagcauucccagugcu

SEQ ID NO: 33829 - RNA, 23 nt, Artificial Sequence
  RNA Oligomer
gauccagagcauucccagugcuu

SEQ ID NO: 33830 - RNA, 23 nt, Artificial Sequence
  RNA Oligomer
auccagagcauucccagugcuuu

SEQ ID NO: 33831 - RNA, 23 nt, Artificial Sequence
  RNA Oligomer
caacuggauggauuuuagagccu

SEQ ID NO: 33832 - RNA, 23 nt, Artificial Sequence
  RNA Oligomer
aacuggauggauuuuagagccuu

SEQ ID NO: 33833 - RNA, 23 nt, Artificial Sequence
  RNA Oligomer
acuggauggauuuuagagccuuu

SEQ ID NO: 33834 - RNA, 23 nt, Artificial Sequence
  RNA Oligomer
cuggauggauuuuagagccuuua

SEQ ID NO: 33835 - RNA, 23 nt, Artificial Sequence
  RNA Oligomer
uggauggauuuuagagccuuuag

SEQ ID NO: 33836 - RNA, 23 nt, Artificial Sequence
  RNA Oligomer
ggauggauuuuagagccuuuagu

SEQ ID NO: 33837 - RNA, 23 nt, Artificial Sequence
  RNA Oligomer
gauggauuuuagagccuuuaguu

SEQ ID NO: 33838 - RNA, 23 nt, Artificial Sequence
  RNA Oligomer
auggauuuuagagccuuuaguuu

SEQ ID NO: 33839 - RNA, 23 nt, Artificial Sequence
  RNA Oligomer
ccacgucucugcauauuguuucu

SEQ ID NO: 33840 - RNA, 23 nt, Artificial Sequence
  RNA Oligomer
cacgucucugcauauuguuucug

SEQ ID NO: 33841 - RNA, 23 nt, Artificial Sequence
  RNA Oligomer
gucuguauuuucaucggccccuc

SEQ ID NO: 33842 - RNA, 23 nt, Artificial Sequence
  RNA Oligomer
ucuguauuuucaucggccccucu

SEQ ID NO: 33843 - RNA, 23 nt, Artificial Sequence
  RNA Oligomer
ugcauauuguuucuggaguaacu

SEQ ID NO: 33844 - RNA, 23 nt, Artificial Sequence
  RNA Oligomer
ggggaagauuuccaucagaugaa

SEQ ID NO: 33845 - RNA, 23 nt, Artificial Sequence
  RNA Oligomer
gggaagauuuccaucagaugaaa

SEQ ID NO: 33846 - RNA, 23 nt, Artificial Sequence
  RNA Oligomer
ggaagauuuccaucagaugaaac

SEQ ID NO: 33847 - RNA, 23 nt, Artificial Sequence
  RNA Oligomer
ccggucccucagcucauuaacac

SEQ ID NO: 33848 - RNA, 23 nt, Artificial Sequence
  RNA Oligomer
cggucccucagcucauuaacacg

SEQ ID NO: 33849 - RNA, 23 nt, Artificial Sequence
  RNA Oligomer
caugacugccacuucugaauuac

SEQ ID NO: 33850 - RNA, 23 nt, Artificial Sequence
  RNA Oligomer
augacugccacuucugaauuacg

SEQ ID NO: 33851 - RNA, 23 nt, Artificial Sequence
  RNA Oligomer
ucuguuguuguagcuuggcauuc

SEQ ID NO: 33852 - RNA, 23 nt, Artificial Sequence
  RNA Oligomer
gauucaauuuguuucuuagcugc

SEQ ID NO: 33853 - RNA, 23 nt, Artificial Sequence
  RNA Oligomer
uagucucuucuguuccacguggc

SEQ ID NO: 33854 - RNA, 23 nt, Artificial Sequence
  RNA Oligomer
agucucuucuguuccacguggcc

SEQ ID NO: 33855 - RNA, 23 nt, Artificial Sequence
  RNA Oligomer
gucucuucuguuccacguggccu

SEQ ID NO: 33856 - RNA, 23 nt, Artificial Sequence
  RNA Oligomer
ucucuucuguuccacguggccuu

SEQ ID NO: 33857 - RNA, 23 nt, Artificial Sequence
  RNA Oligomer
uuuagcuuagcuuccugauucuc

SEQ ID NO: 33858 - RNA, 23 nt, Artificial Sequence
  RNA Oligomer
uuagcuuagcuuccugauucuca

SEQ ID NO: 33859 - RNA, 23 nt, Artificial Sequence
  RNA Oligomer
uagcuuagcuuccugauucucag

SEQ ID NO: 33860 - RNA, 23 nt, Artificial Sequence
  RNA Oligomer
agcgcuguuccuuaguugccagc

SEQ ID NO: 33861 - RNA, 23 nt, Artificial Sequence
  RNA Oligomer
gcgcuguuccuuaguugccagca

SEQ ID NO: 33862 - RNA, 23 nt, Artificial Sequence
  RNA Oligomer
cgcuguuccuuaguugccagcaa

SEQ ID NO: 33863 - RNA, 23 nt, Artificial Sequence
  RNA Oligomer
gcuguuccuuaguugccagcaau

SEQ ID NO: 33864 - RNA, 23 nt, Artificial Sequence
  RNA Oligomer
cuguuccuuaguugccagcaauu

SEQ ID NO: 33865 - RNA, 23 nt, Artificial Sequence
  RNA Oligomer
ugacaaauauuacggguaagucu

SEQ ID NO: 33866 - RNA, 23 nt, Artificial Sequence
  RNA Oligomer
gacaaauauuacggguaagucug

SEQ ID NO: 33867 - RNA, 23 nt, Artificial Sequence
  RNA Oligomer
acaaauauuacggguaagucugu

SEQ ID NO: 33868 - RNA, 23 nt, Artificial Sequence
  RNA Oligomer
caaauauuacggguaagucugua

SEQ ID NO: 33869 - RNA, 23 nt, Artificial Sequence
  RNA Oligomer
aaauauuacggguaagucuguag

SEQ ID NO: 33870 - RNA, 23 nt, Artificial Sequence
  RNA Oligomer
acugacaaccaacuaacaguucu

SEQ ID NO: 33871 - RNA, 23 nt, Artificial Sequence
  RNA Oligomer
cugacaaccaacuaacaguucuu

SEQ ID NO: 33872 - RNA, 23 nt, Artificial Sequence
  RNA Oligomer
gcuuuauuucaucacgcuaaaug

SEQ ID NO: 33873 - RNA, 23 nt, Artificial Sequence
  RNA Oligomer
cuuuauuucaucacgcuaaaugu

SEQ ID NO: 33874 - RNA, 23 nt, Artificial Sequence
  RNA Oligomer
uuuauuucaucacgcuaaauguc

SEQ ID NO: 33875 - RNA, 23 nt, Artificial Sequence
  RNA Oligomer
uccucuaauggugaauucuucaa

SEQ ID NO: 33876 - RNA, 23 nt, Artificial Sequence
  RNA Oligomer
ccucuaauggugaauucuucaau

SEQ ID NO: 33877 - RNA, 23 nt, Artificial Sequence
  RNA Oligomer
aaguuucaggccaagcuccuuug

SEQ ID NO: 33878 - RNA, 23 nt, Artificial Sequence
  RNA Oligomer
aguuucaggccaagcuccuuugu

SEQ ID NO: 33879 - RNA, 23 nt, Artificial Sequence
  RNA Oligomer
guuucaggccaagcuccuuuguc

SEQ ID NO: 33880 - RNA, 23 nt, Artificial Sequence
  RNA Oligomer
uuucaggccaagcuccuuugucu

SEQ ID NO: 33881 - RNA, 23 nt, Artificial Sequence
  RNA Oligomer
uucaggccaagcuccuuugucuu

SEQ ID NO: 33882 - RNA, 23 nt, Artificial Sequence
  RNA Oligomer
aacauaucccuccuuaucauuaa

SEQ ID NO: 33883 - RNA, 23 nt, Artificial Sequence
  RNA Oligomer
acauaucccuccuuaucauuaag

SEQ ID NO: 33884 - RNA, 23 nt, Artificial Sequence
  RNA Oligomer
cauaucccuccuuaucauuaagg

SEQ ID NO: 33885 - RNA, 23 nt, Artificial Sequence
  RNA Oligomer
auaucccuccuuaucauuaaggc

SEQ ID NO: 33886 - RNA, 23 nt, Artificial Sequence
  RNA Oligomer
uaucccuccuuaucauuaaggcg

SEQ ID NO: 33887 - RNA, 23 nt, Artificial Sequence
  RNA Oligomer
augauugucaugcagucuccuuc

SEQ ID NO: 33888 - RNA, 23 nt, Artificial Sequence
  RNA Oligomer
ugauugucaugcagucuccuucu

SEQ ID NO: 33889 - RNA, 23 nt, Artificial Sequence
  RNA Oligomer
gauugucaugcagucuccuucuu

SEQ ID NO: 33890 - RNA, 23 nt, Artificial Sequence
  RNA Oligomer
auugucaugcagucuccuucuuu

SEQ ID NO: 33891 - RNA, 23 nt, Artificial Sequence
  RNA Oligomer
uugucaugcagucuccuucuuuc

SEQ ID NO: 33892 - RNA, 23 nt, Artificial Sequence
  RNA Oligomer
guucauaaucccaaagcgcauaa

SEQ ID NO: 33893 - RNA, 23 nt, Artificial Sequence
  RNA Oligomer
uucauaaucccaaagcgcauaaa

SEQ ID NO: 33894 - RNA, 23 nt, Artificial Sequence
  RNA Oligomer
ucauaaucccaaagcgcauaaau

SEQ ID NO: 33895 - RNA, 23 nt, Artificial Sequence
  RNA Oligomer
cauaaucccaaagcgcauaaaug

SEQ ID NO: 33896 - RNA, 23 nt, Artificial Sequence
  RNA Oligomer
auaaucccaaagcgcauaaauga

SEQ ID NO: 33897 - RNA, 23 nt, Artificial Sequence
  RNA Oligomer
aggcagcacaauguaauggaguc

SEQ ID NO: 33898 - RNA, 23 nt, Artificial Sequence
  RNA Oligomer
ggucaaauucucccuccaaagac

SEQ ID NO: 33899 - RNA, 23 nt, Artificial Sequence
  RNA Oligomer
uuuuacgcaaguuuguccuuuua

SEQ ID NO: 33900 - RNA, 23 nt, Artificial Sequence
  RNA Oligomer
cuccuuuucgggcuccacaugua

SEQ ID NO: 33901 - RNA, 23 nt, Artificial Sequence
  RNA Oligomer
uccuuuucgggcuccacauguaa

SEQ ID NO: 33902 - RNA, 23 nt, Artificial Sequence
  RNA Oligomer
ccuuuucgggcuccacauguaaa

SEQ ID NO: 33903 - RNA, 23 nt, Artificial Sequence
  RNA Oligomer
cuuuucgggcuccacauguaaau

SEQ ID NO: 33904 - RNA, 23 nt, Artificial Sequence
  RNA Oligomer
uuuucgggcuccacauguaaaua

SEQ ID NO: 33905 - RNA, 23 nt, Artificial Sequence
  RNA Oligomer
augaugggacagagauggucucc

SEQ ID NO: 33906 - RNA, 23 nt, Artificial Sequence
  RNA Oligomer
agcuucugaauauuuggcccauu

SEQ ID NO: 33907 - RNA, 23 nt, Artificial Sequence
  RNA Oligomer
gcuucugaauauuuggcccauua

SEQ ID NO: 33908 - RNA, 23 nt, Artificial Sequence
  RNA Oligomer
cuucugaauauuuggcccauuag

SEQ ID NO: 33909 - RNA, 23 nt, Artificial Sequence
  RNA Oligomer
ucguugaagaacaucaaacauuc

SEQ ID NO: 33910 - RNA, 23 nt, Artificial Sequence
  RNA Oligomer
cguugaagaacaucaaacauucg

SEQ ID NO: 33911 - RNA, 23 nt, Artificial Sequence
  RNA Oligomer
cuggcucuguaauagaacuacgu

SEQ ID NO: 33912 - RNA, 23 nt, Artificial Sequence
  RNA Oligomer
uggcucuguaauagaacuacguu

SEQ ID NO: 33913 - RNA, 23 nt, Artificial Sequence
  RNA Oligomer
ggcucuguaauagaacuacguuu

SEQ ID NO: 33914 - RNA, 23 nt, Artificial Sequence
  RNA Oligomer
auagaacuacguuucuuuagagg

SEQ ID NO: 33915 - RNA, 23 nt, Artificial Sequence
  RNA Oligomer
uagaacuacguuucuuuagaggc

SEQ ID NO: 33916 - RNA, 23 nt, Artificial Sequence
  RNA Oligomer
agaacuacguuucuuuagaggcc

SEQ ID NO: 33917 - RNA, 23 nt, Artificial Sequence
  RNA Oligomer
gaacuacguuucuuuagaggccu

SEQ ID NO: 33918 - RNA, 23 nt, Artificial Sequence
  RNA Oligomer
aacuacguuucuuuagaggccuu

SEQ ID NO: 33919 - RNA, 23 nt, Artificial Sequence
  RNA Oligomer
agaacaucaaacauucgcucauu

SEQ ID NO: 33920 - RNA, 23 nt, Artificial Sequence
  RNA Oligomer
acaguuucuuucguaaggcuucu

SEQ ID NO: 33921 - RNA, 23 nt, Artificial Sequence
  RNA Oligomer
caguuucuuucguaaggcuucua

SEQ ID NO: 33922 - RNA, 23 nt, Artificial Sequence
  RNA Oligomer
aguuucuuucguaaggcuucuag

SEQ ID NO: 33923 - RNA, 23 nt, Artificial Sequence
  RNA Oligomer
guuucuuucguaaggcuucuagg

SEQ ID NO: 33924 - RNA, 23 nt, Artificial Sequence
  RNA Oligomer
uuucuuucguaaggcuucuaggu

SEQ ID NO: 33925 - RNA, 23 nt, Artificial Sequence
  RNA Oligomer
acauucgcucauuauccgcaacu

SEQ ID NO: 33926 - RNA, 23 nt, Artificial Sequence
  RNA Oligomer
uauauugaacuugcugccacggu

SEQ ID NO: 33927 - RNA, 23 nt, Artificial Sequence
  RNA Oligomer
auauugaacuugcugccacgguc

SEQ ID NO: 33928 - RNA, 23 nt, Artificial Sequence
  RNA Oligomer
uauugaacuugcugccacggucu

SEQ ID NO: 33929 - RNA, 23 nt, Artificial Sequence
  RNA Oligomer
acugcaucaaacauugagaacgg

SEQ ID NO: 33930 - RNA, 23 nt, Artificial Sequence
  RNA Oligomer
cugcaucaaacauugagaacgga

SEQ ID NO: 33931 - RNA, 23 nt, Artificial Sequence
  RNA Oligomer
ugcaucaaacauugagaacggac

SEQ ID NO: 33932 - RNA, 23 nt, Artificial Sequence
  RNA Oligomer
gcaucaaacauugagaacggacg

SEQ ID NO: 33933 - RNA, 23 nt, Artificial Sequence
  RNA Oligomer
caucaaacauugagaacggacgc

SEQ ID NO: 33934 - RNA, 23 nt, Artificial Sequence
  RNA Oligomer
acauugagaacggacgcacuuuc

SEQ ID NO: 33935 - RNA, 23 nt, Artificial Sequence
  RNA Oligomer
cuuucuucucuuucucccucagc

SEQ ID NO: 33936 - RNA, 23 nt, Artificial Sequence
  RNA Oligomer
caucaucaacuugauccagagca

SEQ ID NO: 33937 - RNA, 23 nt, Artificial Sequence
  RNA Oligomer
aucaucaacuugauccagagcau

SEQ ID NO: 33938 - RNA, 23 nt, Artificial Sequence
  RNA Oligomer
ucaucaacuugauccagagcauu

SEQ ID NO: 33939 - RNA, 23 nt, Artificial Sequence
  RNA Oligomer
caucaacuugauccagagcauuc

SEQ ID NO: 33940 - RNA, 23 nt, Artificial Sequence
  RNA Oligomer
ugcuuugagguacagaagcagag

SEQ ID NO: 33941 - RNA, 23 nt, Artificial Sequence
  RNA Oligomer
gcuuugagguacagaagcagagc

SEQ ID NO: 33942 - RNA, 23 nt, Artificial Sequence
  RNA Oligomer
cuuugagguacagaagcagagcc

SEQ ID NO: 33943 - RNA, 23 nt, Artificial Sequence
  RNA Oligomer
uuugagguacagaagcagagccu

SEQ ID NO: 33944 - RNA, 23 nt, Artificial Sequence
  RNA Oligomer
uugagguacagaagcagagccuu

SEQ ID NO: 33945 - RNA, 23 nt, Artificial Sequence
  RNA Oligomer
ucugcauuugaaggacuccaauc

SEQ ID NO: 33946 - RNA, 23 nt, Artificial Sequence
  RNA Oligomer
acaucggcaucaucuuggacccg

SEQ ID NO: 33947 - RNA, 23 nt, Artificial Sequence
  RNA Oligomer
caucggcaucaucuuggacccga

SEQ ID NO: 33948 - RNA, 23 nt, Artificial Sequence
  RNA Oligomer
aucggcaucaucuuggacccgaa

SEQ ID NO: 33949 - RNA, 23 nt, Artificial Sequence
  RNA Oligomer
gcuuauccaugacugccacuucu

SEQ ID NO: 33950 - RNA, 23 nt, Artificial Sequence
  RNA Oligomer
cuuauccaugacugccacuucug

SEQ ID NO: 33951 - RNA, 23 nt, Artificial Sequence
  RNA Oligomer
uuauccaugacugccacuucuga

SEQ ID NO: 33952 - RNA, 23 nt, Artificial Sequence
  RNA Oligomer
uauccaugacugccacuucugaa

SEQ ID NO: 33953 - RNA, 23 nt, Artificial Sequence
  RNA Oligomer
auccaugacugccacuucugaau

SEQ ID NO: 33954 - RNA, 23 nt, Artificial Sequence
  RNA Oligomer
cuguuguuguagcuuggcauucu

SEQ ID NO: 33955 - RNA, 23 nt, Artificial Sequence
  RNA Oligomer
ucuuuuagccuuuuaaguuucuc

SEQ ID NO: 33956 - RNA, 23 nt, Artificial Sequence
  RNA Oligomer
uuuaaguuucuccugcucagcaa

SEQ ID NO: 33957 - RNA, 23 nt, Artificial Sequence
  RNA Oligomer
uuaaguuucuccugcucagcaac

SEQ ID NO: 33958 - RNA, 23 nt, Artificial Sequence
  RNA Oligomer
ugcucauuguuacugagauacac

SEQ ID NO: 33959 - RNA, 23 nt, Artificial Sequence
  RNA Oligomer
gggcuucaaucuguugcugcugg

SEQ ID NO: 33960 - RNA, 23 nt, Artificial Sequence
  RNA Oligomer
uccauccuaggacuauuaacacc

SEQ ID NO: 33961 - RNA, 23 nt, Artificial Sequence
  RNA Oligomer
ccauccuaggacuauuaacaccg

SEQ ID NO: 33962 - RNA, 23 nt, Artificial Sequence
  RNA Oligomer
cauccuaggacuauuaacaccgu

SEQ ID NO: 33963 - RNA, 23 nt, Artificial Sequence
  RNA Oligomer
auccuaggacuauuaacaccguu

SEQ ID NO: 33964 - RNA, 23 nt, Artificial Sequence
  RNA Oligomer
uccuaggacuauuaacaccguuc

SEQ ID NO: 33965 - RNA, 23 nt, Artificial Sequence
  RNA Oligomer
ccuaggacuauuaacaccguucu

SEQ ID NO: 33966 - RNA, 23 nt, Artificial Sequence
  RNA Oligomer
uugacaaauauuacggguaaguc

SEQ ID NO: 33967 - RNA, 23 nt, Artificial Sequence
  RNA Oligomer
uuaaaauucagccuacaaacaag

SEQ ID NO: 33968 - RNA, 23 nt, Artificial Sequence
  RNA Oligomer
uaaaauucagccuacaaacaaga

SEQ ID NO: 33969 - RNA, 23 nt, Artificial Sequence
  RNA Oligomer
aaaauucagccuacaaacaagau

SEQ ID NO: 33970 - RNA, 23 nt, Artificial Sequence
  RNA Oligomer
aaauucagccuacaaacaagauu

SEQ ID NO: 33971 - RNA, 23 nt, Artificial Sequence
  RNA Oligomer
aauucagccuacaaacaagauuc

SEQ ID NO: 33972 - RNA, 23 nt, Artificial Sequence
  RNA Oligomer
ccuacaaacaagauucuacaucu

SEQ ID NO: 33973 - RNA, 23 nt, Artificial Sequence
  RNA Oligomer
cuacaaacaagauucuacaucua

SEQ ID NO: 33974 - RNA, 23 nt, Artificial Sequence
  RNA Oligomer
uacaaacaagauucuacaucuaa

SEQ ID NO: 33975 - RNA, 23 nt, Artificial Sequence
  RNA Oligomer
acaaacaagauucuacaucuaau

SEQ ID NO: 33976 - RNA, 23 nt, Artificial Sequence
  RNA Oligomer
caaacaagauucuacaucuaauu

SEQ ID NO: 33977 - RNA, 23 nt, Artificial Sequence
  RNA Oligomer
uaauaaaguuauuguucacugac

SEQ ID NO: 33978 - RNA, 23 nt, Artificial Sequence
  RNA Oligomer
aauaaaguuauuguucacugaca

SEQ ID NO: 33979 - RNA, 23 nt, Artificial Sequence
  RNA Oligomer
auaaaguuauuguucacugacaa

SEQ ID NO: 33980 - RNA, 23 nt, Artificial Sequence
  RNA Oligomer
uaaaguuauuguucacugacaac

SEQ ID NO: 33981 - RNA, 23 nt, Artificial Sequence
  RNA Oligomer
aaaguuauuguucacugacaacc

SEQ ID NO: 33982 - RNA, 23 nt, Artificial Sequence
  RNA Oligomer
uauacaagugugcagugccuucg

SEQ ID NO: 33983 - RNA, 23 nt, Artificial Sequence
  RNA Oligomer
auacaagugugcagugccuucga

SEQ ID NO: 33984 - RNA, 23 nt, Artificial Sequence
  RNA Oligomer
uucgauauucaccaggaacuuuu

SEQ ID NO: 33985 - RNA, 23 nt, Artificial Sequence
  RNA Oligomer
ucgauauucaccaggaacuuuua

SEQ ID NO: 33986 - RNA, 23 nt, Artificial Sequence
  RNA Oligomer
cgauauucaccaggaacuuuuac

SEQ ID NO: 33987 - RNA, 23 nt, Artificial Sequence
  RNA Oligomer
gauauucaccaggaacuuuuaca

SEQ ID NO: 33988 - RNA, 23 nt, Artificial Sequence
  RNA Oligomer
auauucaccaggaacuuuuacac

SEQ ID NO: 33989 - RNA, 23 nt, Artificial Sequence
  RNA Oligomer
ucaucacgcuaaauguccucuaa

SEQ ID NO: 33990 - RNA, 23 nt, Artificial Sequence
  RNA Oligomer
caucacgcuaaauguccucuaau

SEQ ID NO: 33991 - RNA, 23 nt, Artificial Sequence
  RNA Oligomer
aucacgcuaaauguccucuaaug

SEQ ID NO: 33992 - RNA, 23 nt, Artificial Sequence
  RNA Oligomer
acagucccagcaaguuacgugga

SEQ ID NO: 33993 - RNA, 23 nt, Artificial Sequence
  RNA Oligomer
cagucccagcaaguuacguggaa

SEQ ID NO: 33994 - RNA, 23 nt, Artificial Sequence
  RNA Oligomer
agucccagcaaguuacguggaac

SEQ ID NO: 33995 - RNA, 23 nt, Artificial Sequence
  RNA Oligomer
guggaacauaucccuccuuauca

SEQ ID NO: 33996 - RNA, 23 nt, Artificial Sequence
  RNA Oligomer
uggaacauaucccuccuuaucau

SEQ ID NO: 33997 - RNA, 23 nt, Artificial Sequence
  RNA Oligomer
ggaacauaucccuccuuaucauu

SEQ ID NO: 33998 - RNA, 23 nt, Artificial Sequence
  RNA Oligomer
gaacauaucccuccuuaucauua

SEQ ID NO: 33999 - RNA, 23 nt, Artificial Sequence
  RNA Oligomer
caucaucauucugagguucauaa

SEQ ID NO: 34000 - RNA, 23 nt, Artificial Sequence
  RNA Oligomer
aucaucauucugagguucauaau

SEQ ID NO: 34001 - RNA, 23 nt, Artificial Sequence
  RNA Oligomer
ucaucauucugagguucauaauc

SEQ ID NO: 34002 - RNA, 23 nt, Artificial Sequence
  RNA Oligomer
uauucauuaugcccaucuucucc

SEQ ID NO: 34003 - RNA, 23 nt, Artificial Sequence
  RNA Oligomer
uccugaacuccauaaagaaauug

SEQ ID NO: 34004 - RNA, 23 nt, Artificial Sequence
  RNA Oligomer
ccugaacuccauaaagaaauugg

SEQ ID NO: 34005 - RNA, 23 nt, Artificial Sequence
  RNA Oligomer
cugaacuccauaaagaaauuggg

SEQ ID NO: 34006 - RNA, 23 nt, Artificial Sequence
  RNA Oligomer
ugaacuccauaaagaaauuggga

SEQ ID NO: 34007 - RNA, 23 nt, Artificial Sequence
  RNA Oligomer
gaacuccauaaagaaauugggag

SEQ ID NO: 34008 - RNA, 23 nt, Artificial Sequence
  RNA Oligomer
gaguguagccuuccuccauuucc

SEQ ID NO: 34009 - RNA, 23 nt, Artificial Sequence
  RNA Oligomer
ucagcagcauuuacauuuacacc

SEQ ID NO: 34010 - RNA, 23 nt, Artificial Sequence
  RNA Oligomer
gaauuucacccucauuccaugag

SEQ ID NO: 34011 - RNA, 23 nt, Artificial Sequence
  RNA Oligomer
aauuucacccucauuccaugagc

SEQ ID NO: 34012 - RNA, 23 nt, Artificial Sequence
  RNA Oligomer
auuucacccucauuccaugagcg

SEQ ID NO: 34013 - RNA, 23 nt, Artificial Sequence
  RNA Oligomer
cuccuccagguacacaucaagca

SEQ ID NO: 34014 - RNA, 23 nt, Artificial Sequence
  RNA Oligomer
uccuccagguacacaucaagcac

SEQ ID NO: 34015 - RNA, 23 nt, Artificial Sequence
  RNA Oligomer
ccuccagguacacaucaagcaca

SEQ ID NO: 34016 - RNA, 23 nt, Artificial Sequence
  RNA Oligomer
cuccagguacacaucaagcacau

SEQ ID NO: 34017 - RNA, 23 nt, Artificial Sequence
  RNA Oligomer
uccagguacacaucaagcacaug

SEQ ID NO: 34018 - RNA, 23 nt, Artificial Sequence
  RNA Oligomer
ccucugacuuccaaaucguugaa

SEQ ID NO: 34019 - RNA, 23 nt, Artificial Sequence
  RNA Oligomer
cucugacuuccaaaucguugaag

SEQ ID NO: 34020 - RNA, 23 nt, Artificial Sequence
  RNA Oligomer
ucugacuuccaaaucguugaaga

SEQ ID NO: 34021 - RNA, 23 nt, Artificial Sequence
  RNA Oligomer
cugacuuccaaaucguugaagaa

SEQ ID NO: 34022 - RNA, 23 nt, Artificial Sequence
  RNA Oligomer
caugucacuguucucuguacugg

SEQ ID NO: 34023 - RNA, 23 nt, Artificial Sequence
  RNA Oligomer
augucacuguucucuguacuggc

SEQ ID NO: 34024 - RNA, 23 nt, Artificial Sequence
  RNA Oligomer
ugucacuguucucuguacuggca

SEQ ID NO: 34025 - RNA, 23 nt, Artificial Sequence
  RNA Oligomer
gucacuguucucuguacuggcau

SEQ ID NO: 34026 - RNA, 23 nt, Artificial Sequence
  RNA Oligomer
ucacuguucucuguacuggcauu

SEQ ID NO: 34027 - RNA, 23 nt, Artificial Sequence
  RNA Oligomer
ucucuguacuggcauuccccaca

SEQ ID NO: 34028 - RNA, 23 nt, Artificial Sequence
  RNA Oligomer
uucugaauauuuggcccauuagg

SEQ ID NO: 34029 - RNA, 23 nt, Artificial Sequence
  RNA Oligomer
guaauagaacuacguuucuuuag

SEQ ID NO: 34030 - RNA, 23 nt, Artificial Sequence
  RNA Oligomer
ggauuagauaagaaaggcaguaa

SEQ ID NO: 34031 - RNA, 23 nt, Artificial Sequence
  RNA Oligomer
gauuagauaagaaaggcaguaau

SEQ ID NO: 34032 - RNA, 23 nt, Artificial Sequence
  RNA Oligomer
auuagauaagaaaggcaguaauu

SEQ ID NO: 34033 - RNA, 23 nt, Artificial Sequence
  RNA Oligomer
uuagauaagaaaggcaguaauuu

SEQ ID NO: 34034 - RNA, 23 nt, Artificial Sequence
  RNA Oligomer
uagauaagaaaggcaguaauuua

SEQ ID NO: 34035 - RNA, 23 nt, Artificial Sequence
  RNA Oligomer
uuucuugcuuagaaccuggagaa

SEQ ID NO: 34036 - RNA, 23 nt, Artificial Sequence
  RNA Oligomer
uucuugcuuagaaccuggagaaa

SEQ ID NO: 34037 - RNA, 23 nt, Artificial Sequence
  RNA Oligomer
ucuugcuuagaaccuggagaaag

SEQ ID NO: 34038 - RNA, 23 nt, Artificial Sequence
  RNA Oligomer
cuugcuuagaaccuggagaaagg

SEQ ID NO: 34039 - RNA, 23 nt, Artificial Sequence
  RNA Oligomer
uugcuuagaaccuggagaaaggg

SEQ ID NO: 34040 - RNA, 23 nt, Artificial Sequence
  RNA Oligomer
uugacaacugcugagaacuuccg

SEQ ID NO: 34041 - RNA, 23 nt, Artificial Sequence
  RNA Oligomer
ugacaacugcugagaacuuccgu

SEQ ID NO: 34042 - RNA, 23 nt, Artificial Sequence
  RNA Oligomer
gacaacugcugagaacuuccguc

SEQ ID NO: 34043 - RNA, 23 nt, Artificial Sequence
  RNA Oligomer
acaacugcugagaacuuccgucu

SEQ ID NO: 34044 - RNA, 23 nt, Artificial Sequence
  RNA Oligomer
caacugcugagaacuuccgucug

SEQ ID NO: 34045 - RNA, 23 nt, Artificial Sequence
  RNA Oligomer
aacugcugagaacuuccgucugg

SEQ ID NO: 34046 - RNA, 23 nt, Artificial Sequence
  RNA Oligomer
acugcugagaacuuccgucuggc

SEQ ID NO: 34047 - RNA, 23 nt, Artificial Sequence
  RNA Oligomer
cugcugagaacuuccgucuggcu

SEQ ID NO: 34048 - RNA, 23 nt, Artificial Sequence
  RNA Oligomer
uaucuucacugcucugguucuuc

SEQ ID NO: 34049 - RNA, 23 nt, Artificial Sequence
  RNA Oligomer
aucuucacugcucugguucuucc

SEQ ID NO: 34050 - RNA, 23 nt, Artificial Sequence
  RNA Oligomer
ucuucacugcucugguucuuccu

SEQ ID NO: 34051 - RNA, 23 nt, Artificial Sequence
  RNA Oligomer
cuucacugcucugguucuuccuc

SEQ ID NO: 34052 - RNA, 23 nt, Artificial Sequence
  RNA Oligomer
uucacugcucugguucuuccuca

SEQ ID NO: 34053 - RNA, 23 nt, Artificial Sequence
  RNA Oligomer
ucacugcucugguucuuccucag

SEQ ID NO: 34054 - RNA, 23 nt, Artificial Sequence
  RNA Oligomer
cauugagaacggacgcacuuucu

SEQ ID NO: 34055 - RNA, 23 nt, Artificial Sequence
  RNA Oligomer
auugagaacggacgcacuuucuu

SEQ ID NO: 34056 - RNA, 23 nt, Artificial Sequence
  RNA Oligomer
uugagaacggacgcacuuucuuc

SEQ ID NO: 34057 - RNA, 23 nt, Artificial Sequence
  RNA Oligomer
agugcuuugagguacagaagcag

SEQ ID NO: 34058 - RNA, 23 nt, Artificial Sequence
  RNA Oligomer
gugcuuugagguacagaagcaga

SEQ ID NO: 34059 - RNA, 23 nt, Artificial Sequence
  RNA Oligomer
ucuacuuuugacacagccaggac

SEQ ID NO: 34060 - RNA, 23 nt, Artificial Sequence
  RNA Oligomer
cuacuuuugacacagccaggacg

SEQ ID NO: 34061 - RNA, 23 nt, Artificial Sequence
  RNA Oligomer
uacuuuugacacagccaggacga

SEQ ID NO: 34062 - RNA, 23 nt, Artificial Sequence
  RNA Oligomer
cgagaugccauuuccugaaguuc

SEQ ID NO: 34063 - RNA, 23 nt, Artificial Sequence
  RNA Oligomer
gagaugccauuuccugaaguuca

SEQ ID NO: 34064 - RNA, 23 nt, Artificial Sequence
  RNA Oligomer
agaugccauuuccugaaguucag

SEQ ID NO: 34065 - RNA, 23 nt, Artificial Sequence
  RNA Oligomer
gaugccauuuccugaaguucagc

SEQ ID NO: 34066 - RNA, 23 nt, Artificial Sequence
  RNA Oligomer
augccauuuccugaaguucagca

SEQ ID NO: 34067 - RNA, 23 nt, Artificial Sequence
  RNA Oligomer
auccauccuaggacuauuaacac

SEQ ID NO: 34068 - RNA, 23 nt, Artificial Sequence
  RNA Oligomer
cuaggacuauuaacaccguucuc

SEQ ID NO: 34069 - RNA, 23 nt, Artificial Sequence
  RNA Oligomer
aagucuguagcaaguuucuaauu

SEQ ID NO: 34070 - RNA, 23 nt, Artificial Sequence
  RNA Oligomer
gucuguagcaaguuucuaauuuc

SEQ ID NO: 34071 - RNA, 23 nt, Artificial Sequence
  RNA Oligomer
ucuguagcaaguuucuaauuucu

SEQ ID NO: 34072 - RNA, 23 nt, Artificial Sequence
  RNA Oligomer
cuguagcaaguuucuaauuucug

SEQ ID NO: 34073 - RNA, 23 nt, Artificial Sequence
  RNA Oligomer
uguagcaaguuucuaauuucuga

SEQ ID NO: 34074 - RNA, 23 nt, Artificial Sequence
  RNA Oligomer
auucagccuacaaacaagauucu

SEQ ID NO: 34075 - RNA, 23 nt, Artificial Sequence
  RNA Oligomer
uucagccuacaaacaagauucua

SEQ ID NO: 34076 - RNA, 23 nt, Artificial Sequence
  RNA Oligomer
ucagccuacaaacaagauucuac

SEQ ID NO: 34077 - RNA, 23 nt, Artificial Sequence
  RNA Oligomer
agccuacaaacaagauucuacau

SEQ ID NO: 34078 - RNA, 23 nt, Artificial Sequence
  RNA Oligomer
cuucacugacaauauacaagugu

SEQ ID NO: 34079 - RNA, 23 nt, Artificial Sequence
  RNA Oligomer
uucacugacaauauacaagugug

SEQ ID NO: 34080 - RNA, 23 nt, Artificial Sequence
  RNA Oligomer
gcaggaggacugguuuaggagca

SEQ ID NO: 34081 - RNA, 23 nt, Artificial Sequence
  RNA Oligomer
caggaggacugguuuaggagcag

SEQ ID NO: 34082 - RNA, 23 nt, Artificial Sequence
  RNA Oligomer
aggaggacugguuuaggagcagc

SEQ ID NO: 34083 - RNA, 23 nt, Artificial Sequence
  RNA Oligomer
ggaggacugguuuaggagcagcu

SEQ ID NO: 34084 - RNA, 23 nt, Artificial Sequence
  RNA Oligomer
gaggacugguuuaggagcagcug

SEQ ID NO: 34085 - RNA, 23 nt, Artificial Sequence
  RNA Oligomer
ggagcagcugcugaaaacacuca

SEQ ID NO: 34086 - RNA, 23 nt, Artificial Sequence
  RNA Oligomer
gagcagcugcugaaaacacucaa

SEQ ID NO: 34087 - RNA, 23 nt, Artificial Sequence
  RNA Oligomer
agcagcugcugaaaacacucaac

SEQ ID NO: 34088 - RNA, 23 nt, Artificial Sequence
  RNA Oligomer
gcagcugcugaaaacacucaaca

SEQ ID NO: 34089 - RNA, 23 nt, Artificial Sequence
  RNA Oligomer
cagcugcugaaaacacucaacag

SEQ ID NO: 34090 - RNA, 23 nt, Artificial Sequence
  RNA Oligomer
ucuucgauauucaccaggaacuu

SEQ ID NO: 34091 - RNA, 23 nt, Artificial Sequence
  RNA Oligomer
cagagagcugauuucccaacugc

SEQ ID NO: 34092 - RNA, 23 nt, Artificial Sequence
  RNA Oligomer
agagagcugauuucccaacugcc

SEQ ID NO: 34093 - RNA, 23 nt, Artificial Sequence
  RNA Oligomer
gagagcugauuucccaacugccc

SEQ ID NO: 34094 - RNA, 23 nt, Artificial Sequence
  RNA Oligomer
agagcugauuucccaacugccca

SEQ ID NO: 34095 - RNA, 23 nt, Artificial Sequence
  RNA Oligomer
gagcugauuucccaacugcccaa

SEQ ID NO: 34096 - RNA, 23 nt, Artificial Sequence
  RNA Oligomer
ucccaacugcccaauaaaugauc

SEQ ID NO: 34097 - RNA, 23 nt, Artificial Sequence
  RNA Oligomer
auccuauuuacuagacaggauuc

SEQ ID NO: 34098 - RNA, 23 nt, Artificial Sequence
  RNA Oligomer
uauucaccaggaacuuuuacacc

SEQ ID NO: 34099 - RNA, 23 nt, Artificial Sequence
  RNA Oligomer
auucaccaggaacuuuuacacca

SEQ ID NO: 34100 - RNA, 23 nt, Artificial Sequence
  RNA Oligomer
uucaccaggaacuuuuacaccau

SEQ ID NO: 34101 - RNA, 23 nt, Artificial Sequence
  RNA Oligomer
ugagauacacgguaagaaacauc

SEQ ID NO: 34102 - RNA, 23 nt, Artificial Sequence
  RNA Oligomer
gagauacacgguaagaaacaucg

SEQ ID NO: 34103 - RNA, 23 nt, Artificial Sequence
  RNA Oligomer
agauacacgguaagaaacaucgg

SEQ ID NO: 34104 - RNA, 23 nt, Artificial Sequence
  RNA Oligomer
gauacacgguaagaaacaucggc

SEQ ID NO: 34105 - RNA, 23 nt, Artificial Sequence
  RNA Oligomer
auacacgguaagaaacaucggca

SEQ ID NO: 34106 - RNA, 23 nt, Artificial Sequence
  RNA Oligomer
gacuaaaauucuguguggaaguu

SEQ ID NO: 34107 - RNA, 23 nt, Artificial Sequence
  RNA Oligomer
gaaguuucaggccaagcuccuuu

SEQ ID NO: 34108 - RNA, 23 nt, Artificial Sequence
  RNA Oligomer
gcucaucaucauucugagguuca

SEQ ID NO: 34109 - RNA, 23 nt, Artificial Sequence
  RNA Oligomer
cucaucaucauucugagguucau

SEQ ID NO: 34110 - RNA, 23 nt, Artificial Sequence
  RNA Oligomer
ucaucaucauucugagguucaua

SEQ ID NO: 34111 - RNA, 23 nt, Artificial Sequence
  RNA Oligomer
acuccauaaagaaauugggagca

SEQ ID NO: 34112 - RNA, 23 nt, Artificial Sequence
  RNA Oligomer
gaucuugguccacucacaauguc

SEQ ID NO: 34113 - RNA, 23 nt, Artificial Sequence
  RNA Oligomer
aucuugguccacucacaaugucc

SEQ ID NO: 34114 - RNA, 23 nt, Artificial Sequence
  RNA Oligomer
ucuugguccacucacaauguccc

SEQ ID NO: 34115 - RNA, 23 nt, Artificial Sequence
  RNA Oligomer
cuugguccacucacaaugucccu

SEQ ID NO: 34116 - RNA, 23 nt, Artificial Sequence
  RNA Oligomer
uugguccacucacaaugucccug

SEQ ID NO: 34117 - RNA, 23 nt, Artificial Sequence
  RNA Oligomer
agccuuccuccauuuccucgcac

SEQ ID NO: 34118 - RNA, 23 nt, Artificial Sequence
  RNA Oligomer
gccuuccuccauuuccucgcacu

SEQ ID NO: 34119 - RNA, 23 nt, Artificial Sequence
  RNA Oligomer
ccuuccuccauuuccucgcacuu

SEQ ID NO: 34120 - RNA, 23 nt, Artificial Sequence
  RNA Oligomer
cuuccuccauuuccucgcacuua

SEQ ID NO: 34121 - RNA, 23 nt, Artificial Sequence
  RNA Oligomer
uuccuccauuuccucgcacuuau

SEQ ID NO: 34122 - RNA, 23 nt, Artificial Sequence
  RNA Oligomer
caucacuaucagcagcauuuaca

SEQ ID NO: 34123 - RNA, 23 nt, Artificial Sequence
  RNA Oligomer
aucacuaucagcagcauuuacau

SEQ ID NO: 34124 - RNA, 23 nt, Artificial Sequence
  RNA Oligomer
ucacuaucagcagcauuuacauu

SEQ ID NO: 34125 - RNA, 23 nt, Artificial Sequence
  RNA Oligomer
uuucacccucauuccaugagcga

SEQ ID NO: 34126 - RNA, 23 nt, Artificial Sequence
  RNA Oligomer
cgaacuucguuccucugacuucc

SEQ ID NO: 34127 - RNA, 23 nt, Artificial Sequence
  RNA Oligomer
gaacuucguuccucugacuucca

SEQ ID NO: 34128 - RNA, 23 nt, Artificial Sequence
  RNA Oligomer
aacuucguuccucugacuuccaa

SEQ ID NO: 34129 - RNA, 23 nt, Artificial Sequence
  RNA Oligomer
acuucguuccucugacuuccaaa

SEQ ID NO: 34130 - RNA, 23 nt, Artificial Sequence
  RNA Oligomer
cuucguuccucugacuuccaaau

SEQ ID NO: 34131 - RNA, 23 nt, Artificial Sequence
  RNA Oligomer
cuggguuauucuggagauuuggg

SEQ ID NO: 34132 - RNA, 23 nt, Artificial Sequence
  RNA Oligomer
uaauagaacuacguuucuuuaga

SEQ ID NO: 34133 - RNA, 23 nt, Artificial Sequence
  RNA Oligomer
aauagaacuacguuucuuuagag

SEQ ID NO: 34134 - RNA, 23 nt, Artificial Sequence
  RNA Oligomer
gaacaucaaacauucgcucauua

SEQ ID NO: 34135 - RNA, 23 nt, Artificial Sequence
  RNA Oligomer
aacaucaaacauucgcucauuau

SEQ ID NO: 34136 - RNA, 23 nt, Artificial Sequence
  RNA Oligomer
auugaacuugcugccacggucug

SEQ ID NO: 34137 - RNA, 23 nt, Artificial Sequence
  RNA Oligomer
cggcagcagcagguggacuuucu

SEQ ID NO: 34138 - RNA, 23 nt, Artificial Sequence
  RNA Oligomer
ggcagcagcagguggacuuucuu

SEQ ID NO: 34139 - RNA, 23 nt, Artificial Sequence
  RNA Oligomer
gcagcagcagguggacuuucuug

SEQ ID NO: 34140 - RNA, 23 nt, Artificial Sequence
  RNA Oligomer
cagcagcagguggacuuucuugc

SEQ ID NO: 34141 - RNA, 23 nt, Artificial Sequence
  RNA Oligomer
agcagcagguggacuuucuugcu

SEQ ID NO: 34142 - RNA, 23 nt, Artificial Sequence
  RNA Oligomer
auaaggcaaauuaaucuguuuug

SEQ ID NO: 34143 - RNA, 23 nt, Artificial Sequence
  RNA Oligomer
uaaggcaaauuaaucuguuuugg

SEQ ID NO: 34144 - RNA, 23 nt, Artificial Sequence
  RNA Oligomer
aaggcaaauuaaucuguuuuggu

SEQ ID NO: 34145 - RNA, 23 nt, Artificial Sequence
  RNA Oligomer
aggcaaauuaaucuguuuugguu

SEQ ID NO: 34146 - RNA, 23 nt, Artificial Sequence
  RNA Oligomer
ggcaaauuaaucuguuuugguuu

SEQ ID NO: 34147 - RNA, 23 nt, Artificial Sequence
  RNA Oligomer
cugguucuuccucagaguaccaa

SEQ ID NO: 34148 - RNA, 23 nt, Artificial Sequence
  RNA Oligomer
ugguucuuccucagaguaccaaa

SEQ ID NO: 34149 - RNA, 23 nt, Artificial Sequence
  RNA Oligomer
gguucuuccucagaguaccaaag

SEQ ID NO: 34150 - RNA, 23 nt, Artificial Sequence
  RNA Oligomer
cuggucuacugcaucaaacauug

SEQ ID NO: 34151 - RNA, 23 nt, Artificial Sequence
  RNA Oligomer
uggucuacugcaucaaacauuga

SEQ ID NO: 34152 - RNA, 23 nt, Artificial Sequence
  RNA Oligomer
agcaaggggguugaauuucaccc

SEQ ID NO: 34153 - RNA, 23 nt, Artificial Sequence
  RNA Oligomer
gcaaggggguugaauuucacccu

SEQ ID NO: 34154 - RNA, 23 nt, Artificial Sequence
  RNA Oligomer
caaggggguugaauuucacccuc

SEQ ID NO: 34155 - RNA, 23 nt, Artificial Sequence
  RNA Oligomer
aaggggguugaauuucacccuca

SEQ ID NO: 34156 - RNA, 23 nt, Artificial Sequence
  RNA Oligomer
aggggguugaauuucacccucau

SEQ ID NO: 34157 - RNA, 23 nt, Artificial Sequence
  RNA Oligomer
auuggaauaaauguucucugggu

SEQ ID NO: 34158 - RNA, 23 nt, Artificial Sequence
  RNA Oligomer
uuggaauaaauguucucugggug

SEQ ID NO: 34159 - RNA, 23 nt, Artificial Sequence
  RNA Oligomer
uggaauaaauguucucugggugc

SEQ ID NO: 34160 - RNA, 23 nt, Artificial Sequence
  RNA Oligomer
ggaauaaauguucucugggugcu

SEQ ID NO: 34161 - RNA, 23 nt, Artificial Sequence
  RNA Oligomer
gaauaaauguucucugggugcug

SEQ ID NO: 34162 - RNA, 23 nt, Artificial Sequence
  RNA Oligomer
ggggguugaauuucacccucauu

SEQ ID NO: 34163 - RNA, 23 nt, Artificial Sequence
  RNA Oligomer
gggguugaauuucacccucauuc

SEQ ID NO: 34164 - RNA, 23 nt, Artificial Sequence
  RNA Oligomer
uucucuguacaaggucaaauucu

SEQ ID NO: 34165 - RNA, 23 nt, Artificial Sequence
  RNA Oligomer
aucguauuacuucuucuuaacag

SEQ ID NO: 34166 - RNA, 23 nt, Artificial Sequence
  RNA Oligomer
gccaaaaauaaucguauuacuuc

SEQ ID NO: 34167 - RNA, 23 nt, Artificial Sequence
  RNA Oligomer
caucaaccucauaaauaauucuc

SEQ ID NO: 34168 - RNA, 23 nt, Artificial Sequence
  RNA Oligomer
ucaaccucauaaauaauucucug

SEQ ID NO: 34169 - RNA, 23 nt, Artificial Sequence
  RNA Oligomer
caaccucauaaauaauucucugu

SEQ ID NO: 34170 - RNA, 23 nt, Artificial Sequence
  RNA Oligomer
uugcguauacauggaauauauug

SEQ ID NO: 34171 - RNA, 23 nt, Artificial Sequence
  RNA Oligomer
gucaucaaccucauaaauaauuc

SEQ ID NO: 34172 - RNA, 23 nt, Artificial Sequence
  RNA Oligomer
accucauaaauaauucucuguac

SEQ ID NO: 34173 - RNA, 23 nt, Artificial Sequence
  RNA Oligomer
cuuuuugcuguagagcugccuuc

SEQ ID NO: 34174 - RNA, 23 nt, Artificial Sequence
  RNA Oligomer
uuucgggcuccacauguaaauau

SEQ ID NO: 34175 - RNA, 23 nt, Artificial Sequence
  RNA Oligomer
cuugggaaaagaucugcauuuga

SEQ ID NO: 34176 - RNA, 23 nt, Artificial Sequence
  RNA Oligomer
uuuuugcuguagagcugccuucu

SEQ ID NO: 34177 - RNA, 23 nt, Artificial Sequence
  RNA Oligomer
augauucaggaaccagagagacc

SEQ ID NO: 34178 - RNA, 23 nt, Artificial Sequence
  RNA Oligomer
uuucgguaaggauuagauaagaa

SEQ ID NO: 34179 - RNA, 23 nt, Artificial Sequence
  RNA Oligomer
uucuuuuugcuguagagcugccu

SEQ ID NO: 34180 - RNA, 23 nt, Artificial Sequence
  RNA Oligomer
cuugauucaauuuguuucuuagc

SEQ ID NO: 34181 - RNA, 23 nt, Artificial Sequence
  RNA Oligomer
uuucccauugcuuagucucuucu

SEQ ID NO: 34182 - RNA, 23 nt, Artificial Sequence
  RNA Oligomer
uacaagugugcagugccuucgag

SEQ ID NO: 34183 - RNA, 23 nt, Artificial Sequence
  RNA Oligomer
ucucccuccaaagacgaaucuag

SEQ ID NO: 34184 - RNA, 23 nt, Artificial Sequence
  RNA Oligomer
aaagacgaaucuagcaguaaagc

SEQ ID NO: 34185 - RNA, 23 nt, Artificial Sequence
  RNA Oligomer
cugaagguggcugauuaguuugu

SEQ ID NO: 34186 - RNA, 23 nt, Artificial Sequence
  RNA Oligomer
uuauuugcaaccugagcaucccg

SEQ ID NO: 34187 - RNA, 23 nt, Artificial Sequence
  RNA Oligomer
gacgcacuuucuucucuuucucc

SEQ ID NO: 34188 - RNA, 23 nt, Artificial Sequence
  RNA Oligomer
uucccauugcuuagucucuucug

SEQ ID NO: 34189 - RNA, 23 nt, Artificial Sequence
  RNA Oligomer
cguagcuuaguuucaauauuuca

SEQ ID NO: 34190 - RNA, 23 nt, Artificial Sequence
  RNA Oligomer
uaaucccaaagcgcauaaaugac

SEQ ID NO: 34191 - RNA, 23 nt, Artificial Sequence
  RNA Oligomer
aaugauucaggaaccagagagac

SEQ ID NO: 34192 - RNA, 23 nt, Artificial Sequence
  RNA Oligomer
cacaccacacuucagccaaaugg

SEQ ID NO: 34193 - RNA, 23 nt, Artificial Sequence
  RNA Oligomer
uugggaaaagaucugcauuugaa

SEQ ID NO: 34194 - RNA, 23 nt, Artificial Sequence
  RNA Oligomer
uuuuagagccuuuaguuugugaa

SEQ ID NO: 34195 - RNA, 23 nt, Artificial Sequence
  RNA Oligomer
uucuuagcugcagcuccuuauag

SEQ ID NO: 34196 - RNA, 23 nt, Artificial Sequence
  RNA Oligomer
uaugcccaucuucuccugaacuc

SEQ ID NO: 34197 - RNA, 23 nt, Artificial Sequence
  RNA Oligomer
uuccucgcacuuaucugcagcag

SEQ ID NO: 34198 - RNA, 23 nt, Artificial Sequence
  RNA Oligomer
uucucccuccaaagacgaaucua

SEQ ID NO: 34199 - RNA, 23 nt, Artificial Sequence
  RNA Oligomer
gauacgcucugagccaguuuuac

SEQ ID NO: 34200 - RNA, 23 nt, Artificial Sequence
  RNA Oligomer
acuugaaaaguguggcccucugg

SEQ ID NO: 34201 - RNA, 23 nt, Artificial Sequence
  RNA Oligomer
uggauauagggaccuacugcagc

SEQ ID NO: 34202 - RNA, 23 nt, Artificial Sequence
  RNA Oligomer
agucuguagcaaguuucuaauuu

SEQ ID NO: 34203 - RNA, 23 nt, Artificial Sequence
  RNA Oligomer
ucccuccaaagacgaaucuagca

SEQ ID NO: 34204 - RNA, 23 nt, Artificial Sequence
  RNA Oligomer
gcugacuuggauggguaugaugg

SEQ ID NO: 34205 - RNA, 23 nt, Artificial Sequence
  RNA Oligomer
acggacgcacuuucuucucuuuc

SEQ ID NO: 34206 - RNA, 23 nt, Artificial Sequence
  RNA Oligomer
uccaccacgucucugcauauugu

SEQ ID NO: 34207 - RNA, 23 nt, Artificial Sequence
  RNA Oligomer
uuucuuuuugcuguagagcugcc

SEQ ID NO: 34208 - RNA, 23 nt, Artificial Sequence
  RNA Oligomer
acugcagacugauugucauggug

SEQ ID NO: 34209 - RNA, 23 nt, Artificial Sequence
  RNA Oligomer
uuucuggcaggaggacugguuua

SEQ ID NO: 34210 - RNA, 23 nt, Artificial Sequence
  RNA Oligomer
uuuacgcaaguuuguccuuuuac

SEQ ID NO: 34211 - RNA, 23 nt, Artificial Sequence
  RNA Oligomer
uuacgcaaguuuguccuuuuacc

SEQ ID NO: 34212 - RNA, 23 nt, Artificial Sequence
  RNA Oligomer
aaaguguggcccucugguaugag

SEQ ID NO: 34213 - RNA, 23 nt, Artificial Sequence
  RNA Oligomer
gaaccucuccaucaucaacuuga

SEQ ID NO: 34214 - RNA, 23 nt, Artificial Sequence
  RNA Oligomer
auccaccacgucucugcauauug

SEQ ID NO: 34215 - RNA, 23 nt, Artificial Sequence
  RNA Oligomer
uagacgacuggauauagggaccu

SEQ ID NO: 34216 - RNA, 23 nt, Artificial Sequence
  RNA Oligomer
uuccuccacaaguuucccauugc

SEQ ID NO: 34217 - RNA, 23 nt, Artificial Sequence
  RNA Oligomer
gauuaaaauucagccuacaaaca

SEQ ID NO: 34218 - RNA, 23 nt, Artificial Sequence
  RNA Oligomer
ucacgcuaaauguccucuaaugg

SEQ ID NO: 34219 - RNA, 23 nt, Artificial Sequence
  RNA Oligomer
ucaucgcuuucaagcuacauugu

SEQ ID NO: 34220 - RNA, 23 nt, Artificial Sequence
  RNA Oligomer
accaggaacuuuuacaccauuuc

SEQ ID NO: 34221 - RNA, 23 nt, Artificial Sequence
  RNA Oligomer
cucccucaggcucauaaucaagg

SEQ ID NO: 34222 - RNA, 23 nt, Artificial Sequence
  RNA Oligomer
uccucugauauaaaagcuucuga

SEQ ID NO: 34223 - RNA, 23 nt, Artificial Sequence
  RNA Oligomer
guugacaacugcugagaacuucc

SEQ ID NO: 34224 - RNA, 23 nt, Artificial Sequence
  RNA Oligomer
uucuggcaggaggacugguuuag

SEQ ID NO: 34225 - RNA, 23 nt, Artificial Sequence
  RNA Oligomer
uuucccaacugcccaauaaauga

SEQ ID NO: 34226 - RNA, 23 nt, Artificial Sequence
  RNA Oligomer
uucaucgcuuucaagcuacauug

SEQ ID NO: 34227 - RNA, 23 nt, Artificial Sequence
  RNA Oligomer
uccaaagacgaaucuagcaguaa

SEQ ID NO: 34228 - RNA, 23 nt, Artificial Sequence
  RNA Oligomer
guccucugauauaaaagcuucug

SEQ ID NO: 34229 - RNA, 23 nt, Artificial Sequence
  RNA Oligomer
ucagcggaaccucuccaucauca

SEQ ID NO: 34230 - RNA, 23 nt, Artificial Sequence
  RNA Oligomer
auuuuagagccuuuaguuuguga

SEQ ID NO: 34231 - RNA, 23 nt, Artificial Sequence
  RNA Oligomer
cuaugaucuugacaaauauuacg

SEQ ID NO: 34232 - RNA, 23 nt, Artificial Sequence
  RNA Oligomer
acauguggagccucuggauuugg

SEQ ID NO: 34233 - RNA, 23 nt, Artificial Sequence
  RNA Oligomer
uggcaugucacuguucucuguac

SEQ ID NO: 34234 - RNA, 23 nt, Artificial Sequence
  RNA Oligomer
ucucugggugcugcuguugauuc

SEQ ID NO: 34235 - RNA, 23 nt, Artificial Sequence
  RNA Oligomer
aacuguugacaacugcugagaac

SEQ ID NO: 34236 - RNA, 23 nt, Artificial Sequence
  RNA Oligomer
uaacuggaacuucugugaagugc

SEQ ID NO: 34237 - RNA, 23 nt, Artificial Sequence
  RNA Oligomer
cuccuuugucuugguuuaauucu

SEQ ID NO: 34238 - RNA, 23 nt, Artificial Sequence
  RNA Oligomer
ucuguuucagguucuggacugcc

SEQ ID NO: 34239 - RNA, 23 nt, Artificial Sequence
  RNA Oligomer
auguucucugggugcugcuguug

SEQ ID NO: 34240 - RNA, 23 nt, Artificial Sequence
  RNA Oligomer
uuucugaaggguggaaguaaggu

SEQ ID NO: 34241 - RNA, 23 nt, Artificial Sequence
  RNA Oligomer
uaaggugucuuuggaaggcuggg

SEQ ID NO: 34242 - RNA, 23 nt, Artificial Sequence
  RNA Oligomer
guagcuuggcauucugcucuuga

SEQ ID NO: 34243 - RNA, 23 nt, Artificial Sequence
  RNA Oligomer
guuucuccugcucagcaacuugu

SEQ ID NO: 34244 - RNA, 23 nt, Artificial Sequence
  RNA Oligomer
caacaggacagagagcugauuuc

SEQ ID NO: 34245 - RNA, 23 nt, Artificial Sequence
  RNA Oligomer
cauucgauuucaucuucgucuuc

SEQ ID NO: 34246 - RNA, 23 nt, Artificial Sequence
  RNA Oligomer
aaauugggagcacugaguguagc

SEQ ID NO: 34247 - RNA, 23 nt, Artificial Sequence
  RNA Oligomer
cuccugacuccaccaaaaacuua

SEQ ID NO: 34248 - RNA, 23 nt, Artificial Sequence
  RNA Oligomer
uguucucugggugcugcuguuga

SEQ ID NO: 34249 - RNA, 23 nt, Artificial Sequence
  RNA Oligomer
ggguggaaguaaggugucuuugg

SEQ ID NO: 34250 - RNA, 23 nt, Artificial Sequence
  RNA Oligomer
cacuucagccaaauggcaaucac

SEQ ID NO: 34251 - RNA, 23 nt, Artificial Sequence
  RNA Oligomer
cuucagccaaauggcaaucacuc

SEQ ID NO: 34252 - RNA, 23 nt, Artificial Sequence
  RNA Oligomer
aucccgcaagauaucuucacugc

SEQ ID NO: 34253 - RNA, 23 nt, Artificial Sequence
  RNA Oligomer
ucagaguaccaaaggaagguggg

SEQ ID NO: 34254 - RNA, 23 nt, Artificial Sequence
  RNA Oligomer
auguugggcagugucuguauuuu

SEQ ID NO: 34255 - RNA, 23 nt, Artificial Sequence
  RNA Oligomer
guugggcagugucuguauuuuca

SEQ ID NO: 34256 - RNA, 23 nt, Artificial Sequence
  RNA Oligomer
ucuugagcaucucuagcugccug

SEQ ID NO: 34257 - RNA, 23 nt, Artificial Sequence
  RNA Oligomer
uucaauuuccuccacaaguuucc

SEQ ID NO: 34258 - RNA, 23 nt, Artificial Sequence
  RNA Oligomer
uuaagugcucucacuuuuuuuag

SEQ ID NO: 34259 - RNA, 23 nt, Artificial Sequence
  RNA Oligomer
aauucuuggguacagucccagca

SEQ ID NO: 34260 - RNA, 23 nt, Artificial Sequence
  RNA Oligomer
cuuucaugggcagcucaucauca

SEQ ID NO: 34261 - RNA, 23 nt, Artificial Sequence
  RNA Oligomer
augcccaucuucuccugaacucc

SEQ ID NO: 34262 - RNA, 23 nt, Artificial Sequence
  RNA Oligomer
auucaggaaccagagagaccacc

SEQ ID NO: 34263 - RNA, 23 nt, Artificial Sequence
  RNA Oligomer
aguaauuuaguugggcugagugg

SEQ ID NO: 34264 - RNA, 23 nt, Artificial Sequence
  RNA Oligomer
auauacacuugaaaaguguggcc

SEQ ID NO: 34265 - RNA, 23 nt, Artificial Sequence
  RNA Oligomer
guaaggugucuuuggaaggcugg

SEQ ID NO: 34266 - RNA, 23 nt, Artificial Sequence
  RNA Oligomer
acacuucagccaaauggcaauca

SEQ ID NO: 34267 - RNA, 23 nt, Artificial Sequence
  RNA Oligomer
acuucagccaaauggcaaucacu

SEQ ID NO: 34268 - RNA, 23 nt, Artificial Sequence
  RNA Oligomer
caagauucuacaucuaauuacug

SEQ ID NO: 34269 - RNA, 23 nt, Artificial Sequence
  RNA Oligomer
aauguccucuaauggugaauucu

SEQ ID NO: 34270 - RNA, 23 nt, Artificial Sequence
  RNA Oligomer
aguuacguggaacauaucccucc

SEQ ID NO: 34271 - RNA, 23 nt, Artificial Sequence
  RNA Oligomer
gagccaguuuuacgcaaguuugu

SEQ ID NO: 34272 - RNA, 23 nt, Artificial Sequence
  RNA Oligomer
ucauuauccgcaacuggacguuc

SEQ ID NO: 34273 - RNA, 23 nt, Artificial Sequence
  RNA Oligomer
uuuauuugcaaccugagcauccc

SEQ ID NO: 34274 - RNA, 23 nt, Artificial Sequence
  RNA Oligomer
uauuugcaaccugagcaucccgc

SEQ ID NO: 34275 - RNA, 23 nt, Artificial Sequence
  RNA Oligomer
uaagaaacaucggcaucaucuug

SEQ ID NO: 34276 - RNA, 23 nt, Artificial Sequence
  RNA Oligomer
uuuagagccuuuaguuugugaag

SEQ ID NO: 34277 - RNA, 23 nt, Artificial Sequence
  RNA Oligomer
uuuugcuguagagcugccuucuu

SEQ ID NO: 34278 - RNA, 23 nt, Artificial Sequence
  RNA Oligomer
auacuuaucugagugcuacacgg

SEQ ID NO: 34279 - RNA, 23 nt, Artificial Sequence
  RNA Oligomer
aucuucuccugaacuccauaaag

SEQ ID NO: 34280 - RNA, 23 nt, Artificial Sequence
  RNA Oligomer
aagaaauugggagcacugagugu

SEQ ID NO: 34281 - RNA, 23 nt, Artificial Sequence
  RNA Oligomer
gaguccauccaucacuaucagca

SEQ ID NO: 34282 - RNA, 23 nt, Artificial Sequence
  RNA Oligomer
guccauccaucacuaucagcagc

SEQ ID NO: 34283 - RNA, 23 nt, Artificial Sequence
  RNA Oligomer
ugagccaguuuuacgcaaguuug

SEQ ID NO: 34284 - RNA, 23 nt, Artificial Sequence
  RNA Oligomer
auauuuggcccauuaggacccuc

SEQ ID NO: 34285 - RNA, 23 nt, Artificial Sequence
  RNA Oligomer
cugaguggccgaggaauucuuuc

SEQ ID NO: 34286 - RNA, 23 nt, Artificial Sequence
  RNA Oligomer
uauuggaauaaauguucucuggg

SEQ ID NO: 34287 - RNA, 23 nt, Artificial Sequence
  RNA Oligomer
uauacacuugaaaaguguggccc

SEQ ID NO: 34288 - RNA, 23 nt, Artificial Sequence
  RNA Oligomer
uuuucugaaggguggaaguaagg

SEQ ID NO: 34289 - RNA, 23 nt, Artificial Sequence
  RNA Oligomer
aaccuggagaaagggucuggucu

SEQ ID NO: 34290 - RNA, 23 nt, Artificial Sequence
  RNA Oligomer
uuugguuuuguaggaacaggagg

SEQ ID NO: 34291 - RNA, 23 nt, Artificial Sequence
  RNA Oligomer
ucaauuuccuccacaaguuuccc

SEQ ID NO: 34292 - RNA, 23 nt, Artificial Sequence
  RNA Oligomer
caauuuccuccacaaguuuccca

SEQ ID NO: 34293 - RNA, 23 nt, Artificial Sequence
  RNA Oligomer
uuuccuccacaaguuucccauug

SEQ ID NO: 34294 - RNA, 23 nt, Artificial Sequence
  RNA Oligomer
uucauucucuucuagagacauuc

SEQ ID NO: 34295 - RNA, 23 nt, Artificial Sequence
  RNA Oligomer
uucuuggguacagucccagcaag

SEQ ID NO: 34296 - RNA, 23 nt, Artificial Sequence
  RNA Oligomer
aaguuacguggaacauaucccuc

SEQ ID NO: 34297 - RNA, 23 nt, Artificial Sequence
  RNA Oligomer
uucccuguggaugauugucaugc

SEQ ID NO: 34298 - RNA, 23 nt, Artificial Sequence
  RNA Oligomer
uuuaaacuuggauccugagaucu

SEQ ID NO: 34299 - RNA, 23 nt, Artificial Sequence
  RNA Oligomer
uaaacuuggauccugagaucuug

SEQ ID NO: 34300 - RNA, 23 nt, Artificial Sequence
  RNA Oligomer
uuaucugcagcagucugcauguc

SEQ ID NO: 34301 - RNA, 23 nt, Artificial Sequence
  RNA Oligomer
cacacacagcauugugaagagcc

SEQ ID NO: 34302 - RNA, 23 nt, Artificial Sequence
  RNA Oligomer
uauuuggcccauuaggacccucu

SEQ ID NO: 34303 - RNA, 23 nt, Artificial Sequence
  RNA Oligomer
uuucguaaggcuucuaggucagc

SEQ ID NO: 34304 - RNA, 23 nt, Artificial Sequence
  RNA Oligomer
uuugguuuaguucccauggacgg

SEQ ID NO: 34305 - RNA, 23 nt, Artificial Sequence
  RNA Oligomer
auauagggaccuacugcagccac

SEQ ID NO: 34306 - RNA, 23 nt, Artificial Sequence
  RNA Oligomer
guuguuguagcuuggcauucugc

SEQ ID NO: 34307 - RNA, 23 nt, Artificial Sequence
  RNA Oligomer
guucaauuuccuccacaaguuuc

SEQ ID NO: 34308 - RNA, 23 nt, Artificial Sequence
  RNA Oligomer
ugcucagcaacuuguugcuguug

SEQ ID NO: 34309 - RNA, 23 nt, Artificial Sequence
  RNA Oligomer
uuaagcgcuguuccuuaguugcc

SEQ ID NO: 34310 - RNA, 23 nt, Artificial Sequence
  RNA Oligomer
uuuuaaagucagcuaugaucuug

SEQ ID NO: 34311 - RNA, 23 nt, Artificial Sequence
  RNA Oligomer
uuaggagcagcugcugaaaacac

SEQ ID NO: 34312 - RNA, 23 nt, Artificial Sequence
  RNA Oligomer
uauacuuaucugagugcuacacg

SEQ ID NO: 34313 - RNA, 23 nt, Artificial Sequence
  RNA Oligomer
aaauguccucuaauggugaauuc

SEQ ID NO: 34314 - RNA, 23 nt, Artificial Sequence
  RNA Oligomer
acagagauuaauucuucauugac

SEQ ID NO: 34315 - RNA, 23 nt, Artificial Sequence
  RNA Oligomer
uucgucuucccuguggaugauug

SEQ ID NO: 34316 - RNA, 23 nt, Artificial Sequence
  RNA Oligomer
augaggcagcacaauguaaugga

SEQ ID NO: 34317 - RNA, 23 nt, Artificial Sequence
  RNA Oligomer
auuuacaccaaacuguaccagga

SEQ ID NO: 34318 - RNA, 23 nt, Artificial Sequence
  RNA Oligomer
auacgcucugagccaguuuuacg

SEQ ID NO: 34319 - RNA, 23 nt, Artificial Sequence
  RNA Oligomer
ugguccucugauauaaaagcuuc

SEQ ID NO: 34320 - RNA, 23 nt, Artificial Sequence
  RNA Oligomer
auuuaguugggcugaguggccga

SEQ ID NO: 34321 - RNA, 23 nt, Artificial Sequence
  RNA Oligomer
uucugggcagcagcaauuacagg

SEQ ID NO: 34322 - RNA, 23 nt, Artificial Sequence
  RNA Oligomer
auucgcucauuauccgcaacugg

SEQ ID NO: 34323 - RNA, 23 nt, Artificial Sequence
  RNA Oligomer
aguaaggugucuuuggaaggcug

SEQ ID NO: 34324 - RNA, 23 nt, Artificial Sequence
  RNA Oligomer
acuuucuugcuuagaaccuggag

SEQ ID NO: 34325 - RNA, 23 nt, Artificial Sequence
  RNA Oligomer
uuaaugucugaagguggcugauu

SEQ ID NO: 34326 - RNA, 23 nt, Artificial Sequence
  RNA Oligomer
uuagagccuuuaguuugugaagc

SEQ ID NO: 34327 - RNA, 23 nt, Artificial Sequence
  RNA Oligomer
gacuggauauagggaccuacugc

SEQ ID NO: 34328 - RNA, 23 nt, Artificial Sequence
  RNA Oligomer
ugcagacugauugucaugguggc

SEQ ID NO: 34329 - RNA, 23 nt, Artificial Sequence
  RNA Oligomer
cuuguugcuguugucgcugaucu

SEQ ID NO: 34330 - RNA, 23 nt, Artificial Sequence
  RNA Oligomer
uuaaagucagcuaugaucuugac

SEQ ID NO: 34331 - RNA, 23 nt, Artificial Sequence
  RNA Oligomer
auauuacggguaagucuguagca

SEQ ID NO: 34332 - RNA, 23 nt, Artificial Sequence
  RNA Oligomer
acugguaccguagcuuaguuuca

SEQ ID NO: 34333 - RNA, 23 nt, Artificial Sequence
  RNA Oligomer
uucuucacugacaauauacaagu

SEQ ID NO: 34334 - RNA, 23 nt, Artificial Sequence
  RNA Oligomer
auucuguguggaaguuucaggcc

SEQ ID NO: 34335 - RNA, 23 nt, Artificial Sequence
  RNA Oligomer
aaacuuggauccugagaucuugg

SEQ ID NO: 34336 - RNA, 23 nt, Artificial Sequence
  RNA Oligomer
aauugggagcacugaguguagcc

SEQ ID NO: 34337 - RNA, 23 nt, Artificial Sequence
  RNA Oligomer
uuacaugaggcagcacaauguaa

SEQ ID NO: 34338 - RNA, 23 nt, Artificial Sequence
  RNA Oligomer
caaacuguaccaggaacuuaacg

SEQ ID NO: 34339 - RNA, 23 nt, Artificial Sequence
  RNA Oligomer
uacgcaaguuuguccuuuuacca

SEQ ID NO: 34340 - RNA, 23 nt, Artificial Sequence
  RNA Oligomer
uuugguucuucuggguuauucug

SEQ ID NO: 34341 - RNA, 23 nt, Artificial Sequence
  RNA Oligomer
aggucagcaucacucugguuucg

SEQ ID NO: 34342 - RNA, 23 nt, Artificial Sequence
  RNA Oligomer
uaauuuaguugggcugaguggcc

SEQ ID NO: 34343 - RNA, 23 nt, Artificial Sequence
  RNA Oligomer
aauuuaguugggcugaguggccg

SEQ ID NO: 34344 - RNA, 23 nt, Artificial Sequence
  RNA Oligomer
cuauuggaauaaauguucucugg

SEQ ID NO: 34345 - RNA, 23 nt, Artificial Sequence
  RNA Oligomer
gaaguaaggugucuuuggaaggc

SEQ ID NO: 34346 - RNA, 23 nt, Artificial Sequence
  RNA Oligomer
uaugcugggagauagcagcacuc

SEQ ID NO: 34347 - RNA, 23 nt, Artificial Sequence
  RNA Oligomer
aacuuccgucuggcuuaaugucu

SEQ ID NO: 34348 - RNA, 23 nt, Artificial Sequence
  RNA Oligomer
uauagaggcgaucaagcucagcc

SEQ ID NO: 34349 - RNA, 23 nt, Artificial Sequence
  RNA Oligomer
ccacugcagacugauugucaugg

SEQ ID NO: 34350 - RNA, 23 nt, Artificial Sequence
  RNA Oligomer
cugcagacugauugucauggugg

SEQ ID NO: 34351 - RNA, 23 nt, Artificial Sequence
  RNA Oligomer
uccacguggccuuuaagugcucu

SEQ ID NO: 34352 - RNA, 23 nt, Artificial Sequence
  RNA Oligomer
aacuguuuuuaaagucagcuaug

SEQ ID NO: 34353 - RNA, 23 nt, Artificial Sequence
  RNA Oligomer
aaagucagcuaugaucuugacaa

SEQ ID NO: 34354 - RNA, 23 nt, Artificial Sequence
  RNA Oligomer
uauuacggguaagucuguagcaa

SEQ ID NO: 34355 - RNA, 23 nt, Artificial Sequence
  RNA Oligomer
guucuucacugacaauauacaag

SEQ ID NO: 34356 - RNA, 23 nt, Artificial Sequence
  RNA Oligomer
acugguuuaggagcagcugcuga

SEQ ID NO: 34357 - RNA, 23 nt, Artificial Sequence
  RNA Oligomer
aaacacucaacaggacagagagc

SEQ ID NO: 34358 - RNA, 23 nt, Artificial Sequence
  RNA Oligomer
uacuuaucugagugcuacacggg

SEQ ID NO: 34359 - RNA, 23 nt, Artificial Sequence
  RNA Oligomer
caucgcuuucaagcuacauuguc

SEQ ID NO: 34360 - RNA, 23 nt, Artificial Sequence
  RNA Oligomer
cuaaaauucuguguggaaguuuc

SEQ ID NO: 34361 - RNA, 23 nt, Artificial Sequence
  RNA Oligomer
uaaaauucuguguggaaguuuca

SEQ ID NO: 34362 - RNA, 23 nt, Artificial Sequence
  RNA Oligomer
uucuguguggaaguuucaggcca

SEQ ID NO: 34363 - RNA, 23 nt, Artificial Sequence
  RNA Oligomer
uuaaacuuggauccugagaucuu

SEQ ID NO: 34364 - RNA, 23 nt, Artificial Sequence
  RNA Oligomer
aacuuggauccugagaucuuggu

SEQ ID NO: 34365 - RNA, 23 nt, Artificial Sequence
  RNA Oligomer
auugggagcacugaguguagccu

SEQ ID NO: 34366 - RNA, 23 nt, Artificial Sequence
  RNA Oligomer
uuuccucgcacuuaucugcagca

SEQ ID NO: 34367 - RNA, 23 nt, Artificial Sequence
  RNA Oligomer
acauuuacaccaaacuguaccag

SEQ ID NO: 34368 - RNA, 23 nt, Artificial Sequence
  RNA Oligomer
cauuuacaccaaacuguaccagg

SEQ ID NO: 34369 - RNA, 23 nt, Artificial Sequence
  RNA Oligomer
uucaggaaccagagagaccaccu

SEQ ID NO: 34370 - RNA, 23 nt, Artificial Sequence
  RNA Oligomer
aauauuuggcccauuaggacccu

SEQ ID NO: 34371 - RNA, 23 nt, Artificial Sequence
  RNA Oligomer
uuccaaaucguugaagaacauca

SEQ ID NO: 34372 - RNA, 23 nt, Artificial Sequence
  RNA Oligomer
uucguaaggcuucuaggucagca

SEQ ID NO: 34373 - RNA, 23 nt, Artificial Sequence
  RNA Oligomer
ugaguggccgaggaauucuuucg

SEQ ID NO: 34374 - RNA, 23 nt, Artificial Sequence
  RNA Oligomer
ugauucugggcagcagcaauuac

SEQ ID NO: 34375 - RNA, 23 nt, Artificial Sequence
  RNA Oligomer
aaaaguguggcccucugguauga

SEQ ID NO: 34376 - RNA, 23 nt, Artificial Sequence
  RNA Oligomer
agccugcuggaaguuuuuuccug

SEQ ID NO: 34377 - RNA, 23 nt, Artificial Sequence
  RNA Oligomer
aggguggaaguaaggugucuuug

SEQ ID NO: 34378 - RNA, 23 nt, Artificial Sequence
  RNA Oligomer
aaugucugaagguggcugauuag

SEQ ID NO: 34379 - RNA, 23 nt, Artificial Sequence
  RNA Oligomer
cucagaguaccaaaggaaggugg

SEQ ID NO: 34380 - RNA, 23 nt, Artificial Sequence
  RNA Oligomer
cauaguagacgacuggauauagg

SEQ ID NO: 34381 - RNA, 23 nt, Artificial Sequence
  RNA Oligomer
uuauagaggcgaucaagcucagc

SEQ ID NO: 34382 - RNA, 23 nt, Artificial Sequence
  RNA Oligomer
uucuccugcucagcaacuuguug

SEQ ID NO: 34383 - RNA, 23 nt, Artificial Sequence
  RNA Oligomer
uuuaaagucagcuaugaucuuga

SEQ ID NO: 34384 - RNA, 23 nt, Artificial Sequence
  RNA Oligomer
aaacaggauugucgcuguauacu

SEQ ID NO: 34385 - RNA, 23 nt, Artificial Sequence
  RNA Oligomer
uaucugagugcuacacgggacac

SEQ ID NO: 34386 - RNA, 23 nt, Artificial Sequence
  RNA Oligomer
agcaaguuacguggaacauaucc

SEQ ID NO: 34387 - RNA, 23 nt, Artificial Sequence
  RNA Oligomer
cuuggauccugagaucuuggucc

SEQ ID NO: 34388 - RNA, 23 nt, Artificial Sequence
  RNA Oligomer
uaucugcagcagucugcauguca

SEQ ID NO: 34389 - RNA, 23 nt, Artificial Sequence
  RNA Oligomer
aucugcagcagucugcaugucac

SEQ ID NO: 34390 - RNA, 23 nt, Artificial Sequence
  RNA Oligomer
aguuuguccuuuuaccaggaggc

SEQ ID NO: 34391 - RNA, 23 nt, Artificial Sequence
  RNA Oligomer
uuuguccuuuuaccaggaggcag

SEQ ID NO: 34392 - RNA, 23 nt, Artificial Sequence
  RNA Oligomer
uuuuuuccuggcgccugcuguug

SEQ ID NO: 34393 - RNA, 23 nt, Artificial Sequence
  RNA Oligomer
gucuggcuuaaugucugaaggug

SEQ ID NO: 34394 - RNA, 23 nt, Artificial Sequence
  RNA Oligomer
ucuggcuuaaugucugaaggugg

SEQ ID NO: 34395 - RNA, 23 nt, Artificial Sequence
  RNA Oligomer
augucugaagguggcugauuagu

SEQ ID NO: 34396 - RNA, 23 nt, Artificial Sequence
  RNA Oligomer
gguuuuguaggaacaggaggugg

SEQ ID NO: 34397 - RNA, 23 nt, Artificial Sequence
  RNA Oligomer
agagccuuuaguuugugaagcag

SEQ ID NO: 34398 - RNA, 23 nt, Artificial Sequence
  RNA Oligomer
gagccuuuaguuugugaagcagc

SEQ ID NO: 34399 - RNA, 23 nt, Artificial Sequence
  RNA Oligomer
cuuccugauucucagcuauuucu

SEQ ID NO: 34400 - RNA, 23 nt, Artificial Sequence
  RNA Oligomer
uccugauucucagcuauuucuuu

SEQ ID NO: 34401 - RNA, 23 nt, Artificial Sequence
  RNA Oligomer
ucagcaacuuguugcuguugucg

SEQ ID NO: 34402 - RNA, 23 nt, Artificial Sequence
  RNA Oligomer
uguugcuguugucgcugaucuug

SEQ ID NO: 34403 - RNA, 23 nt, Artificial Sequence
  RNA Oligomer
ccuuaguugccagcaauuguugc

SEQ ID NO: 34404 - RNA, 23 nt, Artificial Sequence
  RNA Oligomer
aucccuccuuaucauuaaggcgc

SEQ ID NO: 34405 - RNA, 23 nt, Artificial Sequence
  RNA Oligomer
ucaugggcagcucaucaucauuc

SEQ ID NO: 34406 - RNA, 23 nt, Artificial Sequence
  RNA Oligomer
uaauggaguccauccaucacuau

SEQ ID NO: 34407 - RNA, 23 nt, Artificial Sequence
  RNA Oligomer
uaccaggaacuuaacgauuucug

SEQ ID NO: 34408 - RNA, 23 nt, Artificial Sequence
  RNA Oligomer
auuugguucuucuggguuauucu

SEQ ID NO: 34409 - RNA, 23 nt, Artificial Sequence
  RNA Oligomer
auuuggcccauuaggacccucug

SEQ ID NO: 34410 - RNA, 23 nt, Artificial Sequence
  RNA Oligomer
ucuggcucuguaauagaacuacg

SEQ ID NO: 34411 - RNA, 23 nt, Artificial Sequence
  RNA Oligomer
gugcguuagacaguuucuuucgu

SEQ ID NO: 34412 - RNA, 23 nt, Artificial Sequence
  RNA Oligomer
aaucguugaagaacaucaaacau

SEQ ID NO: 34413 - RNA, 23 nt, Artificial Sequence
  RNA Oligomer
uuuucaugguucuccugaacuga

SEQ ID NO: 34414 - RNA, 23 nt, Artificial Sequence
  RNA Oligomer
uacaggcuuaccauauacacuug

SEQ ID NO: 34415 - RNA, 23 nt, Artificial Sequence
  RNA Oligomer
cugcuggaaguuuuuuccuggcg

SEQ ID NO: 34416 - RNA, 23 nt, Artificial Sequence
  RNA Oligomer
augcugggagauagcagcacucu

SEQ ID NO: 34417 - RNA, 23 nt, Artificial Sequence
  RNA Oligomer
gaacuuccgucuggcuuaauguc

SEQ ID NO: 34418 - RNA, 23 nt, Artificial Sequence
  RNA Oligomer
uguuuugguuuuguaggaacagg

SEQ ID NO: 34419 - RNA, 23 nt, Artificial Sequence
  RNA Oligomer
uuuugguuuuguaggaacaggag

SEQ ID NO: 34420 - RNA, 23 nt, Artificial Sequence
  RNA Oligomer
uugguuuuguaggaacaggaggu

SEQ ID NO: 34421 - RNA, 23 nt, Artificial Sequence
  RNA Oligomer
aaucacucucgccggguucuuug

SEQ ID NO: 34422 - RNA, 23 nt, Artificial Sequence
  RNA Oligomer
ugaaugaccaaggaaccauccgg

SEQ ID NO: 34423 - RNA, 23 nt, Artificial Sequence
  RNA Oligomer
auaguagacgacuggauauaggg

SEQ ID NO: 34424 - RNA, 23 nt, Artificial Sequence
  RNA Oligomer
uaguagacgacuggauauaggga

SEQ ID NO: 34425 - RNA, 23 nt, Artificial Sequence
  RNA Oligomer
uauagggaccuacugcagccaca

SEQ ID NO: 34426 - RNA, 23 nt, Artificial Sequence
  RNA Oligomer
gauccugccguucuugagcaucu

SEQ ID NO: 34427 - RNA, 23 nt, Artificial Sequence
  RNA Oligomer
uccugccguucuugagcaucucu

SEQ ID NO: 34428 - RNA, 23 nt, Artificial Sequence
  RNA Oligomer
uccugcucagcaacuuguugcug

SEQ ID NO: 34429 - RNA, 23 nt, Artificial Sequence
  RNA Oligomer
uaagcgcuguuccuuaguugcca

SEQ ID NO: 34430 - RNA, 23 nt, Artificial Sequence
  RNA Oligomer
acuguuuuuaaagucagcuauga

SEQ ID NO: 34431 - RNA, 23 nt, Artificial Sequence
  RNA Oligomer
uaaagucagcuaugaucuugaca

SEQ ID NO: 34432 - RNA, 23 nt, Artificial Sequence
  RNA Oligomer
aaaacaggauugucgcuguauac

SEQ ID NO: 34433 - RNA, 23 nt, Artificial Sequence
  RNA Oligomer
auucuucaucgcuuucaagcuac

SEQ ID NO: 34434 - RNA, 23 nt, Artificial Sequence
  RNA Oligomer
uucuucaucgcuuucaagcuaca

SEQ ID NO: 34435 - RNA, 23 nt, Artificial Sequence
  RNA Oligomer
agcucaucaucauucugagguuc

SEQ ID NO: 34436 - RNA, 23 nt, Artificial Sequence
  RNA Oligomer
aauguaauggaguccauccauca

SEQ ID NO: 34437 - RNA, 23 nt, Artificial Sequence
  RNA Oligomer
uuccaugagcgauacgcucugag

SEQ ID NO: 34438 - RNA, 23 nt, Artificial Sequence
  RNA Oligomer
ucgggcuccacauguaaauaugg

SEQ ID NO: 34439 - RNA, 23 nt, Artificial Sequence
  RNA Oligomer
uuucaugguucuccugaacugaa

SEQ ID NO: 34440 - RNA, 23 nt, Artificial Sequence
  RNA Oligomer
cucuguuucagguucuggacugc

SEQ ID NO: 34441 - RNA, 23 nt, Artificial Sequence
  RNA Oligomer
uuaccauauacacuugaaaagug

SEQ ID NO: 34442 - RNA, 23 nt, Artificial Sequence
  RNA Oligomer
aaguaaggugucuuuggaaggcu

SEQ ID NO: 34443 - RNA, 23 nt, Artificial Sequence
  RNA Oligomer
ugcuuagaaccuggagaaagggu

SEQ ID NO: 34444 - RNA, 23 nt, Artificial Sequence
  RNA Oligomer
uguagcuuggcauucugcucuug

SEQ ID NO: 34445 - RNA, 23 nt, Artificial Sequence
  RNA Oligomer
uugagcaucucuagcugccuggu

SEQ ID NO: 34446 - RNA, 23 nt, Artificial Sequence
  RNA Oligomer
acuuuugacacagccaggacgag

SEQ ID NO: 34447 - RNA, 23 nt, Artificial Sequence
  RNA Oligomer
gacgagcucccucuguuuuugcu

SEQ ID NO: 34448 - RNA, 23 nt, Artificial Sequence
  RNA Oligomer
cuggaacuucugugaagugcugc

SEQ ID NO: 34449 - RNA, 23 nt, Artificial Sequence
  RNA Oligomer
uguuccacguggccuuuaagugc

SEQ ID NO: 34450 - RNA, 23 nt, Artificial Sequence
  RNA Oligomer
aaucagagacagcgaugugacgg

SEQ ID NO: 34451 - RNA, 23 nt, Artificial Sequence
  RNA Oligomer
augugacggcacugguccuuucu

SEQ ID NO: 34452 - RNA, 23 nt, Artificial Sequence
  RNA Oligomer
guauacuuaucugagugcuacac

SEQ ID NO: 34453 - RNA, 23 nt, Artificial Sequence
  RNA Oligomer
ugcugacguagaugcuuuauuuc

SEQ ID NO: 34454 - RNA, 23 nt, Artificial Sequence
  RNA Oligomer
ucauucucuucuagagacauucu

SEQ ID NO: 34455 - RNA, 23 nt, Artificial Sequence
  RNA Oligomer
auucucuucuagagacauucuuc

SEQ ID NO: 34456 - RNA, 23 nt, Artificial Sequence
  RNA Oligomer
uucugagguucauaaucccaaag

SEQ ID NO: 34457 - RNA, 23 nt, Artificial Sequence
  RNA Oligomer
ucugagguucauaaucccaaagc

SEQ ID NO: 34458 - RNA, 23 nt, Artificial Sequence
  RNA Oligomer
aaagaaauugggagcacugagug

SEQ ID NO: 34459 - RNA, 23 nt, Artificial Sequence
  RNA Oligomer
ugaguguagccuuccuccauuuc

SEQ ID NO: 34460 - RNA, 23 nt, Artificial Sequence
  RNA Oligomer
cagucugcaugucacuguagguc

SEQ ID NO: 34461 - RNA, 23 nt, Artificial Sequence
  RNA Oligomer
accaggaacuuaacgauuucugu

SEQ ID NO: 34462 - RNA, 23 nt, Artificial Sequence
  RNA Oligomer
guucaugacgaaggaagaagcga

SEQ ID NO: 34463 - RNA, 23 nt, Artificial Sequence
  RNA Oligomer
auucucccuccaaagacgaaucu

SEQ ID NO: 34464 - RNA, 23 nt, Artificial Sequence
  RNA Oligomer
uugguucuucuggguuauucugg

SEQ ID NO: 34465 - RNA, 23 nt, Artificial Sequence
  RNA Oligomer
uuuagaggccuuggugcguuaga

SEQ ID NO: 34466 - RNA, 23 nt, Artificial Sequence
  RNA Oligomer
guaaggcuucuaggucagcauca

SEQ ID NO: 34467 - RNA, 23 nt, Artificial Sequence
  RNA Oligomer
aucguugaagaacaucaaacauu

SEQ ID NO: 34468 - RNA, 23 nt, Artificial Sequence
  RNA Oligomer
guaauuuaguugggcugaguggc

SEQ ID NO: 34469 - RNA, 23 nt, Artificial Sequence
  RNA Oligomer
auucugggcagcagcaauuacag

SEQ ID NO: 34470 - RNA, 23 nt, Artificial Sequence
  RNA Oligomer
cauauacacuugaaaaguguggc

SEQ ID NO: 34471 - RNA, 23 nt, Artificial Sequence
  RNA Oligomer
auacacuugaaaaguguggcccu

SEQ ID NO: 34472 - RNA, 23 nt, Artificial Sequence
  RNA Oligomer
ugcuggaaguuuuuuccuggcgc

SEQ ID NO: 34473 - RNA, 23 nt, Artificial Sequence
  RNA Oligomer
aaguuuuuuccuggcgccugcug

SEQ ID NO: 34474 - RNA, 23 nt, Artificial Sequence
  RNA Oligomer
uagaaccuggagaaagggucugg

SEQ ID NO: 34475 - RNA, 23 nt, Artificial Sequence
  RNA Oligomer
uuuugguuuaguucccauggacg

SEQ ID NO: 34476 - RNA, 23 nt, Artificial Sequence
  RNA Oligomer
auuugcaaccugagcaucccgca

SEQ ID NO: 34477 - RNA, 23 nt, Artificial Sequence
  RNA Oligomer
uucagccaaauggcaaucacucu

SEQ ID NO: 34478 - RNA, 23 nt, Artificial Sequence
  RNA Oligomer
uugaaggacuccaaucagggcca

SEQ ID NO: 34479 - RNA, 23 nt, Artificial Sequence
  RNA Oligomer
uggauuuuagagccuuuaguuug

SEQ ID NO: 34480 - RNA, 23 nt, Artificial Sequence
  RNA Oligomer
aagccugaaugaccaaggaacca

SEQ ID NO: 34481 - RNA, 23 nt, Artificial Sequence
  RNA Oligomer
cugaaugaccaaggaaccauccg

SEQ ID NO: 34482 - RNA, 23 nt, Artificial Sequence
  RNA Oligomer
aaugaccaaggaaccauccggca

SEQ ID NO: 34483 - RNA, 23 nt, Artificial Sequence
  RNA Oligomer
uuguuguagcuuggcauucugcu

SEQ ID NO: 34484 - RNA, 23 nt, Artificial Sequence
  RNA Oligomer
uuagcugcagcuccuuauagagg

SEQ ID NO: 34485 - RNA, 23 nt, Artificial Sequence
  RNA Oligomer
gaacuucugugaagugcugcuca

SEQ ID NO: 34486 - RNA, 23 nt, Artificial Sequence
  RNA Oligomer
acaaguuucccauugcuuagucu

SEQ ID NO: 34487 - RNA, 23 nt, Artificial Sequence
  RNA Oligomer
cacguggccuuuaagugcucuca

SEQ ID NO: 34488 - RNA, 23 nt, Artificial Sequence
  RNA Oligomer
ucuccugcucagcaacuuguugc

SEQ ID NO: 34489 - RNA, 23 nt, Artificial Sequence
  RNA Oligomer
uccugaaguucagcaagagucag

SEQ ID NO: 34490 - RNA, 23 nt, Artificial Sequence
  RNA Oligomer
aauauuacggguaagucuguagc

SEQ ID NO: 34491 - RNA, 23 nt, Artificial Sequence
  RNA Oligomer
cacugacaaccaacuaacaguuc

SEQ ID NO: 34492 - RNA, 23 nt, Artificial Sequence
  RNA Oligomer
cuguauacuuaucugagugcuac

SEQ ID NO: 34493 - RNA, 23 nt, Artificial Sequence
  RNA Oligomer
aauucuguguggaaguuucaggc

SEQ ID NO: 34494 - RNA, 23 nt, Artificial Sequence
  RNA Oligomer
uuacguggaacauaucccuccuu

SEQ ID NO: 34495 - RNA, 23 nt, Artificial Sequence
  RNA Oligomer
uacguggaacauaucccuccuua

SEQ ID NO: 34496 - RNA, 23 nt, Artificial Sequence
  RNA Oligomer
cagcagucugcaugucacuguag

SEQ ID NO: 34497 - RNA, 23 nt, Artificial Sequence
  RNA Oligomer
guaccaggaacuuaacgauuucu

SEQ ID NO: 34498 - RNA, 23 nt, Artificial Sequence
  RNA Oligomer
agcauugugaagagccgugaugc

SEQ ID NO: 34499 - RNA, 23 nt, Artificial Sequence
  RNA Oligomer
augacgaaggaagaagcgaacuu

SEQ ID NO: 34500 - RNA, 23 nt, Artificial Sequence
  RNA Oligomer
gacgaaggaagaagcgaacuucg

SEQ ID NO: 34501 - RNA, 23 nt, Artificial Sequence
  RNA Oligomer
uuuuaccaggaggcagagagacc

SEQ ID NO: 34502 - RNA, 23 nt, Artificial Sequence
  RNA Oligomer
auauggauucuggauuucuacug

SEQ ID NO: 34503 - RNA, 23 nt, Artificial Sequence
  RNA Oligomer
uucuggauuucuacugggcuuuc

SEQ ID NO: 34504 - RNA, 23 nt, Artificial Sequence
  RNA Oligomer
gaauauuuggcccauuaggaccc

SEQ ID NO: 34505 - RNA, 23 nt, Artificial Sequence
  RNA Oligomer
cuuuagaggccuuggugcguuag

SEQ ID NO: 34506 - RNA, 23 nt, Artificial Sequence
  RNA Oligomer
uuagaggccuuggugcguuagac

SEQ ID NO: 34507 - RNA, 23 nt, Artificial Sequence
  RNA Oligomer
caaaucguugaagaacaucaaac

SEQ ID NO: 34508 - RNA, 23 nt, Artificial Sequence
  RNA Oligomer
uaaggcuucuaggucagcaucac

SEQ ID NO: 34509 - RNA, 23 nt, Artificial Sequence
  RNA Oligomer
uaggucagcaucacucugguuuc

SEQ ID NO: 34510 - RNA, 23 nt, Artificial Sequence
  RNA Oligomer
uucuccugaacugaagaaacagg

SEQ ID NO: 34511 - RNA, 23 nt, Artificial Sequence
  RNA Oligomer
acaggcucuguuucagguucugg

SEQ ID NO: 34512 - RNA, 23 nt, Artificial Sequence
  RNA Oligomer
aaguguggcccucugguaugagu

SEQ ID NO: 34513 - RNA, 23 nt, Artificial Sequence
  RNA Oligomer
uuagaaccuggagaaagggucug

SEQ ID NO: 34514 - RNA, 23 nt, Artificial Sequence
  RNA Oligomer
uugguuuaguucccauggacgga

SEQ ID NO: 34515 - RNA, 23 nt, Artificial Sequence
  RNA Oligomer
gaagguggcugauuaguuugucc

SEQ ID NO: 34516 - RNA, 23 nt, Artificial Sequence
  RNA Oligomer
uuugcaaccugagcaucccgcaa

SEQ ID NO: 34517 - RNA, 23 nt, Artificial Sequence
  RNA Oligomer
uagagccuuuaguuugugaagca

SEQ ID NO: 34518 - RNA, 23 nt, Artificial Sequence
  RNA Oligomer
aaguuucccauugcuuagucucu

SEQ ID NO: 34519 - RNA, 23 nt, Artificial Sequence
  RNA Oligomer
uuccacguggccuuuaagugcuc

SEQ ID NO: 34520 - RNA, 23 nt, Artificial Sequence
  RNA Oligomer
uaaguuucuccugcucagcaacu

SEQ ID NO: 34521 - RNA, 23 nt, Artificial Sequence
  RNA Oligomer
aaaacacucaacaggacagagag

SEQ ID NO: 34522 - RNA, 23 nt, Artificial Sequence
  RNA Oligomer
aacaggacagagagcugauuucc

SEQ ID NO: 34523 - RNA, 23 nt, Artificial Sequence
  RNA Oligomer
acuuaucugagugcuacacggga

SEQ ID NO: 34524 - RNA, 23 nt, Artificial Sequence
  RNA Oligomer
acaccauuucuuuuuaaacuugg

SEQ ID NO: 34525 - RNA, 23 nt, Artificial Sequence
  RNA Oligomer
auguaauggaguccauccaucac

SEQ ID NO: 34526 - RNA, 23 nt, Artificial Sequence
  RNA Oligomer
acuccuccagguacacaucaagc

SEQ ID NO: 34527 - RNA, 23 nt, Artificial Sequence
  RNA Oligomer
cuacguuucuuuagaggccuugg

SEQ ID NO: 34528 - RNA, 23 nt, Artificial Sequence
  RNA Oligomer
uacguuucuuuagaggccuuggu

SEQ ID NO: 34529 - RNA, 23 nt, Artificial Sequence
  RNA Oligomer
uucuuucguaaggcuucuagguc

SEQ ID NO: 34530 - RNA, 23 nt, Artificial Sequence
  RNA Oligomer
acaggcuuaccauauacacuuga

SEQ ID NO: 34531 - RNA, 23 nt, Artificial Sequence
  RNA Oligomer
uaccauauacacuugaaaagugu

SEQ ID NO: 34532 - RNA, 23 nt, Artificial Sequence
  RNA Oligomer
ccauauacacuugaaaagugugg

SEQ ID NO: 34533 - RNA, 23 nt, Artificial Sequence
  RNA Oligomer
uacacuugaaaaguguggcccuc

SEQ ID NO: 34534 - RNA, 23 nt, Artificial Sequence
  RNA Oligomer
ccugcuggaaguuuuuuccuggc

SEQ ID NO: 34535 - RNA, 23 nt, Artificial Sequence
  RNA Oligomer
cuggcuuaaugucugaagguggc

SEQ ID NO: 34536 - RNA, 23 nt, Artificial Sequence
  RNA Oligomer
uuuguaggaacaggaggugguac

SEQ ID NO: 34537 - RNA, 23 nt, Artificial Sequence
  RNA Oligomer
gaacaggaggugguacuuuagcc

SEQ ID NO: 34538 - RNA, 23 nt, Artificial Sequence
  RNA Oligomer
ucccgcaagauaucuucacugcu

SEQ ID NO: 34539 - RNA, 23 nt, Artificial Sequence
  RNA Oligomer
uuucuggaguaacuggaacuucu

SEQ ID NO: 34540 - RNA, 23 nt, Artificial Sequence
  RNA Oligomer
uagcugcagcuccuuauagaggc

SEQ ID NO: 34541 - RNA, 23 nt, Artificial Sequence
  RNA Oligomer
ucagccacugcagacugauuguc

SEQ ID NO: 34542 - RNA, 23 nt, Artificial Sequence
  RNA Oligomer
aacuggaacuucugugaagugcu

SEQ ID NO: 34543 - RNA, 23 nt, Artificial Sequence
  RNA Oligomer
cuucugugaagugcugcucauug

SEQ ID NO: 34544 - RNA, 23 nt, Artificial Sequence
  RNA Oligomer
uucugugaagugcugcucauugu

SEQ ID NO: 34545 - RNA, 23 nt, Artificial Sequence
  RNA Oligomer
caaucagagacagcgaugugacg

SEQ ID NO: 34546 - RNA, 23 nt, Artificial Sequence
  RNA Oligomer
acaggacagagagcugauuuccc

SEQ ID NO: 34547 - RNA, 23 nt, Artificial Sequence
  RNA Oligomer
auucuuguagaaaacaggauugu

SEQ ID NO: 34548 - RNA, 23 nt, Artificial Sequence
  RNA Oligomer
uucucuucuagagacauucuuca

SEQ ID NO: 34549 - RNA, 23 nt, Artificial Sequence
  RNA Oligomer
uacugagauacacgguaagaaac

SEQ ID NO: 34550 - RNA, 23 nt, Artificial Sequence
  RNA Oligomer
ucaggccaagcuccuuugucuug

SEQ ID NO: 34551 - RNA, 23 nt, Artificial Sequence
  RNA Oligomer
caugaggcagcacaauguaaugg

SEQ ID NO: 34552 - RNA, 23 nt, Artificial Sequence
  RNA Oligomer
cguucaugacgaaggaagaagcg

SEQ ID NO: 34553 - RNA, 23 nt, Artificial Sequence
  RNA Oligomer
uugugaagagccgugaugccuuc

SEQ ID NO: 34554 - RNA, 23 nt, Artificial Sequence
  RNA Oligomer
acgaaggaagaagcgaacuucgu

SEQ ID NO: 34555 - RNA, 23 nt, Artificial Sequence
  RNA Oligomer
aagacgaaucuagcaguaaagca

SEQ ID NO: 34556 - RNA, 23 nt, Artificial Sequence
  RNA Oligomer
aaggaagaagcgaacuucguucc

SEQ ID NO: 34557 - RNA, 23 nt, Artificial Sequence
  RNA Oligomer
uuuaccaggaggcagagagaccu

SEQ ID NO: 34558 - RNA, 23 nt, Artificial Sequence
  RNA Oligomer
ugaauauuuggcccauuaggacc

SEQ ID NO: 34559 - RNA, 23 nt, Artificial Sequence
  RNA Oligomer
uuucuuuagaggccuuggugcgu

SEQ ID NO: 34560 - RNA, 23 nt, Artificial Sequence
  RNA Oligomer
cagccugcuggaaguuuuuuccu

SEQ ID NO: 34561 - RNA, 23 nt, Artificial Sequence
  RNA Oligomer
guggacuuucuugcuuagaaccu

SEQ ID NO: 34562 - RNA, 23 nt, Artificial Sequence
  RNA Oligomer
aagguggcugauuaguuugucca

SEQ ID NO: 34563 - RNA, 23 nt, Artificial Sequence
  RNA Oligomer
ucuggaguaacuggaacuucugu

SEQ ID NO: 34564 - RNA, 23 nt, Artificial Sequence
  RNA Oligomer
acuggaacuucugugaagugcug

SEQ ID NO: 34565 - RNA, 23 nt, Artificial Sequence
  RNA Oligomer
uggaacaaauuauucaucuguuc

SEQ ID NO: 34566 - RNA, 23 nt, Artificial Sequence
  RNA Oligomer
uguuccuuaguugccagcaauug

SEQ ID NO: 34567 - RNA, 23 nt, Artificial Sequence
  RNA Oligomer
uuuccugaaguucagcaagaguc

SEQ ID NO: 34568 - RNA, 23 nt, Artificial Sequence
  RNA Oligomer
caggauucuuguagaaaacagga

SEQ ID NO: 34569 - RNA, 23 nt, Artificial Sequence
  RNA Oligomer
aaaauucuguguggaaguuucag

SEQ ID NO: 34570 - RNA, 23 nt, Artificial Sequence
  RNA Oligomer
uggauccugagaucuugguccac

SEQ ID NO: 34571 - RNA, 23 nt, Artificial Sequence
  RNA Oligomer
cgcaccugaagaaugugaaggag

SEQ ID NO: 34572 - RNA, 23 nt, Artificial Sequence
  RNA Oligomer
ucgcaccugaagaaugugaagga

SEQ ID NO: 34573 - RNA, 23 nt, Artificial Sequence
  RNA Oligomer
cucgcaccugaagaaugugaagg

SEQ ID NO: 34574 - RNA, 23 nt, Artificial Sequence
  RNA Oligomer
acucgcaccugaagaaugugaag

SEQ ID NO: 34575 - RNA, 23 nt, Artificial Sequence
  RNA Oligomer
uacucgcaccugaagaaugugaa

SEQ ID NO: 34576 - RNA, 23 nt, Artificial Sequence
  RNA Oligomer
ggagaugcuucagaggauucgga

SEQ ID NO: 34577 - RNA, 23 nt, Artificial Sequence
  RNA Oligomer
aggagaugcuucagaggauucgg

SEQ ID NO: 34578 - RNA, 23 nt, Artificial Sequence
  RNA Oligomer
caggagaugcuucagaggauucg

SEQ ID NO: 34579 - RNA, 23 nt, Artificial Sequence
  RNA Oligomer
gcaggagaugcuucagaggauuc

SEQ ID NO: 34580 - RNA, 23 nt, Artificial Sequence
  RNA Oligomer
cgcaggagaugcuucagaggauu

SEQ ID NO: 34581 - RNA, 23 nt, Artificial Sequence
  RNA Oligomer
ccaccuucaagucucuccagugu

SEQ ID NO: 34582 - RNA, 23 nt, Artificial Sequence
  RNA Oligomer
cccaccuucaagucucuccagug

SEQ ID NO: 34583 - RNA, 23 nt, Artificial Sequence
  RNA Oligomer
ccccaccuucaagucucuccagu

SEQ ID NO: 34584 - RNA, 23 nt, Artificial Sequence
  RNA Oligomer
cccccaccuucaagucucuccag

SEQ ID NO: 34585 - RNA, 23 nt, Artificial Sequence
  RNA Oligomer
gcccccaccuucaagucucucca

SEQ ID NO: 34586 - RNA, 23 nt, Artificial Sequence
  RNA Oligomer
ucaagucucuccagugugugggg

SEQ ID NO: 34587 - RNA, 23 nt, Artificial Sequence
  RNA Oligomer
uucaagucucuccaguguguggg

SEQ ID NO: 34588 - RNA, 23 nt, Artificial Sequence
  RNA Oligomer
cuucaagucucuccagugugugg

SEQ ID NO: 34589 - RNA, 23 nt, Artificial Sequence
  RNA Oligomer
ccuucaagucucuccagugugug

SEQ ID NO: 34590 - RNA, 23 nt, Artificial Sequence
  RNA Oligomer
accuucaagucucuccagugugu

SEQ ID NO: 34591 - RNA, 23 nt, Artificial Sequence
  RNA Oligomer
caccuucaagucucuccagugug

SEQ ID NO: 34592 - RNA, 23 nt, Artificial Sequence
  RNA Oligomer
gaaucugcuuugucuucuacucg

SEQ ID NO: 34593 - RNA, 23 nt, Artificial Sequence
  RNA Oligomer
agaaucugcuuugucuucuacuc

SEQ ID NO: 34594 - RNA, 23 nt, Artificial Sequence
  RNA Oligomer
cagaaucugcuuugucuucuacu

SEQ ID NO: 34595 - RNA, 23 nt, Artificial Sequence
  RNA Oligomer
gcagaaucugcuuugucuucuac

SEQ ID NO: 34596 - RNA, 23 nt, Artificial Sequence
  RNA Oligomer
ggcagaaucugcuuugucuucua

SEQ ID NO: 34597 - RNA, 23 nt, Artificial Sequence
  RNA Oligomer
ccucagauuuggacagcuuuccu

SEQ ID NO: 34598 - RNA, 23 nt, Artificial Sequence
  RNA Oligomer
accucagauuuggacagcuuucc

SEQ ID NO: 34599 - RNA, 23 nt, Artificial Sequence
  RNA Oligomer
gaccucagauuuggacagcuuuc

SEQ ID NO: 34600 - RNA, 23 nt, Artificial Sequence
  RNA Oligomer
ugaccucagauuuggacagcuuu

SEQ ID NO: 34601 - RNA, 23 nt, Artificial Sequence
  RNA Oligomer
cugaccucagauuuggacagcuu

SEQ ID NO: 34602 - RNA, 23 nt, Artificial Sequence
  RNA Oligomer
ccgcaggagaugcuucagaggau

SEQ ID NO: 34603 - RNA, 23 nt, Artificial Sequence
  RNA Oligomer
gcacuguuucuuucaccucaaaa

SEQ ID NO: 34604 - RNA, 23 nt, Artificial Sequence
  RNA Oligomer
ugcacuguuucuuucaccucaaa

SEQ ID NO: 34605 - RNA, 23 nt, Artificial Sequence
  RNA Oligomer
cugcacuguuucuuucaccucaa

SEQ ID NO: 34606 - RNA, 23 nt, Artificial Sequence
  RNA Oligomer
acugcacuguuucuuucaccuca

SEQ ID NO: 34607 - RNA, 23 nt, Artificial Sequence
  RNA Oligomer
aacugcacuguuucuuucaccuc

SEQ ID NO: 34608 - RNA, 23 nt, Artificial Sequence
  RNA Oligomer
gucuucuacucgcaccugaagaa

SEQ ID NO: 34609 - RNA, 23 nt, Artificial Sequence
  RNA Oligomer
ugucuucuacucgcaccugaaga

SEQ ID NO: 34610 - RNA, 23 nt, Artificial Sequence
  RNA Oligomer
uugucuucuacucgcaccugaag

SEQ ID NO: 34611 - RNA, 23 nt, Artificial Sequence
  RNA Oligomer
uuugucuucuacucgcaccugaa

SEQ ID NO: 34612 - RNA, 23 nt, Artificial Sequence
  RNA Oligomer
cuuugucuucuacucgcaccuga

SEQ ID NO: 34613 - RNA, 23 nt, Artificial Sequence
  RNA Oligomer
gggaugacaucacagcucaggug

SEQ ID NO: 34614 - RNA, 23 nt, Artificial Sequence
  RNA Oligomer
ugggaugacaucacagcucaggu

SEQ ID NO: 34615 - RNA, 23 nt, Artificial Sequence
  RNA Oligomer
cugggaugacaucacagcucagg

SEQ ID NO: 34616 - RNA, 23 nt, Artificial Sequence
  RNA Oligomer
ccugggaugacaucacagcucag

SEQ ID NO: 34617 - RNA, 23 nt, Artificial Sequence
  RNA Oligomer
accugggaugacaucacagcuca

SEQ ID NO: 34618 - RNA, 23 nt, Artificial Sequence
  RNA Oligomer
uccucacagugacacacaaccgc

SEQ ID NO: 34619 - RNA, 23 nt, Artificial Sequence
  RNA Oligomer
uuccucacagugacacacaaccg

SEQ ID NO: 34620 - RNA, 23 nt, Artificial Sequence
  RNA Oligomer
cuuccucacagugacacacaacc

SEQ ID NO: 34621 - RNA, 23 nt, Artificial Sequence
  RNA Oligomer
ccuuccucacagugacacacaac

SEQ ID NO: 34622 - RNA, 23 nt, Artificial Sequence
  RNA Oligomer
accuuccucacagugacacacaa

SEQ ID NO: 34623 - RNA, 23 nt, Artificial Sequence
  RNA Oligomer
gcaccugaagaaugugaaggagg

SEQ ID NO: 34624 - RNA, 23 nt, Artificial Sequence
  RNA Oligomer
gcuuugucuucuacucgcaccug

SEQ ID NO: 34625 - RNA, 23 nt, Artificial Sequence
  RNA Oligomer
ugcuuugucuucuacucgcaccu

SEQ ID NO: 34626 - RNA, 23 nt, Artificial Sequence
  RNA Oligomer
cugcuuugucuucuacucgcacc

SEQ ID NO: 34627 - RNA, 23 nt, Artificial Sequence
  RNA Oligomer
ucugcuuugucuucuacucgcac

SEQ ID NO: 34628 - RNA, 23 nt, Artificial Sequence
  RNA Oligomer
aucugcuuugucuucuacucgca

SEQ ID NO: 34629 - RNA, 23 nt, Artificial Sequence
  RNA Oligomer
aaacugcacuguuucuuucaccu

SEQ ID NO: 34630 - RNA, 23 nt, Artificial Sequence
  RNA Oligomer
ccugugagcaacaaaacugcacu

SEQ ID NO: 34631 - RNA, 23 nt, Artificial Sequence
  RNA Oligomer
cccugugagcaacaaaacugcac

SEQ ID NO: 34632 - RNA, 23 nt, Artificial Sequence
  RNA Oligomer
ucccugugagcaacaaaacugca

SEQ ID NO: 34633 - RNA, 23 nt, Artificial Sequence
  RNA Oligomer
gucccugugagcaacaaaacugc

SEQ ID NO: 34634 - RNA, 23 nt, Artificial Sequence
  RNA Oligomer
ggucccugugagcaacaaaacug

SEQ ID NO: 34635 - RNA, 23 nt, Artificial Sequence
  RNA Oligomer
gggaugaucuggaugagcagauc

SEQ ID NO: 34636 - RNA, 23 nt, Artificial Sequence
  RNA Oligomer
cgggaugaucuggaugagcagau

SEQ ID NO: 34637 - RNA, 23 nt, Artificial Sequence
  RNA Oligomer
ccgggaugaucuggaugagcaga

SEQ ID NO: 34638 - RNA, 23 nt, Artificial Sequence
  RNA Oligomer
uccgggaugaucuggaugagcag

SEQ ID NO: 34639 - RNA, 23 nt, Artificial Sequence
  RNA Oligomer
uuccgggaugaucuggaugagca

SEQ ID NO: 34640 - RNA, 23 nt, Artificial Sequence
  RNA Oligomer
accugaagaaugugaaggaggua

SEQ ID NO: 34641 - RNA, 23 nt, Artificial Sequence
  RNA Oligomer
caccugaagaaugugaaggaggu

SEQ ID NO: 34642 - RNA, 23 nt, Artificial Sequence
  RNA Oligomer
cuacucgcaccugaagaauguga

SEQ ID NO: 34643 - RNA, 23 nt, Artificial Sequence
  RNA Oligomer
ucuacucgcaccugaagaaugug

SEQ ID NO: 34644 - RNA, 23 nt, Artificial Sequence
  RNA Oligomer
uucuacucgcaccugaagaaugu

SEQ ID NO: 34645 - RNA, 23 nt, Artificial Sequence
  RNA Oligomer
cuucuacucgcaccugaagaaug

SEQ ID NO: 34646 - RNA, 23 nt, Artificial Sequence
  RNA Oligomer
ucuucuacucgcaccugaagaau

SEQ ID NO: 34647 - RNA, 23 nt, Artificial Sequence
  RNA Oligomer
cgagggcgaagaguucuuugcgg

SEQ ID NO: 34648 - RNA, 23 nt, Artificial Sequence
  RNA Oligomer
ucgagggcgaagaguucuuugcg

SEQ ID NO: 34649 - RNA, 23 nt, Artificial Sequence
  RNA Oligomer
uucgagggcgaagaguucuuugc

SEQ ID NO: 34650 - RNA, 23 nt, Artificial Sequence
  RNA Oligomer
guucgagggcgaagaguucuuug

SEQ ID NO: 34651 - RNA, 23 nt, Artificial Sequence
  RNA Oligomer
uguucgagggcgaagaguucuuu

SEQ ID NO: 34652 - RNA, 23 nt, Artificial Sequence
  RNA Oligomer
ugcugcagguggaauucuugcgu

SEQ ID NO: 34653 - RNA, 23 nt, Artificial Sequence
  RNA Oligomer
cugcugcagguggaauucuugcg

SEQ ID NO: 34654 - RNA, 23 nt, Artificial Sequence
  RNA Oligomer
gcugcugcagguggaauucuugc

SEQ ID NO: 34655 - RNA, 23 nt, Artificial Sequence
  RNA Oligomer
agcugcugcagguggaauucuug

SEQ ID NO: 34656 - RNA, 23 nt, Artificial Sequence
  RNA Oligomer
cagcugcugcagguggaauucuu

SEQ ID NO: 34657 - RNA, 23 nt, Artificial Sequence
  RNA Oligomer
ccugaagaaugugaaggagguau

SEQ ID NO: 34658 - RNA, 23 nt, Artificial Sequence
  RNA Oligomer
gggcagaaucugcuuugucuucu

SEQ ID NO: 34659 - RNA, 23 nt, Artificial Sequence
  RNA Oligomer
agaguucuuugcggccuucgagc

SEQ ID NO: 34660 - RNA, 23 nt, Artificial Sequence
  RNA Oligomer
aagaguucuuugcggccuucgag

SEQ ID NO: 34661 - RNA, 23 nt, Artificial Sequence
  RNA Oligomer
gaagaguucuuugcggccuucga

SEQ ID NO: 34662 - RNA, 23 nt, Artificial Sequence
  RNA Oligomer
cgaagaguucuuugcggccuucg

SEQ ID NO: 34663 - RNA, 23 nt, Artificial Sequence
  RNA Oligomer
gcgaagaguucuuugcggccuuc

SEQ ID NO: 34664 - RNA, 23 nt, Artificial Sequence
  RNA Oligomer
guggaauucuugcgucugagcac

SEQ ID NO: 34665 - RNA, 23 nt, Artificial Sequence
  RNA Oligomer
gguggaauucuugcgucugagca

SEQ ID NO: 34666 - RNA, 23 nt, Artificial Sequence
  RNA Oligomer
agguggaauucuugcgucugagc

SEQ ID NO: 34667 - RNA, 23 nt, Artificial Sequence
  RNA Oligomer
cagguggaauucuugcgucugag

SEQ ID NO: 34668 - RNA, 23 nt, Artificial Sequence
  RNA Oligomer
gcagguggaauucuugcgucuga

SEQ ID NO: 34669 - RNA, 23 nt, Artificial Sequence
  RNA Oligomer
cugacacgguggagauguucgag

SEQ ID NO: 34670 - RNA, 23 nt, Artificial Sequence
  RNA Oligomer
ucugacacgguggagauguucga

SEQ ID NO: 34671 - RNA, 23 nt, Artificial Sequence
  RNA Oligomer
cucugacacgguggagauguucg

SEQ ID NO: 34672 - RNA, 23 nt, Artificial Sequence
  RNA Oligomer
ccucugacacgguggagauguuc

SEQ ID NO: 34673 - RNA, 23 nt, Artificial Sequence
  RNA Oligomer
cccucugacacgguggagauguu

SEQ ID NO: 34674 - RNA, 23 nt, Artificial Sequence
  RNA Oligomer
ggaugacaucacagcucaggugg

SEQ ID NO: 34675 - RNA, 23 nt, Artificial Sequence
  RNA Oligomer
ccugaccucagauuuggacagcu

SEQ ID NO: 34676 - RNA, 23 nt, Artificial Sequence
  RNA Oligomer
agauccgucacaugcucuucucc

SEQ ID NO: 34677 - RNA, 23 nt, Artificial Sequence
  RNA Oligomer
cagauccgucacaugcucuucuc

SEQ ID NO: 34678 - RNA, 23 nt, Artificial Sequence
  RNA Oligomer
gcagauccgucacaugcucuucu

SEQ ID NO: 34679 - RNA, 23 nt, Artificial Sequence
  RNA Oligomer
agcagauccgucacaugcucuuc

SEQ ID NO: 34680 - RNA, 23 nt, Artificial Sequence
  RNA Oligomer
gagcagauccgucacaugcucuu

SEQ ID NO: 34681 - RNA, 23 nt, Artificial Sequence
  RNA Oligomer
ugaagaaugugaaggagguauac

SEQ ID NO: 34682 - RNA, 23 nt, Artificial Sequence
  RNA Oligomer
cugaagaaugugaaggagguaua

SEQ ID NO: 34683 - RNA, 23 nt, Artificial Sequence
  RNA Oligomer
ggcgaagaguucuuugcggccuu

SEQ ID NO: 34684 - RNA, 23 nt, Artificial Sequence
  RNA Oligomer
gggcgaagaguucuuugcggccu

SEQ ID NO: 34685 - RNA, 23 nt, Artificial Sequence
  RNA Oligomer
ugcaccgugugaaccucaucgcu

SEQ ID NO: 34686 - RNA, 23 nt, Artificial Sequence
  RNA Oligomer
cugcaccgugugaaccucaucgc

SEQ ID NO: 34687 - RNA, 23 nt, Artificial Sequence
  RNA Oligomer
gcugcaccgugugaaccucaucg

SEQ ID NO: 34688 - RNA, 23 nt, Artificial Sequence
  RNA Oligomer
ggcugcaccgugugaaccucauc

SEQ ID NO: 34689 - RNA, 23 nt, Artificial Sequence
  RNA Oligomer
cggcugcaccgugugaaccucau

SEQ ID NO: 34690 - RNA, 23 nt, Artificial Sequence
  RNA Oligomer
caccugggaugacaucacagcuc

SEQ ID NO: 34691 - RNA, 23 nt, Artificial Sequence
  RNA Oligomer
ccaccugggaugacaucacagcu

SEQ ID NO: 34692 - RNA, 23 nt, Artificial Sequence
  RNA Oligomer
gccaccugggaugacaucacagc

SEQ ID NO: 34693 - RNA, 23 nt, Artificial Sequence
  RNA Oligomer
agccaccugggaugacaucacag

SEQ ID NO: 34694 - RNA, 23 nt, Artificial Sequence
  RNA Oligomer
cagccaccugggaugacaucaca

SEQ ID NO: 34695 - RNA, 23 nt, Artificial Sequence
  RNA Oligomer
uccgucacaugcucuucuccugg

SEQ ID NO: 34696 - RNA, 23 nt, Artificial Sequence
  RNA Oligomer
auccgucacaugcucuucuccug

SEQ ID NO: 34697 - RNA, 23 nt, Artificial Sequence
  RNA Oligomer
gauccgucacaugcucuucuccu

SEQ ID NO: 34698 - RNA, 23 nt, Artificial Sequence
  RNA Oligomer
cucagauuuggacagcuuuccug

SEQ ID NO: 34699 - RNA, 23 nt, Artificial Sequence
  RNA Oligomer
acuguguggagggcagaaucugc

SEQ ID NO: 34700 - RNA, 23 nt, Artificial Sequence
  RNA Oligomer
gacuguguggagggcagaaucug

SEQ ID NO: 34701 - RNA, 23 nt, Artificial Sequence
  RNA Oligomer
ugacuguguggagggcagaaucu

SEQ ID NO: 34702 - RNA, 23 nt, Artificial Sequence
  RNA Oligomer
cugacuguguggagggcagaauc

SEQ ID NO: 34703 - RNA, 23 nt, Artificial Sequence
  RNA Oligomer
ccugacuguguggagggcagaau

SEQ ID NO: 34704 - RNA, 23 nt, Artificial Sequence
  RNA Oligomer
uggaauucuugcgucugagcacu

SEQ ID NO: 34705 - RNA, 23 nt, Artificial Sequence
  RNA Oligomer
auguucgagggcgaagaguucuu

SEQ ID NO: 34706 - RNA, 23 nt, Artificial Sequence
  RNA Oligomer
cacuucuccugguuccuuguggu

SEQ ID NO: 34707 - RNA, 23 nt, Artificial Sequence
  RNA Oligomer
ccacuucuccugguuccuugugg

SEQ ID NO: 34708 - RNA, 23 nt, Artificial Sequence
  RNA Oligomer
cccacuucuccugguuccuugug

SEQ ID NO: 34709 - RNA, 23 nt, Artificial Sequence
  RNA Oligomer
ccccacuucuccugguuccuugu

SEQ ID NO: 34710 - RNA, 23 nt, Artificial Sequence
  RNA Oligomer
gccccacuucuccugguuccuug

SEQ ID NO: 34711 - RNA, 23 nt, Artificial Sequence
  RNA Oligomer
gucacaugcucuucuccugggcu

SEQ ID NO: 34712 - RNA, 23 nt, Artificial Sequence
  RNA Oligomer
cgucacaugcucuucuccugggc

SEQ ID NO: 34713 - RNA, 23 nt, Artificial Sequence
  RNA Oligomer
ccgucacaugcucuucuccuggg

SEQ ID NO: 34714 - RNA, 23 nt, Artificial Sequence
  RNA Oligomer
acacgguggagauguucgagggc

SEQ ID NO: 34715 - RNA, 23 nt, Artificial Sequence
  RNA Oligomer
gacacgguggagauguucgaggg

SEQ ID NO: 34716 - RNA, 23 nt, Artificial Sequence
  RNA Oligomer
ugacacgguggagauguucgagg

SEQ ID NO: 34717 - RNA, 23 nt, Artificial Sequence
  RNA Oligomer
cuguuccugaccucagauuugga

SEQ ID NO: 34718 - RNA, 23 nt, Artificial Sequence
  RNA Oligomer
acuguuccugaccucagauuugg

SEQ ID NO: 34719 - RNA, 23 nt, Artificial Sequence
  RNA Oligomer
gacuguuccugaccucagauuug

SEQ ID NO: 34720 - RNA, 23 nt, Artificial Sequence
  RNA Oligomer
agacuguuccugaccucagauuu

SEQ ID NO: 34721 - RNA, 23 nt, Artificial Sequence
  RNA Oligomer
cagacuguuccugaccucagauu

SEQ ID NO: 34722 - RNA, 23 nt, Artificial Sequence
  RNA Oligomer
caacaaaacugcacuguuucuuu

SEQ ID NO: 34723 - RNA, 23 nt, Artificial Sequence
  RNA Oligomer
gcaacaaaacugcacuguuucuu

SEQ ID NO: 34724 - RNA, 23 nt, Artificial Sequence
  RNA Oligomer
agcaacaaaacugcacuguuucu

SEQ ID NO: 34725 - RNA, 23 nt, Artificial Sequence
  RNA Oligomer
gagcaacaaaacugcacuguuuc

SEQ ID NO: 34726 - RNA, 23 nt, Artificial Sequence
  RNA Oligomer
ugagcaacaaaacugcacuguuu

SEQ ID NO: 34727 - RNA, 23 nt, Artificial Sequence
  RNA Oligomer
cgcucuugcugucucacaacugc

SEQ ID NO: 34728 - RNA, 23 nt, Artificial Sequence
  RNA Oligomer
gcgcucuugcugucucacaacug

SEQ ID NO: 34729 - RNA, 23 nt, Artificial Sequence
  RNA Oligomer
ugcgcucuugcugucucacaacu

SEQ ID NO: 34730 - RNA, 23 nt, Artificial Sequence
  RNA Oligomer
gugcgcucuugcugucucacaac

SEQ ID NO: 34731 - RNA, 23 nt, Artificial Sequence
  RNA Oligomer
ggugcgcucuugcugucucacaa

SEQ ID NO: 34732 - RNA, 23 nt, Artificial Sequence
  RNA Oligomer
accuggaccugagcuucaacagc

SEQ ID NO: 34733 - RNA, 23 nt, Artificial Sequence
  RNA Oligomer
caccuggaccugagcuucaacag

SEQ ID NO: 34734 - RNA, 23 nt, Artificial Sequence
  RNA Oligomer
ccaccuggaccugagcuucaaca

SEQ ID NO: 34735 - RNA, 23 nt, Artificial Sequence
  RNA Oligomer
cccaccuggaccugagcuucaac

SEQ ID NO: 34736 - RNA, 23 nt, Artificial Sequence
  RNA Oligomer
gcccaccuggaccugagcuucaa

SEQ ID NO: 34737 - RNA, 23 nt, Artificial Sequence
  RNA Oligomer
gccucgaucucucucagaaucug

SEQ ID NO: 34738 - RNA, 23 nt, Artificial Sequence
  RNA Oligomer
cgccucgaucucucucagaaucu

SEQ ID NO: 34739 - RNA, 23 nt, Artificial Sequence
  RNA Oligomer
gcgccucgaucucucucagaauc

SEQ ID NO: 34740 - RNA, 23 nt, Artificial Sequence
  RNA Oligomer
agcgccucgaucucucucagaau

SEQ ID NO: 34741 - RNA, 23 nt, Artificial Sequence
  RNA Oligomer
cagcgccucgaucucucucagaa

SEQ ID NO: 34742 - RNA, 23 nt, Artificial Sequence
  RNA Oligomer
ucaacagccuggagacacugccg

SEQ ID NO: 34743 - RNA, 23 nt, Artificial Sequence
  RNA Oligomer
uucaacagccuggagacacugcc

SEQ ID NO: 34744 - RNA, 23 nt, Artificial Sequence
  RNA Oligomer
cuucaacagccuggagacacugc

SEQ ID NO: 34745 - RNA, 23 nt, Artificial Sequence
  RNA Oligomer
gcuucaacagccuggagacacug

SEQ ID NO: 34746 - RNA, 23 nt, Artificial Sequence
  RNA Oligomer
agcuucaacagccuggagacacu

SEQ ID NO: 34747 - RNA, 23 nt, Artificial Sequence
  RNA Oligomer
ggagggcagaaucugcuuugucu

SEQ ID NO: 34748 - RNA, 23 nt, Artificial Sequence
  RNA Oligomer
uggagggcagaaucugcuuuguc

SEQ ID NO: 34749 - RNA, 23 nt, Artificial Sequence
  RNA Oligomer
guggagggcagaaucugcuuugu

SEQ ID NO: 34750 - RNA, 23 nt, Artificial Sequence
  RNA Oligomer
uguggagggcagaaucugcuuug

SEQ ID NO: 34751 - RNA, 23 nt, Artificial Sequence
  RNA Oligomer
guguggagggcagaaucugcuuu

SEQ ID NO: 34752 - RNA, 23 nt, Artificial Sequence
  RNA Oligomer
acccuugaaucugggagaugccg

SEQ ID NO: 34753 - RNA, 23 nt, Artificial Sequence
  RNA Oligomer
cacccuugaaucugggagaugcc

SEQ ID NO: 34754 - RNA, 23 nt, Artificial Sequence
  RNA Oligomer
gcacccuugaaucugggagaugc

SEQ ID NO: 34755 - RNA, 23 nt, Artificial Sequence
  RNA Oligomer
ggcacccuugaaucugggagaug

SEQ ID NO: 34756 - RNA, 23 nt, Artificial Sequence
  RNA Oligomer
uggcacccuugaaucugggagau

SEQ ID NO: 34757 - RNA, 23 nt, Artificial Sequence
  RNA Oligomer
uuggcacccuugaaucugggaga

SEQ ID NO: 34758 - RNA, 23 nt, Artificial Sequence
  RNA Oligomer
gggucccugugagcaacaaaacu

SEQ ID NO: 34759 - RNA, 23 nt, Artificial Sequence
  RNA Oligomer
cgggucccugugagcaacaaaac

SEQ ID NO: 34760 - RNA, 23 nt, Artificial Sequence
  RNA Oligomer
acgggucccugugagcaacaaaa

SEQ ID NO: 34761 - RNA, 23 nt, Artificial Sequence
  RNA Oligomer
agggcagaaucugcuuugucuuc

SEQ ID NO: 34762 - RNA, 23 nt, Artificial Sequence
  RNA Oligomer
gagggcagaaucugcuuugucuu

SEQ ID NO: 34763 - RNA, 23 nt, Artificial Sequence
  RNA Oligomer
cacgcuaccuccugagauuggag

SEQ ID NO: 34764 - RNA, 23 nt, Artificial Sequence
  RNA Oligomer
acacgcuaccuccugagauugga

SEQ ID NO: 34765 - RNA, 23 nt, Artificial Sequence
  RNA Oligomer
gacacgcuaccuccugagauugg

SEQ ID NO: 34766 - RNA, 23 nt, Artificial Sequence
  RNA Oligomer
ggacacgcuaccuccugagauug

SEQ ID NO: 34767 - RNA, 23 nt, Artificial Sequence
  RNA Oligomer
uggacacgcuaccuccugagauu

SEQ ID NO: 34768 - RNA, 23 nt, Artificial Sequence
  RNA Oligomer
caaaacugcacuguuucuuucac

SEQ ID NO: 34769 - RNA, 23 nt, Artificial Sequence
  RNA Oligomer
acaaaacugcacuguuucuuuca

SEQ ID NO: 34770 - RNA, 23 nt, Artificial Sequence
  RNA Oligomer
aacaaaacugcacuguuucuuuc

SEQ ID NO: 34771 - RNA, 23 nt, Artificial Sequence
  RNA Oligomer
gcaaguaccaggacagcauccga

SEQ ID NO: 34772 - RNA, 23 nt, Artificial Sequence
  RNA Oligomer
cgcaaguaccaggacagcauccg

SEQ ID NO: 34773 - RNA, 23 nt, Artificial Sequence
  RNA Oligomer
ccgcaaguaccaggacagcaucc

SEQ ID NO: 34774 - RNA, 23 nt, Artificial Sequence
  RNA Oligomer
gccgcaaguaccaggacagcauc

SEQ ID NO: 34775 - RNA, 23 nt, Artificial Sequence
  RNA Oligomer
cgccgcaaguaccaggacagcau

SEQ ID NO: 34776 - RNA, 23 nt, Artificial Sequence
  RNA Oligomer
cuggaccugagcuucaacagccu

SEQ ID NO: 34777 - RNA, 23 nt, Artificial Sequence
  RNA Oligomer
ccuggaccugagcuucaacagcc

SEQ ID NO: 34778 - RNA, 23 nt, Artificial Sequence
  RNA Oligomer
gcuuucugacgcagagcaaccug

SEQ ID NO: 34779 - RNA, 23 nt, Artificial Sequence
  RNA Oligomer
ggcuuucugacgcagagcaaccu

SEQ ID NO: 34780 - RNA, 23 nt, Artificial Sequence
  RNA Oligomer
cggcuuucugacgcagagcaacc

SEQ ID NO: 34781 - RNA, 23 nt, Artificial Sequence
  RNA Oligomer
ccggcuuucugacgcagagcaac

SEQ ID NO: 34782 - RNA, 23 nt, Artificial Sequence
  RNA Oligomer
accggcuuucugacgcagagcaa

SEQ ID NO: 34783 - RNA, 23 nt, Artificial Sequence
  RNA Oligomer
agaccuaccuggaggaagaggca

SEQ ID NO: 34784 - RNA, 23 nt, Artificial Sequence
  RNA Oligomer
gagaccuaccuggaggaagaggc

SEQ ID NO: 34785 - RNA, 23 nt, Artificial Sequence
  RNA Oligomer
ggagaccuaccuggaggaagagg

SEQ ID NO: 34786 - RNA, 23 nt, Artificial Sequence
  RNA Oligomer
uggagaccuaccuggaggaagag

SEQ ID NO: 34787 - RNA, 23 nt, Artificial Sequence
  RNA Oligomer
cuggagaccuaccuggaggaaga

SEQ ID NO: 34788 - RNA, 23 nt, Artificial Sequence
  RNA Oligomer
ccucgaucucucucagaaucugc

SEQ ID NO: 34789 - RNA, 23 nt, Artificial Sequence
  RNA Oligomer
cucuugcugucucacaacugccu

SEQ ID NO: 34790 - RNA, 23 nt, Artificial Sequence
  RNA Oligomer
gcucuugcugucucacaacugcc

SEQ ID NO: 34791 - RNA, 23 nt, Artificial Sequence
  RNA Oligomer
agagcaaccugcugaguguggcu

SEQ ID NO: 34792 - RNA, 23 nt, Artificial Sequence
  RNA Oligomer
cagagcaaccugcugaguguggc

SEQ ID NO: 34793 - RNA, 23 nt, Artificial Sequence
  RNA Oligomer
gcagagcaaccugcugagugugg

SEQ ID NO: 34794 - RNA, 23 nt, Artificial Sequence
  RNA Oligomer
cgcagagcaaccugcugagugug

SEQ ID NO: 34795 - RNA, 23 nt, Artificial Sequence
  RNA Oligomer
acgcagagcaaccugcugagugu

SEQ ID NO: 34796 - RNA, 23 nt, Artificial Sequence
  RNA Oligomer
cucugguacaccaccaagaacug

SEQ ID NO: 34797 - RNA, 23 nt, Artificial Sequence
  RNA Oligomer
gcucugguacaccaccaagaacu

SEQ ID NO: 34798 - RNA, 23 nt, Artificial Sequence
  RNA Oligomer
ggcucugguacaccaccaagaac

SEQ ID NO: 34799 - RNA, 23 nt, Artificial Sequence
  RNA Oligomer
uggcucugguacaccaccaagaa

SEQ ID NO: 34800 - RNA, 23 nt, Artificial Sequence
  RNA Oligomer
cuggcucugguacaccaccaaga

SEQ ID NO: 34801 - RNA, 23 nt, Artificial Sequence
  RNA Oligomer
ccugguuccuugugguuucccgc

SEQ ID NO: 34802 - RNA, 23 nt, Artificial Sequence
  RNA Oligomer
uccugguuccuugugguuucccg

SEQ ID NO: 34803 - RNA, 23 nt, Artificial Sequence
  RNA Oligomer
cuccugguuccuugugguuuccc

SEQ ID NO: 34804 - RNA, 23 nt, Artificial Sequence
  RNA Oligomer
ucuccugguuccuugugguuucc

SEQ ID NO: 34805 - RNA, 23 nt, Artificial Sequence
  RNA Oligomer
uucuccugguuccuugugguuuc

SEQ ID NO: 34806 - RNA, 23 nt, Artificial Sequence
  RNA Oligomer
cucgaucucucucagaaucugcu

SEQ ID NO: 34807 - RNA, 23 nt, Artificial Sequence
  RNA Oligomer
gugagcaacaaaacugcacuguu

SEQ ID NO: 34808 - RNA, 23 nt, Artificial Sequence
  RNA Oligomer
ugugagcaacaaaacugcacugu

SEQ ID NO: 34809 - RNA, 23 nt, Artificial Sequence
  RNA Oligomer
cugugagcaacaaaacugcacug

SEQ ID NO: 34810 - RNA, 23 nt, Artificial Sequence
  RNA Oligomer
gacgggucccugugagcaacaaa

SEQ ID NO: 34811 - RNA, 23 nt, Artificial Sequence
  RNA Oligomer
ugagcuucaacagccuggagaca

SEQ ID NO: 34812 - RNA, 23 nt, Artificial Sequence
  RNA Oligomer
cugagcuucaacagccuggagac

SEQ ID NO: 34813 - RNA, 23 nt, Artificial Sequence
  RNA Oligomer
ccugagcuucaacagccuggaga

SEQ ID NO: 34814 - RNA, 23 nt, Artificial Sequence
  RNA Oligomer
accugagcuucaacagccuggag

SEQ ID NO: 34815 - RNA, 23 nt, Artificial Sequence
  RNA Oligomer
gaccugagcuucaacagccugga

SEQ ID NO: 34816 - RNA, 23 nt, Artificial Sequence
  RNA Oligomer
cuccuuggcacccuugaaucugg

SEQ ID NO: 34817 - RNA, 23 nt, Artificial Sequence
  RNA Oligomer
ucuccuuggcacccuugaaucug

SEQ ID NO: 34818 - RNA, 23 nt, Artificial Sequence
  RNA Oligomer
cucuccuuggcacccuugaaucu

SEQ ID NO: 34819 - RNA, 23 nt, Artificial Sequence
  RNA Oligomer
ccucuccuuggcacccuugaauc

SEQ ID NO: 34820 - RNA, 23 nt, Artificial Sequence
  RNA Oligomer
gccucuccuuggcacccuugaau

SEQ ID NO: 34821 - RNA, 23 nt, Artificial Sequence
  RNA Oligomer
ugcagguggaauucuugcgucug

SEQ ID NO: 34822 - RNA, 23 nt, Artificial Sequence
  RNA Oligomer
cugcagguggaauucuugcgucu

SEQ ID NO: 34823 - RNA, 23 nt, Artificial Sequence
  RNA Oligomer
gcugcagguggaauucuugcguc

SEQ ID NO: 34824 - RNA, 23 nt, Artificial Sequence
  RNA Oligomer
ccagacuguuccugaccucagau

SEQ ID NO: 34825 - RNA, 23 nt, Artificial Sequence
  RNA Oligomer
cccagacuguuccugaccucaga

SEQ ID NO: 34826 - RNA, 23 nt, Artificial Sequence
  RNA Oligomer
agcccucauuccagaaaugccca

SEQ ID NO: 34827 - RNA, 23 nt, Artificial Sequence
  RNA Oligomer
cagcccucauuccagaaaugccc

SEQ ID NO: 34828 - RNA, 23 nt, Artificial Sequence
  RNA Oligomer
gcagcccucauuccagaaaugcc

SEQ ID NO: 34829 - RNA, 23 nt, Artificial Sequence
  RNA Oligomer
ggcagcccucauuccagaaaugc

SEQ ID NO: 34830 - RNA, 23 nt, Artificial Sequence
  RNA Oligomer
uggcagcccucauuccagaaaug

SEQ ID NO: 34831 - RNA, 23 nt, Artificial Sequence
  RNA Oligomer
guggcagcccucauuccagaaau

SEQ ID NO: 34832 - RNA, 23 nt, Artificial Sequence
  RNA Oligomer
aguggcagcccucauuccagaaa

SEQ ID NO: 34833 - RNA, 23 nt, Artificial Sequence
  RNA Oligomer
ugccccacuucuccugguuccuu

SEQ ID NO: 34834 - RNA, 23 nt, Artificial Sequence
  RNA Oligomer
uccugaccucagauuuggacagc

SEQ ID NO: 34835 - RNA, 23 nt, Artificial Sequence
  RNA Oligomer
uuccugaccucagauuuggacag

SEQ ID NO: 34836 - RNA, 23 nt, Artificial Sequence
  RNA Oligomer
guuccugaccucagauuuggaca

SEQ ID NO: 34837 - RNA, 23 nt, Artificial Sequence
  RNA Oligomer
uguuccugaccucagauuuggac

SEQ ID NO: 34838 - RNA, 23 nt, Artificial Sequence
  RNA Oligomer
uccuuguccugcacagcaaccuc

SEQ ID NO: 34839 - RNA, 23 nt, Artificial Sequence
  RNA Oligomer
cuccuuguccugcacagcaaccu

SEQ ID NO: 34840 - RNA, 23 nt, Artificial Sequence
  RNA Oligomer
gcuccuuguccugcacagcaacc

SEQ ID NO: 34841 - RNA, 23 nt, Artificial Sequence
  RNA Oligomer
ggcuccuuguccugcacagcaac

SEQ ID NO: 34842 - RNA, 23 nt, Artificial Sequence
  RNA Oligomer
cggcuccuuguccugcacagcaa

SEQ ID NO: 34843 - RNA, 23 nt, Artificial Sequence
  RNA Oligomer
cuuuuaggcuggcccagauauuc

SEQ ID NO: 34844 - RNA, 23 nt, Artificial Sequence
  RNA Oligomer
acuuuuaggcuggcccagauauu

SEQ ID NO: 34845 - RNA, 23 nt, Artificial Sequence
  RNA Oligomer
gacuuuuaggcuggcccagauau

SEQ ID NO: 34846 - RNA, 23 nt, Artificial Sequence
  RNA Oligomer
agacuuuuaggcuggcccagaua

SEQ ID NO: 34847 - RNA, 23 nt, Artificial Sequence
  RNA Oligomer
cagacuuuuaggcuggcccagau

SEQ ID NO: 34848 - RNA, 23 nt, Artificial Sequence
  RNA Oligomer
agauguucgagggcgaagaguuc

SEQ ID NO: 34849 - RNA, 23 nt, Artificial Sequence
  RNA Oligomer
gagauguucgagggcgaagaguu

SEQ ID NO: 34850 - RNA, 23 nt, Artificial Sequence
  RNA Oligomer
ggagauguucgagggcgaagagu

SEQ ID NO: 34851 - RNA, 23 nt, Artificial Sequence
  RNA Oligomer
uggagauguucgagggcgaagag

SEQ ID NO: 34852 - RNA, 23 nt, Artificial Sequence
  RNA Oligomer
guggagauguucgagggcgaaga

SEQ ID NO: 34853 - RNA, 23 nt, Artificial Sequence
  RNA Oligomer
cuucuccugguuccuugugguuu

SEQ ID NO: 34854 - RNA, 23 nt, Artificial Sequence
  RNA Oligomer
acuucuccugguuccuugugguu

SEQ ID NO: 34855 - RNA, 23 nt, Artificial Sequence
  RNA Oligomer
gcuaccuccugagauuggaggcc

SEQ ID NO: 34856 - RNA, 23 nt, Artificial Sequence
  RNA Oligomer
cgcuaccuccugagauuggaggc

SEQ ID NO: 34857 - RNA, 23 nt, Artificial Sequence
  RNA Oligomer
acgcuaccuccugagauuggagg

SEQ ID NO: 34858 - RNA, 23 nt, Artificial Sequence
  RNA Oligomer
cuggacacgcuaccuccugagau

SEQ ID NO: 34859 - RNA, 23 nt, Artificial Sequence
  RNA Oligomer
cucagaaucugcuggacacgcua

SEQ ID NO: 34860 - RNA, 23 nt, Artificial Sequence
  RNA Oligomer
ucucagaaucugcuggacacgcu

SEQ ID NO: 34861 - RNA, 23 nt, Artificial Sequence
  RNA Oligomer
cucucagaaucugcuggacacgc

SEQ ID NO: 34862 - RNA, 23 nt, Artificial Sequence
  RNA Oligomer
ucucucagaaucugcuggacacg

SEQ ID NO: 34863 - RNA, 23 nt, Artificial Sequence
  RNA Oligomer
cucucucagaaucugcuggacac

SEQ ID NO: 34864 - RNA, 23 nt, Artificial Sequence
  RNA Oligomer
ucaccuuccucacagugacacac

SEQ ID NO: 34865 - RNA, 23 nt, Artificial Sequence
  RNA Oligomer
cucaccuuccucacagugacaca

SEQ ID NO: 34866 - RNA, 23 nt, Artificial Sequence
  RNA Oligomer
ccucaccuuccucacagugacac

SEQ ID NO: 34867 - RNA, 23 nt, Artificial Sequence
  RNA Oligomer
cccucaccuuccucacagugaca

SEQ ID NO: 34868 - RNA, 23 nt, Artificial Sequence
  RNA Oligomer
gcccucaccuuccucacagugac

SEQ ID NO: 34869 - RNA, 23 nt, Artificial Sequence
  RNA Oligomer
ugguacaccaccaagaacugugu

SEQ ID NO: 34870 - RNA, 23 nt, Artificial Sequence
  RNA Oligomer
cugguacaccaccaagaacugug

SEQ ID NO: 34871 - RNA, 23 nt, Artificial Sequence
  RNA Oligomer
ucugguacaccaccaagaacugu

SEQ ID NO: 34872 - RNA, 23 nt, Artificial Sequence
  RNA Oligomer
gcagcugcugcagguggaauucu

SEQ ID NO: 34873 - RNA, 23 nt, Artificial Sequence
  RNA Oligomer
ugcagcugcugcagguggaauuc

SEQ ID NO: 34874 - RNA, 23 nt, Artificial Sequence
  RNA Oligomer
cugcagcugcugcagguggaauu

SEQ ID NO: 34875 - RNA, 23 nt, Artificial Sequence
  RNA Oligomer
gagcuucaacagccuggagacac

SEQ ID NO: 34876 - RNA, 23 nt, Artificial Sequence
  RNA Oligomer
ugaucuggaugagcagauccguc

SEQ ID NO: 34877 - RNA, 23 nt, Artificial Sequence
  RNA Oligomer
augaucuggaugagcagauccgu

SEQ ID NO: 34878 - RNA, 23 nt, Artificial Sequence
  RNA Oligomer
gaugaucuggaugagcagauccg

SEQ ID NO: 34879 - RNA, 23 nt, Artificial Sequence
  RNA Oligomer
ggaugaucuggaugagcagaucc

SEQ ID NO: 34880 - RNA, 23 nt, Artificial Sequence
  RNA Oligomer
ugaaccucaucgcucugcagcgg

SEQ ID NO: 34881 - RNA, 23 nt, Artificial Sequence
  RNA Oligomer
gugaaccucaucgcucugcagcg

SEQ ID NO: 34882 - RNA, 23 nt, Artificial Sequence
  RNA Oligomer
ugugaaccucaucgcucugcagc

SEQ ID NO: 34883 - RNA, 23 nt, Artificial Sequence
  RNA Oligomer
gugugaaccucaucgcucugcag

SEQ ID NO: 34884 - RNA, 23 nt, Artificial Sequence
  RNA Oligomer
cgugugaaccucaucgcucugca

SEQ ID NO: 34885 - RNA, 23 nt, Artificial Sequence
  RNA Oligomer
ugacaucacagcucagguggucc

SEQ ID NO: 34886 - RNA, 23 nt, Artificial Sequence
  RNA Oligomer
augacaucacagcucaggugguc

SEQ ID NO: 34887 - RNA, 23 nt, Artificial Sequence
  RNA Oligomer
gaugacaucacagcucagguggu

SEQ ID NO: 34888 - RNA, 23 nt, Artificial Sequence
  RNA Oligomer
gggucaaagucaucuuccccccu

SEQ ID NO: 34889 - RNA, 23 nt, Artificial Sequence
  RNA Oligomer
ggggucaaagucaucuucccccc

SEQ ID NO: 34890 - RNA, 23 nt, Artificial Sequence
  RNA Oligomer
uggggucaaagucaucuuccccc

SEQ ID NO: 34891 - RNA, 23 nt, Artificial Sequence
  RNA Oligomer
cuggggucaaagucaucuucccc

SEQ ID NO: 34892 - RNA, 23 nt, Artificial Sequence
  RNA Oligomer
ccuggggucaaagucaucuuccc

SEQ ID NO: 34893 - RNA, 23 nt, Artificial Sequence
  RNA Oligomer
cccacagacuuuuaggcuggccc

SEQ ID NO: 34894 - RNA, 23 nt, Artificial Sequence
  RNA Oligomer
ccccacagacuuuuaggcuggcc

SEQ ID NO: 34895 - RNA, 23 nt, Artificial Sequence
  RNA Oligomer
gccccacagacuuuuaggcuggc

SEQ ID NO: 34896 - RNA, 23 nt, Artificial Sequence
  RNA Oligomer
ggccccacagacuuuuaggcugg

SEQ ID NO: 34897 - RNA, 23 nt, Artificial Sequence
  RNA Oligomer
aggccccacagacuuuuaggcug

SEQ ID NO: 34898 - RNA, 23 nt, Artificial Sequence
  RNA Oligomer
uggacagcuuuccugugaccccu

SEQ ID NO: 34899 - RNA, 23 nt, Artificial Sequence
  RNA Oligomer
uuggacagcuuuccugugacccc

SEQ ID NO: 34900 - RNA, 23 nt, Artificial Sequence
  RNA Oligomer
uuuggacagcuuuccugugaccc

SEQ ID NO: 34901 - RNA, 23 nt, Artificial Sequence
  RNA Oligomer
auuuggacagcuuuccugugacc

SEQ ID NO: 34902 - RNA, 23 nt, Artificial Sequence
  RNA Oligomer
gauuuggacagcuuuccugugac

SEQ ID NO: 34903 - RNA, 23 nt, Artificial Sequence
  RNA Oligomer
ccacagacuuuuaggcuggccca

SEQ ID NO: 34904 - RNA, 23 nt, Artificial Sequence
  RNA Oligomer
ggaccugagcuucaacagccugg

SEQ ID NO: 34905 - RNA, 23 nt, Artificial Sequence
  RNA Oligomer
uggaccugagcuucaacagccug

SEQ ID NO: 34906 - RNA, 23 nt, Artificial Sequence
  RNA Oligomer
guuccgggaugaucuggaugagc

SEQ ID NO: 34907 - RNA, 23 nt, Artificial Sequence
  RNA Oligomer
aguuccgggaugaucuggaugag

SEQ ID NO: 34908 - RNA, 23 nt, Artificial Sequence
  RNA Oligomer
gaguuccgggaugaucuggauga

SEQ ID NO: 34909 - RNA, 23 nt, Artificial Sequence
  RNA Oligomer
cgaguuccgggaugaucuggaug

SEQ ID NO: 34910 - RNA, 23 nt, Artificial Sequence
  RNA Oligomer
acgaguuccgggaugaucuggau

SEQ ID NO: 34911 - RNA, 23 nt, Artificial Sequence
  RNA Oligomer
ccgugugaaccucaucgcucugc

SEQ ID NO: 34912 - RNA, 23 nt, Artificial Sequence
  RNA Oligomer
accgugugaaccucaucgcucug

SEQ ID NO: 34913 - RNA, 23 nt, Artificial Sequence
  RNA Oligomer
caccgugugaaccucaucgcucu

SEQ ID NO: 34914 - RNA, 23 nt, Artificial Sequence
  RNA Oligomer
ccagaaaugcccagacuguuccu

SEQ ID NO: 34915 - RNA, 23 nt, Artificial Sequence
  RNA Oligomer
uccagaaaugcccagacuguucc

SEQ ID NO: 34916 - RNA, 23 nt, Artificial Sequence
  RNA Oligomer
uuccagaaaugcccagacuguuc

SEQ ID NO: 34917 - RNA, 23 nt, Artificial Sequence
  RNA Oligomer
auuccagaaaugcccagacuguu

SEQ ID NO: 34918 - RNA, 23 nt, Artificial Sequence
  RNA Oligomer
cauuccagaaaugcccagacugu

SEQ ID NO: 34919 - RNA, 23 nt, Artificial Sequence
  RNA Oligomer
agaaucugcuggacacgcuaccu

SEQ ID NO: 34920 - RNA, 23 nt, Artificial Sequence
  RNA Oligomer
cagaaucugcuggacacgcuacc

SEQ ID NO: 34921 - RNA, 23 nt, Artificial Sequence
  RNA Oligomer
ucagaaucugcuggacacgcuac

SEQ ID NO: 34922 - RNA, 23 nt, Artificial Sequence
  RNA Oligomer
ucucucucagaaucugcuggaca

SEQ ID NO: 34923 - RNA, 23 nt, Artificial Sequence
  RNA Oligomer
aucucucucagaaucugcuggac

SEQ ID NO: 34924 - RNA, 23 nt, Artificial Sequence
  RNA Oligomer
cgaucucucucagaaucugcugg

SEQ ID NO: 34925 - RNA, 23 nt, Artificial Sequence
  RNA Oligomer
ucgaucucucucagaaucugcug

SEQ ID NO: 34926 - RNA, 23 nt, Artificial Sequence
  RNA Oligomer
cccuugaaucugggagaugccga

SEQ ID NO: 34927 - RNA, 23 nt, Artificial Sequence
  RNA Oligomer
acaacugccucucugagcugccu

SEQ ID NO: 34928 - RNA, 23 nt, Artificial Sequence
  RNA Oligomer
cacaacugccucucugagcugcc

SEQ ID NO: 34929 - RNA, 23 nt, Artificial Sequence
  RNA Oligomer
ucacaacugccucucugagcugc

SEQ ID NO: 34930 - RNA, 23 nt, Artificial Sequence
  RNA Oligomer
cucacaacugccucucugagcug

SEQ ID NO: 34931 - RNA, 23 nt, Artificial Sequence
  RNA Oligomer
ucucacaacugccucucugagcu

SEQ ID NO: 34932 - RNA, 23 nt, Artificial Sequence
  RNA Oligomer
acaccaccaagaacuguguggga

SEQ ID NO: 34933 - RNA, 23 nt, Artificial Sequence
  RNA Oligomer
uacaccaccaagaacuguguggg

SEQ ID NO: 34934 - RNA, 23 nt, Artificial Sequence
  RNA Oligomer
guacaccaccaagaacugugugg

SEQ ID NO: 34935 - RNA, 23 nt, Artificial Sequence
  RNA Oligomer
gguacaccaccaagaacugugug

SEQ ID NO: 34936 - RNA, 23 nt, Artificial Sequence
  RNA Oligomer
gaauucuugcgucugagcacuca

SEQ ID NO: 34937 - RNA, 23 nt, Artificial Sequence
  RNA Oligomer
ggaauucuugcgucugagcacuc

SEQ ID NO: 34938 - RNA, 23 nt, Artificial Sequence
  RNA Oligomer
cagauuuggacagcuuuccugug

SEQ ID NO: 34939 - RNA, 23 nt, Artificial Sequence
  RNA Oligomer
uggaugagcagauccgucacaug

SEQ ID NO: 34940 - RNA, 23 nt, Artificial Sequence
  RNA Oligomer
cucauuccagaaaugcccagacu

SEQ ID NO: 34941 - RNA, 23 nt, Artificial Sequence
  RNA Oligomer
ugcugucucacaacugccucucu

SEQ ID NO: 34942 - RNA, 23 nt, Artificial Sequence
  RNA Oligomer
ucauuccagaaaugcccagacug

SEQ ID NO: 34943 - RNA, 23 nt, Artificial Sequence
  RNA Oligomer
ccucauuccagaaaugcccagac

SEQ ID NO: 34944 - RNA, 23 nt, Artificial Sequence
  RNA Oligomer
cuccuucacauucuucaggugcg

SEQ ID NO: 34945 - RNA, 23 nt, Artificial Sequence
  RNA Oligomer
uccuucacauucuucaggugcga

SEQ ID NO: 34946 - RNA, 23 nt, Artificial Sequence
  RNA Oligomer
ccuucacauucuucaggugcgag

SEQ ID NO: 34947 - RNA, 23 nt, Artificial Sequence
  RNA Oligomer
cuucacauucuucaggugcgagu

SEQ ID NO: 34948 - RNA, 23 nt, Artificial Sequence
  RNA Oligomer
uucacauucuucaggugcgagua

SEQ ID NO: 34949 - RNA, 23 nt, Artificial Sequence
  RNA Oligomer
uccgaauccucugaagcaucucc

SEQ ID NO: 34950 - RNA, 23 nt, Artificial Sequence
  RNA Oligomer
ccgaauccucugaagcaucuccu

SEQ ID NO: 34951 - RNA, 23 nt, Artificial Sequence
  RNA Oligomer
cgaauccucugaagcaucuccug

SEQ ID NO: 34952 - RNA, 23 nt, Artificial Sequence
  RNA Oligomer
gaauccucugaagcaucuccugc

SEQ ID NO: 34953 - RNA, 23 nt, Artificial Sequence
  RNA Oligomer
aauccucugaagcaucuccugcg

SEQ ID NO: 34954 - RNA, 23 nt, Artificial Sequence
  RNA Oligomer
acacuggagagacuugaaggugg

SEQ ID NO: 34955 - RNA, 23 nt, Artificial Sequence
  RNA Oligomer
cacuggagagacuugaagguggg

SEQ ID NO: 34956 - RNA, 23 nt, Artificial Sequence
  RNA Oligomer
acuggagagacuugaaggugggg

SEQ ID NO: 34957 - RNA, 23 nt, Artificial Sequence
  RNA Oligomer
cuggagagacuugaagguggggg

SEQ ID NO: 34958 - RNA, 23 nt, Artificial Sequence
  RNA Oligomer
uggagagacuugaaggugggggc

SEQ ID NO: 34959 - RNA, 23 nt, Artificial Sequence
  RNA Oligomer
ccccacacacuggagagacuuga

SEQ ID NO: 34960 - RNA, 23 nt, Artificial Sequence
  RNA Oligomer
cccacacacuggagagacuugaa

SEQ ID NO: 34961 - RNA, 23 nt, Artificial Sequence
  RNA Oligomer
ccacacacuggagagacuugaag

SEQ ID NO: 34962 - RNA, 23 nt, Artificial Sequence
  RNA Oligomer
cacacacuggagagacuugaagg

SEQ ID NO: 34963 - RNA, 23 nt, Artificial Sequence
  RNA Oligomer
acacacuggagagacuugaaggu

SEQ ID NO: 34964 - RNA, 23 nt, Artificial Sequence
  RNA Oligomer
cacacuggagagacuugaaggug

SEQ ID NO: 34965 - RNA, 23 nt, Artificial Sequence
  RNA Oligomer
cgaguagaagacaaagcagauuc

SEQ ID NO: 34966 - RNA, 23 nt, Artificial Sequence
  RNA Oligomer
gaguagaagacaaagcagauucu

SEQ ID NO: 34967 - RNA, 23 nt, Artificial Sequence
  RNA Oligomer
aguagaagacaaagcagauucug

SEQ ID NO: 34968 - RNA, 23 nt, Artificial Sequence
  RNA Oligomer
guagaagacaaagcagauucugc

SEQ ID NO: 34969 - RNA, 23 nt, Artificial Sequence
  RNA Oligomer
uagaagacaaagcagauucugcc

SEQ ID NO: 34970 - RNA, 23 nt, Artificial Sequence
  RNA Oligomer
aggaaagcuguccaaaucugagg

SEQ ID NO: 34971 - RNA, 23 nt, Artificial Sequence
  RNA Oligomer
ggaaagcuguccaaaucugaggu

SEQ ID NO: 34972 - RNA, 23 nt, Artificial Sequence
  RNA Oligomer
gaaagcuguccaaaucugagguc

SEQ ID NO: 34973 - RNA, 23 nt, Artificial Sequence
  RNA Oligomer
aaagcuguccaaaucugagguca

SEQ ID NO: 34974 - RNA, 23 nt, Artificial Sequence
  RNA Oligomer
aagcuguccaaaucugaggucag

SEQ ID NO: 34975 - RNA, 23 nt, Artificial Sequence
  RNA Oligomer
auccucugaagcaucuccugcgg

SEQ ID NO: 34976 - RNA, 23 nt, Artificial Sequence
  RNA Oligomer
uuuugaggugaaagaaacagugc

SEQ ID NO: 34977 - RNA, 23 nt, Artificial Sequence
  RNA Oligomer
uuugaggugaaagaaacagugca

SEQ ID NO: 34978 - RNA, 23 nt, Artificial Sequence
  RNA Oligomer
uugaggugaaagaaacagugcag

SEQ ID NO: 34979 - RNA, 23 nt, Artificial Sequence
  RNA Oligomer
ugaggugaaagaaacagugcagu

SEQ ID NO: 34980 - RNA, 23 nt, Artificial Sequence
  RNA Oligomer
gaggugaaagaaacagugcaguu

SEQ ID NO: 34981 - RNA, 23 nt, Artificial Sequence
  RNA Oligomer
uucuucaggugcgaguagaagac

SEQ ID NO: 34982 - RNA, 23 nt, Artificial Sequence
  RNA Oligomer
ucuucaggugcgaguagaagaca

SEQ ID NO: 34983 - RNA, 23 nt, Artificial Sequence
  RNA Oligomer
cuucaggugcgaguagaagacaa

SEQ ID NO: 34984 - RNA, 23 nt, Artificial Sequence
  RNA Oligomer
uucaggugcgaguagaagacaaa

SEQ ID NO: 34985 - RNA, 23 nt, Artificial Sequence
  RNA Oligomer
ucaggugcgaguagaagacaaag

SEQ ID NO: 34986 - RNA, 23 nt, Artificial Sequence
  RNA Oligomer
caccugagcugugaugucauccc

SEQ ID NO: 34987 - RNA, 23 nt, Artificial Sequence
  RNA Oligomer
accugagcugugaugucauccca

SEQ ID NO: 34988 - RNA, 23 nt, Artificial Sequence
  RNA Oligomer
ccugagcugugaugucaucccag

SEQ ID NO: 34989 - RNA, 23 nt, Artificial Sequence
  RNA Oligomer
cugagcugugaugucaucccagg

SEQ ID NO: 34990 - RNA, 23 nt, Artificial Sequence
  RNA Oligomer
ugagcugugaugucaucccaggu

SEQ ID NO: 34991 - RNA, 23 nt, Artificial Sequence
  RNA Oligomer
gcgguugugugucacugugagga

SEQ ID NO: 34992 - RNA, 23 nt, Artificial Sequence
  RNA Oligomer
cgguugugugucacugugaggaa

SEQ ID NO: 34993 - RNA, 23 nt, Artificial Sequence
  RNA Oligomer
gguugugugucacugugaggaag

SEQ ID NO: 34994 - RNA, 23 nt, Artificial Sequence
  RNA Oligomer
guugugugucacugugaggaagg

SEQ ID NO: 34995 - RNA, 23 nt, Artificial Sequence
  RNA Oligomer
uugugugucacugugaggaaggu

SEQ ID NO: 34996 - RNA, 23 nt, Artificial Sequence
  RNA Oligomer
ccuccuucacauucuucaggugc

SEQ ID NO: 34997 - RNA, 23 nt, Artificial Sequence
  RNA Oligomer
caggugcgaguagaagacaaagc

SEQ ID NO: 34998 - RNA, 23 nt, Artificial Sequence
  RNA Oligomer
aggugcgaguagaagacaaagca

SEQ ID NO: 34999 - RNA, 23 nt, Artificial Sequence
  RNA Oligomer
ggugcgaguagaagacaaagcag

SEQ ID NO: 35000 - RNA, 23 nt, Artificial Sequence
  RNA Oligomer
gugcgaguagaagacaaagcaga

SEQ ID NO: 35001 - RNA, 23 nt, Artificial Sequence
  RNA Oligomer
ugcgaguagaagacaaagcagau

SEQ ID NO: 35002 - RNA, 23 nt, Artificial Sequence
  RNA Oligomer
aggugaaagaaacagugcaguuu

SEQ ID NO: 35003 - RNA, 23 nt, Artificial Sequence
  RNA Oligomer
agugcaguuuuguugcucacagg

SEQ ID NO: 35004 - RNA, 23 nt, Artificial Sequence
  RNA Oligomer
gugcaguuuuguugcucacaggg

SEQ ID NO: 35005 - RNA, 23 nt, Artificial Sequence
  RNA Oligomer
ugcaguuuuguugcucacaggga

SEQ ID NO: 35006 - RNA, 23 nt, Artificial Sequence
  RNA Oligomer
gcaguuuuguugcucacagggac

SEQ ID NO: 35007 - RNA, 23 nt, Artificial Sequence
  RNA Oligomer
caguuuuguugcucacagggacc

SEQ ID NO: 35008 - RNA, 23 nt, Artificial Sequence
  RNA Oligomer
gaucugcucauccagaucauccc

SEQ ID NO: 35009 - RNA, 23 nt, Artificial Sequence
  RNA Oligomer
aucugcucauccagaucaucccg

SEQ ID NO: 35010 - RNA, 23 nt, Artificial Sequence
  RNA Oligomer
ucugcucauccagaucaucccgg

SEQ ID NO: 35011 - RNA, 23 nt, Artificial Sequence
  RNA Oligomer
cugcucauccagaucaucccgga

SEQ ID NO: 35012 - RNA, 23 nt, Artificial Sequence
  RNA Oligomer
ugcucauccagaucaucccggaa

SEQ ID NO: 35013 - RNA, 23 nt, Artificial Sequence
  RNA Oligomer
uaccuccuucacauucuucaggu

SEQ ID NO: 35014 - RNA, 23 nt, Artificial Sequence
  RNA Oligomer
accuccuucacauucuucaggug

SEQ ID NO: 35015 - RNA, 23 nt, Artificial Sequence
  RNA Oligomer
ucacauucuucaggugcgaguag

SEQ ID NO: 35016 - RNA, 23 nt, Artificial Sequence
  RNA Oligomer
cacauucuucaggugcgaguaga

SEQ ID NO: 35017 - RNA, 23 nt, Artificial Sequence
  RNA Oligomer
acauucuucaggugcgaguagaa

SEQ ID NO: 35018 - RNA, 23 nt, Artificial Sequence
  RNA Oligomer
cauucuucaggugcgaguagaag

SEQ ID NO: 35019 - RNA, 23 nt, Artificial Sequence
  RNA Oligomer
auucuucaggugcgaguagaaga

SEQ ID NO: 35020 - RNA, 23 nt, Artificial Sequence
  RNA Oligomer
ccgcaaagaacucuucgcccucg

SEQ ID NO: 35021 - RNA, 23 nt, Artificial Sequence
  RNA Oligomer
cgcaaagaacucuucgcccucga

SEQ ID NO: 35022 - RNA, 23 nt, Artificial Sequence
  RNA Oligomer
gcaaagaacucuucgcccucgaa

SEQ ID NO: 35023 - RNA, 23 nt, Artificial Sequence
  RNA Oligomer
caaagaacucuucgcccucgaac

SEQ ID NO: 35024 - RNA, 23 nt, Artificial Sequence
  RNA Oligomer
aaagaacucuucgcccucgaaca

SEQ ID NO: 35025 - RNA, 23 nt, Artificial Sequence
  RNA Oligomer
acgcaagaauuccaccugcagca

SEQ ID NO: 35026 - RNA, 23 nt, Artificial Sequence
  RNA Oligomer
cgcaagaauuccaccugcagcag

SEQ ID NO: 35027 - RNA, 23 nt, Artificial Sequence
  RNA Oligomer
gcaagaauuccaccugcagcagc

SEQ ID NO: 35028 - RNA, 23 nt, Artificial Sequence
  RNA Oligomer
caagaauuccaccugcagcagcu

SEQ ID NO: 35029 - RNA, 23 nt, Artificial Sequence
  RNA Oligomer
aagaauuccaccugcagcagcug

SEQ ID NO: 35030 - RNA, 23 nt, Artificial Sequence
  RNA Oligomer
auaccuccuucacauucuucagg

SEQ ID NO: 35031 - RNA, 23 nt, Artificial Sequence
  RNA Oligomer
agaagacaaagcagauucugccc

SEQ ID NO: 35032 - RNA, 23 nt, Artificial Sequence
  RNA Oligomer
gcucgaaggccgcaaagaacucu

SEQ ID NO: 35033 - RNA, 23 nt, Artificial Sequence
  RNA Oligomer
cucgaaggccgcaaagaacucuu

SEQ ID NO: 35034 - RNA, 23 nt, Artificial Sequence
  RNA Oligomer
ucgaaggccgcaaagaacucuuc

SEQ ID NO: 35035 - RNA, 23 nt, Artificial Sequence
  RNA Oligomer
cgaaggccgcaaagaacucuucg

SEQ ID NO: 35036 - RNA, 23 nt, Artificial Sequence
  RNA Oligomer
gaaggccgcaaagaacucuucgc

SEQ ID NO: 35037 - RNA, 23 nt, Artificial Sequence
  RNA Oligomer
gugcucagacgcaagaauuccac

SEQ ID NO: 35038 - RNA, 23 nt, Artificial Sequence
  RNA Oligomer
ugcucagacgcaagaauuccacc

SEQ ID NO: 35039 - RNA, 23 nt, Artificial Sequence
  RNA Oligomer
gcucagacgcaagaauuccaccu

SEQ ID NO: 35040 - RNA, 23 nt, Artificial Sequence
  RNA Oligomer
cucagacgcaagaauuccaccug

SEQ ID NO: 35041 - RNA, 23 nt, Artificial Sequence
  RNA Oligomer
ucagacgcaagaauuccaccugc

SEQ ID NO: 35042 - RNA, 23 nt, Artificial Sequence
  RNA Oligomer
cucgaacaucuccaccgugucag

SEQ ID NO: 35043 - RNA, 23 nt, Artificial Sequence
  RNA Oligomer
ucgaacaucuccaccgugucaga

SEQ ID NO: 35044 - RNA, 23 nt, Artificial Sequence
  RNA Oligomer
cgaacaucuccaccgugucagag

SEQ ID NO: 35045 - RNA, 23 nt, Artificial Sequence
  RNA Oligomer
gaacaucuccaccgugucagagg

SEQ ID NO: 35046 - RNA, 23 nt, Artificial Sequence
  RNA Oligomer
aacaucuccaccgugucagaggg

SEQ ID NO: 35047 - RNA, 23 nt, Artificial Sequence
  RNA Oligomer
ccaccugagcugugaugucaucc

SEQ ID NO: 35048 - RNA, 23 nt, Artificial Sequence
  RNA Oligomer
agcuguccaaaucugaggucagg

SEQ ID NO: 35049 - RNA, 23 nt, Artificial Sequence
  RNA Oligomer
ggagaagagcaugugacggaucu

SEQ ID NO: 35050 - RNA, 23 nt, Artificial Sequence
  RNA Oligomer
gagaagagcaugugacggaucug

SEQ ID NO: 35051 - RNA, 23 nt, Artificial Sequence
  RNA Oligomer
agaagagcaugugacggaucugc

SEQ ID NO: 35052 - RNA, 23 nt, Artificial Sequence
  RNA Oligomer
gaagagcaugugacggaucugcu

SEQ ID NO: 35053 - RNA, 23 nt, Artificial Sequence
  RNA Oligomer
aagagcaugugacggaucugcuc

SEQ ID NO: 35054 - RNA, 23 nt, Artificial Sequence
  RNA Oligomer
guauaccuccuucacauucuuca

SEQ ID NO: 35055 - RNA, 23 nt, Artificial Sequence
  RNA Oligomer
uauaccuccuucacauucuucag

SEQ ID NO: 35056 - RNA, 23 nt, Artificial Sequence
  RNA Oligomer
aaggccgcaaagaacucuucgcc

SEQ ID NO: 35057 - RNA, 23 nt, Artificial Sequence
  RNA Oligomer
aggccgcaaagaacucuucgccc

SEQ ID NO: 35058 - RNA, 23 nt, Artificial Sequence
  RNA Oligomer
agcgaugagguucacacggugca

SEQ ID NO: 35059 - RNA, 23 nt, Artificial Sequence
  RNA Oligomer
gcgaugagguucacacggugcag

SEQ ID NO: 35060 - RNA, 23 nt, Artificial Sequence
  RNA Oligomer
cgaugagguucacacggugcagc

SEQ ID NO: 35061 - RNA, 23 nt, Artificial Sequence
  RNA Oligomer
gaugagguucacacggugcagcc

SEQ ID NO: 35062 - RNA, 23 nt, Artificial Sequence
  RNA Oligomer
augagguucacacggugcagccg

SEQ ID NO: 35063 - RNA, 23 nt, Artificial Sequence
  RNA Oligomer
gagcugugaugucaucccaggug

SEQ ID NO: 35064 - RNA, 23 nt, Artificial Sequence
  RNA Oligomer
agcugugaugucaucccaggugg

SEQ ID NO: 35065 - RNA, 23 nt, Artificial Sequence
  RNA Oligomer
gcugugaugucaucccagguggc

SEQ ID NO: 35066 - RNA, 23 nt, Artificial Sequence
  RNA Oligomer
cugugaugucaucccagguggcu

SEQ ID NO: 35067 - RNA, 23 nt, Artificial Sequence
  RNA Oligomer
ugugaugucaucccagguggcug

SEQ ID NO: 35068 - RNA, 23 nt, Artificial Sequence
  RNA Oligomer
ccaggagaagagcaugugacgga

SEQ ID NO: 35069 - RNA, 23 nt, Artificial Sequence
  RNA Oligomer
caggagaagagcaugugacggau

SEQ ID NO: 35070 - RNA, 23 nt, Artificial Sequence
  RNA Oligomer
aggagaagagcaugugacggauc

SEQ ID NO: 35071 - RNA, 23 nt, Artificial Sequence
  RNA Oligomer
caggaaagcuguccaaaucugag

SEQ ID NO: 35072 - RNA, 23 nt, Artificial Sequence
  RNA Oligomer
gcagauucugcccuccacacagu

SEQ ID NO: 35073 - RNA, 23 nt, Artificial Sequence
  RNA Oligomer
cagauucugcccuccacacaguc

SEQ ID NO: 35074 - RNA, 23 nt, Artificial Sequence
  RNA Oligomer
agauucugcccuccacacaguca

SEQ ID NO: 35075 - RNA, 23 nt, Artificial Sequence
  RNA Oligomer
gauucugcccuccacacagucag

SEQ ID NO: 35076 - RNA, 23 nt, Artificial Sequence
  RNA Oligomer
auucugcccuccacacagucagg

SEQ ID NO: 35077 - RNA, 23 nt, Artificial Sequence
  RNA Oligomer
agugcucagacgcaagaauucca

SEQ ID NO: 35078 - RNA, 23 nt, Artificial Sequence
  RNA Oligomer
aagaacucuucgcccucgaacau

SEQ ID NO: 35079 - RNA, 23 nt, Artificial Sequence
  RNA Oligomer
accacaaggaaccaggagaagug

SEQ ID NO: 35080 - RNA, 23 nt, Artificial Sequence
  RNA Oligomer
ccacaaggaaccaggagaagugg

SEQ ID NO: 35081 - RNA, 23 nt, Artificial Sequence
  RNA Oligomer
cacaaggaaccaggagaaguggg

SEQ ID NO: 35082 - RNA, 23 nt, Artificial Sequence
  RNA Oligomer
acaaggaaccaggagaagugggg

SEQ ID NO: 35083 - RNA, 23 nt, Artificial Sequence
  RNA Oligomer
caaggaaccaggagaaguggggc

SEQ ID NO: 35084 - RNA, 23 nt, Artificial Sequence
  RNA Oligomer
agcccaggagaagagcaugugac

SEQ ID NO: 35085 - RNA, 23 nt, Artificial Sequence
  RNA Oligomer
gcccaggagaagagcaugugacg

SEQ ID NO: 35086 - RNA, 23 nt, Artificial Sequence
  RNA Oligomer
cccaggagaagagcaugugacgg

SEQ ID NO: 35087 - RNA, 23 nt, Artificial Sequence
  RNA Oligomer
gcccucgaacaucuccaccgugu

SEQ ID NO: 35088 - RNA, 23 nt, Artificial Sequence
  RNA Oligomer
cccucgaacaucuccaccguguc

SEQ ID NO: 35089 - RNA, 23 nt, Artificial Sequence
  RNA Oligomer
ccucgaacaucuccaccguguca

SEQ ID NO: 35090 - RNA, 23 nt, Artificial Sequence
  RNA Oligomer
uccaaaucugaggucaggaacag

SEQ ID NO: 35091 - RNA, 23 nt, Artificial Sequence
  RNA Oligomer
ccaaaucugaggucaggaacagu

SEQ ID NO: 35092 - RNA, 23 nt, Artificial Sequence
  RNA Oligomer
caaaucugaggucaggaacaguc

SEQ ID NO: 35093 - RNA, 23 nt, Artificial Sequence
  RNA Oligomer
aaaucugaggucaggaacagucu

SEQ ID NO: 35094 - RNA, 23 nt, Artificial Sequence
  RNA Oligomer
aaucugaggucaggaacagucug

SEQ ID NO: 35095 - RNA, 23 nt, Artificial Sequence
  RNA Oligomer
aaagaaacagugcaguuuuguug

SEQ ID NO: 35096 - RNA, 23 nt, Artificial Sequence
  RNA Oligomer
aagaaacagugcaguuuuguugc

SEQ ID NO: 35097 - RNA, 23 nt, Artificial Sequence
  RNA Oligomer
agaaacagugcaguuuuguugcu

SEQ ID NO: 35098 - RNA, 23 nt, Artificial Sequence
  RNA Oligomer
gaaacagugcaguuuuguugcuc

SEQ ID NO: 35099 - RNA, 23 nt, Artificial Sequence
  RNA Oligomer
aaacagugcaguuuuguugcuca

SEQ ID NO: 35100 - RNA, 23 nt, Artificial Sequence
  RNA Oligomer
gcaguugugagacagcaagagcg

SEQ ID NO: 35101 - RNA, 23 nt, Artificial Sequence
  RNA Oligomer
caguugugagacagcaagagcgc

SEQ ID NO: 35102 - RNA, 23 nt, Artificial Sequence
  RNA Oligomer
aguugugagacagcaagagcgca

SEQ ID NO: 35103 - RNA, 23 nt, Artificial Sequence
  RNA Oligomer
guugugagacagcaagagcgcac

SEQ ID NO: 35104 - RNA, 23 nt, Artificial Sequence
  RNA Oligomer
uugugagacagcaagagcgcacc

SEQ ID NO: 35105 - RNA, 23 nt, Artificial Sequence
  RNA Oligomer
gcuguugaagcucagguccaggu

SEQ ID NO: 35106 - RNA, 23 nt, Artificial Sequence
  RNA Oligomer
cuguugaagcucagguccaggug

SEQ ID NO: 35107 - RNA, 23 nt, Artificial Sequence
  RNA Oligomer
uguugaagcucagguccaggugg

SEQ ID NO: 35108 - RNA, 23 nt, Artificial Sequence
  RNA Oligomer
guugaagcucagguccagguggg

SEQ ID NO: 35109 - RNA, 23 nt, Artificial Sequence
  RNA Oligomer
uugaagcucagguccaggugggc

SEQ ID NO: 35110 - RNA, 23 nt, Artificial Sequence
  RNA Oligomer
cagauucugagagagaucgaggc

SEQ ID NO: 35111 - RNA, 23 nt, Artificial Sequence
  RNA Oligomer
agauucugagagagaucgaggcg

SEQ ID NO: 35112 - RNA, 23 nt, Artificial Sequence
  RNA Oligomer
gauucugagagagaucgaggcgc

SEQ ID NO: 35113 - RNA, 23 nt, Artificial Sequence
  RNA Oligomer
auucugagagagaucgaggcgcu

SEQ ID NO: 35114 - RNA, 23 nt, Artificial Sequence
  RNA Oligomer
uucugagagagaucgaggcgcug

SEQ ID NO: 35115 - RNA, 23 nt, Artificial Sequence
  RNA Oligomer
cggcagugucuccaggcuguuga

SEQ ID NO: 35116 - RNA, 23 nt, Artificial Sequence
  RNA Oligomer
ggcagugucuccaggcuguugaa

SEQ ID NO: 35117 - RNA, 23 nt, Artificial Sequence
  RNA Oligomer
gcagugucuccaggcuguugaag

SEQ ID NO: 35118 - RNA, 23 nt, Artificial Sequence
  RNA Oligomer
cagugucuccaggcuguugaagc

SEQ ID NO: 35119 - RNA, 23 nt, Artificial Sequence
  RNA Oligomer
agugucuccaggcuguugaagcu

SEQ ID NO: 35120 - RNA, 23 nt, Artificial Sequence
  RNA Oligomer
agacaaagcagauucugcccucc

SEQ ID NO: 35121 - RNA, 23 nt, Artificial Sequence
  RNA Oligomer
gacaaagcagauucugcccucca

SEQ ID NO: 35122 - RNA, 23 nt, Artificial Sequence
  RNA Oligomer
acaaagcagauucugcccuccac

SEQ ID NO: 35123 - RNA, 23 nt, Artificial Sequence
  RNA Oligomer
caaagcagauucugcccuccaca

SEQ ID NO: 35124 - RNA, 23 nt, Artificial Sequence
  RNA Oligomer
aaagcagauucugcccuccacac

SEQ ID NO: 35125 - RNA, 23 nt, Artificial Sequence
  RNA Oligomer
cggcaucucccagauucaagggu

SEQ ID NO: 35126 - RNA, 23 nt, Artificial Sequence
  RNA Oligomer
ggcaucucccagauucaagggug

SEQ ID NO: 35127 - RNA, 23 nt, Artificial Sequence
  RNA Oligomer
gcaucucccagauucaagggugc

SEQ ID NO: 35128 - RNA, 23 nt, Artificial Sequence
  RNA Oligomer
caucucccagauucaagggugcc

SEQ ID NO: 35129 - RNA, 23 nt, Artificial Sequence
  RNA Oligomer
aucucccagauucaagggugcca

SEQ ID NO: 35130 - RNA, 23 nt, Artificial Sequence
  RNA Oligomer
ucucccagauucaagggugccaa

SEQ ID NO: 35131 - RNA, 23 nt, Artificial Sequence
  RNA Oligomer
aguuuuguugcucacagggaccc

SEQ ID NO: 35132 - RNA, 23 nt, Artificial Sequence
  RNA Oligomer
guuuuguugcucacagggacccg

SEQ ID NO: 35133 - RNA, 23 nt, Artificial Sequence
  RNA Oligomer
uuuuguugcucacagggacccgu

SEQ ID NO: 35134 - RNA, 23 nt, Artificial Sequence
  RNA Oligomer
gaagacaaagcagauucugcccu

SEQ ID NO: 35135 - RNA, 23 nt, Artificial Sequence
  RNA Oligomer
aagacaaagcagauucugcccuc

SEQ ID NO: 35136 - RNA, 23 nt, Artificial Sequence
  RNA Oligomer
cuccaaucucaggagguagcgug

SEQ ID NO: 35137 - RNA, 23 nt, Artificial Sequence
  RNA Oligomer
uccaaucucaggagguagcgugu

SEQ ID NO: 35138 - RNA, 23 nt, Artificial Sequence
  RNA Oligomer
ccaaucucaggagguagcguguc

SEQ ID NO: 35139 - RNA, 23 nt, Artificial Sequence
  RNA Oligomer
caaucucaggagguagcgugucc

SEQ ID NO: 35140 - RNA, 23 nt, Artificial Sequence
  RNA Oligomer
aaucucaggagguagcgugucca

SEQ ID NO: 35141 - RNA, 23 nt, Artificial Sequence
  RNA Oligomer
gugaaagaaacagugcaguuuug

SEQ ID NO: 35142 - RNA, 23 nt, Artificial Sequence
  RNA Oligomer
ugaaagaaacagugcaguuuugu

SEQ ID NO: 35143 - RNA, 23 nt, Artificial Sequence
  RNA Oligomer
gaaagaaacagugcaguuuuguu

SEQ ID NO: 35144 - RNA, 23 nt, Artificial Sequence
  RNA Oligomer
ucggaugcuguccugguacuugc

SEQ ID NO: 35145 - RNA, 23 nt, Artificial Sequence
  RNA Oligomer
cggaugcuguccugguacuugcg

SEQ ID NO: 35146 - RNA, 23 nt, Artificial Sequence
  RNA Oligomer
ggaugcuguccugguacuugcgg

SEQ ID NO: 35147 - RNA, 23 nt, Artificial Sequence
  RNA Oligomer
gaugcuguccugguacuugcggc

SEQ ID NO: 35148 - RNA, 23 nt, Artificial Sequence
  RNA Oligomer
augcuguccugguacuugcggcg

SEQ ID NO: 35149 - RNA, 23 nt, Artificial Sequence
  RNA Oligomer
aggcuguugaagcucagguccag

SEQ ID NO: 35150 - RNA, 23 nt, Artificial Sequence
  RNA Oligomer
ggcuguugaagcucagguccagg

SEQ ID NO: 35151 - RNA, 23 nt, Artificial Sequence
  RNA Oligomer
cagguugcucugcgucagaaagc

SEQ ID NO: 35152 - RNA, 23 nt, Artificial Sequence
  RNA Oligomer
agguugcucugcgucagaaagcc

SEQ ID NO: 35153 - RNA, 23 nt, Artificial Sequence
  RNA Oligomer
gguugcucugcgucagaaagccg

SEQ ID NO: 35154 - RNA, 23 nt, Artificial Sequence
  RNA Oligomer
guugcucugcgucagaaagccgg

SEQ ID NO: 35155 - RNA, 23 nt, Artificial Sequence
  RNA Oligomer
uugcucugcgucagaaagccggu

SEQ ID NO: 35156 - RNA, 23 nt, Artificial Sequence
  RNA Oligomer
ugccucuuccuccagguaggucu

SEQ ID NO: 35157 - RNA, 23 nt, Artificial Sequence
  RNA Oligomer
gccucuuccuccagguaggucuc

SEQ ID NO: 35158 - RNA, 23 nt, Artificial Sequence
  RNA Oligomer
ccucuuccuccagguaggucucc

SEQ ID NO: 35159 - RNA, 23 nt, Artificial Sequence
  RNA Oligomer
cucuuccuccagguaggucucca

SEQ ID NO: 35160 - RNA, 23 nt, Artificial Sequence
  RNA Oligomer
ucuuccuccagguaggucuccag

SEQ ID NO: 35161 - RNA, 23 nt, Artificial Sequence
  RNA Oligomer
gcagauucugagagagaucgagg

SEQ ID NO: 35162 - RNA, 23 nt, Artificial Sequence
  RNA Oligomer
aggcaguugugagacagcaagag

SEQ ID NO: 35163 - RNA, 23 nt, Artificial Sequence
  RNA Oligomer
ggcaguugugagacagcaagagc

SEQ ID NO: 35164 - RNA, 23 nt, Artificial Sequence
  RNA Oligomer
agccacacucagcagguugcucu

SEQ ID NO: 35165 - RNA, 23 nt, Artificial Sequence
  RNA Oligomer
gccacacucagcagguugcucug

SEQ ID NO: 35166 - RNA, 23 nt, Artificial Sequence
  RNA Oligomer
ccacacucagcagguugcucugc

SEQ ID NO: 35167 - RNA, 23 nt, Artificial Sequence
  RNA Oligomer
cacacucagcagguugcucugcg

SEQ ID NO: 35168 - RNA, 23 nt, Artificial Sequence
  RNA Oligomer
acacucagcagguugcucugcgu

SEQ ID NO: 35169 - RNA, 23 nt, Artificial Sequence
  RNA Oligomer
caguucuuggugguguaccagag

SEQ ID NO: 35170 - RNA, 23 nt, Artificial Sequence
  RNA Oligomer
aguucuuggugguguaccagagc

SEQ ID NO: 35171 - RNA, 23 nt, Artificial Sequence
  RNA Oligomer
guucuuggugguguaccagagcc

SEQ ID NO: 35172 - RNA, 23 nt, Artificial Sequence
  RNA Oligomer
uucuuggugguguaccagagcca

SEQ ID NO: 35173 - RNA, 23 nt, Artificial Sequence
  RNA Oligomer
ucuuggugguguaccagagccag

SEQ ID NO: 35174 - RNA, 23 nt, Artificial Sequence
  RNA Oligomer
gcgggaaaccacaaggaaccagg

SEQ ID NO: 35175 - RNA, 23 nt, Artificial Sequence
  RNA Oligomer
cgggaaaccacaaggaaccagga

SEQ ID NO: 35176 - RNA, 23 nt, Artificial Sequence
  RNA Oligomer
gggaaaccacaaggaaccaggag

SEQ ID NO: 35177 - RNA, 23 nt, Artificial Sequence
  RNA Oligomer
ggaaaccacaaggaaccaggaga

SEQ ID NO: 35178 - RNA, 23 nt, Artificial Sequence
  RNA Oligomer
gaaaccacaaggaaccaggagaa

SEQ ID NO: 35179 - RNA, 23 nt, Artificial Sequence
  RNA Oligomer
agcagauucugagagagaucgag

SEQ ID NO: 35180 - RNA, 23 nt, Artificial Sequence
  RNA Oligomer
aacagugcaguuuuguugcucac

SEQ ID NO: 35181 - RNA, 23 nt, Artificial Sequence
  RNA Oligomer
acagugcaguuuuguugcucaca

SEQ ID NO: 35182 - RNA, 23 nt, Artificial Sequence
  RNA Oligomer
cagugcaguuuuguugcucacag

SEQ ID NO: 35183 - RNA, 23 nt, Artificial Sequence
  RNA Oligomer
uuuguugcucacagggacccguc

SEQ ID NO: 35184 - RNA, 23 nt, Artificial Sequence
  RNA Oligomer
ugucuccaggcuguugaagcuca

SEQ ID NO: 35185 - RNA, 23 nt, Artificial Sequence
  RNA Oligomer
gucuccaggcuguugaagcucag

SEQ ID NO: 35186 - RNA, 23 nt, Artificial Sequence
  RNA Oligomer
ucuccaggcuguugaagcucagg

SEQ ID NO: 35187 - RNA, 23 nt, Artificial Sequence
  RNA Oligomer
cuccaggcuguugaagcucaggu

SEQ ID NO: 35188 - RNA, 23 nt, Artificial Sequence
  RNA Oligomer
uccaggcuguugaagcucagguc

SEQ ID NO: 35189 - RNA, 23 nt, Artificial Sequence
  RNA Oligomer
ccagauucaagggugccaaggag

SEQ ID NO: 35190 - RNA, 23 nt, Artificial Sequence
  RNA Oligomer
cagauucaagggugccaaggaga

SEQ ID NO: 35191 - RNA, 23 nt, Artificial Sequence
  RNA Oligomer
agauucaagggugccaaggagag

SEQ ID NO: 35192 - RNA, 23 nt, Artificial Sequence
  RNA Oligomer
gauucaagggugccaaggagagg

SEQ ID NO: 35193 - RNA, 23 nt, Artificial Sequence
  RNA Oligomer
auucaagggugccaaggagaggc

SEQ ID NO: 35194 - RNA, 23 nt, Artificial Sequence
  RNA Oligomer
cagacgcaagaauuccaccugca

SEQ ID NO: 35195 - RNA, 23 nt, Artificial Sequence
  RNA Oligomer
agacgcaagaauuccaccugcag

SEQ ID NO: 35196 - RNA, 23 nt, Artificial Sequence
  RNA Oligomer
gacgcaagaauuccaccugcagc

SEQ ID NO: 35197 - RNA, 23 nt, Artificial Sequence
  RNA Oligomer
aucugaggucaggaacagucugg

SEQ ID NO: 35198 - RNA, 23 nt, Artificial Sequence
  RNA Oligomer
ucugaggucaggaacagucuggg

SEQ ID NO: 35199 - RNA, 23 nt, Artificial Sequence
  RNA Oligomer
ugggcauuucuggaaugagggcu

SEQ ID NO: 35200 - RNA, 23 nt, Artificial Sequence
  RNA Oligomer
gggcauuucuggaaugagggcug

SEQ ID NO: 35201 - RNA, 23 nt, Artificial Sequence
  RNA Oligomer
ggcauuucuggaaugagggcugc

SEQ ID NO: 35202 - RNA, 23 nt, Artificial Sequence
  RNA Oligomer
gcauuucuggaaugagggcugcc

SEQ ID NO: 35203 - RNA, 23 nt, Artificial Sequence
  RNA Oligomer
cauuucuggaaugagggcugcca

SEQ ID NO: 35204 - RNA, 23 nt, Artificial Sequence
  RNA Oligomer
auuucuggaaugagggcugccac

SEQ ID NO: 35205 - RNA, 23 nt, Artificial Sequence
  RNA Oligomer
uuucuggaaugagggcugccacu

SEQ ID NO: 35206 - RNA, 23 nt, Artificial Sequence
  RNA Oligomer
aaggaaccaggagaaguggggca

SEQ ID NO: 35207 - RNA, 23 nt, Artificial Sequence
  RNA Oligomer
gcuguccaaaucugaggucagga

SEQ ID NO: 35208 - RNA, 23 nt, Artificial Sequence
  RNA Oligomer
cuguccaaaucugaggucaggaa

SEQ ID NO: 35209 - RNA, 23 nt, Artificial Sequence
  RNA Oligomer
uguccaaaucugaggucaggaac

SEQ ID NO: 35210 - RNA, 23 nt, Artificial Sequence
  RNA Oligomer
guccaaaucugaggucaggaaca

SEQ ID NO: 35211 - RNA, 23 nt, Artificial Sequence
  RNA Oligomer
gagguugcugugcaggacaagga

SEQ ID NO: 35212 - RNA, 23 nt, Artificial Sequence
  RNA Oligomer
agguugcugugcaggacaaggag

SEQ ID NO: 35213 - RNA, 23 nt, Artificial Sequence
  RNA Oligomer
gguugcugugcaggacaaggagc

SEQ ID NO: 35214 - RNA, 23 nt, Artificial Sequence
  RNA Oligomer
guugcugugcaggacaaggagcc

SEQ ID NO: 35215 - RNA, 23 nt, Artificial Sequence
  RNA Oligomer
uugcugugcaggacaaggagccg

SEQ ID NO: 35216 - RNA, 23 nt, Artificial Sequence
  RNA Oligomer
gaauaucugggccagccuaaaag

SEQ ID NO: 35217 - RNA, 23 nt, Artificial Sequence
  RNA Oligomer
aauaucugggccagccuaaaagu

SEQ ID NO: 35218 - RNA, 23 nt, Artificial Sequence
  RNA Oligomer
auaucugggccagccuaaaaguc

SEQ ID NO: 35219 - RNA, 23 nt, Artificial Sequence
  RNA Oligomer
uaucugggccagccuaaaagucu

SEQ ID NO: 35220 - RNA, 23 nt, Artificial Sequence
  RNA Oligomer
aucugggccagccuaaaagucug

SEQ ID NO: 35221 - RNA, 23 nt, Artificial Sequence
  RNA Oligomer
gaacucuucgcccucgaacaucu

SEQ ID NO: 35222 - RNA, 23 nt, Artificial Sequence
  RNA Oligomer
aacucuucgcccucgaacaucuc

SEQ ID NO: 35223 - RNA, 23 nt, Artificial Sequence
  RNA Oligomer
acucuucgcccucgaacaucucc

SEQ ID NO: 35224 - RNA, 23 nt, Artificial Sequence
  RNA Oligomer
cucuucgcccucgaacaucucca

SEQ ID NO: 35225 - RNA, 23 nt, Artificial Sequence
  RNA Oligomer
ucuucgcccucgaacaucuccac

SEQ ID NO: 35226 - RNA, 23 nt, Artificial Sequence
  RNA Oligomer
aaaccacaaggaaccaggagaag

SEQ ID NO: 35227 - RNA, 23 nt, Artificial Sequence
  RNA Oligomer
aaccacaaggaaccaggagaagu

SEQ ID NO: 35228 - RNA, 23 nt, Artificial Sequence
  RNA Oligomer
ggccuccaaucucaggagguagc

SEQ ID NO: 35229 - RNA, 23 nt, Artificial Sequence
  RNA Oligomer
gccuccaaucucaggagguagcg

SEQ ID NO: 35230 - RNA, 23 nt, Artificial Sequence
  RNA Oligomer
ccuccaaucucaggagguagcgu

SEQ ID NO: 35231 - RNA, 23 nt, Artificial Sequence
  RNA Oligomer
aucucaggagguagcguguccag

SEQ ID NO: 35232 - RNA, 23 nt, Artificial Sequence
  RNA Oligomer
uagcguguccagcagauucugag

SEQ ID NO: 35233 - RNA, 23 nt, Artificial Sequence
  RNA Oligomer
agcguguccagcagauucugaga

SEQ ID NO: 35234 - RNA, 23 nt, Artificial Sequence
  RNA Oligomer
gcguguccagcagauucugagag

SEQ ID NO: 35235 - RNA, 23 nt, Artificial Sequence
  RNA Oligomer
cguguccagcagauucugagaga

SEQ ID NO: 35236 - RNA, 23 nt, Artificial Sequence
  RNA Oligomer
guguccagcagauucugagagag

SEQ ID NO: 35237 - RNA, 23 nt, Artificial Sequence
  RNA Oligomer
gugugucacugugaggaagguga

SEQ ID NO: 35238 - RNA, 23 nt, Artificial Sequence
  RNA Oligomer
ugugucacugugaggaaggugag

SEQ ID NO: 35239 - RNA, 23 nt, Artificial Sequence
  RNA Oligomer
gugucacugugaggaaggugagg

SEQ ID NO: 35240 - RNA, 23 nt, Artificial Sequence
  RNA Oligomer
ugucacugugaggaaggugaggg

SEQ ID NO: 35241 - RNA, 23 nt, Artificial Sequence
  RNA Oligomer
gucacugugaggaaggugagggc

SEQ ID NO: 35242 - RNA, 23 nt, Artificial Sequence
  RNA Oligomer
acacaguucuuggugguguacca

SEQ ID NO: 35243 - RNA, 23 nt, Artificial Sequence
  RNA Oligomer
cacaguucuuggugguguaccag

SEQ ID NO: 35244 - RNA, 23 nt, Artificial Sequence
  RNA Oligomer
acaguucuuggugguguaccaga

SEQ ID NO: 35245 - RNA, 23 nt, Artificial Sequence
  RNA Oligomer
agaauuccaccugcagcagcugc

SEQ ID NO: 35246 - RNA, 23 nt, Artificial Sequence
  RNA Oligomer
gaauuccaccugcagcagcugca

SEQ ID NO: 35247 - RNA, 23 nt, Artificial Sequence
  RNA Oligomer
aauuccaccugcagcagcugcag

SEQ ID NO: 35248 - RNA, 23 nt, Artificial Sequence
  RNA Oligomer
gugucuccaggcuguugaagcuc

SEQ ID NO: 35249 - RNA, 23 nt, Artificial Sequence
  RNA Oligomer
gacggaucugcucauccagauca

SEQ ID NO: 35250 - RNA, 23 nt, Artificial Sequence
  RNA Oligomer
acggaucugcucauccagaucau

SEQ ID NO: 35251 - RNA, 23 nt, Artificial Sequence
  RNA Oligomer
cggaucugcucauccagaucauc

SEQ ID NO: 35252 - RNA, 23 nt, Artificial Sequence
  RNA Oligomer
ggaucugcucauccagaucaucc

SEQ ID NO: 35253 - RNA, 23 nt, Artificial Sequence
  RNA Oligomer
ccgcugcagagcgaugagguuca

SEQ ID NO: 35254 - RNA, 23 nt, Artificial Sequence
  RNA Oligomer
cgcugcagagcgaugagguucac

SEQ ID NO: 35255 - RNA, 23 nt, Artificial Sequence
  RNA Oligomer
gcugcagagcgaugagguucaca

SEQ ID NO: 35256 - RNA, 23 nt, Artificial Sequence
  RNA Oligomer
cugcagagcgaugagguucacac

SEQ ID NO: 35257 - RNA, 23 nt, Artificial Sequence
  RNA Oligomer
ugcagagcgaugagguucacacg

SEQ ID NO: 35258 - RNA, 23 nt, Artificial Sequence
  RNA Oligomer
ggaccaccugagcugugauguca

SEQ ID NO: 35259 - RNA, 23 nt, Artificial Sequence
  RNA Oligomer
gaccaccugagcugugaugucau

SEQ ID NO: 35260 - RNA, 23 nt, Artificial Sequence
  RNA Oligomer
accaccugagcugugaugucauc

SEQ ID NO: 35261 - RNA, 23 nt, Artificial Sequence
  RNA Oligomer
aggggggaagaugacuuugaccc

SEQ ID NO: 35262 - RNA, 23 nt, Artificial Sequence
  RNA Oligomer
ggggggaagaugacuuugacccc

SEQ ID NO: 35263 - RNA, 23 nt, Artificial Sequence
  RNA Oligomer
gggggaagaugacuuugacccca

SEQ ID NO: 35264 - RNA, 23 nt, Artificial Sequence
  RNA Oligomer
ggggaagaugacuuugaccccag

SEQ ID NO: 35265 - RNA, 23 nt, Artificial Sequence
  RNA Oligomer
gggaagaugacuuugaccccagg

SEQ ID NO: 35266 - RNA, 23 nt, Artificial Sequence
  RNA Oligomer
gggccagccuaaaagucuguggg

SEQ ID NO: 35267 - RNA, 23 nt, Artificial Sequence
  RNA Oligomer
ggccagccuaaaagucugugggg

SEQ ID NO: 35268 - RNA, 23 nt, Artificial Sequence
  RNA Oligomer
gccagccuaaaagucuguggggc

SEQ ID NO: 35269 - RNA, 23 nt, Artificial Sequence
  RNA Oligomer
ccagccuaaaagucuguggggcc

SEQ ID NO: 35270 - RNA, 23 nt, Artificial Sequence
  RNA Oligomer
cagccuaaaagucuguggggccu

SEQ ID NO: 35271 - RNA, 23 nt, Artificial Sequence
  RNA Oligomer
aggggucacaggaaagcugucca

SEQ ID NO: 35272 - RNA, 23 nt, Artificial Sequence
  RNA Oligomer
ggggucacaggaaagcuguccaa

SEQ ID NO: 35273 - RNA, 23 nt, Artificial Sequence
  RNA Oligomer
gggucacaggaaagcuguccaaa

SEQ ID NO: 35274 - RNA, 23 nt, Artificial Sequence
  RNA Oligomer
ggucacaggaaagcuguccaaau

SEQ ID NO: 35275 - RNA, 23 nt, Artificial Sequence
  RNA Oligomer
gucacaggaaagcuguccaaauc

SEQ ID NO: 35276 - RNA, 23 nt, Artificial Sequence
  RNA Oligomer
ugggccagccuaaaagucugugg

SEQ ID NO: 35277 - RNA, 23 nt, Artificial Sequence
  RNA Oligomer
ccaggcuguugaagcucaggucc

SEQ ID NO: 35278 - RNA, 23 nt, Artificial Sequence
  RNA Oligomer
caggcuguugaagcucaggucca

SEQ ID NO: 35279 - RNA, 23 nt, Artificial Sequence
  RNA Oligomer
gcucauccagaucaucccggaac

SEQ ID NO: 35280 - RNA, 23 nt, Artificial Sequence
  RNA Oligomer
cucauccagaucaucccggaacu

SEQ ID NO: 35281 - RNA, 23 nt, Artificial Sequence
  RNA Oligomer
ucauccagaucaucccggaacuc

SEQ ID NO: 35282 - RNA, 23 nt, Artificial Sequence
  RNA Oligomer
cauccagaucaucccggaacucg

SEQ ID NO: 35283 - RNA, 23 nt, Artificial Sequence
  RNA Oligomer
auccagaucaucccggaacucgu

SEQ ID NO: 35284 - RNA, 23 nt, Artificial Sequence
  RNA Oligomer
gcagagcgaugagguucacacgg

SEQ ID NO: 35285 - RNA, 23 nt, Artificial Sequence
  RNA Oligomer
cagagcgaugagguucacacggu

SEQ ID NO: 35286 - RNA, 23 nt, Artificial Sequence
  RNA Oligomer
agagcgaugagguucacacggug

SEQ ID NO: 35287 - RNA, 23 nt, Artificial Sequence
  RNA Oligomer
aggaacagucugggcauuucugg

SEQ ID NO: 35288 - RNA, 23 nt, Artificial Sequence
  RNA Oligomer
ggaacagucugggcauuucugga

SEQ ID NO: 35289 - RNA, 23 nt, Artificial Sequence
  RNA Oligomer
gaacagucugggcauuucuggaa

SEQ ID NO: 35290 - RNA, 23 nt, Artificial Sequence
  RNA Oligomer
aacagucugggcauuucuggaau

SEQ ID NO: 35291 - RNA, 23 nt, Artificial Sequence
  RNA Oligomer
acagucugggcauuucuggaaug

SEQ ID NO: 35292 - RNA, 23 nt, Artificial Sequence
  RNA Oligomer
agguagcguguccagcagauucu

SEQ ID NO: 35293 - RNA, 23 nt, Artificial Sequence
  RNA Oligomer
gguagcguguccagcagauucug

SEQ ID NO: 35294 - RNA, 23 nt, Artificial Sequence
  RNA Oligomer
guagcguguccagcagauucuga

SEQ ID NO: 35295 - RNA, 23 nt, Artificial Sequence
  RNA Oligomer
uguccagcagauucugagagaga

SEQ ID NO: 35296 - RNA, 23 nt, Artificial Sequence
  RNA Oligomer
guccagcagauucugagagagau

SEQ ID NO: 35297 - RNA, 23 nt, Artificial Sequence
  RNA Oligomer
ccagcagauucugagagagaucg

SEQ ID NO: 35298 - RNA, 23 nt, Artificial Sequence
  RNA Oligomer
cagcagauucugagagagaucga

SEQ ID NO: 35299 - RNA, 23 nt, Artificial Sequence
  RNA Oligomer
ucggcaucucccagauucaaggg

SEQ ID NO: 35300 - RNA, 23 nt, Artificial Sequence
  RNA Oligomer
aggcagcucagagaggcaguugu

SEQ ID NO: 35301 - RNA, 23 nt, Artificial Sequence
  RNA Oligomer
ggcagcucagagaggcaguugug

SEQ ID NO: 35302 - RNA, 23 nt, Artificial Sequence
  RNA Oligomer
gcagcucagagaggcaguuguga

SEQ ID NO: 35303 - RNA, 23 nt, Artificial Sequence
  RNA Oligomer
cagcucagagaggcaguugugag

SEQ ID NO: 35304 - RNA, 23 nt, Artificial Sequence
  RNA Oligomer
agcucagagaggcaguugugaga

SEQ ID NO: 35305 - RNA, 23 nt, Artificial Sequence
  RNA Oligomer
ucccacacaguucuugguggugu

SEQ ID NO: 35306 - RNA, 23 nt, Artificial Sequence
  RNA Oligomer
cccacacaguucuugguggugua

SEQ ID NO: 35307 - RNA, 23 nt, Artificial Sequence
  RNA Oligomer
ccacacaguucuuggugguguac

SEQ ID NO: 35308 - RNA, 23 nt, Artificial Sequence
  RNA Oligomer
cacacaguucuuggugguguacc

SEQ ID NO: 35309 - RNA, 23 nt, Artificial Sequence
  RNA Oligomer
ugagugcucagacgcaagaauuc

SEQ ID NO: 35310 - RNA, 23 nt, Artificial Sequence
  RNA Oligomer
gagugcucagacgcaagaauucc

SEQ ID NO: 35311 - RNA, 23 nt, Artificial Sequence
  RNA Oligomer
cacaggaaagcuguccaaaucug

SEQ ID NO: 35312 - RNA, 23 nt, Artificial Sequence
  RNA Oligomer
caugugacggaucugcucaucca

SEQ ID NO: 35313 - RNA, 23 nt, Artificial Sequence
  RNA Oligomer
agucugggcauuucuggaaugag

SEQ ID NO: 35314 - RNA, 23 nt, Artificial Sequence
  RNA Oligomer
agagaggcaguugugagacagca

SEQ ID NO: 35315 - RNA, 23 nt, Artificial Sequence
  RNA Oligomer
cagucugggcauuucuggaauga

SEQ ID NO: 35316 - RNA, 23 nt, Artificial Sequence
  RNA Oligomer
gucugggcauuucuggaaugagg

SEQ ID NO: 35317 - RNA, 23 nt, Artificial Sequence
  RNA Oligomer
uaccaggaauuacuauguucggg

SEQ ID NO: 35318 - RNA, 23 nt, Artificial Sequence
  RNA Oligomer
uuaccaggaauuacuauguucgg

SEQ ID NO: 35319 - RNA, 23 nt, Artificial Sequence
  RNA Oligomer
uuuaccaggaauuacuauguucg

SEQ ID NO: 35320 - RNA, 23 nt, Artificial Sequence
  RNA Oligomer
cuuuaccaggaauuacuauguuc

SEQ ID NO: 35321 - RNA, 23 nt, Artificial Sequence
  RNA Oligomer
ccuuuaccaggaauuacuauguu

SEQ ID NO: 35322 - RNA, 23 nt, Artificial Sequence
  RNA Oligomer
ccaggaauuacuauguucgggcc

SEQ ID NO: 35323 - RNA, 23 nt, Artificial Sequence
  RNA Oligomer
accaggaauuacuauguucgggc

SEQ ID NO: 35324 - RNA, 23 nt, Artificial Sequence
  RNA Oligomer
ggaauuacuauguucgggccguc

SEQ ID NO: 35325 - RNA, 23 nt, Artificial Sequence
  RNA Oligomer
aggaauuacuauguucgggccgu

SEQ ID NO: 35326 - RNA, 23 nt, Artificial Sequence
  RNA Oligomer
caggaauuacuauguucgggccg

SEQ ID NO: 35327 - RNA, 23 nt, Artificial Sequence
  RNA Oligomer
gggcccuuuaccaggaauuacua

SEQ ID NO: 35328 - RNA, 23 nt, Artificial Sequence
  RNA Oligomer
cgggcccuuuaccaggaauuacu

SEQ ID NO: 35329 - RNA, 23 nt, Artificial Sequence
  RNA Oligomer
ucgggcccuuuaccaggaauuac

SEQ ID NO: 35330 - RNA, 23 nt, Artificial Sequence
  RNA Oligomer
uucgggcccuuuaccaggaauua

SEQ ID NO: 35331 - RNA, 23 nt, Artificial Sequence
  RNA Oligomer
guucgggcccuuuaccaggaauu

SEQ ID NO: 35332 - RNA, 23 nt, Artificial Sequence
  RNA Oligomer
agaaguacaugaccgccguggug

SEQ ID NO: 35333 - RNA, 23 nt, Artificial Sequence
  RNA Oligomer
cagaaguacaugaccgccguggu

SEQ ID NO: 35334 - RNA, 23 nt, Artificial Sequence
  RNA Oligomer
acagaaguacaugaccgccgugg

SEQ ID NO: 35335 - RNA, 23 nt, Artificial Sequence
  RNA Oligomer
gacagaaguacaugaccgccgug

SEQ ID NO: 35336 - RNA, 23 nt, Artificial Sequence
  RNA Oligomer
ggacagaaguacaugaccgccgu

SEQ ID NO: 35337 - RNA, 23 nt, Artificial Sequence
  RNA Oligomer
ggcccuuuaccaggaauuacuau

SEQ ID NO: 35338 - RNA, 23 nt, Artificial Sequence
  RNA Oligomer
cccuuuaccaggaauuacuaugu

SEQ ID NO: 35339 - RNA, 23 nt, Artificial Sequence
  RNA Oligomer
gcccuuuaccaggaauuacuaug

SEQ ID NO: 35340 - RNA, 23 nt, Artificial Sequence
  RNA Oligomer
gcuucacccagugguacuuuggu

SEQ ID NO: 35341 - RNA, 23 nt, Artificial Sequence
  RNA Oligomer
cgcuucacccagugguacuuugg

SEQ ID NO: 35342 - RNA, 23 nt, Artificial Sequence
  RNA Oligomer
gcgcuucacccagugguacuuug

SEQ ID NO: 35343 - RNA, 23 nt, Artificial Sequence
  RNA Oligomer
ggcgcuucacccagugguacuuu

SEQ ID NO: 35344 - RNA, 23 nt, Artificial Sequence
  RNA Oligomer
gggcgcuucacccagugguacuu

SEQ ID NO: 35345 - RNA, 23 nt, Artificial Sequence
  RNA Oligomer
gugguacuuuggugccuacucca

SEQ ID NO: 35346 - RNA, 23 nt, Artificial Sequence
  RNA Oligomer
agugguacuuuggugccuacucc

SEQ ID NO: 35347 - RNA, 23 nt, Artificial Sequence
  RNA Oligomer
cagugguacuuuggugccuacuc

SEQ ID NO: 35348 - RNA, 23 nt, Artificial Sequence
  RNA Oligomer
ccagugguacuuuggugccuacu

SEQ ID NO: 35349 - RNA, 23 nt, Artificial Sequence
  RNA Oligomer
cccagugguacuuuggugccuac

SEQ ID NO: 35350 - RNA, 23 nt, Artificial Sequence
  RNA Oligomer
acccagugguacuuuggugccua

SEQ ID NO: 35351 - RNA, 23 nt, Artificial Sequence
  RNA Oligomer
gggacagaaguacaugaccgccg

SEQ ID NO: 35352 - RNA, 23 nt, Artificial Sequence
  RNA Oligomer
ggggacagaaguacaugaccgcc

SEQ ID NO: 35353 - RNA, 23 nt, Artificial Sequence
  RNA Oligomer
uggggacagaaguacaugaccgc

SEQ ID NO: 35354 - RNA, 23 nt, Artificial Sequence
  RNA Oligomer
cuggggacagaaguacaugaccg

SEQ ID NO: 35355 - RNA, 23 nt, Artificial Sequence
  RNA Oligomer
cacccagugguacuuuggugccu

SEQ ID NO: 35356 - RNA, 23 nt, Artificial Sequence
  RNA Oligomer
ucacccagugguacuuuggugcc

SEQ ID NO: 35357 - RNA, 23 nt, Artificial Sequence
  RNA Oligomer
uucacccagugguacuuuggugc

SEQ ID NO: 35358 - RNA, 23 nt, Artificial Sequence
  RNA Oligomer
cuucacccagugguacuuuggug

SEQ ID NO: 35359 - RNA, 23 nt, Artificial Sequence
  RNA Oligomer
agaucggaggcaccaucaagcag

SEQ ID NO: 35360 - RNA, 23 nt, Artificial Sequence
  RNA Oligomer
cagaucggaggcaccaucaagca

SEQ ID NO: 35361 - RNA, 23 nt, Artificial Sequence
  RNA Oligomer
gcagaucggaggcaccaucaagc

SEQ ID NO: 35362 - RNA, 23 nt, Artificial Sequence
  RNA Oligomer
cgcagaucggaggcaccaucaag

SEQ ID NO: 35363 - RNA, 23 nt, Artificial Sequence
  RNA Oligomer
ccgcagaucggaggcaccaucaa

SEQ ID NO: 35364 - RNA, 23 nt, Artificial Sequence
  RNA Oligomer
ugcacccaccugcaauaaaugca

SEQ ID NO: 35365 - RNA, 23 nt, Artificial Sequence
  RNA Oligomer
gugcacccaccugcaauaaaugc

SEQ ID NO: 35366 - RNA, 23 nt, Artificial Sequence
  RNA Oligomer
ggugcacccaccugcaauaaaug

SEQ ID NO: 35367 - RNA, 23 nt, Artificial Sequence
  RNA Oligomer
aggugcacccaccugcaauaaau

SEQ ID NO: 35368 - RNA, 23 nt, Artificial Sequence
  RNA Oligomer
caggugcacccaccugcaauaaa

SEQ ID NO: 35369 - RNA, 23 nt, Artificial Sequence
  RNA Oligomer
ccaggugcacccaccugcaauaa

SEQ ID NO: 35370 - RNA, 23 nt, Artificial Sequence
  RNA Oligomer
uggggacagaaguacaugaccgc

SEQ ID NO: 35371 - RNA, 23 nt, Artificial Sequence
  RNA Oligomer
cuggggacagaaguacaugaccg

SEQ ID NO: 35372 - RNA, 23 nt, Artificial Sequence
  RNA Oligomer
gcuggggacagaaguacaugacc

SEQ ID NO: 35373 - RNA, 23 nt, Artificial Sequence
  RNA Oligomer
cgcuggggacagaaguacaugac

SEQ ID NO: 35374 - RNA, 23 nt, Artificial Sequence
  RNA Oligomer
gcgcuggggacagaaguacauga

SEQ ID NO: 35375 - RNA, 23 nt, Artificial Sequence
  RNA Oligomer
guguuugugugccugcuggagua

SEQ ID NO: 35376 - RNA, 23 nt, Artificial Sequence
  RNA Oligomer
uguucgggcccuuuaccaggaau

SEQ ID NO: 35377 - RNA, 23 nt, Artificial Sequence
  RNA Oligomer
gguacuuuggugccuacuccauu

SEQ ID NO: 35378 - RNA, 23 nt, Artificial Sequence
  RNA Oligomer
ugguacuuuggugccuacuccau

SEQ ID NO: 35379 - RNA, 23 nt, Artificial Sequence
  RNA Oligomer
cccgaacauaguaauuccuggua

SEQ ID NO: 35380 - RNA, 23 nt, Artificial Sequence
  RNA Oligomer
ccgaacauaguaauuccugguaa

SEQ ID NO: 35381 - RNA, 23 nt, Artificial Sequence
  RNA Oligomer
cgaacauaguaauuccugguaaa

SEQ ID NO: 35382 - RNA, 23 nt, Artificial Sequence
  RNA Oligomer
gaacauaguaauuccugguaaag

SEQ ID NO: 35383 - RNA, 23 nt, Artificial Sequence
  RNA Oligomer
aacauaguaauuccugguaaagg

SEQ ID NO: 35384 - RNA, 23 nt, Artificial Sequence
  RNA Oligomer
ggcccgaacauaguaauuccugg

SEQ ID NO: 35385 - RNA, 23 nt, Artificial Sequence
  RNA Oligomer
gcccgaacauaguaauuccuggu

SEQ ID NO: 35386 - RNA, 23 nt, Artificial Sequence
  RNA Oligomer
gacggcccgaacauaguaauucc

SEQ ID NO: 35387 - RNA, 23 nt, Artificial Sequence
  RNA Oligomer
acggcccgaacauaguaauuccu

SEQ ID NO: 35388 - RNA, 23 nt, Artificial Sequence
  RNA Oligomer
cggcccgaacauaguaauuccug

SEQ ID NO: 35389 - RNA, 23 nt, Artificial Sequence
  RNA Oligomer
uaguaauuccugguaaagggccc

SEQ ID NO: 35390 - RNA, 23 nt, Artificial Sequence
  RNA Oligomer
aguaauuccugguaaagggcccg

SEQ ID NO: 35391 - RNA, 23 nt, Artificial Sequence
  RNA Oligomer
guaauuccugguaaagggcccga

SEQ ID NO: 35392 - RNA, 23 nt, Artificial Sequence
  RNA Oligomer
uaauuccugguaaagggcccgaa

SEQ ID NO: 35393 - RNA, 23 nt, Artificial Sequence
  RNA Oligomer
aauuccugguaaagggcccgaac

SEQ ID NO: 35394 - RNA, 23 nt, Artificial Sequence
  RNA Oligomer
caccacggcggucauguacuucu

SEQ ID NO: 35395 - RNA, 23 nt, Artificial Sequence
  RNA Oligomer
accacggcggucauguacuucug

SEQ ID NO: 35396 - RNA, 23 nt, Artificial Sequence
  RNA Oligomer
ccacggcggucauguacuucugu

SEQ ID NO: 35397 - RNA, 23 nt, Artificial Sequence
  RNA Oligomer
cacggcggucauguacuucuguc

SEQ ID NO: 35398 - RNA, 23 nt, Artificial Sequence
  RNA Oligomer
acggcggucauguacuucugucc

SEQ ID NO: 35399 - RNA, 23 nt, Artificial Sequence
  RNA Oligomer
auaguaauuccugguaaagggcc

SEQ ID NO: 35400 - RNA, 23 nt, Artificial Sequence
  RNA Oligomer
acauaguaauuccugguaaaggg

SEQ ID NO: 35401 - RNA, 23 nt, Artificial Sequence
  RNA Oligomer
cauaguaauuccugguaaagggc

SEQ ID NO: 35402 - RNA, 23 nt, Artificial Sequence
  RNA Oligomer
accaaaguaccacugggugaagc

SEQ ID NO: 35403 - RNA, 23 nt, Artificial Sequence
  RNA Oligomer
ccaaaguaccacugggugaagcg

SEQ ID NO: 35404 - RNA, 23 nt, Artificial Sequence
  RNA Oligomer
caaaguaccacugggugaagcgc

SEQ ID NO: 35405 - RNA, 23 nt, Artificial Sequence
  RNA Oligomer
aaaguaccacugggugaagcgcc

SEQ ID NO: 35406 - RNA, 23 nt, Artificial Sequence
  RNA Oligomer
aaguaccacugggugaagcgccc

SEQ ID NO: 35407 - RNA, 23 nt, Artificial Sequence
  RNA Oligomer
uggaguaggcaccaaaguaccac

SEQ ID NO: 35408 - RNA, 23 nt, Artificial Sequence
  RNA Oligomer
ggaguaggcaccaaaguaccacu

SEQ ID NO: 35409 - RNA, 23 nt, Artificial Sequence
  RNA Oligomer
gaguaggcaccaaaguaccacug

SEQ ID NO: 35410 - RNA, 23 nt, Artificial Sequence
  RNA Oligomer
aguaggcaccaaaguaccacugg

SEQ ID NO: 35411 - RNA, 23 nt, Artificial Sequence
  RNA Oligomer
guaggcaccaaaguaccacuggg

SEQ ID NO: 35412 - RNA, 23 nt, Artificial Sequence
  RNA Oligomer
uaggcaccaaaguaccacugggu

SEQ ID NO: 35413 - RNA, 23 nt, Artificial Sequence
  RNA Oligomer
cggcggucauguacuucuguccc

SEQ ID NO: 35414 - RNA, 23 nt, Artificial Sequence
  RNA Oligomer
ggcggucauguacuucugucccc

SEQ ID NO: 35415 - RNA, 23 nt, Artificial Sequence
  RNA Oligomer
gcggucauguacuucugucccca

SEQ ID NO: 35416 - RNA, 23 nt, Artificial Sequence
  RNA Oligomer
cggucauguacuucuguccccag

SEQ ID NO: 35417 - RNA, 23 nt, Artificial Sequence
  RNA Oligomer
aggcaccaaaguaccacugggug

SEQ ID NO: 35418 - RNA, 23 nt, Artificial Sequence
  RNA Oligomer
ggcaccaaaguaccacuggguga

SEQ ID NO: 35419 - RNA, 23 nt, Artificial Sequence
  RNA Oligomer
gcaccaaaguaccacugggugaa

SEQ ID NO: 35420 - RNA, 23 nt, Artificial Sequence
  RNA Oligomer
caccaaaguaccacugggugaag

SEQ ID NO: 35421 - RNA, 23 nt, Artificial Sequence
  RNA Oligomer
cugcuugauggugccuccgaucu

SEQ ID NO: 35422 - RNA, 23 nt, Artificial Sequence
  RNA Oligomer
ugcuugauggugccuccgaucug

SEQ ID NO: 35423 - RNA, 23 nt, Artificial Sequence
  RNA Oligomer
gcuugauggugccuccgaucugc

SEQ ID NO: 35424 - RNA, 23 nt, Artificial Sequence
  RNA Oligomer
cuugauggugccuccgaucugcg

SEQ ID NO: 35425 - RNA, 23 nt, Artificial Sequence
  RNA Oligomer
uugauggugccuccgaucugcgg

SEQ ID NO: 35426 - RNA, 23 nt, Artificial Sequence
  RNA Oligomer
ugcauuuauugcaggugggugca

SEQ ID NO: 35427 - RNA, 23 nt, Artificial Sequence
  RNA Oligomer
gcauuuauugcaggugggugcac

SEQ ID NO: 35428 - RNA, 23 nt, Artificial Sequence
  RNA Oligomer
cauuuauugcaggugggugcacc

SEQ ID NO: 35429 - RNA, 23 nt, Artificial Sequence
  RNA Oligomer
auuuauugcaggugggugcaccu

SEQ ID NO: 35430 - RNA, 23 nt, Artificial Sequence
  RNA Oligomer
uuuauugcaggugggugcaccug

SEQ ID NO: 35431 - RNA, 23 nt, Artificial Sequence
  RNA Oligomer
uuauugcaggugggugcaccugg

SEQ ID NO: 35432 - RNA, 23 nt, Artificial Sequence
  RNA Oligomer
gcggucauguacuucugucccca

SEQ ID NO: 35433 - RNA, 23 nt, Artificial Sequence
  RNA Oligomer
cggucauguacuucuguccccag

SEQ ID NO: 35434 - RNA, 23 nt, Artificial Sequence
  RNA Oligomer
ggucauguacuucuguccccagc

SEQ ID NO: 35435 - RNA, 23 nt, Artificial Sequence
  RNA Oligomer
gucauguacuucuguccccagcg

SEQ ID NO: 35436 - RNA, 23 nt, Artificial Sequence
  RNA Oligomer
ucauguacuucuguccccagcgc

SEQ ID NO: 35437 - RNA, 23 nt, Artificial Sequence
  RNA Oligomer
uacuccagcaggcacacaaacac

SEQ ID NO: 35438 - RNA, 23 nt, Artificial Sequence
  RNA Oligomer
auuccugguaaagggcccgaaca

SEQ ID NO: 35439 - RNA, 23 nt, Artificial Sequence
  RNA Oligomer
aauggaguaggcaccaaaguacc

SEQ ID NO: 35440 - RNA, 23 nt, Artificial Sequence
  RNA Oligomer
auggaguaggcaccaaaguacca

SEQ ID NO: 35441 - RNA, 23 nt, Artificial Sequence
  RNA Oligomer
ggcgacgagaaagaaauaagauu

SEQ ID NO: 35442 - RNA, 23 nt, Artificial Sequence
  RNA Oligomer
aggcgacgagaaagaaauaagau

SEQ ID NO: 35443 - RNA, 23 nt, Artificial Sequence
  RNA Oligomer
gaggcgacgagaaagaaauaaga

SEQ ID NO: 35444 - RNA, 23 nt, Artificial Sequence
  RNA Oligomer
agaggcgacgagaaagaaauaag

SEQ ID NO: 35445 - RNA, 23 nt, Artificial Sequence
  RNA Oligomer
aagaggcgacgagaaagaaauaa

SEQ ID NO: 35446 - RNA, 23 nt, Artificial Sequence
  RNA Oligomer
ugaagaagaugaaaggaaaaaga

SEQ ID NO: 35447 - RNA, 23 nt, Artificial Sequence
  RNA Oligomer
cugaagaagaugaaaggaaaaag

SEQ ID NO: 35448 - RNA, 23 nt, Artificial Sequence
  RNA Oligomer
ccugaagaagaugaaaggaaaaa

SEQ ID NO: 35449 - RNA, 23 nt, Artificial Sequence
  RNA Oligomer
cccugaagaagaugaaaggaaaa

SEQ ID NO: 35450 - RNA, 23 nt, Artificial Sequence
  RNA Oligomer
ccccugaagaagaugaaaggaaa

SEQ ID NO: 35451 - RNA, 23 nt, Artificial Sequence
  RNA Oligomer
ccucauuuuauacccaaaacccu

SEQ ID NO: 35452 - RNA, 23 nt, Artificial Sequence
  RNA Oligomer
uccucauuuuauacccaaaaccc

SEQ ID NO: 35453 - RNA, 23 nt, Artificial Sequence
  RNA Oligomer
auccucauuuuauacccaaaacc

SEQ ID NO: 35454 - RNA, 23 nt, Artificial Sequence
  RNA Oligomer
aauccucauuuuauacccaaaac

SEQ ID NO: 35455 - RNA, 23 nt, Artificial Sequence
  RNA Oligomer
gaauccucauuuuauacccaaaa

SEQ ID NO: 35456 - RNA, 23 nt, Artificial Sequence
  RNA Oligomer
cgacgagaaagaaauaagauugc

SEQ ID NO: 35457 - RNA, 23 nt, Artificial Sequence
  RNA Oligomer
gcgacgagaaagaaauaagauug

SEQ ID NO: 35458 - RNA, 23 nt, Artificial Sequence
  RNA Oligomer
cgagaaagaaauaagauugcagc

SEQ ID NO: 35459 - RNA, 23 nt, Artificial Sequence
  RNA Oligomer
acgagaaagaaauaagauugcag

SEQ ID NO: 35460 - RNA, 23 nt, Artificial Sequence
  RNA Oligomer
gacgagaaagaaauaagauugca

SEQ ID NO: 35461 - RNA, 23 nt, Artificial Sequence
  RNA Oligomer
gaagaagaugaaaggaaaaagag

SEQ ID NO: 35462 - RNA, 23 nt, Artificial Sequence
  RNA Oligomer
gccccugaagaagaugaaaggaa

SEQ ID NO: 35463 - RNA, 23 nt, Artificial Sequence
  RNA Oligomer
ugaauccucauuuuauacccaaa

SEQ ID NO: 35464 - RNA, 23 nt, Artificial Sequence
  RNA Oligomer
gaagaugaaaggaaaaagaggcg

SEQ ID NO: 35465 - RNA, 23 nt, Artificial Sequence
  RNA Oligomer
agaagaugaaaggaaaaagaggc

SEQ ID NO: 35466 - RNA, 23 nt, Artificial Sequence
  RNA Oligomer
aagaagaugaaaggaaaaagagg

SEQ ID NO: 35467 - RNA, 23 nt, Artificial Sequence
  RNA Oligomer
ccaaaacccugaagccauuggag

SEQ ID NO: 35468 - RNA, 23 nt, Artificial Sequence
  RNA Oligomer
cccaaaacccugaagccauugga

SEQ ID NO: 35469 - RNA, 23 nt, Artificial Sequence
  RNA Oligomer
acccaaaacccugaagccauugg

SEQ ID NO: 35470 - RNA, 23 nt, Artificial Sequence
  RNA Oligomer
uacccaaaacccugaagccauug

SEQ ID NO: 35471 - RNA, 23 nt, Artificial Sequence
  RNA Oligomer
auacccaaaacccugaagccauu

SEQ ID NO: 35472 - RNA, 23 nt, Artificial Sequence
  RNA Oligomer
cucauugaauccucauuuuauac

SEQ ID NO: 35473 - RNA, 23 nt, Artificial Sequence
  RNA Oligomer
ccucauugaauccucauuuuaua

SEQ ID NO: 35474 - RNA, 23 nt, Artificial Sequence
  RNA Oligomer
uccucauugaauccucauuuuau

SEQ ID NO: 35475 - RNA, 23 nt, Artificial Sequence
  RNA Oligomer
guccucauugaauccucauuuua

SEQ ID NO: 35476 - RNA, 23 nt, Artificial Sequence
  RNA Oligomer
aguccucauugaauccucauuuu

SEQ ID NO: 35477 - RNA, 23 nt, Artificial Sequence
  RNA Oligomer
gaguccucauugaauccucauuu

SEQ ID NO: 35478 - RNA, 23 nt, Artificial Sequence
  RNA Oligomer
gcauuguuuuugucauguagcug

SEQ ID NO: 35479 - RNA, 23 nt, Artificial Sequence
  RNA Oligomer
agcauuguuuuugucauguagcu

SEQ ID NO: 35480 - RNA, 23 nt, Artificial Sequence
  RNA Oligomer
uagcauuguuuuugucauguagc

SEQ ID NO: 35481 - RNA, 23 nt, Artificial Sequence
  RNA Oligomer
auagcauuguuuuugucauguag

SEQ ID NO: 35482 - RNA, 23 nt, Artificial Sequence
  RNA Oligomer
aauagcauuguuuuugucaugua

SEQ ID NO: 35483 - RNA, 23 nt, Artificial Sequence
  RNA Oligomer
uugaauccucauuuuauacccaa

SEQ ID NO: 35484 - RNA, 23 nt, Artificial Sequence
  RNA Oligomer
ggaaagugugaaugcugaacuga

SEQ ID NO: 35485 - RNA, 23 nt, Artificial Sequence
  RNA Oligomer
uggaaagugugaaugcugaacug

SEQ ID NO: 35486 - RNA, 23 nt, Artificial Sequence
  RNA Oligomer
cuggaaagugugaaugcugaacu

SEQ ID NO: 35487 - RNA, 23 nt, Artificial Sequence
  RNA Oligomer
gcuggaaagugugaaugcugaac

SEQ ID NO: 35488 - RNA, 23 nt, Artificial Sequence
  RNA Oligomer
agcuggaaagugugaaugcugaa

SEQ ID NO: 35489 - RNA, 23 nt, Artificial Sequence
  RNA Oligomer
gaaacaagaagaaggagaagacg

SEQ ID NO: 35490 - RNA, 23 nt, Artificial Sequence
  RNA Oligomer
cgaaacaagaagaaggagaagac

SEQ ID NO: 35491 - RNA, 23 nt, Artificial Sequence
  RNA Oligomer
ccgaaacaagaagaaggagaaga

SEQ ID NO: 35492 - RNA, 23 nt, Artificial Sequence
  RNA Oligomer
gccgaaacaagaagaaggagaag

SEQ ID NO: 35493 - RNA, 23 nt, Artificial Sequence
  RNA Oligomer
ugccgaaacaagaagaaggagaa

SEQ ID NO: 35494 - RNA, 23 nt, Artificial Sequence
  RNA Oligomer
gugccgaaacaagaagaaggaga

SEQ ID NO: 35495 - RNA, 23 nt, Artificial Sequence
  RNA Oligomer
agugccgaaacaagaagaaggag

SEQ ID NO: 35496 - RNA, 23 nt, Artificial Sequence
  RNA Oligomer
aagugccgaaacaagaagaagga

SEQ ID NO: 35497 - RNA, 23 nt, Artificial Sequence
  RNA Oligomer
aaagaggcgacgagaaagaaaua

SEQ ID NO: 35498 - RNA, 23 nt, Artificial Sequence
  RNA Oligomer
aaaagaggcgacgagaaagaaau

SEQ ID NO: 35499 - RNA, 23 nt, Artificial Sequence
  RNA Oligomer
ggaugucaauagcauuguuuuug

SEQ ID NO: 35500 - RNA, 23 nt, Artificial Sequence
  RNA Oligomer
uggaugucaauagcauuguuuuu

SEQ ID NO: 35501 - RNA, 23 nt, Artificial Sequence
  RNA Oligomer
uuggaugucaauagcauuguuuu

SEQ ID NO: 35502 - RNA, 23 nt, Artificial Sequence
  RNA Oligomer
auuggaugucaauagcauuguuu

SEQ ID NO: 35503 - RNA, 23 nt, Artificial Sequence
  RNA Oligomer
uauuggaugucaauagcauuguu

SEQ ID NO: 35504 - RNA, 23 nt, Artificial Sequence
  RNA Oligomer
gcaagaggaggacagaauucucc

SEQ ID NO: 35505 - RNA, 23 nt, Artificial Sequence
  RNA Oligomer
agcaagaggaggacagaauucuc

SEQ ID NO: 35506 - RNA, 23 nt, Artificial Sequence
  RNA Oligomer
cagcaagaggaggacagaauucu

SEQ ID NO: 35507 - RNA, 23 nt, Artificial Sequence
  RNA Oligomer
ucagcaagaggaggacagaauuc

SEQ ID NO: 35508 - RNA, 23 nt, Artificial Sequence
  RNA Oligomer
gucagcaagaggaggacagaauu

SEQ ID NO: 35509 - RNA, 23 nt, Artificial Sequence
  RNA Oligomer
gaaauugugugugcaagaaaacu

SEQ ID NO: 35510 - RNA, 23 nt, Artificial Sequence
  RNA Oligomer
agaaauugugugugcaagaaaac

SEQ ID NO: 35511 - RNA, 23 nt, Artificial Sequence
  RNA Oligomer
cagaaauugugugugcaagaaaa

SEQ ID NO: 35512 - RNA, 23 nt, Artificial Sequence
  RNA Oligomer
ccagaaauugugugugcaagaaa

SEQ ID NO: 35513 - RNA, 23 nt, Artificial Sequence
  RNA Oligomer
uccagaaauugugugugcaagaa

SEQ ID NO: 35514 - RNA, 23 nt, Artificial Sequence
  RNA Oligomer
guccagaaauugugugugcaaga

SEQ ID NO: 35515 - RNA, 23 nt, Artificial Sequence
  RNA Oligomer
uguccagaaauugugugugcaag

SEQ ID NO: 35516 - RNA, 23 nt, Artificial Sequence
  RNA Oligomer
auguccagaaauugugugugcaa

SEQ ID NO: 35517 - RNA, 23 nt, Artificial Sequence
  RNA Oligomer
ggcuaccauugucacucguaggg

SEQ ID NO: 35518 - RNA, 23 nt, Artificial Sequence
  RNA Oligomer
uggcuaccauugucacucguagg

SEQ ID NO: 35519 - RNA, 23 nt, Artificial Sequence
  RNA Oligomer
guggcuaccauugucacucguag

SEQ ID NO: 35520 - RNA, 23 nt, Artificial Sequence
  RNA Oligomer
cguggcuaccauugucacucgua

SEQ ID NO: 35521 - RNA, 23 nt, Artificial Sequence
  RNA Oligomer
ccguggcuaccauugucacucgu

SEQ ID NO: 35522 - RNA, 23 nt, Artificial Sequence
  RNA Oligomer
ucaucuggauucuacaaaaaacc

SEQ ID NO: 35523 - RNA, 23 nt, Artificial Sequence
  RNA Oligomer
uucaucuggauucuacaaaaaac

SEQ ID NO: 35524 - RNA, 23 nt, Artificial Sequence
  RNA Oligomer
uuucaucuggauucuacaaaaaa

SEQ ID NO: 35525 - RNA, 23 nt, Artificial Sequence
  RNA Oligomer
cuuucaucuggauucuacaaaaa

SEQ ID NO: 35526 - RNA, 23 nt, Artificial Sequence
  RNA Oligomer
ccuuucaucuggauucuacaaaa

SEQ ID NO: 35527 - RNA, 23 nt, Artificial Sequence
  RNA Oligomer
cacuggccauucuuauguuccag

SEQ ID NO: 35528 - RNA, 23 nt, Artificial Sequence
  RNA Oligomer
acacuggccauucuuauguucca

SEQ ID NO: 35529 - RNA, 23 nt, Artificial Sequence
  RNA Oligomer
cacacuggccauucuuauguucc

SEQ ID NO: 35530 - RNA, 23 nt, Artificial Sequence
  RNA Oligomer
acacacuggccauucuuauguuc

SEQ ID NO: 35531 - RNA, 23 nt, Artificial Sequence
  RNA Oligomer
aacacacuggccauucuuauguu

SEQ ID NO: 35532 - RNA, 23 nt, Artificial Sequence
  RNA Oligomer
uauacccaaaacccugaagccau

SEQ ID NO: 35533 - RNA, 23 nt, Artificial Sequence
  RNA Oligomer
cucagaguguuuaauuguacuca

SEQ ID NO: 35534 - RNA, 23 nt, Artificial Sequence
  RNA Oligomer
ucucagaguguuuaauuguacuc

SEQ ID NO: 35535 - RNA, 23 nt, Artificial Sequence
  RNA Oligomer
uucucagaguguuuaauuguacu

SEQ ID NO: 35536 - RNA, 23 nt, Artificial Sequence
  RNA Oligomer
auucucagaguguuuaauuguac

SEQ ID NO: 35537 - RNA, 23 nt, Artificial Sequence
  RNA Oligomer
aauucucagaguguuuaauugua

SEQ ID NO: 35538 - RNA, 23 nt, Artificial Sequence
  RNA Oligomer
gccaaagaauauuccauuuuccu

SEQ ID NO: 35539 - RNA, 23 nt, Artificial Sequence
  RNA Oligomer
agccaaagaauauuccauuuucc

SEQ ID NO: 35540 - RNA, 23 nt, Artificial Sequence
  RNA Oligomer
gagccaaagaauauuccauuuuc

SEQ ID NO: 35541 - RNA, 23 nt, Artificial Sequence
  RNA Oligomer
agagccaaagaauauuccauuuu

SEQ ID NO: 35542 - RNA, 23 nt, Artificial Sequence
  RNA Oligomer
aagagccaaagaauauuccauuu

SEQ ID NO: 35543 - RNA, 23 nt, Artificial Sequence
  RNA Oligomer
ggaguccucauugaauccucauu

SEQ ID NO: 35544 - RNA, 23 nt, Artificial Sequence
  RNA Oligomer
gaaaaagaggcgacgagaaagaa

SEQ ID NO: 35545 - RNA, 23 nt, Artificial Sequence
  RNA Oligomer
ggaaaaagaggcgacgagaaaga

SEQ ID NO: 35546 - RNA, 23 nt, Artificial Sequence
  RNA Oligomer
aggaaaaagaggcgacgagaaag

SEQ ID NO: 35547 - RNA, 23 nt, Artificial Sequence
  RNA Oligomer
aaggaaaaagaggcgacgagaaa

SEQ ID NO: 35548 - RNA, 23 nt, Artificial Sequence
  RNA Oligomer
aaaggaaaaagaggcgacgagaa

SEQ ID NO: 35549 - RNA, 23 nt, Artificial Sequence
  RNA Oligomer
gaaaggaaaaagaggcgacgaga

SEQ ID NO: 35550 - RNA, 23 nt, Artificial Sequence
  RNA Oligomer
ugaaaggaaaaagaggcgacgag

SEQ ID NO: 35551 - RNA, 23 nt, Artificial Sequence
  RNA Oligomer
acagaauucucccagcguuaaca

SEQ ID NO: 35552 - RNA, 23 nt, Artificial Sequence
  RNA Oligomer
gacagaauucucccagcguuaac

SEQ ID NO: 35553 - RNA, 23 nt, Artificial Sequence
  RNA Oligomer
ggacagaauucucccagcguuaa

SEQ ID NO: 35554 - RNA, 23 nt, Artificial Sequence
  RNA Oligomer
aggacagaauucucccagcguua

SEQ ID NO: 35555 - RNA, 23 nt, Artificial Sequence
  RNA Oligomer
gaggacagaauucucccagcguu

SEQ ID NO: 35556 - RNA, 23 nt, Artificial Sequence
  RNA Oligomer
ugucagcaagaggaggacagaau

SEQ ID NO: 35557 - RNA, 23 nt, Artificial Sequence
  RNA Oligomer
caagaaaacuaggcaauguacuc

SEQ ID NO: 35558 - RNA, 23 nt, Artificial Sequence
  RNA Oligomer
gcaagaaaacuaggcaauguacu

SEQ ID NO: 35559 - RNA, 23 nt, Artificial Sequence
  RNA Oligomer
ugcaagaaaacuaggcaauguac

SEQ ID NO: 35560 - RNA, 23 nt, Artificial Sequence
  RNA Oligomer
gugcaagaaaacuaggcaaugua

SEQ ID NO: 35561 - RNA, 23 nt, Artificial Sequence
  RNA Oligomer
ugugcaagaaaacuaggcaaugu

SEQ ID NO: 35562 - RNA, 23 nt, Artificial Sequence
  RNA Oligomer
ggagugagaacagcauuuaguga

SEQ ID NO: 35563 - RNA, 23 nt, Artificial Sequence
  RNA Oligomer
uggagugagaacagcauuuagug

SEQ ID NO: 35564 - RNA, 23 nt, Artificial Sequence
  RNA Oligomer
guggagugagaacagcauuuagu

SEQ ID NO: 35565 - RNA, 23 nt, Artificial Sequence
  RNA Oligomer
uguggagugagaacagcauuuag

SEQ ID NO: 35566 - RNA, 23 nt, Artificial Sequence
  RNA Oligomer
auguggagugagaacagcauuua

SEQ ID NO: 35567 - RNA, 23 nt, Artificial Sequence
  RNA Oligomer
ggccauucuuauguuccagaugg

SEQ ID NO: 35568 - RNA, 23 nt, Artificial Sequence
  RNA Oligomer
uggccauucuuauguuccagaug

SEQ ID NO: 35569 - RNA, 23 nt, Artificial Sequence
  RNA Oligomer
cuggccauucuuauguuccagau

SEQ ID NO: 35570 - RNA, 23 nt, Artificial Sequence
  RNA Oligomer
acuggccauucuuauguuccaga

SEQ ID NO: 35571 - RNA, 23 nt, Artificial Sequence
  RNA Oligomer
caacagauaaaagaaggaacauu

SEQ ID NO: 35572 - RNA, 23 nt, Artificial Sequence
  RNA Oligomer
ccaacagauaaaagaaggaacau

SEQ ID NO: 35573 - RNA, 23 nt, Artificial Sequence
  RNA Oligomer
uccaacagauaaaagaaggaaca

SEQ ID NO: 35574 - RNA, 23 nt, Artificial Sequence
  RNA Oligomer
auccaacagauaaaagaaggaac

SEQ ID NO: 35575 - RNA, 23 nt, Artificial Sequence
  RNA Oligomer
uauccaacagauaaaagaaggaa

SEQ ID NO: 35576 - RNA, 23 nt, Artificial Sequence
  RNA Oligomer
uuauccaacagauaaaagaagga

SEQ ID NO: 35577 - RNA, 23 nt, Artificial Sequence
  RNA Oligomer
gugugaaugcugaacugaaggcu

SEQ ID NO: 35578 - RNA, 23 nt, Artificial Sequence
  RNA Oligomer
agugugaaugcugaacugaaggc

SEQ ID NO: 35579 - RNA, 23 nt, Artificial Sequence
  RNA Oligomer
aagugugaaugcugaacugaagg

SEQ ID NO: 35580 - RNA, 23 nt, Artificial Sequence
  RNA Oligomer
aaagugugaaugcugaacugaag

SEQ ID NO: 35581 - RNA, 23 nt, Artificial Sequence
  RNA Oligomer
gaaagugugaaugcugaacugaa

SEQ ID NO: 35582 - RNA, 23 nt, Artificial Sequence
  RNA Oligomer
gaagcuggaaagugugaaugcug

SEQ ID NO: 35583 - RNA, 23 nt, Artificial Sequence
  RNA Oligomer
agaagcuggaaagugugaaugcu

SEQ ID NO: 35584 - RNA, 23 nt, Artificial Sequence
  RNA Oligomer
gagaagcuggaaagugugaaugc

SEQ ID NO: 35585 - RNA, 23 nt, Artificial Sequence
  RNA Oligomer
ggagaagcuggaaagugugaaug

SEQ ID NO: 35586 - RNA, 23 nt, Artificial Sequence
  RNA Oligomer
cggagaagcuggaaagugugaau

SEQ ID NO: 35587 - RNA, 23 nt, Artificial Sequence
  RNA Oligomer
aaagugccgaaacaagaagaagg

SEQ ID NO: 35588 - RNA, 23 nt, Artificial Sequence
  RNA Oligomer
caaagugccgaaacaagaagaag

SEQ ID NO: 35589 - RNA, 23 nt, Artificial Sequence
  RNA Oligomer
gcaaagugccgaaacaagaagaa

SEQ ID NO: 35590 - RNA, 23 nt, Artificial Sequence
  RNA Oligomer
gaaagaaauaagauugcagcugc

SEQ ID NO: 35591 - RNA, 23 nt, Artificial Sequence
  RNA Oligomer
agaaagaaauaagauugcagcug

SEQ ID NO: 35592 - RNA, 23 nt, Artificial Sequence
  RNA Oligomer
gagaaagaaauaagauugcagcu

SEQ ID NO: 35593 - RNA, 23 nt, Artificial Sequence
  RNA Oligomer
aaaaagaggcgacgagaaagaaa

SEQ ID NO: 35594 - RNA, 23 nt, Artificial Sequence
  RNA Oligomer
augaaaggaaaaagaggcgacga

SEQ ID NO: 35595 - RNA, 23 nt, Artificial Sequence
  RNA Oligomer
gaugaaaggaaaaagaggcgacg

SEQ ID NO: 35596 - RNA, 23 nt, Artificial Sequence
  RNA Oligomer
agaugaaaggaaaaagaggcgac

SEQ ID NO: 35597 - RNA, 23 nt, Artificial Sequence
  RNA Oligomer
ucagaguguuuaauuguacucaa

SEQ ID NO: 35598 - RNA, 23 nt, Artificial Sequence
  RNA Oligomer
aagaaaacuaggcaauguacucu

SEQ ID NO: 35599 - RNA, 23 nt, Artificial Sequence
  RNA Oligomer
gcuaccauugucacucguagggg

SEQ ID NO: 35600 - RNA, 23 nt, Artificial Sequence
  RNA Oligomer
uaacacacuggccauucuuaugu

SEQ ID NO: 35601 - RNA, 23 nt, Artificial Sequence
  RNA Oligomer
uuauacccaaaacccugaagcca

SEQ ID NO: 35602 - RNA, 23 nt, Artificial Sequence
  RNA Oligomer
uuuauacccaaaacccugaagcc

SEQ ID NO: 35603 - RNA, 23 nt, Artificial Sequence
  RNA Oligomer
uuuuauacccaaaacccugaagc

SEQ ID NO: 35604 - RNA, 23 nt, Artificial Sequence
  RNA Oligomer
auuuuauacccaaaacccugaag

SEQ ID NO: 35605 - RNA, 23 nt, Artificial Sequence
  RNA Oligomer
cauuuuauacccaaaacccugaa

SEQ ID NO: 35606 - RNA, 23 nt, Artificial Sequence
  RNA Oligomer
acagauaaaagaaggaacauugc

SEQ ID NO: 35607 - RNA, 23 nt, Artificial Sequence
  RNA Oligomer
aacagauaaaagaaggaacauug

SEQ ID NO: 35608 - RNA, 23 nt, Artificial Sequence
  RNA Oligomer
ugauauacaugcucaaccuucau

SEQ ID NO: 35609 - RNA, 23 nt, Artificial Sequence
  RNA Oligomer
uugauauacaugcucaaccuuca

SEQ ID NO: 35610 - RNA, 23 nt, Artificial Sequence
  RNA Oligomer
uuugauauacaugcucaaccuuc

SEQ ID NO: 35611 - RNA, 23 nt, Artificial Sequence
  RNA Oligomer
auuugauauacaugcucaaccuu

SEQ ID NO: 35612 - RNA, 23 nt, Artificial Sequence
  RNA Oligomer
cauuugauauacaugcucaaccu

SEQ ID NO: 35613 - RNA, 23 nt, Artificial Sequence
  RNA Oligomer
cgagaagcagcauuugauauaca

SEQ ID NO: 35614 - RNA, 23 nt, Artificial Sequence
  RNA Oligomer
acgagaagcagcauuugauauac

SEQ ID NO: 35615 - RNA, 23 nt, Artificial Sequence
  RNA Oligomer
aacgagaagcagcauuugauaua

SEQ ID NO: 35616 - RNA, 23 nt, Artificial Sequence
  RNA Oligomer
gaacgagaagcagcauuugauau

SEQ ID NO: 35617 - RNA, 23 nt, Artificial Sequence
  RNA Oligomer
agaacgagaagcagcauuugaua

SEQ ID NO: 35618 - RNA, 23 nt, Artificial Sequence
  RNA Oligomer
aagcuggaaagugugaaugcuga

SEQ ID NO: 35619 - RNA, 23 nt, Artificial Sequence
  RNA Oligomer
acaagaagaaggagaagacggag

SEQ ID NO: 35620 - RNA, 23 nt, Artificial Sequence
  RNA Oligomer
aacaagaagaaggagaagacgga

SEQ ID NO: 35621 - RNA, 23 nt, Artificial Sequence
  RNA Oligomer
aaacaagaagaaggagaagacgg

SEQ ID NO: 35622 - RNA, 23 nt, Artificial Sequence
  RNA Oligomer
gaaauucucagaguguuuaauug

SEQ ID NO: 35623 - RNA, 23 nt, Artificial Sequence
  RNA Oligomer
ugaaauucucagaguguuuaauu

SEQ ID NO: 35624 - RNA, 23 nt, Artificial Sequence
  RNA Oligomer
gugaaauucucagaguguuuaau

SEQ ID NO: 35625 - RNA, 23 nt, Artificial Sequence
  RNA Oligomer
ugugaaauucucagaguguuuaa

SEQ ID NO: 35626 - RNA, 23 nt, Artificial Sequence
  RNA Oligomer
cugugaaauucucagaguguuua

SEQ ID NO: 35627 - RNA, 23 nt, Artificial Sequence
  RNA Oligomer
gcuggcuacugucuauuaaaauu

SEQ ID NO: 35628 - RNA, 23 nt, Artificial Sequence
  RNA Oligomer
cgcuggcuacugucuauuaaaau

SEQ ID NO: 35629 - RNA, 23 nt, Artificial Sequence
  RNA Oligomer
gacgcuggcuacugucuauuaaa

SEQ ID NO: 35630 - RNA, 23 nt, Artificial Sequence
  RNA Oligomer
ggacgcuggcuacugucuauuaa

SEQ ID NO: 35631 - RNA, 23 nt, Artificial Sequence
  RNA Oligomer
guagcuguuuuaagaaaucuggc

SEQ ID NO: 35632 - RNA, 23 nt, Artificial Sequence
  RNA Oligomer
uguagcuguuuuaagaaaucugg

SEQ ID NO: 35633 - RNA, 23 nt, Artificial Sequence
  RNA Oligomer
auguagcuguuuuaagaaaucug

SEQ ID NO: 35634 - RNA, 23 nt, Artificial Sequence
  RNA Oligomer
cauguagcuguuuuaagaaaucu

SEQ ID NO: 35635 - RNA, 23 nt, Artificial Sequence
  RNA Oligomer
ucauguagcuguuuuaagaaauc

SEQ ID NO: 35636 - RNA, 23 nt, Artificial Sequence
  RNA Oligomer
guggagagauguuuggaaaccac

SEQ ID NO: 35637 - RNA, 23 nt, Artificial Sequence
  RNA Oligomer
aguggagagauguuuggaaacca

SEQ ID NO: 35638 - RNA, 23 nt, Artificial Sequence
  RNA Oligomer
caguggagagauguuuggaaacc

SEQ ID NO: 35639 - RNA, 23 nt, Artificial Sequence
  RNA Oligomer
ucaguggagagauguuuggaaac

SEQ ID NO: 35640 - RNA, 23 nt, Artificial Sequence
  RNA Oligomer
gucaguggagagauguuuggaaa

SEQ ID NO: 35641 - RNA, 23 nt, Artificial Sequence
  RNA Oligomer
ccauuuuccuuuccuugugguug

SEQ ID NO: 35642 - RNA, 23 nt, Artificial Sequence
  RNA Oligomer
uccauuuuccuuuccuugugguu

SEQ ID NO: 35643 - RNA, 23 nt, Artificial Sequence
  RNA Oligomer
uuccauuuuccuuuccuuguggu

SEQ ID NO: 35644 - RNA, 23 nt, Artificial Sequence
  RNA Oligomer
auuccauuuuccuuuccuugugg

SEQ ID NO: 35645 - RNA, 23 nt, Artificial Sequence
  RNA Oligomer
uauuccauuuuccuuuccuugug

SEQ ID NO: 35646 - RNA, 23 nt, Artificial Sequence
  RNA Oligomer
ugcaaacucaguuccaaagucac

SEQ ID NO: 35647 - RNA, 23 nt, Artificial Sequence
  RNA Oligomer
uugcaaacucaguuccaaaguca

SEQ ID NO: 35648 - RNA, 23 nt, Artificial Sequence
  RNA Oligomer
guugcaaacucaguuccaaaguc

SEQ ID NO: 35649 - RNA, 23 nt, Artificial Sequence
  RNA Oligomer
uguugcaaacucaguuccaaagu

SEQ ID NO: 35650 - RNA, 23 nt, Artificial Sequence
  RNA Oligomer
cuguugcaaacucaguuccaaag

SEQ ID NO: 35651 - RNA, 23 nt, Artificial Sequence
  RNA Oligomer
gugugcaagaaaacuaggcaaug

SEQ ID NO: 35652 - RNA, 23 nt, Artificial Sequence
  RNA Oligomer
agcauuuagugaaguugugcaac

SEQ ID NO: 35653 - RNA, 23 nt, Artificial Sequence
  RNA Oligomer
cagcauuuagugaaguugugcaa

SEQ ID NO: 35654 - RNA, 23 nt, Artificial Sequence
  RNA Oligomer
acagcauuuagugaaguugugca

SEQ ID NO: 35655 - RNA, 23 nt, Artificial Sequence
  RNA Oligomer
aacagcauuuagugaaguugugc

SEQ ID NO: 35656 - RNA, 23 nt, Artificial Sequence
  RNA Oligomer
gaacagcauuuagugaaguugug

SEQ ID NO: 35657 - RNA, 23 nt, Artificial Sequence
  RNA Oligomer
caucuggauucuacaaaaaacca

SEQ ID NO: 35658 - RNA, 23 nt, Artificial Sequence
  RNA Oligomer
gccuuucaucuggauucuacaaa

SEQ ID NO: 35659 - RNA, 23 nt, Artificial Sequence
  RNA Oligomer
cgccuuucaucuggauucuacaa

SEQ ID NO: 35660 - RNA, 23 nt, Artificial Sequence
  RNA Oligomer
ccgccuuucaucuggauucuaca

SEQ ID NO: 35661 - RNA, 23 nt, Artificial Sequence
  RNA Oligomer
cccgccuuucaucuggauucuac

SEQ ID NO: 35662 - RNA, 23 nt, Artificial Sequence
  RNA Oligomer
gcccgccuuucaucuggauucua

SEQ ID NO: 35663 - RNA, 23 nt, Artificial Sequence
  RNA Oligomer
ugcccgccuuucaucuggauucu

SEQ ID NO: 35664 - RNA, 23 nt, Artificial Sequence
  RNA Oligomer
ccuuaacacacuggccauucuua

SEQ ID NO: 35665 - RNA, 23 nt, Artificial Sequence
  RNA Oligomer
gccuuaacacacuggccauucuu

SEQ ID NO: 35666 - RNA, 23 nt, Artificial Sequence
  RNA Oligomer
ggccuuaacacacuggccauucu

SEQ ID NO: 35667 - RNA, 23 nt, Artificial Sequence
  RNA Oligomer
aggccuuaacacacuggccauuc

SEQ ID NO: 35668 - RNA, 23 nt, Artificial Sequence
  RNA Oligomer
uaggccuuaacacacuggccauu

SEQ ID NO: 35669 - RNA, 23 nt, Artificial Sequence
  RNA Oligomer
ggaacauugcagagcuaagcagu

SEQ ID NO: 35670 - RNA, 23 nt, Artificial Sequence
  RNA Oligomer
aggaacauugcagagcuaagcag

SEQ ID NO: 35671 - RNA, 23 nt, Artificial Sequence
  RNA Oligomer
aaggaacauugcagagcuaagca

SEQ ID NO: 35672 - RNA, 23 nt, Artificial Sequence
  RNA Oligomer
gaaggaacauugcagagcuaagc

SEQ ID NO: 35673 - RNA, 23 nt, Artificial Sequence
  RNA Oligomer
agaaggaacauugcagagcuaag

SEQ ID NO: 35674 - RNA, 23 nt, Artificial Sequence
  RNA Oligomer
aagaaggaacauugcagagcuaa

SEQ ID NO: 35675 - RNA, 23 nt, Artificial Sequence
  RNA Oligomer
aaagaaggaacauugcagagcua

SEQ ID NO: 35676 - RNA, 23 nt, Artificial Sequence
  RNA Oligomer
aaaagaaggaacauugcagagcu

SEQ ID NO: 35677 - RNA, 23 nt, Artificial Sequence
  RNA Oligomer
aagaacgagaagcagcauuugau

SEQ ID NO: 35678 - RNA, 23 nt, Artificial Sequence
  RNA Oligomer
ugcaaagugccgaaacaagaaga

SEQ ID NO: 35679 - RNA, 23 nt, Artificial Sequence
  RNA Oligomer
cugcaaagugccgaaacaagaag

SEQ ID NO: 35680 - RNA, 23 nt, Artificial Sequence
  RNA Oligomer
gcugcaaagugccgaaacaagaa

SEQ ID NO: 35681 - RNA, 23 nt, Artificial Sequence
  RNA Oligomer
agcugcaaagugccgaaacaaga

SEQ ID NO: 35682 - RNA, 23 nt, Artificial Sequence
  RNA Oligomer
agaaauaagauugcagcugcaaa

SEQ ID NO: 35683 - RNA, 23 nt, Artificial Sequence
  RNA Oligomer
aagaaauaagauugcagcugcaa

SEQ ID NO: 35684 - RNA, 23 nt, Artificial Sequence
  RNA Oligomer
aaagaaauaagauugcagcugca

SEQ ID NO: 35685 - RNA, 23 nt, Artificial Sequence
  RNA Oligomer
caucacaaaagccgagguagccc

SEQ ID NO: 35686 - RNA, 23 nt, Artificial Sequence
  RNA Oligomer
ccaucacaaaagccgagguagcc

SEQ ID NO: 35687 - RNA, 23 nt, Artificial Sequence
  RNA Oligomer
uccaucacaaaagccgagguagc

SEQ ID NO: 35688 - RNA, 23 nt, Artificial Sequence
  RNA Oligomer
guccaucacaaaagccgagguag

SEQ ID NO: 35689 - RNA, 23 nt, Artificial Sequence
  RNA Oligomer
uguccaucacaaaagccgaggua

SEQ ID NO: 35690 - RNA, 23 nt, Artificial Sequence
  RNA Oligomer
cagaguguuuaauuguacucaau

SEQ ID NO: 35691 - RNA, 23 nt, Artificial Sequence
  RNA Oligomer
ggcuacugucuauuaaaauucug

SEQ ID NO: 35692 - RNA, 23 nt, Artificial Sequence
  RNA Oligomer
uggcuacugucuauuaaaauucu

SEQ ID NO: 35693 - RNA, 23 nt, Artificial Sequence
  RNA Oligomer
cuggcuacugucuauuaaaauuc

SEQ ID NO: 35694 - RNA, 23 nt, Artificial Sequence
  RNA Oligomer
aggacgcuggcuacugucuauua

SEQ ID NO: 35695 - RNA, 23 nt, Artificial Sequence
  RNA Oligomer
ucaaggaagagcugagguuugcc

SEQ ID NO: 35696 - RNA, 23 nt, Artificial Sequence
  RNA Oligomer
gucaaggaagagcugagguuugc

SEQ ID NO: 35697 - RNA, 23 nt, Artificial Sequence
  RNA Oligomer
ugucaaggaagagcugagguuug

SEQ ID NO: 35698 - RNA, 23 nt, Artificial Sequence
  RNA Oligomer
uugucaaggaagagcugagguuu

SEQ ID NO: 35699 - RNA, 23 nt, Artificial Sequence
  RNA Oligomer
uuugucaaggaagagcugagguu

SEQ ID NO: 35700 - RNA, 23 nt, Artificial Sequence
  RNA Oligomer
ggaagagccaaagaauauuccau

SEQ ID NO: 35701 - RNA, 23 nt, Artificial Sequence
  RNA Oligomer
uggaagagccaaagaauauucca

SEQ ID NO: 35702 - RNA, 23 nt, Artificial Sequence
  RNA Oligomer
cuggaagagccaaagaauauucc

SEQ ID NO: 35703 - RNA, 23 nt, Artificial Sequence
  RNA Oligomer
gcuggaagagccaaagaauauuc

SEQ ID NO: 35704 - RNA, 23 nt, Artificial Sequence
  RNA Oligomer
ggcuggaagagccaaagaauauu

SEQ ID NO: 35705 - RNA, 23 nt, Artificial Sequence
  RNA Oligomer
ucuguugcaaacucaguuccaaa

SEQ ID NO: 35706 - RNA, 23 nt, Artificial Sequence
  RNA Oligomer
cucuguugcaaacucaguuccaa

SEQ ID NO: 35707 - RNA, 23 nt, Artificial Sequence
  RNA Oligomer
acgugcaguaucucaagauauuc

SEQ ID NO: 35708 - RNA, 23 nt, Artificial Sequence
  RNA Oligomer
cacgugcaguaucucaagauauu

SEQ ID NO: 35709 - RNA, 23 nt, Artificial Sequence
  RNA Oligomer
ccacgugcaguaucucaagauau

SEQ ID NO: 35710 - RNA, 23 nt, Artificial Sequence
  RNA Oligomer
accacgugcaguaucucaagaua

SEQ ID NO: 35711 - RNA, 23 nt, Artificial Sequence
  RNA Oligomer
caccacgugcaguaucucaagau

SEQ ID NO: 35712 - RNA, 23 nt, Artificial Sequence
  RNA Oligomer
ugugugugcaagaaaacuaggca

SEQ ID NO: 35713 - RNA, 23 nt, Artificial Sequence
  RNA Oligomer
uugugugugcaagaaaacuaggc

SEQ ID NO: 35714 - RNA, 23 nt, Artificial Sequence
  RNA Oligomer
auugugugugcaagaaaacuagg

SEQ ID NO: 35715 - RNA, 23 nt, Artificial Sequence
  RNA Oligomer
aauugugugugcaagaaaacuag

SEQ ID NO: 35716 - RNA, 23 nt, Artificial Sequence
  RNA Oligomer
aaauugugugugcaagaaaacua

SEQ ID NO: 35717 - RNA, 23 nt, Artificial Sequence
  RNA Oligomer
cacugguguuugaggauuuugcu

SEQ ID NO: 35718 - RNA, 23 nt, Artificial Sequence
  RNA Oligomer
ucacugguguuugaggauuuugc

SEQ ID NO: 35719 - RNA, 23 nt, Artificial Sequence
  RNA Oligomer
gucacugguguuugaggauuuug

SEQ ID NO: 35720 - RNA, 23 nt, Artificial Sequence
  RNA Oligomer
ggucacugguguuugaggauuuu

SEQ ID NO: 35721 - RNA, 23 nt, Artificial Sequence
  RNA Oligomer
gggucacugguguuugaggauuu

SEQ ID NO: 35722 - RNA, 23 nt, Artificial Sequence
  RNA Oligomer
cugcccgccuuucaucuggauuc

SEQ ID NO: 35723 - RNA, 23 nt, Artificial Sequence
  RNA Oligomer
gucuuccuguguaccucuagaau

SEQ ID NO: 35724 - RNA, 23 nt, Artificial Sequence
  RNA Oligomer
ugucuuccuguguaccucuagaa

SEQ ID NO: 35725 - RNA, 23 nt, Artificial Sequence
  RNA Oligomer
cugucuuccuguguaccucuaga

SEQ ID NO: 35726 - RNA, 23 nt, Artificial Sequence
  RNA Oligomer
gcugucuuccuguguaccucuag

SEQ ID NO: 35727 - RNA, 23 nt, Artificial Sequence
  RNA Oligomer
agcugucuuccuguguaccucua

SEQ ID NO: 35728 - RNA, 23 nt, Artificial Sequence
  RNA Oligomer
cagauaaaagaaggaacauugca

SEQ ID NO: 35729 - RNA, 23 nt, Artificial Sequence
  RNA Oligomer
agaagcagcauuugauauacaug

SEQ ID NO: 35730 - RNA, 23 nt, Artificial Sequence
  RNA Oligomer
gagaagcagcauuugauauacau

SEQ ID NO: 35731 - RNA, 23 nt, Artificial Sequence
  RNA Oligomer
caagaacgagaagcagcauuuga

SEQ ID NO: 35732 - RNA, 23 nt, Artificial Sequence
  RNA Oligomer
ucaagaacgagaagcagcauuug

SEQ ID NO: 35733 - RNA, 23 nt, Artificial Sequence
  RNA Oligomer
cucaagaacgagaagcagcauuu

SEQ ID NO: 35734 - RNA, 23 nt, Artificial Sequence
  RNA Oligomer
ucugugaaauucucagaguguuu

SEQ ID NO: 35735 - RNA, 23 nt, Artificial Sequence
  RNA Oligomer
uucugugaaauucucagaguguu

SEQ ID NO: 35736 - RNA, 23 nt, Artificial Sequence
  RNA Oligomer
ggagagauguuuggaaaccacag

SEQ ID NO: 35737 - RNA, 23 nt, Artificial Sequence
  RNA Oligomer
uggagagauguuuggaaaccaca

SEQ ID NO: 35738 - RNA, 23 nt, Artificial Sequence
  RNA Oligomer
gaagagccaaagaauauuccauu

SEQ ID NO: 35739 - RNA, 23 nt, Artificial Sequence
  RNA Oligomer
ccaaagucacaggaagaaagcag

SEQ ID NO: 35740 - RNA, 23 nt, Artificial Sequence
  RNA Oligomer
uccaaagucacaggaagaaagca

SEQ ID NO: 35741 - RNA, 23 nt, Artificial Sequence
  RNA Oligomer
uuccaaagucacaggaagaaagc

SEQ ID NO: 35742 - RNA, 23 nt, Artificial Sequence
  RNA Oligomer
guuccaaagucacaggaagaaag

SEQ ID NO: 35743 - RNA, 23 nt, Artificial Sequence
  RNA Oligomer
aguuccaaagucacaggaagaaa

SEQ ID NO: 35744 - RNA, 23 nt, Artificial Sequence
  RNA Oligomer
guccucuguugcaaacucaguuc

SEQ ID NO: 35745 - RNA, 23 nt, Artificial Sequence
  RNA Oligomer
gguccucuguugcaaacucaguu

SEQ ID NO: 35746 - RNA, 23 nt, Artificial Sequence
  RNA Oligomer
agguccucuguugcaaacucagu

SEQ ID NO: 35747 - RNA, 23 nt, Artificial Sequence
  RNA Oligomer
cagguccucuguugcaaacucag

SEQ ID NO: 35748 - RNA, 23 nt, Artificial Sequence
  RNA Oligomer
gcagguccucuguugcaaacuca

SEQ ID NO: 35749 - RNA, 23 nt, Artificial Sequence
  RNA Oligomer
caaaauccaugggcaguaugaug

SEQ ID NO: 35750 - RNA, 23 nt, Artificial Sequence
  RNA Oligomer
acaaaauccaugggcaguaugau

SEQ ID NO: 35751 - RNA, 23 nt, Artificial Sequence
  RNA Oligomer
cacaaaauccaugggcaguauga

SEQ ID NO: 35752 - RNA, 23 nt, Artificial Sequence
  RNA Oligomer
acacaaaauccaugggcaguaug

SEQ ID NO: 35753 - RNA, 23 nt, Artificial Sequence
  RNA Oligomer
aacacaaaauccaugggcaguau

SEQ ID NO: 35754 - RNA, 23 nt, Artificial Sequence
  RNA Oligomer
uaacacaaaauccaugggcagua

SEQ ID NO: 35755 - RNA, 23 nt, Artificial Sequence
  RNA Oligomer
gugugugcaagaaaacuaggcaa

SEQ ID NO: 35756 - RNA, 23 nt, Artificial Sequence
  RNA Oligomer
ugggucacugguguuugaggauu

SEQ ID NO: 35757 - RNA, 23 nt, Artificial Sequence
  RNA Oligomer
cguuaggauucaggcagcagugu

SEQ ID NO: 35758 - RNA, 23 nt, Artificial Sequence
  RNA Oligomer
ccguuaggauucaggcagcagug

SEQ ID NO: 35759 - RNA, 23 nt, Artificial Sequence
  RNA Oligomer
accguuaggauucaggcagcagu

SEQ ID NO: 35760 - RNA, 23 nt, Artificial Sequence
  RNA Oligomer
caccguuaggauucaggcagcag

SEQ ID NO: 35761 - RNA, 23 nt, Artificial Sequence
  RNA Oligomer
ccaccguuaggauucaggcagca

SEQ ID NO: 35762 - RNA, 23 nt, Artificial Sequence
  RNA Oligomer
uuaacacacuggccauucuuaug

SEQ ID NO: 35763 - RNA, 23 nt, Artificial Sequence
  RNA Oligomer
cuuaacacacuggccauucuuau

SEQ ID NO: 35764 - RNA, 23 nt, Artificial Sequence
  RNA Oligomer
guguaccucuagaaucccagcag

SEQ ID NO: 35765 - RNA, 23 nt, Artificial Sequence
  RNA Oligomer
uguguaccucuagaaucccagca

SEQ ID NO: 35766 - RNA, 23 nt, Artificial Sequence
  RNA Oligomer
cuguguaccucuagaaucccagc

SEQ ID NO: 35767 - RNA, 23 nt, Artificial Sequence
  RNA Oligomer
ccuguguaccucuagaaucccag

SEQ ID NO: 35768 - RNA, 23 nt, Artificial Sequence
  RNA Oligomer
ccauuggagagcugucuuccugu

SEQ ID NO: 35769 - RNA, 23 nt, Artificial Sequence
  RNA Oligomer
gccauuggagagcugucuuccug

SEQ ID NO: 35770 - RNA, 23 nt, Artificial Sequence
  RNA Oligomer
agccauuggagagcugucuuccu

SEQ ID NO: 35771 - RNA, 23 nt, Artificial Sequence
  RNA Oligomer
aagccauuggagagcugucuucc

SEQ ID NO: 35772 - RNA, 23 nt, Artificial Sequence
  RNA Oligomer
gaagccauuggagagcugucuuc

SEQ ID NO: 35773 - RNA, 23 nt, Artificial Sequence
  RNA Oligomer
ugaagccauuggagagcugucuu

SEQ ID NO: 35774 - RNA, 23 nt, Artificial Sequence
  RNA Oligomer
gggaguccucauugaauccucau

SEQ ID NO: 35775 - RNA, 23 nt, Artificial Sequence
  RNA Oligomer
ucggagaagcuggaaagugugaa

SEQ ID NO: 35776 - RNA, 23 nt, Artificial Sequence
  RNA Oligomer
gucggagaagcuggaaaguguga

SEQ ID NO: 35777 - RNA, 23 nt, Artificial Sequence
  RNA Oligomer
agucggagaagcuggaaagugug

SEQ ID NO: 35778 - RNA, 23 nt, Artificial Sequence
  RNA Oligomer
gagucggagaagcuggaaagugu

SEQ ID NO: 35779 - RNA, 23 nt, Artificial Sequence
  RNA Oligomer
ccauccagaacaagcaccucugc

SEQ ID NO: 35780 - RNA, 23 nt, Artificial Sequence
  RNA Oligomer
gccauccagaacaagcaccucug

SEQ ID NO: 35781 - RNA, 23 nt, Artificial Sequence
  RNA Oligomer
ugccauccagaacaagcaccucu

SEQ ID NO: 35782 - RNA, 23 nt, Artificial Sequence
  RNA Oligomer
uugccauccagaacaagcaccuc

SEQ ID NO: 35783 - RNA, 23 nt, Artificial Sequence
  RNA Oligomer
uuugccauccagaacaagcaccu

SEQ ID NO: 35784 - RNA, 23 nt, Artificial Sequence
  RNA Oligomer
gaugucaauagcauuguuuuugu

SEQ ID NO: 35785 - RNA, 23 nt, Artificial Sequence
  RNA Oligomer
agucaguggagagauguuuggaa

SEQ ID NO: 35786 - RNA, 23 nt, Artificial Sequence
  RNA Oligomer
cagucaguggagagauguuugga

SEQ ID NO: 35787 - RNA, 23 nt, Artificial Sequence
  RNA Oligomer
acagucaguggagagauguuugg

SEQ ID NO: 35788 - RNA, 23 nt, Artificial Sequence
  RNA Oligomer
cacagucaguggagagauguuug

SEQ ID NO: 35789 - RNA, 23 nt, Artificial Sequence
  RNA Oligomer
ccacagucaguggagagauguuu

SEQ ID NO: 35790 - RNA, 23 nt, Artificial Sequence
  RNA Oligomer
accacagucaguggagagauguu

SEQ ID NO: 35791 - RNA, 23 nt, Artificial Sequence
  RNA Oligomer
ggucaggaguugugucuaggcug

SEQ ID NO: 35792 - RNA, 23 nt, Artificial Sequence
  RNA Oligomer
aggucaggaguugugucuaggcu

SEQ ID NO: 35793 - RNA, 23 nt, Artificial Sequence
  RNA Oligomer
uaggucaggaguugugucuaggc

SEQ ID NO: 35794 - RNA, 23 nt, Artificial Sequence
  RNA Oligomer
uuaggucaggaguugugucuagg

SEQ ID NO: 35795 - RNA, 23 nt, Artificial Sequence
  RNA Oligomer
cuuaggucaggaguugugucuag

SEQ ID NO: 35796 - RNA, 23 nt, Artificial Sequence
  RNA Oligomer
agaaagcagaaaguucaacuucc

SEQ ID NO: 35797 - RNA, 23 nt, Artificial Sequence
  RNA Oligomer
aagaaagcagaaaguucaacuuc

SEQ ID NO: 35798 - RNA, 23 nt, Artificial Sequence
  RNA Oligomer
gaagaaagcagaaaguucaacuu

SEQ ID NO: 35799 - RNA, 23 nt, Artificial Sequence
  RNA Oligomer
ggaagaaagcagaaaguucaacu

SEQ ID NO: 35800 - RNA, 23 nt, Artificial Sequence
  RNA Oligomer
aggaagaaagcagaaaguucaac

SEQ ID NO: 35801 - RNA, 23 nt, Artificial Sequence
  RNA Oligomer
caggaagaaagcagaaaguucaa

SEQ ID NO: 35802 - RNA, 23 nt, Artificial Sequence
  RNA Oligomer
acaggaagaaagcagaaaguuca

SEQ ID NO: 35803 - RNA, 23 nt, Artificial Sequence
  RNA Oligomer
cacaggaagaaagcagaaaguuc

SEQ ID NO: 35804 - RNA, 23 nt, Artificial Sequence
  RNA Oligomer
ucacaggaagaaagcagaaaguu

SEQ ID NO: 35805 - RNA, 23 nt, Artificial Sequence
  RNA Oligomer
gucacaggaagaaagcagaaagu

SEQ ID NO: 35806 - RNA, 23 nt, Artificial Sequence
  RNA Oligomer
agaauucucccagcguuaacaca

SEQ ID NO: 35807 - RNA, 23 nt, Artificial Sequence
  RNA Oligomer
cagaauucucccagcguuaacac

SEQ ID NO: 35808 - RNA, 23 nt, Artificial Sequence
  RNA Oligomer
ggauuuugcuaaccugacgcccu

SEQ ID NO: 35809 - RNA, 23 nt, Artificial Sequence
  RNA Oligomer
aggauuuugcuaaccugacgccc

SEQ ID NO: 35810 - RNA, 23 nt, Artificial Sequence
  RNA Oligomer
gaggauuuugcuaaccugacgcc

SEQ ID NO: 35811 - RNA, 23 nt, Artificial Sequence
  RNA Oligomer
ugaggauuuugcuaaccugacgc

SEQ ID NO: 35812 - RNA, 23 nt, Artificial Sequence
  RNA Oligomer
uugaggauuuugcuaaccugacg

SEQ ID NO: 35813 - RNA, 23 nt, Artificial Sequence
  RNA Oligomer
agaucugguuucuaagaguuuug

SEQ ID NO: 35814 - RNA, 23 nt, Artificial Sequence
  RNA Oligomer
cagaucugguuucuaagaguuuu

SEQ ID NO: 35815 - RNA, 23 nt, Artificial Sequence
  RNA Oligomer
ucagaucugguuucuaagaguuu

SEQ ID NO: 35816 - RNA, 23 nt, Artificial Sequence
  RNA Oligomer
cucagaucugguuucuaagaguu

SEQ ID NO: 35817 - RNA, 23 nt, Artificial Sequence
  RNA Oligomer
ucucagaucugguuucuaagagu

SEQ ID NO: 35818 - RNA, 23 nt, Artificial Sequence
  RNA Oligomer
uauguccagaaauugugugugca

SEQ ID NO: 35819 - RNA, 23 nt, Artificial Sequence
  RNA Oligomer
acugguguuugaggauuuugcua

SEQ ID NO: 35820 - RNA, 23 nt, Artificial Sequence
  RNA Oligomer
agaacagcauuuagugaaguugu

SEQ ID NO: 35821 - RNA, 23 nt, Artificial Sequence
  RNA Oligomer
gagaacagcauuuagugaaguug

SEQ ID NO: 35822 - RNA, 23 nt, Artificial Sequence
  RNA Oligomer
ugagaacagcauuuagugaaguu

SEQ ID NO: 35823 - RNA, 23 nt, Artificial Sequence
  RNA Oligomer
gugagaacagcauuuagugaagu

SEQ ID NO: 35824 - RNA, 23 nt, Artificial Sequence
  RNA Oligomer
agugagaacagcauuuagugaag

SEQ ID NO: 35825 - RNA, 23 nt, Artificial Sequence
  RNA Oligomer
gagugagaacagcauuuagugaa

SEQ ID NO: 35826 - RNA, 23 nt, Artificial Sequence
  RNA Oligomer
ggauuuaggccuuaacacacugg

SEQ ID NO: 35827 - RNA, 23 nt, Artificial Sequence
  RNA Oligomer
aggauuuaggccuuaacacacug

SEQ ID NO: 35828 - RNA, 23 nt, Artificial Sequence
  RNA Oligomer
caggauuuaggccuuaacacacu

SEQ ID NO: 35829 - RNA, 23 nt, Artificial Sequence
  RNA Oligomer
ccaggauuuaggccuuaacacac

SEQ ID NO: 35830 - RNA, 23 nt, Artificial Sequence
  RNA Oligomer
uccaggauuuaggccuuaacaca

SEQ ID NO: 35831 - RNA, 23 nt, Artificial Sequence
  RNA Oligomer
ccagggcaagugcaucuuugccu

SEQ ID NO: 35832 - RNA, 23 nt, Artificial Sequence
  RNA Oligomer
accagggcaagugcaucuuugcc

SEQ ID NO: 35833 - RNA, 23 nt, Artificial Sequence
  RNA Oligomer
gaccagggcaagugcaucuuugc

SEQ ID NO: 35834 - RNA, 23 nt, Artificial Sequence
  RNA Oligomer
ggaccagggcaagugcaucuuug

SEQ ID NO: 35835 - RNA, 23 nt, Artificial Sequence
  RNA Oligomer
uggaccagggcaagugcaucuuu

SEQ ID NO: 35836 - RNA, 23 nt, Artificial Sequence
  RNA Oligomer
agagcugucuuccuguguaccuc

SEQ ID NO: 35837 - RNA, 23 nt, Artificial Sequence
  RNA Oligomer
gagagcugucuuccuguguaccu

SEQ ID NO: 35838 - RNA, 23 nt, Artificial Sequence
  RNA Oligomer
ggagagcugucuuccuguguacc

SEQ ID NO: 35839 - RNA, 23 nt, Artificial Sequence
  RNA Oligomer
uggagagcugucuuccuguguac

SEQ ID NO: 35840 - RNA, 23 nt, Artificial Sequence
  RNA Oligomer
uuggagagcugucuuccugugua

SEQ ID NO: 35841 - RNA, 23 nt, Artificial Sequence
  RNA Oligomer
gagcuaagcagucgugguauggg

SEQ ID NO: 35842 - RNA, 23 nt, Artificial Sequence
  RNA Oligomer
agagcuaagcagucgugguaugg

SEQ ID NO: 35843 - RNA, 23 nt, Artificial Sequence
  RNA Oligomer
cagagcuaagcagucgugguaug

SEQ ID NO: 35844 - RNA, 23 nt, Artificial Sequence
  RNA Oligomer
gcagagcuaagcagucgugguau

SEQ ID NO: 35845 - RNA, 23 nt, Artificial Sequence
  RNA Oligomer
ugcagagcuaagcagucguggua

SEQ ID NO: 35846 - RNA, 23 nt, Artificial Sequence
  RNA Oligomer
gaaaccucuuuauccaacagaua

SEQ ID NO: 35847 - RNA, 23 nt, Artificial Sequence
  RNA Oligomer
agaaaccucuuuauccaacagau

SEQ ID NO: 35848 - RNA, 23 nt, Artificial Sequence
  RNA Oligomer
gagaaaccucuuuauccaacaga

SEQ ID NO: 35849 - RNA, 23 nt, Artificial Sequence
  RNA Oligomer
agagaaaccucuuuauccaacag

SEQ ID NO: 35850 - RNA, 23 nt, Artificial Sequence
  RNA Oligomer
gagagaaaccucuuuauccaaca

SEQ ID NO: 35851 - RNA, 23 nt, Artificial Sequence
  RNA Oligomer
uccagaagaugagagaaaccucu

SEQ ID NO: 35852 - RNA, 23 nt, Artificial Sequence
  RNA Oligomer
cuccagaagaugagagaaaccuc

SEQ ID NO: 35853 - RNA, 23 nt, Artificial Sequence
  RNA Oligomer
acuccagaagaugagagaaaccu

SEQ ID NO: 35854 - RNA, 23 nt, Artificial Sequence
  RNA Oligomer
gacuccagaagaugagagaaacc

SEQ ID NO: 35855 - RNA, 23 nt, Artificial Sequence
  RNA Oligomer
ggacuccagaagaugagagaaac

SEQ ID NO: 35856 - RNA, 23 nt, Artificial Sequence
  RNA Oligomer
agaaggagaagacggagugccug

SEQ ID NO: 35857 - RNA, 23 nt, Artificial Sequence
  RNA Oligomer
aagaaggagaagacggagugccu

SEQ ID NO: 35858 - RNA, 23 nt, Artificial Sequence
  RNA Oligomer
gaagaaggagaagacggagugcc

SEQ ID NO: 35859 - RNA, 23 nt, Artificial Sequence
  RNA Oligomer
agaagaaggagaagacggagugc

SEQ ID NO: 35860 - RNA, 23 nt, Artificial Sequence
  RNA Oligomer
aagaagaaggagaagacggagug

SEQ ID NO: 35861 - RNA, 23 nt, Artificial Sequence
  RNA Oligomer
caagaagaaggagaagacggagu

SEQ ID NO: 35862 - RNA, 23 nt, Artificial Sequence
  RNA Oligomer
cugauguuucugugaaauucuca

SEQ ID NO: 35863 - RNA, 23 nt, Artificial Sequence
  RNA Oligomer
ucugauguuucugugaaauucuc

SEQ ID NO: 35864 - RNA, 23 nt, Artificial Sequence
  RNA Oligomer
uucugauguuucugugaaauucu

SEQ ID NO: 35865 - RNA, 23 nt, Artificial Sequence
  RNA Oligomer
auucugauguuucugugaaauuc

SEQ ID NO: 35866 - RNA, 23 nt, Artificial Sequence
  RNA Oligomer
aauucugauguuucugugaaauu

SEQ ID NO: 35867 - RNA, 23 nt, Artificial Sequence
  RNA Oligomer
aaauucugauguuucugugaaau

SEQ ID NO: 35868 - RNA, 23 nt, Artificial Sequence
  RNA Oligomer
aaaauucugauguuucugugaaa

SEQ ID NO: 35869 - RNA, 23 nt, Artificial Sequence
  RNA Oligomer
aaggacgcuggcuacugucuauu

SEQ ID NO: 35870 - RNA, 23 nt, Artificial Sequence
  RNA Oligomer
agcuguuuuaagaaaucuggccc

SEQ ID NO: 35871 - RNA, 23 nt, Artificial Sequence
  RNA Oligomer
uagcuguuuuaagaaaucuggcc

SEQ ID NO: 35872 - RNA, 23 nt, Artificial Sequence
  RNA Oligomer
caauagcauuguuuuugucaugu

SEQ ID NO: 35873 - RNA, 23 nt, Artificial Sequence
  RNA Oligomer
ucaauagcauuguuuuugucaug

SEQ ID NO: 35874 - RNA, 23 nt, Artificial Sequence
  RNA Oligomer
gucaauagcauuguuuuugucau

SEQ ID NO: 35875 - RNA, 23 nt, Artificial Sequence
  RNA Oligomer
ugucaauagcauuguuuuuguca

SEQ ID NO: 35876 - RNA, 23 nt, Artificial Sequence
  RNA Oligomer
augucaauagcauuguuuuuguc

SEQ ID NO: 35877 - RNA, 23 nt, Artificial Sequence
  RNA Oligomer
gagagauguuuggaaaccacagu

SEQ ID NO: 35878 - RNA, 23 nt, Artificial Sequence
  RNA Oligomer
caggaguugugucuaggcuggaa

SEQ ID NO: 35879 - RNA, 23 nt, Artificial Sequence
  RNA Oligomer
ucaggaguugugucuaggcugga

SEQ ID NO: 35880 - RNA, 23 nt, Artificial Sequence
  RNA Oligomer
gucaggaguugugucuaggcugg

SEQ ID NO: 35881 - RNA, 23 nt, Artificial Sequence
  RNA Oligomer
ucaccacgugcaguaucucaaga

SEQ ID NO: 35882 - RNA, 23 nt, Artificial Sequence
  RNA Oligomer
gucaccacgugcaguaucucaag

SEQ ID NO: 35883 - RNA, 23 nt, Artificial Sequence
  RNA Oligomer
ugucaccacgugcaguaucucaa

SEQ ID NO: 35884 - RNA, 23 nt, Artificial Sequence
  RNA Oligomer
uucucagaucugguuucuaagag

SEQ ID NO: 35885 - RNA, 23 nt, Artificial Sequence
  RNA Oligomer
aacuaggcaauguacucuuccga

SEQ ID NO: 35886 - RNA, 23 nt, Artificial Sequence
  RNA Oligomer
aaacuaggcaauguacucuuccg

SEQ ID NO: 35887 - RNA, 23 nt, Artificial Sequence
  RNA Oligomer
aaaacuaggcaauguacucuucc

SEQ ID NO: 35888 - RNA, 23 nt, Artificial Sequence
  RNA Oligomer
gaaaacuaggcaauguacucuuc

SEQ ID NO: 35889 - RNA, 23 nt, Artificial Sequence
  RNA Oligomer
agaaaacuaggcaauguacucuu

SEQ ID NO: 35890 - RNA, 23 nt, Artificial Sequence
  RNA Oligomer
uuauguccagaaauugugugugc

SEQ ID NO: 35891 - RNA, 23 nt, Artificial Sequence
  RNA Oligomer
gauguggagugagaacagcauuu

SEQ ID NO: 35892 - RNA, 23 nt, Artificial Sequence
  RNA Oligomer
cuacaaaaaaccaggaugcccac

SEQ ID NO: 35893 - RNA, 23 nt, Artificial Sequence
  RNA Oligomer
ucuacaaaaaaccaggaugccca

SEQ ID NO: 35894 - RNA, 23 nt, Artificial Sequence
  RNA Oligomer
uucuacaaaaaaccaggaugccc

SEQ ID NO: 35895 - RNA, 23 nt, Artificial Sequence
  RNA Oligomer
auucuacaaaaaaccaggaugcc

SEQ ID NO: 35896 - RNA, 23 nt, Artificial Sequence
  RNA Oligomer
gauucuacaaaaaaccaggaugc

SEQ ID NO: 35897 - RNA, 23 nt, Artificial Sequence
  RNA Oligomer
ggauucuacaaaaaaccaggaug

SEQ ID NO: 35898 - RNA, 23 nt, Artificial Sequence
  RNA Oligomer
uggauucuacaaaaaaccaggau

SEQ ID NO: 35899 - RNA, 23 nt, Artificial Sequence
  RNA Oligomer
ucuggauucuacaaaaaaccagg

SEQ ID NO: 35900 - RNA, 23 nt, Artificial Sequence
  RNA Oligomer
aucuggauucuacaaaaaaccag

SEQ ID NO: 35901 - RNA, 23 nt, Artificial Sequence
  RNA Oligomer
cagaagaugagagaaaccucuuu

SEQ ID NO: 35902 - RNA, 23 nt, Artificial Sequence
  RNA Oligomer
ccagaagaugagagaaaccucuu

SEQ ID NO: 35903 - RNA, 23 nt, Artificial Sequence
  RNA Oligomer
gcucaagaacgagaagcagcauu

SEQ ID NO: 35904 - RNA, 23 nt, Artificial Sequence
  RNA Oligomer
agcucaagaacgagaagcagcau

SEQ ID NO: 35905 - RNA, 23 nt, Artificial Sequence
  RNA Oligomer
gagcucaagaacgagaagcagca

SEQ ID NO: 35906 - RNA, 23 nt, Artificial Sequence
  RNA Oligomer
agagucggagaagcuggaaagug

SEQ ID NO: 35907 - RNA, 23 nt, Artificial Sequence
  RNA Oligomer
aagagucggagaagcuggaaagu

SEQ ID NO: 35908 - RNA, 23 nt, Artificial Sequence
  RNA Oligomer
aaagagucggagaagcuggaaag

SEQ ID NO: 35909 - RNA, 23 nt, Artificial Sequence
  RNA Oligomer
gaaagagucggagaagcuggaaa

SEQ ID NO: 35910 - RNA, 23 nt, Artificial Sequence
  RNA Oligomer
ucacucacacuggccacaaggac

SEQ ID NO: 35911 - RNA, 23 nt, Artificial Sequence
  RNA Oligomer
gucacucacacuggccacaagga

SEQ ID NO: 35912 - RNA, 23 nt, Artificial Sequence
  RNA Oligomer
agucacucacacuggccacaagg

SEQ ID NO: 35913 - RNA, 23 nt, Artificial Sequence
  RNA Oligomer
aagucacucacacuggccacaag

SEQ ID NO: 35914 - RNA, 23 nt, Artificial Sequence
  RNA Oligomer
gaagucacucacacuggccacaa

SEQ ID NO: 35915 - RNA, 23 nt, Artificial Sequence
  RNA Oligomer
gucauguagcuguuuuaagaaau

SEQ ID NO: 35916 - RNA, 23 nt, Artificial Sequence
  RNA Oligomer
ugucauguagcuguuuuaagaaa

SEQ ID NO: 35917 - RNA, 23 nt, Artificial Sequence
  RNA Oligomer
uugucauguagcuguuuuaagaa

SEQ ID NO: 35918 - RNA, 23 nt, Artificial Sequence
  RNA Oligomer
uuugucauguagcuguuuuaaga

SEQ ID NO: 35919 - RNA, 23 nt, Artificial Sequence
  RNA Oligomer
uuauuggaugucaauagcauugu

SEQ ID NO: 35920 - RNA, 23 nt, Artificial Sequence
  RNA Oligomer
cccaggcuuuagcauuauuggau

SEQ ID NO: 35921 - RNA, 23 nt, Artificial Sequence
  RNA Oligomer
acccaggcuuuagcauuauugga

SEQ ID NO: 35922 - RNA, 23 nt, Artificial Sequence
  RNA Oligomer
uacccaggcuuuagcauuauugg

SEQ ID NO: 35923 - RNA, 23 nt, Artificial Sequence
  RNA Oligomer
guacccaggcuuuagcauuauug

SEQ ID NO: 35924 - RNA, 23 nt, Artificial Sequence
  RNA Oligomer
gguacccaggcuuuagcauuauu

SEQ ID NO: 35925 - RNA, 23 nt, Artificial Sequence
  RNA Oligomer
caaggaagagcugagguuugcca

SEQ ID NO: 35926 - RNA, 23 nt, Artificial Sequence
  RNA Oligomer
uccuuuccuugugguugaaaacc

SEQ ID NO: 35927 - RNA, 23 nt, Artificial Sequence
  RNA Oligomer
uuccuuuccuugugguugaaaac

SEQ ID NO: 35928 - RNA, 23 nt, Artificial Sequence
  RNA Oligomer
uuuccuuuccuugugguugaaaa

SEQ ID NO: 35929 - RNA, 23 nt, Artificial Sequence
  RNA Oligomer
uuuuccuuuccuugugguugaaa

SEQ ID NO: 35930 - RNA, 23 nt, Artificial Sequence
  RNA Oligomer
auuuuccuuuccuugugguugaa

SEQ ID NO: 35931 - RNA, 23 nt, Artificial Sequence
  RNA Oligomer
aguugugucuaggcuggaagagc

SEQ ID NO: 35932 - RNA, 23 nt, Artificial Sequence
  RNA Oligomer
gaguugugucuaggcuggaagag

SEQ ID NO: 35933 - RNA, 23 nt, Artificial Sequence
  RNA Oligomer
ggaguugugucuaggcuggaaga

SEQ ID NO: 35934 - RNA, 23 nt, Artificial Sequence
  RNA Oligomer
aggaguugugucuaggcuggaag

SEQ ID NO: 35935 - RNA, 23 nt, Artificial Sequence
  RNA Oligomer
ccacucaaugucuuaggucagga

SEQ ID NO: 35936 - RNA, 23 nt, Artificial Sequence
  RNA Oligomer
uccacucaaugucuuaggucagg

SEQ ID NO: 35937 - RNA, 23 nt, Artificial Sequence
  RNA Oligomer
cuccacucaaugucuuaggucag

SEQ ID NO: 35938 - RNA, 23 nt, Artificial Sequence
  RNA Oligomer
ucuccacucaaugucuuagguca

SEQ ID NO: 35939 - RNA, 23 nt, Artificial Sequence
  RNA Oligomer
cucuccacucaaugucuuagguc

SEQ ID NO: 35940 - RNA, 23 nt, Artificial Sequence
  RNA Oligomer
agucacaggaagaaagcagaaag

SEQ ID NO: 35941 - RNA, 23 nt, Artificial Sequence
  RNA Oligomer
cucaaugucuuaggucaggaguu

SEQ ID NO: 35942 - RNA, 23 nt, Artificial Sequence
  RNA Oligomer
ccagaagagcuugucagcaagag

SEQ ID NO: 35943 - RNA, 23 nt, Artificial Sequence
  RNA Oligomer
gaauauuccauuuuccuuuccuu

SEQ ID NO: 35944 - RNA, 23 nt, Artificial Sequence
  RNA Oligomer
ucauugaauccucauuuuauacc

SEQ ID NO: 35945 - RNA, 23 nt, Artificial Sequence
  RNA Oligomer
gcuuuagcauuauuggaugucaa

SEQ ID NO: 35946 - RNA, 23 nt, Artificial Sequence
  RNA Oligomer
agaauauuccauuuuccuuuccu

SEQ ID NO: 35947 - RNA, 23 nt, Artificial Sequence
  RNA Oligomer
ggguugugcuuucuagcaaauau

SEQ ID NO: 35948 - RNA, 23 nt, Artificial Sequence
  RNA Oligomer
guguuuaauuguacucaauggua

SEQ ID NO: 35949 - RNA, 23 nt, Artificial Sequence
  RNA Oligomer
cacucaaugucuuaggucaggag

SEQ ID NO: 35950 - RNA, 23 nt, Artificial Sequence
  RNA Oligomer
cugaugugacuuuuauaugcuuu

SEQ ID NO: 35951 - RNA, 23 nt, Artificial Sequence
  RNA Oligomer
agaagagcuugucagcaagagga

SEQ ID NO: 35952 - RNA, 23 nt, Artificial Sequence
  RNA Oligomer
uccuguguaccucuagaauccca

SEQ ID NO: 35953 - RNA, 23 nt, Artificial Sequence
  RNA Oligomer
uguuuuugucauguagcuguuuu

SEQ ID NO: 35954 - RNA, 23 nt, Artificial Sequence
  RNA Oligomer
acugaugugacuuuuauaugcuu

SEQ ID NO: 35955 - RNA, 23 nt, Artificial Sequence
  RNA Oligomer
gggauguggagugagaacagcau

SEQ ID NO: 35956 - RNA, 23 nt, Artificial Sequence
  RNA Oligomer
agaaugggaggacuccagaagau

SEQ ID NO: 35957 - RNA, 23 nt, Artificial Sequence
  RNA Oligomer
guguuugcagcugugagaaguca

SEQ ID NO: 35958 - RNA, 23 nt, Artificial Sequence
  RNA Oligomer
aggguuaggacucuccacucaau

SEQ ID NO: 35959 - RNA, 23 nt, Artificial Sequence
  RNA Oligomer
gugacuuuuauaugcuuuuucuc

SEQ ID NO: 35960 - RNA, 23 nt, Artificial Sequence
  RNA Oligomer
gauauacaugcucaaccuucauc

SEQ ID NO: 35961 - RNA, 23 nt, Artificial Sequence
  RNA Oligomer
gcuacugucuauuaaaauucuga

SEQ ID NO: 35962 - RNA, 23 nt, Artificial Sequence
  RNA Oligomer
gcuguuuuaagaaaucuggccca

SEQ ID NO: 35963 - RNA, 23 nt, Artificial Sequence
  RNA Oligomer
uuguuuuugucauguagcuguuu

SEQ ID NO: 35964 - RNA, 23 nt, Artificial Sequence
  RNA Oligomer
ugcuuuuucucagaucugguuuc

SEQ ID NO: 35965 - RNA, 23 nt, Artificial Sequence
  RNA Oligomer
guguuugaggauuuugcuaaccu

SEQ ID NO: 35966 - RNA, 23 nt, Artificial Sequence
  RNA Oligomer
cugguguuugaggauuuugcuaa

SEQ ID NO: 35967 - RNA, 23 nt, Artificial Sequence
  RNA Oligomer
gguuaggacucuccacucaaugu

SEQ ID NO: 35968 - RNA, 23 nt, Artificial Sequence
  RNA Oligomer
aaagucacaggaagaaagcagaa

SEQ ID NO: 35969 - RNA, 23 nt, Artificial Sequence
  RNA Oligomer
uuauaugcuuuuucucagaucug

SEQ ID NO: 35970 - RNA, 23 nt, Artificial Sequence
  RNA Oligomer
ggauguggagugagaacagcauu

SEQ ID NO: 35971 - RNA, 23 nt, Artificial Sequence
  RNA Oligomer
gaagaugagagaaaccucuuuau

SEQ ID NO: 35972 - RNA, 23 nt, Artificial Sequence
  RNA Oligomer
ggguguuugcagcugugagaagu

SEQ ID NO: 35973 - RNA, 23 nt, Artificial Sequence
  RNA Oligomer
guuuuugucauguagcuguuuua

SEQ ID NO: 35974 - RNA, 23 nt, Artificial Sequence
  RNA Oligomer
ggguuaggacucuccacucaaug

SEQ ID NO: 35975 - RNA, 23 nt, Artificial Sequence
  RNA Oligomer
cguuaacacaaaauccaugggca

SEQ ID NO: 35976 - RNA, 23 nt, Artificial Sequence
  RNA Oligomer
gccagaagagcuugucagcaaga

SEQ ID NO: 35977 - RNA, 23 nt, Artificial Sequence
  RNA Oligomer
gguguuugaggauuuugcuaacc

SEQ ID NO: 35978 - RNA, 23 nt, Artificial Sequence
  RNA Oligomer
guauuccuaaccugucagaauaa

SEQ ID NO: 35979 - RNA, 23 nt, Artificial Sequence
  RNA Oligomer
gcauuauuggaugucaauagcau

SEQ ID NO: 35980 - RNA, 23 nt, Artificial Sequence
  RNA Oligomer
uucucccagcguuaacacaaaau

SEQ ID NO: 35981 - RNA, 23 nt, Artificial Sequence
  RNA Oligomer
auaugcuguuauguccagaaauu

SEQ ID NO: 35982 - RNA, 23 nt, Artificial Sequence
  RNA Oligomer
ccuaaccugucagaauaauaaau

SEQ ID NO: 35983 - RNA, 23 nt, Artificial Sequence
  RNA Oligomer
cugggucacugguguuugaggau

SEQ ID NO: 35984 - RNA, 23 nt, Artificial Sequence
  RNA Oligomer
cuuucuagcaaauaugcuguuau

SEQ ID NO: 35985 - RNA, 23 nt, Artificial Sequence
  RNA Oligomer
caggguugugcuuucuagcaaau

SEQ ID NO: 35986 - RNA, 23 nt, Artificial Sequence
  RNA Oligomer
aggguugugcuuucuagcaaaua

SEQ ID NO: 35987 - RNA, 23 nt, Artificial Sequence
  RNA Oligomer
ccaggguugugcuuucuagcaaa

SEQ ID NO: 35988 - RNA, 23 nt, Artificial Sequence
  RNA Oligomer
gaaaaccacagucaguggagaga

SEQ ID NO: 35989 - RNA, 23 nt, Artificial Sequence
  RNA Oligomer
gcaaacucaguuccaaagucaca

SEQ ID NO: 35990 - RNA, 23 nt, Artificial Sequence
  RNA Oligomer
ucccagcguuaacacaaaaucca

SEQ ID NO: 35991 - RNA, 23 nt, Artificial Sequence
  RNA Oligomer
cucuuuauccaacagauaaaaga

SEQ ID NO: 35992 - RNA, 23 nt, Artificial Sequence
  RNA Oligomer
cuaguauuccuaaccugucagaa

SEQ ID NO: 35993 - RNA, 23 nt, Artificial Sequence
  RNA Oligomer
caacacugaugugacuuuuauau

SEQ ID NO: 35994 - RNA, 23 nt, Artificial Sequence
  RNA Oligomer
gcaauguacucuuccgauguuug

SEQ ID NO: 35995 - RNA, 23 nt, Artificial Sequence
  RNA Oligomer
uccuaaccugucagaauaauaaa

SEQ ID NO: 35996 - RNA, 23 nt, Artificial Sequence
  RNA Oligomer
uuccuaaccugucagaauaauaa

SEQ ID NO: 35997 - RNA, 23 nt, Artificial Sequence
  RNA Oligomer
guacucaaugguaucauuacaau

SEQ ID NO: 35998 - RNA, 23 nt, Artificial Sequence
  RNA Oligomer
ccaaagaauauuccauuuuccuu

SEQ ID NO: 35999 - RNA, 23 nt, Artificial Sequence
  RNA Oligomer
ccuaguauuccuaaccugucaga

SEQ ID NO: 36000 - RNA, 23 nt, Artificial Sequence
  RNA Oligomer
agauauucagguggccagaagag

SEQ ID NO: 36001 - RNA, 23 nt, Artificial Sequence
  RNA Oligomer
gcuuucuagcaaauaugcuguua

SEQ ID NO: 36002 - RNA, 23 nt, Artificial Sequence
  RNA Oligomer
ugcuuucuagcaaauaugcuguu

SEQ ID NO: 36003 - RNA, 23 nt, Artificial Sequence
  RNA Oligomer
gcaagugcaucuuugccucaacu

SEQ ID NO: 36004 - RNA, 23 nt, Artificial Sequence
  RNA Oligomer
ccucuuuauccaacagauaaaag

SEQ ID NO: 36005 - RNA, 23 nt, Artificial Sequence
  RNA Oligomer
cucagaaugggaggacuccagaa

SEQ ID NO: 36006 - RNA, 23 nt, Artificial Sequence
  RNA Oligomer
cguguauuguccgggcucagaau

SEQ ID NO: 36007 - RNA, 23 nt, Artificial Sequence
  RNA Oligomer
uaguauuccuaaccugucagaau

SEQ ID NO: 36008 - RNA, 23 nt, Artificial Sequence
  RNA Oligomer
uggccagaagagcuugucagcaa

SEQ ID NO: 36009 - RNA, 23 nt, Artificial Sequence
  RNA Oligomer
caauguacucuuccgauguuugu

SEQ ID NO: 36010 - RNA, 23 nt, Artificial Sequence
  RNA Oligomer
ggcaauguacucuuccgauguuu

SEQ ID NO: 36011 - RNA, 23 nt, Artificial Sequence
  RNA Oligomer
caaauaugcuguuauguccagaa

SEQ ID NO: 36012 - RNA, 23 nt, Artificial Sequence
  RNA Oligomer
aacggccaggguugugcuuucua

SEQ ID NO: 36013 - RNA, 23 nt, Artificial Sequence
  RNA Oligomer
caaaaugaugcuucaacacccag

SEQ ID NO: 36014 - RNA, 23 nt, Artificial Sequence
  RNA Oligomer
gcagaaaguucaacuuccaaagg

SEQ ID NO: 36015 - RNA, 23 nt, Artificial Sequence
  RNA Oligomer
ugugugcaagaaaacuaggcaau

SEQ ID NO: 36016 - RNA, 23 nt, Artificial Sequence
  RNA Oligomer
ucaccguggcuaccauugucacu

SEQ ID NO: 36017 - RNA, 23 nt, Artificial Sequence
  RNA Oligomer
aaaccucuuuauccaacagauaa

SEQ ID NO: 36018 - RNA, 23 nt, Artificial Sequence
  RNA Oligomer
cagcauuugauauacaugcucaa

SEQ ID NO: 36019 - RNA, 23 nt, Artificial Sequence
  RNA Oligomer
agaagacggagugccugcagaaa

SEQ ID NO: 36020 - RNA, 23 nt, Artificial Sequence
  RNA Oligomer
ugguacccaggcuuuagcauuau

SEQ ID NO: 36021 - RNA, 23 nt, Artificial Sequence
  RNA Oligomer
aagcagaaaguucaacuuccaaa

SEQ ID NO: 36022 - RNA, 23 nt, Artificial Sequence
  RNA Oligomer
aaagcagaaaguucaacuuccaa

SEQ ID NO: 36023 - RNA, 23 nt, Artificial Sequence
  RNA Oligomer
caguuccaaagucacaggaagaa

SEQ ID NO: 36024 - RNA, 23 nt, Artificial Sequence
  RNA Oligomer
ccucuguugcaaacucaguucca

SEQ ID NO: 36025 - RNA, 23 nt, Artificial Sequence
  RNA Oligomer
gcaguaucucaagauauucaggu

SEQ ID NO: 36026 - RNA, 23 nt, Artificial Sequence
  RNA Oligomer
acaacacugaugugacuuuuaua

SEQ ID NO: 36027 - RNA, 23 nt, Artificial Sequence
  RNA Oligomer
acacaacacugaugugacuuuua

SEQ ID NO: 36028 - RNA, 23 nt, Artificial Sequence
  RNA Oligomer
gccaggguugugcuuucuagcaa

SEQ ID NO: 36029 - RNA, 23 nt, Artificial Sequence
  RNA Oligomer
ggauucaggcagcagugucugua

SEQ ID NO: 36030 - RNA, 23 nt, Artificial Sequence
  RNA Oligomer
accucuuuauccaacagauaaaa

SEQ ID NO: 36031 - RNA, 23 nt, Artificial Sequence
  RNA Oligomer
gagcugagguuugccauccagaa

SEQ ID NO: 36032 - RNA, 23 nt, Artificial Sequence
  RNA Oligomer
aggcuuuagcauuauuggauguc

SEQ ID NO: 36033 - RNA, 23 nt, Artificial Sequence
  RNA Oligomer
caggcuuuagcauuauuggaugu

SEQ ID NO: 36034 - RNA, 23 nt, Artificial Sequence
  RNA Oligomer
uaggcuggaagagccaaagaaua

SEQ ID NO: 36035 - RNA, 23 nt, Artificial Sequence
  RNA Oligomer
gaauucucccagcguuaacacaa

SEQ ID NO: 36036 - RNA, 23 nt, Artificial Sequence
  RNA Oligomer
ucaagauauucagguggccagaa

SEQ ID NO: 36037 - RNA, 23 nt, Artificial Sequence
  RNA Oligomer
cacaacacugaugugacuuuuau

SEQ ID NO: 36038 - RNA, 23 nt, Artificial Sequence
  RNA Oligomer
cgauguuugugucacacaacacu

SEQ ID NO: 36039 - RNA, 23 nt, Artificial Sequence
  RNA Oligomer
guacucuuccgauguuuguguca

SEQ ID NO: 36040 - RNA, 23 nt, Artificial Sequence
  RNA Oligomer
aaauaugcuguuauguccagaaa

SEQ ID NO: 36041 - RNA, 23 nt, Artificial Sequence
  RNA Oligomer
auccuaguauuccuaaccuguca

SEQ ID NO: 36042 - RNA, 23 nt, Artificial Sequence
  RNA Oligomer
uauccuaguauuccuaaccuguc

SEQ ID NO: 36043 - RNA, 23 nt, Artificial Sequence
  RNA Oligomer
uuauccuaguauuccuaaccugu

SEQ ID NO: 36044 - RNA, 23 nt, Artificial Sequence
  RNA Oligomer
uuuauccuaguauuccuaaccug

SEQ ID NO: 36045 - RNA, 23 nt, Artificial Sequence
  RNA Oligomer
auuuauccuaguauuccuaaccu

SEQ ID NO: 36046 - RNA, 23 nt, Artificial Sequence
  RNA Oligomer
aaucuuauuucuuucucgucgcc

SEQ ID NO: 36047 - RNA, 23 nt, Artificial Sequence
  RNA Oligomer
aucuuauuucuuucucgucgccu

SEQ ID NO: 36048 - RNA, 23 nt, Artificial Sequence
  RNA Oligomer
ucuuauuucuuucucgucgccuc

SEQ ID NO: 36049 - RNA, 23 nt, Artificial Sequence
  RNA Oligomer
cuuauuucuuucucgucgccucu

SEQ ID NO: 36050 - RNA, 23 nt, Artificial Sequence
  RNA Oligomer
uuauuucuuucucgucgccucuu

SEQ ID NO: 36051 - RNA, 23 nt, Artificial Sequence
  RNA Oligomer
ucuuuuuccuuucaucuucuuca

SEQ ID NO: 36052 - RNA, 23 nt, Artificial Sequence
  RNA Oligomer
cuuuuuccuuucaucuucuucag

SEQ ID NO: 36053 - RNA, 23 nt, Artificial Sequence
  RNA Oligomer
uuuuuccuuucaucuucuucagg

SEQ ID NO: 36054 - RNA, 23 nt, Artificial Sequence
  RNA Oligomer
uuuuccuuucaucuucuucaggg

SEQ ID NO: 36055 - RNA, 23 nt, Artificial Sequence
  RNA Oligomer
uuuccuuucaucuucuucagggg

SEQ ID NO: 36056 - RNA, 23 nt, Artificial Sequence
  RNA Oligomer
aggguuuuggguauaaaaugagg

SEQ ID NO: 36057 - RNA, 23 nt, Artificial Sequence
  RNA Oligomer
ggguuuuggguauaaaaugagga

SEQ ID NO: 36058 - RNA, 23 nt, Artificial Sequence
  RNA Oligomer
gguuuuggguauaaaaugaggau

SEQ ID NO: 36059 - RNA, 23 nt, Artificial Sequence
  RNA Oligomer
guuuuggguauaaaaugaggauu

SEQ ID NO: 36060 - RNA, 23 nt, Artificial Sequence
  RNA Oligomer
uuuuggguauaaaaugaggauuc

SEQ ID NO: 36061 - RNA, 23 nt, Artificial Sequence
  RNA Oligomer
gcaaucuuauuucuuucucgucg

SEQ ID NO: 36062 - RNA, 23 nt, Artificial Sequence
  RNA Oligomer
caaucuuauuucuuucucgucgc

SEQ ID NO: 36063 - RNA, 23 nt, Artificial Sequence
  RNA Oligomer
gcugcaaucuuauuucuuucucg

SEQ ID NO: 36064 - RNA, 23 nt, Artificial Sequence
  RNA Oligomer
cugcaaucuuauuucuuucucgu

SEQ ID NO: 36065 - RNA, 23 nt, Artificial Sequence
  RNA Oligomer
ugcaaucuuauuucuuucucguc

SEQ ID NO: 36066 - RNA, 23 nt, Artificial Sequence
  RNA Oligomer
cucuuuuuccuuucaucuucuuc

SEQ ID NO: 36067 - RNA, 23 nt, Artificial Sequence
  RNA Oligomer
uuccuuucaucuucuucaggggc

SEQ ID NO: 36068 - RNA, 23 nt, Artificial Sequence
  RNA Oligomer
uuuggguauaaaaugaggauuca

SEQ ID NO: 36069 - RNA, 23 nt, Artificial Sequence
  RNA Oligomer
cgccucuuuuuccuuucaucuuc

SEQ ID NO: 36070 - RNA, 23 nt, Artificial Sequence
  RNA Oligomer
gccucuuuuuccuuucaucuucu

SEQ ID NO: 36071 - RNA, 23 nt, Artificial Sequence
  RNA Oligomer
ccucuuuuuccuuucaucuucuu

SEQ ID NO: 36072 - RNA, 23 nt, Artificial Sequence
  RNA Oligomer
cuccaauggcuucaggguuuugg

SEQ ID NO: 36073 - RNA, 23 nt, Artificial Sequence
  RNA Oligomer
uccaauggcuucaggguuuuggg

SEQ ID NO: 36074 - RNA, 23 nt, Artificial Sequence
  RNA Oligomer
ccaauggcuucaggguuuugggu

SEQ ID NO: 36075 - RNA, 23 nt, Artificial Sequence
  RNA Oligomer
caauggcuucaggguuuugggua

SEQ ID NO: 36076 - RNA, 23 nt, Artificial Sequence
  RNA Oligomer
aauggcuucaggguuuuggguau

SEQ ID NO: 36077 - RNA, 23 nt, Artificial Sequence
  RNA Oligomer
guauaaaaugaggauucaaugag

SEQ ID NO: 36078 - RNA, 23 nt, Artificial Sequence
  RNA Oligomer
uauaaaaugaggauucaaugagg

SEQ ID NO: 36079 - RNA, 23 nt, Artificial Sequence
  RNA Oligomer
auaaaaugaggauucaaugagga

SEQ ID NO: 36080 - RNA, 23 nt, Artificial Sequence
  RNA Oligomer
uaaaaugaggauucaaugaggac

SEQ ID NO: 36081 - RNA, 23 nt, Artificial Sequence
  RNA Oligomer
aaaaugaggauucaaugaggacu

SEQ ID NO: 36082 - RNA, 23 nt, Artificial Sequence
  RNA Oligomer
aaaugaggauucaaugaggacuc

SEQ ID NO: 36083 - RNA, 23 nt, Artificial Sequence
  RNA Oligomer
cagcuacaugacaaaaacaaugc

SEQ ID NO: 36084 - RNA, 23 nt, Artificial Sequence
  RNA Oligomer
agcuacaugacaaaaacaaugcu

SEQ ID NO: 36085 - RNA, 23 nt, Artificial Sequence
  RNA Oligomer
gcuacaugacaaaaacaaugcua

SEQ ID NO: 36086 - RNA, 23 nt, Artificial Sequence
  RNA Oligomer
cuacaugacaaaaacaaugcuau

SEQ ID NO: 36087 - RNA, 23 nt, Artificial Sequence
  RNA Oligomer
uacaugacaaaaacaaugcuauu

SEQ ID NO: 36088 - RNA, 23 nt, Artificial Sequence
  RNA Oligomer
uuggguauaaaaugaggauucaa

SEQ ID NO: 36089 - RNA, 23 nt, Artificial Sequence
  RNA Oligomer
ucaguucagcauucacacuuucc

SEQ ID NO: 36090 - RNA, 23 nt, Artificial Sequence
  RNA Oligomer
caguucagcauucacacuuucca

SEQ ID NO: 36091 - RNA, 23 nt, Artificial Sequence
  RNA Oligomer
aguucagcauucacacuuuccag

SEQ ID NO: 36092 - RNA, 23 nt, Artificial Sequence
  RNA Oligomer
guucagcauucacacuuuccagc

SEQ ID NO: 36093 - RNA, 23 nt, Artificial Sequence
  RNA Oligomer
uucagcauucacacuuuccagcu

SEQ ID NO: 36094 - RNA, 23 nt, Artificial Sequence
  RNA Oligomer
cgucuucuccuucuucuuguuuc

SEQ ID NO: 36095 - RNA, 23 nt, Artificial Sequence
  RNA Oligomer
gucuucuccuucuucuuguuucg

SEQ ID NO: 36096 - RNA, 23 nt, Artificial Sequence
  RNA Oligomer
ucuucuccuucuucuuguuucgg

SEQ ID NO: 36097 - RNA, 23 nt, Artificial Sequence
  RNA Oligomer
cuucuccuucuucuuguuucggc

SEQ ID NO: 36098 - RNA, 23 nt, Artificial Sequence
  RNA Oligomer
uucuccuucuucuuguuucggca

SEQ ID NO: 36099 - RNA, 23 nt, Artificial Sequence
  RNA Oligomer
ucuccuucuucuuguuucggcac

SEQ ID NO: 36100 - RNA, 23 nt, Artificial Sequence
  RNA Oligomer
cuccuucuucuuguuucggcacu

SEQ ID NO: 36101 - RNA, 23 nt, Artificial Sequence
  RNA Oligomer
uccuucuucuuguuucggcacuu

SEQ ID NO: 36102 - RNA, 23 nt, Artificial Sequence
  RNA Oligomer
uauuucuuucucgucgccucuuu

SEQ ID NO: 36103 - RNA, 23 nt, Artificial Sequence
  RNA Oligomer
auuucuuucucgucgccucuuuu

SEQ ID NO: 36104 - RNA, 23 nt, Artificial Sequence
  RNA Oligomer
caaaaacaaugcuauugacaucc

SEQ ID NO: 36105 - RNA, 23 nt, Artificial Sequence
  RNA Oligomer
aaaaacaaugcuauugacaucca

SEQ ID NO: 36106 - RNA, 23 nt, Artificial Sequence
  RNA Oligomer
aaaacaaugcuauugacauccaa

SEQ ID NO: 36107 - RNA, 23 nt, Artificial Sequence
  RNA Oligomer
aaacaaugcuauugacauccaau

SEQ ID NO: 36108 - RNA, 23 nt, Artificial Sequence
  RNA Oligomer
aacaaugcuauugacauccaaua

SEQ ID NO: 36109 - RNA, 23 nt, Artificial Sequence
  RNA Oligomer
ggagaauucuguccuccucuugc

SEQ ID NO: 36110 - RNA, 23 nt, Artificial Sequence
  RNA Oligomer
gagaauucuguccuccucuugcu

SEQ ID NO: 36111 - RNA, 23 nt, Artificial Sequence
  RNA Oligomer
agaauucuguccuccucuugcug

SEQ ID NO: 36112 - RNA, 23 nt, Artificial Sequence
  RNA Oligomer
gaauucuguccuccucuugcuga

SEQ ID NO: 36113 - RNA, 23 nt, Artificial Sequence
  RNA Oligomer
aauucuguccuccucuugcugac

SEQ ID NO: 36114 - RNA, 23 nt, Artificial Sequence
  RNA Oligomer
aguuuucuugcacacacaauuuc

SEQ ID NO: 36115 - RNA, 23 nt, Artificial Sequence
  RNA Oligomer
guuuucuugcacacacaauuucu

SEQ ID NO: 36116 - RNA, 23 nt, Artificial Sequence
  RNA Oligomer
uuuucuugcacacacaauuucug

SEQ ID NO: 36117 - RNA, 23 nt, Artificial Sequence
  RNA Oligomer
uuucuugcacacacaauuucugg

SEQ ID NO: 36118 - RNA, 23 nt, Artificial Sequence
  RNA Oligomer
uucuugcacacacaauuucugga

SEQ ID NO: 36119 - RNA, 23 nt, Artificial Sequence
  RNA Oligomer
ucuugcacacacaauuucuggac

SEQ ID NO: 36120 - RNA, 23 nt, Artificial Sequence
  RNA Oligomer
cuugcacacacaauuucuggaca

SEQ ID NO: 36121 - RNA, 23 nt, Artificial Sequence
  RNA Oligomer
uugcacacacaauuucuggacau

SEQ ID NO: 36122 - RNA, 23 nt, Artificial Sequence
  RNA Oligomer
cccuacgagugacaaugguagcc

SEQ ID NO: 36123 - RNA, 23 nt, Artificial Sequence
  RNA Oligomer
ccuacgagugacaaugguagcca

SEQ ID NO: 36124 - RNA, 23 nt, Artificial Sequence
  RNA Oligomer
cuacgagugacaaugguagccac

SEQ ID NO: 36125 - RNA, 23 nt, Artificial Sequence
  RNA Oligomer
uacgagugacaaugguagccacg

SEQ ID NO: 36126 - RNA, 23 nt, Artificial Sequence
  RNA Oligomer
acgagugacaaugguagccacgg

SEQ ID NO: 36127 - RNA, 23 nt, Artificial Sequence
  RNA Oligomer
gguuuuuuguagaauccagauga

SEQ ID NO: 36128 - RNA, 23 nt, Artificial Sequence
  RNA Oligomer
guuuuuuguagaauccagaugaa

SEQ ID NO: 36129 - RNA, 23 nt, Artificial Sequence
  RNA Oligomer
uuuuuuguagaauccagaugaaa

SEQ ID NO: 36130 - RNA, 23 nt, Artificial Sequence
  RNA Oligomer
uuuuuguagaauccagaugaaag

SEQ ID NO: 36131 - RNA, 23 nt, Artificial Sequence
  RNA Oligomer
uuuuguagaauccagaugaaagg

SEQ ID NO: 36132 - RNA, 23 nt, Artificial Sequence
  RNA Oligomer
cuggaacauaagaauggccagug

SEQ ID NO: 36133 - RNA, 23 nt, Artificial Sequence
  RNA Oligomer
uggaacauaagaauggccagugu

SEQ ID NO: 36134 - RNA, 23 nt, Artificial Sequence
  RNA Oligomer
ggaacauaagaauggccagugug

SEQ ID NO: 36135 - RNA, 23 nt, Artificial Sequence
  RNA Oligomer
gaacauaagaauggccagugugu

SEQ ID NO: 36136 - RNA, 23 nt, Artificial Sequence
  RNA Oligomer
aacauaagaauggccaguguguu

SEQ ID NO: 36137 - RNA, 23 nt, Artificial Sequence
  RNA Oligomer
auggcuucaggguuuuggguaua

SEQ ID NO: 36138 - RNA, 23 nt, Artificial Sequence
  RNA Oligomer
ugaguacaauuaaacacucugag

SEQ ID NO: 36139 - RNA, 23 nt, Artificial Sequence
  RNA Oligomer
gaguacaauuaaacacucugaga

SEQ ID NO: 36140 - RNA, 23 nt, Artificial Sequence
  RNA Oligomer
aguacaauuaaacacucugagaa

SEQ ID NO: 36141 - RNA, 23 nt, Artificial Sequence
  RNA Oligomer
guacaauuaaacacucugagaau

SEQ ID NO: 36142 - RNA, 23 nt, Artificial Sequence
  RNA Oligomer
uacaauuaaacacucugagaauu

SEQ ID NO: 36143 - RNA, 23 nt, Artificial Sequence
  RNA Oligomer
aggaaaauggaauauucuuuggc

SEQ ID NO: 36144 - RNA, 23 nt, Artificial Sequence
  RNA Oligomer
ggaaaauggaauauucuuuggcu

SEQ ID NO: 36145 - RNA, 23 nt, Artificial Sequence
  RNA Oligomer
gaaaauggaauauucuuuggcuc

SEQ ID NO: 36146 - RNA, 23 nt, Artificial Sequence
  RNA Oligomer
aaaauggaauauucuuuggcucu

SEQ ID NO: 36147 - RNA, 23 nt, Artificial Sequence
  RNA Oligomer
aaauggaauauucuuuggcucuu

SEQ ID NO: 36148 - RNA, 23 nt, Artificial Sequence
  RNA Oligomer
aaugaggauucaaugaggacucc

SEQ ID NO: 36149 - RNA, 23 nt, Artificial Sequence
  RNA Oligomer
uucuuucucgucgccucuuuuuc

SEQ ID NO: 36150 - RNA, 23 nt, Artificial Sequence
  RNA Oligomer
ucuuucucgucgccucuuuuucc

SEQ ID NO: 36151 - RNA, 23 nt, Artificial Sequence
  RNA Oligomer
cuuucucgucgccucuuuuuccu

SEQ ID NO: 36152 - RNA, 23 nt, Artificial Sequence
  RNA Oligomer
uuucucgucgccucuuuuuccuu

SEQ ID NO: 36153 - RNA, 23 nt, Artificial Sequence
  RNA Oligomer
uucucgucgccucuuuuuccuuu

SEQ ID NO: 36154 - RNA, 23 nt, Artificial Sequence
  RNA Oligomer
ucucgucgccucuuuuuccuuuc

SEQ ID NO: 36155 - RNA, 23 nt, Artificial Sequence
  RNA Oligomer
cucgucgccucuuuuuccuuuca

SEQ ID NO: 36156 - RNA, 23 nt, Artificial Sequence
  RNA Oligomer
uguuaacgcugggagaauucugu

SEQ ID NO: 36157 - RNA, 23 nt, Artificial Sequence
  RNA Oligomer
guuaacgcugggagaauucuguc

SEQ ID NO: 36158 - RNA, 23 nt, Artificial Sequence
  RNA Oligomer
uuaacgcugggagaauucugucc

SEQ ID NO: 36159 - RNA, 23 nt, Artificial Sequence
  RNA Oligomer
uaacgcugggagaauucuguccu

SEQ ID NO: 36160 - RNA, 23 nt, Artificial Sequence
  RNA Oligomer
aacgcugggagaauucuguccuc

SEQ ID NO: 36161 - RNA, 23 nt, Artificial Sequence
  RNA Oligomer
auucuguccuccucuugcugaca

SEQ ID NO: 36162 - RNA, 23 nt, Artificial Sequence
  RNA Oligomer
gaguacauugccuaguuuucuug

SEQ ID NO: 36163 - RNA, 23 nt, Artificial Sequence
  RNA Oligomer
aguacauugccuaguuuucuugc

SEQ ID NO: 36164 - RNA, 23 nt, Artificial Sequence
  RNA Oligomer
guacauugccuaguuuucuugca

SEQ ID NO: 36165 - RNA, 23 nt, Artificial Sequence
  RNA Oligomer
uacauugccuaguuuucuugcac

SEQ ID NO: 36166 - RNA, 23 nt, Artificial Sequence
  RNA Oligomer
acauugccuaguuuucuugcaca

SEQ ID NO: 36167 - RNA, 23 nt, Artificial Sequence
  RNA Oligomer
ucacuaaaugcuguucucacucc

SEQ ID NO: 36168 - RNA, 23 nt, Artificial Sequence
  RNA Oligomer
cacuaaaugcuguucucacucca

SEQ ID NO: 36169 - RNA, 23 nt, Artificial Sequence
  RNA Oligomer
acuaaaugcuguucucacuccac

SEQ ID NO: 36170 - RNA, 23 nt, Artificial Sequence
  RNA Oligomer
cuaaaugcuguucucacuccaca

SEQ ID NO: 36171 - RNA, 23 nt, Artificial Sequence
  RNA Oligomer
uaaaugcuguucucacuccacau

SEQ ID NO: 36172 - RNA, 23 nt, Artificial Sequence
  RNA Oligomer
ccaucuggaacauaagaauggcc

SEQ ID NO: 36173 - RNA, 23 nt, Artificial Sequence
  RNA Oligomer
caucuggaacauaagaauggcca

SEQ ID NO: 36174 - RNA, 23 nt, Artificial Sequence
  RNA Oligomer
aucuggaacauaagaauggccag

SEQ ID NO: 36175 - RNA, 23 nt, Artificial Sequence
  RNA Oligomer
ucuggaacauaagaauggccagu

SEQ ID NO: 36176 - RNA, 23 nt, Artificial Sequence
  RNA Oligomer
aauguuccuucuuuuaucuguug

SEQ ID NO: 36177 - RNA, 23 nt, Artificial Sequence
  RNA Oligomer
auguuccuucuuuuaucuguugg

SEQ ID NO: 36178 - RNA, 23 nt, Artificial Sequence
  RNA Oligomer
uguuccuucuuuuaucuguugga

SEQ ID NO: 36179 - RNA, 23 nt, Artificial Sequence
  RNA Oligomer
guuccuucuuuuaucuguuggau

SEQ ID NO: 36180 - RNA, 23 nt, Artificial Sequence
  RNA Oligomer
uuccuucuuuuaucuguuggaua

SEQ ID NO: 36181 - RNA, 23 nt, Artificial Sequence
  RNA Oligomer
uccuucuuuuaucuguuggauaa

SEQ ID NO: 36182 - RNA, 23 nt, Artificial Sequence
  RNA Oligomer
agccuucaguucagcauucacac

SEQ ID NO: 36183 - RNA, 23 nt, Artificial Sequence
  RNA Oligomer
gccuucaguucagcauucacacu

SEQ ID NO: 36184 - RNA, 23 nt, Artificial Sequence
  RNA Oligomer
ccuucaguucagcauucacacuu

SEQ ID NO: 36185 - RNA, 23 nt, Artificial Sequence
  RNA Oligomer
cuucaguucagcauucacacuuu

SEQ ID NO: 36186 - RNA, 23 nt, Artificial Sequence
  RNA Oligomer
uucaguucagcauucacacuuuc

SEQ ID NO: 36187 - RNA, 23 nt, Artificial Sequence
  RNA Oligomer
cagcauucacacuuuccagcuuc

SEQ ID NO: 36188 - RNA, 23 nt, Artificial Sequence
  RNA Oligomer
agcauucacacuuuccagcuucu

SEQ ID NO: 36189 - RNA, 23 nt, Artificial Sequence
  RNA Oligomer
gcauucacacuuuccagcuucuc

SEQ ID NO: 36190 - RNA, 23 nt, Artificial Sequence
  RNA Oligomer
cauucacacuuuccagcuucucc

SEQ ID NO: 36191 - RNA, 23 nt, Artificial Sequence
  RNA Oligomer
auucacacuuuccagcuucuccg

SEQ ID NO: 36192 - RNA, 23 nt, Artificial Sequence
  RNA Oligomer
ccuucuucuuguuucggcacuuu

SEQ ID NO: 36193 - RNA, 23 nt, Artificial Sequence
  RNA Oligomer
cuucuucuuguuucggcacuuug

SEQ ID NO: 36194 - RNA, 23 nt, Artificial Sequence
  RNA Oligomer
uucuucuuguuucggcacuuugc

SEQ ID NO: 36195 - RNA, 23 nt, Artificial Sequence
  RNA Oligomer
gcagcugcaaucuuauuucuuuc

SEQ ID NO: 36196 - RNA, 23 nt, Artificial Sequence
  RNA Oligomer
cagcugcaaucuuauuucuuucu

SEQ ID NO: 36197 - RNA, 23 nt, Artificial Sequence
  RNA Oligomer
agcugcaaucuuauuucuuucuc

SEQ ID NO: 36198 - RNA, 23 nt, Artificial Sequence
  RNA Oligomer
uuucuuucucgucgccucuuuuu

SEQ ID NO: 36199 - RNA, 23 nt, Artificial Sequence
  RNA Oligomer
ucgucgccucuuuuuccuuucau

SEQ ID NO: 36200 - RNA, 23 nt, Artificial Sequence
  RNA Oligomer
cgucgccucuuuuuccuuucauc

SEQ ID NO: 36201 - RNA, 23 nt, Artificial Sequence
  RNA Oligomer
gucgccucuuuuuccuuucaucu

SEQ ID NO: 36202 - RNA, 23 nt, Artificial Sequence
  RNA Oligomer
uugaguacaauuaaacacucuga

SEQ ID NO: 36203 - RNA, 23 nt, Artificial Sequence
  RNA Oligomer
agaguacauugccuaguuuucuu

SEQ ID NO: 36204 - RNA, 23 nt, Artificial Sequence
  RNA Oligomer
ccccuacgagugacaaugguagc

SEQ ID NO: 36205 - RNA, 23 nt, Artificial Sequence
  RNA Oligomer
acauaagaauggccaguguguua

SEQ ID NO: 36206 - RNA, 23 nt, Artificial Sequence
  RNA Oligomer
uggcuucaggguuuuggguauaa

SEQ ID NO: 36207 - RNA, 23 nt, Artificial Sequence
  RNA Oligomer
ggcuucaggguuuuggguauaaa

SEQ ID NO: 36208 - RNA, 23 nt, Artificial Sequence
  RNA Oligomer
gcuucaggguuuuggguauaaaa

SEQ ID NO: 36209 - RNA, 23 nt, Artificial Sequence
  RNA Oligomer
cuucaggguuuuggguauaaaau

SEQ ID NO: 36210 - RNA, 23 nt, Artificial Sequence
  RNA Oligomer
uucaggguuuuggguauaaaaug

SEQ ID NO: 36211 - RNA, 23 nt, Artificial Sequence
  RNA Oligomer
gcaauguuccuucuuuuaucugu

SEQ ID NO: 36212 - RNA, 23 nt, Artificial Sequence
  RNA Oligomer
caauguuccuucuuuuaucuguu

SEQ ID NO: 36213 - RNA, 23 nt, Artificial Sequence
  RNA Oligomer
augaagguugagcauguauauca

SEQ ID NO: 36214 - RNA, 23 nt, Artificial Sequence
  RNA Oligomer
ugaagguugagcauguauaucaa

SEQ ID NO: 36215 - RNA, 23 nt, Artificial Sequence
  RNA Oligomer
gaagguugagcauguauaucaaa

SEQ ID NO: 36216 - RNA, 23 nt, Artificial Sequence
  RNA Oligomer
aagguugagcauguauaucaaau

SEQ ID NO: 36217 - RNA, 23 nt, Artificial Sequence
  RNA Oligomer
agguugagcauguauaucaaaug

SEQ ID NO: 36218 - RNA, 23 nt, Artificial Sequence
  RNA Oligomer
uguauaucaaaugcugcuucucg

SEQ ID NO: 36219 - RNA, 23 nt, Artificial Sequence
  RNA Oligomer
guauaucaaaugcugcuucucgu

SEQ ID NO: 36220 - RNA, 23 nt, Artificial Sequence
  RNA Oligomer
uauaucaaaugcugcuucucguu

SEQ ID NO: 36221 - RNA, 23 nt, Artificial Sequence
  RNA Oligomer
auaucaaaugcugcuucucguuc

SEQ ID NO: 36222 - RNA, 23 nt, Artificial Sequence
  RNA Oligomer
uaucaaaugcugcuucucguucu

SEQ ID NO: 36223 - RNA, 23 nt, Artificial Sequence
  RNA Oligomer
ucagcauucacacuuuccagcuu

SEQ ID NO: 36224 - RNA, 23 nt, Artificial Sequence
  RNA Oligomer
cuccgucuucuccuucuucuugu

SEQ ID NO: 36225 - RNA, 23 nt, Artificial Sequence
  RNA Oligomer
uccgucuucuccuucuucuuguu

SEQ ID NO: 36226 - RNA, 23 nt, Artificial Sequence
  RNA Oligomer
ccgucuucuccuucuucuuguuu

SEQ ID NO: 36227 - RNA, 23 nt, Artificial Sequence
  RNA Oligomer
caauuaaacacucugagaauuuc

SEQ ID NO: 36228 - RNA, 23 nt, Artificial Sequence
  RNA Oligomer
aauuaaacacucugagaauuuca

SEQ ID NO: 36229 - RNA, 23 nt, Artificial Sequence
  RNA Oligomer
auuaaacacucugagaauuucac

SEQ ID NO: 36230 - RNA, 23 nt, Artificial Sequence
  RNA Oligomer
uuaaacacucugagaauuucaca

SEQ ID NO: 36231 - RNA, 23 nt, Artificial Sequence
  RNA Oligomer
uaaacacucugagaauuucacag

SEQ ID NO: 36232 - RNA, 23 nt, Artificial Sequence
  RNA Oligomer
aauuuuaauagacaguagccagc

SEQ ID NO: 36233 - RNA, 23 nt, Artificial Sequence
  RNA Oligomer
auuuuaauagacaguagccagcg

SEQ ID NO: 36234 - RNA, 23 nt, Artificial Sequence
  RNA Oligomer
uuuaauagacaguagccagcguc

SEQ ID NO: 36235 - RNA, 23 nt, Artificial Sequence
  RNA Oligomer
uuaauagacaguagccagcgucc

SEQ ID NO: 36236 - RNA, 23 nt, Artificial Sequence
  RNA Oligomer
gccagauuucuuaaaacagcuac

SEQ ID NO: 36237 - RNA, 23 nt, Artificial Sequence
  RNA Oligomer
ccagauuucuuaaaacagcuaca

SEQ ID NO: 36238 - RNA, 23 nt, Artificial Sequence
  RNA Oligomer
cagauuucuuaaaacagcuacau

SEQ ID NO: 36239 - RNA, 23 nt, Artificial Sequence
  RNA Oligomer
agauuucuuaaaacagcuacaug

SEQ ID NO: 36240 - RNA, 23 nt, Artificial Sequence
  RNA Oligomer
gauuucuuaaaacagcuacauga

SEQ ID NO: 36241 - RNA, 23 nt, Artificial Sequence
  RNA Oligomer
gugguuuccaaacaucucuccac

SEQ ID NO: 36242 - RNA, 23 nt, Artificial Sequence
  RNA Oligomer
ugguuuccaaacaucucuccacu

SEQ ID NO: 36243 - RNA, 23 nt, Artificial Sequence
  RNA Oligomer
gguuuccaaacaucucuccacug

SEQ ID NO: 36244 - RNA, 23 nt, Artificial Sequence
  RNA Oligomer
guuuccaaacaucucuccacuga

SEQ ID NO: 36245 - RNA, 23 nt, Artificial Sequence
  RNA Oligomer
uuuccaaacaucucuccacugac

SEQ ID NO: 36246 - RNA, 23 nt, Artificial Sequence
  RNA Oligomer
caaccacaaggaaaggaaaaugg

SEQ ID NO: 36247 - RNA, 23 nt, Artificial Sequence
  RNA Oligomer
aaccacaaggaaaggaaaaugga

SEQ ID NO: 36248 - RNA, 23 nt, Artificial Sequence
  RNA Oligomer
accacaaggaaaggaaaauggaa

SEQ ID NO: 36249 - RNA, 23 nt, Artificial Sequence
  RNA Oligomer
ccacaaggaaaggaaaauggaau

SEQ ID NO: 36250 - RNA, 23 nt, Artificial Sequence
  RNA Oligomer
cacaaggaaaggaaaauggaaua

SEQ ID NO: 36251 - RNA, 23 nt, Artificial Sequence
  RNA Oligomer
gugacuuuggaacugaguuugca

SEQ ID NO: 36252 - RNA, 23 nt, Artificial Sequence
  RNA Oligomer
ugacuuuggaacugaguuugcaa

SEQ ID NO: 36253 - RNA, 23 nt, Artificial Sequence
  RNA Oligomer
gacuuuggaacugaguuugcaac

SEQ ID NO: 36254 - RNA, 23 nt, Artificial Sequence
  RNA Oligomer
acuuuggaacugaguuugcaaca

SEQ ID NO: 36255 - RNA, 23 nt, Artificial Sequence
  RNA Oligomer
cuuuggaacugaguuugcaacag

SEQ ID NO: 36256 - RNA, 23 nt, Artificial Sequence
  RNA Oligomer
cauugccuaguuuucuugcacac

SEQ ID NO: 36257 - RNA, 23 nt, Artificial Sequence
  RNA Oligomer
guugcacaacuucacuaaaugcu

SEQ ID NO: 36258 - RNA, 23 nt, Artificial Sequence
  RNA Oligomer
uugcacaacuucacuaaaugcug

SEQ ID NO: 36259 - RNA, 23 nt, Artificial Sequence
  RNA Oligomer
ugcacaacuucacuaaaugcugu

SEQ ID NO: 36260 - RNA, 23 nt, Artificial Sequence
  RNA Oligomer
gcacaacuucacuaaaugcuguu

SEQ ID NO: 36261 - RNA, 23 nt, Artificial Sequence
  RNA Oligomer
cacaacuucacuaaaugcuguuc

SEQ ID NO: 36262 - RNA, 23 nt, Artificial Sequence
  RNA Oligomer
ugguuuuuuguagaauccagaug

SEQ ID NO: 36263 - RNA, 23 nt, Artificial Sequence
  RNA Oligomer
uuuguagaauccagaugaaaggc

SEQ ID NO: 36264 - RNA, 23 nt, Artificial Sequence
  RNA Oligomer
uuguagaauccagaugaaaggcg

SEQ ID NO: 36265 - RNA, 23 nt, Artificial Sequence
  RNA Oligomer
uguagaauccagaugaaaggcgg

SEQ ID NO: 36266 - RNA, 23 nt, Artificial Sequence
  RNA Oligomer
guagaauccagaugaaaggcggg

SEQ ID NO: 36267 - RNA, 23 nt, Artificial Sequence
  RNA Oligomer
uagaauccagaugaaaggcgggc

SEQ ID NO: 36268 - RNA, 23 nt, Artificial Sequence
  RNA Oligomer
agaauccagaugaaaggcgggca

SEQ ID NO: 36269 - RNA, 23 nt, Artificial Sequence
  RNA Oligomer
uaagaauggccaguguguuaagg

SEQ ID NO: 36270 - RNA, 23 nt, Artificial Sequence
  RNA Oligomer
aagaauggccaguguguuaaggc

SEQ ID NO: 36271 - RNA, 23 nt, Artificial Sequence
  RNA Oligomer
agaauggccaguguguuaaggcc

SEQ ID NO: 36272 - RNA, 23 nt, Artificial Sequence
  RNA Oligomer
gaauggccaguguguuaaggccu

SEQ ID NO: 36273 - RNA, 23 nt, Artificial Sequence
  RNA Oligomer
aauggccaguguguuaaggccua

SEQ ID NO: 36274 - RNA, 23 nt, Artificial Sequence
  RNA Oligomer
acugcuuagcucugcaauguucc

SEQ ID NO: 36275 - RNA, 23 nt, Artificial Sequence
  RNA Oligomer
cugcuuagcucugcaauguuccu

SEQ ID NO: 36276 - RNA, 23 nt, Artificial Sequence
  RNA Oligomer
ugcuuagcucugcaauguuccuu

SEQ ID NO: 36277 - RNA, 23 nt, Artificial Sequence
  RNA Oligomer
gcuuagcucugcaauguuccuuc

SEQ ID NO: 36278 - RNA, 23 nt, Artificial Sequence
  RNA Oligomer
cuuagcucugcaauguuccuucu

SEQ ID NO: 36279 - RNA, 23 nt, Artificial Sequence
  RNA Oligomer
uuagcucugcaauguuccuucuu

SEQ ID NO: 36280 - RNA, 23 nt, Artificial Sequence
  RNA Oligomer
uagcucugcaauguuccuucuuu

SEQ ID NO: 36281 - RNA, 23 nt, Artificial Sequence
  RNA Oligomer
agcucugcaauguuccuucuuuu

SEQ ID NO: 36282 - RNA, 23 nt, Artificial Sequence
  RNA Oligomer
aucaaaugcugcuucucguucuu

SEQ ID NO: 36283 - RNA, 23 nt, Artificial Sequence
  RNA Oligomer
ucuucuuguuucggcacuuugca

SEQ ID NO: 36284 - RNA, 23 nt, Artificial Sequence
  RNA Oligomer
cuucuuguuucggcacuuugcag

SEQ ID NO: 36285 - RNA, 23 nt, Artificial Sequence
  RNA Oligomer
uucuuguuucggcacuuugcagc

SEQ ID NO: 36286 - RNA, 23 nt, Artificial Sequence
  RNA Oligomer
ucuuguuucggcacuuugcagcu

SEQ ID NO: 36287 - RNA, 23 nt, Artificial Sequence
  RNA Oligomer
uuugcagcugcaaucuuauuucu

SEQ ID NO: 36288 - RNA, 23 nt, Artificial Sequence
  RNA Oligomer
uugcagcugcaaucuuauuucuu

SEQ ID NO: 36289 - RNA, 23 nt, Artificial Sequence
  RNA Oligomer
ugcagcugcaaucuuauuucuuu

SEQ ID NO: 36290 - RNA, 23 nt, Artificial Sequence
  RNA Oligomer
gggcuaccucggcuuuugugaug

SEQ ID NO: 36291 - RNA, 23 nt, Artificial Sequence
  RNA Oligomer
ggcuaccucggcuuuugugaugg

SEQ ID NO: 36292 - RNA, 23 nt, Artificial Sequence
  RNA Oligomer
gcuaccucggcuuuugugaugga

SEQ ID NO: 36293 - RNA, 23 nt, Artificial Sequence
  RNA Oligomer
cuaccucggcuuuugugauggac

SEQ ID NO: 36294 - RNA, 23 nt, Artificial Sequence
  RNA Oligomer
uaccucggcuuuugugauggaca

SEQ ID NO: 36295 - RNA, 23 nt, Artificial Sequence
  RNA Oligomer
auugaguacaauuaaacacucug

SEQ ID NO: 36296 - RNA, 23 nt, Artificial Sequence
  RNA Oligomer
cagaauuuuaauagacaguagcc

SEQ ID NO: 36297 - RNA, 23 nt, Artificial Sequence
  RNA Oligomer
agaauuuuaauagacaguagcca

SEQ ID NO: 36298 - RNA, 23 nt, Artificial Sequence
  RNA Oligomer
gaauuuuaauagacaguagccag

SEQ ID NO: 36299 - RNA, 23 nt, Artificial Sequence
  RNA Oligomer
uaauagacaguagccagcguccu

SEQ ID NO: 36300 - RNA, 23 nt, Artificial Sequence
  RNA Oligomer
ggcaaaccucagcucuuccuuga

SEQ ID NO: 36301 - RNA, 23 nt, Artificial Sequence
  RNA Oligomer
gcaaaccucagcucuuccuugac

SEQ ID NO: 36302 - RNA, 23 nt, Artificial Sequence
  RNA Oligomer
caaaccucagcucuuccuugaca

SEQ ID NO: 36303 - RNA, 23 nt, Artificial Sequence
  RNA Oligomer
aaaccucagcucuuccuugacaa

SEQ ID NO: 36304 - RNA, 23 nt, Artificial Sequence
  RNA Oligomer
aaccucagcucuuccuugacaaa

SEQ ID NO: 36305 - RNA, 23 nt, Artificial Sequence
  RNA Oligomer
auggaauauucuuuggcucuucc

SEQ ID NO: 36306 - RNA, 23 nt, Artificial Sequence
  RNA Oligomer
uggaauauucuuuggcucuucca

SEQ ID NO: 36307 - RNA, 23 nt, Artificial Sequence
  RNA Oligomer
ggaauauucuuuggcucuuccag

SEQ ID NO: 36308 - RNA, 23 nt, Artificial Sequence
  RNA Oligomer
gaauauucuuuggcucuuccagc

SEQ ID NO: 36309 - RNA, 23 nt, Artificial Sequence
  RNA Oligomer
aauauucuuuggcucuuccagcc

SEQ ID NO: 36310 - RNA, 23 nt, Artificial Sequence
  RNA Oligomer
uuuggaacugaguuugcaacaga

SEQ ID NO: 36311 - RNA, 23 nt, Artificial Sequence
  RNA Oligomer
uuggaacugaguuugcaacagag

SEQ ID NO: 36312 - RNA, 23 nt, Artificial Sequence
  RNA Oligomer
gaauaucuugagauacugcacgu

SEQ ID NO: 36313 - RNA, 23 nt, Artificial Sequence
  RNA Oligomer
aauaucuugagauacugcacgug

SEQ ID NO: 36314 - RNA, 23 nt, Artificial Sequence
  RNA Oligomer
auaucuugagauacugcacgugg

SEQ ID NO: 36315 - RNA, 23 nt, Artificial Sequence
  RNA Oligomer
uaucuugagauacugcacguggu

SEQ ID NO: 36316 - RNA, 23 nt, Artificial Sequence
  RNA Oligomer
aucuugagauacugcacguggug

SEQ ID NO: 36317 - RNA, 23 nt, Artificial Sequence
  RNA Oligomer
ugccuaguuuucuugcacacaca

SEQ ID NO: 36318 - RNA, 23 nt, Artificial Sequence
  RNA Oligomer
gccuaguuuucuugcacacacaa

SEQ ID NO: 36319 - RNA, 23 nt, Artificial Sequence
  RNA Oligomer
ccuaguuuucuugcacacacaau

SEQ ID NO: 36320 - RNA, 23 nt, Artificial Sequence
  RNA Oligomer
cuaguuuucuugcacacacaauu

SEQ ID NO: 36321 - RNA, 23 nt, Artificial Sequence
  RNA Oligomer
uaguuuucuugcacacacaauuu

SEQ ID NO: 36322 - RNA, 23 nt, Artificial Sequence
  RNA Oligomer
agcaaaauccucaaacaccagug

SEQ ID NO: 36323 - RNA, 23 nt, Artificial Sequence
  RNA Oligomer
gcaaaauccucaaacaccaguga

SEQ ID NO: 36324 - RNA, 23 nt, Artificial Sequence
  RNA Oligomer
caaaauccucaaacaccagugac

SEQ ID NO: 36325 - RNA, 23 nt, Artificial Sequence
  RNA Oligomer
aaaauccucaaacaccagugacc

SEQ ID NO: 36326 - RNA, 23 nt, Artificial Sequence
  RNA Oligomer
aaauccucaaacaccagugaccc

SEQ ID NO: 36327 - RNA, 23 nt, Artificial Sequence
  RNA Oligomer
gaauccagaugaaaggcgggcag

SEQ ID NO: 36328 - RNA, 23 nt, Artificial Sequence
  RNA Oligomer
auucuagagguacacaggaagac

SEQ ID NO: 36329 - RNA, 23 nt, Artificial Sequence
  RNA Oligomer
uucuagagguacacaggaagaca

SEQ ID NO: 36330 - RNA, 23 nt, Artificial Sequence
  RNA Oligomer
ucuagagguacacaggaagacag

SEQ ID NO: 36331 - RNA, 23 nt, Artificial Sequence
  RNA Oligomer
cuagagguacacaggaagacagc

SEQ ID NO: 36332 - RNA, 23 nt, Artificial Sequence
  RNA Oligomer
uagagguacacaggaagacagcu

SEQ ID NO: 36333 - RNA, 23 nt, Artificial Sequence
  RNA Oligomer
ugcaauguuccuucuuuuaucug

SEQ ID NO: 36334 - RNA, 23 nt, Artificial Sequence
  RNA Oligomer
cauguauaucaaaugcugcuucu

SEQ ID NO: 36335 - RNA, 23 nt, Artificial Sequence
  RNA Oligomer
auguauaucaaaugcugcuucuc

SEQ ID NO: 36336 - RNA, 23 nt, Artificial Sequence
  RNA Oligomer
ucaaaugcugcuucucguucuug

SEQ ID NO: 36337 - RNA, 23 nt, Artificial Sequence
  RNA Oligomer
caaaugcugcuucucguucuuga

SEQ ID NO: 36338 - RNA, 23 nt, Artificial Sequence
  RNA Oligomer
aaaugcugcuucucguucuugag

SEQ ID NO: 36339 - RNA, 23 nt, Artificial Sequence
  RNA Oligomer
aaacacucugagaauuucacaga

SEQ ID NO: 36340 - RNA, 23 nt, Artificial Sequence
  RNA Oligomer
aacacucugagaauuucacagaa

SEQ ID NO: 36341 - RNA, 23 nt, Artificial Sequence
  RNA Oligomer
cugugguuuccaaacaucucucc

SEQ ID NO: 36342 - RNA, 23 nt, Artificial Sequence
  RNA Oligomer
ugugguuuccaaacaucucucca

SEQ ID NO: 36343 - RNA, 23 nt, Artificial Sequence
  RNA Oligomer
aauggaauauucuuuggcucuuc

SEQ ID NO: 36344 - RNA, 23 nt, Artificial Sequence
  RNA Oligomer
cugcuuucuuccugugacuuugg

SEQ ID NO: 36345 - RNA, 23 nt, Artificial Sequence
  RNA Oligomer
ugcuuucuuccugugacuuugga

SEQ ID NO: 36346 - RNA, 23 nt, Artificial Sequence
  RNA Oligomer
gcuuucuuccugugacuuuggaa

SEQ ID NO: 36347 - RNA, 23 nt, Artificial Sequence
  RNA Oligomer
cuuucuuccugugacuuuggaac

SEQ ID NO: 36348 - RNA, 23 nt, Artificial Sequence
  RNA Oligomer
uuucuuccugugacuuuggaacu

SEQ ID NO: 36349 - RNA, 23 nt, Artificial Sequence
  RNA Oligomer
gaacugaguuugcaacagaggac

SEQ ID NO: 36350 - RNA, 23 nt, Artificial Sequence
  RNA Oligomer
aacugaguuugcaacagaggacc

SEQ ID NO: 36351 - RNA, 23 nt, Artificial Sequence
  RNA Oligomer
acugaguuugcaacagaggaccu

SEQ ID NO: 36352 - RNA, 23 nt, Artificial Sequence
  RNA Oligomer
cugaguuugcaacagaggaccug

SEQ ID NO: 36353 - RNA, 23 nt, Artificial Sequence
  RNA Oligomer
ugaguuugcaacagaggaccugc

SEQ ID NO: 36354 - RNA, 23 nt, Artificial Sequence
  RNA Oligomer
caucauacugcccauggauuuug

SEQ ID NO: 36355 - RNA, 23 nt, Artificial Sequence
  RNA Oligomer
aucauacugcccauggauuuugu

SEQ ID NO: 36356 - RNA, 23 nt, Artificial Sequence
  RNA Oligomer
ucauacugcccauggauuuugug

SEQ ID NO: 36357 - RNA, 23 nt, Artificial Sequence
  RNA Oligomer
cauacugcccauggauuuugugu

SEQ ID NO: 36358 - RNA, 23 nt, Artificial Sequence
  RNA Oligomer
auacugcccauggauuuuguguu

SEQ ID NO: 36359 - RNA, 23 nt, Artificial Sequence
  RNA Oligomer
uacugcccauggauuuuguguua

SEQ ID NO: 36360 - RNA, 23 nt, Artificial Sequence
  RNA Oligomer
uugccuaguuuucuugcacacac

SEQ ID NO: 36361 - RNA, 23 nt, Artificial Sequence
  RNA Oligomer
aauccucaaacaccagugaccca

SEQ ID NO: 36362 - RNA, 23 nt, Artificial Sequence
  RNA Oligomer
acacugcugccugaauccuaacg

SEQ ID NO: 36363 - RNA, 23 nt, Artificial Sequence
  RNA Oligomer
cacugcugccugaauccuaacgg

SEQ ID NO: 36364 - RNA, 23 nt, Artificial Sequence
  RNA Oligomer
acugcugccugaauccuaacggu

SEQ ID NO: 36365 - RNA, 23 nt, Artificial Sequence
  RNA Oligomer
cugcugccugaauccuaacggug

SEQ ID NO: 36366 - RNA, 23 nt, Artificial Sequence
  RNA Oligomer
ugcugccugaauccuaacggugg

SEQ ID NO: 36367 - RNA, 23 nt, Artificial Sequence
  RNA Oligomer
cauaagaauggccaguguguuaa

SEQ ID NO: 36368 - RNA, 23 nt, Artificial Sequence
  RNA Oligomer
auaagaauggccaguguguuaag

SEQ ID NO: 36369 - RNA, 23 nt, Artificial Sequence
  RNA Oligomer
cugcugggauucuagagguacac

SEQ ID NO: 36370 - RNA, 23 nt, Artificial Sequence
  RNA Oligomer
ugcugggauucuagagguacaca

SEQ ID NO: 36371 - RNA, 23 nt, Artificial Sequence
  RNA Oligomer
gcugggauucuagagguacacag

SEQ ID NO: 36372 - RNA, 23 nt, Artificial Sequence
  RNA Oligomer
cugggauucuagagguacacagg

SEQ ID NO: 36373 - RNA, 23 nt, Artificial Sequence
  RNA Oligomer
acaggaagacagcucuccaaugg

SEQ ID NO: 36374 - RNA, 23 nt, Artificial Sequence
  RNA Oligomer
caggaagacagcucuccaauggc

SEQ ID NO: 36375 - RNA, 23 nt, Artificial Sequence
  RNA Oligomer
aggaagacagcucuccaauggcu

SEQ ID NO: 36376 - RNA, 23 nt, Artificial Sequence
  RNA Oligomer
ggaagacagcucuccaauggcuu

SEQ ID NO: 36377 - RNA, 23 nt, Artificial Sequence
  RNA Oligomer
gaagacagcucuccaauggcuuc

SEQ ID NO: 36378 - RNA, 23 nt, Artificial Sequence
  RNA Oligomer
aagacagcucuccaauggcuuca

SEQ ID NO: 36379 - RNA, 23 nt, Artificial Sequence
  RNA Oligomer
augaggauucaaugaggacuccc

SEQ ID NO: 36380 - RNA, 23 nt, Artificial Sequence
  RNA Oligomer
uucacacuuuccagcuucuccga

SEQ ID NO: 36381 - RNA, 23 nt, Artificial Sequence
  RNA Oligomer
ucacacuuuccagcuucuccgac

SEQ ID NO: 36382 - RNA, 23 nt, Artificial Sequence
  RNA Oligomer
cacacuuuccagcuucuccgacu

SEQ ID NO: 36383 - RNA, 23 nt, Artificial Sequence
  RNA Oligomer
acacuuuccagcuucuccgacuc

SEQ ID NO: 36384 - RNA, 23 nt, Artificial Sequence
  RNA Oligomer
gcagaggugcuuguucuggaugg

SEQ ID NO: 36385 - RNA, 23 nt, Artificial Sequence
  RNA Oligomer
cagaggugcuuguucuggauggc

SEQ ID NO: 36386 - RNA, 23 nt, Artificial Sequence
  RNA Oligomer
agaggugcuuguucuggauggca

SEQ ID NO: 36387 - RNA, 23 nt, Artificial Sequence
  RNA Oligomer
gaggugcuuguucuggauggcaa

SEQ ID NO: 36388 - RNA, 23 nt, Artificial Sequence
  RNA Oligomer
aggugcuuguucuggauggcaaa

SEQ ID NO: 36389 - RNA, 23 nt, Artificial Sequence
  RNA Oligomer
acaaaaacaaugcuauugacauc

SEQ ID NO: 36390 - RNA, 23 nt, Artificial Sequence
  RNA Oligomer
uuccaaacaucucuccacugacu

SEQ ID NO: 36391 - RNA, 23 nt, Artificial Sequence
  RNA Oligomer
uccaaacaucucuccacugacug

SEQ ID NO: 36392 - RNA, 23 nt, Artificial Sequence
  RNA Oligomer
ccaaacaucucuccacugacugu

SEQ ID NO: 36393 - RNA, 23 nt, Artificial Sequence
  RNA Oligomer
caaacaucucuccacugacugug

SEQ ID NO: 36394 - RNA, 23 nt, Artificial Sequence
  RNA Oligomer
aaacaucucuccacugacugugg

SEQ ID NO: 36395 - RNA, 23 nt, Artificial Sequence
  RNA Oligomer
aacaucucuccacugacuguggu

SEQ ID NO: 36396 - RNA, 23 nt, Artificial Sequence
  RNA Oligomer
cagccuagacacaacuccugacc

SEQ ID NO: 36397 - RNA, 23 nt, Artificial Sequence
  RNA Oligomer
agccuagacacaacuccugaccu

SEQ ID NO: 36398 - RNA, 23 nt, Artificial Sequence
  RNA Oligomer
gccuagacacaacuccugaccua

SEQ ID NO: 36399 - RNA, 23 nt, Artificial Sequence
  RNA Oligomer
ccuagacacaacuccugaccuaa

SEQ ID NO: 36400 - RNA, 23 nt, Artificial Sequence
  RNA Oligomer
cuagacacaacuccugaccuaag

SEQ ID NO: 36401 - RNA, 23 nt, Artificial Sequence
  RNA Oligomer
ggaaguugaacuuucugcuuucu

SEQ ID NO: 36402 - RNA, 23 nt, Artificial Sequence
  RNA Oligomer
gaaguugaacuuucugcuuucuu

SEQ ID NO: 36403 - RNA, 23 nt, Artificial Sequence
  RNA Oligomer
aaguugaacuuucugcuuucuuc

SEQ ID NO: 36404 - RNA, 23 nt, Artificial Sequence
  RNA Oligomer
aguugaacuuucugcuuucuucc

SEQ ID NO: 36405 - RNA, 23 nt, Artificial Sequence
  RNA Oligomer
guugaacuuucugcuuucuuccu

SEQ ID NO: 36406 - RNA, 23 nt, Artificial Sequence
  RNA Oligomer
uugaacuuucugcuuucuuccug

SEQ ID NO: 36407 - RNA, 23 nt, Artificial Sequence
  RNA Oligomer
ugaacuuucugcuuucuuccugu

SEQ ID NO: 36408 - RNA, 23 nt, Artificial Sequence
  RNA Oligomer
gaacuuucugcuuucuuccugug

SEQ ID NO: 36409 - RNA, 23 nt, Artificial Sequence
  RNA Oligomer
aacuuucugcuuucuuccuguga

SEQ ID NO: 36410 - RNA, 23 nt, Artificial Sequence
  RNA Oligomer
acuuucugcuuucuuccugugac

SEQ ID NO: 36411 - RNA, 23 nt, Artificial Sequence
  RNA Oligomer
uguguuaacgcugggagaauucu

SEQ ID NO: 36412 - RNA, 23 nt, Artificial Sequence
  RNA Oligomer
guguuaacgcugggagaauucug

SEQ ID NO: 36413 - RNA, 23 nt, Artificial Sequence
  RNA Oligomer
agggcgucagguuagcaaaaucc

SEQ ID NO: 36414 - RNA, 23 nt, Artificial Sequence
  RNA Oligomer
gggcgucagguuagcaaaauccu

SEQ ID NO: 36415 - RNA, 23 nt, Artificial Sequence
  RNA Oligomer
ggcgucagguuagcaaaauccuc

SEQ ID NO: 36416 - RNA, 23 nt, Artificial Sequence
  RNA Oligomer
gcgucagguuagcaaaauccuca

SEQ ID NO: 36417 - RNA, 23 nt, Artificial Sequence
  RNA Oligomer
cgucagguuagcaaaauccucaa

SEQ ID NO: 36418 - RNA, 23 nt, Artificial Sequence
  RNA Oligomer
caaaacucuuagaaaccagaucu

SEQ ID NO: 36419 - RNA, 23 nt, Artificial Sequence
  RNA Oligomer
aaaacucuuagaaaccagaucug

SEQ ID NO: 36420 - RNA, 23 nt, Artificial Sequence
  RNA Oligomer
aaacucuuagaaaccagaucuga

SEQ ID NO: 36421 - RNA, 23 nt, Artificial Sequence
  RNA Oligomer
aacucuuagaaaccagaucugag

SEQ ID NO: 36422 - RNA, 23 nt, Artificial Sequence
  RNA Oligomer
acucuuagaaaccagaucugaga

SEQ ID NO: 36423 - RNA, 23 nt, Artificial Sequence
  RNA Oligomer
ugcacacacaauuucuggacaua

SEQ ID NO: 36424 - RNA, 23 nt, Artificial Sequence
  RNA Oligomer
uagcaaaauccucaaacaccagu

SEQ ID NO: 36425 - RNA, 23 nt, Artificial Sequence
  RNA Oligomer
acaacuucacuaaaugcuguucu

SEQ ID NO: 36426 - RNA, 23 nt, Artificial Sequence
  RNA Oligomer
caacuucacuaaaugcuguucuc

SEQ ID NO: 36427 - RNA, 23 nt, Artificial Sequence
  RNA Oligomer
aacuucacuaaaugcuguucuca

SEQ ID NO: 36428 - RNA, 23 nt, Artificial Sequence
  RNA Oligomer
acuucacuaaaugcuguucucac

SEQ ID NO: 36429 - RNA, 23 nt, Artificial Sequence
  RNA Oligomer
cuucacuaaaugcuguucucacu

SEQ ID NO: 36430 - RNA, 23 nt, Artificial Sequence
  RNA Oligomer
uucacuaaaugcuguucucacuc

SEQ ID NO: 36431 - RNA, 23 nt, Artificial Sequence
  RNA Oligomer
ccaguguguuaaggccuaaaucc

SEQ ID NO: 36432 - RNA, 23 nt, Artificial Sequence
  RNA Oligomer
caguguguuaaggccuaaauccu

SEQ ID NO: 36433 - RNA, 23 nt, Artificial Sequence
  RNA Oligomer
aguguguuaaggccuaaauccug

SEQ ID NO: 36434 - RNA, 23 nt, Artificial Sequence
  RNA Oligomer
guguguuaaggccuaaauccugg

SEQ ID NO: 36435 - RNA, 23 nt, Artificial Sequence
  RNA Oligomer
uguguuaaggccuaaauccugga

SEQ ID NO: 36436 - RNA, 23 nt, Artificial Sequence
  RNA Oligomer
aggcaaagaugcacuugcccugg

SEQ ID NO: 36437 - RNA, 23 nt, Artificial Sequence
  RNA Oligomer
ggcaaagaugcacuugcccuggu

SEQ ID NO: 36438 - RNA, 23 nt, Artificial Sequence
  RNA Oligomer
gcaaagaugcacuugcccugguc

SEQ ID NO: 36439 - RNA, 23 nt, Artificial Sequence
  RNA Oligomer
caaagaugcacuugcccuggucc

SEQ ID NO: 36440 - RNA, 23 nt, Artificial Sequence
  RNA Oligomer
aaagaugcacuugcccuggucca

SEQ ID NO: 36441 - RNA, 23 nt, Artificial Sequence
  RNA Oligomer
gagguacacaggaagacagcucu

SEQ ID NO: 36442 - RNA, 23 nt, Artificial Sequence
  RNA Oligomer
agguacacaggaagacagcucuc

SEQ ID NO: 36443 - RNA, 23 nt, Artificial Sequence
  RNA Oligomer
gguacacaggaagacagcucucc

SEQ ID NO: 36444 - RNA, 23 nt, Artificial Sequence
  RNA Oligomer
guacacaggaagacagcucucca

SEQ ID NO: 36445 - RNA, 23 nt, Artificial Sequence
  RNA Oligomer
uacacaggaagacagcucuccaa

SEQ ID NO: 36446 - RNA, 23 nt, Artificial Sequence
  RNA Oligomer
cccauaccacgacugcuuagcuc

SEQ ID NO: 36447 - RNA, 23 nt, Artificial Sequence
  RNA Oligomer
ccauaccacgacugcuuagcucu

SEQ ID NO: 36448 - RNA, 23 nt, Artificial Sequence
  RNA Oligomer
cauaccacgacugcuuagcucug

SEQ ID NO: 36449 - RNA, 23 nt, Artificial Sequence
  RNA Oligomer
auaccacgacugcuuagcucugc

SEQ ID NO: 36450 - RNA, 23 nt, Artificial Sequence
  RNA Oligomer
uaccacgacugcuuagcucugca

SEQ ID NO: 36451 - RNA, 23 nt, Artificial Sequence
  RNA Oligomer
uaucuguuggauaaagagguuuc

SEQ ID NO: 36452 - RNA, 23 nt, Artificial Sequence
  RNA Oligomer
aucuguuggauaaagagguuucu

SEQ ID NO: 36453 - RNA, 23 nt, Artificial Sequence
  RNA Oligomer
ucuguuggauaaagagguuucuc

SEQ ID NO: 36454 - RNA, 23 nt, Artificial Sequence
  RNA Oligomer
cuguuggauaaagagguuucucu

SEQ ID NO: 36455 - RNA, 23 nt, Artificial Sequence
  RNA Oligomer
uguuggauaaagagguuucucuc

SEQ ID NO: 36456 - RNA, 23 nt, Artificial Sequence
  RNA Oligomer
agagguuucucucaucuucugga

SEQ ID NO: 36457 - RNA, 23 nt, Artificial Sequence
  RNA Oligomer
gagguuucucucaucuucuggag

SEQ ID NO: 36458 - RNA, 23 nt, Artificial Sequence
  RNA Oligomer
agguuucucucaucuucuggagu

SEQ ID NO: 36459 - RNA, 23 nt, Artificial Sequence
  RNA Oligomer
gguuucucucaucuucuggaguc

SEQ ID NO: 36460 - RNA, 23 nt, Artificial Sequence
  RNA Oligomer
guuucucucaucuucuggagucc

SEQ ID NO: 36461 - RNA, 23 nt, Artificial Sequence
  RNA Oligomer
caggcacuccgucuucuccuucu

SEQ ID NO: 36462 - RNA, 23 nt, Artificial Sequence
  RNA Oligomer
aggcacuccgucuucuccuucuu

SEQ ID NO: 36463 - RNA, 23 nt, Artificial Sequence
  RNA Oligomer
ggcacuccgucuucuccuucuuc

SEQ ID NO: 36464 - RNA, 23 nt, Artificial Sequence
  RNA Oligomer
gcacuccgucuucuccuucuucu

SEQ ID NO: 36465 - RNA, 23 nt, Artificial Sequence
  RNA Oligomer
cacuccgucuucuccuucuucuu

SEQ ID NO: 36466 - RNA, 23 nt, Artificial Sequence
  RNA Oligomer
acuccgucuucuccuucuucuug

SEQ ID NO: 36467 - RNA, 23 nt, Artificial Sequence
  RNA Oligomer
ugagaauuucacagaaacaucag

SEQ ID NO: 36468 - RNA, 23 nt, Artificial Sequence
  RNA Oligomer
gagaauuucacagaaacaucaga

SEQ ID NO: 36469 - RNA, 23 nt, Artificial Sequence
  RNA Oligomer
agaauuucacagaaacaucagaa

SEQ ID NO: 36470 - RNA, 23 nt, Artificial Sequence
  RNA Oligomer
gaauuucacagaaacaucagaau

SEQ ID NO: 36471 - RNA, 23 nt, Artificial Sequence
  RNA Oligomer
aauuucacagaaacaucagaauu

SEQ ID NO: 36472 - RNA, 23 nt, Artificial Sequence
  RNA Oligomer
auuucacagaaacaucagaauuu

SEQ ID NO: 36473 - RNA, 23 nt, Artificial Sequence
  RNA Oligomer
uuucacagaaacaucagaauuuu

SEQ ID NO: 36474 - RNA, 23 nt, Artificial Sequence
  RNA Oligomer
aauagacaguagccagcguccuu

SEQ ID NO: 36475 - RNA, 23 nt, Artificial Sequence
  RNA Oligomer
gggccagauuucuuaaaacagcu

SEQ ID NO: 36476 - RNA, 23 nt, Artificial Sequence
  RNA Oligomer
ggccagauuucuuaaaacagcua

SEQ ID NO: 36477 - RNA, 23 nt, Artificial Sequence
  RNA Oligomer
acaugacaaaaacaaugcuauug

SEQ ID NO: 36478 - RNA, 23 nt, Artificial Sequence
  RNA Oligomer
caugacaaaaacaaugcuauuga

SEQ ID NO: 36479 - RNA, 23 nt, Artificial Sequence
  RNA Oligomer
augacaaaaacaaugcuauugac

SEQ ID NO: 36480 - RNA, 23 nt, Artificial Sequence
  RNA Oligomer
ugacaaaaacaaugcuauugaca

SEQ ID NO: 36481 - RNA, 23 nt, Artificial Sequence
  RNA Oligomer
gacaaaaacaaugcuauugacau

SEQ ID NO: 36482 - RNA, 23 nt, Artificial Sequence
  RNA Oligomer
acugugguuuccaaacaucucuc

SEQ ID NO: 36483 - RNA, 23 nt, Artificial Sequence
  RNA Oligomer
uuccagccuagacacaacuccug

SEQ ID NO: 36484 - RNA, 23 nt, Artificial Sequence
  RNA Oligomer
uccagccuagacacaacuccuga

SEQ ID NO: 36485 - RNA, 23 nt, Artificial Sequence
  RNA Oligomer
ccagccuagacacaacuccugac

SEQ ID NO: 36486 - RNA, 23 nt, Artificial Sequence
  RNA Oligomer
ucuugagauacugcacgugguga

SEQ ID NO: 36487 - RNA, 23 nt, Artificial Sequence
  RNA Oligomer
cuugagauacugcacguggugac

SEQ ID NO: 36488 - RNA, 23 nt, Artificial Sequence
  RNA Oligomer
uugagauacugcacguggugaca

SEQ ID NO: 36489 - RNA, 23 nt, Artificial Sequence
  RNA Oligomer
cucuuagaaaccagaucugagaa

SEQ ID NO: 36490 - RNA, 23 nt, Artificial Sequence
  RNA Oligomer
ucggaagaguacauugccuaguu

SEQ ID NO: 36491 - RNA, 23 nt, Artificial Sequence
  RNA Oligomer
cggaagaguacauugccuaguuu

SEQ ID NO: 36492 - RNA, 23 nt, Artificial Sequence
  RNA Oligomer
ggaagaguacauugccuaguuuu

SEQ ID NO: 36493 - RNA, 23 nt, Artificial Sequence
  RNA Oligomer
gaagaguacauugccuaguuuuc

SEQ ID NO: 36494 - RNA, 23 nt, Artificial Sequence
  RNA Oligomer
aagaguacauugccuaguuuucu

SEQ ID NO: 36495 - RNA, 23 nt, Artificial Sequence
  RNA Oligomer
gcacacacaauuucuggacauaa

SEQ ID NO: 36496 - RNA, 23 nt, Artificial Sequence
  RNA Oligomer
aaaugcuguucucacuccacauc

SEQ ID NO: 36497 - RNA, 23 nt, Artificial Sequence
  RNA Oligomer
gugggcauccugguuuuuuguag

SEQ ID NO: 36498 - RNA, 23 nt, Artificial Sequence
  RNA Oligomer
ugggcauccugguuuuuuguaga

SEQ ID NO: 36499 - RNA, 23 nt, Artificial Sequence
  RNA Oligomer
gggcauccugguuuuuuguagaa

SEQ ID NO: 36500 - RNA, 23 nt, Artificial Sequence
  RNA Oligomer
ggcauccugguuuuuuguagaau

SEQ ID NO: 36501 - RNA, 23 nt, Artificial Sequence
  RNA Oligomer
gcauccugguuuuuuguagaauc

SEQ ID NO: 36502 - RNA, 23 nt, Artificial Sequence
  RNA Oligomer
cauccugguuuuuuguagaaucc

SEQ ID NO: 36503 - RNA, 23 nt, Artificial Sequence
  RNA Oligomer
auccugguuuuuuguagaaucca

SEQ ID NO: 36504 - RNA, 23 nt, Artificial Sequence
  RNA Oligomer
ccugguuuuuuguagaauccaga

SEQ ID NO: 36505 - RNA, 23 nt, Artificial Sequence
  RNA Oligomer
cugguuuuuuguagaauccagau

SEQ ID NO: 36506 - RNA, 23 nt, Artificial Sequence
  RNA Oligomer
aaagagguuucucucaucuucug

SEQ ID NO: 36507 - RNA, 23 nt, Artificial Sequence
  RNA Oligomer
aagagguuucucucaucuucugg

SEQ ID NO: 36508 - RNA, 23 nt, Artificial Sequence
  RNA Oligomer
aaugcugcuucucguucuugagc

SEQ ID NO: 36509 - RNA, 23 nt, Artificial Sequence
  RNA Oligomer
augcugcuucucguucuugagcu

SEQ ID NO: 36510 - RNA, 23 nt, Artificial Sequence
  RNA Oligomer
ugcugcuucucguucuugagcuc

SEQ ID NO: 36511 - RNA, 23 nt, Artificial Sequence
  RNA Oligomer
cacuuuccagcuucuccgacucu

SEQ ID NO: 36512 - RNA, 23 nt, Artificial Sequence
  RNA Oligomer
acuuuccagcuucuccgacucuu

SEQ ID NO: 36513 - RNA, 23 nt, Artificial Sequence
  RNA Oligomer
cuuuccagcuucuccgacucuuu

SEQ ID NO: 36514 - RNA, 23 nt, Artificial Sequence
  RNA Oligomer
uuuccagcuucuccgacucuuuc

SEQ ID NO: 36515 - RNA, 23 nt, Artificial Sequence
  RNA Oligomer
guccuuguggccagugugaguga

SEQ ID NO: 36516 - RNA, 23 nt, Artificial Sequence
  RNA Oligomer
uccuuguggccagugugagugac

SEQ ID NO: 36517 - RNA, 23 nt, Artificial Sequence
  RNA Oligomer
ccuuguggccagugugagugacu

SEQ ID NO: 36518 - RNA, 23 nt, Artificial Sequence
  RNA Oligomer
cuuguggccagugugagugacuu

SEQ ID NO: 36519 - RNA, 23 nt, Artificial Sequence
  RNA Oligomer
uuguggccagugugagugacuuc

SEQ ID NO: 36520 - RNA, 23 nt, Artificial Sequence
  RNA Oligomer
auuucuuaaaacagcuacaugac

SEQ ID NO: 36521 - RNA, 23 nt, Artificial Sequence
  RNA Oligomer
uuucuuaaaacagcuacaugaca

SEQ ID NO: 36522 - RNA, 23 nt, Artificial Sequence
  RNA Oligomer
uucuuaaaacagcuacaugacaa

SEQ ID NO: 36523 - RNA, 23 nt, Artificial Sequence
  RNA Oligomer
ucuuaaaacagcuacaugacaaa

SEQ ID NO: 36524 - RNA, 23 nt, Artificial Sequence
  RNA Oligomer
acaaugcuauugacauccaauaa

SEQ ID NO: 36525 - RNA, 23 nt, Artificial Sequence
  RNA Oligomer
auccaauaaugcuaaagccuggg

SEQ ID NO: 36526 - RNA, 23 nt, Artificial Sequence
  RNA Oligomer
uccaauaaugcuaaagccugggu

SEQ ID NO: 36527 - RNA, 23 nt, Artificial Sequence
  RNA Oligomer
ccaauaaugcuaaagccugggua

SEQ ID NO: 36528 - RNA, 23 nt, Artificial Sequence
  RNA Oligomer
caauaaugcuaaagccuggguac

SEQ ID NO: 36529 - RNA, 23 nt, Artificial Sequence
  RNA Oligomer
aauaaugcuaaagccuggguacc

SEQ ID NO: 36530 - RNA, 23 nt, Artificial Sequence
  RNA Oligomer
uggcaaaccucagcucuuccuug

SEQ ID NO: 36531 - RNA, 23 nt, Artificial Sequence
  RNA Oligomer
gguuuucaaccacaaggaaagga

SEQ ID NO: 36532 - RNA, 23 nt, Artificial Sequence
  RNA Oligomer
guuuucaaccacaaggaaaggaa

SEQ ID NO: 36533 - RNA, 23 nt, Artificial Sequence
  RNA Oligomer
uuuucaaccacaaggaaaggaaa

SEQ ID NO: 36534 - RNA, 23 nt, Artificial Sequence
  RNA Oligomer
uuucaaccacaaggaaaggaaaa

SEQ ID NO: 36535 - RNA, 23 nt, Artificial Sequence
  RNA Oligomer
uucaaccacaaggaaaggaaaau

SEQ ID NO: 36536 - RNA, 23 nt, Artificial Sequence
  RNA Oligomer
gcucuuccagccuagacacaacu

SEQ ID NO: 36537 - RNA, 23 nt, Artificial Sequence
  RNA Oligomer
cucuuccagccuagacacaacuc

SEQ ID NO: 36538 - RNA, 23 nt, Artificial Sequence
  RNA Oligomer
ucuuccagccuagacacaacucc

SEQ ID NO: 36539 - RNA, 23 nt, Artificial Sequence
  RNA Oligomer
cuuccagccuagacacaacuccu

SEQ ID NO: 36540 - RNA, 23 nt, Artificial Sequence
  RNA Oligomer
uccugaccuaagacauugagugg

SEQ ID NO: 36541 - RNA, 23 nt, Artificial Sequence
  RNA Oligomer
ccugaccuaagacauugagugga

SEQ ID NO: 36542 - RNA, 23 nt, Artificial Sequence
  RNA Oligomer
cugaccuaagacauugaguggag

SEQ ID NO: 36543 - RNA, 23 nt, Artificial Sequence
  RNA Oligomer
ugaccuaagacauugaguggaga

SEQ ID NO: 36544 - RNA, 23 nt, Artificial Sequence
  RNA Oligomer
gaccuaagacauugaguggagag

SEQ ID NO: 36545 - RNA, 23 nt, Artificial Sequence
  RNA Oligomer
cuuucugcuuucuuccugugacu

SEQ ID NO: 36546 - RNA, 23 nt, Artificial Sequence
  RNA Oligomer
aacuccugaccuaagacauugag

SEQ ID NO: 36547 - RNA, 23 nt, Artificial Sequence
  RNA Oligomer
cucuugcugacaagcucuucugg

SEQ ID NO: 36548 - RNA, 23 nt, Artificial Sequence
  RNA Oligomer
aaggaaaggaaaauggaauauuc

SEQ ID NO: 36549 - RNA, 23 nt, Artificial Sequence
  RNA Oligomer
gguauaaaaugaggauucaauga

SEQ ID NO: 36550 - RNA, 23 nt, Artificial Sequence
  RNA Oligomer
uugacauccaauaaugcuaaagc

SEQ ID NO: 36551 - RNA, 23 nt, Artificial Sequence
  RNA Oligomer
aggaaaggaaaauggaauauucu

SEQ ID NO: 36552 - RNA, 23 nt, Artificial Sequence
  RNA Oligomer
auauuugcuagaaagcacaaccc

SEQ ID NO: 36553 - RNA, 23 nt, Artificial Sequence
  RNA Oligomer
uaccauugaguacaauuaaacac

SEQ ID NO: 36554 - RNA, 23 nt, Artificial Sequence
  RNA Oligomer
cuccugaccuaagacauugagug

SEQ ID NO: 36555 - RNA, 23 nt, Artificial Sequence
  RNA Oligomer
aaagcauauaaaagucacaucag

SEQ ID NO: 36556 - RNA, 23 nt, Artificial Sequence
  RNA Oligomer
uccucuugcugacaagcucuucu

SEQ ID NO: 36557 - RNA, 23 nt, Artificial Sequence
  RNA Oligomer
ugggauucuagagguacacagga

SEQ ID NO: 36558 - RNA, 23 nt, Artificial Sequence
  RNA Oligomer
aaaacagcuacaugacaaaaaca

SEQ ID NO: 36559 - RNA, 23 nt, Artificial Sequence
  RNA Oligomer
aagcauauaaaagucacaucagu

SEQ ID NO: 36560 - RNA, 23 nt, Artificial Sequence
  RNA Oligomer
augcuguucucacuccacauccc

SEQ ID NO: 36561 - RNA, 23 nt, Artificial Sequence
  RNA Oligomer
aucuucuggaguccucccauucu

SEQ ID NO: 36562 - RNA, 23 nt, Artificial Sequence
  RNA Oligomer
ugacuucucacagcugcaaacac

SEQ ID NO: 36563 - RNA, 23 nt, Artificial Sequence
  RNA Oligomer
auugaguggagaguccuaacccu

SEQ ID NO: 36564 - RNA, 23 nt, Artificial Sequence
  RNA Oligomer
gagaaaaagcauauaaaagucac

SEQ ID NO: 36565 - RNA, 23 nt, Artificial Sequence
  RNA Oligomer
gaugaagguugagcauguauauc

SEQ ID NO: 36566 - RNA, 23 nt, Artificial Sequence
  RNA Oligomer
ucagaauuuuaauagacaguagc

SEQ ID NO: 36567 - RNA, 23 nt, Artificial Sequence
  RNA Oligomer
ugggccagauuucuuaaaacagc

SEQ ID NO: 36568 - RNA, 23 nt, Artificial Sequence
  RNA Oligomer
aaacagcuacaugacaaaaacaa

SEQ ID NO: 36569 - RNA, 23 nt, Artificial Sequence
  RNA Oligomer
gaaaccagaucugagaaaaagca

SEQ ID NO: 36570 - RNA, 23 nt, Artificial Sequence
  RNA Oligomer
agguuagcaaaauccucaaacac

SEQ ID NO: 36571 - RNA, 23 nt, Artificial Sequence
  RNA Oligomer
uuagcaaaauccucaaacaccag

SEQ ID NO: 36572 - RNA, 23 nt, Artificial Sequence
  RNA Oligomer
acauugaguggagaguccuaacc

SEQ ID NO: 36573 - RNA, 23 nt, Artificial Sequence
  RNA Oligomer
uucugcuuucuuccugugacuuu

SEQ ID NO: 36574 - RNA, 23 nt, Artificial Sequence
  RNA Oligomer
cagaucugagaaaaagcauauaa

SEQ ID NO: 36575 - RNA, 23 nt, Artificial Sequence
  RNA Oligomer
aaugcuguucucacuccacaucc

SEQ ID NO: 36576 - RNA, 23 nt, Artificial Sequence
  RNA Oligomer
auaaagagguuucucucaucuuc

SEQ ID NO: 36577 - RNA, 23 nt, Artificial Sequence
  RNA Oligomer
acuucucacagcugcaaacaccc

SEQ ID NO: 36578 - RNA, 23 nt, Artificial Sequence
  RNA Oligomer
uaaaacagcuacaugacaaaaac

SEQ ID NO: 36579 - RNA, 23 nt, Artificial Sequence
  RNA Oligomer
cauugaguggagaguccuaaccc

SEQ ID NO: 36580 - RNA, 23 nt, Artificial Sequence
  RNA Oligomer
ugcccauggauuuuguguuaacg

SEQ ID NO: 36581 - RNA, 23 nt, Artificial Sequence
  RNA Oligomer
ucuugcugacaagcucuucuggc

SEQ ID NO: 36582 - RNA, 23 nt, Artificial Sequence
  RNA Oligomer
gguuagcaaaauccucaaacacc

SEQ ID NO: 36583 - RNA, 23 nt, Artificial Sequence
  RNA Oligomer
uuauucugacagguuaggaauac

SEQ ID NO: 36584 - RNA, 23 nt, Artificial Sequence
  RNA Oligomer
augcuauugacauccaauaaugc

SEQ ID NO: 36585 - RNA, 23 nt, Artificial Sequence
  RNA Oligomer
auuuuguguuaacgcugggagaa

SEQ ID NO: 36586 - RNA, 23 nt, Artificial Sequence
  RNA Oligomer
aauuucuggacauaacagcauau

SEQ ID NO: 36587 - RNA, 23 nt, Artificial Sequence
  RNA Oligomer
auuuauuauucugacagguuagg

SEQ ID NO: 36588 - RNA, 23 nt, Artificial Sequence
  RNA Oligomer
auccucaaacaccagugacccag

SEQ ID NO: 36589 - RNA, 23 nt, Artificial Sequence
  RNA Oligomer
auaacagcauauuugcuagaaag

SEQ ID NO: 36590 - RNA, 23 nt, Artificial Sequence
  RNA Oligomer
auuugcuagaaagcacaacccug

SEQ ID NO: 36591 - RNA, 23 nt, Artificial Sequence
  RNA Oligomer
uauuugcuagaaagcacaacccu

SEQ ID NO: 36592 - RNA, 23 nt, Artificial Sequence
  RNA Oligomer
uuugcuagaaagcacaacccugg

SEQ ID NO: 36593 - RNA, 23 nt, Artificial Sequence
  RNA Oligomer
ucucuccacugacugugguuuuc

SEQ ID NO: 36594 - RNA, 23 nt, Artificial Sequence
  RNA Oligomer
ugugacuuuggaacugaguuugc

SEQ ID NO: 36595 - RNA, 23 nt, Artificial Sequence
  RNA Oligomer
uggauuuuguguuaacgcuggga

SEQ ID NO: 36596 - RNA, 23 nt, Artificial Sequence
  RNA Oligomer
ucuuuuaucuguuggauaaagag

SEQ ID NO: 36597 - RNA, 23 nt, Artificial Sequence
  RNA Oligomer
uucugacagguuaggaauacuag

SEQ ID NO: 36598 - RNA, 23 nt, Artificial Sequence
  RNA Oligomer
auauaaaagucacaucaguguug

SEQ ID NO: 36599 - RNA, 23 nt, Artificial Sequence
  RNA Oligomer
caaacaucggaagaguacauugc

SEQ ID NO: 36600 - RNA, 23 nt, Artificial Sequence
  RNA Oligomer
uuuauuauucugacagguuagga

SEQ ID NO: 36601 - RNA, 23 nt, Artificial Sequence
  RNA Oligomer
uuauuauucugacagguuaggaa

SEQ ID NO: 36602 - RNA, 23 nt, Artificial Sequence
  RNA Oligomer
auuguaaugauaccauugaguac

SEQ ID NO: 36603 - RNA, 23 nt, Artificial Sequence
  RNA Oligomer
aaggaaaauggaauauucuuugg

SEQ ID NO: 36604 - RNA, 23 nt, Artificial Sequence
  RNA Oligomer
ucugacagguuaggaauacuagg

SEQ ID NO: 36605 - RNA, 23 nt, Artificial Sequence
  RNA Oligomer
cucuucuggccaccugaauaucu

SEQ ID NO: 36606 - RNA, 23 nt, Artificial Sequence
  RNA Oligomer
uaacagcauauuugcuagaaagc

SEQ ID NO: 36607 - RNA, 23 nt, Artificial Sequence
  RNA Oligomer
aacagcauauuugcuagaaagca

SEQ ID NO: 36608 - RNA, 23 nt, Artificial Sequence
  RNA Oligomer
aguugaggcaaagaugcacuugc

SEQ ID NO: 36609 - RNA, 23 nt, Artificial Sequence
  RNA Oligomer
cuuuuaucuguuggauaaagagg

SEQ ID NO: 36610 - RNA, 23 nt, Artificial Sequence
  RNA Oligomer
uucuggaguccucccauucugag

SEQ ID NO: 36611 - RNA, 23 nt, Artificial Sequence
  RNA Oligomer
auucugagcccggacaauacacg

SEQ ID NO: 36612 - RNA, 23 nt, Artificial Sequence
  RNA Oligomer
auucugacagguuaggaauacua

SEQ ID NO: 36613 - RNA, 23 nt, Artificial Sequence
  RNA Oligomer
uugcugacaagcucuucuggcca

SEQ ID NO: 36614 - RNA, 23 nt, Artificial Sequence
  RNA Oligomer
acaaacaucggaagaguacauug

SEQ ID NO: 36615 - RNA, 23 nt, Artificial Sequence
  RNA Oligomer
aaacaucggaagaguacauugcc

SEQ ID NO: 36616 - RNA, 23 nt, Artificial Sequence
  RNA Oligomer
uucuggacauaacagcauauuug

SEQ ID NO: 36617 - RNA, 23 nt, Artificial Sequence
  RNA Oligomer
uagaaagcacaacccuggccguu

SEQ ID NO: 36618 - RNA, 23 nt, Artificial Sequence
  RNA Oligomer
cuggguguugaagcaucauuuug

SEQ ID NO: 36619 - RNA, 23 nt, Artificial Sequence
  RNA Oligomer
ccuuuggaaguugaacuuucugc

SEQ ID NO: 36620 - RNA, 23 nt, Artificial Sequence
  RNA Oligomer
auugccuaguuuucuugcacaca

SEQ ID NO: 36621 - RNA, 23 nt, Artificial Sequence
  RNA Oligomer
agugacaaugguagccacgguga

SEQ ID NO: 36622 - RNA, 23 nt, Artificial Sequence
  RNA Oligomer
uuaucuguuggauaaagagguuu

SEQ ID NO: 36623 - RNA, 23 nt, Artificial Sequence
  RNA Oligomer
uugagcauguauaucaaaugcug

SEQ ID NO: 36624 - RNA, 23 nt, Artificial Sequence
  Chemically synthesized
uuucugcaggcacuccgucuucu

SEQ ID NO: 36625 - RNA, 23 nt, Artificial Sequence
  Chemically synthesized
auaaugcuaaagccuggguacca

SEQ ID NO: 36626 - RNA, 23 nt, Artificial Sequence
  Chemically synthesized
uuuggaaguugaacuuucugcuu

SEQ ID NO: 36627 - RNA, 23 nt, Artificial Sequence
  Chemically synthesized
uuggaaguugaacuuucugcuuu

SEQ ID NO: 36628 - RNA, 23 nt, Artificial Sequence
  Chemically synthesized
uucuuccugugacuuuggaacug

SEQ ID NO: 36629 - RNA, 23 nt, Artificial Sequence
  Chemically synthesized
uggaacugaguuugcaacagagg

SEQ ID NO: 36630 - RNA, 23 nt, Artificial Sequence
  Chemically synthesized
accugaauaucuugagauacugc

SEQ ID NO: 36631 - RNA, 23 nt, Artificial Sequence
  Chemically synthesized
uauaaaagucacaucaguguugu

SEQ ID NO: 36632 - RNA, 23 nt, Artificial Sequence
  Chemically synthesized
uaaaagucacaucaguguugugu

SEQ ID NO: 36633 - RNA, 23 nt, Artificial Sequence
  Chemically synthesized
uugcuagaaagcacaacccuggc

SEQ ID NO: 36634 - RNA, 23 nt, Artificial Sequence
  Chemically synthesized
uacagacacugcugccugaaucc

SEQ ID NO: 36635 - RNA, 23 nt, Artificial Sequence
  RNA Oligomer
uuuuaucuguuggauaaagaggu

SEQ ID NO: 36636 - RNA, 23 nt, Artificial Sequence
  RNA Oligomer
uucuggauggcaaaccucagcuc

SEQ ID NO: 36637 - RNA, 23 nt, Artificial Sequence
  RNA Oligomer
gacauccaauaaugcuaaagccu

SEQ ID NO: 36638 - RNA, 23 nt, Artificial Sequence
  RNA Oligomer
acauccaauaaugcuaaagccug

SEQ ID NO: 36639 - RNA, 23 nt, Artificial Sequence
  RNA Oligomer
uauucuuuggcucuuccagccua

SEQ ID NO: 36640 - RNA, 23 nt, Artificial Sequence
  RNA Oligomer
uuguguuaacgcugggagaauuc

SEQ ID NO: 36641 - RNA, 23 nt, Artificial Sequence
  RNA Oligomer
uucuggccaccugaauaucuuga

SEQ ID NO: 36642 - RNA, 23 nt, Artificial Sequence
  RNA Oligomer
auaaaagucacaucaguguugug

SEQ ID NO: 36643 - RNA, 23 nt, Artificial Sequence
  RNA Oligomer
aguguugugugacacaaacaucg

SEQ ID NO: 36644 - RNA, 23 nt, Artificial Sequence
  RNA Oligomer
ugacacaaacaucggaagaguac

SEQ ID NO: 36645 - RNA, 23 nt, Artificial Sequence
  RNA Oligomer
uuucuggacauaacagcauauuu

SEQ ID NO: 36646 - RNA, 23 nt, Artificial Sequence
  RNA Oligomer
ugacagguuaggaauacuaggau

SEQ ID NO: 36647 - RNA, 23 nt, Artificial Sequence
  RNA Oligomer
gacagguuaggaauacuaggaua

SEQ ID NO: 36648 - RNA, 23 nt, Artificial Sequence
  RNA Oligomer
acagguuaggaauacuaggauaa

SEQ ID NO: 36649 - RNA, 23 nt, Artificial Sequence
  RNA Oligomer
cagguuaggaauacuaggauaaa

SEQ ID NO: 36650 - RNA, 23 nt, Artificial Sequence
  RNA Oligomer
agguuaggaauacuaggauaaau

SEQ ID NO: 36651 - RNA, 23 nt, Artificial Sequence
  RNA Oligomer
ucauaucucucccuucuuuaccu

SEQ ID NO: 36652 - RNA, 23 nt, Artificial Sequence
  RNA Oligomer
uucauaucucucccuucuuuacc

SEQ ID NO: 36653 - RNA, 23 nt, Artificial Sequence
  RNA Oligomer
cuucauaucucucccuucuuuac

SEQ ID NO: 36654 - RNA, 23 nt, Artificial Sequence
  RNA Oligomer
gcuucauaucucucccuucuuua

SEQ ID NO: 36655 - RNA, 23 nt, Artificial Sequence
  RNA Oligomer
ugcuucauaucucucccuucuuu

SEQ ID NO: 36656 - RNA, 23 nt, Artificial Sequence
  RNA Oligomer
ccauguguuuugcuuuuauccac

SEQ ID NO: 36657 - RNA, 23 nt, Artificial Sequence
  RNA Oligomer
uccauguguuuugcuuuuaucca

SEQ ID NO: 36658 - RNA, 23 nt, Artificial Sequence
  RNA Oligomer
uuccauguguuuugcuuuuaucc

SEQ ID NO: 36659 - RNA, 23 nt, Artificial Sequence
  RNA Oligomer
uuuccauguguuuugcuuuuauc

SEQ ID NO: 36660 - RNA, 23 nt, Artificial Sequence
  RNA Oligomer
uuuuccauguguuuugcuuuuau

SEQ ID NO: 36661 - RNA, 23 nt, Artificial Sequence
  RNA Oligomer
cugcuucauaucucucccuucuu

SEQ ID NO: 36662 - RNA, 23 nt, Artificial Sequence
  RNA Oligomer
ccugcuucauaucucucccuucu

SEQ ID NO: 36663 - RNA, 23 nt, Artificial Sequence
  RNA Oligomer
cccugcuucauaucucucccuuc

SEQ ID NO: 36664 - RNA, 23 nt, Artificial Sequence
  RNA Oligomer
ucccugcuucauaucucucccuu

SEQ ID NO: 36665 - RNA, 23 nt, Artificial Sequence
  RNA Oligomer
gcacuucauaucuagauuucuag

SEQ ID NO: 36666 - RNA, 23 nt, Artificial Sequence
  RNA Oligomer
ugcacuucauaucuagauuucua

SEQ ID NO: 36667 - RNA, 23 nt, Artificial Sequence
  RNA Oligomer
cugcacuucauaucuagauuucu

SEQ ID NO: 36668 - RNA, 23 nt, Artificial Sequence
  RNA Oligomer
ccugcacuucauaucuagauuuc

SEQ ID NO: 36669 - RNA, 23 nt, Artificial Sequence
  RNA Oligomer
accugcacuucauaucuagauuu

SEQ ID NO: 36670 - RNA, 23 nt, Artificial Sequence
  RNA Oligomer
gccuugcauuuguaccuuauuga

SEQ ID NO: 36671 - RNA, 23 nt, Artificial Sequence
  RNA Oligomer
ugccuugcauuuguaccuuauug

SEQ ID NO: 36672 - RNA, 23 nt, Artificial Sequence
  RNA Oligomer
uugccuugcauuuguaccuuauu

SEQ ID NO: 36673 - RNA, 23 nt, Artificial Sequence
  RNA Oligomer
auugccuugcauuuguaccuuau

SEQ ID NO: 36674 - RNA, 23 nt, Artificial Sequence
  RNA Oligomer
cauugccuugcauuuguaccuua

SEQ ID NO: 36675 - RNA, 23 nt, Artificial Sequence
  RNA Oligomer
cccuucuuuaccuucauuucauc

SEQ ID NO: 36676 - RNA, 23 nt, Artificial Sequence
  RNA Oligomer
ucccuucuuuaccuucauuucau

SEQ ID NO: 36677 - RNA, 23 nt, Artificial Sequence
  RNA Oligomer
cucccuucuuuaccuucauuuca

SEQ ID NO: 36678 - RNA, 23 nt, Artificial Sequence
  RNA Oligomer
ucucccuucuuuaccuucauuuc

SEQ ID NO: 36679 - RNA, 23 nt, Artificial Sequence
  RNA Oligomer
cucucccuucuuuaccuucauuu

SEQ ID NO: 36680 - RNA, 23 nt, Artificial Sequence
  RNA Oligomer
gccuugcacuccugaauuuuauc

SEQ ID NO: 36681 - RNA, 23 nt, Artificial Sequence
  RNA Oligomer
agccuugcacuccugaauuuuau

SEQ ID NO: 36682 - RNA, 23 nt, Artificial Sequence
  RNA Oligomer
aagccuugcacuccugaauuuua

SEQ ID NO: 36683 - RNA, 23 nt, Artificial Sequence
  RNA Oligomer
gaagccuugcacuccugaauuuu

SEQ ID NO: 36684 - RNA, 23 nt, Artificial Sequence
  RNA Oligomer
ugaagccuugcacuccugaauuu

SEQ ID NO: 36685 - RNA, 23 nt, Artificial Sequence
  RNA Oligomer
guauuaaacucuccuuugauauu

SEQ ID NO: 36686 - RNA, 23 nt, Artificial Sequence
  RNA Oligomer
aguauuaaacucuccuuugauau

SEQ ID NO: 36687 - RNA, 23 nt, Artificial Sequence
  RNA Oligomer
caguauuaaacucuccuuugaua

SEQ ID NO: 36688 - RNA, 23 nt, Artificial Sequence
  RNA Oligomer
ucaguauuaaacucuccuuugau

SEQ ID NO: 36689 - RNA, 23 nt, Artificial Sequence
  RNA Oligomer
uucaguauuaaacucuccuuuga

SEQ ID NO: 36690 - RNA, 23 nt, Artificial Sequence
  RNA Oligomer
ccuugcauuuguaccuuauugau

SEQ ID NO: 36691 - RNA, 23 nt, Artificial Sequence
  RNA Oligomer
ccaucuccuaucuuuuauuucau

SEQ ID NO: 36692 - RNA, 23 nt, Artificial Sequence
  RNA Oligomer
accaucuccuaucuuuuauuuca

SEQ ID NO: 36693 - RNA, 23 nt, Artificial Sequence
  RNA Oligomer
gaccaucuccuaucuuuuauuuc

SEQ ID NO: 36694 - RNA, 23 nt, Artificial Sequence
  RNA Oligomer
agaccaucuccuaucuuuuauuu

SEQ ID NO: 36695 - RNA, 23 nt, Artificial Sequence
  RNA Oligomer
gagaccaucuccuaucuuuuauu

SEQ ID NO: 36696 - RNA, 23 nt, Artificial Sequence
  RNA Oligomer
gccuacagaacaaaccaaaaaug

SEQ ID NO: 36697 - RNA, 23 nt, Artificial Sequence
  RNA Oligomer
agccuacagaacaaaccaaaaau

SEQ ID NO: 36698 - RNA, 23 nt, Artificial Sequence
  RNA Oligomer
aagccuacagaacaaaccaaaaa

SEQ ID NO: 36699 - RNA, 23 nt, Artificial Sequence
  RNA Oligomer
caagccuacagaacaaaccaaaa

SEQ ID NO: 36700 - RNA, 23 nt, Artificial Sequence
  RNA Oligomer
ccaagccuacagaacaaaccaaa

SEQ ID NO: 36701 - RNA, 23 nt, Artificial Sequence
  RNA Oligomer
ucucucccuucuuuaccuucauu

SEQ ID NO: 36702 - RNA, 23 nt, Artificial Sequence
  RNA Oligomer
cucccugcuucauaucucucccu

SEQ ID NO: 36703 - RNA, 23 nt, Artificial Sequence
  RNA Oligomer
ccaucucucucccuuacuauucc

SEQ ID NO: 36704 - RNA, 23 nt, Artificial Sequence
  RNA Oligomer
uccaucucucucccuuacuauuc

SEQ ID NO: 36705 - RNA, 23 nt, Artificial Sequence
  RNA Oligomer
guccaucucucucccuuacuauu

SEQ ID NO: 36706 - RNA, 23 nt, Artificial Sequence
  RNA Oligomer
cguccaucucucucccuuacuau

SEQ ID NO: 36707 - RNA, 23 nt, Artificial Sequence
  RNA Oligomer
acguccaucucucucccuuacua

SEQ ID NO: 36708 - RNA, 23 nt, Artificial Sequence
  RNA Oligomer
gcaaaaugcuaggccuguaguag

SEQ ID NO: 36709 - RNA, 23 nt, Artificial Sequence
  RNA Oligomer
agcaaaaugcuaggccuguagua

SEQ ID NO: 36710 - RNA, 23 nt, Artificial Sequence
  RNA Oligomer
uagcaaaaugcuaggccuguagu

SEQ ID NO: 36711 - RNA, 23 nt, Artificial Sequence
  RNA Oligomer
cuagcaaaaugcuaggccuguag

SEQ ID NO: 36712 - RNA, 23 nt, Artificial Sequence
  RNA Oligomer
ccuagcaaaaugcuaggccugua

SEQ ID NO: 36713 - RNA, 23 nt, Artificial Sequence
  RNA Oligomer
gcagaaaccuuguuuguuuuauu

SEQ ID NO: 36714 - RNA, 23 nt, Artificial Sequence
  RNA Oligomer
ggcagaaaccuuguuuguuuuau

SEQ ID NO: 36715 - RNA, 23 nt, Artificial Sequence
  RNA Oligomer
gggcagaaaccuuguuuguuuua

SEQ ID NO: 36716 - RNA, 23 nt, Artificial Sequence
  RNA Oligomer
agggcagaaaccuuguuuguuuu

SEQ ID NO: 36717 - RNA, 23 nt, Artificial Sequence
  RNA Oligomer
gagggcagaaaccuuguuuguuu

SEQ ID NO: 36718 - RNA, 23 nt, Artificial Sequence
  RNA Oligomer
ccucauuaaauggugauuucuug

SEQ ID NO: 36719 - RNA, 23 nt, Artificial Sequence
  RNA Oligomer
accucauuaaauggugauuucuu

SEQ ID NO: 36720 - RNA, 23 nt, Artificial Sequence
  RNA Oligomer
aaccucauuaaauggugauuucu

SEQ ID NO: 36721 - RNA, 23 nt, Artificial Sequence
  RNA Oligomer
gaaccucauuaaauggugauuuc

SEQ ID NO: 36722 - RNA, 23 nt, Artificial Sequence
  RNA Oligomer
ugaaccucauuaaauggugauuu

SEQ ID NO: 36723 - RNA, 23 nt, Artificial Sequence
  RNA Oligomer
ucucccugcuucauaucucuccc

SEQ ID NO: 36724 - RNA, 23 nt, Artificial Sequence
  RNA Oligomer
aucucccugcuucauaucucucc

SEQ ID NO: 36725 - RNA, 23 nt, Artificial Sequence
  RNA Oligomer
uaucucccugcuucauaucucuc

SEQ ID NO: 36726 - RNA, 23 nt, Artificial Sequence
  RNA Oligomer
uuaucucccugcuucauaucucu

SEQ ID NO: 36727 - RNA, 23 nt, Artificial Sequence
  RNA Oligomer
gcauuuguaccuuauugaucuuu

SEQ ID NO: 36728 - RNA, 23 nt, Artificial Sequence
  RNA Oligomer
ugcauuuguaccuuauugaucuu

SEQ ID NO: 36729 - RNA, 23 nt, Artificial Sequence
  RNA Oligomer
uugcauuuguaccuuauugaucu

SEQ ID NO: 36730 - RNA, 23 nt, Artificial Sequence
  RNA Oligomer
cuugcauuuguaccuuauugauc

SEQ ID NO: 36731 - RNA, 23 nt, Artificial Sequence
  RNA Oligomer
cgacauaguauggaaguauuuga

SEQ ID NO: 36732 - RNA, 23 nt, Artificial Sequence
  RNA Oligomer
ucgacauaguauggaaguauuug

SEQ ID NO: 36733 - RNA, 23 nt, Artificial Sequence
  RNA Oligomer
gucgacauaguauggaaguauuu

SEQ ID NO: 36734 - RNA, 23 nt, Artificial Sequence
  RNA Oligomer
ggucgacauaguauggaaguauu

SEQ ID NO: 36735 - RNA, 23 nt, Artificial Sequence
  RNA Oligomer
gggucgacauaguauggaaguau

SEQ ID NO: 36736 - RNA, 23 nt, Artificial Sequence
  RNA Oligomer
gggccuucauuaaauguuuguug

SEQ ID NO: 36737 - RNA, 23 nt, Artificial Sequence
  RNA Oligomer
ugggccuucauuaaauguuuguu

SEQ ID NO: 36738 - RNA, 23 nt, Artificial Sequence
  RNA Oligomer
gugggccuucauuaaauguuugu

SEQ ID NO: 36739 - RNA, 23 nt, Artificial Sequence
  RNA Oligomer
agugggccuucauuaaauguuug

SEQ ID NO: 36740 - RNA, 23 nt, Artificial Sequence
  RNA Oligomer
uagugggccuucauuaaauguuu

SEQ ID NO: 36741 - RNA, 23 nt, Artificial Sequence
  RNA Oligomer
gcuacuuuuacuuguucauuucu

SEQ ID NO: 36742 - RNA, 23 nt, Artificial Sequence
  RNA Oligomer
ugcuacuuuuacuuguucauuuc

SEQ ID NO: 36743 - RNA, 23 nt, Artificial Sequence
  RNA Oligomer
augcuacuuuuacuuguucauuu

SEQ ID NO: 36744 - RNA, 23 nt, Artificial Sequence
  RNA Oligomer
uaugcuacuuuuacuuguucauu

SEQ ID NO: 36745 - RNA, 23 nt, Artificial Sequence
  RNA Oligomer
auaugcuacuuuuacuuguucau

SEQ ID NO: 36746 - RNA, 23 nt, Artificial Sequence
  RNA Oligomer
cccuugaaccucauuaaauggug

SEQ ID NO: 36747 - RNA, 23 nt, Artificial Sequence
  RNA Oligomer
ccccuugaaccucauuaaauggu

SEQ ID NO: 36748 - RNA, 23 nt, Artificial Sequence
  RNA Oligomer
uccccuugaaccucauuaaaugg

SEQ ID NO: 36749 - RNA, 23 nt, Artificial Sequence
  RNA Oligomer
uuccccuugaaccucauuaaaug

SEQ ID NO: 36750 - RNA, 23 nt, Artificial Sequence
  RNA Oligomer
cuuccccuugaaccucauuaaau

SEQ ID NO: 36751 - RNA, 23 nt, Artificial Sequence
  RNA Oligomer
uccucaacuugcugccuaagagg

SEQ ID NO: 36752 - RNA, 23 nt, Artificial Sequence
  RNA Oligomer
cuccucaacuugcugccuaagag

SEQ ID NO: 36753 - RNA, 23 nt, Artificial Sequence
  RNA Oligomer
acuccucaacuugcugccuaaga

SEQ ID NO: 36754 - RNA, 23 nt, Artificial Sequence
  RNA Oligomer
aacuccucaacuugcugccuaag

SEQ ID NO: 36755 - RNA, 23 nt, Artificial Sequence
  RNA Oligomer
gaacuccucaacuugcugccuaa

SEQ ID NO: 36756 - RNA, 23 nt, Artificial Sequence
  RNA Oligomer
ggaucauguaaaugcucaaagau

SEQ ID NO: 36757 - RNA, 23 nt, Artificial Sequence
  RNA Oligomer
aggaucauguaaaugcucaaaga

SEQ ID NO: 36758 - RNA, 23 nt, Artificial Sequence
  RNA Oligomer
caggaucauguaaaugcucaaag

SEQ ID NO: 36759 - RNA, 23 nt, Artificial Sequence
  RNA Oligomer
acaggaucauguaaaugcucaaa

SEQ ID NO: 36760 - RNA, 23 nt, Artificial Sequence
  RNA Oligomer
uacaggaucauguaaaugcucaa

SEQ ID NO: 36761 - RNA, 23 nt, Artificial Sequence
  RNA Oligomer
caaucaaccugcacuucauaucu

SEQ ID NO: 36762 - RNA, 23 nt, Artificial Sequence
  RNA Oligomer
ucaaucaaccugcacuucauauc

SEQ ID NO: 36763 - RNA, 23 nt, Artificial Sequence
  RNA Oligomer
uucaaucaaccugcacuucauau

SEQ ID NO: 36764 - RNA, 23 nt, Artificial Sequence
  RNA Oligomer
auucaaucaaccugcacuucaua

SEQ ID NO: 36765 - RNA, 23 nt, Artificial Sequence
  RNA Oligomer
cauucaaucaaccugcacuucau

SEQ ID NO: 36766 - RNA, 23 nt, Artificial Sequence
  RNA Oligomer
cgaauuguuagaacaucuucugg

SEQ ID NO: 36767 - RNA, 23 nt, Artificial Sequence
  RNA Oligomer
gcgaauuguuagaacaucuucug

SEQ ID NO: 36768 - RNA, 23 nt, Artificial Sequence
  RNA Oligomer
agcgaauuguuagaacaucuucu

SEQ ID NO: 36769 - RNA, 23 nt, Artificial Sequence
  RNA Oligomer
gagcgaauuguuagaacaucuuc

SEQ ID NO: 36770 - RNA, 23 nt, Artificial Sequence
  RNA Oligomer
ugagcgaauuguuagaacaucuu

SEQ ID NO: 36771 - RNA, 23 nt, Artificial Sequence
  RNA Oligomer
gagauaacuuccuucacaucucc

SEQ ID NO: 36772 - RNA, 23 nt, Artificial Sequence
  RNA Oligomer
ugagauaacuuccuucacaucuc

SEQ ID NO: 36773 - RNA, 23 nt, Artificial Sequence
  RNA Oligomer
gugagauaacuuccuucacaucu

SEQ ID NO: 36774 - RNA, 23 nt, Artificial Sequence
  RNA Oligomer
ugugagauaacuuccuucacauc

SEQ ID NO: 36775 - RNA, 23 nt, Artificial Sequence
  RNA Oligomer
gugugagauaacuuccuucacau

SEQ ID NO: 36776 - RNA, 23 nt, Artificial Sequence
  RNA Oligomer
ugugugagauaacuuccuucaca

SEQ ID NO: 36777 - RNA, 23 nt, Artificial Sequence
  RNA Oligomer
uuuuuccauguguuuugcuuuua

SEQ ID NO: 36778 - RNA, 23 nt, Artificial Sequence
  RNA Oligomer
cucauuaaauggugauuucuugc

SEQ ID NO: 36779 - RNA, 23 nt, Artificial Sequence
  RNA Oligomer
cccuucugcuuucuauuaccccu

SEQ ID NO: 36780 - RNA, 23 nt, Artificial Sequence
  RNA Oligomer
acccuucugcuuucuauuacccc

SEQ ID NO: 36781 - RNA, 23 nt, Artificial Sequence
  RNA Oligomer
aacccuucugcuuucuauuaccc

SEQ ID NO: 36782 - RNA, 23 nt, Artificial Sequence
  RNA Oligomer
gaacccuucugcuuucuauuacc

SEQ ID NO: 36783 - RNA, 23 nt, Artificial Sequence
  RNA Oligomer
agaacccuucugcuuucuauuac

SEQ ID NO: 36784 - RNA, 23 nt, Artificial Sequence
  RNA Oligomer
ggaacuccucaacuugcugccua

SEQ ID NO: 36785 - RNA, 23 nt, Artificial Sequence
  RNA Oligomer
aaaccuuuaucccugcuuaucug

SEQ ID NO: 36786 - RNA, 23 nt, Artificial Sequence
  RNA Oligomer
gaaaccuuuaucccugcuuaucu

SEQ ID NO: 36787 - RNA, 23 nt, Artificial Sequence
  RNA Oligomer
agaaaccuuuaucccugcuuauc

SEQ ID NO: 36788 - RNA, 23 nt, Artificial Sequence
  RNA Oligomer
uagaaaccuuuaucccugcuuau

SEQ ID NO: 36789 - RNA, 23 nt, Artificial Sequence
  RNA Oligomer
cuagaaaccuuuaucccugcuua

SEQ ID NO: 36790 - RNA, 23 nt, Artificial Sequence
  RNA Oligomer
gcuuuuauuucagugccauacau

SEQ ID NO: 36791 - RNA, 23 nt, Artificial Sequence
  RNA Oligomer
ggcuuuuauuucagugccauaca

SEQ ID NO: 36792 - RNA, 23 nt, Artificial Sequence
  RNA Oligomer
uggcuuuuauuucagugccauac

SEQ ID NO: 36793 - RNA, 23 nt, Artificial Sequence
  RNA Oligomer
guggcuuuuauuucagugccaua

SEQ ID NO: 36794 - RNA, 23 nt, Artificial Sequence
  RNA Oligomer
uguggcuuuuauuucagugccau

SEQ ID NO: 36795 - RNA, 23 nt, Artificial Sequence
  RNA Oligomer
aucucucccuucuuuaccuucau

SEQ ID NO: 36796 - RNA, 23 nt, Artificial Sequence
  RNA Oligomer
uaucucucccuucuuuaccuuca

SEQ ID NO: 36797 - RNA, 23 nt, Artificial Sequence
  RNA Oligomer
auaucucucccuucuuuaccuuc

SEQ ID NO: 36798 - RNA, 23 nt, Artificial Sequence
  RNA Oligomer
cauaucucucccuucuuuaccuu

SEQ ID NO: 36799 - RNA, 23 nt, Artificial Sequence
  RNA Oligomer
cuuaucucccugcuucauaucuc

SEQ ID NO: 36800 - RNA, 23 nt, Artificial Sequence
  RNA Oligomer
gcuuaucucccugcuucauaucu

SEQ ID NO: 36801 - RNA, 23 nt, Artificial Sequence
  RNA Oligomer
agcuuaucucccugcuucauauc

SEQ ID NO: 36802 - RNA, 23 nt, Artificial Sequence
  RNA Oligomer
uagcuuaucucccugcuucauau

SEQ ID NO: 36803 - RNA, 23 nt, Artificial Sequence
  RNA Oligomer
ccauggaagucucaaagaucuuu

SEQ ID NO: 36804 - RNA, 23 nt, Artificial Sequence
  RNA Oligomer
cccauggaagucucaaagaucuu

SEQ ID NO: 36805 - RNA, 23 nt, Artificial Sequence
  RNA Oligomer
gcccauggaagucucaaagaucu

SEQ ID NO: 36806 - RNA, 23 nt, Artificial Sequence
  RNA Oligomer
ugcccauggaagucucaaagauc

SEQ ID NO: 36807 - RNA, 23 nt, Artificial Sequence
  RNA Oligomer
uugcccauggaagucucaaagau

SEQ ID NO: 36808 - RNA, 23 nt, Artificial Sequence
  RNA Oligomer
acauugccuugcauuuguaccuu

SEQ ID NO: 36809 - RNA, 23 nt, Artificial Sequence
  RNA Oligomer
ccgcccuuuuuguccuagaguga

SEQ ID NO: 36810 - RNA, 23 nt, Artificial Sequence
  RNA Oligomer
uccgcccuuuuuguccuagagug

SEQ ID NO: 36811 - RNA, 23 nt, Artificial Sequence
  RNA Oligomer
cuccgcccuuuuuguccuagagu

SEQ ID NO: 36812 - RNA, 23 nt, Artificial Sequence
  RNA Oligomer
ccuccgcccuuuuuguccuagag

SEQ ID NO: 36813 - RNA, 23 nt, Artificial Sequence
  RNA Oligomer
uccuccgcccuuuuuguccuaga

SEQ ID NO: 36814 - RNA, 23 nt, Artificial Sequence
  RNA Oligomer
gcaaggagaugucugaauacugc

SEQ ID NO: 36815 - RNA, 23 nt, Artificial Sequence
  RNA Oligomer
ugcaaggagaugucugaauacug

SEQ ID NO: 36816 - RNA, 23 nt, Artificial Sequence
  RNA Oligomer
gugcaaggagaugucugaauacu

SEQ ID NO: 36817 - RNA, 23 nt, Artificial Sequence
  RNA Oligomer
ggugcaaggagaugucugaauac

SEQ ID NO: 36818 - RNA, 23 nt, Artificial Sequence
  RNA Oligomer
cggugcaaggagaugucugaaua

SEQ ID NO: 36819 - RNA, 23 nt, Artificial Sequence
  RNA Oligomer
uugcacuccugaauuuuaucaaa

SEQ ID NO: 36820 - RNA, 23 nt, Artificial Sequence
  RNA Oligomer
cuugcacuccugaauuuuaucaa

SEQ ID NO: 36821 - RNA, 23 nt, Artificial Sequence
  RNA Oligomer
ccuugcacuccugaauuuuauca

SEQ ID NO: 36822 - RNA, 23 nt, Artificial Sequence
  RNA Oligomer
ugggucgacauaguauggaagua

SEQ ID NO: 36823 - RNA, 23 nt, Artificial Sequence
  RNA Oligomer
uugggucgacauaguauggaagu

SEQ ID NO: 36824 - RNA, 23 nt, Artificial Sequence
  RNA Oligomer
uuugggucgacauaguauggaag

SEQ ID NO: 36825 - RNA, 23 nt, Artificial Sequence
  RNA Oligomer
cuuugggucgacauaguauggaa

SEQ ID NO: 36826 - RNA, 23 nt, Artificial Sequence
  RNA Oligomer
gcauuuuuagcuccuugaagaca

SEQ ID NO: 36827 - RNA, 23 nt, Artificial Sequence
  RNA Oligomer
ggcauuuuuagcuccuugaagac

SEQ ID NO: 36828 - RNA, 23 nt, Artificial Sequence
  RNA Oligomer
uggcauuuuuagcuccuugaaga

SEQ ID NO: 36829 - RNA, 23 nt, Artificial Sequence
  RNA Oligomer
cuggcauuuuuagcuccuugaag

SEQ ID NO: 36830 - RNA, 23 nt, Artificial Sequence
  RNA Oligomer
acuggcauuuuuagcuccuugaa

SEQ ID NO: 36831 - RNA, 23 nt, Artificial Sequence
  RNA Oligomer
guacuuuguuuuuccauguguuu

SEQ ID NO: 36832 - RNA, 23 nt, Artificial Sequence
  RNA Oligomer
uguacuuuguuuuuccauguguu

SEQ ID NO: 36833 - RNA, 23 nt, Artificial Sequence
  RNA Oligomer
uuguacuuuguuuuuccaugugu

SEQ ID NO: 36834 - RNA, 23 nt, Artificial Sequence
  RNA Oligomer
uuuguacuuuguuuuuccaugug

SEQ ID NO: 36835 - RNA, 23 nt, Artificial Sequence
  RNA Oligomer
auuuguacuuuguuuuuccaugu

SEQ ID NO: 36836 - RNA, 23 nt, Artificial Sequence
  RNA Oligomer
ugacaauauacacggauuauuau

SEQ ID NO: 36837 - RNA, 23 nt, Artificial Sequence
  RNA Oligomer
uugacaauauacacggauuauua

SEQ ID NO: 36838 - RNA, 23 nt, Artificial Sequence
  RNA Oligomer
uuugacaauauacacggauuauu

SEQ ID NO: 36839 - RNA, 23 nt, Artificial Sequence
  RNA Oligomer
uuuugacaauauacacggauuau

SEQ ID NO: 36840 - RNA, 23 nt, Artificial Sequence
  RNA Oligomer
cuuuugacaauauacacggauua

SEQ ID NO: 36841 - RNA, 23 nt, Artificial Sequence
  RNA Oligomer
gccuucauuaaauguuuguugaa

SEQ ID NO: 36842 - RNA, 23 nt, Artificial Sequence
  RNA Oligomer
ggccuucauuaaauguuuguuga

SEQ ID NO: 36843 - RNA, 23 nt, Artificial Sequence
  RNA Oligomer
ccucucagcuucuaauuuugugc

SEQ ID NO: 36844 - RNA, 23 nt, Artificial Sequence
  RNA Oligomer
uccucucagcuucuaauuuugug

SEQ ID NO: 36845 - RNA, 23 nt, Artificial Sequence
  RNA Oligomer
cuccucucagcuucuaauuuugu

SEQ ID NO: 36846 - RNA, 23 nt, Artificial Sequence
  RNA Oligomer
ucuccucucagcuucuaauuuug

SEQ ID NO: 36847 - RNA, 23 nt, Artificial Sequence
  RNA Oligomer
gucuccucucagcuucuaauuuu

SEQ ID NO: 36848 - RNA, 23 nt, Artificial Sequence
  RNA Oligomer
ccuuugauauuauguggcuuuua

SEQ ID NO: 36849 - RNA, 23 nt, Artificial Sequence
  RNA Oligomer
uccuuugauauuauguggcuuuu

SEQ ID NO: 36850 - RNA, 23 nt, Artificial Sequence
  RNA Oligomer
cuccuuugauauuauguggcuuu

SEQ ID NO: 36851 - RNA, 23 nt, Artificial Sequence
  RNA Oligomer
ucuccuuugauauuauguggcuu

SEQ ID NO: 36852 - RNA, 23 nt, Artificial Sequence
  RNA Oligomer
cucuccuuugauauuauguggcu

SEQ ID NO: 36853 - RNA, 23 nt, Artificial Sequence
  RNA Oligomer
acucuccuuugauauuauguggc

SEQ ID NO: 36854 - RNA, 23 nt, Artificial Sequence
  RNA Oligomer
aacucuccuuugauauuaugugg

SEQ ID NO: 36855 - RNA, 23 nt, Artificial Sequence
  RNA Oligomer
aaacucuccuuugauauuaugug

SEQ ID NO: 36856 - RNA, 23 nt, Artificial Sequence
  RNA Oligomer
uaaacucuccuuugauauuaugu

SEQ ID NO: 36857 - RNA, 23 nt, Artificial Sequence
  RNA Oligomer
uuaaacucuccuuugauauuaug

SEQ ID NO: 36858 - RNA, 23 nt, Artificial Sequence
  RNA Oligomer
aaccugcacuucauaucuagauu

SEQ ID NO: 36859 - RNA, 23 nt, Artificial Sequence
  RNA Oligomer
cccacuuucauucaaucaaccug

SEQ ID NO: 36860 - RNA, 23 nt, Artificial Sequence
  RNA Oligomer
ucccacuuucauucaaucaaccu

SEQ ID NO: 36861 - RNA, 23 nt, Artificial Sequence
  RNA Oligomer
uucccacuuucauucaaucaacc

SEQ ID NO: 36862 - RNA, 23 nt, Artificial Sequence
  RNA Oligomer
auucccacuuucauucaaucaac

SEQ ID NO: 36863 - RNA, 23 nt, Artificial Sequence
  RNA Oligomer
uauucccacuuucauucaaucaa

SEQ ID NO: 36864 - RNA, 23 nt, Artificial Sequence
  RNA Oligomer
agagaccaucuccuaucuuuuau

SEQ ID NO: 36865 - RNA, 23 nt, Artificial Sequence
  RNA Oligomer
cuuuguuuuuccauguguuuugc

SEQ ID NO: 36866 - RNA, 23 nt, Artificial Sequence
  RNA Oligomer
acuuuguuuuuccauguguuuug

SEQ ID NO: 36867 - RNA, 23 nt, Artificial Sequence
  RNA Oligomer
uacuuuguuuuuccauguguuuu

SEQ ID NO: 36868 - RNA, 23 nt, Artificial Sequence
  RNA Oligomer
ccuuguuuguuuuauucaccauc

SEQ ID NO: 36869 - RNA, 23 nt, Artificial Sequence
  RNA Oligomer
accuuguuuguuuuauucaccau

SEQ ID NO: 36870 - RNA, 23 nt, Artificial Sequence
  RNA Oligomer
aaccuuguuuguuuuauucacca

SEQ ID NO: 36871 - RNA, 23 nt, Artificial Sequence
  RNA Oligomer
aaaccuuguuuguuuuauucacc

SEQ ID NO: 36872 - RNA, 23 nt, Artificial Sequence
  RNA Oligomer
gaaaccuuguuuguuuuauucac

SEQ ID NO: 36873 - RNA, 23 nt, Artificial Sequence
  RNA Oligomer
ucaacuugcugccuaagaggggu

SEQ ID NO: 36874 - RNA, 23 nt, Artificial Sequence
  RNA Oligomer
cucaacuugcugccuaagagggg

SEQ ID NO: 36875 - RNA, 23 nt, Artificial Sequence
  RNA Oligomer
ccucaacuugcugccuaagaggg

SEQ ID NO: 36876 - RNA, 23 nt, Artificial Sequence
  RNA Oligomer
ucaaccuagaaaccuuuaucccu

SEQ ID NO: 36877 - RNA, 23 nt, Artificial Sequence
  RNA Oligomer
uucaaccuagaaaccuuuauccc

SEQ ID NO: 36878 - RNA, 23 nt, Artificial Sequence
  RNA Oligomer
uuucaaccuagaaaccuuuaucc

SEQ ID NO: 36879 - RNA, 23 nt, Artificial Sequence
  RNA Oligomer
uuuucaaccuagaaaccuuuauc

SEQ ID NO: 36880 - RNA, 23 nt, Artificial Sequence
  RNA Oligomer
guuuucaaccuagaaaccuuuau

SEQ ID NO: 36881 - RNA, 23 nt, Artificial Sequence
  RNA Oligomer
ucauguaaaugcucaaagaugua

SEQ ID NO: 36882 - RNA, 23 nt, Artificial Sequence
  RNA Oligomer
aucauguaaaugcucaaagaugu

SEQ ID NO: 36883 - RNA, 23 nt, Artificial Sequence
  RNA Oligomer
gaucauguaaaugcucaaagaug

SEQ ID NO: 36884 - RNA, 23 nt, Artificial Sequence
  RNA Oligomer
cuagcuuaucucccugcuucaua

SEQ ID NO: 36885 - RNA, 23 nt, Artificial Sequence
  RNA Oligomer
ccuagcuuaucucccugcuucau

SEQ ID NO: 36886 - RNA, 23 nt, Artificial Sequence
  RNA Oligomer
cacuucauaucuagauuucuaga

SEQ ID NO: 36887 - RNA, 23 nt, Artificial Sequence
  RNA Oligomer
caaccugcacuucauaucuagau

SEQ ID NO: 36888 - RNA, 23 nt, Artificial Sequence
  RNA Oligomer
ccacuuucauucaaucaaccugc

SEQ ID NO: 36889 - RNA, 23 nt, Artificial Sequence
  RNA Oligomer
cccuuacuauucccacuuucauu

SEQ ID NO: 36890 - RNA, 23 nt, Artificial Sequence
  RNA Oligomer
ucccuuacuauucccacuuucau

SEQ ID NO: 36891 - RNA, 23 nt, Artificial Sequence
  RNA Oligomer
cucccuuacuauucccacuuuca

SEQ ID NO: 36892 - RNA, 23 nt, Artificial Sequence
  RNA Oligomer
ucucccuuacuauucccacuuuc

SEQ ID NO: 36893 - RNA, 23 nt, Artificial Sequence
  RNA Oligomer
cucucccuuacuauucccacuuu

SEQ ID NO: 36894 - RNA, 23 nt, Artificial Sequence
  RNA Oligomer
aacguccaucucucucccuuacu

SEQ ID NO: 36895 - RNA, 23 nt, Artificial Sequence
  RNA Oligomer
aaacguccaucucucucccuuac

SEQ ID NO: 36896 - RNA, 23 nt, Artificial Sequence
  RNA Oligomer
gaaacguccaucucucucccuua

SEQ ID NO: 36897 - RNA, 23 nt, Artificial Sequence
  RNA Oligomer
agaaacguccaucucucucccuu

SEQ ID NO: 36898 - RNA, 23 nt, Artificial Sequence
  RNA Oligomer
gaagaagcaaacaugacuagaga

SEQ ID NO: 36899 - RNA, 23 nt, Artificial Sequence
  RNA Oligomer
ugaagaagcaaacaugacuagag

SEQ ID NO: 36900 - RNA, 23 nt, Artificial Sequence
  RNA Oligomer
cugaagaagcaaacaugacuaga

SEQ ID NO: 36901 - RNA, 23 nt, Artificial Sequence
  RNA Oligomer
ucugaagaagcaaacaugacuag

SEQ ID NO: 36902 - RNA, 23 nt, Artificial Sequence
  RNA Oligomer
cucugaagaagcaaacaugacua

SEQ ID NO: 36903 - RNA, 23 nt, Artificial Sequence
  RNA Oligomer
ugacaagugaaguuguaaacaca

SEQ ID NO: 36904 - RNA, 23 nt, Artificial Sequence
  RNA Oligomer
cugacaagugaaguuguaaacac

SEQ ID NO: 36905 - RNA, 23 nt, Artificial Sequence
  RNA Oligomer
ccugacaagugaaguuguaaaca

SEQ ID NO: 36906 - RNA, 23 nt, Artificial Sequence
  RNA Oligomer
gccugacaagugaaguuguaaac

SEQ ID NO: 36907 - RNA, 23 nt, Artificial Sequence
  RNA Oligomer
agccugacaagugaaguuguaaa

SEQ ID NO: 36908 - RNA, 23 nt, Artificial Sequence
  RNA Oligomer
gcccaucaucucugccuuugagu

SEQ ID NO: 36909 - RNA, 23 nt, Artificial Sequence
  RNA Oligomer
ugcccaucaucucugccuuugag

SEQ ID NO: 36910 - RNA, 23 nt, Artificial Sequence
  RNA Oligomer
gugcccaucaucucugccuuuga

SEQ ID NO: 36911 - RNA, 23 nt, Artificial Sequence
  RNA Oligomer
ugugcccaucaucucugccuuug

SEQ ID NO: 36912 - RNA, 23 nt, Artificial Sequence
  RNA Oligomer
cugugcccaucaucucugccuuu

SEQ ID NO: 36913 - RNA, 23 nt, Artificial Sequence
  RNA Oligomer
ggagagugaugccgguaaagaaa

SEQ ID NO: 36914 - RNA, 23 nt, Artificial Sequence
  RNA Oligomer
aggagagugaugccgguaaagaa

SEQ ID NO: 36915 - RNA, 23 nt, Artificial Sequence
  RNA Oligomer
gaggagagugaugccgguaaaga

SEQ ID NO: 36916 - RNA, 23 nt, Artificial Sequence
  RNA Oligomer
cgaggagagugaugccgguaaag

SEQ ID NO: 36917 - RNA, 23 nt, Artificial Sequence
  RNA Oligomer
gcgaggagagugaugccgguaaa

SEQ ID NO: 36918 - RNA, 23 nt, Artificial Sequence
  RNA Oligomer
ccuacagaacaaaccaaaaaugu

SEQ ID NO: 36919 - RNA, 23 nt, Artificial Sequence
  RNA Oligomer
caagagaaacugcagaauuuugc

SEQ ID NO: 36920 - RNA, 23 nt, Artificial Sequence
  RNA Oligomer
gcaagagaaacugcagaauuuug

SEQ ID NO: 36921 - RNA, 23 nt, Artificial Sequence
  RNA Oligomer
ugcaagagaaacugcagaauuuu

SEQ ID NO: 36922 - RNA, 23 nt, Artificial Sequence
  RNA Oligomer
augcaagagaaacugcagaauuu

SEQ ID NO: 36923 - RNA, 23 nt, Artificial Sequence
  RNA Oligomer
aaugcaagagaaacugcagaauu

SEQ ID NO: 36924 - RNA, 23 nt, Artificial Sequence
  RNA Oligomer
cacaggaaaugcaagagaaacug

SEQ ID NO: 36925 - RNA, 23 nt, Artificial Sequence
  RNA Oligomer
gcacaggaaaugcaagagaaacu

SEQ ID NO: 36926 - RNA, 23 nt, Artificial Sequence
  RNA Oligomer
ugcacaggaaaugcaagagaaac

SEQ ID NO: 36927 - RNA, 23 nt, Artificial Sequence
  RNA Oligomer
cugcacaggaaaugcaagagaaa

SEQ ID NO: 36928 - RNA, 23 nt, Artificial Sequence
  RNA Oligomer
acugcacaggaaaugcaagagaa

SEQ ID NO: 36929 - RNA, 23 nt, Artificial Sequence
  RNA Oligomer
guuuuuccauguguuuugcuuuu

SEQ ID NO: 36930 - RNA, 23 nt, Artificial Sequence
  RNA Oligomer
uauaugcuacuuuuacuuguuca

SEQ ID NO: 36931 - RNA, 23 nt, Artificial Sequence
  RNA Oligomer
ugguguccuucuuccucaagucu

SEQ ID NO: 36932 - RNA, 23 nt, Artificial Sequence
  RNA Oligomer
gugguguccuucuuccucaaguc

SEQ ID NO: 36933 - RNA, 23 nt, Artificial Sequence
  RNA Oligomer
ggugguguccuucuuccucaagu

SEQ ID NO: 36934 - RNA, 23 nt, Artificial Sequence
  RNA Oligomer
aggugguguccuucuuccucaag

SEQ ID NO: 36935 - RNA, 23 nt, Artificial Sequence
  RNA Oligomer
caggugguguccuucuuccucaa

SEQ ID NO: 36936 - RNA, 23 nt, Artificial Sequence
  RNA Oligomer
uagaacccuucugcuuucuauua

SEQ ID NO: 36937 - RNA, 23 nt, Artificial Sequence
  RNA Oligomer
uuagaacccuucugcuuucuauu

SEQ ID NO: 36938 - RNA, 23 nt, Artificial Sequence
  RNA Oligomer
cuuagaacccuucugcuuucuau

SEQ ID NO: 36939 - RNA, 23 nt, Artificial Sequence
  RNA Oligomer
uuauuucagugccauacauguua

SEQ ID NO: 36940 - RNA, 23 nt, Artificial Sequence
  RNA Oligomer
uuuauuucagugccauacauguu

SEQ ID NO: 36941 - RNA, 23 nt, Artificial Sequence
  RNA Oligomer
uuuuauuucagugccauacaugu

SEQ ID NO: 36942 - RNA, 23 nt, Artificial Sequence
  RNA Oligomer
cuuuuauuucagugccauacaug

SEQ ID NO: 36943 - RNA, 23 nt, Artificial Sequence
  RNA Oligomer
ucccuagacucuguaaccaccuc

SEQ ID NO: 36944 - RNA, 23 nt, Artificial Sequence
  RNA Oligomer
uucccuagacucuguaaccaccu

SEQ ID NO: 36945 - RNA, 23 nt, Artificial Sequence
  RNA Oligomer
uuucccuagacucuguaaccacc

SEQ ID NO: 36946 - RNA, 23 nt, Artificial Sequence
  RNA Oligomer
guuucccuagacucuguaaccac

SEQ ID NO: 36947 - RNA, 23 nt, Artificial Sequence
  RNA Oligomer
uguuucccuagacucuguaacca

SEQ ID NO: 36948 - RNA, 23 nt, Artificial Sequence
  RNA Oligomer
ggaagucucaaagaucuuucguu

SEQ ID NO: 36949 - RNA, 23 nt, Artificial Sequence
  RNA Oligomer
uggaagucucaaagaucuuucgu

SEQ ID NO: 36950 - RNA, 23 nt, Artificial Sequence
  RNA Oligomer
auggaagucucaaagaucuuucg

SEQ ID NO: 36951 - RNA, 23 nt, Artificial Sequence
  RNA Oligomer
cauggaagucucaaagaucuuuc

SEQ ID NO: 36952 - RNA, 23 nt, Artificial Sequence
  RNA Oligomer
auccuccgcccuuuuuguccuag

SEQ ID NO: 36953 - RNA, 23 nt, Artificial Sequence
  RNA Oligomer
uauccuccgcccuuuuuguccua

SEQ ID NO: 36954 - RNA, 23 nt, Artificial Sequence
  RNA Oligomer
ggagagggcauauaaauucccca

SEQ ID NO: 36955 - RNA, 23 nt, Artificial Sequence
  RNA Oligomer
gggagagggcauauaaauucccc

SEQ ID NO: 36956 - RNA, 23 nt, Artificial Sequence
  RNA Oligomer
ggggagagggcauauaaauuccc

SEQ ID NO: 36957 - RNA, 23 nt, Artificial Sequence
  RNA Oligomer
uggggagagggcauauaaauucc

SEQ ID NO: 36958 - RNA, 23 nt, Artificial Sequence
  RNA Oligomer
auggggagagggcauauaaauuc

SEQ ID NO: 36959 - RNA, 23 nt, Artificial Sequence
  RNA Oligomer
gagccugacaagugaaguuguaa

SEQ ID NO: 36960 - RNA, 23 nt, Artificial Sequence
  RNA Oligomer
agagccugacaagugaaguugua

SEQ ID NO: 36961 - RNA, 23 nt, Artificial Sequence
  RNA Oligomer
cccaucaucucugccuuugagug

SEQ ID NO: 36962 - RNA, 23 nt, Artificial Sequence
  RNA Oligomer
agacaugauaugcggcuaugccu

SEQ ID NO: 36963 - RNA, 23 nt, Artificial Sequence
  RNA Oligomer
cagacaugauaugcggcuaugcc

SEQ ID NO: 36964 - RNA, 23 nt, Artificial Sequence
  RNA Oligomer
ucagacaugauaugcggcuaugc

SEQ ID NO: 36965 - RNA, 23 nt, Artificial Sequence
  RNA Oligomer
cucagacaugauaugcggcuaug

SEQ ID NO: 36966 - RNA, 23 nt, Artificial Sequence
  RNA Oligomer
gcucagacaugauaugcggcuau

SEQ ID NO: 36967 - RNA, 23 nt, Artificial Sequence
  RNA Oligomer
gcaggauauugggaguguguggc

SEQ ID NO: 36968 - RNA, 23 nt, Artificial Sequence
  RNA Oligomer
cgcaggauauugggagugugugg

SEQ ID NO: 36969 - RNA, 23 nt, Artificial Sequence
  RNA Oligomer
acgcaggauauugggagugugug

SEQ ID NO: 36970 - RNA, 23 nt, Artificial Sequence
  RNA Oligomer
gacgcaggauauugggagugugu

SEQ ID NO: 36971 - RNA, 23 nt, Artificial Sequence
  RNA Oligomer
ggacgcaggauauugggagugug

SEQ ID NO: 36972 - RNA, 23 nt, Artificial Sequence
  RNA Oligomer
agagaaacugcagaauuuugcac

SEQ ID NO: 36973 - RNA, 23 nt, Artificial Sequence
  RNA Oligomer
aagagaaacugcagaauuuugca

SEQ ID NO: 36974 - RNA, 23 nt, Artificial Sequence
  RNA Oligomer
gggacgcaggauauugggagugu

SEQ ID NO: 36975 - RNA, 23 nt, Artificial Sequence
  RNA Oligomer
gcauauagguugcagucucggcc

SEQ ID NO: 36976 - RNA, 23 nt, Artificial Sequence
  RNA Oligomer
ggcauauagguugcagucucggc

SEQ ID NO: 36977 - RNA, 23 nt, Artificial Sequence
  RNA Oligomer
uggcauauagguugcagucucgg

SEQ ID NO: 36978 - RNA, 23 nt, Artificial Sequence
  RNA Oligomer
cuggcauauagguugcagucucg

SEQ ID NO: 36979 - RNA, 23 nt, Artificial Sequence
  RNA Oligomer
gcuggcauauagguugcagucuc

SEQ ID NO: 36980 - RNA, 23 nt, Artificial Sequence
  RNA Oligomer
gugaagccuugcacuccugaauu

SEQ ID NO: 36981 - RNA, 23 nt, Artificial Sequence
  RNA Oligomer
ccaggauuuuguauugccaucgg

SEQ ID NO: 36982 - RNA, 23 nt, Artificial Sequence
  RNA Oligomer
gccaggauuuuguauugccaucg

SEQ ID NO: 36983 - RNA, 23 nt, Artificial Sequence
  RNA Oligomer
ugccaggauuuuguauugccauc

SEQ ID NO: 36984 - RNA, 23 nt, Artificial Sequence
  RNA Oligomer
cugccaggauuuuguauugccau

SEQ ID NO: 36985 - RNA, 23 nt, Artificial Sequence
  RNA Oligomer
acugccaggauuuuguauugcca

SEQ ID NO: 36986 - RNA, 23 nt, Artificial Sequence
  RNA Oligomer
gacauaguauggaaguauuugag

SEQ ID NO: 36987 - RNA, 23 nt, Artificial Sequence
  RNA Oligomer
gcuuuuauccacuggcauuuuua

SEQ ID NO: 36988 - RNA, 23 nt, Artificial Sequence
  RNA Oligomer
ugcuuuuauccacuggcauuuuu

SEQ ID NO: 36989 - RNA, 23 nt, Artificial Sequence
  RNA Oligomer
uugcuuuuauccacuggcauuuu

SEQ ID NO: 36990 - RNA, 23 nt, Artificial Sequence
  RNA Oligomer
uuugcuuuuauccacuggcauuu

SEQ ID NO: 36991 - RNA, 23 nt, Artificial Sequence
  RNA Oligomer
uuuugcuuuuauccacuggcauu

SEQ ID NO: 36992 - RNA, 23 nt, Artificial Sequence
  RNA Oligomer
cuacaauccuaccuuuugauaaa

SEQ ID NO: 36993 - RNA, 23 nt, Artificial Sequence
  RNA Oligomer
gcuacaauccuaccuuuugauaa

SEQ ID NO: 36994 - RNA, 23 nt, Artificial Sequence
  RNA Oligomer
agcuacaauccuaccuuuugaua

SEQ ID NO: 36995 - RNA, 23 nt, Artificial Sequence
  RNA Oligomer
uagcuacaauccuaccuuuugau

SEQ ID NO: 36996 - RNA, 23 nt, Artificial Sequence
  RNA Oligomer
uuagcuacaauccuaccuuuuga

SEQ ID NO: 36997 - RNA, 23 nt, Artificial Sequence
  RNA Oligomer
cagaaaccuuguuuguuuuauuc

SEQ ID NO: 36998 - RNA, 23 nt, Artificial Sequence
  RNA Oligomer
ccuugaaccucauuaaaugguga

SEQ ID NO: 36999 - RNA, 23 nt, Artificial Sequence
  RNA Oligomer
caaccuagaaaccuuuaucccug

SEQ ID NO: 37000 - RNA, 23 nt, Artificial Sequence
  RNA Oligomer
cuuugauauuauguggcuuuuau

SEQ ID NO: 37001 - RNA, 23 nt, Artificial Sequence
  RNA Oligomer
uccugagaaacguccaucucucu

SEQ ID NO: 37002 - RNA, 23 nt, Artificial Sequence
  RNA Oligomer
uuccugagaaacguccaucucuc

SEQ ID NO: 37003 - RNA, 23 nt, Artificial Sequence
  RNA Oligomer
cuuccugagaaacguccaucucu

SEQ ID NO: 37004 - RNA, 23 nt, Artificial Sequence
  RNA Oligomer
ccuuccugagaaacguccaucuc

SEQ ID NO: 37005 - RNA, 23 nt, Artificial Sequence
  RNA Oligomer
uccuuccugagaaacguccaucu

SEQ ID NO: 37006 - RNA, 23 nt, Artificial Sequence
  RNA Oligomer
cccuagacucuguaaccaccucu

SEQ ID NO: 37007 - RNA, 23 nt, Artificial Sequence
  RNA Oligomer
ggacacucuuggcucguuugggc

SEQ ID NO: 37008 - RNA, 23 nt, Artificial Sequence
  RNA Oligomer
aggacacucuuggcucguuuggg

SEQ ID NO: 37009 - RNA, 23 nt, Artificial Sequence
  RNA Oligomer
aaggacacucuuggcucguuugg

SEQ ID NO: 37010 - RNA, 23 nt, Artificial Sequence
  RNA Oligomer
gaaggacacucuuggcucguuug

SEQ ID NO: 37011 - RNA, 23 nt, Artificial Sequence
  RNA Oligomer
ggaaggacacucuuggcucguuu

SEQ ID NO: 37012 - RNA, 23 nt, Artificial Sequence
  RNA Oligomer
gaagcaaacaugacuagagacgc

SEQ ID NO: 37013 - RNA, 23 nt, Artificial Sequence
  RNA Oligomer
agaagcaaacaugacuagagacg

SEQ ID NO: 37014 - RNA, 23 nt, Artificial Sequence
  RNA Oligomer
aagaagcaaacaugacuagagac

SEQ ID NO: 37015 - RNA, 23 nt, Artificial Sequence
  RNA Oligomer
ggacaucaucaccuuggaaauga

SEQ ID NO: 37016 - RNA, 23 nt, Artificial Sequence
  RNA Oligomer
aggacaucaucaccuuggaaaug

SEQ ID NO: 37017 - RNA, 23 nt, Artificial Sequence
  RNA Oligomer
aaggacaucaucaccuuggaaau

SEQ ID NO: 37018 - RNA, 23 nt, Artificial Sequence
  RNA Oligomer
gaaggacaucaucaccuuggaaa

SEQ ID NO: 37019 - RNA, 23 nt, Artificial Sequence
  RNA Oligomer
agaaggacaucaucaccuuggaa

SEQ ID NO: 37020 - RNA, 23 nt, Artificial Sequence
  RNA Oligomer
gagagaccaucuccuaucuuuua

SEQ ID NO: 37021 - RNA, 23 nt, Artificial Sequence
  RNA Oligomer
ccauauuuguguucaguuccagc

SEQ ID NO: 37022 - RNA, 23 nt, Artificial Sequence
  RNA Oligomer
cccauauuuguguucaguuccag

SEQ ID NO: 37023 - RNA, 23 nt, Artificial Sequence
  RNA Oligomer
ccccauauuuguguucaguucca

SEQ ID NO: 37024 - RNA, 23 nt, Artificial Sequence
  RNA Oligomer
uccccauauuuguguucaguucc

SEQ ID NO: 37025 - RNA, 23 nt, Artificial Sequence
  RNA Oligomer
uuccccauauuuguguucaguuc

SEQ ID NO: 37026 - RNA, 23 nt, Artificial Sequence
  RNA Oligomer
ccaucaucucugccuuugagugu

SEQ ID NO: 37027 - RNA, 23 nt, Artificial Sequence
  RNA Oligomer
uugagcgaauuguuagaacaucu

SEQ ID NO: 37028 - RNA, 23 nt, Artificial Sequence
  RNA Oligomer
cagaauuccaccggugcaaggag

SEQ ID NO: 37029 - RNA, 23 nt, Artificial Sequence
  RNA Oligomer
acagaauuccaccggugcaagga

SEQ ID NO: 37030 - RNA, 23 nt, Artificial Sequence
  RNA Oligomer
cacagaauuccaccggugcaagg

SEQ ID NO: 37031 - RNA, 23 nt, Artificial Sequence
  RNA Oligomer
gcacagaauuccaccggugcaag

SEQ ID NO: 37032 - RNA, 23 nt, Artificial Sequence
  RNA Oligomer
ggcacagaauuccaccggugcaa

SEQ ID NO: 37033 - RNA, 23 nt, Artificial Sequence
  RNA Oligomer
acaugcugguuaaggugaacgca

SEQ ID NO: 37034 - RNA, 23 nt, Artificial Sequence
  RNA Oligomer
gacaugcugguuaaggugaacgc

SEQ ID NO: 37035 - RNA, 23 nt, Artificial Sequence
  RNA Oligomer
cgacaugcugguuaaggugaacg

SEQ ID NO: 37036 - RNA, 23 nt, Artificial Sequence
  RNA Oligomer
ccgacaugcugguuaaggugaac

SEQ ID NO: 37037 - RNA, 23 nt, Artificial Sequence
  RNA Oligomer
gccgacaugcugguuaaggugaa

SEQ ID NO: 37038 - RNA, 23 nt, Artificial Sequence
  RNA Oligomer
ggccgacaugcugguuaagguga

SEQ ID NO: 37039 - RNA, 23 nt, Artificial Sequence
  RNA Oligomer
uggccgacaugcugguuaaggug

SEQ ID NO: 37040 - RNA, 23 nt, Artificial Sequence
  RNA Oligomer
guggccgacaugcugguuaaggu

SEQ ID NO: 37041 - RNA, 23 nt, Artificial Sequence
  RNA Oligomer
ccguggagaugagacugaucgug

SEQ ID NO: 37042 - RNA, 23 nt, Artificial Sequence
  RNA Oligomer
gccguggagaugagacugaucgu

SEQ ID NO: 37043 - RNA, 23 nt, Artificial Sequence
  RNA Oligomer
ugccguggagaugagacugaucg

SEQ ID NO: 37044 - RNA, 23 nt, Artificial Sequence
  RNA Oligomer
cugccguggagaugagacugauc

SEQ ID NO: 37045 - RNA, 23 nt, Artificial Sequence
  RNA Oligomer
ccugccguggagaugagacugau

SEQ ID NO: 37046 - RNA, 23 nt, Artificial Sequence
  RNA Oligomer
ccauguucuaugugaccagacug

SEQ ID NO: 37047 - RNA, 23 nt, Artificial Sequence
  RNA Oligomer
uccauguucuaugugaccagacu

SEQ ID NO: 37048 - RNA, 23 nt, Artificial Sequence
  RNA Oligomer
guccauguucuaugugaccagac

SEQ ID NO: 37049 - RNA, 23 nt, Artificial Sequence
  RNA Oligomer
cguccauguucuaugugaccaga

SEQ ID NO: 37050 - RNA, 23 nt, Artificial Sequence
  RNA Oligomer
acguccauguucuaugugaccag

SEQ ID NO: 37051 - RNA, 23 nt, Artificial Sequence
  RNA Oligomer
ggaaguauuugagagagagaacc

SEQ ID NO: 37052 - RNA, 23 nt, Artificial Sequence
  RNA Oligomer
uggaaguauuugagagagagaac

SEQ ID NO: 37053 - RNA, 23 nt, Artificial Sequence
  RNA Oligomer
auggaaguauuugagagagagaa

SEQ ID NO: 37054 - RNA, 23 nt, Artificial Sequence
  RNA Oligomer
uauggaaguauuugagagagaga

SEQ ID NO: 37055 - RNA, 23 nt, Artificial Sequence
  RNA Oligomer
guauggaaguauuugagagagag

SEQ ID NO: 37056 - RNA, 23 nt, Artificial Sequence
  RNA Oligomer
caaaaugcuaggccuguaguagu

SEQ ID NO: 37057 - RNA, 23 nt, Artificial Sequence
  RNA Oligomer
cuuuuauccacuggcauuuuuag

SEQ ID NO: 37058 - RNA, 23 nt, Artificial Sequence
  RNA Oligomer
guuuugcuuuuauccacuggcau

SEQ ID NO: 37059 - RNA, 23 nt, Artificial Sequence
  RNA Oligomer
guguuuugcuuuuauccacuggc

SEQ ID NO: 37060 - RNA, 23 nt, Artificial Sequence
  RNA Oligomer
uguguuuugcuuuuauccacugg

SEQ ID NO: 37061 - RNA, 23 nt, Artificial Sequence
  RNA Oligomer
auguguuuugcuuuuauccacug

SEQ ID NO: 37062 - RNA, 23 nt, Artificial Sequence
  RNA Oligomer
cauguguuuugcuuuuauccacu

SEQ ID NO: 37063 - RNA, 23 nt, Artificial Sequence
  RNA Oligomer
gacaauauacacggauuauuauu

SEQ ID NO: 37064 - RNA, 23 nt, Artificial Sequence
  RNA Oligomer
auauaugcuacuuuuacuuguuc

SEQ ID NO: 37065 - RNA, 23 nt, Artificial Sequence
  RNA Oligomer
ccucaagucuugacaauucccgg

SEQ ID NO: 37066 - RNA, 23 nt, Artificial Sequence
  RNA Oligomer
uccucaagucuugacaauucccg

SEQ ID NO: 37067 - RNA, 23 nt, Artificial Sequence
  RNA Oligomer
uuccucaagucuugacaauuccc

SEQ ID NO: 37068 - RNA, 23 nt, Artificial Sequence
  RNA Oligomer
cuuccucaagucuugacaauucc

SEQ ID NO: 37069 - RNA, 23 nt, Artificial Sequence
  RNA Oligomer
ucuuccucaagucuugacaauuc

SEQ ID NO: 37070 - RNA, 23 nt, Artificial Sequence
  RNA Oligomer
ggugauuucuugcuaagcuccag

SEQ ID NO: 37071 - RNA, 23 nt, Artificial Sequence
  RNA Oligomer
uggugauuucuugcuaagcucca

SEQ ID NO: 37072 - RNA, 23 nt, Artificial Sequence
  RNA Oligomer
auggugauuucuugcuaagcucc

SEQ ID NO: 37073 - RNA, 23 nt, Artificial Sequence
  RNA Oligomer
aauggugauuucuugcuaagcuc

SEQ ID NO: 37074 - RNA, 23 nt, Artificial Sequence
  RNA Oligomer
aaauggugauuucuugcuaagcu

SEQ ID NO: 37075 - RNA, 23 nt, Artificial Sequence
  RNA Oligomer
caacuucccuguucuuuaagacu

SEQ ID NO: 37076 - RNA, 23 nt, Artificial Sequence
  RNA Oligomer
ccaacuucccuguucuuuaagac

SEQ ID NO: 37077 - RNA, 23 nt, Artificial Sequence
  RNA Oligomer
cccaacuucccuguucuuuaaga

SEQ ID NO: 37078 - RNA, 23 nt, Artificial Sequence
  RNA Oligomer
ucccaacuucccuguucuuuaag

SEQ ID NO: 37079 - RNA, 23 nt, Artificial Sequence
  RNA Oligomer
uucccaacuucccuguucuuuaa

SEQ ID NO: 37080 - RNA, 23 nt, Artificial Sequence
  RNA Oligomer
ccuuuaucccugcuuaucugaaa

SEQ ID NO: 37081 - RNA, 23 nt, Artificial Sequence
  RNA Oligomer
accuuuaucccugcuuaucugaa

SEQ ID NO: 37082 - RNA, 23 nt, Artificial Sequence
  RNA Oligomer
aaccuuuaucccugcuuaucuga

SEQ ID NO: 37083 - RNA, 23 nt, Artificial Sequence
  RNA Oligomer
ucagugccauacauguuauuguu

SEQ ID NO: 37084 - RNA, 23 nt, Artificial Sequence
  RNA Oligomer
uucagugccauacauguuauugu

SEQ ID NO: 37085 - RNA, 23 nt, Artificial Sequence
  RNA Oligomer
uuucagugccauacauguuauug

SEQ ID NO: 37086 - RNA, 23 nt, Artificial Sequence
  RNA Oligomer
auuucagugccauacauguuauu

SEQ ID NO: 37087 - RNA, 23 nt, Artificial Sequence
  RNA Oligomer
uauuucagugccauacauguuau

SEQ ID NO: 37088 - RNA, 23 nt, Artificial Sequence
  RNA Oligomer
ucaaccugcacuucauaucuaga

SEQ ID NO: 37089 - RNA, 23 nt, Artificial Sequence
  RNA Oligomer
aucaaccugcacuucauaucuag

SEQ ID NO: 37090 - RNA, 23 nt, Artificial Sequence
  RNA Oligomer
aaucaaccugcacuucauaucua

SEQ ID NO: 37091 - RNA, 23 nt, Artificial Sequence
  RNA Oligomer
ccaccucucugucuuuuuccuuc

SEQ ID NO: 37092 - RNA, 23 nt, Artificial Sequence
  RNA Oligomer
accaccucucugucuuuuuccuu

SEQ ID NO: 37093 - RNA, 23 nt, Artificial Sequence
  RNA Oligomer
aaccaccucucugucuuuuuccu

SEQ ID NO: 37094 - RNA, 23 nt, Artificial Sequence
  RNA Oligomer
guaaccaccucucugucuuuuuc

SEQ ID NO: 37095 - RNA, 23 nt, Artificial Sequence
  RNA Oligomer
ugagcuuuguuacugaaaugagc

SEQ ID NO: 37096 - RNA, 23 nt, Artificial Sequence
  RNA Oligomer
cugagcuuuguuacugaaaugag

SEQ ID NO: 37097 - RNA, 23 nt, Artificial Sequence
  RNA Oligomer
ucugagcuuuguuacugaaauga

SEQ ID NO: 37098 - RNA, 23 nt, Artificial Sequence
  RNA Oligomer
cucugagcuuuguuacugaaaug

SEQ ID NO: 37099 - RNA, 23 nt, Artificial Sequence
  RNA Oligomer
ucucugagcuuuguuacugaaau

SEQ ID NO: 37100 - RNA, 23 nt, Artificial Sequence
  RNA Oligomer
ccuuauugaucuuugcccaugga

SEQ ID NO: 37101 - RNA, 23 nt, Artificial Sequence
  RNA Oligomer
accuuauugaucuuugcccaugg

SEQ ID NO: 37102 - RNA, 23 nt, Artificial Sequence
  RNA Oligomer
uaccuuauugaucuuugcccaug

SEQ ID NO: 37103 - RNA, 23 nt, Artificial Sequence
  RNA Oligomer
guaccuuauugaucuuugcccau

SEQ ID NO: 37104 - RNA, 23 nt, Artificial Sequence
  RNA Oligomer
uguaccuuauugaucuuugccca

SEQ ID NO: 37105 - RNA, 23 nt, Artificial Sequence
  RNA Oligomer
gacaucaucaccuuggaaaugag

SEQ ID NO: 37106 - RNA, 23 nt, Artificial Sequence
  RNA Oligomer
acauuaguuaagaugucugagag

SEQ ID NO: 37107 - RNA, 23 nt, Artificial Sequence
  RNA Oligomer
uacauuaguuaagaugucugaga

SEQ ID NO: 37108 - RNA, 23 nt, Artificial Sequence
  RNA Oligomer
uuacauuaguuaagaugucugag

SEQ ID NO: 37109 - RNA, 23 nt, Artificial Sequence
  RNA Oligomer
uauuacauuaguuaagaugucug

SEQ ID NO: 37110 - RNA, 23 nt, Artificial Sequence
  RNA Oligomer
auuccccauauuuguguucaguu

SEQ ID NO: 37111 - RNA, 23 nt, Artificial Sequence
  RNA Oligomer
uauggggagagggcauauaaauu

SEQ ID NO: 37112 - RNA, 23 nt, Artificial Sequence
  RNA Oligomer
aagagccugacaagugaaguugu

SEQ ID NO: 37113 - RNA, 23 nt, Artificial Sequence
  RNA Oligomer
gaagagccugacaagugaaguug

SEQ ID NO: 37114 - RNA, 23 nt, Artificial Sequence
  RNA Oligomer
ugaagagccugacaagugaaguu

SEQ ID NO: 37115 - RNA, 23 nt, Artificial Sequence
  RNA Oligomer
ccuuuucugugaagcccuuugcc

SEQ ID NO: 37116 - RNA, 23 nt, Artificial Sequence
  RNA Oligomer
uccuuuucugugaagcccuuugc

SEQ ID NO: 37117 - RNA, 23 nt, Artificial Sequence
  RNA Oligomer
cuccuuuucugugaagcccuuug

SEQ ID NO: 37118 - RNA, 23 nt, Artificial Sequence
  RNA Oligomer
gcuccuuuucugugaagcccuuu

SEQ ID NO: 37119 - RNA, 23 nt, Artificial Sequence
  RNA Oligomer
agcuccuuuucugugaagcccuu

SEQ ID NO: 37120 - RNA, 23 nt, Artificial Sequence
  RNA Oligomer
ggagaugucugaauacugcagca

SEQ ID NO: 37121 - RNA, 23 nt, Artificial Sequence
  RNA Oligomer
aggagaugucugaauacugcagc

SEQ ID NO: 37122 - RNA, 23 nt, Artificial Sequence
  RNA Oligomer
aaggagaugucugaauacugcag

SEQ ID NO: 37123 - RNA, 23 nt, Artificial Sequence
  RNA Oligomer
caaggagaugucugaauacugca

SEQ ID NO: 37124 - RNA, 23 nt, Artificial Sequence
  RNA Oligomer
cgcgcucagacaugauaugcggc

SEQ ID NO: 37125 - RNA, 23 nt, Artificial Sequence
  RNA Oligomer
acgcgcucagacaugauaugcgg

SEQ ID NO: 37126 - RNA, 23 nt, Artificial Sequence
  RNA Oligomer
cacgcgcucagacaugauaugcg

SEQ ID NO: 37127 - RNA, 23 nt, Artificial Sequence
  RNA Oligomer
ccacgcgcucagacaugauaugc

SEQ ID NO: 37128 - RNA, 23 nt, Artificial Sequence
  RNA Oligomer
cccacgcgcucagacaugauaug

SEQ ID NO: 37129 - RNA, 23 nt, Artificial Sequence
  RNA Oligomer
ccagacugcacaggaaaugcaag

SEQ ID NO: 37130 - RNA, 23 nt, Artificial Sequence
  RNA Oligomer
accagacugcacaggaaaugcaa

SEQ ID NO: 37131 - RNA, 23 nt, Artificial Sequence
  RNA Oligomer
gaccagacugcacaggaaaugca

SEQ ID NO: 37132 - RNA, 23 nt, Artificial Sequence
  RNA Oligomer
ugaccagacugcacaggaaaugc

SEQ ID NO: 37133 - RNA, 23 nt, Artificial Sequence
  RNA Oligomer
gugaccagacugcacaggaaaug

SEQ ID NO: 37134 - RNA, 23 nt, Artificial Sequence
  RNA Oligomer
ugugaccagacugcacaggaaau

SEQ ID NO: 37135 - RNA, 23 nt, Artificial Sequence
  RNA Oligomer
augugaccagacugcacaggaaa

SEQ ID NO: 37136 - RNA, 23 nt, Artificial Sequence
  RNA Oligomer
uaugugaccagacugcacaggaa

SEQ ID NO: 37137 - RNA, 23 nt, Artificial Sequence
  RNA Oligomer
ucaucaucaggaaacucuaaaaa

SEQ ID NO: 37138 - RNA, 23 nt, Artificial Sequence
  RNA Oligomer
cucaucaucaggaaacucuaaaa

SEQ ID NO: 37139 - RNA, 23 nt, Artificial Sequence
  RNA Oligomer
ccucaucaucaggaaacucuaaa

SEQ ID NO: 37140 - RNA, 23 nt, Artificial Sequence
  RNA Oligomer
uccucaucaucaggaaacucuaa

SEQ ID NO: 37141 - RNA, 23 nt, Artificial Sequence
  RNA Oligomer
auccucaucaucaggaaacucua

SEQ ID NO: 37142 - RNA, 23 nt, Artificial Sequence
  RNA Oligomer
cacugccaggauuuuguauugcc

SEQ ID NO: 37143 - RNA, 23 nt, Artificial Sequence
  RNA Oligomer
ccacugccaggauuuuguauugc

SEQ ID NO: 37144 - RNA, 23 nt, Artificial Sequence
  RNA Oligomer
cccacugccaggauuuuguauug

SEQ ID NO: 37145 - RNA, 23 nt, Artificial Sequence
  RNA Oligomer
ucccacugccaggauuuuguauu

SEQ ID NO: 37146 - RNA, 23 nt, Artificial Sequence
  RNA Oligomer
cucccacugccaggauuuuguau

SEQ ID NO: 37147 - RNA, 23 nt, Artificial Sequence
  RNA Oligomer
acucccacugccaggauuuugua

SEQ ID NO: 37148 - RNA, 23 nt, Artificial Sequence
  RNA Oligomer
cuaggccuguaguagucaaggug

SEQ ID NO: 37149 - RNA, 23 nt, Artificial Sequence
  RNA Oligomer
gcuaggccuguaguagucaaggu

SEQ ID NO: 37150 - RNA, 23 nt, Artificial Sequence
  RNA Oligomer
ugcuaggccuguaguagucaagg

SEQ ID NO: 37151 - RNA, 23 nt, Artificial Sequence
  RNA Oligomer
augcuaggccuguaguagucaag

SEQ ID NO: 37152 - RNA, 23 nt, Artificial Sequence
  RNA Oligomer
aaugcuaggccuguaguagucaa

SEQ ID NO: 37153 - RNA, 23 nt, Artificial Sequence
  RNA Oligomer
uguuuuuccauguguuuugcuuu

SEQ ID NO: 37154 - RNA, 23 nt, Artificial Sequence
  RNA Oligomer
uuguuuuuccauguguuuugcuu

SEQ ID NO: 37155 - RNA, 23 nt, Artificial Sequence
  RNA Oligomer
uuuguuuuuccauguguuuugcu

SEQ ID NO: 37156 - RNA, 23 nt, Artificial Sequence
  RNA Oligomer
cuuagcuacaauccuaccuuuug

SEQ ID NO: 37157 - RNA, 23 nt, Artificial Sequence
  RNA Oligomer
ccuuagcuacaauccuaccuuuu

SEQ ID NO: 37158 - RNA, 23 nt, Artificial Sequence
  RNA Oligomer
accuuagcuacaauccuaccuuu

SEQ ID NO: 37159 - RNA, 23 nt, Artificial Sequence
  RNA Oligomer
aaccuuagcuacaauccuaccuu

SEQ ID NO: 37160 - RNA, 23 nt, Artificial Sequence
  RNA Oligomer
auagugggccuucauuaaauguu

SEQ ID NO: 37161 - RNA, 23 nt, Artificial Sequence
  RNA Oligomer
ucaggugguguccuucuuccuca

SEQ ID NO: 37162 - RNA, 23 nt, Artificial Sequence
  RNA Oligomer
uaaauggugauuucuugcuaagc

SEQ ID NO: 37163 - RNA, 23 nt, Artificial Sequence
  RNA Oligomer
uuaaauggugauuucuugcuaag

SEQ ID NO: 37164 - RNA, 23 nt, Artificial Sequence
  RNA Oligomer
auuaaauggugauuucuugcuaa

SEQ ID NO: 37165 - RNA, 23 nt, Artificial Sequence
  RNA Oligomer
cauuaaauggugauuucuugcua

SEQ ID NO: 37166 - RNA, 23 nt, Artificial Sequence
  RNA Oligomer
cuucccaacuucccuguucuuua

SEQ ID NO: 37167 - RNA, 23 nt, Artificial Sequence
  RNA Oligomer
ugcucaaagauguaauguaguuc

SEQ ID NO: 37168 - RNA, 23 nt, Artificial Sequence
  RNA Oligomer
augcucaaagauguaauguaguu

SEQ ID NO: 37169 - RNA, 23 nt, Artificial Sequence
  RNA Oligomer
aaugcucaaagauguaauguagu

SEQ ID NO: 37170 - RNA, 23 nt, Artificial Sequence
  RNA Oligomer
aaaugcucaaagauguaauguag

SEQ ID NO: 37171 - RNA, 23 nt, Artificial Sequence
  RNA Oligomer
uaaaugcucaaagauguaaugua

SEQ ID NO: 37172 - RNA, 23 nt, Artificial Sequence
  RNA Oligomer
ugucuagaauccugcuuuacagg

SEQ ID NO: 37173 - RNA, 23 nt, Artificial Sequence
  RNA Oligomer
cugucuagaauccugcuuuacag

SEQ ID NO: 37174 - RNA, 23 nt, Artificial Sequence
  RNA Oligomer
ucugucuagaauccugcuuuaca

SEQ ID NO: 37175 - RNA, 23 nt, Artificial Sequence
  RNA Oligomer
aucugucuagaauccugcuuuac

SEQ ID NO: 37176 - RNA, 23 nt, Artificial Sequence
  RNA Oligomer
aaucugucuagaauccugcuuua

SEQ ID NO: 37177 - RNA, 23 nt, Artificial Sequence
  RNA Oligomer
aaaucugucuagaauccugcuuu

SEQ ID NO: 37178 - RNA, 23 nt, Artificial Sequence
  RNA Oligomer
ccuucuuuaccuucauuucaucc

SEQ ID NO: 37179 - RNA, 23 nt, Artificial Sequence
  RNA Oligomer
agacucuguaaccaccucucugu

SEQ ID NO: 37180 - RNA, 23 nt, Artificial Sequence
  RNA Oligomer
uagacucuguaaccaccucucug

SEQ ID NO: 37181 - RNA, 23 nt, Artificial Sequence
  RNA Oligomer
cuagacucuguaaccaccucucu

SEQ ID NO: 37182 - RNA, 23 nt, Artificial Sequence
  RNA Oligomer
ccuagacucuguaaccaccucuc

SEQ ID NO: 37183 - RNA, 23 nt, Artificial Sequence
  RNA Oligomer
caggaagaaugguguguuucccu

SEQ ID NO: 37184 - RNA, 23 nt, Artificial Sequence
  RNA Oligomer
ccaggaagaaugguguguuuccc

SEQ ID NO: 37185 - RNA, 23 nt, Artificial Sequence
  RNA Oligomer
gccaggaagaaugguguguuucc

SEQ ID NO: 37186 - RNA, 23 nt, Artificial Sequence
  RNA Oligomer
ggccaggaagaaugguguguuuc

SEQ ID NO: 37187 - RNA, 23 nt, Artificial Sequence
  RNA Oligomer
aggccaggaagaaugguguguuu

SEQ ID NO: 37188 - RNA, 23 nt, Artificial Sequence
  RNA Oligomer
uuguaccuuauugaucuuugccc

SEQ ID NO: 37189 - RNA, 23 nt, Artificial Sequence
  RNA Oligomer
uuuguaccuuauugaucuuugcc

SEQ ID NO: 37190 - RNA, 23 nt, Artificial Sequence
  RNA Oligomer
auuuguaccuuauugaucuuugc

SEQ ID NO: 37191 - RNA, 23 nt, Artificial Sequence
  RNA Oligomer
guguucaguuccagcuuuuguag

SEQ ID NO: 37192 - RNA, 23 nt, Artificial Sequence
  RNA Oligomer
uguguucaguuccagcuuuugua

SEQ ID NO: 37193 - RNA, 23 nt, Artificial Sequence
  RNA Oligomer
uuguguucaguuccagcuuuugu

SEQ ID NO: 37194 - RNA, 23 nt, Artificial Sequence
  RNA Oligomer
uuuguguucaguuccagcuuuug

SEQ ID NO: 37195 - RNA, 23 nt, Artificial Sequence
  RNA Oligomer
auuuguguucaguuccagcuuuu

SEQ ID NO: 37196 - RNA, 23 nt, Artificial Sequence
  RNA Oligomer
caggaauguuucagcugcaguug

SEQ ID NO: 37197 - RNA, 23 nt, Artificial Sequence
  RNA Oligomer
ccaggaauguuucagcugcaguu

SEQ ID NO: 37198 - RNA, 23 nt, Artificial Sequence
  RNA Oligomer
gccaggaauguuucagcugcagu

SEQ ID NO: 37199 - RNA, 23 nt, Artificial Sequence
  RNA Oligomer
ugccaggaauguuucagcugcag

SEQ ID NO: 37200 - RNA, 23 nt, Artificial Sequence
  RNA Oligomer
uugccaggaauguuucagcugca

SEQ ID NO: 37201 - RNA, 23 nt, Artificial Sequence
  RNA Oligomer
auugccaggaauguuucagcugc

SEQ ID NO: 37202 - RNA, 23 nt, Artificial Sequence
  RNA Oligomer
ucagggaugugggaaucucccag

SEQ ID NO: 37203 - RNA, 23 nt, Artificial Sequence
  RNA Oligomer
cucagggaugugggaaucuccca

SEQ ID NO: 37204 - RNA, 23 nt, Artificial Sequence
  RNA Oligomer
ccucagggaugugggaaucuccc

SEQ ID NO: 37205 - RNA, 23 nt, Artificial Sequence
  RNA Oligomer
cccucagggaugugggaaucucc

SEQ ID NO: 37206 - RNA, 23 nt, Artificial Sequence
  RNA Oligomer
ccccucagggaugugggaaucuc

SEQ ID NO: 37207 - RNA, 23 nt, Artificial Sequence
  RNA Oligomer
ggaggugugauagagccuuugau

SEQ ID NO: 37208 - RNA, 23 nt, Artificial Sequence
  RNA Oligomer
aggaggugugauagagccuuuga

SEQ ID NO: 37209 - RNA, 23 nt, Artificial Sequence
  RNA Oligomer
caggaggugugauagagccuuug

SEQ ID NO: 37210 - RNA, 23 nt, Artificial Sequence
  RNA Oligomer
acaggaggugugauagagccuuu

SEQ ID NO: 37211 - RNA, 23 nt, Artificial Sequence
  RNA Oligomer
cacaggaggugugauagagccuu

SEQ ID NO: 37212 - RNA, 23 nt, Artificial Sequence
  RNA Oligomer
ccggugcaaggagaugucugaau

SEQ ID NO: 37213 - RNA, 23 nt, Artificial Sequence
  RNA Oligomer
ggaucgggaagguuaugcuccug

SEQ ID NO: 37214 - RNA, 23 nt, Artificial Sequence
  RNA Oligomer
aggaucgggaagguuaugcuccu

SEQ ID NO: 37215 - RNA, 23 nt, Artificial Sequence
  RNA Oligomer
aaggaucgggaagguuaugcucc

SEQ ID NO: 37216 - RNA, 23 nt, Artificial Sequence
  RNA Oligomer
caaggaucgggaagguuaugcuc

SEQ ID NO: 37217 - RNA, 23 nt, Artificial Sequence
  RNA Oligomer
ucaaggaucgggaagguuaugcu

SEQ ID NO: 37218 - RNA, 23 nt, Artificial Sequence
  RNA Oligomer
gaacgcacuuaucaaggaucggg

SEQ ID NO: 37219 - RNA, 23 nt, Artificial Sequence
  RNA Oligomer
ugaacgcacuuaucaaggaucgg

SEQ ID NO: 37220 - RNA, 23 nt, Artificial Sequence
  RNA Oligomer
gugaacgcacuuaucaaggaucg

SEQ ID NO: 37221 - RNA, 23 nt, Artificial Sequence
  RNA Oligomer
ggugaacgcacuuaucaaggauc

SEQ ID NO: 37222 - RNA, 23 nt, Artificial Sequence
  RNA Oligomer
aggugaacgcacuuaucaaggau

SEQ ID NO: 37223 - RNA, 23 nt, Artificial Sequence
  RNA Oligomer
ugagcgggcuugugauaugcacg

SEQ ID NO: 37224 - RNA, 23 nt, Artificial Sequence
  RNA Oligomer
cugagcgggcuugugauaugcac

SEQ ID NO: 37225 - RNA, 23 nt, Artificial Sequence
  RNA Oligomer
ucugagcgggcuugugauaugca

SEQ ID NO: 37226 - RNA, 23 nt, Artificial Sequence
  RNA Oligomer
uucugagcgggcuugugauaugc

SEQ ID NO: 37227 - RNA, 23 nt, Artificial Sequence
  RNA Oligomer
uuucugagcgggcuugugauaug

SEQ ID NO: 37228 - RNA, 23 nt, Artificial Sequence
  RNA Oligomer
ugccgguaaagaaaaguugccga

SEQ ID NO: 37229 - RNA, 23 nt, Artificial Sequence
  RNA Oligomer
augccgguaaagaaaaguugccg

SEQ ID NO: 37230 - RNA, 23 nt, Artificial Sequence
  RNA Oligomer
gaugccgguaaagaaaaguugcc

SEQ ID NO: 37231 - RNA, 23 nt, Artificial Sequence
  RNA Oligomer
ugaugccgguaaagaaaaguugc

SEQ ID NO: 37232 - RNA, 23 nt, Artificial Sequence
  RNA Oligomer
gugaugccgguaaagaaaaguug

SEQ ID NO: 37233 - RNA, 23 nt, Artificial Sequence
  RNA Oligomer
agugaugccgguaaagaaaaguu

SEQ ID NO: 37234 - RNA, 23 nt, Artificial Sequence
  RNA Oligomer
gagugaugccgguaaagaaaagu

SEQ ID NO: 37235 - RNA, 23 nt, Artificial Sequence
  RNA Oligomer
agagugaugccgguaaagaaaag

SEQ ID NO: 37236 - RNA, 23 nt, Artificial Sequence
  RNA Oligomer
accaaaaauguucuucauccagg

SEQ ID NO: 37237 - RNA, 23 nt, Artificial Sequence
  RNA Oligomer
aaccaaaaauguucuucauccag

SEQ ID NO: 37238 - RNA, 23 nt, Artificial Sequence
  RNA Oligomer
aaaccaaaaauguucuucaucca

SEQ ID NO: 37239 - RNA, 23 nt, Artificial Sequence
  RNA Oligomer
caaaccaaaaauguucuucaucc

SEQ ID NO: 37240 - RNA, 23 nt, Artificial Sequence
  RNA Oligomer
acaaaccaaaaauguucuucauc

SEQ ID NO: 37241 - RNA, 23 nt, Artificial Sequence
  RNA Oligomer
caggaaacucuaaaaaagaaccg

SEQ ID NO: 37242 - RNA, 23 nt, Artificial Sequence
  RNA Oligomer
ucaggaaacucuaaaaaagaacc

SEQ ID NO: 37243 - RNA, 23 nt, Artificial Sequence
  RNA Oligomer
aucaggaaacucuaaaaaagaac

SEQ ID NO: 37244 - RNA, 23 nt, Artificial Sequence
  RNA Oligomer
caucaggaaacucuaaaaaagaa

SEQ ID NO: 37245 - RNA, 23 nt, Artificial Sequence
  RNA Oligomer
ucaucaggaaacucuaaaaaaga

SEQ ID NO: 37246 - RNA, 23 nt, Artificial Sequence
  RNA Oligomer
cauccucaucaucaggaaacucu

SEQ ID NO: 37247 - RNA, 23 nt, Artificial Sequence
  RNA Oligomer
ccauggucccuagcaaaaugcua

SEQ ID NO: 37248 - RNA, 23 nt, Artificial Sequence
  RNA Oligomer
cccauggucccuagcaaaaugcu

SEQ ID NO: 37249 - RNA, 23 nt, Artificial Sequence
  RNA Oligomer
ucccauggucccuagcaaaaugc

SEQ ID NO: 37250 - RNA, 23 nt, Artificial Sequence
  RNA Oligomer
cucccauggucccuagcaaaaug

SEQ ID NO: 37251 - RNA, 23 nt, Artificial Sequence
  RNA Oligomer
ucucccauggucccuagcaaaau

SEQ ID NO: 37252 - RNA, 23 nt, Artificial Sequence
  RNA Oligomer
cacggauuauuauuuguacuuug

SEQ ID NO: 37253 - RNA, 23 nt, Artificial Sequence
  RNA Oligomer
acacggauuauuauuuguacuuu

SEQ ID NO: 37254 - RNA, 23 nt, Artificial Sequence
  RNA Oligomer
uacacggauuauuauuuguacuu

SEQ ID NO: 37255 - RNA, 23 nt, Artificial Sequence
  RNA Oligomer
auacacggauuauuauuuguacu

SEQ ID NO: 37256 - RNA, 23 nt, Artificial Sequence
  RNA Oligomer
uauacacggauuauuauuuguac

SEQ ID NO: 37257 - RNA, 23 nt, Artificial Sequence
  RNA Oligomer
uacaauccuaccuuuugauaaaa

SEQ ID NO: 37258 - RNA, 23 nt, Artificial Sequence
  RNA Oligomer
ccaucauguaccaagugcuuggc

SEQ ID NO: 37259 - RNA, 23 nt, Artificial Sequence
  RNA Oligomer
accaucauguaccaagugcuugg

SEQ ID NO: 37260 - RNA, 23 nt, Artificial Sequence
  RNA Oligomer
caccaucauguaccaagugcuug

SEQ ID NO: 37261 - RNA, 23 nt, Artificial Sequence
  RNA Oligomer
ucaccaucauguaccaagugcuu

SEQ ID NO: 37262 - RNA, 23 nt, Artificial Sequence
  RNA Oligomer
uucaccaucauguaccaagugcu

SEQ ID NO: 37263 - RNA, 23 nt, Artificial Sequence
  RNA Oligomer
ccuucuuccucaagucuugacaa

SEQ ID NO: 37264 - RNA, 23 nt, Artificial Sequence
  RNA Oligomer
uccuucuuccucaagucuugaca

SEQ ID NO: 37265 - RNA, 23 nt, Artificial Sequence
  RNA Oligomer
guccuucuuccucaagucuugac

SEQ ID NO: 37266 - RNA, 23 nt, Artificial Sequence
  RNA Oligomer
uguccuucuuccucaagucuuga

SEQ ID NO: 37267 - RNA, 23 nt, Artificial Sequence
  RNA Oligomer
guguccuucuuccucaagucuug

SEQ ID NO: 37268 - RNA, 23 nt, Artificial Sequence
  RNA Oligomer
cuucuaauuuugugcucuuuccu

SEQ ID NO: 37269 - RNA, 23 nt, Artificial Sequence
  RNA Oligomer
gcuucuaauuuugugcucuuucc

SEQ ID NO: 37270 - RNA, 23 nt, Artificial Sequence
  RNA Oligomer
agcuucuaauuuugugcucuuuc

SEQ ID NO: 37271 - RNA, 23 nt, Artificial Sequence
  RNA Oligomer
cagcuucuaauuuugugcucuuu

SEQ ID NO: 37272 - RNA, 23 nt, Artificial Sequence
  RNA Oligomer
ucagcuucuaauuuugugcucuu

SEQ ID NO: 37273 - RNA, 23 nt, Artificial Sequence
  RNA Oligomer
gugauuucuugcuaagcuccagc

SEQ ID NO: 37274 - RNA, 23 nt, Artificial Sequence
  RNA Oligomer
ugguuuaugagaacugguucuug

SEQ ID NO: 37275 - RNA, 23 nt, Artificial Sequence
  RNA Oligomer
uugguuuaugagaacugguucuu

SEQ ID NO: 37276 - RNA, 23 nt, Artificial Sequence
  RNA Oligomer
cuugguuuaugagaacugguucu

SEQ ID NO: 37277 - RNA, 23 nt, Artificial Sequence
  RNA Oligomer
ccuugguuuaugagaacugguuc

SEQ ID NO: 37278 - RNA, 23 nt, Artificial Sequence
  RNA Oligomer
accuugguuuaugagaacugguu

SEQ ID NO: 37279 - RNA, 23 nt, Artificial Sequence
  RNA Oligomer
gccauacauguuauuguuuucaa

SEQ ID NO: 37280 - RNA, 23 nt, Artificial Sequence
  RNA Oligomer
ugccauacauguuauuguuuuca

SEQ ID NO: 37281 - RNA, 23 nt, Artificial Sequence
  RNA Oligomer
gugccauacauguuauuguuuuc

SEQ ID NO: 37282 - RNA, 23 nt, Artificial Sequence
  RNA Oligomer
agugccauacauguuauuguuuu

SEQ ID NO: 37283 - RNA, 23 nt, Artificial Sequence
  RNA Oligomer
cagugccauacauguuauuguuu

SEQ ID NO: 37284 - RNA, 23 nt, Artificial Sequence
  RNA Oligomer
guaaaugcucaaagauguaaugu

SEQ ID NO: 37285 - RNA, 23 nt, Artificial Sequence
  RNA Oligomer
uguaaaugcucaaagauguaaug

SEQ ID NO: 37286 - RNA, 23 nt, Artificial Sequence
  RNA Oligomer
auguaaaugcucaaagauguaau

SEQ ID NO: 37287 - RNA, 23 nt, Artificial Sequence
  RNA Oligomer
cauguaaaugcucaaagauguaa

SEQ ID NO: 37288 - RNA, 23 nt, Artificial Sequence
  RNA Oligomer
uuacaggaucauguaaaugcuca

SEQ ID NO: 37289 - RNA, 23 nt, Artificial Sequence
  RNA Oligomer
uuuacaggaucauguaaaugcuc

SEQ ID NO: 37290 - RNA, 23 nt, Artificial Sequence
  RNA Oligomer
cuuuacaggaucauguaaaugcu

SEQ ID NO: 37291 - RNA, 23 nt, Artificial Sequence
  RNA Oligomer
uuccuuccugagaaacguccauc

SEQ ID NO: 37292 - RNA, 23 nt, Artificial Sequence
  RNA Oligomer
uuuccuuccugagaaacguccau

SEQ ID NO: 37293 - RNA, 23 nt, Artificial Sequence
  RNA Oligomer
cauuuguaccuuauugaucuuug

SEQ ID NO: 37294 - RNA, 23 nt, Artificial Sequence
  RNA Oligomer
gcaaacaugacuagagacgcacc

SEQ ID NO: 37295 - RNA, 23 nt, Artificial Sequence
  RNA Oligomer
agcaaacaugacuagagacgcac

SEQ ID NO: 37296 - RNA, 23 nt, Artificial Sequence
  RNA Oligomer
aagcaaacaugacuagagacgca

SEQ ID NO: 37297 - RNA, 23 nt, Artificial Sequence
  RNA Oligomer
gcucugaagaagcaaacaugacu

SEQ ID NO: 37298 - RNA, 23 nt, Artificial Sequence
  RNA Oligomer
acaucaucaccuuggaaaugagg

SEQ ID NO: 37299 - RNA, 23 nt, Artificial Sequence
  RNA Oligomer
gacauuaucuuuuggcucugaag

SEQ ID NO: 37300 - RNA, 23 nt, Artificial Sequence
  RNA Oligomer
agacauuaucuuuuggcucugaa

SEQ ID NO: 37301 - RNA, 23 nt, Artificial Sequence
  RNA Oligomer
uagacauuaucuuuuggcucuga

SEQ ID NO: 37302 - RNA, 23 nt, Artificial Sequence
  RNA Oligomer
guagacauuaucuuuuggcucug

SEQ ID NO: 37303 - RNA, 23 nt, Artificial Sequence
  RNA Oligomer
uguagacauuaucuuuuggcucu

SEQ ID NO: 37304 - RNA, 23 nt, Artificial Sequence
  RNA Oligomer
uuaguuaagaugucugagagacc

SEQ ID NO: 37305 - RNA, 23 nt, Artificial Sequence
  RNA Oligomer
auuaguuaagaugucugagagac

SEQ ID NO: 37306 - RNA, 23 nt, Artificial Sequence
  RNA Oligomer
cauuaguuaagaugucugagaga

SEQ ID NO: 37307 - RNA, 23 nt, Artificial Sequence
  RNA Oligomer
cuuuuguagauggcacuuuagug

SEQ ID NO: 37308 - RNA, 23 nt, Artificial Sequence
  RNA Oligomer
gcuuuuguagauggcacuuuagu

SEQ ID NO: 37309 - RNA, 23 nt, Artificial Sequence
  RNA Oligomer
agcuuuuguagauggcacuuuag

SEQ ID NO: 37310 - RNA, 23 nt, Artificial Sequence
  RNA Oligomer
cagcuuuuguagauggcacuuua

SEQ ID NO: 37311 - RNA, 23 nt, Artificial Sequence
  RNA Oligomer
ccagcuuuuguagauggcacuuu

SEQ ID NO: 37312 - RNA, 23 nt, Artificial Sequence
  RNA Oligomer
gaaguuguaaacacagugugguu

SEQ ID NO: 37313 - RNA, 23 nt, Artificial Sequence
  RNA Oligomer
ugaaguuguaaacacaguguggu

SEQ ID NO: 37314 - RNA, 23 nt, Artificial Sequence
  RNA Oligomer
gugaaguuguaaacacagugugg

SEQ ID NO: 37315 - RNA, 23 nt, Artificial Sequence
  RNA Oligomer
agugaaguuguaaacacagugug

SEQ ID NO: 37316 - RNA, 23 nt, Artificial Sequence
  RNA Oligomer
aagugaaguuguaaacacagugu

SEQ ID NO: 37317 - RNA, 23 nt, Artificial Sequence
  RNA Oligomer
caagugaaguuguaaacacagug

SEQ ID NO: 37318 - RNA, 23 nt, Artificial Sequence
  RNA Oligomer
acaagugaaguuguaaacacagu

SEQ ID NO: 37319 - RNA, 23 nt, Artificial Sequence
  RNA Oligomer
aucaaggaucgggaagguuaugc

SEQ ID NO: 37320 - RNA, 23 nt, Artificial Sequence
  RNA Oligomer
uaucaaggaucgggaagguuaug

SEQ ID NO: 37321 - RNA, 23 nt, Artificial Sequence
  RNA Oligomer
uuaucaaggaucgggaagguuau

SEQ ID NO: 37322 - RNA, 23 nt, Artificial Sequence
  RNA Oligomer
gacaugauaugcggcuaugccug

SEQ ID NO: 37323 - RNA, 23 nt, Artificial Sequence
  RNA Oligomer
cgcucagacaugauaugcggcua

SEQ ID NO: 37324 - RNA, 23 nt, Artificial Sequence
  RNA Oligomer
cuacagaacaaaccaaaaauguu

SEQ ID NO: 37325 - RNA, 23 nt, Artificial Sequence
  RNA Oligomer
guggaccacaguacucuagucac

SEQ ID NO: 37326 - RNA, 23 nt, Artificial Sequence
  RNA Oligomer
uguggaccacaguacucuaguca

SEQ ID NO: 37327 - RNA, 23 nt, Artificial Sequence
  RNA Oligomer
auguggaccacaguacucuaguc

SEQ ID NO: 37328 - RNA, 23 nt, Artificial Sequence
  RNA Oligomer
gauguggaccacaguacucuagu

SEQ ID NO: 37329 - RNA, 23 nt, Artificial Sequence
  RNA Oligomer
ggauguggaccacaguacucuag

SEQ ID NO: 37330 - RNA, 23 nt, Artificial Sequence
  RNA Oligomer
aguauggaaguauuugagagaga

SEQ ID NO: 37331 - RNA, 23 nt, Artificial Sequence
  RNA Oligomer
gcaugcauccucaucaucaggaa

SEQ ID NO: 37332 - RNA, 23 nt, Artificial Sequence
  RNA Oligomer
ggcaugcauccucaucaucagga

SEQ ID NO: 37333 - RNA, 23 nt, Artificial Sequence
  RNA Oligomer
uggcaugcauccucaucaucagg

SEQ ID NO: 37334 - RNA, 23 nt, Artificial Sequence
  RNA Oligomer
guggcaugcauccucaucaucag

SEQ ID NO: 37335 - RNA, 23 nt, Artificial Sequence
  RNA Oligomer
uguggcaugcauccucaucauca

SEQ ID NO: 37336 - RNA, 23 nt, Artificial Sequence
  RNA Oligomer
agacauaucaugugugagauaac

SEQ ID NO: 37337 - RNA, 23 nt, Artificial Sequence
  RNA Oligomer
aagacauaucaugugugagauaa

SEQ ID NO: 37338 - RNA, 23 nt, Artificial Sequence
  RNA Oligomer
gaagacauaucaugugugagaua

SEQ ID NO: 37339 - RNA, 23 nt, Artificial Sequence
  RNA Oligomer
ugaagacauaucaugugugagau

SEQ ID NO: 37340 - RNA, 23 nt, Artificial Sequence
  RNA Oligomer
uugaagacauaucaugugugaga

SEQ ID NO: 37341 - RNA, 23 nt, Artificial Sequence
  RNA Oligomer
cuugaagacauaucaugugugag

SEQ ID NO: 37342 - RNA, 23 nt, Artificial Sequence
  RNA Oligomer
ccuugaagacauaucauguguga

SEQ ID NO: 37343 - RNA, 23 nt, Artificial Sequence
  RNA Oligomer
ccuuuugacaauauacacggauu

SEQ ID NO: 37344 - RNA, 23 nt, Artificial Sequence
  RNA Oligomer
auucaccaucauguaccaagugc

SEQ ID NO: 37345 - RNA, 23 nt, Artificial Sequence
  RNA Oligomer
uauucaccaucauguaccaagug

SEQ ID NO: 37346 - RNA, 23 nt, Artificial Sequence
  RNA Oligomer
uuauucaccaucauguaccaagu

SEQ ID NO: 37347 - RNA, 23 nt, Artificial Sequence
  RNA Oligomer
cuguaaaugagggcagaaaccuu

SEQ ID NO: 37348 - RNA, 23 nt, Artificial Sequence
  RNA Oligomer
gcuguaaaugagggcagaaaccu

SEQ ID NO: 37349 - RNA, 23 nt, Artificial Sequence
  RNA Oligomer
ggcuguaaaugagggcagaaacc

SEQ ID NO: 37350 - RNA, 23 nt, Artificial Sequence
  RNA Oligomer
aggcuguaaaugagggcagaaac

SEQ ID NO: 37351 - RNA, 23 nt, Artificial Sequence
  RNA Oligomer
caggcuguaaaugagggcagaaa

SEQ ID NO: 37352 - RNA, 23 nt, Artificial Sequence
  RNA Oligomer
ccaggcuguaaaugagggcagaa

SEQ ID NO: 37353 - RNA, 23 nt, Artificial Sequence
  RNA Oligomer
accaggcuguaaaugagggcaga

SEQ ID NO: 37354 - RNA, 23 nt, Artificial Sequence
  RNA Oligomer
cuaccaggcuguaaaugagggca

SEQ ID NO: 37355 - RNA, 23 nt, Artificial Sequence
  RNA Oligomer
ccuaccaggcuguaaaugagggc

SEQ ID NO: 37356 - RNA, 23 nt, Artificial Sequence
  RNA Oligomer
cccuaccaggcuguaaaugaggg

SEQ ID NO: 37357 - RNA, 23 nt, Artificial Sequence
  RNA Oligomer
ccccuaccaggcuguaaaugagg

SEQ ID NO: 37358 - RNA, 23 nt, Artificial Sequence
  RNA Oligomer
uccccuaccaggcuguaaaugag

SEQ ID NO: 37359 - RNA, 23 nt, Artificial Sequence
  RNA Oligomer
gucaccacaucuugucuuuuccc

SEQ ID NO: 37360 - RNA, 23 nt, Artificial Sequence
  RNA Oligomer
ugucaccacaucuugucuuuucc

SEQ ID NO: 37361 - RNA, 23 nt, Artificial Sequence
  RNA Oligomer
cugucaccacaucuugucuuuuc

SEQ ID NO: 37362 - RNA, 23 nt, Artificial Sequence
  RNA Oligomer
ucugucaccacaucuugucuuuu

SEQ ID NO: 37363 - RNA, 23 nt, Artificial Sequence
  RNA Oligomer
gucugucaccacaucuugucuuu

SEQ ID NO: 37364 - RNA, 23 nt, Artificial Sequence
  RNA Oligomer
cucucagcuucuaauuuugugcu

SEQ ID NO: 37365 - RNA, 23 nt, Artificial Sequence
  RNA Oligomer
guaaacucuucaccuugguuuau

SEQ ID NO: 37366 - RNA, 23 nt, Artificial Sequence
  RNA Oligomer
uguaaacucuucaccuugguuua

SEQ ID NO: 37367 - RNA, 23 nt, Artificial Sequence
  RNA Oligomer
auguaaacucuucaccuugguuu

SEQ ID NO: 37368 - RNA, 23 nt, Artificial Sequence
  RNA Oligomer
aauguaaacucuucaccuugguu

SEQ ID NO: 37369 - RNA, 23 nt, Artificial Sequence
  RNA Oligomer
aaauguaaacucuucaccuuggu

SEQ ID NO: 37370 - RNA, 23 nt, Artificial Sequence
  RNA Oligomer
ccuucugcuuucuauuaccccuc

SEQ ID NO: 37371 - RNA, 23 nt, Artificial Sequence
  RNA Oligomer
gcuuagaacccuucugcuuucua

SEQ ID NO: 37372 - RNA, 23 nt, Artificial Sequence
  RNA Oligomer
ugcuuagaacccuucugcuuucu

SEQ ID NO: 37373 - RNA, 23 nt, Artificial Sequence
  RNA Oligomer
cugcuuagaacccuucugcuuuc

SEQ ID NO: 37374 - RNA, 23 nt, Artificial Sequence
  RNA Oligomer
ccugcuuagaacccuucugcuuu

SEQ ID NO: 37375 - RNA, 23 nt, Artificial Sequence
  RNA Oligomer
cccugcuuagaacccuucugcuu

SEQ ID NO: 37376 - RNA, 23 nt, Artificial Sequence
  RNA Oligomer
acuucccaacuucccuguucuuu

SEQ ID NO: 37377 - RNA, 23 nt, Artificial Sequence
  RNA Oligomer
uggaacuccucaacuugcugccu

SEQ ID NO: 37378 - RNA, 23 nt, Artificial Sequence
  RNA Oligomer
guggaacuccucaacuugcugcc

SEQ ID NO: 37379 - RNA, 23 nt, Artificial Sequence
  RNA Oligomer
uguggaacuccucaacuugcugc

SEQ ID NO: 37380 - RNA, 23 nt, Artificial Sequence
  RNA Oligomer
auguggaacuccucaacuugcug

SEQ ID NO: 37381 - RNA, 23 nt, Artificial Sequence
  RNA Oligomer
gcucaaagauguaauguaguucu

SEQ ID NO: 37382 - RNA, 23 nt, Artificial Sequence
  RNA Oligomer
ccaaaucugucuagaauccugcu

SEQ ID NO: 37383 - RNA, 23 nt, Artificial Sequence
  RNA Oligomer
accaaaucugucuagaauccugc

SEQ ID NO: 37384 - RNA, 23 nt, Artificial Sequence
  RNA Oligomer
caccaaaucugucuagaauccug

SEQ ID NO: 37385 - RNA, 23 nt, Artificial Sequence
  RNA Oligomer
ccaccaaaucugucuagaauccu

SEQ ID NO: 37386 - RNA, 23 nt, Artificial Sequence
  RNA Oligomer
gccaccaaaucugucuagaaucc

SEQ ID NO: 37387 - RNA, 23 nt, Artificial Sequence
  RNA Oligomer
ucucucccuuacuauucccacuu

SEQ ID NO: 37388 - RNA, 23 nt, Artificial Sequence
  RNA Oligomer
gacucuguaaccaccucucuguc

SEQ ID NO: 37389 - RNA, 23 nt, Artificial Sequence
  RNA Oligomer
guuucucugagcuuuguuacuga

SEQ ID NO: 37390 - RNA, 23 nt, Artificial Sequence
  RNA Oligomer
uguuucucugagcuuuguuacug

SEQ ID NO: 37391 - RNA, 23 nt, Artificial Sequence
  RNA Oligomer
uuguuucucugagcuuuguuacu

SEQ ID NO: 37392 - RNA, 23 nt, Artificial Sequence
  RNA Oligomer
guuguuucucugagcuuuguuac

SEQ ID NO: 37393 - RNA, 23 nt, Artificial Sequence
  RNA Oligomer
gguuguuucucugagcuuuguua

SEQ ID NO: 37394 - RNA, 23 nt, Artificial Sequence
  RNA Oligomer
gaagucucaaagaucuuucguug

SEQ ID NO: 37395 - RNA, 23 nt, Artificial Sequence
  RNA Oligomer
ggcucugaagaagcaaacaugac

SEQ ID NO: 37396 - RNA, 23 nt, Artificial Sequence
  RNA Oligomer
uggcucugaagaagcaaacauga

SEQ ID NO: 37397 - RNA, 23 nt, Artificial Sequence
  RNA Oligomer
uuggcucugaagaagcaaacaug

SEQ ID NO: 37398 - RNA, 23 nt, Artificial Sequence
  RNA Oligomer
acauuaucuuuuggcucugaaga

SEQ ID NO: 37399 - RNA, 23 nt, Artificial Sequence
  RNA Oligomer
guaaacacagugugguuaugggg

SEQ ID NO: 37400 - RNA, 23 nt, Artificial Sequence
  RNA Oligomer
uguaaacacagugugguuauggg

SEQ ID NO: 37401 - RNA, 23 nt, Artificial Sequence
  RNA Oligomer
uuguaaacacagugugguuaugg

SEQ ID NO: 37402 - RNA, 23 nt, Artificial Sequence
  RNA Oligomer
guuguaaacacagugugguuaug

SEQ ID NO: 37403 - RNA, 23 nt, Artificial Sequence
  RNA Oligomer
aguuguaaacacagugugguuau

SEQ ID NO: 37404 - RNA, 23 nt, Artificial Sequence
  RNA Oligomer
aggaauguuucagcugcaguuga

SEQ ID NO: 37405 - RNA, 23 nt, Artificial Sequence
  RNA Oligomer
ucuucaggaugcacgguuucugu

SEQ ID NO: 37406 - RNA, 23 nt, Artificial Sequence
  RNA Oligomer
aucuucaggaugcacgguuucug

SEQ ID NO: 37407 - RNA, 23 nt, Artificial Sequence
  RNA Oligomer
gaucuucaggaugcacgguuucu

SEQ ID NO: 37408 - RNA, 23 nt, Artificial Sequence
  RNA Oligomer
ugaucuucaggaugcacgguuuc

SEQ ID NO: 37409 - RNA, 23 nt, Artificial Sequence
  RNA Oligomer
uugaucuucaggaugcacgguuu

SEQ ID NO: 37410 - RNA, 23 nt, Artificial Sequence
  RNA Oligomer
gugugauagagccuuugaucuuc

SEQ ID NO: 37411 - RNA, 23 nt, Artificial Sequence
  RNA Oligomer
ggugugauagagccuuugaucuu

SEQ ID NO: 37412 - RNA, 23 nt, Artificial Sequence
  RNA Oligomer
aggugugauagagccuuugaucu

SEQ ID NO: 37413 - RNA, 23 nt, Artificial Sequence
  RNA Oligomer
gaggugugauagagccuuugauc

SEQ ID NO: 37414 - RNA, 23 nt, Artificial Sequence
  RNA Oligomer
agaugucugaauacugcagcacu

SEQ ID NO: 37415 - RNA, 23 nt, Artificial Sequence
  RNA Oligomer
gagaugucugaauacugcagcac

SEQ ID NO: 37416 - RNA, 23 nt, Artificial Sequence
  RNA Oligomer
cuguuguugagcgaauuguuaga

SEQ ID NO: 37417 - RNA, 23 nt, Artificial Sequence
  RNA Oligomer
gcuguuguugagcgaauuguuag

SEQ ID NO: 37418 - RNA, 23 nt, Artificial Sequence
  RNA Oligomer
agcuguuguugagcgaauuguua

SEQ ID NO: 37419 - RNA, 23 nt, Artificial Sequence
  RNA Oligomer
cagcuguuguugagcgaauuguu

SEQ ID NO: 37420 - RNA, 23 nt, Artificial Sequence
  RNA Oligomer
acagcuguuguugagcgaauugu

SEQ ID NO: 37421 - RNA, 23 nt, Artificial Sequence
  RNA Oligomer
aagaaaaguugccgaagaugaga

SEQ ID NO: 37422 - RNA, 23 nt, Artificial Sequence
  RNA Oligomer
aaagaaaaguugccgaagaugag

SEQ ID NO: 37423 - RNA, 23 nt, Artificial Sequence
  RNA Oligomer
uaaagaaaaguugccgaagauga

SEQ ID NO: 37424 - RNA, 23 nt, Artificial Sequence
  RNA Oligomer
guaaagaaaaguugccgaagaug

SEQ ID NO: 37425 - RNA, 23 nt, Artificial Sequence
  RNA Oligomer
gguaaagaaaaguugccgaagau

SEQ ID NO: 37426 - RNA, 23 nt, Artificial Sequence
  RNA Oligomer
gagagugaugccgguaaagaaaa

SEQ ID NO: 37427 - RNA, 23 nt, Artificial Sequence
  RNA Oligomer
ggagaugagacugaucguggggu

SEQ ID NO: 37428 - RNA, 23 nt, Artificial Sequence
  RNA Oligomer
uggagaugagacugaucgugggg

SEQ ID NO: 37429 - RNA, 23 nt, Artificial Sequence
  RNA Oligomer
guggagaugagacugaucguggg

SEQ ID NO: 37430 - RNA, 23 nt, Artificial Sequence
  RNA Oligomer
cguggagaugagacugaucgugg

SEQ ID NO: 37431 - RNA, 23 nt, Artificial Sequence
  RNA Oligomer
ugacguccauguucuaugugacc

SEQ ID NO: 37432 - RNA, 23 nt, Artificial Sequence
  RNA Oligomer
augacguccauguucuaugugac

SEQ ID NO: 37433 - RNA, 23 nt, Artificial Sequence
  RNA Oligomer
uaugacguccauguucuauguga

SEQ ID NO: 37434 - RNA, 23 nt, Artificial Sequence
  RNA Oligomer
cuaugacguccauguucuaugug

SEQ ID NO: 37435 - RNA, 23 nt, Artificial Sequence
  RNA Oligomer
gcuaugacguccauguucuaugu

SEQ ID NO: 37436 - RNA, 23 nt, Artificial Sequence
  RNA Oligomer
ccagcuggcauauagguugcagu

SEQ ID NO: 37437 - RNA, 23 nt, Artificial Sequence
  RNA Oligomer
uccagcuggcauauagguugcag

SEQ ID NO: 37438 - RNA, 23 nt, Artificial Sequence
  RNA Oligomer
uuccagcuggcauauagguugca

SEQ ID NO: 37439 - RNA, 23 nt, Artificial Sequence
  RNA Oligomer
cuuccagcuggcauauagguugc

SEQ ID NO: 37440 - RNA, 23 nt, Artificial Sequence
  RNA Oligomer
acuuccagcuggcauauagguug

SEQ ID NO: 37441 - RNA, 23 nt, Artificial Sequence
  RNA Oligomer
ggauuuuguauugccaucgggug

SEQ ID NO: 37442 - RNA, 23 nt, Artificial Sequence
  RNA Oligomer
aggauuuuguauugccaucgggu

SEQ ID NO: 37443 - RNA, 23 nt, Artificial Sequence
  RNA Oligomer
caggauuuuguauugccaucggg

SEQ ID NO: 37444 - RNA, 23 nt, Artificial Sequence
  RNA Oligomer
ccuuugggucgacauaguaugga

SEQ ID NO: 37445 - RNA, 23 nt, Artificial Sequence
  RNA Oligomer
gccuuugggucgacauaguaugg

SEQ ID NO: 37446 - RNA, 23 nt, Artificial Sequence
  RNA Oligomer
ugccuuugggucgacauaguaug

SEQ ID NO: 37447 - RNA, 23 nt, Artificial Sequence
  RNA Oligomer
cugccuuugggucgacauaguau

SEQ ID NO: 37448 - RNA, 23 nt, Artificial Sequence
  RNA Oligomer
ccugccuuugggucgacauagua

SEQ ID NO: 37449 - RNA, 23 nt, Artificial Sequence
  RNA Oligomer
cuguaguagucaaggugcucaau

SEQ ID NO: 37450 - RNA, 23 nt, Artificial Sequence
  RNA Oligomer
ccuguaguagucaaggugcucaa

SEQ ID NO: 37451 - RNA, 23 nt, Artificial Sequence
  RNA Oligomer
gccuguaguagucaaggugcuca

SEQ ID NO: 37452 - RNA, 23 nt, Artificial Sequence
  RNA Oligomer
ggccuguaguagucaaggugcuc

SEQ ID NO: 37453 - RNA, 23 nt, Artificial Sequence
  RNA Oligomer
aggccuguaguagucaaggugcu

SEQ ID NO: 37454 - RNA, 23 nt, Artificial Sequence
  RNA Oligomer
aaaugcuaggccuguaguaguca

SEQ ID NO: 37455 - RNA, 23 nt, Artificial Sequence
  RNA Oligomer
aaaaugcuaggccuguaguaguc

SEQ ID NO: 37456 - RNA, 23 nt, Artificial Sequence
  RNA Oligomer
ucaugugugagauaacuuccuuc

SEQ ID NO: 37457 - RNA, 23 nt, Artificial Sequence
  RNA Oligomer
aucaugugugagauaacuuccuu

SEQ ID NO: 37458 - RNA, 23 nt, Artificial Sequence
  RNA Oligomer
uaucaugugugagauaacuuccu

SEQ ID NO: 37459 - RNA, 23 nt, Artificial Sequence
  RNA Oligomer
auaucaugugugagauaacuucc

SEQ ID NO: 37460 - RNA, 23 nt, Artificial Sequence
  RNA Oligomer
cauaucaugugugagauaacuuc

SEQ ID NO: 37461 - RNA, 23 nt, Artificial Sequence
  RNA Oligomer
guguggcaugcauccucaucauc

SEQ ID NO: 37462 - RNA, 23 nt, Artificial Sequence
  RNA Oligomer
gcacauagugggccuucauuaaa

SEQ ID NO: 37463 - RNA, 23 nt, Artificial Sequence
  RNA Oligomer
ggcacauagugggccuucauuaa

SEQ ID NO: 37464 - RNA, 23 nt, Artificial Sequence
  RNA Oligomer
uggcacauagugggccuucauua

SEQ ID NO: 37465 - RNA, 23 nt, Artificial Sequence
  RNA Oligomer
uuggcacauagugggccuucauu

SEQ ID NO: 37466 - RNA, 23 nt, Artificial Sequence
  RNA Oligomer
cuuggcacauagugggccuucau

SEQ ID NO: 37467 - RNA, 23 nt, Artificial Sequence
  RNA Oligomer
caccacaucuugucuuuuccccu

SEQ ID NO: 37468 - RNA, 23 nt, Artificial Sequence
  RNA Oligomer
ucaccacaucuugucuuuucccc

SEQ ID NO: 37469 - RNA, 23 nt, Artificial Sequence
  RNA Oligomer
cucagcuucuaauuuugugcucu

SEQ ID NO: 37470 - RNA, 23 nt, Artificial Sequence
  RNA Oligomer
caccuugguuuaugagaacuggu

SEQ ID NO: 37471 - RNA, 23 nt, Artificial Sequence
  RNA Oligomer
ucaccuugguuuaugagaacugg

SEQ ID NO: 37472 - RNA, 23 nt, Artificial Sequence
  RNA Oligomer
uucaccuugguuuaugagaacug

SEQ ID NO: 37473 - RNA, 23 nt, Artificial Sequence
  RNA Oligomer
cucuucaccuugguuuaugagaa

SEQ ID NO: 37474 - RNA, 23 nt, Artificial Sequence
  RNA Oligomer
acucuucaccuugguuuaugaga

SEQ ID NO: 37475 - RNA, 23 nt, Artificial Sequence
  RNA Oligomer
aacucuucaccuugguuuaugag

SEQ ID NO: 37476 - RNA, 23 nt, Artificial Sequence
  RNA Oligomer
aaacucuucaccuugguuuauga

SEQ ID NO: 37477 - RNA, 23 nt, Artificial Sequence
  RNA Oligomer
uaaacucuucaccuugguuuaug

SEQ ID NO: 37478 - RNA, 23 nt, Artificial Sequence
  RNA Oligomer
ccccugcuuagaacccuucugcu

SEQ ID NO: 37479 - RNA, 23 nt, Artificial Sequence
  RNA Oligomer
cccccugcuuagaacccuucugc

SEQ ID NO: 37480 - RNA, 23 nt, Artificial Sequence
  RNA Oligomer
ccccccugcuuagaacccuucug

SEQ ID NO: 37481 - RNA, 23 nt, Artificial Sequence
  RNA Oligomer
guaauguaguucuuuguuccugc

SEQ ID NO: 37482 - RNA, 23 nt, Artificial Sequence
  RNA Oligomer
uguaauguaguucuuuguuccug

SEQ ID NO: 37483 - RNA, 23 nt, Artificial Sequence
  RNA Oligomer
auguaauguaguucuuuguuccu

SEQ ID NO: 37484 - RNA, 23 nt, Artificial Sequence
  RNA Oligomer
gauguaauguaguucuuuguucc

SEQ ID NO: 37485 - RNA, 23 nt, Artificial Sequence
  RNA Oligomer
agauguaauguaguucuuuguuc

SEQ ID NO: 37486 - RNA, 23 nt, Artificial Sequence
  RNA Oligomer
cugccaccaaaucugucuagaau

SEQ ID NO: 37487 - RNA, 23 nt, Artificial Sequence
  RNA Oligomer
gcugccaccaaaucugucuagaa

SEQ ID NO: 37488 - RNA, 23 nt, Artificial Sequence
  RNA Oligomer
ugcugccaccaaaucugucuaga

SEQ ID NO: 37489 - RNA, 23 nt, Artificial Sequence
  RNA Oligomer
cugcugccaccaaaucugucuag

SEQ ID NO: 37490 - RNA, 23 nt, Artificial Sequence
  RNA Oligomer
gcugcugccaccaaaucugucua

SEQ ID NO: 37491 - RNA, 23 nt, Artificial Sequence
  RNA Oligomer
uguaaccaccucucugucuuuuu

SEQ ID NO: 37492 - RNA, 23 nt, Artificial Sequence
  RNA Oligomer
cuguaaccaccucucugucuuuu

SEQ ID NO: 37493 - RNA, 23 nt, Artificial Sequence
  RNA Oligomer
ucuguaaccaccucucugucuuu

SEQ ID NO: 37494 - RNA, 23 nt, Artificial Sequence
  RNA Oligomer
cucuguaaccaccucucugucuu

SEQ ID NO: 37495 - RNA, 23 nt, Artificial Sequence
  RNA Oligomer
gagcuuuguuacugaaaugagcc

SEQ ID NO: 37496 - RNA, 23 nt, Artificial Sequence
  RNA Oligomer
uucucugagcuuuguuacugaaa

SEQ ID NO: 37497 - RNA, 23 nt, Artificial Sequence
  RNA Oligomer
uuucucugagcuuuguuacugaa

SEQ ID NO: 37498 - RNA, 23 nt, Artificial Sequence
  RNA Oligomer
cguugguuguuucucugagcuuu

SEQ ID NO: 37499 - RNA, 23 nt, Artificial Sequence
  RNA Oligomer
ucguugguuguuucucugagcuu

SEQ ID NO: 37500 - RNA, 23 nt, Artificial Sequence
  RNA Oligomer
uucguugguuguuucucugagcu

SEQ ID NO: 37501 - RNA, 23 nt, Artificial Sequence
  RNA Oligomer
uuucguugguuguuucucugagc

SEQ ID NO: 37502 - RNA, 23 nt, Artificial Sequence
  RNA Oligomer
cuuucguugguuguuucucugag

SEQ ID NO: 37503 - RNA, 23 nt, Artificial Sequence
  RNA Oligomer
uggaaggacacucuuggcucguu

SEQ ID NO: 37504 - RNA, 23 nt, Artificial Sequence
  RNA Oligomer
ugacuagagacgcaccuugcugc

SEQ ID NO: 37505 - RNA, 23 nt, Artificial Sequence
  RNA Oligomer
augacuagagacgcaccuugcug

SEQ ID NO: 37506 - RNA, 23 nt, Artificial Sequence
  RNA Oligomer
caugacuagagacgcaccuugcu

SEQ ID NO: 37507 - RNA, 23 nt, Artificial Sequence
  RNA Oligomer
acaugacuagagacgcaccuugc

SEQ ID NO: 37508 - RNA, 23 nt, Artificial Sequence
  RNA Oligomer
aacaugacuagagacgcaccuug

SEQ ID NO: 37509 - RNA, 23 nt, Artificial Sequence
  RNA Oligomer
guccuagagugagaguuuggaag

SEQ ID NO: 37510 - RNA, 23 nt, Artificial Sequence
  RNA Oligomer
uguccuagagugagaguuuggaa

SEQ ID NO: 37511 - RNA, 23 nt, Artificial Sequence
  RNA Oligomer
uuguccuagagugagaguuugga

SEQ ID NO: 37512 - RNA, 23 nt, Artificial Sequence
  RNA Oligomer
uuuguccuagagugagaguuugg

SEQ ID NO: 37513 - RNA, 23 nt, Artificial Sequence
  RNA Oligomer
uuuuguccuagagugagaguuug

SEQ ID NO: 37514 - RNA, 23 nt, Artificial Sequence
  RNA Oligomer
ucauauccuccgcccuuuuuguc

SEQ ID NO: 37515 - RNA, 23 nt, Artificial Sequence
  RNA Oligomer
uucauauccuccgcccuuuuugu

SEQ ID NO: 37516 - RNA, 23 nt, Artificial Sequence
  RNA Oligomer
auucauauccuccgcccuuuuug

SEQ ID NO: 37517 - RNA, 23 nt, Artificial Sequence
  RNA Oligomer
cauucauauccuccgcccuuuuu

SEQ ID NO: 37518 - RNA, 23 nt, Artificial Sequence
  RNA Oligomer
ucauucauauccuccgcccuuuu

SEQ ID NO: 37519 - RNA, 23 nt, Artificial Sequence
  RNA Oligomer
uccagcuuuuguagauggcacuu

SEQ ID NO: 37520 - RNA, 23 nt, Artificial Sequence
  RNA Oligomer
uuccagcuuuuguagauggcacu

SEQ ID NO: 37521 - RNA, 23 nt, Artificial Sequence
  RNA Oligomer
guuccagcuuuuguagauggcac

SEQ ID NO: 37522 - RNA, 23 nt, Artificial Sequence
  RNA Oligomer
uauugccaggaauguuucagcug

SEQ ID NO: 37523 - RNA, 23 nt, Artificial Sequence
  RNA Oligomer
guugagcgaauuguuagaacauc

SEQ ID NO: 37524 - RNA, 23 nt, Artificial Sequence
  RNA Oligomer
cuuaucaaggaucgggaagguua

SEQ ID NO: 37525 - RNA, 23 nt, Artificial Sequence
  RNA Oligomer
gcacuuaucaaggaucgggaagg

SEQ ID NO: 37526 - RNA, 23 nt, Artificial Sequence
  RNA Oligomer
cgcacuuaucaaggaucgggaag

SEQ ID NO: 37527 - RNA, 23 nt, Artificial Sequence
  RNA Oligomer
acgcacuuaucaaggaucgggaa

SEQ ID NO: 37528 - RNA, 23 nt, Artificial Sequence
  RNA Oligomer
aacgcacuuaucaaggaucggga

SEQ ID NO: 37529 - RNA, 23 nt, Artificial Sequence
  RNA Oligomer
aacagcuguuguugagcgaauug

SEQ ID NO: 37530 - RNA, 23 nt, Artificial Sequence
  RNA Oligomer
gcccacgcgcucagacaugauau

SEQ ID NO: 37531 - RNA, 23 nt, Artificial Sequence
  RNA Oligomer
agguuuuucagcucuuugacaac

SEQ ID NO: 37532 - RNA, 23 nt, Artificial Sequence
  RNA Oligomer
gagguuuuucagcucuuugacaa

SEQ ID NO: 37533 - RNA, 23 nt, Artificial Sequence
  RNA Oligomer
agagguuuuucagcucuuugaca

SEQ ID NO: 37534 - RNA, 23 nt, Artificial Sequence
  RNA Oligomer
aagagguuuuucagcucuuugac

SEQ ID NO: 37535 - RNA, 23 nt, Artificial Sequence
  RNA Oligomer
caagagguuuuucagcucuuuga

SEQ ID NO: 37536 - RNA, 23 nt, Artificial Sequence
  RNA Oligomer
ccagcuccaagagguuuuucagc

SEQ ID NO: 37537 - RNA, 23 nt, Artificial Sequence
  RNA Oligomer
uccagcuccaagagguuuuucag

SEQ ID NO: 37538 - RNA, 23 nt, Artificial Sequence
  RNA Oligomer
cuccagcuccaagagguuuuuca

SEQ ID NO: 37539 - RNA, 23 nt, Artificial Sequence
  RNA Oligomer
gcuccagcuccaagagguuuuuc

SEQ ID NO: 37540 - RNA, 23 nt, Artificial Sequence
  RNA Oligomer
ugcuccagcuccaagagguuuuu

SEQ ID NO: 37541 - RNA, 23 nt, Artificial Sequence
  RNA Oligomer
gacguccauguucuaugugacca

SEQ ID NO: 37542 - RNA, 23 nt, Artificial Sequence
  RNA Oligomer
uggagagaaagaacuggaauuuc

SEQ ID NO: 37543 - RNA, 23 nt, Artificial Sequence
  RNA Oligomer
cuggagagaaagaacuggaauuu

SEQ ID NO: 37544 - RNA, 23 nt, Artificial Sequence
  RNA Oligomer
acuggagagaaagaacuggaauu

SEQ ID NO: 37545 - RNA, 23 nt, Artificial Sequence
  RNA Oligomer
cacuggagagaaagaacuggaau

SEQ ID NO: 37546 - RNA, 23 nt, Artificial Sequence
  RNA Oligomer
ucacuggagagaaagaacuggaa

SEQ ID NO: 37547 - RNA, 23 nt, Artificial Sequence
  RNA Oligomer
ggggacgcaggauauugggagug

SEQ ID NO: 37548 - RNA, 23 nt, Artificial Sequence
  RNA Oligomer
auauuuguuugggugguuuguga

SEQ ID NO: 37549 - RNA, 23 nt, Artificial Sequence
  RNA Oligomer
aauauuuguuugggugguuugug

SEQ ID NO: 37550 - RNA, 23 nt, Artificial Sequence
  RNA Oligomer
aaauauuuguuugggugguuugu

SEQ ID NO: 37551 - RNA, 23 nt, Artificial Sequence
  RNA Oligomer
uaaauauuuguuugggugguuug

SEQ ID NO: 37552 - RNA, 23 nt, Artificial Sequence
  RNA Oligomer
auaaauauuuguuugggugguuu

SEQ ID NO: 37553 - RNA, 23 nt, Artificial Sequence
  RNA Oligomer
guagucaaggugcucaauaaaua

SEQ ID NO: 37554 - RNA, 23 nt, Artificial Sequence
  RNA Oligomer
aguagucaaggugcucaauaaau

SEQ ID NO: 37555 - RNA, 23 nt, Artificial Sequence
  RNA Oligomer
uaguagucaaggugcucaauaaa

SEQ ID NO: 37556 - RNA, 23 nt, Artificial Sequence
  RNA Oligomer
guaguagucaaggugcucaauaa

SEQ ID NO: 37557 - RNA, 23 nt, Artificial Sequence
  RNA Oligomer
uguaguagucaaggugcucaaua

SEQ ID NO: 37558 - RNA, 23 nt, Artificial Sequence
  RNA Oligomer
aggggacgcaggauauugggagu

SEQ ID NO: 37559 - RNA, 23 nt, Artificial Sequence
  RNA Oligomer
uccuugaagacauaucaugugug

SEQ ID NO: 37560 - RNA, 23 nt, Artificial Sequence
  RNA Oligomer
gcuccuugaagacauaucaugug

SEQ ID NO: 37561 - RNA, 23 nt, Artificial Sequence
  RNA Oligomer
agcuccuugaagacauaucaugu

SEQ ID NO: 37562 - RNA, 23 nt, Artificial Sequence
  RNA Oligomer
uagcuccuugaagacauaucaug

SEQ ID NO: 37563 - RNA, 23 nt, Artificial Sequence
  RNA Oligomer
uuagcuccuugaagacauaucau

SEQ ID NO: 37564 - RNA, 23 nt, Artificial Sequence
  RNA Oligomer
uuuagcuccuugaagacauauca

SEQ ID NO: 37565 - RNA, 23 nt, Artificial Sequence
  RNA Oligomer
caaccuuagcuacaauccuaccu

SEQ ID NO: 37566 - RNA, 23 nt, Artificial Sequence
  RNA Oligomer
ccaaccuuagcuacaauccuacc

SEQ ID NO: 37567 - RNA, 23 nt, Artificial Sequence
  RNA Oligomer
gccaaccuuagcuacaauccuac

SEQ ID NO: 37568 - RNA, 23 nt, Artificial Sequence
  RNA Oligomer
agccaaccuuagcuacaauccua

SEQ ID NO: 37569 - RNA, 23 nt, Artificial Sequence
  RNA Oligomer
ccugagcagucuacuucuguguc

SEQ ID NO: 37570 - RNA, 23 nt, Artificial Sequence
  RNA Oligomer
cccugagcagucuacuucugugu

SEQ ID NO: 37571 - RNA, 23 nt, Artificial Sequence
  RNA Oligomer
ucccugagcagucuacuucugug

SEQ ID NO: 37572 - RNA, 23 nt, Artificial Sequence
  RNA Oligomer
gucccugagcagucuacuucugu

SEQ ID NO: 37573 - RNA, 23 nt, Artificial Sequence
  RNA Oligomer
agucccugagcagucuacuucug

SEQ ID NO: 37574 - RNA, 23 nt, Artificial Sequence
  RNA Oligomer
cuucaccuugguuuaugagaacu

SEQ ID NO: 37575 - RNA, 23 nt, Artificial Sequence
  RNA Oligomer
ucuucaccuugguuuaugagaac

SEQ ID NO: 37576 - RNA, 23 nt, Artificial Sequence
  RNA Oligomer
accccccugcuuagaacccuucu

SEQ ID NO: 37577 - RNA, 23 nt, Artificial Sequence
  RNA Oligomer
cugcuuucucuuucaguauuaaa

SEQ ID NO: 37578 - RNA, 23 nt, Artificial Sequence
  RNA Oligomer
ccugcuuucucuuucaguauuaa

SEQ ID NO: 37579 - RNA, 23 nt, Artificial Sequence
  RNA Oligomer
uccugcuuucucuuucaguauua

SEQ ID NO: 37580 - RNA, 23 nt, Artificial Sequence
  RNA Oligomer
uuccugcuuucucuuucaguauu

SEQ ID NO: 37581 - RNA, 23 nt, Artificial Sequence
  RNA Oligomer
guuccugcuuucucuuucaguau

SEQ ID NO: 37582 - RNA, 23 nt, Artificial Sequence
  RNA Oligomer
aguucuuuguuccugcuuucucu

SEQ ID NO: 37583 - RNA, 23 nt, Artificial Sequence
  RNA Oligomer
uaguucuuuguuccugcuuucuc

SEQ ID NO: 37584 - RNA, 23 nt, Artificial Sequence
  RNA Oligomer
guaguucuuuguuccugcuuucu

SEQ ID NO: 37585 - RNA, 23 nt, Artificial Sequence
  RNA Oligomer
uguaguucuuuguuccugcuuuc

SEQ ID NO: 37586 - RNA, 23 nt, Artificial Sequence
  RNA Oligomer
auguaguucuuuguuccugcuuu

SEQ ID NO: 37587 - RNA, 23 nt, Artificial Sequence
  RNA Oligomer
aauguaguucuuuguuccugcuu

SEQ ID NO: 37588 - RNA, 23 nt, Artificial Sequence
  RNA Oligomer
uaauguaguucuuuguuccugcu

SEQ ID NO: 37589 - RNA, 23 nt, Artificial Sequence
  RNA Oligomer
ccuuacuauucccacuuucauuc

SEQ ID NO: 37590 - RNA, 23 nt, Artificial Sequence
  RNA Oligomer
ccucucugucuuuuuccuuccug

SEQ ID NO: 37591 - RNA, 23 nt, Artificial Sequence
  RNA Oligomer
accucucugucuuuuuccuuccu

SEQ ID NO: 37592 - RNA, 23 nt, Artificial Sequence
  RNA Oligomer
caccucucugucuuuuuccuucc

SEQ ID NO: 37593 - RNA, 23 nt, Artificial Sequence
  RNA Oligomer
caaagaucuuucguugguuguuu

SEQ ID NO: 37594 - RNA, 23 nt, Artificial Sequence
  RNA Oligomer
ucaaagaucuuucguugguuguu

SEQ ID NO: 37595 - RNA, 23 nt, Artificial Sequence
  RNA Oligomer
cucaaagaucuuucguugguugu

SEQ ID NO: 37596 - RNA, 23 nt, Artificial Sequence
  RNA Oligomer
ucucaaagaucuuucguugguug

SEQ ID NO: 37597 - RNA, 23 nt, Artificial Sequence
  RNA Oligomer
gucucaaagaucuuucguugguu

SEQ ID NO: 37598 - RNA, 23 nt, Artificial Sequence
  RNA Oligomer
gaagguguccaaauuuaauguag

SEQ ID NO: 37599 - RNA, 23 nt, Artificial Sequence
  RNA Oligomer
ggaagguguccaaauuuaaugua

SEQ ID NO: 37600 - RNA, 23 nt, Artificial Sequence
  RNA Oligomer
uggaagguguccaaauuuaaugu

SEQ ID NO: 37601 - RNA, 23 nt, Artificial Sequence
  RNA Oligomer
uuggaagguguccaaauuuaaug

SEQ ID NO: 37602 - RNA, 23 nt, Artificial Sequence
  RNA Oligomer
uuuggaagguguccaaauuuaau

SEQ ID NO: 37603 - RNA, 23 nt, Artificial Sequence
  RNA Oligomer
uucuggagaaggacaucaucacc

SEQ ID NO: 37604 - RNA, 23 nt, Artificial Sequence
  RNA Oligomer
cuucuggagaaggacaucaucac

SEQ ID NO: 37605 - RNA, 23 nt, Artificial Sequence
  RNA Oligomer
ucuucuggagaaggacaucauca

SEQ ID NO: 37606 - RNA, 23 nt, Artificial Sequence
  RNA Oligomer
aucuucuggagaaggacaucauc

SEQ ID NO: 37607 - RNA, 23 nt, Artificial Sequence
  RNA Oligomer
caucuucuggagaaggacaucau

SEQ ID NO: 37608 - RNA, 23 nt, Artificial Sequence
  RNA Oligomer
uauuuguguucaguuccagcuuu

SEQ ID NO: 37609 - RNA, 23 nt, Artificial Sequence
  RNA Oligomer
aaguuguaaacacagugugguua

SEQ ID NO: 37610 - RNA, 23 nt, Artificial Sequence
  RNA Oligomer
uugaagagccugacaagugaagu

SEQ ID NO: 37611 - RNA, 23 nt, Artificial Sequence
  RNA Oligomer
guugaagagccugacaagugaag

SEQ ID NO: 37612 - RNA, 23 nt, Artificial Sequence
  RNA Oligomer
aguugaagagccugacaagugaa

SEQ ID NO: 37613 - RNA, 23 nt, Artificial Sequence
  RNA Oligomer
caguugaagagccugacaaguga

SEQ ID NO: 37614 - RNA, 23 nt, Artificial Sequence
  RNA Oligomer
ugauagagccuuugaucuucagg

SEQ ID NO: 37615 - RNA, 23 nt, Artificial Sequence
  RNA Oligomer
gugauagagccuuugaucuucag

SEQ ID NO: 37616 - RNA, 23 nt, Artificial Sequence
  RNA Oligomer
ugugauagagccuuugaucuuca

SEQ ID NO: 37617 - RNA, 23 nt, Artificial Sequence
  RNA Oligomer
uguugagcgaauuguuagaacau

SEQ ID NO: 37618 - RNA, 23 nt, Artificial Sequence
  RNA Oligomer
cacuuaucaaggaucgggaaggu

SEQ ID NO: 37619 - RNA, 23 nt, Artificial Sequence
  RNA Oligomer
aaggugaacgcacuuaucaagga

SEQ ID NO: 37620 - RNA, 23 nt, Artificial Sequence
  RNA Oligomer
cugguacaucgaggcucuugcuc

SEQ ID NO: 37621 - RNA, 23 nt, Artificial Sequence
  RNA Oligomer
ccugguacaucgaggcucuugcu

SEQ ID NO: 37622 - RNA, 23 nt, Artificial Sequence
  RNA Oligomer
uccugguacaucgaggcucuugc

SEQ ID NO: 37623 - RNA, 23 nt, Artificial Sequence
  RNA Oligomer
uuccugguacaucgaggcucuug

SEQ ID NO: 37624 - RNA, 23 nt, Artificial Sequence
  RNA Oligomer
guuccugguacaucgaggcucuu

SEQ ID NO: 37625 - RNA, 23 nt, Artificial Sequence
  RNA Oligomer
cgguaaagaaaaguugccgaaga

SEQ ID NO: 37626 - RNA, 23 nt, Artificial Sequence
  RNA Oligomer
ugcgaggagagugaugccgguaa

SEQ ID NO: 37627 - RNA, 23 nt, Artificial Sequence
  RNA Oligomer
cccaagccuacagaacaaaccaa

SEQ ID NO: 37628 - RNA, 23 nt, Artificial Sequence
  RNA Oligomer
gcccaagccuacagaacaaacca

SEQ ID NO: 37629 - RNA, 23 nt, Artificial Sequence
  RNA Oligomer
ugcccaagccuacagaacaaacc

SEQ ID NO: 37630 - RNA, 23 nt, Artificial Sequence
  RNA Oligomer
cugcccaagccuacagaacaaac

SEQ ID NO: 37631 - RNA, 23 nt, Artificial Sequence
  RNA Oligomer
acugcccaagccuacagaacaaa

SEQ ID NO: 37632 - RNA, 23 nt, Artificial Sequence
  RNA Oligomer
ggcuaugacguccauguucuaug

SEQ ID NO: 37633 - RNA, 23 nt, Artificial Sequence
  RNA Oligomer
gggcuaugacguccauguucuau

SEQ ID NO: 37634 - RNA, 23 nt, Artificial Sequence
  RNA Oligomer
ugggcuaugacguccauguucua

SEQ ID NO: 37635 - RNA, 23 nt, Artificial Sequence
  RNA Oligomer
uugggcuaugacguccauguucu

SEQ ID NO: 37636 - RNA, 23 nt, Artificial Sequence
  RNA Oligomer
agaaagaacuggaauuucgcucu

SEQ ID NO: 37637 - RNA, 23 nt, Artificial Sequence
  RNA Oligomer
gagaaagaacuggaauuucgcuc

SEQ ID NO: 37638 - RNA, 23 nt, Artificial Sequence
  RNA Oligomer
agagaaagaacuggaauuucgcu

SEQ ID NO: 37639 - RNA, 23 nt, Artificial Sequence
  RNA Oligomer
gagagaaagaacuggaauuucgc

SEQ ID NO: 37640 - RNA, 23 nt, Artificial Sequence
  RNA Oligomer
ggagagaaagaacuggaauuucg

SEQ ID NO: 37641 - RNA, 23 nt, Artificial Sequence
  RNA Oligomer
uucacuggagagaaagaacugga

SEQ ID NO: 37642 - RNA, 23 nt, Artificial Sequence
  RNA Oligomer
cuucacuggagagaaagaacugg

SEQ ID NO: 37643 - RNA, 23 nt, Artificial Sequence
  RNA Oligomer
acuucacuggagagaaagaacug

SEQ ID NO: 37644 - RNA, 23 nt, Artificial Sequence
  RNA Oligomer
cacuucacuggagagaaagaacu

SEQ ID NO: 37645 - RNA, 23 nt, Artificial Sequence
  RNA Oligomer
gccaaauaaaugcucauauuuau

SEQ ID NO: 37646 - RNA, 23 nt, Artificial Sequence
  RNA Oligomer
ugccaaauaaaugcucauauuua

SEQ ID NO: 37647 - RNA, 23 nt, Artificial Sequence
  RNA Oligomer
gugccaaauaaaugcucauauuu

SEQ ID NO: 37648 - RNA, 23 nt, Artificial Sequence
  RNA Oligomer
ggugccaaauaaaugcucauauu

SEQ ID NO: 37649 - RNA, 23 nt, Artificial Sequence
  RNA Oligomer
gggugccaaauaaaugcucauau

SEQ ID NO: 37650 - RNA, 23 nt, Artificial Sequence
  RNA Oligomer
aaguauuugagagagagaaccuu

SEQ ID NO: 37651 - RNA, 23 nt, Artificial Sequence
  RNA Oligomer
gaaguauuugagagagagaaccu

SEQ ID NO: 37652 - RNA, 23 nt, Artificial Sequence
  RNA Oligomer
uagucaaggugcucaauaaauau

SEQ ID NO: 37653 - RNA, 23 nt, Artificial Sequence
  RNA Oligomer
cagucccugagcagucuacuucu

SEQ ID NO: 37654 - RNA, 23 nt, Artificial Sequence
  RNA Oligomer
ucagucccugagcagucuacuuc

SEQ ID NO: 37655 - RNA, 23 nt, Artificial Sequence
  RNA Oligomer
uucagucccugagcagucuacuu

SEQ ID NO: 37656 - RNA, 23 nt, Artificial Sequence
  RNA Oligomer
cuaauuuugugcucuuuccugcc

SEQ ID NO: 37657 - RNA, 23 nt, Artificial Sequence
  RNA Oligomer
ucuaauuuugugcucuuuccugc

SEQ ID NO: 37658 - RNA, 23 nt, Artificial Sequence
  RNA Oligomer
uucuaauuuugugcucuuuccug

SEQ ID NO: 37659 - RNA, 23 nt, Artificial Sequence
  RNA Oligomer
ucucagcuucuaauuuugugcuc

SEQ ID NO: 37660 - RNA, 23 nt, Artificial Sequence
  RNA Oligomer
ggucuccucucagcuucuaauuu

SEQ ID NO: 37661 - RNA, 23 nt, Artificial Sequence
  RNA Oligomer
uggucuccucucagcuucuaauu

SEQ ID NO: 37662 - RNA, 23 nt, Artificial Sequence
  RNA Oligomer
guggucuccucucagcuucuaau

SEQ ID NO: 37663 - RNA, 23 nt, Artificial Sequence
  RNA Oligomer
aguggucuccucucagcuucuaa

SEQ ID NO: 37664 - RNA, 23 nt, Artificial Sequence
  RNA Oligomer
gaguggucuccucucagcuucua

SEQ ID NO: 37665 - RNA, 23 nt, Artificial Sequence
  RNA Oligomer
aucugaaacuucccaacuucccu

SEQ ID NO: 37666 - RNA, 23 nt, Artificial Sequence
  RNA Oligomer
uaucugaaacuucccaacuuccc

SEQ ID NO: 37667 - RNA, 23 nt, Artificial Sequence
  RNA Oligomer
uuaucugaaacuucccaacuucc

SEQ ID NO: 37668 - RNA, 23 nt, Artificial Sequence
  RNA Oligomer
cuuaucugaaacuucccaacuuc

SEQ ID NO: 37669 - RNA, 23 nt, Artificial Sequence
  RNA Oligomer
gcuuaucugaaacuucccaacuu

SEQ ID NO: 37670 - RNA, 23 nt, Artificial Sequence
  RNA Oligomer
ugcuuaucugaaacuucccaacu

SEQ ID NO: 37671 - RNA, 23 nt, Artificial Sequence
  RNA Oligomer
cugcuuaucugaaacuucccaac

SEQ ID NO: 37672 - RNA, 23 nt, Artificial Sequence
  RNA Oligomer
ccugcuuaucugaaacuucccaa

SEQ ID NO: 37673 - RNA, 23 nt, Artificial Sequence
  RNA Oligomer
cccugcuuaucugaaacuuccca

SEQ ID NO: 37674 - RNA, 23 nt, Artificial Sequence
  RNA Oligomer
uuucaguauuaaacucuccuuug

SEQ ID NO: 37675 - RNA, 23 nt, Artificial Sequence
  RNA Oligomer
cuuucaguauuaaacucuccuuu

SEQ ID NO: 37676 - RNA, 23 nt, Artificial Sequence
  RNA Oligomer
ucuuucaguauuaaacucuccuu

SEQ ID NO: 37677 - RNA, 23 nt, Artificial Sequence
  RNA Oligomer
caaagauguaauguaguucuuug

SEQ ID NO: 37678 - RNA, 23 nt, Artificial Sequence
  RNA Oligomer
ucaaagauguaauguaguucuuu

SEQ ID NO: 37679 - RNA, 23 nt, Artificial Sequence
  RNA Oligomer
cucaaagauguaauguaguucuu

SEQ ID NO: 37680 - RNA, 23 nt, Artificial Sequence
  RNA Oligomer
caaaucugucuagaauccugcuu

SEQ ID NO: 37681 - RNA, 23 nt, Artificial Sequence
  RNA Oligomer
agcuuuguuacugaaaugagccu

SEQ ID NO: 37682 - RNA, 23 nt, Artificial Sequence
  RNA Oligomer
cauuaucuuuuggcucugaagaa

SEQ ID NO: 37683 - RNA, 23 nt, Artificial Sequence
  RNA Oligomer
uucaguuccagcuuuuguagaug

SEQ ID NO: 37684 - RNA, 23 nt, Artificial Sequence
  RNA Oligomer
guucaguuccagcuuuuguagau

SEQ ID NO: 37685 - RNA, 23 nt, Artificial Sequence
  RNA Oligomer
uguucaguuccagcuuuuguaga

SEQ ID NO: 37686 - RNA, 23 nt, Artificial Sequence
  RNA Oligomer
ggaugcacgguuucuguucugcc

SEQ ID NO: 37687 - RNA, 23 nt, Artificial Sequence
  RNA Oligomer
aggaugcacgguuucuguucugc

SEQ ID NO: 37688 - RNA, 23 nt, Artificial Sequence
  RNA Oligomer
caggaugcacgguuucuguucug

SEQ ID NO: 37689 - RNA, 23 nt, Artificial Sequence
  RNA Oligomer
ucaggaugcacgguuucuguucu

SEQ ID NO: 37690 - RNA, 23 nt, Artificial Sequence
  RNA Oligomer
uucaggaugcacgguuucuguuc

SEQ ID NO: 37691 - RNA, 23 nt, Artificial Sequence
  RNA Oligomer
uuguugagcgaauuguuagaaca

SEQ ID NO: 37692 - RNA, 23 nt, Artificial Sequence
  RNA Oligomer
guguuuucugagcgggcuuguga

SEQ ID NO: 37693 - RNA, 23 nt, Artificial Sequence
  RNA Oligomer
aguguuuucugagcgggcuugug

SEQ ID NO: 37694 - RNA, 23 nt, Artificial Sequence
  RNA Oligomer
aaguguuuucugagcgggcuugu

SEQ ID NO: 37695 - RNA, 23 nt, Artificial Sequence
  RNA Oligomer
caaguguuuucugagcgggcuug

SEQ ID NO: 37696 - RNA, 23 nt, Artificial Sequence
  RNA Oligomer
ucaaguguuuucugagcgggcuu

SEQ ID NO: 37697 - RNA, 23 nt, Artificial Sequence
  RNA Oligomer
cuaugguguggaugggaaacugc

SEQ ID NO: 37698 - RNA, 23 nt, Artificial Sequence
  RNA Oligomer
ucuaugguguggaugggaaacug

SEQ ID NO: 37699 - RNA, 23 nt, Artificial Sequence
  RNA Oligomer
aucuaugguguggaugggaaacu

SEQ ID NO: 37700 - RNA, 23 nt, Artificial Sequence
  RNA Oligomer
caucuaugguguggaugggaaac

SEQ ID NO: 37701 - RNA, 23 nt, Artificial Sequence
  RNA Oligomer
ccaucuaugguguggaugggaaa

SEQ ID NO: 37702 - RNA, 23 nt, Artificial Sequence
  RNA Oligomer
uuugggcuaugacguccauguuc

SEQ ID NO: 37703 - RNA, 23 nt, Artificial Sequence
  RNA Oligomer
uaguauggaaguauuugagagag

SEQ ID NO: 37704 - RNA, 23 nt, Artificial Sequence
  RNA Oligomer
auaguauggaaguauuugagaga

SEQ ID NO: 37705 - RNA, 23 nt, Artificial Sequence
  RNA Oligomer
cauaguauggaaguauuugagag

SEQ ID NO: 37706 - RNA, 23 nt, Artificial Sequence
  RNA Oligomer
ugaauaaaagagggaagaaggca

SEQ ID NO: 37707 - RNA, 23 nt, Artificial Sequence
  RNA Oligomer
uugaauaaaagagggaagaaggc

SEQ ID NO: 37708 - RNA, 23 nt, Artificial Sequence
  RNA Oligomer
guugaauaaaagagggaagaagg

SEQ ID NO: 37709 - RNA, 23 nt, Artificial Sequence
  RNA Oligomer
uguugaauaaaagagggaagaag

SEQ ID NO: 37710 - RNA, 23 nt, Artificial Sequence
  RNA Oligomer
uuguugaauaaaagagggaagaa

SEQ ID NO: 37711 - RNA, 23 nt, Artificial Sequence
  RNA Oligomer
uuuguugaauaaaagagggaaga

SEQ ID NO: 37712 - RNA, 23 nt, Artificial Sequence
  RNA Oligomer
guuuguugaauaaaagagggaag

SEQ ID NO: 37713 - RNA, 23 nt, Artificial Sequence
  RNA Oligomer
uguuuguugaauaaaagagggaa

SEQ ID NO: 37714 - RNA, 23 nt, Artificial Sequence
  RNA Oligomer
cauagugggccuucauuaaaugu

SEQ ID NO: 37715 - RNA, 23 nt, Artificial Sequence
  RNA Oligomer
acauagugggccuucauuaaaug

SEQ ID NO: 37716 - RNA, 23 nt, Artificial Sequence
  RNA Oligomer
cacauagugggccuucauuaaau

SEQ ID NO: 37717 - RNA, 23 nt, Artificial Sequence
  RNA Oligomer
uaccaggcuguaaaugagggcag

SEQ ID NO: 37718 - RNA, 23 nt, Artificial Sequence
  RNA Oligomer
cugucuuuuuccuuccugagaaa

SEQ ID NO: 37719 - RNA, 23 nt, Artificial Sequence
  RNA Oligomer
ucugucuuuuuccuuccugagaa

SEQ ID NO: 37720 - RNA, 23 nt, Artificial Sequence
  RNA Oligomer
cucugucuuuuuccuuccugaga

SEQ ID NO: 37721 - RNA, 23 nt, Artificial Sequence
  RNA Oligomer
ucucugucuuuuuccuuccugag

SEQ ID NO: 37722 - RNA, 23 nt, Artificial Sequence
  RNA Oligomer
cucucugucuuuuuccuuccuga

SEQ ID NO: 37723 - RNA, 23 nt, Artificial Sequence
  RNA Oligomer
caucagagaaggccaggaagaau

SEQ ID NO: 37724 - RNA, 23 nt, Artificial Sequence
  RNA Oligomer
gcaucagagaaggccaggaagaa

SEQ ID NO: 37725 - RNA, 23 nt, Artificial Sequence
  RNA Oligomer
agcaucagagaaggccaggaaga

SEQ ID NO: 37726 - RNA, 23 nt, Artificial Sequence
  RNA Oligomer
gagcaucagagaaggccaggaag

SEQ ID NO: 37727 - RNA, 23 nt, Artificial Sequence
  RNA Oligomer
ggagcaucagagaaggccaggaa

SEQ ID NO: 37728 - RNA, 23 nt, Artificial Sequence
  RNA Oligomer
agucucaaagaucuuucguuggu

SEQ ID NO: 37729 - RNA, 23 nt, Artificial Sequence
  RNA Oligomer
cuagagugagaguuuggaaggug

SEQ ID NO: 37730 - RNA, 23 nt, Artificial Sequence
  RNA Oligomer
ccuagagugagaguuuggaaggu

SEQ ID NO: 37731 - RNA, 23 nt, Artificial Sequence
  RNA Oligomer
uccuagagugagaguuuggaagg

SEQ ID NO: 37732 - RNA, 23 nt, Artificial Sequence
  RNA Oligomer
uucauucauauccuccgcccuuu

SEQ ID NO: 37733 - RNA, 23 nt, Artificial Sequence
  RNA Oligomer
accggugcaaggagaugucugaa

SEQ ID NO: 37734 - RNA, 23 nt, Artificial Sequence
  RNA Oligomer
caccggugcaaggagaugucuga

SEQ ID NO: 37735 - RNA, 23 nt, Artificial Sequence
  RNA Oligomer
guuguugagcgaauuguuagaac

SEQ ID NO: 37736 - RNA, 23 nt, Artificial Sequence
  RNA Oligomer
uguuguugagcgaauuguuagaa

SEQ ID NO: 37737 - RNA, 23 nt, Artificial Sequence
  RNA Oligomer
acagaacaaaccaaaaauguucu

SEQ ID NO: 37738 - RNA, 23 nt, Artificial Sequence
  RNA Oligomer
uacagaacaaaccaaaaauguuc

SEQ ID NO: 37739 - RNA, 23 nt, Artificial Sequence
  RNA Oligomer
ugguguggaugggaaacugcucc

SEQ ID NO: 37740 - RNA, 23 nt, Artificial Sequence
  RNA Oligomer
augguguggaugggaaacugcuc

SEQ ID NO: 37741 - RNA, 23 nt, Artificial Sequence
  RNA Oligomer
uaugguguggaugggaaacugcu

SEQ ID NO: 37742 - RNA, 23 nt, Artificial Sequence
  RNA Oligomer
gccaucuaugguguggaugggaa

SEQ ID NO: 37743 - RNA, 23 nt, Artificial Sequence
  RNA Oligomer
ggaaaugcaagagaaacugcaga

SEQ ID NO: 37744 - RNA, 23 nt, Artificial Sequence
  RNA Oligomer
aggaaaugcaagagaaacugcag

SEQ ID NO: 37745 - RNA, 23 nt, Artificial Sequence
  RNA Oligomer
caggaaaugcaagagaaacugca

SEQ ID NO: 37746 - RNA, 23 nt, Artificial Sequence
  RNA Oligomer
acaggaaaugcaagagaaacugc

SEQ ID NO: 37747 - RNA, 23 nt, Artificial Sequence
  RNA Oligomer
ugcacuucacuggagagaaagaa

SEQ ID NO: 37748 - RNA, 23 nt, Artificial Sequence
  RNA Oligomer
gugcacuucacuggagagaaaga

SEQ ID NO: 37749 - RNA, 23 nt, Artificial Sequence
  RNA Oligomer
ugugcacuucacuggagagaaag

SEQ ID NO: 37750 - RNA, 23 nt, Artificial Sequence
  RNA Oligomer
augugcacuucacuggagagaaa

SEQ ID NO: 37751 - RNA, 23 nt, Artificial Sequence
  RNA Oligomer
aaugugcacuucacuggagagaa

SEQ ID NO: 37752 - RNA, 23 nt, Artificial Sequence
  RNA Oligomer
aucaucaggaaacucuaaaaaag

SEQ ID NO: 37753 - RNA, 23 nt, Artificial Sequence
  RNA Oligomer
caucaucaggaaacucuaaaaaa

SEQ ID NO: 37754 - RNA, 23 nt, Artificial Sequence
  RNA Oligomer
acaucucccauggucccuagcaa

SEQ ID NO: 37755 - RNA, 23 nt, Artificial Sequence
  RNA Oligomer
cacaucucccauggucccuagca

SEQ ID NO: 37756 - RNA, 23 nt, Artificial Sequence
  RNA Oligomer
ucacaucucccauggucccuagc

SEQ ID NO: 37757 - RNA, 23 nt, Artificial Sequence
  RNA Oligomer
uucacaucucccauggucccuag

SEQ ID NO: 37758 - RNA, 23 nt, Artificial Sequence
  RNA Oligomer
cuucacaucucccauggucccua

SEQ ID NO: 37759 - RNA, 23 nt, Artificial Sequence
  RNA Oligomer
gaauaaaagagggaagaaggcaa

SEQ ID NO: 37760 - RNA, 23 nt, Artificial Sequence
  RNA Oligomer
caggauuugguuguuuaaauaua

SEQ ID NO: 37761 - RNA, 23 nt, Artificial Sequence
  RNA Oligomer
ccaggauuugguuguuuaaauau

SEQ ID NO: 37762 - RNA, 23 nt, Artificial Sequence
  RNA Oligomer
gccaggauuugguuguuuaaaua

SEQ ID NO: 37763 - RNA, 23 nt, Artificial Sequence
  RNA Oligomer
ggccaggauuugguuguuuaaau

SEQ ID NO: 37764 - RNA, 23 nt, Artificial Sequence
  RNA Oligomer
uggccaggauuugguuguuuaaa

SEQ ID NO: 37765 - RNA, 23 nt, Artificial Sequence
  RNA Oligomer
gcuuucucuuucaguauuaaacu

SEQ ID NO: 37766 - RNA, 23 nt, Artificial Sequence
  RNA Oligomer
ugcuuucucuuucaguauuaaac

SEQ ID NO: 37767 - RNA, 23 nt, Artificial Sequence
  RNA Oligomer
guucuuuguuccugcuuucucuu

SEQ ID NO: 37768 - RNA, 23 nt, Artificial Sequence
  RNA Oligomer
aagauguaauguaguucuuuguu

SEQ ID NO: 37769 - RNA, 23 nt, Artificial Sequence
  RNA Oligomer
aaagauguaauguaguucuuugu

SEQ ID NO: 37770 - RNA, 23 nt, Artificial Sequence
  RNA Oligomer
ggcugcugccaccaaaucugucu

SEQ ID NO: 37771 - RNA, 23 nt, Artificial Sequence
  RNA Oligomer
cucucucccuuacuauucccacu

SEQ ID NO: 37772 - RNA, 23 nt, Artificial Sequence
  RNA Oligomer
gguguccaaauuuaauguagaca

SEQ ID NO: 37773 - RNA, 23 nt, Artificial Sequence
  RNA Oligomer
agguguccaaauuuaauguagac

SEQ ID NO: 37774 - RNA, 23 nt, Artificial Sequence
  RNA Oligomer
aagguguccaaauuuaauguaga

SEQ ID NO: 37775 - RNA, 23 nt, Artificial Sequence
  RNA Oligomer
gccuugguuggaccuauugccag

SEQ ID NO: 37776 - RNA, 23 nt, Artificial Sequence
  RNA Oligomer
agccuugguuggaccuauugcca

SEQ ID NO: 37777 - RNA, 23 nt, Artificial Sequence
  RNA Oligomer
cagccuugguuggaccuauugcc

SEQ ID NO: 37778 - RNA, 23 nt, Artificial Sequence
  RNA Oligomer
ccagccuugguuggaccuauugc

SEQ ID NO: 37779 - RNA, 23 nt, Artificial Sequence
  RNA Oligomer
gccagccuugguuggaccuauug

SEQ ID NO: 37780 - RNA, 23 nt, Artificial Sequence
  RNA Oligomer
acacuuccagcuggcauauaggu

SEQ ID NO: 37781 - RNA, 23 nt, Artificial Sequence
  RNA Oligomer
cacacuuccagcuggcauauagg

SEQ ID NO: 37782 - RNA, 23 nt, Artificial Sequence
  RNA Oligomer
acacacuuccagcuggcauauag

SEQ ID NO: 37783 - RNA, 23 nt, Artificial Sequence
  RNA Oligomer
aacacacuuccagcuggcauaua

SEQ ID NO: 37784 - RNA, 23 nt, Artificial Sequence
  RNA Oligomer
aaacacacuuccagcuggcauau

SEQ ID NO: 37785 - RNA, 23 nt, Artificial Sequence
  RNA Oligomer
cuccugaauuuuaucaaacacac

SEQ ID NO: 37786 - RNA, 23 nt, Artificial Sequence
  RNA Oligomer
acuccugaauuuuaucaaacaca

SEQ ID NO: 37787 - RNA, 23 nt, Artificial Sequence
  RNA Oligomer
cacuccugaauuuuaucaaacac

SEQ ID NO: 37788 - RNA, 23 nt, Artificial Sequence
  RNA Oligomer
gcacuccugaauuuuaucaaaca

SEQ ID NO: 37789 - RNA, 23 nt, Artificial Sequence
  RNA Oligomer
ugcacuccugaauuuuaucaaac

SEQ ID NO: 37790 - RNA, 23 nt, Artificial Sequence
  RNA Oligomer
ccaaagugggcaguuucagccag

SEQ ID NO: 37791 - RNA, 23 nt, Artificial Sequence
  RNA Oligomer
gccaaagugggcaguuucagcca

SEQ ID NO: 37792 - RNA, 23 nt, Artificial Sequence
  RNA Oligomer
ggccaaagugggcaguuucagcc

SEQ ID NO: 37793 - RNA, 23 nt, Artificial Sequence
  RNA Oligomer
aggccaaagugggcaguuucagc

SEQ ID NO: 37794 - RNA, 23 nt, Artificial Sequence
  RNA Oligomer
caggccaaagugggcaguuucag

SEQ ID NO: 37795 - RNA, 23 nt, Artificial Sequence
  RNA Oligomer
gcuuuguuacugaaaugagccuc

SEQ ID NO: 37796 - RNA, 23 nt, Artificial Sequence
  RNA Oligomer
uuugcccauggaagucucaaaga

SEQ ID NO: 37797 - RNA, 23 nt, Artificial Sequence
  RNA Oligomer
cuuugcccauggaagucucaaag

SEQ ID NO: 37798 - RNA, 23 nt, Artificial Sequence
  RNA Oligomer
ccaguggaaggacacucuuggcu

SEQ ID NO: 37799 - RNA, 23 nt, Artificial Sequence
  RNA Oligomer
cccaguggaaggacacucuuggc

SEQ ID NO: 37800 - RNA, 23 nt, Artificial Sequence
  RNA Oligomer
acccaguggaaggacacucuugg

SEQ ID NO: 37801 - RNA, 23 nt, Artificial Sequence
  RNA Oligomer
cacccaguggaaggacacucuug

SEQ ID NO: 37802 - RNA, 23 nt, Artificial Sequence
  RNA Oligomer
ccacccaguggaaggacacucuu

SEQ ID NO: 37803 - RNA, 23 nt, Artificial Sequence
  RNA Oligomer
gugagaguuuggaagguguccaa

SEQ ID NO: 37804 - RNA, 23 nt, Artificial Sequence
  RNA Oligomer
agugagaguuuggaaggugucca

SEQ ID NO: 37805 - RNA, 23 nt, Artificial Sequence
  RNA Oligomer
gagugagaguuuggaaggugucc

SEQ ID NO: 37806 - RNA, 23 nt, Artificial Sequence
  RNA Oligomer
agagugagaguuuggaagguguc

SEQ ID NO: 37807 - RNA, 23 nt, Artificial Sequence
  RNA Oligomer
uagagugagaguuuggaaggugu

SEQ ID NO: 37808 - RNA, 23 nt, Artificial Sequence
  RNA Oligomer
auauuuguguucaguuccagcuu

SEQ ID NO: 37809 - RNA, 23 nt, Artificial Sequence
  RNA Oligomer
cauauuuguguucaguuccagcu

SEQ ID NO: 37810 - RNA, 23 nt, Artificial Sequence
  RNA Oligomer
gaauguuucagcugcaguugaag

SEQ ID NO: 37811 - RNA, 23 nt, Artificial Sequence
  RNA Oligomer
ggaauguuucagcugcaguugaa

SEQ ID NO: 37812 - RNA, 23 nt, Artificial Sequence
  RNA Oligomer
cacuuccagcuggcauauagguu

SEQ ID NO: 37813 - RNA, 23 nt, Artificial Sequence
  RNA Oligomer
ccacaucuugucuuuuccccuca

SEQ ID NO: 37814 - RNA, 23 nt, Artificial Sequence
  RNA Oligomer
accacaucuugucuuuuccccuc

SEQ ID NO: 37815 - RNA, 23 nt, Artificial Sequence
  RNA Oligomer
ucuuugcccauggaagucucaaa

SEQ ID NO: 37816 - RNA, 23 nt, Artificial Sequence
  RNA Oligomer
aacauugccuugcauuuguaccu

SEQ ID NO: 37817 - RNA, 23 nt, Artificial Sequence
  RNA Oligomer
caacauugccuugcauuuguacc

SEQ ID NO: 37818 - RNA, 23 nt, Artificial Sequence
  RNA Oligomer
ccaacauugccuugcauuuguac

SEQ ID NO: 37819 - RNA, 23 nt, Artificial Sequence
  RNA Oligomer
gccaacauugccuugcauuugua

SEQ ID NO: 37820 - RNA, 23 nt, Artificial Sequence
  RNA Oligomer
cgccaucuaugguguggauggga

SEQ ID NO: 37821 - RNA, 23 nt, Artificial Sequence
  RNA Oligomer
gcgccaucuaugguguggauggg

SEQ ID NO: 37822 - RNA, 23 nt, Artificial Sequence
  RNA Oligomer
ggcgccaucuaugguguggaugg

SEQ ID NO: 37823 - RNA, 23 nt, Artificial Sequence
  RNA Oligomer
gggcgccaucuaugguguggaug

SEQ ID NO: 37824 - RNA, 23 nt, Artificial Sequence
  RNA Oligomer
agggcgccaucuaugguguggau

SEQ ID NO: 37825 - RNA, 23 nt, Artificial Sequence
  RNA Oligomer
ccauucuuucuuccuccagucug

SEQ ID NO: 37826 - RNA, 23 nt, Artificial Sequence
  RNA Oligomer
uccauucuuucuuccuccagucu

SEQ ID NO: 37827 - RNA, 23 nt, Artificial Sequence
  RNA Oligomer
uuccauucuuucuuccuccaguc

SEQ ID NO: 37828 - RNA, 23 nt, Artificial Sequence
  RNA Oligomer
cuuccauucuuucuuccuccagu

SEQ ID NO: 37829 - RNA, 23 nt, Artificial Sequence
  RNA Oligomer
acuuccauucuuucuuccuccag

SEQ ID NO: 37830 - RNA, 23 nt, Artificial Sequence
  RNA Oligomer
aacuuccauucuuucuuccucca

SEQ ID NO: 37831 - RNA, 23 nt, Artificial Sequence
  RNA Oligomer
ucccugcuuaucugaaacuuccc

SEQ ID NO: 37832 - RNA, 23 nt, Artificial Sequence
  RNA Oligomer
aucccugcuuaucugaaacuucc

SEQ ID NO: 37833 - RNA, 23 nt, Artificial Sequence
  RNA Oligomer
uaucccugcuuaucugaaacuuc

SEQ ID NO: 37834 - RNA, 23 nt, Artificial Sequence
  RNA Oligomer
uuaucccugcuuaucugaaacuu

SEQ ID NO: 37835 - RNA, 23 nt, Artificial Sequence
  RNA Oligomer
guguuucccuagacucuguaacc

SEQ ID NO: 37836 - RNA, 23 nt, Artificial Sequence
  RNA Oligomer
uguguuucccuagacucuguaac

SEQ ID NO: 37837 - RNA, 23 nt, Artificial Sequence
  RNA Oligomer
guguguuucccuagacucuguaa

SEQ ID NO: 37838 - RNA, 23 nt, Artificial Sequence
  RNA Oligomer
gguguguuucccuagacucugua

SEQ ID NO: 37839 - RNA, 23 nt, Artificial Sequence
  RNA Oligomer
ugguguguuucccuagacucugu

SEQ ID NO: 37840 - RNA, 23 nt, Artificial Sequence
  RNA Oligomer
gacaagugaaguuguaaacacag

SEQ ID NO: 37841 - RNA, 23 nt, Artificial Sequence
  RNA Oligomer
aaaugcaagagaaacugcagaau

SEQ ID NO: 37842 - RNA, 23 nt, Artificial Sequence
  RNA Oligomer
uaggccuguaguagucaaggugc

SEQ ID NO: 37843 - RNA, 23 nt, Artificial Sequence
  RNA Oligomer
ccuagaaaccuuuaucccugcuu

SEQ ID NO: 37844 - RNA, 23 nt, Artificial Sequence
  RNA Oligomer
auguggcuuuuauuucagugcca

SEQ ID NO: 37845 - RNA, 23 nt, Artificial Sequence
  RNA Oligomer
accuucauuucauccuguuggcu

SEQ ID NO: 37846 - RNA, 23 nt, Artificial Sequence
  RNA Oligomer
uaccuucauuucauccuguuggc

SEQ ID NO: 37847 - RNA, 23 nt, Artificial Sequence
  RNA Oligomer
uuaccuucauuucauccuguugg

SEQ ID NO: 37848 - RNA, 23 nt, Artificial Sequence
  RNA Oligomer
uuuaccuucauuucauccuguug

SEQ ID NO: 37849 - RNA, 23 nt, Artificial Sequence
  RNA Oligomer
cuuuaccuucauuucauccuguu

SEQ ID NO: 37850 - RNA, 23 nt, Artificial Sequence
  RNA Oligomer
ugguuguuucucugagcuuuguu

SEQ ID NO: 37851 - RNA, 23 nt, Artificial Sequence
  RNA Oligomer
uugguuguuucucugagcuuugu

SEQ ID NO: 37852 - RNA, 23 nt, Artificial Sequence
  RNA Oligomer
guugguuguuucucugagcuuug

SEQ ID NO: 37853 - RNA, 23 nt, Artificial Sequence
  RNA Oligomer
guguccaaauuuaauguagacau

SEQ ID NO: 37854 - RNA, 23 nt, Artificial Sequence
  RNA Oligomer
ccagcuccuuuucugugaagccc

SEQ ID NO: 37855 - RNA, 23 nt, Artificial Sequence
  RNA Oligomer
gccagcuccuuuucugugaagcc

SEQ ID NO: 37856 - RNA, 23 nt, Artificial Sequence
  RNA Oligomer
ggccagcuccuuuucugugaagc

SEQ ID NO: 37857 - RNA, 23 nt, Artificial Sequence
  RNA Oligomer
aggccagcuccuuuucugugaag

SEQ ID NO: 37858 - RNA, 23 nt, Artificial Sequence
  RNA Oligomer
caggccagcuccuuuucugugaa

SEQ ID NO: 37859 - RNA, 23 nt, Artificial Sequence
  RNA Oligomer
ccaggccagcuccuuuucuguga

SEQ ID NO: 37860 - RNA, 23 nt, Artificial Sequence
  RNA Oligomer
ggaaucucccagacuuguuuccu

SEQ ID NO: 37861 - RNA, 23 nt, Artificial Sequence
  RNA Oligomer
gggaaucucccagacuuguuucc

SEQ ID NO: 37862 - RNA, 23 nt, Artificial Sequence
  RNA Oligomer
ugggaaucucccagacuuguuuc

SEQ ID NO: 37863 - RNA, 23 nt, Artificial Sequence
  RNA Oligomer
gugggaaucucccagacuuguuu

SEQ ID NO: 37864 - RNA, 23 nt, Artificial Sequence
  RNA Oligomer
ugugggaaucucccagacuuguu

SEQ ID NO: 37865 - RNA, 23 nt, Artificial Sequence
  RNA Oligomer
cguggccgacaugcugguuaagg

SEQ ID NO: 37866 - RNA, 23 nt, Artificial Sequence
  RNA Oligomer
acguggccgacaugcugguuaag

SEQ ID NO: 37867 - RNA, 23 nt, Artificial Sequence
  RNA Oligomer
cacguggccgacaugcugguuaa

SEQ ID NO: 37868 - RNA, 23 nt, Artificial Sequence
  RNA Oligomer
aaacagcuguuguugagcgaauu

SEQ ID NO: 37869 - RNA, 23 nt, Artificial Sequence
  RNA Oligomer
caaacagcuguuguugagcgaau

SEQ ID NO: 37870 - RNA, 23 nt, Artificial Sequence
  RNA Oligomer
gaauuuugcacaguuaccugcac

SEQ ID NO: 37871 - RNA, 23 nt, Artificial Sequence
  RNA Oligomer
agaauuuugcacaguuaccugca

SEQ ID NO: 37872 - RNA, 23 nt, Artificial Sequence
  RNA Oligomer
cagaauuuugcacaguuaccugc

SEQ ID NO: 37873 - RNA, 23 nt, Artificial Sequence
  RNA Oligomer
gcagaauuuugcacaguuaccug

SEQ ID NO: 37874 - RNA, 23 nt, Artificial Sequence
  RNA Oligomer
ugcagaauuuugcacaguuaccu

SEQ ID NO: 37875 - RNA, 23 nt, Artificial Sequence
  RNA Oligomer
cugcagaauuuugcacaguuacc

SEQ ID NO: 37876 - RNA, 23 nt, Artificial Sequence
  RNA Oligomer
acugcagaauuuugcacaguuac

SEQ ID NO: 37877 - RNA, 23 nt, Artificial Sequence
  RNA Oligomer
aacugcagaauuuugcacaguua

SEQ ID NO: 37878 - RNA, 23 nt, Artificial Sequence
  RNA Oligomer
ucacccucuucaagcuuuugggc

SEQ ID NO: 37879 - RNA, 23 nt, Artificial Sequence
  RNA Oligomer
gucacccucuucaagcuuuuggg

SEQ ID NO: 37880 - RNA, 23 nt, Artificial Sequence
  RNA Oligomer
agucacccucuucaagcuuuugg

SEQ ID NO: 37881 - RNA, 23 nt, Artificial Sequence
  RNA Oligomer
uagucacccucuucaagcuuuug

SEQ ID NO: 37882 - RNA, 23 nt, Artificial Sequence
  RNA Oligomer
cuagucacccucuucaagcuuuu

SEQ ID NO: 37883 - RNA, 23 nt, Artificial Sequence
  RNA Oligomer
ggugcucaauaaauauuuguuug

SEQ ID NO: 37884 - RNA, 23 nt, Artificial Sequence
  RNA Oligomer
aggugcucaauaaauauuuguuu

SEQ ID NO: 37885 - RNA, 23 nt, Artificial Sequence
  RNA Oligomer
aaggugcucaauaaauauuuguu

SEQ ID NO: 37886 - RNA, 23 nt, Artificial Sequence
  RNA Oligomer
caaggugcucaauaaauauuugu

SEQ ID NO: 37887 - RNA, 23 nt, Artificial Sequence
  RNA Oligomer
ucaaggugcucaauaaauauuug

SEQ ID NO: 37888 - RNA, 23 nt, Artificial Sequence
  RNA Oligomer
cucaggugguguccuucuuccuc

SEQ ID NO: 37889 - RNA, 23 nt, Artificial Sequence
  RNA Oligomer
acucaggugguguccuucuuccu

SEQ ID NO: 37890 - RNA, 23 nt, Artificial Sequence
  RNA Oligomer
gacucaggugguguccuucuucc

SEQ ID NO: 37891 - RNA, 23 nt, Artificial Sequence
  RNA Oligomer
ugacucaggugguguccuucuuc

SEQ ID NO: 37892 - RNA, 23 nt, Artificial Sequence
  RNA Oligomer
uugacucaggugguguccuucuu

SEQ ID NO: 37893 - RNA, 23 nt, Artificial Sequence
  RNA Oligomer
ugccaccaaaucugucuagaauc

SEQ ID NO: 37894 - RNA, 23 nt, Artificial Sequence
  RNA Oligomer
agccaacauugccuugcauuugu

SEQ ID NO: 37895 - RNA, 23 nt, Artificial Sequence
  RNA Oligomer
cagccaacauugccuugcauuug

SEQ ID NO: 37896 - RNA, 23 nt, Artificial Sequence
  RNA Oligomer
ucagccaacauugccuugcauuu

SEQ ID NO: 37897 - RNA, 23 nt, Artificial Sequence
  RNA Oligomer
agauggcacuuuagugauugcuu

SEQ ID NO: 37898 - RNA, 23 nt, Artificial Sequence
  RNA Oligomer
uagauggcacuuuagugauugcu

SEQ ID NO: 37899 - RNA, 23 nt, Artificial Sequence
  RNA Oligomer
guagauggcacuuuagugauugc

SEQ ID NO: 37900 - RNA, 23 nt, Artificial Sequence
  RNA Oligomer
uguagauggcacuuuagugauug

SEQ ID NO: 37901 - RNA, 23 nt, Artificial Sequence
  RNA Oligomer
uuguagauggcacuuuagugauu

SEQ ID NO: 37902 - RNA, 23 nt, Artificial Sequence
  RNA Oligomer
agccuuugaucuucaggaugcac

SEQ ID NO: 37903 - RNA, 23 nt, Artificial Sequence
  RNA Oligomer
gagccuuugaucuucaggaugca

SEQ ID NO: 37904 - RNA, 23 nt, Artificial Sequence
  RNA Oligomer
agagccuuugaucuucaggaugc

SEQ ID NO: 37905 - RNA, 23 nt, Artificial Sequence
  RNA Oligomer
uagagccuuugaucuucaggaug

SEQ ID NO: 37906 - RNA, 23 nt, Artificial Sequence
  RNA Oligomer
auagagccuuugaucuucaggau

SEQ ID NO: 37907 - RNA, 23 nt, Artificial Sequence
  RNA Oligomer
gggcuugugauaugcacguggcc

SEQ ID NO: 37908 - RNA, 23 nt, Artificial Sequence
  RNA Oligomer
cgggcuugugauaugcacguggc

SEQ ID NO: 37909 - RNA, 23 nt, Artificial Sequence
  RNA Oligomer
gcgggcuugugauaugcacgugg

SEQ ID NO: 37910 - RNA, 23 nt, Artificial Sequence
  RNA Oligomer
agcgggcuugugauaugcacgug

SEQ ID NO: 37911 - RNA, 23 nt, Artificial Sequence
  RNA Oligomer
gagcgggcuugugauaugcacgu

SEQ ID NO: 37912 - RNA, 23 nt, Artificial Sequence
  RNA Oligomer
ccgguaaagaaaaguugccgaag

SEQ ID NO: 37913 - RNA, 23 nt, Artificial Sequence
  RNA Oligomer
gccgguaaagaaaaguugccgaa

SEQ ID NO: 37914 - RNA, 23 nt, Artificial Sequence
  RNA Oligomer
ggaaacucuaaaaaagaaccgag

SEQ ID NO: 37915 - RNA, 23 nt, Artificial Sequence
  RNA Oligomer
aggaaacucuaaaaaagaaccga

SEQ ID NO: 37916 - RNA, 23 nt, Artificial Sequence
  RNA Oligomer
gcauccucaucaucaggaaacuc

SEQ ID NO: 37917 - RNA, 23 nt, Artificial Sequence
  RNA Oligomer
ugcauccucaucaucaggaaacu

SEQ ID NO: 37918 - RNA, 23 nt, Artificial Sequence
  RNA Oligomer
augcauccucaucaucaggaaac

SEQ ID NO: 37919 - RNA, 23 nt, Artificial Sequence
  RNA Oligomer
caugcauccucaucaucaggaaa

SEQ ID NO: 37920 - RNA, 23 nt, Artificial Sequence
  RNA Oligomer
gucaaggugcucaauaaauauuu

SEQ ID NO: 37921 - RNA, 23 nt, Artificial Sequence
  RNA Oligomer
agucaaggugcucaauaaauauu

SEQ ID NO: 37922 - RNA, 23 nt, Artificial Sequence
  RNA Oligomer
augugugagauaacuuccuucac

SEQ ID NO: 37923 - RNA, 23 nt, Artificial Sequence
  RNA Oligomer
caugugugagauaacuuccuuca

SEQ ID NO: 37924 - RNA, 23 nt, Artificial Sequence
  RNA Oligomer
agaaugguguguuucccuagacu

SEQ ID NO: 37925 - RNA, 23 nt, Artificial Sequence
  RNA Oligomer
aagaaugguguguuucccuagac

SEQ ID NO: 37926 - RNA, 23 nt, Artificial Sequence
  RNA Oligomer
gaagaaugguguguuucccuaga

SEQ ID NO: 37927 - RNA, 23 nt, Artificial Sequence
  RNA Oligomer
ggaagaaugguguguuucccuag

SEQ ID NO: 37928 - RNA, 23 nt, Artificial Sequence
  RNA Oligomer
aggaagaaugguguguuucccua

SEQ ID NO: 37929 - RNA, 23 nt, Artificial Sequence
  RNA Oligomer
cgcccuuuuuguccuagagugag

SEQ ID NO: 37930 - RNA, 23 nt, Artificial Sequence
  RNA Oligomer
uggagaaggacaucaucaccuug

SEQ ID NO: 37931 - RNA, 23 nt, Artificial Sequence
  RNA Oligomer
cuggagaaggacaucaucaccuu

SEQ ID NO: 37932 - RNA, 23 nt, Artificial Sequence
  RNA Oligomer
ucuggagaaggacaucaucaccu

SEQ ID NO: 37933 - RNA, 23 nt, Artificial Sequence
  RNA Oligomer
ggcacuuuagugauugcuuuuau

SEQ ID NO: 37934 - RNA, 23 nt, Artificial Sequence
  RNA Oligomer
uggcacuuuagugauugcuuuua

SEQ ID NO: 37935 - RNA, 23 nt, Artificial Sequence
  RNA Oligomer
auggcacuuuagugauugcuuuu

SEQ ID NO: 37936 - RNA, 23 nt, Artificial Sequence
  RNA Oligomer
gauggcacuuuagugauugcuuu

SEQ ID NO: 37937 - RNA, 23 nt, Artificial Sequence
  RNA Oligomer
agccagccuugguuggaccuauu

SEQ ID NO: 37938 - RNA, 23 nt, Artificial Sequence
  RNA Oligomer
ggcuugugauaugcacguggccg

SEQ ID NO: 37939 - RNA, 23 nt, Artificial Sequence
  RNA Oligomer
guacucuagucacccucuucaag

SEQ ID NO: 37940 - RNA, 23 nt, Artificial Sequence
  RNA Oligomer
aguacucuagucacccucuucaa

SEQ ID NO: 37941 - RNA, 23 nt, Artificial Sequence
  RNA Oligomer
caguacucuagucacccucuuca

SEQ ID NO: 37942 - RNA, 23 nt, Artificial Sequence
  RNA Oligomer
acaguacucuagucacccucuuc

SEQ ID NO: 37943 - RNA, 23 nt, Artificial Sequence
  RNA Oligomer
cacaguacucuagucacccucuu

SEQ ID NO: 37944 - RNA, 23 nt, Artificial Sequence
  RNA Oligomer
ugagggcagaaaccuuguuuguu

SEQ ID NO: 37945 - RNA, 23 nt, Artificial Sequence
  RNA Oligomer
augagggcagaaaccuuguuugu

SEQ ID NO: 37946 - RNA, 23 nt, Artificial Sequence
  RNA Oligomer
aaugagggcagaaaccuuguuug

SEQ ID NO: 37947 - RNA, 23 nt, Artificial Sequence
  RNA Oligomer
aaaugagggcagaaaccuuguuu

SEQ ID NO: 37948 - RNA, 23 nt, Artificial Sequence
  RNA Oligomer
ccaagcuuuugaugccuucugug

SEQ ID NO: 37949 - RNA, 23 nt, Artificial Sequence
  RNA Oligomer
cccaagcuuuugaugccuucugu

SEQ ID NO: 37950 - RNA, 23 nt, Artificial Sequence
  RNA Oligomer
ccccaagcuuuugaugccuucug

SEQ ID NO: 37951 - RNA, 23 nt, Artificial Sequence
  RNA Oligomer
uccccaagcuuuugaugccuucu

SEQ ID NO: 37952 - RNA, 23 nt, Artificial Sequence
  RNA Oligomer
guccccaagcuuuugaugccuuc

SEQ ID NO: 37953 - RNA, 23 nt, Artificial Sequence
  RNA Oligomer
aacuucccaacuucccuguucuu

SEQ ID NO: 37954 - RNA, 23 nt, Artificial Sequence
  RNA Oligomer
uccuagcuuaucucccugcuuca

SEQ ID NO: 37955 - RNA, 23 nt, Artificial Sequence
  RNA Oligomer
uuccuagcuuaucucccugcuuc

SEQ ID NO: 37956 - RNA, 23 nt, Artificial Sequence
  RNA Oligomer
cuuccuagcuuaucucccugcuu

SEQ ID NO: 37957 - RNA, 23 nt, Artificial Sequence
  RNA Oligomer
gcaguuucagccagaauguggaa

SEQ ID NO: 37958 - RNA, 23 nt, Artificial Sequence
  RNA Oligomer
ggcaguuucagccagaaugugga

SEQ ID NO: 37959 - RNA, 23 nt, Artificial Sequence
  RNA Oligomer
gggcaguuucagccagaaugugg

SEQ ID NO: 37960 - RNA, 23 nt, Artificial Sequence
  RNA Oligomer
ugggcaguuucagccagaaugug

SEQ ID NO: 37961 - RNA, 23 nt, Artificial Sequence
  RNA Oligomer
gugggcaguuucagccagaaugu

SEQ ID NO: 37962 - RNA, 23 nt, Artificial Sequence
  RNA Oligomer
ugagaaacguccaucucucuccc

SEQ ID NO: 37963 - RNA, 23 nt, Artificial Sequence
  RNA Oligomer
cugagaaacguccaucucucucc

SEQ ID NO: 37964 - RNA, 23 nt, Artificial Sequence
  RNA Oligomer
ccugagaaacguccaucucucuc

SEQ ID NO: 37965 - RNA, 23 nt, Artificial Sequence
  RNA Oligomer
gucagccaacauugccuugcauu

SEQ ID NO: 37966 - RNA, 23 nt, Artificial Sequence
  RNA Oligomer
cccuuuuuguccuagagugagag

SEQ ID NO: 37967 - RNA, 23 nt, Artificial Sequence
  RNA Oligomer
gcccuuuuuguccuagagugaga

SEQ ID NO: 37968 - RNA, 23 nt, Artificial Sequence
  RNA Oligomer
gcacuuuagugauugcuuuuauu

SEQ ID NO: 37969 - RNA, 23 nt, Artificial Sequence
  RNA Oligomer
uggaccuauugccaggaauguuu

SEQ ID NO: 37970 - RNA, 23 nt, Artificial Sequence
  RNA Oligomer
uuggaccuauugccaggaauguu

SEQ ID NO: 37971 - RNA, 23 nt, Artificial Sequence
  RNA Oligomer
guuggaccuauugccaggaaugu

SEQ ID NO: 37972 - RNA, 23 nt, Artificial Sequence
  RNA Oligomer
gguuggaccuauugccaggaaug

SEQ ID NO: 37973 - RNA, 23 nt, Artificial Sequence
  RNA Oligomer
ugguuggaccuauugccaggaau

SEQ ID NO: 37974 - RNA, 23 nt, Artificial Sequence
  RNA Oligomer
ggcucuugcucaaguguuuucug

SEQ ID NO: 37975 - RNA, 23 nt, Artificial Sequence
  RNA Oligomer
aggcucuugcucaaguguuuucu

SEQ ID NO: 37976 - RNA, 23 nt, Artificial Sequence
  RNA Oligomer
gaggcucuugcucaaguguuuuc

SEQ ID NO: 37977 - RNA, 23 nt, Artificial Sequence
  RNA Oligomer
cgaggcucuugcucaaguguuuu

SEQ ID NO: 37978 - RNA, 23 nt, Artificial Sequence
  RNA Oligomer
ucgaggcucuugcucaaguguuu

SEQ ID NO: 37979 - RNA, 23 nt, Artificial Sequence
  RNA Oligomer
ggaacaccaaacgagguuccugg

SEQ ID NO: 37980 - RNA, 23 nt, Artificial Sequence
  RNA Oligomer
cggaacaccaaacgagguuccug

SEQ ID NO: 37981 - RNA, 23 nt, Artificial Sequence
  RNA Oligomer
gcggaacaccaaacgagguuccu

SEQ ID NO: 37982 - RNA, 23 nt, Artificial Sequence
  RNA Oligomer
ugcggaacaccaaacgagguucc

SEQ ID NO: 37983 - RNA, 23 nt, Artificial Sequence
  RNA Oligomer
augcggaacaccaaacgagguuc

SEQ ID NO: 37984 - RNA, 23 nt, Artificial Sequence
  RNA Oligomer
caugcggaacaccaaacgagguu

SEQ ID NO: 37985 - RNA, 23 nt, Artificial Sequence
  RNA Oligomer
cccucauuuaaaauguaaacucu

SEQ ID NO: 37986 - RNA, 23 nt, Artificial Sequence
  RNA Oligomer
ucauuaaauggugauuucuugcu

SEQ ID NO: 37987 - RNA, 23 nt, Artificial Sequence
  RNA Oligomer
cuuauugaucuuugcccauggaa

SEQ ID NO: 37988 - RNA, 23 nt, Artificial Sequence
  RNA Oligomer
ccuuuuuguccuagagugagagu

SEQ ID NO: 37989 - RNA, 23 nt, Artificial Sequence
  RNA Oligomer
ucauucaaucaaccugcacuuca

SEQ ID NO: 37990 - RNA, 23 nt, Artificial Sequence
  RNA Oligomer
aggauauugggaguguguggcau

SEQ ID NO: 37991 - RNA, 23 nt, Artificial Sequence
  RNA Oligomer
cuuguuuguuuuauucaccauca

SEQ ID NO: 37992 - RNA, 23 nt, Artificial Sequence
  RNA Oligomer
cuuuuuguccuagagugagaguu

SEQ ID NO: 37993 - RNA, 23 nt, Artificial Sequence
  RNA Oligomer
ggauauugggaguguguggcaug

SEQ ID NO: 37994 - RNA, 23 nt, Artificial Sequence
  RNA Oligomer
uguuuguuuuauucaccaucaug

SEQ ID NO: 37995 - RNA, 23 nt, Artificial Sequence
  RNA Oligomer
cuucuuuaccuucauuucauccu

SEQ ID NO: 37996 - RNA, 23 nt, Artificial Sequence
  RNA Oligomer
cuauucccacuuucauucaauca

SEQ ID NO: 37997 - RNA, 23 nt, Artificial Sequence
  RNA Oligomer
caaacaugacuagagacgcaccu

SEQ ID NO: 37998 - RNA, 23 nt, Artificial Sequence
  RNA Oligomer
gacuuguuuccugugcccaucau

SEQ ID NO: 37999 - RNA, 23 nt, Artificial Sequence
  RNA Oligomer
ggaugugggaaucucccagacuu

SEQ ID NO: 38000 - RNA, 23 nt, Artificial Sequence
  RNA Oligomer
acuuaucaaggaucgggaagguu

SEQ ID NO: 38001 - RNA, 23 nt, Artificial Sequence
  RNA Oligomer
gaauuuuaucaaacacacuucca

SEQ ID NO: 38002 - RNA, 23 nt, Artificial Sequence
  RNA Oligomer
acauaguauggaaguauuugaga

SEQ ID NO: 38003 - RNA, 23 nt, Artificial Sequence
  RNA Oligomer
caauaaauauuuguuuggguggu

SEQ ID NO: 38004 - RNA, 23 nt, Artificial Sequence
  RNA Oligomer
guuuguuuuauucaccaucaugu

SEQ ID NO: 38005 - RNA, 23 nt, Artificial Sequence
  RNA Oligomer
cucuuucaguauuaaacucuccu

SEQ ID NO: 38006 - RNA, 23 nt, Artificial Sequence
  RNA Oligomer
cgggugccaaauaaaugcucaua

SEQ ID NO: 38007 - RNA, 23 nt, Artificial Sequence
  RNA Oligomer
cacuuucauucaaucaaccugca

SEQ ID NO: 38008 - RNA, 23 nt, Artificial Sequence
  RNA Oligomer
uuacuauucccacuuucauucaa

SEQ ID NO: 38009 - RNA, 23 nt, Artificial Sequence
  RNA Oligomer
cucauugcauuuauugcaguuua

SEQ ID NO: 38010 - RNA, 23 nt, Artificial Sequence
  RNA Oligomer
aagaucuuucguugguuguuucu

SEQ ID NO: 38011 - RNA, 23 nt, Artificial Sequence
  RNA Oligomer
ucaauaaauauuuguuugggugg

SEQ ID NO: 38012 - RNA, 23 nt, Artificial Sequence
  RNA Oligomer
uaaaugagggcagaaaccuuguu

SEQ ID NO: 38013 - RNA, 23 nt, Artificial Sequence
  RNA Oligomer
ccuggccaggauuugguuguuua

SEQ ID NO: 38014 - RNA, 23 nt, Artificial Sequence
  RNA Oligomer
aagugggcaguuucagccagaau

SEQ ID NO: 38015 - RNA, 23 nt, Artificial Sequence
  RNA Oligomer
uuguuagaacaucuucuggagaa

SEQ ID NO: 38016 - RNA, 23 nt, Artificial Sequence
  RNA Oligomer
ccagaauguggaacuccucaacu

SEQ ID NO: 38017 - RNA, 23 nt, Artificial Sequence
  RNA Oligomer
gcucaauaaauauuuguuugggu

SEQ ID NO: 38018 - RNA, 23 nt, Artificial Sequence
  RNA Oligomer
cccucauugcauuuauugcaguu

SEQ ID NO: 38019 - RNA, 23 nt, Artificial Sequence
  RNA Oligomer
gguguccuucuuccucaagucuu

SEQ ID NO: 38020 - RNA, 23 nt, Artificial Sequence
  RNA Oligomer
guugaccaacaagauggaaagaa

SEQ ID NO: 38021 - RNA, 23 nt, Artificial Sequence
  RNA Oligomer
gguugaccaacaagauggaaaga

SEQ ID NO: 38022 - RNA, 23 nt, Artificial Sequence
  RNA Oligomer
cucaauaaauauuuguuugggug

SEQ ID NO: 38023 - RNA, 23 nt, Artificial Sequence
  RNA Oligomer
cauguuauuguuuucaaccuaga

SEQ ID NO: 38024 - RNA, 23 nt, Artificial Sequence
  RNA Oligomer
gguuaugcuccuggcacagaauu

SEQ ID NO: 38025 - RNA, 23 nt, Artificial Sequence
  RNA Oligomer
ccacaguacucuagucacccucu

SEQ ID NO: 38026 - RNA, 23 nt, Artificial Sequence
  RNA Oligomer
ucaaacacacuuccagcuggcau

SEQ ID NO: 38027 - RNA, 23 nt, Artificial Sequence
  RNA Oligomer
ccucauugcauuuauugcaguuu

SEQ ID NO: 38028 - RNA, 23 nt, Artificial Sequence
  RNA Oligomer
accuagaaaccuuuaucccugcu

SEQ ID NO: 38029 - RNA, 23 nt, Artificial Sequence
  RNA Oligomer
gaaugguguguuucccuagacuc

SEQ ID NO: 38030 - RNA, 23 nt, Artificial Sequence
  RNA Oligomer
cugagagaccaucuccuaucuuu

SEQ ID NO: 38031 - RNA, 23 nt, Artificial Sequence
  RNA Oligomer
gugcucaauaaauauuuguuugg

SEQ ID NO: 38032 - RNA, 23 nt, Artificial Sequence
  RNA Oligomer
cuugaaccucauuaaauggugau

SEQ ID NO: 38033 - RNA, 23 nt, Artificial Sequence
  RNA Oligomer
ugcuuuacaggaucauguaaaug

SEQ ID NO: 38034 - RNA, 23 nt, Artificial Sequence
  RNA Oligomer
agaauccugcuuuacaggaucau

SEQ ID NO: 38035 - RNA, 23 nt, Artificial Sequence
  RNA Oligomer
ccagacuuguuuccugugcccau

SEQ ID NO: 38036 - RNA, 23 nt, Artificial Sequence
  RNA Oligomer
gugcuagccaaacagcuguuguu

SEQ ID NO: 38037 - RNA, 23 nt, Artificial Sequence
  RNA Oligomer
gaaacuucccaacuucccuguuc

SEQ ID NO: 38038 - RNA, 23 nt, Artificial Sequence
  RNA Oligomer
gcugguuaaggugaacgcacuua

SEQ ID NO: 38039 - RNA, 23 nt, Artificial Sequence
  RNA Oligomer
gggauguggaccacaguacucua

SEQ ID NO: 38040 - RNA, 23 nt, Artificial Sequence
  RNA Oligomer
ccugaauuuuaucaaacacacuu

SEQ ID NO: 38041 - RNA, 23 nt, Artificial Sequence
  RNA Oligomer
acauaucaugugugagauaacuu

SEQ ID NO: 38042 - RNA, 23 nt, Artificial Sequence
  RNA Oligomer
aguuuggaagguguccaaauuua

SEQ ID NO: 38043 - RNA, 23 nt, Artificial Sequence
  RNA Oligomer
ucugagagaccaucuccuaucuu

SEQ ID NO: 38044 - RNA, 23 nt, Artificial Sequence
  RNA Oligomer
gaauuccaccggugcaaggagau

SEQ ID NO: 38045 - RNA, 23 nt, Artificial Sequence
  RNA Oligomer
accaaacgagguuccugguacau

SEQ ID NO: 38046 - RNA, 23 nt, Artificial Sequence
  RNA Oligomer
agauggaaagaaccacgcaggau

SEQ ID NO: 38047 - RNA, 23 nt, Artificial Sequence
  RNA Oligomer
ccaagagguuuuucagcucuuug

SEQ ID NO: 38048 - RNA, 23 nt, Artificial Sequence
  RNA Oligomer
gacauaucaugugugagauaacu

SEQ ID NO: 38049 - RNA, 23 nt, Artificial Sequence
  RNA Oligomer
cuaccuuuugauaaaauguuccu

SEQ ID NO: 38050 - RNA, 23 nt, Artificial Sequence
  RNA Oligomer
uugaaccucauuaaauggugauu

SEQ ID NO: 38051 - RNA, 23 nt, Artificial Sequence
  RNA Oligomer
cagaauguggaacuccucaacuu

SEQ ID NO: 38052 - RNA, 23 nt, Artificial Sequence
  RNA Oligomer
gccagaauguggaacuccucaac

SEQ ID NO: 38053 - RNA, 23 nt, Artificial Sequence
  RNA Oligomer
gagaaacguccaucucucucccu

SEQ ID NO: 38054 - RNA, 23 nt, Artificial Sequence
  RNA Oligomer
gaguuuggaagguguccaaauuu

SEQ ID NO: 38055 - RNA, 23 nt, Artificial Sequence
  RNA Oligomer
agaguuuggaagguguccaaauu

SEQ ID NO: 38056 - RNA, 23 nt, Artificial Sequence
  RNA Oligomer
agguuaugcuccuggcacagaau

SEQ ID NO: 38057 - RNA, 23 nt, Artificial Sequence
  RNA Oligomer
gguuaaggugaacgcacuuauca

SEQ ID NO: 38058 - RNA, 23 nt, Artificial Sequence
  RNA Oligomer
ccaaacgagguuccugguacauc

SEQ ID NO: 38059 - RNA, 23 nt, Artificial Sequence
  RNA Oligomer
ggugcuagccaaacagcuguugu

SEQ ID NO: 38060 - RNA, 23 nt, Artificial Sequence
  RNA Oligomer
gaaacugcagaauuuugcacagu

SEQ ID NO: 38061 - RNA, 23 nt, Artificial Sequence
  RNA Oligomer
agaaacugcagaauuuugcacag

SEQ ID NO: 38062 - RNA, 23 nt, Artificial Sequence
  RNA Oligomer
caaacacacuuccagcuggcaua

SEQ ID NO: 38063 - RNA, 23 nt, Artificial Sequence
  RNA Oligomer
uccuuuugacaauauacacggau

SEQ ID NO: 38064 - RNA, 23 nt, Artificial Sequence
  RNA Oligomer
uccugcuuuacaggaucauguaa

SEQ ID NO: 38065 - RNA, 23 nt, Artificial Sequence
  RNA Oligomer
gcuuccuagcuuaucucccugcu

SEQ ID NO: 38066 - RNA, 23 nt, Artificial Sequence
  RNA Oligomer
agaucuuucguugguuguuucuc

SEQ ID NO: 38067 - RNA, 23 nt, Artificial Sequence
  RNA Oligomer
gaccuauugccaggaauguuuca

SEQ ID NO: 38068 - RNA, 23 nt, Artificial Sequence
  RNA Oligomer
ggaccuauugccaggaauguuuc

SEQ ID NO: 38069 - RNA, 23 nt, Artificial Sequence
  RNA Oligomer
cugugaagcccuuugccuguaga

SEQ ID NO: 38070 - RNA, 23 nt, Artificial Sequence
  RNA Oligomer
gaagguuaugcuccuggcacaga

SEQ ID NO: 38071 - RNA, 23 nt, Artificial Sequence
  RNA Oligomer
gcucuugcucaaguguuuucuga

SEQ ID NO: 38072 - RNA, 23 nt, Artificial Sequence
  RNA Oligomer
guggugcuagccaaacagcuguu

SEQ ID NO: 38073 - RNA, 23 nt, Artificial Sequence
  RNA Oligomer
gcuccaagagguuuuucagcucu

SEQ ID NO: 38074 - RNA, 23 nt, Artificial Sequence
  RNA Oligomer
gaaacucuaaaaaagaaccgagu

SEQ ID NO: 38075 - RNA, 23 nt, Artificial Sequence
  RNA Oligomer
cccuagcaaaaugcuaggccugu

SEQ ID NO: 38076 - RNA, 23 nt, Artificial Sequence
  RNA Oligomer
ucccuagcaaaaugcuaggccug

SEQ ID NO: 38077 - RNA, 23 nt, Artificial Sequence
  RNA Oligomer
uguuuucaaccuagaaaccuuua

SEQ ID NO: 38078 - RNA, 23 nt, Artificial Sequence
  RNA Oligomer
cagccagaauguggaacuccuca

SEQ ID NO: 38079 - RNA, 23 nt, Artificial Sequence
  RNA Oligomer
cugcuuuacaggaucauguaaau

SEQ ID NO: 38080 - RNA, 23 nt, Artificial Sequence
  RNA Oligomer
ccugcuuuacaggaucauguaaa

SEQ ID NO: 38081 - RNA, 23 nt, Artificial Sequence
  RNA Oligomer
gaauuguuagaacaucuucugga

SEQ ID NO: 38082 - RNA, 23 nt, Artificial Sequence
  RNA Oligomer
uugguuggaccuauugccaggaa

SEQ ID NO: 38083 - RNA, 23 nt, Artificial Sequence
  RNA Oligomer
cuucaggaugcacgguuucuguu

SEQ ID NO: 38084 - RNA, 23 nt, Artificial Sequence
  RNA Oligomer
ugguuaaggugaacgcacuuauc

SEQ ID NO: 38085 - RNA, 23 nt, Artificial Sequence
  RNA Oligomer
gaccaacaagauggaaagaacca

SEQ ID NO: 38086 - RNA, 23 nt, Artificial Sequence
  RNA Oligomer
gaacaaaccaaaaauguucuuca

SEQ ID NO: 38087 - RNA, 23 nt, Artificial Sequence
  RNA Oligomer
gacugcacaggaaaugcaagaga

SEQ ID NO: 38088 - RNA, 23 nt, Artificial Sequence
  RNA Oligomer
gcacuucacuggagagaaagaac

SEQ ID NO: 38089 - RNA, 23 nt, Artificial Sequence
  RNA Oligomer
gguguugagcaaugugcacuuca

SEQ ID NO: 38090 - RNA, 23 nt, Artificial Sequence
  RNA Oligomer
uccugaauuuuaucaaacacacu

SEQ ID NO: 38091 - RNA, 23 nt, Artificial Sequence
  RNA Oligomer
aguccugccuuugggucgacaua

SEQ ID NO: 38092 - RNA, 23 nt, Artificial Sequence
  RNA Oligomer
caauccuaccuuuugauaaaaug

SEQ ID NO: 38093 - RNA, 23 nt, Artificial Sequence
  RNA Oligomer
cuucuuccucaagucuugacaau

SEQ ID NO: 38094 - RNA, 23 nt, Artificial Sequence
  RNA Oligomer
cuggccaggauuugguuguuuaa

SEQ ID NO: 38095 - RNA, 23 nt, Artificial Sequence
  RNA Oligomer
gaacaucuucuggagaaggacau

SEQ ID NO: 38096 - RNA, 23 nt, Artificial Sequence
  RNA Oligomer
ugagagaccaucuccuaucuuuu

SEQ ID NO: 38097 - RNA, 23 nt, Artificial Sequence
  RNA Oligomer
gcuuuugggcuaugacguccaug

SEQ ID NO: 38098 - RNA, 23 nt, Artificial Sequence
  RNA Oligomer
agcuuuugggcuaugacguccau

SEQ ID NO: 38099 - RNA, 23 nt, Artificial Sequence
  RNA Oligomer
ucuagucacccucuucaagcuuu

SEQ ID NO: 38100 - RNA, 23 nt, Artificial Sequence
  RNA Oligomer
cucuagucacccucuucaagcuu

SEQ ID NO: 38101 - RNA, 23 nt, Artificial Sequence
  RNA Oligomer
ucgggugccaaauaaaugcucau

SEQ ID NO: 38102 - RNA, 23 nt, Artificial Sequence
  RNA Oligomer
guauugccaucgggugccaaaua

SEQ ID NO: 38103 - RNA, 23 nt, Artificial Sequence
  RNA Oligomer
ggaagaaggcaagccaaccuuag

SEQ ID NO: 38104 - RNA, 23 nt, Artificial Sequence
  RNA Oligomer
cuguucucacauaacagaguagu

SEQ ID NO: 38105 - RNA, 23 nt, Artificial Sequence
  RNA Oligomer
acauguuauuguuuucaaccuag

SEQ ID NO: 38106 - RNA, 23 nt, Artificial Sequence
  RNA Oligomer
aaagugggcaguuucagccagaa

SEQ ID NO: 38107 - RNA, 23 nt, Artificial Sequence
  RNA Oligomer
ucuagaaaagcuuccuagcuuau

SEQ ID NO: 38108 - RNA, 23 nt, Artificial Sequence
  RNA Oligomer
gagaguuuggaagguguccaaau

SEQ ID NO: 38109 - RNA, 23 nt, Artificial Sequence
  RNA Oligomer
ccaaacagcuguuguugagcgaa

SEQ ID NO: 38110 - RNA, 23 nt, Artificial Sequence
  RNA Oligomer
agaacaaaccaaaaauguucuuc

SEQ ID NO: 38111 - RNA, 23 nt, Artificial Sequence
  RNA Oligomer
cuccaagagguuuuucagcucuu

SEQ ID NO: 38112 - RNA, 23 nt, Artificial Sequence
  RNA Oligomer
cucuaaaaaagaaccgaguggug

SEQ ID NO: 38113 - RNA, 23 nt, Artificial Sequence
  RNA Oligomer
cucuucaagcuuuugggcuauga

SEQ ID NO: 38114 - RNA, 23 nt, Artificial Sequence
  RNA Oligomer
ccucuucaagcuuuugggcuaug

SEQ ID NO: 38115 - RNA, 23 nt, Artificial Sequence
  RNA Oligomer
cagcuggcauauagguugcaguc

SEQ ID NO: 38116 - RNA, 23 nt, Artificial Sequence
  RNA Oligomer
uucugugucugucaccacaucuu

SEQ ID NO: 38117 - RNA, 23 nt, Artificial Sequence
  RNA Oligomer
cucuugacucaggugguguccuu

SEQ ID NO: 38118 - RNA, 23 nt, Artificial Sequence
  RNA Oligomer
guucucacauaacagaguaguuu

SEQ ID NO: 38119 - RNA, 23 nt, Artificial Sequence
  RNA Oligomer
uguucucacauaacagaguaguu

SEQ ID NO: 38120 - RNA, 23 nt, Artificial Sequence
  RNA Oligomer
gcuuuacaggaucauguaaaugc

SEQ ID NO: 38121 - RNA, 23 nt, Artificial Sequence
  RNA Oligomer
cuagaaaagcuuccuagcuuauc

SEQ ID NO: 38122 - RNA, 23 nt, Artificial Sequence
  RNA Oligomer
ugagaguuuggaagguguccaaa

SEQ ID NO: 38123 - RNA, 23 nt, Artificial Sequence
  RNA Oligomer
gccuuugaucuucaggaugcacg

SEQ ID NO: 38124 - RNA, 23 nt, Artificial Sequence
  RNA Oligomer
ucagcucuuugacaacgccaacu

SEQ ID NO: 38125 - RNA, 23 nt, Artificial Sequence
  RNA Oligomer
uccaagagguuuuucagcucuuu

SEQ ID NO: 38126 - RNA, 23 nt, Artificial Sequence
  RNA Oligomer
aaacugcagaauuuugcacaguu

SEQ ID NO: 38127 - RNA, 23 nt, Artificial Sequence
  RNA Oligomer
cccucuucaagcuuuugggcuau

SEQ ID NO: 38128 - RNA, 23 nt, Artificial Sequence
  RNA Oligomer
gaccacaguacucuagucacccu

SEQ ID NO: 38129 - RNA, 23 nt, Artificial Sequence
  RNA Oligomer
agaacuggaauuucgcucuggag

SEQ ID NO: 38130 - RNA, 23 nt, Artificial Sequence
  RNA Oligomer
caaugugcacuucacuggagaga

SEQ ID NO: 38131 - RNA, 23 nt, Artificial Sequence
  RNA Oligomer
gcaaugugcacuucacuggagag

SEQ ID NO: 38132 - RNA, 23 nt, Artificial Sequence
  RNA Oligomer
gagcaaugugcacuucacuggag

SEQ ID NO: 38133 - RNA, 23 nt, Artificial Sequence
  RNA Oligomer
ugguguugagcaaugugcacuuc

SEQ ID NO: 38134 - RNA, 23 nt, Artificial Sequence
  RNA Oligomer
ugagagagagaaccuuuccacuc

SEQ ID NO: 38135 - RNA, 23 nt, Artificial Sequence
  RNA Oligomer
gggaagaaggcaagccaaccuua

SEQ ID NO: 38136 - RNA, 23 nt, Artificial Sequence
  RNA Oligomer
ugucugucaccacaucuugucuu

SEQ ID NO: 38137 - RNA, 23 nt, Artificial Sequence
  RNA Oligomer
caagcuuuugaugccuucuguga

SEQ ID NO: 38138 - RNA, 23 nt, Artificial Sequence
  RNA Oligomer
ccauacauguuauuguuuucaac

SEQ ID NO: 38139 - RNA, 23 nt, Artificial Sequence
  RNA Oligomer
agccagaauguggaacuccucaa

SEQ ID NO: 38140 - RNA, 23 nt, Artificial Sequence
  RNA Oligomer
agauuucuagaaaagcuuccuag

SEQ ID NO: 38141 - RNA, 23 nt, Artificial Sequence
  RNA Oligomer
gaguguguggcaugcauccucau

SEQ ID NO: 38142 - RNA, 23 nt, Artificial Sequence
  RNA Oligomer
agaugucugagagaccaucuccu

SEQ ID NO: 38143 - RNA, 23 nt, Artificial Sequence
  RNA Oligomer
aacaccaaacgagguuccuggua

SEQ ID NO: 38144 - RNA, 23 nt, Artificial Sequence
  RNA Oligomer
caaaaauguucuucauccaggcc

SEQ ID NO: 38145 - RNA, 23 nt, Artificial Sequence
  RNA Oligomer
gaaagaacuggaauuucgcucug

SEQ ID NO: 38146 - RNA, 23 nt, Artificial Sequence
  RNA Oligomer
cugguguugagcaaugugcacuu

SEQ ID NO: 38147 - RNA, 23 nt, Artificial Sequence
  RNA Oligomer
uguuugggugguuugugagccuu

SEQ ID NO: 38148 - RNA, 23 nt, Artificial Sequence
  RNA Oligomer
cuacuuuuacuuguucauuucug

SEQ ID NO: 38149 - RNA, 23 nt, Artificial Sequence
  RNA Oligomer
uagauuucuagaaaagcuuccua

SEQ ID NO: 38150 - RNA, 23 nt, Artificial Sequence
  RNA Oligomer
ucaccuuggaaaugagggagcuc

SEQ ID NO: 38151 - RNA, 23 nt, Artificial Sequence
  RNA Oligomer
ucuuucguugguuguuucucuga

SEQ ID NO: 38152 - RNA, 23 nt, Artificial Sequence
  RNA Oligomer
ucuuuuggcucugaagaagcaaa

SEQ ID NO: 38153 - RNA, 23 nt, Artificial Sequence
  RNA Oligomer
uggaccacaggaggugugauaga

SEQ ID NO: 38154 - RNA, 23 nt, Artificial Sequence
  RNA Oligomer
ggguugaccaacaagauggaaag

SEQ ID NO: 38155 - RNA, 23 nt, Artificial Sequence
  RNA Oligomer
agaaccgaguggugcuagccaaa

SEQ ID NO: 38156 - RNA, 23 nt, Artificial Sequence
  RNA Oligomer
gccuagcacugguguugagcaau

SEQ ID NO: 38157 - RNA, 23 nt, Artificial Sequence
  RNA Oligomer
agaaggcaagccaaccuuagcua

SEQ ID NO: 38158 - RNA, 23 nt, Artificial Sequence
  RNA Oligomer
gaauccugcuuuacaggaucaug

SEQ ID NO: 38159 - RNA, 23 nt, Artificial Sequence
  RNA Oligomer
gucuagaauccugcuuuacagga

SEQ ID NO: 38160 - RNA, 23 nt, Artificial Sequence
  RNA Oligomer
caccuuggaaaugagggagcuca

SEQ ID NO: 38161 - RNA, 23 nt, Artificial Sequence
  RNA Oligomer
ucaguuccagcuuuuguagaugg

SEQ ID NO: 38162 - RNA, 23 nt, Artificial Sequence
  RNA Oligomer
cugguuaaggugaacgcacuuau

SEQ ID NO: 38163 - RNA, 23 nt, Artificial Sequence
  RNA Oligomer
ugcugguuaaggugaacgcacuu

SEQ ID NO: 38164 - RNA, 23 nt, Artificial Sequence
  RNA Oligomer
ccuagcacugguguugagcaaug

SEQ ID NO: 38165 - RNA, 23 nt, Artificial Sequence
  RNA Oligomer
ugaauuuuaucaaacacacuucc

SEQ ID NO: 38166 - RNA, 23 nt, Artificial Sequence
  RNA Oligomer
ccaucgggugccaaauaaaugcu

SEQ ID NO: 38167 - RNA, 23 nt, Artificial Sequence
  RNA Oligomer
uuguauugccaucgggugccaaa

SEQ ID NO: 38168 - RNA, 23 nt, Artificial Sequence
  RNA Oligomer
guauuugagagagagaaccuuuc

SEQ ID NO: 38169 - RNA, 23 nt, Artificial Sequence
  RNA Oligomer
aaguccugccuuugggucgacau

SEQ ID NO: 38170 - RNA, 23 nt, Artificial Sequence
  RNA Oligomer
uccacuggcauuuuuagcuccuu

SEQ ID NO: 38171 - RNA, 23 nt, Artificial Sequence
  RNA Oligomer
cauguaccaagugcuuggcacau

SEQ ID NO: 38172 - RNA, 23 nt, Artificial Sequence
  RNA Oligomer
acuuuuacuuguucauuucuguc

SEQ ID NO: 38173 - RNA, 23 nt, Artificial Sequence
  RNA Oligomer
cuacuucugugucugucaccaca

SEQ ID NO: 38174 - RNA, 23 nt, Artificial Sequence
  RNA Oligomer
accuggccaggauuugguuguuu

SEQ ID NO: 38175 - RNA, 23 nt, Artificial Sequence
  RNA Oligomer
ccuuggaaaugagggagcucauc

SEQ ID NO: 38176 - RNA, 23 nt, Artificial Sequence
  RNA Oligomer
accuuggaaaugagggagcucau

SEQ ID NO: 38177 - RNA, 23 nt, Artificial Sequence
  RNA Oligomer
aucgaggcucuugcucaaguguu

SEQ ID NO: 38178 - RNA, 23 nt, Artificial Sequence
  RNA Oligomer
cagaacaaaccaaaaauguucuu

SEQ ID NO: 38179 - RNA, 23 nt, Artificial Sequence
  RNA Oligomer
guguugagcaaugugcacuucac

SEQ ID NO: 38180 - RNA, 23 nt, Artificial Sequence
  RNA Oligomer
uccacucccacugccaggauuuu

SEQ ID NO: 38181 - RNA, 23 nt, Artificial Sequence
  RNA Oligomer
gcaagccaaccuuagcuacaauc

SEQ ID NO: 38182 - RNA, 23 nt, Artificial Sequence
  RNA Oligomer
cuuuuacuuguucauuucugucu

SEQ ID NO: 38183 - RNA, 23 nt, Artificial Sequence
  RNA Oligomer
ucucacauaacagaguaguuuug

SEQ ID NO: 38184 - RNA, 23 nt, Artificial Sequence
  RNA Oligomer
cuauugccaggaauguuucagcu

SEQ ID NO: 38185 - RNA, 23 nt, Artificial Sequence
  RNA Oligomer
gcuagccaaacagcuguuguuga

SEQ ID NO: 38186 - RNA, 23 nt, Artificial Sequence
  RNA Oligomer
aucucccauggucccuagcaaaa

SEQ ID NO: 38187 - RNA, 23 nt, Artificial Sequence
  RNA Oligomer
ucauuucauccuguuggcugcug

SEQ ID NO: 38188 - RNA, 23 nt, Artificial Sequence
  RNA Oligomer
ggagaaggacaucaucaccuugg

SEQ ID NO: 38189 - RNA, 23 nt, Artificial Sequence
  RNA Oligomer
agacuuguuuccugugcccauca

SEQ ID NO: 38190 - RNA, 23 nt, Artificial Sequence
  RNA Oligomer
gcacugguguugagcaaugugca

SEQ ID NO: 38191 - RNA, 23 nt, Artificial Sequence
  RNA Oligomer
uugccaucgggugccaaauaaau

SEQ ID NO: 38192 - RNA, 23 nt, Artificial Sequence
  RNA Oligomer
ccacuggcauuuuuagcuccuug

SEQ ID NO: 38193 - RNA, 23 nt, Artificial Sequence
  RNA Oligomer
gaaggcaagccaaccuuagcuac

SEQ ID NO: 38194 - RNA, 23 nt, Artificial Sequence
  RNA Oligomer
cugugucugucaccacaucuugu

SEQ ID NO: 38195 - RNA, 23 nt, Artificial Sequence
  RNA Oligomer
cugagcagucuacuucugugucu

SEQ ID NO: 38196 - RNA, 23 nt, Artificial Sequence
  RNA Oligomer
gucuuuuuccuuccugagaaacg

SEQ ID NO: 38197 - RNA, 23 nt, Artificial Sequence
  RNA Oligomer
acaucuucuggagaaggacauca

SEQ ID NO: 38198 - RNA, 23 nt, Artificial Sequence
  RNA Oligomer
agggaagaaggcaagccaaccuu

SEQ ID NO: 38199 - RNA, 23 nt, Artificial Sequence
  RNA Oligomer
ccagucuguucucacauaacaga

SEQ ID NO: 38200 - RNA, 23 nt, Artificial Sequence
  RNA Oligomer
uccuccagucuguucucacauaa

SEQ ID NO: 38201 - RNA, 23 nt, Artificial Sequence
  RNA Oligomer
uuccuccagucuguucucacaua

SEQ ID NO: 38202 - RNA, 23 nt, Artificial Sequence
  RNA Oligomer
gcugcaguugaagagccugacaa

SEQ ID NO: 38203 - RNA, 23 nt, Artificial Sequence
  RNA Oligomer
ucagcugcaguugaagagccuga

SEQ ID NO: 38204 - RNA, 23 nt, Artificial Sequence
  RNA Oligomer
agaacaucuucuggagaaggaca

SEQ ID NO: 38205 - RNA, 23 nt, Artificial Sequence
  RNA Oligomer
gcaguugaagagccugacaagug

SEQ ID NO: 38206 - RNA, 23 nt, Artificial Sequence
  RNA Oligomer
agagagaaccuuuccacucccac

SEQ ID NO: 38207 - RNA, 23 nt, Artificial Sequence
  RNA Oligomer
agauaacuuccuucacaucuccc

SEQ ID NO: 38208 - RNA, 23 nt, Artificial Sequence
  RNA Oligomer
guaccaagugcuuggcacauagu

SEQ ID NO: 38209 - RNA, 23 nt, Artificial Sequence
  RNA Oligomer
ccuccagucuguucucacauaac

SEQ ID NO: 38210 - RNA, 23 nt, Artificial Sequence
  RNA Oligomer
uuagaacaucuucuggagaagga

SEQ ID NO: 38211 - RNA, 23 nt, Artificial Sequence
  RNA Oligomer
gagagaaccuuuccacucccacu

SEQ ID NO: 38212 - RNA, 23 nt, Artificial Sequence
  RNA Oligomer
gagagagaaccuuuccacuccca

SEQ ID NO: 38213 - RNA, 23 nt, Artificial Sequence
  RNA Oligomer
agcagucuacuucugugucuguc

SEQ ID NO: 38214 - RNA, 23 nt, Artificial Sequence
  RNA Oligomer
gugcucuuuccugcccuuuuccu

SEQ ID NO: 38215 - RNA, 23 nt, Artificial Sequence
  RNA Oligomer
acugcuccagcuccaagagguuu

SEQ ID NO: 38216 - RNA, 23 nt, Artificial Sequence
  RNA Oligomer
cacuggcauuuuuagcuccuuga

SEQ ID NO: 38217 - RNA, 23 nt, Artificial Sequence
  RNA Oligomer
ggcaagccaaccuuagcuacaau

SEQ ID NO: 38218 - RNA, 23 nt, Artificial Sequence
  RNA Oligomer
gcagucuacuucugugucuguca

SEQ ID NO: 38219 - RNA, 23 nt, Artificial Sequence
  RNA Oligomer
cuccagucuguucucacauaaca

SEQ ID NO: 38220 - RNA, 23 nt, Artificial Sequence
  RNA Oligomer
ugaaacuucccaacuucccuguu

SEQ ID NO: 38221 - RNA, 23 nt, Artificial Sequence
  RNA Oligomer
uguuccugcuuucucuuucagua

SEQ ID NO: 38222 - RNA, 23 nt, Artificial Sequence
  RNA Oligomer
ugucuuuuuccuuccugagaaac

SEQ ID NO: 38223 - RNA, 23 nt, Artificial Sequence
  RNA Oligomer
ugucagccaacauugccuugcau

SEQ ID NO: 38224 - RNA, 23 nt, Artificial Sequence
  RNA Oligomer
ugcaguugaagagccugacaagu

SEQ ID NO: 38225 - RNA, 23 nt, Artificial Sequence
  RNA Oligomer
gccaaacagcuguuguugagcga

SEQ ID NO: 38226 - RNA, 23 nt, Artificial Sequence
  RNA Oligomer
cugcuccagcuccaagagguuuu

SEQ ID NO: 38227 - RNA, 23 nt, Artificial Sequence
  RNA Oligomer
cagucuacuucugugucugucac

SEQ ID NO: 38228 - RNA, 23 nt, Artificial Sequence
  RNA Oligomer
gguacaucgaggcucuugcucaa

SEQ ID NO: 38229 - RNA, 23 nt, Artificial Sequence
  RNA Oligomer
gucuacuucugugucugucacca

SEQ ID NO: 38230 - RNA, 23 nt, Artificial Sequence
  RNA Oligomer
gagcagucuacuucugugucugu

SEQ ID NO: 38231 - RNA, 23 nt, Artificial Sequence
  RNA Oligomer
gucuguucucacauaacagagua

SEQ ID NO: 38232 - RNA, 23 nt, Artificial Sequence
  RNA Oligomer
agcugcaguugaagagccugaca

SEQ ID NO: 38233 - RNA, 23 nt, Artificial Sequence
  RNA Oligomer
ccuucauuucauccuguuggcug

SEQ ID NO: 38234 - RNA, 23 nt, Artificial Sequence
  RNA Oligomer
gccagaauguggaacuccucaac

SEQ ID NO: 38235 - RNA, 23 nt, Artificial Sequence
  RNA Oligomer
agccagaauguggaacuccucaa

SEQ ID NO: 38236 - RNA, 23 nt, Artificial Sequence
  RNA Oligomer
cagccagaauguggaacuccuca

SEQ ID NO: 38237 - RNA, 23 nt, Artificial Sequence
  RNA Oligomer
ucagccagaauguggaacuccuc

SEQ ID NO: 38238 - RNA, 23 nt, Artificial Sequence
  RNA Oligomer
uucagccagaauguggaacuccu

SEQ ID NO: 38239 - RNA, 23 nt, Artificial Sequence
  RNA Oligomer
agguaaagaagggagagauauga

SEQ ID NO: 38240 - RNA, 23 nt, Artificial Sequence
  RNA Oligomer
gguaaagaagggagagauaugaa

SEQ ID NO: 38241 - RNA, 23 nt, Artificial Sequence
  RNA Oligomer
guaaagaagggagagauaugaag

SEQ ID NO: 38242 - RNA, 23 nt, Artificial Sequence
  RNA Oligomer
uaaagaagggagagauaugaagc

SEQ ID NO: 38243 - RNA, 23 nt, Artificial Sequence
  RNA Oligomer
aaagaagggagagauaugaagca

SEQ ID NO: 38244 - RNA, 23 nt, Artificial Sequence
  RNA Oligomer
guggauaaaagcaaaacacaugg

SEQ ID NO: 38245 - RNA, 23 nt, Artificial Sequence
  RNA Oligomer
uggauaaaagcaaaacacaugga

SEQ ID NO: 38246 - RNA, 23 nt, Artificial Sequence
  RNA Oligomer
ggauaaaagcaaaacacauggaa

SEQ ID NO: 38247 - RNA, 23 nt, Artificial Sequence
  RNA Oligomer
gauaaaagcaaaacacauggaaa

SEQ ID NO: 38248 - RNA, 23 nt, Artificial Sequence
  RNA Oligomer
auaaaagcaaaacacauggaaaa

SEQ ID NO: 38249 - RNA, 23 nt, Artificial Sequence
  RNA Oligomer
aagaagggagagauaugaagcag

SEQ ID NO: 38250 - RNA, 23 nt, Artificial Sequence
  RNA Oligomer
agaagggagagauaugaagcagg

SEQ ID NO: 38251 - RNA, 23 nt, Artificial Sequence
  RNA Oligomer
gaagggagagauaugaagcaggg

SEQ ID NO: 38252 - RNA, 23 nt, Artificial Sequence
  RNA Oligomer
aagggagagauaugaagcaggga

SEQ ID NO: 38253 - RNA, 23 nt, Artificial Sequence
  RNA Oligomer
cuagaaaucuagauaugaagugc

SEQ ID NO: 38254 - RNA, 23 nt, Artificial Sequence
  RNA Oligomer
uagaaaucuagauaugaagugca

SEQ ID NO: 38255 - RNA, 23 nt, Artificial Sequence
  RNA Oligomer
agaaaucuagauaugaagugcag

SEQ ID NO: 38256 - RNA, 23 nt, Artificial Sequence
  RNA Oligomer
gaaaucuagauaugaagugcagg

SEQ ID NO: 38257 - RNA, 23 nt, Artificial Sequence
  RNA Oligomer
aaaucuagauaugaagugcaggu

SEQ ID NO: 38258 - RNA, 23 nt, Artificial Sequence
  RNA Oligomer
ucaauaagguacaaaugcaaggc

SEQ ID NO: 38259 - RNA, 23 nt, Artificial Sequence
  RNA Oligomer
caauaagguacaaaugcaaggca

SEQ ID NO: 38260 - RNA, 23 nt, Artificial Sequence
  RNA Oligomer
aauaagguacaaaugcaaggcaa

SEQ ID NO: 38261 - RNA, 23 nt, Artificial Sequence
  RNA Oligomer
auaagguacaaaugcaaggcaau

SEQ ID NO: 38262 - RNA, 23 nt, Artificial Sequence
  RNA Oligomer
uaagguacaaaugcaaggcaaug

SEQ ID NO: 38263 - RNA, 23 nt, Artificial Sequence
  RNA Oligomer
gaugaaaugaagguaaagaaggg

SEQ ID NO: 38264 - RNA, 23 nt, Artificial Sequence
  RNA Oligomer
augaaaugaagguaaagaaggga

SEQ ID NO: 38265 - RNA, 23 nt, Artificial Sequence
  RNA Oligomer
ugaaaugaagguaaagaagggag

SEQ ID NO: 38266 - RNA, 23 nt, Artificial Sequence
  RNA Oligomer
gaaaugaagguaaagaagggaga

SEQ ID NO: 38267 - RNA, 23 nt, Artificial Sequence
  RNA Oligomer
aaaugaagguaaagaagggagag

SEQ ID NO: 38268 - RNA, 23 nt, Artificial Sequence
  RNA Oligomer
gauaaaauucaggagugcaaggc

SEQ ID NO: 38269 - RNA, 23 nt, Artificial Sequence
  RNA Oligomer
auaaaauucaggagugcaaggcu

SEQ ID NO: 38270 - RNA, 23 nt, Artificial Sequence
  RNA Oligomer
uaaaauucaggagugcaaggcuu

SEQ ID NO: 38271 - RNA, 23 nt, Artificial Sequence
  RNA Oligomer
aaaauucaggagugcaaggcuuc

SEQ ID NO: 38272 - RNA, 23 nt, Artificial Sequence
  RNA Oligomer
aaauucaggagugcaaggcuuca

SEQ ID NO: 38273 - RNA, 23 nt, Artificial Sequence
  RNA Oligomer
aauaucaaaggagaguuuaauac

SEQ ID NO: 38274 - RNA, 23 nt, Artificial Sequence
  RNA Oligomer
auaucaaaggagaguuuaauacu

SEQ ID NO: 38275 - RNA, 23 nt, Artificial Sequence
  RNA Oligomer
uaucaaaggagaguuuaauacug

SEQ ID NO: 38276 - RNA, 23 nt, Artificial Sequence
  RNA Oligomer
aucaaaggagaguuuaauacuga

SEQ ID NO: 38277 - RNA, 23 nt, Artificial Sequence
  RNA Oligomer
ucaaaggagaguuuaauacugaa

SEQ ID NO: 38278 - RNA, 23 nt, Artificial Sequence
  RNA Oligomer
aucaauaagguacaaaugcaagg

SEQ ID NO: 38279 - RNA, 23 nt, Artificial Sequence
  RNA Oligomer
augaaauaaaagauaggagaugg

SEQ ID NO: 38280 - RNA, 23 nt, Artificial Sequence
  RNA Oligomer
ugaaauaaaagauaggagauggu

SEQ ID NO: 38281 - RNA, 23 nt, Artificial Sequence
  RNA Oligomer
gaaauaaaagauaggagaugguc

SEQ ID NO: 38282 - RNA, 23 nt, Artificial Sequence
  RNA Oligomer
aaauaaaagauaggagauggucu

SEQ ID NO: 38283 - RNA, 23 nt, Artificial Sequence
  RNA Oligomer
aauaaaagauaggagauggucuc

SEQ ID NO: 38284 - RNA, 23 nt, Artificial Sequence
  RNA Oligomer
cauuuuugguuuguucuguaggc

SEQ ID NO: 38285 - RNA, 23 nt, Artificial Sequence
  RNA Oligomer
auuuuugguuuguucuguaggcu

SEQ ID NO: 38286 - RNA, 23 nt, Artificial Sequence
  RNA Oligomer
uuuuugguuuguucuguaggcuu

SEQ ID NO: 38287 - RNA, 23 nt, Artificial Sequence
  RNA Oligomer
uuuugguuuguucuguaggcuug

SEQ ID NO: 38288 - RNA, 23 nt, Artificial Sequence
  RNA Oligomer
uuugguuuguucuguaggcuugg

SEQ ID NO: 38289 - RNA, 23 nt, Artificial Sequence
  RNA Oligomer
aaugaagguaaagaagggagaga

SEQ ID NO: 38290 - RNA, 23 nt, Artificial Sequence
  RNA Oligomer
agggagagauaugaagcagggag

SEQ ID NO: 38291 - RNA, 23 nt, Artificial Sequence
  RNA Oligomer
ggaauaguaagggagagagaugg

SEQ ID NO: 38292 - RNA, 23 nt, Artificial Sequence
  RNA Oligomer
gaauaguaagggagagagaugga

SEQ ID NO: 38293 - RNA, 23 nt, Artificial Sequence
  RNA Oligomer
aauaguaagggagagagauggac

SEQ ID NO: 38294 - RNA, 23 nt, Artificial Sequence
  RNA Oligomer
auaguaagggagagagauggacg

SEQ ID NO: 38295 - RNA, 23 nt, Artificial Sequence
  RNA Oligomer
uaguaagggagagagauggacgu

SEQ ID NO: 38296 - RNA, 23 nt, Artificial Sequence
  RNA Oligomer
cuacuacaggccuagcauuuugc

SEQ ID NO: 38297 - RNA, 23 nt, Artificial Sequence
  RNA Oligomer
uacuacaggccuagcauuuugcu

SEQ ID NO: 38298 - RNA, 23 nt, Artificial Sequence
  RNA Oligomer
acuacaggccuagcauuuugcua

SEQ ID NO: 38299 - RNA, 23 nt, Artificial Sequence
  RNA Oligomer
cuacaggccuagcauuuugcuag

SEQ ID NO: 38300 - RNA, 23 nt, Artificial Sequence
  RNA Oligomer
uacaggccuagcauuuugcuagg

SEQ ID NO: 38301 - RNA, 23 nt, Artificial Sequence
  RNA Oligomer
aauaaaacaaacaagguuucugc

SEQ ID NO: 38302 - RNA, 23 nt, Artificial Sequence
  RNA Oligomer
auaaaacaaacaagguuucugcc

SEQ ID NO: 38303 - RNA, 23 nt, Artificial Sequence
  RNA Oligomer
uaaaacaaacaagguuucugccc

SEQ ID NO: 38304 - RNA, 23 nt, Artificial Sequence
  RNA Oligomer
aaaacaaacaagguuucugcccu

SEQ ID NO: 38305 - RNA, 23 nt, Artificial Sequence
  RNA Oligomer
aaacaaacaagguuucugcccuc

SEQ ID NO: 38306 - RNA, 23 nt, Artificial Sequence
  RNA Oligomer
caagaaaucaccauuuaaugagg

SEQ ID NO: 38307 - RNA, 23 nt, Artificial Sequence
  RNA Oligomer
aagaaaucaccauuuaaugaggu

SEQ ID NO: 38308 - RNA, 23 nt, Artificial Sequence
  RNA Oligomer
agaaaucaccauuuaaugagguu

SEQ ID NO: 38309 - RNA, 23 nt, Artificial Sequence
  RNA Oligomer
gaaaucaccauuuaaugagguuc

SEQ ID NO: 38310 - RNA, 23 nt, Artificial Sequence
  RNA Oligomer
aaaucaccauuuaaugagguuca

SEQ ID NO: 38311 - RNA, 23 nt, Artificial Sequence
  RNA Oligomer
gggagagauaugaagcagggaga

SEQ ID NO: 38312 - RNA, 23 nt, Artificial Sequence
  RNA Oligomer
ggagagauaugaagcagggagau

SEQ ID NO: 38313 - RNA, 23 nt, Artificial Sequence
  RNA Oligomer
gagagauaugaagcagggagaua

SEQ ID NO: 38314 - RNA, 23 nt, Artificial Sequence
  RNA Oligomer
agagauaugaagcagggagauaa

SEQ ID NO: 38315 - RNA, 23 nt, Artificial Sequence
  RNA Oligomer
aaagaucaauaagguacaaaugc

SEQ ID NO: 38316 - RNA, 23 nt, Artificial Sequence
  RNA Oligomer
aagaucaauaagguacaaaugca

SEQ ID NO: 38317 - RNA, 23 nt, Artificial Sequence
  RNA Oligomer
agaucaauaagguacaaaugcaa

SEQ ID NO: 38318 - RNA, 23 nt, Artificial Sequence
  RNA Oligomer
gaucaauaagguacaaaugcaag

SEQ ID NO: 38319 - RNA, 23 nt, Artificial Sequence
  RNA Oligomer
ucaaauacuuccauacuaugucg

SEQ ID NO: 38320 - RNA, 23 nt, Artificial Sequence
  RNA Oligomer
caaauacuuccauacuaugucga

SEQ ID NO: 38321 - RNA, 23 nt, Artificial Sequence
  RNA Oligomer
aaauacuuccauacuaugucgac

SEQ ID NO: 38322 - RNA, 23 nt, Artificial Sequence
  RNA Oligomer
aauacuuccauacuaugucgacc

SEQ ID NO: 38323 - RNA, 23 nt, Artificial Sequence
  RNA Oligomer
auacuuccauacuaugucgaccc

SEQ ID NO: 38324 - RNA, 23 nt, Artificial Sequence
  RNA Oligomer
caacaaacauuuaaugaaggccc

SEQ ID NO: 38325 - RNA, 23 nt, Artificial Sequence
  RNA Oligomer
aacaaacauuuaaugaaggccca

SEQ ID NO: 38326 - RNA, 23 nt, Artificial Sequence
  RNA Oligomer
acaaacauuuaaugaaggcccac

SEQ ID NO: 38327 - RNA, 23 nt, Artificial Sequence
  RNA Oligomer
caaacauuuaaugaaggcccacu

SEQ ID NO: 38328 - RNA, 23 nt, Artificial Sequence
  RNA Oligomer
aaacauuuaaugaaggcccacua

SEQ ID NO: 38329 - RNA, 23 nt, Artificial Sequence
  RNA Oligomer
agaaaugaacaaguaaaaguagc

SEQ ID NO: 38330 - RNA, 23 nt, Artificial Sequence
  RNA Oligomer
gaaaugaacaaguaaaaguagca

SEQ ID NO: 38331 - RNA, 23 nt, Artificial Sequence
  RNA Oligomer
aaaugaacaaguaaaaguagcau

SEQ ID NO: 38332 - RNA, 23 nt, Artificial Sequence
  RNA Oligomer
aaugaacaaguaaaaguagcaua

SEQ ID NO: 38333 - RNA, 23 nt, Artificial Sequence
  RNA Oligomer
augaacaaguaaaaguagcauau

SEQ ID NO: 38334 - RNA, 23 nt, Artificial Sequence
  RNA Oligomer
caccauuuaaugagguucaaggg

SEQ ID NO: 38335 - RNA, 23 nt, Artificial Sequence
  RNA Oligomer
accauuuaaugagguucaagggg

SEQ ID NO: 38336 - RNA, 23 nt, Artificial Sequence
  RNA Oligomer
ccauuuaaugagguucaagggga

SEQ ID NO: 38337 - RNA, 23 nt, Artificial Sequence
  RNA Oligomer
cauuuaaugagguucaaggggaa

SEQ ID NO: 38338 - RNA, 23 nt, Artificial Sequence
  RNA Oligomer
auuuaaugagguucaaggggaag

SEQ ID NO: 38339 - RNA, 23 nt, Artificial Sequence
  RNA Oligomer
ccucuuaggcagcaaguugagga

SEQ ID NO: 38340 - RNA, 23 nt, Artificial Sequence
  RNA Oligomer
cucuuaggcagcaaguugaggag

SEQ ID NO: 38341 - RNA, 23 nt, Artificial Sequence
  RNA Oligomer
ucuuaggcagcaaguugaggagu

SEQ ID NO: 38342 - RNA, 23 nt, Artificial Sequence
  RNA Oligomer
cuuaggcagcaaguugaggaguu

SEQ ID NO: 38343 - RNA, 23 nt, Artificial Sequence
  RNA Oligomer
uuaggcagcaaguugaggaguuc

SEQ ID NO: 38344 - RNA, 23 nt, Artificial Sequence
  RNA Oligomer
aucuuugagcauuuacaugaucc

SEQ ID NO: 38345 - RNA, 23 nt, Artificial Sequence
  RNA Oligomer
ucuuugagcauuuacaugauccu

SEQ ID NO: 38346 - RNA, 23 nt, Artificial Sequence
  RNA Oligomer
cuuugagcauuuacaugauccug

SEQ ID NO: 38347 - RNA, 23 nt, Artificial Sequence
  RNA Oligomer
uuugagcauuuacaugauccugu

SEQ ID NO: 38348 - RNA, 23 nt, Artificial Sequence
  RNA Oligomer
uugagcauuuacaugauccugua

SEQ ID NO: 38349 - RNA, 23 nt, Artificial Sequence
  RNA Oligomer
agauaugaagugcagguugauug

SEQ ID NO: 38350 - RNA, 23 nt, Artificial Sequence
  RNA Oligomer
gauaugaagugcagguugauuga

SEQ ID NO: 38351 - RNA, 23 nt, Artificial Sequence
  RNA Oligomer
auaugaagugcagguugauugaa

SEQ ID NO: 38352 - RNA, 23 nt, Artificial Sequence
  RNA Oligomer
uaugaagugcagguugauugaau

SEQ ID NO: 38353 - RNA, 23 nt, Artificial Sequence
  RNA Oligomer
augaagugcagguugauugaaug

SEQ ID NO: 38354 - RNA, 23 nt, Artificial Sequence
  RNA Oligomer
ccagaagauguucuaacaauucg

SEQ ID NO: 38355 - RNA, 23 nt, Artificial Sequence
  RNA Oligomer
cagaagauguucuaacaauucgc

SEQ ID NO: 38356 - RNA, 23 nt, Artificial Sequence
  RNA Oligomer
agaagauguucuaacaauucgcu

SEQ ID NO: 38357 - RNA, 23 nt, Artificial Sequence
  RNA Oligomer
gaagauguucuaacaauucgcuc

SEQ ID NO: 38358 - RNA, 23 nt, Artificial Sequence
  RNA Oligomer
aagauguucuaacaauucgcuca

SEQ ID NO: 38359 - RNA, 23 nt, Artificial Sequence
  RNA Oligomer
ggagaugugaaggaaguuaucuc

SEQ ID NO: 38360 - RNA, 23 nt, Artificial Sequence
  RNA Oligomer
gagaugugaaggaaguuaucuca

SEQ ID NO: 38361 - RNA, 23 nt, Artificial Sequence
  RNA Oligomer
agaugugaaggaaguuaucucac

SEQ ID NO: 38362 - RNA, 23 nt, Artificial Sequence
  RNA Oligomer
gaugugaaggaaguuaucucaca

SEQ ID NO: 38363 - RNA, 23 nt, Artificial Sequence
  RNA Oligomer
augugaaggaaguuaucucacac

SEQ ID NO: 38364 - RNA, 23 nt, Artificial Sequence
  RNA Oligomer
ugugaaggaaguuaucucacaca

SEQ ID NO: 38365 - RNA, 23 nt, Artificial Sequence
  RNA Oligomer
uaaaagcaaaacacauggaaaaa

SEQ ID NO: 38366 - RNA, 23 nt, Artificial Sequence
  RNA Oligomer
gcaagaaaucaccauuuaaugag

SEQ ID NO: 38367 - RNA, 23 nt, Artificial Sequence
  RNA Oligomer
agggguaauagaaagcagaaggg

SEQ ID NO: 38368 - RNA, 23 nt, Artificial Sequence
  RNA Oligomer
gggguaauagaaagcagaagggu

SEQ ID NO: 38369 - RNA, 23 nt, Artificial Sequence
  RNA Oligomer
ggguaauagaaagcagaaggguu

SEQ ID NO: 38370 - RNA, 23 nt, Artificial Sequence
  RNA Oligomer
gguaauagaaagcagaaggguuc

SEQ ID NO: 38371 - RNA, 23 nt, Artificial Sequence
  RNA Oligomer
guaauagaaagcagaaggguucu

SEQ ID NO: 38372 - RNA, 23 nt, Artificial Sequence
  RNA Oligomer
uaggcagcaaguugaggaguucc

SEQ ID NO: 38373 - RNA, 23 nt, Artificial Sequence
  RNA Oligomer
cagauaagcagggauaaagguuu

SEQ ID NO: 38374 - RNA, 23 nt, Artificial Sequence
  RNA Oligomer
agauaagcagggauaaagguuuc

SEQ ID NO: 38375 - RNA, 23 nt, Artificial Sequence
  RNA Oligomer
gauaagcagggauaaagguuucu

SEQ ID NO: 38376 - RNA, 23 nt, Artificial Sequence
  RNA Oligomer
auaagcagggauaaagguuucua

SEQ ID NO: 38377 - RNA, 23 nt, Artificial Sequence
  RNA Oligomer
uaagcagggauaaagguuucuag

SEQ ID NO: 38378 - RNA, 23 nt, Artificial Sequence
  RNA Oligomer
auguauggcacugaaauaaaagc

SEQ ID NO: 38379 - RNA, 23 nt, Artificial Sequence
  RNA Oligomer
uguauggcacugaaauaaaagcc

SEQ ID NO: 38380 - RNA, 23 nt, Artificial Sequence
  RNA Oligomer
guauggcacugaaauaaaagcca

SEQ ID NO: 38381 - RNA, 23 nt, Artificial Sequence
  RNA Oligomer
uauggcacugaaauaaaagccac

SEQ ID NO: 38382 - RNA, 23 nt, Artificial Sequence
  RNA Oligomer
auggcacugaaauaaaagccaca

SEQ ID NO: 38383 - RNA, 23 nt, Artificial Sequence
  RNA Oligomer
augaagguaaagaagggagagau

SEQ ID NO: 38384 - RNA, 23 nt, Artificial Sequence
  RNA Oligomer
ugaagguaaagaagggagagaua

SEQ ID NO: 38385 - RNA, 23 nt, Artificial Sequence
  RNA Oligomer
gaagguaaagaagggagagauau

SEQ ID NO: 38386 - RNA, 23 nt, Artificial Sequence
  RNA Oligomer
aagguaaagaagggagagauaug

SEQ ID NO: 38387 - RNA, 23 nt, Artificial Sequence
  RNA Oligomer
gagauaugaagcagggagauaag

SEQ ID NO: 38388 - RNA, 23 nt, Artificial Sequence
  RNA Oligomer
agauaugaagcagggagauaagc

SEQ ID NO: 38389 - RNA, 23 nt, Artificial Sequence
  RNA Oligomer
gauaugaagcagggagauaagcu

SEQ ID NO: 38390 - RNA, 23 nt, Artificial Sequence
  RNA Oligomer
auaugaagcagggagauaagcua

SEQ ID NO: 38391 - RNA, 23 nt, Artificial Sequence
  RNA Oligomer
aaagaucuuugagacuuccaugg

SEQ ID NO: 38392 - RNA, 23 nt, Artificial Sequence
  RNA Oligomer
aagaucuuugagacuuccauggg

SEQ ID NO: 38393 - RNA, 23 nt, Artificial Sequence
  RNA Oligomer
agaucuuugagacuuccaugggc

SEQ ID NO: 38394 - RNA, 23 nt, Artificial Sequence
  RNA Oligomer
gaucuuugagacuuccaugggca

SEQ ID NO: 38395 - RNA, 23 nt, Artificial Sequence
  RNA Oligomer
aucuuugagacuuccaugggcaa

SEQ ID NO: 38396 - RNA, 23 nt, Artificial Sequence
  RNA Oligomer
aagguacaaaugcaaggcaaugu

SEQ ID NO: 38397 - RNA, 23 nt, Artificial Sequence
  RNA Oligomer
ucacucuaggacaaaaagggcgg

SEQ ID NO: 38398 - RNA, 23 nt, Artificial Sequence
  RNA Oligomer
cacucuaggacaaaaagggcgga

SEQ ID NO: 38399 - RNA, 23 nt, Artificial Sequence
  RNA Oligomer
acucuaggacaaaaagggcggag

SEQ ID NO: 38400 - RNA, 23 nt, Artificial Sequence
  RNA Oligomer
cucuaggacaaaaagggcggagg

SEQ ID NO: 38401 - RNA, 23 nt, Artificial Sequence
  RNA Oligomer
ucuaggacaaaaagggcggagga

SEQ ID NO: 38402 - RNA, 23 nt, Artificial Sequence
  RNA Oligomer
gcaguauucagacaucuccuugc

SEQ ID NO: 38403 - RNA, 23 nt, Artificial Sequence
  RNA Oligomer
caguauucagacaucuccuugca

SEQ ID NO: 38404 - RNA, 23 nt, Artificial Sequence
  RNA Oligomer
aguauucagacaucuccuugcac

SEQ ID NO: 38405 - RNA, 23 nt, Artificial Sequence
  RNA Oligomer
guauucagacaucuccuugcacc

SEQ ID NO: 38406 - RNA, 23 nt, Artificial Sequence
  RNA Oligomer
uauucagacaucuccuugcaccg

SEQ ID NO: 38407 - RNA, 23 nt, Artificial Sequence
  RNA Oligomer
uuugauaaaauucaggagugcaa

SEQ ID NO: 38408 - RNA, 23 nt, Artificial Sequence
  RNA Oligomer
uugauaaaauucaggagugcaag

SEQ ID NO: 38409 - RNA, 23 nt, Artificial Sequence
  RNA Oligomer
ugauaaaauucaggagugcaagg

SEQ ID NO: 38410 - RNA, 23 nt, Artificial Sequence
  RNA Oligomer
uacuuccauacuaugucgaccca

SEQ ID NO: 38411 - RNA, 23 nt, Artificial Sequence
  RNA Oligomer
acuuccauacuaugucgacccaa

SEQ ID NO: 38412 - RNA, 23 nt, Artificial Sequence
  RNA Oligomer
cuuccauacuaugucgacccaaa

SEQ ID NO: 38413 - RNA, 23 nt, Artificial Sequence
  RNA Oligomer
uuccauacuaugucgacccaaag

SEQ ID NO: 38414 - RNA, 23 nt, Artificial Sequence
  RNA Oligomer
ugucuucaaggagcuaaaaaugc

SEQ ID NO: 38415 - RNA, 23 nt, Artificial Sequence
  RNA Oligomer
gucuucaaggagcuaaaaaugcc

SEQ ID NO: 38416 - RNA, 23 nt, Artificial Sequence
  RNA Oligomer
ucuucaaggagcuaaaaaugcca

SEQ ID NO: 38417 - RNA, 23 nt, Artificial Sequence
  RNA Oligomer
cuucaaggagcuaaaaaugccag

SEQ ID NO: 38418 - RNA, 23 nt, Artificial Sequence
  RNA Oligomer
uucaaggagcuaaaaaugccagu

SEQ ID NO: 38419 - RNA, 23 nt, Artificial Sequence
  RNA Oligomer
aaacacauggaaaaacaaaguac

SEQ ID NO: 38420 - RNA, 23 nt, Artificial Sequence
  RNA Oligomer
aacacauggaaaaacaaaguaca

SEQ ID NO: 38421 - RNA, 23 nt, Artificial Sequence
  RNA Oligomer
acacauggaaaaacaaaguacaa

SEQ ID NO: 38422 - RNA, 23 nt, Artificial Sequence
  RNA Oligomer
cacauggaaaaacaaaguacaaa

SEQ ID NO: 38423 - RNA, 23 nt, Artificial Sequence
  RNA Oligomer
acauggaaaaacaaaguacaaau

SEQ ID NO: 38424 - RNA, 23 nt, Artificial Sequence
  RNA Oligomer
auaauaauccguguauauuguca

SEQ ID NO: 38425 - RNA, 23 nt, Artificial Sequence
  RNA Oligomer
uaauaauccguguauauugucaa

SEQ ID NO: 38426 - RNA, 23 nt, Artificial Sequence
  RNA Oligomer
aauaauccguguauauugucaaa

SEQ ID NO: 38427 - RNA, 23 nt, Artificial Sequence
  RNA Oligomer
auaauccguguauauugucaaaa

SEQ ID NO: 38428 - RNA, 23 nt, Artificial Sequence
  RNA Oligomer
uaauccguguauauugucaaaag

SEQ ID NO: 38429 - RNA, 23 nt, Artificial Sequence
  RNA Oligomer
uucaacaaacauuuaaugaaggc

SEQ ID NO: 38430 - RNA, 23 nt, Artificial Sequence
  RNA Oligomer
ucaacaaacauuuaaugaaggcc

SEQ ID NO: 38431 - RNA, 23 nt, Artificial Sequence
  RNA Oligomer
gcacaaaauuagaagcugagagg

SEQ ID NO: 38432 - RNA, 23 nt, Artificial Sequence
  RNA Oligomer
cacaaaauuagaagcugagagga

SEQ ID NO: 38433 - RNA, 23 nt, Artificial Sequence
  RNA Oligomer
acaaaauuagaagcugagaggag

SEQ ID NO: 38434 - RNA, 23 nt, Artificial Sequence
  RNA Oligomer
caaaauuagaagcugagaggaga

SEQ ID NO: 38435 - RNA, 23 nt, Artificial Sequence
  RNA Oligomer
aaaauuagaagcugagaggagac

SEQ ID NO: 38436 - RNA, 23 nt, Artificial Sequence
  RNA Oligomer
uaaaagccacauaauaucaaagg

SEQ ID NO: 38437 - RNA, 23 nt, Artificial Sequence
  RNA Oligomer
aaaagccacauaauaucaaagga

SEQ ID NO: 38438 - RNA, 23 nt, Artificial Sequence
  RNA Oligomer
aaagccacauaauaucaaaggag

SEQ ID NO: 38439 - RNA, 23 nt, Artificial Sequence
  RNA Oligomer
aagccacauaauaucaaaggaga

SEQ ID NO: 38440 - RNA, 23 nt, Artificial Sequence
  RNA Oligomer
agccacauaauaucaaaggagag

SEQ ID NO: 38441 - RNA, 23 nt, Artificial Sequence
  RNA Oligomer
gccacauaauaucaaaggagagu

SEQ ID NO: 38442 - RNA, 23 nt, Artificial Sequence
  RNA Oligomer
ccacauaauaucaaaggagaguu

SEQ ID NO: 38443 - RNA, 23 nt, Artificial Sequence
  RNA Oligomer
cacauaauaucaaaggagaguuu

SEQ ID NO: 38444 - RNA, 23 nt, Artificial Sequence
  RNA Oligomer
acauaauaucaaaggagaguuua

SEQ ID NO: 38445 - RNA, 23 nt, Artificial Sequence
  RNA Oligomer
cauaauaucaaaggagaguuuaa

SEQ ID NO: 38446 - RNA, 23 nt, Artificial Sequence
  RNA Oligomer
aaucuagauaugaagugcagguu

SEQ ID NO: 38447 - RNA, 23 nt, Artificial Sequence
  RNA Oligomer
cagguugauugaaugaaaguggg

SEQ ID NO: 38448 - RNA, 23 nt, Artificial Sequence
  RNA Oligomer
agguugauugaaugaaaguggga

SEQ ID NO: 38449 - RNA, 23 nt, Artificial Sequence
  RNA Oligomer
gguugauugaaugaaagugggaa

SEQ ID NO: 38450 - RNA, 23 nt, Artificial Sequence
  RNA Oligomer
guugauugaaugaaagugggaau

SEQ ID NO: 38451 - RNA, 23 nt, Artificial Sequence
  RNA Oligomer
uugauugaaugaaagugggaaua

SEQ ID NO: 38452 - RNA, 23 nt, Artificial Sequence
  RNA Oligomer
auaaaagauaggagauggucucu

SEQ ID NO: 38453 - RNA, 23 nt, Artificial Sequence
  RNA Oligomer
gcaaaacacauggaaaaacaaag

SEQ ID NO: 38454 - RNA, 23 nt, Artificial Sequence
  RNA Oligomer
caaaacacauggaaaaacaaagu

SEQ ID NO: 38455 - RNA, 23 nt, Artificial Sequence
  RNA Oligomer
aaaacacauggaaaaacaaagua

SEQ ID NO: 38456 - RNA, 23 nt, Artificial Sequence
  RNA Oligomer
gauggugaauaaaacaaacaagg

SEQ ID NO: 38457 - RNA, 23 nt, Artificial Sequence
  RNA Oligomer
auggugaauaaaacaaacaaggu

SEQ ID NO: 38458 - RNA, 23 nt, Artificial Sequence
  RNA Oligomer
uggugaauaaaacaaacaagguu

SEQ ID NO: 38459 - RNA, 23 nt, Artificial Sequence
  RNA Oligomer
ggugaauaaaacaaacaagguuu

SEQ ID NO: 38460 - RNA, 23 nt, Artificial Sequence
  RNA Oligomer
gugaauaaaacaaacaagguuuc

SEQ ID NO: 38461 - RNA, 23 nt, Artificial Sequence
  RNA Oligomer
accccucuuaggcagcaaguuga

SEQ ID NO: 38462 - RNA, 23 nt, Artificial Sequence
  RNA Oligomer
ccccucuuaggcagcaaguugag

SEQ ID NO: 38463 - RNA, 23 nt, Artificial Sequence
  RNA Oligomer
cccucuuaggcagcaaguugagg

SEQ ID NO: 38464 - RNA, 23 nt, Artificial Sequence
  RNA Oligomer
agggauaaagguuucuagguuga

SEQ ID NO: 38465 - RNA, 23 nt, Artificial Sequence
  RNA Oligomer
gggauaaagguuucuagguugaa

SEQ ID NO: 38466 - RNA, 23 nt, Artificial Sequence
  RNA Oligomer
ggauaaagguuucuagguugaaa

SEQ ID NO: 38467 - RNA, 23 nt, Artificial Sequence
  RNA Oligomer
gauaaagguuucuagguugaaaa

SEQ ID NO: 38468 - RNA, 23 nt, Artificial Sequence
  RNA Oligomer
auaaagguuucuagguugaaaac

SEQ ID NO: 38469 - RNA, 23 nt, Artificial Sequence
  RNA Oligomer
uacaucuuugagcauuuacauga

SEQ ID NO: 38470 - RNA, 23 nt, Artificial Sequence
  RNA Oligomer
acaucuuugagcauuuacaugau

SEQ ID NO: 38471 - RNA, 23 nt, Artificial Sequence
  RNA Oligomer
caucuuugagcauuuacaugauc

SEQ ID NO: 38472 - RNA, 23 nt, Artificial Sequence
  RNA Oligomer
uaugaagcagggagauaagcuag

SEQ ID NO: 38473 - RNA, 23 nt, Artificial Sequence
  RNA Oligomer
augaagcagggagauaagcuagg

SEQ ID NO: 38474 - RNA, 23 nt, Artificial Sequence
  RNA Oligomer
ucuagaaaucuagauaugaagug

SEQ ID NO: 38475 - RNA, 23 nt, Artificial Sequence
  RNA Oligomer
aucuagauaugaagugcagguug

SEQ ID NO: 38476 - RNA, 23 nt, Artificial Sequence
  RNA Oligomer
gcagguugauugaaugaaagugg

SEQ ID NO: 38477 - RNA, 23 nt, Artificial Sequence
  RNA Oligomer
aaugaaagugggaauaguaaggg

SEQ ID NO: 38478 - RNA, 23 nt, Artificial Sequence
  RNA Oligomer
augaaagugggaauaguaaggga

SEQ ID NO: 38479 - RNA, 23 nt, Artificial Sequence
  RNA Oligomer
ugaaagugggaauaguaagggag

SEQ ID NO: 38480 - RNA, 23 nt, Artificial Sequence
  RNA Oligomer
gaaagugggaauaguaagggaga

SEQ ID NO: 38481 - RNA, 23 nt, Artificial Sequence
  RNA Oligomer
aaagugggaauaguaagggagag

SEQ ID NO: 38482 - RNA, 23 nt, Artificial Sequence
  RNA Oligomer
aguaagggagagagauggacguu

SEQ ID NO: 38483 - RNA, 23 nt, Artificial Sequence
  RNA Oligomer
guaagggagagagauggacguuu

SEQ ID NO: 38484 - RNA, 23 nt, Artificial Sequence
  RNA Oligomer
uaagggagagagauggacguuuc

SEQ ID NO: 38485 - RNA, 23 nt, Artificial Sequence
  RNA Oligomer
aagggagagagauggacguuucu

SEQ ID NO: 38486 - RNA, 23 nt, Artificial Sequence
  RNA Oligomer
ucucuagucauguuugcuucuuc

SEQ ID NO: 38487 - RNA, 23 nt, Artificial Sequence
  RNA Oligomer
cucuagucauguuugcuucuuca

SEQ ID NO: 38488 - RNA, 23 nt, Artificial Sequence
  RNA Oligomer
ucuagucauguuugcuucuucag

SEQ ID NO: 38489 - RNA, 23 nt, Artificial Sequence
  RNA Oligomer
cuagucauguuugcuucuucaga

SEQ ID NO: 38490 - RNA, 23 nt, Artificial Sequence
  RNA Oligomer
uagucauguuugcuucuucagag

SEQ ID NO: 38491 - RNA, 23 nt, Artificial Sequence
  RNA Oligomer
uguguuuacaacuucacuuguca

SEQ ID NO: 38492 - RNA, 23 nt, Artificial Sequence
  RNA Oligomer
guguuuacaacuucacuugucag

SEQ ID NO: 38493 - RNA, 23 nt, Artificial Sequence
  RNA Oligomer
uguuuacaacuucacuugucagg

SEQ ID NO: 38494 - RNA, 23 nt, Artificial Sequence
  RNA Oligomer
guuuacaacuucacuugucaggc

SEQ ID NO: 38495 - RNA, 23 nt, Artificial Sequence
  RNA Oligomer
uuuacaacuucacuugucaggcu

SEQ ID NO: 38496 - RNA, 23 nt, Artificial Sequence
  RNA Oligomer
acucaaaggcagagaugaugggc

SEQ ID NO: 38497 - RNA, 23 nt, Artificial Sequence
  RNA Oligomer
cucaaaggcagagaugaugggca

SEQ ID NO: 38498 - RNA, 23 nt, Artificial Sequence
  RNA Oligomer
ucaaaggcagagaugaugggcac

SEQ ID NO: 38499 - RNA, 23 nt, Artificial Sequence
  RNA Oligomer
caaaggcagagaugaugggcaca

SEQ ID NO: 38500 - RNA, 23 nt, Artificial Sequence
  RNA Oligomer
aaaggcagagaugaugggcacag

SEQ ID NO: 38501 - RNA, 23 nt, Artificial Sequence
  RNA Oligomer
uuucuuuaccggcaucacucucc

SEQ ID NO: 38502 - RNA, 23 nt, Artificial Sequence
  RNA Oligomer
uucuuuaccggcaucacucuccu

SEQ ID NO: 38503 - RNA, 23 nt, Artificial Sequence
  RNA Oligomer
ucuuuaccggcaucacucuccuc

SEQ ID NO: 38504 - RNA, 23 nt, Artificial Sequence
  RNA Oligomer
cuuuaccggcaucacucuccucg

SEQ ID NO: 38505 - RNA, 23 nt, Artificial Sequence
  RNA Oligomer
uuuaccggcaucacucuccucgc

SEQ ID NO: 38506 - RNA, 23 nt, Artificial Sequence
  RNA Oligomer
acauuuuugguuuguucuguagg

SEQ ID NO: 38507 - RNA, 23 nt, Artificial Sequence
  RNA Oligomer
gcaaaauucugcaguuucucuug

SEQ ID NO: 38508 - RNA, 23 nt, Artificial Sequence
  RNA Oligomer
caaaauucugcaguuucucuugc

SEQ ID NO: 38509 - RNA, 23 nt, Artificial Sequence
  RNA Oligomer
aaaauucugcaguuucucuugca

SEQ ID NO: 38510 - RNA, 23 nt, Artificial Sequence
  RNA Oligomer
aaauucugcaguuucucuugcau

SEQ ID NO: 38511 - RNA, 23 nt, Artificial Sequence
  RNA Oligomer
aauucugcaguuucucuugcauu

SEQ ID NO: 38512 - RNA, 23 nt, Artificial Sequence
  RNA Oligomer
caguuucucuugcauuuccugug

SEQ ID NO: 38513 - RNA, 23 nt, Artificial Sequence
  RNA Oligomer
aguuucucuugcauuuccugugc

SEQ ID NO: 38514 - RNA, 23 nt, Artificial Sequence
  RNA Oligomer
guuucucuugcauuuccugugca

SEQ ID NO: 38515 - RNA, 23 nt, Artificial Sequence
  RNA Oligomer
uuucucuugcauuuccugugcag

SEQ ID NO: 38516 - RNA, 23 nt, Artificial Sequence
  RNA Oligomer
uucucuugcauuuccugugcagu

SEQ ID NO: 38517 - RNA, 23 nt, Artificial Sequence
  RNA Oligomer
aaaagcaaaacacauggaaaaac

SEQ ID NO: 38518 - RNA, 23 nt, Artificial Sequence
  RNA Oligomer
ugaacaaguaaaaguagcauaua

SEQ ID NO: 38519 - RNA, 23 nt, Artificial Sequence
  RNA Oligomer
agacuugaggaagaaggacacca

SEQ ID NO: 38520 - RNA, 23 nt, Artificial Sequence
  RNA Oligomer
gacuugaggaagaaggacaccac

SEQ ID NO: 38521 - RNA, 23 nt, Artificial Sequence
  RNA Oligomer
acuugaggaagaaggacaccacc

SEQ ID NO: 38522 - RNA, 23 nt, Artificial Sequence
  RNA Oligomer
cuugaggaagaaggacaccaccu

SEQ ID NO: 38523 - RNA, 23 nt, Artificial Sequence
  RNA Oligomer
uugaggaagaaggacaccaccug

SEQ ID NO: 38524 - RNA, 23 nt, Artificial Sequence
  RNA Oligomer
uaauagaaagcagaaggguucua

SEQ ID NO: 38525 - RNA, 23 nt, Artificial Sequence
  RNA Oligomer
aauagaaagcagaaggguucuaa

SEQ ID NO: 38526 - RNA, 23 nt, Artificial Sequence
  RNA Oligomer
auagaaagcagaaggguucuaag

SEQ ID NO: 38527 - RNA, 23 nt, Artificial Sequence
  RNA Oligomer
uaacauguauggcacugaaauaa

SEQ ID NO: 38528 - RNA, 23 nt, Artificial Sequence
  RNA Oligomer
aacauguauggcacugaaauaaa

SEQ ID NO: 38529 - RNA, 23 nt, Artificial Sequence
  RNA Oligomer
acauguauggcacugaaauaaaa

SEQ ID NO: 38530 - RNA, 23 nt, Artificial Sequence
  RNA Oligomer
cauguauggcacugaaauaaaag

SEQ ID NO: 38531 - RNA, 23 nt, Artificial Sequence
  RNA Oligomer
gaggugguuacagagucuaggga

SEQ ID NO: 38532 - RNA, 23 nt, Artificial Sequence
  RNA Oligomer
aggugguuacagagucuagggaa

SEQ ID NO: 38533 - RNA, 23 nt, Artificial Sequence
  RNA Oligomer
ggugguuacagagucuagggaaa

SEQ ID NO: 38534 - RNA, 23 nt, Artificial Sequence
  RNA Oligomer
gugguuacagagucuagggaaac

SEQ ID NO: 38535 - RNA, 23 nt, Artificial Sequence
  RNA Oligomer
ugguuacagagucuagggaaaca

SEQ ID NO: 38536 - RNA, 23 nt, Artificial Sequence
  RNA Oligomer
aacgaaagaucuuugagacuucc

SEQ ID NO: 38537 - RNA, 23 nt, Artificial Sequence
  RNA Oligomer
acgaaagaucuuugagacuucca

SEQ ID NO: 38538 - RNA, 23 nt, Artificial Sequence
  RNA Oligomer
cgaaagaucuuugagacuuccau

SEQ ID NO: 38539 - RNA, 23 nt, Artificial Sequence
  RNA Oligomer
gaaagaucuuugagacuuccaug

SEQ ID NO: 38540 - RNA, 23 nt, Artificial Sequence
  RNA Oligomer
cuaggacaaaaagggcggaggau

SEQ ID NO: 38541 - RNA, 23 nt, Artificial Sequence
  RNA Oligomer
uaggacaaaaagggcggaggaua

SEQ ID NO: 38542 - RNA, 23 nt, Artificial Sequence
  RNA Oligomer
uggggaauuuauaugcccucucc

SEQ ID NO: 38543 - RNA, 23 nt, Artificial Sequence
  RNA Oligomer
ggggaauuuauaugcccucuccc

SEQ ID NO: 38544 - RNA, 23 nt, Artificial Sequence
  RNA Oligomer
gggaauuuauaugcccucucccc

SEQ ID NO: 38545 - RNA, 23 nt, Artificial Sequence
  RNA Oligomer
ggaauuuauaugcccucucccca

SEQ ID NO: 38546 - RNA, 23 nt, Artificial Sequence
  RNA Oligomer
gaauuuauaugcccucuccccau

SEQ ID NO: 38547 - RNA, 23 nt, Artificial Sequence
  RNA Oligomer
uuacaacuucacuugucaggcuc

SEQ ID NO: 38548 - RNA, 23 nt, Artificial Sequence
  RNA Oligomer
uacaacuucacuugucaggcucu

SEQ ID NO: 38549 - RNA, 23 nt, Artificial Sequence
  RNA Oligomer
cacucaaaggcagagaugauggg

SEQ ID NO: 38550 - RNA, 23 nt, Artificial Sequence
  RNA Oligomer
aggcauagccgcauaucaugucu

SEQ ID NO: 38551 - RNA, 23 nt, Artificial Sequence
  RNA Oligomer
ggcauagccgcauaucaugucug

SEQ ID NO: 38552 - RNA, 23 nt, Artificial Sequence
  RNA Oligomer
gcauagccgcauaucaugucuga

SEQ ID NO: 38553 - RNA, 23 nt, Artificial Sequence
  RNA Oligomer
cauagccgcauaucaugucugag

SEQ ID NO: 38554 - RNA, 23 nt, Artificial Sequence
  RNA Oligomer
auagccgcauaucaugucugagc

SEQ ID NO: 38555 - RNA, 23 nt, Artificial Sequence
  RNA Oligomer
gccacacacucccaauauccugc

SEQ ID NO: 38556 - RNA, 23 nt, Artificial Sequence
  RNA Oligomer
ccacacacucccaauauccugcg

SEQ ID NO: 38557 - RNA, 23 nt, Artificial Sequence
  RNA Oligomer
cacacacucccaauauccugcgu

SEQ ID NO: 38558 - RNA, 23 nt, Artificial Sequence
  RNA Oligomer
acacacucccaauauccugcguc

SEQ ID NO: 38559 - RNA, 23 nt, Artificial Sequence
  RNA Oligomer
cacacucccaauauccugcgucc

SEQ ID NO: 38560 - RNA, 23 nt, Artificial Sequence
  RNA Oligomer
gugcaaaauucugcaguuucucu

SEQ ID NO: 38561 - RNA, 23 nt, Artificial Sequence
  RNA Oligomer
ugcaaaauucugcaguuucucuu

SEQ ID NO: 38562 - RNA, 23 nt, Artificial Sequence
  RNA Oligomer
acacucccaauauccugcguccc

SEQ ID NO: 38563 - RNA, 23 nt, Artificial Sequence
  RNA Oligomer
ggccgagacugcaaccuauaugc

SEQ ID NO: 38564 - RNA, 23 nt, Artificial Sequence
  RNA Oligomer
gccgagacugcaaccuauaugcc

SEQ ID NO: 38565 - RNA, 23 nt, Artificial Sequence
  RNA Oligomer
ccgagacugcaaccuauaugcca

SEQ ID NO: 38566 - RNA, 23 nt, Artificial Sequence
  RNA Oligomer
cgagacugcaaccuauaugccag

SEQ ID NO: 38567 - RNA, 23 nt, Artificial Sequence
  RNA Oligomer
gagacugcaaccuauaugccagc

SEQ ID NO: 38568 - RNA, 23 nt, Artificial Sequence
  RNA Oligomer
aauucaggagugcaaggcuucac

SEQ ID NO: 38569 - RNA, 23 nt, Artificial Sequence
  RNA Oligomer
ccgauggcaauacaaaauccugg

SEQ ID NO: 38570 - RNA, 23 nt, Artificial Sequence
  RNA Oligomer
cgauggcaauacaaaauccuggc

SEQ ID NO: 38571 - RNA, 23 nt, Artificial Sequence
  RNA Oligomer
gauggcaauacaaaauccuggca

SEQ ID NO: 38572 - RNA, 23 nt, Artificial Sequence
  RNA Oligomer
auggcaauacaaaauccuggcag

SEQ ID NO: 38573 - RNA, 23 nt, Artificial Sequence
  RNA Oligomer
uggcaauacaaaauccuggcagu

SEQ ID NO: 38574 - RNA, 23 nt, Artificial Sequence
  RNA Oligomer
cucaaauacuuccauacuauguc

SEQ ID NO: 38575 - RNA, 23 nt, Artificial Sequence
  RNA Oligomer
uaaaaaugccaguggauaaaagc

SEQ ID NO: 38576 - RNA, 23 nt, Artificial Sequence
  RNA Oligomer
aaaaaugccaguggauaaaagca

SEQ ID NO: 38577 - RNA, 23 nt, Artificial Sequence
  RNA Oligomer
aaaaugccaguggauaaaagcaa

SEQ ID NO: 38578 - RNA, 23 nt, Artificial Sequence
  RNA Oligomer
aaaugccaguggauaaaagcaaa

SEQ ID NO: 38579 - RNA, 23 nt, Artificial Sequence
  RNA Oligomer
aaugccaguggauaaaagcaaaa

SEQ ID NO: 38580 - RNA, 23 nt, Artificial Sequence
  RNA Oligomer
uuuaucaaaagguaggauuguag

SEQ ID NO: 38581 - RNA, 23 nt, Artificial Sequence
  RNA Oligomer
uuaucaaaagguaggauuguagc

SEQ ID NO: 38582 - RNA, 23 nt, Artificial Sequence
  RNA Oligomer
uaucaaaagguaggauuguagcu

SEQ ID NO: 38583 - RNA, 23 nt, Artificial Sequence
  RNA Oligomer
aucaaaagguaggauuguagcua

SEQ ID NO: 38584 - RNA, 23 nt, Artificial Sequence
  RNA Oligomer
ucaaaagguaggauuguagcuaa

SEQ ID NO: 38585 - RNA, 23 nt, Artificial Sequence
  RNA Oligomer
gaauaaaacaaacaagguuucug

SEQ ID NO: 38586 - RNA, 23 nt, Artificial Sequence
  RNA Oligomer
ucaccauuuaaugagguucaagg

SEQ ID NO: 38587 - RNA, 23 nt, Artificial Sequence
  RNA Oligomer
cagggauaaagguuucuagguug

SEQ ID NO: 38588 - RNA, 23 nt, Artificial Sequence
  RNA Oligomer
auaaaagccacauaauaucaaag

SEQ ID NO: 38589 - RNA, 23 nt, Artificial Sequence
  RNA Oligomer
agagagauggacguuucucagga

SEQ ID NO: 38590 - RNA, 23 nt, Artificial Sequence
  RNA Oligomer
gagagauggacguuucucaggaa

SEQ ID NO: 38591 - RNA, 23 nt, Artificial Sequence
  RNA Oligomer
agagauggacguuucucaggaag

SEQ ID NO: 38592 - RNA, 23 nt, Artificial Sequence
  RNA Oligomer
gagauggacguuucucaggaagg

SEQ ID NO: 38593 - RNA, 23 nt, Artificial Sequence
  RNA Oligomer
agauggacguuucucaggaagga

SEQ ID NO: 38594 - RNA, 23 nt, Artificial Sequence
  RNA Oligomer
agaggugguuacagagucuaggg

SEQ ID NO: 38595 - RNA, 23 nt, Artificial Sequence
  RNA Oligomer
gcccaaacgagccaagagugucc

SEQ ID NO: 38596 - RNA, 23 nt, Artificial Sequence
  RNA Oligomer
cccaaacgagccaagaguguccu

SEQ ID NO: 38597 - RNA, 23 nt, Artificial Sequence
  RNA Oligomer
ccaaacgagccaagaguguccuu

SEQ ID NO: 38598 - RNA, 23 nt, Artificial Sequence
  RNA Oligomer
caaacgagccaagaguguccuuc

SEQ ID NO: 38599 - RNA, 23 nt, Artificial Sequence
  RNA Oligomer
aaacgagccaagaguguccuucc

SEQ ID NO: 38600 - RNA, 23 nt, Artificial Sequence
  RNA Oligomer
gcgucucuagucauguuugcuuc

SEQ ID NO: 38601 - RNA, 23 nt, Artificial Sequence
  RNA Oligomer
cgucucuagucauguuugcuucu

SEQ ID NO: 38602 - RNA, 23 nt, Artificial Sequence
  RNA Oligomer
gucucuagucauguuugcuucuu

SEQ ID NO: 38603 - RNA, 23 nt, Artificial Sequence
  RNA Oligomer
ucauuuccaaggugaugaugucc

SEQ ID NO: 38604 - RNA, 23 nt, Artificial Sequence
  RNA Oligomer
cauuuccaaggugaugauguccu

SEQ ID NO: 38605 - RNA, 23 nt, Artificial Sequence
  RNA Oligomer
auuuccaaggugaugauguccuu

SEQ ID NO: 38606 - RNA, 23 nt, Artificial Sequence
  RNA Oligomer
uuuccaaggugaugauguccuuc

SEQ ID NO: 38607 - RNA, 23 nt, Artificial Sequence
  RNA Oligomer
uuccaaggugaugauguccuucu

SEQ ID NO: 38608 - RNA, 23 nt, Artificial Sequence
  RNA Oligomer
uaaaagauaggagauggucucuc

SEQ ID NO: 38609 - RNA, 23 nt, Artificial Sequence
  RNA Oligomer
gcuggaacugaacacaaauaugg

SEQ ID NO: 38610 - RNA, 23 nt, Artificial Sequence
  RNA Oligomer
cuggaacugaacacaaauauggg

SEQ ID NO: 38611 - RNA, 23 nt, Artificial Sequence
  RNA Oligomer
uggaacugaacacaaauaugggg

SEQ ID NO: 38612 - RNA, 23 nt, Artificial Sequence
  RNA Oligomer
ggaacugaacacaaauaugggga

SEQ ID NO: 38613 - RNA, 23 nt, Artificial Sequence
  RNA Oligomer
gaacugaacacaaauauggggaa

SEQ ID NO: 38614 - RNA, 23 nt, Artificial Sequence
  RNA Oligomer
acacucaaaggcagagaugaugg

SEQ ID NO: 38615 - RNA, 23 nt, Artificial Sequence
  RNA Oligomer
agauguucuaacaauucgcucaa

SEQ ID NO: 38616 - RNA, 23 nt, Artificial Sequence
  RNA Oligomer
cuccuugcaccgguggaauucug

SEQ ID NO: 38617 - RNA, 23 nt, Artificial Sequence
  RNA Oligomer
uccuugcaccgguggaauucugu

SEQ ID NO: 38618 - RNA, 23 nt, Artificial Sequence
  RNA Oligomer
ccuugcaccgguggaauucugug

SEQ ID NO: 38619 - RNA, 23 nt, Artificial Sequence
  RNA Oligomer
cuugcaccgguggaauucugugc

SEQ ID NO: 38620 - RNA, 23 nt, Artificial Sequence
  RNA Oligomer
uugcaccgguggaauucugugcc

SEQ ID NO: 38621 - RNA, 23 nt, Artificial Sequence
  RNA Oligomer
ugcguucaccuuaaccagcaugu

SEQ ID NO: 38622 - RNA, 23 nt, Artificial Sequence
  RNA Oligomer
gcguucaccuuaaccagcauguc

SEQ ID NO: 38623 - RNA, 23 nt, Artificial Sequence
  RNA Oligomer
cguucaccuuaaccagcaugucg

SEQ ID NO: 38624 - RNA, 23 nt, Artificial Sequence
  RNA Oligomer
guucaccuuaaccagcaugucgg

SEQ ID NO: 38625 - RNA, 23 nt, Artificial Sequence
  RNA Oligomer
uucaccuuaaccagcaugucggc

SEQ ID NO: 38626 - RNA, 23 nt, Artificial Sequence
  RNA Oligomer
ucaccuuaaccagcaugucggcc

SEQ ID NO: 38627 - RNA, 23 nt, Artificial Sequence
  RNA Oligomer
caccuuaaccagcaugucggcca

SEQ ID NO: 38628 - RNA, 23 nt, Artificial Sequence
  RNA Oligomer
accuuaaccagcaugucggccac

SEQ ID NO: 38629 - RNA, 23 nt, Artificial Sequence
  RNA Oligomer
cacgaucagucucaucuccacgg

SEQ ID NO: 38630 - RNA, 23 nt, Artificial Sequence
  RNA Oligomer
acgaucagucucaucuccacggc

SEQ ID NO: 38631 - RNA, 23 nt, Artificial Sequence
  RNA Oligomer
cgaucagucucaucuccacggca

SEQ ID NO: 38632 - RNA, 23 nt, Artificial Sequence
  RNA Oligomer
gaucagucucaucuccacggcag

SEQ ID NO: 38633 - RNA, 23 nt, Artificial Sequence
  RNA Oligomer
aucagucucaucuccacggcagg

SEQ ID NO: 38634 - RNA, 23 nt, Artificial Sequence
  RNA Oligomer
cagucuggucacauagaacaugg

SEQ ID NO: 38635 - RNA, 23 nt, Artificial Sequence
  RNA Oligomer
agucuggucacauagaacaugga

SEQ ID NO: 38636 - RNA, 23 nt, Artificial Sequence
  RNA Oligomer
gucuggucacauagaacauggac

SEQ ID NO: 38637 - RNA, 23 nt, Artificial Sequence
  RNA Oligomer
ucuggucacauagaacauggacg

SEQ ID NO: 38638 - RNA, 23 nt, Artificial Sequence
  RNA Oligomer
cuggucacauagaacauggacgu

SEQ ID NO: 38639 - RNA, 23 nt, Artificial Sequence
  RNA Oligomer
gguucucucucucaaauacuucc

SEQ ID NO: 38640 - RNA, 23 nt, Artificial Sequence
  RNA Oligomer
guucucucucucaaauacuucca

SEQ ID NO: 38641 - RNA, 23 nt, Artificial Sequence
  RNA Oligomer
uucucucucucaaauacuuccau

SEQ ID NO: 38642 - RNA, 23 nt, Artificial Sequence
  RNA Oligomer
ucucucucucaaauacuuccaua

SEQ ID NO: 38643 - RNA, 23 nt, Artificial Sequence
  RNA Oligomer
cucucucucaaauacuuccauac

SEQ ID NO: 38644 - RNA, 23 nt, Artificial Sequence
  RNA Oligomer
acuacuacaggccuagcauuuug

SEQ ID NO: 38645 - RNA, 23 nt, Artificial Sequence
  RNA Oligomer
cuaaaaaugccaguggauaaaag

SEQ ID NO: 38646 - RNA, 23 nt, Artificial Sequence
  RNA Oligomer
augccaguggauaaaagcaaaac

SEQ ID NO: 38647 - RNA, 23 nt, Artificial Sequence
  RNA Oligomer
gccaguggauaaaagcaaaacac

SEQ ID NO: 38648 - RNA, 23 nt, Artificial Sequence
  RNA Oligomer
ccaguggauaaaagcaaaacaca

SEQ ID NO: 38649 - RNA, 23 nt, Artificial Sequence
  RNA Oligomer
caguggauaaaagcaaaacacau

SEQ ID NO: 38650 - RNA, 23 nt, Artificial Sequence
  RNA Oligomer
aguggauaaaagcaaaacacaug

SEQ ID NO: 38651 - RNA, 23 nt, Artificial Sequence
  RNA Oligomer
aauaauaauccguguauauuguc

SEQ ID NO: 38652 - RNA, 23 nt, Artificial Sequence
  RNA Oligomer
gaacaaguaaaaguagcauauau

SEQ ID NO: 38653 - RNA, 23 nt, Artificial Sequence
  RNA Oligomer
ccgggaauugucaagacuugagg

SEQ ID NO: 38654 - RNA, 23 nt, Artificial Sequence
  RNA Oligomer
cgggaauugucaagacuugagga

SEQ ID NO: 38655 - RNA, 23 nt, Artificial Sequence
  RNA Oligomer
gggaauugucaagacuugaggaa

SEQ ID NO: 38656 - RNA, 23 nt, Artificial Sequence
  RNA Oligomer
ggaauugucaagacuugaggaag

SEQ ID NO: 38657 - RNA, 23 nt, Artificial Sequence
  RNA Oligomer
gaauugucaagacuugaggaaga

SEQ ID NO: 38658 - RNA, 23 nt, Artificial Sequence
  RNA Oligomer
cuggagcuuagcaagaaaucacc

SEQ ID NO: 38659 - RNA, 23 nt, Artificial Sequence
  RNA Oligomer
uggagcuuagcaagaaaucacca

SEQ ID NO: 38660 - RNA, 23 nt, Artificial Sequence
  RNA Oligomer
ggagcuuagcaagaaaucaccau

SEQ ID NO: 38661 - RNA, 23 nt, Artificial Sequence
  RNA Oligomer
gagcuuagcaagaaaucaccauu

SEQ ID NO: 38662 - RNA, 23 nt, Artificial Sequence
  RNA Oligomer
agcuuagcaagaaaucaccauuu

SEQ ID NO: 38663 - RNA, 23 nt, Artificial Sequence
  RNA Oligomer
agucuuaaagaacagggaaguug

SEQ ID NO: 38664 - RNA, 23 nt, Artificial Sequence
  RNA Oligomer
gucuuaaagaacagggaaguugg

SEQ ID NO: 38665 - RNA, 23 nt, Artificial Sequence
  RNA Oligomer
ucuuaaagaacagggaaguuggg

SEQ ID NO: 38666 - RNA, 23 nt, Artificial Sequence
  RNA Oligomer
cuuaaagaacagggaaguuggga

SEQ ID NO: 38667 - RNA, 23 nt, Artificial Sequence
  RNA Oligomer
uuaaagaacagggaaguugggaa

SEQ ID NO: 38668 - RNA, 23 nt, Artificial Sequence
  RNA Oligomer
uuucagauaagcagggauaaagg

SEQ ID NO: 38669 - RNA, 23 nt, Artificial Sequence
  RNA Oligomer
uucagauaagcagggauaaaggu

SEQ ID NO: 38670 - RNA, 23 nt, Artificial Sequence
  RNA Oligomer
ucagauaagcagggauaaagguu

SEQ ID NO: 38671 - RNA, 23 nt, Artificial Sequence
  RNA Oligomer
aacaauaacauguauggcacuga

SEQ ID NO: 38672 - RNA, 23 nt, Artificial Sequence
  RNA Oligomer
acaauaacauguauggcacugaa

SEQ ID NO: 38673 - RNA, 23 nt, Artificial Sequence
  RNA Oligomer
caauaacauguauggcacugaaa

SEQ ID NO: 38674 - RNA, 23 nt, Artificial Sequence
  RNA Oligomer
aauaacauguauggcacugaaau

SEQ ID NO: 38675 - RNA, 23 nt, Artificial Sequence
  RNA Oligomer
auaacauguauggcacugaaaua

SEQ ID NO: 38676 - RNA, 23 nt, Artificial Sequence
  RNA Oligomer
ucuagauaugaagugcagguuga

SEQ ID NO: 38677 - RNA, 23 nt, Artificial Sequence
  RNA Oligomer
cuagauaugaagugcagguugau

SEQ ID NO: 38678 - RNA, 23 nt, Artificial Sequence
  RNA Oligomer
uagauaugaagugcagguugauu

SEQ ID NO: 38679 - RNA, 23 nt, Artificial Sequence
  RNA Oligomer
gaaggaaaaagacagagaggugg

SEQ ID NO: 38680 - RNA, 23 nt, Artificial Sequence
  RNA Oligomer
aaggaaaaagacagagagguggu

SEQ ID NO: 38681 - RNA, 23 nt, Artificial Sequence
  RNA Oligomer
aggaaaaagacagagaggugguu

SEQ ID NO: 38682 - RNA, 23 nt, Artificial Sequence
  RNA Oligomer
gaaaaagacagagaggugguuac

SEQ ID NO: 38683 - RNA, 23 nt, Artificial Sequence
  RNA Oligomer
gcucauuucaguaacaaagcuca

SEQ ID NO: 38684 - RNA, 23 nt, Artificial Sequence
  RNA Oligomer
cucauuucaguaacaaagcucag

SEQ ID NO: 38685 - RNA, 23 nt, Artificial Sequence
  RNA Oligomer
ucauuucaguaacaaagcucaga

SEQ ID NO: 38686 - RNA, 23 nt, Artificial Sequence
  RNA Oligomer
cauuucaguaacaaagcucagag

SEQ ID NO: 38687 - RNA, 23 nt, Artificial Sequence
  RNA Oligomer
auuucaguaacaaagcucagaga

SEQ ID NO: 38688 - RNA, 23 nt, Artificial Sequence
  RNA Oligomer
uccaugggcaaagaucaauaagg

SEQ ID NO: 38689 - RNA, 23 nt, Artificial Sequence
  RNA Oligomer
ccaugggcaaagaucaauaaggu

SEQ ID NO: 38690 - RNA, 23 nt, Artificial Sequence
  RNA Oligomer
caugggcaaagaucaauaaggua

SEQ ID NO: 38691 - RNA, 23 nt, Artificial Sequence
  RNA Oligomer
augggcaaagaucaauaagguac

SEQ ID NO: 38692 - RNA, 23 nt, Artificial Sequence
  RNA Oligomer
ugggcaaagaucaauaagguaca

SEQ ID NO: 38693 - RNA, 23 nt, Artificial Sequence
  RNA Oligomer
cucauuuccaaggugaugauguc

SEQ ID NO: 38694 - RNA, 23 nt, Artificial Sequence
  RNA Oligomer
cucucagacaucuuaacuaaugu

SEQ ID NO: 38695 - RNA, 23 nt, Artificial Sequence
  RNA Oligomer
ucucagacaucuuaacuaaugua

SEQ ID NO: 38696 - RNA, 23 nt, Artificial Sequence
  RNA Oligomer
cucagacaucuuaacuaauguaa

SEQ ID NO: 38697 - RNA, 23 nt, Artificial Sequence
  RNA Oligomer
cagacaucuuaacuaauguaaua

SEQ ID NO: 38698 - RNA, 23 nt, Artificial Sequence
  RNA Oligomer
aacugaacacaaauauggggaau

SEQ ID NO: 38699 - RNA, 23 nt, Artificial Sequence
  RNA Oligomer
aauuuauaugcccucuccccaua

SEQ ID NO: 38700 - RNA, 23 nt, Artificial Sequence
  RNA Oligomer
acaacuucacuugucaggcucuu

SEQ ID NO: 38701 - RNA, 23 nt, Artificial Sequence
  RNA Oligomer
caacuucacuugucaggcucuuc

SEQ ID NO: 38702 - RNA, 23 nt, Artificial Sequence
  RNA Oligomer
aacuucacuugucaggcucuuca

SEQ ID NO: 38703 - RNA, 23 nt, Artificial Sequence
  RNA Oligomer
ggcaaagggcuucacagaaaagg

SEQ ID NO: 38704 - RNA, 23 nt, Artificial Sequence
  RNA Oligomer
gcaaagggcuucacagaaaagga

SEQ ID NO: 38705 - RNA, 23 nt, Artificial Sequence
  RNA Oligomer
caaagggcuucacagaaaaggag

SEQ ID NO: 38706 - RNA, 23 nt, Artificial Sequence
  RNA Oligomer
aaagggcuucacagaaaaggagc

SEQ ID NO: 38707 - RNA, 23 nt, Artificial Sequence
  RNA Oligomer
aagggcuucacagaaaaggagcu

SEQ ID NO: 38708 - RNA, 23 nt, Artificial Sequence
  RNA Oligomer
ugcugcaguauucagacaucucc

SEQ ID NO: 38709 - RNA, 23 nt, Artificial Sequence
  RNA Oligomer
gcugcaguauucagacaucuccu

SEQ ID NO: 38710 - RNA, 23 nt, Artificial Sequence
  RNA Oligomer
cugcaguauucagacaucuccuu

SEQ ID NO: 38711 - RNA, 23 nt, Artificial Sequence
  RNA Oligomer
ugcaguauucagacaucuccuug

SEQ ID NO: 38712 - RNA, 23 nt, Artificial Sequence
  RNA Oligomer
gccgcauaucaugucugagcgcg

SEQ ID NO: 38713 - RNA, 23 nt, Artificial Sequence
  RNA Oligomer
ccgcauaucaugucugagcgcgu

SEQ ID NO: 38714 - RNA, 23 nt, Artificial Sequence
  RNA Oligomer
cgcauaucaugucugagcgcgug

SEQ ID NO: 38715 - RNA, 23 nt, Artificial Sequence
  RNA Oligomer
gcauaucaugucugagcgcgugg

SEQ ID NO: 38716 - RNA, 23 nt, Artificial Sequence
  RNA Oligomer
cauaucaugucugagcgcguggg

SEQ ID NO: 38717 - RNA, 23 nt, Artificial Sequence
  RNA Oligomer
cuugcauuuccugugcagucugg

SEQ ID NO: 38718 - RNA, 23 nt, Artificial Sequence
  RNA Oligomer
uugcauuuccugugcagucuggu

SEQ ID NO: 38719 - RNA, 23 nt, Artificial Sequence
  RNA Oligomer
ugcauuuccugugcagucugguc

SEQ ID NO: 38720 - RNA, 23 nt, Artificial Sequence
  RNA Oligomer
gcauuuccugugcagucugguca

SEQ ID NO: 38721 - RNA, 23 nt, Artificial Sequence
  RNA Oligomer
cauuuccugugcagucuggucac

SEQ ID NO: 38722 - RNA, 23 nt, Artificial Sequence
  RNA Oligomer
auuuccugugcagucuggucaca

SEQ ID NO: 38723 - RNA, 23 nt, Artificial Sequence
  RNA Oligomer
uuuccugugcagucuggucacau

SEQ ID NO: 38724 - RNA, 23 nt, Artificial Sequence
  RNA Oligomer
uuccugugcagucuggucacaua

SEQ ID NO: 38725 - RNA, 23 nt, Artificial Sequence
  RNA Oligomer
uuuuuagaguuuccugaugauga

SEQ ID NO: 38726 - RNA, 23 nt, Artificial Sequence
  RNA Oligomer
uuuuagaguuuccugaugaugag

SEQ ID NO: 38727 - RNA, 23 nt, Artificial Sequence
  RNA Oligomer
uuuagaguuuccugaugaugagg

SEQ ID NO: 38728 - RNA, 23 nt, Artificial Sequence
  RNA Oligomer
uuagaguuuccugaugaugagga

SEQ ID NO: 38729 - RNA, 23 nt, Artificial Sequence
  RNA Oligomer
uagaguuuccugaugaugaggau

SEQ ID NO: 38730 - RNA, 23 nt, Artificial Sequence
  RNA Oligomer
ggcaauacaaaauccuggcagug

SEQ ID NO: 38731 - RNA, 23 nt, Artificial Sequence
  RNA Oligomer
gcaauacaaaauccuggcagugg

SEQ ID NO: 38732 - RNA, 23 nt, Artificial Sequence
  RNA Oligomer
caauacaaaauccuggcaguggg

SEQ ID NO: 38733 - RNA, 23 nt, Artificial Sequence
  RNA Oligomer
aauacaaaauccuggcaguggga

SEQ ID NO: 38734 - RNA, 23 nt, Artificial Sequence
  RNA Oligomer
auacaaaauccuggcagugggag

SEQ ID NO: 38735 - RNA, 23 nt, Artificial Sequence
  RNA Oligomer
uacaaaauccuggcagugggagu

SEQ ID NO: 38736 - RNA, 23 nt, Artificial Sequence
  RNA Oligomer
caccuugacuacuacaggccuag

SEQ ID NO: 38737 - RNA, 23 nt, Artificial Sequence
  RNA Oligomer
accuugacuacuacaggccuagc

SEQ ID NO: 38738 - RNA, 23 nt, Artificial Sequence
  RNA Oligomer
ccuugacuacuacaggccuagca

SEQ ID NO: 38739 - RNA, 23 nt, Artificial Sequence
  RNA Oligomer
cuugacuacuacaggccuagcau

SEQ ID NO: 38740 - RNA, 23 nt, Artificial Sequence
  RNA Oligomer
uugacuacuacaggccuagcauu

SEQ ID NO: 38741 - RNA, 23 nt, Artificial Sequence
  RNA Oligomer
aaagcaaaacacauggaaaaaca

SEQ ID NO: 38742 - RNA, 23 nt, Artificial Sequence
  RNA Oligomer
aagcaaaacacauggaaaaacaa

SEQ ID NO: 38743 - RNA, 23 nt, Artificial Sequence
  RNA Oligomer
agcaaaacacauggaaaaacaaa

SEQ ID NO: 38744 - RNA, 23 nt, Artificial Sequence
  RNA Oligomer
caaaagguaggauuguagcuaag

SEQ ID NO: 38745 - RNA, 23 nt, Artificial Sequence
  RNA Oligomer
aaaagguaggauuguagcuaagg

SEQ ID NO: 38746 - RNA, 23 nt, Artificial Sequence
  RNA Oligomer
aaagguaggauuguagcuaaggu

SEQ ID NO: 38747 - RNA, 23 nt, Artificial Sequence
  RNA Oligomer
aagguaggauuguagcuaagguu

SEQ ID NO: 38748 - RNA, 23 nt, Artificial Sequence
  RNA Oligomer
aacauuuaaugaaggcccacuau

SEQ ID NO: 38749 - RNA, 23 nt, Artificial Sequence
  RNA Oligomer
ugaggaagaaggacaccaccuga

SEQ ID NO: 38750 - RNA, 23 nt, Artificial Sequence
  RNA Oligomer
gcuuagcaagaaaucaccauuua

SEQ ID NO: 38751 - RNA, 23 nt, Artificial Sequence
  RNA Oligomer
cuuagcaagaaaucaccauuuaa

SEQ ID NO: 38752 - RNA, 23 nt, Artificial Sequence
  RNA Oligomer
uuagcaagaaaucaccauuuaau

SEQ ID NO: 38753 - RNA, 23 nt, Artificial Sequence
  RNA Oligomer
uagcaagaaaucaccauuuaaug

SEQ ID NO: 38754 - RNA, 23 nt, Artificial Sequence
  RNA Oligomer
uaaagaacagggaaguugggaag

SEQ ID NO: 38755 - RNA, 23 nt, Artificial Sequence
  RNA Oligomer
gaacuacauuacaucuuugagca

SEQ ID NO: 38756 - RNA, 23 nt, Artificial Sequence
  RNA Oligomer
aacuacauuacaucuuugagcau

SEQ ID NO: 38757 - RNA, 23 nt, Artificial Sequence
  RNA Oligomer
acuacauuacaucuuugagcauu

SEQ ID NO: 38758 - RNA, 23 nt, Artificial Sequence
  RNA Oligomer
cuacauuacaucuuugagcauuu

SEQ ID NO: 38759 - RNA, 23 nt, Artificial Sequence
  RNA Oligomer
uacauuacaucuuugagcauuua

SEQ ID NO: 38760 - RNA, 23 nt, Artificial Sequence
  RNA Oligomer
ccuguaaagcaggauucuagaca

SEQ ID NO: 38761 - RNA, 23 nt, Artificial Sequence
  RNA Oligomer
cuguaaagcaggauucuagacag

SEQ ID NO: 38762 - RNA, 23 nt, Artificial Sequence
  RNA Oligomer
uguaaagcaggauucuagacaga

SEQ ID NO: 38763 - RNA, 23 nt, Artificial Sequence
  RNA Oligomer
guaaagcaggauucuagacagau

SEQ ID NO: 38764 - RNA, 23 nt, Artificial Sequence
  RNA Oligomer
uaaagcaggauucuagacagauu

SEQ ID NO: 38765 - RNA, 23 nt, Artificial Sequence
  RNA Oligomer
aaagcaggauucuagacagauuu

SEQ ID NO: 38766 - RNA, 23 nt, Artificial Sequence
  RNA Oligomer
ggaugaaaugaagguaaagaagg

SEQ ID NO: 38767 - RNA, 23 nt, Artificial Sequence
  RNA Oligomer
acagagaggugguuacagagucu

SEQ ID NO: 38768 - RNA, 23 nt, Artificial Sequence
  RNA Oligomer
cagagaggugguuacagagucua

SEQ ID NO: 38769 - RNA, 23 nt, Artificial Sequence
  RNA Oligomer
agagaggugguuacagagucuag

SEQ ID NO: 38770 - RNA, 23 nt, Artificial Sequence
  RNA Oligomer
gagaggugguuacagagucuagg

SEQ ID NO: 38771 - RNA, 23 nt, Artificial Sequence
  RNA Oligomer
agggaaacacaccauucuuccug

SEQ ID NO: 38772 - RNA, 23 nt, Artificial Sequence
  RNA Oligomer
gggaaacacaccauucuuccugg

SEQ ID NO: 38773 - RNA, 23 nt, Artificial Sequence
  RNA Oligomer
ggaaacacaccauucuuccuggc

SEQ ID NO: 38774 - RNA, 23 nt, Artificial Sequence
  RNA Oligomer
gaaacacaccauucuuccuggcc

SEQ ID NO: 38775 - RNA, 23 nt, Artificial Sequence
  RNA Oligomer
aaacacaccauucuuccuggccu

SEQ ID NO: 38776 - RNA, 23 nt, Artificial Sequence
  RNA Oligomer
gggcaaagaucaauaagguacaa

SEQ ID NO: 38777 - RNA, 23 nt, Artificial Sequence
  RNA Oligomer
ggcaaagaucaauaagguacaaa

SEQ ID NO: 38778 - RNA, 23 nt, Artificial Sequence
  RNA Oligomer
gcaaagaucaauaagguacaaau

SEQ ID NO: 38779 - RNA, 23 nt, Artificial Sequence
  RNA Oligomer
cuacaaaagcuggaacugaacac

SEQ ID NO: 38780 - RNA, 23 nt, Artificial Sequence
  RNA Oligomer
uacaaaagcuggaacugaacaca

SEQ ID NO: 38781 - RNA, 23 nt, Artificial Sequence
  RNA Oligomer
acaaaagcuggaacugaacacaa

SEQ ID NO: 38782 - RNA, 23 nt, Artificial Sequence
  RNA Oligomer
caaaagcuggaacugaacacaaa

SEQ ID NO: 38783 - RNA, 23 nt, Artificial Sequence
  RNA Oligomer
aaaagcuggaacugaacacaaau

SEQ ID NO: 38784 - RNA, 23 nt, Artificial Sequence
  RNA Oligomer
caacugcagcugaaacauuccug

SEQ ID NO: 38785 - RNA, 23 nt, Artificial Sequence
  RNA Oligomer
aacugcagcugaaacauuccugg

SEQ ID NO: 38786 - RNA, 23 nt, Artificial Sequence
  RNA Oligomer
acugcagcugaaacauuccuggc

SEQ ID NO: 38787 - RNA, 23 nt, Artificial Sequence
  RNA Oligomer
cugcagcugaaacauuccuggca

SEQ ID NO: 38788 - RNA, 23 nt, Artificial Sequence
  RNA Oligomer
ugcagcugaaacauuccuggcaa

SEQ ID NO: 38789 - RNA, 23 nt, Artificial Sequence
  RNA Oligomer
gcagcugaaacauuccuggcaau

SEQ ID NO: 38790 - RNA, 23 nt, Artificial Sequence
  RNA Oligomer
cugggagauucccacaucccuga

SEQ ID NO: 38791 - RNA, 23 nt, Artificial Sequence
  RNA Oligomer
ugggagauucccacaucccugag

SEQ ID NO: 38792 - RNA, 23 nt, Artificial Sequence
  RNA Oligomer
gggagauucccacaucccugagg

SEQ ID NO: 38793 - RNA, 23 nt, Artificial Sequence
  RNA Oligomer
ggagauucccacaucccugaggg

SEQ ID NO: 38794 - RNA, 23 nt, Artificial Sequence
  RNA Oligomer
gagauucccacaucccugagggg

SEQ ID NO: 38795 - RNA, 23 nt, Artificial Sequence
  RNA Oligomer
aucaaaggcucuaucacaccucc

SEQ ID NO: 38796 - RNA, 23 nt, Artificial Sequence
  RNA Oligomer
ucaaaggcucuaucacaccuccu

SEQ ID NO: 38797 - RNA, 23 nt, Artificial Sequence
  RNA Oligomer
caaaggcucuaucacaccuccug

SEQ ID NO: 38798 - RNA, 23 nt, Artificial Sequence
  RNA Oligomer
aaaggcucuaucacaccuccugu

SEQ ID NO: 38799 - RNA, 23 nt, Artificial Sequence
  RNA Oligomer
aaggcucuaucacaccuccugug

SEQ ID NO: 38800 - RNA, 23 nt, Artificial Sequence
  RNA Oligomer
auucagacaucuccuugcaccgg

SEQ ID NO: 38801 - RNA, 23 nt, Artificial Sequence
  RNA Oligomer
caggagcauaaccuucccgaucc

SEQ ID NO: 38802 - RNA, 23 nt, Artificial Sequence
  RNA Oligomer
aggagcauaaccuucccgauccu

SEQ ID NO: 38803 - RNA, 23 nt, Artificial Sequence
  RNA Oligomer
ggagcauaaccuucccgauccuu

SEQ ID NO: 38804 - RNA, 23 nt, Artificial Sequence
  RNA Oligomer
gagcauaaccuucccgauccuug

SEQ ID NO: 38805 - RNA, 23 nt, Artificial Sequence
  RNA Oligomer
agcauaaccuucccgauccuuga

SEQ ID NO: 38806 - RNA, 23 nt, Artificial Sequence
  RNA Oligomer
cccgauccuugauaagugcguuc

SEQ ID NO: 38807 - RNA, 23 nt, Artificial Sequence
  RNA Oligomer
ccgauccuugauaagugcguuca

SEQ ID NO: 38808 - RNA, 23 nt, Artificial Sequence
  RNA Oligomer
cgauccuugauaagugcguucac

SEQ ID NO: 38809 - RNA, 23 nt, Artificial Sequence
  RNA Oligomer
gauccuugauaagugcguucacc

SEQ ID NO: 38810 - RNA, 23 nt, Artificial Sequence
  RNA Oligomer
auccuugauaagugcguucaccu

SEQ ID NO: 38811 - RNA, 23 nt, Artificial Sequence
  RNA Oligomer
cgugcauaucacaagcccgcuca

SEQ ID NO: 38812 - RNA, 23 nt, Artificial Sequence
  RNA Oligomer
gugcauaucacaagcccgcucag

SEQ ID NO: 38813 - RNA, 23 nt, Artificial Sequence
  RNA Oligomer
ugcauaucacaagcccgcucaga

SEQ ID NO: 38814 - RNA, 23 nt, Artificial Sequence
  RNA Oligomer
gcauaucacaagcccgcucagaa

SEQ ID NO: 38815 - RNA, 23 nt, Artificial Sequence
  RNA Oligomer
cauaucacaagcccgcucagaaa

SEQ ID NO: 38816 - RNA, 23 nt, Artificial Sequence
  RNA Oligomer
ucggcaacuuuucuuuaccggca

SEQ ID NO: 38817 - RNA, 23 nt, Artificial Sequence
  RNA Oligomer
cggcaacuuuucuuuaccggcau

SEQ ID NO: 38818 - RNA, 23 nt, Artificial Sequence
  RNA Oligomer
ggcaacuuuucuuuaccggcauc

SEQ ID NO: 38819 - RNA, 23 nt, Artificial Sequence
  RNA Oligomer
gcaacuuuucuuuaccggcauca

SEQ ID NO: 38820 - RNA, 23 nt, Artificial Sequence
  RNA Oligomer
caacuuuucuuuaccggcaucac

SEQ ID NO: 38821 - RNA, 23 nt, Artificial Sequence
  RNA Oligomer
aacuuuucuuuaccggcaucacu

SEQ ID NO: 38822 - RNA, 23 nt, Artificial Sequence
  RNA Oligomer
acuuuucuuuaccggcaucacuc

SEQ ID NO: 38823 - RNA, 23 nt, Artificial Sequence
  RNA Oligomer
cuuuucuuuaccggcaucacucu

SEQ ID NO: 38824 - RNA, 23 nt, Artificial Sequence
  RNA Oligomer
ccuggaugaagaacauuuuuggu

SEQ ID NO: 38825 - RNA, 23 nt, Artificial Sequence
  RNA Oligomer
cuggaugaagaacauuuuugguu

SEQ ID NO: 38826 - RNA, 23 nt, Artificial Sequence
  RNA Oligomer
uggaugaagaacauuuuugguuu

SEQ ID NO: 38827 - RNA, 23 nt, Artificial Sequence
  RNA Oligomer
ggaugaagaacauuuuugguuug

SEQ ID NO: 38828 - RNA, 23 nt, Artificial Sequence
  RNA Oligomer
gaugaagaacauuuuugguuugu

SEQ ID NO: 38829 - RNA, 23 nt, Artificial Sequence
  RNA Oligomer
cgguucuuuuuuagaguuuccug

SEQ ID NO: 38830 - RNA, 23 nt, Artificial Sequence
  RNA Oligomer
gguucuuuuuuagaguuuccuga

SEQ ID NO: 38831 - RNA, 23 nt, Artificial Sequence
  RNA Oligomer
guucuuuuuuagaguuuccugau

SEQ ID NO: 38832 - RNA, 23 nt, Artificial Sequence
  RNA Oligomer
uucuuuuuuagaguuuccugaug

SEQ ID NO: 38833 - RNA, 23 nt, Artificial Sequence
  RNA Oligomer
ucuuuuuuagaguuuccugauga

SEQ ID NO: 38834 - RNA, 23 nt, Artificial Sequence
  RNA Oligomer
agaguuuccugaugaugaggaug

SEQ ID NO: 38835 - RNA, 23 nt, Artificial Sequence
  RNA Oligomer
uagcauuuugcuagggaccaugg

SEQ ID NO: 38836 - RNA, 23 nt, Artificial Sequence
  RNA Oligomer
agcauuuugcuagggaccauggg

SEQ ID NO: 38837 - RNA, 23 nt, Artificial Sequence
  RNA Oligomer
gcauuuugcuagggaccauggga

SEQ ID NO: 38838 - RNA, 23 nt, Artificial Sequence
  RNA Oligomer
cauuuugcuagggaccaugggag

SEQ ID NO: 38839 - RNA, 23 nt, Artificial Sequence
  RNA Oligomer
auuuugcuagggaccaugggaga

SEQ ID NO: 38840 - RNA, 23 nt, Artificial Sequence
  RNA Oligomer
caaaguacaaauaauaauccgug

SEQ ID NO: 38841 - RNA, 23 nt, Artificial Sequence
  RNA Oligomer
aaaguacaaauaauaauccgugu

SEQ ID NO: 38842 - RNA, 23 nt, Artificial Sequence
  RNA Oligomer
aaguacaaauaauaauccgugua

SEQ ID NO: 38843 - RNA, 23 nt, Artificial Sequence
  RNA Oligomer
aguacaaauaauaauccguguau

SEQ ID NO: 38844 - RNA, 23 nt, Artificial Sequence
  RNA Oligomer
guacaaauaauaauccguguaua

SEQ ID NO: 38845 - RNA, 23 nt, Artificial Sequence
  RNA Oligomer
uuuuaucaaaagguaggauugua

SEQ ID NO: 38846 - RNA, 23 nt, Artificial Sequence
  RNA Oligomer
gccaagcacuugguacaugaugg

SEQ ID NO: 38847 - RNA, 23 nt, Artificial Sequence
  RNA Oligomer
ccaagcacuugguacaugauggu

SEQ ID NO: 38848 - RNA, 23 nt, Artificial Sequence
  RNA Oligomer
caagcacuugguacaugauggug

SEQ ID NO: 38849 - RNA, 23 nt, Artificial Sequence
  RNA Oligomer
aagcacuugguacaugaugguga

SEQ ID NO: 38850 - RNA, 23 nt, Artificial Sequence
  RNA Oligomer
agcacuugguacaugauggugaa

SEQ ID NO: 38851 - RNA, 23 nt, Artificial Sequence
  RNA Oligomer
uugucaagacuugaggaagaagg

SEQ ID NO: 38852 - RNA, 23 nt, Artificial Sequence
  RNA Oligomer
ugucaagacuugaggaagaagga

SEQ ID NO: 38853 - RNA, 23 nt, Artificial Sequence
  RNA Oligomer
gucaagacuugaggaagaaggac

SEQ ID NO: 38854 - RNA, 23 nt, Artificial Sequence
  RNA Oligomer
ucaagacuugaggaagaaggaca

SEQ ID NO: 38855 - RNA, 23 nt, Artificial Sequence
  RNA Oligomer
caagacuugaggaagaaggacac

SEQ ID NO: 38856 - RNA, 23 nt, Artificial Sequence
  RNA Oligomer
aggaaagagcacaaaauuagaag

SEQ ID NO: 38857 - RNA, 23 nt, Artificial Sequence
  RNA Oligomer
ggaaagagcacaaaauuagaagc

SEQ ID NO: 38858 - RNA, 23 nt, Artificial Sequence
  RNA Oligomer
gaaagagcacaaaauuagaagcu

SEQ ID NO: 38859 - RNA, 23 nt, Artificial Sequence
  RNA Oligomer
aaagagcacaaaauuagaagcug

SEQ ID NO: 38860 - RNA, 23 nt, Artificial Sequence
  RNA Oligomer
aagagcacaaaauuagaagcuga

SEQ ID NO: 38861 - RNA, 23 nt, Artificial Sequence
  RNA Oligomer
gcuggagcuuagcaagaaaucac

SEQ ID NO: 38862 - RNA, 23 nt, Artificial Sequence
  RNA Oligomer
caagaaccaguucucauaaacca

SEQ ID NO: 38863 - RNA, 23 nt, Artificial Sequence
  RNA Oligomer
aagaaccaguucucauaaaccaa

SEQ ID NO: 38864 - RNA, 23 nt, Artificial Sequence
  RNA Oligomer
agaaccaguucucauaaaccaag

SEQ ID NO: 38865 - RNA, 23 nt, Artificial Sequence
  RNA Oligomer
gaaccaguucucauaaaccaagg

SEQ ID NO: 38866 - RNA, 23 nt, Artificial Sequence
  RNA Oligomer
aaccaguucucauaaaccaaggu

SEQ ID NO: 38867 - RNA, 23 nt, Artificial Sequence
  RNA Oligomer
uugaaaacaauaacauguauggc

SEQ ID NO: 38868 - RNA, 23 nt, Artificial Sequence
  RNA Oligomer
ugaaaacaauaacauguauggca

SEQ ID NO: 38869 - RNA, 23 nt, Artificial Sequence
  RNA Oligomer
gaaaacaauaacauguauggcac

SEQ ID NO: 38870 - RNA, 23 nt, Artificial Sequence
  RNA Oligomer
aaaacaauaacauguauggcacu

SEQ ID NO: 38871 - RNA, 23 nt, Artificial Sequence
  RNA Oligomer
aaacaauaacauguauggcacug

SEQ ID NO: 38872 - RNA, 23 nt, Artificial Sequence
  RNA Oligomer
acauuacaucuuugagcauuuac

SEQ ID NO: 38873 - RNA, 23 nt, Artificial Sequence
  RNA Oligomer
cauuacaucuuugagcauuuaca

SEQ ID NO: 38874 - RNA, 23 nt, Artificial Sequence
  RNA Oligomer
auuacaucuuugagcauuuacau

SEQ ID NO: 38875 - RNA, 23 nt, Artificial Sequence
  RNA Oligomer
uuacaucuuugagcauuuacaug

SEQ ID NO: 38876 - RNA, 23 nt, Artificial Sequence
  RNA Oligomer
ugagcauuuacaugauccuguaa

SEQ ID NO: 38877 - RNA, 23 nt, Artificial Sequence
  RNA Oligomer
gagcauuuacaugauccuguaaa

SEQ ID NO: 38878 - RNA, 23 nt, Artificial Sequence
  RNA Oligomer
agcauuuacaugauccuguaaag

SEQ ID NO: 38879 - RNA, 23 nt, Artificial Sequence
  RNA Oligomer
gauggacguuucucaggaaggaa

SEQ ID NO: 38880 - RNA, 23 nt, Artificial Sequence
  RNA Oligomer
auggacguuucucaggaaggaaa

SEQ ID NO: 38881 - RNA, 23 nt, Artificial Sequence
  RNA Oligomer
caaagaucaauaagguacaaaug

SEQ ID NO: 38882 - RNA, 23 nt, Artificial Sequence
  RNA Oligomer
ggugcgucucuagucauguuugc

SEQ ID NO: 38883 - RNA, 23 nt, Artificial Sequence
  RNA Oligomer
gugcgucucuagucauguuugcu

SEQ ID NO: 38884 - RNA, 23 nt, Artificial Sequence
  RNA Oligomer
ugcgucucuagucauguuugcuu

SEQ ID NO: 38885 - RNA, 23 nt, Artificial Sequence
  RNA Oligomer
agucauguuugcuucuucagagc

SEQ ID NO: 38886 - RNA, 23 nt, Artificial Sequence
  RNA Oligomer
ccucauuuccaaggugaugaugu

SEQ ID NO: 38887 - RNA, 23 nt, Artificial Sequence
  RNA Oligomer
cuucagagccaaaagauaauguc

SEQ ID NO: 38888 - RNA, 23 nt, Artificial Sequence
  RNA Oligomer
uucagagccaaaagauaaugucu

SEQ ID NO: 38889 - RNA, 23 nt, Artificial Sequence
  RNA Oligomer
ucagagccaaaagauaaugucua

SEQ ID NO: 38890 - RNA, 23 nt, Artificial Sequence
  RNA Oligomer
cagagccaaaagauaaugucuac

SEQ ID NO: 38891 - RNA, 23 nt, Artificial Sequence
  RNA Oligomer
agagccaaaagauaaugucuaca

SEQ ID NO: 38892 - RNA, 23 nt, Artificial Sequence
  RNA Oligomer
ggucucucagacaucuuaacuaa

SEQ ID NO: 38893 - RNA, 23 nt, Artificial Sequence
  RNA Oligomer
gucucucagacaucuuaacuaau

SEQ ID NO: 38894 - RNA, 23 nt, Artificial Sequence
  RNA Oligomer
ucucucagacaucuuaacuaaug

SEQ ID NO: 38895 - RNA, 23 nt, Artificial Sequence
  RNA Oligomer
cacuaaagugccaucuacaaaag

SEQ ID NO: 38896 - RNA, 23 nt, Artificial Sequence
  RNA Oligomer
acuaaagugccaucuacaaaagc

SEQ ID NO: 38897 - RNA, 23 nt, Artificial Sequence
  RNA Oligomer
cuaaagugccaucuacaaaagcu

SEQ ID NO: 38898 - RNA, 23 nt, Artificial Sequence
  RNA Oligomer
uaaagugccaucuacaaaagcug

SEQ ID NO: 38899 - RNA, 23 nt, Artificial Sequence
  RNA Oligomer
aaagugccaucuacaaaagcugg

SEQ ID NO: 38900 - RNA, 23 nt, Artificial Sequence
  RNA Oligomer
aaccacacuguguuuacaacuuc

SEQ ID NO: 38901 - RNA, 23 nt, Artificial Sequence
  RNA Oligomer
accacacuguguuuacaacuuca

SEQ ID NO: 38902 - RNA, 23 nt, Artificial Sequence
  RNA Oligomer
ccacacuguguuuacaacuucac

SEQ ID NO: 38903 - RNA, 23 nt, Artificial Sequence
  RNA Oligomer
cacacuguguuuacaacuucacu

SEQ ID NO: 38904 - RNA, 23 nt, Artificial Sequence
  RNA Oligomer
acacuguguuuacaacuucacuu

SEQ ID NO: 38905 - RNA, 23 nt, Artificial Sequence
  RNA Oligomer
cacuguguuuacaacuucacuug

SEQ ID NO: 38906 - RNA, 23 nt, Artificial Sequence
  RNA Oligomer
acuguguuuacaacuucacuugu

SEQ ID NO: 38907 - RNA, 23 nt, Artificial Sequence
  RNA Oligomer
gcauaaccuucccgauccuugau

SEQ ID NO: 38908 - RNA, 23 nt, Artificial Sequence
  RNA Oligomer
cauaaccuucccgauccuugaua

SEQ ID NO: 38909 - RNA, 23 nt, Artificial Sequence
  RNA Oligomer
auaaccuucccgauccuugauaa

SEQ ID NO: 38910 - RNA, 23 nt, Artificial Sequence
  RNA Oligomer
caggcauagccgcauaucauguc

SEQ ID NO: 38911 - RNA, 23 nt, Artificial Sequence
  RNA Oligomer
uagccgcauaucaugucugagcg

SEQ ID NO: 38912 - RNA, 23 nt, Artificial Sequence
  RNA Oligomer
aacauuuuugguuuguucuguag

SEQ ID NO: 38913 - RNA, 23 nt, Artificial Sequence
  RNA Oligomer
gugacuagaguacugugguccac

SEQ ID NO: 38914 - RNA, 23 nt, Artificial Sequence
  RNA Oligomer
ugacuagaguacugugguccaca

SEQ ID NO: 38915 - RNA, 23 nt, Artificial Sequence
  RNA Oligomer
gacuagaguacugugguccacau

SEQ ID NO: 38916 - RNA, 23 nt, Artificial Sequence
  RNA Oligomer
acuagaguacugugguccacauc

SEQ ID NO: 38917 - RNA, 23 nt, Artificial Sequence
  RNA Oligomer
cuagaguacugugguccacaucc

SEQ ID NO: 38918 - RNA, 23 nt, Artificial Sequence
  RNA Oligomer
ucucucucaaauacuuccauacu

SEQ ID NO: 38919 - RNA, 23 nt, Artificial Sequence
  RNA Oligomer
uuccugaugaugaggaugcaugc

SEQ ID NO: 38920 - RNA, 23 nt, Artificial Sequence
  RNA Oligomer
uccugaugaugaggaugcaugcc

SEQ ID NO: 38921 - RNA, 23 nt, Artificial Sequence
  RNA Oligomer
ccugaugaugaggaugcaugcca

SEQ ID NO: 38922 - RNA, 23 nt, Artificial Sequence
  RNA Oligomer
cugaugaugaggaugcaugccac

SEQ ID NO: 38923 - RNA, 23 nt, Artificial Sequence
  RNA Oligomer
ugaugaugaggaugcaugccaca

SEQ ID NO: 38924 - RNA, 23 nt, Artificial Sequence
  RNA Oligomer
guuaucucacacaugauaugucu

SEQ ID NO: 38925 - RNA, 23 nt, Artificial Sequence
  RNA Oligomer
uuaucucacacaugauaugucuu

SEQ ID NO: 38926 - RNA, 23 nt, Artificial Sequence
  RNA Oligomer
uaucucacacaugauaugucuuc

SEQ ID NO: 38927 - RNA, 23 nt, Artificial Sequence
  RNA Oligomer
aucucacacaugauaugucuuca

SEQ ID NO: 38928 - RNA, 23 nt, Artificial Sequence
  RNA Oligomer
ucucacacaugauaugucuucaa

SEQ ID NO: 38929 - RNA, 23 nt, Artificial Sequence
  RNA Oligomer
cucacacaugauaugucuucaag

SEQ ID NO: 38930 - RNA, 23 nt, Artificial Sequence
  RNA Oligomer
ucacacaugauaugucuucaagg

SEQ ID NO: 38931 - RNA, 23 nt, Artificial Sequence
  RNA Oligomer
aauccguguauauugucaaaagg

SEQ ID NO: 38932 - RNA, 23 nt, Artificial Sequence
  RNA Oligomer
gcacuugguacaugauggugaau

SEQ ID NO: 38933 - RNA, 23 nt, Artificial Sequence
  RNA Oligomer
cacuugguacaugauggugaaua

SEQ ID NO: 38934 - RNA, 23 nt, Artificial Sequence
  RNA Oligomer
acuugguacaugauggugaauaa

SEQ ID NO: 38935 - RNA, 23 nt, Artificial Sequence
  RNA Oligomer
aagguuucugcccucauuuacag

SEQ ID NO: 38936 - RNA, 23 nt, Artificial Sequence
  RNA Oligomer
agguuucugcccucauuuacagc

SEQ ID NO: 38937 - RNA, 23 nt, Artificial Sequence
  RNA Oligomer
gguuucugcccucauuuacagcc

SEQ ID NO: 38938 - RNA, 23 nt, Artificial Sequence
  RNA Oligomer
guuucugcccucauuuacagccu

SEQ ID NO: 38939 - RNA, 23 nt, Artificial Sequence
  RNA Oligomer
uuucugcccucauuuacagccug

SEQ ID NO: 38940 - RNA, 23 nt, Artificial Sequence
  RNA Oligomer
uucugcccucauuuacagccugg

SEQ ID NO: 38941 - RNA, 23 nt, Artificial Sequence
  RNA Oligomer
ucugcccucauuuacagccuggu

SEQ ID NO: 38942 - RNA, 23 nt, Artificial Sequence
  RNA Oligomer
ugcccucauuuacagccugguag

SEQ ID NO: 38943 - RNA, 23 nt, Artificial Sequence
  RNA Oligomer
gcccucauuuacagccugguagg

SEQ ID NO: 38944 - RNA, 23 nt, Artificial Sequence
  RNA Oligomer
cccucauuuacagccugguaggg

SEQ ID NO: 38945 - RNA, 23 nt, Artificial Sequence
  RNA Oligomer
ccucauuuacagccugguagggg

SEQ ID NO: 38946 - RNA, 23 nt, Artificial Sequence
  RNA Oligomer
cucauuuacagccugguagggga

SEQ ID NO: 38947 - RNA, 23 nt, Artificial Sequence
  RNA Oligomer
gggaaaagacaagauguggugac

SEQ ID NO: 38948 - RNA, 23 nt, Artificial Sequence
  RNA Oligomer
ggaaaagacaagauguggugaca

SEQ ID NO: 38949 - RNA, 23 nt, Artificial Sequence
  RNA Oligomer
gaaaagacaagauguggugacag

SEQ ID NO: 38950 - RNA, 23 nt, Artificial Sequence
  RNA Oligomer
aaaagacaagauguggugacaga

SEQ ID NO: 38951 - RNA, 23 nt, Artificial Sequence
  RNA Oligomer
aaagacaagauguggugacagac

SEQ ID NO: 38952 - RNA, 23 nt, Artificial Sequence
  RNA Oligomer
agcacaaaauuagaagcugagag

SEQ ID NO: 38953 - RNA, 23 nt, Artificial Sequence
  RNA Oligomer
auaaaccaaggugaagaguuuac

SEQ ID NO: 38954 - RNA, 23 nt, Artificial Sequence
  RNA Oligomer
uaaaccaaggugaagaguuuaca

SEQ ID NO: 38955 - RNA, 23 nt, Artificial Sequence
  RNA Oligomer
aaaccaaggugaagaguuuacau

SEQ ID NO: 38956 - RNA, 23 nt, Artificial Sequence
  RNA Oligomer
aaccaaggugaagaguuuacauu

SEQ ID NO: 38957 - RNA, 23 nt, Artificial Sequence
  RNA Oligomer
accaaggugaagaguuuacauuu

SEQ ID NO: 38958 - RNA, 23 nt, Artificial Sequence
  RNA Oligomer
gagggguaauagaaagcagaagg

SEQ ID NO: 38959 - RNA, 23 nt, Artificial Sequence
  RNA Oligomer
uagaaagcagaaggguucuaagc

SEQ ID NO: 38960 - RNA, 23 nt, Artificial Sequence
  RNA Oligomer
agaaagcagaaggguucuaagca

SEQ ID NO: 38961 - RNA, 23 nt, Artificial Sequence
  RNA Oligomer
gaaagcagaaggguucuaagcag

SEQ ID NO: 38962 - RNA, 23 nt, Artificial Sequence
  RNA Oligomer
aaagcagaaggguucuaagcagg

SEQ ID NO: 38963 - RNA, 23 nt, Artificial Sequence
  RNA Oligomer
aagcagaaggguucuaagcaggg

SEQ ID NO: 38964 - RNA, 23 nt, Artificial Sequence
  RNA Oligomer
aaagaacagggaaguugggaagu

SEQ ID NO: 38965 - RNA, 23 nt, Artificial Sequence
  RNA Oligomer
aggcagcaaguugaggaguucca

SEQ ID NO: 38966 - RNA, 23 nt, Artificial Sequence
  RNA Oligomer
ggcagcaaguugaggaguuccac

SEQ ID NO: 38967 - RNA, 23 nt, Artificial Sequence
  RNA Oligomer
gcagcaaguugaggaguuccaca

SEQ ID NO: 38968 - RNA, 23 nt, Artificial Sequence
  RNA Oligomer
cagcaaguugaggaguuccacau

SEQ ID NO: 38969 - RNA, 23 nt, Artificial Sequence
  RNA Oligomer
agaacuacauuacaucuuugagc

SEQ ID NO: 38970 - RNA, 23 nt, Artificial Sequence
  RNA Oligomer
agcaggauucuagacagauuugg

SEQ ID NO: 38971 - RNA, 23 nt, Artificial Sequence
  RNA Oligomer
gcaggauucuagacagauuuggu

SEQ ID NO: 38972 - RNA, 23 nt, Artificial Sequence
  RNA Oligomer
caggauucuagacagauuuggug

SEQ ID NO: 38973 - RNA, 23 nt, Artificial Sequence
  RNA Oligomer
aggauucuagacagauuuggugg

SEQ ID NO: 38974 - RNA, 23 nt, Artificial Sequence
  RNA Oligomer
ggauucuagacagauuugguggc

SEQ ID NO: 38975 - RNA, 23 nt, Artificial Sequence
  RNA Oligomer
aagugggaauaguaagggagaga

SEQ ID NO: 38976 - RNA, 23 nt, Artificial Sequence
  RNA Oligomer
gacagagaggugguuacagaguc

SEQ ID NO: 38977 - RNA, 23 nt, Artificial Sequence
  RNA Oligomer
ucaguaacaaagcucagagaaac

SEQ ID NO: 38978 - RNA, 23 nt, Artificial Sequence
  RNA Oligomer
caguaacaaagcucagagaaaca

SEQ ID NO: 38979 - RNA, 23 nt, Artificial Sequence
  RNA Oligomer
aguaacaaagcucagagaaacaa

SEQ ID NO: 38980 - RNA, 23 nt, Artificial Sequence
  RNA Oligomer
guaacaaagcucagagaaacaac

SEQ ID NO: 38981 - RNA, 23 nt, Artificial Sequence
  RNA Oligomer
uaacaaagcucagagaaacaacc

SEQ ID NO: 38982 - RNA, 23 nt, Artificial Sequence
  RNA Oligomer
caacgaaagaucuuugagacuuc

SEQ ID NO: 38983 - RNA, 23 nt, Artificial Sequence
  RNA Oligomer
gucauguuugcuucuucagagcc

SEQ ID NO: 38984 - RNA, 23 nt, Artificial Sequence
  RNA Oligomer
ucauguuugcuucuucagagcca

SEQ ID NO: 38985 - RNA, 23 nt, Artificial Sequence
  RNA Oligomer
cauguuugcuucuucagagccaa

SEQ ID NO: 38986 - RNA, 23 nt, Artificial Sequence
  RNA Oligomer
ucuucagagccaaaagauaaugu

SEQ ID NO: 38987 - RNA, 23 nt, Artificial Sequence
  RNA Oligomer
ccccauaaccacacuguguuuac

SEQ ID NO: 38988 - RNA, 23 nt, Artificial Sequence
  RNA Oligomer
cccauaaccacacuguguuuaca

SEQ ID NO: 38989 - RNA, 23 nt, Artificial Sequence
  RNA Oligomer
ccauaaccacacuguguuuacaa

SEQ ID NO: 38990 - RNA, 23 nt, Artificial Sequence
  RNA Oligomer
cauaaccacacuguguuuacaac

SEQ ID NO: 38991 - RNA, 23 nt, Artificial Sequence
  RNA Oligomer
auaaccacacuguguuuacaacu

SEQ ID NO: 38992 - RNA, 23 nt, Artificial Sequence
  RNA Oligomer
ucaacugcagcugaaacauuccu

SEQ ID NO: 38993 - RNA, 23 nt, Artificial Sequence
  RNA Oligomer
acagaaaccgugcauccugaaga

SEQ ID NO: 38994 - RNA, 23 nt, Artificial Sequence
  RNA Oligomer
cagaaaccgugcauccugaagau

SEQ ID NO: 38995 - RNA, 23 nt, Artificial Sequence
  RNA Oligomer
agaaaccgugcauccugaagauc

SEQ ID NO: 38996 - RNA, 23 nt, Artificial Sequence
  RNA Oligomer
gaaaccgugcauccugaagauca

SEQ ID NO: 38997 - RNA, 23 nt, Artificial Sequence
  RNA Oligomer
aaaccgugcauccugaagaucaa

SEQ ID NO: 38998 - RNA, 23 nt, Artificial Sequence
  RNA Oligomer
gaagaucaaaggcucuaucacac

SEQ ID NO: 38999 - RNA, 23 nt, Artificial Sequence
  RNA Oligomer
aagaucaaaggcucuaucacacc

SEQ ID NO: 39000 - RNA, 23 nt, Artificial Sequence
  RNA Oligomer
agaucaaaggcucuaucacaccu

SEQ ID NO: 39001 - RNA, 23 nt, Artificial Sequence
  RNA Oligomer
gaucaaaggcucuaucacaccuc

SEQ ID NO: 39002 - RNA, 23 nt, Artificial Sequence
  RNA Oligomer
agugcugcaguauucagacaucu

SEQ ID NO: 39003 - RNA, 23 nt, Artificial Sequence
  RNA Oligomer
gugcugcaguauucagacaucuc

SEQ ID NO: 39004 - RNA, 23 nt, Artificial Sequence
  RNA Oligomer
ucuaacaauucgcucaacaacag

SEQ ID NO: 39005 - RNA, 23 nt, Artificial Sequence
  RNA Oligomer
cuaacaauucgcucaacaacagc

SEQ ID NO: 39006 - RNA, 23 nt, Artificial Sequence
  RNA Oligomer
uaacaauucgcucaacaacagcu

SEQ ID NO: 39007 - RNA, 23 nt, Artificial Sequence
  RNA Oligomer
aacaauucgcucaacaacagcug

SEQ ID NO: 39008 - RNA, 23 nt, Artificial Sequence
  RNA Oligomer
acaauucgcucaacaacagcugu

SEQ ID NO: 39009 - RNA, 23 nt, Artificial Sequence
  RNA Oligomer
ucucaucuucggcaacuuuucuu

SEQ ID NO: 39010 - RNA, 23 nt, Artificial Sequence
  RNA Oligomer
cucaucuucggcaacuuuucuuu

SEQ ID NO: 39011 - RNA, 23 nt, Artificial Sequence
  RNA Oligomer
ucaucuucggcaacuuuucuuua

SEQ ID NO: 39012 - RNA, 23 nt, Artificial Sequence
  RNA Oligomer
caucuucggcaacuuuucuuuac

SEQ ID NO: 39013 - RNA, 23 nt, Artificial Sequence
  RNA Oligomer
aucuucggcaacuuuucuuuacc

SEQ ID NO: 39014 - RNA, 23 nt, Artificial Sequence
  RNA Oligomer
uuuucuuuaccggcaucacucuc

SEQ ID NO: 39015 - RNA, 23 nt, Artificial Sequence
  RNA Oligomer
accccacgaucagucucaucucc

SEQ ID NO: 39016 - RNA, 23 nt, Artificial Sequence
  RNA Oligomer
ccccacgaucagucucaucucca

SEQ ID NO: 39017 - RNA, 23 nt, Artificial Sequence
  RNA Oligomer
cccacgaucagucucaucuccac

SEQ ID NO: 39018 - RNA, 23 nt, Artificial Sequence
  RNA Oligomer
ccacgaucagucucaucuccacg

SEQ ID NO: 39019 - RNA, 23 nt, Artificial Sequence
  RNA Oligomer
ggucacauagaacauggacguca

SEQ ID NO: 39020 - RNA, 23 nt, Artificial Sequence
  RNA Oligomer
gucacauagaacauggacgucau

SEQ ID NO: 39021 - RNA, 23 nt, Artificial Sequence
  RNA Oligomer
ucacauagaacauggacgucaua

SEQ ID NO: 39022 - RNA, 23 nt, Artificial Sequence
  RNA Oligomer
cacauagaacauggacgucauag

SEQ ID NO: 39023 - RNA, 23 nt, Artificial Sequence
  RNA Oligomer
acauagaacauggacgucauagc

SEQ ID NO: 39024 - RNA, 23 nt, Artificial Sequence
  RNA Oligomer
acugcaaccuauaugccagcugg

SEQ ID NO: 39025 - RNA, 23 nt, Artificial Sequence
  RNA Oligomer
cugcaaccuauaugccagcugga

SEQ ID NO: 39026 - RNA, 23 nt, Artificial Sequence
  RNA Oligomer
ugcaaccuauaugccagcuggaa

SEQ ID NO: 39027 - RNA, 23 nt, Artificial Sequence
  RNA Oligomer
gcaaccuauaugccagcuggaag

SEQ ID NO: 39028 - RNA, 23 nt, Artificial Sequence
  RNA Oligomer
caaccuauaugccagcuggaagu

SEQ ID NO: 39029 - RNA, 23 nt, Artificial Sequence
  RNA Oligomer
cacccgauggcaauacaaaaucc

SEQ ID NO: 39030 - RNA, 23 nt, Artificial Sequence
  RNA Oligomer
acccgauggcaauacaaaauccu

SEQ ID NO: 39031 - RNA, 23 nt, Artificial Sequence
  RNA Oligomer
cccgauggcaauacaaaauccug

SEQ ID NO: 39032 - RNA, 23 nt, Artificial Sequence
  RNA Oligomer
uccauacuaugucgacccaaagg

SEQ ID NO: 39033 - RNA, 23 nt, Artificial Sequence
  RNA Oligomer
ccauacuaugucgacccaaaggc

SEQ ID NO: 39034 - RNA, 23 nt, Artificial Sequence
  RNA Oligomer
cauacuaugucgacccaaaggca

SEQ ID NO: 39035 - RNA, 23 nt, Artificial Sequence
  RNA Oligomer
auacuaugucgacccaaaggcag

SEQ ID NO: 39036 - RNA, 23 nt, Artificial Sequence
  RNA Oligomer
uacuaugucgacccaaaggcagg

SEQ ID NO: 39037 - RNA, 23 nt, Artificial Sequence
  RNA Oligomer
auugagcaccuugacuacuacag

SEQ ID NO: 39038 - RNA, 23 nt, Artificial Sequence
  RNA Oligomer
uugagcaccuugacuacuacagg

SEQ ID NO: 39039 - RNA, 23 nt, Artificial Sequence
  RNA Oligomer
ugagcaccuugacuacuacaggc

SEQ ID NO: 39040 - RNA, 23 nt, Artificial Sequence
  RNA Oligomer
gagcaccuugacuacuacaggcc

SEQ ID NO: 39041 - RNA, 23 nt, Artificial Sequence
  RNA Oligomer
agcaccuugacuacuacaggccu

SEQ ID NO: 39042 - RNA, 23 nt, Artificial Sequence
  RNA Oligomer
ugacuacuacaggccuagcauuu

SEQ ID NO: 39043 - RNA, 23 nt, Artificial Sequence
  RNA Oligomer
gacuacuacaggccuagcauuuu

SEQ ID NO: 39044 - RNA, 23 nt, Artificial Sequence
  RNA Oligomer
gaaggaaguuaucucacacauga

SEQ ID NO: 39045 - RNA, 23 nt, Artificial Sequence
  RNA Oligomer
aaggaaguuaucucacacaugau

SEQ ID NO: 39046 - RNA, 23 nt, Artificial Sequence
  RNA Oligomer
aggaaguuaucucacacaugaua

SEQ ID NO: 39047 - RNA, 23 nt, Artificial Sequence
  RNA Oligomer
ggaaguuaucucacacaugauau

SEQ ID NO: 39048 - RNA, 23 nt, Artificial Sequence
  RNA Oligomer
gaaguuaucucacacaugauaug

SEQ ID NO: 39049 - RNA, 23 nt, Artificial Sequence
  RNA Oligomer
gaugaugaggaugcaugccacac

SEQ ID NO: 39050 - RNA, 23 nt, Artificial Sequence
  RNA Oligomer
uuuaaugaaggcccacuaugugc

SEQ ID NO: 39051 - RNA, 23 nt, Artificial Sequence
  RNA Oligomer
uuaaugaaggcccacuaugugcc

SEQ ID NO: 39052 - RNA, 23 nt, Artificial Sequence
  RNA Oligomer
uaaugaaggcccacuaugugcca

SEQ ID NO: 39053 - RNA, 23 nt, Artificial Sequence
  RNA Oligomer
aaugaaggcccacuaugugccaa

SEQ ID NO: 39054 - RNA, 23 nt, Artificial Sequence
  RNA Oligomer
augaaggcccacuaugugccaag

SEQ ID NO: 39055 - RNA, 23 nt, Artificial Sequence
  RNA Oligomer
aggggaaaagacaagauguggug

SEQ ID NO: 39056 - RNA, 23 nt, Artificial Sequence
  RNA Oligomer
ggggaaaagacaagaugugguga

SEQ ID NO: 39057 - RNA, 23 nt, Artificial Sequence
  RNA Oligomer
agagcacaaaauuagaagcugag

SEQ ID NO: 39058 - RNA, 23 nt, Artificial Sequence
  RNA Oligomer
accaguucucauaaaccaaggug

SEQ ID NO: 39059 - RNA, 23 nt, Artificial Sequence
  RNA Oligomer
ccaguucucauaaaccaagguga

SEQ ID NO: 39060 - RNA, 23 nt, Artificial Sequence
  RNA Oligomer
caguucucauaaaccaaggugaa

SEQ ID NO: 39061 - RNA, 23 nt, Artificial Sequence
  RNA Oligomer
uucucauaaaccaaggugaagag

SEQ ID NO: 39062 - RNA, 23 nt, Artificial Sequence
  RNA Oligomer
ucucauaaaccaaggugaagagu

SEQ ID NO: 39063 - RNA, 23 nt, Artificial Sequence
  RNA Oligomer
cucauaaaccaaggugaagaguu

SEQ ID NO: 39064 - RNA, 23 nt, Artificial Sequence
  RNA Oligomer
ucauaaaccaaggugaagaguuu

SEQ ID NO: 39065 - RNA, 23 nt, Artificial Sequence
  RNA Oligomer
cauaaaccaaggugaagaguuua

SEQ ID NO: 39066 - RNA, 23 nt, Artificial Sequence
  RNA Oligomer
agcagaaggguucuaagcagggg

SEQ ID NO: 39067 - RNA, 23 nt, Artificial Sequence
  RNA Oligomer
gcagaaggguucuaagcaggggg

SEQ ID NO: 39068 - RNA, 23 nt, Artificial Sequence
  RNA Oligomer
cagaaggguucuaagcagggggg

SEQ ID NO: 39069 - RNA, 23 nt, Artificial Sequence
  RNA Oligomer
gcaggaacaaagaacuacauuac

SEQ ID NO: 39070 - RNA, 23 nt, Artificial Sequence
  RNA Oligomer
caggaacaaagaacuacauuaca

SEQ ID NO: 39071 - RNA, 23 nt, Artificial Sequence
  RNA Oligomer
aggaacaaagaacuacauuacau

SEQ ID NO: 39072 - RNA, 23 nt, Artificial Sequence
  RNA Oligomer
ggaacaaagaacuacauuacauc

SEQ ID NO: 39073 - RNA, 23 nt, Artificial Sequence
  RNA Oligomer
gaacaaagaacuacauuacaucu

SEQ ID NO: 39074 - RNA, 23 nt, Artificial Sequence
  RNA Oligomer
auucuagacagauuugguggcag

SEQ ID NO: 39075 - RNA, 23 nt, Artificial Sequence
  RNA Oligomer
uucuagacagauuugguggcagc

SEQ ID NO: 39076 - RNA, 23 nt, Artificial Sequence
  RNA Oligomer
ucuagacagauuugguggcagca

SEQ ID NO: 39077 - RNA, 23 nt, Artificial Sequence
  RNA Oligomer
cuagacagauuugguggcagcag

SEQ ID NO: 39078 - RNA, 23 nt, Artificial Sequence
  RNA Oligomer
uagacagauuugguggcagcagc

SEQ ID NO: 39079 - RNA, 23 nt, Artificial Sequence
  RNA Oligomer
aaaaagacagagaggugguuaca

SEQ ID NO: 39080 - RNA, 23 nt, Artificial Sequence
  RNA Oligomer
aaaagacagagaggugguuacag

SEQ ID NO: 39081 - RNA, 23 nt, Artificial Sequence
  RNA Oligomer
aaagacagagaggugguuacaga

SEQ ID NO: 39082 - RNA, 23 nt, Artificial Sequence
  RNA Oligomer
aagacagagaggugguuacagag

SEQ ID NO: 39083 - RNA, 23 nt, Artificial Sequence
  RNA Oligomer
ggcucauuucaguaacaaagcuc

SEQ ID NO: 39084 - RNA, 23 nt, Artificial Sequence
  RNA Oligomer
uuucaguaacaaagcucagagaa

SEQ ID NO: 39085 - RNA, 23 nt, Artificial Sequence
  RNA Oligomer
uucaguaacaaagcucagagaaa

SEQ ID NO: 39086 - RNA, 23 nt, Artificial Sequence
  RNA Oligomer
aaagcucagagaaacaaccaacg

SEQ ID NO: 39087 - RNA, 23 nt, Artificial Sequence
  RNA Oligomer
aagcucagagaaacaaccaacga

SEQ ID NO: 39088 - RNA, 23 nt, Artificial Sequence
  RNA Oligomer
agcucagagaaacaaccaacgaa

SEQ ID NO: 39089 - RNA, 23 nt, Artificial Sequence
  RNA Oligomer
gcucagagaaacaaccaacgaaa

SEQ ID NO: 39090 - RNA, 23 nt, Artificial Sequence
  RNA Oligomer
cucagagaaacaaccaacgaaag

SEQ ID NO: 39091 - RNA, 23 nt, Artificial Sequence
  RNA Oligomer
aacgagccaagaguguccuucca

SEQ ID NO: 39092 - RNA, 23 nt, Artificial Sequence
  RNA Oligomer
gcagcaaggugcgucucuaguca

SEQ ID NO: 39093 - RNA, 23 nt, Artificial Sequence
  RNA Oligomer
cagcaaggugcgucucuagucau

SEQ ID NO: 39094 - RNA, 23 nt, Artificial Sequence
  RNA Oligomer
agcaaggugcgucucuagucaug

SEQ ID NO: 39095 - RNA, 23 nt, Artificial Sequence
  RNA Oligomer
gcaaggugcgucucuagucaugu

SEQ ID NO: 39096 - RNA, 23 nt, Artificial Sequence
  RNA Oligomer
caaggugcgucucuagucauguu

SEQ ID NO: 39097 - RNA, 23 nt, Artificial Sequence
  RNA Oligomer
cuuccaaacucucacucuaggac

SEQ ID NO: 39098 - RNA, 23 nt, Artificial Sequence
  RNA Oligomer
uuccaaacucucacucuaggaca

SEQ ID NO: 39099 - RNA, 23 nt, Artificial Sequence
  RNA Oligomer
uccaaacucucacucuaggacaa

SEQ ID NO: 39100 - RNA, 23 nt, Artificial Sequence
  RNA Oligomer
ccaaacucucacucuaggacaaa

SEQ ID NO: 39101 - RNA, 23 nt, Artificial Sequence
  RNA Oligomer
caaacucucacucuaggacaaaa

SEQ ID NO: 39102 - RNA, 23 nt, Artificial Sequence
  RNA Oligomer
gacaaaaagggcggaggauauga

SEQ ID NO: 39103 - RNA, 23 nt, Artificial Sequence
  RNA Oligomer
acaaaaagggcggaggauaugaa

SEQ ID NO: 39104 - RNA, 23 nt, Artificial Sequence
  RNA Oligomer
caaaaagggcggaggauaugaau

SEQ ID NO: 39105 - RNA, 23 nt, Artificial Sequence
  RNA Oligomer
aaaaagggcggaggauaugaaug

SEQ ID NO: 39106 - RNA, 23 nt, Artificial Sequence
  RNA Oligomer
aaaagggcggaggauaugaauga

SEQ ID NO: 39107 - RNA, 23 nt, Artificial Sequence
  RNA Oligomer
aagugccaucuacaaaagcugga

SEQ ID NO: 39108 - RNA, 23 nt, Artificial Sequence
  RNA Oligomer
agugccaucuacaaaagcuggaa

SEQ ID NO: 39109 - RNA, 23 nt, Artificial Sequence
  RNA Oligomer
gugccaucuacaaaagcuggaac

SEQ ID NO: 39110 - RNA, 23 nt, Artificial Sequence
  RNA Oligomer
cagcugaaacauuccuggcaaua

SEQ ID NO: 39111 - RNA, 23 nt, Artificial Sequence
  RNA Oligomer
gauguucuaacaauucgcucaac

SEQ ID NO: 39112 - RNA, 23 nt, Artificial Sequence
  RNA Oligomer
uaaccuucccgauccuugauaag

SEQ ID NO: 39113 - RNA, 23 nt, Artificial Sequence
  RNA Oligomer
ccuucccgauccuugauaagugc

SEQ ID NO: 39114 - RNA, 23 nt, Artificial Sequence
  RNA Oligomer
cuucccgauccuugauaagugcg

SEQ ID NO: 39115 - RNA, 23 nt, Artificial Sequence
  RNA Oligomer
uucccgauccuugauaagugcgu

SEQ ID NO: 39116 - RNA, 23 nt, Artificial Sequence
  RNA Oligomer
ucccgauccuugauaagugcguu

SEQ ID NO: 39117 - RNA, 23 nt, Artificial Sequence
  RNA Oligomer
caauucgcucaacaacagcuguu

SEQ ID NO: 39118 - RNA, 23 nt, Artificial Sequence
  RNA Oligomer
auaucaugucugagcgcgugggc

SEQ ID NO: 39119 - RNA, 23 nt, Artificial Sequence
  RNA Oligomer
guugucaaagagcugaaaaaccu

SEQ ID NO: 39120 - RNA, 23 nt, Artificial Sequence
  RNA Oligomer
uugucaaagagcugaaaaaccuc

SEQ ID NO: 39121 - RNA, 23 nt, Artificial Sequence
  RNA Oligomer
ugucaaagagcugaaaaaccucu

SEQ ID NO: 39122 - RNA, 23 nt, Artificial Sequence
  RNA Oligomer
gucaaagagcugaaaaaccucuu

SEQ ID NO: 39123 - RNA, 23 nt, Artificial Sequence
  RNA Oligomer
ucaaagagcugaaaaaccucuug

SEQ ID NO: 39124 - RNA, 23 nt, Artificial Sequence
  RNA Oligomer
gcugaaaaaccucuuggagcugg

SEQ ID NO: 39125 - RNA, 23 nt, Artificial Sequence
  RNA Oligomer
cugaaaaaccucuuggagcugga

SEQ ID NO: 39126 - RNA, 23 nt, Artificial Sequence
  RNA Oligomer
ugaaaaaccucuuggagcuggag

SEQ ID NO: 39127 - RNA, 23 nt, Artificial Sequence
  RNA Oligomer
gaaaaaccucuuggagcuggagc

SEQ ID NO: 39128 - RNA, 23 nt, Artificial Sequence
  RNA Oligomer
aaaaaccucuuggagcuggagca

SEQ ID NO: 39129 - RNA, 23 nt, Artificial Sequence
  RNA Oligomer
uggucacauagaacauggacguc

SEQ ID NO: 39130 - RNA, 23 nt, Artificial Sequence
  RNA Oligomer
gaaauuccaguucuuucucucca

SEQ ID NO: 39131 - RNA, 23 nt, Artificial Sequence
  RNA Oligomer
aaauuccaguucuuucucuccag

SEQ ID NO: 39132 - RNA, 23 nt, Artificial Sequence
  RNA Oligomer
aauuccaguucuuucucuccagu

SEQ ID NO: 39133 - RNA, 23 nt, Artificial Sequence
  RNA Oligomer
auuccaguucuuucucuccagug

SEQ ID NO: 39134 - RNA, 23 nt, Artificial Sequence
  RNA Oligomer
uuccaguucuuucucuccaguga

SEQ ID NO: 39135 - RNA, 23 nt, Artificial Sequence
  RNA Oligomer
cacucccaauauccugcgucccc

SEQ ID NO: 39136 - RNA, 23 nt, Artificial Sequence
  RNA Oligomer
ucacaaaccacccaaacaaauau

SEQ ID NO: 39137 - RNA, 23 nt, Artificial Sequence
  RNA Oligomer
cacaaaccacccaaacaaauauu

SEQ ID NO: 39138 - RNA, 23 nt, Artificial Sequence
  RNA Oligomer
acaaaccacccaaacaaauauuu

SEQ ID NO: 39139 - RNA, 23 nt, Artificial Sequence
  RNA Oligomer
caaaccacccaaacaaauauuua

SEQ ID NO: 39140 - RNA, 23 nt, Artificial Sequence
  RNA Oligomer
aaaccacccaaacaaauauuuau

SEQ ID NO: 39141 - RNA, 23 nt, Artificial Sequence
  RNA Oligomer
uauuuauugagcaccuugacuac

SEQ ID NO: 39142 - RNA, 23 nt, Artificial Sequence
  RNA Oligomer
auuuauugagcaccuugacuacu

SEQ ID NO: 39143 - RNA, 23 nt, Artificial Sequence
  RNA Oligomer
uuuauugagcaccuugacuacua

SEQ ID NO: 39144 - RNA, 23 nt, Artificial Sequence
  RNA Oligomer
uuauugagcaccuugacuacuac

SEQ ID NO: 39145 - RNA, 23 nt, Artificial Sequence
  RNA Oligomer
uauugagcaccuugacuacuaca

SEQ ID NO: 39146 - RNA, 23 nt, Artificial Sequence
  RNA Oligomer
acucccaauauccugcguccccu

SEQ ID NO: 39147 - RNA, 23 nt, Artificial Sequence
  RNA Oligomer
cacacaugauaugucuucaagga

SEQ ID NO: 39148 - RNA, 23 nt, Artificial Sequence
  RNA Oligomer
cacaugauaugucuucaaggagc

SEQ ID NO: 39149 - RNA, 23 nt, Artificial Sequence
  RNA Oligomer
acaugauaugucuucaaggagcu

SEQ ID NO: 39150 - RNA, 23 nt, Artificial Sequence
  RNA Oligomer
caugauaugucuucaaggagcua

SEQ ID NO: 39151 - RNA, 23 nt, Artificial Sequence
  RNA Oligomer
augauaugucuucaaggagcuaa

SEQ ID NO: 39152 - RNA, 23 nt, Artificial Sequence
  RNA Oligomer
ugauaugucuucaaggagcuaaa

SEQ ID NO: 39153 - RNA, 23 nt, Artificial Sequence
  RNA Oligomer
agguaggauuguagcuaagguug

SEQ ID NO: 39154 - RNA, 23 nt, Artificial Sequence
  RNA Oligomer
gguaggauuguagcuaagguugg

SEQ ID NO: 39155 - RNA, 23 nt, Artificial Sequence
  RNA Oligomer
guaggauuguagcuaagguuggc

SEQ ID NO: 39156 - RNA, 23 nt, Artificial Sequence
  RNA Oligomer
uaggauuguagcuaagguuggcu

SEQ ID NO: 39157 - RNA, 23 nt, Artificial Sequence
  RNA Oligomer
gacacagaaguagacugcucagg

SEQ ID NO: 39158 - RNA, 23 nt, Artificial Sequence
  RNA Oligomer
acacagaaguagacugcucaggg

SEQ ID NO: 39159 - RNA, 23 nt, Artificial Sequence
  RNA Oligomer
cacagaaguagacugcucaggga

SEQ ID NO: 39160 - RNA, 23 nt, Artificial Sequence
  RNA Oligomer
acagaaguagacugcucagggac

SEQ ID NO: 39161 - RNA, 23 nt, Artificial Sequence
  RNA Oligomer
cagaaguagacugcucagggacu

SEQ ID NO: 39162 - RNA, 23 nt, Artificial Sequence
  RNA Oligomer
aguucucauaaaccaaggugaag

SEQ ID NO: 39163 - RNA, 23 nt, Artificial Sequence
  RNA Oligomer
guucucauaaaccaaggugaaga

SEQ ID NO: 39164 - RNA, 23 nt, Artificial Sequence
  RNA Oligomer
agaaggguucuaagcaggggggu

SEQ ID NO: 39165 - RNA, 23 nt, Artificial Sequence
  RNA Oligomer
uuuaauacugaaagagaaagcag

SEQ ID NO: 39166 - RNA, 23 nt, Artificial Sequence
  RNA Oligomer
uuaauacugaaagagaaagcagg

SEQ ID NO: 39167 - RNA, 23 nt, Artificial Sequence
  RNA Oligomer
uaauacugaaagagaaagcagga

SEQ ID NO: 39168 - RNA, 23 nt, Artificial Sequence
  RNA Oligomer
aauacugaaagagaaagcaggaa

SEQ ID NO: 39169 - RNA, 23 nt, Artificial Sequence
  RNA Oligomer
auacugaaagagaaagcaggaac

SEQ ID NO: 39170 - RNA, 23 nt, Artificial Sequence
  RNA Oligomer
agagaaagcaggaacaaagaacu

SEQ ID NO: 39171 - RNA, 23 nt, Artificial Sequence
  RNA Oligomer
gagaaagcaggaacaaagaacua

SEQ ID NO: 39172 - RNA, 23 nt, Artificial Sequence
  RNA Oligomer
agaaagcaggaacaaagaacuac

SEQ ID NO: 39173 - RNA, 23 nt, Artificial Sequence
  RNA Oligomer
gaaagcaggaacaaagaacuaca

SEQ ID NO: 39174 - RNA, 23 nt, Artificial Sequence
  RNA Oligomer
aaagcaggaacaaagaacuacau

SEQ ID NO: 39175 - RNA, 23 nt, Artificial Sequence
  RNA Oligomer
aagcaggaacaaagaacuacauu

SEQ ID NO: 39176 - RNA, 23 nt, Artificial Sequence
  RNA Oligomer
agcaggaacaaagaacuacauua

SEQ ID NO: 39177 - RNA, 23 nt, Artificial Sequence
  RNA Oligomer
gaaugaaagugggaauaguaagg

SEQ ID NO: 39178 - RNA, 23 nt, Artificial Sequence
  RNA Oligomer
caggaaggaaaaagacagagagg

SEQ ID NO: 39179 - RNA, 23 nt, Artificial Sequence
  RNA Oligomer
aggaaggaaaaagacagagaggu

SEQ ID NO: 39180 - RNA, 23 nt, Artificial Sequence
  RNA Oligomer
ggaaggaaaaagacagagaggug

SEQ ID NO: 39181 - RNA, 23 nt, Artificial Sequence
  RNA Oligomer
aaacaaccaacgaaagaucuuug

SEQ ID NO: 39182 - RNA, 23 nt, Artificial Sequence
  RNA Oligomer
aacaaccaacgaaagaucuuuga

SEQ ID NO: 39183 - RNA, 23 nt, Artificial Sequence
  RNA Oligomer
acaaccaacgaaagaucuuugag

SEQ ID NO: 39184 - RNA, 23 nt, Artificial Sequence
  RNA Oligomer
caaccaacgaaagaucuuugaga

SEQ ID NO: 39185 - RNA, 23 nt, Artificial Sequence
  RNA Oligomer
aaccaacgaaagaucuuugagac

SEQ ID NO: 39186 - RNA, 23 nt, Artificial Sequence
  RNA Oligomer
cuacauuaaauuuggacaccuuc

SEQ ID NO: 39187 - RNA, 23 nt, Artificial Sequence
  RNA Oligomer
uacauuaaauuuggacaccuucc

SEQ ID NO: 39188 - RNA, 23 nt, Artificial Sequence
  RNA Oligomer
acauuaaauuuggacaccuucca

SEQ ID NO: 39189 - RNA, 23 nt, Artificial Sequence
  RNA Oligomer
cauuaaauuuggacaccuuccaa

SEQ ID NO: 39190 - RNA, 23 nt, Artificial Sequence
  RNA Oligomer
auuaaauuuggacaccuuccaaa

SEQ ID NO: 39191 - RNA, 23 nt, Artificial Sequence
  RNA Oligomer
ggugaugauguccuucuccagaa

SEQ ID NO: 39192 - RNA, 23 nt, Artificial Sequence
  RNA Oligomer
gugaugauguccuucuccagaag

SEQ ID NO: 39193 - RNA, 23 nt, Artificial Sequence
  RNA Oligomer
ugaugauguccuucuccagaaga

SEQ ID NO: 39194 - RNA, 23 nt, Artificial Sequence
  RNA Oligomer
gaugauguccuucuccagaagau

SEQ ID NO: 39195 - RNA, 23 nt, Artificial Sequence
  RNA Oligomer
augauguccuucuccagaagaug

SEQ ID NO: 39196 - RNA, 23 nt, Artificial Sequence
  RNA Oligomer
aaagcuggaacugaacacaaaua

SEQ ID NO: 39197 - RNA, 23 nt, Artificial Sequence
  RNA Oligomer
uaaccacacuguguuuacaacuu

SEQ ID NO: 39198 - RNA, 23 nt, Artificial Sequence
  RNA Oligomer
acuucacuugucaggcucuucaa

SEQ ID NO: 39199 - RNA, 23 nt, Artificial Sequence
  RNA Oligomer
cuucacuugucaggcucuucaac

SEQ ID NO: 39200 - RNA, 23 nt, Artificial Sequence
  RNA Oligomer
uucacuugucaggcucuucaacu

SEQ ID NO: 39201 - RNA, 23 nt, Artificial Sequence
  RNA Oligomer
ucacuugucaggcucuucaacug

SEQ ID NO: 39202 - RNA, 23 nt, Artificial Sequence
  RNA Oligomer
ccugaagaucaaaggcucuauca

SEQ ID NO: 39203 - RNA, 23 nt, Artificial Sequence
  RNA Oligomer
cugaagaucaaaggcucuaucac

SEQ ID NO: 39204 - RNA, 23 nt, Artificial Sequence
  RNA Oligomer
ugaagaucaaaggcucuaucaca

SEQ ID NO: 39205 - RNA, 23 nt, Artificial Sequence
  RNA Oligomer
auguucuaacaauucgcucaaca

SEQ ID NO: 39206 - RNA, 23 nt, Artificial Sequence
  RNA Oligomer
accuucccgauccuugauaagug

SEQ ID NO: 39207 - RNA, 23 nt, Artificial Sequence
  RNA Oligomer
uccuugauaagugcguucaccuu

SEQ ID NO: 39208 - RNA, 23 nt, Artificial Sequence
  RNA Oligomer
gagcaagagccucgauguaccag

SEQ ID NO: 39209 - RNA, 23 nt, Artificial Sequence
  RNA Oligomer
agcaagagccucgauguaccagg

SEQ ID NO: 39210 - RNA, 23 nt, Artificial Sequence
  RNA Oligomer
gcaagagccucgauguaccagga

SEQ ID NO: 39211 - RNA, 23 nt, Artificial Sequence
  RNA Oligomer
caagagccucgauguaccaggaa

SEQ ID NO: 39212 - RNA, 23 nt, Artificial Sequence
  RNA Oligomer
aagagccucgauguaccaggaac

SEQ ID NO: 39213 - RNA, 23 nt, Artificial Sequence
  RNA Oligomer
ucuucggcaacuuuucuuuaccg

SEQ ID NO: 39214 - RNA, 23 nt, Artificial Sequence
  RNA Oligomer
uuaccggcaucacucuccucgca

SEQ ID NO: 39215 - RNA, 23 nt, Artificial Sequence
  RNA Oligomer
uugguuuguucuguaggcuuggg

SEQ ID NO: 39216 - RNA, 23 nt, Artificial Sequence
  RNA Oligomer
ugguuuguucuguaggcuugggc

SEQ ID NO: 39217 - RNA, 23 nt, Artificial Sequence
  RNA Oligomer
gguuuguucuguaggcuugggca

SEQ ID NO: 39218 - RNA, 23 nt, Artificial Sequence
  RNA Oligomer
guuuguucuguaggcuugggcag

SEQ ID NO: 39219 - RNA, 23 nt, Artificial Sequence
  RNA Oligomer
uuuguucuguaggcuugggcagu

SEQ ID NO: 39220 - RNA, 23 nt, Artificial Sequence
  RNA Oligomer
cauagaacauggacgucauagcc

SEQ ID NO: 39221 - RNA, 23 nt, Artificial Sequence
  RNA Oligomer
auagaacauggacgucauagccc

SEQ ID NO: 39222 - RNA, 23 nt, Artificial Sequence
  RNA Oligomer
uagaacauggacgucauagccca

SEQ ID NO: 39223 - RNA, 23 nt, Artificial Sequence
  RNA Oligomer
agaacauggacgucauagcccaa

SEQ ID NO: 39224 - RNA, 23 nt, Artificial Sequence
  RNA Oligomer
agagcgaaauuccaguucuuucu

SEQ ID NO: 39225 - RNA, 23 nt, Artificial Sequence
  RNA Oligomer
gagcgaaauuccaguucuuucuc

SEQ ID NO: 39226 - RNA, 23 nt, Artificial Sequence
  RNA Oligomer
agcgaaauuccaguucuuucucu

SEQ ID NO: 39227 - RNA, 23 nt, Artificial Sequence
  RNA Oligomer
gcgaaauuccaguucuuucucuc

SEQ ID NO: 39228 - RNA, 23 nt, Artificial Sequence
  RNA Oligomer
cgaaauuccaguucuuucucucc

SEQ ID NO: 39229 - RNA, 23 nt, Artificial Sequence
  RNA Oligomer
uccaguucuuucucuccagugaa

SEQ ID NO: 39230 - RNA, 23 nt, Artificial Sequence
  RNA Oligomer
ccaguucuuucucuccagugaag

SEQ ID NO: 39231 - RNA, 23 nt, Artificial Sequence
  RNA Oligomer
caguucuuucucuccagugaagu

SEQ ID NO: 39232 - RNA, 23 nt, Artificial Sequence
  RNA Oligomer
aguucuuucucuccagugaagug

SEQ ID NO: 39233 - RNA, 23 nt, Artificial Sequence
  RNA Oligomer
auaaauaugagcauuuauuuggc

SEQ ID NO: 39234 - RNA, 23 nt, Artificial Sequence
  RNA Oligomer
uaaauaugagcauuuauuuggca

SEQ ID NO: 39235 - RNA, 23 nt, Artificial Sequence
  RNA Oligomer
aaauaugagcauuuauuuggcac

SEQ ID NO: 39236 - RNA, 23 nt, Artificial Sequence
  RNA Oligomer
aauaugagcauuuauuuggcacc

SEQ ID NO: 39237 - RNA, 23 nt, Artificial Sequence
  RNA Oligomer
auaugagcauuuauuuggcaccc

SEQ ID NO: 39238 - RNA, 23 nt, Artificial Sequence
  RNA Oligomer
aagguucucucucucaaauacuu

SEQ ID NO: 39239 - RNA, 23 nt, Artificial Sequence
  RNA Oligomer
agguucucucucucaaauacuuc

SEQ ID NO: 39240 - RNA, 23 nt, Artificial Sequence
  RNA Oligomer
auauuuauugagcaccuugacua

SEQ ID NO: 39241 - RNA, 23 nt, Artificial Sequence
  RNA Oligomer
agaaguagacugcucagggacug

SEQ ID NO: 39242 - RNA, 23 nt, Artificial Sequence
  RNA Oligomer
gaaguagacugcucagggacuga

SEQ ID NO: 39243 - RNA, 23 nt, Artificial Sequence
  RNA Oligomer
aaguagacugcucagggacugaa

SEQ ID NO: 39244 - RNA, 23 nt, Artificial Sequence
  RNA Oligomer
ggcaggaaagagcacaaaauuag

SEQ ID NO: 39245 - RNA, 23 nt, Artificial Sequence
  RNA Oligomer
gcaggaaagagcacaaaauuaga

SEQ ID NO: 39246 - RNA, 23 nt, Artificial Sequence
  RNA Oligomer
caggaaagagcacaaaauuagaa

SEQ ID NO: 39247 - RNA, 23 nt, Artificial Sequence
  RNA Oligomer
gagcacaaaauuagaagcugaga

SEQ ID NO: 39248 - RNA, 23 nt, Artificial Sequence
  RNA Oligomer
aaauuagaagcugagaggagacc

SEQ ID NO: 39249 - RNA, 23 nt, Artificial Sequence
  RNA Oligomer
aauuagaagcugagaggagacca

SEQ ID NO: 39250 - RNA, 23 nt, Artificial Sequence
  RNA Oligomer
auuagaagcugagaggagaccac

SEQ ID NO: 39251 - RNA, 23 nt, Artificial Sequence
  RNA Oligomer
uuagaagcugagaggagaccacu

SEQ ID NO: 39252 - RNA, 23 nt, Artificial Sequence
  RNA Oligomer
uagaagcugagaggagaccacuc

SEQ ID NO: 39253 - RNA, 23 nt, Artificial Sequence
  RNA Oligomer
agggaaguugggaaguuucagau

SEQ ID NO: 39254 - RNA, 23 nt, Artificial Sequence
  RNA Oligomer
gggaaguugggaaguuucagaua

SEQ ID NO: 39255 - RNA, 23 nt, Artificial Sequence
  RNA Oligomer
ggaaguugggaaguuucagauaa

SEQ ID NO: 39256 - RNA, 23 nt, Artificial Sequence
  RNA Oligomer
gaaguugggaaguuucagauaag

SEQ ID NO: 39257 - RNA, 23 nt, Artificial Sequence
  RNA Oligomer
aaguugggaaguuucagauaagc

SEQ ID NO: 39258 - RNA, 23 nt, Artificial Sequence
  RNA Oligomer
aguugggaaguuucagauaagca

SEQ ID NO: 39259 - RNA, 23 nt, Artificial Sequence
  RNA Oligomer
guugggaaguuucagauaagcag

SEQ ID NO: 39260 - RNA, 23 nt, Artificial Sequence
  RNA Oligomer
uugggaaguuucagauaagcagg

SEQ ID NO: 39261 - RNA, 23 nt, Artificial Sequence
  RNA Oligomer
ugggaaguuucagauaagcaggg

SEQ ID NO: 39262 - RNA, 23 nt, Artificial Sequence
  RNA Oligomer
caaaggagaguuuaauacugaaa

SEQ ID NO: 39263 - RNA, 23 nt, Artificial Sequence
  RNA Oligomer
aaaggagaguuuaauacugaaag

SEQ ID NO: 39264 - RNA, 23 nt, Artificial Sequence
  RNA Oligomer
aaggagaguuuaauacugaaaga

SEQ ID NO: 39265 - RNA, 23 nt, Artificial Sequence
  RNA Oligomer
caaagaacuacauuacaucuuug

SEQ ID NO: 39266 - RNA, 23 nt, Artificial Sequence
  RNA Oligomer
aaagaacuacauuacaucuuuga

SEQ ID NO: 39267 - RNA, 23 nt, Artificial Sequence
  RNA Oligomer
aagaacuacauuacaucuuugag

SEQ ID NO: 39268 - RNA, 23 nt, Artificial Sequence
  RNA Oligomer
aagcaggauucuagacagauuug

SEQ ID NO: 39269 - RNA, 23 nt, Artificial Sequence
  RNA Oligomer
aggcucauuucaguaacaaagcu

SEQ ID NO: 39270 - RNA, 23 nt, Artificial Sequence
  RNA Oligomer
uucuucagagccaaaagauaaug

SEQ ID NO: 39271 - RNA, 23 nt, Artificial Sequence
  RNA Oligomer
caucuacaaaagcuggaacugaa

SEQ ID NO: 39272 - RNA, 23 nt, Artificial Sequence
  RNA Oligomer
aucuacaaaagcuggaacugaac

SEQ ID NO: 39273 - RNA, 23 nt, Artificial Sequence
  RNA Oligomer
ucuacaaaagcuggaacugaaca

SEQ ID NO: 39274 - RNA, 23 nt, Artificial Sequence
  RNA Oligomer
ggcagaacagaaaccgugcaucc

SEQ ID NO: 39275 - RNA, 23 nt, Artificial Sequence
  RNA Oligomer
gcagaacagaaaccgugcauccu

SEQ ID NO: 39276 - RNA, 23 nt, Artificial Sequence
  RNA Oligomer
cagaacagaaaccgugcauccug

SEQ ID NO: 39277 - RNA, 23 nt, Artificial Sequence
  RNA Oligomer
agaacagaaaccgugcauccuga

SEQ ID NO: 39278 - RNA, 23 nt, Artificial Sequence
  RNA Oligomer
gaacagaaaccgugcauccugaa

SEQ ID NO: 39279 - RNA, 23 nt, Artificial Sequence
  RNA Oligomer
uguucuaacaauucgcucaacaa

SEQ ID NO: 39280 - RNA, 23 nt, Artificial Sequence
  RNA Oligomer
ucacaagcccgcucagaaaacac

SEQ ID NO: 39281 - RNA, 23 nt, Artificial Sequence
  RNA Oligomer
cacaagcccgcucagaaaacacu

SEQ ID NO: 39282 - RNA, 23 nt, Artificial Sequence
  RNA Oligomer
acaagcccgcucagaaaacacuu

SEQ ID NO: 39283 - RNA, 23 nt, Artificial Sequence
  RNA Oligomer
caagcccgcucagaaaacacuug

SEQ ID NO: 39284 - RNA, 23 nt, Artificial Sequence
  RNA Oligomer
aagcccgcucagaaaacacuuga

SEQ ID NO: 39285 - RNA, 23 nt, Artificial Sequence
  RNA Oligomer
gcaguuucccauccacaccauag

SEQ ID NO: 39286 - RNA, 23 nt, Artificial Sequence
  RNA Oligomer
caguuucccauccacaccauaga

SEQ ID NO: 39287 - RNA, 23 nt, Artificial Sequence
  RNA Oligomer
aguuucccauccacaccauagau

SEQ ID NO: 39288 - RNA, 23 nt, Artificial Sequence
  RNA Oligomer
guuucccauccacaccauagaug

SEQ ID NO: 39289 - RNA, 23 nt, Artificial Sequence
  RNA Oligomer
uuucccauccacaccauagaugg

SEQ ID NO: 39290 - RNA, 23 nt, Artificial Sequence
  RNA Oligomer
gaacauggacgucauagcccaaa

SEQ ID NO: 39291 - RNA, 23 nt, Artificial Sequence
  RNA Oligomer
cucucucaaauacuuccauacua

SEQ ID NO: 39292 - RNA, 23 nt, Artificial Sequence
  RNA Oligomer
ucucucaaauacuuccauacuau

SEQ ID NO: 39293 - RNA, 23 nt, Artificial Sequence
  RNA Oligomer
cucucaaauacuuccauacuaug

SEQ ID NO: 39294 - RNA, 23 nt, Artificial Sequence
  RNA Oligomer
ugccuucuucccucuuuuauuca

SEQ ID NO: 39295 - RNA, 23 nt, Artificial Sequence
  RNA Oligomer
gccuucuucccucuuuuauucaa

SEQ ID NO: 39296 - RNA, 23 nt, Artificial Sequence
  RNA Oligomer
ccuucuucccucuuuuauucaac

SEQ ID NO: 39297 - RNA, 23 nt, Artificial Sequence
  RNA Oligomer
cuucuucccucuuuuauucaaca

SEQ ID NO: 39298 - RNA, 23 nt, Artificial Sequence
  RNA Oligomer
uucuucccucuuuuauucaacaa

SEQ ID NO: 39299 - RNA, 23 nt, Artificial Sequence
  RNA Oligomer
ucuucccucuuuuauucaacaaa

SEQ ID NO: 39300 - RNA, 23 nt, Artificial Sequence
  RNA Oligomer
cuucccucuuuuauucaacaaac

SEQ ID NO: 39301 - RNA, 23 nt, Artificial Sequence
  RNA Oligomer
uucccucuuuuauucaacaaaca

SEQ ID NO: 39302 - RNA, 23 nt, Artificial Sequence
  RNA Oligomer
acauuuaaugaaggcccacuaug

SEQ ID NO: 39303 - RNA, 23 nt, Artificial Sequence
  RNA Oligomer
cauuuaaugaaggcccacuaugu

SEQ ID NO: 39304 - RNA, 23 nt, Artificial Sequence
  RNA Oligomer
auuuaaugaaggcccacuaugug

SEQ ID NO: 39305 - RNA, 23 nt, Artificial Sequence
  RNA Oligomer
cugcccucauuuacagccuggua

SEQ ID NO: 39306 - RNA, 23 nt, Artificial Sequence
  RNA Oligomer
uuucucaggaaggaaaaagacag

SEQ ID NO: 39307 - RNA, 23 nt, Artificial Sequence
  RNA Oligomer
uucucaggaaggaaaaagacaga

SEQ ID NO: 39308 - RNA, 23 nt, Artificial Sequence
  RNA Oligomer
ucucaggaaggaaaaagacagag

SEQ ID NO: 39309 - RNA, 23 nt, Artificial Sequence
  RNA Oligomer
cucaggaaggaaaaagacagaga

SEQ ID NO: 39310 - RNA, 23 nt, Artificial Sequence
  RNA Oligomer
ucaggaaggaaaaagacagagag

SEQ ID NO: 39311 - RNA, 23 nt, Artificial Sequence
  RNA Oligomer
auucuuccuggccuucucugaug

SEQ ID NO: 39312 - RNA, 23 nt, Artificial Sequence
  RNA Oligomer
uucuuccuggccuucucugaugc

SEQ ID NO: 39313 - RNA, 23 nt, Artificial Sequence
  RNA Oligomer
ucuuccuggccuucucugaugcu

SEQ ID NO: 39314 - RNA, 23 nt, Artificial Sequence
  RNA Oligomer
cuuccuggccuucucugaugcuc

SEQ ID NO: 39315 - RNA, 23 nt, Artificial Sequence
  RNA Oligomer
uuccuggccuucucugaugcucc

SEQ ID NO: 39316 - RNA, 23 nt, Artificial Sequence
  RNA Oligomer
accaacgaaagaucuuugagacu

SEQ ID NO: 39317 - RNA, 23 nt, Artificial Sequence
  RNA Oligomer
caccuuccaaacucucacucuag

SEQ ID NO: 39318 - RNA, 23 nt, Artificial Sequence
  RNA Oligomer
accuuccaaacucucacucuagg

SEQ ID NO: 39319 - RNA, 23 nt, Artificial Sequence
  RNA Oligomer
ccuuccaaacucucacucuagga

SEQ ID NO: 39320 - RNA, 23 nt, Artificial Sequence
  RNA Oligomer
aaagggcggaggauaugaaugaa

SEQ ID NO: 39321 - RNA, 23 nt, Artificial Sequence
  RNA Oligomer
uucagacaucuccuugcaccggu

SEQ ID NO: 39322 - RNA, 23 nt, Artificial Sequence
  RNA Oligomer
ucagacaucuccuugcaccggug

SEQ ID NO: 39323 - RNA, 23 nt, Artificial Sequence
  RNA Oligomer
guucuaacaauucgcucaacaac

SEQ ID NO: 39324 - RNA, 23 nt, Artificial Sequence
  RNA Oligomer
uucuaacaauucgcucaacaaca

SEQ ID NO: 39325 - RNA, 23 nt, Artificial Sequence
  RNA Oligomer
agaacauuuuugguuuguucugu

SEQ ID NO: 39326 - RNA, 23 nt, Artificial Sequence
  RNA Oligomer
gaacauuuuugguuuguucugua

SEQ ID NO: 39327 - RNA, 23 nt, Artificial Sequence
  RNA Oligomer
ggagcaguuucccauccacacca

SEQ ID NO: 39328 - RNA, 23 nt, Artificial Sequence
  RNA Oligomer
gagcaguuucccauccacaccau

SEQ ID NO: 39329 - RNA, 23 nt, Artificial Sequence
  RNA Oligomer
agcaguuucccauccacaccaua

SEQ ID NO: 39330 - RNA, 23 nt, Artificial Sequence
  RNA Oligomer
uucccauccacaccauagauggc

SEQ ID NO: 39331 - RNA, 23 nt, Artificial Sequence
  RNA Oligomer
ucugcaguuucucuugcauuucc

SEQ ID NO: 39332 - RNA, 23 nt, Artificial Sequence
  RNA Oligomer
cugcaguuucucuugcauuuccu

SEQ ID NO: 39333 - RNA, 23 nt, Artificial Sequence
  RNA Oligomer
ugcaguuucucuugcauuuccug

SEQ ID NO: 39334 - RNA, 23 nt, Artificial Sequence
  RNA Oligomer
gcaguuucucuugcauuuccugu

SEQ ID NO: 39335 - RNA, 23 nt, Artificial Sequence
  RNA Oligomer
uucuuucucuccagugaagugca

SEQ ID NO: 39336 - RNA, 23 nt, Artificial Sequence
  RNA Oligomer
ucuuucucuccagugaagugcac

SEQ ID NO: 39337 - RNA, 23 nt, Artificial Sequence
  RNA Oligomer
cuuucucuccagugaagugcaca

SEQ ID NO: 39338 - RNA, 23 nt, Artificial Sequence
  RNA Oligomer
uuucucuccagugaagugcacau

SEQ ID NO: 39339 - RNA, 23 nt, Artificial Sequence
  RNA Oligomer
uucucuccagugaagugcacauu

SEQ ID NO: 39340 - RNA, 23 nt, Artificial Sequence
  RNA Oligomer
cuuuuuuagaguuuccugaugau

SEQ ID NO: 39341 - RNA, 23 nt, Artificial Sequence
  RNA Oligomer
uuuuuuagaguuuccugaugaug

SEQ ID NO: 39342 - RNA, 23 nt, Artificial Sequence
  RNA Oligomer
uugcuagggaccaugggagaugu

SEQ ID NO: 39343 - RNA, 23 nt, Artificial Sequence
  RNA Oligomer
ugcuagggaccaugggagaugug

SEQ ID NO: 39344 - RNA, 23 nt, Artificial Sequence
  RNA Oligomer
gcuagggaccaugggagauguga

SEQ ID NO: 39345 - RNA, 23 nt, Artificial Sequence
  RNA Oligomer
cuagggaccaugggagaugugaa

SEQ ID NO: 39346 - RNA, 23 nt, Artificial Sequence
  RNA Oligomer
uagggaccaugggagaugugaag

SEQ ID NO: 39347 - RNA, 23 nt, Artificial Sequence
  RNA Oligomer
uugccuucuucccucuuuuauuc

SEQ ID NO: 39348 - RNA, 23 nt, Artificial Sequence
  RNA Oligomer
uauauuuaaacaaccaaauccug

SEQ ID NO: 39349 - RNA, 23 nt, Artificial Sequence
  RNA Oligomer
auauuuaaacaaccaaauccugg

SEQ ID NO: 39350 - RNA, 23 nt, Artificial Sequence
  RNA Oligomer
uauuuaaacaaccaaauccuggc

SEQ ID NO: 39351 - RNA, 23 nt, Artificial Sequence
  RNA Oligomer
auuuaaacaaccaaauccuggcc

SEQ ID NO: 39352 - RNA, 23 nt, Artificial Sequence
  RNA Oligomer
uuuaaacaaccaaauccuggcca

SEQ ID NO: 39353 - RNA, 23 nt, Artificial Sequence
  RNA Oligomer
aguuuaauacugaaagagaaagc

SEQ ID NO: 39354 - RNA, 23 nt, Artificial Sequence
  RNA Oligomer
guuuaauacugaaagagaaagca

SEQ ID NO: 39355 - RNA, 23 nt, Artificial Sequence
  RNA Oligomer
aagagaaagcaggaacaaagaac

SEQ ID NO: 39356 - RNA, 23 nt, Artificial Sequence
  RNA Oligomer
aacaaagaacuacauuacaucuu

SEQ ID NO: 39357 - RNA, 23 nt, Artificial Sequence
  RNA Oligomer
acaaagaacuacauuacaucuuu

SEQ ID NO: 39358 - RNA, 23 nt, Artificial Sequence
  RNA Oligomer
agacagauuugguggcagcagcc

SEQ ID NO: 39359 - RNA, 23 nt, Artificial Sequence
  RNA Oligomer
agugggaauaguaagggagagag

SEQ ID NO: 39360 - RNA, 23 nt, Artificial Sequence
  RNA Oligomer
ugucuacauuaaauuuggacacc

SEQ ID NO: 39361 - RNA, 23 nt, Artificial Sequence
  RNA Oligomer
gucuacauuaaauuuggacaccu

SEQ ID NO: 39362 - RNA, 23 nt, Artificial Sequence
  RNA Oligomer
ucuacauuaaauuuggacaccuu

SEQ ID NO: 39363 - RNA, 23 nt, Artificial Sequence
  RNA Oligomer
cuggcaauagguccaaccaaggc

SEQ ID NO: 39364 - RNA, 23 nt, Artificial Sequence
  RNA Oligomer
uggcaauagguccaaccaaggcu

SEQ ID NO: 39365 - RNA, 23 nt, Artificial Sequence
  RNA Oligomer
ggcaauagguccaaccaaggcug

SEQ ID NO: 39366 - RNA, 23 nt, Artificial Sequence
  RNA Oligomer
gcaauagguccaaccaaggcugg

SEQ ID NO: 39367 - RNA, 23 nt, Artificial Sequence
  RNA Oligomer
caauagguccaaccaaggcuggc

SEQ ID NO: 39368 - RNA, 23 nt, Artificial Sequence
  RNA Oligomer
accuauaugccagcuggaagugu

SEQ ID NO: 39369 - RNA, 23 nt, Artificial Sequence
  RNA Oligomer
ccuauaugccagcuggaagugug

SEQ ID NO: 39370 - RNA, 23 nt, Artificial Sequence
  RNA Oligomer
cuauaugccagcuggaagugugu

SEQ ID NO: 39371 - RNA, 23 nt, Artificial Sequence
  RNA Oligomer
uauaugccagcuggaaguguguu

SEQ ID NO: 39372 - RNA, 23 nt, Artificial Sequence
  RNA Oligomer
auaugccagcuggaaguguguuu

SEQ ID NO: 39373 - RNA, 23 nt, Artificial Sequence
  RNA Oligomer
guguguuugauaaaauucaggag

SEQ ID NO: 39374 - RNA, 23 nt, Artificial Sequence
  RNA Oligomer
uguguuugauaaaauucaggagu

SEQ ID NO: 39375 - RNA, 23 nt, Artificial Sequence
  RNA Oligomer
guguuugauaaaauucaggagug

SEQ ID NO: 39376 - RNA, 23 nt, Artificial Sequence
  RNA Oligomer
uguuugauaaaauucaggagugc

SEQ ID NO: 39377 - RNA, 23 nt, Artificial Sequence
  RNA Oligomer
guuugauaaaauucaggagugca

SEQ ID NO: 39378 - RNA, 23 nt, Artificial Sequence
  RNA Oligomer
cuggcugaaacugcccacuuugg

SEQ ID NO: 39379 - RNA, 23 nt, Artificial Sequence
  RNA Oligomer
uggcugaaacugcccacuuuggc

SEQ ID NO: 39380 - RNA, 23 nt, Artificial Sequence
  RNA Oligomer
ggcugaaacugcccacuuuggcc

SEQ ID NO: 39381 - RNA, 23 nt, Artificial Sequence
  RNA Oligomer
gcugaaacugcccacuuuggccu

SEQ ID NO: 39382 - RNA, 23 nt, Artificial Sequence
  RNA Oligomer
cugaaacugcccacuuuggccug

SEQ ID NO: 39383 - RNA, 23 nt, Artificial Sequence
  RNA Oligomer
gaggcucauuucaguaacaaagc

SEQ ID NO: 39384 - RNA, 23 nt, Artificial Sequence
  RNA Oligomer
ucuuugagacuuccaugggcaaa

SEQ ID NO: 39385 - RNA, 23 nt, Artificial Sequence
  RNA Oligomer
cuuugagacuuccaugggcaaag

SEQ ID NO: 39386 - RNA, 23 nt, Artificial Sequence
  RNA Oligomer
agccaagaguguccuuccacugg

SEQ ID NO: 39387 - RNA, 23 nt, Artificial Sequence
  RNA Oligomer
gccaagaguguccuuccacuggg

SEQ ID NO: 39388 - RNA, 23 nt, Artificial Sequence
  RNA Oligomer
ccaagaguguccuuccacugggu

SEQ ID NO: 39389 - RNA, 23 nt, Artificial Sequence
  RNA Oligomer
caagaguguccuuccacugggug

SEQ ID NO: 39390 - RNA, 23 nt, Artificial Sequence
  RNA Oligomer
aagaguguccuuccacugggugg

SEQ ID NO: 39391 - RNA, 23 nt, Artificial Sequence
  RNA Oligomer
uuggacaccuuccaaacucucac

SEQ ID NO: 39392 - RNA, 23 nt, Artificial Sequence
  RNA Oligomer
uggacaccuuccaaacucucacu

SEQ ID NO: 39393 - RNA, 23 nt, Artificial Sequence
  RNA Oligomer
ggacaccuuccaaacucucacuc

SEQ ID NO: 39394 - RNA, 23 nt, Artificial Sequence
  RNA Oligomer
gacaccuuccaaacucucacucu

SEQ ID NO: 39395 - RNA, 23 nt, Artificial Sequence
  RNA Oligomer
acaccuuccaaacucucacucua

SEQ ID NO: 39396 - RNA, 23 nt, Artificial Sequence
  RNA Oligomer
aagcuggaacugaacacaaauau

SEQ ID NO: 39397 - RNA, 23 nt, Artificial Sequence
  RNA Oligomer
agcuggaacugaacacaaauaug

SEQ ID NO: 39398 - RNA, 23 nt, Artificial Sequence
  RNA Oligomer
cuucaacugcagcugaaacauuc

SEQ ID NO: 39399 - RNA, 23 nt, Artificial Sequence
  RNA Oligomer
uucaacugcagcugaaacauucc

SEQ ID NO: 39400 - RNA, 23 nt, Artificial Sequence
  RNA Oligomer
aaccuauaugccagcuggaagug

SEQ ID NO: 39401 - RNA, 23 nt, Artificial Sequence
  RNA Oligomer
ugaggggaaaagacaagaugugg

SEQ ID NO: 39402 - RNA, 23 nt, Artificial Sequence
  RNA Oligomer
gaggggaaaagacaagauguggu

SEQ ID NO: 39403 - RNA, 23 nt, Artificial Sequence
  RNA Oligomer
uuugagacuuccaugggcaaaga

SEQ ID NO: 39404 - RNA, 23 nt, Artificial Sequence
  RNA Oligomer
agguacaaaugcaaggcaauguu

SEQ ID NO: 39405 - RNA, 23 nt, Artificial Sequence
  RNA Oligomer
gguacaaaugcaaggcaauguug

SEQ ID NO: 39406 - RNA, 23 nt, Artificial Sequence
  RNA Oligomer
guacaaaugcaaggcaauguugg

SEQ ID NO: 39407 - RNA, 23 nt, Artificial Sequence
  RNA Oligomer
uacaaaugcaaggcaauguuggc

SEQ ID NO: 39408 - RNA, 23 nt, Artificial Sequence
  RNA Oligomer
ucccauccacaccauagauggcg

SEQ ID NO: 39409 - RNA, 23 nt, Artificial Sequence
  RNA Oligomer
cccauccacaccauagauggcgc

SEQ ID NO: 39410 - RNA, 23 nt, Artificial Sequence
  RNA Oligomer
ccauccacaccauagauggcgcc

SEQ ID NO: 39411 - RNA, 23 nt, Artificial Sequence
  RNA Oligomer
cauccacaccauagauggcgccc

SEQ ID NO: 39412 - RNA, 23 nt, Artificial Sequence
  RNA Oligomer
auccacaccauagauggcgcccu

SEQ ID NO: 39413 - RNA, 23 nt, Artificial Sequence
  RNA Oligomer
cagacuggaggaagaaagaaugg

SEQ ID NO: 39414 - RNA, 23 nt, Artificial Sequence
  RNA Oligomer
agacuggaggaagaaagaaugga

SEQ ID NO: 39415 - RNA, 23 nt, Artificial Sequence
  RNA Oligomer
gacuggaggaagaaagaauggaa

SEQ ID NO: 39416 - RNA, 23 nt, Artificial Sequence
  RNA Oligomer
acuggaggaagaaagaauggaag

SEQ ID NO: 39417 - RNA, 23 nt, Artificial Sequence
  RNA Oligomer
cuggaggaagaaagaauggaagu

SEQ ID NO: 39418 - RNA, 23 nt, Artificial Sequence
  RNA Oligomer
uggaggaagaaagaauggaaguu

SEQ ID NO: 39419 - RNA, 23 nt, Artificial Sequence
  RNA Oligomer
gggaaguuucagauaagcaggga

SEQ ID NO: 39420 - RNA, 23 nt, Artificial Sequence
  RNA Oligomer
ggaaguuucagauaagcagggau

SEQ ID NO: 39421 - RNA, 23 nt, Artificial Sequence
  RNA Oligomer
gaaguuucagauaagcagggaua

SEQ ID NO: 39422 - RNA, 23 nt, Artificial Sequence
  RNA Oligomer
aaguuucagauaagcagggauaa

SEQ ID NO: 39423 - RNA, 23 nt, Artificial Sequence
  RNA Oligomer
gguuacagagucuagggaaacac

SEQ ID NO: 39424 - RNA, 23 nt, Artificial Sequence
  RNA Oligomer
guuacagagucuagggaaacaca

SEQ ID NO: 39425 - RNA, 23 nt, Artificial Sequence
  RNA Oligomer
uuacagagucuagggaaacacac

SEQ ID NO: 39426 - RNA, 23 nt, Artificial Sequence
  RNA Oligomer
uacagagucuagggaaacacacc

SEQ ID NO: 39427 - RNA, 23 nt, Artificial Sequence
  RNA Oligomer
acagagucuagggaaacacacca

SEQ ID NO: 39428 - RNA, 23 nt, Artificial Sequence
  RNA Oligomer
cuguguuuacaacuucacuuguc

SEQ ID NO: 39429 - RNA, 23 nt, Artificial Sequence
  RNA Oligomer
auucugcaguuucucuugcauuu

SEQ ID NO: 39430 - RNA, 23 nt, Artificial Sequence
  RNA Oligomer
gcaccuugacuacuacaggccua

SEQ ID NO: 39431 - RNA, 23 nt, Artificial Sequence
  RNA Oligomer
aagcagggauaaagguuucuagg

SEQ ID NO: 39432 - RNA, 23 nt, Artificial Sequence
  RNA Oligomer
uggcacugaaauaaaagccacau

SEQ ID NO: 39433 - RNA, 23 nt, Artificial Sequence
  RNA Oligomer
agccaacaggaugaaaugaaggu

SEQ ID NO: 39434 - RNA, 23 nt, Artificial Sequence
  RNA Oligomer
gccaacaggaugaaaugaaggua

SEQ ID NO: 39435 - RNA, 23 nt, Artificial Sequence
  RNA Oligomer
ccaacaggaugaaaugaagguaa

SEQ ID NO: 39436 - RNA, 23 nt, Artificial Sequence
  RNA Oligomer
caacaggaugaaaugaagguaaa

SEQ ID NO: 39437 - RNA, 23 nt, Artificial Sequence
  RNA Oligomer
aacaggaugaaaugaagguaaag

SEQ ID NO: 39438 - RNA, 23 nt, Artificial Sequence
  RNA Oligomer
aacaaagcucagagaaacaacca

SEQ ID NO: 39439 - RNA, 23 nt, Artificial Sequence
  RNA Oligomer
acaaagcucagagaaacaaccaa

SEQ ID NO: 39440 - RNA, 23 nt, Artificial Sequence
  RNA Oligomer
caaagcucagagaaacaaccaac

SEQ ID NO: 39441 - RNA, 23 nt, Artificial Sequence
  RNA Oligomer
augucuacauuaaauuuggacac

SEQ ID NO: 39442 - RNA, 23 nt, Artificial Sequence
  RNA Oligomer
gggcuucacagaaaaggagcugg

SEQ ID NO: 39443 - RNA, 23 nt, Artificial Sequence
  RNA Oligomer
ggcuucacagaaaaggagcuggc

SEQ ID NO: 39444 - RNA, 23 nt, Artificial Sequence
  RNA Oligomer
gcuucacagaaaaggagcuggcc

SEQ ID NO: 39445 - RNA, 23 nt, Artificial Sequence
  RNA Oligomer
cuucacagaaaaggagcuggccu

SEQ ID NO: 39446 - RNA, 23 nt, Artificial Sequence
  RNA Oligomer
uucacagaaaaggagcuggccug

SEQ ID NO: 39447 - RNA, 23 nt, Artificial Sequence
  RNA Oligomer
ucacagaaaaggagcuggccugg

SEQ ID NO: 39448 - RNA, 23 nt, Artificial Sequence
  RNA Oligomer
aggaaacaagucugggagauucc

SEQ ID NO: 39449 - RNA, 23 nt, Artificial Sequence
  RNA Oligomer
ggaaacaagucugggagauuccc

SEQ ID NO: 39450 - RNA, 23 nt, Artificial Sequence
  RNA Oligomer
gaaacaagucugggagauuccca

SEQ ID NO: 39451 - RNA, 23 nt, Artificial Sequence
  RNA Oligomer
aaacaagucugggagauucccac

SEQ ID NO: 39452 - RNA, 23 nt, Artificial Sequence
  RNA Oligomer
aacaagucugggagauucccaca

SEQ ID NO: 39453 - RNA, 23 nt, Artificial Sequence
  RNA Oligomer
ccuuaaccagcaugucggccacg

SEQ ID NO: 39454 - RNA, 23 nt, Artificial Sequence
  RNA Oligomer
cuuaaccagcaugucggccacgu

SEQ ID NO: 39455 - RNA, 23 nt, Artificial Sequence
  RNA Oligomer
uuaaccagcaugucggccacgug

SEQ ID NO: 39456 - RNA, 23 nt, Artificial Sequence
  RNA Oligomer
aauucgcucaacaacagcuguuu

SEQ ID NO: 39457 - RNA, 23 nt, Artificial Sequence
  RNA Oligomer
auucgcucaacaacagcuguuug

SEQ ID NO: 39458 - RNA, 23 nt, Artificial Sequence
  RNA Oligomer
gugcagguaacugugcaaaauuc

SEQ ID NO: 39459 - RNA, 23 nt, Artificial Sequence
  RNA Oligomer
ugcagguaacugugcaaaauucu

SEQ ID NO: 39460 - RNA, 23 nt, Artificial Sequence
  RNA Oligomer
gcagguaacugugcaaaauucug

SEQ ID NO: 39461 - RNA, 23 nt, Artificial Sequence
  RNA Oligomer
cagguaacugugcaaaauucugc

SEQ ID NO: 39462 - RNA, 23 nt, Artificial Sequence
  RNA Oligomer
agguaacugugcaaaauucugca

SEQ ID NO: 39463 - RNA, 23 nt, Artificial Sequence
  RNA Oligomer
gguaacugugcaaaauucugcag

SEQ ID NO: 39464 - RNA, 23 nt, Artificial Sequence
  RNA Oligomer
guaacugugcaaaauucugcagu

SEQ ID NO: 39465 - RNA, 23 nt, Artificial Sequence
  RNA Oligomer
uaacugugcaaaauucugcaguu

SEQ ID NO: 39466 - RNA, 23 nt, Artificial Sequence
  RNA Oligomer
gcccaaaagcuugaagaggguga

SEQ ID NO: 39467 - RNA, 23 nt, Artificial Sequence
  RNA Oligomer
cccaaaagcuugaagagggugac

SEQ ID NO: 39468 - RNA, 23 nt, Artificial Sequence
  RNA Oligomer
ccaaaagcuugaagagggugacu

SEQ ID NO: 39469 - RNA, 23 nt, Artificial Sequence
  RNA Oligomer
caaaagcuugaagagggugacua

SEQ ID NO: 39470 - RNA, 23 nt, Artificial Sequence
  RNA Oligomer
aaaagcuugaagagggugacuag

SEQ ID NO: 39471 - RNA, 23 nt, Artificial Sequence
  RNA Oligomer
caaacaaauauuuauugagcacc

SEQ ID NO: 39472 - RNA, 23 nt, Artificial Sequence
  RNA Oligomer
aaacaaauauuuauugagcaccu

SEQ ID NO: 39473 - RNA, 23 nt, Artificial Sequence
  RNA Oligomer
aacaaauauuuauugagcaccuu

SEQ ID NO: 39474 - RNA, 23 nt, Artificial Sequence
  RNA Oligomer
acaaauauuuauugagcaccuug

SEQ ID NO: 39475 - RNA, 23 nt, Artificial Sequence
  RNA Oligomer
caaauauuuauugagcaccuuga

SEQ ID NO: 39476 - RNA, 23 nt, Artificial Sequence
  RNA Oligomer
gaggaagaaggacaccaccugag

SEQ ID NO: 39477 - RNA, 23 nt, Artificial Sequence
  RNA Oligomer
aggaagaaggacaccaccugagu

SEQ ID NO: 39478 - RNA, 23 nt, Artificial Sequence
  RNA Oligomer
ggaagaaggacaccaccugaguc

SEQ ID NO: 39479 - RNA, 23 nt, Artificial Sequence
  RNA Oligomer
gaagaaggacaccaccugaguca

SEQ ID NO: 39480 - RNA, 23 nt, Artificial Sequence
  RNA Oligomer
aagaaggacaccaccugagucaa

SEQ ID NO: 39481 - RNA, 23 nt, Artificial Sequence
  RNA Oligomer
gauucuagacagauuugguggca

SEQ ID NO: 39482 - RNA, 23 nt, Artificial Sequence
  RNA Oligomer
acaaaugcaaggcaauguuggcu

SEQ ID NO: 39483 - RNA, 23 nt, Artificial Sequence
  RNA Oligomer
caaaugcaaggcaauguuggcug

SEQ ID NO: 39484 - RNA, 23 nt, Artificial Sequence
  RNA Oligomer
aaaugcaaggcaauguuggcuga

SEQ ID NO: 39485 - RNA, 23 nt, Artificial Sequence
  RNA Oligomer
aagcaaucacuaaagugccaucu

SEQ ID NO: 39486 - RNA, 23 nt, Artificial Sequence
  RNA Oligomer
agcaaucacuaaagugccaucua

SEQ ID NO: 39487 - RNA, 23 nt, Artificial Sequence
  RNA Oligomer
gcaaucacuaaagugccaucuac

SEQ ID NO: 39488 - RNA, 23 nt, Artificial Sequence
  RNA Oligomer
caaucacuaaagugccaucuaca

SEQ ID NO: 39489 - RNA, 23 nt, Artificial Sequence
  RNA Oligomer
aaucacuaaagugccaucuacaa

SEQ ID NO: 39490 - RNA, 23 nt, Artificial Sequence
  RNA Oligomer
gugcauccugaagaucaaaggcu

SEQ ID NO: 39491 - RNA, 23 nt, Artificial Sequence
  RNA Oligomer
ugcauccugaagaucaaaggcuc

SEQ ID NO: 39492 - RNA, 23 nt, Artificial Sequence
  RNA Oligomer
gcauccugaagaucaaaggcucu

SEQ ID NO: 39493 - RNA, 23 nt, Artificial Sequence
  RNA Oligomer
cauccugaagaucaaaggcucua

SEQ ID NO: 39494 - RNA, 23 nt, Artificial Sequence
  RNA Oligomer
auccugaagaucaaaggcucuau

SEQ ID NO: 39495 - RNA, 23 nt, Artificial Sequence
  RNA Oligomer
ggccacgugcauaucacaagccc

SEQ ID NO: 39496 - RNA, 23 nt, Artificial Sequence
  RNA Oligomer
gccacgugcauaucacaagcccg

SEQ ID NO: 39497 - RNA, 23 nt, Artificial Sequence
  RNA Oligomer
ccacgugcauaucacaagcccgc

SEQ ID NO: 39498 - RNA, 23 nt, Artificial Sequence
  RNA Oligomer
cacgugcauaucacaagcccgcu

SEQ ID NO: 39499 - RNA, 23 nt, Artificial Sequence
  RNA Oligomer
acgugcauaucacaagcccgcuc

SEQ ID NO: 39500 - RNA, 23 nt, Artificial Sequence
  RNA Oligomer
cuucggcaacuuuucuuuaccgg

SEQ ID NO: 39501 - RNA, 23 nt, Artificial Sequence
  RNA Oligomer
uucggcaacuuuucuuuaccggc

SEQ ID NO: 39502 - RNA, 23 nt, Artificial Sequence
  RNA Oligomer
cucgguucuuuuuuagaguuucc

SEQ ID NO: 39503 - RNA, 23 nt, Artificial Sequence
  RNA Oligomer
ucgguucuuuuuuagaguuuccu

SEQ ID NO: 39504 - RNA, 23 nt, Artificial Sequence
  RNA Oligomer
gaguuuccugaugaugaggaugc

SEQ ID NO: 39505 - RNA, 23 nt, Artificial Sequence
  RNA Oligomer
aguuuccugaugaugaggaugca

SEQ ID NO: 39506 - RNA, 23 nt, Artificial Sequence
  RNA Oligomer
guuuccugaugaugaggaugcau

SEQ ID NO: 39507 - RNA, 23 nt, Artificial Sequence
  RNA Oligomer
uuuccugaugaugaggaugcaug

SEQ ID NO: 39508 - RNA, 23 nt, Artificial Sequence
  RNA Oligomer
aaauauuuauugagcaccuugac

SEQ ID NO: 39509 - RNA, 23 nt, Artificial Sequence
  RNA Oligomer
aauauuuauugagcaccuugacu

SEQ ID NO: 39510 - RNA, 23 nt, Artificial Sequence
  RNA Oligomer
gugaaggaaguuaucucacacau

SEQ ID NO: 39511 - RNA, 23 nt, Artificial Sequence
  RNA Oligomer
ugaaggaaguuaucucacacaug

SEQ ID NO: 39512 - RNA, 23 nt, Artificial Sequence
  RNA Oligomer
agucuagggaaacacaccauucu

SEQ ID NO: 39513 - RNA, 23 nt, Artificial Sequence
  RNA Oligomer
gucuagggaaacacaccauucuu

SEQ ID NO: 39514 - RNA, 23 nt, Artificial Sequence
  RNA Oligomer
ucuagggaaacacaccauucuuc

SEQ ID NO: 39515 - RNA, 23 nt, Artificial Sequence
  RNA Oligomer
cuagggaaacacaccauucuucc

SEQ ID NO: 39516 - RNA, 23 nt, Artificial Sequence
  RNA Oligomer
uagggaaacacaccauucuuccu

SEQ ID NO: 39517 - RNA, 23 nt, Artificial Sequence
  RNA Oligomer
cucacucuaggacaaaaagggcg

SEQ ID NO: 39518 - RNA, 23 nt, Artificial Sequence
  RNA Oligomer
caaggugaugauguccuucucca

SEQ ID NO: 39519 - RNA, 23 nt, Artificial Sequence
  RNA Oligomer
aaggugaugauguccuucuccag

SEQ ID NO: 39520 - RNA, 23 nt, Artificial Sequence
  RNA Oligomer
aggugaugauguccuucuccaga

SEQ ID NO: 39521 - RNA, 23 nt, Artificial Sequence
  RNA Oligomer
auaaaagcaaucacuaaagugcc

SEQ ID NO: 39522 - RNA, 23 nt, Artificial Sequence
  RNA Oligomer
uaaaagcaaucacuaaagugcca

SEQ ID NO: 39523 - RNA, 23 nt, Artificial Sequence
  RNA Oligomer
aaaagcaaucacuaaagugccau

SEQ ID NO: 39524 - RNA, 23 nt, Artificial Sequence
  RNA Oligomer
aaagcaaucacuaaagugccauc

SEQ ID NO: 39525 - RNA, 23 nt, Artificial Sequence
  RNA Oligomer
aauagguccaaccaaggcuggcu

SEQ ID NO: 39526 - RNA, 23 nt, Artificial Sequence
  RNA Oligomer
cggccacgugcauaucacaagcc

SEQ ID NO: 39527 - RNA, 23 nt, Artificial Sequence
  RNA Oligomer
cuugaagagggugacuagaguac

SEQ ID NO: 39528 - RNA, 23 nt, Artificial Sequence
  RNA Oligomer
uugaagagggugacuagaguacu

SEQ ID NO: 39529 - RNA, 23 nt, Artificial Sequence
  RNA Oligomer
ugaagagggugacuagaguacug

SEQ ID NO: 39530 - RNA, 23 nt, Artificial Sequence
  RNA Oligomer
gaagagggugacuagaguacugu

SEQ ID NO: 39531 - RNA, 23 nt, Artificial Sequence
  RNA Oligomer
aagagggugacuagaguacugug

SEQ ID NO: 39532 - RNA, 23 nt, Artificial Sequence
  RNA Oligomer
aacaaacaagguuucugcccuca

SEQ ID NO: 39533 - RNA, 23 nt, Artificial Sequence
  RNA Oligomer
acaaacaagguuucugcccucau

SEQ ID NO: 39534 - RNA, 23 nt, Artificial Sequence
  RNA Oligomer
caaacaagguuucugcccucauu

SEQ ID NO: 39535 - RNA, 23 nt, Artificial Sequence
  RNA Oligomer
aaacaagguuucugcccucauuu

SEQ ID NO: 39536 - RNA, 23 nt, Artificial Sequence
  RNA Oligomer
cacagaaggcaucaaaagcuugg

SEQ ID NO: 39537 - RNA, 23 nt, Artificial Sequence
  RNA Oligomer
acagaaggcaucaaaagcuuggg

SEQ ID NO: 39538 - RNA, 23 nt, Artificial Sequence
  RNA Oligomer
cagaaggcaucaaaagcuugggg

SEQ ID NO: 39539 - RNA, 23 nt, Artificial Sequence
  RNA Oligomer
agaaggcaucaaaagcuugggga

SEQ ID NO: 39540 - RNA, 23 nt, Artificial Sequence
  RNA Oligomer
gaaggcaucaaaagcuuggggac

SEQ ID NO: 39541 - RNA, 23 nt, Artificial Sequence
  RNA Oligomer
aagaacagggaaguugggaaguu

SEQ ID NO: 39542 - RNA, 23 nt, Artificial Sequence
  RNA Oligomer
ugaagcagggagauaagcuagga

SEQ ID NO: 39543 - RNA, 23 nt, Artificial Sequence
  RNA Oligomer
gaagcagggagauaagcuaggaa

SEQ ID NO: 39544 - RNA, 23 nt, Artificial Sequence
  RNA Oligomer
aagcagggagauaagcuaggaag

SEQ ID NO: 39545 - RNA, 23 nt, Artificial Sequence
  RNA Oligomer
uuccacauucuggcugaaacugc

SEQ ID NO: 39546 - RNA, 23 nt, Artificial Sequence
  RNA Oligomer
uccacauucuggcugaaacugcc

SEQ ID NO: 39547 - RNA, 23 nt, Artificial Sequence
  RNA Oligomer
ccacauucuggcugaaacugccc

SEQ ID NO: 39548 - RNA, 23 nt, Artificial Sequence
  RNA Oligomer
cacauucuggcugaaacugccca

SEQ ID NO: 39549 - RNA, 23 nt, Artificial Sequence
  RNA Oligomer
acauucuggcugaaacugcccac

SEQ ID NO: 39550 - RNA, 23 nt, Artificial Sequence
  RNA Oligomer
gggagagagauggacguuucuca

SEQ ID NO: 39551 - RNA, 23 nt, Artificial Sequence
  RNA Oligomer
ggagagagauggacguuucucag

SEQ ID NO: 39552 - RNA, 23 nt, Artificial Sequence
  RNA Oligomer
gagagagauggacguuucucagg

SEQ ID NO: 39553 - RNA, 23 nt, Artificial Sequence
  RNA Oligomer
aaugcaaggcaauguuggcugac

SEQ ID NO: 39554 - RNA, 23 nt, Artificial Sequence
  RNA Oligomer
cucucacucuaggacaaaaaggg

SEQ ID NO: 39555 - RNA, 23 nt, Artificial Sequence
  RNA Oligomer
ucucacucuaggacaaaaagggc

SEQ ID NO: 39556 - RNA, 23 nt, Artificial Sequence
  RNA Oligomer
aauaaaagcaaucacuaaagugc

SEQ ID NO: 39557 - RNA, 23 nt, Artificial Sequence
  RNA Oligomer
aaacauuccuggcaauaggucca

SEQ ID NO: 39558 - RNA, 23 nt, Artificial Sequence
  RNA Oligomer
aacauuccuggcaauagguccaa

SEQ ID NO: 39559 - RNA, 23 nt, Artificial Sequence
  RNA Oligomer
acauuccuggcaauagguccaac

SEQ ID NO: 39560 - RNA, 23 nt, Artificial Sequence
  RNA Oligomer
cauuccuggcaauagguccaacc

SEQ ID NO: 39561 - RNA, 23 nt, Artificial Sequence
  RNA Oligomer
auuccuggcaauagguccaacca

SEQ ID NO: 39562 - RNA, 23 nt, Artificial Sequence
  RNA Oligomer
cagaaaacacuugagcaagagcc

SEQ ID NO: 39563 - RNA, 23 nt, Artificial Sequence
  RNA Oligomer
agaaaacacuugagcaagagccu

SEQ ID NO: 39564 - RNA, 23 nt, Artificial Sequence
  RNA Oligomer
gaaaacacuugagcaagagccuc

SEQ ID NO: 39565 - RNA, 23 nt, Artificial Sequence
  RNA Oligomer
aaaacacuugagcaagagccucg

SEQ ID NO: 39566 - RNA, 23 nt, Artificial Sequence
  RNA Oligomer
aaacacuugagcaagagccucga

SEQ ID NO: 39567 - RNA, 23 nt, Artificial Sequence
  RNA Oligomer
ccaggaaccucguuugguguucc

SEQ ID NO: 39568 - RNA, 23 nt, Artificial Sequence
  RNA Oligomer
caggaaccucguuugguguuccg

SEQ ID NO: 39569 - RNA, 23 nt, Artificial Sequence
  RNA Oligomer
aggaaccucguuugguguuccgc

SEQ ID NO: 39570 - RNA, 23 nt, Artificial Sequence
  RNA Oligomer
ggaaccucguuugguguuccgca

SEQ ID NO: 39571 - RNA, 23 nt, Artificial Sequence
  RNA Oligomer
gaaccucguuugguguuccgcau

SEQ ID NO: 39572 - RNA, 23 nt, Artificial Sequence
  RNA Oligomer
aaccucguuugguguuccgcaug

SEQ ID NO: 39573 - RNA, 23 nt, Artificial Sequence
  RNA Oligomer
agaguuuacauuuuaaaugaggg

SEQ ID NO: 39574 - RNA, 23 nt, Artificial Sequence
  RNA Oligomer
agcaagaaaucaccauuuaauga

SEQ ID NO: 39575 - RNA, 23 nt, Artificial Sequence
  RNA Oligomer
uuccaugggcaaagaucaauaag

SEQ ID NO: 39576 - RNA, 23 nt, Artificial Sequence
  RNA Oligomer
acucucacucuaggacaaaaagg

SEQ ID NO: 39577 - RNA, 23 nt, Artificial Sequence
  RNA Oligomer
ugaagugcagguugauugaauga

SEQ ID NO: 39578 - RNA, 23 nt, Artificial Sequence
  RNA Oligomer
augccacacacucccaauauccu

SEQ ID NO: 39579 - RNA, 23 nt, Artificial Sequence
  RNA Oligomer
ugauggugaauaaaacaaacaag

SEQ ID NO: 39580 - RNA, 23 nt, Artificial Sequence
  RNA Oligomer
aacucucacucuaggacaaaaag

SEQ ID NO: 39581 - RNA, 23 nt, Artificial Sequence
  RNA Oligomer
caugccacacacucccaauaucc

SEQ ID NO: 39582 - RNA, 23 nt, Artificial Sequence
  RNA Oligomer
caugauggugaauaaaacaaaca

SEQ ID NO: 39583 - RNA, 23 nt, Artificial Sequence
  RNA Oligomer
aggaugaaaugaagguaaagaag

SEQ ID NO: 39584 - RNA, 23 nt, Artificial Sequence
  RNA Oligomer
ugauugaaugaaagugggaauag

SEQ ID NO: 39585 - RNA, 23 nt, Artificial Sequence
  RNA Oligomer
aggugcgucucuagucauguuug

SEQ ID NO: 39586 - RNA, 23 nt, Artificial Sequence
  RNA Oligomer
augaugggcacaggaaacaaguc

SEQ ID NO: 39587 - RNA, 23 nt, Artificial Sequence
  RNA Oligomer
aagucugggagauucccacaucc

SEQ ID NO: 39588 - RNA, 23 nt, Artificial Sequence
  RNA Oligomer
aaccuucccgauccuugauaagu

SEQ ID NO: 39589 - RNA, 23 nt, Artificial Sequence
  RNA Oligomer
uggaaguguguuugauaaaauuc

SEQ ID NO: 39590 - RNA, 23 nt, Artificial Sequence
  RNA Oligomer
ucucaaauacuuccauacuaugu

SEQ ID NO: 39591 - RNA, 23 nt, Artificial Sequence
  RNA Oligomer
accacccaaacaaauauuuauug

SEQ ID NO: 39592 - RNA, 23 nt, Artificial Sequence
  RNA Oligomer
acaugauggugaauaaaacaaac

SEQ ID NO: 39593 - RNA, 23 nt, Artificial Sequence
  RNA Oligomer
aggagaguuuaauacugaaagag

SEQ ID NO: 39594 - RNA, 23 nt, Artificial Sequence
  RNA Oligomer
uaugagcauuuauuuggcacccg

SEQ ID NO: 39595 - RNA, 23 nt, Artificial Sequence
  RNA Oligomer
ugcagguugauugaaugaaagug

SEQ ID NO: 39596 - RNA, 23 nt, Artificial Sequence
  RNA Oligomer
uugaaugaaagugggaauaguaa

SEQ ID NO: 39597 - RNA, 23 nt, Artificial Sequence
  RNA Oligomer
uaaacugcaauaaaugcaaugag

SEQ ID NO: 39598 - RNA, 23 nt, Artificial Sequence
  RNA Oligomer
agaaacaaccaacgaaagaucuu

SEQ ID NO: 39599 - RNA, 23 nt, Artificial Sequence
  RNA Oligomer
ccacccaaacaaauauuuauuga

SEQ ID NO: 39600 - RNA, 23 nt, Artificial Sequence
  RNA Oligomer
aacaagguuucugcccucauuua

SEQ ID NO: 39601 - RNA, 23 nt, Artificial Sequence
  RNA Oligomer
uaaacaaccaaauccuggccagg

SEQ ID NO: 39602 - RNA, 23 nt, Artificial Sequence
  RNA Oligomer
auucuggcugaaacugcccacuu

SEQ ID NO: 39603 - RNA, 23 nt, Artificial Sequence
  RNA Oligomer
uucuccagaagauguucuaacaa

SEQ ID NO: 39604 - RNA, 23 nt, Artificial Sequence
  RNA Oligomer
aguugaggaguuccacauucugg

SEQ ID NO: 39605 - RNA, 23 nt, Artificial Sequence
  RNA Oligomer
acccaaacaaauauuuauugagc

SEQ ID NO: 39606 - RNA, 23 nt, Artificial Sequence
  RNA Oligomer
aacugcaauaaaugcaaugaggg

SEQ ID NO: 39607 - RNA, 23 nt, Artificial Sequence
  RNA Oligomer
aagacuugaggaagaaggacacc

SEQ ID NO: 39608 - RNA, 23 nt, Artificial Sequence
  RNA Oligomer
uucuuuccaucuuguuggucaac

SEQ ID NO: 39609 - RNA, 23 nt, Artificial Sequence
  RNA Oligomer
ucuuuccaucuuguuggucaacc

SEQ ID NO: 39610 - RNA, 23 nt, Artificial Sequence
  RNA Oligomer
cacccaaacaaauauuuauugag

SEQ ID NO: 39611 - RNA, 23 nt, Artificial Sequence
  RNA Oligomer
ucuagguugaaaacaauaacaug

SEQ ID NO: 39612 - RNA, 23 nt, Artificial Sequence
  RNA Oligomer
aauucugugccaggagcauaacc

SEQ ID NO: 39613 - RNA, 23 nt, Artificial Sequence
  RNA Oligomer
agagggugacuagaguacugugg

SEQ ID NO: 39614 - RNA, 23 nt, Artificial Sequence
  RNA Oligomer
augccagcuggaaguguguuuga

SEQ ID NO: 39615 - RNA, 23 nt, Artificial Sequence
  RNA Oligomer
aaacugcaauaaaugcaaugagg

SEQ ID NO: 39616 - RNA, 23 nt, Artificial Sequence
  RNA Oligomer
agcagggauaaagguuucuaggu

SEQ ID NO: 39617 - RNA, 23 nt, Artificial Sequence
  RNA Oligomer
gagucuagggaaacacaccauuc

SEQ ID NO: 39618 - RNA, 23 nt, Artificial Sequence
  RNA Oligomer
aaagauaggagauggucucucag

SEQ ID NO: 39619 - RNA, 23 nt, Artificial Sequence
  RNA Oligomer
ccaaacaaauauuuauugagcac

SEQ ID NO: 39620 - RNA, 23 nt, Artificial Sequence
  RNA Oligomer
aucaccauuuaaugagguucaag

SEQ ID NO: 39621 - RNA, 23 nt, Artificial Sequence
  RNA Oligomer
cauuuacaugauccuguaaagca

SEQ ID NO: 39622 - RNA, 23 nt, Artificial Sequence
  RNA Oligomer
augauccuguaaagcaggauucu

SEQ ID NO: 39623 - RNA, 23 nt, Artificial Sequence
  RNA Oligomer
augggcacaggaaacaagucugg

SEQ ID NO: 39624 - RNA, 23 nt, Artificial Sequence
  RNA Oligomer
aacaacagcuguuuggcuagcac

SEQ ID NO: 39625 - RNA, 23 nt, Artificial Sequence
  RNA Oligomer
gaacagggaaguugggaaguuuc

SEQ ID NO: 39626 - RNA, 23 nt, Artificial Sequence
  RNA Oligomer
uaagugcguucaccuuaaccagc

SEQ ID NO: 39627 - RNA, 23 nt, Artificial Sequence
  RNA Oligomer
uagaguacugugguccacauccc

SEQ ID NO: 39628 - RNA, 23 nt, Artificial Sequence
  RNA Oligomer
aaguguguuugauaaaauucagg

SEQ ID NO: 39629 - RNA, 23 nt, Artificial Sequence
  RNA Oligomer
aaguuaucucacacaugauaugu

SEQ ID NO: 39630 - RNA, 23 nt, Artificial Sequence
  RNA Oligomer
uaaauuuggacaccuuccaaacu

SEQ ID NO: 39631 - RNA, 23 nt, Artificial Sequence
  RNA Oligomer
aagauaggagauggucucucaga

SEQ ID NO: 39632 - RNA, 23 nt, Artificial Sequence
  RNA Oligomer
aucuccuugcaccgguggaauuc

SEQ ID NO: 39633 - RNA, 23 nt, Artificial Sequence
  RNA Oligomer
auguaccaggaaccucguuuggu

SEQ ID NO: 39634 - RNA, 23 nt, Artificial Sequence
  RNA Oligomer
auccugcgugguucuuuccaucu

SEQ ID NO: 39635 - RNA, 23 nt, Artificial Sequence
  RNA Oligomer
caaagagcugaaaaaccucuugg

SEQ ID NO: 39636 - RNA, 23 nt, Artificial Sequence
  RNA Oligomer
aguuaucucacacaugauauguc

SEQ ID NO: 39637 - RNA, 23 nt, Artificial Sequence
  RNA Oligomer
aggaacauuuuaucaaaagguag

SEQ ID NO: 39638 - RNA, 23 nt, Artificial Sequence
  RNA Oligomer
aaucaccauuuaaugagguucaa

SEQ ID NO: 39639 - RNA, 23 nt, Artificial Sequence
  RNA Oligomer
aaguugaggaguuccacauucug

SEQ ID NO: 39640 - RNA, 23 nt, Artificial Sequence
  RNA Oligomer
guugaggaguuccacauucuggc

SEQ ID NO: 39641 - RNA, 23 nt, Artificial Sequence
  RNA Oligomer
agggagagagauggacguuucuc

SEQ ID NO: 39642 - RNA, 23 nt, Artificial Sequence
  RNA Oligomer
aaauuuggacaccuuccaaacuc

SEQ ID NO: 39643 - RNA, 23 nt, Artificial Sequence
  RNA Oligomer
aauuuggacaccuuccaaacucu

SEQ ID NO: 39644 - RNA, 23 nt, Artificial Sequence
  RNA Oligomer
auucugugccaggagcauaaccu

SEQ ID NO: 39645 - RNA, 23 nt, Artificial Sequence
  RNA Oligomer
ugauaagugcguucaccuuaacc

SEQ ID NO: 39646 - RNA, 23 nt, Artificial Sequence
  RNA Oligomer
gauguaccaggaaccucguuugg

SEQ ID NO: 39647 - RNA, 23 nt, Artificial Sequence
  RNA Oligomer
acaacagcuguuuggcuagcacc

SEQ ID NO: 39648 - RNA, 23 nt, Artificial Sequence
  RNA Oligomer
acugugcaaaauucugcaguuuc

SEQ ID NO: 39649 - RNA, 23 nt, Artificial Sequence
  RNA Oligomer
cugugcaaaauucugcaguuucu

SEQ ID NO: 39650 - RNA, 23 nt, Artificial Sequence
  RNA Oligomer
uaugccagcuggaaguguguuug

SEQ ID NO: 39651 - RNA, 23 nt, Artificial Sequence
  RNA Oligomer
auccguguauauugucaaaagga

SEQ ID NO: 39652 - RNA, 23 nt, Artificial Sequence
  RNA Oligomer
uuacaugauccuguaaagcagga

SEQ ID NO: 39653 - RNA, 23 nt, Artificial Sequence
  RNA Oligomer
agcagggagauaagcuaggaagc

SEQ ID NO: 39654 - RNA, 23 nt, Artificial Sequence
  RNA Oligomer
gagaaacaaccaacgaaagaucu

SEQ ID NO: 39655 - RNA, 23 nt, Artificial Sequence
  RNA Oligomer
ugaaacauuccuggcaauagguc

SEQ ID NO: 39656 - RNA, 23 nt, Artificial Sequence
  RNA Oligomer
gaaacauuccuggcaauaggucc

SEQ ID NO: 39657 - RNA, 23 nt, Artificial Sequence
  RNA Oligomer
ucuacaggcaaagggcuucacag

SEQ ID NO: 39658 - RNA, 23 nt, Artificial Sequence
  RNA Oligomer
ucugugccaggagcauaaccuuc

SEQ ID NO: 39659 - RNA, 23 nt, Artificial Sequence
  RNA Oligomer
ucagaaaacacuugagcaagagc

SEQ ID NO: 39660 - RNA, 23 nt, Artificial Sequence
  RNA Oligomer
aacagcuguuuggcuagcaccac

SEQ ID NO: 39661 - RNA, 23 nt, Artificial Sequence
  RNA Oligomer
agagcugaaaaaccucuuggagc

SEQ ID NO: 39662 - RNA, 23 nt, Artificial Sequence
  RNA Oligomer
acucgguucuuuuuuagaguuuc

SEQ ID NO: 39663 - RNA, 23 nt, Artificial Sequence
  RNA Oligomer
acaggccuagcauuuugcuaggg

SEQ ID NO: 39664 - RNA, 23 nt, Artificial Sequence
  RNA Oligomer
caggccuagcauuuugcuaggga

SEQ ID NO: 39665 - RNA, 23 nt, Artificial Sequence
  RNA Oligomer
uaaagguuucuagguugaaaaca

SEQ ID NO: 39666 - RNA, 23 nt, Artificial Sequence
  RNA Oligomer
ugaggaguuccacauucuggcug

SEQ ID NO: 39667 - RNA, 23 nt, Artificial Sequence
  RNA Oligomer
auuuacaugauccuguaaagcag

SEQ ID NO: 39668 - RNA, 23 nt, Artificial Sequence
  RNA Oligomer
uuuacaugauccuguaaagcagg

SEQ ID NO: 39669 - RNA, 23 nt, Artificial Sequence
  RNA Oligomer
uccagaagauguucuaacaauuc

SEQ ID NO: 39670 - RNA, 23 nt, Artificial Sequence
  RNA Oligomer
uuccuggcaauagguccaaccaa

SEQ ID NO: 39671 - RNA, 23 nt, Artificial Sequence
  RNA Oligomer
aacagaaaccgugcauccugaag

SEQ ID NO: 39672 - RNA, 23 nt, Artificial Sequence
  RNA Oligomer
gauaagugcguucaccuuaacca

SEQ ID NO: 39673 - RNA, 23 nt, Artificial Sequence
  RNA Oligomer
ugguucuuuccaucuuguugguc

SEQ ID NO: 39674 - RNA, 23 nt, Artificial Sequence
  RNA Oligomer
ugaagaacauuuuugguuuguuc

SEQ ID NO: 39675 - RNA, 23 nt, Artificial Sequence
  RNA Oligomer
ucucuugcauuuccugugcaguc

SEQ ID NO: 39676 - RNA, 23 nt, Artificial Sequence
  RNA Oligomer
guucuuucucuccagugaagugc

SEQ ID NO: 39677 - RNA, 23 nt, Artificial Sequence
  RNA Oligomer
ugaagugcacauugcucaacacc

SEQ ID NO: 39678 - RNA, 23 nt, Artificial Sequence
  RNA Oligomer
aguguguuugauaaaauucagga

SEQ ID NO: 39679 - RNA, 23 nt, Artificial Sequence
  RNA Oligomer
uaugucgacccaaaggcaggacu

SEQ ID NO: 39680 - RNA, 23 nt, Artificial Sequence
  RNA Oligomer
cauuuuaucaaaagguaggauug

SEQ ID NO: 39681 - RNA, 23 nt, Artificial Sequence
  RNA Oligomer
auugucaagacuugaggaagaag

SEQ ID NO: 39682 - RNA, 23 nt, Artificial Sequence
  RNA Oligomer
uuaaacaaccaaauccuggccag

SEQ ID NO: 39683 - RNA, 23 nt, Artificial Sequence
  RNA Oligomer
auguccuucuccagaagauguuc

SEQ ID NO: 39684 - RNA, 23 nt, Artificial Sequence
  RNA Oligomer
aaaagauaggagauggucucuca

SEQ ID NO: 39685 - RNA, 23 nt, Artificial Sequence
  RNA Oligomer
cauggacgucauagcccaaaagc

SEQ ID NO: 39686 - RNA, 23 nt, Artificial Sequence
  RNA Oligomer
auggacgucauagcccaaaagcu

SEQ ID NO: 39687 - RNA, 23 nt, Artificial Sequence
  RNA Oligomer
aaagcuugaagagggugacuaga

SEQ ID NO: 39688 - RNA, 23 nt, Artificial Sequence
  RNA Oligomer
aagcuugaagagggugacuagag

SEQ ID NO: 39689 - RNA, 23 nt, Artificial Sequence
  RNA Oligomer
augagcauuuauuuggcacccga

SEQ ID NO: 39690 - RNA, 23 nt, Artificial Sequence
  RNA Oligomer
uauuuggcacccgauggcaauac

SEQ ID NO: 39691 - RNA, 23 nt, Artificial Sequence
  RNA Oligomer
cuaagguuggcuugccuucuucc

SEQ ID NO: 39692 - RNA, 23 nt, Artificial Sequence
  RNA Oligomer
acuacucuguuaugugagaacag

SEQ ID NO: 39693 - RNA, 23 nt, Artificial Sequence
  RNA Oligomer
cuagguugaaaacaauaacaugu

SEQ ID NO: 39694 - RNA, 23 nt, Artificial Sequence
  RNA Oligomer
uucuggcugaaacugcccacuuu

SEQ ID NO: 39695 - RNA, 23 nt, Artificial Sequence
  RNA Oligomer
auaagcuaggaagcuuuucuaga

SEQ ID NO: 39696 - RNA, 23 nt, Artificial Sequence
  RNA Oligomer
auuuggacaccuuccaaacucuc

SEQ ID NO: 39697 - RNA, 23 nt, Artificial Sequence
  RNA Oligomer
uucgcucaacaacagcuguuugg

SEQ ID NO: 39698 - RNA, 23 nt, Artificial Sequence
  RNA Oligomer
gaagaacauuuuugguuuguucu

SEQ ID NO: 39699 - RNA, 23 nt, Artificial Sequence
  RNA Oligomer
aagagcugaaaaaccucuuggag

SEQ ID NO: 39700 - RNA, 23 nt, Artificial Sequence
  RNA Oligomer
caccacucgguucuuuuuuagag

SEQ ID NO: 39701 - RNA, 23 nt, Artificial Sequence
  RNA Oligomer
ucauagcccaaaagcuugaagag

SEQ ID NO: 39702 - RNA, 23 nt, Artificial Sequence
  RNA Oligomer
cauagcccaaaagcuugaagagg

SEQ ID NO: 39703 - RNA, 23 nt, Artificial Sequence
  RNA Oligomer
gacugcaaccuauaugccagcug

SEQ ID NO: 39704 - RNA, 23 nt, Artificial Sequence
  RNA Oligomer
aagauguggugacagacacagaa

SEQ ID NO: 39705 - RNA, 23 nt, Artificial Sequence
  RNA Oligomer
aaggacaccaccugagucaagag

SEQ ID NO: 39706 - RNA, 23 nt, Artificial Sequence
  RNA Oligomer
aaacuacucuguuaugugagaac

SEQ ID NO: 39707 - RNA, 23 nt, Artificial Sequence
  RNA Oligomer
aacuacucuguuaugugagaaca

SEQ ID NO: 39708 - RNA, 23 nt, Artificial Sequence
  RNA Oligomer
gcauuuacaugauccuguaaagc

SEQ ID NO: 39709 - RNA, 23 nt, Artificial Sequence
  RNA Oligomer
gauaagcuaggaagcuuuucuag

SEQ ID NO: 39710 - RNA, 23 nt, Artificial Sequence
  RNA Oligomer
uuuggacaccuuccaaacucuca

SEQ ID NO: 39711 - RNA, 23 nt, Artificial Sequence
  RNA Oligomer
cgugcauccugaagaucaaaggc

SEQ ID NO: 39712 - RNA, 23 nt, Artificial Sequence
  RNA Oligomer
aguuggcguugucaaagagcuga

SEQ ID NO: 39713 - RNA, 23 nt, Artificial Sequence
  RNA Oligomer
aaagagcugaaaaaccucuugga

SEQ ID NO: 39714 - RNA, 23 nt, Artificial Sequence
  RNA Oligomer
aacugugcaaaauucugcaguuu

SEQ ID NO: 39715 - RNA, 23 nt, Artificial Sequence
  RNA Oligomer
auagcccaaaagcuugaagaggg

SEQ ID NO: 39716 - RNA, 23 nt, Artificial Sequence
  RNA Oligomer
agggugacuagaguacugugguc

SEQ ID NO: 39717 - RNA, 23 nt, Artificial Sequence
  RNA Oligomer
cuccagagcgaaauuccaguucu

SEQ ID NO: 39718 - RNA, 23 nt, Artificial Sequence
  RNA Oligomer
ucucuccagugaagugcacauug

SEQ ID NO: 39719 - RNA, 23 nt, Artificial Sequence
  RNA Oligomer
cucuccagugaagugcacauugc

SEQ ID NO: 39720 - RNA, 23 nt, Artificial Sequence
  RNA Oligomer
cuccagugaagugcacauugcuc

SEQ ID NO: 39721 - RNA, 23 nt, Artificial Sequence
  RNA Oligomer
gaagugcacauugcucaacacca

SEQ ID NO: 39722 - RNA, 23 nt, Artificial Sequence
  RNA Oligomer
gaguggaaagguucucucucuca

SEQ ID NO: 39723 - RNA, 23 nt, Artificial Sequence
  RNA Oligomer
uaagguuggcuugccuucuuccc

SEQ ID NO: 39724 - RNA, 23 nt, Artificial Sequence
  RNA Oligomer
aagacaagauguggugacagaca

SEQ ID NO: 39725 - RNA, 23 nt, Artificial Sequence
  RNA Oligomer
ucacagaaggcaucaaaagcuug

SEQ ID NO: 39726 - RNA, 23 nt, Artificial Sequence
  RNA Oligomer
guugaaaacaauaacauguaugg

SEQ ID NO: 39727 - RNA, 23 nt, Artificial Sequence
  RNA Oligomer
uugaggaguuccacauucuggcu

SEQ ID NO: 39728 - RNA, 23 nt, Artificial Sequence
  RNA Oligomer
cuaggaagcuuuucuagaaaucu

SEQ ID NO: 39729 - RNA, 23 nt, Artificial Sequence
  RNA Oligomer
augaggaugcaugccacacacuc

SEQ ID NO: 39730 - RNA, 23 nt, Artificial Sequence
  RNA Oligomer
aggagauggucucucagacaucu

SEQ ID NO: 39731 - RNA, 23 nt, Artificial Sequence
  RNA Oligomer
uaccaggaaccucguuugguguu

SEQ ID NO: 39732 - RNA, 23 nt, Artificial Sequence
  RNA Oligomer
ggccuggaugaagaacauuuuug

SEQ ID NO: 39733 - RNA, 23 nt, Artificial Sequence
  RNA Oligomer
cagagcgaaauuccaguucuuuc

SEQ ID NO: 39734 - RNA, 23 nt, Artificial Sequence
  RNA Oligomer
aagugcacauugcucaacaccag

SEQ ID NO: 39735 - RNA, 23 nt, Artificial Sequence
  RNA Oligomer
aaggcucacaaaccacccaaaca

SEQ ID NO: 39736 - RNA, 23 nt, Artificial Sequence
  RNA Oligomer
cagaaaugaacaaguaaaaguag

SEQ ID NO: 39737 - RNA, 23 nt, Artificial Sequence
  RNA Oligomer
uaggaagcuuuucuagaaaucua

SEQ ID NO: 39738 - RNA, 23 nt, Artificial Sequence
  RNA Oligomer
gagcucccucauuuccaagguga

SEQ ID NO: 39739 - RNA, 23 nt, Artificial Sequence
  RNA Oligomer
ucagagaaacaaccaacgaaaga

SEQ ID NO: 39740 - RNA, 23 nt, Artificial Sequence
  RNA Oligomer
uuugcuucuucagagccaaaaga

SEQ ID NO: 39741 - RNA, 23 nt, Artificial Sequence
  RNA Oligomer
ucuaucacaccuccuguggucca

SEQ ID NO: 39742 - RNA, 23 nt, Artificial Sequence
  RNA Oligomer
cuuuccaucuuguuggucaaccc

SEQ ID NO: 39743 - RNA, 23 nt, Artificial Sequence
  RNA Oligomer
uuuggcuagcaccacucgguucu

SEQ ID NO: 39744 - RNA, 23 nt, Artificial Sequence
  RNA Oligomer
auugcucaacaccagugcuaggc

SEQ ID NO: 39745 - RNA, 23 nt, Artificial Sequence
  RNA Oligomer
uagcuaagguuggcuugccuucu

SEQ ID NO: 39746 - RNA, 23 nt, Artificial Sequence
  RNA Oligomer
caugauccuguaaagcaggauuc

SEQ ID NO: 39747 - RNA, 23 nt, Artificial Sequence
  RNA Oligomer
uccuguaaagcaggauucuagac

SEQ ID NO: 39748 - RNA, 23 nt, Artificial Sequence
  RNA Oligomer
ugagcucccucauuuccaaggug

SEQ ID NO: 39749 - RNA, 23 nt, Artificial Sequence
  RNA Oligomer
ccaucuacaaaagcuggaacuga

SEQ ID NO: 39750 - RNA, 23 nt, Artificial Sequence
  RNA Oligomer
auaagugcguucaccuuaaccag

SEQ ID NO: 39751 - RNA, 23 nt, Artificial Sequence
  RNA Oligomer
aagugcguucaccuuaaccagca

SEQ ID NO: 39752 - RNA, 23 nt, Artificial Sequence
  RNA Oligomer
cauugcucaacaccagugcuagg

SEQ ID NO: 39753 - RNA, 23 nt, Artificial Sequence
  RNA Oligomer
ggaaguguguuugauaaaauuca

SEQ ID NO: 39754 - RNA, 23 nt, Artificial Sequence
  RNA Oligomer
agcauuuauuuggcacccgaugg

SEQ ID NO: 39755 - RNA, 23 nt, Artificial Sequence
  RNA Oligomer
uuuggcacccgauggcaauacaa

SEQ ID NO: 39756 - RNA, 23 nt, Artificial Sequence
  RNA Oligomer
gaaagguucucucucucaaauac

SEQ ID NO: 39757 - RNA, 23 nt, Artificial Sequence
  RNA Oligomer
augucgacccaaaggcaggacuu

SEQ ID NO: 39758 - RNA, 23 nt, Artificial Sequence
  RNA Oligomer
aaggagcuaaaaaugccagugga

SEQ ID NO: 39759 - RNA, 23 nt, Artificial Sequence
  RNA Oligomer
augugccaagcacuugguacaug

SEQ ID NO: 39760 - RNA, 23 nt, Artificial Sequence
  RNA Oligomer
gacagaaaugaacaaguaaaagu

SEQ ID NO: 39761 - RNA, 23 nt, Artificial Sequence
  RNA Oligomer
uguggugacagacacagaaguag

SEQ ID NO: 39762 - RNA, 23 nt, Artificial Sequence
  RNA Oligomer
aaacaaccaaauccuggccaggu

SEQ ID NO: 39763 - RNA, 23 nt, Artificial Sequence
  RNA Oligomer
gaugagcucccucauuuccaagg

SEQ ID NO: 39764 - RNA, 23 nt, Artificial Sequence
  RNA Oligomer
augagcucccucauuuccaaggu

SEQ ID NO: 39765 - RNA, 23 nt, Artificial Sequence
  RNA Oligomer
aacacuugagcaagagccucgau

SEQ ID NO: 39766 - RNA, 23 nt, Artificial Sequence
  RNA Oligomer
aagaacauuuuugguuuguucug

SEQ ID NO: 39767 - RNA, 23 nt, Artificial Sequence
  RNA Oligomer
gugaagugcacauugcucaacac

SEQ ID NO: 39768 - RNA, 23 nt, Artificial Sequence
  RNA Oligomer
aaaauccuggcagugggagugga

SEQ ID NO: 39769 - RNA, 23 nt, Artificial Sequence
  RNA Oligomer
gauuguagcuaagguuggcuugc

SEQ ID NO: 39770 - RNA, 23 nt, Artificial Sequence
  RNA Oligomer
agacagaaaugaacaaguaaaag

SEQ ID NO: 39771 - RNA, 23 nt, Artificial Sequence
  RNA Oligomer
caaaacuacucuguuaugugaga

SEQ ID NO: 39772 - RNA, 23 nt, Artificial Sequence
  RNA Oligomer
agcugaaacauuccuggcaauag

SEQ ID NO: 39773 - RNA, 23 nt, Artificial Sequence
  RNA Oligomer
ucaacaacagcuguuuggcuagc

SEQ ID NO: 39774 - RNA, 23 nt, Artificial Sequence
  RNA Oligomer
uuuugcuagggaccaugggagau

SEQ ID NO: 39775 - RNA, 23 nt, Artificial Sequence
  RNA Oligomer
cagcagccaacaggaugaaauga

SEQ ID NO: 39776 - RNA, 23 nt, Artificial Sequence
  RNA Oligomer
ccaaggugaugauguccuucucc

SEQ ID NO: 39777 - RNA, 23 nt, Artificial Sequence
  RNA Oligomer
ugaugggcacaggaaacaagucu

SEQ ID NO: 39778 - RNA, 23 nt, Artificial Sequence
  RNA Oligomer
ugcacauugcucaacaccagugc

SEQ ID NO: 39779 - RNA, 23 nt, Artificial Sequence
  RNA Oligomer
auuuauuuggcacccgauggcaa

SEQ ID NO: 39780 - RNA, 23 nt, Artificial Sequence
  RNA Oligomer
caaggagcuaaaaaugccagugg

SEQ ID NO: 39781 - RNA, 23 nt, Artificial Sequence
  RNA Oligomer
guagcuaagguuggcuugccuuc

SEQ ID NO: 39782 - RNA, 23 nt, Artificial Sequence
  RNA Oligomer
acaagauguggugacagacacag

SEQ ID NO: 39783 - RNA, 23 nt, Artificial Sequence
  RNA Oligomer
agacacagaaguagacugcucag

SEQ ID NO: 39784 - RNA, 23 nt, Artificial Sequence
  RNA Oligomer
cguuucucaggaaggaaaaagac

SEQ ID NO: 39785 - RNA, 23 nt, Artificial Sequence
  RNA Oligomer
ugauguccuucuccagaagaugu

SEQ ID NO: 39786 - RNA, 23 nt, Artificial Sequence
  RNA Oligomer
aagguuggcuugccuucuucccu

SEQ ID NO: 39787 - RNA, 23 nt, Artificial Sequence
  RNA Oligomer
ucuguuaugugagaacagacugg

SEQ ID NO: 39788 - RNA, 23 nt, Artificial Sequence
  RNA Oligomer
uuaugugagaacagacuggagga

SEQ ID NO: 39789 - RNA, 23 nt, Artificial Sequence
  RNA Oligomer
uaugugagaacagacuggaggaa

SEQ ID NO: 39790 - RNA, 23 nt, Artificial Sequence
  RNA Oligomer
uugucaggcucuucaacugcagc

SEQ ID NO: 39791 - RNA, 23 nt, Artificial Sequence
  RNA Oligomer
ucaggcucuucaacugcagcuga

SEQ ID NO: 39792 - RNA, 23 nt, Artificial Sequence
  RNA Oligomer
uguccuucuccagaagauguucu

SEQ ID NO: 39793 - RNA, 23 nt, Artificial Sequence
  RNA Oligomer
cacuugucaggcucuucaacugc

SEQ ID NO: 39794 - RNA, 23 nt, Artificial Sequence
  RNA Oligomer
gugggaguggaaagguucucucu

SEQ ID NO: 39795 - RNA, 23 nt, Artificial Sequence
  RNA Oligomer
gggagaugugaaggaaguuaucu

SEQ ID NO: 39796 - RNA, 23 nt, Artificial Sequence
  RNA Oligomer
acuaugugccaagcacuugguac

SEQ ID NO: 39797 - RNA, 23 nt, Artificial Sequence
  RNA Oligomer
guuaugugagaacagacuggagg

SEQ ID NO: 39798 - RNA, 23 nt, Artificial Sequence
  RNA Oligomer
uccuucuccagaagauguucuaa

SEQ ID NO: 39799 - RNA, 23 nt, Artificial Sequence
  RNA Oligomer
agugggaguggaaagguucucuc

SEQ ID NO: 39800 - RNA, 23 nt, Artificial Sequence
  RNA Oligomer
ugggaguggaaagguucucucuc

SEQ ID NO: 39801 - RNA, 23 nt, Artificial Sequence
  RNA Oligomer
gacagacacagaaguagacugcu

SEQ ID NO: 39802 - RNA, 23 nt, Artificial Sequence
  RNA Oligomer
aggaaaagggcaggaaagagcac

SEQ ID NO: 39803 - RNA, 23 nt, Artificial Sequence
  RNA Oligomer
aaaccucuuggagcuggagcagu

SEQ ID NO: 39804 - RNA, 23 nt, Artificial Sequence
  RNA Oligomer
ucaaggagcuaaaaaugccagug

SEQ ID NO: 39805 - RNA, 23 nt, Artificial Sequence
  RNA Oligomer
auuguagcuaagguuggcuugcc

SEQ ID NO: 39806 - RNA, 23 nt, Artificial Sequence
  RNA Oligomer
ugacagacacagaaguagacugc

SEQ ID NO: 39807 - RNA, 23 nt, Artificial Sequence
  RNA Oligomer
uguuaugugagaacagacuggag

SEQ ID NO: 39808 - RNA, 23 nt, Artificial Sequence
  RNA Oligomer
aacagggaaguugggaaguuuca

SEQ ID NO: 39809 - RNA, 23 nt, Artificial Sequence
  RNA Oligomer
uacugaaagagaaagcaggaaca

SEQ ID NO: 39810 - RNA, 23 nt, Artificial Sequence
  RNA Oligomer
guuucucaggaaggaaaaagaca

SEQ ID NO: 39811 - RNA, 23 nt, Artificial Sequence
  RNA Oligomer
augcaaggcaauguuggcugaca

SEQ ID NO: 39812 - RNA, 23 nt, Artificial Sequence
  RNA Oligomer
acuugucaggcucuucaacugca

SEQ ID NO: 39813 - RNA, 23 nt, Artificial Sequence
  RNA Oligomer
ucgcucaacaacagcuguuuggc

SEQ ID NO: 39814 - RNA, 23 nt, Artificial Sequence
  RNA Oligomer
aaaaccucuuggagcuggagcag

SEQ ID NO: 39815 - RNA, 23 nt, Artificial Sequence
  RNA Oligomer
gugacagacacagaaguagacug

SEQ ID NO: 39816 - RNA, 23 nt, Artificial Sequence
  RNA Oligomer
uugagcaagagccucgauguacc

SEQ ID NO: 39817 - RNA, 23 nt, Artificial Sequence
  RNA Oligomer
uggugacagacacagaaguagac

SEQ ID NO: 39818 - RNA, 23 nt, Artificial Sequence
  RNA Oligomer
acagacacagaaguagacugcuc

SEQ ID NO: 39819 - RNA, 23 nt, Artificial Sequence
  RNA Oligomer
uacucuguuaugugagaacagac

SEQ ID NO: 39820 - RNA, 23 nt, Artificial Sequence
  RNA Oligomer
ugucaggcucuucaacugcagcu

SEQ ID NO: 39821 - RNA, 23 nt, Artificial Sequence
  RNA Oligomer
cagccaacaggaugaaaugaagg

SEQ ID NO: 39822 - RNA, 23 nt, Artificial Sequence
  RNA Oligomer
guugaggaguuccacauucuggc

SEQ ID NO: 39823 - RNA, 23 nt, Artificial Sequence
  RNA Oligomer
uugaggaguuccacauucuggcu

SEQ ID NO: 39824 - RNA, 23 nt, Artificial Sequence
  RNA Oligomer
ugaggaguuccacauucuggcug

SEQ ID NO: 39825 - RNA, 23 nt, Artificial Sequence
  RNA Oligomer
gaggaguuccacauucuggcuga

SEQ ID NO: 39826 - RNA, 23 nt, Artificial Sequence
  RNA Oligomer
aggaguuccacauucuggcugaa

SEQ ID NO: 39827 - RNA, 23 nt, Artificial Sequence
  RNA Oligomer
ggaugaaaaucaggcucuucaca

SEQ ID NO: 39828 - RNA, 23 nt, Artificial Sequence
  RNA Oligomer
gggaugaaaaucaggcucuucac

SEQ ID NO: 39829 - RNA, 23 nt, Artificial Sequence
  RNA Oligomer
ugggaugaaaaucaggcucuuca

SEQ ID NO: 39830 - RNA, 23 nt, Artificial Sequence
  RNA Oligomer
cugggaugaaaaucaggcucuuc

SEQ ID NO: 39831 - RNA, 23 nt, Artificial Sequence
  RNA Oligomer
gcugggaugaaaaucaggcucuu

SEQ ID NO: 39832 - RNA, 23 nt, Artificial Sequence
  RNA Oligomer
ggcugggaauaaauuuuuaucug

SEQ ID NO: 39833 - RNA, 23 nt, Artificial Sequence
  RNA Oligomer
uggcugggaauaaauuuuuaucu

SEQ ID NO: 39834 - RNA, 23 nt, Artificial Sequence
  RNA Oligomer
auggcugggaauaaauuuuuauc

SEQ ID NO: 39835 - RNA, 23 nt, Artificial Sequence
  RNA Oligomer
cauggcugggaauaaauuuuuau

SEQ ID NO: 39836 - RNA, 23 nt, Artificial Sequence
  RNA Oligomer
ucauggcugggaauaaauuuuua

SEQ ID NO: 39837 - RNA, 23 nt, Artificial Sequence
  RNA Oligomer
ccauuacacacgaguuauuuugg

SEQ ID NO: 39838 - RNA, 23 nt, Artificial Sequence
  RNA Oligomer
uccauuacacacgaguuauuuug

SEQ ID NO: 39839 - RNA, 23 nt, Artificial Sequence
  RNA Oligomer
uuccauuacacacgaguuauuuu

SEQ ID NO: 39840 - RNA, 23 nt, Artificial Sequence
  RNA Oligomer
uuuccauuacacacgaguuauuu

SEQ ID NO: 39841 - RNA, 23 nt, Artificial Sequence
  RNA Oligomer
cuuuccauuacacacgaguuauu

SEQ ID NO: 39842 - RNA, 23 nt, Artificial Sequence
  RNA Oligomer
cgaggacacuucaaaagaugugc

SEQ ID NO: 39843 - RNA, 23 nt, Artificial Sequence
  RNA Oligomer
ucgaggacacuucaaaagaugug

SEQ ID NO: 39844 - RNA, 23 nt, Artificial Sequence
  RNA Oligomer
cucgaggacacuucaaaagaugu

SEQ ID NO: 39845 - RNA, 23 nt, Artificial Sequence
  RNA Oligomer
ucucgaggacacuucaaaagaug

SEQ ID NO: 39846 - RNA, 23 nt, Artificial Sequence
  RNA Oligomer
cucucgaggacacuucaaaagau

SEQ ID NO: 39847 - RNA, 23 nt, Artificial Sequence
  RNA Oligomer
ccaacuggaacaaugaguucaag

SEQ ID NO: 39848 - RNA, 23 nt, Artificial Sequence
  RNA Oligomer
cccaacuggaacaaugaguucaa

SEQ ID NO: 39849 - RNA, 23 nt, Artificial Sequence
  RNA Oligomer
gcccaacuggaacaaugaguuca

SEQ ID NO: 39850 - RNA, 23 nt, Artificial Sequence
  RNA Oligomer
ggcccaacuggaacaaugaguuc

SEQ ID NO: 39851 - RNA, 23 nt, Artificial Sequence
  RNA Oligomer
aggcccaacuggaacaaugaguu

SEQ ID NO: 39852 - RNA, 23 nt, Artificial Sequence
  RNA Oligomer
ucaauuuucuggcaaggaacccu

SEQ ID NO: 39853 - RNA, 23 nt, Artificial Sequence
  RNA Oligomer
cucaauuuucuggcaaggaaccc

SEQ ID NO: 39854 - RNA, 23 nt, Artificial Sequence
  RNA Oligomer
ccucaauuuucuggcaaggaacc

SEQ ID NO: 39855 - RNA, 23 nt, Artificial Sequence
  RNA Oligomer
gccucaauuuucuggcaaggaac

SEQ ID NO: 39856 - RNA, 23 nt, Artificial Sequence
  RNA Oligomer
ugccucaauuuucuggcaaggaa

SEQ ID NO: 39857 - RNA, 23 nt, Artificial Sequence
  RNA Oligomer
cucauggcugggaauaaauuuuu

SEQ ID NO: 39858 - RNA, 23 nt, Artificial Sequence
  RNA Oligomer
ccagagguguucauuucuauuac

SEQ ID NO: 39859 - RNA, 23 nt, Artificial Sequence
  RNA Oligomer
cccagagguguucauuucuauua

SEQ ID NO: 39860 - RNA, 23 nt, Artificial Sequence
  RNA Oligomer
ccccagagguguucauuucuauu

SEQ ID NO: 39861 - RNA, 23 nt, Artificial Sequence
  RNA Oligomer
accccagagguguucauuucuau

SEQ ID NO: 39862 - RNA, 23 nt, Artificial Sequence
  RNA Oligomer
gaccccagagguguucauuucua

SEQ ID NO: 39863 - RNA, 23 nt, Artificial Sequence
  RNA Oligomer
ggcugggaugaaaaucaggcucu

SEQ ID NO: 39864 - RNA, 23 nt, Artificial Sequence
  RNA Oligomer
uggcuuuagucuugaucaugacc

SEQ ID NO: 39865 - RNA, 23 nt, Artificial Sequence
  RNA Oligomer
cuggcuuuagucuugaucaugac

SEQ ID NO: 39866 - RNA, 23 nt, Artificial Sequence
  RNA Oligomer
ucuggcuuuagucuugaucauga

SEQ ID NO: 39867 - RNA, 23 nt, Artificial Sequence
  RNA Oligomer
cucuggcuuuagucuugaucaug

SEQ ID NO: 39868 - RNA, 23 nt, Artificial Sequence
  RNA Oligomer
ucucuggcuuuagucuugaucau

SEQ ID NO: 39869 - RNA, 23 nt, Artificial Sequence
  RNA Oligomer
ggaggcaauuagacaaaaaccuc

SEQ ID NO: 39870 - RNA, 23 nt, Artificial Sequence
  RNA Oligomer
aggaggcaauuagacaaaaaccu

SEQ ID NO: 39871 - RNA, 23 nt, Artificial Sequence
  RNA Oligomer
gaggaggcaauuagacaaaaacc

SEQ ID NO: 39872 - RNA, 23 nt, Artificial Sequence
  RNA Oligomer
ggaggaggcaauuagacaaaaac

SEQ ID NO: 39873 - RNA, 23 nt, Artificial Sequence
  RNA Oligomer
uggaggaggcaauuagacaaaaa

SEQ ID NO: 39874 - RNA, 23 nt, Artificial Sequence
  RNA Oligomer
cgaguuauuuuggguucaacacu

SEQ ID NO: 39875 - RNA, 23 nt, Artificial Sequence
  RNA Oligomer
acgaguuauuuuggguucaacac

SEQ ID NO: 39876 - RNA, 23 nt, Artificial Sequence
  RNA Oligomer
cacgaguuauuuuggguucaaca

SEQ ID NO: 39877 - RNA, 23 nt, Artificial Sequence
  RNA Oligomer
acacgaguuauuuuggguucaac

SEQ ID NO: 39878 - RNA, 23 nt, Artificial Sequence
  RNA Oligomer
cacacgaguuauuuuggguucaa

SEQ ID NO: 39879 - RNA, 23 nt, Artificial Sequence
  RNA Oligomer
gguguucauuucuauuacaacaa

SEQ ID NO: 39880 - RNA, 23 nt, Artificial Sequence
  RNA Oligomer
agguguucauuucuauuacaaca

SEQ ID NO: 39881 - RNA, 23 nt, Artificial Sequence
  RNA Oligomer
gagguguucauuucuauuacaac

SEQ ID NO: 39882 - RNA, 23 nt, Artificial Sequence
  RNA Oligomer
agagguguucauuucuauuacaa

SEQ ID NO: 39883 - RNA, 23 nt, Artificial Sequence
  RNA Oligomer
cagagguguucauuucuauuaca

SEQ ID NO: 39884 - RNA, 23 nt, Artificial Sequence
  RNA Oligomer
gcagcaguauuggcguguucuuc

SEQ ID NO: 39885 - RNA, 23 nt, Artificial Sequence
  RNA Oligomer
agcagcaguauuggcguguucuu

SEQ ID NO: 39886 - RNA, 23 nt, Artificial Sequence
  RNA Oligomer
cagcagcaguauuggcguguucu

SEQ ID NO: 39887 - RNA, 23 nt, Artificial Sequence
  RNA Oligomer
ccagcagcaguauuggcguguuc

SEQ ID NO: 39888 - RNA, 23 nt, Artificial Sequence
  RNA Oligomer
cccagcagcaguauuggcguguu

SEQ ID NO: 39889 - RNA, 23 nt, Artificial Sequence
  RNA Oligomer
aaaucaggcucuucacauagcuu

SEQ ID NO: 39890 - RNA, 23 nt, Artificial Sequence
  RNA Oligomer
aaaaucaggcucuucacauagcu

SEQ ID NO: 39891 - RNA, 23 nt, Artificial Sequence
  RNA Oligomer
gaaaaucaggcucuucacauagc

SEQ ID NO: 39892 - RNA, 23 nt, Artificial Sequence
  RNA Oligomer
ugaaaaucaggcucuucacauag

SEQ ID NO: 39893 - RNA, 23 nt, Artificial Sequence
  RNA Oligomer
augaaaaucaggcucuucacaua

SEQ ID NO: 39894 - RNA, 23 nt, Artificial Sequence
  RNA Oligomer
acaaugaguucaagcagauugcc

SEQ ID NO: 39895 - RNA, 23 nt, Artificial Sequence
  RNA Oligomer
aacaaugaguucaagcagauugc

SEQ ID NO: 39896 - RNA, 23 nt, Artificial Sequence
  RNA Oligomer
gaacaaugaguucaagcagauug

SEQ ID NO: 39897 - RNA, 23 nt, Artificial Sequence
  RNA Oligomer
ggaacaaugaguucaagcagauu

SEQ ID NO: 39898 - RNA, 23 nt, Artificial Sequence
  RNA Oligomer
uggaacaaugaguucaagcagau

SEQ ID NO: 39899 - RNA, 23 nt, Artificial Sequence
  RNA Oligomer
ugacagauguauuucacuaccca

SEQ ID NO: 39900 - RNA, 23 nt, Artificial Sequence
  RNA Oligomer
cugacagauguauuucacuaccc

SEQ ID NO: 39901 - RNA, 23 nt, Artificial Sequence
  RNA Oligomer
ccugacagauguauuucacuacc

SEQ ID NO: 39902 - RNA, 23 nt, Artificial Sequence
  RNA Oligomer
cccugacagauguauuucacuac

SEQ ID NO: 39903 - RNA, 23 nt, Artificial Sequence
  RNA Oligomer
gcccugacagauguauuucacua

SEQ ID NO: 39904 - RNA, 23 nt, Artificial Sequence
  RNA Oligomer
guaugcaugugaaagaauaauua

SEQ ID NO: 39905 - RNA, 23 nt, Artificial Sequence
  RNA Oligomer
uguaugcaugugaaagaauaauu

SEQ ID NO: 39906 - RNA, 23 nt, Artificial Sequence
  RNA Oligomer
uuguaugcaugugaaagaauaau

SEQ ID NO: 39907 - RNA, 23 nt, Artificial Sequence
  RNA Oligomer
cuuguaugcaugugaaagaauaa

SEQ ID NO: 39908 - RNA, 23 nt, Artificial Sequence
  RNA Oligomer
ucuuguaugcaugugaaagaaua

SEQ ID NO: 39909 - RNA, 23 nt, Artificial Sequence
  RNA Oligomer
gccugaauuuuaacugcaugcua

SEQ ID NO: 39910 - RNA, 23 nt, Artificial Sequence
  RNA Oligomer
ugccugaauuuuaacugcaugcu

SEQ ID NO: 39911 - RNA, 23 nt, Artificial Sequence
  RNA Oligomer
gugccugaauuuuaacugcaugc

SEQ ID NO: 39912 - RNA, 23 nt, Artificial Sequence
  RNA Oligomer
ugugccugaauuuuaacugcaug

SEQ ID NO: 39913 - RNA, 23 nt, Artificial Sequence
  RNA Oligomer
cugugccugaauuuuaacugcau

SEQ ID NO: 39914 - RNA, 23 nt, Artificial Sequence
  RNA Oligomer
cacuauaccauacuuccuuagcu

SEQ ID NO: 39915 - RNA, 23 nt, Artificial Sequence
  RNA Oligomer
acacuauaccauacuuccuuagc

SEQ ID NO: 39916 - RNA, 23 nt, Artificial Sequence
  RNA Oligomer
uacacuauaccauacuuccuuag

SEQ ID NO: 39917 - RNA, 23 nt, Artificial Sequence
  RNA Oligomer
guacacuauaccauacuuccuua

SEQ ID NO: 39918 - RNA, 23 nt, Artificial Sequence
  RNA Oligomer
aguacacuauaccauacuuccuu

SEQ ID NO: 39919 - RNA, 23 nt, Artificial Sequence
  RNA Oligomer
cgaaaauacugacgugauuacag

SEQ ID NO: 39920 - RNA, 23 nt, Artificial Sequence
  RNA Oligomer
acgaaaauacugacgugauuaca

SEQ ID NO: 39921 - RNA, 23 nt, Artificial Sequence
  RNA Oligomer
gacgaaaauacugacgugauuac

SEQ ID NO: 39922 - RNA, 23 nt, Artificial Sequence
  RNA Oligomer
ggacgaaaauacugacgugauua

SEQ ID NO: 39923 - RNA, 23 nt, Artificial Sequence
  RNA Oligomer
gggacgaaaauacugacgugauu

SEQ ID NO: 39924 - RNA, 23 nt, Artificial Sequence
  RNA Oligomer
cacuuucugaguuaucauauauu

SEQ ID NO: 39925 - RNA, 23 nt, Artificial Sequence
  RNA Oligomer
ucacuuucugaguuaucauauau

SEQ ID NO: 39926 - RNA, 23 nt, Artificial Sequence
  RNA Oligomer
cucacuuucugaguuaucauaua

SEQ ID NO: 39927 - RNA, 23 nt, Artificial Sequence
  RNA Oligomer
acucacuuucugaguuaucauau

SEQ ID NO: 39928 - RNA, 23 nt, Artificial Sequence
  RNA Oligomer
aacucacuuucugaguuaucaua

SEQ ID NO: 39929 - RNA, 23 nt, Artificial Sequence
  RNA Oligomer
gcaacaaguaucaugauggggug

SEQ ID NO: 39930 - RNA, 23 nt, Artificial Sequence
  RNA Oligomer
agcaacaaguaucaugauggggu

SEQ ID NO: 39931 - RNA, 23 nt, Artificial Sequence
  RNA Oligomer
gagcaacaaguaucaugaugggg

SEQ ID NO: 39932 - RNA, 23 nt, Artificial Sequence
  RNA Oligomer
agagcaacaaguaucaugauggg

SEQ ID NO: 39933 - RNA, 23 nt, Artificial Sequence
  RNA Oligomer
aagagcaacaaguaucaugaugg

SEQ ID NO: 39934 - RNA, 23 nt, Artificial Sequence
  RNA Oligomer
uccuggaacuucacaugaaaaag

SEQ ID NO: 39935 - RNA, 23 nt, Artificial Sequence
  RNA Oligomer
guccuggaacuucacaugaaaaa

SEQ ID NO: 39936 - RNA, 23 nt, Artificial Sequence
  RNA Oligomer
aguccuggaacuucacaugaaaa

SEQ ID NO: 39937 - RNA, 23 nt, Artificial Sequence
  RNA Oligomer
gaguccuggaacuucacaugaaa

SEQ ID NO: 39938 - RNA, 23 nt, Artificial Sequence
  RNA Oligomer
ggaguccuggaacuucacaugaa

SEQ ID NO: 39939 - RNA, 23 nt, Artificial Sequence
  RNA Oligomer
cgaagagcaacaaguaucaugau

SEQ ID NO: 39940 - RNA, 23 nt, Artificial Sequence
  RNA Oligomer
ccgaagagcaacaaguaucauga

SEQ ID NO: 39941 - RNA, 23 nt, Artificial Sequence
  RNA Oligomer
gccgaagagcaacaaguaucaug

SEQ ID NO: 39942 - RNA, 23 nt, Artificial Sequence
  RNA Oligomer
agccgaagagcaacaaguaucau

SEQ ID NO: 39943 - RNA, 23 nt, Artificial Sequence
  RNA Oligomer
cagccgaagagcaacaaguauca

SEQ ID NO: 39944 - RNA, 23 nt, Artificial Sequence
  RNA Oligomer
ucgucuucuuucucagccuggcc

SEQ ID NO: 39945 - RNA, 23 nt, Artificial Sequence
  RNA Oligomer
aucgucuucuuucucagccuggc

SEQ ID NO: 39946 - RNA, 23 nt, Artificial Sequence
  RNA Oligomer
caucgucuucuuucucagccugg

SEQ ID NO: 39947 - RNA, 23 nt, Artificial Sequence
  RNA Oligomer
ucaucgucuucuuucucagccug

SEQ ID NO: 39948 - RNA, 23 nt, Artificial Sequence
  RNA Oligomer
uucaucgucuucuuucucagccu

SEQ ID NO: 39949 - RNA, 23 nt, Artificial Sequence
  RNA Oligomer
auguuuucaucgucuucuuucuc

SEQ ID NO: 39950 - RNA, 23 nt, Artificial Sequence
  RNA Oligomer
cauguuuucaucgucuucuuucu

SEQ ID NO: 39951 - RNA, 23 nt, Artificial Sequence
  RNA Oligomer
ccauguuuucaucgucuucuuuc

SEQ ID NO: 39952 - RNA, 23 nt, Artificial Sequence
  RNA Oligomer
accauguuuucaucgucuucuuu

SEQ ID NO: 39953 - RNA, 23 nt, Artificial Sequence
  RNA Oligomer
caccauguuuucaucgucuucuu

SEQ ID NO: 39954 - RNA, 23 nt, Artificial Sequence
  RNA Oligomer
gcuuuagucuugaucaugaccuc

SEQ ID NO: 39955 - RNA, 23 nt, Artificial Sequence
  RNA Oligomer
ggcuuuagucuugaucaugaccu

SEQ ID NO: 39956 - RNA, 23 nt, Artificial Sequence
  RNA Oligomer
cucucuggcuuuagucuugauca

SEQ ID NO: 39957 - RNA, 23 nt, Artificial Sequence
  RNA Oligomer
ucucucuggcuuuagucuugauc

SEQ ID NO: 39958 - RNA, 23 nt, Artificial Sequence
  RNA Oligomer
aucucucuggcuuuagucuugau

SEQ ID NO: 39959 - RNA, 23 nt, Artificial Sequence
  RNA Oligomer
ccacugaauugcuaaggacaaua

SEQ ID NO: 39960 - RNA, 23 nt, Artificial Sequence
  RNA Oligomer
accacugaauugcuaaggacaau

SEQ ID NO: 39961 - RNA, 23 nt, Artificial Sequence
  RNA Oligomer
aaccacugaauugcuaaggacaa

SEQ ID NO: 39962 - RNA, 23 nt, Artificial Sequence
  RNA Oligomer
caaccacugaauugcuaaggaca

SEQ ID NO: 39963 - RNA, 23 nt, Artificial Sequence
  RNA Oligomer
acaaccacugaauugcuaaggac

SEQ ID NO: 39964 - RNA, 23 nt, Artificial Sequence
  RNA Oligomer
acaacaaggagagcuucuagacu

SEQ ID NO: 39965 - RNA, 23 nt, Artificial Sequence
  RNA Oligomer
uacaacaaggagagcuucuagac

SEQ ID NO: 39966 - RNA, 23 nt, Artificial Sequence
  RNA Oligomer
uuacaacaaggagagcuucuaga

SEQ ID NO: 39967 - RNA, 23 nt, Artificial Sequence
  RNA Oligomer
auuacaacaaggagagcuucuag

SEQ ID NO: 39968 - RNA, 23 nt, Artificial Sequence
  RNA Oligomer
uauuacaacaaggagagcuucua

SEQ ID NO: 39969 - RNA, 23 nt, Artificial Sequence
  RNA Oligomer
ccauauuaguacucucauggcug

SEQ ID NO: 39970 - RNA, 23 nt, Artificial Sequence
  RNA Oligomer
accauauuaguacucucauggcu

SEQ ID NO: 39971 - RNA, 23 nt, Artificial Sequence
  RNA Oligomer
caccauauuaguacucucauggc

SEQ ID NO: 39972 - RNA, 23 nt, Artificial Sequence
  RNA Oligomer
ccaccauauuaguacucucaugg

SEQ ID NO: 39973 - RNA, 23 nt, Artificial Sequence
  RNA Oligomer
uccaccauauuaguacucucaug

SEQ ID NO: 39974 - RNA, 23 nt, Artificial Sequence
  RNA Oligomer
gcucuucugaaaucuauauggua

SEQ ID NO: 39975 - RNA, 23 nt, Artificial Sequence
  RNA Oligomer
ugcucuucugaaaucuauauggu

SEQ ID NO: 39976 - RNA, 23 nt, Artificial Sequence
  RNA Oligomer
cugcucuucugaaaucuauaugg

SEQ ID NO: 39977 - RNA, 23 nt, Artificial Sequence
  RNA Oligomer
gcugcucuucugaaaucuauaug

SEQ ID NO: 39978 - RNA, 23 nt, Artificial Sequence
  RNA Oligomer
cgcugcucuucugaaaucuauau

SEQ ID NO: 39979 - RNA, 23 nt, Artificial Sequence
  RNA Oligomer
ucgcugcucuucugaaaucuaua

SEQ ID NO: 39980 - RNA, 23 nt, Artificial Sequence
  RNA Oligomer
uucgcugcucuucugaaaucuau

SEQ ID NO: 39981 - RNA, 23 nt, Artificial Sequence
  RNA Oligomer
cuucgcugcucuucugaaaucua

SEQ ID NO: 39982 - RNA, 23 nt, Artificial Sequence
  RNA Oligomer
ccuucgcugcucuucugaaaucu

SEQ ID NO: 39983 - RNA, 23 nt, Artificial Sequence
  RNA Oligomer
ccuaugaguuguucugguacaca

SEQ ID NO: 39984 - RNA, 23 nt, Artificial Sequence
  RNA Oligomer
uccuaugaguuguucugguacac

SEQ ID NO: 39985 - RNA, 23 nt, Artificial Sequence
  RNA Oligomer
cuccuaugaguuguucugguaca

SEQ ID NO: 39986 - RNA, 23 nt, Artificial Sequence
  RNA Oligomer
ccuccuaugaguuguucugguac

SEQ ID NO: 39987 - RNA, 23 nt, Artificial Sequence
  RNA Oligomer
gccuccuaugaguuguucuggua

SEQ ID NO: 39988 - RNA, 23 nt, Artificial Sequence
  RNA Oligomer
gcccuuacuaacgacccaacauc

SEQ ID NO: 39989 - RNA, 23 nt, Artificial Sequence
  RNA Oligomer
agcccuuacuaacgacccaacau

SEQ ID NO: 39990 - RNA, 23 nt, Artificial Sequence
  RNA Oligomer
aagcccuuacuaacgacccaaca

SEQ ID NO: 39991 - RNA, 23 nt, Artificial Sequence
  RNA Oligomer
gaagcccuuacuaacgacccaac

SEQ ID NO: 39992 - RNA, 23 nt, Artificial Sequence
  RNA Oligomer
ggaagcccuuacuaacgacccaa

SEQ ID NO: 39993 - RNA, 23 nt, Artificial Sequence
  RNA Oligomer
ccauacuuccuuagcuuauaaau

SEQ ID NO: 39994 - RNA, 23 nt, Artificial Sequence
  RNA Oligomer
accauacuuccuuagcuuauaaa

SEQ ID NO: 39995 - RNA, 23 nt, Artificial Sequence
  RNA Oligomer
uaccauacuuccuuagcuuauaa

SEQ ID NO: 39996 - RNA, 23 nt, Artificial Sequence
  RNA Oligomer
auaccauacuuccuuagcuuaua

SEQ ID NO: 39997 - RNA, 23 nt, Artificial Sequence
  RNA Oligomer
uauaccauacuuccuuagcuuau

SEQ ID NO: 39998 - RNA, 23 nt, Artificial Sequence
  RNA Oligomer
cggcugggaugaaaaucaggcuc

SEQ ID NO: 39999 - RNA, 23 nt, Artificial Sequence
  RNA Oligomer
ccggcugggaugaaaaucaggcu

SEQ ID NO: 40000 - RNA, 23 nt, Artificial Sequence
  RNA Oligomer
accggcugggaugaaaaucaggc

SEQ ID NO: 40001 - RNA, 23 nt, Artificial Sequence
  RNA Oligomer
uaccggcugggaugaaaaucagg

SEQ ID NO: 40002 - RNA, 23 nt, Artificial Sequence
  RNA Oligomer
uuaccggcugggaugaaaaucag

SEQ ID NO: 40003 - RNA, 23 nt, Artificial Sequence
  RNA Oligomer
caagagcuuuugagugguuugcu

SEQ ID NO: 40004 - RNA, 23 nt, Artificial Sequence
  RNA Oligomer
gcaagagcuuuugagugguuugc

SEQ ID NO: 40005 - RNA, 23 nt, Artificial Sequence
  RNA Oligomer
ugcaagagcuuuugagugguuug

SEQ ID NO: 40006 - RNA, 23 nt, Artificial Sequence
  RNA Oligomer
augcaagagcuuuugagugguuu

SEQ ID NO: 40007 - RNA, 23 nt, Artificial Sequence
  RNA Oligomer
gaugcaagagcuuuugagugguu

SEQ ID NO: 40008 - RNA, 23 nt, Artificial Sequence
  RNA Oligomer
cccuucgcugcucuucugaaauc

SEQ ID NO: 40009 - RNA, 23 nt, Artificial Sequence
  RNA Oligomer
ucccuucgcugcucuucugaaau

SEQ ID NO: 40010 - RNA, 23 nt, Artificial Sequence
  RNA Oligomer
cucccuucgcugcucuucugaaa

SEQ ID NO: 40011 - RNA, 23 nt, Artificial Sequence
  RNA Oligomer
ugcccugacagauguauuucacu

SEQ ID NO: 40012 - RNA, 23 nt, Artificial Sequence
  RNA Oligomer
cugcccugacagauguauuucac

SEQ ID NO: 40013 - RNA, 23 nt, Artificial Sequence
  RNA Oligomer
acugcccugacagauguauuuca

SEQ ID NO: 40014 - RNA, 23 nt, Artificial Sequence
  RNA Oligomer
caacaaguaucaugauggggugc

SEQ ID NO: 40015 - RNA, 23 nt, Artificial Sequence
  RNA Oligomer
gaagagcaacaaguaucaugaug

SEQ ID NO: 40016 - RNA, 23 nt, Artificial Sequence
  RNA Oligomer
acagccgaagagcaacaaguauc

SEQ ID NO: 40017 - RNA, 23 nt, Artificial Sequence
  RNA Oligomer
gacagccgaagagcaacaaguau

SEQ ID NO: 40018 - RNA, 23 nt, Artificial Sequence
  RNA Oligomer
ggucuuguaugcaugugaaagaa

SEQ ID NO: 40019 - RNA, 23 nt, Artificial Sequence
  RNA Oligomer
uggucuuguaugcaugugaaaga

SEQ ID NO: 40020 - RNA, 23 nt, Artificial Sequence
  RNA Oligomer
guggucuuguaugcaugugaaag

SEQ ID NO: 40021 - RNA, 23 nt, Artificial Sequence
  RNA Oligomer
uguggucuuguaugcaugugaaa

SEQ ID NO: 40022 - RNA, 23 nt, Artificial Sequence
  RNA Oligomer
cuguggucuuguaugcaugugaa

SEQ ID NO: 40023 - RNA, 23 nt, Artificial Sequence
  RNA Oligomer
uuucaucgucuucuuucucagcc

SEQ ID NO: 40024 - RNA, 23 nt, Artificial Sequence
  RNA Oligomer
uuuucaucgucuucuuucucagc

SEQ ID NO: 40025 - RNA, 23 nt, Artificial Sequence
  RNA Oligomer
guuuucaucgucuucuuucucag

SEQ ID NO: 40026 - RNA, 23 nt, Artificial Sequence
  RNA Oligomer
guggaggaggcaauuagacaaaa

SEQ ID NO: 40027 - RNA, 23 nt, Artificial Sequence
  RNA Oligomer
cguggaggaggcaauuagacaaa

SEQ ID NO: 40028 - RNA, 23 nt, Artificial Sequence
  RNA Oligomer
ccguggaggaggcaauuagacaa

SEQ ID NO: 40029 - RNA, 23 nt, Artificial Sequence
  RNA Oligomer
gcacugugccugaauuuuaacug

SEQ ID NO: 40030 - RNA, 23 nt, Artificial Sequence
  RNA Oligomer
cgcacugugccugaauuuuaacu

SEQ ID NO: 40031 - RNA, 23 nt, Artificial Sequence
  RNA Oligomer
ccgcacugugccugaauuuuaac

SEQ ID NO: 40032 - RNA, 23 nt, Artificial Sequence
  RNA Oligomer
uccgcacugugccugaauuuuaa

SEQ ID NO: 40033 - RNA, 23 nt, Artificial Sequence
  RNA Oligomer
auccgcacugugccugaauuuua

SEQ ID NO: 40034 - RNA, 23 nt, Artificial Sequence
  RNA Oligomer
cuauaccauacuuccuuagcuua

SEQ ID NO: 40035 - RNA, 23 nt, Artificial Sequence
  RNA Oligomer
acuauaccauacuuccuuagcuu

SEQ ID NO: 40036 - RNA, 23 nt, Artificial Sequence
  RNA Oligomer
gggaacuggugaauaauaauuaa

SEQ ID NO: 40037 - RNA, 23 nt, Artificial Sequence
  RNA Oligomer
ugggaacuggugaauaauaauua

SEQ ID NO: 40038 - RNA, 23 nt, Artificial Sequence
  RNA Oligomer
uugggaacuggugaauaauaauu

SEQ ID NO: 40039 - RNA, 23 nt, Artificial Sequence
  RNA Oligomer
guugggaacuggugaauaauaau

SEQ ID NO: 40040 - RNA, 23 nt, Artificial Sequence
  RNA Oligomer
aguugggaacuggugaauaauaa

SEQ ID NO: 40041 - RNA, 23 nt, Artificial Sequence
  RNA Oligomer
gcaguauuggcguguucuucugu

SEQ ID NO: 40042 - RNA, 23 nt, Artificial Sequence
  RNA Oligomer
agcaguauuggcguguucuucug

SEQ ID NO: 40043 - RNA, 23 nt, Artificial Sequence
  RNA Oligomer
cagcaguauuggcguguucuucu

SEQ ID NO: 40044 - RNA, 23 nt, Artificial Sequence
  RNA Oligomer
caaugaguucaagcagauugccu

SEQ ID NO: 40045 - RNA, 23 nt, Artificial Sequence
  RNA Oligomer
gacgugauuacaggcuuaaagca

SEQ ID NO: 40046 - RNA, 23 nt, Artificial Sequence
  RNA Oligomer
ugacgugauuacaggcuuaaagc

SEQ ID NO: 40047 - RNA, 23 nt, Artificial Sequence
  RNA Oligomer
cugacgugauuacaggcuuaaag

SEQ ID NO: 40048 - RNA, 23 nt, Artificial Sequence
  RNA Oligomer
acugacgugauuacaggcuuaaa

SEQ ID NO: 40049 - RNA, 23 nt, Artificial Sequence
  RNA Oligomer
uacugacgugauuacaggcuuaa

SEQ ID NO: 40050 - RNA, 23 nt, Artificial Sequence
  RNA Oligomer
auacugacgugauuacaggcuua

SEQ ID NO: 40051 - RNA, 23 nt, Artificial Sequence
  RNA Oligomer
cucuucacauagcuuuacacugg

SEQ ID NO: 40052 - RNA, 23 nt, Artificial Sequence
  RNA Oligomer
gcucuucacauagcuuuacacug

SEQ ID NO: 40053 - RNA, 23 nt, Artificial Sequence
  RNA Oligomer
ggcucuucacauagcuuuacacu

SEQ ID NO: 40054 - RNA, 23 nt, Artificial Sequence
  RNA Oligomer
aggcucuucacauagcuuuacac

SEQ ID NO: 40055 - RNA, 23 nt, Artificial Sequence
  RNA Oligomer
caggcucuucacauagcuuuaca

SEQ ID NO: 40056 - RNA, 23 nt, Artificial Sequence
  RNA Oligomer
cuuaccggcugggaugaaaauca

SEQ ID NO: 40057 - RNA, 23 nt, Artificial Sequence
  RNA Oligomer
aaacucacuuucugaguuaucau

SEQ ID NO: 40058 - RNA, 23 nt, Artificial Sequence
  RNA Oligomer
ugagcaagguguauuucuacugg

SEQ ID NO: 40059 - RNA, 23 nt, Artificial Sequence
  RNA Oligomer
cugagcaagguguauuucuacug

SEQ ID NO: 40060 - RNA, 23 nt, Artificial Sequence
  RNA Oligomer
gcugagcaagguguauuucuacu

SEQ ID NO: 40061 - RNA, 23 nt, Artificial Sequence
  RNA Oligomer
agcugagcaagguguauuucuac

SEQ ID NO: 40062 - RNA, 23 nt, Artificial Sequence
  RNA Oligomer
aagcugagcaagguguauuucua

SEQ ID NO: 40063 - RNA, 23 nt, Artificial Sequence
  RNA Oligomer
cuauaugguacaaaugcagugag

SEQ ID NO: 40064 - RNA, 23 nt, Artificial Sequence
  RNA Oligomer
ucuauaugguacaaaugcaguga

SEQ ID NO: 40065 - RNA, 23 nt, Artificial Sequence
  RNA Oligomer
aucuauaugguacaaaugcagug

SEQ ID NO: 40066 - RNA, 23 nt, Artificial Sequence
  RNA Oligomer
aaucuauaugguacaaaugcagu

SEQ ID NO: 40067 - RNA, 23 nt, Artificial Sequence
  RNA Oligomer
aaaucuauaugguacaaaugcag

SEQ ID NO: 40068 - RNA, 23 nt, Artificial Sequence
  RNA Oligomer
acucccuucgcugcucuucugaa

SEQ ID NO: 40069 - RNA, 23 nt, Artificial Sequence
  RNA Oligomer
cccaggaagacuuuuucagcgug

SEQ ID NO: 40070 - RNA, 23 nt, Artificial Sequence
  RNA Oligomer
ccccaggaagacuuuuucagcgu

SEQ ID NO: 40071 - RNA, 23 nt, Artificial Sequence
  RNA Oligomer
cccccaggaagacuuuuucagcg

SEQ ID NO: 40072 - RNA, 23 nt, Artificial Sequence
  RNA Oligomer
ccccccaggaagacuuuuucagc

SEQ ID NO: 40073 - RNA, 23 nt, Artificial Sequence
  RNA Oligomer
gccccccaggaagacuuuuucag

SEQ ID NO: 40074 - RNA, 23 nt, Artificial Sequence
  RNA Oligomer
cggcuuggaaauggauuuuaggc

SEQ ID NO: 40075 - RNA, 23 nt, Artificial Sequence
  RNA Oligomer
ucggcuuggaaauggauuuuagg

SEQ ID NO: 40076 - RNA, 23 nt, Artificial Sequence
  RNA Oligomer
cucggcuuggaaauggauuuuag

SEQ ID NO: 40077 - RNA, 23 nt, Artificial Sequence
  RNA Oligomer
ccucggcuuggaaauggauuuua

SEQ ID NO: 40078 - RNA, 23 nt, Artificial Sequence
  RNA Oligomer
cccucggcuuggaaauggauuuu

SEQ ID NO: 40079 - RNA, 23 nt, Artificial Sequence
  RNA Oligomer
ggugaucucucuggcuuuagucu

SEQ ID NO: 40080 - RNA, 23 nt, Artificial Sequence
  RNA Oligomer
uggugaucucucuggcuuuaguc

SEQ ID NO: 40081 - RNA, 23 nt, Artificial Sequence
  RNA Oligomer
cuggugaucucucuggcuuuagu

SEQ ID NO: 40082 - RNA, 23 nt, Artificial Sequence
  RNA Oligomer
ucuggugaucucucuggcuuuag

SEQ ID NO: 40083 - RNA, 23 nt, Artificial Sequence
  RNA Oligomer
gucuggugaucucucuggcuuua

SEQ ID NO: 40084 - RNA, 23 nt, Artificial Sequence
  RNA Oligomer
acaaacacaaccacugaauugcu

SEQ ID NO: 40085 - RNA, 23 nt, Artificial Sequence
  RNA Oligomer
cacaaacacaaccacugaauugc

SEQ ID NO: 40086 - RNA, 23 nt, Artificial Sequence
  RNA Oligomer
ccacaaacacaaccacugaauug

SEQ ID NO: 40087 - RNA, 23 nt, Artificial Sequence
  RNA Oligomer
cccacaaacacaaccacugaauu

SEQ ID NO: 40088 - RNA, 23 nt, Artificial Sequence
  RNA Oligomer
ccccacaaacacaaccacugaau

SEQ ID NO: 40089 - RNA, 23 nt, Artificial Sequence
  RNA Oligomer
gcauuucuucaaccuggaacgcu

SEQ ID NO: 40090 - RNA, 23 nt, Artificial Sequence
  RNA Oligomer
cgcauuucuucaaccuggaacgc

SEQ ID NO: 40091 - RNA, 23 nt, Artificial Sequence
  RNA Oligomer
gcgcauuucuucaaccuggaacg

SEQ ID NO: 40092 - RNA, 23 nt, Artificial Sequence
  RNA Oligomer
ggcgcauuucuucaaccuggaac

SEQ ID NO: 40093 - RNA, 23 nt, Artificial Sequence
  RNA Oligomer
uggcgcauuucuucaaccuggaa

SEQ ID NO: 40094 - RNA, 23 nt, Artificial Sequence
  RNA Oligomer
accucagauuucacaaacugguc

SEQ ID NO: 40095 - RNA, 23 nt, Artificial Sequence
  RNA Oligomer
aaccucagauuucacaaacuggu

SEQ ID NO: 40096 - RNA, 23 nt, Artificial Sequence
  RNA Oligomer
aaaccucagauuucacaaacugg

SEQ ID NO: 40097 - RNA, 23 nt, Artificial Sequence
  RNA Oligomer
aaaaccucagauuucacaaacug

SEQ ID NO: 40098 - RNA, 23 nt, Artificial Sequence
  RNA Oligomer
aaaaaccucagauuucacaaacu

SEQ ID NO: 40099 - RNA, 23 nt, Artificial Sequence
  RNA Oligomer
agacaaaaaccucagauuucaca

SEQ ID NO: 40100 - RNA, 23 nt, Artificial Sequence
  RNA Oligomer
uagacaaaaaccucagauuucac

SEQ ID NO: 40101 - RNA, 23 nt, Artificial Sequence
  RNA Oligomer
uuagacaaaaaccucagauuuca

SEQ ID NO: 40102 - RNA, 23 nt, Artificial Sequence
  RNA Oligomer
auuagacaaaaaccucagauuuc

SEQ ID NO: 40103 - RNA, 23 nt, Artificial Sequence
  RNA Oligomer
aauuagacaaaaaccucagauuu

SEQ ID NO: 40104 - RNA, 23 nt, Artificial Sequence
  RNA Oligomer
ucauaagaggaacaaguauuugc

SEQ ID NO: 40105 - RNA, 23 nt, Artificial Sequence
  RNA Oligomer
uucauaagaggaacaaguauuug

SEQ ID NO: 40106 - RNA, 23 nt, Artificial Sequence
  RNA Oligomer
auucauaagaggaacaaguauuu

SEQ ID NO: 40107 - RNA, 23 nt, Artificial Sequence
  RNA Oligomer
cauucauaagaggaacaaguauu

SEQ ID NO: 40108 - RNA, 23 nt, Artificial Sequence
  RNA Oligomer
ucauucauaagaggaacaaguau

SEQ ID NO: 40109 - RNA, 23 nt, Artificial Sequence
  RNA Oligomer
cugcaugcuaauucuaauaccug

SEQ ID NO: 40110 - RNA, 23 nt, Artificial Sequence
  RNA Oligomer
acugcaugcuaauucuaauaccu

SEQ ID NO: 40111 - RNA, 23 nt, Artificial Sequence
  RNA Oligomer
aacugcaugcuaauucuaauacc

SEQ ID NO: 40112 - RNA, 23 nt, Artificial Sequence
  RNA Oligomer
uaacugcaugcuaauucuaauac

SEQ ID NO: 40113 - RNA, 23 nt, Artificial Sequence
  RNA Oligomer
uuaacugcaugcuaauucuaaua

SEQ ID NO: 40114 - RNA, 23 nt, Artificial Sequence
  RNA Oligomer
cccuuacuaacgacccaacaucc

SEQ ID NO: 40115 - RNA, 23 nt, Artificial Sequence
  RNA Oligomer
acacacgaguuauuuuggguuca

SEQ ID NO: 40116 - RNA, 23 nt, Artificial Sequence
  RNA Oligomer
uacacacgaguuauuuuggguuc

SEQ ID NO: 40117 - RNA, 23 nt, Artificial Sequence
  RNA Oligomer
uuacacacgaguuauuuuggguu

SEQ ID NO: 40118 - RNA, 23 nt, Artificial Sequence
  RNA Oligomer
ucucauggcugggaauaaauuuu

SEQ ID NO: 40119 - RNA, 23 nt, Artificial Sequence
  RNA Oligomer
ccaggcauuguguuuucaaucaa

SEQ ID NO: 40120 - RNA, 23 nt, Artificial Sequence
  RNA Oligomer
uccaggcauuguguuuucaauca

SEQ ID NO: 40121 - RNA, 23 nt, Artificial Sequence
  RNA Oligomer
guccaggcauuguguuuucaauc

SEQ ID NO: 40122 - RNA, 23 nt, Artificial Sequence
  RNA Oligomer
aguccaggcauuguguuuucaau

SEQ ID NO: 40123 - RNA, 23 nt, Artificial Sequence
  RNA Oligomer
aaguccaggcauuguguuuucaa

SEQ ID NO: 40124 - RNA, 23 nt, Artificial Sequence
  RNA Oligomer
aggagagcuucuagacuuuggag

SEQ ID NO: 40125 - RNA, 23 nt, Artificial Sequence
  RNA Oligomer
aaggagagcuucuagacuuugga

SEQ ID NO: 40126 - RNA, 23 nt, Artificial Sequence
  RNA Oligomer
caaggagagcuucuagacuuugg

SEQ ID NO: 40127 - RNA, 23 nt, Artificial Sequence
  RNA Oligomer
acaaggagagcuucuagacuuug

SEQ ID NO: 40128 - RNA, 23 nt, Artificial Sequence
  RNA Oligomer
aacaaggagagcuucuagacuuu

SEQ ID NO: 40129 - RNA, 23 nt, Artificial Sequence
  RNA Oligomer
gaggacacuucaaaagaugugcc

SEQ ID NO: 40130 - RNA, 23 nt, Artificial Sequence
  RNA Oligomer
cgugauuacaggcuuaaagcaga

SEQ ID NO: 40131 - RNA, 23 nt, Artificial Sequence
  RNA Oligomer
acgugauuacaggcuuaaagcag

SEQ ID NO: 40132 - RNA, 23 nt, Artificial Sequence
  RNA Oligomer
ggaugcaagagcuuuugaguggu

SEQ ID NO: 40133 - RNA, 23 nt, Artificial Sequence
  RNA Oligomer
ggauuuugaaugagggucucucc

SEQ ID NO: 40134 - RNA, 23 nt, Artificial Sequence
  RNA Oligomer
uggauuuugaaugagggucucuc

SEQ ID NO: 40135 - RNA, 23 nt, Artificial Sequence
  RNA Oligomer
cuggauuuugaaugagggucucu

SEQ ID NO: 40136 - RNA, 23 nt, Artificial Sequence
  RNA Oligomer
gcuggauuuugaaugagggucuc

SEQ ID NO: 40137 - RNA, 23 nt, Artificial Sequence
  RNA Oligomer
ugcuggauuuugaaugagggucu

SEQ ID NO: 40138 - RNA, 23 nt, Artificial Sequence
  RNA Oligomer
gaagcugagcaagguguauuucu

SEQ ID NO: 40139 - RNA, 23 nt, Artificial Sequence
  RNA Oligomer
ugaagcugagcaagguguauuuc

SEQ ID NO: 40140 - RNA, 23 nt, Artificial Sequence
  RNA Oligomer
cugaagcugagcaagguguauuu

SEQ ID NO: 40141 - RNA, 23 nt, Artificial Sequence
  RNA Oligomer
cuggcgauuucaacaagaaguug

SEQ ID NO: 40142 - RNA, 23 nt, Artificial Sequence
  RNA Oligomer
ucuggcgauuucaacaagaaguu

SEQ ID NO: 40143 - RNA, 23 nt, Artificial Sequence
  RNA Oligomer
uucuggcgauuucaacaagaagu

SEQ ID NO: 40144 - RNA, 23 nt, Artificial Sequence
  RNA Oligomer
guucuggcgauuucaacaagaag

SEQ ID NO: 40145 - RNA, 23 nt, Artificial Sequence
  RNA Oligomer
gguucuggcgauuucaacaagaa

SEQ ID NO: 40146 - RNA, 23 nt, Artificial Sequence
  RNA Oligomer
ucggauuguucgaggccaaaccc

SEQ ID NO: 40147 - RNA, 23 nt, Artificial Sequence
  RNA Oligomer
gucggauuguucgaggccaaacc

SEQ ID NO: 40148 - RNA, 23 nt, Artificial Sequence
  RNA Oligomer
ggucggauuguucgaggccaaac

SEQ ID NO: 40149 - RNA, 23 nt, Artificial Sequence
  RNA Oligomer
gggucggauuguucgaggccaaa

SEQ ID NO: 40150 - RNA, 23 nt, Artificial Sequence
  RNA Oligomer
cgggucggauuguucgaggccaa

SEQ ID NO: 40151 - RNA, 23 nt, Artificial Sequence
  RNA Oligomer
aggugagggagaagaaauuuccu

SEQ ID NO: 40152 - RNA, 23 nt, Artificial Sequence
  RNA Oligomer
caggugagggagaagaaauuucc

SEQ ID NO: 40153 - RNA, 23 nt, Artificial Sequence
  RNA Oligomer
acaggugagggagaagaaauuuc

SEQ ID NO: 40154 - RNA, 23 nt, Artificial Sequence
  RNA Oligomer
cacaggugagggagaagaaauuu

SEQ ID NO: 40155 - RNA, 23 nt, Artificial Sequence
  RNA Oligomer
acacaggugagggagaagaaauu

SEQ ID NO: 40156 - RNA, 23 nt, Artificial Sequence
  RNA Oligomer
guggcgcauuucuucaaccugga

SEQ ID NO: 40157 - RNA, 23 nt, Artificial Sequence
  RNA Oligomer
gcaugcuaauucuaauaccuguc

SEQ ID NO: 40158 - RNA, 23 nt, Artificial Sequence
  RNA Oligomer
ugcaugcuaauucuaauaccugu

SEQ ID NO: 40159 - RNA, 23 nt, Artificial Sequence
  RNA Oligomer
cacugugccugaauuuuaacugc

SEQ ID NO: 40160 - RNA, 23 nt, Artificial Sequence
  RNA Oligomer
acguucuacugguaugaagagga

SEQ ID NO: 40161 - RNA, 23 nt, Artificial Sequence
  RNA Oligomer
cacguucuacugguaugaagagg

SEQ ID NO: 40162 - RNA, 23 nt, Artificial Sequence
  RNA Oligomer
acacguucuacugguaugaagag

SEQ ID NO: 40163 - RNA, 23 nt, Artificial Sequence
  RNA Oligomer
gacacguucuacugguaugaaga

SEQ ID NO: 40164 - RNA, 23 nt, Artificial Sequence
  RNA Oligomer
ugacacguucuacugguaugaag

SEQ ID NO: 40165 - RNA, 23 nt, Artificial Sequence
  RNA Oligomer
uugacacguucuacugguaugaa

SEQ ID NO: 40166 - RNA, 23 nt, Artificial Sequence
  RNA Oligomer
gucauauacaacagaacaaaaac

SEQ ID NO: 40167 - RNA, 23 nt, Artificial Sequence
  RNA Oligomer
ugucauauacaacagaacaaaaa

SEQ ID NO: 40168 - RNA, 23 nt, Artificial Sequence
  RNA Oligomer
augucauauacaacagaacaaaa

SEQ ID NO: 40169 - RNA, 23 nt, Artificial Sequence
  RNA Oligomer
caugucauauacaacagaacaaa

SEQ ID NO: 40170 - RNA, 23 nt, Artificial Sequence
  RNA Oligomer
acaugucauauacaacagaacaa

SEQ ID NO: 40171 - RNA, 23 nt, Artificial Sequence
  RNA Oligomer
cucucauggcugggaauaaauuu

SEQ ID NO: 40172 - RNA, 23 nt, Artificial Sequence
  RNA Oligomer
acucucauggcugggaauaaauu

SEQ ID NO: 40173 - RNA, 23 nt, Artificial Sequence
  RNA Oligomer
caggcauuguguuuucaaucaag

SEQ ID NO: 40174 - RNA, 23 nt, Artificial Sequence
  RNA Oligomer
agagcuucuagacuuuggagguc

SEQ ID NO: 40175 - RNA, 23 nt, Artificial Sequence
  RNA Oligomer
gagagcuucuagacuuuggaggu

SEQ ID NO: 40176 - RNA, 23 nt, Artificial Sequence
  RNA Oligomer
ggagagcuucuagacuuuggagg

SEQ ID NO: 40177 - RNA, 23 nt, Artificial Sequence
  RNA Oligomer
ugggacgaaaauacugacgugau

SEQ ID NO: 40178 - RNA, 23 nt, Artificial Sequence
  RNA Oligomer
cugggacgaaaauacugacguga

SEQ ID NO: 40179 - RNA, 23 nt, Artificial Sequence
  RNA Oligomer
acugggacgaaaauacugacgug

SEQ ID NO: 40180 - RNA, 23 nt, Artificial Sequence
  RNA Oligomer
cugaaaucuauaugguacaaaug

SEQ ID NO: 40181 - RNA, 23 nt, Artificial Sequence
  RNA Oligomer
ucugaaaucuauaugguacaaau

SEQ ID NO: 40182 - RNA, 23 nt, Artificial Sequence
  RNA Oligomer
uucugaaaucuauaugguacaaa

SEQ ID NO: 40183 - RNA, 23 nt, Artificial Sequence
  RNA Oligomer
cuucugaaaucuauaugguacaa

SEQ ID NO: 40184 - RNA, 23 nt, Artificial Sequence
  RNA Oligomer
ucuucugaaaucuauaugguaca

SEQ ID NO: 40185 - RNA, 23 nt, Artificial Sequence
  RNA Oligomer
auaauuagguucuggcgauuuca

SEQ ID NO: 40186 - RNA, 23 nt, Artificial Sequence
  RNA Oligomer
aauaauuagguucuggcgauuuc

SEQ ID NO: 40187 - RNA, 23 nt, Artificial Sequence
  RNA Oligomer
gaauaauuagguucuggcgauuu

SEQ ID NO: 40188 - RNA, 23 nt, Artificial Sequence
  RNA Oligomer
agaauaauuagguucuggcgauu

SEQ ID NO: 40189 - RNA, 23 nt, Artificial Sequence
  RNA Oligomer
aagaauaauuagguucuggcgau

SEQ ID NO: 40190 - RNA, 23 nt, Artificial Sequence
  RNA Oligomer
gucuuguaugcaugugaaagaau

SEQ ID NO: 40191 - RNA, 23 nt, Artificial Sequence
  RNA Oligomer
cccgugccucaauuuucuggcaa

SEQ ID NO: 40192 - RNA, 23 nt, Artificial Sequence
  RNA Oligomer
ccccgugccucaauuuucuggca

SEQ ID NO: 40193 - RNA, 23 nt, Artificial Sequence
  RNA Oligomer
gccccgugccucaauuuucuggc

SEQ ID NO: 40194 - RNA, 23 nt, Artificial Sequence
  RNA Oligomer
ugccccgugccucaauuuucugg

SEQ ID NO: 40195 - RNA, 23 nt, Artificial Sequence
  RNA Oligomer
augccccgugccucaauuuucug

SEQ ID NO: 40196 - RNA, 23 nt, Artificial Sequence
  RNA Oligomer
ugcacaacaucaccuucuguaga

SEQ ID NO: 40197 - RNA, 23 nt, Artificial Sequence
  RNA Oligomer
cugcacaacaucaccuucuguag

SEQ ID NO: 40198 - RNA, 23 nt, Artificial Sequence
  RNA Oligomer
ucugcacaacaucaccuucugua

SEQ ID NO: 40199 - RNA, 23 nt, Artificial Sequence
  RNA Oligomer
cucugcacaacaucaccuucugu

SEQ ID NO: 40200 - RNA, 23 nt, Artificial Sequence
  RNA Oligomer
ucucugcacaacaucaccuucug

SEQ ID NO: 40201 - RNA, 23 nt, Artificial Sequence
  RNA Oligomer
cucucugcacaacaucaccuucu

SEQ ID NO: 40202 - RNA, 23 nt, Artificial Sequence
  RNA Oligomer
ucucucugcacaacaucaccuuc

SEQ ID NO: 40203 - RNA, 23 nt, Artificial Sequence
  RNA Oligomer
cucucucugcacaacaucaccuu

SEQ ID NO: 40204 - RNA, 23 nt, Artificial Sequence
  RNA Oligomer
gaaauuuccugacagccgaagag

SEQ ID NO: 40205 - RNA, 23 nt, Artificial Sequence
  RNA Oligomer
agaaauuuccugacagccgaaga

SEQ ID NO: 40206 - RNA, 23 nt, Artificial Sequence
  RNA Oligomer
aagaaauuuccugacagccgaag

SEQ ID NO: 40207 - RNA, 23 nt, Artificial Sequence
  RNA Oligomer
gaagaaauuuccugacagccgaa

SEQ ID NO: 40208 - RNA, 23 nt, Artificial Sequence
  RNA Oligomer
agaagaaauuuccugacagccga

SEQ ID NO: 40209 - RNA, 23 nt, Artificial Sequence
  RNA Oligomer
gucucucucugcacaacaucacc

SEQ ID NO: 40210 - RNA, 23 nt, Artificial Sequence
  RNA Oligomer
agucucucucugcacaacaucac

SEQ ID NO: 40211 - RNA, 23 nt, Artificial Sequence
  RNA Oligomer
cagucucucucugcacaacauca

SEQ ID NO: 40212 - RNA, 23 nt, Artificial Sequence
  RNA Oligomer
acagucucucucugcacaacauc

SEQ ID NO: 40213 - RNA, 23 nt, Artificial Sequence
  RNA Oligomer
gacagucucucucugcacaacau

SEQ ID NO: 40214 - RNA, 23 nt, Artificial Sequence
  RNA Oligomer
cacacaccauguuuucaucgucu

SEQ ID NO: 40215 - RNA, 23 nt, Artificial Sequence
  RNA Oligomer
acacacaccauguuuucaucguc

SEQ ID NO: 40216 - RNA, 23 nt, Artificial Sequence
  RNA Oligomer
uacacacaccauguuuucaucgu

SEQ ID NO: 40217 - RNA, 23 nt, Artificial Sequence
  RNA Oligomer
guacacacaccauguuuucaucg

SEQ ID NO: 40218 - RNA, 23 nt, Artificial Sequence
  RNA Oligomer
gguacacacaccauguuuucauc

SEQ ID NO: 40219 - RNA, 23 nt, Artificial Sequence
  RNA Oligomer
cacaaccacugaauugcuaagga

SEQ ID NO: 40220 - RNA, 23 nt, Artificial Sequence
  RNA Oligomer
ucguggcgcauuucuucaaccug

SEQ ID NO: 40221 - RNA, 23 nt, Artificial Sequence
  RNA Oligomer
aucguggcgcauuucuucaaccu

SEQ ID NO: 40222 - RNA, 23 nt, Artificial Sequence
  RNA Oligomer
caucguggcgcauuucuucaacc

SEQ ID NO: 40223 - RNA, 23 nt, Artificial Sequence
  RNA Oligomer
acaucguggcgcauuucuucaac

SEQ ID NO: 40224 - RNA, 23 nt, Artificial Sequence
  RNA Oligomer
cacaucguggcgcauuucuucaa

SEQ ID NO: 40225 - RNA, 23 nt, Artificial Sequence
  RNA Oligomer
gaggcaauuagacaaaaaccuca

SEQ ID NO: 40226 - RNA, 23 nt, Artificial Sequence
  RNA Oligomer
cauaagaggaacaaguauuugcu

SEQ ID NO: 40227 - RNA, 23 nt, Artificial Sequence
  RNA Oligomer
cuacugguaugaagaggaggagu

SEQ ID NO: 40228 - RNA, 23 nt, Artificial Sequence
  RNA Oligomer
ucuacugguaugaagaggaggag

SEQ ID NO: 40229 - RNA, 23 nt, Artificial Sequence
  RNA Oligomer
uucuacugguaugaagaggagga

SEQ ID NO: 40230 - RNA, 23 nt, Artificial Sequence
  RNA Oligomer
guucuacugguaugaagaggagg

SEQ ID NO: 40231 - RNA, 23 nt, Artificial Sequence
  RNA Oligomer
cguucuacugguaugaagaggag

SEQ ID NO: 40232 - RNA, 23 nt, Artificial Sequence
  RNA Oligomer
auugacacguucuacugguauga

SEQ ID NO: 40233 - RNA, 23 nt, Artificial Sequence
  RNA Oligomer
cauacuuccuuagcuuauaaaua

SEQ ID NO: 40234 - RNA, 23 nt, Artificial Sequence
  RNA Oligomer
ggaacuggugaauaauaauuaac

SEQ ID NO: 40235 - RNA, 23 nt, Artificial Sequence
  RNA Oligomer
uacucucauggcugggaauaaau

SEQ ID NO: 40236 - RNA, 23 nt, Artificial Sequence
  RNA Oligomer
guacucucauggcugggaauaaa

SEQ ID NO: 40237 - RNA, 23 nt, Artificial Sequence
  RNA Oligomer
ccacuuguauucaucagcugacc

SEQ ID NO: 40238 - RNA, 23 nt, Artificial Sequence
  RNA Oligomer
gccacuuguauucaucagcugac

SEQ ID NO: 40239 - RNA, 23 nt, Artificial Sequence
  RNA Oligomer
ugccacuuguauucaucagcuga

SEQ ID NO: 40240 - RNA, 23 nt, Artificial Sequence
  RNA Oligomer
gugccacuuguauucaucagcug

SEQ ID NO: 40241 - RNA, 23 nt, Artificial Sequence
  RNA Oligomer
ugugccacuuguauucaucagcu

SEQ ID NO: 40242 - RNA, 23 nt, Artificial Sequence
  RNA Oligomer
cuccaccauauuaguacucucau

SEQ ID NO: 40243 - RNA, 23 nt, Artificial Sequence
  RNA Oligomer
aauacugacgugauuacaggcuu

SEQ ID NO: 40244 - RNA, 23 nt, Artificial Sequence
  RNA Oligomer
gcuuuacacugggacgaaaauac

SEQ ID NO: 40245 - RNA, 23 nt, Artificial Sequence
  RNA Oligomer
agcuuuacacugggacgaaaaua

SEQ ID NO: 40246 - RNA, 23 nt, Artificial Sequence
  RNA Oligomer
uagcuuuacacugggacgaaaau

SEQ ID NO: 40247 - RNA, 23 nt, Artificial Sequence
  RNA Oligomer
auagcuuuacacugggacgaaaa

SEQ ID NO: 40248 - RNA, 23 nt, Artificial Sequence
  RNA Oligomer
cauagcuuuacacugggacgaaa

SEQ ID NO: 40249 - RNA, 23 nt, Artificial Sequence
  RNA Oligomer
cgggaugcaagagcuuuugagug

SEQ ID NO: 40250 - RNA, 23 nt, Artificial Sequence
  RNA Oligomer
ccgggaugcaagagcuuuugagu

SEQ ID NO: 40251 - RNA, 23 nt, Artificial Sequence
  RNA Oligomer
gccgggaugcaagagcuuuugag

SEQ ID NO: 40252 - RNA, 23 nt, Artificial Sequence
  RNA Oligomer
ugccgggaugcaagagcuuuuga

SEQ ID NO: 40253 - RNA, 23 nt, Artificial Sequence
  RNA Oligomer
uugccgggaugcaagagcuuuug

SEQ ID NO: 40254 - RNA, 23 nt, Artificial Sequence
  RNA Oligomer
cucuucugaaaucuauaugguac

SEQ ID NO: 40255 - RNA, 23 nt, Artificial Sequence
  RNA Oligomer
gagaagaaauuuccugacagccg

SEQ ID NO: 40256 - RNA, 23 nt, Artificial Sequence
  RNA Oligomer
ggagaagaaauuuccugacagcc

SEQ ID NO: 40257 - RNA, 23 nt, Artificial Sequence
  RNA Oligomer
gggagaagaaauuuccugacagc

SEQ ID NO: 40258 - RNA, 23 nt, Artificial Sequence
  RNA Oligomer
ggccuccuaugaguuguucuggu

SEQ ID NO: 40259 - RNA, 23 nt, Artificial Sequence
  RNA Oligomer
gaucucucuggcuuuagucuuga

SEQ ID NO: 40260 - RNA, 23 nt, Artificial Sequence
  RNA Oligomer
ugaucucucuggcuuuagucuug

SEQ ID NO: 40261 - RNA, 23 nt, Artificial Sequence
  RNA Oligomer
gugaucucucuggcuuuagucuu

SEQ ID NO: 40262 - RNA, 23 nt, Artificial Sequence
  RNA Oligomer
uccccacaaacacaaccacugaa

SEQ ID NO: 40263 - RNA, 23 nt, Artificial Sequence
  RNA Oligomer
uuccccacaaacacaaccacuga

SEQ ID NO: 40264 - RNA, 23 nt, Artificial Sequence
  RNA Oligomer
cuuccccacaaacacaaccacug

SEQ ID NO: 40265 - RNA, 23 nt, Artificial Sequence
  RNA Oligomer
caaaaaccucagauuucacaaac

SEQ ID NO: 40266 - RNA, 23 nt, Artificial Sequence
  RNA Oligomer
acaaaaaccucagauuucacaaa

SEQ ID NO: 40267 - RNA, 23 nt, Artificial Sequence
  RNA Oligomer
caauuagacaaaaaccucagauu

SEQ ID NO: 40268 - RNA, 23 nt, Artificial Sequence
  RNA Oligomer
gcaauuagacaaaaaccucagau

SEQ ID NO: 40269 - RNA, 23 nt, Artificial Sequence
  RNA Oligomer
gucagucgaaaccuuauuucauu

SEQ ID NO: 40270 - RNA, 23 nt, Artificial Sequence
  RNA Oligomer
ugucagucgaaaccuuauuucau

SEQ ID NO: 40271 - RNA, 23 nt, Artificial Sequence
  RNA Oligomer
cugucagucgaaaccuuauuuca

SEQ ID NO: 40272 - RNA, 23 nt, Artificial Sequence
  RNA Oligomer
ccugucagucgaaaccuuauuuc

SEQ ID NO: 40273 - RNA, 23 nt, Artificial Sequence
  RNA Oligomer
accugucagucgaaaccuuauuu

SEQ ID NO: 40274 - RNA, 23 nt, Artificial Sequence
  RNA Oligomer
cuaauucuaauaccugucagucg

SEQ ID NO: 40275 - RNA, 23 nt, Artificial Sequence
  RNA Oligomer
gcuaauucuaauaccugucaguc

SEQ ID NO: 40276 - RNA, 23 nt, Artificial Sequence
  RNA Oligomer
ugcuaauucuaauaccugucagu

SEQ ID NO: 40277 - RNA, 23 nt, Artificial Sequence
  RNA Oligomer
augcuaauucuaauaccugucag

SEQ ID NO: 40278 - RNA, 23 nt, Artificial Sequence
  RNA Oligomer
caugcuaauucuaauaccuguca

SEQ ID NO: 40279 - RNA, 23 nt, Artificial Sequence
  RNA Oligomer
ccugaauuuuaacugcaugcuaa

SEQ ID NO: 40280 - RNA, 23 nt, Artificial Sequence
  RNA Oligomer
uauugacacguucuacugguaug

SEQ ID NO: 40281 - RNA, 23 nt, Artificial Sequence
  RNA Oligomer
uuauugacacguucuacugguau

SEQ ID NO: 40282 - RNA, 23 nt, Artificial Sequence
  RNA Oligomer
ugaccccagagguguucauuucu

SEQ ID NO: 40283 - RNA, 23 nt, Artificial Sequence
  RNA Oligomer
ucuccaccauauuaguacucuca

SEQ ID NO: 40284 - RNA, 23 nt, Artificial Sequence
  RNA Oligomer
cacugggacgaaaauacugacgu

SEQ ID NO: 40285 - RNA, 23 nt, Artificial Sequence
  RNA Oligomer
gguuugcugaucucuuacucucc

SEQ ID NO: 40286 - RNA, 23 nt, Artificial Sequence
  RNA Oligomer
ugguuugcugaucucuuacucuc

SEQ ID NO: 40287 - RNA, 23 nt, Artificial Sequence
  RNA Oligomer
gugguuugcugaucucuuacucu

SEQ ID NO: 40288 - RNA, 23 nt, Artificial Sequence
  RNA Oligomer
agugguuugcugaucucuuacuc

SEQ ID NO: 40289 - RNA, 23 nt, Artificial Sequence
  RNA Oligomer
gagugguuugcugaucucuuacu

SEQ ID NO: 40290 - RNA, 23 nt, Artificial Sequence
  RNA Oligomer
gggugcuggauuuugaaugaggg

SEQ ID NO: 40291 - RNA, 23 nt, Artificial Sequence
  RNA Oligomer
ggggugcuggauuuugaaugagg

SEQ ID NO: 40292 - RNA, 23 nt, Artificial Sequence
  RNA Oligomer
uggggugcuggauuuugaaugag

SEQ ID NO: 40293 - RNA, 23 nt, Artificial Sequence
  RNA Oligomer
auggggugcuggauuuugaauga

SEQ ID NO: 40294 - RNA, 23 nt, Artificial Sequence
  RNA Oligomer
gauggggugcuggauuuugaaug

SEQ ID NO: 40295 - RNA, 23 nt, Artificial Sequence
  RNA Oligomer
gcguggcuuuaaaauggcgccag

SEQ ID NO: 40296 - RNA, 23 nt, Artificial Sequence
  RNA Oligomer
agcguggcuuuaaaauggcgcca

SEQ ID NO: 40297 - RNA, 23 nt, Artificial Sequence
  RNA Oligomer
aagcguggcuuuaaaauggcgcc

SEQ ID NO: 40298 - RNA, 23 nt, Artificial Sequence
  RNA Oligomer
aaagcguggcuuuaaaauggcgc

SEQ ID NO: 40299 - RNA, 23 nt, Artificial Sequence
  RNA Oligomer
aaaagcguggcuuuaaaauggcg

SEQ ID NO: 40300 - RNA, 23 nt, Artificial Sequence
  RNA Oligomer
uaauuagguucuggcgauuucaa

SEQ ID NO: 40301 - RNA, 23 nt, Artificial Sequence
  RNA Oligomer
ccuguggucuuguaugcauguga

SEQ ID NO: 40302 - RNA, 23 nt, Artificial Sequence
  RNA Oligomer
cccuguggucuuguaugcaugug

SEQ ID NO: 40303 - RNA, 23 nt, Artificial Sequence
  RNA Oligomer
gcccuguggucuuguaugcaugu

SEQ ID NO: 40304 - RNA, 23 nt, Artificial Sequence
  RNA Oligomer
ggcccuguggucuuguaugcaug

SEQ ID NO: 40305 - RNA, 23 nt, Artificial Sequence
  RNA Oligomer
aggcccuguggucuuguaugcau

SEQ ID NO: 40306 - RNA, 23 nt, Artificial Sequence
  RNA Oligomer
acaucaccuucuguagagaccgc

SEQ ID NO: 40307 - RNA, 23 nt, Artificial Sequence
  RNA Oligomer
aacaucaccuucuguagagaccg

SEQ ID NO: 40308 - RNA, 23 nt, Artificial Sequence
  RNA Oligomer
caacaucaccuucuguagagacc

SEQ ID NO: 40309 - RNA, 23 nt, Artificial Sequence
  RNA Oligomer
acaacaucaccuucuguagagac

SEQ ID NO: 40310 - RNA, 23 nt, Artificial Sequence
  RNA Oligomer
cacaacaucaccuucuguagaga

SEQ ID NO: 40311 - RNA, 23 nt, Artificial Sequence
  RNA Oligomer
ggucuggugaucucucuggcuuu

SEQ ID NO: 40312 - RNA, 23 nt, Artificial Sequence
  RNA Oligomer
cggucuggugaucucucuggcuu

SEQ ID NO: 40313 - RNA, 23 nt, Artificial Sequence
  RNA Oligomer
caaacacaaccacugaauugcua

SEQ ID NO: 40314 - RNA, 23 nt, Artificial Sequence
  RNA Oligomer
agacacaggugagggagaagaaa

SEQ ID NO: 40315 - RNA, 23 nt, Artificial Sequence
  RNA Oligomer
cagacacaggugagggagaagaa

SEQ ID NO: 40316 - RNA, 23 nt, Artificial Sequence
  RNA Oligomer
ccagacacaggugagggagaaga

SEQ ID NO: 40317 - RNA, 23 nt, Artificial Sequence
  RNA Oligomer
uccagacacaggugagggagaag

SEQ ID NO: 40318 - RNA, 23 nt, Artificial Sequence
  RNA Oligomer
auccagacacaggugagggagaa

SEQ ID NO: 40319 - RNA, 23 nt, Artificial Sequence
  RNA Oligomer
cguggcgcauuucuucaaccugg

SEQ ID NO: 40320 - RNA, 23 nt, Artificial Sequence
  RNA Oligomer
ggcaauuagacaaaaaccucaga

SEQ ID NO: 40321 - RNA, 23 nt, Artificial Sequence
  RNA Oligomer
aggcaauuagacaaaaaccucag

SEQ ID NO: 40322 - RNA, 23 nt, Artificial Sequence
  RNA Oligomer
uuuaacugcaugcuaauucuaau

SEQ ID NO: 40323 - RNA, 23 nt, Artificial Sequence
  RNA Oligomer
acugugccugaauuuuaacugca

SEQ ID NO: 40324 - RNA, 23 nt, Artificial Sequence
  RNA Oligomer
caguugggaacuggugaauaaua

SEQ ID NO: 40325 - RNA, 23 nt, Artificial Sequence
  RNA Oligomer
ccaguugggaacuggugaauaau

SEQ ID NO: 40326 - RNA, 23 nt, Artificial Sequence
  RNA Oligomer
cccaguugggaacuggugaauaa

SEQ ID NO: 40327 - RNA, 23 nt, Artificial Sequence
  RNA Oligomer
caaguccaggcauuguguuuuca

SEQ ID NO: 40328 - RNA, 23 nt, Artificial Sequence
  RNA Oligomer
ucaaguccaggcauuguguuuuc

SEQ ID NO: 40329 - RNA, 23 nt, Artificial Sequence
  RNA Oligomer
caacaaggagagcuucuagacuu

SEQ ID NO: 40330 - RNA, 23 nt, Artificial Sequence
  RNA Oligomer
ccuggaaacacggaugagugagc

SEQ ID NO: 40331 - RNA, 23 nt, Artificial Sequence
  RNA Oligomer
cccuggaaacacggaugagugag

SEQ ID NO: 40332 - RNA, 23 nt, Artificial Sequence
  RNA Oligomer
ucccuggaaacacggaugaguga

SEQ ID NO: 40333 - RNA, 23 nt, Artificial Sequence
  RNA Oligomer
cucccuggaaacacggaugagug

SEQ ID NO: 40334 - RNA, 23 nt, Artificial Sequence
  RNA Oligomer
ucucccuggaaacacggaugagu

SEQ ID NO: 40335 - RNA, 23 nt, Artificial Sequence
  RNA Oligomer
ggugcuggauuuugaaugagggu

SEQ ID NO: 40336 - RNA, 23 nt, Artificial Sequence
  RNA Oligomer
aacugcccugacagauguauuuc

SEQ ID NO: 40337 - RNA, 23 nt, Artificial Sequence
  RNA Oligomer
agguucuggcgauuucaacaaga

SEQ ID NO: 40338 - RNA, 23 nt, Artificial Sequence
  RNA Oligomer
uagguucuggcgauuucaacaag

SEQ ID NO: 40339 - RNA, 23 nt, Artificial Sequence
  RNA Oligomer
uuagguucuggcgauuucaacaa

SEQ ID NO: 40340 - RNA, 23 nt, Artificial Sequence
  RNA Oligomer
acccucggcuuggaaauggauuu

SEQ ID NO: 40341 - RNA, 23 nt, Artificial Sequence
  RNA Oligomer
ggugagggagaagaaauuuccug

SEQ ID NO: 40342 - RNA, 23 nt, Artificial Sequence
  RNA Oligomer
gacacaggugagggagaagaaau

SEQ ID NO: 40343 - RNA, 23 nt, Artificial Sequence
  RNA Oligomer
ccacaucguggcgcauuucuuca

SEQ ID NO: 40344 - RNA, 23 nt, Artificial Sequence
  RNA Oligomer
uccacaucguggcgcauuucuuc

SEQ ID NO: 40345 - RNA, 23 nt, Artificial Sequence
  RNA Oligomer
auccacaucguggcgcauuucuu

SEQ ID NO: 40346 - RNA, 23 nt, Artificial Sequence
  RNA Oligomer
gacccaacauccagacacaggug

SEQ ID NO: 40347 - RNA, 23 nt, Artificial Sequence
  RNA Oligomer
cgacccaacauccagacacaggu

SEQ ID NO: 40348 - RNA, 23 nt, Artificial Sequence
  RNA Oligomer
acgacccaacauccagacacagg

SEQ ID NO: 40349 - RNA, 23 nt, Artificial Sequence
  RNA Oligomer
aacgacccaacauccagacacag

SEQ ID NO: 40350 - RNA, 23 nt, Artificial Sequence
  RNA Oligomer
uaacgacccaacauccagacaca

SEQ ID NO: 40351 - RNA, 23 nt, Artificial Sequence
  RNA Oligomer
ugaauuuuaacugcaugcuaauu

SEQ ID NO: 40352 - RNA, 23 nt, Artificial Sequence
  RNA Oligomer
cugaauuuuaacugcaugcuaau

SEQ ID NO: 40353 - RNA, 23 nt, Artificial Sequence
  RNA Oligomer
gaguuauuuuggguucaacacug

SEQ ID NO: 40354 - RNA, 23 nt, Artificial Sequence
  RNA Oligomer
auuacacacgaguuauuuugggu

SEQ ID NO: 40355 - RNA, 23 nt, Artificial Sequence
  RNA Oligomer
guguucuucuguggaccuaaagc

SEQ ID NO: 40356 - RNA, 23 nt, Artificial Sequence
  RNA Oligomer
cguguucuucuguggaccuaaag

SEQ ID NO: 40357 - RNA, 23 nt, Artificial Sequence
  RNA Oligomer
gcguguucuucuguggaccuaaa

SEQ ID NO: 40358 - RNA, 23 nt, Artificial Sequence
  RNA Oligomer
ggcguguucuucuguggaccuaa

SEQ ID NO: 40359 - RNA, 23 nt, Artificial Sequence
  RNA Oligomer
uggcguguucuucuguggaccua

SEQ ID NO: 40360 - RNA, 23 nt, Artificial Sequence
  RNA Oligomer
guauuggcguguucuucugugga

SEQ ID NO: 40361 - RNA, 23 nt, Artificial Sequence
  RNA Oligomer
aguauuggcguguucuucugugg

SEQ ID NO: 40362 - RNA, 23 nt, Artificial Sequence
  RNA Oligomer
caguauuggcguguucuucugug

SEQ ID NO: 40363 - RNA, 23 nt, Artificial Sequence
  RNA Oligomer
gaaaauacugacgugauuacagg

SEQ ID NO: 40364 - RNA, 23 nt, Artificial Sequence
  RNA Oligomer
cugaucucuuacucucccuggaa

SEQ ID NO: 40365 - RNA, 23 nt, Artificial Sequence
  RNA Oligomer
gcugaucucuuacucucccugga

SEQ ID NO: 40366 - RNA, 23 nt, Artificial Sequence
  RNA Oligomer
ugcugaucucuuacucucccugg

SEQ ID NO: 40367 - RNA, 23 nt, Artificial Sequence
  RNA Oligomer
uugcugaucucuuacucucccug

SEQ ID NO: 40368 - RNA, 23 nt, Artificial Sequence
  RNA Oligomer
uuugcugaucucuuacucucccu

SEQ ID NO: 40369 - RNA, 23 nt, Artificial Sequence
  RNA Oligomer
gcuuuugagugguuugcugaucu

SEQ ID NO: 40370 - RNA, 23 nt, Artificial Sequence
  RNA Oligomer
agcuuuugagugguuugcugauc

SEQ ID NO: 40371 - RNA, 23 nt, Artificial Sequence
  RNA Oligomer
gagcuuuugagugguuugcugau

SEQ ID NO: 40372 - RNA, 23 nt, Artificial Sequence
  RNA Oligomer
agagcuuuugagugguuugcuga

SEQ ID NO: 40373 - RNA, 23 nt, Artificial Sequence
  RNA Oligomer
aagagcuuuugagugguuugcug

SEQ ID NO: 40374 - RNA, 23 nt, Artificial Sequence
  RNA Oligomer
gggaugcaagagcuuuugagugg

SEQ ID NO: 40375 - RNA, 23 nt, Artificial Sequence
  RNA Oligomer
cuacuggauuugccgggaugcaa

SEQ ID NO: 40376 - RNA, 23 nt, Artificial Sequence
  RNA Oligomer
ucuacuggauuugccgggaugca

SEQ ID NO: 40377 - RNA, 23 nt, Artificial Sequence
  RNA Oligomer
uucuacuggauuugccgggaugc

SEQ ID NO: 40378 - RNA, 23 nt, Artificial Sequence
  RNA Oligomer
uuucuacuggauuugccgggaug

SEQ ID NO: 40379 - RNA, 23 nt, Artificial Sequence
  RNA Oligomer
auuucuacuggauuugccgggau

SEQ ID NO: 40380 - RNA, 23 nt, Artificial Sequence
  RNA Oligomer
aagaaguugucauuaccaaggug

SEQ ID NO: 40381 - RNA, 23 nt, Artificial Sequence
  RNA Oligomer
caagaaguugucauuaccaaggu

SEQ ID NO: 40382 - RNA, 23 nt, Artificial Sequence
  RNA Oligomer
acaagaaguugucauuaccaagg

SEQ ID NO: 40383 - RNA, 23 nt, Artificial Sequence
  RNA Oligomer
aacaagaaguugucauuaccaag

SEQ ID NO: 40384 - RNA, 23 nt, Artificial Sequence
  RNA Oligomer
caacaagaaguugucauuaccaa

SEQ ID NO: 40385 - RNA, 23 nt, Artificial Sequence
  RNA Oligomer
acacaaccacugaauugcuaagg

SEQ ID NO: 40386 - RNA, 23 nt, Artificial Sequence
  RNA Oligomer
aacacaaccacugaauugcuaag

SEQ ID NO: 40387 - RNA, 23 nt, Artificial Sequence
  RNA Oligomer
augaagaggaggagucuuuccau

SEQ ID NO: 40388 - RNA, 23 nt, Artificial Sequence
  RNA Oligomer
uaugaagaggaggagucuuucca

SEQ ID NO: 40389 - RNA, 23 nt, Artificial Sequence
  RNA Oligomer
guaugaagaggaggagucuuucc

SEQ ID NO: 40390 - RNA, 23 nt, Artificial Sequence
  RNA Oligomer
gguaugaagaggaggagucuuuc

SEQ ID NO: 40391 - RNA, 23 nt, Artificial Sequence
  RNA Oligomer
ugguaugaagaggaggagucuuu

SEQ ID NO: 40392 - RNA, 23 nt, Artificial Sequence
  RNA Oligomer
cugguaugaagaggaggagucuu

SEQ ID NO: 40393 - RNA, 23 nt, Artificial Sequence
  RNA Oligomer
acugguaugaagaggaggagucu

SEQ ID NO: 40394 - RNA, 23 nt, Artificial Sequence
  RNA Oligomer
uacugguaugaagaggaggaguc

SEQ ID NO: 40395 - RNA, 23 nt, Artificial Sequence
  RNA Oligomer
uuuauugacacguucuacuggua

SEQ ID NO: 40396 - RNA, 23 nt, Artificial Sequence
  RNA Oligomer
uguuuauugacacguucuacugg

SEQ ID NO: 40397 - RNA, 23 nt, Artificial Sequence
  RNA Oligomer
cuguuuauugacacguucuacug

SEQ ID NO: 40398 - RNA, 23 nt, Artificial Sequence
  RNA Oligomer
ucuguuuauugacacguucuacu

SEQ ID NO: 40399 - RNA, 23 nt, Artificial Sequence
  RNA Oligomer
aucuguuuauugacacguucuac

SEQ ID NO: 40400 - RNA, 23 nt, Artificial Sequence
  RNA Oligomer
uaucuguuuauugacacguucua

SEQ ID NO: 40401 - RNA, 23 nt, Artificial Sequence
  RNA Oligomer
gacggccuguugauaugagcucc

SEQ ID NO: 40402 - RNA, 23 nt, Artificial Sequence
  RNA Oligomer
ugacggccuguugauaugagcuc

SEQ ID NO: 40403 - RNA, 23 nt, Artificial Sequence
  RNA Oligomer
gugacggccuguugauaugagcu

SEQ ID NO: 40404 - RNA, 23 nt, Artificial Sequence
  RNA Oligomer
ugugacggccuguugauaugagc

SEQ ID NO: 40405 - RNA, 23 nt, Artificial Sequence
  RNA Oligomer
cugugacggccuguugauaugag

SEQ ID NO: 40406 - RNA, 23 nt, Artificial Sequence
  RNA Oligomer
ccugugacggccuguugauauga

SEQ ID NO: 40407 - RNA, 23 nt, Artificial Sequence
  RNA Oligomer
uccugugacggccuguugauaug

SEQ ID NO: 40408 - RNA, 23 nt, Artificial Sequence
  RNA Oligomer
caaaagaugugccacuuguauuc

SEQ ID NO: 40409 - RNA, 23 nt, Artificial Sequence
  RNA Oligomer
ucaaaagaugugccacuuguauu

SEQ ID NO: 40410 - RNA, 23 nt, Artificial Sequence
  RNA Oligomer
uucaaaagaugugccacuuguau

SEQ ID NO: 40411 - RNA, 23 nt, Artificial Sequence
  RNA Oligomer
cuucaaaagaugugccacuugua

SEQ ID NO: 40412 - RNA, 23 nt, Artificial Sequence
  RNA Oligomer
acuucaaaagaugugccacuugu

SEQ ID NO: 40413 - RNA, 23 nt, Artificial Sequence
  RNA Oligomer
cacuucaaaagaugugccacuug

SEQ ID NO: 40414 - RNA, 23 nt, Artificial Sequence
  RNA Oligomer
acacuucaaaagaugugccacuu

SEQ ID NO: 40415 - RNA, 23 nt, Artificial Sequence
  RNA Oligomer
guucuucuguggaccuaaagcuc

SEQ ID NO: 40416 - RNA, 23 nt, Artificial Sequence
  RNA Oligomer
uguucuucuguggaccuaaagcu

SEQ ID NO: 40417 - RNA, 23 nt, Artificial Sequence
  RNA Oligomer
acauagcuuuacacugggacgaa

SEQ ID NO: 40418 - RNA, 23 nt, Artificial Sequence
  RNA Oligomer
gcuuuaaaauggcgccagggcag

SEQ ID NO: 40419 - RNA, 23 nt, Artificial Sequence
  RNA Oligomer
ggcuuuaaaauggcgccagggca

SEQ ID NO: 40420 - RNA, 23 nt, Artificial Sequence
  RNA Oligomer
uggcuuuaaaauggcgccagggc

SEQ ID NO: 40421 - RNA, 23 nt, Artificial Sequence
  RNA Oligomer
guggcuuuaaaauggcgccaggg

SEQ ID NO: 40422 - RNA, 23 nt, Artificial Sequence
  RNA Oligomer
cguggcuuuaaaauggcgccagg

SEQ ID NO: 40423 - RNA, 23 nt, Artificial Sequence
  RNA Oligomer
ucaacaagaaguugucauuacca

SEQ ID NO: 40424 - RNA, 23 nt, Artificial Sequence
  RNA Oligomer
uucaacaagaaguugucauuacc

SEQ ID NO: 40425 - RNA, 23 nt, Artificial Sequence
  RNA Oligomer
cgucuucuuucucagccuggcca

SEQ ID NO: 40426 - RNA, 23 nt, Artificial Sequence
  RNA Oligomer
cuguugauaugagcucccaguug

SEQ ID NO: 40427 - RNA, 23 nt, Artificial Sequence
  RNA Oligomer
ccuguugauaugagcucccaguu

SEQ ID NO: 40428 - RNA, 23 nt, Artificial Sequence
  RNA Oligomer
gccuguugauaugagcucccagu

SEQ ID NO: 40429 - RNA, 23 nt, Artificial Sequence
  RNA Oligomer
ggccuguugauaugagcucccag

SEQ ID NO: 40430 - RNA, 23 nt, Artificial Sequence
  RNA Oligomer
cggccuguugauaugagcuccca

SEQ ID NO: 40431 - RNA, 23 nt, Artificial Sequence
  RNA Oligomer
acggccuguugauaugagcuccc

SEQ ID NO: 40432 - RNA, 23 nt, Artificial Sequence
  RNA Oligomer
gucaaguccaggcauuguguuuu

SEQ ID NO: 40433 - RNA, 23 nt, Artificial Sequence
  RNA Oligomer
ugaucucuuacucucccuggaaa

SEQ ID NO: 40434 - RNA, 23 nt, Artificial Sequence
  RNA Oligomer
acugaagcugagcaagguguauu

SEQ ID NO: 40435 - RNA, 23 nt, Artificial Sequence
  RNA Oligomer
cacugaagcugagcaagguguau

SEQ ID NO: 40436 - RNA, 23 nt, Artificial Sequence
  RNA Oligomer
gugcuggauuuugaaugaggguc

SEQ ID NO: 40437 - RNA, 23 nt, Artificial Sequence
  RNA Oligomer
aacccucggcuuggaaauggauu

SEQ ID NO: 40438 - RNA, 23 nt, Artificial Sequence
  RNA Oligomer
gaacccucggcuuggaaauggau

SEQ ID NO: 40439 - RNA, 23 nt, Artificial Sequence
  RNA Oligomer
cuucuguagagaccgcuaugcag

SEQ ID NO: 40440 - RNA, 23 nt, Artificial Sequence
  RNA Oligomer
ccuucuguagagaccgcuaugca

SEQ ID NO: 40441 - RNA, 23 nt, Artificial Sequence
  RNA Oligomer
accuucuguagagaccgcuaugc

SEQ ID NO: 40442 - RNA, 23 nt, Artificial Sequence
  RNA Oligomer
caccuucuguagagaccgcuaug

SEQ ID NO: 40443 - RNA, 23 nt, Artificial Sequence
  RNA Oligomer
ucaccuucuguagagaccgcuau

SEQ ID NO: 40444 - RNA, 23 nt, Artificial Sequence
  RNA Oligomer
aucaccuucuguagagaccgcua

SEQ ID NO: 40445 - RNA, 23 nt, Artificial Sequence
  RNA Oligomer
agacagucucucucugcacaaca

SEQ ID NO: 40446 - RNA, 23 nt, Artificial Sequence
  RNA Oligomer
aagacagucucucucugcacaac

SEQ ID NO: 40447 - RNA, 23 nt, Artificial Sequence
  RNA Oligomer
ggaggagucuuuccauuacacac

SEQ ID NO: 40448 - RNA, 23 nt, Artificial Sequence
  RNA Oligomer
aggaggagucuuuccauuacaca

SEQ ID NO: 40449 - RNA, 23 nt, Artificial Sequence
  RNA Oligomer
gaggaggagucuuuccauuacac

SEQ ID NO: 40450 - RNA, 23 nt, Artificial Sequence
  RNA Oligomer
agaggaggagucuuuccauuaca

SEQ ID NO: 40451 - RNA, 23 nt, Artificial Sequence
  RNA Oligomer
aagaggaggagucuuuccauuac

SEQ ID NO: 40452 - RNA, 23 nt, Artificial Sequence
  RNA Oligomer
uuaucuguuuauugacacguucu

SEQ ID NO: 40453 - RNA, 23 nt, Artificial Sequence
  RNA Oligomer
uuuaucuguuuauugacacguuc

SEQ ID NO: 40454 - RNA, 23 nt, Artificial Sequence
  RNA Oligomer
uuuuaucuguuuauugacacguu

SEQ ID NO: 40455 - RNA, 23 nt, Artificial Sequence
  RNA Oligomer
ggucaaguccaggcauuguguuu

SEQ ID NO: 40456 - RNA, 23 nt, Artificial Sequence
  RNA Oligomer
aggucaaguccaggcauuguguu

SEQ ID NO: 40457 - RNA, 23 nt, Artificial Sequence
  RNA Oligomer
gaggucaaguccaggcauugugu

SEQ ID NO: 40458 - RNA, 23 nt, Artificial Sequence
  RNA Oligomer
ggaggucaaguccaggcauugug

SEQ ID NO: 40459 - RNA, 23 nt, Artificial Sequence
  RNA Oligomer
cacuuguauucaucagcugaccc

SEQ ID NO: 40460 - RNA, 23 nt, Artificial Sequence
  RNA Oligomer
augugccacuuguauucaucagc

SEQ ID NO: 40461 - RNA, 23 nt, Artificial Sequence
  RNA Oligomer
gaugugccacuuguauucaucag

SEQ ID NO: 40462 - RNA, 23 nt, Artificial Sequence
  RNA Oligomer
ccacugaagcugagcaaggugua

SEQ ID NO: 40463 - RNA, 23 nt, Artificial Sequence
  RNA Oligomer
ggcuuggaaauggauuuuaggcc

SEQ ID NO: 40464 - RNA, 23 nt, Artificial Sequence
  RNA Oligomer
caaguuauugauuccaaagaacu

SEQ ID NO: 40465 - RNA, 23 nt, Artificial Sequence
  RNA Oligomer
ucaaguuauugauuccaaagaac

SEQ ID NO: 40466 - RNA, 23 nt, Artificial Sequence
  RNA Oligomer
aucaaguuauugauuccaaagaa

SEQ ID NO: 40467 - RNA, 23 nt, Artificial Sequence
  RNA Oligomer
aaucaaguuauugauuccaaaga

SEQ ID NO: 40468 - RNA, 23 nt, Artificial Sequence
  RNA Oligomer
caaucaaguuauugauuccaaag

SEQ ID NO: 40469 - RNA, 23 nt, Artificial Sequence
  RNA Oligomer
gcauuguguuuucaaucaaguua

SEQ ID NO: 40470 - RNA, 23 nt, Artificial Sequence
  RNA Oligomer
ggcauuguguuuucaaucaaguu

SEQ ID NO: 40471 - RNA, 23 nt, Artificial Sequence
  RNA Oligomer
aggcauuguguuuucaaucaagu

SEQ ID NO: 40472 - RNA, 23 nt, Artificial Sequence
  RNA Oligomer
agaugugccacuuguauucauca

SEQ ID NO: 40473 - RNA, 23 nt, Artificial Sequence
  RNA Oligomer
aagaugugccacuuguauucauc

SEQ ID NO: 40474 - RNA, 23 nt, Artificial Sequence
  RNA Oligomer
aaagaugugccacuuguauucau

SEQ ID NO: 40475 - RNA, 23 nt, Artificial Sequence
  RNA Oligomer
ucaggcucuucacauagcuuuac

SEQ ID NO: 40476 - RNA, 23 nt, Artificial Sequence
  RNA Oligomer
aucaggcucuucacauagcuuua

SEQ ID NO: 40477 - RNA, 23 nt, Artificial Sequence
  RNA Oligomer
aaucaggcucuucacauagcuuu

SEQ ID NO: 40478 - RNA, 23 nt, Artificial Sequence
  RNA Oligomer
cccacugaagcugagcaaggugu

SEQ ID NO: 40479 - RNA, 23 nt, Artificial Sequence
  RNA Oligomer
ccccacugaagcugagcaaggug

SEQ ID NO: 40480 - RNA, 23 nt, Artificial Sequence
  RNA Oligomer
accccacugaagcugagcaaggu

SEQ ID NO: 40481 - RNA, 23 nt, Artificial Sequence
  RNA Oligomer
cagggcaguacaucuuggugcag

SEQ ID NO: 40482 - RNA, 23 nt, Artificial Sequence
  RNA Oligomer
ccagggcaguacaucuuggugca

SEQ ID NO: 40483 - RNA, 23 nt, Artificial Sequence
  RNA Oligomer
gccagggcaguacaucuuggugc

SEQ ID NO: 40484 - RNA, 23 nt, Artificial Sequence
  RNA Oligomer
cgccagggcaguacaucuuggug

SEQ ID NO: 40485 - RNA, 23 nt, Artificial Sequence
  RNA Oligomer
gcgccagggcaguacaucuuggu

SEQ ID NO: 40486 - RNA, 23 nt, Artificial Sequence
  RNA Oligomer
ggauuuuaggcccuguggucuug

SEQ ID NO: 40487 - RNA, 23 nt, Artificial Sequence
  RNA Oligomer
uggauuuuaggcccuguggucuu

SEQ ID NO: 40488 - RNA, 23 nt, Artificial Sequence
  RNA Oligomer
auggauuuuaggcccuguggucu

SEQ ID NO: 40489 - RNA, 23 nt, Artificial Sequence
  RNA Oligomer
aauggauuuuaggcccugugguc

SEQ ID NO: 40490 - RNA, 23 nt, Artificial Sequence
  RNA Oligomer
aaauggauuuuaggcccuguggu

SEQ ID NO: 40491 - RNA, 23 nt, Artificial Sequence
  RNA Oligomer
gcacaacaucaccuucuguagag

SEQ ID NO: 40492 - RNA, 23 nt, Artificial Sequence
  RNA Oligomer
ugagugguuugcugaucucuuac

SEQ ID NO: 40493 - RNA, 23 nt, Artificial Sequence
  RNA Oligomer
uugagugguuugcugaucucuua

SEQ ID NO: 40494 - RNA, 23 nt, Artificial Sequence
  RNA Oligomer
uuugccgggaugcaagagcuuuu

SEQ ID NO: 40495 - RNA, 23 nt, Artificial Sequence
  RNA Oligomer
gaaaaagcguggcuuuaaaaugg

SEQ ID NO: 40496 - RNA, 23 nt, Artificial Sequence
  RNA Oligomer
ugaaaaagcguggcuuuaaaaug

SEQ ID NO: 40497 - RNA, 23 nt, Artificial Sequence
  RNA Oligomer
augaaaaagcguggcuuuaaaau

SEQ ID NO: 40498 - RNA, 23 nt, Artificial Sequence
  RNA Oligomer
caugaaaaagcguggcuuuaaaa

SEQ ID NO: 40499 - RNA, 23 nt, Artificial Sequence
  RNA Oligomer
acaugaaaaagcguggcuuuaaa

SEQ ID NO: 40500 - RNA, 23 nt, Artificial Sequence
  RNA Oligomer
uggaacuucacaugaaaaagcgu

SEQ ID NO: 40501 - RNA, 23 nt, Artificial Sequence
  RNA Oligomer
cuggaacuucacaugaaaaagcg

SEQ ID NO: 40502 - RNA, 23 nt, Artificial Sequence
  RNA Oligomer
ccuggaacuucacaugaaaaagc

SEQ ID NO: 40503 - RNA, 23 nt, Artificial Sequence
  RNA Oligomer
uaggcccuguggucuuguaugca

SEQ ID NO: 40504 - RNA, 23 nt, Artificial Sequence
  RNA Oligomer
ucuuuccauuacacacgaguuau

SEQ ID NO: 40505 - RNA, 23 nt, Artificial Sequence
  RNA Oligomer
gucuuuccauuacacacgaguua

SEQ ID NO: 40506 - RNA, 23 nt, Artificial Sequence
  RNA Oligomer
gaggagucuuuccauuacacacg

SEQ ID NO: 40507 - RNA, 23 nt, Artificial Sequence
  RNA Oligomer
aaaagaugugccacuuguauuca

SEQ ID NO: 40508 - RNA, 23 nt, Artificial Sequence
  RNA Oligomer
gaggcccaacuggaacaaugagu

SEQ ID NO: 40509 - RNA, 23 nt, Artificial Sequence
  RNA Oligomer
ggaggcccaacuggaacaaugag

SEQ ID NO: 40510 - RNA, 23 nt, Artificial Sequence
  RNA Oligomer
gggaggcccaacuggaacaauga

SEQ ID NO: 40511 - RNA, 23 nt, Artificial Sequence
  RNA Oligomer
acaggcuuaaagcagaagaccuu

SEQ ID NO: 40512 - RNA, 23 nt, Artificial Sequence
  RNA Oligomer
uacaggcuuaaagcagaagaccu

SEQ ID NO: 40513 - RNA, 23 nt, Artificial Sequence
  RNA Oligomer
uuacaggcuuaaagcagaagacc

SEQ ID NO: 40514 - RNA, 23 nt, Artificial Sequence
  RNA Oligomer
auuacaggcuuaaagcagaagac

SEQ ID NO: 40515 - RNA, 23 nt, Artificial Sequence
  RNA Oligomer
gauuacaggcuuaaagcagaaga

SEQ ID NO: 40516 - RNA, 23 nt, Artificial Sequence
  RNA Oligomer
gcgauuucaacaagaaguuguca

SEQ ID NO: 40517 - RNA, 23 nt, Artificial Sequence
  RNA Oligomer
ggcgauuucaacaagaaguuguc

SEQ ID NO: 40518 - RNA, 23 nt, Artificial Sequence
  RNA Oligomer
uggcgauuucaacaagaaguugu

SEQ ID NO: 40519 - RNA, 23 nt, Artificial Sequence
  RNA Oligomer
ugguacacacaccauguuuucau

SEQ ID NO: 40520 - RNA, 23 nt, Artificial Sequence
  RNA Oligomer
cugguacacacaccauguuuuca

SEQ ID NO: 40521 - RNA, 23 nt, Artificial Sequence
  RNA Oligomer
ucugguacacacaccauguuuuc

SEQ ID NO: 40522 - RNA, 23 nt, Artificial Sequence
  RNA Oligomer
uucugguacacacaccauguuuu

SEQ ID NO: 40523 - RNA, 23 nt, Artificial Sequence
  RNA Oligomer
acuggaacaaugaguucaagcag

SEQ ID NO: 40524 - RNA, 23 nt, Artificial Sequence
  RNA Oligomer
aacuggaacaaugaguucaagca

SEQ ID NO: 40525 - RNA, 23 nt, Artificial Sequence
  RNA Oligomer
caacuggaacaaugaguucaagc

SEQ ID NO: 40526 - RNA, 23 nt, Artificial Sequence
  RNA Oligomer
caggcuuaaagcagaagaccuuc

SEQ ID NO: 40527 - RNA, 23 nt, Artificial Sequence
  RNA Oligomer
gagggucucuccaccauauuagu

SEQ ID NO: 40528 - RNA, 23 nt, Artificial Sequence
  RNA Oligomer
ugagggucucuccaccauauuag

SEQ ID NO: 40529 - RNA, 23 nt, Artificial Sequence
  RNA Oligomer
augagggucucuccaccauauua

SEQ ID NO: 40530 - RNA, 23 nt, Artificial Sequence
  RNA Oligomer
aaugagggucucuccaccauauu

SEQ ID NO: 40531 - RNA, 23 nt, Artificial Sequence
  RNA Oligomer
gaaugagggucucuccaccauau

SEQ ID NO: 40532 - RNA, 23 nt, Artificial Sequence
  RNA Oligomer
ugacagccgaagagcaacaagua

SEQ ID NO: 40533 - RNA, 23 nt, Artificial Sequence
  RNA Oligomer
cugacagccgaagagcaacaagu

SEQ ID NO: 40534 - RNA, 23 nt, Artificial Sequence
  RNA Oligomer
ccugacagccgaagagcaacaag

SEQ ID NO: 40535 - RNA, 23 nt, Artificial Sequence
  RNA Oligomer
uccugacagccgaagagcaacaa

SEQ ID NO: 40536 - RNA, 23 nt, Artificial Sequence
  RNA Oligomer
cuaugggauagcuguuaaugcaa

SEQ ID NO: 40537 - RNA, 23 nt, Artificial Sequence
  RNA Oligomer
ccuaugggauagcuguuaaugca

SEQ ID NO: 40538 - RNA, 23 nt, Artificial Sequence
  RNA Oligomer
gccuaugggauagcuguuaaugc

SEQ ID NO: 40539 - RNA, 23 nt, Artificial Sequence
  RNA Oligomer
cgccuaugggauagcuguuaaug

SEQ ID NO: 40540 - RNA, 23 nt, Artificial Sequence
  RNA Oligomer
ucgccuaugggauagcuguuaau

SEQ ID NO: 40541 - RNA, 23 nt, Artificial Sequence
  RNA Oligomer
gucgccuaugggauagcuguuaa

SEQ ID NO: 40542 - RNA, 23 nt, Artificial Sequence
  RNA Oligomer
gucgaaaccuuauuucauucaua

SEQ ID NO: 40543 - RNA, 23 nt, Artificial Sequence
  RNA Oligomer
agucgaaaccuuauuucauucau

SEQ ID NO: 40544 - RNA, 23 nt, Artificial Sequence
  RNA Oligomer
cagucgaaaccuuauuucauuca

SEQ ID NO: 40545 - RNA, 23 nt, Artificial Sequence
  RNA Oligomer
ucagucgaaaccuuauuucauuc

SEQ ID NO: 40546 - RNA, 23 nt, Artificial Sequence
  RNA Oligomer
gaacaguacacuauaccauacuu

SEQ ID NO: 40547 - RNA, 23 nt, Artificial Sequence
  RNA Oligomer
ugaacaguacacuauaccauacu

SEQ ID NO: 40548 - RNA, 23 nt, Artificial Sequence
  RNA Oligomer
gugaacaguacacuauaccauac

SEQ ID NO: 40549 - RNA, 23 nt, Artificial Sequence
  RNA Oligomer
ugugaacaguacacuauaccaua

SEQ ID NO: 40550 - RNA, 23 nt, Artificial Sequence
  RNA Oligomer
uugugaacaguacacuauaccau

SEQ ID NO: 40551 - RNA, 23 nt, Artificial Sequence
  RNA Oligomer
guguauuucuacuggauuugccg

SEQ ID NO: 40552 - RNA, 23 nt, Artificial Sequence
  RNA Oligomer
gguguauuucuacuggauuugcc

SEQ ID NO: 40553 - RNA, 23 nt, Artificial Sequence
  RNA Oligomer
agguguauuucuacuggauuugc

SEQ ID NO: 40554 - RNA, 23 nt, Artificial Sequence
  RNA Oligomer
aagguguauuucuacuggauuug

SEQ ID NO: 40555 - RNA, 23 nt, Artificial Sequence
  RNA Oligomer
caagguguauuucuacuggauuu

SEQ ID NO: 40556 - RNA, 23 nt, Artificial Sequence
  RNA Oligomer
gcaagguguauuucuacuggauu

SEQ ID NO: 40557 - RNA, 23 nt, Artificial Sequence
  RNA Oligomer
agcaagguguauuucuacuggau

SEQ ID NO: 40558 - RNA, 23 nt, Artificial Sequence
  RNA Oligomer
gagcaagguguauuucuacugga

SEQ ID NO: 40559 - RNA, 23 nt, Artificial Sequence
  RNA Oligomer
ggaagacuuuuucagcgugcaca

SEQ ID NO: 40560 - RNA, 23 nt, Artificial Sequence
  RNA Oligomer
aggaagacuuuuucagcgugcac

SEQ ID NO: 40561 - RNA, 23 nt, Artificial Sequence
  RNA Oligomer
caggaagacuuuuucagcgugca

SEQ ID NO: 40562 - RNA, 23 nt, Artificial Sequence
  RNA Oligomer
ccaggaagacuuuuucagcgugc

SEQ ID NO: 40563 - RNA, 23 nt, Artificial Sequence
  RNA Oligomer
gugccucaauuuucuggcaagga

SEQ ID NO: 40564 - RNA, 23 nt, Artificial Sequence
  RNA Oligomer
cgugccucaauuuucuggcaagg

SEQ ID NO: 40565 - RNA, 23 nt, Artificial Sequence
  RNA Oligomer
ccgugccucaauuuucuggcaag

SEQ ID NO: 40566 - RNA, 23 nt, Artificial Sequence
  RNA Oligomer
aggccuccuaugaguuguucugg

SEQ ID NO: 40567 - RNA, 23 nt, Artificial Sequence
  RNA Oligomer
caggccuccuaugaguuguucug

SEQ ID NO: 40568 - RNA, 23 nt, Artificial Sequence
  RNA Oligomer
acaggccuccuaugaguuguucu

SEQ ID NO: 40569 - RNA, 23 nt, Artificial Sequence
  RNA Oligomer
gacaggccuccuaugaguuguuc

SEQ ID NO: 40570 - RNA, 23 nt, Artificial Sequence
  RNA Oligomer
agacaggccuccuaugaguuguu

SEQ ID NO: 40571 - RNA, 23 nt, Artificial Sequence
  RNA Oligomer
gaauugcuaaggacaauagcagg

SEQ ID NO: 40572 - RNA, 23 nt, Artificial Sequence
  RNA Oligomer
ugaauugcuaaggacaauagcag

SEQ ID NO: 40573 - RNA, 23 nt, Artificial Sequence
  RNA Oligomer
cugaauugcuaaggacaauagca

SEQ ID NO: 40574 - RNA, 23 nt, Artificial Sequence
  RNA Oligomer
acugaauugcuaaggacaauagc

SEQ ID NO: 40575 - RNA, 23 nt, Artificial Sequence
  RNA Oligomer
cacugaauugcuaaggacaauag

SEQ ID NO: 40576 - RNA, 23 nt, Artificial Sequence
  RNA Oligomer
gaagaggaggagucuuuccauua

SEQ ID NO: 40577 - RNA, 23 nt, Artificial Sequence
  RNA Oligomer
ugaagaggaggagucuuuccauu

SEQ ID NO: 40578 - RNA, 23 nt, Artificial Sequence
  RNA Oligomer
ugauuacaggcuuaaagcagaag

SEQ ID NO: 40579 - RNA, 23 nt, Artificial Sequence
  RNA Oligomer
gugauuacaggcuuaaagcagaa

SEQ ID NO: 40580 - RNA, 23 nt, Artificial Sequence
  RNA Oligomer
caaaugcagugaggcacagaccc

SEQ ID NO: 40581 - RNA, 23 nt, Artificial Sequence
  RNA Oligomer
acaaaugcagugaggcacagacc

SEQ ID NO: 40582 - RNA, 23 nt, Artificial Sequence
  RNA Oligomer
uacaaaugcagugaggcacagac

SEQ ID NO: 40583 - RNA, 23 nt, Artificial Sequence
  RNA Oligomer
guacaaaugcagugaggcacaga

SEQ ID NO: 40584 - RNA, 23 nt, Artificial Sequence
  RNA Oligomer
gguacaaaugcagugaggcacag

SEQ ID NO: 40585 - RNA, 23 nt, Artificial Sequence
  RNA Oligomer
ggaacuucacaugaaaaagcgug

SEQ ID NO: 40586 - RNA, 23 nt, Artificial Sequence
  RNA Oligomer
gcuuggaaauggauuuuaggccc

SEQ ID NO: 40587 - RNA, 23 nt, Artificial Sequence
  RNA Oligomer
uucauucauaagaggaacaagua

SEQ ID NO: 40588 - RNA, 23 nt, Artificial Sequence
  RNA Oligomer
uuucauucauaagaggaacaagu

SEQ ID NO: 40589 - RNA, 23 nt, Artificial Sequence
  RNA Oligomer
auuucauucauaagaggaacaag

SEQ ID NO: 40590 - RNA, 23 nt, Artificial Sequence
  RNA Oligomer
uauuucauucauaagaggaacaa

SEQ ID NO: 40591 - RNA, 23 nt, Artificial Sequence
  RNA Oligomer
cauccgcacugugccugaauuuu

SEQ ID NO: 40592 - RNA, 23 nt, Artificial Sequence
  RNA Oligomer
gcauccgcacugugccugaauuu

SEQ ID NO: 40593 - RNA, 23 nt, Artificial Sequence
  RNA Oligomer
ggagucuuuccauuacacacgag

SEQ ID NO: 40594 - RNA, 23 nt, Artificial Sequence
  RNA Oligomer
aggagucuuuccauuacacacga

SEQ ID NO: 40595 - RNA, 23 nt, Artificial Sequence
  RNA Oligomer
caguacacuauaccauacuuccu

SEQ ID NO: 40596 - RNA, 23 nt, Artificial Sequence
  RNA Oligomer
acaguacacuauaccauacuucc

SEQ ID NO: 40597 - RNA, 23 nt, Artificial Sequence
  RNA Oligomer
aacaguacacuauaccauacuuc

SEQ ID NO: 40598 - RNA, 23 nt, Artificial Sequence
  RNA Oligomer
uggaggucaaguccaggcauugu

SEQ ID NO: 40599 - RNA, 23 nt, Artificial Sequence
  RNA Oligomer
uuggaggucaaguccaggcauug

SEQ ID NO: 40600 - RNA, 23 nt, Artificial Sequence
  RNA Oligomer
uuuggaggucaaguccaggcauu

SEQ ID NO: 40601 - RNA, 23 nt, Artificial Sequence
  RNA Oligomer
ucuagacuuuggaggucaagucc

SEQ ID NO: 40602 - RNA, 23 nt, Artificial Sequence
  RNA Oligomer
uucuagacuuuggaggucaaguc

SEQ ID NO: 40603 - RNA, 23 nt, Artificial Sequence
  RNA Oligomer
cuucuagacuuuggaggucaagu

SEQ ID NO: 40604 - RNA, 23 nt, Artificial Sequence
  RNA Oligomer
gcuucuagacuuuggaggucaag

SEQ ID NO: 40605 - RNA, 23 nt, Artificial Sequence
  RNA Oligomer
agcuucuagacuuuggaggucaa

SEQ ID NO: 40606 - RNA, 23 nt, Artificial Sequence
  RNA Oligomer
caagcagauugccuacaaucacc

SEQ ID NO: 40607 - RNA, 23 nt, Artificial Sequence
  RNA Oligomer
ucaagcagauugccuacaaucac

SEQ ID NO: 40608 - RNA, 23 nt, Artificial Sequence
  RNA Oligomer
uucaagcagauugccuacaauca

SEQ ID NO: 40609 - RNA, 23 nt, Artificial Sequence
  RNA Oligomer
guucaagcagauugccuacaauc

SEQ ID NO: 40610 - RNA, 23 nt, Artificial Sequence
  RNA Oligomer
aguucaagcagauugccuacaau

SEQ ID NO: 40611 - RNA, 23 nt, Artificial Sequence
  RNA Oligomer
gaguucaagcagauugccuacaa

SEQ ID NO: 40612 - RNA, 23 nt, Artificial Sequence
  RNA Oligomer
ugggaggcccaacuggaacaaug

SEQ ID NO: 40613 - RNA, 23 nt, Artificial Sequence
  RNA Oligomer
augggaggcccaacuggaacaau

SEQ ID NO: 40614 - RNA, 23 nt, Artificial Sequence
  RNA Oligomer
agggucucuccaccauauuagua

SEQ ID NO: 40615 - RNA, 23 nt, Artificial Sequence
  RNA Oligomer
agauguauuucacuacccagugu

SEQ ID NO: 40616 - RNA, 23 nt, Artificial Sequence
  RNA Oligomer
cagauguauuucacuacccagug

SEQ ID NO: 40617 - RNA, 23 nt, Artificial Sequence
  RNA Oligomer
acagauguauuucacuacccagu

SEQ ID NO: 40618 - RNA, 23 nt, Artificial Sequence
  RNA Oligomer
gacagauguauuucacuacccag

SEQ ID NO: 40619 - RNA, 23 nt, Artificial Sequence
  RNA Oligomer
cacaugaaaaagcguggcuuuaa

SEQ ID NO: 40620 - RNA, 23 nt, Artificial Sequence
  RNA Oligomer
uuccugacagccgaagagcaaca

SEQ ID NO: 40621 - RNA, 23 nt, Artificial Sequence
  RNA Oligomer
acaccauguuuucaucgucuucu

SEQ ID NO: 40622 - RNA, 23 nt, Artificial Sequence
  RNA Oligomer
cacaccauguuuucaucgucuuc

SEQ ID NO: 40623 - RNA, 23 nt, Artificial Sequence
  RNA Oligomer
acacaccauguuuucaucgucuu

SEQ ID NO: 40624 - RNA, 23 nt, Artificial Sequence
  RNA Oligomer
guucugguacacacaccauguuu

SEQ ID NO: 40625 - RNA, 23 nt, Artificial Sequence
  RNA Oligomer
uguucugguacacacaccauguu

SEQ ID NO: 40626 - RNA, 23 nt, Artificial Sequence
  RNA Oligomer
gugagggagaagaaauuuccuga

SEQ ID NO: 40627 - RNA, 23 nt, Artificial Sequence
  RNA Oligomer
cacuuuccaagcugggcaacacc

SEQ ID NO: 40628 - RNA, 23 nt, Artificial Sequence
  RNA Oligomer
gcacuuuccaagcugggcaacac

SEQ ID NO: 40629 - RNA, 23 nt, Artificial Sequence
  RNA Oligomer
cgcacuuuccaagcugggcaaca

SEQ ID NO: 40630 - RNA, 23 nt, Artificial Sequence
  RNA Oligomer
ccgcacuuuccaagcugggcaac

SEQ ID NO: 40631 - RNA, 23 nt, Artificial Sequence
  RNA Oligomer
gccgcacuuuccaagcugggcaa

SEQ ID NO: 40632 - RNA, 23 nt, Artificial Sequence
  RNA Oligomer
agcauccgcacugugccugaauu

SEQ ID NO: 40633 - RNA, 23 nt, Artificial Sequence
  RNA Oligomer
agucuuuccauuacacacgaguu

SEQ ID NO: 40634 - RNA, 23 nt, Artificial Sequence
  RNA Oligomer
gagucuuuccauuacacacgagu

SEQ ID NO: 40635 - RNA, 23 nt, Artificial Sequence
  RNA Oligomer
ggacacuucaaaagaugugccac

SEQ ID NO: 40636 - RNA, 23 nt, Artificial Sequence
  RNA Oligomer
aggacacuucaaaagaugugcca

SEQ ID NO: 40637 - RNA, 23 nt, Artificial Sequence
  RNA Oligomer
ucucucgaggacacuucaaaaga

SEQ ID NO: 40638 - RNA, 23 nt, Artificial Sequence
  RNA Oligomer
cucucucgaggacacuucaaaag

SEQ ID NO: 40639 - RNA, 23 nt, Artificial Sequence
  RNA Oligomer
gcucucucgaggacacuucaaaa

SEQ ID NO: 40640 - RNA, 23 nt, Artificial Sequence
  RNA Oligomer
agcucucucgaggacacuucaaa

SEQ ID NO: 40641 - RNA, 23 nt, Artificial Sequence
  RNA Oligomer
gcagauugccuacaaucacccca

SEQ ID NO: 40642 - RNA, 23 nt, Artificial Sequence
  RNA Oligomer
agcagauugccuacaaucacccc

SEQ ID NO: 40643 - RNA, 23 nt, Artificial Sequence
  RNA Oligomer
aagcagauugccuacaaucaccc

SEQ ID NO: 40644 - RNA, 23 nt, Artificial Sequence
  RNA Oligomer
cucuccaccauauuaguacucuc

SEQ ID NO: 40645 - RNA, 23 nt, Artificial Sequence
  RNA Oligomer
ucucuccaccauauuaguacucu

SEQ ID NO: 40646 - RNA, 23 nt, Artificial Sequence
  RNA Oligomer
cuggaacaaugaguucaagcaga

SEQ ID NO: 40647 - RNA, 23 nt, Artificial Sequence
  RNA Oligomer
gucucuccaccauauuaguacuc

SEQ ID NO: 40648 - RNA, 23 nt, Artificial Sequence
  RNA Oligomer
ccaaacccaagacagucucucuc

SEQ ID NO: 40649 - RNA, 23 nt, Artificial Sequence
  RNA Oligomer
gccaaacccaagacagucucucu

SEQ ID NO: 40650 - RNA, 23 nt, Artificial Sequence
  RNA Oligomer
ggccaaacccaagacagucucuc

SEQ ID NO: 40651 - RNA, 23 nt, Artificial Sequence
  RNA Oligomer
aggccaaacccaagacagucucu

SEQ ID NO: 40652 - RNA, 23 nt, Artificial Sequence
  RNA Oligomer
gaggccaaacccaagacagucuc

SEQ ID NO: 40653 - RNA, 23 nt, Artificial Sequence
  RNA Oligomer
ggaacaaguauuugcugcagagg

SEQ ID NO: 40654 - RNA, 23 nt, Artificial Sequence
  RNA Oligomer
aggaacaaguauuugcugcagag

SEQ ID NO: 40655 - RNA, 23 nt, Artificial Sequence
  RNA Oligomer
gaggaacaaguauuugcugcaga

SEQ ID NO: 40656 - RNA, 23 nt, Artificial Sequence
  RNA Oligomer
agaggaacaaguauuugcugcag

SEQ ID NO: 40657 - RNA, 23 nt, Artificial Sequence
  RNA Oligomer
aagaggaacaaguauuugcugca

SEQ ID NO: 40658 - RNA, 23 nt, Artificial Sequence
  RNA Oligomer
ucccaguugggaacuggugaaua

SEQ ID NO: 40659 - RNA, 23 nt, Artificial Sequence
  RNA Oligomer
cucccaguugggaacuggugaau

SEQ ID NO: 40660 - RNA, 23 nt, Artificial Sequence
  RNA Oligomer
gcucccaguugggaacuggugaa

SEQ ID NO: 40661 - RNA, 23 nt, Artificial Sequence
  RNA Oligomer
caccaggaauuccugugacggcc

SEQ ID NO: 40662 - RNA, 23 nt, Artificial Sequence
  RNA Oligomer
ccaccaggaauuccugugacggc

SEQ ID NO: 40663 - RNA, 23 nt, Artificial Sequence
  RNA Oligomer
uccaccaggaauuccugugacgg

SEQ ID NO: 40664 - RNA, 23 nt, Artificial Sequence
  RNA Oligomer
acuccaccaggaauuccugugac

SEQ ID NO: 40665 - RNA, 23 nt, Artificial Sequence
  RNA Oligomer
gggucucuccaccauauuaguac

SEQ ID NO: 40666 - RNA, 23 nt, Artificial Sequence
  RNA Oligomer
cuagggaagcccuuacuaacgac

SEQ ID NO: 40667 - RNA, 23 nt, Artificial Sequence
  RNA Oligomer
acuagggaagcccuuacuaacga

SEQ ID NO: 40668 - RNA, 23 nt, Artificial Sequence
  RNA Oligomer
uacuagggaagcccuuacuaacg

SEQ ID NO: 40669 - RNA, 23 nt, Artificial Sequence
  RNA Oligomer
uuacuagggaagcccuuacuaac

SEQ ID NO: 40670 - RNA, 23 nt, Artificial Sequence
  RNA Oligomer
uuuacuagggaagcccuuacuaa

SEQ ID NO: 40671 - RNA, 23 nt, Artificial Sequence
  RNA Oligomer
uggaguccuggaacuucacauga

SEQ ID NO: 40672 - RNA, 23 nt, Artificial Sequence
  RNA Oligomer
cuggaguccuggaacuucacaug

SEQ ID NO: 40673 - RNA, 23 nt, Artificial Sequence
  RNA Oligomer
ucuggaguccuggaacuucacau

SEQ ID NO: 40674 - RNA, 23 nt, Artificial Sequence
  RNA Oligomer
cucuggaguccuggaacuucaca

SEQ ID NO: 40675 - RNA, 23 nt, Artificial Sequence
  RNA Oligomer
agagaccgcuaugcagaauggca

SEQ ID NO: 40676 - RNA, 23 nt, Artificial Sequence
  RNA Oligomer
uagagaccgcuaugcagaauggc

SEQ ID NO: 40677 - RNA, 23 nt, Artificial Sequence
  RNA Oligomer
guagagaccgcuaugcagaaugg

SEQ ID NO: 40678 - RNA, 23 nt, Artificial Sequence
  RNA Oligomer
uguagagaccgcuaugcagaaug

SEQ ID NO: 40679 - RNA, 23 nt, Artificial Sequence
  RNA Oligomer
cuguagagaccgcuaugcagaau

SEQ ID NO: 40680 - RNA, 23 nt, Artificial Sequence
  RNA Oligomer
acccaagacagucucucucugca

SEQ ID NO: 40681 - RNA, 23 nt, Artificial Sequence
  RNA Oligomer
aacccaagacagucucucucugc

SEQ ID NO: 40682 - RNA, 23 nt, Artificial Sequence
  RNA Oligomer
aaacccaagacagucucucucug

SEQ ID NO: 40683 - RNA, 23 nt, Artificial Sequence
  RNA Oligomer
caaacccaagacagucucucucu

SEQ ID NO: 40684 - RNA, 23 nt, Artificial Sequence
  RNA Oligomer
cgaggccaaacccaagacagucu

SEQ ID NO: 40685 - RNA, 23 nt, Artificial Sequence
  RNA Oligomer
uaccugucagucgaaaccuuauu

SEQ ID NO: 40686 - RNA, 23 nt, Artificial Sequence
  RNA Oligomer
auaccugucagucgaaaccuuau

SEQ ID NO: 40687 - RNA, 23 nt, Artificial Sequence
  RNA Oligomer
aauaccugucagucgaaaccuua

SEQ ID NO: 40688 - RNA, 23 nt, Artificial Sequence
  RNA Oligomer
uaauaccugucagucgaaaccuu

SEQ ID NO: 40689 - RNA, 23 nt, Artificial Sequence
  RNA Oligomer
aacuccaccaggaauuccuguga

SEQ ID NO: 40690 - RNA, 23 nt, Artificial Sequence
  RNA Oligomer
uaaagcagaagaccuucuauggg

SEQ ID NO: 40691 - RNA, 23 nt, Artificial Sequence
  RNA Oligomer
uuaaagcagaagaccuucuaugg

SEQ ID NO: 40692 - RNA, 23 nt, Artificial Sequence
  RNA Oligomer
cuuaaagcagaagaccuucuaug

SEQ ID NO: 40693 - RNA, 23 nt, Artificial Sequence
  RNA Oligomer
gcuuaaagcagaagaccuucuau

SEQ ID NO: 40694 - RNA, 23 nt, Artificial Sequence
  RNA Oligomer
ggcuuaaagcagaagaccuucua

SEQ ID NO: 40695 - RNA, 23 nt, Artificial Sequence
  RNA Oligomer
cacauagcuuuacacugggacga

SEQ ID NO: 40696 - RNA, 23 nt, Artificial Sequence
  RNA Oligomer
ucacauagcuuuacacugggacg

SEQ ID NO: 40697 - RNA, 23 nt, Artificial Sequence
  RNA Oligomer
uucacauagcuuuacacugggac

SEQ ID NO: 40698 - RNA, 23 nt, Artificial Sequence
  RNA Oligomer
cuucacauagcuuuacacuggga

SEQ ID NO: 40699 - RNA, 23 nt, Artificial Sequence
  RNA Oligomer
ucuucacauagcuuuacacuggg

SEQ ID NO: 40700 - RNA, 23 nt, Artificial Sequence
  RNA Oligomer
gggaaaacucacuuucugaguua

SEQ ID NO: 40701 - RNA, 23 nt, Artificial Sequence
  RNA Oligomer
ggggaaaacucacuuucugaguu

SEQ ID NO: 40702 - RNA, 23 nt, Artificial Sequence
  RNA Oligomer
aggggaaaacucacuuucugagu

SEQ ID NO: 40703 - RNA, 23 nt, Artificial Sequence
  RNA Oligomer
caggggaaaacucacuuucugag

SEQ ID NO: 40704 - RNA, 23 nt, Artificial Sequence
  RNA Oligomer
gcaggggaaaacucacuuucuga

SEQ ID NO: 40705 - RNA, 23 nt, Artificial Sequence
  RNA Oligomer
guauuucacuacccagugugugu

SEQ ID NO: 40706 - RNA, 23 nt, Artificial Sequence
  RNA Oligomer
uguauuucacuacccagugugug

SEQ ID NO: 40707 - RNA, 23 nt, Artificial Sequence
  RNA Oligomer
auguauuucacuacccagugugu

SEQ ID NO: 40708 - RNA, 23 nt, Artificial Sequence
  RNA Oligomer
gauguauuucacuacccagugug

SEQ ID NO: 40709 - RNA, 23 nt, Artificial Sequence
  RNA Oligomer
ggaacccucggcuuggaaaugga

SEQ ID NO: 40710 - RNA, 23 nt, Artificial Sequence
  RNA Oligomer
aggaacccucggcuuggaaaugg

SEQ ID NO: 40711 - RNA, 23 nt, Artificial Sequence
  RNA Oligomer
aaggaacccucggcuuggaaaug

SEQ ID NO: 40712 - RNA, 23 nt, Artificial Sequence
  RNA Oligomer
caaggaacccucggcuuggaaau

SEQ ID NO: 40713 - RNA, 23 nt, Artificial Sequence
  RNA Oligomer
gaguuguucugguacacacacca

SEQ ID NO: 40714 - RNA, 23 nt, Artificial Sequence
  RNA Oligomer
ugaguuguucugguacacacacc

SEQ ID NO: 40715 - RNA, 23 nt, Artificial Sequence
  RNA Oligomer
augaguuguucugguacacacac

SEQ ID NO: 40716 - RNA, 23 nt, Artificial Sequence
  RNA Oligomer
uaugaguuguucugguacacaca

SEQ ID NO: 40717 - RNA, 23 nt, Artificial Sequence
  RNA Oligomer
cuaugaguuguucugguacacac

SEQ ID NO: 40718 - RNA, 23 nt, Artificial Sequence
  RNA Oligomer
caacugaguucaucagacaggcc

SEQ ID NO: 40719 - RNA, 23 nt, Artificial Sequence
  RNA Oligomer
ucaacugaguucaucagacaggc

SEQ ID NO: 40720 - RNA, 23 nt, Artificial Sequence
  RNA Oligomer
gucaacugaguucaucagacagg

SEQ ID NO: 40721 - RNA, 23 nt, Artificial Sequence
  RNA Oligomer
cgucaacugaguucaucagacag

SEQ ID NO: 40722 - RNA, 23 nt, Artificial Sequence
  RNA Oligomer
ucgucaacugaguucaucagaca

SEQ ID NO: 40723 - RNA, 23 nt, Artificial Sequence
  RNA Oligomer
ugaccucgucaacugaguucauc

SEQ ID NO: 40724 - RNA, 23 nt, Artificial Sequence
  RNA Oligomer
augaccucgucaacugaguucau

SEQ ID NO: 40725 - RNA, 23 nt, Artificial Sequence
  RNA Oligomer
caugaccucgucaacugaguuca

SEQ ID NO: 40726 - RNA, 23 nt, Artificial Sequence
  RNA Oligomer
ucaugaccucgucaacugaguuc

SEQ ID NO: 40727 - RNA, 23 nt, Artificial Sequence
  RNA Oligomer
aucaugaccucgucaacugaguu

SEQ ID NO: 40728 - RNA, 23 nt, Artificial Sequence
  RNA Oligomer
cauccacaucguggcgcauuucu

SEQ ID NO: 40729 - RNA, 23 nt, Artificial Sequence
  RNA Oligomer
ccauccacaucguggcgcauuuc

SEQ ID NO: 40730 - RNA, 23 nt, Artificial Sequence
  RNA Oligomer
accauccacaucguggcgcauuu

SEQ ID NO: 40731 - RNA, 23 nt, Artificial Sequence
  RNA Oligomer
gggauagcuguuaaugcaaccau

SEQ ID NO: 40732 - RNA, 23 nt, Artificial Sequence
  RNA Oligomer
ugggauagcuguuaaugcaacca

SEQ ID NO: 40733 - RNA, 23 nt, Artificial Sequence
  RNA Oligomer
augggauagcuguuaaugcaacc

SEQ ID NO: 40734 - RNA, 23 nt, Artificial Sequence
  RNA Oligomer
uaugggauagcuguuaaugcaac

SEQ ID NO: 40735 - RNA, 23 nt, Artificial Sequence
  RNA Oligomer
ccucagauuucacaaacuggucg

SEQ ID NO: 40736 - RNA, 23 nt, Artificial Sequence
  RNA Oligomer
uaacuauugugaacaguacacua

SEQ ID NO: 40737 - RNA, 23 nt, Artificial Sequence
  RNA Oligomer
uuaacuauugugaacaguacacu

SEQ ID NO: 40738 - RNA, 23 nt, Artificial Sequence
  RNA Oligomer
auuaacuauugugaacaguacac

SEQ ID NO: 40739 - RNA, 23 nt, Artificial Sequence
  RNA Oligomer
aauuaacuauugugaacaguaca

SEQ ID NO: 40740 - RNA, 23 nt, Artificial Sequence
  RNA Oligomer
uaauuaacuauugugaacaguac

SEQ ID NO: 40741 - RNA, 23 nt, Artificial Sequence
  RNA Oligomer
aggcuuaaagcagaagaccuucu

SEQ ID NO: 40742 - RNA, 23 nt, Artificial Sequence
  RNA Oligomer
cucuuacucucccuggaaacacg

SEQ ID NO: 40743 - RNA, 23 nt, Artificial Sequence
  RNA Oligomer
ucucuuacucucccuggaaacac

SEQ ID NO: 40744 - RNA, 23 nt, Artificial Sequence
  RNA Oligomer
aucucuuacucucccuggaaaca

SEQ ID NO: 40745 - RNA, 23 nt, Artificial Sequence
  RNA Oligomer
gaucucuuacucucccuggaaac

SEQ ID NO: 40746 - RNA, 23 nt, Artificial Sequence
  RNA Oligomer
gaacugcccugacagauguauuu

SEQ ID NO: 40747 - RNA, 23 nt, Artificial Sequence
  RNA Oligomer
ggaacugcccugacagauguauu

SEQ ID NO: 40748 - RNA, 23 nt, Artificial Sequence
  RNA Oligomer
uggaacugcccugacagauguau

SEQ ID NO: 40749 - RNA, 23 nt, Artificial Sequence
  RNA Oligomer
uuggaacugcccugacagaugua

SEQ ID NO: 40750 - RNA, 23 nt, Artificial Sequence
  RNA Oligomer
uuuggaacugcccugacagaugu

SEQ ID NO: 40751 - RNA, 23 nt, Artificial Sequence
  RNA Oligomer
gaagacuuuuucagcgugcacau

SEQ ID NO: 40752 - RNA, 23 nt, Artificial Sequence
  RNA Oligomer
gccauaucuucgcuggaguggca

SEQ ID NO: 40753 - RNA, 23 nt, Artificial Sequence
  RNA Oligomer
agccauaucuucgcuggaguggc

SEQ ID NO: 40754 - RNA, 23 nt, Artificial Sequence
  RNA Oligomer
cagccauaucuucgcuggagugg

SEQ ID NO: 40755 - RNA, 23 nt, Artificial Sequence
  RNA Oligomer
ccagccauaucuucgcuggagug

SEQ ID NO: 40756 - RNA, 23 nt, Artificial Sequence
  RNA Oligomer
cccagccauaucuucgcuggagu

SEQ ID NO: 40757 - RNA, 23 nt, Artificial Sequence
  RNA Oligomer
ccaagacagucucucucugcaca

SEQ ID NO: 40758 - RNA, 23 nt, Artificial Sequence
  RNA Oligomer
cccaagacagucucucucugcac

SEQ ID NO: 40759 - RNA, 23 nt, Artificial Sequence
  RNA Oligomer
cggauuguucgaggccaaaccca

SEQ ID NO: 40760 - RNA, 23 nt, Artificial Sequence
  RNA Oligomer
agggagaagaaauuuccugacag

SEQ ID NO: 40761 - RNA, 23 nt, Artificial Sequence
  RNA Oligomer
gagggagaagaaauuuccugaca

SEQ ID NO: 40762 - RNA, 23 nt, Artificial Sequence
  RNA Oligomer
ugagggagaagaaauuuccugac

SEQ ID NO: 40763 - RNA, 23 nt, Artificial Sequence
  RNA Oligomer
gaccucgucaacugaguucauca

SEQ ID NO: 40764 - RNA, 23 nt, Artificial Sequence
  RNA Oligomer
uugaucaugaccucgucaacuga

SEQ ID NO: 40765 - RNA, 23 nt, Artificial Sequence
  RNA Oligomer
cuugaucaugaccucgucaacug

SEQ ID NO: 40766 - RNA, 23 nt, Artificial Sequence
  RNA Oligomer
ucuugaucaugaccucgucaacu

SEQ ID NO: 40767 - RNA, 23 nt, Artificial Sequence
  RNA Oligomer
gucuugaucaugaccucgucaac

SEQ ID NO: 40768 - RNA, 23 nt, Artificial Sequence
  RNA Oligomer
agucuugaucaugaccucgucaa

SEQ ID NO: 40769 - RNA, 23 nt, Artificial Sequence
  RNA Oligomer
uagucuugaucaugaccucguca

SEQ ID NO: 40770 - RNA, 23 nt, Artificial Sequence
  RNA Oligomer
uuagucuugaucaugaccucguc

SEQ ID NO: 40771 - RNA, 23 nt, Artificial Sequence
  RNA Oligomer
uuuagucuugaucaugaccucgu

SEQ ID NO: 40772 - RNA, 23 nt, Artificial Sequence
  RNA Oligomer
cuaacgagagcuaccucaacccu

SEQ ID NO: 40773 - RNA, 23 nt, Artificial Sequence
  RNA Oligomer
ccuaacgagagcuaccucaaccc

SEQ ID NO: 40774 - RNA, 23 nt, Artificial Sequence
  RNA Oligomer
cccuaacgagagcuaccucaacc

SEQ ID NO: 40775 - RNA, 23 nt, Artificial Sequence
  RNA Oligomer
ccccuaacgagagcuaccucaac

SEQ ID NO: 40776 - RNA, 23 nt, Artificial Sequence
  RNA Oligomer
accccuaacgagagcuaccucaa

SEQ ID NO: 40777 - RNA, 23 nt, Artificial Sequence
  RNA Oligomer
gacaaaaaccucagauuucacaa

SEQ ID NO: 40778 - RNA, 23 nt, Artificial Sequence
  RNA Oligomer
cuaauaccugucagucgaaaccu

SEQ ID NO: 40779 - RNA, 23 nt, Artificial Sequence
  RNA Oligomer
ucuaauaccugucagucgaaacc

SEQ ID NO: 40780 - RNA, 23 nt, Artificial Sequence
  RNA Oligomer
uucuaauaccugucagucgaaac

SEQ ID NO: 40781 - RNA, 23 nt, Artificial Sequence
  RNA Oligomer
auucuaauaccugucagucgaaa

SEQ ID NO: 40782 - RNA, 23 nt, Artificial Sequence
  RNA Oligomer
aauucuaauaccugucagucgaa

SEQ ID NO: 40783 - RNA, 23 nt, Artificial Sequence
  RNA Oligomer
gggaagcccuuacuaacgaccca

SEQ ID NO: 40784 - RNA, 23 nt, Artificial Sequence
  RNA Oligomer
agggaagcccuuacuaacgaccc

SEQ ID NO: 40785 - RNA, 23 nt, Artificial Sequence
  RNA Oligomer
uagggaagcccuuacuaacgacc

SEQ ID NO: 40786 - RNA, 23 nt, Artificial Sequence
  RNA Oligomer
aacaugucauauacaacagaaca

SEQ ID NO: 40787 - RNA, 23 nt, Artificial Sequence
  RNA Oligomer
uaacaugucauauacaacagaac

SEQ ID NO: 40788 - RNA, 23 nt, Artificial Sequence
  RNA Oligomer
auaacaugucauauacaacagaa

SEQ ID NO: 40789 - RNA, 23 nt, Artificial Sequence
  RNA Oligomer
cuaaagcucucucgaggacacuu

SEQ ID NO: 40790 - RNA, 23 nt, Artificial Sequence
  RNA Oligomer
ccuaaagcucucucgaggacacu

SEQ ID NO: 40791 - RNA, 23 nt, Artificial Sequence
  RNA Oligomer
accuaaagcucucucgaggacac

SEQ ID NO: 40792 - RNA, 23 nt, Artificial Sequence
  RNA Oligomer
gaccuaaagcucucucgaggaca

SEQ ID NO: 40793 - RNA, 23 nt, Artificial Sequence
  RNA Oligomer
ggaccuaaagcucucucgaggac

SEQ ID NO: 40794 - RNA, 23 nt, Artificial Sequence
  RNA Oligomer
cagaagaccuucuaugggaggcc

SEQ ID NO: 40795 - RNA, 23 nt, Artificial Sequence
  RNA Oligomer
gcagaagaccuucuaugggaggc

SEQ ID NO: 40796 - RNA, 23 nt, Artificial Sequence
  RNA Oligomer
agcagaagaccuucuaugggagg

SEQ ID NO: 40797 - RNA, 23 nt, Artificial Sequence
  RNA Oligomer
aagcagaagaccuucuaugggag

SEQ ID NO: 40798 - RNA, 23 nt, Artificial Sequence
  RNA Oligomer
aaagcagaagaccuucuauggga

SEQ ID NO: 40799 - RNA, 23 nt, Artificial Sequence
  RNA Oligomer
ggucucuccaccauauuaguacu

SEQ ID NO: 40800 - RNA, 23 nt, Artificial Sequence
  RNA Oligomer
aaaacucacuuucugaguuauca

SEQ ID NO: 40801 - RNA, 23 nt, Artificial Sequence
  RNA Oligomer
gaaaacucacuuucugaguuauc

SEQ ID NO: 40802 - RNA, 23 nt, Artificial Sequence
  RNA Oligomer
ggaaaacucacuuucugaguuau

SEQ ID NO: 40803 - RNA, 23 nt, Artificial Sequence
  RNA Oligomer
ucacaugaaaaagcguggcuuua

SEQ ID NO: 40804 - RNA, 23 nt, Artificial Sequence
  RNA Oligomer
uucacaugaaaaagcguggcuuu

SEQ ID NO: 40805 - RNA, 23 nt, Artificial Sequence
  RNA Oligomer
cuucacaugaaaaagcguggcuu

SEQ ID NO: 40806 - RNA, 23 nt, Artificial Sequence
  RNA Oligomer
cucgucaacugaguucaucagac

SEQ ID NO: 40807 - RNA, 23 nt, Artificial Sequence
  RNA Oligomer
ucagauuucacaaacuggucgcc

SEQ ID NO: 40808 - RNA, 23 nt, Artificial Sequence
  RNA Oligomer
cucagauuucacaaacuggucgc

SEQ ID NO: 40809 - RNA, 23 nt, Artificial Sequence
  RNA Oligomer
aauaacaugucauauacaacaga

SEQ ID NO: 40810 - RNA, 23 nt, Artificial Sequence
  RNA Oligomer
auugugaacaguacacuauacca

SEQ ID NO: 40811 - RNA, 23 nt, Artificial Sequence
  RNA Oligomer
uauugugaacaguacacuauacc

SEQ ID NO: 40812 - RNA, 23 nt, Artificial Sequence
  RNA Oligomer
cuauugugaacaguacacuauac

SEQ ID NO: 40813 - RNA, 23 nt, Artificial Sequence
  RNA Oligomer
aguacucucauggcugggaauaa

SEQ ID NO: 40814 - RNA, 23 nt, Artificial Sequence
  RNA Oligomer
uaguacucucauggcugggaaua

SEQ ID NO: 40815 - RNA, 23 nt, Artificial Sequence
  RNA Oligomer
uuaguacucucauggcugggaau

SEQ ID NO: 40816 - RNA, 23 nt, Artificial Sequence
  RNA Oligomer
auuaguacucucauggcugggaa

SEQ ID NO: 40817 - RNA, 23 nt, Artificial Sequence
  RNA Oligomer
agaagaccuucuaugggaggccc

SEQ ID NO: 40818 - RNA, 23 nt, Artificial Sequence
  RNA Oligomer
ugaaugagggucucuccaccaua

SEQ ID NO: 40819 - RNA, 23 nt, Artificial Sequence
  RNA Oligomer
uuugagugguuugcugaucucuu

SEQ ID NO: 40820 - RNA, 23 nt, Artificial Sequence
  RNA Oligomer
uuuugagugguuugcugaucucu

SEQ ID NO: 40821 - RNA, 23 nt, Artificial Sequence
  RNA Oligomer
cuuuugagugguuugcugaucuc

SEQ ID NO: 40822 - RNA, 23 nt, Artificial Sequence
  RNA Oligomer
gaacuucacaugaaaaagcgugg

SEQ ID NO: 40823 - RNA, 23 nt, Artificial Sequence
  RNA Oligomer
ucauuaccaaggugguaagccac

SEQ ID NO: 40824 - RNA, 23 nt, Artificial Sequence
  RNA Oligomer
gucauuaccaaggugguaagcca

SEQ ID NO: 40825 - RNA, 23 nt, Artificial Sequence
  RNA Oligomer
ugucauuaccaaggugguaagcc

SEQ ID NO: 40826 - RNA, 23 nt, Artificial Sequence
  RNA Oligomer
uugucauuaccaaggugguaagc

SEQ ID NO: 40827 - RNA, 23 nt, Artificial Sequence
  RNA Oligomer
guugucauuaccaaggugguaag

SEQ ID NO: 40828 - RNA, 23 nt, Artificial Sequence
  RNA Oligomer
aguugucauuaccaaggugguaa

SEQ ID NO: 40829 - RNA, 23 nt, Artificial Sequence
  RNA Oligomer
gagaccgcuaugcagaauggcag

SEQ ID NO: 40830 - RNA, 23 nt, Artificial Sequence
  RNA Oligomer
ggauuguucgaggccaaacccaa

SEQ ID NO: 40831 - RNA, 23 nt, Artificial Sequence
  RNA Oligomer
ccucgucaacugaguucaucaga

SEQ ID NO: 40832 - RNA, 23 nt, Artificial Sequence
  RNA Oligomer
accucgucaacugaguucaucag

SEQ ID NO: 40833 - RNA, 23 nt, Artificial Sequence
  RNA Oligomer
ggauagcuguuaaugcaaccauc

SEQ ID NO: 40834 - RNA, 23 nt, Artificial Sequence
  RNA Oligomer
gaauuuuaacugcaugcuaauuc

SEQ ID NO: 40835 - RNA, 23 nt, Artificial Sequence
  RNA Oligomer
ccaaagaacuccaccaggaauuc

SEQ ID NO: 40836 - RNA, 23 nt, Artificial Sequence
  RNA Oligomer
uccaaagaacuccaccaggaauu

SEQ ID NO: 40837 - RNA, 23 nt, Artificial Sequence
  RNA Oligomer
uuccaaagaacuccaccaggaau

SEQ ID NO: 40838 - RNA, 23 nt, Artificial Sequence
  RNA Oligomer
auuccaaagaacuccaccaggaa

SEQ ID NO: 40839 - RNA, 23 nt, Artificial Sequence
  RNA Oligomer
gauuccaaagaacuccaccagga

SEQ ID NO: 40840 - RNA, 23 nt, Artificial Sequence
  RNA Oligomer
agacuuuggaggucaaguccagg

SEQ ID NO: 40841 - RNA, 23 nt, Artificial Sequence
  RNA Oligomer
uagacuuuggaggucaaguccag

SEQ ID NO: 40842 - RNA, 23 nt, Artificial Sequence
  RNA Oligomer
cuagacuuuggaggucaagucca

SEQ ID NO: 40843 - RNA, 23 nt, Artificial Sequence
  RNA Oligomer
gacacuucaaaagaugugccacu

SEQ ID NO: 40844 - RNA, 23 nt, Artificial Sequence
  RNA Oligomer
gcccagccauaucuucgcuggag

SEQ ID NO: 40845 - RNA, 23 nt, Artificial Sequence
  RNA Oligomer
caguacaucuuggugcagugccc

SEQ ID NO: 40846 - RNA, 23 nt, Artificial Sequence
  RNA Oligomer
gcaguacaucuuggugcagugcc

SEQ ID NO: 40847 - RNA, 23 nt, Artificial Sequence
  RNA Oligomer
ggcaguacaucuuggugcagugc

SEQ ID NO: 40848 - RNA, 23 nt, Artificial Sequence
  RNA Oligomer
gggcaguacaucuuggugcagug

SEQ ID NO: 40849 - RNA, 23 nt, Artificial Sequence
  RNA Oligomer
agggcaguacaucuuggugcagu

SEQ ID NO: 40850 - RNA, 23 nt, Artificial Sequence
  RNA Oligomer
acuucacaugaaaaagcguggcu

SEQ ID NO: 40851 - RNA, 23 nt, Artificial Sequence
  RNA Oligomer
ccucuggaguccuggaacuucac

SEQ ID NO: 40852 - RNA, 23 nt, Artificial Sequence
  RNA Oligomer
cccucuggaguccuggaacuuca

SEQ ID NO: 40853 - RNA, 23 nt, Artificial Sequence
  RNA Oligomer
cuaugcagaauggcagacagugg

SEQ ID NO: 40854 - RNA, 23 nt, Artificial Sequence
  RNA Oligomer
gcuaugcagaauggcagacagug

SEQ ID NO: 40855 - RNA, 23 nt, Artificial Sequence
  RNA Oligomer
cgcuaugcagaauggcagacagu

SEQ ID NO: 40856 - RNA, 23 nt, Artificial Sequence
  RNA Oligomer
ccgcuaugcagaauggcagacag

SEQ ID NO: 40857 - RNA, 23 nt, Artificial Sequence
  RNA Oligomer
accgcuaugcagaauggcagaca

SEQ ID NO: 40858 - RNA, 23 nt, Artificial Sequence
  RNA Oligomer
gaccgcuaugcagaauggcagac

SEQ ID NO: 40859 - RNA, 23 nt, Artificial Sequence
  RNA Oligomer
agaccgcuaugcagaauggcaga

SEQ ID NO: 40860 - RNA, 23 nt, Artificial Sequence
  RNA Oligomer
ucuucaaccuggaacgcuaccac

SEQ ID NO: 40861 - RNA, 23 nt, Artificial Sequence
  RNA Oligomer
uucuucaaccuggaacgcuacca

SEQ ID NO: 40862 - RNA, 23 nt, Artificial Sequence
  RNA Oligomer
uuucuucaaccuggaacgcuacc

SEQ ID NO: 40863 - RNA, 23 nt, Artificial Sequence
  RNA Oligomer
auuucuucaaccuggaacgcuac

SEQ ID NO: 40864 - RNA, 23 nt, Artificial Sequence
  RNA Oligomer
cauuucuucaaccuggaacgcua

SEQ ID NO: 40865 - RNA, 23 nt, Artificial Sequence
  RNA Oligomer
agcuguuaaugcaaccauccaca

SEQ ID NO: 40866 - RNA, 23 nt, Artificial Sequence
  RNA Oligomer
uagcuguuaaugcaaccauccac

SEQ ID NO: 40867 - RNA, 23 nt, Artificial Sequence
  RNA Oligomer
auagcuguuaaugcaaccaucca

SEQ ID NO: 40868 - RNA, 23 nt, Artificial Sequence
  RNA Oligomer
gauagcuguuaaugcaaccaucc

SEQ ID NO: 40869 - RNA, 23 nt, Artificial Sequence
  RNA Oligomer
ucacaaacuggucgccuauggga

SEQ ID NO: 40870 - RNA, 23 nt, Artificial Sequence
  RNA Oligomer
uucacaaacuggucgccuauggg

SEQ ID NO: 40871 - RNA, 23 nt, Artificial Sequence
  RNA Oligomer
uuucacaaacuggucgccuaugg

SEQ ID NO: 40872 - RNA, 23 nt, Artificial Sequence
  RNA Oligomer
auuucacaaacuggucgccuaug

SEQ ID NO: 40873 - RNA, 23 nt, Artificial Sequence
  RNA Oligomer
gauuucacaaacuggucgccuau

SEQ ID NO: 40874 - RNA, 23 nt, Artificial Sequence
  RNA Oligomer
acuauugugaacaguacacuaua

SEQ ID NO: 40875 - RNA, 23 nt, Artificial Sequence
  RNA Oligomer
aacuauugugaacaguacacuau

SEQ ID NO: 40876 - RNA, 23 nt, Artificial Sequence
  RNA Oligomer
guggaccuaaagcucucucgagg

SEQ ID NO: 40877 - RNA, 23 nt, Artificial Sequence
  RNA Oligomer
uguggaccuaaagcucucucgag

SEQ ID NO: 40878 - RNA, 23 nt, Artificial Sequence
  RNA Oligomer
cuguggaccuaaagcucucucga

SEQ ID NO: 40879 - RNA, 23 nt, Artificial Sequence
  RNA Oligomer
ucuguggaccuaaagcucucucg

SEQ ID NO: 40880 - RNA, 23 nt, Artificial Sequence
  RNA Oligomer
uucuguggaccuaaagcucucuc

SEQ ID NO: 40881 - RNA, 23 nt, Artificial Sequence
  RNA Oligomer
cucucccuggaaacacggaugag

SEQ ID NO: 40882 - RNA, 23 nt, Artificial Sequence
  RNA Oligomer
acucucccuggaaacacggauga

SEQ ID NO: 40883 - RNA, 23 nt, Artificial Sequence
  RNA Oligomer
gacuuuuucagcgugcacauccg

SEQ ID NO: 40884 - RNA, 23 nt, Artificial Sequence
  RNA Oligomer
agacuuuuucagcgugcacaucc

SEQ ID NO: 40885 - RNA, 23 nt, Artificial Sequence
  RNA Oligomer
aagacuuuuucagcgugcacauc

SEQ ID NO: 40886 - RNA, 23 nt, Artificial Sequence
  RNA Oligomer
ccauaucuucgcuggaguggcac

SEQ ID NO: 40887 - RNA, 23 nt, Artificial Sequence
  RNA Oligomer
aaacacaaccacugaauugcuaa

SEQ ID NO: 40888 - RNA, 23 nt, Artificial Sequence
  RNA Oligomer
ggucgccuaugggauagcuguua

SEQ ID NO: 40889 - RNA, 23 nt, Artificial Sequence
  RNA Oligomer
uggucgccuaugggauagcuguu

SEQ ID NO: 40890 - RNA, 23 nt, Artificial Sequence
  RNA Oligomer
agauuucacaaacuggucgccua

SEQ ID NO: 40891 - RNA, 23 nt, Artificial Sequence
  RNA Oligomer
accguggaggaggcaauuagaca

SEQ ID NO: 40892 - RNA, 23 nt, Artificial Sequence
  RNA Oligomer
gaccguggaggaggcaauuagac

SEQ ID NO: 40893 - RNA, 23 nt, Artificial Sequence
  RNA Oligomer
ggaccguggaggaggcaauuaga

SEQ ID NO: 40894 - RNA, 23 nt, Artificial Sequence
  RNA Oligomer
aggaccguggaggaggcaauuag

SEQ ID NO: 40895 - RNA, 23 nt, Artificial Sequence
  RNA Oligomer
gaggaccguggaggaggcaauua

SEQ ID NO: 40896 - RNA, 23 nt, Artificial Sequence
  RNA Oligomer
acaaguauuugcugcagaggacc

SEQ ID NO: 40897 - RNA, 23 nt, Artificial Sequence
  RNA Oligomer
aacaaguauuugcugcagaggac

SEQ ID NO: 40898 - RNA, 23 nt, Artificial Sequence
  RNA Oligomer
gaacaaguauuugcugcagagga

SEQ ID NO: 40899 - RNA, 23 nt, Artificial Sequence
  RNA Oligomer
uuucaacaagaaguugucauuac

SEQ ID NO: 40900 - RNA, 23 nt, Artificial Sequence
  RNA Oligomer
cgauuucaacaagaaguugucau

SEQ ID NO: 40901 - RNA, 23 nt, Artificial Sequence
  RNA Oligomer
ggaaauggauuuuaggcccugug

SEQ ID NO: 40902 - RNA, 23 nt, Artificial Sequence
  RNA Oligomer
uggaaauggauuuuaggcccugu

SEQ ID NO: 40903 - RNA, 23 nt, Artificial Sequence
  RNA Oligomer
uuggaaauggauuuuaggcccug

SEQ ID NO: 40904 - RNA, 23 nt, Artificial Sequence
  RNA Oligomer
cuuggaaauggauuuuaggcccu

SEQ ID NO: 40905 - RNA, 23 nt, Artificial Sequence
  RNA Oligomer
ucaucagacaggccuccuaugag

SEQ ID NO: 40906 - RNA, 23 nt, Artificial Sequence
  RNA Oligomer
uucaucagacaggccuccuauga

SEQ ID NO: 40907 - RNA, 23 nt, Artificial Sequence
  RNA Oligomer
guucaucagacaggccuccuaug

SEQ ID NO: 40908 - RNA, 23 nt, Artificial Sequence
  RNA Oligomer
aguucaucagacaggccuccuau

SEQ ID NO: 40909 - RNA, 23 nt, Artificial Sequence
  RNA Oligomer
gaguucaucagacaggccuccua

SEQ ID NO: 40910 - RNA, 23 nt, Artificial Sequence
  RNA Oligomer
agagcuaccucaacccuguccgg

SEQ ID NO: 40911 - RNA, 23 nt, Artificial Sequence
  RNA Oligomer
gagagcuaccucaacccuguccg

SEQ ID NO: 40912 - RNA, 23 nt, Artificial Sequence
  RNA Oligomer
cgagagcuaccucaacccugucc

SEQ ID NO: 40913 - RNA, 23 nt, Artificial Sequence
  RNA Oligomer
acgagagcuaccucaacccuguc

SEQ ID NO: 40914 - RNA, 23 nt, Artificial Sequence
  RNA Oligomer
aacgagagcuaccucaacccugu

SEQ ID NO: 40915 - RNA, 23 nt, Artificial Sequence
  RNA Oligomer
aagaacuccaccaggaauuccug

SEQ ID NO: 40916 - RNA, 23 nt, Artificial Sequence
  RNA Oligomer
aaagaacuccaccaggaauuccu

SEQ ID NO: 40917 - RNA, 23 nt, Artificial Sequence
  RNA Oligomer
caaagaacuccaccaggaauucc

SEQ ID NO: 40918 - RNA, 23 nt, Artificial Sequence
  RNA Oligomer
cauuguguuuucaaucaaguuau

SEQ ID NO: 40919 - RNA, 23 nt, Artificial Sequence
  RNA Oligomer
uggaccuaaagcucucucgagga

SEQ ID NO: 40920 - RNA, 23 nt, Artificial Sequence
  RNA Oligomer
gaaauggauuuuaggcccugugg

SEQ ID NO: 40921 - RNA, 23 nt, Artificial Sequence
  RNA Oligomer
caagacagucucucucugcacaa

SEQ ID NO: 40922 - RNA, 23 nt, Artificial Sequence
  RNA Oligomer
caccccuaacgagagcuaccuca

SEQ ID NO: 40923 - RNA, 23 nt, Artificial Sequence
  RNA Oligomer
cgaaaccuuauuucauucauaag

SEQ ID NO: 40924 - RNA, 23 nt, Artificial Sequence
  RNA Oligomer
ucgaaaccuuauuucauucauaa

SEQ ID NO: 40925 - RNA, 23 nt, Artificial Sequence
  RNA Oligomer
ucuggcgauuucaacaagaaguu

SEQ ID NO: 40926 - RNA, 23 nt, Artificial Sequence
  RNA Oligomer
uucuggcgauuucaacaagaagu

SEQ ID NO: 40927 - RNA, 23 nt, Artificial Sequence
  RNA Oligomer
guucuggcgauuucaacaagaag

SEQ ID NO: 40928 - RNA, 23 nt, Artificial Sequence
  RNA Oligomer
gguucuggcgauuucaacaagaa

SEQ ID NO: 40929 - RNA, 23 nt, Artificial Sequence
  RNA Oligomer
agguucuggcgauuucaacaaga

SEQ ID NO: 40930 - RNA, 23 nt, Artificial Sequence
  RNA Oligomer
gcaugugaaagaauaauuagguu

SEQ ID NO: 40931 - RNA, 23 nt, Artificial Sequence
  RNA Oligomer
ucauuucuauuacaacaaggaga

SEQ ID NO: 40932 - RNA, 23 nt, Artificial Sequence
  RNA Oligomer
guguucauuucuauuacaacaag

SEQ ID NO: 40933 - RNA, 23 nt, Artificial Sequence
  RNA Oligomer
cuauuacaacaaggagagcuucu

SEQ ID NO: 40934 - RNA, 23 nt, Artificial Sequence
  RNA Oligomer
guucauuucuauuacaacaagga

SEQ ID NO: 40935 - RNA, 23 nt, Artificial Sequence
  RNA Oligomer
gcugggaauaaauuuuuaucugu

SEQ ID NO: 40936 - RNA, 23 nt, Artificial Sequence
  RNA Oligomer
ugaaagaauaauuagguucuggc

SEQ ID NO: 40937 - RNA, 23 nt, Artificial Sequence
  RNA Oligomer
gacaaaauaauuuacuagggaag

SEQ ID NO: 40938 - RNA, 23 nt, Artificial Sequence
  RNA Oligomer
acaaaauaauuuacuagggaagc

SEQ ID NO: 40939 - RNA, 23 nt, Artificial Sequence
  RNA Oligomer
caaguauuugcugcagaggaccg

SEQ ID NO: 40940 - RNA, 23 nt, Artificial Sequence
  RNA Oligomer
gaauuccugugacggccuguuga

SEQ ID NO: 40941 - RNA, 23 nt, Artificial Sequence
  RNA Oligomer
uguuuucaucgucuucuuucuca

SEQ ID NO: 40942 - RNA, 23 nt, Artificial Sequence
  RNA Oligomer
caacagaacaaaaacauuuacug

SEQ ID NO: 40943 - RNA, 23 nt, Artificial Sequence
  RNA Oligomer
uggaaacacggaugagugagcag

SEQ ID NO: 40944 - RNA, 23 nt, Artificial Sequence
  RNA Oligomer
aaaauggcgccagggcaguacau

SEQ ID NO: 40945 - RNA, 23 nt, Artificial Sequence
  RNA Oligomer
ccuuagcuuauaaauaacauguc

SEQ ID NO: 40946 - RNA, 23 nt, Artificial Sequence
  RNA Oligomer
auauauuucuuaccggcugggau

SEQ ID NO: 40947 - RNA, 23 nt, Artificial Sequence
  RNA Oligomer
ugaguucaagcagauugccuaca

SEQ ID NO: 40948 - RNA, 23 nt, Artificial Sequence
  RNA Oligomer
gcuguuaaugcaaccauccacau

SEQ ID NO: 40949 - RNA, 23 nt, Artificial Sequence
  RNA Oligomer
ccuuauuucauucauaagaggaa

SEQ ID NO: 40950 - RNA, 23 nt, Artificial Sequence
  RNA Oligomer
aagcucucucgaggacacuucaa

SEQ ID NO: 40951 - RNA, 23 nt, Artificial Sequence
  RNA Oligomer
ugaaaucuauaugguacaaaugc

SEQ ID NO: 40952 - RNA, 23 nt, Artificial Sequence
  RNA Oligomer
ccuuuggaacugcccugacagau

SEQ ID NO: 40953 - RNA, 23 nt, Artificial Sequence
  RNA Oligomer
accuuauuucauucauaagagga

SEQ ID NO: 40954 - RNA, 23 nt, Artificial Sequence
  RNA Oligomer
ccuuacuaacgacccaacaucca

SEQ ID NO: 40955 - RNA, 23 nt, Artificial Sequence
  RNA Oligomer
ucauauauuucuuaccggcuggg

SEQ ID NO: 40956 - RNA, 23 nt, Artificial Sequence
  RNA Oligomer
gauuugccgggaugcaagagcuu

SEQ ID NO: 40957 - RNA, 23 nt, Artificial Sequence
  RNA Oligomer
aguuguucugguacacacaccau

SEQ ID NO: 40958 - RNA, 23 nt, Artificial Sequence
  RNA Oligomer
ugaucaugaccucgucaacugag

SEQ ID NO: 40959 - RNA, 23 nt, Artificial Sequence
  RNA Oligomer
cuguuaaugcaaccauccacauc

SEQ ID NO: 40960 - RNA, 23 nt, Artificial Sequence
  RNA Oligomer
aggaauuccugugacggccuguu

SEQ ID NO: 40961 - RNA, 23 nt, Artificial Sequence
  RNA Oligomer
uugaaugagggucucuccaccau

SEQ ID NO: 40962 - RNA, 23 nt, Artificial Sequence
  RNA Oligomer
gucuucuuucucagccuggccau

SEQ ID NO: 40963 - RNA, 23 nt, Artificial Sequence
  RNA Oligomer
gcuaaggacaauagcaggcguca

SEQ ID NO: 40964 - RNA, 23 nt, Artificial Sequence
  RNA Oligomer
ugcuaaggacaauagcaggcguc

SEQ ID NO: 40965 - RNA, 23 nt, Artificial Sequence
  RNA Oligomer
ugauaugagcucccaguugggaa

SEQ ID NO: 40966 - RNA, 23 nt, Artificial Sequence
  RNA Oligomer
ucagacaggccuccuaugaguug

SEQ ID NO: 40967 - RNA, 23 nt, Artificial Sequence
  RNA Oligomer
gaaguugucauuaccaagguggu

SEQ ID NO: 40968 - RNA, 23 nt, Artificial Sequence
  RNA Oligomer
acaaacuggucgccuaugggaua

SEQ ID NO: 40969 - RNA, 23 nt, Artificial Sequence
  RNA Oligomer
aaccauccacaucguggcgcauu

SEQ ID NO: 40970 - RNA, 23 nt, Artificial Sequence
  RNA Oligomer
uucuuaccggcugggaugaaaau

SEQ ID NO: 40971 - RNA, 23 nt, Artificial Sequence
  RNA Oligomer
acccaacauccagacacagguga

SEQ ID NO: 40972 - RNA, 23 nt, Artificial Sequence
  RNA Oligomer
agaacuccaccaggaauuccugu

SEQ ID NO: 40973 - RNA, 23 nt, Artificial Sequence
  RNA Oligomer
ugugaagagccugauuuucaucc

SEQ ID NO: 40974 - RNA, 23 nt, Artificial Sequence
  RNA Oligomer
gugaagagccugauuuucauccc

SEQ ID NO: 40975 - RNA, 23 nt, Artificial Sequence
  RNA Oligomer
ugaagagccugauuuucauccca

SEQ ID NO: 40976 - RNA, 23 nt, Artificial Sequence
  RNA Oligomer
gaagagccugauuuucaucccag

SEQ ID NO: 40977 - RNA, 23 nt, Artificial Sequence
  RNA Oligomer
aagagccugauuuucaucccagc

SEQ ID NO: 40978 - RNA, 23 nt, Artificial Sequence
  RNA Oligomer
cagauaaaaauuuauucccagcc

SEQ ID NO: 40979 - RNA, 23 nt, Artificial Sequence
  RNA Oligomer
agauaaaaauuuauucccagcca

SEQ ID NO: 40980 - RNA, 23 nt, Artificial Sequence
  RNA Oligomer
gauaaaaauuuauucccagccau

SEQ ID NO: 40981 - RNA, 23 nt, Artificial Sequence
  RNA Oligomer
auaaaaauuuauucccagccaug

SEQ ID NO: 40982 - RNA, 23 nt, Artificial Sequence
  RNA Oligomer
uaaaaauuuauucccagccauga

SEQ ID NO: 40983 - RNA, 23 nt, Artificial Sequence
  RNA Oligomer
ccaaaauaacucguguguaaugg

SEQ ID NO: 40984 - RNA, 23 nt, Artificial Sequence
  RNA Oligomer
caaaauaacucguguguaaugga

SEQ ID NO: 40985 - RNA, 23 nt, Artificial Sequence
  RNA Oligomer
aaaauaacucguguguaauggaa

SEQ ID NO: 40986 - RNA, 23 nt, Artificial Sequence
  RNA Oligomer
aaauaacucguguguaauggaaa

SEQ ID NO: 40987 - RNA, 23 nt, Artificial Sequence
  RNA Oligomer
aauaacucguguguaauggaaag

SEQ ID NO: 40988 - RNA, 23 nt, Artificial Sequence
  RNA Oligomer
gcacaucuuuugaaguguccucg

SEQ ID NO: 40989 - RNA, 23 nt, Artificial Sequence
  RNA Oligomer
cacaucuuuugaaguguccucga

SEQ ID NO: 40990 - RNA, 23 nt, Artificial Sequence
  RNA Oligomer
acaucuuuugaaguguccucgag

SEQ ID NO: 40991 - RNA, 23 nt, Artificial Sequence
  RNA Oligomer
caucuuuugaaguguccucgaga

SEQ ID NO: 40992 - RNA, 23 nt, Artificial Sequence
  RNA Oligomer
aucuuuugaaguguccucgagag

SEQ ID NO: 40993 - RNA, 23 nt, Artificial Sequence
  RNA Oligomer
cuugaacucauuguuccaguugg

SEQ ID NO: 40994 - RNA, 23 nt, Artificial Sequence
  RNA Oligomer
uugaacucauuguuccaguuggg

SEQ ID NO: 40995 - RNA, 23 nt, Artificial Sequence
  RNA Oligomer
ugaacucauuguuccaguugggc

SEQ ID NO: 40996 - RNA, 23 nt, Artificial Sequence
  RNA Oligomer
gaacucauuguuccaguugggcc

SEQ ID NO: 40997 - RNA, 23 nt, Artificial Sequence
  RNA Oligomer
aacucauuguuccaguugggccu

SEQ ID NO: 40998 - RNA, 23 nt, Artificial Sequence
  RNA Oligomer
aggguuccuugccagaaaauuga

SEQ ID NO: 40999 - RNA, 23 nt, Artificial Sequence
  RNA Oligomer
ggguuccuugccagaaaauugag

SEQ ID NO: 41000 - RNA, 23 nt, Artificial Sequence
  RNA Oligomer
gguuccuugccagaaaauugagg

SEQ ID NO: 41001 - RNA, 23 nt, Artificial Sequence
  RNA Oligomer
guuccuugccagaaaauugaggc

SEQ ID NO: 41002 - RNA, 23 nt, Artificial Sequence
  RNA Oligomer
uuccuugccagaaaauugaggca

SEQ ID NO: 41003 - RNA, 23 nt, Artificial Sequence
  RNA Oligomer
aaaaauuuauucccagccaugag

SEQ ID NO: 41004 - RNA, 23 nt, Artificial Sequence
  RNA Oligomer
guaauagaaaugaacaccucugg

SEQ ID NO: 41005 - RNA, 23 nt, Artificial Sequence
  RNA Oligomer
uaauagaaaugaacaccucuggg

SEQ ID NO: 41006 - RNA, 23 nt, Artificial Sequence
  RNA Oligomer
aauagaaaugaacaccucugggg

SEQ ID NO: 41007 - RNA, 23 nt, Artificial Sequence
  RNA Oligomer
auagaaaugaacaccucuggggu

SEQ ID NO: 41008 - RNA, 23 nt, Artificial Sequence
  RNA Oligomer
uagaaaugaacaccucugggguc

SEQ ID NO: 41009 - RNA, 23 nt, Artificial Sequence
  RNA Oligomer
agagccugauuuucaucccagcc

SEQ ID NO: 41010 - RNA, 23 nt, Artificial Sequence
  RNA Oligomer
ggucaugaucaagacuaaagcca

SEQ ID NO: 41011 - RNA, 23 nt, Artificial Sequence
  RNA Oligomer
gucaugaucaagacuaaagccag

SEQ ID NO: 41012 - RNA, 23 nt, Artificial Sequence
  RNA Oligomer
ucaugaucaagacuaaagccaga

SEQ ID NO: 41013 - RNA, 23 nt, Artificial Sequence
  RNA Oligomer
caugaucaagacuaaagccagag

SEQ ID NO: 41014 - RNA, 23 nt, Artificial Sequence
  RNA Oligomer
augaucaagacuaaagccagaga

SEQ ID NO: 41015 - RNA, 23 nt, Artificial Sequence
  RNA Oligomer
gagguuuuugucuaauugccucc

SEQ ID NO: 41016 - RNA, 23 nt, Artificial Sequence
  RNA Oligomer
agguuuuugucuaauugccuccu

SEQ ID NO: 41017 - RNA, 23 nt, Artificial Sequence
  RNA Oligomer
gguuuuugucuaauugccuccuc

SEQ ID NO: 41018 - RNA, 23 nt, Artificial Sequence
  RNA Oligomer
guuuuugucuaauugccuccucc

SEQ ID NO: 41019 - RNA, 23 nt, Artificial Sequence
  RNA Oligomer
uuuuugucuaauugccuccucca

SEQ ID NO: 41020 - RNA, 23 nt, Artificial Sequence
  RNA Oligomer
aguguugaacccaaaauaacucg

SEQ ID NO: 41021 - RNA, 23 nt, Artificial Sequence
  RNA Oligomer
guguugaacccaaaauaacucgu

SEQ ID NO: 41022 - RNA, 23 nt, Artificial Sequence
  RNA Oligomer
uguugaacccaaaauaacucgug

SEQ ID NO: 41023 - RNA, 23 nt, Artificial Sequence
  RNA Oligomer
guugaacccaaaauaacucgugu

SEQ ID NO: 41024 - RNA, 23 nt, Artificial Sequence
  RNA Oligomer
uugaacccaaaauaacucgugug

SEQ ID NO: 41025 - RNA, 23 nt, Artificial Sequence
  RNA Oligomer
uuguuguaauagaaaugaacacc

SEQ ID NO: 41026 - RNA, 23 nt, Artificial Sequence
  RNA Oligomer
uguuguaauagaaaugaacaccu

SEQ ID NO: 41027 - RNA, 23 nt, Artificial Sequence
  RNA Oligomer
guuguaauagaaaugaacaccuc

SEQ ID NO: 41028 - RNA, 23 nt, Artificial Sequence
  RNA Oligomer
uuguaauagaaaugaacaccucu

SEQ ID NO: 41029 - RNA, 23 nt, Artificial Sequence
  RNA Oligomer
uguaauagaaaugaacaccucug

SEQ ID NO: 41030 - RNA, 23 nt, Artificial Sequence
  RNA Oligomer
gaagaacacgccaauacugcugc

SEQ ID NO: 41031 - RNA, 23 nt, Artificial Sequence
  RNA Oligomer
aagaacacgccaauacugcugcu

SEQ ID NO: 41032 - RNA, 23 nt, Artificial Sequence
  RNA Oligomer
agaacacgccaauacugcugcug

SEQ ID NO: 41033 - RNA, 23 nt, Artificial Sequence
  RNA Oligomer
gaacacgccaauacugcugcugg

SEQ ID NO: 41034 - RNA, 23 nt, Artificial Sequence
  RNA Oligomer
aacacgccaauacugcugcuggg

SEQ ID NO: 41035 - RNA, 23 nt, Artificial Sequence
  RNA Oligomer
aagcuaugugaagagccugauuu

SEQ ID NO: 41036 - RNA, 23 nt, Artificial Sequence
  RNA Oligomer
agcuaugugaagagccugauuuu

SEQ ID NO: 41037 - RNA, 23 nt, Artificial Sequence
  RNA Oligomer
gcuaugugaagagccugauuuuc

SEQ ID NO: 41038 - RNA, 23 nt, Artificial Sequence
  RNA Oligomer
cuaugugaagagccugauuuuca

SEQ ID NO: 41039 - RNA, 23 nt, Artificial Sequence
  RNA Oligomer
uaugugaagagccugauuuucau

SEQ ID NO: 41040 - RNA, 23 nt, Artificial Sequence
  RNA Oligomer
ggcaaucugcuugaacucauugu

SEQ ID NO: 41041 - RNA, 23 nt, Artificial Sequence
  RNA Oligomer
gcaaucugcuugaacucauuguu

SEQ ID NO: 41042 - RNA, 23 nt, Artificial Sequence
  RNA Oligomer
caaucugcuugaacucauuguuc

SEQ ID NO: 41043 - RNA, 23 nt, Artificial Sequence
  RNA Oligomer
aaucugcuugaacucauuguucc

SEQ ID NO: 41044 - RNA, 23 nt, Artificial Sequence
  RNA Oligomer
aucugcuugaacucauuguucca

SEQ ID NO: 41045 - RNA, 23 nt, Artificial Sequence
  RNA Oligomer
uggguagugaaauacaucuguca

SEQ ID NO: 41046 - RNA, 23 nt, Artificial Sequence
  RNA Oligomer
ggguagugaaauacaucugucag

SEQ ID NO: 41047 - RNA, 23 nt, Artificial Sequence
  RNA Oligomer
gguagugaaauacaucugucagg

SEQ ID NO: 41048 - RNA, 23 nt, Artificial Sequence
  RNA Oligomer
guagugaaauacaucugucaggg

SEQ ID NO: 41049 - RNA, 23 nt, Artificial Sequence
  RNA Oligomer
uagugaaauacaucugucagggc

SEQ ID NO: 41050 - RNA, 23 nt, Artificial Sequence
  RNA Oligomer
uaauuauucuuucacaugcauac

SEQ ID NO: 41051 - RNA, 23 nt, Artificial Sequence
  RNA Oligomer
aauuauucuuucacaugcauaca

SEQ ID NO: 41052 - RNA, 23 nt, Artificial Sequence
  RNA Oligomer
auuauucuuucacaugcauacaa

SEQ ID NO: 41053 - RNA, 23 nt, Artificial Sequence
  RNA Oligomer
uuauucuuucacaugcauacaag

SEQ ID NO: 41054 - RNA, 23 nt, Artificial Sequence
  RNA Oligomer
uauucuuucacaugcauacaaga

SEQ ID NO: 41055 - RNA, 23 nt, Artificial Sequence
  RNA Oligomer
uagcaugcaguuaaaauucaggc

SEQ ID NO: 41056 - RNA, 23 nt, Artificial Sequence
  RNA Oligomer
agcaugcaguuaaaauucaggca

SEQ ID NO: 41057 - RNA, 23 nt, Artificial Sequence
  RNA Oligomer
gcaugcaguuaaaauucaggcac

SEQ ID NO: 41058 - RNA, 23 nt, Artificial Sequence
  RNA Oligomer
caugcaguuaaaauucaggcaca

SEQ ID NO: 41059 - RNA, 23 nt, Artificial Sequence
  RNA Oligomer
augcaguuaaaauucaggcacag

SEQ ID NO: 41060 - RNA, 23 nt, Artificial Sequence
  RNA Oligomer
agcuaaggaaguaugguauagug

SEQ ID NO: 41061 - RNA, 23 nt, Artificial Sequence
  RNA Oligomer
gcuaaggaaguaugguauagugu

SEQ ID NO: 41062 - RNA, 23 nt, Artificial Sequence
  RNA Oligomer
cuaaggaaguaugguauagugua

SEQ ID NO: 41063 - RNA, 23 nt, Artificial Sequence
  RNA Oligomer
uaaggaaguaugguauaguguac

SEQ ID NO: 41064 - RNA, 23 nt, Artificial Sequence
  RNA Oligomer
aaggaaguaugguauaguguacu

SEQ ID NO: 41065 - RNA, 23 nt, Artificial Sequence
  RNA Oligomer
cuguaaucacgucaguauuuucg

SEQ ID NO: 41066 - RNA, 23 nt, Artificial Sequence
  RNA Oligomer
uguaaucacgucaguauuuucgu

SEQ ID NO: 41067 - RNA, 23 nt, Artificial Sequence
  RNA Oligomer
guaaucacgucaguauuuucguc

SEQ ID NO: 41068 - RNA, 23 nt, Artificial Sequence
  RNA Oligomer
uaaucacgucaguauuuucgucc

SEQ ID NO: 41069 - RNA, 23 nt, Artificial Sequence
  RNA Oligomer
aaucacgucaguauuuucguccc

SEQ ID NO: 41070 - RNA, 23 nt, Artificial Sequence
  RNA Oligomer
aauauaugauaacucagaaagug

SEQ ID NO: 41071 - RNA, 23 nt, Artificial Sequence
  RNA Oligomer
auauaugauaacucagaaaguga

SEQ ID NO: 41072 - RNA, 23 nt, Artificial Sequence
  RNA Oligomer
uauaugauaacucagaaagugag

SEQ ID NO: 41073 - RNA, 23 nt, Artificial Sequence
  RNA Oligomer
auaugauaacucagaaagugagu

SEQ ID NO: 41074 - RNA, 23 nt, Artificial Sequence
  RNA Oligomer
uaugauaacucagaaagugaguu

SEQ ID NO: 41075 - RNA, 23 nt, Artificial Sequence
  RNA Oligomer
caccccaucaugauacuuguugc

SEQ ID NO: 41076 - RNA, 23 nt, Artificial Sequence
  RNA Oligomer
accccaucaugauacuuguugcu

SEQ ID NO: 41077 - RNA, 23 nt, Artificial Sequence
  RNA Oligomer
ccccaucaugauacuuguugcuc

SEQ ID NO: 41078 - RNA, 23 nt, Artificial Sequence
  RNA Oligomer
cccaucaugauacuuguugcucu

SEQ ID NO: 41079 - RNA, 23 nt, Artificial Sequence
  RNA Oligomer
ccaucaugauacuuguugcucuu

SEQ ID NO: 41080 - RNA, 23 nt, Artificial Sequence
  RNA Oligomer
cuuuuucaugugaaguuccagga

SEQ ID NO: 41081 - RNA, 23 nt, Artificial Sequence
  RNA Oligomer
uuuuucaugugaaguuccaggac

SEQ ID NO: 41082 - RNA, 23 nt, Artificial Sequence
  RNA Oligomer
uuuucaugugaaguuccaggacu

SEQ ID NO: 41083 - RNA, 23 nt, Artificial Sequence
  RNA Oligomer
uuucaugugaaguuccaggacuc

SEQ ID NO: 41084 - RNA, 23 nt, Artificial Sequence
  RNA Oligomer
uucaugugaaguuccaggacucc

SEQ ID NO: 41085 - RNA, 23 nt, Artificial Sequence
  RNA Oligomer
aucaugauacuuguugcucuucg

SEQ ID NO: 41086 - RNA, 23 nt, Artificial Sequence
  RNA Oligomer
ucaugauacuuguugcucuucgg

SEQ ID NO: 41087 - RNA, 23 nt, Artificial Sequence
  RNA Oligomer
caugauacuuguugcucuucggc

SEQ ID NO: 41088 - RNA, 23 nt, Artificial Sequence
  RNA Oligomer
augauacuuguugcucuucggcu

SEQ ID NO: 41089 - RNA, 23 nt, Artificial Sequence
  RNA Oligomer
ugauacuuguugcucuucggcug

SEQ ID NO: 41090 - RNA, 23 nt, Artificial Sequence
  RNA Oligomer
ggccaggcugagaaagaagacga

SEQ ID NO: 41091 - RNA, 23 nt, Artificial Sequence
  RNA Oligomer
gccaggcugagaaagaagacgau

SEQ ID NO: 41092 - RNA, 23 nt, Artificial Sequence
  RNA Oligomer
ccaggcugagaaagaagacgaug

SEQ ID NO: 41093 - RNA, 23 nt, Artificial Sequence
  RNA Oligomer
caggcugagaaagaagacgauga

SEQ ID NO: 41094 - RNA, 23 nt, Artificial Sequence
  RNA Oligomer
aggcugagaaagaagacgaugaa

SEQ ID NO: 41095 - RNA, 23 nt, Artificial Sequence
  RNA Oligomer
gagaaagaagacgaugaaaacau

SEQ ID NO: 41096 - RNA, 23 nt, Artificial Sequence
  RNA Oligomer
agaaagaagacgaugaaaacaug

SEQ ID NO: 41097 - RNA, 23 nt, Artificial Sequence
  RNA Oligomer
gaaagaagacgaugaaaacaugg

SEQ ID NO: 41098 - RNA, 23 nt, Artificial Sequence
  RNA Oligomer
aaagaagacgaugaaaacauggu

SEQ ID NO: 41099 - RNA, 23 nt, Artificial Sequence
  RNA Oligomer
aagaagacgaugaaaacauggug

SEQ ID NO: 41100 - RNA, 23 nt, Artificial Sequence
  RNA Oligomer
gaggucaugaucaagacuaaagc

SEQ ID NO: 41101 - RNA, 23 nt, Artificial Sequence
  RNA Oligomer
aggucaugaucaagacuaaagcc

SEQ ID NO: 41102 - RNA, 23 nt, Artificial Sequence
  RNA Oligomer
ugaucaagacuaaagccagagag

SEQ ID NO: 41103 - RNA, 23 nt, Artificial Sequence
  RNA Oligomer
gaucaagacuaaagccagagaga

SEQ ID NO: 41104 - RNA, 23 nt, Artificial Sequence
  RNA Oligomer
aucaagacuaaagccagagagau

SEQ ID NO: 41105 - RNA, 23 nt, Artificial Sequence
  RNA Oligomer
uauuguccuuagcaauucagugg

SEQ ID NO: 41106 - RNA, 23 nt, Artificial Sequence
  RNA Oligomer
auuguccuuagcaauucaguggu

SEQ ID NO: 41107 - RNA, 23 nt, Artificial Sequence
  RNA Oligomer
uuguccuuagcaauucagugguu

SEQ ID NO: 41108 - RNA, 23 nt, Artificial Sequence
  RNA Oligomer
uguccuuagcaauucagugguug

SEQ ID NO: 41109 - RNA, 23 nt, Artificial Sequence
  RNA Oligomer
guccuuagcaauucagugguugu

SEQ ID NO: 41110 - RNA, 23 nt, Artificial Sequence
  RNA Oligomer
agucuagaagcucuccuuguugu

SEQ ID NO: 41111 - RNA, 23 nt, Artificial Sequence
  RNA Oligomer
gucuagaagcucuccuuguugua

SEQ ID NO: 41112 - RNA, 23 nt, Artificial Sequence
  RNA Oligomer
ucuagaagcucuccuuguuguaa

SEQ ID NO: 41113 - RNA, 23 nt, Artificial Sequence
  RNA Oligomer
cuagaagcucuccuuguuguaau

SEQ ID NO: 41114 - RNA, 23 nt, Artificial Sequence
  RNA Oligomer
uagaagcucuccuuguuguaaua

SEQ ID NO: 41115 - RNA, 23 nt, Artificial Sequence
  RNA Oligomer
cagccaugagaguacuaauaugg

SEQ ID NO: 41116 - RNA, 23 nt, Artificial Sequence
  RNA Oligomer
agccaugagaguacuaauauggu

SEQ ID NO: 41117 - RNA, 23 nt, Artificial Sequence
  RNA Oligomer
gccaugagaguacuaauauggug

SEQ ID NO: 41118 - RNA, 23 nt, Artificial Sequence
  RNA Oligomer
ccaugagaguacuaauauggugg

SEQ ID NO: 41119 - RNA, 23 nt, Artificial Sequence
  RNA Oligomer
caugagaguacuaauauggugga

SEQ ID NO: 41120 - RNA, 23 nt, Artificial Sequence
  RNA Oligomer
uaccauauagauuucagaagagc

SEQ ID NO: 41121 - RNA, 23 nt, Artificial Sequence
  RNA Oligomer
accauauagauuucagaagagca

SEQ ID NO: 41122 - RNA, 23 nt, Artificial Sequence
  RNA Oligomer
ccauauagauuucagaagagcag

SEQ ID NO: 41123 - RNA, 23 nt, Artificial Sequence
  RNA Oligomer
cauauagauuucagaagagcagc

SEQ ID NO: 41124 - RNA, 23 nt, Artificial Sequence
  RNA Oligomer
auauagauuucagaagagcagcg

SEQ ID NO: 41125 - RNA, 23 nt, Artificial Sequence
  RNA Oligomer
uauagauuucagaagagcagcga

SEQ ID NO: 41126 - RNA, 23 nt, Artificial Sequence
  RNA Oligomer
auagauuucagaagagcagcgaa

SEQ ID NO: 41127 - RNA, 23 nt, Artificial Sequence
  RNA Oligomer
uagauuucagaagagcagcgaag

SEQ ID NO: 41128 - RNA, 23 nt, Artificial Sequence
  RNA Oligomer
agauuucagaagagcagcgaagg

SEQ ID NO: 41129 - RNA, 23 nt, Artificial Sequence
  RNA Oligomer
uguguaccagaacaacucauagg

SEQ ID NO: 41130 - RNA, 23 nt, Artificial Sequence
  RNA Oligomer
guguaccagaacaacucauagga

SEQ ID NO: 41131 - RNA, 23 nt, Artificial Sequence
  RNA Oligomer
uguaccagaacaacucauaggag

SEQ ID NO: 41132 - RNA, 23 nt, Artificial Sequence
  RNA Oligomer
guaccagaacaacucauaggagg

SEQ ID NO: 41133 - RNA, 23 nt, Artificial Sequence
  RNA Oligomer
uaccagaacaacucauaggaggc

SEQ ID NO: 41134 - RNA, 23 nt, Artificial Sequence
  RNA Oligomer
gauguugggucguuaguaagggc

SEQ ID NO: 41135 - RNA, 23 nt, Artificial Sequence
  RNA Oligomer
auguugggucguuaguaagggcu

SEQ ID NO: 41136 - RNA, 23 nt, Artificial Sequence
  RNA Oligomer
uguugggucguuaguaagggcuu

SEQ ID NO: 41137 - RNA, 23 nt, Artificial Sequence
  RNA Oligomer
guugggucguuaguaagggcuuc

SEQ ID NO: 41138 - RNA, 23 nt, Artificial Sequence
  RNA Oligomer
uugggucguuaguaagggcuucc

SEQ ID NO: 41139 - RNA, 23 nt, Artificial Sequence
  RNA Oligomer
auuuauaagcuaaggaaguaugg

SEQ ID NO: 41140 - RNA, 23 nt, Artificial Sequence
  RNA Oligomer
uuuauaagcuaaggaaguauggu

SEQ ID NO: 41141 - RNA, 23 nt, Artificial Sequence
  RNA Oligomer
uuauaagcuaaggaaguauggua

SEQ ID NO: 41142 - RNA, 23 nt, Artificial Sequence
  RNA Oligomer
uauaagcuaaggaaguaugguau

SEQ ID NO: 41143 - RNA, 23 nt, Artificial Sequence
  RNA Oligomer
auaagcuaaggaaguaugguaua

SEQ ID NO: 41144 - RNA, 23 nt, Artificial Sequence
  RNA Oligomer
gagccugauuuucaucccagccg

SEQ ID NO: 41145 - RNA, 23 nt, Artificial Sequence
  RNA Oligomer
agccugauuuucaucccagccgg

SEQ ID NO: 41146 - RNA, 23 nt, Artificial Sequence
  RNA Oligomer
gccugauuuucaucccagccggu

SEQ ID NO: 41147 - RNA, 23 nt, Artificial Sequence
  RNA Oligomer
ccugauuuucaucccagccggua

SEQ ID NO: 41148 - RNA, 23 nt, Artificial Sequence
  RNA Oligomer
cugauuuucaucccagccgguaa

SEQ ID NO: 41149 - RNA, 23 nt, Artificial Sequence
  RNA Oligomer
agcaaaccacucaaaagcucuug

SEQ ID NO: 41150 - RNA, 23 nt, Artificial Sequence
  RNA Oligomer
gcaaaccacucaaaagcucuugc

SEQ ID NO: 41151 - RNA, 23 nt, Artificial Sequence
  RNA Oligomer
caaaccacucaaaagcucuugca

SEQ ID NO: 41152 - RNA, 23 nt, Artificial Sequence
  RNA Oligomer
aaaccacucaaaagcucuugcau

SEQ ID NO: 41153 - RNA, 23 nt, Artificial Sequence
  RNA Oligomer
aaccacucaaaagcucuugcauc

SEQ ID NO: 41154 - RNA, 23 nt, Artificial Sequence
  RNA Oligomer
gauuucagaagagcagcgaaggg

SEQ ID NO: 41155 - RNA, 23 nt, Artificial Sequence
  RNA Oligomer
auuucagaagagcagcgaaggga

SEQ ID NO: 41156 - RNA, 23 nt, Artificial Sequence
  RNA Oligomer
uuucagaagagcagcgaagggag

SEQ ID NO: 41157 - RNA, 23 nt, Artificial Sequence
  RNA Oligomer
agugaaauacaucugucagggca

SEQ ID NO: 41158 - RNA, 23 nt, Artificial Sequence
  RNA Oligomer
gugaaauacaucugucagggcag

SEQ ID NO: 41159 - RNA, 23 nt, Artificial Sequence
  RNA Oligomer
ugaaauacaucugucagggcagu

SEQ ID NO: 41160 - RNA, 23 nt, Artificial Sequence
  RNA Oligomer
gcaccccaucaugauacuuguug

SEQ ID NO: 41161 - RNA, 23 nt, Artificial Sequence
  RNA Oligomer
caucaugauacuuguugcucuuc

SEQ ID NO: 41162 - RNA, 23 nt, Artificial Sequence
  RNA Oligomer
gauacuuguugcucuucggcugu

SEQ ID NO: 41163 - RNA, 23 nt, Artificial Sequence
  RNA Oligomer
auacuuguugcucuucggcuguc

SEQ ID NO: 41164 - RNA, 23 nt, Artificial Sequence
  RNA Oligomer
uucuuucacaugcauacaagacc

SEQ ID NO: 41165 - RNA, 23 nt, Artificial Sequence
  RNA Oligomer
ucuuucacaugcauacaagacca

SEQ ID NO: 41166 - RNA, 23 nt, Artificial Sequence
  RNA Oligomer
cuuucacaugcauacaagaccac

SEQ ID NO: 41167 - RNA, 23 nt, Artificial Sequence
  RNA Oligomer
uuucacaugcauacaagaccaca

SEQ ID NO: 41168 - RNA, 23 nt, Artificial Sequence
  RNA Oligomer
uucacaugcauacaagaccacag

SEQ ID NO: 41169 - RNA, 23 nt, Artificial Sequence
  RNA Oligomer
ggcugagaaagaagacgaugaaa

SEQ ID NO: 41170 - RNA, 23 nt, Artificial Sequence
  RNA Oligomer
gcugagaaagaagacgaugaaaa

SEQ ID NO: 41171 - RNA, 23 nt, Artificial Sequence
  RNA Oligomer
cugagaaagaagacgaugaaaac

SEQ ID NO: 41172 - RNA, 23 nt, Artificial Sequence
  RNA Oligomer
uuuugucuaauugccuccuccac

SEQ ID NO: 41173 - RNA, 23 nt, Artificial Sequence
  RNA Oligomer
uuugucuaauugccuccuccacg

SEQ ID NO: 41174 - RNA, 23 nt, Artificial Sequence
  RNA Oligomer
uugucuaauugccuccuccacgg

SEQ ID NO: 41175 - RNA, 23 nt, Artificial Sequence
  RNA Oligomer
caguuaaaauucaggcacagugc

SEQ ID NO: 41176 - RNA, 23 nt, Artificial Sequence
  RNA Oligomer
aguuaaaauucaggcacagugcg

SEQ ID NO: 41177 - RNA, 23 nt, Artificial Sequence
  RNA Oligomer
guuaaaauucaggcacagugcgg

SEQ ID NO: 41178 - RNA, 23 nt, Artificial Sequence
  RNA Oligomer
uuaaaauucaggcacagugcgga

SEQ ID NO: 41179 - RNA, 23 nt, Artificial Sequence
  RNA Oligomer
uaaaauucaggcacagugcggau

SEQ ID NO: 41180 - RNA, 23 nt, Artificial Sequence
  RNA Oligomer
uaagcuaaggaaguaugguauag

SEQ ID NO: 41181 - RNA, 23 nt, Artificial Sequence
  RNA Oligomer
aagcuaaggaaguaugguauagu

SEQ ID NO: 41182 - RNA, 23 nt, Artificial Sequence
  RNA Oligomer
uuaauuauuauucaccaguuccc

SEQ ID NO: 41183 - RNA, 23 nt, Artificial Sequence
  RNA Oligomer
uaauuauuauucaccaguuccca

SEQ ID NO: 41184 - RNA, 23 nt, Artificial Sequence
  RNA Oligomer
aauuauuauucaccaguucccaa

SEQ ID NO: 41185 - RNA, 23 nt, Artificial Sequence
  RNA Oligomer
auuauuauucaccaguucccaac

SEQ ID NO: 41186 - RNA, 23 nt, Artificial Sequence
  RNA Oligomer
uuauuauucaccaguucccaacu

SEQ ID NO: 41187 - RNA, 23 nt, Artificial Sequence
  RNA Oligomer
acagaagaacacgccaauacugc

SEQ ID NO: 41188 - RNA, 23 nt, Artificial Sequence
  RNA Oligomer
cagaagaacacgccaauacugcu

SEQ ID NO: 41189 - RNA, 23 nt, Artificial Sequence
  RNA Oligomer
agaagaacacgccaauacugcug

SEQ ID NO: 41190 - RNA, 23 nt, Artificial Sequence
  RNA Oligomer
aggcaaucugcuugaacucauug

SEQ ID NO: 41191 - RNA, 23 nt, Artificial Sequence
  RNA Oligomer
ugcuuuaagccuguaaucacguc

SEQ ID NO: 41192 - RNA, 23 nt, Artificial Sequence
  RNA Oligomer
gcuuuaagccuguaaucacguca

SEQ ID NO: 41193 - RNA, 23 nt, Artificial Sequence
  RNA Oligomer
cuuuaagccuguaaucacgucag

SEQ ID NO: 41194 - RNA, 23 nt, Artificial Sequence
  RNA Oligomer
uuuaagccuguaaucacgucagu

SEQ ID NO: 41195 - RNA, 23 nt, Artificial Sequence
  RNA Oligomer
uuaagccuguaaucacgucagua

SEQ ID NO: 41196 - RNA, 23 nt, Artificial Sequence
  RNA Oligomer
uaagccuguaaucacgucaguau

SEQ ID NO: 41197 - RNA, 23 nt, Artificial Sequence
  RNA Oligomer
ccaguguaaagcuaugugaagag

SEQ ID NO: 41198 - RNA, 23 nt, Artificial Sequence
  RNA Oligomer
caguguaaagcuaugugaagagc

SEQ ID NO: 41199 - RNA, 23 nt, Artificial Sequence
  RNA Oligomer
aguguaaagcuaugugaagagcc

SEQ ID NO: 41200 - RNA, 23 nt, Artificial Sequence
  RNA Oligomer
guguaaagcuaugugaagagccu

SEQ ID NO: 41201 - RNA, 23 nt, Artificial Sequence
  RNA Oligomer
uguaaagcuaugugaagagccug

SEQ ID NO: 41202 - RNA, 23 nt, Artificial Sequence
  RNA Oligomer
ugauuuucaucccagccgguaag

SEQ ID NO: 41203 - RNA, 23 nt, Artificial Sequence
  RNA Oligomer
augauaacucagaaagugaguuu

SEQ ID NO: 41204 - RNA, 23 nt, Artificial Sequence
  RNA Oligomer
ccaguagaaauacaccuugcuca

SEQ ID NO: 41205 - RNA, 23 nt, Artificial Sequence
  RNA Oligomer
caguagaaauacaccuugcucag

SEQ ID NO: 41206 - RNA, 23 nt, Artificial Sequence
  RNA Oligomer
aguagaaauacaccuugcucagc

SEQ ID NO: 41207 - RNA, 23 nt, Artificial Sequence
  RNA Oligomer
guagaaauacaccuugcucagcu

SEQ ID NO: 41208 - RNA, 23 nt, Artificial Sequence
  RNA Oligomer
uagaaauacaccuugcucagcuu

SEQ ID NO: 41209 - RNA, 23 nt, Artificial Sequence
  RNA Oligomer
cucacugcauuuguaccauauag

SEQ ID NO: 41210 - RNA, 23 nt, Artificial Sequence
  RNA Oligomer
ucacugcauuuguaccauauaga

SEQ ID NO: 41211 - RNA, 23 nt, Artificial Sequence
  RNA Oligomer
cacugcauuuguaccauauagau

SEQ ID NO: 41212 - RNA, 23 nt, Artificial Sequence
  RNA Oligomer
acugcauuuguaccauauagauu

SEQ ID NO: 41213 - RNA, 23 nt, Artificial Sequence
  RNA Oligomer
cugcauuuguaccauauagauuu

SEQ ID NO: 41214 - RNA, 23 nt, Artificial Sequence
  RNA Oligomer
uucagaagagcagcgaagggagu

SEQ ID NO: 41215 - RNA, 23 nt, Artificial Sequence
  RNA Oligomer
cacgcugaaaaagucuuccuggg

SEQ ID NO: 41216 - RNA, 23 nt, Artificial Sequence
  RNA Oligomer
acgcugaaaaagucuuccugggg

SEQ ID NO: 41217 - RNA, 23 nt, Artificial Sequence
  RNA Oligomer
cgcugaaaaagucuuccuggggg

SEQ ID NO: 41218 - RNA, 23 nt, Artificial Sequence
  RNA Oligomer
gcugaaaaagucuuccugggggg

SEQ ID NO: 41219 - RNA, 23 nt, Artificial Sequence
  RNA Oligomer
cugaaaaagucuuccuggggggc

SEQ ID NO: 41220 - RNA, 23 nt, Artificial Sequence
  RNA Oligomer
gccuaaaauccauuuccaagccg

SEQ ID NO: 41221 - RNA, 23 nt, Artificial Sequence
  RNA Oligomer
ccuaaaauccauuuccaagccga

SEQ ID NO: 41222 - RNA, 23 nt, Artificial Sequence
  RNA Oligomer
cuaaaauccauuuccaagccgag

SEQ ID NO: 41223 - RNA, 23 nt, Artificial Sequence
  RNA Oligomer
uaaaauccauuuccaagccgagg

SEQ ID NO: 41224 - RNA, 23 nt, Artificial Sequence
  RNA Oligomer
aaaauccauuuccaagccgaggg

SEQ ID NO: 41225 - RNA, 23 nt, Artificial Sequence
  RNA Oligomer
agacuaaagccagagagaucacc

SEQ ID NO: 41226 - RNA, 23 nt, Artificial Sequence
  RNA Oligomer
gacuaaagccagagagaucacca

SEQ ID NO: 41227 - RNA, 23 nt, Artificial Sequence
  RNA Oligomer
acuaaagccagagagaucaccag

SEQ ID NO: 41228 - RNA, 23 nt, Artificial Sequence
  RNA Oligomer
cuaaagccagagagaucaccaga

SEQ ID NO: 41229 - RNA, 23 nt, Artificial Sequence
  RNA Oligomer
uaaagccagagagaucaccagac

SEQ ID NO: 41230 - RNA, 23 nt, Artificial Sequence
  RNA Oligomer
agcaauucagugguuguguuugu

SEQ ID NO: 41231 - RNA, 23 nt, Artificial Sequence
  RNA Oligomer
gcaauucagugguuguguuugug

SEQ ID NO: 41232 - RNA, 23 nt, Artificial Sequence
  RNA Oligomer
caauucagugguuguguuugugg

SEQ ID NO: 41233 - RNA, 23 nt, Artificial Sequence
  RNA Oligomer
aauucagugguuguguuuguggg

SEQ ID NO: 41234 - RNA, 23 nt, Artificial Sequence
  RNA Oligomer
auucagugguuguguuugugggg

SEQ ID NO: 41235 - RNA, 23 nt, Artificial Sequence
  RNA Oligomer
agcguuccagguugaagaaaugc

SEQ ID NO: 41236 - RNA, 23 nt, Artificial Sequence
  RNA Oligomer
gcguuccagguugaagaaaugcg

SEQ ID NO: 41237 - RNA, 23 nt, Artificial Sequence
  RNA Oligomer
cguuccagguugaagaaaugcgc

SEQ ID NO: 41238 - RNA, 23 nt, Artificial Sequence
  RNA Oligomer
guuccagguugaagaaaugcgcc

SEQ ID NO: 41239 - RNA, 23 nt, Artificial Sequence
  RNA Oligomer
uuccagguugaagaaaugcgcca

SEQ ID NO: 41240 - RNA, 23 nt, Artificial Sequence
  RNA Oligomer
gaccaguuugugaaaucugaggu

SEQ ID NO: 41241 - RNA, 23 nt, Artificial Sequence
  RNA Oligomer
accaguuugugaaaucugagguu

SEQ ID NO: 41242 - RNA, 23 nt, Artificial Sequence
  RNA Oligomer
ccaguuugugaaaucugagguuu

SEQ ID NO: 41243 - RNA, 23 nt, Artificial Sequence
  RNA Oligomer
caguuugugaaaucugagguuuu

SEQ ID NO: 41244 - RNA, 23 nt, Artificial Sequence
  RNA Oligomer
aguuugugaaaucugagguuuuu

SEQ ID NO: 41245 - RNA, 23 nt, Artificial Sequence
  RNA Oligomer
ugugaaaucugagguuuuugucu

SEQ ID NO: 41246 - RNA, 23 nt, Artificial Sequence
  RNA Oligomer
gugaaaucugagguuuuugucua

SEQ ID NO: 41247 - RNA, 23 nt, Artificial Sequence
  RNA Oligomer
ugaaaucugagguuuuugucuaa

SEQ ID NO: 41248 - RNA, 23 nt, Artificial Sequence
  RNA Oligomer
gaaaucugagguuuuugucuaau

SEQ ID NO: 41249 - RNA, 23 nt, Artificial Sequence
  RNA Oligomer
aaaucugagguuuuugucuaauu

SEQ ID NO: 41250 - RNA, 23 nt, Artificial Sequence
  RNA Oligomer
gcaaauacuuguuccucuuauga

SEQ ID NO: 41251 - RNA, 23 nt, Artificial Sequence
  RNA Oligomer
caaauacuuguuccucuuaugaa

SEQ ID NO: 41252 - RNA, 23 nt, Artificial Sequence
  RNA Oligomer
aaauacuuguuccucuuaugaau

SEQ ID NO: 41253 - RNA, 23 nt, Artificial Sequence
  RNA Oligomer
aauacuuguuccucuuaugaaug

SEQ ID NO: 41254 - RNA, 23 nt, Artificial Sequence
  RNA Oligomer
auacuuguuccucuuaugaauga

SEQ ID NO: 41255 - RNA, 23 nt, Artificial Sequence
  RNA Oligomer
cagguauuagaauuagcaugcag

SEQ ID NO: 41256 - RNA, 23 nt, Artificial Sequence
  RNA Oligomer
agguauuagaauuagcaugcagu

SEQ ID NO: 41257 - RNA, 23 nt, Artificial Sequence
  RNA Oligomer
gguauuagaauuagcaugcaguu

SEQ ID NO: 41258 - RNA, 23 nt, Artificial Sequence
  RNA Oligomer
guauuagaauuagcaugcaguua

SEQ ID NO: 41259 - RNA, 23 nt, Artificial Sequence
  RNA Oligomer
uauuagaauuagcaugcaguuaa

SEQ ID NO: 41260 - RNA, 23 nt, Artificial Sequence
  RNA Oligomer
ggauguugggucguuaguaaggg

SEQ ID NO: 41261 - RNA, 23 nt, Artificial Sequence
  RNA Oligomer
ugaacccaaaauaacucgugugu

SEQ ID NO: 41262 - RNA, 23 nt, Artificial Sequence
  RNA Oligomer
gaacccaaaauaacucgugugua

SEQ ID NO: 41263 - RNA, 23 nt, Artificial Sequence
  RNA Oligomer
aacccaaaauaacucguguguaa

SEQ ID NO: 41264 - RNA, 23 nt, Artificial Sequence
  RNA Oligomer
aaaauuuauucccagccaugaga

SEQ ID NO: 41265 - RNA, 23 nt, Artificial Sequence
  RNA Oligomer
uugauugaaaacacaaugccugg

SEQ ID NO: 41266 - RNA, 23 nt, Artificial Sequence
  RNA Oligomer
ugauugaaaacacaaugccugga

SEQ ID NO: 41267 - RNA, 23 nt, Artificial Sequence
  RNA Oligomer
gauugaaaacacaaugccuggac

SEQ ID NO: 41268 - RNA, 23 nt, Artificial Sequence
  RNA Oligomer
auugaaaacacaaugccuggacu

SEQ ID NO: 41269 - RNA, 23 nt, Artificial Sequence
  RNA Oligomer
uugaaaacacaaugccuggacuu

SEQ ID NO: 41270 - RNA, 23 nt, Artificial Sequence
  RNA Oligomer
cuccaaagucuagaagcucuccu

SEQ ID NO: 41271 - RNA, 23 nt, Artificial Sequence
  RNA Oligomer
uccaaagucuagaagcucuccuu

SEQ ID NO: 41272 - RNA, 23 nt, Artificial Sequence
  RNA Oligomer
ccaaagucuagaagcucuccuug

SEQ ID NO: 41273 - RNA, 23 nt, Artificial Sequence
  RNA Oligomer
caaagucuagaagcucuccuugu

SEQ ID NO: 41274 - RNA, 23 nt, Artificial Sequence
  RNA Oligomer
aaagucuagaagcucuccuuguu

SEQ ID NO: 41275 - RNA, 23 nt, Artificial Sequence
  RNA Oligomer
ggcacaucuuuugaaguguccuc

SEQ ID NO: 41276 - RNA, 23 nt, Artificial Sequence
  RNA Oligomer
ucugcuuuaagccuguaaucacg

SEQ ID NO: 41277 - RNA, 23 nt, Artificial Sequence
  RNA Oligomer
cugcuuuaagccuguaaucacgu

SEQ ID NO: 41278 - RNA, 23 nt, Artificial Sequence
  RNA Oligomer
accacucaaaagcucuugcaucc

SEQ ID NO: 41279 - RNA, 23 nt, Artificial Sequence
  RNA Oligomer
ggagagacccucauucaaaaucc

SEQ ID NO: 41280 - RNA, 23 nt, Artificial Sequence
  RNA Oligomer
gagagacccucauucaaaaucca

SEQ ID NO: 41281 - RNA, 23 nt, Artificial Sequence
  RNA Oligomer
agagacccucauucaaaauccag

SEQ ID NO: 41282 - RNA, 23 nt, Artificial Sequence
  RNA Oligomer
gagacccucauucaaaauccagc

SEQ ID NO: 41283 - RNA, 23 nt, Artificial Sequence
  RNA Oligomer
agacccucauucaaaauccagca

SEQ ID NO: 41284 - RNA, 23 nt, Artificial Sequence
  RNA Oligomer
agaaauacaccuugcucagcuuc

SEQ ID NO: 41285 - RNA, 23 nt, Artificial Sequence
  RNA Oligomer
gaaauacaccuugcucagcuuca

SEQ ID NO: 41286 - RNA, 23 nt, Artificial Sequence
  RNA Oligomer
aaauacaccuugcucagcuucag

SEQ ID NO: 41287 - RNA, 23 nt, Artificial Sequence
  RNA Oligomer
caacuucuuguugaaaucgccag

SEQ ID NO: 41288 - RNA, 23 nt, Artificial Sequence
  RNA Oligomer
aacuucuuguugaaaucgccaga

SEQ ID NO: 41289 - RNA, 23 nt, Artificial Sequence
  RNA Oligomer
acuucuuguugaaaucgccagaa

SEQ ID NO: 41290 - RNA, 23 nt, Artificial Sequence
  RNA Oligomer
cuucuuguugaaaucgccagaac

SEQ ID NO: 41291 - RNA, 23 nt, Artificial Sequence
  RNA Oligomer
uucuuguugaaaucgccagaacc

SEQ ID NO: 41292 - RNA, 23 nt, Artificial Sequence
  RNA Oligomer
ggguuuggccucgaacaauccga

SEQ ID NO: 41293 - RNA, 23 nt, Artificial Sequence
  RNA Oligomer
gguuuggccucgaacaauccgac

SEQ ID NO: 41294 - RNA, 23 nt, Artificial Sequence
  RNA Oligomer
guuuggccucgaacaauccgacc

SEQ ID NO: 41295 - RNA, 23 nt, Artificial Sequence
  RNA Oligomer
uuuggccucgaacaauccgaccc

SEQ ID NO: 41296 - RNA, 23 nt, Artificial Sequence
  RNA Oligomer
uuggccucgaacaauccgacccg

SEQ ID NO: 41297 - RNA, 23 nt, Artificial Sequence
  RNA Oligomer
aggaaauuucuucucccucaccu

SEQ ID NO: 41298 - RNA, 23 nt, Artificial Sequence
  RNA Oligomer
ggaaauuucuucucccucaccug

SEQ ID NO: 41299 - RNA, 23 nt, Artificial Sequence
  RNA Oligomer
gaaauuucuucucccucaccugu

SEQ ID NO: 41300 - RNA, 23 nt, Artificial Sequence
  RNA Oligomer
aaauuucuucucccucaccugug

SEQ ID NO: 41301 - RNA, 23 nt, Artificial Sequence
  RNA Oligomer
aauuucuucucccucaccugugu

SEQ ID NO: 41302 - RNA, 23 nt, Artificial Sequence
  RNA Oligomer
uccagguugaagaaaugcgccac

SEQ ID NO: 41303 - RNA, 23 nt, Artificial Sequence
  RNA Oligomer
gacagguauuagaauuagcaugc

SEQ ID NO: 41304 - RNA, 23 nt, Artificial Sequence
  RNA Oligomer
acagguauuagaauuagcaugca

SEQ ID NO: 41305 - RNA, 23 nt, Artificial Sequence
  RNA Oligomer
gcaguuaaaauucaggcacagug

SEQ ID NO: 41306 - RNA, 23 nt, Artificial Sequence
  RNA Oligomer
uccucuucauaccaguagaacgu

SEQ ID NO: 41307 - RNA, 23 nt, Artificial Sequence
  RNA Oligomer
ccucuucauaccaguagaacgug

SEQ ID NO: 41308 - RNA, 23 nt, Artificial Sequence
  RNA Oligomer
cucuucauaccaguagaacgugu

SEQ ID NO: 41309 - RNA, 23 nt, Artificial Sequence
  RNA Oligomer
ucuucauaccaguagaacguguc

SEQ ID NO: 41310 - RNA, 23 nt, Artificial Sequence
  RNA Oligomer
cuucauaccaguagaacguguca

SEQ ID NO: 41311 - RNA, 23 nt, Artificial Sequence
  RNA Oligomer
uucauaccaguagaacgugucaa

SEQ ID NO: 41312 - RNA, 23 nt, Artificial Sequence
  RNA Oligomer
guuuuuguucuguuguauaugac

SEQ ID NO: 41313 - RNA, 23 nt, Artificial Sequence
  RNA Oligomer
uuuuuguucuguuguauaugaca

SEQ ID NO: 41314 - RNA, 23 nt, Artificial Sequence
  RNA Oligomer
uuuuguucuguuguauaugacau

SEQ ID NO: 41315 - RNA, 23 nt, Artificial Sequence
  RNA Oligomer
uuuguucuguuguauaugacaug

SEQ ID NO: 41316 - RNA, 23 nt, Artificial Sequence
  RNA Oligomer
uuguucuguuguauaugacaugu

SEQ ID NO: 41317 - RNA, 23 nt, Artificial Sequence
  RNA Oligomer
aaauuuauucccagccaugagag

SEQ ID NO: 41318 - RNA, 23 nt, Artificial Sequence
  RNA Oligomer
aauuuauucccagccaugagagu

SEQ ID NO: 41319 - RNA, 23 nt, Artificial Sequence
  RNA Oligomer
cuugauugaaaacacaaugccug

SEQ ID NO: 41320 - RNA, 23 nt, Artificial Sequence
  RNA Oligomer
gaccuccaaagucuagaagcucu

SEQ ID NO: 41321 - RNA, 23 nt, Artificial Sequence
  RNA Oligomer
accuccaaagucuagaagcucuc

SEQ ID NO: 41322 - RNA, 23 nt, Artificial Sequence
  RNA Oligomer
ccuccaaagucuagaagcucucc

SEQ ID NO: 41323 - RNA, 23 nt, Artificial Sequence
  RNA Oligomer
aucacgucaguauuuucguccca

SEQ ID NO: 41324 - RNA, 23 nt, Artificial Sequence
  RNA Oligomer
ucacgucaguauuuucgucccag

SEQ ID NO: 41325 - RNA, 23 nt, Artificial Sequence
  RNA Oligomer
cacgucaguauuuucgucccagu

SEQ ID NO: 41326 - RNA, 23 nt, Artificial Sequence
  RNA Oligomer
cauuuguaccauauagauuucag

SEQ ID NO: 41327 - RNA, 23 nt, Artificial Sequence
  RNA Oligomer
auuuguaccauauagauuucaga

SEQ ID NO: 41328 - RNA, 23 nt, Artificial Sequence
  RNA Oligomer
uuuguaccauauagauuucagaa

SEQ ID NO: 41329 - RNA, 23 nt, Artificial Sequence
  RNA Oligomer
uuguaccauauagauuucagaag

SEQ ID NO: 41330 - RNA, 23 nt, Artificial Sequence
  RNA Oligomer
uguaccauauagauuucagaaga

SEQ ID NO: 41331 - RNA, 23 nt, Artificial Sequence
  RNA Oligomer
ugaaaucgccagaaccuaauuau

SEQ ID NO: 41332 - RNA, 23 nt, Artificial Sequence
  RNA Oligomer
gaaaucgccagaaccuaauuauu

SEQ ID NO: 41333 - RNA, 23 nt, Artificial Sequence
  RNA Oligomer
aaaucgccagaaccuaauuauuc

SEQ ID NO: 41334 - RNA, 23 nt, Artificial Sequence
  RNA Oligomer
aaucgccagaaccuaauuauucu

SEQ ID NO: 41335 - RNA, 23 nt, Artificial Sequence
  RNA Oligomer
aucgccagaaccuaauuauucuu

SEQ ID NO: 41336 - RNA, 23 nt, Artificial Sequence
  RNA Oligomer
auucuuucacaugcauacaagac

SEQ ID NO: 41337 - RNA, 23 nt, Artificial Sequence
  RNA Oligomer
uugccagaaaauugaggcacggg

SEQ ID NO: 41338 - RNA, 23 nt, Artificial Sequence
  RNA Oligomer
ugccagaaaauugaggcacgggg

SEQ ID NO: 41339 - RNA, 23 nt, Artificial Sequence
  RNA Oligomer
gccagaaaauugaggcacggggc

SEQ ID NO: 41340 - RNA, 23 nt, Artificial Sequence
  RNA Oligomer
ccagaaaauugaggcacggggca

SEQ ID NO: 41341 - RNA, 23 nt, Artificial Sequence
  RNA Oligomer
cagaaaauugaggcacggggcau

SEQ ID NO: 41342 - RNA, 23 nt, Artificial Sequence
  RNA Oligomer
ucuacagaaggugauguugugca

SEQ ID NO: 41343 - RNA, 23 nt, Artificial Sequence
  RNA Oligomer
cuacagaaggugauguugugcag

SEQ ID NO: 41344 - RNA, 23 nt, Artificial Sequence
  RNA Oligomer
uacagaaggugauguugugcaga

SEQ ID NO: 41345 - RNA, 23 nt, Artificial Sequence
  RNA Oligomer
acagaaggugauguugugcagag

SEQ ID NO: 41346 - RNA, 23 nt, Artificial Sequence
  RNA Oligomer
cagaaggugauguugugcagaga

SEQ ID NO: 41347 - RNA, 23 nt, Artificial Sequence
  RNA Oligomer
agaaggugauguugugcagagag

SEQ ID NO: 41348 - RNA, 23 nt, Artificial Sequence
  RNA Oligomer
gaaggugauguugugcagagaga

SEQ ID NO: 41349 - RNA, 23 nt, Artificial Sequence
  RNA Oligomer
aaggugauguugugcagagagag

SEQ ID NO: 41350 - RNA, 23 nt, Artificial Sequence
  RNA Oligomer
cucuucggcugucaggaaauuuc

SEQ ID NO: 41351 - RNA, 23 nt, Artificial Sequence
  RNA Oligomer
ucuucggcugucaggaaauuucu

SEQ ID NO: 41352 - RNA, 23 nt, Artificial Sequence
  RNA Oligomer
cuucggcugucaggaaauuucuu

SEQ ID NO: 41353 - RNA, 23 nt, Artificial Sequence
  RNA Oligomer
uucggcugucaggaaauuucuuc

SEQ ID NO: 41354 - RNA, 23 nt, Artificial Sequence
  RNA Oligomer
ucggcugucaggaaauuucuucu

SEQ ID NO: 41355 - RNA, 23 nt, Artificial Sequence
  RNA Oligomer
ggugauguugugcagagagagac

SEQ ID NO: 41356 - RNA, 23 nt, Artificial Sequence
  RNA Oligomer
gugauguugugcagagagagacu

SEQ ID NO: 41357 - RNA, 23 nt, Artificial Sequence
  RNA Oligomer
ugauguugugcagagagagacug

SEQ ID NO: 41358 - RNA, 23 nt, Artificial Sequence
  RNA Oligomer
gauguugugcagagagagacugu

SEQ ID NO: 41359 - RNA, 23 nt, Artificial Sequence
  RNA Oligomer
auguugugcagagagagacuguc

SEQ ID NO: 41360 - RNA, 23 nt, Artificial Sequence
  RNA Oligomer
agacgaugaaaacauggugugug

SEQ ID NO: 41361 - RNA, 23 nt, Artificial Sequence
  RNA Oligomer
gacgaugaaaacauggugugugu

SEQ ID NO: 41362 - RNA, 23 nt, Artificial Sequence
  RNA Oligomer
acgaugaaaacauggugugugua

SEQ ID NO: 41363 - RNA, 23 nt, Artificial Sequence
  RNA Oligomer
cgaugaaaacaugguguguguac

SEQ ID NO: 41364 - RNA, 23 nt, Artificial Sequence
  RNA Oligomer
gaugaaaacaugguguguguacc

SEQ ID NO: 41365 - RNA, 23 nt, Artificial Sequence
  RNA Oligomer
uccuuagcaauucagugguugug

SEQ ID NO: 41366 - RNA, 23 nt, Artificial Sequence
  RNA Oligomer
cagguugaagaaaugcgccacga

SEQ ID NO: 41367 - RNA, 23 nt, Artificial Sequence
  RNA Oligomer
agguugaagaaaugcgccacgau

SEQ ID NO: 41368 - RNA, 23 nt, Artificial Sequence
  RNA Oligomer
gguugaagaaaugcgccacgaug

SEQ ID NO: 41369 - RNA, 23 nt, Artificial Sequence
  RNA Oligomer
guugaagaaaugcgccacgaugu

SEQ ID NO: 41370 - RNA, 23 nt, Artificial Sequence
  RNA Oligomer
uugaagaaaugcgccacgaugug

SEQ ID NO: 41371 - RNA, 23 nt, Artificial Sequence
  RNA Oligomer
ugagguuuuugucuaauugccuc

SEQ ID NO: 41372 - RNA, 23 nt, Artificial Sequence
  RNA Oligomer
agcaaauacuuguuccucuuaug

SEQ ID NO: 41373 - RNA, 23 nt, Artificial Sequence
  RNA Oligomer
acuccuccucuucauaccaguag

SEQ ID NO: 41374 - RNA, 23 nt, Artificial Sequence
  RNA Oligomer
cuccuccucuucauaccaguaga

SEQ ID NO: 41375 - RNA, 23 nt, Artificial Sequence
  RNA Oligomer
uccuccucuucauaccaguagaa

SEQ ID NO: 41376 - RNA, 23 nt, Artificial Sequence
  RNA Oligomer
ccuccucuucauaccaguagaac

SEQ ID NO: 41377 - RNA, 23 nt, Artificial Sequence
  RNA Oligomer
cuccucuucauaccaguagaacg

SEQ ID NO: 41378 - RNA, 23 nt, Artificial Sequence
  RNA Oligomer
ucauaccaguagaacgugucaau

SEQ ID NO: 41379 - RNA, 23 nt, Artificial Sequence
  RNA Oligomer
uauuuauaagcuaaggaaguaug

SEQ ID NO: 41380 - RNA, 23 nt, Artificial Sequence
  RNA Oligomer
guuaauuauuauucaccaguucc

SEQ ID NO: 41381 - RNA, 23 nt, Artificial Sequence
  RNA Oligomer
auuuauucccagccaugagagua

SEQ ID NO: 41382 - RNA, 23 nt, Artificial Sequence
  RNA Oligomer
uuuauucccagccaugagaguac

SEQ ID NO: 41383 - RNA, 23 nt, Artificial Sequence
  RNA Oligomer
ggucagcugaugaauacaagugg

SEQ ID NO: 41384 - RNA, 23 nt, Artificial Sequence
  RNA Oligomer
gucagcugaugaauacaaguggc

SEQ ID NO: 41385 - RNA, 23 nt, Artificial Sequence
  RNA Oligomer
ucagcugaugaauacaaguggca

SEQ ID NO: 41386 - RNA, 23 nt, Artificial Sequence
  RNA Oligomer
cagcugaugaauacaaguggcac

SEQ ID NO: 41387 - RNA, 23 nt, Artificial Sequence
  RNA Oligomer
agcugaugaauacaaguggcaca

SEQ ID NO: 41388 - RNA, 23 nt, Artificial Sequence
  RNA Oligomer
augagaguacuaauaugguggag

SEQ ID NO: 41389 - RNA, 23 nt, Artificial Sequence
  RNA Oligomer
aagccuguaaucacgucaguauu

SEQ ID NO: 41390 - RNA, 23 nt, Artificial Sequence
  RNA Oligomer
guauuuucgucccaguguaaagc

SEQ ID NO: 41391 - RNA, 23 nt, Artificial Sequence
  RNA Oligomer
uauuuucgucccaguguaaagcu

SEQ ID NO: 41392 - RNA, 23 nt, Artificial Sequence
  RNA Oligomer
auuuucgucccaguguaaagcua

SEQ ID NO: 41393 - RNA, 23 nt, Artificial Sequence
  RNA Oligomer
uuuucgucccaguguaaagcuau

SEQ ID NO: 41394 - RNA, 23 nt, Artificial Sequence
  RNA Oligomer
uuucgucccaguguaaagcuaug

SEQ ID NO: 41395 - RNA, 23 nt, Artificial Sequence
  RNA Oligomer
cacucaaaagcucuugcaucccg

SEQ ID NO: 41396 - RNA, 23 nt, Artificial Sequence
  RNA Oligomer
acucaaaagcucuugcaucccgg

SEQ ID NO: 41397 - RNA, 23 nt, Artificial Sequence
  RNA Oligomer
cucaaaagcucuugcaucccggc

SEQ ID NO: 41398 - RNA, 23 nt, Artificial Sequence
  RNA Oligomer
ucaaaagcucuugcaucccggca

SEQ ID NO: 41399 - RNA, 23 nt, Artificial Sequence
  RNA Oligomer
caaaagcucuugcaucccggcaa

SEQ ID NO: 41400 - RNA, 23 nt, Artificial Sequence
  RNA Oligomer
guaccauauagauuucagaagag

SEQ ID NO: 41401 - RNA, 23 nt, Artificial Sequence
  RNA Oligomer
cggcugucaggaaauuucuucuc

SEQ ID NO: 41402 - RNA, 23 nt, Artificial Sequence
  RNA Oligomer
ggcugucaggaaauuucuucucc

SEQ ID NO: 41403 - RNA, 23 nt, Artificial Sequence
  RNA Oligomer
gcugucaggaaauuucuucuccc

SEQ ID NO: 41404 - RNA, 23 nt, Artificial Sequence
  RNA Oligomer
accagaacaacucauaggaggcc

SEQ ID NO: 41405 - RNA, 23 nt, Artificial Sequence
  RNA Oligomer
ucaagacuaaagccagagagauc

SEQ ID NO: 41406 - RNA, 23 nt, Artificial Sequence
  RNA Oligomer
caagacuaaagccagagagauca

SEQ ID NO: 41407 - RNA, 23 nt, Artificial Sequence
  RNA Oligomer
aagacuaaagccagagagaucac

SEQ ID NO: 41408 - RNA, 23 nt, Artificial Sequence
  RNA Oligomer
uucagugguuguguuugugggga

SEQ ID NO: 41409 - RNA, 23 nt, Artificial Sequence
  RNA Oligomer
ucagugguuguguuuguggggaa

SEQ ID NO: 41410 - RNA, 23 nt, Artificial Sequence
  RNA Oligomer
cagugguuguguuuguggggaag

SEQ ID NO: 41411 - RNA, 23 nt, Artificial Sequence
  RNA Oligomer
guuugugaaaucugagguuuuug

SEQ ID NO: 41412 - RNA, 23 nt, Artificial Sequence
  RNA Oligomer
uuugugaaaucugagguuuuugu

SEQ ID NO: 41413 - RNA, 23 nt, Artificial Sequence
  RNA Oligomer
aaucugagguuuuugucuaauug

SEQ ID NO: 41414 - RNA, 23 nt, Artificial Sequence
  RNA Oligomer
aucugagguuuuugucuaauugc

SEQ ID NO: 41415 - RNA, 23 nt, Artificial Sequence
  RNA Oligomer
aaugaaauaagguuucgacugac

SEQ ID NO: 41416 - RNA, 23 nt, Artificial Sequence
  RNA Oligomer
augaaauaagguuucgacugaca

SEQ ID NO: 41417 - RNA, 23 nt, Artificial Sequence
  RNA Oligomer
ugaaauaagguuucgacugacag

SEQ ID NO: 41418 - RNA, 23 nt, Artificial Sequence
  RNA Oligomer
gaaauaagguuucgacugacagg

SEQ ID NO: 41419 - RNA, 23 nt, Artificial Sequence
  RNA Oligomer
aaauaagguuucgacugacaggu

SEQ ID NO: 41420 - RNA, 23 nt, Artificial Sequence
  RNA Oligomer
cgacugacagguauuagaauuag

SEQ ID NO: 41421 - RNA, 23 nt, Artificial Sequence
  RNA Oligomer
gacugacagguauuagaauuagc

SEQ ID NO: 41422 - RNA, 23 nt, Artificial Sequence
  RNA Oligomer
acugacagguauuagaauuagca

SEQ ID NO: 41423 - RNA, 23 nt, Artificial Sequence
  RNA Oligomer
cugacagguauuagaauuagcau

SEQ ID NO: 41424 - RNA, 23 nt, Artificial Sequence
  RNA Oligomer
ugacagguauuagaauuagcaug

SEQ ID NO: 41425 - RNA, 23 nt, Artificial Sequence
  RNA Oligomer
uuagcaugcaguuaaaauucagg

SEQ ID NO: 41426 - RNA, 23 nt, Artificial Sequence
  RNA Oligomer
cauaccaguagaacgugucaaua

SEQ ID NO: 41427 - RNA, 23 nt, Artificial Sequence
  RNA Oligomer
auaccaguagaacgugucaauaa

SEQ ID NO: 41428 - RNA, 23 nt, Artificial Sequence
  RNA Oligomer
agaaaugaacaccucugggguca

SEQ ID NO: 41429 - RNA, 23 nt, Artificial Sequence
  RNA Oligomer
ugagaguacuaauaugguggaga

SEQ ID NO: 41430 - RNA, 23 nt, Artificial Sequence
  RNA Oligomer
acgucaguauuuucgucccagug

SEQ ID NO: 41431 - RNA, 23 nt, Artificial Sequence
  RNA Oligomer
ggagaguaagagaucagcaaacc

SEQ ID NO: 41432 - RNA, 23 nt, Artificial Sequence
  RNA Oligomer
gagaguaagagaucagcaaacca

SEQ ID NO: 41433 - RNA, 23 nt, Artificial Sequence
  RNA Oligomer
agaguaagagaucagcaaaccac

SEQ ID NO: 41434 - RNA, 23 nt, Artificial Sequence
  RNA Oligomer
gaguaagagaucagcaaaccacu

SEQ ID NO: 41435 - RNA, 23 nt, Artificial Sequence
  RNA Oligomer
aguaagagaucagcaaaccacuc

SEQ ID NO: 41436 - RNA, 23 nt, Artificial Sequence
  RNA Oligomer
cccucauucaaaauccagcaccc

SEQ ID NO: 41437 - RNA, 23 nt, Artificial Sequence
  RNA Oligomer
ccucauucaaaauccagcacccc

SEQ ID NO: 41438 - RNA, 23 nt, Artificial Sequence
  RNA Oligomer
cucauucaaaauccagcacccca

SEQ ID NO: 41439 - RNA, 23 nt, Artificial Sequence
  RNA Oligomer
ucauucaaaauccagcaccccau

SEQ ID NO: 41440 - RNA, 23 nt, Artificial Sequence
  RNA Oligomer
cauucaaaauccagcaccccauc

SEQ ID NO: 41441 - RNA, 23 nt, Artificial Sequence
  RNA Oligomer
cuggcgccauuuuaaagccacgc

SEQ ID NO: 41442 - RNA, 23 nt, Artificial Sequence
  RNA Oligomer
uggcgccauuuuaaagccacgcu

SEQ ID NO: 41443 - RNA, 23 nt, Artificial Sequence
  RNA Oligomer
ggcgccauuuuaaagccacgcuu

SEQ ID NO: 41444 - RNA, 23 nt, Artificial Sequence
  RNA Oligomer
gcgccauuuuaaagccacgcuuu

SEQ ID NO: 41445 - RNA, 23 nt, Artificial Sequence
  RNA Oligomer
cgccauuuuaaagccacgcuuuu

SEQ ID NO: 41446 - RNA, 23 nt, Artificial Sequence
  RNA Oligomer
uugaaaucgccagaaccuaauua

SEQ ID NO: 41447 - RNA, 23 nt, Artificial Sequence
  RNA Oligomer
ucacaugcauacaagaccacagg

SEQ ID NO: 41448 - RNA, 23 nt, Artificial Sequence
  RNA Oligomer
cacaugcauacaagaccacaggg

SEQ ID NO: 41449 - RNA, 23 nt, Artificial Sequence
  RNA Oligomer
acaugcauacaagaccacagggc

SEQ ID NO: 41450 - RNA, 23 nt, Artificial Sequence
  RNA Oligomer
caugcauacaagaccacagggcc

SEQ ID NO: 41451 - RNA, 23 nt, Artificial Sequence
  RNA Oligomer
augcauacaagaccacagggccu

SEQ ID NO: 41452 - RNA, 23 nt, Artificial Sequence
  RNA Oligomer
gcggucucuacagaaggugaugu

SEQ ID NO: 41453 - RNA, 23 nt, Artificial Sequence
  RNA Oligomer
cggucucuacagaaggugauguu

SEQ ID NO: 41454 - RNA, 23 nt, Artificial Sequence
  RNA Oligomer
ggucucuacagaaggugauguug

SEQ ID NO: 41455 - RNA, 23 nt, Artificial Sequence
  RNA Oligomer
gucucuacagaaggugauguugu

SEQ ID NO: 41456 - RNA, 23 nt, Artificial Sequence
  RNA Oligomer
ucucuacagaaggugauguugug

SEQ ID NO: 41457 - RNA, 23 nt, Artificial Sequence
  RNA Oligomer
aaagccagagagaucaccagacc

SEQ ID NO: 41458 - RNA, 23 nt, Artificial Sequence
  RNA Oligomer
aagccagagagaucaccagaccg

SEQ ID NO: 41459 - RNA, 23 nt, Artificial Sequence
  RNA Oligomer
uagcaauucagugguuguguuug

SEQ ID NO: 41460 - RNA, 23 nt, Artificial Sequence
  RNA Oligomer
uuucuucucccucaccugugucu

SEQ ID NO: 41461 - RNA, 23 nt, Artificial Sequence
  RNA Oligomer
uucuucucccucaccugugucug

SEQ ID NO: 41462 - RNA, 23 nt, Artificial Sequence
  RNA Oligomer
ucuucucccucaccugugucugg

SEQ ID NO: 41463 - RNA, 23 nt, Artificial Sequence
  RNA Oligomer
cuucucccucaccugugucugga

SEQ ID NO: 41464 - RNA, 23 nt, Artificial Sequence
  RNA Oligomer
uucucccucaccugugucuggau

SEQ ID NO: 41465 - RNA, 23 nt, Artificial Sequence
  RNA Oligomer
ccagguugaagaaaugcgccacg

SEQ ID NO: 41466 - RNA, 23 nt, Artificial Sequence
  RNA Oligomer
ucugagguuuuugucuaauugcc

SEQ ID NO: 41467 - RNA, 23 nt, Artificial Sequence
  RNA Oligomer
cugagguuuuugucuaauugccu

SEQ ID NO: 41468 - RNA, 23 nt, Artificial Sequence
  RNA Oligomer
auuagaauuagcaugcaguuaaa

SEQ ID NO: 41469 - RNA, 23 nt, Artificial Sequence
  RNA Oligomer
ugcaguuaaaauucaggcacagu

SEQ ID NO: 41470 - RNA, 23 nt, Artificial Sequence
  RNA Oligomer
uauuauucaccaguucccaacug

SEQ ID NO: 41471 - RNA, 23 nt, Artificial Sequence
  RNA Oligomer
auuauucaccaguucccaacugg

SEQ ID NO: 41472 - RNA, 23 nt, Artificial Sequence
  RNA Oligomer
uuauucaccaguucccaacuggg

SEQ ID NO: 41473 - RNA, 23 nt, Artificial Sequence
  RNA Oligomer
ugaaaacacaaugccuggacuug

SEQ ID NO: 41474 - RNA, 23 nt, Artificial Sequence
  RNA Oligomer
gaaaacacaaugccuggacuuga

SEQ ID NO: 41475 - RNA, 23 nt, Artificial Sequence
  RNA Oligomer
aagucuagaagcucuccuuguug

SEQ ID NO: 41476 - RNA, 23 nt, Artificial Sequence
  RNA Oligomer
gcucacucauccguguuuccagg

SEQ ID NO: 41477 - RNA, 23 nt, Artificial Sequence
  RNA Oligomer
cucacucauccguguuuccaggg

SEQ ID NO: 41478 - RNA, 23 nt, Artificial Sequence
  RNA Oligomer
ucacucauccguguuuccaggga

SEQ ID NO: 41479 - RNA, 23 nt, Artificial Sequence
  RNA Oligomer
cacucauccguguuuccagggag

SEQ ID NO: 41480 - RNA, 23 nt, Artificial Sequence
  RNA Oligomer
acucauccguguuuccagggaga

SEQ ID NO: 41481 - RNA, 23 nt, Artificial Sequence
  RNA Oligomer
acccucauucaaaauccagcacc

SEQ ID NO: 41482 - RNA, 23 nt, Artificial Sequence
  RNA Oligomer
gaaauacaucugucagggcaguu

SEQ ID NO: 41483 - RNA, 23 nt, Artificial Sequence
  RNA Oligomer
ucuuguugaaaucgccagaaccu

SEQ ID NO: 41484 - RNA, 23 nt, Artificial Sequence
  RNA Oligomer
cuuguugaaaucgccagaaccua

SEQ ID NO: 41485 - RNA, 23 nt, Artificial Sequence
  RNA Oligomer
uuguugaaaucgccagaaccuaa

SEQ ID NO: 41486 - RNA, 23 nt, Artificial Sequence
  RNA Oligomer
aaauccauuuccaagccgagggu

SEQ ID NO: 41487 - RNA, 23 nt, Artificial Sequence
  RNA Oligomer
caggaaauuucuucucccucacc

SEQ ID NO: 41488 - RNA, 23 nt, Artificial Sequence
  RNA Oligomer
auuucuucucccucaccuguguc

SEQ ID NO: 41489 - RNA, 23 nt, Artificial Sequence
  RNA Oligomer
ugaagaaaugcgccacgaugugg

SEQ ID NO: 41490 - RNA, 23 nt, Artificial Sequence
  RNA Oligomer
gaagaaaugcgccacgaugugga

SEQ ID NO: 41491 - RNA, 23 nt, Artificial Sequence
  RNA Oligomer
aagaaaugcgccacgauguggau

SEQ ID NO: 41492 - RNA, 23 nt, Artificial Sequence
  RNA Oligomer
caccugugucuggauguuggguc

SEQ ID NO: 41493 - RNA, 23 nt, Artificial Sequence
  RNA Oligomer
accugugucuggauguugggucg

SEQ ID NO: 41494 - RNA, 23 nt, Artificial Sequence
  RNA Oligomer
ccugugucuggauguugggucgu

SEQ ID NO: 41495 - RNA, 23 nt, Artificial Sequence
  RNA Oligomer
cugugucuggauguugggucguu

SEQ ID NO: 41496 - RNA, 23 nt, Artificial Sequence
  RNA Oligomer
ugugucuggauguugggucguua

SEQ ID NO: 41497 - RNA, 23 nt, Artificial Sequence
  RNA Oligomer
aauuagcaugcaguuaaaauuca

SEQ ID NO: 41498 - RNA, 23 nt, Artificial Sequence
  RNA Oligomer
auuagcaugcaguuaaaauucag

SEQ ID NO: 41499 - RNA, 23 nt, Artificial Sequence
  RNA Oligomer
caguguugaacccaaaauaacuc

SEQ ID NO: 41500 - RNA, 23 nt, Artificial Sequence
  RNA Oligomer
acccaaaauaacucguguguaau

SEQ ID NO: 41501 - RNA, 23 nt, Artificial Sequence
  RNA Oligomer
gcuuuagguccacagaagaacac

SEQ ID NO: 41502 - RNA, 23 nt, Artificial Sequence
  RNA Oligomer
cuuuagguccacagaagaacacg

SEQ ID NO: 41503 - RNA, 23 nt, Artificial Sequence
  RNA Oligomer
uuuagguccacagaagaacacgc

SEQ ID NO: 41504 - RNA, 23 nt, Artificial Sequence
  RNA Oligomer
uuagguccacagaagaacacgcc

SEQ ID NO: 41505 - RNA, 23 nt, Artificial Sequence
  RNA Oligomer
uagguccacagaagaacacgcca

SEQ ID NO: 41506 - RNA, 23 nt, Artificial Sequence
  RNA Oligomer
uccacagaagaacacgccaauac

SEQ ID NO: 41507 - RNA, 23 nt, Artificial Sequence
  RNA Oligomer
ccacagaagaacacgccaauacu

SEQ ID NO: 41508 - RNA, 23 nt, Artificial Sequence
  RNA Oligomer
cacagaagaacacgccaauacug

SEQ ID NO: 41509 - RNA, 23 nt, Artificial Sequence
  RNA Oligomer
ccuguaaucacgucaguauuuuc

SEQ ID NO: 41510 - RNA, 23 nt, Artificial Sequence
  RNA Oligomer
uuccagggagaguaagagaucag

SEQ ID NO: 41511 - RNA, 23 nt, Artificial Sequence
  RNA Oligomer
uccagggagaguaagagaucagc

SEQ ID NO: 41512 - RNA, 23 nt, Artificial Sequence
  RNA Oligomer
ccagggagaguaagagaucagca

SEQ ID NO: 41513 - RNA, 23 nt, Artificial Sequence
  RNA Oligomer
cagggagaguaagagaucagcaa

SEQ ID NO: 41514 - RNA, 23 nt, Artificial Sequence
  RNA Oligomer
agggagaguaagagaucagcaaa

SEQ ID NO: 41515 - RNA, 23 nt, Artificial Sequence
  RNA Oligomer
agaucagcaaaccacucaaaagc

SEQ ID NO: 41516 - RNA, 23 nt, Artificial Sequence
  RNA Oligomer
gaucagcaaaccacucaaaagcu

SEQ ID NO: 41517 - RNA, 23 nt, Artificial Sequence
  RNA Oligomer
aucagcaaaccacucaaaagcuc

SEQ ID NO: 41518 - RNA, 23 nt, Artificial Sequence
  RNA Oligomer
ucagcaaaccacucaaaagcucu

SEQ ID NO: 41519 - RNA, 23 nt, Artificial Sequence
  RNA Oligomer
cagcaaaccacucaaaagcucuu

SEQ ID NO: 41520 - RNA, 23 nt, Artificial Sequence
  RNA Oligomer
ccacucaaaagcucuugcauccc

SEQ ID NO: 41521 - RNA, 23 nt, Artificial Sequence
  RNA Oligomer
uugcaucccggcaaauccaguag

SEQ ID NO: 41522 - RNA, 23 nt, Artificial Sequence
  RNA Oligomer
ugcaucccggcaaauccaguaga

SEQ ID NO: 41523 - RNA, 23 nt, Artificial Sequence
  RNA Oligomer
gcaucccggcaaauccaguagaa

SEQ ID NO: 41524 - RNA, 23 nt, Artificial Sequence
  RNA Oligomer
caucccggcaaauccaguagaaa

SEQ ID NO: 41525 - RNA, 23 nt, Artificial Sequence
  RNA Oligomer
aucccggcaaauccaguagaaau

SEQ ID NO: 41526 - RNA, 23 nt, Artificial Sequence
  RNA Oligomer
caccuugguaaugacaacuucuu

SEQ ID NO: 41527 - RNA, 23 nt, Artificial Sequence
  RNA Oligomer
accuugguaaugacaacuucuug

SEQ ID NO: 41528 - RNA, 23 nt, Artificial Sequence
  RNA Oligomer
ccuugguaaugacaacuucuugu

SEQ ID NO: 41529 - RNA, 23 nt, Artificial Sequence
  RNA Oligomer
cuugguaaugacaacuucuuguu

SEQ ID NO: 41530 - RNA, 23 nt, Artificial Sequence
  RNA Oligomer
uugguaaugacaacuucuuguug

SEQ ID NO: 41531 - RNA, 23 nt, Artificial Sequence
  RNA Oligomer
ccuuagcaauucagugguugugu

SEQ ID NO: 41532 - RNA, 23 nt, Artificial Sequence
  RNA Oligomer
cuuagcaauucagugguuguguu

SEQ ID NO: 41533 - RNA, 23 nt, Artificial Sequence
  RNA Oligomer
auggaaagacuccuccucuucau

SEQ ID NO: 41534 - RNA, 23 nt, Artificial Sequence
  RNA Oligomer
uggaaagacuccuccucuucaua

SEQ ID NO: 41535 - RNA, 23 nt, Artificial Sequence
  RNA Oligomer
ggaaagacuccuccucuucauac

SEQ ID NO: 41536 - RNA, 23 nt, Artificial Sequence
  RNA Oligomer
gaaagacuccuccucuucauacc

SEQ ID NO: 41537 - RNA, 23 nt, Artificial Sequence
  RNA Oligomer
aaagacuccuccucuucauacca

SEQ ID NO: 41538 - RNA, 23 nt, Artificial Sequence
  RNA Oligomer
aagacuccuccucuucauaccag

SEQ ID NO: 41539 - RNA, 23 nt, Artificial Sequence
  RNA Oligomer
agacuccuccucuucauaccagu

SEQ ID NO: 41540 - RNA, 23 nt, Artificial Sequence
  RNA Oligomer
gacuccuccucuucauaccagua

SEQ ID NO: 41541 - RNA, 23 nt, Artificial Sequence
  RNA Oligomer
uaccaguagaacgugucaauaaa

SEQ ID NO: 41542 - RNA, 23 nt, Artificial Sequence
  RNA Oligomer
ccaguagaacgugucaauaaaca

SEQ ID NO: 41543 - RNA, 23 nt, Artificial Sequence
  RNA Oligomer
caguagaacgugucaauaaacag

SEQ ID NO: 41544 - RNA, 23 nt, Artificial Sequence
  RNA Oligomer
aguagaacgugucaauaaacaga

SEQ ID NO: 41545 - RNA, 23 nt, Artificial Sequence
  RNA Oligomer
guagaacgugucaauaaacagau

SEQ ID NO: 41546 - RNA, 23 nt, Artificial Sequence
  RNA Oligomer
uagaacgugucaauaaacagaua

SEQ ID NO: 41547 - RNA, 23 nt, Artificial Sequence
  RNA Oligomer
ggagcucauaucaacaggccguc

SEQ ID NO: 41548 - RNA, 23 nt, Artificial Sequence
  RNA Oligomer
gagcucauaucaacaggccguca

SEQ ID NO: 41549 - RNA, 23 nt, Artificial Sequence
  RNA Oligomer
agcucauaucaacaggccgucac

SEQ ID NO: 41550 - RNA, 23 nt, Artificial Sequence
  RNA Oligomer
gcucauaucaacaggccgucaca

SEQ ID NO: 41551 - RNA, 23 nt, Artificial Sequence
  RNA Oligomer
cucauaucaacaggccgucacag

SEQ ID NO: 41552 - RNA, 23 nt, Artificial Sequence
  RNA Oligomer
ucauaucaacaggccgucacagg

SEQ ID NO: 41553 - RNA, 23 nt, Artificial Sequence
  RNA Oligomer
cauaucaacaggccgucacagga

SEQ ID NO: 41554 - RNA, 23 nt, Artificial Sequence
  RNA Oligomer
gaauacaaguggcacaucuuuug

SEQ ID NO: 41555 - RNA, 23 nt, Artificial Sequence
  RNA Oligomer
aauacaaguggcacaucuuuuga

SEQ ID NO: 41556 - RNA, 23 nt, Artificial Sequence
  RNA Oligomer
auacaaguggcacaucuuuugaa

SEQ ID NO: 41557 - RNA, 23 nt, Artificial Sequence
  RNA Oligomer
uacaaguggcacaucuuuugaag

SEQ ID NO: 41558 - RNA, 23 nt, Artificial Sequence
  RNA Oligomer
acaaguggcacaucuuuugaagu

SEQ ID NO: 41559 - RNA, 23 nt, Artificial Sequence
  RNA Oligomer
caaguggcacaucuuuugaagug

SEQ ID NO: 41560 - RNA, 23 nt, Artificial Sequence
  RNA Oligomer
aaguggcacaucuuuugaagugu

SEQ ID NO: 41561 - RNA, 23 nt, Artificial Sequence
  RNA Oligomer
gagcuuuagguccacagaagaac

SEQ ID NO: 41562 - RNA, 23 nt, Artificial Sequence
  RNA Oligomer
agcuuuagguccacagaagaaca

SEQ ID NO: 41563 - RNA, 23 nt, Artificial Sequence
  RNA Oligomer
uucgucccaguguaaagcuaugu

SEQ ID NO: 41564 - RNA, 23 nt, Artificial Sequence
  RNA Oligomer
cugcccuggcgccauuuuaaagc

SEQ ID NO: 41565 - RNA, 23 nt, Artificial Sequence
  RNA Oligomer
ugcccuggcgccauuuuaaagcc

SEQ ID NO: 41566 - RNA, 23 nt, Artificial Sequence
  RNA Oligomer
gcccuggcgccauuuuaaagcca

SEQ ID NO: 41567 - RNA, 23 nt, Artificial Sequence
  RNA Oligomer
cccuggcgccauuuuaaagccac

SEQ ID NO: 41568 - RNA, 23 nt, Artificial Sequence
  RNA Oligomer
ccuggcgccauuuuaaagccacg

SEQ ID NO: 41569 - RNA, 23 nt, Artificial Sequence
  RNA Oligomer
ugguaaugacaacuucuuguuga

SEQ ID NO: 41570 - RNA, 23 nt, Artificial Sequence
  RNA Oligomer
gguaaugacaacuucuuguugaa

SEQ ID NO: 41571 - RNA, 23 nt, Artificial Sequence
  RNA Oligomer
uggccaggcugagaaagaagacg

SEQ ID NO: 41572 - RNA, 23 nt, Artificial Sequence
  RNA Oligomer
caacugggagcucauaucaacag

SEQ ID NO: 41573 - RNA, 23 nt, Artificial Sequence
  RNA Oligomer
aacugggagcucauaucaacagg

SEQ ID NO: 41574 - RNA, 23 nt, Artificial Sequence
  RNA Oligomer
acugggagcucauaucaacaggc

SEQ ID NO: 41575 - RNA, 23 nt, Artificial Sequence
  RNA Oligomer
cugggagcucauaucaacaggcc

SEQ ID NO: 41576 - RNA, 23 nt, Artificial Sequence
  RNA Oligomer
ugggagcucauaucaacaggccg

SEQ ID NO: 41577 - RNA, 23 nt, Artificial Sequence
  RNA Oligomer
gggagcucauaucaacaggccgu

SEQ ID NO: 41578 - RNA, 23 nt, Artificial Sequence
  RNA Oligomer
aaaacacaaugccuggacuugac

SEQ ID NO: 41579 - RNA, 23 nt, Artificial Sequence
  RNA Oligomer
uuuccagggagaguaagagauca

SEQ ID NO: 41580 - RNA, 23 nt, Artificial Sequence
  RNA Oligomer
aauacaccuugcucagcuucagu

SEQ ID NO: 41581 - RNA, 23 nt, Artificial Sequence
  RNA Oligomer
auacaccuugcucagcuucagug

SEQ ID NO: 41582 - RNA, 23 nt, Artificial Sequence
  RNA Oligomer
gacccucauucaaaauccagcac

SEQ ID NO: 41583 - RNA, 23 nt, Artificial Sequence
  RNA Oligomer
aauccauuuccaagccgaggguu

SEQ ID NO: 41584 - RNA, 23 nt, Artificial Sequence
  RNA Oligomer
auccauuuccaagccgaggguuc

SEQ ID NO: 41585 - RNA, 23 nt, Artificial Sequence
  RNA Oligomer
cugcauagcggucucuacagaag

SEQ ID NO: 41586 - RNA, 23 nt, Artificial Sequence
  RNA Oligomer
ugcauagcggucucuacagaagg

SEQ ID NO: 41587 - RNA, 23 nt, Artificial Sequence
  RNA Oligomer
gcauagcggucucuacagaaggu

SEQ ID NO: 41588 - RNA, 23 nt, Artificial Sequence
  RNA Oligomer
cauagcggucucuacagaaggug

SEQ ID NO: 41589 - RNA, 23 nt, Artificial Sequence
  RNA Oligomer
auagcggucucuacagaagguga

SEQ ID NO: 41590 - RNA, 23 nt, Artificial Sequence
  RNA Oligomer
uagcggucucuacagaaggugau

SEQ ID NO: 41591 - RNA, 23 nt, Artificial Sequence
  RNA Oligomer
uguugugcagagagagacugucu

SEQ ID NO: 41592 - RNA, 23 nt, Artificial Sequence
  RNA Oligomer
guugugcagagagagacugucuu

SEQ ID NO: 41593 - RNA, 23 nt, Artificial Sequence
  RNA Oligomer
guguguaauggaaagacuccucc

SEQ ID NO: 41594 - RNA, 23 nt, Artificial Sequence
  RNA Oligomer
uguguaauggaaagacuccuccu

SEQ ID NO: 41595 - RNA, 23 nt, Artificial Sequence
  RNA Oligomer
guguaauggaaagacuccuccuc

SEQ ID NO: 41596 - RNA, 23 nt, Artificial Sequence
  RNA Oligomer
uguaauggaaagacuccuccucu

SEQ ID NO: 41597 - RNA, 23 nt, Artificial Sequence
  RNA Oligomer
guaauggaaagacuccuccucuu

SEQ ID NO: 41598 - RNA, 23 nt, Artificial Sequence
  RNA Oligomer
agaacgugucaauaaacagauaa

SEQ ID NO: 41599 - RNA, 23 nt, Artificial Sequence
  RNA Oligomer
gaacgugucaauaaacagauaaa

SEQ ID NO: 41600 - RNA, 23 nt, Artificial Sequence
  RNA Oligomer
aacgugucaauaaacagauaaaa

SEQ ID NO: 41601 - RNA, 23 nt, Artificial Sequence
  RNA Oligomer
aaacacaaugccuggacuugacc

SEQ ID NO: 41602 - RNA, 23 nt, Artificial Sequence
  RNA Oligomer
aacacaaugccuggacuugaccu

SEQ ID NO: 41603 - RNA, 23 nt, Artificial Sequence
  RNA Oligomer
acacaaugccuggacuugaccuc

SEQ ID NO: 41604 - RNA, 23 nt, Artificial Sequence
  RNA Oligomer
cacaaugccuggacuugaccucc

SEQ ID NO: 41605 - RNA, 23 nt, Artificial Sequence
  RNA Oligomer
gggucagcugaugaauacaagug

SEQ ID NO: 41606 - RNA, 23 nt, Artificial Sequence
  RNA Oligomer
gcugaugaauacaaguggcacau

SEQ ID NO: 41607 - RNA, 23 nt, Artificial Sequence
  RNA Oligomer
cugaugaauacaaguggcacauc

SEQ ID NO: 41608 - RNA, 23 nt, Artificial Sequence
  RNA Oligomer
uacaccuugcucagcuucagugg

SEQ ID NO: 41609 - RNA, 23 nt, Artificial Sequence
  RNA Oligomer
ggccuaaaauccauuuccaagcc

SEQ ID NO: 41610 - RNA, 23 nt, Artificial Sequence
  RNA Oligomer
aguucuuuggaaucaauaacuug

SEQ ID NO: 41611 - RNA, 23 nt, Artificial Sequence
  RNA Oligomer
guucuuuggaaucaauaacuuga

SEQ ID NO: 41612 - RNA, 23 nt, Artificial Sequence
  RNA Oligomer
uucuuuggaaucaauaacuugau

SEQ ID NO: 41613 - RNA, 23 nt, Artificial Sequence
  RNA Oligomer
ucuuuggaaucaauaacuugauu

SEQ ID NO: 41614 - RNA, 23 nt, Artificial Sequence
  RNA Oligomer
cuuuggaaucaauaacuugauug

SEQ ID NO: 41615 - RNA, 23 nt, Artificial Sequence
  RNA Oligomer
uaacuugauugaaaacacaaugc

SEQ ID NO: 41616 - RNA, 23 nt, Artificial Sequence
  RNA Oligomer
aacuugauugaaaacacaaugcc

SEQ ID NO: 41617 - RNA, 23 nt, Artificial Sequence
  RNA Oligomer
acuugauugaaaacacaaugccu

SEQ ID NO: 41618 - RNA, 23 nt, Artificial Sequence
  RNA Oligomer
ugaugaauacaaguggcacaucu

SEQ ID NO: 41619 - RNA, 23 nt, Artificial Sequence
  RNA Oligomer
gaugaauacaaguggcacaucuu

SEQ ID NO: 41620 - RNA, 23 nt, Artificial Sequence
  RNA Oligomer
augaauacaaguggcacaucuuu

SEQ ID NO: 41621 - RNA, 23 nt, Artificial Sequence
  RNA Oligomer
guaaagcuaugugaagagccuga

SEQ ID NO: 41622 - RNA, 23 nt, Artificial Sequence
  RNA Oligomer
uaaagcuaugugaagagccugau

SEQ ID NO: 41623 - RNA, 23 nt, Artificial Sequence
  RNA Oligomer
aaagcuaugugaagagccugauu

SEQ ID NO: 41624 - RNA, 23 nt, Artificial Sequence
  RNA Oligomer
acaccuugcucagcuucaguggg

SEQ ID NO: 41625 - RNA, 23 nt, Artificial Sequence
  RNA Oligomer
caccuugcucagcuucagugggg

SEQ ID NO: 41626 - RNA, 23 nt, Artificial Sequence
  RNA Oligomer
accuugcucagcuucaguggggu

SEQ ID NO: 41627 - RNA, 23 nt, Artificial Sequence
  RNA Oligomer
cugcaccaagauguacugcccug

SEQ ID NO: 41628 - RNA, 23 nt, Artificial Sequence
  RNA Oligomer
ugcaccaagauguacugcccugg

SEQ ID NO: 41629 - RNA, 23 nt, Artificial Sequence
  RNA Oligomer
gcaccaagauguacugcccuggc

SEQ ID NO: 41630 - RNA, 23 nt, Artificial Sequence
  RNA Oligomer
caccaagauguacugcccuggcg

SEQ ID NO: 41631 - RNA, 23 nt, Artificial Sequence
  RNA Oligomer
accaagauguacugcccuggcgc

SEQ ID NO: 41632 - RNA, 23 nt, Artificial Sequence
  RNA Oligomer
caagaccacagggccuaaaaucc

SEQ ID NO: 41633 - RNA, 23 nt, Artificial Sequence
  RNA Oligomer
aagaccacagggccuaaaaucca

SEQ ID NO: 41634 - RNA, 23 nt, Artificial Sequence
  RNA Oligomer
agaccacagggccuaaaauccau

SEQ ID NO: 41635 - RNA, 23 nt, Artificial Sequence
  RNA Oligomer
gaccacagggccuaaaauccauu

SEQ ID NO: 41636 - RNA, 23 nt, Artificial Sequence
  RNA Oligomer
accacagggccuaaaauccauuu

SEQ ID NO: 41637 - RNA, 23 nt, Artificial Sequence
  RNA Oligomer
cucuacagaaggugauguugugc

SEQ ID NO: 41638 - RNA, 23 nt, Artificial Sequence
  RNA Oligomer
guaagagaucagcaaaccacuca

SEQ ID NO: 41639 - RNA, 23 nt, Artificial Sequence
  RNA Oligomer
uaagagaucagcaaaccacucaa

SEQ ID NO: 41640 - RNA, 23 nt, Artificial Sequence
  RNA Oligomer
aaaagcucuugcaucccggcaaa

SEQ ID NO: 41641 - RNA, 23 nt, Artificial Sequence
  RNA Oligomer
ccauuuuaaagccacgcuuuuuc

SEQ ID NO: 41642 - RNA, 23 nt, Artificial Sequence
  RNA Oligomer
cauuuuaaagccacgcuuuuuca

SEQ ID NO: 41643 - RNA, 23 nt, Artificial Sequence
  RNA Oligomer
auuuuaaagccacgcuuuuucau

SEQ ID NO: 41644 - RNA, 23 nt, Artificial Sequence
  RNA Oligomer
uuuuaaagccacgcuuuuucaug

SEQ ID NO: 41645 - RNA, 23 nt, Artificial Sequence
  RNA Oligomer
uuuaaagccacgcuuuuucaugu

SEQ ID NO: 41646 - RNA, 23 nt, Artificial Sequence
  RNA Oligomer
acgcuuuuucaugugaaguucca

SEQ ID NO: 41647 - RNA, 23 nt, Artificial Sequence
  RNA Oligomer
cgcuuuuucaugugaaguuccag

SEQ ID NO: 41648 - RNA, 23 nt, Artificial Sequence
  RNA Oligomer
gcuuuuucaugugaaguuccagg

SEQ ID NO: 41649 - RNA, 23 nt, Artificial Sequence
  RNA Oligomer
ugcauacaagaccacagggccua

SEQ ID NO: 41650 - RNA, 23 nt, Artificial Sequence
  RNA Oligomer
auaacucguguguaauggaaaga

SEQ ID NO: 41651 - RNA, 23 nt, Artificial Sequence
  RNA Oligomer
uaacucguguguaauggaaagac

SEQ ID NO: 41652 - RNA, 23 nt, Artificial Sequence
  RNA Oligomer
cguguguaauggaaagacuccuc

SEQ ID NO: 41653 - RNA, 23 nt, Artificial Sequence
  RNA Oligomer
ugaauacaaguggcacaucuuuu

SEQ ID NO: 41654 - RNA, 23 nt, Artificial Sequence
  RNA Oligomer
acucauuguuccaguugggccuc

SEQ ID NO: 41655 - RNA, 23 nt, Artificial Sequence
  RNA Oligomer
cucauuguuccaguugggccucc

SEQ ID NO: 41656 - RNA, 23 nt, Artificial Sequence
  RNA Oligomer
ucauuguuccaguugggccuccc

SEQ ID NO: 41657 - RNA, 23 nt, Artificial Sequence
  RNA Oligomer
aaggucuucugcuuuaagccugu

SEQ ID NO: 41658 - RNA, 23 nt, Artificial Sequence
  RNA Oligomer
aggucuucugcuuuaagccugua

SEQ ID NO: 41659 - RNA, 23 nt, Artificial Sequence
  RNA Oligomer
ggucuucugcuuuaagccuguaa

SEQ ID NO: 41660 - RNA, 23 nt, Artificial Sequence
  RNA Oligomer
gucuucugcuuuaagccuguaau

SEQ ID NO: 41661 - RNA, 23 nt, Artificial Sequence
  RNA Oligomer
ucuucugcuuuaagccuguaauc

SEQ ID NO: 41662 - RNA, 23 nt, Artificial Sequence
  RNA Oligomer
ugacaacuucuuguugaaaucgc

SEQ ID NO: 41663 - RNA, 23 nt, Artificial Sequence
  RNA Oligomer
gacaacuucuuguugaaaucgcc

SEQ ID NO: 41664 - RNA, 23 nt, Artificial Sequence
  RNA Oligomer
acaacuucuuguugaaaucgcca

SEQ ID NO: 41665 - RNA, 23 nt, Artificial Sequence
  RNA Oligomer
augaaaacaugguguguguacca

SEQ ID NO: 41666 - RNA, 23 nt, Artificial Sequence
  RNA Oligomer
ugaaaacaugguguguguaccag

SEQ ID NO: 41667 - RNA, 23 nt, Artificial Sequence
  RNA Oligomer
gaaaacaugguguguguaccaga

SEQ ID NO: 41668 - RNA, 23 nt, Artificial Sequence
  RNA Oligomer
aaaacaugguguguguaccagaa

SEQ ID NO: 41669 - RNA, 23 nt, Artificial Sequence
  RNA Oligomer
cugcuugaacucauuguuccagu

SEQ ID NO: 41670 - RNA, 23 nt, Artificial Sequence
  RNA Oligomer
ugcuugaacucauuguuccaguu

SEQ ID NO: 41671 - RNA, 23 nt, Artificial Sequence
  RNA Oligomer
gcuugaacucauuguuccaguug

SEQ ID NO: 41672 - RNA, 23 nt, Artificial Sequence
  RNA Oligomer
gaaggucuucugcuuuaagccug

SEQ ID NO: 41673 - RNA, 23 nt, Artificial Sequence
  RNA Oligomer
acuaauaugguggagagacccuc

SEQ ID NO: 41674 - RNA, 23 nt, Artificial Sequence
  RNA Oligomer
cuaauaugguggagagacccuca

SEQ ID NO: 41675 - RNA, 23 nt, Artificial Sequence
  RNA Oligomer
uaauaugguggagagacccucau

SEQ ID NO: 41676 - RNA, 23 nt, Artificial Sequence
  RNA Oligomer
aauaugguggagagacccucauu

SEQ ID NO: 41677 - RNA, 23 nt, Artificial Sequence
  RNA Oligomer
auaugguggagagacccucauuc

SEQ ID NO: 41678 - RNA, 23 nt, Artificial Sequence
  RNA Oligomer
uacuuguugcucuucggcuguca

SEQ ID NO: 41679 - RNA, 23 nt, Artificial Sequence
  RNA Oligomer
acuuguugcucuucggcugucag

SEQ ID NO: 41680 - RNA, 23 nt, Artificial Sequence
  RNA Oligomer
cuuguugcucuucggcugucagg

SEQ ID NO: 41681 - RNA, 23 nt, Artificial Sequence
  RNA Oligomer
uuguugcucuucggcugucagga

SEQ ID NO: 41682 - RNA, 23 nt, Artificial Sequence
  RNA Oligomer
uugcauuaacagcuaucccauag

SEQ ID NO: 41683 - RNA, 23 nt, Artificial Sequence
  RNA Oligomer
ugcauuaacagcuaucccauagg

SEQ ID NO: 41684 - RNA, 23 nt, Artificial Sequence
  RNA Oligomer
gcauuaacagcuaucccauaggc

SEQ ID NO: 41685 - RNA, 23 nt, Artificial Sequence
  RNA Oligomer
cauuaacagcuaucccauaggcg

SEQ ID NO: 41686 - RNA, 23 nt, Artificial Sequence
  RNA Oligomer
auuaacagcuaucccauaggcga

SEQ ID NO: 41687 - RNA, 23 nt, Artificial Sequence
  RNA Oligomer
uuaacagcuaucccauaggcgac

SEQ ID NO: 41688 - RNA, 23 nt, Artificial Sequence
  RNA Oligomer
uaugaaugaaauaagguuucgac

SEQ ID NO: 41689 - RNA, 23 nt, Artificial Sequence
  RNA Oligomer
augaaugaaauaagguuucgacu

SEQ ID NO: 41690 - RNA, 23 nt, Artificial Sequence
  RNA Oligomer
ugaaugaaauaagguuucgacug

SEQ ID NO: 41691 - RNA, 23 nt, Artificial Sequence
  RNA Oligomer
gaaugaaauaagguuucgacuga

SEQ ID NO: 41692 - RNA, 23 nt, Artificial Sequence
  RNA Oligomer
aaguaugguauaguguacuguuc

SEQ ID NO: 41693 - RNA, 23 nt, Artificial Sequence
  RNA Oligomer
aguaugguauaguguacuguuca

SEQ ID NO: 41694 - RNA, 23 nt, Artificial Sequence
  RNA Oligomer
guaugguauaguguacuguucac

SEQ ID NO: 41695 - RNA, 23 nt, Artificial Sequence
  RNA Oligomer
uaugguauaguguacuguucaca

SEQ ID NO: 41696 - RNA, 23 nt, Artificial Sequence
  RNA Oligomer
augguauaguguacuguucacaa

SEQ ID NO: 41697 - RNA, 23 nt, Artificial Sequence
  RNA Oligomer
cggcaaauccaguagaaauacac

SEQ ID NO: 41698 - RNA, 23 nt, Artificial Sequence
  RNA Oligomer
ggcaaauccaguagaaauacacc

SEQ ID NO: 41699 - RNA, 23 nt, Artificial Sequence
  RNA Oligomer
gcaaauccaguagaaauacaccu

SEQ ID NO: 41700 - RNA, 23 nt, Artificial Sequence
  RNA Oligomer
caaauccaguagaaauacaccuu

SEQ ID NO: 41701 - RNA, 23 nt, Artificial Sequence
  RNA Oligomer
aaauccaguagaaauacaccuug

SEQ ID NO: 41702 - RNA, 23 nt, Artificial Sequence
  RNA Oligomer
aauccaguagaaauacaccuugc

SEQ ID NO: 41703 - RNA, 23 nt, Artificial Sequence
  RNA Oligomer
auccaguagaaauacaccuugcu

SEQ ID NO: 41704 - RNA, 23 nt, Artificial Sequence
  RNA Oligomer
uccaguagaaauacaccuugcuc

SEQ ID NO: 41705 - RNA, 23 nt, Artificial Sequence
  RNA Oligomer
ugugcacgcugaaaaagucuucc

SEQ ID NO: 41706 - RNA, 23 nt, Artificial Sequence
  RNA Oligomer
gugcacgcugaaaaagucuuccu

SEQ ID NO: 41707 - RNA, 23 nt, Artificial Sequence
  RNA Oligomer
ugcacgcugaaaaagucuuccug

SEQ ID NO: 41708 - RNA, 23 nt, Artificial Sequence
  RNA Oligomer
gcacgcugaaaaagucuuccugg

SEQ ID NO: 41709 - RNA, 23 nt, Artificial Sequence
  RNA Oligomer
uccuugccagaaaauugaggcac

SEQ ID NO: 41710 - RNA, 23 nt, Artificial Sequence
  RNA Oligomer
ccuugccagaaaauugaggcacg

SEQ ID NO: 41711 - RNA, 23 nt, Artificial Sequence
  RNA Oligomer
cuugccagaaaauugaggcacgg

SEQ ID NO: 41712 - RNA, 23 nt, Artificial Sequence
  RNA Oligomer
ccagaacaacucauaggaggccu

SEQ ID NO: 41713 - RNA, 23 nt, Artificial Sequence
  RNA Oligomer
cagaacaacucauaggaggccug

SEQ ID NO: 41714 - RNA, 23 nt, Artificial Sequence
  RNA Oligomer
agaacaacucauaggaggccugu

SEQ ID NO: 41715 - RNA, 23 nt, Artificial Sequence
  RNA Oligomer
gaacaacucauaggaggccuguc

SEQ ID NO: 41716 - RNA, 23 nt, Artificial Sequence
  RNA Oligomer
aacaacucauaggaggccugucu

SEQ ID NO: 41717 - RNA, 23 nt, Artificial Sequence
  RNA Oligomer
ccugcuauuguccuuagcaauuc

SEQ ID NO: 41718 - RNA, 23 nt, Artificial Sequence
  RNA Oligomer
cugcuauuguccuuagcaauuca

SEQ ID NO: 41719 - RNA, 23 nt, Artificial Sequence
  RNA Oligomer
ugcuauuguccuuagcaauucag

SEQ ID NO: 41720 - RNA, 23 nt, Artificial Sequence
  RNA Oligomer
gcuauuguccuuagcaauucagu

SEQ ID NO: 41721 - RNA, 23 nt, Artificial Sequence
  RNA Oligomer
cuauuguccuuagcaauucagug

SEQ ID NO: 41722 - RNA, 23 nt, Artificial Sequence
  RNA Oligomer
uaauggaaagacuccuccucuuc

SEQ ID NO: 41723 - RNA, 23 nt, Artificial Sequence
  RNA Oligomer
aauggaaagacuccuccucuuca

SEQ ID NO: 41724 - RNA, 23 nt, Artificial Sequence
  RNA Oligomer
cuucugcuuuaagccuguaauca

SEQ ID NO: 41725 - RNA, 23 nt, Artificial Sequence
  RNA Oligomer
uucugcuuuaagccuguaaucac

SEQ ID NO: 41726 - RNA, 23 nt, Artificial Sequence
  RNA Oligomer
gggucugugccucacugcauuug

SEQ ID NO: 41727 - RNA, 23 nt, Artificial Sequence
  RNA Oligomer
ggucugugccucacugcauuugu

SEQ ID NO: 41728 - RNA, 23 nt, Artificial Sequence
  RNA Oligomer
gucugugccucacugcauuugua

SEQ ID NO: 41729 - RNA, 23 nt, Artificial Sequence
  RNA Oligomer
ucugugccucacugcauuuguac

SEQ ID NO: 41730 - RNA, 23 nt, Artificial Sequence
  RNA Oligomer
cugugccucacugcauuuguacc

SEQ ID NO: 41731 - RNA, 23 nt, Artificial Sequence
  RNA Oligomer
cacgcuuuuucaugugaaguucc

SEQ ID NO: 41732 - RNA, 23 nt, Artificial Sequence
  RNA Oligomer
gggccuaaaauccauuuccaagc

SEQ ID NO: 41733 - RNA, 23 nt, Artificial Sequence
  RNA Oligomer
uacuuguuccucuuaugaaugaa

SEQ ID NO: 41734 - RNA, 23 nt, Artificial Sequence
  RNA Oligomer
acuuguuccucuuaugaaugaaa

SEQ ID NO: 41735 - RNA, 23 nt, Artificial Sequence
  RNA Oligomer
cuuguuccucuuaugaaugaaau

SEQ ID NO: 41736 - RNA, 23 nt, Artificial Sequence
  RNA Oligomer
uuguuccucuuaugaaugaaaua

SEQ ID NO: 41737 - RNA, 23 nt, Artificial Sequence
  RNA Oligomer
aaaauucaggcacagugcggaug

SEQ ID NO: 41738 - RNA, 23 nt, Artificial Sequence
  RNA Oligomer
aaauucaggcacagugcggaugc

SEQ ID NO: 41739 - RNA, 23 nt, Artificial Sequence
  RNA Oligomer
cucguguguaauggaaagacucc

SEQ ID NO: 41740 - RNA, 23 nt, Artificial Sequence
  RNA Oligomer
ucguguguaauggaaagacuccu

SEQ ID NO: 41741 - RNA, 23 nt, Artificial Sequence
  RNA Oligomer
aggaaguaugguauaguguacug

SEQ ID NO: 41742 - RNA, 23 nt, Artificial Sequence
  RNA Oligomer
ggaaguaugguauaguguacugu

SEQ ID NO: 41743 - RNA, 23 nt, Artificial Sequence
  RNA Oligomer
gaaguaugguauaguguacuguu

SEQ ID NO: 41744 - RNA, 23 nt, Artificial Sequence
  RNA Oligomer
acaaugccuggacuugaccucca

SEQ ID NO: 41745 - RNA, 23 nt, Artificial Sequence
  RNA Oligomer
caaugccuggacuugaccuccaa

SEQ ID NO: 41746 - RNA, 23 nt, Artificial Sequence
  RNA Oligomer
aaugccuggacuugaccuccaaa

SEQ ID NO: 41747 - RNA, 23 nt, Artificial Sequence
  RNA Oligomer
ggacuugaccuccaaagucuaga

SEQ ID NO: 41748 - RNA, 23 nt, Artificial Sequence
  RNA Oligomer
gacuugaccuccaaagucuagaa

SEQ ID NO: 41749 - RNA, 23 nt, Artificial Sequence
  RNA Oligomer
acuugaccuccaaagucuagaag

SEQ ID NO: 41750 - RNA, 23 nt, Artificial Sequence
  RNA Oligomer
cuugaccuccaaagucuagaagc

SEQ ID NO: 41751 - RNA, 23 nt, Artificial Sequence
  RNA Oligomer
uugaccuccaaagucuagaagcu

SEQ ID NO: 41752 - RNA, 23 nt, Artificial Sequence
  RNA Oligomer
ggugauuguaggcaaucugcuug

SEQ ID NO: 41753 - RNA, 23 nt, Artificial Sequence
  RNA Oligomer
gugauuguaggcaaucugcuuga

SEQ ID NO: 41754 - RNA, 23 nt, Artificial Sequence
  RNA Oligomer
ugauuguaggcaaucugcuugaa

SEQ ID NO: 41755 - RNA, 23 nt, Artificial Sequence
  RNA Oligomer
gauuguaggcaaucugcuugaac

SEQ ID NO: 41756 - RNA, 23 nt, Artificial Sequence
  RNA Oligomer
auuguaggcaaucugcuugaacu

SEQ ID NO: 41757 - RNA, 23 nt, Artificial Sequence
  RNA Oligomer
uuguaggcaaucugcuugaacuc

SEQ ID NO: 41758 - RNA, 23 nt, Artificial Sequence
  RNA Oligomer
cauuguuccaguugggccuccca

SEQ ID NO: 41759 - RNA, 23 nt, Artificial Sequence
  RNA Oligomer
auuguuccaguugggccucccau

SEQ ID NO: 41760 - RNA, 23 nt, Artificial Sequence
  RNA Oligomer
uacuaauaugguggagagacccu

SEQ ID NO: 41761 - RNA, 23 nt, Artificial Sequence
  RNA Oligomer
acacuggguagugaaauacaucu

SEQ ID NO: 41762 - RNA, 23 nt, Artificial Sequence
  RNA Oligomer
cacuggguagugaaauacaucug

SEQ ID NO: 41763 - RNA, 23 nt, Artificial Sequence
  RNA Oligomer
acuggguagugaaauacaucugu

SEQ ID NO: 41764 - RNA, 23 nt, Artificial Sequence
  RNA Oligomer
cuggguagugaaauacaucuguc

SEQ ID NO: 41765 - RNA, 23 nt, Artificial Sequence
  RNA Oligomer
uuaaagccacgcuuuuucaugug

SEQ ID NO: 41766 - RNA, 23 nt, Artificial Sequence
  RNA Oligomer
uguugcucuucggcugucaggaa

SEQ ID NO: 41767 - RNA, 23 nt, Artificial Sequence
  RNA Oligomer
agaagacgaugaaaacauggugu

SEQ ID NO: 41768 - RNA, 23 nt, Artificial Sequence
  RNA Oligomer
gaagacgaugaaaacauggugug

SEQ ID NO: 41769 - RNA, 23 nt, Artificial Sequence
  RNA Oligomer
aagacgaugaaaacauggugugu

SEQ ID NO: 41770 - RNA, 23 nt, Artificial Sequence
  RNA Oligomer
aaacaugguguguguaccagaac

SEQ ID NO: 41771 - RNA, 23 nt, Artificial Sequence
  RNA Oligomer
aacaugguguguguaccagaaca

SEQ ID NO: 41772 - RNA, 23 nt, Artificial Sequence
  RNA Oligomer
ucaggaaauuucuucucccucac

SEQ ID NO: 41773 - RNA, 23 nt, Artificial Sequence
  RNA Oligomer
gguguugcccagcuuggaaagug

SEQ ID NO: 41774 - RNA, 23 nt, Artificial Sequence
  RNA Oligomer
guguugcccagcuuggaaagugc

SEQ ID NO: 41775 - RNA, 23 nt, Artificial Sequence
  RNA Oligomer
uguugcccagcuuggaaagugcg

SEQ ID NO: 41776 - RNA, 23 nt, Artificial Sequence
  RNA Oligomer
guugcccagcuuggaaagugcgg

SEQ ID NO: 41777 - RNA, 23 nt, Artificial Sequence
  RNA Oligomer
uugcccagcuuggaaagugcggc

SEQ ID NO: 41778 - RNA, 23 nt, Artificial Sequence
  RNA Oligomer
aauucaggcacagugcggaugcu

SEQ ID NO: 41779 - RNA, 23 nt, Artificial Sequence
  RNA Oligomer
aacucguguguaauggaaagacu

SEQ ID NO: 41780 - RNA, 23 nt, Artificial Sequence
  RNA Oligomer
acucguguguaauggaaagacuc

SEQ ID NO: 41781 - RNA, 23 nt, Artificial Sequence
  RNA Oligomer
guggcacaucuuuugaagugucc

SEQ ID NO: 41782 - RNA, 23 nt, Artificial Sequence
  RNA Oligomer
uggcacaucuuuugaaguguccu

SEQ ID NO: 41783 - RNA, 23 nt, Artificial Sequence
  RNA Oligomer
ucuuuugaaguguccucgagaga

SEQ ID NO: 41784 - RNA, 23 nt, Artificial Sequence
  RNA Oligomer
cuuuugaaguguccucgagagag

SEQ ID NO: 41785 - RNA, 23 nt, Artificial Sequence
  RNA Oligomer
uuuugaaguguccucgagagagc

SEQ ID NO: 41786 - RNA, 23 nt, Artificial Sequence
  RNA Oligomer
uuugaaguguccucgagagagcu

SEQ ID NO: 41787 - RNA, 23 nt, Artificial Sequence
  RNA Oligomer
uggggugauuguaggcaaucugc

SEQ ID NO: 41788 - RNA, 23 nt, Artificial Sequence
  RNA Oligomer
ggggugauuguaggcaaucugcu

SEQ ID NO: 41789 - RNA, 23 nt, Artificial Sequence
  RNA Oligomer
gggugauuguaggcaaucugcuu

SEQ ID NO: 41790 - RNA, 23 nt, Artificial Sequence
  RNA Oligomer
gagaguacuaauaugguggagag

SEQ ID NO: 41791 - RNA, 23 nt, Artificial Sequence
  RNA Oligomer
agaguacuaauaugguggagaga

SEQ ID NO: 41792 - RNA, 23 nt, Artificial Sequence
  RNA Oligomer
ucugcuugaacucauuguuccag

SEQ ID NO: 41793 - RNA, 23 nt, Artificial Sequence
  RNA Oligomer
gaguacuaauaugguggagagac

SEQ ID NO: 41794 - RNA, 23 nt, Artificial Sequence
  RNA Oligomer
gagagagacugucuuggguuugg

SEQ ID NO: 41795 - RNA, 23 nt, Artificial Sequence
  RNA Oligomer
agagagacugucuuggguuuggc

SEQ ID NO: 41796 - RNA, 23 nt, Artificial Sequence
  RNA Oligomer
gagagacugucuuggguuuggcc

SEQ ID NO: 41797 - RNA, 23 nt, Artificial Sequence
  RNA Oligomer
agagacugucuuggguuuggccu

SEQ ID NO: 41798 - RNA, 23 nt, Artificial Sequence
  RNA Oligomer
gagacugucuuggguuuggccuc

SEQ ID NO: 41799 - RNA, 23 nt, Artificial Sequence
  RNA Oligomer
ccucugcagcaaauacuuguucc

SEQ ID NO: 41800 - RNA, 23 nt, Artificial Sequence
  RNA Oligomer
cucugcagcaaauacuuguuccu

SEQ ID NO: 41801 - RNA, 23 nt, Artificial Sequence
  RNA Oligomer
ucugcagcaaauacuuguuccuc

SEQ ID NO: 41802 - RNA, 23 nt, Artificial Sequence
  RNA Oligomer
cugcagcaaauacuuguuccucu

SEQ ID NO: 41803 - RNA, 23 nt, Artificial Sequence
  RNA Oligomer
ugcagcaaauacuuguuccucuu

SEQ ID NO: 41804 - RNA, 23 nt, Artificial Sequence
  RNA Oligomer
uauucaccaguucccaacuggga

SEQ ID NO: 41805 - RNA, 23 nt, Artificial Sequence
  RNA Oligomer
auucaccaguucccaacugggag

SEQ ID NO: 41806 - RNA, 23 nt, Artificial Sequence
  RNA Oligomer
uucaccaguucccaacugggagc

SEQ ID NO: 41807 - RNA, 23 nt, Artificial Sequence
  RNA Oligomer
ggccgucacaggaauuccuggug

SEQ ID NO: 41808 - RNA, 23 nt, Artificial Sequence
  RNA Oligomer
gccgucacaggaauuccuggugg

SEQ ID NO: 41809 - RNA, 23 nt, Artificial Sequence
  RNA Oligomer
ccgucacaggaauuccuggugga

SEQ ID NO: 41810 - RNA, 23 nt, Artificial Sequence
  RNA Oligomer
gucacaggaauuccugguggagu

SEQ ID NO: 41811 - RNA, 23 nt, Artificial Sequence
  RNA Oligomer
guacuaauaugguggagagaccc

SEQ ID NO: 41812 - RNA, 23 nt, Artificial Sequence
  RNA Oligomer
gucguuaguaagggcuucccuag

SEQ ID NO: 41813 - RNA, 23 nt, Artificial Sequence
  RNA Oligomer
ucguuaguaagggcuucccuagu

SEQ ID NO: 41814 - RNA, 23 nt, Artificial Sequence
  RNA Oligomer
cguuaguaagggcuucccuagua

SEQ ID NO: 41815 - RNA, 23 nt, Artificial Sequence
  RNA Oligomer
guuaguaagggcuucccuaguaa

SEQ ID NO: 41816 - RNA, 23 nt, Artificial Sequence
  RNA Oligomer
uuaguaagggcuucccuaguaaa

SEQ ID NO: 41817 - RNA, 23 nt, Artificial Sequence
  RNA Oligomer
ucaugugaaguuccaggacucca

SEQ ID NO: 41818 - RNA, 23 nt, Artificial Sequence
  RNA Oligomer
caugugaaguuccaggacuccag

SEQ ID NO: 41819 - RNA, 23 nt, Artificial Sequence
  RNA Oligomer
augugaaguuccaggacuccaga

SEQ ID NO: 41820 - RNA, 23 nt, Artificial Sequence
  RNA Oligomer
ugugaaguuccaggacuccagag

SEQ ID NO: 41821 - RNA, 23 nt, Artificial Sequence
  RNA Oligomer
ugccauucugcauagcggucucu

SEQ ID NO: 41822 - RNA, 23 nt, Artificial Sequence
  RNA Oligomer
gccauucugcauagcggucucua

SEQ ID NO: 41823 - RNA, 23 nt, Artificial Sequence
  RNA Oligomer
ccauucugcauagcggucucuac

SEQ ID NO: 41824 - RNA, 23 nt, Artificial Sequence
  RNA Oligomer
cauucugcauagcggucucuaca

SEQ ID NO: 41825 - RNA, 23 nt, Artificial Sequence
  RNA Oligomer
auucugcauagcggucucuacag

SEQ ID NO: 41826 - RNA, 23 nt, Artificial Sequence
  RNA Oligomer
ugcagagagagacugucuugggu

SEQ ID NO: 41827 - RNA, 23 nt, Artificial Sequence
  RNA Oligomer
gcagagagagacugucuuggguu

SEQ ID NO: 41828 - RNA, 23 nt, Artificial Sequence
  RNA Oligomer
cagagagagacugucuuggguuu

SEQ ID NO: 41829 - RNA, 23 nt, Artificial Sequence
  RNA Oligomer
agagagagacugucuuggguuug

SEQ ID NO: 41830 - RNA, 23 nt, Artificial Sequence
  RNA Oligomer
agacugucuuggguuuggccucg

SEQ ID NO: 41831 - RNA, 23 nt, Artificial Sequence
  RNA Oligomer
aauaagguuucgacugacaggua

SEQ ID NO: 41832 - RNA, 23 nt, Artificial Sequence
  RNA Oligomer
auaagguuucgacugacagguau

SEQ ID NO: 41833 - RNA, 23 nt, Artificial Sequence
  RNA Oligomer
uaagguuucgacugacagguauu

SEQ ID NO: 41834 - RNA, 23 nt, Artificial Sequence
  RNA Oligomer
aagguuucgacugacagguauua

SEQ ID NO: 41835 - RNA, 23 nt, Artificial Sequence
  RNA Oligomer
ucacaggaauuccugguggaguu

SEQ ID NO: 41836 - RNA, 23 nt, Artificial Sequence
  RNA Oligomer
cccauagaaggucuucugcuuua

SEQ ID NO: 41837 - RNA, 23 nt, Artificial Sequence
  RNA Oligomer
ccauagaaggucuucugcuuuaa

SEQ ID NO: 41838 - RNA, 23 nt, Artificial Sequence
  RNA Oligomer
cauagaaggucuucugcuuuaag

SEQ ID NO: 41839 - RNA, 23 nt, Artificial Sequence
  RNA Oligomer
auagaaggucuucugcuuuaagc

SEQ ID NO: 41840 - RNA, 23 nt, Artificial Sequence
  RNA Oligomer
uagaaggucuucugcuuuaagcc

SEQ ID NO: 41841 - RNA, 23 nt, Artificial Sequence
  RNA Oligomer
ucgucccaguguaaagcuaugug

SEQ ID NO: 41842 - RNA, 23 nt, Artificial Sequence
  RNA Oligomer
cgucccaguguaaagcuauguga

SEQ ID NO: 41843 - RNA, 23 nt, Artificial Sequence
  RNA Oligomer
gucccaguguaaagcuaugugaa

SEQ ID NO: 41844 - RNA, 23 nt, Artificial Sequence
  RNA Oligomer
ucccaguguaaagcuaugugaag

SEQ ID NO: 41845 - RNA, 23 nt, Artificial Sequence
  RNA Oligomer
cccaguguaaagcuaugugaaga

SEQ ID NO: 41846 - RNA, 23 nt, Artificial Sequence
  RNA Oligomer
uaacucagaaagugaguuuuccc

SEQ ID NO: 41847 - RNA, 23 nt, Artificial Sequence
  RNA Oligomer
aacucagaaagugaguuuucccc

SEQ ID NO: 41848 - RNA, 23 nt, Artificial Sequence
  RNA Oligomer
acucagaaagugaguuuuccccu

SEQ ID NO: 41849 - RNA, 23 nt, Artificial Sequence
  RNA Oligomer
cucagaaagugaguuuuccccug

SEQ ID NO: 41850 - RNA, 23 nt, Artificial Sequence
  RNA Oligomer
ucagaaagugaguuuuccccugc

SEQ ID NO: 41851 - RNA, 23 nt, Artificial Sequence
  RNA Oligomer
acacacacuggguagugaaauac

SEQ ID NO: 41852 - RNA, 23 nt, Artificial Sequence
  RNA Oligomer
cacacacuggguagugaaauaca

SEQ ID NO: 41853 - RNA, 23 nt, Artificial Sequence
  RNA Oligomer
acacacuggguagugaaauacau

SEQ ID NO: 41854 - RNA, 23 nt, Artificial Sequence
  RNA Oligomer
cacacuggguagugaaauacauc

SEQ ID NO: 41855 - RNA, 23 nt, Artificial Sequence
  RNA Oligomer
uccauuuccaagccgaggguucc

SEQ ID NO: 41856 - RNA, 23 nt, Artificial Sequence
  RNA Oligomer
ccauuuccaagccgaggguuccu

SEQ ID NO: 41857 - RNA, 23 nt, Artificial Sequence
  RNA Oligomer
cauuuccaagccgaggguuccuu

SEQ ID NO: 41858 - RNA, 23 nt, Artificial Sequence
  RNA Oligomer
auuuccaagccgaggguuccuug

SEQ ID NO: 41859 - RNA, 23 nt, Artificial Sequence
  RNA Oligomer
ugguguguguaccagaacaacuc

SEQ ID NO: 41860 - RNA, 23 nt, Artificial Sequence
  RNA Oligomer
gguguguguaccagaacaacuca

SEQ ID NO: 41861 - RNA, 23 nt, Artificial Sequence
  RNA Oligomer
guguguguaccagaacaacucau

SEQ ID NO: 41862 - RNA, 23 nt, Artificial Sequence
  RNA Oligomer
uguguguaccagaacaacucaua

SEQ ID NO: 41863 - RNA, 23 nt, Artificial Sequence
  Chemically synthesized
guguguaccagaacaacucauag

SEQ ID NO: 41864 - RNA, 23 nt, Artificial Sequence
  Chemically synthesized
ggccugucugaugaacucaguug

SEQ ID NO: 41865 - RNA, 23 nt, Artificial Sequence
  Chemically synthesized
gccugucugaugaacucaguuga

SEQ ID NO: 41866 - RNA, 23 nt, Artificial Sequence
  Chemically synthesized
ccugucugaugaacucaguugac

SEQ ID NO: 41867 - RNA, 23 nt, Artificial Sequence
  Chemically synthesized
cugucugaugaacucaguugacg

SEQ ID NO: 41868 - RNA, 23 nt, Artificial Sequence
  Chemically synthesized
ugucugaugaacucaguugacga

SEQ ID NO: 41869 - RNA, 23 nt, Artificial Sequence
  Chemically synthesized
gaugaacucaguugacgagguca

SEQ ID NO: 41870 - RNA, 23 nt, Artificial Sequence
  Chemically synthesized
augaacucaguugacgaggucau

SEQ ID NO: 41871 - RNA, 23 nt, Artificial Sequence
  Chemically synthesized
ugaacucaguugacgaggucaug

SEQ ID NO: 41872 - RNA, 23 nt, Artificial Sequence
  Chemically synthesized
gaacucaguugacgaggucauga

SEQ ID NO: 41873 - RNA, 23 nt, Artificial Sequence
  RNA Oligomer
aacucaguugacgaggucaugau

SEQ ID NO: 41874 - RNA, 23 nt, Artificial Sequence
  RNA Oligomer
agaaaugcgccacgauguggaug

SEQ ID NO: 41875 - RNA, 23 nt, Artificial Sequence
  RNA Oligomer
gaaaugcgccacgauguggaugg

SEQ ID NO: 41876 - RNA, 23 nt, Artificial Sequence
  RNA Oligomer
aaaugcgccacgauguggauggu

SEQ ID NO: 41877 - RNA, 23 nt, Artificial Sequence
  RNA Oligomer
augguugcauuaacagcuauccc

SEQ ID NO: 41878 - RNA, 23 nt, Artificial Sequence
  RNA Oligomer
ugguugcauuaacagcuauccca

SEQ ID NO: 41879 - RNA, 23 nt, Artificial Sequence
  RNA Oligomer
gguugcauuaacagcuaucccau

SEQ ID NO: 41880 - RNA, 23 nt, Artificial Sequence
  RNA Oligomer
guugcauuaacagcuaucccaua

SEQ ID NO: 41881 - RNA, 23 nt, Artificial Sequence
  RNA Oligomer
cgaccaguuugugaaaucugagg

SEQ ID NO: 41882 - RNA, 23 nt, Artificial Sequence
  RNA Oligomer
uaguguacuguucacaauaguua

SEQ ID NO: 41883 - RNA, 23 nt, Artificial Sequence
  RNA Oligomer
aguguacuguucacaauaguuaa

SEQ ID NO: 41884 - RNA, 23 nt, Artificial Sequence
  RNA Oligomer
guguacuguucacaauaguuaau

SEQ ID NO: 41885 - RNA, 23 nt, Artificial Sequence
  RNA Oligomer
uguacuguucacaauaguuaauu

SEQ ID NO: 41886 - RNA, 23 nt, Artificial Sequence
  RNA Oligomer
guacuguucacaauaguuaauua

SEQ ID NO: 41887 - RNA, 23 nt, Artificial Sequence
  RNA Oligomer
agaaggucuucugcuuuaagccu

SEQ ID NO: 41888 - RNA, 23 nt, Artificial Sequence
  RNA Oligomer
cguguuuccagggagaguaagag

SEQ ID NO: 41889 - RNA, 23 nt, Artificial Sequence
  RNA Oligomer
guguuuccagggagaguaagaga

SEQ ID NO: 41890 - RNA, 23 nt, Artificial Sequence
  RNA Oligomer
uguuuccagggagaguaagagau

SEQ ID NO: 41891 - RNA, 23 nt, Artificial Sequence
  RNA Oligomer
guuuccagggagaguaagagauc

SEQ ID NO: 41892 - RNA, 23 nt, Artificial Sequence
  RNA Oligomer
aaauacaucugucagggcaguuc

SEQ ID NO: 41893 - RNA, 23 nt, Artificial Sequence
  RNA Oligomer
aauacaucugucagggcaguucc

SEQ ID NO: 41894 - RNA, 23 nt, Artificial Sequence
  RNA Oligomer
auacaucugucagggcaguucca

SEQ ID NO: 41895 - RNA, 23 nt, Artificial Sequence
  RNA Oligomer
uacaucugucagggcaguuccaa

SEQ ID NO: 41896 - RNA, 23 nt, Artificial Sequence
  RNA Oligomer
acaucugucagggcaguuccaaa

SEQ ID NO: 41897 - RNA, 23 nt, Artificial Sequence
  RNA Oligomer
augugcacgcugaaaaagucuuc

SEQ ID NO: 41898 - RNA, 23 nt, Artificial Sequence
  RNA Oligomer
ugccacuccagcgaagauauggc

SEQ ID NO: 41899 - RNA, 23 nt, Artificial Sequence
  RNA Oligomer
gccacuccagcgaagauauggcu

SEQ ID NO: 41900 - RNA, 23 nt, Artificial Sequence
  RNA Oligomer
ccacuccagcgaagauauggcug

SEQ ID NO: 41901 - RNA, 23 nt, Artificial Sequence
  RNA Oligomer
cacuccagcgaagauauggcugg

SEQ ID NO: 41902 - RNA, 23 nt, Artificial Sequence
  RNA Oligomer
acuccagcgaagauauggcuggg

SEQ ID NO: 41903 - RNA, 23 nt, Artificial Sequence
  RNA Oligomer
ugugcagagagagacugucuugg

SEQ ID NO: 41904 - RNA, 23 nt, Artificial Sequence
  RNA Oligomer
gugcagagagagacugucuuggg

SEQ ID NO: 41905 - RNA, 23 nt, Artificial Sequence
  RNA Oligomer
uggguuuggccucgaacaauccg

SEQ ID NO: 41906 - RNA, 23 nt, Artificial Sequence
  RNA Oligomer
cugucaggaaauuucuucucccu

SEQ ID NO: 41907 - RNA, 23 nt, Artificial Sequence
  RNA Oligomer
ugucaggaaauuucuucucccuc

SEQ ID NO: 41908 - RNA, 23 nt, Artificial Sequence
  RNA Oligomer
gucaggaaauuucuucucccuca

SEQ ID NO: 41909 - RNA, 23 nt, Artificial Sequence
  RNA Oligomer
ugaugaacucaguugacgagguc

SEQ ID NO: 41910 - RNA, 23 nt, Artificial Sequence
  RNA Oligomer
ucaguugacgaggucaugaucaa

SEQ ID NO: 41911 - RNA, 23 nt, Artificial Sequence
  RNA Oligomer
caguugacgaggucaugaucaag

SEQ ID NO: 41912 - RNA, 23 nt, Artificial Sequence
  RNA Oligomer
aguugacgaggucaugaucaaga

SEQ ID NO: 41913 - RNA, 23 nt, Artificial Sequence
  RNA Oligomer
guugacgaggucaugaucaagac

SEQ ID NO: 41914 - RNA, 23 nt, Artificial Sequence
  RNA Oligomer
uugacgaggucaugaucaagacu

SEQ ID NO: 41915 - RNA, 23 nt, Artificial Sequence
  RNA Oligomer
ugacgaggucaugaucaagacua

SEQ ID NO: 41916 - RNA, 23 nt, Artificial Sequence
  RNA Oligomer
gacgaggucaugaucaagacuaa

SEQ ID NO: 41917 - RNA, 23 nt, Artificial Sequence
  RNA Oligomer
acgaggucaugaucaagacuaaa

SEQ ID NO: 41918 - RNA, 23 nt, Artificial Sequence
  RNA Oligomer
aggguugagguagcucucguuag

SEQ ID NO: 41919 - RNA, 23 nt, Artificial Sequence
  RNA Oligomer
ggguugagguagcucucguuagg

SEQ ID NO: 41920 - RNA, 23 nt, Artificial Sequence
  RNA Oligomer
gguugagguagcucucguuaggg

SEQ ID NO: 41921 - RNA, 23 nt, Artificial Sequence
  RNA Oligomer
guugagguagcucucguuagggg

SEQ ID NO: 41922 - RNA, 23 nt, Artificial Sequence
  RNA Oligomer
uugagguagcucucguuaggggu

SEQ ID NO: 41923 - RNA, 23 nt, Artificial Sequence
  RNA Oligomer
uugugaaaucugagguuuuuguc

SEQ ID NO: 41924 - RNA, 23 nt, Artificial Sequence
  RNA Oligomer
agguuucgacugacagguauuag

SEQ ID NO: 41925 - RNA, 23 nt, Artificial Sequence
  RNA Oligomer
gguuucgacugacagguauuaga

SEQ ID NO: 41926 - RNA, 23 nt, Artificial Sequence
  RNA Oligomer
guuucgacugacagguauuagaa

SEQ ID NO: 41927 - RNA, 23 nt, Artificial Sequence
  RNA Oligomer
uuucgacugacagguauuagaau

SEQ ID NO: 41928 - RNA, 23 nt, Artificial Sequence
  RNA Oligomer
uucgacugacagguauuagaauu

SEQ ID NO: 41929 - RNA, 23 nt, Artificial Sequence
  RNA Oligomer
ugggucguuaguaagggcuuccc

SEQ ID NO: 41930 - RNA, 23 nt, Artificial Sequence
  RNA Oligomer
gggucguuaguaagggcuucccu

SEQ ID NO: 41931 - RNA, 23 nt, Artificial Sequence
  RNA Oligomer
ggucguuaguaagggcuucccua

SEQ ID NO: 41932 - RNA, 23 nt, Artificial Sequence
  RNA Oligomer
uguucuguuguauaugacauguu

SEQ ID NO: 41933 - RNA, 23 nt, Artificial Sequence
  RNA Oligomer
guucuguuguauaugacauguua

SEQ ID NO: 41934 - RNA, 23 nt, Artificial Sequence
  RNA Oligomer
uucuguuguauaugacauguuau

SEQ ID NO: 41935 - RNA, 23 nt, Artificial Sequence
  RNA Oligomer
aaguguccucgagagagcuuuag

SEQ ID NO: 41936 - RNA, 23 nt, Artificial Sequence
  RNA Oligomer
aguguccucgagagagcuuuagg

SEQ ID NO: 41937 - RNA, 23 nt, Artificial Sequence
  RNA Oligomer
guguccucgagagagcuuuaggu

SEQ ID NO: 41938 - RNA, 23 nt, Artificial Sequence
  RNA Oligomer
uguccucgagagagcuuuagguc

SEQ ID NO: 41939 - RNA, 23 nt, Artificial Sequence
  RNA Oligomer
guccucgagagagcuuuaggucc

SEQ ID NO: 41940 - RNA, 23 nt, Artificial Sequence
  RNA Oligomer
ggccucccauagaaggucuucug

SEQ ID NO: 41941 - RNA, 23 nt, Artificial Sequence
  RNA Oligomer
gccucccauagaaggucuucugc

SEQ ID NO: 41942 - RNA, 23 nt, Artificial Sequence
  RNA Oligomer
ccucccauagaaggucuucugcu

SEQ ID NO: 41943 - RNA, 23 nt, Artificial Sequence
  RNA Oligomer
cucccauagaaggucuucugcuu

SEQ ID NO: 41944 - RNA, 23 nt, Artificial Sequence
  RNA Oligomer
ucccauagaaggucuucugcuuu

SEQ ID NO: 41945 - RNA, 23 nt, Artificial Sequence
  RNA Oligomer
aguacuaauaugguggagagacc

SEQ ID NO: 41946 - RNA, 23 nt, Artificial Sequence
  RNA Oligomer
ugauaacucagaaagugaguuuu

SEQ ID NO: 41947 - RNA, 23 nt, Artificial Sequence
  RNA Oligomer
gauaacucagaaagugaguuuuc

SEQ ID NO: 41948 - RNA, 23 nt, Artificial Sequence
  RNA Oligomer
auaacucagaaagugaguuuucc

SEQ ID NO: 41949 - RNA, 23 nt, Artificial Sequence
  RNA Oligomer
uaaagccacgcuuuuucauguga

SEQ ID NO: 41950 - RNA, 23 nt, Artificial Sequence
  RNA Oligomer
aaagccacgcuuuuucaugugaa

SEQ ID NO: 41951 - RNA, 23 nt, Artificial Sequence
  RNA Oligomer
aagccacgcuuuuucaugugaag

SEQ ID NO: 41952 - RNA, 23 nt, Artificial Sequence
  RNA Oligomer
gucugaugaacucaguugacgag

SEQ ID NO: 41953 - RNA, 23 nt, Artificial Sequence
  RNA Oligomer
ggcgaccaguuugugaaaucuga

SEQ ID NO: 41954 - RNA, 23 nt, Artificial Sequence
  RNA Oligomer
gcgaccaguuugugaaaucugag

SEQ ID NO: 41955 - RNA, 23 nt, Artificial Sequence
  RNA Oligomer
ucuguuguauaugacauguuauu

SEQ ID NO: 41956 - RNA, 23 nt, Artificial Sequence
  RNA Oligomer
ugguauaguguacuguucacaau

SEQ ID NO: 41957 - RNA, 23 nt, Artificial Sequence
  RNA Oligomer
gguauaguguacuguucacaaua

SEQ ID NO: 41958 - RNA, 23 nt, Artificial Sequence
  RNA Oligomer
guauaguguacuguucacaauag

SEQ ID NO: 41959 - RNA, 23 nt, Artificial Sequence
  RNA Oligomer
uuauucccagccaugagaguacu

SEQ ID NO: 41960 - RNA, 23 nt, Artificial Sequence
  RNA Oligomer
uauucccagccaugagaguacua

SEQ ID NO: 41961 - RNA, 23 nt, Artificial Sequence
  RNA Oligomer
auucccagccaugagaguacuaa

SEQ ID NO: 41962 - RNA, 23 nt, Artificial Sequence
  RNA Oligomer
uucccagccaugagaguacuaau

SEQ ID NO: 41963 - RNA, 23 nt, Artificial Sequence
  RNA Oligomer
gggccucccauagaaggucuucu

SEQ ID NO: 41964 - RNA, 23 nt, Artificial Sequence
  RNA Oligomer
uaugguggagagacccucauuca

SEQ ID NO: 41965 - RNA, 23 nt, Artificial Sequence
  RNA Oligomer
aagagaucagcaaaccacucaaa

SEQ ID NO: 41966 - RNA, 23 nt, Artificial Sequence
  RNA Oligomer
agagaucagcaaaccacucaaaa

SEQ ID NO: 41967 - RNA, 23 nt, Artificial Sequence
  RNA Oligomer
gagaucagcaaaccacucaaaag

SEQ ID NO: 41968 - RNA, 23 nt, Artificial Sequence
  RNA Oligomer
ccacgcuuuuucaugugaaguuc

SEQ ID NO: 41969 - RNA, 23 nt, Artificial Sequence
  RNA Oligomer
guggcuuaccaccuugguaauga

SEQ ID NO: 41970 - RNA, 23 nt, Artificial Sequence
  RNA Oligomer
uggcuuaccaccuugguaaugac

SEQ ID NO: 41971 - RNA, 23 nt, Artificial Sequence
  RNA Oligomer
ggcuuaccaccuugguaaugaca

SEQ ID NO: 41972 - RNA, 23 nt, Artificial Sequence
  RNA Oligomer
gcuuaccaccuugguaaugacaa

SEQ ID NO: 41973 - RNA, 23 nt, Artificial Sequence
  RNA Oligomer
cuuaccaccuugguaaugacaac

SEQ ID NO: 41974 - RNA, 23 nt, Artificial Sequence
  RNA Oligomer
uuaccaccuugguaaugacaacu

SEQ ID NO: 41975 - RNA, 23 nt, Artificial Sequence
  RNA Oligomer
cugccauucugcauagcggucuc

SEQ ID NO: 41976 - RNA, 23 nt, Artificial Sequence
  RNA Oligomer
uuggguuuggccucgaacaaucc

SEQ ID NO: 41977 - RNA, 23 nt, Artificial Sequence
  RNA Oligomer
ucugaugaacucaguugacgagg

SEQ ID NO: 41978 - RNA, 23 nt, Artificial Sequence
  RNA Oligomer
cugaugaacucaguugacgaggu

SEQ ID NO: 41979 - RNA, 23 nt, Artificial Sequence
  RNA Oligomer
gaugguugcauuaacagcuaucc

SEQ ID NO: 41980 - RNA, 23 nt, Artificial Sequence
  RNA Oligomer
gaauuagcaugcaguuaaaauuc

SEQ ID NO: 41981 - RNA, 23 nt, Artificial Sequence
  RNA Oligomer
gaauuccugguggaguucuuugg

SEQ ID NO: 41982 - RNA, 23 nt, Artificial Sequence
  RNA Oligomer
aauuccugguggaguucuuugga

SEQ ID NO: 41983 - RNA, 23 nt, Artificial Sequence
  RNA Oligomer
auuccugguggaguucuuuggaa

SEQ ID NO: 41984 - RNA, 23 nt, Artificial Sequence
  RNA Oligomer
uuccugguggaguucuuuggaau

SEQ ID NO: 41985 - RNA, 23 nt, Artificial Sequence
  RNA Oligomer
uccugguggaguucuuuggaauc

SEQ ID NO: 41986 - RNA, 23 nt, Artificial Sequence
  RNA Oligomer
ccuggacuugaccuccaaagucu

SEQ ID NO: 41987 - RNA, 23 nt, Artificial Sequence
  RNA Oligomer
cuggacuugaccuccaaagucua

SEQ ID NO: 41988 - RNA, 23 nt, Artificial Sequence
  RNA Oligomer
uggacuugaccuccaaagucuag

SEQ ID NO: 41989 - RNA, 23 nt, Artificial Sequence
  RNA Oligomer
aguggcacaucuuuugaaguguc

SEQ ID NO: 41990 - RNA, 23 nt, Artificial Sequence
  RNA Oligomer
cuccagcgaagauauggcugggc

SEQ ID NO: 41991 - RNA, 23 nt, Artificial Sequence
  RNA Oligomer
gggcacugcaccaagauguacug

SEQ ID NO: 41992 - RNA, 23 nt, Artificial Sequence
  RNA Oligomer
ggcacugcaccaagauguacugc

SEQ ID NO: 41993 - RNA, 23 nt, Artificial Sequence
  RNA Oligomer
gcacugcaccaagauguacugcc

SEQ ID NO: 41994 - RNA, 23 nt, Artificial Sequence
  RNA Oligomer
cacugcaccaagauguacugccc

SEQ ID NO: 41995 - RNA, 23 nt, Artificial Sequence
  RNA Oligomer
acugcaccaagauguacugcccu

SEQ ID NO: 41996 - RNA, 23 nt, Artificial Sequence
  RNA Oligomer
agccacgcuuuuucaugugaagu

SEQ ID NO: 41997 - RNA, 23 nt, Artificial Sequence
  RNA Oligomer
gugaaguuccaggacuccagagg

SEQ ID NO: 41998 - RNA, 23 nt, Artificial Sequence
  RNA Oligomer
ugaaguuccaggacuccagaggg

SEQ ID NO: 41999 - RNA, 23 nt, Artificial Sequence
  RNA Oligomer
ccacugucugccauucugcauag

SEQ ID NO: 42000 - RNA, 23 nt, Artificial Sequence
  RNA Oligomer
cacugucugccauucugcauagc

SEQ ID NO: 42001 - RNA, 23 nt, Artificial Sequence
  RNA Oligomer
acugucugccauucugcauagcg

SEQ ID NO: 42002 - RNA, 23 nt, Artificial Sequence
  RNA Oligomer
cugucugccauucugcauagcgg

SEQ ID NO: 42003 - RNA, 23 nt, Artificial Sequence
  RNA Oligomer
ugucugccauucugcauagcggu

SEQ ID NO: 42004 - RNA, 23 nt, Artificial Sequence
  RNA Oligomer
gucugccauucugcauagcgguc

SEQ ID NO: 42005 - RNA, 23 nt, Artificial Sequence
  RNA Oligomer
ucugccauucugcauagcggucu

SEQ ID NO: 42006 - RNA, 23 nt, Artificial Sequence
  RNA Oligomer
gugguagcguuccagguugaaga

SEQ ID NO: 42007 - RNA, 23 nt, Artificial Sequence
  RNA Oligomer
ugguagcguuccagguugaagaa

SEQ ID NO: 42008 - RNA, 23 nt, Artificial Sequence
  RNA Oligomer
gguagcguuccagguugaagaaa

SEQ ID NO: 42009 - RNA, 23 nt, Artificial Sequence
  RNA Oligomer
guagcguuccagguugaagaaau

SEQ ID NO: 42010 - RNA, 23 nt, Artificial Sequence
  RNA Oligomer
uagcguuccagguugaagaaaug

SEQ ID NO: 42011 - RNA, 23 nt, Artificial Sequence
  RNA Oligomer
uguggaugguugcauuaacagcu

SEQ ID NO: 42012 - RNA, 23 nt, Artificial Sequence
  RNA Oligomer
guggaugguugcauuaacagcua

SEQ ID NO: 42013 - RNA, 23 nt, Artificial Sequence
  RNA Oligomer
uggaugguugcauuaacagcuau

SEQ ID NO: 42014 - RNA, 23 nt, Artificial Sequence
  RNA Oligomer
ggaugguugcauuaacagcuauc

SEQ ID NO: 42015 - RNA, 23 nt, Artificial Sequence
  RNA Oligomer
ucccauaggcgaccaguuuguga

SEQ ID NO: 42016 - RNA, 23 nt, Artificial Sequence
  RNA Oligomer
cccauaggcgaccaguuugugaa

SEQ ID NO: 42017 - RNA, 23 nt, Artificial Sequence
  RNA Oligomer
ccauaggcgaccaguuugugaaa

SEQ ID NO: 42018 - RNA, 23 nt, Artificial Sequence
  RNA Oligomer
cauaggcgaccaguuugugaaau

SEQ ID NO: 42019 - RNA, 23 nt, Artificial Sequence
  RNA Oligomer
auaggcgaccaguuugugaaauc

SEQ ID NO: 42020 - RNA, 23 nt, Artificial Sequence
  RNA Oligomer
uauaguguacuguucacaauagu

SEQ ID NO: 42021 - RNA, 23 nt, Artificial Sequence
  RNA Oligomer
auaguguacuguucacaauaguu

SEQ ID NO: 42022 - RNA, 23 nt, Artificial Sequence
  RNA Oligomer
ccucgagagagcuuuagguccac

SEQ ID NO: 42023 - RNA, 23 nt, Artificial Sequence
  RNA Oligomer
cucgagagagcuuuagguccaca

SEQ ID NO: 42024 - RNA, 23 nt, Artificial Sequence
  RNA Oligomer
ucgagagagcuuuagguccacag

SEQ ID NO: 42025 - RNA, 23 nt, Artificial Sequence
  RNA Oligomer
cgagagagcuuuagguccacaga

SEQ ID NO: 42026 - RNA, 23 nt, Artificial Sequence
  RNA Oligomer
gagagagcuuuagguccacagaa

SEQ ID NO: 42027 - RNA, 23 nt, Artificial Sequence
  RNA Oligomer
cucauccguguuuccagggagag

SEQ ID NO: 42028 - RNA, 23 nt, Artificial Sequence
  RNA Oligomer
ucauccguguuuccagggagagu

SEQ ID NO: 42029 - RNA, 23 nt, Artificial Sequence
  RNA Oligomer
cggaugugcacgcugaaaaaguc

SEQ ID NO: 42030 - RNA, 23 nt, Artificial Sequence
  RNA Oligomer
ggaugugcacgcugaaaaagucu

SEQ ID NO: 42031 - RNA, 23 nt, Artificial Sequence
  RNA Oligomer
gaugugcacgcugaaaaagucuu

SEQ ID NO: 42032 - RNA, 23 nt, Artificial Sequence
  RNA Oligomer
gugccacuccagcgaagauaugg

SEQ ID NO: 42033 - RNA, 23 nt, Artificial Sequence
  RNA Oligomer
uuagcaauucagugguuguguuu

SEQ ID NO: 42034 - RNA, 23 nt, Artificial Sequence
  RNA Oligomer
uaacagcuaucccauaggcgacc

SEQ ID NO: 42035 - RNA, 23 nt, Artificial Sequence
  RNA Oligomer
aacagcuaucccauaggcgacca

SEQ ID NO: 42036 - RNA, 23 nt, Artificial Sequence
  RNA Oligomer
uaggcgaccaguuugugaaaucu

SEQ ID NO: 42037 - RNA, 23 nt, Artificial Sequence
  RNA Oligomer
ugucuaauugccuccuccacggu

SEQ ID NO: 42038 - RNA, 23 nt, Artificial Sequence
  RNA Oligomer
gucuaauugccuccuccacgguc

SEQ ID NO: 42039 - RNA, 23 nt, Artificial Sequence
  RNA Oligomer
ucuaauugccuccuccacggucc

SEQ ID NO: 42040 - RNA, 23 nt, Artificial Sequence
  RNA Oligomer
cuaauugccuccuccacgguccu

SEQ ID NO: 42041 - RNA, 23 nt, Artificial Sequence
  RNA Oligomer
uaauugccuccuccacgguccuc

SEQ ID NO: 42042 - RNA, 23 nt, Artificial Sequence
  RNA Oligomer
gguccucugcagcaaauacuugu

SEQ ID NO: 42043 - RNA, 23 nt, Artificial Sequence
  RNA Oligomer
guccucugcagcaaauacuuguu

SEQ ID NO: 42044 - RNA, 23 nt, Artificial Sequence
  RNA Oligomer
uccucugcagcaaauacuuguuc

SEQ ID NO: 42045 - RNA, 23 nt, Artificial Sequence
  RNA Oligomer
guaaugacaacuucuuguugaaa

SEQ ID NO: 42046 - RNA, 23 nt, Artificial Sequence
  RNA Oligomer
augacaacuucuuguugaaaucg

SEQ ID NO: 42047 - RNA, 23 nt, Artificial Sequence
  RNA Oligomer
cacagggccuaaaauccauuucc

SEQ ID NO: 42048 - RNA, 23 nt, Artificial Sequence
  RNA Oligomer
acagggccuaaaauccauuucca

SEQ ID NO: 42049 - RNA, 23 nt, Artificial Sequence
  RNA Oligomer
cagggccuaaaauccauuuccaa

SEQ ID NO: 42050 - RNA, 23 nt, Artificial Sequence
  RNA Oligomer
agggccuaaaauccauuuccaag

SEQ ID NO: 42051 - RNA, 23 nt, Artificial Sequence
  RNA Oligomer
cucauaggaggccugucugauga

SEQ ID NO: 42052 - RNA, 23 nt, Artificial Sequence
  RNA Oligomer
ucauaggaggccugucugaugaa

SEQ ID NO: 42053 - RNA, 23 nt, Artificial Sequence
  RNA Oligomer
cauaggaggccugucugaugaac

SEQ ID NO: 42054 - RNA, 23 nt, Artificial Sequence
  RNA Oligomer
auaggaggccugucugaugaacu

SEQ ID NO: 42055 - RNA, 23 nt, Artificial Sequence
  RNA Oligomer
uaggaggccugucugaugaacuc

SEQ ID NO: 42056 - RNA, 23 nt, Artificial Sequence
  RNA Oligomer
ccggacaggguugagguagcucu

SEQ ID NO: 42057 - RNA, 23 nt, Artificial Sequence
  RNA Oligomer
cggacaggguugagguagcucuc

SEQ ID NO: 42058 - RNA, 23 nt, Artificial Sequence
  RNA Oligomer
ggacaggguugagguagcucucg

SEQ ID NO: 42059 - RNA, 23 nt, Artificial Sequence
  RNA Oligomer
gacaggguugagguagcucucgu

SEQ ID NO: 42060 - RNA, 23 nt, Artificial Sequence
  RNA Oligomer
acaggguugagguagcucucguu

SEQ ID NO: 42061 - RNA, 23 nt, Artificial Sequence
  RNA Oligomer
caggaauuccugguggaguucuu

SEQ ID NO: 42062 - RNA, 23 nt, Artificial Sequence
  RNA Oligomer
aggaauuccugguggaguucuuu

SEQ ID NO: 42063 - RNA, 23 nt, Artificial Sequence
  RNA Oligomer
ggaauuccugguggaguucuuug

SEQ ID NO: 42064 - RNA, 23 nt, Artificial Sequence
  RNA Oligomer
auaacuugauugaaaacacaaug

SEQ ID NO: 42065 - RNA, 23 nt, Artificial Sequence
  RNA Oligomer
uccucgagagagcuuuaggucca

SEQ ID NO: 42066 - RNA, 23 nt, Artificial Sequence
  RNA Oligomer
ccacagggccuaaaauccauuuc

SEQ ID NO: 42067 - RNA, 23 nt, Artificial Sequence
  RNA Oligomer
uugugcagagagagacugucuug

SEQ ID NO: 42068 - RNA, 23 nt, Artificial Sequence
  RNA Oligomer
ugagguagcucucguuaggggug

SEQ ID NO: 42069 - RNA, 23 nt, Artificial Sequence
  RNA Oligomer
cuuaugaaugaaauaagguuucg

SEQ ID NO: 42070 - RNA, 23 nt, Artificial Sequence
  RNA Oligomer
uuaugaaugaaauaagguuucga

SEQ ID NO: 42071 - RNA, 23 nt, Artificial Sequence
  RNA Oligomer
aacuucuuguugaaaucgccaga

SEQ ID NO: 42072 - RNA, 23 nt, Artificial Sequence
  RNA Oligomer
acuucuuguugaaaucgccagaa

SEQ ID NO: 42073 - RNA, 23 nt, Artificial Sequence
  RNA Oligomer
cuucuuguugaaaucgccagaac

SEQ ID NO: 42074 - RNA, 23 nt, Artificial Sequence
  RNA Oligomer
uucuuguugaaaucgccagaacc

SEQ ID NO: 42075 - RNA, 23 nt, Artificial Sequence
  RNA Oligomer
ucuuguugaaaucgccagaaccu

SEQ ID NO: 42076 - RNA, 23 nt, Artificial Sequence
  RNA Oligomer
aaccuaauuauucuuucacaugc

SEQ ID NO: 42077 - RNA, 23 nt, Artificial Sequence
  RNA Oligomer
ucuccuuguuguaauagaaauga

SEQ ID NO: 42078 - RNA, 23 nt, Artificial Sequence
  RNA Oligomer
cuuguuguaauagaaaugaacac

SEQ ID NO: 42079 - RNA, 23 nt, Artificial Sequence
  RNA Oligomer
agaagcucuccuuguuguaauag

SEQ ID NO: 42080 - RNA, 23 nt, Artificial Sequence
  RNA Oligomer
uccuuguuguaauagaaaugaac

SEQ ID NO: 42081 - RNA, 23 nt, Artificial Sequence
  RNA Oligomer
acagauaaaaauuuauucccagc

SEQ ID NO: 42082 - RNA, 23 nt, Artificial Sequence
  RNA Oligomer
gccagaaccuaauuauucuuuca

SEQ ID NO: 42083 - RNA, 23 nt, Artificial Sequence
  RNA Oligomer
cuucccuaguaaauuauuuuguc

SEQ ID NO: 42084 - RNA, 23 nt, Artificial Sequence
  RNA Oligomer
gcuucccuaguaaauuauuuugu

SEQ ID NO: 42085 - RNA, 23 nt, Artificial Sequence
  RNA Oligomer
cgguccucugcagcaaauacuug

SEQ ID NO: 42086 - RNA, 23 nt, Artificial Sequence
  RNA Oligomer
ucaacaggccgucacaggaauuc

SEQ ID NO: 42087 - RNA, 23 nt, Artificial Sequence
  RNA Oligomer
ugagaaagaagacgaugaaaaca

SEQ ID NO: 42088 - RNA, 23 nt, Artificial Sequence
  RNA Oligomer
caguaaauguuuuuguucuguug

SEQ ID NO: 42089 - RNA, 23 nt, Artificial Sequence
  RNA Oligomer
cugcucacucauccguguuucca

SEQ ID NO: 42090 - RNA, 23 nt, Artificial Sequence
  RNA Oligomer
auguacugcccuggcgccauuuu

SEQ ID NO: 42091 - RNA, 23 nt, Artificial Sequence
  RNA Oligomer
gacauguuauuuauaagcuaagg

SEQ ID NO: 42092 - RNA, 23 nt, Artificial Sequence
  RNA Oligomer
aucccagccgguaagaaauauau

SEQ ID NO: 42093 - RNA, 23 nt, Artificial Sequence
  RNA Oligomer
uguaggcaaucugcuugaacuca

SEQ ID NO: 42094 - RNA, 23 nt, Artificial Sequence
  RNA Oligomer
auguggaugguugcauuaacagc

SEQ ID NO: 42095 - RNA, 23 nt, Artificial Sequence
  RNA Oligomer
uuccucuuaugaaugaaauaagg

SEQ ID NO: 42096 - RNA, 23 nt, Artificial Sequence
  RNA Oligomer
uugaaguguccucgagagagcuu

SEQ ID NO: 42097 - RNA, 23 nt, Artificial Sequence
  RNA Oligomer
gcauuuguaccauauagauuuca

SEQ ID NO: 42098 - RNA, 23 nt, Artificial Sequence
  RNA Oligomer
aucugucagggcaguuccaaagg

SEQ ID NO: 42099 - RNA, 23 nt, Artificial Sequence
  RNA Oligomer
uccucuuaugaaugaaauaaggu

SEQ ID NO: 42100 - RNA, 23 nt, Artificial Sequence
  RNA Oligomer
uggauguugggucguuaguaagg

SEQ ID NO: 42101 - RNA, 23 nt, Artificial Sequence
  RNA Oligomer
cccagccgguaagaaauauauga

SEQ ID NO: 42102 - RNA, 23 nt, Artificial Sequence
  RNA Oligomer
aagcucuugcaucccggcaaauc

SEQ ID NO: 42103 - RNA, 23 nt, Artificial Sequence
  RNA Oligomer
augguguguguaccagaacaacu

SEQ ID NO: 42104 - RNA, 23 nt, Artificial Sequence
  RNA Oligomer
cucaguugacgaggucaugauca

SEQ ID NO: 42105 - RNA, 23 nt, Artificial Sequence
  RNA Oligomer
gauguggaugguugcauuaacag

SEQ ID NO: 42106 - RNA, 23 nt, Artificial Sequence
  RNA Oligomer
aacaggccgucacaggaauuccu

SEQ ID NO: 42107 - RNA, 23 nt, Artificial Sequence
  RNA Oligomer
augguggagagacccucauucaa

SEQ ID NO: 42108 - RNA, 23 nt, Artificial Sequence
  RNA Oligomer
auggccaggcugagaaagaagac

SEQ ID NO: 42109 - RNA, 23 nt, Artificial Sequence
  RNA Oligomer
ugacgccugcuauuguccuuagc

SEQ ID NO: 42110 - RNA, 23 nt, Artificial Sequence
  RNA Oligomer
gacgccugcuauuguccuuagca

SEQ ID NO: 42111 - RNA, 23 nt, Artificial Sequence
  RNA Oligomer
uucccaacugggagcucauauca

SEQ ID NO: 42112 - RNA, 23 nt, Artificial Sequence
  RNA Oligomer
caacucauaggaggccugucuga

SEQ ID NO: 42113 - RNA, 23 nt, Artificial Sequence
  RNA Oligomer
accaccuugguaaugacaacuuc

SEQ ID NO: 42114 - RNA, 23 nt, Artificial Sequence
  RNA Oligomer
uaucccauaggcgaccaguuugu

SEQ ID NO: 42115 - RNA, 23 nt, Artificial Sequence
  RNA Oligomer
aaugcgccacgauguggaugguu

SEQ ID NO: 42116 - RNA, 23 nt, Artificial Sequence
  RNA Oligomer
auuuucaucccagccgguaagaa

SEQ ID NO: 42117 - RNA, 23 nt, Artificial Sequence
  RNA Oligomer
ucaccugugucuggauguugggu

SEQ ID NO: 42118 - RNA, 23 nt, Artificial Sequence
  RNA Oligomer
acaggaauuccugguggaguucu

SEQ ID NO: 42119 - RNA, 23 nt, Artificial Sequence
  RNA Oligomer
cgaucguagaaacacagaauggg

SEQ ID NO: 42120 - RNA, 23 nt, Artificial Sequence
  RNA Oligomer
gcgaucguagaaacacagaaugg

SEQ ID NO: 42121 - RNA, 23 nt, Artificial Sequence
  RNA Oligomer
agcgaucguagaaacacagaaug

SEQ ID NO: 42122 - RNA, 23 nt, Artificial Sequence
  RNA Oligomer
gagcgaucguagaaacacagaau

SEQ ID NO: 42123 - RNA, 23 nt, Artificial Sequence
  RNA Oligomer
ggagcgaucguagaaacacagaa

SEQ ID NO: 42124 - RNA, 23 nt, Artificial Sequence
  RNA Oligomer
agaaggaaguggagaguaaagac

SEQ ID NO: 42125 - RNA, 23 nt, Artificial Sequence
  RNA Oligomer
gagaaggaaguggagaguaaaga

SEQ ID NO: 42126 - RNA, 23 nt, Artificial Sequence
  RNA Oligomer
cgagaaggaaguggagaguaaag

SEQ ID NO: 42127 - RNA, 23 nt, Artificial Sequence
  RNA Oligomer
ucgagaaggaaguggagaguaaa

SEQ ID NO: 42128 - RNA, 23 nt, Artificial Sequence
  RNA Oligomer
uucgagaaggaaguggagaguaa

SEQ ID NO: 42129 - RNA, 23 nt, Artificial Sequence
  RNA Oligomer
gaucguagaaacacagaauggga

SEQ ID NO: 42130 - RNA, 23 nt, Artificial Sequence
  RNA Oligomer
cuucgagaaggaaguggagagua

SEQ ID NO: 42131 - RNA, 23 nt, Artificial Sequence
  RNA Oligomer
acuucgagaaggaaguggagagu

SEQ ID NO: 42132 - RNA, 23 nt, Artificial Sequence
  RNA Oligomer
gcaacagguuggugaaaacccug

SEQ ID NO: 42133 - RNA, 23 nt, Artificial Sequence
  RNA Oligomer
agcaacagguuggugaaaacccu

SEQ ID NO: 42134 - RNA, 23 nt, Artificial Sequence
  RNA Oligomer
gagcaacagguuggugaaaaccc

SEQ ID NO: 42135 - RNA, 23 nt, Artificial Sequence
  RNA Oligomer
cgagcaacagguuggugaaaacc

SEQ ID NO: 42136 - RNA, 23 nt, Artificial Sequence
  RNA Oligomer
gcgagcaacagguuggugaaaac

SEQ ID NO: 42137 - RNA, 23 nt, Artificial Sequence
  RNA Oligomer
uggagcgaucguagaaacacaga

SEQ ID NO: 42138 - RNA, 23 nt, Artificial Sequence
  RNA Oligomer
ggaaguggagaguaaagacagcg

SEQ ID NO: 42139 - RNA, 23 nt, Artificial Sequence
  RNA Oligomer
aggaaguggagaguaaagacagc

SEQ ID NO: 42140 - RNA, 23 nt, Artificial Sequence
  RNA Oligomer
aaggaaguggagaguaaagacag

SEQ ID NO: 42141 - RNA, 23 nt, Artificial Sequence
  RNA Oligomer
gaaggaaguggagaguaaagaca

SEQ ID NO: 42142 - RNA, 23 nt, Artificial Sequence
  RNA Oligomer
agcgagcaacagguuggugaaaa

SEQ ID NO: 42143 - RNA, 23 nt, Artificial Sequence
  RNA Oligomer
aggcggaacuuguaggaacgcgg

SEQ ID NO: 42144 - RNA, 23 nt, Artificial Sequence
  RNA Oligomer
caggcggaacuuguaggaacgcg

SEQ ID NO: 42145 - RNA, 23 nt, Artificial Sequence
  RNA Oligomer
gcaggcggaacuuguaggaacgc

SEQ ID NO: 42146 - RNA, 23 nt, Artificial Sequence
  RNA Oligomer
ggcaggcggaacuuguaggaacg

SEQ ID NO: 42147 - RNA, 23 nt, Artificial Sequence
  RNA Oligomer
cggcaggcggaacuuguaggaac

SEQ ID NO: 42148 - RNA, 23 nt, Artificial Sequence
  RNA Oligomer
ccuggagcgaucguagaaacaca

SEQ ID NO: 42149 - RNA, 23 nt, Artificial Sequence
  RNA Oligomer
gccuggagcgaucguagaaacac

SEQ ID NO: 42150 - RNA, 23 nt, Artificial Sequence
  RNA Oligomer
cgccuggagcgaucguagaaaca

SEQ ID NO: 42151 - RNA, 23 nt, Artificial Sequence
  RNA Oligomer
gcgccuggagcgaucguagaaac

SEQ ID NO: 42152 - RNA, 23 nt, Artificial Sequence
  RNA Oligomer
agcgccuggagcgaucguagaaa

SEQ ID NO: 42153 - RNA, 23 nt, Artificial Sequence
  RNA Oligomer
gaaguggagaguaaagacagcgc

SEQ ID NO: 42154 - RNA, 23 nt, Artificial Sequence
  RNA Oligomer
gagcgagcaacagguuggugaaa

SEQ ID NO: 42155 - RNA, 23 nt, Artificial Sequence
  RNA Oligomer
ggagcgagcaacagguuggugaa

SEQ ID NO: 42156 - RNA, 23 nt, Artificial Sequence
  RNA Oligomer
cccuguguccuuggagaaagcug

SEQ ID NO: 42157 - RNA, 23 nt, Artificial Sequence
  RNA Oligomer
acccuguguccuuggagaaagcu

SEQ ID NO: 42158 - RNA, 23 nt, Artificial Sequence
  RNA Oligomer
aacccuguguccuuggagaaagc

SEQ ID NO: 42159 - RNA, 23 nt, Artificial Sequence
  RNA Oligomer
aaacccuguguccuuggagaaag

SEQ ID NO: 42160 - RNA, 23 nt, Artificial Sequence
  RNA Oligomer
aaaacccuguguccuuggagaaa

SEQ ID NO: 42161 - RNA, 23 nt, Artificial Sequence
  RNA Oligomer
cuggagcgaucguagaaacacag

SEQ ID NO: 42162 - RNA, 23 nt, Artificial Sequence
  RNA Oligomer
gaaagcugguucccguuuuccag

SEQ ID NO: 42163 - RNA, 23 nt, Artificial Sequence
  RNA Oligomer
agaaagcugguucccguuuucca

SEQ ID NO: 42164 - RNA, 23 nt, Artificial Sequence
  RNA Oligomer
gagaaagcugguucccguuuucc

SEQ ID NO: 42165 - RNA, 23 nt, Artificial Sequence
  RNA Oligomer
ggagaaagcugguucccguuuuc

SEQ ID NO: 42166 - RNA, 23 nt, Artificial Sequence
  RNA Oligomer
uggagaaagcugguucccguuuu

SEQ ID NO: 42167 - RNA, 23 nt, Artificial Sequence
  RNA Oligomer
ccaaugcuauuuacauacagcuc

SEQ ID NO: 42168 - RNA, 23 nt, Artificial Sequence
  RNA Oligomer
cccaaugcuauuuacauacagcu

SEQ ID NO: 42169 - RNA, 23 nt, Artificial Sequence
  RNA Oligomer
ccccaaugcuauuuacauacagc

SEQ ID NO: 42170 - RNA, 23 nt, Artificial Sequence
  RNA Oligomer
accccaaugcuauuuacauacag

SEQ ID NO: 42171 - RNA, 23 nt, Artificial Sequence
  RNA Oligomer
caccccaaugcuauuuacauaca

SEQ ID NO: 42172 - RNA, 23 nt, Artificial Sequence
  RNA Oligomer
ccuguguccuuggagaaagcugg

SEQ ID NO: 42173 - RNA, 23 nt, Artificial Sequence
  RNA Oligomer
uccuuggagaaagcugguucccg

SEQ ID NO: 42174 - RNA, 23 nt, Artificial Sequence
  RNA Oligomer
guccuuggagaaagcugguuccc

SEQ ID NO: 42175 - RNA, 23 nt, Artificial Sequence
  RNA Oligomer
uguccuuggagaaagcugguucc

SEQ ID NO: 42176 - RNA, 23 nt, Artificial Sequence
  RNA Oligomer
guguccuuggagaaagcugguuc

SEQ ID NO: 42177 - RNA, 23 nt, Artificial Sequence
  RNA Oligomer
uguguccuuggagaaagcugguu

SEQ ID NO: 42178 - RNA, 23 nt, Artificial Sequence
  RNA Oligomer
acaccccaaugcuauuuacauac

SEQ ID NO: 42179 - RNA, 23 nt, Artificial Sequence
  RNA Oligomer
ccuuggagaaagcugguucccgu

SEQ ID NO: 42180 - RNA, 23 nt, Artificial Sequence
  RNA Oligomer
caaugcuauuuacauacagcucu

SEQ ID NO: 42181 - RNA, 23 nt, Artificial Sequence
  RNA Oligomer
ggaaauccagcugcagaaacaga

SEQ ID NO: 42182 - RNA, 23 nt, Artificial Sequence
  RNA Oligomer
uggaaauccagcugcagaaacag

SEQ ID NO: 42183 - RNA, 23 nt, Artificial Sequence
  RNA Oligomer
uuggaaauccagcugcagaaaca

SEQ ID NO: 42184 - RNA, 23 nt, Artificial Sequence
  RNA Oligomer
uuuggaaauccagcugcagaaac

SEQ ID NO: 42185 - RNA, 23 nt, Artificial Sequence
  RNA Oligomer
cuuuggaaauccagcugcagaaa

SEQ ID NO: 42186 - RNA, 23 nt, Artificial Sequence
  RNA Oligomer
cccuuuggaaauccagcugcaga

SEQ ID NO: 42187 - RNA, 23 nt, Artificial Sequence
  RNA Oligomer
gcccuuuggaaauccagcugcag

SEQ ID NO: 42188 - RNA, 23 nt, Artificial Sequence
  RNA Oligomer
agcccuuuggaaauccagcugca

SEQ ID NO: 42189 - RNA, 23 nt, Artificial Sequence
  RNA Oligomer
aagcccuuuggaaauccagcugc

SEQ ID NO: 42190 - RNA, 23 nt, Artificial Sequence
  RNA Oligomer
gaagcccuuuggaaauccagcug

SEQ ID NO: 42191 - RNA, 23 nt, Artificial Sequence
  RNA Oligomer
ggaagcccuuuggaaauccagcu

SEQ ID NO: 42192 - RNA, 23 nt, Artificial Sequence
  RNA Oligomer
gggaagcccuuuggaaauccagc

SEQ ID NO: 42193 - RNA, 23 nt, Artificial Sequence
  RNA Oligomer
ggggaagcccuuuggaaauccag

SEQ ID NO: 42194 - RNA, 23 nt, Artificial Sequence
  RNA Oligomer
uggggaagcccuuuggaaaucca

SEQ ID NO: 42195 - RNA, 23 nt, Artificial Sequence
  RNA Oligomer
cuggggaagcccuuuggaaaucc

SEQ ID NO: 42196 - RNA, 23 nt, Artificial Sequence
  RNA Oligomer
acuggggaagcccuuuggaaauc

SEQ ID NO: 42197 - RNA, 23 nt, Artificial Sequence
  RNA Oligomer
ccuuuggaaauccagcugcagaa

SEQ ID NO: 42198 - RNA, 23 nt, Artificial Sequence
  RNA Oligomer
gguuggugaaaacccuguguccu

SEQ ID NO: 42199 - RNA, 23 nt, Artificial Sequence
  RNA Oligomer
agguuggugaaaacccugugucc

SEQ ID NO: 42200 - RNA, 23 nt, Artificial Sequence
  RNA Oligomer
cagguuggugaaaacccuguguc

SEQ ID NO: 42201 - RNA, 23 nt, Artificial Sequence
  RNA Oligomer
acagguuggugaaaacccugugu

SEQ ID NO: 42202 - RNA, 23 nt, Artificial Sequence
  RNA Oligomer
aacagguuggugaaaacccugug

SEQ ID NO: 42203 - RNA, 23 nt, Artificial Sequence
  RNA Oligomer
agaguaaagacagcgccuggagc

SEQ ID NO: 42204 - RNA, 23 nt, Artificial Sequence
  RNA Oligomer
gagaguaaagacagcgccuggag

SEQ ID NO: 42205 - RNA, 23 nt, Artificial Sequence
  RNA Oligomer
ggagaguaaagacagcgccugga

SEQ ID NO: 42206 - RNA, 23 nt, Artificial Sequence
  RNA Oligomer
uggagaguaaagacagcgccugg

SEQ ID NO: 42207 - RNA, 23 nt, Artificial Sequence
  RNA Oligomer
guggagaguaaagacagcgccug

SEQ ID NO: 42208 - RNA, 23 nt, Artificial Sequence
  RNA Oligomer
ugaaaacccuguguccuuggaga

SEQ ID NO: 42209 - RNA, 23 nt, Artificial Sequence
  RNA Oligomer
gugaaaacccuguguccuuggag

SEQ ID NO: 42210 - RNA, 23 nt, Artificial Sequence
  RNA Oligomer
uggugaaaacccuguguccuugg

SEQ ID NO: 42211 - RNA, 23 nt, Artificial Sequence
  RNA Oligomer
uuggugaaaacccuguguccuug

SEQ ID NO: 42212 - RNA, 23 nt, Artificial Sequence
  RNA Oligomer
ggcacuucgagaaggaaguggag

SEQ ID NO: 42213 - RNA, 23 nt, Artificial Sequence
  RNA Oligomer
uggcacuucgagaaggaagugga

SEQ ID NO: 42214 - RNA, 23 nt, Artificial Sequence
  RNA Oligomer
uuggcacuucgagaaggaagugg

SEQ ID NO: 42215 - RNA, 23 nt, Artificial Sequence
  RNA Oligomer
guuggcacuucgagaaggaagug

SEQ ID NO: 42216 - RNA, 23 nt, Artificial Sequence
  RNA Oligomer
gguuggcacuucgagaaggaagu

SEQ ID NO: 42217 - RNA, 23 nt, Artificial Sequence
  RNA Oligomer
caacagguuggugaaaacccugu

SEQ ID NO: 42218 - RNA, 23 nt, Artificial Sequence
  RNA Oligomer
guuggugaaaacccuguguccuu

SEQ ID NO: 42219 - RNA, 23 nt, Artificial Sequence
  RNA Oligomer
ccagcugcagaaacagacacccc

SEQ ID NO: 42220 - RNA, 23 nt, Artificial Sequence
  RNA Oligomer
uccagcugcagaaacagacaccc

SEQ ID NO: 42221 - RNA, 23 nt, Artificial Sequence
  RNA Oligomer
auccagcugcagaaacagacacc

SEQ ID NO: 42222 - RNA, 23 nt, Artificial Sequence
  RNA Oligomer
aauccagcugcagaaacagacac

SEQ ID NO: 42223 - RNA, 23 nt, Artificial Sequence
  RNA Oligomer
aaauccagcugcagaaacagaca

SEQ ID NO: 42224 - RNA, 23 nt, Artificial Sequence
  RNA Oligomer
gcacuucgagaaggaaguggaga

SEQ ID NO: 42225 - RNA, 23 nt, Artificial Sequence
  RNA Oligomer
gaaaacccuguguccuuggagaa

SEQ ID NO: 42226 - RNA, 23 nt, Artificial Sequence
  RNA Oligomer
ugguucccguuuuccagaggggg

SEQ ID NO: 42227 - RNA, 23 nt, Artificial Sequence
  RNA Oligomer
cugguucccguuuuccagagggg

SEQ ID NO: 42228 - RNA, 23 nt, Artificial Sequence
  RNA Oligomer
gcugguucccguuuuccagaggg

SEQ ID NO: 42229 - RNA, 23 nt, Artificial Sequence
  RNA Oligomer
agcugguucccguuuuccagagg

SEQ ID NO: 42230 - RNA, 23 nt, Artificial Sequence
  RNA Oligomer
aagcugguucccguuuuccagag

SEQ ID NO: 42231 - RNA, 23 nt, Artificial Sequence
  RNA Oligomer
uuggagaaagcugguucccguuu

SEQ ID NO: 42232 - RNA, 23 nt, Artificial Sequence
  RNA Oligomer
augcuauuuacauacagcucuau

SEQ ID NO: 42233 - RNA, 23 nt, Artificial Sequence
  RNA Oligomer
aaugcuauuuacauacagcucua

SEQ ID NO: 42234 - RNA, 23 nt, Artificial Sequence
  RNA Oligomer
caaugcuauuuacauacagcucu

SEQ ID NO: 42235 - RNA, 23 nt, Artificial Sequence
  RNA Oligomer
ccaaugcuauuuacauacagcuc

SEQ ID NO: 42236 - RNA, 23 nt, Artificial Sequence
  RNA Oligomer
cccaaugcuauuuacauacagcu

SEQ ID NO: 42237 - RNA, 23 nt, Artificial Sequence
  RNA Oligomer
cguagaaacacagaaugggacug

SEQ ID NO: 42238 - RNA, 23 nt, Artificial Sequence
  RNA Oligomer
cccauucuguguuucuacgaucg

SEQ ID NO: 42239 - RNA, 23 nt, Artificial Sequence
  RNA Oligomer
ccauucuguguuucuacgaucgc

SEQ ID NO: 42240 - RNA, 23 nt, Artificial Sequence
  RNA Oligomer
cauucuguguuucuacgaucgcu

SEQ ID NO: 42241 - RNA, 23 nt, Artificial Sequence
  RNA Oligomer
auucuguguuucuacgaucgcuc

SEQ ID NO: 42242 - RNA, 23 nt, Artificial Sequence
  RNA Oligomer
uucuguguuucuacgaucgcucc

SEQ ID NO: 42243 - RNA, 23 nt, Artificial Sequence
  RNA Oligomer
gucuuuacucuccacuuccuucu

SEQ ID NO: 42244 - RNA, 23 nt, Artificial Sequence
  RNA Oligomer
ucuuuacucuccacuuccuucuc

SEQ ID NO: 42245 - RNA, 23 nt, Artificial Sequence
  RNA Oligomer
cuuuacucuccacuuccuucucg

SEQ ID NO: 42246 - RNA, 23 nt, Artificial Sequence
  RNA Oligomer
uuuacucuccacuuccuucucga

SEQ ID NO: 42247 - RNA, 23 nt, Artificial Sequence
  RNA Oligomer
uuacucuccacuuccuucucgaa

SEQ ID NO: 42248 - RNA, 23 nt, Artificial Sequence
  RNA Oligomer
ucccauucuguguuucuacgauc

SEQ ID NO: 42249 - RNA, 23 nt, Artificial Sequence
  RNA Oligomer
uacucuccacuuccuucucgaag

SEQ ID NO: 42250 - RNA, 23 nt, Artificial Sequence
  RNA Oligomer
acucuccacuuccuucucgaagu

SEQ ID NO: 42251 - RNA, 23 nt, Artificial Sequence
  RNA Oligomer
caggguuuucaccaaccuguugc

SEQ ID NO: 42252 - RNA, 23 nt, Artificial Sequence
  RNA Oligomer
aggguuuucaccaaccuguugcu

SEQ ID NO: 42253 - RNA, 23 nt, Artificial Sequence
  RNA Oligomer
ggguuuucaccaaccuguugcuc

SEQ ID NO: 42254 - RNA, 23 nt, Artificial Sequence
  RNA Oligomer
gguuuucaccaaccuguugcucg

SEQ ID NO: 42255 - RNA, 23 nt, Artificial Sequence
  RNA Oligomer
guuuucaccaaccuguugcucgc

SEQ ID NO: 42256 - RNA, 23 nt, Artificial Sequence
  RNA Oligomer
ucuguguuucuacgaucgcucca

SEQ ID NO: 42257 - RNA, 23 nt, Artificial Sequence
  RNA Oligomer
cgcugucuuuacucuccacuucc

SEQ ID NO: 42258 - RNA, 23 nt, Artificial Sequence
  RNA Oligomer
gcugucuuuacucuccacuuccu

SEQ ID NO: 42259 - RNA, 23 nt, Artificial Sequence
  RNA Oligomer
cugucuuuacucuccacuuccuu

SEQ ID NO: 42260 - RNA, 23 nt, Artificial Sequence
  RNA Oligomer
ugucuuuacucuccacuuccuuc

SEQ ID NO: 42261 - RNA, 23 nt, Artificial Sequence
  RNA Oligomer
uuuucaccaaccuguugcucgcu

SEQ ID NO: 42262 - RNA, 23 nt, Artificial Sequence
  RNA Oligomer
ccgcguuccuacaaguuccgccu

SEQ ID NO: 42263 - RNA, 23 nt, Artificial Sequence
  RNA Oligomer
cgcguuccuacaaguuccgccug

SEQ ID NO: 42264 - RNA, 23 nt, Artificial Sequence
  RNA Oligomer
gcguuccuacaaguuccgccugc

SEQ ID NO: 42265 - RNA, 23 nt, Artificial Sequence
  RNA Oligomer
cguuccuacaaguuccgccugcc

SEQ ID NO: 42266 - RNA, 23 nt, Artificial Sequence
  RNA Oligomer
guuccuacaaguuccgccugccg

SEQ ID NO: 42267 - RNA, 23 nt, Artificial Sequence
  RNA Oligomer
uguguuucuacgaucgcuccagg

SEQ ID NO: 42268 - RNA, 23 nt, Artificial Sequence
  RNA Oligomer
guguuucuacgaucgcuccaggc

SEQ ID NO: 42269 - RNA, 23 nt, Artificial Sequence
  RNA Oligomer
uguuucuacgaucgcuccaggcg

SEQ ID NO: 42270 - RNA, 23 nt, Artificial Sequence
  RNA Oligomer
guuucuacgaucgcuccaggcgc

SEQ ID NO: 42271 - RNA, 23 nt, Artificial Sequence
  RNA Oligomer
uuucuacgaucgcuccaggcgcu

SEQ ID NO: 42272 - RNA, 23 nt, Artificial Sequence
  RNA Oligomer
gcgcugucuuuacucuccacuuc

SEQ ID NO: 42273 - RNA, 23 nt, Artificial Sequence
  RNA Oligomer
uuucaccaaccuguugcucgcuc

SEQ ID NO: 42274 - RNA, 23 nt, Artificial Sequence
  RNA Oligomer
uucaccaaccuguugcucgcucc

SEQ ID NO: 42275 - RNA, 23 nt, Artificial Sequence
  RNA Oligomer
cagcuuucuccaaggacacaggg

SEQ ID NO: 42276 - RNA, 23 nt, Artificial Sequence
  RNA Oligomer
agcuuucuccaaggacacagggu

SEQ ID NO: 42277 - RNA, 23 nt, Artificial Sequence
  RNA Oligomer
gcuuucuccaaggacacaggguu

SEQ ID NO: 42278 - RNA, 23 nt, Artificial Sequence
  RNA Oligomer
cuuucuccaaggacacaggguuu

SEQ ID NO: 42279 - RNA, 23 nt, Artificial Sequence
  RNA Oligomer
uuucuccaaggacacaggguuuu

SEQ ID NO: 42280 - RNA, 23 nt, Artificial Sequence
  RNA Oligomer
cuguguuucuacgaucgcuccag

SEQ ID NO: 42281 - RNA, 23 nt, Artificial Sequence
  RNA Oligomer
cuggaaaacgggaaccagcuuuc

SEQ ID NO: 42282 - RNA, 23 nt, Artificial Sequence
  RNA Oligomer
uggaaaacgggaaccagcuuucu

SEQ ID NO: 42283 - RNA, 23 nt, Artificial Sequence
  RNA Oligomer
ggaaaacgggaaccagcuuucuc

SEQ ID NO: 42284 - RNA, 23 nt, Artificial Sequence
  RNA Oligomer
gaaaacgggaaccagcuuucucc

SEQ ID NO: 42285 - RNA, 23 nt, Artificial Sequence
  RNA Oligomer
aaaacgggaaccagcuuucucca

SEQ ID NO: 42286 - RNA, 23 nt, Artificial Sequence
  RNA Oligomer
gagcuguauguaaauagcauugg

SEQ ID NO: 42287 - RNA, 23 nt, Artificial Sequence
  RNA Oligomer
agcuguauguaaauagcauuggg

SEQ ID NO: 42288 - RNA, 23 nt, Artificial Sequence
  RNA Oligomer
gcuguauguaaauagcauugggg

SEQ ID NO: 42289 - RNA, 23 nt, Artificial Sequence
  RNA Oligomer
cuguauguaaauagcauuggggu

SEQ ID NO: 42290 - RNA, 23 nt, Artificial Sequence
  RNA Oligomer
uguauguaaauagcauuggggug

SEQ ID NO: 42291 - RNA, 23 nt, Artificial Sequence
  RNA Oligomer
ccagcuuucuccaaggacacagg

SEQ ID NO: 42292 - RNA, 23 nt, Artificial Sequence
  RNA Oligomer
cgggaaccagcuuucuccaagga

SEQ ID NO: 42293 - RNA, 23 nt, Artificial Sequence
  RNA Oligomer
gggaaccagcuuucuccaaggac

SEQ ID NO: 42294 - RNA, 23 nt, Artificial Sequence
  RNA Oligomer
ggaaccagcuuucuccaaggaca

SEQ ID NO: 42295 - RNA, 23 nt, Artificial Sequence
  RNA Oligomer
gaaccagcuuucuccaaggacac

SEQ ID NO: 42296 - RNA, 23 nt, Artificial Sequence
  RNA Oligomer
aaccagcuuucuccaaggacaca

SEQ ID NO: 42297 - RNA, 23 nt, Artificial Sequence
  RNA Oligomer
guauguaaauagcauuggggugu

SEQ ID NO: 42298 - RNA, 23 nt, Artificial Sequence
  RNA Oligomer
acgggaaccagcuuucuccaagg

SEQ ID NO: 42299 - RNA, 23 nt, Artificial Sequence
  RNA Oligomer
agagcuguauguaaauagcauug

SEQ ID NO: 42300 - RNA, 23 nt, Artificial Sequence
  RNA Oligomer
ucuguuucugcagcuggauuucc

SEQ ID NO: 42301 - RNA, 23 nt, Artificial Sequence
  RNA Oligomer
cuguuucugcagcuggauuucca

SEQ ID NO: 42302 - RNA, 23 nt, Artificial Sequence
  RNA Oligomer
uguuucugcagcuggauuuccaa

SEQ ID NO: 42303 - RNA, 23 nt, Artificial Sequence
  RNA Oligomer
guuucugcagcuggauuuccaaa

SEQ ID NO: 42304 - RNA, 23 nt, Artificial Sequence
  RNA Oligomer
uuucugcagcuggauuuccaaag

SEQ ID NO: 42305 - RNA, 23 nt, Artificial Sequence
  RNA Oligomer
ucugcagcuggauuuccaaaggg

SEQ ID NO: 42306 - RNA, 23 nt, Artificial Sequence
  RNA Oligomer
cugcagcuggauuuccaaagggc

SEQ ID NO: 42307 - RNA, 23 nt, Artificial Sequence
  RNA Oligomer
ugcagcuggauuuccaaagggcu

SEQ ID NO: 42308 - RNA, 23 nt, Artificial Sequence
  RNA Oligomer
gcagcuggauuuccaaagggcuu

SEQ ID NO: 42309 - RNA, 23 nt, Artificial Sequence
  RNA Oligomer
cagcuggauuuccaaagggcuuc

SEQ ID NO: 42310 - RNA, 23 nt, Artificial Sequence
  RNA Oligomer
agcuggauuuccaaagggcuucc

SEQ ID NO: 42311 - RNA, 23 nt, Artificial Sequence
  RNA Oligomer
gcuggauuuccaaagggcuuccc

SEQ ID NO: 42312 - RNA, 23 nt, Artificial Sequence
  RNA Oligomer
cuggauuuccaaagggcuucccc

SEQ ID NO: 42313 - RNA, 23 nt, Artificial Sequence
  RNA Oligomer
uggauuuccaaagggcuucccca

SEQ ID NO: 42314 - RNA, 23 nt, Artificial Sequence
  RNA Oligomer
ggauuuccaaagggcuuccccag

SEQ ID NO: 42315 - RNA, 23 nt, Artificial Sequence
  RNA Oligomer
gauuuccaaagggcuuccccagu

SEQ ID NO: 42316 - RNA, 23 nt, Artificial Sequence
  RNA Oligomer
uucugcagcuggauuuccaaagg

SEQ ID NO: 42317 - RNA, 23 nt, Artificial Sequence
  RNA Oligomer
aggacacaggguuuucaccaacc

SEQ ID NO: 42318 - RNA, 23 nt, Artificial Sequence
  RNA Oligomer
ggacacaggguuuucaccaaccu

SEQ ID NO: 42319 - RNA, 23 nt, Artificial Sequence
  RNA Oligomer
gacacaggguuuucaccaaccug

SEQ ID NO: 42320 - RNA, 23 nt, Artificial Sequence
  RNA Oligomer
acacaggguuuucaccaaccugu

SEQ ID NO: 42321 - RNA, 23 nt, Artificial Sequence
  RNA Oligomer
cacaggguuuucaccaaccuguu

SEQ ID NO: 42322 - RNA, 23 nt, Artificial Sequence
  RNA Oligomer
gcuccaggcgcugucuuuacucu

SEQ ID NO: 42323 - RNA, 23 nt, Artificial Sequence
  RNA Oligomer
cuccaggcgcugucuuuacucuc

SEQ ID NO: 42324 - RNA, 23 nt, Artificial Sequence
  RNA Oligomer
uccaggcgcugucuuuacucucc

SEQ ID NO: 42325 - RNA, 23 nt, Artificial Sequence
  RNA Oligomer
ccaggcgcugucuuuacucucca

SEQ ID NO: 42326 - RNA, 23 nt, Artificial Sequence
  RNA Oligomer
caggcgcugucuuuacucuccac

SEQ ID NO: 42327 - RNA, 23 nt, Artificial Sequence
  RNA Oligomer
ucuccaaggacacaggguuuuca

SEQ ID NO: 42328 - RNA, 23 nt, Artificial Sequence
  RNA Oligomer
cuccaaggacacaggguuuucac

SEQ ID NO: 42329 - RNA, 23 nt, Artificial Sequence
  RNA Oligomer
ccaaggacacaggguuuucacca

SEQ ID NO: 42330 - RNA, 23 nt, Artificial Sequence
  RNA Oligomer
caaggacacaggguuuucaccaa

SEQ ID NO: 42331 - RNA, 23 nt, Artificial Sequence
  RNA Oligomer
cuccacuuccuucucgaagugcc

SEQ ID NO: 42332 - RNA, 23 nt, Artificial Sequence
  RNA Oligomer
uccacuuccuucucgaagugcca

SEQ ID NO: 42333 - RNA, 23 nt, Artificial Sequence
  RNA Oligomer
ccacuuccuucucgaagugccaa

SEQ ID NO: 42334 - RNA, 23 nt, Artificial Sequence
  RNA Oligomer
cacuuccuucucgaagugccaac

SEQ ID NO: 42335 - RNA, 23 nt, Artificial Sequence
  RNA Oligomer
acuuccuucucgaagugccaacc

SEQ ID NO: 42336 - RNA, 23 nt, Artificial Sequence
  RNA Oligomer
acaggguuuucaccaaccuguug

SEQ ID NO: 42337 - RNA, 23 nt, Artificial Sequence
  RNA Oligomer
aaggacacaggguuuucaccaac

SEQ ID NO: 42338 - RNA, 23 nt, Artificial Sequence
  RNA Oligomer
ggggugucuguuucugcagcugg

SEQ ID NO: 42339 - RNA, 23 nt, Artificial Sequence
  RNA Oligomer
gggugucuguuucugcagcugga

SEQ ID NO: 42340 - RNA, 23 nt, Artificial Sequence
  RNA Oligomer
ggugucuguuucugcagcuggau

SEQ ID NO: 42341 - RNA, 23 nt, Artificial Sequence
  RNA Oligomer
gugucuguuucugcagcuggauu

SEQ ID NO: 42342 - RNA, 23 nt, Artificial Sequence
  RNA Oligomer
ugucuguuucugcagcuggauuu

SEQ ID NO: 42343 - RNA, 23 nt, Artificial Sequence
  RNA Oligomer
ucuccacuuccuucucgaagugc

SEQ ID NO: 42344 - RNA, 23 nt, Artificial Sequence
  RNA Oligomer
uucuccaaggacacaggguuuuc

SEQ ID NO: 42345 - RNA, 23 nt, Artificial Sequence
  RNA Oligomer
cccccucuggaaaacgggaacca

SEQ ID NO: 42346 - RNA, 23 nt, Artificial Sequence
  RNA Oligomer
ccccucuggaaaacgggaaccag

SEQ ID NO: 42347 - RNA, 23 nt, Artificial Sequence
  RNA Oligomer
cccucuggaaaacgggaaccagc

SEQ ID NO: 42348 - RNA, 23 nt, Artificial Sequence
  RNA Oligomer
ccucuggaaaacgggaaccagcu

SEQ ID NO: 42349 - RNA, 23 nt, Artificial Sequence
  RNA Oligomer
cucuggaaaacgggaaccagcuu

SEQ ID NO: 42350 - RNA, 23 nt, Artificial Sequence
  RNA Oligomer
aaacgggaaccagcuuucuccaa

SEQ ID NO: 42351 - RNA, 23 nt, Artificial Sequence
  RNA Oligomer
auagagcuguauguaaauagcau

SEQ ID NO: 42352 - RNA, 23 nt, Artificial Sequence
  RNA Oligomer
uagagcuguauguaaauagcauu

SEQ ID NO: 42353 - RNA, 23 nt, Artificial Sequence
  RNA Oligomer
agagcuguauguaaauagcauug

SEQ ID NO: 42354 - RNA, 23 nt, Artificial Sequence
  RNA Oligomer
gagcuguauguaaauagcauugg

SEQ ID NO: 42355 - RNA, 23 nt, Artificial Sequence
  RNA Oligomer
agcuguauguaaauagcauuggg

SEQ ID NO: 42356 - RNA, 23 nt, Artificial Sequence
  RNA Oligomer
cagucccauucuguguuucuacg

SEQ ID NO: 42357 - RNA, 23 nt, Artificial Sequence
  RNA Oligomer
ggaguacauuacuuuucuugaag

SEQ ID NO: 42358 - RNA, 23 nt, Artificial Sequence
  RNA Oligomer
aggaguacauuacuuuucuugaa

SEQ ID NO: 42359 - RNA, 23 nt, Artificial Sequence
  RNA Oligomer
caggaguacauuacuuuucuuga

SEQ ID NO: 42360 - RNA, 23 nt, Artificial Sequence
  RNA Oligomer
ccaggaguacauuacuuuucuug

SEQ ID NO: 42361 - RNA, 23 nt, Artificial Sequence
  RNA Oligomer
accaggaguacauuacuuuucuu

SEQ ID NO: 42362 - RNA, 23 nt, Artificial Sequence
  RNA Oligomer
agacaaagcuuuuguugauuucc

SEQ ID NO: 42363 - RNA, 23 nt, Artificial Sequence
  RNA Oligomer
gagacaaagcuuuuguugauuuc

SEQ ID NO: 42364 - RNA, 23 nt, Artificial Sequence
  RNA Oligomer
ggagacaaagcuuuuguugauuu

SEQ ID NO: 42365 - RNA, 23 nt, Artificial Sequence
  RNA Oligomer
cggagacaaagcuuuuguugauu

SEQ ID NO: 42366 - RNA, 23 nt, Artificial Sequence
  RNA Oligomer
acggagacaaagcuuuuguugau

SEQ ID NO: 42367 - RNA, 23 nt, Artificial Sequence
  RNA Oligomer
ccuuauaugaccaccuaauggau

SEQ ID NO: 42368 - RNA, 23 nt, Artificial Sequence
  RNA Oligomer
gccuuauaugaccaccuaaugga

SEQ ID NO: 42369 - RNA, 23 nt, Artificial Sequence
  RNA Oligomer
ggccuuauaugaccaccuaaugg

SEQ ID NO: 42370 - RNA, 23 nt, Artificial Sequence
  RNA Oligomer
gggccuuauaugaccaccuaaug

SEQ ID NO: 42371 - RNA, 23 nt, Artificial Sequence
  RNA Oligomer
ugggccuuauaugaccaccuaau

SEQ ID NO: 42372 - RNA, 23 nt, Artificial Sequence
  RNA Oligomer
gacggagacaaagcuuuuguuga

SEQ ID NO: 42373 - RNA, 23 nt, Artificial Sequence
  RNA Oligomer
cgacggagacaaagcuuuuguug

SEQ ID NO: 42374 - RNA, 23 nt, Artificial Sequence
  RNA Oligomer
ccgacggagacaaagcuuuuguu

SEQ ID NO: 42375 - RNA, 23 nt, Artificial Sequence
  RNA Oligomer
ugggacagaagcgaaauuagugc

SEQ ID NO: 42376 - RNA, 23 nt, Artificial Sequence
  RNA Oligomer
augggacagaagcgaaauuagug

SEQ ID NO: 42377 - RNA, 23 nt, Artificial Sequence
  RNA Oligomer
aaugggacagaagcgaaauuagu

SEQ ID NO: 42378 - RNA, 23 nt, Artificial Sequence
  RNA Oligomer
gaaugggacagaagcgaaauuag

SEQ ID NO: 42379 - RNA, 23 nt, Artificial Sequence
  RNA Oligomer
ugaaugggacagaagcgaaauua

SEQ ID NO: 42380 - RNA, 23 nt, Artificial Sequence
  RNA Oligomer
cugaaugggacagaagcgaaauu

SEQ ID NO: 42381 - RNA, 23 nt, Artificial Sequence
  RNA Oligomer
acugaaugggacagaagcgaaau

SEQ ID NO: 42382 - RNA, 23 nt, Artificial Sequence
  RNA Oligomer
aacugaaugggacagaagcgaaa

SEQ ID NO: 42383 - RNA, 23 nt, Artificial Sequence
  RNA Oligomer
ggacaacacuuuugcagaugagc

SEQ ID NO: 42384 - RNA, 23 nt, Artificial Sequence
  RNA Oligomer
uggacaacacuuuugcagaugag

SEQ ID NO: 42385 - RNA, 23 nt, Artificial Sequence
  RNA Oligomer
guggacaacacuuuugcagauga

SEQ ID NO: 42386 - RNA, 23 nt, Artificial Sequence
  RNA Oligomer
gguggacaacacuuuugcagaug

SEQ ID NO: 42387 - RNA, 23 nt, Artificial Sequence
  RNA Oligomer
ggguggacaacacuuuugcagau

SEQ ID NO: 42388 - RNA, 23 nt, Artificial Sequence
  RNA Oligomer
ggauacuaauuauacacucaaca

SEQ ID NO: 42389 - RNA, 23 nt, Artificial Sequence
  RNA Oligomer
aggauacuaauuauacacucaac

SEQ ID NO: 42390 - RNA, 23 nt, Artificial Sequence
  RNA Oligomer
aaggauacuaauuauacacucaa

SEQ ID NO: 42391 - RNA, 23 nt, Artificial Sequence
  RNA Oligomer
gaaggauacuaauuauacacuca

SEQ ID NO: 42392 - RNA, 23 nt, Artificial Sequence
  RNA Oligomer
ggaaggauacuaauuauacacuc

SEQ ID NO: 42393 - RNA, 23 nt, Artificial Sequence
  RNA Oligomer
ggaggaaagaaaaauucagaagc

SEQ ID NO: 42394 - RNA, 23 nt, Artificial Sequence
  RNA Oligomer
aggaggaaagaaaaauucagaag

SEQ ID NO: 42395 - RNA, 23 nt, Artificial Sequence
  RNA Oligomer
aaggaggaaagaaaaauucagaa

SEQ ID NO: 42396 - RNA, 23 nt, Artificial Sequence
  RNA Oligomer
uaaggaggaaagaaaaauucaga

SEQ ID NO: 42397 - RNA, 23 nt, Artificial Sequence
  RNA Oligomer
uuaaggaggaaagaaaaauucag

SEQ ID NO: 42398 - RNA, 23 nt, Artificial Sequence
  RNA Oligomer
cgagucugaauggaaggauacua

SEQ ID NO: 42399 - RNA, 23 nt, Artificial Sequence
  RNA Oligomer
gcgagucugaauggaaggauacu

SEQ ID NO: 42400 - RNA, 23 nt, Artificial Sequence
  RNA Oligomer
ggcgagucugaauggaaggauac

SEQ ID NO: 42401 - RNA, 23 nt, Artificial Sequence
  RNA Oligomer
uggcgagucugaauggaaggaua

SEQ ID NO: 42402 - RNA, 23 nt, Artificial Sequence
  RNA Oligomer
cuggcgagucugaauggaaggau

SEQ ID NO: 42403 - RNA, 23 nt, Artificial Sequence
  RNA Oligomer
gacaaagcuuuuguugauuuccu

SEQ ID NO: 42404 - RNA, 23 nt, Artificial Sequence
  RNA Oligomer
gggaaaaaaucacggucacuuuc

SEQ ID NO: 42405 - RNA, 23 nt, Artificial Sequence
  RNA Oligomer
ggggaaaaaaucacggucacuuu

SEQ ID NO: 42406 - RNA, 23 nt, Artificial Sequence
  RNA Oligomer
cggggaaaaaaucacggucacuu

SEQ ID NO: 42407 - RNA, 23 nt, Artificial Sequence
  RNA Oligomer
ccggggaaaaaaucacggucacu

SEQ ID NO: 42408 - RNA, 23 nt, Artificial Sequence
  RNA Oligomer
gccggggaaaaaaucacggucac

SEQ ID NO: 42409 - RNA, 23 nt, Artificial Sequence
  RNA Oligomer
caccaggaguacauuacuuuucu

SEQ ID NO: 42410 - RNA, 23 nt, Artificial Sequence
  RNA Oligomer
gcaccaggaguacauuacuuuuc

SEQ ID NO: 42411 - RNA, 23 nt, Artificial Sequence
  RNA Oligomer
agcaccaggaguacauuacuuuu

SEQ ID NO: 42412 - RNA, 23 nt, Artificial Sequence
  RNA Oligomer
gagcaccaggaguacauuacuuu

SEQ ID NO: 42413 - RNA, 23 nt, Artificial Sequence
  RNA Oligomer
ggagcaccaggaguacauuacuu

SEQ ID NO: 42414 - RNA, 23 nt, Artificial Sequence
  RNA Oligomer
cugaauggaaggauacuaauuau

SEQ ID NO: 42415 - RNA, 23 nt, Artificial Sequence
  RNA Oligomer
ucugaauggaaggauacuaauua

SEQ ID NO: 42416 - RNA, 23 nt, Artificial Sequence
  RNA Oligomer
gucugaauggaaggauacuaauu

SEQ ID NO: 42417 - RNA, 23 nt, Artificial Sequence
  RNA Oligomer
agucugaauggaaggauacuaau

SEQ ID NO: 42418 - RNA, 23 nt, Artificial Sequence
  RNA Oligomer
gagucugaauggaaggauacuaa

SEQ ID NO: 42419 - RNA, 23 nt, Artificial Sequence
  RNA Oligomer
accgacggagacaaagcuuuugu

SEQ ID NO: 42420 - RNA, 23 nt, Artificial Sequence
  RNA Oligomer
caccgacggagacaaagcuuuug

SEQ ID NO: 42421 - RNA, 23 nt, Artificial Sequence
  RNA Oligomer
acaccgacggagacaaagcuuuu

SEQ ID NO: 42422 - RNA, 23 nt, Artificial Sequence
  RNA Oligomer
cacaccgacggagacaaagcuuu

SEQ ID NO: 42423 - RNA, 23 nt, Artificial Sequence
  RNA Oligomer
cgaaauuagugcggaaaguugcc

SEQ ID NO: 42424 - RNA, 23 nt, Artificial Sequence
  RNA Oligomer
gcgaaauuagugcggaaaguugc

SEQ ID NO: 42425 - RNA, 23 nt, Artificial Sequence
  RNA Oligomer
agcgaaauuagugcggaaaguug

SEQ ID NO: 42426 - RNA, 23 nt, Artificial Sequence
  RNA Oligomer
aagcgaaauuagugcggaaaguu

SEQ ID NO: 42427 - RNA, 23 nt, Artificial Sequence
  RNA Oligomer
gaagcgaaauuagugcggaaagu

SEQ ID NO: 42428 - RNA, 23 nt, Artificial Sequence
  RNA Oligomer
ucaagaguuuugucaagagccag

SEQ ID NO: 42429 - RNA, 23 nt, Artificial Sequence
  RNA Oligomer
cucaagaguuuugucaagagcca

SEQ ID NO: 42430 - RNA, 23 nt, Artificial Sequence
  RNA Oligomer
ccucaagaguuuugucaagagcc

SEQ ID NO: 42431 - RNA, 23 nt, Artificial Sequence
  RNA Oligomer
accucaagaguuuugucaagagc

SEQ ID NO: 42432 - RNA, 23 nt, Artificial Sequence
  RNA Oligomer
gaccucaagaguuuugucaagag

SEQ ID NO: 42433 - RNA, 23 nt, Artificial Sequence
  RNA Oligomer
ugacaucaacucccaauuucgug

SEQ ID NO: 42434 - RNA, 23 nt, Artificial Sequence
  RNA Oligomer
cugacaucaacucccaauuucgu

SEQ ID NO: 42435 - RNA, 23 nt, Artificial Sequence
  RNA Oligomer
acugacaucaacucccaauuucg

SEQ ID NO: 42436 - RNA, 23 nt, Artificial Sequence
  RNA Oligomer
aacugacaucaacucccaauuuc

SEQ ID NO: 42437 - RNA, 23 nt, Artificial Sequence
  RNA Oligomer
gaacugacaucaacucccaauuu

SEQ ID NO: 42438 - RNA, 23 nt, Artificial Sequence
  RNA Oligomer
ugaacugacaucaacucccaauu

SEQ ID NO: 42439 - RNA, 23 nt, Artificial Sequence
  RNA Oligomer
cggucacuuucaacauuaacaac

SEQ ID NO: 42440 - RNA, 23 nt, Artificial Sequence
  RNA Oligomer
acggucacuuucaacauuaacaa

SEQ ID NO: 42441 - RNA, 23 nt, Artificial Sequence
  RNA Oligomer
cacggucacuuucaacauuaaca

SEQ ID NO: 42442 - RNA, 23 nt, Artificial Sequence
  RNA Oligomer
ucacggucacuuucaacauuaac

SEQ ID NO: 42443 - RNA, 23 nt, Artificial Sequence
  RNA Oligomer
aucacggucacuuucaacauuaa

SEQ ID NO: 42444 - RNA, 23 nt, Artificial Sequence
  RNA Oligomer
agaagcgaaauuagugcggaaag

SEQ ID NO: 42445 - RNA, 23 nt, Artificial Sequence
  RNA Oligomer
cagaagcgaaauuagugcggaaa

SEQ ID NO: 42446 - RNA, 23 nt, Artificial Sequence
  RNA Oligomer
ggacagaagcgaaauuagugcgg

SEQ ID NO: 42447 - RNA, 23 nt, Artificial Sequence
  RNA Oligomer
gggacagaagcgaaauuagugcg

SEQ ID NO: 42448 - RNA, 23 nt, Artificial Sequence
  RNA Oligomer
gcuuuggccagugaacaaauccu

SEQ ID NO: 42449 - RNA, 23 nt, Artificial Sequence
  RNA Oligomer
ggcuuuggccagugaacaaaucc

SEQ ID NO: 42450 - RNA, 23 nt, Artificial Sequence
  RNA Oligomer
aggcuuuggccagugaacaaauc

SEQ ID NO: 42451 - RNA, 23 nt, Artificial Sequence
  RNA Oligomer
caggcuuuggccagugaacaaau

SEQ ID NO: 42452 - RNA, 23 nt, Artificial Sequence
  RNA Oligomer
gcaggcuuuggccagugaacaaa

SEQ ID NO: 42453 - RNA, 23 nt, Artificial Sequence
  RNA Oligomer
uccugagugaugaaauuaaggag

SEQ ID NO: 42454 - RNA, 23 nt, Artificial Sequence
  RNA Oligomer
uuccugagugaugaaauuaagga

SEQ ID NO: 42455 - RNA, 23 nt, Artificial Sequence
  RNA Oligomer
uuuccugagugaugaaauuaagg

SEQ ID NO: 42456 - RNA, 23 nt, Artificial Sequence
  RNA Oligomer
auuuccugagugaugaaauuaag

SEQ ID NO: 42457 - RNA, 23 nt, Artificial Sequence
  RNA Oligomer
gauuuccugagugaugaaauuaa

SEQ ID NO: 42458 - RNA, 23 nt, Artificial Sequence
  RNA Oligomer
agaguuuugucaagagccaguag

SEQ ID NO: 42459 - RNA, 23 nt, Artificial Sequence
  RNA Oligomer
aagaguuuugucaagagccagua

SEQ ID NO: 42460 - RNA, 23 nt, Artificial Sequence
  RNA Oligomer
caagaguuuugucaagagccagu

SEQ ID NO: 42461 - RNA, 23 nt, Artificial Sequence
  RNA Oligomer
agaccucaagaguuuugucaaga

SEQ ID NO: 42462 - RNA, 23 nt, Artificial Sequence
  RNA Oligomer
aagaccucaagaguuuugucaag

SEQ ID NO: 42463 - RNA, 23 nt, Artificial Sequence
  RNA Oligomer
gaagaccucaagaguuuugucaa

SEQ ID NO: 42464 - RNA, 23 nt, Artificial Sequence
  RNA Oligomer
ugaagaccucaagaguuuuguca

SEQ ID NO: 42465 - RNA, 23 nt, Artificial Sequence
  RNA Oligomer
uggaaggauacuaauuauacacu

SEQ ID NO: 42466 - RNA, 23 nt, Artificial Sequence
  RNA Oligomer
auggaaggauacuaauuauacac

SEQ ID NO: 42467 - RNA, 23 nt, Artificial Sequence
  RNA Oligomer
aauggaaggauacuaauuauaca

SEQ ID NO: 42468 - RNA, 23 nt, Artificial Sequence
  RNA Oligomer
gaauggaaggauacuaauuauac

SEQ ID NO: 42469 - RNA, 23 nt, Artificial Sequence
  RNA Oligomer
ugaauggaaggauacuaauuaua

SEQ ID NO: 42470 - RNA, 23 nt, Artificial Sequence
  RNA Oligomer
agaaugaugauggcaagaaggcc

SEQ ID NO: 42471 - RNA, 23 nt, Artificial Sequence
  RNA Oligomer
aagaaugaugauggcaagaaggc

SEQ ID NO: 42472 - RNA, 23 nt, Artificial Sequence
  RNA Oligomer
aaagaaugaugauggcaagaagg

SEQ ID NO: 42473 - RNA, 23 nt, Artificial Sequence
  RNA Oligomer
uaaagaaugaugauggcaagaag

SEQ ID NO: 42474 - RNA, 23 nt, Artificial Sequence
  RNA Oligomer
auaaagaaugaugauggcaagaa

SEQ ID NO: 42475 - RNA, 23 nt, Artificial Sequence
  RNA Oligomer
ucgugguugaaguuauaaagaau

SEQ ID NO: 42476 - RNA, 23 nt, Artificial Sequence
  RNA Oligomer
uucgugguugaaguuauaaagaa

SEQ ID NO: 42477 - RNA, 23 nt, Artificial Sequence
  RNA Oligomer
uuucgugguugaaguuauaaaga

SEQ ID NO: 42478 - RNA, 23 nt, Artificial Sequence
  RNA Oligomer
auuucgugguugaaguuauaaag

SEQ ID NO: 42479 - RNA, 23 nt, Artificial Sequence
  RNA Oligomer
aauuucgugguugaaguuauaaa

SEQ ID NO: 42480 - RNA, 23 nt, Artificial Sequence
  RNA Oligomer
gcauaaaacccucccuaagaugu

SEQ ID NO: 42481 - RNA, 23 nt, Artificial Sequence
  RNA Oligomer
agcauaaaacccucccuaagaug

SEQ ID NO: 42482 - RNA, 23 nt, Artificial Sequence
  RNA Oligomer
aagcauaaaacccucccuaagau

SEQ ID NO: 42483 - RNA, 23 nt, Artificial Sequence
  RNA Oligomer
gaagcauaaaacccucccuaaga

SEQ ID NO: 42484 - RNA, 23 nt, Artificial Sequence
  RNA Oligomer
agaagcauaaaacccucccuaag

SEQ ID NO: 42485 - RNA, 23 nt, Artificial Sequence
  RNA Oligomer
ugaugaaauuaaggaggaaagaa

SEQ ID NO: 42486 - RNA, 23 nt, Artificial Sequence
  RNA Oligomer
gugaugaaauuaaggaggaaaga

SEQ ID NO: 42487 - RNA, 23 nt, Artificial Sequence
  RNA Oligomer
agugaugaaauuaaggaggaaag

SEQ ID NO: 42488 - RNA, 23 nt, Artificial Sequence
  RNA Oligomer
gagugaugaaauuaaggaggaaa

SEQ ID NO: 42489 - RNA, 23 nt, Artificial Sequence
  RNA Oligomer
ugagugaugaaauuaaggaggaa

SEQ ID NO: 42490 - RNA, 23 nt, Artificial Sequence
  RNA Oligomer
ccugagugaugaaauuaaggagg

SEQ ID NO: 42491 - RNA, 23 nt, Artificial Sequence
  RNA Oligomer
uugaagaccucaagaguuuuguc

SEQ ID NO: 42492 - RNA, 23 nt, Artificial Sequence
  RNA Oligomer
cuugaagaccucaagaguuuugu

SEQ ID NO: 42493 - RNA, 23 nt, Artificial Sequence
  RNA Oligomer
ucuugaagaccucaagaguuuug

SEQ ID NO: 42494 - RNA, 23 nt, Artificial Sequence
  RNA Oligomer
cuaauuauacacucaacacagau

SEQ ID NO: 42495 - RNA, 23 nt, Artificial Sequence
  RNA Oligomer
acuaauuauacacucaacacaga

SEQ ID NO: 42496 - RNA, 23 nt, Artificial Sequence
  RNA Oligomer
uacuaauuauacacucaacacag

SEQ ID NO: 42497 - RNA, 23 nt, Artificial Sequence
  RNA Oligomer
auacuaauuauacacucaacaca

SEQ ID NO: 42498 - RNA, 23 nt, Artificial Sequence
  RNA Oligomer
gauacuaauuauacacucaacac

SEQ ID NO: 42499 - RNA, 23 nt, Artificial Sequence
  RNA Oligomer
caaagcuuuuguugauuuccuga

SEQ ID NO: 42500 - RNA, 23 nt, Artificial Sequence
  RNA Oligomer
acaaagcuuuuguugauuuccug

SEQ ID NO: 42501 - RNA, 23 nt, Artificial Sequence
  RNA Oligomer
cgugguugaaguuauaaagaaug

SEQ ID NO: 42502 - RNA, 23 nt, Artificial Sequence
  RNA Oligomer
gacaucaacucccaauuucgugg

SEQ ID NO: 42503 - RNA, 23 nt, Artificial Sequence
  RNA Oligomer
gcagaagguugaagaacaggagc

SEQ ID NO: 42504 - RNA, 23 nt, Artificial Sequence
  RNA Oligomer
ggcagaagguugaagaacaggag

SEQ ID NO: 42505 - RNA, 23 nt, Artificial Sequence
  RNA Oligomer
gggcagaagguugaagaacagga

SEQ ID NO: 42506 - RNA, 23 nt, Artificial Sequence
  RNA Oligomer
agggcagaagguugaagaacagg

SEQ ID NO: 42507 - RNA, 23 nt, Artificial Sequence
  RNA Oligomer
aagggcagaagguugaagaacag

SEQ ID NO: 42508 - RNA, 23 nt, Artificial Sequence
  RNA Oligomer
ucaacauuaacaacagcauccca

SEQ ID NO: 42509 - RNA, 23 nt, Artificial Sequence
  RNA Oligomer
uucaacauuaacaacagcauccc

SEQ ID NO: 42510 - RNA, 23 nt, Artificial Sequence
  RNA Oligomer
uuucaacauuaacaacagcaucc

SEQ ID NO: 42511 - RNA, 23 nt, Artificial Sequence
  RNA Oligomer
cuuucaacauuaacaacagcauc

SEQ ID NO: 42512 - RNA, 23 nt, Artificial Sequence
  RNA Oligomer
acuuucaacauuaacaacagcau

SEQ ID NO: 42513 - RNA, 23 nt, Artificial Sequence
  RNA Oligomer
gaaaaaaucacggucacuuucaa

SEQ ID NO: 42514 - RNA, 23 nt, Artificial Sequence
  RNA Oligomer
ggaaaaaaucacggucacuuuca

SEQ ID NO: 42515 - RNA, 23 nt, Artificial Sequence
  RNA Oligomer
cagaagcauaaaacccucccuaa

SEQ ID NO: 42516 - RNA, 23 nt, Artificial Sequence
  RNA Oligomer
gaggaaagaaaaauucagaagca

SEQ ID NO: 42517 - RNA, 23 nt, Artificial Sequence
  RNA Oligomer
gaaauuaaggaggaaagaaaaau

SEQ ID NO: 42518 - RNA, 23 nt, Artificial Sequence
  RNA Oligomer
ugaaauuaaggaggaaagaaaaa

SEQ ID NO: 42519 - RNA, 23 nt, Artificial Sequence
  RNA Oligomer
augaaauuaaggaggaaagaaaa

SEQ ID NO: 42520 - RNA, 23 nt, Artificial Sequence
  RNA Oligomer
gaugaaauuaaggaggaaagaaa

SEQ ID NO: 42521 - RNA, 23 nt, Artificial Sequence
  RNA Oligomer
cugagugaugaaauuaaggagga

SEQ ID NO: 42522 - RNA, 23 nt, Artificial Sequence
  RNA Oligomer
uuacuuuucuugaagaccucaag

SEQ ID NO: 42523 - RNA, 23 nt, Artificial Sequence
  RNA Oligomer
auuacuuuucuugaagaccucaa

SEQ ID NO: 42524 - RNA, 23 nt, Artificial Sequence
  RNA Oligomer
cauuacuuuucuugaagaccuca

SEQ ID NO: 42525 - RNA, 23 nt, Artificial Sequence
  RNA Oligomer
acauuacuuuucuugaagaccuc

SEQ ID NO: 42526 - RNA, 23 nt, Artificial Sequence
  RNA Oligomer
uacauuacuuuucuugaagaccu

SEQ ID NO: 42527 - RNA, 23 nt, Artificial Sequence
  RNA Oligomer
guacauuacuuuucuugaagacc

SEQ ID NO: 42528 - RNA, 23 nt, Artificial Sequence
  RNA Oligomer
aguacauuacuuuucuugaagac

SEQ ID NO: 42529 - RNA, 23 nt, Artificial Sequence
  RNA Oligomer
ugauuuccugagugaugaaauua

SEQ ID NO: 42530 - RNA, 23 nt, Artificial Sequence
  RNA Oligomer
uugauuuccugagugaugaaauu

SEQ ID NO: 42531 - RNA, 23 nt, Artificial Sequence
  RNA Oligomer
guugauuuccugagugaugaaau

SEQ ID NO: 42532 - RNA, 23 nt, Artificial Sequence
  RNA Oligomer
uguugauuuccugagugaugaaa

SEQ ID NO: 42533 - RNA, 23 nt, Artificial Sequence
  RNA Oligomer
uuguugauuuccugagugaugaa

SEQ ID NO: 42534 - RNA, 23 nt, Artificial Sequence
  RNA Oligomer
ggguuguccuuugcaucugcacg

SEQ ID NO: 42535 - RNA, 23 nt, Artificial Sequence
  RNA Oligomer
uggguuguccuuugcaucugcac

SEQ ID NO: 42536 - RNA, 23 nt, Artificial Sequence
  RNA Oligomer
cuggguuguccuuugcaucugca

SEQ ID NO: 42537 - RNA, 23 nt, Artificial Sequence
  RNA Oligomer
ccuggguuguccuuugcaucugc

SEQ ID NO: 42538 - RNA, 23 nt, Artificial Sequence
  RNA Oligomer
gccuggguuguccuuugcaucug

SEQ ID NO: 42539 - RNA, 23 nt, Artificial Sequence
  RNA Oligomer
cuaucagggaaguuagcuuucag

SEQ ID NO: 42540 - RNA, 23 nt, Artificial Sequence
  RNA Oligomer
ucuaucagggaaguuagcuuuca

SEQ ID NO: 42541 - RNA, 23 nt, Artificial Sequence
  RNA Oligomer
cucuaucagggaaguuagcuuuc

SEQ ID NO: 42542 - RNA, 23 nt, Artificial Sequence
  RNA Oligomer
ucucuaucagggaaguuagcuuu

SEQ ID NO: 42543 - RNA, 23 nt, Artificial Sequence
  RNA Oligomer
uucucuaucagggaaguuagcuu

SEQ ID NO: 42544 - RNA, 23 nt, Artificial Sequence
  RNA Oligomer
caagggcagaagguugaagaaca

SEQ ID NO: 42545 - RNA, 23 nt, Artificial Sequence
  RNA Oligomer
aaucacggucacuuucaacauua

SEQ ID NO: 42546 - RNA, 23 nt, Artificial Sequence
  RNA Oligomer
acagaagcgaaauuagugcggaa

SEQ ID NO: 42547 - RNA, 23 nt, Artificial Sequence
  RNA Oligomer
gacagaagcgaaauuagugcgga

SEQ ID NO: 42548 - RNA, 23 nt, Artificial Sequence
  RNA Oligomer
guuuugucaagagccaguagagc

SEQ ID NO: 42549 - RNA, 23 nt, Artificial Sequence
  RNA Oligomer
aguuuugucaagagccaguagag

SEQ ID NO: 42550 - RNA, 23 nt, Artificial Sequence
  RNA Oligomer
gaguuuugucaagagccaguaga

SEQ ID NO: 42551 - RNA, 23 nt, Artificial Sequence
  RNA Oligomer
gaguacauuacuuuucuugaaga

SEQ ID NO: 42552 - RNA, 23 nt, Artificial Sequence
  RNA Oligomer
acuggcgagucugaauggaagga

SEQ ID NO: 42553 - RNA, 23 nt, Artificial Sequence
  RNA Oligomer
ucagggaaguuagcuuucagucc

SEQ ID NO: 42554 - RNA, 23 nt, Artificial Sequence
  RNA Oligomer
aucagggaaguuagcuuucaguc

SEQ ID NO: 42555 - RNA, 23 nt, Artificial Sequence
  RNA Oligomer
uaucagggaaguuagcuuucagu

SEQ ID NO: 42556 - RNA, 23 nt, Artificial Sequence
  RNA Oligomer
ggcugagagugacaucuucucua

SEQ ID NO: 42557 - RNA, 23 nt, Artificial Sequence
  RNA Oligomer
aggcugagagugacaucuucucu

SEQ ID NO: 42558 - RNA, 23 nt, Artificial Sequence
  RNA Oligomer
gaggcugagagugacaucuucuc

SEQ ID NO: 42559 - RNA, 23 nt, Artificial Sequence
  RNA Oligomer
cgaggcugagagugacaucuucu

SEQ ID NO: 42560 - RNA, 23 nt, Artificial Sequence
  RNA Oligomer
acgaggcugagagugacaucuuc

SEQ ID NO: 42561 - RNA, 23 nt, Artificial Sequence
  RNA Oligomer
gaaugaugauggcaagaaggccc

SEQ ID NO: 42562 - RNA, 23 nt, Artificial Sequence
  RNA Oligomer
uauaaagaaugaugauggcaaga

SEQ ID NO: 42563 - RNA, 23 nt, Artificial Sequence
  RNA Oligomer
uuauaaagaaugaugauggcaag

SEQ ID NO: 42564 - RNA, 23 nt, Artificial Sequence
  RNA Oligomer
guuauaaagaaugaugauggcaa

SEQ ID NO: 42565 - RNA, 23 nt, Artificial Sequence
  RNA Oligomer
gugguugaaguuauaaagaauga

SEQ ID NO: 42566 - RNA, 23 nt, Artificial Sequence
  RNA Oligomer
caauuucgugguugaaguuauaa

SEQ ID NO: 42567 - RNA, 23 nt, Artificial Sequence
  RNA Oligomer
ccaauuucgugguugaaguuaua

SEQ ID NO: 42568 - RNA, 23 nt, Artificial Sequence
  RNA Oligomer
cccaauuucgugguugaaguuau

SEQ ID NO: 42569 - RNA, 23 nt, Artificial Sequence
  RNA Oligomer
ucccaauuucgugguugaaguua

SEQ ID NO: 42570 - RNA, 23 nt, Artificial Sequence
  RNA Oligomer
cucccaauuucgugguugaaguu

SEQ ID NO: 42571 - RNA, 23 nt, Artificial Sequence
  RNA Oligomer
aaaucacggucacuuucaacauu

SEQ ID NO: 42572 - RNA, 23 nt, Artificial Sequence
  RNA Oligomer
gugcuuugaaaugauuaucaucc

SEQ ID NO: 42573 - RNA, 23 nt, Artificial Sequence
  RNA Oligomer
ugugcuuugaaaugauuaucauc

SEQ ID NO: 42574 - RNA, 23 nt, Artificial Sequence
  RNA Oligomer
augugcuuugaaaugauuaucau

SEQ ID NO: 42575 - RNA, 23 nt, Artificial Sequence
  RNA Oligomer
caugugcuuugaaaugauuauca

SEQ ID NO: 42576 - RNA, 23 nt, Artificial Sequence
  RNA Oligomer
acaugugcuuugaaaugauuauc

SEQ ID NO: 42577 - RNA, 23 nt, Artificial Sequence
  RNA Oligomer
cuagacaugugcuuugaaaugau

SEQ ID NO: 42578 - RNA, 23 nt, Artificial Sequence
  RNA Oligomer
gcuagacaugugcuuugaaauga

SEQ ID NO: 42579 - RNA, 23 nt, Artificial Sequence
  RNA Oligomer
agcuagacaugugcuuugaaaug

SEQ ID NO: 42580 - RNA, 23 nt, Artificial Sequence
  RNA Oligomer
aagcuagacaugugcuuugaaau

SEQ ID NO: 42581 - RNA, 23 nt, Artificial Sequence
  RNA Oligomer
gaagcuagacaugugcuuugaaa

SEQ ID NO: 42582 - RNA, 23 nt, Artificial Sequence
  RNA Oligomer
uucuugaagaccucaagaguuuu

SEQ ID NO: 42583 - RNA, 23 nt, Artificial Sequence
  RNA Oligomer
uuucuugaagaccucaagaguuu

SEQ ID NO: 42584 - RNA, 23 nt, Artificial Sequence
  RNA Oligomer
acaacacuuuugcagaugagcug

SEQ ID NO: 42585 - RNA, 23 nt, Artificial Sequence
  RNA Oligomer
gacaacacuuuugcagaugagcu

SEQ ID NO: 42586 - RNA, 23 nt, Artificial Sequence
  RNA Oligomer
caucuucucuaucagggaaguua

SEQ ID NO: 42587 - RNA, 23 nt, Artificial Sequence
  RNA Oligomer
acaucuucucuaucagggaaguu

SEQ ID NO: 42588 - RNA, 23 nt, Artificial Sequence
  RNA Oligomer
gacaucuucucuaucagggaagu

SEQ ID NO: 42589 - RNA, 23 nt, Artificial Sequence
  RNA Oligomer
ugacaucuucucuaucagggaag

SEQ ID NO: 42590 - RNA, 23 nt, Artificial Sequence
  RNA Oligomer
gugacaucuucucuaucagggaa

SEQ ID NO: 42591 - RNA, 23 nt, Artificial Sequence
  RNA Oligomer
gaaauuagugcggaaaguugccg

SEQ ID NO: 42592 - RNA, 23 nt, Artificial Sequence
  RNA Oligomer
caacacuuuugcagaugagcugg

SEQ ID NO: 42593 - RNA, 23 nt, Artificial Sequence
  RNA Oligomer
acacucaacacagauuccuugga

SEQ ID NO: 42594 - RNA, 23 nt, Artificial Sequence
  RNA Oligomer
uacacucaacacagauuccuugg

SEQ ID NO: 42595 - RNA, 23 nt, Artificial Sequence
  RNA Oligomer
auacacucaacacagauuccuug

SEQ ID NO: 42596 - RNA, 23 nt, Artificial Sequence
  RNA Oligomer
uauacacucaacacagauuccuu

SEQ ID NO: 42597 - RNA, 23 nt, Artificial Sequence
  RNA Oligomer
uuauacacucaacacagauuccu

SEQ ID NO: 42598 - RNA, 23 nt, Artificial Sequence
  RNA Oligomer
cacuggcgagucugaauggaagg

SEQ ID NO: 42599 - RNA, 23 nt, Artificial Sequence
  RNA Oligomer
ccacuggcgagucugaauggaag

SEQ ID NO: 42600 - RNA, 23 nt, Artificial Sequence
  RNA Oligomer
uccacuggcgagucugaauggaa

SEQ ID NO: 42601 - RNA, 23 nt, Artificial Sequence
  RNA Oligomer
cagggaaguuagcuuucagucca

SEQ ID NO: 42602 - RNA, 23 nt, Artificial Sequence
  RNA Oligomer
agcuuuuguugauuuccugagug

SEQ ID NO: 42603 - RNA, 23 nt, Artificial Sequence
  RNA Oligomer
aagcuuuuguugauuuccugagu

SEQ ID NO: 42604 - RNA, 23 nt, Artificial Sequence
  RNA Oligomer
aaagcuuuuguugauuuccugag

SEQ ID NO: 42605 - RNA, 23 nt, Artificial Sequence
  RNA Oligomer
cuucucuaucagggaaguuagcu

SEQ ID NO: 42606 - RNA, 23 nt, Artificial Sequence
  RNA Oligomer
ucuucucuaucagggaaguuagc

SEQ ID NO: 42607 - RNA, 23 nt, Artificial Sequence
  RNA Oligomer
aucuucucuaucagggaaguuag

SEQ ID NO: 42608 - RNA, 23 nt, Artificial Sequence
  RNA Oligomer
gacgaggcugagagugacaucuu

SEQ ID NO: 42609 - RNA, 23 nt, Artificial Sequence
  RNA Oligomer
agacgaggcugagagugacaucu

SEQ ID NO: 42610 - RNA, 23 nt, Artificial Sequence
  RNA Oligomer
aagacgaggcugagagugacauc

SEQ ID NO: 42611 - RNA, 23 nt, Artificial Sequence
  RNA Oligomer
gaagacgaggcugagagugacau

SEQ ID NO: 42612 - RNA, 23 nt, Artificial Sequence
  RNA Oligomer
gaagguugaagaacaggagccug

SEQ ID NO: 42613 - RNA, 23 nt, Artificial Sequence
  RNA Oligomer
agaagguugaagaacaggagccu

SEQ ID NO: 42614 - RNA, 23 nt, Artificial Sequence
  RNA Oligomer
cagaagguugaagaacaggagcc

SEQ ID NO: 42615 - RNA, 23 nt, Artificial Sequence
  RNA Oligomer
aaaaucacggucacuuucaacau

SEQ ID NO: 42616 - RNA, 23 nt, Artificial Sequence
  RNA Oligomer
aaaaaucacggucacuuucaaca

SEQ ID NO: 42617 - RNA, 23 nt, Artificial Sequence
  RNA Oligomer
aaaaaaucacggucacuuucaac

SEQ ID NO: 42618 - RNA, 23 nt, Artificial Sequence
  RNA Oligomer
ggaacugaaugggacagaagcga

SEQ ID NO: 42619 - RNA, 23 nt, Artificial Sequence
  RNA Oligomer
uggaacugaaugggacagaagcg

SEQ ID NO: 42620 - RNA, 23 nt, Artificial Sequence
  RNA Oligomer
cuggaacugaaugggacagaagc

SEQ ID NO: 42621 - RNA, 23 nt, Artificial Sequence
  RNA Oligomer
gcuggaacugaaugggacagaag

SEQ ID NO: 42622 - RNA, 23 nt, Artificial Sequence
  RNA Oligomer
agcuggaacugaaugggacagaa

SEQ ID NO: 42623 - RNA, 23 nt, Artificial Sequence
  RNA Oligomer
guugggagcuggaacugaauggg

SEQ ID NO: 42624 - RNA, 23 nt, Artificial Sequence
  RNA Oligomer
gguugggagcuggaacugaaugg

SEQ ID NO: 42625 - RNA, 23 nt, Artificial Sequence
  RNA Oligomer
agguugggagcuggaacugaaug

SEQ ID NO: 42626 - RNA, 23 nt, Artificial Sequence
  RNA Oligomer
gagguugggagcuggaacugaau

SEQ ID NO: 42627 - RNA, 23 nt, Artificial Sequence
  RNA Oligomer
ggagguugggagcuggaacugaa

SEQ ID NO: 42628 - RNA, 23 nt, Artificial Sequence
  RNA Oligomer
cuacucugaagcuagacaugugc

SEQ ID NO: 42629 - RNA, 23 nt, Artificial Sequence
  RNA Oligomer
ccuacucugaagcuagacaugug

SEQ ID NO: 42630 - RNA, 23 nt, Artificial Sequence
  RNA Oligomer
uccuacucugaagcuagacaugu

SEQ ID NO: 42631 - RNA, 23 nt, Artificial Sequence
  RNA Oligomer
auccuacucugaagcuagacaug

SEQ ID NO: 42632 - RNA, 23 nt, Artificial Sequence
  RNA Oligomer
aauccuacucugaagcuagacau

SEQ ID NO: 42633 - RNA, 23 nt, Artificial Sequence
  RNA Oligomer
gaaguuagcuuucaguccacugg

SEQ ID NO: 42634 - RNA, 23 nt, Artificial Sequence
  RNA Oligomer
ggaaguuagcuuucaguccacug

SEQ ID NO: 42635 - RNA, 23 nt, Artificial Sequence
  RNA Oligomer
gggaaguuagcuuucaguccacu

SEQ ID NO: 42636 - RNA, 23 nt, Artificial Sequence
  RNA Oligomer
agggaaguuagcuuucaguccac

SEQ ID NO: 42637 - RNA, 23 nt, Artificial Sequence
  RNA Oligomer
ugagguuggacaagaagacgagg

SEQ ID NO: 42638 - RNA, 23 nt, Artificial Sequence
  RNA Oligomer
augagguuggacaagaagacgag

SEQ ID NO: 42639 - RNA, 23 nt, Artificial Sequence
  RNA Oligomer
gaugagguuggacaagaagacga

SEQ ID NO: 42640 - RNA, 23 nt, Artificial Sequence
  RNA Oligomer
ggaugagguuggacaagaagacg

SEQ ID NO: 42641 - RNA, 23 nt, Artificial Sequence
  RNA Oligomer
aggaugagguuggacaagaagac

SEQ ID NO: 42642 - RNA, 23 nt, Artificial Sequence
  RNA Oligomer
caacauuugauggugaggaggaa

SEQ ID NO: 42643 - RNA, 23 nt, Artificial Sequence
  RNA Oligomer
ccaacauuugauggugaggagga

SEQ ID NO: 42644 - RNA, 23 nt, Artificial Sequence
  RNA Oligomer
accaacauuugauggugaggagg

SEQ ID NO: 42645 - RNA, 23 nt, Artificial Sequence
  RNA Oligomer
caccaacauuugauggugaggag

SEQ ID NO: 42646 - RNA, 23 nt, Artificial Sequence
  RNA Oligomer
ccaccaacauuugauggugagga

SEQ ID NO: 42647 - RNA, 23 nt, Artificial Sequence
  RNA Oligomer
auaguuucauggcaggcuuuggc

SEQ ID NO: 42648 - RNA, 23 nt, Artificial Sequence
  RNA Oligomer
cauaguuucauggcaggcuuugg

SEQ ID NO: 42649 - RNA, 23 nt, Artificial Sequence
  RNA Oligomer
ccauaguuucauggcaggcuuug

SEQ ID NO: 42650 - RNA, 23 nt, Artificial Sequence
  RNA Oligomer
gccauaguuucauggcaggcuuu

SEQ ID NO: 42651 - RNA, 23 nt, Artificial Sequence
  RNA Oligomer
agccauaguuucauggcaggcuu

SEQ ID NO: 42652 - RNA, 23 nt, Artificial Sequence
  RNA Oligomer
gccaguagagcagacagaugcug

SEQ ID NO: 42653 - RNA, 23 nt, Artificial Sequence
  RNA Oligomer
agccaguagagcagacagaugcu

SEQ ID NO: 42654 - RNA, 23 nt, Artificial Sequence
  RNA Oligomer
gagccaguagagcagacagaugc

SEQ ID NO: 42655 - RNA, 23 nt, Artificial Sequence
  RNA Oligomer
agagccaguagagcagacagaug

SEQ ID NO: 42656 - RNA, 23 nt, Artificial Sequence
  RNA Oligomer
aagagccaguagagcagacagau

SEQ ID NO: 42657 - RNA, 23 nt, Artificial Sequence
  RNA Oligomer
ccuaauggauuuccuugccgacc

SEQ ID NO: 42658 - RNA, 23 nt, Artificial Sequence
  RNA Oligomer
accuaauggauuuccuugccgac

SEQ ID NO: 42659 - RNA, 23 nt, Artificial Sequence
  RNA Oligomer
caccuaauggauuuccuugccga

SEQ ID NO: 42660 - RNA, 23 nt, Artificial Sequence
  RNA Oligomer
ccaccuaauggauuuccuugccg

SEQ ID NO: 42661 - RNA, 23 nt, Artificial Sequence
  RNA Oligomer
accaccuaauggauuuccuugcc

SEQ ID NO: 42662 - RNA, 23 nt, Artificial Sequence
  RNA Oligomer
ucaacacagauuccuuggacugg

SEQ ID NO: 42663 - RNA, 23 nt, Artificial Sequence
  RNA Oligomer
cucaacacagauuccuuggacug

SEQ ID NO: 42664 - RNA, 23 nt, Artificial Sequence
  RNA Oligomer
acucaacacagauuccuuggacu

SEQ ID NO: 42665 - RNA, 23 nt, Artificial Sequence
  RNA Oligomer
cacucaacacagauuccuuggac

SEQ ID NO: 42666 - RNA, 23 nt, Artificial Sequence
  RNA Oligomer
gacaagaagacgaggcugagagu

SEQ ID NO: 42667 - RNA, 23 nt, Artificial Sequence
  RNA Oligomer
ggacaagaagacgaggcugagag

SEQ ID NO: 42668 - RNA, 23 nt, Artificial Sequence
  RNA Oligomer
uggacaagaagacgaggcugaga

SEQ ID NO: 42669 - RNA, 23 nt, Artificial Sequence
  RNA Oligomer
uuggacaagaagacgaggcugag

SEQ ID NO: 42670 - RNA, 23 nt, Artificial Sequence
  RNA Oligomer
guuggacaagaagacgaggcuga

SEQ ID NO: 42671 - RNA, 23 nt, Artificial Sequence
  RNA Oligomer
gguuggacaagaagacgaggcug

SEQ ID NO: 42672 - RNA, 23 nt, Artificial Sequence
  RNA Oligomer
agguuggacaagaagacgaggcu

SEQ ID NO: 42673 - RNA, 23 nt, Artificial Sequence
  RNA Oligomer
gagguuggacaagaagacgaggc

SEQ ID NO: 42674 - RNA, 23 nt, Artificial Sequence
  RNA Oligomer
guguuggacugucauuauccaga

SEQ ID NO: 42675 - RNA, 23 nt, Artificial Sequence
  RNA Oligomer
uguguuggacugucauuauccag

SEQ ID NO: 42676 - RNA, 23 nt, Artificial Sequence
  RNA Oligomer
uuguguuggacugucauuaucca

SEQ ID NO: 42677 - RNA, 23 nt, Artificial Sequence
  RNA Oligomer
cuuguguuggacugucauuaucc

SEQ ID NO: 42678 - RNA, 23 nt, Artificial Sequence
  RNA Oligomer
ccuuguguuggacugucauuauc

SEQ ID NO: 42679 - RNA, 23 nt, Artificial Sequence
  RNA Oligomer
gguugaagaacaggagccugaac

SEQ ID NO: 42680 - RNA, 23 nt, Artificial Sequence
  RNA Oligomer
agguugaagaacaggagccugaa

SEQ ID NO: 42681 - RNA, 23 nt, Artificial Sequence
  RNA Oligomer
aagguugaagaacaggagccuga

SEQ ID NO: 42682 - RNA, 23 nt, Artificial Sequence
  RNA Oligomer
gcaagggcagaagguugaagaac

SEQ ID NO: 42683 - RNA, 23 nt, Artificial Sequence
  RNA Oligomer
ggaaagaaaaauucagaagcaua

SEQ ID NO: 42684 - RNA, 23 nt, Artificial Sequence
  RNA Oligomer
aggaaagaaaaauucagaagcau

SEQ ID NO: 42685 - RNA, 23 nt, Artificial Sequence
  RNA Oligomer
gacaugugcuuugaaaugauuau

SEQ ID NO: 42686 - RNA, 23 nt, Artificial Sequence
  RNA Oligomer
agacaugugcuuugaaaugauua

SEQ ID NO: 42687 - RNA, 23 nt, Artificial Sequence
  RNA Oligomer
uagacaugugcuuugaaaugauu

SEQ ID NO: 42688 - RNA, 23 nt, Artificial Sequence
  RNA Oligomer
ugaagcuagacaugugcuuugaa

SEQ ID NO: 42689 - RNA, 23 nt, Artificial Sequence
  RNA Oligomer
ccaguagagcagacagaugcuga

SEQ ID NO: 42690 - RNA, 23 nt, Artificial Sequence
  RNA Oligomer
gggguggacaacacuuuugcaga

SEQ ID NO: 42691 - RNA, 23 nt, Artificial Sequence
  RNA Oligomer
agggguggacaacacuuuugcag

SEQ ID NO: 42692 - RNA, 23 nt, Artificial Sequence
  RNA Oligomer
agaggaugagguuggacaagaag

SEQ ID NO: 42693 - RNA, 23 nt, Artificial Sequence
  RNA Oligomer
cagaggaugagguuggacaagaa

SEQ ID NO: 42694 - RNA, 23 nt, Artificial Sequence
  RNA Oligomer
ccagaggaugagguuggacaaga

SEQ ID NO: 42695 - RNA, 23 nt, Artificial Sequence
  RNA Oligomer
uccagaggaugagguuggacaag

SEQ ID NO: 42696 - RNA, 23 nt, Artificial Sequence
  RNA Oligomer
auccagaggaugagguuggacaa

SEQ ID NO: 42697 - RNA, 23 nt, Artificial Sequence
  RNA Oligomer
cccuuguguuggacugucauuau

SEQ ID NO: 42698 - RNA, 23 nt, Artificial Sequence
  RNA Oligomer
gcccuuguguuggacugucauua

SEQ ID NO: 42699 - RNA, 23 nt, Artificial Sequence
  RNA Oligomer
ggcccuuguguuggacugucauu

SEQ ID NO: 42700 - RNA, 23 nt, Artificial Sequence
  RNA Oligomer
aggcccuuguguuggacugucau

SEQ ID NO: 42701 - RNA, 23 nt, Artificial Sequence
  RNA Oligomer
cacuuucaacauuaacaacagca

SEQ ID NO: 42702 - RNA, 23 nt, Artificial Sequence
  RNA Oligomer
ucacuuucaacauuaacaacagc

SEQ ID NO: 42703 - RNA, 23 nt, Artificial Sequence
  RNA Oligomer
gucacuuucaacauuaacaacag

SEQ ID NO: 42704 - RNA, 23 nt, Artificial Sequence
  RNA Oligomer
caucccaccaacauuugauggug

SEQ ID NO: 42705 - RNA, 23 nt, Artificial Sequence
  RNA Oligomer
gcaucccaccaacauuugauggu

SEQ ID NO: 42706 - RNA, 23 nt, Artificial Sequence
  RNA Oligomer
agcaucccaccaacauuugaugg

SEQ ID NO: 42707 - RNA, 23 nt, Artificial Sequence
  RNA Oligomer
cagcaucccaccaacauuugaug

SEQ ID NO: 42708 - RNA, 23 nt, Artificial Sequence
  RNA Oligomer
acagcaucccaccaacauuugau

SEQ ID NO: 42709 - RNA, 23 nt, Artificial Sequence
  RNA Oligomer
aacagcaucccaccaacauuuga

SEQ ID NO: 42710 - RNA, 23 nt, Artificial Sequence
  RNA Oligomer
aaauccuacucugaagcuagaca

SEQ ID NO: 42711 - RNA, 23 nt, Artificial Sequence
  RNA Oligomer
caaauccuacucugaagcuagac

SEQ ID NO: 42712 - RNA, 23 nt, Artificial Sequence
  RNA Oligomer
acaaauccuacucugaagcuaga

SEQ ID NO: 42713 - RNA, 23 nt, Artificial Sequence
  RNA Oligomer
aacaaauccuacucugaagcuag

SEQ ID NO: 42714 - RNA, 23 nt, Artificial Sequence
  RNA Oligomer
gaacaaauccuacucugaagcua

SEQ ID NO: 42715 - RNA, 23 nt, Artificial Sequence
  RNA Oligomer
gaggaugagguuggacaagaaga

SEQ ID NO: 42716 - RNA, 23 nt, Artificial Sequence
  RNA Oligomer
cucugaagcuagacaugugcuuu

SEQ ID NO: 42717 - RNA, 23 nt, Artificial Sequence
  RNA Oligomer
acucugaagcuagacaugugcuu

SEQ ID NO: 42718 - RNA, 23 nt, Artificial Sequence
  RNA Oligomer
uacucugaagcuagacaugugcu

SEQ ID NO: 42719 - RNA, 23 nt, Artificial Sequence
  RNA Oligomer
gaccaccuaauggauuuccuugc

SEQ ID NO: 42720 - RNA, 23 nt, Artificial Sequence
  RNA Oligomer
ugaccaccuaauggauuuccuug

SEQ ID NO: 42721 - RNA, 23 nt, Artificial Sequence
  RNA Oligomer
augaccaccuaauggauuuccuu

SEQ ID NO: 42722 - RNA, 23 nt, Artificial Sequence
  RNA Oligomer
cugggccuuauaugaccaccuaa

SEQ ID NO: 42723 - RNA, 23 nt, Artificial Sequence
  RNA Oligomer
acugggccuuauaugaccaccua

SEQ ID NO: 42724 - RNA, 23 nt, Artificial Sequence
  RNA Oligomer
ggccagugaacaaauccuacucu

SEQ ID NO: 42725 - RNA, 23 nt, Artificial Sequence
  RNA Oligomer
uggccagugaacaaauccuacuc

SEQ ID NO: 42726 - RNA, 23 nt, Artificial Sequence
  RNA Oligomer
uuggccagugaacaaauccuacu

SEQ ID NO: 42727 - RNA, 23 nt, Artificial Sequence
  RNA Oligomer
uuuggccagugaacaaauccuac

SEQ ID NO: 42728 - RNA, 23 nt, Artificial Sequence
  RNA Oligomer
cuuuggccagugaacaaauccua

SEQ ID NO: 42729 - RNA, 23 nt, Artificial Sequence
  RNA Oligomer
uaugaccaccuaauggauuuccu

SEQ ID NO: 42730 - RNA, 23 nt, Artificial Sequence
  RNA Oligomer
auaugaccaccuaauggauuucc

SEQ ID NO: 42731 - RNA, 23 nt, Artificial Sequence
  RNA Oligomer
uauaugaccaccuaauggauuuc

SEQ ID NO: 42732 - RNA, 23 nt, Artificial Sequence
  RNA Oligomer
uuauaugaccaccuaauggauuu

SEQ ID NO: 42733 - RNA, 23 nt, Artificial Sequence
  RNA Oligomer
gaaagaaaaauucagaagcauaa

SEQ ID NO: 42734 - RNA, 23 nt, Artificial Sequence
  RNA Oligomer
uggagcaccaggaguacauuacu

SEQ ID NO: 42735 - RNA, 23 nt, Artificial Sequence
  RNA Oligomer
cuggagcaccaggaguacauuac

SEQ ID NO: 42736 - RNA, 23 nt, Artificial Sequence
  RNA Oligomer
ccuggagcaccaggaguacauua

SEQ ID NO: 42737 - RNA, 23 nt, Artificial Sequence
  RNA Oligomer
cccuggagcaccaggaguacauu

SEQ ID NO: 42738 - RNA, 23 nt, Artificial Sequence
  RNA Oligomer
ggacugucauuauccagaggaug

SEQ ID NO: 42739 - RNA, 23 nt, Artificial Sequence
  RNA Oligomer
uggacugucauuauccagaggau

SEQ ID NO: 42740 - RNA, 23 nt, Artificial Sequence
  RNA Oligomer
uuggacugucauuauccagagga

SEQ ID NO: 42741 - RNA, 23 nt, Artificial Sequence
  RNA Oligomer
guuggacugucauuauccagagg

SEQ ID NO: 42742 - RNA, 23 nt, Artificial Sequence
  RNA Oligomer
uguuggacugucauuauccagag

SEQ ID NO: 42743 - RNA, 23 nt, Artificial Sequence
  RNA Oligomer
acucccaauuucgugguugaagu

SEQ ID NO: 42744 - RNA, 23 nt, Artificial Sequence
  RNA Oligomer
aacucccaauuucgugguugaag

SEQ ID NO: 42745 - RNA, 23 nt, Artificial Sequence
  RNA Oligomer
caacucccaauuucgugguugaa

SEQ ID NO: 42746 - RNA, 23 nt, Artificial Sequence
  RNA Oligomer
ucaacucccaauuucgugguuga

SEQ ID NO: 42747 - RNA, 23 nt, Artificial Sequence
  RNA Oligomer
gagccugaacugacaucaacucc

SEQ ID NO: 42748 - RNA, 23 nt, Artificial Sequence
  RNA Oligomer
ggagccugaacugacaucaacuc

SEQ ID NO: 42749 - RNA, 23 nt, Artificial Sequence
  RNA Oligomer
aggagccugaacugacaucaacu

SEQ ID NO: 42750 - RNA, 23 nt, Artificial Sequence
  RNA Oligomer
caggagccugaacugacaucaac

SEQ ID NO: 42751 - RNA, 23 nt, Artificial Sequence
  RNA Oligomer
acaggagccugaacugacaucaa

SEQ ID NO: 42752 - RNA, 23 nt, Artificial Sequence
  RNA Oligomer
ccagugaacaaauccuacucuga

SEQ ID NO: 42753 - RNA, 23 nt, Artificial Sequence
  RNA Oligomer
gccagugaacaaauccuacucug

SEQ ID NO: 42754 - RNA, 23 nt, Artificial Sequence
  RNA Oligomer
gacagaugcugaaagccauaguu

SEQ ID NO: 42755 - RNA, 23 nt, Artificial Sequence
  RNA Oligomer
agacagaugcugaaagccauagu

SEQ ID NO: 42756 - RNA, 23 nt, Artificial Sequence
  RNA Oligomer
cagacagaugcugaaagccauag

SEQ ID NO: 42757 - RNA, 23 nt, Artificial Sequence
  RNA Oligomer
gcagacagaugcugaaagccaua

SEQ ID NO: 42758 - RNA, 23 nt, Artificial Sequence
  RNA Oligomer
agcagacagaugcugaaagccau

SEQ ID NO: 42759 - RNA, 23 nt, Artificial Sequence
  RNA Oligomer
gacugggccuuauaugaccaccu

SEQ ID NO: 42760 - RNA, 23 nt, Artificial Sequence
  RNA Oligomer
ggucacuuucaacauuaacaaca

SEQ ID NO: 42761 - RNA, 23 nt, Artificial Sequence
  RNA Oligomer
gcccuggagcaccaggaguacau

SEQ ID NO: 42762 - RNA, 23 nt, Artificial Sequence
  RNA Oligomer
agagugacaucuucucuaucagg

SEQ ID NO: 42763 - RNA, 23 nt, Artificial Sequence
  RNA Oligomer
gagagugacaucuucucuaucag

SEQ ID NO: 42764 - RNA, 23 nt, Artificial Sequence
  RNA Oligomer
ugagagugacaucuucucuauca

SEQ ID NO: 42765 - RNA, 23 nt, Artificial Sequence
  RNA Oligomer
cugagagugacaucuucucuauc

SEQ ID NO: 42766 - RNA, 23 nt, Artificial Sequence
  RNA Oligomer
gcugagagugacaucuucucuau

SEQ ID NO: 42767 - RNA, 23 nt, Artificial Sequence
  RNA Oligomer
cgcaagggcagaagguugaagaa

SEQ ID NO: 42768 - RNA, 23 nt, Artificial Sequence
  RNA Oligomer
ucgcaagggcagaagguugaaga

SEQ ID NO: 42769 - RNA, 23 nt, Artificial Sequence
  RNA Oligomer
cucgcaagggcagaagguugaag

SEQ ID NO: 42770 - RNA, 23 nt, Artificial Sequence
  RNA Oligomer
ccucgcaagggcagaagguugaa

SEQ ID NO: 42771 - RNA, 23 nt, Artificial Sequence
  RNA Oligomer
ggccuggguuguccuuugcaucu

SEQ ID NO: 42772 - RNA, 23 nt, Artificial Sequence
  RNA Oligomer
aggccuggguuguccuuugcauc

SEQ ID NO: 42773 - RNA, 23 nt, Artificial Sequence
  RNA Oligomer
uaggccuggguuguccuuugcau

SEQ ID NO: 42774 - RNA, 23 nt, Artificial Sequence
  RNA Oligomer
ugaacaaauccuacucugaagcu

SEQ ID NO: 42775 - RNA, 23 nt, Artificial Sequence
  RNA Oligomer
gugaacaaauccuacucugaagc

SEQ ID NO: 42776 - RNA, 23 nt, Artificial Sequence
  RNA Oligomer
agugaacaaauccuacucugaag

SEQ ID NO: 42777 - RNA, 23 nt, Artificial Sequence
  RNA Oligomer
cagugaacaaauccuacucugaa

SEQ ID NO: 42778 - RNA, 23 nt, Artificial Sequence
  RNA Oligomer
ggcaggcuuuggccagugaacaa

SEQ ID NO: 42779 - RNA, 23 nt, Artificial Sequence
  RNA Oligomer
gaugcugaaagccauaguuucau

SEQ ID NO: 42780 - RNA, 23 nt, Artificial Sequence
  RNA Oligomer
agaugcugaaagccauaguuuca

SEQ ID NO: 42781 - RNA, 23 nt, Artificial Sequence
  RNA Oligomer
cagaugcugaaagccauaguuuc

SEQ ID NO: 42782 - RNA, 23 nt, Artificial Sequence
  RNA Oligomer
acagaugcugaaagccauaguuu

SEQ ID NO: 42783 - RNA, 23 nt, Artificial Sequence
  RNA Oligomer
aucaacucccaauuucgugguug

SEQ ID NO: 42784 - RNA, 23 nt, Artificial Sequence
  RNA Oligomer
caucaacucccaauuucgugguu

SEQ ID NO: 42785 - RNA, 23 nt, Artificial Sequence
  RNA Oligomer
gccugaacugacaucaacuccca

SEQ ID NO: 42786 - RNA, 23 nt, Artificial Sequence
  RNA Oligomer
agccugaacugacaucaacuccc

SEQ ID NO: 42787 - RNA, 23 nt, Artificial Sequence
  RNA Oligomer
aacaggagccugaacugacauca

SEQ ID NO: 42788 - RNA, 23 nt, Artificial Sequence
  RNA Oligomer
agagcagacagaugcugaaagcc

SEQ ID NO: 42789 - RNA, 23 nt, Artificial Sequence
  RNA Oligomer
uagagcagacagaugcugaaagc

SEQ ID NO: 42790 - RNA, 23 nt, Artificial Sequence
  RNA Oligomer
guagagcagacagaugcugaaag

SEQ ID NO: 42791 - RNA, 23 nt, Artificial Sequence
  RNA Oligomer
aguagagcagacagaugcugaaa

SEQ ID NO: 42792 - RNA, 23 nt, Artificial Sequence
  RNA Oligomer
caguagagcagacagaugcugaa

SEQ ID NO: 42793 - RNA, 23 nt, Artificial Sequence
  RNA Oligomer
uccuuggacugggccuuauauga

SEQ ID NO: 42794 - RNA, 23 nt, Artificial Sequence
  RNA Oligomer
uuccuuggacugggccuuauaug

SEQ ID NO: 42795 - RNA, 23 nt, Artificial Sequence
  RNA Oligomer
auuccuuggacugggccuuauau

SEQ ID NO: 42796 - RNA, 23 nt, Artificial Sequence
  RNA Oligomer
gauuccuuggacugggccuuaua

SEQ ID NO: 42797 - RNA, 23 nt, Artificial Sequence
  RNA Oligomer
agauuccuuggacugggccuuau

SEQ ID NO: 42798 - RNA, 23 nt, Artificial Sequence
  RNA Oligomer
ugaagaacaggagccugaacuga

SEQ ID NO: 42799 - RNA, 23 nt, Artificial Sequence
  RNA Oligomer
uugaagaacaggagccugaacug

SEQ ID NO: 42800 - RNA, 23 nt, Artificial Sequence
  RNA Oligomer
guugaagaacaggagccugaacu

SEQ ID NO: 42801 - RNA, 23 nt, Artificial Sequence
  RNA Oligomer
gagcuggaacugaaugggacaga

SEQ ID NO: 42802 - RNA, 23 nt, Artificial Sequence
  RNA Oligomer
ccuaagaugucuggagguuggga

SEQ ID NO: 42803 - RNA, 23 nt, Artificial Sequence
  RNA Oligomer
cccuaagaugucuggagguuggg

SEQ ID NO: 42804 - RNA, 23 nt, Artificial Sequence
  RNA Oligomer
ucccuaagaugucuggagguugg

SEQ ID NO: 42805 - RNA, 23 nt, Artificial Sequence
  RNA Oligomer
cucccuaagaugucuggagguug

SEQ ID NO: 42806 - RNA, 23 nt, Artificial Sequence
  RNA Oligomer
ccucccuaagaugucuggagguu

SEQ ID NO: 42807 - RNA, 23 nt, Artificial Sequence
  RNA Oligomer
ccuuggacugggccuuauaugac

SEQ ID NO: 42808 - RNA, 23 nt, Artificial Sequence
  RNA Oligomer
agugacaucuucucuaucaggga

SEQ ID NO: 42809 - RNA, 23 nt, Artificial Sequence
  RNA Oligomer
gagugacaucuucucuaucaggg

SEQ ID NO: 42810 - RNA, 23 nt, Artificial Sequence
  RNA Oligomer
gaacaggagccugaacugacauc

SEQ ID NO: 42811 - RNA, 23 nt, Artificial Sequence
  RNA Oligomer
agaacaggagccugaacugacau

SEQ ID NO: 42812 - RNA, 23 nt, Artificial Sequence
  RNA Oligomer
aagaacaggagccugaacugaca

SEQ ID NO: 42813 - RNA, 23 nt, Artificial Sequence
  RNA Oligomer
guccuuugcaucugcacguguuc

SEQ ID NO: 42814 - RNA, 23 nt, Artificial Sequence
  RNA Oligomer
uuguccuuugcaucugcacgugu

SEQ ID NO: 42815 - RNA, 23 nt, Artificial Sequence
  RNA Oligomer
guuguccuuugcaucugcacgug

SEQ ID NO: 42816 - RNA, 23 nt, Artificial Sequence
  RNA Oligomer
gguuguccuuugcaucugcacgu

SEQ ID NO: 42817 - RNA, 23 nt, Artificial Sequence
  RNA Oligomer
auaaaacccucccuaagaugucu

SEQ ID NO: 42818 - RNA, 23 nt, Artificial Sequence
  RNA Oligomer
cauaaaacccucccuaagauguc

SEQ ID NO: 42819 - RNA, 23 nt, Artificial Sequence
  RNA Oligomer
gagggguggacaacacuuuugca

SEQ ID NO: 42820 - RNA, 23 nt, Artificial Sequence
  RNA Oligomer
cgagggguggacaacacuuuugc

SEQ ID NO: 42821 - RNA, 23 nt, Artificial Sequence
  RNA Oligomer
cugaacugacaucaacucccaau

SEQ ID NO: 42822 - RNA, 23 nt, Artificial Sequence
  RNA Oligomer
ccugaacugacaucaacucccaa

SEQ ID NO: 42823 - RNA, 23 nt, Artificial Sequence
  RNA Oligomer
ucagaagcauaaaacccucccua

SEQ ID NO: 42824 - RNA, 23 nt, Artificial Sequence
  RNA Oligomer
uucagaagcauaaaacccucccu

SEQ ID NO: 42825 - RNA, 23 nt, Artificial Sequence
  RNA Oligomer
cugaaagccauaguuucauggca

SEQ ID NO: 42826 - RNA, 23 nt, Artificial Sequence
  RNA Oligomer
gcugaaagccauaguuucauggc

SEQ ID NO: 42827 - RNA, 23 nt, Artificial Sequence
  RNA Oligomer
ugcugaaagccauaguuucaugg

SEQ ID NO: 42828 - RNA, 23 nt, Artificial Sequence
  RNA Oligomer
augcugaaagccauaguuucaug

SEQ ID NO: 42829 - RNA, 23 nt, Artificial Sequence
  RNA Oligomer
gagcagacagaugcugaaagcca

SEQ ID NO: 42830 - RNA, 23 nt, Artificial Sequence
  RNA Oligomer
ucauuauccagaggaugagguug

SEQ ID NO: 42831 - RNA, 23 nt, Artificial Sequence
  RNA Oligomer
gucauuauccagaggaugagguu

SEQ ID NO: 42832 - RNA, 23 nt, Artificial Sequence
  RNA Oligomer
ugucauuauccagaggaugaggu

SEQ ID NO: 42833 - RNA, 23 nt, Artificial Sequence
  RNA Oligomer
cugucauuauccagaggaugagg

SEQ ID NO: 42834 - RNA, 23 nt, Artificial Sequence
  RNA Oligomer
acugucauuauccagaggaugag

SEQ ID NO: 42835 - RNA, 23 nt, Artificial Sequence
  RNA Oligomer
gacugucauuauccagaggauga

SEQ ID NO: 42836 - RNA, 23 nt, Artificial Sequence
  RNA Oligomer
aaggcccuuguguuggacuguca

SEQ ID NO: 42837 - RNA, 23 nt, Artificial Sequence
  RNA Oligomer
cccaccaacauuugauggugagg

SEQ ID NO: 42838 - RNA, 23 nt, Artificial Sequence
  RNA Oligomer
ucccaccaacauuugauggugag

SEQ ID NO: 42839 - RNA, 23 nt, Artificial Sequence
  RNA Oligomer
aucccaccaacauuugaugguga

SEQ ID NO: 42840 - RNA, 23 nt, Artificial Sequence
  RNA Oligomer
cccucccuaagaugucuggaggu

SEQ ID NO: 42841 - RNA, 23 nt, Artificial Sequence
  RNA Oligomer
auucagaagcauaaaacccuccc

SEQ ID NO: 42842 - RNA, 23 nt, Artificial Sequence
  RNA Oligomer
aauucagaagcauaaaacccucc

SEQ ID NO: 42843 - RNA, 23 nt, Artificial Sequence
  RNA Oligomer
aaauucagaagcauaaaacccuc

SEQ ID NO: 42844 - RNA, 23 nt, Artificial Sequence
  RNA Oligomer
cuuuucuugaagaccucaagagu

SEQ ID NO: 42845 - RNA, 23 nt, Artificial Sequence
  RNA Oligomer
acuuuucuugaagaccucaagag

SEQ ID NO: 42846 - RNA, 23 nt, Artificial Sequence
  RNA Oligomer
uacuuuucuugaagaccucaaga

SEQ ID NO: 42847 - RNA, 23 nt, Artificial Sequence
  RNA Oligomer
ggacugggccuuauaugaccacc

SEQ ID NO: 42848 - RNA, 23 nt, Artificial Sequence
  RNA Oligomer
uggacugggccuuauaugaccac

SEQ ID NO: 42849 - RNA, 23 nt, Artificial Sequence
  RNA Oligomer
uuggacugggccuuauaugacca

SEQ ID NO: 42850 - RNA, 23 nt, Artificial Sequence
  RNA Oligomer
cuuggacugggccuuauaugacc

SEQ ID NO: 42851 - RNA, 23 nt, Artificial Sequence
  RNA Oligomer
gcaagaaggcccuuguguuggac

SEQ ID NO: 42852 - RNA, 23 nt, Artificial Sequence
  RNA Oligomer
ggcaagaaggcccuuguguugga

SEQ ID NO: 42853 - RNA, 23 nt, Artificial Sequence
  RNA Oligomer
uggcaagaaggcccuuguguugg

SEQ ID NO: 42854 - RNA, 23 nt, Artificial Sequence
  RNA Oligomer
auggcaagaaggcccuuguguug

SEQ ID NO: 42855 - RNA, 23 nt, Artificial Sequence
  RNA Oligomer
gauggcaagaaggcccuuguguu

SEQ ID NO: 42856 - RNA, 23 nt, Artificial Sequence
  RNA Oligomer
acaucaacucccaauuucguggu

SEQ ID NO: 42857 - RNA, 23 nt, Artificial Sequence
  RNA Oligomer
gaaaaauucagaagcauaaaacc

SEQ ID NO: 42858 - RNA, 23 nt, Artificial Sequence
  RNA Oligomer
gcuuuuguugauuuccugaguga

SEQ ID NO: 42859 - RNA, 23 nt, Artificial Sequence
  RNA Oligomer
gguugaaguuauaaagaaugaug

SEQ ID NO: 42860 - RNA, 23 nt, Artificial Sequence
  RNA Oligomer
cuuuuguugauuuccugagugau

SEQ ID NO: 42861 - RNA, 23 nt, Artificial Sequence
  RNA Oligomer
caacauuaacaacagcaucccac

SEQ ID NO: 42862 - RNA, 23 nt, Artificial Sequence
  RNA Oligomer
acaagaagacgaggcugagagug

SEQ ID NO: 42863 - RNA, 23 nt, Artificial Sequence
  RNA Oligomer
caagagccaguagagcagacaga

SEQ ID NO: 42864 - RNA, 23 nt, Artificial Sequence
  RNA Oligomer
ucaagagccaguagagcagacag

SEQ ID NO: 42865 - RNA, 23 nt, Artificial Sequence
  RNA Oligomer
gaacugaaugggacagaagcgaa

SEQ ID NO: 42866 - RNA, 23 nt, Artificial Sequence
  RNA Oligomer
cuuauaugaccaccuaauggauu

SEQ ID NO: 42867 - RNA, 23 nt, Artificial Sequence
  RNA Oligomer
aucugcacguguucgcagucguu

SEQ ID NO: 42868 - RNA, 23 nt, Artificial Sequence
  RNA Oligomer
uaacaacagcaucccaccaacau

SEQ ID NO: 42869 - RNA, 23 nt, Artificial Sequence
  RNA Oligomer
ugauggcaagaaggcccuugugu

SEQ ID NO: 42870 - RNA, 23 nt, Artificial Sequence
  RNA Oligomer
acaacagcaucccaccaacauuu

SEQ ID NO: 42871 - RNA, 23 nt, Artificial Sequence
  RNA Oligomer
gcuuugaaaugauuaucauccua

SEQ ID NO: 42872 - RNA, 23 nt, Artificial Sequence
  RNA Oligomer
ucugcacguguucgcagucguuu

SEQ ID NO: 42873 - RNA, 23 nt, Artificial Sequence
  RNA Oligomer
acauuugauggugaggaggaacc

SEQ ID NO: 42874 - RNA, 23 nt, Artificial Sequence
  RNA Oligomer
ucaguccacuggcgagucugaau

SEQ ID NO: 42875 - RNA, 23 nt, Artificial Sequence
  RNA Oligomer
caagaaggcccuuguguuggacu

SEQ ID NO: 42876 - RNA, 23 nt, Artificial Sequence
  RNA Oligomer
acauaaaauugguuuaucuccuc

SEQ ID NO: 42877 - RNA, 23 nt, Artificial Sequence
  RNA Oligomer
acauuaacaacagcaucccacca

SEQ ID NO: 42878 - RNA, 23 nt, Artificial Sequence
  RNA Oligomer
agacauaaaauugguuuaucucc

SEQ ID NO: 42879 - RNA, 23 nt, Artificial Sequence
  RNA Oligomer
cuucaagaaaaguaauguacucc

SEQ ID NO: 42880 - RNA, 23 nt, Artificial Sequence
  RNA Oligomer
uucaagaaaaguaauguacuccu

SEQ ID NO: 42881 - RNA, 23 nt, Artificial Sequence
  RNA Oligomer
ucaagaaaaguaauguacuccug

SEQ ID NO: 42882 - RNA, 23 nt, Artificial Sequence
  RNA Oligomer
caagaaaaguaauguacuccugg

SEQ ID NO: 42883 - RNA, 23 nt, Artificial Sequence
  RNA Oligomer
aagaaaaguaauguacuccuggu

SEQ ID NO: 42884 - RNA, 23 nt, Artificial Sequence
  RNA Oligomer
ggaaaucaacaaaagcuuugucu

SEQ ID NO: 42885 - RNA, 23 nt, Artificial Sequence
  RNA Oligomer
gaaaucaacaaaagcuuugucuc

SEQ ID NO: 42886 - RNA, 23 nt, Artificial Sequence
  RNA Oligomer
aaaucaacaaaagcuuugucucc

SEQ ID NO: 42887 - RNA, 23 nt, Artificial Sequence
  RNA Oligomer
aaucaacaaaagcuuugucuccg

SEQ ID NO: 42888 - RNA, 23 nt, Artificial Sequence
  RNA Oligomer
aucaacaaaagcuuugucuccgu

SEQ ID NO: 42889 - RNA, 23 nt, Artificial Sequence
  RNA Oligomer
auccauuagguggucauauaagg

SEQ ID NO: 42890 - RNA, 23 nt, Artificial Sequence
  RNA Oligomer
uccauuagguggucauauaaggc

SEQ ID NO: 42891 - RNA, 23 nt, Artificial Sequence
  RNA Oligomer
ccauuagguggucauauaaggcc

SEQ ID NO: 42892 - RNA, 23 nt, Artificial Sequence
  RNA Oligomer
cauuagguggucauauaaggccc

SEQ ID NO: 42893 - RNA, 23 nt, Artificial Sequence
  RNA Oligomer
auuagguggucauauaaggccca

SEQ ID NO: 42894 - RNA, 23 nt, Artificial Sequence
  RNA Oligomer
ucaacaaaagcuuugucuccguc

SEQ ID NO: 42895 - RNA, 23 nt, Artificial Sequence
  RNA Oligomer
caacaaaagcuuugucuccgucg

SEQ ID NO: 42896 - RNA, 23 nt, Artificial Sequence
  RNA Oligomer
aacaaaagcuuugucuccgucgg

SEQ ID NO: 42897 - RNA, 23 nt, Artificial Sequence
  RNA Oligomer
gcacuaauuucgcuucuguccca

SEQ ID NO: 42898 - RNA, 23 nt, Artificial Sequence
  RNA Oligomer
cacuaauuucgcuucugucccau

SEQ ID NO: 42899 - RNA, 23 nt, Artificial Sequence
  RNA Oligomer
acuaauuucgcuucugucccauu

SEQ ID NO: 42900 - RNA, 23 nt, Artificial Sequence
  RNA Oligomer
cuaauuucgcuucugucccauuc

SEQ ID NO: 42901 - RNA, 23 nt, Artificial Sequence
  RNA Oligomer
uaauuucgcuucugucccauuca

SEQ ID NO: 42902 - RNA, 23 nt, Artificial Sequence
  RNA Oligomer
aauuucgcuucugucccauucag

SEQ ID NO: 42903 - RNA, 23 nt, Artificial Sequence
  RNA Oligomer
auuucgcuucugucccauucagu

SEQ ID NO: 42904 - RNA, 23 nt, Artificial Sequence
  RNA Oligomer
uuucgcuucugucccauucaguu

SEQ ID NO: 42905 - RNA, 23 nt, Artificial Sequence
  RNA Oligomer
gcucaucugcaaaaguguugucc

SEQ ID NO: 42906 - RNA, 23 nt, Artificial Sequence
  RNA Oligomer
cucaucugcaaaaguguugucca

SEQ ID NO: 42907 - RNA, 23 nt, Artificial Sequence
  RNA Oligomer
ucaucugcaaaaguguuguccac

SEQ ID NO: 42908 - RNA, 23 nt, Artificial Sequence
  RNA Oligomer
caucugcaaaaguguuguccacc

SEQ ID NO: 42909 - RNA, 23 nt, Artificial Sequence
  RNA Oligomer
aucugcaaaaguguuguccaccc

SEQ ID NO: 42910 - RNA, 23 nt, Artificial Sequence
  RNA Oligomer
uguugaguguauaauuaguaucc

SEQ ID NO: 42911 - RNA, 23 nt, Artificial Sequence
  RNA Oligomer
guugaguguauaauuaguauccu

SEQ ID NO: 42912 - RNA, 23 nt, Artificial Sequence
  RNA Oligomer
uugaguguauaauuaguauccuu

SEQ ID NO: 42913 - RNA, 23 nt, Artificial Sequence
  RNA Oligomer
ugaguguauaauuaguauccuuc

SEQ ID NO: 42914 - RNA, 23 nt, Artificial Sequence
  RNA Oligomer
gaguguauaauuaguauccuucc

SEQ ID NO: 42915 - RNA, 23 nt, Artificial Sequence
  RNA Oligomer
gcuucugaauuuuucuuuccucc

SEQ ID NO: 42916 - RNA, 23 nt, Artificial Sequence
  RNA Oligomer
cuucugaauuuuucuuuccuccu

SEQ ID NO: 42917 - RNA, 23 nt, Artificial Sequence
  RNA Oligomer
uucugaauuuuucuuuccuccuu

SEQ ID NO: 42918 - RNA, 23 nt, Artificial Sequence
  RNA Oligomer
ucugaauuuuucuuuccuccuua

SEQ ID NO: 42919 - RNA, 23 nt, Artificial Sequence
  RNA Oligomer
cugaauuuuucuuuccuccuuaa

SEQ ID NO: 42920 - RNA, 23 nt, Artificial Sequence
  RNA Oligomer
uaguauccuuccauucagacucg

SEQ ID NO: 42921 - RNA, 23 nt, Artificial Sequence
  RNA Oligomer
aguauccuuccauucagacucgc

SEQ ID NO: 42922 - RNA, 23 nt, Artificial Sequence
  RNA Oligomer
guauccuuccauucagacucgcc

SEQ ID NO: 42923 - RNA, 23 nt, Artificial Sequence
  RNA Oligomer
uauccuuccauucagacucgcca

SEQ ID NO: 42924 - RNA, 23 nt, Artificial Sequence
  RNA Oligomer
auccuuccauucagacucgccag

SEQ ID NO: 42925 - RNA, 23 nt, Artificial Sequence
  RNA Oligomer
aggaaaucaacaaaagcuuuguc

SEQ ID NO: 42926 - RNA, 23 nt, Artificial Sequence
  RNA Oligomer
gaaagugaccgugauuuuuuccc

SEQ ID NO: 42927 - RNA, 23 nt, Artificial Sequence
  RNA Oligomer
aaagugaccgugauuuuuucccc

SEQ ID NO: 42928 - RNA, 23 nt, Artificial Sequence
  RNA Oligomer
aagugaccgugauuuuuuccccg

SEQ ID NO: 42929 - RNA, 23 nt, Artificial Sequence
  RNA Oligomer
agugaccgugauuuuuuccccgg

SEQ ID NO: 42930 - RNA, 23 nt, Artificial Sequence
  RNA Oligomer
gugaccgugauuuuuuccccggc

SEQ ID NO: 42931 - RNA, 23 nt, Artificial Sequence
  RNA Oligomer
agaaaaguaauguacuccuggug

SEQ ID NO: 42932 - RNA, 23 nt, Artificial Sequence
  RNA Oligomer
gaaaaguaauguacuccuggugc

SEQ ID NO: 42933 - RNA, 23 nt, Artificial Sequence
  RNA Oligomer
aaaaguaauguacuccuggugcu

SEQ ID NO: 42934 - RNA, 23 nt, Artificial Sequence
  RNA Oligomer
aaaguaauguacuccuggugcuc

SEQ ID NO: 42935 - RNA, 23 nt, Artificial Sequence
  RNA Oligomer
aaguaauguacuccuggugcucc

SEQ ID NO: 42936 - RNA, 23 nt, Artificial Sequence
  RNA Oligomer
auaauuaguauccuuccauucag

SEQ ID NO: 42937 - RNA, 23 nt, Artificial Sequence
  RNA Oligomer
uaauuaguauccuuccauucaga

SEQ ID NO: 42938 - RNA, 23 nt, Artificial Sequence
  RNA Oligomer
aauuaguauccuuccauucagac

SEQ ID NO: 42939 - RNA, 23 nt, Artificial Sequence
  RNA Oligomer
auuaguauccuuccauucagacu

SEQ ID NO: 42940 - RNA, 23 nt, Artificial Sequence
  RNA Oligomer
uuaguauccuuccauucagacuc

SEQ ID NO: 42941 - RNA, 23 nt, Artificial Sequence
  RNA Oligomer
acaaaagcuuugucuccgucggu

SEQ ID NO: 42942 - RNA, 23 nt, Artificial Sequence
  RNA Oligomer
caaaagcuuugucuccgucggug

SEQ ID NO: 42943 - RNA, 23 nt, Artificial Sequence
  RNA Oligomer
aaaagcuuugucuccgucggugu

SEQ ID NO: 42944 - RNA, 23 nt, Artificial Sequence
  RNA Oligomer
aaagcuuugucuccgucggugug

SEQ ID NO: 42945 - RNA, 23 nt, Artificial Sequence
  RNA Oligomer
ggcaacuuuccgcacuaauuucg

SEQ ID NO: 42946 - RNA, 23 nt, Artificial Sequence
  RNA Oligomer
gcaacuuuccgcacuaauuucgc

SEQ ID NO: 42947 - RNA, 23 nt, Artificial Sequence
  RNA Oligomer
caacuuuccgcacuaauuucgcu

SEQ ID NO: 42948 - RNA, 23 nt, Artificial Sequence
  RNA Oligomer
aacuuuccgcacuaauuucgcuu

SEQ ID NO: 42949 - RNA, 23 nt, Artificial Sequence
  RNA Oligomer
acuuuccgcacuaauuucgcuuc

SEQ ID NO: 42950 - RNA, 23 nt, Artificial Sequence
  RNA Oligomer
cuggcucuugacaaaacucuuga

SEQ ID NO: 42951 - RNA, 23 nt, Artificial Sequence
  RNA Oligomer
uggcucuugacaaaacucuugag

SEQ ID NO: 42952 - RNA, 23 nt, Artificial Sequence
  RNA Oligomer
ggcucuugacaaaacucuugagg

SEQ ID NO: 42953 - RNA, 23 nt, Artificial Sequence
  RNA Oligomer
gcucuugacaaaacucuugaggu

SEQ ID NO: 42954 - RNA, 23 nt, Artificial Sequence
  RNA Oligomer
cucuugacaaaacucuugagguc

SEQ ID NO: 42955 - RNA, 23 nt, Artificial Sequence
  RNA Oligomer
cacgaaauugggaguugauguca

SEQ ID NO: 42956 - RNA, 23 nt, Artificial Sequence
  RNA Oligomer
acgaaauugggaguugaugucag

SEQ ID NO: 42957 - RNA, 23 nt, Artificial Sequence
  RNA Oligomer
cgaaauugggaguugaugucagu

SEQ ID NO: 42958 - RNA, 23 nt, Artificial Sequence
  RNA Oligomer
gaaauugggaguugaugucaguu

SEQ ID NO: 42959 - RNA, 23 nt, Artificial Sequence
  RNA Oligomer
aaauugggaguugaugucaguuc

SEQ ID NO: 42960 - RNA, 23 nt, Artificial Sequence
  RNA Oligomer
aauugggaguugaugucaguuca

SEQ ID NO: 42961 - RNA, 23 nt, Artificial Sequence
  RNA Oligomer
guuguuaauguugaaagugaccg

SEQ ID NO: 42962 - RNA, 23 nt, Artificial Sequence
  RNA Oligomer
uuguuaauguugaaagugaccgu

SEQ ID NO: 42963 - RNA, 23 nt, Artificial Sequence
  RNA Oligomer
uguuaauguugaaagugaccgug

SEQ ID NO: 42964 - RNA, 23 nt, Artificial Sequence
  RNA Oligomer
guuaauguugaaagugaccguga

SEQ ID NO: 42965 - RNA, 23 nt, Artificial Sequence
  RNA Oligomer
uuaauguugaaagugaccgugau

SEQ ID NO: 42966 - RNA, 23 nt, Artificial Sequence
  RNA Oligomer
cuuuccgcacuaauuucgcuucu

SEQ ID NO: 42967 - RNA, 23 nt, Artificial Sequence
  RNA Oligomer
uuuccgcacuaauuucgcuucug

SEQ ID NO: 42968 - RNA, 23 nt, Artificial Sequence
  RNA Oligomer
ccgcacuaauuucgcuucugucc

SEQ ID NO: 42969 - RNA, 23 nt, Artificial Sequence
  RNA Oligomer
cgcacuaauuucgcuucuguccc

SEQ ID NO: 42970 - RNA, 23 nt, Artificial Sequence
  RNA Oligomer
aggauuuguucacuggccaaagc

SEQ ID NO: 42971 - RNA, 23 nt, Artificial Sequence
  RNA Oligomer
ggauuuguucacuggccaaagcc

SEQ ID NO: 42972 - RNA, 23 nt, Artificial Sequence
  RNA Oligomer
gauuuguucacuggccaaagccu

SEQ ID NO: 42973 - RNA, 23 nt, Artificial Sequence
  RNA Oligomer
auuuguucacuggccaaagccug

SEQ ID NO: 42974 - RNA, 23 nt, Artificial Sequence
  RNA Oligomer
uuuguucacuggccaaagccugc

SEQ ID NO: 42975 - RNA, 23 nt, Artificial Sequence
  RNA Oligomer
cuccuuaauuucaucacucagga

SEQ ID NO: 42976 - RNA, 23 nt, Artificial Sequence
  RNA Oligomer
uccuuaauuucaucacucaggaa

SEQ ID NO: 42977 - RNA, 23 nt, Artificial Sequence
  RNA Oligomer
ccuuaauuucaucacucaggaaa

SEQ ID NO: 42978 - RNA, 23 nt, Artificial Sequence
  RNA Oligomer
cuuaauuucaucacucaggaaau

SEQ ID NO: 42979 - RNA, 23 nt, Artificial Sequence
  RNA Oligomer
uuaauuucaucacucaggaaauc

SEQ ID NO: 42980 - RNA, 23 nt, Artificial Sequence
  RNA Oligomer
cuacuggcucuugacaaaacucu

SEQ ID NO: 42981 - RNA, 23 nt, Artificial Sequence
  RNA Oligomer
uacuggcucuugacaaaacucuu

SEQ ID NO: 42982 - RNA, 23 nt, Artificial Sequence
  RNA Oligomer
acuggcucuugacaaaacucuug

SEQ ID NO: 42983 - RNA, 23 nt, Artificial Sequence
  RNA Oligomer
ucuugacaaaacucuugaggucu

SEQ ID NO: 42984 - RNA, 23 nt, Artificial Sequence
  RNA Oligomer
cuugacaaaacucuugaggucuu

SEQ ID NO: 42985 - RNA, 23 nt, Artificial Sequence
  RNA Oligomer
uugacaaaacucuugaggucuuc

SEQ ID NO: 42986 - RNA, 23 nt, Artificial Sequence
  RNA Oligomer
ugacaaaacucuugaggucuuca

SEQ ID NO: 42987 - RNA, 23 nt, Artificial Sequence
  RNA Oligomer
aguguauaauuaguauccuucca

SEQ ID NO: 42988 - RNA, 23 nt, Artificial Sequence
  RNA Oligomer
guguauaauuaguauccuuccau

SEQ ID NO: 42989 - RNA, 23 nt, Artificial Sequence
  RNA Oligomer
uguauaauuaguauccuuccauu

SEQ ID NO: 42990 - RNA, 23 nt, Artificial Sequence
  RNA Oligomer
guauaauuaguauccuuccauuc

SEQ ID NO: 42991 - RNA, 23 nt, Artificial Sequence
  RNA Oligomer
uauaauuaguauccuuccauuca

SEQ ID NO: 42992 - RNA, 23 nt, Artificial Sequence
  RNA Oligomer
ggccuucuugccaucaucauucu

SEQ ID NO: 42993 - RNA, 23 nt, Artificial Sequence
  RNA Oligomer
gccuucuugccaucaucauucuu

SEQ ID NO: 42994 - RNA, 23 nt, Artificial Sequence
  RNA Oligomer
ccuucuugccaucaucauucuuu

SEQ ID NO: 42995 - RNA, 23 nt, Artificial Sequence
  RNA Oligomer
cuucuugccaucaucauucuuua

SEQ ID NO: 42996 - RNA, 23 nt, Artificial Sequence
  RNA Oligomer
uucuugccaucaucauucuuuau

SEQ ID NO: 42997 - RNA, 23 nt, Artificial Sequence
  RNA Oligomer
auucuuuauaacuucaaccacga

SEQ ID NO: 42998 - RNA, 23 nt, Artificial Sequence
  RNA Oligomer
uucuuuauaacuucaaccacgaa

SEQ ID NO: 42999 - RNA, 23 nt, Artificial Sequence
  RNA Oligomer
ucuuuauaacuucaaccacgaaa

SEQ ID NO: 43000 - RNA, 23 nt, Artificial Sequence
  RNA Oligomer
cuuuauaacuucaaccacgaaau

SEQ ID NO: 43001 - RNA, 23 nt, Artificial Sequence
  RNA Oligomer
uuuauaacuucaaccacgaaauu

SEQ ID NO: 43002 - RNA, 23 nt, Artificial Sequence
  RNA Oligomer
acaucuuagggaggguuuuaugc

SEQ ID NO: 43003 - RNA, 23 nt, Artificial Sequence
  RNA Oligomer
caucuuagggaggguuuuaugcu

SEQ ID NO: 43004 - RNA, 23 nt, Artificial Sequence
  RNA Oligomer
aucuuagggaggguuuuaugcuu

SEQ ID NO: 43005 - RNA, 23 nt, Artificial Sequence
  RNA Oligomer
ucuuagggaggguuuuaugcuuc

SEQ ID NO: 43006 - RNA, 23 nt, Artificial Sequence
  RNA Oligomer
cuuagggaggguuuuaugcuucu

SEQ ID NO: 43007 - RNA, 23 nt, Artificial Sequence
  RNA Oligomer
uucuuuccuccuuaauuucauca

SEQ ID NO: 43008 - RNA, 23 nt, Artificial Sequence
  RNA Oligomer
ucuuuccuccuuaauuucaucac

SEQ ID NO: 43009 - RNA, 23 nt, Artificial Sequence
  RNA Oligomer
cuuuccuccuuaauuucaucacu

SEQ ID NO: 43010 - RNA, 23 nt, Artificial Sequence
  RNA Oligomer
uuuccuccuuaauuucaucacuc

SEQ ID NO: 43011 - RNA, 23 nt, Artificial Sequence
  RNA Oligomer
uuccuccuuaauuucaucacuca

SEQ ID NO: 43012 - RNA, 23 nt, Artificial Sequence
  RNA Oligomer
ccuccuuaauuucaucacucagg

SEQ ID NO: 43013 - RNA, 23 nt, Artificial Sequence
  RNA Oligomer
gacaaaacucuugaggucuucaa

SEQ ID NO: 43014 - RNA, 23 nt, Artificial Sequence
  RNA Oligomer
acaaaacucuugaggucuucaag

SEQ ID NO: 43015 - RNA, 23 nt, Artificial Sequence
  RNA Oligomer
caaaacucuugaggucuucaaga

SEQ ID NO: 43016 - RNA, 23 nt, Artificial Sequence
  RNA Oligomer
aucuguguugaguguauaauuag

SEQ ID NO: 43017 - RNA, 23 nt, Artificial Sequence
  RNA Oligomer
ucuguguugaguguauaauuagu

SEQ ID NO: 43018 - RNA, 23 nt, Artificial Sequence
  RNA Oligomer
cuguguugaguguauaauuagua

SEQ ID NO: 43019 - RNA, 23 nt, Artificial Sequence
  RNA Oligomer
uguguugaguguauaauuaguau

SEQ ID NO: 43020 - RNA, 23 nt, Artificial Sequence
  RNA Oligomer
guguugaguguauaauuaguauc

SEQ ID NO: 43021 - RNA, 23 nt, Artificial Sequence
  RNA Oligomer
ucaggaaaucaacaaaagcuuug

SEQ ID NO: 43022 - RNA, 23 nt, Artificial Sequence
  RNA Oligomer
caggaaaucaacaaaagcuuugu

SEQ ID NO: 43023 - RNA, 23 nt, Artificial Sequence
  RNA Oligomer
cauucuuuauaacuucaaccacg

SEQ ID NO: 43024 - RNA, 23 nt, Artificial Sequence
  RNA Oligomer
ccacgaaauugggaguugauguc

SEQ ID NO: 43025 - RNA, 23 nt, Artificial Sequence
  RNA Oligomer
gcuccuguucuucaaccuucugc

SEQ ID NO: 43026 - RNA, 23 nt, Artificial Sequence
  RNA Oligomer
cuccuguucuucaaccuucugcc

SEQ ID NO: 43027 - RNA, 23 nt, Artificial Sequence
  RNA Oligomer
uccuguucuucaaccuucugccc

SEQ ID NO: 43028 - RNA, 23 nt, Artificial Sequence
  RNA Oligomer
ccuguucuucaaccuucugcccu

SEQ ID NO: 43029 - RNA, 23 nt, Artificial Sequence
  RNA Oligomer
cuguucuucaaccuucugcccuu

SEQ ID NO: 43030 - RNA, 23 nt, Artificial Sequence
  RNA Oligomer
ugggaugcuguuguuaauguuga

SEQ ID NO: 43031 - RNA, 23 nt, Artificial Sequence
  RNA Oligomer
gggaugcuguuguuaauguugaa

SEQ ID NO: 43032 - RNA, 23 nt, Artificial Sequence
  RNA Oligomer
ggaugcuguuguuaauguugaaa

SEQ ID NO: 43033 - RNA, 23 nt, Artificial Sequence
  RNA Oligomer
gaugcuguuguuaauguugaaag

SEQ ID NO: 43034 - RNA, 23 nt, Artificial Sequence
  RNA Oligomer
augcuguuguuaauguugaaagu

SEQ ID NO: 43035 - RNA, 23 nt, Artificial Sequence
  RNA Oligomer
uugaaagugaccgugauuuuuuc

SEQ ID NO: 43036 - RNA, 23 nt, Artificial Sequence
  RNA Oligomer
ugaaagugaccgugauuuuuucc

SEQ ID NO: 43037 - RNA, 23 nt, Artificial Sequence
  RNA Oligomer
uuagggaggguuuuaugcuucug

SEQ ID NO: 43038 - RNA, 23 nt, Artificial Sequence
  RNA Oligomer
ugcuucugaauuuuucuuuccuc

SEQ ID NO: 43039 - RNA, 23 nt, Artificial Sequence
  RNA Oligomer
auuuuucuuuccuccuuaauuuc

SEQ ID NO: 43040 - RNA, 23 nt, Artificial Sequence
  RNA Oligomer
uuuuucuuuccuccuuaauuuca

SEQ ID NO: 43041 - RNA, 23 nt, Artificial Sequence
  RNA Oligomer
uuuucuuuccuccuuaauuucau

SEQ ID NO: 43042 - RNA, 23 nt, Artificial Sequence
  RNA Oligomer
uuucuuuccuccuuaauuucauc

SEQ ID NO: 43043 - RNA, 23 nt, Artificial Sequence
  RNA Oligomer
uccuccuuaauuucaucacucag

SEQ ID NO: 43044 - RNA, 23 nt, Artificial Sequence
  RNA Oligomer
cuugaggucuucaagaaaaguaa

SEQ ID NO: 43045 - RNA, 23 nt, Artificial Sequence
  RNA Oligomer
uugaggucuucaagaaaaguaau

SEQ ID NO: 43046 - RNA, 23 nt, Artificial Sequence
  RNA Oligomer
ugaggucuucaagaaaaguaaug

SEQ ID NO: 43047 - RNA, 23 nt, Artificial Sequence
  RNA Oligomer
gaggucuucaagaaaaguaaugu

SEQ ID NO: 43048 - RNA, 23 nt, Artificial Sequence
  RNA Oligomer
aggucuucaagaaaaguaaugua

SEQ ID NO: 43049 - RNA, 23 nt, Artificial Sequence
  RNA Oligomer
ggucuucaagaaaaguaauguac

SEQ ID NO: 43050 - RNA, 23 nt, Artificial Sequence
  RNA Oligomer
gucuucaagaaaaguaauguacu

SEQ ID NO: 43051 - RNA, 23 nt, Artificial Sequence
  RNA Oligomer
uaauuucaucacucaggaaauca

SEQ ID NO: 43052 - RNA, 23 nt, Artificial Sequence
  RNA Oligomer
aauuucaucacucaggaaaucaa

SEQ ID NO: 43053 - RNA, 23 nt, Artificial Sequence
  RNA Oligomer
auuucaucacucaggaaaucaac

SEQ ID NO: 43054 - RNA, 23 nt, Artificial Sequence
  RNA Oligomer
uuucaucacucaggaaaucaaca

SEQ ID NO: 43055 - RNA, 23 nt, Artificial Sequence
  RNA Oligomer
uucaucacucaggaaaucaacaa

SEQ ID NO: 43056 - RNA, 23 nt, Artificial Sequence
  RNA Oligomer
cgugcagaugcaaaggacaaccc

SEQ ID NO: 43057 - RNA, 23 nt, Artificial Sequence
  RNA Oligomer
gugcagaugcaaaggacaaccca

SEQ ID NO: 43058 - RNA, 23 nt, Artificial Sequence
  RNA Oligomer
ugcagaugcaaaggacaacccag

SEQ ID NO: 43059 - RNA, 23 nt, Artificial Sequence
  RNA Oligomer
gcagaugcaaaggacaacccagg

SEQ ID NO: 43060 - RNA, 23 nt, Artificial Sequence
  RNA Oligomer
cagaugcaaaggacaacccaggc

SEQ ID NO: 43061 - RNA, 23 nt, Artificial Sequence
  RNA Oligomer
cugaaagcuaacuucccugauag

SEQ ID NO: 43062 - RNA, 23 nt, Artificial Sequence
  RNA Oligomer
ugaaagcuaacuucccugauaga

SEQ ID NO: 43063 - RNA, 23 nt, Artificial Sequence
  RNA Oligomer
gaaagcuaacuucccugauagag

SEQ ID NO: 43064 - RNA, 23 nt, Artificial Sequence
  RNA Oligomer
aaagcuaacuucccugauagaga

SEQ ID NO: 43065 - RNA, 23 nt, Artificial Sequence
  RNA Oligomer
aagcuaacuucccugauagagaa

SEQ ID NO: 43066 - RNA, 23 nt, Artificial Sequence
  RNA Oligomer
uguucuucaaccuucugcccuug

SEQ ID NO: 43067 - RNA, 23 nt, Artificial Sequence
  RNA Oligomer
uaauguugaaagugaccgugauu

SEQ ID NO: 43068 - RNA, 23 nt, Artificial Sequence
  RNA Oligomer
uuccgcacuaauuucgcuucugu

SEQ ID NO: 43069 - RNA, 23 nt, Artificial Sequence
  RNA Oligomer
uccgcacuaauuucgcuucuguc

SEQ ID NO: 43070 - RNA, 23 nt, Artificial Sequence
  RNA Oligomer
gcucuacuggcucuugacaaaac

SEQ ID NO: 43071 - RNA, 23 nt, Artificial Sequence
  RNA Oligomer
cucuacuggcucuugacaaaacu

SEQ ID NO: 43072 - RNA, 23 nt, Artificial Sequence
  RNA Oligomer
ucuacuggcucuugacaaaacuc

SEQ ID NO: 43073 - RNA, 23 nt, Artificial Sequence
  RNA Oligomer
ucuucaagaaaaguaauguacuc

SEQ ID NO: 43074 - RNA, 23 nt, Artificial Sequence
  RNA Oligomer
uccuuccauucagacucgccagu

SEQ ID NO: 43075 - RNA, 23 nt, Artificial Sequence
  RNA Oligomer
ggacugaaagcuaacuucccuga

SEQ ID NO: 43076 - RNA, 23 nt, Artificial Sequence
  RNA Oligomer
gacugaaagcuaacuucccugau

SEQ ID NO: 43077 - RNA, 23 nt, Artificial Sequence
  RNA Oligomer
acugaaagcuaacuucccugaua

SEQ ID NO: 43078 - RNA, 23 nt, Artificial Sequence
  RNA Oligomer
uagagaagaugucacucucagcc

SEQ ID NO: 43079 - RNA, 23 nt, Artificial Sequence
  RNA Oligomer
agagaagaugucacucucagccu

SEQ ID NO: 43080 - RNA, 23 nt, Artificial Sequence
  RNA Oligomer
gagaagaugucacucucagccuc

SEQ ID NO: 43081 - RNA, 23 nt, Artificial Sequence
  RNA Oligomer
agaagaugucacucucagccucg

SEQ ID NO: 43082 - RNA, 23 nt, Artificial Sequence
  RNA Oligomer
gaagaugucacucucagccucgu

SEQ ID NO: 43083 - RNA, 23 nt, Artificial Sequence
  RNA Oligomer
gggccuucuugccaucaucauuc

SEQ ID NO: 43084 - RNA, 23 nt, Artificial Sequence
  RNA Oligomer
ucuugccaucaucauucuuuaua

SEQ ID NO: 43085 - RNA, 23 nt, Artificial Sequence
  RNA Oligomer
cuugccaucaucauucuuuauaa

SEQ ID NO: 43086 - RNA, 23 nt, Artificial Sequence
  RNA Oligomer
uugccaucaucauucuuuauaac

SEQ ID NO: 43087 - RNA, 23 nt, Artificial Sequence
  RNA Oligomer
ucauucuuuauaacuucaaccac

SEQ ID NO: 43088 - RNA, 23 nt, Artificial Sequence
  RNA Oligomer
uuauaacuucaaccacgaaauug

SEQ ID NO: 43089 - RNA, 23 nt, Artificial Sequence
  RNA Oligomer
uauaacuucaaccacgaaauugg

SEQ ID NO: 43090 - RNA, 23 nt, Artificial Sequence
  RNA Oligomer
auaacuucaaccacgaaauuggg

SEQ ID NO: 43091 - RNA, 23 nt, Artificial Sequence
  RNA Oligomer
uaacuucaaccacgaaauuggga

SEQ ID NO: 43092 - RNA, 23 nt, Artificial Sequence
  RNA Oligomer
aacuucaaccacgaaauugggag

SEQ ID NO: 43093 - RNA, 23 nt, Artificial Sequence
  RNA Oligomer
aauguugaaagugaccgugauuu

SEQ ID NO: 43094 - RNA, 23 nt, Artificial Sequence
  RNA Oligomer
ggaugauaaucauuucaaagcac

SEQ ID NO: 43095 - RNA, 23 nt, Artificial Sequence
  RNA Oligomer
gaugauaaucauuucaaagcaca

SEQ ID NO: 43096 - RNA, 23 nt, Artificial Sequence
  RNA Oligomer
augauaaucauuucaaagcacau

SEQ ID NO: 43097 - RNA, 23 nt, Artificial Sequence
  RNA Oligomer
ugauaaucauuucaaagcacaug

SEQ ID NO: 43098 - RNA, 23 nt, Artificial Sequence
  RNA Oligomer
gauaaucauuucaaagcacaugu

SEQ ID NO: 43099 - RNA, 23 nt, Artificial Sequence
  RNA Oligomer
aucauuucaaagcacaugucuag

SEQ ID NO: 43100 - RNA, 23 nt, Artificial Sequence
  RNA Oligomer
ucauuucaaagcacaugucuagc

SEQ ID NO: 43101 - RNA, 23 nt, Artificial Sequence
  RNA Oligomer
cauuucaaagcacaugucuagcu

SEQ ID NO: 43102 - RNA, 23 nt, Artificial Sequence
  RNA Oligomer
auuucaaagcacaugucuagcuu

SEQ ID NO: 43103 - RNA, 23 nt, Artificial Sequence
  RNA Oligomer
uuucaaagcacaugucuagcuuc

SEQ ID NO: 43104 - RNA, 23 nt, Artificial Sequence
  RNA Oligomer
aaaacucuugaggucuucaagaa

SEQ ID NO: 43105 - RNA, 23 nt, Artificial Sequence
  RNA Oligomer
aaacucuugaggucuucaagaaa

SEQ ID NO: 43106 - RNA, 23 nt, Artificial Sequence
  RNA Oligomer
cagcucaucugcaaaaguguugu

SEQ ID NO: 43107 - RNA, 23 nt, Artificial Sequence
  RNA Oligomer
agcucaucugcaaaaguguuguc

SEQ ID NO: 43108 - RNA, 23 nt, Artificial Sequence
  RNA Oligomer
uaacuucccugauagagaagaug

SEQ ID NO: 43109 - RNA, 23 nt, Artificial Sequence
  RNA Oligomer
aacuucccugauagagaagaugu

SEQ ID NO: 43110 - RNA, 23 nt, Artificial Sequence
  RNA Oligomer
acuucccugauagagaagauguc

SEQ ID NO: 43111 - RNA, 23 nt, Artificial Sequence
  RNA Oligomer
cuucccugauagagaagauguca

SEQ ID NO: 43112 - RNA, 23 nt, Artificial Sequence
  RNA Oligomer
uucccugauagagaagaugucac

SEQ ID NO: 43113 - RNA, 23 nt, Artificial Sequence
  RNA Oligomer
cggcaacuuuccgcacuaauuuc

SEQ ID NO: 43114 - RNA, 23 nt, Artificial Sequence
  RNA Oligomer
ccagcucaucugcaaaaguguug

SEQ ID NO: 43115 - RNA, 23 nt, Artificial Sequence
  RNA Oligomer
uccaaggaaucuguguugagugu

SEQ ID NO: 43116 - RNA, 23 nt, Artificial Sequence
  RNA Oligomer
ccaaggaaucuguguugagugua

SEQ ID NO: 43117 - RNA, 23 nt, Artificial Sequence
  RNA Oligomer
caaggaaucuguguugaguguau

SEQ ID NO: 43118 - RNA, 23 nt, Artificial Sequence
  RNA Oligomer
aaggaaucuguguugaguguaua

SEQ ID NO: 43119 - RNA, 23 nt, Artificial Sequence
  RNA Oligomer
aggaaucuguguugaguguauaa

SEQ ID NO: 43120 - RNA, 23 nt, Artificial Sequence
  RNA Oligomer
ccuuccauucagacucgccagug

SEQ ID NO: 43121 - RNA, 23 nt, Artificial Sequence
  RNA Oligomer
cuuccauucagacucgccagugg

SEQ ID NO: 43122 - RNA, 23 nt, Artificial Sequence
  RNA Oligomer
uuccauucagacucgccagugga

SEQ ID NO: 43123 - RNA, 23 nt, Artificial Sequence
  RNA Oligomer
uggacugaaagcuaacuucccug

SEQ ID NO: 43124 - RNA, 23 nt, Artificial Sequence
  RNA Oligomer
cacucaggaaaucaacaaaagcu

SEQ ID NO: 43125 - RNA, 23 nt, Artificial Sequence
  RNA Oligomer
acucaggaaaucaacaaaagcuu

SEQ ID NO: 43126 - RNA, 23 nt, Artificial Sequence
  RNA Oligomer
cucaggaaaucaacaaaagcuuu

SEQ ID NO: 43127 - RNA, 23 nt, Artificial Sequence
  RNA Oligomer
agcuaacuucccugauagagaag

SEQ ID NO: 43128 - RNA, 23 nt, Artificial Sequence
  RNA Oligomer
gcuaacuucccugauagagaaga

SEQ ID NO: 43129 - RNA, 23 nt, Artificial Sequence
  RNA Oligomer
cuaacuucccugauagagaagau

SEQ ID NO: 43130 - RNA, 23 nt, Artificial Sequence
  RNA Oligomer
aagaugucacucucagccucguc

SEQ ID NO: 43131 - RNA, 23 nt, Artificial Sequence
  RNA Oligomer
agaugucacucucagccucgucu

SEQ ID NO: 43132 - RNA, 23 nt, Artificial Sequence
  RNA Oligomer
gaugucacucucagccucgucuu

SEQ ID NO: 43133 - RNA, 23 nt, Artificial Sequence
  RNA Oligomer
augucacucucagccucgucuuc

SEQ ID NO: 43134 - RNA, 23 nt, Artificial Sequence
  RNA Oligomer
caggcuccuguucuucaaccuuc

SEQ ID NO: 43135 - RNA, 23 nt, Artificial Sequence
  RNA Oligomer
aggcuccuguucuucaaccuucu

SEQ ID NO: 43136 - RNA, 23 nt, Artificial Sequence
  RNA Oligomer
ggcuccuguucuucaaccuucug

SEQ ID NO: 43137 - RNA, 23 nt, Artificial Sequence
  RNA Oligomer
auguugaaagugaccgugauuuu

SEQ ID NO: 43138 - RNA, 23 nt, Artificial Sequence
  RNA Oligomer
uguugaaagugaccgugauuuuu

SEQ ID NO: 43139 - RNA, 23 nt, Artificial Sequence
  RNA Oligomer
guugaaagugaccgugauuuuuu

SEQ ID NO: 43140 - RNA, 23 nt, Artificial Sequence
  RNA Oligomer
ucgcuucugucccauucaguucc

SEQ ID NO: 43141 - RNA, 23 nt, Artificial Sequence
  RNA Oligomer
cgcuucugucccauucaguucca

SEQ ID NO: 43142 - RNA, 23 nt, Artificial Sequence
  RNA Oligomer
gcuucugucccauucaguuccag

SEQ ID NO: 43143 - RNA, 23 nt, Artificial Sequence
  RNA Oligomer
cuucugucccauucaguuccagc

SEQ ID NO: 43144 - RNA, 23 nt, Artificial Sequence
  RNA Oligomer
uucugucccauucaguuccagcu

SEQ ID NO: 43145 - RNA, 23 nt, Artificial Sequence
  RNA Oligomer
cccauucaguuccagcucccaac

SEQ ID NO: 43146 - RNA, 23 nt, Artificial Sequence
  RNA Oligomer
ccauucaguuccagcucccaacc

SEQ ID NO: 43147 - RNA, 23 nt, Artificial Sequence
  RNA Oligomer
cauucaguuccagcucccaaccu

SEQ ID NO: 43148 - RNA, 23 nt, Artificial Sequence
  RNA Oligomer
auucaguuccagcucccaaccuc

SEQ ID NO: 43149 - RNA, 23 nt, Artificial Sequence
  RNA Oligomer
uucaguuccagcucccaaccucc

SEQ ID NO: 43150 - RNA, 23 nt, Artificial Sequence
  RNA Oligomer
gcacaugucuagcuucagaguag

SEQ ID NO: 43151 - RNA, 23 nt, Artificial Sequence
  RNA Oligomer
cacaugucuagcuucagaguagg

SEQ ID NO: 43152 - RNA, 23 nt, Artificial Sequence
  RNA Oligomer
acaugucuagcuucagaguagga

SEQ ID NO: 43153 - RNA, 23 nt, Artificial Sequence
  RNA Oligomer
caugucuagcuucagaguaggau

SEQ ID NO: 43154 - RNA, 23 nt, Artificial Sequence
  RNA Oligomer
augucuagcuucagaguaggauu

SEQ ID NO: 43155 - RNA, 23 nt, Artificial Sequence
  RNA Oligomer
ccaguggacugaaagcuaacuuc

SEQ ID NO: 43156 - RNA, 23 nt, Artificial Sequence
  RNA Oligomer
caguggacugaaagcuaacuucc

SEQ ID NO: 43157 - RNA, 23 nt, Artificial Sequence
  RNA Oligomer
aguggacugaaagcuaacuuccc

SEQ ID NO: 43158 - RNA, 23 nt, Artificial Sequence
  RNA Oligomer
guggacugaaagcuaacuucccu

SEQ ID NO: 43159 - RNA, 23 nt, Artificial Sequence
  RNA Oligomer
ccucgucuucuuguccaaccuca

SEQ ID NO: 43160 - RNA, 23 nt, Artificial Sequence
  RNA Oligomer
cucgucuucuuguccaaccucau

SEQ ID NO: 43161 - RNA, 23 nt, Artificial Sequence
  RNA Oligomer
ucgucuucuuguccaaccucauc

SEQ ID NO: 43162 - RNA, 23 nt, Artificial Sequence
  RNA Oligomer
cgucuucuuguccaaccucaucc

SEQ ID NO: 43163 - RNA, 23 nt, Artificial Sequence
  RNA Oligomer
gucuucuuguccaaccucauccu

SEQ ID NO: 43164 - RNA, 23 nt, Artificial Sequence
  RNA Oligomer
uuccuccucaccaucaaauguug

SEQ ID NO: 43165 - RNA, 23 nt, Artificial Sequence
  RNA Oligomer
uccuccucaccaucaaauguugg

SEQ ID NO: 43166 - RNA, 23 nt, Artificial Sequence
  RNA Oligomer
ccuccucaccaucaaauguuggu

SEQ ID NO: 43167 - RNA, 23 nt, Artificial Sequence
  RNA Oligomer
cuccucaccaucaaauguuggug

SEQ ID NO: 43168 - RNA, 23 nt, Artificial Sequence
  RNA Oligomer
uccucaccaucaaauguuggugg

SEQ ID NO: 43169 - RNA, 23 nt, Artificial Sequence
  RNA Oligomer
gccaaagccugccaugaaacuau

SEQ ID NO: 43170 - RNA, 23 nt, Artificial Sequence
  RNA Oligomer
ccaaagccugccaugaaacuaug

SEQ ID NO: 43171 - RNA, 23 nt, Artificial Sequence
  RNA Oligomer
caaagccugccaugaaacuaugg

SEQ ID NO: 43172 - RNA, 23 nt, Artificial Sequence
  RNA Oligomer
aaagccugccaugaaacuauggc

SEQ ID NO: 43173 - RNA, 23 nt, Artificial Sequence
  RNA Oligomer
aagccugccaugaaacuauggcu

SEQ ID NO: 43174 - RNA, 23 nt, Artificial Sequence
  RNA Oligomer
cagcaucugucugcucuacuggc

SEQ ID NO: 43175 - RNA, 23 nt, Artificial Sequence
  RNA Oligomer
agcaucugucugcucuacuggcu

SEQ ID NO: 43176 - RNA, 23 nt, Artificial Sequence
  RNA Oligomer
gcaucugucugcucuacuggcuc

SEQ ID NO: 43177 - RNA, 23 nt, Artificial Sequence
  RNA Oligomer
caucugucugcucuacuggcucu

SEQ ID NO: 43178 - RNA, 23 nt, Artificial Sequence
  RNA Oligomer
aucugucugcucuacuggcucuu

SEQ ID NO: 43179 - RNA, 23 nt, Artificial Sequence
  RNA Oligomer
ggucggcaaggaaauccauuagg

SEQ ID NO: 43180 - RNA, 23 nt, Artificial Sequence
  RNA Oligomer
gucggcaaggaaauccauuaggu

SEQ ID NO: 43181 - RNA, 23 nt, Artificial Sequence
  RNA Oligomer
ucggcaaggaaauccauuaggug

SEQ ID NO: 43182 - RNA, 23 nt, Artificial Sequence
  RNA Oligomer
cggcaaggaaauccauuaggugg

SEQ ID NO: 43183 - RNA, 23 nt, Artificial Sequence
  RNA Oligomer
ggcaaggaaauccauuagguggu

SEQ ID NO: 43184 - RNA, 23 nt, Artificial Sequence
  RNA Oligomer
ccaguccaaggaaucuguguuga

SEQ ID NO: 43185 - RNA, 23 nt, Artificial Sequence
  RNA Oligomer
caguccaaggaaucuguguugag

SEQ ID NO: 43186 - RNA, 23 nt, Artificial Sequence
  RNA Oligomer
aguccaaggaaucuguguugagu

SEQ ID NO: 43187 - RNA, 23 nt, Artificial Sequence
  RNA Oligomer
guccaaggaaucuguguugagug

SEQ ID NO: 43188 - RNA, 23 nt, Artificial Sequence
  RNA Oligomer
acucucagccucgucuucuuguc

SEQ ID NO: 43189 - RNA, 23 nt, Artificial Sequence
  RNA Oligomer
cucucagccucgucuucuugucc

SEQ ID NO: 43190 - RNA, 23 nt, Artificial Sequence
  RNA Oligomer
ucucagccucgucuucuugucca

SEQ ID NO: 43191 - RNA, 23 nt, Artificial Sequence
  RNA Oligomer
cucagccucgucuucuuguccaa

SEQ ID NO: 43192 - RNA, 23 nt, Artificial Sequence
  RNA Oligomer
ucagccucgucuucuuguccaac

SEQ ID NO: 43193 - RNA, 23 nt, Artificial Sequence
  RNA Oligomer
cagccucgucuucuuguccaacc

SEQ ID NO: 43194 - RNA, 23 nt, Artificial Sequence
  RNA Oligomer
agccucgucuucuuguccaaccu

SEQ ID NO: 43195 - RNA, 23 nt, Artificial Sequence
  RNA Oligomer
gccucgucuucuuguccaaccuc

SEQ ID NO: 43196 - RNA, 23 nt, Artificial Sequence
  RNA Oligomer
ucuggauaaugacaguccaacac

SEQ ID NO: 43197 - RNA, 23 nt, Artificial Sequence
  RNA Oligomer
cuggauaaugacaguccaacaca

SEQ ID NO: 43198 - RNA, 23 nt, Artificial Sequence
  RNA Oligomer
uggauaaugacaguccaacacaa

SEQ ID NO: 43199 - RNA, 23 nt, Artificial Sequence
  RNA Oligomer
ggauaaugacaguccaacacaag

SEQ ID NO: 43200 - RNA, 23 nt, Artificial Sequence
  RNA Oligomer
gauaaugacaguccaacacaagg

SEQ ID NO: 43201 - RNA, 23 nt, Artificial Sequence
  RNA Oligomer
guucaggcuccuguucuucaacc

SEQ ID NO: 43202 - RNA, 23 nt, Artificial Sequence
  RNA Oligomer
uucaggcuccuguucuucaaccu

SEQ ID NO: 43203 - RNA, 23 nt, Artificial Sequence
  RNA Oligomer
ucaggcuccuguucuucaaccuu

SEQ ID NO: 43204 - RNA, 23 nt, Artificial Sequence
  RNA Oligomer
guucuucaaccuucugcccuugc

SEQ ID NO: 43205 - RNA, 23 nt, Artificial Sequence
  RNA Oligomer
uaugcuucugaauuuuucuuucc

SEQ ID NO: 43206 - RNA, 23 nt, Artificial Sequence
  RNA Oligomer
augcuucugaauuuuucuuuccu

SEQ ID NO: 43207 - RNA, 23 nt, Artificial Sequence
  RNA Oligomer
auaaucauuucaaagcacauguc

SEQ ID NO: 43208 - RNA, 23 nt, Artificial Sequence
  RNA Oligomer
uaaucauuucaaagcacaugucu

SEQ ID NO: 43209 - RNA, 23 nt, Artificial Sequence
  RNA Oligomer
aaucauuucaaagcacaugucua

SEQ ID NO: 43210 - RNA, 23 nt, Artificial Sequence
  RNA Oligomer
uucaaagcacaugucuagcuuca

SEQ ID NO: 43211 - RNA, 23 nt, Artificial Sequence
  RNA Oligomer
ucagcaucugucugcucuacugg

SEQ ID NO: 43212 - RNA, 23 nt, Artificial Sequence
  RNA Oligomer
ucugcaaaaguguuguccacccc

SEQ ID NO: 43213 - RNA, 23 nt, Artificial Sequence
  RNA Oligomer
cugcaaaaguguuguccaccccu

SEQ ID NO: 43214 - RNA, 23 nt, Artificial Sequence
  RNA Oligomer
cuucuuguccaaccucauccucu

SEQ ID NO: 43215 - RNA, 23 nt, Artificial Sequence
  RNA Oligomer
uucuuguccaaccucauccucug

SEQ ID NO: 43216 - RNA, 23 nt, Artificial Sequence
  RNA Oligomer
ucuuguccaaccucauccucugg

SEQ ID NO: 43217 - RNA, 23 nt, Artificial Sequence
  RNA Oligomer
cuuguccaaccucauccucugga

SEQ ID NO: 43218 - RNA, 23 nt, Artificial Sequence
  RNA Oligomer
uuguccaaccucauccucuggau

SEQ ID NO: 43219 - RNA, 23 nt, Artificial Sequence
  RNA Oligomer
auaaugacaguccaacacaaggg

SEQ ID NO: 43220 - RNA, 23 nt, Artificial Sequence
  RNA Oligomer
uaaugacaguccaacacaagggc

SEQ ID NO: 43221 - RNA, 23 nt, Artificial Sequence
  RNA Oligomer
aaugacaguccaacacaagggcc

SEQ ID NO: 43222 - RNA, 23 nt, Artificial Sequence
  RNA Oligomer
augacaguccaacacaagggccu

SEQ ID NO: 43223 - RNA, 23 nt, Artificial Sequence
  RNA Oligomer
ugcuguuguuaauguugaaagug

SEQ ID NO: 43224 - RNA, 23 nt, Artificial Sequence
  RNA Oligomer
gcuguuguuaauguugaaaguga

SEQ ID NO: 43225 - RNA, 23 nt, Artificial Sequence
  RNA Oligomer
cuguuguuaauguugaaagugac

SEQ ID NO: 43226 - RNA, 23 nt, Artificial Sequence
  RNA Oligomer
caccaucaaauguuggugggaug

SEQ ID NO: 43227 - RNA, 23 nt, Artificial Sequence
  RNA Oligomer
accaucaaauguuggugggaugc

SEQ ID NO: 43228 - RNA, 23 nt, Artificial Sequence
  RNA Oligomer
ccaucaaauguuggugggaugcu

SEQ ID NO: 43229 - RNA, 23 nt, Artificial Sequence
  RNA Oligomer
caucaaauguuggugggaugcug

SEQ ID NO: 43230 - RNA, 23 nt, Artificial Sequence
  RNA Oligomer
aucaaauguuggugggaugcugu

SEQ ID NO: 43231 - RNA, 23 nt, Artificial Sequence
  RNA Oligomer
ucaaauguuggugggaugcuguu

SEQ ID NO: 43232 - RNA, 23 nt, Artificial Sequence
  RNA Oligomer
ugucuagcuucagaguaggauuu

SEQ ID NO: 43233 - RNA, 23 nt, Artificial Sequence
  RNA Oligomer
gucuagcuucagaguaggauuug

SEQ ID NO: 43234 - RNA, 23 nt, Artificial Sequence
  RNA Oligomer
ucuagcuucagaguaggauuugu

SEQ ID NO: 43235 - RNA, 23 nt, Artificial Sequence
  RNA Oligomer
cuagcuucagaguaggauuuguu

SEQ ID NO: 43236 - RNA, 23 nt, Artificial Sequence
  RNA Oligomer
uagcuucagaguaggauuuguuc

SEQ ID NO: 43237 - RNA, 23 nt, Artificial Sequence
  RNA Oligomer
ucuucuuguccaaccucauccuc

SEQ ID NO: 43238 - RNA, 23 nt, Artificial Sequence
  RNA Oligomer
aaagcacaugucuagcuucagag

SEQ ID NO: 43239 - RNA, 23 nt, Artificial Sequence
  RNA Oligomer
aagcacaugucuagcuucagagu

SEQ ID NO: 43240 - RNA, 23 nt, Artificial Sequence
  RNA Oligomer
agcacaugucuagcuucagagua

SEQ ID NO: 43241 - RNA, 23 nt, Artificial Sequence
  RNA Oligomer
gcaaggaaauccauuaggugguc

SEQ ID NO: 43242 - RNA, 23 nt, Artificial Sequence
  RNA Oligomer
caaggaaauccauuaggugguca

SEQ ID NO: 43243 - RNA, 23 nt, Artificial Sequence
  RNA Oligomer
aaggaaauccauuagguggucau

SEQ ID NO: 43244 - RNA, 23 nt, Artificial Sequence
  RNA Oligomer
uuagguggucauauaaggcccag

SEQ ID NO: 43245 - RNA, 23 nt, Artificial Sequence
  RNA Oligomer
uagguggucauauaaggcccagu

SEQ ID NO: 43246 - RNA, 23 nt, Artificial Sequence
  RNA Oligomer
agaguaggauuuguucacuggcc

SEQ ID NO: 43247 - RNA, 23 nt, Artificial Sequence
  RNA Oligomer
gaguaggauuuguucacuggcca

SEQ ID NO: 43248 - RNA, 23 nt, Artificial Sequence
  RNA Oligomer
aguaggauuuguucacuggccaa

SEQ ID NO: 43249 - RNA, 23 nt, Artificial Sequence
  RNA Oligomer
guaggauuuguucacuggccaaa

SEQ ID NO: 43250 - RNA, 23 nt, Artificial Sequence
  RNA Oligomer
uaggauuuguucacuggccaaag

SEQ ID NO: 43251 - RNA, 23 nt, Artificial Sequence
  RNA Oligomer
aggaaauccauuagguggucaua

SEQ ID NO: 43252 - RNA, 23 nt, Artificial Sequence
  RNA Oligomer
ggaaauccauuagguggucauau

SEQ ID NO: 43253 - RNA, 23 nt, Artificial Sequence
  RNA Oligomer
gaaauccauuagguggucauaua

SEQ ID NO: 43254 - RNA, 23 nt, Artificial Sequence
  RNA Oligomer
aaauccauuagguggucauauaa

SEQ ID NO: 43255 - RNA, 23 nt, Artificial Sequence
  RNA Oligomer
uuaugcuucugaauuuuucuuuc

SEQ ID NO: 43256 - RNA, 23 nt, Artificial Sequence
  RNA Oligomer
aguaauguacuccuggugcucca

SEQ ID NO: 43257 - RNA, 23 nt, Artificial Sequence
  RNA Oligomer
guaauguacuccuggugcuccag

SEQ ID NO: 43258 - RNA, 23 nt, Artificial Sequence
  RNA Oligomer
uaauguacuccuggugcuccagg

SEQ ID NO: 43259 - RNA, 23 nt, Artificial Sequence
  RNA Oligomer
aauguacuccuggugcuccaggg

SEQ ID NO: 43260 - RNA, 23 nt, Artificial Sequence
  RNA Oligomer
cauccucuggauaaugacagucc

SEQ ID NO: 43261 - RNA, 23 nt, Artificial Sequence
  RNA Oligomer
auccucuggauaaugacagucca

SEQ ID NO: 43262 - RNA, 23 nt, Artificial Sequence
  RNA Oligomer
uccucuggauaaugacaguccaa

SEQ ID NO: 43263 - RNA, 23 nt, Artificial Sequence
  RNA Oligomer
ccucuggauaaugacaguccaac

SEQ ID NO: 43264 - RNA, 23 nt, Artificial Sequence
  RNA Oligomer
cucuggauaaugacaguccaaca

SEQ ID NO: 43265 - RNA, 23 nt, Artificial Sequence
  RNA Oligomer
acuucaaccacgaaauugggagu

SEQ ID NO: 43266 - RNA, 23 nt, Artificial Sequence
  RNA Oligomer
cuucaaccacgaaauugggaguu

SEQ ID NO: 43267 - RNA, 23 nt, Artificial Sequence
  RNA Oligomer
uucaaccacgaaauugggaguug

SEQ ID NO: 43268 - RNA, 23 nt, Artificial Sequence
  RNA Oligomer
ucaaccacgaaauugggaguuga

SEQ ID NO: 43269 - RNA, 23 nt, Artificial Sequence
  RNA Oligomer
ggaguugaugucaguucaggcuc

SEQ ID NO: 43270 - RNA, 23 nt, Artificial Sequence
  RNA Oligomer
gaguugaugucaguucaggcucc

SEQ ID NO: 43271 - RNA, 23 nt, Artificial Sequence
  RNA Oligomer
aguugaugucaguucaggcuccu

SEQ ID NO: 43272 - RNA, 23 nt, Artificial Sequence
  RNA Oligomer
guugaugucaguucaggcuccug

SEQ ID NO: 43273 - RNA, 23 nt, Artificial Sequence
  RNA Oligomer
uugaugucaguucaggcuccugu

SEQ ID NO: 43274 - RNA, 23 nt, Artificial Sequence
  RNA Oligomer
ucagaguaggauuuguucacugg

SEQ ID NO: 43275 - RNA, 23 nt, Artificial Sequence
  RNA Oligomer
cagaguaggauuuguucacuggc

SEQ ID NO: 43276 - RNA, 23 nt, Artificial Sequence
  RNA Oligomer
aacuauggcuuucagcaucuguc

SEQ ID NO: 43277 - RNA, 23 nt, Artificial Sequence
  RNA Oligomer
acuauggcuuucagcaucugucu

SEQ ID NO: 43278 - RNA, 23 nt, Artificial Sequence
  RNA Oligomer
cuauggcuuucagcaucugucug

SEQ ID NO: 43279 - RNA, 23 nt, Artificial Sequence
  RNA Oligomer
uauggcuuucagcaucugucugc

SEQ ID NO: 43280 - RNA, 23 nt, Artificial Sequence
  RNA Oligomer
auggcuuucagcaucugucugcu

SEQ ID NO: 43281 - RNA, 23 nt, Artificial Sequence
  RNA Oligomer
agguggucauauaaggcccaguc

SEQ ID NO: 43282 - RNA, 23 nt, Artificial Sequence
  RNA Oligomer
uguuguuaauguugaaagugacc

SEQ ID NO: 43283 - RNA, 23 nt, Artificial Sequence
  RNA Oligomer
auguacuccuggugcuccagggc

SEQ ID NO: 43284 - RNA, 23 nt, Artificial Sequence
  RNA Oligomer
ccugauagagaagaugucacucu

SEQ ID NO: 43285 - RNA, 23 nt, Artificial Sequence
  RNA Oligomer
cugauagagaagaugucacucuc

SEQ ID NO: 43286 - RNA, 23 nt, Artificial Sequence
  RNA Oligomer
ugauagagaagaugucacucuca

SEQ ID NO: 43287 - RNA, 23 nt, Artificial Sequence
  RNA Oligomer
gauagagaagaugucacucucag

SEQ ID NO: 43288 - RNA, 23 nt, Artificial Sequence
  RNA Oligomer
auagagaagaugucacucucagc

SEQ ID NO: 43289 - RNA, 23 nt, Artificial Sequence
  RNA Oligomer
uucuucaaccuucugcccuugcg

SEQ ID NO: 43290 - RNA, 23 nt, Artificial Sequence
  RNA Oligomer
ucuucaaccuucugcccuugcga

SEQ ID NO: 43291 - RNA, 23 nt, Artificial Sequence
  RNA Oligomer
cuucaaccuucugcccuugcgag

SEQ ID NO: 43292 - RNA, 23 nt, Artificial Sequence
  RNA Oligomer
uucaaccuucugcccuugcgagg

SEQ ID NO: 43293 - RNA, 23 nt, Artificial Sequence
  RNA Oligomer
agaugcaaaggacaacccaggcc

SEQ ID NO: 43294 - RNA, 23 nt, Artificial Sequence
  RNA Oligomer
gaugcaaaggacaacccaggccu

SEQ ID NO: 43295 - RNA, 23 nt, Artificial Sequence
  RNA Oligomer
augcaaaggacaacccaggccua

SEQ ID NO: 43296 - RNA, 23 nt, Artificial Sequence
  RNA Oligomer
agcuucagaguaggauuuguuca

SEQ ID NO: 43297 - RNA, 23 nt, Artificial Sequence
  RNA Oligomer
gcuucagaguaggauuuguucac

SEQ ID NO: 43298 - RNA, 23 nt, Artificial Sequence
  RNA Oligomer
cuucagaguaggauuuguucacu

SEQ ID NO: 43299 - RNA, 23 nt, Artificial Sequence
  RNA Oligomer
uucagaguaggauuuguucacug

SEQ ID NO: 43300 - RNA, 23 nt, Artificial Sequence
  RNA Oligomer
uuguucacuggccaaagccugcc

SEQ ID NO: 43301 - RNA, 23 nt, Artificial Sequence
  RNA Oligomer
augaaacuauggcuuucagcauc

SEQ ID NO: 43302 - RNA, 23 nt, Artificial Sequence
  RNA Oligomer
ugaaacuauggcuuucagcaucu

SEQ ID NO: 43303 - RNA, 23 nt, Artificial Sequence
  RNA Oligomer
gaaacuauggcuuucagcaucug

SEQ ID NO: 43304 - RNA, 23 nt, Artificial Sequence
  RNA Oligomer
aaacuauggcuuucagcaucugu

SEQ ID NO: 43305 - RNA, 23 nt, Artificial Sequence
  RNA Oligomer
caaccacgaaauugggaguugau

SEQ ID NO: 43306 - RNA, 23 nt, Artificial Sequence
  RNA Oligomer
aaccacgaaauugggaguugaug

SEQ ID NO: 43307 - RNA, 23 nt, Artificial Sequence
  RNA Oligomer
ugggaguugaugucaguucaggc

SEQ ID NO: 43308 - RNA, 23 nt, Artificial Sequence
  RNA Oligomer
gggaguugaugucaguucaggcu

SEQ ID NO: 43309 - RNA, 23 nt, Artificial Sequence
  RNA Oligomer
ugaugucaguucaggcuccuguu

SEQ ID NO: 43310 - RNA, 23 nt, Artificial Sequence
  RNA Oligomer
ggcuuucagcaucugucugcucu

SEQ ID NO: 43311 - RNA, 23 nt, Artificial Sequence
  RNA Oligomer
gcuuucagcaucugucugcucua

SEQ ID NO: 43312 - RNA, 23 nt, Artificial Sequence
  RNA Oligomer
cuuucagcaucugucugcucuac

SEQ ID NO: 43313 - RNA, 23 nt, Artificial Sequence
  RNA Oligomer
uuucagcaucugucugcucuacu

SEQ ID NO: 43314 - RNA, 23 nt, Artificial Sequence
  RNA Oligomer
uucagcaucugucugcucuacug

SEQ ID NO: 43315 - RNA, 23 nt, Artificial Sequence
  RNA Oligomer
ucauauaaggcccaguccaagga

SEQ ID NO: 43316 - RNA, 23 nt, Artificial Sequence
  RNA Oligomer
cauauaaggcccaguccaaggaa

SEQ ID NO: 43317 - RNA, 23 nt, Artificial Sequence
  RNA Oligomer
auauaaggcccaguccaaggaau

SEQ ID NO: 43318 - RNA, 23 nt, Artificial Sequence
  RNA Oligomer
uauaaggcccaguccaaggaauc

SEQ ID NO: 43319 - RNA, 23 nt, Artificial Sequence
  RNA Oligomer
auaaggcccaguccaaggaaucu

SEQ ID NO: 43320 - RNA, 23 nt, Artificial Sequence
  RNA Oligomer
ucaguucaggcuccuguucuuca

SEQ ID NO: 43321 - RNA, 23 nt, Artificial Sequence
  RNA Oligomer
caguucaggcuccuguucuucaa

SEQ ID NO: 43322 - RNA, 23 nt, Artificial Sequence
  RNA Oligomer
aguucaggcuccuguucuucaac

SEQ ID NO: 43323 - RNA, 23 nt, Artificial Sequence
  RNA Oligomer
ucugucccauucaguuccagcuc

SEQ ID NO: 43324 - RNA, 23 nt, Artificial Sequence
  RNA Oligomer
ucccaaccuccagacaucuuagg

SEQ ID NO: 43325 - RNA, 23 nt, Artificial Sequence
  RNA Oligomer
cccaaccuccagacaucuuaggg

SEQ ID NO: 43326 - RNA, 23 nt, Artificial Sequence
  RNA Oligomer
ccaaccuccagacaucuuaggga

SEQ ID NO: 43327 - RNA, 23 nt, Artificial Sequence
  RNA Oligomer
caaccuccagacaucuuagggag

SEQ ID NO: 43328 - RNA, 23 nt, Artificial Sequence
  RNA Oligomer
aaccuccagacaucuuagggagg

SEQ ID NO: 43329 - RNA, 23 nt, Artificial Sequence
  RNA Oligomer
gucauauaaggcccaguccaagg

SEQ ID NO: 43330 - RNA, 23 nt, Artificial Sequence
  RNA Oligomer
ucccugauagagaagaugucacu

SEQ ID NO: 43331 - RNA, 23 nt, Artificial Sequence
  RNA Oligomer
cccugauagagaagaugucacuc

SEQ ID NO: 43332 - RNA, 23 nt, Artificial Sequence
  RNA Oligomer
gaugucaguucaggcuccuguuc

SEQ ID NO: 43333 - RNA, 23 nt, Artificial Sequence
  RNA Oligomer
augucaguucaggcuccuguucu

SEQ ID NO: 43334 - RNA, 23 nt, Artificial Sequence
  RNA Oligomer
ugucaguucaggcuccuguucuu

SEQ ID NO: 43335 - RNA, 23 nt, Artificial Sequence
  RNA Oligomer
gaacacgugcagaugcaaaggac

SEQ ID NO: 43336 - RNA, 23 nt, Artificial Sequence
  RNA Oligomer
acacgugcagaugcaaaggacaa

SEQ ID NO: 43337 - RNA, 23 nt, Artificial Sequence
  RNA Oligomer
cacgugcagaugcaaaggacaac

SEQ ID NO: 43338 - RNA, 23 nt, Artificial Sequence
  RNA Oligomer
acgugcagaugcaaaggacaacc

SEQ ID NO: 43339 - RNA, 23 nt, Artificial Sequence
  RNA Oligomer
agacaucuuagggaggguuuuau

SEQ ID NO: 43340 - RNA, 23 nt, Artificial Sequence
  RNA Oligomer
gacaucuuagggaggguuuuaug

SEQ ID NO: 43341 - RNA, 23 nt, Artificial Sequence
  RNA Oligomer
ugcaaaaguguuguccaccccuc

SEQ ID NO: 43342 - RNA, 23 nt, Artificial Sequence
  RNA Oligomer
gcaaaaguguuguccaccccucg

SEQ ID NO: 43343 - RNA, 23 nt, Artificial Sequence
  RNA Oligomer
auugggaguugaugucaguucag

SEQ ID NO: 43344 - RNA, 23 nt, Artificial Sequence
  RNA Oligomer
uugggaguugaugucaguucagg

SEQ ID NO: 43345 - RNA, 23 nt, Artificial Sequence
  RNA Oligomer
uagggaggguuuuaugcuucuga

SEQ ID NO: 43346 - RNA, 23 nt, Artificial Sequence
  RNA Oligomer
agggaggguuuuaugcuucugaa

SEQ ID NO: 43347 - RNA, 23 nt, Artificial Sequence
  RNA Oligomer
ugccaugaaacuauggcuuucag

SEQ ID NO: 43348 - RNA, 23 nt, Artificial Sequence
  RNA Oligomer
gccaugaaacuauggcuuucagc

SEQ ID NO: 43349 - RNA, 23 nt, Artificial Sequence
  RNA Oligomer
ccaugaaacuauggcuuucagca

SEQ ID NO: 43350 - RNA, 23 nt, Artificial Sequence
  RNA Oligomer
caugaaacuauggcuuucagcau

SEQ ID NO: 43351 - RNA, 23 nt, Artificial Sequence
  RNA Oligomer
uggcuuucagcaucugucugcuc

SEQ ID NO: 43352 - RNA, 23 nt, Artificial Sequence
  RNA Oligomer
caaccucauccucuggauaauga

SEQ ID NO: 43353 - RNA, 23 nt, Artificial Sequence
  RNA Oligomer
aaccucauccucuggauaaugac

SEQ ID NO: 43354 - RNA, 23 nt, Artificial Sequence
  RNA Oligomer
accucauccucuggauaaugaca

SEQ ID NO: 43355 - RNA, 23 nt, Artificial Sequence
  RNA Oligomer
ccucauccucuggauaaugacag

SEQ ID NO: 43356 - RNA, 23 nt, Artificial Sequence
  RNA Oligomer
cucauccucuggauaaugacagu

SEQ ID NO: 43357 - RNA, 23 nt, Artificial Sequence
  RNA Oligomer
ucauccucuggauaaugacaguc

SEQ ID NO: 43358 - RNA, 23 nt, Artificial Sequence
  RNA Oligomer
ugacaguccaacacaagggccuu

SEQ ID NO: 43359 - RNA, 23 nt, Artificial Sequence
  RNA Oligomer
ccucaccaucaaauguugguggg

SEQ ID NO: 43360 - RNA, 23 nt, Artificial Sequence
  RNA Oligomer
cucaccaucaaauguugguggga

SEQ ID NO: 43361 - RNA, 23 nt, Artificial Sequence
  RNA Oligomer
ucaccaucaaauguuggugggau

SEQ ID NO: 43362 - RNA, 23 nt, Artificial Sequence
  RNA Oligomer
accuccagacaucuuagggaggg

SEQ ID NO: 43363 - RNA, 23 nt, Artificial Sequence
  RNA Oligomer
gggaggguuuuaugcuucugaau

SEQ ID NO: 43364 - RNA, 23 nt, Artificial Sequence
  RNA Oligomer
ggaggguuuuaugcuucugaauu

SEQ ID NO: 43365 - RNA, 23 nt, Artificial Sequence
  RNA Oligomer
gaggguuuuaugcuucugaauuu

SEQ ID NO: 43366 - RNA, 23 nt, Artificial Sequence
  RNA Oligomer
acucuugaggucuucaagaaaag

SEQ ID NO: 43367 - RNA, 23 nt, Artificial Sequence
  RNA Oligomer
cucuugaggucuucaagaaaagu

SEQ ID NO: 43368 - RNA, 23 nt, Artificial Sequence
  RNA Oligomer
ucuugaggucuucaagaaaagua

SEQ ID NO: 43369 - RNA, 23 nt, Artificial Sequence
  RNA Oligomer
gguggucauauaaggcccagucc

SEQ ID NO: 43370 - RNA, 23 nt, Artificial Sequence
  RNA Oligomer
guggucauauaaggcccagucca

SEQ ID NO: 43371 - RNA, 23 nt, Artificial Sequence
  RNA Oligomer
uggucauauaaggcccaguccaa

SEQ ID NO: 43372 - RNA, 23 nt, Artificial Sequence
  RNA Oligomer
ggucauauaaggcccaguccaag

SEQ ID NO: 43373 - RNA, 23 nt, Artificial Sequence
  RNA Oligomer
guccaacacaagggccuucuugc

SEQ ID NO: 43374 - RNA, 23 nt, Artificial Sequence
  RNA Oligomer
uccaacacaagggccuucuugcc

SEQ ID NO: 43375 - RNA, 23 nt, Artificial Sequence
  RNA Oligomer
ccaacacaagggccuucuugcca

SEQ ID NO: 43376 - RNA, 23 nt, Artificial Sequence
  RNA Oligomer
caacacaagggccuucuugccau

SEQ ID NO: 43377 - RNA, 23 nt, Artificial Sequence
  RNA Oligomer
aacacaagggccuucuugccauc

SEQ ID NO: 43378 - RNA, 23 nt, Artificial Sequence
  RNA Oligomer
accacgaaauugggaguugaugu

SEQ ID NO: 43379 - RNA, 23 nt, Artificial Sequence
  RNA Oligomer
gguuuuaugcuucugaauuuuuc

SEQ ID NO: 43380 - RNA, 23 nt, Artificial Sequence
  RNA Oligomer
ucacucaggaaaucaacaaaagc

SEQ ID NO: 43381 - RNA, 23 nt, Artificial Sequence
  RNA Oligomer
caucauucuuuauaacuucaacc

SEQ ID NO: 43382 - RNA, 23 nt, Artificial Sequence
  RNA Oligomer
aucacucaggaaaucaacaaaag

SEQ ID NO: 43383 - RNA, 23 nt, Artificial Sequence
  RNA Oligomer
gugggaugcuguuguuaauguug

SEQ ID NO: 43384 - RNA, 23 nt, Artificial Sequence
  RNA Oligomer
cacucucagccucgucuucuugu

SEQ ID NO: 43385 - RNA, 23 nt, Artificial Sequence
  RNA Oligomer
ucugucugcucuacuggcucuug

SEQ ID NO: 43386 - RNA, 23 nt, Artificial Sequence
  RNA Oligomer
cugucugcucuacuggcucuuga

SEQ ID NO: 43387 - RNA, 23 nt, Artificial Sequence
  RNA Oligomer
uucgcuucugucccauucaguuc

SEQ ID NO: 43388 - RNA, 23 nt, Artificial Sequence
  RNA Oligomer
aauccauuagguggucauauaag

SEQ ID NO: 43389 - RNA, 23 nt, Artificial Sequence
  RNA Oligomer
aacgacugcgaacacgugcagau

SEQ ID NO: 43390 - RNA, 23 nt, Artificial Sequence
  RNA Oligomer
auguuggugggaugcuguuguua

SEQ ID NO: 43391 - RNA, 23 nt, Artificial Sequence
  RNA Oligomer
acacaagggccuucuugccauca

SEQ ID NO: 43392 - RNA, 23 nt, Artificial Sequence
  RNA Oligomer
aaauguuggugggaugcuguugu

SEQ ID NO: 43393 - RNA, 23 nt, Artificial Sequence
  RNA Oligomer
uaggaugauaaucauuucaaagc

SEQ ID NO: 43394 - RNA, 23 nt, Artificial Sequence
  RNA Oligomer
aaacgacugcgaacacgugcaga

SEQ ID NO: 43395 - RNA, 23 nt, Artificial Sequence
  RNA Oligomer
gguuccuccucaccaucaaaugu

SEQ ID NO: 43396 - RNA, 23 nt, Artificial Sequence
  RNA Oligomer
auucagacucgccaguggacuga

SEQ ID NO: 43397 - RNA, 23 nt, Artificial Sequence
  RNA Oligomer
aguccaacacaagggccuucuug

SEQ ID NO: 43398 - RNA, 23 nt, Artificial Sequence
  RNA Oligomer
gaggagauaaaccaauuuuaugu

SEQ ID NO: 43399 - RNA, 23 nt, Artificial Sequence
  RNA Oligomer
uggugggaugcuguuguuaaugu

SEQ ID NO: 43400 - RNA, 23 nt, Artificial Sequence
  RNA Oligomer
ggagauaaaccaauuuuaugucu

SEQ ID NO: 43401 - RNA, 23 nt, Artificial Sequence
  RNA Oligomer
ggaauuaagucuccgauuauuag

SEQ ID NO: 43402 - RNA, 23 nt, Artificial Sequence
  RNA Oligomer
aggaauuaagucuccgauuauua

SEQ ID NO: 43403 - RNA, 23 nt, Artificial Sequence
  RNA Oligomer
aaggaauuaagucuccgauuauu

SEQ ID NO: 43404 - RNA, 23 nt, Artificial Sequence
  RNA Oligomer
uaaggaauuaagucuccgauuau

SEQ ID NO: 43405 - RNA, 23 nt, Artificial Sequence
  RNA Oligomer
auaaggaauuaagucuccgauua

SEQ ID NO: 43406 - RNA, 23 nt, Artificial Sequence
  RNA Oligomer
cugcauuggugaauuuaauccuc

SEQ ID NO: 43407 - RNA, 23 nt, Artificial Sequence
  RNA Oligomer
ucugcauuggugaauuuaauccu

SEQ ID NO: 43408 - RNA, 23 nt, Artificial Sequence
  RNA Oligomer
cucugcauuggugaauuuaaucc

SEQ ID NO: 43409 - RNA, 23 nt, Artificial Sequence
  RNA Oligomer
acucugcauuggugaauuuaauc

SEQ ID NO: 43410 - RNA, 23 nt, Artificial Sequence
  RNA Oligomer
cacucugcauuggugaauuuaau

SEQ ID NO: 43411 - RNA, 23 nt, Artificial Sequence
  RNA Oligomer
caacuuuugugugcuuuuaaaau

SEQ ID NO: 43412 - RNA, 23 nt, Artificial Sequence
  RNA Oligomer
ucaacuuuugugugcuuuuaaaa

SEQ ID NO: 43413 - RNA, 23 nt, Artificial Sequence
  RNA Oligomer
uucaacuuuugugugcuuuuaaa

SEQ ID NO: 43414 - RNA, 23 nt, Artificial Sequence
  RNA Oligomer
guucaacuuuugugugcuuuuaa

SEQ ID NO: 43415 - RNA, 23 nt, Artificial Sequence
  RNA Oligomer
uguucaacuuuugugugcuuuua

SEQ ID NO: 43416 - RNA, 23 nt, Artificial Sequence
  RNA Oligomer
ggaaaaaauacugcuggacgcac

SEQ ID NO: 43417 - RNA, 23 nt, Artificial Sequence
  RNA Oligomer
uggaaaaaauacugcuggacgca

SEQ ID NO: 43418 - RNA, 23 nt, Artificial Sequence
  RNA Oligomer
auggaaaaaauacugcuggacgc

SEQ ID NO: 43419 - RNA, 23 nt, Artificial Sequence
  RNA Oligomer
cauggaaaaaauacugcuggacg

SEQ ID NO: 43420 - RNA, 23 nt, Artificial Sequence
  RNA Oligomer
acauggaaaaaauacugcuggac

SEQ ID NO: 43421 - RNA, 23 nt, Artificial Sequence
  RNA Oligomer
agguugucuacuaaagaaagauu

SEQ ID NO: 43422 - RNA, 23 nt, Artificial Sequence
  RNA Oligomer
cagguugucuacuaaagaaagau

SEQ ID NO: 43423 - RNA, 23 nt, Artificial Sequence
  RNA Oligomer
gcagguugucuacuaaagaaaga

SEQ ID NO: 43424 - RNA, 23 nt, Artificial Sequence
  RNA Oligomer
ugcagguugucuacuaaagaaag

SEQ ID NO: 43425 - RNA, 23 nt, Artificial Sequence
  RNA Oligomer
augcagguugucuacuaaagaaa

SEQ ID NO: 43426 - RNA, 23 nt, Artificial Sequence
  RNA Oligomer
gaugcagguugucuacuaaagaa

SEQ ID NO: 43427 - RNA, 23 nt, Artificial Sequence
  RNA Oligomer
gccuuauauaucacacuauugua

SEQ ID NO: 43428 - RNA, 23 nt, Artificial Sequence
  RNA Oligomer
ggccuuauauaucacacuauugu

SEQ ID NO: 43429 - RNA, 23 nt, Artificial Sequence
  RNA Oligomer
uggccuuauauaucacacuauug

SEQ ID NO: 43430 - RNA, 23 nt, Artificial Sequence
  RNA Oligomer
guggccuuauauaucacacuauu

SEQ ID NO: 43431 - RNA, 23 nt, Artificial Sequence
  RNA Oligomer
uguggccuuauauaucacacuau

SEQ ID NO: 43432 - RNA, 23 nt, Artificial Sequence
  RNA Oligomer
ugaauuuaauccucuccuuugug

SEQ ID NO: 43433 - RNA, 23 nt, Artificial Sequence
  RNA Oligomer
gugaauuuaauccucuccuuugu

SEQ ID NO: 43434 - RNA, 23 nt, Artificial Sequence
  RNA Oligomer
ggugaauuuaauccucuccuuug

SEQ ID NO: 43435 - RNA, 23 nt, Artificial Sequence
  RNA Oligomer
uggugaauuuaauccucuccuuu

SEQ ID NO: 43436 - RNA, 23 nt, Artificial Sequence
  RNA Oligomer
uuggugaauuuaauccucuccuu

SEQ ID NO: 43437 - RNA, 23 nt, Artificial Sequence
  RNA Oligomer
uuguggccuuauauaucacacua

SEQ ID NO: 43438 - RNA, 23 nt, Artificial Sequence
  RNA Oligomer
gagaaaaacagcucacagucuga

SEQ ID NO: 43439 - RNA, 23 nt, Artificial Sequence
  RNA Oligomer
agagaaaaacagcucacagucug

SEQ ID NO: 43440 - RNA, 23 nt, Artificial Sequence
  RNA Oligomer
gagagaaaaacagcucacagucu

SEQ ID NO: 43441 - RNA, 23 nt, Artificial Sequence
  RNA Oligomer
ggagagaaaaacagcucacaguc

SEQ ID NO: 43442 - RNA, 23 nt, Artificial Sequence
  RNA Oligomer
uggagagaaaaacagcucacagu

SEQ ID NO: 43443 - RNA, 23 nt, Artificial Sequence
  RNA Oligomer
gacauggaaaaaauacugcugga

SEQ ID NO: 43444 - RNA, 23 nt, Artificial Sequence
  RNA Oligomer
gccucgguuucuauuuauaaugg

SEQ ID NO: 43445 - RNA, 23 nt, Artificial Sequence
  RNA Oligomer
agccucgguuucuauuuauaaug

SEQ ID NO: 43446 - RNA, 23 nt, Artificial Sequence
  RNA Oligomer
cagccucgguuucuauuuauaau

SEQ ID NO: 43447 - RNA, 23 nt, Artificial Sequence
  RNA Oligomer
ccagccucgguuucuauuuauaa

SEQ ID NO: 43448 - RNA, 23 nt, Artificial Sequence
  RNA Oligomer
uccagccucgguuucuauuuaua

SEQ ID NO: 43449 - RNA, 23 nt, Artificial Sequence
  RNA Oligomer
ggaaagaaguugaaagcaucuug

SEQ ID NO: 43450 - RNA, 23 nt, Artificial Sequence
  RNA Oligomer
aggaaagaaguugaaagcaucuu

SEQ ID NO: 43451 - RNA, 23 nt, Artificial Sequence
  RNA Oligomer
aaggaaagaaguugaaagcaucu

SEQ ID NO: 43452 - RNA, 23 nt, Artificial Sequence
  RNA Oligomer
gaaggaaagaaguugaaagcauc

SEQ ID NO: 43453 - RNA, 23 nt, Artificial Sequence
  RNA Oligomer
agaaggaaagaaguugaaagcau

SEQ ID NO: 43454 - RNA, 23 nt, Artificial Sequence
  RNA Oligomer
ccaagauagagcuacaaacucag

SEQ ID NO: 43455 - RNA, 23 nt, Artificial Sequence
  RNA Oligomer
accaagauagagcuacaaacuca

SEQ ID NO: 43456 - RNA, 23 nt, Artificial Sequence
  RNA Oligomer
aaccaagauagagcuacaaacuc

SEQ ID NO: 43457 - RNA, 23 nt, Artificial Sequence
  RNA Oligomer
aaaccaagauagagcuacaaacu

SEQ ID NO: 43458 - RNA, 23 nt, Artificial Sequence
  RNA Oligomer
gaaaccaagauagagcuacaaac

SEQ ID NO: 43459 - RNA, 23 nt, Artificial Sequence
  RNA Oligomer
ggguuuguccaaaauaaauauug

SEQ ID NO: 43460 - RNA, 23 nt, Artificial Sequence
  RNA Oligomer
gggguuuguccaaaauaaauauu

SEQ ID NO: 43461 - RNA, 23 nt, Artificial Sequence
  RNA Oligomer
agggguuuguccaaaauaaauau

SEQ ID NO: 43462 - RNA, 23 nt, Artificial Sequence
  RNA Oligomer
aagggguuuguccaaaauaaaua

SEQ ID NO: 43463 - RNA, 23 nt, Artificial Sequence
  RNA Oligomer
uaagggguuuguccaaaauaaau

SEQ ID NO: 43464 - RNA, 23 nt, Artificial Sequence
  RNA Oligomer
ggagacauggaaaaaauacugcu

SEQ ID NO: 43465 - RNA, 23 nt, Artificial Sequence
  RNA Oligomer
uggagacauggaaaaaauacugc

SEQ ID NO: 43466 - RNA, 23 nt, Artificial Sequence
  RNA Oligomer
auggagacauggaaaaaauacug

SEQ ID NO: 43467 - RNA, 23 nt, Artificial Sequence
  RNA Oligomer
aauggagacauggaaaaaauacu

SEQ ID NO: 43468 - RNA, 23 nt, Artificial Sequence
  RNA Oligomer
uaauggagacauggaaaaaauac

SEQ ID NO: 43469 - RNA, 23 nt, Artificial Sequence
  RNA Oligomer
guguucaacuuuugugugcuuuu

SEQ ID NO: 43470 - RNA, 23 nt, Artificial Sequence
  RNA Oligomer
gcauuggugaauuuaauccucuc

SEQ ID NO: 43471 - RNA, 23 nt, Artificial Sequence
  RNA Oligomer
ugcauuggugaauuuaauccucu

SEQ ID NO: 43472 - RNA, 23 nt, Artificial Sequence
  RNA Oligomer
ucacucugcauuggugaauuuaa

SEQ ID NO: 43473 - RNA, 23 nt, Artificial Sequence
  RNA Oligomer
aucacucugcauuggugaauuua

SEQ ID NO: 43474 - RNA, 23 nt, Artificial Sequence
  RNA Oligomer
uaucacucugcauuggugaauuu

SEQ ID NO: 43475 - RNA, 23 nt, Artificial Sequence
  RNA Oligomer
uuaucacucugcauuggugaauu

SEQ ID NO: 43476 - RNA, 23 nt, Artificial Sequence
  RNA Oligomer
gaauuaagucuccgauuauuagg

SEQ ID NO: 43477 - RNA, 23 nt, Artificial Sequence
  RNA Oligomer
gcguuccuaauuuaguaaaauaa

SEQ ID NO: 43478 - RNA, 23 nt, Artificial Sequence
  RNA Oligomer
ugcguuccuaauuuaguaaaaua

SEQ ID NO: 43479 - RNA, 23 nt, Artificial Sequence
  RNA Oligomer
cugcguuccuaauuuaguaaaau

SEQ ID NO: 43480 - RNA, 23 nt, Artificial Sequence
  RNA Oligomer
gcugcguuccuaauuuaguaaaa

SEQ ID NO: 43481 - RNA, 23 nt, Artificial Sequence
  RNA Oligomer
ugcugcguuccuaauuuaguaaa

SEQ ID NO: 43482 - RNA, 23 nt, Artificial Sequence
  RNA Oligomer
agacauggaaaaaauacugcugg

SEQ ID NO: 43483 - RNA, 23 nt, Artificial Sequence
  RNA Oligomer
gagacauggaaaaaauacugcug

SEQ ID NO: 43484 - RNA, 23 nt, Artificial Sequence
  RNA Oligomer
cuaagcaaaucugugucuacuuu

SEQ ID NO: 43485 - RNA, 23 nt, Artificial Sequence
  RNA Oligomer
ucuaagcaaaucugugucuacuu

SEQ ID NO: 43486 - RNA, 23 nt, Artificial Sequence
  RNA Oligomer
uucuaagcaaaucugugucuacu

SEQ ID NO: 43487 - RNA, 23 nt, Artificial Sequence
  RNA Oligomer
auucuaagcaaaucugugucuac

SEQ ID NO: 43488 - RNA, 23 nt, Artificial Sequence
  RNA Oligomer
uauucuaagcaaaucugugucua

SEQ ID NO: 43489 - RNA, 23 nt, Artificial Sequence
  RNA Oligomer
ugugugcuuuuaaaaucagcuuu

SEQ ID NO: 43490 - RNA, 23 nt, Artificial Sequence
  RNA Oligomer
uugugugcuuuuaaaaucagcuu

SEQ ID NO: 43491 - RNA, 23 nt, Artificial Sequence
  RNA Oligomer
uuugugugcuuuuaaaaucagcu

SEQ ID NO: 43492 - RNA, 23 nt, Artificial Sequence
  RNA Oligomer
uuuugugugcuuuuaaaaucagc

SEQ ID NO: 43493 - RNA, 23 nt, Artificial Sequence
  RNA Oligomer
cuuuugugugcuuuuaaaaucag

SEQ ID NO: 43494 - RNA, 23 nt, Artificial Sequence
  RNA Oligomer
ccgauuauuaggugaucacccug

SEQ ID NO: 43495 - RNA, 23 nt, Artificial Sequence
  RNA Oligomer
uccgauuauuaggugaucacccu

SEQ ID NO: 43496 - RNA, 23 nt, Artificial Sequence
  RNA Oligomer
cuccgauuauuaggugaucaccc

SEQ ID NO: 43497 - RNA, 23 nt, Artificial Sequence
  RNA Oligomer
ucuccgauuauuaggugaucacc

SEQ ID NO: 43498 - RNA, 23 nt, Artificial Sequence
  RNA Oligomer
gucuccgauuauuaggugaucac

SEQ ID NO: 43499 - RNA, 23 nt, Artificial Sequence
  RNA Oligomer
guugucuacuaaagaaagauuau

SEQ ID NO: 43500 - RNA, 23 nt, Artificial Sequence
  RNA Oligomer
gguugucuacuaaagaaagauua

SEQ ID NO: 43501 - RNA, 23 nt, Artificial Sequence
  RNA Oligomer
ccuuaauucagcugaaguacuuu

SEQ ID NO: 43502 - RNA, 23 nt, Artificial Sequence
  RNA Oligomer
accuuaauucagcugaaguacuu

SEQ ID NO: 43503 - RNA, 23 nt, Artificial Sequence
  RNA Oligomer
aaccuuaauucagcugaaguacu

SEQ ID NO: 43504 - RNA, 23 nt, Artificial Sequence
  RNA Oligomer
caaccuuaauucagcugaaguac

SEQ ID NO: 43505 - RNA, 23 nt, Artificial Sequence
  RNA Oligomer
gcaaccuuaauucagcugaagua

SEQ ID NO: 43506 - RNA, 23 nt, Artificial Sequence
  RNA Oligomer
auaauggagacauggaaaaaaua

SEQ ID NO: 43507 - RNA, 23 nt, Artificial Sequence
  RNA Oligomer
uauaauggagacauggaaaaaau

SEQ ID NO: 43508 - RNA, 23 nt, Artificial Sequence
  RNA Oligomer
uguguucaacuuuugugugcuuu

SEQ ID NO: 43509 - RNA, 23 nt, Artificial Sequence
  RNA Oligomer
uuguguucaacuuuugugugcuu

SEQ ID NO: 43510 - RNA, 23 nt, Artificial Sequence
  RNA Oligomer
uccuuuguguucaacuuuugugu

SEQ ID NO: 43511 - RNA, 23 nt, Artificial Sequence
  RNA Oligomer
cuccuuuguguucaacuuuugug

SEQ ID NO: 43512 - RNA, 23 nt, Artificial Sequence
  RNA Oligomer
ucuccuuuguguucaacuuuugu

SEQ ID NO: 43513 - RNA, 23 nt, Artificial Sequence
  RNA Oligomer
cucuccuuuguguucaacuuuug

SEQ ID NO: 43514 - RNA, 23 nt, Artificial Sequence
  RNA Oligomer
ccucuccuuuguguucaacuuuu

SEQ ID NO: 43515 - RNA, 23 nt, Artificial Sequence
  RNA Oligomer
uccucuccuuuguguucaacuuu

SEQ ID NO: 43516 - RNA, 23 nt, Artificial Sequence
  RNA Oligomer
auccucuccuuuguguucaacuu

SEQ ID NO: 43517 - RNA, 23 nt, Artificial Sequence
  RNA Oligomer
aauccucuccuuuguguucaacu

SEQ ID NO: 43518 - RNA, 23 nt, Artificial Sequence
  RNA Oligomer
uaauccucuccuuuguguucaac

SEQ ID NO: 43519 - RNA, 23 nt, Artificial Sequence
  RNA Oligomer
uuaauccucuccuuuguguucaa

SEQ ID NO: 43520 - RNA, 23 nt, Artificial Sequence
  RNA Oligomer
gaauuuaauccucuccuuugugu

SEQ ID NO: 43521 - RNA, 23 nt, Artificial Sequence
  RNA Oligomer
caaacucagcuguacaguucgua

SEQ ID NO: 43522 - RNA, 23 nt, Artificial Sequence
  RNA Oligomer
acaaacucagcuguacaguucgu

SEQ ID NO: 43523 - RNA, 23 nt, Artificial Sequence
  RNA Oligomer
uacaaacucagcuguacaguucg

SEQ ID NO: 43524 - RNA, 23 nt, Artificial Sequence
  RNA Oligomer
cuacaaacucagcuguacaguuc

SEQ ID NO: 43525 - RNA, 23 nt, Artificial Sequence
  RNA Oligomer
gcuacaaacucagcuguacaguu

SEQ ID NO: 43526 - RNA, 23 nt, Artificial Sequence
  RNA Oligomer
cugugaaaauuugguaguaaauu

SEQ ID NO: 43527 - RNA, 23 nt, Artificial Sequence
  RNA Oligomer
acugugaaaauuugguaguaaau

SEQ ID NO: 43528 - RNA, 23 nt, Artificial Sequence
  RNA Oligomer
uacugugaaaauuugguaguaaa

SEQ ID NO: 43529 - RNA, 23 nt, Artificial Sequence
  RNA Oligomer
cuacugugaaaauuugguaguaa

SEQ ID NO: 43530 - RNA, 23 nt, Artificial Sequence
  RNA Oligomer
ucuacugugaaaauuugguagua

SEQ ID NO: 43531 - RNA, 23 nt, Artificial Sequence
  RNA Oligomer
ucacugaagagcuguuagauccu

SEQ ID NO: 43532 - RNA, 23 nt, Artificial Sequence
  RNA Oligomer
cucacugaagagcuguuagaucc

SEQ ID NO: 43533 - RNA, 23 nt, Artificial Sequence
  RNA Oligomer
gcucacugaagagcuguuagauc

SEQ ID NO: 43534 - RNA, 23 nt, Artificial Sequence
  RNA Oligomer
agcucacugaagagcuguuagau

SEQ ID NO: 43535 - RNA, 23 nt, Artificial Sequence
  RNA Oligomer
uagcucacugaagagcuguuaga

SEQ ID NO: 43536 - RNA, 23 nt, Artificial Sequence
  RNA Oligomer
caacauagcucacugaagagcug

SEQ ID NO: 43537 - RNA, 23 nt, Artificial Sequence
  RNA Oligomer
gcaacauagcucacugaagagcu

SEQ ID NO: 43538 - RNA, 23 nt, Artificial Sequence
  RNA Oligomer
ugcaacauagcucacugaagagc

SEQ ID NO: 43539 - RNA, 23 nt, Artificial Sequence
  RNA Oligomer
uugcaacauagcucacugaagag

SEQ ID NO: 43540 - RNA, 23 nt, Artificial Sequence
  RNA Oligomer
cuugcaacauagcucacugaaga

SEQ ID NO: 43541 - RNA, 23 nt, Artificial Sequence
  RNA Oligomer
accuccaccagcaccuuuugaug

SEQ ID NO: 43542 - RNA, 23 nt, Artificial Sequence
  RNA Oligomer
aaccuccaccagcaccuuuugau

SEQ ID NO: 43543 - RNA, 23 nt, Artificial Sequence
  RNA Oligomer
caaccuccaccagcaccuuuuga

SEQ ID NO: 43544 - RNA, 23 nt, Artificial Sequence
  RNA Oligomer
acaaccuccaccagcaccuuuug

SEQ ID NO: 43545 - RNA, 23 nt, Artificial Sequence
  RNA Oligomer
gacaaccuccaccagcaccuuuu

SEQ ID NO: 43546 - RNA, 23 nt, Artificial Sequence
  RNA Oligomer
uuccagccucgguuucuauuuau

SEQ ID NO: 43547 - RNA, 23 nt, Artificial Sequence
  RNA Oligomer
caagucggccggaaaauauuccc

SEQ ID NO: 43548 - RNA, 23 nt, Artificial Sequence
  RNA Oligomer
ucaagucggccggaaaauauucc

SEQ ID NO: 43549 - RNA, 23 nt, Artificial Sequence
  RNA Oligomer
gucaagucggccggaaaauauuc

SEQ ID NO: 43550 - RNA, 23 nt, Artificial Sequence
  RNA Oligomer
ggucaagucggccggaaaauauu

SEQ ID NO: 43551 - RNA, 23 nt, Artificial Sequence
  RNA Oligomer
uggucaagucggccggaaaauau

SEQ ID NO: 43552 - RNA, 23 nt, Artificial Sequence
  RNA Oligomer
ucagauuggauaugggauugguc

SEQ ID NO: 43553 - RNA, 23 nt, Artificial Sequence
  RNA Oligomer
cucagauuggauaugggauuggu

SEQ ID NO: 43554 - RNA, 23 nt, Artificial Sequence
  RNA Oligomer
acucagauuggauaugggauugg

SEQ ID NO: 43555 - RNA, 23 nt, Artificial Sequence
  RNA Oligomer
aacucagauuggauaugggauug

SEQ ID NO: 43556 - RNA, 23 nt, Artificial Sequence
  RNA Oligomer
aaacucagauuggauaugggauu

SEQ ID NO: 43557 - RNA, 23 nt, Artificial Sequence
  RNA Oligomer
gaaaaacucagauuggauauggg

SEQ ID NO: 43558 - RNA, 23 nt, Artificial Sequence
  RNA Oligomer
agaaaaacucagauuggauaugg

SEQ ID NO: 43559 - RNA, 23 nt, Artificial Sequence
  RNA Oligomer
aagaaaaacucagauuggauaug

SEQ ID NO: 43560 - RNA, 23 nt, Artificial Sequence
  RNA Oligomer
gaagaaaaacucagauuggauau

SEQ ID NO: 43561 - RNA, 23 nt, Artificial Sequence
  RNA Oligomer
ugaagaaaaacucagauuggaua

SEQ ID NO: 43562 - RNA, 23 nt, Artificial Sequence
  RNA Oligomer
gaaagcaucuugaagaaaaacuc

SEQ ID NO: 43563 - RNA, 23 nt, Artificial Sequence
  RNA Oligomer
ugaaagcaucuugaagaaaaacu

SEQ ID NO: 43564 - RNA, 23 nt, Artificial Sequence
  RNA Oligomer
uugaaagcaucuugaagaaaaac

SEQ ID NO: 43565 - RNA, 23 nt, Artificial Sequence
  RNA Oligomer
guugaaagcaucuugaagaaaaa

SEQ ID NO: 43566 - RNA, 23 nt, Artificial Sequence
  RNA Oligomer
aguugaaagcaucuugaagaaaa

SEQ ID NO: 43567 - RNA, 23 nt, Artificial Sequence
  RNA Oligomer
auuggugaauuuaauccucuccu

SEQ ID NO: 43568 - RNA, 23 nt, Artificial Sequence
  RNA Oligomer
cguacacuaaacucuucuugcuu

SEQ ID NO: 43569 - RNA, 23 nt, Artificial Sequence
  RNA Oligomer
ucguacacuaaacucuucuugcu

SEQ ID NO: 43570 - RNA, 23 nt, Artificial Sequence
  RNA Oligomer
uucguacacuaaacucuucuugc

SEQ ID NO: 43571 - RNA, 23 nt, Artificial Sequence
  RNA Oligomer
guucguacacuaaacucuucuug

SEQ ID NO: 43572 - RNA, 23 nt, Artificial Sequence
  RNA Oligomer
aguucguacacuaaacucuucuu

SEQ ID NO: 43573 - RNA, 23 nt, Artificial Sequence
  RNA Oligomer
agaaaccaagauagagcuacaaa

SEQ ID NO: 43574 - RNA, 23 nt, Artificial Sequence
  RNA Oligomer
cacacuauuguagaaaguauuau

SEQ ID NO: 43575 - RNA, 23 nt, Artificial Sequence
  RNA Oligomer
ucacacuauuguagaaaguauua

SEQ ID NO: 43576 - RNA, 23 nt, Artificial Sequence
  RNA Oligomer
aucacacuauuguagaaaguauu

SEQ ID NO: 43577 - RNA, 23 nt, Artificial Sequence
  RNA Oligomer
uaucacacuauuguagaaaguau

SEQ ID NO: 43578 - RNA, 23 nt, Artificial Sequence
  RNA Oligomer
auaucacacuauuguagaaagua

SEQ ID NO: 43579 - RNA, 23 nt, Artificial Sequence
  RNA Oligomer
gucuacugugaaaauuugguagu

SEQ ID NO: 43580 - RNA, 23 nt, Artificial Sequence
  RNA Oligomer
ugucuacugugaaaauuugguag

SEQ ID NO: 43581 - RNA, 23 nt, Artificial Sequence
  RNA Oligomer
augucuacugugaaaauuuggua

SEQ ID NO: 43582 - RNA, 23 nt, Artificial Sequence
  RNA Oligomer
cgucacuuguguuuauuuguucu

SEQ ID NO: 43583 - RNA, 23 nt, Artificial Sequence
  RNA Oligomer
acgucacuuguguuuauuuguuc

SEQ ID NO: 43584 - RNA, 23 nt, Artificial Sequence
  RNA Oligomer
cacgucacuuguguuuauuuguu

SEQ ID NO: 43585 - RNA, 23 nt, Artificial Sequence
  RNA Oligomer
ccacgucacuuguguuuauuugu

SEQ ID NO: 43586 - RNA, 23 nt, Artificial Sequence
  RNA Oligomer
gccacgucacuuguguuuauuug

SEQ ID NO: 43587 - RNA, 23 nt, Artificial Sequence
  RNA Oligomer
guggauuacuucugagcuugcaa

SEQ ID NO: 43588 - RNA, 23 nt, Artificial Sequence
  RNA Oligomer
aguggauuacuucugagcuugca

SEQ ID NO: 43589 - RNA, 23 nt, Artificial Sequence
  RNA Oligomer
uaguggauuacuucugagcuugc

SEQ ID NO: 43590 - RNA, 23 nt, Artificial Sequence
  RNA Oligomer
uuaguggauuacuucugagcuug

SEQ ID NO: 43591 - RNA, 23 nt, Artificial Sequence
  RNA Oligomer
guuaguggauuacuucugagcuu

SEQ ID NO: 43592 - RNA, 23 nt, Artificial Sequence
  RNA Oligomer
uuauaauggagacauggaaaaaa

SEQ ID NO: 43593 - RNA, 23 nt, Artificial Sequence
  RNA Oligomer
uuuauaauggagacauggaaaaa

SEQ ID NO: 43594 - RNA, 23 nt, Artificial Sequence
  RNA Oligomer
auuuauaauggagacauggaaaa

SEQ ID NO: 43595 - RNA, 23 nt, Artificial Sequence
  RNA Oligomer
uauuuauaauggagacauggaaa

SEQ ID NO: 43596 - RNA, 23 nt, Artificial Sequence
  RNA Oligomer
cuauuuauaauggagacauggaa

SEQ ID NO: 43597 - RNA, 23 nt, Artificial Sequence
  RNA Oligomer
ggauaugggauuggucaagucgg

SEQ ID NO: 43598 - RNA, 23 nt, Artificial Sequence
  RNA Oligomer
uggauaugggauuggucaagucg

SEQ ID NO: 43599 - RNA, 23 nt, Artificial Sequence
  RNA Oligomer
uuggauaugggauuggucaaguc

SEQ ID NO: 43600 - RNA, 23 nt, Artificial Sequence
  RNA Oligomer
auuggauaugggauuggucaagu

SEQ ID NO: 43601 - RNA, 23 nt, Artificial Sequence
  RNA Oligomer
gauuggauaugggauuggucaag

SEQ ID NO: 43602 - RNA, 23 nt, Artificial Sequence
  RNA Oligomer
ccuggguagaacugcacuucagc

SEQ ID NO: 43603 - RNA, 23 nt, Artificial Sequence
  RNA Oligomer
uccuggguagaacugcacuucag

SEQ ID NO: 43604 - RNA, 23 nt, Artificial Sequence
  RNA Oligomer
cuccuggguagaacugcacuuca

SEQ ID NO: 43605 - RNA, 23 nt, Artificial Sequence
  RNA Oligomer
gcuccuggguagaacugcacuuc

SEQ ID NO: 43606 - RNA, 23 nt, Artificial Sequence
  RNA Oligomer
ggcuccuggguagaacugcacuu

SEQ ID NO: 43607 - RNA, 23 nt, Artificial Sequence
  RNA Oligomer
cucagcuguacaguucguacacu

SEQ ID NO: 43608 - RNA, 23 nt, Artificial Sequence
  RNA Oligomer
acucagcuguacaguucguacac

SEQ ID NO: 43609 - RNA, 23 nt, Artificial Sequence
  RNA Oligomer
aacucagcuguacaguucguaca

SEQ ID NO: 43610 - RNA, 23 nt, Artificial Sequence
  RNA Oligomer
aaacucagcuguacaguucguac

SEQ ID NO: 43611 - RNA, 23 nt, Artificial Sequence
  RNA Oligomer
ucauaaucaacagaaaccaagau

SEQ ID NO: 43612 - RNA, 23 nt, Artificial Sequence
  RNA Oligomer
uucauaaucaacagaaaccaaga

SEQ ID NO: 43613 - RNA, 23 nt, Artificial Sequence
  RNA Oligomer
guucauaaucaacagaaaccaag

SEQ ID NO: 43614 - RNA, 23 nt, Artificial Sequence
  RNA Oligomer
uguucauaaucaacagaaaccaa

SEQ ID NO: 43615 - RNA, 23 nt, Artificial Sequence
  RNA Oligomer
uuguucauaaucaacagaaacca

SEQ ID NO: 43616 - RNA, 23 nt, Artificial Sequence
  RNA Oligomer
cacuuguguuuauuuguucugua

SEQ ID NO: 43617 - RNA, 23 nt, Artificial Sequence
  RNA Oligomer
ucacuuguguuuauuuguucugu

SEQ ID NO: 43618 - RNA, 23 nt, Artificial Sequence
  RNA Oligomer
gucacuuguguuuauuuguucug

SEQ ID NO: 43619 - RNA, 23 nt, Artificial Sequence
  RNA Oligomer
ggccacgucacuuguguuuauuu

SEQ ID NO: 43620 - RNA, 23 nt, Artificial Sequence
  RNA Oligomer
guucguuaguggauuacuucuga

SEQ ID NO: 43621 - RNA, 23 nt, Artificial Sequence
  RNA Oligomer
gguucguuaguggauuacuucug

SEQ ID NO: 43622 - RNA, 23 nt, Artificial Sequence
  RNA Oligomer
ugguucguuaguggauuacuucu

SEQ ID NO: 43623 - RNA, 23 nt, Artificial Sequence
  RNA Oligomer
uugguucguuaguggauuacuuc

SEQ ID NO: 43624 - RNA, 23 nt, Artificial Sequence
  RNA Oligomer
cuugguucguuaguggauuacuu

SEQ ID NO: 43625 - RNA, 23 nt, Artificial Sequence
  RNA Oligomer
acuugguucguuaguggauuacu

SEQ ID NO: 43626 - RNA, 23 nt, Artificial Sequence
  RNA Oligomer
gacuugguucguuaguggauuac

SEQ ID NO: 43627 - RNA, 23 nt, Artificial Sequence
  RNA Oligomer
ugacuugguucguuaguggauua

SEQ ID NO: 43628 - RNA, 23 nt, Artificial Sequence
  RNA Oligomer
ccucgguuucuauuuauaaugga

SEQ ID NO: 43629 - RNA, 23 nt, Artificial Sequence
  RNA Oligomer
guuccagccucgguuucuauuua

SEQ ID NO: 43630 - RNA, 23 nt, Artificial Sequence
  RNA Oligomer
uccucuuuaaacacccgaagcgc

SEQ ID NO: 43631 - RNA, 23 nt, Artificial Sequence
  RNA Oligomer
uuccucuuuaaacacccgaagcg

SEQ ID NO: 43632 - RNA, 23 nt, Artificial Sequence
  RNA Oligomer
guuccucuuuaaacacccgaagc

SEQ ID NO: 43633 - RNA, 23 nt, Artificial Sequence
  RNA Oligomer
aguuccucuuuaaacacccgaag

SEQ ID NO: 43634 - RNA, 23 nt, Artificial Sequence
  RNA Oligomer
gaguuccucuuuaaacacccgaa

SEQ ID NO: 43635 - RNA, 23 nt, Artificial Sequence
  RNA Oligomer
uuggucaagucggccggaaaaua

SEQ ID NO: 43636 - RNA, 23 nt, Artificial Sequence
  RNA Oligomer
ggaagaugauauugaaagaagga

SEQ ID NO: 43637 - RNA, 23 nt, Artificial Sequence
  RNA Oligomer
aggaagaugauauugaaagaagg

SEQ ID NO: 43638 - RNA, 23 nt, Artificial Sequence
  RNA Oligomer
gaggaagaugauauugaaagaag

SEQ ID NO: 43639 - RNA, 23 nt, Artificial Sequence
  RNA Oligomer
ugaggaagaugauauugaaagaa

SEQ ID NO: 43640 - RNA, 23 nt, Artificial Sequence
  RNA Oligomer
cugaggaagaugauauugaaaga

SEQ ID NO: 43641 - RNA, 23 nt, Artificial Sequence
  RNA Oligomer
cugaaacagauacccauagcauu

SEQ ID NO: 43642 - RNA, 23 nt, Artificial Sequence
  RNA Oligomer
ucugaaacagauacccauagcau

SEQ ID NO: 43643 - RNA, 23 nt, Artificial Sequence
  RNA Oligomer
uucugaaacagauacccauagca

SEQ ID NO: 43644 - RNA, 23 nt, Artificial Sequence
  RNA Oligomer
cuucugaaacagauacccauagc

SEQ ID NO: 43645 - RNA, 23 nt, Artificial Sequence
  RNA Oligomer
gcuucugaaacagauacccauag

SEQ ID NO: 43646 - RNA, 23 nt, Artificial Sequence
  RNA Oligomer
ccuuuguguucaacuuuugugug

SEQ ID NO: 43647 - RNA, 23 nt, Artificial Sequence
  RNA Oligomer
acacuaaacucuucuugcuuuug

SEQ ID NO: 43648 - RNA, 23 nt, Artificial Sequence
  RNA Oligomer
uacacuaaacucuucuugcuuuu

SEQ ID NO: 43649 - RNA, 23 nt, Artificial Sequence
  RNA Oligomer
guacacuaaacucuucuugcuuu

SEQ ID NO: 43650 - RNA, 23 nt, Artificial Sequence
  RNA Oligomer
caagauagagcuacaaacucagc

SEQ ID NO: 43651 - RNA, 23 nt, Artificial Sequence
  RNA Oligomer
cagaaaccaagauagagcuacaa

SEQ ID NO: 43652 - RNA, 23 nt, Artificial Sequence
  RNA Oligomer
gcaugucagacugauuaaugucu

SEQ ID NO: 43653 - RNA, 23 nt, Artificial Sequence
  RNA Oligomer
agcaugucagacugauuaauguc

SEQ ID NO: 43654 - RNA, 23 nt, Artificial Sequence
  RNA Oligomer
aagcaugucagacugauuaaugu

SEQ ID NO: 43655 - RNA, 23 nt, Artificial Sequence
  RNA Oligomer
uaagcaugucagacugauuaaug

SEQ ID NO: 43656 - RNA, 23 nt, Artificial Sequence
  RNA Oligomer
auaagcaugucagacugauuaau

SEQ ID NO: 43657 - RNA, 23 nt, Artificial Sequence
  RNA Oligomer
acaccuaugggaucaauaagcau

SEQ ID NO: 43658 - RNA, 23 nt, Artificial Sequence
  RNA Oligomer
uacaccuaugggaucaauaagca

SEQ ID NO: 43659 - RNA, 23 nt, Artificial Sequence
  RNA Oligomer
uuacaccuaugggaucaauaagc

SEQ ID NO: 43660 - RNA, 23 nt, Artificial Sequence
  RNA Oligomer
auuacaccuaugggaucaauaag

SEQ ID NO: 43661 - RNA, 23 nt, Artificial Sequence
  RNA Oligomer
aauuacaccuaugggaucaauaa

SEQ ID NO: 43662 - RNA, 23 nt, Artificial Sequence
  RNA Oligomer
uaauuacaccuaugggaucaaua

SEQ ID NO: 43663 - RNA, 23 nt, Artificial Sequence
  RNA Oligomer
auaauuacaccuaugggaucaau

SEQ ID NO: 43664 - RNA, 23 nt, Artificial Sequence
  RNA Oligomer
augcugcguuccuaauuuaguaa

SEQ ID NO: 43665 - RNA, 23 nt, Artificial Sequence
  RNA Oligomer
aaugcugcguuccuaauuuagua

SEQ ID NO: 43666 - RNA, 23 nt, Artificial Sequence
  RNA Oligomer
cacugaagagcuguuagauccug

SEQ ID NO: 43667 - RNA, 23 nt, Artificial Sequence
  RNA Oligomer
cugacuugguucguuaguggauu

SEQ ID NO: 43668 - RNA, 23 nt, Artificial Sequence
  RNA Oligomer
gagucugacuugguucguuagug

SEQ ID NO: 43669 - RNA, 23 nt, Artificial Sequence
  RNA Oligomer
ggagucugacuugguucguuagu

SEQ ID NO: 43670 - RNA, 23 nt, Artificial Sequence
  RNA Oligomer
uggagucugacuugguucguuag

SEQ ID NO: 43671 - RNA, 23 nt, Artificial Sequence
  RNA Oligomer
cuggagucugacuugguucguua

SEQ ID NO: 43672 - RNA, 23 nt, Artificial Sequence
  RNA Oligomer
acuggagucugacuugguucguu

SEQ ID NO: 43673 - RNA, 23 nt, Artificial Sequence
  RNA Oligomer
auuggucaagucggccggaaaau

SEQ ID NO: 43674 - RNA, 23 nt, Artificial Sequence
  RNA Oligomer
ucugaggaagaugauauugaaag

SEQ ID NO: 43675 - RNA, 23 nt, Artificial Sequence
  RNA Oligomer
gucugaggaagaugauauugaaa

SEQ ID NO: 43676 - RNA, 23 nt, Artificial Sequence
  RNA Oligomer
agucugaggaagaugauauugaa

SEQ ID NO: 43677 - RNA, 23 nt, Artificial Sequence
  RNA Oligomer
cagucugaggaagaugauauuga

SEQ ID NO: 43678 - RNA, 23 nt, Artificial Sequence
  RNA Oligomer
acagucugaggaagaugauauug

SEQ ID NO: 43679 - RNA, 23 nt, Artificial Sequence
  RNA Oligomer
cacagucugaggaagaugauauu

SEQ ID NO: 43680 - RNA, 23 nt, Artificial Sequence
  RNA Oligomer
ucacagucugaggaagaugauau

SEQ ID NO: 43681 - RNA, 23 nt, Artificial Sequence
  RNA Oligomer
cucacagucugaggaagaugaua

SEQ ID NO: 43682 - RNA, 23 nt, Artificial Sequence
  RNA Oligomer
gcucacagucugaggaagaugau

SEQ ID NO: 43683 - RNA, 23 nt, Artificial Sequence
  RNA Oligomer
gaaacagauacccauagcauugg

SEQ ID NO: 43684 - RNA, 23 nt, Artificial Sequence
  RNA Oligomer
ugaaacagauacccauagcauug

SEQ ID NO: 43685 - RNA, 23 nt, Artificial Sequence
  RNA Oligomer
auuguggccuuauauaucacacu

SEQ ID NO: 43686 - RNA, 23 nt, Artificial Sequence
  RNA Oligomer
ugauuaaugucuacugugaaaau

SEQ ID NO: 43687 - RNA, 23 nt, Artificial Sequence
  RNA Oligomer
cugauuaaugucuacugugaaaa

SEQ ID NO: 43688 - RNA, 23 nt, Artificial Sequence
  RNA Oligomer
acugauuaaugucuacugugaaa

SEQ ID NO: 43689 - RNA, 23 nt, Artificial Sequence
  RNA Oligomer
gacugauuaaugucuacugugaa

SEQ ID NO: 43690 - RNA, 23 nt, Artificial Sequence
  RNA Oligomer
agacugauuaaugucuacuguga

SEQ ID NO: 43691 - RNA, 23 nt, Artificial Sequence
  RNA Oligomer
guaaaugcugcguuccuaauuua

SEQ ID NO: 43692 - RNA, 23 nt, Artificial Sequence
  RNA Oligomer
uguaaaugcugcguuccuaauuu

SEQ ID NO: 43693 - RNA, 23 nt, Artificial Sequence
  RNA Oligomer
cuguaaaugcugcguuccuaauu

SEQ ID NO: 43694 - RNA, 23 nt, Artificial Sequence
  RNA Oligomer
ucuguaaaugcugcguuccuaau

SEQ ID NO: 43695 - RNA, 23 nt, Artificial Sequence
  RNA Oligomer
uucuguaaaugcugcguuccuaa

SEQ ID NO: 43696 - RNA, 23 nt, Artificial Sequence
  RNA Oligomer
guucuguaaaugcugcguuccua

SEQ ID NO: 43697 - RNA, 23 nt, Artificial Sequence
  RNA Oligomer
cguuaguggauuacuucugagcu

SEQ ID NO: 43698 - RNA, 23 nt, Artificial Sequence
  RNA Oligomer
ucguuaguggauuacuucugagc

SEQ ID NO: 43699 - RNA, 23 nt, Artificial Sequence
  RNA Oligomer
uucguuaguggauuacuucugag

SEQ ID NO: 43700 - RNA, 23 nt, Artificial Sequence
  RNA Oligomer
uugaagaaaaacucagauuggau

SEQ ID NO: 43701 - RNA, 23 nt, Artificial Sequence
  RNA Oligomer
cuugaagaaaaacucagauugga

SEQ ID NO: 43702 - RNA, 23 nt, Artificial Sequence
  RNA Oligomer
ucuugaagaaaaacucagauugg

SEQ ID NO: 43703 - RNA, 23 nt, Artificial Sequence
  RNA Oligomer
aucuugaagaaaaacucagauug

SEQ ID NO: 43704 - RNA, 23 nt, Artificial Sequence
  RNA Oligomer
gcaucuugaagaaaaacucagau

SEQ ID NO: 43705 - RNA, 23 nt, Artificial Sequence
  RNA Oligomer
agcaucuugaagaaaaacucaga

SEQ ID NO: 43706 - RNA, 23 nt, Artificial Sequence
  RNA Oligomer
aagcaucuugaagaaaaacucag

SEQ ID NO: 43707 - RNA, 23 nt, Artificial Sequence
  RNA Oligomer
aaagcaucuugaagaaaaacuca

SEQ ID NO: 43708 - RNA, 23 nt, Artificial Sequence
  RNA Oligomer
aaguugaaagcaucuugaagaaa

SEQ ID NO: 43709 - RNA, 23 nt, Artificial Sequence
  RNA Oligomer
gaaguugaaagcaucuugaagaa

SEQ ID NO: 43710 - RNA, 23 nt, Artificial Sequence
  RNA Oligomer
agaaguugaaagcaucuugaaga

SEQ ID NO: 43711 - RNA, 23 nt, Artificial Sequence
  RNA Oligomer
aagaaguugaaagcaucuugaag

SEQ ID NO: 43712 - RNA, 23 nt, Artificial Sequence
  RNA Oligomer
aaagaaguugaaagcaucuugaa

SEQ ID NO: 43713 - RNA, 23 nt, Artificial Sequence
  RNA Oligomer
gaaagaaguugaaagcaucuuga

SEQ ID NO: 43714 - RNA, 23 nt, Artificial Sequence
  RNA Oligomer
aagaaggaaagaaguugaaagca

SEQ ID NO: 43715 - RNA, 23 nt, Artificial Sequence
  RNA Oligomer
aaagaaggaaagaaguugaaagc

SEQ ID NO: 43716 - RNA, 23 nt, Artificial Sequence
  RNA Oligomer
gaaagaaggaaagaaguugaaag

SEQ ID NO: 43717 - RNA, 23 nt, Artificial Sequence
  RNA Oligomer
ugaaagaaggaaagaaguugaaa

SEQ ID NO: 43718 - RNA, 23 nt, Artificial Sequence
  RNA Oligomer
uugaaagaaggaaagaaguugaa

SEQ ID NO: 43719 - RNA, 23 nt, Artificial Sequence
  RNA Oligomer
agcucacagucugaggaagauga

SEQ ID NO: 43720 - RNA, 23 nt, Artificial Sequence
  RNA Oligomer
gcuuuugcauuauaaggaauuaa

SEQ ID NO: 43721 - RNA, 23 nt, Artificial Sequence
  RNA Oligomer
ugcuuuugcauuauaaggaauua

SEQ ID NO: 43722 - RNA, 23 nt, Artificial Sequence
  RNA Oligomer
uugcuuuugcauuauaaggaauu

SEQ ID NO: 43723 - RNA, 23 nt, Artificial Sequence
  RNA Oligomer
cuugcuuuugcauuauaaggaau

SEQ ID NO: 43724 - RNA, 23 nt, Artificial Sequence
  RNA Oligomer
ucuugcuuuugcauuauaaggaa

SEQ ID NO: 43725 - RNA, 23 nt, Artificial Sequence
  RNA Oligomer
cacuaaacucuucuugcuuuugc

SEQ ID NO: 43726 - RNA, 23 nt, Artificial Sequence
  RNA Oligomer
caguucguacacuaaacucuucu

SEQ ID NO: 43727 - RNA, 23 nt, Artificial Sequence
  RNA Oligomer
aucaacagaaaccaagauagagc

SEQ ID NO: 43728 - RNA, 23 nt, Artificial Sequence
  RNA Oligomer
aaucaacagaaaccaagauagag

SEQ ID NO: 43729 - RNA, 23 nt, Artificial Sequence
  RNA Oligomer
uaaucaacagaaaccaagauaga

SEQ ID NO: 43730 - RNA, 23 nt, Artificial Sequence
  RNA Oligomer
auaaucaacagaaaccaagauag

SEQ ID NO: 43731 - RNA, 23 nt, Artificial Sequence
  RNA Oligomer
cauaaucaacagaaaccaagaua

SEQ ID NO: 43732 - RNA, 23 nt, Artificial Sequence
  RNA Oligomer
gggaucaauaagcaugucagacu

SEQ ID NO: 43733 - RNA, 23 nt, Artificial Sequence
  RNA Oligomer
ugggaucaauaagcaugucagac

SEQ ID NO: 43734 - RNA, 23 nt, Artificial Sequence
  RNA Oligomer
augggaucaauaagcaugucaga

SEQ ID NO: 43735 - RNA, 23 nt, Artificial Sequence
  RNA Oligomer
uaugggaucaauaagcaugucag

SEQ ID NO: 43736 - RNA, 23 nt, Artificial Sequence
  RNA Oligomer
cuaugggaucaauaagcauguca

SEQ ID NO: 43737 - RNA, 23 nt, Artificial Sequence
  RNA Oligomer
aaaugcugcguuccuaauuuagu

SEQ ID NO: 43738 - RNA, 23 nt, Artificial Sequence
  RNA Oligomer
uaaaugcugcguuccuaauuuag

SEQ ID NO: 43739 - RNA, 23 nt, Artificial Sequence
  RNA Oligomer
uguucuguaaaugcugcguuccu

SEQ ID NO: 43740 - RNA, 23 nt, Artificial Sequence
  RNA Oligomer
uuguucuguaaaugcugcguucc

SEQ ID NO: 43741 - RNA, 23 nt, Artificial Sequence
  RNA Oligomer
uuuguucuguaaaugcugcguuc

SEQ ID NO: 43742 - RNA, 23 nt, Artificial Sequence
  RNA Oligomer
auuuguucuguaaaugcugcguu

SEQ ID NO: 43743 - RNA, 23 nt, Artificial Sequence
  RNA Oligomer
aacuggagucugacuugguucgu

SEQ ID NO: 43744 - RNA, 23 nt, Artificial Sequence
  RNA Oligomer
ggaucuauauuggaaggcgucug

SEQ ID NO: 43745 - RNA, 23 nt, Artificial Sequence
  RNA Oligomer
gggaucuauauuggaaggcgucu

SEQ ID NO: 43746 - RNA, 23 nt, Artificial Sequence
  RNA Oligomer
ggggaucuauauuggaaggcguc

SEQ ID NO: 43747 - RNA, 23 nt, Artificial Sequence
  RNA Oligomer
uggggaucuauauuggaaggcgu

SEQ ID NO: 43748 - RNA, 23 nt, Artificial Sequence
  RNA Oligomer
uuggggaucuauauuggaaggcg

SEQ ID NO: 43749 - RNA, 23 nt, Artificial Sequence
  RNA Oligomer
auuggggaucuauauuggaaggc

SEQ ID NO: 43750 - RNA, 23 nt, Artificial Sequence
  RNA Oligomer
cuggguagaacugcacuucagca

SEQ ID NO: 43751 - RNA, 23 nt, Artificial Sequence
  RNA Oligomer
cagauuggauaugggauugguca

SEQ ID NO: 43752 - RNA, 23 nt, Artificial Sequence
  RNA Oligomer
acuucagcaauaaugggaacggg

SEQ ID NO: 43753 - RNA, 23 nt, Artificial Sequence
  RNA Oligomer
cacuucagcaauaaugggaacgg

SEQ ID NO: 43754 - RNA, 23 nt, Artificial Sequence
  RNA Oligomer
gcacuucagcaauaaugggaacg

SEQ ID NO: 43755 - RNA, 23 nt, Artificial Sequence
  RNA Oligomer
ugcacuucagcaauaaugggaac

SEQ ID NO: 43756 - RNA, 23 nt, Artificial Sequence
  RNA Oligomer
cugcacuucagcaauaaugggaa

SEQ ID NO: 43757 - RNA, 23 nt, Artificial Sequence
  RNA Oligomer
caccacaagauaccaacagggcu

SEQ ID NO: 43758 - RNA, 23 nt, Artificial Sequence
  RNA Oligomer
acaccacaagauaccaacagggc

SEQ ID NO: 43759 - RNA, 23 nt, Artificial Sequence
  RNA Oligomer
gacaccacaagauaccaacaggg

SEQ ID NO: 43760 - RNA, 23 nt, Artificial Sequence
  RNA Oligomer
agacaccacaagauaccaacagg

SEQ ID NO: 43761 - RNA, 23 nt, Artificial Sequence
  RNA Oligomer
cagacaccacaagauaccaacag

SEQ ID NO: 43762 - RNA, 23 nt, Artificial Sequence
  RNA Oligomer
acagaaaccaagauagagcuaca

SEQ ID NO: 43763 - RNA, 23 nt, Artificial Sequence
  RNA Oligomer
aacagaaaccaagauagagcuac

SEQ ID NO: 43764 - RNA, 23 nt, Artificial Sequence
  RNA Oligomer
caacagaaaccaagauagagcua

SEQ ID NO: 43765 - RNA, 23 nt, Artificial Sequence
  RNA Oligomer
ggaugcagguugucuacuaaaga

SEQ ID NO: 43766 - RNA, 23 nt, Artificial Sequence
  RNA Oligomer
uggaugcagguugucuacuaaag

SEQ ID NO: 43767 - RNA, 23 nt, Artificial Sequence
  RNA Oligomer
auggaugcagguugucuacuaaa

SEQ ID NO: 43768 - RNA, 23 nt, Artificial Sequence
  RNA Oligomer
aauggaugcagguugucuacuaa

SEQ ID NO: 43769 - RNA, 23 nt, Artificial Sequence
  RNA Oligomer
aaauggaugcagguugucuacua

SEQ ID NO: 43770 - RNA, 23 nt, Artificial Sequence
  RNA Oligomer
gucaugauguguguuguauuuua

SEQ ID NO: 43771 - RNA, 23 nt, Artificial Sequence
  RNA Oligomer
agucaugauguguguuguauuuu

SEQ ID NO: 43772 - RNA, 23 nt, Artificial Sequence
  RNA Oligomer
uagucaugauguguguuguauuu

SEQ ID NO: 43773 - RNA, 23 nt, Artificial Sequence
  RNA Oligomer
cuagucaugauguguguuguauu

SEQ ID NO: 43774 - RNA, 23 nt, Artificial Sequence
  RNA Oligomer
acuagucaugauguguguuguau

SEQ ID NO: 43775 - RNA, 23 nt, Artificial Sequence
  RNA Oligomer
ggaucaauaagcaugucagacug

SEQ ID NO: 43776 - RNA, 23 nt, Artificial Sequence
  RNA Oligomer
cuucugagcuugcaacauagcuc

SEQ ID NO: 43777 - RNA, 23 nt, Artificial Sequence
  RNA Oligomer
acuucugagcuugcaacauagcu

SEQ ID NO: 43778 - RNA, 23 nt, Artificial Sequence
  RNA Oligomer
uacuucugagcuugcaacauagc

SEQ ID NO: 43779 - RNA, 23 nt, Artificial Sequence
  RNA Oligomer
uuacuucugagcuugcaacauag

SEQ ID NO: 43780 - RNA, 23 nt, Artificial Sequence
  RNA Oligomer
auuacuucugagcuugcaacaua

SEQ ID NO: 43781 - RNA, 23 nt, Artificial Sequence
  RNA Oligomer
agucugacuugguucguuagugg

SEQ ID NO: 43782 - RNA, 23 nt, Artificial Sequence
  RNA Oligomer
gaacuggagucugacuugguucg

SEQ ID NO: 43783 - RNA, 23 nt, Artificial Sequence
  RNA Oligomer
agaacuggagucugacuugguuc

SEQ ID NO: 43784 - RNA, 23 nt, Artificial Sequence
  RNA Oligomer
aagaacuggagucugacuugguu

SEQ ID NO: 43785 - RNA, 23 nt, Artificial Sequence
  RNA Oligomer
cgagcgucaugaagaaagggggc

SEQ ID NO: 43786 - RNA, 23 nt, Artificial Sequence
  RNA Oligomer
acgagcgucaugaagaaaggggg

SEQ ID NO: 43787 - RNA, 23 nt, Artificial Sequence
  RNA Oligomer
cacgagcgucaugaagaaagggg

SEQ ID NO: 43788 - RNA, 23 nt, Artificial Sequence
  RNA Oligomer
acacgagcgucaugaagaaaggg

SEQ ID NO: 43789 - RNA, 23 nt, Artificial Sequence
  RNA Oligomer
aacacgagcgucaugaagaaagg

SEQ ID NO: 43790 - RNA, 23 nt, Artificial Sequence
  RNA Oligomer
auugaaagaaggaaagaaguuga

SEQ ID NO: 43791 - RNA, 23 nt, Artificial Sequence
  RNA Oligomer
uauugaaagaaggaaagaaguug

SEQ ID NO: 43792 - RNA, 23 nt, Artificial Sequence
  RNA Oligomer
auauugaaagaaggaaagaaguu

SEQ ID NO: 43793 - RNA, 23 nt, Artificial Sequence
  RNA Oligomer
gugcuuuuaaaaucagcuuuauu

SEQ ID NO: 43794 - RNA, 23 nt, Artificial Sequence
  RNA Oligomer
ugugcuuuuaaaaucagcuuuau

SEQ ID NO: 43795 - RNA, 23 nt, Artificial Sequence
  RNA Oligomer
gugugcuuuuaaaaucagcuuua

SEQ ID NO: 43796 - RNA, 23 nt, Artificial Sequence
  RNA Oligomer
cucuuuaucacucugcauuggug

SEQ ID NO: 43797 - RNA, 23 nt, Artificial Sequence
  RNA Oligomer
ccucuuuaucacucugcauuggu

SEQ ID NO: 43798 - RNA, 23 nt, Artificial Sequence
  RNA Oligomer
uccucuuuaucacucugcauugg

SEQ ID NO: 43799 - RNA, 23 nt, Artificial Sequence
  RNA Oligomer
uuccucuuuaucacucugcauug

SEQ ID NO: 43800 - RNA, 23 nt, Artificial Sequence
  RNA Oligomer
uuuccucuuuaucacucugcauu

SEQ ID NO: 43801 - RNA, 23 nt, Artificial Sequence
  RNA Oligomer
uauuguggccuuauauaucacac

SEQ ID NO: 43802 - RNA, 23 nt, Artificial Sequence
  RNA Oligomer
caugauguguguuguauuuuaaa

SEQ ID NO: 43803 - RNA, 23 nt, Artificial Sequence
  RNA Oligomer
ucaugauguguguuguauuuuaa

SEQ ID NO: 43804 - RNA, 23 nt, Artificial Sequence
  RNA Oligomer
uacuagucaugauguguguugua

SEQ ID NO: 43805 - RNA, 23 nt, Artificial Sequence
  RNA Oligomer
auacuagucaugauguguguugu

SEQ ID NO: 43806 - RNA, 23 nt, Artificial Sequence
  RNA Oligomer
uauacuagucaugauguguguug

SEQ ID NO: 43807 - RNA, 23 nt, Artificial Sequence
  RNA Oligomer
cagacugauuaaugucuacugug

SEQ ID NO: 43808 - RNA, 23 nt, Artificial Sequence
  RNA Oligomer
ucagacugauuaaugucuacugu

SEQ ID NO: 43809 - RNA, 23 nt, Artificial Sequence
  RNA Oligomer
ccuaugggaucaauaagcauguc

SEQ ID NO: 43810 - RNA, 23 nt, Artificial Sequence
  RNA Oligomer
accuaugggaucaauaagcaugu

SEQ ID NO: 43811 - RNA, 23 nt, Artificial Sequence
  RNA Oligomer
caccuaugggaucaauaagcaug

SEQ ID NO: 43812 - RNA, 23 nt, Artificial Sequence
  RNA Oligomer
cuuguguuuauuuguucuguaaa

SEQ ID NO: 43813 - RNA, 23 nt, Artificial Sequence
  RNA Oligomer
acuuguguuuauuuguucuguaa

SEQ ID NO: 43814 - RNA, 23 nt, Artificial Sequence
  RNA Oligomer
ggauuacuucugagcuugcaaca

SEQ ID NO: 43815 - RNA, 23 nt, Artificial Sequence
  RNA Oligomer
uggauuacuucugagcuugcaac

SEQ ID NO: 43816 - RNA, 23 nt, Artificial Sequence
  RNA Oligomer
ucugacuugguucguuaguggau

SEQ ID NO: 43817 - RNA, 23 nt, Artificial Sequence
  RNA Oligomer
gucugacuugguucguuagugga

SEQ ID NO: 43818 - RNA, 23 nt, Artificial Sequence
  RNA Oligomer
agauuggauaugggauuggucaa

SEQ ID NO: 43819 - RNA, 23 nt, Artificial Sequence
  RNA Oligomer
ucagcuuuauucuaagcaaaucu

SEQ ID NO: 43820 - RNA, 23 nt, Artificial Sequence
  RNA Oligomer
aucagcuuuauucuaagcaaauc

SEQ ID NO: 43821 - RNA, 23 nt, Artificial Sequence
  RNA Oligomer
aaucagcuuuauucuaagcaaau

SEQ ID NO: 43822 - RNA, 23 nt, Artificial Sequence
  RNA Oligomer
aaaucagcuuuauucuaagcaaa

SEQ ID NO: 43823 - RNA, 23 nt, Artificial Sequence
  RNA Oligomer
aaaaucagcuuuauucuaagcaa

SEQ ID NO: 43824 - RNA, 23 nt, Artificial Sequence
  RNA Oligomer
cuacucaguaucuuuuccucuuu

SEQ ID NO: 43825 - RNA, 23 nt, Artificial Sequence
  RNA Oligomer
ccuacucaguaucuuuuccucuu

SEQ ID NO: 43826 - RNA, 23 nt, Artificial Sequence
  RNA Oligomer
accuacucaguaucuuuuccucu

SEQ ID NO: 43827 - RNA, 23 nt, Artificial Sequence
  RNA Oligomer
caccuacucaguaucuuuuccuc

SEQ ID NO: 43828 - RNA, 23 nt, Artificial Sequence
  RNA Oligomer
gcaccuacucaguaucuuuuccu

SEQ ID NO: 43829 - RNA, 23 nt, Artificial Sequence
  RNA Oligomer
ucaacagaaaccaagauagagcu

SEQ ID NO: 43830 - RNA, 23 nt, Artificial Sequence
  RNA Oligomer
cuauauuggaaggcgucugacaa

SEQ ID NO: 43831 - RNA, 23 nt, Artificial Sequence
  RNA Oligomer
ucuauauuggaaggcgucugaca

SEQ ID NO: 43832 - RNA, 23 nt, Artificial Sequence
  RNA Oligomer
aucuauauuggaaggcgucugac

SEQ ID NO: 43833 - RNA, 23 nt, Artificial Sequence
  RNA Oligomer
gaucuauauuggaaggcgucuga

SEQ ID NO: 43834 - RNA, 23 nt, Artificial Sequence
  RNA Oligomer
ucucucauuugcuggccaucgga

SEQ ID NO: 43835 - RNA, 23 nt, Artificial Sequence
  RNA Oligomer
cucucucauuugcuggccaucgg

SEQ ID NO: 43836 - RNA, 23 nt, Artificial Sequence
  RNA Oligomer
gcucucucauuugcuggccaucg

SEQ ID NO: 43837 - RNA, 23 nt, Artificial Sequence
  RNA Oligomer
ugcucucucauuugcuggccauc

SEQ ID NO: 43838 - RNA, 23 nt, Artificial Sequence
  RNA Oligomer
cugcucucucauuugcuggccau

SEQ ID NO: 43839 - RNA, 23 nt, Artificial Sequence
  RNA Oligomer
gaacacgagcgucaugaagaaag

SEQ ID NO: 43840 - RNA, 23 nt, Artificial Sequence
  RNA Oligomer
uuggagagaaaaacagcucacag

SEQ ID NO: 43841 - RNA, 23 nt, Artificial Sequence
  RNA Oligomer
auuggagagaaaaacagcucaca

SEQ ID NO: 43842 - RNA, 23 nt, Artificial Sequence
  RNA Oligomer
cauuggagagaaaaacagcucac

SEQ ID NO: 43843 - RNA, 23 nt, Artificial Sequence
  RNA Oligomer
gcauuggagagaaaaacagcuca

SEQ ID NO: 43844 - RNA, 23 nt, Artificial Sequence
  RNA Oligomer
agcauuggagagaaaaacagcuc

SEQ ID NO: 43845 - RNA, 23 nt, Artificial Sequence
  RNA Oligomer
uagcauuggagagaaaaacagcu

SEQ ID NO: 43846 - RNA, 23 nt, Artificial Sequence
  RNA Oligomer
auagcauuggagagaaaaacagc

SEQ ID NO: 43847 - RNA, 23 nt, Artificial Sequence
  RNA Oligomer
cauagcauuggagagaaaaacag

SEQ ID NO: 43848 - RNA, 23 nt, Artificial Sequence
  RNA Oligomer
cagcuuuauucuaagcaaaucug

SEQ ID NO: 43849 - RNA, 23 nt, Artificial Sequence
  RNA Oligomer
guaucuuuuccucuuuaucacuc

SEQ ID NO: 43850 - RNA, 23 nt, Artificial Sequence
  RNA Oligomer
aguaucuuuuccucuuuaucacu

SEQ ID NO: 43851 - RNA, 23 nt, Artificial Sequence
  RNA Oligomer
caguaucuuuuccucuuuaucac

SEQ ID NO: 43852 - RNA, 23 nt, Artificial Sequence
  RNA Oligomer
ucaguaucuuuuccucuuuauca

SEQ ID NO: 43853 - RNA, 23 nt, Artificial Sequence
  RNA Oligomer
cucaguaucuuuuccucuuuauc

SEQ ID NO: 43854 - RNA, 23 nt, Artificial Sequence
  RNA Oligomer
aaugucuacugugaaaauuuggu

SEQ ID NO: 43855 - RNA, 23 nt, Artificial Sequence
  RNA Oligomer
uaaugucuacugugaaaauuugg

SEQ ID NO: 43856 - RNA, 23 nt, Artificial Sequence
  RNA Oligomer
uuaaugucuacugugaaaauuug

SEQ ID NO: 43857 - RNA, 23 nt, Artificial Sequence
  RNA Oligomer
aauaagcaugucagacugauuaa

SEQ ID NO: 43858 - RNA, 23 nt, Artificial Sequence
  RNA Oligomer
ucaauaagcaugucagacugauu

SEQ ID NO: 43859 - RNA, 23 nt, Artificial Sequence
  RNA Oligomer
aucaauaagcaugucagacugau

SEQ ID NO: 43860 - RNA, 23 nt, Artificial Sequence
  RNA Oligomer
gaucaauaagcaugucagacuga

SEQ ID NO: 43861 - RNA, 23 nt, Artificial Sequence
  RNA Oligomer
gcugcucucucauuugcuggcca

SEQ ID NO: 43862 - RNA, 23 nt, Artificial Sequence
  RNA Oligomer
gcaaaucugugucuacuuuaaaa

SEQ ID NO: 43863 - RNA, 23 nt, Artificial Sequence
  RNA Oligomer
agcaaaucugugucuacuuuaaa

SEQ ID NO: 43864 - RNA, 23 nt, Artificial Sequence
  RNA Oligomer
aagcaaaucugugucuacuuuaa

SEQ ID NO: 43865 - RNA, 23 nt, Artificial Sequence
  RNA Oligomer
uaagcaaaucugugucuacuuua

SEQ ID NO: 43866 - RNA, 23 nt, Artificial Sequence
  RNA Oligomer
uuuuccucuuuaucacucugcau

SEQ ID NO: 43867 - RNA, 23 nt, Artificial Sequence
  RNA Oligomer
caauaagcaugucagacugauua

SEQ ID NO: 43868 - RNA, 23 nt, Artificial Sequence
  RNA Oligomer
agaugauauugaaagaaggaaag

SEQ ID NO: 43869 - RNA, 23 nt, Artificial Sequence
  RNA Oligomer
aagaugauauugaaagaaggaaa

SEQ ID NO: 43870 - RNA, 23 nt, Artificial Sequence
  RNA Oligomer
gaagaugauauugaaagaaggaa

SEQ ID NO: 43871 - RNA, 23 nt, Artificial Sequence
  RNA Oligomer
acucaguaucuuuuccucuuuau

SEQ ID NO: 43872 - RNA, 23 nt, Artificial Sequence
  RNA Oligomer
uacucaguaucuuuuccucuuua

SEQ ID NO: 43873 - RNA, 23 nt, Artificial Sequence
  RNA Oligomer
cauauucucugcagaauuucuga

SEQ ID NO: 43874 - RNA, 23 nt, Artificial Sequence
  RNA Oligomer
gcauauucucugcagaauuucug

SEQ ID NO: 43875 - RNA, 23 nt, Artificial Sequence
  RNA Oligomer
ggcauauucucugcagaauuucu

SEQ ID NO: 43876 - RNA, 23 nt, Artificial Sequence
  RNA Oligomer
gggcauauucucugcagaauuuc

SEQ ID NO: 43877 - RNA, 23 nt, Artificial Sequence
  RNA Oligomer
ggggcauauucucugcagaauuu

SEQ ID NO: 43878 - RNA, 23 nt, Artificial Sequence
  RNA Oligomer
gggggcauauucucugcagaauu

SEQ ID NO: 43879 - RNA, 23 nt, Artificial Sequence
  RNA Oligomer
agggggcauauucucugcagaau

SEQ ID NO: 43880 - RNA, 23 nt, Artificial Sequence
  RNA Oligomer
aagggggcauauucucugcagaa

SEQ ID NO: 43881 - RNA, 23 nt, Artificial Sequence
  RNA Oligomer
cuuuuccucuuuaucacucugca

SEQ ID NO: 43882 - RNA, 23 nt, Artificial Sequence
  RNA Oligomer
cgguuucuauuuauaauggagac

SEQ ID NO: 43883 - RNA, 23 nt, Artificial Sequence
  RNA Oligomer
ucgguuucuauuuauaauggaga

SEQ ID NO: 43884 - RNA, 23 nt, Artificial Sequence
  RNA Oligomer
cucgguuucuauuuauaauggag

SEQ ID NO: 43885 - RNA, 23 nt, Artificial Sequence
  RNA Oligomer
ugcagaauuucugaaaguuuucc

SEQ ID NO: 43886 - RNA, 23 nt, Artificial Sequence
  RNA Oligomer
cugcagaauuucugaaaguuuuc

SEQ ID NO: 43887 - RNA, 23 nt, Artificial Sequence
  RNA Oligomer
ucugcagaauuucugaaaguuuu

SEQ ID NO: 43888 - RNA, 23 nt, Artificial Sequence
  RNA Oligomer
cucugcagaauuucugaaaguuu

SEQ ID NO: 43889 - RNA, 23 nt, Artificial Sequence
  RNA Oligomer
ucucugcagaauuucugaaaguu

SEQ ID NO: 43890 - RNA, 23 nt, Artificial Sequence
  RNA Oligomer
ccaaggaguuccucuuuaaacac

SEQ ID NO: 43891 - RNA, 23 nt, Artificial Sequence
  RNA Oligomer
cccaaggaguuccucuuuaaaca

SEQ ID NO: 43892 - RNA, 23 nt, Artificial Sequence
  RNA Oligomer
ccccaaggaguuccucuuuaaac

SEQ ID NO: 43893 - RNA, 23 nt, Artificial Sequence
  RNA Oligomer
cccccaaggaguuccucuuuaaa

SEQ ID NO: 43894 - RNA, 23 nt, Artificial Sequence
  RNA Oligomer
ccccccaaggaguuccucuuuaa

SEQ ID NO: 43895 - RNA, 23 nt, Artificial Sequence
  RNA Oligomer
uccccccaaggaguuccucuuua

SEQ ID NO: 43896 - RNA, 23 nt, Artificial Sequence
  RNA Oligomer
uauaaggaauuaagucuccgauu

SEQ ID NO: 43897 - RNA, 23 nt, Artificial Sequence
  RNA Oligomer
uuauaaggaauuaagucuccgau

SEQ ID NO: 43898 - RNA, 23 nt, Artificial Sequence
  RNA Oligomer
uucucugcagaauuucugaaagu

SEQ ID NO: 43899 - RNA, 23 nt, Artificial Sequence
  RNA Oligomer
cagcucacagucugaggaagaug

SEQ ID NO: 43900 - RNA, 23 nt, Artificial Sequence
  RNA Oligomer
acagcucacagucugaggaagau

SEQ ID NO: 43901 - RNA, 23 nt, Artificial Sequence
  RNA Oligomer
aacagcucacagucugaggaaga

SEQ ID NO: 43902 - RNA, 23 nt, Artificial Sequence
  RNA Oligomer
aaacagcucacagucugaggaag

SEQ ID NO: 43903 - RNA, 23 nt, Artificial Sequence
  RNA Oligomer
aaaacagcucacagucugaggaa

SEQ ID NO: 43904 - RNA, 23 nt, Artificial Sequence
  RNA Oligomer
aaaaacagcucacagucugagga

SEQ ID NO: 43905 - RNA, 23 nt, Artificial Sequence
  RNA Oligomer
ccauagcauuggagagaaaaaca

SEQ ID NO: 43906 - RNA, 23 nt, Artificial Sequence
  RNA Oligomer
cccauagcauuggagagaaaaac

SEQ ID NO: 43907 - RNA, 23 nt, Artificial Sequence
  RNA Oligomer
acccauagcauuggagagaaaaa

SEQ ID NO: 43908 - RNA, 23 nt, Artificial Sequence
  RNA Oligomer
uacccauagcauuggagagaaaa

SEQ ID NO: 43909 - RNA, 23 nt, Artificial Sequence
  RNA Oligomer
auacccauagcauuggagagaaa

SEQ ID NO: 43910 - RNA, 23 nt, Artificial Sequence
  RNA Oligomer
cuaaacucuucuugcuuuugcau

SEQ ID NO: 43911 - RNA, 23 nt, Artificial Sequence
  RNA Oligomer
acuaaacucuucuugcuuuugca

SEQ ID NO: 43912 - RNA, 23 nt, Artificial Sequence
  RNA Oligomer
agacacuaaaaucauguugaucu

SEQ ID NO: 43913 - RNA, 23 nt, Artificial Sequence
  RNA Oligomer
uagacacuaaaaucauguugauc

SEQ ID NO: 43914 - RNA, 23 nt, Artificial Sequence
  RNA Oligomer
auagacacuaaaaucauguugau

SEQ ID NO: 43915 - RNA, 23 nt, Artificial Sequence
  RNA Oligomer
aauagacacuaaaaucauguuga

SEQ ID NO: 43916 - RNA, 23 nt, Artificial Sequence
  RNA Oligomer
gaauagacacuaaaaucauguug

SEQ ID NO: 43917 - RNA, 23 nt, Artificial Sequence
  RNA Oligomer
uggccacgucacuuguguuuauu

SEQ ID NO: 43918 - RNA, 23 nt, Artificial Sequence
  RNA Oligomer
guggccacgucacuuguguuuau

SEQ ID NO: 43919 - RNA, 23 nt, Artificial Sequence
  RNA Oligomer
gguggccacgucacuuguguuua

SEQ ID NO: 43920 - RNA, 23 nt, Artificial Sequence
  RNA Oligomer
ggguggccacgucacuuguguuu

SEQ ID NO: 43921 - RNA, 23 nt, Artificial Sequence
  RNA Oligomer
accuuuugaugaagaacuggagu

SEQ ID NO: 43922 - RNA, 23 nt, Artificial Sequence
  RNA Oligomer
caccuuuugaugaagaacuggag

SEQ ID NO: 43923 - RNA, 23 nt, Artificial Sequence
  RNA Oligomer
gcaccuuuugaugaagaacugga

SEQ ID NO: 43924 - RNA, 23 nt, Artificial Sequence
  RNA Oligomer
agcaccuuuugaugaagaacugg

SEQ ID NO: 43925 - RNA, 23 nt, Artificial Sequence
  RNA Oligomer
cagcaccuuuugaugaagaacug

SEQ ID NO: 43926 - RNA, 23 nt, Artificial Sequence
  RNA Oligomer
gcagaauuucugaaaguuuuccu

SEQ ID NO: 43927 - RNA, 23 nt, Artificial Sequence
  RNA Oligomer
agucuccgauuauuaggugauca

SEQ ID NO: 43928 - RNA, 23 nt, Artificial Sequence
  RNA Oligomer
aagucuccgauuauuaggugauc

SEQ ID NO: 43929 - RNA, 23 nt, Artificial Sequence
  RNA Oligomer
cuucuugcuuuugcauuauaagg

SEQ ID NO: 43930 - RNA, 23 nt, Artificial Sequence
  RNA Oligomer
ucuucuugcuuuugcauuauaag

SEQ ID NO: 43931 - RNA, 23 nt, Artificial Sequence
  RNA Oligomer
cucuucuugcuuuugcauuauaa

SEQ ID NO: 43932 - RNA, 23 nt, Artificial Sequence
  RNA Oligomer
acucuucuugcuuuugcauuaua

SEQ ID NO: 43933 - RNA, 23 nt, Artificial Sequence
  RNA Oligomer
aacucuucuugcuuuugcauuau

SEQ ID NO: 43934 - RNA, 23 nt, Artificial Sequence
  RNA Oligomer
caaaauaaauauuguggccuuau

SEQ ID NO: 43935 - RNA, 23 nt, Artificial Sequence
  RNA Oligomer
ccaaaauaaauauuguggccuua

SEQ ID NO: 43936 - RNA, 23 nt, Artificial Sequence
  RNA Oligomer
uccaaaauaaauauuguggccuu

SEQ ID NO: 43937 - RNA, 23 nt, Artificial Sequence
  RNA Oligomer
guccaaaauaaauauuguggccu

SEQ ID NO: 43938 - RNA, 23 nt, Artificial Sequence
  RNA Oligomer
uguccaaaauaaauauuguggcc

SEQ ID NO: 43939 - RNA, 23 nt, Artificial Sequence
  RNA Oligomer
gaagagcuguuagauccuggggu

SEQ ID NO: 43940 - RNA, 23 nt, Artificial Sequence
  RNA Oligomer
ugaagagcuguuagauccugggg

SEQ ID NO: 43941 - RNA, 23 nt, Artificial Sequence
  RNA Oligomer
cugaagagcuguuagauccuggg

SEQ ID NO: 43942 - RNA, 23 nt, Artificial Sequence
  RNA Oligomer
acugaagagcuguuagauccugg

SEQ ID NO: 43943 - RNA, 23 nt, Artificial Sequence
  RNA Oligomer
caagauaccaacagggcuucuga

SEQ ID NO: 43944 - RNA, 23 nt, Artificial Sequence
  RNA Oligomer
acaagauaccaacagggcuucug

SEQ ID NO: 43945 - RNA, 23 nt, Artificial Sequence
  RNA Oligomer
cacaagauaccaacagggcuucu

SEQ ID NO: 43946 - RNA, 23 nt, Artificial Sequence
  RNA Oligomer
ccacaagauaccaacagggcuuc

SEQ ID NO: 43947 - RNA, 23 nt, Artificial Sequence
  RNA Oligomer
accacaagauaccaacagggcuu

SEQ ID NO: 43948 - RNA, 23 nt, Artificial Sequence
  RNA Oligomer
ggcaccuacucaguaucuuuucc

SEQ ID NO: 43949 - RNA, 23 nt, Artificial Sequence
  RNA Oligomer
aggcaccuacucaguaucuuuuc

SEQ ID NO: 43950 - RNA, 23 nt, Artificial Sequence
  RNA Oligomer
aaggcaccuacucaguaucuuuu

SEQ ID NO: 43951 - RNA, 23 nt, Artificial Sequence
  RNA Oligomer
gaaggcaccuacucaguaucuuu

SEQ ID NO: 43952 - RNA, 23 nt, Artificial Sequence
  RNA Oligomer
ugaaggcaccuacucaguaucuu

SEQ ID NO: 43953 - RNA, 23 nt, Artificial Sequence
  RNA Oligomer
caagagcucucacugugacagcc

SEQ ID NO: 43954 - RNA, 23 nt, Artificial Sequence
  RNA Oligomer
ccaagagcucucacugugacagc

SEQ ID NO: 43955 - RNA, 23 nt, Artificial Sequence
  RNA Oligomer
uccaagagcucucacugugacag

SEQ ID NO: 43956 - RNA, 23 nt, Artificial Sequence
  RNA Oligomer
cuccaagagcucucacugugaca

SEQ ID NO: 43957 - RNA, 23 nt, Artificial Sequence
  RNA Oligomer
gcuccaagagcucucacugugac

SEQ ID NO: 43958 - RNA, 23 nt, Artificial Sequence
  RNA Oligomer
agcuccaagagcucucacuguga

SEQ ID NO: 43959 - RNA, 23 nt, Artificial Sequence
  RNA Oligomer
aaacucuucuugcuuuugcauua

SEQ ID NO: 43960 - RNA, 23 nt, Artificial Sequence
  RNA Oligomer
guacaguucguacacuaaacucu

SEQ ID NO: 43961 - RNA, 23 nt, Artificial Sequence
  RNA Oligomer
uguacaguucguacacuaaacuc

SEQ ID NO: 43962 - RNA, 23 nt, Artificial Sequence
  RNA Oligomer
cuguacaguucguacacuaaacu

SEQ ID NO: 43963 - RNA, 23 nt, Artificial Sequence
  RNA Oligomer
gcuguacaguucguacacuaaac

SEQ ID NO: 43964 - RNA, 23 nt, Artificial Sequence
  RNA Oligomer
agcuguacaguucguacacuaaa

SEQ ID NO: 43965 - RNA, 23 nt, Artificial Sequence
  RNA Oligomer
ucagcugaaguacuuuauauuuc

SEQ ID NO: 43966 - RNA, 23 nt, Artificial Sequence
  RNA Oligomer
uucagcugaaguacuuuauauuu

SEQ ID NO: 43967 - RNA, 23 nt, Artificial Sequence
  RNA Oligomer
auucagcugaaguacuuuauauu

SEQ ID NO: 43968 - RNA, 23 nt, Artificial Sequence
  RNA Oligomer
aauucagcugaaguacuuuauau

SEQ ID NO: 43969 - RNA, 23 nt, Artificial Sequence
  RNA Oligomer
uaauucagcugaaguacuuuaua

SEQ ID NO: 43970 - RNA, 23 nt, Artificial Sequence
  RNA Oligomer
ugaugaagaacuggagucugacu

SEQ ID NO: 43971 - RNA, 23 nt, Artificial Sequence
  RNA Oligomer
uugaugaagaacuggagucugac

SEQ ID NO: 43972 - RNA, 23 nt, Artificial Sequence
  RNA Oligomer
uuugaugaagaacuggagucuga

SEQ ID NO: 43973 - RNA, 23 nt, Artificial Sequence
  RNA Oligomer
uuuugaugaagaacuggagucug

SEQ ID NO: 43974 - RNA, 23 nt, Artificial Sequence
  RNA Oligomer
cuuuugaugaagaacuggagucu

SEQ ID NO: 43975 - RNA, 23 nt, Artificial Sequence
  RNA Oligomer
ccagcaccuuuugaugaagaacu

SEQ ID NO: 43976 - RNA, 23 nt, Artificial Sequence
  RNA Oligomer
accagcaccuuuugaugaagaac

SEQ ID NO: 43977 - RNA, 23 nt, Artificial Sequence
  RNA Oligomer
caccagcaccuuuugaugaagaa

SEQ ID NO: 43978 - RNA, 23 nt, Artificial Sequence
  RNA Oligomer
ccaccagcaccuuuugaugaaga

SEQ ID NO: 43979 - RNA, 23 nt, Artificial Sequence
  RNA Oligomer
uccaccagcaccuuuugaugaag

SEQ ID NO: 43980 - RNA, 23 nt, Artificial Sequence
  RNA Oligomer
cuccaccagcaccuuuugaugaa

SEQ ID NO: 43981 - RNA, 23 nt, Artificial Sequence
  RNA Oligomer
cugaaaguuuuccuuccaucucu

SEQ ID NO: 43982 - RNA, 23 nt, Artificial Sequence
  RNA Oligomer
ucugaaaguuuuccuuccaucuc

SEQ ID NO: 43983 - RNA, 23 nt, Artificial Sequence
  RNA Oligomer
uucugaaaguuuuccuuccaucu

SEQ ID NO: 43984 - RNA, 23 nt, Artificial Sequence
  RNA Oligomer
uuucugaaaguuuuccuuccauc

SEQ ID NO: 43985 - RNA, 23 nt, Artificial Sequence
  RNA Oligomer
auuucugaaaguuuuccuuccau

SEQ ID NO: 43986 - RNA, 23 nt, Artificial Sequence
  RNA Oligomer
auucucugcagaauuucugaaag

SEQ ID NO: 43987 - RNA, 23 nt, Artificial Sequence
  RNA Oligomer
uauucucugcagaauuucugaaa

SEQ ID NO: 43988 - RNA, 23 nt, Artificial Sequence
  RNA Oligomer
auauucucugcagaauuucugaa

SEQ ID NO: 43989 - RNA, 23 nt, Artificial Sequence
  RNA Oligomer
gauacccauagcauuggagagaa

SEQ ID NO: 43990 - RNA, 23 nt, Artificial Sequence
  RNA Oligomer
caacagggcuucugaaacagaua

SEQ ID NO: 43991 - RNA, 23 nt, Artificial Sequence
  RNA Oligomer
ccaacagggcuucugaaacagau

SEQ ID NO: 43992 - RNA, 23 nt, Artificial Sequence
  RNA Oligomer
accaacagggcuucugaaacaga

SEQ ID NO: 43993 - RNA, 23 nt, Artificial Sequence
  RNA Oligomer
uaccaacagggcuucugaaacag

SEQ ID NO: 43994 - RNA, 23 nt, Artificial Sequence
  RNA Oligomer
auaccaacagggcuucugaaaca

SEQ ID NO: 43995 - RNA, 23 nt, Artificial Sequence
  RNA Oligomer
gcuuuauucuaagcaaaucugug

SEQ ID NO: 43996 - RNA, 23 nt, Artificial Sequence
  RNA Oligomer
agcuuuauucuaagcaaaucugu

SEQ ID NO: 43997 - RNA, 23 nt, Artificial Sequence
  RNA Oligomer
cccuggaugaucaguuuucugcu

SEQ ID NO: 43998 - RNA, 23 nt, Artificial Sequence
  RNA Oligomer
acccuggaugaucaguuuucugc

SEQ ID NO: 43999 - RNA, 23 nt, Artificial Sequence
  RNA Oligomer
cacccuggaugaucaguuuucug

SEQ ID NO: 44000 - RNA, 23 nt, Artificial Sequence
  RNA Oligomer
ucacccuggaugaucaguuuucu

SEQ ID NO: 44001 - RNA, 23 nt, Artificial Sequence
  RNA Oligomer
aucacccuggaugaucaguuuuc

SEQ ID NO: 44002 - RNA, 23 nt, Artificial Sequence
  RNA Oligomer
gaucacccuggaugaucaguuuu

SEQ ID NO: 44003 - RNA, 23 nt, Artificial Sequence
  RNA Oligomer
ugaucacccuggaugaucaguuu

SEQ ID NO: 44004 - RNA, 23 nt, Artificial Sequence
  RNA Oligomer
gugaucacccuggaugaucaguu

SEQ ID NO: 44005 - RNA, 23 nt, Artificial Sequence
  RNA Oligomer
ugcaaccuuaauucagcugaagu

SEQ ID NO: 44006 - RNA, 23 nt, Artificial Sequence
  RNA Oligomer
cugcaaccuuaauucagcugaag

SEQ ID NO: 44007 - RNA, 23 nt, Artificial Sequence
  RNA Oligomer
ucugcaaccuuaauucagcugaa

SEQ ID NO: 44008 - RNA, 23 nt, Artificial Sequence
  RNA Oligomer
cucugcugcucucucauuugcug

SEQ ID NO: 44009 - RNA, 23 nt, Artificial Sequence
  RNA Oligomer
ucucugcugcucucucauuugcu

SEQ ID NO: 44010 - RNA, 23 nt, Artificial Sequence
  RNA Oligomer
aucucugcugcucucucauuugc

SEQ ID NO: 44011 - RNA, 23 nt, Artificial Sequence
  RNA Oligomer
caucucugcugcucucucauuug

SEQ ID NO: 44012 - RNA, 23 nt, Artificial Sequence
  RNA Oligomer
ccaucucugcugcucucucauuu

SEQ ID NO: 44013 - RNA, 23 nt, Artificial Sequence
  RNA Oligomer
ggaacacgagcgucaugaagaaa

SEQ ID NO: 44014 - RNA, 23 nt, Artificial Sequence
  RNA Oligomer
aggaacacgagcgucaugaagaa

SEQ ID NO: 44015 - RNA, 23 nt, Artificial Sequence
  RNA Oligomer
gaggaacacgagcgucaugaaga

SEQ ID NO: 44016 - RNA, 23 nt, Artificial Sequence
  RNA Oligomer
ugaggaacacgagcgucaugaag

SEQ ID NO: 44017 - RNA, 23 nt, Artificial Sequence
  RNA Oligomer
augaggaacacgagcgucaugaa

SEQ ID NO: 44018 - RNA, 23 nt, Artificial Sequence
  RNA Oligomer
gaacugcacuucagcaauaaugg

SEQ ID NO: 44019 - RNA, 23 nt, Artificial Sequence
  RNA Oligomer
agaacugcacuucagcaauaaug

SEQ ID NO: 44020 - RNA, 23 nt, Artificial Sequence
  RNA Oligomer
uagaacugcacuucagcaauaau

SEQ ID NO: 44021 - RNA, 23 nt, Artificial Sequence
  RNA Oligomer
guagaacugcacuucagcaauaa

SEQ ID NO: 44022 - RNA, 23 nt, Artificial Sequence
  RNA Oligomer
gguagaacugcacuucagcaaua

SEQ ID NO: 44023 - RNA, 23 nt, Artificial Sequence
  RNA Oligomer
gauaccaacagggcuucugaaac

SEQ ID NO: 44024 - RNA, 23 nt, Artificial Sequence
  RNA Oligomer
agauaccaacagggcuucugaaa

SEQ ID NO: 44025 - RNA, 23 nt, Artificial Sequence
  RNA Oligomer
uuuaucacucugcauuggugaau

SEQ ID NO: 44026 - RNA, 23 nt, Artificial Sequence
  RNA Oligomer
uaaacucuucuugcuuuugcauu

SEQ ID NO: 44027 - RNA, 23 nt, Artificial Sequence
  RNA Oligomer
guagcuccaagagcucucacugu

SEQ ID NO: 44028 - RNA, 23 nt, Artificial Sequence
  RNA Oligomer
aguagcuccaagagcucucacug

SEQ ID NO: 44029 - RNA, 23 nt, Artificial Sequence
  RNA Oligomer
gaguagcuccaagagcucucacu

SEQ ID NO: 44030 - RNA, 23 nt, Artificial Sequence
  RNA Oligomer
ggaguagcuccaagagcucucac

SEQ ID NO: 44031 - RNA, 23 nt, Artificial Sequence
  RNA Oligomer
cggaguagcuccaagagcucuca

SEQ ID NO: 44032 - RNA, 23 nt, Artificial Sequence
  RNA Oligomer
cagcuguacaguucguacacuaa

SEQ ID NO: 44033 - RNA, 23 nt, Artificial Sequence
  RNA Oligomer
ucagcuguacaguucguacacua

SEQ ID NO: 44034 - RNA, 23 nt, Artificial Sequence
  RNA Oligomer
uauaucacacuauuguagaaagu

SEQ ID NO: 44035 - RNA, 23 nt, Artificial Sequence
  RNA Oligomer
cagcugaaguacuuuauauuuca

SEQ ID NO: 44036 - RNA, 23 nt, Artificial Sequence
  RNA Oligomer
ggaugaucaguuuucugcugaag

SEQ ID NO: 44037 - RNA, 23 nt, Artificial Sequence
  RNA Oligomer
uggaugaucaguuuucugcugaa

SEQ ID NO: 44038 - RNA, 23 nt, Artificial Sequence
  RNA Oligomer
cuggaugaucaguuuucugcuga

SEQ ID NO: 44039 - RNA, 23 nt, Artificial Sequence
  RNA Oligomer
ccuggaugaucaguuuucugcug

SEQ ID NO: 44040 - RNA, 23 nt, Artificial Sequence
  RNA Oligomer
uagcuccaagagcucucacugug

SEQ ID NO: 44041 - RNA, 23 nt, Artificial Sequence
  RNA Oligomer
acaguucguacacuaaacucuuc

SEQ ID NO: 44042 - RNA, 23 nt, Artificial Sequence
  RNA Oligomer
uacaguucguacacuaaacucuu

SEQ ID NO: 44043 - RNA, 23 nt, Artificial Sequence
  RNA Oligomer
agagcuacaaacucagcuguaca

SEQ ID NO: 44044 - RNA, 23 nt, Artificial Sequence
  RNA Oligomer
uagagcuacaaacucagcuguac

SEQ ID NO: 44045 - RNA, 23 nt, Artificial Sequence
  RNA Oligomer
auagagcuacaaacucagcugua

SEQ ID NO: 44046 - RNA, 23 nt, Artificial Sequence
  RNA Oligomer
gauagagcuacaaacucagcugu

SEQ ID NO: 44047 - RNA, 23 nt, Artificial Sequence
  RNA Oligomer
agauagagcuacaaacucagcug

SEQ ID NO: 44048 - RNA, 23 nt, Artificial Sequence
  RNA Oligomer
aagauagagcuacaaacucagcu

SEQ ID NO: 44049 - RNA, 23 nt, Artificial Sequence
  RNA Oligomer
uuaauucagcugaaguacuuuau

SEQ ID NO: 44050 - RNA, 23 nt, Artificial Sequence
  RNA Oligomer
aucugcaaccuuaauucagcuga

SEQ ID NO: 44051 - RNA, 23 nt, Artificial Sequence
  RNA Oligomer
gacacuaaaaucauguugaucua

SEQ ID NO: 44052 - RNA, 23 nt, Artificial Sequence
  RNA Oligomer
auagcucacugaagagcuguuag

SEQ ID NO: 44053 - RNA, 23 nt, Artificial Sequence
  RNA Oligomer
cauagcucacugaagagcuguua

SEQ ID NO: 44054 - RNA, 23 nt, Artificial Sequence
  RNA Oligomer
gcuugcaacauagcucacugaag

SEQ ID NO: 44055 - RNA, 23 nt, Artificial Sequence
  RNA Oligomer
agcuugcaacauagcucacugaa

SEQ ID NO: 44056 - RNA, 23 nt, Artificial Sequence
  RNA Oligomer
gagcuugcaacauagcucacuga

SEQ ID NO: 44057 - RNA, 23 nt, Artificial Sequence
  RNA Oligomer
ugagcuugcaacauagcucacug

SEQ ID NO: 44058 - RNA, 23 nt, Artificial Sequence
  RNA Oligomer
cugagcuugcaacauagcucacu

SEQ ID NO: 44059 - RNA, 23 nt, Artificial Sequence
  RNA Oligomer
caucuugaagaaaaacucagauu

SEQ ID NO: 44060 - RNA, 23 nt, Artificial Sequence
  RNA Oligomer
ugaucaguuuucugcugaaggca

SEQ ID NO: 44061 - RNA, 23 nt, Artificial Sequence
  RNA Oligomer
augaucaguuuucugcugaaggc

SEQ ID NO: 44062 - RNA, 23 nt, Artificial Sequence
  RNA Oligomer
gaugaucaguuuucugcugaagg

SEQ ID NO: 44063 - RNA, 23 nt, Artificial Sequence
  RNA Oligomer
agcuacaaacucagcuguacagu

SEQ ID NO: 44064 - RNA, 23 nt, Artificial Sequence
  RNA Oligomer
gagcuacaaacucagcuguacag

SEQ ID NO: 44065 - RNA, 23 nt, Artificial Sequence
  RNA Oligomer
ggguagaacugcacuucagcaau

SEQ ID NO: 44066 - RNA, 23 nt, Artificial Sequence
  RNA Oligomer
uggguagaacugcacuucagcaa

SEQ ID NO: 44067 - RNA, 23 nt, Artificial Sequence
  RNA Oligomer
ugaaaguuuuccuuccaucucug

SEQ ID NO: 44068 - RNA, 23 nt, Artificial Sequence
  RNA Oligomer
caugaggaacacgagcgucauga

SEQ ID NO: 44069 - RNA, 23 nt, Artificial Sequence
  RNA Oligomer
gcaugaggaacacgagcgucaug

SEQ ID NO: 44070 - RNA, 23 nt, Artificial Sequence
  RNA Oligomer
agcaugaggaacacgagcgucau

SEQ ID NO: 44071 - RNA, 23 nt, Artificial Sequence
  RNA Oligomer
ggaguuccucuuuaaacacccga

SEQ ID NO: 44072 - RNA, 23 nt, Artificial Sequence
  RNA Oligomer
aggaguuccucuuuaaacacccg

SEQ ID NO: 44073 - RNA, 23 nt, Artificial Sequence
  RNA Oligomer
aaggaguuccucuuuaaacaccc

SEQ ID NO: 44074 - RNA, 23 nt, Artificial Sequence
  RNA Oligomer
caaggaguuccucuuuaaacacc

SEQ ID NO: 44075 - RNA, 23 nt, Artificial Sequence
  RNA Oligomer
cauuggugaauuuaauccucucc

SEQ ID NO: 44076 - RNA, 23 nt, Artificial Sequence
  RNA Oligomer
uaagucuccgauuauuaggugau

SEQ ID NO: 44077 - RNA, 23 nt, Artificial Sequence
  RNA Oligomer
ccuccaccagcaccuuuugauga

SEQ ID NO: 44078 - RNA, 23 nt, Artificial Sequence
  RNA Oligomer
acccucagcaugaggaacacgag

SEQ ID NO: 44079 - RNA, 23 nt, Artificial Sequence
  RNA Oligomer
cacccucagcaugaggaacacga

SEQ ID NO: 44080 - RNA, 23 nt, Artificial Sequence
  RNA Oligomer
ccacccucagcaugaggaacacg

SEQ ID NO: 44081 - RNA, 23 nt, Artificial Sequence
  RNA Oligomer
gccacccucagcaugaggaacac

SEQ ID NO: 44082 - RNA, 23 nt, Artificial Sequence
  RNA Oligomer
ggccacccucagcaugaggaaca

SEQ ID NO: 44083 - RNA, 23 nt, Artificial Sequence
  RNA Oligomer
gucagacugauuaaugucuacug

SEQ ID NO: 44084 - RNA, 23 nt, Artificial Sequence
  RNA Oligomer
ugucagacugauuaaugucuacu

SEQ ID NO: 44085 - RNA, 23 nt, Artificial Sequence
  RNA Oligomer
augucagacugauuaaugucuac

SEQ ID NO: 44086 - RNA, 23 nt, Artificial Sequence
  RNA Oligomer
caugucagacugauuaaugucua

SEQ ID NO: 44087 - RNA, 23 nt, Artificial Sequence
  RNA Oligomer
aauuucugaaaguuuuccuucca

SEQ ID NO: 44088 - RNA, 23 nt, Artificial Sequence
  RNA Oligomer
cguuccagccucgguuucuauuu

SEQ ID NO: 44089 - RNA, 23 nt, Artificial Sequence
  RNA Oligomer
ccucuuuaaacacccgaagcgca

SEQ ID NO: 44090 - RNA, 23 nt, Artificial Sequence
  RNA Oligomer
ggugaucacccuggaugaucagu

SEQ ID NO: 44091 - RNA, 23 nt, Artificial Sequence
  RNA Oligomer
aggugaucacccuggaugaucag

SEQ ID NO: 44092 - RNA, 23 nt, Artificial Sequence
  RNA Oligomer
uaggugaucacccuggaugauca

SEQ ID NO: 44093 - RNA, 23 nt, Artificial Sequence
  RNA Oligomer
uuaagucuccgauuauuagguga

SEQ ID NO: 44094 - RNA, 23 nt, Artificial Sequence
  RNA Oligomer
cuuaauucagcugaaguacuuua

SEQ ID NO: 44095 - RNA, 23 nt, Artificial Sequence
  RNA Oligomer
ugcugcucucucauuugcuggcc

SEQ ID NO: 44096 - RNA, 23 nt, Artificial Sequence
  RNA Oligomer
cugcugcucucucauuugcuggc

SEQ ID NO: 44097 - RNA, 23 nt, Artificial Sequence
  RNA Oligomer
ucugcugcucucucauuugcugg

SEQ ID NO: 44098 - RNA, 23 nt, Artificial Sequence
  RNA Oligomer
agauacccauagcauuggagaga

SEQ ID NO: 44099 - RNA, 23 nt, Artificial Sequence
  RNA Oligomer
cagauacccauagcauuggagag

SEQ ID NO: 44100 - RNA, 23 nt, Artificial Sequence
  RNA Oligomer
acagauacccauagcauuggaga

SEQ ID NO: 44101 - RNA, 23 nt, Artificial Sequence
  RNA Oligomer
aacagauacccauagcauuggag

SEQ ID NO: 44102 - RNA, 23 nt, Artificial Sequence
  RNA Oligomer
aaacagauacccauagcauugga

SEQ ID NO: 44103 - RNA, 23 nt, Artificial Sequence
  RNA Oligomer
aacugcacuucagcaauaauggg

SEQ ID NO: 44104 - RNA, 23 nt, Artificial Sequence
  RNA Oligomer
gcagacaccacaagauaccaaca

SEQ ID NO: 44105 - RNA, 23 nt, Artificial Sequence
  RNA Oligomer
cgcagacaccacaagauaccaac

SEQ ID NO: 44106 - RNA, 23 nt, Artificial Sequence
  RNA Oligomer
ucgcagacaccacaagauaccaa

SEQ ID NO: 44107 - RNA, 23 nt, Artificial Sequence
  RNA Oligomer
cucgcagacaccacaagauacca

SEQ ID NO: 44108 - RNA, 23 nt, Artificial Sequence
  RNA Oligomer
gcucgcagacaccacaagauacc

SEQ ID NO: 44109 - RNA, 23 nt, Artificial Sequence
  RNA Oligomer
cugaaggcaccuacucaguaucu

SEQ ID NO: 44110 - RNA, 23 nt, Artificial Sequence
  RNA Oligomer
gcugaaggcaccuacucaguauc

SEQ ID NO: 44111 - RNA, 23 nt, Artificial Sequence
  RNA Oligomer
ugcugaaggcaccuacucaguau

SEQ ID NO: 44112 - RNA, 23 nt, Artificial Sequence
  RNA Oligomer
uuaggugaucacccuggaugauc

SEQ ID NO: 44113 - RNA, 23 nt, Artificial Sequence
  RNA Oligomer
auuaggugaucacccuggaugau

SEQ ID NO: 44114 - RNA, 23 nt, Artificial Sequence
  RNA Oligomer
uaucugcaaccuuaauucagcug

SEQ ID NO: 44115 - RNA, 23 nt, Artificial Sequence
  RNA Oligomer
uuaucugcaaccuuaauucagcu

SEQ ID NO: 44116 - RNA, 23 nt, Artificial Sequence
  RNA Oligomer
gcguuccagccucgguuucuauu

SEQ ID NO: 44117 - RNA, 23 nt, Artificial Sequence
  RNA Oligomer
agcguuccagccucgguuucuau

SEQ ID NO: 44118 - RNA, 23 nt, Artificial Sequence
  RNA Oligomer
cagcguuccagccucgguuucua

SEQ ID NO: 44119 - RNA, 23 nt, Artificial Sequence
  RNA Oligomer
acugcacuucagcaauaauggga

SEQ ID NO: 44120 - RNA, 23 nt, Artificial Sequence
  RNA Oligomer
cgcucgcagacaccacaagauac

SEQ ID NO: 44121 - RNA, 23 nt, Artificial Sequence
  RNA Oligomer
ucgcucgcagacaccacaagaua

SEQ ID NO: 44122 - RNA, 23 nt, Artificial Sequence
  RNA Oligomer
cucgcucgcagacaccacaagau

SEQ ID NO: 44123 - RNA, 23 nt, Artificial Sequence
  RNA Oligomer
ucaguuuucugcugaaggcaccu

SEQ ID NO: 44124 - RNA, 23 nt, Artificial Sequence
  RNA Oligomer
aucaguuuucugcugaaggcacc

SEQ ID NO: 44125 - RNA, 23 nt, Artificial Sequence
  RNA Oligomer
gaucaguuuucugcugaaggcac

SEQ ID NO: 44126 - RNA, 23 nt, Artificial Sequence
  RNA Oligomer
ucugagcuugcaacauagcucac

SEQ ID NO: 44127 - RNA, 23 nt, Artificial Sequence
  RNA Oligomer
uucugagcuugcaacauagcuca

SEQ ID NO: 44128 - RNA, 23 nt, Artificial Sequence
  RNA Oligomer
agggcuucugaaacagauaccca

SEQ ID NO: 44129 - RNA, 23 nt, Artificial Sequence
  RNA Oligomer
cagggcuucugaaacagauaccc

SEQ ID NO: 44130 - RNA, 23 nt, Artificial Sequence
  RNA Oligomer
acagggcuucugaaacagauacc

SEQ ID NO: 44131 - RNA, 23 nt, Artificial Sequence
  RNA Oligomer
aacagggcuucugaaacagauac

SEQ ID NO: 44132 - RNA, 23 nt, Artificial Sequence
  RNA Oligomer
cugcugaaggcaccuacucagua

SEQ ID NO: 44133 - RNA, 23 nt, Artificial Sequence
  RNA Oligomer
gggcuucugaaacagauacccau

SEQ ID NO: 44134 - RNA, 23 nt, Artificial Sequence
  RNA Oligomer
uucuugcuuuugcauuauaagga

SEQ ID NO: 44135 - RNA, 23 nt, Artificial Sequence
  RNA Oligomer
uuguccaaaauaaauauuguggc

SEQ ID NO: 44136 - RNA, 23 nt, Artificial Sequence
  RNA Oligomer
acauagcucacugaagagcuguu

SEQ ID NO: 44137 - RNA, 23 nt, Artificial Sequence
  RNA Oligomer
ggcuucugaaacagauacccaua

SEQ ID NO: 44138 - RNA, 23 nt, Artificial Sequence
  RNA Oligomer
gacauggaaaaaauacugcugga

SEQ ID NO: 44139 - RNA, 23 nt, Artificial Sequence
  RNA Oligomer
agacauggaaaaaauacugcugg

SEQ ID NO: 44140 - RNA, 23 nt, Artificial Sequence
  RNA Oligomer
gagacauggaaaaaauacugcug

SEQ ID NO: 44141 - RNA, 23 nt, Artificial Sequence
  RNA Oligomer
ggagacauggaaaaaauacugcu

SEQ ID NO: 44142 - RNA, 23 nt, Artificial Sequence
  RNA Oligomer
uggagacauggaaaaaauacugc

SEQ ID NO: 44143 - RNA, 23 nt, Artificial Sequence
  RNA Oligomer
ucuauuuauaauggagacaugga

SEQ ID NO: 44144 - RNA, 23 nt, Artificial Sequence
  RNA Oligomer
aaaacucagauuggauaugggau

SEQ ID NO: 44145 - RNA, 23 nt, Artificial Sequence
  RNA Oligomer
cucucauuugcuggccaucggau

SEQ ID NO: 44146 - RNA, 23 nt, Artificial Sequence
  RNA Oligomer
auauacuagucaugauguguguu

SEQ ID NO: 44147 - RNA, 23 nt, Artificial Sequence
  RNA Oligomer
gaugauauugaaagaaggaaaga

SEQ ID NO: 44148 - RNA, 23 nt, Artificial Sequence
  RNA Oligomer
gcauuauaaggaauuaagucucc

SEQ ID NO: 44149 - RNA, 23 nt, Artificial Sequence
  RNA Oligomer
guguuuauuuguucuguaaaugc

SEQ ID NO: 44150 - RNA, 23 nt, Artificial Sequence
  RNA Oligomer
gguuucuauuuauaauggagaca

SEQ ID NO: 44151 - RNA, 23 nt, Artificial Sequence
  RNA Oligomer
uccaucucugcugcucucucauu

SEQ ID NO: 44152 - RNA, 23 nt, Artificial Sequence
  RNA Oligomer
ccuuuugaugaagaacuggaguc

SEQ ID NO: 44153 - RNA, 23 nt, Artificial Sequence
  RNA Oligomer
agaaaaacagcucacagucugag

SEQ ID NO: 44154 - RNA, 23 nt, Artificial Sequence
  RNA Oligomer
cgauuauuaggugaucacccugg

SEQ ID NO: 44155 - RNA, 23 nt, Artificial Sequence
  RNA Oligomer
caguuuucugcugaaggcaccua

SEQ ID NO: 44156 - RNA, 23 nt, Artificial Sequence
  RNA Oligomer
ugacaaccuccaccagcaccuuu

SEQ ID NO: 44157 - RNA, 23 nt, Artificial Sequence
  RNA Oligomer
cagaauuucugaaaguuuuccuu

SEQ ID NO: 44158 - RNA, 23 nt, Artificial Sequence
  RNA Oligomer
gauuggucaagucggccggaaaa

SEQ ID NO: 44159 - RNA, 23 nt, Artificial Sequence
  RNA Oligomer
cuuuaucacucugcauuggugaa

SEQ ID NO: 44160 - RNA, 23 nt, Artificial Sequence
  RNA Oligomer
guugaucuauaauuacaccuaug

SEQ ID NO: 44161 - RNA, 23 nt, Artificial Sequence
  RNA Oligomer
agaauuucugaaaguuuuccuuc

SEQ ID NO: 44162 - RNA, 23 nt, Artificial Sequence
  RNA Oligomer
gcuaauuguucauaaucaacaga

SEQ ID NO: 44163 - RNA, 23 nt, Artificial Sequence
  RNA Oligomer
ccuuauauaucacacuauuguag

SEQ ID NO: 44164 - RNA, 23 nt, Artificial Sequence
  RNA Oligomer
gauuacuucugagcuugcaacau

SEQ ID NO: 44165 - RNA, 23 nt, Artificial Sequence
  RNA Oligomer
gaaaguuuuccuuccaucucugc

SEQ ID NO: 44166 - RNA, 23 nt, Artificial Sequence
  RNA Oligomer
aagauaccaacagggcuucugaa

SEQ ID NO: 44167 - RNA, 23 nt, Artificial Sequence
  RNA Oligomer
ugaucuauaauuacaccuauggg

SEQ ID NO: 44168 - RNA, 23 nt, Artificial Sequence
  RNA Oligomer
acagcaugagucuggacggagua

SEQ ID NO: 44169 - RNA, 23 nt, Artificial Sequence
  RNA Oligomer
gaaaaauucagaagcauaaaacc

SEQ ID NO: 44170 - RNA, 23 nt, Artificial Sequence
  RNA Oligomer
gcuuuuguugauuuccugaguga

SEQ ID NO: 44171 - RNA, 23 nt, Artificial Sequence
  RNA Oligomer
gguugaaguuauaaagaaugaug

SEQ ID NO: 44172 - RNA, 23 nt, Artificial Sequence
  RNA Oligomer
cuuuuguugauuuccugagugau

SEQ ID NO: 44173 - RNA, 23 nt, Artificial Sequence
  RNA Oligomer
caacauuaacaacagcaucccac

SEQ ID NO: 44174 - RNA, 23 nt, Artificial Sequence
  RNA Oligomer
acaagaagacgaggcugagagug

SEQ ID NO: 44175 - RNA, 23 nt, Artificial Sequence
  RNA Oligomer
caagagccaguagagcagacaga

SEQ ID NO: 44176 - RNA, 23 nt, Artificial Sequence
  RNA Oligomer
ucaagagccaguagagcagacag

SEQ ID NO: 44177 - RNA, 23 nt, Artificial Sequence
  RNA Oligomer
gaacugaaugggacagaagcgaa

SEQ ID NO: 44178 - RNA, 23 nt, Artificial Sequence
  RNA Oligomer
cuuauaugaccaccuaauggauu

SEQ ID NO: 44179 - RNA, 23 nt, Artificial Sequence
  RNA Oligomer
aucugcacguguucgcagucguu

SEQ ID NO: 44180 - RNA, 23 nt, Artificial Sequence
  RNA Oligomer
uaacaacagcaucccaccaacau

SEQ ID NO: 44181 - RNA, 23 nt, Artificial Sequence
  RNA Oligomer
ugauggcaagaaggcccuugugu

SEQ ID NO: 44182 - RNA, 23 nt, Artificial Sequence
  RNA Oligomer
acaacagcaucccaccaacauuu

SEQ ID NO: 44183 - RNA, 23 nt, Artificial Sequence
  RNA Oligomer
gcuuugaaaugauuaucauccua

SEQ ID NO: 44184 - RNA, 23 nt, Artificial Sequence
  RNA Oligomer
ucugcacguguucgcagucguuu

SEQ ID NO: 44185 - RNA, 23 nt, Artificial Sequence
  RNA Oligomer
acauuugauggugaggaggaacc

SEQ ID NO: 44186 - RNA, 23 nt, Artificial Sequence
  RNA Oligomer
ucaguccacuggcgagucugaau

SEQ ID NO: 44187 - RNA, 23 nt, Artificial Sequence
  RNA Oligomer
caagaaggcccuuguguuggacu

SEQ ID NO: 44188 - RNA, 23 nt, Artificial Sequence
  RNA Oligomer
acauaaaauugguuuaucuccuc

SEQ ID NO: 44189 - RNA, 23 nt, Artificial Sequence
  RNA Oligomer
acauuaacaacagcaucccacca

SEQ ID NO: 44190 - RNA, 23 nt, Artificial Sequence
  RNA Oligomer
agacauaaaauugguuuaucucc

SEQ ID NO: 44191 - RNA, 23 nt, Artificial Sequence
  RNA Oligomer
gaaaaauucagaagcauaaaacc

SEQ ID NO: 44192 - RNA, 23 nt, Artificial Sequence
  RNA Oligomer
gcuuuuguugauuuccugaguga

SEQ ID NO: 44193 - RNA, 23 nt, Artificial Sequence
  RNA Oligomer
gguugaaguuauaaagaaugaug

SEQ ID NO: 44194 - RNA, 23 nt, Artificial Sequence
  RNA Oligomer
cuuuuguugauuuccugagugau

SEQ ID NO: 44195 - RNA, 23 nt, Artificial Sequence
  RNA Oligomer
cuaauaaucggagacuuaauucc

SEQ ID NO: 44196 - RNA, 23 nt, Artificial Sequence
  RNA Oligomer
uaauaaucggagacuuaauuccu

SEQ ID NO: 44197 - RNA, 23 nt, Artificial Sequence
  RNA Oligomer
aauaaucggagacuuaauuccuu

SEQ ID NO: 44198 - RNA, 23 nt, Artificial Sequence
  RNA Oligomer
auaaucggagacuuaauuccuua

SEQ ID NO: 44199 - RNA, 23 nt, Artificial Sequence
  RNA Oligomer
uaaucggagacuuaauuccuuau

SEQ ID NO: 44200 - RNA, 23 nt, Artificial Sequence
  RNA Oligomer
gaggauuaaauucaccaaugcag

SEQ ID NO: 44201 - RNA, 23 nt, Artificial Sequence
  RNA Oligomer
aggauuaaauucaccaaugcaga

SEQ ID NO: 44202 - RNA, 23 nt, Artificial Sequence
  RNA Oligomer
ggauuaaauucaccaaugcagag

SEQ ID NO: 44203 - RNA, 23 nt, Artificial Sequence
  RNA Oligomer
gauuaaauucaccaaugcagagu

SEQ ID NO: 44204 - RNA, 23 nt, Artificial Sequence
  RNA Oligomer
auuaaauucaccaaugcagagug

SEQ ID NO: 44205 - RNA, 23 nt, Artificial Sequence
  RNA Oligomer
auuuuaaaagcacacaaaaguug

SEQ ID NO: 44206 - RNA, 23 nt, Artificial Sequence
  RNA Oligomer
uuuuaaaagcacacaaaaguuga

SEQ ID NO: 44207 - RNA, 23 nt, Artificial Sequence
  RNA Oligomer
uuuaaaagcacacaaaaguugaa

SEQ ID NO: 44208 - RNA, 23 nt, Artificial Sequence
  RNA Oligomer
uuaaaagcacacaaaaguugaac

SEQ ID NO: 44209 - RNA, 23 nt, Artificial Sequence
  RNA Oligomer
uaaaagcacacaaaaguugaaca

SEQ ID NO: 44210 - RNA, 23 nt, Artificial Sequence
  RNA Oligomer
gugcguccagcaguauuuuuucc

SEQ ID NO: 44211 - RNA, 23 nt, Artificial Sequence
  RNA Oligomer
ugcguccagcaguauuuuuucca

SEQ ID NO: 44212 - RNA, 23 nt, Artificial Sequence
  RNA Oligomer
gcguccagcaguauuuuuuccau

SEQ ID NO: 44213 - RNA, 23 nt, Artificial Sequence
  RNA Oligomer
cguccagcaguauuuuuuccaug

SEQ ID NO: 44214 - RNA, 23 nt, Artificial Sequence
  RNA Oligomer
guccagcaguauuuuuuccaugu

SEQ ID NO: 44215 - RNA, 23 nt, Artificial Sequence
  RNA Oligomer
aaucuuucuuuaguagacaaccu

SEQ ID NO: 44216 - RNA, 23 nt, Artificial Sequence
  RNA Oligomer
aucuuucuuuaguagacaaccug

SEQ ID NO: 44217 - RNA, 23 nt, Artificial Sequence
  RNA Oligomer
ucuuucuuuaguagacaaccugc

SEQ ID NO: 44218 - RNA, 23 nt, Artificial Sequence
  RNA Oligomer
cuuucuuuaguagacaaccugca

SEQ ID NO: 44219 - RNA, 23 nt, Artificial Sequence
  RNA Oligomer
uuucuuuaguagacaaccugcau

SEQ ID NO: 44220 - RNA, 23 nt, Artificial Sequence
  RNA Oligomer
uucuuuaguagacaaccugcauc

SEQ ID NO: 44221 - RNA, 23 nt, Artificial Sequence
  RNA Oligomer
uacaauagugugauauauaaggc

SEQ ID NO: 44222 - RNA, 23 nt, Artificial Sequence
  RNA Oligomer
acaauagugugauauauaaggcc

SEQ ID NO: 44223 - RNA, 23 nt, Artificial Sequence
  RNA Oligomer
caauagugugauauauaaggcca

SEQ ID NO: 44224 - RNA, 23 nt, Artificial Sequence
  RNA Oligomer
aauagugugauauauaaggccac

SEQ ID NO: 44225 - RNA, 23 nt, Artificial Sequence
  RNA Oligomer
auagugugauauauaaggccaca

SEQ ID NO: 44226 - RNA, 23 nt, Artificial Sequence
  RNA Oligomer
cacaaaggagaggauuaaauuca

SEQ ID NO: 44227 - RNA, 23 nt, Artificial Sequence
  RNA Oligomer
acaaaggagaggauuaaauucac

SEQ ID NO: 44228 - RNA, 23 nt, Artificial Sequence
  RNA Oligomer
caaaggagaggauuaaauucacc

SEQ ID NO: 44229 - RNA, 23 nt, Artificial Sequence
  RNA Oligomer
aaaggagaggauuaaauucacca

SEQ ID NO: 44230 - RNA, 23 nt, Artificial Sequence
  RNA Oligomer
aaggagaggauuaaauucaccaa

SEQ ID NO: 44231 - RNA, 23 nt, Artificial Sequence
  RNA Oligomer
uagugugauauauaaggccacaa

SEQ ID NO: 44232 - RNA, 23 nt, Artificial Sequence
  RNA Oligomer
ucagacugugagcuguuuuucuc

SEQ ID NO: 44233 - RNA, 23 nt, Artificial Sequence
  RNA Oligomer
cagacugugagcuguuuuucucu

SEQ ID NO: 44234 - RNA, 23 nt, Artificial Sequence
  RNA Oligomer
agacugugagcuguuuuucucuc

SEQ ID NO: 44235 - RNA, 23 nt, Artificial Sequence
  RNA Oligomer
gacugugagcuguuuuucucucc

SEQ ID NO: 44236 - RNA, 23 nt, Artificial Sequence
  RNA Oligomer
acugugagcuguuuuucucucca

SEQ ID NO: 44237 - RNA, 23 nt, Artificial Sequence
  RNA Oligomer
uccagcaguauuuuuuccauguc

SEQ ID NO: 44238 - RNA, 23 nt, Artificial Sequence
  RNA Oligomer
ccauuauaaauagaaaccgaggc

SEQ ID NO: 44239 - RNA, 23 nt, Artificial Sequence
  RNA Oligomer
cauuauaaauagaaaccgaggcu

SEQ ID NO: 44240 - RNA, 23 nt, Artificial Sequence
  RNA Oligomer
auuauaaauagaaaccgaggcug

SEQ ID NO: 44241 - RNA, 23 nt, Artificial Sequence
  RNA Oligomer
uuauaaauagaaaccgaggcugg

SEQ ID NO: 44242 - RNA, 23 nt, Artificial Sequence
  RNA Oligomer
uauaaauagaaaccgaggcugga

SEQ ID NO: 44243 - RNA, 23 nt, Artificial Sequence
  RNA Oligomer
caagaugcuuucaacuucuuucc

SEQ ID NO: 44244 - RNA, 23 nt, Artificial Sequence
  RNA Oligomer
aagaugcuuucaacuucuuuccu

SEQ ID NO: 44245 - RNA, 23 nt, Artificial Sequence
  RNA Oligomer
agaugcuuucaacuucuuuccuu

SEQ ID NO: 44246 - RNA, 23 nt, Artificial Sequence
  RNA Oligomer
gaugcuuucaacuucuuuccuuc

SEQ ID NO: 44247 - RNA, 23 nt, Artificial Sequence
  RNA Oligomer
augcuuucaacuucuuuccuucu

SEQ ID NO: 44248 - RNA, 23 nt, Artificial Sequence
  RNA Oligomer
cugaguuuguagcucuaucuugg

SEQ ID NO: 44249 - RNA, 23 nt, Artificial Sequence
  RNA Oligomer
ugaguuuguagcucuaucuuggu

SEQ ID NO: 44250 - RNA, 23 nt, Artificial Sequence
  RNA Oligomer
gaguuuguagcucuaucuugguu

SEQ ID NO: 44251 - RNA, 23 nt, Artificial Sequence
  RNA Oligomer
aguuuguagcucuaucuugguuu

SEQ ID NO: 44252 - RNA, 23 nt, Artificial Sequence
  RNA Oligomer
guuuguagcucuaucuugguuuc

SEQ ID NO: 44253 - RNA, 23 nt, Artificial Sequence
  RNA Oligomer
caauauuuauuuuggacaaaccc

SEQ ID NO: 44254 - RNA, 23 nt, Artificial Sequence
  RNA Oligomer
aauauuuauuuuggacaaacccc

SEQ ID NO: 44255 - RNA, 23 nt, Artificial Sequence
  RNA Oligomer
auauuuauuuuggacaaaccccu

SEQ ID NO: 44256 - RNA, 23 nt, Artificial Sequence
  RNA Oligomer
uauuuauuuuggacaaaccccuu

SEQ ID NO: 44257 - RNA, 23 nt, Artificial Sequence
  RNA Oligomer
auuuauuuuggacaaaccccuua

SEQ ID NO: 44258 - RNA, 23 nt, Artificial Sequence
  RNA Oligomer
agcaguauuuuuuccaugucucc

SEQ ID NO: 44259 - RNA, 23 nt, Artificial Sequence
  RNA Oligomer
gcaguauuuuuuccaugucucca

SEQ ID NO: 44260 - RNA, 23 nt, Artificial Sequence
  RNA Oligomer
caguauuuuuuccaugucuccau

SEQ ID NO: 44261 - RNA, 23 nt, Artificial Sequence
  RNA Oligomer
aguauuuuuuccaugucuccauu

SEQ ID NO: 44262 - RNA, 23 nt, Artificial Sequence
  RNA Oligomer
guauuuuuuccaugucuccauua

SEQ ID NO: 44263 - RNA, 23 nt, Artificial Sequence
  RNA Oligomer
aaaagcacacaaaaguugaacac

SEQ ID NO: 44264 - RNA, 23 nt, Artificial Sequence
  RNA Oligomer
gagaggauuaaauucaccaaugc

SEQ ID NO: 44265 - RNA, 23 nt, Artificial Sequence
  RNA Oligomer
agaggauuaaauucaccaaugca

SEQ ID NO: 44266 - RNA, 23 nt, Artificial Sequence
  RNA Oligomer
uuaaauucaccaaugcagaguga

SEQ ID NO: 44267 - RNA, 23 nt, Artificial Sequence
  RNA Oligomer
uaaauucaccaaugcagagugau

SEQ ID NO: 44268 - RNA, 23 nt, Artificial Sequence
  RNA Oligomer
aaauucaccaaugcagagugaua

SEQ ID NO: 44269 - RNA, 23 nt, Artificial Sequence
  RNA Oligomer
aauucaccaaugcagagugauaa

SEQ ID NO: 44270 - RNA, 23 nt, Artificial Sequence
  RNA Oligomer
ccuaauaaucggagacuuaauuc

SEQ ID NO: 44271 - RNA, 23 nt, Artificial Sequence
  RNA Oligomer
uuauuuuacuaaauuaggaacgc

SEQ ID NO: 44272 - RNA, 23 nt, Artificial Sequence
  RNA Oligomer
uauuuuacuaaauuaggaacgca

SEQ ID NO: 44273 - RNA, 23 nt, Artificial Sequence
  RNA Oligomer
auuuuacuaaauuaggaacgcag

SEQ ID NO: 44274 - RNA, 23 nt, Artificial Sequence
  RNA Oligomer
uuuuacuaaauuaggaacgcagc

SEQ ID NO: 44275 - RNA, 23 nt, Artificial Sequence
  RNA Oligomer
uuuacuaaauuaggaacgcagca

SEQ ID NO: 44276 - RNA, 23 nt, Artificial Sequence
  RNA Oligomer
ccagcaguauuuuuuccaugucu

SEQ ID NO: 44277 - RNA, 23 nt, Artificial Sequence
  RNA Oligomer
cagcaguauuuuuuccaugucuc

SEQ ID NO: 44278 - RNA, 23 nt, Artificial Sequence
  RNA Oligomer
aaaguagacacagauuugcuuag

SEQ ID NO: 44279 - RNA, 23 nt, Artificial Sequence
  RNA Oligomer
aaguagacacagauuugcuuaga

SEQ ID NO: 44280 - RNA, 23 nt, Artificial Sequence
  RNA Oligomer
aguagacacagauuugcuuagaa

SEQ ID NO: 44281 - RNA, 23 nt, Artificial Sequence
  RNA Oligomer
guagacacagauuugcuuagaau

SEQ ID NO: 44282 - RNA, 23 nt, Artificial Sequence
  RNA Oligomer
uagacacagauuugcuuagaaua

SEQ ID NO: 44283 - RNA, 23 nt, Artificial Sequence
  RNA Oligomer
aaagcugauuuuaaaagcacaca

SEQ ID NO: 44284 - RNA, 23 nt, Artificial Sequence
  RNA Oligomer
aagcugauuuuaaaagcacacaa

SEQ ID NO: 44285 - RNA, 23 nt, Artificial Sequence
  RNA Oligomer
agcugauuuuaaaagcacacaaa

SEQ ID NO: 44286 - RNA, 23 nt, Artificial Sequence
  RNA Oligomer
gcugauuuuaaaagcacacaaaa

SEQ ID NO: 44287 - RNA, 23 nt, Artificial Sequence
  RNA Oligomer
cugauuuuaaaagcacacaaaag

SEQ ID NO: 44288 - RNA, 23 nt, Artificial Sequence
  RNA Oligomer
cagggugaucaccuaauaaucgg

SEQ ID NO: 44289 - RNA, 23 nt, Artificial Sequence
  RNA Oligomer
agggugaucaccuaauaaucgga

SEQ ID NO: 44290 - RNA, 23 nt, Artificial Sequence
  RNA Oligomer
gggugaucaccuaauaaucggag

SEQ ID NO: 44291 - RNA, 23 nt, Artificial Sequence
  RNA Oligomer
ggugaucaccuaauaaucggaga

SEQ ID NO: 44292 - RNA, 23 nt, Artificial Sequence
  RNA Oligomer
gugaucaccuaauaaucggagac

SEQ ID NO: 44293 - RNA, 23 nt, Artificial Sequence
  RNA Oligomer
auaaucuuucuuuaguagacaac

SEQ ID NO: 44294 - RNA, 23 nt, Artificial Sequence
  RNA Oligomer
uaaucuuucuuuaguagacaacc

SEQ ID NO: 44295 - RNA, 23 nt, Artificial Sequence
  RNA Oligomer
aaaguacuucagcugaauuaagg

SEQ ID NO: 44296 - RNA, 23 nt, Artificial Sequence
  RNA Oligomer
aaguacuucagcugaauuaaggu

SEQ ID NO: 44297 - RNA, 23 nt, Artificial Sequence
  RNA Oligomer
aguacuucagcugaauuaagguu

SEQ ID NO: 44298 - RNA, 23 nt, Artificial Sequence
  RNA Oligomer
guacuucagcugaauuaagguug

SEQ ID NO: 44299 - RNA, 23 nt, Artificial Sequence
  RNA Oligomer
uacuucagcugaauuaagguugc

SEQ ID NO: 44300 - RNA, 23 nt, Artificial Sequence
  RNA Oligomer
uauuuuuuccaugucuccauuau

SEQ ID NO: 44301 - RNA, 23 nt, Artificial Sequence
  RNA Oligomer
auuuuuuccaugucuccauuaua

SEQ ID NO: 44302 - RNA, 23 nt, Artificial Sequence
  RNA Oligomer
aaagcacacaaaaguugaacaca

SEQ ID NO: 44303 - RNA, 23 nt, Artificial Sequence
  RNA Oligomer
aagcacacaaaaguugaacacaa

SEQ ID NO: 44304 - RNA, 23 nt, Artificial Sequence
  RNA Oligomer
acacaaaaguugaacacaaagga

SEQ ID NO: 44305 - RNA, 23 nt, Artificial Sequence
  RNA Oligomer
cacaaaaguugaacacaaaggag

SEQ ID NO: 44306 - RNA, 23 nt, Artificial Sequence
  RNA Oligomer
acaaaaguugaacacaaaggaga

SEQ ID NO: 44307 - RNA, 23 nt, Artificial Sequence
  RNA Oligomer
caaaaguugaacacaaaggagag

SEQ ID NO: 44308 - RNA, 23 nt, Artificial Sequence
  RNA Oligomer
aaaaguugaacacaaaggagagg

SEQ ID NO: 44309 - RNA, 23 nt, Artificial Sequence
  RNA Oligomer
aaaguugaacacaaaggagagga

SEQ ID NO: 44310 - RNA, 23 nt, Artificial Sequence
  RNA Oligomer
aaguugaacacaaaggagaggau

SEQ ID NO: 44311 - RNA, 23 nt, Artificial Sequence
  RNA Oligomer
aguugaacacaaaggagaggauu

SEQ ID NO: 44312 - RNA, 23 nt, Artificial Sequence
  RNA Oligomer
guugaacacaaaggagaggauua

SEQ ID NO: 44313 - RNA, 23 nt, Artificial Sequence
  RNA Oligomer
uugaacacaaaggagaggauuaa

SEQ ID NO: 44314 - RNA, 23 nt, Artificial Sequence
  RNA Oligomer
acacaaaggagaggauuaaauuc

SEQ ID NO: 44315 - RNA, 23 nt, Artificial Sequence
  RNA Oligomer
uacgaacuguacagcugaguuug

SEQ ID NO: 44316 - RNA, 23 nt, Artificial Sequence
  RNA Oligomer
acgaacuguacagcugaguuugu

SEQ ID NO: 44317 - RNA, 23 nt, Artificial Sequence
  RNA Oligomer
cgaacuguacagcugaguuugua

SEQ ID NO: 44318 - RNA, 23 nt, Artificial Sequence
  RNA Oligomer
gaacuguacagcugaguuuguag

SEQ ID NO: 44319 - RNA, 23 nt, Artificial Sequence
  RNA Oligomer
aacuguacagcugaguuuguagc

SEQ ID NO: 44320 - RNA, 23 nt, Artificial Sequence
  RNA Oligomer
aauuuacuaccaaauuuucacag

SEQ ID NO: 44321 - RNA, 23 nt, Artificial Sequence
  RNA Oligomer
auuuacuaccaaauuuucacagu

SEQ ID NO: 44322 - RNA, 23 nt, Artificial Sequence
  RNA Oligomer
uuuacuaccaaauuuucacagua

SEQ ID NO: 44323 - RNA, 23 nt, Artificial Sequence
  RNA Oligomer
uuacuaccaaauuuucacaguag

SEQ ID NO: 44324 - RNA, 23 nt, Artificial Sequence
  RNA Oligomer
uacuaccaaauuuucacaguaga

SEQ ID NO: 44325 - RNA, 23 nt, Artificial Sequence
  RNA Oligomer
aggaucuaacagcucuucaguga

SEQ ID NO: 44326 - RNA, 23 nt, Artificial Sequence
  RNA Oligomer
ggaucuaacagcucuucagugag

SEQ ID NO: 44327 - RNA, 23 nt, Artificial Sequence
  RNA Oligomer
gaucuaacagcucuucagugagc

SEQ ID NO: 44328 - RNA, 23 nt, Artificial Sequence
  RNA Oligomer
aucuaacagcucuucagugagcu

SEQ ID NO: 44329 - RNA, 23 nt, Artificial Sequence
  RNA Oligomer
ucuaacagcucuucagugagcua

SEQ ID NO: 44330 - RNA, 23 nt, Artificial Sequence
  RNA Oligomer
cagcucuucagugagcuauguug

SEQ ID NO: 44331 - RNA, 23 nt, Artificial Sequence
  RNA Oligomer
agcucuucagugagcuauguugc

SEQ ID NO: 44332 - RNA, 23 nt, Artificial Sequence
  RNA Oligomer
gcucuucagugagcuauguugca

SEQ ID NO: 44333 - RNA, 23 nt, Artificial Sequence
  RNA Oligomer
cucuucagugagcuauguugcaa

SEQ ID NO: 44334 - RNA, 23 nt, Artificial Sequence
  RNA Oligomer
ucuucagugagcuauguugcaag

SEQ ID NO: 44335 - RNA, 23 nt, Artificial Sequence
  RNA Oligomer
caucaaaaggugcugguggaggu

SEQ ID NO: 44336 - RNA, 23 nt, Artificial Sequence
  RNA Oligomer
aucaaaaggugcugguggagguu

SEQ ID NO: 44337 - RNA, 23 nt, Artificial Sequence
  RNA Oligomer
ucaaaaggugcugguggagguug

SEQ ID NO: 44338 - RNA, 23 nt, Artificial Sequence
  RNA Oligomer
caaaaggugcugguggagguugu

SEQ ID NO: 44339 - RNA, 23 nt, Artificial Sequence
  RNA Oligomer
aaaaggugcugguggagguuguc

SEQ ID NO: 44340 - RNA, 23 nt, Artificial Sequence
  RNA Oligomer
auaaauagaaaccgaggcuggaa

SEQ ID NO: 44341 - RNA, 23 nt, Artificial Sequence
  RNA Oligomer
gggaauauuuuccggccgacuug

SEQ ID NO: 44342 - RNA, 23 nt, Artificial Sequence
  RNA Oligomer
ggaauauuuuccggccgacuuga

SEQ ID NO: 44343 - RNA, 23 nt, Artificial Sequence
  RNA Oligomer
gaauauuuuccggccgacuugac

SEQ ID NO: 44344 - RNA, 23 nt, Artificial Sequence
  RNA Oligomer
aauauuuuccggccgacuugacc

SEQ ID NO: 44345 - RNA, 23 nt, Artificial Sequence
  RNA Oligomer
auauuuuccggccgacuugacca

SEQ ID NO: 44346 - RNA, 23 nt, Artificial Sequence
  RNA Oligomer
gaccaaucccauauccaaucuga

SEQ ID NO: 44347 - RNA, 23 nt, Artificial Sequence
  RNA Oligomer
accaaucccauauccaaucugag

SEQ ID NO: 44348 - RNA, 23 nt, Artificial Sequence
  RNA Oligomer
ccaaucccauauccaaucugagu

SEQ ID NO: 44349 - RNA, 23 nt, Artificial Sequence
  RNA Oligomer
caaucccauauccaaucugaguu

SEQ ID NO: 44350 - RNA, 23 nt, Artificial Sequence
  RNA Oligomer
aaucccauauccaaucugaguuu

SEQ ID NO: 44351 - RNA, 23 nt, Artificial Sequence
  RNA Oligomer
cccauauccaaucugaguuuuuc

SEQ ID NO: 44352 - RNA, 23 nt, Artificial Sequence
  RNA Oligomer
ccauauccaaucugaguuuuucu

SEQ ID NO: 44353 - RNA, 23 nt, Artificial Sequence
  RNA Oligomer
cauauccaaucugaguuuuucuu

SEQ ID NO: 44354 - RNA, 23 nt, Artificial Sequence
  RNA Oligomer
auauccaaucugaguuuuucuuc

SEQ ID NO: 44355 - RNA, 23 nt, Artificial Sequence
  RNA Oligomer
uauccaaucugaguuuuucuuca

SEQ ID NO: 44356 - RNA, 23 nt, Artificial Sequence
  RNA Oligomer
gaguuuuucuucaagaugcuuuc

SEQ ID NO: 44357 - RNA, 23 nt, Artificial Sequence
  RNA Oligomer
aguuuuucuucaagaugcuuuca

SEQ ID NO: 44358 - RNA, 23 nt, Artificial Sequence
  RNA Oligomer
guuuuucuucaagaugcuuucaa

SEQ ID NO: 44359 - RNA, 23 nt, Artificial Sequence
  RNA Oligomer
uuuuucuucaagaugcuuucaac

SEQ ID NO: 44360 - RNA, 23 nt, Artificial Sequence
  RNA Oligomer
uuuucuucaagaugcuuucaacu

SEQ ID NO: 44361 - RNA, 23 nt, Artificial Sequence
  RNA Oligomer
aggagaggauuaaauucaccaau

SEQ ID NO: 44362 - RNA, 23 nt, Artificial Sequence
  RNA Oligomer
aagcaagaagaguuuaguguacg

SEQ ID NO: 44363 - RNA, 23 nt, Artificial Sequence
  RNA Oligomer
agcaagaagaguuuaguguacga

SEQ ID NO: 44364 - RNA, 23 nt, Artificial Sequence
  RNA Oligomer
gcaagaagaguuuaguguacgaa

SEQ ID NO: 44365 - RNA, 23 nt, Artificial Sequence
  RNA Oligomer
caagaagaguuuaguguacgaac

SEQ ID NO: 44366 - RNA, 23 nt, Artificial Sequence
  RNA Oligomer
aagaagaguuuaguguacgaacu

SEQ ID NO: 44367 - RNA, 23 nt, Artificial Sequence
  RNA Oligomer
uuuguagcucuaucuugguuucu

SEQ ID NO: 44368 - RNA, 23 nt, Artificial Sequence
  RNA Oligomer
auaauacuuucuacaauagugug

SEQ ID NO: 44369 - RNA, 23 nt, Artificial Sequence
  RNA Oligomer
uaauacuuucuacaauaguguga

SEQ ID NO: 44370 - RNA, 23 nt, Artificial Sequence
  RNA Oligomer
aauacuuucuacaauagugugau

SEQ ID NO: 44371 - RNA, 23 nt, Artificial Sequence
  RNA Oligomer
auacuuucuacaauagugugaua

SEQ ID NO: 44372 - RNA, 23 nt, Artificial Sequence
  RNA Oligomer
uacuuucuacaauagugugauau

SEQ ID NO: 44373 - RNA, 23 nt, Artificial Sequence
  RNA Oligomer
acuaccaaauuuucacaguagac

SEQ ID NO: 44374 - RNA, 23 nt, Artificial Sequence
  RNA Oligomer
cuaccaaauuuucacaguagaca

SEQ ID NO: 44375 - RNA, 23 nt, Artificial Sequence
  RNA Oligomer
uaccaaauuuucacaguagacau

SEQ ID NO: 44376 - RNA, 23 nt, Artificial Sequence
  RNA Oligomer
agaacaaauaaacacaagugacg

SEQ ID NO: 44377 - RNA, 23 nt, Artificial Sequence
  RNA Oligomer
gaacaaauaaacacaagugacgu

SEQ ID NO: 44378 - RNA, 23 nt, Artificial Sequence
  RNA Oligomer
aacaaauaaacacaagugacgug

SEQ ID NO: 44379 - RNA, 23 nt, Artificial Sequence
  RNA Oligomer
acaaauaaacacaagugacgugg

SEQ ID NO: 44380 - RNA, 23 nt, Artificial Sequence
  RNA Oligomer
caaauaaacacaagugacguggc

SEQ ID NO: 44381 - RNA, 23 nt, Artificial Sequence
  RNA Oligomer
uugcaagcucagaaguaauccac

SEQ ID NO: 44382 - RNA, 23 nt, Artificial Sequence
  RNA Oligomer
ugcaagcucagaaguaauccacu

SEQ ID NO: 44383 - RNA, 23 nt, Artificial Sequence
  RNA Oligomer
gcaagcucagaaguaauccacua

SEQ ID NO: 44384 - RNA, 23 nt, Artificial Sequence
  RNA Oligomer
caagcucagaaguaauccacuaa

SEQ ID NO: 44385 - RNA, 23 nt, Artificial Sequence
  RNA Oligomer
aagcucagaaguaauccacuaac

SEQ ID NO: 44386 - RNA, 23 nt, Artificial Sequence
  RNA Oligomer
uuuuuuccaugucuccauuauaa

SEQ ID NO: 44387 - RNA, 23 nt, Artificial Sequence
  RNA Oligomer
uuuuuccaugucuccauuauaaa

SEQ ID NO: 44388 - RNA, 23 nt, Artificial Sequence
  RNA Oligomer
uuuuccaugucuccauuauaaau

SEQ ID NO: 44389 - RNA, 23 nt, Artificial Sequence
  RNA Oligomer
uuuccaugucuccauuauaaaua

SEQ ID NO: 44390 - RNA, 23 nt, Artificial Sequence
  RNA Oligomer
uuccaugucuccauuauaaauag

SEQ ID NO: 44391 - RNA, 23 nt, Artificial Sequence
  RNA Oligomer
ccgacuugaccaaucccauaucc

SEQ ID NO: 44392 - RNA, 23 nt, Artificial Sequence
  RNA Oligomer
cgacuugaccaaucccauaucca

SEQ ID NO: 44393 - RNA, 23 nt, Artificial Sequence
  RNA Oligomer
gacuugaccaaucccauauccaa

SEQ ID NO: 44394 - RNA, 23 nt, Artificial Sequence
  RNA Oligomer
acuugaccaaucccauauccaau

SEQ ID NO: 44395 - RNA, 23 nt, Artificial Sequence
  RNA Oligomer
cuugaccaaucccauauccaauc

SEQ ID NO: 44396 - RNA, 23 nt, Artificial Sequence
  RNA Oligomer
gcugaagugcaguucuacccagg

SEQ ID NO: 44397 - RNA, 23 nt, Artificial Sequence
  RNA Oligomer
cugaagugcaguucuacccagga

SEQ ID NO: 44398 - RNA, 23 nt, Artificial Sequence
  RNA Oligomer
ugaagugcaguucuacccaggag

SEQ ID NO: 44399 - RNA, 23 nt, Artificial Sequence
  RNA Oligomer
gaagugcaguucuacccaggagc

SEQ ID NO: 44400 - RNA, 23 nt, Artificial Sequence
  RNA Oligomer
aagugcaguucuacccaggagcc

SEQ ID NO: 44401 - RNA, 23 nt, Artificial Sequence
  RNA Oligomer
aguguacgaacuguacagcugag

SEQ ID NO: 44402 - RNA, 23 nt, Artificial Sequence
  RNA Oligomer
guguacgaacuguacagcugagu

SEQ ID NO: 44403 - RNA, 23 nt, Artificial Sequence
  RNA Oligomer
uguacgaacuguacagcugaguu

SEQ ID NO: 44404 - RNA, 23 nt, Artificial Sequence
  RNA Oligomer
guacgaacuguacagcugaguuu

SEQ ID NO: 44405 - RNA, 23 nt, Artificial Sequence
  RNA Oligomer
aucuugguuucuguugauuauga

SEQ ID NO: 44406 - RNA, 23 nt, Artificial Sequence
  RNA Oligomer
ucuugguuucuguugauuaugaa

SEQ ID NO: 44407 - RNA, 23 nt, Artificial Sequence
  RNA Oligomer
cuugguuucuguugauuaugaac

SEQ ID NO: 44408 - RNA, 23 nt, Artificial Sequence
  RNA Oligomer
uugguuucuguugauuaugaaca

SEQ ID NO: 44409 - RNA, 23 nt, Artificial Sequence
  RNA Oligomer
ugguuucuguugauuaugaacaa

SEQ ID NO: 44410 - RNA, 23 nt, Artificial Sequence
  RNA Oligomer
uacagaacaaauaaacacaagug

SEQ ID NO: 44411 - RNA, 23 nt, Artificial Sequence
  RNA Oligomer
acagaacaaauaaacacaaguga

SEQ ID NO: 44412 - RNA, 23 nt, Artificial Sequence
  RNA Oligomer
cagaacaaauaaacacaagugac

SEQ ID NO: 44413 - RNA, 23 nt, Artificial Sequence
  RNA Oligomer
aaauaaacacaagugacguggcc

SEQ ID NO: 44414 - RNA, 23 nt, Artificial Sequence
  RNA Oligomer
ucagaaguaauccacuaacgaac

SEQ ID NO: 44415 - RNA, 23 nt, Artificial Sequence
  RNA Oligomer
cagaaguaauccacuaacgaacc

SEQ ID NO: 44416 - RNA, 23 nt, Artificial Sequence
  RNA Oligomer
agaaguaauccacuaacgaacca

SEQ ID NO: 44417 - RNA, 23 nt, Artificial Sequence
  RNA Oligomer
gaaguaauccacuaacgaaccaa

SEQ ID NO: 44418 - RNA, 23 nt, Artificial Sequence
  RNA Oligomer
aaguaauccacuaacgaaccaag

SEQ ID NO: 44419 - RNA, 23 nt, Artificial Sequence
  RNA Oligomer
aguaauccacuaacgaaccaagu

SEQ ID NO: 44420 - RNA, 23 nt, Artificial Sequence
  RNA Oligomer
guaauccacuaacgaaccaaguc

SEQ ID NO: 44421 - RNA, 23 nt, Artificial Sequence
  RNA Oligomer
uaauccacuaacgaaccaaguca

SEQ ID NO: 44422 - RNA, 23 nt, Artificial Sequence
  RNA Oligomer
uccauuauaaauagaaaccgagg

SEQ ID NO: 44423 - RNA, 23 nt, Artificial Sequence
  RNA Oligomer
uaaauagaaaccgaggcuggaac

SEQ ID NO: 44424 - RNA, 23 nt, Artificial Sequence
  RNA Oligomer
gcgcuucggguguuuaaagagga

SEQ ID NO: 44425 - RNA, 23 nt, Artificial Sequence
  RNA Oligomer
cgcuucggguguuuaaagaggaa

SEQ ID NO: 44426 - RNA, 23 nt, Artificial Sequence
  RNA Oligomer
gcuucggguguuuaaagaggaac

SEQ ID NO: 44427 - RNA, 23 nt, Artificial Sequence
  RNA Oligomer
cuucggguguuuaaagaggaacu

SEQ ID NO: 44428 - RNA, 23 nt, Artificial Sequence
  RNA Oligomer
uucggguguuuaaagaggaacuc

SEQ ID NO: 44429 - RNA, 23 nt, Artificial Sequence
  RNA Oligomer
uauuuuccggccgacuugaccaa

SEQ ID NO: 44430 - RNA, 23 nt, Artificial Sequence
  RNA Oligomer
uccuucuuucaauaucaucuucc

SEQ ID NO: 44431 - RNA, 23 nt, Artificial Sequence
  RNA Oligomer
ccuucuuucaauaucaucuuccu

SEQ ID NO: 44432 - RNA, 23 nt, Artificial Sequence
  RNA Oligomer
cuucuuucaauaucaucuuccuc

SEQ ID NO: 44433 - RNA, 23 nt, Artificial Sequence
  RNA Oligomer
uucuuucaauaucaucuuccuca

SEQ ID NO: 44434 - RNA, 23 nt, Artificial Sequence
  RNA Oligomer
ucuuucaauaucaucuuccucag

SEQ ID NO: 44435 - RNA, 23 nt, Artificial Sequence
  RNA Oligomer
aaugcuauggguaucuguuucag

SEQ ID NO: 44436 - RNA, 23 nt, Artificial Sequence
  RNA Oligomer
augcuauggguaucuguuucaga

SEQ ID NO: 44437 - RNA, 23 nt, Artificial Sequence
  RNA Oligomer
ugcuauggguaucuguuucagaa

SEQ ID NO: 44438 - RNA, 23 nt, Artificial Sequence
  RNA Oligomer
gcuauggguaucuguuucagaag

SEQ ID NO: 44439 - RNA, 23 nt, Artificial Sequence
  RNA Oligomer
cuauggguaucuguuucagaagc

SEQ ID NO: 44440 - RNA, 23 nt, Artificial Sequence
  RNA Oligomer
cacacaaaaguugaacacaaagg

SEQ ID NO: 44441 - RNA, 23 nt, Artificial Sequence
  RNA Oligomer
caaaagcaagaagaguuuagugu

SEQ ID NO: 44442 - RNA, 23 nt, Artificial Sequence
  RNA Oligomer
aaaagcaagaagaguuuagugua

SEQ ID NO: 44443 - RNA, 23 nt, Artificial Sequence
  RNA Oligomer
aaagcaagaagaguuuaguguac

SEQ ID NO: 44444 - RNA, 23 nt, Artificial Sequence
  RNA Oligomer
gcugaguuuguagcucuaucuug

SEQ ID NO: 44445 - RNA, 23 nt, Artificial Sequence
  RNA Oligomer
uuguagcucuaucuugguuucug

SEQ ID NO: 44446 - RNA, 23 nt, Artificial Sequence
  RNA Oligomer
agacauuaaucagucugacaugc

SEQ ID NO: 44447 - RNA, 23 nt, Artificial Sequence
  RNA Oligomer
gacauuaaucagucugacaugcu

SEQ ID NO: 44448 - RNA, 23 nt, Artificial Sequence
  RNA Oligomer
acauuaaucagucugacaugcuu

SEQ ID NO: 44449 - RNA, 23 nt, Artificial Sequence
  RNA Oligomer
cauuaaucagucugacaugcuua

SEQ ID NO: 44450 - RNA, 23 nt, Artificial Sequence
  RNA Oligomer
auuaaucagucugacaugcuuau

SEQ ID NO: 44451 - RNA, 23 nt, Artificial Sequence
  RNA Oligomer
augcuuauugaucccauaggugu

SEQ ID NO: 44452 - RNA, 23 nt, Artificial Sequence
  RNA Oligomer
ugcuuauugaucccauaggugua

SEQ ID NO: 44453 - RNA, 23 nt, Artificial Sequence
  RNA Oligomer
gcuuauugaucccauagguguaa

SEQ ID NO: 44454 - RNA, 23 nt, Artificial Sequence
  RNA Oligomer
cuuauugaucccauagguguaau

SEQ ID NO: 44455 - RNA, 23 nt, Artificial Sequence
  RNA Oligomer
uuauugaucccauagguguaauu

SEQ ID NO: 44456 - RNA, 23 nt, Artificial Sequence
  RNA Oligomer
uauugaucccauagguguaauua

SEQ ID NO: 44457 - RNA, 23 nt, Artificial Sequence
  RNA Oligomer
auugaucccauagguguaauuau

SEQ ID NO: 44458 - RNA, 23 nt, Artificial Sequence
  RNA Oligomer
uuacuaaauuaggaacgcagcau

SEQ ID NO: 44459 - RNA, 23 nt, Artificial Sequence
  RNA Oligomer
uacuaaauuaggaacgcagcauu

SEQ ID NO: 44460 - RNA, 23 nt, Artificial Sequence
  RNA Oligomer
caggaucuaacagcucuucagug

SEQ ID NO: 44461 - RNA, 23 nt, Artificial Sequence
  RNA Oligomer
aauccacuaacgaaccaagucag

SEQ ID NO: 44462 - RNA, 23 nt, Artificial Sequence
  RNA Oligomer
cacuaacgaaccaagucagacuc

SEQ ID NO: 44463 - RNA, 23 nt, Artificial Sequence
  RNA Oligomer
acuaacgaaccaagucagacucc

SEQ ID NO: 44464 - RNA, 23 nt, Artificial Sequence
  RNA Oligomer
cuaacgaaccaagucagacucca

SEQ ID NO: 44465 - RNA, 23 nt, Artificial Sequence
  RNA Oligomer
uaacgaaccaagucagacuccag

SEQ ID NO: 44466 - RNA, 23 nt, Artificial Sequence
  RNA Oligomer
aacgaaccaagucagacuccagu

SEQ ID NO: 44467 - RNA, 23 nt, Artificial Sequence
  RNA Oligomer
auuuuccggccgacuugaccaau

SEQ ID NO: 44468 - RNA, 23 nt, Artificial Sequence
  RNA Oligomer
cuuucaauaucaucuuccucaga

SEQ ID NO: 44469 - RNA, 23 nt, Artificial Sequence
  RNA Oligomer
uuucaauaucaucuuccucagac

SEQ ID NO: 44470 - RNA, 23 nt, Artificial Sequence
  RNA Oligomer
uucaauaucaucuuccucagacu

SEQ ID NO: 44471 - RNA, 23 nt, Artificial Sequence
  RNA Oligomer
ucaauaucaucuuccucagacug

SEQ ID NO: 44472 - RNA, 23 nt, Artificial Sequence
  RNA Oligomer
caauaucaucuuccucagacugu

SEQ ID NO: 44473 - RNA, 23 nt, Artificial Sequence
  RNA Oligomer
aauaucaucuuccucagacugug

SEQ ID NO: 44474 - RNA, 23 nt, Artificial Sequence
  RNA Oligomer
auaucaucuuccucagacuguga

SEQ ID NO: 44475 - RNA, 23 nt, Artificial Sequence
  RNA Oligomer
uaucaucuuccucagacugugag

SEQ ID NO: 44476 - RNA, 23 nt, Artificial Sequence
  RNA Oligomer
aucaucuuccucagacugugagc

SEQ ID NO: 44477 - RNA, 23 nt, Artificial Sequence
  RNA Oligomer
ccaaugcuauggguaucuguuuc

SEQ ID NO: 44478 - RNA, 23 nt, Artificial Sequence
  RNA Oligomer
caaugcuauggguaucuguuuca

SEQ ID NO: 44479 - RNA, 23 nt, Artificial Sequence
  RNA Oligomer
agugugauauauaaggccacaau

SEQ ID NO: 44480 - RNA, 23 nt, Artificial Sequence
  RNA Oligomer
auuuucacaguagacauuaauca

SEQ ID NO: 44481 - RNA, 23 nt, Artificial Sequence
  RNA Oligomer
uuuucacaguagacauuaaucag

SEQ ID NO: 44482 - RNA, 23 nt, Artificial Sequence
  RNA Oligomer
uuucacaguagacauuaaucagu

SEQ ID NO: 44483 - RNA, 23 nt, Artificial Sequence
  RNA Oligomer
uucacaguagacauuaaucaguc

SEQ ID NO: 44484 - RNA, 23 nt, Artificial Sequence
  RNA Oligomer
ucacaguagacauuaaucagucu

SEQ ID NO: 44485 - RNA, 23 nt, Artificial Sequence
  RNA Oligomer
uaaauuaggaacgcagcauuuac

SEQ ID NO: 44486 - RNA, 23 nt, Artificial Sequence
  RNA Oligomer
aaauuaggaacgcagcauuuaca

SEQ ID NO: 44487 - RNA, 23 nt, Artificial Sequence
  RNA Oligomer
aauuaggaacgcagcauuuacag

SEQ ID NO: 44488 - RNA, 23 nt, Artificial Sequence
  RNA Oligomer
auuaggaacgcagcauuuacaga

SEQ ID NO: 44489 - RNA, 23 nt, Artificial Sequence
  RNA Oligomer
uuaggaacgcagcauuuacagaa

SEQ ID NO: 44490 - RNA, 23 nt, Artificial Sequence
  RNA Oligomer
uaggaacgcagcauuuacagaac

SEQ ID NO: 44491 - RNA, 23 nt, Artificial Sequence
  RNA Oligomer
agcucagaaguaauccacuaacg

SEQ ID NO: 44492 - RNA, 23 nt, Artificial Sequence
  RNA Oligomer
gcucagaaguaauccacuaacga

SEQ ID NO: 44493 - RNA, 23 nt, Artificial Sequence
  RNA Oligomer
cucagaaguaauccacuaacgaa

SEQ ID NO: 44494 - RNA, 23 nt, Artificial Sequence
  RNA Oligomer
auccaaucugaguuuuucuucaa

SEQ ID NO: 44495 - RNA, 23 nt, Artificial Sequence
  RNA Oligomer
uccaaucugaguuuuucuucaag

SEQ ID NO: 44496 - RNA, 23 nt, Artificial Sequence
  RNA Oligomer
ccaaucugaguuuuucuucaaga

SEQ ID NO: 44497 - RNA, 23 nt, Artificial Sequence
  RNA Oligomer
caaucugaguuuuucuucaagau

SEQ ID NO: 44498 - RNA, 23 nt, Artificial Sequence
  RNA Oligomer
aucugaguuuuucuucaagaugc

SEQ ID NO: 44499 - RNA, 23 nt, Artificial Sequence
  RNA Oligomer
ucugaguuuuucuucaagaugcu

SEQ ID NO: 44500 - RNA, 23 nt, Artificial Sequence
  RNA Oligomer
cugaguuuuucuucaagaugcuu

SEQ ID NO: 44501 - RNA, 23 nt, Artificial Sequence
  RNA Oligomer
ugaguuuuucuucaagaugcuuu

SEQ ID NO: 44502 - RNA, 23 nt, Artificial Sequence
  RNA Oligomer
uuucuucaagaugcuuucaacuu

SEQ ID NO: 44503 - RNA, 23 nt, Artificial Sequence
  RNA Oligomer
uucuucaagaugcuuucaacuuc

SEQ ID NO: 44504 - RNA, 23 nt, Artificial Sequence
  RNA Oligomer
ucuucaagaugcuuucaacuucu

SEQ ID NO: 44505 - RNA, 23 nt, Artificial Sequence
  RNA Oligomer
cuucaagaugcuuucaacuucuu

SEQ ID NO: 44506 - RNA, 23 nt, Artificial Sequence
  RNA Oligomer
uucaagaugcuuucaacuucuuu

SEQ ID NO: 44507 - RNA, 23 nt, Artificial Sequence
  RNA Oligomer
ucaagaugcuuucaacuucuuuc

SEQ ID NO: 44508 - RNA, 23 nt, Artificial Sequence
  RNA Oligomer
ugcuuucaacuucuuuccuucuu

SEQ ID NO: 44509 - RNA, 23 nt, Artificial Sequence
  RNA Oligomer
gcuuucaacuucuuuccuucuuu

SEQ ID NO: 44510 - RNA, 23 nt, Artificial Sequence
  RNA Oligomer
cuuucaacuucuuuccuucuuuc

SEQ ID NO: 44511 - RNA, 23 nt, Artificial Sequence
  RNA Oligomer
uuucaacuucuuuccuucuuuca

SEQ ID NO: 44512 - RNA, 23 nt, Artificial Sequence
  RNA Oligomer
uucaacuucuuuccuucuuucaa

SEQ ID NO: 44513 - RNA, 23 nt, Artificial Sequence
  RNA Oligomer
ucaucuuccucagacugugagcu

SEQ ID NO: 44514 - RNA, 23 nt, Artificial Sequence
  RNA Oligomer
uuaauuccuuauaaugcaaaagc

SEQ ID NO: 44515 - RNA, 23 nt, Artificial Sequence
  RNA Oligomer
uaauuccuuauaaugcaaaagca

SEQ ID NO: 44516 - RNA, 23 nt, Artificial Sequence
  RNA Oligomer
aauuccuuauaaugcaaaagcaa

SEQ ID NO: 44517 - RNA, 23 nt, Artificial Sequence
  RNA Oligomer
auuccuuauaaugcaaaagcaag

SEQ ID NO: 44518 - RNA, 23 nt, Artificial Sequence
  RNA Oligomer
uuccuuauaaugcaaaagcaaga

SEQ ID NO: 44519 - RNA, 23 nt, Artificial Sequence
  RNA Oligomer
gcaaaagcaagaagaguuuagug

SEQ ID NO: 44520 - RNA, 23 nt, Artificial Sequence
  RNA Oligomer
agaagaguuuaguguacgaacug

SEQ ID NO: 44521 - RNA, 23 nt, Artificial Sequence
  RNA Oligomer
gcucuaucuugguuucuguugau

SEQ ID NO: 44522 - RNA, 23 nt, Artificial Sequence
  RNA Oligomer
cucuaucuugguuucuguugauu

SEQ ID NO: 44523 - RNA, 23 nt, Artificial Sequence
  RNA Oligomer
ucuaucuugguuucuguugauua

SEQ ID NO: 44524 - RNA, 23 nt, Artificial Sequence
  RNA Oligomer
cuaucuugguuucuguugauuau

SEQ ID NO: 44525 - RNA, 23 nt, Artificial Sequence
  RNA Oligomer
uaucuugguuucuguugauuaug

SEQ ID NO: 44526 - RNA, 23 nt, Artificial Sequence
  RNA Oligomer
agucugacaugcuuauugauccc

SEQ ID NO: 44527 - RNA, 23 nt, Artificial Sequence
  RNA Oligomer
gucugacaugcuuauugauccca

SEQ ID NO: 44528 - RNA, 23 nt, Artificial Sequence
  RNA Oligomer
ucugacaugcuuauugaucccau

SEQ ID NO: 44529 - RNA, 23 nt, Artificial Sequence
  RNA Oligomer
cugacaugcuuauugaucccaua

SEQ ID NO: 44530 - RNA, 23 nt, Artificial Sequence
  RNA Oligomer
ugacaugcuuauugaucccauag

SEQ ID NO: 44531 - RNA, 23 nt, Artificial Sequence
  RNA Oligomer
acuaaauuaggaacgcagcauuu

SEQ ID NO: 44532 - RNA, 23 nt, Artificial Sequence
  RNA Oligomer
cuaaauuaggaacgcagcauuua

SEQ ID NO: 44533 - RNA, 23 nt, Artificial Sequence
  RNA Oligomer
aggaacgcagcauuuacagaaca

SEQ ID NO: 44534 - RNA, 23 nt, Artificial Sequence
  RNA Oligomer
ggaacgcagcauuuacagaacaa

SEQ ID NO: 44535 - RNA, 23 nt, Artificial Sequence
  RNA Oligomer
gaacgcagcauuuacagaacaaa

SEQ ID NO: 44536 - RNA, 23 nt, Artificial Sequence
  RNA Oligomer
aacgcagcauuuacagaacaaau

SEQ ID NO: 44537 - RNA, 23 nt, Artificial Sequence
  RNA Oligomer
acgaaccaagucagacuccaguu

SEQ ID NO: 44538 - RNA, 23 nt, Artificial Sequence
  RNA Oligomer
cagacgccuuccaauauagaucc

SEQ ID NO: 44539 - RNA, 23 nt, Artificial Sequence
  RNA Oligomer
agacgccuuccaauauagauccc

SEQ ID NO: 44540 - RNA, 23 nt, Artificial Sequence
  RNA Oligomer
gacgccuuccaauauagaucccc

SEQ ID NO: 44541 - RNA, 23 nt, Artificial Sequence
  RNA Oligomer
acgccuuccaauauagaucccca

SEQ ID NO: 44542 - RNA, 23 nt, Artificial Sequence
  RNA Oligomer
cgccuuccaauauagauccccaa

SEQ ID NO: 44543 - RNA, 23 nt, Artificial Sequence
  RNA Oligomer
gccuuccaauauagauccccaau

SEQ ID NO: 44544 - RNA, 23 nt, Artificial Sequence
  RNA Oligomer
ugcugaagugcaguucuacccag

SEQ ID NO: 44545 - RNA, 23 nt, Artificial Sequence
  RNA Oligomer
ugaccaaucccauauccaaucug

SEQ ID NO: 44546 - RNA, 23 nt, Artificial Sequence
  RNA Oligomer
cccguucccauuauugcugaagu

SEQ ID NO: 44547 - RNA, 23 nt, Artificial Sequence
  RNA Oligomer
ccguucccauuauugcugaagug

SEQ ID NO: 44548 - RNA, 23 nt, Artificial Sequence
  RNA Oligomer
cguucccauuauugcugaagugc

SEQ ID NO: 44549 - RNA, 23 nt, Artificial Sequence
  RNA Oligomer
guucccauuauugcugaagugca

SEQ ID NO: 44550 - RNA, 23 nt, Artificial Sequence
  RNA Oligomer
uucccauuauugcugaagugcag

SEQ ID NO: 44551 - RNA, 23 nt, Artificial Sequence
  RNA Oligomer
agcccuguugguaucuuguggug

SEQ ID NO: 44552 - RNA, 23 nt, Artificial Sequence
  RNA Oligomer
gcccuguugguaucuuguggugu

SEQ ID NO: 44553 - RNA, 23 nt, Artificial Sequence
  RNA Oligomer
cccuguugguaucuugugguguc

SEQ ID NO: 44554 - RNA, 23 nt, Artificial Sequence
  RNA Oligomer
ccuguugguaucuuguggugucu

SEQ ID NO: 44555 - RNA, 23 nt, Artificial Sequence
  RNA Oligomer
cuguugguaucuuguggugucug

SEQ ID NO: 44556 - RNA, 23 nt, Artificial Sequence
  RNA Oligomer
uguagcucuaucuugguuucugu

SEQ ID NO: 44557 - RNA, 23 nt, Artificial Sequence
  RNA Oligomer
guagcucuaucuugguuucuguu

SEQ ID NO: 44558 - RNA, 23 nt, Artificial Sequence
  RNA Oligomer
uagcucuaucuugguuucuguug

SEQ ID NO: 44559 - RNA, 23 nt, Artificial Sequence
  RNA Oligomer
ucuuuaguagacaaccugcaucc

SEQ ID NO: 44560 - RNA, 23 nt, Artificial Sequence
  RNA Oligomer
cuuuaguagacaaccugcaucca

SEQ ID NO: 44561 - RNA, 23 nt, Artificial Sequence
  RNA Oligomer
uuuaguagacaaccugcauccau

SEQ ID NO: 44562 - RNA, 23 nt, Artificial Sequence
  RNA Oligomer
uuaguagacaaccugcauccauu

SEQ ID NO: 44563 - RNA, 23 nt, Artificial Sequence
  RNA Oligomer
uaguagacaaccugcauccauuu

SEQ ID NO: 44564 - RNA, 23 nt, Artificial Sequence
  RNA Oligomer
uaaaauacaacacacaucaugac

SEQ ID NO: 44565 - RNA, 23 nt, Artificial Sequence
  RNA Oligomer
aaaauacaacacacaucaugacu

SEQ ID NO: 44566 - RNA, 23 nt, Artificial Sequence
  RNA Oligomer
aaauacaacacacaucaugacua

SEQ ID NO: 44567 - RNA, 23 nt, Artificial Sequence
  RNA Oligomer
aauacaacacacaucaugacuag

SEQ ID NO: 44568 - RNA, 23 nt, Artificial Sequence
  RNA Oligomer
auacaacacacaucaugacuagu

SEQ ID NO: 44569 - RNA, 23 nt, Artificial Sequence
  RNA Oligomer
cagucugacaugcuuauugaucc

SEQ ID NO: 44570 - RNA, 23 nt, Artificial Sequence
  RNA Oligomer
gagcuauguugcaagcucagaag

SEQ ID NO: 44571 - RNA, 23 nt, Artificial Sequence
  RNA Oligomer
agcuauguugcaagcucagaagu

SEQ ID NO: 44572 - RNA, 23 nt, Artificial Sequence
  RNA Oligomer
gcuauguugcaagcucagaagua

SEQ ID NO: 44573 - RNA, 23 nt, Artificial Sequence
  RNA Oligomer
cuauguugcaagcucagaaguaa

SEQ ID NO: 44574 - RNA, 23 nt, Artificial Sequence
  RNA Oligomer
uauguugcaagcucagaaguaau

SEQ ID NO: 44575 - RNA, 23 nt, Artificial Sequence
  RNA Oligomer
ccacuaacgaaccaagucagacu

SEQ ID NO: 44576 - RNA, 23 nt, Artificial Sequence
  RNA Oligomer
cgaaccaagucagacuccaguuc

SEQ ID NO: 44577 - RNA, 23 nt, Artificial Sequence
  RNA Oligomer
gaaccaagucagacuccaguucu

SEQ ID NO: 44578 - RNA, 23 nt, Artificial Sequence
  RNA Oligomer
aaccaagucagacuccaguucuu

SEQ ID NO: 44579 - RNA, 23 nt, Artificial Sequence
  RNA Oligomer
gcccccuuucuucaugacgcucg

SEQ ID NO: 44580 - RNA, 23 nt, Artificial Sequence
  RNA Oligomer
cccccuuucuucaugacgcucgu

SEQ ID NO: 44581 - RNA, 23 nt, Artificial Sequence
  RNA Oligomer
ccccuuucuucaugacgcucgug

SEQ ID NO: 44582 - RNA, 23 nt, Artificial Sequence
  RNA Oligomer
cccuuucuucaugacgcucgugu

SEQ ID NO: 44583 - RNA, 23 nt, Artificial Sequence
  RNA Oligomer
ccuuucuucaugacgcucguguu

SEQ ID NO: 44584 - RNA, 23 nt, Artificial Sequence
  RNA Oligomer
ucaacuucuuuccuucuuucaau

SEQ ID NO: 44585 - RNA, 23 nt, Artificial Sequence
  RNA Oligomer
caacuucuuuccuucuuucaaua

SEQ ID NO: 44586 - RNA, 23 nt, Artificial Sequence
  RNA Oligomer
aacuucuuuccuucuuucaauau

SEQ ID NO: 44587 - RNA, 23 nt, Artificial Sequence
  RNA Oligomer
aauaaagcugauuuuaaaagcac

SEQ ID NO: 44588 - RNA, 23 nt, Artificial Sequence
  RNA Oligomer
auaaagcugauuuuaaaagcaca

SEQ ID NO: 44589 - RNA, 23 nt, Artificial Sequence
  RNA Oligomer
uaaagcugauuuuaaaagcacac

SEQ ID NO: 44590 - RNA, 23 nt, Artificial Sequence
  RNA Oligomer
caccaaugcagagugauaaagag

SEQ ID NO: 44591 - RNA, 23 nt, Artificial Sequence
  RNA Oligomer
accaaugcagagugauaaagagg

SEQ ID NO: 44592 - RNA, 23 nt, Artificial Sequence
  RNA Oligomer
ccaaugcagagugauaaagagga

SEQ ID NO: 44593 - RNA, 23 nt, Artificial Sequence
  RNA Oligomer
caaugcagagugauaaagaggaa

SEQ ID NO: 44594 - RNA, 23 nt, Artificial Sequence
  RNA Oligomer
aaugcagagugauaaagaggaaa

SEQ ID NO: 44595 - RNA, 23 nt, Artificial Sequence
  RNA Oligomer
gugugauauauaaggccacaaua

SEQ ID NO: 44596 - RNA, 23 nt, Artificial Sequence
  RNA Oligomer
uuuaaaauacaacacacaucaug

SEQ ID NO: 44597 - RNA, 23 nt, Artificial Sequence
  RNA Oligomer
uuaaaauacaacacacaucauga

SEQ ID NO: 44598 - RNA, 23 nt, Artificial Sequence
  RNA Oligomer
uacaacacacaucaugacuagua

SEQ ID NO: 44599 - RNA, 23 nt, Artificial Sequence
  RNA Oligomer
acaacacacaucaugacuaguau

SEQ ID NO: 44600 - RNA, 23 nt, Artificial Sequence
  RNA Oligomer
caacacacaucaugacuaguaua

SEQ ID NO: 44601 - RNA, 23 nt, Artificial Sequence
  RNA Oligomer
cacaguagacauuaaucagucug

SEQ ID NO: 44602 - RNA, 23 nt, Artificial Sequence
  RNA Oligomer
acaguagacauuaaucagucuga

SEQ ID NO: 44603 - RNA, 23 nt, Artificial Sequence
  RNA Oligomer
gacaugcuuauugaucccauagg

SEQ ID NO: 44604 - RNA, 23 nt, Artificial Sequence
  RNA Oligomer
acaugcuuauugaucccauaggu

SEQ ID NO: 44605 - RNA, 23 nt, Artificial Sequence
  RNA Oligomer
caugcuuauugaucccauaggug

SEQ ID NO: 44606 - RNA, 23 nt, Artificial Sequence
  RNA Oligomer
uuuacagaacaaauaaacacaag

SEQ ID NO: 44607 - RNA, 23 nt, Artificial Sequence
  RNA Oligomer
uuacagaacaaauaaacacaagu

SEQ ID NO: 44608 - RNA, 23 nt, Artificial Sequence
  RNA Oligomer
uguugcaagcucagaaguaaucc

SEQ ID NO: 44609 - RNA, 23 nt, Artificial Sequence
  RNA Oligomer
guugcaagcucagaaguaaucca

SEQ ID NO: 44610 - RNA, 23 nt, Artificial Sequence
  RNA Oligomer
auccacuaacgaaccaagucaga

SEQ ID NO: 44611 - RNA, 23 nt, Artificial Sequence
  RNA Oligomer
uccacuaacgaaccaagucagac

SEQ ID NO: 44612 - RNA, 23 nt, Artificial Sequence
  RNA Oligomer
uugaccaaucccauauccaaucu

SEQ ID NO: 44613 - RNA, 23 nt, Artificial Sequence
  RNA Oligomer
agauuugcuuagaauaaagcuga

SEQ ID NO: 44614 - RNA, 23 nt, Artificial Sequence
  RNA Oligomer
gauuugcuuagaauaaagcugau

SEQ ID NO: 44615 - RNA, 23 nt, Artificial Sequence
  RNA Oligomer
auuugcuuagaauaaagcugauu

SEQ ID NO: 44616 - RNA, 23 nt, Artificial Sequence
  RNA Oligomer
uuugcuuagaauaaagcugauuu

SEQ ID NO: 44617 - RNA, 23 nt, Artificial Sequence
  RNA Oligomer
uugcuuagaauaaagcugauuuu

SEQ ID NO: 44618 - RNA, 23 nt, Artificial Sequence
  RNA Oligomer
aaagaggaaaagauacugaguag

SEQ ID NO: 44619 - RNA, 23 nt, Artificial Sequence
  RNA Oligomer
aagaggaaaagauacugaguagg

SEQ ID NO: 44620 - RNA, 23 nt, Artificial Sequence
  RNA Oligomer
agaggaaaagauacugaguaggu

SEQ ID NO: 44621 - RNA, 23 nt, Artificial Sequence
  RNA Oligomer
gaggaaaagauacugaguaggug

SEQ ID NO: 44622 - RNA, 23 nt, Artificial Sequence
  RNA Oligomer
aggaaaagauacugaguaggugc

SEQ ID NO: 44623 - RNA, 23 nt, Artificial Sequence
  RNA Oligomer
agcucuaucuugguuucuguuga

SEQ ID NO: 44624 - RNA, 23 nt, Artificial Sequence
  RNA Oligomer
uugucagacgccuuccaauauag

SEQ ID NO: 44625 - RNA, 23 nt, Artificial Sequence
  RNA Oligomer
ugucagacgccuuccaauauaga

SEQ ID NO: 44626 - RNA, 23 nt, Artificial Sequence
  RNA Oligomer
gucagacgccuuccaauauagau

SEQ ID NO: 44627 - RNA, 23 nt, Artificial Sequence
  RNA Oligomer
ucagacgccuuccaauauagauc

SEQ ID NO: 44628 - RNA, 23 nt, Artificial Sequence
  RNA Oligomer
uccgauggccagcaaaugagaga

SEQ ID NO: 44629 - RNA, 23 nt, Artificial Sequence
  RNA Oligomer
ccgauggccagcaaaugagagag

SEQ ID NO: 44630 - RNA, 23 nt, Artificial Sequence
  RNA Oligomer
cgauggccagcaaaugagagagc

SEQ ID NO: 44631 - RNA, 23 nt, Artificial Sequence
  RNA Oligomer
gauggccagcaaaugagagagca

SEQ ID NO: 44632 - RNA, 23 nt, Artificial Sequence
  RNA Oligomer
auggccagcaaaugagagagcag

SEQ ID NO: 44633 - RNA, 23 nt, Artificial Sequence
  RNA Oligomer
cuuucuucaugacgcucguguuc

SEQ ID NO: 44634 - RNA, 23 nt, Artificial Sequence
  RNA Oligomer
cugugagcuguuuuucucuccaa

SEQ ID NO: 44635 - RNA, 23 nt, Artificial Sequence
  RNA Oligomer
ugugagcuguuuuucucuccaau

SEQ ID NO: 44636 - RNA, 23 nt, Artificial Sequence
  RNA Oligomer
gugagcuguuuuucucuccaaug

SEQ ID NO: 44637 - RNA, 23 nt, Artificial Sequence
  RNA Oligomer
ugagcuguuuuucucuccaaugc

SEQ ID NO: 44638 - RNA, 23 nt, Artificial Sequence
  RNA Oligomer
gagcuguuuuucucuccaaugcu

SEQ ID NO: 44639 - RNA, 23 nt, Artificial Sequence
  RNA Oligomer
agcuguuuuucucuccaaugcua

SEQ ID NO: 44640 - RNA, 23 nt, Artificial Sequence
  RNA Oligomer
gcuguuuuucucuccaaugcuau

SEQ ID NO: 44641 - RNA, 23 nt, Artificial Sequence
  RNA Oligomer
cuguuuuucucuccaaugcuaug

SEQ ID NO: 44642 - RNA, 23 nt, Artificial Sequence
  RNA Oligomer
cagauuugcuuagaauaaagcug

SEQ ID NO: 44643 - RNA, 23 nt, Artificial Sequence
  RNA Oligomer
gagugauaaagaggaaaagauac

SEQ ID NO: 44644 - RNA, 23 nt, Artificial Sequence
  RNA Oligomer
agugauaaagaggaaaagauacu

SEQ ID NO: 44645 - RNA, 23 nt, Artificial Sequence
  RNA Oligomer
gugauaaagaggaaaagauacug

SEQ ID NO: 44646 - RNA, 23 nt, Artificial Sequence
  RNA Oligomer
ugauaaagaggaaaagauacuga

SEQ ID NO: 44647 - RNA, 23 nt, Artificial Sequence
  RNA Oligomer
gauaaagaggaaaagauacugag

SEQ ID NO: 44648 - RNA, 23 nt, Artificial Sequence
  RNA Oligomer
accaaauuuucacaguagacauu

SEQ ID NO: 44649 - RNA, 23 nt, Artificial Sequence
  RNA Oligomer
ccaaauuuucacaguagacauua

SEQ ID NO: 44650 - RNA, 23 nt, Artificial Sequence
  RNA Oligomer
caaauuuucacaguagacauuaa

SEQ ID NO: 44651 - RNA, 23 nt, Artificial Sequence
  RNA Oligomer
uuaaucagucugacaugcuuauu

SEQ ID NO: 44652 - RNA, 23 nt, Artificial Sequence
  RNA Oligomer
aaucagucugacaugcuuauuga

SEQ ID NO: 44653 - RNA, 23 nt, Artificial Sequence
  RNA Oligomer
aucagucugacaugcuuauugau

SEQ ID NO: 44654 - RNA, 23 nt, Artificial Sequence
  RNA Oligomer
ucagucugacaugcuuauugauc

SEQ ID NO: 44655 - RNA, 23 nt, Artificial Sequence
  RNA Oligomer
uggccagcaaaugagagagcagc

SEQ ID NO: 44656 - RNA, 23 nt, Artificial Sequence
  RNA Oligomer
uuuuaaaguagacacagauuugc

SEQ ID NO: 44657 - RNA, 23 nt, Artificial Sequence
  RNA Oligomer
uuuaaaguagacacagauuugcu

SEQ ID NO: 44658 - RNA, 23 nt, Artificial Sequence
  RNA Oligomer
uuaaaguagacacagauuugcuu

SEQ ID NO: 44659 - RNA, 23 nt, Artificial Sequence
  RNA Oligomer
uaaaguagacacagauuugcuua

SEQ ID NO: 44660 - RNA, 23 nt, Artificial Sequence
  RNA Oligomer
augcagagugauaaagaggaaaa

SEQ ID NO: 44661 - RNA, 23 nt, Artificial Sequence
  RNA Oligomer
uaaucagucugacaugcuuauug

SEQ ID NO: 44662 - RNA, 23 nt, Artificial Sequence
  RNA Oligomer
cuuuccuucuuucaauaucaucu

SEQ ID NO: 44663 - RNA, 23 nt, Artificial Sequence
  RNA Oligomer
uuuccuucuuucaauaucaucuu

SEQ ID NO: 44664 - RNA, 23 nt, Artificial Sequence
  RNA Oligomer
uuccuucuuucaauaucaucuuc

SEQ ID NO: 44665 - RNA, 23 nt, Artificial Sequence
  RNA Oligomer
auaaagaggaaaagauacugagu

SEQ ID NO: 44666 - RNA, 23 nt, Artificial Sequence
  RNA Oligomer
uaaagaggaaaagauacugagua

SEQ ID NO: 44667 - RNA, 23 nt, Artificial Sequence
  RNA Oligomer
ucagaaauucugcagagaauaug

SEQ ID NO: 44668 - RNA, 23 nt, Artificial Sequence
  RNA Oligomer
cagaaauucugcagagaauaugc

SEQ ID NO: 44669 - RNA, 23 nt, Artificial Sequence
  RNA Oligomer
agaaauucugcagagaauaugcc

SEQ ID NO: 44670 - RNA, 23 nt, Artificial Sequence
  RNA Oligomer
gaaauucugcagagaauaugccc

SEQ ID NO: 44671 - RNA, 23 nt, Artificial Sequence
  RNA Oligomer
aaauucugcagagaauaugcccc

SEQ ID NO: 44672 - RNA, 23 nt, Artificial Sequence
  RNA Oligomer
aauucugcagagaauaugccccc

SEQ ID NO: 44673 - RNA, 23 nt, Artificial Sequence
  RNA Oligomer
auucugcagagaauaugcccccu

SEQ ID NO: 44674 - RNA, 23 nt, Artificial Sequence
  RNA Oligomer
uucugcagagaauaugcccccuu

SEQ ID NO: 44675 - RNA, 23 nt, Artificial Sequence
  RNA Oligomer
ugcagagugauaaagaggaaaag

SEQ ID NO: 44676 - RNA, 23 nt, Artificial Sequence
  RNA Oligomer
gucuccauuauaaauagaaaccg

SEQ ID NO: 44677 - RNA, 23 nt, Artificial Sequence
  RNA Oligomer
ucuccauuauaaauagaaaccga

SEQ ID NO: 44678 - RNA, 23 nt, Artificial Sequence
  RNA Oligomer
cuccauuauaaauagaaaccgag

SEQ ID NO: 44679 - RNA, 23 nt, Artificial Sequence
  RNA Oligomer
ggaaaacuuucagaaauucugca

SEQ ID NO: 44680 - RNA, 23 nt, Artificial Sequence
  RNA Oligomer
gaaaacuuucagaaauucugcag

SEQ ID NO: 44681 - RNA, 23 nt, Artificial Sequence
  RNA Oligomer
aaaacuuucagaaauucugcaga

SEQ ID NO: 44682 - RNA, 23 nt, Artificial Sequence
  RNA Oligomer
aaacuuucagaaauucugcagag

SEQ ID NO: 44683 - RNA, 23 nt, Artificial Sequence
  RNA Oligomer
aacuuucagaaauucugcagaga

SEQ ID NO: 44684 - RNA, 23 nt, Artificial Sequence
  RNA Oligomer
guguuuaaagaggaacuccuugg

SEQ ID NO: 44685 - RNA, 23 nt, Artificial Sequence
  RNA Oligomer
uguuuaaagaggaacuccuuggg

SEQ ID NO: 44686 - RNA, 23 nt, Artificial Sequence
  RNA Oligomer
guuuaaagaggaacuccuugggg

SEQ ID NO: 44687 - RNA, 23 nt, Artificial Sequence
  RNA Oligomer
uuuaaagaggaacuccuuggggg

SEQ ID NO: 44688 - RNA, 23 nt, Artificial Sequence
  RNA Oligomer
uuaaagaggaacuccuugggggg

SEQ ID NO: 44689 - RNA, 23 nt, Artificial Sequence
  RNA Oligomer
uaaagaggaacuccuugggggga

SEQ ID NO: 44690 - RNA, 23 nt, Artificial Sequence
  RNA Oligomer
aaucggagacuuaauuccuuaua

SEQ ID NO: 44691 - RNA, 23 nt, Artificial Sequence
  RNA Oligomer
aucggagacuuaauuccuuauaa

SEQ ID NO: 44692 - RNA, 23 nt, Artificial Sequence
  RNA Oligomer
acuuucagaaauucugcagagaa

SEQ ID NO: 44693 - RNA, 23 nt, Artificial Sequence
  RNA Oligomer
caucuuccucagacugugagcug

SEQ ID NO: 44694 - RNA, 23 nt, Artificial Sequence
  RNA Oligomer
aucuuccucagacugugagcugu

SEQ ID NO: 44695 - RNA, 23 nt, Artificial Sequence
  RNA Oligomer
ucuuccucagacugugagcuguu

SEQ ID NO: 44696 - RNA, 23 nt, Artificial Sequence
  RNA Oligomer
cuuccucagacugugagcuguuu

SEQ ID NO: 44697 - RNA, 23 nt, Artificial Sequence
  RNA Oligomer
uuccucagacugugagcuguuuu

SEQ ID NO: 44698 - RNA, 23 nt, Artificial Sequence
  RNA Oligomer
uccucagacugugagcuguuuuu

SEQ ID NO: 44699 - RNA, 23 nt, Artificial Sequence
  RNA Oligomer
uguuuuucucuccaaugcuaugg

SEQ ID NO: 44700 - RNA, 23 nt, Artificial Sequence
  RNA Oligomer
guuuuucucuccaaugcuauggg

SEQ ID NO: 44701 - RNA, 23 nt, Artificial Sequence
  RNA Oligomer
uuuuucucuccaaugcuaugggu

SEQ ID NO: 44702 - RNA, 23 nt, Artificial Sequence
  RNA Oligomer
uuuucucuccaaugcuaugggua

SEQ ID NO: 44703 - RNA, 23 nt, Artificial Sequence
  RNA Oligomer
uuucucuccaaugcuauggguau

SEQ ID NO: 44704 - RNA, 23 nt, Artificial Sequence
  RNA Oligomer
augcaaaagcaagaagaguuuag

SEQ ID NO: 44705 - RNA, 23 nt, Artificial Sequence
  RNA Oligomer
ugcaaaagcaagaagaguuuagu

SEQ ID NO: 44706 - RNA, 23 nt, Artificial Sequence
  RNA Oligomer
agaucaacaugauuuuagugucu

SEQ ID NO: 44707 - RNA, 23 nt, Artificial Sequence
  RNA Oligomer
gaucaacaugauuuuagugucua

SEQ ID NO: 44708 - RNA, 23 nt, Artificial Sequence
  RNA Oligomer
aucaacaugauuuuagugucuau

SEQ ID NO: 44709 - RNA, 23 nt, Artificial Sequence
  RNA Oligomer
ucaacaugauuuuagugucuauu

SEQ ID NO: 44710 - RNA, 23 nt, Artificial Sequence
  RNA Oligomer
caacaugauuuuagugucuauuc

SEQ ID NO: 44711 - RNA, 23 nt, Artificial Sequence
  RNA Oligomer
aauaaacacaagugacguggcca

SEQ ID NO: 44712 - RNA, 23 nt, Artificial Sequence
  RNA Oligomer
auaaacacaagugacguggccac

SEQ ID NO: 44713 - RNA, 23 nt, Artificial Sequence
  RNA Oligomer
uaaacacaagugacguggccacc

SEQ ID NO: 44714 - RNA, 23 nt, Artificial Sequence
  RNA Oligomer
aaacacaagugacguggccaccc

SEQ ID NO: 44715 - RNA, 23 nt, Artificial Sequence
  RNA Oligomer
acuccaguucuucaucaaaaggu

SEQ ID NO: 44716 - RNA, 23 nt, Artificial Sequence
  RNA Oligomer
cuccaguucuucaucaaaaggug

SEQ ID NO: 44717 - RNA, 23 nt, Artificial Sequence
  RNA Oligomer
uccaguucuucaucaaaaggugc

SEQ ID NO: 44718 - RNA, 23 nt, Artificial Sequence
  RNA Oligomer
ccaguucuucaucaaaaggugcu

SEQ ID NO: 44719 - RNA, 23 nt, Artificial Sequence
  RNA Oligomer
caguucuucaucaaaaggugcug

SEQ ID NO: 44720 - RNA, 23 nt, Artificial Sequence
  RNA Oligomer
aggaaaacuuucagaaauucugc

SEQ ID NO: 44721 - RNA, 23 nt, Artificial Sequence
  RNA Oligomer
ugaucaccuaauaaucggagacu

SEQ ID NO: 44722 - RNA, 23 nt, Artificial Sequence
  RNA Oligomer
gaucaccuaauaaucggagacuu

SEQ ID NO: 44723 - RNA, 23 nt, Artificial Sequence
  RNA Oligomer
ccuuauaaugcaaaagcaagaag

SEQ ID NO: 44724 - RNA, 23 nt, Artificial Sequence
  RNA Oligomer
cuuauaaugcaaaagcaagaaga

SEQ ID NO: 44725 - RNA, 23 nt, Artificial Sequence
  RNA Oligomer
uuauaaugcaaaagcaagaagag

SEQ ID NO: 44726 - RNA, 23 nt, Artificial Sequence
  RNA Oligomer
uauaaugcaaaagcaagaagagu

SEQ ID NO: 44727 - RNA, 23 nt, Artificial Sequence
  RNA Oligomer
auaaugcaaaagcaagaagaguu

SEQ ID NO: 44728 - RNA, 23 nt, Artificial Sequence
  RNA Oligomer
auaaggccacaauauuuauuuug

SEQ ID NO: 44729 - RNA, 23 nt, Artificial Sequence
  RNA Oligomer
uaaggccacaauauuuauuuugg

SEQ ID NO: 44730 - RNA, 23 nt, Artificial Sequence
  RNA Oligomer
aaggccacaauauuuauuuugga

SEQ ID NO: 44731 - RNA, 23 nt, Artificial Sequence
  RNA Oligomer
aggccacaauauuuauuuuggac

SEQ ID NO: 44732 - RNA, 23 nt, Artificial Sequence
  RNA Oligomer
ggccacaauauuuauuuuggaca

SEQ ID NO: 44733 - RNA, 23 nt, Artificial Sequence
  RNA Oligomer
accccaggaucuaacagcucuuc

SEQ ID NO: 44734 - RNA, 23 nt, Artificial Sequence
  RNA Oligomer
ccccaggaucuaacagcucuuca

SEQ ID NO: 44735 - RNA, 23 nt, Artificial Sequence
  RNA Oligomer
cccaggaucuaacagcucuucag

SEQ ID NO: 44736 - RNA, 23 nt, Artificial Sequence
  RNA Oligomer
ccaggaucuaacagcucuucagu

SEQ ID NO: 44737 - RNA, 23 nt, Artificial Sequence
  RNA Oligomer
ucagaagcccuguugguaucuug

SEQ ID NO: 44738 - RNA, 23 nt, Artificial Sequence
  RNA Oligomer
cagaagcccuguugguaucuugu

SEQ ID NO: 44739 - RNA, 23 nt, Artificial Sequence
  RNA Oligomer
agaagcccuguugguaucuugug

SEQ ID NO: 44740 - RNA, 23 nt, Artificial Sequence
  RNA Oligomer
gaagcccuguugguaucuugugg

SEQ ID NO: 44741 - RNA, 23 nt, Artificial Sequence
  RNA Oligomer
aagcccuguugguaucuuguggu

SEQ ID NO: 44742 - RNA, 23 nt, Artificial Sequence
  RNA Oligomer
ggaaaagauacugaguaggugcc

SEQ ID NO: 44743 - RNA, 23 nt, Artificial Sequence
  RNA Oligomer
gaaaagauacugaguaggugccu

SEQ ID NO: 44744 - RNA, 23 nt, Artificial Sequence
  RNA Oligomer
aaaagauacugaguaggugccuu

SEQ ID NO: 44745 - RNA, 23 nt, Artificial Sequence
  RNA Oligomer
aaagauacugaguaggugccuuc

SEQ ID NO: 44746 - RNA, 23 nt, Artificial Sequence
  RNA Oligomer
aagauacugaguaggugccuuca

SEQ ID NO: 44747 - RNA, 23 nt, Artificial Sequence
  RNA Oligomer
ggcugucacagugagagcucuug

SEQ ID NO: 44748 - RNA, 23 nt, Artificial Sequence
  RNA Oligomer
gcugucacagugagagcucuugg

SEQ ID NO: 44749 - RNA, 23 nt, Artificial Sequence
  RNA Oligomer
cugucacagugagagcucuugga

SEQ ID NO: 44750 - RNA, 23 nt, Artificial Sequence
  RNA Oligomer
ugucacagugagagcucuuggag

SEQ ID NO: 44751 - RNA, 23 nt, Artificial Sequence
  RNA Oligomer
gucacagugagagcucuuggagc

SEQ ID NO: 44752 - RNA, 23 nt, Artificial Sequence
  RNA Oligomer
ucacagugagagcucuuggagcu

SEQ ID NO: 44753 - RNA, 23 nt, Artificial Sequence
  RNA Oligomer
uaaugcaaaagcaagaagaguuu

SEQ ID NO: 44754 - RNA, 23 nt, Artificial Sequence
  RNA Oligomer
agaguuuaguguacgaacuguac

SEQ ID NO: 44755 - RNA, 23 nt, Artificial Sequence
  RNA Oligomer
gaguuuaguguacgaacuguaca

SEQ ID NO: 44756 - RNA, 23 nt, Artificial Sequence
  RNA Oligomer
aguuuaguguacgaacuguacag

SEQ ID NO: 44757 - RNA, 23 nt, Artificial Sequence
  RNA Oligomer
guuuaguguacgaacuguacagc

SEQ ID NO: 44758 - RNA, 23 nt, Artificial Sequence
  RNA Oligomer
uuuaguguacgaacuguacagcu

SEQ ID NO: 44759 - RNA, 23 nt, Artificial Sequence
  RNA Oligomer
gaaauauaaaguacuucagcuga

SEQ ID NO: 44760 - RNA, 23 nt, Artificial Sequence
  RNA Oligomer
aaauauaaaguacuucagcugaa

SEQ ID NO: 44761 - RNA, 23 nt, Artificial Sequence
  RNA Oligomer
aauauaaaguacuucagcugaau

SEQ ID NO: 44762 - RNA, 23 nt, Artificial Sequence
  RNA Oligomer
auauaaaguacuucagcugaauu

SEQ ID NO: 44763 - RNA, 23 nt, Artificial Sequence
  RNA Oligomer
uauaaaguacuucagcugaauua

SEQ ID NO: 44764 - RNA, 23 nt, Artificial Sequence
  RNA Oligomer
agucagacuccaguucuucauca

SEQ ID NO: 44765 - RNA, 23 nt, Artificial Sequence
  RNA Oligomer
gucagacuccaguucuucaucaa

SEQ ID NO: 44766 - RNA, 23 nt, Artificial Sequence
  RNA Oligomer
ucagacuccaguucuucaucaaa

SEQ ID NO: 44767 - RNA, 23 nt, Artificial Sequence
  RNA Oligomer
cagacuccaguucuucaucaaaa

SEQ ID NO: 44768 - RNA, 23 nt, Artificial Sequence
  RNA Oligomer
agacuccaguucuucaucaaaag

SEQ ID NO: 44769 - RNA, 23 nt, Artificial Sequence
  RNA Oligomer
aguucuucaucaaaaggugcugg

SEQ ID NO: 44770 - RNA, 23 nt, Artificial Sequence
  RNA Oligomer
guucuucaucaaaaggugcuggu

SEQ ID NO: 44771 - RNA, 23 nt, Artificial Sequence
  RNA Oligomer
uucuucaucaaaaggugcuggug

SEQ ID NO: 44772 - RNA, 23 nt, Artificial Sequence
  RNA Oligomer
ucuucaucaaaaggugcuggugg

SEQ ID NO: 44773 - RNA, 23 nt, Artificial Sequence
  RNA Oligomer
cuucaucaaaaggugcuggugga

SEQ ID NO: 44774 - RNA, 23 nt, Artificial Sequence
  RNA Oligomer
uucaucaaaaggugcugguggag

SEQ ID NO: 44775 - RNA, 23 nt, Artificial Sequence
  RNA Oligomer
agagauggaaggaaaacuuucag

SEQ ID NO: 44776 - RNA, 23 nt, Artificial Sequence
  RNA Oligomer
gagauggaaggaaaacuuucaga

SEQ ID NO: 44777 - RNA, 23 nt, Artificial Sequence
  RNA Oligomer
agauggaaggaaaacuuucagaa

SEQ ID NO: 44778 - RNA, 23 nt, Artificial Sequence
  RNA Oligomer
gauggaaggaaaacuuucagaaa

SEQ ID NO: 44779 - RNA, 23 nt, Artificial Sequence
  RNA Oligomer
auggaaggaaaacuuucagaaau

SEQ ID NO: 44780 - RNA, 23 nt, Artificial Sequence
  RNA Oligomer
cuuucagaaauucugcagagaau

SEQ ID NO: 44781 - RNA, 23 nt, Artificial Sequence
  RNA Oligomer
uuucagaaauucugcagagaaua

SEQ ID NO: 44782 - RNA, 23 nt, Artificial Sequence
  RNA Oligomer
uucagaaauucugcagagaauau

SEQ ID NO: 44783 - RNA, 23 nt, Artificial Sequence
  RNA Oligomer
uucucuccaaugcuauggguauc

SEQ ID NO: 44784 - RNA, 23 nt, Artificial Sequence
  RNA Oligomer
uaucuguuucagaagcccuguug

SEQ ID NO: 44785 - RNA, 23 nt, Artificial Sequence
  RNA Oligomer
aucuguuucagaagcccuguugg

SEQ ID NO: 44786 - RNA, 23 nt, Artificial Sequence
  RNA Oligomer
ucuguuucagaagcccuguuggu

SEQ ID NO: 44787 - RNA, 23 nt, Artificial Sequence
  RNA Oligomer
cuguuucagaagcccuguuggua

SEQ ID NO: 44788 - RNA, 23 nt, Artificial Sequence
  RNA Oligomer
uguuucagaagcccuguugguau

SEQ ID NO: 44789 - RNA, 23 nt, Artificial Sequence
  RNA Oligomer
cacagauuugcuuagaauaaagc

SEQ ID NO: 44790 - RNA, 23 nt, Artificial Sequence
  RNA Oligomer
acagauuugcuuagaauaaagcu

SEQ ID NO: 44791 - RNA, 23 nt, Artificial Sequence
  RNA Oligomer
agcagaaaacugaucauccaggg

SEQ ID NO: 44792 - RNA, 23 nt, Artificial Sequence
  RNA Oligomer
gcagaaaacugaucauccagggu

SEQ ID NO: 44793 - RNA, 23 nt, Artificial Sequence
  RNA Oligomer
cagaaaacugaucauccagggug

SEQ ID NO: 44794 - RNA, 23 nt, Artificial Sequence
  RNA Oligomer
agaaaacugaucauccaggguga

SEQ ID NO: 44795 - RNA, 23 nt, Artificial Sequence
  RNA Oligomer
gaaaacugaucauccagggugau

SEQ ID NO: 44796 - RNA, 23 nt, Artificial Sequence
  RNA Oligomer
aaaacugaucauccagggugauc

SEQ ID NO: 44797 - RNA, 23 nt, Artificial Sequence
  RNA Oligomer
aaacugaucauccagggugauca

SEQ ID NO: 44798 - RNA, 23 nt, Artificial Sequence
  RNA Oligomer
aacugaucauccagggugaucac

SEQ ID NO: 44799 - RNA, 23 nt, Artificial Sequence
  RNA Oligomer
acuucagcugaauuaagguugca

SEQ ID NO: 44800 - RNA, 23 nt, Artificial Sequence
  RNA Oligomer
cuucagcugaauuaagguugcag

SEQ ID NO: 44801 - RNA, 23 nt, Artificial Sequence
  RNA Oligomer
uucagcugaauuaagguugcaga

SEQ ID NO: 44802 - RNA, 23 nt, Artificial Sequence
  RNA Oligomer
cagcaaaugagagagcagcagag

SEQ ID NO: 44803 - RNA, 23 nt, Artificial Sequence
  RNA Oligomer
agcaaaugagagagcagcagaga

SEQ ID NO: 44804 - RNA, 23 nt, Artificial Sequence
  RNA Oligomer
gcaaaugagagagcagcagagau

SEQ ID NO: 44805 - RNA, 23 nt, Artificial Sequence
  RNA Oligomer
caaaugagagagcagcagagaug

SEQ ID NO: 44806 - RNA, 23 nt, Artificial Sequence
  RNA Oligomer
aaaugagagagcagcagagaugg

SEQ ID NO: 44807 - RNA, 23 nt, Artificial Sequence
  RNA Oligomer
uuucuucaugacgcucguguucc

SEQ ID NO: 44808 - RNA, 23 nt, Artificial Sequence
  RNA Oligomer
uucuucaugacgcucguguuccu

SEQ ID NO: 44809 - RNA, 23 nt, Artificial Sequence
  RNA Oligomer
ucuucaugacgcucguguuccuc

SEQ ID NO: 44810 - RNA, 23 nt, Artificial Sequence
  RNA Oligomer
cuucaugacgcucguguuccuca

SEQ ID NO: 44811 - RNA, 23 nt, Artificial Sequence
  RNA Oligomer
uucaugacgcucguguuccucau

SEQ ID NO: 44812 - RNA, 23 nt, Artificial Sequence
  RNA Oligomer
ccauuauugcugaagugcaguuc

SEQ ID NO: 44813 - RNA, 23 nt, Artificial Sequence
  RNA Oligomer
cauuauugcugaagugcaguucu

SEQ ID NO: 44814 - RNA, 23 nt, Artificial Sequence
  RNA Oligomer
auuauugcugaagugcaguucua

SEQ ID NO: 44815 - RNA, 23 nt, Artificial Sequence
  RNA Oligomer
uuauugcugaagugcaguucuac

SEQ ID NO: 44816 - RNA, 23 nt, Artificial Sequence
  RNA Oligomer
uauugcugaagugcaguucuacc

SEQ ID NO: 44817 - RNA, 23 nt, Artificial Sequence
  RNA Oligomer
guuucagaagcccuguugguauc

SEQ ID NO: 44818 - RNA, 23 nt, Artificial Sequence
  RNA Oligomer
uuucagaagcccuguugguaucu

SEQ ID NO: 44819 - RNA, 23 nt, Artificial Sequence
  RNA Oligomer
auucaccaaugcagagugauaaa

SEQ ID NO: 44820 - RNA, 23 nt, Artificial Sequence
  RNA Oligomer
aaugcaaaagcaagaagaguuua

SEQ ID NO: 44821 - RNA, 23 nt, Artificial Sequence
  RNA Oligomer
acagugagagcucuuggagcuac

SEQ ID NO: 44822 - RNA, 23 nt, Artificial Sequence
  RNA Oligomer
cagugagagcucuuggagcuacu

SEQ ID NO: 44823 - RNA, 23 nt, Artificial Sequence
  RNA Oligomer
agugagagcucuuggagcuacuc

SEQ ID NO: 44824 - RNA, 23 nt, Artificial Sequence
  RNA Oligomer
gugagagcucuuggagcuacucc

SEQ ID NO: 44825 - RNA, 23 nt, Artificial Sequence
  RNA Oligomer
ugagagcucuuggagcuacuccg

SEQ ID NO: 44826 - RNA, 23 nt, Artificial Sequence
  RNA Oligomer
uuaguguacgaacuguacagcug

SEQ ID NO: 44827 - RNA, 23 nt, Artificial Sequence
  RNA Oligomer
uaguguacgaacuguacagcuga

SEQ ID NO: 44828 - RNA, 23 nt, Artificial Sequence
  RNA Oligomer
acuuucuacaauagugugauaua

SEQ ID NO: 44829 - RNA, 23 nt, Artificial Sequence
  RNA Oligomer
ugaaauauaaaguacuucagcug

SEQ ID NO: 44830 - RNA, 23 nt, Artificial Sequence
  RNA Oligomer
cuucagcagaaaacugaucaucc

SEQ ID NO: 44831 - RNA, 23 nt, Artificial Sequence
  RNA Oligomer
uucagcagaaaacugaucaucca

SEQ ID NO: 44832 - RNA, 23 nt, Artificial Sequence
  RNA Oligomer
ucagcagaaaacugaucauccag

SEQ ID NO: 44833 - RNA, 23 nt, Artificial Sequence
  RNA Oligomer
cagcagaaaacugaucauccagg

SEQ ID NO: 44834 - RNA, 23 nt, Artificial Sequence
  RNA Oligomer
cacagugagagcucuuggagcua

SEQ ID NO: 44835 - RNA, 23 nt, Artificial Sequence
  RNA Oligomer
gaagaguuuaguguacgaacugu

SEQ ID NO: 44836 - RNA, 23 nt, Artificial Sequence
  RNA Oligomer
aagaguuuaguguacgaacugua

SEQ ID NO: 44837 - RNA, 23 nt, Artificial Sequence
  RNA Oligomer
uguacagcugaguuuguagcucu

SEQ ID NO: 44838 - RNA, 23 nt, Artificial Sequence
  RNA Oligomer
guacagcugaguuuguagcucua

SEQ ID NO: 44839 - RNA, 23 nt, Artificial Sequence
  RNA Oligomer
uacagcugaguuuguagcucuau

SEQ ID NO: 44840 - RNA, 23 nt, Artificial Sequence
  RNA Oligomer
acagcugaguuuguagcucuauc

SEQ ID NO: 44841 - RNA, 23 nt, Artificial Sequence
  RNA Oligomer
cagcugaguuuguagcucuaucu

SEQ ID NO: 44842 - RNA, 23 nt, Artificial Sequence
  RNA Oligomer
agcugaguuuguagcucuaucuu

SEQ ID NO: 44843 - RNA, 23 nt, Artificial Sequence
  RNA Oligomer
auaaaguacuucagcugaauuaa

SEQ ID NO: 44844 - RNA, 23 nt, Artificial Sequence
  RNA Oligomer
ucagcugaauuaagguugcagau

SEQ ID NO: 44845 - RNA, 23 nt, Artificial Sequence
  RNA Oligomer
uagaucaacaugauuuuaguguc

SEQ ID NO: 44846 - RNA, 23 nt, Artificial Sequence
  RNA Oligomer
cuaacagcucuucagugagcuau

SEQ ID NO: 44847 - RNA, 23 nt, Artificial Sequence
  RNA Oligomer
uaacagcucuucagugagcuaug

SEQ ID NO: 44848 - RNA, 23 nt, Artificial Sequence
  RNA Oligomer
cuucagugagcuauguugcaagc

SEQ ID NO: 44849 - RNA, 23 nt, Artificial Sequence
  RNA Oligomer
uucagugagcuauguugcaagcu

SEQ ID NO: 44850 - RNA, 23 nt, Artificial Sequence
  RNA Oligomer
ucagugagcuauguugcaagcuc

SEQ ID NO: 44851 - RNA, 23 nt, Artificial Sequence
  RNA Oligomer
cagugagcuauguugcaagcuca

SEQ ID NO: 44852 - RNA, 23 nt, Artificial Sequence
  RNA Oligomer
agugagcuauguugcaagcucag

SEQ ID NO: 44853 - RNA, 23 nt, Artificial Sequence
  RNA Oligomer
aaucugaguuuuucuucaagaug

SEQ ID NO: 44854 - RNA, 23 nt, Artificial Sequence
  RNA Oligomer
ugccuucagcagaaaacugauca

SEQ ID NO: 44855 - RNA, 23 nt, Artificial Sequence
  RNA Oligomer
gccuucagcagaaaacugaucau

SEQ ID NO: 44856 - RNA, 23 nt, Artificial Sequence
  RNA Oligomer
ccuucagcagaaaacugaucauc

SEQ ID NO: 44857 - RNA, 23 nt, Artificial Sequence
  RNA Oligomer
acuguacagcugaguuuguagcu

SEQ ID NO: 44858 - RNA, 23 nt, Artificial Sequence
  RNA Oligomer
cuguacagcugaguuuguagcuc

SEQ ID NO: 44859 - RNA, 23 nt, Artificial Sequence
  RNA Oligomer
auugcugaagugcaguucuaccc

SEQ ID NO: 44860 - RNA, 23 nt, Artificial Sequence
  RNA Oligomer
uugcugaagugcaguucuaccca

SEQ ID NO: 44861 - RNA, 23 nt, Artificial Sequence
  RNA Oligomer
cagagauggaaggaaaacuuuca

SEQ ID NO: 44862 - RNA, 23 nt, Artificial Sequence
  RNA Oligomer
ucaugacgcucguguuccucaug

SEQ ID NO: 44863 - RNA, 23 nt, Artificial Sequence
  RNA Oligomer
caugacgcucguguuccucaugc

SEQ ID NO: 44864 - RNA, 23 nt, Artificial Sequence
  RNA Oligomer
augacgcucguguuccucaugcu

SEQ ID NO: 44865 - RNA, 23 nt, Artificial Sequence
  RNA Oligomer
ucggguguuuaaagaggaacucc

SEQ ID NO: 44866 - RNA, 23 nt, Artificial Sequence
  RNA Oligomer
cggguguuuaaagaggaacuccu

SEQ ID NO: 44867 - RNA, 23 nt, Artificial Sequence
  RNA Oligomer
ggguguuuaaagaggaacuccuu

SEQ ID NO: 44868 - RNA, 23 nt, Artificial Sequence
  RNA Oligomer
gguguuuaaagaggaacuccuug

SEQ ID NO: 44869 - RNA, 23 nt, Artificial Sequence
  RNA Oligomer
ggagaggauuaaauucaccaaug

SEQ ID NO: 44870 - RNA, 23 nt, Artificial Sequence
  RNA Oligomer
aucaccuaauaaucggagacuua

SEQ ID NO: 44871 - RNA, 23 nt, Artificial Sequence
  RNA Oligomer
ucaucaaaaggugcugguggagg

SEQ ID NO: 44872 - RNA, 23 nt, Artificial Sequence
  RNA Oligomer
cucguguuccucaugcugagggu

SEQ ID NO: 44873 - RNA, 23 nt, Artificial Sequence
  RNA Oligomer
ucguguuccucaugcugagggug

SEQ ID NO: 44874 - RNA, 23 nt, Artificial Sequence
  RNA Oligomer
cguguuccucaugcugagggugg

SEQ ID NO: 44875 - RNA, 23 nt, Artificial Sequence
  RNA Oligomer
guguuccucaugcugaggguggc

SEQ ID NO: 44876 - RNA, 23 nt, Artificial Sequence
  RNA Oligomer
uguuccucaugcugaggguggcc

SEQ ID NO: 44877 - RNA, 23 nt, Artificial Sequence
  RNA Oligomer
caguagacauuaaucagucugac

SEQ ID NO: 44878 - RNA, 23 nt, Artificial Sequence
  RNA Oligomer
aguagacauuaaucagucugaca

SEQ ID NO: 44879 - RNA, 23 nt, Artificial Sequence
  RNA Oligomer
guagacauuaaucagucugacau

SEQ ID NO: 44880 - RNA, 23 nt, Artificial Sequence
  RNA Oligomer
uagacauuaaucagucugacaug

SEQ ID NO: 44881 - RNA, 23 nt, Artificial Sequence
  RNA Oligomer
uggaaggaaaacuuucagaaauu

SEQ ID NO: 44882 - RNA, 23 nt, Artificial Sequence
  RNA Oligomer
aaauagaaaccgaggcuggaacg

SEQ ID NO: 44883 - RNA, 23 nt, Artificial Sequence
  RNA Oligomer
ugcgcuucggguguuuaaagagg

SEQ ID NO: 44884 - RNA, 23 nt, Artificial Sequence
  RNA Oligomer
acugaucauccagggugaucacc

SEQ ID NO: 44885 - RNA, 23 nt, Artificial Sequence
  RNA Oligomer
cugaucauccagggugaucaccu

SEQ ID NO: 44886 - RNA, 23 nt, Artificial Sequence
  RNA Oligomer
ugaucauccagggugaucaccua

SEQ ID NO: 44887 - RNA, 23 nt, Artificial Sequence
  RNA Oligomer
ucaccuaauaaucggagacuuaa

SEQ ID NO: 44888 - RNA, 23 nt, Artificial Sequence
  RNA Oligomer
uaaaguacuucagcugaauuaag

SEQ ID NO: 44889 - RNA, 23 nt, Artificial Sequence
  RNA Oligomer
ggccagcaaaugagagagcagca

SEQ ID NO: 44890 - RNA, 23 nt, Artificial Sequence
  RNA Oligomer
gccagcaaaugagagagcagcag

SEQ ID NO: 44891 - RNA, 23 nt, Artificial Sequence
  RNA Oligomer
ccagcaaaugagagagcagcaga

SEQ ID NO: 44892 - RNA, 23 nt, Artificial Sequence
  RNA Oligomer
ucucuccaaugcuauggguaucu

SEQ ID NO: 44893 - RNA, 23 nt, Artificial Sequence
  RNA Oligomer
cucuccaaugcuauggguaucug

SEQ ID NO: 44894 - RNA, 23 nt, Artificial Sequence
  RNA Oligomer
ucuccaaugcuauggguaucugu

SEQ ID NO: 44895 - RNA, 23 nt, Artificial Sequence
  RNA Oligomer
cuccaaugcuauggguaucuguu

SEQ ID NO: 44896 - RNA, 23 nt, Artificial Sequence
  RNA Oligomer
uccaaugcuauggguaucuguuu

SEQ ID NO: 44897 - RNA, 23 nt, Artificial Sequence
  RNA Oligomer
cccauuauugcugaagugcaguu

SEQ ID NO: 44898 - RNA, 23 nt, Artificial Sequence
  RNA Oligomer
uguugguaucuuguggugucugc

SEQ ID NO: 44899 - RNA, 23 nt, Artificial Sequence
  RNA Oligomer
guugguaucuuguggugucugcg

SEQ ID NO: 44900 - RNA, 23 nt, Artificial Sequence
  RNA Oligomer
uugguaucuuguggugucugcga

SEQ ID NO: 44901 - RNA, 23 nt, Artificial Sequence
  RNA Oligomer
ugguaucuuguggugucugcgag

SEQ ID NO: 44902 - RNA, 23 nt, Artificial Sequence
  RNA Oligomer
gguaucuuguggugucugcgagc

SEQ ID NO: 44903 - RNA, 23 nt, Artificial Sequence
  RNA Oligomer
agauacugaguaggugccuucag

SEQ ID NO: 44904 - RNA, 23 nt, Artificial Sequence
  RNA Oligomer
gauacugaguaggugccuucagc

SEQ ID NO: 44905 - RNA, 23 nt, Artificial Sequence
  RNA Oligomer
auacugaguaggugccuucagca

SEQ ID NO: 44906 - RNA, 23 nt, Artificial Sequence
  RNA Oligomer
gaucauccagggugaucaccuaa

SEQ ID NO: 44907 - RNA, 23 nt, Artificial Sequence
  RNA Oligomer
aucauccagggugaucaccuaau

SEQ ID NO: 44908 - RNA, 23 nt, Artificial Sequence
  RNA Oligomer
cagcugaauuaagguugcagaua

SEQ ID NO: 44909 - RNA, 23 nt, Artificial Sequence
  RNA Oligomer
agcugaauuaagguugcagauaa

SEQ ID NO: 44910 - RNA, 23 nt, Artificial Sequence
  RNA Oligomer
aauagaaaccgaggcuggaacgc

SEQ ID NO: 44911 - RNA, 23 nt, Artificial Sequence
  RNA Oligomer
auagaaaccgaggcuggaacgcu

SEQ ID NO: 44912 - RNA, 23 nt, Artificial Sequence
  RNA Oligomer
uagaaaccgaggcuggaacgcug

SEQ ID NO: 44913 - RNA, 23 nt, Artificial Sequence
  RNA Oligomer
ucccauuauugcugaagugcagu

SEQ ID NO: 44914 - RNA, 23 nt, Artificial Sequence
  RNA Oligomer
guaucuuguggugucugcgagcg

SEQ ID NO: 44915 - RNA, 23 nt, Artificial Sequence
  RNA Oligomer
uaucuuguggugucugcgagcga

SEQ ID NO: 44916 - RNA, 23 nt, Artificial Sequence
  RNA Oligomer
aucuuguggugucugcgagcgag

SEQ ID NO: 44917 - RNA, 23 nt, Artificial Sequence
  RNA Oligomer
aggugccuucagcagaaaacuga

SEQ ID NO: 44918 - RNA, 23 nt, Artificial Sequence
  RNA Oligomer
ggugccuucagcagaaaacugau

SEQ ID NO: 44919 - RNA, 23 nt, Artificial Sequence
  RNA Oligomer
gugccuucagcagaaaacugauc

SEQ ID NO: 44920 - RNA, 23 nt, Artificial Sequence
  RNA Oligomer
gugagcuauguugcaagcucaga

SEQ ID NO: 44921 - RNA, 23 nt, Artificial Sequence
  RNA Oligomer
ugagcuauguugcaagcucagaa

SEQ ID NO: 44922 - RNA, 23 nt, Artificial Sequence
  RNA Oligomer
uggguaucuguuucagaagcccu

SEQ ID NO: 44923 - RNA, 23 nt, Artificial Sequence
  RNA Oligomer
ggguaucuguuucagaagcccug

SEQ ID NO: 44924 - RNA, 23 nt, Artificial Sequence
  RNA Oligomer
gguaucuguuucagaagcccugu

SEQ ID NO: 44925 - RNA, 23 nt, Artificial Sequence
  RNA Oligomer
guaucuguuucagaagcccuguu

SEQ ID NO: 44926 - RNA, 23 nt, Artificial Sequence
  RNA Oligomer
uacugaguaggugccuucagcag

SEQ ID NO: 44927 - RNA, 23 nt, Artificial Sequence
  RNA Oligomer
auggguaucuguuucagaagccc

SEQ ID NO: 44928 - RNA, 23 nt, Artificial Sequence
  RNA Oligomer
uccuuauaaugcaaaagcaagaa

SEQ ID NO: 44929 - RNA, 23 nt, Artificial Sequence
  RNA Oligomer
gccacaauauuuauuuuggacaa

SEQ ID NO: 44930 - RNA, 23 nt, Artificial Sequence
  RNA Oligomer
aacagcucuucagugagcuaugu

SEQ ID NO: 44931 - RNA, 23 nt, Artificial Sequence
  RNA Oligomer
uauggguaucuguuucagaagcc

SEQ ID NO: 44932 - RNA, 23 nt, Artificial Sequence
  RNA Oligomer
uccagcaguauuuuuuccauguc

SEQ ID NO: 44933 - RNA, 23 nt, Artificial Sequence
  RNA Oligomer
ccagcaguauuuuuuccaugucu

SEQ ID NO: 44934 - RNA, 23 nt, Artificial Sequence
  RNA Oligomer
cagcaguauuuuuuccaugucuc

SEQ ID NO: 44935 - RNA, 23 nt, Artificial Sequence
  RNA Oligomer
agcaguauuuuuuccaugucucc

SEQ ID NO: 44936 - RNA, 23 nt, Artificial Sequence
  RNA Oligomer
gcaguauuuuuuccaugucucca

SEQ ID NO: 44937 - RNA, 23 nt, Artificial Sequence
  RNA Oligomer
uccaugucuccauuauaaauaga

SEQ ID NO: 44938 - RNA, 23 nt, Artificial Sequence
  RNA Oligomer
aucccauauccaaucugaguuuu

SEQ ID NO: 44939 - RNA, 23 nt, Artificial Sequence
  RNA Oligomer
auccgauggccagcaaaugagag

SEQ ID NO: 44940 - RNA, 23 nt, Artificial Sequence
  RNA Oligomer
aacacacaucaugacuaguauau

SEQ ID NO: 44941 - RNA, 23 nt, Artificial Sequence
  RNA Oligomer
ucuuuccuucuuucaauaucauc

SEQ ID NO: 44942 - RNA, 23 nt, Artificial Sequence
  RNA Oligomer
ggagacuuaauuccuuauaaugc

SEQ ID NO: 44943 - RNA, 23 nt, Artificial Sequence
  RNA Oligomer
gcauuuacagaacaaauaaacac

SEQ ID NO: 44944 - RNA, 23 nt, Artificial Sequence
  RNA Oligomer
ugucuccauuauaaauagaaacc

SEQ ID NO: 44945 - RNA, 23 nt, Artificial Sequence
  RNA Oligomer
aaugagagagcagcagagaugga

SEQ ID NO: 44946 - RNA, 23 nt, Artificial Sequence
  RNA Oligomer
gacuccaguucuucaucaaaagg

SEQ ID NO: 44947 - RNA, 23 nt, Artificial Sequence
  RNA Oligomer
cucagacugugagcuguuuuucu

SEQ ID NO: 44948 - RNA, 23 nt, Artificial Sequence
  RNA Oligomer
ccagggugaucaccuaauaaucg

SEQ ID NO: 44949 - RNA, 23 nt, Artificial Sequence
  RNA Oligomer
uaggugccuucagcagaaaacug

SEQ ID NO: 44950 - RNA, 23 nt, Artificial Sequence
  RNA Oligomer
aaaggugcugguggagguuguca

SEQ ID NO: 44951 - RNA, 23 nt, Artificial Sequence
  RNA Oligomer
aaggaaaacuuucagaaauucug

SEQ ID NO: 44952 - RNA, 23 nt, Artificial Sequence
  RNA Oligomer
uuuuccggccgacuugaccaauc

SEQ ID NO: 44953 - RNA, 23 nt, Artificial Sequence
  RNA Oligomer
uucaccaaugcagagugauaaag

SEQ ID NO: 44954 - RNA, 23 nt, Artificial Sequence
  RNA Oligomer
cauagguguaauuauagaucaac

SEQ ID NO: 44955 - RNA, 23 nt, Artificial Sequence
  RNA Oligomer
gaaggaaaacuuucagaaauucu

SEQ ID NO: 44956 - RNA, 23 nt, Artificial Sequence
  RNA Oligomer
ucuguugauuaugaacaauuagc

SEQ ID NO: 44957 - RNA, 23 nt, Artificial Sequence
  RNA Oligomer
cuacaauagugugauauauaagg

SEQ ID NO: 44958 - RNA, 23 nt, Artificial Sequence
  RNA Oligomer
auguugcaagcucagaaguaauc

SEQ ID NO: 44959 - RNA, 23 nt, Artificial Sequence
  RNA Oligomer
gcagagauggaaggaaaacuuuc

SEQ ID NO: 44960 - RNA, 23 nt, Artificial Sequence
  RNA Oligomer
uucagaagcccuguugguaucuu

SEQ ID NO: 44961 - RNA, 23 nt, Artificial Sequence
  RNA Oligomer
cccauagguguaauuauagauca

SEQ ID NO: 44962 - RNA, 23 nt, Artificial Sequence
  RNA Oligomer
uacuccguccagacucaugcugu

SEQ ID NO: 44963 - RNA, 23 nt, Artificial Sequence
  RNA Oligomer
gguuuuaugcuucugaauuuuuc

SEQ ID NO: 44964 - RNA, 23 nt, Artificial Sequence
  RNA Oligomer
ucacucaggaaaucaacaaaagc

SEQ ID NO: 44965 - RNA, 23 nt, Artificial Sequence
  RNA Oligomer
caucauucuuuauaacuucaacc

SEQ ID NO: 44966 - RNA, 23 nt, Artificial Sequence
  RNA Oligomer
aucacucaggaaaucaacaaaag

SEQ ID NO: 44967 - RNA, 23 nt, Artificial Sequence
  RNA Oligomer
gugggaugcuguuguuaauguug

SEQ ID NO: 44968 - RNA, 23 nt, Artificial Sequence
  RNA Oligomer
cacucucagccucgucuucuugu

SEQ ID NO: 44969 - RNA, 23 nt, Artificial Sequence
  RNA Oligomer
ucugucugcucuacuggcucuug

SEQ ID NO: 44970 - RNA, 23 nt, Artificial Sequence
  RNA Oligomer
cugucugcucuacuggcucuuga

SEQ ID NO: 44971 - RNA, 23 nt, Artificial Sequence
  RNA Oligomer
uucgcuucugucccauucaguuc

SEQ ID NO: 44972 - RNA, 23 nt, Artificial Sequence
  RNA Oligomer
aauccauuagguggucauauaag

SEQ ID NO: 44973 - RNA, 23 nt, Artificial Sequence
  RNA Oligomer
aacgacugcgaacacgugcagau

SEQ ID NO: 44974 - RNA, 23 nt, Artificial Sequence
  RNA Oligomer
auguuggugggaugcuguuguua

SEQ ID NO: 44975 - RNA, 23 nt, Artificial Sequence
  RNA Oligomer
acacaagggccuucuugccauca

SEQ ID NO: 44976 - RNA, 23 nt, Artificial Sequence
  RNA Oligomer
aaauguuggugggaugcuguugu

SEQ ID NO: 44977 - RNA, 23 nt, Artificial Sequence
  RNA Oligomer
uaggaugauaaucauuucaaagc

SEQ ID NO: 44978 - RNA, 23 nt, Artificial Sequence
  RNA Oligomer
aaacgacugcgaacacgugcaga

SEQ ID NO: 44979 - RNA, 23 nt, Artificial Sequence
  RNA Oligomer
gguuccuccucaccaucaaaugu

SEQ ID NO: 44980 - RNA, 23 nt, Artificial Sequence
  RNA Oligomer
auucagacucgccaguggacuga

SEQ ID NO: 44981 - RNA, 23 nt, Artificial Sequence
  RNA Oligomer
aguccaacacaagggccuucuug

SEQ ID NO: 44982 - RNA, 23 nt, Artificial Sequence
  RNA Oligomer
gaggagauaaaccaauuuuaugu

SEQ ID NO: 44983 - RNA, 23 nt, Artificial Sequence
  RNA Oligomer
uggugggaugcuguuguuaaugu

SEQ ID NO: 44984 - RNA, 23 nt, Artificial Sequence
  RNA Oligomer
ggagauaaaccaauuuuaugucu

SEQ ID NO: 44985 - RNA, 23 nt, Artificial Sequence
  RNA Oligomer
gguuuuaugcuucugaauuuuuc

SEQ ID NO: 44986 - RNA, 23 nt, Artificial Sequence
  RNA Oligomer
ucacucaggaaaucaacaaaagc

SEQ ID NO: 44987 - RNA, 23 nt, Artificial Sequence
  RNA Oligomer
caucauucuuuauaacuucaacc

SEQ ID NO: 44988 - RNA, 23 nt, Artificial Sequence
  RNA Oligomer
aucacucaggaaaucaacaaaag

SEQ ID NO: 44989 - RNA, 23 nt, Artificial Sequence
  RNA Oligomer
cagaacacaacaaacuuaaagcc

SEQ ID NO: 44990 - RNA, 23 nt, Artificial Sequence
  RNA Oligomer
ucagaacacaacaaacuuaaagc

SEQ ID NO: 44991 - RNA, 23 nt, Artificial Sequence
  RNA Oligomer
cucagaacacaacaaacuuaaag

SEQ ID NO: 44992 - RNA, 23 nt, Artificial Sequence
  RNA Oligomer
acucagaacacaacaaacuuaaa

SEQ ID NO: 44993 - RNA, 23 nt, Artificial Sequence
  RNA Oligomer
gacucagaacacaacaaacuuaa

SEQ ID NO: 44994 - RNA, 23 nt, Artificial Sequence
  RNA Oligomer
ugacucagaacacaacaaacuua

SEQ ID NO: 44995 - RNA, 23 nt, Artificial Sequence
  RNA Oligomer
gaacacaacaaacuuaaagccag

SEQ ID NO: 44996 - RNA, 23 nt, Artificial Sequence
  RNA Oligomer
agaacacaacaaacuuaaagcca

SEQ ID NO: 44997 - RNA, 23 nt, Artificial Sequence
  RNA Oligomer
ggagauucuacauucacaguccu

SEQ ID NO: 44998 - RNA, 23 nt, Artificial Sequence
  RNA Oligomer
uggagauucuacauucacagucc

SEQ ID NO: 44999 - RNA, 23 nt, Artificial Sequence
  RNA Oligomer
uuggagauucuacauucacaguc

SEQ ID NO: 45000 - RNA, 23 nt, Artificial Sequence
  RNA Oligomer
auuggagauucuacauucacagu

SEQ ID NO: 45001 - RNA, 23 nt, Artificial Sequence
  RNA Oligomer
gauuggagauucuacauucacag

SEQ ID NO: 45002 - RNA, 23 nt, Artificial Sequence
  RNA Oligomer
ggaauaguaugcgcagcuuauga

SEQ ID NO: 45003 - RNA, 23 nt, Artificial Sequence
  RNA Oligomer
aggaauaguaugcgcagcuuaug

SEQ ID NO: 45004 - RNA, 23 nt, Artificial Sequence
  RNA Oligomer
aaggaauaguaugcgcagcuuau

SEQ ID NO: 45005 - RNA, 23 nt, Artificial Sequence
  RNA Oligomer
caaggaauaguaugcgcagcuua

SEQ ID NO: 45006 - RNA, 23 nt, Artificial Sequence
  RNA Oligomer
ucaaggaauaguaugcgcagcuu

SEQ ID NO: 45007 - RNA, 23 nt, Artificial Sequence
  RNA Oligomer
acaacaaacuuaaagccagucag

SEQ ID NO: 45008 - RNA, 23 nt, Artificial Sequence
  RNA Oligomer
cacaacaaacuuaaagccaguca

SEQ ID NO: 45009 - RNA, 23 nt, Artificial Sequence
  RNA Oligomer
acacaacaaacuuaaagccaguc

SEQ ID NO: 45010 - RNA, 23 nt, Artificial Sequence
  RNA Oligomer
aacacaacaaacuuaaagccagu

SEQ ID NO: 45011 - RNA, 23 nt, Artificial Sequence
  RNA Oligomer
cugacucagaacacaacaaacuu

SEQ ID NO: 45012 - RNA, 23 nt, Artificial Sequence
  RNA Oligomer
gcugacucagaacacaacaaacu

SEQ ID NO: 45013 - RNA, 23 nt, Artificial Sequence
  RNA Oligomer
agcugacucagaacacaacaaac

SEQ ID NO: 45014 - RNA, 23 nt, Artificial Sequence
  RNA Oligomer
cagcugacucagaacacaacaaa

SEQ ID NO: 45015 - RNA, 23 nt, Artificial Sequence
  RNA Oligomer
ccugaauucaugaagaaacugca

SEQ ID NO: 45016 - RNA, 23 nt, Artificial Sequence
  RNA Oligomer
uccugaauucaugaagaaacugc

SEQ ID NO: 45017 - RNA, 23 nt, Artificial Sequence
  RNA Oligomer
guccugaauucaugaagaaacug

SEQ ID NO: 45018 - RNA, 23 nt, Artificial Sequence
  RNA Oligomer
uguccugaauucaugaagaaacu

SEQ ID NO: 45019 - RNA, 23 nt, Artificial Sequence
  RNA Oligomer
auguccugaauucaugaagaaac

SEQ ID NO: 45020 - RNA, 23 nt, Artificial Sequence
  RNA Oligomer
ucaaugaugugucuucaauguca

SEQ ID NO: 45021 - RNA, 23 nt, Artificial Sequence
  RNA Oligomer
gucaaugaugugucuucaauguc

SEQ ID NO: 45022 - RNA, 23 nt, Artificial Sequence
  RNA Oligomer
ugucaaugaugugucuucaaugu

SEQ ID NO: 45023 - RNA, 23 nt, Artificial Sequence
  RNA Oligomer
cugucaaugaugugucuucaaug

SEQ ID NO: 45024 - RNA, 23 nt, Artificial Sequence
  RNA Oligomer
ucugucaaugaugugucuucaau

SEQ ID NO: 45025 - RNA, 23 nt, Artificial Sequence
  RNA Oligomer
accuaaauaugcuggauauagcu

SEQ ID NO: 45026 - RNA, 23 nt, Artificial Sequence
  RNA Oligomer
gaccuaaauaugcuggauauagc

SEQ ID NO: 45027 - RNA, 23 nt, Artificial Sequence
  RNA Oligomer
agaccuaaauaugcuggauauag

SEQ ID NO: 45028 - RNA, 23 nt, Artificial Sequence
  RNA Oligomer
cagaccuaaauaugcuggauaua

SEQ ID NO: 45029 - RNA, 23 nt, Artificial Sequence
  RNA Oligomer
acagaccuaaauaugcuggauau

SEQ ID NO: 45030 - RNA, 23 nt, Artificial Sequence
  RNA Oligomer
ggagcuagaucaugaaagaaugu

SEQ ID NO: 45031 - RNA, 23 nt, Artificial Sequence
  RNA Oligomer
uggagcuagaucaugaaagaaug

SEQ ID NO: 45032 - RNA, 23 nt, Artificial Sequence
  RNA Oligomer
auggagcuagaucaugaaagaau

SEQ ID NO: 45033 - RNA, 23 nt, Artificial Sequence
  RNA Oligomer
gauggagcuagaucaugaaagaa

SEQ ID NO: 45034 - RNA, 23 nt, Artificial Sequence
  RNA Oligomer
agauggagcuagaucaugaaaga

SEQ ID NO: 45035 - RNA, 23 nt, Artificial Sequence
  RNA Oligomer
acagaaaucccuagaagaauuuc

SEQ ID NO: 45036 - RNA, 23 nt, Artificial Sequence
  RNA Oligomer
cacagaaaucccuagaagaauuu

SEQ ID NO: 45037 - RNA, 23 nt, Artificial Sequence
  RNA Oligomer
ccacagaaaucccuagaagaauu

SEQ ID NO: 45038 - RNA, 23 nt, Artificial Sequence
  RNA Oligomer
accacagaaaucccuagaagaau

SEQ ID NO: 45039 - RNA, 23 nt, Artificial Sequence
  RNA Oligomer
caccacagaaaucccuagaagaa

SEQ ID NO: 45040 - RNA, 23 nt, Artificial Sequence
  RNA Oligomer
gcaaucaagaagcuaagccgacc

SEQ ID NO: 45041 - RNA, 23 nt, Artificial Sequence
  RNA Oligomer
ugcaaucaagaagcuaagccgac

SEQ ID NO: 45042 - RNA, 23 nt, Artificial Sequence
  RNA Oligomer
uugcaaucaagaagcuaagccga

SEQ ID NO: 45043 - RNA, 23 nt, Artificial Sequence
  RNA Oligomer
guugcaaucaagaagcuaagccg

SEQ ID NO: 45044 - RNA, 23 nt, Artificial Sequence
  RNA Oligomer
uguugcaaucaagaagcuaagcc

SEQ ID NO: 45045 - RNA, 23 nt, Artificial Sequence
  RNA Oligomer
cgguuagucauugauagaacuac

SEQ ID NO: 45046 - RNA, 23 nt, Artificial Sequence
  RNA Oligomer
ucgguuagucauugauagaacua

SEQ ID NO: 45047 - RNA, 23 nt, Artificial Sequence
  RNA Oligomer
gucgguuagucauugauagaacu

SEQ ID NO: 45048 - RNA, 23 nt, Artificial Sequence
  RNA Oligomer
agucgguuagucauugauagaac

SEQ ID NO: 45049 - RNA, 23 nt, Artificial Sequence
  RNA Oligomer
gagucgguuagucauugauagaa

SEQ ID NO: 45050 - RNA, 23 nt, Artificial Sequence
  RNA Oligomer
gcaucuaaaaggaucucuguaga

SEQ ID NO: 45051 - RNA, 23 nt, Artificial Sequence
  RNA Oligomer
ugcaucuaaaaggaucucuguag

SEQ ID NO: 45052 - RNA, 23 nt, Artificial Sequence
  RNA Oligomer
augcaucuaaaaggaucucugua

SEQ ID NO: 45053 - RNA, 23 nt, Artificial Sequence
  RNA Oligomer
gaugcaucuaaaaggaucucugu

SEQ ID NO: 45054 - RNA, 23 nt, Artificial Sequence
  RNA Oligomer
agaugcaucuaaaaggaucucug

SEQ ID NO: 45055 - RNA, 23 nt, Artificial Sequence
  RNA Oligomer
ggauauagcuuugagaaacucuu

SEQ ID NO: 45056 - RNA, 23 nt, Artificial Sequence
  RNA Oligomer
uggauauagcuuugagaaacucu

SEQ ID NO: 45057 - RNA, 23 nt, Artificial Sequence
  RNA Oligomer
cuggauauagcuuugagaaacuc

SEQ ID NO: 45058 - RNA, 23 nt, Artificial Sequence
  RNA Oligomer
gcuggauauagcuuugagaaacu

SEQ ID NO: 45059 - RNA, 23 nt, Artificial Sequence
  RNA Oligomer
ugcuggauauagcuuugagaaac

SEQ ID NO: 45060 - RNA, 23 nt, Artificial Sequence
  RNA Oligomer
aacagaccuaaauaugcuggaua

SEQ ID NO: 45061 - RNA, 23 nt, Artificial Sequence
  RNA Oligomer
cauguccugaauucaugaagaaa

SEQ ID NO: 45062 - RNA, 23 nt, Artificial Sequence
  RNA Oligomer
agauuggagauucuacauucaca

SEQ ID NO: 45063 - RNA, 23 nt, Artificial Sequence
  RNA Oligomer
gagauuggagauucuacauucac

SEQ ID NO: 45064 - RNA, 23 nt, Artificial Sequence
  RNA Oligomer
agagauuggagauucuacauuca

SEQ ID NO: 45065 - RNA, 23 nt, Artificial Sequence
  RNA Oligomer
uagagauuggagauucuacauuc

SEQ ID NO: 45066 - RNA, 23 nt, Artificial Sequence
  RNA Oligomer
guagagauuggagauucuacauu

SEQ ID NO: 45067 - RNA, 23 nt, Artificial Sequence
  RNA Oligomer
gaauuauucaucgggacuuaaag

SEQ ID NO: 45068 - RNA, 23 nt, Artificial Sequence
  RNA Oligomer
ggaauuauucaucgggacuuaaa

SEQ ID NO: 45069 - RNA, 23 nt, Artificial Sequence
  RNA Oligomer
uggaauuauucaucgggacuuaa

SEQ ID NO: 45070 - RNA, 23 nt, Artificial Sequence
  RNA Oligomer
cuggaauuauucaucgggacuua

SEQ ID NO: 45071 - RNA, 23 nt, Artificial Sequence
  RNA Oligomer
gcuggaauuauucaucgggacuu

SEQ ID NO: 45072 - RNA, 23 nt, Artificial Sequence
  RNA Oligomer
gcucauggaugcaaaucuuugcc

SEQ ID NO: 45073 - RNA, 23 nt, Artificial Sequence
  RNA Oligomer
agcucauggaugcaaaucuuugc

SEQ ID NO: 45074 - RNA, 23 nt, Artificial Sequence
  RNA Oligomer
gagcucauggaugcaaaucuuug

SEQ ID NO: 45075 - RNA, 23 nt, Artificial Sequence
  RNA Oligomer
ggagcucauggaugcaaaucuuu

SEQ ID NO: 45076 - RNA, 23 nt, Artificial Sequence
  RNA Oligomer
uggagcucauggaugcaaaucuu

SEQ ID NO: 45077 - RNA, 23 nt, Artificial Sequence
  RNA Oligomer
ucacaccacagaaaucccuagaa

SEQ ID NO: 45078 - RNA, 23 nt, Artificial Sequence
  RNA Oligomer
uucacaccacagaaaucccuaga

SEQ ID NO: 45079 - RNA, 23 nt, Artificial Sequence
  RNA Oligomer
uuucacaccacagaaaucccuag

SEQ ID NO: 45080 - RNA, 23 nt, Artificial Sequence
  RNA Oligomer
uuuucacaccacagaaaucccua

SEQ ID NO: 45081 - RNA, 23 nt, Artificial Sequence
  RNA Oligomer
guuuucacaccacagaaaucccu

SEQ ID NO: 45082 - RNA, 23 nt, Artificial Sequence
  RNA Oligomer
ggagcucaaggaauaguaugcgc

SEQ ID NO: 45083 - RNA, 23 nt, Artificial Sequence
  RNA Oligomer
aggagcucaaggaauaguaugcg

SEQ ID NO: 45084 - RNA, 23 nt, Artificial Sequence
  RNA Oligomer
caggagcucaaggaauaguaugc

SEQ ID NO: 45085 - RNA, 23 nt, Artificial Sequence
  RNA Oligomer
ucaggagcucaaggaauaguaug

SEQ ID NO: 45086 - RNA, 23 nt, Artificial Sequence
  RNA Oligomer
cucaggagcucaaggaauaguau

SEQ ID NO: 45087 - RNA, 23 nt, Artificial Sequence
  RNA Oligomer
guacaucaaugucugguaugauc

SEQ ID NO: 45088 - RNA, 23 nt, Artificial Sequence
  RNA Oligomer
cguacaucaaugucugguaugau

SEQ ID NO: 45089 - RNA, 23 nt, Artificial Sequence
  RNA Oligomer
ccguacaucaaugucugguauga

SEQ ID NO: 45090 - RNA, 23 nt, Artificial Sequence
  RNA Oligomer
cccguacaucaaugucugguaug

SEQ ID NO: 45091 - RNA, 23 nt, Artificial Sequence
  RNA Oligomer
acccguacaucaaugucugguau

SEQ ID NO: 45092 - RNA, 23 nt, Artificial Sequence
  RNA Oligomer
ccagcugacucagaacacaacaa

SEQ ID NO: 45093 - RNA, 23 nt, Artificial Sequence
  RNA Oligomer
aaacagaccuaaauaugcuggau

SEQ ID NO: 45094 - RNA, 23 nt, Artificial Sequence
  RNA Oligomer
gcccaguaauauaguaguaaaau

SEQ ID NO: 45095 - RNA, 23 nt, Artificial Sequence
  RNA Oligomer
agcccaguaauauaguaguaaaa

SEQ ID NO: 45096 - RNA, 23 nt, Artificial Sequence
  RNA Oligomer
aagcccaguaauauaguaguaaa

SEQ ID NO: 45097 - RNA, 23 nt, Artificial Sequence
  RNA Oligomer
aaagcccaguaauauaguaguaa

SEQ ID NO: 45098 - RNA, 23 nt, Artificial Sequence
  RNA Oligomer
uaaagcccaguaauauaguagua

SEQ ID NO: 45099 - RNA, 23 nt, Artificial Sequence
  RNA Oligomer
agcuagaucaugaaagaaugucc

SEQ ID NO: 45100 - RNA, 23 nt, Artificial Sequence
  RNA Oligomer
gagcuagaucaugaaagaauguc

SEQ ID NO: 45101 - RNA, 23 nt, Artificial Sequence
  RNA Oligomer
gucuuauuuuugggugauuuuuc

SEQ ID NO: 45102 - RNA, 23 nt, Artificial Sequence
  RNA Oligomer
ggucuuauuuuugggugauuuuu

SEQ ID NO: 45103 - RNA, 23 nt, Artificial Sequence
  RNA Oligomer
uggucuuauuuuugggugauuuu

SEQ ID NO: 45104 - RNA, 23 nt, Artificial Sequence
  RNA Oligomer
guggucuuauuuuugggugauuu

SEQ ID NO: 45105 - RNA, 23 nt, Artificial Sequence
  RNA Oligomer
aguggucuuauuuuugggugauu

SEQ ID NO: 45106 - RNA, 23 nt, Artificial Sequence
  RNA Oligomer
caguggucuuauuuuugggugau

SEQ ID NO: 45107 - RNA, 23 nt, Artificial Sequence
  RNA Oligomer
acaauucaguggucuuauuuuug

SEQ ID NO: 45108 - RNA, 23 nt, Artificial Sequence
  RNA Oligomer
aacaauucaguggucuuauuuuu

SEQ ID NO: 45109 - RNA, 23 nt, Artificial Sequence
  RNA Oligomer
aaacaauucaguggucuuauuuu

SEQ ID NO: 45110 - RNA, 23 nt, Artificial Sequence
  RNA Oligomer
aaaacaauucaguggucuuauuu

SEQ ID NO: 45111 - RNA, 23 nt, Artificial Sequence
  RNA Oligomer
gaaaacaauucaguggucuuauu

SEQ ID NO: 45112 - RNA, 23 nt, Artificial Sequence
  RNA Oligomer
gggcugcuguagaugacuacuug

SEQ ID NO: 45113 - RNA, 23 nt, Artificial Sequence
  RNA Oligomer
cugggcugcuguagaugacuacu

SEQ ID NO: 45114 - RNA, 23 nt, Artificial Sequence
  RNA Oligomer
cucugggcugcuguagaugacua

SEQ ID NO: 45115 - RNA, 23 nt, Artificial Sequence
  RNA Oligomer
agaguggaaagaauugauauaua

SEQ ID NO: 45116 - RNA, 23 nt, Artificial Sequence
  RNA Oligomer
aagaguggaaagaauugauauau

SEQ ID NO: 45117 - RNA, 23 nt, Artificial Sequence
  RNA Oligomer
gaagaguggaaagaauugauaua

SEQ ID NO: 45118 - RNA, 23 nt, Artificial Sequence
  RNA Oligomer
agaagaguggaaagaauugauau

SEQ ID NO: 45119 - RNA, 23 nt, Artificial Sequence
  RNA Oligomer
uagaagaguggaaagaauugaua

SEQ ID NO: 45120 - RNA, 23 nt, Artificial Sequence
  RNA Oligomer
gcucaggagcucaaggaauagua

SEQ ID NO: 45121 - RNA, 23 nt, Artificial Sequence
  RNA Oligomer
gcaguuagaugaaagggaacaca

SEQ ID NO: 45122 - RNA, 23 nt, Artificial Sequence
  RNA Oligomer
agcaguuagaugaaagggaacac

SEQ ID NO: 45123 - RNA, 23 nt, Artificial Sequence
  RNA Oligomer
aagcaguuagaugaaagggaaca

SEQ ID NO: 45124 - RNA, 23 nt, Artificial Sequence
  RNA Oligomer
caagcaguuagaugaaagggaac

SEQ ID NO: 45125 - RNA, 23 nt, Artificial Sequence
  RNA Oligomer
acaagcaguuagaugaaagggaa

SEQ ID NO: 45126 - RNA, 23 nt, Artificial Sequence
  RNA Oligomer
ggcucaggagcucaaggaauagu

SEQ ID NO: 45127 - RNA, 23 nt, Artificial Sequence
  RNA Oligomer
aggcucaggagcucaaggaauag

SEQ ID NO: 45128 - RNA, 23 nt, Artificial Sequence
  RNA Oligomer
uaggcucaggagcucaaggaaua

SEQ ID NO: 45129 - RNA, 23 nt, Artificial Sequence
  RNA Oligomer
cacccguacaucaaugucuggua

SEQ ID NO: 45130 - RNA, 23 nt, Artificial Sequence
  RNA Oligomer
ccaacacccguacaucaaugucu

SEQ ID NO: 45131 - RNA, 23 nt, Artificial Sequence
  RNA Oligomer
uccaacacccguacaucaauguc

SEQ ID NO: 45132 - RNA, 23 nt, Artificial Sequence
  RNA Oligomer
cuccaacacccguacaucaaugu

SEQ ID NO: 45133 - RNA, 23 nt, Artificial Sequence
  RNA Oligomer
ucuccaacacccguacaucaaug

SEQ ID NO: 45134 - RNA, 23 nt, Artificial Sequence
  RNA Oligomer
cucuccaacacccguacaucaau

SEQ ID NO: 45135 - RNA, 23 nt, Artificial Sequence
  RNA Oligomer
caccauguccugaauucaugaag

SEQ ID NO: 45136 - RNA, 23 nt, Artificial Sequence
  RNA Oligomer
acaccauguccugaauucaugaa

SEQ ID NO: 45137 - RNA, 23 nt, Artificial Sequence
  RNA Oligomer
aacaccauguccugaauucauga

SEQ ID NO: 45138 - RNA, 23 nt, Artificial Sequence
  RNA Oligomer
gaacaccauguccugaauucaug

SEQ ID NO: 45139 - RNA, 23 nt, Artificial Sequence
  RNA Oligomer
ggaacaccauguccugaauucau

SEQ ID NO: 45140 - RNA, 23 nt, Artificial Sequence
  RNA Oligomer
agauucuacauucacaguccuga

SEQ ID NO: 45141 - RNA, 23 nt, Artificial Sequence
  RNA Oligomer
gagauucuacauucacaguccug

SEQ ID NO: 45142 - RNA, 23 nt, Artificial Sequence
  RNA Oligomer
cccaguaauauaguaguaaaauc

SEQ ID NO: 45143 - RNA, 23 nt, Artificial Sequence
  RNA Oligomer
gcaccuucauucugcuggaauua

SEQ ID NO: 45144 - RNA, 23 nt, Artificial Sequence
  RNA Oligomer
agcaccuucauucugcuggaauu

SEQ ID NO: 45145 - RNA, 23 nt, Artificial Sequence
  RNA Oligomer
aagcaccuucauucugcuggaau

SEQ ID NO: 45146 - RNA, 23 nt, Artificial Sequence
  RNA Oligomer
caagcaccuucauucugcuggaa

SEQ ID NO: 45147 - RNA, 23 nt, Artificial Sequence
  RNA Oligomer
ucaagcaccuucauucugcugga

SEQ ID NO: 45148 - RNA, 23 nt, Artificial Sequence
  RNA Oligomer
gcaagcgugacaacaauuuuuau

SEQ ID NO: 45149 - RNA, 23 nt, Artificial Sequence
  RNA Oligomer
agcaagcgugacaacaauuuuua

SEQ ID NO: 45150 - RNA, 23 nt, Artificial Sequence
  RNA Oligomer
aagcaagcgugacaacaauuuuu

SEQ ID NO: 45151 - RNA, 23 nt, Artificial Sequence
  RNA Oligomer
gaagcaagcgugacaacaauuuu

SEQ ID NO: 45152 - RNA, 23 nt, Artificial Sequence
  RNA Oligomer
agaagcaagcgugacaacaauuu

SEQ ID NO: 45153 - RNA, 23 nt, Artificial Sequence
  RNA Oligomer
agagcuaguucuuaugaaaugug

SEQ ID NO: 45154 - RNA, 23 nt, Artificial Sequence
  RNA Oligomer
gagagcuaguucuuaugaaaugu

SEQ ID NO: 45155 - RNA, 23 nt, Artificial Sequence
  RNA Oligomer
agagagcuaguucuuaugaaaug

SEQ ID NO: 45156 - RNA, 23 nt, Artificial Sequence
  RNA Oligomer
cagagagcuaguucuuaugaaau

SEQ ID NO: 45157 - RNA, 23 nt, Artificial Sequence
  RNA Oligomer
acagagagcuaguucuuaugaaa

SEQ ID NO: 45158 - RNA, 23 nt, Artificial Sequence
  RNA Oligomer
caagaagcuaagccgaccauuuc

SEQ ID NO: 45159 - RNA, 23 nt, Artificial Sequence
  RNA Oligomer
ucaagaagcuaagccgaccauuu

SEQ ID NO: 45160 - RNA, 23 nt, Artificial Sequence
  RNA Oligomer
aucaagaagcuaagccgaccauu

SEQ ID NO: 45161 - RNA, 23 nt, Artificial Sequence
  RNA Oligomer
aaucaagaagcuaagccgaccau

SEQ ID NO: 45162 - RNA, 23 nt, Artificial Sequence
  RNA Oligomer
caaucaagaagcuaagccgacca

SEQ ID NO: 45163 - RNA, 23 nt, Artificial Sequence
  RNA Oligomer
gucugucaaugaugugucuucaa

SEQ ID NO: 45164 - RNA, 23 nt, Artificial Sequence
  RNA Oligomer
ggaacacacaauagaagagugga

SEQ ID NO: 45165 - RNA, 23 nt, Artificial Sequence
  RNA Oligomer
gggaacacacaauagaagagugg

SEQ ID NO: 45166 - RNA, 23 nt, Artificial Sequence
  RNA Oligomer
agggaacacacaauagaagagug

SEQ ID NO: 45167 - RNA, 23 nt, Artificial Sequence
  RNA Oligomer
aagggaacacacaauagaagagu

SEQ ID NO: 45168 - RNA, 23 nt, Artificial Sequence
  RNA Oligomer
aaagggaacacacaauagaagag

SEQ ID NO: 45169 - RNA, 23 nt, Artificial Sequence
  RNA Oligomer
ccagucaggcaagggauuuguua

SEQ ID NO: 45170 - RNA, 23 nt, Artificial Sequence
  RNA Oligomer
gccagucaggcaagggauuuguu

SEQ ID NO: 45171 - RNA, 23 nt, Artificial Sequence
  RNA Oligomer
agccagucaggcaagggauuugu

SEQ ID NO: 45172 - RNA, 23 nt, Artificial Sequence
  RNA Oligomer
aagccagucaggcaagggauuug

SEQ ID NO: 45173 - RNA, 23 nt, Artificial Sequence
  RNA Oligomer
aaagccagucaggcaagggauuu

SEQ ID NO: 45174 - RNA, 23 nt, Artificial Sequence
  RNA Oligomer
cccagcugacucagaacacaaca

SEQ ID NO: 45175 - RNA, 23 nt, Artificial Sequence
  RNA Oligomer
ucccagcugacucagaacacaac

SEQ ID NO: 45176 - RNA, 23 nt, Artificial Sequence
  RNA Oligomer
uucccagcugacucagaacacaa

SEQ ID NO: 45177 - RNA, 23 nt, Artificial Sequence
  RNA Oligomer
uuucccagcugacucagaacaca

SEQ ID NO: 45178 - RNA, 23 nt, Artificial Sequence
  RNA Oligomer
ggaacgaguuuuaugaugacgcc

SEQ ID NO: 45179 - RNA, 23 nt, Artificial Sequence
  RNA Oligomer
aggaacgaguuuuaugaugacgc

SEQ ID NO: 45180 - RNA, 23 nt, Artificial Sequence
  RNA Oligomer
caggaacgaguuuuaugaugacg

SEQ ID NO: 45181 - RNA, 23 nt, Artificial Sequence
  RNA Oligomer
gcaggaacgaguuuuaugaugac

SEQ ID NO: 45182 - RNA, 23 nt, Artificial Sequence
  RNA Oligomer
ugcaggaacgaguuuuaugauga

SEQ ID NO: 45183 - RNA, 23 nt, Artificial Sequence
  RNA Oligomer
guaaaaucugauugcacuuugaa

SEQ ID NO: 45184 - RNA, 23 nt, Artificial Sequence
  RNA Oligomer
aguaaaaucugauugcacuuuga

SEQ ID NO: 45185 - RNA, 23 nt, Artificial Sequence
  RNA Oligomer
uaguaaaaucugauugcacuuug

SEQ ID NO: 45186 - RNA, 23 nt, Artificial Sequence
  RNA Oligomer
guaguaaaaucugauugcacuuu

SEQ ID NO: 45187 - RNA, 23 nt, Artificial Sequence
  RNA Oligomer
aguaguaaaaucugauugcacuu

SEQ ID NO: 45188 - RNA, 23 nt, Artificial Sequence
  RNA Oligomer
uaguaguaaaaucugauugcacu

SEQ ID NO: 45189 - RNA, 23 nt, Artificial Sequence
  RNA Oligomer
auaguaguaaaaucugauugcac

SEQ ID NO: 45190 - RNA, 23 nt, Artificial Sequence
  RNA Oligomer
uauaguaguaaaaucugauugca

SEQ ID NO: 45191 - RNA, 23 nt, Artificial Sequence
  RNA Oligomer
ggaaucaagcaccuucauucugc

SEQ ID NO: 45192 - RNA, 23 nt, Artificial Sequence
  RNA Oligomer
uggaaucaagcaccuucauucug

SEQ ID NO: 45193 - RNA, 23 nt, Artificial Sequence
  RNA Oligomer
guggaaucaagcaccuucauucu

SEQ ID NO: 45194 - RNA, 23 nt, Artificial Sequence
  RNA Oligomer
uguggaaucaagcaccuucauuc

SEQ ID NO: 45195 - RNA, 23 nt, Artificial Sequence
  RNA Oligomer
guguggaaucaagcaccuucauu

SEQ ID NO: 45196 - RNA, 23 nt, Artificial Sequence
  RNA Oligomer
uacagagagcuaguucuuaugaa

SEQ ID NO: 45197 - RNA, 23 nt, Artificial Sequence
  RNA Oligomer
ccauuucagaaucagacucaugc

SEQ ID NO: 45198 - RNA, 23 nt, Artificial Sequence
  RNA Oligomer
accauuucagaaucagacucaug

SEQ ID NO: 45199 - RNA, 23 nt, Artificial Sequence
  RNA Oligomer
gaccauuucagaaucagacucau

SEQ ID NO: 45200 - RNA, 23 nt, Artificial Sequence
  RNA Oligomer
cgaccauuucagaaucagacuca

SEQ ID NO: 45201 - RNA, 23 nt, Artificial Sequence
  RNA Oligomer
ccgaccauuucagaaucagacuc

SEQ ID NO: 45202 - RNA, 23 nt, Artificial Sequence
  RNA Oligomer
acaguccugaaacgauaucagaa

SEQ ID NO: 45203 - RNA, 23 nt, Artificial Sequence
  RNA Oligomer
cacaguccugaaacgauaucaga

SEQ ID NO: 45204 - RNA, 23 nt, Artificial Sequence
  RNA Oligomer
ucacaguccugaaacgauaucag

SEQ ID NO: 45205 - RNA, 23 nt, Artificial Sequence
  RNA Oligomer
uucacaguccugaaacgauauca

SEQ ID NO: 45206 - RNA, 23 nt, Artificial Sequence
  RNA Oligomer
auucacaguccugaaacgauauc

SEQ ID NO: 45207 - RNA, 23 nt, Artificial Sequence
  RNA Oligomer
ccuaaauaugcuggauauagcuu

SEQ ID NO: 45208 - RNA, 23 nt, Artificial Sequence
  RNA Oligomer
guugaaaacagaccuaaauaugc

SEQ ID NO: 45209 - RNA, 23 nt, Artificial Sequence
  RNA Oligomer
cguugaaaacagaccuaaauaug

SEQ ID NO: 45210 - RNA, 23 nt, Artificial Sequence
  RNA Oligomer
acguugaaaacagaccuaaauau

SEQ ID NO: 45211 - RNA, 23 nt, Artificial Sequence
  RNA Oligomer
uacguugaaaacagaccuaaaua

SEQ ID NO: 45212 - RNA, 23 nt, Artificial Sequence
  RNA Oligomer
uuacguugaaaacagaccuaaau

SEQ ID NO: 45213 - RNA, 23 nt, Artificial Sequence
  RNA Oligomer
ugaagaaacugcaaccaacagua

SEQ ID NO: 45214 - RNA, 23 nt, Artificial Sequence
  RNA Oligomer
augaagaaacugcaaccaacagu

SEQ ID NO: 45215 - RNA, 23 nt, Artificial Sequence
  RNA Oligomer
caugaagaaacugcaaccaacag

SEQ ID NO: 45216 - RNA, 23 nt, Artificial Sequence
  RNA Oligomer
ucaugaagaaacugcaaccaaca

SEQ ID NO: 45217 - RNA, 23 nt, Artificial Sequence
  RNA Oligomer
uucaugaagaaacugcaaccaac

SEQ ID NO: 45218 - RNA, 23 nt, Artificial Sequence
  RNA Oligomer
gcaugggcuacaaggaaaacgug

SEQ ID NO: 45219 - RNA, 23 nt, Artificial Sequence
  RNA Oligomer
ggcaugggcuacaaggaaaacgu

SEQ ID NO: 45220 - RNA, 23 nt, Artificial Sequence
  RNA Oligomer
uggcaugggcuacaaggaaaacg

SEQ ID NO: 45221 - RNA, 23 nt, Artificial Sequence
  RNA Oligomer
uuggcaugggcuacaaggaaaac

SEQ ID NO: 45222 - RNA, 23 nt, Artificial Sequence
  RNA Oligomer
cuuggcaugggcuacaaggaaaa

SEQ ID NO: 45223 - RNA, 23 nt, Artificial Sequence
  RNA Oligomer
ugcuggaauuauucaucgggacu

SEQ ID NO: 45224 - RNA, 23 nt, Artificial Sequence
  RNA Oligomer
caccuucauucugcuggaauuau

SEQ ID NO: 45225 - RNA, 23 nt, Artificial Sequence
  RNA Oligomer
gcuagaucaugaaagaauguccu

SEQ ID NO: 45226 - RNA, 23 nt, Artificial Sequence
  RNA Oligomer
gaagcuaagccgaccauuucaga

SEQ ID NO: 45227 - RNA, 23 nt, Artificial Sequence
  RNA Oligomer
agaagcuaagccgaccauuucag

SEQ ID NO: 45228 - RNA, 23 nt, Artificial Sequence
  RNA Oligomer
aagaagcuaagccgaccauuuca

SEQ ID NO: 45229 - RNA, 23 nt, Artificial Sequence
  RNA Oligomer
gguuagucauugauagaacuacu

SEQ ID NO: 45230 - RNA, 23 nt, Artificial Sequence
  RNA Oligomer
ggagucgguuagucauugauaga

SEQ ID NO: 45231 - RNA, 23 nt, Artificial Sequence
  RNA Oligomer
gggagucgguuagucauugauag

SEQ ID NO: 45232 - RNA, 23 nt, Artificial Sequence
  RNA Oligomer
ggggagucgguuagucauugaua

SEQ ID NO: 45233 - RNA, 23 nt, Artificial Sequence
  RNA Oligomer
uggggagucgguuagucauugau

SEQ ID NO: 45234 - RNA, 23 nt, Artificial Sequence
  RNA Oligomer
auggggagucgguuagucauuga

SEQ ID NO: 45235 - RNA, 23 nt, Artificial Sequence
  RNA Oligomer
cgucugucaaugaugugucuuca

SEQ ID NO: 45236 - RNA, 23 nt, Artificial Sequence
  RNA Oligomer
ucgucugucaaugaugugucuuc

SEQ ID NO: 45237 - RNA, 23 nt, Artificial Sequence
  RNA Oligomer
auagaagaguggaaagaauugau

SEQ ID NO: 45238 - RNA, 23 nt, Artificial Sequence
  RNA Oligomer
aauagaagaguggaaagaauuga

SEQ ID NO: 45239 - RNA, 23 nt, Artificial Sequence
  RNA Oligomer
caauagaagaguggaaagaauug

SEQ ID NO: 45240 - RNA, 23 nt, Artificial Sequence
  RNA Oligomer
acaauagaagaguggaaagaauu

SEQ ID NO: 45241 - RNA, 23 nt, Artificial Sequence
  RNA Oligomer
cacaauagaagaguggaaagaau

SEQ ID NO: 45242 - RNA, 23 nt, Artificial Sequence
  RNA Oligomer
ugaaagggaacacacaauagaag

SEQ ID NO: 45243 - RNA, 23 nt, Artificial Sequence
  RNA Oligomer
augaaagggaacacacaauagaa

SEQ ID NO: 45244 - RNA, 23 nt, Artificial Sequence
  RNA Oligomer
gaugaaagggaacacacaauaga

SEQ ID NO: 45245 - RNA, 23 nt, Artificial Sequence
  RNA Oligomer
agaugaaagggaacacacaauag

SEQ ID NO: 45246 - RNA, 23 nt, Artificial Sequence
  RNA Oligomer
uagaugaaagggaacacacaaua

SEQ ID NO: 45247 - RNA, 23 nt, Artificial Sequence
  RNA Oligomer
gcucuccaacacccguacaucaa

SEQ ID NO: 45248 - RNA, 23 nt, Artificial Sequence
  RNA Oligomer
agcucuccaacacccguacauca

SEQ ID NO: 45249 - RNA, 23 nt, Artificial Sequence
  RNA Oligomer
aagcucuccaacacccguacauc

SEQ ID NO: 45250 - RNA, 23 nt, Artificial Sequence
  RNA Oligomer
gaagcucuccaacacccguacau

SEQ ID NO: 45251 - RNA, 23 nt, Artificial Sequence
  RNA Oligomer
cuaaaaggaucucuguagaugaa

SEQ ID NO: 45252 - RNA, 23 nt, Artificial Sequence
  RNA Oligomer
ucuaaaaggaucucuguagauga

SEQ ID NO: 45253 - RNA, 23 nt, Artificial Sequence
  RNA Oligomer
aucuaaaaggaucucuguagaug

SEQ ID NO: 45254 - RNA, 23 nt, Artificial Sequence
  RNA Oligomer
caucuaaaaggaucucuguagau

SEQ ID NO: 45255 - RNA, 23 nt, Artificial Sequence
  RNA Oligomer
uagaugcaucuaaaaggaucucu

SEQ ID NO: 45256 - RNA, 23 nt, Artificial Sequence
  RNA Oligomer
augcuggauauagcuuugagaaa

SEQ ID NO: 45257 - RNA, 23 nt, Artificial Sequence
  RNA Oligomer
guuuuaugaugacgccuuaugua

SEQ ID NO: 45258 - RNA, 23 nt, Artificial Sequence
  RNA Oligomer
aguuuuaugaugacgccuuaugu

SEQ ID NO: 45259 - RNA, 23 nt, Artificial Sequence
  RNA Oligomer
gaguuuuaugaugacgccuuaug

SEQ ID NO: 45260 - RNA, 23 nt, Artificial Sequence
  RNA Oligomer
cgaguuuuaugaugacgccuuau

SEQ ID NO: 45261 - RNA, 23 nt, Artificial Sequence
  RNA Oligomer
acgaguuuuaugaugacgccuua

SEQ ID NO: 45262 - RNA, 23 nt, Artificial Sequence
  RNA Oligomer
aacgaguuuuaugaugacgccuu

SEQ ID NO: 45263 - RNA, 23 nt, Artificial Sequence
  RNA Oligomer
gaacgaguuuuaugaugacgccu

SEQ ID NO: 45264 - RNA, 23 nt, Artificial Sequence
  RNA Oligomer
uguagagauuggagauucuacau

SEQ ID NO: 45265 - RNA, 23 nt, Artificial Sequence
  RNA Oligomer
cugcaggaacgaguuuuaugaug

SEQ ID NO: 45266 - RNA, 23 nt, Artificial Sequence
  RNA Oligomer
acugcaggaacgaguuuuaugau

SEQ ID NO: 45267 - RNA, 23 nt, Artificial Sequence
  RNA Oligomer
gacugcaggaacgaguuuuauga

SEQ ID NO: 45268 - RNA, 23 nt, Artificial Sequence
  RNA Oligomer
guguagagauuggagauucuaca

SEQ ID NO: 45269 - RNA, 23 nt, Artificial Sequence
  RNA Oligomer
gcacuuugaagauucuugacuuc

SEQ ID NO: 45270 - RNA, 23 nt, Artificial Sequence
  RNA Oligomer
ugcacuuugaagauucuugacuu

SEQ ID NO: 45271 - RNA, 23 nt, Artificial Sequence
  RNA Oligomer
uugcacuuugaagauucuugacu

SEQ ID NO: 45272 - RNA, 23 nt, Artificial Sequence
  RNA Oligomer
auugcacuuugaagauucuugac

SEQ ID NO: 45273 - RNA, 23 nt, Artificial Sequence
  RNA Oligomer
gauugcacuuugaagauucuuga

SEQ ID NO: 45274 - RNA, 23 nt, Artificial Sequence
  RNA Oligomer
ugauugcacuuugaagauucuug

SEQ ID NO: 45275 - RNA, 23 nt, Artificial Sequence
  RNA Oligomer
cugauugcacuuugaagauucuu

SEQ ID NO: 45276 - RNA, 23 nt, Artificial Sequence
  RNA Oligomer
ucugauugcacuuugaagauucu

SEQ ID NO: 45277 - RNA, 23 nt, Artificial Sequence
  RNA Oligomer
aucugauugcacuuugaagauuc

SEQ ID NO: 45278 - RNA, 23 nt, Artificial Sequence
  RNA Oligomer
aaucugauugcacuuugaagauu

SEQ ID NO: 45279 - RNA, 23 nt, Artificial Sequence
  RNA Oligomer
agcgugacaacaauuuuuauagu

SEQ ID NO: 45280 - RNA, 23 nt, Artificial Sequence
  RNA Oligomer
aagcgugacaacaauuuuuauag

SEQ ID NO: 45281 - RNA, 23 nt, Artificial Sequence
  RNA Oligomer
caagcgugacaacaauuuuuaua

SEQ ID NO: 45282 - RNA, 23 nt, Artificial Sequence
  RNA Oligomer
cuaguucuuaugaaauguguuaa

SEQ ID NO: 45283 - RNA, 23 nt, Artificial Sequence
  RNA Oligomer
gcuaguucuuaugaaauguguua

SEQ ID NO: 45284 - RNA, 23 nt, Artificial Sequence
  RNA Oligomer
agcuaguucuuaugaaauguguu

SEQ ID NO: 45285 - RNA, 23 nt, Artificial Sequence
  RNA Oligomer
gagcuaguucuuaugaaaugugu

SEQ ID NO: 45286 - RNA, 23 nt, Artificial Sequence
  RNA Oligomer
ugaaagaaauguugcaaucaaga

SEQ ID NO: 45287 - RNA, 23 nt, Artificial Sequence
  RNA Oligomer
uugaaagaaauguugcaaucaag

SEQ ID NO: 45288 - RNA, 23 nt, Artificial Sequence
  RNA Oligomer
cuugaaagaaauguugcaaucaa

SEQ ID NO: 45289 - RNA, 23 nt, Artificial Sequence
  RNA Oligomer
ucuugaaagaaauguugcaauca

SEQ ID NO: 45290 - RNA, 23 nt, Artificial Sequence
  RNA Oligomer
uucuugaaagaaauguugcaauc

SEQ ID NO: 45291 - RNA, 23 nt, Artificial Sequence
  RNA Oligomer
gucauugauagaacuacuuugaa

SEQ ID NO: 45292 - RNA, 23 nt, Artificial Sequence
  RNA Oligomer
agucauugauagaacuacuuuga

SEQ ID NO: 45293 - RNA, 23 nt, Artificial Sequence
  RNA Oligomer
uagucauugauagaacuacuuug

SEQ ID NO: 45294 - RNA, 23 nt, Artificial Sequence
  RNA Oligomer
uuagucauugauagaacuacuuu

SEQ ID NO: 45295 - RNA, 23 nt, Artificial Sequence
  RNA Oligomer
guuagucauugauagaacuacuu

SEQ ID NO: 45296 - RNA, 23 nt, Artificial Sequence
  RNA Oligomer
gaauaguaugcgcagcuuaugau

SEQ ID NO: 45297 - RNA, 23 nt, Artificial Sequence
  RNA Oligomer
ugaugugucuucaaugucaacag

SEQ ID NO: 45298 - RNA, 23 nt, Artificial Sequence
  RNA Oligomer
augaugugucuucaaugucaaca

SEQ ID NO: 45299 - RNA, 23 nt, Artificial Sequence
  RNA Oligomer
aaugaugugucuucaaugucaac

SEQ ID NO: 45300 - RNA, 23 nt, Artificial Sequence
  RNA Oligomer
caaugaugugucuucaaugucaa

SEQ ID NO: 45301 - RNA, 23 nt, Artificial Sequence
  RNA Oligomer
cucaaggaauaguaugcgcagcu

SEQ ID NO: 45302 - RNA, 23 nt, Artificial Sequence
  RNA Oligomer
gcucaaggaauaguaugcgcagc

SEQ ID NO: 45303 - RNA, 23 nt, Artificial Sequence
  RNA Oligomer
agcucaaggaauaguaugcgcag

SEQ ID NO: 45304 - RNA, 23 nt, Artificial Sequence
  RNA Oligomer
gagcucaaggaauaguaugcgca

SEQ ID NO: 45305 - RNA, 23 nt, Artificial Sequence
  RNA Oligomer
gcagcagugaucaauggcucuca

SEQ ID NO: 45306 - RNA, 23 nt, Artificial Sequence
  RNA Oligomer
ugcagcagugaucaauggcucuc

SEQ ID NO: 45307 - RNA, 23 nt, Artificial Sequence
  RNA Oligomer
gugcagcagugaucaauggcucu

SEQ ID NO: 45308 - RNA, 23 nt, Artificial Sequence
  RNA Oligomer
ggugcagcagugaucaauggcuc

SEQ ID NO: 45309 - RNA, 23 nt, Artificial Sequence
  RNA Oligomer
aggugcagcagugaucaauggcu

SEQ ID NO: 45310 - RNA, 23 nt, Artificial Sequence
  RNA Oligomer
gaguggaaagaauugauauauaa

SEQ ID NO: 45311 - RNA, 23 nt, Artificial Sequence
  RNA Oligomer
acacaauagaagaguggaaagaa

SEQ ID NO: 45312 - RNA, 23 nt, Artificial Sequence
  RNA Oligomer
cacacaauagaagaguggaaaga

SEQ ID NO: 45313 - RNA, 23 nt, Artificial Sequence
  RNA Oligomer
gaacacacaauagaagaguggaa

SEQ ID NO: 45314 - RNA, 23 nt, Artificial Sequence
  RNA Oligomer
gcugguaauagaugcaucuaaaa

SEQ ID NO: 45315 - RNA, 23 nt, Artificial Sequence
  RNA Oligomer
ugcugguaauagaugcaucuaaa

SEQ ID NO: 45316 - RNA, 23 nt, Artificial Sequence
  RNA Oligomer
augcugguaauagaugcaucuaa

SEQ ID NO: 45317 - RNA, 23 nt, Artificial Sequence
  RNA Oligomer
aaugcugguaauagaugcaucua

SEQ ID NO: 45318 - RNA, 23 nt, Artificial Sequence
  RNA Oligomer
aaaugcugguaauagaugcaucu

SEQ ID NO: 45319 - RNA, 23 nt, Artificial Sequence
  RNA Oligomer
cauucacaguccugaaacgauau

SEQ ID NO: 45320 - RNA, 23 nt, Artificial Sequence
  RNA Oligomer
cuuacguugaaaacagaccuaaa

SEQ ID NO: 45321 - RNA, 23 nt, Artificial Sequence
  RNA Oligomer
ccuuggcaugggcuacaaggaaa

SEQ ID NO: 45322 - RNA, 23 nt, Artificial Sequence
  RNA Oligomer
aaaucugauugcacuuugaagau

SEQ ID NO: 45323 - RNA, 23 nt, Artificial Sequence
  RNA Oligomer
aaaaucugauugcacuuugaaga

SEQ ID NO: 45324 - RNA, 23 nt, Artificial Sequence
  RNA Oligomer
uaaaaucugauugcacuuugaag

SEQ ID NO: 45325 - RNA, 23 nt, Artificial Sequence
  RNA Oligomer
cugcuggaauuauucaucgggac

SEQ ID NO: 45326 - RNA, 23 nt, Artificial Sequence
  RNA Oligomer
ucugcuggaauuauucaucggga

SEQ ID NO: 45327 - RNA, 23 nt, Artificial Sequence
  RNA Oligomer
guccuaccuucucuaucagaugc

SEQ ID NO: 45328 - RNA, 23 nt, Artificial Sequence
  RNA Oligomer
uguccuaccuucucuaucagaug

SEQ ID NO: 45329 - RNA, 23 nt, Artificial Sequence
  RNA Oligomer
auguccuaccuucucuaucagau

SEQ ID NO: 45330 - RNA, 23 nt, Artificial Sequence
  RNA Oligomer
aauguccuaccuucucuaucaga

SEQ ID NO: 45331 - RNA, 23 nt, Artificial Sequence
  RNA Oligomer
gaauguccuaccuucucuaucag

SEQ ID NO: 45332 - RNA, 23 nt, Artificial Sequence
  RNA Oligomer
gcgugacaacaauuuuuauagug

SEQ ID NO: 45333 - RNA, 23 nt, Artificial Sequence
  RNA Oligomer
ucaugaaagaauguccuaccuuc

SEQ ID NO: 45334 - RNA, 23 nt, Artificial Sequence
  RNA Oligomer
aucaugaaagaauguccuaccuu

SEQ ID NO: 45335 - RNA, 23 nt, Artificial Sequence
  RNA Oligomer
gaucaugaaagaauguccuaccu

SEQ ID NO: 45336 - RNA, 23 nt, Artificial Sequence
  RNA Oligomer
agaucaugaaagaauguccuacc

SEQ ID NO: 45337 - RNA, 23 nt, Artificial Sequence
  RNA Oligomer
uagaucaugaaagaauguccuac

SEQ ID NO: 45338 - RNA, 23 nt, Artificial Sequence
  RNA Oligomer
cuagaucaugaaagaauguccua

SEQ ID NO: 45339 - RNA, 23 nt, Artificial Sequence
  RNA Oligomer
cagaagcaagcgugacaacaauu

SEQ ID NO: 45340 - RNA, 23 nt, Artificial Sequence
  RNA Oligomer
gcagaagcaagcgugacaacaau

SEQ ID NO: 45341 - RNA, 23 nt, Artificial Sequence
  RNA Oligomer
agcagaagcaagcgugacaacaa

SEQ ID NO: 45342 - RNA, 23 nt, Artificial Sequence
  RNA Oligomer
cuagaagaauuucaagauguuua

SEQ ID NO: 45343 - RNA, 23 nt, Artificial Sequence
  RNA Oligomer
ccuagaagaauuucaagauguuu

SEQ ID NO: 45344 - RNA, 23 nt, Artificial Sequence
  RNA Oligomer
cccuagaagaauuucaagauguu

SEQ ID NO: 45345 - RNA, 23 nt, Artificial Sequence
  RNA Oligomer
ucccuagaagaauuucaagaugu

SEQ ID NO: 45346 - RNA, 23 nt, Artificial Sequence
  RNA Oligomer
aucccuagaagaauuucaagaug

SEQ ID NO: 45347 - RNA, 23 nt, Artificial Sequence
  RNA Oligomer
ucaguggucuuauuuuuggguga

SEQ ID NO: 45348 - RNA, 23 nt, Artificial Sequence
  RNA Oligomer
caauucaguggucuuauuuuugg

SEQ ID NO: 45349 - RNA, 23 nt, Artificial Sequence
  RNA Oligomer
gucuucaaugucaacagauccga

SEQ ID NO: 45350 - RNA, 23 nt, Artificial Sequence
  RNA Oligomer
ugucuucaaugucaacagauccg

SEQ ID NO: 45351 - RNA, 23 nt, Artificial Sequence
  RNA Oligomer
gugucuucaaugucaacagaucc

SEQ ID NO: 45352 - RNA, 23 nt, Artificial Sequence
  RNA Oligomer
ugugucuucaaugucaacagauc

SEQ ID NO: 45353 - RNA, 23 nt, Artificial Sequence
  RNA Oligomer
augugucuucaaugucaacagau

SEQ ID NO: 45354 - RNA, 23 nt, Artificial Sequence
  RNA Oligomer
gaugugucuucaaugucaacaga

SEQ ID NO: 45355 - RNA, 23 nt, Artificial Sequence
  RNA Oligomer
gucgucugucaaugaugugucuu

SEQ ID NO: 45356 - RNA, 23 nt, Artificial Sequence
  RNA Oligomer
cgucgucugucaaugaugugucu

SEQ ID NO: 45357 - RNA, 23 nt, Artificial Sequence
  RNA Oligomer
ucgucgucugucaaugauguguc

SEQ ID NO: 45358 - RNA, 23 nt, Artificial Sequence
  RNA Oligomer
acacccguacaucaaugucuggu

SEQ ID NO: 45359 - RNA, 23 nt, Artificial Sequence
  RNA Oligomer
aacacccguacaucaaugucugg

SEQ ID NO: 45360 - RNA, 23 nt, Artificial Sequence
  RNA Oligomer
caacacccguacaucaaugucug

SEQ ID NO: 45361 - RNA, 23 nt, Artificial Sequence
  RNA Oligomer
auagaugcaucuaaaaggaucuc

SEQ ID NO: 45362 - RNA, 23 nt, Artificial Sequence
  RNA Oligomer
aauagaugcaucuaaaaggaucu

SEQ ID NO: 45363 - RNA, 23 nt, Artificial Sequence
  RNA Oligomer
uaauagaugcaucuaaaaggauc

SEQ ID NO: 45364 - RNA, 23 nt, Artificial Sequence
  RNA Oligomer
caguccugaaacgauaucagaau

SEQ ID NO: 45365 - RNA, 23 nt, Artificial Sequence
  RNA Oligomer
uaugcuggauauagcuuugagaa

SEQ ID NO: 45366 - RNA, 23 nt, Artificial Sequence
  RNA Oligomer
aaaacagaccuaaauaugcugga

SEQ ID NO: 45367 - RNA, 23 nt, Artificial Sequence
  RNA Oligomer
aguguagagauuggagauucuac

SEQ ID NO: 45368 - RNA, 23 nt, Artificial Sequence
  RNA Oligomer
uaguguagagauuggagauucua

SEQ ID NO: 45369 - RNA, 23 nt, Artificial Sequence
  RNA Oligomer
auaguguagagauuggagauucu

SEQ ID NO: 45370 - RNA, 23 nt, Artificial Sequence
  RNA Oligomer
uauaguguagagauuggagauuc

SEQ ID NO: 45371 - RNA, 23 nt, Artificial Sequence
  RNA Oligomer
uuauaguguagagauuggagauu

SEQ ID NO: 45372 - RNA, 23 nt, Artificial Sequence
  RNA Oligomer
accuucauucugcuggaauuauu

SEQ ID NO: 45373 - RNA, 23 nt, Artificial Sequence
  RNA Oligomer
cagauggagcuagaucaugaaag

SEQ ID NO: 45374 - RNA, 23 nt, Artificial Sequence
  RNA Oligomer
acauagucauggagcucauggau

SEQ ID NO: 45375 - RNA, 23 nt, Artificial Sequence
  RNA Oligomer
uacauagucauggagcucaugga

SEQ ID NO: 45376 - RNA, 23 nt, Artificial Sequence
  RNA Oligomer
uuacauagucauggagcucaugg

SEQ ID NO: 45377 - RNA, 23 nt, Artificial Sequence
  RNA Oligomer
uuuacauagucauggagcucaug

SEQ ID NO: 45378 - RNA, 23 nt, Artificial Sequence
  RNA Oligomer
guuuacauagucauggagcucau

SEQ ID NO: 45379 - RNA, 23 nt, Artificial Sequence
  RNA Oligomer
uuggccuuuugaauguuuucaca

SEQ ID NO: 45380 - RNA, 23 nt, Artificial Sequence
  RNA Oligomer
auuggccuuuugaauguuuucac

SEQ ID NO: 45381 - RNA, 23 nt, Artificial Sequence
  RNA Oligomer
aauuggccuuuugaauguuuuca

SEQ ID NO: 45382 - RNA, 23 nt, Artificial Sequence
  RNA Oligomer
uaauuggccuuuugaauguuuuc

SEQ ID NO: 45383 - RNA, 23 nt, Artificial Sequence
  RNA Oligomer
auaauuggccuuuugaauguuuu

SEQ ID NO: 45384 - RNA, 23 nt, Artificial Sequence
  RNA Oligomer
gccgaccauuucagaaucagacu

SEQ ID NO: 45385 - RNA, 23 nt, Artificial Sequence
  RNA Oligomer
agccgaccauuucagaaucagac

SEQ ID NO: 45386 - RNA, 23 nt, Artificial Sequence
  RNA Oligomer
ugaugccauucuugaaagaaaug

SEQ ID NO: 45387 - RNA, 23 nt, Artificial Sequence
  RNA Oligomer
augaugccauucuugaaagaaau

SEQ ID NO: 45388 - RNA, 23 nt, Artificial Sequence
  RNA Oligomer
uaugaugccauucuugaaagaaa

SEQ ID NO: 45389 - RNA, 23 nt, Artificial Sequence
  RNA Oligomer
uuaugaugccauucuugaaagaa

SEQ ID NO: 45390 - RNA, 23 nt, Artificial Sequence
  RNA Oligomer
cuuaugaugccauucuugaaaga

SEQ ID NO: 45391 - RNA, 23 nt, Artificial Sequence
  RNA Oligomer
uucaguggucuuauuuuugggug

SEQ ID NO: 45392 - RNA, 23 nt, Artificial Sequence
  RNA Oligomer
ugaaaacaauucaguggucuuau

SEQ ID NO: 45393 - RNA, 23 nt, Artificial Sequence
  RNA Oligomer
uugaaaacaauucaguggucuua

SEQ ID NO: 45394 - RNA, 23 nt, Artificial Sequence
  RNA Oligomer
uuugaaaacaauucaguggucuu

SEQ ID NO: 45395 - RNA, 23 nt, Artificial Sequence
  RNA Oligomer
cuuugaaaacaauucaguggucu

SEQ ID NO: 45396 - RNA, 23 nt, Artificial Sequence
  RNA Oligomer
aucgucgucugucaaugaugugu

SEQ ID NO: 45397 - RNA, 23 nt, Artificial Sequence
  RNA Oligomer
caucgucgucugucaaugaugug

SEQ ID NO: 45398 - RNA, 23 nt, Artificial Sequence
  RNA Oligomer
ucaucgucgucugucaaugaugu

SEQ ID NO: 45399 - RNA, 23 nt, Artificial Sequence
  RNA Oligomer
ucaucaucgucgucugucaauga

SEQ ID NO: 45400 - RNA, 23 nt, Artificial Sequence
  RNA Oligomer
aucaucaucgucgucugucaaug

SEQ ID NO: 45401 - RNA, 23 nt, Artificial Sequence
  RNA Oligomer
caucaucaucgucgucugucaau

SEQ ID NO: 45402 - RNA, 23 nt, Artificial Sequence
  RNA Oligomer
ccaucaucaucgucgucugucaa

SEQ ID NO: 45403 - RNA, 23 nt, Artificial Sequence
  RNA Oligomer
uccaucaucaucgucgucuguca

SEQ ID NO: 45404 - RNA, 23 nt, Artificial Sequence
  RNA Oligomer
cagcauccaucaucaucgucguc

SEQ ID NO: 45405 - RNA, 23 nt, Artificial Sequence
  RNA Oligomer
ucagcauccaucaucaucgucgu

SEQ ID NO: 45406 - RNA, 23 nt, Artificial Sequence
  RNA Oligomer
cucagcauccaucaucaucgucg

SEQ ID NO: 45407 - RNA, 23 nt, Artificial Sequence
  RNA Oligomer
ucucagcauccaucaucaucguc

SEQ ID NO: 45408 - RNA, 23 nt, Artificial Sequence
  RNA Oligomer
cucucagcauccaucaucaucgu

SEQ ID NO: 45409 - RNA, 23 nt, Artificial Sequence
  RNA Oligomer
gcagugaucaauggcucucagca

SEQ ID NO: 45410 - RNA, 23 nt, Artificial Sequence
  RNA Oligomer
agcagugaucaauggcucucagc

SEQ ID NO: 45411 - RNA, 23 nt, Artificial Sequence
  RNA Oligomer
cagcagugaucaauggcucucag

SEQ ID NO: 45412 - RNA, 23 nt, Artificial Sequence
  RNA Oligomer
gaaagggaacacacaauagaaga

SEQ ID NO: 45413 - RNA, 23 nt, Artificial Sequence
  RNA Oligomer
caaaaugcugguaauagaugcau

SEQ ID NO: 45414 - RNA, 23 nt, Artificial Sequence
  RNA Oligomer
ccaaaaugcugguaauagaugca

SEQ ID NO: 45415 - RNA, 23 nt, Artificial Sequence
  RNA Oligomer
uccaaaaugcugguaauagaugc

SEQ ID NO: 45416 - RNA, 23 nt, Artificial Sequence
  RNA Oligomer
auccaaaaugcugguaauagaug

SEQ ID NO: 45417 - RNA, 23 nt, Artificial Sequence
  RNA Oligomer
uauccaaaaugcugguaauagau

SEQ ID NO: 45418 - RNA, 23 nt, Artificial Sequence
  RNA Oligomer
aggcaagggauuuguuauccaaa

SEQ ID NO: 45419 - RNA, 23 nt, Artificial Sequence
  RNA Oligomer
caggcaagggauuuguuauccaa

SEQ ID NO: 45420 - RNA, 23 nt, Artificial Sequence
  RNA Oligomer
ucaggcaagggauuuguuaucca

SEQ ID NO: 45421 - RNA, 23 nt, Artificial Sequence
  RNA Oligomer
gucaggcaagggauuuguuaucc

SEQ ID NO: 45422 - RNA, 23 nt, Artificial Sequence
  RNA Oligomer
agucaggcaagggauuuguuauc

SEQ ID NO: 45423 - RNA, 23 nt, Artificial Sequence
  RNA Oligomer
cagucaggcaagggauuuguuau

SEQ ID NO: 45424 - RNA, 23 nt, Artificial Sequence
  RNA Oligomer
guaaggacuuacguugaaaacag

SEQ ID NO: 45425 - RNA, 23 nt, Artificial Sequence
  RNA Oligomer
aguaaggacuuacguugaaaaca

SEQ ID NO: 45426 - RNA, 23 nt, Artificial Sequence
  RNA Oligomer
caguaaggacuuacguugaaaac

SEQ ID NO: 45427 - RNA, 23 nt, Artificial Sequence
  RNA Oligomer
acaguaaggacuuacguugaaaa

SEQ ID NO: 45428 - RNA, 23 nt, Artificial Sequence
  RNA Oligomer
aacaguaaggacuuacguugaaa

SEQ ID NO: 45429 - RNA, 23 nt, Artificial Sequence
  RNA Oligomer
cuuugaagauucuugacuucggu

SEQ ID NO: 45430 - RNA, 23 nt, Artificial Sequence
  RNA Oligomer
acuuugaagauucuugacuucgg

SEQ ID NO: 45431 - RNA, 23 nt, Artificial Sequence
  RNA Oligomer
cacuuugaagauucuugacuucg

SEQ ID NO: 45432 - RNA, 23 nt, Artificial Sequence
  RNA Oligomer
gaaagaaauguugcaaucaagaa

SEQ ID NO: 45433 - RNA, 23 nt, Artificial Sequence
  RNA Oligomer
auucaguggucuuauuuuugggu

SEQ ID NO: 45434 - RNA, 23 nt, Artificial Sequence
  RNA Oligomer
aauucaguggucuuauuuuuggg

SEQ ID NO: 45435 - RNA, 23 nt, Artificial Sequence
  RNA Oligomer
gauggggagucgguuagucauug

SEQ ID NO: 45436 - RNA, 23 nt, Artificial Sequence
  RNA Oligomer
gcauccaucaucaucgucgucug

SEQ ID NO: 45437 - RNA, 23 nt, Artificial Sequence
  RNA Oligomer
agcauccaucaucaucgucgucu

SEQ ID NO: 45438 - RNA, 23 nt, Artificial Sequence
  RNA Oligomer
uaggugcagcagugaucaauggc

SEQ ID NO: 45439 - RNA, 23 nt, Artificial Sequence
  RNA Oligomer
uuaggugcagcagugaucaaugg

SEQ ID NO: 45440 - RNA, 23 nt, Artificial Sequence
  RNA Oligomer
uuuaggugcagcagugaucaaug

SEQ ID NO: 45441 - RNA, 23 nt, Artificial Sequence
  RNA Oligomer
cuuuaggugcagcagugaucaau

SEQ ID NO: 45442 - RNA, 23 nt, Artificial Sequence
  RNA Oligomer
gacaagcaguuagaugaaaggga

SEQ ID NO: 45443 - RNA, 23 nt, Artificial Sequence
  RNA Oligomer
ugacaagcaguuagaugaaaggg

SEQ ID NO: 45444 - RNA, 23 nt, Artificial Sequence
  RNA Oligomer
cugacaagcaguuagaugaaagg

SEQ ID NO: 45445 - RNA, 23 nt, Artificial Sequence
  RNA Oligomer
ccugacaagcaguuagaugaaag

SEQ ID NO: 45446 - RNA, 23 nt, Artificial Sequence
  RNA Oligomer
cccugacaagcaguuagaugaaa

SEQ ID NO: 45447 - RNA, 23 nt, Artificial Sequence
  RNA Oligomer
guaugauccuucugaagcagaag

SEQ ID NO: 45448 - RNA, 23 nt, Artificial Sequence
  RNA Oligomer
gguaugauccuucugaagcagaa

SEQ ID NO: 45449 - RNA, 23 nt, Artificial Sequence
  RNA Oligomer
ugguaugauccuucugaagcaga

SEQ ID NO: 45450 - RNA, 23 nt, Artificial Sequence
  RNA Oligomer
cugguaugauccuucugaagcag

SEQ ID NO: 45451 - RNA, 23 nt, Artificial Sequence
  RNA Oligomer
ucugguaugauccuucugaagca

SEQ ID NO: 45452 - RNA, 23 nt, Artificial Sequence
  RNA Oligomer
cuaaauaugcuggauauagcuuu

SEQ ID NO: 45453 - RNA, 23 nt, Artificial Sequence
  RNA Oligomer
cugaauucaugaagaaacugcaa

SEQ ID NO: 45454 - RNA, 23 nt, Artificial Sequence
  RNA Oligomer
cuuauguagugacucgcuacuac

SEQ ID NO: 45455 - RNA, 23 nt, Artificial Sequence
  RNA Oligomer
ccuuauguagugacucgcuacua

SEQ ID NO: 45456 - RNA, 23 nt, Artificial Sequence
  RNA Oligomer
gccuuauguagugacucgcuacu

SEQ ID NO: 45457 - RNA, 23 nt, Artificial Sequence
  RNA Oligomer
cgccuuauguagugacucgcuac

SEQ ID NO: 45458 - RNA, 23 nt, Artificial Sequence
  RNA Oligomer
acgccuuauguagugacucgcua

SEQ ID NO: 45459 - RNA, 23 nt, Artificial Sequence
  RNA Oligomer
ggacugcaggaacgaguuuuaug

SEQ ID NO: 45460 - RNA, 23 nt, Artificial Sequence
  RNA Oligomer
aggacugcaggaacgaguuuuau

SEQ ID NO: 45461 - RNA, 23 nt, Artificial Sequence
  RNA Oligomer
agaauguccuaccuucucuauca

SEQ ID NO: 45462 - RNA, 23 nt, Artificial Sequence
  RNA Oligomer
ucagauggagcuagaucaugaaa

SEQ ID NO: 45463 - RNA, 23 nt, Artificial Sequence
  RNA Oligomer
uucagauggagcuagaucaugaa

SEQ ID NO: 45464 - RNA, 23 nt, Artificial Sequence
  RNA Oligomer
auucagauggagcuagaucauga

SEQ ID NO: 45465 - RNA, 23 nt, Artificial Sequence
  RNA Oligomer
gcucucagcauccaucaucaucg

SEQ ID NO: 45466 - RNA, 23 nt, Artificial Sequence
  RNA Oligomer
ggcucucagcauccaucaucauc

SEQ ID NO: 45467 - RNA, 23 nt, Artificial Sequence
  RNA Oligomer
uggcucucagcauccaucaucau

SEQ ID NO: 45468 - RNA, 23 nt, Artificial Sequence
  RNA Oligomer
auggcucucagcauccaucauca

SEQ ID NO: 45469 - RNA, 23 nt, Artificial Sequence
  RNA Oligomer
aauggcucucagcauccaucauc

SEQ ID NO: 45470 - RNA, 23 nt, Artificial Sequence
  RNA Oligomer
aggaaguuauggacuuggaggag

SEQ ID NO: 45471 - RNA, 23 nt, Artificial Sequence
  RNA Oligomer
aaggaaguuauggacuuggagga

SEQ ID NO: 45472 - RNA, 23 nt, Artificial Sequence
  RNA Oligomer
uaaggaaguuauggacuuggagg

SEQ ID NO: 45473 - RNA, 23 nt, Artificial Sequence
  RNA Oligomer
auaaggaaguuauggacuuggag

SEQ ID NO: 45474 - RNA, 23 nt, Artificial Sequence
  RNA Oligomer
uauaaggaaguuauggacuugga

SEQ ID NO: 45475 - RNA, 23 nt, Artificial Sequence
  RNA Oligomer
auauaaggaaguuauggacuugg

SEQ ID NO: 45476 - RNA, 23 nt, Artificial Sequence
  RNA Oligomer
uauauaaggaaguuauggacuug

SEQ ID NO: 45477 - RNA, 23 nt, Artificial Sequence
  RNA Oligomer
auauauaaggaaguuauggacuu

SEQ ID NO: 45478 - RNA, 23 nt, Artificial Sequence
  RNA Oligomer
uuagaugaaagggaacacacaau

SEQ ID NO: 45479 - RNA, 23 nt, Artificial Sequence
  RNA Oligomer
uaaggacuuacguugaaaacaga

SEQ ID NO: 45480 - RNA, 23 nt, Artificial Sequence
  RNA Oligomer
ugggcuacaaggaaaacguggau

SEQ ID NO: 45481 - RNA, 23 nt, Artificial Sequence
  RNA Oligomer
augggcuacaaggaaaacgugga

SEQ ID NO: 45482 - RNA, 23 nt, Artificial Sequence
  RNA Oligomer
caugggcuacaaggaaaacgugg

SEQ ID NO: 45483 - RNA, 23 nt, Artificial Sequence
  RNA Oligomer
gacgccuuauguagugacucgcu

SEQ ID NO: 45484 - RNA, 23 nt, Artificial Sequence
  RNA Oligomer
ugacgccuuauguagugacucgc

SEQ ID NO: 45485 - RNA, 23 nt, Artificial Sequence
  RNA Oligomer
uuaaagcccaguaauauaguagu

SEQ ID NO: 45486 - RNA, 23 nt, Artificial Sequence
  RNA Oligomer
cuuaaagcccaguaauauaguag

SEQ ID NO: 45487 - RNA, 23 nt, Artificial Sequence
  RNA Oligomer
acuuaaagcccaguaauauagua

SEQ ID NO: 45488 - RNA, 23 nt, Artificial Sequence
  RNA Oligomer
gauucagauggagcuagaucaug

SEQ ID NO: 45489 - RNA, 23 nt, Artificial Sequence
  RNA Oligomer
agagaaccaagaauggaguuaua

SEQ ID NO: 45490 - RNA, 23 nt, Artificial Sequence
  RNA Oligomer
ggagagaaccaagaauggaguua

SEQ ID NO: 45491 - RNA, 23 nt, Artificial Sequence
  RNA Oligomer
ggaauaaaguuauugaacagcuu

SEQ ID NO: 45492 - RNA, 23 nt, Artificial Sequence
  RNA Oligomer
gagaaccaagaauggaguuauac

SEQ ID NO: 45493 - RNA, 23 nt, Artificial Sequence
  RNA Oligomer
cgugacaacaauuuuuauagugu

SEQ ID NO: 45494 - RNA, 23 nt, Artificial Sequence
  RNA Oligomer
guggaaagaauugauauauaagg

SEQ ID NO: 45495 - RNA, 23 nt, Artificial Sequence
  RNA Oligomer
ggaaguuauggacuuggaggaga

SEQ ID NO: 45496 - RNA, 23 nt, Artificial Sequence
  RNA Oligomer
gcaagggauuuguuauccaaaau

SEQ ID NO: 45497 - RNA, 23 nt, Artificial Sequence
  RNA Oligomer
ugaauucaugaagaaacugcaac

SEQ ID NO: 45498 - RNA, 23 nt, Artificial Sequence
  RNA Oligomer
uaaaguuauugaacagcuuggaa

SEQ ID NO: 45499 - RNA, 23 nt, Artificial Sequence
  RNA Oligomer
gaauaaaguuauugaacagcuug

SEQ ID NO: 45500 - RNA, 23 nt, Artificial Sequence
  RNA Oligomer
uggaauaaaguuauugaacagcu

SEQ ID NO: 45501 - RNA, 23 nt, Artificial Sequence
  RNA Oligomer
ucaguggaauaaaguuauugaac

SEQ ID NO: 45502 - RNA, 23 nt, Artificial Sequence
  RNA Oligomer
ugaucaguggaauaaaguuauug

SEQ ID NO: 45503 - RNA, 23 nt, Artificial Sequence
  RNA Oligomer
aagugauucagauggagcuagau

SEQ ID NO: 45504 - RNA, 23 nt, Artificial Sequence
  RNA Oligomer
aguuauggacuuggaggagagaa

SEQ ID NO: 45505 - RNA, 23 nt, Artificial Sequence
  RNA Oligomer
caguuagaugaaagggaacacac

SEQ ID NO: 45506 - RNA, 23 nt, Artificial Sequence
  RNA Oligomer
gcuuggaacaccauguccugaau

SEQ ID NO: 45507 - RNA, 23 nt, Artificial Sequence
  RNA Oligomer
caguggaauaaaguuauugaaca

SEQ ID NO: 45508 - RNA, 23 nt, Artificial Sequence
  RNA Oligomer
cuaagccgaccauuucagaauca

SEQ ID NO: 45509 - RNA, 23 nt, Artificial Sequence
  RNA Oligomer
guggaauaaaguuauugaacagc

SEQ ID NO: 45510 - RNA, 23 nt, Artificial Sequence
  RNA Oligomer
caaugucugguaugauccuucug

SEQ ID NO: 45511 - RNA, 23 nt, Artificial Sequence
  RNA Oligomer
ugaauguuuucacaccacagaaa

SEQ ID NO: 45512 - RNA, 23 nt, Artificial Sequence
  RNA Oligomer
uguuauccaaaaugcugguaaua

SEQ ID NO: 45513 - RNA, 23 nt, Artificial Sequence
  RNA Oligomer
ccauguccugaauucaugaagaa

SEQ ID NO: 45514 - RNA, 23 nt, Artificial Sequence
  RNA Oligomer
acaccacagaaaucccuagaaga

SEQ ID NO: 45515 - RNA, 23 nt, Artificial Sequence
  RNA Oligomer
ggaugcaaaucuuugccaaguga

SEQ ID NO: 45516 - RNA, 23 nt, Artificial Sequence
  RNA Oligomer
cuacagagagcuaguucuuauga

SEQ ID NO: 45517 - RNA, 23 nt, Artificial Sequence
  RNA Oligomer
caaacuuaaagccagucaggcaa

SEQ ID NO: 45518 - RNA, 23 nt, Artificial Sequence
  RNA Oligomer
gaagaaacugcaaccaacaguaa

SEQ ID NO: 45519 - RNA, 23 nt, Artificial Sequence
  RNA Oligomer
ccuucauucugcuggaauuauuc

SEQ ID NO: 45520 - RNA, 23 nt, Artificial Sequence
  RNA Oligomer
cacaccacagaaaucccuagaag

SEQ ID NO: 45521 - RNA, 23 nt, Artificial Sequence
  RNA Oligomer
ggcaagggauuuguuauccaaaa

SEQ ID NO: 45522 - RNA, 23 nt, Artificial Sequence
  RNA Oligomer
ccugaaacgauaucagaauuuaa

SEQ ID NO: 45523 - RNA, 23 nt, Artificial Sequence
  RNA Oligomer
cuuggaacaccauguccugaauu

SEQ ID NO: 45524 - RNA, 23 nt, Artificial Sequence
  RNA Oligomer
cgggacuuaaagcccaguaauau

SEQ ID NO: 45525 - RNA, 23 nt, Artificial Sequence
  RNA Oligomer
ucaucgggacuuaaagcccagua

SEQ ID NO: 45526 - RNA, 23 nt, Artificial Sequence
  RNA Oligomer
aggagagaaccaagaauggaguu

SEQ ID NO: 45527 - RNA, 23 nt, Artificial Sequence
  RNA Oligomer
guaauagaugcaucuaaaaggau

SEQ ID NO: 45528 - RNA, 23 nt, Artificial Sequence
  RNA Oligomer
caagggauuuguuauccaaaaug

SEQ ID NO: 45529 - RNA, 23 nt, Artificial Sequence
  RNA Oligomer
guccugaaacgauaucagaauuu

SEQ ID NO: 45530 - RNA, 23 nt, Artificial Sequence
  RNA Oligomer
uacauucacaguccugaaacgau

SEQ ID NO: 45531 - RNA, 23 nt, Artificial Sequence
  RNA Oligomer
cugguaauagaugcaucuaaaag

SEQ ID NO: 45532 - RNA, 23 nt, Artificial Sequence
  RNA Oligomer
uccugaaacgauaucagaauuua

SEQ ID NO: 45533 - RNA, 23 nt, Artificial Sequence
  RNA Oligomer
gaugcaaaucuuugccaagugau

SEQ ID NO: 45534 - RNA, 23 nt, Artificial Sequence
  RNA Oligomer
gaauguuuucacaccacagaaau

SEQ ID NO: 45535 - RNA, 23 nt, Artificial Sequence
  RNA Oligomer
ccaaagaucccugacaagcaguu

SEQ ID NO: 45536 - RNA, 23 nt, Artificial Sequence
  RNA Oligomer
agggauuuguuauccaaaaugcu

SEQ ID NO: 45537 - RNA, 23 nt, Artificial Sequence
  RNA Oligomer
agcuaagccgaccauuucagaau

SEQ ID NO: 45538 - RNA, 23 nt, Artificial Sequence
  RNA Oligomer
aagcuaagccgaccauuucagaa

SEQ ID NO: 45539 - RNA, 23 nt, Artificial Sequence
  RNA Oligomer
ccaucaugagcagaagcaagcgu

SEQ ID NO: 45540 - RNA, 23 nt, Artificial Sequence
  RNA Oligomer
ugggcugcuguagaugacuacuu

SEQ ID NO: 45541 - RNA, 23 nt, Artificial Sequence
  RNA Oligomer
ucaaugucaacagauccgacuuu

SEQ ID NO: 45542 - RNA, 23 nt, Artificial Sequence
  RNA Oligomer
auaggcucaggagcucaaggaau

SEQ ID NO: 45543 - RNA, 23 nt, Artificial Sequence
  RNA Oligomer
agcuuggaacaccauguccugaa

SEQ ID NO: 45544 - RNA, 23 nt, Artificial Sequence
  RNA Oligomer
ucgggacuuaaagcccaguaaua

SEQ ID NO: 45545 - RNA, 23 nt, Artificial Sequence
  RNA Oligomer
caucgggacuuaaagcccaguaa

SEQ ID NO: 45546 - RNA, 23 nt, Artificial Sequence
  RNA Oligomer
augcaaaucuuugccaagugauu

SEQ ID NO: 45547 - RNA, 23 nt, Artificial Sequence
  RNA Oligomer
cuguagaugacuacuugggccau

SEQ ID NO: 45548 - RNA, 23 nt, Artificial Sequence
  RNA Oligomer
cugauacagacagcagucuagaa

SEQ ID NO: 45549 - RNA, 23 nt, Artificial Sequence
  RNA Oligomer
caaccaacaguaaggacuuacgu

SEQ ID NO: 45550 - RNA, 23 nt, Artificial Sequence
  RNA Oligomer
ccaggacugcaggaacgaguuuu

SEQ ID NO: 45551 - RNA, 23 nt, Artificial Sequence
  RNA Oligomer
gggacuuaaagcccaguaauaua

SEQ ID NO: 45552 - RNA, 23 nt, Artificial Sequence
  RNA Oligomer
aucgggacuuaaagcccaguaau

SEQ ID NO: 45553 - RNA, 23 nt, Artificial Sequence
  RNA Oligomer
ugagcagaagcaagcgugacaac

SEQ ID NO: 45554 - RNA, 23 nt, Artificial Sequence
  RNA Oligomer
gcagaagcuccaccaccaaagau

SEQ ID NO: 45555 - RNA, 23 nt, Artificial Sequence
  RNA Oligomer
ucaaugucugguaugauccuucu

SEQ ID NO: 45556 - RNA, 23 nt, Artificial Sequence
  RNA Oligomer
gggauuuguuauccaaaaugcug

SEQ ID NO: 45557 - RNA, 23 nt, Artificial Sequence
  RNA Oligomer
ucagaauuuaaaaccuauaggcu

SEQ ID NO: 45558 - RNA, 23 nt, Artificial Sequence
  RNA Oligomer
gcuuugagaaacucuucccugau

SEQ ID NO: 45559 - RNA, 23 nt, Artificial Sequence
  RNA Oligomer
acauucacaguccugaaacgaua

SEQ ID NO: 45560 - RNA, 23 nt, Artificial Sequence
  RNA Oligomer
accauguccugaauucaugaaga

SEQ ID NO: 45561 - RNA, 23 nt, Artificial Sequence
  RNA Oligomer
cagaaaucccuagaagaauuuca

SEQ ID NO: 45562 - RNA, 23 nt, Artificial Sequence
  RNA Oligomer
ggcugcuguagaugacuacuugg

SEQ ID NO: 45563 - RNA, 23 nt, Artificial Sequence
  RNA Oligomer
cgacuuuggccucugauacagac

SEQ ID NO: 45564 - RNA, 23 nt, Artificial Sequence
  RNA Oligomer
ggaggagagaaccaagaauggag

SEQ ID NO: 45565 - RNA, 23 nt, Artificial Sequence
  RNA Oligomer
aggaucucuguagaugaagcucu

SEQ ID NO: 45566 - RNA, 23 nt, Artificial Sequence
  RNA Oligomer
cagaauuuaaaaccuauaggcuc

SEQ ID NO: 45567 - RNA, 23 nt, Artificial Sequence
  RNA Oligomer
caacaguaaggacuuacguugaa

SEQ ID NO: 45568 - RNA, 23 nt, Artificial Sequence
  RNA Oligomer
caggacugcaggaacgaguuuua

SEQ ID NO: 45569 - RNA, 23 nt, Artificial Sequence
  RNA Oligomer
ggacuuaaagcccaguaauauag

SEQ ID NO: 45570 - RNA, 23 nt, Artificial Sequence
  RNA Oligomer
cuucauucugcuggaauuauuca

SEQ ID NO: 45571 - RNA, 23 nt, Artificial Sequence
  RNA Oligomer
ucauggagcucauggaugcaaau

SEQ ID NO: 45572 - RNA, 23 nt, Artificial Sequence
  RNA Oligomer
gagcagaagcaagcgugacaaca

SEQ ID NO: 45573 - RNA, 23 nt, Artificial Sequence
  RNA Oligomer
ugaucaauggcucucagcaucca

SEQ ID NO: 45574 - RNA, 23 nt, Artificial Sequence
  RNA Oligomer
acacacaauagaagaguggaaag

SEQ ID NO: 45575 - RNA, 23 nt, Artificial Sequence
  RNA Oligomer
aaccuauaggcucaggagcucaa

SEQ ID NO: 45576 - RNA, 23 nt, Artificial Sequence
  RNA Oligomer
uuguuauccaaaaugcugguaau

SEQ ID NO: 45577 - RNA, 23 nt, Artificial Sequence
  RNA Oligomer
agcuuugagaaacucuucccuga

SEQ ID NO: 45578 - RNA, 23 nt, Artificial Sequence
  RNA Oligomer
cugcaaccaacaguaaggacuua

SEQ ID NO: 45579 - RNA, 23 nt, Artificial Sequence
  RNA Oligomer
uguguggaaucaagcaccuucau

SEQ ID NO: 45580 - RNA, 23 nt, Artificial Sequence
  RNA Oligomer
ucucuaucagaugcuguguggaa

SEQ ID NO: 45581 - RNA, 23 nt, Artificial Sequence
  RNA Oligomer
cuaccuucucuaucagaugcugu

SEQ ID NO: 45582 - RNA, 23 nt, Artificial Sequence
  RNA Oligomer
agucauggagcucauggaugcaa

SEQ ID NO: 45583 - RNA, 23 nt, Artificial Sequence
  RNA Oligomer
agaaaucccuagaagaauuucaa

SEQ ID NO: 45584 - RNA, 23 nt, Artificial Sequence
  RNA Oligomer
gaaauguugcaaucaagaagcua

SEQ ID NO: 45585 - RNA, 23 nt, Artificial Sequence
  RNA Oligomer
gaagcagaagcuccaccaccaaa

SEQ ID NO: 45586 - RNA, 23 nt, Artificial Sequence
  RNA Oligomer
ugaagcucuccaacacccguaca

SEQ ID NO: 45587 - RNA, 23 nt, Artificial Sequence
  RNA Oligomer
gcaaccaacaguaaggacuuacg

SEQ ID NO: 45588 - RNA, 23 nt, Artificial Sequence
  RNA Oligomer
ugaugacgccuuauguagugacu

SEQ ID NO: 45589 - RNA, 23 nt, Artificial Sequence
  RNA Oligomer
gccgaccauuucagaaucagacu

SEQ ID NO: 45590 - RNA, 23 nt, Artificial Sequence
  RNA Oligomer
agccgaccauuucagaaucagac

SEQ ID NO: 45591 - RNA, 23 nt, Artificial Sequence
  RNA Oligomer
aagccgaccauuucagaaucaga

SEQ ID NO: 45592 - RNA, 23 nt, Artificial Sequence
  RNA Oligomer
uaagccgaccauuucagaaucag

SEQ ID NO: 45593 - RNA, 23 nt, Artificial Sequence
  RNA Oligomer
cuaagccgaccauuucagaauca

SEQ ID NO: 45594 - RNA, 23 nt, Artificial Sequence
  RNA Oligomer
uggaugcaaaucuuugccaagug

SEQ ID NO: 45595 - RNA, 23 nt, Artificial Sequence
  RNA Oligomer
auggaugcaaaucuuugccaagu

SEQ ID NO: 45596 - RNA, 23 nt, Artificial Sequence
  RNA Oligomer
cauggaugcaaaucuuugccaag

SEQ ID NO: 45597 - RNA, 23 nt, Artificial Sequence
  RNA Oligomer
ucauggaugcaaaucuuugccaa

SEQ ID NO: 45598 - RNA, 23 nt, Artificial Sequence
  RNA Oligomer
cucauggaugcaaaucuuugcca

SEQ ID NO: 45599 - RNA, 23 nt, Artificial Sequence
  RNA Oligomer
ggcuuuaaguuuguuguguucug

SEQ ID NO: 45600 - RNA, 23 nt, Artificial Sequence
  RNA Oligomer
gcuuuaaguuuguuguguucuga

SEQ ID NO: 45601 - RNA, 23 nt, Artificial Sequence
  RNA Oligomer
cuuuaaguuuguuguguucugag

SEQ ID NO: 45602 - RNA, 23 nt, Artificial Sequence
  RNA Oligomer
uuuaaguuuguuguguucugagu

SEQ ID NO: 45603 - RNA, 23 nt, Artificial Sequence
  RNA Oligomer
uuaaguuuguuguguucugaguc

SEQ ID NO: 45604 - RNA, 23 nt, Artificial Sequence
  RNA Oligomer
uaaguuuguuguguucugaguca

SEQ ID NO: 45605 - RNA, 23 nt, Artificial Sequence
  RNA Oligomer
cuggcuuuaaguuuguuguguuc

SEQ ID NO: 45606 - RNA, 23 nt, Artificial Sequence
  RNA Oligomer
uggcuuuaaguuuguuguguucu

SEQ ID NO: 45607 - RNA, 23 nt, Artificial Sequence
  RNA Oligomer
aggacugugaauguagaaucucc

SEQ ID NO: 45608 - RNA, 23 nt, Artificial Sequence
  RNA Oligomer
ggacugugaauguagaaucucca

SEQ ID NO: 45609 - RNA, 23 nt, Artificial Sequence
  RNA Oligomer
gacugugaauguagaaucuccaa

SEQ ID NO: 45610 - RNA, 23 nt, Artificial Sequence
  RNA Oligomer
acugugaauguagaaucuccaau

SEQ ID NO: 45611 - RNA, 23 nt, Artificial Sequence
  RNA Oligomer
cugugaauguagaaucuccaauc

SEQ ID NO: 45612 - RNA, 23 nt, Artificial Sequence
  RNA Oligomer
ucauaagcugcgcauacuauucc

SEQ ID NO: 45613 - RNA, 23 nt, Artificial Sequence
  RNA Oligomer
cauaagcugcgcauacuauuccu

SEQ ID NO: 45614 - RNA, 23 nt, Artificial Sequence
  RNA Oligomer
auaagcugcgcauacuauuccuu

SEQ ID NO: 45615 - RNA, 23 nt, Artificial Sequence
  RNA Oligomer
uaagcugcgcauacuauuccuug

SEQ ID NO: 45616 - RNA, 23 nt, Artificial Sequence
  RNA Oligomer
aagcugcgcauacuauuccuuga

SEQ ID NO: 45617 - RNA, 23 nt, Artificial Sequence
  RNA Oligomer
cugacuggcuuuaaguuuguugu

SEQ ID NO: 45618 - RNA, 23 nt, Artificial Sequence
  RNA Oligomer
ugacuggcuuuaaguuuguugug

SEQ ID NO: 45619 - RNA, 23 nt, Artificial Sequence
  RNA Oligomer
gacuggcuuuaaguuuguugugu

SEQ ID NO: 45620 - RNA, 23 nt, Artificial Sequence
  RNA Oligomer
acuggcuuuaaguuuguuguguu

SEQ ID NO: 45621 - RNA, 23 nt, Artificial Sequence
  RNA Oligomer
aaguuuguuguguucugagucag

SEQ ID NO: 45622 - RNA, 23 nt, Artificial Sequence
  RNA Oligomer
aguuuguuguguucugagucagc

SEQ ID NO: 45623 - RNA, 23 nt, Artificial Sequence
  RNA Oligomer
guuuguuguguucugagucagcu

SEQ ID NO: 45624 - RNA, 23 nt, Artificial Sequence
  RNA Oligomer
uuuguuguguucugagucagcug

SEQ ID NO: 45625 - RNA, 23 nt, Artificial Sequence
  RNA Oligomer
ugcaguuucuucaugaauucagg

SEQ ID NO: 45626 - RNA, 23 nt, Artificial Sequence
  RNA Oligomer
gcaguuucuucaugaauucagga

SEQ ID NO: 45627 - RNA, 23 nt, Artificial Sequence
  RNA Oligomer
caguuucuucaugaauucaggac

SEQ ID NO: 45628 - RNA, 23 nt, Artificial Sequence
  RNA Oligomer
aguuucuucaugaauucaggaca

SEQ ID NO: 45629 - RNA, 23 nt, Artificial Sequence
  RNA Oligomer
guuucuucaugaauucaggacau

SEQ ID NO: 45630 - RNA, 23 nt, Artificial Sequence
  RNA Oligomer
ugacauugaagacacaucauuga

SEQ ID NO: 45631 - RNA, 23 nt, Artificial Sequence
  RNA Oligomer
gacauugaagacacaucauugac

SEQ ID NO: 45632 - RNA, 23 nt, Artificial Sequence
  RNA Oligomer
acauugaagacacaucauugaca

SEQ ID NO: 45633 - RNA, 23 nt, Artificial Sequence
  RNA Oligomer
cauugaagacacaucauugacag

SEQ ID NO: 45634 - RNA, 23 nt, Artificial Sequence
  RNA Oligomer
auugaagacacaucauugacaga

SEQ ID NO: 45635 - RNA, 23 nt, Artificial Sequence
  RNA Oligomer
agcuauauccagcauauuuaggu

SEQ ID NO: 45636 - RNA, 23 nt, Artificial Sequence
  RNA Oligomer
gcuauauccagcauauuuagguc

SEQ ID NO: 45637 - RNA, 23 nt, Artificial Sequence
  RNA Oligomer
cuauauccagcauauuuaggucu

SEQ ID NO: 45638 - RNA, 23 nt, Artificial Sequence
  RNA Oligomer
uauauccagcauauuuaggucug

SEQ ID NO: 45639 - RNA, 23 nt, Artificial Sequence
  RNA Oligomer
auauccagcauauuuaggucugu

SEQ ID NO: 45640 - RNA, 23 nt, Artificial Sequence
  RNA Oligomer
acauucuuucaugaucuagcucc

SEQ ID NO: 45641 - RNA, 23 nt, Artificial Sequence
  RNA Oligomer
cauucuuucaugaucuagcucca

SEQ ID NO: 45642 - RNA, 23 nt, Artificial Sequence
  RNA Oligomer
auucuuucaugaucuagcuccau

SEQ ID NO: 45643 - RNA, 23 nt, Artificial Sequence
  RNA Oligomer
uucuuucaugaucuagcuccauc

SEQ ID NO: 45644 - RNA, 23 nt, Artificial Sequence
  RNA Oligomer
ucuuucaugaucuagcuccaucu

SEQ ID NO: 45645 - RNA, 23 nt, Artificial Sequence
  RNA Oligomer
gaaauucuucuagggauuucugu

SEQ ID NO: 45646 - RNA, 23 nt, Artificial Sequence
  RNA Oligomer
aaauucuucuagggauuucugug

SEQ ID NO: 45647 - RNA, 23 nt, Artificial Sequence
  RNA Oligomer
aauucuucuagggauuucugugg

SEQ ID NO: 45648 - RNA, 23 nt, Artificial Sequence
  RNA Oligomer
auucuucuagggauuucuguggu

SEQ ID NO: 45649 - RNA, 23 nt, Artificial Sequence
  RNA Oligomer
uucuucuagggauuucuguggug

SEQ ID NO: 45650 - RNA, 23 nt, Artificial Sequence
  RNA Oligomer
ggucggcuuagcuucuugauugc

SEQ ID NO: 45651 - RNA, 23 nt, Artificial Sequence
  RNA Oligomer
gucggcuuagcuucuugauugca

SEQ ID NO: 45652 - RNA, 23 nt, Artificial Sequence
  RNA Oligomer
ucggcuuagcuucuugauugcaa

SEQ ID NO: 45653 - RNA, 23 nt, Artificial Sequence
  RNA Oligomer
cggcuuagcuucuugauugcaac

SEQ ID NO: 45654 - RNA, 23 nt, Artificial Sequence
  RNA Oligomer
ggcuuagcuucuugauugcaaca

SEQ ID NO: 45655 - RNA, 23 nt, Artificial Sequence
  RNA Oligomer
guaguucuaucaaugacuaaccg

SEQ ID NO: 45656 - RNA, 23 nt, Artificial Sequence
  RNA Oligomer
uaguucuaucaaugacuaaccga

SEQ ID NO: 45657 - RNA, 23 nt, Artificial Sequence
  RNA Oligomer
aguucuaucaaugacuaaccgac

SEQ ID NO: 45658 - RNA, 23 nt, Artificial Sequence
  RNA Oligomer
guucuaucaaugacuaaccgacu

SEQ ID NO: 45659 - RNA, 23 nt, Artificial Sequence
  RNA Oligomer
uucuaucaaugacuaaccgacuc

SEQ ID NO: 45660 - RNA, 23 nt, Artificial Sequence
  RNA Oligomer
ucuacagagauccuuuuagaugc

SEQ ID NO: 45661 - RNA, 23 nt, Artificial Sequence
  RNA Oligomer
cuacagagauccuuuuagaugca

SEQ ID NO: 45662 - RNA, 23 nt, Artificial Sequence
  RNA Oligomer
uacagagauccuuuuagaugcau

SEQ ID NO: 45663 - RNA, 23 nt, Artificial Sequence
  RNA Oligomer
acagagauccuuuuagaugcauc

SEQ ID NO: 45664 - RNA, 23 nt, Artificial Sequence
  RNA Oligomer
cagagauccuuuuagaugcaucu

SEQ ID NO: 45665 - RNA, 23 nt, Artificial Sequence
  RNA Oligomer
aagaguuucucaaagcuauaucc

SEQ ID NO: 45666 - RNA, 23 nt, Artificial Sequence
  RNA Oligomer
agaguuucucaaagcuauaucca

SEQ ID NO: 45667 - RNA, 23 nt, Artificial Sequence
  RNA Oligomer
gaguuucucaaagcuauauccag

SEQ ID NO: 45668 - RNA, 23 nt, Artificial Sequence
  RNA Oligomer
aguuucucaaagcuauauccagc

SEQ ID NO: 45669 - RNA, 23 nt, Artificial Sequence
  RNA Oligomer
guuucucaaagcuauauccagca

SEQ ID NO: 45670 - RNA, 23 nt, Artificial Sequence
  RNA Oligomer
uauccagcauauuuaggucuguu

SEQ ID NO: 45671 - RNA, 23 nt, Artificial Sequence
  RNA Oligomer
uuucuucaugaauucaggacaug

SEQ ID NO: 45672 - RNA, 23 nt, Artificial Sequence
  RNA Oligomer
ugugaauguagaaucuccaaucu

SEQ ID NO: 45673 - RNA, 23 nt, Artificial Sequence
  RNA Oligomer
gugaauguagaaucuccaaucuc

SEQ ID NO: 45674 - RNA, 23 nt, Artificial Sequence
  RNA Oligomer
ugaauguagaaucuccaaucucu

SEQ ID NO: 45675 - RNA, 23 nt, Artificial Sequence
  RNA Oligomer
gaauguagaaucuccaaucucua

SEQ ID NO: 45676 - RNA, 23 nt, Artificial Sequence
  RNA Oligomer
aauguagaaucuccaaucucuac

SEQ ID NO: 45677 - RNA, 23 nt, Artificial Sequence
  RNA Oligomer
cuuuaagucccgaugaauaauuc

SEQ ID NO: 45678 - RNA, 23 nt, Artificial Sequence
  RNA Oligomer
uuuaagucccgaugaauaauucc

SEQ ID NO: 45679 - RNA, 23 nt, Artificial Sequence
  RNA Oligomer
uuaagucccgaugaauaauucca

SEQ ID NO: 45680 - RNA, 23 nt, Artificial Sequence
  RNA Oligomer
uaagucccgaugaauaauuccag

SEQ ID NO: 45681 - RNA, 23 nt, Artificial Sequence
  RNA Oligomer
aagucccgaugaauaauuccagc

SEQ ID NO: 45682 - RNA, 23 nt, Artificial Sequence
  RNA Oligomer
ggcaaagauuugcauccaugagc

SEQ ID NO: 45683 - RNA, 23 nt, Artificial Sequence
  RNA Oligomer
gcaaagauuugcauccaugagcu

SEQ ID NO: 45684 - RNA, 23 nt, Artificial Sequence
  RNA Oligomer
caaagauuugcauccaugagcuc

SEQ ID NO: 45685 - RNA, 23 nt, Artificial Sequence
  RNA Oligomer
aaagauuugcauccaugagcucc

SEQ ID NO: 45686 - RNA, 23 nt, Artificial Sequence
  RNA Oligomer
aagauuugcauccaugagcucca

SEQ ID NO: 45687 - RNA, 23 nt, Artificial Sequence
  RNA Oligomer
uucuagggauuucugugguguga

SEQ ID NO: 45688 - RNA, 23 nt, Artificial Sequence
  RNA Oligomer
ucuagggauuucuguggugugaa

SEQ ID NO: 45689 - RNA, 23 nt, Artificial Sequence
  RNA Oligomer
cuagggauuucuguggugugaaa

SEQ ID NO: 45690 - RNA, 23 nt, Artificial Sequence
  RNA Oligomer
uagggauuucuguggugugaaaa

SEQ ID NO: 45691 - RNA, 23 nt, Artificial Sequence
  RNA Oligomer
agggauuucuguggugugaaaac

SEQ ID NO: 45692 - RNA, 23 nt, Artificial Sequence
  RNA Oligomer
gcgcauacuauuccuugagcucc

SEQ ID NO: 45693 - RNA, 23 nt, Artificial Sequence
  RNA Oligomer
cgcauacuauuccuugagcuccu

SEQ ID NO: 45694 - RNA, 23 nt, Artificial Sequence
  RNA Oligomer
gcauacuauuccuugagcuccug

SEQ ID NO: 45695 - RNA, 23 nt, Artificial Sequence
  RNA Oligomer
cauacuauuccuugagcuccuga

SEQ ID NO: 45696 - RNA, 23 nt, Artificial Sequence
  RNA Oligomer
auacuauuccuugagcuccugag

SEQ ID NO: 45697 - RNA, 23 nt, Artificial Sequence
  RNA Oligomer
gaucauaccagacauugauguac

SEQ ID NO: 45698 - RNA, 23 nt, Artificial Sequence
  RNA Oligomer
aucauaccagacauugauguacg

SEQ ID NO: 45699 - RNA, 23 nt, Artificial Sequence
  RNA Oligomer
ucauaccagacauugauguacgg

SEQ ID NO: 45700 - RNA, 23 nt, Artificial Sequence
  RNA Oligomer
cauaccagacauugauguacggg

SEQ ID NO: 45701 - RNA, 23 nt, Artificial Sequence
  RNA Oligomer
auaccagacauugauguacgggu

SEQ ID NO: 45702 - RNA, 23 nt, Artificial Sequence
  RNA Oligomer
uuguuguguucugagucagcugg

SEQ ID NO: 45703 - RNA, 23 nt, Artificial Sequence
  RNA Oligomer
auccagcauauuuaggucuguuu

SEQ ID NO: 45704 - RNA, 23 nt, Artificial Sequence
  RNA Oligomer
auuuuacuacuauauuacugggc

SEQ ID NO: 45705 - RNA, 23 nt, Artificial Sequence
  RNA Oligomer
uuuuacuacuauauuacugggcu

SEQ ID NO: 45706 - RNA, 23 nt, Artificial Sequence
  RNA Oligomer
uuuacuacuauauuacugggcuu

SEQ ID NO: 45707 - RNA, 23 nt, Artificial Sequence
  RNA Oligomer
uuacuacuauauuacugggcuuu

SEQ ID NO: 45708 - RNA, 23 nt, Artificial Sequence
  RNA Oligomer
uacuacuauauuacugggcuuua

SEQ ID NO: 45709 - RNA, 23 nt, Artificial Sequence
  RNA Oligomer
ggacauucuuucaugaucuagcu

SEQ ID NO: 45710 - RNA, 23 nt, Artificial Sequence
  RNA Oligomer
gacauucuuucaugaucuagcuc

SEQ ID NO: 45711 - RNA, 23 nt, Artificial Sequence
  RNA Oligomer
gaaaaaucacccaaaaauaagac

SEQ ID NO: 45712 - RNA, 23 nt, Artificial Sequence
  RNA Oligomer
aaaaaucacccaaaaauaagacc

SEQ ID NO: 45713 - RNA, 23 nt, Artificial Sequence
  RNA Oligomer
aaaaucacccaaaaauaagacca

SEQ ID NO: 45714 - RNA, 23 nt, Artificial Sequence
  RNA Oligomer
aaaucacccaaaaauaagaccac

SEQ ID NO: 45715 - RNA, 23 nt, Artificial Sequence
  RNA Oligomer
aaucacccaaaaauaagaccacu

SEQ ID NO: 45716 - RNA, 23 nt, Artificial Sequence
  RNA Oligomer
aucacccaaaaauaagaccacug

SEQ ID NO: 45717 - RNA, 23 nt, Artificial Sequence
  RNA Oligomer
caaaaauaagaccacugaauugu

SEQ ID NO: 45718 - RNA, 23 nt, Artificial Sequence
  RNA Oligomer
aaaaauaagaccacugaauuguu

SEQ ID NO: 45719 - RNA, 23 nt, Artificial Sequence
  RNA Oligomer
aaaauaagaccacugaauuguuu

SEQ ID NO: 45720 - RNA, 23 nt, Artificial Sequence
  RNA Oligomer
aaauaagaccacugaauuguuuu

SEQ ID NO: 45721 - RNA, 23 nt, Artificial Sequence
  RNA Oligomer
aauaagaccacugaauuguuuuc

SEQ ID NO: 45722 - RNA, 23 nt, Artificial Sequence
  RNA Oligomer
caaguagucaucuacagcagccc

SEQ ID NO: 45723 - RNA, 23 nt, Artificial Sequence
  RNA Oligomer
aguagucaucuacagcagcccag

SEQ ID NO: 45724 - RNA, 23 nt, Artificial Sequence
  RNA Oligomer
uagucaucuacagcagcccagag

SEQ ID NO: 45725 - RNA, 23 nt, Artificial Sequence
  RNA Oligomer
uauauaucaauucuuuccacucu

SEQ ID NO: 45726 - RNA, 23 nt, Artificial Sequence
  RNA Oligomer
auauaucaauucuuuccacucuu

SEQ ID NO: 45727 - RNA, 23 nt, Artificial Sequence
  RNA Oligomer
uauaucaauucuuuccacucuuc

SEQ ID NO: 45728 - RNA, 23 nt, Artificial Sequence
  RNA Oligomer
auaucaauucuuuccacucuucu

SEQ ID NO: 45729 - RNA, 23 nt, Artificial Sequence
  RNA Oligomer
uaucaauucuuuccacucuucua

SEQ ID NO: 45730 - RNA, 23 nt, Artificial Sequence
  RNA Oligomer
uacuauuccuugagcuccugagc

SEQ ID NO: 45731 - RNA, 23 nt, Artificial Sequence
  RNA Oligomer
uguguucccuuucaucuaacugc

SEQ ID NO: 45732 - RNA, 23 nt, Artificial Sequence
  RNA Oligomer
guguucccuuucaucuaacugcu

SEQ ID NO: 45733 - RNA, 23 nt, Artificial Sequence
  RNA Oligomer
uguucccuuucaucuaacugcuu

SEQ ID NO: 45734 - RNA, 23 nt, Artificial Sequence
  RNA Oligomer
guucccuuucaucuaacugcuug

SEQ ID NO: 45735 - RNA, 23 nt, Artificial Sequence
  RNA Oligomer
uucccuuucaucuaacugcuugu

SEQ ID NO: 45736 - RNA, 23 nt, Artificial Sequence
  RNA Oligomer
acuauuccuugagcuccugagcc

SEQ ID NO: 45737 - RNA, 23 nt, Artificial Sequence
  RNA Oligomer
cuauuccuugagcuccugagccu

SEQ ID NO: 45738 - RNA, 23 nt, Artificial Sequence
  RNA Oligomer
uauuccuugagcuccugagccua

SEQ ID NO: 45739 - RNA, 23 nt, Artificial Sequence
  RNA Oligomer
uaccagacauugauguacgggug

SEQ ID NO: 45740 - RNA, 23 nt, Artificial Sequence
  RNA Oligomer
agacauugauguacggguguugg

SEQ ID NO: 45741 - RNA, 23 nt, Artificial Sequence
  RNA Oligomer
gacauugauguacggguguugga

SEQ ID NO: 45742 - RNA, 23 nt, Artificial Sequence
  RNA Oligomer
acauugauguacggguguuggag

SEQ ID NO: 45743 - RNA, 23 nt, Artificial Sequence
  RNA Oligomer
cauugauguacggguguuggaga

SEQ ID NO: 45744 - RNA, 23 nt, Artificial Sequence
  RNA Oligomer
auugauguacggguguuggagag

SEQ ID NO: 45745 - RNA, 23 nt, Artificial Sequence
  RNA Oligomer
cuucaugaauucaggacauggug

SEQ ID NO: 45746 - RNA, 23 nt, Artificial Sequence
  RNA Oligomer
uucaugaauucaggacauggugu

SEQ ID NO: 45747 - RNA, 23 nt, Artificial Sequence
  RNA Oligomer
ucaugaauucaggacaugguguu

SEQ ID NO: 45748 - RNA, 23 nt, Artificial Sequence
  RNA Oligomer
caugaauucaggacaugguguuc

SEQ ID NO: 45749 - RNA, 23 nt, Artificial Sequence
  RNA Oligomer
augaauucaggacaugguguucc

SEQ ID NO: 45750 - RNA, 23 nt, Artificial Sequence
  RNA Oligomer
ucaggacugugaauguagaaucu

SEQ ID NO: 45751 - RNA, 23 nt, Artificial Sequence
  RNA Oligomer
caggacugugaauguagaaucuc

SEQ ID NO: 45752 - RNA, 23 nt, Artificial Sequence
  RNA Oligomer
gauuuuacuacuauauuacuggg

SEQ ID NO: 45753 - RNA, 23 nt, Artificial Sequence
  RNA Oligomer
uaauuccagcagaaugaaggugc

SEQ ID NO: 45754 - RNA, 23 nt, Artificial Sequence
  RNA Oligomer
aauuccagcagaaugaaggugcu

SEQ ID NO: 45755 - RNA, 23 nt, Artificial Sequence
  RNA Oligomer
auuccagcagaaugaaggugcuu

SEQ ID NO: 45756 - RNA, 23 nt, Artificial Sequence
  RNA Oligomer
uuccagcagaaugaaggugcuug

SEQ ID NO: 45757 - RNA, 23 nt, Artificial Sequence
  RNA Oligomer
uccagcagaaugaaggugcuuga

SEQ ID NO: 45758 - RNA, 23 nt, Artificial Sequence
  RNA Oligomer
auaaaaauuguugucacgcuugc

SEQ ID NO: 45759 - RNA, 23 nt, Artificial Sequence
  RNA Oligomer
uaaaaauuguugucacgcuugcu

SEQ ID NO: 45760 - RNA, 23 nt, Artificial Sequence
  RNA Oligomer
aaaaauuguugucacgcuugcuu

SEQ ID NO: 45761 - RNA, 23 nt, Artificial Sequence
  RNA Oligomer
aaaauuguugucacgcuugcuuc

SEQ ID NO: 45762 - RNA, 23 nt, Artificial Sequence
  RNA Oligomer
aaauuguugucacgcuugcuucu

SEQ ID NO: 45763 - RNA, 23 nt, Artificial Sequence
  RNA Oligomer
cacauuucauaagaacuagcucu

SEQ ID NO: 45764 - RNA, 23 nt, Artificial Sequence
  RNA Oligomer
acauuucauaagaacuagcucuc

SEQ ID NO: 45765 - RNA, 23 nt, Artificial Sequence
  RNA Oligomer
cauuucauaagaacuagcucucu

SEQ ID NO: 45766 - RNA, 23 nt, Artificial Sequence
  RNA Oligomer
auuucauaagaacuagcucucug

SEQ ID NO: 45767 - RNA, 23 nt, Artificial Sequence
  RNA Oligomer
uuucauaagaacuagcucucugu

SEQ ID NO: 45768 - RNA, 23 nt, Artificial Sequence
  RNA Oligomer
gaaauggucggcuuagcuucuug

SEQ ID NO: 45769 - RNA, 23 nt, Artificial Sequence
  RNA Oligomer
aaauggucggcuuagcuucuuga

SEQ ID NO: 45770 - RNA, 23 nt, Artificial Sequence
  RNA Oligomer
aauggucggcuuagcuucuugau

SEQ ID NO: 45771 - RNA, 23 nt, Artificial Sequence
  RNA Oligomer
auggucggcuuagcuucuugauu

SEQ ID NO: 45772 - RNA, 23 nt, Artificial Sequence
  RNA Oligomer
uggucggcuuagcuucuugauug

SEQ ID NO: 45773 - RNA, 23 nt, Artificial Sequence
  RNA Oligomer
uugaagacacaucauugacagac

SEQ ID NO: 45774 - RNA, 23 nt, Artificial Sequence
  RNA Oligomer
uccacucuucuauuguguguucc

SEQ ID NO: 45775 - RNA, 23 nt, Artificial Sequence
  RNA Oligomer
ccacucuucuauuguguguuccc

SEQ ID NO: 45776 - RNA, 23 nt, Artificial Sequence
  RNA Oligomer
cacucuucuauuguguguucccu

SEQ ID NO: 45777 - RNA, 23 nt, Artificial Sequence
  RNA Oligomer
acucuucuauuguguguucccuu

SEQ ID NO: 45778 - RNA, 23 nt, Artificial Sequence
  RNA Oligomer
cucuucuauuguguguucccuuu

SEQ ID NO: 45779 - RNA, 23 nt, Artificial Sequence
  RNA Oligomer
uaacaaaucccuugccugacugg

SEQ ID NO: 45780 - RNA, 23 nt, Artificial Sequence
  RNA Oligomer
aacaaaucccuugccugacuggc

SEQ ID NO: 45781 - RNA, 23 nt, Artificial Sequence
  RNA Oligomer
acaaaucccuugccugacuggcu

SEQ ID NO: 45782 - RNA, 23 nt, Artificial Sequence
  RNA Oligomer
caaaucccuugccugacuggcuu

SEQ ID NO: 45783 - RNA, 23 nt, Artificial Sequence
  RNA Oligomer
aaaucccuugccugacuggcuuu

SEQ ID NO: 45784 - RNA, 23 nt, Artificial Sequence
  RNA Oligomer
uguuguguucugagucagcuggg

SEQ ID NO: 45785 - RNA, 23 nt, Artificial Sequence
  RNA Oligomer
guuguguucugagucagcuggga

SEQ ID NO: 45786 - RNA, 23 nt, Artificial Sequence
  RNA Oligomer
uuguguucugagucagcugggaa

SEQ ID NO: 45787 - RNA, 23 nt, Artificial Sequence
  RNA Oligomer
uguguucugagucagcugggaaa

SEQ ID NO: 45788 - RNA, 23 nt, Artificial Sequence
  RNA Oligomer
ggcgucaucauaaaacucguucc

SEQ ID NO: 45789 - RNA, 23 nt, Artificial Sequence
  RNA Oligomer
gcgucaucauaaaacucguuccu

SEQ ID NO: 45790 - RNA, 23 nt, Artificial Sequence
  RNA Oligomer
cgucaucauaaaacucguuccug

SEQ ID NO: 45791 - RNA, 23 nt, Artificial Sequence
  RNA Oligomer
gucaucauaaaacucguuccugc

SEQ ID NO: 45792 - RNA, 23 nt, Artificial Sequence
  RNA Oligomer
ucaucauaaaacucguuccugca

SEQ ID NO: 45793 - RNA, 23 nt, Artificial Sequence
  RNA Oligomer
uucaaagugcaaucagauuuuac

SEQ ID NO: 45794 - RNA, 23 nt, Artificial Sequence
  RNA Oligomer
ucaaagugcaaucagauuuuacu

SEQ ID NO: 45795 - RNA, 23 nt, Artificial Sequence
  RNA Oligomer
caaagugcaaucagauuuuacua

SEQ ID NO: 45796 - RNA, 23 nt, Artificial Sequence
  RNA Oligomer
aaagugcaaucagauuuuacuac

SEQ ID NO: 45797 - RNA, 23 nt, Artificial Sequence
  RNA Oligomer
aagugcaaucagauuuuacuacu

SEQ ID NO: 45798 - RNA, 23 nt, Artificial Sequence
  RNA Oligomer
agugcaaucagauuuuacuacua

SEQ ID NO: 45799 - RNA, 23 nt, Artificial Sequence
  RNA Oligomer
gugcaaucagauuuuacuacuau

SEQ ID NO: 45800 - RNA, 23 nt, Artificial Sequence
  RNA Oligomer
ugcaaucagauuuuacuacuaua

SEQ ID NO: 45801 - RNA, 23 nt, Artificial Sequence
  RNA Oligomer
gcagaaugaaggugcuugauucc

SEQ ID NO: 45802 - RNA, 23 nt, Artificial Sequence
  RNA Oligomer
cagaaugaaggugcuugauucca

SEQ ID NO: 45803 - RNA, 23 nt, Artificial Sequence
  RNA Oligomer
agaaugaaggugcuugauuccac

SEQ ID NO: 45804 - RNA, 23 nt, Artificial Sequence
  RNA Oligomer
gaaugaaggugcuugauuccaca

SEQ ID NO: 45805 - RNA, 23 nt, Artificial Sequence
  RNA Oligomer
aaugaaggugcuugauuccacac

SEQ ID NO: 45806 - RNA, 23 nt, Artificial Sequence
  RNA Oligomer
uucauaagaacuagcucucugua

SEQ ID NO: 45807 - RNA, 23 nt, Artificial Sequence
  RNA Oligomer
gcaugagucugauucugaaaugg

SEQ ID NO: 45808 - RNA, 23 nt, Artificial Sequence
  RNA Oligomer
caugagucugauucugaaauggu

SEQ ID NO: 45809 - RNA, 23 nt, Artificial Sequence
  RNA Oligomer
augagucugauucugaaaugguc

SEQ ID NO: 45810 - RNA, 23 nt, Artificial Sequence
  RNA Oligomer
ugagucugauucugaaauggucg

SEQ ID NO: 45811 - RNA, 23 nt, Artificial Sequence
  RNA Oligomer
gagucugauucugaaauggucgg

SEQ ID NO: 45812 - RNA, 23 nt, Artificial Sequence
  RNA Oligomer
uucugauaucguuucaggacugu

SEQ ID NO: 45813 - RNA, 23 nt, Artificial Sequence
  RNA Oligomer
ucugauaucguuucaggacugug

SEQ ID NO: 45814 - RNA, 23 nt, Artificial Sequence
  RNA Oligomer
cugauaucguuucaggacuguga

SEQ ID NO: 45815 - RNA, 23 nt, Artificial Sequence
  RNA Oligomer
ugauaucguuucaggacugugaa

SEQ ID NO: 45816 - RNA, 23 nt, Artificial Sequence
  RNA Oligomer
gauaucguuucaggacugugaau

SEQ ID NO: 45817 - RNA, 23 nt, Artificial Sequence
  RNA Oligomer
aagcuauauccagcauauuuagg

SEQ ID NO: 45818 - RNA, 23 nt, Artificial Sequence
  RNA Oligomer
gcauauuuaggucuguuuucaac

SEQ ID NO: 45819 - RNA, 23 nt, Artificial Sequence
  RNA Oligomer
cauauuuaggucuguuuucaacg

SEQ ID NO: 45820 - RNA, 23 nt, Artificial Sequence
  RNA Oligomer
auauuuaggucuguuuucaacgu

SEQ ID NO: 45821 - RNA, 23 nt, Artificial Sequence
  RNA Oligomer
uauuuaggucuguuuucaacgua

SEQ ID NO: 45822 - RNA, 23 nt, Artificial Sequence
  RNA Oligomer
auuuaggucuguuuucaacguaa

SEQ ID NO: 45823 - RNA, 23 nt, Artificial Sequence
  RNA Oligomer
uacuguugguugcaguuucuuca

SEQ ID NO: 45824 - RNA, 23 nt, Artificial Sequence
  RNA Oligomer
acuguugguugcaguuucuucau

SEQ ID NO: 45825 - RNA, 23 nt, Artificial Sequence
  RNA Oligomer
cuguugguugcaguuucuucaug

SEQ ID NO: 45826 - RNA, 23 nt, Artificial Sequence
  RNA Oligomer
uguugguugcaguuucuucauga

SEQ ID NO: 45827 - RNA, 23 nt, Artificial Sequence
  RNA Oligomer
guugguugcaguuucuucaugaa

SEQ ID NO: 45828 - RNA, 23 nt, Artificial Sequence
  RNA Oligomer
cacguuuuccuuguagcccaugc

SEQ ID NO: 45829 - RNA, 23 nt, Artificial Sequence
  RNA Oligomer
acguuuuccuuguagcccaugcc

SEQ ID NO: 45830 - RNA, 23 nt, Artificial Sequence
  RNA Oligomer
cguuuuccuuguagcccaugcca

SEQ ID NO: 45831 - RNA, 23 nt, Artificial Sequence
  RNA Oligomer
guuuuccuuguagcccaugccaa

SEQ ID NO: 45832 - RNA, 23 nt, Artificial Sequence
  RNA Oligomer
uuuuccuuguagcccaugccaag

SEQ ID NO: 45833 - RNA, 23 nt, Artificial Sequence
  RNA Oligomer
agucccgaugaauaauuccagca

SEQ ID NO: 45834 - RNA, 23 nt, Artificial Sequence
  RNA Oligomer
auaauuccagcagaaugaaggug

SEQ ID NO: 45835 - RNA, 23 nt, Artificial Sequence
  RNA Oligomer
aggacauucuuucaugaucuagc

SEQ ID NO: 45836 - RNA, 23 nt, Artificial Sequence
  RNA Oligomer
ucugaaauggucggcuuagcuuc

SEQ ID NO: 45837 - RNA, 23 nt, Artificial Sequence
  RNA Oligomer
cugaaauggucggcuuagcuucu

SEQ ID NO: 45838 - RNA, 23 nt, Artificial Sequence
  RNA Oligomer
ugaaauggucggcuuagcuucuu

SEQ ID NO: 45839 - RNA, 23 nt, Artificial Sequence
  RNA Oligomer
aguaguucuaucaaugacuaacc

SEQ ID NO: 45840 - RNA, 23 nt, Artificial Sequence
  RNA Oligomer
ucuaucaaugacuaaccgacucc

SEQ ID NO: 45841 - RNA, 23 nt, Artificial Sequence
  RNA Oligomer
cuaucaaugacuaaccgacuccc

SEQ ID NO: 45842 - RNA, 23 nt, Artificial Sequence
  RNA Oligomer
uaucaaugacuaaccgacucccc

SEQ ID NO: 45843 - RNA, 23 nt, Artificial Sequence
  RNA Oligomer
aucaaugacuaaccgacucccca

SEQ ID NO: 45844 - RNA, 23 nt, Artificial Sequence
  RNA Oligomer
ucaaugacuaaccgacuccccau

SEQ ID NO: 45845 - RNA, 23 nt, Artificial Sequence
  RNA Oligomer
ugaagacacaucauugacagacg

SEQ ID NO: 45846 - RNA, 23 nt, Artificial Sequence
  RNA Oligomer
gaagacacaucauugacagacga

SEQ ID NO: 45847 - RNA, 23 nt, Artificial Sequence
  RNA Oligomer
aucaauucuuuccacucuucuau

SEQ ID NO: 45848 - RNA, 23 nt, Artificial Sequence
  RNA Oligomer
ucaauucuuuccacucuucuauu

SEQ ID NO: 45849 - RNA, 23 nt, Artificial Sequence
  RNA Oligomer
caauucuuuccacucuucuauug

SEQ ID NO: 45850 - RNA, 23 nt, Artificial Sequence
  RNA Oligomer
aauucuuuccacucuucuauugu

SEQ ID NO: 45851 - RNA, 23 nt, Artificial Sequence
  RNA Oligomer
auucuuuccacucuucuauugug

SEQ ID NO: 45852 - RNA, 23 nt, Artificial Sequence
  RNA Oligomer
cuucuauuguguguucccuuuca

SEQ ID NO: 45853 - RNA, 23 nt, Artificial Sequence
  RNA Oligomer
uucuauuguguguucccuuucau

SEQ ID NO: 45854 - RNA, 23 nt, Artificial Sequence
  RNA Oligomer
ucuauuguguguucccuuucauc

SEQ ID NO: 45855 - RNA, 23 nt, Artificial Sequence
  RNA Oligomer
cuauuguguguucccuuucaucu

SEQ ID NO: 45856 - RNA, 23 nt, Artificial Sequence
  RNA Oligomer
uauuguguguucccuuucaucua

SEQ ID NO: 45857 - RNA, 23 nt, Artificial Sequence
  RNA Oligomer
uugauguacggguguuggagagc

SEQ ID NO: 45858 - RNA, 23 nt, Artificial Sequence
  RNA Oligomer
ugauguacggguguuggagagcu

SEQ ID NO: 45859 - RNA, 23 nt, Artificial Sequence
  RNA Oligomer
gauguacggguguuggagagcuu

SEQ ID NO: 45860 - RNA, 23 nt, Artificial Sequence
  RNA Oligomer
auguacggguguuggagagcuuc

SEQ ID NO: 45861 - RNA, 23 nt, Artificial Sequence
  RNA Oligomer
uucaucuacagagauccuuuuag

SEQ ID NO: 45862 - RNA, 23 nt, Artificial Sequence
  RNA Oligomer
ucaucuacagagauccuuuuaga

SEQ ID NO: 45863 - RNA, 23 nt, Artificial Sequence
  RNA Oligomer
caucuacagagauccuuuuagau

SEQ ID NO: 45864 - RNA, 23 nt, Artificial Sequence
  RNA Oligomer
aucuacagagauccuuuuagaug

SEQ ID NO: 45865 - RNA, 23 nt, Artificial Sequence
  RNA Oligomer
agagauccuuuuagaugcaucua

SEQ ID NO: 45866 - RNA, 23 nt, Artificial Sequence
  RNA Oligomer
uuucucaaagcuauauccagcau

SEQ ID NO: 45867 - RNA, 23 nt, Artificial Sequence
  RNA Oligomer
uacauaaggcgucaucauaaaac

SEQ ID NO: 45868 - RNA, 23 nt, Artificial Sequence
  RNA Oligomer
acauaaggcgucaucauaaaacu

SEQ ID NO: 45869 - RNA, 23 nt, Artificial Sequence
  RNA Oligomer
cauaaggcgucaucauaaaacuc

SEQ ID NO: 45870 - RNA, 23 nt, Artificial Sequence
  RNA Oligomer
auaaggcgucaucauaaaacucg

SEQ ID NO: 45871 - RNA, 23 nt, Artificial Sequence
  RNA Oligomer
uaaggcgucaucauaaaacucgu

SEQ ID NO: 45872 - RNA, 23 nt, Artificial Sequence
  RNA Oligomer
aaggcgucaucauaaaacucguu

SEQ ID NO: 45873 - RNA, 23 nt, Artificial Sequence
  RNA Oligomer
aggcgucaucauaaaacucguuc

SEQ ID NO: 45874 - RNA, 23 nt, Artificial Sequence
  RNA Oligomer
auguagaaucuccaaucucuaca

SEQ ID NO: 45875 - RNA, 23 nt, Artificial Sequence
  RNA Oligomer
caucauaaaacucguuccugcag

SEQ ID NO: 45876 - RNA, 23 nt, Artificial Sequence
  RNA Oligomer
aucauaaaacucguuccugcagu

SEQ ID NO: 45877 - RNA, 23 nt, Artificial Sequence
  RNA Oligomer
ucauaaaacucguuccugcaguc

SEQ ID NO: 45878 - RNA, 23 nt, Artificial Sequence
  RNA Oligomer
uguagaaucuccaaucucuacac

SEQ ID NO: 45879 - RNA, 23 nt, Artificial Sequence
  RNA Oligomer
gaagucaagaaucuucaaagugc

SEQ ID NO: 45880 - RNA, 23 nt, Artificial Sequence
  RNA Oligomer
aagucaagaaucuucaaagugca

SEQ ID NO: 45881 - RNA, 23 nt, Artificial Sequence
  RNA Oligomer
agucaagaaucuucaaagugcaa

SEQ ID NO: 45882 - RNA, 23 nt, Artificial Sequence
  RNA Oligomer
gucaagaaucuucaaagugcaau

SEQ ID NO: 45883 - RNA, 23 nt, Artificial Sequence
  RNA Oligomer
ucaagaaucuucaaagugcaauc

SEQ ID NO: 45884 - RNA, 23 nt, Artificial Sequence
  RNA Oligomer
caagaaucuucaaagugcaauca

SEQ ID NO: 45885 - RNA, 23 nt, Artificial Sequence
  RNA Oligomer
aagaaucuucaaagugcaaucag

SEQ ID NO: 45886 - RNA, 23 nt, Artificial Sequence
  RNA Oligomer
agaaucuucaaagugcaaucaga

SEQ ID NO: 45887 - RNA, 23 nt, Artificial Sequence
  RNA Oligomer
gaaucuucaaagugcaaucagau

SEQ ID NO: 45888 - RNA, 23 nt, Artificial Sequence
  RNA Oligomer
aaucuucaaagugcaaucagauu

SEQ ID NO: 45889 - RNA, 23 nt, Artificial Sequence
  RNA Oligomer
acuauaaaaauuguugucacgcu

SEQ ID NO: 45890 - RNA, 23 nt, Artificial Sequence
  RNA Oligomer
cuauaaaaauuguugucacgcuu

SEQ ID NO: 45891 - RNA, 23 nt, Artificial Sequence
  RNA Oligomer
uauaaaaauuguugucacgcuug

SEQ ID NO: 45892 - RNA, 23 nt, Artificial Sequence
  RNA Oligomer
uuaacacauuucauaagaacuag

SEQ ID NO: 45893 - RNA, 23 nt, Artificial Sequence
  RNA Oligomer
uaacacauuucauaagaacuagc

SEQ ID NO: 45894 - RNA, 23 nt, Artificial Sequence
  RNA Oligomer
aacacauuucauaagaacuagcu

SEQ ID NO: 45895 - RNA, 23 nt, Artificial Sequence
  RNA Oligomer
acacauuucauaagaacuagcuc

SEQ ID NO: 45896 - RNA, 23 nt, Artificial Sequence
  RNA Oligomer
ucuugauugcaacauuucuuuca

SEQ ID NO: 45897 - RNA, 23 nt, Artificial Sequence
  RNA Oligomer
cuugauugcaacauuucuuucaa

SEQ ID NO: 45898 - RNA, 23 nt, Artificial Sequence
  RNA Oligomer
uugauugcaacauuucuuucaag

SEQ ID NO: 45899 - RNA, 23 nt, Artificial Sequence
  RNA Oligomer
ugauugcaacauuucuuucaaga

SEQ ID NO: 45900 - RNA, 23 nt, Artificial Sequence
  RNA Oligomer
gauugcaacauuucuuucaagaa

SEQ ID NO: 45901 - RNA, 23 nt, Artificial Sequence
  RNA Oligomer
uucaaaguaguucuaucaaugac

SEQ ID NO: 45902 - RNA, 23 nt, Artificial Sequence
  RNA Oligomer
ucaaaguaguucuaucaaugacu

SEQ ID NO: 45903 - RNA, 23 nt, Artificial Sequence
  RNA Oligomer
caaaguaguucuaucaaugacua

SEQ ID NO: 45904 - RNA, 23 nt, Artificial Sequence
  RNA Oligomer
aaaguaguucuaucaaugacuaa

SEQ ID NO: 45905 - RNA, 23 nt, Artificial Sequence
  RNA Oligomer
aaguaguucuaucaaugacuaac

SEQ ID NO: 45906 - RNA, 23 nt, Artificial Sequence
  RNA Oligomer
aucauaagcugcgcauacuauuc

SEQ ID NO: 45907 - RNA, 23 nt, Artificial Sequence
  RNA Oligomer
cuguugacauugaagacacauca

SEQ ID NO: 45908 - RNA, 23 nt, Artificial Sequence
  RNA Oligomer
uguugacauugaagacacaucau

SEQ ID NO: 45909 - RNA, 23 nt, Artificial Sequence
  RNA Oligomer
guugacauugaagacacaucauu

SEQ ID NO: 45910 - RNA, 23 nt, Artificial Sequence
  RNA Oligomer
uugacauugaagacacaucauug

SEQ ID NO: 45911 - RNA, 23 nt, Artificial Sequence
  RNA Oligomer
agcugcgcauacuauuccuugag

SEQ ID NO: 45912 - RNA, 23 nt, Artificial Sequence
  RNA Oligomer
gcugcgcauacuauuccuugagc

SEQ ID NO: 45913 - RNA, 23 nt, Artificial Sequence
  RNA Oligomer
cugcgcauacuauuccuugagcu

SEQ ID NO: 45914 - RNA, 23 nt, Artificial Sequence
  RNA Oligomer
ugcgcauacuauuccuugagcuc

SEQ ID NO: 45915 - RNA, 23 nt, Artificial Sequence
  RNA Oligomer
ugagagccauugaucacugcugc

SEQ ID NO: 45916 - RNA, 23 nt, Artificial Sequence
  RNA Oligomer
gagagccauugaucacugcugca

SEQ ID NO: 45917 - RNA, 23 nt, Artificial Sequence
  RNA Oligomer
agagccauugaucacugcugcac

SEQ ID NO: 45918 - RNA, 23 nt, Artificial Sequence
  RNA Oligomer
gagccauugaucacugcugcacc

SEQ ID NO: 45919 - RNA, 23 nt, Artificial Sequence
  RNA Oligomer
agccauugaucacugcugcaccu

SEQ ID NO: 45920 - RNA, 23 nt, Artificial Sequence
  RNA Oligomer
uuauauaucaauucuuuccacuc

SEQ ID NO: 45921 - RNA, 23 nt, Artificial Sequence
  RNA Oligomer
uucuuuccacucuucuauugugu

SEQ ID NO: 45922 - RNA, 23 nt, Artificial Sequence
  RNA Oligomer
ucuuuccacucuucuauugugug

SEQ ID NO: 45923 - RNA, 23 nt, Artificial Sequence
  RNA Oligomer
uuccacucuucuauuguguguuc

SEQ ID NO: 45924 - RNA, 23 nt, Artificial Sequence
  RNA Oligomer
uuuuagaugcaucuauuaccagc

SEQ ID NO: 45925 - RNA, 23 nt, Artificial Sequence
  RNA Oligomer
uuuagaugcaucuauuaccagca

SEQ ID NO: 45926 - RNA, 23 nt, Artificial Sequence
  RNA Oligomer
uuagaugcaucuauuaccagcau

SEQ ID NO: 45927 - RNA, 23 nt, Artificial Sequence
  RNA Oligomer
uagaugcaucuauuaccagcauu

SEQ ID NO: 45928 - RNA, 23 nt, Artificial Sequence
  RNA Oligomer
agaugcaucuauuaccagcauuu

SEQ ID NO: 45929 - RNA, 23 nt, Artificial Sequence
  RNA Oligomer
auaucguuucaggacugugaaug

SEQ ID NO: 45930 - RNA, 23 nt, Artificial Sequence
  RNA Oligomer
uuuaggucuguuuucaacguaag

SEQ ID NO: 45931 - RNA, 23 nt, Artificial Sequence
  RNA Oligomer
uuuccuuguagcccaugccaagg

SEQ ID NO: 45932 - RNA, 23 nt, Artificial Sequence
  RNA Oligomer
aucuucaaagugcaaucagauuu

SEQ ID NO: 45933 - RNA, 23 nt, Artificial Sequence
  RNA Oligomer
ucuucaaagugcaaucagauuuu

SEQ ID NO: 45934 - RNA, 23 nt, Artificial Sequence
  RNA Oligomer
cuucaaagugcaaucagauuuua

SEQ ID NO: 45935 - RNA, 23 nt, Artificial Sequence
  RNA Oligomer
gucccgaugaauaauuccagcag

SEQ ID NO: 45936 - RNA, 23 nt, Artificial Sequence
  RNA Oligomer
ucccgaugaauaauuccagcaga

SEQ ID NO: 45937 - RNA, 23 nt, Artificial Sequence
  RNA Oligomer
gcaucugauagagaagguaggac

SEQ ID NO: 45938 - RNA, 23 nt, Artificial Sequence
  RNA Oligomer
caucugauagagaagguaggaca

SEQ ID NO: 45939 - RNA, 23 nt, Artificial Sequence
  RNA Oligomer
aucugauagagaagguaggacau

SEQ ID NO: 45940 - RNA, 23 nt, Artificial Sequence
  RNA Oligomer
ucugauagagaagguaggacauu

SEQ ID NO: 45941 - RNA, 23 nt, Artificial Sequence
  RNA Oligomer
cugauagagaagguaggacauuc

SEQ ID NO: 45942 - RNA, 23 nt, Artificial Sequence
  RNA Oligomer
cacuauaaaaauuguugucacgc

SEQ ID NO: 45943 - RNA, 23 nt, Artificial Sequence
  RNA Oligomer
gaagguaggacauucuuucauga

SEQ ID NO: 45944 - RNA, 23 nt, Artificial Sequence
  RNA Oligomer
aagguaggacauucuuucaugau

SEQ ID NO: 45945 - RNA, 23 nt, Artificial Sequence
  RNA Oligomer
agguaggacauucuuucaugauc

SEQ ID NO: 45946 - RNA, 23 nt, Artificial Sequence
  RNA Oligomer
gguaggacauucuuucaugaucu

SEQ ID NO: 45947 - RNA, 23 nt, Artificial Sequence
  RNA Oligomer
guaggacauucuuucaugaucua

SEQ ID NO: 45948 - RNA, 23 nt, Artificial Sequence
  RNA Oligomer
uaggacauucuuucaugaucuag

SEQ ID NO: 45949 - RNA, 23 nt, Artificial Sequence
  RNA Oligomer
aauuguugucacgcuugcuucug

SEQ ID NO: 45950 - RNA, 23 nt, Artificial Sequence
  RNA Oligomer
auuguugucacgcuugcuucugc

SEQ ID NO: 45951 - RNA, 23 nt, Artificial Sequence
  RNA Oligomer
uuguugucacgcuugcuucugcu

SEQ ID NO: 45952 - RNA, 23 nt, Artificial Sequence
  RNA Oligomer
uaaacaucuugaaauucuucuag

SEQ ID NO: 45953 - RNA, 23 nt, Artificial Sequence
  RNA Oligomer
aaacaucuugaaauucuucuagg

SEQ ID NO: 45954 - RNA, 23 nt, Artificial Sequence
  RNA Oligomer
aacaucuugaaauucuucuaggg

SEQ ID NO: 45955 - RNA, 23 nt, Artificial Sequence
  RNA Oligomer
acaucuugaaauucuucuaggga

SEQ ID NO: 45956 - RNA, 23 nt, Artificial Sequence
  RNA Oligomer
caucuugaaauucuucuagggau

SEQ ID NO: 45957 - RNA, 23 nt, Artificial Sequence
  RNA Oligomer
ucacccaaaaauaagaccacuga

SEQ ID NO: 45958 - RNA, 23 nt, Artificial Sequence
  RNA Oligomer
ccaaaaauaagaccacugaauug

SEQ ID NO: 45959 - RNA, 23 nt, Artificial Sequence
  RNA Oligomer
ucggaucuguugacauugaagac

SEQ ID NO: 45960 - RNA, 23 nt, Artificial Sequence
  RNA Oligomer
cggaucuguugacauugaagaca

SEQ ID NO: 45961 - RNA, 23 nt, Artificial Sequence
  RNA Oligomer
ggaucuguugacauugaagacac

SEQ ID NO: 45962 - RNA, 23 nt, Artificial Sequence
  RNA Oligomer
gaucuguugacauugaagacaca

SEQ ID NO: 45963 - RNA, 23 nt, Artificial Sequence
  RNA Oligomer
aucuguugacauugaagacacau

SEQ ID NO: 45964 - RNA, 23 nt, Artificial Sequence
  RNA Oligomer
ucuguugacauugaagacacauc

SEQ ID NO: 45965 - RNA, 23 nt, Artificial Sequence
  RNA Oligomer
aagacacaucauugacagacgac

SEQ ID NO: 45966 - RNA, 23 nt, Artificial Sequence
  RNA Oligomer
agacacaucauugacagacgacg

SEQ ID NO: 45967 - RNA, 23 nt, Artificial Sequence
  RNA Oligomer
gacacaucauugacagacgacga

SEQ ID NO: 45968 - RNA, 23 nt, Artificial Sequence
  RNA Oligomer
accagacauugauguacgggugu

SEQ ID NO: 45969 - RNA, 23 nt, Artificial Sequence
  RNA Oligomer
ccagacauugauguacggguguu

SEQ ID NO: 45970 - RNA, 23 nt, Artificial Sequence
  RNA Oligomer
cagacauugauguacggguguug

SEQ ID NO: 45971 - RNA, 23 nt, Artificial Sequence
  RNA Oligomer
gagauccuuuuagaugcaucuau

SEQ ID NO: 45972 - RNA, 23 nt, Artificial Sequence
  RNA Oligomer
agauccuuuuagaugcaucuauu

SEQ ID NO: 45973 - RNA, 23 nt, Artificial Sequence
  RNA Oligomer
gauccuuuuagaugcaucuauua

SEQ ID NO: 45974 - RNA, 23 nt, Artificial Sequence
  RNA Oligomer
auucugauaucguuucaggacug

SEQ ID NO: 45975 - RNA, 23 nt, Artificial Sequence
  RNA Oligomer
uucucaaagcuauauccagcaua

SEQ ID NO: 45976 - RNA, 23 nt, Artificial Sequence
  RNA Oligomer
uccagcauauuuaggucuguuuu

SEQ ID NO: 45977 - RNA, 23 nt, Artificial Sequence
  RNA Oligomer
guagaaucuccaaucucuacacu

SEQ ID NO: 45978 - RNA, 23 nt, Artificial Sequence
  RNA Oligomer
uagaaucuccaaucucuacacua

SEQ ID NO: 45979 - RNA, 23 nt, Artificial Sequence
  RNA Oligomer
agaaucuccaaucucuacacuau

SEQ ID NO: 45980 - RNA, 23 nt, Artificial Sequence
  RNA Oligomer
gaaucuccaaucucuacacuaua

SEQ ID NO: 45981 - RNA, 23 nt, Artificial Sequence
  RNA Oligomer
aaucuccaaucucuacacuauaa

SEQ ID NO: 45982 - RNA, 23 nt, Artificial Sequence
  RNA Oligomer
aauaauuccagcagaaugaaggu

SEQ ID NO: 45983 - RNA, 23 nt, Artificial Sequence
  RNA Oligomer
cuuucaugaucuagcuccaucug

SEQ ID NO: 45984 - RNA, 23 nt, Artificial Sequence
  RNA Oligomer
auccaugagcuccaugacuaugu

SEQ ID NO: 45985 - RNA, 23 nt, Artificial Sequence
  RNA Oligomer
uccaugagcuccaugacuaugua

SEQ ID NO: 45986 - RNA, 23 nt, Artificial Sequence
  RNA Oligomer
ccaugagcuccaugacuauguaa

SEQ ID NO: 45987 - RNA, 23 nt, Artificial Sequence
  RNA Oligomer
caugagcuccaugacuauguaaa

SEQ ID NO: 45988 - RNA, 23 nt, Artificial Sequence
  RNA Oligomer
augagcuccaugacuauguaaac

SEQ ID NO: 45989 - RNA, 23 nt, Artificial Sequence
  RNA Oligomer
ugugaaaacauucaaaaggccaa

SEQ ID NO: 45990 - RNA, 23 nt, Artificial Sequence
  RNA Oligomer
gugaaaacauucaaaaggccaau

SEQ ID NO: 45991 - RNA, 23 nt, Artificial Sequence
  RNA Oligomer
ugaaaacauucaaaaggccaauu

SEQ ID NO: 45992 - RNA, 23 nt, Artificial Sequence
  RNA Oligomer
gaaaacauucaaaaggccaauua

SEQ ID NO: 45993 - RNA, 23 nt, Artificial Sequence
  RNA Oligomer
aaaacauucaaaaggccaauuau

SEQ ID NO: 45994 - RNA, 23 nt, Artificial Sequence
  RNA Oligomer
agucugauucugaaauggucggc

SEQ ID NO: 45995 - RNA, 23 nt, Artificial Sequence
  RNA Oligomer
gucugauucugaaauggucggcu

SEQ ID NO: 45996 - RNA, 23 nt, Artificial Sequence
  RNA Oligomer
cauuucuuucaagaauggcauca

SEQ ID NO: 45997 - RNA, 23 nt, Artificial Sequence
  RNA Oligomer
auuucuuucaagaauggcaucau

SEQ ID NO: 45998 - RNA, 23 nt, Artificial Sequence
  RNA Oligomer
uuucuuucaagaauggcaucaua

SEQ ID NO: 45999 - RNA, 23 nt, Artificial Sequence
  RNA Oligomer
uucuuucaagaauggcaucauaa

SEQ ID NO: 46000 - RNA, 23 nt, Artificial Sequence
  RNA Oligomer
ucuuucaagaauggcaucauaag

SEQ ID NO: 46001 - RNA, 23 nt, Artificial Sequence
  RNA Oligomer
cacccaaaaauaagaccacugaa

SEQ ID NO: 46002 - RNA, 23 nt, Artificial Sequence
  RNA Oligomer
auaagaccacugaauuguuuuca

SEQ ID NO: 46003 - RNA, 23 nt, Artificial Sequence
  RNA Oligomer
uaagaccacugaauuguuuucaa

SEQ ID NO: 46004 - RNA, 23 nt, Artificial Sequence
  RNA Oligomer
aagaccacugaauuguuuucaaa

SEQ ID NO: 46005 - RNA, 23 nt, Artificial Sequence
  RNA Oligomer
agaccacugaauuguuuucaaag

SEQ ID NO: 46006 - RNA, 23 nt, Artificial Sequence
  RNA Oligomer
acacaucauugacagacgacgau

SEQ ID NO: 46007 - RNA, 23 nt, Artificial Sequence
  RNA Oligomer
cacaucauugacagacgacgaug

SEQ ID NO: 46008 - RNA, 23 nt, Artificial Sequence
  RNA Oligomer
acaucauugacagacgacgauga

SEQ ID NO: 46009 - RNA, 23 nt, Artificial Sequence
  RNA Oligomer
ucauugacagacgacgaugauga

SEQ ID NO: 46010 - RNA, 23 nt, Artificial Sequence
  RNA Oligomer
cauugacagacgacgaugaugau

SEQ ID NO: 46011 - RNA, 23 nt, Artificial Sequence
  RNA Oligomer
auugacagacgacgaugaugaug

SEQ ID NO: 46012 - RNA, 23 nt, Artificial Sequence
  RNA Oligomer
uugacagacgacgaugaugaugg

SEQ ID NO: 46013 - RNA, 23 nt, Artificial Sequence
  RNA Oligomer
ugacagacgacgaugaugaugga

SEQ ID NO: 46014 - RNA, 23 nt, Artificial Sequence
  RNA Oligomer
gacgacgaugaugauggaugcug

SEQ ID NO: 46015 - RNA, 23 nt, Artificial Sequence
  RNA Oligomer
acgacgaugaugauggaugcuga

SEQ ID NO: 46016 - RNA, 23 nt, Artificial Sequence
  RNA Oligomer
cgacgaugaugauggaugcugag

SEQ ID NO: 46017 - RNA, 23 nt, Artificial Sequence
  RNA Oligomer
gacgaugaugauggaugcugaga

SEQ ID NO: 46018 - RNA, 23 nt, Artificial Sequence
  RNA Oligomer
acgaugaugauggaugcugagag

SEQ ID NO: 46019 - RNA, 23 nt, Artificial Sequence
  RNA Oligomer
ugcugagagccauugaucacugc

SEQ ID NO: 46020 - RNA, 23 nt, Artificial Sequence
  RNA Oligomer
gcugagagccauugaucacugcu

SEQ ID NO: 46021 - RNA, 23 nt, Artificial Sequence
  RNA Oligomer
cugagagccauugaucacugcug

SEQ ID NO: 46022 - RNA, 23 nt, Artificial Sequence
  RNA Oligomer
ucuucuauuguguguucccuuuc

SEQ ID NO: 46023 - RNA, 23 nt, Artificial Sequence
  RNA Oligomer
augcaucuauuaccagcauuuug

SEQ ID NO: 46024 - RNA, 23 nt, Artificial Sequence
  RNA Oligomer
ugcaucuauuaccagcauuuugg

SEQ ID NO: 46025 - RNA, 23 nt, Artificial Sequence
  RNA Oligomer
gcaucuauuaccagcauuuugga

SEQ ID NO: 46026 - RNA, 23 nt, Artificial Sequence
  RNA Oligomer
caucuauuaccagcauuuuggau

SEQ ID NO: 46027 - RNA, 23 nt, Artificial Sequence
  RNA Oligomer
aucuauuaccagcauuuuggaua

SEQ ID NO: 46028 - RNA, 23 nt, Artificial Sequence
  RNA Oligomer
uuuggauaacaaaucccuugccu

SEQ ID NO: 46029 - RNA, 23 nt, Artificial Sequence
  RNA Oligomer
uuggauaacaaaucccuugccug

SEQ ID NO: 46030 - RNA, 23 nt, Artificial Sequence
  RNA Oligomer
uggauaacaaaucccuugccuga

SEQ ID NO: 46031 - RNA, 23 nt, Artificial Sequence
  RNA Oligomer
ggauaacaaaucccuugccugac

SEQ ID NO: 46032 - RNA, 23 nt, Artificial Sequence
  RNA Oligomer
gauaacaaaucccuugccugacu

SEQ ID NO: 46033 - RNA, 23 nt, Artificial Sequence
  RNA Oligomer
auaacaaaucccuugccugacug

SEQ ID NO: 46034 - RNA, 23 nt, Artificial Sequence
  RNA Oligomer
cuguuuucaacguaaguccuuac

SEQ ID NO: 46035 - RNA, 23 nt, Artificial Sequence
  RNA Oligomer
uguuuucaacguaaguccuuacu

SEQ ID NO: 46036 - RNA, 23 nt, Artificial Sequence
  RNA Oligomer
guuuucaacguaaguccuuacug

SEQ ID NO: 46037 - RNA, 23 nt, Artificial Sequence
  RNA Oligomer
uuuucaacguaaguccuuacugu

SEQ ID NO: 46038 - RNA, 23 nt, Artificial Sequence
  RNA Oligomer
uuucaacguaaguccuuacuguu

SEQ ID NO: 46039 - RNA, 23 nt, Artificial Sequence
  RNA Oligomer
accgaagucaagaaucuucaaag

SEQ ID NO: 46040 - RNA, 23 nt, Artificial Sequence
  RNA Oligomer
ccgaagucaagaaucuucaaagu

SEQ ID NO: 46041 - RNA, 23 nt, Artificial Sequence
  RNA Oligomer
cgaagucaagaaucuucaaagug

SEQ ID NO: 46042 - RNA, 23 nt, Artificial Sequence
  RNA Oligomer
uucuugauugcaacauuucuuuc

SEQ ID NO: 46043 - RNA, 23 nt, Artificial Sequence
  RNA Oligomer
acccaaaaauaagaccacugaau

SEQ ID NO: 46044 - RNA, 23 nt, Artificial Sequence
  RNA Oligomer
cccaaaaauaagaccacugaauu

SEQ ID NO: 46045 - RNA, 23 nt, Artificial Sequence
  RNA Oligomer
caaugacuaaccgacuccccauc

SEQ ID NO: 46046 - RNA, 23 nt, Artificial Sequence
  RNA Oligomer
cagacgacgaugaugauggaugc

SEQ ID NO: 46047 - RNA, 23 nt, Artificial Sequence
  RNA Oligomer
agacgacgaugaugauggaugcu

SEQ ID NO: 46048 - RNA, 23 nt, Artificial Sequence
  RNA Oligomer
gccauugaucacugcugcaccua

SEQ ID NO: 46049 - RNA, 23 nt, Artificial Sequence
  RNA Oligomer
ccauugaucacugcugcaccuaa

SEQ ID NO: 46050 - RNA, 23 nt, Artificial Sequence
  RNA Oligomer
cauugaucacugcugcaccuaaa

SEQ ID NO: 46051 - RNA, 23 nt, Artificial Sequence
  RNA Oligomer
auugaucacugcugcaccuaaag

SEQ ID NO: 46052 - RNA, 23 nt, Artificial Sequence
  RNA Oligomer
ucccuuucaucuaacugcuuguc

SEQ ID NO: 46053 - RNA, 23 nt, Artificial Sequence
  RNA Oligomer
cccuuucaucuaacugcuuguca

SEQ ID NO: 46054 - RNA, 23 nt, Artificial Sequence
  RNA Oligomer
ccuuucaucuaacugcuugucag

SEQ ID NO: 46055 - RNA, 23 nt, Artificial Sequence
  RNA Oligomer
cuuucaucuaacugcuugucagg

SEQ ID NO: 46056 - RNA, 23 nt, Artificial Sequence
  RNA Oligomer
uuucaucuaacugcuugucaggg

SEQ ID NO: 46057 - RNA, 23 nt, Artificial Sequence
  RNA Oligomer
cuucugcuucagaaggaucauac

SEQ ID NO: 46058 - RNA, 23 nt, Artificial Sequence
  RNA Oligomer
uucugcuucagaaggaucauacc

SEQ ID NO: 46059 - RNA, 23 nt, Artificial Sequence
  RNA Oligomer
ucugcuucagaaggaucauacca

SEQ ID NO: 46060 - RNA, 23 nt, Artificial Sequence
  RNA Oligomer
cugcuucagaaggaucauaccag

SEQ ID NO: 46061 - RNA, 23 nt, Artificial Sequence
  RNA Oligomer
ugcuucagaaggaucauaccaga

SEQ ID NO: 46062 - RNA, 23 nt, Artificial Sequence
  RNA Oligomer
aaagcuauauccagcauauuuag

SEQ ID NO: 46063 - RNA, 23 nt, Artificial Sequence
  RNA Oligomer
uugcaguuucuucaugaauucag

SEQ ID NO: 46064 - RNA, 23 nt, Artificial Sequence
  RNA Oligomer
guaguagcgagucacuacauaag

SEQ ID NO: 46065 - RNA, 23 nt, Artificial Sequence
  RNA Oligomer
uaguagcgagucacuacauaagg

SEQ ID NO: 46066 - RNA, 23 nt, Artificial Sequence
  RNA Oligomer
aguagcgagucacuacauaaggc

SEQ ID NO: 46067 - RNA, 23 nt, Artificial Sequence
  RNA Oligomer
guagcgagucacuacauaaggcg

SEQ ID NO: 46068 - RNA, 23 nt, Artificial Sequence
  RNA Oligomer
uagcgagucacuacauaaggcgu

SEQ ID NO: 46069 - RNA, 23 nt, Artificial Sequence
  RNA Oligomer
cauaaaacucguuccugcagucc

SEQ ID NO: 46070 - RNA, 23 nt, Artificial Sequence
  RNA Oligomer
auaaaacucguuccugcaguccu

SEQ ID NO: 46071 - RNA, 23 nt, Artificial Sequence
  RNA Oligomer
ugauagagaagguaggacauucu

SEQ ID NO: 46072 - RNA, 23 nt, Artificial Sequence
  RNA Oligomer
uuucaugaucuagcuccaucuga

SEQ ID NO: 46073 - RNA, 23 nt, Artificial Sequence
  RNA Oligomer
uucaugaucuagcuccaucugaa

SEQ ID NO: 46074 - RNA, 23 nt, Artificial Sequence
  RNA Oligomer
ucaugaucuagcuccaucugaau

SEQ ID NO: 46075 - RNA, 23 nt, Artificial Sequence
  RNA Oligomer
cgaugaugauggaugcugagagc

SEQ ID NO: 46076 - RNA, 23 nt, Artificial Sequence
  RNA Oligomer
gaugaugauggaugcugagagcc

SEQ ID NO: 46077 - RNA, 23 nt, Artificial Sequence
  RNA Oligomer
augaugauggaugcugagagcca

SEQ ID NO: 46078 - RNA, 23 nt, Artificial Sequence
  RNA Oligomer
ugaugauggaugcugagagccau

SEQ ID NO: 46079 - RNA, 23 nt, Artificial Sequence
  RNA Oligomer
gaugauggaugcugagagccauu

SEQ ID NO: 46080 - RNA, 23 nt, Artificial Sequence
  RNA Oligomer
cuccuccaaguccauaacuuccu

SEQ ID NO: 46081 - RNA, 23 nt, Artificial Sequence
  RNA Oligomer
uccuccaaguccauaacuuccuu

SEQ ID NO: 46082 - RNA, 23 nt, Artificial Sequence
  RNA Oligomer
ccuccaaguccauaacuuccuua

SEQ ID NO: 46083 - RNA, 23 nt, Artificial Sequence
  RNA Oligomer
cuccaaguccauaacuuccuuau

SEQ ID NO: 46084 - RNA, 23 nt, Artificial Sequence
  RNA Oligomer
uccaaguccauaacuuccuuaua

SEQ ID NO: 46085 - RNA, 23 nt, Artificial Sequence
  RNA Oligomer
ccaaguccauaacuuccuuauau

SEQ ID NO: 46086 - RNA, 23 nt, Artificial Sequence
  RNA Oligomer
caaguccauaacuuccuuauaua

SEQ ID NO: 46087 - RNA, 23 nt, Artificial Sequence
  RNA Oligomer
aaguccauaacuuccuuauauau

SEQ ID NO: 46088 - RNA, 23 nt, Artificial Sequence
  RNA Oligomer
auuguguguucccuuucaucuaa

SEQ ID NO: 46089 - RNA, 23 nt, Artificial Sequence
  RNA Oligomer
ucuguuuucaacguaaguccuua

SEQ ID NO: 46090 - RNA, 23 nt, Artificial Sequence
  RNA Oligomer
auccacguuuuccuuguagccca

SEQ ID NO: 46091 - RNA, 23 nt, Artificial Sequence
  RNA Oligomer
uccacguuuuccuuguagcccau

SEQ ID NO: 46092 - RNA, 23 nt, Artificial Sequence
  RNA Oligomer
ccacguuuuccuuguagcccaug

SEQ ID NO: 46093 - RNA, 23 nt, Artificial Sequence
  RNA Oligomer
agcgagucacuacauaaggcguc

SEQ ID NO: 46094 - RNA, 23 nt, Artificial Sequence
  RNA Oligomer
gcgagucacuacauaaggcguca

SEQ ID NO: 46095 - RNA, 23 nt, Artificial Sequence
  RNA Oligomer
acuacuauauuacugggcuuuaa

SEQ ID NO: 46096 - RNA, 23 nt, Artificial Sequence
  RNA Oligomer
cuacuauauuacugggcuuuaag

SEQ ID NO: 46097 - RNA, 23 nt, Artificial Sequence
  RNA Oligomer
uacuauauuacugggcuuuaagu

SEQ ID NO: 46098 - RNA, 23 nt, Artificial Sequence
  RNA Oligomer
caugaucuagcuccaucugaauc

SEQ ID NO: 46099 - RNA, 23 nt, Artificial Sequence
  RNA Oligomer
uauaacuccauucuugguucucu

SEQ ID NO: 46100 - RNA, 23 nt, Artificial Sequence
  RNA Oligomer
uaacuccauucuugguucucucc

SEQ ID NO: 46101 - RNA, 23 nt, Artificial Sequence
  RNA Oligomer
aagcuguucaauaacuuuauucc

SEQ ID NO: 46102 - RNA, 23 nt, Artificial Sequence
  RNA Oligomer
guauaacuccauucuugguucuc

SEQ ID NO: 46103 - RNA, 23 nt, Artificial Sequence
  RNA Oligomer
acacuauaaaaauuguugucacg

SEQ ID NO: 46104 - RNA, 23 nt, Artificial Sequence
  RNA Oligomer
ccuuauauaucaauucuuuccac

SEQ ID NO: 46105 - RNA, 23 nt, Artificial Sequence
  RNA Oligomer
ucuccuccaaguccauaacuucc

SEQ ID NO: 46106 - RNA, 23 nt, Artificial Sequence
  RNA Oligomer
auuuuggauaacaaaucccuugc

SEQ ID NO: 46107 - RNA, 23 nt, Artificial Sequence
  RNA Oligomer
guugcaguuucuucaugaauuca

SEQ ID NO: 46108 - RNA, 23 nt, Artificial Sequence
  RNA Oligomer
uuccaagcuguucaauaacuuua

SEQ ID NO: 46109 - RNA, 23 nt, Artificial Sequence
  RNA Oligomer
caagcuguucaauaacuuuauuc

SEQ ID NO: 46110 - RNA, 23 nt, Artificial Sequence
  RNA Oligomer
agcuguucaauaacuuuauucca

SEQ ID NO: 46111 - RNA, 23 nt, Artificial Sequence
  RNA Oligomer
guucaauaacuuuauuccacuga

SEQ ID NO: 46112 - RNA, 23 nt, Artificial Sequence
  RNA Oligomer
caauaacuuuauuccacugauca

SEQ ID NO: 46113 - RNA, 23 nt, Artificial Sequence
  RNA Oligomer
aucuagcuccaucugaaucacuu

SEQ ID NO: 46114 - RNA, 23 nt, Artificial Sequence
  RNA Oligomer
uucucuccuccaaguccauaacu

SEQ ID NO: 46115 - RNA, 23 nt, Artificial Sequence
  RNA Oligomer
guguguucccuuucaucuaacug

SEQ ID NO: 46116 - RNA, 23 nt, Artificial Sequence
  RNA Oligomer
auucaggacaugguguuccaagc

SEQ ID NO: 46117 - RNA, 23 nt, Artificial Sequence
  RNA Oligomer
uguucaauaacuuuauuccacug

SEQ ID NO: 46118 - RNA, 23 nt, Artificial Sequence
  RNA Oligomer
ugauucugaaauggucggcuuag

SEQ ID NO: 46119 - RNA, 23 nt, Artificial Sequence
  RNA Oligomer
gcuguucaauaacuuuauuccac

SEQ ID NO: 46120 - RNA, 23 nt, Artificial Sequence
  RNA Oligomer
cagaaggaucauaccagacauug

SEQ ID NO: 46121 - RNA, 23 nt, Artificial Sequence
  RNA Oligomer
uuucuguggugugaaaacauuca

SEQ ID NO: 46122 - RNA, 23 nt, Artificial Sequence
  RNA Oligomer
uauuaccagcauuuuggauaaca

SEQ ID NO: 46123 - RNA, 23 nt, Artificial Sequence
  RNA Oligomer
uucuucaugaauucaggacaugg

SEQ ID NO: 46124 - RNA, 23 nt, Artificial Sequence
  RNA Oligomer
ucuucuagggauuucuguggugu

SEQ ID NO: 46125 - RNA, 23 nt, Artificial Sequence
  RNA Oligomer
ucacuuggcaaagauuugcaucc

SEQ ID NO: 46126 - RNA, 23 nt, Artificial Sequence
  RNA Oligomer
ucauaagaacuagcucucuguag

SEQ ID NO: 46127 - RNA, 23 nt, Artificial Sequence
  RNA Oligomer
uugccugacuggcuuuaaguuug

SEQ ID NO: 46128 - RNA, 23 nt, Artificial Sequence
  RNA Oligomer
uuacuguugguugcaguuucuuc

SEQ ID NO: 46129 - RNA, 23 nt, Artificial Sequence
  RNA Oligomer
gaauaauuccagcagaaugaagg

SEQ ID NO: 46130 - RNA, 23 nt, Artificial Sequence
  RNA Oligomer
cuucuagggauuucuguggugug

SEQ ID NO: 46131 - RNA, 23 nt, Artificial Sequence
  RNA Oligomer
uuuuggauaacaaaucccuugcc

SEQ ID NO: 46132 - RNA, 23 nt, Artificial Sequence
  RNA Oligomer
uuaaauucugauaucguuucagg

SEQ ID NO: 46133 - RNA, 23 nt, Artificial Sequence
  RNA Oligomer
aauucaggacaugguguuccaag

SEQ ID NO: 46134 - RNA, 23 nt, Artificial Sequence
  RNA Oligomer
auauuacugggcuuuaagucccg

SEQ ID NO: 46135 - RNA, 23 nt, Artificial Sequence
  RNA Oligomer
uacugggcuuuaagucccgauga

SEQ ID NO: 46136 - RNA, 23 nt, Artificial Sequence
  RNA Oligomer
aacuccauucuugguucucuccu

SEQ ID NO: 46137 - RNA, 23 nt, Artificial Sequence
  RNA Oligomer
auccuuuuagaugcaucuauuac

SEQ ID NO: 46138 - RNA, 23 nt, Artificial Sequence
  RNA Oligomer
cauuuuggauaacaaaucccuug

SEQ ID NO: 46139 - RNA, 23 nt, Artificial Sequence
  RNA Oligomer
aaauucugauaucguuucaggac

SEQ ID NO: 46140 - RNA, 23 nt, Artificial Sequence
  RNA Oligomer
aucguuucaggacugugaaugua

SEQ ID NO: 46141 - RNA, 23 nt, Artificial Sequence
  RNA Oligomer
cuuuuagaugcaucuauuaccag

SEQ ID NO: 46142 - RNA, 23 nt, Artificial Sequence
  RNA Oligomer
uaaauucugauaucguuucagga

SEQ ID NO: 46143 - RNA, 23 nt, Artificial Sequence
  RNA Oligomer
aucacuuggcaaagauuugcauc

SEQ ID NO: 46144 - RNA, 23 nt, Artificial Sequence
  RNA Oligomer
auuucuguggugugaaaacauuc

SEQ ID NO: 46145 - RNA, 23 nt, Artificial Sequence
  RNA Oligomer
aacugcuugucagggaucuuugg

SEQ ID NO: 46146 - RNA, 23 nt, Artificial Sequence
  RNA Oligomer
agcauuuuggauaacaaaucccu

SEQ ID NO: 46147 - RNA, 23 nt, Artificial Sequence
  RNA Oligomer
auucugaaauggucggcuuagcu

SEQ ID NO: 46148 - RNA, 23 nt, Artificial Sequence
  RNA Oligomer
uucugaaauggucggcuuagcuu

SEQ ID NO: 46149 - RNA, 23 nt, Artificial Sequence
  RNA Oligomer
acgcuugcuucugcucaugaugg

SEQ ID NO: 46150 - RNA, 23 nt, Artificial Sequence
  RNA Oligomer
aaguagucaucuacagcagccca

SEQ ID NO: 46151 - RNA, 23 nt, Artificial Sequence
  RNA Oligomer
aaagucggaucuguugacauuga

SEQ ID NO: 46152 - RNA, 23 nt, Artificial Sequence
  RNA Oligomer
auuccuugagcuccugagccuau

SEQ ID NO: 46153 - RNA, 23 nt, Artificial Sequence
  RNA Oligomer
uucaggacaugguguuccaagcu

SEQ ID NO: 46154 - RNA, 23 nt, Artificial Sequence
  RNA Oligomer
uauuacugggcuuuaagucccga

SEQ ID NO: 46155 - RNA, 23 nt, Artificial Sequence
  RNA Oligomer
uuacugggcuuuaagucccgaug

SEQ ID NO: 46156 - RNA, 23 nt, Artificial Sequence
  RNA Oligomer
aaucacuuggcaaagauuugcau

SEQ ID NO: 46157 - RNA, 23 nt, Artificial Sequence
  RNA Oligomer
auggcccaaguagucaucuacag

SEQ ID NO: 46158 - RNA, 23 nt, Artificial Sequence
  RNA Oligomer
uucuagacugcugucuguaucag

SEQ ID NO: 46159 - RNA, 23 nt, Artificial Sequence
  RNA Oligomer
acguaaguccuuacuguugguug

SEQ ID NO: 46160 - RNA, 23 nt, Artificial Sequence
  RNA Oligomer
aaaacucguuccugcaguccugg

SEQ ID NO: 46161 - RNA, 23 nt, Artificial Sequence
  RNA Oligomer
uauauuacugggcuuuaaguccc

SEQ ID NO: 46162 - RNA, 23 nt, Artificial Sequence
  RNA Oligomer
auuacugggcuuuaagucccgau

SEQ ID NO: 46163 - RNA, 23 nt, Artificial Sequence
  RNA Oligomer
guugucacgcuugcuucugcuca

SEQ ID NO: 46164 - RNA, 23 nt, Artificial Sequence
  RNA Oligomer
aucuuuggugguggagcuucugc

SEQ ID NO: 46165 - RNA, 23 nt, Artificial Sequence
  RNA Oligomer
agaaggaucauaccagacauuga

SEQ ID NO: 46166 - RNA, 23 nt, Artificial Sequence
  RNA Oligomer
cagcauuuuggauaacaaauccc

SEQ ID NO: 46167 - RNA, 23 nt, Artificial Sequence
  RNA Oligomer
agccuauagguuuuaaauucuga

SEQ ID NO: 46168 - RNA, 23 nt, Artificial Sequence
  RNA Oligomer
aucagggaagaguuucucaaagc

SEQ ID NO: 46169 - RNA, 23 nt, Artificial Sequence
  RNA Oligomer
uaucguuucaggacugugaaugu

SEQ ID NO: 46170 - RNA, 23 nt, Artificial Sequence
  RNA Oligomer
ucuucaugaauucaggacauggu

SEQ ID NO: 46171 - RNA, 23 nt, Artificial Sequence
  RNA Oligomer
ugaaauucuucuagggauuucug

SEQ ID NO: 46172 - RNA, 23 nt, Artificial Sequence
  RNA Oligomer
ccaaguagucaucuacagcagcc

SEQ ID NO: 46173 - RNA, 23 nt, Artificial Sequence
  RNA Oligomer
gucuguaucagaggccaaagucg

SEQ ID NO: 46174 - RNA, 23 nt, Artificial Sequence
  RNA Oligomer
cuccauucuugguucucuccucc

SEQ ID NO: 46175 - RNA, 23 nt, Artificial Sequence
  RNA Oligomer
agagcuucaucuacagagauccu

SEQ ID NO: 46176 - RNA, 23 nt, Artificial Sequence
  RNA Oligomer
gagccuauagguuuuaaauucug

SEQ ID NO: 46177 - RNA, 23 nt, Artificial Sequence
  RNA Oligomer
uucaacguaaguccuuacuguug

SEQ ID NO: 46178 - RNA, 23 nt, Artificial Sequence
  RNA Oligomer
uaaaacucguuccugcaguccug

SEQ ID NO: 46179 - RNA, 23 nt, Artificial Sequence
  RNA Oligomer
cuauauuacugggcuuuaagucc

SEQ ID NO: 46180 - RNA, 23 nt, Artificial Sequence
  RNA Oligomer
ugaauaauuccagcagaaugaag

SEQ ID NO: 46181 - RNA, 23 nt, Artificial Sequence
  RNA Oligomer
auuugcauccaugagcuccauga

SEQ ID NO: 46182 - RNA, 23 nt, Artificial Sequence
  RNA Oligomer
uguugucacgcuugcuucugcuc

SEQ ID NO: 46183 - RNA, 23 nt, Artificial Sequence
  RNA Oligomer
uggaugcugagagccauugauca

SEQ ID NO: 46184 - RNA, 23 nt, Artificial Sequence
  RNA Oligomer
cuuuccacucuucuauugugugu

SEQ ID NO: 46185 - RNA, 23 nt, Artificial Sequence
  RNA Oligomer
uugagcuccugagccuauagguu

SEQ ID NO: 46186 - RNA, 23 nt, Artificial Sequence
  RNA Oligomer
auuaccagcauuuuggauaacaa

SEQ ID NO: 46187 - RNA, 23 nt, Artificial Sequence
  RNA Oligomer
ucagggaagaguuucucaaagcu

SEQ ID NO: 46188 - RNA, 23 nt, Artificial Sequence
  RNA Oligomer
uaaguccuuacuguugguugcag

SEQ ID NO: 46189 - RNA, 23 nt, Artificial Sequence
  RNA Oligomer
augaaggugcuugauuccacaca

SEQ ID NO: 46190 - RNA, 23 nt, Artificial Sequence
  RNA Oligomer
uuccacacagcaucugauagaga

SEQ ID NO: 46191 - RNA, 23 nt, Artificial Sequence
  RNA Oligomer
acagcaucugauagagaagguag

SEQ ID NO: 46192 - RNA, 23 nt, Artificial Sequence
  RNA Oligomer
uugcauccaugagcuccaugacu

SEQ ID NO: 46193 - RNA, 23 nt, Artificial Sequence
  RNA Oligomer
uugaaauucuucuagggauuucu

SEQ ID NO: 46194 - RNA, 23 nt, Artificial Sequence
  RNA Oligomer
uagcuucuugauugcaacauuuc

SEQ ID NO: 46195 - RNA, 23 nt, Artificial Sequence
  RNA Oligomer
uuuggugguggagcuucugcuuc

SEQ ID NO: 46196 - RNA, 23 nt, Artificial Sequence
  RNA Oligomer
uguacggguguuggagagcuuca

SEQ ID NO: 46197 - RNA, 23 nt, Artificial Sequence
  RNA Oligomer
cguaaguccuuacuguugguugc

SEQ ID NO: 46198 - RNA, 23 nt, Artificial Sequence
  RNA Oligomer
agucacuacauaaggcgucauca

SEQ ID NO: 46199 - RNA, 23 nt, Artificial Sequence
  RNA Oligomer
agucugauucugaaauggucggc

SEQ ID NO: 46200 - RNA, 23 nt, Artificial Sequence
  RNA Oligomer
gucugauucugaaauggucggcu

SEQ ID NO: 46201 - RNA, 23 nt, Artificial Sequence
  RNA Oligomer
ucugauucugaaauggucggcuu

SEQ ID NO: 46202 - RNA, 23 nt, Artificial Sequence
  RNA Oligomer
cugauucugaaauggucggcuua

SEQ ID NO: 46203 - RNA, 23 nt, Artificial Sequence
  RNA Oligomer
ugauucugaaauggucggcuuag

SEQ ID NO: 46204 - RNA, 23 nt, Artificial Sequence
  RNA Oligomer
cacuuggcaaagauuugcaucca

SEQ ID NO: 46205 - RNA, 23 nt, Artificial Sequence
  RNA Oligomer
acuuggcaaagauuugcauccau

SEQ ID NO: 46206 - RNA, 23 nt, Artificial Sequence
  RNA Oligomer
cuuggcaaagauuugcauccaug

SEQ ID NO: 46207 - RNA, 23 nt, Artificial Sequence
  RNA Oligomer
uuggcaaagauuugcauccauga

SEQ ID NO: 46208 - RNA, 23 nt, Artificial Sequence
  RNA Oligomer
uggcaaagauuugcauccaugag

SEQ ID NO: 46209 - RNA, 23 nt, Artificial Sequence
  RNA Oligomer
ggaccuaaaaccuaguaaucuag

SEQ ID NO: 46210 - RNA, 23 nt, Artificial Sequence
  RNA Oligomer
gggaccuaaaaccuaguaaucua

SEQ ID NO: 46211 - RNA, 23 nt, Artificial Sequence
  RNA Oligomer
agggaccuaaaaccuaguaaucu

SEQ ID NO: 46212 - RNA, 23 nt, Artificial Sequence
  RNA Oligomer
cagggaccuaaaaccuaguaauc

SEQ ID NO: 46213 - RNA, 23 nt, Artificial Sequence
  RNA Oligomer
acagggaccuaaaaccuaguaau

SEQ ID NO: 46214 - RNA, 23 nt, Artificial Sequence
  RNA Oligomer
ggaauucaaugauguguaucugg

SEQ ID NO: 46215 - RNA, 23 nt, Artificial Sequence
  RNA Oligomer
aggaauucaaugauguguaucug

SEQ ID NO: 46216 - RNA, 23 nt, Artificial Sequence
  RNA Oligomer
gaggaauucaaugauguguaucu

SEQ ID NO: 46217 - RNA, 23 nt, Artificial Sequence
  RNA Oligomer
ggaggaauucaaugauguguauc

SEQ ID NO: 46218 - RNA, 23 nt, Artificial Sequence
  RNA Oligomer
uggaggaauucaaugauguguau

SEQ ID NO: 46219 - RNA, 23 nt, Artificial Sequence
  RNA Oligomer
ccuaaaaccuaguaaucuagcug

SEQ ID NO: 46220 - RNA, 23 nt, Artificial Sequence
  RNA Oligomer
accuaaaaccuaguaaucuagcu

SEQ ID NO: 46221 - RNA, 23 nt, Artificial Sequence
  RNA Oligomer
gaccuaaaaccuaguaaucuagc

SEQ ID NO: 46222 - RNA, 23 nt, Artificial Sequence
  RNA Oligomer
gggcagaucugaacaacauugug

SEQ ID NO: 46223 - RNA, 23 nt, Artificial Sequence
  RNA Oligomer
ggggcagaucugaacaacauugu

SEQ ID NO: 46224 - RNA, 23 nt, Artificial Sequence
  RNA Oligomer
gggggcagaucugaacaacauug

SEQ ID NO: 46225 - RNA, 23 nt, Artificial Sequence
  RNA Oligomer
ugggggcagaucugaacaacauu

SEQ ID NO: 46226 - RNA, 23 nt, Artificial Sequence
  RNA Oligomer
augggggcagaucugaacaacau

SEQ ID NO: 46227 - RNA, 23 nt, Artificial Sequence
  RNA Oligomer
ccauuucaguccaucauucaugc

SEQ ID NO: 46228 - RNA, 23 nt, Artificial Sequence
  RNA Oligomer
accauuucaguccaucauucaug

SEQ ID NO: 46229 - RNA, 23 nt, Artificial Sequence
  RNA Oligomer
gaccauuucaguccaucauucau

SEQ ID NO: 46230 - RNA, 23 nt, Artificial Sequence
  RNA Oligomer
agaccauuucaguccaucauuca

SEQ ID NO: 46231 - RNA, 23 nt, Artificial Sequence
  RNA Oligomer
cagaccauuucaguccaucauuc

SEQ ID NO: 46232 - RNA, 23 nt, Artificial Sequence
  RNA Oligomer
ccaucauucaugcgaaaagaacc

SEQ ID NO: 46233 - RNA, 23 nt, Artificial Sequence
  RNA Oligomer
uccaucauucaugcgaaaagaac

SEQ ID NO: 46234 - RNA, 23 nt, Artificial Sequence
  RNA Oligomer
guccaucauucaugcgaaaagaa

SEQ ID NO: 46235 - RNA, 23 nt, Artificial Sequence
  RNA Oligomer
aguccaucauucaugcgaaaaga

SEQ ID NO: 46236 - RNA, 23 nt, Artificial Sequence
  RNA Oligomer
caguccaucauucaugcgaaaag

SEQ ID NO: 46237 - RNA, 23 nt, Artificial Sequence
  RNA Oligomer
cuggaggaauucaaugaugugua

SEQ ID NO: 46238 - RNA, 23 nt, Artificial Sequence
  RNA Oligomer
agaacauuguuuccugguacaga

SEQ ID NO: 46239 - RNA, 23 nt, Artificial Sequence
  RNA Oligomer
aagaacauuguuuccugguacag

SEQ ID NO: 46240 - RNA, 23 nt, Artificial Sequence
  RNA Oligomer
gaagaacauuguuuccugguaca

SEQ ID NO: 46241 - RNA, 23 nt, Artificial Sequence
  RNA Oligomer
ggaagaacauuguuuccugguac

SEQ ID NO: 46242 - RNA, 23 nt, Artificial Sequence
  RNA Oligomer
uggaagaacauuguuuccuggua

SEQ ID NO: 46243 - RNA, 23 nt, Artificial Sequence
  RNA Oligomer
ggcacacagaugaugaaaugaca

SEQ ID NO: 46244 - RNA, 23 nt, Artificial Sequence
  RNA Oligomer
cggcacacagaugaugaaaugac

SEQ ID NO: 46245 - RNA, 23 nt, Artificial Sequence
  RNA Oligomer
ucggcacacagaugaugaaauga

SEQ ID NO: 46246 - RNA, 23 nt, Artificial Sequence
  RNA Oligomer
cucggcacacagaugaugaaaug

SEQ ID NO: 46247 - RNA, 23 nt, Artificial Sequence
  RNA Oligomer
gcucggcacacagaugaugaaau

SEQ ID NO: 46248 - RNA, 23 nt, Artificial Sequence
  RNA Oligomer
gcugaagauucuggauuuuggac

SEQ ID NO: 46249 - RNA, 23 nt, Artificial Sequence
  RNA Oligomer
agcugaagauucuggauuuugga

SEQ ID NO: 46250 - RNA, 23 nt, Artificial Sequence
  RNA Oligomer
gagcugaagauucuggauuuugg

SEQ ID NO: 46251 - RNA, 23 nt, Artificial Sequence
  RNA Oligomer
ugagcugaagauucuggauuuug

SEQ ID NO: 46252 - RNA, 23 nt, Artificial Sequence
  RNA Oligomer
gugagcugaagauucuggauuuu

SEQ ID NO: 46253 - RNA, 23 nt, Artificial Sequence
  RNA Oligomer
gcagaucugaacaacauugugaa

SEQ ID NO: 46254 - RNA, 23 nt, Artificial Sequence
  RNA Oligomer
ggcagaucugaacaacauuguga

SEQ ID NO: 46255 - RNA, 23 nt, Artificial Sequence
  RNA Oligomer
gacuggaagaacauuguuuccug

SEQ ID NO: 46256 - RNA, 23 nt, Artificial Sequence
  RNA Oligomer
ugacuggaagaacauuguuuccu

SEQ ID NO: 46257 - RNA, 23 nt, Artificial Sequence
  RNA Oligomer
uugacuggaagaacauuguuucc

SEQ ID NO: 46258 - RNA, 23 nt, Artificial Sequence
  RNA Oligomer
guugacuggaagaacauuguuuc

SEQ ID NO: 46259 - RNA, 23 nt, Artificial Sequence
  RNA Oligomer
uguugacuggaagaacauuguuu

SEQ ID NO: 46260 - RNA, 23 nt, Artificial Sequence
  RNA Oligomer
ugaacuggaugcauuacaaccag

SEQ ID NO: 46261 - RNA, 23 nt, Artificial Sequence
  RNA Oligomer
cugaacuggaugcauuacaacca

SEQ ID NO: 46262 - RNA, 23 nt, Artificial Sequence
  RNA Oligomer
gcugaacuggaugcauuacaacc

SEQ ID NO: 46263 - RNA, 23 nt, Artificial Sequence
  RNA Oligomer
ugcugaacuggaugcauuacaac

SEQ ID NO: 46264 - RNA, 23 nt, Artificial Sequence
  RNA Oligomer
augcugaacuggaugcauuacaa

SEQ ID NO: 46265 - RNA, 23 nt, Artificial Sequence
  RNA Oligomer
gcacacagaugaugaaaugacag

SEQ ID NO: 46266 - RNA, 23 nt, Artificial Sequence
  RNA Oligomer
ugugagcugaagauucuggauuu

SEQ ID NO: 46267 - RNA, 23 nt, Artificial Sequence
  RNA Oligomer
ccaaauucuccgaggucuaaagu

SEQ ID NO: 46268 - RNA, 23 nt, Artificial Sequence
  RNA Oligomer
accaaauucuccgaggucuaaag

SEQ ID NO: 46269 - RNA, 23 nt, Artificial Sequence
  RNA Oligomer
uaccaaauucuccgaggucuaaa

SEQ ID NO: 46270 - RNA, 23 nt, Artificial Sequence
  RNA Oligomer
cuaccaaauucuccgaggucuaa

SEQ ID NO: 46271 - RNA, 23 nt, Artificial Sequence
  RNA Oligomer
ucuaccaaauucuccgaggucua

SEQ ID NO: 46272 - RNA, 23 nt, Artificial Sequence
  RNA Oligomer
cugaacaacauugugaaauguca

SEQ ID NO: 46273 - RNA, 23 nt, Artificial Sequence
  RNA Oligomer
ucugaacaacauugugaaauguc

SEQ ID NO: 46274 - RNA, 23 nt, Artificial Sequence
  RNA Oligomer
aucugaacaacauugugaaaugu

SEQ ID NO: 46275 - RNA, 23 nt, Artificial Sequence
  RNA Oligomer
gaucugaacaacauugugaaaug

SEQ ID NO: 46276 - RNA, 23 nt, Artificial Sequence
  RNA Oligomer
agaucugaacaacauugugaaau

SEQ ID NO: 46277 - RNA, 23 nt, Artificial Sequence
  RNA Oligomer
caaggucucuggaggaauucaau

SEQ ID NO: 46278 - RNA, 23 nt, Artificial Sequence
  RNA Oligomer
gcaaggucucuggaggaauucaa

SEQ ID NO: 46279 - RNA, 23 nt, Artificial Sequence
  RNA Oligomer
ugcaaggucucuggaggaauuca

SEQ ID NO: 46280 - RNA, 23 nt, Artificial Sequence
  RNA Oligomer
cugcaaggucucuggaggaauuc

SEQ ID NO: 46281 - RNA, 23 nt, Artificial Sequence
  RNA Oligomer
ccugcaaggucucuggaggaauu

SEQ ID NO: 46282 - RNA, 23 nt, Artificial Sequence
  RNA Oligomer
ccagaccauuucaguccaucauu

SEQ ID NO: 46283 - RNA, 23 nt, Artificial Sequence
  RNA Oligomer
cugugagcugaagauucuggauu

SEQ ID NO: 46284 - RNA, 23 nt, Artificial Sequence
  RNA Oligomer
uccuuaucuaccaaauucuccga

SEQ ID NO: 46285 - RNA, 23 nt, Artificial Sequence
  RNA Oligomer
uuccuuaucuaccaaauucuccg

SEQ ID NO: 46286 - RNA, 23 nt, Artificial Sequence
  RNA Oligomer
guuccuuaucuaccaaauucucc

SEQ ID NO: 46287 - RNA, 23 nt, Artificial Sequence
  RNA Oligomer
aguuccuuaucuaccaaauucuc

SEQ ID NO: 46288 - RNA, 23 nt, Artificial Sequence
  RNA Oligomer
caguuccuuaucuaccaaauucu

SEQ ID NO: 46289 - RNA, 23 nt, Artificial Sequence
  RNA Oligomer
ugaacaacauugugaaaugucag

SEQ ID NO: 46290 - RNA, 23 nt, Artificial Sequence
  RNA Oligomer
gcgguuacuuaaacauaugaaac

SEQ ID NO: 46291 - RNA, 23 nt, Artificial Sequence
  RNA Oligomer
ugcgguuacuuaaacauaugaaa

SEQ ID NO: 46292 - RNA, 23 nt, Artificial Sequence
  RNA Oligomer
cugcgguuacuuaaacauaugaa

SEQ ID NO: 46293 - RNA, 23 nt, Artificial Sequence
  RNA Oligomer
acugcgguuacuuaaacauauga

SEQ ID NO: 46294 - RNA, 23 nt, Artificial Sequence
  RNA Oligomer
aacugcgguuacuuaaacauaug

SEQ ID NO: 46295 - RNA, 23 nt, Artificial Sequence
  RNA Oligomer
gcuguugacuggaagaacauugu

SEQ ID NO: 46296 - RNA, 23 nt, Artificial Sequence
  RNA Oligomer
agcuguugacuggaagaacauug

SEQ ID NO: 46297 - RNA, 23 nt, Artificial Sequence
  RNA Oligomer
gagcuguugacuggaagaacauu

SEQ ID NO: 46298 - RNA, 23 nt, Artificial Sequence
  RNA Oligomer
cgagcuguugacuggaagaacau

SEQ ID NO: 46299 - RNA, 23 nt, Artificial Sequence
  RNA Oligomer
ccgagcuguugacuggaagaaca

SEQ ID NO: 46300 - RNA, 23 nt, Artificial Sequence
  RNA Oligomer
acauucagcugacauaauucaca

SEQ ID NO: 46301 - RNA, 23 nt, Artificial Sequence
  RNA Oligomer
uacauucagcugacauaauucac

SEQ ID NO: 46302 - RNA, 23 nt, Artificial Sequence
  RNA Oligomer
auacauucagcugacauaauuca

SEQ ID NO: 46303 - RNA, 23 nt, Artificial Sequence
  RNA Oligomer
uauacauucagcugacauaauuc

SEQ ID NO: 46304 - RNA, 23 nt, Artificial Sequence
  RNA Oligomer
auauacauucagcugacauaauu

SEQ ID NO: 46305 - RNA, 23 nt, Artificial Sequence
  RNA Oligomer
cgaggucuaaaguauauacauuc

SEQ ID NO: 46306 - RNA, 23 nt, Artificial Sequence
  RNA Oligomer
ccgaggucuaaaguauauacauu

SEQ ID NO: 46307 - RNA, 23 nt, Artificial Sequence
  RNA Oligomer
uccgaggucuaaaguauauacau

SEQ ID NO: 46308 - RNA, 23 nt, Artificial Sequence
  RNA Oligomer
cuccgaggucuaaaguauauaca

SEQ ID NO: 46309 - RNA, 23 nt, Artificial Sequence
  RNA Oligomer
ucuccgaggucuaaaguauauac

SEQ ID NO: 46310 - RNA, 23 nt, Artificial Sequence
  RNA Oligomer
uucuccgaggucuaaaguauaua

SEQ ID NO: 46311 - RNA, 23 nt, Artificial Sequence
  RNA Oligomer
ucaguuccuuaucuaccaaauuc

SEQ ID NO: 46312 - RNA, 23 nt, Artificial Sequence
  RNA Oligomer
uucaguuccuuaucuaccaaauu

SEQ ID NO: 46313 - RNA, 23 nt, Artificial Sequence
  RNA Oligomer
guucaguuccuuaucuaccaaau

SEQ ID NO: 46314 - RNA, 23 nt, Artificial Sequence
  RNA Oligomer
uguucaguuccuuaucuaccaaa

SEQ ID NO: 46315 - RNA, 23 nt, Artificial Sequence
  RNA Oligomer
auguucaguuccuuaucuaccaa

SEQ ID NO: 46316 - RNA, 23 nt, Artificial Sequence
  RNA Oligomer
ggucucuggaggaauucaaugau

SEQ ID NO: 46317 - RNA, 23 nt, Artificial Sequence
  RNA Oligomer
aggucucuggaggaauucaauga

SEQ ID NO: 46318 - RNA, 23 nt, Artificial Sequence
  RNA Oligomer
aaggucucuggaggaauucaaug

SEQ ID NO: 46319 - RNA, 23 nt, Artificial Sequence
  RNA Oligomer
accugcaaggucucuggaggaau

SEQ ID NO: 46320 - RNA, 23 nt, Artificial Sequence
  RNA Oligomer
cgguuacuuaaacauaugaaaca

SEQ ID NO: 46321 - RNA, 23 nt, Artificial Sequence
  RNA Oligomer
gaacugcgguuacuuaaacauau

SEQ ID NO: 46322 - RNA, 23 nt, Artificial Sequence
  RNA Oligomer
gaacauuguuuccugguacagac

SEQ ID NO: 46323 - RNA, 23 nt, Artificial Sequence
  RNA Oligomer
cuguugacuggaagaacauuguu

SEQ ID NO: 46324 - RNA, 23 nt, Artificial Sequence
  RNA Oligomer
gccgagcuguugacuggaagaac

SEQ ID NO: 46325 - RNA, 23 nt, Artificial Sequence
  RNA Oligomer
ggccgagcuguugacuggaagaa

SEQ ID NO: 46326 - RNA, 23 nt, Artificial Sequence
  RNA Oligomer
cuccugagaucaugcugaacugg

SEQ ID NO: 46327 - RNA, 23 nt, Artificial Sequence
  RNA Oligomer
gcuccugagaucaugcugaacug

SEQ ID NO: 46328 - RNA, 23 nt, Artificial Sequence
  RNA Oligomer
ggcuccugagaucaugcugaacu

SEQ ID NO: 46329 - RNA, 23 nt, Artificial Sequence
  RNA Oligomer
gggcuccugagaucaugcugaac

SEQ ID NO: 46330 - RNA, 23 nt, Artificial Sequence
  RNA Oligomer
agggcuccugagaucaugcugaa

SEQ ID NO: 46331 - RNA, 23 nt, Artificial Sequence
  RNA Oligomer
guauauacauucagcugacauaa

SEQ ID NO: 46332 - RNA, 23 nt, Artificial Sequence
  RNA Oligomer
aguauauacauucagcugacaua

SEQ ID NO: 46333 - RNA, 23 nt, Artificial Sequence
  RNA Oligomer
aaguauauacauucagcugacau

SEQ ID NO: 46334 - RNA, 23 nt, Artificial Sequence
  RNA Oligomer
aaaguauauacauucagcugaca

SEQ ID NO: 46335 - RNA, 23 nt, Artificial Sequence
  RNA Oligomer
uaaaguauauacauucagcugac

SEQ ID NO: 46336 - RNA, 23 nt, Artificial Sequence
  RNA Oligomer
gcuuacagaugaccauguucagu

SEQ ID NO: 46337 - RNA, 23 nt, Artificial Sequence
  RNA Oligomer
agcuuacagaugaccauguucag

SEQ ID NO: 46338 - RNA, 23 nt, Artificial Sequence
  RNA Oligomer
aagcuuacagaugaccauguuca

SEQ ID NO: 46339 - RNA, 23 nt, Artificial Sequence
  RNA Oligomer
gaagcuuacagaugaccauguuc

SEQ ID NO: 46340 - RNA, 23 nt, Artificial Sequence
  RNA Oligomer
agaagcuuacagaugaccauguu

SEQ ID NO: 46341 - RNA, 23 nt, Artificial Sequence
  RNA Oligomer
cagaagcuuacagaugaccaugu

SEQ ID NO: 46342 - RNA, 23 nt, Artificial Sequence
  RNA Oligomer
ucagaagcuuacagaugaccaug

SEQ ID NO: 46343 - RNA, 23 nt, Artificial Sequence
  RNA Oligomer
gucagaagcuuacagaugaccau

SEQ ID NO: 46344 - RNA, 23 nt, Artificial Sequence
  RNA Oligomer
ugucagaagcuuacagaugacca

SEQ ID NO: 46345 - RNA, 23 nt, Artificial Sequence
  RNA Oligomer
augucagaagcuuacagaugacc

SEQ ID NO: 46346 - RNA, 23 nt, Artificial Sequence
  RNA Oligomer
aaugucagaagcuuacagaugac

SEQ ID NO: 46347 - RNA, 23 nt, Artificial Sequence
  RNA Oligomer
cagaucugaacaacauugugaaa

SEQ ID NO: 46348 - RNA, 23 nt, Artificial Sequence
  RNA Oligomer
ucuggaggaauucaaugaugugu

SEQ ID NO: 46349 - RNA, 23 nt, Artificial Sequence
  RNA Oligomer
cucuggaggaauucaaugaugug

SEQ ID NO: 46350 - RNA, 23 nt, Artificial Sequence
  RNA Oligomer
caccugcaaggucucuggaggaa

SEQ ID NO: 46351 - RNA, 23 nt, Artificial Sequence
  RNA Oligomer
gcgaaaagaaccuacagagaacu

SEQ ID NO: 46352 - RNA, 23 nt, Artificial Sequence
  RNA Oligomer
ugcgaaaagaaccuacagagaac

SEQ ID NO: 46353 - RNA, 23 nt, Artificial Sequence
  RNA Oligomer
augcgaaaagaaccuacagagaa

SEQ ID NO: 46354 - RNA, 23 nt, Artificial Sequence
  RNA Oligomer
caugcgaaaagaaccuacagaga

SEQ ID NO: 46355 - RNA, 23 nt, Artificial Sequence
  RNA Oligomer
ucaugcgaaaagaaccuacagag

SEQ ID NO: 46356 - RNA, 23 nt, Artificial Sequence
  RNA Oligomer
ucaguccaucauucaugcgaaaa

SEQ ID NO: 46357 - RNA, 23 nt, Artificial Sequence
  RNA Oligomer
gguuacguguggcagugaagaag

SEQ ID NO: 46358 - RNA, 23 nt, Artificial Sequence
  RNA Oligomer
ggguuacguguggcagugaagaa

SEQ ID NO: 46359 - RNA, 23 nt, Artificial Sequence
  RNA Oligomer
gggguuacguguggcagugaaga

SEQ ID NO: 46360 - RNA, 23 nt, Artificial Sequence
  RNA Oligomer
cgggguuacguguggcagugaag

SEQ ID NO: 46361 - RNA, 23 nt, Artificial Sequence
  RNA Oligomer
acgggguuacguguggcagugaa

SEQ ID NO: 46362 - RNA, 23 nt, Artificial Sequence
  RNA Oligomer
gcauaauggccgagcuguugacu

SEQ ID NO: 46363 - RNA, 23 nt, Artificial Sequence
  RNA Oligomer
ugcauaauggccgagcuguugac

SEQ ID NO: 46364 - RNA, 23 nt, Artificial Sequence
  RNA Oligomer
augcauaauggccgagcuguuga

SEQ ID NO: 46365 - RNA, 23 nt, Artificial Sequence
  RNA Oligomer
gaugcauaauggccgagcuguug

SEQ ID NO: 46366 - RNA, 23 nt, Artificial Sequence
  RNA Oligomer
ggaugcauaauggccgagcuguu

SEQ ID NO: 46367 - RNA, 23 nt, Artificial Sequence
  RNA Oligomer
agaucaugcugaacuggaugcau

SEQ ID NO: 46368 - RNA, 23 nt, Artificial Sequence
  RNA Oligomer
gagaucaugcugaacuggaugca

SEQ ID NO: 46369 - RNA, 23 nt, Artificial Sequence
  RNA Oligomer
ugagaucaugcugaacuggaugc

SEQ ID NO: 46370 - RNA, 23 nt, Artificial Sequence
  RNA Oligomer
cugagaucaugcugaacuggaug

SEQ ID NO: 46371 - RNA, 23 nt, Artificial Sequence
  RNA Oligomer
ccugagaucaugcugaacuggau

SEQ ID NO: 46372 - RNA, 23 nt, Artificial Sequence
  RNA Oligomer
ggcucggcacacagaugaugaaa

SEQ ID NO: 46373 - RNA, 23 nt, Artificial Sequence
  RNA Oligomer
auucuccgaggucuaaaguauau

SEQ ID NO: 46374 - RNA, 23 nt, Artificial Sequence
  RNA Oligomer
aaaugucagaagcuuacagauga

SEQ ID NO: 46375 - RNA, 23 nt, Artificial Sequence
  RNA Oligomer
ucucuggaggaauucaaugaugu

SEQ ID NO: 46376 - RNA, 23 nt, Artificial Sequence
  RNA Oligomer
gucucuggaggaauucaaugaug

SEQ ID NO: 46377 - RNA, 23 nt, Artificial Sequence
  RNA Oligomer
aggagcugaacaagacaaucugg

SEQ ID NO: 46378 - RNA, 23 nt, Artificial Sequence
  RNA Oligomer
caggagcugaacaagacaaucug

SEQ ID NO: 46379 - RNA, 23 nt, Artificial Sequence
  RNA Oligomer
gcaggagcugaacaagacaaucu

SEQ ID NO: 46380 - RNA, 23 nt, Artificial Sequence
  RNA Oligomer
ggcaggagcugaacaagacaauc

SEQ ID NO: 46381 - RNA, 23 nt, Artificial Sequence
  RNA Oligomer
cggcaggagcugaacaagacaau

SEQ ID NO: 46382 - RNA, 23 nt, Artificial Sequence
  RNA Oligomer
agaacugcgguuacuuaaacaua

SEQ ID NO: 46383 - RNA, 23 nt, Artificial Sequence
  RNA Oligomer
gagaacugcgguuacuuaaacau

SEQ ID NO: 46384 - RNA, 23 nt, Artificial Sequence
  RNA Oligomer
agagaacugcgguuacuuaaaca

SEQ ID NO: 46385 - RNA, 23 nt, Artificial Sequence
  RNA Oligomer
cagagaacugcgguuacuuaaac

SEQ ID NO: 46386 - RNA, 23 nt, Artificial Sequence
  RNA Oligomer
acagagaacugcgguuacuuaaa

SEQ ID NO: 46387 - RNA, 23 nt, Artificial Sequence
  RNA Oligomer
cgaaaagaaccuacagagaacug

SEQ ID NO: 46388 - RNA, 23 nt, Artificial Sequence
  RNA Oligomer
caugcugaacuggaugcauuaca

SEQ ID NO: 46389 - RNA, 23 nt, Artificial Sequence
  RNA Oligomer
uccugagaucaugcugaacugga

SEQ ID NO: 46390 - RNA, 23 nt, Artificial Sequence
  RNA Oligomer
acacagaugaugaaaugacaggc

SEQ ID NO: 46391 - RNA, 23 nt, Artificial Sequence
  RNA Oligomer
cacacagaugaugaaaugacagg

SEQ ID NO: 46392 - RNA, 23 nt, Artificial Sequence
  RNA Oligomer
uggcucggcacacagaugaugaa

SEQ ID NO: 46393 - RNA, 23 nt, Artificial Sequence
  RNA Oligomer
agauucuggauuuuggacuggcu

SEQ ID NO: 46394 - RNA, 23 nt, Artificial Sequence
  RNA Oligomer
aagauucuggauuuuggacuggc

SEQ ID NO: 46395 - RNA, 23 nt, Artificial Sequence
  RNA Oligomer
gaagauucuggauuuuggacugg

SEQ ID NO: 46396 - RNA, 23 nt, Artificial Sequence
  RNA Oligomer
ugaagauucuggauuuuggacug

SEQ ID NO: 46397 - RNA, 23 nt, Artificial Sequence
  RNA Oligomer
cugaagauucuggauuuuggacu

SEQ ID NO: 46398 - RNA, 23 nt, Artificial Sequence
  RNA Oligomer
acugugagcugaagauucuggau

SEQ ID NO: 46399 - RNA, 23 nt, Artificial Sequence
  RNA Oligomer
agacugugagcugaagauucugg

SEQ ID NO: 46400 - RNA, 23 nt, Artificial Sequence
  RNA Oligomer
aagacugugagcugaagauucug

SEQ ID NO: 46401 - RNA, 23 nt, Artificial Sequence
  RNA Oligomer
gaagacugugagcugaagauucu

SEQ ID NO: 46402 - RNA, 23 nt, Artificial Sequence
  RNA Oligomer
ugaagacugugagcugaagauuc

SEQ ID NO: 46403 - RNA, 23 nt, Artificial Sequence
  RNA Oligomer
augaagacugugagcugaagauu

SEQ ID NO: 46404 - RNA, 23 nt, Artificial Sequence
  RNA Oligomer
ugacauaauucacagggaccuaa

SEQ ID NO: 46405 - RNA, 23 nt, Artificial Sequence
  RNA Oligomer
cugacauaauucacagggaccua

SEQ ID NO: 46406 - RNA, 23 nt, Artificial Sequence
  RNA Oligomer
gcugacauaauucacagggaccu

SEQ ID NO: 46407 - RNA, 23 nt, Artificial Sequence
  RNA Oligomer
agcugacauaauucacagggacc

SEQ ID NO: 46408 - RNA, 23 nt, Artificial Sequence
  RNA Oligomer
cagcugacauaauucacagggac

SEQ ID NO: 46409 - RNA, 23 nt, Artificial Sequence
  RNA Oligomer
gaggucuaaaguauauacauuca

SEQ ID NO: 46410 - RNA, 23 nt, Artificial Sequence
  RNA Oligomer
ugaccauguucaguuccuuaucu

SEQ ID NO: 46411 - RNA, 23 nt, Artificial Sequence
  RNA Oligomer
augaccauguucaguuccuuauc

SEQ ID NO: 46412 - RNA, 23 nt, Artificial Sequence
  RNA Oligomer
gaugaccauguucaguuccuuau

SEQ ID NO: 46413 - RNA, 23 nt, Artificial Sequence
  RNA Oligomer
agaugaccauguucaguuccuua

SEQ ID NO: 46414 - RNA, 23 nt, Artificial Sequence
  RNA Oligomer
cagaugaccauguucaguuccuu

SEQ ID NO: 46415 - RNA, 23 nt, Artificial Sequence
  RNA Oligomer
ugugaaaugucagaagcuuacag

SEQ ID NO: 46416 - RNA, 23 nt, Artificial Sequence
  RNA Oligomer
uugugaaaugucagaagcuuaca

SEQ ID NO: 46417 - RNA, 23 nt, Artificial Sequence
  RNA Oligomer
auugugaaaugucagaagcuuac

SEQ ID NO: 46418 - RNA, 23 nt, Artificial Sequence
  RNA Oligomer
cauugugaaaugucagaagcuua

SEQ ID NO: 46419 - RNA, 23 nt, Artificial Sequence
  RNA Oligomer
acauugugaaaugucagaagcuu

SEQ ID NO: 46420 - RNA, 23 nt, Artificial Sequence
  RNA Oligomer
ccggcaggagcugaacaagacaa

SEQ ID NO: 46421 - RNA, 23 nt, Artificial Sequence
  RNA Oligomer
gaaaagaaccuacagagaacugc

SEQ ID NO: 46422 - RNA, 23 nt, Artificial Sequence
  RNA Oligomer
uggccgagcuguugacuggaaga

SEQ ID NO: 46423 - RNA, 23 nt, Artificial Sequence
  RNA Oligomer
ugcauuacaaccagacaguugau

SEQ ID NO: 46424 - RNA, 23 nt, Artificial Sequence
  RNA Oligomer
augcauuacaaccagacaguuga

SEQ ID NO: 46425 - RNA, 23 nt, Artificial Sequence
  RNA Oligomer
gaugcauuacaaccagacaguug

SEQ ID NO: 46426 - RNA, 23 nt, Artificial Sequence
  RNA Oligomer
ggaugcauuacaaccagacaguu

SEQ ID NO: 46427 - RNA, 23 nt, Artificial Sequence
  RNA Oligomer
uggaugcauuacaaccagacagu

SEQ ID NO: 46428 - RNA, 23 nt, Artificial Sequence
  RNA Oligomer
ugaaaugacaggcuacguggcca

SEQ ID NO: 46429 - RNA, 23 nt, Artificial Sequence
  RNA Oligomer
augaaaugacaggcuacguggcc

SEQ ID NO: 46430 - RNA, 23 nt, Artificial Sequence
  RNA Oligomer
gaugaaaugacaggcuacguggc

SEQ ID NO: 46431 - RNA, 23 nt, Artificial Sequence
  RNA Oligomer
ugaugaaaugacaggcuacgugg

SEQ ID NO: 46432 - RNA, 23 nt, Artificial Sequence
  RNA Oligomer
augaugaaaugacaggcuacgug

SEQ ID NO: 46433 - RNA, 23 nt, Artificial Sequence
  RNA Oligomer
gaugaugaaaugacaggcuacgu

SEQ ID NO: 46434 - RNA, 23 nt, Artificial Sequence
  RNA Oligomer
agaugaugaaaugacaggcuacg

SEQ ID NO: 46435 - RNA, 23 nt, Artificial Sequence
  RNA Oligomer
cagaugaugaaaugacaggcuac

SEQ ID NO: 46436 - RNA, 23 nt, Artificial Sequence
  RNA Oligomer
acagaugaugaaaugacaggcua

SEQ ID NO: 46437 - RNA, 23 nt, Artificial Sequence
  RNA Oligomer
cacagaugaugaaaugacaggcu

SEQ ID NO: 46438 - RNA, 23 nt, Artificial Sequence
  RNA Oligomer
aaugaagacugugagcugaagau

SEQ ID NO: 46439 - RNA, 23 nt, Artificial Sequence
  RNA Oligomer
gaaugaagacugugagcugaaga

SEQ ID NO: 46440 - RNA, 23 nt, Artificial Sequence
  RNA Oligomer
ugaaugaagacugugagcugaag

SEQ ID NO: 46441 - RNA, 23 nt, Artificial Sequence
  RNA Oligomer
acauaauucacagggaccuaaaa

SEQ ID NO: 46442 - RNA, 23 nt, Artificial Sequence
  RNA Oligomer
gacauaauucacagggaccuaaa

SEQ ID NO: 46443 - RNA, 23 nt, Artificial Sequence
  RNA Oligomer
ucagcugacauaauucacaggga

SEQ ID NO: 46444 - RNA, 23 nt, Artificial Sequence
  RNA Oligomer
caaauucuccgaggucuaaagua

SEQ ID NO: 46445 - RNA, 23 nt, Artificial Sequence
  RNA Oligomer
ugaaaugucagaagcuuacagau

SEQ ID NO: 46446 - RNA, 23 nt, Artificial Sequence
  RNA Oligomer
gugaaaugucagaagcuuacaga

SEQ ID NO: 46447 - RNA, 23 nt, Artificial Sequence
  RNA Oligomer
gccgcuggaaaaugucucaggag

SEQ ID NO: 46448 - RNA, 23 nt, Artificial Sequence
  RNA Oligomer
ugccgcuggaaaaugucucagga

SEQ ID NO: 46449 - RNA, 23 nt, Artificial Sequence
  RNA Oligomer
cugccgcuggaaaaugucucagg

SEQ ID NO: 46450 - RNA, 23 nt, Artificial Sequence
  RNA Oligomer
gcugccgcuggaaaaugucucag

SEQ ID NO: 46451 - RNA, 23 nt, Artificial Sequence
  RNA Oligomer
ggcugccgcuggaaaaugucuca

SEQ ID NO: 46452 - RNA, 23 nt, Artificial Sequence
  RNA Oligomer
gagcugaacaagacaaucuggga

SEQ ID NO: 46453 - RNA, 23 nt, Artificial Sequence
  RNA Oligomer
ggagcugaacaagacaaucuggg

SEQ ID NO: 46454 - RNA, 23 nt, Artificial Sequence
  RNA Oligomer
uacagagaacugcgguuacuuaa

SEQ ID NO: 46455 - RNA, 23 nt, Artificial Sequence
  RNA Oligomer
cuacagagaacugcgguuacuua

SEQ ID NO: 46456 - RNA, 23 nt, Artificial Sequence
  RNA Oligomer
caucauucaugcgaaaagaaccu

SEQ ID NO: 46457 - RNA, 23 nt, Artificial Sequence
  RNA Oligomer
gucagugggaugcauaauggccg

SEQ ID NO: 46458 - RNA, 23 nt, Artificial Sequence
  RNA Oligomer
ggucagugggaugcauaauggcc

SEQ ID NO: 46459 - RNA, 23 nt, Artificial Sequence
  RNA Oligomer
uggucagugggaugcauaauggc

SEQ ID NO: 46460 - RNA, 23 nt, Artificial Sequence
  RNA Oligomer
uuggucagugggaugcauaaugg

SEQ ID NO: 46461 - RNA, 23 nt, Artificial Sequence
  RNA Oligomer
uuuggucagugggaugcauaaug

SEQ ID NO: 46462 - RNA, 23 nt, Artificial Sequence
  RNA Oligomer
auuuggucagugggaugcauaau

SEQ ID NO: 46463 - RNA, 23 nt, Artificial Sequence
  RNA Oligomer
cucugugugugcugcuuuugaca

SEQ ID NO: 46464 - RNA, 23 nt, Artificial Sequence
  RNA Oligomer
gcucugugugugcugcuuuugac

SEQ ID NO: 46465 - RNA, 23 nt, Artificial Sequence
  RNA Oligomer
ggcucugugugugcugcuuuuga

SEQ ID NO: 46466 - RNA, 23 nt, Artificial Sequence
  RNA Oligomer
uggcucugugugugcugcuuuug

SEQ ID NO: 46467 - RNA, 23 nt, Artificial Sequence
  RNA Oligomer
auggcucugugugugcugcuuuu

SEQ ID NO: 46468 - RNA, 23 nt, Artificial Sequence
  RNA Oligomer
cugugaaugaagacugugagcug

SEQ ID NO: 46469 - RNA, 23 nt, Artificial Sequence
  RNA Oligomer
gcugugaaugaagacugugagcu

SEQ ID NO: 46470 - RNA, 23 nt, Artificial Sequence
  RNA Oligomer
agcugugaaugaagacugugagc

SEQ ID NO: 46471 - RNA, 23 nt, Artificial Sequence
  RNA Oligomer
uagcugugaaugaagacugugag

SEQ ID NO: 46472 - RNA, 23 nt, Artificial Sequence
  RNA Oligomer
cuagcugugaaugaagacuguga

SEQ ID NO: 46473 - RNA, 23 nt, Artificial Sequence
  RNA Oligomer
ucuagcugugaaugaagacugug

SEQ ID NO: 46474 - RNA, 23 nt, Artificial Sequence
  RNA Oligomer
aucuagcugugaaugaagacugu

SEQ ID NO: 46475 - RNA, 23 nt, Artificial Sequence
  RNA Oligomer
uaaucuagcugugaaugaagacu

SEQ ID NO: 46476 - RNA, 23 nt, Artificial Sequence
  RNA Oligomer
guaaucuagcugugaaugaagac

SEQ ID NO: 46477 - RNA, 23 nt, Artificial Sequence
  RNA Oligomer
aguaaucuagcugugaaugaaga

SEQ ID NO: 46478 - RNA, 23 nt, Artificial Sequence
  RNA Oligomer
uaguaaucuagcugugaaugaag

SEQ ID NO: 46479 - RNA, 23 nt, Artificial Sequence
  RNA Oligomer
cuaguaaucuagcugugaaugaa

SEQ ID NO: 46480 - RNA, 23 nt, Artificial Sequence
  RNA Oligomer
accauguucaguuccuuaucuac

SEQ ID NO: 46481 - RNA, 23 nt, Artificial Sequence
  RNA Oligomer
gaccauguucaguuccuuaucua

SEQ ID NO: 46482 - RNA, 23 nt, Artificial Sequence
  RNA Oligomer
acagaugaccauguucaguuccu

SEQ ID NO: 46483 - RNA, 23 nt, Artificial Sequence
  RNA Oligomer
uacagaugaccauguucaguucc

SEQ ID NO: 46484 - RNA, 23 nt, Artificial Sequence
  RNA Oligomer
uuacagaugaccauguucaguuc

SEQ ID NO: 46485 - RNA, 23 nt, Artificial Sequence
  RNA Oligomer
cuuacagaugaccauguucaguu

SEQ ID NO: 46486 - RNA, 23 nt, Artificial Sequence
  RNA Oligomer
aaaaugugauuggucuguuggac

SEQ ID NO: 46487 - RNA, 23 nt, Artificial Sequence
  RNA Oligomer
gaaaaugugauuggucuguugga

SEQ ID NO: 46488 - RNA, 23 nt, Artificial Sequence
  RNA Oligomer
ugaaaaugugauuggucuguugg

SEQ ID NO: 46489 - RNA, 23 nt, Artificial Sequence
  RNA Oligomer
augaaaaugugauuggucuguug

SEQ ID NO: 46490 - RNA, 23 nt, Artificial Sequence
  RNA Oligomer
caugaaaaugugauuggucuguu

SEQ ID NO: 46491 - RNA, 23 nt, Artificial Sequence
  RNA Oligomer
acaugaaaaugugauuggucugu

SEQ ID NO: 46492 - RNA, 23 nt, Artificial Sequence
  RNA Oligomer
aacaugaaaaugugauuggucug

SEQ ID NO: 46493 - RNA, 23 nt, Artificial Sequence
  RNA Oligomer
aaacaugaaaaugugauuggucu

SEQ ID NO: 46494 - RNA, 23 nt, Artificial Sequence
  RNA Oligomer
gaaacaugaaaaugugauugguc

SEQ ID NO: 46495 - RNA, 23 nt, Artificial Sequence
  RNA Oligomer
ugaaacaugaaaaugugauuggu

SEQ ID NO: 46496 - RNA, 23 nt, Artificial Sequence
  RNA Oligomer
uucaugcgaaaagaaccuacaga

SEQ ID NO: 46497 - RNA, 23 nt, Artificial Sequence
  RNA Oligomer
uccagaccauuucaguccaucau

SEQ ID NO: 46498 - RNA, 23 nt, Artificial Sequence
  RNA Oligomer
cuccagaccauuucaguccauca

SEQ ID NO: 46499 - RNA, 23 nt, Artificial Sequence
  RNA Oligomer
ucuccagaccauuucaguccauc

SEQ ID NO: 46500 - RNA, 23 nt, Artificial Sequence
  RNA Oligomer
cucuccagaccauuucaguccau

SEQ ID NO: 46501 - RNA, 23 nt, Artificial Sequence
  RNA Oligomer
uauuuggucagugggaugcauaa

SEQ ID NO: 46502 - RNA, 23 nt, Artificial Sequence
  RNA Oligomer
cagggcuccugagaucaugcuga

SEQ ID NO: 46503 - RNA, 23 nt, Artificial Sequence
  RNA Oligomer
gugaaugaagacugugagcugaa

SEQ ID NO: 46504 - RNA, 23 nt, Artificial Sequence
  RNA Oligomer
ugugaaugaagacugugagcuga

SEQ ID NO: 46505 - RNA, 23 nt, Artificial Sequence
  RNA Oligomer
acaagacaaucugggaggugccc

SEQ ID NO: 46506 - RNA, 23 nt, Artificial Sequence
  RNA Oligomer
aacaagacaaucugggaggugcc

SEQ ID NO: 46507 - RNA, 23 nt, Artificial Sequence
  RNA Oligomer
gaacaagacaaucugggaggugc

SEQ ID NO: 46508 - RNA, 23 nt, Artificial Sequence
  RNA Oligomer
ugaacaagacaaucugggaggug

SEQ ID NO: 46509 - RNA, 23 nt, Artificial Sequence
  RNA Oligomer
cugaacaagacaaucugggaggu

SEQ ID NO: 46510 - RNA, 23 nt, Artificial Sequence
  RNA Oligomer
agcugaacaagacaaucugggag

SEQ ID NO: 46511 - RNA, 23 nt, Artificial Sequence
  RNA Oligomer
gcucuccagaccauuucagucca

SEQ ID NO: 46512 - RNA, 23 nt, Artificial Sequence
  RNA Oligomer
agcucuccagaccauuucagucc

SEQ ID NO: 46513 - RNA, 23 nt, Artificial Sequence
  RNA Oligomer
aagcucuccagaccauuucaguc

SEQ ID NO: 46514 - RNA, 23 nt, Artificial Sequence
  RNA Oligomer
gaagcucuccagaccauuucagu

SEQ ID NO: 46515 - RNA, 23 nt, Artificial Sequence
  RNA Oligomer
agaagcucuccagaccauuucag

SEQ ID NO: 46516 - RNA, 23 nt, Artificial Sequence
  RNA Oligomer
accagacaguugauauuugguca

SEQ ID NO: 46517 - RNA, 23 nt, Artificial Sequence
  RNA Oligomer
aaccagacaguugauauuugguc

SEQ ID NO: 46518 - RNA, 23 nt, Artificial Sequence
  RNA Oligomer
caaccagacaguugauauuuggu

SEQ ID NO: 46519 - RNA, 23 nt, Artificial Sequence
  RNA Oligomer
acaaccagacaguugauauuugg

SEQ ID NO: 46520 - RNA, 23 nt, Artificial Sequence
  RNA Oligomer
uacaaccagacaguugauauuug

SEQ ID NO: 46521 - RNA, 23 nt, Artificial Sequence
  RNA Oligomer
aaucuagcugugaaugaagacug

SEQ ID NO: 46522 - RNA, 23 nt, Artificial Sequence
  RNA Oligomer
ccuaguaaucuagcugugaauga

SEQ ID NO: 46523 - RNA, 23 nt, Artificial Sequence
  RNA Oligomer
accuaguaaucuagcugugaaug

SEQ ID NO: 46524 - RNA, 23 nt, Artificial Sequence
  RNA Oligomer
aaccuaguaaucuagcugugaau

SEQ ID NO: 46525 - RNA, 23 nt, Artificial Sequence
  RNA Oligomer
aauucuccgaggucuaaaguaua

SEQ ID NO: 46526 - RNA, 23 nt, Artificial Sequence
  RNA Oligomer
aaauucuccgaggucuaaaguau

SEQ ID NO: 46527 - RNA, 23 nt, Artificial Sequence
  RNA Oligomer
ccauguucaguuccuuaucuacc

SEQ ID NO: 46528 - RNA, 23 nt, Artificial Sequence
  RNA Oligomer
gcugaacaagacaaucugggagg

SEQ ID NO: 46529 - RNA, 23 nt, Artificial Sequence
  RNA Oligomer
auucaugcgaaaagaaccuacag

SEQ ID NO: 46530 - RNA, 23 nt, Artificial Sequence
  RNA Oligomer
cauucaugcgaaaagaaccuaca

SEQ ID NO: 46531 - RNA, 23 nt, Artificial Sequence
  RNA Oligomer
ucauucaugcgaaaagaaccuac

SEQ ID NO: 46532 - RNA, 23 nt, Artificial Sequence
  RNA Oligomer
caguugauauuuggucaguggga

SEQ ID NO: 46533 - RNA, 23 nt, Artificial Sequence
  RNA Oligomer
acaguugauauuuggucaguggg

SEQ ID NO: 46534 - RNA, 23 nt, Artificial Sequence
  RNA Oligomer
gacaguugauauuuggucagugg

SEQ ID NO: 46535 - RNA, 23 nt, Artificial Sequence
  RNA Oligomer
agacaguugauauuuggucagug

SEQ ID NO: 46536 - RNA, 23 nt, Artificial Sequence
  RNA Oligomer
cagacaguugauauuuggucagu

SEQ ID NO: 46537 - RNA, 23 nt, Artificial Sequence
  RNA Oligomer
ccagacaguugauauuuggucag

SEQ ID NO: 46538 - RNA, 23 nt, Artificial Sequence
  RNA Oligomer
uauggcucugugugugcugcuuu

SEQ ID NO: 46539 - RNA, 23 nt, Artificial Sequence
  RNA Oligomer
uucagcugacauaauucacaggg

SEQ ID NO: 46540 - RNA, 23 nt, Artificial Sequence
  RNA Oligomer
auucagcugacauaauucacagg

SEQ ID NO: 46541 - RNA, 23 nt, Artificial Sequence
  RNA Oligomer
cauucagcugacauaauucacag

SEQ ID NO: 46542 - RNA, 23 nt, Artificial Sequence
  RNA Oligomer
cauguucaguuccuuaucuacca

SEQ ID NO: 46543 - RNA, 23 nt, Artificial Sequence
  RNA Oligomer
cuggaagaacauuguuuccuggu

SEQ ID NO: 46544 - RNA, 23 nt, Artificial Sequence
  RNA Oligomer
acuggaagaacauuguuuccugg

SEQ ID NO: 46545 - RNA, 23 nt, Artificial Sequence
  RNA Oligomer
cacagggaccuaaaaccuaguaa

SEQ ID NO: 46546 - RNA, 23 nt, Artificial Sequence
  RNA Oligomer
ucacagggaccuaaaaccuagua

SEQ ID NO: 46547 - RNA, 23 nt, Artificial Sequence
  RNA Oligomer
gauauuuggucagugggaugcau

SEQ ID NO: 46548 - RNA, 23 nt, Artificial Sequence
  RNA Oligomer
ugauauuuggucagugggaugca

SEQ ID NO: 46549 - RNA, 23 nt, Artificial Sequence
  RNA Oligomer
uugauauuuggucagugggaugc

SEQ ID NO: 46550 - RNA, 23 nt, Artificial Sequence
  RNA Oligomer
guugauauuuggucagugggaug

SEQ ID NO: 46551 - RNA, 23 nt, Artificial Sequence
  RNA Oligomer
aguugauauuuggucagugggau

SEQ ID NO: 46552 - RNA, 23 nt, Artificial Sequence
  RNA Oligomer
ucaaugauguguaucuggugacc

SEQ ID NO: 46553 - RNA, 23 nt, Artificial Sequence
  RNA Oligomer
uucaaugauguguaucuggugac

SEQ ID NO: 46554 - RNA, 23 nt, Artificial Sequence
  RNA Oligomer
auucaaugauguguaucugguga

SEQ ID NO: 46555 - RNA, 23 nt, Artificial Sequence
  RNA Oligomer
aauucaaugauguguaucuggug

SEQ ID NO: 46556 - RNA, 23 nt, Artificial Sequence
  RNA Oligomer
gaauucaaugauguguaucuggu

SEQ ID NO: 46557 - RNA, 23 nt, Artificial Sequence
  RNA Oligomer
uucaguccaucauucaugcgaaa

SEQ ID NO: 46558 - RNA, 23 nt, Artificial Sequence
  RNA Oligomer
ccuacagagaacugcgguuacuu

SEQ ID NO: 46559 - RNA, 23 nt, Artificial Sequence
  RNA Oligomer
accuacagagaacugcgguuacu

SEQ ID NO: 46560 - RNA, 23 nt, Artificial Sequence
  RNA Oligomer
aaccuacagagaacugcgguuac

SEQ ID NO: 46561 - RNA, 23 nt, Artificial Sequence
  RNA Oligomer
gaaccuacagagaacugcgguua

SEQ ID NO: 46562 - RNA, 23 nt, Artificial Sequence
  RNA Oligomer
uccugguacagaccauauuaacc

SEQ ID NO: 46563 - RNA, 23 nt, Artificial Sequence
  RNA Oligomer
uuccugguacagaccauauuaac

SEQ ID NO: 46564 - RNA, 23 nt, Artificial Sequence
  RNA Oligomer
uuuccugguacagaccauauuaa

SEQ ID NO: 46565 - RNA, 23 nt, Artificial Sequence
  RNA Oligomer
guuuccugguacagaccauauua

SEQ ID NO: 46566 - RNA, 23 nt, Artificial Sequence
  RNA Oligomer
uguuuccugguacagaccauauu

SEQ ID NO: 46567 - RNA, 23 nt, Artificial Sequence
  RNA Oligomer
ugcugcuuuugacacaaaaacgg

SEQ ID NO: 46568 - RNA, 23 nt, Artificial Sequence
  RNA Oligomer
gugcugcuuuugacacaaaaacg

SEQ ID NO: 46569 - RNA, 23 nt, Artificial Sequence
  RNA Oligomer
ugugcugcuuuugacacaaaaac

SEQ ID NO: 46570 - RNA, 23 nt, Artificial Sequence
  RNA Oligomer
gugugcugcuuuugacacaaaaa

SEQ ID NO: 46571 - RNA, 23 nt, Artificial Sequence
  RNA Oligomer
ugugugcugcuuuugacacaaaa

SEQ ID NO: 46572 - RNA, 23 nt, Artificial Sequence
  RNA Oligomer
accggcaggagcugaacaagaca

SEQ ID NO: 46573 - RNA, 23 nt, Artificial Sequence
  RNA Oligomer
guguggcagugaagaagcucucc

SEQ ID NO: 46574 - RNA, 23 nt, Artificial Sequence
  RNA Oligomer
cguguggcagugaagaagcucuc

SEQ ID NO: 46575 - RNA, 23 nt, Artificial Sequence
  RNA Oligomer
acguguggcagugaagaagcucu

SEQ ID NO: 46576 - RNA, 23 nt, Artificial Sequence
  RNA Oligomer
uacguguggcagugaagaagcuc

SEQ ID NO: 46577 - RNA, 23 nt, Artificial Sequence
  RNA Oligomer
uuacguguggcagugaagaagcu

SEQ ID NO: 46578 - RNA, 23 nt, Artificial Sequence
  RNA Oligomer
uuucaguccaucauucaugcgaa

SEQ ID NO: 46579 - RNA, 23 nt, Artificial Sequence
  RNA Oligomer
cuggaugcauuacaaccagacag

SEQ ID NO: 46580 - RNA, 23 nt, Artificial Sequence
  RNA Oligomer
acuggaugcauuacaaccagaca

SEQ ID NO: 46581 - RNA, 23 nt, Artificial Sequence
  RNA Oligomer
aacuggaugcauuacaaccagac

SEQ ID NO: 46582 - RNA, 23 nt, Artificial Sequence
  RNA Oligomer
aaaccuaguaaucuagcugugaa

SEQ ID NO: 46583 - RNA, 23 nt, Artificial Sequence
  RNA Oligomer
aaaaccuaguaaucuagcuguga

SEQ ID NO: 46584 - RNA, 23 nt, Artificial Sequence
  RNA Oligomer
uaaaaccuaguaaucuagcugug

SEQ ID NO: 46585 - RNA, 23 nt, Artificial Sequence
  RNA Oligomer
cuaaaaccuaguaaucuagcugu

SEQ ID NO: 46586 - RNA, 23 nt, Artificial Sequence
  RNA Oligomer
aucuaccaaauucuccgaggucu

SEQ ID NO: 46587 - RNA, 23 nt, Artificial Sequence
  RNA Oligomer
uaucuaccaaauucuccgagguc

SEQ ID NO: 46588 - RNA, 23 nt, Artificial Sequence
  RNA Oligomer
uuaucuaccaaauucuccgaggu

SEQ ID NO: 46589 - RNA, 23 nt, Artificial Sequence
  RNA Oligomer
gaacaacauugugaaaugucaga

SEQ ID NO: 46590 - RNA, 23 nt, Artificial Sequence
  RNA Oligomer
gugugugcugcuuuugacacaaa

SEQ ID NO: 46591 - RNA, 23 nt, Artificial Sequence
  RNA Oligomer
ugggaugcauaauggccgagcug

SEQ ID NO: 46592 - RNA, 23 nt, Artificial Sequence
  RNA Oligomer
gugggaugcauaauggccgagcu

SEQ ID NO: 46593 - RNA, 23 nt, Artificial Sequence
  RNA Oligomer
agugggaugcauaauggccgagc

SEQ ID NO: 46594 - RNA, 23 nt, Artificial Sequence
  RNA Oligomer
cagugggaugcauaauggccgag

SEQ ID NO: 46595 - RNA, 23 nt, Artificial Sequence
  RNA Oligomer
ucagugggaugcauaauggccga

SEQ ID NO: 46596 - RNA, 23 nt, Artificial Sequence
  RNA Oligomer
gcauuacaaccagacaguugaua

SEQ ID NO: 46597 - RNA, 23 nt, Artificial Sequence
  RNA Oligomer
uucacagggaccuaaaaccuagu

SEQ ID NO: 46598 - RNA, 23 nt, Artificial Sequence
  RNA Oligomer
auuucaguccaucauucaugcga

SEQ ID NO: 46599 - RNA, 23 nt, Artificial Sequence
  RNA Oligomer
gcuggaaaaugucucaggagagg

SEQ ID NO: 46600 - RNA, 23 nt, Artificial Sequence
  RNA Oligomer
cgcuggaaaaugucucaggagag

SEQ ID NO: 46601 - RNA, 23 nt, Artificial Sequence
  RNA Oligomer
ccgcuggaaaaugucucaggaga

SEQ ID NO: 46602 - RNA, 23 nt, Artificial Sequence
  RNA Oligomer
auucacagggaccuaaaaccuag

SEQ ID NO: 46603 - RNA, 23 nt, Artificial Sequence
  RNA Oligomer
gcguuaccagaaccugucuccag

SEQ ID NO: 46604 - RNA, 23 nt, Artificial Sequence
  RNA Oligomer
agcguuaccagaaccugucucca

SEQ ID NO: 46605 - RNA, 23 nt, Artificial Sequence
  RNA Oligomer
gagcguuaccagaaccugucucc

SEQ ID NO: 46606 - RNA, 23 nt, Artificial Sequence
  RNA Oligomer
cgagcguuaccagaaccugucuc

SEQ ID NO: 46607 - RNA, 23 nt, Artificial Sequence
  RNA Oligomer
ccgagcguuaccagaaccugucu

SEQ ID NO: 46608 - RNA, 23 nt, Artificial Sequence
  RNA Oligomer
cccgagcguuaccagaaccuguc

SEQ ID NO: 46609 - RNA, 23 nt, Artificial Sequence
  RNA Oligomer
aacauugugaaaugucagaagcu

SEQ ID NO: 46610 - RNA, 23 nt, Artificial Sequence
  RNA Oligomer
caacauugugaaaugucagaagc

SEQ ID NO: 46611 - RNA, 23 nt, Artificial Sequence
  RNA Oligomer
acaacauugugaaaugucagaag

SEQ ID NO: 46612 - RNA, 23 nt, Artificial Sequence
  RNA Oligomer
aacaacauugugaaaugucagaa

SEQ ID NO: 46613 - RNA, 23 nt, Artificial Sequence
  RNA Oligomer
gacguuuuuacaccugcaagguc

SEQ ID NO: 46614 - RNA, 23 nt, Artificial Sequence
  RNA Oligomer
ggacguuuuuacaccugcaaggu

SEQ ID NO: 46615 - RNA, 23 nt, Artificial Sequence
  RNA Oligomer
uggacguuuuuacaccugcaagg

SEQ ID NO: 46616 - RNA, 23 nt, Artificial Sequence
  RNA Oligomer
uuggacguuuuuacaccugcaag

SEQ ID NO: 46617 - RNA, 23 nt, Artificial Sequence
  RNA Oligomer
guuggacguuuuuacaccugcaa

SEQ ID NO: 46618 - RNA, 23 nt, Artificial Sequence
  RNA Oligomer
uguuggacguuuuuacaccugca

SEQ ID NO: 46619 - RNA, 23 nt, Artificial Sequence
  RNA Oligomer
uuggucuguuggacguuuuuaca

SEQ ID NO: 46620 - RNA, 23 nt, Artificial Sequence
  RNA Oligomer
auuggucuguuggacguuuuuac

SEQ ID NO: 46621 - RNA, 23 nt, Artificial Sequence
  RNA Oligomer
gauuggucuguuggacguuuuua

SEQ ID NO: 46622 - RNA, 23 nt, Artificial Sequence
  RNA Oligomer
ugauuggucuguuggacguuuuu

SEQ ID NO: 46623 - RNA, 23 nt, Artificial Sequence
  RNA Oligomer
gugauuggucuguuggacguuuu

SEQ ID NO: 46624 - RNA, 23 nt, Artificial Sequence
  RNA Oligomer
ggaaaaugucucaggagaggccc

SEQ ID NO: 46625 - RNA, 23 nt, Artificial Sequence
  RNA Oligomer
uggaaaaugucucaggagaggcc

SEQ ID NO: 46626 - RNA, 23 nt, Artificial Sequence
  RNA Oligomer
cuggaaaaugucucaggagaggc

SEQ ID NO: 46627 - RNA, 23 nt, Artificial Sequence
  RNA Oligomer
cugcuuuugacacaaaaacgggg

SEQ ID NO: 46628 - RNA, 23 nt, Artificial Sequence
  RNA Oligomer
gcugcuuuugacacaaaaacggg

SEQ ID NO: 46629 - RNA, 23 nt, Artificial Sequence
  RNA Oligomer
ucaugcugaacuggaugcauuac

SEQ ID NO: 46630 - RNA, 23 nt, Artificial Sequence
  RNA Oligomer
aucaugcugaacuggaugcauua

SEQ ID NO: 46631 - RNA, 23 nt, Artificial Sequence
  RNA Oligomer
auaauucacagggaccuaaaacc

SEQ ID NO: 46632 - RNA, 23 nt, Artificial Sequence
  RNA Oligomer
cauaauucacagggaccuaaaac

SEQ ID NO: 46633 - RNA, 23 nt, Artificial Sequence
  RNA Oligomer
cguuaccagaaccugucuccagu

SEQ ID NO: 46634 - RNA, 23 nt, Artificial Sequence
  RNA Oligomer
uggucuguuggacguuuuuacac

SEQ ID NO: 46635 - RNA, 23 nt, Artificial Sequence
  RNA Oligomer
ugugauuggucuguuggacguuu

SEQ ID NO: 46636 - RNA, 23 nt, Artificial Sequence
  RNA Oligomer
augugauuggucuguuggacguu

SEQ ID NO: 46637 - RNA, 23 nt, Artificial Sequence
  RNA Oligomer
aaugugauuggucuguuggacgu

SEQ ID NO: 46638 - RNA, 23 nt, Artificial Sequence
  RNA Oligomer
agaaccuacagagaacugcgguu

SEQ ID NO: 46639 - RNA, 23 nt, Artificial Sequence
  RNA Oligomer
aagaagcucuccagaccauuuca

SEQ ID NO: 46640 - RNA, 23 nt, Artificial Sequence
  RNA Oligomer
gaagaagcucuccagaccauuuc

SEQ ID NO: 46641 - RNA, 23 nt, Artificial Sequence
  RNA Oligomer
ugaagaagcucuccagaccauuu

SEQ ID NO: 46642 - RNA, 23 nt, Artificial Sequence
  RNA Oligomer
uuacaaccagacaguugauauuu

SEQ ID NO: 46643 - RNA, 23 nt, Artificial Sequence
  RNA Oligomer
auuacaaccagacaguugauauu

SEQ ID NO: 46644 - RNA, 23 nt, Artificial Sequence
  RNA Oligomer
gaacuggaugcauuacaaccaga

SEQ ID NO: 46645 - RNA, 23 nt, Artificial Sequence
  RNA Oligomer
gaucaugcugaacuggaugcauu

SEQ ID NO: 46646 - RNA, 23 nt, Artificial Sequence
  RNA Oligomer
gugaagaagcucuccagaccauu

SEQ ID NO: 46647 - RNA, 23 nt, Artificial Sequence
  RNA Oligomer
agugaagaagcucuccagaccau

SEQ ID NO: 46648 - RNA, 23 nt, Artificial Sequence
  RNA Oligomer
gcagugaagaagcucuccagacc

SEQ ID NO: 46649 - RNA, 23 nt, Artificial Sequence
  RNA Oligomer
ggcagugaagaagcucuccagac

SEQ ID NO: 46650 - RNA, 23 nt, Artificial Sequence
  RNA Oligomer
uggcagugaagaagcucuccaga

SEQ ID NO: 46651 - RNA, 23 nt, Artificial Sequence
  RNA Oligomer
guggcagugaagaagcucuccag

SEQ ID NO: 46652 - RNA, 23 nt, Artificial Sequence
  RNA Oligomer
uguggcagugaagaagcucucca

SEQ ID NO: 46653 - RNA, 23 nt, Artificial Sequence
  RNA Oligomer
acagggcuccugagaucaugcug

SEQ ID NO: 46654 - RNA, 23 nt, Artificial Sequence
  RNA Oligomer
uacagggcuccugagaucaugcu

SEQ ID NO: 46655 - RNA, 23 nt, Artificial Sequence
  RNA Oligomer
guacagggcuccugagaucaugc

SEQ ID NO: 46656 - RNA, 23 nt, Artificial Sequence
  RNA Oligomer
gguacagggcuccugagaucaug

SEQ ID NO: 46657 - RNA, 23 nt, Artificial Sequence
  RNA Oligomer
ugguacagggcuccugagaucau

SEQ ID NO: 46658 - RNA, 23 nt, Artificial Sequence
  RNA Oligomer
ugugugugcugcuuuugacacaa

SEQ ID NO: 46659 - RNA, 23 nt, Artificial Sequence
  RNA Oligomer
ggucuguuggacguuuuuacacc

SEQ ID NO: 46660 - RNA, 23 nt, Artificial Sequence
  RNA Oligomer
cugugugugcugcuuuugacaca

SEQ ID NO: 46661 - RNA, 23 nt, Artificial Sequence
  RNA Oligomer
cauuacaaccagacaguugauau

SEQ ID NO: 46662 - RNA, 23 nt, Artificial Sequence
  RNA Oligomer
gucuguuggacguuuuuacaccu

SEQ ID NO: 46663 - RNA, 23 nt, Artificial Sequence
  RNA Oligomer
uuguuuccugguacagaccauau

SEQ ID NO: 46664 - RNA, 23 nt, Artificial Sequence
  RNA Oligomer
auuguuuccugguacagaccaua

SEQ ID NO: 46665 - RNA, 23 nt, Artificial Sequence
  RNA Oligomer
cauuguuuccugguacagaccau

SEQ ID NO: 46666 - RNA, 23 nt, Artificial Sequence
  RNA Oligomer
cagugaagaagcucuccagacca

SEQ ID NO: 46667 - RNA, 23 nt, Artificial Sequence
  RNA Oligomer
accagaaccugucuccagugggc

SEQ ID NO: 46668 - RNA, 23 nt, Artificial Sequence
  RNA Oligomer
uaccagaaccugucuccaguggg

SEQ ID NO: 46669 - RNA, 23 nt, Artificial Sequence
  RNA Oligomer
uuaccagaaccugucuccagugg

SEQ ID NO: 46670 - RNA, 23 nt, Artificial Sequence
  RNA Oligomer
guuaccagaaccugucuccagug

SEQ ID NO: 46671 - RNA, 23 nt, Artificial Sequence
  RNA Oligomer
ccuuaucuaccaaauucuccgag

SEQ ID NO: 46672 - RNA, 23 nt, Artificial Sequence
  RNA Oligomer
gaaaugucagaagcuuacagaug

SEQ ID NO: 46673 - RNA, 23 nt, Artificial Sequence
  RNA Oligomer
gaaaaugucucaggagaggccca

SEQ ID NO: 46674 - RNA, 23 nt, Artificial Sequence
  RNA Oligomer
uguguaucuggugacccaucuca

SEQ ID NO: 46675 - RNA, 23 nt, Artificial Sequence
  RNA Oligomer
cuauggcucugugugugcugcuu

SEQ ID NO: 46676 - RNA, 23 nt, Artificial Sequence
  RNA Oligomer
gucuaaaguauauacauucagcu

SEQ ID NO: 46677 - RNA, 23 nt, Artificial Sequence
  RNA Oligomer
cuaaaguauauacauucagcuga

SEQ ID NO: 46678 - RNA, 23 nt, Artificial Sequence
  RNA Oligomer
aggucuaaaguauauacauucag

SEQ ID NO: 46679 - RNA, 23 nt, Artificial Sequence
  RNA Oligomer
ggucuaaaguauauacauucagc

SEQ ID NO: 46680 - RNA, 23 nt, Artificial Sequence
  RNA Oligomer
guguaucuggugacccaucucau

SEQ ID NO: 46681 - RNA, 23 nt, Artificial Sequence
  RNA Oligomer
ugauguguaucuggugacccauc

SEQ ID NO: 46682 - RNA, 23 nt, Artificial Sequence
  RNA Oligomer
acauuguuuccugguacagacca

SEQ ID NO: 46683 - RNA, 23 nt, Artificial Sequence
  RNA Oligomer
cuagauuacuagguuuuaggucc

SEQ ID NO: 46684 - RNA, 23 nt, Artificial Sequence
  RNA Oligomer
uagauuacuagguuuuagguccc

SEQ ID NO: 46685 - RNA, 23 nt, Artificial Sequence
  RNA Oligomer
agauuacuagguuuuaggucccu

SEQ ID NO: 46686 - RNA, 23 nt, Artificial Sequence
  RNA Oligomer
gauuacuagguuuuaggucccug

SEQ ID NO: 46687 - RNA, 23 nt, Artificial Sequence
  RNA Oligomer
auuacuagguuuuaggucccugu

SEQ ID NO: 46688 - RNA, 23 nt, Artificial Sequence
  RNA Oligomer
ccagauacacaucauugaauucc

SEQ ID NO: 46689 - RNA, 23 nt, Artificial Sequence
  RNA Oligomer
cagauacacaucauugaauuccu

SEQ ID NO: 46690 - RNA, 23 nt, Artificial Sequence
  RNA Oligomer
agauacacaucauugaauuccuc

SEQ ID NO: 46691 - RNA, 23 nt, Artificial Sequence
  RNA Oligomer
gauacacaucauugaauuccucc

SEQ ID NO: 46692 - RNA, 23 nt, Artificial Sequence
  RNA Oligomer
auacacaucauugaauuccucca

SEQ ID NO: 46693 - RNA, 23 nt, Artificial Sequence
  RNA Oligomer
cagcuagauuacuagguuuuagg

SEQ ID NO: 46694 - RNA, 23 nt, Artificial Sequence
  RNA Oligomer
agcuagauuacuagguuuuaggu

SEQ ID NO: 46695 - RNA, 23 nt, Artificial Sequence
  RNA Oligomer
gcuagauuacuagguuuuagguc

SEQ ID NO: 46696 - RNA, 23 nt, Artificial Sequence
  RNA Oligomer
cacaauguuguucagaucugccc

SEQ ID NO: 46697 - RNA, 23 nt, Artificial Sequence
  RNA Oligomer
acaauguuguucagaucugcccc

SEQ ID NO: 46698 - RNA, 23 nt, Artificial Sequence
  RNA Oligomer
caauguuguucagaucugccccc

SEQ ID NO: 46699 - RNA, 23 nt, Artificial Sequence
  RNA Oligomer
aauguuguucagaucugccccca

SEQ ID NO: 46700 - RNA, 23 nt, Artificial Sequence
  RNA Oligomer
auguuguucagaucugcccccau

SEQ ID NO: 46701 - RNA, 23 nt, Artificial Sequence
  RNA Oligomer
gcaugaaugauggacugaaaugg

SEQ ID NO: 46702 - RNA, 23 nt, Artificial Sequence
  RNA Oligomer
caugaaugauggacugaaauggu

SEQ ID NO: 46703 - RNA, 23 nt, Artificial Sequence
  RNA Oligomer
augaaugauggacugaaaugguc

SEQ ID NO: 46704 - RNA, 23 nt, Artificial Sequence
  RNA Oligomer
ugaaugauggacugaaauggucu

SEQ ID NO: 46705 - RNA, 23 nt, Artificial Sequence
  RNA Oligomer
gaaugauggacugaaauggucug

SEQ ID NO: 46706 - RNA, 23 nt, Artificial Sequence
  RNA Oligomer
gguucuuuucgcaugaaugaugg

SEQ ID NO: 46707 - RNA, 23 nt, Artificial Sequence
  RNA Oligomer
guucuuuucgcaugaaugaugga

SEQ ID NO: 46708 - RNA, 23 nt, Artificial Sequence
  RNA Oligomer
uucuuuucgcaugaaugauggac

SEQ ID NO: 46709 - RNA, 23 nt, Artificial Sequence
  RNA Oligomer
ucuuuucgcaugaaugauggacu

SEQ ID NO: 46710 - RNA, 23 nt, Artificial Sequence
  RNA Oligomer
cuuuucgcaugaaugauggacug

SEQ ID NO: 46711 - RNA, 23 nt, Artificial Sequence
  RNA Oligomer
uacacaucauugaauuccuccag

SEQ ID NO: 46712 - RNA, 23 nt, Artificial Sequence
  RNA Oligomer
ucuguaccaggaaacaauguucu

SEQ ID NO: 46713 - RNA, 23 nt, Artificial Sequence
  RNA Oligomer
cuguaccaggaaacaauguucuu

SEQ ID NO: 46714 - RNA, 23 nt, Artificial Sequence
  RNA Oligomer
uguaccaggaaacaauguucuuc

SEQ ID NO: 46715 - RNA, 23 nt, Artificial Sequence
  RNA Oligomer
guaccaggaaacaauguucuucc

SEQ ID NO: 46716 - RNA, 23 nt, Artificial Sequence
  RNA Oligomer
uaccaggaaacaauguucuucca

SEQ ID NO: 46717 - RNA, 23 nt, Artificial Sequence
  RNA Oligomer
ugucauuucaucaucugugugcc

SEQ ID NO: 46718 - RNA, 23 nt, Artificial Sequence
  RNA Oligomer
gucauuucaucaucugugugccg

SEQ ID NO: 46719 - RNA, 23 nt, Artificial Sequence
  RNA Oligomer
ucauuucaucaucugugugccga

SEQ ID NO: 46720 - RNA, 23 nt, Artificial Sequence
  RNA Oligomer
cauuucaucaucugugugccgag

SEQ ID NO: 46721 - RNA, 23 nt, Artificial Sequence
  RNA Oligomer
auuucaucaucugugugccgagc

SEQ ID NO: 46722 - RNA, 23 nt, Artificial Sequence
  RNA Oligomer
guccaaaauccagaaucuucagc

SEQ ID NO: 46723 - RNA, 23 nt, Artificial Sequence
  RNA Oligomer
uccaaaauccagaaucuucagcu

SEQ ID NO: 46724 - RNA, 23 nt, Artificial Sequence
  RNA Oligomer
ccaaaauccagaaucuucagcuc

SEQ ID NO: 46725 - RNA, 23 nt, Artificial Sequence
  RNA Oligomer
caaaauccagaaucuucagcuca

SEQ ID NO: 46726 - RNA, 23 nt, Artificial Sequence
  RNA Oligomer
aaaauccagaaucuucagcucac

SEQ ID NO: 46727 - RNA, 23 nt, Artificial Sequence
  RNA Oligomer
uucacaauguuguucagaucugc

SEQ ID NO: 46728 - RNA, 23 nt, Artificial Sequence
  RNA Oligomer
ucacaauguuguucagaucugcc

SEQ ID NO: 46729 - RNA, 23 nt, Artificial Sequence
  RNA Oligomer
caggaaacaauguucuuccaguc

SEQ ID NO: 46730 - RNA, 23 nt, Artificial Sequence
  RNA Oligomer
aggaaacaauguucuuccaguca

SEQ ID NO: 46731 - RNA, 23 nt, Artificial Sequence
  RNA Oligomer
ggaaacaauguucuuccagucaa

SEQ ID NO: 46732 - RNA, 23 nt, Artificial Sequence
  RNA Oligomer
gaaacaauguucuuccagucaac

SEQ ID NO: 46733 - RNA, 23 nt, Artificial Sequence
  RNA Oligomer
aaacaauguucuuccagucaaca

SEQ ID NO: 46734 - RNA, 23 nt, Artificial Sequence
  RNA Oligomer
cugguuguaaugcauccaguuca

SEQ ID NO: 46735 - RNA, 23 nt, Artificial Sequence
  RNA Oligomer
ugguuguaaugcauccaguucag

SEQ ID NO: 46736 - RNA, 23 nt, Artificial Sequence
  RNA Oligomer
gguuguaaugcauccaguucagc

SEQ ID NO: 46737 - RNA, 23 nt, Artificial Sequence
  RNA Oligomer
guuguaaugcauccaguucagca

SEQ ID NO: 46738 - RNA, 23 nt, Artificial Sequence
  RNA Oligomer
uuguaaugcauccaguucagcau

SEQ ID NO: 46739 - RNA, 23 nt, Artificial Sequence
  RNA Oligomer
cugucauuucaucaucugugugc

SEQ ID NO: 46740 - RNA, 23 nt, Artificial Sequence
  RNA Oligomer
aaauccagaaucuucagcucaca

SEQ ID NO: 46741 - RNA, 23 nt, Artificial Sequence
  RNA Oligomer
acuuuagaccucggagaauuugg

SEQ ID NO: 46742 - RNA, 23 nt, Artificial Sequence
  RNA Oligomer
cuuuagaccucggagaauuuggu

SEQ ID NO: 46743 - RNA, 23 nt, Artificial Sequence
  RNA Oligomer
uuuagaccucggagaauuuggua

SEQ ID NO: 46744 - RNA, 23 nt, Artificial Sequence
  RNA Oligomer
uuagaccucggagaauuugguag

SEQ ID NO: 46745 - RNA, 23 nt, Artificial Sequence
  RNA Oligomer
uagaccucggagaauuugguaga

SEQ ID NO: 46746 - RNA, 23 nt, Artificial Sequence
  RNA Oligomer
ugacauuucacaauguuguucag

SEQ ID NO: 46747 - RNA, 23 nt, Artificial Sequence
  RNA Oligomer
gacauuucacaauguuguucaga

SEQ ID NO: 46748 - RNA, 23 nt, Artificial Sequence
  RNA Oligomer
acauuucacaauguuguucagau

SEQ ID NO: 46749 - RNA, 23 nt, Artificial Sequence
  RNA Oligomer
cauuucacaauguuguucagauc

SEQ ID NO: 46750 - RNA, 23 nt, Artificial Sequence
  RNA Oligomer
auuucacaauguuguucagaucu

SEQ ID NO: 46751 - RNA, 23 nt, Artificial Sequence
  RNA Oligomer
auugaauuccuccagagaccuug

SEQ ID NO: 46752 - RNA, 23 nt, Artificial Sequence
  RNA Oligomer
uugaauuccuccagagaccuugc

SEQ ID NO: 46753 - RNA, 23 nt, Artificial Sequence
  RNA Oligomer
ugaauuccuccagagaccuugca

SEQ ID NO: 46754 - RNA, 23 nt, Artificial Sequence
  RNA Oligomer
gaauuccuccagagaccuugcag

SEQ ID NO: 46755 - RNA, 23 nt, Artificial Sequence
  RNA Oligomer
aauuccuccagagaccuugcagg

SEQ ID NO: 46756 - RNA, 23 nt, Artificial Sequence
  RNA Oligomer
aaugauggacugaaauggucugg

SEQ ID NO: 46757 - RNA, 23 nt, Artificial Sequence
  RNA Oligomer
aauccagaaucuucagcucacag

SEQ ID NO: 46758 - RNA, 23 nt, Artificial Sequence
  RNA Oligomer
ucggagaauuugguagauaagga

SEQ ID NO: 46759 - RNA, 23 nt, Artificial Sequence
  RNA Oligomer
cggagaauuugguagauaaggaa

SEQ ID NO: 46760 - RNA, 23 nt, Artificial Sequence
  RNA Oligomer
ggagaauuugguagauaaggaac

SEQ ID NO: 46761 - RNA, 23 nt, Artificial Sequence
  RNA Oligomer
gagaauuugguagauaaggaacu

SEQ ID NO: 46762 - RNA, 23 nt, Artificial Sequence
  RNA Oligomer
agaauuugguagauaaggaacug

SEQ ID NO: 46763 - RNA, 23 nt, Artificial Sequence
  RNA Oligomer
cugacauuucacaauguuguuca

SEQ ID NO: 46764 - RNA, 23 nt, Artificial Sequence
  RNA Oligomer
guuucauauguuuaaguaaccgc

SEQ ID NO: 46765 - RNA, 23 nt, Artificial Sequence
  RNA Oligomer
uuucauauguuuaaguaaccgca

SEQ ID NO: 46766 - RNA, 23 nt, Artificial Sequence
  RNA Oligomer
uucauauguuuaaguaaccgcag

SEQ ID NO: 46767 - RNA, 23 nt, Artificial Sequence
  RNA Oligomer
ucauauguuuaaguaaccgcagu

SEQ ID NO: 46768 - RNA, 23 nt, Artificial Sequence
  RNA Oligomer
cauauguuuaaguaaccgcaguu

SEQ ID NO: 46769 - RNA, 23 nt, Artificial Sequence
  RNA Oligomer
acaauguucuuccagucaacagc

SEQ ID NO: 46770 - RNA, 23 nt, Artificial Sequence
  RNA Oligomer
caauguucuuccagucaacagcu

SEQ ID NO: 46771 - RNA, 23 nt, Artificial Sequence
  RNA Oligomer
aauguucuuccagucaacagcuc

SEQ ID NO: 46772 - RNA, 23 nt, Artificial Sequence
  RNA Oligomer
auguucuuccagucaacagcucg

SEQ ID NO: 46773 - RNA, 23 nt, Artificial Sequence
  RNA Oligomer
uguucuuccagucaacagcucgg

SEQ ID NO: 46774 - RNA, 23 nt, Artificial Sequence
  RNA Oligomer
ugugaauuaugucagcugaaugu

SEQ ID NO: 46775 - RNA, 23 nt, Artificial Sequence
  RNA Oligomer
gugaauuaugucagcugaaugua

SEQ ID NO: 46776 - RNA, 23 nt, Artificial Sequence
  RNA Oligomer
ugaauuaugucagcugaauguau

SEQ ID NO: 46777 - RNA, 23 nt, Artificial Sequence
  RNA Oligomer
gaauuaugucagcugaauguaua

SEQ ID NO: 46778 - RNA, 23 nt, Artificial Sequence
  RNA Oligomer
aauuaugucagcugaauguauau

SEQ ID NO: 46779 - RNA, 23 nt, Artificial Sequence
  RNA Oligomer
gaauguauauacuuuagaccucg

SEQ ID NO: 46780 - RNA, 23 nt, Artificial Sequence
  RNA Oligomer
aauguauauacuuuagaccucgg

SEQ ID NO: 46781 - RNA, 23 nt, Artificial Sequence
  RNA Oligomer
auguauauacuuuagaccucgga

SEQ ID NO: 46782 - RNA, 23 nt, Artificial Sequence
  RNA Oligomer
uguauauacuuuagaccucggag

SEQ ID NO: 46783 - RNA, 23 nt, Artificial Sequence
  RNA Oligomer
guauauacuuuagaccucggaga

SEQ ID NO: 46784 - RNA, 23 nt, Artificial Sequence
  RNA Oligomer
uauauacuuuagaccucggagaa

SEQ ID NO: 46785 - RNA, 23 nt, Artificial Sequence
  RNA Oligomer
gaauuugguagauaaggaacuga

SEQ ID NO: 46786 - RNA, 23 nt, Artificial Sequence
  RNA Oligomer
aauuugguagauaaggaacugaa

SEQ ID NO: 46787 - RNA, 23 nt, Artificial Sequence
  RNA Oligomer
auuugguagauaaggaacugaac

SEQ ID NO: 46788 - RNA, 23 nt, Artificial Sequence
  RNA Oligomer
uuugguagauaaggaacugaaca

SEQ ID NO: 46789 - RNA, 23 nt, Artificial Sequence
  RNA Oligomer
uugguagauaaggaacugaacau

SEQ ID NO: 46790 - RNA, 23 nt, Artificial Sequence
  RNA Oligomer
aucauugaauuccuccagagacc

SEQ ID NO: 46791 - RNA, 23 nt, Artificial Sequence
  RNA Oligomer
ucauugaauuccuccagagaccu

SEQ ID NO: 46792 - RNA, 23 nt, Artificial Sequence
  RNA Oligomer
cauugaauuccuccagagaccuu

SEQ ID NO: 46793 - RNA, 23 nt, Artificial Sequence
  RNA Oligomer
auuccuccagagaccuugcaggu

SEQ ID NO: 46794 - RNA, 23 nt, Artificial Sequence
  RNA Oligomer
uguuucauauguuuaaguaaccg

SEQ ID NO: 46795 - RNA, 23 nt, Artificial Sequence
  RNA Oligomer
auauguuuaaguaaccgcaguuc

SEQ ID NO: 46796 - RNA, 23 nt, Artificial Sequence
  RNA Oligomer
gucuguaccaggaaacaauguuc

SEQ ID NO: 46797 - RNA, 23 nt, Artificial Sequence
  RNA Oligomer
aacaauguucuuccagucaacag

SEQ ID NO: 46798 - RNA, 23 nt, Artificial Sequence
  RNA Oligomer
guucuuccagucaacagcucggc

SEQ ID NO: 46799 - RNA, 23 nt, Artificial Sequence
  RNA Oligomer
uucuuccagucaacagcucggcc

SEQ ID NO: 46800 - RNA, 23 nt, Artificial Sequence
  RNA Oligomer
ccaguucagcaugaucucaggag

SEQ ID NO: 46801 - RNA, 23 nt, Artificial Sequence
  RNA Oligomer
caguucagcaugaucucaggagc

SEQ ID NO: 46802 - RNA, 23 nt, Artificial Sequence
  RNA Oligomer
aguucagcaugaucucaggagcc

SEQ ID NO: 46803 - RNA, 23 nt, Artificial Sequence
  RNA Oligomer
guucagcaugaucucaggagccc

SEQ ID NO: 46804 - RNA, 23 nt, Artificial Sequence
  RNA Oligomer
uucagcaugaucucaggagcccu

SEQ ID NO: 46805 - RNA, 23 nt, Artificial Sequence
  RNA Oligomer
uuaugucagcugaauguauauac

SEQ ID NO: 46806 - RNA, 23 nt, Artificial Sequence
  RNA Oligomer
uaugucagcugaauguauauacu

SEQ ID NO: 46807 - RNA, 23 nt, Artificial Sequence
  RNA Oligomer
augucagcugaauguauauacuu

SEQ ID NO: 46808 - RNA, 23 nt, Artificial Sequence
  RNA Oligomer
ugucagcugaauguauauacuuu

SEQ ID NO: 46809 - RNA, 23 nt, Artificial Sequence
  RNA Oligomer
gucagcugaauguauauacuuua

SEQ ID NO: 46810 - RNA, 23 nt, Artificial Sequence
  RNA Oligomer
acugaacauggucaucuguaagc

SEQ ID NO: 46811 - RNA, 23 nt, Artificial Sequence
  RNA Oligomer
cugaacauggucaucuguaagcu

SEQ ID NO: 46812 - RNA, 23 nt, Artificial Sequence
  RNA Oligomer
ugaacauggucaucuguaagcuu

SEQ ID NO: 46813 - RNA, 23 nt, Artificial Sequence
  RNA Oligomer
gaacauggucaucuguaagcuuc

SEQ ID NO: 46814 - RNA, 23 nt, Artificial Sequence
  RNA Oligomer
aacauggucaucuguaagcuucu

SEQ ID NO: 46815 - RNA, 23 nt, Artificial Sequence
  RNA Oligomer
acauggucaucuguaagcuucug

SEQ ID NO: 46816 - RNA, 23 nt, Artificial Sequence
  RNA Oligomer
cauggucaucuguaagcuucuga

SEQ ID NO: 46817 - RNA, 23 nt, Artificial Sequence
  RNA Oligomer
auggucaucuguaagcuucugac

SEQ ID NO: 46818 - RNA, 23 nt, Artificial Sequence
  RNA Oligomer
uggucaucuguaagcuucugaca

SEQ ID NO: 46819 - RNA, 23 nt, Artificial Sequence
  RNA Oligomer
ggucaucuguaagcuucugacau

SEQ ID NO: 46820 - RNA, 23 nt, Artificial Sequence
  RNA Oligomer
gucaucuguaagcuucugacauu

SEQ ID NO: 46821 - RNA, 23 nt, Artificial Sequence
  RNA Oligomer
uuucacaauguuguucagaucug

SEQ ID NO: 46822 - RNA, 23 nt, Artificial Sequence
  RNA Oligomer
acacaucauugaauuccuccaga

SEQ ID NO: 46823 - RNA, 23 nt, Artificial Sequence
  RNA Oligomer
cacaucauugaauuccuccagag

SEQ ID NO: 46824 - RNA, 23 nt, Artificial Sequence
  RNA Oligomer
uuccuccagagaccuugcaggug

SEQ ID NO: 46825 - RNA, 23 nt, Artificial Sequence
  RNA Oligomer
aguucucuguagguucuuuucgc

SEQ ID NO: 46826 - RNA, 23 nt, Artificial Sequence
  RNA Oligomer
guucucuguagguucuuuucgca

SEQ ID NO: 46827 - RNA, 23 nt, Artificial Sequence
  RNA Oligomer
uucucuguagguucuuuucgcau

SEQ ID NO: 46828 - RNA, 23 nt, Artificial Sequence
  RNA Oligomer
ucucuguagguucuuuucgcaug

SEQ ID NO: 46829 - RNA, 23 nt, Artificial Sequence
  RNA Oligomer
cucuguagguucuuuucgcauga

SEQ ID NO: 46830 - RNA, 23 nt, Artificial Sequence
  RNA Oligomer
uuuucgcaugaaugauggacuga

SEQ ID NO: 46831 - RNA, 23 nt, Artificial Sequence
  RNA Oligomer
cuucuucacugccacacguaacc

SEQ ID NO: 46832 - RNA, 23 nt, Artificial Sequence
  RNA Oligomer
uucuucacugccacacguaaccc

SEQ ID NO: 46833 - RNA, 23 nt, Artificial Sequence
  RNA Oligomer
ucuucacugccacacguaacccc

SEQ ID NO: 46834 - RNA, 23 nt, Artificial Sequence
  RNA Oligomer
cuucacugccacacguaaccccg

SEQ ID NO: 46835 - RNA, 23 nt, Artificial Sequence
  RNA Oligomer
uucacugccacacguaaccccgu

SEQ ID NO: 46836 - RNA, 23 nt, Artificial Sequence
  RNA Oligomer
agucaacagcucggccauuaugc

SEQ ID NO: 46837 - RNA, 23 nt, Artificial Sequence
  RNA Oligomer
gucaacagcucggccauuaugca

SEQ ID NO: 46838 - RNA, 23 nt, Artificial Sequence
  RNA Oligomer
ucaacagcucggccauuaugcau

SEQ ID NO: 46839 - RNA, 23 nt, Artificial Sequence
  RNA Oligomer
caacagcucggccauuaugcauc

SEQ ID NO: 46840 - RNA, 23 nt, Artificial Sequence
  RNA Oligomer
aacagcucggccauuaugcaucc

SEQ ID NO: 46841 - RNA, 23 nt, Artificial Sequence
  RNA Oligomer
augcauccaguucagcaugaucu

SEQ ID NO: 46842 - RNA, 23 nt, Artificial Sequence
  RNA Oligomer
ugcauccaguucagcaugaucuc

SEQ ID NO: 46843 - RNA, 23 nt, Artificial Sequence
  RNA Oligomer
gcauccaguucagcaugaucuca

SEQ ID NO: 46844 - RNA, 23 nt, Artificial Sequence
  RNA Oligomer
cauccaguucagcaugaucucag

SEQ ID NO: 46845 - RNA, 23 nt, Artificial Sequence
  RNA Oligomer
auccaguucagcaugaucucagg

SEQ ID NO: 46846 - RNA, 23 nt, Artificial Sequence
  RNA Oligomer
uuucaucaucugugugccgagcc

SEQ ID NO: 46847 - RNA, 23 nt, Artificial Sequence
  RNA Oligomer
auauacuuuagaccucggagaau

SEQ ID NO: 46848 - RNA, 23 nt, Artificial Sequence
  RNA Oligomer
ucaucuguaagcuucugacauuu

SEQ ID NO: 46849 - RNA, 23 nt, Artificial Sequence
  RNA Oligomer
acaucauugaauuccuccagaga

SEQ ID NO: 46850 - RNA, 23 nt, Artificial Sequence
  RNA Oligomer
caucauugaauuccuccagagac

SEQ ID NO: 46851 - RNA, 23 nt, Artificial Sequence
  RNA Oligomer
ccagauugucuuguucagcuccu

SEQ ID NO: 46852 - RNA, 23 nt, Artificial Sequence
  RNA Oligomer
cagauugucuuguucagcuccug

SEQ ID NO: 46853 - RNA, 23 nt, Artificial Sequence
  RNA Oligomer
agauugucuuguucagcuccugc

SEQ ID NO: 46854 - RNA, 23 nt, Artificial Sequence
  RNA Oligomer
gauugucuuguucagcuccugcc

SEQ ID NO: 46855 - RNA, 23 nt, Artificial Sequence
  RNA Oligomer
auugucuuguucagcuccugccg

SEQ ID NO: 46856 - RNA, 23 nt, Artificial Sequence
  RNA Oligomer
uauguuuaaguaaccgcaguucu

SEQ ID NO: 46857 - RNA, 23 nt, Artificial Sequence
  RNA Oligomer
auguuuaaguaaccgcaguucuc

SEQ ID NO: 46858 - RNA, 23 nt, Artificial Sequence
  RNA Oligomer
uguuuaaguaaccgcaguucucu

SEQ ID NO: 46859 - RNA, 23 nt, Artificial Sequence
  RNA Oligomer
guuuaaguaaccgcaguucucug

SEQ ID NO: 46860 - RNA, 23 nt, Artificial Sequence
  RNA Oligomer
uuuaaguaaccgcaguucucugu

SEQ ID NO: 46861 - RNA, 23 nt, Artificial Sequence
  RNA Oligomer
caguucucuguagguucuuuucg

SEQ ID NO: 46862 - RNA, 23 nt, Artificial Sequence
  RNA Oligomer
uguaaugcauccaguucagcaug

SEQ ID NO: 46863 - RNA, 23 nt, Artificial Sequence
  RNA Oligomer
uccaguucagcaugaucucagga

SEQ ID NO: 46864 - RNA, 23 nt, Artificial Sequence
  RNA Oligomer
gccugucauuucaucaucugugu

SEQ ID NO: 46865 - RNA, 23 nt, Artificial Sequence
  RNA Oligomer
ccugucauuucaucaucugugug

SEQ ID NO: 46866 - RNA, 23 nt, Artificial Sequence
  RNA Oligomer
uucaucaucugugugccgagcca

SEQ ID NO: 46867 - RNA, 23 nt, Artificial Sequence
  RNA Oligomer
agccaguccaaaauccagaaucu

SEQ ID NO: 46868 - RNA, 23 nt, Artificial Sequence
  RNA Oligomer
gccaguccaaaauccagaaucuu

SEQ ID NO: 46869 - RNA, 23 nt, Artificial Sequence
  RNA Oligomer
ccaguccaaaauccagaaucuuc

SEQ ID NO: 46870 - RNA, 23 nt, Artificial Sequence
  RNA Oligomer
caguccaaaauccagaaucuuca

SEQ ID NO: 46871 - RNA, 23 nt, Artificial Sequence
  RNA Oligomer
aguccaaaauccagaaucuucag

SEQ ID NO: 46872 - RNA, 23 nt, Artificial Sequence
  RNA Oligomer
auccagaaucuucagcucacagu

SEQ ID NO: 46873 - RNA, 23 nt, Artificial Sequence
  RNA Oligomer
ccagaaucuucagcucacagucu

SEQ ID NO: 46874 - RNA, 23 nt, Artificial Sequence
  RNA Oligomer
cagaaucuucagcucacagucuu

SEQ ID NO: 46875 - RNA, 23 nt, Artificial Sequence
  RNA Oligomer
agaaucuucagcucacagucuuc

SEQ ID NO: 46876 - RNA, 23 nt, Artificial Sequence
  RNA Oligomer
gaaucuucagcucacagucuuca

SEQ ID NO: 46877 - RNA, 23 nt, Artificial Sequence
  RNA Oligomer
aaucuucagcucacagucuucau

SEQ ID NO: 46878 - RNA, 23 nt, Artificial Sequence
  RNA Oligomer
uuaggucccugugaauuauguca

SEQ ID NO: 46879 - RNA, 23 nt, Artificial Sequence
  RNA Oligomer
uaggucccugugaauuaugucag

SEQ ID NO: 46880 - RNA, 23 nt, Artificial Sequence
  RNA Oligomer
aggucccugugaauuaugucagc

SEQ ID NO: 46881 - RNA, 23 nt, Artificial Sequence
  RNA Oligomer
ggucccugugaauuaugucagcu

SEQ ID NO: 46882 - RNA, 23 nt, Artificial Sequence
  RNA Oligomer
gucccugugaauuaugucagcug

SEQ ID NO: 46883 - RNA, 23 nt, Artificial Sequence
  RNA Oligomer
ugaauguauauacuuuagaccuc

SEQ ID NO: 46884 - RNA, 23 nt, Artificial Sequence
  RNA Oligomer
agauaaggaacugaacaugguca

SEQ ID NO: 46885 - RNA, 23 nt, Artificial Sequence
  RNA Oligomer
gauaaggaacugaacauggucau

SEQ ID NO: 46886 - RNA, 23 nt, Artificial Sequence
  RNA Oligomer
auaaggaacugaacauggucauc

SEQ ID NO: 46887 - RNA, 23 nt, Artificial Sequence
  RNA Oligomer
uaaggaacugaacauggucaucu

SEQ ID NO: 46888 - RNA, 23 nt, Artificial Sequence
  RNA Oligomer
aaggaacugaacauggucaucug

SEQ ID NO: 46889 - RNA, 23 nt, Artificial Sequence
  RNA Oligomer
cuguaagcuucugacauuucaca

SEQ ID NO: 46890 - RNA, 23 nt, Artificial Sequence
  RNA Oligomer
uguaagcuucugacauuucacaa

SEQ ID NO: 46891 - RNA, 23 nt, Artificial Sequence
  RNA Oligomer
guaagcuucugacauuucacaau

SEQ ID NO: 46892 - RNA, 23 nt, Artificial Sequence
  RNA Oligomer
uaagcuucugacauuucacaaug

SEQ ID NO: 46893 - RNA, 23 nt, Artificial Sequence
  RNA Oligomer
aagcuucugacauuucacaaugu

SEQ ID NO: 46894 - RNA, 23 nt, Artificial Sequence
  RNA Oligomer
uugucuuguucagcuccugccgg

SEQ ID NO: 46895 - RNA, 23 nt, Artificial Sequence
  RNA Oligomer
gcaguucucuguagguucuuuuc

SEQ ID NO: 46896 - RNA, 23 nt, Artificial Sequence
  RNA Oligomer
ucuuccagucaacagcucggcca

SEQ ID NO: 46897 - RNA, 23 nt, Artificial Sequence
  RNA Oligomer
aucaacugucugguuguaaugca

SEQ ID NO: 46898 - RNA, 23 nt, Artificial Sequence
  RNA Oligomer
ucaacugucugguuguaaugcau

SEQ ID NO: 46899 - RNA, 23 nt, Artificial Sequence
  RNA Oligomer
caacugucugguuguaaugcauc

SEQ ID NO: 46900 - RNA, 23 nt, Artificial Sequence
  RNA Oligomer
aacugucugguuguaaugcaucc

SEQ ID NO: 46901 - RNA, 23 nt, Artificial Sequence
  RNA Oligomer
acugucugguuguaaugcaucca

SEQ ID NO: 46902 - RNA, 23 nt, Artificial Sequence
  RNA Oligomer
uggccacguagccugucauuuca

SEQ ID NO: 46903 - RNA, 23 nt, Artificial Sequence
  RNA Oligomer
ggccacguagccugucauuucau

SEQ ID NO: 46904 - RNA, 23 nt, Artificial Sequence
  RNA Oligomer
gccacguagccugucauuucauc

SEQ ID NO: 46905 - RNA, 23 nt, Artificial Sequence
  RNA Oligomer
ccacguagccugucauuucauca

SEQ ID NO: 46906 - RNA, 23 nt, Artificial Sequence
  RNA Oligomer
cacguagccugucauuucaucau

SEQ ID NO: 46907 - RNA, 23 nt, Artificial Sequence
  RNA Oligomer
acguagccugucauuucaucauc

SEQ ID NO: 46908 - RNA, 23 nt, Artificial Sequence
  RNA Oligomer
cguagccugucauuucaucaucu

SEQ ID NO: 46909 - RNA, 23 nt, Artificial Sequence
  RNA Oligomer
guagccugucauuucaucaucug

SEQ ID NO: 46910 - RNA, 23 nt, Artificial Sequence
  RNA Oligomer
uagccugucauuucaucaucugu

SEQ ID NO: 46911 - RNA, 23 nt, Artificial Sequence
  RNA Oligomer
agccugucauuucaucaucugug

SEQ ID NO: 46912 - RNA, 23 nt, Artificial Sequence
  RNA Oligomer
aucuucagcucacagucuucauu

SEQ ID NO: 46913 - RNA, 23 nt, Artificial Sequence
  RNA Oligomer
ucuucagcucacagucuucauuc

SEQ ID NO: 46914 - RNA, 23 nt, Artificial Sequence
  RNA Oligomer
cuucagcucacagucuucauuca

SEQ ID NO: 46915 - RNA, 23 nt, Artificial Sequence
  RNA Oligomer
uuuuaggucccugugaauuaugu

SEQ ID NO: 46916 - RNA, 23 nt, Artificial Sequence
  RNA Oligomer
uuuaggucccugugaauuauguc

SEQ ID NO: 46917 - RNA, 23 nt, Artificial Sequence
  RNA Oligomer
ucccugugaauuaugucagcuga

SEQ ID NO: 46918 - RNA, 23 nt, Artificial Sequence
  RNA Oligomer
uacuuuagaccucggagaauuug

SEQ ID NO: 46919 - RNA, 23 nt, Artificial Sequence
  RNA Oligomer
aucuguaagcuucugacauuuca

SEQ ID NO: 46920 - RNA, 23 nt, Artificial Sequence
  RNA Oligomer
ucuguaagcuucugacauuucac

SEQ ID NO: 46921 - RNA, 23 nt, Artificial Sequence
  RNA Oligomer
cuccugagacauuuuccagcggc

SEQ ID NO: 46922 - RNA, 23 nt, Artificial Sequence
  RNA Oligomer
uccugagacauuuuccagcggca

SEQ ID NO: 46923 - RNA, 23 nt, Artificial Sequence
  RNA Oligomer
ccugagacauuuuccagcggcag

SEQ ID NO: 46924 - RNA, 23 nt, Artificial Sequence
  RNA Oligomer
cugagacauuuuccagcggcagc

SEQ ID NO: 46925 - RNA, 23 nt, Artificial Sequence
  RNA Oligomer
ugagacauuuuccagcggcagcc

SEQ ID NO: 46926 - RNA, 23 nt, Artificial Sequence
  RNA Oligomer
ucccagauugucuuguucagcuc

SEQ ID NO: 46927 - RNA, 23 nt, Artificial Sequence
  RNA Oligomer
cccagauugucuuguucagcucc

SEQ ID NO: 46928 - RNA, 23 nt, Artificial Sequence
  RNA Oligomer
uuaaguaaccgcaguucucugua

SEQ ID NO: 46929 - RNA, 23 nt, Artificial Sequence
  RNA Oligomer
uaaguaaccgcaguucucuguag

SEQ ID NO: 46930 - RNA, 23 nt, Artificial Sequence
  RNA Oligomer
agguucuuuucgcaugaaugaug

SEQ ID NO: 46931 - RNA, 23 nt, Artificial Sequence
  RNA Oligomer
cggccauuaugcaucccacugac

SEQ ID NO: 46932 - RNA, 23 nt, Artificial Sequence
  RNA Oligomer
ggccauuaugcaucccacugacc

SEQ ID NO: 46933 - RNA, 23 nt, Artificial Sequence
  RNA Oligomer
gccauuaugcaucccacugacca

SEQ ID NO: 46934 - RNA, 23 nt, Artificial Sequence
  RNA Oligomer
ccauuaugcaucccacugaccaa

SEQ ID NO: 46935 - RNA, 23 nt, Artificial Sequence
  RNA Oligomer
cauuaugcaucccacugaccaaa

SEQ ID NO: 46936 - RNA, 23 nt, Artificial Sequence
  RNA Oligomer
auuaugcaucccacugaccaaau

SEQ ID NO: 46937 - RNA, 23 nt, Artificial Sequence
  RNA Oligomer
ugucaaaagcagcacacacagag

SEQ ID NO: 46938 - RNA, 23 nt, Artificial Sequence
  RNA Oligomer
gucaaaagcagcacacacagagc

SEQ ID NO: 46939 - RNA, 23 nt, Artificial Sequence
  RNA Oligomer
ucaaaagcagcacacacagagcc

SEQ ID NO: 46940 - RNA, 23 nt, Artificial Sequence
  RNA Oligomer
caaaagcagcacacacagagcca

SEQ ID NO: 46941 - RNA, 23 nt, Artificial Sequence
  RNA Oligomer
aaaagcagcacacacagagccau

SEQ ID NO: 46942 - RNA, 23 nt, Artificial Sequence
  RNA Oligomer
cagcucacagucuucauucacag

SEQ ID NO: 46943 - RNA, 23 nt, Artificial Sequence
  RNA Oligomer
agcucacagucuucauucacagc

SEQ ID NO: 46944 - RNA, 23 nt, Artificial Sequence
  RNA Oligomer
gcucacagucuucauucacagcu

SEQ ID NO: 46945 - RNA, 23 nt, Artificial Sequence
  RNA Oligomer
cucacagucuucauucacagcua

SEQ ID NO: 46946 - RNA, 23 nt, Artificial Sequence
  RNA Oligomer
ucacagucuucauucacagcuag

SEQ ID NO: 46947 - RNA, 23 nt, Artificial Sequence
  RNA Oligomer
cacagucuucauucacagcuaga

SEQ ID NO: 46948 - RNA, 23 nt, Artificial Sequence
  RNA Oligomer
acagucuucauucacagcuagau

SEQ ID NO: 46949 - RNA, 23 nt, Artificial Sequence
  RNA Oligomer
agucuucauucacagcuagauua

SEQ ID NO: 46950 - RNA, 23 nt, Artificial Sequence
  RNA Oligomer
gucuucauucacagcuagauuac

SEQ ID NO: 46951 - RNA, 23 nt, Artificial Sequence
  RNA Oligomer
ucuucauucacagcuagauuacu

SEQ ID NO: 46952 - RNA, 23 nt, Artificial Sequence
  RNA Oligomer
cuucauucacagcuagauuacua

SEQ ID NO: 46953 - RNA, 23 nt, Artificial Sequence
  RNA Oligomer
uucauucacagcuagauuacuag

SEQ ID NO: 46954 - RNA, 23 nt, Artificial Sequence
  RNA Oligomer
guagauaaggaacugaacauggu

SEQ ID NO: 46955 - RNA, 23 nt, Artificial Sequence
  RNA Oligomer
uagauaaggaacugaacaugguc

SEQ ID NO: 46956 - RNA, 23 nt, Artificial Sequence
  RNA Oligomer
aggaacugaacauggucaucugu

SEQ ID NO: 46957 - RNA, 23 nt, Artificial Sequence
  RNA Oligomer
ggaacugaacauggucaucugua

SEQ ID NO: 46958 - RNA, 23 nt, Artificial Sequence
  RNA Oligomer
gaacugaacauggucaucuguaa

SEQ ID NO: 46959 - RNA, 23 nt, Artificial Sequence
  RNA Oligomer
aacugaacauggucaucuguaag

SEQ ID NO: 46960 - RNA, 23 nt, Artificial Sequence
  RNA Oligomer
guccaacagaccaaucacauuuu

SEQ ID NO: 46961 - RNA, 23 nt, Artificial Sequence
  RNA Oligomer
uccaacagaccaaucacauuuuc

SEQ ID NO: 46962 - RNA, 23 nt, Artificial Sequence
  RNA Oligomer
ccaacagaccaaucacauuuuca

SEQ ID NO: 46963 - RNA, 23 nt, Artificial Sequence
  RNA Oligomer
caacagaccaaucacauuuucau

SEQ ID NO: 46964 - RNA, 23 nt, Artificial Sequence
  RNA Oligomer
aacagaccaaucacauuuucaug

SEQ ID NO: 46965 - RNA, 23 nt, Artificial Sequence
  RNA Oligomer
acagaccaaucacauuuucaugu

SEQ ID NO: 46966 - RNA, 23 nt, Artificial Sequence
  RNA Oligomer
cagaccaaucacauuuucauguu

SEQ ID NO: 46967 - RNA, 23 nt, Artificial Sequence
  RNA Oligomer
agaccaaucacauuuucauguuu

SEQ ID NO: 46968 - RNA, 23 nt, Artificial Sequence
  RNA Oligomer
gaccaaucacauuuucauguuuc

SEQ ID NO: 46969 - RNA, 23 nt, Artificial Sequence
  RNA Oligomer
accaaucacauuuucauguuuca

SEQ ID NO: 46970 - RNA, 23 nt, Artificial Sequence
  RNA Oligomer
ucuguagguucuuuucgcaugaa

SEQ ID NO: 46971 - RNA, 23 nt, Artificial Sequence
  RNA Oligomer
augauggacugaaauggucugga

SEQ ID NO: 46972 - RNA, 23 nt, Artificial Sequence
  RNA Oligomer
ugauggacugaaauggucuggag

SEQ ID NO: 46973 - RNA, 23 nt, Artificial Sequence
  RNA Oligomer
gauggacugaaauggucuggaga

SEQ ID NO: 46974 - RNA, 23 nt, Artificial Sequence
  RNA Oligomer
auggacugaaauggucuggagag

SEQ ID NO: 46975 - RNA, 23 nt, Artificial Sequence
  RNA Oligomer
uuaugcaucccacugaccaaaua

SEQ ID NO: 46976 - RNA, 23 nt, Artificial Sequence
  RNA Oligomer
ucagcaugaucucaggagcccug

SEQ ID NO: 46977 - RNA, 23 nt, Artificial Sequence
  RNA Oligomer
uucagcucacagucuucauucac

SEQ ID NO: 46978 - RNA, 23 nt, Artificial Sequence
  RNA Oligomer
ucagcucacagucuucauucaca

SEQ ID NO: 46979 - RNA, 23 nt, Artificial Sequence
  RNA Oligomer
gggcaccucccagauugucuugu

SEQ ID NO: 46980 - RNA, 23 nt, Artificial Sequence
  RNA Oligomer
ggcaccucccagauugucuuguu

SEQ ID NO: 46981 - RNA, 23 nt, Artificial Sequence
  RNA Oligomer
gcaccucccagauugucuuguuc

SEQ ID NO: 46982 - RNA, 23 nt, Artificial Sequence
  RNA Oligomer
caccucccagauugucuuguuca

SEQ ID NO: 46983 - RNA, 23 nt, Artificial Sequence
  RNA Oligomer
accucccagauugucuuguucag

SEQ ID NO: 46984 - RNA, 23 nt, Artificial Sequence
  RNA Oligomer
cucccagauugucuuguucagcu

SEQ ID NO: 46985 - RNA, 23 nt, Artificial Sequence
  RNA Oligomer
uggacugaaauggucuggagagc

SEQ ID NO: 46986 - RNA, 23 nt, Artificial Sequence
  RNA Oligomer
ggacugaaauggucuggagagcu

SEQ ID NO: 46987 - RNA, 23 nt, Artificial Sequence
  RNA Oligomer
gacugaaauggucuggagagcuu

SEQ ID NO: 46988 - RNA, 23 nt, Artificial Sequence
  RNA Oligomer
acugaaauggucuggagagcuuc

SEQ ID NO: 46989 - RNA, 23 nt, Artificial Sequence
  RNA Oligomer
cugaaauggucuggagagcuucu

SEQ ID NO: 46990 - RNA, 23 nt, Artificial Sequence
  RNA Oligomer
ugaccaaauaucaacugucuggu

SEQ ID NO: 46991 - RNA, 23 nt, Artificial Sequence
  RNA Oligomer
gaccaaauaucaacugucugguu

SEQ ID NO: 46992 - RNA, 23 nt, Artificial Sequence
  RNA Oligomer
accaaauaucaacugucugguug

SEQ ID NO: 46993 - RNA, 23 nt, Artificial Sequence
  RNA Oligomer
ccaaauaucaacugucugguugu

SEQ ID NO: 46994 - RNA, 23 nt, Artificial Sequence
  RNA Oligomer
caaauaucaacugucugguugua

SEQ ID NO: 46995 - RNA, 23 nt, Artificial Sequence
  RNA Oligomer
cagucuucauucacagcuagauu

SEQ ID NO: 46996 - RNA, 23 nt, Artificial Sequence
  RNA Oligomer
ucauucacagcuagauuacuagg

SEQ ID NO: 46997 - RNA, 23 nt, Artificial Sequence
  RNA Oligomer
cauucacagcuagauuacuaggu

SEQ ID NO: 46998 - RNA, 23 nt, Artificial Sequence
  RNA Oligomer
auucacagcuagauuacuagguu

SEQ ID NO: 46999 - RNA, 23 nt, Artificial Sequence
  RNA Oligomer
uauacuuuagaccucggagaauu

SEQ ID NO: 47000 - RNA, 23 nt, Artificial Sequence
  RNA Oligomer
auacuuuagaccucggagaauuu

SEQ ID NO: 47001 - RNA, 23 nt, Artificial Sequence
  RNA Oligomer
gguagauaaggaacugaacaugg

SEQ ID NO: 47002 - RNA, 23 nt, Artificial Sequence
  RNA Oligomer
ccucccagauugucuuguucagc

SEQ ID NO: 47003 - RNA, 23 nt, Artificial Sequence
  RNA Oligomer
cuguagguucuuuucgcaugaau

SEQ ID NO: 47004 - RNA, 23 nt, Artificial Sequence
  RNA Oligomer
uguagguucuuuucgcaugaaug

SEQ ID NO: 47005 - RNA, 23 nt, Artificial Sequence
  RNA Oligomer
guagguucuuuucgcaugaauga

SEQ ID NO: 47006 - RNA, 23 nt, Artificial Sequence
  RNA Oligomer
ucccacugaccaaauaucaacug

SEQ ID NO: 47007 - RNA, 23 nt, Artificial Sequence
  RNA Oligomer
cccacugaccaaauaucaacugu

SEQ ID NO: 47008 - RNA, 23 nt, Artificial Sequence
  RNA Oligomer
ccacugaccaaauaucaacuguc

SEQ ID NO: 47009 - RNA, 23 nt, Artificial Sequence
  RNA Oligomer
cacugaccaaauaucaacugucu

SEQ ID NO: 47010 - RNA, 23 nt, Artificial Sequence
  RNA Oligomer
acugaccaaauaucaacugucug

SEQ ID NO: 47011 - RNA, 23 nt, Artificial Sequence
  RNA Oligomer
cugaccaaauaucaacugucugg

SEQ ID NO: 47012 - RNA, 23 nt, Artificial Sequence
  RNA Oligomer
aaagcagcacacacagagccaua

SEQ ID NO: 47013 - RNA, 23 nt, Artificial Sequence
  RNA Oligomer
cccugugaauuaugucagcugaa

SEQ ID NO: 47014 - RNA, 23 nt, Artificial Sequence
  RNA Oligomer
ccugugaauuaugucagcugaau

SEQ ID NO: 47015 - RNA, 23 nt, Artificial Sequence
  RNA Oligomer
cugugaauuaugucagcugaaug

SEQ ID NO: 47016 - RNA, 23 nt, Artificial Sequence
  RNA Oligomer
ugguagauaaggaacugaacaug

SEQ ID NO: 47017 - RNA, 23 nt, Artificial Sequence
  RNA Oligomer
accaggaaacaauguucuuccag

SEQ ID NO: 47018 - RNA, 23 nt, Artificial Sequence
  RNA Oligomer
ccaggaaacaauguucuuccagu

SEQ ID NO: 47019 - RNA, 23 nt, Artificial Sequence
  RNA Oligomer
uuacuagguuuuaggucccugug

SEQ ID NO: 47020 - RNA, 23 nt, Artificial Sequence
  RNA Oligomer
uacuagguuuuaggucccuguga

SEQ ID NO: 47021 - RNA, 23 nt, Artificial Sequence
  RNA Oligomer
augcaucccacugaccaaauauc

SEQ ID NO: 47022 - RNA, 23 nt, Artificial Sequence
  RNA Oligomer
ugcaucccacugaccaaauauca

SEQ ID NO: 47023 - RNA, 23 nt, Artificial Sequence
  RNA Oligomer
gcaucccacugaccaaauaucaa

SEQ ID NO: 47024 - RNA, 23 nt, Artificial Sequence
  RNA Oligomer
caucccacugaccaaauaucaac

SEQ ID NO: 47025 - RNA, 23 nt, Artificial Sequence
  RNA Oligomer
aucccacugaccaaauaucaacu

SEQ ID NO: 47026 - RNA, 23 nt, Artificial Sequence
  RNA Oligomer
ggucaccagauacacaucauuga

SEQ ID NO: 47027 - RNA, 23 nt, Artificial Sequence
  RNA Oligomer
gucaccagauacacaucauugaa

SEQ ID NO: 47028 - RNA, 23 nt, Artificial Sequence
  RNA Oligomer
ucaccagauacacaucauugaau

SEQ ID NO: 47029 - RNA, 23 nt, Artificial Sequence
  RNA Oligomer
caccagauacacaucauugaauu

SEQ ID NO: 47030 - RNA, 23 nt, Artificial Sequence
  RNA Oligomer
accagauacacaucauugaauuc

SEQ ID NO: 47031 - RNA, 23 nt, Artificial Sequence
  RNA Oligomer
uuucgcaugaaugauggacugaa

SEQ ID NO: 47032 - RNA, 23 nt, Artificial Sequence
  RNA Oligomer
aaguaaccgcaguucucuguagg

SEQ ID NO: 47033 - RNA, 23 nt, Artificial Sequence
  RNA Oligomer
aguaaccgcaguucucuguaggu

SEQ ID NO: 47034 - RNA, 23 nt, Artificial Sequence
  RNA Oligomer
guaaccgcaguucucuguagguu

SEQ ID NO: 47035 - RNA, 23 nt, Artificial Sequence
  RNA Oligomer
uaaccgcaguucucuguagguuc

SEQ ID NO: 47036 - RNA, 23 nt, Artificial Sequence
  RNA Oligomer
gguuaauauggucuguaccagga

SEQ ID NO: 47037 - RNA, 23 nt, Artificial Sequence
  RNA Oligomer
guuaauauggucuguaccaggaa

SEQ ID NO: 47038 - RNA, 23 nt, Artificial Sequence
  RNA Oligomer
uuaauauggucuguaccaggaaa

SEQ ID NO: 47039 - RNA, 23 nt, Artificial Sequence
  RNA Oligomer
uaauauggucuguaccaggaaac

SEQ ID NO: 47040 - RNA, 23 nt, Artificial Sequence
  RNA Oligomer
aauauggucuguaccaggaaaca

SEQ ID NO: 47041 - RNA, 23 nt, Artificial Sequence
  RNA Oligomer
ccguuuuugugucaaaagcagca

SEQ ID NO: 47042 - RNA, 23 nt, Artificial Sequence
  RNA Oligomer
cguuuuugugucaaaagcagcac

SEQ ID NO: 47043 - RNA, 23 nt, Artificial Sequence
  RNA Oligomer
guuuuugugucaaaagcagcaca

SEQ ID NO: 47044 - RNA, 23 nt, Artificial Sequence
  RNA Oligomer
uuuuugugucaaaagcagcacac

SEQ ID NO: 47045 - RNA, 23 nt, Artificial Sequence
  RNA Oligomer
uuuugugucaaaagcagcacaca

SEQ ID NO: 47046 - RNA, 23 nt, Artificial Sequence
  RNA Oligomer
ugucuuguucagcuccugccggu

SEQ ID NO: 47047 - RNA, 23 nt, Artificial Sequence
  RNA Oligomer
ggagagcuucuucacugccacac

SEQ ID NO: 47048 - RNA, 23 nt, Artificial Sequence
  RNA Oligomer
gagagcuucuucacugccacacg

SEQ ID NO: 47049 - RNA, 23 nt, Artificial Sequence
  RNA Oligomer
agagcuucuucacugccacacgu

SEQ ID NO: 47050 - RNA, 23 nt, Artificial Sequence
  RNA Oligomer
gagcuucuucacugccacacgua

SEQ ID NO: 47051 - RNA, 23 nt, Artificial Sequence
  RNA Oligomer
agcuucuucacugccacacguaa

SEQ ID NO: 47052 - RNA, 23 nt, Artificial Sequence
  RNA Oligomer
uucgcaugaaugauggacugaaa

SEQ ID NO: 47053 - RNA, 23 nt, Artificial Sequence
  RNA Oligomer
cugucugguuguaaugcauccag

SEQ ID NO: 47054 - RNA, 23 nt, Artificial Sequence
  RNA Oligomer
ugucugguuguaaugcauccagu

SEQ ID NO: 47055 - RNA, 23 nt, Artificial Sequence
  RNA Oligomer
gucugguuguaaugcauccaguu

SEQ ID NO: 47056 - RNA, 23 nt, Artificial Sequence
  RNA Oligomer
uucacagcuagauuacuagguuu

SEQ ID NO: 47057 - RNA, 23 nt, Artificial Sequence
  RNA Oligomer
ucacagcuagauuacuagguuuu

SEQ ID NO: 47058 - RNA, 23 nt, Artificial Sequence
  RNA Oligomer
cacagcuagauuacuagguuuua

SEQ ID NO: 47059 - RNA, 23 nt, Artificial Sequence
  RNA Oligomer
acagcuagauuacuagguuuuag

SEQ ID NO: 47060 - RNA, 23 nt, Artificial Sequence
  RNA Oligomer
agaccucggagaauuugguagau

SEQ ID NO: 47061 - RNA, 23 nt, Artificial Sequence
  RNA Oligomer
gaccucggagaauuugguagaua

SEQ ID NO: 47062 - RNA, 23 nt, Artificial Sequence
  RNA Oligomer
accucggagaauuugguagauaa

SEQ ID NO: 47063 - RNA, 23 nt, Artificial Sequence
  RNA Oligomer
ucugacauuucacaauguuguuc

SEQ ID NO: 47064 - RNA, 23 nt, Artificial Sequence
  RNA Oligomer
uuugugucaaaagcagcacacac

SEQ ID NO: 47065 - RNA, 23 nt, Artificial Sequence
  RNA Oligomer
cagcucggccauuaugcauccca

SEQ ID NO: 47066 - RNA, 23 nt, Artificial Sequence
  RNA Oligomer
agcucggccauuaugcaucccac

SEQ ID NO: 47067 - RNA, 23 nt, Artificial Sequence
  RNA Oligomer
gcucggccauuaugcaucccacu

SEQ ID NO: 47068 - RNA, 23 nt, Artificial Sequence
  RNA Oligomer
cucggccauuaugcaucccacug

SEQ ID NO: 47069 - RNA, 23 nt, Artificial Sequence
  RNA Oligomer
ucggccauuaugcaucccacuga

SEQ ID NO: 47070 - RNA, 23 nt, Artificial Sequence
  RNA Oligomer
uaucaacugucugguuguaaugc

SEQ ID NO: 47071 - RNA, 23 nt, Artificial Sequence
  RNA Oligomer
acuagguuuuaggucccugugaa

SEQ ID NO: 47072 - RNA, 23 nt, Artificial Sequence
  RNA Oligomer
ucgcaugaaugauggacugaaau

SEQ ID NO: 47073 - RNA, 23 nt, Artificial Sequence
  RNA Oligomer
ccucuccugagacauuuuccagc

SEQ ID NO: 47074 - RNA, 23 nt, Artificial Sequence
  RNA Oligomer
cucuccugagacauuuuccagcg

SEQ ID NO: 47075 - RNA, 23 nt, Artificial Sequence
  RNA Oligomer
ucuccugagacauuuuccagcgg

SEQ ID NO: 47076 - RNA, 23 nt, Artificial Sequence
  RNA Oligomer
cuagguuuuaggucccugugaau

SEQ ID NO: 47077 - RNA, 23 nt, Artificial Sequence
  RNA Oligomer
cuggagacagguucugguaacgc

SEQ ID NO: 47078 - RNA, 23 nt, Artificial Sequence
  RNA Oligomer
uggagacagguucugguaacgcu

SEQ ID NO: 47079 - RNA, 23 nt, Artificial Sequence
  RNA Oligomer
ggagacagguucugguaacgcuc

SEQ ID NO: 47080 - RNA, 23 nt, Artificial Sequence
  RNA Oligomer
gagacagguucugguaacgcucg

SEQ ID NO: 47081 - RNA, 23 nt, Artificial Sequence
  RNA Oligomer
agacagguucugguaacgcucgg

SEQ ID NO: 47082 - RNA, 23 nt, Artificial Sequence
  RNA Oligomer
gacagguucugguaacgcucggg

SEQ ID NO: 47083 - RNA, 23 nt, Artificial Sequence
  RNA Oligomer
agcuucugacauuucacaauguu

SEQ ID NO: 47084 - RNA, 23 nt, Artificial Sequence
  RNA Oligomer
gcuucugacauuucacaauguug

SEQ ID NO: 47085 - RNA, 23 nt, Artificial Sequence
  RNA Oligomer
cuucugacauuucacaauguugu

SEQ ID NO: 47086 - RNA, 23 nt, Artificial Sequence
  RNA Oligomer
uucugacauuucacaauguuguu

SEQ ID NO: 47087 - RNA, 23 nt, Artificial Sequence
  RNA Oligomer
gaccuugcagguguaaaaacguc

SEQ ID NO: 47088 - RNA, 23 nt, Artificial Sequence
  RNA Oligomer
accuugcagguguaaaaacgucc

SEQ ID NO: 47089 - RNA, 23 nt, Artificial Sequence
  RNA Oligomer
ccuugcagguguaaaaacgucca

SEQ ID NO: 47090 - RNA, 23 nt, Artificial Sequence
  RNA Oligomer
cuugcagguguaaaaacguccaa

SEQ ID NO: 47091 - RNA, 23 nt, Artificial Sequence
  RNA Oligomer
uugcagguguaaaaacguccaac

SEQ ID NO: 47092 - RNA, 23 nt, Artificial Sequence
  RNA Oligomer
ugcagguguaaaaacguccaaca

SEQ ID NO: 47093 - RNA, 23 nt, Artificial Sequence
  RNA Oligomer
uguaaaaacguccaacagaccaa

SEQ ID NO: 47094 - RNA, 23 nt, Artificial Sequence
  RNA Oligomer
guaaaaacguccaacagaccaau

SEQ ID NO: 47095 - RNA, 23 nt, Artificial Sequence
  RNA Oligomer
uaaaaacguccaacagaccaauc

SEQ ID NO: 47096 - RNA, 23 nt, Artificial Sequence
  RNA Oligomer
aaaaacguccaacagaccaauca

SEQ ID NO: 47097 - RNA, 23 nt, Artificial Sequence
  RNA Oligomer
aaaacguccaacagaccaaucac

SEQ ID NO: 47098 - RNA, 23 nt, Artificial Sequence
  RNA Oligomer
gggccucuccugagacauuuucc

SEQ ID NO: 47099 - RNA, 23 nt, Artificial Sequence
  RNA Oligomer
ggccucuccugagacauuuucca

SEQ ID NO: 47100 - RNA, 23 nt, Artificial Sequence
  RNA Oligomer
gccucuccugagacauuuuccag

SEQ ID NO: 47101 - RNA, 23 nt, Artificial Sequence
  RNA Oligomer
ccccguuuuugugucaaaagcag

SEQ ID NO: 47102 - RNA, 23 nt, Artificial Sequence
  RNA Oligomer
cccguuuuugugucaaaagcagc

SEQ ID NO: 47103 - RNA, 23 nt, Artificial Sequence
  RNA Oligomer
guaaugcauccaguucagcauga

SEQ ID NO: 47104 - RNA, 23 nt, Artificial Sequence
  RNA Oligomer
uaaugcauccaguucagcaugau

SEQ ID NO: 47105 - RNA, 23 nt, Artificial Sequence
  RNA Oligomer
gguuuuaggucccugugaauuau

SEQ ID NO: 47106 - RNA, 23 nt, Artificial Sequence
  RNA Oligomer
guuuuaggucccugugaauuaug

SEQ ID NO: 47107 - RNA, 23 nt, Artificial Sequence
  RNA Oligomer
acuggagacagguucugguaacg

SEQ ID NO: 47108 - RNA, 23 nt, Artificial Sequence
  RNA Oligomer
guguaaaaacguccaacagacca

SEQ ID NO: 47109 - RNA, 23 nt, Artificial Sequence
  RNA Oligomer
aaacguccaacagaccaaucaca

SEQ ID NO: 47110 - RNA, 23 nt, Artificial Sequence
  RNA Oligomer
aacguccaacagaccaaucacau

SEQ ID NO: 47111 - RNA, 23 nt, Artificial Sequence
  RNA Oligomer
acguccaacagaccaaucacauu

SEQ ID NO: 47112 - RNA, 23 nt, Artificial Sequence
  RNA Oligomer
aaccgcaguucucuguagguucu

SEQ ID NO: 47113 - RNA, 23 nt, Artificial Sequence
  RNA Oligomer
ugaaauggucuggagagcuucuu

SEQ ID NO: 47114 - RNA, 23 nt, Artificial Sequence
  RNA Oligomer
gaaauggucuggagagcuucuuc

SEQ ID NO: 47115 - RNA, 23 nt, Artificial Sequence
  RNA Oligomer
aaauggucuggagagcuucuuca

SEQ ID NO: 47116 - RNA, 23 nt, Artificial Sequence
  RNA Oligomer
aaauaucaacugucugguuguaa

SEQ ID NO: 47117 - RNA, 23 nt, Artificial Sequence
  RNA Oligomer
aauaucaacugucugguuguaau

SEQ ID NO: 47118 - RNA, 23 nt, Artificial Sequence
  RNA Oligomer
ucugguuguaaugcauccaguuc

SEQ ID NO: 47119 - RNA, 23 nt, Artificial Sequence
  RNA Oligomer
aaugcauccaguucagcaugauc

SEQ ID NO: 47120 - RNA, 23 nt, Artificial Sequence
  RNA Oligomer
aauggucuggagagcuucuucac

SEQ ID NO: 47121 - RNA, 23 nt, Artificial Sequence
  RNA Oligomer
auggucuggagagcuucuucacu

SEQ ID NO: 47122 - RNA, 23 nt, Artificial Sequence
  RNA Oligomer
ggucuggagagcuucuucacugc

SEQ ID NO: 47123 - RNA, 23 nt, Artificial Sequence
  RNA Oligomer
gucuggagagcuucuucacugcc

SEQ ID NO: 47124 - RNA, 23 nt, Artificial Sequence
  RNA Oligomer
ucuggagagcuucuucacugcca

SEQ ID NO: 47125 - RNA, 23 nt, Artificial Sequence
  RNA Oligomer
cuggagagcuucuucacugccac

SEQ ID NO: 47126 - RNA, 23 nt, Artificial Sequence
  RNA Oligomer
uggagagcuucuucacugccaca

SEQ ID NO: 47127 - RNA, 23 nt, Artificial Sequence
  RNA Oligomer
cagcaugaucucaggagcccugu

SEQ ID NO: 47128 - RNA, 23 nt, Artificial Sequence
  RNA Oligomer
agcaugaucucaggagcccugua

SEQ ID NO: 47129 - RNA, 23 nt, Artificial Sequence
  RNA Oligomer
gcaugaucucaggagcccuguac

SEQ ID NO: 47130 - RNA, 23 nt, Artificial Sequence
  RNA Oligomer
caugaucucaggagcccuguacc

SEQ ID NO: 47131 - RNA, 23 nt, Artificial Sequence
  RNA Oligomer
augaucucaggagcccuguacca

SEQ ID NO: 47132 - RNA, 23 nt, Artificial Sequence
  RNA Oligomer
uugugucaaaagcagcacacaca

SEQ ID NO: 47133 - RNA, 23 nt, Artificial Sequence
  RNA Oligomer
gguguaaaaacguccaacagacc

SEQ ID NO: 47134 - RNA, 23 nt, Artificial Sequence
  RNA Oligomer
ugugucaaaagcagcacacacag

SEQ ID NO: 47135 - RNA, 23 nt, Artificial Sequence
  RNA Oligomer
auaucaacugucugguuguaaug

SEQ ID NO: 47136 - RNA, 23 nt, Artificial Sequence
  RNA Oligomer
agguguaaaaacguccaacagac

SEQ ID NO: 47137 - RNA, 23 nt, Artificial Sequence
  RNA Oligomer
auauggucuguaccaggaaacaa

SEQ ID NO: 47138 - RNA, 23 nt, Artificial Sequence
  RNA Oligomer
uauggucuguaccaggaaacaau

SEQ ID NO: 47139 - RNA, 23 nt, Artificial Sequence
  RNA Oligomer
auggucuguaccaggaaacaaug

SEQ ID NO: 47140 - RNA, 23 nt, Artificial Sequence
  RNA Oligomer
uggucuggagagcuucuucacug

SEQ ID NO: 47141 - RNA, 23 nt, Artificial Sequence
  RNA Oligomer
gcccacuggagacagguucuggu

SEQ ID NO: 47142 - RNA, 23 nt, Artificial Sequence
  RNA Oligomer
cccacuggagacagguucuggua

SEQ ID NO: 47143 - RNA, 23 nt, Artificial Sequence
  RNA Oligomer
ccacuggagacagguucugguaa

SEQ ID NO: 47144 - RNA, 23 nt, Artificial Sequence
  RNA Oligomer
cacuggagacagguucugguaac

SEQ ID NO: 47145 - RNA, 23 nt, Artificial Sequence
  RNA Oligomer
cucggagaauuugguagauaagg

SEQ ID NO: 47146 - RNA, 23 nt, Artificial Sequence
  RNA Oligomer
caucuguaagcuucugacauuuc

SEQ ID NO: 47147 - RNA, 23 nt, Artificial Sequence
  RNA Oligomer
ugggccucuccugagacauuuuc

SEQ ID NO: 47148 - RNA, 23 nt, Artificial Sequence
  RNA Oligomer
ugagaugggucaccagauacaca

SEQ ID NO: 47149 - RNA, 23 nt, Artificial Sequence
  RNA Oligomer
aagcagcacacacagagccauag

SEQ ID NO: 47150 - RNA, 23 nt, Artificial Sequence
  RNA Oligomer
agcugaauguauauacuuuagac

SEQ ID NO: 47151 - RNA, 23 nt, Artificial Sequence
  RNA Oligomer
ucagcugaauguauauacuuuag

SEQ ID NO: 47152 - RNA, 23 nt, Artificial Sequence
  RNA Oligomer
cugaauguauauacuuuagaccu

SEQ ID NO: 47153 - RNA, 23 nt, Artificial Sequence
  RNA Oligomer
gcugaauguauauacuuuagacc

SEQ ID NO: 47154 - RNA, 23 nt, Artificial Sequence
  RNA Oligomer
augagaugggucaccagauacac

SEQ ID NO: 47155 - RNA, 23 nt, Artificial Sequence
  RNA Oligomer
gaugggucaccagauacacauca

SEQ ID NO: 47156 - RNA, 23 nt, Artificial Sequence
  RNA Oligomer
uggucuguaccaggaaacaaugu

SEQ ID NO: 47157 - RNA, 23 nt, Artificial Sequence
  RNA Oligomer
ccaauacugacccucuuuaccuc

SEQ ID NO: 47158 - RNA, 23 nt, Artificial Sequence
  RNA Oligomer
accaauacugacccucuuuaccu

SEQ ID NO: 47159 - RNA, 23 nt, Artificial Sequence
  RNA Oligomer
gaccaauacugacccucuuuacc

SEQ ID NO: 47160 - RNA, 23 nt, Artificial Sequence
  RNA Oligomer
ugaccaauacugacccucuuuac

SEQ ID NO: 47161 - RNA, 23 nt, Artificial Sequence
  RNA Oligomer
uugaccaauacugacccucuuua

SEQ ID NO: 47162 - RNA, 23 nt, Artificial Sequence
  RNA Oligomer
ccuucuuaaagccuuauuuuuca

SEQ ID NO: 47163 - RNA, 23 nt, Artificial Sequence
  RNA Oligomer
gccuucuuaaagccuuauuuuuc

SEQ ID NO: 47164 - RNA, 23 nt, Artificial Sequence
  RNA Oligomer
agccuucuuaaagccuuauuuuu

SEQ ID NO: 47165 - RNA, 23 nt, Artificial Sequence
  RNA Oligomer
aagccuucuuaaagccuuauuuu

SEQ ID NO: 47166 - RNA, 23 nt, Artificial Sequence
  RNA Oligomer
caagccuucuuaaagccuuauuu

SEQ ID NO: 47167 - RNA, 23 nt, Artificial Sequence
  RNA Oligomer
ggagauuggugcuguaaaauacc

SEQ ID NO: 47168 - RNA, 23 nt, Artificial Sequence
  RNA Oligomer
aggagauuggugcuguaaaauac

SEQ ID NO: 47169 - RNA, 23 nt, Artificial Sequence
  RNA Oligomer
aaggagauuggugcuguaaaaua

SEQ ID NO: 47170 - RNA, 23 nt, Artificial Sequence
  RNA Oligomer
uaaggagauuggugcuguaaaau

SEQ ID NO: 47171 - RNA, 23 nt, Artificial Sequence
  RNA Oligomer
cuaaggagauuggugcuguaaaa

SEQ ID NO: 47172 - RNA, 23 nt, Artificial Sequence
  RNA Oligomer
cccuauccuauccgcaaacagau

SEQ ID NO: 47173 - RNA, 23 nt, Artificial Sequence
  RNA Oligomer
ccccuauccuauccgcaaacaga

SEQ ID NO: 47174 - RNA, 23 nt, Artificial Sequence
  RNA Oligomer
cccccuauccuauccgcaaacag

SEQ ID NO: 47175 - RNA, 23 nt, Artificial Sequence
  RNA Oligomer
gcccccuauccuauccgcaaaca

SEQ ID NO: 47176 - RNA, 23 nt, Artificial Sequence
  RNA Oligomer
cgcccccuauccuauccgcaaac

SEQ ID NO: 47177 - RNA, 23 nt, Artificial Sequence
  RNA Oligomer
gggcauuuaauucaucuuuaaac

SEQ ID NO: 47178 - RNA, 23 nt, Artificial Sequence
  RNA Oligomer
ugggcauuuaauucaucuuuaaa

SEQ ID NO: 47179 - RNA, 23 nt, Artificial Sequence
  RNA Oligomer
uugggcauuuaauucaucuuuaa

SEQ ID NO: 47180 - RNA, 23 nt, Artificial Sequence
  RNA Oligomer
auugggcauuuaauucaucuuua

SEQ ID NO: 47181 - RNA, 23 nt, Artificial Sequence
  RNA Oligomer
aauugggcauuuaauucaucuuu

SEQ ID NO: 47182 - RNA, 23 nt, Artificial Sequence
  RNA Oligomer
gaaagugucacggguaaaaacuc

SEQ ID NO: 47183 - RNA, 23 nt, Artificial Sequence
  RNA Oligomer
ugaaagugucacggguaaaaacu

SEQ ID NO: 47184 - RNA, 23 nt, Artificial Sequence
  RNA Oligomer
augaaagugucacggguaaaaac

SEQ ID NO: 47185 - RNA, 23 nt, Artificial Sequence
  RNA Oligomer
aaugaaagugucacggguaaaaa

SEQ ID NO: 47186 - RNA, 23 nt, Artificial Sequence
  RNA Oligomer
gaaugaaagugucacggguaaaa

SEQ ID NO: 47187 - RNA, 23 nt, Artificial Sequence
  RNA Oligomer
cgaguuuucugaccagcuuuugc

SEQ ID NO: 47188 - RNA, 23 nt, Artificial Sequence
  RNA Oligomer
gcgaguuuucugaccagcuuuug

SEQ ID NO: 47189 - RNA, 23 nt, Artificial Sequence
  RNA Oligomer
agcgaguuuucugaccagcuuuu

SEQ ID NO: 47190 - RNA, 23 nt, Artificial Sequence
  RNA Oligomer
uagcgaguuuucugaccagcuuu

SEQ ID NO: 47191 - RNA, 23 nt, Artificial Sequence
  RNA Oligomer
auagcgaguuuucugaccagcuu

SEQ ID NO: 47192 - RNA, 23 nt, Artificial Sequence
  RNA Oligomer
ggaguguuuuuacauugaucuuu

SEQ ID NO: 47193 - RNA, 23 nt, Artificial Sequence
  RNA Oligomer
uggaguguuuuuacauugaucuu

SEQ ID NO: 47194 - RNA, 23 nt, Artificial Sequence
  RNA Oligomer
guggaguguuuuuacauugaucu

SEQ ID NO: 47195 - RNA, 23 nt, Artificial Sequence
  RNA Oligomer
uguggaguguuuuuacauugauc

SEQ ID NO: 47196 - RNA, 23 nt, Artificial Sequence
  RNA Oligomer
uuguggaguguuuuuacauugau

SEQ ID NO: 47197 - RNA, 23 nt, Artificial Sequence
  RNA Oligomer
gcagaauuguggaguguuuuuac

SEQ ID NO: 47198 - RNA, 23 nt, Artificial Sequence
  RNA Oligomer
ugcagaauuguggaguguuuuua

SEQ ID NO: 47199 - RNA, 23 nt, Artificial Sequence
  RNA Oligomer
uugcagaauuguggaguguuuuu

SEQ ID NO: 47200 - RNA, 23 nt, Artificial Sequence
  RNA Oligomer
guugcagaauuguggaguguuuu

SEQ ID NO: 47201 - RNA, 23 nt, Artificial Sequence
  RNA Oligomer
aguugcagaauuguggaguguuu

SEQ ID NO: 47202 - RNA, 23 nt, Artificial Sequence
  RNA Oligomer
gguguaaaaaucauguguugcag

SEQ ID NO: 47203 - RNA, 23 nt, Artificial Sequence
  RNA Oligomer
agguguaaaaaucauguguugca

SEQ ID NO: 47204 - RNA, 23 nt, Artificial Sequence
  RNA Oligomer
uagguguaaaaaucauguguugc

SEQ ID NO: 47205 - RNA, 23 nt, Artificial Sequence
  RNA Oligomer
cuagguguaaaaaucauguguug

SEQ ID NO: 47206 - RNA, 23 nt, Artificial Sequence
  RNA Oligomer
acuagguguaaaaaucauguguu

SEQ ID NO: 47207 - RNA, 23 nt, Artificial Sequence
  RNA Oligomer
gaacugcuauuuccucuaaugaa

SEQ ID NO: 47208 - RNA, 23 nt, Artificial Sequence
  RNA Oligomer
agaacugcuauuuccucuaauga

SEQ ID NO: 47209 - RNA, 23 nt, Artificial Sequence
  RNA Oligomer
cagaacugcuauuuccucuaaug

SEQ ID NO: 47210 - RNA, 23 nt, Artificial Sequence
  RNA Oligomer
acagaacugcuauuuccucuaau

SEQ ID NO: 47211 - RNA, 23 nt, Artificial Sequence
  RNA Oligomer
aacagaacugcuauuuccucuaa

SEQ ID NO: 47212 - RNA, 23 nt, Artificial Sequence
  RNA Oligomer
gggaacuaaacuugaucuuaggg

SEQ ID NO: 47213 - RNA, 23 nt, Artificial Sequence
  RNA Oligomer
ugggaacuaaacuugaucuuagg

SEQ ID NO: 47214 - RNA, 23 nt, Artificial Sequence
  RNA Oligomer
gugggaacuaaacuugaucuuag

SEQ ID NO: 47215 - RNA, 23 nt, Artificial Sequence
  RNA Oligomer
agugggaacuaaacuugaucuua

SEQ ID NO: 47216 - RNA, 23 nt, Artificial Sequence
  RNA Oligomer
uagugggaacuaaacuugaucuu

SEQ ID NO: 47217 - RNA, 23 nt, Artificial Sequence
  RNA Oligomer
cuugaccaauacugacccucuuu

SEQ ID NO: 47218 - RNA, 23 nt, Artificial Sequence
  RNA Oligomer
ccauguuacuuuauucagagcua

SEQ ID NO: 47219 - RNA, 23 nt, Artificial Sequence
  RNA Oligomer
uccauguuacuuuauucagagcu

SEQ ID NO: 47220 - RNA, 23 nt, Artificial Sequence
  RNA Oligomer
uuccauguuacuuuauucagagc

SEQ ID NO: 47221 - RNA, 23 nt, Artificial Sequence
  RNA Oligomer
uuuccauguuacuuuauucagag

SEQ ID NO: 47222 - RNA, 23 nt, Artificial Sequence
  RNA Oligomer
cuuuccauguuacuuuauucaga

SEQ ID NO: 47223 - RNA, 23 nt, Artificial Sequence
  RNA Oligomer
uggagauuuacacuacauuguac

SEQ ID NO: 47224 - RNA, 23 nt, Artificial Sequence
  RNA Oligomer
guggagauuuacacuacauugua

SEQ ID NO: 47225 - RNA, 23 nt, Artificial Sequence
  RNA Oligomer
aguggagauuuacacuacauugu

SEQ ID NO: 47226 - RNA, 23 nt, Artificial Sequence
  RNA Oligomer
aaguggagauuuacacuacauug

SEQ ID NO: 47227 - RNA, 23 nt, Artificial Sequence
  RNA Oligomer
gaaguggagauuuacacuacauu

SEQ ID NO: 47228 - RNA, 23 nt, Artificial Sequence
  RNA Oligomer
cgaaguggagauuuacacuacau

SEQ ID NO: 47229 - RNA, 23 nt, Artificial Sequence
  RNA Oligomer
caaugcauuuccuggagaauaua

SEQ ID NO: 47230 - RNA, 23 nt, Artificial Sequence
  RNA Oligomer
ccaaugcauuuccuggagaauau

SEQ ID NO: 47231 - RNA, 23 nt, Artificial Sequence
  RNA Oligomer
accaaugcauuuccuggagaaua

SEQ ID NO: 47232 - RNA, 23 nt, Artificial Sequence
  RNA Oligomer
aaccaaugcauuuccuggagaau

SEQ ID NO: 47233 - RNA, 23 nt, Artificial Sequence
  RNA Oligomer
caaccaaugcauuuccuggagaa

SEQ ID NO: 47234 - RNA, 23 nt, Artificial Sequence
  RNA Oligomer
ugauuucauagcgaguuuucuga

SEQ ID NO: 47235 - RNA, 23 nt, Artificial Sequence
  RNA Oligomer
gugauuucauagcgaguuuucug

SEQ ID NO: 47236 - RNA, 23 nt, Artificial Sequence
  RNA Oligomer
ugugauuucauagcgaguuuucu

SEQ ID NO: 47237 - RNA, 23 nt, Artificial Sequence
  RNA Oligomer
uugugauuucauagcgaguuuuc

SEQ ID NO: 47238 - RNA, 23 nt, Artificial Sequence
  RNA Oligomer
uuugugauuucauagcgaguuuu

SEQ ID NO: 47239 - RNA, 23 nt, Artificial Sequence
  RNA Oligomer
cuuugugauuucauagcgaguuu

SEQ ID NO: 47240 - RNA, 23 nt, Artificial Sequence
  RNA Oligomer
guaguucucagaugcguaaagca

SEQ ID NO: 47241 - RNA, 23 nt, Artificial Sequence
  RNA Oligomer
uguaguucucagaugcguaaagc

SEQ ID NO: 47242 - RNA, 23 nt, Artificial Sequence
  RNA Oligomer
auguaguucucagaugcguaaag

SEQ ID NO: 47243 - RNA, 23 nt, Artificial Sequence
  RNA Oligomer
uauguaguucucagaugcguaaa

SEQ ID NO: 47244 - RNA, 23 nt, Artificial Sequence
  RNA Oligomer
cuauguaguucucagaugcguaa

SEQ ID NO: 47245 - RNA, 23 nt, Artificial Sequence
  RNA Oligomer
ccuauccuauccgcaaacagaug

SEQ ID NO: 47246 - RNA, 23 nt, Artificial Sequence
  RNA Oligomer
cgcuuugccuauugauguuccuu

SEQ ID NO: 47247 - RNA, 23 nt, Artificial Sequence
  RNA Oligomer
ucgcuuugccuauugauguuccu

SEQ ID NO: 47248 - RNA, 23 nt, Artificial Sequence
  RNA Oligomer
gucgcuuugccuauugauguucc

SEQ ID NO: 47249 - RNA, 23 nt, Artificial Sequence
  RNA Oligomer
agucgcuuugccuauugauguuc

SEQ ID NO: 47250 - RNA, 23 nt, Artificial Sequence
  RNA Oligomer
uagucgcuuugccuauugauguu

SEQ ID NO: 47251 - RNA, 23 nt, Artificial Sequence
  RNA Oligomer
cgauuaguaaaagugcuuuccau

SEQ ID NO: 47252 - RNA, 23 nt, Artificial Sequence
  RNA Oligomer
ucgauuaguaaaagugcuuucca

SEQ ID NO: 47253 - RNA, 23 nt, Artificial Sequence
  RNA Oligomer
gucgauuaguaaaagugcuuucc

SEQ ID NO: 47254 - RNA, 23 nt, Artificial Sequence
  RNA Oligomer
ugucgauuaguaaaagugcuuuc

SEQ ID NO: 47255 - RNA, 23 nt, Artificial Sequence
  RNA Oligomer
uugucgauuaguaaaagugcuuu

SEQ ID NO: 47256 - RNA, 23 nt, Artificial Sequence
  RNA Oligomer
ccuucugacugagcaauaugccu

SEQ ID NO: 47257 - RNA, 23 nt, Artificial Sequence
  RNA Oligomer
cccuucugacugagcaauaugcc

SEQ ID NO: 47258 - RNA, 23 nt, Artificial Sequence
  RNA Oligomer
ccccuucugacugagcaauaugc

SEQ ID NO: 47259 - RNA, 23 nt, Artificial Sequence
  RNA Oligomer
accccuucugacugagcaauaug

SEQ ID NO: 47260 - RNA, 23 nt, Artificial Sequence
  RNA Oligomer
aaccccuucugacugagcaauau

SEQ ID NO: 47261 - RNA, 23 nt, Artificial Sequence
  RNA Oligomer
gaaccccuucugacugagcaaua

SEQ ID NO: 47262 - RNA, 23 nt, Artificial Sequence
  RNA Oligomer
cggguaaaaacucuaaaagguua

SEQ ID NO: 47263 - RNA, 23 nt, Artificial Sequence
  RNA Oligomer
acggguaaaaacucuaaaagguu

SEQ ID NO: 47264 - RNA, 23 nt, Artificial Sequence
  RNA Oligomer
cacggguaaaaacucuaaaaggu

SEQ ID NO: 47265 - RNA, 23 nt, Artificial Sequence
  RNA Oligomer
ucacggguaaaaacucuaaaagg

SEQ ID NO: 47266 - RNA, 23 nt, Artificial Sequence
  RNA Oligomer
gucacggguaaaaacucuaaaag

SEQ ID NO: 47267 - RNA, 23 nt, Artificial Sequence
  RNA Oligomer
ugucacggguaaaaacucuaaaa

SEQ ID NO: 47268 - RNA, 23 nt, Artificial Sequence
  RNA Oligomer
ggaucagucuuugugauuucaua

SEQ ID NO: 47269 - RNA, 23 nt, Artificial Sequence
  RNA Oligomer
uggaucagucuuugugauuucau

SEQ ID NO: 47270 - RNA, 23 nt, Artificial Sequence
  RNA Oligomer
uuggaucagucuuugugauuuca

SEQ ID NO: 47271 - RNA, 23 nt, Artificial Sequence
  RNA Oligomer
uuuggaucagucuuugugauuuc

SEQ ID NO: 47272 - RNA, 23 nt, Artificial Sequence
  RNA Oligomer
cuuuggaucagucuuugugauuu

SEQ ID NO: 47273 - RNA, 23 nt, Artificial Sequence
  RNA Oligomer
gccuauugauguuccuuuggguc

SEQ ID NO: 47274 - RNA, 23 nt, Artificial Sequence
  RNA Oligomer
ugccuauugauguuccuuugggu

SEQ ID NO: 47275 - RNA, 23 nt, Artificial Sequence
  RNA Oligomer
uugccuauugauguuccuuuggg

SEQ ID NO: 47276 - RNA, 23 nt, Artificial Sequence
  RNA Oligomer
uuugccuauugauguuccuuugg

SEQ ID NO: 47277 - RNA, 23 nt, Artificial Sequence
  RNA Oligomer
cuuugccuauugauguuccuuug

SEQ ID NO: 47278 - RNA, 23 nt, Artificial Sequence
  RNA Oligomer
gcuuugccuauugauguuccuuu

SEQ ID NO: 47279 - RNA, 23 nt, Artificial Sequence
  RNA Oligomer
ugcuuuccauguuacuuuauuca

SEQ ID NO: 47280 - RNA, 23 nt, Artificial Sequence
  RNA Oligomer
gugcuuuccauguuacuuuauuc

SEQ ID NO: 47281 - RNA, 23 nt, Artificial Sequence
  RNA Oligomer
agugcuuuccauguuacuuuauu

SEQ ID NO: 47282 - RNA, 23 nt, Artificial Sequence
  RNA Oligomer
aagugcuuuccauguuacuuuau

SEQ ID NO: 47283 - RNA, 23 nt, Artificial Sequence
  RNA Oligomer
aaagugcuuuccauguuacuuua

SEQ ID NO: 47284 - RNA, 23 nt, Artificial Sequence
  RNA Oligomer
gugucacggguaaaaacucuaaa

SEQ ID NO: 47285 - RNA, 23 nt, Artificial Sequence
  RNA Oligomer
agugucacggguaaaaacucuaa

SEQ ID NO: 47286 - RNA, 23 nt, Artificial Sequence
  RNA Oligomer
ggaaugaaagugucacggguaaa

SEQ ID NO: 47287 - RNA, 23 nt, Artificial Sequence
  RNA Oligomer
ggagauuuacacuacauuguaca

SEQ ID NO: 47288 - RNA, 23 nt, Artificial Sequence
  RNA Oligomer
caguguuugacgaagcgauccga

SEQ ID NO: 47289 - RNA, 23 nt, Artificial Sequence
  RNA Oligomer
acaguguuugacgaagcgauccg

SEQ ID NO: 47290 - RNA, 23 nt, Artificial Sequence
  RNA Oligomer
gacaguguuugacgaagcgaucc

SEQ ID NO: 47291 - RNA, 23 nt, Artificial Sequence
  RNA Oligomer
agacaguguuugacgaagcgauc

SEQ ID NO: 47292 - RNA, 23 nt, Artificial Sequence
  RNA Oligomer
aagacaguguuugacgaagcgau

SEQ ID NO: 47293 - RNA, 23 nt, Artificial Sequence
  RNA Oligomer
ggaacuaaacuugaucuuaggga

SEQ ID NO: 47294 - RNA, 23 nt, Artificial Sequence
  RNA Oligomer
guguaaaaaucauguguugcagc

SEQ ID NO: 47295 - RNA, 23 nt, Artificial Sequence
  RNA Oligomer
aaaagugcuuuccauguuacuuu

SEQ ID NO: 47296 - RNA, 23 nt, Artificial Sequence
  RNA Oligomer
gcuuuuccuuucucuuacaccug

SEQ ID NO: 47297 - RNA, 23 nt, Artificial Sequence
  RNA Oligomer
agcuuuuccuuucucuuacaccu

SEQ ID NO: 47298 - RNA, 23 nt, Artificial Sequence
  RNA Oligomer
aagcuuuuccuuucucuuacacc

SEQ ID NO: 47299 - RNA, 23 nt, Artificial Sequence
  RNA Oligomer
uaagcuuuuccuuucucuuacac

SEQ ID NO: 47300 - RNA, 23 nt, Artificial Sequence
  RNA Oligomer
uuaagcuuuuccuuucucuuaca

SEQ ID NO: 47301 - RNA, 23 nt, Artificial Sequence
  RNA Oligomer
ggaaauguuuucuuaagcuuuuc

SEQ ID NO: 47302 - RNA, 23 nt, Artificial Sequence
  RNA Oligomer
aggaaauguuuucuuaagcuuuu

SEQ ID NO: 47303 - RNA, 23 nt, Artificial Sequence
  RNA Oligomer
caggaaauguuuucuuaagcuuu

SEQ ID NO: 47304 - RNA, 23 nt, Artificial Sequence
  RNA Oligomer
ucaggaaauguuuucuuaagcuu

SEQ ID NO: 47305 - RNA, 23 nt, Artificial Sequence
  RNA Oligomer
aucaggaaauguuuucuuaagcu

SEQ ID NO: 47306 - RNA, 23 nt, Artificial Sequence
  RNA Oligomer
agaugaugaaagaaagguuggua

SEQ ID NO: 47307 - RNA, 23 nt, Artificial Sequence
  RNA Oligomer
uagaugaugaaagaaagguuggu

SEQ ID NO: 47308 - RNA, 23 nt, Artificial Sequence
  RNA Oligomer
guagaugaugaaagaaagguugg

SEQ ID NO: 47309 - RNA, 23 nt, Artificial Sequence
  RNA Oligomer
aguagaugaugaaagaaagguug

SEQ ID NO: 47310 - RNA, 23 nt, Artificial Sequence
  RNA Oligomer
caguagaugaugaaagaaagguu

SEQ ID NO: 47311 - RNA, 23 nt, Artificial Sequence
  RNA Oligomer
gcaguagaugaugaaagaaaggu

SEQ ID NO: 47312 - RNA, 23 nt, Artificial Sequence
  RNA Oligomer
ugcaguagaugaugaaagaaagg

SEQ ID NO: 47313 - RNA, 23 nt, Artificial Sequence
  RNA Oligomer
augcaguagaugaugaaagaaag

SEQ ID NO: 47314 - RNA, 23 nt, Artificial Sequence
  RNA Oligomer
aaugcaguagaugaugaaagaaa

SEQ ID NO: 47315 - RNA, 23 nt, Artificial Sequence
  RNA Oligomer
aaaugcaguagaugaugaaagaa

SEQ ID NO: 47316 - RNA, 23 nt, Artificial Sequence
  RNA Oligomer
acauuguacaaggaaugaaagug

SEQ ID NO: 47317 - RNA, 23 nt, Artificial Sequence
  RNA Oligomer
uacauuguacaaggaaugaaagu

SEQ ID NO: 47318 - RNA, 23 nt, Artificial Sequence
  RNA Oligomer
cuacauuguacaaggaaugaaag

SEQ ID NO: 47319 - RNA, 23 nt, Artificial Sequence
  RNA Oligomer
acuacauuguacaaggaaugaaa

SEQ ID NO: 47320 - RNA, 23 nt, Artificial Sequence
  RNA Oligomer
cacuacauuguacaaggaaugaa

SEQ ID NO: 47321 - RNA, 23 nt, Artificial Sequence
  RNA Oligomer
gagauuuacacuacauuguacaa

SEQ ID NO: 47322 - RNA, 23 nt, Artificial Sequence
  RNA Oligomer
gaacagaacugcuauuuccucua

SEQ ID NO: 47323 - RNA, 23 nt, Artificial Sequence
  RNA Oligomer
cagucuuugugauuucauagcga

SEQ ID NO: 47324 - RNA, 23 nt, Artificial Sequence
  RNA Oligomer
ucagucuuugugauuucauagcg

SEQ ID NO: 47325 - RNA, 23 nt, Artificial Sequence
  RNA Oligomer
aucagucuuugugauuucauagc

SEQ ID NO: 47326 - RNA, 23 nt, Artificial Sequence
  RNA Oligomer
gaucagucuuugugauuucauag

SEQ ID NO: 47327 - RNA, 23 nt, Artificial Sequence
  RNA Oligomer
cagacucacauucuauuaaaauu

SEQ ID NO: 47328 - RNA, 23 nt, Artificial Sequence
  RNA Oligomer
ucagacucacauucuauuaaaau

SEQ ID NO: 47329 - RNA, 23 nt, Artificial Sequence
  RNA Oligomer
uucagacucacauucuauuaaaa

SEQ ID NO: 47330 - RNA, 23 nt, Artificial Sequence
  RNA Oligomer
guucagacucacauucuauuaaa

SEQ ID NO: 47331 - RNA, 23 nt, Artificial Sequence
  RNA Oligomer
aguucagacucacauucuauuaa

SEQ ID NO: 47332 - RNA, 23 nt, Artificial Sequence
  RNA Oligomer
agauuggugcuguaaaauaccug

SEQ ID NO: 47333 - RNA, 23 nt, Artificial Sequence
  RNA Oligomer
gagauuggugcuguaaaauaccu

SEQ ID NO: 47334 - RNA, 23 nt, Artificial Sequence
  RNA Oligomer
gccacuacaacagaauuuuuuaa

SEQ ID NO: 47335 - RNA, 23 nt, Artificial Sequence
  RNA Oligomer
agccacuacaacagaauuuuuua

SEQ ID NO: 47336 - RNA, 23 nt, Artificial Sequence
  RNA Oligomer
cagccacuacaacagaauuuuuu

SEQ ID NO: 47337 - RNA, 23 nt, Artificial Sequence
  RNA Oligomer
ucagccacuacaacagaauuuuu

SEQ ID NO: 47338 - RNA, 23 nt, Artificial Sequence
  RNA Oligomer
uucagccacuacaacagaauuuu

SEQ ID NO: 47339 - RNA, 23 nt, Artificial Sequence
  RNA Oligomer
gguucuguaaacugugcuagugc

SEQ ID NO: 47340 - RNA, 23 nt, Artificial Sequence
  RNA Oligomer
agguucuguaaacugugcuagug

SEQ ID NO: 47341 - RNA, 23 nt, Artificial Sequence
  RNA Oligomer
gagguucuguaaacugugcuagu

SEQ ID NO: 47342 - RNA, 23 nt, Artificial Sequence
  RNA Oligomer
ugagguucuguaaacugugcuag

SEQ ID NO: 47343 - RNA, 23 nt, Artificial Sequence
  RNA Oligomer
gugagguucuguaaacugugcua

SEQ ID NO: 47344 - RNA, 23 nt, Artificial Sequence
  RNA Oligomer
gggucugugagguucuguaaacu

SEQ ID NO: 47345 - RNA, 23 nt, Artificial Sequence
  RNA Oligomer
ugggucugugagguucuguaaac

SEQ ID NO: 47346 - RNA, 23 nt, Artificial Sequence
  RNA Oligomer
uugggucugugagguucuguaaa

SEQ ID NO: 47347 - RNA, 23 nt, Artificial Sequence
  RNA Oligomer
uuugggucugugagguucuguaa

SEQ ID NO: 47348 - RNA, 23 nt, Artificial Sequence
  RNA Oligomer
cuuugggucugugagguucugua

SEQ ID NO: 47349 - RNA, 23 nt, Artificial Sequence
  RNA Oligomer
guaacuagguguaaaaaucaugu

SEQ ID NO: 47350 - RNA, 23 nt, Artificial Sequence
  RNA Oligomer
aguaacuagguguaaaaaucaug

SEQ ID NO: 47351 - RNA, 23 nt, Artificial Sequence
  RNA Oligomer
uaguaacuagguguaaaaaucau

SEQ ID NO: 47352 - RNA, 23 nt, Artificial Sequence
  RNA Oligomer
cuaguaacuagguguaaaaauca

SEQ ID NO: 47353 - RNA, 23 nt, Artificial Sequence
  RNA Oligomer
ucuaguaacuagguguaaaaauc

SEQ ID NO: 47354 - RNA, 23 nt, Artificial Sequence
  RNA Oligomer
gcuuuccauguuacuuuauucag

SEQ ID NO: 47355 - RNA, 23 nt, Artificial Sequence
  RNA Oligomer
aaauugggcauuuaauucaucuu

SEQ ID NO: 47356 - RNA, 23 nt, Artificial Sequence
  RNA Oligomer
gguauuaucaggaaauguuuucu

SEQ ID NO: 47357 - RNA, 23 nt, Artificial Sequence
  RNA Oligomer
ugguauuaucaggaaauguuuuc

SEQ ID NO: 47358 - RNA, 23 nt, Artificial Sequence
  RNA Oligomer
uugguauuaucaggaaauguuuu

SEQ ID NO: 47359 - RNA, 23 nt, Artificial Sequence
  RNA Oligomer
guugguauuaucaggaaauguuu

SEQ ID NO: 47360 - RNA, 23 nt, Artificial Sequence
  RNA Oligomer
gguugguauuaucaggaaauguu

SEQ ID NO: 47361 - RNA, 23 nt, Artificial Sequence
  RNA Oligomer
agguugguauuaucaggaaaugu

SEQ ID NO: 47362 - RNA, 23 nt, Artificial Sequence
  RNA Oligomer
aagguugguauuaucaggaaaug

SEQ ID NO: 47363 - RNA, 23 nt, Artificial Sequence
  RNA Oligomer
aaagguugguauuaucaggaaau

SEQ ID NO: 47364 - RNA, 23 nt, Artificial Sequence
  RNA Oligomer
gaaagguugguauuaucaggaaa

SEQ ID NO: 47365 - RNA, 23 nt, Artificial Sequence
  RNA Oligomer
agaaagguugguauuaucaggaa

SEQ ID NO: 47366 - RNA, 23 nt, Artificial Sequence
  RNA Oligomer
guacaaggaaugaaagugucacg

SEQ ID NO: 47367 - RNA, 23 nt, Artificial Sequence
  RNA Oligomer
uguacaaggaaugaaagugucac

SEQ ID NO: 47368 - RNA, 23 nt, Artificial Sequence
  RNA Oligomer
uuguacaaggaaugaaaguguca

SEQ ID NO: 47369 - RNA, 23 nt, Artificial Sequence
  RNA Oligomer
auuguacaaggaaugaaaguguc

SEQ ID NO: 47370 - RNA, 23 nt, Artificial Sequence
  RNA Oligomer
cauuguacaaggaaugaaagugu

SEQ ID NO: 47371 - RNA, 23 nt, Artificial Sequence
  RNA Oligomer
caaaauacgaaguggagauuuac

SEQ ID NO: 47372 - RNA, 23 nt, Artificial Sequence
  RNA Oligomer
acaaaauacgaaguggagauuua

SEQ ID NO: 47373 - RNA, 23 nt, Artificial Sequence
  RNA Oligomer
gacaaaauacgaaguggagauuu

SEQ ID NO: 47374 - RNA, 23 nt, Artificial Sequence
  RNA Oligomer
ugacaaaauacgaaguggagauu

SEQ ID NO: 47375 - RNA, 23 nt, Artificial Sequence
  RNA Oligomer
uugacaaaauacgaaguggagau

SEQ ID NO: 47376 - RNA, 23 nt, Artificial Sequence
  RNA Oligomer
aacugcuauuuccucuaaugaag

SEQ ID NO: 47377 - RNA, 23 nt, Artificial Sequence
  RNA Oligomer
ccuauguaguucucagaugcgua

SEQ ID NO: 47378 - RNA, 23 nt, Artificial Sequence
  RNA Oligomer
uccuauguaguucucagaugcgu

SEQ ID NO: 47379 - RNA, 23 nt, Artificial Sequence
  RNA Oligomer
cuccuauguaguucucagaugcg

SEQ ID NO: 47380 - RNA, 23 nt, Artificial Sequence
  RNA Oligomer
ucuccuauguaguucucagaugc

SEQ ID NO: 47381 - RNA, 23 nt, Artificial Sequence
  RNA Oligomer
cucuccuauguaguucucagaug

SEQ ID NO: 47382 - RNA, 23 nt, Artificial Sequence
  RNA Oligomer
gauuaagaguugccaaaauaccu

SEQ ID NO: 47383 - RNA, 23 nt, Artificial Sequence
  RNA Oligomer
agauuaagaguugccaaaauacc

SEQ ID NO: 47384 - RNA, 23 nt, Artificial Sequence
  RNA Oligomer
cagauuaagaguugccaaaauac

SEQ ID NO: 47385 - RNA, 23 nt, Artificial Sequence
  RNA Oligomer
ucagauuaagaguugccaaaaua

SEQ ID NO: 47386 - RNA, 23 nt, Artificial Sequence
  RNA Oligomer
uucagauuaagaguugccaaaau

SEQ ID NO: 47387 - RNA, 23 nt, Artificial Sequence
  RNA Oligomer
uccugcaucauuugaaaaugucc

SEQ ID NO: 47388 - RNA, 23 nt, Artificial Sequence
  RNA Oligomer
guccugcaucauuugaaaauguc

SEQ ID NO: 47389 - RNA, 23 nt, Artificial Sequence
  RNA Oligomer
aguccugcaucauuugaaaaugu

SEQ ID NO: 47390 - RNA, 23 nt, Artificial Sequence
  RNA Oligomer
gaguccugcaucauuugaaaaug

SEQ ID NO: 47391 - RNA, 23 nt, Artificial Sequence
  RNA Oligomer
ugaguccugcaucauuugaaaau

SEQ ID NO: 47392 - RNA, 23 nt, Artificial Sequence
  RNA Oligomer
uaauuugcuuuucccuugugagu

SEQ ID NO: 47393 - RNA, 23 nt, Artificial Sequence
  RNA Oligomer
uuaauuugcuuuucccuugugag

SEQ ID NO: 47394 - RNA, 23 nt, Artificial Sequence
  RNA Oligomer
cuuaauuugcuuuucccuuguga

SEQ ID NO: 47395 - RNA, 23 nt, Artificial Sequence
  RNA Oligomer
ucuuaauuugcuuuucccuugug

SEQ ID NO: 47396 - RNA, 23 nt, Artificial Sequence
  RNA Oligomer
uucuuaauuugcuuuucccuugu

SEQ ID NO: 47397 - RNA, 23 nt, Artificial Sequence
  RNA Oligomer
caagaagauuaugacagauuacg

SEQ ID NO: 47398 - RNA, 23 nt, Artificial Sequence
  RNA Oligomer
acaagaagauuaugacagauuac

SEQ ID NO: 47399 - RNA, 23 nt, Artificial Sequence
  RNA Oligomer
gacaagaagauuaugacagauua

SEQ ID NO: 47400 - RNA, 23 nt, Artificial Sequence
  RNA Oligomer
ggacaagaagauuaugacagauu

SEQ ID NO: 47401 - RNA, 23 nt, Artificial Sequence
  RNA Oligomer
uggacaagaagauuaugacagau

SEQ ID NO: 47402 - RNA, 23 nt, Artificial Sequence
  RNA Oligomer
ccggugaaucugggcuuauggga

SEQ ID NO: 47403 - RNA, 23 nt, Artificial Sequence
  RNA Oligomer
accggugaaucugggcuuauggg

SEQ ID NO: 47404 - RNA, 23 nt, Artificial Sequence
  RNA Oligomer
aaccggugaaucugggcuuaugg

SEQ ID NO: 47405 - RNA, 23 nt, Artificial Sequence
  RNA Oligomer
aaaccggugaaucugggcuuaug

SEQ ID NO: 47406 - RNA, 23 nt, Artificial Sequence
  RNA Oligomer
aaaaccggugaaucugggcuuau

SEQ ID NO: 47407 - RNA, 23 nt, Artificial Sequence
  RNA Oligomer
gaauuguggaguguuuuuacauu

SEQ ID NO: 47408 - RNA, 23 nt, Artificial Sequence
  RNA Oligomer
agaauuguggaguguuuuuacau

SEQ ID NO: 47409 - RNA, 23 nt, Artificial Sequence
  RNA Oligomer
cagaauuguggaguguuuuuaca

SEQ ID NO: 47410 - RNA, 23 nt, Artificial Sequence
  RNA Oligomer
ccacuacaacagaauuuuuuaaa

SEQ ID NO: 47411 - RNA, 23 nt, Artificial Sequence
  RNA Oligomer
cugacgauguucuguacaacuua

SEQ ID NO: 47412 - RNA, 23 nt, Artificial Sequence
  RNA Oligomer
gcugacgauguucuguacaacuu

SEQ ID NO: 47413 - RNA, 23 nt, Artificial Sequence
  RNA Oligomer
ugcugacgauguucuguacaacu

SEQ ID NO: 47414 - RNA, 23 nt, Artificial Sequence
  RNA Oligomer
gugcugacgauguucuguacaac

SEQ ID NO: 47415 - RNA, 23 nt, Artificial Sequence
  RNA Oligomer
agugcugacgauguucuguacaa

SEQ ID NO: 47416 - RNA, 23 nt, Artificial Sequence
  RNA Oligomer
aacuagguguaaaaaucaugugu

SEQ ID NO: 47417 - RNA, 23 nt, Artificial Sequence
  RNA Oligomer
uaacuagguguaaaaaucaugug

SEQ ID NO: 47418 - RNA, 23 nt, Artificial Sequence
  RNA Oligomer
ugcuuuccuuaguuuucuaguaa

SEQ ID NO: 47419 - RNA, 23 nt, Artificial Sequence
  RNA Oligomer
gugcuuuccuuaguuuucuagua

SEQ ID NO: 47420 - RNA, 23 nt, Artificial Sequence
  RNA Oligomer
agugcuuuccuuaguuuucuagu

SEQ ID NO: 47421 - RNA, 23 nt, Artificial Sequence
  RNA Oligomer
aagugcuuuccuuaguuuucuag

SEQ ID NO: 47422 - RNA, 23 nt, Artificial Sequence
  RNA Oligomer
uaagugcuuuccuuaguuuucua

SEQ ID NO: 47423 - RNA, 23 nt, Artificial Sequence
  RNA Oligomer
gcuaauaagugcuuuccuuaguu

SEQ ID NO: 47424 - RNA, 23 nt, Artificial Sequence
  RNA Oligomer
agcuaauaagugcuuuccuuagu

SEQ ID NO: 47425 - RNA, 23 nt, Artificial Sequence
  RNA Oligomer
gagcuaauaagugcuuuccuuag

SEQ ID NO: 47426 - RNA, 23 nt, Artificial Sequence
  RNA Oligomer
agagcuaauaagugcuuuccuua

SEQ ID NO: 47427 - RNA, 23 nt, Artificial Sequence
  RNA Oligomer
cagagcuaauaagugcuuuccuu

SEQ ID NO: 47428 - RNA, 23 nt, Artificial Sequence
  RNA Oligomer
uaguaaaagugcuuuccauguua

SEQ ID NO: 47429 - RNA, 23 nt, Artificial Sequence
  RNA Oligomer
uuaguaaaagugcuuuccauguu

SEQ ID NO: 47430 - RNA, 23 nt, Artificial Sequence
  RNA Oligomer
auuaguaaaagugcuuuccaugu

SEQ ID NO: 47431 - RNA, 23 nt, Artificial Sequence
  RNA Oligomer
gauuaguaaaagugcuuuccaug

SEQ ID NO: 47432 - RNA, 23 nt, Artificial Sequence
  RNA Oligomer
cuaacuuaguaagugcuuuucuu

SEQ ID NO: 47433 - RNA, 23 nt, Artificial Sequence
  RNA Oligomer
gcuaacuuaguaagugcuuuucu

SEQ ID NO: 47434 - RNA, 23 nt, Artificial Sequence
  RNA Oligomer
cgcuaacuuaguaagugcuuuuc

SEQ ID NO: 47435 - RNA, 23 nt, Artificial Sequence
  RNA Oligomer
ucgcuaacuuaguaagugcuuuu

SEQ ID NO: 47436 - RNA, 23 nt, Artificial Sequence
  RNA Oligomer
gucgcuaacuuaguaagugcuuu

SEQ ID NO: 47437 - RNA, 23 nt, Artificial Sequence
  RNA Oligomer
cuuaagcuuuuccuuucucuuac

SEQ ID NO: 47438 - RNA, 23 nt, Artificial Sequence
  RNA Oligomer
gaaagaaagguugguauuaucag

SEQ ID NO: 47439 - RNA, 23 nt, Artificial Sequence
  RNA Oligomer
ugaaagaaagguugguauuauca

SEQ ID NO: 47440 - RNA, 23 nt, Artificial Sequence
  RNA Oligomer
augaaagaaagguugguauuauc

SEQ ID NO: 47441 - RNA, 23 nt, Artificial Sequence
  RNA Oligomer
gaugaaagaaagguugguauuau

SEQ ID NO: 47442 - RNA, 23 nt, Artificial Sequence
  RNA Oligomer
ugaugaaagaaagguugguauua

SEQ ID NO: 47443 - RNA, 23 nt, Artificial Sequence
  RNA Oligomer
gucaaaugcaguagaugaugaaa

SEQ ID NO: 47444 - RNA, 23 nt, Artificial Sequence
  RNA Oligomer
ugucaaaugcaguagaugaugaa

SEQ ID NO: 47445 - RNA, 23 nt, Artificial Sequence
  RNA Oligomer
cugucaaaugcaguagaugauga

SEQ ID NO: 47446 - RNA, 23 nt, Artificial Sequence
  RNA Oligomer
ucugucaaaugcaguagaugaug

SEQ ID NO: 47447 - RNA, 23 nt, Artificial Sequence
  RNA Oligomer
uucugucaaaugcaguagaugau

SEQ ID NO: 47448 - RNA, 23 nt, Artificial Sequence
  RNA Oligomer
aagugucacggguaaaaacucua

SEQ ID NO: 47449 - RNA, 23 nt, Artificial Sequence
  RNA Oligomer
caaaggacaaagacaguauuuug

SEQ ID NO: 47450 - RNA, 23 nt, Artificial Sequence
  RNA Oligomer
ucaaaggacaaagacaguauuuu

SEQ ID NO: 47451 - RNA, 23 nt, Artificial Sequence
  RNA Oligomer
aucaaaggacaaagacaguauuu

SEQ ID NO: 47452 - RNA, 23 nt, Artificial Sequence
  RNA Oligomer
gaucaaaggacaaagacaguauu

SEQ ID NO: 47453 - RNA, 23 nt, Artificial Sequence
  RNA Oligomer
ugaucaaaggacaaagacaguau

SEQ ID NO: 47454 - RNA, 23 nt, Artificial Sequence
  RNA Oligomer
ugcuauuuccucuaaugaagaau

SEQ ID NO: 47455 - RNA, 23 nt, Artificial Sequence
  RNA Oligomer
cugcuauuuccucuaaugaagaa

SEQ ID NO: 47456 - RNA, 23 nt, Artificial Sequence
  RNA Oligomer
acugcuauuuccucuaaugaaga

SEQ ID NO: 47457 - RNA, 23 nt, Artificial Sequence
  RNA Oligomer
acaccgagcacugaacuuugcaa

SEQ ID NO: 47458 - RNA, 23 nt, Artificial Sequence
  RNA Oligomer
aacaccgagcacugaacuuugca

SEQ ID NO: 47459 - RNA, 23 nt, Artificial Sequence
  RNA Oligomer
gaacaccgagcacugaacuuugc

SEQ ID NO: 47460 - RNA, 23 nt, Artificial Sequence
  RNA Oligomer
agaacaccgagcacugaacuuug

SEQ ID NO: 47461 - RNA, 23 nt, Artificial Sequence
  RNA Oligomer
gagaacaccgagcacugaacuuu

SEQ ID NO: 47462 - RNA, 23 nt, Artificial Sequence
  RNA Oligomer
cuucugaacuacacugcauuguu

SEQ ID NO: 47463 - RNA, 23 nt, Artificial Sequence
  RNA Oligomer
ccuucugaacuacacugcauugu

SEQ ID NO: 47464 - RNA, 23 nt, Artificial Sequence
  RNA Oligomer
accuucugaacuacacugcauug

SEQ ID NO: 47465 - RNA, 23 nt, Artificial Sequence
  RNA Oligomer
uaccuucugaacuacacugcauu

SEQ ID NO: 47466 - RNA, 23 nt, Artificial Sequence
  RNA Oligomer
auaccuucugaacuacacugcau

SEQ ID NO: 47467 - RNA, 23 nt, Artificial Sequence
  RNA Oligomer
accauuuuuugaaccaaucagua

SEQ ID NO: 47468 - RNA, 23 nt, Artificial Sequence
  RNA Oligomer
aaccauuuuuugaaccaaucagu

SEQ ID NO: 47469 - RNA, 23 nt, Artificial Sequence
  RNA Oligomer
aaaccauuuuuugaaccaaucag

SEQ ID NO: 47470 - RNA, 23 nt, Artificial Sequence
  RNA Oligomer
aaaaccauuuuuugaaccaauca

SEQ ID NO: 47471 - RNA, 23 nt, Artificial Sequence
  RNA Oligomer
uaaaaccauuuuuugaaccaauc

SEQ ID NO: 47472 - RNA, 23 nt, Artificial Sequence
  RNA Oligomer
cccgugaagaagaggaagagaaa

SEQ ID NO: 47473 - RNA, 23 nt, Artificial Sequence
  RNA Oligomer
ucccgugaagaagaggaagagaa

SEQ ID NO: 47474 - RNA, 23 nt, Artificial Sequence
  RNA Oligomer
cucccgugaagaagaggaagaga

SEQ ID NO: 47475 - RNA, 23 nt, Artificial Sequence
  RNA Oligomer
ccucccgugaagaagaggaagag

SEQ ID NO: 47476 - RNA, 23 nt, Artificial Sequence
  RNA Oligomer
gccucccgugaagaagaggaaga

SEQ ID NO: 47477 - RNA, 23 nt, Artificial Sequence
  RNA Oligomer
caagacaguguuugacgaagcga

SEQ ID NO: 47478 - RNA, 23 nt, Artificial Sequence
  RNA Oligomer
ucaagacaguguuugacgaagcg

SEQ ID NO: 47479 - RNA, 23 nt, Artificial Sequence
  RNA Oligomer
cucaagacaguguuugacgaagc

SEQ ID NO: 47480 - RNA, 23 nt, Artificial Sequence
  RNA Oligomer
gcuaaggagauuggugcuguaaa

SEQ ID NO: 47481 - RNA, 23 nt, Artificial Sequence
  RNA Oligomer
gggaugauaaagacacgaucgag

SEQ ID NO: 47482 - RNA, 23 nt, Artificial Sequence
  RNA Oligomer
agggaugauaaagacacgaucga

SEQ ID NO: 47483 - RNA, 23 nt, Artificial Sequence
  RNA Oligomer
uagggaugauaaagacacgaucg

SEQ ID NO: 47484 - RNA, 23 nt, Artificial Sequence
  RNA Oligomer
uuagggaugauaaagacacgauc

SEQ ID NO: 47485 - RNA, 23 nt, Artificial Sequence
  RNA Oligomer
cuuagggaugauaaagacacgau

SEQ ID NO: 47486 - RNA, 23 nt, Artificial Sequence
  RNA Oligomer
cuagugggaacuaaacuugaucu

SEQ ID NO: 47487 - RNA, 23 nt, Artificial Sequence
  RNA Oligomer
ccuagugggaacuaaacuugauc

SEQ ID NO: 47488 - RNA, 23 nt, Artificial Sequence
  RNA Oligomer
uccuagugggaacuaaacuugau

SEQ ID NO: 47489 - RNA, 23 nt, Artificial Sequence
  RNA Oligomer
cgugcaaagugguauccugaggu

SEQ ID NO: 47490 - RNA, 23 nt, Artificial Sequence
  RNA Oligomer
ccgugcaaagugguauccugagg

SEQ ID NO: 47491 - RNA, 23 nt, Artificial Sequence
  RNA Oligomer
uccgugcaaagugguauccugag

SEQ ID NO: 47492 - RNA, 23 nt, Artificial Sequence
  RNA Oligomer
guccgugcaaagugguauccuga

SEQ ID NO: 47493 - RNA, 23 nt, Artificial Sequence
  RNA Oligomer
uguccgugcaaagugguauccug

SEQ ID NO: 47494 - RNA, 23 nt, Artificial Sequence
  RNA Oligomer
uugaaaauguccgugcaaagugg

SEQ ID NO: 47495 - RNA, 23 nt, Artificial Sequence
  RNA Oligomer
uuugaaaauguccgugcaaagug

SEQ ID NO: 47496 - RNA, 23 nt, Artificial Sequence
  RNA Oligomer
auuugaaaauguccgugcaaagu

SEQ ID NO: 47497 - RNA, 23 nt, Artificial Sequence
  RNA Oligomer
cauuugaaaauguccgugcaaag

SEQ ID NO: 47498 - RNA, 23 nt, Artificial Sequence
  RNA Oligomer
ucauuugaaaauguccgugcaaa

SEQ ID NO: 47499 - RNA, 23 nt, Artificial Sequence
  RNA Oligomer
gcaguuuuccucagcuuugggug

SEQ ID NO: 47500 - RNA, 23 nt, Artificial Sequence
  RNA Oligomer
ugcaguuuuccucagcuuugggu

SEQ ID NO: 47501 - RNA, 23 nt, Artificial Sequence
  RNA Oligomer
cugcaguuuuccucagcuuuggg

SEQ ID NO: 47502 - RNA, 23 nt, Artificial Sequence
  RNA Oligomer
ucugcaguuuuccucagcuuugg

SEQ ID NO: 47503 - RNA, 23 nt, Artificial Sequence
  RNA Oligomer
cucugcaguuuuccucagcuuug

SEQ ID NO: 47504 - RNA, 23 nt, Artificial Sequence
  RNA Oligomer
cggugaaucugggcuuaugggau

SEQ ID NO: 47505 - RNA, 23 nt, Artificial Sequence
  RNA Oligomer
gaaaaccggugaaucugggcuua

SEQ ID NO: 47506 - RNA, 23 nt, Artificial Sequence
  RNA Oligomer
uagugcugacgauguucuguaca

SEQ ID NO: 47507 - RNA, 23 nt, Artificial Sequence
  RNA Oligomer
cuagugcugacgauguucuguac

SEQ ID NO: 47508 - RNA, 23 nt, Artificial Sequence
  RNA Oligomer
gcuagugcugacgauguucugua

SEQ ID NO: 47509 - RNA, 23 nt, Artificial Sequence
  RNA Oligomer
gucuuugacaauuauucugccaa

SEQ ID NO: 47510 - RNA, 23 nt, Artificial Sequence
  RNA Oligomer
ugucuuugacaauuauucugcca

SEQ ID NO: 47511 - RNA, 23 nt, Artificial Sequence
  RNA Oligomer
cugucuuugacaauuauucugcc

SEQ ID NO: 47512 - RNA, 23 nt, Artificial Sequence
  RNA Oligomer
acugucuuugacaauuauucugc

SEQ ID NO: 47513 - RNA, 23 nt, Artificial Sequence
  RNA Oligomer
uacugucuuugacaauuauucug

SEQ ID NO: 47514 - RNA, 23 nt, Artificial Sequence
  RNA Oligomer
ccuuaguuuucuaguaacuaggu

SEQ ID NO: 47515 - RNA, 23 nt, Artificial Sequence
  RNA Oligomer
uccuuaguuuucuaguaacuagg

SEQ ID NO: 47516 - RNA, 23 nt, Artificial Sequence
  RNA Oligomer
uuccuuaguuuucuaguaacuag

SEQ ID NO: 47517 - RNA, 23 nt, Artificial Sequence
  RNA Oligomer
uuuccuuaguuuucuaguaacua

SEQ ID NO: 47518 - RNA, 23 nt, Artificial Sequence
  RNA Oligomer
cuuuccuuaguuuucuaguaacu

SEQ ID NO: 47519 - RNA, 23 nt, Artificial Sequence
  RNA Oligomer
guuacuuuauucagagcuaauaa

SEQ ID NO: 47520 - RNA, 23 nt, Artificial Sequence
  RNA Oligomer
uguuacuuuauucagagcuaaua

SEQ ID NO: 47521 - RNA, 23 nt, Artificial Sequence
  RNA Oligomer
auguuacuuuauucagagcuaau

SEQ ID NO: 47522 - RNA, 23 nt, Artificial Sequence
  RNA Oligomer
cauguuacuuuauucagagcuaa

SEQ ID NO: 47523 - RNA, 23 nt, Artificial Sequence
  RNA Oligomer
uuugucgauuaguaaaagugcuu

SEQ ID NO: 47524 - RNA, 23 nt, Artificial Sequence
  RNA Oligomer
caauaugccuccuuguauuauaa

SEQ ID NO: 47525 - RNA, 23 nt, Artificial Sequence
  RNA Oligomer
gcaauaugccuccuuguauuaua

SEQ ID NO: 47526 - RNA, 23 nt, Artificial Sequence
  RNA Oligomer
agcaauaugccuccuuguauuau

SEQ ID NO: 47527 - RNA, 23 nt, Artificial Sequence
  RNA Oligomer
gagcaauaugccuccuuguauua

SEQ ID NO: 47528 - RNA, 23 nt, Artificial Sequence
  RNA Oligomer
ugagcaauaugccuccuuguauu

SEQ ID NO: 47529 - RNA, 23 nt, Artificial Sequence
  RNA Oligomer
cugagcaauaugccuccuuguau

SEQ ID NO: 47530 - RNA, 23 nt, Artificial Sequence
  RNA Oligomer
cuuaguaagugcuuuucuuauag

SEQ ID NO: 47531 - RNA, 23 nt, Artificial Sequence
  RNA Oligomer
acuuaguaagugcuuuucuuaua

SEQ ID NO: 47532 - RNA, 23 nt, Artificial Sequence
  RNA Oligomer
aacuuaguaagugcuuuucuuau

SEQ ID NO: 47533 - RNA, 23 nt, Artificial Sequence
  RNA Oligomer
uaacuuaguaagugcuuuucuua

SEQ ID NO: 47534 - RNA, 23 nt, Artificial Sequence
  RNA Oligomer
augaugaaagaaagguugguauu

SEQ ID NO: 47535 - RNA, 23 nt, Artificial Sequence
  RNA Oligomer
caaaugcaguagaugaugaaaga

SEQ ID NO: 47536 - RNA, 23 nt, Artificial Sequence
  RNA Oligomer
gguaaaaacucuaaaagguuaau

SEQ ID NO: 47537 - RNA, 23 nt, Artificial Sequence
  RNA Oligomer
ggguaaaaacucuaaaagguuaa

SEQ ID NO: 47538 - RNA, 23 nt, Artificial Sequence
  RNA Oligomer
gcggagauuuugaacagaacugc

SEQ ID NO: 47539 - RNA, 23 nt, Artificial Sequence
  RNA Oligomer
ugcggagauuuugaacagaacug

SEQ ID NO: 47540 - RNA, 23 nt, Artificial Sequence
  RNA Oligomer
uugcggagauuuugaacagaacu

SEQ ID NO: 47541 - RNA, 23 nt, Artificial Sequence
  RNA Oligomer
uuugcggagauuuugaacagaac

SEQ ID NO: 47542 - RNA, 23 nt, Artificial Sequence
  RNA Oligomer
uuuugcggagauuuugaacagaa

SEQ ID NO: 47543 - RNA, 23 nt, Artificial Sequence
  RNA Oligomer
ucuuugugauuucauagcgaguu

SEQ ID NO: 47544 - RNA, 23 nt, Artificial Sequence
  RNA Oligomer
gcucuccuauguaguucucagau

SEQ ID NO: 47545 - RNA, 23 nt, Artificial Sequence
  RNA Oligomer
ugcucuccuauguaguucucaga

SEQ ID NO: 47546 - RNA, 23 nt, Artificial Sequence
  RNA Oligomer
gccauuuccuguuucucugcagu

SEQ ID NO: 47547 - RNA, 23 nt, Artificial Sequence
  RNA Oligomer
ggccauuuccuguuucucugcag

SEQ ID NO: 47548 - RNA, 23 nt, Artificial Sequence
  RNA Oligomer
cggccauuuccuguuucucugca

SEQ ID NO: 47549 - RNA, 23 nt, Artificial Sequence
  RNA Oligomer
gcggccauuuccuguuucucugc

SEQ ID NO: 47550 - RNA, 23 nt, Artificial Sequence
  RNA Oligomer
agcggccauuuccuguuucucug

SEQ ID NO: 47551 - RNA, 23 nt, Artificial Sequence
  RNA Oligomer
aaaaugacaagccuucuuaaagc

SEQ ID NO: 47552 - RNA, 23 nt, Artificial Sequence
  RNA Oligomer
uaaaaugacaagccuucuuaaag

SEQ ID NO: 47553 - RNA, 23 nt, Artificial Sequence
  RNA Oligomer
cuaaaaugacaagccuucuuaaa

SEQ ID NO: 47554 - RNA, 23 nt, Artificial Sequence
  RNA Oligomer
ccuaaaaugacaagccuucuuaa

SEQ ID NO: 47555 - RNA, 23 nt, Artificial Sequence
  RNA Oligomer
cccuaaaaugacaagccuucuua

SEQ ID NO: 47556 - RNA, 23 nt, Artificial Sequence
  RNA Oligomer
ccaaucaguaauuuuaagguuuu

SEQ ID NO: 47557 - RNA, 23 nt, Artificial Sequence
  RNA Oligomer
accaaucaguaauuuuaagguuu

SEQ ID NO: 47558 - RNA, 23 nt, Artificial Sequence
  RNA Oligomer
aaccaaucaguaauuuuaagguu

SEQ ID NO: 47559 - RNA, 23 nt, Artificial Sequence
  RNA Oligomer
gaaccaaucaguaauuuuaaggu

SEQ ID NO: 47560 - RNA, 23 nt, Artificial Sequence
  RNA Oligomer
ugaaccaaucaguaauuuuaagg

SEQ ID NO: 47561 - RNA, 23 nt, Artificial Sequence
  RNA Oligomer
gaaaaugccugcuguuguaaaug

SEQ ID NO: 47562 - RNA, 23 nt, Artificial Sequence
  RNA Oligomer
agaaaaugccugcuguuguaaau

SEQ ID NO: 47563 - RNA, 23 nt, Artificial Sequence
  RNA Oligomer
gagaaaaugccugcuguuguaaa

SEQ ID NO: 47564 - RNA, 23 nt, Artificial Sequence
  RNA Oligomer
agagaaaaugccugcuguuguaa

SEQ ID NO: 47565 - RNA, 23 nt, Artificial Sequence
  RNA Oligomer
aagagaaaaugccugcuguugua

SEQ ID NO: 47566 - RNA, 23 nt, Artificial Sequence
  RNA Oligomer
auguccgugcaaagugguauccu

SEQ ID NO: 47567 - RNA, 23 nt, Artificial Sequence
  RNA Oligomer
ccugcaucauuugaaaauguccg

SEQ ID NO: 47568 - RNA, 23 nt, Artificial Sequence
  RNA Oligomer
ccuugugaguccugcaucauuug

SEQ ID NO: 47569 - RNA, 23 nt, Artificial Sequence
  RNA Oligomer
cccuugugaguccugcaucauuu

SEQ ID NO: 47570 - RNA, 23 nt, Artificial Sequence
  RNA Oligomer
ucccuugugaguccugcaucauu

SEQ ID NO: 47571 - RNA, 23 nt, Artificial Sequence
  RNA Oligomer
uucccuugugaguccugcaucau

SEQ ID NO: 47572 - RNA, 23 nt, Artificial Sequence
  RNA Oligomer
uuucccuugugaguccugcauca

SEQ ID NO: 47573 - RNA, 23 nt, Artificial Sequence
  RNA Oligomer
gaagauuaugacagauuacgccc

SEQ ID NO: 47574 - RNA, 23 nt, Artificial Sequence
  RNA Oligomer
agaagauuaugacagauuacgcc

SEQ ID NO: 47575 - RNA, 23 nt, Artificial Sequence
  RNA Oligomer
aagaagauuaugacagauuacgc

SEQ ID NO: 47576 - RNA, 23 nt, Artificial Sequence
  RNA Oligomer
agcuggacaagaagauuaugaca

SEQ ID NO: 47577 - RNA, 23 nt, Artificial Sequence
  RNA Oligomer
cagcuggacaagaagauuaugac

SEQ ID NO: 47578 - RNA, 23 nt, Artificial Sequence
  RNA Oligomer
acagcuggacaagaagauuauga

SEQ ID NO: 47579 - RNA, 23 nt, Artificial Sequence
  RNA Oligomer
uacagcuggacaagaagauuaug

SEQ ID NO: 47580 - RNA, 23 nt, Artificial Sequence
  RNA Oligomer
auacagcuggacaagaagauuau

SEQ ID NO: 47581 - RNA, 23 nt, Artificial Sequence
  RNA Oligomer
cuucagccacuacaacagaauuu

SEQ ID NO: 47582 - RNA, 23 nt, Artificial Sequence
  RNA Oligomer
ccuucagccacuacaacagaauu

SEQ ID NO: 47583 - RNA, 23 nt, Artificial Sequence
  RNA Oligomer
cccuucagccacuacaacagaau

SEQ ID NO: 47584 - RNA, 23 nt, Artificial Sequence
  RNA Oligomer
cugugagguucuguaaacugugc

SEQ ID NO: 47585 - RNA, 23 nt, Artificial Sequence
  RNA Oligomer
ucugugagguucuguaaacugug

SEQ ID NO: 47586 - RNA, 23 nt, Artificial Sequence
  RNA Oligomer
gucugugagguucuguaaacugu

SEQ ID NO: 47587 - RNA, 23 nt, Artificial Sequence
  RNA Oligomer
ggucugugagguucuguaaacug

SEQ ID NO: 47588 - RNA, 23 nt, Artificial Sequence
  RNA Oligomer
gcuuuccuuaguuuucuaguaac

SEQ ID NO: 47589 - RNA, 23 nt, Artificial Sequence
  RNA Oligomer
uaaaagugcuuuccauguuacuu

SEQ ID NO: 47590 - RNA, 23 nt, Artificial Sequence
  RNA Oligomer
guaaaagugcuuuccauguuacu

SEQ ID NO: 47591 - RNA, 23 nt, Artificial Sequence
  RNA Oligomer
aguaaaagugcuuuccauguuac

SEQ ID NO: 47592 - RNA, 23 nt, Artificial Sequence
  RNA Oligomer
agguuuuuuugucgauuaguaaa

SEQ ID NO: 47593 - RNA, 23 nt, Artificial Sequence
  RNA Oligomer
aagguuuuuuugucgauuaguaa

SEQ ID NO: 47594 - RNA, 23 nt, Artificial Sequence
  RNA Oligomer
gaagguuuuuuugucgauuagua

SEQ ID NO: 47595 - RNA, 23 nt, Artificial Sequence
  RNA Oligomer
agaagguuuuuuugucgauuagu

SEQ ID NO: 47596 - RNA, 23 nt, Artificial Sequence
  RNA Oligomer
uagaagguuuuuuugucgauuag

SEQ ID NO: 47597 - RNA, 23 nt, Artificial Sequence
  RNA Oligomer
uuagaagguuuuuuugucgauua

SEQ ID NO: 47598 - RNA, 23 nt, Artificial Sequence
  RNA Oligomer
auuagaagguuuuuuugucgauu

SEQ ID NO: 47599 - RNA, 23 nt, Artificial Sequence
  RNA Oligomer
auauaucccuacugucuuugaca

SEQ ID NO: 47600 - RNA, 23 nt, Artificial Sequence
  RNA Oligomer
aauauaucccuacugucuuugac

SEQ ID NO: 47601 - RNA, 23 nt, Artificial Sequence
  RNA Oligomer
gaauauaucccuacugucuuuga

SEQ ID NO: 47602 - RNA, 23 nt, Artificial Sequence
  RNA Oligomer
agaauauaucccuacugucuuug

SEQ ID NO: 47603 - RNA, 23 nt, Artificial Sequence
  RNA Oligomer
gagaauauaucccuacugucuuu

SEQ ID NO: 47604 - RNA, 23 nt, Artificial Sequence
  RNA Oligomer
caucuuuaaacugguuguucugu

SEQ ID NO: 47605 - RNA, 23 nt, Artificial Sequence
  RNA Oligomer
ucaucuuuaaacugguuguucug

SEQ ID NO: 47606 - RNA, 23 nt, Artificial Sequence
  RNA Oligomer
uucaucuuuaaacugguuguucu

SEQ ID NO: 47607 - RNA, 23 nt, Artificial Sequence
  RNA Oligomer
auucaucuuuaaacugguuguuc

SEQ ID NO: 47608 - RNA, 23 nt, Artificial Sequence
  RNA Oligomer
aauucaucuuuaaacugguuguu

SEQ ID NO: 47609 - RNA, 23 nt, Artificial Sequence
  RNA Oligomer
uaauucaucuuuaaacugguugu

SEQ ID NO: 47610 - RNA, 23 nt, Artificial Sequence
  RNA Oligomer
uaucaggaaauguuuucuuaagc

SEQ ID NO: 47611 - RNA, 23 nt, Artificial Sequence
  RNA Oligomer
uuaucaggaaauguuuucuuaag

SEQ ID NO: 47612 - RNA, 23 nt, Artificial Sequence
  RNA Oligomer
gguuaauuucugucaaaugcagu

SEQ ID NO: 47613 - RNA, 23 nt, Artificial Sequence
  RNA Oligomer
agguuaauuucugucaaaugcag

SEQ ID NO: 47614 - RNA, 23 nt, Artificial Sequence
  RNA Oligomer
aagguuaauuucugucaaaugca

SEQ ID NO: 47615 - RNA, 23 nt, Artificial Sequence
  RNA Oligomer
aaagguuaauuucugucaaaugc

SEQ ID NO: 47616 - RNA, 23 nt, Artificial Sequence
  RNA Oligomer
aaaagguuaauuucugucaaaug

SEQ ID NO: 47617 - RNA, 23 nt, Artificial Sequence
  RNA Oligomer
acacuacauuguacaaggaauga

SEQ ID NO: 47618 - RNA, 23 nt, Artificial Sequence
  RNA Oligomer
uacacuacauuguacaaggaaug

SEQ ID NO: 47619 - RNA, 23 nt, Artificial Sequence
  RNA Oligomer
aaaauacgaaguggagauuuaca

SEQ ID NO: 47620 - RNA, 23 nt, Artificial Sequence
  RNA Oligomer
aaaggacaaagacaguauuuuga

SEQ ID NO: 47621 - RNA, 23 nt, Artificial Sequence
  RNA Oligomer
aguuuucugaccagcuuuugcgg

SEQ ID NO: 47622 - RNA, 23 nt, Artificial Sequence
  RNA Oligomer
gaguuuucugaccagcuuuugcg

SEQ ID NO: 47623 - RNA, 23 nt, Artificial Sequence
  RNA Oligomer
cacugaacuuugcaaagaccuuc

SEQ ID NO: 47624 - RNA, 23 nt, Artificial Sequence
  RNA Oligomer
gcacugaacuuugcaaagaccuu

SEQ ID NO: 47625 - RNA, 23 nt, Artificial Sequence
  RNA Oligomer
agcacugaacuuugcaaagaccu

SEQ ID NO: 47626 - RNA, 23 nt, Artificial Sequence
  RNA Oligomer
gagcacugaacuuugcaaagacc

SEQ ID NO: 47627 - RNA, 23 nt, Artificial Sequence
  RNA Oligomer
cgagcacugaacuuugcaaagac

SEQ ID NO: 47628 - RNA, 23 nt, Artificial Sequence
  RNA Oligomer
gcccuaaaaugacaagccuucuu

SEQ ID NO: 47629 - RNA, 23 nt, Artificial Sequence
  RNA Oligomer
cuaaauguaagaguucagacuca

SEQ ID NO: 47630 - RNA, 23 nt, Artificial Sequence
  RNA Oligomer
ucuaaauguaagaguucagacuc

SEQ ID NO: 47631 - RNA, 23 nt, Artificial Sequence
  RNA Oligomer
uucuaaauguaagaguucagacu

SEQ ID NO: 47632 - RNA, 23 nt, Artificial Sequence
  RNA Oligomer
guucuaaauguaagaguucagac

SEQ ID NO: 47633 - RNA, 23 nt, Artificial Sequence
  RNA Oligomer
uguucuaaauguaagaguucaga

SEQ ID NO: 47634 - RNA, 23 nt, Artificial Sequence
  RNA Oligomer
ggcuaaggagauuggugcuguaa

SEQ ID NO: 47635 - RNA, 23 nt, Artificial Sequence
  RNA Oligomer
uggcuaaggagauuggugcugua

SEQ ID NO: 47636 - RNA, 23 nt, Artificial Sequence
  RNA Oligomer
ccauggcuaaggagauuggugcu

SEQ ID NO: 47637 - RNA, 23 nt, Artificial Sequence
  RNA Oligomer
gccauggcuaaggagauuggugc

SEQ ID NO: 47638 - RNA, 23 nt, Artificial Sequence
  RNA Oligomer
agccauggcuaaggagauuggug

SEQ ID NO: 47639 - RNA, 23 nt, Artificial Sequence
  RNA Oligomer
uagccauggcuaaggagauuggu

SEQ ID NO: 47640 - RNA, 23 nt, Artificial Sequence
  RNA Oligomer
cuagccauggcuaaggagauugg

SEQ ID NO: 47641 - RNA, 23 nt, Artificial Sequence
  RNA Oligomer
gugaguccugcaucauuugaaaa

SEQ ID NO: 47642 - RNA, 23 nt, Artificial Sequence
  RNA Oligomer
ugugaguccugcaucauuugaaa

SEQ ID NO: 47643 - RNA, 23 nt, Artificial Sequence
  RNA Oligomer
uugugaguccugcaucauuugaa

SEQ ID NO: 47644 - RNA, 23 nt, Artificial Sequence
  RNA Oligomer
cuggacaagaagauuaugacaga

SEQ ID NO: 47645 - RNA, 23 nt, Artificial Sequence
  RNA Oligomer
uguuuugcauguaugacuuaaua

SEQ ID NO: 47646 - RNA, 23 nt, Artificial Sequence
  RNA Oligomer
auguuuugcauguaugacuuaau

SEQ ID NO: 47647 - RNA, 23 nt, Artificial Sequence
  RNA Oligomer
uauguuuugcauguaugacuuaa

SEQ ID NO: 47648 - RNA, 23 nt, Artificial Sequence
  RNA Oligomer
uuauguuuugcauguaugacuua

SEQ ID NO: 47649 - RNA, 23 nt, Artificial Sequence
  RNA Oligomer
auuauguuuugcauguaugacuu

SEQ ID NO: 47650 - RNA, 23 nt, Artificial Sequence
  RNA Oligomer
auuguggaguguuuuuacauuga

SEQ ID NO: 47651 - RNA, 23 nt, Artificial Sequence
  RNA Oligomer
ugcuagugcugacgauguucugu

SEQ ID NO: 47652 - RNA, 23 nt, Artificial Sequence
  RNA Oligomer
gugcuagugcugacgauguucug

SEQ ID NO: 47653 - RNA, 23 nt, Artificial Sequence
  RNA Oligomer
ugugcuagugcugacgauguucu

SEQ ID NO: 47654 - RNA, 23 nt, Artificial Sequence
  RNA Oligomer
cuaugaaccuucuuaacaucacu

SEQ ID NO: 47655 - RNA, 23 nt, Artificial Sequence
  RNA Oligomer
acuaugaaccuucuuaacaucac

SEQ ID NO: 47656 - RNA, 23 nt, Artificial Sequence
  RNA Oligomer
aacuaugaaccuucuuaacauca

SEQ ID NO: 47657 - RNA, 23 nt, Artificial Sequence
  RNA Oligomer
aaacuaugaaccuucuuaacauc

SEQ ID NO: 47658 - RNA, 23 nt, Artificial Sequence
  RNA Oligomer
uaaacuaugaaccuucuuaacau

SEQ ID NO: 47659 - RNA, 23 nt, Artificial Sequence
  RNA Oligomer
cauuagaagguuuuuuugucgau

SEQ ID NO: 47660 - RNA, 23 nt, Artificial Sequence
  RNA Oligomer
guaagugcuuuucuuauagaacc

SEQ ID NO: 47661 - RNA, 23 nt, Artificial Sequence
  RNA Oligomer
aguaagugcuuuucuuauagaac

SEQ ID NO: 47662 - RNA, 23 nt, Artificial Sequence
  RNA Oligomer
uaguaagugcuuuucuuauagaa

SEQ ID NO: 47663 - RNA, 23 nt, Artificial Sequence
  RNA Oligomer
uuaguaagugcuuuucuuauaga

SEQ ID NO: 47664 - RNA, 23 nt, Artificial Sequence
  RNA Oligomer
agucgcuaacuuaguaagugcuu

SEQ ID NO: 47665 - RNA, 23 nt, Artificial Sequence
  RNA Oligomer
ucuuaagcuuuuccuuucucuua

SEQ ID NO: 47666 - RNA, 23 nt, Artificial Sequence
  RNA Oligomer
uucuuaagcuuuuccuuucucuu

SEQ ID NO: 47667 - RNA, 23 nt, Artificial Sequence
  RNA Oligomer
uuucuuaagcuuuuccuuucucu

SEQ ID NO: 47668 - RNA, 23 nt, Artificial Sequence
  RNA Oligomer
uuuucuuaagcuuuuccuuucuc

SEQ ID NO: 47669 - RNA, 23 nt, Artificial Sequence
  RNA Oligomer
guuuucuuaagcuuuuccuuucu

SEQ ID NO: 47670 - RNA, 23 nt, Artificial Sequence
  RNA Oligomer
ucaaaugcaguagaugaugaaag

SEQ ID NO: 47671 - RNA, 23 nt, Artificial Sequence
  RNA Oligomer
uuacacuacauuguacaaggaau

SEQ ID NO: 47672 - RNA, 23 nt, Artificial Sequence
  RNA Oligomer
uuuacacuacauuguacaaggaa

SEQ ID NO: 47673 - RNA, 23 nt, Artificial Sequence
  RNA Oligomer
auuuacacuacauuguacaagga

SEQ ID NO: 47674 - RNA, 23 nt, Artificial Sequence
  RNA Oligomer
gugaucaaaggacaaagacagua

SEQ ID NO: 47675 - RNA, 23 nt, Artificial Sequence
  RNA Oligomer
gacauaacauuguacuguaaugg

SEQ ID NO: 47676 - RNA, 23 nt, Artificial Sequence
  RNA Oligomer
cgacauaacauuguacuguaaug

SEQ ID NO: 47677 - RNA, 23 nt, Artificial Sequence
  RNA Oligomer
ccgacauaacauuguacuguaau

SEQ ID NO: 47678 - RNA, 23 nt, Artificial Sequence
  RNA Oligomer
cccgacauaacauuguacuguaa

SEQ ID NO: 47679 - RNA, 23 nt, Artificial Sequence
  RNA Oligomer
ucccgacauaacauuguacugua

SEQ ID NO: 47680 - RNA, 23 nt, Artificial Sequence
  RNA Oligomer
uucccgacauaacauuguacugu

SEQ ID NO: 47681 - RNA, 23 nt, Artificial Sequence
  RNA Oligomer
guucccgacauaacauuguacug

SEQ ID NO: 47682 - RNA, 23 nt, Artificial Sequence
  RNA Oligomer
uguucccgacauaacauuguacu

SEQ ID NO: 47683 - RNA, 23 nt, Artificial Sequence
  RNA Oligomer
uugcucuccuauguaguucucag

SEQ ID NO: 47684 - RNA, 23 nt, Artificial Sequence
  RNA Oligomer
cuugcucuccuauguaguucuca

SEQ ID NO: 47685 - RNA, 23 nt, Artificial Sequence
  RNA Oligomer
acuugcucuccuauguaguucuc

SEQ ID NO: 47686 - RNA, 23 nt, Artificial Sequence
  RNA Oligomer
cgagaacaccgagcacugaacuu

SEQ ID NO: 47687 - RNA, 23 nt, Artificial Sequence
  RNA Oligomer
ccgagaacaccgagcacugaacu

SEQ ID NO: 47688 - RNA, 23 nt, Artificial Sequence
  RNA Oligomer
gccgagaacaccgagcacugaac

SEQ ID NO: 47689 - RNA, 23 nt, Artificial Sequence
  RNA Oligomer
ugaacuacacugcauuguugugc

SEQ ID NO: 47690 - RNA, 23 nt, Artificial Sequence
  RNA Oligomer
cugaacuacacugcauuguugug

SEQ ID NO: 47691 - RNA, 23 nt, Artificial Sequence
  RNA Oligomer
ucugaacuacacugcauuguugu

SEQ ID NO: 47692 - RNA, 23 nt, Artificial Sequence
  RNA Oligomer
uucugaacuacacugcauuguug

SEQ ID NO: 47693 - RNA, 23 nt, Artificial Sequence
  RNA Oligomer
cuuguucagauuaagaguugcca

SEQ ID NO: 47694 - RNA, 23 nt, Artificial Sequence
  RNA Oligomer
ucuuguucagauuaagaguugcc

SEQ ID NO: 47695 - RNA, 23 nt, Artificial Sequence
  RNA Oligomer
uucuuguucagauuaagaguugc

SEQ ID NO: 47696 - RNA, 23 nt, Artificial Sequence
  RNA Oligomer
auucuuguucagauuaagaguug

SEQ ID NO: 47697 - RNA, 23 nt, Artificial Sequence
  RNA Oligomer
cauucuuguucagauuaagaguu

SEQ ID NO: 47698 - RNA, 23 nt, Artificial Sequence
  RNA Oligomer
agcccuaaaaugacaagccuucu

SEQ ID NO: 47699 - RNA, 23 nt, Artificial Sequence
  RNA Oligomer
uagcccuaaaaugacaagccuuc

SEQ ID NO: 47700 - RNA, 23 nt, Artificial Sequence
  RNA Oligomer
ggaagagaaaaugccugcuguug

SEQ ID NO: 47701 - RNA, 23 nt, Artificial Sequence
  RNA Oligomer
aggaagagaaaaugccugcuguu

SEQ ID NO: 47702 - RNA, 23 nt, Artificial Sequence
  RNA Oligomer
gaggaagagaaaaugccugcugu

SEQ ID NO: 47703 - RNA, 23 nt, Artificial Sequence
  RNA Oligomer
agaggaagagaaaaugccugcug

SEQ ID NO: 47704 - RNA, 23 nt, Artificial Sequence
  RNA Oligomer
aagaggaagagaaaaugccugcu

SEQ ID NO: 47705 - RNA, 23 nt, Artificial Sequence
  RNA Oligomer
gagcggccauuuccuguuucucu

SEQ ID NO: 47706 - RNA, 23 nt, Artificial Sequence
  RNA Oligomer
ucccaacacucccaucauccuag

SEQ ID NO: 47707 - RNA, 23 nt, Artificial Sequence
  RNA Oligomer
gucccaacacucccaucauccua

SEQ ID NO: 47708 - RNA, 23 nt, Artificial Sequence
  RNA Oligomer
ugucccaacacucccaucauccu

SEQ ID NO: 47709 - RNA, 23 nt, Artificial Sequence
  RNA Oligomer
cugucccaacacucccaucaucc

SEQ ID NO: 47710 - RNA, 23 nt, Artificial Sequence
  RNA Oligomer
acugucccaacacucccaucauc

SEQ ID NO: 47711 - RNA, 23 nt, Artificial Sequence
  RNA Oligomer
cacugucccaacacucccaucau

SEQ ID NO: 47712 - RNA, 23 nt, Artificial Sequence
  RNA Oligomer
gcaaagugguauccugaggugcg

SEQ ID NO: 47713 - RNA, 23 nt, Artificial Sequence
  RNA Oligomer
ugcaaagugguauccugaggugc

SEQ ID NO: 47714 - RNA, 23 nt, Artificial Sequence
  RNA Oligomer
gugcaaagugguauccugaggug

SEQ ID NO: 47715 - RNA, 23 nt, Artificial Sequence
  RNA Oligomer
aauguccgugcaaagugguaucc

SEQ ID NO: 47716 - RNA, 23 nt, Artificial Sequence
  RNA Oligomer
aaauguccgugcaaagugguauc

SEQ ID NO: 47717 - RNA, 23 nt, Artificial Sequence
  RNA Oligomer
gaguguuuuuacauugaucuuuu

SEQ ID NO: 47718 - RNA, 23 nt, Artificial Sequence
  RNA Oligomer
aauuguggaguguuuuuacauug

SEQ ID NO: 47719 - RNA, 23 nt, Artificial Sequence
  RNA Oligomer
ugugagguucuguaaacugugcu

SEQ ID NO: 47720 - RNA, 23 nt, Artificial Sequence
  RNA Oligomer
cuauugauguuccuuugggucug

SEQ ID NO: 47721 - RNA, 23 nt, Artificial Sequence
  RNA Oligomer
ccuauugauguuccuuugggucu

SEQ ID NO: 47722 - RNA, 23 nt, Artificial Sequence
  RNA Oligomer
caauuauucugccaauguuaugg

SEQ ID NO: 47723 - RNA, 23 nt, Artificial Sequence
  RNA Oligomer
acaauuauucugccaauguuaug

SEQ ID NO: 47724 - RNA, 23 nt, Artificial Sequence
  RNA Oligomer
gacaauuauucugccaauguuau

SEQ ID NO: 47725 - RNA, 23 nt, Artificial Sequence
  RNA Oligomer
ugacaauuauucugccaauguua

SEQ ID NO: 47726 - RNA, 23 nt, Artificial Sequence
  RNA Oligomer
uugacaauuauucugccaauguu

SEQ ID NO: 47727 - RNA, 23 nt, Artificial Sequence
  RNA Oligomer
auaagugcuuuccuuaguuuucu

SEQ ID NO: 47728 - RNA, 23 nt, Artificial Sequence
  RNA Oligomer
uuuugucgauuaguaaaagugcu

SEQ ID NO: 47729 - RNA, 23 nt, Artificial Sequence
  RNA Oligomer
gaugaugaaagaaagguugguau

SEQ ID NO: 47730 - RNA, 23 nt, Artificial Sequence
  RNA Oligomer
uuugacaaaauacgaaguggaga

SEQ ID NO: 47731 - RNA, 23 nt, Artificial Sequence
  RNA Oligomer
uuuugacaaaauacgaaguggag

SEQ ID NO: 47732 - RNA, 23 nt, Artificial Sequence
  RNA Oligomer
auuuugacaaaauacgaagugga

SEQ ID NO: 47733 - RNA, 23 nt, Artificial Sequence
  RNA Oligomer
ugugugaucaaaggacaaagaca

SEQ ID NO: 47734 - RNA, 23 nt, Artificial Sequence
  RNA Oligomer
gugugugaucaaaggacaaagac

SEQ ID NO: 47735 - RNA, 23 nt, Artificial Sequence
  RNA Oligomer
ugugugugaucaaaggacaaaga

SEQ ID NO: 47736 - RNA, 23 nt, Artificial Sequence
  RNA Oligomer
gugugugugaucaaaggacaaag

SEQ ID NO: 47737 - RNA, 23 nt, Artificial Sequence
  RNA Oligomer
ggugugugugaucaaaggacaaa

SEQ ID NO: 47738 - RNA, 23 nt, Artificial Sequence
  RNA Oligomer
augaagcguugccauugaacuca

SEQ ID NO: 47739 - RNA, 23 nt, Artificial Sequence
  RNA Oligomer
aaugaagcguugccauugaacuc

SEQ ID NO: 47740 - RNA, 23 nt, Artificial Sequence
  RNA Oligomer
gaaugaagcguugccauugaacu

SEQ ID NO: 47741 - RNA, 23 nt, Artificial Sequence
  RNA Oligomer
cgaaugaagcguugccauugaac

SEQ ID NO: 47742 - RNA, 23 nt, Artificial Sequence
  RNA Oligomer
ccgaaugaagcguugccauugaa

SEQ ID NO: 47743 - RNA, 23 nt, Artificial Sequence
  RNA Oligomer
gaacuuugcaaagaccuucgucu

SEQ ID NO: 47744 - RNA, 23 nt, Artificial Sequence
  RNA Oligomer
ugaacuuugcaaagaccuucguc

SEQ ID NO: 47745 - RNA, 23 nt, Artificial Sequence
  RNA Oligomer
cugaacuuugcaaagaccuucgu

SEQ ID NO: 47746 - RNA, 23 nt, Artificial Sequence
  RNA Oligomer
acugaacuuugcaaagaccuucg

SEQ ID NO: 47747 - RNA, 23 nt, Artificial Sequence
  RNA Oligomer
gaacuacacugcauuguugugcc

SEQ ID NO: 47748 - RNA, 23 nt, Artificial Sequence
  RNA Oligomer
gccugcuguuguaaaugucucag

SEQ ID NO: 47749 - RNA, 23 nt, Artificial Sequence
  RNA Oligomer
ugccugcuguuguaaaugucuca

SEQ ID NO: 47750 - RNA, 23 nt, Artificial Sequence
  RNA Oligomer
augccugcuguuguaaaugucuc

SEQ ID NO: 47751 - RNA, 23 nt, Artificial Sequence
  RNA Oligomer
aaugccugcuguuguaaaugucu

SEQ ID NO: 47752 - RNA, 23 nt, Artificial Sequence
  RNA Oligomer
aaaugccugcuguuguaaauguc

SEQ ID NO: 47753 - RNA, 23 nt, Artificial Sequence
  RNA Oligomer
auggcuaaggagauuggugcugu

SEQ ID NO: 47754 - RNA, 23 nt, Artificial Sequence
  RNA Oligomer
uaaacuugaucuuagggaugaua

SEQ ID NO: 47755 - RNA, 23 nt, Artificial Sequence
  RNA Oligomer
cuaaacuugaucuuagggaugau

SEQ ID NO: 47756 - RNA, 23 nt, Artificial Sequence
  RNA Oligomer
acuaaacuugaucuuagggauga

SEQ ID NO: 47757 - RNA, 23 nt, Artificial Sequence
  RNA Oligomer
aacuaaacuugaucuuagggaug

SEQ ID NO: 47758 - RNA, 23 nt, Artificial Sequence
  RNA Oligomer
gaacuaaacuugaucuuagggau

SEQ ID NO: 47759 - RNA, 23 nt, Artificial Sequence
  RNA Oligomer
cuugugaguccugcaucauuuga

SEQ ID NO: 47760 - RNA, 23 nt, Artificial Sequence
  RNA Oligomer
cugggcuuaugggauacagcugg

SEQ ID NO: 47761 - RNA, 23 nt, Artificial Sequence
  RNA Oligomer
ucugggcuuaugggauacagcug

SEQ ID NO: 47762 - RNA, 23 nt, Artificial Sequence
  RNA Oligomer
aucugggcuuaugggauacagcu

SEQ ID NO: 47763 - RNA, 23 nt, Artificial Sequence
  RNA Oligomer
aaucugggcuuaugggauacagc

SEQ ID NO: 47764 - RNA, 23 nt, Artificial Sequence
  RNA Oligomer
gaaucugggcuuaugggauacag

SEQ ID NO: 47765 - RNA, 23 nt, Artificial Sequence
  RNA Oligomer
uguuaugguagauggaaaaccgg

SEQ ID NO: 47766 - RNA, 23 nt, Artificial Sequence
  RNA Oligomer
auguuaugguagauggaaaaccg

SEQ ID NO: 47767 - RNA, 23 nt, Artificial Sequence
  RNA Oligomer
aauguuaugguagauggaaaacc

SEQ ID NO: 47768 - RNA, 23 nt, Artificial Sequence
  RNA Oligomer
caauguuaugguagauggaaaac

SEQ ID NO: 47769 - RNA, 23 nt, Artificial Sequence
  RNA Oligomer
ccaauguuaugguagauggaaaa

SEQ ID NO: 47770 - RNA, 23 nt, Artificial Sequence
  RNA Oligomer
ccuuugggucugugagguucugu

SEQ ID NO: 47771 - RNA, 23 nt, Artificial Sequence
  RNA Oligomer
uccuuugggucugugagguucug

SEQ ID NO: 47772 - RNA, 23 nt, Artificial Sequence
  RNA Oligomer
uuccuuugggucugugagguucu

SEQ ID NO: 47773 - RNA, 23 nt, Artificial Sequence
  RNA Oligomer
guuccuuugggucugugagguuc

SEQ ID NO: 47774 - RNA, 23 nt, Artificial Sequence
  RNA Oligomer
uguuccuuugggucugugagguu

SEQ ID NO: 47775 - RNA, 23 nt, Artificial Sequence
  RNA Oligomer
guagucgcuuugccuauugaugu

SEQ ID NO: 47776 - RNA, 23 nt, Artificial Sequence
  RNA Oligomer
uguagucgcuuugccuauugaug

SEQ ID NO: 47777 - RNA, 23 nt, Artificial Sequence
  RNA Oligomer
cuguagucgcuuugccuauugau

SEQ ID NO: 47778 - RNA, 23 nt, Artificial Sequence
  RNA Oligomer
ccuguagucgcuuugccuauuga

SEQ ID NO: 47779 - RNA, 23 nt, Artificial Sequence
  RNA Oligomer
uccuguagucgcuuugccuauug

SEQ ID NO: 47780 - RNA, 23 nt, Artificial Sequence
  RNA Oligomer
aucauguguugcagcuuuauagu

SEQ ID NO: 47781 - RNA, 23 nt, Artificial Sequence
  RNA Oligomer
aaucauguguugcagcuuuauag

SEQ ID NO: 47782 - RNA, 23 nt, Artificial Sequence
  RNA Oligomer
aaaucauguguugcagcuuuaua

SEQ ID NO: 47783 - RNA, 23 nt, Artificial Sequence
  RNA Oligomer
aaaaucauguguugcagcuuuau

SEQ ID NO: 47784 - RNA, 23 nt, Artificial Sequence
  RNA Oligomer
aaaaaucauguguugcagcuuua

SEQ ID NO: 47785 - RNA, 23 nt, Artificial Sequence
  RNA Oligomer
gguuuuuuugucgauuaguaaaa

SEQ ID NO: 47786 - RNA, 23 nt, Artificial Sequence
  RNA Oligomer
gcauuagaagguuuuuuugucga

SEQ ID NO: 47787 - RNA, 23 nt, Artificial Sequence
  RNA Oligomer
ugcauuagaagguuuuuuugucg

SEQ ID NO: 47788 - RNA, 23 nt, Artificial Sequence
  RNA Oligomer
augcauuagaagguuuuuuuguc

SEQ ID NO: 47789 - RNA, 23 nt, Artificial Sequence
  RNA Oligomer
aaugcauuagaagguuuuuuugu

SEQ ID NO: 47790 - RNA, 23 nt, Artificial Sequence
  RNA Oligomer
uaaugcauuagaagguuuuuuug

SEQ ID NO: 47791 - RNA, 23 nt, Artificial Sequence
  RNA Oligomer
gauaaugcauuagaagguuuuuu

SEQ ID NO: 47792 - RNA, 23 nt, Artificial Sequence
  RNA Oligomer
ugauaaugcauuagaagguuuuu

SEQ ID NO: 47793 - RNA, 23 nt, Artificial Sequence
  RNA Oligomer
cugauaaugcauuagaagguuuu

SEQ ID NO: 47794 - RNA, 23 nt, Artificial Sequence
  RNA Oligomer
ucugauaaugcauuagaagguuu

SEQ ID NO: 47795 - RNA, 23 nt, Artificial Sequence
  RNA Oligomer
uucugauaaugcauuagaagguu

SEQ ID NO: 47796 - RNA, 23 nt, Artificial Sequence
  RNA Oligomer
uuucugauaaugcauuagaaggu

SEQ ID NO: 47797 - RNA, 23 nt, Artificial Sequence
  RNA Oligomer
gacaaagacaguauuuugacaaa

SEQ ID NO: 47798 - RNA, 23 nt, Artificial Sequence
  RNA Oligomer
ggacaaagacaguauuuugacaa

SEQ ID NO: 47799 - RNA, 23 nt, Artificial Sequence
  RNA Oligomer
aggacaaagacaguauuuugaca

SEQ ID NO: 47800 - RNA, 23 nt, Artificial Sequence
  RNA Oligomer
aaggacaaagacaguauuuugac

SEQ ID NO: 47801 - RNA, 23 nt, Artificial Sequence
  RNA Oligomer
gugugaucaaaggacaaagacag

SEQ ID NO: 47802 - RNA, 23 nt, Artificial Sequence
  RNA Oligomer
gggugugugugaucaaaggacaa

SEQ ID NO: 47803 - RNA, 23 nt, Artificial Sequence
  RNA Oligomer
cggagauuuugaacagaacugcu

SEQ ID NO: 47804 - RNA, 23 nt, Artificial Sequence
  RNA Oligomer
ucuuuggaucagucuuugugauu

SEQ ID NO: 47805 - RNA, 23 nt, Artificial Sequence
  RNA Oligomer
cuguaauggagugagcguagcag

SEQ ID NO: 47806 - RNA, 23 nt, Artificial Sequence
  RNA Oligomer
acuguaauggagugagcguagca

SEQ ID NO: 47807 - RNA, 23 nt, Artificial Sequence
  RNA Oligomer
uacuguaauggagugagcguagc

SEQ ID NO: 47808 - RNA, 23 nt, Artificial Sequence
  RNA Oligomer
guacuguaauggagugagcguag

SEQ ID NO: 47809 - RNA, 23 nt, Artificial Sequence
  RNA Oligomer
uguacuguaauggagugagcgua

SEQ ID NO: 47810 - RNA, 23 nt, Artificial Sequence
  RNA Oligomer
ugaguuagcagcacguguucccg

SEQ ID NO: 47811 - RNA, 23 nt, Artificial Sequence
  RNA Oligomer
gugaguuagcagcacguguuccc

SEQ ID NO: 47812 - RNA, 23 nt, Artificial Sequence
  RNA Oligomer
agugaguuagcagcacguguucc

SEQ ID NO: 47813 - RNA, 23 nt, Artificial Sequence
  RNA Oligomer
cagugaguuagcagcacguguuc

SEQ ID NO: 47814 - RNA, 23 nt, Artificial Sequence
  RNA Oligomer
ccagugaguuagcagcacguguu

SEQ ID NO: 47815 - RNA, 23 nt, Artificial Sequence
  RNA Oligomer
acgguagcuucugcaguuaggag

SEQ ID NO: 47816 - RNA, 23 nt, Artificial Sequence
  RNA Oligomer
gacgguagcuucugcaguuagga

SEQ ID NO: 47817 - RNA, 23 nt, Artificial Sequence
  RNA Oligomer
agacgguagcuucugcaguuagg

SEQ ID NO: 47818 - RNA, 23 nt, Artificial Sequence
  RNA Oligomer
aagacgguagcuucugcaguuag

SEQ ID NO: 47819 - RNA, 23 nt, Artificial Sequence
  RNA Oligomer
gaagacgguagcuucugcaguua

SEQ ID NO: 47820 - RNA, 23 nt, Artificial Sequence
  RNA Oligomer
guaaaacuugccuacugaucagu

SEQ ID NO: 47821 - RNA, 23 nt, Artificial Sequence
  RNA Oligomer
gguaaaacuugccuacugaucag

SEQ ID NO: 47822 - RNA, 23 nt, Artificial Sequence
  RNA Oligomer
agguaaaacuugccuacugauca

SEQ ID NO: 47823 - RNA, 23 nt, Artificial Sequence
  RNA Oligomer
uagguaaaacuugccuacugauc

SEQ ID NO: 47824 - RNA, 23 nt, Artificial Sequence
  RNA Oligomer
guagguaaaacuugccuacugau

SEQ ID NO: 47825 - RNA, 23 nt, Artificial Sequence
  RNA Oligomer
ccuuauuuuucaaaagcgccccc

SEQ ID NO: 47826 - RNA, 23 nt, Artificial Sequence
  RNA Oligomer
gccuuauuuuucaaaagcgcccc

SEQ ID NO: 47827 - RNA, 23 nt, Artificial Sequence
  RNA Oligomer
agccuuauuuuucaaaagcgccc

SEQ ID NO: 47828 - RNA, 23 nt, Artificial Sequence
  RNA Oligomer
aagccuuauuuuucaaaagcgcc

SEQ ID NO: 47829 - RNA, 23 nt, Artificial Sequence
  RNA Oligomer
aaagccuuauuuuucaaaagcgc

SEQ ID NO: 47830 - RNA, 23 nt, Artificial Sequence
  RNA Oligomer
aaaaugccugcuguuguaaaugu

SEQ ID NO: 47831 - RNA, 23 nt, Artificial Sequence
  RNA Oligomer
acacgaucgagaaacugaaggag

SEQ ID NO: 47832 - RNA, 23 nt, Artificial Sequence
  RNA Oligomer
gacacgaucgagaaacugaagga

SEQ ID NO: 47833 - RNA, 23 nt, Artificial Sequence
  RNA Oligomer
agacacgaucgagaaacugaagg

SEQ ID NO: 47834 - RNA, 23 nt, Artificial Sequence
  RNA Oligomer
aagacacgaucgagaaacugaag

SEQ ID NO: 47835 - RNA, 23 nt, Artificial Sequence
  RNA Oligomer
aaagacacgaucgagaaacugaa

SEQ ID NO: 47836 - RNA, 23 nt, Artificial Sequence
  RNA Oligomer
ugaucuuagggaugauaaagaca

SEQ ID NO: 47837 - RNA, 23 nt, Artificial Sequence
  RNA Oligomer
uugaucuuagggaugauaaagac

SEQ ID NO: 47838 - RNA, 23 nt, Artificial Sequence
  RNA Oligomer
cuugaucuuagggaugauaaaga

SEQ ID NO: 47839 - RNA, 23 nt, Artificial Sequence
  RNA Oligomer
acuugaucuuagggaugauaaag

SEQ ID NO: 47840 - RNA, 23 nt, Artificial Sequence
  RNA Oligomer
aacuugaucuuagggaugauaaa

SEQ ID NO: 47841 - RNA, 23 nt, Artificial Sequence
  RNA Oligomer
caacacucccaucauccuagugg

SEQ ID NO: 47842 - RNA, 23 nt, Artificial Sequence
  RNA Oligomer
ccaacacucccaucauccuagug

SEQ ID NO: 47843 - RNA, 23 nt, Artificial Sequence
  RNA Oligomer
cccaacacucccaucauccuagu

SEQ ID NO: 47844 - RNA, 23 nt, Artificial Sequence
  RNA Oligomer
caaagugguauccugaggugcgg

SEQ ID NO: 47845 - RNA, 23 nt, Artificial Sequence
  RNA Oligomer
gauguguucuuaauuugcuuuuc

SEQ ID NO: 47846 - RNA, 23 nt, Artificial Sequence
  RNA Oligomer
agauguguucuuaauuugcuuuu

SEQ ID NO: 47847 - RNA, 23 nt, Artificial Sequence
  RNA Oligomer
cagauguguucuuaauuugcuuu

SEQ ID NO: 47848 - RNA, 23 nt, Artificial Sequence
  RNA Oligomer
acagauguguucuuaauuugcuu

SEQ ID NO: 47849 - RNA, 23 nt, Artificial Sequence
  RNA Oligomer
aacagauguguucuuaauuugcu

SEQ ID NO: 47850 - RNA, 23 nt, Artificial Sequence
  RNA Oligomer
gcuggacaagaagauuaugacag

SEQ ID NO: 47851 - RNA, 23 nt, Artificial Sequence
  RNA Oligomer
gccaauguuaugguagauggaaa

SEQ ID NO: 47852 - RNA, 23 nt, Artificial Sequence
  RNA Oligomer
caguugcagaauuguggaguguu

SEQ ID NO: 47853 - RNA, 23 nt, Artificial Sequence
  RNA Oligomer
uaaauugacaguugcagaauugu

SEQ ID NO: 47854 - RNA, 23 nt, Artificial Sequence
  RNA Oligomer
uuaaauugacaguugcagaauug

SEQ ID NO: 47855 - RNA, 23 nt, Artificial Sequence
  RNA Oligomer
uuuaaauugacaguugcagaauu

SEQ ID NO: 47856 - RNA, 23 nt, Artificial Sequence
  RNA Oligomer
uuuuaaauugacaguugcagaau

SEQ ID NO: 47857 - RNA, 23 nt, Artificial Sequence
  RNA Oligomer
uuuuuaaauugacaguugcagaa

SEQ ID NO: 47858 - RNA, 23 nt, Artificial Sequence
  RNA Oligomer
acccuucagccacuacaacagaa

SEQ ID NO: 47859 - RNA, 23 nt, Artificial Sequence
  RNA Oligomer
gacccuucagccacuacaacaga

SEQ ID NO: 47860 - RNA, 23 nt, Artificial Sequence
  RNA Oligomer
ggacccuucagccacuacaacag

SEQ ID NO: 47861 - RNA, 23 nt, Artificial Sequence
  RNA Oligomer
gggacccuucagccacuacaaca

SEQ ID NO: 47862 - RNA, 23 nt, Artificial Sequence
  RNA Oligomer
cuguacaacuuaacucacuggcg

SEQ ID NO: 47863 - RNA, 23 nt, Artificial Sequence
  RNA Oligomer
ucuguacaacuuaacucacuggc

SEQ ID NO: 47864 - RNA, 23 nt, Artificial Sequence
  RNA Oligomer
uucuguacaacuuaacucacugg

SEQ ID NO: 47865 - RNA, 23 nt, Artificial Sequence
  RNA Oligomer
guucuguacaacuuaacucacug

SEQ ID NO: 47866 - RNA, 23 nt, Artificial Sequence
  RNA Oligomer
uguucuguacaacuuaacucacu

SEQ ID NO: 47867 - RNA, 23 nt, Artificial Sequence
  RNA Oligomer
gaaccuucuuaacaucacugucu

SEQ ID NO: 47868 - RNA, 23 nt, Artificial Sequence
  RNA Oligomer
ugaaccuucuuaacaucacuguc

SEQ ID NO: 47869 - RNA, 23 nt, Artificial Sequence
  RNA Oligomer
augaaccuucuuaacaucacugu

SEQ ID NO: 47870 - RNA, 23 nt, Artificial Sequence
  RNA Oligomer
uaugaaccuucuuaacaucacug

SEQ ID NO: 47871 - RNA, 23 nt, Artificial Sequence
  RNA Oligomer
ucauguguugcagcuuuauaguu

SEQ ID NO: 47872 - RNA, 23 nt, Artificial Sequence
  RNA Oligomer
cuacugucuuugacaauuauucu

SEQ ID NO: 47873 - RNA, 23 nt, Artificial Sequence
  RNA Oligomer
ccuacugucuuugacaauuauuc

SEQ ID NO: 47874 - RNA, 23 nt, Artificial Sequence
  RNA Oligomer
cccuacugucuuugacaauuauu

SEQ ID NO: 47875 - RNA, 23 nt, Artificial Sequence
  RNA Oligomer
ucccuacugucuuugacaauuau

SEQ ID NO: 47876 - RNA, 23 nt, Artificial Sequence
  RNA Oligomer
aucccuacugucuuugacaauua

SEQ ID NO: 47877 - RNA, 23 nt, Artificial Sequence
  RNA Oligomer
uagucgcuaacuuaguaagugcu

SEQ ID NO: 47878 - RNA, 23 nt, Artificial Sequence
  RNA Oligomer
uuagucgcuaacuuaguaagugc

SEQ ID NO: 47879 - RNA, 23 nt, Artificial Sequence
  RNA Oligomer
guuagucgcuaacuuaguaagug

SEQ ID NO: 47880 - RNA, 23 nt, Artificial Sequence
  RNA Oligomer
uguuagucgcuaacuuaguaagu

SEQ ID NO: 47881 - RNA, 23 nt, Artificial Sequence
  RNA Oligomer
cuguuagucgcuaacuuaguaag

SEQ ID NO: 47882 - RNA, 23 nt, Artificial Sequence
  RNA Oligomer
ucuguuagucgcuaacuuaguaa

SEQ ID NO: 47883 - RNA, 23 nt, Artificial Sequence
  RNA Oligomer
guuguucuguuagucgcuaacuu

SEQ ID NO: 47884 - RNA, 23 nt, Artificial Sequence
  RNA Oligomer
gguuguucuguuagucgcuaacu

SEQ ID NO: 47885 - RNA, 23 nt, Artificial Sequence
  RNA Oligomer
ugguuguucuguuagucgcuaac

SEQ ID NO: 47886 - RNA, 23 nt, Artificial Sequence
  RNA Oligomer
cugguuguucuguuagucgcuaa

SEQ ID NO: 47887 - RNA, 23 nt, Artificial Sequence
  RNA Oligomer
acugguuguucuguuagucgcua

SEQ ID NO: 47888 - RNA, 23 nt, Artificial Sequence
  RNA Oligomer
caaagacaguauuuugacaaaau

SEQ ID NO: 47889 - RNA, 23 nt, Artificial Sequence
  RNA Oligomer
acaaagacaguauuuugacaaaa

SEQ ID NO: 47890 - RNA, 23 nt, Artificial Sequence
  RNA Oligomer
ugugaucaaaggacaaagacagu

SEQ ID NO: 47891 - RNA, 23 nt, Artificial Sequence
  RNA Oligomer
ggggugugugugaucaaaggaca

SEQ ID NO: 47892 - RNA, 23 nt, Artificial Sequence
  RNA Oligomer
uggggugugugugaucaaaggac

SEQ ID NO: 47893 - RNA, 23 nt, Artificial Sequence
  RNA Oligomer
guggggugugugugaucaaagga

SEQ ID NO: 47894 - RNA, 23 nt, Artificial Sequence
  RNA Oligomer
gguggggugugugugaucaaagg

SEQ ID NO: 47895 - RNA, 23 nt, Artificial Sequence
  RNA Oligomer
cacuugcucuccuauguaguucu

SEQ ID NO: 47896 - RNA, 23 nt, Artificial Sequence
  RNA Oligomer
gacacuugcucuccuauguaguu

SEQ ID NO: 47897 - RNA, 23 nt, Artificial Sequence
  RNA Oligomer
agacacuugcucuccuauguagu

SEQ ID NO: 47898 - RNA, 23 nt, Artificial Sequence
  RNA Oligomer
cagacacuugcucuccuauguag

SEQ ID NO: 47899 - RNA, 23 nt, Artificial Sequence
  RNA Oligomer
gcagacacuugcucuccuaugua

SEQ ID NO: 47900 - RNA, 23 nt, Artificial Sequence
  RNA Oligomer
ugcagacacuugcucuccuaugu

SEQ ID NO: 47901 - RNA, 23 nt, Artificial Sequence
  RNA Oligomer
ccauucuuguucagauuaagagu

SEQ ID NO: 47902 - RNA, 23 nt, Artificial Sequence
  RNA Oligomer
cccauucuuguucagauuaagag

SEQ ID NO: 47903 - RNA, 23 nt, Artificial Sequence
  RNA Oligomer
ccccauucuuguucagauuaaga

SEQ ID NO: 47904 - RNA, 23 nt, Artificial Sequence
  RNA Oligomer
cccccauucuuguucagauuaag

SEQ ID NO: 47905 - RNA, 23 nt, Artificial Sequence
  RNA Oligomer
ccccccauucuuguucagauuaa

SEQ ID NO: 47906 - RNA, 23 nt, Artificial Sequence
  RNA Oligomer
acaagccuucuuaaagccuuauu

SEQ ID NO: 47907 - RNA, 23 nt, Artificial Sequence
  RNA Oligomer
gcuguuguaaaugucucagcccc

SEQ ID NO: 47908 - RNA, 23 nt, Artificial Sequence
  RNA Oligomer
ugcuguuguaaaugucucagccc

SEQ ID NO: 47909 - RNA, 23 nt, Artificial Sequence
  RNA Oligomer
cugcuguuguaaaugucucagcc

SEQ ID NO: 47910 - RNA, 23 nt, Artificial Sequence
  RNA Oligomer
ccugcuguuguaaaugucucagc

SEQ ID NO: 47911 - RNA, 23 nt, Artificial Sequence
  RNA Oligomer
gcuguaaaauaccuggagugcuc

SEQ ID NO: 47912 - RNA, 23 nt, Artificial Sequence
  RNA Oligomer
ugcuguaaaauaccuggagugcu

SEQ ID NO: 47913 - RNA, 23 nt, Artificial Sequence
  RNA Oligomer
gugcuguaaaauaccuggagugc

SEQ ID NO: 47914 - RNA, 23 nt, Artificial Sequence
  RNA Oligomer
ggugcuguaaaauaccuggagug

SEQ ID NO: 47915 - RNA, 23 nt, Artificial Sequence
  RNA Oligomer
uggugcuguaaaauaccuggagu

SEQ ID NO: 47916 - RNA, 23 nt, Artificial Sequence
  RNA Oligomer
cauggcuaaggagauuggugcug

SEQ ID NO: 47917 - RNA, 23 nt, Artificial Sequence
  RNA Oligomer
aaacuugaucuuagggaugauaa

SEQ ID NO: 47918 - RNA, 23 nt, Artificial Sequence
  RNA Oligomer
cauugaucuuuugcuaaugcaau

SEQ ID NO: 47919 - RNA, 23 nt, Artificial Sequence
  RNA Oligomer
acauugaucuuuugcuaaugcaa

SEQ ID NO: 47920 - RNA, 23 nt, Artificial Sequence
  RNA Oligomer
uacauugaucuuuugcuaaugca

SEQ ID NO: 47921 - RNA, 23 nt, Artificial Sequence
  RNA Oligomer
uuacauugaucuuuugcuaaugc

SEQ ID NO: 47922 - RNA, 23 nt, Artificial Sequence
  RNA Oligomer
uuuacauugaucuuuugcuaaug

SEQ ID NO: 47923 - RNA, 23 nt, Artificial Sequence
  RNA Oligomer
caacuuaacucacuggcgagaau

SEQ ID NO: 47924 - RNA, 23 nt, Artificial Sequence
  RNA Oligomer
acaacuuaacucacuggcgagaa

SEQ ID NO: 47925 - RNA, 23 nt, Artificial Sequence
  RNA Oligomer
uacaacuuaacucacuggcgaga

SEQ ID NO: 47926 - RNA, 23 nt, Artificial Sequence
  RNA Oligomer
guacaacuuaacucacuggcgag

SEQ ID NO: 47927 - RNA, 23 nt, Artificial Sequence
  RNA Oligomer
uguacaacuuaacucacuggcga

SEQ ID NO: 47928 - RNA, 23 nt, Artificial Sequence
  RNA Oligomer
gccuccuuguauuauaaaaucuu

SEQ ID NO: 47929 - RNA, 23 nt, Artificial Sequence
  RNA Oligomer
ugccuccuuguauuauaaaaucu

SEQ ID NO: 47930 - RNA, 23 nt, Artificial Sequence
  RNA Oligomer
augccuccuuguauuauaaaauc

SEQ ID NO: 47931 - RNA, 23 nt, Artificial Sequence
  RNA Oligomer
uaugccuccuuguauuauaaaau

SEQ ID NO: 47932 - RNA, 23 nt, Artificial Sequence
  RNA Oligomer
auaugccuccuuguauuauaaaa

SEQ ID NO: 47933 - RNA, 23 nt, Artificial Sequence
  RNA Oligomer
gugcuuuucuuauagaaccccuu

SEQ ID NO: 47934 - RNA, 23 nt, Artificial Sequence
  RNA Oligomer
agugcuuuucuuauagaaccccu

SEQ ID NO: 47935 - RNA, 23 nt, Artificial Sequence
  RNA Oligomer
aagugcuuuucuuauagaacccc

SEQ ID NO: 47936 - RNA, 23 nt, Artificial Sequence
  RNA Oligomer
uaagugcuuuucuuauagaaccc

SEQ ID NO: 47937 - RNA, 23 nt, Artificial Sequence
  RNA Oligomer
uuguucuguuagucgcuaacuua

SEQ ID NO: 47938 - RNA, 23 nt, Artificial Sequence
  RNA Oligomer
agaauucuguuuagcugugggug

SEQ ID NO: 47939 - RNA, 23 nt, Artificial Sequence
  RNA Oligomer
aagaauucuguuuagcugugggu

SEQ ID NO: 47940 - RNA, 23 nt, Artificial Sequence
  RNA Oligomer
gaagaauucuguuuagcuguggg

SEQ ID NO: 47941 - RNA, 23 nt, Artificial Sequence
  RNA Oligomer
ugaagaauucuguuuagcugugg

SEQ ID NO: 47942 - RNA, 23 nt, Artificial Sequence
  RNA Oligomer
augaagaauucuguuuagcugug

SEQ ID NO: 47943 - RNA, 23 nt, Artificial Sequence
  RNA Oligomer
ggagauuuugaacagaacugcua

SEQ ID NO: 47944 - RNA, 23 nt, Artificial Sequence
  RNA Oligomer
cucuuuggaucagucuuugugau

SEQ ID NO: 47945 - RNA, 23 nt, Artificial Sequence
  RNA Oligomer
acauuguacuguaauggagugag

SEQ ID NO: 47946 - RNA, 23 nt, Artificial Sequence
  RNA Oligomer
aacauuguacuguaauggaguga

SEQ ID NO: 47947 - RNA, 23 nt, Artificial Sequence
  RNA Oligomer
uaacauuguacuguaauggagug

SEQ ID NO: 47948 - RNA, 23 nt, Artificial Sequence
  RNA Oligomer
auaacauuguacuguaauggagu

SEQ ID NO: 47949 - RNA, 23 nt, Artificial Sequence
  RNA Oligomer
cauaacauuguacuguaauggag

SEQ ID NO: 47950 - RNA, 23 nt, Artificial Sequence
  RNA Oligomer
accagugaguuagcagcacgugu

SEQ ID NO: 47951 - RNA, 23 nt, Artificial Sequence
  RNA Oligomer
caccagugaguuagcagcacgug

SEQ ID NO: 47952 - RNA, 23 nt, Artificial Sequence
  RNA Oligomer
ucaccagugaguuagcagcacgu

SEQ ID NO: 47953 - RNA, 23 nt, Artificial Sequence
  RNA Oligomer
acacuugcucuccuauguaguuc

SEQ ID NO: 47954 - RNA, 23 nt, Artificial Sequence
  RNA Oligomer
ucaaugccaacuuuuuguuacag

SEQ ID NO: 47955 - RNA, 23 nt, Artificial Sequence
  RNA Oligomer
cucaaugccaacuuuuuguuaca

SEQ ID NO: 47956 - RNA, 23 nt, Artificial Sequence
  RNA Oligomer
acucaaugccaacuuuuuguuac

SEQ ID NO: 47957 - RNA, 23 nt, Artificial Sequence
  RNA Oligomer
cacucaaugccaacuuuuuguua

SEQ ID NO: 47958 - RNA, 23 nt, Artificial Sequence
  RNA Oligomer
gcacucaaugccaacuuuuuguu

SEQ ID NO: 47959 - RNA, 23 nt, Artificial Sequence
  RNA Oligomer
cuccuguagucgcuuugccuauu

SEQ ID NO: 47960 - RNA, 23 nt, Artificial Sequence
  RNA Oligomer
guugcagcuuuauaguuuuuaaa

SEQ ID NO: 47961 - RNA, 23 nt, Artificial Sequence
  RNA Oligomer
uguugcagcuuuauaguuuuuaa

SEQ ID NO: 47962 - RNA, 23 nt, Artificial Sequence
  RNA Oligomer
guguugcagcuuuauaguuuuua

SEQ ID NO: 47963 - RNA, 23 nt, Artificial Sequence
  RNA Oligomer
uguguugcagcuuuauaguuuuu

SEQ ID NO: 47964 - RNA, 23 nt, Artificial Sequence
  RNA Oligomer
auguguugcagcuuuauaguuuu

SEQ ID NO: 47965 - RNA, 23 nt, Artificial Sequence
  RNA Oligomer
guaaaaaucauguguugcagcuu

SEQ ID NO: 47966 - RNA, 23 nt, Artificial Sequence
  RNA Oligomer
uguaaaaaucauguguugcagcu

SEQ ID NO: 47967 - RNA, 23 nt, Artificial Sequence
  RNA Oligomer
gcauuuccuggagaauauauccc

SEQ ID NO: 47968 - RNA, 23 nt, Artificial Sequence
  RNA Oligomer
ugcauuuccuggagaauauaucc

SEQ ID NO: 47969 - RNA, 23 nt, Artificial Sequence
  RNA Oligomer
augcauuuccuggagaauauauc

SEQ ID NO: 47970 - RNA, 23 nt, Artificial Sequence
  RNA Oligomer
aaugcauuuccuggagaauauau

SEQ ID NO: 47971 - RNA, 23 nt, Artificial Sequence
  RNA Oligomer
aaugaagaauucuguuuagcugu

SEQ ID NO: 47972 - RNA, 23 nt, Artificial Sequence
  RNA Oligomer
uaaugaagaauucuguuuagcug

SEQ ID NO: 47973 - RNA, 23 nt, Artificial Sequence
  RNA Oligomer
gagauuuugaacagaacugcuau

SEQ ID NO: 47974 - RNA, 23 nt, Artificial Sequence
  RNA Oligomer
ucagcucuuuggaucagucuuug

SEQ ID NO: 47975 - RNA, 23 nt, Artificial Sequence
  RNA Oligomer
cucagcucuuuggaucagucuuu

SEQ ID NO: 47976 - RNA, 23 nt, Artificial Sequence
  RNA Oligomer
gcucagcucuuuggaucagucuu

SEQ ID NO: 47977 - RNA, 23 nt, Artificial Sequence
  RNA Oligomer
agcucagcucuuuggaucagucu

SEQ ID NO: 47978 - RNA, 23 nt, Artificial Sequence
  RNA Oligomer
cagcucagcucuuuggaucaguc

SEQ ID NO: 47979 - RNA, 23 nt, Artificial Sequence
  RNA Oligomer
gcagcucagcucuuuggaucagu

SEQ ID NO: 47980 - RNA, 23 nt, Artificial Sequence
  RNA Oligomer
agcagcucagcucuuuggaucag

SEQ ID NO: 47981 - RNA, 23 nt, Artificial Sequence
  RNA Oligomer
guguucccgacauaacauuguac

SEQ ID NO: 47982 - RNA, 23 nt, Artificial Sequence
  RNA Oligomer
gugcagacacuugcucuccuaug

SEQ ID NO: 47983 - RNA, 23 nt, Artificial Sequence
  RNA Oligomer
ggugcagacacuugcucuccuau

SEQ ID NO: 47984 - RNA, 23 nt, Artificial Sequence
  RNA Oligomer
ccgagcacugaacuuugcaaaga

SEQ ID NO: 47985 - RNA, 23 nt, Artificial Sequence
  RNA Oligomer
accgagcacugaacuuugcaaag

SEQ ID NO: 47986 - RNA, 23 nt, Artificial Sequence
  RNA Oligomer
caccgagcacugaacuuugcaaa

SEQ ID NO: 47987 - RNA, 23 nt, Artificial Sequence
  RNA Oligomer
cuguaaaauaccuggagugcucg

SEQ ID NO: 47988 - RNA, 23 nt, Artificial Sequence
  RNA Oligomer
uuggugcuguaaaauaccuggag

SEQ ID NO: 47989 - RNA, 23 nt, Artificial Sequence
  RNA Oligomer
auuggugcuguaaaauaccugga

SEQ ID NO: 47990 - RNA, 23 nt, Artificial Sequence
  RNA Oligomer
ggauacagcuggacaagaagauu

SEQ ID NO: 47991 - RNA, 23 nt, Artificial Sequence
  RNA Oligomer
gggauacagcuggacaagaagau

SEQ ID NO: 47992 - RNA, 23 nt, Artificial Sequence
  RNA Oligomer
ugggauacagcuggacaagaaga

SEQ ID NO: 47993 - RNA, 23 nt, Artificial Sequence
  RNA Oligomer
augggauacagcuggacaagaag

SEQ ID NO: 47994 - RNA, 23 nt, Artificial Sequence
  RNA Oligomer
uaugggauacagcuggacaagaa

SEQ ID NO: 47995 - RNA, 23 nt, Artificial Sequence
  RNA Oligomer
cuuaaacuaugaaccuucuuaac

SEQ ID NO: 47996 - RNA, 23 nt, Artificial Sequence
  RNA Oligomer
ucuuaaacuaugaaccuucuuaa

SEQ ID NO: 47997 - RNA, 23 nt, Artificial Sequence
  RNA Oligomer
uucuuaaacuaugaaccuucuua

SEQ ID NO: 47998 - RNA, 23 nt, Artificial Sequence
  RNA Oligomer
auucuuaaacuaugaaccuucuu

SEQ ID NO: 47999 - RNA, 23 nt, Artificial Sequence
  RNA Oligomer
aauucuuaaacuaugaaccuucu

SEQ ID NO: 48000 - RNA, 23 nt, Artificial Sequence
  RNA Oligomer
cuuuugcggagauuuugaacaga

SEQ ID NO: 48001 - RNA, 23 nt, Artificial Sequence
  RNA Oligomer
cguguucccgacauaacauugua

SEQ ID NO: 48002 - RNA, 23 nt, Artificial Sequence
  RNA Oligomer
cgguagcuucugcaguuaggagg

SEQ ID NO: 48003 - RNA, 23 nt, Artificial Sequence
  RNA Oligomer
cgcacucaaugccaacuuuuugu

SEQ ID NO: 48004 - RNA, 23 nt, Artificial Sequence
  RNA Oligomer
ucgcacucaaugccaacuuuuug

SEQ ID NO: 48005 - RNA, 23 nt, Artificial Sequence
  RNA Oligomer
uucgcacucaaugccaacuuuuu

SEQ ID NO: 48006 - RNA, 23 nt, Artificial Sequence
  RNA Oligomer
ccucaagacaguguuugacgaag

SEQ ID NO: 48007 - RNA, 23 nt, Artificial Sequence
  RNA Oligomer
gccucaagacaguguuugacgaa

SEQ ID NO: 48008 - RNA, 23 nt, Artificial Sequence
  RNA Oligomer
agaaacugaaggagaagaagcug

SEQ ID NO: 48009 - RNA, 23 nt, Artificial Sequence
  RNA Oligomer
gagaaacugaaggagaagaagcu

SEQ ID NO: 48010 - RNA, 23 nt, Artificial Sequence
  RNA Oligomer
cgagaaacugaaggagaagaagc

SEQ ID NO: 48011 - RNA, 23 nt, Artificial Sequence
  RNA Oligomer
ucgagaaacugaaggagaagaag

SEQ ID NO: 48012 - RNA, 23 nt, Artificial Sequence
  RNA Oligomer
aucgagaaacugaaggagaagaa

SEQ ID NO: 48013 - RNA, 23 nt, Artificial Sequence
  RNA Oligomer
ucuuagggaugauaaagacacga

SEQ ID NO: 48014 - RNA, 23 nt, Artificial Sequence
  RNA Oligomer
gcauuauguuuugcauguaugac

SEQ ID NO: 48015 - RNA, 23 nt, Artificial Sequence
  RNA Oligomer
agcauuauguuuugcauguauga

SEQ ID NO: 48016 - RNA, 23 nt, Artificial Sequence
  RNA Oligomer
uagcauuauguuuugcauguaug

SEQ ID NO: 48017 - RNA, 23 nt, Artificial Sequence
  RNA Oligomer
uuagcauuauguuuugcauguau

SEQ ID NO: 48018 - RNA, 23 nt, Artificial Sequence
  RNA Oligomer
auuagcauuauguuuugcaugua

SEQ ID NO: 48019 - RNA, 23 nt, Artificial Sequence
  RNA Oligomer
uuugacaauuauucugccaaugu

SEQ ID NO: 48020 - RNA, 23 nt, Artificial Sequence
  RNA Oligomer
ccuccuguagucgcuuugccuau

SEQ ID NO: 48021 - RNA, 23 nt, Artificial Sequence
  RNA Oligomer
cauguguugcagcuuuauaguuu

SEQ ID NO: 48022 - RNA, 23 nt, Artificial Sequence
  RNA Oligomer
ccuggagaauauaucccuacugu

SEQ ID NO: 48023 - RNA, 23 nt, Artificial Sequence
  RNA Oligomer
uccuggagaauauaucccuacug

SEQ ID NO: 48024 - RNA, 23 nt, Artificial Sequence
  RNA Oligomer
uuccuggagaauauaucccuacu

SEQ ID NO: 48025 - RNA, 23 nt, Artificial Sequence
  RNA Oligomer
uuuccuggagaauauaucccuac

SEQ ID NO: 48026 - RNA, 23 nt, Artificial Sequence
  RNA Oligomer
auuuccuggagaauauaucccua

SEQ ID NO: 48027 - RNA, 23 nt, Artificial Sequence
  RNA Oligomer
cuguuuagcugugggugugccgg

SEQ ID NO: 48028 - RNA, 23 nt, Artificial Sequence
  RNA Oligomer
ucuguuuagcugugggugugccg

SEQ ID NO: 48029 - RNA, 23 nt, Artificial Sequence
  RNA Oligomer
uucuguuuagcugugggugugcc

SEQ ID NO: 48030 - RNA, 23 nt, Artificial Sequence
  RNA Oligomer
auucuguuuagcugugggugugc

SEQ ID NO: 48031 - RNA, 23 nt, Artificial Sequence
  RNA Oligomer
aauucuguuuagcugugggugug

SEQ ID NO: 48032 - RNA, 23 nt, Artificial Sequence
  RNA Oligomer
gcuuuugcggagauuuugaacag

SEQ ID NO: 48033 - RNA, 23 nt, Artificial Sequence
  RNA Oligomer
agcuuuugcggagauuuugaaca

SEQ ID NO: 48034 - RNA, 23 nt, Artificial Sequence
  RNA Oligomer
cagcuuuugcggagauuuugaac

SEQ ID NO: 48035 - RNA, 23 nt, Artificial Sequence
  RNA Oligomer
ccagcuuuugcggagauuuugaa

SEQ ID NO: 48036 - RNA, 23 nt, Artificial Sequence
  RNA Oligomer
agcucuuuggaucagucuuugug

SEQ ID NO: 48037 - RNA, 23 nt, Artificial Sequence
  RNA Oligomer
cagcucuuuggaucagucuuugu

SEQ ID NO: 48038 - RNA, 23 nt, Artificial Sequence
  RNA Oligomer
uuguacuguaauggagugagcgu

SEQ ID NO: 48039 - RNA, 23 nt, Artificial Sequence
  RNA Oligomer
auuguacuguaauggagugagcg

SEQ ID NO: 48040 - RNA, 23 nt, Artificial Sequence
  RNA Oligomer
cauuguacuguaauggagugagc

SEQ ID NO: 48041 - RNA, 23 nt, Artificial Sequence
  RNA Oligomer
cccgaaugaagcguugccauuga

SEQ ID NO: 48042 - RNA, 23 nt, Artificial Sequence
  RNA Oligomer
ucccgaaugaagcguugccauug

SEQ ID NO: 48043 - RNA, 23 nt, Artificial Sequence
  RNA Oligomer
cucccgaaugaagcguugccauu

SEQ ID NO: 48044 - RNA, 23 nt, Artificial Sequence
  RNA Oligomer
caaaauaccuucugaacuacacu

SEQ ID NO: 48045 - RNA, 23 nt, Artificial Sequence
  RNA Oligomer
ccaaaauaccuucugaacuacac

SEQ ID NO: 48046 - RNA, 23 nt, Artificial Sequence
  RNA Oligomer
gccaaaauaccuucugaacuaca

SEQ ID NO: 48047 - RNA, 23 nt, Artificial Sequence
  RNA Oligomer
ugccaaaauaccuucugaacuac

SEQ ID NO: 48048 - RNA, 23 nt, Artificial Sequence
  RNA Oligomer
uugccaaaauaccuucugaacua

SEQ ID NO: 48049 - RNA, 23 nt, Artificial Sequence
  RNA Oligomer
agaguugccaaaauaccuucuga

SEQ ID NO: 48050 - RNA, 23 nt, Artificial Sequence
  RNA Oligomer
aagaguugccaaaauaccuucug

SEQ ID NO: 48051 - RNA, 23 nt, Artificial Sequence
  RNA Oligomer
uaagaguugccaaaauaccuucu

SEQ ID NO: 48052 - RNA, 23 nt, Artificial Sequence
  RNA Oligomer
uuaagaguugccaaaauaccuuc

SEQ ID NO: 48053 - RNA, 23 nt, Artificial Sequence
  RNA Oligomer
auuaagaguugccaaaauaccuu

SEQ ID NO: 48054 - RNA, 23 nt, Artificial Sequence
  RNA Oligomer
gccuccuguagucgcuuugccua

SEQ ID NO: 48055 - RNA, 23 nt, Artificial Sequence
  RNA Oligomer
acuugaccaauacugacccucuu

SEQ ID NO: 48056 - RNA, 23 nt, Artificial Sequence
  RNA Oligomer
cuaaugaagaauucuguuuagcu

SEQ ID NO: 48057 - RNA, 23 nt, Artificial Sequence
  RNA Oligomer
ucagaugcguaaagcagaacagc

SEQ ID NO: 48058 - RNA, 23 nt, Artificial Sequence
  RNA Oligomer
cucagaugcguaaagcagaacag

SEQ ID NO: 48059 - RNA, 23 nt, Artificial Sequence
  RNA Oligomer
ucucagaugcguaaagcagaaca

SEQ ID NO: 48060 - RNA, 23 nt, Artificial Sequence
  RNA Oligomer
uucucagaugcguaaagcagaac

SEQ ID NO: 48061 - RNA, 23 nt, Artificial Sequence
  RNA Oligomer
guucucagaugcguaaagcagaa

SEQ ID NO: 48062 - RNA, 23 nt, Artificial Sequence
  RNA Oligomer
guugccaaaauaccuucugaacu

SEQ ID NO: 48063 - RNA, 23 nt, Artificial Sequence
  RNA Oligomer
aguugccaaaauaccuucugaac

SEQ ID NO: 48064 - RNA, 23 nt, Artificial Sequence
  RNA Oligomer
gaguugccaaaauaccuucugaa

SEQ ID NO: 48065 - RNA, 23 nt, Artificial Sequence
  RNA Oligomer
ggccucaagacaguguuugacga

SEQ ID NO: 48066 - RNA, 23 nt, Artificial Sequence
  RNA Oligomer
agaagaagcugacucccaucacc

SEQ ID NO: 48067 - RNA, 23 nt, Artificial Sequence
  RNA Oligomer
gagaagaagcugacucccaucac

SEQ ID NO: 48068 - RNA, 23 nt, Artificial Sequence
  RNA Oligomer
ggagaagaagcugacucccauca

SEQ ID NO: 48069 - RNA, 23 nt, Artificial Sequence
  RNA Oligomer
aggagaagaagcugacucccauc

SEQ ID NO: 48070 - RNA, 23 nt, Artificial Sequence
  RNA Oligomer
aaggagaagaagcugacucccau

SEQ ID NO: 48071 - RNA, 23 nt, Artificial Sequence
  RNA Oligomer
uagauggaaaaccggugaaucug

SEQ ID NO: 48072 - RNA, 23 nt, Artificial Sequence
  RNA Oligomer
guagauggaaaaccggugaaucu

SEQ ID NO: 48073 - RNA, 23 nt, Artificial Sequence
  RNA Oligomer
gguagauggaaaaccggugaauc

SEQ ID NO: 48074 - RNA, 23 nt, Artificial Sequence
  RNA Oligomer
ugguagauggaaaaccggugaau

SEQ ID NO: 48075 - RNA, 23 nt, Artificial Sequence
  RNA Oligomer
augguagauggaaaaccggugaa

SEQ ID NO: 48076 - RNA, 23 nt, Artificial Sequence
  RNA Oligomer
uaugguagauggaaaaccgguga

SEQ ID NO: 48077 - RNA, 23 nt, Artificial Sequence
  RNA Oligomer
cuuugacaauuauucugccaaug

SEQ ID NO: 48078 - RNA, 23 nt, Artificial Sequence
  RNA Oligomer
ucuuugacaauuauucugccaau

SEQ ID NO: 48079 - RNA, 23 nt, Artificial Sequence
  RNA Oligomer
cacugucacuugaccaauacuga

SEQ ID NO: 48080 - RNA, 23 nt, Artificial Sequence
  RNA Oligomer
acacugucacuugaccaauacug

SEQ ID NO: 48081 - RNA, 23 nt, Artificial Sequence
  RNA Oligomer
gacacugucacuugaccaauacu

SEQ ID NO: 48082 - RNA, 23 nt, Artificial Sequence
  RNA Oligomer
cgacacugucacuugaccaauac

SEQ ID NO: 48083 - RNA, 23 nt, Artificial Sequence
  RNA Oligomer
ccgacacugucacuugaccaaua

SEQ ID NO: 48084 - RNA, 23 nt, Artificial Sequence
  RNA Oligomer
cccaaauugggcauuuaauucau

SEQ ID NO: 48085 - RNA, 23 nt, Artificial Sequence
  RNA Oligomer
ccccaaauugggcauuuaauuca

SEQ ID NO: 48086 - RNA, 23 nt, Artificial Sequence
  RNA Oligomer
uccccaaauugggcauuuaauuc

SEQ ID NO: 48087 - RNA, 23 nt, Artificial Sequence
  RNA Oligomer
cuccccaaauugggcauuuaauu

SEQ ID NO: 48088 - RNA, 23 nt, Artificial Sequence
  RNA Oligomer
ccuccccaaauugggcauuuaau

SEQ ID NO: 48089 - RNA, 23 nt, Artificial Sequence
  RNA Oligomer
aggaaugaaagugucacggguaa

SEQ ID NO: 48090 - RNA, 23 nt, Artificial Sequence
  RNA Oligomer
aaggaaugaaagugucacgggua

SEQ ID NO: 48091 - RNA, 23 nt, Artificial Sequence
  RNA Oligomer
caaggaaugaaagugucacgggu

SEQ ID NO: 48092 - RNA, 23 nt, Artificial Sequence
  RNA Oligomer
ccucccgaaugaagcguugccau

SEQ ID NO: 48093 - RNA, 23 nt, Artificial Sequence
  RNA Oligomer
cccccccauucuuguucagauua

SEQ ID NO: 48094 - RNA, 23 nt, Artificial Sequence
  RNA Oligomer
gacaagccuucuuaaagccuuau

SEQ ID NO: 48095 - RNA, 23 nt, Artificial Sequence
  RNA Oligomer
aagaagaggaagagaaaaugccu

SEQ ID NO: 48096 - RNA, 23 nt, Artificial Sequence
  RNA Oligomer
gaagaagaggaagagaaaaugcc

SEQ ID NO: 48097 - RNA, 23 nt, Artificial Sequence
  RNA Oligomer
ugaagaagaggaagagaaaaugc

SEQ ID NO: 48098 - RNA, 23 nt, Artificial Sequence
  RNA Oligomer
gugaagaagaggaagagaaaaug

SEQ ID NO: 48099 - RNA, 23 nt, Artificial Sequence
  RNA Oligomer
cgugaagaagaggaagagaaaau

SEQ ID NO: 48100 - RNA, 23 nt, Artificial Sequence
  RNA Oligomer
ccgugaagaagaggaagagaaaa

SEQ ID NO: 48101 - RNA, 23 nt, Artificial Sequence
  RNA Oligomer
ugaaggagaagaagcugacuccc

SEQ ID NO: 48102 - RNA, 23 nt, Artificial Sequence
  RNA Oligomer
cugaaggagaagaagcugacucc

SEQ ID NO: 48103 - RNA, 23 nt, Artificial Sequence
  RNA Oligomer
acugaaggagaagaagcugacuc

SEQ ID NO: 48104 - RNA, 23 nt, Artificial Sequence
  RNA Oligomer
aacugaaggagaagaagcugacu

SEQ ID NO: 48105 - RNA, 23 nt, Artificial Sequence
  RNA Oligomer
aaacugaaggagaagaagcugac

SEQ ID NO: 48106 - RNA, 23 nt, Artificial Sequence
  RNA Oligomer
gauacagcuggacaagaagauua

SEQ ID NO: 48107 - RNA, 23 nt, Artificial Sequence
  RNA Oligomer
cgauguucuguacaacuuaacuc

SEQ ID NO: 48108 - RNA, 23 nt, Artificial Sequence
  RNA Oligomer
acgauguucuguacaacuuaacu

SEQ ID NO: 48109 - RNA, 23 nt, Artificial Sequence
  RNA Oligomer
gacgauguucuguacaacuuaac

SEQ ID NO: 48110 - RNA, 23 nt, Artificial Sequence
  RNA Oligomer
ugacgauguucuguacaacuuaa

SEQ ID NO: 48111 - RNA, 23 nt, Artificial Sequence
  RNA Oligomer
uucuaguaacuagguguaaaaau

SEQ ID NO: 48112 - RNA, 23 nt, Artificial Sequence
  RNA Oligomer
uuucuaguaacuagguguaaaaa

SEQ ID NO: 48113 - RNA, 23 nt, Artificial Sequence
  RNA Oligomer
uuuucuaguaacuagguguaaaa

SEQ ID NO: 48114 - RNA, 23 nt, Artificial Sequence
  RNA Oligomer
uccuguuucucugcaguuuuccu

SEQ ID NO: 48115 - RNA, 23 nt, Artificial Sequence
  RNA Oligomer
uuccuguuucucugcaguuuucc

SEQ ID NO: 48116 - RNA, 23 nt, Artificial Sequence
  RNA Oligomer
uuuccuguuucucugcaguuuuc

SEQ ID NO: 48117 - RNA, 23 nt, Artificial Sequence
  RNA Oligomer
auuuccuguuucucugcaguuuu

SEQ ID NO: 48118 - RNA, 23 nt, Artificial Sequence
  RNA Oligomer
cauuuccuguuucucugcaguuu

SEQ ID NO: 48119 - RNA, 23 nt, Artificial Sequence
  RNA Oligomer
ccaaauugggcauuuaauucauc

SEQ ID NO: 48120 - RNA, 23 nt, Artificial Sequence
  RNA Oligomer
acaaccaaugcauuuccuggaga

SEQ ID NO: 48121 - RNA, 23 nt, Artificial Sequence
  RNA Oligomer
gcucuuuggaucagucuuuguga

SEQ ID NO: 48122 - RNA, 23 nt, Artificial Sequence
  RNA Oligomer
guucagauuaagaguugccaaaa

SEQ ID NO: 48123 - RNA, 23 nt, Artificial Sequence
  RNA Oligomer
uguucagauuaagaguugccaaa

SEQ ID NO: 48124 - RNA, 23 nt, Artificial Sequence
  RNA Oligomer
ugacaagccuucuuaaagccuua

SEQ ID NO: 48125 - RNA, 23 nt, Artificial Sequence
  RNA Oligomer
augacaagccuucuuaaagccuu

SEQ ID NO: 48126 - RNA, 23 nt, Artificial Sequence
  RNA Oligomer
gaagagaaaaugccugcuguugu

SEQ ID NO: 48127 - RNA, 23 nt, Artificial Sequence
  RNA Oligomer
agaagaggaagagaaaaugccug

SEQ ID NO: 48128 - RNA, 23 nt, Artificial Sequence
  RNA Oligomer
gaucgagaaacugaaggagaaga

SEQ ID NO: 48129 - RNA, 23 nt, Artificial Sequence
  RNA Oligomer
cgaucgagaaacugaaggagaag

SEQ ID NO: 48130 - RNA, 23 nt, Artificial Sequence
  RNA Oligomer
acgaucgagaaacugaaggagaa

SEQ ID NO: 48131 - RNA, 23 nt, Artificial Sequence
  RNA Oligomer
ggagcggccauuuccuguuucuc

SEQ ID NO: 48132 - RNA, 23 nt, Artificial Sequence
  RNA Oligomer
uggagcggccauuuccuguuucu

SEQ ID NO: 48133 - RNA, 23 nt, Artificial Sequence
  RNA Oligomer
cugugcuagugcugacgauguuc

SEQ ID NO: 48134 - RNA, 23 nt, Artificial Sequence
  RNA Oligomer
acugugcuagugcugacgauguu

SEQ ID NO: 48135 - RNA, 23 nt, Artificial Sequence
  RNA Oligomer
aacugugcuagugcugacgaugu

SEQ ID NO: 48136 - RNA, 23 nt, Artificial Sequence
  RNA Oligomer
aaacugugcuagugcugacgaug

SEQ ID NO: 48137 - RNA, 23 nt, Artificial Sequence
  RNA Oligomer
uaaacugugcuagugcugacgau

SEQ ID NO: 48138 - RNA, 23 nt, Artificial Sequence
  RNA Oligomer
aauaugccuccuuguauuauaaa

SEQ ID NO: 48139 - RNA, 23 nt, Artificial Sequence
  RNA Oligomer
ggagaauauaucccuacugucuu

SEQ ID NO: 48140 - RNA, 23 nt, Artificial Sequence
  RNA Oligomer
uggagaauauaucccuacugucu

SEQ ID NO: 48141 - RNA, 23 nt, Artificial Sequence
  RNA Oligomer
cuggagaauauaucccuacuguc

SEQ ID NO: 48142 - RNA, 23 nt, Artificial Sequence
  RNA Oligomer
ugcaggccaucaaguguguggug

SEQ ID NO: 48143 - RNA, 23 nt, Artificial Sequence
  RNA Oligomer
augcaggccaucaaguguguggu

SEQ ID NO: 48144 - RNA, 23 nt, Artificial Sequence
  RNA Oligomer
gaugcaggccaucaagugugugg

SEQ ID NO: 48145 - RNA, 23 nt, Artificial Sequence
  RNA Oligomer
ugaugcaggccaucaagugugug

SEQ ID NO: 48146 - RNA, 23 nt, Artificial Sequence
  RNA Oligomer
cugaugcaggccaucaagugugu

SEQ ID NO: 48147 - RNA, 23 nt, Artificial Sequence
  RNA Oligomer
cacgaucgagaaacugaaggaga

SEQ ID NO: 48148 - RNA, 23 nt, Artificial Sequence
  RNA Oligomer
ugccaauguuaugguagauggaa

SEQ ID NO: 48149 - RNA, 23 nt, Artificial Sequence
  RNA Oligomer
cugccaauguuaugguagaugga

SEQ ID NO: 48150 - RNA, 23 nt, Artificial Sequence
  RNA Oligomer
ucugccaauguuaugguagaugg

SEQ ID NO: 48151 - RNA, 23 nt, Artificial Sequence
  RNA Oligomer
uucugccaauguuaugguagaug

SEQ ID NO: 48152 - RNA, 23 nt, Artificial Sequence
  RNA Oligomer
auucugccaauguuaugguagau

SEQ ID NO: 48153 - RNA, 23 nt, Artificial Sequence
  RNA Oligomer
uaucccuacugucuuugacaauu

SEQ ID NO: 48154 - RNA, 23 nt, Artificial Sequence
  RNA Oligomer
gaacagccucccgaaugaagcgu

SEQ ID NO: 48155 - RNA, 23 nt, Artificial Sequence
  RNA Oligomer
agaacagccucccgaaugaagcg

SEQ ID NO: 48156 - RNA, 23 nt, Artificial Sequence
  RNA Oligomer
cagaacagccucccgaaugaagc

SEQ ID NO: 48157 - RNA, 23 nt, Artificial Sequence
  RNA Oligomer
gcagaacagccucccgaaugaag

SEQ ID NO: 48158 - RNA, 23 nt, Artificial Sequence
  RNA Oligomer
agcagaacagccucccgaaugaa

SEQ ID NO: 48159 - RNA, 23 nt, Artificial Sequence
  RNA Oligomer
agaagacgguagcuucugcaguu

SEQ ID NO: 48160 - RNA, 23 nt, Artificial Sequence
  RNA Oligomer
ccugucccuuggaaccuuuguac

SEQ ID NO: 48161 - RNA, 23 nt, Artificial Sequence
  RNA Oligomer
uccugucccuuggaaccuuugua

SEQ ID NO: 48162 - RNA, 23 nt, Artificial Sequence
  RNA Oligomer
guccugucccuuggaaccuuugu

SEQ ID NO: 48163 - RNA, 23 nt, Artificial Sequence
  RNA Oligomer
gguccugucccuuggaaccuuug

SEQ ID NO: 48164 - RNA, 23 nt, Artificial Sequence
  RNA Oligomer
ugguccugucccuuggaaccuuu

SEQ ID NO: 48165 - RNA, 23 nt, Artificial Sequence
  RNA Oligomer
agauggaaaaccggugaaucugg

SEQ ID NO: 48166 - RNA, 23 nt, Artificial Sequence
  RNA Oligomer
gcuaaugcaauuagcauuauguu

SEQ ID NO: 48167 - RNA, 23 nt, Artificial Sequence
  RNA Oligomer
ugcuaaugcaauuagcauuaugu

SEQ ID NO: 48168 - RNA, 23 nt, Artificial Sequence
  RNA Oligomer
uugcuaaugcaauuagcauuaug

SEQ ID NO: 48169 - RNA, 23 nt, Artificial Sequence
  RNA Oligomer
uuugcuaaugcaauuagcauuau

SEQ ID NO: 48170 - RNA, 23 nt, Artificial Sequence
  RNA Oligomer
uuuugcuaaugcaauuagcauua

SEQ ID NO: 48171 - RNA, 23 nt, Artificial Sequence
  RNA Oligomer
ugauguuccuuugggucugugag

SEQ ID NO: 48172 - RNA, 23 nt, Artificial Sequence
  RNA Oligomer
uugauguuccuuugggucuguga

SEQ ID NO: 48173 - RNA, 23 nt, Artificial Sequence
  RNA Oligomer
auugauguuccuuugggucugug

SEQ ID NO: 48174 - RNA, 23 nt, Artificial Sequence
  RNA Oligomer
uauugauguuccuuugggucugu

SEQ ID NO: 48175 - RNA, 23 nt, Artificial Sequence
  RNA Oligomer
accgacacugucacuugaccaau

SEQ ID NO: 48176 - RNA, 23 nt, Artificial Sequence
  RNA Oligomer
uaccgacacugucacuugaccaa

SEQ ID NO: 48177 - RNA, 23 nt, Artificial Sequence
  RNA Oligomer
auaucccuacugucuuugacaau

SEQ ID NO: 48178 - RNA, 23 nt, Artificial Sequence
  RNA Oligomer
gaccagcuuuugcggagauuuug

SEQ ID NO: 48179 - RNA, 23 nt, Artificial Sequence
  RNA Oligomer
ugaccagcuuuugcggagauuuu

SEQ ID NO: 48180 - RNA, 23 nt, Artificial Sequence
  RNA Oligomer
cugaccagcuuuugcggagauuu

SEQ ID NO: 48181 - RNA, 23 nt, Artificial Sequence
  RNA Oligomer
ucugaccagcuuuugcggagauu

SEQ ID NO: 48182 - RNA, 23 nt, Artificial Sequence
  RNA Oligomer
uucugaccagcuuuugcggagau

SEQ ID NO: 48183 - RNA, 23 nt, Artificial Sequence
  RNA Oligomer
cguagcagcucagcucuuuggau

SEQ ID NO: 48184 - RNA, 23 nt, Artificial Sequence
  RNA Oligomer
gcguagcagcucagcucuuugga

SEQ ID NO: 48185 - RNA, 23 nt, Artificial Sequence
  RNA Oligomer
agcguagcagcucagcucuuugg

SEQ ID NO: 48186 - RNA, 23 nt, Artificial Sequence
  RNA Oligomer
gagcguagcagcucagcucuuug

SEQ ID NO: 48187 - RNA, 23 nt, Artificial Sequence
  RNA Oligomer
ugagcguagcagcucagcucuuu

SEQ ID NO: 48188 - RNA, 23 nt, Artificial Sequence
  RNA Oligomer
ccauugaacucaccagugaguua

SEQ ID NO: 48189 - RNA, 23 nt, Artificial Sequence
  RNA Oligomer
gccauugaacucaccagugaguu

SEQ ID NO: 48190 - RNA, 23 nt, Artificial Sequence
  RNA Oligomer
ugccauugaacucaccagugagu

SEQ ID NO: 48191 - RNA, 23 nt, Artificial Sequence
  RNA Oligomer
uugccauugaacucaccagugag

SEQ ID NO: 48192 - RNA, 23 nt, Artificial Sequence
  RNA Oligomer
guugccauugaacucaccaguga

SEQ ID NO: 48193 - RNA, 23 nt, Artificial Sequence
  RNA Oligomer
gcguugccauugaacucaccagu

SEQ ID NO: 48194 - RNA, 23 nt, Artificial Sequence
  RNA Oligomer
agcguugccauugaacucaccag

SEQ ID NO: 48195 - RNA, 23 nt, Artificial Sequence
  RNA Oligomer
aagcguugccauugaacucacca

SEQ ID NO: 48196 - RNA, 23 nt, Artificial Sequence
  RNA Oligomer
gaagcguugccauugaacucacc

SEQ ID NO: 48197 - RNA, 23 nt, Artificial Sequence
  RNA Oligomer
ugaagcguugccauugaacucac

SEQ ID NO: 48198 - RNA, 23 nt, Artificial Sequence
  RNA Oligomer
agaugcguaaagcagaacagccu

SEQ ID NO: 48199 - RNA, 23 nt, Artificial Sequence
  RNA Oligomer
cagaugcguaaagcagaacagcc

SEQ ID NO: 48200 - RNA, 23 nt, Artificial Sequence
  RNA Oligomer
gccaacuuuuuguuacagauuaa

SEQ ID NO: 48201 - RNA, 23 nt, Artificial Sequence
  RNA Oligomer
ugccaacuuuuuguuacagauua

SEQ ID NO: 48202 - RNA, 23 nt, Artificial Sequence
  RNA Oligomer
augccaacuuuuuguuacagauu

SEQ ID NO: 48203 - RNA, 23 nt, Artificial Sequence
  RNA Oligomer
aaugccaacuuuuuguuacagau

SEQ ID NO: 48204 - RNA, 23 nt, Artificial Sequence
  RNA Oligomer
caaugccaacuuuuuguuacaga

SEQ ID NO: 48205 - RNA, 23 nt, Artificial Sequence
  RNA Oligomer
gaggccucaagacaguguuugac

SEQ ID NO: 48206 - RNA, 23 nt, Artificial Sequence
  RNA Oligomer
cgaggccucaagacaguguuuga

SEQ ID NO: 48207 - RNA, 23 nt, Artificial Sequence
  RNA Oligomer
gcgaggccucaagacaguguuug

SEQ ID NO: 48208 - RNA, 23 nt, Artificial Sequence
  RNA Oligomer
agcgaggccucaagacaguguuu

SEQ ID NO: 48209 - RNA, 23 nt, Artificial Sequence
  RNA Oligomer
cagcgaggccucaagacaguguu

SEQ ID NO: 48210 - RNA, 23 nt, Artificial Sequence
  RNA Oligomer
ucauccuagugggaacuaaacuu

SEQ ID NO: 48211 - RNA, 23 nt, Artificial Sequence
  RNA Oligomer
aucauccuagugggaacuaaacu

SEQ ID NO: 48212 - RNA, 23 nt, Artificial Sequence
  RNA Oligomer
caucauccuagugggaacuaaac

SEQ ID NO: 48213 - RNA, 23 nt, Artificial Sequence
  RNA Oligomer
ccaucauccuagugggaacuaaa

SEQ ID NO: 48214 - RNA, 23 nt, Artificial Sequence
  RNA Oligomer
cccaucauccuagugggaacuaa

SEQ ID NO: 48215 - RNA, 23 nt, Artificial Sequence
  RNA Oligomer
uuuucccuugugaguccugcauc

SEQ ID NO: 48216 - RNA, 23 nt, Artificial Sequence
  RNA Oligomer
cuuuucccuugugaguccugcau

SEQ ID NO: 48217 - RNA, 23 nt, Artificial Sequence
  RNA Oligomer
aauuagcauuauguuuugcaugu

SEQ ID NO: 48218 - RNA, 23 nt, Artificial Sequence
  RNA Oligomer
gauguucuguacaacuuaacuca

SEQ ID NO: 48219 - RNA, 23 nt, Artificial Sequence
  RNA Oligomer
acugucacuugaccaauacugac

SEQ ID NO: 48220 - RNA, 23 nt, Artificial Sequence
  RNA Oligomer
ucagagcuaauaagugcuuuccu

SEQ ID NO: 48221 - RNA, 23 nt, Artificial Sequence
  RNA Oligomer
uucagagcuaauaagugcuuucc

SEQ ID NO: 48222 - RNA, 23 nt, Artificial Sequence
  RNA Oligomer
auucagagcuaauaagugcuuuc

SEQ ID NO: 48223 - RNA, 23 nt, Artificial Sequence
  RNA Oligomer
uauucagagcuaauaagugcuuu

SEQ ID NO: 48224 - RNA, 23 nt, Artificial Sequence
  RNA Oligomer
guggagcggccauuuccuguuuc

SEQ ID NO: 48225 - RNA, 23 nt, Artificial Sequence
  RNA Oligomer
aguggagcggccauuuccuguuu

SEQ ID NO: 48226 - RNA, 23 nt, Artificial Sequence
  RNA Oligomer
acgaaguggagauuuacacuaca

SEQ ID NO: 48227 - RNA, 23 nt, Artificial Sequence
  RNA Oligomer
uacgaaguggagauuuacacuac

SEQ ID NO: 48228 - RNA, 23 nt, Artificial Sequence
  RNA Oligomer
auacgaaguggagauuuacacua

SEQ ID NO: 48229 - RNA, 23 nt, Artificial Sequence
  RNA Oligomer
uuguucagauuaagaguugccaa

SEQ ID NO: 48230 - RNA, 23 nt, Artificial Sequence
  RNA Oligomer
uguagguaaaacuugccuacuga

SEQ ID NO: 48231 - RNA, 23 nt, Artificial Sequence
  RNA Oligomer
cuguagguaaaacuugccuacug

SEQ ID NO: 48232 - RNA, 23 nt, Artificial Sequence
  RNA Oligomer
ccaacuuuuuguuacagauuaau

SEQ ID NO: 48233 - RNA, 23 nt, Artificial Sequence
  RNA Oligomer
uugguccugucccuuggaaccuu

SEQ ID NO: 48234 - RNA, 23 nt, Artificial Sequence
  RNA Oligomer
ucccaucauccuagugggaacua

SEQ ID NO: 48235 - RNA, 23 nt, Artificial Sequence
  RNA Oligomer
cucccaucauccuagugggaacu

SEQ ID NO: 48236 - RNA, 23 nt, Artificial Sequence
  RNA Oligomer
acucccaucauccuagugggaac

SEQ ID NO: 48237 - RNA, 23 nt, Artificial Sequence
  RNA Oligomer
ucucugcaguuuuccucagcuuu

SEQ ID NO: 48238 - RNA, 23 nt, Artificial Sequence
  RNA Oligomer
uucucugcaguuuuccucagcuu

SEQ ID NO: 48239 - RNA, 23 nt, Artificial Sequence
  RNA Oligomer
uuaugggauacagcuggacaaga

SEQ ID NO: 48240 - RNA, 23 nt, Artificial Sequence
  RNA Oligomer
uuaacucacuggcgagaauacag

SEQ ID NO: 48241 - RNA, 23 nt, Artificial Sequence
  RNA Oligomer
cuuaacucacuggcgagaauaca

SEQ ID NO: 48242 - RNA, 23 nt, Artificial Sequence
  RNA Oligomer
acuuaacucacuggcgagaauac

SEQ ID NO: 48243 - RNA, 23 nt, Artificial Sequence
  RNA Oligomer
aacuuaacucacuggcgagaaua

SEQ ID NO: 48244 - RNA, 23 nt, Artificial Sequence
  RNA Oligomer
uuaccgacacugucacuugacca

SEQ ID NO: 48245 - RNA, 23 nt, Artificial Sequence
  RNA Oligomer
ucacugucuugccagauuaccga

SEQ ID NO: 48246 - RNA, 23 nt, Artificial Sequence
  RNA Oligomer
aucacugucuugccagauuaccg

SEQ ID NO: 48247 - RNA, 23 nt, Artificial Sequence
  RNA Oligomer
caucacugucuugccagauuacc

SEQ ID NO: 48248 - RNA, 23 nt, Artificial Sequence
  RNA Oligomer
acaucacugucuugccagauuac

SEQ ID NO: 48249 - RNA, 23 nt, Artificial Sequence
  RNA Oligomer
aacaucacugucuugccagauua

SEQ ID NO: 48250 - RNA, 23 nt, Artificial Sequence
  RNA Oligomer
uauaucccuacugucuuugacaa

SEQ ID NO: 48251 - RNA, 23 nt, Artificial Sequence
  RNA Oligomer
acaaggaaugaaagugucacggg

SEQ ID NO: 48252 - RNA, 23 nt, Artificial Sequence
  RNA Oligomer
uacaaggaaugaaagugucacgg

SEQ ID NO: 48253 - RNA, 23 nt, Artificial Sequence
  RNA Oligomer
cuacugaucaguuacacaaccaa

SEQ ID NO: 48254 - RNA, 23 nt, Artificial Sequence
  RNA Oligomer
ccuacugaucaguuacacaacca

SEQ ID NO: 48255 - RNA, 23 nt, Artificial Sequence
  RNA Oligomer
gccuacugaucaguuacacaacc

SEQ ID NO: 48256 - RNA, 23 nt, Artificial Sequence
  RNA Oligomer
ugccuacugaucaguuacacaac

SEQ ID NO: 48257 - RNA, 23 nt, Artificial Sequence
  RNA Oligomer
uugccuacugaucaguuacacaa

SEQ ID NO: 48258 - RNA, 23 nt, Artificial Sequence
  RNA Oligomer
cuugccuacugaucaguuacaca

SEQ ID NO: 48259 - RNA, 23 nt, Artificial Sequence
  RNA Oligomer
acuugccuacugaucaguuacac

SEQ ID NO: 48260 - RNA, 23 nt, Artificial Sequence
  RNA Oligomer
aggugcagacacuugcucuccua

SEQ ID NO: 48261 - RNA, 23 nt, Artificial Sequence
  RNA Oligomer
gaguucagacucacauucuauua

SEQ ID NO: 48262 - RNA, 23 nt, Artificial Sequence
  RNA Oligomer
agaguucagacucacauucuauu

SEQ ID NO: 48263 - RNA, 23 nt, Artificial Sequence
  RNA Oligomer
ccauuuuuugaaccaaucaguaa

SEQ ID NO: 48264 - RNA, 23 nt, Artificial Sequence
  RNA Oligomer
cuucgcacucaaugccaacuuuu

SEQ ID NO: 48265 - RNA, 23 nt, Artificial Sequence
  RNA Oligomer
ccuucgcacucaaugccaacuuu

SEQ ID NO: 48266 - RNA, 23 nt, Artificial Sequence
  RNA Oligomer
gccuucgcacucaaugccaacuu

SEQ ID NO: 48267 - RNA, 23 nt, Artificial Sequence
  RNA Oligomer
gucuagccauggcuaaggagauu

SEQ ID NO: 48268 - RNA, 23 nt, Artificial Sequence
  RNA Oligomer
ggucuagccauggcuaaggagau

SEQ ID NO: 48269 - RNA, 23 nt, Artificial Sequence
  RNA Oligomer
gggucuagccauggcuaaggaga

SEQ ID NO: 48270 - RNA, 23 nt, Artificial Sequence
  RNA Oligomer
agggucuagccauggcuaaggag

SEQ ID NO: 48271 - RNA, 23 nt, Artificial Sequence
  RNA Oligomer
cagggucuagccauggcuaagga

SEQ ID NO: 48272 - RNA, 23 nt, Artificial Sequence
  RNA Oligomer
auccuagugggaacuaaacuuga

SEQ ID NO: 48273 - RNA, 23 nt, Artificial Sequence
  RNA Oligomer
cauccuagugggaacuaaacuug

SEQ ID NO: 48274 - RNA, 23 nt, Artificial Sequence
  RNA Oligomer
cuuaugggauacagcuggacaag

SEQ ID NO: 48275 - RNA, 23 nt, Artificial Sequence
  RNA Oligomer
gcuuaugggauacagcuggacaa

SEQ ID NO: 48276 - RNA, 23 nt, Artificial Sequence
  RNA Oligomer
cuuuugcuaaugcaauuagcauu

SEQ ID NO: 48277 - RNA, 23 nt, Artificial Sequence
  RNA Oligomer
ucuuuugcuaaugcaauuagcau

SEQ ID NO: 48278 - RNA, 23 nt, Artificial Sequence
  RNA Oligomer
aucuuuugcuaaugcaauuagca

SEQ ID NO: 48279 - RNA, 23 nt, Artificial Sequence
  RNA Oligomer
gaucuuuugcuaaugcaauuagc

SEQ ID NO: 48280 - RNA, 23 nt, Artificial Sequence
  RNA Oligomer
ugaucuuuugcuaaugcaauuag

SEQ ID NO: 48281 - RNA, 23 nt, Artificial Sequence
  RNA Oligomer
cuguuucucugcaguuuuccuca

SEQ ID NO: 48282 - RNA, 23 nt, Artificial Sequence
  RNA Oligomer
ccuguuucucugcaguuuuccuc

SEQ ID NO: 48283 - RNA, 23 nt, Artificial Sequence
  RNA Oligomer
guuuucuaguaacuagguguaaa

SEQ ID NO: 48284 - RNA, 23 nt, Artificial Sequence
  RNA Oligomer
uuauucagagcuaauaagugcuu

SEQ ID NO: 48285 - RNA, 23 nt, Artificial Sequence
  RNA Oligomer
cauuuccuggagaauauaucccu

SEQ ID NO: 48286 - RNA, 23 nt, Artificial Sequence
  RNA Oligomer
uuucugucaaaugcaguagauga

SEQ ID NO: 48287 - RNA, 23 nt, Artificial Sequence
  RNA Oligomer
auuucugucaaaugcaguagaug

SEQ ID NO: 48288 - RNA, 23 nt, Artificial Sequence
  RNA Oligomer
aauuucugucaaaugcaguagau

SEQ ID NO: 48289 - RNA, 23 nt, Artificial Sequence
  RNA Oligomer
cacaaccaaugcauuuccuggag

SEQ ID NO: 48290 - RNA, 23 nt, Artificial Sequence
  RNA Oligomer
accagcuuuugcggagauuuuga

SEQ ID NO: 48291 - RNA, 23 nt, Artificial Sequence
  RNA Oligomer
ugaucaguuacacaaccaaugca

SEQ ID NO: 48292 - RNA, 23 nt, Artificial Sequence
  RNA Oligomer
cugaucaguuacacaaccaaugc

SEQ ID NO: 48293 - RNA, 23 nt, Artificial Sequence
  RNA Oligomer
acugaucaguuacacaaccaaug

SEQ ID NO: 48294 - RNA, 23 nt, Artificial Sequence
  RNA Oligomer
uacugaucaguuacacaaccaau

SEQ ID NO: 48295 - RNA, 23 nt, Artificial Sequence
  RNA Oligomer
aagcagaacagccucccgaauga

SEQ ID NO: 48296 - RNA, 23 nt, Artificial Sequence
  RNA Oligomer
gcguaaagcagaacagccucccg

SEQ ID NO: 48297 - RNA, 23 nt, Artificial Sequence
  RNA Oligomer
ugcguaaagcagaacagccuccc

SEQ ID NO: 48298 - RNA, 23 nt, Artificial Sequence
  RNA Oligomer
augcguaaagcagaacagccucc

SEQ ID NO: 48299 - RNA, 23 nt, Artificial Sequence
  RNA Oligomer
gaugcguaaagcagaacagccuc

SEQ ID NO: 48300 - RNA, 23 nt, Artificial Sequence
  RNA Oligomer
aacuugccuacugaucaguuaca

SEQ ID NO: 48301 - RNA, 23 nt, Artificial Sequence
  RNA Oligomer
aaacuugccuacugaucaguuac

SEQ ID NO: 48302 - RNA, 23 nt, Artificial Sequence
  RNA Oligomer
aaaacuugccuacugaucaguua

SEQ ID NO: 48303 - RNA, 23 nt, Artificial Sequence
  RNA Oligomer
uaaagccuuauuuuucaaaagcg

SEQ ID NO: 48304 - RNA, 23 nt, Artificial Sequence
  RNA Oligomer
uuagcccuaaaaugacaagccuu

SEQ ID NO: 48305 - RNA, 23 nt, Artificial Sequence
  RNA Oligomer
uuuagcccuaaaaugacaagccu

SEQ ID NO: 48306 - RNA, 23 nt, Artificial Sequence
  RNA Oligomer
cgccucccgugaagaagaggaag

SEQ ID NO: 48307 - RNA, 23 nt, Artificial Sequence
  RNA Oligomer
ccgccucccgugaagaagaggaa

SEQ ID NO: 48308 - RNA, 23 nt, Artificial Sequence
  RNA Oligomer
gcuauuuccucuaaugaagaauu

SEQ ID NO: 48309 - RNA, 23 nt, Artificial Sequence
  RNA Oligomer
uugaacagaacugcuauuuccuc

SEQ ID NO: 48310 - RNA, 23 nt, Artificial Sequence
  RNA Oligomer
uuugaacagaacugcuauuuccu

SEQ ID NO: 48311 - RNA, 23 nt, Artificial Sequence
  RNA Oligomer
uuuugaacagaacugcuauuucc

SEQ ID NO: 48312 - RNA, 23 nt, Artificial Sequence
  RNA Oligomer
auuuugaacagaacugcuauuuc

SEQ ID NO: 48313 - RNA, 23 nt, Artificial Sequence
  RNA Oligomer
gauuuugaacagaacugcuauuu

SEQ ID NO: 48314 - RNA, 23 nt, Artificial Sequence
  RNA Oligomer
acacaaccaaugcauuuccugga

SEQ ID NO: 48315 - RNA, 23 nt, Artificial Sequence
  RNA Oligomer
uacacaaccaaugcauuuccugg

SEQ ID NO: 48316 - RNA, 23 nt, Artificial Sequence
  RNA Oligomer
uuacacaaccaaugcauuuccug

SEQ ID NO: 48317 - RNA, 23 nt, Artificial Sequence
  RNA Oligomer
guuacacaaccaaugcauuuccu

SEQ ID NO: 48318 - RNA, 23 nt, Artificial Sequence
  RNA Oligomer
uuucugaccagcuuuugcggaga

SEQ ID NO: 48319 - RNA, 23 nt, Artificial Sequence
  RNA Oligomer
aaugacaagccuucuuaaagccu

SEQ ID NO: 48320 - RNA, 23 nt, Artificial Sequence
  RNA Oligomer
aaaugacaagccuucuuaaagcc

SEQ ID NO: 48321 - RNA, 23 nt, Artificial Sequence
  RNA Oligomer
uaagaguucagacucacauucua

SEQ ID NO: 48322 - RNA, 23 nt, Artificial Sequence
  RNA Oligomer
guaagaguucagacucacauucu

SEQ ID NO: 48323 - RNA, 23 nt, Artificial Sequence
  RNA Oligomer
uguaagaguucagacucacauuc

SEQ ID NO: 48324 - RNA, 23 nt, Artificial Sequence
  RNA Oligomer
auguaagaguucagacucacauu

SEQ ID NO: 48325 - RNA, 23 nt, Artificial Sequence
  RNA Oligomer
aauguaagaguucagacucacau

SEQ ID NO: 48326 - RNA, 23 nt, Artificial Sequence
  RNA Oligomer
cugacucccaucaccuauccgca

SEQ ID NO: 48327 - RNA, 23 nt, Artificial Sequence
  RNA Oligomer
gcugacucccaucaccuauccgc

SEQ ID NO: 48328 - RNA, 23 nt, Artificial Sequence
  RNA Oligomer
agcugacucccaucaccuauccg

SEQ ID NO: 48329 - RNA, 23 nt, Artificial Sequence
  RNA Oligomer
aagcugacucccaucaccuaucc

SEQ ID NO: 48330 - RNA, 23 nt, Artificial Sequence
  RNA Oligomer
gaagcugacucccaucaccuauc

SEQ ID NO: 48331 - RNA, 23 nt, Artificial Sequence
  RNA Oligomer
agaagcugacucccaucaccuau

SEQ ID NO: 48332 - RNA, 23 nt, Artificial Sequence
  RNA Oligomer
uauucugccaauguuaugguaga

SEQ ID NO: 48333 - RNA, 23 nt, Artificial Sequence
  RNA Oligomer
uuauucugccaauguuaugguag

SEQ ID NO: 48334 - RNA, 23 nt, Artificial Sequence
  RNA Oligomer
auuauucugccaauguuauggua

SEQ ID NO: 48335 - RNA, 23 nt, Artificial Sequence
  RNA Oligomer
uucuguuagucgcuaacuuagua

SEQ ID NO: 48336 - RNA, 23 nt, Artificial Sequence
  RNA Oligomer
guucuguuagucgcuaacuuagu

SEQ ID NO: 48337 - RNA, 23 nt, Artificial Sequence
  RNA Oligomer
uguucuguuagucgcuaacuuag

SEQ ID NO: 48338 - RNA, 23 nt, Artificial Sequence
  RNA Oligomer
aauacgaaguggagauuuacacu

SEQ ID NO: 48339 - RNA, 23 nt, Artificial Sequence
  RNA Oligomer
aaauacgaaguggagauuuacac

SEQ ID NO: 48340 - RNA, 23 nt, Artificial Sequence
  RNA Oligomer
ugaacagaacugcuauuuccucu

SEQ ID NO: 48341 - RNA, 23 nt, Artificial Sequence
  RNA Oligomer
cguugccauugaacucaccagug

SEQ ID NO: 48342 - RNA, 23 nt, Artificial Sequence
  RNA Oligomer
ccuucgucuuugagaagacggua

SEQ ID NO: 48343 - RNA, 23 nt, Artificial Sequence
  RNA Oligomer
accuucgucuuugagaagacggu

SEQ ID NO: 48344 - RNA, 23 nt, Artificial Sequence
  RNA Oligomer
gaccuucgucuuugagaagacgg

SEQ ID NO: 48345 - RNA, 23 nt, Artificial Sequence
  RNA Oligomer
agaccuucgucuuugagaagacg

SEQ ID NO: 48346 - RNA, 23 nt, Artificial Sequence
  RNA Oligomer
aagaccuucgucuuugagaagac

SEQ ID NO: 48347 - RNA, 23 nt, Artificial Sequence
  RNA Oligomer
aaagaccuucgucuuugagaaga

SEQ ID NO: 48348 - RNA, 23 nt, Artificial Sequence
  RNA Oligomer
caaagaccuucgucuuugagaag

SEQ ID NO: 48349 - RNA, 23 nt, Artificial Sequence
  RNA Oligomer
gcaaagaccuucgucuuugagaa

SEQ ID NO: 48350 - RNA, 23 nt, Artificial Sequence
  RNA Oligomer
ugcaaagaccuucgucuuugaga

SEQ ID NO: 48351 - RNA, 23 nt, Artificial Sequence
  RNA Oligomer
uugcaaagaccuucgucuuugag

SEQ ID NO: 48352 - RNA, 23 nt, Artificial Sequence
  RNA Oligomer
uuugcaaagaccuucgucuuuga

SEQ ID NO: 48353 - RNA, 23 nt, Artificial Sequence
  RNA Oligomer
cuuugcaaagaccuucgucuuug

SEQ ID NO: 48354 - RNA, 23 nt, Artificial Sequence
  RNA Oligomer
uuaaagccuuauuuuucaaaagc

SEQ ID NO: 48355 - RNA, 23 nt, Artificial Sequence
  RNA Oligomer
ucuagccauggcuaaggagauug

SEQ ID NO: 48356 - RNA, 23 nt, Artificial Sequence
  RNA Oligomer
acacucccaucauccuaguggga

SEQ ID NO: 48357 - RNA, 23 nt, Artificial Sequence
  RNA Oligomer
aacacucccaucauccuaguggg

SEQ ID NO: 48358 - RNA, 23 nt, Artificial Sequence
  RNA Oligomer
uucuuaacaucacugucuugcca

SEQ ID NO: 48359 - RNA, 23 nt, Artificial Sequence
  RNA Oligomer
cuucuuaacaucacugucuugcc

SEQ ID NO: 48360 - RNA, 23 nt, Artificial Sequence
  RNA Oligomer
ccuucuuaacaucacugucuugc

SEQ ID NO: 48361 - RNA, 23 nt, Artificial Sequence
  RNA Oligomer
accuucuuaacaucacugucuug

SEQ ID NO: 48362 - RNA, 23 nt, Artificial Sequence
  RNA Oligomer
aaccuucuuaacaucacugucuu

SEQ ID NO: 48363 - RNA, 23 nt, Artificial Sequence
  RNA Oligomer
aguuacacaaccaaugcauuucc

SEQ ID NO: 48364 - RNA, 23 nt, Artificial Sequence
  RNA Oligomer
cauagcgaguuuucugaccagcu

SEQ ID NO: 48365 - RNA, 23 nt, Artificial Sequence
  RNA Oligomer
gcauuguugugccgagaacaccg

SEQ ID NO: 48366 - RNA, 23 nt, Artificial Sequence
  RNA Oligomer
ugcauuguugugccgagaacacc

SEQ ID NO: 48367 - RNA, 23 nt, Artificial Sequence
  RNA Oligomer
cugcauuguugugccgagaacac

SEQ ID NO: 48368 - RNA, 23 nt, Artificial Sequence
  RNA Oligomer
acugcauuguugugccgagaaca

SEQ ID NO: 48369 - RNA, 23 nt, Artificial Sequence
  RNA Oligomer
cacugcauuguugugccgagaac

SEQ ID NO: 48370 - RNA, 23 nt, Artificial Sequence
  RNA Oligomer
uuggugcuguaaaauaccuggag

SEQ ID NO: 48371 - RNA, 23 nt, Artificial Sequence
  RNA Oligomer
auuggugcuguaaaauaccugga

SEQ ID NO: 48372 - RNA, 23 nt, Artificial Sequence
  RNA Oligomer
gauuggugcuguaaaauaccugg

SEQ ID NO: 48373 - RNA, 23 nt, Artificial Sequence
  RNA Oligomer
agauuggugcuguaaaauaccug

SEQ ID NO: 48374 - RNA, 23 nt, Artificial Sequence
  RNA Oligomer
gagauuggugcuguaaaauaccu

SEQ ID NO: 48375 - RNA, 23 nt, Artificial Sequence
  RNA Oligomer
gaaaauguccgugcaaaguggua

SEQ ID NO: 48376 - RNA, 23 nt, Artificial Sequence
  RNA Oligomer
uguucuuaauuugcuuuucccuu

SEQ ID NO: 48377 - RNA, 23 nt, Artificial Sequence
  RNA Oligomer
guguucuuaauuugcuuuucccu

SEQ ID NO: 48378 - RNA, 23 nt, Artificial Sequence
  RNA Oligomer
ccauaaaaccauuuuuugaacca

SEQ ID NO: 48379 - RNA, 23 nt, Artificial Sequence
  RNA Oligomer
caaauugggcauuuaauucaucu

SEQ ID NO: 48380 - RNA, 23 nt, Artificial Sequence
  RNA Oligomer
gaauucuguuuagcugugggugu

SEQ ID NO: 48381 - RNA, 23 nt, Artificial Sequence
  RNA Oligomer
gucuuugugauuucauagcgagu

SEQ ID NO: 48382 - RNA, 23 nt, Artificial Sequence
  RNA Oligomer
uuccuuucucuuacaccugccau

SEQ ID NO: 48383 - RNA, 23 nt, Artificial Sequence
  RNA Oligomer
cucuaaaagguuaauuucuguca

SEQ ID NO: 48384 - RNA, 23 nt, Artificial Sequence
  RNA Oligomer
ugaaucugggcuuaugggauaca

SEQ ID NO: 48385 - RNA, 23 nt, Artificial Sequence
  RNA Oligomer
acaguugcagaauuguggagugu

SEQ ID NO: 48386 - RNA, 23 nt, Artificial Sequence
  RNA Oligomer
uccuuucucuuacaccugccaug

SEQ ID NO: 48387 - RNA, 23 nt, Artificial Sequence
  RNA Oligomer
acucuaaaagguuaauuucuguc

SEQ ID NO: 48388 - RNA, 23 nt, Artificial Sequence
  RNA Oligomer
ggugaaucugggcuuaugggaua

SEQ ID NO: 48389 - RNA, 23 nt, Artificial Sequence
  RNA Oligomer
guaaacugugcuagugcugacga

SEQ ID NO: 48390 - RNA, 23 nt, Artificial Sequence
  RNA Oligomer
gaaauguuuucuuaagcuuuucc

SEQ ID NO: 48391 - RNA, 23 nt, Artificial Sequence
  RNA Oligomer
uccauaaaaccauuuuuugaacc

SEQ ID NO: 48392 - RNA, 23 nt, Artificial Sequence
  RNA Oligomer
augauaaagacacgaucgagaaa

SEQ ID NO: 48393 - RNA, 23 nt, Artificial Sequence
  RNA Oligomer
acacugcauuguugugccgagaa

SEQ ID NO: 48394 - RNA, 23 nt, Artificial Sequence
  RNA Oligomer
gcauguaugacuuaauaaauccu

SEQ ID NO: 48395 - RNA, 23 nt, Artificial Sequence
  RNA Oligomer
gaaacugaaggagaagaagcuga

SEQ ID NO: 48396 - RNA, 23 nt, Artificial Sequence
  RNA Oligomer
aguuuucuaguaacuagguguaa

SEQ ID NO: 48397 - RNA, 23 nt, Artificial Sequence
  RNA Oligomer
uaguuuucuaguaacuaggugua

SEQ ID NO: 48398 - RNA, 23 nt, Artificial Sequence
  RNA Oligomer
uaaaaaucauguguugcagcuuu

SEQ ID NO: 48399 - RNA, 23 nt, Artificial Sequence
  RNA Oligomer
cuaauaagugcuuuccuuaguuu

SEQ ID NO: 48400 - RNA, 23 nt, Artificial Sequence
  RNA Oligomer
gcaauuagcauuauguuuugcau

SEQ ID NO: 48401 - RNA, 23 nt, Artificial Sequence
  RNA Oligomer
guguuuuuacauugaucuuuugc

SEQ ID NO: 48402 - RNA, 23 nt, Artificial Sequence
  RNA Oligomer
ucaguuacacaaccaaugcauuu

SEQ ID NO: 48403 - RNA, 23 nt, Artificial Sequence
  RNA Oligomer
agauuuacacuacauuguacaag

SEQ ID NO: 48404 - RNA, 23 nt, Artificial Sequence
  RNA Oligomer
cuauuuccucuaaugaagaauuc

SEQ ID NO: 48405 - RNA, 23 nt, Artificial Sequence
  RNA Oligomer
aucauuugaaaauguccgugcaa

SEQ ID NO: 48406 - RNA, 23 nt, Artificial Sequence
  RNA Oligomer
ccagauuaccgacacugucacuu

SEQ ID NO: 48407 - RNA, 23 nt, Artificial Sequence
  RNA Oligomer
uccucuaaugaagaauucuguuu

SEQ ID NO: 48408 - RNA, 23 nt, Artificial Sequence
  RNA Oligomer
gcaguuaggaggugcagacacuu

SEQ ID NO: 48409 - RNA, 23 nt, Artificial Sequence
  RNA Oligomer
agaauacagcgugggacccuuca

SEQ ID NO: 48410 - RNA, 23 nt, Artificial Sequence
  RNA Oligomer
guuaauuucugucaaaugcagua

SEQ ID NO: 48411 - RNA, 23 nt, Artificial Sequence
  RNA Oligomer
guauuuugacaaaauacgaagug

SEQ ID NO: 48412 - RNA, 23 nt, Artificial Sequence
  RNA Oligomer
agauuuugaacagaacugcuauu

SEQ ID NO: 48413 - RNA, 23 nt, Artificial Sequence
  RNA Oligomer
ccauuuccuguuucucugcaguu

SEQ ID NO: 48414 - RNA, 23 nt, Artificial Sequence
  RNA Oligomer
aagaagcugacucccaucaccua

SEQ ID NO: 48415 - RNA, 23 nt, Artificial Sequence
  RNA Oligomer
agauuaccgacacugucacuuga

SEQ ID NO: 48416 - RNA, 23 nt, Artificial Sequence
  RNA Oligomer
agacaguauuuugacaaaauacg

SEQ ID NO: 48417 - RNA, 23 nt, Artificial Sequence
  RNA Oligomer
cucuaaugaagaauucuguuuag

SEQ ID NO: 48418 - RNA, 23 nt, Artificial Sequence
  RNA Oligomer
ccucuaaugaagaauucuguuua

SEQ ID NO: 48419 - RNA, 23 nt, Artificial Sequence
  RNA Oligomer
caauuagcauuauguuuugcaug

SEQ ID NO: 48420 - RNA, 23 nt, Artificial Sequence
  RNA Oligomer
aucaguuacacaaccaaugcauu

SEQ ID NO: 48421 - RNA, 23 nt, Artificial Sequence
  RNA Oligomer
gaaggagaagaagcugacuccca

SEQ ID NO: 48422 - RNA, 23 nt, Artificial Sequence
  RNA Oligomer
cacuugaccaauacugacccucu

SEQ ID NO: 48423 - RNA, 23 nt, Artificial Sequence
  RNA Oligomer
uuccucuaaugaagaauucuguu

SEQ ID NO: 48424 - RNA, 23 nt, Artificial Sequence
  RNA Oligomer
ggaaaaccggugaaucugggcuu

SEQ ID NO: 48425 - RNA, 23 nt, Artificial Sequence
  RNA Oligomer
ucacuugaccaauacugacccuc

SEQ ID NO: 48426 - RNA, 23 nt, Artificial Sequence
  RNA Oligomer
ucuuuaaacugguuguucuguua

SEQ ID NO: 48427 - RNA, 23 nt, Artificial Sequence
  RNA Oligomer
cgucuuugagaagacgguagcuu

SEQ ID NO: 48428 - RNA, 23 nt, Artificial Sequence
  RNA Oligomer
gucacuugaccaauacugacccu

SEQ ID NO: 48429 - RNA, 23 nt, Artificial Sequence
  RNA Oligomer
gucuugccagauuaccgacacug

SEQ ID NO: 48430 - RNA, 23 nt, Artificial Sequence
  RNA Oligomer
uaaaacuugccuacugaucaguu

SEQ ID NO: 48431 - RNA, 23 nt, Artificial Sequence
  RNA Oligomer
gagcuguagguaaaacuugccua

SEQ ID NO: 48432 - RNA, 23 nt, Artificial Sequence
  RNA Oligomer
gcacguguucccgacauaacauu

SEQ ID NO: 48433 - RNA, 23 nt, Artificial Sequence
  RNA Oligomer
guagcuucugcaguuaggaggug

SEQ ID NO: 48434 - RNA, 23 nt, Artificial Sequence
  RNA Oligomer
uggaaaaccggugaaucugggcu

SEQ ID NO: 48435 - RNA, 23 nt, Artificial Sequence
  RNA Oligomer
ugcaauuagcauuauguuuugca

SEQ ID NO: 48436 - RNA, 23 nt, Artificial Sequence
  RNA Oligomer
gccagauuaccgacacugucacu

SEQ ID NO: 48437 - RNA, 23 nt, Artificial Sequence
  RNA Oligomer
gcuguagguaaaacuugccuacu

SEQ ID NO: 48438 - RNA, 23 nt, Artificial Sequence
  RNA Oligomer
agcacguguucccgacauaacau

SEQ ID NO: 48439 - RNA, 23 nt, Artificial Sequence
  RNA Oligomer
ugagaagacgguagcuucugcag

SEQ ID NO: 48440 - RNA, 23 nt, Artificial Sequence
  RNA Oligomer
cuacacugcauuguugugccgag

SEQ ID NO: 48441 - RNA, 23 nt, Artificial Sequence
  RNA Oligomer
agccuucgcacucaaugccaacu

SEQ ID NO: 48442 - RNA, 23 nt, Artificial Sequence
  RNA Oligomer
ggaugauaaagacacgaucgaga

SEQ ID NO: 48443 - RNA, 23 nt, Artificial Sequence
  RNA Oligomer
acauaacauuguacuguaaugga

SEQ ID NO: 48444 - RNA, 23 nt, Artificial Sequence
  RNA Oligomer
acuuugcaaagaccuucgucuuu

SEQ ID NO: 48445 - RNA, 23 nt, Artificial Sequence
  RNA Oligomer
uaacaucacugucuugccagauu

SEQ ID NO: 48446 - RNA, 23 nt, Artificial Sequence
  RNA Oligomer
cugacugagcaauaugccuccuu

SEQ ID NO: 48447 - RNA, 23 nt, Artificial Sequence
  RNA Oligomer
ucgucuuugagaagacgguagcu

SEQ ID NO: 48448 - RNA, 23 nt, Artificial Sequence
  RNA Oligomer
acugagcaauaugccuccuugua

SEQ ID NO: 48449 - RNA, 23 nt, Artificial Sequence
  RNA Oligomer
aaauguaagaguucagacucaca

SEQ ID NO: 48450 - RNA, 23 nt, Artificial Sequence
  RNA Oligomer
gcaucauuugaaaauguccgugc

SEQ ID NO: 48451 - RNA, 23 nt, Artificial Sequence
  RNA Oligomer
guaauggagugagcguagcagcu

SEQ ID NO: 48452 - RNA, 23 nt, Artificial Sequence
  RNA Oligomer
acguguucccgacauaacauugu

SEQ ID NO: 48453 - RNA, 23 nt, Artificial Sequence
  RNA Oligomer
agcuucugcaguuaggaggugca

SEQ ID NO: 48454 - RNA, 23 nt, Artificial Sequence
  RNA Oligomer
gacugagcaauaugccuccuugu

SEQ ID NO: 48455 - RNA, 23 nt, Artificial Sequence
  RNA Oligomer
caguuaggaggugcagacacuug

SEQ ID NO: 48456 - RNA, 23 nt, Artificial Sequence
  RNA Oligomer
cuuuaaacugguuguucuguuag

SEQ ID NO: 48457 - RNA, 23 nt, Artificial Sequence
  RNA Oligomer
uaaagcagaacagccucccgaau

SEQ ID NO: 48458 - RNA, 23 nt, Artificial Sequence
  RNA Oligomer
cacucccaucauccuagugggaa

SEQ ID NO: 48459 - RNA, 23 nt, Artificial Sequence
  RNA Oligomer
ggcuuaugggauacagcuggaca

SEQ ID NO: 48460 - RNA, 23 nt, Artificial Sequence
  RNA Oligomer
ugacugagcaauaugccuccuug

SEQ ID NO: 48461 - RNA, 23 nt, Artificial Sequence
  RNA Oligomer
agcagcacguguucccgacauaa

SEQ ID NO: 48462 - RNA, 23 nt, Artificial Sequence
  RNA Oligomer
guucuugguccugucccuuggaa

SEQ ID NO: 48463 - RNA, 23 nt, Artificial Sequence
  RNA Oligomer
uuagcagcacguguucccgacau

SEQ ID NO: 48464 - RNA, 23 nt, Artificial Sequence
  RNA Oligomer
gagguaaagagggucaguauugg

SEQ ID NO: 48465 - RNA, 23 nt, Artificial Sequence
  RNA Oligomer
agguaaagagggucaguauuggu

SEQ ID NO: 48466 - RNA, 23 nt, Artificial Sequence
  RNA Oligomer
gguaaagagggucaguauugguc

SEQ ID NO: 48467 - RNA, 23 nt, Artificial Sequence
  RNA Oligomer
guaaagagggucaguauugguca

SEQ ID NO: 48468 - RNA, 23 nt, Artificial Sequence
  RNA Oligomer
uaaagagggucaguauuggucaa

SEQ ID NO: 48469 - RNA, 23 nt, Artificial Sequence
  RNA Oligomer
ugaaaaauaaggcuuuaagaagg

SEQ ID NO: 48470 - RNA, 23 nt, Artificial Sequence
  RNA Oligomer
gaaaaauaaggcuuuaagaaggc

SEQ ID NO: 48471 - RNA, 23 nt, Artificial Sequence
  RNA Oligomer
aaaaauaaggcuuuaagaaggcu

SEQ ID NO: 48472 - RNA, 23 nt, Artificial Sequence
  RNA Oligomer
aaaauaaggcuuuaagaaggcuu

SEQ ID NO: 48473 - RNA, 23 nt, Artificial Sequence
  RNA Oligomer
aaauaaggcuuuaagaaggcuug

SEQ ID NO: 48474 - RNA, 23 nt, Artificial Sequence
  RNA Oligomer
gguauuuuacagcaccaaucucc

SEQ ID NO: 48475 - RNA, 23 nt, Artificial Sequence
  RNA Oligomer
guauuuuacagcaccaaucuccu

SEQ ID NO: 48476 - RNA, 23 nt, Artificial Sequence
  RNA Oligomer
uauuuuacagcaccaaucuccuu

SEQ ID NO: 48477 - RNA, 23 nt, Artificial Sequence
  RNA Oligomer
auuuuacagcaccaaucuccuua

SEQ ID NO: 48478 - RNA, 23 nt, Artificial Sequence
  RNA Oligomer
uuuuacagcaccaaucuccuuag

SEQ ID NO: 48479 - RNA, 23 nt, Artificial Sequence
  RNA Oligomer
aucuguuugcggauaggauaggg

SEQ ID NO: 48480 - RNA, 23 nt, Artificial Sequence
  RNA Oligomer
ucuguuugcggauaggauagggg

SEQ ID NO: 48481 - RNA, 23 nt, Artificial Sequence
  RNA Oligomer
cuguuugcggauaggauaggggg

SEQ ID NO: 48482 - RNA, 23 nt, Artificial Sequence
  RNA Oligomer
uguuugcggauaggauagggggc

SEQ ID NO: 48483 - RNA, 23 nt, Artificial Sequence
  RNA Oligomer
guuugcggauaggauagggggcg

SEQ ID NO: 48484 - RNA, 23 nt, Artificial Sequence
  RNA Oligomer
guuuaaagaugaauuaaaugccc

SEQ ID NO: 48485 - RNA, 23 nt, Artificial Sequence
  RNA Oligomer
uuuaaagaugaauuaaaugccca

SEQ ID NO: 48486 - RNA, 23 nt, Artificial Sequence
  RNA Oligomer
uuaaagaugaauuaaaugcccaa

SEQ ID NO: 48487 - RNA, 23 nt, Artificial Sequence
  RNA Oligomer
uaaagaugaauuaaaugcccaau

SEQ ID NO: 48488 - RNA, 23 nt, Artificial Sequence
  RNA Oligomer
aaagaugaauuaaaugcccaauu

SEQ ID NO: 48489 - RNA, 23 nt, Artificial Sequence
  RNA Oligomer
gaguuuuuacccgugacacuuuc

SEQ ID NO: 48490 - RNA, 23 nt, Artificial Sequence
  RNA Oligomer
aguuuuuacccgugacacuuuca

SEQ ID NO: 48491 - RNA, 23 nt, Artificial Sequence
  RNA Oligomer
guuuuuacccgugacacuuucau

SEQ ID NO: 48492 - RNA, 23 nt, Artificial Sequence
  RNA Oligomer
uuuuuacccgugacacuuucauu

SEQ ID NO: 48493 - RNA, 23 nt, Artificial Sequence
  RNA Oligomer
uuuuacccgugacacuuucauuc

SEQ ID NO: 48494 - RNA, 23 nt, Artificial Sequence
  RNA Oligomer
gcaaaagcuggucagaaaacucg

SEQ ID NO: 48495 - RNA, 23 nt, Artificial Sequence
  RNA Oligomer
caaaagcuggucagaaaacucgc

SEQ ID NO: 48496 - RNA, 23 nt, Artificial Sequence
  RNA Oligomer
aaaagcuggucagaaaacucgcu

SEQ ID NO: 48497 - RNA, 23 nt, Artificial Sequence
  RNA Oligomer
aaagcuggucagaaaacucgcua

SEQ ID NO: 48498 - RNA, 23 nt, Artificial Sequence
  RNA Oligomer
aagcuggucagaaaacucgcuau

SEQ ID NO: 48499 - RNA, 23 nt, Artificial Sequence
  RNA Oligomer
aaagaucaauguaaaaacacucc

SEQ ID NO: 48500 - RNA, 23 nt, Artificial Sequence
  RNA Oligomer
aagaucaauguaaaaacacucca

SEQ ID NO: 48501 - RNA, 23 nt, Artificial Sequence
  RNA Oligomer
agaucaauguaaaaacacuccac

SEQ ID NO: 48502 - RNA, 23 nt, Artificial Sequence
  RNA Oligomer
gaucaauguaaaaacacuccaca

SEQ ID NO: 48503 - RNA, 23 nt, Artificial Sequence
  RNA Oligomer
aucaauguaaaaacacuccacaa

SEQ ID NO: 48504 - RNA, 23 nt, Artificial Sequence
  RNA Oligomer
guaaaaacacuccacaauucugc

SEQ ID NO: 48505 - RNA, 23 nt, Artificial Sequence
  RNA Oligomer
uaaaaacacuccacaauucugca

SEQ ID NO: 48506 - RNA, 23 nt, Artificial Sequence
  RNA Oligomer
aaaaacacuccacaauucugcaa

SEQ ID NO: 48507 - RNA, 23 nt, Artificial Sequence
  RNA Oligomer
aaaacacuccacaauucugcaac

SEQ ID NO: 48508 - RNA, 23 nt, Artificial Sequence
  RNA Oligomer
aaacacuccacaauucugcaacu

SEQ ID NO: 48509 - RNA, 23 nt, Artificial Sequence
  RNA Oligomer
cugcaacacaugauuuuuacacc

SEQ ID NO: 48510 - RNA, 23 nt, Artificial Sequence
  RNA Oligomer
ugcaacacaugauuuuuacaccu

SEQ ID NO: 48511 - RNA, 23 nt, Artificial Sequence
  RNA Oligomer
gcaacacaugauuuuuacaccua

SEQ ID NO: 48512 - RNA, 23 nt, Artificial Sequence
  RNA Oligomer
caacacaugauuuuuacaccuag

SEQ ID NO: 48513 - RNA, 23 nt, Artificial Sequence
  RNA Oligomer
aacacaugauuuuuacaccuagu

SEQ ID NO: 48514 - RNA, 23 nt, Artificial Sequence
  RNA Oligomer
uucauuagaggaaauagcaguuc

SEQ ID NO: 48515 - RNA, 23 nt, Artificial Sequence
  RNA Oligomer
ucauuagaggaaauagcaguucu

SEQ ID NO: 48516 - RNA, 23 nt, Artificial Sequence
  RNA Oligomer
cauuagaggaaauagcaguucug

SEQ ID NO: 48517 - RNA, 23 nt, Artificial Sequence
  RNA Oligomer
auuagaggaaauagcaguucugu

SEQ ID NO: 48518 - RNA, 23 nt, Artificial Sequence
  RNA Oligomer
uuagaggaaauagcaguucuguu

SEQ ID NO: 48519 - RNA, 23 nt, Artificial Sequence
  RNA Oligomer
cccuaagaucaaguuuaguuccc

SEQ ID NO: 48520 - RNA, 23 nt, Artificial Sequence
  RNA Oligomer
ccuaagaucaaguuuaguuccca

SEQ ID NO: 48521 - RNA, 23 nt, Artificial Sequence
  RNA Oligomer
cuaagaucaaguuuaguucccac

SEQ ID NO: 48522 - RNA, 23 nt, Artificial Sequence
  RNA Oligomer
uaagaucaaguuuaguucccacu

SEQ ID NO: 48523 - RNA, 23 nt, Artificial Sequence
  RNA Oligomer
aagaucaaguuuaguucccacua

SEQ ID NO: 48524 - RNA, 23 nt, Artificial Sequence
  RNA Oligomer
aaagagggucaguauuggucaag

SEQ ID NO: 48525 - RNA, 23 nt, Artificial Sequence
  RNA Oligomer
uagcucugaauaaaguaacaugg

SEQ ID NO: 48526 - RNA, 23 nt, Artificial Sequence
  RNA Oligomer
agcucugaauaaaguaacaugga

SEQ ID NO: 48527 - RNA, 23 nt, Artificial Sequence
  RNA Oligomer
gcucugaauaaaguaacauggaa

SEQ ID NO: 48528 - RNA, 23 nt, Artificial Sequence
  RNA Oligomer
cucugaauaaaguaacauggaaa

SEQ ID NO: 48529 - RNA, 23 nt, Artificial Sequence
  RNA Oligomer
ucugaauaaaguaacauggaaag

SEQ ID NO: 48530 - RNA, 23 nt, Artificial Sequence
  RNA Oligomer
guacaauguaguguaaaucucca

SEQ ID NO: 48531 - RNA, 23 nt, Artificial Sequence
  RNA Oligomer
uacaauguaguguaaaucuccac

SEQ ID NO: 48532 - RNA, 23 nt, Artificial Sequence
  RNA Oligomer
acaauguaguguaaaucuccacu

SEQ ID NO: 48533 - RNA, 23 nt, Artificial Sequence
  RNA Oligomer
caauguaguguaaaucuccacuu

SEQ ID NO: 48534 - RNA, 23 nt, Artificial Sequence
  RNA Oligomer
aauguaguguaaaucuccacuuc

SEQ ID NO: 48535 - RNA, 23 nt, Artificial Sequence
  RNA Oligomer
auguaguguaaaucuccacuucg

SEQ ID NO: 48536 - RNA, 23 nt, Artificial Sequence
  RNA Oligomer
uauauucuccaggaaaugcauug

SEQ ID NO: 48537 - RNA, 23 nt, Artificial Sequence
  RNA Oligomer
auauucuccaggaaaugcauugg

SEQ ID NO: 48538 - RNA, 23 nt, Artificial Sequence
  RNA Oligomer
uauucuccaggaaaugcauuggu

SEQ ID NO: 48539 - RNA, 23 nt, Artificial Sequence
  RNA Oligomer
auucuccaggaaaugcauugguu

SEQ ID NO: 48540 - RNA, 23 nt, Artificial Sequence
  RNA Oligomer
uucuccaggaaaugcauugguug

SEQ ID NO: 48541 - RNA, 23 nt, Artificial Sequence
  RNA Oligomer
ucagaaaacucgcuaugaaauca

SEQ ID NO: 48542 - RNA, 23 nt, Artificial Sequence
  RNA Oligomer
cagaaaacucgcuaugaaaucac

SEQ ID NO: 48543 - RNA, 23 nt, Artificial Sequence
  RNA Oligomer
agaaaacucgcuaugaaaucaca

SEQ ID NO: 48544 - RNA, 23 nt, Artificial Sequence
  RNA Oligomer
gaaaacucgcuaugaaaucacaa

SEQ ID NO: 48545 - RNA, 23 nt, Artificial Sequence
  RNA Oligomer
aaaacucgcuaugaaaucacaaa

SEQ ID NO: 48546 - RNA, 23 nt, Artificial Sequence
  RNA Oligomer
aaacucgcuaugaaaucacaaag

SEQ ID NO: 48547 - RNA, 23 nt, Artificial Sequence
  RNA Oligomer
ugcuuuacgcaucugagaacuac

SEQ ID NO: 48548 - RNA, 23 nt, Artificial Sequence
  RNA Oligomer
gcuuuacgcaucugagaacuaca

SEQ ID NO: 48549 - RNA, 23 nt, Artificial Sequence
  RNA Oligomer
cuuuacgcaucugagaacuacau

SEQ ID NO: 48550 - RNA, 23 nt, Artificial Sequence
  RNA Oligomer
uuuacgcaucugagaacuacaua

SEQ ID NO: 48551 - RNA, 23 nt, Artificial Sequence
  RNA Oligomer
uuacgcaucugagaacuacauag

SEQ ID NO: 48552 - RNA, 23 nt, Artificial Sequence
  RNA Oligomer
caucuguuugcggauaggauagg

SEQ ID NO: 48553 - RNA, 23 nt, Artificial Sequence
  RNA Oligomer
aaggaacaucaauaggcaaagcg

SEQ ID NO: 48554 - RNA, 23 nt, Artificial Sequence
  RNA Oligomer
aggaacaucaauaggcaaagcga

SEQ ID NO: 48555 - RNA, 23 nt, Artificial Sequence
  RNA Oligomer
ggaacaucaauaggcaaagcgac

SEQ ID NO: 48556 - RNA, 23 nt, Artificial Sequence
  RNA Oligomer
gaacaucaauaggcaaagcgacu

SEQ ID NO: 48557 - RNA, 23 nt, Artificial Sequence
  RNA Oligomer
aacaucaauaggcaaagcgacua

SEQ ID NO: 48558 - RNA, 23 nt, Artificial Sequence
  RNA Oligomer
auggaaagcacuuuuacuaaucg

SEQ ID NO: 48559 - RNA, 23 nt, Artificial Sequence
  RNA Oligomer
uggaaagcacuuuuacuaaucga

SEQ ID NO: 48560 - RNA, 23 nt, Artificial Sequence
  RNA Oligomer
ggaaagcacuuuuacuaaucgac

SEQ ID NO: 48561 - RNA, 23 nt, Artificial Sequence
  RNA Oligomer
gaaagcacuuuuacuaaucgaca

SEQ ID NO: 48562 - RNA, 23 nt, Artificial Sequence
  RNA Oligomer
aaagcacuuuuacuaaucgacaa

SEQ ID NO: 48563 - RNA, 23 nt, Artificial Sequence
  RNA Oligomer
aggcauauugcucagucagaagg

SEQ ID NO: 48564 - RNA, 23 nt, Artificial Sequence
  RNA Oligomer
ggcauauugcucagucagaaggg

SEQ ID NO: 48565 - RNA, 23 nt, Artificial Sequence
  RNA Oligomer
gcauauugcucagucagaagggg

SEQ ID NO: 48566 - RNA, 23 nt, Artificial Sequence
  RNA Oligomer
cauauugcucagucagaaggggu

SEQ ID NO: 48567 - RNA, 23 nt, Artificial Sequence
  RNA Oligomer
auauugcucagucagaagggguu

SEQ ID NO: 48568 - RNA, 23 nt, Artificial Sequence
  RNA Oligomer
uauugcucagucagaagggguuc

SEQ ID NO: 48569 - RNA, 23 nt, Artificial Sequence
  RNA Oligomer
uaaccuuuuagaguuuuuacccg

SEQ ID NO: 48570 - RNA, 23 nt, Artificial Sequence
  RNA Oligomer
aaccuuuuagaguuuuuacccgu

SEQ ID NO: 48571 - RNA, 23 nt, Artificial Sequence
  RNA Oligomer
accuuuuagaguuuuuacccgug

SEQ ID NO: 48572 - RNA, 23 nt, Artificial Sequence
  RNA Oligomer
ccuuuuagaguuuuuacccguga

SEQ ID NO: 48573 - RNA, 23 nt, Artificial Sequence
  RNA Oligomer
cuuuuagaguuuuuacccgugac

SEQ ID NO: 48574 - RNA, 23 nt, Artificial Sequence
  RNA Oligomer
uuuuagaguuuuuacccgugaca

SEQ ID NO: 48575 - RNA, 23 nt, Artificial Sequence
  RNA Oligomer
uaugaaaucacaaagacugaucc

SEQ ID NO: 48576 - RNA, 23 nt, Artificial Sequence
  RNA Oligomer
augaaaucacaaagacugaucca

SEQ ID NO: 48577 - RNA, 23 nt, Artificial Sequence
  RNA Oligomer
ugaaaucacaaagacugauccaa

SEQ ID NO: 48578 - RNA, 23 nt, Artificial Sequence
  RNA Oligomer
gaaaucacaaagacugauccaaa

SEQ ID NO: 48579 - RNA, 23 nt, Artificial Sequence
  RNA Oligomer
aaaucacaaagacugauccaaag

SEQ ID NO: 48580 - RNA, 23 nt, Artificial Sequence
  RNA Oligomer
gacccaaaggaacaucaauaggc

SEQ ID NO: 48581 - RNA, 23 nt, Artificial Sequence
  RNA Oligomer
acccaaaggaacaucaauaggca

SEQ ID NO: 48582 - RNA, 23 nt, Artificial Sequence
  RNA Oligomer
cccaaaggaacaucaauaggcaa

SEQ ID NO: 48583 - RNA, 23 nt, Artificial Sequence
  RNA Oligomer
ccaaaggaacaucaauaggcaaa

SEQ ID NO: 48584 - RNA, 23 nt, Artificial Sequence
  RNA Oligomer
caaaggaacaucaauaggcaaag

SEQ ID NO: 48585 - RNA, 23 nt, Artificial Sequence
  RNA Oligomer
aaaggaacaucaauaggcaaagc

SEQ ID NO: 48586 - RNA, 23 nt, Artificial Sequence
  RNA Oligomer
ugaauaaaguaacauggaaagca

SEQ ID NO: 48587 - RNA, 23 nt, Artificial Sequence
  RNA Oligomer
gaauaaaguaacauggaaagcac

SEQ ID NO: 48588 - RNA, 23 nt, Artificial Sequence
  RNA Oligomer
aauaaaguaacauggaaagcacu

SEQ ID NO: 48589 - RNA, 23 nt, Artificial Sequence
  RNA Oligomer
auaaaguaacauggaaagcacuu

SEQ ID NO: 48590 - RNA, 23 nt, Artificial Sequence
  RNA Oligomer
uaaaguaacauggaaagcacuuu

SEQ ID NO: 48591 - RNA, 23 nt, Artificial Sequence
  RNA Oligomer
uuuagaguuuuuacccgugacac

SEQ ID NO: 48592 - RNA, 23 nt, Artificial Sequence
  RNA Oligomer
uuagaguuuuuacccgugacacu

SEQ ID NO: 48593 - RNA, 23 nt, Artificial Sequence
  RNA Oligomer
uuuacccgugacacuuucauucc

SEQ ID NO: 48594 - RNA, 23 nt, Artificial Sequence
  RNA Oligomer
uguacaauguaguguaaaucucc

SEQ ID NO: 48595 - RNA, 23 nt, Artificial Sequence
  RNA Oligomer
ucggaucgcuucgucaaacacug

SEQ ID NO: 48596 - RNA, 23 nt, Artificial Sequence
  RNA Oligomer
cggaucgcuucgucaaacacugu

SEQ ID NO: 48597 - RNA, 23 nt, Artificial Sequence
  RNA Oligomer
ggaucgcuucgucaaacacuguc

SEQ ID NO: 48598 - RNA, 23 nt, Artificial Sequence
  RNA Oligomer
gaucgcuucgucaaacacugucu

SEQ ID NO: 48599 - RNA, 23 nt, Artificial Sequence
  RNA Oligomer
aucgcuucgucaaacacugucuu

SEQ ID NO: 48600 - RNA, 23 nt, Artificial Sequence
  RNA Oligomer
ucccuaagaucaaguuuaguucc

SEQ ID NO: 48601 - RNA, 23 nt, Artificial Sequence
  RNA Oligomer
gcugcaacacaugauuuuuacac

SEQ ID NO: 48602 - RNA, 23 nt, Artificial Sequence
  RNA Oligomer
aaaguaacauggaaagcacuuuu

SEQ ID NO: 48603 - RNA, 23 nt, Artificial Sequence
  RNA Oligomer
cagguguaagagaaaggaaaagc

SEQ ID NO: 48604 - RNA, 23 nt, Artificial Sequence
  RNA Oligomer
agguguaagagaaaggaaaagcu

SEQ ID NO: 48605 - RNA, 23 nt, Artificial Sequence
  RNA Oligomer
gguguaagagaaaggaaaagcuu

SEQ ID NO: 48606 - RNA, 23 nt, Artificial Sequence
  RNA Oligomer
guguaagagaaaggaaaagcuua

SEQ ID NO: 48607 - RNA, 23 nt, Artificial Sequence
  RNA Oligomer
uguaagagaaaggaaaagcuuaa

SEQ ID NO: 48608 - RNA, 23 nt, Artificial Sequence
  RNA Oligomer
gaaaagcuuaagaaaacauuucc

SEQ ID NO: 48609 - RNA, 23 nt, Artificial Sequence
  RNA Oligomer
aaaagcuuaagaaaacauuuccu

SEQ ID NO: 48610 - RNA, 23 nt, Artificial Sequence
  RNA Oligomer
aaagcuuaagaaaacauuuccug

SEQ ID NO: 48611 - RNA, 23 nt, Artificial Sequence
  RNA Oligomer
aagcuuaagaaaacauuuccuga

SEQ ID NO: 48612 - RNA, 23 nt, Artificial Sequence
  RNA Oligomer
agcuuaagaaaacauuuccugau

SEQ ID NO: 48613 - RNA, 23 nt, Artificial Sequence
  RNA Oligomer
uaccaaccuuucuuucaucaucu

SEQ ID NO: 48614 - RNA, 23 nt, Artificial Sequence
  RNA Oligomer
accaaccuuucuuucaucaucua

SEQ ID NO: 48615 - RNA, 23 nt, Artificial Sequence
  RNA Oligomer
ccaaccuuucuuucaucaucuac

SEQ ID NO: 48616 - RNA, 23 nt, Artificial Sequence
  RNA Oligomer
caaccuuucuuucaucaucuacu

SEQ ID NO: 48617 - RNA, 23 nt, Artificial Sequence
  RNA Oligomer
aaccuuucuuucaucaucuacug

SEQ ID NO: 48618 - RNA, 23 nt, Artificial Sequence
  RNA Oligomer
accuuucuuucaucaucuacugc

SEQ ID NO: 48619 - RNA, 23 nt, Artificial Sequence
  RNA Oligomer
ccuuucuuucaucaucuacugca

SEQ ID NO: 48620 - RNA, 23 nt, Artificial Sequence
  RNA Oligomer
cuuucuuucaucaucuacugcau

SEQ ID NO: 48621 - RNA, 23 nt, Artificial Sequence
  RNA Oligomer
uuucuuucaucaucuacugcauu

SEQ ID NO: 48622 - RNA, 23 nt, Artificial Sequence
  RNA Oligomer
uucuuucaucaucuacugcauuu

SEQ ID NO: 48623 - RNA, 23 nt, Artificial Sequence
  RNA Oligomer
cacuuucauuccuuguacaaugu

SEQ ID NO: 48624 - RNA, 23 nt, Artificial Sequence
  RNA Oligomer
acuuucauuccuuguacaaugua

SEQ ID NO: 48625 - RNA, 23 nt, Artificial Sequence
  RNA Oligomer
cuuucauuccuuguacaauguag

SEQ ID NO: 48626 - RNA, 23 nt, Artificial Sequence
  RNA Oligomer
uuucauuccuuguacaauguagu

SEQ ID NO: 48627 - RNA, 23 nt, Artificial Sequence
  RNA Oligomer
uucauuccuuguacaauguagug

SEQ ID NO: 48628 - RNA, 23 nt, Artificial Sequence
  RNA Oligomer
uuguacaauguaguguaaaucuc

SEQ ID NO: 48629 - RNA, 23 nt, Artificial Sequence
  RNA Oligomer
uagaggaaauagcaguucuguuc

SEQ ID NO: 48630 - RNA, 23 nt, Artificial Sequence
  RNA Oligomer
ucgcuaugaaaucacaaagacug

SEQ ID NO: 48631 - RNA, 23 nt, Artificial Sequence
  RNA Oligomer
cgcuaugaaaucacaaagacuga

SEQ ID NO: 48632 - RNA, 23 nt, Artificial Sequence
  RNA Oligomer
gcuaugaaaucacaaagacugau

SEQ ID NO: 48633 - RNA, 23 nt, Artificial Sequence
  RNA Oligomer
cuaugaaaucacaaagacugauc

SEQ ID NO: 48634 - RNA, 23 nt, Artificial Sequence
  RNA Oligomer
aauuuuaauagaaugugagucug

SEQ ID NO: 48635 - RNA, 23 nt, Artificial Sequence
  RNA Oligomer
auuuuaauagaaugugagucuga

SEQ ID NO: 48636 - RNA, 23 nt, Artificial Sequence
  RNA Oligomer
uuuuaauagaaugugagucugaa

SEQ ID NO: 48637 - RNA, 23 nt, Artificial Sequence
  RNA Oligomer
uuuaauagaaugugagucugaac

SEQ ID NO: 48638 - RNA, 23 nt, Artificial Sequence
  RNA Oligomer
uuaauagaaugugagucugaacu

SEQ ID NO: 48639 - RNA, 23 nt, Artificial Sequence
  RNA Oligomer
cagguauuuuacagcaccaaucu

SEQ ID NO: 48640 - RNA, 23 nt, Artificial Sequence
  RNA Oligomer
agguauuuuacagcaccaaucuc

SEQ ID NO: 48641 - RNA, 23 nt, Artificial Sequence
  RNA Oligomer
uuaaaaaauucuguuguaguggc

SEQ ID NO: 48642 - RNA, 23 nt, Artificial Sequence
  RNA Oligomer
uaaaaaauucuguuguaguggcu

SEQ ID NO: 48643 - RNA, 23 nt, Artificial Sequence
  RNA Oligomer
aaaaaauucuguuguaguggcug

SEQ ID NO: 48644 - RNA, 23 nt, Artificial Sequence
  RNA Oligomer
aaaaauucuguuguaguggcuga

SEQ ID NO: 48645 - RNA, 23 nt, Artificial Sequence
  RNA Oligomer
aaaauucuguuguaguggcugaa

SEQ ID NO: 48646 - RNA, 23 nt, Artificial Sequence
  RNA Oligomer
gcacuagcacaguuuacagaacc

SEQ ID NO: 48647 - RNA, 23 nt, Artificial Sequence
  RNA Oligomer
cacuagcacaguuuacagaaccu

SEQ ID NO: 48648 - RNA, 23 nt, Artificial Sequence
  RNA Oligomer
acuagcacaguuuacagaaccuc

SEQ ID NO: 48649 - RNA, 23 nt, Artificial Sequence
  RNA Oligomer
cuagcacaguuuacagaaccuca

SEQ ID NO: 48650 - RNA, 23 nt, Artificial Sequence
  RNA Oligomer
uagcacaguuuacagaaccucac

SEQ ID NO: 48651 - RNA, 23 nt, Artificial Sequence
  RNA Oligomer
aguuuacagaaccucacagaccc

SEQ ID NO: 48652 - RNA, 23 nt, Artificial Sequence
  RNA Oligomer
guuuacagaaccucacagaccca

SEQ ID NO: 48653 - RNA, 23 nt, Artificial Sequence
  RNA Oligomer
uuuacagaaccucacagacccaa

SEQ ID NO: 48654 - RNA, 23 nt, Artificial Sequence
  RNA Oligomer
uuacagaaccucacagacccaaa

SEQ ID NO: 48655 - RNA, 23 nt, Artificial Sequence
  RNA Oligomer
uacagaaccucacagacccaaag

SEQ ID NO: 48656 - RNA, 23 nt, Artificial Sequence
  RNA Oligomer
acaugauuuuuacaccuaguuac

SEQ ID NO: 48657 - RNA, 23 nt, Artificial Sequence
  RNA Oligomer
caugauuuuuacaccuaguuacu

SEQ ID NO: 48658 - RNA, 23 nt, Artificial Sequence
  RNA Oligomer
augauuuuuacaccuaguuacua

SEQ ID NO: 48659 - RNA, 23 nt, Artificial Sequence
  RNA Oligomer
ugauuuuuacaccuaguuacuag

SEQ ID NO: 48660 - RNA, 23 nt, Artificial Sequence
  RNA Oligomer
gauuuuuacaccuaguuacuaga

SEQ ID NO: 48661 - RNA, 23 nt, Artificial Sequence
  RNA Oligomer
cugaauaaaguaacauggaaagc

SEQ ID NO: 48662 - RNA, 23 nt, Artificial Sequence
  RNA Oligomer
aagaugaauuaaaugcccaauuu

SEQ ID NO: 48663 - RNA, 23 nt, Artificial Sequence
  RNA Oligomer
agaaaacauuuccugauaauacc

SEQ ID NO: 48664 - RNA, 23 nt, Artificial Sequence
  RNA Oligomer
gaaaacauuuccugauaauacca

SEQ ID NO: 48665 - RNA, 23 nt, Artificial Sequence
  RNA Oligomer
aaaacauuuccugauaauaccaa

SEQ ID NO: 48666 - RNA, 23 nt, Artificial Sequence
  RNA Oligomer
aaacauuuccugauaauaccaac

SEQ ID NO: 48667 - RNA, 23 nt, Artificial Sequence
  RNA Oligomer
aacauuuccugauaauaccaacc

SEQ ID NO: 48668 - RNA, 23 nt, Artificial Sequence
  RNA Oligomer
acauuuccugauaauaccaaccu

SEQ ID NO: 48669 - RNA, 23 nt, Artificial Sequence
  RNA Oligomer
cauuuccugauaauaccaaccuu

SEQ ID NO: 48670 - RNA, 23 nt, Artificial Sequence
  RNA Oligomer
auuuccugauaauaccaaccuuu

SEQ ID NO: 48671 - RNA, 23 nt, Artificial Sequence
  RNA Oligomer
uuuccugauaauaccaaccuuuc

SEQ ID NO: 48672 - RNA, 23 nt, Artificial Sequence
  RNA Oligomer
uuccugauaauaccaaccuuucu

SEQ ID NO: 48673 - RNA, 23 nt, Artificial Sequence
  RNA Oligomer
cgugacacuuucauuccuuguac

SEQ ID NO: 48674 - RNA, 23 nt, Artificial Sequence
  RNA Oligomer
gugacacuuucauuccuuguaca

SEQ ID NO: 48675 - RNA, 23 nt, Artificial Sequence
  RNA Oligomer
ugacacuuucauuccuuguacaa

SEQ ID NO: 48676 - RNA, 23 nt, Artificial Sequence
  RNA Oligomer
gacacuuucauuccuuguacaau

SEQ ID NO: 48677 - RNA, 23 nt, Artificial Sequence
  RNA Oligomer
acacuuucauuccuuguacaaug

SEQ ID NO: 48678 - RNA, 23 nt, Artificial Sequence
  RNA Oligomer
guaaaucuccacuucguauuuug

SEQ ID NO: 48679 - RNA, 23 nt, Artificial Sequence
  RNA Oligomer
uaaaucuccacuucguauuuugu

SEQ ID NO: 48680 - RNA, 23 nt, Artificial Sequence
  RNA Oligomer
aaaucuccacuucguauuuuguc

SEQ ID NO: 48681 - RNA, 23 nt, Artificial Sequence
  RNA Oligomer
aaucuccacuucguauuuuguca

SEQ ID NO: 48682 - RNA, 23 nt, Artificial Sequence
  RNA Oligomer
aucuccacuucguauuuugucaa

SEQ ID NO: 48683 - RNA, 23 nt, Artificial Sequence
  RNA Oligomer
cuucauuagaggaaauagcaguu

SEQ ID NO: 48684 - RNA, 23 nt, Artificial Sequence
  RNA Oligomer
uacgcaucugagaacuacauagg

SEQ ID NO: 48685 - RNA, 23 nt, Artificial Sequence
  RNA Oligomer
acgcaucugagaacuacauagga

SEQ ID NO: 48686 - RNA, 23 nt, Artificial Sequence
  RNA Oligomer
cgcaucugagaacuacauaggag

SEQ ID NO: 48687 - RNA, 23 nt, Artificial Sequence
  RNA Oligomer
gcaucugagaacuacauaggaga

SEQ ID NO: 48688 - RNA, 23 nt, Artificial Sequence
  RNA Oligomer
caucugagaacuacauaggagag

SEQ ID NO: 48689 - RNA, 23 nt, Artificial Sequence
  RNA Oligomer
agguauuuuggcaacucuuaauc

SEQ ID NO: 48690 - RNA, 23 nt, Artificial Sequence
  RNA Oligomer
gguauuuuggcaacucuuaaucu

SEQ ID NO: 48691 - RNA, 23 nt, Artificial Sequence
  RNA Oligomer
guauuuuggcaacucuuaaucug

SEQ ID NO: 48692 - RNA, 23 nt, Artificial Sequence
  RNA Oligomer
uauuuuggcaacucuuaaucuga

SEQ ID NO: 48693 - RNA, 23 nt, Artificial Sequence
  RNA Oligomer
auuuuggcaacucuuaaucugaa

SEQ ID NO: 48694 - RNA, 23 nt, Artificial Sequence
  RNA Oligomer
ggacauuuucaaaugaugcagga

SEQ ID NO: 48695 - RNA, 23 nt, Artificial Sequence
  RNA Oligomer
gacauuuucaaaugaugcaggac

SEQ ID NO: 48696 - RNA, 23 nt, Artificial Sequence
  RNA Oligomer
acauuuucaaaugaugcaggacu

SEQ ID NO: 48697 - RNA, 23 nt, Artificial Sequence
  RNA Oligomer
cauuuucaaaugaugcaggacuc

SEQ ID NO: 48698 - RNA, 23 nt, Artificial Sequence
  RNA Oligomer
auuuucaaaugaugcaggacuca

SEQ ID NO: 48699 - RNA, 23 nt, Artificial Sequence
  RNA Oligomer
acucacaagggaaaagcaaauua

SEQ ID NO: 48700 - RNA, 23 nt, Artificial Sequence
  RNA Oligomer
cucacaagggaaaagcaaauuaa

SEQ ID NO: 48701 - RNA, 23 nt, Artificial Sequence
  RNA Oligomer
ucacaagggaaaagcaaauuaag

SEQ ID NO: 48702 - RNA, 23 nt, Artificial Sequence
  RNA Oligomer
cacaagggaaaagcaaauuaaga

SEQ ID NO: 48703 - RNA, 23 nt, Artificial Sequence
  RNA Oligomer
acaagggaaaagcaaauuaagaa

SEQ ID NO: 48704 - RNA, 23 nt, Artificial Sequence
  RNA Oligomer
cguaaucugucauaaucuucuug

SEQ ID NO: 48705 - RNA, 23 nt, Artificial Sequence
  RNA Oligomer
guaaucugucauaaucuucuugu

SEQ ID NO: 48706 - RNA, 23 nt, Artificial Sequence
  RNA Oligomer
uaaucugucauaaucuucuuguc

SEQ ID NO: 48707 - RNA, 23 nt, Artificial Sequence
  RNA Oligomer
aaucugucauaaucuucuugucc

SEQ ID NO: 48708 - RNA, 23 nt, Artificial Sequence
  RNA Oligomer
aucugucauaaucuucuugucca

SEQ ID NO: 48709 - RNA, 23 nt, Artificial Sequence
  RNA Oligomer
ucccauaagcccagauucaccgg

SEQ ID NO: 48710 - RNA, 23 nt, Artificial Sequence
  RNA Oligomer
cccauaagcccagauucaccggu

SEQ ID NO: 48711 - RNA, 23 nt, Artificial Sequence
  RNA Oligomer
ccauaagcccagauucaccgguu

SEQ ID NO: 48712 - RNA, 23 nt, Artificial Sequence
  RNA Oligomer
cauaagcccagauucaccgguuu

SEQ ID NO: 48713 - RNA, 23 nt, Artificial Sequence
  RNA Oligomer
auaagcccagauucaccgguuuu

SEQ ID NO: 48714 - RNA, 23 nt, Artificial Sequence
  RNA Oligomer
aauguaaaaacacuccacaauuc

SEQ ID NO: 48715 - RNA, 23 nt, Artificial Sequence
  RNA Oligomer
auguaaaaacacuccacaauucu

SEQ ID NO: 48716 - RNA, 23 nt, Artificial Sequence
  RNA Oligomer
uguaaaaacacuccacaauucug

SEQ ID NO: 48717 - RNA, 23 nt, Artificial Sequence
  RNA Oligomer
uuuaaaaaauucuguuguagugg

SEQ ID NO: 48718 - RNA, 23 nt, Artificial Sequence
  RNA Oligomer
uaaguuguacagaacaucgucag

SEQ ID NO: 48719 - RNA, 23 nt, Artificial Sequence
  RNA Oligomer
aaguuguacagaacaucgucagc

SEQ ID NO: 48720 - RNA, 23 nt, Artificial Sequence
  RNA Oligomer
aguuguacagaacaucgucagca

SEQ ID NO: 48721 - RNA, 23 nt, Artificial Sequence
  RNA Oligomer
guuguacagaacaucgucagcac

SEQ ID NO: 48722 - RNA, 23 nt, Artificial Sequence
  RNA Oligomer
uuguacagaacaucgucagcacu

SEQ ID NO: 48723 - RNA, 23 nt, Artificial Sequence
  RNA Oligomer
acacaugauuuuuacaccuaguu

SEQ ID NO: 48724 - RNA, 23 nt, Artificial Sequence
  RNA Oligomer
cacaugauuuuuacaccuaguua

SEQ ID NO: 48725 - RNA, 23 nt, Artificial Sequence
  RNA Oligomer
uuacuagaaaacuaaggaaagca

SEQ ID NO: 48726 - RNA, 23 nt, Artificial Sequence
  RNA Oligomer
uacuagaaaacuaaggaaagcac

SEQ ID NO: 48727 - RNA, 23 nt, Artificial Sequence
  RNA Oligomer
acuagaaaacuaaggaaagcacu

SEQ ID NO: 48728 - RNA, 23 nt, Artificial Sequence
  RNA Oligomer
cuagaaaacuaaggaaagcacuu

SEQ ID NO: 48729 - RNA, 23 nt, Artificial Sequence
  RNA Oligomer
uagaaaacuaaggaaagcacuua

SEQ ID NO: 48730 - RNA, 23 nt, Artificial Sequence
  RNA Oligomer
aacuaaggaaagcacuuauuagc

SEQ ID NO: 48731 - RNA, 23 nt, Artificial Sequence
  RNA Oligomer
acuaaggaaagcacuuauuagcu

SEQ ID NO: 48732 - RNA, 23 nt, Artificial Sequence
  RNA Oligomer
cuaaggaaagcacuuauuagcuc

SEQ ID NO: 48733 - RNA, 23 nt, Artificial Sequence
  RNA Oligomer
uaaggaaagcacuuauuagcucu

SEQ ID NO: 48734 - RNA, 23 nt, Artificial Sequence
  RNA Oligomer
aaggaaagcacuuauuagcucug

SEQ ID NO: 48735 - RNA, 23 nt, Artificial Sequence
  RNA Oligomer
uaacauggaaagcacuuuuacua

SEQ ID NO: 48736 - RNA, 23 nt, Artificial Sequence
  RNA Oligomer
aacauggaaagcacuuuuacuaa

SEQ ID NO: 48737 - RNA, 23 nt, Artificial Sequence
  RNA Oligomer
acauggaaagcacuuuuacuaau

SEQ ID NO: 48738 - RNA, 23 nt, Artificial Sequence
  RNA Oligomer
cauggaaagcacuuuuacuaauc

SEQ ID NO: 48739 - RNA, 23 nt, Artificial Sequence
  RNA Oligomer
aagaaaagcacuuacuaaguuag

SEQ ID NO: 48740 - RNA, 23 nt, Artificial Sequence
  RNA Oligomer
agaaaagcacuuacuaaguuagc

SEQ ID NO: 48741 - RNA, 23 nt, Artificial Sequence
  RNA Oligomer
gaaaagcacuuacuaaguuagcg

SEQ ID NO: 48742 - RNA, 23 nt, Artificial Sequence
  RNA Oligomer
aaaagcacuuacuaaguuagcga

SEQ ID NO: 48743 - RNA, 23 nt, Artificial Sequence
  RNA Oligomer
aaagcacuuacuaaguuagcgac

SEQ ID NO: 48744 - RNA, 23 nt, Artificial Sequence
  RNA Oligomer
guaagagaaaggaaaagcuuaag

SEQ ID NO: 48745 - RNA, 23 nt, Artificial Sequence
  RNA Oligomer
cugauaauaccaaccuuucuuuc

SEQ ID NO: 48746 - RNA, 23 nt, Artificial Sequence
  RNA Oligomer
ugauaauaccaaccuuucuuuca

SEQ ID NO: 48747 - RNA, 23 nt, Artificial Sequence
  RNA Oligomer
gauaauaccaaccuuucuuucau

SEQ ID NO: 48748 - RNA, 23 nt, Artificial Sequence
  RNA Oligomer
auaauaccaaccuuucuuucauc

SEQ ID NO: 48749 - RNA, 23 nt, Artificial Sequence
  RNA Oligomer
uaauaccaaccuuucuuucauca

SEQ ID NO: 48750 - RNA, 23 nt, Artificial Sequence
  RNA Oligomer
uuucaucaucuacugcauuugac

SEQ ID NO: 48751 - RNA, 23 nt, Artificial Sequence
  RNA Oligomer
uucaucaucuacugcauuugaca

SEQ ID NO: 48752 - RNA, 23 nt, Artificial Sequence
  RNA Oligomer
ucaucaucuacugcauuugacag

SEQ ID NO: 48753 - RNA, 23 nt, Artificial Sequence
  RNA Oligomer
caucaucuacugcauuugacaga

SEQ ID NO: 48754 - RNA, 23 nt, Artificial Sequence
  RNA Oligomer
aucaucuacugcauuugacagaa

SEQ ID NO: 48755 - RNA, 23 nt, Artificial Sequence
  RNA Oligomer
uagaguuuuuacccgugacacuu

SEQ ID NO: 48756 - RNA, 23 nt, Artificial Sequence
  RNA Oligomer
caaaauacugucuuuguccuuug

SEQ ID NO: 48757 - RNA, 23 nt, Artificial Sequence
  RNA Oligomer
aaaauacugucuuuguccuuuga

SEQ ID NO: 48758 - RNA, 23 nt, Artificial Sequence
  RNA Oligomer
aaauacugucuuuguccuuugau

SEQ ID NO: 48759 - RNA, 23 nt, Artificial Sequence
  RNA Oligomer
aauacugucuuuguccuuugauc

SEQ ID NO: 48760 - RNA, 23 nt, Artificial Sequence
  RNA Oligomer
auacugucuuuguccuuugauca

SEQ ID NO: 48761 - RNA, 23 nt, Artificial Sequence
  RNA Oligomer
auucuucauuagaggaaauagca

SEQ ID NO: 48762 - RNA, 23 nt, Artificial Sequence
  RNA Oligomer
uucuucauuagaggaaauagcag

SEQ ID NO: 48763 - RNA, 23 nt, Artificial Sequence
  RNA Oligomer
ucuucauuagaggaaauagcagu

SEQ ID NO: 48764 - RNA, 23 nt, Artificial Sequence
  RNA Oligomer
uugcaaaguucagugcucggugu

SEQ ID NO: 48765 - RNA, 23 nt, Artificial Sequence
  RNA Oligomer
ugcaaaguucagugcucgguguu

SEQ ID NO: 48766 - RNA, 23 nt, Artificial Sequence
  RNA Oligomer
gcaaaguucagugcucgguguuc

SEQ ID NO: 48767 - RNA, 23 nt, Artificial Sequence
  RNA Oligomer
caaaguucagugcucgguguucu

SEQ ID NO: 48768 - RNA, 23 nt, Artificial Sequence
  RNA Oligomer
aaaguucagugcucgguguucuc

SEQ ID NO: 48769 - RNA, 23 nt, Artificial Sequence
  RNA Oligomer
aacaaugcaguguaguucagaag

SEQ ID NO: 48770 - RNA, 23 nt, Artificial Sequence
  RNA Oligomer
acaaugcaguguaguucagaagg

SEQ ID NO: 48771 - RNA, 23 nt, Artificial Sequence
  RNA Oligomer
caaugcaguguaguucagaaggu

SEQ ID NO: 48772 - RNA, 23 nt, Artificial Sequence
  RNA Oligomer
aaugcaguguaguucagaaggua

SEQ ID NO: 48773 - RNA, 23 nt, Artificial Sequence
  RNA Oligomer
augcaguguaguucagaagguau

SEQ ID NO: 48774 - RNA, 23 nt, Artificial Sequence
  RNA Oligomer
uacugauugguucaaaaaauggu

SEQ ID NO: 48775 - RNA, 23 nt, Artificial Sequence
  RNA Oligomer
acugauugguucaaaaaaugguu

SEQ ID NO: 48776 - RNA, 23 nt, Artificial Sequence
  RNA Oligomer
cugauugguucaaaaaaugguuu

SEQ ID NO: 48777 - RNA, 23 nt, Artificial Sequence
  RNA Oligomer
ugauugguucaaaaaaugguuuu

SEQ ID NO: 48778 - RNA, 23 nt, Artificial Sequence
  RNA Oligomer
gauugguucaaaaaaugguuuua

SEQ ID NO: 48779 - RNA, 23 nt, Artificial Sequence
  RNA Oligomer
uuucucuuccucuucuucacggg

SEQ ID NO: 48780 - RNA, 23 nt, Artificial Sequence
  RNA Oligomer
uucucuuccucuucuucacggga

SEQ ID NO: 48781 - RNA, 23 nt, Artificial Sequence
  RNA Oligomer
ucucuuccucuucuucacgggag

SEQ ID NO: 48782 - RNA, 23 nt, Artificial Sequence
  RNA Oligomer
cucuuccucuucuucacgggagg

SEQ ID NO: 48783 - RNA, 23 nt, Artificial Sequence
  RNA Oligomer
ucuuccucuucuucacgggaggc

SEQ ID NO: 48784 - RNA, 23 nt, Artificial Sequence
  RNA Oligomer
ucgcuucgucaaacacugucuug

SEQ ID NO: 48785 - RNA, 23 nt, Artificial Sequence
  RNA Oligomer
cgcuucgucaaacacugucuuga

SEQ ID NO: 48786 - RNA, 23 nt, Artificial Sequence
  RNA Oligomer
gcuucgucaaacacugucuugag

SEQ ID NO: 48787 - RNA, 23 nt, Artificial Sequence
  RNA Oligomer
uuuacagcaccaaucuccuuagc

SEQ ID NO: 48788 - RNA, 23 nt, Artificial Sequence
  RNA Oligomer
cucgaucgugucuuuaucauccc

SEQ ID NO: 48789 - RNA, 23 nt, Artificial Sequence
  RNA Oligomer
ucgaucgugucuuuaucaucccu

SEQ ID NO: 48790 - RNA, 23 nt, Artificial Sequence
  RNA Oligomer
cgaucgugucuuuaucaucccua

SEQ ID NO: 48791 - RNA, 23 nt, Artificial Sequence
  RNA Oligomer
gaucgugucuuuaucaucccuaa

SEQ ID NO: 48792 - RNA, 23 nt, Artificial Sequence
  RNA Oligomer
aucgugucuuuaucaucccuaag

SEQ ID NO: 48793 - RNA, 23 nt, Artificial Sequence
  RNA Oligomer
agaucaaguuuaguucccacuag

SEQ ID NO: 48794 - RNA, 23 nt, Artificial Sequence
  RNA Oligomer
gaucaaguuuaguucccacuagg

SEQ ID NO: 48795 - RNA, 23 nt, Artificial Sequence
  RNA Oligomer
aucaaguuuaguucccacuagga

SEQ ID NO: 48796 - RNA, 23 nt, Artificial Sequence
  RNA Oligomer
accucaggauaccacuuugcacg

SEQ ID NO: 48797 - RNA, 23 nt, Artificial Sequence
  RNA Oligomer
ccucaggauaccacuuugcacgg

SEQ ID NO: 48798 - RNA, 23 nt, Artificial Sequence
  RNA Oligomer
cucaggauaccacuuugcacgga

SEQ ID NO: 48799 - RNA, 23 nt, Artificial Sequence
  RNA Oligomer
ucaggauaccacuuugcacggac

SEQ ID NO: 48800 - RNA, 23 nt, Artificial Sequence
  RNA Oligomer
caggauaccacuuugcacggaca

SEQ ID NO: 48801 - RNA, 23 nt, Artificial Sequence
  RNA Oligomer
ccacuuugcacggacauuuucaa

SEQ ID NO: 48802 - RNA, 23 nt, Artificial Sequence
  RNA Oligomer
cacuuugcacggacauuuucaaa

SEQ ID NO: 48803 - RNA, 23 nt, Artificial Sequence
  RNA Oligomer
acuuugcacggacauuuucaaau

SEQ ID NO: 48804 - RNA, 23 nt, Artificial Sequence
  RNA Oligomer
cuuugcacggacauuuucaaaug

SEQ ID NO: 48805 - RNA, 23 nt, Artificial Sequence
  RNA Oligomer
uuugcacggacauuuucaaauga

SEQ ID NO: 48806 - RNA, 23 nt, Artificial Sequence
  RNA Oligomer
cacccaaagcugaggaaaacugc

SEQ ID NO: 48807 - RNA, 23 nt, Artificial Sequence
  RNA Oligomer
acccaaagcugaggaaaacugca

SEQ ID NO: 48808 - RNA, 23 nt, Artificial Sequence
  RNA Oligomer
cccaaagcugaggaaaacugcag

SEQ ID NO: 48809 - RNA, 23 nt, Artificial Sequence
  RNA Oligomer
ccaaagcugaggaaaacugcaga

SEQ ID NO: 48810 - RNA, 23 nt, Artificial Sequence
  RNA Oligomer
caaagcugaggaaaacugcagag

SEQ ID NO: 48811 - RNA, 23 nt, Artificial Sequence
  RNA Oligomer
aucccauaagcccagauucaccg

SEQ ID NO: 48812 - RNA, 23 nt, Artificial Sequence
  RNA Oligomer
uaagcccagauucaccgguuuuc

SEQ ID NO: 48813 - RNA, 23 nt, Artificial Sequence
  RNA Oligomer
uguacagaacaucgucagcacua

SEQ ID NO: 48814 - RNA, 23 nt, Artificial Sequence
  RNA Oligomer
guacagaacaucgucagcacuag

SEQ ID NO: 48815 - RNA, 23 nt, Artificial Sequence
  RNA Oligomer
uacagaacaucgucagcacuagc

SEQ ID NO: 48816 - RNA, 23 nt, Artificial Sequence
  RNA Oligomer
uuggcagaauaauugucaaagac

SEQ ID NO: 48817 - RNA, 23 nt, Artificial Sequence
  RNA Oligomer
uggcagaauaauugucaaagaca

SEQ ID NO: 48818 - RNA, 23 nt, Artificial Sequence
  RNA Oligomer
ggcagaauaauugucaaagacag

SEQ ID NO: 48819 - RNA, 23 nt, Artificial Sequence
  RNA Oligomer
gcagaauaauugucaaagacagu

SEQ ID NO: 48820 - RNA, 23 nt, Artificial Sequence
  RNA Oligomer
cagaauaauugucaaagacagua

SEQ ID NO: 48821 - RNA, 23 nt, Artificial Sequence
  RNA Oligomer
accuaguuacuagaaaacuaagg

SEQ ID NO: 48822 - RNA, 23 nt, Artificial Sequence
  RNA Oligomer
ccuaguuacuagaaaacuaagga

SEQ ID NO: 48823 - RNA, 23 nt, Artificial Sequence
  RNA Oligomer
cuaguuacuagaaaacuaaggaa

SEQ ID NO: 48824 - RNA, 23 nt, Artificial Sequence
  RNA Oligomer
uaguuacuagaaaacuaaggaaa

SEQ ID NO: 48825 - RNA, 23 nt, Artificial Sequence
  RNA Oligomer
aguuacuagaaaacuaaggaaag

SEQ ID NO: 48826 - RNA, 23 nt, Artificial Sequence
  RNA Oligomer
uuauuagcucugaauaaaguaac

SEQ ID NO: 48827 - RNA, 23 nt, Artificial Sequence
  RNA Oligomer
uauuagcucugaauaaaguaaca

SEQ ID NO: 48828 - RNA, 23 nt, Artificial Sequence
  RNA Oligomer
auuagcucugaauaaaguaacau

SEQ ID NO: 48829 - RNA, 23 nt, Artificial Sequence
  RNA Oligomer
uuagcucugaauaaaguaacaug

SEQ ID NO: 48830 - RNA, 23 nt, Artificial Sequence
  RNA Oligomer
aagcacuuuuacuaaucgacaaa

SEQ ID NO: 48831 - RNA, 23 nt, Artificial Sequence
  RNA Oligomer
uuauaauacaaggaggcauauug

SEQ ID NO: 48832 - RNA, 23 nt, Artificial Sequence
  RNA Oligomer
uauaauacaaggaggcauauugc

SEQ ID NO: 48833 - RNA, 23 nt, Artificial Sequence
  RNA Oligomer
auaauacaaggaggcauauugcu

SEQ ID NO: 48834 - RNA, 23 nt, Artificial Sequence
  RNA Oligomer
uaauacaaggaggcauauugcuc

SEQ ID NO: 48835 - RNA, 23 nt, Artificial Sequence
  RNA Oligomer
aauacaaggaggcauauugcuca

SEQ ID NO: 48836 - RNA, 23 nt, Artificial Sequence
  RNA Oligomer
auacaaggaggcauauugcucag

SEQ ID NO: 48837 - RNA, 23 nt, Artificial Sequence
  RNA Oligomer
cuauaagaaaagcacuuacuaag

SEQ ID NO: 48838 - RNA, 23 nt, Artificial Sequence
  RNA Oligomer
uauaagaaaagcacuuacuaagu

SEQ ID NO: 48839 - RNA, 23 nt, Artificial Sequence
  RNA Oligomer
auaagaaaagcacuuacuaaguu

SEQ ID NO: 48840 - RNA, 23 nt, Artificial Sequence
  RNA Oligomer
uaagaaaagcacuuacuaaguua

SEQ ID NO: 48841 - RNA, 23 nt, Artificial Sequence
  RNA Oligomer
aauaccaaccuuucuuucaucau

SEQ ID NO: 48842 - RNA, 23 nt, Artificial Sequence
  RNA Oligomer
ucuuucaucaucuacugcauuug

SEQ ID NO: 48843 - RNA, 23 nt, Artificial Sequence
  RNA Oligomer
auuaaccuuuuagaguuuuuacc

SEQ ID NO: 48844 - RNA, 23 nt, Artificial Sequence
  RNA Oligomer
uuaaccuuuuagaguuuuuaccc

SEQ ID NO: 48845 - RNA, 23 nt, Artificial Sequence
  RNA Oligomer
gcaguucuguucaaaaucuccgc

SEQ ID NO: 48846 - RNA, 23 nt, Artificial Sequence
  RNA Oligomer
caguucuguucaaaaucuccgca

SEQ ID NO: 48847 - RNA, 23 nt, Artificial Sequence
  RNA Oligomer
aguucuguucaaaaucuccgcaa

SEQ ID NO: 48848 - RNA, 23 nt, Artificial Sequence
  RNA Oligomer
guucuguucaaaaucuccgcaaa

SEQ ID NO: 48849 - RNA, 23 nt, Artificial Sequence
  RNA Oligomer
uucuguucaaaaucuccgcaaaa

SEQ ID NO: 48850 - RNA, 23 nt, Artificial Sequence
  RNA Oligomer
aacucgcuaugaaaucacaaaga

SEQ ID NO: 48851 - RNA, 23 nt, Artificial Sequence
  RNA Oligomer
aucugagaacuacauaggagagc

SEQ ID NO: 48852 - RNA, 23 nt, Artificial Sequence
  RNA Oligomer
ucugagaacuacauaggagagca

SEQ ID NO: 48853 - RNA, 23 nt, Artificial Sequence
  RNA Oligomer
acugcagagaaacaggaaauggc

SEQ ID NO: 48854 - RNA, 23 nt, Artificial Sequence
  RNA Oligomer
cugcagagaaacaggaaauggcc

SEQ ID NO: 48855 - RNA, 23 nt, Artificial Sequence
  RNA Oligomer
ugcagagaaacaggaaauggccg

SEQ ID NO: 48856 - RNA, 23 nt, Artificial Sequence
  RNA Oligomer
gcagagaaacaggaaauggccgc

SEQ ID NO: 48857 - RNA, 23 nt, Artificial Sequence
  RNA Oligomer
cagagaaacaggaaauggccgcu

SEQ ID NO: 48858 - RNA, 23 nt, Artificial Sequence
  RNA Oligomer
gcuuuaagaaggcuugucauuuu

SEQ ID NO: 48859 - RNA, 23 nt, Artificial Sequence
  RNA Oligomer
cuuuaagaaggcuugucauuuua

SEQ ID NO: 48860 - RNA, 23 nt, Artificial Sequence
  RNA Oligomer
uuuaagaaggcuugucauuuuag

SEQ ID NO: 48861 - RNA, 23 nt, Artificial Sequence
  RNA Oligomer
uuaagaaggcuugucauuuuagg

SEQ ID NO: 48862 - RNA, 23 nt, Artificial Sequence
  RNA Oligomer
uaagaaggcuugucauuuuaggg

SEQ ID NO: 48863 - RNA, 23 nt, Artificial Sequence
  RNA Oligomer
aaaaccuuaaaauuacugauugg

SEQ ID NO: 48864 - RNA, 23 nt, Artificial Sequence
  RNA Oligomer
aaaccuuaaaauuacugauuggu

SEQ ID NO: 48865 - RNA, 23 nt, Artificial Sequence
  RNA Oligomer
aaccuuaaaauuacugauugguu

SEQ ID NO: 48866 - RNA, 23 nt, Artificial Sequence
  RNA Oligomer
accuuaaaauuacugauugguuc

SEQ ID NO: 48867 - RNA, 23 nt, Artificial Sequence
  RNA Oligomer
ccuuaaaauuacugauugguuca

SEQ ID NO: 48868 - RNA, 23 nt, Artificial Sequence
  RNA Oligomer
cauuuacaacagcaggcauuuuc

SEQ ID NO: 48869 - RNA, 23 nt, Artificial Sequence
  RNA Oligomer
auuuacaacagcaggcauuuucu

SEQ ID NO: 48870 - RNA, 23 nt, Artificial Sequence
  RNA Oligomer
uuuacaacagcaggcauuuucuc

SEQ ID NO: 48871 - RNA, 23 nt, Artificial Sequence
  RNA Oligomer
uuacaacagcaggcauuuucucu

SEQ ID NO: 48872 - RNA, 23 nt, Artificial Sequence
  RNA Oligomer
uacaacagcaggcauuuucucuu

SEQ ID NO: 48873 - RNA, 23 nt, Artificial Sequence
  RNA Oligomer
aggauaccacuuugcacggacau

SEQ ID NO: 48874 - RNA, 23 nt, Artificial Sequence
  RNA Oligomer
cggacauuuucaaaugaugcagg

SEQ ID NO: 48875 - RNA, 23 nt, Artificial Sequence
  RNA Oligomer
caaaugaugcaggacucacaagg

SEQ ID NO: 48876 - RNA, 23 nt, Artificial Sequence
  RNA Oligomer
aaaugaugcaggacucacaaggg

SEQ ID NO: 48877 - RNA, 23 nt, Artificial Sequence
  RNA Oligomer
aaugaugcaggacucacaaggga

SEQ ID NO: 48878 - RNA, 23 nt, Artificial Sequence
  RNA Oligomer
augaugcaggacucacaagggaa

SEQ ID NO: 48879 - RNA, 23 nt, Artificial Sequence
  RNA Oligomer
ugaugcaggacucacaagggaaa

SEQ ID NO: 48880 - RNA, 23 nt, Artificial Sequence
  RNA Oligomer
gggcguaaucugucauaaucuuc

SEQ ID NO: 48881 - RNA, 23 nt, Artificial Sequence
  RNA Oligomer
ggcguaaucugucauaaucuucu

SEQ ID NO: 48882 - RNA, 23 nt, Artificial Sequence
  RNA Oligomer
gcguaaucugucauaaucuucuu

SEQ ID NO: 48883 - RNA, 23 nt, Artificial Sequence
  RNA Oligomer
ugucauaaucuucuuguccagcu

SEQ ID NO: 48884 - RNA, 23 nt, Artificial Sequence
  RNA Oligomer
gucauaaucuucuuguccagcug

SEQ ID NO: 48885 - RNA, 23 nt, Artificial Sequence
  RNA Oligomer
ucauaaucuucuuguccagcugu

SEQ ID NO: 48886 - RNA, 23 nt, Artificial Sequence
  RNA Oligomer
cauaaucuucuuguccagcugua

SEQ ID NO: 48887 - RNA, 23 nt, Artificial Sequence
  RNA Oligomer
auaaucuucuuguccagcuguau

SEQ ID NO: 48888 - RNA, 23 nt, Artificial Sequence
  RNA Oligomer
aaauucuguuguaguggcugaag

SEQ ID NO: 48889 - RNA, 23 nt, Artificial Sequence
  RNA Oligomer
aauucuguuguaguggcugaagg

SEQ ID NO: 48890 - RNA, 23 nt, Artificial Sequence
  RNA Oligomer
auucuguuguaguggcugaaggg

SEQ ID NO: 48891 - RNA, 23 nt, Artificial Sequence
  RNA Oligomer
gcacaguuuacagaaccucacag

SEQ ID NO: 48892 - RNA, 23 nt, Artificial Sequence
  RNA Oligomer
cacaguuuacagaaccucacaga

SEQ ID NO: 48893 - RNA, 23 nt, Artificial Sequence
  RNA Oligomer
acaguuuacagaaccucacagac

SEQ ID NO: 48894 - RNA, 23 nt, Artificial Sequence
  RNA Oligomer
caguuuacagaaccucacagacc

SEQ ID NO: 48895 - RNA, 23 nt, Artificial Sequence
  RNA Oligomer
guuacuagaaaacuaaggaaagc

SEQ ID NO: 48896 - RNA, 23 nt, Artificial Sequence
  RNA Oligomer
aaguaacauggaaagcacuuuua

SEQ ID NO: 48897 - RNA, 23 nt, Artificial Sequence
  RNA Oligomer
aguaacauggaaagcacuuuuac

SEQ ID NO: 48898 - RNA, 23 nt, Artificial Sequence
  RNA Oligomer
guaacauggaaagcacuuuuacu

SEQ ID NO: 48899 - RNA, 23 nt, Artificial Sequence
  RNA Oligomer
uuuacuaaucgacaaaaaaaccu

SEQ ID NO: 48900 - RNA, 23 nt, Artificial Sequence
  RNA Oligomer
uuacuaaucgacaaaaaaaccuu

SEQ ID NO: 48901 - RNA, 23 nt, Artificial Sequence
  RNA Oligomer
uacuaaucgacaaaaaaaccuuc

SEQ ID NO: 48902 - RNA, 23 nt, Artificial Sequence
  RNA Oligomer
acuaaucgacaaaaaaaccuucu

SEQ ID NO: 48903 - RNA, 23 nt, Artificial Sequence
  RNA Oligomer
cuaaucgacaaaaaaaccuucua

SEQ ID NO: 48904 - RNA, 23 nt, Artificial Sequence
  RNA Oligomer
uaaucgacaaaaaaaccuucuaa

SEQ ID NO: 48905 - RNA, 23 nt, Artificial Sequence
  RNA Oligomer
aaucgacaaaaaaaccuucuaau

SEQ ID NO: 48906 - RNA, 23 nt, Artificial Sequence
  RNA Oligomer
ugucaaagacaguagggauauau

SEQ ID NO: 48907 - RNA, 23 nt, Artificial Sequence
  RNA Oligomer
gucaaagacaguagggauauauu

SEQ ID NO: 48908 - RNA, 23 nt, Artificial Sequence
  RNA Oligomer
ucaaagacaguagggauauauuc

SEQ ID NO: 48909 - RNA, 23 nt, Artificial Sequence
  RNA Oligomer
caaagacaguagggauauauucu

SEQ ID NO: 48910 - RNA, 23 nt, Artificial Sequence
  RNA Oligomer
aaagacaguagggauauauucuc

SEQ ID NO: 48911 - RNA, 23 nt, Artificial Sequence
  RNA Oligomer
acagaacaaccaguuuaaagaug

SEQ ID NO: 48912 - RNA, 23 nt, Artificial Sequence
  RNA Oligomer
cagaacaaccaguuuaaagauga

SEQ ID NO: 48913 - RNA, 23 nt, Artificial Sequence
  RNA Oligomer
agaacaaccaguuuaaagaugaa

SEQ ID NO: 48914 - RNA, 23 nt, Artificial Sequence
  RNA Oligomer
gaacaaccaguuuaaagaugaau

SEQ ID NO: 48915 - RNA, 23 nt, Artificial Sequence
  RNA Oligomer
aacaaccaguuuaaagaugaauu

SEQ ID NO: 48916 - RNA, 23 nt, Artificial Sequence
  RNA Oligomer
acaaccaguuuaaagaugaauua

SEQ ID NO: 48917 - RNA, 23 nt, Artificial Sequence
  RNA Oligomer
gcuuaagaaaacauuuccugaua

SEQ ID NO: 48918 - RNA, 23 nt, Artificial Sequence
  RNA Oligomer
cuuaagaaaacauuuccugauaa

SEQ ID NO: 48919 - RNA, 23 nt, Artificial Sequence
  RNA Oligomer
acugcauuugacagaaauuaacc

SEQ ID NO: 48920 - RNA, 23 nt, Artificial Sequence
  RNA Oligomer
cugcauuugacagaaauuaaccu

SEQ ID NO: 48921 - RNA, 23 nt, Artificial Sequence
  RNA Oligomer
ugcauuugacagaaauuaaccuu

SEQ ID NO: 48922 - RNA, 23 nt, Artificial Sequence
  RNA Oligomer
gcauuugacagaaauuaaccuuu

SEQ ID NO: 48923 - RNA, 23 nt, Artificial Sequence
  RNA Oligomer
cauuugacagaaauuaaccuuuu

SEQ ID NO: 48924 - RNA, 23 nt, Artificial Sequence
  RNA Oligomer
ucauuccuuguacaauguagugu

SEQ ID NO: 48925 - RNA, 23 nt, Artificial Sequence
  RNA Oligomer
cauuccuuguacaauguagugua

SEQ ID NO: 48926 - RNA, 23 nt, Artificial Sequence
  RNA Oligomer
uguaaaucuccacuucguauuuu

SEQ ID NO: 48927 - RNA, 23 nt, Artificial Sequence
  RNA Oligomer
ucaaaauacugucuuuguccuuu

SEQ ID NO: 48928 - RNA, 23 nt, Artificial Sequence
  RNA Oligomer
ccgcaaaagcuggucagaaaacu

SEQ ID NO: 48929 - RNA, 23 nt, Artificial Sequence
  RNA Oligomer
cgcaaaagcuggucagaaaacuc

SEQ ID NO: 48930 - RNA, 23 nt, Artificial Sequence
  RNA Oligomer
gaaggucuuugcaaaguucagug

SEQ ID NO: 48931 - RNA, 23 nt, Artificial Sequence
  RNA Oligomer
aaggucuuugcaaaguucagugc

SEQ ID NO: 48932 - RNA, 23 nt, Artificial Sequence
  RNA Oligomer
aggucuuugcaaaguucagugcu

SEQ ID NO: 48933 - RNA, 23 nt, Artificial Sequence
  RNA Oligomer
ggucuuugcaaaguucagugcuc

SEQ ID NO: 48934 - RNA, 23 nt, Artificial Sequence
  RNA Oligomer
gucuuugcaaaguucagugcucg

SEQ ID NO: 48935 - RNA, 23 nt, Artificial Sequence
  RNA Oligomer
aagaaggcuugucauuuuagggc

SEQ ID NO: 48936 - RNA, 23 nt, Artificial Sequence
  RNA Oligomer
ugagucugaacucuuacauuuag

SEQ ID NO: 48937 - RNA, 23 nt, Artificial Sequence
  RNA Oligomer
gagucugaacucuuacauuuaga

SEQ ID NO: 48938 - RNA, 23 nt, Artificial Sequence
  RNA Oligomer
agucugaacucuuacauuuagaa

SEQ ID NO: 48939 - RNA, 23 nt, Artificial Sequence
  RNA Oligomer
gucugaacucuuacauuuagaac

SEQ ID NO: 48940 - RNA, 23 nt, Artificial Sequence
  RNA Oligomer
ucugaacucuuacauuuagaaca

SEQ ID NO: 48941 - RNA, 23 nt, Artificial Sequence
  RNA Oligomer
uuacagcaccaaucuccuuagcc

SEQ ID NO: 48942 - RNA, 23 nt, Artificial Sequence
  RNA Oligomer
uacagcaccaaucuccuuagcca

SEQ ID NO: 48943 - RNA, 23 nt, Artificial Sequence
  RNA Oligomer
agcaccaaucuccuuagccaugg

SEQ ID NO: 48944 - RNA, 23 nt, Artificial Sequence
  RNA Oligomer
gcaccaaucuccuuagccauggc

SEQ ID NO: 48945 - RNA, 23 nt, Artificial Sequence
  RNA Oligomer
caccaaucuccuuagccauggcu

SEQ ID NO: 48946 - RNA, 23 nt, Artificial Sequence
  RNA Oligomer
accaaucuccuuagccauggcua

SEQ ID NO: 48947 - RNA, 23 nt, Artificial Sequence
  RNA Oligomer
ccaaucuccuuagccauggcuag

SEQ ID NO: 48948 - RNA, 23 nt, Artificial Sequence
  RNA Oligomer
uuuucaaaugaugcaggacucac

SEQ ID NO: 48949 - RNA, 23 nt, Artificial Sequence
  RNA Oligomer
uuucaaaugaugcaggacucaca

SEQ ID NO: 48950 - RNA, 23 nt, Artificial Sequence
  RNA Oligomer
uucaaaugaugcaggacucacaa

SEQ ID NO: 48951 - RNA, 23 nt, Artificial Sequence
  RNA Oligomer
ucugucauaaucuucuuguccag

SEQ ID NO: 48952 - RNA, 23 nt, Artificial Sequence
  RNA Oligomer
uauuaagucauacaugcaaaaca

SEQ ID NO: 48953 - RNA, 23 nt, Artificial Sequence
  RNA Oligomer
auuaagucauacaugcaaaacau

SEQ ID NO: 48954 - RNA, 23 nt, Artificial Sequence
  RNA Oligomer
uuaagucauacaugcaaaacaua

SEQ ID NO: 48955 - RNA, 23 nt, Artificial Sequence
  RNA Oligomer
uaagucauacaugcaaaacauaa

SEQ ID NO: 48956 - RNA, 23 nt, Artificial Sequence
  RNA Oligomer
aagucauacaugcaaaacauaau

SEQ ID NO: 48957 - RNA, 23 nt, Artificial Sequence
  RNA Oligomer
ucaauguaaaaacacuccacaau

SEQ ID NO: 48958 - RNA, 23 nt, Artificial Sequence
  RNA Oligomer
acagaacaucgucagcacuagca

SEQ ID NO: 48959 - RNA, 23 nt, Artificial Sequence
  RNA Oligomer
cagaacaucgucagcacuagcac

SEQ ID NO: 48960 - RNA, 23 nt, Artificial Sequence
  RNA Oligomer
agaacaucgucagcacuagcaca

SEQ ID NO: 48961 - RNA, 23 nt, Artificial Sequence
  RNA Oligomer
agugauguuaagaagguucauag

SEQ ID NO: 48962 - RNA, 23 nt, Artificial Sequence
  RNA Oligomer
gugauguuaagaagguucauagu

SEQ ID NO: 48963 - RNA, 23 nt, Artificial Sequence
  RNA Oligomer
ugauguuaagaagguucauaguu

SEQ ID NO: 48964 - RNA, 23 nt, Artificial Sequence
  RNA Oligomer
gauguuaagaagguucauaguuu

SEQ ID NO: 48965 - RNA, 23 nt, Artificial Sequence
  RNA Oligomer
auguuaagaagguucauaguuua

SEQ ID NO: 48966 - RNA, 23 nt, Artificial Sequence
  RNA Oligomer
aucgacaaaaaaaccuucuaaug

SEQ ID NO: 48967 - RNA, 23 nt, Artificial Sequence
  RNA Oligomer
gguucuauaagaaaagcacuuac

SEQ ID NO: 48968 - RNA, 23 nt, Artificial Sequence
  RNA Oligomer
guucuauaagaaaagcacuuacu

SEQ ID NO: 48969 - RNA, 23 nt, Artificial Sequence
  RNA Oligomer
uucuauaagaaaagcacuuacua

SEQ ID NO: 48970 - RNA, 23 nt, Artificial Sequence
  RNA Oligomer
ucuauaagaaaagcacuuacuaa

SEQ ID NO: 48971 - RNA, 23 nt, Artificial Sequence
  RNA Oligomer
aagcacuuacuaaguuagcgacu

SEQ ID NO: 48972 - RNA, 23 nt, Artificial Sequence
  RNA Oligomer
uaagagaaaggaaaagcuuaaga

SEQ ID NO: 48973 - RNA, 23 nt, Artificial Sequence
  RNA Oligomer
aagagaaaggaaaagcuuaagaa

SEQ ID NO: 48974 - RNA, 23 nt, Artificial Sequence
  RNA Oligomer
agagaaaggaaaagcuuaagaaa

SEQ ID NO: 48975 - RNA, 23 nt, Artificial Sequence
  RNA Oligomer
gagaaaggaaaagcuuaagaaaa

SEQ ID NO: 48976 - RNA, 23 nt, Artificial Sequence
  RNA Oligomer
agaaaggaaaagcuuaagaaaac

SEQ ID NO: 48977 - RNA, 23 nt, Artificial Sequence
  RNA Oligomer
cuuucaucaucuacugcauuuga

SEQ ID NO: 48978 - RNA, 23 nt, Artificial Sequence
  RNA Oligomer
auuccuuguacaauguaguguaa

SEQ ID NO: 48979 - RNA, 23 nt, Artificial Sequence
  RNA Oligomer
uuccuuguacaauguaguguaaa

SEQ ID NO: 48980 - RNA, 23 nt, Artificial Sequence
  RNA Oligomer
uccuuguacaauguaguguaaau

SEQ ID NO: 48981 - RNA, 23 nt, Artificial Sequence
  RNA Oligomer
uacugucuuuguccuuugaucac

SEQ ID NO: 48982 - RNA, 23 nt, Artificial Sequence
  RNA Oligomer
ccauuacaguacaauguuauguc

SEQ ID NO: 48983 - RNA, 23 nt, Artificial Sequence
  RNA Oligomer
cauuacaguacaauguuaugucg

SEQ ID NO: 48984 - RNA, 23 nt, Artificial Sequence
  RNA Oligomer
auuacaguacaauguuaugucgg

SEQ ID NO: 48985 - RNA, 23 nt, Artificial Sequence
  RNA Oligomer
uuacaguacaauguuaugucggg

SEQ ID NO: 48986 - RNA, 23 nt, Artificial Sequence
  RNA Oligomer
uacaguacaauguuaugucggga

SEQ ID NO: 48987 - RNA, 23 nt, Artificial Sequence
  RNA Oligomer
acaguacaauguuaugucgggaa

SEQ ID NO: 48988 - RNA, 23 nt, Artificial Sequence
  RNA Oligomer
caguacaauguuaugucgggaac

SEQ ID NO: 48989 - RNA, 23 nt, Artificial Sequence
  RNA Oligomer
aguacaauguuaugucgggaaca

SEQ ID NO: 48990 - RNA, 23 nt, Artificial Sequence
  RNA Oligomer
cugagaacuacauaggagagcaa

SEQ ID NO: 48991 - RNA, 23 nt, Artificial Sequence
  RNA Oligomer
ugagaacuacauaggagagcaag

SEQ ID NO: 48992 - RNA, 23 nt, Artificial Sequence
  RNA Oligomer
gagaacuacauaggagagcaagu

SEQ ID NO: 48993 - RNA, 23 nt, Artificial Sequence
  RNA Oligomer
aaguucagugcucgguguucucg

SEQ ID NO: 48994 - RNA, 23 nt, Artificial Sequence
  RNA Oligomer
aguucagugcucgguguucucgg

SEQ ID NO: 48995 - RNA, 23 nt, Artificial Sequence
  RNA Oligomer
guucagugcucgguguucucggc

SEQ ID NO: 48996 - RNA, 23 nt, Artificial Sequence
  RNA Oligomer
gcacaacaaugcaguguaguuca

SEQ ID NO: 48997 - RNA, 23 nt, Artificial Sequence
  RNA Oligomer
cacaacaaugcaguguaguucag

SEQ ID NO: 48998 - RNA, 23 nt, Artificial Sequence
  RNA Oligomer
acaacaaugcaguguaguucaga

SEQ ID NO: 48999 - RNA, 23 nt, Artificial Sequence
  RNA Oligomer
caacaaugcaguguaguucagaa

SEQ ID NO: 49000 - RNA, 23 nt, Artificial Sequence
  RNA Oligomer
uggcaacucuuaaucugaacaag

SEQ ID NO: 49001 - RNA, 23 nt, Artificial Sequence
  RNA Oligomer
ggcaacucuuaaucugaacaaga

SEQ ID NO: 49002 - RNA, 23 nt, Artificial Sequence
  RNA Oligomer
gcaacucuuaaucugaacaagaa

SEQ ID NO: 49003 - RNA, 23 nt, Artificial Sequence
  RNA Oligomer
caacucuuaaucugaacaagaau

SEQ ID NO: 49004 - RNA, 23 nt, Artificial Sequence
  RNA Oligomer
aacucuuaaucugaacaagaaug

SEQ ID NO: 49005 - RNA, 23 nt, Artificial Sequence
  RNA Oligomer
agaaggcuugucauuuuagggcu

SEQ ID NO: 49006 - RNA, 23 nt, Artificial Sequence
  RNA Oligomer
gaaggcuugucauuuuagggcua

SEQ ID NO: 49007 - RNA, 23 nt, Artificial Sequence
  RNA Oligomer
caacagcaggcauuuucucuucc

SEQ ID NO: 49008 - RNA, 23 nt, Artificial Sequence
  RNA Oligomer
aacagcaggcauuuucucuuccu

SEQ ID NO: 49009 - RNA, 23 nt, Artificial Sequence
  RNA Oligomer
acagcaggcauuuucucuuccuc

SEQ ID NO: 49010 - RNA, 23 nt, Artificial Sequence
  RNA Oligomer
cagcaggcauuuucucuuccucu

SEQ ID NO: 49011 - RNA, 23 nt, Artificial Sequence
  RNA Oligomer
agcaggcauuuucucuuccucuu

SEQ ID NO: 49012 - RNA, 23 nt, Artificial Sequence
  RNA Oligomer
agagaaacaggaaauggccgcuc

SEQ ID NO: 49013 - RNA, 23 nt, Artificial Sequence
  RNA Oligomer
cuaggaugaugggaguguuggga

SEQ ID NO: 49014 - RNA, 23 nt, Artificial Sequence
  RNA Oligomer
uaggaugaugggaguguugggac

SEQ ID NO: 49015 - RNA, 23 nt, Artificial Sequence
  RNA Oligomer
aggaugaugggaguguugggaca

SEQ ID NO: 49016 - RNA, 23 nt, Artificial Sequence
  RNA Oligomer
ggaugaugggaguguugggacag

SEQ ID NO: 49017 - RNA, 23 nt, Artificial Sequence
  RNA Oligomer
gaugaugggaguguugggacagu

SEQ ID NO: 49018 - RNA, 23 nt, Artificial Sequence
  RNA Oligomer
augaugggaguguugggacagug

SEQ ID NO: 49019 - RNA, 23 nt, Artificial Sequence
  RNA Oligomer
cgcaccucaggauaccacuuugc

SEQ ID NO: 49020 - RNA, 23 nt, Artificial Sequence
  RNA Oligomer
gcaccucaggauaccacuuugca

SEQ ID NO: 49021 - RNA, 23 nt, Artificial Sequence
  RNA Oligomer
caccucaggauaccacuuugcac

SEQ ID NO: 49022 - RNA, 23 nt, Artificial Sequence
  RNA Oligomer
ggauaccacuuugcacggacauu

SEQ ID NO: 49023 - RNA, 23 nt, Artificial Sequence
  RNA Oligomer
gauaccacuuugcacggacauuu

SEQ ID NO: 49024 - RNA, 23 nt, Artificial Sequence
  RNA Oligomer
aaaagaucaauguaaaaacacuc

SEQ ID NO: 49025 - RNA, 23 nt, Artificial Sequence
  RNA Oligomer
caauguaaaaacacuccacaauu

SEQ ID NO: 49026 - RNA, 23 nt, Artificial Sequence
  RNA Oligomer
agcacaguuuacagaaccucaca

SEQ ID NO: 49027 - RNA, 23 nt, Artificial Sequence
  RNA Oligomer
cagacccaaaggaacaucaauag

SEQ ID NO: 49028 - RNA, 23 nt, Artificial Sequence
  RNA Oligomer
agacccaaaggaacaucaauagg

SEQ ID NO: 49029 - RNA, 23 nt, Artificial Sequence
  RNA Oligomer
ccauaacauuggcagaauaauug

SEQ ID NO: 49030 - RNA, 23 nt, Artificial Sequence
  RNA Oligomer
cauaacauuggcagaauaauugu

SEQ ID NO: 49031 - RNA, 23 nt, Artificial Sequence
  RNA Oligomer
auaacauuggcagaauaauuguc

SEQ ID NO: 49032 - RNA, 23 nt, Artificial Sequence
  RNA Oligomer
uaacauuggcagaauaauuguca

SEQ ID NO: 49033 - RNA, 23 nt, Artificial Sequence
  RNA Oligomer
aacauuggcagaauaauugucaa

SEQ ID NO: 49034 - RNA, 23 nt, Artificial Sequence
  RNA Oligomer
agaaaacuaaggaaagcacuuau

SEQ ID NO: 49035 - RNA, 23 nt, Artificial Sequence
  RNA Oligomer
agcacuuuuacuaaucgacaaaa

SEQ ID NO: 49036 - RNA, 23 nt, Artificial Sequence
  RNA Oligomer
auaccaaccuuucuuucaucauc

SEQ ID NO: 49037 - RNA, 23 nt, Artificial Sequence
  RNA Oligomer
ucuccacuucguauuuugucaaa

SEQ ID NO: 49038 - RNA, 23 nt, Artificial Sequence
  RNA Oligomer
cuccacuucguauuuugucaaaa

SEQ ID NO: 49039 - RNA, 23 nt, Artificial Sequence
  RNA Oligomer
uccacuucguauuuugucaaaau

SEQ ID NO: 49040 - RNA, 23 nt, Artificial Sequence
  RNA Oligomer
ugucuuuguccuuugaucacaca

SEQ ID NO: 49041 - RNA, 23 nt, Artificial Sequence
  RNA Oligomer
gucuuuguccuuugaucacacac

SEQ ID NO: 49042 - RNA, 23 nt, Artificial Sequence
  RNA Oligomer
ucuuuguccuuugaucacacaca

SEQ ID NO: 49043 - RNA, 23 nt, Artificial Sequence
  RNA Oligomer
cuuuguccuuugaucacacacac

SEQ ID NO: 49044 - RNA, 23 nt, Artificial Sequence
  RNA Oligomer
uuuguccuuugaucacacacacc

SEQ ID NO: 49045 - RNA, 23 nt, Artificial Sequence
  RNA Oligomer
ugaguucaauggcaacgcuucau

SEQ ID NO: 49046 - RNA, 23 nt, Artificial Sequence
  RNA Oligomer
gaguucaauggcaacgcuucauu

SEQ ID NO: 49047 - RNA, 23 nt, Artificial Sequence
  RNA Oligomer
aguucaauggcaacgcuucauuc

SEQ ID NO: 49048 - RNA, 23 nt, Artificial Sequence
  RNA Oligomer
guucaauggcaacgcuucauucg

SEQ ID NO: 49049 - RNA, 23 nt, Artificial Sequence
  RNA Oligomer
uucaauggcaacgcuucauucgg

SEQ ID NO: 49050 - RNA, 23 nt, Artificial Sequence
  RNA Oligomer
agacgaaggucuuugcaaaguuc

SEQ ID NO: 49051 - RNA, 23 nt, Artificial Sequence
  RNA Oligomer
gacgaaggucuuugcaaaguuca

SEQ ID NO: 49052 - RNA, 23 nt, Artificial Sequence
  RNA Oligomer
acgaaggucuuugcaaaguucag

SEQ ID NO: 49053 - RNA, 23 nt, Artificial Sequence
  RNA Oligomer
cgaaggucuuugcaaaguucagu

SEQ ID NO: 49054 - RNA, 23 nt, Artificial Sequence
  RNA Oligomer
ggcacaacaaugcaguguaguuc

SEQ ID NO: 49055 - RNA, 23 nt, Artificial Sequence
  RNA Oligomer
cugagacauuuacaacagcaggc

SEQ ID NO: 49056 - RNA, 23 nt, Artificial Sequence
  RNA Oligomer
ugagacauuuacaacagcaggca

SEQ ID NO: 49057 - RNA, 23 nt, Artificial Sequence
  RNA Oligomer
gagacauuuacaacagcaggcau

SEQ ID NO: 49058 - RNA, 23 nt, Artificial Sequence
  RNA Oligomer
agacauuuacaacagcaggcauu

SEQ ID NO: 49059 - RNA, 23 nt, Artificial Sequence
  RNA Oligomer
gacauuuacaacagcaggcauuu

SEQ ID NO: 49060 - RNA, 23 nt, Artificial Sequence
  RNA Oligomer
acagcaccaaucuccuuagccau

SEQ ID NO: 49061 - RNA, 23 nt, Artificial Sequence
  RNA Oligomer
uaucaucccuaagaucaaguuua

SEQ ID NO: 49062 - RNA, 23 nt, Artificial Sequence
  RNA Oligomer
aucaucccuaagaucaaguuuag

SEQ ID NO: 49063 - RNA, 23 nt, Artificial Sequence
  RNA Oligomer
ucaucccuaagaucaaguuuagu

SEQ ID NO: 49064 - RNA, 23 nt, Artificial Sequence
  RNA Oligomer
caucccuaagaucaaguuuaguu

SEQ ID NO: 49065 - RNA, 23 nt, Artificial Sequence
  RNA Oligomer
aucccuaagaucaaguuuaguuc

SEQ ID NO: 49066 - RNA, 23 nt, Artificial Sequence
  RNA Oligomer
ucaaaugaugcaggacucacaag

SEQ ID NO: 49067 - RNA, 23 nt, Artificial Sequence
  RNA Oligomer
ccagcuguaucccauaagcccag

SEQ ID NO: 49068 - RNA, 23 nt, Artificial Sequence
  RNA Oligomer
cagcuguaucccauaagcccaga

SEQ ID NO: 49069 - RNA, 23 nt, Artificial Sequence
  RNA Oligomer
agcuguaucccauaagcccagau

SEQ ID NO: 49070 - RNA, 23 nt, Artificial Sequence
  RNA Oligomer
gcuguaucccauaagcccagauu

SEQ ID NO: 49071 - RNA, 23 nt, Artificial Sequence
  RNA Oligomer
cuguaucccauaagcccagauuc

SEQ ID NO: 49072 - RNA, 23 nt, Artificial Sequence
  RNA Oligomer
ccgguuuuccaucuaccauaaca

SEQ ID NO: 49073 - RNA, 23 nt, Artificial Sequence
  RNA Oligomer
cgguuuuccaucuaccauaacau

SEQ ID NO: 49074 - RNA, 23 nt, Artificial Sequence
  RNA Oligomer
gguuuuccaucuaccauaacauu

SEQ ID NO: 49075 - RNA, 23 nt, Artificial Sequence
  RNA Oligomer
guuuuccaucuaccauaacauug

SEQ ID NO: 49076 - RNA, 23 nt, Artificial Sequence
  RNA Oligomer
uuuuccaucuaccauaacauugg

SEQ ID NO: 49077 - RNA, 23 nt, Artificial Sequence
  RNA Oligomer
acagaaccucacagacccaaagg

SEQ ID NO: 49078 - RNA, 23 nt, Artificial Sequence
  RNA Oligomer
cagaaccucacagacccaaagga

SEQ ID NO: 49079 - RNA, 23 nt, Artificial Sequence
  RNA Oligomer
agaaccucacagacccaaaggaa

SEQ ID NO: 49080 - RNA, 23 nt, Artificial Sequence
  RNA Oligomer
gaaccucacagacccaaaggaac

SEQ ID NO: 49081 - RNA, 23 nt, Artificial Sequence
  RNA Oligomer
aaccucacagacccaaaggaaca

SEQ ID NO: 49082 - RNA, 23 nt, Artificial Sequence
  RNA Oligomer
acaucaauaggcaaagcgacuac

SEQ ID NO: 49083 - RNA, 23 nt, Artificial Sequence
  RNA Oligomer
caucaauaggcaaagcgacuaca

SEQ ID NO: 49084 - RNA, 23 nt, Artificial Sequence
  RNA Oligomer
aucaauaggcaaagcgacuacag

SEQ ID NO: 49085 - RNA, 23 nt, Artificial Sequence
  RNA Oligomer
ucaauaggcaaagcgacuacagg

SEQ ID NO: 49086 - RNA, 23 nt, Artificial Sequence
  RNA Oligomer
caauaggcaaagcgacuacagga

SEQ ID NO: 49087 - RNA, 23 nt, Artificial Sequence
  RNA Oligomer
acuauaaagcugcaacacaugau

SEQ ID NO: 49088 - RNA, 23 nt, Artificial Sequence
  RNA Oligomer
cuauaaagcugcaacacaugauu

SEQ ID NO: 49089 - RNA, 23 nt, Artificial Sequence
  RNA Oligomer
uauaaagcugcaacacaugauuu

SEQ ID NO: 49090 - RNA, 23 nt, Artificial Sequence
  RNA Oligomer
auaaagcugcaacacaugauuuu

SEQ ID NO: 49091 - RNA, 23 nt, Artificial Sequence
  RNA Oligomer
uaaagcugcaacacaugauuuuu

SEQ ID NO: 49092 - RNA, 23 nt, Artificial Sequence
  RNA Oligomer
uuuuacuaaucgacaaaaaaacc

SEQ ID NO: 49093 - RNA, 23 nt, Artificial Sequence
  RNA Oligomer
ucgacaaaaaaaccuucuaaugc

SEQ ID NO: 49094 - RNA, 23 nt, Artificial Sequence
  RNA Oligomer
cgacaaaaaaaccuucuaaugca

SEQ ID NO: 49095 - RNA, 23 nt, Artificial Sequence
  RNA Oligomer
gacaaaaaaaccuucuaaugcau

SEQ ID NO: 49096 - RNA, 23 nt, Artificial Sequence
  RNA Oligomer
acaaaaaaaccuucuaaugcauu

SEQ ID NO: 49097 - RNA, 23 nt, Artificial Sequence
  RNA Oligomer
caaaaaaaccuucuaaugcauua

SEQ ID NO: 49098 - RNA, 23 nt, Artificial Sequence
  RNA Oligomer
aaaaaaccuucuaaugcauuauc

SEQ ID NO: 49099 - RNA, 23 nt, Artificial Sequence
  RNA Oligomer
aaaaaccuucuaaugcauuauca

SEQ ID NO: 49100 - RNA, 23 nt, Artificial Sequence
  RNA Oligomer
aaaaccuucuaaugcauuaucag

SEQ ID NO: 49101 - RNA, 23 nt, Artificial Sequence
  RNA Oligomer
aaaccuucuaaugcauuaucaga

SEQ ID NO: 49102 - RNA, 23 nt, Artificial Sequence
  RNA Oligomer
aaccuucuaaugcauuaucagaa

SEQ ID NO: 49103 - RNA, 23 nt, Artificial Sequence
  RNA Oligomer
accuucuaaugcauuaucagaaa

SEQ ID NO: 49104 - RNA, 23 nt, Artificial Sequence
  RNA Oligomer
uuugucaaaauacugucuuuguc

SEQ ID NO: 49105 - RNA, 23 nt, Artificial Sequence
  RNA Oligomer
uugucaaaauacugucuuugucc

SEQ ID NO: 49106 - RNA, 23 nt, Artificial Sequence
  RNA Oligomer
ugucaaaauacugucuuuguccu

SEQ ID NO: 49107 - RNA, 23 nt, Artificial Sequence
  RNA Oligomer
gucaaaauacugucuuuguccuu

SEQ ID NO: 49108 - RNA, 23 nt, Artificial Sequence
  RNA Oligomer
cugucuuuguccuuugaucacac

SEQ ID NO: 49109 - RNA, 23 nt, Artificial Sequence
  RNA Oligomer
uuguccuuugaucacacacaccc

SEQ ID NO: 49110 - RNA, 23 nt, Artificial Sequence
  RNA Oligomer
agcaguucuguucaaaaucuccg

SEQ ID NO: 49111 - RNA, 23 nt, Artificial Sequence
  RNA Oligomer
aaucacaaagacugauccaaaga

SEQ ID NO: 49112 - RNA, 23 nt, Artificial Sequence
  RNA Oligomer
cugcuacgcucacuccauuacag

SEQ ID NO: 49113 - RNA, 23 nt, Artificial Sequence
  RNA Oligomer
ugcuacgcucacuccauuacagu

SEQ ID NO: 49114 - RNA, 23 nt, Artificial Sequence
  RNA Oligomer
gcuacgcucacuccauuacagua

SEQ ID NO: 49115 - RNA, 23 nt, Artificial Sequence
  RNA Oligomer
cuacgcucacuccauuacaguac

SEQ ID NO: 49116 - RNA, 23 nt, Artificial Sequence
  RNA Oligomer
uacgcucacuccauuacaguaca

SEQ ID NO: 49117 - RNA, 23 nt, Artificial Sequence
  RNA Oligomer
cgggaacacgugcugcuaacuca

SEQ ID NO: 49118 - RNA, 23 nt, Artificial Sequence
  RNA Oligomer
gggaacacgugcugcuaacucac

SEQ ID NO: 49119 - RNA, 23 nt, Artificial Sequence
  RNA Oligomer
ggaacacgugcugcuaacucacu

SEQ ID NO: 49120 - RNA, 23 nt, Artificial Sequence
  RNA Oligomer
gaacacgugcugcuaacucacug

SEQ ID NO: 49121 - RNA, 23 nt, Artificial Sequence
  RNA Oligomer
aacacgugcugcuaacucacugg

SEQ ID NO: 49122 - RNA, 23 nt, Artificial Sequence
  RNA Oligomer
cuccuaacugcagaagcuaccgu

SEQ ID NO: 49123 - RNA, 23 nt, Artificial Sequence
  RNA Oligomer
uccuaacugcagaagcuaccguc

SEQ ID NO: 49124 - RNA, 23 nt, Artificial Sequence
  RNA Oligomer
ccuaacugcagaagcuaccgucu

SEQ ID NO: 49125 - RNA, 23 nt, Artificial Sequence
  RNA Oligomer
cuaacugcagaagcuaccgucuu

SEQ ID NO: 49126 - RNA, 23 nt, Artificial Sequence
  RNA Oligomer
uaacugcagaagcuaccgucuuc

SEQ ID NO: 49127 - RNA, 23 nt, Artificial Sequence
  RNA Oligomer
acugaucaguaggcaaguuuuac

SEQ ID NO: 49128 - RNA, 23 nt, Artificial Sequence
  RNA Oligomer
cugaucaguaggcaaguuuuacc

SEQ ID NO: 49129 - RNA, 23 nt, Artificial Sequence
  RNA Oligomer
ugaucaguaggcaaguuuuaccu

SEQ ID NO: 49130 - RNA, 23 nt, Artificial Sequence
  RNA Oligomer
gaucaguaggcaaguuuuaccua

SEQ ID NO: 49131 - RNA, 23 nt, Artificial Sequence
  RNA Oligomer
aucaguaggcaaguuuuaccuac

SEQ ID NO: 49132 - RNA, 23 nt, Artificial Sequence
  RNA Oligomer
gggggcgcuuuugaaaaauaagg

SEQ ID NO: 49133 - RNA, 23 nt, Artificial Sequence
  RNA Oligomer
ggggcgcuuuugaaaaauaaggc

SEQ ID NO: 49134 - RNA, 23 nt, Artificial Sequence
  RNA Oligomer
gggcgcuuuugaaaaauaaggcu

SEQ ID NO: 49135 - RNA, 23 nt, Artificial Sequence
  RNA Oligomer
ggcgcuuuugaaaaauaaggcuu

SEQ ID NO: 49136 - RNA, 23 nt, Artificial Sequence
  RNA Oligomer
gcgcuuuugaaaaauaaggcuuu

SEQ ID NO: 49137 - RNA, 23 nt, Artificial Sequence
  RNA Oligomer
acauuuacaacagcaggcauuuu

SEQ ID NO: 49138 - RNA, 23 nt, Artificial Sequence
  RNA Oligomer
cuccuucaguuucucgaucgugu

SEQ ID NO: 49139 - RNA, 23 nt, Artificial Sequence
  RNA Oligomer
uccuucaguuucucgaucguguc

SEQ ID NO: 49140 - RNA, 23 nt, Artificial Sequence
  RNA Oligomer
ccuucaguuucucgaucgugucu

SEQ ID NO: 49141 - RNA, 23 nt, Artificial Sequence
  RNA Oligomer
cuucaguuucucgaucgugucuu

SEQ ID NO: 49142 - RNA, 23 nt, Artificial Sequence
  RNA Oligomer
uucaguuucucgaucgugucuuu

SEQ ID NO: 49143 - RNA, 23 nt, Artificial Sequence
  RNA Oligomer
ugucuuuaucaucccuaagauca

SEQ ID NO: 49144 - RNA, 23 nt, Artificial Sequence
  RNA Oligomer
gucuuuaucaucccuaagaucaa

SEQ ID NO: 49145 - RNA, 23 nt, Artificial Sequence
  RNA Oligomer
ucuuuaucaucccuaagaucaag

SEQ ID NO: 49146 - RNA, 23 nt, Artificial Sequence
  RNA Oligomer
cuuuaucaucccuaagaucaagu

SEQ ID NO: 49147 - RNA, 23 nt, Artificial Sequence
  RNA Oligomer
uuuaucaucccuaagaucaaguu

SEQ ID NO: 49148 - RNA, 23 nt, Artificial Sequence
  RNA Oligomer
ccacuaggaugaugggaguguug

SEQ ID NO: 49149 - RNA, 23 nt, Artificial Sequence
  RNA Oligomer
cacuaggaugaugggaguguugg

SEQ ID NO: 49150 - RNA, 23 nt, Artificial Sequence
  RNA Oligomer
acuaggaugaugggaguguuggg

SEQ ID NO: 49151 - RNA, 23 nt, Artificial Sequence
  RNA Oligomer
ccgcaccucaggauaccacuuug

SEQ ID NO: 49152 - RNA, 23 nt, Artificial Sequence
  RNA Oligomer
gaaaagcaaauuaagaacacauc

SEQ ID NO: 49153 - RNA, 23 nt, Artificial Sequence
  RNA Oligomer
aaaagcaaauuaagaacacaucu

SEQ ID NO: 49154 - RNA, 23 nt, Artificial Sequence
  RNA Oligomer
aaagcaaauuaagaacacaucug

SEQ ID NO: 49155 - RNA, 23 nt, Artificial Sequence
  RNA Oligomer
aagcaaauuaagaacacaucugu

SEQ ID NO: 49156 - RNA, 23 nt, Artificial Sequence
  RNA Oligomer
agcaaauuaagaacacaucuguu

SEQ ID NO: 49157 - RNA, 23 nt, Artificial Sequence
  RNA Oligomer
cugucauaaucuucuuguccagc

SEQ ID NO: 49158 - RNA, 23 nt, Artificial Sequence
  RNA Oligomer
uuuccaucuaccauaacauuggc

SEQ ID NO: 49159 - RNA, 23 nt, Artificial Sequence
  RNA Oligomer
aacacuccacaauucugcaacug

SEQ ID NO: 49160 - RNA, 23 nt, Artificial Sequence
  RNA Oligomer
acaauucugcaacugucaauuua

SEQ ID NO: 49161 - RNA, 23 nt, Artificial Sequence
  RNA Oligomer
caauucugcaacugucaauuuaa

SEQ ID NO: 49162 - RNA, 23 nt, Artificial Sequence
  RNA Oligomer
aauucugcaacugucaauuuaaa

SEQ ID NO: 49163 - RNA, 23 nt, Artificial Sequence
  RNA Oligomer
auucugcaacugucaauuuaaaa

SEQ ID NO: 49164 - RNA, 23 nt, Artificial Sequence
  RNA Oligomer
uucugcaacugucaauuuaaaaa

SEQ ID NO: 49165 - RNA, 23 nt, Artificial Sequence
  RNA Oligomer
uucuguuguaguggcugaagggu

SEQ ID NO: 49166 - RNA, 23 nt, Artificial Sequence
  RNA Oligomer
ucuguuguaguggcugaaggguc

SEQ ID NO: 49167 - RNA, 23 nt, Artificial Sequence
  RNA Oligomer
cuguuguaguggcugaagggucc

SEQ ID NO: 49168 - RNA, 23 nt, Artificial Sequence
  RNA Oligomer
uguuguaguggcugaaggguccc

SEQ ID NO: 49169 - RNA, 23 nt, Artificial Sequence
  RNA Oligomer
cgccagugaguuaaguuguacag

SEQ ID NO: 49170 - RNA, 23 nt, Artificial Sequence
  RNA Oligomer
gccagugaguuaaguuguacaga

SEQ ID NO: 49171 - RNA, 23 nt, Artificial Sequence
  RNA Oligomer
ccagugaguuaaguuguacagaa

SEQ ID NO: 49172 - RNA, 23 nt, Artificial Sequence
  RNA Oligomer
cagugaguuaaguuguacagaac

SEQ ID NO: 49173 - RNA, 23 nt, Artificial Sequence
  RNA Oligomer
agugaguuaaguuguacagaaca

SEQ ID NO: 49174 - RNA, 23 nt, Artificial Sequence
  RNA Oligomer
agacagugauguuaagaagguuc

SEQ ID NO: 49175 - RNA, 23 nt, Artificial Sequence
  RNA Oligomer
gacagugauguuaagaagguuca

SEQ ID NO: 49176 - RNA, 23 nt, Artificial Sequence
  RNA Oligomer
acagugauguuaagaagguucau

SEQ ID NO: 49177 - RNA, 23 nt, Artificial Sequence
  RNA Oligomer
cagugauguuaagaagguucaua

SEQ ID NO: 49178 - RNA, 23 nt, Artificial Sequence
  RNA Oligomer
aacuauaaagcugcaacacauga

SEQ ID NO: 49179 - RNA, 23 nt, Artificial Sequence
  RNA Oligomer
agaauaauugucaaagacaguag

SEQ ID NO: 49180 - RNA, 23 nt, Artificial Sequence
  RNA Oligomer
gaauaauugucaaagacaguagg

SEQ ID NO: 49181 - RNA, 23 nt, Artificial Sequence
  RNA Oligomer
aauaauugucaaagacaguaggg

SEQ ID NO: 49182 - RNA, 23 nt, Artificial Sequence
  RNA Oligomer
auaauugucaaagacaguaggga

SEQ ID NO: 49183 - RNA, 23 nt, Artificial Sequence
  RNA Oligomer
uaauugucaaagacaguagggau

SEQ ID NO: 49184 - RNA, 23 nt, Artificial Sequence
  RNA Oligomer
agcacuuacuaaguuagcgacua

SEQ ID NO: 49185 - RNA, 23 nt, Artificial Sequence
  RNA Oligomer
gcacuuacuaaguuagcgacuaa

SEQ ID NO: 49186 - RNA, 23 nt, Artificial Sequence
  RNA Oligomer
cacuuacuaaguuagcgacuaac

SEQ ID NO: 49187 - RNA, 23 nt, Artificial Sequence
  RNA Oligomer
acuuacuaaguuagcgacuaaca

SEQ ID NO: 49188 - RNA, 23 nt, Artificial Sequence
  RNA Oligomer
cuuacuaaguuagcgacuaacag

SEQ ID NO: 49189 - RNA, 23 nt, Artificial Sequence
  RNA Oligomer
uuacuaaguuagcgacuaacaga

SEQ ID NO: 49190 - RNA, 23 nt, Artificial Sequence
  RNA Oligomer
aaguuagcgacuaacagaacaac

SEQ ID NO: 49191 - RNA, 23 nt, Artificial Sequence
  RNA Oligomer
aguuagcgacuaacagaacaacc

SEQ ID NO: 49192 - RNA, 23 nt, Artificial Sequence
  RNA Oligomer
guuagcgacuaacagaacaacca

SEQ ID NO: 49193 - RNA, 23 nt, Artificial Sequence
  RNA Oligomer
uuagcgacuaacagaacaaccag

SEQ ID NO: 49194 - RNA, 23 nt, Artificial Sequence
  RNA Oligomer
uagcgacuaacagaacaaccagu

SEQ ID NO: 49195 - RNA, 23 nt, Artificial Sequence
  RNA Oligomer
auuuugucaaaauacugucuuug

SEQ ID NO: 49196 - RNA, 23 nt, Artificial Sequence
  RNA Oligomer
uuuugucaaaauacugucuuugu

SEQ ID NO: 49197 - RNA, 23 nt, Artificial Sequence
  RNA Oligomer
acugucuuuguccuuugaucaca

SEQ ID NO: 49198 - RNA, 23 nt, Artificial Sequence
  RNA Oligomer
uguccuuugaucacacacacccc

SEQ ID NO: 49199 - RNA, 23 nt, Artificial Sequence
  RNA Oligomer
guccuuugaucacacacacccca

SEQ ID NO: 49200 - RNA, 23 nt, Artificial Sequence
  RNA Oligomer
uccuuugaucacacacaccccac

SEQ ID NO: 49201 - RNA, 23 nt, Artificial Sequence
  RNA Oligomer
ccuuugaucacacacaccccacc

SEQ ID NO: 49202 - RNA, 23 nt, Artificial Sequence
  RNA Oligomer
agaacuacauaggagagcaagug

SEQ ID NO: 49203 - RNA, 23 nt, Artificial Sequence
  RNA Oligomer
aacuacauaggagagcaaguguc

SEQ ID NO: 49204 - RNA, 23 nt, Artificial Sequence
  RNA Oligomer
acuacauaggagagcaagugucu

SEQ ID NO: 49205 - RNA, 23 nt, Artificial Sequence
  RNA Oligomer
cuacauaggagagcaagugucug

SEQ ID NO: 49206 - RNA, 23 nt, Artificial Sequence
  RNA Oligomer
uacauaggagagcaagugucugc

SEQ ID NO: 49207 - RNA, 23 nt, Artificial Sequence
  RNA Oligomer
acauaggagagcaagugucugca

SEQ ID NO: 49208 - RNA, 23 nt, Artificial Sequence
  RNA Oligomer
acucuuaaucugaacaagaaugg

SEQ ID NO: 49209 - RNA, 23 nt, Artificial Sequence
  RNA Oligomer
cucuuaaucugaacaagaauggg

SEQ ID NO: 49210 - RNA, 23 nt, Artificial Sequence
  RNA Oligomer
ucuuaaucugaacaagaaugggg

SEQ ID NO: 49211 - RNA, 23 nt, Artificial Sequence
  RNA Oligomer
cuuaaucugaacaagaauggggg

SEQ ID NO: 49212 - RNA, 23 nt, Artificial Sequence
  RNA Oligomer
uuaaucugaacaagaaugggggg

SEQ ID NO: 49213 - RNA, 23 nt, Artificial Sequence
  RNA Oligomer
aauaaggcuuuaagaaggcuugu

SEQ ID NO: 49214 - RNA, 23 nt, Artificial Sequence
  RNA Oligomer
ggggcugagacauuuacaacagc

SEQ ID NO: 49215 - RNA, 23 nt, Artificial Sequence
  RNA Oligomer
gggcugagacauuuacaacagca

SEQ ID NO: 49216 - RNA, 23 nt, Artificial Sequence
  RNA Oligomer
ggcugagacauuuacaacagcag

SEQ ID NO: 49217 - RNA, 23 nt, Artificial Sequence
  RNA Oligomer
gcugagacauuuacaacagcagg

SEQ ID NO: 49218 - RNA, 23 nt, Artificial Sequence
  RNA Oligomer
gagcacuccagguauuuuacagc

SEQ ID NO: 49219 - RNA, 23 nt, Artificial Sequence
  RNA Oligomer
agcacuccagguauuuuacagca

SEQ ID NO: 49220 - RNA, 23 nt, Artificial Sequence
  RNA Oligomer
gcacuccagguauuuuacagcac

SEQ ID NO: 49221 - RNA, 23 nt, Artificial Sequence
  RNA Oligomer
cacuccagguauuuuacagcacc

SEQ ID NO: 49222 - RNA, 23 nt, Artificial Sequence
  RNA Oligomer
acuccagguauuuuacagcacca

SEQ ID NO: 49223 - RNA, 23 nt, Artificial Sequence
  RNA Oligomer
cagcaccaaucuccuuagccaug

SEQ ID NO: 49224 - RNA, 23 nt, Artificial Sequence
  RNA Oligomer
uuaucaucccuaagaucaaguuu

SEQ ID NO: 49225 - RNA, 23 nt, Artificial Sequence
  RNA Oligomer
auugcauuagcaaaagaucaaug

SEQ ID NO: 49226 - RNA, 23 nt, Artificial Sequence
  RNA Oligomer
uugcauuagcaaaagaucaaugu

SEQ ID NO: 49227 - RNA, 23 nt, Artificial Sequence
  RNA Oligomer
ugcauuagcaaaagaucaaugua

SEQ ID NO: 49228 - RNA, 23 nt, Artificial Sequence
  RNA Oligomer
gcauuagcaaaagaucaauguaa

SEQ ID NO: 49229 - RNA, 23 nt, Artificial Sequence
  RNA Oligomer
cauuagcaaaagaucaauguaaa

SEQ ID NO: 49230 - RNA, 23 nt, Artificial Sequence
  RNA Oligomer
auucucgccagugaguuaaguug

SEQ ID NO: 49231 - RNA, 23 nt, Artificial Sequence
  RNA Oligomer
uucucgccagugaguuaaguugu

SEQ ID NO: 49232 - RNA, 23 nt, Artificial Sequence
  RNA Oligomer
ucucgccagugaguuaaguugua

SEQ ID NO: 49233 - RNA, 23 nt, Artificial Sequence
  RNA Oligomer
cucgccagugaguuaaguuguac

SEQ ID NO: 49234 - RNA, 23 nt, Artificial Sequence
  RNA Oligomer
ucgccagugaguuaaguuguaca

SEQ ID NO: 49235 - RNA, 23 nt, Artificial Sequence
  RNA Oligomer
aagauuuuauaauacaaggaggc

SEQ ID NO: 49236 - RNA, 23 nt, Artificial Sequence
  RNA Oligomer
agauuuuauaauacaaggaggca

SEQ ID NO: 49237 - RNA, 23 nt, Artificial Sequence
  RNA Oligomer
gauuuuauaauacaaggaggcau

SEQ ID NO: 49238 - RNA, 23 nt, Artificial Sequence
  RNA Oligomer
auuuuauaauacaaggaggcaua

SEQ ID NO: 49239 - RNA, 23 nt, Artificial Sequence
  RNA Oligomer
uuuuauaauacaaggaggcauau

SEQ ID NO: 49240 - RNA, 23 nt, Artificial Sequence
  RNA Oligomer
aagggguucuauaagaaaagcac

SEQ ID NO: 49241 - RNA, 23 nt, Artificial Sequence
  RNA Oligomer
agggguucuauaagaaaagcacu

SEQ ID NO: 49242 - RNA, 23 nt, Artificial Sequence
  RNA Oligomer
gggguucuauaagaaaagcacuu

SEQ ID NO: 49243 - RNA, 23 nt, Artificial Sequence
  RNA Oligomer
ggguucuauaagaaaagcacuua

SEQ ID NO: 49244 - RNA, 23 nt, Artificial Sequence
  RNA Oligomer
uaaguuagcgacuaacagaacaa

SEQ ID NO: 49245 - RNA, 23 nt, Artificial Sequence
  RNA Oligomer
cacccacagcuaaacagaauucu

SEQ ID NO: 49246 - RNA, 23 nt, Artificial Sequence
  RNA Oligomer
acccacagcuaaacagaauucuu

SEQ ID NO: 49247 - RNA, 23 nt, Artificial Sequence
  RNA Oligomer
cccacagcuaaacagaauucuuc

SEQ ID NO: 49248 - RNA, 23 nt, Artificial Sequence
  RNA Oligomer
ccacagcuaaacagaauucuuca

SEQ ID NO: 49249 - RNA, 23 nt, Artificial Sequence
  RNA Oligomer
cacagcuaaacagaauucuucau

SEQ ID NO: 49250 - RNA, 23 nt, Artificial Sequence
  RNA Oligomer
uagcaguucuguucaaaaucucc

SEQ ID NO: 49251 - RNA, 23 nt, Artificial Sequence
  RNA Oligomer
aucacaaagacugauccaaagag

SEQ ID NO: 49252 - RNA, 23 nt, Artificial Sequence
  RNA Oligomer
cucacuccauuacaguacaaugu

SEQ ID NO: 49253 - RNA, 23 nt, Artificial Sequence
  RNA Oligomer
ucacuccauuacaguacaauguu

SEQ ID NO: 49254 - RNA, 23 nt, Artificial Sequence
  RNA Oligomer
cacuccauuacaguacaauguua

SEQ ID NO: 49255 - RNA, 23 nt, Artificial Sequence
  RNA Oligomer
acuccauuacaguacaauguuau

SEQ ID NO: 49256 - RNA, 23 nt, Artificial Sequence
  RNA Oligomer
cuccauuacaguacaauguuaug

SEQ ID NO: 49257 - RNA, 23 nt, Artificial Sequence
  RNA Oligomer
acacgugcugcuaacucacuggu

SEQ ID NO: 49258 - RNA, 23 nt, Artificial Sequence
  RNA Oligomer
cacgugcugcuaacucacuggug

SEQ ID NO: 49259 - RNA, 23 nt, Artificial Sequence
  RNA Oligomer
acgugcugcuaacucacugguga

SEQ ID NO: 49260 - RNA, 23 nt, Artificial Sequence
  RNA Oligomer
gaacuacauaggagagcaagugu

SEQ ID NO: 49261 - RNA, 23 nt, Artificial Sequence
  RNA Oligomer
cuguaacaaaaaguuggcauuga

SEQ ID NO: 49262 - RNA, 23 nt, Artificial Sequence
  RNA Oligomer
uguaacaaaaaguuggcauugag

SEQ ID NO: 49263 - RNA, 23 nt, Artificial Sequence
  RNA Oligomer
guaacaaaaaguuggcauugagu

SEQ ID NO: 49264 - RNA, 23 nt, Artificial Sequence
  RNA Oligomer
uaacaaaaaguuggcauugagug

SEQ ID NO: 49265 - RNA, 23 nt, Artificial Sequence
  RNA Oligomer
aacaaaaaguuggcauugagugc

SEQ ID NO: 49266 - RNA, 23 nt, Artificial Sequence
  RNA Oligomer
aauaggcaaagcgacuacaggag

SEQ ID NO: 49267 - RNA, 23 nt, Artificial Sequence
  RNA Oligomer
uuuaaaaacuauaaagcugcaac

SEQ ID NO: 49268 - RNA, 23 nt, Artificial Sequence
  RNA Oligomer
uuaaaaacuauaaagcugcaaca

SEQ ID NO: 49269 - RNA, 23 nt, Artificial Sequence
  RNA Oligomer
uaaaaacuauaaagcugcaacac

SEQ ID NO: 49270 - RNA, 23 nt, Artificial Sequence
  RNA Oligomer
aaaaacuauaaagcugcaacaca

SEQ ID NO: 49271 - RNA, 23 nt, Artificial Sequence
  RNA Oligomer
aaaacuauaaagcugcaacacau

SEQ ID NO: 49272 - RNA, 23 nt, Artificial Sequence
  RNA Oligomer
aagcugcaacacaugauuuuuac

SEQ ID NO: 49273 - RNA, 23 nt, Artificial Sequence
  RNA Oligomer
agcugcaacacaugauuuuuaca

SEQ ID NO: 49274 - RNA, 23 nt, Artificial Sequence
  RNA Oligomer
gggauauauucuccaggaaaugc

SEQ ID NO: 49275 - RNA, 23 nt, Artificial Sequence
  RNA Oligomer
ggauauauucuccaggaaaugca

SEQ ID NO: 49276 - RNA, 23 nt, Artificial Sequence
  RNA Oligomer
gauauauucuccaggaaaugcau

SEQ ID NO: 49277 - RNA, 23 nt, Artificial Sequence
  RNA Oligomer
auauauucuccaggaaaugcauu

SEQ ID NO: 49278 - RNA, 23 nt, Artificial Sequence
  RNA Oligomer
acagcuaaacagaauucuucauu

SEQ ID NO: 49279 - RNA, 23 nt, Artificial Sequence
  RNA Oligomer
cagcuaaacagaauucuucauua

SEQ ID NO: 49280 - RNA, 23 nt, Artificial Sequence
  RNA Oligomer
auagcaguucuguucaaaaucuc

SEQ ID NO: 49281 - RNA, 23 nt, Artificial Sequence
  RNA Oligomer
caaagacugauccaaagagcuga

SEQ ID NO: 49282 - RNA, 23 nt, Artificial Sequence
  RNA Oligomer
aaagacugauccaaagagcugag

SEQ ID NO: 49283 - RNA, 23 nt, Artificial Sequence
  RNA Oligomer
aagacugauccaaagagcugagc

SEQ ID NO: 49284 - RNA, 23 nt, Artificial Sequence
  RNA Oligomer
agacugauccaaagagcugagcu

SEQ ID NO: 49285 - RNA, 23 nt, Artificial Sequence
  RNA Oligomer
gacugauccaaagagcugagcug

SEQ ID NO: 49286 - RNA, 23 nt, Artificial Sequence
  RNA Oligomer
acugauccaaagagcugagcugc

SEQ ID NO: 49287 - RNA, 23 nt, Artificial Sequence
  RNA Oligomer
cugauccaaagagcugagcugcu

SEQ ID NO: 49288 - RNA, 23 nt, Artificial Sequence
  RNA Oligomer
guacaauguuaugucgggaacac

SEQ ID NO: 49289 - RNA, 23 nt, Artificial Sequence
  RNA Oligomer
cauaggagagcaagugucugcac

SEQ ID NO: 49290 - RNA, 23 nt, Artificial Sequence
  RNA Oligomer
auaggagagcaagugucugcacc

SEQ ID NO: 49291 - RNA, 23 nt, Artificial Sequence
  RNA Oligomer
ucuuugcaaaguucagugcucgg

SEQ ID NO: 49292 - RNA, 23 nt, Artificial Sequence
  RNA Oligomer
cuuugcaaaguucagugcucggu

SEQ ID NO: 49293 - RNA, 23 nt, Artificial Sequence
  RNA Oligomer
uuugcaaaguucagugcucggug

SEQ ID NO: 49294 - RNA, 23 nt, Artificial Sequence
  RNA Oligomer
cgagcacuccagguauuuuacag

SEQ ID NO: 49295 - RNA, 23 nt, Artificial Sequence
  RNA Oligomer
cuccagguauuuuacagcaccaa

SEQ ID NO: 49296 - RNA, 23 nt, Artificial Sequence
  RNA Oligomer
uccagguauuuuacagcaccaau

SEQ ID NO: 49297 - RNA, 23 nt, Artificial Sequence
  RNA Oligomer
aaucuucuuguccagcuguaucc

SEQ ID NO: 49298 - RNA, 23 nt, Artificial Sequence
  RNA Oligomer
aucuucuuguccagcuguauccc

SEQ ID NO: 49299 - RNA, 23 nt, Artificial Sequence
  RNA Oligomer
ucuucuuguccagcuguauccca

SEQ ID NO: 49300 - RNA, 23 nt, Artificial Sequence
  RNA Oligomer
cuucuuguccagcuguaucccau

SEQ ID NO: 49301 - RNA, 23 nt, Artificial Sequence
  RNA Oligomer
uucuuguccagcuguaucccaua

SEQ ID NO: 49302 - RNA, 23 nt, Artificial Sequence
  RNA Oligomer
guuaagaagguucauaguuuaag

SEQ ID NO: 49303 - RNA, 23 nt, Artificial Sequence
  RNA Oligomer
uuaagaagguucauaguuuaaga

SEQ ID NO: 49304 - RNA, 23 nt, Artificial Sequence
  RNA Oligomer
uaagaagguucauaguuuaagaa

SEQ ID NO: 49305 - RNA, 23 nt, Artificial Sequence
  RNA Oligomer
aagaagguucauaguuuaagaau

SEQ ID NO: 49306 - RNA, 23 nt, Artificial Sequence
  RNA Oligomer
agaagguucauaguuuaagaauu

SEQ ID NO: 49307 - RNA, 23 nt, Artificial Sequence
  RNA Oligomer
ucuguucaaaaucuccgcaaaag

SEQ ID NO: 49308 - RNA, 23 nt, Artificial Sequence
  RNA Oligomer
uacaauguuaugucgggaacacg

SEQ ID NO: 49309 - RNA, 23 nt, Artificial Sequence
  RNA Oligomer
ccuccuaacugcagaagcuaccg

SEQ ID NO: 49310 - RNA, 23 nt, Artificial Sequence
  RNA Oligomer
acaaaaaguuggcauugagugcg

SEQ ID NO: 49311 - RNA, 23 nt, Artificial Sequence
  RNA Oligomer
caaaaaguuggcauugagugcga

SEQ ID NO: 49312 - RNA, 23 nt, Artificial Sequence
  RNA Oligomer
aaaaaguuggcauugagugcgaa

SEQ ID NO: 49313 - RNA, 23 nt, Artificial Sequence
  RNA Oligomer
cuucgucaaacacugucuugagg

SEQ ID NO: 49314 - RNA, 23 nt, Artificial Sequence
  RNA Oligomer
uucgucaaacacugucuugaggc

SEQ ID NO: 49315 - RNA, 23 nt, Artificial Sequence
  RNA Oligomer
cagcuucuucuccuucaguuucu

SEQ ID NO: 49316 - RNA, 23 nt, Artificial Sequence
  RNA Oligomer
agcuucuucuccuucaguuucuc

SEQ ID NO: 49317 - RNA, 23 nt, Artificial Sequence
  RNA Oligomer
gcuucuucuccuucaguuucucg

SEQ ID NO: 49318 - RNA, 23 nt, Artificial Sequence
  RNA Oligomer
cuucuucuccuucaguuucucga

SEQ ID NO: 49319 - RNA, 23 nt, Artificial Sequence
  RNA Oligomer
uucuucuccuucaguuucucgau

SEQ ID NO: 49320 - RNA, 23 nt, Artificial Sequence
  RNA Oligomer
ucgugucuuuaucaucccuaaga

SEQ ID NO: 49321 - RNA, 23 nt, Artificial Sequence
  RNA Oligomer
gucauacaugcaaaacauaaugc

SEQ ID NO: 49322 - RNA, 23 nt, Artificial Sequence
  RNA Oligomer
ucauacaugcaaaacauaaugcu

SEQ ID NO: 49323 - RNA, 23 nt, Artificial Sequence
  RNA Oligomer
cauacaugcaaaacauaaugcua

SEQ ID NO: 49324 - RNA, 23 nt, Artificial Sequence
  RNA Oligomer
auacaugcaaaacauaaugcuaa

SEQ ID NO: 49325 - RNA, 23 nt, Artificial Sequence
  RNA Oligomer
uacaugcaaaacauaaugcuaau

SEQ ID NO: 49326 - RNA, 23 nt, Artificial Sequence
  RNA Oligomer
acauuggcagaauaauugucaaa

SEQ ID NO: 49327 - RNA, 23 nt, Artificial Sequence
  RNA Oligomer
auaggcaaagcgacuacaggagg

SEQ ID NO: 49328 - RNA, 23 nt, Artificial Sequence
  RNA Oligomer
aaacuauaaagcugcaacacaug

SEQ ID NO: 49329 - RNA, 23 nt, Artificial Sequence
  RNA Oligomer
acaguagggauauauucuccagg

SEQ ID NO: 49330 - RNA, 23 nt, Artificial Sequence
  RNA Oligomer
caguagggauauauucuccagga

SEQ ID NO: 49331 - RNA, 23 nt, Artificial Sequence
  RNA Oligomer
aguagggauauauucuccaggaa

SEQ ID NO: 49332 - RNA, 23 nt, Artificial Sequence
  RNA Oligomer
guagggauauauucuccaggaaa

SEQ ID NO: 49333 - RNA, 23 nt, Artificial Sequence
  RNA Oligomer
uagggauauauucuccaggaaau

SEQ ID NO: 49334 - RNA, 23 nt, Artificial Sequence
  RNA Oligomer
ccggcacacccacagcuaaacag

SEQ ID NO: 49335 - RNA, 23 nt, Artificial Sequence
  RNA Oligomer
cggcacacccacagcuaaacaga

SEQ ID NO: 49336 - RNA, 23 nt, Artificial Sequence
  RNA Oligomer
ggcacacccacagcuaaacagaa

SEQ ID NO: 49337 - RNA, 23 nt, Artificial Sequence
  RNA Oligomer
gcacacccacagcuaaacagaau

SEQ ID NO: 49338 - RNA, 23 nt, Artificial Sequence
  RNA Oligomer
cacacccacagcuaaacagaauu

SEQ ID NO: 49339 - RNA, 23 nt, Artificial Sequence
  RNA Oligomer
cuguucaaaaucuccgcaaaagc

SEQ ID NO: 49340 - RNA, 23 nt, Artificial Sequence
  RNA Oligomer
uguucaaaaucuccgcaaaagcu

SEQ ID NO: 49341 - RNA, 23 nt, Artificial Sequence
  RNA Oligomer
guucaaaaucuccgcaaaagcug

SEQ ID NO: 49342 - RNA, 23 nt, Artificial Sequence
  RNA Oligomer
uucaaaaucuccgcaaaagcugg

SEQ ID NO: 49343 - RNA, 23 nt, Artificial Sequence
  RNA Oligomer
cacaaagacugauccaaagagcu

SEQ ID NO: 49344 - RNA, 23 nt, Artificial Sequence
  RNA Oligomer
acaaagacugauccaaagagcug

SEQ ID NO: 49345 - RNA, 23 nt, Artificial Sequence
  RNA Oligomer
acgcucacuccauuacaguacaa

SEQ ID NO: 49346 - RNA, 23 nt, Artificial Sequence
  RNA Oligomer
cgcucacuccauuacaguacaau

SEQ ID NO: 49347 - RNA, 23 nt, Artificial Sequence
  RNA Oligomer
gcucacuccauuacaguacaaug

SEQ ID NO: 49348 - RNA, 23 nt, Artificial Sequence
  RNA Oligomer
ucaauggcaacgcuucauucggg

SEQ ID NO: 49349 - RNA, 23 nt, Artificial Sequence
  RNA Oligomer
caauggcaacgcuucauucggga

SEQ ID NO: 49350 - RNA, 23 nt, Artificial Sequence
  RNA Oligomer
aauggcaacgcuucauucgggag

SEQ ID NO: 49351 - RNA, 23 nt, Artificial Sequence
  RNA Oligomer
aguguaguucagaagguauuuug

SEQ ID NO: 49352 - RNA, 23 nt, Artificial Sequence
  RNA Oligomer
guguaguucagaagguauuuugg

SEQ ID NO: 49353 - RNA, 23 nt, Artificial Sequence
  RNA Oligomer
uguaguucagaagguauuuuggc

SEQ ID NO: 49354 - RNA, 23 nt, Artificial Sequence
  RNA Oligomer
guaguucagaagguauuuuggca

SEQ ID NO: 49355 - RNA, 23 nt, Artificial Sequence
  RNA Oligomer
uaguucagaagguauuuuggcaa

SEQ ID NO: 49356 - RNA, 23 nt, Artificial Sequence
  RNA Oligomer
ucagaagguauuuuggcaacucu

SEQ ID NO: 49357 - RNA, 23 nt, Artificial Sequence
  RNA Oligomer
cagaagguauuuuggcaacucuu

SEQ ID NO: 49358 - RNA, 23 nt, Artificial Sequence
  RNA Oligomer
agaagguauuuuggcaacucuua

SEQ ID NO: 49359 - RNA, 23 nt, Artificial Sequence
  RNA Oligomer
gaagguauuuuggcaacucuuaa

SEQ ID NO: 49360 - RNA, 23 nt, Artificial Sequence
  RNA Oligomer
aagguauuuuggcaacucuuaau

SEQ ID NO: 49361 - RNA, 23 nt, Artificial Sequence
  RNA Oligomer
uaggcaaagcgacuacaggaggc

SEQ ID NO: 49362 - RNA, 23 nt, Artificial Sequence
  RNA Oligomer
aagagggucaguauuggucaagu

SEQ ID NO: 49363 - RNA, 23 nt, Artificial Sequence
  RNA Oligomer
agcuaaacagaauucuucauuag

SEQ ID NO: 49364 - RNA, 23 nt, Artificial Sequence
  RNA Oligomer
gcuguucugcuuuacgcaucuga

SEQ ID NO: 49365 - RNA, 23 nt, Artificial Sequence
  RNA Oligomer
cuguucugcuuuacgcaucugag

SEQ ID NO: 49366 - RNA, 23 nt, Artificial Sequence
  RNA Oligomer
uguucugcuuuacgcaucugaga

SEQ ID NO: 49367 - RNA, 23 nt, Artificial Sequence
  RNA Oligomer
guucugcuuuacgcaucugagaa

SEQ ID NO: 49368 - RNA, 23 nt, Artificial Sequence
  RNA Oligomer
uucugcuuuacgcaucugagaac

SEQ ID NO: 49369 - RNA, 23 nt, Artificial Sequence
  RNA Oligomer
aguucagaagguauuuuggcaac

SEQ ID NO: 49370 - RNA, 23 nt, Artificial Sequence
  RNA Oligomer
guucagaagguauuuuggcaacu

SEQ ID NO: 49371 - RNA, 23 nt, Artificial Sequence
  RNA Oligomer
uucagaagguauuuuggcaacuc

SEQ ID NO: 49372 - RNA, 23 nt, Artificial Sequence
  RNA Oligomer
ucgucaaacacugucuugaggcc

SEQ ID NO: 49373 - RNA, 23 nt, Artificial Sequence
  RNA Oligomer
ggugaugggagucagcuucuucu

SEQ ID NO: 49374 - RNA, 23 nt, Artificial Sequence
  RNA Oligomer
gugaugggagucagcuucuucuc

SEQ ID NO: 49375 - RNA, 23 nt, Artificial Sequence
  RNA Oligomer
ugaugggagucagcuucuucucc

SEQ ID NO: 49376 - RNA, 23 nt, Artificial Sequence
  RNA Oligomer
gaugggagucagcuucuucuccu

SEQ ID NO: 49377 - RNA, 23 nt, Artificial Sequence
  RNA Oligomer
augggagucagcuucuucuccuu

SEQ ID NO: 49378 - RNA, 23 nt, Artificial Sequence
  RNA Oligomer
cagauucaccgguuuuccaucua

SEQ ID NO: 49379 - RNA, 23 nt, Artificial Sequence
  RNA Oligomer
agauucaccgguuuuccaucuac

SEQ ID NO: 49380 - RNA, 23 nt, Artificial Sequence
  RNA Oligomer
gauucaccgguuuuccaucuacc

SEQ ID NO: 49381 - RNA, 23 nt, Artificial Sequence
  RNA Oligomer
auucaccgguuuuccaucuacca

SEQ ID NO: 49382 - RNA, 23 nt, Artificial Sequence
  RNA Oligomer
uucaccgguuuuccaucuaccau

SEQ ID NO: 49383 - RNA, 23 nt, Artificial Sequence
  RNA Oligomer
ucaccgguuuuccaucuaccaua

SEQ ID NO: 49384 - RNA, 23 nt, Artificial Sequence
  RNA Oligomer
cauuggcagaauaauugucaaag

SEQ ID NO: 49385 - RNA, 23 nt, Artificial Sequence
  RNA Oligomer
auuggcagaauaauugucaaaga

SEQ ID NO: 49386 - RNA, 23 nt, Artificial Sequence
  RNA Oligomer
ucaguauuggucaagugacagug

SEQ ID NO: 49387 - RNA, 23 nt, Artificial Sequence
  RNA Oligomer
caguauuggucaagugacagugu

SEQ ID NO: 49388 - RNA, 23 nt, Artificial Sequence
  RNA Oligomer
aguauuggucaagugacaguguc

SEQ ID NO: 49389 - RNA, 23 nt, Artificial Sequence
  RNA Oligomer
guauuggucaagugacagugucg

SEQ ID NO: 49390 - RNA, 23 nt, Artificial Sequence
  RNA Oligomer
uauuggucaagugacagugucgg

SEQ ID NO: 49391 - RNA, 23 nt, Artificial Sequence
  RNA Oligomer
augaauuaaaugcccaauuuggg

SEQ ID NO: 49392 - RNA, 23 nt, Artificial Sequence
  RNA Oligomer
ugaauuaaaugcccaauuugggg

SEQ ID NO: 49393 - RNA, 23 nt, Artificial Sequence
  RNA Oligomer
gaauuaaaugcccaauuugggga

SEQ ID NO: 49394 - RNA, 23 nt, Artificial Sequence
  RNA Oligomer
aauuaaaugcccaauuuggggag

SEQ ID NO: 49395 - RNA, 23 nt, Artificial Sequence
  RNA Oligomer
auuaaaugcccaauuuggggagg

SEQ ID NO: 49396 - RNA, 23 nt, Artificial Sequence
  RNA Oligomer
uuacccgugacacuuucauuccu

SEQ ID NO: 49397 - RNA, 23 nt, Artificial Sequence
  RNA Oligomer
uacccgugacacuuucauuccuu

SEQ ID NO: 49398 - RNA, 23 nt, Artificial Sequence
  RNA Oligomer
acccgugacacuuucauuccuug

SEQ ID NO: 49399 - RNA, 23 nt, Artificial Sequence
  RNA Oligomer
auggcaacgcuucauucgggagg

SEQ ID NO: 49400 - RNA, 23 nt, Artificial Sequence
  RNA Oligomer
uaaucugaacaagaauggggggg

SEQ ID NO: 49401 - RNA, 23 nt, Artificial Sequence
  RNA Oligomer
auaaggcuuuaagaaggcuuguc

SEQ ID NO: 49402 - RNA, 23 nt, Artificial Sequence
  RNA Oligomer
aggcauuuucucuuccucuucuu

SEQ ID NO: 49403 - RNA, 23 nt, Artificial Sequence
  RNA Oligomer
ggcauuuucucuuccucuucuuc

SEQ ID NO: 49404 - RNA, 23 nt, Artificial Sequence
  RNA Oligomer
gcauuuucucuuccucuucuuca

SEQ ID NO: 49405 - RNA, 23 nt, Artificial Sequence
  RNA Oligomer
cauuuucucuuccucuucuucac

SEQ ID NO: 49406 - RNA, 23 nt, Artificial Sequence
  RNA Oligomer
auuuucucuuccucuucuucacg

SEQ ID NO: 49407 - RNA, 23 nt, Artificial Sequence
  RNA Oligomer
uuuucucuuccucuucuucacgg

SEQ ID NO: 49408 - RNA, 23 nt, Artificial Sequence
  RNA Oligomer
gggagucagcuucuucuccuuca

SEQ ID NO: 49409 - RNA, 23 nt, Artificial Sequence
  RNA Oligomer
ggagucagcuucuucuccuucag

SEQ ID NO: 49410 - RNA, 23 nt, Artificial Sequence
  RNA Oligomer
gagucagcuucuucuccuucagu

SEQ ID NO: 49411 - RNA, 23 nt, Artificial Sequence
  RNA Oligomer
agucagcuucuucuccuucaguu

SEQ ID NO: 49412 - RNA, 23 nt, Artificial Sequence
  RNA Oligomer
gucagcuucuucuccuucaguuu

SEQ ID NO: 49413 - RNA, 23 nt, Artificial Sequence
  RNA Oligomer
uaaucuucuuguccagcuguauc

SEQ ID NO: 49414 - RNA, 23 nt, Artificial Sequence
  RNA Oligomer
gaguuaaguuguacagaacaucg

SEQ ID NO: 49415 - RNA, 23 nt, Artificial Sequence
  RNA Oligomer
aguuaaguuguacagaacaucgu

SEQ ID NO: 49416 - RNA, 23 nt, Artificial Sequence
  RNA Oligomer
guuaaguuguacagaacaucguc

SEQ ID NO: 49417 - RNA, 23 nt, Artificial Sequence
  RNA Oligomer
uuaaguuguacagaacaucguca

SEQ ID NO: 49418 - RNA, 23 nt, Artificial Sequence
  RNA Oligomer
auuuuuacaccuaguuacuagaa

SEQ ID NO: 49419 - RNA, 23 nt, Artificial Sequence
  RNA Oligomer
uuuuuacaccuaguuacuagaaa

SEQ ID NO: 49420 - RNA, 23 nt, Artificial Sequence
  RNA Oligomer
uuuuacaccuaguuacuagaaaa

SEQ ID NO: 49421 - RNA, 23 nt, Artificial Sequence
  RNA Oligomer
aggaaaacugcagagaaacagga

SEQ ID NO: 49422 - RNA, 23 nt, Artificial Sequence
  RNA Oligomer
ggaaaacugcagagaaacaggaa

SEQ ID NO: 49423 - RNA, 23 nt, Artificial Sequence
  RNA Oligomer
gaaaacugcagagaaacaggaaa

SEQ ID NO: 49424 - RNA, 23 nt, Artificial Sequence
  RNA Oligomer
aaaacugcagagaaacaggaaau

SEQ ID NO: 49425 - RNA, 23 nt, Artificial Sequence
  RNA Oligomer
aaacugcagagaaacaggaaaug

SEQ ID NO: 49426 - RNA, 23 nt, Artificial Sequence
  RNA Oligomer
gaugaauuaaaugcccaauuugg

SEQ ID NO: 49427 - RNA, 23 nt, Artificial Sequence
  RNA Oligomer
ucuccaggaaaugcauugguugu

SEQ ID NO: 49428 - RNA, 23 nt, Artificial Sequence
  RNA Oligomer
ucacaaagacugauccaaagagc

SEQ ID NO: 49429 - RNA, 23 nt, Artificial Sequence
  RNA Oligomer
uuuuggcaacucuuaaucugaac

SEQ ID NO: 49430 - RNA, 23 nt, Artificial Sequence
  RNA Oligomer
uuuggcaacucuuaaucugaaca

SEQ ID NO: 49431 - RNA, 23 nt, Artificial Sequence
  RNA Oligomer
uaaggcuuuaagaaggcuuguca

SEQ ID NO: 49432 - RNA, 23 nt, Artificial Sequence
  RNA Oligomer
aaggcuuuaagaaggcuugucau

SEQ ID NO: 49433 - RNA, 23 nt, Artificial Sequence
  RNA Oligomer
acaacagcaggcauuuucucuuc

SEQ ID NO: 49434 - RNA, 23 nt, Artificial Sequence
  RNA Oligomer
caggcauuuucucuuccucuucu

SEQ ID NO: 49435 - RNA, 23 nt, Artificial Sequence
  RNA Oligomer
ucuucuccuucaguuucucgauc

SEQ ID NO: 49436 - RNA, 23 nt, Artificial Sequence
  RNA Oligomer
cuucuccuucaguuucucgaucg

SEQ ID NO: 49437 - RNA, 23 nt, Artificial Sequence
  RNA Oligomer
uucuccuucaguuucucgaucgu

SEQ ID NO: 49438 - RNA, 23 nt, Artificial Sequence
  RNA Oligomer
gagaaacaggaaauggccgcucc

SEQ ID NO: 49439 - RNA, 23 nt, Artificial Sequence
  RNA Oligomer
agaaacaggaaauggccgcucca

SEQ ID NO: 49440 - RNA, 23 nt, Artificial Sequence
  RNA Oligomer
gaacaucgucagcacuagcacag

SEQ ID NO: 49441 - RNA, 23 nt, Artificial Sequence
  RNA Oligomer
aacaucgucagcacuagcacagu

SEQ ID NO: 49442 - RNA, 23 nt, Artificial Sequence
  RNA Oligomer
acaucgucagcacuagcacaguu

SEQ ID NO: 49443 - RNA, 23 nt, Artificial Sequence
  RNA Oligomer
caucgucagcacuagcacaguuu

SEQ ID NO: 49444 - RNA, 23 nt, Artificial Sequence
  RNA Oligomer
aucgucagcacuagcacaguuua

SEQ ID NO: 49445 - RNA, 23 nt, Artificial Sequence
  RNA Oligomer
uuuauaauacaaggaggcauauu

SEQ ID NO: 49446 - RNA, 23 nt, Artificial Sequence
  RNA Oligomer
aagacaguagggauauauucucc

SEQ ID NO: 49447 - RNA, 23 nt, Artificial Sequence
  RNA Oligomer
agacaguagggauauauucucca

SEQ ID NO: 49448 - RNA, 23 nt, Artificial Sequence
  RNA Oligomer
gacaguagggauauauucuccag

SEQ ID NO: 49449 - RNA, 23 nt, Artificial Sequence
  RNA Oligomer
caccacacacuugauggccugca

SEQ ID NO: 49450 - RNA, 23 nt, Artificial Sequence
  RNA Oligomer
accacacacuugauggccugcau

SEQ ID NO: 49451 - RNA, 23 nt, Artificial Sequence
  RNA Oligomer
ccacacacuugauggccugcauc

SEQ ID NO: 49452 - RNA, 23 nt, Artificial Sequence
  RNA Oligomer
cacacacuugauggccugcauca

SEQ ID NO: 49453 - RNA, 23 nt, Artificial Sequence
  RNA Oligomer
acacacuugauggccugcaucag

SEQ ID NO: 49454 - RNA, 23 nt, Artificial Sequence
  RNA Oligomer
ucuccuucaguuucucgaucgug

SEQ ID NO: 49455 - RNA, 23 nt, Artificial Sequence
  RNA Oligomer
uuccaucuaccauaacauuggca

SEQ ID NO: 49456 - RNA, 23 nt, Artificial Sequence
  RNA Oligomer
uccaucuaccauaacauuggcag

SEQ ID NO: 49457 - RNA, 23 nt, Artificial Sequence
  RNA Oligomer
ccaucuaccauaacauuggcaga

SEQ ID NO: 49458 - RNA, 23 nt, Artificial Sequence
  RNA Oligomer
caucuaccauaacauuggcagaa

SEQ ID NO: 49459 - RNA, 23 nt, Artificial Sequence
  RNA Oligomer
aucuaccauaacauuggcagaau

SEQ ID NO: 49460 - RNA, 23 nt, Artificial Sequence
  RNA Oligomer
aauugucaaagacaguagggaua

SEQ ID NO: 49461 - RNA, 23 nt, Artificial Sequence
  RNA Oligomer
acgcuucauucgggaggcuguuc

SEQ ID NO: 49462 - RNA, 23 nt, Artificial Sequence
  RNA Oligomer
cgcuucauucgggaggcuguucu

SEQ ID NO: 49463 - RNA, 23 nt, Artificial Sequence
  RNA Oligomer
gcuucauucgggaggcuguucug

SEQ ID NO: 49464 - RNA, 23 nt, Artificial Sequence
  RNA Oligomer
cuucauucgggaggcuguucugc

SEQ ID NO: 49465 - RNA, 23 nt, Artificial Sequence
  RNA Oligomer
uucauucgggaggcuguucugcu

SEQ ID NO: 49466 - RNA, 23 nt, Artificial Sequence
  RNA Oligomer
aacugcagaagcuaccgucuucu

SEQ ID NO: 49467 - RNA, 23 nt, Artificial Sequence
  RNA Oligomer
guacaaagguuccaagggacagg

SEQ ID NO: 49468 - RNA, 23 nt, Artificial Sequence
  RNA Oligomer
uacaaagguuccaagggacagga

SEQ ID NO: 49469 - RNA, 23 nt, Artificial Sequence
  RNA Oligomer
acaaagguuccaagggacaggac

SEQ ID NO: 49470 - RNA, 23 nt, Artificial Sequence
  RNA Oligomer
caaagguuccaagggacaggacc

SEQ ID NO: 49471 - RNA, 23 nt, Artificial Sequence
  RNA Oligomer
aaagguuccaagggacaggacca

SEQ ID NO: 49472 - RNA, 23 nt, Artificial Sequence
  RNA Oligomer
ccagauucaccgguuuuccaucu

SEQ ID NO: 49473 - RNA, 23 nt, Artificial Sequence
  RNA Oligomer
aacauaaugcuaauugcauuagc

SEQ ID NO: 49474 - RNA, 23 nt, Artificial Sequence
  RNA Oligomer
acauaaugcuaauugcauuagca

SEQ ID NO: 49475 - RNA, 23 nt, Artificial Sequence
  RNA Oligomer
cauaaugcuaauugcauuagcaa

SEQ ID NO: 49476 - RNA, 23 nt, Artificial Sequence
  RNA Oligomer
auaaugcuaauugcauuagcaaa

SEQ ID NO: 49477 - RNA, 23 nt, Artificial Sequence
  RNA Oligomer
uaaugcuaauugcauuagcaaaa

SEQ ID NO: 49478 - RNA, 23 nt, Artificial Sequence
  RNA Oligomer
cucacagacccaaaggaacauca

SEQ ID NO: 49479 - RNA, 23 nt, Artificial Sequence
  RNA Oligomer
ucacagacccaaaggaacaucaa

SEQ ID NO: 49480 - RNA, 23 nt, Artificial Sequence
  RNA Oligomer
cacagacccaaaggaacaucaau

SEQ ID NO: 49481 - RNA, 23 nt, Artificial Sequence
  RNA Oligomer
acagacccaaaggaacaucaaua

SEQ ID NO: 49482 - RNA, 23 nt, Artificial Sequence
  RNA Oligomer
auuggucaagugacagugucggu

SEQ ID NO: 49483 - RNA, 23 nt, Artificial Sequence
  RNA Oligomer
uuggucaagugacagugucggua

SEQ ID NO: 49484 - RNA, 23 nt, Artificial Sequence
  RNA Oligomer
auugucaaagacaguagggauau

SEQ ID NO: 49485 - RNA, 23 nt, Artificial Sequence
  RNA Oligomer
caaaaucuccgcaaaagcugguc

SEQ ID NO: 49486 - RNA, 23 nt, Artificial Sequence
  RNA Oligomer
aaaaucuccgcaaaagcugguca

SEQ ID NO: 49487 - RNA, 23 nt, Artificial Sequence
  RNA Oligomer
aaaucuccgcaaaagcuggucag

SEQ ID NO: 49488 - RNA, 23 nt, Artificial Sequence
  RNA Oligomer
aaucuccgcaaaagcuggucaga

SEQ ID NO: 49489 - RNA, 23 nt, Artificial Sequence
  RNA Oligomer
aucuccgcaaaagcuggucagaa

SEQ ID NO: 49490 - RNA, 23 nt, Artificial Sequence
  RNA Oligomer
auccaaagagcugagcugcuacg

SEQ ID NO: 49491 - RNA, 23 nt, Artificial Sequence
  RNA Oligomer
uccaaagagcugagcugcuacgc

SEQ ID NO: 49492 - RNA, 23 nt, Artificial Sequence
  RNA Oligomer
ccaaagagcugagcugcuacgcu

SEQ ID NO: 49493 - RNA, 23 nt, Artificial Sequence
  RNA Oligomer
caaagagcugagcugcuacgcuc

SEQ ID NO: 49494 - RNA, 23 nt, Artificial Sequence
  RNA Oligomer
aaagagcugagcugcuacgcuca

SEQ ID NO: 49495 - RNA, 23 nt, Artificial Sequence
  RNA Oligomer
uaacucacuggugaguucaaugg

SEQ ID NO: 49496 - RNA, 23 nt, Artificial Sequence
  RNA Oligomer
aacucacuggugaguucaauggc

SEQ ID NO: 49497 - RNA, 23 nt, Artificial Sequence
  RNA Oligomer
acucacuggugaguucaauggca

SEQ ID NO: 49498 - RNA, 23 nt, Artificial Sequence
  RNA Oligomer
cucacuggugaguucaauggcaa

SEQ ID NO: 49499 - RNA, 23 nt, Artificial Sequence
  RNA Oligomer
ucacuggugaguucaauggcaac

SEQ ID NO: 49500 - RNA, 23 nt, Artificial Sequence
  RNA Oligomer
acuggugaguucaauggcaacgc

SEQ ID NO: 49501 - RNA, 23 nt, Artificial Sequence
  RNA Oligomer
cuggugaguucaauggcaacgcu

SEQ ID NO: 49502 - RNA, 23 nt, Artificial Sequence
  RNA Oligomer
uggugaguucaauggcaacgcuu

SEQ ID NO: 49503 - RNA, 23 nt, Artificial Sequence
  RNA Oligomer
ggugaguucaauggcaacgcuuc

SEQ ID NO: 49504 - RNA, 23 nt, Artificial Sequence
  RNA Oligomer
gugaguucaauggcaacgcuuca

SEQ ID NO: 49505 - RNA, 23 nt, Artificial Sequence
  RNA Oligomer
aggcuguucugcuuuacgcaucu

SEQ ID NO: 49506 - RNA, 23 nt, Artificial Sequence
  RNA Oligomer
ggcuguucugcuuuacgcaucug

SEQ ID NO: 49507 - RNA, 23 nt, Artificial Sequence
  RNA Oligomer
uuaaucuguaacaaaaaguuggc

SEQ ID NO: 49508 - RNA, 23 nt, Artificial Sequence
  RNA Oligomer
uaaucuguaacaaaaaguuggca

SEQ ID NO: 49509 - RNA, 23 nt, Artificial Sequence
  RNA Oligomer
aaucuguaacaaaaaguuggcau

SEQ ID NO: 49510 - RNA, 23 nt, Artificial Sequence
  RNA Oligomer
aucuguaacaaaaaguuggcauu

SEQ ID NO: 49511 - RNA, 23 nt, Artificial Sequence
  RNA Oligomer
ucuguaacaaaaaguuggcauug

SEQ ID NO: 49512 - RNA, 23 nt, Artificial Sequence
  RNA Oligomer
gucaaacacugucuugaggccuc

SEQ ID NO: 49513 - RNA, 23 nt, Artificial Sequence
  RNA Oligomer
ucaaacacugucuugaggccucg

SEQ ID NO: 49514 - RNA, 23 nt, Artificial Sequence
  RNA Oligomer
caaacacugucuugaggccucgc

SEQ ID NO: 49515 - RNA, 23 nt, Artificial Sequence
  RNA Oligomer
aaacacugucuugaggccucgcu

SEQ ID NO: 49516 - RNA, 23 nt, Artificial Sequence
  RNA Oligomer
aacacugucuugaggccucgcug

SEQ ID NO: 49517 - RNA, 23 nt, Artificial Sequence
  RNA Oligomer
aaguuuaguucccacuaggauga

SEQ ID NO: 49518 - RNA, 23 nt, Artificial Sequence
  RNA Oligomer
aguuuaguucccacuaggaugau

SEQ ID NO: 49519 - RNA, 23 nt, Artificial Sequence
  RNA Oligomer
guuuaguucccacuaggaugaug

SEQ ID NO: 49520 - RNA, 23 nt, Artificial Sequence
  RNA Oligomer
uuuaguucccacuaggaugaugg

SEQ ID NO: 49521 - RNA, 23 nt, Artificial Sequence
  RNA Oligomer
uuaguucccacuaggaugauggg

SEQ ID NO: 49522 - RNA, 23 nt, Artificial Sequence
  RNA Oligomer
gaugcaggacucacaagggaaaa

SEQ ID NO: 49523 - RNA, 23 nt, Artificial Sequence
  RNA Oligomer
augcaggacucacaagggaaaag

SEQ ID NO: 49524 - RNA, 23 nt, Artificial Sequence
  RNA Oligomer
acaugcaaaacauaaugcuaauu

SEQ ID NO: 49525 - RNA, 23 nt, Artificial Sequence
  RNA Oligomer
ugaguuaaguuguacagaacauc

SEQ ID NO: 49526 - RNA, 23 nt, Artificial Sequence
  RNA Oligomer
gucaguauuggucaagugacagu

SEQ ID NO: 49527 - RNA, 23 nt, Artificial Sequence
  RNA Oligomer
aggaaagcacuuauuagcucuga

SEQ ID NO: 49528 - RNA, 23 nt, Artificial Sequence
  RNA Oligomer
ggaaagcacuuauuagcucugaa

SEQ ID NO: 49529 - RNA, 23 nt, Artificial Sequence
  RNA Oligomer
gaaagcacuuauuagcucugaau

SEQ ID NO: 49530 - RNA, 23 nt, Artificial Sequence
  RNA Oligomer
aaagcacuuauuagcucugaaua

SEQ ID NO: 49531 - RNA, 23 nt, Artificial Sequence
  RNA Oligomer
gaaacaggaaauggccgcuccac

SEQ ID NO: 49532 - RNA, 23 nt, Artificial Sequence
  RNA Oligomer
aaacaggaaauggccgcuccacu

SEQ ID NO: 49533 - RNA, 23 nt, Artificial Sequence
  RNA Oligomer
uguaguguaaaucuccacuucgu

SEQ ID NO: 49534 - RNA, 23 nt, Artificial Sequence
  RNA Oligomer
guaguguaaaucuccacuucgua

SEQ ID NO: 49535 - RNA, 23 nt, Artificial Sequence
  RNA Oligomer
uaguguaaaucuccacuucguau

SEQ ID NO: 49536 - RNA, 23 nt, Artificial Sequence
  RNA Oligomer
uuggcaacucuuaaucugaacaa

SEQ ID NO: 49537 - RNA, 23 nt, Artificial Sequence
  RNA Oligomer
ucaguaggcaaguuuuaccuaca

SEQ ID NO: 49538 - RNA, 23 nt, Artificial Sequence
  RNA Oligomer
caguaggcaaguuuuaccuacag

SEQ ID NO: 49539 - RNA, 23 nt, Artificial Sequence
  RNA Oligomer
auuaaucuguaacaaaaaguugg

SEQ ID NO: 49540 - RNA, 23 nt, Artificial Sequence
  RNA Oligomer
aagguuccaagggacaggaccaa

SEQ ID NO: 49541 - RNA, 23 nt, Artificial Sequence
  RNA Oligomer
uaguucccacuaggaugauggga

SEQ ID NO: 49542 - RNA, 23 nt, Artificial Sequence
  RNA Oligomer
aguucccacuaggaugaugggag

SEQ ID NO: 49543 - RNA, 23 nt, Artificial Sequence
  RNA Oligomer
guucccacuaggaugaugggagu

SEQ ID NO: 49544 - RNA, 23 nt, Artificial Sequence
  RNA Oligomer
aaagcugaggaaaacugcagaga

SEQ ID NO: 49545 - RNA, 23 nt, Artificial Sequence
  RNA Oligomer
aagcugaggaaaacugcagagaa

SEQ ID NO: 49546 - RNA, 23 nt, Artificial Sequence
  RNA Oligomer
ucuuguccagcuguaucccauaa

SEQ ID NO: 49547 - RNA, 23 nt, Artificial Sequence
  RNA Oligomer
cuguauucucgccagugaguuaa

SEQ ID NO: 49548 - RNA, 23 nt, Artificial Sequence
  RNA Oligomer
uguauucucgccagugaguuaag

SEQ ID NO: 49549 - RNA, 23 nt, Artificial Sequence
  RNA Oligomer
guauucucgccagugaguuaagu

SEQ ID NO: 49550 - RNA, 23 nt, Artificial Sequence
  RNA Oligomer
uauucucgccagugaguuaaguu

SEQ ID NO: 49551 - RNA, 23 nt, Artificial Sequence
  RNA Oligomer
uggucaagugacagugucgguaa

SEQ ID NO: 49552 - RNA, 23 nt, Artificial Sequence
  RNA Oligomer
ucgguaaucuggcaagacaguga

SEQ ID NO: 49553 - RNA, 23 nt, Artificial Sequence
  RNA Oligomer
cgguaaucuggcaagacagugau

SEQ ID NO: 49554 - RNA, 23 nt, Artificial Sequence
  RNA Oligomer
gguaaucuggcaagacagugaug

SEQ ID NO: 49555 - RNA, 23 nt, Artificial Sequence
  RNA Oligomer
guaaucuggcaagacagugaugu

SEQ ID NO: 49556 - RNA, 23 nt, Artificial Sequence
  RNA Oligomer
uaaucuggcaagacagugauguu

SEQ ID NO: 49557 - RNA, 23 nt, Artificial Sequence
  RNA Oligomer
uugucaaagacaguagggauaua

SEQ ID NO: 49558 - RNA, 23 nt, Artificial Sequence
  RNA Oligomer
cccgugacacuuucauuccuugu

SEQ ID NO: 49559 - RNA, 23 nt, Artificial Sequence
  RNA Oligomer
ccgugacacuuucauuccuugua

SEQ ID NO: 49560 - RNA, 23 nt, Artificial Sequence
  RNA Oligomer
uugguuguguaacugaucaguag

SEQ ID NO: 49561 - RNA, 23 nt, Artificial Sequence
  RNA Oligomer
ugguuguguaacugaucaguagg

SEQ ID NO: 49562 - RNA, 23 nt, Artificial Sequence
  RNA Oligomer
gguuguguaacugaucaguaggc

SEQ ID NO: 49563 - RNA, 23 nt, Artificial Sequence
  RNA Oligomer
guuguguaacugaucaguaggca

SEQ ID NO: 49564 - RNA, 23 nt, Artificial Sequence
  RNA Oligomer
uuguguaacugaucaguaggcaa

SEQ ID NO: 49565 - RNA, 23 nt, Artificial Sequence
  RNA Oligomer
uguguaacugaucaguaggcaag

SEQ ID NO: 49566 - RNA, 23 nt, Artificial Sequence
  RNA Oligomer
guguaacugaucaguaggcaagu

SEQ ID NO: 49567 - RNA, 23 nt, Artificial Sequence
  RNA Oligomer
uaggagagcaagugucugcaccu

SEQ ID NO: 49568 - RNA, 23 nt, Artificial Sequence
  RNA Oligomer
uaauagaaugugagucugaacuc

SEQ ID NO: 49569 - RNA, 23 nt, Artificial Sequence
  RNA Oligomer
aauagaaugugagucugaacucu

SEQ ID NO: 49570 - RNA, 23 nt, Artificial Sequence
  RNA Oligomer
uuacugauugguucaaaaaaugg

SEQ ID NO: 49571 - RNA, 23 nt, Artificial Sequence
  RNA Oligomer
aaaaguuggcauugagugcgaag

SEQ ID NO: 49572 - RNA, 23 nt, Artificial Sequence
  RNA Oligomer
aaaguuggcauugagugcgaagg

SEQ ID NO: 49573 - RNA, 23 nt, Artificial Sequence
  RNA Oligomer
aaguuggcauugagugcgaaggc

SEQ ID NO: 49574 - RNA, 23 nt, Artificial Sequence
  RNA Oligomer
aaucuccuuagccauggcuagac

SEQ ID NO: 49575 - RNA, 23 nt, Artificial Sequence
  RNA Oligomer
aucuccuuagccauggcuagacc

SEQ ID NO: 49576 - RNA, 23 nt, Artificial Sequence
  RNA Oligomer
ucuccuuagccauggcuagaccc

SEQ ID NO: 49577 - RNA, 23 nt, Artificial Sequence
  RNA Oligomer
cuccuuagccauggcuagacccu

SEQ ID NO: 49578 - RNA, 23 nt, Artificial Sequence
  RNA Oligomer
uccuuagccauggcuagacccug

SEQ ID NO: 49579 - RNA, 23 nt, Artificial Sequence
  RNA Oligomer
ucaaguuuaguucccacuaggau

SEQ ID NO: 49580 - RNA, 23 nt, Artificial Sequence
  RNA Oligomer
caaguuuaguucccacuaggaug

SEQ ID NO: 49581 - RNA, 23 nt, Artificial Sequence
  RNA Oligomer
cuuguccagcuguaucccauaag

SEQ ID NO: 49582 - RNA, 23 nt, Artificial Sequence
  RNA Oligomer
uuguccagcuguaucccauaagc

SEQ ID NO: 49583 - RNA, 23 nt, Artificial Sequence
  RNA Oligomer
aaugcuaauugcauuagcaaaag

SEQ ID NO: 49584 - RNA, 23 nt, Artificial Sequence
  RNA Oligomer
augcuaauugcauuagcaaaaga

SEQ ID NO: 49585 - RNA, 23 nt, Artificial Sequence
  RNA Oligomer
ugcuaauugcauuagcaaaagau

SEQ ID NO: 49586 - RNA, 23 nt, Artificial Sequence
  RNA Oligomer
gcuaauugcauuagcaaaagauc

SEQ ID NO: 49587 - RNA, 23 nt, Artificial Sequence
  RNA Oligomer
cuaauugcauuagcaaaagauca

SEQ ID NO: 49588 - RNA, 23 nt, Artificial Sequence
  RNA Oligomer
ugaggaaaacugcagagaaacag

SEQ ID NO: 49589 - RNA, 23 nt, Artificial Sequence
  RNA Oligomer
gaggaaaacugcagagaaacagg

SEQ ID NO: 49590 - RNA, 23 nt, Artificial Sequence
  RNA Oligomer
uuuacaccuaguuacuagaaaac

SEQ ID NO: 49591 - RNA, 23 nt, Artificial Sequence
  RNA Oligomer
aagcacuuauuagcucugaauaa

SEQ ID NO: 49592 - RNA, 23 nt, Artificial Sequence
  RNA Oligomer
agggauauauucuccaggaaaug

SEQ ID NO: 49593 - RNA, 23 nt, Artificial Sequence
  RNA Oligomer
ucaucuacugcauuugacagaaa

SEQ ID NO: 49594 - RNA, 23 nt, Artificial Sequence
  RNA Oligomer
caucuacugcauuugacagaaau

SEQ ID NO: 49595 - RNA, 23 nt, Artificial Sequence
  RNA Oligomer
aucuacugcauuugacagaaauu

SEQ ID NO: 49596 - RNA, 23 nt, Artificial Sequence
  RNA Oligomer
cuccaggaaaugcauugguugug

SEQ ID NO: 49597 - RNA, 23 nt, Artificial Sequence
  RNA Oligomer
ucaaaaucuccgcaaaagcuggu

SEQ ID NO: 49598 - RNA, 23 nt, Artificial Sequence
  RNA Oligomer
ugcauugguuguguaacugauca

SEQ ID NO: 49599 - RNA, 23 nt, Artificial Sequence
  RNA Oligomer
gcauugguuguguaacugaucag

SEQ ID NO: 49600 - RNA, 23 nt, Artificial Sequence
  RNA Oligomer
cauugguuguguaacugaucagu

SEQ ID NO: 49601 - RNA, 23 nt, Artificial Sequence
  RNA Oligomer
auugguuguguaacugaucagua

SEQ ID NO: 49602 - RNA, 23 nt, Artificial Sequence
  RNA Oligomer
ucauucgggaggcuguucugcuu

SEQ ID NO: 49603 - RNA, 23 nt, Artificial Sequence
  RNA Oligomer
cgggaggcuguucugcuuuacgc

SEQ ID NO: 49604 - RNA, 23 nt, Artificial Sequence
  RNA Oligomer
gggaggcuguucugcuuuacgca

SEQ ID NO: 49605 - RNA, 23 nt, Artificial Sequence
  RNA Oligomer
ggaggcuguucugcuuuacgcau

SEQ ID NO: 49606 - RNA, 23 nt, Artificial Sequence
  RNA Oligomer
gaggcuguucugcuuuacgcauc

SEQ ID NO: 49607 - RNA, 23 nt, Artificial Sequence
  RNA Oligomer
uguaacugaucaguaggcaaguu

SEQ ID NO: 49608 - RNA, 23 nt, Artificial Sequence
  RNA Oligomer
guaacugaucaguaggcaaguuu

SEQ ID NO: 49609 - RNA, 23 nt, Artificial Sequence
  RNA Oligomer
uaacugaucaguaggcaaguuuu

SEQ ID NO: 49610 - RNA, 23 nt, Artificial Sequence
  RNA Oligomer
cgcuuuugaaaaauaaggcuuua

SEQ ID NO: 49611 - RNA, 23 nt, Artificial Sequence
  RNA Oligomer
aaggcuugucauuuuagggcuaa

SEQ ID NO: 49612 - RNA, 23 nt, Artificial Sequence
  RNA Oligomer
aggcuugucauuuuagggcuaaa

SEQ ID NO: 49613 - RNA, 23 nt, Artificial Sequence
  RNA Oligomer
cuuccucuucuucacgggaggcg

SEQ ID NO: 49614 - RNA, 23 nt, Artificial Sequence
  RNA Oligomer
uuccucuucuucacgggaggcgg

SEQ ID NO: 49615 - RNA, 23 nt, Artificial Sequence
  RNA Oligomer
aauucuucauuagaggaaauagc

SEQ ID NO: 49616 - RNA, 23 nt, Artificial Sequence
  RNA Oligomer
gaggaaauagcaguucuguucaa

SEQ ID NO: 49617 - RNA, 23 nt, Artificial Sequence
  RNA Oligomer
aggaaauagcaguucuguucaaa

SEQ ID NO: 49618 - RNA, 23 nt, Artificial Sequence
  RNA Oligomer
ggaaauagcaguucuguucaaaa

SEQ ID NO: 49619 - RNA, 23 nt, Artificial Sequence
  RNA Oligomer
gaaauagcaguucuguucaaaau

SEQ ID NO: 49620 - RNA, 23 nt, Artificial Sequence
  RNA Oligomer
aaauagcaguucuguucaaaauc

SEQ ID NO: 49621 - RNA, 23 nt, Artificial Sequence
  RNA Oligomer
uccaggaaaugcauugguugugu

SEQ ID NO: 49622 - RNA, 23 nt, Artificial Sequence
  RNA Oligomer
ccaggaaaugcauugguugugua

SEQ ID NO: 49623 - RNA, 23 nt, Artificial Sequence
  RNA Oligomer
caggaaaugcauugguuguguaa

SEQ ID NO: 49624 - RNA, 23 nt, Artificial Sequence
  RNA Oligomer
aggaaaugcauugguuguguaac

SEQ ID NO: 49625 - RNA, 23 nt, Artificial Sequence
  RNA Oligomer
ucuccgcaaaagcuggucagaaa

SEQ ID NO: 49626 - RNA, 23 nt, Artificial Sequence
  RNA Oligomer
aggcuuuaagaaggcuugucauu

SEQ ID NO: 49627 - RNA, 23 nt, Artificial Sequence
  RNA Oligomer
ggcuuuaagaaggcuugucauuu

SEQ ID NO: 49628 - RNA, 23 nt, Artificial Sequence
  RNA Oligomer
uagaaugugagucugaacucuua

SEQ ID NO: 49629 - RNA, 23 nt, Artificial Sequence
  RNA Oligomer
agaaugugagucugaacucuuac

SEQ ID NO: 49630 - RNA, 23 nt, Artificial Sequence
  RNA Oligomer
gaaugugagucugaacucuuaca

SEQ ID NO: 49631 - RNA, 23 nt, Artificial Sequence
  RNA Oligomer
aaugugagucugaacucuuacau

SEQ ID NO: 49632 - RNA, 23 nt, Artificial Sequence
  RNA Oligomer
augugagucugaacucuuacauu

SEQ ID NO: 49633 - RNA, 23 nt, Artificial Sequence
  RNA Oligomer
ugcggauaggugaugggagucag

SEQ ID NO: 49634 - RNA, 23 nt, Artificial Sequence
  RNA Oligomer
gcggauaggugaugggagucagc

SEQ ID NO: 49635 - RNA, 23 nt, Artificial Sequence
  RNA Oligomer
cggauaggugaugggagucagcu

SEQ ID NO: 49636 - RNA, 23 nt, Artificial Sequence
  RNA Oligomer
ggauaggugaugggagucagcuu

SEQ ID NO: 49637 - RNA, 23 nt, Artificial Sequence
  RNA Oligomer
gauaggugaugggagucagcuuc

SEQ ID NO: 49638 - RNA, 23 nt, Artificial Sequence
  RNA Oligomer
auaggugaugggagucagcuucu

SEQ ID NO: 49639 - RNA, 23 nt, Artificial Sequence
  RNA Oligomer
ucuaccauaacauuggcagaaua

SEQ ID NO: 49640 - RNA, 23 nt, Artificial Sequence
  RNA Oligomer
cuaccauaacauuggcagaauaa

SEQ ID NO: 49641 - RNA, 23 nt, Artificial Sequence
  RNA Oligomer
uaccauaacauuggcagaauaau

SEQ ID NO: 49642 - RNA, 23 nt, Artificial Sequence
  RNA Oligomer
uacuaaguuagcgacuaacagaa

SEQ ID NO: 49643 - RNA, 23 nt, Artificial Sequence
  RNA Oligomer
acuaaguuagcgacuaacagaac

SEQ ID NO: 49644 - RNA, 23 nt, Artificial Sequence
  RNA Oligomer
cuaaguuagcgacuaacagaaca

SEQ ID NO: 49645 - RNA, 23 nt, Artificial Sequence
  RNA Oligomer
aguguaaaucuccacuucguauu

SEQ ID NO: 49646 - RNA, 23 nt, Artificial Sequence
  RNA Oligomer
guguaaaucuccacuucguauuu

SEQ ID NO: 49647 - RNA, 23 nt, Artificial Sequence
  RNA Oligomer
agaggaaauagcaguucuguuca

SEQ ID NO: 49648 - RNA, 23 nt, Artificial Sequence
  RNA Oligomer
cacuggugaguucaauggcaacg

SEQ ID NO: 49649 - RNA, 23 nt, Artificial Sequence
  RNA Oligomer
uaccgucuucucaaagacgaagg

SEQ ID NO: 49650 - RNA, 23 nt, Artificial Sequence
  RNA Oligomer
accgucuucucaaagacgaaggu

SEQ ID NO: 49651 - RNA, 23 nt, Artificial Sequence
  RNA Oligomer
ccgucuucucaaagacgaagguc

SEQ ID NO: 49652 - RNA, 23 nt, Artificial Sequence
  RNA Oligomer
cgucuucucaaagacgaaggucu

SEQ ID NO: 49653 - RNA, 23 nt, Artificial Sequence
  RNA Oligomer
gucuucucaaagacgaaggucuu

SEQ ID NO: 49654 - RNA, 23 nt, Artificial Sequence
  RNA Oligomer
ucuucucaaagacgaaggucuuu

SEQ ID NO: 49655 - RNA, 23 nt, Artificial Sequence
  RNA Oligomer
cuucucaaagacgaaggucuuug

SEQ ID NO: 49656 - RNA, 23 nt, Artificial Sequence
  RNA Oligomer
uucucaaagacgaaggucuuugc

SEQ ID NO: 49657 - RNA, 23 nt, Artificial Sequence
  RNA Oligomer
ucucaaagacgaaggucuuugca

SEQ ID NO: 49658 - RNA, 23 nt, Artificial Sequence
  RNA Oligomer
cucaaagacgaaggucuuugcaa

SEQ ID NO: 49659 - RNA, 23 nt, Artificial Sequence
  RNA Oligomer
ucaaagacgaaggucuuugcaaa

SEQ ID NO: 49660 - RNA, 23 nt, Artificial Sequence
  RNA Oligomer
caaagacgaaggucuuugcaaag

SEQ ID NO: 49661 - RNA, 23 nt, Artificial Sequence
  RNA Oligomer
gcuuuugaaaaauaaggcuuuaa

SEQ ID NO: 49662 - RNA, 23 nt, Artificial Sequence
  RNA Oligomer
caaucuccuuagccauggcuaga

SEQ ID NO: 49663 - RNA, 23 nt, Artificial Sequence
  RNA Oligomer
ucccacuaggaugaugggagugu

SEQ ID NO: 49664 - RNA, 23 nt, Artificial Sequence
  RNA Oligomer
cccacuaggaugaugggaguguu

SEQ ID NO: 49665 - RNA, 23 nt, Artificial Sequence
  RNA Oligomer
uggcaagacagugauguuaagaa

SEQ ID NO: 49666 - RNA, 23 nt, Artificial Sequence
  RNA Oligomer
ggcaagacagugauguuaagaag

SEQ ID NO: 49667 - RNA, 23 nt, Artificial Sequence
  RNA Oligomer
gcaagacagugauguuaagaagg

SEQ ID NO: 49668 - RNA, 23 nt, Artificial Sequence
  RNA Oligomer
caagacagugauguuaagaaggu

SEQ ID NO: 49669 - RNA, 23 nt, Artificial Sequence
  RNA Oligomer
aagacagugauguuaagaagguu

SEQ ID NO: 49670 - RNA, 23 nt, Artificial Sequence
  RNA Oligomer
ggaaaugcauugguuguguaacu

SEQ ID NO: 49671 - RNA, 23 nt, Artificial Sequence
  RNA Oligomer
agcuggucagaaaacucgcuaug

SEQ ID NO: 49672 - RNA, 23 nt, Artificial Sequence
  RNA Oligomer
cgguguucucggcacaacaaugc

SEQ ID NO: 49673 - RNA, 23 nt, Artificial Sequence
  RNA Oligomer
gguguucucggcacaacaaugca

SEQ ID NO: 49674 - RNA, 23 nt, Artificial Sequence
  RNA Oligomer
guguucucggcacaacaaugcag

SEQ ID NO: 49675 - RNA, 23 nt, Artificial Sequence
  RNA Oligomer
uguucucggcacaacaaugcagu

SEQ ID NO: 49676 - RNA, 23 nt, Artificial Sequence
  RNA Oligomer
guucucggcacaacaaugcagug

SEQ ID NO: 49677 - RNA, 23 nt, Artificial Sequence
  RNA Oligomer
cuccagguauuuuacagcaccaa

SEQ ID NO: 49678 - RNA, 23 nt, Artificial Sequence
  RNA Oligomer
uccagguauuuuacagcaccaau

SEQ ID NO: 49679 - RNA, 23 nt, Artificial Sequence
  RNA Oligomer
ccagguauuuuacagcaccaauc

SEQ ID NO: 49680 - RNA, 23 nt, Artificial Sequence
  RNA Oligomer
cagguauuuuacagcaccaaucu

SEQ ID NO: 49681 - RNA, 23 nt, Artificial Sequence
  RNA Oligomer
agguauuuuacagcaccaaucuc

SEQ ID NO: 49682 - RNA, 23 nt, Artificial Sequence
  RNA Oligomer
uaccacuuugcacggacauuuuc

SEQ ID NO: 49683 - RNA, 23 nt, Artificial Sequence
  RNA Oligomer
aagggaaaagcaaauuaagaaca

SEQ ID NO: 49684 - RNA, 23 nt, Artificial Sequence
  RNA Oligomer
agggaaaagcaaauuaagaacac

SEQ ID NO: 49685 - RNA, 23 nt, Artificial Sequence
  RNA Oligomer
ugguucaaaaaaugguuuuaugg

SEQ ID NO: 49686 - RNA, 23 nt, Artificial Sequence
  RNA Oligomer
agaugaauuaaaugcccaauuug

SEQ ID NO: 49687 - RNA, 23 nt, Artificial Sequence
  RNA Oligomer
acacccacagcuaaacagaauuc

SEQ ID NO: 49688 - RNA, 23 nt, Artificial Sequence
  RNA Oligomer
acucgcuaugaaaucacaaagac

SEQ ID NO: 49689 - RNA, 23 nt, Artificial Sequence
  RNA Oligomer
auggcagguguaagagaaaggaa

SEQ ID NO: 49690 - RNA, 23 nt, Artificial Sequence
  RNA Oligomer
ugacagaaauuaaccuuuuagag

SEQ ID NO: 49691 - RNA, 23 nt, Artificial Sequence
  RNA Oligomer
uguaucccauaagcccagauuca

SEQ ID NO: 49692 - RNA, 23 nt, Artificial Sequence
  RNA Oligomer
acacuccacaauucugcaacugu

SEQ ID NO: 49693 - RNA, 23 nt, Artificial Sequence
  RNA Oligomer
cauggcagguguaagagaaagga

SEQ ID NO: 49694 - RNA, 23 nt, Artificial Sequence
  RNA Oligomer
gacagaaauuaaccuuuuagagu

SEQ ID NO: 49695 - RNA, 23 nt, Artificial Sequence
  RNA Oligomer
uaucccauaagcccagauucacc

SEQ ID NO: 49696 - RNA, 23 nt, Artificial Sequence
  RNA Oligomer
ucgucagcacuagcacaguuuac

SEQ ID NO: 49697 - RNA, 23 nt, Artificial Sequence
  RNA Oligomer
ggaaaagcuuaagaaaacauuuc

SEQ ID NO: 49698 - RNA, 23 nt, Artificial Sequence
  RNA Oligomer
gguucaaaaaaugguuuuaugga

SEQ ID NO: 49699 - RNA, 23 nt, Artificial Sequence
  RNA Oligomer
uuucucgaucgugucuuuaucau

SEQ ID NO: 49700 - RNA, 23 nt, Artificial Sequence
  RNA Oligomer
uucucggcacaacaaugcagugu

SEQ ID NO: 49701 - RNA, 23 nt, Artificial Sequence
  RNA Oligomer
aggauuuauuaagucauacaugc

SEQ ID NO: 49702 - RNA, 23 nt, Artificial Sequence
  RNA Oligomer
ucagcuucuucuccuucaguuuc

SEQ ID NO: 49703 - RNA, 23 nt, Artificial Sequence
  RNA Oligomer
uuacaccuaguuacuagaaaacu

SEQ ID NO: 49704 - RNA, 23 nt, Artificial Sequence
  RNA Oligomer
uacaccuaguuacuagaaaacua

SEQ ID NO: 49705 - RNA, 23 nt, Artificial Sequence
  RNA Oligomer
aaagcugcaacacaugauuuuua

SEQ ID NO: 49706 - RNA, 23 nt, Artificial Sequence
  RNA Oligomer
aaacuaaggaaagcacuuauuag

SEQ ID NO: 49707 - RNA, 23 nt, Artificial Sequence
  RNA Oligomer
augcaaaacauaaugcuaauugc

SEQ ID NO: 49708 - RNA, 23 nt, Artificial Sequence
  RNA Oligomer
gcaaaagaucaauguaaaaacac

SEQ ID NO: 49709 - RNA, 23 nt, Artificial Sequence
  RNA Oligomer
aaaugcauugguuguguaacuga

SEQ ID NO: 49710 - RNA, 23 nt, Artificial Sequence
  RNA Oligomer
cuuguacaauguaguguaaaucu

SEQ ID NO: 49711 - RNA, 23 nt, Artificial Sequence
  RNA Oligomer
gaauucuucauuagaggaaauag

SEQ ID NO: 49712 - RNA, 23 nt, Artificial Sequence
  RNA Oligomer
uugcacggacauuuucaaaugau

SEQ ID NO: 49713 - RNA, 23 nt, Artificial Sequence
  RNA Oligomer
aagugacagugucgguaaucugg

SEQ ID NO: 49714 - RNA, 23 nt, Artificial Sequence
  RNA Oligomer
aaacagaauucuucauuagagga

SEQ ID NO: 49715 - RNA, 23 nt, Artificial Sequence
  RNA Oligomer
aagugucugcaccuccuaacugc

SEQ ID NO: 49716 - RNA, 23 nt, Artificial Sequence
  RNA Oligomer
ugaagggucccacgcuguauucu

SEQ ID NO: 49717 - RNA, 23 nt, Artificial Sequence
  RNA Oligomer
uacugcauuugacagaaauuaac

SEQ ID NO: 49718 - RNA, 23 nt, Artificial Sequence
  RNA Oligomer
cacuucguauuuugucaaaauac

SEQ ID NO: 49719 - RNA, 23 nt, Artificial Sequence
  RNA Oligomer
aauagcaguucuguucaaaaucu

SEQ ID NO: 49720 - RNA, 23 nt, Artificial Sequence
  RNA Oligomer
aacugcagagaaacaggaaaugg

SEQ ID NO: 49721 - RNA, 23 nt, Artificial Sequence
  RNA Oligomer
uaggugaugggagucagcuucuu

SEQ ID NO: 49722 - RNA, 23 nt, Artificial Sequence
  RNA Oligomer
ucaagugacagugucgguaaucu

SEQ ID NO: 49723 - RNA, 23 nt, Artificial Sequence
  RNA Oligomer
cguauuuugucaaaauacugucu

SEQ ID NO: 49724 - RNA, 23 nt, Artificial Sequence
  RNA Oligomer
cuaaacagaauucuucauuagag

SEQ ID NO: 49725 - RNA, 23 nt, Artificial Sequence
  RNA Oligomer
uaaacagaauucuucauuagagg

SEQ ID NO: 49726 - RNA, 23 nt, Artificial Sequence
  RNA Oligomer
caugcaaaacauaaugcuaauug

SEQ ID NO: 49727 - RNA, 23 nt, Artificial Sequence
  RNA Oligomer
aaugcauugguuguguaacugau

SEQ ID NO: 49728 - RNA, 23 nt, Artificial Sequence
  RNA Oligomer
ugggagucagcuucuucuccuuc

SEQ ID NO: 49729 - RNA, 23 nt, Artificial Sequence
  RNA Oligomer
agagggucaguauuggucaagug

SEQ ID NO: 49730 - RNA, 23 nt, Artificial Sequence
  RNA Oligomer
aacagaauucuucauuagaggaa

SEQ ID NO: 49731 - RNA, 23 nt, Artificial Sequence
  RNA Oligomer
aagcccagauucaccgguuuucc

SEQ ID NO: 49732 - RNA, 23 nt, Artificial Sequence
  RNA Oligomer
gagggucaguauuggucaaguga

SEQ ID NO: 49733 - RNA, 23 nt, Artificial Sequence
  RNA Oligomer
uaacagaacaaccaguuuaaaga

SEQ ID NO: 49734 - RNA, 23 nt, Artificial Sequence
  RNA Oligomer
aagcuaccgucuucucaaagacg

SEQ ID NO: 49735 - RNA, 23 nt, Artificial Sequence
  RNA Oligomer
agggucaguauuggucaagugac

SEQ ID NO: 49736 - RNA, 23 nt, Artificial Sequence
  RNA Oligomer
cagugucgguaaucuggcaagac

SEQ ID NO: 49737 - RNA, 23 nt, Artificial Sequence
  RNA Oligomer
aacugaucaguaggcaaguuuua

SEQ ID NO: 49738 - RNA, 23 nt, Artificial Sequence
  RNA Oligomer
uaggcaaguuuuaccuacagcuc

SEQ ID NO: 49739 - RNA, 23 nt, Artificial Sequence
  RNA Oligomer
aauguuaugucgggaacacgugc

SEQ ID NO: 49740 - RNA, 23 nt, Artificial Sequence
  RNA Oligomer
caccuccuaacugcagaagcuac

SEQ ID NO: 49741 - RNA, 23 nt, Artificial Sequence
  RNA Oligomer
agcccagauucaccgguuuucca

SEQ ID NO: 49742 - RNA, 23 nt, Artificial Sequence
  RNA Oligomer
ugcaaaacauaaugcuaauugca

SEQ ID NO: 49743 - RNA, 23 nt, Artificial Sequence
  RNA Oligomer
agugacagugucgguaaucuggc

SEQ ID NO: 49744 - RNA, 23 nt, Artificial Sequence
  RNA Oligomer
aguaggcaaguuuuaccuacagc

SEQ ID NO: 49745 - RNA, 23 nt, Artificial Sequence
  RNA Oligomer
auguuaugucgggaacacgugcu

SEQ ID NO: 49746 - RNA, 23 nt, Artificial Sequence
  RNA Oligomer
cugcagaagcuaccgucuucuca

SEQ ID NO: 49747 - RNA, 23 nt, Artificial Sequence
  RNA Oligomer
cucggcacaacaaugcaguguag

SEQ ID NO: 49748 - RNA, 23 nt, Artificial Sequence
  RNA Oligomer
aguuggcauugagugcgaaggcu

SEQ ID NO: 49749 - RNA, 23 nt, Artificial Sequence
  RNA Oligomer
ucucgaucgugucuuuaucaucc

SEQ ID NO: 49750 - RNA, 23 nt, Artificial Sequence
  RNA Oligomer
uccauuacaguacaauguuaugu

SEQ ID NO: 49751 - RNA, 23 nt, Artificial Sequence
  RNA Oligomer
aaagacgaaggucuuugcaaagu

SEQ ID NO: 49752 - RNA, 23 nt, Artificial Sequence
  RNA Oligomer
aaucuggcaagacagugauguua

SEQ ID NO: 49753 - RNA, 23 nt, Artificial Sequence
  RNA Oligomer
aaggaggcauauugcucagucag

SEQ ID NO: 49754 - RNA, 23 nt, Artificial Sequence
  RNA Oligomer
agcuaccgucuucucaaagacga

SEQ ID NO: 49755 - RNA, 23 nt, Artificial Sequence
  RNA Oligomer
uacaaggaggcauauugcucagu

SEQ ID NO: 49756 - RNA, 23 nt, Artificial Sequence
  RNA Oligomer
ugugagucugaacucuuacauuu

SEQ ID NO: 49757 - RNA, 23 nt, Artificial Sequence
  RNA Oligomer
gcacggacauuuucaaaugaugc

SEQ ID NO: 49758 - RNA, 23 nt, Artificial Sequence
  RNA Oligomer
agcugcuacgcucacuccauuac

SEQ ID NO: 49759 - RNA, 23 nt, Artificial Sequence
  RNA Oligomer
acaauguuaugucgggaacacgu

SEQ ID NO: 49760 - RNA, 23 nt, Artificial Sequence
  RNA Oligomer
ugcaccuccuaacugcagaagcu

SEQ ID NO: 49761 - RNA, 23 nt, Artificial Sequence
  RNA Oligomer
acaaggaggcauauugcucaguc

SEQ ID NO: 49762 - RNA, 23 nt, Artificial Sequence
  RNA Oligomer
caagugucugcaccuccuaacug

SEQ ID NO: 49763 - RNA, 23 nt, Artificial Sequence
  RNA Oligomer
cuaacagaacaaccaguuuaaag

SEQ ID NO: 49764 - RNA, 23 nt, Artificial Sequence
  RNA Oligomer
auucgggaggcuguucugcuuua

SEQ ID NO: 49765 - RNA, 23 nt, Artificial Sequence
  RNA Oligomer
uucccacuaggaugaugggagug

SEQ ID NO: 49766 - RNA, 23 nt, Artificial Sequence
  RNA Oligomer
uguccagcuguaucccauaagcc

SEQ ID NO: 49767 - RNA, 23 nt, Artificial Sequence
  RNA Oligomer
caaggaggcauauugcucaguca

SEQ ID NO: 49768 - RNA, 23 nt, Artificial Sequence
  RNA Oligomer
uuaugucgggaacacgugcugcu

SEQ ID NO: 49769 - RNA, 23 nt, Artificial Sequence
  RNA Oligomer
uuccaagggacaggaccaagaac

SEQ ID NO: 49770 - RNA, 23 nt, Artificial Sequence
  RNA Oligomer
augucgggaacacgugcugcuaa

SEQ ID NO: 49771 - RNA, 23 nt, Artificial Sequence
  RNA Oligomer
cccaauguuucguauaucuguuc

SEQ ID NO: 49772 - RNA, 23 nt, Artificial Sequence
  RNA Oligomer
acccaauguuucguauaucuguu

SEQ ID NO: 49773 - RNA, 23 nt, Artificial Sequence
  RNA Oligomer
aacccaauguuucguauaucugu

SEQ ID NO: 49774 - RNA, 23 nt, Artificial Sequence
  RNA Oligomer
gaacccaauguuucguauaucug

SEQ ID NO: 49775 - RNA, 23 nt, Artificial Sequence
  RNA Oligomer
agaacccaauguuucguauaucu

SEQ ID NO: 49776 - RNA, 23 nt, Artificial Sequence
  RNA Oligomer
gcaugaaaguuagcagagacaag

SEQ ID NO: 49777 - RNA, 23 nt, Artificial Sequence
  RNA Oligomer
agcaugaaaguuagcagagacaa

SEQ ID NO: 49778 - RNA, 23 nt, Artificial Sequence
  RNA Oligomer
cagcaugaaaguuagcagagaca

SEQ ID NO: 49779 - RNA, 23 nt, Artificial Sequence
  RNA Oligomer
gcagcaugaaaguuagcagagac

SEQ ID NO: 49780 - RNA, 23 nt, Artificial Sequence
  RNA Oligomer
ggcagcaugaaaguuagcagaga

SEQ ID NO: 49781 - RNA, 23 nt, Artificial Sequence
  RNA Oligomer
ccgacuaacaccacuggaagcuu

SEQ ID NO: 49782 - RNA, 23 nt, Artificial Sequence
  RNA Oligomer
cccgacuaacaccacuggaagcu

SEQ ID NO: 49783 - RNA, 23 nt, Artificial Sequence
  RNA Oligomer
gcccgacuaacaccacuggaagc

SEQ ID NO: 49784 - RNA, 23 nt, Artificial Sequence
  RNA Oligomer
ugcccgacuaacaccacuggaag

SEQ ID NO: 49785 - RNA, 23 nt, Artificial Sequence
  RNA Oligomer
cugcccgacuaacaccacuggaa

SEQ ID NO: 49786 - RNA, 23 nt, Artificial Sequence
  RNA Oligomer
ggagaaauauaucgcuuguuuug

SEQ ID NO: 49787 - RNA, 23 nt, Artificial Sequence
  RNA Oligomer
aggagaaauauaucgcuuguuuu

SEQ ID NO: 49788 - RNA, 23 nt, Artificial Sequence
  RNA Oligomer
aaggagaaauauaucgcuuguuu

SEQ ID NO: 49789 - RNA, 23 nt, Artificial Sequence
  RNA Oligomer
gaaggagaaauauaucgcuuguu

SEQ ID NO: 49790 - RNA, 23 nt, Artificial Sequence
  RNA Oligomer
ugaaggagaaauauaucgcuugu

SEQ ID NO: 49791 - RNA, 23 nt, Artificial Sequence
  RNA Oligomer
cccaacauaaagacaaaaggaag

SEQ ID NO: 49792 - RNA, 23 nt, Artificial Sequence
  RNA Oligomer
ccccaacauaaagacaaaaggaa

SEQ ID NO: 49793 - RNA, 23 nt, Artificial Sequence
  RNA Oligomer
accccaacauaaagacaaaagga

SEQ ID NO: 49794 - RNA, 23 nt, Artificial Sequence
  RNA Oligomer
caccccaacauaaagacaaaagg

SEQ ID NO: 49795 - RNA, 23 nt, Artificial Sequence
  RNA Oligomer
acaccccaacauaaagacaaaag

SEQ ID NO: 49796 - RNA, 23 nt, Artificial Sequence
  RNA Oligomer
ccaaaugucaaacuaccaaaugg

SEQ ID NO: 49797 - RNA, 23 nt, Artificial Sequence
  RNA Oligomer
cccaaaugucaaacuaccaaaug

SEQ ID NO: 49798 - RNA, 23 nt, Artificial Sequence
  RNA Oligomer
acccaaaugucaaacuaccaaau

SEQ ID NO: 49799 - RNA, 23 nt, Artificial Sequence
  RNA Oligomer
gacccaaaugucaaacuaccaaa

SEQ ID NO: 49800 - RNA, 23 nt, Artificial Sequence
  RNA Oligomer
ggacccaaaugucaaacuaccaa

SEQ ID NO: 49801 - RNA, 23 nt, Artificial Sequence
  RNA Oligomer
gagaacccaauguuucguauauc

SEQ ID NO: 49802 - RNA, 23 nt, Artificial Sequence
  RNA Oligomer
ggagaacccaauguuucguauau

SEQ ID NO: 49803 - RNA, 23 nt, Artificial Sequence
  RNA Oligomer
aggagaacccaauguuucguaua

SEQ ID NO: 49804 - RNA, 23 nt, Artificial Sequence
  RNA Oligomer
gaggagaacccaauguuucguau

SEQ ID NO: 49805 - RNA, 23 nt, Artificial Sequence
  RNA Oligomer
ggacaagagauuuaagaaucgag

SEQ ID NO: 49806 - RNA, 23 nt, Artificial Sequence
  RNA Oligomer
aggacaagagauuuaagaaucga

SEQ ID NO: 49807 - RNA, 23 nt, Artificial Sequence
  RNA Oligomer
caggacaagagauuuaagaaucg

SEQ ID NO: 49808 - RNA, 23 nt, Artificial Sequence
  RNA Oligomer
gcaggacaagagauuuaagaauc

SEQ ID NO: 49809 - RNA, 23 nt, Artificial Sequence
  RNA Oligomer
ugcaggacaagagauuuaagaau

SEQ ID NO: 49810 - RNA, 23 nt, Artificial Sequence
  RNA Oligomer
ccacaagaagucagcuauacaga

SEQ ID NO: 49811 - RNA, 23 nt, Artificial Sequence
  RNA Oligomer
gccacaagaagucagcuauacag

SEQ ID NO: 49812 - RNA, 23 nt, Artificial Sequence
  RNA Oligomer
ggccacaagaagucagcuauaca

SEQ ID NO: 49813 - RNA, 23 nt, Artificial Sequence
  RNA Oligomer
aggccacaagaagucagcuauac

SEQ ID NO: 49814 - RNA, 23 nt, Artificial Sequence
  RNA Oligomer
caggccacaagaagucagcuaua

SEQ ID NO: 49815 - RNA, 23 nt, Artificial Sequence
  RNA Oligomer
ccauccuuauuccuccucaugcu

SEQ ID NO: 49816 - RNA, 23 nt, Artificial Sequence
  RNA Oligomer
accauccuuauuccuccucaugc

SEQ ID NO: 49817 - RNA, 23 nt, Artificial Sequence
  RNA Oligomer
uaccauccuuauuccuccucaug

SEQ ID NO: 49818 - RNA, 23 nt, Artificial Sequence
  RNA Oligomer
cuaccauccuuauuccuccucau

SEQ ID NO: 49819 - RNA, 23 nt, Artificial Sequence
  RNA Oligomer
gcuaccauccuuauuccuccuca

SEQ ID NO: 49820 - RNA, 23 nt, Artificial Sequence
  RNA Oligomer
cgaggagaacccaauguuucgua

SEQ ID NO: 49821 - RNA, 23 nt, Artificial Sequence
  RNA Oligomer
ccgaggagaacccaauguuucgu

SEQ ID NO: 49822 - RNA, 23 nt, Artificial Sequence
  RNA Oligomer
caccugcacucuucaacuucacc

SEQ ID NO: 49823 - RNA, 23 nt, Artificial Sequence
  RNA Oligomer
acaccugcacucuucaacuucac

SEQ ID NO: 49824 - RNA, 23 nt, Artificial Sequence
  RNA Oligomer
cacaccugcacucuucaacuuca

SEQ ID NO: 49825 - RNA, 23 nt, Artificial Sequence
  RNA Oligomer
acacaccugcacucuucaacuuc

SEQ ID NO: 49826 - RNA, 23 nt, Artificial Sequence
  RNA Oligomer
gacacaccugcacucuucaacuu

SEQ ID NO: 49827 - RNA, 23 nt, Artificial Sequence
  RNA Oligomer
agaacuuaaugcugcauuuaucg

SEQ ID NO: 49828 - RNA, 23 nt, Artificial Sequence
  RNA Oligomer
gagaacuuaaugcugcauuuauc

SEQ ID NO: 49829 - RNA, 23 nt, Artificial Sequence
  RNA Oligomer
ggagaacuuaaugcugcauuuau

SEQ ID NO: 49830 - RNA, 23 nt, Artificial Sequence
  RNA Oligomer
gggagaacuuaaugcugcauuua

SEQ ID NO: 49831 - RNA, 23 nt, Artificial Sequence
  RNA Oligomer
ugggagaacuuaaugcugcauuu

SEQ ID NO: 49832 - RNA, 23 nt, Artificial Sequence
  RNA Oligomer
gugggagaacuuaaugcugcauu

SEQ ID NO: 49833 - RNA, 23 nt, Artificial Sequence
  RNA Oligomer
ugugggagaacuuaaugcugcau

SEQ ID NO: 49834 - RNA, 23 nt, Artificial Sequence
  RNA Oligomer
ccaaacuacacagaauuuaaauu

SEQ ID NO: 49835 - RNA, 23 nt, Artificial Sequence
  RNA Oligomer
cccaaacuacacagaauuuaaau

SEQ ID NO: 49836 - RNA, 23 nt, Artificial Sequence
  RNA Oligomer
acccaaacuacacagaauuuaaa

SEQ ID NO: 49837 - RNA, 23 nt, Artificial Sequence
  RNA Oligomer
aacccaaacuacacagaauuuaa

SEQ ID NO: 49838 - RNA, 23 nt, Artificial Sequence
  RNA Oligomer
gaacccaaacuacacagaauuua

SEQ ID NO: 49839 - RNA, 23 nt, Artificial Sequence
  RNA Oligomer
ggauauuaaaccgcagaaccucu

SEQ ID NO: 49840 - RNA, 23 nt, Artificial Sequence
  RNA Oligomer
gggauauuaaaccgcagaaccuc

SEQ ID NO: 49841 - RNA, 23 nt, Artificial Sequence
  RNA Oligomer
cgggauauuaaaccgcagaaccu

SEQ ID NO: 49842 - RNA, 23 nt, Artificial Sequence
  RNA Oligomer
ucgggauauuaaaccgcagaacc

SEQ ID NO: 49843 - RNA, 23 nt, Artificial Sequence
  RNA Oligomer
aucgggauauuaaaccgcagaac

SEQ ID NO: 49844 - RNA, 23 nt, Artificial Sequence
  RNA Oligomer
gagaaauauaucgcuuguuuugu

SEQ ID NO: 49845 - RNA, 23 nt, Artificial Sequence
  RNA Oligomer
cugucuugaaggagaaauauauc

SEQ ID NO: 49846 - RNA, 23 nt, Artificial Sequence
  RNA Oligomer
ucugucuugaaggagaaauauau

SEQ ID NO: 49847 - RNA, 23 nt, Artificial Sequence
  RNA Oligomer
aucugucuugaaggagaaauaua

SEQ ID NO: 49848 - RNA, 23 nt, Artificial Sequence
  RNA Oligomer
gaucugucuugaaggagaaauau

SEQ ID NO: 49849 - RNA, 23 nt, Artificial Sequence
  RNA Oligomer
cgaucugucuugaaggagaaaua

SEQ ID NO: 49850 - RNA, 23 nt, Artificial Sequence
  RNA Oligomer
ccaacauaaagacaaaaggaaga

SEQ ID NO: 49851 - RNA, 23 nt, Artificial Sequence
  RNA Oligomer
gcauuuaucguuaaccuaacacc

SEQ ID NO: 49852 - RNA, 23 nt, Artificial Sequence
  RNA Oligomer
ugcauuuaucguuaaccuaacac

SEQ ID NO: 49853 - RNA, 23 nt, Artificial Sequence
  RNA Oligomer
cugcauuuaucguuaaccuaaca

SEQ ID NO: 49854 - RNA, 23 nt, Artificial Sequence
  RNA Oligomer
gcugcauuuaucguuaaccuaac

SEQ ID NO: 49855 - RNA, 23 nt, Artificial Sequence
  RNA Oligomer
ugcugcauuuaucguuaaccuaa

SEQ ID NO: 49856 - RNA, 23 nt, Artificial Sequence
  RNA Oligomer
caaaugucaaacuaccaaauggg

SEQ ID NO: 49857 - RNA, 23 nt, Artificial Sequence
  RNA Oligomer
gccacugauuauaccucuaguau

SEQ ID NO: 49858 - RNA, 23 nt, Artificial Sequence
  RNA Oligomer
agccacugauuauaccucuagua

SEQ ID NO: 49859 - RNA, 23 nt, Artificial Sequence
  RNA Oligomer
gagccacugauuauaccucuagu

SEQ ID NO: 49860 - RNA, 23 nt, Artificial Sequence
  RNA Oligomer
ggagccacugauuauaccucuag

SEQ ID NO: 49861 - RNA, 23 nt, Artificial Sequence
  RNA Oligomer
uggagccacugauuauaccucua

SEQ ID NO: 49862 - RNA, 23 nt, Artificial Sequence
  RNA Oligomer
ccaauguuucguauaucuguucu

SEQ ID NO: 49863 - RNA, 23 nt, Artificial Sequence
  RNA Oligomer
gccagcugcacaggaaaaaccac

SEQ ID NO: 49864 - RNA, 23 nt, Artificial Sequence
  RNA Oligomer
agccagcugcacaggaaaaacca

SEQ ID NO: 49865 - RNA, 23 nt, Artificial Sequence
  RNA Oligomer
cagccagcugcacaggaaaaacc

SEQ ID NO: 49866 - RNA, 23 nt, Artificial Sequence
  RNA Oligomer
gcagccagcugcacaggaaaaac

SEQ ID NO: 49867 - RNA, 23 nt, Artificial Sequence
  RNA Oligomer
agcagccagcugcacaggaaaaa

SEQ ID NO: 49868 - RNA, 23 nt, Artificial Sequence
  RNA Oligomer
caagaacugucaaguaauccacc

SEQ ID NO: 49869 - RNA, 23 nt, Artificial Sequence
  RNA Oligomer
ucaagaacugucaaguaauccac

SEQ ID NO: 49870 - RNA, 23 nt, Artificial Sequence
  RNA Oligomer
cucaagaacugucaaguaaucca

SEQ ID NO: 49871 - RNA, 23 nt, Artificial Sequence
  RNA Oligomer
acucaagaacugucaaguaaucc

SEQ ID NO: 49872 - RNA, 23 nt, Artificial Sequence
  RNA Oligomer
cacucaagaacugucaaguaauc

SEQ ID NO: 49873 - RNA, 23 nt, Artificial Sequence
  RNA Oligomer
agacacaccugcacucuucaacu

SEQ ID NO: 49874 - RNA, 23 nt, Artificial Sequence
  RNA Oligomer
gagacacaccugcacucuucaac

SEQ ID NO: 49875 - RNA, 23 nt, Artificial Sequence
  RNA Oligomer
cgagacacaccugcacucuucaa

SEQ ID NO: 49876 - RNA, 23 nt, Artificial Sequence
  RNA Oligomer
ggacauuucaccucaggagugcg

SEQ ID NO: 49877 - RNA, 23 nt, Artificial Sequence
  RNA Oligomer
aggacauuucaccucaggagugc

SEQ ID NO: 49878 - RNA, 23 nt, Artificial Sequence
  RNA Oligomer
caggacauuucaccucaggagug

SEQ ID NO: 49879 - RNA, 23 nt, Artificial Sequence
  RNA Oligomer
acaggacauuucaccucaggagu

SEQ ID NO: 49880 - RNA, 23 nt, Artificial Sequence
  RNA Oligomer
aacaggacauuucaccucaggag

SEQ ID NO: 49881 - RNA, 23 nt, Artificial Sequence
  RNA Oligomer
ccacugauuauaccucuaguaua

SEQ ID NO: 49882 - RNA, 23 nt, Artificial Sequence
  RNA Oligomer
ggaaacaguauacagaguugcca

SEQ ID NO: 49883 - RNA, 23 nt, Artificial Sequence
  RNA Oligomer
cggaaacaguauacagaguugcc

SEQ ID NO: 49884 - RNA, 23 nt, Artificial Sequence
  RNA Oligomer
ccggaaacaguauacagaguugc

SEQ ID NO: 49885 - RNA, 23 nt, Artificial Sequence
  RNA Oligomer
uccggaaacaguauacagaguug

SEQ ID NO: 49886 - RNA, 23 nt, Artificial Sequence
  RNA Oligomer
uuccggaaacaguauacagaguu

SEQ ID NO: 49887 - RNA, 23 nt, Artificial Sequence
  RNA Oligomer
agaaaguauugcaggacaagaga

SEQ ID NO: 49888 - RNA, 23 nt, Artificial Sequence
  RNA Oligomer
aagaaaguauugcaggacaagag

SEQ ID NO: 49889 - RNA, 23 nt, Artificial Sequence
  RNA Oligomer
caagaaaguauugcaggacaaga

SEQ ID NO: 49890 - RNA, 23 nt, Artificial Sequence
  RNA Oligomer
ucaagaaaguauugcaggacaag

SEQ ID NO: 49891 - RNA, 23 nt, Artificial Sequence
  RNA Oligomer
aucaagaaaguauugcaggacaa

SEQ ID NO: 49892 - RNA, 23 nt, Artificial Sequence
  RNA Oligomer
ccaucaagaaaguauugcaggac

SEQ ID NO: 49893 - RNA, 23 nt, Artificial Sequence
  RNA Oligomer
gccaucaagaaaguauugcagga

SEQ ID NO: 49894 - RNA, 23 nt, Artificial Sequence
  RNA Oligomer
cgccaucaagaaaguauugcagg

SEQ ID NO: 49895 - RNA, 23 nt, Artificial Sequence
  RNA Oligomer
ucgccaucaagaaaguauugcag

SEQ ID NO: 49896 - RNA, 23 nt, Artificial Sequence
  RNA Oligomer
gucgccaucaagaaaguauugca

SEQ ID NO: 49897 - RNA, 23 nt, Artificial Sequence
  RNA Oligomer
uugaaggagaaauauaucgcuug

SEQ ID NO: 49898 - RNA, 23 nt, Artificial Sequence
  RNA Oligomer
cuugaaggagaaauauaucgcuu

SEQ ID NO: 49899 - RNA, 23 nt, Artificial Sequence
  RNA Oligomer
ucuugaaggagaaauauaucgcu

SEQ ID NO: 49900 - RNA, 23 nt, Artificial Sequence
  RNA Oligomer
gguauaucaagccaaacuuugug

SEQ ID NO: 49901 - RNA, 23 nt, Artificial Sequence
  RNA Oligomer
ugguauaucaagccaaacuuugu

SEQ ID NO: 49902 - RNA, 23 nt, Artificial Sequence
  RNA Oligomer
gugguauaucaagccaaacuuug

SEQ ID NO: 49903 - RNA, 23 nt, Artificial Sequence
  RNA Oligomer
ugugguauaucaagccaaacuuu

SEQ ID NO: 49904 - RNA, 23 nt, Artificial Sequence
  RNA Oligomer
gugugguauaucaagccaaacuu

SEQ ID NO: 49905 - RNA, 23 nt, Artificial Sequence
  RNA Oligomer
gucuugaaggagaaauauaucgc

SEQ ID NO: 49906 - RNA, 23 nt, Artificial Sequence
  RNA Oligomer
ugucuugaaggagaaauauaucg

SEQ ID NO: 49907 - RNA, 23 nt, Artificial Sequence
  RNA Oligomer
caagaagucagcuauacagacac

SEQ ID NO: 49908 - RNA, 23 nt, Artificial Sequence
  RNA Oligomer
acaagaagucagcuauacagaca

SEQ ID NO: 49909 - RNA, 23 nt, Artificial Sequence
  RNA Oligomer
cacaagaagucagcuauacagac

SEQ ID NO: 49910 - RNA, 23 nt, Artificial Sequence
  RNA Oligomer
cauccuuauuccuccucaugcuc

SEQ ID NO: 49911 - RNA, 23 nt, Artificial Sequence
  RNA Oligomer
gcacucuucaacuucaccacuca

SEQ ID NO: 49912 - RNA, 23 nt, Artificial Sequence
  RNA Oligomer
ugcacucuucaacuucaccacuc

SEQ ID NO: 49913 - RNA, 23 nt, Artificial Sequence
  RNA Oligomer
cugcacucuucaacuucaccacu

SEQ ID NO: 49914 - RNA, 23 nt, Artificial Sequence
  RNA Oligomer
ccugcacucuucaacuucaccac

SEQ ID NO: 49915 - RNA, 23 nt, Artificial Sequence
  RNA Oligomer
accugcacucuucaacuucacca

SEQ ID NO: 49916 - RNA, 23 nt, Artificial Sequence
  RNA Oligomer
ugaacccaaacuacacagaauuu

SEQ ID NO: 49917 - RNA, 23 nt, Artificial Sequence
  RNA Oligomer
ggaucaguugguagaaauaauca

SEQ ID NO: 49918 - RNA, 23 nt, Artificial Sequence
  RNA Oligomer
uggaucaguugguagaaauaauc

SEQ ID NO: 49919 - RNA, 23 nt, Artificial Sequence
  RNA Oligomer
guggaucaguugguagaaauaau

SEQ ID NO: 49920 - RNA, 23 nt, Artificial Sequence
  RNA Oligomer
uguggaucaguugguagaaauaa

SEQ ID NO: 49921 - RNA, 23 nt, Artificial Sequence
  RNA Oligomer
guguggaucaguugguagaaaua

SEQ ID NO: 49922 - RNA, 23 nt, Artificial Sequence
  RNA Oligomer
cugugauuuaugucaaguuguau

SEQ ID NO: 49923 - RNA, 23 nt, Artificial Sequence
  RNA Oligomer
ccugugauuuaugucaaguugua

SEQ ID NO: 49924 - RNA, 23 nt, Artificial Sequence
  RNA Oligomer
cccugugauuuaugucaaguugu

SEQ ID NO: 49925 - RNA, 23 nt, Artificial Sequence
  RNA Oligomer
ucccugugauuuaugucaaguug

SEQ ID NO: 49926 - RNA, 23 nt, Artificial Sequence
  RNA Oligomer
cucccugugauuuaugucaaguu

SEQ ID NO: 49927 - RNA, 23 nt, Artificial Sequence
  RNA Oligomer
ggucgccaucaagaaaguauugc

SEQ ID NO: 49928 - RNA, 23 nt, Artificial Sequence
  RNA Oligomer
uggucgccaucaagaaaguauug

SEQ ID NO: 49929 - RNA, 23 nt, Artificial Sequence
  RNA Oligomer
cuggucgccaucaagaaaguauu

SEQ ID NO: 49930 - RNA, 23 nt, Artificial Sequence
  RNA Oligomer
ccgaucugucuugaaggagaaau

SEQ ID NO: 49931 - RNA, 23 nt, Artificial Sequence
  RNA Oligomer
gccgaucugucuugaaggagaaa

SEQ ID NO: 49932 - RNA, 23 nt, Artificial Sequence
  RNA Oligomer
ugccgaucugucuugaaggagaa

SEQ ID NO: 49933 - RNA, 23 nt, Artificial Sequence
  RNA Oligomer
gugccgaucugucuugaaggaga

SEQ ID NO: 49934 - RNA, 23 nt, Artificial Sequence
  RNA Oligomer
ggcuaccauccuuauuccuccuc

SEQ ID NO: 49935 - RNA, 23 nt, Artificial Sequence
  RNA Oligomer
ccacucaagaacugucaaguaau

SEQ ID NO: 49936 - RNA, 23 nt, Artificial Sequence
  RNA Oligomer
cgacuaacaccacuggaagcuug

SEQ ID NO: 49937 - RNA, 23 nt, Artificial Sequence
  RNA Oligomer
gguguggaucaguugguagaaau

SEQ ID NO: 49938 - RNA, 23 nt, Artificial Sequence
  RNA Oligomer
ggauccugauacugcuguauuaa

SEQ ID NO: 49939 - RNA, 23 nt, Artificial Sequence
  RNA Oligomer
uggauccugauacugcuguauua

SEQ ID NO: 49940 - RNA, 23 nt, Artificial Sequence
  RNA Oligomer
uuggauccugauacugcuguauu

SEQ ID NO: 49941 - RNA, 23 nt, Artificial Sequence
  RNA Oligomer
guuggauccugauacugcuguau

SEQ ID NO: 49942 - RNA, 23 nt, Artificial Sequence
  RNA Oligomer
uguuggauccugauacugcugua

SEQ ID NO: 49943 - RNA, 23 nt, Artificial Sequence
  RNA Oligomer
gccaucgggauauuaaaccgcag

SEQ ID NO: 49944 - RNA, 23 nt, Artificial Sequence
  RNA Oligomer
ugccaucgggauauuaaaccgca

SEQ ID NO: 49945 - RNA, 23 nt, Artificial Sequence
  RNA Oligomer
cugccaucgggauauuaaaccgc

SEQ ID NO: 49946 - RNA, 23 nt, Artificial Sequence
  RNA Oligomer
ucugccaucgggauauuaaaccg

SEQ ID NO: 49947 - RNA, 23 nt, Artificial Sequence
  RNA Oligomer
aucugccaucgggauauuaaacc

SEQ ID NO: 49948 - RNA, 23 nt, Artificial Sequence
  RNA Oligomer
aaucugccaucgggauauuaaac

SEQ ID NO: 49949 - RNA, 23 nt, Artificial Sequence
  RNA Oligomer
gaaucugccaucgggauauuaaa

SEQ ID NO: 49950 - RNA, 23 nt, Artificial Sequence
  RNA Oligomer
ggaaucugccaucgggauauuaa

SEQ ID NO: 49951 - RNA, 23 nt, Artificial Sequence
  RNA Oligomer
uggaaucugccaucgggauauua

SEQ ID NO: 49952 - RNA, 23 nt, Artificial Sequence
  RNA Oligomer
uuggaaucugccaucgggauauu

SEQ ID NO: 49953 - RNA, 23 nt, Artificial Sequence
  RNA Oligomer
uuuggaaucugccaucgggauau

SEQ ID NO: 49954 - RNA, 23 nt, Artificial Sequence
  RNA Oligomer
gcucccugugauuuaugucaagu

SEQ ID NO: 49955 - RNA, 23 nt, Artificial Sequence
  RNA Oligomer
cgcucccugugauuuaugucaag

SEQ ID NO: 49956 - RNA, 23 nt, Artificial Sequence
  RNA Oligomer
acgcucccugugauuuaugucaa

SEQ ID NO: 49957 - RNA, 23 nt, Artificial Sequence
  RNA Oligomer
acacuauagucgagccaaacaga

SEQ ID NO: 49958 - RNA, 23 nt, Artificial Sequence
  RNA Oligomer
gacacuauagucgagccaaacag

SEQ ID NO: 49959 - RNA, 23 nt, Artificial Sequence
  RNA Oligomer
agacacuauagucgagccaaaca

SEQ ID NO: 49960 - RNA, 23 nt, Artificial Sequence
  RNA Oligomer
cagacacuauagucgagccaaac

SEQ ID NO: 49961 - RNA, 23 nt, Artificial Sequence
  RNA Oligomer
ccagacacuauagucgagccaaa

SEQ ID NO: 49962 - RNA, 23 nt, Artificial Sequence
  RNA Oligomer
gaaagcuagaucacuguaacaua

SEQ ID NO: 49963 - RNA, 23 nt, Artificial Sequence
  RNA Oligomer
agaaagcuagaucacuguaacau

SEQ ID NO: 49964 - RNA, 23 nt, Artificial Sequence
  RNA Oligomer
gagaaagcuagaucacuguaaca

SEQ ID NO: 49965 - RNA, 23 nt, Artificial Sequence
  RNA Oligomer
ugagaaagcuagaucacuguaac

SEQ ID NO: 49966 - RNA, 23 nt, Artificial Sequence
  RNA Oligomer
augagaaagcuagaucacuguaa

SEQ ID NO: 49967 - RNA, 23 nt, Artificial Sequence
  RNA Oligomer
guauacaaaaggagugaaaagcc

SEQ ID NO: 49968 - RNA, 23 nt, Artificial Sequence
  RNA Oligomer
aguauacaaaaggagugaaaagc

SEQ ID NO: 49969 - RNA, 23 nt, Artificial Sequence
  RNA Oligomer
uaguauacaaaaggagugaaaag

SEQ ID NO: 49970 - RNA, 23 nt, Artificial Sequence
  RNA Oligomer
auaguauacaaaaggagugaaaa

SEQ ID NO: 49971 - RNA, 23 nt, Artificial Sequence
  RNA Oligomer
uauaguauacaaaaggagugaaa

SEQ ID NO: 49972 - RNA, 23 nt, Artificial Sequence
  RNA Oligomer
cagcuauacagacacuaaaguga

SEQ ID NO: 49973 - RNA, 23 nt, Artificial Sequence
  RNA Oligomer
ucagcuauacagacacuaaagug

SEQ ID NO: 49974 - RNA, 23 nt, Artificial Sequence
  RNA Oligomer
gucagcuauacagacacuaaagu

SEQ ID NO: 49975 - RNA, 23 nt, Artificial Sequence
  RNA Oligomer
agucagcuauacagacacuaaag

SEQ ID NO: 49976 - RNA, 23 nt, Artificial Sequence
  RNA Oligomer
aagucagcuauacagacacuaaa

SEQ ID NO: 49977 - RNA, 23 nt, Artificial Sequence
  RNA Oligomer
ugaaaguuagcagagacaaggac

SEQ ID NO: 49978 - RNA, 23 nt, Artificial Sequence
  RNA Oligomer
augaaaguuagcagagacaagga

SEQ ID NO: 49979 - RNA, 23 nt, Artificial Sequence
  RNA Oligomer
caugaaaguuagcagagacaagg

SEQ ID NO: 49980 - RNA, 23 nt, Artificial Sequence
  RNA Oligomer
ggaaaaaccaccaguuacuugag

SEQ ID NO: 49981 - RNA, 23 nt, Artificial Sequence
  RNA Oligomer
aggaaaaaccaccaguuacuuga

SEQ ID NO: 49982 - RNA, 23 nt, Artificial Sequence
  RNA Oligomer
caggaaaaaccaccaguuacuug

SEQ ID NO: 49983 - RNA, 23 nt, Artificial Sequence
  RNA Oligomer
acaggaaaaaccaccaguuacuu

SEQ ID NO: 49984 - RNA, 23 nt, Artificial Sequence
  RNA Oligomer
cacaggaaaaaccaccaguuacu

SEQ ID NO: 49985 - RNA, 23 nt, Artificial Sequence
  RNA Oligomer
uggcuaccauccuuauuccuccu

SEQ ID NO: 49986 - RNA, 23 nt, Artificial Sequence
  RNA Oligomer
cuggcuaccauccuuauuccucc

SEQ ID NO: 49987 - RNA, 23 nt, Artificial Sequence
  RNA Oligomer
ucuggcuaccauccuuauuccuc

SEQ ID NO: 49988 - RNA, 23 nt, Artificial Sequence
  RNA Oligomer
cucuggcuaccauccuuauuccu

SEQ ID NO: 49989 - RNA, 23 nt, Artificial Sequence
  RNA Oligomer
gggacccaaaugucaaacuacca

SEQ ID NO: 49990 - RNA, 23 nt, Artificial Sequence
  RNA Oligomer
ugaauuacgggacccaaauguca

SEQ ID NO: 49991 - RNA, 23 nt, Artificial Sequence
  RNA Oligomer
augaauuacgggacccaaauguc

SEQ ID NO: 49992 - RNA, 23 nt, Artificial Sequence
  RNA Oligomer
gaugaauuacgggacccaaaugu

SEQ ID NO: 49993 - RNA, 23 nt, Artificial Sequence
  RNA Oligomer
ugaugaauuacgggacccaaaug

SEQ ID NO: 49994 - RNA, 23 nt, Artificial Sequence
  RNA Oligomer
uugaugaauuacgggacccaaau

SEQ ID NO: 49995 - RNA, 23 nt, Artificial Sequence
  RNA Oligomer
augcugcauuuaucguuaaccua

SEQ ID NO: 49996 - RNA, 23 nt, Artificial Sequence
  RNA Oligomer
aaugcugcauuuaucguuaaccu

SEQ ID NO: 49997 - RNA, 23 nt, Artificial Sequence
  RNA Oligomer
gcacauucauuuuuugaugaauu

SEQ ID NO: 49998 - RNA, 23 nt, Artificial Sequence
  RNA Oligomer
ugcacauucauuuuuugaugaau

SEQ ID NO: 49999 - RNA, 23 nt, Artificial Sequence
  RNA Oligomer
gugcacauucauuuuuugaugaa

SEQ ID NO: 50000 - RNA, 23 nt, Artificial Sequence
  RNA Oligomer
ugugcacauucauuuuuugauga

SEQ ID NO: 50001 - RNA, 23 nt, Artificial Sequence
  RNA Oligomer
uugugcacauucauuuuuugaug

SEQ ID NO: 50002 - RNA, 23 nt, Artificial Sequence
  RNA Oligomer
gaacuuaaugcugcauuuaucgu

SEQ ID NO: 50003 - RNA, 23 nt, Artificial Sequence
  RNA Oligomer
augaacccaaacuacacagaauu

SEQ ID NO: 50004 - RNA, 23 nt, Artificial Sequence
  RNA Oligomer
cugugggagaacuuaaugcugca

SEQ ID NO: 50005 - RNA, 23 nt, Artificial Sequence
  RNA Oligomer
ugguagaaauaaucaagguccug

SEQ ID NO: 50006 - RNA, 23 nt, Artificial Sequence
  RNA Oligomer
uugguagaaauaaucaagguccu

SEQ ID NO: 50007 - RNA, 23 nt, Artificial Sequence
  RNA Oligomer
guugguagaaauaaucaaggucc

SEQ ID NO: 50008 - RNA, 23 nt, Artificial Sequence
  RNA Oligomer
aguugguagaaauaaucaagguc

SEQ ID NO: 50009 - RNA, 23 nt, Artificial Sequence
  RNA Oligomer
caguugguagaaauaaucaaggu

SEQ ID NO: 50010 - RNA, 23 nt, Artificial Sequence
  RNA Oligomer
ucaguugguagaaauaaucaagg

SEQ ID NO: 50011 - RNA, 23 nt, Artificial Sequence
  RNA Oligomer
aucaguugguagaaauaaucaag

SEQ ID NO: 50012 - RNA, 23 nt, Artificial Sequence
  RNA Oligomer
gaucaguugguagaaauaaucaa

SEQ ID NO: 50013 - RNA, 23 nt, Artificial Sequence
  RNA Oligomer
ugguguggaucaguugguagaaa

SEQ ID NO: 50014 - RNA, 23 nt, Artificial Sequence
  RNA Oligomer
ugagcuguuacuaggacaaccaa

SEQ ID NO: 50015 - RNA, 23 nt, Artificial Sequence
  RNA Oligomer
cugagcuguuacuaggacaacca

SEQ ID NO: 50016 - RNA, 23 nt, Artificial Sequence
  RNA Oligomer
gcugagcuguuacuaggacaacc

SEQ ID NO: 50017 - RNA, 23 nt, Artificial Sequence
  RNA Oligomer
ggcugagcuguuacuaggacaac

SEQ ID NO: 50018 - RNA, 23 nt, Artificial Sequence
  RNA Oligomer
uggcugagcuguuacuaggacaa

SEQ ID NO: 50019 - RNA, 23 nt, Artificial Sequence
  RNA Oligomer
cuuuggaaucugccaucgggaua

SEQ ID NO: 50020 - RNA, 23 nt, Artificial Sequence
  RNA Oligomer
caaguuguauauguaucagcugu

SEQ ID NO: 50021 - RNA, 23 nt, Artificial Sequence
  RNA Oligomer
ucaaguuguauauguaucagcug

SEQ ID NO: 50022 - RNA, 23 nt, Artificial Sequence
  RNA Oligomer
gucaaguuguauauguaucagcu

SEQ ID NO: 50023 - RNA, 23 nt, Artificial Sequence
  RNA Oligomer
ugucaaguuguauauguaucagc

SEQ ID NO: 50024 - RNA, 23 nt, Artificial Sequence
  RNA Oligomer
augucaaguuguauauguaucag

SEQ ID NO: 50025 - RNA, 23 nt, Artificial Sequence
  RNA Oligomer
gacgcucccugugauuuauguca

SEQ ID NO: 50026 - RNA, 23 nt, Artificial Sequence
  RNA Oligomer
agacgcucccugugauuuauguc

SEQ ID NO: 50027 - RNA, 23 nt, Artificial Sequence
  RNA Oligomer
cagacgcucccugugauuuaugu

SEQ ID NO: 50028 - RNA, 23 nt, Artificial Sequence
  RNA Oligomer
acagacgcucccugugauuuaug

SEQ ID NO: 50029 - RNA, 23 nt, Artificial Sequence
  RNA Oligomer
aacagacgcucccugugauuuau

SEQ ID NO: 50030 - RNA, 23 nt, Artificial Sequence
  RNA Oligomer
cuaucuuaaucuggugcuggacu

SEQ ID NO: 50031 - RNA, 23 nt, Artificial Sequence
  RNA Oligomer
ucuaucuuaaucuggugcuggac

SEQ ID NO: 50032 - RNA, 23 nt, Artificial Sequence
  RNA Oligomer
gucuaucuuaaucuggugcugga

SEQ ID NO: 50033 - RNA, 23 nt, Artificial Sequence
  RNA Oligomer
ggucuaucuuaaucuggugcugg

SEQ ID NO: 50034 - RNA, 23 nt, Artificial Sequence
  RNA Oligomer
aggucuaucuuaaucuggugcug

SEQ ID NO: 50035 - RNA, 23 nt, Artificial Sequence
  RNA Oligomer
gaggucuaucuuaaucuggugcu

SEQ ID NO: 50036 - RNA, 23 nt, Artificial Sequence
  RNA Oligomer
ugaggucuaucuuaaucuggugc

SEQ ID NO: 50037 - RNA, 23 nt, Artificial Sequence
  RNA Oligomer
augaggucuaucuuaaucuggug

SEQ ID NO: 50038 - RNA, 23 nt, Artificial Sequence
  RNA Oligomer
gaugaggucuaucuuaaucuggu

SEQ ID NO: 50039 - RNA, 23 nt, Artificial Sequence
  RNA Oligomer
agaugaggucuaucuuaaucugg

SEQ ID NO: 50040 - RNA, 23 nt, Artificial Sequence
  RNA Oligomer
aagaugaggucuaucuuaaucug

SEQ ID NO: 50041 - RNA, 23 nt, Artificial Sequence
  RNA Oligomer
acuggucgccaucaagaaaguau

SEQ ID NO: 50042 - RNA, 23 nt, Artificial Sequence
  RNA Oligomer
cgaagagagugaucaugucaggg

SEQ ID NO: 50043 - RNA, 23 nt, Artificial Sequence
  RNA Oligomer
gcgaagagagugaucaugucagg

SEQ ID NO: 50044 - RNA, 23 nt, Artificial Sequence
  RNA Oligomer
cgcgaagagagugaucaugucag

SEQ ID NO: 50045 - RNA, 23 nt, Artificial Sequence
  RNA Oligomer
ucgcgaagagagugaucauguca

SEQ ID NO: 50046 - RNA, 23 nt, Artificial Sequence
  RNA Oligomer
uucgcgaagagagugaucauguc

SEQ ID NO: 50047 - RNA, 23 nt, Artificial Sequence
  RNA Oligomer
cgugccgaucugucuugaaggag

SEQ ID NO: 50048 - RNA, 23 nt, Artificial Sequence
  RNA Oligomer
ccgugccgaucugucuugaagga

SEQ ID NO: 50049 - RNA, 23 nt, Artificial Sequence
  RNA Oligomer
ggaaaaggugauucgcgaagaga

SEQ ID NO: 50050 - RNA, 23 nt, Artificial Sequence
  RNA Oligomer
aggaaaaggugauucgcgaagag

SEQ ID NO: 50051 - RNA, 23 nt, Artificial Sequence
  RNA Oligomer
aaggaaaaggugauucgcgaaga

SEQ ID NO: 50052 - RNA, 23 nt, Artificial Sequence
  RNA Oligomer
gaaggaaaaggugauucgcgaag

SEQ ID NO: 50053 - RNA, 23 nt, Artificial Sequence
  RNA Oligomer
ggaaggaaaaggugauucgcgaa

SEQ ID NO: 50054 - RNA, 23 nt, Artificial Sequence
  RNA Oligomer
gaaggaaggaaaaggugauucgc

SEQ ID NO: 50055 - RNA, 23 nt, Artificial Sequence
  RNA Oligomer
ggaaggaaggaaaaggugauucg

SEQ ID NO: 50056 - RNA, 23 nt, Artificial Sequence
  RNA Oligomer
aggaaggaaggaaaaggugauuc

SEQ ID NO: 50057 - RNA, 23 nt, Artificial Sequence
  RNA Oligomer
gaggaaggaaggaaaaggugauu

SEQ ID NO: 50058 - RNA, 23 nt, Artificial Sequence
  RNA Oligomer
ggaggaaggaaggaaaaggugau

SEQ ID NO: 50059 - RNA, 23 nt, Artificial Sequence
  RNA Oligomer
gaccaauaaugcugcuucugcau

SEQ ID NO: 50060 - RNA, 23 nt, Artificial Sequence
  RNA Oligomer
agaccaauaaugcugcuucugca

SEQ ID NO: 50061 - RNA, 23 nt, Artificial Sequence
  RNA Oligomer
cagaccaauaaugcugcuucugc

SEQ ID NO: 50062 - RNA, 23 nt, Artificial Sequence
  RNA Oligomer
acagaccaauaaugcugcuucug

SEQ ID NO: 50063 - RNA, 23 nt, Artificial Sequence
  RNA Oligomer
gacagaccaauaaugcugcuucu

SEQ ID NO: 50064 - RNA, 23 nt, Artificial Sequence
  RNA Oligomer
ccuuauuccuccucaugcucgga

SEQ ID NO: 50065 - RNA, 23 nt, Artificial Sequence
  RNA Oligomer
uccuuauuccuccucaugcucgg

SEQ ID NO: 50066 - RNA, 23 nt, Artificial Sequence
  RNA Oligomer
auccuuauuccuccucaugcucg

SEQ ID NO: 50067 - RNA, 23 nt, Artificial Sequence
  RNA Oligomer
cucuucaacuucaccacucaaga

SEQ ID NO: 50068 - RNA, 23 nt, Artificial Sequence
  RNA Oligomer
acucuucaacuucaccacucaag

SEQ ID NO: 50069 - RNA, 23 nt, Artificial Sequence
  RNA Oligomer
cacucuucaacuucaccacucaa

SEQ ID NO: 50070 - RNA, 23 nt, Artificial Sequence
  RNA Oligomer
acaccaacugcccgacuaacacc

SEQ ID NO: 50071 - RNA, 23 nt, Artificial Sequence
  RNA Oligomer
uacaccaacugcccgacuaacac

SEQ ID NO: 50072 - RNA, 23 nt, Artificial Sequence
  RNA Oligomer
auacaccaacugcccgacuaaca

SEQ ID NO: 50073 - RNA, 23 nt, Artificial Sequence
  RNA Oligomer
uauacaccaacugcccgacuaac

SEQ ID NO: 50074 - RNA, 23 nt, Artificial Sequence
  RNA Oligomer
guauacaccaacugcccgacuaa

SEQ ID NO: 50075 - RNA, 23 nt, Artificial Sequence
  RNA Oligomer
gucaggaacaggacauuucaccu

SEQ ID NO: 50076 - RNA, 23 nt, Artificial Sequence
  RNA Oligomer
cgucaggaacaggacauuucacc

SEQ ID NO: 50077 - RNA, 23 nt, Artificial Sequence
  RNA Oligomer
ucgucaggaacaggacauuucac

SEQ ID NO: 50078 - RNA, 23 nt, Artificial Sequence
  RNA Oligomer
uucgucaggaacaggacauuuca

SEQ ID NO: 50079 - RNA, 23 nt, Artificial Sequence
  RNA Oligomer
auucgucaggaacaggacauuuc

SEQ ID NO: 50080 - RNA, 23 nt, Artificial Sequence
  RNA Oligomer
agggagcaaaucagagaaaugaa

SEQ ID NO: 50081 - RNA, 23 nt, Artificial Sequence
  RNA Oligomer
aagggagcaaaucagagaaauga

SEQ ID NO: 50082 - RNA, 23 nt, Artificial Sequence
  RNA Oligomer
caagggagcaaaucagagaaaug

SEQ ID NO: 50083 - RNA, 23 nt, Artificial Sequence
  RNA Oligomer
acaagggagcaaaucagagaaau

SEQ ID NO: 50084 - RNA, 23 nt, Artificial Sequence
  RNA Oligomer
aacaagggagcaaaucagagaaa

SEQ ID NO: 50085 - RNA, 23 nt, Artificial Sequence
  RNA Oligomer
gguagaaauaaucaagguccugg

SEQ ID NO: 50086 - RNA, 23 nt, Artificial Sequence
  RNA Oligomer
cuguauuaaaacucugugacuuu

SEQ ID NO: 50087 - RNA, 23 nt, Artificial Sequence
  RNA Oligomer
gcuguauuaaaacucugugacuu

SEQ ID NO: 50088 - RNA, 23 nt, Artificial Sequence
  RNA Oligomer
ugcuguauuaaaacucugugacu

SEQ ID NO: 50089 - RNA, 23 nt, Artificial Sequence
  RNA Oligomer
cugcuguauuaaaacucugugac

SEQ ID NO: 50090 - RNA, 23 nt, Artificial Sequence
  RNA Oligomer
acugcuguauuaaaacucuguga

SEQ ID NO: 50091 - RNA, 23 nt, Artificial Sequence
  RNA Oligomer
uacugcuguauuaaaacucugug

SEQ ID NO: 50092 - RNA, 23 nt, Artificial Sequence
  RNA Oligomer
aaacagacgcucccugugauuua

SEQ ID NO: 50093 - RNA, 23 nt, Artificial Sequence
  RNA Oligomer
caucaagaaaguauugcaggaca

SEQ ID NO: 50094 - RNA, 23 nt, Artificial Sequence
  RNA Oligomer
aggaaggaaaaggugauucgcga

SEQ ID NO: 50095 - RNA, 23 nt, Artificial Sequence
  RNA Oligomer
aaggaaggaaaaggugauucgcg

SEQ ID NO: 50096 - RNA, 23 nt, Artificial Sequence
  RNA Oligomer
ccagcugcacaggaaaaaccacc

SEQ ID NO: 50097 - RNA, 23 nt, Artificial Sequence
  RNA Oligomer
ggacagaccaauaaugcugcuuc

SEQ ID NO: 50098 - RNA, 23 nt, Artificial Sequence
  RNA Oligomer
uggacagaccaauaaugcugcuu

SEQ ID NO: 50099 - RNA, 23 nt, Artificial Sequence
  RNA Oligomer
guggacagaccaauaaugcugcu

SEQ ID NO: 50100 - RNA, 23 nt, Artificial Sequence
  RNA Oligomer
cguggacagaccaauaaugcugc

SEQ ID NO: 50101 - RNA, 23 nt, Artificial Sequence
  RNA Oligomer
ccguggacagaccaauaaugcug

SEQ ID NO: 50102 - RNA, 23 nt, Artificial Sequence
  RNA Oligomer
caacuucaccacucaagaacugu

SEQ ID NO: 50103 - RNA, 23 nt, Artificial Sequence
  RNA Oligomer
ucaacuucaccacucaagaacug

SEQ ID NO: 50104 - RNA, 23 nt, Artificial Sequence
  RNA Oligomer
uucaacuucaccacucaagaacu

SEQ ID NO: 50105 - RNA, 23 nt, Artificial Sequence
  RNA Oligomer
cuucaacuucaccacucaagaac

SEQ ID NO: 50106 - RNA, 23 nt, Artificial Sequence
  RNA Oligomer
ucuucaacuucaccacucaagaa

SEQ ID NO: 50107 - RNA, 23 nt, Artificial Sequence
  RNA Oligomer
cauuuaucguuaaccuaacaccc

SEQ ID NO: 50108 - RNA, 23 nt, Artificial Sequence
  RNA Oligomer
cuggaagcuugugcacauucauu

SEQ ID NO: 50109 - RNA, 23 nt, Artificial Sequence
  RNA Oligomer
acuggaagcuugugcacauucau

SEQ ID NO: 50110 - RNA, 23 nt, Artificial Sequence
  RNA Oligomer
cacuggaagcuugugcacauuca

SEQ ID NO: 50111 - RNA, 23 nt, Artificial Sequence
  RNA Oligomer
ccacuggaagcuugugcacauuc

SEQ ID NO: 50112 - RNA, 23 nt, Artificial Sequence
  RNA Oligomer
accacuggaagcuugugcacauu

SEQ ID NO: 50113 - RNA, 23 nt, Artificial Sequence
  RNA Oligomer
ggauucgucaggaacaggacauu

SEQ ID NO: 50114 - RNA, 23 nt, Artificial Sequence
  RNA Oligomer
aggauucgucaggaacaggacau

SEQ ID NO: 50115 - RNA, 23 nt, Artificial Sequence
  RNA Oligomer
aaggauucgucaggaacaggaca

SEQ ID NO: 50116 - RNA, 23 nt, Artificial Sequence
  RNA Oligomer
uaaggauucgucaggaacaggac

SEQ ID NO: 50117 - RNA, 23 nt, Artificial Sequence
  RNA Oligomer
cuaaggauucgucaggaacagga

SEQ ID NO: 50118 - RNA, 23 nt, Artificial Sequence
  RNA Oligomer
gcaaaucagagaaaugaacccaa

SEQ ID NO: 50119 - RNA, 23 nt, Artificial Sequence
  RNA Oligomer
agcaaaucagagaaaugaaccca

SEQ ID NO: 50120 - RNA, 23 nt, Artificial Sequence
  RNA Oligomer
gagcaaaucagagaaaugaaccc

SEQ ID NO: 50121 - RNA, 23 nt, Artificial Sequence
  RNA Oligomer
ggagcaaaucagagaaaugaacc

SEQ ID NO: 50122 - RNA, 23 nt, Artificial Sequence
  RNA Oligomer
gggagcaaaucagagaaaugaac

SEQ ID NO: 50123 - RNA, 23 nt, Artificial Sequence
  RNA Oligomer
ccaacaagggagcaaaucagaga

SEQ ID NO: 50124 - RNA, 23 nt, Artificial Sequence
  RNA Oligomer
uccaacaagggagcaaaucagag

SEQ ID NO: 50125 - RNA, 23 nt, Artificial Sequence
  RNA Oligomer
cuccaacaagggagcaaaucaga

SEQ ID NO: 50126 - RNA, 23 nt, Artificial Sequence
  RNA Oligomer
acuccaacaagggagcaaaucag

SEQ ID NO: 50127 - RNA, 23 nt, Artificial Sequence
  RNA Oligomer
aacuccaacaagggagcaaauca

SEQ ID NO: 50128 - RNA, 23 nt, Artificial Sequence
  RNA Oligomer
ggauagugguguggaucaguugg

SEQ ID NO: 50129 - RNA, 23 nt, Artificial Sequence
  RNA Oligomer
gggauagugguguggaucaguug

SEQ ID NO: 50130 - RNA, 23 nt, Artificial Sequence
  RNA Oligomer
ggggauagugguguggaucaguu

SEQ ID NO: 50131 - RNA, 23 nt, Artificial Sequence
  RNA Oligomer
aggggauagugguguggaucagu

SEQ ID NO: 50132 - RNA, 23 nt, Artificial Sequence
  RNA Oligomer
caggggauagugguguggaucag

SEQ ID NO: 50133 - RNA, 23 nt, Artificial Sequence
  RNA Oligomer
guauaucuguucucgguacuaua

SEQ ID NO: 50134 - RNA, 23 nt, Artificial Sequence
  RNA Oligomer
cguauaucuguucucgguacuau

SEQ ID NO: 50135 - RNA, 23 nt, Artificial Sequence
  RNA Oligomer
ucguauaucuguucucgguacua

SEQ ID NO: 50136 - RNA, 23 nt, Artificial Sequence
  RNA Oligomer
uucguauaucuguucucgguacu

SEQ ID NO: 50137 - RNA, 23 nt, Artificial Sequence
  RNA Oligomer
uuucguauaucuguucucgguac

SEQ ID NO: 50138 - RNA, 23 nt, Artificial Sequence
  RNA Oligomer
auacugcuguauuaaaacucugu

SEQ ID NO: 50139 - RNA, 23 nt, Artificial Sequence
  RNA Oligomer
gauacugcuguauuaaaacucug

SEQ ID NO: 50140 - RNA, 23 nt, Artificial Sequence
  RNA Oligomer
uguauauguaucagcuguuccga

SEQ ID NO: 50141 - RNA, 23 nt, Artificial Sequence
  RNA Oligomer
uuguauauguaucagcuguuccg

SEQ ID NO: 50142 - RNA, 23 nt, Artificial Sequence
  RNA Oligomer
guuguauauguaucagcuguucc

SEQ ID NO: 50143 - RNA, 23 nt, Artificial Sequence
  RNA Oligomer
aguuguauauguaucagcuguuc

SEQ ID NO: 50144 - RNA, 23 nt, Artificial Sequence
  RNA Oligomer
aaguuguauauguaucagcuguu

SEQ ID NO: 50145 - RNA, 23 nt, Artificial Sequence
  RNA Oligomer
uaugucaaguuguauauguauca

SEQ ID NO: 50146 - RNA, 23 nt, Artificial Sequence
  RNA Oligomer
uuaugucaaguuguauauguauc

SEQ ID NO: 50147 - RNA, 23 nt, Artificial Sequence
  RNA Oligomer
cuauagucgagccaaacagacgc

SEQ ID NO: 50148 - RNA, 23 nt, Artificial Sequence
  RNA Oligomer
acuauagucgagccaaacagacg

SEQ ID NO: 50149 - RNA, 23 nt, Artificial Sequence
  RNA Oligomer
cacuauagucgagccaaacagac

SEQ ID NO: 50150 - RNA, 23 nt, Artificial Sequence
  RNA Oligomer
guuccggaaacaguauacagagu

SEQ ID NO: 50151 - RNA, 23 nt, Artificial Sequence
  RNA Oligomer
ccagaucaugagaaagcuagauc

SEQ ID NO: 50152 - RNA, 23 nt, Artificial Sequence
  RNA Oligomer
uccagaucaugagaaagcuagau

SEQ ID NO: 50153 - RNA, 23 nt, Artificial Sequence
  RNA Oligomer
cuccagaucaugagaaagcuaga

SEQ ID NO: 50154 - RNA, 23 nt, Artificial Sequence
  RNA Oligomer
gcuccagaucaugagaaagcuag

SEQ ID NO: 50155 - RNA, 23 nt, Artificial Sequence
  RNA Oligomer
agcuccagaucaugagaaagcua

SEQ ID NO: 50156 - RNA, 23 nt, Artificial Sequence
  RNA Oligomer
aacuggucgccaucaagaaagua

SEQ ID NO: 50157 - RNA, 23 nt, Artificial Sequence
  RNA Oligomer
gaacuggucgccaucaagaaagu

SEQ ID NO: 50158 - RNA, 23 nt, Artificial Sequence
  RNA Oligomer
ggugugguauaucaagccaaacu

SEQ ID NO: 50159 - RNA, 23 nt, Artificial Sequence
  RNA Oligomer
gcagcaaggugacaacaguggug

SEQ ID NO: 50160 - RNA, 23 nt, Artificial Sequence
  RNA Oligomer
ggcagcaaggugacaacaguggu

SEQ ID NO: 50161 - RNA, 23 nt, Artificial Sequence
  RNA Oligomer
cggcagcaaggugacaacagugg

SEQ ID NO: 50162 - RNA, 23 nt, Artificial Sequence
  RNA Oligomer
acggcagcaaggugacaacagug

SEQ ID NO: 50163 - RNA, 23 nt, Artificial Sequence
  RNA Oligomer
gacggcagcaaggugacaacagu

SEQ ID NO: 50164 - RNA, 23 nt, Artificial Sequence
  RNA Oligomer
auucgcgaagagagugaucaugu

SEQ ID NO: 50165 - RNA, 23 nt, Artificial Sequence
  RNA Oligomer
gauucgcgaagagagugaucaug

SEQ ID NO: 50166 - RNA, 23 nt, Artificial Sequence
  RNA Oligomer
ccaacuccaccugaacagucccg

SEQ ID NO: 50167 - RNA, 23 nt, Artificial Sequence
  RNA Oligomer
uccaacuccaccugaacaguccc

SEQ ID NO: 50168 - RNA, 23 nt, Artificial Sequence
  RNA Oligomer
uuccaacuccaccugaacagucc

SEQ ID NO: 50169 - RNA, 23 nt, Artificial Sequence
  RNA Oligomer
cuuccaacuccaccugaacaguc

SEQ ID NO: 50170 - RNA, 23 nt, Artificial Sequence
  RNA Oligomer
gcuuccaacuccaccugaacagu

SEQ ID NO: 50171 - RNA, 23 nt, Artificial Sequence
  RNA Oligomer
caccacucaagaacugucaagua

SEQ ID NO: 50172 - RNA, 23 nt, Artificial Sequence
  RNA Oligomer
ucaccacucaagaacugucaagu

SEQ ID NO: 50173 - RNA, 23 nt, Artificial Sequence
  RNA Oligomer
uucaccacucaagaacugucaag

SEQ ID NO: 50174 - RNA, 23 nt, Artificial Sequence
  RNA Oligomer
cuucaccacucaagaacugucaa

SEQ ID NO: 50175 - RNA, 23 nt, Artificial Sequence
  RNA Oligomer
acuucaccacucaagaacuguca

SEQ ID NO: 50176 - RNA, 23 nt, Artificial Sequence
  RNA Oligomer
cuugugcacauucauuuuuugau

SEQ ID NO: 50177 - RNA, 23 nt, Artificial Sequence
  RNA Oligomer
gcuugugcacauucauuuuuuga

SEQ ID NO: 50178 - RNA, 23 nt, Artificial Sequence
  RNA Oligomer
agcuugugcacauucauuuuuug

SEQ ID NO: 50179 - RNA, 23 nt, Artificial Sequence
  RNA Oligomer
aagcuugugcacauucauuuuuu

SEQ ID NO: 50180 - RNA, 23 nt, Artificial Sequence
  RNA Oligomer
gaagcuugugcacauucauuuuu

SEQ ID NO: 50181 - RNA, 23 nt, Artificial Sequence
  RNA Oligomer
uaaugcugcauuuaucguuaacc

SEQ ID NO: 50182 - RNA, 23 nt, Artificial Sequence
  RNA Oligomer
uuaaugcugcauuuaucguuaac

SEQ ID NO: 50183 - RNA, 23 nt, Artificial Sequence
  RNA Oligomer
aguauacaccaacugcccgacua

SEQ ID NO: 50184 - RNA, 23 nt, Artificial Sequence
  RNA Oligomer
caacaagggagcaaaucagagaa

SEQ ID NO: 50185 - RNA, 23 nt, Artificial Sequence
  RNA Oligomer
guagaaauaaucaagguccuggg

SEQ ID NO: 50186 - RNA, 23 nt, Artificial Sequence
  RNA Oligomer
uuggagccacugauuauaccucu

SEQ ID NO: 50187 - RNA, 23 nt, Artificial Sequence
  RNA Oligomer
uuuggagccacugauuauaccuc

SEQ ID NO: 50188 - RNA, 23 nt, Artificial Sequence
  RNA Oligomer
cuuuggagccacugauuauaccu

SEQ ID NO: 50189 - RNA, 23 nt, Artificial Sequence
  RNA Oligomer
guuucguauaucuguucucggua

SEQ ID NO: 50190 - RNA, 23 nt, Artificial Sequence
  RNA Oligomer
uguuucguauaucuguucucggu

SEQ ID NO: 50191 - RNA, 23 nt, Artificial Sequence
  RNA Oligomer
ugauacugcuguauuaaaacucu

SEQ ID NO: 50192 - RNA, 23 nt, Artificial Sequence
  RNA Oligomer
gccuauauccauuccuuuggaau

SEQ ID NO: 50193 - RNA, 23 nt, Artificial Sequence
  RNA Oligomer
agccuauauccauuccuuuggaa

SEQ ID NO: 50194 - RNA, 23 nt, Artificial Sequence
  RNA Oligomer
uagccuauauccauuccuuugga

SEQ ID NO: 50195 - RNA, 23 nt, Artificial Sequence
  RNA Oligomer
uuagccuauauccauuccuuugg

SEQ ID NO: 50196 - RNA, 23 nt, Artificial Sequence
  RNA Oligomer
uuuagccuauauccauuccuuug

SEQ ID NO: 50197 - RNA, 23 nt, Artificial Sequence
  RNA Oligomer
guuuagccuauauccauuccuuu

SEQ ID NO: 50198 - RNA, 23 nt, Artificial Sequence
  RNA Oligomer
aguuuagccuauauccauuccuu

SEQ ID NO: 50199 - RNA, 23 nt, Artificial Sequence
  RNA Oligomer
guauauguaucagcuguuccgaa

SEQ ID NO: 50200 - RNA, 23 nt, Artificial Sequence
  RNA Oligomer
gugauuuaugucaaguuguauau

SEQ ID NO: 50201 - RNA, 23 nt, Artificial Sequence
  RNA Oligomer
ugugauuuaugucaaguuguaua

SEQ ID NO: 50202 - RNA, 23 nt, Artificial Sequence
  RNA Oligomer
gaagaaagaugaggucuaucuua

SEQ ID NO: 50203 - RNA, 23 nt, Artificial Sequence
  RNA Oligomer
agaagaaagaugaggucuaucuu

SEQ ID NO: 50204 - RNA, 23 nt, Artificial Sequence
  RNA Oligomer
gagaagaaagaugaggucuaucu

SEQ ID NO: 50205 - RNA, 23 nt, Artificial Sequence
  RNA Oligomer
ugagaagaaagaugaggucuauc

SEQ ID NO: 50206 - RNA, 23 nt, Artificial Sequence
  RNA Oligomer
gugagaagaaagaugaggucuau

SEQ ID NO: 50207 - RNA, 23 nt, Artificial Sequence
  RNA Oligomer
ccaguggugagaagaaagaugag

SEQ ID NO: 50208 - RNA, 23 nt, Artificial Sequence
  RNA Oligomer
uccaguggugagaagaaagauga

SEQ ID NO: 50209 - RNA, 23 nt, Artificial Sequence
  RNA Oligomer
cuccaguggugagaagaaagaug

SEQ ID NO: 50210 - RNA, 23 nt, Artificial Sequence
  RNA Oligomer
acuccaguggugagaagaaagau

SEQ ID NO: 50211 - RNA, 23 nt, Artificial Sequence
  RNA Oligomer
uacuccaguggugagaagaaaga

SEQ ID NO: 50212 - RNA, 23 nt, Artificial Sequence
  RNA Oligomer
caugagaaagcuagaucacugua

SEQ ID NO: 50213 - RNA, 23 nt, Artificial Sequence
  RNA Oligomer
ucaugagaaagcuagaucacugu

SEQ ID NO: 50214 - RNA, 23 nt, Artificial Sequence
  RNA Oligomer
uugcaggacaagagauuuaagaa

SEQ ID NO: 50215 - RNA, 23 nt, Artificial Sequence
  RNA Oligomer
auugcaggacaagagauuuaaga

SEQ ID NO: 50216 - RNA, 23 nt, Artificial Sequence
  RNA Oligomer
uauugcaggacaagagauuuaag

SEQ ID NO: 50217 - RNA, 23 nt, Artificial Sequence
  RNA Oligomer
guauugcaggacaagagauuuaa

SEQ ID NO: 50218 - RNA, 23 nt, Artificial Sequence
  RNA Oligomer
ggaucauuuggugugguauauca

SEQ ID NO: 50219 - RNA, 23 nt, Artificial Sequence
  RNA Oligomer
uggaucauuuggugugguauauc

SEQ ID NO: 50220 - RNA, 23 nt, Artificial Sequence
  RNA Oligomer
auggaucauuuggugugguauau

SEQ ID NO: 50221 - RNA, 23 nt, Artificial Sequence
  RNA Oligomer
aauggaucauuuggugugguaua

SEQ ID NO: 50222 - RNA, 23 nt, Artificial Sequence
  RNA Oligomer
aaauggaucauuuggugugguau

SEQ ID NO: 50223 - RNA, 23 nt, Artificial Sequence
  RNA Oligomer
gaaauggaucauuugguguggua

SEQ ID NO: 50224 - RNA, 23 nt, Artificial Sequence
  RNA Oligomer
ugauuggaaauggaucauuuggu

SEQ ID NO: 50225 - RNA, 23 nt, Artificial Sequence
  RNA Oligomer
gugauuggaaauggaucauuugg

SEQ ID NO: 50226 - RNA, 23 nt, Artificial Sequence
  RNA Oligomer
agugauuggaaauggaucauuug

SEQ ID NO: 50227 - RNA, 23 nt, Artificial Sequence
  RNA Oligomer
aagugauuggaaauggaucauuu

SEQ ID NO: 50228 - RNA, 23 nt, Artificial Sequence
  RNA Oligomer
aaagugauuggaaauggaucauu

SEQ ID NO: 50229 - RNA, 23 nt, Artificial Sequence
  RNA Oligomer
gaaaaggugauucgcgaagagag

SEQ ID NO: 50230 - RNA, 23 nt, Artificial Sequence
  RNA Oligomer
gcacaggaaaaaccaccaguuac

SEQ ID NO: 50231 - RNA, 23 nt, Artificial Sequence
  RNA Oligomer
ugcacaggaaaaaccaccaguua

SEQ ID NO: 50232 - RNA, 23 nt, Artificial Sequence
  RNA Oligomer
cugcacaggaaaaaccaccaguu

SEQ ID NO: 50233 - RNA, 23 nt, Artificial Sequence
  RNA Oligomer
gcugcacaggaaaaaccaccagu

SEQ ID NO: 50234 - RNA, 23 nt, Artificial Sequence
  RNA Oligomer
agcugcacaggaaaaaccaccag

SEQ ID NO: 50235 - RNA, 23 nt, Artificial Sequence
  RNA Oligomer
accacucaagaacugucaaguaa

SEQ ID NO: 50236 - RNA, 23 nt, Artificial Sequence
  RNA Oligomer
ggaagcuugugcacauucauuuu

SEQ ID NO: 50237 - RNA, 23 nt, Artificial Sequence
  RNA Oligomer
cuuaaugcugcauuuaucguuaa

SEQ ID NO: 50238 - RNA, 23 nt, Artificial Sequence
  RNA Oligomer
ccgucugcuggaguauacaccaa

SEQ ID NO: 50239 - RNA, 23 nt, Artificial Sequence
  RNA Oligomer
gccgucugcuggaguauacacca

SEQ ID NO: 50240 - RNA, 23 nt, Artificial Sequence
  RNA Oligomer
agccgucugcuggaguauacacc

SEQ ID NO: 50241 - RNA, 23 nt, Artificial Sequence
  RNA Oligomer
uagccgucugcuggaguauacac

SEQ ID NO: 50242 - RNA, 23 nt, Artificial Sequence
  RNA Oligomer
guagccgucugcuggaguauaca

SEQ ID NO: 50243 - RNA, 23 nt, Artificial Sequence
  RNA Oligomer
acuaaggauucgucaggaacagg

SEQ ID NO: 50244 - RNA, 23 nt, Artificial Sequence
  RNA Oligomer
gacuaaggauucgucaggaacag

SEQ ID NO: 50245 - RNA, 23 nt, Artificial Sequence
  RNA Oligomer
ggacuaaggauucgucaggaaca

SEQ ID NO: 50246 - RNA, 23 nt, Artificial Sequence
  RNA Oligomer
uggacuaaggauucgucaggaac

SEQ ID NO: 50247 - RNA, 23 nt, Artificial Sequence
  RNA Oligomer
uuggacuaaggauucgucaggaa

SEQ ID NO: 50248 - RNA, 23 nt, Artificial Sequence
  RNA Oligomer
guauuaaaacucugugacuuugg

SEQ ID NO: 50249 - RNA, 23 nt, Artificial Sequence
  RNA Oligomer
uguauuaaaacucugugacuuug

SEQ ID NO: 50250 - RNA, 23 nt, Artificial Sequence
  RNA Oligomer
gaaacaguauacagaguugccag

SEQ ID NO: 50251 - RNA, 23 nt, Artificial Sequence
  RNA Oligomer
ggugagaagaaagaugaggucua

SEQ ID NO: 50252 - RNA, 23 nt, Artificial Sequence
  RNA Oligomer
ugcguuauuucuucuacuccagu

SEQ ID NO: 50253 - RNA, 23 nt, Artificial Sequence
  RNA Oligomer
uugcguuauuucuucuacuccag

SEQ ID NO: 50254 - RNA, 23 nt, Artificial Sequence
  RNA Oligomer
auugcguuauuucuucuacucca

SEQ ID NO: 50255 - RNA, 23 nt, Artificial Sequence
  RNA Oligomer
gauugcguuauuucuucuacucc

SEQ ID NO: 50256 - RNA, 23 nt, Artificial Sequence
  RNA Oligomer
cgauugcguuauuucuucuacuc

SEQ ID NO: 50257 - RNA, 23 nt, Artificial Sequence
  RNA Oligomer
ccgauugcguuauuucuucuacu

SEQ ID NO: 50258 - RNA, 23 nt, Artificial Sequence
  RNA Oligomer
uccgauugcguuauuucuucuac

SEQ ID NO: 50259 - RNA, 23 nt, Artificial Sequence
  RNA Oligomer
guccgauugcguuauuucuucua

SEQ ID NO: 50260 - RNA, 23 nt, Artificial Sequence
  RNA Oligomer
aguccgauugcguuauuucuucu

SEQ ID NO: 50261 - RNA, 23 nt, Artificial Sequence
  RNA Oligomer
uaguccgauugcguuauuucuuc

SEQ ID NO: 50262 - RNA, 23 nt, Artificial Sequence
  RNA Oligomer
acuguaacauaguccgauugcgu

SEQ ID NO: 50263 - RNA, 23 nt, Artificial Sequence
  RNA Oligomer
cacuguaacauaguccgauugcg

SEQ ID NO: 50264 - RNA, 23 nt, Artificial Sequence
  RNA Oligomer
ucacuguaacauaguccgauugc

SEQ ID NO: 50265 - RNA, 23 nt, Artificial Sequence
  RNA Oligomer
aucacuguaacauaguccgauug

SEQ ID NO: 50266 - RNA, 23 nt, Artificial Sequence
  RNA Oligomer
gaucacuguaacauaguccgauu

SEQ ID NO: 50267 - RNA, 23 nt, Artificial Sequence
  RNA Oligomer
agaucacuguaacauaguccgau

SEQ ID NO: 50268 - RNA, 23 nt, Artificial Sequence
  RNA Oligomer
cuagaucacuguaacauaguccg

SEQ ID NO: 50269 - RNA, 23 nt, Artificial Sequence
  RNA Oligomer
gcuagaucacuguaacauagucc

SEQ ID NO: 50270 - RNA, 23 nt, Artificial Sequence
  RNA Oligomer
agcuagaucacuguaacauaguc

SEQ ID NO: 50271 - RNA, 23 nt, Artificial Sequence
  RNA Oligomer
agaaauaaucaagguccugggaa

SEQ ID NO: 50272 - RNA, 23 nt, Artificial Sequence
  RNA Oligomer
caauguuucguauaucuguucuc

SEQ ID NO: 50273 - RNA, 23 nt, Artificial Sequence
  RNA Oligomer
auauguuaaauauccgugccgau

SEQ ID NO: 50274 - RNA, 23 nt, Artificial Sequence
  RNA Oligomer
caccucuggcuaccauccuuauu

SEQ ID NO: 50275 - RNA, 23 nt, Artificial Sequence
  RNA Oligomer
gaaaguauugcaggacaagagau

SEQ ID NO: 50276 - RNA, 23 nt, Artificial Sequence
  RNA Oligomer
cuguuccgaaguuuagccuauau

SEQ ID NO: 50277 - RNA, 23 nt, Artificial Sequence
  RNA Oligomer
cuguaacauaguccgauugcguu

SEQ ID NO: 50278 - RNA, 23 nt, Artificial Sequence
  RNA Oligomer
ggugauucgcgaagagagugauc

SEQ ID NO: 50279 - RNA, 23 nt, Artificial Sequence
  RNA Oligomer
gaucauuuggugugguauaucaa

SEQ ID NO: 50280 - RNA, 23 nt, Artificial Sequence
  RNA Oligomer
gaaaaaccaccaguuacuugagu

SEQ ID NO: 50281 - RNA, 23 nt, Artificial Sequence
  RNA Oligomer
uguguguuggcugagcuguuacu

SEQ ID NO: 50282 - RNA, 23 nt, Artificial Sequence
  RNA Oligomer
acaguauacagaguugccagaca

SEQ ID NO: 50283 - RNA, 23 nt, Artificial Sequence
  RNA Oligomer
aguauugcaggacaagagauuua

SEQ ID NO: 50284 - RNA, 23 nt, Artificial Sequence
  RNA Oligomer
ugauucgcgaagagagugaucau

SEQ ID NO: 50285 - RNA, 23 nt, Artificial Sequence
  RNA Oligomer
gcuguguguuggcugagcuguua

SEQ ID NO: 50286 - RNA, 23 nt, Artificial Sequence
  RNA Oligomer
ccucuuguuggauccugauacug

SEQ ID NO: 50287 - RNA, 23 nt, Artificial Sequence
  RNA Oligomer
ccaccucuggcuaccauccuuau

SEQ ID NO: 50288 - RNA, 23 nt, Artificial Sequence
  RNA Oligomer
acauaguccgauugcguuauuuc

SEQ ID NO: 50289 - RNA, 23 nt, Artificial Sequence
  RNA Oligomer
caacauaaagacaaaaggaagaa

SEQ ID NO: 50290 - RNA, 23 nt, Artificial Sequence
  RNA Oligomer
caaacuaccaaaugggcgagaca

SEQ ID NO: 50291 - RNA, 23 nt, Artificial Sequence
  RNA Oligomer
uggaagcuugugcacauucauuu

SEQ ID NO: 50292 - RNA, 23 nt, Artificial Sequence
  RNA Oligomer
gugaaaagccaagaggacgaagu

SEQ ID NO: 50293 - RNA, 23 nt, Artificial Sequence
  RNA Oligomer
guaacauaguccgauugcguuau

SEQ ID NO: 50294 - RNA, 23 nt, Artificial Sequence
  RNA Oligomer
cagaugcuaauacuggagaccgu

SEQ ID NO: 50295 - RNA, 23 nt, Artificial Sequence
  RNA Oligomer
cuguuacuaggacaaccaauauu

SEQ ID NO: 50296 - RNA, 23 nt, Artificial Sequence
  RNA Oligomer
gaggacgaagucuuuuucuuuuu

SEQ ID NO: 50297 - RNA, 23 nt, Artificial Sequence
  RNA Oligomer
gaaaagccaagaggacgaagucu

SEQ ID NO: 50298 - RNA, 23 nt, Artificial Sequence
  RNA Oligomer
caaaaggagugaaaagccaagag

SEQ ID NO: 50299 - RNA, 23 nt, Artificial Sequence
  RNA Oligomer
guggugagaagaaagaugagguc

SEQ ID NO: 50300 - RNA, 23 nt, Artificial Sequence
  RNA Oligomer
aacauaguccgauugcguuauuu

SEQ ID NO: 50301 - RNA, 23 nt, Artificial Sequence
  RNA Oligomer
ucaaacuaccaaaugggcgagac

SEQ ID NO: 50302 - RNA, 23 nt, Artificial Sequence
  RNA Oligomer
caauugcacuguguagccgucug

SEQ ID NO: 50303 - RNA, 23 nt, Artificial Sequence
  RNA Oligomer
gcaauugcacuguguagccgucu

SEQ ID NO: 50304 - RNA, 23 nt, Artificial Sequence
  RNA Oligomer
ggaacuccaacaagggagcaaau

SEQ ID NO: 50305 - RNA, 23 nt, Artificial Sequence
  RNA Oligomer
ggugcuggacuauguuccggaaa

SEQ ID NO: 50306 - RNA, 23 nt, Artificial Sequence
  RNA Oligomer
gcguuauuucuucuacuccagug

SEQ ID NO: 50307 - RNA, 23 nt, Artificial Sequence
  RNA Oligomer
uaacauaguccgauugcguuauu

SEQ ID NO: 50308 - RNA, 23 nt, Artificial Sequence
  RNA Oligomer
gcuaauacuggagaccguggaca

SEQ ID NO: 50309 - RNA, 23 nt, Artificial Sequence
  RNA Oligomer
cgaaguuuagccuauauccauuc

SEQ ID NO: 50310 - RNA, 23 nt, Artificial Sequence
  RNA Oligomer
ccgaaguuuagccuauauccauu

SEQ ID NO: 50311 - RNA, 23 nt, Artificial Sequence
  RNA Oligomer
gcuucugcaucagcuuccaacuc

SEQ ID NO: 50312 - RNA, 23 nt, Artificial Sequence
  RNA Oligomer
ccaaacagacgcucccugugauu

SEQ ID NO: 50313 - RNA, 23 nt, Artificial Sequence
  RNA Oligomer
acaaaugccacagcagcgucaga

SEQ ID NO: 50314 - RNA, 23 nt, Artificial Sequence
  RNA Oligomer
guauggucugcuggcuguguguu

SEQ ID NO: 50315 - RNA, 23 nt, Artificial Sequence
  RNA Oligomer
gaaguuuagccuauauccauucc

SEQ ID NO: 50316 - RNA, 23 nt, Artificial Sequence
  RNA Oligomer
caaacagacgcucccugugauuu

SEQ ID NO: 50317 - RNA, 23 nt, Artificial Sequence
  RNA Oligomer
acaagagauuuaagaaucgagag

SEQ ID NO: 50318 - RNA, 23 nt, Artificial Sequence
  RNA Oligomer
ggaaauggaucauuugguguggu

SEQ ID NO: 50319 - RNA, 23 nt, Artificial Sequence
  RNA Oligomer
gaagucagcuauacagacacuaa

SEQ ID NO: 50320 - RNA, 23 nt, Artificial Sequence
  RNA Oligomer
cagcuuuuggcagcaugaaaguu

SEQ ID NO: 50321 - RNA, 23 nt, Artificial Sequence
  RNA Oligomer
agaguugaucuuuggagccacug

SEQ ID NO: 50322 - RNA, 23 nt, Artificial Sequence
  RNA Oligomer
ccaucgggauauuaaaccgcaga

SEQ ID NO: 50323 - RNA, 23 nt, Artificial Sequence
  RNA Oligomer
gugcuggacuauguuccggaaac

SEQ ID NO: 50324 - RNA, 23 nt, Artificial Sequence
  RNA Oligomer
agaagucagcuauacagacacua

SEQ ID NO: 50325 - RNA, 23 nt, Artificial Sequence
  RNA Oligomer
agaaaaggaggaaggaaggaaaa

SEQ ID NO: 50326 - RNA, 23 nt, Artificial Sequence
  RNA Oligomer
agacaaaaggaagaaaaggagga

SEQ ID NO: 50327 - RNA, 23 nt, Artificial Sequence
  RNA Oligomer
ggagaccguggacagaccaauaa

SEQ ID NO: 50328 - RNA, 23 nt, Artificial Sequence
  RNA Oligomer
cagaguugaucuuuggagccacu

SEQ ID NO: 50329 - RNA, 23 nt, Artificial Sequence
  RNA Oligomer
acucugugacuuuggaagugcaa

SEQ ID NO: 50330 - RNA, 23 nt, Artificial Sequence
  RNA Oligomer
ccacagcagcgucagaugcuaau

SEQ ID NO: 50331 - RNA, 23 nt, Artificial Sequence
  RNA Oligomer
gaauuacgggacccaaaugucaa

SEQ ID NO: 50332 - RNA, 23 nt, Artificial Sequence
  RNA Oligomer
ggaacaggacauuucaccucagg

SEQ ID NO: 50333 - RNA, 23 nt, Artificial Sequence
  RNA Oligomer
ugggaacuccaacaagggagcaa

SEQ ID NO: 50334 - RNA, 23 nt, Artificial Sequence
  RNA Oligomer
guccgaggagaacccaauguuuc

SEQ ID NO: 50335 - RNA, 23 nt, Artificial Sequence
  RNA Oligomer
ccugauacugcuguauuaaaacu

SEQ ID NO: 50336 - RNA, 23 nt, Artificial Sequence
  RNA Oligomer
gacaggccacaagaagucagcua

SEQ ID NO: 50337 - RNA, 23 nt, Artificial Sequence
  RNA Oligomer
uggcagcaugaaaguuagcagag

SEQ ID NO: 50338 - RNA, 23 nt, Artificial Sequence
  RNA Oligomer
gaacaggacauuucaccucagga

SEQ ID NO: 50339 - RNA, 23 nt, Artificial Sequence
  RNA Oligomer
acacagaauuuaaauucccucaa

SEQ ID NO: 50340 - RNA, 23 nt, Artificial Sequence
  RNA Oligomer
gaaaugaacccaaacuacacaga

SEQ ID NO: 50341 - RNA, 23 nt, Artificial Sequence
  RNA Oligomer
gggaacuccaacaagggagcaaa

SEQ ID NO: 50342 - RNA, 23 nt, Artificial Sequence
  RNA Oligomer
caucgggauauuaaaccgcagaa

SEQ ID NO: 50343 - RNA, 23 nt, Artificial Sequence
  RNA Oligomer
ggaagaaaaggaggaaggaagga

SEQ ID NO: 50344 - RNA, 23 nt, Artificial Sequence
  RNA Oligomer
aggaacaggacauuucaccucag

SEQ ID NO: 50345 - RNA, 23 nt, Artificial Sequence
  RNA Oligomer
aaaugaacccaaacuacacagaa

SEQ ID NO: 50346 - RNA, 23 nt, Artificial Sequence
  RNA Oligomer
gaacuccaacaagggagcaaauc

SEQ ID NO: 50347 - RNA, 23 nt, Artificial Sequence
  RNA Oligomer
gcuguuacuaggacaaccaauau

SEQ ID NO: 50348 - RNA, 23 nt, Artificial Sequence
  RNA Oligomer
gaagucuuuuucuuuuucuucug

SEQ ID NO: 50349 - RNA, 23 nt, Artificial Sequence
  RNA Oligomer
ugaucuuuggagccacugauuau

SEQ ID NO: 50350 - RNA, 23 nt, Artificial Sequence
  RNA Oligomer
gguccgaggagaacccaauguuu

SEQ ID NO: 50351 - RNA, 23 nt, Artificial Sequence
  RNA Oligomer
agaggacgaagucuuuuucuuuu

SEQ ID NO: 50352 - RNA, 23 nt, Artificial Sequence
  RNA Oligomer
ccaagaggacgaagucuuuuucu

SEQ ID NO: 50353 - RNA, 23 nt, Artificial Sequence
  RNA Oligomer
ggagaacuggucgccaucaagaa

SEQ ID NO: 50354 - RNA, 23 nt, Artificial Sequence
  RNA Oligomer
aggagaacuggucgccaucaaga

SEQ ID NO: 50355 - RNA, 23 nt, Artificial Sequence
  RNA Oligomer
cagccuucagcuuuuggcagcau

SEQ ID NO: 50356 - RNA, 23 nt, Artificial Sequence
  RNA Oligomer
gaaaaggaggaaggaaggaaaag

SEQ ID NO: 50357 - RNA, 23 nt, Artificial Sequence
  RNA Oligomer
acaaaaggaagaaaaggaggaag

SEQ ID NO: 50358 - RNA, 23 nt, Artificial Sequence
  RNA Oligomer
gagcuguuacuaggacaaccaau

SEQ ID NO: 50359 - RNA, 23 nt, Artificial Sequence
  RNA Oligomer
agucuuuuucuuuuucuucugug

SEQ ID NO: 50360 - RNA, 23 nt, Artificial Sequence
  RNA Oligomer
uugaucuuuggagccacugauua

SEQ ID NO: 50361 - RNA, 23 nt, Artificial Sequence
  RNA Oligomer
aggacgaagucuuuuucuuuuuc

SEQ ID NO: 50362 - RNA, 23 nt, Artificial Sequence
  RNA Oligomer
gaaagaugaggucuaucuuaauc

SEQ ID NO: 50363 - RNA, 23 nt, Artificial Sequence
  RNA Oligomer
gucaaguaauccaccucuggcua

SEQ ID NO: 50364 - RNA, 23 nt, Artificial Sequence
  RNA Oligomer
cgggacccaaaugucaaacuacc

SEQ ID NO: 50365 - RNA, 23 nt, Artificial Sequence
  RNA Oligomer
acgggacccaaaugucaaacuac

SEQ ID NO: 50366 - RNA, 23 nt, Artificial Sequence
  RNA Oligomer
gauucgucaggaacaggacauuu

SEQ ID NO: 50367 - RNA, 23 nt, Artificial Sequence
  RNA Oligomer
caaaucagagaaaugaacccaaa

SEQ ID NO: 50368 - RNA, 23 nt, Artificial Sequence
  RNA Oligomer
gauccugauacugcuguauuaaa

SEQ ID NO: 50369 - RNA, 23 nt, Artificial Sequence
  RNA Oligomer
ccuauauccauuccuuuggaauc

SEQ ID NO: 50370 - RNA, 23 nt, Artificial Sequence
  RNA Oligomer
ucaggagaacuggucgccaucaa

SEQ ID NO: 50371 - RNA, 23 nt, Artificial Sequence
  RNA Oligomer
gaacagauauacgaaacauuggg

SEQ ID NO: 50372 - RNA, 23 nt, Artificial Sequence
  RNA Oligomer
aacagauauacgaaacauugggu

SEQ ID NO: 50373 - RNA, 23 nt, Artificial Sequence
  RNA Oligomer
acagauauacgaaacauuggguu

SEQ ID NO: 50374 - RNA, 23 nt, Artificial Sequence
  RNA Oligomer
cagauauacgaaacauuggguuc

SEQ ID NO: 50375 - RNA, 23 nt, Artificial Sequence
  RNA Oligomer
agauauacgaaacauuggguucu

SEQ ID NO: 50376 - RNA, 23 nt, Artificial Sequence
  RNA Oligomer
cuugucucugcuaacuuucaugc

SEQ ID NO: 50377 - RNA, 23 nt, Artificial Sequence
  RNA Oligomer
uugucucugcuaacuuucaugcu

SEQ ID NO: 50378 - RNA, 23 nt, Artificial Sequence
  RNA Oligomer
ugucucugcuaacuuucaugcug

SEQ ID NO: 50379 - RNA, 23 nt, Artificial Sequence
  RNA Oligomer
gucucugcuaacuuucaugcugc

SEQ ID NO: 50380 - RNA, 23 nt, Artificial Sequence
  RNA Oligomer
ucucugcuaacuuucaugcugcc

SEQ ID NO: 50381 - RNA, 23 nt, Artificial Sequence
  RNA Oligomer
aagcuuccagugguguuagucgg

SEQ ID NO: 50382 - RNA, 23 nt, Artificial Sequence
  RNA Oligomer
agcuuccagugguguuagucggg

SEQ ID NO: 50383 - RNA, 23 nt, Artificial Sequence
  RNA Oligomer
gcuuccagugguguuagucgggc

SEQ ID NO: 50384 - RNA, 23 nt, Artificial Sequence
  RNA Oligomer
cuuccagugguguuagucgggca

SEQ ID NO: 50385 - RNA, 23 nt, Artificial Sequence
  RNA Oligomer
uuccagugguguuagucgggcag

SEQ ID NO: 50386 - RNA, 23 nt, Artificial Sequence
  RNA Oligomer
caaaacaagcgauauauuucucc

SEQ ID NO: 50387 - RNA, 23 nt, Artificial Sequence
  RNA Oligomer
aaaacaagcgauauauuucuccu

SEQ ID NO: 50388 - RNA, 23 nt, Artificial Sequence
  RNA Oligomer
aaacaagcgauauauuucuccuu

SEQ ID NO: 50389 - RNA, 23 nt, Artificial Sequence
  RNA Oligomer
aacaagcgauauauuucuccuuc

SEQ ID NO: 50390 - RNA, 23 nt, Artificial Sequence
  RNA Oligomer
acaagcgauauauuucuccuuca

SEQ ID NO: 50391 - RNA, 23 nt, Artificial Sequence
  RNA Oligomer
cuuccuuuugucuuuauguuggg

SEQ ID NO: 50392 - RNA, 23 nt, Artificial Sequence
  RNA Oligomer
uuccuuuugucuuuauguugggg

SEQ ID NO: 50393 - RNA, 23 nt, Artificial Sequence
  RNA Oligomer
uccuuuugucuuuauguuggggu

SEQ ID NO: 50394 - RNA, 23 nt, Artificial Sequence
  RNA Oligomer
ccuuuugucuuuauguuggggug

SEQ ID NO: 50395 - RNA, 23 nt, Artificial Sequence
  RNA Oligomer
cuuuugucuuuauguuggggugu

SEQ ID NO: 50396 - RNA, 23 nt, Artificial Sequence
  RNA Oligomer
ccauuugguaguuugacauuugg

SEQ ID NO: 50397 - RNA, 23 nt, Artificial Sequence
  RNA Oligomer
cauuugguaguuugacauuuggg

SEQ ID NO: 50398 - RNA, 23 nt, Artificial Sequence
  RNA Oligomer
auuugguaguuugacauuugggu

SEQ ID NO: 50399 - RNA, 23 nt, Artificial Sequence
  RNA Oligomer
uuugguaguuugacauuuggguc

SEQ ID NO: 50400 - RNA, 23 nt, Artificial Sequence
  RNA Oligomer
uugguaguuugacauuugggucc

SEQ ID NO: 50401 - RNA, 23 nt, Artificial Sequence
  RNA Oligomer
gauauacgaaacauuggguucuc

SEQ ID NO: 50402 - RNA, 23 nt, Artificial Sequence
  RNA Oligomer
auauacgaaacauuggguucucc

SEQ ID NO: 50403 - RNA, 23 nt, Artificial Sequence
  RNA Oligomer
uauacgaaacauuggguucuccu

SEQ ID NO: 50404 - RNA, 23 nt, Artificial Sequence
  RNA Oligomer
auacgaaacauuggguucuccuc

SEQ ID NO: 50405 - RNA, 23 nt, Artificial Sequence
  RNA Oligomer
cucgauucuuaaaucucuugucc

SEQ ID NO: 50406 - RNA, 23 nt, Artificial Sequence
  RNA Oligomer
ucgauucuuaaaucucuuguccu

SEQ ID NO: 50407 - RNA, 23 nt, Artificial Sequence
  RNA Oligomer
cgauucuuaaaucucuuguccug

SEQ ID NO: 50408 - RNA, 23 nt, Artificial Sequence
  RNA Oligomer
gauucuuaaaucucuuguccugc

SEQ ID NO: 50409 - RNA, 23 nt, Artificial Sequence
  RNA Oligomer
auucuuaaaucucuuguccugca

SEQ ID NO: 50410 - RNA, 23 nt, Artificial Sequence
  RNA Oligomer
ucuguauagcugacuucuugugg

SEQ ID NO: 50411 - RNA, 23 nt, Artificial Sequence
  RNA Oligomer
cuguauagcugacuucuuguggc

SEQ ID NO: 50412 - RNA, 23 nt, Artificial Sequence
  RNA Oligomer
uguauagcugacuucuuguggcc

SEQ ID NO: 50413 - RNA, 23 nt, Artificial Sequence
  RNA Oligomer
guauagcugacuucuuguggccu

SEQ ID NO: 50414 - RNA, 23 nt, Artificial Sequence
  RNA Oligomer
uauagcugacuucuuguggccug

SEQ ID NO: 50415 - RNA, 23 nt, Artificial Sequence
  RNA Oligomer
agcaugaggaggaauaaggaugg

SEQ ID NO: 50416 - RNA, 23 nt, Artificial Sequence
  RNA Oligomer
gcaugaggaggaauaaggauggu

SEQ ID NO: 50417 - RNA, 23 nt, Artificial Sequence
  RNA Oligomer
caugaggaggaauaaggauggua

SEQ ID NO: 50418 - RNA, 23 nt, Artificial Sequence
  RNA Oligomer
augaggaggaauaaggaugguag

SEQ ID NO: 50419 - RNA, 23 nt, Artificial Sequence
  RNA Oligomer
ugaggaggaauaaggaugguagc

SEQ ID NO: 50420 - RNA, 23 nt, Artificial Sequence
  RNA Oligomer
uacgaaacauuggguucuccucg

SEQ ID NO: 50421 - RNA, 23 nt, Artificial Sequence
  RNA Oligomer
acgaaacauuggguucuccucgg

SEQ ID NO: 50422 - RNA, 23 nt, Artificial Sequence
  RNA Oligomer
ggugaaguugaagagugcaggug

SEQ ID NO: 50423 - RNA, 23 nt, Artificial Sequence
  RNA Oligomer
gugaaguugaagagugcaggugu

SEQ ID NO: 50424 - RNA, 23 nt, Artificial Sequence
  RNA Oligomer
ugaaguugaagagugcaggugug

SEQ ID NO: 50425 - RNA, 23 nt, Artificial Sequence
  RNA Oligomer
gaaguugaagagugcaggugugu

SEQ ID NO: 50426 - RNA, 23 nt, Artificial Sequence
  RNA Oligomer
aaguugaagagugcagguguguc

SEQ ID NO: 50427 - RNA, 23 nt, Artificial Sequence
  RNA Oligomer
cgauaaaugcagcauuaaguucu

SEQ ID NO: 50428 - RNA, 23 nt, Artificial Sequence
  RNA Oligomer
gauaaaugcagcauuaaguucuc

SEQ ID NO: 50429 - RNA, 23 nt, Artificial Sequence
  RNA Oligomer
auaaaugcagcauuaaguucucc

SEQ ID NO: 50430 - RNA, 23 nt, Artificial Sequence
  RNA Oligomer
uaaaugcagcauuaaguucuccc

SEQ ID NO: 50431 - RNA, 23 nt, Artificial Sequence
  RNA Oligomer
aaaugcagcauuaaguucuccca

SEQ ID NO: 50432 - RNA, 23 nt, Artificial Sequence
  RNA Oligomer
aaugcagcauuaaguucucccac

SEQ ID NO: 50433 - RNA, 23 nt, Artificial Sequence
  RNA Oligomer
augcagcauuaaguucucccaca

SEQ ID NO: 50434 - RNA, 23 nt, Artificial Sequence
  RNA Oligomer
aauuuaaauucuguguaguuugg

SEQ ID NO: 50435 - RNA, 23 nt, Artificial Sequence
  RNA Oligomer
auuuaaauucuguguaguuuggg

SEQ ID NO: 50436 - RNA, 23 nt, Artificial Sequence
  RNA Oligomer
uuuaaauucuguguaguuugggu

SEQ ID NO: 50437 - RNA, 23 nt, Artificial Sequence
  RNA Oligomer
uuaaauucuguguaguuuggguu

SEQ ID NO: 50438 - RNA, 23 nt, Artificial Sequence
  RNA Oligomer
uaaauucuguguaguuuggguuc

SEQ ID NO: 50439 - RNA, 23 nt, Artificial Sequence
  RNA Oligomer
agagguucugcgguuuaauaucc

SEQ ID NO: 50440 - RNA, 23 nt, Artificial Sequence
  RNA Oligomer
gagguucugcgguuuaauauccc

SEQ ID NO: 50441 - RNA, 23 nt, Artificial Sequence
  RNA Oligomer
agguucugcgguuuaauaucccg

SEQ ID NO: 50442 - RNA, 23 nt, Artificial Sequence
  RNA Oligomer
gguucugcgguuuaauaucccga

SEQ ID NO: 50443 - RNA, 23 nt, Artificial Sequence
  RNA Oligomer
guucugcgguuuaauaucccgau

SEQ ID NO: 50444 - RNA, 23 nt, Artificial Sequence
  RNA Oligomer
acaaaacaagcgauauauuucuc

SEQ ID NO: 50445 - RNA, 23 nt, Artificial Sequence
  RNA Oligomer
gauauauuucuccuucaagacag

SEQ ID NO: 50446 - RNA, 23 nt, Artificial Sequence
  RNA Oligomer
auauauuucuccuucaagacaga

SEQ ID NO: 50447 - RNA, 23 nt, Artificial Sequence
  RNA Oligomer
uauauuucuccuucaagacagau

SEQ ID NO: 50448 - RNA, 23 nt, Artificial Sequence
  RNA Oligomer
auauuucuccuucaagacagauc

SEQ ID NO: 50449 - RNA, 23 nt, Artificial Sequence
  RNA Oligomer
uauuucuccuucaagacagaucg

SEQ ID NO: 50450 - RNA, 23 nt, Artificial Sequence
  RNA Oligomer
ucuuccuuuugucuuuauguugg

SEQ ID NO: 50451 - RNA, 23 nt, Artificial Sequence
  RNA Oligomer
gguguuagguuaacgauaaaugc

SEQ ID NO: 50452 - RNA, 23 nt, Artificial Sequence
  RNA Oligomer
guguuagguuaacgauaaaugca

SEQ ID NO: 50453 - RNA, 23 nt, Artificial Sequence
  RNA Oligomer
uguuagguuaacgauaaaugcag

SEQ ID NO: 50454 - RNA, 23 nt, Artificial Sequence
  RNA Oligomer
guuagguuaacgauaaaugcagc

SEQ ID NO: 50455 - RNA, 23 nt, Artificial Sequence
  RNA Oligomer
uuagguuaacgauaaaugcagca

SEQ ID NO: 50456 - RNA, 23 nt, Artificial Sequence
  RNA Oligomer
cccauuugguaguuugacauuug

SEQ ID NO: 50457 - RNA, 23 nt, Artificial Sequence
  RNA Oligomer
auacuagagguauaaucaguggc

SEQ ID NO: 50458 - RNA, 23 nt, Artificial Sequence
  RNA Oligomer
uacuagagguauaaucaguggcu

SEQ ID NO: 50459 - RNA, 23 nt, Artificial Sequence
  RNA Oligomer
acuagagguauaaucaguggcuc

SEQ ID NO: 50460 - RNA, 23 nt, Artificial Sequence
  RNA Oligomer
cuagagguauaaucaguggcucc

SEQ ID NO: 50461 - RNA, 23 nt, Artificial Sequence
  RNA Oligomer
uagagguauaaucaguggcucca

SEQ ID NO: 50462 - RNA, 23 nt, Artificial Sequence
  RNA Oligomer
agaacagauauacgaaacauugg

SEQ ID NO: 50463 - RNA, 23 nt, Artificial Sequence
  RNA Oligomer
gugguuuuuccugugcagcuggc

SEQ ID NO: 50464 - RNA, 23 nt, Artificial Sequence
  RNA Oligomer
ugguuuuuccugugcagcuggcu

SEQ ID NO: 50465 - RNA, 23 nt, Artificial Sequence
  RNA Oligomer
gguuuuuccugugcagcuggcug

SEQ ID NO: 50466 - RNA, 23 nt, Artificial Sequence
  RNA Oligomer
guuuuuccugugcagcuggcugc

SEQ ID NO: 50467 - RNA, 23 nt, Artificial Sequence
  RNA Oligomer
uuuuuccugugcagcuggcugcu

SEQ ID NO: 50468 - RNA, 23 nt, Artificial Sequence
  RNA Oligomer
gguggauuacuugacaguucuug

SEQ ID NO: 50469 - RNA, 23 nt, Artificial Sequence
  RNA Oligomer
guggauuacuugacaguucuuga

SEQ ID NO: 50470 - RNA, 23 nt, Artificial Sequence
  RNA Oligomer
uggauuacuugacaguucuugag

SEQ ID NO: 50471 - RNA, 23 nt, Artificial Sequence
  RNA Oligomer
ggauuacuugacaguucuugagu

SEQ ID NO: 50472 - RNA, 23 nt, Artificial Sequence
  RNA Oligomer
gauuacuugacaguucuugagug

SEQ ID NO: 50473 - RNA, 23 nt, Artificial Sequence
  RNA Oligomer
aguugaagagugcaggugugucu

SEQ ID NO: 50474 - RNA, 23 nt, Artificial Sequence
  RNA Oligomer
guugaagagugcaggugugucuc

SEQ ID NO: 50475 - RNA, 23 nt, Artificial Sequence
  RNA Oligomer
uugaagagugcaggugugucucg

SEQ ID NO: 50476 - RNA, 23 nt, Artificial Sequence
  RNA Oligomer
cgcacuccugaggugaaaugucc

SEQ ID NO: 50477 - RNA, 23 nt, Artificial Sequence
  RNA Oligomer
gcacuccugaggugaaauguccu

SEQ ID NO: 50478 - RNA, 23 nt, Artificial Sequence
  RNA Oligomer
cacuccugaggugaaauguccug

SEQ ID NO: 50479 - RNA, 23 nt, Artificial Sequence
  RNA Oligomer
acuccugaggugaaauguccugu

SEQ ID NO: 50480 - RNA, 23 nt, Artificial Sequence
  RNA Oligomer
cuccugaggugaaauguccuguu

SEQ ID NO: 50481 - RNA, 23 nt, Artificial Sequence
  RNA Oligomer
uauacuagagguauaaucagugg

SEQ ID NO: 50482 - RNA, 23 nt, Artificial Sequence
  RNA Oligomer
uggcaacucuguauacuguuucc

SEQ ID NO: 50483 - RNA, 23 nt, Artificial Sequence
  RNA Oligomer
ggcaacucuguauacuguuuccg

SEQ ID NO: 50484 - RNA, 23 nt, Artificial Sequence
  RNA Oligomer
gcaacucuguauacuguuuccgg

SEQ ID NO: 50485 - RNA, 23 nt, Artificial Sequence
  RNA Oligomer
caacucuguauacuguuuccgga

SEQ ID NO: 50486 - RNA, 23 nt, Artificial Sequence
  RNA Oligomer
aacucuguauacuguuuccggaa

SEQ ID NO: 50487 - RNA, 23 nt, Artificial Sequence
  RNA Oligomer
ucucuuguccugcaauacuuucu

SEQ ID NO: 50488 - RNA, 23 nt, Artificial Sequence
  RNA Oligomer
cucuuguccugcaauacuuucuu

SEQ ID NO: 50489 - RNA, 23 nt, Artificial Sequence
  RNA Oligomer
ucuuguccugcaauacuuucuug

SEQ ID NO: 50490 - RNA, 23 nt, Artificial Sequence
  RNA Oligomer
cuuguccugcaauacuuucuuga

SEQ ID NO: 50491 - RNA, 23 nt, Artificial Sequence
  RNA Oligomer
uuguccugcaauacuuucuugau

SEQ ID NO: 50492 - RNA, 23 nt, Artificial Sequence
  RNA Oligomer
guccugcaauacuuucuugaugg

SEQ ID NO: 50493 - RNA, 23 nt, Artificial Sequence
  RNA Oligomer
uccugcaauacuuucuugauggc

SEQ ID NO: 50494 - RNA, 23 nt, Artificial Sequence
  RNA Oligomer
ccugcaauacuuucuugauggcg

SEQ ID NO: 50495 - RNA, 23 nt, Artificial Sequence
  RNA Oligomer
cugcaauacuuucuugauggcga

SEQ ID NO: 50496 - RNA, 23 nt, Artificial Sequence
  RNA Oligomer
ugcaauacuuucuugauggcgac

SEQ ID NO: 50497 - RNA, 23 nt, Artificial Sequence
  RNA Oligomer
caagcgauauauuucuccuucaa

SEQ ID NO: 50498 - RNA, 23 nt, Artificial Sequence
  RNA Oligomer
aagcgauauauuucuccuucaag

SEQ ID NO: 50499 - RNA, 23 nt, Artificial Sequence
  RNA Oligomer
agcgauauauuucuccuucaaga

SEQ ID NO: 50500 - RNA, 23 nt, Artificial Sequence
  RNA Oligomer
cacaaaguuuggcuugauauacc

SEQ ID NO: 50501 - RNA, 23 nt, Artificial Sequence
  RNA Oligomer
acaaaguuuggcuugauauacca

SEQ ID NO: 50502 - RNA, 23 nt, Artificial Sequence
  RNA Oligomer
caaaguuuggcuugauauaccac

SEQ ID NO: 50503 - RNA, 23 nt, Artificial Sequence
  RNA Oligomer
aaaguuuggcuugauauaccaca

SEQ ID NO: 50504 - RNA, 23 nt, Artificial Sequence
  RNA Oligomer
aaguuuggcuugauauaccacac

SEQ ID NO: 50505 - RNA, 23 nt, Artificial Sequence
  RNA Oligomer
gcgauauauuucuccuucaagac

SEQ ID NO: 50506 - RNA, 23 nt, Artificial Sequence
  RNA Oligomer
cgauauauuucuccuucaagaca

SEQ ID NO: 50507 - RNA, 23 nt, Artificial Sequence
  RNA Oligomer
gugucuguauagcugacuucuug

SEQ ID NO: 50508 - RNA, 23 nt, Artificial Sequence
  RNA Oligomer
ugucuguauagcugacuucuugu

SEQ ID NO: 50509 - RNA, 23 nt, Artificial Sequence
  RNA Oligomer
gucuguauagcugacuucuugug

SEQ ID NO: 50510 - RNA, 23 nt, Artificial Sequence
  RNA Oligomer
gagcaugaggaggaauaaggaug

SEQ ID NO: 50511 - RNA, 23 nt, Artificial Sequence
  RNA Oligomer
ugaguggugaaguugaagagugc

SEQ ID NO: 50512 - RNA, 23 nt, Artificial Sequence
  RNA Oligomer
gaguggugaaguugaagagugca

SEQ ID NO: 50513 - RNA, 23 nt, Artificial Sequence
  RNA Oligomer
aguggugaaguugaagagugcag

SEQ ID NO: 50514 - RNA, 23 nt, Artificial Sequence
  RNA Oligomer
guggugaaguugaagagugcagg

SEQ ID NO: 50515 - RNA, 23 nt, Artificial Sequence
  RNA Oligomer
uggugaaguugaagagugcaggu

SEQ ID NO: 50516 - RNA, 23 nt, Artificial Sequence
  RNA Oligomer
aaauucuguguaguuuggguuca

SEQ ID NO: 50517 - RNA, 23 nt, Artificial Sequence
  RNA Oligomer
ugauuauuucuaccaacugaucc

SEQ ID NO: 50518 - RNA, 23 nt, Artificial Sequence
  RNA Oligomer
gauuauuucuaccaacugaucca

SEQ ID NO: 50519 - RNA, 23 nt, Artificial Sequence
  RNA Oligomer
auuauuucuaccaacugauccac

SEQ ID NO: 50520 - RNA, 23 nt, Artificial Sequence
  RNA Oligomer
uuauuucuaccaacugauccaca

SEQ ID NO: 50521 - RNA, 23 nt, Artificial Sequence
  RNA Oligomer
uauuucuaccaacugauccacac

SEQ ID NO: 50522 - RNA, 23 nt, Artificial Sequence
  RNA Oligomer
auacaacuugacauaaaucacag

SEQ ID NO: 50523 - RNA, 23 nt, Artificial Sequence
  RNA Oligomer
uacaacuugacauaaaucacagg

SEQ ID NO: 50524 - RNA, 23 nt, Artificial Sequence
  RNA Oligomer
acaacuugacauaaaucacaggg

SEQ ID NO: 50525 - RNA, 23 nt, Artificial Sequence
  RNA Oligomer
caacuugacauaaaucacaggga

SEQ ID NO: 50526 - RNA, 23 nt, Artificial Sequence
  RNA Oligomer
aacuugacauaaaucacagggag

SEQ ID NO: 50527 - RNA, 23 nt, Artificial Sequence
  RNA Oligomer
gcaauacuuucuugauggcgacc

SEQ ID NO: 50528 - RNA, 23 nt, Artificial Sequence
  RNA Oligomer
caauacuuucuugauggcgacca

SEQ ID NO: 50529 - RNA, 23 nt, Artificial Sequence
  RNA Oligomer
aauacuuucuugauggcgaccag

SEQ ID NO: 50530 - RNA, 23 nt, Artificial Sequence
  RNA Oligomer
auuucuccuucaagacagaucgg

SEQ ID NO: 50531 - RNA, 23 nt, Artificial Sequence
  RNA Oligomer
uuucuccuucaagacagaucggc

SEQ ID NO: 50532 - RNA, 23 nt, Artificial Sequence
  RNA Oligomer
uucuccuucaagacagaucggca

SEQ ID NO: 50533 - RNA, 23 nt, Artificial Sequence
  RNA Oligomer
ucuccuucaagacagaucggcac

SEQ ID NO: 50534 - RNA, 23 nt, Artificial Sequence
  RNA Oligomer
gaggaggaauaaggaugguagcc

SEQ ID NO: 50535 - RNA, 23 nt, Artificial Sequence
  RNA Oligomer
auuacuugacaguucuugagugg

SEQ ID NO: 50536 - RNA, 23 nt, Artificial Sequence
  RNA Oligomer
caagcuuccagugguguuagucg

SEQ ID NO: 50537 - RNA, 23 nt, Artificial Sequence
  RNA Oligomer
auuucuaccaacugauccacacc

SEQ ID NO: 50538 - RNA, 23 nt, Artificial Sequence
  RNA Oligomer
uuaauacagcaguaucaggaucc

SEQ ID NO: 50539 - RNA, 23 nt, Artificial Sequence
  RNA Oligomer
uaauacagcaguaucaggaucca

SEQ ID NO: 50540 - RNA, 23 nt, Artificial Sequence
  RNA Oligomer
aauacagcaguaucaggauccaa

SEQ ID NO: 50541 - RNA, 23 nt, Artificial Sequence
  RNA Oligomer
auacagcaguaucaggauccaac

SEQ ID NO: 50542 - RNA, 23 nt, Artificial Sequence
  RNA Oligomer
uacagcaguaucaggauccaaca

SEQ ID NO: 50543 - RNA, 23 nt, Artificial Sequence
  RNA Oligomer
cugcgguuuaauaucccgauggc

SEQ ID NO: 50544 - RNA, 23 nt, Artificial Sequence
  RNA Oligomer
ugcgguuuaauaucccgauggca

SEQ ID NO: 50545 - RNA, 23 nt, Artificial Sequence
  RNA Oligomer
gcgguuuaauaucccgauggcag

SEQ ID NO: 50546 - RNA, 23 nt, Artificial Sequence
  RNA Oligomer
cgguuuaauaucccgauggcaga

SEQ ID NO: 50547 - RNA, 23 nt, Artificial Sequence
  RNA Oligomer
gguuuaauaucccgauggcagau

SEQ ID NO: 50548 - RNA, 23 nt, Artificial Sequence
  RNA Oligomer
guuuaauaucccgauggcagauu

SEQ ID NO: 50549 - RNA, 23 nt, Artificial Sequence
  RNA Oligomer
uuuaauaucccgauggcagauuc

SEQ ID NO: 50550 - RNA, 23 nt, Artificial Sequence
  RNA Oligomer
uuaauaucccgauggcagauucc

SEQ ID NO: 50551 - RNA, 23 nt, Artificial Sequence
  RNA Oligomer
uaauaucccgauggcagauucca

SEQ ID NO: 50552 - RNA, 23 nt, Artificial Sequence
  RNA Oligomer
aauaucccgauggcagauuccaa

SEQ ID NO: 50553 - RNA, 23 nt, Artificial Sequence
  RNA Oligomer
auaucccgauggcagauuccaaa

SEQ ID NO: 50554 - RNA, 23 nt, Artificial Sequence
  RNA Oligomer
acuugacauaaaucacagggagc

SEQ ID NO: 50555 - RNA, 23 nt, Artificial Sequence
  RNA Oligomer
cuugacauaaaucacagggagcg

SEQ ID NO: 50556 - RNA, 23 nt, Artificial Sequence
  RNA Oligomer
uugacauaaaucacagggagcgu

SEQ ID NO: 50557 - RNA, 23 nt, Artificial Sequence
  RNA Oligomer
ucuguuuggcucgacuauagugu

SEQ ID NO: 50558 - RNA, 23 nt, Artificial Sequence
  RNA Oligomer
cuguuuggcucgacuauaguguc

SEQ ID NO: 50559 - RNA, 23 nt, Artificial Sequence
  RNA Oligomer
uguuuggcucgacuauagugucu

SEQ ID NO: 50560 - RNA, 23 nt, Artificial Sequence
  RNA Oligomer
guuuggcucgacuauagugucug

SEQ ID NO: 50561 - RNA, 23 nt, Artificial Sequence
  RNA Oligomer
uuuggcucgacuauagugucugg

SEQ ID NO: 50562 - RNA, 23 nt, Artificial Sequence
  RNA Oligomer
uauguuacagugaucuagcuuuc

SEQ ID NO: 50563 - RNA, 23 nt, Artificial Sequence
  RNA Oligomer
auguuacagugaucuagcuuucu

SEQ ID NO: 50564 - RNA, 23 nt, Artificial Sequence
  RNA Oligomer
uguuacagugaucuagcuuucuc

SEQ ID NO: 50565 - RNA, 23 nt, Artificial Sequence
  RNA Oligomer
guuacagugaucuagcuuucuca

SEQ ID NO: 50566 - RNA, 23 nt, Artificial Sequence
  RNA Oligomer
uuacagugaucuagcuuucucau

SEQ ID NO: 50567 - RNA, 23 nt, Artificial Sequence
  RNA Oligomer
ggcuuuucacuccuuuuguauac

SEQ ID NO: 50568 - RNA, 23 nt, Artificial Sequence
  RNA Oligomer
gcuuuucacuccuuuuguauacu

SEQ ID NO: 50569 - RNA, 23 nt, Artificial Sequence
  RNA Oligomer
cuuuucacuccuuuuguauacua

SEQ ID NO: 50570 - RNA, 23 nt, Artificial Sequence
  RNA Oligomer
uuuucacuccuuuuguauacuau

SEQ ID NO: 50571 - RNA, 23 nt, Artificial Sequence
  RNA Oligomer
uuucacuccuuuuguauacuaua

SEQ ID NO: 50572 - RNA, 23 nt, Artificial Sequence
  RNA Oligomer
ucacuuuagugucuguauagcug

SEQ ID NO: 50573 - RNA, 23 nt, Artificial Sequence
  RNA Oligomer
cacuuuagugucuguauagcuga

SEQ ID NO: 50574 - RNA, 23 nt, Artificial Sequence
  RNA Oligomer
acuuuagugucuguauagcugac

SEQ ID NO: 50575 - RNA, 23 nt, Artificial Sequence
  RNA Oligomer
cuuuagugucuguauagcugacu

SEQ ID NO: 50576 - RNA, 23 nt, Artificial Sequence
  RNA Oligomer
uuuagugucuguauagcugacuu

SEQ ID NO: 50577 - RNA, 23 nt, Artificial Sequence
  RNA Oligomer
guccuugucucugcuaacuuuca

SEQ ID NO: 50578 - RNA, 23 nt, Artificial Sequence
  RNA Oligomer
uccuugucucugcuaacuuucau

SEQ ID NO: 50579 - RNA, 23 nt, Artificial Sequence
  RNA Oligomer
ccuugucucugcuaacuuucaug

SEQ ID NO: 50580 - RNA, 23 nt, Artificial Sequence
  RNA Oligomer
cucaaguaacuggugguuuuucc

SEQ ID NO: 50581 - RNA, 23 nt, Artificial Sequence
  RNA Oligomer
ucaaguaacuggugguuuuuccu

SEQ ID NO: 50582 - RNA, 23 nt, Artificial Sequence
  RNA Oligomer
caaguaacuggugguuuuuccug

SEQ ID NO: 50583 - RNA, 23 nt, Artificial Sequence
  RNA Oligomer
aaguaacuggugguuuuuccugu

SEQ ID NO: 50584 - RNA, 23 nt, Artificial Sequence
  RNA Oligomer
aguaacuggugguuuuuccugug

SEQ ID NO: 50585 - RNA, 23 nt, Artificial Sequence
  RNA Oligomer
aggaggaauaaggaugguagcca

SEQ ID NO: 50586 - RNA, 23 nt, Artificial Sequence
  RNA Oligomer
ggaggaauaaggaugguagccag

SEQ ID NO: 50587 - RNA, 23 nt, Artificial Sequence
  RNA Oligomer
gaggaauaaggaugguagccaga

SEQ ID NO: 50588 - RNA, 23 nt, Artificial Sequence
  RNA Oligomer
aggaauaaggaugguagccagag

SEQ ID NO: 50589 - RNA, 23 nt, Artificial Sequence
  RNA Oligomer
ugguaguuugacauuuggguccc

SEQ ID NO: 50590 - RNA, 23 nt, Artificial Sequence
  RNA Oligomer
ugacauuugggucccguaauuca

SEQ ID NO: 50591 - RNA, 23 nt, Artificial Sequence
  RNA Oligomer
gacauuugggucccguaauucau

SEQ ID NO: 50592 - RNA, 23 nt, Artificial Sequence
  RNA Oligomer
acauuugggucccguaauucauc

SEQ ID NO: 50593 - RNA, 23 nt, Artificial Sequence
  RNA Oligomer
cauuugggucccguaauucauca

SEQ ID NO: 50594 - RNA, 23 nt, Artificial Sequence
  RNA Oligomer
auuugggucccguaauucaucaa

SEQ ID NO: 50595 - RNA, 23 nt, Artificial Sequence
  RNA Oligomer
uagguuaacgauaaaugcagcau

SEQ ID NO: 50596 - RNA, 23 nt, Artificial Sequence
  RNA Oligomer
agguuaacgauaaaugcagcauu

SEQ ID NO: 50597 - RNA, 23 nt, Artificial Sequence
  RNA Oligomer
aauucaucaaaaaaugaaugugc

SEQ ID NO: 50598 - RNA, 23 nt, Artificial Sequence
  RNA Oligomer
auucaucaaaaaaugaaugugca

SEQ ID NO: 50599 - RNA, 23 nt, Artificial Sequence
  RNA Oligomer
uucaucaaaaaaugaaugugcac

SEQ ID NO: 50600 - RNA, 23 nt, Artificial Sequence
  RNA Oligomer
ucaucaaaaaaugaaugugcaca

SEQ ID NO: 50601 - RNA, 23 nt, Artificial Sequence
  RNA Oligomer
caucaaaaaaugaaugugcacaa

SEQ ID NO: 50602 - RNA, 23 nt, Artificial Sequence
  RNA Oligomer
acgauaaaugcagcauuaaguuc

SEQ ID NO: 50603 - RNA, 23 nt, Artificial Sequence
  RNA Oligomer
aauucuguguaguuuggguucau

SEQ ID NO: 50604 - RNA, 23 nt, Artificial Sequence
  RNA Oligomer
ugcagcauuaaguucucccacag

SEQ ID NO: 50605 - RNA, 23 nt, Artificial Sequence
  RNA Oligomer
caggaccuugauuauuucuacca

SEQ ID NO: 50606 - RNA, 23 nt, Artificial Sequence
  RNA Oligomer
aggaccuugauuauuucuaccaa

SEQ ID NO: 50607 - RNA, 23 nt, Artificial Sequence
  RNA Oligomer
ggaccuugauuauuucuaccaac

SEQ ID NO: 50608 - RNA, 23 nt, Artificial Sequence
  RNA Oligomer
gaccuugauuauuucuaccaacu

SEQ ID NO: 50609 - RNA, 23 nt, Artificial Sequence
  RNA Oligomer
accuugauuauuucuaccaacug

SEQ ID NO: 50610 - RNA, 23 nt, Artificial Sequence
  RNA Oligomer
ccuugauuauuucuaccaacuga

SEQ ID NO: 50611 - RNA, 23 nt, Artificial Sequence
  RNA Oligomer
cuugauuauuucuaccaacugau

SEQ ID NO: 50612 - RNA, 23 nt, Artificial Sequence
  RNA Oligomer
uugauuauuucuaccaacugauc

SEQ ID NO: 50613 - RNA, 23 nt, Artificial Sequence
  RNA Oligomer
uuucuaccaacugauccacacca

SEQ ID NO: 50614 - RNA, 23 nt, Artificial Sequence
  RNA Oligomer
uugguuguccuaguaacagcuca

SEQ ID NO: 50615 - RNA, 23 nt, Artificial Sequence
  RNA Oligomer
ugguuguccuaguaacagcucag

SEQ ID NO: 50616 - RNA, 23 nt, Artificial Sequence
  RNA Oligomer
gguuguccuaguaacagcucagc

SEQ ID NO: 50617 - RNA, 23 nt, Artificial Sequence
  RNA Oligomer
guuguccuaguaacagcucagcc

SEQ ID NO: 50618 - RNA, 23 nt, Artificial Sequence
  RNA Oligomer
uuguccuaguaacagcucagcca

SEQ ID NO: 50619 - RNA, 23 nt, Artificial Sequence
  RNA Oligomer
uaucccgauggcagauuccaaag

SEQ ID NO: 50620 - RNA, 23 nt, Artificial Sequence
  RNA Oligomer
acagcugauacauauacaacuug

SEQ ID NO: 50621 - RNA, 23 nt, Artificial Sequence
  RNA Oligomer
cagcugauacauauacaacuuga

SEQ ID NO: 50622 - RNA, 23 nt, Artificial Sequence
  RNA Oligomer
agcugauacauauacaacuugac

SEQ ID NO: 50623 - RNA, 23 nt, Artificial Sequence
  RNA Oligomer
gcugauacauauacaacuugaca

SEQ ID NO: 50624 - RNA, 23 nt, Artificial Sequence
  RNA Oligomer
cugauacauauacaacuugacau

SEQ ID NO: 50625 - RNA, 23 nt, Artificial Sequence
  RNA Oligomer
ugacauaaaucacagggagcguc

SEQ ID NO: 50626 - RNA, 23 nt, Artificial Sequence
  RNA Oligomer
gacauaaaucacagggagcgucu

SEQ ID NO: 50627 - RNA, 23 nt, Artificial Sequence
  RNA Oligomer
acauaaaucacagggagcgucug

SEQ ID NO: 50628 - RNA, 23 nt, Artificial Sequence
  RNA Oligomer
cauaaaucacagggagcgucugu

SEQ ID NO: 50629 - RNA, 23 nt, Artificial Sequence
  RNA Oligomer
auaaaucacagggagcgucuguu

SEQ ID NO: 50630 - RNA, 23 nt, Artificial Sequence
  RNA Oligomer
aguccagcaccagauuaagauag

SEQ ID NO: 50631 - RNA, 23 nt, Artificial Sequence
  RNA Oligomer
guccagcaccagauuaagauaga

SEQ ID NO: 50632 - RNA, 23 nt, Artificial Sequence
  RNA Oligomer
uccagcaccagauuaagauagac

SEQ ID NO: 50633 - RNA, 23 nt, Artificial Sequence
  RNA Oligomer
ccagcaccagauuaagauagacc

SEQ ID NO: 50634 - RNA, 23 nt, Artificial Sequence
  RNA Oligomer
cagcaccagauuaagauagaccu

SEQ ID NO: 50635 - RNA, 23 nt, Artificial Sequence
  RNA Oligomer
agcaccagauuaagauagaccuc

SEQ ID NO: 50636 - RNA, 23 nt, Artificial Sequence
  RNA Oligomer
gcaccagauuaagauagaccuca

SEQ ID NO: 50637 - RNA, 23 nt, Artificial Sequence
  RNA Oligomer
caccagauuaagauagaccucau

SEQ ID NO: 50638 - RNA, 23 nt, Artificial Sequence
  RNA Oligomer
accagauuaagauagaccucauc

SEQ ID NO: 50639 - RNA, 23 nt, Artificial Sequence
  RNA Oligomer
ccagauuaagauagaccucaucu

SEQ ID NO: 50640 - RNA, 23 nt, Artificial Sequence
  RNA Oligomer
cagauuaagauagaccucaucuu

SEQ ID NO: 50641 - RNA, 23 nt, Artificial Sequence
  RNA Oligomer
auacuuucuugauggcgaccagu

SEQ ID NO: 50642 - RNA, 23 nt, Artificial Sequence
  RNA Oligomer
cccugacaugaucacucucuucg

SEQ ID NO: 50643 - RNA, 23 nt, Artificial Sequence
  RNA Oligomer
ccugacaugaucacucucuucgc

SEQ ID NO: 50644 - RNA, 23 nt, Artificial Sequence
  RNA Oligomer
cugacaugaucacucucuucgcg

SEQ ID NO: 50645 - RNA, 23 nt, Artificial Sequence
  RNA Oligomer
ugacaugaucacucucuucgcga

SEQ ID NO: 50646 - RNA, 23 nt, Artificial Sequence
  RNA Oligomer
gacaugaucacucucuucgcgaa

SEQ ID NO: 50647 - RNA, 23 nt, Artificial Sequence
  RNA Oligomer
cuccuucaagacagaucggcacg

SEQ ID NO: 50648 - RNA, 23 nt, Artificial Sequence
  RNA Oligomer
uccuucaagacagaucggcacgg

SEQ ID NO: 50649 - RNA, 23 nt, Artificial Sequence
  RNA Oligomer
ucucuucgcgaaucaccuuuucc

SEQ ID NO: 50650 - RNA, 23 nt, Artificial Sequence
  RNA Oligomer
cucuucgcgaaucaccuuuuccu

SEQ ID NO: 50651 - RNA, 23 nt, Artificial Sequence
  RNA Oligomer
ucuucgcgaaucaccuuuuccuu

SEQ ID NO: 50652 - RNA, 23 nt, Artificial Sequence
  RNA Oligomer
cuucgcgaaucaccuuuuccuuc

SEQ ID NO: 50653 - RNA, 23 nt, Artificial Sequence
  RNA Oligomer
uucgcgaaucaccuuuuccuucc

SEQ ID NO: 50654 - RNA, 23 nt, Artificial Sequence
  RNA Oligomer
gcgaaucaccuuuuccuuccuuc

SEQ ID NO: 50655 - RNA, 23 nt, Artificial Sequence
  RNA Oligomer
cgaaucaccuuuuccuuccuucc

SEQ ID NO: 50656 - RNA, 23 nt, Artificial Sequence
  RNA Oligomer
gaaucaccuuuuccuuccuuccu

SEQ ID NO: 50657 - RNA, 23 nt, Artificial Sequence
  RNA Oligomer
aaucaccuuuuccuuccuuccuc

SEQ ID NO: 50658 - RNA, 23 nt, Artificial Sequence
  RNA Oligomer
aucaccuuuuccuuccuuccucc

SEQ ID NO: 50659 - RNA, 23 nt, Artificial Sequence
  RNA Oligomer
augcagaagcagcauuauugguc

SEQ ID NO: 50660 - RNA, 23 nt, Artificial Sequence
  RNA Oligomer
ugcagaagcagcauuauuggucu

SEQ ID NO: 50661 - RNA, 23 nt, Artificial Sequence
  RNA Oligomer
gcagaagcagcauuauuggucug

SEQ ID NO: 50662 - RNA, 23 nt, Artificial Sequence
  RNA Oligomer
cagaagcagcauuauuggucugu

SEQ ID NO: 50663 - RNA, 23 nt, Artificial Sequence
  RNA Oligomer
agaagcagcauuauuggucuguc

SEQ ID NO: 50664 - RNA, 23 nt, Artificial Sequence
  RNA Oligomer
uccgagcaugaggaggaauaagg

SEQ ID NO: 50665 - RNA, 23 nt, Artificial Sequence
  RNA Oligomer
ccgagcaugaggaggaauaagga

SEQ ID NO: 50666 - RNA, 23 nt, Artificial Sequence
  RNA Oligomer
cgagcaugaggaggaauaaggau

SEQ ID NO: 50667 - RNA, 23 nt, Artificial Sequence
  RNA Oligomer
ucuugaguggugaaguugaagag

SEQ ID NO: 50668 - RNA, 23 nt, Artificial Sequence
  RNA Oligomer
cuugaguggugaaguugaagagu

SEQ ID NO: 50669 - RNA, 23 nt, Artificial Sequence
  RNA Oligomer
uugaguggugaaguugaagagug

SEQ ID NO: 50670 - RNA, 23 nt, Artificial Sequence
  RNA Oligomer
gguguuagucgggcaguuggugu

SEQ ID NO: 50671 - RNA, 23 nt, Artificial Sequence
  RNA Oligomer
guguuagucgggcaguuggugua

SEQ ID NO: 50672 - RNA, 23 nt, Artificial Sequence
  RNA Oligomer
uguuagucgggcaguugguguau

SEQ ID NO: 50673 - RNA, 23 nt, Artificial Sequence
  RNA Oligomer
guuagucgggcaguugguguaua

SEQ ID NO: 50674 - RNA, 23 nt, Artificial Sequence
  RNA Oligomer
uuagucgggcaguugguguauac

SEQ ID NO: 50675 - RNA, 23 nt, Artificial Sequence
  RNA Oligomer
aggugaaauguccuguuccugac

SEQ ID NO: 50676 - RNA, 23 nt, Artificial Sequence
  RNA Oligomer
ggugaaauguccuguuccugacg

SEQ ID NO: 50677 - RNA, 23 nt, Artificial Sequence
  RNA Oligomer
gugaaauguccuguuccugacga

SEQ ID NO: 50678 - RNA, 23 nt, Artificial Sequence
  RNA Oligomer
ugaaauguccuguuccugacgaa

SEQ ID NO: 50679 - RNA, 23 nt, Artificial Sequence
  RNA Oligomer
gaaauguccuguuccugacgaau

SEQ ID NO: 50680 - RNA, 23 nt, Artificial Sequence
  RNA Oligomer
uucauuucucugauuugcucccu

SEQ ID NO: 50681 - RNA, 23 nt, Artificial Sequence
  RNA Oligomer
ucauuucucugauuugcucccuu

SEQ ID NO: 50682 - RNA, 23 nt, Artificial Sequence
  RNA Oligomer
cauuucucugauuugcucccuug

SEQ ID NO: 50683 - RNA, 23 nt, Artificial Sequence
  RNA Oligomer
auuucucugauuugcucccuugu

SEQ ID NO: 50684 - RNA, 23 nt, Artificial Sequence
  RNA Oligomer
uuucucugauuugcucccuuguu

SEQ ID NO: 50685 - RNA, 23 nt, Artificial Sequence
  RNA Oligomer
ccaggaccuugauuauuucuacc

SEQ ID NO: 50686 - RNA, 23 nt, Artificial Sequence
  RNA Oligomer
aaagucacagaguuuuaauacag

SEQ ID NO: 50687 - RNA, 23 nt, Artificial Sequence
  RNA Oligomer
aagucacagaguuuuaauacagc

SEQ ID NO: 50688 - RNA, 23 nt, Artificial Sequence
  RNA Oligomer
agucacagaguuuuaauacagca

SEQ ID NO: 50689 - RNA, 23 nt, Artificial Sequence
  RNA Oligomer
gucacagaguuuuaauacagcag

SEQ ID NO: 50690 - RNA, 23 nt, Artificial Sequence
  RNA Oligomer
ucacagaguuuuaauacagcagu

SEQ ID NO: 50691 - RNA, 23 nt, Artificial Sequence
  RNA Oligomer
cacagaguuuuaauacagcagua

SEQ ID NO: 50692 - RNA, 23 nt, Artificial Sequence
  RNA Oligomer
uaaaucacagggagcgucuguuu

SEQ ID NO: 50693 - RNA, 23 nt, Artificial Sequence
  RNA Oligomer
uguccugcaauacuuucuugaug

SEQ ID NO: 50694 - RNA, 23 nt, Artificial Sequence
  RNA Oligomer
ucgcgaaucaccuuuuccuuccu

SEQ ID NO: 50695 - RNA, 23 nt, Artificial Sequence
  RNA Oligomer
cgcgaaucaccuuuuccuuccuu

SEQ ID NO: 50696 - RNA, 23 nt, Artificial Sequence
  RNA Oligomer
ggugguuuuuccugugcagcugg

SEQ ID NO: 50697 - RNA, 23 nt, Artificial Sequence
  RNA Oligomer
gaagcagcauuauuggucugucc

SEQ ID NO: 50698 - RNA, 23 nt, Artificial Sequence
  RNA Oligomer
aagcagcauuauuggucugucca

SEQ ID NO: 50699 - RNA, 23 nt, Artificial Sequence
  RNA Oligomer
agcagcauuauuggucuguccac

SEQ ID NO: 50700 - RNA, 23 nt, Artificial Sequence
  RNA Oligomer
gcagcauuauuggucuguccacg

SEQ ID NO: 50701 - RNA, 23 nt, Artificial Sequence
  RNA Oligomer
cagcauuauuggucuguccacgg

SEQ ID NO: 50702 - RNA, 23 nt, Artificial Sequence
  RNA Oligomer
acaguucuugaguggugaaguug

SEQ ID NO: 50703 - RNA, 23 nt, Artificial Sequence
  RNA Oligomer
caguucuugaguggugaaguuga

SEQ ID NO: 50704 - RNA, 23 nt, Artificial Sequence
  RNA Oligomer
aguucuugaguggugaaguugaa

SEQ ID NO: 50705 - RNA, 23 nt, Artificial Sequence
  RNA Oligomer
guucuugaguggugaaguugaag

SEQ ID NO: 50706 - RNA, 23 nt, Artificial Sequence
  RNA Oligomer
uucuugaguggugaaguugaaga

SEQ ID NO: 50707 - RNA, 23 nt, Artificial Sequence
  RNA Oligomer
ggguguuagguuaacgauaaaug

SEQ ID NO: 50708 - RNA, 23 nt, Artificial Sequence
  RNA Oligomer
aaugaaugugcacaagcuuccag

SEQ ID NO: 50709 - RNA, 23 nt, Artificial Sequence
  RNA Oligomer
augaaugugcacaagcuuccagu

SEQ ID NO: 50710 - RNA, 23 nt, Artificial Sequence
  RNA Oligomer
ugaaugugcacaagcuuccagug

SEQ ID NO: 50711 - RNA, 23 nt, Artificial Sequence
  RNA Oligomer
gaaugugcacaagcuuccagugg

SEQ ID NO: 50712 - RNA, 23 nt, Artificial Sequence
  RNA Oligomer
aaugugcacaagcuuccaguggu

SEQ ID NO: 50713 - RNA, 23 nt, Artificial Sequence
  RNA Oligomer
aauguccuguuccugacgaaucc

SEQ ID NO: 50714 - RNA, 23 nt, Artificial Sequence
  RNA Oligomer
auguccuguuccugacgaauccu

SEQ ID NO: 50715 - RNA, 23 nt, Artificial Sequence
  RNA Oligomer
uguccuguuccugacgaauccuu

SEQ ID NO: 50716 - RNA, 23 nt, Artificial Sequence
  RNA Oligomer
guccuguuccugacgaauccuua

SEQ ID NO: 50717 - RNA, 23 nt, Artificial Sequence
  RNA Oligomer
uccuguuccugacgaauccuuag

SEQ ID NO: 50718 - RNA, 23 nt, Artificial Sequence
  RNA Oligomer
uuggguucauuucucugauuugc

SEQ ID NO: 50719 - RNA, 23 nt, Artificial Sequence
  RNA Oligomer
uggguucauuucucugauuugcu

SEQ ID NO: 50720 - RNA, 23 nt, Artificial Sequence
  RNA Oligomer
ggguucauuucucugauuugcuc

SEQ ID NO: 50721 - RNA, 23 nt, Artificial Sequence
  RNA Oligomer
gguucauuucucugauuugcucc

SEQ ID NO: 50722 - RNA, 23 nt, Artificial Sequence
  RNA Oligomer
guucauuucucugauuugcuccc

SEQ ID NO: 50723 - RNA, 23 nt, Artificial Sequence
  RNA Oligomer
ucucugauuugcucccuuguugg

SEQ ID NO: 50724 - RNA, 23 nt, Artificial Sequence
  RNA Oligomer
cucugauuugcucccuuguugga

SEQ ID NO: 50725 - RNA, 23 nt, Artificial Sequence
  RNA Oligomer
ucugauuugcucccuuguuggag

SEQ ID NO: 50726 - RNA, 23 nt, Artificial Sequence
  RNA Oligomer
cugauuugcucccuuguuggagu

SEQ ID NO: 50727 - RNA, 23 nt, Artificial Sequence
  RNA Oligomer
ugauuugcucccuuguuggaguu

SEQ ID NO: 50728 - RNA, 23 nt, Artificial Sequence
  RNA Oligomer
ccaacugauccacaccacuaucc

SEQ ID NO: 50729 - RNA, 23 nt, Artificial Sequence
  RNA Oligomer
caacugauccacaccacuauccc

SEQ ID NO: 50730 - RNA, 23 nt, Artificial Sequence
  RNA Oligomer
aacugauccacaccacuaucccc

SEQ ID NO: 50731 - RNA, 23 nt, Artificial Sequence
  RNA Oligomer
acugauccacaccacuauccccu

SEQ ID NO: 50732 - RNA, 23 nt, Artificial Sequence
  RNA Oligomer
cugauccacaccacuauccccug

SEQ ID NO: 50733 - RNA, 23 nt, Artificial Sequence
  RNA Oligomer
uauaguaccgagaacagauauac

SEQ ID NO: 50734 - RNA, 23 nt, Artificial Sequence
  RNA Oligomer
auaguaccgagaacagauauacg

SEQ ID NO: 50735 - RNA, 23 nt, Artificial Sequence
  RNA Oligomer
uaguaccgagaacagauauacga

SEQ ID NO: 50736 - RNA, 23 nt, Artificial Sequence
  RNA Oligomer
aguaccgagaacagauauacgaa

SEQ ID NO: 50737 - RNA, 23 nt, Artificial Sequence
  RNA Oligomer
guaccgagaacagauauacgaaa

SEQ ID NO: 50738 - RNA, 23 nt, Artificial Sequence
  RNA Oligomer
acagaguuuuaauacagcaguau

SEQ ID NO: 50739 - RNA, 23 nt, Artificial Sequence
  RNA Oligomer
cagaguuuuaauacagcaguauc

SEQ ID NO: 50740 - RNA, 23 nt, Artificial Sequence
  RNA Oligomer
ucggaacagcugauacauauaca

SEQ ID NO: 50741 - RNA, 23 nt, Artificial Sequence
  RNA Oligomer
cggaacagcugauacauauacaa

SEQ ID NO: 50742 - RNA, 23 nt, Artificial Sequence
  RNA Oligomer
ggaacagcugauacauauacaac

SEQ ID NO: 50743 - RNA, 23 nt, Artificial Sequence
  RNA Oligomer
gaacagcugauacauauacaacu

SEQ ID NO: 50744 - RNA, 23 nt, Artificial Sequence
  RNA Oligomer
aacagcugauacauauacaacuu

SEQ ID NO: 50745 - RNA, 23 nt, Artificial Sequence
  RNA Oligomer
ugauacauauacaacuugacaua

SEQ ID NO: 50746 - RNA, 23 nt, Artificial Sequence
  RNA Oligomer
gauacauauacaacuugacauaa

SEQ ID NO: 50747 - RNA, 23 nt, Artificial Sequence
  RNA Oligomer
gcgucuguuuggcucgacuauag

SEQ ID NO: 50748 - RNA, 23 nt, Artificial Sequence
  RNA Oligomer
cgucuguuuggcucgacuauagu

SEQ ID NO: 50749 - RNA, 23 nt, Artificial Sequence
  RNA Oligomer
gucuguuuggcucgacuauagug

SEQ ID NO: 50750 - RNA, 23 nt, Artificial Sequence
  RNA Oligomer
acucuguauacuguuuccggaac

SEQ ID NO: 50751 - RNA, 23 nt, Artificial Sequence
  RNA Oligomer
gaucuagcuuucucaugaucugg

SEQ ID NO: 50752 - RNA, 23 nt, Artificial Sequence
  RNA Oligomer
aucuagcuuucucaugaucugga

SEQ ID NO: 50753 - RNA, 23 nt, Artificial Sequence
  RNA Oligomer
ucuagcuuucucaugaucuggag

SEQ ID NO: 50754 - RNA, 23 nt, Artificial Sequence
  RNA Oligomer
cuagcuuucucaugaucuggagc

SEQ ID NO: 50755 - RNA, 23 nt, Artificial Sequence
  RNA Oligomer
uagcuuucucaugaucuggagcu

SEQ ID NO: 50756 - RNA, 23 nt, Artificial Sequence
  RNA Oligomer
uacuuucuugauggcgaccaguu

SEQ ID NO: 50757 - RNA, 23 nt, Artificial Sequence
  RNA Oligomer
acuuucuugauggcgaccaguuc

SEQ ID NO: 50758 - RNA, 23 nt, Artificial Sequence
  RNA Oligomer
aguuuggcuugauauaccacacc

SEQ ID NO: 50759 - RNA, 23 nt, Artificial Sequence
  RNA Oligomer
caccacuguugucaccuugcugc

SEQ ID NO: 50760 - RNA, 23 nt, Artificial Sequence
  RNA Oligomer
accacuguugucaccuugcugcc

SEQ ID NO: 50761 - RNA, 23 nt, Artificial Sequence
  RNA Oligomer
ccacuguugucaccuugcugccg

SEQ ID NO: 50762 - RNA, 23 nt, Artificial Sequence
  RNA Oligomer
cacuguugucaccuugcugccgu

SEQ ID NO: 50763 - RNA, 23 nt, Artificial Sequence
  RNA Oligomer
acuguugucaccuugcugccguc

SEQ ID NO: 50764 - RNA, 23 nt, Artificial Sequence
  RNA Oligomer
acaugaucacucucuucgcgaau

SEQ ID NO: 50765 - RNA, 23 nt, Artificial Sequence
  RNA Oligomer
caugaucacucucuucgcgaauc

SEQ ID NO: 50766 - RNA, 23 nt, Artificial Sequence
  RNA Oligomer
cgggacuguucagguggaguugg

SEQ ID NO: 50767 - RNA, 23 nt, Artificial Sequence
  RNA Oligomer
gggacuguucagguggaguugga

SEQ ID NO: 50768 - RNA, 23 nt, Artificial Sequence
  RNA Oligomer
ggacuguucagguggaguuggaa

SEQ ID NO: 50769 - RNA, 23 nt, Artificial Sequence
  RNA Oligomer
gacuguucagguggaguuggaag

SEQ ID NO: 50770 - RNA, 23 nt, Artificial Sequence
  RNA Oligomer
acuguucagguggaguuggaagc

SEQ ID NO: 50771 - RNA, 23 nt, Artificial Sequence
  RNA Oligomer
uacuugacaguucuugaguggug

SEQ ID NO: 50772 - RNA, 23 nt, Artificial Sequence
  RNA Oligomer
acuugacaguucuugagugguga

SEQ ID NO: 50773 - RNA, 23 nt, Artificial Sequence
  RNA Oligomer
cuugacaguucuugaguggugaa

SEQ ID NO: 50774 - RNA, 23 nt, Artificial Sequence
  RNA Oligomer
uugacaguucuugaguggugaag

SEQ ID NO: 50775 - RNA, 23 nt, Artificial Sequence
  RNA Oligomer
ugacaguucuugaguggugaagu

SEQ ID NO: 50776 - RNA, 23 nt, Artificial Sequence
  RNA Oligomer
aucaaaaaaugaaugugcacaag

SEQ ID NO: 50777 - RNA, 23 nt, Artificial Sequence
  RNA Oligomer
ucaaaaaaugaaugugcacaagc

SEQ ID NO: 50778 - RNA, 23 nt, Artificial Sequence
  RNA Oligomer
caaaaaaugaaugugcacaagcu

SEQ ID NO: 50779 - RNA, 23 nt, Artificial Sequence
  RNA Oligomer
aaaaaaugaaugugcacaagcuu

SEQ ID NO: 50780 - RNA, 23 nt, Artificial Sequence
  RNA Oligomer
aaaaaugaaugugcacaagcuuc

SEQ ID NO: 50781 - RNA, 23 nt, Artificial Sequence
  RNA Oligomer
gguuaacgauaaaugcagcauua

SEQ ID NO: 50782 - RNA, 23 nt, Artificial Sequence
  RNA Oligomer
guuaacgauaaaugcagcauuaa

SEQ ID NO: 50783 - RNA, 23 nt, Artificial Sequence
  RNA Oligomer
uagucgggcaguugguguauacu

SEQ ID NO: 50784 - RNA, 23 nt, Artificial Sequence
  RNA Oligomer
uucucugauuugcucccuuguug

SEQ ID NO: 50785 - RNA, 23 nt, Artificial Sequence
  RNA Oligomer
cccaggaccuugauuauuucuac

SEQ ID NO: 50786 - RNA, 23 nt, Artificial Sequence
  RNA Oligomer
agagguauaaucaguggcuccaa

SEQ ID NO: 50787 - RNA, 23 nt, Artificial Sequence
  RNA Oligomer
gagguauaaucaguggcuccaaa

SEQ ID NO: 50788 - RNA, 23 nt, Artificial Sequence
  RNA Oligomer
agguauaaucaguggcuccaaag

SEQ ID NO: 50789 - RNA, 23 nt, Artificial Sequence
  RNA Oligomer
uaccgagaacagauauacgaaac

SEQ ID NO: 50790 - RNA, 23 nt, Artificial Sequence
  RNA Oligomer
accgagaacagauauacgaaaca

SEQ ID NO: 50791 - RNA, 23 nt, Artificial Sequence
  RNA Oligomer
agaguuuuaauacagcaguauca

SEQ ID NO: 50792 - RNA, 23 nt, Artificial Sequence
  RNA Oligomer
auuccaaaggaauggauauaggc

SEQ ID NO: 50793 - RNA, 23 nt, Artificial Sequence
  RNA Oligomer
uuccaaaggaauggauauaggcu

SEQ ID NO: 50794 - RNA, 23 nt, Artificial Sequence
  RNA Oligomer
uccaaaggaauggauauaggcua

SEQ ID NO: 50795 - RNA, 23 nt, Artificial Sequence
  RNA Oligomer
ccaaaggaauggauauaggcuaa

SEQ ID NO: 50796 - RNA, 23 nt, Artificial Sequence
  RNA Oligomer
caaaggaauggauauaggcuaaa

SEQ ID NO: 50797 - RNA, 23 nt, Artificial Sequence
  RNA Oligomer
aaaggaauggauauaggcuaaac

SEQ ID NO: 50798 - RNA, 23 nt, Artificial Sequence
  RNA Oligomer
aaggaauggauauaggcuaaacu

SEQ ID NO: 50799 - RNA, 23 nt, Artificial Sequence
  RNA Oligomer
uucggaacagcugauacauauac

SEQ ID NO: 50800 - RNA, 23 nt, Artificial Sequence
  RNA Oligomer
auauacaacuugacauaaaucac

SEQ ID NO: 50801 - RNA, 23 nt, Artificial Sequence
  RNA Oligomer
uauacaacuugacauaaaucaca

SEQ ID NO: 50802 - RNA, 23 nt, Artificial Sequence
  RNA Oligomer
uaagauagaccucaucuuucuuc

SEQ ID NO: 50803 - RNA, 23 nt, Artificial Sequence
  RNA Oligomer
aagauagaccucaucuuucuucu

SEQ ID NO: 50804 - RNA, 23 nt, Artificial Sequence
  RNA Oligomer
agauagaccucaucuuucuucuc

SEQ ID NO: 50805 - RNA, 23 nt, Artificial Sequence
  RNA Oligomer
gauagaccucaucuuucuucuca

SEQ ID NO: 50806 - RNA, 23 nt, Artificial Sequence
  RNA Oligomer
auagaccucaucuuucuucucac

SEQ ID NO: 50807 - RNA, 23 nt, Artificial Sequence
  RNA Oligomer
cucaucuuucuucucaccacugg

SEQ ID NO: 50808 - RNA, 23 nt, Artificial Sequence
  RNA Oligomer
ucaucuuucuucucaccacugga

SEQ ID NO: 50809 - RNA, 23 nt, Artificial Sequence
  RNA Oligomer
caucuuucuucucaccacuggag

SEQ ID NO: 50810 - RNA, 23 nt, Artificial Sequence
  RNA Oligomer
aucuuucuucucaccacuggagu

SEQ ID NO: 50811 - RNA, 23 nt, Artificial Sequence
  RNA Oligomer
ucuuucuucucaccacuggagua

SEQ ID NO: 50812 - RNA, 23 nt, Artificial Sequence
  RNA Oligomer
uacagugaucuagcuuucucaug

SEQ ID NO: 50813 - RNA, 23 nt, Artificial Sequence
  RNA Oligomer
acagugaucuagcuuucucauga

SEQ ID NO: 50814 - RNA, 23 nt, Artificial Sequence
  RNA Oligomer
uucuuaaaucucuuguccugcaa

SEQ ID NO: 50815 - RNA, 23 nt, Artificial Sequence
  RNA Oligomer
ucuuaaaucucuuguccugcaau

SEQ ID NO: 50816 - RNA, 23 nt, Artificial Sequence
  RNA Oligomer
cuuaaaucucuuguccugcaaua

SEQ ID NO: 50817 - RNA, 23 nt, Artificial Sequence
  RNA Oligomer
uuaaaucucuuguccugcaauac

SEQ ID NO: 50818 - RNA, 23 nt, Artificial Sequence
  RNA Oligomer
ugauauaccacaccaaaugaucc

SEQ ID NO: 50819 - RNA, 23 nt, Artificial Sequence
  RNA Oligomer
gauauaccacaccaaaugaucca

SEQ ID NO: 50820 - RNA, 23 nt, Artificial Sequence
  RNA Oligomer
auauaccacaccaaaugauccau

SEQ ID NO: 50821 - RNA, 23 nt, Artificial Sequence
  RNA Oligomer
uauaccacaccaaaugauccauu

SEQ ID NO: 50822 - RNA, 23 nt, Artificial Sequence
  RNA Oligomer
auaccacaccaaaugauccauuu

SEQ ID NO: 50823 - RNA, 23 nt, Artificial Sequence
  RNA Oligomer
uaccacaccaaaugauccauuuc

SEQ ID NO: 50824 - RNA, 23 nt, Artificial Sequence
  RNA Oligomer
accaaaugauccauuuccaauca

SEQ ID NO: 50825 - RNA, 23 nt, Artificial Sequence
  RNA Oligomer
ccaaaugauccauuuccaaucac

SEQ ID NO: 50826 - RNA, 23 nt, Artificial Sequence
  RNA Oligomer
caaaugauccauuuccaaucacu

SEQ ID NO: 50827 - RNA, 23 nt, Artificial Sequence
  RNA Oligomer
aaaugauccauuuccaaucacuu

SEQ ID NO: 50828 - RNA, 23 nt, Artificial Sequence
  RNA Oligomer
aaugauccauuuccaaucacuuu

SEQ ID NO: 50829 - RNA, 23 nt, Artificial Sequence
  RNA Oligomer
cucucuucgcgaaucaccuuuuc

SEQ ID NO: 50830 - RNA, 23 nt, Artificial Sequence
  RNA Oligomer
guaacuggugguuuuuccugugc

SEQ ID NO: 50831 - RNA, 23 nt, Artificial Sequence
  RNA Oligomer
uaacuggugguuuuuccugugca

SEQ ID NO: 50832 - RNA, 23 nt, Artificial Sequence
  RNA Oligomer
aacuggugguuuuuccugugcag

SEQ ID NO: 50833 - RNA, 23 nt, Artificial Sequence
  RNA Oligomer
acuggugguuuuuccugugcagc

SEQ ID NO: 50834 - RNA, 23 nt, Artificial Sequence
  RNA Oligomer
cuggugguuuuuccugugcagcu

SEQ ID NO: 50835 - RNA, 23 nt, Artificial Sequence
  RNA Oligomer
uuacuugacaguucuugaguggu

SEQ ID NO: 50836 - RNA, 23 nt, Artificial Sequence
  RNA Oligomer
aaaaugaaugugcacaagcuucc

SEQ ID NO: 50837 - RNA, 23 nt, Artificial Sequence
  RNA Oligomer
uuaacgauaaaugcagcauuaag

SEQ ID NO: 50838 - RNA, 23 nt, Artificial Sequence
  RNA Oligomer
uugguguauacuccagcagacgg

SEQ ID NO: 50839 - RNA, 23 nt, Artificial Sequence
  RNA Oligomer
ugguguauacuccagcagacggc

SEQ ID NO: 50840 - RNA, 23 nt, Artificial Sequence
  RNA Oligomer
gguguauacuccagcagacggcu

SEQ ID NO: 50841 - RNA, 23 nt, Artificial Sequence
  RNA Oligomer
guguauacuccagcagacggcua

SEQ ID NO: 50842 - RNA, 23 nt, Artificial Sequence
  RNA Oligomer
uguauacuccagcagacggcuac

SEQ ID NO: 50843 - RNA, 23 nt, Artificial Sequence
  RNA Oligomer
ccuguuccugacgaauccuuagu

SEQ ID NO: 50844 - RNA, 23 nt, Artificial Sequence
  RNA Oligomer
cuguuccugacgaauccuuaguc

SEQ ID NO: 50845 - RNA, 23 nt, Artificial Sequence
  RNA Oligomer
uguuccugacgaauccuuagucc

SEQ ID NO: 50846 - RNA, 23 nt, Artificial Sequence
  RNA Oligomer
guuccugacgaauccuuagucca

SEQ ID NO: 50847 - RNA, 23 nt, Artificial Sequence
  RNA Oligomer
uuccugacgaauccuuaguccaa

SEQ ID NO: 50848 - RNA, 23 nt, Artificial Sequence
  RNA Oligomer
ccaaagucacagaguuuuaauac

SEQ ID NO: 50849 - RNA, 23 nt, Artificial Sequence
  RNA Oligomer
caaagucacagaguuuuaauaca

SEQ ID NO: 50850 - RNA, 23 nt, Artificial Sequence
  RNA Oligomer
cuggcaacucuguauacuguuuc

SEQ ID NO: 50851 - RNA, 23 nt, Artificial Sequence
  RNA Oligomer
uagaccucaucuuucuucucacc

SEQ ID NO: 50852 - RNA, 23 nt, Artificial Sequence
  RNA Oligomer
acuggaguagaagaaauaacgca

SEQ ID NO: 50853 - RNA, 23 nt, Artificial Sequence
  RNA Oligomer
cuggaguagaagaaauaacgcaa

SEQ ID NO: 50854 - RNA, 23 nt, Artificial Sequence
  RNA Oligomer
uggaguagaagaaauaacgcaau

SEQ ID NO: 50855 - RNA, 23 nt, Artificial Sequence
  RNA Oligomer
ggaguagaagaaauaacgcaauc

SEQ ID NO: 50856 - RNA, 23 nt, Artificial Sequence
  RNA Oligomer
gaguagaagaaauaacgcaaucg

SEQ ID NO: 50857 - RNA, 23 nt, Artificial Sequence
  RNA Oligomer
aguagaagaaauaacgcaaucgg

SEQ ID NO: 50858 - RNA, 23 nt, Artificial Sequence
  RNA Oligomer
guagaagaaauaacgcaaucgga

SEQ ID NO: 50859 - RNA, 23 nt, Artificial Sequence
  RNA Oligomer
uagaagaaauaacgcaaucggac

SEQ ID NO: 50860 - RNA, 23 nt, Artificial Sequence
  RNA Oligomer
agaagaaauaacgcaaucggacu

SEQ ID NO: 50861 - RNA, 23 nt, Artificial Sequence
  RNA Oligomer
gaagaaauaacgcaaucggacua

SEQ ID NO: 50862 - RNA, 23 nt, Artificial Sequence
  RNA Oligomer
acgcaaucggacuauguuacagu

SEQ ID NO: 50863 - RNA, 23 nt, Artificial Sequence
  RNA Oligomer
cgcaaucggacuauguuacagug

SEQ ID NO: 50864 - RNA, 23 nt, Artificial Sequence
  RNA Oligomer
gcaaucggacuauguuacaguga

SEQ ID NO: 50865 - RNA, 23 nt, Artificial Sequence
  RNA Oligomer
caaucggacuauguuacagugau

SEQ ID NO: 50866 - RNA, 23 nt, Artificial Sequence
  RNA Oligomer
aaucggacuauguuacagugauc

SEQ ID NO: 50867 - RNA, 23 nt, Artificial Sequence
  RNA Oligomer
aucggacuauguuacagugaucu

SEQ ID NO: 50868 - RNA, 23 nt, Artificial Sequence
  RNA Oligomer
cggacuauguuacagugaucuag

SEQ ID NO: 50869 - RNA, 23 nt, Artificial Sequence
  RNA Oligomer
ggacuauguuacagugaucuagc

SEQ ID NO: 50870 - RNA, 23 nt, Artificial Sequence
  RNA Oligomer
gacuauguuacagugaucuagcu

SEQ ID NO: 50871 - RNA, 23 nt, Artificial Sequence
  RNA Oligomer
uucccaggaccuugauuauuucu

SEQ ID NO: 50872 - RNA, 23 nt, Artificial Sequence
  RNA Oligomer
gagaacagauauacgaaacauug

SEQ ID NO: 50873 - RNA, 23 nt, Artificial Sequence
  RNA Oligomer
aucggcacggauauuuaacauau

SEQ ID NO: 50874 - RNA, 23 nt, Artificial Sequence
  RNA Oligomer
aauaaggaugguagccagaggug

SEQ ID NO: 50875 - RNA, 23 nt, Artificial Sequence
  RNA Oligomer
aucucuuguccugcaauacuuuc

SEQ ID NO: 50876 - RNA, 23 nt, Artificial Sequence
  RNA Oligomer
auauaggcuaaacuucggaacag

SEQ ID NO: 50877 - RNA, 23 nt, Artificial Sequence
  RNA Oligomer
aacgcaaucggacuauguuacag

SEQ ID NO: 50878 - RNA, 23 nt, Artificial Sequence
  RNA Oligomer
gaucacucucuucgcgaaucacc

SEQ ID NO: 50879 - RNA, 23 nt, Artificial Sequence
  RNA Oligomer
uugauauaccacaccaaaugauc

SEQ ID NO: 50880 - RNA, 23 nt, Artificial Sequence
  RNA Oligomer
acucaaguaacuggugguuuuuc

SEQ ID NO: 50881 - RNA, 23 nt, Artificial Sequence
  RNA Oligomer
aguaacagcucagccaacacaca

SEQ ID NO: 50882 - RNA, 23 nt, Artificial Sequence
  RNA Oligomer
ugucuggcaacucuguauacugu

SEQ ID NO: 50883 - RNA, 23 nt, Artificial Sequence
  RNA Oligomer
uaaaucucuuguccugcaauacu

SEQ ID NO: 50884 - RNA, 23 nt, Artificial Sequence
  RNA Oligomer
augaucacucucuucgcgaauca

SEQ ID NO: 50885 - RNA, 23 nt, Artificial Sequence
  RNA Oligomer
uaacagcucagccaacacacagc

SEQ ID NO: 50886 - RNA, 23 nt, Artificial Sequence
  RNA Oligomer
caguaucaggauccaacaagagg

SEQ ID NO: 50887 - RNA, 23 nt, Artificial Sequence
  RNA Oligomer
auaaggaugguagccagaggugg

SEQ ID NO: 50888 - RNA, 23 nt, Artificial Sequence
  RNA Oligomer
gaaauaacgcaaucggacuaugu

SEQ ID NO: 50889 - RNA, 23 nt, Artificial Sequence
  RNA Oligomer
uucuuccuuuugucuuuauguug

SEQ ID NO: 50890 - RNA, 23 nt, Artificial Sequence
  RNA Oligomer
ugucucgcccauuugguaguuug

SEQ ID NO: 50891 - RNA, 23 nt, Artificial Sequence
  RNA Oligomer
aaaugaaugugcacaagcuucca

SEQ ID NO: 50892 - RNA, 23 nt, Artificial Sequence
  RNA Oligomer
acuucguccucuuggcuuuucac

SEQ ID NO: 50893 - RNA, 23 nt, Artificial Sequence
  RNA Oligomer
auaacgcaaucggacuauguuac

SEQ ID NO: 50894 - RNA, 23 nt, Artificial Sequence
  RNA Oligomer
acggucuccaguauuagcaucug

SEQ ID NO: 50895 - RNA, 23 nt, Artificial Sequence
  RNA Oligomer
aauauugguuguccuaguaacag

SEQ ID NO: 50896 - RNA, 23 nt, Artificial Sequence
  RNA Oligomer
aaaaagaaaaagacuucguccuc

SEQ ID NO: 50897 - RNA, 23 nt, Artificial Sequence
  RNA Oligomer
agacuucguccucuuggcuuuuc

SEQ ID NO: 50898 - RNA, 23 nt, Artificial Sequence
  RNA Oligomer
cucuuggcuuuucacuccuuuug

SEQ ID NO: 50899 - RNA, 23 nt, Artificial Sequence
  RNA Oligomer
gaccucaucuuucuucucaccac

SEQ ID NO: 50900 - RNA, 23 nt, Artificial Sequence
  RNA Oligomer
aaauaacgcaaucggacuauguu

SEQ ID NO: 50901 - RNA, 23 nt, Artificial Sequence
  RNA Oligomer
gucucgcccauuugguaguuuga

SEQ ID NO: 50902 - RNA, 23 nt, Artificial Sequence
  RNA Oligomer
cagacggcuacacagugcaauug

SEQ ID NO: 50903 - RNA, 23 nt, Artificial Sequence
  RNA Oligomer
agacggcuacacagugcaauugc

SEQ ID NO: 50904 - RNA, 23 nt, Artificial Sequence
  RNA Oligomer
auuugcucccuuguuggaguucc

SEQ ID NO: 50905 - RNA, 23 nt, Artificial Sequence
  RNA Oligomer
uuuccggaacauaguccagcacc

SEQ ID NO: 50906 - RNA, 23 nt, Artificial Sequence
  RNA Oligomer
cacuggaguagaagaaauaacgc

SEQ ID NO: 50907 - RNA, 23 nt, Artificial Sequence
  RNA Oligomer
aauaacgcaaucggacuauguua

SEQ ID NO: 50908 - RNA, 23 nt, Artificial Sequence
  RNA Oligomer
uguccacggucuccaguauuagc

SEQ ID NO: 50909 - RNA, 23 nt, Artificial Sequence
  RNA Oligomer
gaauggauauaggcuaaacuucg

SEQ ID NO: 50910 - RNA, 23 nt, Artificial Sequence
  RNA Oligomer
aauggauauaggcuaaacuucgg

SEQ ID NO: 50911 - RNA, 23 nt, Artificial Sequence
  RNA Oligomer
gaguuggaagcugaugcagaagc

SEQ ID NO: 50912 - RNA, 23 nt, Artificial Sequence
  RNA Oligomer
aaucacagggagcgucuguuugg

SEQ ID NO: 50913 - RNA, 23 nt, Artificial Sequence
  RNA Oligomer
ucugacgcugcuguggcauuugu

SEQ ID NO: 50914 - RNA, 23 nt, Artificial Sequence
  RNA Oligomer
aacacacagccagcagaccauac

SEQ ID NO: 50915 - RNA, 23 nt, Artificial Sequence
  RNA Oligomer
ggaauggauauaggcuaaacuuc

SEQ ID NO: 50916 - RNA, 23 nt, Artificial Sequence
  RNA Oligomer
aaaucacagggagcgucuguuug

SEQ ID NO: 50917 - RNA, 23 nt, Artificial Sequence
  RNA Oligomer
cucucgauucuuaaaucucuugu

SEQ ID NO: 50918 - RNA, 23 nt, Artificial Sequence
  RNA Oligomer
accacaccaaaugauccauuucc

SEQ ID NO: 50919 - RNA, 23 nt, Artificial Sequence
  RNA Oligomer
uuagugucuguauagcugacuuc

SEQ ID NO: 50920 - RNA, 23 nt, Artificial Sequence
  RNA Oligomer
aacuuucaugcugccaaaagcug

SEQ ID NO: 50921 - RNA, 23 nt, Artificial Sequence
  RNA Oligomer
caguggcuccaaagaucaacucu

SEQ ID NO: 50922 - RNA, 23 nt, Artificial Sequence
  RNA Oligomer
ucugcgguuuaauaucccgaugg

SEQ ID NO: 50923 - RNA, 23 nt, Artificial Sequence
  RNA Oligomer
guuuccggaacauaguccagcac

SEQ ID NO: 50924 - RNA, 23 nt, Artificial Sequence
  RNA Oligomer
uagugucuguauagcugacuucu

SEQ ID NO: 50925 - RNA, 23 nt, Artificial Sequence
  RNA Oligomer
uuuuccuuccuuccuccuuuucu

SEQ ID NO: 50926 - RNA, 23 nt, Artificial Sequence
  RNA Oligomer
uccuccuuuucuuccuuuugucu

SEQ ID NO: 50927 - RNA, 23 nt, Artificial Sequence
  RNA Oligomer
uuauuggucuguccacggucucc

SEQ ID NO: 50928 - RNA, 23 nt, Artificial Sequence
  RNA Oligomer
aguggcuccaaagaucaacucug

SEQ ID NO: 50929 - RNA, 23 nt, Artificial Sequence
  RNA Oligomer
uugcacuuccaaagucacagagu

SEQ ID NO: 50930 - RNA, 23 nt, Artificial Sequence
  RNA Oligomer
auuagcaucugacgcugcugugg

SEQ ID NO: 50931 - RNA, 23 nt, Artificial Sequence
  RNA Oligomer
uugacauuugggucccguaauuc

SEQ ID NO: 50932 - RNA, 23 nt, Artificial Sequence
  RNA Oligomer
ccugaggugaaauguccuguucc

SEQ ID NO: 50933 - RNA, 23 nt, Artificial Sequence
  RNA Oligomer
uugcucccuuguuggaguuccca

SEQ ID NO: 50934 - RNA, 23 nt, Artificial Sequence
  RNA Oligomer
gaaacauuggguucuccucggac

SEQ ID NO: 50935 - RNA, 23 nt, Artificial Sequence
  RNA Oligomer
aguuuuaauacagcaguaucagg

SEQ ID NO: 50936 - RNA, 23 nt, Artificial Sequence
  RNA Oligomer
uagcugacuucuuguggccuguc

SEQ ID NO: 50937 - RNA, 23 nt, Artificial Sequence
  RNA Oligomer
cucugcuaacuuucaugcugcca

SEQ ID NO: 50938 - RNA, 23 nt, Artificial Sequence
  RNA Oligomer
uccugaggugaaauguccuguuc

SEQ ID NO: 50939 - RNA, 23 nt, Artificial Sequence
  RNA Oligomer
uugagggaauuuaaauucugugu

SEQ ID NO: 50940 - RNA, 23 nt, Artificial Sequence
  RNA Oligomer
ucuguguaguuuggguucauuuc

SEQ ID NO: 50941 - RNA, 23 nt, Artificial Sequence
  RNA Oligomer
uuugcucccuuguuggaguuccc

SEQ ID NO: 50942 - RNA, 23 nt, Artificial Sequence
  RNA Oligomer
uucugcgguuuaauaucccgaug

SEQ ID NO: 50943 - RNA, 23 nt, Artificial Sequence
  RNA Oligomer
uccuuccuuccuccuuuucuucc

SEQ ID NO: 50944 - RNA, 23 nt, Artificial Sequence
  RNA Oligomer
cugaggugaaauguccuguuccu

SEQ ID NO: 50945 - RNA, 23 nt, Artificial Sequence
  RNA Oligomer
uucuguguaguuuggguucauuu

SEQ ID NO: 50946 - RNA, 23 nt, Artificial Sequence
  RNA Oligomer
gauuugcucccuuguuggaguuc

SEQ ID NO: 50947 - RNA, 23 nt, Artificial Sequence
  RNA Oligomer
auauugguuguccuaguaacagc

SEQ ID NO: 50948 - RNA, 23 nt, Artificial Sequence
  RNA Oligomer
cagaagaaaaagaaaaagacuuc

SEQ ID NO: 50949 - RNA, 23 nt, Artificial Sequence
  RNA Oligomer
auaaucaguggcuccaaagauca

SEQ ID NO: 50950 - RNA, 23 nt, Artificial Sequence
  RNA Oligomer
aaacauuggguucuccucggacc

SEQ ID NO: 50951 - RNA, 23 nt, Artificial Sequence
  RNA Oligomer
aaaagaaaaagacuucguccucu

SEQ ID NO: 50952 - RNA, 23 nt, Artificial Sequence
  RNA Oligomer
agaaaaagacuucguccucuugg

SEQ ID NO: 50953 - RNA, 23 nt, Artificial Sequence
  RNA Oligomer
uucuugauggcgaccaguucucc

SEQ ID NO: 50954 - RNA, 23 nt, Artificial Sequence
  RNA Oligomer
ucuugauggcgaccaguucuccu

SEQ ID NO: 50955 - RNA, 23 nt, Artificial Sequence
  RNA Oligomer
augcugccaaaagcugaaggcug

SEQ ID NO: 50956 - RNA, 23 nt, Artificial Sequence
  RNA Oligomer
cuuuuccuuccuuccuccuuuuc

SEQ ID NO: 50957 - RNA, 23 nt, Artificial Sequence
  RNA Oligomer
cuuccuccuuuucuuccuuuugu

SEQ ID NO: 50958 - RNA, 23 nt, Artificial Sequence
  RNA Oligomer
auugguuguccuaguaacagcuc

SEQ ID NO: 50959 - RNA, 23 nt, Artificial Sequence
  RNA Oligomer
cacagaagaaaaagaaaaagacu

SEQ ID NO: 50960 - RNA, 23 nt, Artificial Sequence
  RNA Oligomer
uaaucaguggcuccaaagaucaa

SEQ ID NO: 50961 - RNA, 23 nt, Artificial Sequence
  RNA Oligomer
gaaaaagaaaaagacuucguccu

SEQ ID NO: 50962 - RNA, 23 nt, Artificial Sequence
  RNA Oligomer
gauuaagauagaccucaucuuuc

SEQ ID NO: 50963 - RNA, 23 nt, Artificial Sequence
  RNA Oligomer
uagccagagguggauuacuugac

SEQ ID NO: 50964 - RNA, 23 nt, Artificial Sequence
  RNA Oligomer
gguaguuugacauuugggucccg

SEQ ID NO: 50965 - RNA, 23 nt, Artificial Sequence
  RNA Oligomer
guaguuugacauuugggucccgu

SEQ ID NO: 50966 - RNA, 23 nt, Artificial Sequence
  RNA Oligomer
aaauguccuguuccugacgaauc

SEQ ID NO: 50967 - RNA, 23 nt, Artificial Sequence
  RNA Oligomer
uuuggguucauuucucugauuug

SEQ ID NO: 50968 - RNA, 23 nt, Artificial Sequence
  RNA Oligomer
uuuaauacagcaguaucaggauc

SEQ ID NO: 50969 - RNA, 23 nt, Artificial Sequence
  RNA Oligomer
gauuccaaaggaauggauauagg

SEQ ID NO: 50970 - RNA, 23 nt, Artificial Sequence
  RNA Oligomer
uugauggcgaccaguucuccuga

SEQ ID NO: 50971 - RNA, 18 nt, Artificial Sequence
  RNA Oligomer
cgagaaacaggcgauaau

SEQ ID NO: 50972 - RNA, 19 nt, Artificial Sequence
  RNA Oligomer
auuaucgccuguuucucgg

SEQ ID NO: 50973 - RNA, 19 nt, Artificial Sequence
  RNA Oligomer
ccagacgccauuuaaaagu

SEQ ID NO: 50974 - RNA, 19 nt, Artificial Sequence
  RNA Oligomer
acuuuuaaauggcgucugg

SEQ ID NO: 50975 - RNA, 19 nt, Artificial Sequence
  RNA Oligomer
guggcucugauugcuuuau

SEQ ID NO: 50976 - RNA, 19 nt, Artificial Sequence
  RNA Oligomer
auaaagcaaucagagccac

SEQ ID NO: 50977 - RNA, 19 nt, Artificial Sequence
  RNA Oligomer
ccaaagggaaauaugcuuu

SEQ ID NO: 50978 - RNA, 19 nt, Artificial Sequence
  RNA Oligomer
aaagcauauuucccuuugg

SEQ ID NO: 50979 - RNA, 19 nt, Artificial Sequence
  RNA Oligomer
cacaacuacaccacgagaa

SEQ ID NO: 50980 - RNA, 19 nt, Artificial Sequence
  RNA Oligomer
uucucgugguguaguugug

SEQ ID NO: 50981 - RNA, 19 nt, Artificial Sequence
  RNA Oligomer
gacaaugccuggaucgaga

SEQ ID NO: 50982 - RNA, 19 nt, Artificial Sequence
  RNA Oligomer
ucucgauccaggcauuguc

SEQ ID NO: 50983 - RNA, 19 nt, Artificial Sequence
  RNA Oligomer
ccaagaacuucaacaugaa

SEQ ID NO: 50984 - RNA, 19 nt, Artificial Sequence
  RNA Oligomer
uucauguugaaguucuugg

SEQ ID NO: 50985 - RNA, 19 nt, Artificial Sequence
  RNA Oligomer
gacagagucuugaagauuu

SEQ ID NO: 50986 - RNA, 19 nt, Artificial Sequence
  RNA Oligomer
aaaucuucaagacucuguc

SEQ ID NO: 50987 - RNA, 19 nt, Artificial Sequence
  RNA Oligomer
guggcauauucuaagaaau

SEQ ID NO: 50988 - RNA, 19 nt, Artificial Sequence
  RNA Oligomer
auuucuuagaauaugccac

SEQ ID NO: 50989 - RNA, 19 nt, Artificial Sequence
  RNA Oligomer
cccagacauuaacuucaau

SEQ ID NO: 50990 - RNA, 19 nt, Artificial Sequence
  RNA Oligomer
auugaaguuaaugucuggg

SEQ ID NO: 50991 - RNA, 19 nt, Artificial Sequence
  RNA Oligomer
gggugcauuuauuucaaaa

SEQ ID NO: 50992 - RNA, 19 nt, Artificial Sequence
  RNA Oligomer
uuuugaaauaaaugcaccc

SEQ ID NO: 50993 - RNA, 23 nt, Artificial Sequence
  RNA Oligomer
ccgagaaacaggcgauaauuuuu

SEQ ID NO: 50994 - RNA, 23 nt, Artificial Sequence
  RNA Oligomer
uccgagaaacaggcgauaauuuu

SEQ ID NO: 50995 - RNA, 23 nt, Artificial Sequence
  RNA Oligomer
uuccgagaaacaggcgauaauuu

SEQ ID NO: 50996 - RNA, 23 nt, Artificial Sequence
  RNA Oligomer
cuuccgagaaacaggcgauaauu

SEQ ID NO: 50997 - RNA, 23 nt, Artificial Sequence
  RNA Oligomer
ucuuccgagaaacaggcgauaau

SEQ ID NO: 50998 - RNA, 23 nt, Artificial Sequence
  RNA Oligomer
gaucaucuuuuccuacguuugcu

SEQ ID NO: 50999 - RNA, 23 nt, Artificial Sequence
  RNA Oligomer
ugaucaucuuuuccuacguuugc

SEQ ID NO: 51000 - RNA, 23 nt, Artificial Sequence
  RNA Oligomer
gugaucaucuuuuccuacguuug

SEQ ID NO: 51001 - RNA, 23 nt, Artificial Sequence
  RNA Oligomer
cgugaucaucuuuuccuacguuu

SEQ ID NO: 51002 - RNA, 23 nt, Artificial Sequence
  RNA Oligomer
acgugaucaucuuuuccuacguu

SEQ ID NO: 51003 - RNA, 23 nt, Artificial Sequence
  RNA Oligomer
cacgugaucaucuuuuccuacgu

SEQ ID NO: 51004 - RNA, 23 nt, Artificial Sequence
  RNA Oligomer
cgagaaacaggcgauaauuuuuc

SEQ ID NO: 51005 - RNA, 23 nt, Artificial Sequence
  RNA Oligomer
ccagguuuaaacaucacuuguac

SEQ ID NO: 51006 - RNA, 23 nt, Artificial Sequence
  RNA Oligomer
gccagguuuaaacaucacuugua

SEQ ID NO: 51007 - RNA, 23 nt, Artificial Sequence
  RNA Oligomer
ugccagguuuaaacaucacuugu

SEQ ID NO: 51008 - RNA, 23 nt, Artificial Sequence
  RNA Oligomer
cugccagguuuaaacaucacuug

SEQ ID NO: 51009 - RNA, 23 nt, Artificial Sequence
  RNA Oligomer
ccugccagguuuaaacaucacuu

SEQ ID NO: 51010 - RNA, 23 nt, Artificial Sequence
  RNA Oligomer
ccacgugaucaucuuuuccuacg

SEQ ID NO: 51011 - RNA, 23 nt, Artificial Sequence
  RNA Oligomer
uccacgugaucaucuuuuccuac

SEQ ID NO: 51012 - RNA, 23 nt, Artificial Sequence
  RNA Oligomer
uuccacgugaucaucuuuuccua

SEQ ID NO: 51013 - RNA, 23 nt, Artificial Sequence
  RNA Oligomer
ggaggaaaauuugacauuaucca

SEQ ID NO: 51014 - RNA, 23 nt, Artificial Sequence
  RNA Oligomer
cggaggaaaauuugacauuaucc

SEQ ID NO: 51015 - RNA, 23 nt, Artificial Sequence
  RNA Oligomer
ccggaggaaaauuugacauuauc

SEQ ID NO: 51016 - RNA, 23 nt, Artificial Sequence
  RNA Oligomer
accggaggaaaauuugacauuau

SEQ ID NO: 51017 - RNA, 23 nt, Artificial Sequence
  RNA Oligomer
caccggaggaaaauuugacauua

SEQ ID NO: 51018 - RNA, 23 nt, Artificial Sequence
  RNA Oligomer
ugauaaaagucuucgggauccgu

SEQ ID NO: 51019 - RNA, 23 nt, Artificial Sequence
  RNA Oligomer
cugauaaaagucuucgggauccg

SEQ ID NO: 51020 - RNA, 23 nt, Artificial Sequence
  RNA Oligomer
ucugauaaaagucuucgggaucc

SEQ ID NO: 51021 - RNA, 23 nt, Artificial Sequence
  RNA Oligomer
cucugauaaaagucuucgggauc

SEQ ID NO: 51022 - RNA, 23 nt, Artificial Sequence
  RNA Oligomer
acucugauaaaagucuucgggau

SEQ ID NO: 51023 - RNA, 23 nt, Artificial Sequence
  RNA Oligomer
cgauaauuuuucagauguggcaa

SEQ ID NO: 51024 - RNA, 23 nt, Artificial Sequence
  RNA Oligomer
gcgauaauuuuucagauguggca

SEQ ID NO: 51025 - RNA, 23 nt, Artificial Sequence
  RNA Oligomer
ggcgauaauuuuucagauguggc

SEQ ID NO: 51026 - RNA, 23 nt, Artificial Sequence
  RNA Oligomer
aggcgauaauuuuucagaugugg

SEQ ID NO: 51027 - RNA, 23 nt, Artificial Sequence
  RNA Oligomer
caggcgauaauuuuucagaugug

SEQ ID NO: 51028 - RNA, 23 nt, Artificial Sequence
  RNA Oligomer
acaggcgauaauuuuucagaugu

SEQ ID NO: 51029 - RNA, 23 nt, Artificial Sequence
  RNA Oligomer
aacaggcgauaauuuuucagaug

SEQ ID NO: 51030 - RNA, 23 nt, Artificial Sequence
  RNA Oligomer
ccgaaaacuucacugugcucauc

SEQ ID NO: 51031 - RNA, 23 nt, Artificial Sequence
  RNA Oligomer
gccgaaaacuucacugugcucau

SEQ ID NO: 51032 - RNA, 23 nt, Artificial Sequence
  RNA Oligomer
ugccgaaaacuucacugugcuca

SEQ ID NO: 51033 - RNA, 23 nt, Artificial Sequence
  RNA Oligomer
gugccgaaaacuucacugugcuc

SEQ ID NO: 51034 - RNA, 23 nt, Artificial Sequence
  RNA Oligomer
agugccgaaaacuucacugugcu

SEQ ID NO: 51035 - RNA, 23 nt, Artificial Sequence
  RNA Oligomer
gcagacuacaccuucccuuugca

SEQ ID NO: 51036 - RNA, 23 nt, Artificial Sequence
  RNA Oligomer
cgcagacuacaccuucccuuugc

SEQ ID NO: 51037 - RNA, 23 nt, Artificial Sequence
  RNA Oligomer
ccgcagacuacaccuucccuuug

SEQ ID NO: 51038 - RNA, 23 nt, Artificial Sequence
  RNA Oligomer
accgcagacuacaccuucccuuu

SEQ ID NO: 51039 - RNA, 23 nt, Artificial Sequence
  RNA Oligomer
caccgcagacuacaccuucccuu

SEQ ID NO: 51040 - RNA, 23 nt, Artificial Sequence
  RNA Oligomer
aucaucuuuuccuacguuugcuu

SEQ ID NO: 51041 - RNA, 23 nt, Artificial Sequence
  RNA Oligomer
gguucuuccacgugaucaucuuu

SEQ ID NO: 51042 - RNA, 23 nt, Artificial Sequence
  RNA Oligomer
ugguucuuccacgugaucaucuu

SEQ ID NO: 51043 - RNA, 23 nt, Artificial Sequence
  RNA Oligomer
gugguucuuccacgugaucaucu

SEQ ID NO: 51044 - RNA, 23 nt, Artificial Sequence
  RNA Oligomer
agugguucuuccacgugaucauc

SEQ ID NO: 51045 - RNA, 23 nt, Artificial Sequence
  RNA Oligomer
aagugguucuuccacgugaucau

SEQ ID NO: 51046 - RNA, 23 nt, Artificial Sequence
  RNA Oligomer
aaacaggcgauaauuuuucagau

SEQ ID NO: 51047 - RNA, 23 nt, Artificial Sequence
  RNA Oligomer
gguuuaaacaucacuuguaccuu

SEQ ID NO: 51048 - RNA, 23 nt, Artificial Sequence
  RNA Oligomer
agguuuaaacaucacuuguaccu

SEQ ID NO: 51049 - RNA, 23 nt, Artificial Sequence
  RNA Oligomer
cagguuuaaacaucacuuguacc

SEQ ID NO: 51050 - RNA, 23 nt, Artificial Sequence
  RNA Oligomer
ucaagaacaauaucgacuucccc

SEQ ID NO: 51051 - RNA, 23 nt, Artificial Sequence
  RNA Oligomer
aucaagaacaauaucgacuuccc

SEQ ID NO: 51052 - RNA, 23 nt, Artificial Sequence
  RNA Oligomer
caucaagaacaauaucgacuucc

SEQ ID NO: 51053 - RNA, 23 nt, Artificial Sequence
  RNA Oligomer
ucaucaagaacaauaucgacuuc

SEQ ID NO: 51054 - RNA, 23 nt, Artificial Sequence
  RNA Oligomer
cucaucaagaacaauaucgacuu

SEQ ID NO: 51055 - RNA, 23 nt, Artificial Sequence
  RNA Oligomer
cgauggacuucacagauuugucc

SEQ ID NO: 51056 - RNA, 23 nt, Artificial Sequence
  RNA Oligomer
gcgauggacuucacagauuuguc

SEQ ID NO: 51057 - RNA, 23 nt, Artificial Sequence
  RNA Oligomer
ugcgauggacuucacagauuugu

SEQ ID NO: 51058 - RNA, 23 nt, Artificial Sequence
  RNA Oligomer
cugcgauggacuucacagauuug

SEQ ID NO: 51059 - RNA, 23 nt, Artificial Sequence
  RNA Oligomer
ccugcgauggacuucacagauuu

SEQ ID NO: 51060 - RNA, 23 nt, Artificial Sequence
  RNA Oligomer
ggagaagucugcaagaugucaag

SEQ ID NO: 51061 - RNA, 23 nt, Artificial Sequence
  RNA Oligomer
gggagaagucugcaagaugucaa

SEQ ID NO: 51062 - RNA, 23 nt, Artificial Sequence
  RNA Oligomer
agggagaagucugcaagauguca

SEQ ID NO: 51063 - RNA, 23 nt, Artificial Sequence
  RNA Oligomer
uagggagaagucugcaagauguc

SEQ ID NO: 51064 - RNA, 23 nt, Artificial Sequence
  RNA Oligomer
cuagggagaagucugcaagaugu

SEQ ID NO: 51065 - RNA, 23 nt, Artificial Sequence
  RNA Oligomer
cgcucccauauuuaucccuggug

SEQ ID NO: 51066 - RNA, 23 nt, Artificial Sequence
  RNA Oligomer
ucgcucccauauuuaucccuggu

SEQ ID NO: 51067 - RNA, 23 nt, Artificial Sequence
  RNA Oligomer
gucgcucccauauuuaucccugg

SEQ ID NO: 51068 - RNA, 23 nt, Artificial Sequence
  RNA Oligomer
ugucgcucccauauuuaucccug

SEQ ID NO: 51069 - RNA, 23 nt, Artificial Sequence
  RNA Oligomer
cugucgcucccauauuuaucccu

SEQ ID NO: 51070 - RNA, 23 nt, Artificial Sequence
  RNA Oligomer
gcaccggaggaaaauuugacauu

SEQ ID NO: 51071 - RNA, 23 nt, Artificial Sequence
  RNA Oligomer
ccaguaugagacgaacaaaguca

SEQ ID NO: 51072 - RNA, 23 nt, Artificial Sequence
  RNA Oligomer
uccaguaugagacgaacaaaguc

SEQ ID NO: 51073 - RNA, 23 nt, Artificial Sequence
  RNA Oligomer
uuccaguaugagacgaacaaagu

SEQ ID NO: 51074 - RNA, 23 nt, Artificial Sequence
  RNA Oligomer
uuuccaguaugagacgaacaaag

SEQ ID NO: 51075 - RNA, 23 nt, Artificial Sequence
  RNA Oligomer
uuuuccaguaugagacgaacaaa

SEQ ID NO: 51076 - RNA, 23 nt, Artificial Sequence
  RNA Oligomer
gcucaucaagaacaauaucgacu

SEQ ID NO: 51077 - RNA, 23 nt, Artificial Sequence
  RNA Oligomer
ugcucaucaagaacaauaucgac

SEQ ID NO: 51078 - RNA, 23 nt, Artificial Sequence
  RNA Oligomer
gugcucaucaagaacaauaucga

SEQ ID NO: 51079 - RNA, 23 nt, Artificial Sequence
  RNA Oligomer
gcagagcaaaggaauucagaccg

SEQ ID NO: 51080 - RNA, 23 nt, Artificial Sequence
  RNA Oligomer
cgcagagcaaaggaauucagacc

SEQ ID NO: 51081 - RNA, 23 nt, Artificial Sequence
  RNA Oligomer
ccgcagagcaaaggaauucagac

SEQ ID NO: 51082 - RNA, 23 nt, Artificial Sequence
  RNA Oligomer
cccgcagagcaaaggaauucaga

SEQ ID NO: 51083 - RNA, 23 nt, Artificial Sequence
  RNA Oligomer
acccgcagagcaaaggaauucag

SEQ ID NO: 51084 - RNA, 23 nt, Artificial Sequence
  RNA Oligomer
ggauagcagaggugaaagaggag

SEQ ID NO: 51085 - RNA, 23 nt, Artificial Sequence
  RNA Oligomer
gggauagcagaggugaaagagga

SEQ ID NO: 51086 - RNA, 23 nt, Artificial Sequence
  RNA Oligomer
ggggauagcagaggugaaagagg

SEQ ID NO: 51087 - RNA, 23 nt, Artificial Sequence
  RNA Oligomer
aggggauagcagaggugaaagag

SEQ ID NO: 51088 - RNA, 23 nt, Artificial Sequence
  RNA Oligomer
aaggggauagcagaggugaaaga

SEQ ID NO: 51089 - RNA, 23 nt, Artificial Sequence
  RNA Oligomer
acuagggagaagucugcaagaug

SEQ ID NO: 51090 - RNA, 23 nt, Artificial Sequence
  RNA Oligomer
uacuagggagaagucugcaagau

SEQ ID NO: 51091 - RNA, 23 nt, Artificial Sequence
  RNA Oligomer
acgaauacuacuacaggaagaag

SEQ ID NO: 51092 - RNA, 23 nt, Artificial Sequence
  RNA Oligomer
aacgaauacuacuacaggaagaa

SEQ ID NO: 51093 - RNA, 23 nt, Artificial Sequence
  RNA Oligomer
caacgaauacuacuacaggaaga

SEQ ID NO: 51094 - RNA, 23 nt, Artificial Sequence
  RNA Oligomer
ucaacgaauacuacuacaggaag

SEQ ID NO: 51095 - RNA, 23 nt, Artificial Sequence
  RNA Oligomer
gucaacgaauacuacuacaggaa

SEQ ID NO: 51096 - RNA, 23 nt, Artificial Sequence
  RNA Oligomer
ccuguguggucaacgaauacuac

SEQ ID NO: 51097 - RNA, 23 nt, Artificial Sequence
  RNA Oligomer
cccuguguggucaacgaauacua

SEQ ID NO: 51098 - RNA, 23 nt, Artificial Sequence
  RNA Oligomer
gcccuguguggucaacgaauacu

SEQ ID NO: 51099 - RNA, 23 nt, Artificial Sequence
  RNA Oligomer
agcccuguguggucaacgaauac

SEQ ID NO: 51100 - RNA, 23 nt, Artificial Sequence
  RNA Oligomer
cagcccuguguggucaacgaaua

SEQ ID NO: 51101 - RNA, 23 nt, Artificial Sequence
  RNA Oligomer
ggcaccggaggaaaauuugacau

SEQ ID NO: 51102 - RNA, 23 nt, Artificial Sequence
  RNA Oligomer
caagaacaauaucgacuuccccg

SEQ ID NO: 51103 - RNA, 23 nt, Artificial Sequence
  RNA Oligomer
cagugccgaaaacuucacugugc

SEQ ID NO: 51104 - RNA, 23 nt, Artificial Sequence
  RNA Oligomer
ggaacucuuucuucgugaugaca

SEQ ID NO: 51105 - RNA, 23 nt, Artificial Sequence
  RNA Oligomer
gggaacucuuucuucgugaugac

SEQ ID NO: 51106 - RNA, 23 nt, Artificial Sequence
  RNA Oligomer
ggggaacucuuucuucgugauga

SEQ ID NO: 51107 - RNA, 23 nt, Artificial Sequence
  RNA Oligomer
aggggaacucuuucuucgugaug

SEQ ID NO: 51108 - RNA, 23 nt, Artificial Sequence
  RNA Oligomer
caggggaacucuuucuucgugau

SEQ ID NO: 51109 - RNA, 23 nt, Artificial Sequence
  RNA Oligomer
ucuuuuccuacguuugcuuugcu

SEQ ID NO: 51110 - RNA, 23 nt, Artificial Sequence
  RNA Oligomer
aucuuuuccuacguuugcuuugc

SEQ ID NO: 51111 - RNA, 23 nt, Artificial Sequence
  RNA Oligomer
caucuuuuccuacguuugcuuug

SEQ ID NO: 51112 - RNA, 23 nt, Artificial Sequence
  RNA Oligomer
ucaucuuuuccuacguuugcuuu

SEQ ID NO: 51113 - RNA, 23 nt, Artificial Sequence
  RNA Oligomer
cuuccacgugaucaucuuuuccu

SEQ ID NO: 51114 - RNA, 23 nt, Artificial Sequence
  RNA Oligomer
ucuuccacgugaucaucuuuucc

SEQ ID NO: 51115 - RNA, 23 nt, Artificial Sequence
  RNA Oligomer
uucuuccacgugaucaucuuuuc

SEQ ID NO: 51116 - RNA, 23 nt, Artificial Sequence
  RNA Oligomer
guucuuccacgugaucaucuuuu

SEQ ID NO: 51117 - RNA, 23 nt, Artificial Sequence
  RNA Oligomer
agauacagcugcuuagaaaggag

SEQ ID NO: 51118 - RNA, 23 nt, Artificial Sequence
  RNA Oligomer
gagauacagcugcuuagaaagga

SEQ ID NO: 51119 - RNA, 23 nt, Artificial Sequence
  RNA Oligomer
ggagauacagcugcuuagaaagg

SEQ ID NO: 51120 - RNA, 23 nt, Artificial Sequence
  RNA Oligomer
aggagauacagcugcuuagaaag

SEQ ID NO: 51121 - RNA, 23 nt, Artificial Sequence
  RNA Oligomer
gaggagauacagcugcuuagaaa

SEQ ID NO: 51122 - RNA, 23 nt, Artificial Sequence
  RNA Oligomer
ccaaagccgacauuaaaguaugu

SEQ ID NO: 51123 - RNA, 23 nt, Artificial Sequence
  RNA Oligomer
gccaaagccgacauuaaaguaug

SEQ ID NO: 51124 - RNA, 23 nt, Artificial Sequence
  RNA Oligomer
agccaaagccgacauuaaaguau

SEQ ID NO: 51125 - RNA, 23 nt, Artificial Sequence
  RNA Oligomer
gagccaaagccgacauuaaagua

SEQ ID NO: 51126 - RNA, 23 nt, Artificial Sequence
  RNA Oligomer
ggagccaaagccgacauuaaagu

SEQ ID NO: 51127 - RNA, 23 nt, Artificial Sequence
  RNA Oligomer
uggucaacgaauacuacuacagg

SEQ ID NO: 51128 - RNA, 23 nt, Artificial Sequence
  RNA Oligomer
guggucaacgaauacuacuacag

SEQ ID NO: 51129 - RNA, 23 nt, Artificial Sequence
  RNA Oligomer
uguggucaacgaauacuacuaca

SEQ ID NO: 51130 - RNA, 23 nt, Artificial Sequence
  RNA Oligomer
guguggucaacgaauacuacuac

SEQ ID NO: 51131 - RNA, 23 nt, Artificial Sequence
  RNA Oligomer
uguguggucaacgaauacuacua

SEQ ID NO: 51132 - RNA, 23 nt, Artificial Sequence
  RNA Oligomer
gcucaacccucuccuacuucggu

SEQ ID NO: 51133 - RNA, 23 nt, Artificial Sequence
  RNA Oligomer
ggcucaacccucuccuacuucgg

SEQ ID NO: 51134 - RNA, 23 nt, Artificial Sequence
  RNA Oligomer
cggcucaacccucuccuacuucg

SEQ ID NO: 51135 - RNA, 23 nt, Artificial Sequence
  RNA Oligomer
ucggcucaacccucuccuacuuc

SEQ ID NO: 51136 - RNA, 23 nt, Artificial Sequence
  RNA Oligomer
aucggcucaacccucuccuacuu

SEQ ID NO: 51137 - RNA, 23 nt, Artificial Sequence
  RNA Oligomer
uccugccagguuuaaacaucacu

SEQ ID NO: 51138 - RNA, 23 nt, Artificial Sequence
  RNA Oligomer
guuuuccaguaugagacgaacaa

SEQ ID NO: 51139 - RNA, 23 nt, Artificial Sequence
  RNA Oligomer
ucacugugcucaucaagaacaau

SEQ ID NO: 51140 - RNA, 23 nt, Artificial Sequence
  RNA Oligomer
uucacugugcucaucaagaacaa

SEQ ID NO: 51141 - RNA, 23 nt, Artificial Sequence
  RNA Oligomer
cuucacugugcucaucaagaaca

SEQ ID NO: 51142 - RNA, 23 nt, Artificial Sequence
  RNA Oligomer
acuucacugugcucaucaagaac

SEQ ID NO: 51143 - RNA, 23 nt, Artificial Sequence
  RNA Oligomer
aacuucacugugcucaucaagaa

SEQ ID NO: 51144 - RNA, 23 nt, Artificial Sequence
  RNA Oligomer
cgagguuguaaaaagggauggau

SEQ ID NO: 51145 - RNA, 23 nt, Artificial Sequence
  RNA Oligomer
ccgagguuguaaaaagggaugga

SEQ ID NO: 51146 - RNA, 23 nt, Artificial Sequence
  RNA Oligomer
accgagguuguaaaaagggaugg

SEQ ID NO: 51147 - RNA, 23 nt, Artificial Sequence
  RNA Oligomer
gaccgagguuguaaaaagggaug

SEQ ID NO: 51148 - RNA, 23 nt, Artificial Sequence
  RNA Oligomer
ugaccgagguuguaaaaagggau

SEQ ID NO: 51149 - RNA, 23 nt, Artificial Sequence
  RNA Oligomer
ugacaaacuuucucaaaacagaa

SEQ ID NO: 51150 - RNA, 23 nt, Artificial Sequence
  RNA Oligomer
augacaaacuuucucaaaacaga

SEQ ID NO: 51151 - RNA, 23 nt, Artificial Sequence
  RNA Oligomer
gaugacaaacuuucucaaaacag

SEQ ID NO: 51152 - RNA, 23 nt, Artificial Sequence
  RNA Oligomer
ugaugacaaacuuucucaaaaca

SEQ ID NO: 51153 - RNA, 23 nt, Artificial Sequence
  RNA Oligomer
gugaugacaaacuuucucaaaac

SEQ ID NO: 51154 - RNA, 23 nt, Artificial Sequence
  RNA Oligomer
agaauggagugaagaaguuggug

SEQ ID NO: 51155 - RNA, 23 nt, Artificial Sequence
  RNA Oligomer
gagaauggagugaagaaguuggu

SEQ ID NO: 51156 - RNA, 23 nt, Artificial Sequence
  RNA Oligomer
ggagaauggagugaagaaguugg

SEQ ID NO: 51157 - RNA, 23 nt, Artificial Sequence
  RNA Oligomer
uggagaauggagugaagaaguug

SEQ ID NO: 51158 - RNA, 23 nt, Artificial Sequence
  RNA Oligomer
guggagaauggagugaagaaguu

SEQ ID NO: 51159 - RNA, 23 nt, Artificial Sequence
  RNA Oligomer
gcaguacaguggcuucaagaguc

SEQ ID NO: 51160 - RNA, 23 nt, Artificial Sequence
  RNA Oligomer
ggcaguacaguggcuucaagagu

SEQ ID NO: 51161 - RNA, 23 nt, Artificial Sequence
  RNA Oligomer
gggcaguacaguggcuucaagag

SEQ ID NO: 51162 - RNA, 23 nt, Artificial Sequence
  RNA Oligomer
agggcaguacaguggcuucaaga

SEQ ID NO: 51163 - RNA, 23 nt, Artificial Sequence
  RNA Oligomer
aagggcaguacaguggcuucaag

SEQ ID NO: 51164 - RNA, 23 nt, Artificial Sequence
  RNA Oligomer
gaagucugcaagaugucaagggc

SEQ ID NO: 51165 - RNA, 23 nt, Artificial Sequence
  RNA Oligomer
agaagucugcaagaugucaaggg

SEQ ID NO: 51166 - RNA, 23 nt, Artificial Sequence
  RNA Oligomer
gagaagucugcaagaugucaagg

SEQ ID NO: 51167 - RNA, 23 nt, Artificial Sequence
  RNA Oligomer
ggaagaagugcgaguccauugug

SEQ ID NO: 51168 - RNA, 23 nt, Artificial Sequence
  RNA Oligomer
aggaagaagugcgaguccauugu

SEQ ID NO: 51169 - RNA, 23 nt, Artificial Sequence
  RNA Oligomer
caggaagaagugcgaguccauug

SEQ ID NO: 51170 - RNA, 23 nt, Artificial Sequence
  RNA Oligomer
acaggaagaagugcgaguccauu

SEQ ID NO: 51171 - RNA, 23 nt, Artificial Sequence
  RNA Oligomer
uacaggaagaagugcgaguccau

SEQ ID NO: 51172 - RNA, 23 nt, Artificial Sequence
  RNA Oligomer
ggucaacgaauacuacuacagga

SEQ ID NO: 51173 - RNA, 23 nt, Artificial Sequence
  RNA Oligomer
cuguguggucaacgaauacuacu

SEQ ID NO: 51174 - RNA, 23 nt, Artificial Sequence
  RNA Oligomer
gcucccauauuuaucccuggugc

SEQ ID NO: 51175 - RNA, 23 nt, Artificial Sequence
  RNA Oligomer
agcaugaauuauggcaccauuaa

SEQ ID NO: 51176 - RNA, 23 nt, Artificial Sequence
  RNA Oligomer
gagcaugaauuauggcaccauua

SEQ ID NO: 51177 - RNA, 23 nt, Artificial Sequence
  RNA Oligomer
agagcaugaauuauggcaccauu

SEQ ID NO: 51178 - RNA, 23 nt, Artificial Sequence
  RNA Oligomer
cagagcaugaauuauggcaccau

SEQ ID NO: 51179 - RNA, 23 nt, Artificial Sequence
  RNA Oligomer
ccagagcaugaauuauggcacca

SEQ ID NO: 51180 - RNA, 23 nt, Artificial Sequence
  RNA Oligomer
gaaacggacucugauaaaagucu

SEQ ID NO: 51181 - RNA, 23 nt, Artificial Sequence
  RNA Oligomer
agaaacggacucugauaaaaguc

SEQ ID NO: 51182 - RNA, 23 nt, Artificial Sequence
  RNA Oligomer
gagaaacggacucugauaaaagu

SEQ ID NO: 51183 - RNA, 23 nt, Artificial Sequence
  RNA Oligomer
ugagaaacggacucugauaaaag

SEQ ID NO: 51184 - RNA, 23 nt, Artificial Sequence
  RNA Oligomer
uugagaaacggacucugauaaaa

SEQ ID NO: 51185 - RNA, 23 nt, Artificial Sequence
  RNA Oligomer
gaaacaggcgauaauuuuucaga

SEQ ID NO: 51186 - RNA, 23 nt, Artificial Sequence
  RNA Oligomer
agaaacaggcgauaauuuuucag

SEQ ID NO: 51187 - RNA, 23 nt, Artificial Sequence
  RNA Oligomer
gagaaacaggcgauaauuuuuca

SEQ ID NO: 51188 - RNA, 23 nt, Artificial Sequence
  RNA Oligomer
ccuuccacaagacucagaaucca

SEQ ID NO: 51189 - RNA, 23 nt, Artificial Sequence
  RNA Oligomer
accuuccacaagacucagaaucc

SEQ ID NO: 51190 - RNA, 23 nt, Artificial Sequence
  RNA Oligomer
uaccuuccacaagacucagaauc

SEQ ID NO: 51191 - RNA, 23 nt, Artificial Sequence
  RNA Oligomer
guaccuuccacaagacucagaau

SEQ ID NO: 51192 - RNA, 23 nt, Artificial Sequence
  RNA Oligomer
uguaccuuccacaagacucagaa

SEQ ID NO: 51193 - RNA, 23 nt, Artificial Sequence
  RNA Oligomer
cacaacuacaccacgagaaacau

SEQ ID NO: 51194 - RNA, 23 nt, Artificial Sequence
  RNA Oligomer
ccacaacuacaccacgagaaaca

SEQ ID NO: 51195 - RNA, 23 nt, Artificial Sequence
  RNA Oligomer
gccacaacuacaccacgagaaac

SEQ ID NO: 51196 - RNA, 23 nt, Artificial Sequence
  RNA Oligomer
ggccacaacuacaccacgagaaa

SEQ ID NO: 51197 - RNA, 23 nt, Artificial Sequence
  RNA Oligomer
cggccacaacuacaccacgagaa

SEQ ID NO: 51198 - RNA, 23 nt, Artificial Sequence
  RNA Oligomer
gacccgcagagcaaaggaauuca

SEQ ID NO: 51199 - RNA, 23 nt, Artificial Sequence
  RNA Oligomer
acaccgcagacuacaccuucccu

SEQ ID NO: 51200 - RNA, 23 nt, Artificial Sequence
  RNA Oligomer
gacaccgcagacuacaccuuccc

SEQ ID NO: 51201 - RNA, 23 nt, Artificial Sequence
  RNA Oligomer
ugacaccgcagacuacaccuucc

SEQ ID NO: 51202 - RNA, 23 nt, Artificial Sequence
  RNA Oligomer
uugacaccgcagacuacaccuuc

SEQ ID NO: 51203 - RNA, 23 nt, Artificial Sequence
  RNA Oligomer
uuugacaccgcagacuacaccuu

SEQ ID NO: 51204 - RNA, 23 nt, Artificial Sequence
  RNA Oligomer
cguggagaauggagugaagaagu

SEQ ID NO: 51205 - RNA, 23 nt, Artificial Sequence
  RNA Oligomer
ucguggagaauggagugaagaag

SEQ ID NO: 51206 - RNA, 23 nt, Artificial Sequence
  RNA Oligomer
gcagcuacuagggagaagucugc

SEQ ID NO: 51207 - RNA, 23 nt, Artificial Sequence
  RNA Oligomer
agcagcuacuagggagaagucug

SEQ ID NO: 51208 - RNA, 23 nt, Artificial Sequence
  RNA Oligomer
cagcagcuacuagggagaagucu

SEQ ID NO: 51209 - RNA, 23 nt, Artificial Sequence
  RNA Oligomer
ccagcagcuacuagggagaaguc

SEQ ID NO: 51210 - RNA, 23 nt, Artificial Sequence
  RNA Oligomer
accagcagcuacuagggagaagu

SEQ ID NO: 51211 - RNA, 23 nt, Artificial Sequence
  RNA Oligomer
cgaauacuacuacaggaagaagu

SEQ ID NO: 51212 - RNA, 23 nt, Artificial Sequence
  RNA Oligomer
gacuuccucaucgacacuuacuc

SEQ ID NO: 51213 - RNA, 23 nt, Artificial Sequence
  RNA Oligomer
cgacuuccucaucgacacuuacu

SEQ ID NO: 51214 - RNA, 23 nt, Artificial Sequence
  RNA Oligomer
ucgacuuccucaucgacacuuac

SEQ ID NO: 51215 - RNA, 23 nt, Artificial Sequence
  RNA Oligomer
aucgacuuccucaucgacacuua

SEQ ID NO: 51216 - RNA, 23 nt, Artificial Sequence
  RNA Oligomer
caucgacuuccucaucgacacuu

SEQ ID NO: 51217 - RNA, 23 nt, Artificial Sequence
  RNA Oligomer
uggcaccggaggaaaauuugaca

SEQ ID NO: 51218 - RNA, 23 nt, Artificial Sequence
  RNA Oligomer
uuggcaccggaggaaaauuugac

SEQ ID NO: 51219 - RNA, 23 nt, Artificial Sequence
  RNA Oligomer
uuuggcaccggaggaaaauuuga

SEQ ID NO: 51220 - RNA, 23 nt, Artificial Sequence
  RNA Oligomer
uuuuggcaccggaggaaaauuug

SEQ ID NO: 51221 - RNA, 23 nt, Artificial Sequence
  RNA Oligomer
uuuuuggcaccggaggaaaauuu

SEQ ID NO: 51222 - RNA, 23 nt, Artificial Sequence
  RNA Oligomer
acaacuacaccacgagaaacauc

SEQ ID NO: 51223 - RNA, 23 nt, Artificial Sequence
  RNA Oligomer
agaacaauaucgacuuccccggc

SEQ ID NO: 51224 - RNA, 23 nt, Artificial Sequence
  RNA Oligomer
aagaacaauaucgacuuccccgg

SEQ ID NO: 51225 - RNA, 23 nt, Artificial Sequence
  RNA Oligomer
ggacccgcagagcaaaggaauuc

SEQ ID NO: 51226 - RNA, 23 nt, Artificial Sequence
  RNA Oligomer
gacaaacuuucucaaaacagaag

SEQ ID NO: 51227 - RNA, 23 nt, Artificial Sequence
  RNA Oligomer
gaagggcaguacaguggcuucaa

SEQ ID NO: 51228 - RNA, 23 nt, Artificial Sequence
  RNA Oligomer
cgaagagugaagggcaguacagu

SEQ ID NO: 51229 - RNA, 23 nt, Artificial Sequence
  RNA Oligomer
ccgaagagugaagggcaguacag

SEQ ID NO: 51230 - RNA, 23 nt, Artificial Sequence
  RNA Oligomer
uccgaagagugaagggcaguaca

SEQ ID NO: 51231 - RNA, 23 nt, Artificial Sequence
  RNA Oligomer
uuccgaagagugaagggcaguac

SEQ ID NO: 51232 - RNA, 23 nt, Artificial Sequence
  RNA Oligomer
uuuccgaagagugaagggcagua

SEQ ID NO: 51233 - RNA, 23 nt, Artificial Sequence
  RNA Oligomer
agaggagauacagcugcuuagaa

SEQ ID NO: 51234 - RNA, 23 nt, Artificial Sequence
  RNA Oligomer
cagaggagauacagcugcuuaga

SEQ ID NO: 51235 - RNA, 23 nt, Artificial Sequence
  RNA Oligomer
cuacuagggagaagucugcaaga

SEQ ID NO: 51236 - RNA, 23 nt, Artificial Sequence
  RNA Oligomer
gcuacuagggagaagucugcaag

SEQ ID NO: 51237 - RNA, 23 nt, Artificial Sequence
  RNA Oligomer
cauuaaaguauguguccuuugug

SEQ ID NO: 51238 - RNA, 23 nt, Artificial Sequence
  RNA Oligomer
acauuaaaguauguguccuuugu

SEQ ID NO: 51239 - RNA, 23 nt, Artificial Sequence
  RNA Oligomer
gacauuaaaguauguguccuuug

SEQ ID NO: 51240 - RNA, 23 nt, Artificial Sequence
  RNA Oligomer
cgacauuaaaguauguguccuuu

SEQ ID NO: 51241 - RNA, 23 nt, Artificial Sequence
  RNA Oligomer
ccgacauuaaaguauguguccuu

SEQ ID NO: 51242 - RNA, 23 nt, Artificial Sequence
  RNA Oligomer
gaauacuacuacaggaagaagug

SEQ ID NO: 51243 - RNA, 23 nt, Artificial Sequence
  RNA Oligomer
gcugucgcucccauauuuauccc

SEQ ID NO: 51244 - RNA, 23 nt, Artificial Sequence
  RNA Oligomer
ugcugucgcucccauauuuaucc

SEQ ID NO: 51245 - RNA, 23 nt, Artificial Sequence
  RNA Oligomer
cugcugucgcucccauauuuauc

SEQ ID NO: 51246 - RNA, 23 nt, Artificial Sequence
  RNA Oligomer
acugcugucgcucccauauuuau

SEQ ID NO: 51247 - RNA, 23 nt, Artificial Sequence
  RNA Oligomer
acuuccucaucgacacuuacucc

SEQ ID NO: 51248 - RNA, 23 nt, Artificial Sequence
  RNA Oligomer
uccagagcaugaauuauggcacc

SEQ ID NO: 51249 - RNA, 23 nt, Artificial Sequence
  RNA Oligomer
auccagagcaugaauuauggcac

SEQ ID NO: 51250 - RNA, 23 nt, Artificial Sequence
  RNA Oligomer
ggaaaacaauguugagaaacgga

SEQ ID NO: 51251 - RNA, 23 nt, Artificial Sequence
  RNA Oligomer
aggaaaacaauguugagaaacgg

SEQ ID NO: 51252 - RNA, 23 nt, Artificial Sequence
  RNA Oligomer
aaggaaaacaauguugagaaacg

SEQ ID NO: 51253 - RNA, 23 nt, Artificial Sequence
  RNA Oligomer
caaggaaaacaauguugagaaac

SEQ ID NO: 51254 - RNA, 23 nt, Artificial Sequence
  RNA Oligomer
acaaggaaaacaauguugagaaa

SEQ ID NO: 51255 - RNA, 23 nt, Artificial Sequence
  RNA Oligomer
caguaugagacgaacaaagucac

SEQ ID NO: 51256 - RNA, 23 nt, Artificial Sequence
  RNA Oligomer
aaacuucacugugcucaucaaga

SEQ ID NO: 51257 - RNA, 23 nt, Artificial Sequence
  RNA Oligomer
aaaacuucacugugcucaucaag

SEQ ID NO: 51258 - RNA, 23 nt, Artificial Sequence
  RNA Oligomer
gaaaacuucacugugcucaucaa

SEQ ID NO: 51259 - RNA, 23 nt, Artificial Sequence
  RNA Oligomer
cugaccgagguuguaaaaaggga

SEQ ID NO: 51260 - RNA, 23 nt, Artificial Sequence
  RNA Oligomer
ucugaccgagguuguaaaaaggg

SEQ ID NO: 51261 - RNA, 23 nt, Artificial Sequence
  RNA Oligomer
cucugaccgagguuguaaaaagg

SEQ ID NO: 51262 - RNA, 23 nt, Artificial Sequence
  RNA Oligomer
ccucugaccgagguuguaaaaag

SEQ ID NO: 51263 - RNA, 23 nt, Artificial Sequence
  RNA Oligomer
gcaggggaacucuuucuucguga

SEQ ID NO: 51264 - RNA, 23 nt, Artificial Sequence
  RNA Oligomer
cagacuacaccuucccuuugcag

SEQ ID NO: 51265 - RNA, 23 nt, Artificial Sequence
  RNA Oligomer
aucguggagaauggagugaagaa

SEQ ID NO: 51266 - RNA, 23 nt, Artificial Sequence
  RNA Oligomer
gaucguggagaauggagugaaga

SEQ ID NO: 51267 - RNA, 23 nt, Artificial Sequence
  RNA Oligomer
agaucguggagaauggagugaag

SEQ ID NO: 51268 - RNA, 23 nt, Artificial Sequence
  RNA Oligomer
gagaucguggagaauggagugaa

SEQ ID NO: 51269 - RNA, 23 nt, Artificial Sequence
  RNA Oligomer
ccagaggagauacagcugcuuag

SEQ ID NO: 51270 - RNA, 23 nt, Artificial Sequence
  RNA Oligomer
accagaggagauacagcugcuua

SEQ ID NO: 51271 - RNA, 23 nt, Artificial Sequence
  RNA Oligomer
aaccagaggagauacagcugcuu

SEQ ID NO: 51272 - RNA, 23 nt, Artificial Sequence
  RNA Oligomer
ucacagauuuguccaggcugccc

SEQ ID NO: 51273 - RNA, 23 nt, Artificial Sequence
  RNA Oligomer
uucacagauuuguccaggcugcc

SEQ ID NO: 51274 - RNA, 23 nt, Artificial Sequence
  RNA Oligomer
cuucacagauuuguccaggcugc

SEQ ID NO: 51275 - RNA, 23 nt, Artificial Sequence
  RNA Oligomer
acuucacagauuuguccaggcug

SEQ ID NO: 51276 - RNA, 23 nt, Artificial Sequence
  RNA Oligomer
gacuucacagauuuguccaggcu

SEQ ID NO: 51277 - RNA, 23 nt, Artificial Sequence
  RNA Oligomer
gcaagaugucaagggccaagaag

SEQ ID NO: 51278 - RNA, 23 nt, Artificial Sequence
  RNA Oligomer
ugcaagaugucaagggccaagaa

SEQ ID NO: 51279 - RNA, 23 nt, Artificial Sequence
  RNA Oligomer
cugcaagaugucaagggccaaga

SEQ ID NO: 51280 - RNA, 23 nt, Artificial Sequence
  RNA Oligomer
ucugcaagaugucaagggccaag

SEQ ID NO: 51281 - RNA, 23 nt, Artificial Sequence
  RNA Oligomer
gucugcaagaugucaagggccaa

SEQ ID NO: 51282 - RNA, 23 nt, Artificial Sequence
  RNA Oligomer
aaagccgacauuaaaguaugugu

SEQ ID NO: 51283 - RNA, 23 nt, Artificial Sequence
  RNA Oligomer
caaagccgacauuaaaguaugug

SEQ ID NO: 51284 - RNA, 23 nt, Artificial Sequence
  RNA Oligomer
uggagccaaagccgacauuaaag

SEQ ID NO: 51285 - RNA, 23 nt, Artificial Sequence
  RNA Oligomer
ccagcugguuguguacaucggcu

SEQ ID NO: 51286 - RNA, 23 nt, Artificial Sequence
  RNA Oligomer
uccagcugguuguguacaucggc

SEQ ID NO: 51287 - RNA, 23 nt, Artificial Sequence
  RNA Oligomer
auccagcugguuguguacaucgg

SEQ ID NO: 51288 - RNA, 23 nt, Artificial Sequence
  RNA Oligomer
uauccagcugguuguguacaucg

SEQ ID NO: 51289 - RNA, 23 nt, Artificial Sequence
  RNA Oligomer
uuauccagcugguuguguacauc

SEQ ID NO: 51290 - RNA, 23 nt, Artificial Sequence
  RNA Oligomer
uuguaccuuccacaagacucaga

SEQ ID NO: 51291 - RNA, 23 nt, Artificial Sequence
  RNA Oligomer
cuuguaccuuccacaagacucag

SEQ ID NO: 51292 - RNA, 23 nt, Artificial Sequence
  RNA Oligomer
acuuguaccuuccacaagacuca

SEQ ID NO: 51293 - RNA, 23 nt, Artificial Sequence
  RNA Oligomer
guuuaaacaucacuuguaccuuc

SEQ ID NO: 51294 - RNA, 23 nt, Artificial Sequence
  RNA Oligomer
ugaacagugccgaaaacuucacu

SEQ ID NO: 51295 - RNA, 23 nt, Artificial Sequence
  RNA Oligomer
uugaacagugccgaaaacuucac

SEQ ID NO: 51296 - RNA, 23 nt, Artificial Sequence
  RNA Oligomer
cuugaacagugccgaaaacuuca

SEQ ID NO: 51297 - RNA, 23 nt, Artificial Sequence
  RNA Oligomer
ucuugaacagugccgaaaacuuc

SEQ ID NO: 51298 - RNA, 23 nt, Artificial Sequence
  RNA Oligomer
cucuugaacagugccgaaaacuu

SEQ ID NO: 51299 - RNA, 23 nt, Artificial Sequence
  RNA Oligomer
ucucuugaacagugccgaaaacu

SEQ ID NO: 51300 - RNA, 23 nt, Artificial Sequence
  RNA Oligomer
cucucuugaacagugccgaaaac

SEQ ID NO: 51301 - RNA, 23 nt, Artificial Sequence
  RNA Oligomer
gcucucuugaacagugccgaaaa

SEQ ID NO: 51302 - RNA, 23 nt, Artificial Sequence
  RNA Oligomer
ugcucucuugaacagugccgaaa

SEQ ID NO: 51303 - RNA, 23 nt, Artificial Sequence
  RNA Oligomer
ucucaaaacagaaggccaagagc

SEQ ID NO: 51304 - RNA, 23 nt, Artificial Sequence
  RNA Oligomer
uucucaaaacagaaggccaagag

SEQ ID NO: 51305 - RNA, 23 nt, Artificial Sequence
  RNA Oligomer
uuucucaaaacagaaggccaaga

SEQ ID NO: 51306 - RNA, 23 nt, Artificial Sequence
  RNA Oligomer
cuuucucaaaacagaaggccaag

SEQ ID NO: 51307 - RNA, 23 nt, Artificial Sequence
  RNA Oligomer
acuuucucaaaacagaaggccaa

SEQ ID NO: 51308 - RNA, 23 nt, Artificial Sequence
  RNA Oligomer
ggagaucguggagaauggaguga

SEQ ID NO: 51309 - RNA, 23 nt, Artificial Sequence
  RNA Oligomer
aggagaucguggagaauggagug

SEQ ID NO: 51310 - RNA, 23 nt, Artificial Sequence
  RNA Oligomer
gaggagaucguggagaauggagu

SEQ ID NO: 51311 - RNA, 23 nt, Artificial Sequence
  RNA Oligomer
agaggagaucguggagaauggag

SEQ ID NO: 51312 - RNA, 23 nt, Artificial Sequence
  RNA Oligomer
aagaggagaucguggagaaugga

SEQ ID NO: 51313 - RNA, 23 nt, Artificial Sequence
  RNA Oligomer
cagaggugaaagaggagaucgug

SEQ ID NO: 51314 - RNA, 23 nt, Artificial Sequence
  RNA Oligomer
gcagaggugaaagaggagaucgu

SEQ ID NO: 51315 - RNA, 23 nt, Artificial Sequence
  RNA Oligomer
agcagaggugaaagaggagaucg

SEQ ID NO: 51316 - RNA, 23 nt, Artificial Sequence
  RNA Oligomer
uagcagaggugaaagaggagauc

SEQ ID NO: 51317 - RNA, 23 nt, Artificial Sequence
  RNA Oligomer
auagcagaggugaaagaggagau

SEQ ID NO: 51318 - RNA, 23 nt, Artificial Sequence
  RNA Oligomer
gaaggggauagcagaggugaaag

SEQ ID NO: 51319 - RNA, 23 nt, Artificial Sequence
  RNA Oligomer
uccuacguuugcuuugcucuggu

SEQ ID NO: 51320 - RNA, 23 nt, Artificial Sequence
  RNA Oligomer
uuccuacguuugcuuugcucugg

SEQ ID NO: 51321 - RNA, 23 nt, Artificial Sequence
  RNA Oligomer
uuuccuacguuugcuuugcucug

SEQ ID NO: 51322 - RNA, 23 nt, Artificial Sequence
  RNA Oligomer
uuuuccuacguuugcuuugcucu

SEQ ID NO: 51323 - RNA, 23 nt, Artificial Sequence
  RNA Oligomer
cuuuuccuacguuugcuuugcuc

SEQ ID NO: 51324 - RNA, 23 nt, Artificial Sequence
  RNA Oligomer
ugcuuagaaaggaggcgacuccu

SEQ ID NO: 51325 - RNA, 23 nt, Artificial Sequence
  RNA Oligomer
cugcuuagaaaggaggcgacucc

SEQ ID NO: 51326 - RNA, 23 nt, Artificial Sequence
  RNA Oligomer
gcugcuuagaaaggaggcgacuc

SEQ ID NO: 51327 - RNA, 23 nt, Artificial Sequence
  RNA Oligomer
agcugcuuagaaaggaggcgacu

SEQ ID NO: 51328 - RNA, 23 nt, Artificial Sequence
  RNA Oligomer
cagcugcuuagaaaggaggcgac

SEQ ID NO: 51329 - RNA, 23 nt, Artificial Sequence
  RNA Oligomer
gcaccauuaagugguucuuccac

SEQ ID NO: 51330 - RNA, 23 nt, Artificial Sequence
  RNA Oligomer
ggcaccauuaagugguucuucca

SEQ ID NO: 51331 - RNA, 23 nt, Artificial Sequence
  RNA Oligomer
uggcaccauuaagugguucuucc

SEQ ID NO: 51332 - RNA, 23 nt, Artificial Sequence
  RNA Oligomer
auggcaccauuaagugguucuuc

SEQ ID NO: 51333 - RNA, 23 nt, Artificial Sequence
  RNA Oligomer
uauggcaccauuaagugguucuu

SEQ ID NO: 51334 - RNA, 23 nt, Artificial Sequence
  RNA Oligomer
agaagugcgaguccauuguggag

SEQ ID NO: 51335 - RNA, 23 nt, Artificial Sequence
  RNA Oligomer
aagaagugcgaguccauugugga

SEQ ID NO: 51336 - RNA, 23 nt, Artificial Sequence
  RNA Oligomer
gaagaagugcgaguccauugugg

SEQ ID NO: 51337 - RNA, 23 nt, Artificial Sequence
  RNA Oligomer
ucaaaacagaaggccaagagcag

SEQ ID NO: 51338 - RNA, 23 nt, Artificial Sequence
  RNA Oligomer
cucaaaacagaaggccaagagca

SEQ ID NO: 51339 - RNA, 23 nt, Artificial Sequence
  RNA Oligomer
gagugaagaaguuggugcacagu

SEQ ID NO: 51340 - RNA, 23 nt, Artificial Sequence
  RNA Oligomer
ggagugaagaaguuggugcacag

SEQ ID NO: 51341 - RNA, 23 nt, Artificial Sequence
  RNA Oligomer
uggagugaagaaguuggugcaca

SEQ ID NO: 51342 - RNA, 23 nt, Artificial Sequence
  RNA Oligomer
auggagugaagaaguuggugcac

SEQ ID NO: 51343 - RNA, 23 nt, Artificial Sequence
  RNA Oligomer
aauggagugaagaaguuggugca

SEQ ID NO: 51344 - RNA, 23 nt, Artificial Sequence
  RNA Oligomer
gaauggagugaagaaguuggugc

SEQ ID NO: 51345 - RNA, 23 nt, Artificial Sequence
  RNA Oligomer
gauagcagaggugaaagaggaga

SEQ ID NO: 51346 - RNA, 23 nt, Artificial Sequence
  RNA Oligomer
acguuugcuuugcucuggugagu

SEQ ID NO: 51347 - RNA, 23 nt, Artificial Sequence
  RNA Oligomer
uacguuugcuuugcucuggugag

SEQ ID NO: 51348 - RNA, 23 nt, Artificial Sequence
  RNA Oligomer
cuacguuugcuuugcucugguga

SEQ ID NO: 51349 - RNA, 23 nt, Artificial Sequence
  RNA Oligomer
ccuacguuugcuuugcucuggug

SEQ ID NO: 51350 - RNA, 23 nt, Artificial Sequence
  RNA Oligomer
acagcugcuuagaaaggaggcga

SEQ ID NO: 51351 - RNA, 23 nt, Artificial Sequence
  RNA Oligomer
uacagcugcuuagaaaggaggcg

SEQ ID NO: 51352 - RNA, 23 nt, Artificial Sequence
  RNA Oligomer
auacagcugcuuagaaaggaggc

SEQ ID NO: 51353 - RNA, 23 nt, Artificial Sequence
  RNA Oligomer
gauacagcugcuuagaaaggagg

SEQ ID NO: 51354 - RNA, 23 nt, Artificial Sequence
  RNA Oligomer
gacaaccagaggagauacagcug

SEQ ID NO: 51355 - RNA, 23 nt, Artificial Sequence
  RNA Oligomer
ggacaaccagaggagauacagcu

SEQ ID NO: 51356 - RNA, 23 nt, Artificial Sequence
  RNA Oligomer
uggacaaccagaggagauacagc

SEQ ID NO: 51357 - RNA, 23 nt, Artificial Sequence
  RNA Oligomer
cuggacaaccagaggagauacag

SEQ ID NO: 51358 - RNA, 23 nt, Artificial Sequence
  RNA Oligomer
ccuggacaaccagaggagauaca

SEQ ID NO: 51359 - RNA, 23 nt, Artificial Sequence
  RNA Oligomer
uguucaucgacuuccucaucgac

SEQ ID NO: 51360 - RNA, 23 nt, Artificial Sequence
  RNA Oligomer
guguucaucgacuuccucaucga

SEQ ID NO: 51361 - RNA, 23 nt, Artificial Sequence
  RNA Oligomer
uguguucaucgacuuccucaucg

SEQ ID NO: 51362 - RNA, 23 nt, Artificial Sequence
  RNA Oligomer
cuguguucaucgacuuccucauc

SEQ ID NO: 51363 - RNA, 23 nt, Artificial Sequence
  RNA Oligomer
gcuguguucaucgacuuccucau

SEQ ID NO: 51364 - RNA, 23 nt, Artificial Sequence
  RNA Oligomer
cguuuugacauccugguuuuugg

SEQ ID NO: 51365 - RNA, 23 nt, Artificial Sequence
  RNA Oligomer
ccguuuugacauccugguuuuug

SEQ ID NO: 51366 - RNA, 23 nt, Artificial Sequence
  RNA Oligomer
uccguuuugacauccugguuuuu

SEQ ID NO: 51367 - RNA, 23 nt, Artificial Sequence
  RNA Oligomer
auccguuuugacauccugguuuu

SEQ ID NO: 51368 - RNA, 23 nt, Artificial Sequence
  RNA Oligomer
gauccguuuugacauccugguuu

SEQ ID NO: 51369 - RNA, 23 nt, Artificial Sequence
  RNA Oligomer
acaauguugagaaacggacucug

SEQ ID NO: 51370 - RNA, 23 nt, Artificial Sequence
  RNA Oligomer
aacaauguugagaaacggacucu

SEQ ID NO: 51371 - RNA, 23 nt, Artificial Sequence
  RNA Oligomer
aaacaauguugagaaacggacuc

SEQ ID NO: 51372 - RNA, 23 nt, Artificial Sequence
  RNA Oligomer
aaaacaauguugagaaacggacu

SEQ ID NO: 51373 - RNA, 23 nt, Artificial Sequence
  RNA Oligomer
gaaaacaauguugagaaacggac

SEQ ID NO: 51374 - RNA, 23 nt, Artificial Sequence
  RNA Oligomer
gacucagaauccacaguguccca

SEQ ID NO: 51375 - RNA, 23 nt, Artificial Sequence
  RNA Oligomer
agacucagaauccacaguguccc

SEQ ID NO: 51376 - RNA, 23 nt, Artificial Sequence
  RNA Oligomer
aagacucagaauccacagugucc

SEQ ID NO: 51377 - RNA, 23 nt, Artificial Sequence
  RNA Oligomer
caagacucagaauccacaguguc

SEQ ID NO: 51378 - RNA, 23 nt, Artificial Sequence
  RNA Oligomer
acaagacucagaauccacagugu

SEQ ID NO: 51379 - RNA, 23 nt, Artificial Sequence
  RNA Oligomer
uccucugaccgagguuguaaaaa

SEQ ID NO: 51380 - RNA, 23 nt, Artificial Sequence
  RNA Oligomer
gcagugauguuuuccaguaugag

SEQ ID NO: 51381 - RNA, 23 nt, Artificial Sequence
  RNA Oligomer
ugcagugauguuuuccaguauga

SEQ ID NO: 51382 - RNA, 23 nt, Artificial Sequence
  RNA Oligomer
cugcagugauguuuuccaguaug

SEQ ID NO: 51383 - RNA, 23 nt, Artificial Sequence
  RNA Oligomer
gcugcagugauguuuuccaguau

SEQ ID NO: 51384 - RNA, 23 nt, Artificial Sequence
  RNA Oligomer
agcugcagugauguuuuccagua

SEQ ID NO: 51385 - RNA, 23 nt, Artificial Sequence
  RNA Oligomer
acaaacuuucucaaaacagaagg

SEQ ID NO: 51386 - RNA, 23 nt, Artificial Sequence
  RNA Oligomer
ugagugacaagcuguaccagcgg

SEQ ID NO: 51387 - RNA, 23 nt, Artificial Sequence
  RNA Oligomer
gugagugacaagcuguaccagcg

SEQ ID NO: 51388 - RNA, 23 nt, Artificial Sequence
  RNA Oligomer
ggugagugacaagcuguaccagc

SEQ ID NO: 51389 - RNA, 23 nt, Artificial Sequence
  RNA Oligomer
uggugagugacaagcuguaccag

SEQ ID NO: 51390 - RNA, 23 nt, Artificial Sequence
  RNA Oligomer
cuggugagugacaagcuguacca

SEQ ID NO: 51391 - RNA, 23 nt, Artificial Sequence
  RNA Oligomer
ucuggugagugacaagcuguacc

SEQ ID NO: 51392 - RNA, 23 nt, Artificial Sequence
  RNA Oligomer
cucuggugagugacaagcuguac

SEQ ID NO: 51393 - RNA, 23 nt, Artificial Sequence
  RNA Oligomer
gcucuggugagugacaagcugua

SEQ ID NO: 51394 - RNA, 23 nt, Artificial Sequence
  RNA Oligomer
cguuugcuuugcucuggugagug

SEQ ID NO: 51395 - RNA, 23 nt, Artificial Sequence
  RNA Oligomer
uccuggacaaccagaggagauac

SEQ ID NO: 51396 - RNA, 23 nt, Artificial Sequence
  RNA Oligomer
agaugucaagggccaagaagucc

SEQ ID NO: 51397 - RNA, 23 nt, Artificial Sequence
  RNA Oligomer
aagaugucaagggccaagaaguc

SEQ ID NO: 51398 - RNA, 23 nt, Artificial Sequence
  RNA Oligomer
caagaugucaagggccaagaagu

SEQ ID NO: 51399 - RNA, 23 nt, Artificial Sequence
  RNA Oligomer
cuacaggaagaagugcgagucca

SEQ ID NO: 51400 - RNA, 23 nt, Artificial Sequence
  RNA Oligomer
acuacaggaagaagugcgagucc

SEQ ID NO: 51401 - RNA, 23 nt, Artificial Sequence
  RNA Oligomer
uacuacaggaagaagugcgaguc

SEQ ID NO: 51402 - RNA, 23 nt, Artificial Sequence
  RNA Oligomer
uccucaucgacacuuacuccagu

SEQ ID NO: 51403 - RNA, 23 nt, Artificial Sequence
  RNA Oligomer
uuccucaucgacacuuacuccag

SEQ ID NO: 51404 - RNA, 23 nt, Artificial Sequence
  RNA Oligomer
cuuccucaucgacacuuacucca

SEQ ID NO: 51405 - RNA, 23 nt, Artificial Sequence
  RNA Oligomer
cgcuguguucaucgacuuccuca

SEQ ID NO: 51406 - RNA, 23 nt, Artificial Sequence
  RNA Oligomer
ccgcuguguucaucgacuuccuc

SEQ ID NO: 51407 - RNA, 23 nt, Artificial Sequence
  RNA Oligomer
gccgcuguguucaucgacuuccu

SEQ ID NO: 51408 - RNA, 23 nt, Artificial Sequence
  RNA Oligomer
ggccgcuguguucaucgacuucc

SEQ ID NO: 51409 - RNA, 23 nt, Artificial Sequence
  RNA Oligomer
uggccgcuguguucaucgacuuc

SEQ ID NO: 51410 - RNA, 23 nt, Artificial Sequence
  RNA Oligomer
guuguguacaucggcucaacccu

SEQ ID NO: 51411 - RNA, 23 nt, Artificial Sequence
  RNA Oligomer
gguuguguacaucggcucaaccc

SEQ ID NO: 51412 - RNA, 23 nt, Artificial Sequence
  RNA Oligomer
ugguuguguacaucggcucaacc

SEQ ID NO: 51413 - RNA, 23 nt, Artificial Sequence
  RNA Oligomer
cugguuguguacaucggcucaac

SEQ ID NO: 51414 - RNA, 23 nt, Artificial Sequence
  RNA Oligomer
gcugguuguguacaucggcucaa

SEQ ID NO: 51415 - RNA, 23 nt, Artificial Sequence
  RNA Oligomer
ggauccguuuugacauccugguu

SEQ ID NO: 51416 - RNA, 23 nt, Artificial Sequence
  RNA Oligomer
guuguaaaaagggauggauggac

SEQ ID NO: 51417 - RNA, 23 nt, Artificial Sequence
  RNA Oligomer
gguuguaaaaagggauggaugga

SEQ ID NO: 51418 - RNA, 23 nt, Artificial Sequence
  RNA Oligomer
agguuguaaaaagggauggaugg

SEQ ID NO: 51419 - RNA, 23 nt, Artificial Sequence
  RNA Oligomer
gagguuguaaaaagggauggaug

SEQ ID NO: 51420 - RNA, 23 nt, Artificial Sequence
  RNA Oligomer
cgugaugacaaacuuucucaaaa

SEQ ID NO: 51421 - RNA, 23 nt, Artificial Sequence
  RNA Oligomer
ucgugaugacaaacuuucucaaa

SEQ ID NO: 51422 - RNA, 23 nt, Artificial Sequence
  RNA Oligomer
uucgugaugacaaacuuucucaa

SEQ ID NO: 51423 - RNA, 23 nt, Artificial Sequence
  RNA Oligomer
cuucgugaugacaaacuuucuca

SEQ ID NO: 51424 - RNA, 23 nt, Artificial Sequence
  RNA Oligomer
ucuucgugaugacaaacuuucuc

SEQ ID NO: 51425 - RNA, 23 nt, Artificial Sequence
  RNA Oligomer
gaagagugaagggcaguacagug

SEQ ID NO: 51426 - RNA, 23 nt, Artificial Sequence
  RNA Oligomer
caaccagaggagauacagcugcu

SEQ ID NO: 51427 - RNA, 23 nt, Artificial Sequence
  RNA Oligomer
agucugcaagaugucaagggcca

SEQ ID NO: 51428 - RNA, 23 nt, Artificial Sequence
  RNA Oligomer
aaccagcagcuacuagggagaag

SEQ ID NO: 51429 - RNA, 23 nt, Artificial Sequence
  RNA Oligomer
cuacaaggaaaacaauguugaga

SEQ ID NO: 51430 - RNA, 23 nt, Artificial Sequence
  RNA Oligomer
acuacaaggaaaacaauguugag

SEQ ID NO: 51431 - RNA, 23 nt, Artificial Sequence
  RNA Oligomer
uacuacaaggaaaacaauguuga

SEQ ID NO: 51432 - RNA, 23 nt, Artificial Sequence
  RNA Oligomer
guacuacaaggaaaacaauguug

SEQ ID NO: 51433 - RNA, 23 nt, Artificial Sequence
  RNA Oligomer
aguacuacaaggaaaacaauguu

SEQ ID NO: 51434 - RNA, 23 nt, Artificial Sequence
  RNA Oligomer
caaagucacucggauccagagca

SEQ ID NO: 51435 - RNA, 23 nt, Artificial Sequence
  RNA Oligomer
acaaagucacucggauccagagc

SEQ ID NO: 51436 - RNA, 23 nt, Artificial Sequence
  RNA Oligomer
aacaaagucacucggauccagag

SEQ ID NO: 51437 - RNA, 23 nt, Artificial Sequence
  RNA Oligomer
gaacaaagucacucggauccaga

SEQ ID NO: 51438 - RNA, 23 nt, Artificial Sequence
  RNA Oligomer
cgaacaaagucacucggauccag

SEQ ID NO: 51439 - RNA, 23 nt, Artificial Sequence
  RNA Oligomer
agcugguuguguacaucggcuca

SEQ ID NO: 51440 - RNA, 23 nt, Artificial Sequence
  RNA Oligomer
cagcugguuguguacaucggcuc

SEQ ID NO: 51441 - RNA, 23 nt, Artificial Sequence
  RNA Oligomer
guuuugacauccugguuuuuggc

SEQ ID NO: 51442 - RNA, 23 nt, Artificial Sequence
  RNA Oligomer
uacaaggaaaacaauguugagaa

SEQ ID NO: 51443 - RNA, 23 nt, Artificial Sequence
  RNA Oligomer
cagugauguuuuccaguaugaga

SEQ ID NO: 51444 - RNA, 23 nt, Artificial Sequence
  RNA Oligomer
acucuuucuucgugaugacaaac

SEQ ID NO: 51445 - RNA, 23 nt, Artificial Sequence
  RNA Oligomer
aacucuuucuucgugaugacaaa

SEQ ID NO: 51446 - RNA, 23 nt, Artificial Sequence
  RNA Oligomer
gaacucuuucuucgugaugacaa

SEQ ID NO: 51447 - RNA, 23 nt, Artificial Sequence
  RNA Oligomer
gaggauccggaaagaguuuccga

SEQ ID NO: 51448 - RNA, 23 nt, Artificial Sequence
  RNA Oligomer
ggaggauccggaaagaguuuccg

SEQ ID NO: 51449 - RNA, 23 nt, Artificial Sequence
  RNA Oligomer
uggaggauccggaaagaguuucc

SEQ ID NO: 51450 - RNA, 23 nt, Artificial Sequence
  RNA Oligomer
cuggaggauccggaaagaguuuc

SEQ ID NO: 51451 - RNA, 23 nt, Artificial Sequence
  RNA Oligomer
gcuggaggauccggaaagaguuu

SEQ ID NO: 51452 - RNA, 23 nt, Artificial Sequence
  RNA Oligomer
uaacugcugucgcucccauauuu

SEQ ID NO: 51453 - RNA, 23 nt, Artificial Sequence
  RNA Oligomer
guaacugcugucgcucccauauu

SEQ ID NO: 51454 - RNA, 23 nt, Artificial Sequence
  RNA Oligomer
aguaacugcugucgcucccauau

SEQ ID NO: 51455 - RNA, 23 nt, Artificial Sequence
  RNA Oligomer
caguaacugcugucgcucccaua

SEQ ID NO: 51456 - RNA, 23 nt, Artificial Sequence
  RNA Oligomer
ccaguaacugcugucgcucccau

SEQ ID NO: 51457 - RNA, 23 nt, Artificial Sequence
  RNA Oligomer
gcaugaauuauggcaccauuaag

SEQ ID NO: 51458 - RNA, 23 nt, Artificial Sequence
  RNA Oligomer
aaguacuacaaggaaaacaaugu

SEQ ID NO: 51459 - RNA, 23 nt, Artificial Sequence
  RNA Oligomer
caaguacuacaaggaaaacaaug

SEQ ID NO: 51460 - RNA, 23 nt, Artificial Sequence
  RNA Oligomer
ccaaguacuacaaggaaaacaau

SEQ ID NO: 51461 - RNA, 23 nt, Artificial Sequence
  RNA Oligomer
uuauggcaccauuaagugguucu

SEQ ID NO: 51462 - RNA, 23 nt, Artificial Sequence
  RNA Oligomer
ggacucugauaaaagucuucggg

SEQ ID NO: 51463 - RNA, 23 nt, Artificial Sequence
  RNA Oligomer
cggacucugauaaaagucuucgg

SEQ ID NO: 51464 - RNA, 23 nt, Artificial Sequence
  RNA Oligomer
acggacucugauaaaagucuucg

SEQ ID NO: 51465 - RNA, 23 nt, Artificial Sequence
  RNA Oligomer
aacggacucugauaaaagucuuc

SEQ ID NO: 51466 - RNA, 23 nt, Artificial Sequence
  RNA Oligomer
aaacggacucugauaaaagucuu

SEQ ID NO: 51467 - RNA, 23 nt, Artificial Sequence
  RNA Oligomer
gccaaguacuacaaggaaaacaa

SEQ ID NO: 51468 - RNA, 23 nt, Artificial Sequence
  RNA Oligomer
ggauccagagcaugaauuauggc

SEQ ID NO: 51469 - RNA, 23 nt, Artificial Sequence
  RNA Oligomer
cggauccagagcaugaauuaugg

SEQ ID NO: 51470 - RNA, 23 nt, Artificial Sequence
  RNA Oligomer
ucggauccagagcaugaauuaug

SEQ ID NO: 51471 - RNA, 23 nt, Artificial Sequence
  RNA Oligomer
cucggauccagagcaugaauuau

SEQ ID NO: 51472 - RNA, 23 nt, Artificial Sequence
  RNA Oligomer
acucggauccagagcaugaauua

SEQ ID NO: 51473 - RNA, 23 nt, Artificial Sequence
  RNA Oligomer
ggagacaucuuccgagaaacagg

SEQ ID NO: 51474 - RNA, 23 nt, Artificial Sequence
  RNA Oligomer
aggagacaucuuccgagaaacag

SEQ ID NO: 51475 - RNA, 23 nt, Artificial Sequence
  RNA Oligomer
uaggagacaucuuccgagaaaca

SEQ ID NO: 51476 - RNA, 23 nt, Artificial Sequence
  RNA Oligomer
cuaggagacaucuuccgagaaac

SEQ ID NO: 51477 - RNA, 23 nt, Artificial Sequence
  RNA Oligomer
acuaggagacaucuuccgagaaa

SEQ ID NO: 51478 - RNA, 23 nt, Artificial Sequence
  RNA Oligomer
gugauguuuuccaguaugagacg

SEQ ID NO: 51479 - RNA, 23 nt, Artificial Sequence
  RNA Oligomer
agugauguuuuccaguaugagac

SEQ ID NO: 51480 - RNA, 23 nt, Artificial Sequence
  RNA Oligomer
gggauccguuuugacauccuggu

SEQ ID NO: 51481 - RNA, 23 nt, Artificial Sequence
  RNA Oligomer
gucuucgggauccguuuugacau

SEQ ID NO: 51482 - RNA, 23 nt, Artificial Sequence
  RNA Oligomer
agucuucgggauccguuuugaca

SEQ ID NO: 51483 - RNA, 23 nt, Artificial Sequence
  RNA Oligomer
aagucuucgggauccguuuugac

SEQ ID NO: 51484 - RNA, 23 nt, Artificial Sequence
  RNA Oligomer
aaagucuucgggauccguuuuga

SEQ ID NO: 51485 - RNA, 23 nt, Artificial Sequence
  RNA Oligomer
aaaagucuucgggauccguuuug

SEQ ID NO: 51486 - RNA, 23 nt, Artificial Sequence
  RNA Oligomer
agacaucuuccgagaaacaggcg

SEQ ID NO: 51487 - RNA, 23 nt, Artificial Sequence
  RNA Oligomer
gagacaucuuccgagaaacaggc

SEQ ID NO: 51488 - RNA, 23 nt, Artificial Sequence
  RNA Oligomer
agaaguuggugcacagugucuuu

SEQ ID NO: 51489 - RNA, 23 nt, Artificial Sequence
  RNA Oligomer
aagaaguuggugcacagugucuu

SEQ ID NO: 51490 - RNA, 23 nt, Artificial Sequence
  RNA Oligomer
gaagaaguuggugcacagugucu

SEQ ID NO: 51491 - RNA, 23 nt, Artificial Sequence
  RNA Oligomer
ugaagaaguuggugcacaguguc

SEQ ID NO: 51492 - RNA, 23 nt, Artificial Sequence
  RNA Oligomer
gugaagaaguuggugcacagugu

SEQ ID NO: 51493 - RNA, 23 nt, Artificial Sequence
  RNA Oligomer
uuaaacaucacuuguaccuucca

SEQ ID NO: 51494 - RNA, 23 nt, Artificial Sequence
  RNA Oligomer
gauaauuuuucagauguggcaau

SEQ ID NO: 51495 - RNA, 23 nt, Artificial Sequence
  RNA Oligomer
ucagcccuguguggucaacgaau

SEQ ID NO: 51496 - RNA, 23 nt, Artificial Sequence
  RNA Oligomer
guauguguccuuuguggaugaau

SEQ ID NO: 51497 - RNA, 23 nt, Artificial Sequence
  RNA Oligomer
gaaaauuugacauuauccagcug

SEQ ID NO: 51498 - RNA, 23 nt, Artificial Sequence
  RNA Oligomer
gagaaacauccugccagguuuaa

SEQ ID NO: 51499 - RNA, 23 nt, Artificial Sequence
  RNA Oligomer
uaauuuuucagauguggcaauuc

SEQ ID NO: 51500 - RNA, 23 nt, Artificial Sequence
  RNA Oligomer
ggaaagaguuuccgaagagugaa

SEQ ID NO: 51501 - RNA, 23 nt, Artificial Sequence
  RNA Oligomer
cccauuuuccgacuaggagacau

SEQ ID NO: 51502 - RNA, 23 nt, Artificial Sequence
  RNA Oligomer
aacauccugccagguuuaaacau

SEQ ID NO: 51503 - RNA, 23 nt, Artificial Sequence
  RNA Oligomer
agaaacauccugccagguuuaaa

SEQ ID NO: 51504 - RNA, 23 nt, Artificial Sequence
  RNA Oligomer
ugaaagaggagaucguggagaau

SEQ ID NO: 51505 - RNA, 23 nt, Artificial Sequence
  RNA Oligomer
ccauuaagugguucuuccacgug

SEQ ID NO: 51506 - RNA, 23 nt, Artificial Sequence
  RNA Oligomer
agggaaccagaagaccugugaag

SEQ ID NO: 51507 - RNA, 23 nt, Artificial Sequence
  RNA Oligomer
gugacaagcuguaccagcggaaa

SEQ ID NO: 51508 - RNA, 23 nt, Artificial Sequence
  RNA Oligomer
ucccauauuuaucccuggugcaa

SEQ ID NO: 51509 - RNA, 23 nt, Artificial Sequence
  RNA Oligomer
gaaguuggugcacagugucuuug

SEQ ID NO: 51510 - RNA, 23 nt, Artificial Sequence
  RNA Oligomer
gugaaagaggagaucguggagaa

SEQ ID NO: 51511 - RNA, 23 nt, Artificial Sequence
  RNA Oligomer
ggugaaagaggagaucguggaga

SEQ ID NO: 51512 - RNA, 23 nt, Artificial Sequence
  RNA Oligomer
ugacaagcuguaccagcggaaag

SEQ ID NO: 51513 - RNA, 23 nt, Artificial Sequence
  RNA Oligomer
ccauuuuccgacuaggagacauc

SEQ ID NO: 51514 - RNA, 23 nt, Artificial Sequence
  RNA Oligomer
cuguuccucugaccgagguugua

SEQ ID NO: 51515 - RNA, 23 nt, Artificial Sequence
  RNA Oligomer
ugauguuuuccaguaugagacga

SEQ ID NO: 51516 - RNA, 23 nt, Artificial Sequence
  RNA Oligomer
gaaagaggagaucguggagaaug

SEQ ID NO: 51517 - RNA, 23 nt, Artificial Sequence
  RNA Oligomer
caagaagucccaagaccugcgau

SEQ ID NO: 51518 - RNA, 23 nt, Artificial Sequence
  RNA Oligomer
cgccaaguacuacaaggaaaaca

SEQ ID NO: 51519 - RNA, 23 nt, Artificial Sequence
  RNA Oligomer
ucacuuguaccuuccacaagacu

SEQ ID NO: 51520 - RNA, 23 nt, Artificial Sequence
  RNA Oligomer
cacugugcucaucaagaacaaua

SEQ ID NO: 51521 - RNA, 23 nt, Artificial Sequence
  RNA Oligomer
cgagaaacauccugccagguuua

SEQ ID NO: 51522 - RNA, 23 nt, Artificial Sequence
  RNA Oligomer
agcaaaggaauucagaccggaag

SEQ ID NO: 51523 - RNA, 23 nt, Artificial Sequence
  RNA Oligomer
cucccauauuuaucccuggugca

SEQ ID NO: 51524 - RNA, 23 nt, Artificial Sequence
  RNA Oligomer
cugugcucaucaagaacaauauc

SEQ ID NO: 51525 - RNA, 23 nt, Artificial Sequence
  RNA Oligomer
gcagcugcagugauguuuuccag

SEQ ID NO: 51526 - RNA, 23 nt, Artificial Sequence
  RNA Oligomer
cuuuguggaugaaucccacauua

SEQ ID NO: 51527 - RNA, 23 nt, Artificial Sequence
  RNA Oligomer
ccuuuguggaugaaucccacauu

SEQ ID NO: 51528 - RNA, 23 nt, Artificial Sequence
  RNA Oligomer
ugcgaguccauuguggagccaaa

SEQ ID NO: 51529 - RNA, 23 nt, Artificial Sequence
  RNA Oligomer
ccauauuuaucccuggugcaagu

SEQ ID NO: 51530 - RNA, 23 nt, Artificial Sequence
  RNA Oligomer
gauaaaagucuucgggauccguu

SEQ ID NO: 51531 - RNA, 23 nt, Artificial Sequence
  RNA Oligomer
aguauguguccuuuguggaugaa

SEQ ID NO: 51532 - RNA, 23 nt, Artificial Sequence
  RNA Oligomer
gccgacauuaaaguauguguccu

SEQ ID NO: 51533 - RNA, 23 nt, Artificial Sequence
  RNA Oligomer
acgccaaguacuacaaggaaaac

SEQ ID NO: 51534 - RNA, 23 nt, Artificial Sequence
  RNA Oligomer
gaaucccacauuaggauggugaa

SEQ ID NO: 51535 - RNA, 23 nt, Artificial Sequence
  RNA Oligomer
ggaugaaucccacauuaggaugg

SEQ ID NO: 51536 - RNA, 23 nt, Artificial Sequence
  RNA Oligomer
uccuuuguggaugaaucccacau

SEQ ID NO: 51537 - RNA, 23 nt, Artificial Sequence
  RNA Oligomer
ugacauuauccagcugguugugu

SEQ ID NO: 51538 - RNA, 23 nt, Artificial Sequence
  RNA Oligomer
cacuuguaccuuccacaagacuc

SEQ ID NO: 51539 - RNA, 23 nt, Artificial Sequence
  RNA Oligomer
cgaaaacuucacugugcucauca

SEQ ID NO: 51540 - RNA, 23 nt, Artificial Sequence
  RNA Oligomer
gcuuagaaaggaggcgacuccua

SEQ ID NO: 51541 - RNA, 23 nt, Artificial Sequence
  RNA Oligomer
ugaaucccacauuaggaugguga

SEQ ID NO: 51542 - RNA, 23 nt, Artificial Sequence
  RNA Oligomer
guggagccaaagccgacauuaaa

SEQ ID NO: 51543 - RNA, 23 nt, Artificial Sequence
  RNA Oligomer
cucaucgacacuuacuccaguaa

SEQ ID NO: 51544 - RNA, 23 nt, Artificial Sequence
  RNA Oligomer
auacgccaaguacuacaaggaaa

SEQ ID NO: 51545 - RNA, 23 nt, Artificial Sequence
  RNA Oligomer
gacuaggagacaucuuccgagaa

SEQ ID NO: 51546 - RNA, 23 nt, Artificial Sequence
  RNA Oligomer
ucagaauccacagugucccauuu

SEQ ID NO: 51547 - RNA, 23 nt, Artificial Sequence
  RNA Oligomer
acaucacuuguaccuuccacaag

SEQ ID NO: 51548 - RNA, 23 nt, Artificial Sequence
  RNA Oligomer
aacaucacuuguaccuuccacaa

SEQ ID NO: 51549 - RNA, 23 nt, Artificial Sequence
  RNA Oligomer
cacgagaaacauccugccagguu

SEQ ID NO: 51550 - RNA, 23 nt, Artificial Sequence
  RNA Oligomer
uggacccgcagagcaaaggaauu

SEQ ID NO: 51551 - RNA, 23 nt, Artificial Sequence
  RNA Oligomer
guacaguggcuucaagaguccuu

SEQ ID NO: 51552 - RNA, 23 nt, Artificial Sequence
  RNA Oligomer
accugcgauggacuucacagauu

SEQ ID NO: 51553 - RNA, 23 nt, Artificial Sequence
  RNA Oligomer
caagaccugcgauggacuucaca

SEQ ID NO: 51554 - RNA, 23 nt, Artificial Sequence
  RNA Oligomer
agcuacuagggagaagucugcaa

SEQ ID NO: 51555 - RNA, 23 nt, Artificial Sequence
  RNA Oligomer
gaaccagcagcuacuagggagaa

SEQ ID NO: 51556 - RNA, 23 nt, Artificial Sequence
  RNA Oligomer
cccauauuuaucccuggugcaag

SEQ ID NO: 51557 - RNA, 23 nt, Artificial Sequence
  RNA Oligomer
caauguugagaaacggacucuga

SEQ ID NO: 51558 - RNA, 23 nt, Artificial Sequence
  RNA Oligomer
ucacucggauccagagcaugaau

SEQ ID NO: 51559 - RNA, 23 nt, Artificial Sequence
  RNA Oligomer
cacagugucccauuuuccgacua

SEQ ID NO: 51560 - RNA, 23 nt, Artificial Sequence
  RNA Oligomer
acaccacgagaaacauccugcca

SEQ ID NO: 51561 - RNA, 23 nt, Artificial Sequence
  RNA Oligomer
ggaaccagaagaccugugaaguc

SEQ ID NO: 51562 - RNA, 23 nt, Artificial Sequence
  RNA Oligomer
cucuuucuucgugaugacaaacu

SEQ ID NO: 51563 - RNA, 23 nt, Artificial Sequence
  RNA Oligomer
gugucuuugacaccgcagacuac

SEQ ID NO: 51564 - RNA, 23 nt, Artificial Sequence
  RNA Oligomer
gacauuauccagcugguugugua

SEQ ID NO: 51565 - RNA, 23 nt, Artificial Sequence
  RNA Oligomer
guugagaaacggacucugauaaa

SEQ ID NO: 51566 - RNA, 23 nt, Artificial Sequence
  RNA Oligomer
cacucggauccagagcaugaauu

SEQ ID NO: 51567 - RNA, 23 nt, Artificial Sequence
  RNA Oligomer
acagugucccauuuuccgacuag

SEQ ID NO: 51568 - RNA, 23 nt, Artificial Sequence
  RNA Oligomer
caguucugugcacaccaagguga

SEQ ID NO: 51569 - RNA, 23 nt, Artificial Sequence
  RNA Oligomer
guccuuuguggaugaaucccaca

SEQ ID NO: 51570 - RNA, 23 nt, Artificial Sequence
  RNA Oligomer
ucagauacgccaaguacuacaag

SEQ ID NO: 51571 - RNA, 23 nt, Artificial Sequence
  RNA Oligomer
cgacuaggagacaucuuccgaga

SEQ ID NO: 51572 - RNA, 23 nt, Artificial Sequence
  RNA Oligomer
cagaauccacagugucccauuuu

SEQ ID NO: 51573 - RNA, 23 nt, Artificial Sequence
  RNA Oligomer
ccacaagacucagaauccacagu

SEQ ID NO: 51574 - RNA, 23 nt, Artificial Sequence
  RNA Oligomer
cugcucucuugaacagugccgaa

SEQ ID NO: 51575 - RNA, 23 nt, Artificial Sequence
  RNA Oligomer
ugaagggaaccagaagaccugug

SEQ ID NO: 51576 - RNA, 23 nt, Artificial Sequence
  RNA Oligomer
gaauucagaccggaaggugugua

SEQ ID NO: 51577 - RNA, 23 nt, Artificial Sequence
  RNA Oligomer
cuuucuucgugaugacaaacuuu

SEQ ID NO: 51578 - RNA, 23 nt, Artificial Sequence
  RNA Oligomer
cggaaagaguuuccgaagaguga

SEQ ID NO: 51579 - RNA, 23 nt, Artificial Sequence
  RNA Oligomer
ccggaaagaguuuccgaagagug

SEQ ID NO: 51580 - RNA, 23 nt, Artificial Sequence
  RNA Oligomer
ugcaucaccaccucagagcuguu

SEQ ID NO: 51581 - RNA, 23 nt, Artificial Sequence
  RNA Oligomer
ucaucgacacuuacuccaguaac

SEQ ID NO: 51582 - RNA, 23 nt, Artificial Sequence
  RNA Oligomer
ugguuuuuggcaccggaggaaaa

SEQ ID NO: 51583 - RNA, 23 nt, Artificial Sequence
  RNA Oligomer
guggcuucaagaguccuuacuga

SEQ ID NO: 51584 - RNA, 23 nt, Artificial Sequence
  RNA Oligomer
caguggcuucaagaguccuuacu

SEQ ID NO: 51585 - RNA, 23 nt, Artificial Sequence
  RNA Oligomer
acaguggcuucaagaguccuuac

SEQ ID NO: 51586 - RNA, 23 nt, Artificial Sequence
  RNA Oligomer
ccacauuaggauggugaaccagc

SEQ ID NO: 51587 - RNA, 23 nt, Artificial Sequence
  RNA Oligomer
guggaugaaucccacauuaggau

SEQ ID NO: 51588 - RNA, 23 nt, Artificial Sequence
  RNA Oligomer
uaaaguauguguccuuuguggau

SEQ ID NO: 51589 - RNA, 23 nt, Artificial Sequence
  RNA Oligomer
uguggagccaaagccgacauuaa

SEQ ID NO: 51590 - RNA, 23 nt, Artificial Sequence
  RNA Oligomer
acacuuacuccaguaacugcugu

SEQ ID NO: 51591 - RNA, 23 nt, Artificial Sequence
  RNA Oligomer
ccucaucgacacuuacuccagua

SEQ ID NO: 51592 - RNA, 23 nt, Artificial Sequence
  RNA Oligomer
ggaaaauuugacauuauccagcu

SEQ ID NO: 51593 - RNA, 23 nt, Artificial Sequence
  RNA Oligomer
ccagacgccauuuaaaagucugc

SEQ ID NO: 51594 - RNA, 23 nt, Artificial Sequence
  RNA Oligomer
gccagacgccauuuaaaagucug

SEQ ID NO: 51595 - RNA, 23 nt, Artificial Sequence
  RNA Oligomer
agccagacgccauuuaaaagucu

SEQ ID NO: 51596 - RNA, 23 nt, Artificial Sequence
  RNA Oligomer
aagccagacgccauuuaaaaguc

SEQ ID NO: 51597 - RNA, 23 nt, Artificial Sequence
  RNA Oligomer
gaagccagacgccauuuaaaagu

SEQ ID NO: 51598 - RNA, 23 nt, Artificial Sequence
  RNA Oligomer
guggcucugauugcuuuauccaa

SEQ ID NO: 51599 - RNA, 23 nt, Artificial Sequence
  RNA Oligomer
gguggcucugauugcuuuaucca

SEQ ID NO: 51600 - RNA, 23 nt, Artificial Sequence
  RNA Oligomer
ggguggcucugauugcuuuaucc

SEQ ID NO: 51601 - RNA, 23 nt, Artificial Sequence
  RNA Oligomer
uggguggcucugauugcuuuauc

SEQ ID NO: 51602 - RNA, 23 nt, Artificial Sequence
  RNA Oligomer
auggguggcucugauugcuuuau

SEQ ID NO: 51603 - RNA, 23 nt, Artificial Sequence
  RNA Oligomer
ccaaagggaaauaugcuuucauc

SEQ ID NO: 51604 - RNA, 23 nt, Artificial Sequence
  RNA Oligomer
gccaaagggaaauaugcuuucau

SEQ ID NO: 51605 - RNA, 23 nt, Artificial Sequence
  RNA Oligomer
agccaaagggaaauaugcuuuca

SEQ ID NO: 51606 - RNA, 23 nt, Artificial Sequence
  RNA Oligomer
cagccaaagggaaauaugcuuuc

SEQ ID NO: 51607 - RNA, 23 nt, Artificial Sequence
  RNA Oligomer
ucagccaaagggaaauaugcuuu

SEQ ID NO: 51608 - RNA, 23 nt, Artificial Sequence
  RNA Oligomer
aaaaauuaucgccuguuucucgg

SEQ ID NO: 51609 - RNA, 23 nt, Artificial Sequence
  RNA Oligomer
aaaauuaucgccuguuucucgga

SEQ ID NO: 51610 - RNA, 23 nt, Artificial Sequence
  RNA Oligomer
aaauuaucgccuguuucucggaa

SEQ ID NO: 51611 - RNA, 23 nt, Artificial Sequence
  RNA Oligomer
aauuaucgccuguuucucggaag

SEQ ID NO: 51612 - RNA, 23 nt, Artificial Sequence
  RNA Oligomer
auuaucgccuguuucucggaaga

SEQ ID NO: 51613 - RNA, 23 nt, Artificial Sequence
  RNA Oligomer
agcaaacguaggaaaagaugauc

SEQ ID NO: 51614 - RNA, 23 nt, Artificial Sequence
  RNA Oligomer
gcaaacguaggaaaagaugauca

SEQ ID NO: 51615 - RNA, 23 nt, Artificial Sequence
  RNA Oligomer
caaacguaggaaaagaugaucac

SEQ ID NO: 51616 - RNA, 23 nt, Artificial Sequence
  RNA Oligomer
aaacguaggaaaagaugaucacg

SEQ ID NO: 51617 - RNA, 23 nt, Artificial Sequence
  RNA Oligomer
aacguaggaaaagaugaucacgu

SEQ ID NO: 51618 - RNA, 23 nt, Artificial Sequence
  RNA Oligomer
acguaggaaaagaugaucacgug

SEQ ID NO: 51619 - RNA, 23 nt, Artificial Sequence
  RNA Oligomer
gaaaaauuaucgccuguuucucg

SEQ ID NO: 51620 - RNA, 23 nt, Artificial Sequence
  RNA Oligomer
guacaagugauguuuaaaccugg

SEQ ID NO: 51621 - RNA, 23 nt, Artificial Sequence
  RNA Oligomer
uacaagugauguuuaaaccuggc

SEQ ID NO: 51622 - RNA, 23 nt, Artificial Sequence
  RNA Oligomer
acaagugauguuuaaaccuggca

SEQ ID NO: 51623 - RNA, 23 nt, Artificial Sequence
  RNA Oligomer
caagugauguuuaaaccuggcag

SEQ ID NO: 51624 - RNA, 23 nt, Artificial Sequence
  RNA Oligomer
aagugauguuuaaaccuggcagg

SEQ ID NO: 51625 - RNA, 23 nt, Artificial Sequence
  RNA Oligomer
cguaggaaaagaugaucacgugg

SEQ ID NO: 51626 - RNA, 23 nt, Artificial Sequence
  RNA Oligomer
guaggaaaagaugaucacgugga

SEQ ID NO: 51627 - RNA, 23 nt, Artificial Sequence
  RNA Oligomer
uaggaaaagaugaucacguggaa

SEQ ID NO: 51628 - RNA, 23 nt, Artificial Sequence
  RNA Oligomer
uggauaaugucaaauuuuccucc

SEQ ID NO: 51629 - RNA, 23 nt, Artificial Sequence
  RNA Oligomer
ggauaaugucaaauuuuccuccg

SEQ ID NO: 51630 - RNA, 23 nt, Artificial Sequence
  RNA Oligomer
gauaaugucaaauuuuccuccgg

SEQ ID NO: 51631 - RNA, 23 nt, Artificial Sequence
  RNA Oligomer
auaaugucaaauuuuccuccggu

SEQ ID NO: 51632 - RNA, 23 nt, Artificial Sequence
  RNA Oligomer
uaaugucaaauuuuccuccggug

SEQ ID NO: 51633 - RNA, 23 nt, Artificial Sequence
  RNA Oligomer
acggaucccgaagacuuuuauca

SEQ ID NO: 51634 - RNA, 23 nt, Artificial Sequence
  RNA Oligomer
cggaucccgaagacuuuuaucag

SEQ ID NO: 51635 - RNA, 23 nt, Artificial Sequence
  RNA Oligomer
ggaucccgaagacuuuuaucaga

SEQ ID NO: 51636 - RNA, 23 nt, Artificial Sequence
  RNA Oligomer
gaucccgaagacuuuuaucagag

SEQ ID NO: 51637 - RNA, 23 nt, Artificial Sequence
  RNA Oligomer
aucccgaagacuuuuaucagagu

SEQ ID NO: 51638 - RNA, 23 nt, Artificial Sequence
  RNA Oligomer
uugccacaucugaaaaauuaucg

SEQ ID NO: 51639 - RNA, 23 nt, Artificial Sequence
  RNA Oligomer
ugccacaucugaaaaauuaucgc

SEQ ID NO: 51640 - RNA, 23 nt, Artificial Sequence
  RNA Oligomer
gccacaucugaaaaauuaucgcc

SEQ ID NO: 51641 - RNA, 23 nt, Artificial Sequence
  RNA Oligomer
ccacaucugaaaaauuaucgccu

SEQ ID NO: 51642 - RNA, 23 nt, Artificial Sequence
  RNA Oligomer
cacaucugaaaaauuaucgccug

SEQ ID NO: 51643 - RNA, 23 nt, Artificial Sequence
  RNA Oligomer
acaucugaaaaauuaucgccugu

SEQ ID NO: 51644 - RNA, 23 nt, Artificial Sequence
  RNA Oligomer
caucugaaaaauuaucgccuguu

SEQ ID NO: 51645 - RNA, 23 nt, Artificial Sequence
  RNA Oligomer
gaugagcacagugaaguuuucgg

SEQ ID NO: 51646 - RNA, 23 nt, Artificial Sequence
  RNA Oligomer
augagcacagugaaguuuucggc

SEQ ID NO: 51647 - RNA, 23 nt, Artificial Sequence
  RNA Oligomer
ugagcacagugaaguuuucggca

SEQ ID NO: 51648 - RNA, 23 nt, Artificial Sequence
  RNA Oligomer
gagcacagugaaguuuucggcac

SEQ ID NO: 51649 - RNA, 23 nt, Artificial Sequence
  RNA Oligomer
agcacagugaaguuuucggcacu

SEQ ID NO: 51650 - RNA, 23 nt, Artificial Sequence
  RNA Oligomer
ugcaaagggaagguguagucugc

SEQ ID NO: 51651 - RNA, 23 nt, Artificial Sequence
  RNA Oligomer
gcaaagggaagguguagucugcg

SEQ ID NO: 51652 - RNA, 23 nt, Artificial Sequence
  RNA Oligomer
caaagggaagguguagucugcgg

SEQ ID NO: 51653 - RNA, 23 nt, Artificial Sequence
  RNA Oligomer
aaagggaagguguagucugcggu

SEQ ID NO: 51654 - RNA, 23 nt, Artificial Sequence
  RNA Oligomer
aagggaagguguagucugcggug

SEQ ID NO: 51655 - RNA, 23 nt, Artificial Sequence
  RNA Oligomer
aagcaaacguaggaaaagaugau

SEQ ID NO: 51656 - RNA, 23 nt, Artificial Sequence
  RNA Oligomer
aaagaugaucacguggaagaacc

SEQ ID NO: 51657 - RNA, 23 nt, Artificial Sequence
  RNA Oligomer
aagaugaucacguggaagaacca

SEQ ID NO: 51658 - RNA, 23 nt, Artificial Sequence
  RNA Oligomer
agaugaucacguggaagaaccac

SEQ ID NO: 51659 - RNA, 23 nt, Artificial Sequence
  RNA Oligomer
gaugaucacguggaagaaccacu

SEQ ID NO: 51660 - RNA, 23 nt, Artificial Sequence
  RNA Oligomer
augaucacguggaagaaccacuu

SEQ ID NO: 51661 - RNA, 23 nt, Artificial Sequence
  RNA Oligomer
aucugaaaaauuaucgccuguuu

SEQ ID NO: 51662 - RNA, 23 nt, Artificial Sequence
  RNA Oligomer
aagguacaagugauguuuaaacc

SEQ ID NO: 51663 - RNA, 23 nt, Artificial Sequence
  RNA Oligomer
agguacaagugauguuuaaaccu

SEQ ID NO: 51664 - RNA, 23 nt, Artificial Sequence
  RNA Oligomer
gguacaagugauguuuaaaccug

SEQ ID NO: 51665 - RNA, 23 nt, Artificial Sequence
  RNA Oligomer
ggggaagucgauauuguucuuga

SEQ ID NO: 51666 - RNA, 23 nt, Artificial Sequence
  RNA Oligomer
gggaagucgauauuguucuugau

SEQ ID NO: 51667 - RNA, 23 nt, Artificial Sequence
  RNA Oligomer
ggaagucgauauuguucuugaug

SEQ ID NO: 51668 - RNA, 23 nt, Artificial Sequence
  RNA Oligomer
gaagucgauauuguucuugauga

SEQ ID NO: 51669 - RNA, 23 nt, Artificial Sequence
  RNA Oligomer
aagucgauauuguucuugaugag

SEQ ID NO: 51670 - RNA, 23 nt, Artificial Sequence
  RNA Oligomer
ggacaaaucugugaaguccaucg

SEQ ID NO: 51671 - RNA, 23 nt, Artificial Sequence
  RNA Oligomer
gacaaaucugugaaguccaucgc

SEQ ID NO: 51672 - RNA, 23 nt, Artificial Sequence
  RNA Oligomer
acaaaucugugaaguccaucgca

SEQ ID NO: 51673 - RNA, 23 nt, Artificial Sequence
  RNA Oligomer
caaaucugugaaguccaucgcag

SEQ ID NO: 51674 - RNA, 23 nt, Artificial Sequence
  RNA Oligomer
aaaucugugaaguccaucgcagg

SEQ ID NO: 51675 - RNA, 23 nt, Artificial Sequence
  RNA Oligomer
cuugacaucuugcagacuucucc

SEQ ID NO: 51676 - RNA, 23 nt, Artificial Sequence
  RNA Oligomer
uugacaucuugcagacuucuccc

SEQ ID NO: 51677 - RNA, 23 nt, Artificial Sequence
  RNA Oligomer
ugacaucuugcagacuucucccu

SEQ ID NO: 51678 - RNA, 23 nt, Artificial Sequence
  RNA Oligomer
gacaucuugcagacuucucccua

SEQ ID NO: 51679 - RNA, 23 nt, Artificial Sequence
  RNA Oligomer
acaucuugcagacuucucccuag

SEQ ID NO: 51680 - RNA, 23 nt, Artificial Sequence
  RNA Oligomer
caccagggauaaauaugggagcg

SEQ ID NO: 51681 - RNA, 23 nt, Artificial Sequence
  RNA Oligomer
accagggauaaauaugggagcga

SEQ ID NO: 51682 - RNA, 23 nt, Artificial Sequence
  RNA Oligomer
ccagggauaaauaugggagcgac

SEQ ID NO: 51683 - RNA, 23 nt, Artificial Sequence
  RNA Oligomer
cagggauaaauaugggagcgaca

SEQ ID NO: 51684 - RNA, 23 nt, Artificial Sequence
  RNA Oligomer
agggauaaauaugggagcgacag

SEQ ID NO: 51685 - RNA, 23 nt, Artificial Sequence
  RNA Oligomer
aaugucaaauuuuccuccggugc

SEQ ID NO: 51686 - RNA, 23 nt, Artificial Sequence
  RNA Oligomer
ugacuuuguucgucucauacugg

SEQ ID NO: 51687 - RNA, 23 nt, Artificial Sequence
  RNA Oligomer
gacuuuguucgucucauacugga

SEQ ID NO: 51688 - RNA, 23 nt, Artificial Sequence
  RNA Oligomer
acuuuguucgucucauacuggaa

SEQ ID NO: 51689 - RNA, 23 nt, Artificial Sequence
  RNA Oligomer
cuuuguucgucucauacuggaaa

SEQ ID NO: 51690 - RNA, 23 nt, Artificial Sequence
  RNA Oligomer
uuuguucgucucauacuggaaaa

SEQ ID NO: 51691 - RNA, 23 nt, Artificial Sequence
  RNA Oligomer
agucgauauuguucuugaugagc

SEQ ID NO: 51692 - RNA, 23 nt, Artificial Sequence
  RNA Oligomer
gucgauauuguucuugaugagca

SEQ ID NO: 51693 - RNA, 23 nt, Artificial Sequence
  RNA Oligomer
ucgauauuguucuugaugagcac

SEQ ID NO: 51694 - RNA, 23 nt, Artificial Sequence
  RNA Oligomer
cggucugaauuccuuugcucugc

SEQ ID NO: 51695 - RNA, 23 nt, Artificial Sequence
  RNA Oligomer
ggucugaauuccuuugcucugcg

SEQ ID NO: 51696 - RNA, 23 nt, Artificial Sequence
  RNA Oligomer
gucugaauuccuuugcucugcgg

SEQ ID NO: 51697 - RNA, 23 nt, Artificial Sequence
  RNA Oligomer
ucugaauuccuuugcucugcggg

SEQ ID NO: 51698 - RNA, 23 nt, Artificial Sequence
  RNA Oligomer
cugaauuccuuugcucugcgggu

SEQ ID NO: 51699 - RNA, 23 nt, Artificial Sequence
  RNA Oligomer
cuccucuuucaccucugcuaucc

SEQ ID NO: 51700 - RNA, 23 nt, Artificial Sequence
  RNA Oligomer
uccucuuucaccucugcuauccc

SEQ ID NO: 51701 - RNA, 23 nt, Artificial Sequence
  RNA Oligomer
ccucuuucaccucugcuaucccc

SEQ ID NO: 51702 - RNA, 23 nt, Artificial Sequence
  RNA Oligomer
cucuuucaccucugcuauccccu

SEQ ID NO: 51703 - RNA, 23 nt, Artificial Sequence
  RNA Oligomer
ucuuucaccucugcuauccccuu

SEQ ID NO: 51704 - RNA, 23 nt, Artificial Sequence
  RNA Oligomer
caucuugcagacuucucccuagu

SEQ ID NO: 51705 - RNA, 23 nt, Artificial Sequence
  RNA Oligomer
aucuugcagacuucucccuagua

SEQ ID NO: 51706 - RNA, 23 nt, Artificial Sequence
  RNA Oligomer
cuucuuccuguaguaguauucgu

SEQ ID NO: 51707 - RNA, 23 nt, Artificial Sequence
  RNA Oligomer
uucuuccuguaguaguauucguu

SEQ ID NO: 51708 - RNA, 23 nt, Artificial Sequence
  RNA Oligomer
ucuuccuguaguaguauucguug

SEQ ID NO: 51709 - RNA, 23 nt, Artificial Sequence
  RNA Oligomer
cuuccuguaguaguauucguuga

SEQ ID NO: 51710 - RNA, 23 nt, Artificial Sequence
  RNA Oligomer
uuccuguaguaguauucguugac

SEQ ID NO: 51711 - RNA, 23 nt, Artificial Sequence
  RNA Oligomer
guaguauucguugaccacacagg

SEQ ID NO: 51712 - RNA, 23 nt, Artificial Sequence
  RNA Oligomer
uaguauucguugaccacacaggg

SEQ ID NO: 51713 - RNA, 23 nt, Artificial Sequence
  RNA Oligomer
aguauucguugaccacacagggc

SEQ ID NO: 51714 - RNA, 23 nt, Artificial Sequence
  RNA Oligomer
guauucguugaccacacagggcu

SEQ ID NO: 51715 - RNA, 23 nt, Artificial Sequence
  RNA Oligomer
uauucguugaccacacagggcug

SEQ ID NO: 51716 - RNA, 23 nt, Artificial Sequence
  RNA Oligomer
augucaaauuuuccuccggugcc

SEQ ID NO: 51717 - RNA, 23 nt, Artificial Sequence
  RNA Oligomer
cggggaagucgauauuguucuug

SEQ ID NO: 51718 - RNA, 23 nt, Artificial Sequence
  RNA Oligomer
gcacagugaaguuuucggcacug

SEQ ID NO: 51719 - RNA, 23 nt, Artificial Sequence
  RNA Oligomer
ugucaucacgaagaaagaguucc

SEQ ID NO: 51720 - RNA, 23 nt, Artificial Sequence
  RNA Oligomer
gucaucacgaagaaagaguuccc

SEQ ID NO: 51721 - RNA, 23 nt, Artificial Sequence
  RNA Oligomer
ucaucacgaagaaagaguucccc

SEQ ID NO: 51722 - RNA, 23 nt, Artificial Sequence
  RNA Oligomer
caucacgaagaaagaguuccccu

SEQ ID NO: 51723 - RNA, 23 nt, Artificial Sequence
  RNA Oligomer
aucacgaagaaagaguuccccug

SEQ ID NO: 51724 - RNA, 23 nt, Artificial Sequence
  RNA Oligomer
agcaaagcaaacguaggaaaaga

SEQ ID NO: 51725 - RNA, 23 nt, Artificial Sequence
  RNA Oligomer
gcaaagcaaacguaggaaaagau

SEQ ID NO: 51726 - RNA, 23 nt, Artificial Sequence
  RNA Oligomer
caaagcaaacguaggaaaagaug

SEQ ID NO: 51727 - RNA, 23 nt, Artificial Sequence
  RNA Oligomer
aaagcaaacguaggaaaagauga

SEQ ID NO: 51728 - RNA, 23 nt, Artificial Sequence
  RNA Oligomer
aggaaaagaugaucacguggaag

SEQ ID NO: 51729 - RNA, 23 nt, Artificial Sequence
  RNA Oligomer
ggaaaagaugaucacguggaaga

SEQ ID NO: 51730 - RNA, 23 nt, Artificial Sequence
  RNA Oligomer
gaaaagaugaucacguggaagaa

SEQ ID NO: 51731 - RNA, 23 nt, Artificial Sequence
  RNA Oligomer
aaaagaugaucacguggaagaac

SEQ ID NO: 51732 - RNA, 23 nt, Artificial Sequence
  RNA Oligomer
cuccuuucuaagcagcuguaucu

SEQ ID NO: 51733 - RNA, 23 nt, Artificial Sequence
  RNA Oligomer
uccuuucuaagcagcuguaucuc

SEQ ID NO: 51734 - RNA, 23 nt, Artificial Sequence
  RNA Oligomer
ccuuucuaagcagcuguaucucc

SEQ ID NO: 51735 - RNA, 23 nt, Artificial Sequence
  RNA Oligomer
cuuucuaagcagcuguaucuccu

SEQ ID NO: 51736 - RNA, 23 nt, Artificial Sequence
  RNA Oligomer
uuucuaagcagcuguaucuccuc

SEQ ID NO: 51737 - RNA, 23 nt, Artificial Sequence
  RNA Oligomer
acauacuuuaaugucggcuuugg

SEQ ID NO: 51738 - RNA, 23 nt, Artificial Sequence
  RNA Oligomer
cauacuuuaaugucggcuuuggc

SEQ ID NO: 51739 - RNA, 23 nt, Artificial Sequence
  RNA Oligomer
auacuuuaaugucggcuuuggcu

SEQ ID NO: 51740 - RNA, 23 nt, Artificial Sequence
  RNA Oligomer
uacuuuaaugucggcuuuggcuc

SEQ ID NO: 51741 - RNA, 23 nt, Artificial Sequence
  RNA Oligomer
acuuuaaugucggcuuuggcucc

SEQ ID NO: 51742 - RNA, 23 nt, Artificial Sequence
  RNA Oligomer
ccuguaguaguauucguugacca

SEQ ID NO: 51743 - RNA, 23 nt, Artificial Sequence
  RNA Oligomer
cuguaguaguauucguugaccac

SEQ ID NO: 51744 - RNA, 23 nt, Artificial Sequence
  RNA Oligomer
uguaguaguauucguugaccaca

SEQ ID NO: 51745 - RNA, 23 nt, Artificial Sequence
  RNA Oligomer
guaguaguauucguugaccacac

SEQ ID NO: 51746 - RNA, 23 nt, Artificial Sequence
  RNA Oligomer
uaguaguauucguugaccacaca

SEQ ID NO: 51747 - RNA, 23 nt, Artificial Sequence
  RNA Oligomer
accgaaguaggagaggguugagc

SEQ ID NO: 51748 - RNA, 23 nt, Artificial Sequence
  RNA Oligomer
ccgaaguaggagaggguugagcc

SEQ ID NO: 51749 - RNA, 23 nt, Artificial Sequence
  RNA Oligomer
cgaaguaggagaggguugagccg

SEQ ID NO: 51750 - RNA, 23 nt, Artificial Sequence
  RNA Oligomer
gaaguaggagaggguugagccga

SEQ ID NO: 51751 - RNA, 23 nt, Artificial Sequence
  RNA Oligomer
aaguaggagaggguugagccgau

SEQ ID NO: 51752 - RNA, 23 nt, Artificial Sequence
  RNA Oligomer
agugauguuuaaaccuggcagga

SEQ ID NO: 51753 - RNA, 23 nt, Artificial Sequence
  RNA Oligomer
uuguucgucucauacuggaaaac

SEQ ID NO: 51754 - RNA, 23 nt, Artificial Sequence
  RNA Oligomer
auuguucuugaugagcacaguga

SEQ ID NO: 51755 - RNA, 23 nt, Artificial Sequence
  RNA Oligomer
uuguucuugaugagcacagugaa

SEQ ID NO: 51756 - RNA, 23 nt, Artificial Sequence
  RNA Oligomer
uguucuugaugagcacagugaag

SEQ ID NO: 51757 - RNA, 23 nt, Artificial Sequence
  RNA Oligomer
guucuugaugagcacagugaagu

SEQ ID NO: 51758 - RNA, 23 nt, Artificial Sequence
  RNA Oligomer
uucuugaugagcacagugaaguu

SEQ ID NO: 51759 - RNA, 23 nt, Artificial Sequence
  RNA Oligomer
auccaucccuuuuuacaaccucg

SEQ ID NO: 51760 - RNA, 23 nt, Artificial Sequence
  RNA Oligomer
uccaucccuuuuuacaaccucgg

SEQ ID NO: 51761 - RNA, 23 nt, Artificial Sequence
  RNA Oligomer
ccaucccuuuuuacaaccucggu

SEQ ID NO: 51762 - RNA, 23 nt, Artificial Sequence
  RNA Oligomer
caucccuuuuuacaaccucgguc

SEQ ID NO: 51763 - RNA, 23 nt, Artificial Sequence
  RNA Oligomer
aucccuuuuuacaaccucgguca

SEQ ID NO: 51764 - RNA, 23 nt, Artificial Sequence
  RNA Oligomer
uucuguuuugagaaaguuuguca

SEQ ID NO: 51765 - RNA, 23 nt, Artificial Sequence
  RNA Oligomer
ucuguuuugagaaaguuugucau

SEQ ID NO: 51766 - RNA, 23 nt, Artificial Sequence
  RNA Oligomer
cuguuuugagaaaguuugucauc

SEQ ID NO: 51767 - RNA, 23 nt, Artificial Sequence
  RNA Oligomer
uguuuugagaaaguuugucauca

SEQ ID NO: 51768 - RNA, 23 nt, Artificial Sequence
  RNA Oligomer
guuuugagaaaguuugucaucac

SEQ ID NO: 51769 - RNA, 23 nt, Artificial Sequence
  RNA Oligomer
caccaacuucuucacuccauucu

SEQ ID NO: 51770 - RNA, 23 nt, Artificial Sequence
  RNA Oligomer
accaacuucuucacuccauucuc

SEQ ID NO: 51771 - RNA, 23 nt, Artificial Sequence
  RNA Oligomer
ccaacuucuucacuccauucucc

SEQ ID NO: 51772 - RNA, 23 nt, Artificial Sequence
  RNA Oligomer
caacuucuucacuccauucucca

SEQ ID NO: 51773 - RNA, 23 nt, Artificial Sequence
  RNA Oligomer
aacuucuucacuccauucuccac

SEQ ID NO: 51774 - RNA, 23 nt, Artificial Sequence
  RNA Oligomer
gacucuugaagccacuguacugc

SEQ ID NO: 51775 - RNA, 23 nt, Artificial Sequence
  RNA Oligomer
acucuugaagccacuguacugcc

SEQ ID NO: 51776 - RNA, 23 nt, Artificial Sequence
  RNA Oligomer
cucuugaagccacuguacugccc

SEQ ID NO: 51777 - RNA, 23 nt, Artificial Sequence
  RNA Oligomer
ucuugaagccacuguacugcccu

SEQ ID NO: 51778 - RNA, 23 nt, Artificial Sequence
  RNA Oligomer
cuugaagccacuguacugcccuu

SEQ ID NO: 51779 - RNA, 23 nt, Artificial Sequence
  RNA Oligomer
gcccuugacaucuugcagacuuc

SEQ ID NO: 51780 - RNA, 23 nt, Artificial Sequence
  RNA Oligomer
cccuugacaucuugcagacuucu

SEQ ID NO: 51781 - RNA, 23 nt, Artificial Sequence
  RNA Oligomer
ccuugacaucuugcagacuucuc

SEQ ID NO: 51782 - RNA, 23 nt, Artificial Sequence
  RNA Oligomer
cacaauggacucgcacuucuucc

SEQ ID NO: 51783 - RNA, 23 nt, Artificial Sequence
  RNA Oligomer
acaauggacucgcacuucuuccu

SEQ ID NO: 51784 - RNA, 23 nt, Artificial Sequence
  RNA Oligomer
caauggacucgcacuucuuccug

SEQ ID NO: 51785 - RNA, 23 nt, Artificial Sequence
  RNA Oligomer
aauggacucgcacuucuuccugu

SEQ ID NO: 51786 - RNA, 23 nt, Artificial Sequence
  RNA Oligomer
auggacucgcacuucuuccugua

SEQ ID NO: 51787 - RNA, 23 nt, Artificial Sequence
  RNA Oligomer
uccuguaguaguauucguugacc

SEQ ID NO: 51788 - RNA, 23 nt, Artificial Sequence
  RNA Oligomer
aguaguauucguugaccacacag

SEQ ID NO: 51789 - RNA, 23 nt, Artificial Sequence
  RNA Oligomer
gcaccagggauaaauaugggagc

SEQ ID NO: 51790 - RNA, 23 nt, Artificial Sequence
  RNA Oligomer
uuaauggugccauaauucaugcu

SEQ ID NO: 51791 - RNA, 23 nt, Artificial Sequence
  RNA Oligomer
uaauggugccauaauucaugcuc

SEQ ID NO: 51792 - RNA, 23 nt, Artificial Sequence
  RNA Oligomer
aauggugccauaauucaugcucu

SEQ ID NO: 51793 - RNA, 23 nt, Artificial Sequence
  RNA Oligomer
auggugccauaauucaugcucug

SEQ ID NO: 51794 - RNA, 23 nt, Artificial Sequence
  RNA Oligomer
uggugccauaauucaugcucugg

SEQ ID NO: 51795 - RNA, 23 nt, Artificial Sequence
  RNA Oligomer
agacuuuuaucagaguccguuuc

SEQ ID NO: 51796 - RNA, 23 nt, Artificial Sequence
  RNA Oligomer
gacuuuuaucagaguccguuucu

SEQ ID NO: 51797 - RNA, 23 nt, Artificial Sequence
  RNA Oligomer
acuuuuaucagaguccguuucuc

SEQ ID NO: 51798 - RNA, 23 nt, Artificial Sequence
  RNA Oligomer
cuuuuaucagaguccguuucuca

SEQ ID NO: 51799 - RNA, 23 nt, Artificial Sequence
  RNA Oligomer
uuuuaucagaguccguuucucaa

SEQ ID NO: 51800 - RNA, 23 nt, Artificial Sequence
  RNA Oligomer
ucugaaaaauuaucgccuguuuc

SEQ ID NO: 51801 - RNA, 23 nt, Artificial Sequence
  RNA Oligomer
cugaaaaauuaucgccuguuucu

SEQ ID NO: 51802 - RNA, 23 nt, Artificial Sequence
  RNA Oligomer
ugaaaaauuaucgccuguuucuc

SEQ ID NO: 51803 - RNA, 23 nt, Artificial Sequence
  RNA Oligomer
uggauucugagucuuguggaagg

SEQ ID NO: 51804 - RNA, 23 nt, Artificial Sequence
  RNA Oligomer
ggauucugagucuuguggaaggu

SEQ ID NO: 51805 - RNA, 23 nt, Artificial Sequence
  RNA Oligomer
gauucugagucuuguggaaggua

SEQ ID NO: 51806 - RNA, 23 nt, Artificial Sequence
  RNA Oligomer
auucugagucuuguggaagguac

SEQ ID NO: 51807 - RNA, 23 nt, Artificial Sequence
  RNA Oligomer
uucugagucuuguggaagguaca

SEQ ID NO: 51808 - RNA, 23 nt, Artificial Sequence
  RNA Oligomer
auguuucucgugguguaguugug

SEQ ID NO: 51809 - RNA, 23 nt, Artificial Sequence
  RNA Oligomer
uguuucucgugguguaguugugg

SEQ ID NO: 51810 - RNA, 23 nt, Artificial Sequence
  RNA Oligomer
guuucucgugguguaguuguggc

SEQ ID NO: 51811 - RNA, 23 nt, Artificial Sequence
  RNA Oligomer
uuucucgugguguaguuguggcc

SEQ ID NO: 51812 - RNA, 23 nt, Artificial Sequence
  RNA Oligomer
uucucgugguguaguuguggccg

SEQ ID NO: 51813 - RNA, 23 nt, Artificial Sequence
  RNA Oligomer
ugaauuccuuugcucugcggguc

SEQ ID NO: 51814 - RNA, 23 nt, Artificial Sequence
  RNA Oligomer
agggaagguguagucugcggugu

SEQ ID NO: 51815 - RNA, 23 nt, Artificial Sequence
  RNA Oligomer
gggaagguguagucugcgguguc

SEQ ID NO: 51816 - RNA, 23 nt, Artificial Sequence
  RNA Oligomer
ggaagguguagucugcgguguca

SEQ ID NO: 51817 - RNA, 23 nt, Artificial Sequence
  RNA Oligomer
gaagguguagucugcggugucaa

SEQ ID NO: 51818 - RNA, 23 nt, Artificial Sequence
  RNA Oligomer
aagguguagucugcggugucaaa

SEQ ID NO: 51819 - RNA, 23 nt, Artificial Sequence
  RNA Oligomer
acuucuucacuccauucuccacg

SEQ ID NO: 51820 - RNA, 23 nt, Artificial Sequence
  RNA Oligomer
cuucuucacuccauucuccacga

SEQ ID NO: 51821 - RNA, 23 nt, Artificial Sequence
  RNA Oligomer
gcagacuucucccuaguagcugc

SEQ ID NO: 51822 - RNA, 23 nt, Artificial Sequence
  RNA Oligomer
cagacuucucccuaguagcugcu

SEQ ID NO: 51823 - RNA, 23 nt, Artificial Sequence
  RNA Oligomer
agacuucucccuaguagcugcug

SEQ ID NO: 51824 - RNA, 23 nt, Artificial Sequence
  RNA Oligomer
gacuucucccuaguagcugcugg

SEQ ID NO: 51825 - RNA, 23 nt, Artificial Sequence
  RNA Oligomer
acuucucccuaguagcugcuggu

SEQ ID NO: 51826 - RNA, 23 nt, Artificial Sequence
  RNA Oligomer
acuucuuccuguaguaguauucg

SEQ ID NO: 51827 - RNA, 23 nt, Artificial Sequence
  RNA Oligomer
gaguaagugucgaugaggaaguc

SEQ ID NO: 51828 - RNA, 23 nt, Artificial Sequence
  RNA Oligomer
aguaagugucgaugaggaagucg

SEQ ID NO: 51829 - RNA, 23 nt, Artificial Sequence
  RNA Oligomer
guaagugucgaugaggaagucga

SEQ ID NO: 51830 - RNA, 23 nt, Artificial Sequence
  RNA Oligomer
uaagugucgaugaggaagucgau

SEQ ID NO: 51831 - RNA, 23 nt, Artificial Sequence
  RNA Oligomer
aagugucgaugaggaagucgaug

SEQ ID NO: 51832 - RNA, 23 nt, Artificial Sequence
  RNA Oligomer
ugucaaauuuuccuccggugcca

SEQ ID NO: 51833 - RNA, 23 nt, Artificial Sequence
  RNA Oligomer
gucaaauuuuccuccggugccaa

SEQ ID NO: 51834 - RNA, 23 nt, Artificial Sequence
  RNA Oligomer
ucaaauuuuccuccggugccaaa

SEQ ID NO: 51835 - RNA, 23 nt, Artificial Sequence
  RNA Oligomer
caaauuuuccuccggugccaaaa

SEQ ID NO: 51836 - RNA, 23 nt, Artificial Sequence
  RNA Oligomer
aaauuuuccuccggugccaaaaa

SEQ ID NO: 51837 - RNA, 23 nt, Artificial Sequence
  RNA Oligomer
gauguuucucgugguguaguugu

SEQ ID NO: 51838 - RNA, 23 nt, Artificial Sequence
  RNA Oligomer
gccggggaagucgauauuguucu

SEQ ID NO: 51839 - RNA, 23 nt, Artificial Sequence
  RNA Oligomer
ccggggaagucgauauuguucuu

SEQ ID NO: 51840 - RNA, 23 nt, Artificial Sequence
  RNA Oligomer
gaauuccuuugcucugcgggucc

SEQ ID NO: 51841 - RNA, 23 nt, Artificial Sequence
  RNA Oligomer
cuucuguuuugagaaaguuuguc

SEQ ID NO: 51842 - RNA, 23 nt, Artificial Sequence
  RNA Oligomer
uugaagccacuguacugcccuuc

SEQ ID NO: 51843 - RNA, 23 nt, Artificial Sequence
  RNA Oligomer
acuguacugcccuucacucuucg

SEQ ID NO: 51844 - RNA, 23 nt, Artificial Sequence
  RNA Oligomer
cuguacugcccuucacucuucgg

SEQ ID NO: 51845 - RNA, 23 nt, Artificial Sequence
  RNA Oligomer
uguacugcccuucacucuucgga

SEQ ID NO: 51846 - RNA, 23 nt, Artificial Sequence
  RNA Oligomer
guacugcccuucacucuucggaa

SEQ ID NO: 51847 - RNA, 23 nt, Artificial Sequence
  RNA Oligomer
uacugcccuucacucuucggaaa

SEQ ID NO: 51848 - RNA, 23 nt, Artificial Sequence
  RNA Oligomer
uucuaagcagcuguaucuccucu

SEQ ID NO: 51849 - RNA, 23 nt, Artificial Sequence
  RNA Oligomer
ucuaagcagcuguaucuccucug

SEQ ID NO: 51850 - RNA, 23 nt, Artificial Sequence
  RNA Oligomer
ucuugcagacuucucccuaguag

SEQ ID NO: 51851 - RNA, 23 nt, Artificial Sequence
  RNA Oligomer
cuugcagacuucucccuaguagc

SEQ ID NO: 51852 - RNA, 23 nt, Artificial Sequence
  RNA Oligomer
cacaaaggacacauacuuuaaug

SEQ ID NO: 51853 - RNA, 23 nt, Artificial Sequence
  RNA Oligomer
acaaaggacacauacuuuaaugu

SEQ ID NO: 51854 - RNA, 23 nt, Artificial Sequence
  RNA Oligomer
caaaggacacauacuuuaauguc

SEQ ID NO: 51855 - RNA, 23 nt, Artificial Sequence
  RNA Oligomer
aaaggacacauacuuuaaugucg

SEQ ID NO: 51856 - RNA, 23 nt, Artificial Sequence
  RNA Oligomer
aaggacacauacuuuaaugucgg

SEQ ID NO: 51857 - RNA, 23 nt, Artificial Sequence
  RNA Oligomer
cacuucuuccuguaguaguauuc

SEQ ID NO: 51858 - RNA, 23 nt, Artificial Sequence
  RNA Oligomer
gggauaaauaugggagcgacagc

SEQ ID NO: 51859 - RNA, 23 nt, Artificial Sequence
  RNA Oligomer
ggauaaauaugggagcgacagca

SEQ ID NO: 51860 - RNA, 23 nt, Artificial Sequence
  RNA Oligomer
gauaaauaugggagcgacagcag

SEQ ID NO: 51861 - RNA, 23 nt, Artificial Sequence
  RNA Oligomer
auaaauaugggagcgacagcagu

SEQ ID NO: 51862 - RNA, 23 nt, Artificial Sequence
  RNA Oligomer
ggaguaagugucgaugaggaagu

SEQ ID NO: 51863 - RNA, 23 nt, Artificial Sequence
  RNA Oligomer
ggugccauaauucaugcucugga

SEQ ID NO: 51864 - RNA, 23 nt, Artificial Sequence
  RNA Oligomer
gugccauaauucaugcucuggau

SEQ ID NO: 51865 - RNA, 23 nt, Artificial Sequence
  RNA Oligomer
uccguuucucaacauuguuuucc

SEQ ID NO: 51866 - RNA, 23 nt, Artificial Sequence
  RNA Oligomer
ccguuucucaacauuguuuuccu

SEQ ID NO: 51867 - RNA, 23 nt, Artificial Sequence
  RNA Oligomer
cguuucucaacauuguuuuccuu

SEQ ID NO: 51868 - RNA, 23 nt, Artificial Sequence
  RNA Oligomer
guuucucaacauuguuuuccuug

SEQ ID NO: 51869 - RNA, 23 nt, Artificial Sequence
  RNA Oligomer
uuucucaacauuguuuuccuugu

SEQ ID NO: 51870 - RNA, 23 nt, Artificial Sequence
  RNA Oligomer
gugacuuuguucgucucauacug

SEQ ID NO: 51871 - RNA, 23 nt, Artificial Sequence
  RNA Oligomer
ucuugaugagcacagugaaguuu

SEQ ID NO: 51872 - RNA, 23 nt, Artificial Sequence
  RNA Oligomer
cuugaugagcacagugaaguuuu

SEQ ID NO: 51873 - RNA, 23 nt, Artificial Sequence
  RNA Oligomer
uugaugagcacagugaaguuuuc

SEQ ID NO: 51874 - RNA, 23 nt, Artificial Sequence
  RNA Oligomer
ucccuuuuuacaaccucggucag

SEQ ID NO: 51875 - RNA, 23 nt, Artificial Sequence
  RNA Oligomer
cccuuuuuacaaccucggucaga

SEQ ID NO: 51876 - RNA, 23 nt, Artificial Sequence
  RNA Oligomer
ccuuuuuacaaccucggucagag

SEQ ID NO: 51877 - RNA, 23 nt, Artificial Sequence
  RNA Oligomer
cuuuuuacaaccucggucagagg

SEQ ID NO: 51878 - RNA, 23 nt, Artificial Sequence
  RNA Oligomer
ucacgaagaaagaguuccccugc

SEQ ID NO: 51879 - RNA, 23 nt, Artificial Sequence
  RNA Oligomer
cugcaaagggaagguguagucug

SEQ ID NO: 51880 - RNA, 23 nt, Artificial Sequence
  RNA Oligomer
uucuucacuccauucuccacgau

SEQ ID NO: 51881 - RNA, 23 nt, Artificial Sequence
  RNA Oligomer
ucuucacuccauucuccacgauc

SEQ ID NO: 51882 - RNA, 23 nt, Artificial Sequence
  RNA Oligomer
cuucacuccauucuccacgaucu

SEQ ID NO: 51883 - RNA, 23 nt, Artificial Sequence
  RNA Oligomer
uucacuccauucuccacgaucuc

SEQ ID NO: 51884 - RNA, 23 nt, Artificial Sequence
  RNA Oligomer
cuaagcagcuguaucuccucugg

SEQ ID NO: 51885 - RNA, 23 nt, Artificial Sequence
  RNA Oligomer
uaagcagcuguaucuccucuggu

SEQ ID NO: 51886 - RNA, 23 nt, Artificial Sequence
  RNA Oligomer
aagcagcuguaucuccucugguu

SEQ ID NO: 51887 - RNA, 23 nt, Artificial Sequence
  RNA Oligomer
gggcagccuggacaaaucuguga

SEQ ID NO: 51888 - RNA, 23 nt, Artificial Sequence
  RNA Oligomer
ggcagccuggacaaaucugugaa

SEQ ID NO: 51889 - RNA, 23 nt, Artificial Sequence
  RNA Oligomer
gcagccuggacaaaucugugaag

SEQ ID NO: 51890 - RNA, 23 nt, Artificial Sequence
  RNA Oligomer
cagccuggacaaaucugugaagu

SEQ ID NO: 51891 - RNA, 23 nt, Artificial Sequence
  RNA Oligomer
agccuggacaaaucugugaaguc

SEQ ID NO: 51892 - RNA, 23 nt, Artificial Sequence
  RNA Oligomer
cuucuuggcccuugacaucuugc

SEQ ID NO: 51893 - RNA, 23 nt, Artificial Sequence
  RNA Oligomer
uucuuggcccuugacaucuugca

SEQ ID NO: 51894 - RNA, 23 nt, Artificial Sequence
  RNA Oligomer
ucuuggcccuugacaucuugcag

SEQ ID NO: 51895 - RNA, 23 nt, Artificial Sequence
  RNA Oligomer
cuuggcccuugacaucuugcaga

SEQ ID NO: 51896 - RNA, 23 nt, Artificial Sequence
  RNA Oligomer
uuggcccuugacaucuugcagac

SEQ ID NO: 51897 - RNA, 23 nt, Artificial Sequence
  RNA Oligomer
acacauacuuuaaugucggcuuu

SEQ ID NO: 51898 - RNA, 23 nt, Artificial Sequence
  RNA Oligomer
cacauacuuuaaugucggcuuug

SEQ ID NO: 51899 - RNA, 23 nt, Artificial Sequence
  RNA Oligomer
cuuuaaugucggcuuuggcucca

SEQ ID NO: 51900 - RNA, 23 nt, Artificial Sequence
  RNA Oligomer
agccgauguacacaaccagcugg

SEQ ID NO: 51901 - RNA, 23 nt, Artificial Sequence
  RNA Oligomer
gccgauguacacaaccagcugga

SEQ ID NO: 51902 - RNA, 23 nt, Artificial Sequence
  RNA Oligomer
ccgauguacacaaccagcuggau

SEQ ID NO: 51903 - RNA, 23 nt, Artificial Sequence
  RNA Oligomer
cgauguacacaaccagcuggaua

SEQ ID NO: 51904 - RNA, 23 nt, Artificial Sequence
  RNA Oligomer
gauguacacaaccagcuggauaa

SEQ ID NO: 51905 - RNA, 23 nt, Artificial Sequence
  RNA Oligomer
ucugagucuuguggaagguacaa

SEQ ID NO: 51906 - RNA, 23 nt, Artificial Sequence
  RNA Oligomer
cugagucuuguggaagguacaag

SEQ ID NO: 51907 - RNA, 23 nt, Artificial Sequence
  RNA Oligomer
ugagucuuguggaagguacaagu

SEQ ID NO: 51908 - RNA, 23 nt, Artificial Sequence
  RNA Oligomer
gaagguacaagugauguuuaaac

SEQ ID NO: 51909 - RNA, 23 nt, Artificial Sequence
  RNA Oligomer
agugaaguuuucggcacuguuca

SEQ ID NO: 51910 - RNA, 23 nt, Artificial Sequence
  RNA Oligomer
gugaaguuuucggcacuguucaa

SEQ ID NO: 51911 - RNA, 23 nt, Artificial Sequence
  RNA Oligomer
ugaaguuuucggcacuguucaag

SEQ ID NO: 51912 - RNA, 23 nt, Artificial Sequence
  RNA Oligomer
gaaguuuucggcacuguucaaga

SEQ ID NO: 51913 - RNA, 23 nt, Artificial Sequence
  RNA Oligomer
aaguuuucggcacuguucaagag

SEQ ID NO: 51914 - RNA, 23 nt, Artificial Sequence
  RNA Oligomer
aguuuucggcacuguucaagaga

SEQ ID NO: 51915 - RNA, 23 nt, Artificial Sequence
  RNA Oligomer
guuuucggcacuguucaagagag

SEQ ID NO: 51916 - RNA, 23 nt, Artificial Sequence
  RNA Oligomer
uuuucggcacuguucaagagagc

SEQ ID NO: 51917 - RNA, 23 nt, Artificial Sequence
  RNA Oligomer
uuucggcacuguucaagagagca

SEQ ID NO: 51918 - RNA, 23 nt, Artificial Sequence
  RNA Oligomer
gcucuuggccuucuguuuugaga

SEQ ID NO: 51919 - RNA, 23 nt, Artificial Sequence
  RNA Oligomer
cucuuggccuucuguuuugagaa

SEQ ID NO: 51920 - RNA, 23 nt, Artificial Sequence
  RNA Oligomer
ucuuggccuucuguuuugagaaa

SEQ ID NO: 51921 - RNA, 23 nt, Artificial Sequence
  RNA Oligomer
cuuggccuucuguuuugagaaag

SEQ ID NO: 51922 - RNA, 23 nt, Artificial Sequence
  RNA Oligomer
uuggccuucuguuuugagaaagu

SEQ ID NO: 51923 - RNA, 23 nt, Artificial Sequence
  RNA Oligomer
ucacuccauucuccacgaucucc

SEQ ID NO: 51924 - RNA, 23 nt, Artificial Sequence
  RNA Oligomer
cacuccauucuccacgaucuccu

SEQ ID NO: 51925 - RNA, 23 nt, Artificial Sequence
  RNA Oligomer
acuccauucuccacgaucuccuc

SEQ ID NO: 51926 - RNA, 23 nt, Artificial Sequence
  RNA Oligomer
cuccauucuccacgaucuccucu

SEQ ID NO: 51927 - RNA, 23 nt, Artificial Sequence
  RNA Oligomer
uccauucuccacgaucuccucuu

SEQ ID NO: 51928 - RNA, 23 nt, Artificial Sequence
  RNA Oligomer
cacgaucuccucuuucaccucug

SEQ ID NO: 51929 - RNA, 23 nt, Artificial Sequence
  RNA Oligomer
acgaucuccucuuucaccucugc

SEQ ID NO: 51930 - RNA, 23 nt, Artificial Sequence
  RNA Oligomer
cgaucuccucuuucaccucugcu

SEQ ID NO: 51931 - RNA, 23 nt, Artificial Sequence
  RNA Oligomer
gaucuccucuuucaccucugcua

SEQ ID NO: 51932 - RNA, 23 nt, Artificial Sequence
  RNA Oligomer
aucuccucuuucaccucugcuau

SEQ ID NO: 51933 - RNA, 23 nt, Artificial Sequence
  RNA Oligomer
cuuucaccucugcuauccccuuc

SEQ ID NO: 51934 - RNA, 23 nt, Artificial Sequence
  RNA Oligomer
accagagcaaagcaaacguagga

SEQ ID NO: 51935 - RNA, 23 nt, Artificial Sequence
  RNA Oligomer
ccagagcaaagcaaacguaggaa

SEQ ID NO: 51936 - RNA, 23 nt, Artificial Sequence
  RNA Oligomer
cagagcaaagcaaacguaggaaa

SEQ ID NO: 51937 - RNA, 23 nt, Artificial Sequence
  RNA Oligomer
agagcaaagcaaacguaggaaaa

SEQ ID NO: 51938 - RNA, 23 nt, Artificial Sequence
  RNA Oligomer
gagcaaagcaaacguaggaaaag

SEQ ID NO: 51939 - RNA, 23 nt, Artificial Sequence
  RNA Oligomer
aggagucgccuccuuucuaagca

SEQ ID NO: 51940 - RNA, 23 nt, Artificial Sequence
  RNA Oligomer
ggagucgccuccuuucuaagcag

SEQ ID NO: 51941 - RNA, 23 nt, Artificial Sequence
  RNA Oligomer
gagucgccuccuuucuaagcagc

SEQ ID NO: 51942 - RNA, 23 nt, Artificial Sequence
  RNA Oligomer
agucgccuccuuucuaagcagcu

SEQ ID NO: 51943 - RNA, 23 nt, Artificial Sequence
  RNA Oligomer
gucgccuccuuucuaagcagcug

SEQ ID NO: 51944 - RNA, 23 nt, Artificial Sequence
  RNA Oligomer
guggaagaaccacuuaauggugc

SEQ ID NO: 51945 - RNA, 23 nt, Artificial Sequence
  RNA Oligomer
uggaagaaccacuuaauggugcc

SEQ ID NO: 51946 - RNA, 23 nt, Artificial Sequence
  RNA Oligomer
ggaagaaccacuuaauggugcca

SEQ ID NO: 51947 - RNA, 23 nt, Artificial Sequence
  RNA Oligomer
gaagaaccacuuaauggugccau

SEQ ID NO: 51948 - RNA, 23 nt, Artificial Sequence
  RNA Oligomer
aagaaccacuuaauggugccaua

SEQ ID NO: 51949 - RNA, 23 nt, Artificial Sequence
  RNA Oligomer
cuccacaauggacucgcacuucu

SEQ ID NO: 51950 - RNA, 23 nt, Artificial Sequence
  RNA Oligomer
uccacaauggacucgcacuucuu

SEQ ID NO: 51951 - RNA, 23 nt, Artificial Sequence
  RNA Oligomer
ccacaauggacucgcacuucuuc

SEQ ID NO: 51952 - RNA, 23 nt, Artificial Sequence
  RNA Oligomer
cugcucuuggccuucuguuuuga

SEQ ID NO: 51953 - RNA, 23 nt, Artificial Sequence
  RNA Oligomer
ugcucuuggccuucuguuuugag

SEQ ID NO: 51954 - RNA, 23 nt, Artificial Sequence
  RNA Oligomer
acugugcaccaacuucuucacuc

SEQ ID NO: 51955 - RNA, 23 nt, Artificial Sequence
  RNA Oligomer
cugugcaccaacuucuucacucc

SEQ ID NO: 51956 - RNA, 23 nt, Artificial Sequence
  RNA Oligomer
ugugcaccaacuucuucacucca

SEQ ID NO: 51957 - RNA, 23 nt, Artificial Sequence
  RNA Oligomer
gugcaccaacuucuucacuccau

SEQ ID NO: 51958 - RNA, 23 nt, Artificial Sequence
  RNA Oligomer
ugcaccaacuucuucacuccauu

SEQ ID NO: 51959 - RNA, 23 nt, Artificial Sequence
  RNA Oligomer
gcaccaacuucuucacuccauuc

SEQ ID NO: 51960 - RNA, 23 nt, Artificial Sequence
  RNA Oligomer
ucuccucuuucaccucugcuauc

SEQ ID NO: 51961 - RNA, 23 nt, Artificial Sequence
  RNA Oligomer
acucaccagagcaaagcaaacgu

SEQ ID NO: 51962 - RNA, 23 nt, Artificial Sequence
  RNA Oligomer
cucaccagagcaaagcaaacgua

SEQ ID NO: 51963 - RNA, 23 nt, Artificial Sequence
  RNA Oligomer
ucaccagagcaaagcaaacguag

SEQ ID NO: 51964 - RNA, 23 nt, Artificial Sequence
  RNA Oligomer
caccagagcaaagcaaacguagg

SEQ ID NO: 51965 - RNA, 23 nt, Artificial Sequence
  RNA Oligomer
ucgccuccuuucuaagcagcugu

SEQ ID NO: 51966 - RNA, 23 nt, Artificial Sequence
  RNA Oligomer
cgccuccuuucuaagcagcugua

SEQ ID NO: 51967 - RNA, 23 nt, Artificial Sequence
  RNA Oligomer
gccuccuuucuaagcagcuguau

SEQ ID NO: 51968 - RNA, 23 nt, Artificial Sequence
  RNA Oligomer
ccuccuuucuaagcagcuguauc

SEQ ID NO: 51969 - RNA, 23 nt, Artificial Sequence
  RNA Oligomer
cagcuguaucuccucugguuguc

SEQ ID NO: 51970 - RNA, 23 nt, Artificial Sequence
  RNA Oligomer
agcuguaucuccucugguugucc

SEQ ID NO: 51971 - RNA, 23 nt, Artificial Sequence
  RNA Oligomer
gcuguaucuccucugguugucca

SEQ ID NO: 51972 - RNA, 23 nt, Artificial Sequence
  RNA Oligomer
cuguaucuccucugguuguccag

SEQ ID NO: 51973 - RNA, 23 nt, Artificial Sequence
  RNA Oligomer
uguaucuccucugguuguccagg

SEQ ID NO: 51974 - RNA, 23 nt, Artificial Sequence
  RNA Oligomer
gucgaugaggaagucgaugaaca

SEQ ID NO: 51975 - RNA, 23 nt, Artificial Sequence
  RNA Oligomer
ucgaugaggaagucgaugaacac

SEQ ID NO: 51976 - RNA, 23 nt, Artificial Sequence
  RNA Oligomer
cgaugaggaagucgaugaacaca

SEQ ID NO: 51977 - RNA, 23 nt, Artificial Sequence
  RNA Oligomer
gaugaggaagucgaugaacacag

SEQ ID NO: 51978 - RNA, 23 nt, Artificial Sequence
  RNA Oligomer
augaggaagucgaugaacacagc

SEQ ID NO: 51979 - RNA, 23 nt, Artificial Sequence
  RNA Oligomer
ccaaaaaccaggaugucaaaacg

SEQ ID NO: 51980 - RNA, 23 nt, Artificial Sequence
  RNA Oligomer
caaaaaccaggaugucaaaacgg

SEQ ID NO: 51981 - RNA, 23 nt, Artificial Sequence
  RNA Oligomer
aaaaaccaggaugucaaaacgga

SEQ ID NO: 51982 - RNA, 23 nt, Artificial Sequence
  RNA Oligomer
aaaaccaggaugucaaaacggau

SEQ ID NO: 51983 - RNA, 23 nt, Artificial Sequence
  RNA Oligomer
aaaccaggaugucaaaacggauc

SEQ ID NO: 51984 - RNA, 23 nt, Artificial Sequence
  RNA Oligomer
cagaguccguuucucaacauugu

SEQ ID NO: 51985 - RNA, 23 nt, Artificial Sequence
  RNA Oligomer
agaguccguuucucaacauuguu

SEQ ID NO: 51986 - RNA, 23 nt, Artificial Sequence
  RNA Oligomer
gaguccguuucucaacauuguuu

SEQ ID NO: 51987 - RNA, 23 nt, Artificial Sequence
  RNA Oligomer
aguccguuucucaacauuguuuu

SEQ ID NO: 51988 - RNA, 23 nt, Artificial Sequence
  RNA Oligomer
guccguuucucaacauuguuuuc

SEQ ID NO: 51989 - RNA, 23 nt, Artificial Sequence
  RNA Oligomer
ugggacacuguggauucugaguc

SEQ ID NO: 51990 - RNA, 23 nt, Artificial Sequence
  RNA Oligomer
gggacacuguggauucugagucu

SEQ ID NO: 51991 - RNA, 23 nt, Artificial Sequence
  RNA Oligomer
ggacacuguggauucugagucuu

SEQ ID NO: 51992 - RNA, 23 nt, Artificial Sequence
  RNA Oligomer
gacacuguggauucugagucuug

SEQ ID NO: 51993 - RNA, 23 nt, Artificial Sequence
  RNA Oligomer
acacuguggauucugagucuugu

SEQ ID NO: 51994 - RNA, 23 nt, Artificial Sequence
  RNA Oligomer
uuuuuacaaccucggucagagga

SEQ ID NO: 51995 - RNA, 23 nt, Artificial Sequence
  RNA Oligomer
cucauacuggaaaacaucacugc

SEQ ID NO: 51996 - RNA, 23 nt, Artificial Sequence
  RNA Oligomer
ucauacuggaaaacaucacugca

SEQ ID NO: 51997 - RNA, 23 nt, Artificial Sequence
  RNA Oligomer
cauacuggaaaacaucacugcag

SEQ ID NO: 51998 - RNA, 23 nt, Artificial Sequence
  RNA Oligomer
auacuggaaaacaucacugcagc

SEQ ID NO: 51999 - RNA, 23 nt, Artificial Sequence
  RNA Oligomer
uacuggaaaacaucacugcagcu

SEQ ID NO: 52000 - RNA, 23 nt, Artificial Sequence
  RNA Oligomer
ccuucuguuuugagaaaguuugu

SEQ ID NO: 52001 - RNA, 23 nt, Artificial Sequence
  RNA Oligomer
ccgcugguacagcuugucacuca

SEQ ID NO: 52002 - RNA, 23 nt, Artificial Sequence
  RNA Oligomer
cgcugguacagcuugucacucac

SEQ ID NO: 52003 - RNA, 23 nt, Artificial Sequence
  RNA Oligomer
gcugguacagcuugucacucacc

SEQ ID NO: 52004 - RNA, 23 nt, Artificial Sequence
  RNA Oligomer
cugguacagcuugucacucacca

SEQ ID NO: 52005 - RNA, 23 nt, Artificial Sequence
  RNA Oligomer
ugguacagcuugucacucaccag

SEQ ID NO: 52006 - RNA, 23 nt, Artificial Sequence
  RNA Oligomer
gguacagcuugucacucaccaga

SEQ ID NO: 52007 - RNA, 23 nt, Artificial Sequence
  RNA Oligomer
guacagcuugucacucaccagag

SEQ ID NO: 52008 - RNA, 23 nt, Artificial Sequence
  RNA Oligomer
uacagcuugucacucaccagagc

SEQ ID NO: 52009 - RNA, 23 nt, Artificial Sequence
  RNA Oligomer
cacucaccagagcaaagcaaacg

SEQ ID NO: 52010 - RNA, 23 nt, Artificial Sequence
  RNA Oligomer
guaucuccucugguuguccagga

SEQ ID NO: 52011 - RNA, 23 nt, Artificial Sequence
  RNA Oligomer
ggacuucuuggcccuugacaucu

SEQ ID NO: 52012 - RNA, 23 nt, Artificial Sequence
  RNA Oligomer
gacuucuuggcccuugacaucuu

SEQ ID NO: 52013 - RNA, 23 nt, Artificial Sequence
  RNA Oligomer
acuucuuggcccuugacaucuug

SEQ ID NO: 52014 - RNA, 23 nt, Artificial Sequence
  RNA Oligomer
uggacucgcacuucuuccuguag

SEQ ID NO: 52015 - RNA, 23 nt, Artificial Sequence
  RNA Oligomer
ggacucgcacuucuuccuguagu

SEQ ID NO: 52016 - RNA, 23 nt, Artificial Sequence
  RNA Oligomer
gacucgcacuucuuccuguagua

SEQ ID NO: 52017 - RNA, 23 nt, Artificial Sequence
  RNA Oligomer
acuggaguaagugucgaugagga

SEQ ID NO: 52018 - RNA, 23 nt, Artificial Sequence
  RNA Oligomer
cuggaguaagugucgaugaggaa

SEQ ID NO: 52019 - RNA, 23 nt, Artificial Sequence
  RNA Oligomer
uggaguaagugucgaugaggaag

SEQ ID NO: 52020 - RNA, 23 nt, Artificial Sequence
  RNA Oligomer
ugaggaagucgaugaacacagcg

SEQ ID NO: 52021 - RNA, 23 nt, Artificial Sequence
  RNA Oligomer
gaggaagucgaugaacacagcgg

SEQ ID NO: 52022 - RNA, 23 nt, Artificial Sequence
  RNA Oligomer
aggaagucgaugaacacagcggc

SEQ ID NO: 52023 - RNA, 23 nt, Artificial Sequence
  RNA Oligomer
ggaagucgaugaacacagcggcc

SEQ ID NO: 52024 - RNA, 23 nt, Artificial Sequence
  RNA Oligomer
gaagucgaugaacacagcggcca

SEQ ID NO: 52025 - RNA, 23 nt, Artificial Sequence
  RNA Oligomer
aggguugagccgauguacacaac

SEQ ID NO: 52026 - RNA, 23 nt, Artificial Sequence
  RNA Oligomer
ggguugagccgauguacacaacc

SEQ ID NO: 52027 - RNA, 23 nt, Artificial Sequence
  RNA Oligomer
gguugagccgauguacacaacca

SEQ ID NO: 52028 - RNA, 23 nt, Artificial Sequence
  RNA Oligomer
guugagccgauguacacaaccag

SEQ ID NO: 52029 - RNA, 23 nt, Artificial Sequence
  RNA Oligomer
uugagccgauguacacaaccagc

SEQ ID NO: 52030 - RNA, 23 nt, Artificial Sequence
  RNA Oligomer
aaccaggaugucaaaacggaucc

SEQ ID NO: 52031 - RNA, 23 nt, Artificial Sequence
  RNA Oligomer
guccauccaucccuuuuuacaac

SEQ ID NO: 52032 - RNA, 23 nt, Artificial Sequence
  RNA Oligomer
uccauccaucccuuuuuacaacc

SEQ ID NO: 52033 - RNA, 23 nt, Artificial Sequence
  RNA Oligomer
ccauccaucccuuuuuacaaccu

SEQ ID NO: 52034 - RNA, 23 nt, Artificial Sequence
  RNA Oligomer
cauccaucccuuuuuacaaccuc

SEQ ID NO: 52035 - RNA, 23 nt, Artificial Sequence
  RNA Oligomer
uuuugagaaaguuugucaucacg

SEQ ID NO: 52036 - RNA, 23 nt, Artificial Sequence
  RNA Oligomer
uuugagaaaguuugucaucacga

SEQ ID NO: 52037 - RNA, 23 nt, Artificial Sequence
  RNA Oligomer
uugagaaaguuugucaucacgaa

SEQ ID NO: 52038 - RNA, 23 nt, Artificial Sequence
  RNA Oligomer
ugagaaaguuugucaucacgaag

SEQ ID NO: 52039 - RNA, 23 nt, Artificial Sequence
  RNA Oligomer
gagaaaguuugucaucacgaaga

SEQ ID NO: 52040 - RNA, 23 nt, Artificial Sequence
  RNA Oligomer
cacuguacugcccuucacucuuc

SEQ ID NO: 52041 - RNA, 23 nt, Artificial Sequence
  RNA Oligomer
agcagcuguaucuccucugguug

SEQ ID NO: 52042 - RNA, 23 nt, Artificial Sequence
  RNA Oligomer
uggcccuugacaucuugcagacu

SEQ ID NO: 52043 - RNA, 23 nt, Artificial Sequence
  RNA Oligomer
cuucucccuaguagcugcugguu

SEQ ID NO: 52044 - RNA, 23 nt, Artificial Sequence
  RNA Oligomer
ucucaacauuguuuuccuuguag

SEQ ID NO: 52045 - RNA, 23 nt, Artificial Sequence
  RNA Oligomer
cucaacauuguuuuccuuguagu

SEQ ID NO: 52046 - RNA, 23 nt, Artificial Sequence
  RNA Oligomer
ucaacauuguuuuccuuguagua

SEQ ID NO: 52047 - RNA, 23 nt, Artificial Sequence
  RNA Oligomer
caacauuguuuuccuuguaguac

SEQ ID NO: 52048 - RNA, 23 nt, Artificial Sequence
  RNA Oligomer
aacauuguuuuccuuguaguacu

SEQ ID NO: 52049 - RNA, 23 nt, Artificial Sequence
  RNA Oligomer
ugcucuggauccgagugacuuug

SEQ ID NO: 52050 - RNA, 23 nt, Artificial Sequence
  RNA Oligomer
gcucuggauccgagugacuuugu

SEQ ID NO: 52051 - RNA, 23 nt, Artificial Sequence
  RNA Oligomer
cucuggauccgagugacuuuguu

SEQ ID NO: 52052 - RNA, 23 nt, Artificial Sequence
  RNA Oligomer
ucuggauccgagugacuuuguuc

SEQ ID NO: 52053 - RNA, 23 nt, Artificial Sequence
  RNA Oligomer
cuggauccgagugacuuuguucg

SEQ ID NO: 52054 - RNA, 23 nt, Artificial Sequence
  RNA Oligomer
ugagccgauguacacaaccagcu

SEQ ID NO: 52055 - RNA, 23 nt, Artificial Sequence
  RNA Oligomer
gagccgauguacacaaccagcug

SEQ ID NO: 52056 - RNA, 23 nt, Artificial Sequence
  RNA Oligomer
gccaaaaaccaggaugucaaaac

SEQ ID NO: 52057 - RNA, 23 nt, Artificial Sequence
  RNA Oligomer
uucucaacauuguuuuccuugua

SEQ ID NO: 52058 - RNA, 23 nt, Artificial Sequence
  RNA Oligomer
ucucauacuggaaaacaucacug

SEQ ID NO: 52059 - RNA, 23 nt, Artificial Sequence
  RNA Oligomer
guuugucaucacgaagaaagagu

SEQ ID NO: 52060 - RNA, 23 nt, Artificial Sequence
  RNA Oligomer
uuugucaucacgaagaaagaguu

SEQ ID NO: 52061 - RNA, 23 nt, Artificial Sequence
  RNA Oligomer
uugucaucacgaagaaagaguuc

SEQ ID NO: 52062 - RNA, 23 nt, Artificial Sequence
  RNA Oligomer
ucggaaacucuuuccggauccuc

SEQ ID NO: 52063 - RNA, 23 nt, Artificial Sequence
  RNA Oligomer
cggaaacucuuuccggauccucc

SEQ ID NO: 52064 - RNA, 23 nt, Artificial Sequence
  RNA Oligomer
ggaaacucuuuccggauccucca

SEQ ID NO: 52065 - RNA, 23 nt, Artificial Sequence
  RNA Oligomer
gaaacucuuuccggauccuccag

SEQ ID NO: 52066 - RNA, 23 nt, Artificial Sequence
  RNA Oligomer
aaacucuuuccggauccuccagc

SEQ ID NO: 52067 - RNA, 23 nt, Artificial Sequence
  RNA Oligomer
aaauaugggagcgacagcaguua

SEQ ID NO: 52068 - RNA, 23 nt, Artificial Sequence
  RNA Oligomer
aauaugggagcgacagcaguuac

SEQ ID NO: 52069 - RNA, 23 nt, Artificial Sequence
  RNA Oligomer
auaugggagcgacagcaguuacu

SEQ ID NO: 52070 - RNA, 23 nt, Artificial Sequence
  RNA Oligomer
uaugggagcgacagcaguuacug

SEQ ID NO: 52071 - RNA, 23 nt, Artificial Sequence
  RNA Oligomer
augggagcgacagcaguuacugg

SEQ ID NO: 52072 - RNA, 23 nt, Artificial Sequence
  RNA Oligomer
cuuaauggugccauaauucaugc

SEQ ID NO: 52073 - RNA, 23 nt, Artificial Sequence
  RNA Oligomer
acauuguuuuccuuguaguacuu

SEQ ID NO: 52074 - RNA, 23 nt, Artificial Sequence
  RNA Oligomer
cauuguuuuccuuguaguacuug

SEQ ID NO: 52075 - RNA, 23 nt, Artificial Sequence
  RNA Oligomer
auuguuuuccuuguaguacuugg

SEQ ID NO: 52076 - RNA, 23 nt, Artificial Sequence
  RNA Oligomer
agaaccacuuaauggugccauaa

SEQ ID NO: 52077 - RNA, 23 nt, Artificial Sequence
  RNA Oligomer
cccgaagacuuuuaucagagucc

SEQ ID NO: 52078 - RNA, 23 nt, Artificial Sequence
  RNA Oligomer
ccgaagacuuuuaucagaguccg

SEQ ID NO: 52079 - RNA, 23 nt, Artificial Sequence
  RNA Oligomer
cgaagacuuuuaucagaguccgu

SEQ ID NO: 52080 - RNA, 23 nt, Artificial Sequence
  RNA Oligomer
gaagacuuuuaucagaguccguu

SEQ ID NO: 52081 - RNA, 23 nt, Artificial Sequence
  RNA Oligomer
aagacuuuuaucagaguccguuu

SEQ ID NO: 52082 - RNA, 23 nt, Artificial Sequence
  RNA Oligomer
uuguuuuccuuguaguacuuggc

SEQ ID NO: 52083 - RNA, 23 nt, Artificial Sequence
  RNA Oligomer
gccauaauucaugcucuggaucc

SEQ ID NO: 52084 - RNA, 23 nt, Artificial Sequence
  RNA Oligomer
ccauaauucaugcucuggauccg

SEQ ID NO: 52085 - RNA, 23 nt, Artificial Sequence
  RNA Oligomer
cauaauucaugcucuggauccga

SEQ ID NO: 52086 - RNA, 23 nt, Artificial Sequence
  RNA Oligomer
auaauucaugcucuggauccgag

SEQ ID NO: 52087 - RNA, 23 nt, Artificial Sequence
  RNA Oligomer
uaauucaugcucuggauccgagu

SEQ ID NO: 52088 - RNA, 23 nt, Artificial Sequence
  RNA Oligomer
ccuguuucucggaagaugucucc

SEQ ID NO: 52089 - RNA, 23 nt, Artificial Sequence
  RNA Oligomer
cuguuucucggaagaugucuccu

SEQ ID NO: 52090 - RNA, 23 nt, Artificial Sequence
  RNA Oligomer
uguuucucggaagaugucuccua

SEQ ID NO: 52091 - RNA, 23 nt, Artificial Sequence
  RNA Oligomer
guuucucggaagaugucuccuag

SEQ ID NO: 52092 - RNA, 23 nt, Artificial Sequence
  RNA Oligomer
uuucucggaagaugucuccuagu

SEQ ID NO: 52093 - RNA, 23 nt, Artificial Sequence
  RNA Oligomer
cgucucauacuggaaaacaucac

SEQ ID NO: 52094 - RNA, 23 nt, Artificial Sequence
  RNA Oligomer
gucucauacuggaaaacaucacu

SEQ ID NO: 52095 - RNA, 23 nt, Artificial Sequence
  RNA Oligomer
accaggaugucaaaacggauccc

SEQ ID NO: 52096 - RNA, 23 nt, Artificial Sequence
  RNA Oligomer
augucaaaacggaucccgaagac

SEQ ID NO: 52097 - RNA, 23 nt, Artificial Sequence
  RNA Oligomer
ugucaaaacggaucccgaagacu

SEQ ID NO: 52098 - RNA, 23 nt, Artificial Sequence
  RNA Oligomer
gucaaaacggaucccgaagacuu

SEQ ID NO: 52099 - RNA, 23 nt, Artificial Sequence
  RNA Oligomer
ucaaaacggaucccgaagacuuu

SEQ ID NO: 52100 - RNA, 23 nt, Artificial Sequence
  RNA Oligomer
caaaacggaucccgaagacuuuu

SEQ ID NO: 52101 - RNA, 23 nt, Artificial Sequence
  RNA Oligomer
cgccuguuucucggaagaugucu

SEQ ID NO: 52102 - RNA, 23 nt, Artificial Sequence
  RNA Oligomer
gccuguuucucggaagaugucuc

SEQ ID NO: 52103 - RNA, 23 nt, Artificial Sequence
  RNA Oligomer
aaagacacugugcaccaacuucu

SEQ ID NO: 52104 - RNA, 23 nt, Artificial Sequence
  RNA Oligomer
aagacacugugcaccaacuucuu

SEQ ID NO: 52105 - RNA, 23 nt, Artificial Sequence
  RNA Oligomer
agacacugugcaccaacuucuuc

SEQ ID NO: 52106 - RNA, 23 nt, Artificial Sequence
  RNA Oligomer
gacacugugcaccaacuucuuca

SEQ ID NO: 52107 - RNA, 23 nt, Artificial Sequence
  RNA Oligomer
acacugugcaccaacuucuucac

SEQ ID NO: 52108 - RNA, 23 nt, Artificial Sequence
  RNA Oligomer
uggaagguacaagugauguuuaa

SEQ ID NO: 52109 - RNA, 23 nt, Artificial Sequence
  RNA Oligomer
auugccacaucugaaaaauuauc

SEQ ID NO: 52110 - RNA, 23 nt, Artificial Sequence
  RNA Oligomer
auucguugaccacacagggcuga

SEQ ID NO: 52111 - RNA, 23 nt, Artificial Sequence
  RNA Oligomer
auucauccacaaaggacacauac

SEQ ID NO: 52112 - RNA, 23 nt, Artificial Sequence
  RNA Oligomer
cagcuggauaaugucaaauuuuc

SEQ ID NO: 52113 - RNA, 23 nt, Artificial Sequence
  RNA Oligomer
uuaaaccuggcaggauguuucuc

SEQ ID NO: 52114 - RNA, 23 nt, Artificial Sequence
  RNA Oligomer
gaauugccacaucugaaaaauua

SEQ ID NO: 52115 - RNA, 23 nt, Artificial Sequence
  RNA Oligomer
uucacucuucggaaacucuuucc

SEQ ID NO: 52116 - RNA, 23 nt, Artificial Sequence
  RNA Oligomer
augucuccuagucggaaaauggg

SEQ ID NO: 52117 - RNA, 23 nt, Artificial Sequence
  RNA Oligomer
auguuuaaaccuggcaggauguu

SEQ ID NO: 52118 - RNA, 23 nt, Artificial Sequence
  RNA Oligomer
uuuaaaccuggcaggauguuucu

SEQ ID NO: 52119 - RNA, 23 nt, Artificial Sequence
  RNA Oligomer
auucuccacgaucuccucuuuca

SEQ ID NO: 52120 - RNA, 23 nt, Artificial Sequence
  RNA Oligomer
cacguggaagaaccacuuaaugg

SEQ ID NO: 52121 - RNA, 23 nt, Artificial Sequence
  RNA Oligomer
cuucacaggucuucugguucccu

SEQ ID NO: 52122 - RNA, 23 nt, Artificial Sequence
  RNA Oligomer
uuuccgcugguacagcuugucac

SEQ ID NO: 52123 - RNA, 23 nt, Artificial Sequence
  RNA Oligomer
uugcaccagggauaaauauggga

SEQ ID NO: 52124 - RNA, 23 nt, Artificial Sequence
  RNA Oligomer
caaagacacugugcaccaacuuc

SEQ ID NO: 52125 - RNA, 23 nt, Artificial Sequence
  RNA Oligomer
uucuccacgaucuccucuuucac

SEQ ID NO: 52126 - RNA, 23 nt, Artificial Sequence
  RNA Oligomer
ucuccacgaucuccucuuucacc

SEQ ID NO: 52127 - RNA, 23 nt, Artificial Sequence
  RNA Oligomer
cuuuccgcugguacagcuuguca

SEQ ID NO: 52128 - RNA, 23 nt, Artificial Sequence
  RNA Oligomer
gaugucuccuagucggaaaaugg

SEQ ID NO: 52129 - RNA, 23 nt, Artificial Sequence
  RNA Oligomer
uacaaccucggucagaggaacag

SEQ ID NO: 52130 - RNA, 23 nt, Artificial Sequence
  RNA Oligomer
ucgucucauacuggaaaacauca

SEQ ID NO: 52131 - RNA, 23 nt, Artificial Sequence
  RNA Oligomer
cauucuccacgaucuccucuuuc

SEQ ID NO: 52132 - RNA, 23 nt, Artificial Sequence
  RNA Oligomer
aucgcaggucuugggacuucuug

SEQ ID NO: 52133 - RNA, 23 nt, Artificial Sequence
  RNA Oligomer
uguuuuccuuguaguacuuggcg

SEQ ID NO: 52134 - RNA, 23 nt, Artificial Sequence
  RNA Oligomer
agucuuguggaagguacaaguga

SEQ ID NO: 52135 - RNA, 23 nt, Artificial Sequence
  RNA Oligomer
uauuguucuugaugagcacagug

SEQ ID NO: 52136 - RNA, 23 nt, Artificial Sequence
  RNA Oligomer
uaaaccuggcaggauguuucucg

SEQ ID NO: 52137 - RNA, 23 nt, Artificial Sequence
  RNA Oligomer
cuuccggucugaauuccuuugcu

SEQ ID NO: 52138 - RNA, 23 nt, Artificial Sequence
  RNA Oligomer
ugcaccagggauaaauaugggag

SEQ ID NO: 52139 - RNA, 23 nt, Artificial Sequence
  RNA Oligomer
gauauuguucuugaugagcacag

SEQ ID NO: 52140 - RNA, 23 nt, Artificial Sequence
  RNA Oligomer
cuggaaaacaucacugcagcugc

SEQ ID NO: 52141 - RNA, 23 nt, Artificial Sequence
  RNA Oligomer
uaaugugggauucauccacaaag

SEQ ID NO: 52142 - RNA, 23 nt, Artificial Sequence
  RNA Oligomer
aaugugggauucauccacaaagg

SEQ ID NO: 52143 - RNA, 23 nt, Artificial Sequence
  RNA Oligomer
uuuggcuccacaauggacucgca

SEQ ID NO: 52144 - RNA, 23 nt, Artificial Sequence
  RNA Oligomer
acuugcaccagggauaaauaugg

SEQ ID NO: 52145 - RNA, 23 nt, Artificial Sequence
  RNA Oligomer
aacggaucccgaagacuuuuauc

SEQ ID NO: 52146 - RNA, 23 nt, Artificial Sequence
  RNA Oligomer
uucauccacaaaggacacauacu

SEQ ID NO: 52147 - RNA, 23 nt, Artificial Sequence
  RNA Oligomer
aggacacauacuuuaaugucggc

SEQ ID NO: 52148 - RNA, 23 nt, Artificial Sequence
  RNA Oligomer
guuuuccuuguaguacuuggcgu

SEQ ID NO: 52149 - RNA, 23 nt, Artificial Sequence
  RNA Oligomer
uucaccauccuaaugugggauuc

SEQ ID NO: 52150 - RNA, 23 nt, Artificial Sequence
  RNA Oligomer
ccauccuaaugugggauucaucc

SEQ ID NO: 52151 - RNA, 23 nt, Artificial Sequence
  RNA Oligomer
augugggauucauccacaaagga

SEQ ID NO: 52152 - RNA, 23 nt, Artificial Sequence
  RNA Oligomer
acacaaccagcuggauaauguca

SEQ ID NO: 52153 - RNA, 23 nt, Artificial Sequence
  RNA Oligomer
gagucuuguggaagguacaagug

SEQ ID NO: 52154 - RNA, 23 nt, Artificial Sequence
  RNA Oligomer
ugaugagcacagugaaguuuucg

SEQ ID NO: 52155 - RNA, 23 nt, Artificial Sequence
  RNA Oligomer
uaggagucgccuccuuucuaagc

SEQ ID NO: 52156 - RNA, 23 nt, Artificial Sequence
  RNA Oligomer
ucaccauccuaaugugggauuca

SEQ ID NO: 52157 - RNA, 23 nt, Artificial Sequence
  RNA Oligomer
uuuaaugucggcuuuggcuccac

SEQ ID NO: 52158 - RNA, 23 nt, Artificial Sequence
  RNA Oligomer
uuacuggaguaagugucgaugag

SEQ ID NO: 52159 - RNA, 23 nt, Artificial Sequence
  RNA Oligomer
uuuccuuguaguacuuggcguau

SEQ ID NO: 52160 - RNA, 23 nt, Artificial Sequence
  RNA Oligomer
uucucggaagaugucuccuaguc

SEQ ID NO: 52161 - RNA, 23 nt, Artificial Sequence
  RNA Oligomer
aaaugggacacuguggauucuga

SEQ ID NO: 52162 - RNA, 23 nt, Artificial Sequence
  RNA Oligomer
cuuguggaagguacaagugaugu

SEQ ID NO: 52163 - RNA, 23 nt, Artificial Sequence
  RNA Oligomer
uuguggaagguacaagugauguu

SEQ ID NO: 52164 - RNA, 23 nt, Artificial Sequence
  RNA Oligomer
aaccuggcaggauguuucucgug

SEQ ID NO: 52165 - RNA, 23 nt, Artificial Sequence
  RNA Oligomer
aauuccuuugcucugcgggucca

SEQ ID NO: 52166 - RNA, 23 nt, Artificial Sequence
  RNA Oligomer
aaggacucuugaagccacuguac

SEQ ID NO: 52167 - RNA, 23 nt, Artificial Sequence
  RNA Oligomer
aaucugugaaguccaucgcaggu

SEQ ID NO: 52168 - RNA, 23 nt, Artificial Sequence
  RNA Oligomer
ugugaaguccaucgcaggucuug

SEQ ID NO: 52169 - RNA, 23 nt, Artificial Sequence
  RNA Oligomer
uugcagacuucucccuaguagcu

SEQ ID NO: 52170 - RNA, 23 nt, Artificial Sequence
  RNA Oligomer
uucucccuaguagcugcugguuc

SEQ ID NO: 52171 - RNA, 23 nt, Artificial Sequence
  RNA Oligomer
cuugcaccagggauaaauauggg

SEQ ID NO: 52172 - RNA, 23 nt, Artificial Sequence
  RNA Oligomer
ucagaguccguuucucaacauug

SEQ ID NO: 52173 - RNA, 23 nt, Artificial Sequence
  RNA Oligomer
auucaugcucuggauccgaguga

SEQ ID NO: 52174 - RNA, 23 nt, Artificial Sequence
  RNA Oligomer
uagucggaaaaugggacacugug

SEQ ID NO: 52175 - RNA, 23 nt, Artificial Sequence
  RNA Oligomer
uggcaggauguuucucguggugu

SEQ ID NO: 52176 - RNA, 23 nt, Artificial Sequence
  RNA Oligomer
gacuucacaggucuucugguucc

SEQ ID NO: 52177 - RNA, 23 nt, Artificial Sequence
  RNA Oligomer
aguuugucaucacgaagaaagag

SEQ ID NO: 52178 - RNA, 23 nt, Artificial Sequence
  RNA Oligomer
guagucugcggugucaaagacac

SEQ ID NO: 52179 - RNA, 23 nt, Artificial Sequence
  RNA Oligomer
uacacaaccagcuggauaauguc

SEQ ID NO: 52180 - RNA, 23 nt, Artificial Sequence
  RNA Oligomer
uuuaucagaguccguuucucaac

SEQ ID NO: 52181 - RNA, 23 nt, Artificial Sequence
  RNA Oligomer
aauucaugcucuggauccgagug

SEQ ID NO: 52182 - RNA, 23 nt, Artificial Sequence
  RNA Oligomer
cuagucggaaaaugggacacugu

SEQ ID NO: 52183 - RNA, 23 nt, Artificial Sequence
  RNA Oligomer
ucaccuuggugugcacagaacug

SEQ ID NO: 52184 - RNA, 23 nt, Artificial Sequence
  RNA Oligomer
ugugggauucauccacaaaggac

SEQ ID NO: 52185 - RNA, 23 nt, Artificial Sequence
  RNA Oligomer
cuuguaguacuuggcguaucuga

SEQ ID NO: 52186 - RNA, 23 nt, Artificial Sequence
  RNA Oligomer
ucucggaagaugucuccuagucg

SEQ ID NO: 52187 - RNA, 23 nt, Artificial Sequence
  RNA Oligomer
aaaaugggacacuguggauucug

SEQ ID NO: 52188 - RNA, 23 nt, Artificial Sequence
  RNA Oligomer
acuguggauucugagucuugugg

SEQ ID NO: 52189 - RNA, 23 nt, Artificial Sequence
  RNA Oligomer
uucggcacuguucaagagagcag

SEQ ID NO: 52190 - RNA, 23 nt, Artificial Sequence
  RNA Oligomer
cacaggucuucugguucccuuca

SEQ ID NO: 52191 - RNA, 23 nt, Artificial Sequence
  RNA Oligomer
uacacaccuuccggucugaauuc

SEQ ID NO: 52192 - RNA, 23 nt, Artificial Sequence
  RNA Oligomer
aaaguuugucaucacgaagaaag

SEQ ID NO: 52193 - RNA, 23 nt, Artificial Sequence
  RNA Oligomer
ucacucuucggaaacucuuuccg

SEQ ID NO: 52194 - RNA, 23 nt, Artificial Sequence
  RNA Oligomer
cacucuucggaaacucuuuccgg

SEQ ID NO: 52195 - RNA, 23 nt, Artificial Sequence
  RNA Oligomer
aacagcucugagguggugaugca

SEQ ID NO: 52196 - RNA, 23 nt, Artificial Sequence
  RNA Oligomer
guuacuggaguaagugucgauga

SEQ ID NO: 52197 - RNA, 23 nt, Artificial Sequence
  RNA Oligomer
uuuuccuccggugccaaaaacca

SEQ ID NO: 52198 - RNA, 23 nt, Artificial Sequence
  RNA Oligomer
ucaguaaggacucuugaagccac

SEQ ID NO: 52199 - RNA, 23 nt, Artificial Sequence
  RNA Oligomer
aguaaggacucuugaagccacug

SEQ ID NO: 52200 - RNA, 23 nt, Artificial Sequence
  RNA Oligomer
guaaggacucuugaagccacugu

SEQ ID NO: 52201 - RNA, 23 nt, Artificial Sequence
  RNA Oligomer
gcugguucaccauccuaaugugg

SEQ ID NO: 52202 - RNA, 23 nt, Artificial Sequence
  RNA Oligomer
auccuaaugugggauucauccac

SEQ ID NO: 52203 - RNA, 23 nt, Artificial Sequence
  RNA Oligomer
auccacaaaggacacauacuuua

SEQ ID NO: 52204 - RNA, 23 nt, Artificial Sequence
  RNA Oligomer
uuaaugucggcuuuggcuccaca

SEQ ID NO: 52205 - RNA, 23 nt, Artificial Sequence
  RNA Oligomer
acagcaguuacuggaguaagugu

SEQ ID NO: 52206 - RNA, 23 nt, Artificial Sequence
  RNA Oligomer
uacuggaguaagugucgaugagg

SEQ ID NO: 52207 - RNA, 23 nt, Artificial Sequence
  RNA Oligomer
agcuggauaaugucaaauuuucc

SEQ ID NO: 52208 - RNA, 23 nt, Artificial Sequence
  RNA Oligomer
gcagacuuuuaaauggcgucugg

SEQ ID NO: 52209 - RNA, 23 nt, Artificial Sequence
  RNA Oligomer
cagacuuuuaaauggcgucuggc

SEQ ID NO: 52210 - RNA, 23 nt, Artificial Sequence
  RNA Oligomer
agacuuuuaaauggcgucuggcu

SEQ ID NO: 52211 - RNA, 23 nt, Artificial Sequence
  RNA Oligomer
gacuuuuaaauggcgucuggcuu

SEQ ID NO: 52212 - RNA, 23 nt, Artificial Sequence
  RNA Oligomer
acuuuuaaauggcgucuggcuuc

SEQ ID NO: 52213 - RNA, 23 nt, Artificial Sequence
  RNA Oligomer
uuggauaaagcaaucagagccac

SEQ ID NO: 52214 - RNA, 23 nt, Artificial Sequence
  RNA Oligomer
uggauaaagcaaucagagccacc

SEQ ID NO: 52215 - RNA, 23 nt, Artificial Sequence
  RNA Oligomer
ggauaaagcaaucagagccaccc

SEQ ID NO: 52216 - RNA, 23 nt, Artificial Sequence
  RNA Oligomer
gauaaagcaaucagagccaccca

SEQ ID NO: 52217 - RNA, 23 nt, Artificial Sequence
  RNA Oligomer
auaaagcaaucagagccacccau

SEQ ID NO: 52218 - RNA, 23 nt, Artificial Sequence
  RNA Oligomer
gaugaaagcauauuucccuuugg

SEQ ID NO: 52219 - RNA, 23 nt, Artificial Sequence
  RNA Oligomer
augaaagcauauuucccuuuggc

SEQ ID NO: 52220 - RNA, 23 nt, Artificial Sequence
  RNA Oligomer
ugaaagcauauuucccuuuggcu

SEQ ID NO: 52221 - RNA, 23 nt, Artificial Sequence
  RNA Oligomer
gaaagcauauuucccuuuggcug

SEQ ID NO: 52222 - RNA, 23 nt, Artificial Sequence
  RNA Oligomer
aaagcauauuucccuuuggcuga

SEQ ID NO: 52223 - RNA, 23 nt, Artificial Sequence
  RNA Oligomer
cggcaacaaugacaagcaagaaa

SEQ ID NO: 52224 - RNA, 23 nt, Artificial Sequence
  RNA Oligomer
ucggcaacaaugacaagcaagaa

SEQ ID NO: 52225 - RNA, 23 nt, Artificial Sequence
  RNA Oligomer
uucggcaacaaugacaagcaaga

SEQ ID NO: 52226 - RNA, 23 nt, Artificial Sequence
  RNA Oligomer
cuucggcaacaaugacaagcaag

SEQ ID NO: 52227 - RNA, 23 nt, Artificial Sequence
  RNA Oligomer
ccuucggcaacaaugacaagcaa

SEQ ID NO: 52228 - RNA, 23 nt, Artificial Sequence
  RNA Oligomer
ccaagaucaucauugugaagcgg

SEQ ID NO: 52229 - RNA, 23 nt, Artificial Sequence
  RNA Oligomer
cccaagaucaucauugugaagcg

SEQ ID NO: 52230 - RNA, 23 nt, Artificial Sequence
  RNA Oligomer
gcccaagaucaucauugugaagc

SEQ ID NO: 52231 - RNA, 23 nt, Artificial Sequence
  RNA Oligomer
ggcccaagaucaucauugugaag

SEQ ID NO: 52232 - RNA, 23 nt, Artificial Sequence
  RNA Oligomer
gggcccaagaucaucauugugaa

SEQ ID NO: 52233 - RNA, 23 nt, Artificial Sequence
  RNA Oligomer
accugaacauccucuccuacuuc

SEQ ID NO: 52234 - RNA, 23 nt, Artificial Sequence
  RNA Oligomer
caccugaacauccucuccuacuu

SEQ ID NO: 52235 - RNA, 23 nt, Artificial Sequence
  RNA Oligomer
ccaccugaacauccucuccuacu

SEQ ID NO: 52236 - RNA, 23 nt, Artificial Sequence
  RNA Oligomer
uccaccugaacauccucuccuac

SEQ ID NO: 52237 - RNA, 23 nt, Artificial Sequence
  RNA Oligomer
uuccaccugaacauccucuccua

SEQ ID NO: 52238 - RNA, 23 nt, Artificial Sequence
  RNA Oligomer
acaagcagcucaagaacaagcug

SEQ ID NO: 52239 - RNA, 23 nt, Artificial Sequence
  RNA Oligomer
cacaagcagcucaagaacaagcu

SEQ ID NO: 52240 - RNA, 23 nt, Artificial Sequence
  RNA Oligomer
gcacaagcagcucaagaacaagc

SEQ ID NO: 52241 - RNA, 23 nt, Artificial Sequence
  RNA Oligomer
ggcacaagcagcucaagaacaag

SEQ ID NO: 52242 - RNA, 23 nt, Artificial Sequence
  RNA Oligomer
aggcacaagcagcucaagaacaa

SEQ ID NO: 52243 - RNA, 23 nt, Artificial Sequence
  RNA Oligomer
gcacauuuuuaccaucaguaaga

SEQ ID NO: 52244 - RNA, 23 nt, Artificial Sequence
  RNA Oligomer
ugcacauuuuuaccaucaguaag

SEQ ID NO: 52245 - RNA, 23 nt, Artificial Sequence
  RNA Oligomer
augcacauuuuuaccaucaguaa

SEQ ID NO: 52246 - RNA, 23 nt, Artificial Sequence
  RNA Oligomer
caugcacauuuuuaccaucagua

SEQ ID NO: 52247 - RNA, 23 nt, Artificial Sequence
  RNA Oligomer
ucaugcacauuuuuaccaucagu

SEQ ID NO: 52248 - RNA, 23 nt, Artificial Sequence
  RNA Oligomer
acaccuugcucuaccuguacgag

SEQ ID NO: 52249 - RNA, 23 nt, Artificial Sequence
  RNA Oligomer
gacaccuugcucuaccuguacga

SEQ ID NO: 52250 - RNA, 23 nt, Artificial Sequence
  RNA Oligomer
ggacaccuugcucuaccuguacg

SEQ ID NO: 52251 - RNA, 23 nt, Artificial Sequence
  RNA Oligomer
gggacaccuugcucuaccuguac

SEQ ID NO: 52252 - RNA, 23 nt, Artificial Sequence
  RNA Oligomer
ugggacaccuugcucuaccugua

SEQ ID NO: 52253 - RNA, 23 nt, Artificial Sequence
  RNA Oligomer
acaucacuaucucccugauccag

SEQ ID NO: 52254 - RNA, 23 nt, Artificial Sequence
  RNA Oligomer
gacaucacuaucucccugaucca

SEQ ID NO: 52255 - RNA, 23 nt, Artificial Sequence
  RNA Oligomer
ggacaucacuaucucccugaucc

SEQ ID NO: 52256 - RNA, 23 nt, Artificial Sequence
  RNA Oligomer
cggacaucacuaucucccugauc

SEQ ID NO: 52257 - RNA, 23 nt, Artificial Sequence
  RNA Oligomer
ucggacaucacuaucucccugau

SEQ ID NO: 52258 - RNA, 23 nt, Artificial Sequence
  RNA Oligomer
cgacagcuaccacgugaaugccc

SEQ ID NO: 52259 - RNA, 23 nt, Artificial Sequence
  RNA Oligomer
gcgacagcuaccacgugaaugcc

SEQ ID NO: 52260 - RNA, 23 nt, Artificial Sequence
  RNA Oligomer
ggcgacagcuaccacgugaaugc

SEQ ID NO: 52261 - RNA, 23 nt, Artificial Sequence
  RNA Oligomer
gggcgacagcuaccacgugaaug

SEQ ID NO: 52262 - RNA, 23 nt, Artificial Sequence
  RNA Oligomer
cgggcgacagcuaccacgugaau

SEQ ID NO: 52263 - RNA, 23 nt, Artificial Sequence
  RNA Oligomer
ugaacauccucuccuacuucgcc

SEQ ID NO: 52264 - RNA, 23 nt, Artificial Sequence
  RNA Oligomer
cugaacauccucuccuacuucgc

SEQ ID NO: 52265 - RNA, 23 nt, Artificial Sequence
  RNA Oligomer
ccugaacauccucuccuacuucg

SEQ ID NO: 52266 - RNA, 23 nt, Artificial Sequence
  RNA Oligomer
ccaaggacaugaaguuugugucu

SEQ ID NO: 52267 - RNA, 23 nt, Artificial Sequence
  RNA Oligomer
gccaaggacaugaaguuuguguc

SEQ ID NO: 52268 - RNA, 23 nt, Artificial Sequence
  RNA Oligomer
ggccaaggacaugaaguuugugu

SEQ ID NO: 52269 - RNA, 23 nt, Artificial Sequence
  RNA Oligomer
aggccaaggacaugaaguuugug

SEQ ID NO: 52270 - RNA, 23 nt, Artificial Sequence
  RNA Oligomer
gaggccaaggacaugaaguuugu

SEQ ID NO: 52271 - RNA, 23 nt, Artificial Sequence
  RNA Oligomer
cagcugcacucaucuccaacaag

SEQ ID NO: 52272 - RNA, 23 nt, Artificial Sequence
  RNA Oligomer
acagcugcacucaucuccaacaa

SEQ ID NO: 52273 - RNA, 23 nt, Artificial Sequence
  RNA Oligomer
gacagcugcacucaucuccaaca

SEQ ID NO: 52274 - RNA, 23 nt, Artificial Sequence
  RNA Oligomer
ugacagcugcacucaucuccaac

SEQ ID NO: 52275 - RNA, 23 nt, Artificial Sequence
  RNA Oligomer
augacagcugcacucaucuccaa

SEQ ID NO: 52276 - RNA, 23 nt, Artificial Sequence
  RNA Oligomer
cccgcagugagaucuucauggau

SEQ ID NO: 52277 - RNA, 23 nt, Artificial Sequence
  RNA Oligomer
gcccgcagugagaucuucaugga

SEQ ID NO: 52278 - RNA, 23 nt, Artificial Sequence
  RNA Oligomer
ugcccgcagugagaucuucaugg

SEQ ID NO: 52279 - RNA, 23 nt, Artificial Sequence
  RNA Oligomer
uugcccgcagugagaucuucaug

SEQ ID NO: 52280 - RNA, 23 nt, Artificial Sequence
  RNA Oligomer
auugcccgcagugagaucuucau

SEQ ID NO: 52281 - RNA, 23 nt, Artificial Sequence
  RNA Oligomer
gcaacagcagccucuucaagagc

SEQ ID NO: 52282 - RNA, 23 nt, Artificial Sequence
  RNA Oligomer
agcaacagcagccucuucaagag

SEQ ID NO: 52283 - RNA, 23 nt, Artificial Sequence
  RNA Oligomer
cagcaacagcagccucuucaaga

SEQ ID NO: 52284 - RNA, 23 nt, Artificial Sequence
  RNA Oligomer
gcagcaacagcagccucuucaag

SEQ ID NO: 52285 - RNA, 23 nt, Artificial Sequence
  RNA Oligomer
cgcagcaacagcagccucuucaa

SEQ ID NO: 52286 - RNA, 23 nt, Artificial Sequence
  RNA Oligomer
ggaagagcauaaagaagaugcug

SEQ ID NO: 52287 - RNA, 23 nt, Artificial Sequence
  RNA Oligomer
aggaagagcauaaagaagaugcu

SEQ ID NO: 52288 - RNA, 23 nt, Artificial Sequence
  RNA Oligomer
caggaagagcauaaagaagaugc

SEQ ID NO: 52289 - RNA, 23 nt, Artificial Sequence
  RNA Oligomer
gcaggaagagcauaaagaagaug

SEQ ID NO: 52290 - RNA, 23 nt, Artificial Sequence
  RNA Oligomer
ugcaggaagagcauaaagaagau

SEQ ID NO: 52291 - RNA, 23 nt, Artificial Sequence
  RNA Oligomer
ccaugugucucuagaaccccagu

SEQ ID NO: 52292 - RNA, 23 nt, Artificial Sequence
  RNA Oligomer
cccaugugucucuagaaccccag

SEQ ID NO: 52293 - RNA, 23 nt, Artificial Sequence
  RNA Oligomer
ccccaugugucucuagaacccca

SEQ ID NO: 52294 - RNA, 23 nt, Artificial Sequence
  RNA Oligomer
accccaugugucucuagaacccc

SEQ ID NO: 52295 - RNA, 23 nt, Artificial Sequence
  RNA Oligomer
caccccaugugucucuagaaccc

SEQ ID NO: 52296 - RNA, 23 nt, Artificial Sequence
  RNA Oligomer
ucgaggacaucagcaauaagguu

SEQ ID NO: 52297 - RNA, 23 nt, Artificial Sequence
  RNA Oligomer
aucgaggacaucagcaauaaggu

SEQ ID NO: 52298 - RNA, 23 nt, Artificial Sequence
  RNA Oligomer
gaucgaggacaucagcaauaagg

SEQ ID NO: 52299 - RNA, 23 nt, Artificial Sequence
  RNA Oligomer
agaucgaggacaucagcaauaag

SEQ ID NO: 52300 - RNA, 23 nt, Artificial Sequence
  RNA Oligomer
aagaucgaggacaucagcaauaa

SEQ ID NO: 52301 - RNA, 23 nt, Artificial Sequence
  RNA Oligomer
cugcacucaucuccaacaagccu

SEQ ID NO: 52302 - RNA, 23 nt, Artificial Sequence
  RNA Oligomer
gcugcacucaucuccaacaagcc

SEQ ID NO: 52303 - RNA, 23 nt, Artificial Sequence
  RNA Oligomer
agcugcacucaucuccaacaagc

SEQ ID NO: 52304 - RNA, 23 nt, Artificial Sequence
  RNA Oligomer
gcagugagaucuucauggaugag

SEQ ID NO: 52305 - RNA, 23 nt, Artificial Sequence
  RNA Oligomer
cgcagugagaucuucauggauga

SEQ ID NO: 52306 - RNA, 23 nt, Artificial Sequence
  RNA Oligomer
ccgcagugagaucuucauggaug

SEQ ID NO: 52307 - RNA, 23 nt, Artificial Sequence
  RNA Oligomer
gcguguucuuccaggagauguuu

SEQ ID NO: 52308 - RNA, 23 nt, Artificial Sequence
  RNA Oligomer
agcguguucuuccaggagauguu

SEQ ID NO: 52309 - RNA, 23 nt, Artificial Sequence
  RNA Oligomer
gagcguguucuuccaggagaugu

SEQ ID NO: 52310 - RNA, 23 nt, Artificial Sequence
  RNA Oligomer
ugagcguguucuuccaggagaug

SEQ ID NO: 52311 - RNA, 23 nt, Artificial Sequence
  RNA Oligomer
cugagcguguucuuccaggagau

SEQ ID NO: 52312 - RNA, 23 nt, Artificial Sequence
  RNA Oligomer
cugucuucauuuuccuaaaccug

SEQ ID NO: 52313 - RNA, 23 nt, Artificial Sequence
  RNA Oligomer
ccugucuucauuuuccuaaaccu

SEQ ID NO: 52314 - RNA, 23 nt, Artificial Sequence
  RNA Oligomer
cccugucuucauuuuccuaaacc

SEQ ID NO: 52315 - RNA, 23 nt, Artificial Sequence
  RNA Oligomer
ucccugucuucauuuuccuaaac

SEQ ID NO: 52316 - RNA, 23 nt, Artificial Sequence
  RNA Oligomer
cucccugucuucauuuuccuaaa

SEQ ID NO: 52317 - RNA, 23 nt, Artificial Sequence
  RNA Oligomer
ccacgauccaguacaacguggug

SEQ ID NO: 52318 - RNA, 23 nt, Artificial Sequence
  RNA Oligomer
uccacgauccaguacaacguggu

SEQ ID NO: 52319 - RNA, 23 nt, Artificial Sequence
  RNA Oligomer
guccacgauccaguacaacgugg

SEQ ID NO: 52320 - RNA, 23 nt, Artificial Sequence
  RNA Oligomer
uguccacgauccaguacaacgug

SEQ ID NO: 52321 - RNA, 23 nt, Artificial Sequence
  RNA Oligomer
cuguccacgauccaguacaacgu

SEQ ID NO: 52322 - RNA, 23 nt, Artificial Sequence
  RNA Oligomer
ucgacggugugaacuucaacccg

SEQ ID NO: 52323 - RNA, 23 nt, Artificial Sequence
  RNA Oligomer
aucgacggugugaacuucaaccc

SEQ ID NO: 52324 - RNA, 23 nt, Artificial Sequence
  RNA Oligomer
caucgacggugugaacuucaacc

SEQ ID NO: 52325 - RNA, 23 nt, Artificial Sequence
  RNA Oligomer
acaucgacggugugaacuucaac

SEQ ID NO: 52326 - RNA, 23 nt, Artificial Sequence
  RNA Oligomer
uacaucgacggugugaacuucaa

SEQ ID NO: 52327 - RNA, 23 nt, Artificial Sequence
  RNA Oligomer
ggaugaugaaggacgucuucuuc

SEQ ID NO: 52328 - RNA, 23 nt, Artificial Sequence
  RNA Oligomer
cggaugaugaaggacgucuucuu

SEQ ID NO: 52329 - RNA, 23 nt, Artificial Sequence
  RNA Oligomer
gcggaugaugaaggacgucuucu

SEQ ID NO: 52330 - RNA, 23 nt, Artificial Sequence
  RNA Oligomer
agcggaugaugaaggacgucuuc

SEQ ID NO: 52331 - RNA, 23 nt, Artificial Sequence
  RNA Oligomer
aagcggaugaugaaggacgucuu

SEQ ID NO: 52332 - RNA, 23 nt, Artificial Sequence
  RNA Oligomer
cacauuuuuaccaucaguaagac

SEQ ID NO: 52333 - RNA, 23 nt, Artificial Sequence
  RNA Oligomer
gcaacaaugacaagcaagaaagc

SEQ ID NO: 52334 - RNA, 23 nt, Artificial Sequence
  RNA Oligomer
ggcaacaaugacaagcaagaaag

SEQ ID NO: 52335 - RNA, 23 nt, Artificial Sequence
  RNA Oligomer
cgaggacaucagcaauaagguug

SEQ ID NO: 52336 - RNA, 23 nt, Artificial Sequence
  RNA Oligomer
accuccucaucgccauguucaac

SEQ ID NO: 52337 - RNA, 23 nt, Artificial Sequence
  RNA Oligomer
aaccuccucaucgccauguucaa

SEQ ID NO: 52338 - RNA, 23 nt, Artificial Sequence
  RNA Oligomer
caaccuccucaucgccauguuca

SEQ ID NO: 52339 - RNA, 23 nt, Artificial Sequence
  RNA Oligomer
ucaaccuccucaucgccauguuc

SEQ ID NO: 52340 - RNA, 23 nt, Artificial Sequence
  RNA Oligomer
cucaaccuccucaucgccauguu

SEQ ID NO: 52341 - RNA, 23 nt, Artificial Sequence
  RNA Oligomer
ggggcccaagaucaucauuguga

SEQ ID NO: 52342 - RNA, 23 nt, Artificial Sequence
  RNA Oligomer
gaagaaagaaugcguguauuuug

SEQ ID NO: 52343 - RNA, 23 nt, Artificial Sequence
  RNA Oligomer
agaagaaagaaugcguguauuuu

SEQ ID NO: 52344 - RNA, 23 nt, Artificial Sequence
  RNA Oligomer
aagaagaaagaaugcguguauuu

SEQ ID NO: 52345 - RNA, 23 nt, Artificial Sequence
  RNA Oligomer
caagaagaaagaaugcguguauu

SEQ ID NO: 52346 - RNA, 23 nt, Artificial Sequence
  RNA Oligomer
ucaagaagaaagaaugcguguau

SEQ ID NO: 52347 - RNA, 23 nt, Artificial Sequence
  RNA Oligomer
cuuccaccugaacauccucuccu

SEQ ID NO: 52348 - RNA, 23 nt, Artificial Sequence
  RNA Oligomer
ggaggccaaggacaugaaguuug

SEQ ID NO: 52349 - RNA, 23 nt, Artificial Sequence
  RNA Oligomer
ggagauguuugagaccuucacgg

SEQ ID NO: 52350 - RNA, 23 nt, Artificial Sequence
  RNA Oligomer
aggagauguuugagaccuucacg

SEQ ID NO: 52351 - RNA, 23 nt, Artificial Sequence
  RNA Oligomer
caggagauguuugagaccuucac

SEQ ID NO: 52352 - RNA, 23 nt, Artificial Sequence
  RNA Oligomer
ccaggagauguuugagaccuuca

SEQ ID NO: 52353 - RNA, 23 nt, Artificial Sequence
  RNA Oligomer
uccaggagauguuugagaccuuc

SEQ ID NO: 52354 - RNA, 23 nt, Artificial Sequence
  RNA Oligomer
uuccaggagauguuugagaccuu

SEQ ID NO: 52355 - RNA, 23 nt, Artificial Sequence
  RNA Oligomer
gcaaccacucucacuucauccuc

SEQ ID NO: 52356 - RNA, 23 nt, Artificial Sequence
  RNA Oligomer
agcaaccacucucacuucauccu

SEQ ID NO: 52357 - RNA, 23 nt, Artificial Sequence
  RNA Oligomer
cagcaaccacucucacuucaucc

SEQ ID NO: 52358 - RNA, 23 nt, Artificial Sequence
  RNA Oligomer
acagcaaccacucucacuucauc

SEQ ID NO: 52359 - RNA, 23 nt, Artificial Sequence
  RNA Oligomer
gacagcaaccacucucacuucau

SEQ ID NO: 52360 - RNA, 23 nt, Artificial Sequence
  RNA Oligomer
agaaggugaaaaaguacguccga

SEQ ID NO: 52361 - RNA, 23 nt, Artificial Sequence
  RNA Oligomer
cagaaggugaaaaaguacguccg

SEQ ID NO: 52362 - RNA, 23 nt, Artificial Sequence
  RNA Oligomer
ccagaaggugaaaaaguacgucc

SEQ ID NO: 52363 - RNA, 23 nt, Artificial Sequence
  RNA Oligomer
gccagaaggugaaaaaguacguc

SEQ ID NO: 52364 - RNA, 23 nt, Artificial Sequence
  RNA Oligomer
agccagaaggugaaaaaguacgu

SEQ ID NO: 52365 - RNA, 23 nt, Artificial Sequence
  RNA Oligomer
ggccuaugucugugaggaagggg

SEQ ID NO: 52366 - RNA, 23 nt, Artificial Sequence
  RNA Oligomer
aggccuaugucugugaggaaggg

SEQ ID NO: 52367 - RNA, 23 nt, Artificial Sequence
  RNA Oligomer
caggccuaugucugugaggaagg

SEQ ID NO: 52368 - RNA, 23 nt, Artificial Sequence
  RNA Oligomer
ucaggccuaugucugugaggaag

SEQ ID NO: 52369 - RNA, 23 nt, Artificial Sequence
  RNA Oligomer
cucaggccuaugucugugaggaa

SEQ ID NO: 52370 - RNA, 23 nt, Artificial Sequence
  RNA Oligomer
cuuuugaaaacuugcugaagugc

SEQ ID NO: 52371 - RNA, 23 nt, Artificial Sequence
  RNA Oligomer
ucuuuugaaaacuugcugaagug

SEQ ID NO: 52372 - RNA, 23 nt, Artificial Sequence
  RNA Oligomer
gucuuuugaaaacuugcugaagu

SEQ ID NO: 52373 - RNA, 23 nt, Artificial Sequence
  RNA Oligomer
cgucuuuugaaaacuugcugaag

SEQ ID NO: 52374 - RNA, 23 nt, Artificial Sequence
  RNA Oligomer
ccgucuuuugaaaacuugcugaa

SEQ ID NO: 52375 - RNA, 23 nt, Artificial Sequence
  RNA Oligomer
cugcaggaagagcauaaagaaga

SEQ ID NO: 52376 - RNA, 23 nt, Artificial Sequence
  RNA Oligomer
ucugcaggaagagcauaaagaag

SEQ ID NO: 52377 - RNA, 23 nt, Artificial Sequence
  RNA Oligomer
aucugcaggaagagcauaaagaa

SEQ ID NO: 52378 - RNA, 23 nt, Artificial Sequence
  RNA Oligomer
ggacaucagcaauaagguugacg

SEQ ID NO: 52379 - RNA, 23 nt, Artificial Sequence
  RNA Oligomer
aggacaucagcaauaagguugac

SEQ ID NO: 52380 - RNA, 23 nt, Artificial Sequence
  RNA Oligomer
gaggacaucagcaauaagguuga

SEQ ID NO: 52381 - RNA, 23 nt, Artificial Sequence
  RNA Oligomer
gaggcacaagcagcucaagaaca

SEQ ID NO: 52382 - RNA, 23 nt, Artificial Sequence
  RNA Oligomer
agaggcacaagcagcucaagaac

SEQ ID NO: 52383 - RNA, 23 nt, Artificial Sequence
  RNA Oligomer
accugcagcucuucaucaagagg

SEQ ID NO: 52384 - RNA, 23 nt, Artificial Sequence
  RNA Oligomer
caccugcagcucuucaucaagag

SEQ ID NO: 52385 - RNA, 23 nt, Artificial Sequence
  RNA Oligomer
ccaccugcagcucuucaucaaga

SEQ ID NO: 52386 - RNA, 23 nt, Artificial Sequence
  RNA Oligomer
gccaccugcagcucuucaucaag

SEQ ID NO: 52387 - RNA, 23 nt, Artificial Sequence
  RNA Oligomer
agccaccugcagcucuucaucaa

SEQ ID NO: 52388 - RNA, 23 nt, Artificial Sequence
  RNA Oligomer
gcguguauuuuguggaaaguucc

SEQ ID NO: 52389 - RNA, 23 nt, Artificial Sequence
  RNA Oligomer
ugcguguauuuuguggaaaguuc

SEQ ID NO: 52390 - RNA, 23 nt, Artificial Sequence
  RNA Oligomer
augcguguauuuuguggaaaguu

SEQ ID NO: 52391 - RNA, 23 nt, Artificial Sequence
  RNA Oligomer
aaugcguguauuuuguggaaagu

SEQ ID NO: 52392 - RNA, 23 nt, Artificial Sequence
  RNA Oligomer
gaaugcguguauuuuguggaaag

SEQ ID NO: 52393 - RNA, 23 nt, Artificial Sequence
  RNA Oligomer
ucauugugaagcggaugaugaag

SEQ ID NO: 52394 - RNA, 23 nt, Artificial Sequence
  RNA Oligomer
aucauugugaagcggaugaugaa

SEQ ID NO: 52395 - RNA, 23 nt, Artificial Sequence
  RNA Oligomer
caucauugugaagcggaugauga

SEQ ID NO: 52396 - RNA, 23 nt, Artificial Sequence
  RNA Oligomer
ucaucauugugaagcggaugaug

SEQ ID NO: 52397 - RNA, 23 nt, Artificial Sequence
  RNA Oligomer
aucaucauugugaagcggaugau

SEQ ID NO: 52398 - RNA, 23 nt, Artificial Sequence
  RNA Oligomer
gaucaucauugugaagcggauga

SEQ ID NO: 52399 - RNA, 23 nt, Artificial Sequence
  RNA Oligomer
agaucaucauugugaagcggaug

SEQ ID NO: 52400 - RNA, 23 nt, Artificial Sequence
  RNA Oligomer
aagaucaucauugugaagcggau

SEQ ID NO: 52401 - RNA, 23 nt, Artificial Sequence
  RNA Oligomer
uggggcccaagaucaucauugug

SEQ ID NO: 52402 - RNA, 23 nt, Artificial Sequence
  RNA Oligomer
cuggggcccaagaucaucauugu

SEQ ID NO: 52403 - RNA, 23 nt, Artificial Sequence
  RNA Oligomer
cgaagagagagcccagaaacugc

SEQ ID NO: 52404 - RNA, 23 nt, Artificial Sequence
  RNA Oligomer
acgaagagagagcccagaaacug

SEQ ID NO: 52405 - RNA, 23 nt, Artificial Sequence
  RNA Oligomer
gacgaagagagagcccagaaacu

SEQ ID NO: 52406 - RNA, 23 nt, Artificial Sequence
  RNA Oligomer
ggacgaagagagagcccagaaac

SEQ ID NO: 52407 - RNA, 23 nt, Artificial Sequence
  RNA Oligomer
aggacgaagagagagcccagaaa

SEQ ID NO: 52408 - RNA, 23 nt, Artificial Sequence
  RNA Oligomer
gcagaccaaggaaagaggaggug

SEQ ID NO: 52409 - RNA, 23 nt, Artificial Sequence
  RNA Oligomer
agcagaccaaggaaagaggaggu

SEQ ID NO: 52410 - RNA, 23 nt, Artificial Sequence
  RNA Oligomer
gagcagaccaaggaaagaggagg

SEQ ID NO: 52411 - RNA, 23 nt, Artificial Sequence
  RNA Oligomer
ggagcagaccaaggaaagaggag

SEQ ID NO: 52412 - RNA, 23 nt, Artificial Sequence
  RNA Oligomer
cggagcagaccaaggaaagagga

SEQ ID NO: 52413 - RNA, 23 nt, Artificial Sequence
  RNA Oligomer
ucggagcagaccaaggaaagagg

SEQ ID NO: 52414 - RNA, 23 nt, Artificial Sequence
  RNA Oligomer
aucggagcagaccaaggaaagag

SEQ ID NO: 52415 - RNA, 23 nt, Artificial Sequence
  RNA Oligomer
uaucggagcagaccaaggaaaga

SEQ ID NO: 52416 - RNA, 23 nt, Artificial Sequence
  RNA Oligomer
ugaacaggcugaacucuaaccug

SEQ ID NO: 52417 - RNA, 23 nt, Artificial Sequence
  RNA Oligomer
cugaacaggcugaacucuaaccu

SEQ ID NO: 52418 - RNA, 23 nt, Artificial Sequence
  RNA Oligomer
gcugaacaggcugaacucuaacc

SEQ ID NO: 52419 - RNA, 23 nt, Artificial Sequence
  RNA Oligomer
agcugaacaggcugaacucuaac

SEQ ID NO: 52420 - RNA, 23 nt, Artificial Sequence
  RNA Oligomer
gagcugaacaggcugaacucuaa

SEQ ID NO: 52421 - RNA, 23 nt, Artificial Sequence
  RNA Oligomer
acuguccacgauccaguacaacg

SEQ ID NO: 52422 - RNA, 23 nt, Artificial Sequence
  RNA Oligomer
cacuguccacgauccaguacaac

SEQ ID NO: 52423 - RNA, 23 nt, Artificial Sequence
  RNA Oligomer
ccacuguccacgauccaguacaa

SEQ ID NO: 52424 - RNA, 23 nt, Artificial Sequence
  RNA Oligomer
gaagaucgaggacaucagcaaua

SEQ ID NO: 52425 - RNA, 23 nt, Artificial Sequence
  RNA Oligomer
agaagaucgaggacaucagcaau

SEQ ID NO: 52426 - RNA, 23 nt, Artificial Sequence
  RNA Oligomer
cagaagaucgaggacaucagcaa

SEQ ID NO: 52427 - RNA, 23 nt, Artificial Sequence
  RNA Oligomer
ccgacaguuccagcaaaagcagc

SEQ ID NO: 52428 - RNA, 23 nt, Artificial Sequence
  RNA Oligomer
accgacaguuccagcaaaagcag

SEQ ID NO: 52429 - RNA, 23 nt, Artificial Sequence
  RNA Oligomer
aaccgacaguuccagcaaaagca

SEQ ID NO: 52430 - RNA, 23 nt, Artificial Sequence
  RNA Oligomer
gaaccgacaguuccagcaaaagc

SEQ ID NO: 52431 - RNA, 23 nt, Artificial Sequence
  RNA Oligomer
agaaccgacaguuccagcaaaag

SEQ ID NO: 52432 - RNA, 23 nt, Artificial Sequence
  RNA Oligomer
cgacggugugaacuucaacccgg

SEQ ID NO: 52433 - RNA, 23 nt, Artificial Sequence
  RNA Oligomer
cuacaucgacggugugaacuuca

SEQ ID NO: 52434 - RNA, 23 nt, Artificial Sequence
  RNA Oligomer
gcuacaucgacggugugaacuuc

SEQ ID NO: 52435 - RNA, 23 nt, Artificial Sequence
  RNA Oligomer
ggcuacaucgacggugugaacuu

SEQ ID NO: 52436 - RNA, 23 nt, Artificial Sequence
  RNA Oligomer
ugaagcggaugaugaaggacguc

SEQ ID NO: 52437 - RNA, 23 nt, Artificial Sequence
  RNA Oligomer
gugaagcggaugaugaaggacgu

SEQ ID NO: 52438 - RNA, 23 nt, Artificial Sequence
  RNA Oligomer
ugugaagcggaugaugaaggacg

SEQ ID NO: 52439 - RNA, 23 nt, Artificial Sequence
  RNA Oligomer
uugugaagcggaugaugaaggac

SEQ ID NO: 52440 - RNA, 23 nt, Artificial Sequence
  RNA Oligomer
auugugaagcggaugaugaagga

SEQ ID NO: 52441 - RNA, 23 nt, Artificial Sequence
  RNA Oligomer
gccuuguacuucagugacuucug

SEQ ID NO: 52442 - RNA, 23 nt, Artificial Sequence
  RNA Oligomer
agccuuguacuucagugacuucu

SEQ ID NO: 52443 - RNA, 23 nt, Artificial Sequence
  RNA Oligomer
cagccuuguacuucagugacuuc

SEQ ID NO: 52444 - RNA, 23 nt, Artificial Sequence
  RNA Oligomer
gcagccuuguacuucagugacuu

SEQ ID NO: 52445 - RNA, 23 nt, Artificial Sequence
  RNA Oligomer
ggcagccuuguacuucagugacu

SEQ ID NO: 52446 - RNA, 23 nt, Artificial Sequence
  RNA Oligomer
uggaggccaaggacaugaaguuu

SEQ ID NO: 52447 - RNA, 23 nt, Artificial Sequence
  RNA Oligomer
cuggaggccaaggacaugaaguu

SEQ ID NO: 52448 - RNA, 23 nt, Artificial Sequence
  RNA Oligomer
ccauccgugaccuucucauuugg

SEQ ID NO: 52449 - RNA, 23 nt, Artificial Sequence
  RNA Oligomer
cccauccgugaccuucucauuug

SEQ ID NO: 52450 - RNA, 23 nt, Artificial Sequence
  RNA Oligomer
ccccauccgugaccuucucauuu

SEQ ID NO: 52451 - RNA, 23 nt, Artificial Sequence
  RNA Oligomer
accccauccgugaccuucucauu

SEQ ID NO: 52452 - RNA, 23 nt, Artificial Sequence
  RNA Oligomer
gaccccauccgugaccuucucau

SEQ ID NO: 52453 - RNA, 23 nt, Artificial Sequence
  RNA Oligomer
cguggauuccugaaaacaucaag

SEQ ID NO: 52454 - RNA, 23 nt, Artificial Sequence
  RNA Oligomer
ucguggauuccugaaaacaucaa

SEQ ID NO: 52455 - RNA, 23 nt, Artificial Sequence
  RNA Oligomer
uucguggauuccugaaaacauca

SEQ ID NO: 52456 - RNA, 23 nt, Artificial Sequence
  RNA Oligomer
guucguggauuccugaaaacauc

SEQ ID NO: 52457 - RNA, 23 nt, Artificial Sequence
  RNA Oligomer
aguucguggauuccugaaaacau

SEQ ID NO: 52458 - RNA, 23 nt, Artificial Sequence
  RNA Oligomer
caguucguggauuccugaaaaca

SEQ ID NO: 52459 - RNA, 23 nt, Artificial Sequence
  RNA Oligomer
ucaguucguggauuccugaaaac

SEQ ID NO: 52460 - RNA, 23 nt, Artificial Sequence
  RNA Oligomer
cucaguucguggauuccugaaaa

SEQ ID NO: 52461 - RNA, 23 nt, Artificial Sequence
  RNA Oligomer
gugagaucuucauggaugagugg

SEQ ID NO: 52462 - RNA, 23 nt, Artificial Sequence
  RNA Oligomer
agugagaucuucauggaugagug

SEQ ID NO: 52463 - RNA, 23 nt, Artificial Sequence
  RNA Oligomer
cagugagaucuucauggaugagu

SEQ ID NO: 52464 - RNA, 23 nt, Artificial Sequence
  RNA Oligomer
cuaucucccugauccagcagaaa

SEQ ID NO: 52465 - RNA, 23 nt, Artificial Sequence
  RNA Oligomer
acuaucucccugauccagcagaa

SEQ ID NO: 52466 - RNA, 23 nt, Artificial Sequence
  RNA Oligomer
cacuaucucccugauccagcaga

SEQ ID NO: 52467 - RNA, 23 nt, Artificial Sequence
  RNA Oligomer
ucacuaucucccugauccagcag

SEQ ID NO: 52468 - RNA, 23 nt, Artificial Sequence
  RNA Oligomer
aucacuaucucccugauccagca

SEQ ID NO: 52469 - RNA, 23 nt, Artificial Sequence
  RNA Oligomer
cgaguacauacuggaugaggaug

SEQ ID NO: 52470 - RNA, 23 nt, Artificial Sequence
  RNA Oligomer
ccgaguacauacuggaugaggau

SEQ ID NO: 52471 - RNA, 23 nt, Artificial Sequence
  RNA Oligomer
gccgaguacauacuggaugagga

SEQ ID NO: 52472 - RNA, 23 nt, Artificial Sequence
  RNA Oligomer
cgccgaguacauacuggaugagg

SEQ ID NO: 52473 - RNA, 23 nt, Artificial Sequence
  RNA Oligomer
ccgccgaguacauacuggaugag

SEQ ID NO: 52474 - RNA, 23 nt, Artificial Sequence
  RNA Oligomer
cccuucggcaacaaugacaagca

SEQ ID NO: 52475 - RNA, 23 nt, Artificial Sequence
  RNA Oligomer
ugaaaaaguacguccgagucucc

SEQ ID NO: 52476 - RNA, 23 nt, Artificial Sequence
  RNA Oligomer
gugaaaaaguacguccgagucuc

SEQ ID NO: 52477 - RNA, 23 nt, Artificial Sequence
  RNA Oligomer
ggugaaaaaguacguccgagucu

SEQ ID NO: 52478 - RNA, 23 nt, Artificial Sequence
  RNA Oligomer
aggugaaaaaguacguccgaguc

SEQ ID NO: 52479 - RNA, 23 nt, Artificial Sequence
  RNA Oligomer
aaggugaaaaaguacguccgagu

SEQ ID NO: 52480 - RNA, 23 nt, Artificial Sequence
  RNA Oligomer
gaaggugaaaaaguacguccgag

SEQ ID NO: 52481 - RNA, 23 nt, Artificial Sequence
  RNA Oligomer
agcucccugucuucauuuuccua

SEQ ID NO: 52482 - RNA, 23 nt, Artificial Sequence
  RNA Oligomer
cagcucccugucuucauuuuccu

SEQ ID NO: 52483 - RNA, 23 nt, Artificial Sequence
  RNA Oligomer
ucagcucccugucuucauuuucc

SEQ ID NO: 52484 - RNA, 23 nt, Artificial Sequence
  RNA Oligomer
aucagcucccugucuucauuuuc

SEQ ID NO: 52485 - RNA, 23 nt, Artificial Sequence
  RNA Oligomer
caucagcucccugucuucauuuu

SEQ ID NO: 52486 - RNA, 23 nt, Artificial Sequence
  RNA Oligomer
gccuaugucugugaggaaggggc

SEQ ID NO: 52487 - RNA, 23 nt, Artificial Sequence
  RNA Oligomer
augaccucaugaacuggaagggg

SEQ ID NO: 52488 - RNA, 23 nt, Artificial Sequence
  RNA Oligomer
gaugaccucaugaacuggaaggg

SEQ ID NO: 52489 - RNA, 23 nt, Artificial Sequence
  RNA Oligomer
agaugaccucaugaacuggaagg

SEQ ID NO: 52490 - RNA, 23 nt, Artificial Sequence
  RNA Oligomer
cagaugaccucaugaacuggaag

SEQ ID NO: 52491 - RNA, 23 nt, Artificial Sequence
  RNA Oligomer
gcagaugaccucaugaacuggaa

SEQ ID NO: 52492 - RNA, 23 nt, Artificial Sequence
  RNA Oligomer
cugcagaugaccucaugaacugg

SEQ ID NO: 52493 - RNA, 23 nt, Artificial Sequence
  RNA Oligomer
gcugcagaugaccucaugaacug

SEQ ID NO: 52494 - RNA, 23 nt, Artificial Sequence
  RNA Oligomer
ugcugcagaugaccucaugaacu

SEQ ID NO: 52495 - RNA, 23 nt, Artificial Sequence
  RNA Oligomer
cugcugcagaugaccucaugaac

SEQ ID NO: 52496 - RNA, 23 nt, Artificial Sequence
  RNA Oligomer
ucugcugcagaugaccucaugaa

SEQ ID NO: 52497 - RNA, 23 nt, Artificial Sequence
  RNA Oligomer
agaaugacguggagcugaacagg

SEQ ID NO: 52498 - RNA, 23 nt, Artificial Sequence
  RNA Oligomer
cagaaugacguggagcugaacag

SEQ ID NO: 52499 - RNA, 23 nt, Artificial Sequence
  RNA Oligomer
ccagaaugacguggagcugaaca

SEQ ID NO: 52500 - RNA, 23 nt, Artificial Sequence
  RNA Oligomer
accagaaugacguggagcugaac

SEQ ID NO: 52501 - RNA, 23 nt, Artificial Sequence
  RNA Oligomer
gaccagaaugacguggagcugaa

SEQ ID NO: 52502 - RNA, 23 nt, Artificial Sequence
  RNA Oligomer
ggaguuccugaucuaugacccac

SEQ ID NO: 52503 - RNA, 23 nt, Artificial Sequence
  RNA Oligomer
cggaguuccugaucuaugaccca

SEQ ID NO: 52504 - RNA, 23 nt, Artificial Sequence
  RNA Oligomer
acggaguuccugaucuaugaccc

SEQ ID NO: 52505 - RNA, 23 nt, Artificial Sequence
  RNA Oligomer
gacggaguuccugaucuaugacc

SEQ ID NO: 52506 - RNA, 23 nt, Artificial Sequence
  RNA Oligomer
agacggaguuccugaucuaugac

SEQ ID NO: 52507 - RNA, 23 nt, Artificial Sequence
  RNA Oligomer
uccucaucgccauguucaacuac

SEQ ID NO: 52508 - RNA, 23 nt, Artificial Sequence
  RNA Oligomer
cuccucaucgccauguucaacua

SEQ ID NO: 52509 - RNA, 23 nt, Artificial Sequence
  RNA Oligomer
ccuccucaucgccauguucaacu

SEQ ID NO: 52510 - RNA, 23 nt, Artificial Sequence
  RNA Oligomer
gggcuacaucgacggugugaacu

SEQ ID NO: 52511 - RNA, 23 nt, Artificial Sequence
  RNA Oligomer
cgggcuacaucgacggugugaac

SEQ ID NO: 52512 - RNA, 23 nt, Artificial Sequence
  RNA Oligomer
ccgggcuacaucgacggugugaa

SEQ ID NO: 52513 - RNA, 23 nt, Artificial Sequence
  RNA Oligomer
agaaugcguguauuuuguggaaa

SEQ ID NO: 52514 - RNA, 23 nt, Artificial Sequence
  RNA Oligomer
caagaucaucauugugaagcgga

SEQ ID NO: 52515 - RNA, 23 nt, Artificial Sequence
  RNA Oligomer
aucaagaagaaagaaugcgugua

SEQ ID NO: 52516 - RNA, 23 nt, Artificial Sequence
  RNA Oligomer
ccuggaggccaaggacaugaagu

SEQ ID NO: 52517 - RNA, 23 nt, Artificial Sequence
  RNA Oligomer
cccuggaggccaaggacaugaag

SEQ ID NO: 52518 - RNA, 23 nt, Artificial Sequence
  RNA Oligomer
gcccuggaggccaaggacaugaa

SEQ ID NO: 52519 - RNA, 23 nt, Artificial Sequence
  RNA Oligomer
ccuucucauuugggccauugucc

SEQ ID NO: 52520 - RNA, 23 nt, Artificial Sequence
  RNA Oligomer
accuucucauuugggccauuguc

SEQ ID NO: 52521 - RNA, 23 nt, Artificial Sequence
  RNA Oligomer
gaccuucucauuugggccauugu

SEQ ID NO: 52522 - RNA, 23 nt, Artificial Sequence
  RNA Oligomer
ugaccuucucauuugggccauug

SEQ ID NO: 52523 - RNA, 23 nt, Artificial Sequence
  RNA Oligomer
gugaccuucucauuugggccauu

SEQ ID NO: 52524 - RNA, 23 nt, Artificial Sequence
  RNA Oligomer
ccuugcucuaccuguacgagaac

SEQ ID NO: 52525 - RNA, 23 nt, Artificial Sequence
  RNA Oligomer
accuugcucuaccuguacgagaa

SEQ ID NO: 52526 - RNA, 23 nt, Artificial Sequence
  RNA Oligomer
caccuugcucuaccuguacgaga

SEQ ID NO: 52527 - RNA, 23 nt, Artificial Sequence
  RNA Oligomer
gcaguggaagccuucagaucugc

SEQ ID NO: 52528 - RNA, 23 nt, Artificial Sequence
  RNA Oligomer
ggcaguggaagccuucagaucug

SEQ ID NO: 52529 - RNA, 23 nt, Artificial Sequence
  RNA Oligomer
uggcaguggaagccuucagaucu

SEQ ID NO: 52530 - RNA, 23 nt, Artificial Sequence
  RNA Oligomer
guggcaguggaagccuucagauc

SEQ ID NO: 52531 - RNA, 23 nt, Artificial Sequence
  RNA Oligomer
aguggcaguggaagccuucagau

SEQ ID NO: 52532 - RNA, 23 nt, Artificial Sequence
  RNA Oligomer
ccaaaaagauccaagauaucguc

SEQ ID NO: 52533 - RNA, 23 nt, Artificial Sequence
  RNA Oligomer
accaaaaagauccaagauaucgu

SEQ ID NO: 52534 - RNA, 23 nt, Artificial Sequence
  RNA Oligomer
gaccaaaaagauccaagauaucg

SEQ ID NO: 52535 - RNA, 23 nt, Artificial Sequence
  RNA Oligomer
ggaccaaaaagauccaagauauc

SEQ ID NO: 52536 - RNA, 23 nt, Artificial Sequence
  RNA Oligomer
uggaccaaaaagauccaagauau

SEQ ID NO: 52537 - RNA, 23 nt, Artificial Sequence
  RNA Oligomer
gucgaguggaccaaaaagaucca

SEQ ID NO: 52538 - RNA, 23 nt, Artificial Sequence
  RNA Oligomer
ugucgaguggaccaaaaagaucc

SEQ ID NO: 52539 - RNA, 23 nt, Artificial Sequence
  RNA Oligomer
uugucgaguggaccaaaaagauc

SEQ ID NO: 52540 - RNA, 23 nt, Artificial Sequence
  RNA Oligomer
auugucgaguggaccaaaaagau

SEQ ID NO: 52541 - RNA, 23 nt, Artificial Sequence
  RNA Oligomer
gauugucgaguggaccaaaaaga

SEQ ID NO: 52542 - RNA, 23 nt, Artificial Sequence
  RNA Oligomer
cuucacggaaagcaggauugucg

SEQ ID NO: 52543 - RNA, 23 nt, Artificial Sequence
  RNA Oligomer
ccuucacggaaagcaggauuguc

SEQ ID NO: 52544 - RNA, 23 nt, Artificial Sequence
  RNA Oligomer
accuucacggaaagcaggauugu

SEQ ID NO: 52545 - RNA, 23 nt, Artificial Sequence
  RNA Oligomer
gaccuucacggaaagcaggauug

SEQ ID NO: 52546 - RNA, 23 nt, Artificial Sequence
  RNA Oligomer
agaccuucacggaaagcaggauu

SEQ ID NO: 52547 - RNA, 23 nt, Artificial Sequence
  RNA Oligomer
cguugcacaccaucgacaacgcc

SEQ ID NO: 52548 - RNA, 23 nt, Artificial Sequence
  RNA Oligomer
acguugcacaccaucgacaacgc

SEQ ID NO: 52549 - RNA, 23 nt, Artificial Sequence
  RNA Oligomer
cacguugcacaccaucgacaacg

SEQ ID NO: 52550 - RNA, 23 nt, Artificial Sequence
  RNA Oligomer
gcacguugcacaccaucgacaac

SEQ ID NO: 52551 - RNA, 23 nt, Artificial Sequence
  RNA Oligomer
ggcacguugcacaccaucgacaa

SEQ ID NO: 52552 - RNA, 23 nt, Artificial Sequence
  RNA Oligomer
caaggaaagaggagguguggcca

SEQ ID NO: 52553 - RNA, 23 nt, Artificial Sequence
  RNA Oligomer
ccaaggaaagaggagguguggcc

SEQ ID NO: 52554 - RNA, 23 nt, Artificial Sequence
  RNA Oligomer
accaaggaaagaggagguguggc

SEQ ID NO: 52555 - RNA, 23 nt, Artificial Sequence
  RNA Oligomer
gaccaaggaaagaggaggugugg

SEQ ID NO: 52556 - RNA, 23 nt, Artificial Sequence
  RNA Oligomer
agaccaaggaaagaggaggugug

SEQ ID NO: 52557 - RNA, 23 nt, Artificial Sequence
  RNA Oligomer
ccaagaacuucaacaugaagccg

SEQ ID NO: 52558 - RNA, 23 nt, Artificial Sequence
  RNA Oligomer
gccaagaacuucaacaugaagcc

SEQ ID NO: 52559 - RNA, 23 nt, Artificial Sequence
  RNA Oligomer
ggccaagaacuucaacaugaagc

SEQ ID NO: 52560 - RNA, 23 nt, Artificial Sequence
  RNA Oligomer
gggccaagaacuucaacaugaag

SEQ ID NO: 52561 - RNA, 23 nt, Artificial Sequence
  RNA Oligomer
ggggccaagaacuucaacaugaa

SEQ ID NO: 52562 - RNA, 23 nt, Artificial Sequence
  RNA Oligomer
ugucuucauuuuccuaaaccugg

SEQ ID NO: 52563 - RNA, 23 nt, Artificial Sequence
  RNA Oligomer
gcugaacucuaaccugcacgccu

SEQ ID NO: 52564 - RNA, 23 nt, Artificial Sequence
  RNA Oligomer
ggcugaacucuaaccugcacgcc

SEQ ID NO: 52565 - RNA, 23 nt, Artificial Sequence
  RNA Oligomer
aggcugaacucuaaccugcacgc

SEQ ID NO: 52566 - RNA, 23 nt, Artificial Sequence
  RNA Oligomer
caggcugaacucuaaccugcacg

SEQ ID NO: 52567 - RNA, 23 nt, Artificial Sequence
  RNA Oligomer
acaggcugaacucuaaccugcac

SEQ ID NO: 52568 - RNA, 23 nt, Artificial Sequence
  RNA Oligomer
gccgucuuuugaaaacuugcuga

SEQ ID NO: 52569 - RNA, 23 nt, Artificial Sequence
  RNA Oligomer
ggccgucuuuugaaaacuugcug

SEQ ID NO: 52570 - RNA, 23 nt, Artificial Sequence
  RNA Oligomer
acaucagcaauaagguugacgcc

SEQ ID NO: 52571 - RNA, 23 nt, Artificial Sequence
  RNA Oligomer
gacaucagcaauaagguugacgc

SEQ ID NO: 52572 - RNA, 23 nt, Artificial Sequence
  RNA Oligomer
acaagcuggagaagaacgaggag

SEQ ID NO: 52573 - RNA, 23 nt, Artificial Sequence
  RNA Oligomer
aacaagcuggagaagaacgagga

SEQ ID NO: 52574 - RNA, 23 nt, Artificial Sequence
  RNA Oligomer
gaacaagcuggagaagaacgagg

SEQ ID NO: 52575 - RNA, 23 nt, Artificial Sequence
  RNA Oligomer
agaacaagcuggagaagaacgag

SEQ ID NO: 52576 - RNA, 23 nt, Artificial Sequence
  RNA Oligomer
aagaacaagcuggagaagaacga

SEQ ID NO: 52577 - RNA, 23 nt, Artificial Sequence
  RNA Oligomer
cguguauuuuguggaaaguucca

SEQ ID NO: 52578 - RNA, 23 nt, Artificial Sequence
  RNA Oligomer
gaagcggaugaugaaggacgucu

SEQ ID NO: 52579 - RNA, 23 nt, Artificial Sequence
  RNA Oligomer
gcuggggcccaagaucaucauug

SEQ ID NO: 52580 - RNA, 23 nt, Artificial Sequence
  RNA Oligomer
agaaagaaugcguguauuuugug

SEQ ID NO: 52581 - RNA, 23 nt, Artificial Sequence
  RNA Oligomer
aagaaagaaugcguguauuuugu

SEQ ID NO: 52582 - RNA, 23 nt, Artificial Sequence
  RNA Oligomer
ccuuguacuucagugacuucugg

SEQ ID NO: 52583 - RNA, 23 nt, Artificial Sequence
  RNA Oligomer
ggaggaguaugagcacagagcca

SEQ ID NO: 52584 - RNA, 23 nt, Artificial Sequence
  RNA Oligomer
cggaggaguaugagcacagagcc

SEQ ID NO: 52585 - RNA, 23 nt, Artificial Sequence
  RNA Oligomer
gcggaggaguaugagcacagagc

SEQ ID NO: 52586 - RNA, 23 nt, Artificial Sequence
  RNA Oligomer
ggcggaggaguaugagcacagag

SEQ ID NO: 52587 - RNA, 23 nt, Artificial Sequence
  RNA Oligomer
uggcggaggaguaugagcacaga

SEQ ID NO: 52588 - RNA, 23 nt, Artificial Sequence
  RNA Oligomer
guggauuccugaaaacaucaaga

SEQ ID NO: 52589 - RNA, 23 nt, Artificial Sequence
  RNA Oligomer
ccaacaagccugaguuugugaag

SEQ ID NO: 52590 - RNA, 23 nt, Artificial Sequence
  RNA Oligomer
uccaacaagccugaguuugugaa

SEQ ID NO: 52591 - RNA, 23 nt, Artificial Sequence
  RNA Oligomer
cuccaacaagccugaguuuguga

SEQ ID NO: 52592 - RNA, 23 nt, Artificial Sequence
  RNA Oligomer
ucuccaacaagccugaguuugug

SEQ ID NO: 52593 - RNA, 23 nt, Artificial Sequence
  RNA Oligomer
aucuccaacaagccugaguuugu

SEQ ID NO: 52594 - RNA, 23 nt, Artificial Sequence
  RNA Oligomer
agccucaguucguggauuccuga

SEQ ID NO: 52595 - RNA, 23 nt, Artificial Sequence
  RNA Oligomer
aagccucaguucguggauuccug

SEQ ID NO: 52596 - RNA, 23 nt, Artificial Sequence
  RNA Oligomer
aaagccucaguucguggauuccu

SEQ ID NO: 52597 - RNA, 23 nt, Artificial Sequence
  RNA Oligomer
gaaagccucaguucguggauucc

SEQ ID NO: 52598 - RNA, 23 nt, Artificial Sequence
  RNA Oligomer
agaaagccucaguucguggauuc

SEQ ID NO: 52599 - RNA, 23 nt, Artificial Sequence
  RNA Oligomer
ucgaguggaccaaaaagauccaa

SEQ ID NO: 52600 - RNA, 23 nt, Artificial Sequence
  RNA Oligomer
cagaccaaggaaagaggaggugu

SEQ ID NO: 52601 - RNA, 23 nt, Artificial Sequence
  RNA Oligomer
ccaggcuggagaaguucauaucg

SEQ ID NO: 52602 - RNA, 23 nt, Artificial Sequence
  RNA Oligomer
accaggcuggagaaguucauauc

SEQ ID NO: 52603 - RNA, 23 nt, Artificial Sequence
  RNA Oligomer
gaccaggcuggagaaguucauau

SEQ ID NO: 52604 - RNA, 23 nt, Artificial Sequence
  RNA Oligomer
ggaccaggcuggagaaguucaua

SEQ ID NO: 52605 - RNA, 23 nt, Artificial Sequence
  RNA Oligomer
aggaccaggcuggagaaguucau

SEQ ID NO: 52606 - RNA, 23 nt, Artificial Sequence
  RNA Oligomer
caaccacucucacuucauccucg

SEQ ID NO: 52607 - RNA, 23 nt, Artificial Sequence
  RNA Oligomer
caacaaugacaagcaagaaagcc

SEQ ID NO: 52608 - RNA, 23 nt, Artificial Sequence
  RNA Oligomer
ucuucauuuuccuaaaccugggc

SEQ ID NO: 52609 - RNA, 23 nt, Artificial Sequence
  RNA Oligomer
gucuucauuuuccuaaaccuggg

SEQ ID NO: 52610 - RNA, 23 nt, Artificial Sequence
  RNA Oligomer
agaaacauguccaggagaugcca

SEQ ID NO: 52611 - RNA, 23 nt, Artificial Sequence
  RNA Oligomer
aagaaacauguccaggagaugcc

SEQ ID NO: 52612 - RNA, 23 nt, Artificial Sequence
  RNA Oligomer
aaagaaacauguccaggagaugc

SEQ ID NO: 52613 - RNA, 23 nt, Artificial Sequence
  RNA Oligomer
caaagaaacauguccaggagaug

SEQ ID NO: 52614 - RNA, 23 nt, Artificial Sequence
  RNA Oligomer
ccaaagaaacauguccaggagau

SEQ ID NO: 52615 - RNA, 23 nt, Artificial Sequence
  RNA Oligomer
ccuucugguuuggugucaacagc

SEQ ID NO: 52616 - RNA, 23 nt, Artificial Sequence
  RNA Oligomer
gccuucugguuuggugucaacag

SEQ ID NO: 52617 - RNA, 23 nt, Artificial Sequence
  RNA Oligomer
ggccuucugguuuggugucaaca

SEQ ID NO: 52618 - RNA, 23 nt, Artificial Sequence
  RNA Oligomer
gggccuucugguuuggugucaac

SEQ ID NO: 52619 - RNA, 23 nt, Artificial Sequence
  RNA Oligomer
ggggccuucugguuuggugucaa

SEQ ID NO: 52620 - RNA, 23 nt, Artificial Sequence
  RNA Oligomer
gacaaugccuggaucgagacggu

SEQ ID NO: 52621 - RNA, 23 nt, Artificial Sequence
  RNA Oligomer
ggacaaugccuggaucgagacgg

SEQ ID NO: 52622 - RNA, 23 nt, Artificial Sequence
  RNA Oligomer
cggacaaugccuggaucgagacg

SEQ ID NO: 52623 - RNA, 23 nt, Artificial Sequence
  RNA Oligomer
acggacaaugccuggaucgagac

SEQ ID NO: 52624 - RNA, 23 nt, Artificial Sequence
  RNA Oligomer
cacggacaaugccuggaucgaga

SEQ ID NO: 52625 - RNA, 23 nt, Artificial Sequence
  RNA Oligomer
acaaaggcuacauggaugacccg

SEQ ID NO: 52626 - RNA, 23 nt, Artificial Sequence
  RNA Oligomer
uacaaaggcuacauggaugaccc

SEQ ID NO: 52627 - RNA, 23 nt, Artificial Sequence
  RNA Oligomer
guacaaaggcuacauggaugacc

SEQ ID NO: 52628 - RNA, 23 nt, Artificial Sequence
  RNA Oligomer
uguacaaaggcuacauggaugac

SEQ ID NO: 52629 - RNA, 23 nt, Artificial Sequence
  RNA Oligomer
guguacaaaggcuacauggauga

SEQ ID NO: 52630 - RNA, 23 nt, Artificial Sequence
  RNA Oligomer
gguguacaaaggcuacauggaug

SEQ ID NO: 52631 - RNA, 23 nt, Artificial Sequence
  RNA Oligomer
agguguacaaaggcuacauggau

SEQ ID NO: 52632 - RNA, 23 nt, Artificial Sequence
  RNA Oligomer
uggagguguacaaaggcuacaug

SEQ ID NO: 52633 - RNA, 23 nt, Artificial Sequence
  RNA Oligomer
auggagguguacaaaggcuacau

SEQ ID NO: 52634 - RNA, 23 nt, Artificial Sequence
  RNA Oligomer
cauggagguguacaaaggcuaca

SEQ ID NO: 52635 - RNA, 23 nt, Artificial Sequence
  RNA Oligomer
gcauggagguguacaaaggcuac

SEQ ID NO: 52636 - RNA, 23 nt, Artificial Sequence
  RNA Oligomer
ggcauggagguguacaaaggcua

SEQ ID NO: 52637 - RNA, 23 nt, Artificial Sequence
  RNA Oligomer
cggcauggagguguacaaaggcu

SEQ ID NO: 52638 - RNA, 23 nt, Artificial Sequence
  RNA Oligomer
gcggcauggagguguacaaaggc

SEQ ID NO: 52639 - RNA, 23 nt, Artificial Sequence
  RNA Oligomer
ugcggcauggagguguacaaagg

SEQ ID NO: 52640 - RNA, 23 nt, Artificial Sequence
  RNA Oligomer
gugcggcauggagguguacaaag

SEQ ID NO: 52641 - RNA, 23 nt, Artificial Sequence
  RNA Oligomer
agugcggcauggagguguacaaa

SEQ ID NO: 52642 - RNA, 23 nt, Artificial Sequence
  RNA Oligomer
gcagaagaucgaggacaucagca

SEQ ID NO: 52643 - RNA, 23 nt, Artificial Sequence
  RNA Oligomer
agcagaagaucgaggacaucagc

SEQ ID NO: 52644 - RNA, 23 nt, Artificial Sequence
  RNA Oligomer
gagcagaagaucgaggacaucag

SEQ ID NO: 52645 - RNA, 23 nt, Artificial Sequence
  RNA Oligomer
uccuccuacucugccucuaccug

SEQ ID NO: 52646 - RNA, 23 nt, Artificial Sequence
  RNA Oligomer
guccuccuacucugccucuaccu

SEQ ID NO: 52647 - RNA, 23 nt, Artificial Sequence
  RNA Oligomer
gguccuccuacucugccucuacc

SEQ ID NO: 52648 - RNA, 23 nt, Artificial Sequence
  RNA Oligomer
cgguccuccuacucugccucuac

SEQ ID NO: 52649 - RNA, 23 nt, Artificial Sequence
  RNA Oligomer
acgguccuccuacucugccucua

SEQ ID NO: 52650 - RNA, 23 nt, Artificial Sequence
  RNA Oligomer
caucaagaagaaagaaugcgugu

SEQ ID NO: 52651 - RNA, 23 nt, Artificial Sequence
  RNA Oligomer
acaucaagaagaaagaaugcgug

SEQ ID NO: 52652 - RNA, 23 nt, Artificial Sequence
  RNA Oligomer
ccucaguucguggauuccugaaa

SEQ ID NO: 52653 - RNA, 23 nt, Artificial Sequence
  RNA Oligomer
agaucuucauggaugaguggcag

SEQ ID NO: 52654 - RNA, 23 nt, Artificial Sequence
  RNA Oligomer
gagaucuucauggaugaguggca

SEQ ID NO: 52655 - RNA, 23 nt, Artificial Sequence
  RNA Oligomer
ugagaucuucauggaugaguggc

SEQ ID NO: 52656 - RNA, 23 nt, Artificial Sequence
  RNA Oligomer
acugagcguguucuuccaggaga

SEQ ID NO: 52657 - RNA, 23 nt, Artificial Sequence
  RNA Oligomer
guacauacuggaugaggauggcc

SEQ ID NO: 52658 - RNA, 23 nt, Artificial Sequence
  RNA Oligomer
aguacauacuggaugaggauggc

SEQ ID NO: 52659 - RNA, 23 nt, Artificial Sequence
  RNA Oligomer
gaguacauacuggaugaggaugg

SEQ ID NO: 52660 - RNA, 23 nt, Artificial Sequence
  RNA Oligomer
ugaucuaccaccucaugacccag

SEQ ID NO: 52661 - RNA, 23 nt, Artificial Sequence
  RNA Oligomer
gugaucuaccaccucaugaccca

SEQ ID NO: 52662 - RNA, 23 nt, Artificial Sequence
  RNA Oligomer
cgugaucuaccaccucaugaccc

SEQ ID NO: 52663 - RNA, 23 nt, Artificial Sequence
  RNA Oligomer
gcgugaucuaccaccucaugacc

SEQ ID NO: 52664 - RNA, 23 nt, Artificial Sequence
  RNA Oligomer
agcgugaucuaccaccucaugac

SEQ ID NO: 52665 - RNA, 23 nt, Artificial Sequence
  RNA Oligomer
caaauaaaguuccugacacgucc

SEQ ID NO: 52666 - RNA, 23 nt, Artificial Sequence
  RNA Oligomer
acaaauaaaguuccugacacguc

SEQ ID NO: 52667 - RNA, 23 nt, Artificial Sequence
  RNA Oligomer
cacaaauaaaguuccugacacgu

SEQ ID NO: 52668 - RNA, 23 nt, Artificial Sequence
  RNA Oligomer
ccacaaauaaaguuccugacacg

SEQ ID NO: 52669 - RNA, 23 nt, Artificial Sequence
  RNA Oligomer
uccacaaauaaaguuccugacac

SEQ ID NO: 52670 - RNA, 23 nt, Artificial Sequence
  RNA Oligomer
gcuuuccacaaauaaaguuccug

SEQ ID NO: 52671 - RNA, 23 nt, Artificial Sequence
  RNA Oligomer
ugcuuuccacaaauaaaguuccu

SEQ ID NO: 52672 - RNA, 23 nt, Artificial Sequence
  RNA Oligomer
gugcuuuccacaaauaaaguucc

SEQ ID NO: 52673 - RNA, 23 nt, Artificial Sequence
  RNA Oligomer
ugugcuuuccacaaauaaaguuc

SEQ ID NO: 52674 - RNA, 23 nt, Artificial Sequence
  RNA Oligomer
cugugcuuuccacaaauaaaguu

SEQ ID NO: 52675 - RNA, 23 nt, Artificial Sequence
  RNA Oligomer
ggagguguacaaaggcuacaugg

SEQ ID NO: 52676 - RNA, 23 nt, Artificial Sequence
  RNA Oligomer
gaaaguuccaaacugucugaugc

SEQ ID NO: 52677 - RNA, 23 nt, Artificial Sequence
  RNA Oligomer
ggaaaguuccaaacugucugaug

SEQ ID NO: 52678 - RNA, 23 nt, Artificial Sequence
  RNA Oligomer
uggaaaguuccaaacugucugau

SEQ ID NO: 52679 - RNA, 23 nt, Artificial Sequence
  RNA Oligomer
guggaaaguuccaaacugucuga

SEQ ID NO: 52680 - RNA, 23 nt, Artificial Sequence
  RNA Oligomer
uguggaaaguuccaaacugucug

SEQ ID NO: 52681 - RNA, 23 nt, Artificial Sequence
  RNA Oligomer
caagaacaagcuggagaagaacg

SEQ ID NO: 52682 - RNA, 23 nt, Artificial Sequence
  RNA Oligomer
ucaagaacaagcuggagaagaac

SEQ ID NO: 52683 - RNA, 23 nt, Artificial Sequence
  RNA Oligomer
cucaagaacaagcuggagaagaa

SEQ ID NO: 52684 - RNA, 23 nt, Artificial Sequence
  RNA Oligomer
agcacacggaccagauuuggaag

SEQ ID NO: 52685 - RNA, 23 nt, Artificial Sequence
  RNA Oligomer
gagcacacggaccagauuuggaa

SEQ ID NO: 52686 - RNA, 23 nt, Artificial Sequence
  RNA Oligomer
ggagcacacggaccagauuugga

SEQ ID NO: 52687 - RNA, 23 nt, Artificial Sequence
  RNA Oligomer
aggagcacacggaccagauuugg

SEQ ID NO: 52688 - RNA, 23 nt, Artificial Sequence
  RNA Oligomer
caggagcacacggaccagauuug

SEQ ID NO: 52689 - RNA, 23 nt, Artificial Sequence
  RNA Oligomer
gcaggagcacacggaccagauuu

SEQ ID NO: 52690 - RNA, 23 nt, Artificial Sequence
  RNA Oligomer
guguauuuuguggaaaguuccaa

SEQ ID NO: 52691 - RNA, 23 nt, Artificial Sequence
  RNA Oligomer
accacuccuaccucaccaucuuc

SEQ ID NO: 52692 - RNA, 23 nt, Artificial Sequence
  RNA Oligomer
uaccacuccuaccucaccaucuu

SEQ ID NO: 52693 - RNA, 23 nt, Artificial Sequence
  RNA Oligomer
cuaccacuccuaccucaccaucu

SEQ ID NO: 52694 - RNA, 23 nt, Artificial Sequence
  RNA Oligomer
ucuaccacuccuaccucaccauc

SEQ ID NO: 52695 - RNA, 23 nt, Artificial Sequence
  RNA Oligomer
gucuaccacuccuaccucaccau

SEQ ID NO: 52696 - RNA, 23 nt, Artificial Sequence
  RNA Oligomer
gaaagaaugcguguauuuugugg

SEQ ID NO: 52697 - RNA, 23 nt, Artificial Sequence
  RNA Oligomer
agugcgggcugaugaagaaggca

SEQ ID NO: 52698 - RNA, 23 nt, Artificial Sequence
  RNA Oligomer
gagugcgggcugaugaagaaggc

SEQ ID NO: 52699 - RNA, 23 nt, Artificial Sequence
  RNA Oligomer
cgagugcgggcugaugaagaagg

SEQ ID NO: 52700 - RNA, 23 nt, Artificial Sequence
  RNA Oligomer
acgagugcgggcugaugaagaag

SEQ ID NO: 52701 - RNA, 23 nt, Artificial Sequence
  RNA Oligomer
gacgagugcgggcugaugaagaa

SEQ ID NO: 52702 - RNA, 23 nt, Artificial Sequence
  RNA Oligomer
guggaagccuucagaucugcacc

SEQ ID NO: 52703 - RNA, 23 nt, Artificial Sequence
  RNA Oligomer
aguggaagccuucagaucugcac

SEQ ID NO: 52704 - RNA, 23 nt, Artificial Sequence
  RNA Oligomer
caguggaagccuucagaucugca

SEQ ID NO: 52705 - RNA, 23 nt, Artificial Sequence
  RNA Oligomer
aagaaagccucaguucguggauu

SEQ ID NO: 52706 - RNA, 23 nt, Artificial Sequence
  RNA Oligomer
ggaaagcaggauugucgagugga

SEQ ID NO: 52707 - RNA, 23 nt, Artificial Sequence
  RNA Oligomer
cggaaagcaggauugucgagugg

SEQ ID NO: 52708 - RNA, 23 nt, Artificial Sequence
  RNA Oligomer
acggaaagcaggauugucgagug

SEQ ID NO: 52709 - RNA, 23 nt, Artificial Sequence
  RNA Oligomer
cacggaaagcaggauugucgagu

SEQ ID NO: 52710 - RNA, 23 nt, Artificial Sequence
  RNA Oligomer
ucacggaaagcaggauugucgag

SEQ ID NO: 52711 - RNA, 23 nt, Artificial Sequence
  RNA Oligomer
uucacggaaagcaggauugucga

SEQ ID NO: 52712 - RNA, 23 nt, Artificial Sequence
  RNA Oligomer
cuuccaggagauguuugagaccu

SEQ ID NO: 52713 - RNA, 23 nt, Artificial Sequence
  RNA Oligomer
ucuuccaggagauguuugagacc

SEQ ID NO: 52714 - RNA, 23 nt, Artificial Sequence
  RNA Oligomer
uucuuccaggagauguuugagac

SEQ ID NO: 52715 - RNA, 23 nt, Artificial Sequence
  RNA Oligomer
uguucuuccaggagauguuugag

SEQ ID NO: 52716 - RNA, 23 nt, Artificial Sequence
  RNA Oligomer
guguucuuccaggagauguuuga

SEQ ID NO: 52717 - RNA, 23 nt, Artificial Sequence
  RNA Oligomer
cguguucuuccaggagauguuug

SEQ ID NO: 52718 - RNA, 23 nt, Artificial Sequence
  RNA Oligomer
gaaguucauaucggagcagacca

SEQ ID NO: 52719 - RNA, 23 nt, Artificial Sequence
  RNA Oligomer
agaaguucauaucggagcagacc

SEQ ID NO: 52720 - RNA, 23 nt, Artificial Sequence
  RNA Oligomer
gagaaguucauaucggagcagac

SEQ ID NO: 52721 - RNA, 23 nt, Artificial Sequence
  RNA Oligomer
ggagaaguucauaucggagcaga

SEQ ID NO: 52722 - RNA, 23 nt, Artificial Sequence
  RNA Oligomer
uggagaaguucauaucggagcag

SEQ ID NO: 52723 - RNA, 23 nt, Artificial Sequence
  RNA Oligomer
cugaaacuggcaguggcauggaa

SEQ ID NO: 52724 - RNA, 23 nt, Artificial Sequence
  RNA Oligomer
ugaaacuggcaguggcauggaau

SEQ ID NO: 52725 - RNA, 23 nt, Artificial Sequence
  RNA Oligomer
ggauugucgaguggaccaaaaag

SEQ ID NO: 52726 - RNA, 23 nt, Artificial Sequence
  RNA Oligomer
gcaagaaagccucaguucgugga

SEQ ID NO: 52727 - RNA, 23 nt, Artificial Sequence
  RNA Oligomer
ccaucugcaggaagagcauaaag

SEQ ID NO: 52728 - RNA, 23 nt, Artificial Sequence
  RNA Oligomer
gaaacuggcaguggcauggaauc

SEQ ID NO: 52729 - RNA, 23 nt, Artificial Sequence
  RNA Oligomer
caggauugucgaguggaccaaaa

SEQ ID NO: 52730 - RNA, 23 nt, Artificial Sequence
  RNA Oligomer
aaggaaagaggagguguggccau

SEQ ID NO: 52731 - RNA, 23 nt, Artificial Sequence
  RNA Oligomer
cccaucagcucccugucuucauu

SEQ ID NO: 52732 - RNA, 23 nt, Artificial Sequence
  RNA Oligomer
gguuuggugucaacagcucacag

SEQ ID NO: 52733 - RNA, 23 nt, Artificial Sequence
  RNA Oligomer
cuacauggaugacccgaggaaca

SEQ ID NO: 52734 - RNA, 23 nt, Artificial Sequence
  RNA Oligomer
aagaaugcguguauuuuguggaa

SEQ ID NO: 52735 - RNA, 23 nt, Artificial Sequence
  RNA Oligomer
acauccucuccuacuucgccuuc

SEQ ID NO: 52736 - RNA, 23 nt, Artificial Sequence
  RNA Oligomer
cugguuuggugucaacagcucac

SEQ ID NO: 52737 - RNA, 23 nt, Artificial Sequence
  RNA Oligomer
ucauggaugaguggcaguggaag

SEQ ID NO: 52738 - RNA, 23 nt, Artificial Sequence
  RNA Oligomer
aggauugucgaguggaccaaaaa

SEQ ID NO: 52739 - RNA, 23 nt, Artificial Sequence
  RNA Oligomer
caagaaagccucaguucguggau

SEQ ID NO: 52740 - RNA, 23 nt, Artificial Sequence
  RNA Oligomer
ggcuggagaaguucauaucggag

SEQ ID NO: 52741 - RNA, 23 nt, Artificial Sequence
  RNA Oligomer
gcaauaagguugacgccauggug

SEQ ID NO: 52742 - RNA, 23 nt, Artificial Sequence
  RNA Oligomer
agauuuggaaguuccagcgccau

SEQ ID NO: 52743 - RNA, 23 nt, Artificial Sequence
  RNA Oligomer
gacauugcccgcagugagaucuu

SEQ ID NO: 52744 - RNA, 23 nt, Artificial Sequence
  RNA Oligomer
ccaucuugcaggccuugcugaaa

SEQ ID NO: 52745 - RNA, 23 nt, Artificial Sequence
  RNA Oligomer
acccaucagcucccugucuucau

SEQ ID NO: 52746 - RNA, 23 nt, Artificial Sequence
  RNA Oligomer
gaacgugguaaaacccaagacau

SEQ ID NO: 52747 - RNA, 23 nt, Artificial Sequence
  RNA Oligomer
ggaacgugguaaaacccaagaca

SEQ ID NO: 52748 - RNA, 23 nt, Artificial Sequence
  RNA Oligomer
cugaaggaguuugucaccuggga

SEQ ID NO: 52749 - RNA, 23 nt, Artificial Sequence
  RNA Oligomer
uuccugaucuaugacccacccuu

SEQ ID NO: 52750 - RNA, 23 nt, Artificial Sequence
  RNA Oligomer
gcucccugucuucauuuuccuaa

SEQ ID NO: 52751 - RNA, 23 nt, Artificial Sequence
  RNA Oligomer
ccugaucuaugacccacccuuuu

SEQ ID NO: 52752 - RNA, 23 nt, Artificial Sequence
  RNA Oligomer
gggagacggaguuccugaucuau

SEQ ID NO: 52753 - RNA, 23 nt, Artificial Sequence
  RNA Oligomer
cucugucuuccaccugacccaaa

SEQ ID NO: 52754 - RNA, 23 nt, Artificial Sequence
  RNA Oligomer
ccagaaccgacaguuccagcaaa

SEQ ID NO: 52755 - RNA, 23 nt, Artificial Sequence
  RNA Oligomer
gcucaugcacauuuuuaccauca

SEQ ID NO: 52756 - RNA, 23 nt, Artificial Sequence
  RNA Oligomer
cccaaguuucuccucugacccau

SEQ ID NO: 52757 - RNA, 23 nt, Artificial Sequence
  RNA Oligomer
ggagacggaguuccugaucuaug

SEQ ID NO: 52758 - RNA, 23 nt, Artificial Sequence
  RNA Oligomer
ccauguucaacuacaccuuccag

SEQ ID NO: 52759 - RNA, 23 nt, Artificial Sequence
  RNA Oligomer
cucucuggacuucauccuguucu

SEQ ID NO: 52760 - RNA, 23 nt, Artificial Sequence
  RNA Oligomer
ccugagccagaaggugaaaaagu

SEQ ID NO: 52761 - RNA, 23 nt, Artificial Sequence
  RNA Oligomer
ccaucagcucccugucuucauuu

SEQ ID NO: 52762 - RNA, 23 nt, Artificial Sequence
  RNA Oligomer
ccaaguuucuccucugacccauc

SEQ ID NO: 52763 - RNA, 23 nt, Artificial Sequence
  RNA Oligomer
gcacacagugggacccaaagaaa

SEQ ID NO: 52764 - RNA, 23 nt, Artificial Sequence
  RNA Oligomer
ugaaaacuugcugaagugcggca

SEQ ID NO: 52765 - RNA, 23 nt, Artificial Sequence
  RNA Oligomer
cgauccaguacaacgugguggau

SEQ ID NO: 52766 - RNA, 23 nt, Artificial Sequence
  RNA Oligomer
ccuccggcucaugcacauuuuua

SEQ ID NO: 52767 - RNA, 23 nt, Artificial Sequence
  RNA Oligomer
aggucauuggccugaggcaaguu

SEQ ID NO: 52768 - RNA, 23 nt, Artificial Sequence
  RNA Oligomer
gccaucugcaggaagagcauaaa

SEQ ID NO: 52769 - RNA, 23 nt, Artificial Sequence
  RNA Oligomer
cugaucuaugacccacccuuuua

SEQ ID NO: 52770 - RNA, 23 nt, Artificial Sequence
  RNA Oligomer
ugaaggagaacuaccuccagaac

SEQ ID NO: 52771 - RNA, 23 nt, Artificial Sequence
  RNA Oligomer
cgccauguucaacuacaccuucc

SEQ ID NO: 52772 - RNA, 23 nt, Artificial Sequence
  RNA Oligomer
ccucaucgccauguucaacuaca

SEQ ID NO: 52773 - RNA, 23 nt, Artificial Sequence
  RNA Oligomer
acgucuucuucuuccucuuccug

SEQ ID NO: 52774 - RNA, 23 nt, Artificial Sequence
  RNA Oligomer
acgaugacagcugcacucaucuc

SEQ ID NO: 52775 - RNA, 23 nt, Artificial Sequence
  RNA Oligomer
cgaguggaccaaaaagauccaag

SEQ ID NO: 52776 - RNA, 23 nt, Artificial Sequence
  RNA Oligomer
caaguuucuccucugacccauca

SEQ ID NO: 52777 - RNA, 23 nt, Artificial Sequence
  RNA Oligomer
gcucauccaccauggaggucauu

SEQ ID NO: 52778 - RNA, 23 nt, Artificial Sequence
  RNA Oligomer
ggagaucuaccugaaggagaacu

SEQ ID NO: 52779 - RNA, 23 nt, Artificial Sequence
  RNA Oligomer
caagaggcacaagcagcucaaga

SEQ ID NO: 52780 - RNA, 23 nt, Artificial Sequence
  RNA Oligomer
gccauguucaacuacaccuucca

SEQ ID NO: 52781 - RNA, 23 nt, Artificial Sequence
  RNA Oligomer
ucgccauguucaacuacaccuuc

SEQ ID NO: 52782 - RNA, 23 nt, Artificial Sequence
  RNA Oligomer
caagaccacuuuggccacgagaa

SEQ ID NO: 52783 - RNA, 23 nt, Artificial Sequence
  RNA Oligomer
gcaggauugucgaguggaccaaa

SEQ ID NO: 52784 - RNA, 23 nt, Artificial Sequence
  RNA Oligomer
cauaucggagcagaccaaggaaa

SEQ ID NO: 52785 - RNA, 23 nt, Artificial Sequence
  RNA Oligomer
gccuccggcucaugcacauuuuu

SEQ ID NO: 52786 - RNA, 23 nt, Artificial Sequence
  RNA Oligomer
ucaucuccaacaagccugaguuu

SEQ ID NO: 52787 - RNA, 23 nt, Artificial Sequence
  RNA Oligomer
gccucaguucguggauuccugaa

SEQ ID NO: 52788 - RNA, 23 nt, Artificial Sequence
  RNA Oligomer
gaaagaggagguguggccaucaa

SEQ ID NO: 52789 - RNA, 23 nt, Artificial Sequence
  RNA Oligomer
ucauaucggagcagaccaaggaa

SEQ ID NO: 52790 - RNA, 23 nt, Artificial Sequence
  RNA Oligomer
cucuucugugcuuuccacaaaua

SEQ ID NO: 52791 - RNA, 23 nt, Artificial Sequence
  RNA Oligomer
ccaagacauuaaaucugccaucu

SEQ ID NO: 52792 - RNA, 23 nt, Artificial Sequence
  RNA Oligomer
gaacuccugacugucaggauaaa

SEQ ID NO: 52793 - RNA, 23 nt, Artificial Sequence
  RNA Oligomer
gagaugcuaccucggaagcugaa

SEQ ID NO: 52794 - RNA, 23 nt, Artificial Sequence
  RNA Oligomer
gagccaucugcaggaagagcaua

SEQ ID NO: 52795 - RNA, 23 nt, Artificial Sequence
  RNA Oligomer
uccugaucuaugacccacccuuu

SEQ ID NO: 52796 - RNA, 23 nt, Artificial Sequence
  RNA Oligomer
gucauccucucucuggacuucau

SEQ ID NO: 52797 - RNA, 23 nt, Artificial Sequence
  RNA Oligomer
gugguggucuuccaccugaacau

SEQ ID NO: 52798 - RNA, 23 nt, Artificial Sequence
  RNA Oligomer
ggugcagcugaaggaguuuguca

SEQ ID NO: 52799 - RNA, 23 nt, Artificial Sequence
  RNA Oligomer
agcagaaacugagcguguucuuc

SEQ ID NO: 52800 - RNA, 23 nt, Artificial Sequence
  RNA Oligomer
caacagcagccucuucaagagcu

SEQ ID NO: 52801 - RNA, 23 nt, Artificial Sequence
  RNA Oligomer
ccuagacagcaaccacucucacu

SEQ ID NO: 52802 - RNA, 23 nt, Artificial Sequence
  RNA Oligomer
caagacauuaaaucugccaucuc

SEQ ID NO: 52803 - RNA, 23 nt, Artificial Sequence
  RNA Oligomer
cccaagacauuaaaucugccauc

SEQ ID NO: 52804 - RNA, 23 nt, Artificial Sequence
  RNA Oligomer
acccaagacauuaaaucugccau

SEQ ID NO: 52805 - RNA, 23 nt, Artificial Sequence
  RNA Oligomer
gggaacgugguaaaacccaagac

SEQ ID NO: 52806 - RNA, 23 nt, Artificial Sequence
  RNA Oligomer
cacacagugggacccaaagaaac

SEQ ID NO: 52807 - RNA, 23 nt, Artificial Sequence
  RNA Oligomer
gcacugucugaacuccugacugu

SEQ ID NO: 52808 - RNA, 23 nt, Artificial Sequence
  RNA Oligomer
agccaucugcaggaagagcauaa

SEQ ID NO: 52809 - RNA, 23 nt, Artificial Sequence
  RNA Oligomer
cagaaccgacaguuccagcaaaa

SEQ ID NO: 52810 - RNA, 23 nt, Artificial Sequence
  RNA Oligomer
acacggaccagauuuggaaguuc

SEQ ID NO: 52811 - RNA, 23 nt, Artificial Sequence
  RNA Oligomer
gcacacggaccagauuuggaagu

SEQ ID NO: 52812 - RNA, 23 nt, Artificial Sequence
  RNA Oligomer
ccggcucaugcacauuuuuacca

SEQ ID NO: 52813 - RNA, 23 nt, Artificial Sequence
  RNA Oligomer
ucauuugggccauuguccagaac

SEQ ID NO: 52814 - RNA, 23 nt, Artificial Sequence
  RNA Oligomer
aguggaccaaaaagauccaagau

SEQ ID NO: 52815 - RNA, 23 nt, Artificial Sequence
  RNA Oligomer
ccagcagaaacugagcguguucu

SEQ ID NO: 52816 - RNA, 23 nt, Artificial Sequence
  RNA Oligomer
gccugucucggacaucacuaucu

SEQ ID NO: 52817 - RNA, 23 nt, Artificial Sequence
  RNA Oligomer
cuagacagcaaccacucucacuu

SEQ ID NO: 52818 - RNA, 23 nt, Artificial Sequence
  RNA Oligomer
aggagaugccaaccgaugccuuu

SEQ ID NO: 52819 - RNA, 23 nt, Artificial Sequence
  RNA Oligomer
aacgugguaaaacccaagacauu

SEQ ID NO: 52820 - RNA, 23 nt, Artificial Sequence
  RNA Oligomer
gagguguacaaaggcuacaugga

SEQ ID NO: 52821 - RNA, 23 nt, Artificial Sequence
  RNA Oligomer
gcuauccugggagaucuaccuga

SEQ ID NO: 52822 - RNA, 23 nt, Artificial Sequence
  RNA Oligomer
guacuucagugacuucuggaaua

SEQ ID NO: 52823 - RNA, 23 nt, Artificial Sequence
  RNA Oligomer
uuucuugcuugucauuguugccg

SEQ ID NO: 52824 - RNA, 23 nt, Artificial Sequence
  RNA Oligomer
uucuugcuugucauuguugccga

SEQ ID NO: 52825 - RNA, 23 nt, Artificial Sequence
  RNA Oligomer
ucuugcuugucauuguugccgaa

SEQ ID NO: 52826 - RNA, 23 nt, Artificial Sequence
  RNA Oligomer
cuugcuugucauuguugccgaag

SEQ ID NO: 52827 - RNA, 23 nt, Artificial Sequence
  RNA Oligomer
uugcuugucauuguugccgaagg

SEQ ID NO: 52828 - RNA, 23 nt, Artificial Sequence
  RNA Oligomer
ccgcuucacaaugaugaucuugg

SEQ ID NO: 52829 - RNA, 23 nt, Artificial Sequence
  RNA Oligomer
cgcuucacaaugaugaucuuggg

SEQ ID NO: 52830 - RNA, 23 nt, Artificial Sequence
  RNA Oligomer
gcuucacaaugaugaucuugggc

SEQ ID NO: 52831 - RNA, 23 nt, Artificial Sequence
  RNA Oligomer
cuucacaaugaugaucuugggcc

SEQ ID NO: 52832 - RNA, 23 nt, Artificial Sequence
  RNA Oligomer
uucacaaugaugaucuugggccc

SEQ ID NO: 52833 - RNA, 23 nt, Artificial Sequence
  RNA Oligomer
gaaguaggagaggauguucaggu

SEQ ID NO: 52834 - RNA, 23 nt, Artificial Sequence
  RNA Oligomer
aaguaggagaggauguucaggug

SEQ ID NO: 52835 - RNA, 23 nt, Artificial Sequence
  RNA Oligomer
aguaggagaggauguucaggugg

SEQ ID NO: 52836 - RNA, 23 nt, Artificial Sequence
  RNA Oligomer
guaggagaggauguucaggugga

SEQ ID NO: 52837 - RNA, 23 nt, Artificial Sequence
  RNA Oligomer
uaggagaggauguucagguggaa

SEQ ID NO: 52838 - RNA, 23 nt, Artificial Sequence
  RNA Oligomer
cagcuuguucuugagcugcuugu

SEQ ID NO: 52839 - RNA, 23 nt, Artificial Sequence
  RNA Oligomer
agcuuguucuugagcugcuugug

SEQ ID NO: 52840 - RNA, 23 nt, Artificial Sequence
  RNA Oligomer
gcuuguucuugagcugcuugugc

SEQ ID NO: 52841 - RNA, 23 nt, Artificial Sequence
  RNA Oligomer
cuuguucuugagcugcuugugcc

SEQ ID NO: 52842 - RNA, 23 nt, Artificial Sequence
  RNA Oligomer
uuguucuugagcugcuugugccu

SEQ ID NO: 52843 - RNA, 23 nt, Artificial Sequence
  RNA Oligomer
ucuuacugaugguaaaaaugugc

SEQ ID NO: 52844 - RNA, 23 nt, Artificial Sequence
  RNA Oligomer
cuuacugaugguaaaaaugugca

SEQ ID NO: 52845 - RNA, 23 nt, Artificial Sequence
  RNA Oligomer
uuacugaugguaaaaaugugcau

SEQ ID NO: 52846 - RNA, 23 nt, Artificial Sequence
  RNA Oligomer
uacugaugguaaaaaugugcaug

SEQ ID NO: 52847 - RNA, 23 nt, Artificial Sequence
  RNA Oligomer
acugaugguaaaaaugugcauga

SEQ ID NO: 52848 - RNA, 23 nt, Artificial Sequence
  RNA Oligomer
cucguacagguagagcaaggugu

SEQ ID NO: 52849 - RNA, 23 nt, Artificial Sequence
  RNA Oligomer
ucguacagguagagcaagguguc

SEQ ID NO: 52850 - RNA, 23 nt, Artificial Sequence
  RNA Oligomer
cguacagguagagcaaggugucc

SEQ ID NO: 52851 - RNA, 23 nt, Artificial Sequence
  RNA Oligomer
guacagguagagcaagguguccc

SEQ ID NO: 52852 - RNA, 23 nt, Artificial Sequence
  RNA Oligomer
uacagguagagcaagguguccca

SEQ ID NO: 52853 - RNA, 23 nt, Artificial Sequence
  RNA Oligomer
cuggaucagggagauagugaugu

SEQ ID NO: 52854 - RNA, 23 nt, Artificial Sequence
  RNA Oligomer
uggaucagggagauagugauguc

SEQ ID NO: 52855 - RNA, 23 nt, Artificial Sequence
  RNA Oligomer
ggaucagggagauagugaugucc

SEQ ID NO: 52856 - RNA, 23 nt, Artificial Sequence
  RNA Oligomer
gaucagggagauagugauguccg

SEQ ID NO: 52857 - RNA, 23 nt, Artificial Sequence
  RNA Oligomer
aucagggagauagugauguccga

SEQ ID NO: 52858 - RNA, 23 nt, Artificial Sequence
  RNA Oligomer
gggcauucacgugguagcugucg

SEQ ID NO: 52859 - RNA, 23 nt, Artificial Sequence
  RNA Oligomer
ggcauucacgugguagcugucgc

SEQ ID NO: 52860 - RNA, 23 nt, Artificial Sequence
  RNA Oligomer
gcauucacgugguagcugucgcc

SEQ ID NO: 52861 - RNA, 23 nt, Artificial Sequence
  RNA Oligomer
cauucacgugguagcugucgccc

SEQ ID NO: 52862 - RNA, 23 nt, Artificial Sequence
  RNA Oligomer
auucacgugguagcugucgcccg

SEQ ID NO: 52863 - RNA, 23 nt, Artificial Sequence
  RNA Oligomer
ggcgaaguaggagaggauguuca

SEQ ID NO: 52864 - RNA, 23 nt, Artificial Sequence
  RNA Oligomer
gcgaaguaggagaggauguucag

SEQ ID NO: 52865 - RNA, 23 nt, Artificial Sequence
  RNA Oligomer
cgaaguaggagaggauguucagg

SEQ ID NO: 52866 - RNA, 23 nt, Artificial Sequence
  RNA Oligomer
agacacaaacuucauguccuugg

SEQ ID NO: 52867 - RNA, 23 nt, Artificial Sequence
  RNA Oligomer
gacacaaacuucauguccuuggc

SEQ ID NO: 52868 - RNA, 23 nt, Artificial Sequence
  RNA Oligomer
acacaaacuucauguccuuggcc

SEQ ID NO: 52869 - RNA, 23 nt, Artificial Sequence
  RNA Oligomer
cacaaacuucauguccuuggccu

SEQ ID NO: 52870 - RNA, 23 nt, Artificial Sequence
  RNA Oligomer
acaaacuucauguccuuggccuc

SEQ ID NO: 52871 - RNA, 23 nt, Artificial Sequence
  RNA Oligomer
cuuguuggagaugagugcagcug

SEQ ID NO: 52872 - RNA, 23 nt, Artificial Sequence
  RNA Oligomer
uuguuggagaugagugcagcugu

SEQ ID NO: 52873 - RNA, 23 nt, Artificial Sequence
  RNA Oligomer
uguuggagaugagugcagcuguc

SEQ ID NO: 52874 - RNA, 23 nt, Artificial Sequence
  RNA Oligomer
guuggagaugagugcagcuguca

SEQ ID NO: 52875 - RNA, 23 nt, Artificial Sequence
  RNA Oligomer
uuggagaugagugcagcugucau

SEQ ID NO: 52876 - RNA, 23 nt, Artificial Sequence
  RNA Oligomer
auccaugaagaucucacugcggg

SEQ ID NO: 52877 - RNA, 23 nt, Artificial Sequence
  RNA Oligomer
uccaugaagaucucacugcgggc

SEQ ID NO: 52878 - RNA, 23 nt, Artificial Sequence
  RNA Oligomer
ccaugaagaucucacugcgggca

SEQ ID NO: 52879 - RNA, 23 nt, Artificial Sequence
  RNA Oligomer
caugaagaucucacugcgggcaa

SEQ ID NO: 52880 - RNA, 23 nt, Artificial Sequence
  RNA Oligomer
augaagaucucacugcgggcaau

SEQ ID NO: 52881 - RNA, 23 nt, Artificial Sequence
  RNA Oligomer
gcucuugaagaggcugcuguugc

SEQ ID NO: 52882 - RNA, 23 nt, Artificial Sequence
  RNA Oligomer
cucuugaagaggcugcuguugcu

SEQ ID NO: 52883 - RNA, 23 nt, Artificial Sequence
  RNA Oligomer
ucuugaagaggcugcuguugcug

SEQ ID NO: 52884 - RNA, 23 nt, Artificial Sequence
  RNA Oligomer
cuugaagaggcugcuguugcugc

SEQ ID NO: 52885 - RNA, 23 nt, Artificial Sequence
  RNA Oligomer
uugaagaggcugcuguugcugcg

SEQ ID NO: 52886 - RNA, 23 nt, Artificial Sequence
  RNA Oligomer
cagcaucuucuuuaugcucuucc

SEQ ID NO: 52887 - RNA, 23 nt, Artificial Sequence
  RNA Oligomer
agcaucuucuuuaugcucuuccu

SEQ ID NO: 52888 - RNA, 23 nt, Artificial Sequence
  RNA Oligomer
gcaucuucuuuaugcucuuccug

SEQ ID NO: 52889 - RNA, 23 nt, Artificial Sequence
  RNA Oligomer
caucuucuuuaugcucuuccugc

SEQ ID NO: 52890 - RNA, 23 nt, Artificial Sequence
  RNA Oligomer
aucuucuuuaugcucuuccugca

SEQ ID NO: 52891 - RNA, 23 nt, Artificial Sequence
  RNA Oligomer
acugggguucuagagacacaugg

SEQ ID NO: 52892 - RNA, 23 nt, Artificial Sequence
  RNA Oligomer
cugggguucuagagacacauggg

SEQ ID NO: 52893 - RNA, 23 nt, Artificial Sequence
  RNA Oligomer
ugggguucuagagacacaugggg

SEQ ID NO: 52894 - RNA, 23 nt, Artificial Sequence
  RNA Oligomer
gggguucuagagacacauggggu

SEQ ID NO: 52895 - RNA, 23 nt, Artificial Sequence
  RNA Oligomer
ggguucuagagacacauggggug

SEQ ID NO: 52896 - RNA, 23 nt, Artificial Sequence
  RNA Oligomer
aaccuuauugcugauguccucga

SEQ ID NO: 52897 - RNA, 23 nt, Artificial Sequence
  RNA Oligomer
accuuauugcugauguccucgau

SEQ ID NO: 52898 - RNA, 23 nt, Artificial Sequence
  RNA Oligomer
ccuuauugcugauguccucgauc

SEQ ID NO: 52899 - RNA, 23 nt, Artificial Sequence
  RNA Oligomer
cuuauugcugauguccucgaucu

SEQ ID NO: 52900 - RNA, 23 nt, Artificial Sequence
  RNA Oligomer
uuauugcugauguccucgaucuu

SEQ ID NO: 52901 - RNA, 23 nt, Artificial Sequence
  RNA Oligomer
aggcuuguuggagaugagugcag

SEQ ID NO: 52902 - RNA, 23 nt, Artificial Sequence
  RNA Oligomer
ggcuuguuggagaugagugcagc

SEQ ID NO: 52903 - RNA, 23 nt, Artificial Sequence
  RNA Oligomer
gcuuguuggagaugagugcagcu

SEQ ID NO: 52904 - RNA, 23 nt, Artificial Sequence
  RNA Oligomer
cucauccaugaagaucucacugc

SEQ ID NO: 52905 - RNA, 23 nt, Artificial Sequence
  RNA Oligomer
ucauccaugaagaucucacugcg

SEQ ID NO: 52906 - RNA, 23 nt, Artificial Sequence
  RNA Oligomer
cauccaugaagaucucacugcgg

SEQ ID NO: 52907 - RNA, 23 nt, Artificial Sequence
  RNA Oligomer
aaacaucuccuggaagaacacgc

SEQ ID NO: 52908 - RNA, 23 nt, Artificial Sequence
  RNA Oligomer
aacaucuccuggaagaacacgcu

SEQ ID NO: 52909 - RNA, 23 nt, Artificial Sequence
  RNA Oligomer
acaucuccuggaagaacacgcuc

SEQ ID NO: 52910 - RNA, 23 nt, Artificial Sequence
  RNA Oligomer
caucuccuggaagaacacgcuca

SEQ ID NO: 52911 - RNA, 23 nt, Artificial Sequence
  RNA Oligomer
aucuccuggaagaacacgcucag

SEQ ID NO: 52912 - RNA, 23 nt, Artificial Sequence
  RNA Oligomer
cagguuuaggaaaaugaagacag

SEQ ID NO: 52913 - RNA, 23 nt, Artificial Sequence
  RNA Oligomer
agguuuaggaaaaugaagacagg

SEQ ID NO: 52914 - RNA, 23 nt, Artificial Sequence
  RNA Oligomer
gguuuaggaaaaugaagacaggg

SEQ ID NO: 52915 - RNA, 23 nt, Artificial Sequence
  RNA Oligomer
guuuaggaaaaugaagacaggga

SEQ ID NO: 52916 - RNA, 23 nt, Artificial Sequence
  RNA Oligomer
uuuaggaaaaugaagacagggag

SEQ ID NO: 52917 - RNA, 23 nt, Artificial Sequence
  RNA Oligomer
caccacguuguacuggaucgugg

SEQ ID NO: 52918 - RNA, 23 nt, Artificial Sequence
  RNA Oligomer
accacguuguacuggaucgugga

SEQ ID NO: 52919 - RNA, 23 nt, Artificial Sequence
  RNA Oligomer
ccacguuguacuggaucguggac

SEQ ID NO: 52920 - RNA, 23 nt, Artificial Sequence
  RNA Oligomer
cacguuguacuggaucguggaca

SEQ ID NO: 52921 - RNA, 23 nt, Artificial Sequence
  RNA Oligomer
acguuguacuggaucguggacag

SEQ ID NO: 52922 - RNA, 23 nt, Artificial Sequence
  RNA Oligomer
cggguugaaguucacaccgucga

SEQ ID NO: 52923 - RNA, 23 nt, Artificial Sequence
  RNA Oligomer
ggguugaaguucacaccgucgau

SEQ ID NO: 52924 - RNA, 23 nt, Artificial Sequence
  RNA Oligomer
gguugaaguucacaccgucgaug

SEQ ID NO: 52925 - RNA, 23 nt, Artificial Sequence
  RNA Oligomer
guugaaguucacaccgucgaugu

SEQ ID NO: 52926 - RNA, 23 nt, Artificial Sequence
  RNA Oligomer
uugaaguucacaccgucgaugua

SEQ ID NO: 52927 - RNA, 23 nt, Artificial Sequence
  RNA Oligomer
gaagaagacguccuucaucaucc

SEQ ID NO: 52928 - RNA, 23 nt, Artificial Sequence
  RNA Oligomer
aagaagacguccuucaucauccg

SEQ ID NO: 52929 - RNA, 23 nt, Artificial Sequence
  RNA Oligomer
agaagacguccuucaucauccgc

SEQ ID NO: 52930 - RNA, 23 nt, Artificial Sequence
  RNA Oligomer
gaagacguccuucaucauccgcu

SEQ ID NO: 52931 - RNA, 23 nt, Artificial Sequence
  RNA Oligomer
aagacguccuucaucauccgcuu

SEQ ID NO: 52932 - RNA, 23 nt, Artificial Sequence
  RNA Oligomer
gucuuacugaugguaaaaaugug

SEQ ID NO: 52933 - RNA, 23 nt, Artificial Sequence
  RNA Oligomer
gcuuucuugcuugucauuguugc

SEQ ID NO: 52934 - RNA, 23 nt, Artificial Sequence
  RNA Oligomer
cuuucuugcuugucauuguugcc

SEQ ID NO: 52935 - RNA, 23 nt, Artificial Sequence
  RNA Oligomer
caaccuuauugcugauguccucg

SEQ ID NO: 52936 - RNA, 23 nt, Artificial Sequence
  RNA Oligomer
guugaacauggcgaugaggaggu

SEQ ID NO: 52937 - RNA, 23 nt, Artificial Sequence
  RNA Oligomer
uugaacauggcgaugaggagguu

SEQ ID NO: 52938 - RNA, 23 nt, Artificial Sequence
  RNA Oligomer
ugaacauggcgaugaggagguug

SEQ ID NO: 52939 - RNA, 23 nt, Artificial Sequence
  RNA Oligomer
gaacauggcgaugaggagguuga

SEQ ID NO: 52940 - RNA, 23 nt, Artificial Sequence
  RNA Oligomer
aacauggcgaugaggagguugag

SEQ ID NO: 52941 - RNA, 23 nt, Artificial Sequence
  RNA Oligomer
ucacaaugaugaucuugggcccc

SEQ ID NO: 52942 - RNA, 23 nt, Artificial Sequence
  RNA Oligomer
caaaauacacgcauucuuucuuc

SEQ ID NO: 52943 - RNA, 23 nt, Artificial Sequence
  RNA Oligomer
aaaauacacgcauucuuucuucu

SEQ ID NO: 52944 - RNA, 23 nt, Artificial Sequence
  RNA Oligomer
aaauacacgcauucuuucuucuu

SEQ ID NO: 52945 - RNA, 23 nt, Artificial Sequence
  RNA Oligomer
aauacacgcauucuuucuucuug

SEQ ID NO: 52946 - RNA, 23 nt, Artificial Sequence
  RNA Oligomer
auacacgcauucuuucuucuuga

SEQ ID NO: 52947 - RNA, 23 nt, Artificial Sequence
  RNA Oligomer
aggagaggauguucagguggaag

SEQ ID NO: 52948 - RNA, 23 nt, Artificial Sequence
  RNA Oligomer
caaacuucauguccuuggccucc

SEQ ID NO: 52949 - RNA, 23 nt, Artificial Sequence
  RNA Oligomer
ccgugaaggucucaaacaucucc

SEQ ID NO: 52950 - RNA, 23 nt, Artificial Sequence
  RNA Oligomer
cgugaaggucucaaacaucuccu

SEQ ID NO: 52951 - RNA, 23 nt, Artificial Sequence
  RNA Oligomer
gugaaggucucaaacaucuccug

SEQ ID NO: 52952 - RNA, 23 nt, Artificial Sequence
  RNA Oligomer
ugaaggucucaaacaucuccugg

SEQ ID NO: 52953 - RNA, 23 nt, Artificial Sequence
  RNA Oligomer
gaaggucucaaacaucuccugga

SEQ ID NO: 52954 - RNA, 23 nt, Artificial Sequence
  RNA Oligomer
aaggucucaaacaucuccuggaa

SEQ ID NO: 52955 - RNA, 23 nt, Artificial Sequence
  RNA Oligomer
gaggaugaagugagagugguugc

SEQ ID NO: 52956 - RNA, 23 nt, Artificial Sequence
  RNA Oligomer
aggaugaagugagagugguugcu

SEQ ID NO: 52957 - RNA, 23 nt, Artificial Sequence
  RNA Oligomer
ggaugaagugagagugguugcug

SEQ ID NO: 52958 - RNA, 23 nt, Artificial Sequence
  RNA Oligomer
gaugaagugagagugguugcugu

SEQ ID NO: 52959 - RNA, 23 nt, Artificial Sequence
  RNA Oligomer
augaagugagagugguugcuguc

SEQ ID NO: 52960 - RNA, 23 nt, Artificial Sequence
  RNA Oligomer
ucggacguacuuuuucaccuucu

SEQ ID NO: 52961 - RNA, 23 nt, Artificial Sequence
  RNA Oligomer
cggacguacuuuuucaccuucug

SEQ ID NO: 52962 - RNA, 23 nt, Artificial Sequence
  RNA Oligomer
ggacguacuuuuucaccuucugg

SEQ ID NO: 52963 - RNA, 23 nt, Artificial Sequence
  RNA Oligomer
gacguacuuuuucaccuucuggc

SEQ ID NO: 52964 - RNA, 23 nt, Artificial Sequence
  RNA Oligomer
acguacuuuuucaccuucuggcu

SEQ ID NO: 52965 - RNA, 23 nt, Artificial Sequence
  RNA Oligomer
ccccuuccucacagacauaggcc

SEQ ID NO: 52966 - RNA, 23 nt, Artificial Sequence
  RNA Oligomer
cccuuccucacagacauaggccu

SEQ ID NO: 52967 - RNA, 23 nt, Artificial Sequence
  RNA Oligomer
ccuuccucacagacauaggccug

SEQ ID NO: 52968 - RNA, 23 nt, Artificial Sequence
  RNA Oligomer
cuuccucacagacauaggccuga

SEQ ID NO: 52969 - RNA, 23 nt, Artificial Sequence
  RNA Oligomer
uuccucacagacauaggccugag

SEQ ID NO: 52970 - RNA, 23 nt, Artificial Sequence
  RNA Oligomer
gcacuucagcaaguuuucaaaag

SEQ ID NO: 52971 - RNA, 23 nt, Artificial Sequence
  RNA Oligomer
cacuucagcaaguuuucaaaaga

SEQ ID NO: 52972 - RNA, 23 nt, Artificial Sequence
  RNA Oligomer
acuucagcaaguuuucaaaagac

SEQ ID NO: 52973 - RNA, 23 nt, Artificial Sequence
  RNA Oligomer
cuucagcaaguuuucaaaagacg

SEQ ID NO: 52974 - RNA, 23 nt, Artificial Sequence
  RNA Oligomer
uucagcaaguuuucaaaagacgg

SEQ ID NO: 52975 - RNA, 23 nt, Artificial Sequence
  RNA Oligomer
ucuucuuuaugcucuuccugcag

SEQ ID NO: 52976 - RNA, 23 nt, Artificial Sequence
  RNA Oligomer
cuucuuuaugcucuuccugcaga

SEQ ID NO: 52977 - RNA, 23 nt, Artificial Sequence
  RNA Oligomer
uucuuuaugcucuuccugcagau

SEQ ID NO: 52978 - RNA, 23 nt, Artificial Sequence
  RNA Oligomer
cgucaaccuuauugcugaugucc

SEQ ID NO: 52979 - RNA, 23 nt, Artificial Sequence
  RNA Oligomer
gucaaccuuauugcugauguccu

SEQ ID NO: 52980 - RNA, 23 nt, Artificial Sequence
  RNA Oligomer
ucaaccuuauugcugauguccuc

SEQ ID NO: 52981 - RNA, 23 nt, Artificial Sequence
  RNA Oligomer
uguucuugagcugcuugugccuc

SEQ ID NO: 52982 - RNA, 23 nt, Artificial Sequence
  RNA Oligomer
guucuugagcugcuugugccucu

SEQ ID NO: 52983 - RNA, 23 nt, Artificial Sequence
  RNA Oligomer
ccucuugaugaagagcugcaggu

SEQ ID NO: 52984 - RNA, 23 nt, Artificial Sequence
  RNA Oligomer
cucuugaugaagagcugcaggug

SEQ ID NO: 52985 - RNA, 23 nt, Artificial Sequence
  RNA Oligomer
ucuugaugaagagcugcaggugg

SEQ ID NO: 52986 - RNA, 23 nt, Artificial Sequence
  RNA Oligomer
cuugaugaagagcugcagguggc

SEQ ID NO: 52987 - RNA, 23 nt, Artificial Sequence
  RNA Oligomer
uugaugaagagcugcagguggcu

SEQ ID NO: 52988 - RNA, 23 nt, Artificial Sequence
  RNA Oligomer
ggaacuuuccacaaaauacacgc

SEQ ID NO: 52989 - RNA, 23 nt, Artificial Sequence
  RNA Oligomer
gaacuuuccacaaaauacacgca

SEQ ID NO: 52990 - RNA, 23 nt, Artificial Sequence
  RNA Oligomer
aacuuuccacaaaauacacgcau

SEQ ID NO: 52991 - RNA, 23 nt, Artificial Sequence
  RNA Oligomer
acuuuccacaaaauacacgcauu

SEQ ID NO: 52992 - RNA, 23 nt, Artificial Sequence
  RNA Oligomer
cuuuccacaaaauacacgcauuc

SEQ ID NO: 52993 - RNA, 23 nt, Artificial Sequence
  RNA Oligomer
cuucaucauccgcuucacaauga

SEQ ID NO: 52994 - RNA, 23 nt, Artificial Sequence
  RNA Oligomer
uucaucauccgcuucacaaugau

SEQ ID NO: 52995 - RNA, 23 nt, Artificial Sequence
  RNA Oligomer
ucaucauccgcuucacaaugaug

SEQ ID NO: 52996 - RNA, 23 nt, Artificial Sequence
  RNA Oligomer
caucauccgcuucacaaugauga

SEQ ID NO: 52997 - RNA, 23 nt, Artificial Sequence
  RNA Oligomer
aucauccgcuucacaaugaugau

SEQ ID NO: 52998 - RNA, 23 nt, Artificial Sequence
  RNA Oligomer
ucauccgcuucacaaugaugauc

SEQ ID NO: 52999 - RNA, 23 nt, Artificial Sequence
  RNA Oligomer
cauccgcuucacaaugaugaucu

SEQ ID NO: 53000 - RNA, 23 nt, Artificial Sequence
  RNA Oligomer
auccgcuucacaaugaugaucuu

SEQ ID NO: 53001 - RNA, 23 nt, Artificial Sequence
  RNA Oligomer
cacaaugaugaucuugggcccca

SEQ ID NO: 53002 - RNA, 23 nt, Artificial Sequence
  RNA Oligomer
acaaugaugaucuugggccccag

SEQ ID NO: 53003 - RNA, 23 nt, Artificial Sequence
  RNA Oligomer
gcaguuucugggcucucucuucg

SEQ ID NO: 53004 - RNA, 23 nt, Artificial Sequence
  RNA Oligomer
caguuucugggcucucucuucgu

SEQ ID NO: 53005 - RNA, 23 nt, Artificial Sequence
  RNA Oligomer
aguuucugggcucucucuucguc

SEQ ID NO: 53006 - RNA, 23 nt, Artificial Sequence
  RNA Oligomer
guuucugggcucucucuucgucc

SEQ ID NO: 53007 - RNA, 23 nt, Artificial Sequence
  RNA Oligomer
uuucugggcucucucuucguccu

SEQ ID NO: 53008 - RNA, 23 nt, Artificial Sequence
  RNA Oligomer
caccuccucuuuccuuggucugc

SEQ ID NO: 53009 - RNA, 23 nt, Artificial Sequence
  RNA Oligomer
accuccucuuuccuuggucugcu

SEQ ID NO: 53010 - RNA, 23 nt, Artificial Sequence
  RNA Oligomer
ccuccucuuuccuuggucugcuc

SEQ ID NO: 53011 - RNA, 23 nt, Artificial Sequence
  RNA Oligomer
cuccucuuuccuuggucugcucc

SEQ ID NO: 53012 - RNA, 23 nt, Artificial Sequence
  RNA Oligomer
uccucuuuccuuggucugcuccg

SEQ ID NO: 53013 - RNA, 23 nt, Artificial Sequence
  RNA Oligomer
ccucuuuccuuggucugcuccga

SEQ ID NO: 53014 - RNA, 23 nt, Artificial Sequence
  RNA Oligomer
cucuuuccuuggucugcuccgau

SEQ ID NO: 53015 - RNA, 23 nt, Artificial Sequence
  RNA Oligomer
ucuuuccuuggucugcuccgaua

SEQ ID NO: 53016 - RNA, 23 nt, Artificial Sequence
  RNA Oligomer
cagguuagaguucagccuguuca

SEQ ID NO: 53017 - RNA, 23 nt, Artificial Sequence
  RNA Oligomer
agguuagaguucagccuguucag

SEQ ID NO: 53018 - RNA, 23 nt, Artificial Sequence
  RNA Oligomer
gguuagaguucagccuguucagc

SEQ ID NO: 53019 - RNA, 23 nt, Artificial Sequence
  RNA Oligomer
guuagaguucagccuguucagcu

SEQ ID NO: 53020 - RNA, 23 nt, Artificial Sequence
  RNA Oligomer
uuagaguucagccuguucagcuc

SEQ ID NO: 53021 - RNA, 23 nt, Artificial Sequence
  RNA Oligomer
cguuguacuggaucguggacagu

SEQ ID NO: 53022 - RNA, 23 nt, Artificial Sequence
  RNA Oligomer
guuguacuggaucguggacagug

SEQ ID NO: 53023 - RNA, 23 nt, Artificial Sequence
  RNA Oligomer
uuguacuggaucguggacagugg

SEQ ID NO: 53024 - RNA, 23 nt, Artificial Sequence
  RNA Oligomer
uauugcugauguccucgaucuuc

SEQ ID NO: 53025 - RNA, 23 nt, Artificial Sequence
  RNA Oligomer
auugcugauguccucgaucuucu

SEQ ID NO: 53026 - RNA, 23 nt, Artificial Sequence
  RNA Oligomer
uugcugauguccucgaucuucug

SEQ ID NO: 53027 - RNA, 23 nt, Artificial Sequence
  RNA Oligomer
gcugcuuuugcuggaacugucgg

SEQ ID NO: 53028 - RNA, 23 nt, Artificial Sequence
  RNA Oligomer
cugcuuuugcuggaacugucggu

SEQ ID NO: 53029 - RNA, 23 nt, Artificial Sequence
  RNA Oligomer
ugcuuuugcuggaacugucgguu

SEQ ID NO: 53030 - RNA, 23 nt, Artificial Sequence
  RNA Oligomer
gcuuuugcuggaacugucgguuc

SEQ ID NO: 53031 - RNA, 23 nt, Artificial Sequence
  RNA Oligomer
cuuuugcuggaacugucgguucu

SEQ ID NO: 53032 - RNA, 23 nt, Artificial Sequence
  RNA Oligomer
ccggguugaaguucacaccgucg

SEQ ID NO: 53033 - RNA, 23 nt, Artificial Sequence
  RNA Oligomer
ugaaguucacaccgucgauguag

SEQ ID NO: 53034 - RNA, 23 nt, Artificial Sequence
  RNA Oligomer
gaaguucacaccgucgauguagc

SEQ ID NO: 53035 - RNA, 23 nt, Artificial Sequence
  RNA Oligomer
aaguucacaccgucgauguagcc

SEQ ID NO: 53036 - RNA, 23 nt, Artificial Sequence
  RNA Oligomer
gacguccuucaucauccgcuuca

SEQ ID NO: 53037 - RNA, 23 nt, Artificial Sequence
  RNA Oligomer
acguccuucaucauccgcuucac

SEQ ID NO: 53038 - RNA, 23 nt, Artificial Sequence
  RNA Oligomer
cguccuucaucauccgcuucaca

SEQ ID NO: 53039 - RNA, 23 nt, Artificial Sequence
  RNA Oligomer
guccuucaucauccgcuucacaa

SEQ ID NO: 53040 - RNA, 23 nt, Artificial Sequence
  RNA Oligomer
uccuucaucauccgcuucacaau

SEQ ID NO: 53041 - RNA, 23 nt, Artificial Sequence
  RNA Oligomer
cagaagucacugaaguacaaggc

SEQ ID NO: 53042 - RNA, 23 nt, Artificial Sequence
  RNA Oligomer
agaagucacugaaguacaaggcu

SEQ ID NO: 53043 - RNA, 23 nt, Artificial Sequence
  RNA Oligomer
gaagucacugaaguacaaggcug

SEQ ID NO: 53044 - RNA, 23 nt, Artificial Sequence
  RNA Oligomer
aagucacugaaguacaaggcugc

SEQ ID NO: 53045 - RNA, 23 nt, Artificial Sequence
  RNA Oligomer
agucacugaaguacaaggcugcc

SEQ ID NO: 53046 - RNA, 23 nt, Artificial Sequence
  RNA Oligomer
aaacuucauguccuuggccucca

SEQ ID NO: 53047 - RNA, 23 nt, Artificial Sequence
  RNA Oligomer
aacuucauguccuuggccuccag

SEQ ID NO: 53048 - RNA, 23 nt, Artificial Sequence
  RNA Oligomer
ccaaaugagaaggucacggaugg

SEQ ID NO: 53049 - RNA, 23 nt, Artificial Sequence
  RNA Oligomer
caaaugagaaggucacggauggg

SEQ ID NO: 53050 - RNA, 23 nt, Artificial Sequence
  RNA Oligomer
aaaugagaaggucacggaugggg

SEQ ID NO: 53051 - RNA, 23 nt, Artificial Sequence
  RNA Oligomer
aaugagaaggucacggauggggu

SEQ ID NO: 53052 - RNA, 23 nt, Artificial Sequence
  RNA Oligomer
augagaaggucacggaugggguc

SEQ ID NO: 53053 - RNA, 23 nt, Artificial Sequence
  RNA Oligomer
cuugauguuuucaggaauccacg

SEQ ID NO: 53054 - RNA, 23 nt, Artificial Sequence
  RNA Oligomer
uugauguuuucaggaauccacga

SEQ ID NO: 53055 - RNA, 23 nt, Artificial Sequence
  RNA Oligomer
ugauguuuucaggaauccacgaa

SEQ ID NO: 53056 - RNA, 23 nt, Artificial Sequence
  RNA Oligomer
gauguuuucaggaauccacgaac

SEQ ID NO: 53057 - RNA, 23 nt, Artificial Sequence
  RNA Oligomer
auguuuucaggaauccacgaacu

SEQ ID NO: 53058 - RNA, 23 nt, Artificial Sequence
  RNA Oligomer
uguuuucaggaauccacgaacug

SEQ ID NO: 53059 - RNA, 23 nt, Artificial Sequence
  RNA Oligomer
guuuucaggaauccacgaacuga

SEQ ID NO: 53060 - RNA, 23 nt, Artificial Sequence
  RNA Oligomer
uuuucaggaauccacgaacugag

SEQ ID NO: 53061 - RNA, 23 nt, Artificial Sequence
  RNA Oligomer
ccacucauccaugaagaucucac

SEQ ID NO: 53062 - RNA, 23 nt, Artificial Sequence
  RNA Oligomer
cacucauccaugaagaucucacu

SEQ ID NO: 53063 - RNA, 23 nt, Artificial Sequence
  RNA Oligomer
acucauccaugaagaucucacug

SEQ ID NO: 53064 - RNA, 23 nt, Artificial Sequence
  RNA Oligomer
uuucugcuggaucagggagauag

SEQ ID NO: 53065 - RNA, 23 nt, Artificial Sequence
  RNA Oligomer
uucugcuggaucagggagauagu

SEQ ID NO: 53066 - RNA, 23 nt, Artificial Sequence
  RNA Oligomer
ucugcuggaucagggagauagug

SEQ ID NO: 53067 - RNA, 23 nt, Artificial Sequence
  RNA Oligomer
cugcuggaucagggagauaguga

SEQ ID NO: 53068 - RNA, 23 nt, Artificial Sequence
  RNA Oligomer
ugcuggaucagggagauagugau

SEQ ID NO: 53069 - RNA, 23 nt, Artificial Sequence
  RNA Oligomer
cauccucauccaguauguacucg

SEQ ID NO: 53070 - RNA, 23 nt, Artificial Sequence
  RNA Oligomer
auccucauccaguauguacucgg

SEQ ID NO: 53071 - RNA, 23 nt, Artificial Sequence
  RNA Oligomer
uccucauccaguauguacucggc

SEQ ID NO: 53072 - RNA, 23 nt, Artificial Sequence
  RNA Oligomer
ccucauccaguauguacucggcg

SEQ ID NO: 53073 - RNA, 23 nt, Artificial Sequence
  RNA Oligomer
cucauccaguauguacucggcgg

SEQ ID NO: 53074 - RNA, 23 nt, Artificial Sequence
  RNA Oligomer
ugcuugucauuguugccgaaggg

SEQ ID NO: 53075 - RNA, 23 nt, Artificial Sequence
  RNA Oligomer
ggagacucggacguacuuuuuca

SEQ ID NO: 53076 - RNA, 23 nt, Artificial Sequence
  RNA Oligomer
gagacucggacguacuuuuucac

SEQ ID NO: 53077 - RNA, 23 nt, Artificial Sequence
  RNA Oligomer
agacucggacguacuuuuucacc

SEQ ID NO: 53078 - RNA, 23 nt, Artificial Sequence
  RNA Oligomer
gacucggacguacuuuuucaccu

SEQ ID NO: 53079 - RNA, 23 nt, Artificial Sequence
  RNA Oligomer
acucggacguacuuuuucaccuu

SEQ ID NO: 53080 - RNA, 23 nt, Artificial Sequence
  RNA Oligomer
cucggacguacuuuuucaccuuc

SEQ ID NO: 53081 - RNA, 23 nt, Artificial Sequence
  RNA Oligomer
uaggaaaaugaagacagggagcu

SEQ ID NO: 53082 - RNA, 23 nt, Artificial Sequence
  RNA Oligomer
aggaaaaugaagacagggagcug

SEQ ID NO: 53083 - RNA, 23 nt, Artificial Sequence
  RNA Oligomer
ggaaaaugaagacagggagcuga

SEQ ID NO: 53084 - RNA, 23 nt, Artificial Sequence
  RNA Oligomer
gaaaaugaagacagggagcugau

SEQ ID NO: 53085 - RNA, 23 nt, Artificial Sequence
  RNA Oligomer
aaaaugaagacagggagcugaug

SEQ ID NO: 53086 - RNA, 23 nt, Artificial Sequence
  RNA Oligomer
gccccuuccucacagacauaggc

SEQ ID NO: 53087 - RNA, 23 nt, Artificial Sequence
  RNA Oligomer
ccccuuccaguucaugaggucau

SEQ ID NO: 53088 - RNA, 23 nt, Artificial Sequence
  RNA Oligomer
cccuuccaguucaugaggucauc

SEQ ID NO: 53089 - RNA, 23 nt, Artificial Sequence
  RNA Oligomer
ccuuccaguucaugaggucaucu

SEQ ID NO: 53090 - RNA, 23 nt, Artificial Sequence
  RNA Oligomer
cuuccaguucaugaggucaucug

SEQ ID NO: 53091 - RNA, 23 nt, Artificial Sequence
  RNA Oligomer
uuccaguucaugaggucaucugc

SEQ ID NO: 53092 - RNA, 23 nt, Artificial Sequence
  RNA Oligomer
ccaguucaugaggucaucugcag

SEQ ID NO: 53093 - RNA, 23 nt, Artificial Sequence
  RNA Oligomer
caguucaugaggucaucugcagc

SEQ ID NO: 53094 - RNA, 23 nt, Artificial Sequence
  RNA Oligomer
aguucaugaggucaucugcagca

SEQ ID NO: 53095 - RNA, 23 nt, Artificial Sequence
  RNA Oligomer
guucaugaggucaucugcagcag

SEQ ID NO: 53096 - RNA, 23 nt, Artificial Sequence
  RNA Oligomer
uucaugaggucaucugcagcaga

SEQ ID NO: 53097 - RNA, 23 nt, Artificial Sequence
  RNA Oligomer
ccuguucagcuccacgucauucu

SEQ ID NO: 53098 - RNA, 23 nt, Artificial Sequence
  RNA Oligomer
cuguucagcuccacgucauucug

SEQ ID NO: 53099 - RNA, 23 nt, Artificial Sequence
  RNA Oligomer
uguucagcuccacgucauucugg

SEQ ID NO: 53100 - RNA, 23 nt, Artificial Sequence
  RNA Oligomer
guucagcuccacgucauucuggu

SEQ ID NO: 53101 - RNA, 23 nt, Artificial Sequence
  RNA Oligomer
uucagcuccacgucauucugguc

SEQ ID NO: 53102 - RNA, 23 nt, Artificial Sequence
  RNA Oligomer
gugggucauagaucaggaacucc

SEQ ID NO: 53103 - RNA, 23 nt, Artificial Sequence
  RNA Oligomer
ugggucauagaucaggaacuccg

SEQ ID NO: 53104 - RNA, 23 nt, Artificial Sequence
  RNA Oligomer
gggucauagaucaggaacuccgu

SEQ ID NO: 53105 - RNA, 23 nt, Artificial Sequence
  RNA Oligomer
ggucauagaucaggaacuccguc

SEQ ID NO: 53106 - RNA, 23 nt, Artificial Sequence
  RNA Oligomer
gucauagaucaggaacuccgucu

SEQ ID NO: 53107 - RNA, 23 nt, Artificial Sequence
  RNA Oligomer
guaguugaacauggcgaugagga

SEQ ID NO: 53108 - RNA, 23 nt, Artificial Sequence
  RNA Oligomer
uaguugaacauggcgaugaggag

SEQ ID NO: 53109 - RNA, 23 nt, Artificial Sequence
  RNA Oligomer
aguugaacauggcgaugaggagg

SEQ ID NO: 53110 - RNA, 23 nt, Artificial Sequence
  RNA Oligomer
aguucacaccgucgauguagccc

SEQ ID NO: 53111 - RNA, 23 nt, Artificial Sequence
  RNA Oligomer
guucacaccgucgauguagcccg

SEQ ID NO: 53112 - RNA, 23 nt, Artificial Sequence
  RNA Oligomer
uucacaccgucgauguagcccgg

SEQ ID NO: 53113 - RNA, 23 nt, Artificial Sequence
  RNA Oligomer
uuuccacaaaauacacgcauucu

SEQ ID NO: 53114 - RNA, 23 nt, Artificial Sequence
  RNA Oligomer
uccgcuucacaaugaugaucuug

SEQ ID NO: 53115 - RNA, 23 nt, Artificial Sequence
  RNA Oligomer
uacacgcauucuuucuucuugau

SEQ ID NO: 53116 - RNA, 23 nt, Artificial Sequence
  RNA Oligomer
acuucauguccuuggccuccagg

SEQ ID NO: 53117 - RNA, 23 nt, Artificial Sequence
  RNA Oligomer
cuucauguccuuggccuccaggg

SEQ ID NO: 53118 - RNA, 23 nt, Artificial Sequence
  RNA Oligomer
uucauguccuuggccuccagggc

SEQ ID NO: 53119 - RNA, 23 nt, Artificial Sequence
  RNA Oligomer
ggacaauggcccaaaugagaagg

SEQ ID NO: 53120 - RNA, 23 nt, Artificial Sequence
  RNA Oligomer
gacaauggcccaaaugagaaggu

SEQ ID NO: 53121 - RNA, 23 nt, Artificial Sequence
  RNA Oligomer
acaauggcccaaaugagaagguc

SEQ ID NO: 53122 - RNA, 23 nt, Artificial Sequence
  RNA Oligomer
caauggcccaaaugagaagguca

SEQ ID NO: 53123 - RNA, 23 nt, Artificial Sequence
  RNA Oligomer
aauggcccaaaugagaaggucac

SEQ ID NO: 53124 - RNA, 23 nt, Artificial Sequence
  RNA Oligomer
guucucguacagguagagcaagg

SEQ ID NO: 53125 - RNA, 23 nt, Artificial Sequence
  RNA Oligomer
uucucguacagguagagcaaggu

SEQ ID NO: 53126 - RNA, 23 nt, Artificial Sequence
  RNA Oligomer
ucucguacagguagagcaaggug

SEQ ID NO: 53127 - RNA, 23 nt, Artificial Sequence
  RNA Oligomer
gcagaucugaaggcuuccacugc

SEQ ID NO: 53128 - RNA, 23 nt, Artificial Sequence
  RNA Oligomer
cagaucugaaggcuuccacugcc

SEQ ID NO: 53129 - RNA, 23 nt, Artificial Sequence
  RNA Oligomer
agaucugaaggcuuccacugcca

SEQ ID NO: 53130 - RNA, 23 nt, Artificial Sequence
  RNA Oligomer
gaucugaaggcuuccacugccac

SEQ ID NO: 53131 - RNA, 23 nt, Artificial Sequence
  RNA Oligomer
aucugaaggcuuccacugccacu

SEQ ID NO: 53132 - RNA, 23 nt, Artificial Sequence
  RNA Oligomer
gacgauaucuuggaucuuuuugg

SEQ ID NO: 53133 - RNA, 23 nt, Artificial Sequence
  RNA Oligomer
acgauaucuuggaucuuuuuggu

SEQ ID NO: 53134 - RNA, 23 nt, Artificial Sequence
  RNA Oligomer
cgauaucuuggaucuuuuugguc

SEQ ID NO: 53135 - RNA, 23 nt, Artificial Sequence
  RNA Oligomer
gauaucuuggaucuuuuuggucc

SEQ ID NO: 53136 - RNA, 23 nt, Artificial Sequence
  RNA Oligomer
auaucuuggaucuuuuuggucca

SEQ ID NO: 53137 - RNA, 23 nt, Artificial Sequence
  RNA Oligomer
uggaucuuuuugguccacucgac

SEQ ID NO: 53138 - RNA, 23 nt, Artificial Sequence
  RNA Oligomer
ggaucuuuuugguccacucgaca

SEQ ID NO: 53139 - RNA, 23 nt, Artificial Sequence
  RNA Oligomer
gaucuuuuugguccacucgacaa

SEQ ID NO: 53140 - RNA, 23 nt, Artificial Sequence
  RNA Oligomer
aucuuuuugguccacucgacaau

SEQ ID NO: 53141 - RNA, 23 nt, Artificial Sequence
  RNA Oligomer
ucuuuuugguccacucgacaauc

SEQ ID NO: 53142 - RNA, 23 nt, Artificial Sequence
  RNA Oligomer
cgacaauccugcuuuccgugaag

SEQ ID NO: 53143 - RNA, 23 nt, Artificial Sequence
  RNA Oligomer
gacaauccugcuuuccgugaagg

SEQ ID NO: 53144 - RNA, 23 nt, Artificial Sequence
  RNA Oligomer
acaauccugcuuuccgugaaggu

SEQ ID NO: 53145 - RNA, 23 nt, Artificial Sequence
  RNA Oligomer
caauccugcuuuccgugaagguc

SEQ ID NO: 53146 - RNA, 23 nt, Artificial Sequence
  RNA Oligomer
aauccugcuuuccgugaaggucu

SEQ ID NO: 53147 - RNA, 23 nt, Artificial Sequence
  RNA Oligomer
ggcguugucgauggugugcaacg

SEQ ID NO: 53148 - RNA, 23 nt, Artificial Sequence
  RNA Oligomer
gcguugucgauggugugcaacgu

SEQ ID NO: 53149 - RNA, 23 nt, Artificial Sequence
  RNA Oligomer
cguugucgauggugugcaacgug

SEQ ID NO: 53150 - RNA, 23 nt, Artificial Sequence
  RNA Oligomer
guugucgauggugugcaacgugc

SEQ ID NO: 53151 - RNA, 23 nt, Artificial Sequence
  RNA Oligomer
uugucgauggugugcaacgugcc

SEQ ID NO: 53152 - RNA, 23 nt, Artificial Sequence
  RNA Oligomer
uggccacaccuccucuuuccuug

SEQ ID NO: 53153 - RNA, 23 nt, Artificial Sequence
  RNA Oligomer
ggccacaccuccucuuuccuugg

SEQ ID NO: 53154 - RNA, 23 nt, Artificial Sequence
  RNA Oligomer
gccacaccuccucuuuccuuggu

SEQ ID NO: 53155 - RNA, 23 nt, Artificial Sequence
  RNA Oligomer
ccacaccuccucuuuccuugguc

SEQ ID NO: 53156 - RNA, 23 nt, Artificial Sequence
  RNA Oligomer
cacaccuccucuuuccuuggucu

SEQ ID NO: 53157 - RNA, 23 nt, Artificial Sequence
  RNA Oligomer
cggcuucauguugaaguucuugg

SEQ ID NO: 53158 - RNA, 23 nt, Artificial Sequence
  RNA Oligomer
ggcuucauguugaaguucuuggc

SEQ ID NO: 53159 - RNA, 23 nt, Artificial Sequence
  RNA Oligomer
gcuucauguugaaguucuuggcc

SEQ ID NO: 53160 - RNA, 23 nt, Artificial Sequence
  RNA Oligomer
cuucauguugaaguucuuggccc

SEQ ID NO: 53161 - RNA, 23 nt, Artificial Sequence
  RNA Oligomer
uucauguugaaguucuuggcccc

SEQ ID NO: 53162 - RNA, 23 nt, Artificial Sequence
  RNA Oligomer
ccagguuuaggaaaaugaagaca

SEQ ID NO: 53163 - RNA, 23 nt, Artificial Sequence
  RNA Oligomer
aggcgugcagguuagaguucagc

SEQ ID NO: 53164 - RNA, 23 nt, Artificial Sequence
  RNA Oligomer
ggcgugcagguuagaguucagcc

SEQ ID NO: 53165 - RNA, 23 nt, Artificial Sequence
  RNA Oligomer
gcgugcagguuagaguucagccu

SEQ ID NO: 53166 - RNA, 23 nt, Artificial Sequence
  RNA Oligomer
cgugcagguuagaguucagccug

SEQ ID NO: 53167 - RNA, 23 nt, Artificial Sequence
  RNA Oligomer
gugcagguuagaguucagccugu

SEQ ID NO: 53168 - RNA, 23 nt, Artificial Sequence
  RNA Oligomer
ucagcaaguuuucaaaagacggc

SEQ ID NO: 53169 - RNA, 23 nt, Artificial Sequence
  RNA Oligomer
cagcaaguuuucaaaagacggcc

SEQ ID NO: 53170 - RNA, 23 nt, Artificial Sequence
  RNA Oligomer
ggcgucaaccuuauugcugaugu

SEQ ID NO: 53171 - RNA, 23 nt, Artificial Sequence
  RNA Oligomer
gcgucaaccuuauugcugauguc

SEQ ID NO: 53172 - RNA, 23 nt, Artificial Sequence
  RNA Oligomer
cuccucguucuucuccagcuugu

SEQ ID NO: 53173 - RNA, 23 nt, Artificial Sequence
  RNA Oligomer
uccucguucuucuccagcuuguu

SEQ ID NO: 53174 - RNA, 23 nt, Artificial Sequence
  RNA Oligomer
ccucguucuucuccagcuuguuc

SEQ ID NO: 53175 - RNA, 23 nt, Artificial Sequence
  RNA Oligomer
cucguucuucuccagcuuguucu

SEQ ID NO: 53176 - RNA, 23 nt, Artificial Sequence
  RNA Oligomer
ucguucuucuccagcuuguucuu

SEQ ID NO: 53177 - RNA, 23 nt, Artificial Sequence
  RNA Oligomer
uggaacuuuccacaaaauacacg

SEQ ID NO: 53178 - RNA, 23 nt, Artificial Sequence
  RNA Oligomer
agacguccuucaucauccgcuuc

SEQ ID NO: 53179 - RNA, 23 nt, Artificial Sequence
  RNA Oligomer
caaugaugaucuugggccccagc

SEQ ID NO: 53180 - RNA, 23 nt, Artificial Sequence
  RNA Oligomer
cacaaaauacacgcauucuuucu

SEQ ID NO: 53181 - RNA, 23 nt, Artificial Sequence
  RNA Oligomer
acaaaauacacgcauucuuucuu

SEQ ID NO: 53182 - RNA, 23 nt, Artificial Sequence
  RNA Oligomer
ccagaagucacugaaguacaagg

SEQ ID NO: 53183 - RNA, 23 nt, Artificial Sequence
  RNA Oligomer
uggcucugugcucauacuccucc

SEQ ID NO: 53184 - RNA, 23 nt, Artificial Sequence
  RNA Oligomer
ggcucugugcucauacuccuccg

SEQ ID NO: 53185 - RNA, 23 nt, Artificial Sequence
  RNA Oligomer
gcucugugcucauacuccuccgc

SEQ ID NO: 53186 - RNA, 23 nt, Artificial Sequence
  RNA Oligomer
cucugugcucauacuccuccgcc

SEQ ID NO: 53187 - RNA, 23 nt, Artificial Sequence
  RNA Oligomer
ucugugcucauacuccuccgcca

SEQ ID NO: 53188 - RNA, 23 nt, Artificial Sequence
  RNA Oligomer
ucuugauguuuucaggaauccac

SEQ ID NO: 53189 - RNA, 23 nt, Artificial Sequence
  RNA Oligomer
cuucacaaacucaggcuuguugg

SEQ ID NO: 53190 - RNA, 23 nt, Artificial Sequence
  RNA Oligomer
uucacaaacucaggcuuguugga

SEQ ID NO: 53191 - RNA, 23 nt, Artificial Sequence
  RNA Oligomer
ucacaaacucaggcuuguuggag

SEQ ID NO: 53192 - RNA, 23 nt, Artificial Sequence
  RNA Oligomer
cacaaacucaggcuuguuggaga

SEQ ID NO: 53193 - RNA, 23 nt, Artificial Sequence
  RNA Oligomer
acaaacucaggcuuguuggagau

SEQ ID NO: 53194 - RNA, 23 nt, Artificial Sequence
  RNA Oligomer
ucaggaauccacgaacugaggcu

SEQ ID NO: 53195 - RNA, 23 nt, Artificial Sequence
  RNA Oligomer
caggaauccacgaacugaggcuu

SEQ ID NO: 53196 - RNA, 23 nt, Artificial Sequence
  RNA Oligomer
aggaauccacgaacugaggcuuu

SEQ ID NO: 53197 - RNA, 23 nt, Artificial Sequence
  RNA Oligomer
ggaauccacgaacugaggcuuuc

SEQ ID NO: 53198 - RNA, 23 nt, Artificial Sequence
  RNA Oligomer
gaauccacgaacugaggcuuucu

SEQ ID NO: 53199 - RNA, 23 nt, Artificial Sequence
  RNA Oligomer
uuggaucuuuuugguccacucga

SEQ ID NO: 53200 - RNA, 23 nt, Artificial Sequence
  RNA Oligomer
acaccuccucuuuccuuggucug

SEQ ID NO: 53201 - RNA, 23 nt, Artificial Sequence
  RNA Oligomer
cgauaugaacuucuccagccugg

SEQ ID NO: 53202 - RNA, 23 nt, Artificial Sequence
  RNA Oligomer
gauaugaacuucuccagccuggu

SEQ ID NO: 53203 - RNA, 23 nt, Artificial Sequence
  RNA Oligomer
auaugaacuucuccagccugguc

SEQ ID NO: 53204 - RNA, 23 nt, Artificial Sequence
  RNA Oligomer
uaugaacuucuccagccuggucc

SEQ ID NO: 53205 - RNA, 23 nt, Artificial Sequence
  RNA Oligomer
augaacuucuccagccugguccu

SEQ ID NO: 53206 - RNA, 23 nt, Artificial Sequence
  RNA Oligomer
cgaggaugaagugagagugguug

SEQ ID NO: 53207 - RNA, 23 nt, Artificial Sequence
  RNA Oligomer
ggcuuucuugcuugucauuguug

SEQ ID NO: 53208 - RNA, 23 nt, Artificial Sequence
  RNA Oligomer
gcccagguuuaggaaaaugaaga

SEQ ID NO: 53209 - RNA, 23 nt, Artificial Sequence
  RNA Oligomer
cccagguuuaggaaaaugaagac

SEQ ID NO: 53210 - RNA, 23 nt, Artificial Sequence
  RNA Oligomer
uggcaucuccuggacauguuucu

SEQ ID NO: 53211 - RNA, 23 nt, Artificial Sequence
  RNA Oligomer
ggcaucuccuggacauguuucuu

SEQ ID NO: 53212 - RNA, 23 nt, Artificial Sequence
  RNA Oligomer
gcaucuccuggacauguuucuuu

SEQ ID NO: 53213 - RNA, 23 nt, Artificial Sequence
  RNA Oligomer
caucuccuggacauguuucuuug

SEQ ID NO: 53214 - RNA, 23 nt, Artificial Sequence
  RNA Oligomer
aucuccuggacauguuucuuugg

SEQ ID NO: 53215 - RNA, 23 nt, Artificial Sequence
  RNA Oligomer
gcuguugacaccaaaccagaagg

SEQ ID NO: 53216 - RNA, 23 nt, Artificial Sequence
  RNA Oligomer
cuguugacaccaaaccagaaggc

SEQ ID NO: 53217 - RNA, 23 nt, Artificial Sequence
  RNA Oligomer
uguugacaccaaaccagaaggcc

SEQ ID NO: 53218 - RNA, 23 nt, Artificial Sequence
  RNA Oligomer
guugacaccaaaccagaaggccc

SEQ ID NO: 53219 - RNA, 23 nt, Artificial Sequence
  RNA Oligomer
uugacaccaaaccagaaggcccc

SEQ ID NO: 53220 - RNA, 23 nt, Artificial Sequence
  RNA Oligomer
accgucucgauccaggcauuguc

SEQ ID NO: 53221 - RNA, 23 nt, Artificial Sequence
  RNA Oligomer
ccgucucgauccaggcauugucc

SEQ ID NO: 53222 - RNA, 23 nt, Artificial Sequence
  RNA Oligomer
cgucucgauccaggcauuguccg

SEQ ID NO: 53223 - RNA, 23 nt, Artificial Sequence
  RNA Oligomer
gucucgauccaggcauuguccgu

SEQ ID NO: 53224 - RNA, 23 nt, Artificial Sequence
  RNA Oligomer
ucucgauccaggcauuguccgug

SEQ ID NO: 53225 - RNA, 23 nt, Artificial Sequence
  RNA Oligomer
cgggucauccauguagccuuugu

SEQ ID NO: 53226 - RNA, 23 nt, Artificial Sequence
  RNA Oligomer
gggucauccauguagccuuugua

SEQ ID NO: 53227 - RNA, 23 nt, Artificial Sequence
  RNA Oligomer
ggucauccauguagccuuuguac

SEQ ID NO: 53228 - RNA, 23 nt, Artificial Sequence
  RNA Oligomer
gucauccauguagccuuuguaca

SEQ ID NO: 53229 - RNA, 23 nt, Artificial Sequence
  RNA Oligomer
ucauccauguagccuuuguacac

SEQ ID NO: 53230 - RNA, 23 nt, Artificial Sequence
  RNA Oligomer
cauccauguagccuuuguacacc

SEQ ID NO: 53231 - RNA, 23 nt, Artificial Sequence
  RNA Oligomer
auccauguagccuuuguacaccu

SEQ ID NO: 53232 - RNA, 23 nt, Artificial Sequence
  RNA Oligomer
cauguagccuuuguacaccucca

SEQ ID NO: 53233 - RNA, 23 nt, Artificial Sequence
  RNA Oligomer
auguagccuuuguacaccuccau

SEQ ID NO: 53234 - RNA, 23 nt, Artificial Sequence
  RNA Oligomer
uguagccuuuguacaccuccaug

SEQ ID NO: 53235 - RNA, 23 nt, Artificial Sequence
  RNA Oligomer
guagccuuuguacaccuccaugc

SEQ ID NO: 53236 - RNA, 23 nt, Artificial Sequence
  RNA Oligomer
uagccuuuguacaccuccaugcc

SEQ ID NO: 53237 - RNA, 23 nt, Artificial Sequence
  RNA Oligomer
agccuuuguacaccuccaugccg

SEQ ID NO: 53238 - RNA, 23 nt, Artificial Sequence
  RNA Oligomer
gccuuuguacaccuccaugccgc

SEQ ID NO: 53239 - RNA, 23 nt, Artificial Sequence
  RNA Oligomer
ccuuuguacaccuccaugccgca

SEQ ID NO: 53240 - RNA, 23 nt, Artificial Sequence
  RNA Oligomer
cuuuguacaccuccaugccgcac

SEQ ID NO: 53241 - RNA, 23 nt, Artificial Sequence
  RNA Oligomer
uuuguacaccuccaugccgcacu

SEQ ID NO: 53242 - RNA, 23 nt, Artificial Sequence
  RNA Oligomer
ugcugauguccucgaucuucugc

SEQ ID NO: 53243 - RNA, 23 nt, Artificial Sequence
  RNA Oligomer
gcugauguccucgaucuucugcu

SEQ ID NO: 53244 - RNA, 23 nt, Artificial Sequence
  RNA Oligomer
cugauguccucgaucuucugcuc

SEQ ID NO: 53245 - RNA, 23 nt, Artificial Sequence
  RNA Oligomer
cagguagaggcagaguaggagga

SEQ ID NO: 53246 - RNA, 23 nt, Artificial Sequence
  RNA Oligomer
agguagaggcagaguaggaggac

SEQ ID NO: 53247 - RNA, 23 nt, Artificial Sequence
  RNA Oligomer
gguagaggcagaguaggaggacc

SEQ ID NO: 53248 - RNA, 23 nt, Artificial Sequence
  RNA Oligomer
guagaggcagaguaggaggaccg

SEQ ID NO: 53249 - RNA, 23 nt, Artificial Sequence
  RNA Oligomer
uagaggcagaguaggaggaccgu

SEQ ID NO: 53250 - RNA, 23 nt, Artificial Sequence
  RNA Oligomer
acacgcauucuuucuucuugaug

SEQ ID NO: 53251 - RNA, 23 nt, Artificial Sequence
  RNA Oligomer
cacgcauucuuucuucuugaugu

SEQ ID NO: 53252 - RNA, 23 nt, Artificial Sequence
  RNA Oligomer
uuucaggaauccacgaacugagg

SEQ ID NO: 53253 - RNA, 23 nt, Artificial Sequence
  RNA Oligomer
cugccacucauccaugaagaucu

SEQ ID NO: 53254 - RNA, 23 nt, Artificial Sequence
  RNA Oligomer
ugccacucauccaugaagaucuc

SEQ ID NO: 53255 - RNA, 23 nt, Artificial Sequence
  RNA Oligomer
gccacucauccaugaagaucuca

SEQ ID NO: 53256 - RNA, 23 nt, Artificial Sequence
  RNA Oligomer
ucuccuggaagaacacgcucagu

SEQ ID NO: 53257 - RNA, 23 nt, Artificial Sequence
  RNA Oligomer
ggccauccucauccaguauguac

SEQ ID NO: 53258 - RNA, 23 nt, Artificial Sequence
  RNA Oligomer
gccauccucauccaguauguacu

SEQ ID NO: 53259 - RNA, 23 nt, Artificial Sequence
  RNA Oligomer
ccauccucauccaguauguacuc

SEQ ID NO: 53260 - RNA, 23 nt, Artificial Sequence
  RNA Oligomer
cugggucaugaggugguagauca

SEQ ID NO: 53261 - RNA, 23 nt, Artificial Sequence
  RNA Oligomer
ugggucaugaggugguagaucac

SEQ ID NO: 53262 - RNA, 23 nt, Artificial Sequence
  RNA Oligomer
gggucaugaggugguagaucacg

SEQ ID NO: 53263 - RNA, 23 nt, Artificial Sequence
  RNA Oligomer
ggucaugaggugguagaucacgc

SEQ ID NO: 53264 - RNA, 23 nt, Artificial Sequence
  RNA Oligomer
gucaugaggugguagaucacgcu

SEQ ID NO: 53265 - RNA, 23 nt, Artificial Sequence
  RNA Oligomer
ggacgugucaggaacuuuauuug

SEQ ID NO: 53266 - RNA, 23 nt, Artificial Sequence
  RNA Oligomer
gacgugucaggaacuuuauuugu

SEQ ID NO: 53267 - RNA, 23 nt, Artificial Sequence
  RNA Oligomer
acgugucaggaacuuuauuugug

SEQ ID NO: 53268 - RNA, 23 nt, Artificial Sequence
  RNA Oligomer
cgugucaggaacuuuauuugugg

SEQ ID NO: 53269 - RNA, 23 nt, Artificial Sequence
  RNA Oligomer
gugucaggaacuuuauuugugga

SEQ ID NO: 53270 - RNA, 23 nt, Artificial Sequence
  RNA Oligomer
caggaacuuuauuuguggaaagc

SEQ ID NO: 53271 - RNA, 23 nt, Artificial Sequence
  RNA Oligomer
aggaacuuuauuuguggaaagca

SEQ ID NO: 53272 - RNA, 23 nt, Artificial Sequence
  RNA Oligomer
ggaacuuuauuuguggaaagcac

SEQ ID NO: 53273 - RNA, 23 nt, Artificial Sequence
  RNA Oligomer
gaacuuuauuuguggaaagcaca

SEQ ID NO: 53274 - RNA, 23 nt, Artificial Sequence
  RNA Oligomer
aacuuuauuuguggaaagcacag

SEQ ID NO: 53275 - RNA, 23 nt, Artificial Sequence
  RNA Oligomer
ccauguagccuuuguacaccucc

SEQ ID NO: 53276 - RNA, 23 nt, Artificial Sequence
  RNA Oligomer
gcaucagacaguuuggaacuuuc

SEQ ID NO: 53277 - RNA, 23 nt, Artificial Sequence
  RNA Oligomer
caucagacaguuuggaacuuucc

SEQ ID NO: 53278 - RNA, 23 nt, Artificial Sequence
  RNA Oligomer
aucagacaguuuggaacuuucca

SEQ ID NO: 53279 - RNA, 23 nt, Artificial Sequence
  RNA Oligomer
ucagacaguuuggaacuuuccac

SEQ ID NO: 53280 - RNA, 23 nt, Artificial Sequence
  RNA Oligomer
cagacaguuuggaacuuuccaca

SEQ ID NO: 53281 - RNA, 23 nt, Artificial Sequence
  RNA Oligomer
cguucuucuccagcuuguucuug

SEQ ID NO: 53282 - RNA, 23 nt, Artificial Sequence
  RNA Oligomer
guucuucuccagcuuguucuuga

SEQ ID NO: 53283 - RNA, 23 nt, Artificial Sequence
  RNA Oligomer
uucuucuccagcuuguucuugag

SEQ ID NO: 53284 - RNA, 23 nt, Artificial Sequence
  RNA Oligomer
cuuccaaaucugguccgugugcu

SEQ ID NO: 53285 - RNA, 23 nt, Artificial Sequence
  RNA Oligomer
uuccaaaucugguccgugugcuc

SEQ ID NO: 53286 - RNA, 23 nt, Artificial Sequence
  RNA Oligomer
uccaaaucugguccgugugcucc

SEQ ID NO: 53287 - RNA, 23 nt, Artificial Sequence
  RNA Oligomer
ccaaaucugguccgugugcuccu

SEQ ID NO: 53288 - RNA, 23 nt, Artificial Sequence
  RNA Oligomer
caaaucugguccgugugcuccug

SEQ ID NO: 53289 - RNA, 23 nt, Artificial Sequence
  RNA Oligomer
aaaucugguccgugugcuccugc

SEQ ID NO: 53290 - RNA, 23 nt, Artificial Sequence
  RNA Oligomer
uuggaacuuuccacaaaauacac

SEQ ID NO: 53291 - RNA, 23 nt, Artificial Sequence
  RNA Oligomer
gaagauggugagguaggaguggu

SEQ ID NO: 53292 - RNA, 23 nt, Artificial Sequence
  RNA Oligomer
aagauggugagguaggaguggua

SEQ ID NO: 53293 - RNA, 23 nt, Artificial Sequence
  RNA Oligomer
agauggugagguaggagugguag

SEQ ID NO: 53294 - RNA, 23 nt, Artificial Sequence
  RNA Oligomer
gauggugagguaggagugguaga

SEQ ID NO: 53295 - RNA, 23 nt, Artificial Sequence
  RNA Oligomer
auggugagguaggagugguagac

SEQ ID NO: 53296 - RNA, 23 nt, Artificial Sequence
  RNA Oligomer
ccacaaaauacacgcauucuuuc

SEQ ID NO: 53297 - RNA, 23 nt, Artificial Sequence
  RNA Oligomer
ugccuucuucaucagcccgcacu

SEQ ID NO: 53298 - RNA, 23 nt, Artificial Sequence
  RNA Oligomer
gccuucuucaucagcccgcacuc

SEQ ID NO: 53299 - RNA, 23 nt, Artificial Sequence
  RNA Oligomer
ccuucuucaucagcccgcacucg

SEQ ID NO: 53300 - RNA, 23 nt, Artificial Sequence
  RNA Oligomer
cuucuucaucagcccgcacucgu

SEQ ID NO: 53301 - RNA, 23 nt, Artificial Sequence
  RNA Oligomer
uucuucaucagcccgcacucguc

SEQ ID NO: 53302 - RNA, 23 nt, Artificial Sequence
  RNA Oligomer
ggugcagaucugaaggcuuccac

SEQ ID NO: 53303 - RNA, 23 nt, Artificial Sequence
  RNA Oligomer
gugcagaucugaaggcuuccacu

SEQ ID NO: 53304 - RNA, 23 nt, Artificial Sequence
  RNA Oligomer
ugcagaucugaaggcuuccacug

SEQ ID NO: 53305 - RNA, 23 nt, Artificial Sequence
  RNA Oligomer
aauccacgaacugaggcuuucuu

SEQ ID NO: 53306 - RNA, 23 nt, Artificial Sequence
  RNA Oligomer
uccacucgacaauccugcuuucc

SEQ ID NO: 53307 - RNA, 23 nt, Artificial Sequence
  RNA Oligomer
ccacucgacaauccugcuuuccg

SEQ ID NO: 53308 - RNA, 23 nt, Artificial Sequence
  RNA Oligomer
cacucgacaauccugcuuuccgu

SEQ ID NO: 53309 - RNA, 23 nt, Artificial Sequence
  RNA Oligomer
acucgacaauccugcuuuccgug

SEQ ID NO: 53310 - RNA, 23 nt, Artificial Sequence
  RNA Oligomer
cucgacaauccugcuuuccguga

SEQ ID NO: 53311 - RNA, 23 nt, Artificial Sequence
  RNA Oligomer
ucgacaauccugcuuuccgugaa

SEQ ID NO: 53312 - RNA, 23 nt, Artificial Sequence
  RNA Oligomer
aggucucaaacaucuccuggaag

SEQ ID NO: 53313 - RNA, 23 nt, Artificial Sequence
  RNA Oligomer
ggucucaaacaucuccuggaaga

SEQ ID NO: 53314 - RNA, 23 nt, Artificial Sequence
  RNA Oligomer
gucucaaacaucuccuggaagaa

SEQ ID NO: 53315 - RNA, 23 nt, Artificial Sequence
  RNA Oligomer
cucaaacaucuccuggaagaaca

SEQ ID NO: 53316 - RNA, 23 nt, Artificial Sequence
  RNA Oligomer
ucaaacaucuccuggaagaacac

SEQ ID NO: 53317 - RNA, 23 nt, Artificial Sequence
  RNA Oligomer
caaacaucuccuggaagaacacg

SEQ ID NO: 53318 - RNA, 23 nt, Artificial Sequence
  RNA Oligomer
uggucugcuccgauaugaacuuc

SEQ ID NO: 53319 - RNA, 23 nt, Artificial Sequence
  RNA Oligomer
ggucugcuccgauaugaacuucu

SEQ ID NO: 53320 - RNA, 23 nt, Artificial Sequence
  RNA Oligomer
gucugcuccgauaugaacuucuc

SEQ ID NO: 53321 - RNA, 23 nt, Artificial Sequence
  RNA Oligomer
ucugcuccgauaugaacuucucc

SEQ ID NO: 53322 - RNA, 23 nt, Artificial Sequence
  RNA Oligomer
cugcuccgauaugaacuucucca

SEQ ID NO: 53323 - RNA, 23 nt, Artificial Sequence
  RNA Oligomer
uuccaugccacugccaguuucag

SEQ ID NO: 53324 - RNA, 23 nt, Artificial Sequence
  RNA Oligomer
auuccaugccacugccaguuuca

SEQ ID NO: 53325 - RNA, 23 nt, Artificial Sequence
  RNA Oligomer
cuuuuugguccacucgacaaucc

SEQ ID NO: 53326 - RNA, 23 nt, Artificial Sequence
  RNA Oligomer
uccacgaacugaggcuuucuugc

SEQ ID NO: 53327 - RNA, 23 nt, Artificial Sequence
  RNA Oligomer
cuuuaugcucuuccugcagaugg

SEQ ID NO: 53328 - RNA, 23 nt, Artificial Sequence
  RNA Oligomer
gauuccaugccacugccaguuuc

SEQ ID NO: 53329 - RNA, 23 nt, Artificial Sequence
  RNA Oligomer
uuuugguccacucgacaauccug

SEQ ID NO: 53330 - RNA, 23 nt, Artificial Sequence
  RNA Oligomer
auggccacaccuccucuuuccuu

SEQ ID NO: 53331 - RNA, 23 nt, Artificial Sequence
  RNA Oligomer
aaugaagacagggagcugauggg

SEQ ID NO: 53332 - RNA, 23 nt, Artificial Sequence
  RNA Oligomer
cugugagcuguugacaccaaacc

SEQ ID NO: 53333 - RNA, 23 nt, Artificial Sequence
  RNA Oligomer
uguuccucgggucauccauguag

SEQ ID NO: 53334 - RNA, 23 nt, Artificial Sequence
  RNA Oligomer
uuccacaaaauacacgcauucuu

SEQ ID NO: 53335 - RNA, 23 nt, Artificial Sequence
  RNA Oligomer
gaaggcgaaguaggagaggaugu

SEQ ID NO: 53336 - RNA, 23 nt, Artificial Sequence
  RNA Oligomer
gugagcuguugacaccaaaccag

SEQ ID NO: 53337 - RNA, 23 nt, Artificial Sequence
  RNA Oligomer
cuuccacugccacucauccauga

SEQ ID NO: 53338 - RNA, 23 nt, Artificial Sequence
  RNA Oligomer
uuuuugguccacucgacaauccu

SEQ ID NO: 53339 - RNA, 23 nt, Artificial Sequence
  RNA Oligomer
auccacgaacugaggcuuucuug

SEQ ID NO: 53340 - RNA, 23 nt, Artificial Sequence
  RNA Oligomer
cuccgauaugaacuucuccagcc

SEQ ID NO: 53341 - RNA, 23 nt, Artificial Sequence
  RNA Oligomer
caccauggcgucaaccuuauugc

SEQ ID NO: 53342 - RNA, 23 nt, Artificial Sequence
  RNA Oligomer
auggcgcuggaacuuccaaaucu

SEQ ID NO: 53343 - RNA, 23 nt, Artificial Sequence
  RNA Oligomer
aagaucucacugcgggcaauguc

SEQ ID NO: 53344 - RNA, 23 nt, Artificial Sequence
  RNA Oligomer
uuucagcaaggccugcaagaugg

SEQ ID NO: 53345 - RNA, 23 nt, Artificial Sequence
  RNA Oligomer
augaagacagggagcugaugggu

SEQ ID NO: 53346 - RNA, 23 nt, Artificial Sequence
  RNA Oligomer
augucuuggguuuuaccacguuc

SEQ ID NO: 53347 - RNA, 23 nt, Artificial Sequence
  RNA Oligomer
ugucuuggguuuuaccacguucc

SEQ ID NO: 53348 - RNA, 23 nt, Artificial Sequence
  RNA Oligomer
ucccaggugacaaacuccuucag

SEQ ID NO: 53349 - RNA, 23 nt, Artificial Sequence
  RNA Oligomer
aagggugggucauagaucaggaa

SEQ ID NO: 53350 - RNA, 23 nt, Artificial Sequence
  RNA Oligomer
uuaggaaaaugaagacagggagc

SEQ ID NO: 53351 - RNA, 23 nt, Artificial Sequence
  RNA Oligomer
aaaagggugggucauagaucagg

SEQ ID NO: 53352 - RNA, 23 nt, Artificial Sequence
  RNA Oligomer
auagaucaggaacuccgucuccc

SEQ ID NO: 53353 - RNA, 23 nt, Artificial Sequence
  RNA Oligomer
uuugggucagguggaagacagag

SEQ ID NO: 53354 - RNA, 23 nt, Artificial Sequence
  RNA Oligomer
uuugcuggaacugucgguucugg

SEQ ID NO: 53355 - RNA, 23 nt, Artificial Sequence
  RNA Oligomer
ugaugguaaaaaugugcaugagc

SEQ ID NO: 53356 - RNA, 23 nt, Artificial Sequence
  RNA Oligomer
augggucagaggagaaacuuggg

SEQ ID NO: 53357 - RNA, 23 nt, Artificial Sequence
  RNA Oligomer
cauagaucaggaacuccgucucc

SEQ ID NO: 53358 - RNA, 23 nt, Artificial Sequence
  RNA Oligomer
cuggaagguguaguugaacaugg

SEQ ID NO: 53359 - RNA, 23 nt, Artificial Sequence
  RNA Oligomer
agaacaggaugaaguccagagag

SEQ ID NO: 53360 - RNA, 23 nt, Artificial Sequence
  RNA Oligomer
acuuuuucaccuucuggcucagg

SEQ ID NO: 53361 - RNA, 23 nt, Artificial Sequence
  RNA Oligomer
aaaugaagacagggagcugaugg

SEQ ID NO: 53362 - RNA, 23 nt, Artificial Sequence
  RNA Oligomer
gaugggucagaggagaaacuugg

SEQ ID NO: 53363 - RNA, 23 nt, Artificial Sequence
  RNA Oligomer
uuucuuugggucccacugugugc

SEQ ID NO: 53364 - RNA, 23 nt, Artificial Sequence
  RNA Oligomer
ugccgcacuucagcaaguuuuca

SEQ ID NO: 53365 - RNA, 23 nt, Artificial Sequence
  RNA Oligomer
auccaccacguuguacuggaucg

SEQ ID NO: 53366 - RNA, 23 nt, Artificial Sequence
  RNA Oligomer
uaaaaaugugcaugagccggagg

SEQ ID NO: 53367 - RNA, 23 nt, Artificial Sequence
  RNA Oligomer
aacuugccucaggccaaugaccu

SEQ ID NO: 53368 - RNA, 23 nt, Artificial Sequence
  RNA Oligomer
uuuaugcucuuccugcagauggc

SEQ ID NO: 53369 - RNA, 23 nt, Artificial Sequence
  RNA Oligomer
uaaaagggugggucauagaucag

SEQ ID NO: 53370 - RNA, 23 nt, Artificial Sequence
  RNA Oligomer
guucuggagguaguucuccuuca

SEQ ID NO: 53371 - RNA, 23 nt, Artificial Sequence
  RNA Oligomer
ggaagguguaguugaacauggcg

SEQ ID NO: 53372 - RNA, 23 nt, Artificial Sequence
  RNA Oligomer
uguaguugaacauggcgaugagg

SEQ ID NO: 53373 - RNA, 23 nt, Artificial Sequence
  RNA Oligomer
caggaagaggaagaagaagacgu

SEQ ID NO: 53374 - RNA, 23 nt, Artificial Sequence
  RNA Oligomer
gagaugagugcagcugucaucgu

SEQ ID NO: 53375 - RNA, 23 nt, Artificial Sequence
  RNA Oligomer
cuuggaucuuuuugguccacucg

SEQ ID NO: 53376 - RNA, 23 nt, Artificial Sequence
  RNA Oligomer
ugaugggucagaggagaaacuug

SEQ ID NO: 53377 - RNA, 23 nt, Artificial Sequence
  RNA Oligomer
aaugaccuccaugguggaugagc

SEQ ID NO: 53378 - RNA, 23 nt, Artificial Sequence
  RNA Oligomer
aguucuccuucagguagaucucc

SEQ ID NO: 53379 - RNA, 23 nt, Artificial Sequence
  RNA Oligomer
ucuugagcugcuugugccucuug

SEQ ID NO: 53380 - RNA, 23 nt, Artificial Sequence
  RNA Oligomer
uggaagguguaguugaacauggc

SEQ ID NO: 53381 - RNA, 23 nt, Artificial Sequence
  RNA Oligomer
gaagguguaguugaacauggcga

SEQ ID NO: 53382 - RNA, 23 nt, Artificial Sequence
  RNA Oligomer
uucucguggccaaaguggucuug

SEQ ID NO: 53383 - RNA, 23 nt, Artificial Sequence
  RNA Oligomer
uuugguccacucgacaauccugc

SEQ ID NO: 53384 - RNA, 23 nt, Artificial Sequence
  RNA Oligomer
uuuccuuggucugcuccgauaug

SEQ ID NO: 53385 - RNA, 23 nt, Artificial Sequence
  RNA Oligomer
aaaaaugugcaugagccggaggc

SEQ ID NO: 53386 - RNA, 23 nt, Artificial Sequence
  RNA Oligomer
aaacucaggcuuguuggagauga

SEQ ID NO: 53387 - RNA, 23 nt, Artificial Sequence
  RNA Oligomer
uucaggaauccacgaacugaggc

SEQ ID NO: 53388 - RNA, 23 nt, Artificial Sequence
  RNA Oligomer
uugauggccacaccuccucuuuc

SEQ ID NO: 53389 - RNA, 23 nt, Artificial Sequence
  RNA Oligomer
uuccuuggucugcuccgauauga

SEQ ID NO: 53390 - RNA, 23 nt, Artificial Sequence
  RNA Oligomer
uauuuguggaaagcacagaagag

SEQ ID NO: 53391 - RNA, 23 nt, Artificial Sequence
  RNA Oligomer
agauggcagauuuaaugucuugg

SEQ ID NO: 53392 - RNA, 23 nt, Artificial Sequence
  RNA Oligomer
uuuauccugacagucaggaguuc

SEQ ID NO: 53393 - RNA, 23 nt, Artificial Sequence
  RNA Oligomer
uucagcuuccgagguagcaucuc

SEQ ID NO: 53394 - RNA, 23 nt, Artificial Sequence
  RNA Oligomer
uaugcucuuccugcagauggcuc

SEQ ID NO: 53395 - RNA, 23 nt, Artificial Sequence
  RNA Oligomer
aaagggugggucauagaucagga

SEQ ID NO: 53396 - RNA, 23 nt, Artificial Sequence
  RNA Oligomer
augaaguccagagagaggaugac

SEQ ID NO: 53397 - RNA, 23 nt, Artificial Sequence
  RNA Oligomer
auguucagguggaagaccaccac

SEQ ID NO: 53398 - RNA, 23 nt, Artificial Sequence
  RNA Oligomer
ugacaaacuccuucagcugcacc

SEQ ID NO: 53399 - RNA, 23 nt, Artificial Sequence
  RNA Oligomer
gaagaacacgcucaguuucugcu

SEQ ID NO: 53400 - RNA, 23 nt, Artificial Sequence
  RNA Oligomer
agcucuugaagaggcugcuguug

SEQ ID NO: 53401 - RNA, 23 nt, Artificial Sequence
  RNA Oligomer
agugagagugguugcugucuagg

SEQ ID NO: 53402 - RNA, 23 nt, Artificial Sequence
  RNA Oligomer
gagauggcagauuuaaugucuug

SEQ ID NO: 53403 - RNA, 23 nt, Artificial Sequence
  RNA Oligomer
gauggcagauuuaaugucuuggg

SEQ ID NO: 53404 - RNA, 23 nt, Artificial Sequence
  RNA Oligomer
auggcagauuuaaugucuugggu

SEQ ID NO: 53405 - RNA, 23 nt, Artificial Sequence
  RNA Oligomer
gucuuggguuuuaccacguuccc

SEQ ID NO: 53406 - RNA, 23 nt, Artificial Sequence
  RNA Oligomer
guuucuuugggucccacugugug

SEQ ID NO: 53407 - RNA, 23 nt, Artificial Sequence
  RNA Oligomer
acagucaggaguucagacagugc

SEQ ID NO: 53408 - RNA, 23 nt, Artificial Sequence
  RNA Oligomer
uuaugcucuuccugcagauggcu

SEQ ID NO: 53409 - RNA, 23 nt, Artificial Sequence
  RNA Oligomer
uuuugcuggaacugucgguucug

SEQ ID NO: 53410 - RNA, 23 nt, Artificial Sequence
  RNA Oligomer
gaacuuccaaaucugguccgugu

SEQ ID NO: 53411 - RNA, 23 nt, Artificial Sequence
  RNA Oligomer
acuuccaaaucugguccgugugc

SEQ ID NO: 53412 - RNA, 23 nt, Artificial Sequence
  RNA Oligomer
ugguaaaaaugugcaugagccgg

SEQ ID NO: 53413 - RNA, 23 nt, Artificial Sequence
  RNA Oligomer
guucuggacaauggcccaaauga

SEQ ID NO: 53414 - RNA, 23 nt, Artificial Sequence
  RNA Oligomer
aucuuggaucuuuuugguccacu

SEQ ID NO: 53415 - RNA, 23 nt, Artificial Sequence
  RNA Oligomer
agaacacgcucaguuucugcugg

SEQ ID NO: 53416 - RNA, 23 nt, Artificial Sequence
  RNA Oligomer
agauagugauguccgagacaggc

SEQ ID NO: 53417 - RNA, 23 nt, Artificial Sequence
  RNA Oligomer
aagugagagugguugcugucuag

SEQ ID NO: 53418 - RNA, 23 nt, Artificial Sequence
  RNA Oligomer
aaaggcaucgguuggcaucuccu

SEQ ID NO: 53419 - RNA, 23 nt, Artificial Sequence
  RNA Oligomer
aaugucuuggguuuuaccacguu

SEQ ID NO: 53420 - RNA, 23 nt, Artificial Sequence
  RNA Oligomer
uccauguagccuuuguacaccuc

SEQ ID NO: 53421 - RNA, 23 nt, Artificial Sequence
  RNA Oligomer
ucagguagaucucccaggauagc

SEQ ID NO: 53422 - RNA, 23 nt, Artificial Sequence
  RNA Oligomer
uauuccagaagucacugaaguac

SEQ ID NO: 53423 - RNA, 23 nt, Artificial Sequence
  RNA Oligomer
gcacuucucaacaaauuuacacg

SEQ ID NO: 53424 - RNA, 23 nt, Artificial Sequence
  RNA Oligomer
ugcacuucucaacaaauuuacac

SEQ ID NO: 53425 - RNA, 23 nt, Artificial Sequence
  RNA Oligomer
cugcacuucucaacaaauuuaca

SEQ ID NO: 53426 - RNA, 23 nt, Artificial Sequence
  RNA Oligomer
acugcacuucucaacaaauuuac

SEQ ID NO: 53427 - RNA, 23 nt, Artificial Sequence
  RNA Oligomer
gacugcacuucucaacaaauuua

SEQ ID NO: 53428 - RNA, 23 nt, Artificial Sequence
  RNA Oligomer
ccauauauuauaccaguugcuuc

SEQ ID NO: 53429 - RNA, 23 nt, Artificial Sequence
  RNA Oligomer
cccauauauuauaccaguugcuu

SEQ ID NO: 53430 - RNA, 23 nt, Artificial Sequence
  RNA Oligomer
gcccauauauuauaccaguugcu

SEQ ID NO: 53431 - RNA, 23 nt, Artificial Sequence
  RNA Oligomer
ugcccauauauuauaccaguugc

SEQ ID NO: 53432 - RNA, 23 nt, Artificial Sequence
  RNA Oligomer
cugcccauauauuauaccaguug

SEQ ID NO: 53433 - RNA, 23 nt, Artificial Sequence
  RNA Oligomer
gcaaaaugaagggaaacacacgg

SEQ ID NO: 53434 - RNA, 23 nt, Artificial Sequence
  RNA Oligomer
ggcaaaaugaagggaaacacacg

SEQ ID NO: 53435 - RNA, 23 nt, Artificial Sequence
  RNA Oligomer
uggcaaaaugaagggaaacacac

SEQ ID NO: 53436 - RNA, 23 nt, Artificial Sequence
  RNA Oligomer
guggcaaaaugaagggaaacaca

SEQ ID NO: 53437 - RNA, 23 nt, Artificial Sequence
  RNA Oligomer
aguggcaaaaugaagggaaacac

SEQ ID NO: 53438 - RNA, 23 nt, Artificial Sequence
  RNA Oligomer
aaguggcaaaaugaagggaaaca

SEQ ID NO: 53439 - RNA, 23 nt, Artificial Sequence
  RNA Oligomer
gacauuaacuucaaucgauuguu

SEQ ID NO: 53440 - RNA, 23 nt, Artificial Sequence
  RNA Oligomer
agacauuaacuucaaucgauugu

SEQ ID NO: 53441 - RNA, 23 nt, Artificial Sequence
  RNA Oligomer
cagacauuaacuucaaucgauug

SEQ ID NO: 53442 - RNA, 23 nt, Artificial Sequence
  RNA Oligomer
ccagacauuaacuucaaucgauu

SEQ ID NO: 53443 - RNA, 23 nt, Artificial Sequence
  RNA Oligomer
cccagacauuaacuucaaucgau

SEQ ID NO: 53444 - RNA, 23 nt, Artificial Sequence
  RNA Oligomer
cucaacaaauuuacacgacccca

SEQ ID NO: 53445 - RNA, 23 nt, Artificial Sequence
  RNA Oligomer
ucucaacaaauuuacacgacccc

SEQ ID NO: 53446 - RNA, 23 nt, Artificial Sequence
  RNA Oligomer
uucucaacaaauuuacacgaccc

SEQ ID NO: 53447 - RNA, 23 nt, Artificial Sequence
  RNA Oligomer
cuucucaacaaauuuacacgacc

SEQ ID NO: 53448 - RNA, 23 nt, Artificial Sequence
  RNA Oligomer
acuucucaacaaauuuacacgac

SEQ ID NO: 53449 - RNA, 23 nt, Artificial Sequence
  RNA Oligomer
uaaguggcaaaaugaagggaaac

SEQ ID NO: 53450 - RNA, 23 nt, Artificial Sequence
  RNA Oligomer
guaaguggcaaaaugaagggaaa

SEQ ID NO: 53451 - RNA, 23 nt, Artificial Sequence
  RNA Oligomer
acccagacauuaacuucaaucga

SEQ ID NO: 53452 - RNA, 23 nt, Artificial Sequence
  RNA Oligomer
uacccagacauuaacuucaaucg

SEQ ID NO: 53453 - RNA, 23 nt, Artificial Sequence
  RNA Oligomer
uuacccagacauuaacuucaauc

SEQ ID NO: 53454 - RNA, 23 nt, Artificial Sequence
  RNA Oligomer
guuacccagacauuaacuucaau

SEQ ID NO: 53455 - RNA, 23 nt, Artificial Sequence
  RNA Oligomer
agagaauagagacaaucaacagu

SEQ ID NO: 53456 - RNA, 23 nt, Artificial Sequence
  RNA Oligomer
aagagaauagagacaaucaacag

SEQ ID NO: 53457 - RNA, 23 nt, Artificial Sequence
  RNA Oligomer
gaagagaauagagacaaucaaca

SEQ ID NO: 53458 - RNA, 23 nt, Artificial Sequence
  RNA Oligomer
ugaagagaauagagacaaucaac

SEQ ID NO: 53459 - RNA, 23 nt, Artificial Sequence
  RNA Oligomer
gugaagagaauagagacaaucaa

SEQ ID NO: 53460 - RNA, 23 nt, Artificial Sequence
  RNA Oligomer
ggaaucucuuuaacugauuuugc

SEQ ID NO: 53461 - RNA, 23 nt, Artificial Sequence
  RNA Oligomer
aggaaucucuuuaacugauuuug

SEQ ID NO: 53462 - RNA, 23 nt, Artificial Sequence
  RNA Oligomer
caggaaucucuuuaacugauuuu

SEQ ID NO: 53463 - RNA, 23 nt, Artificial Sequence
  RNA Oligomer
ccaggaaucucuuuaacugauuu

SEQ ID NO: 53464 - RNA, 23 nt, Artificial Sequence
  RNA Oligomer
uccaggaaucucuuuaacugauu

SEQ ID NO: 53465 - RNA, 23 nt, Artificial Sequence
  RNA Oligomer
ccaggaaacaaguugaaauccag

SEQ ID NO: 53466 - RNA, 23 nt, Artificial Sequence
  RNA Oligomer
gccaggaaacaaguugaaaucca

SEQ ID NO: 53467 - RNA, 23 nt, Artificial Sequence
  RNA Oligomer
ugccaggaaacaaguugaaaucc

SEQ ID NO: 53468 - RNA, 23 nt, Artificial Sequence
  RNA Oligomer
augccaggaaacaaguugaaauc

SEQ ID NO: 53469 - RNA, 23 nt, Artificial Sequence
  RNA Oligomer
gaugccaggaaacaaguugaaau

SEQ ID NO: 53470 - RNA, 23 nt, Artificial Sequence
  RNA Oligomer
ccauucauauaccaugcugucga

SEQ ID NO: 53471 - RNA, 23 nt, Artificial Sequence
  RNA Oligomer
uccauucauauaccaugcugucg

SEQ ID NO: 53472 - RNA, 23 nt, Artificial Sequence
  RNA Oligomer
auccauucauauaccaugcuguc

SEQ ID NO: 53473 - RNA, 23 nt, Artificial Sequence
  RNA Oligomer
uauccauucauauaccaugcugu

SEQ ID NO: 53474 - RNA, 23 nt, Artificial Sequence
  RNA Oligomer
uuauccauucauauaccaugcug

SEQ ID NO: 53475 - RNA, 23 nt, Artificial Sequence
  RNA Oligomer
gaauguagaaugcagaaauucua

SEQ ID NO: 53476 - RNA, 23 nt, Artificial Sequence
  RNA Oligomer
ugaauguagaaugcagaaauucu

SEQ ID NO: 53477 - RNA, 23 nt, Artificial Sequence
  RNA Oligomer
cugaauguagaaugcagaaauuc

SEQ ID NO: 53478 - RNA, 23 nt, Artificial Sequence
  RNA Oligomer
ccugaauguagaaugcagaaauu

SEQ ID NO: 53479 - RNA, 23 nt, Artificial Sequence
  RNA Oligomer
gccugaauguagaaugcagaaau

SEQ ID NO: 53480 - RNA, 23 nt, Artificial Sequence
  RNA Oligomer
ccacucaacucuuaauaugcuug

SEQ ID NO: 53481 - RNA, 23 nt, Artificial Sequence
  RNA Oligomer
uccacucaacucuuaauaugcuu

SEQ ID NO: 53482 - RNA, 23 nt, Artificial Sequence
  RNA Oligomer
uuccacucaacucuuaauaugcu

SEQ ID NO: 53483 - RNA, 23 nt, Artificial Sequence
  RNA Oligomer
cuuccacucaacucuuaauaugc

SEQ ID NO: 53484 - RNA, 23 nt, Artificial Sequence
  RNA Oligomer
ccuuccacucaacucuuaauaug

SEQ ID NO: 53485 - RNA, 23 nt, Artificial Sequence
  RNA Oligomer
cacgacgaaaugcuaagaugaaa

SEQ ID NO: 53486 - RNA, 23 nt, Artificial Sequence
  RNA Oligomer
ccacgacgaaaugcuaagaugaa

SEQ ID NO: 53487 - RNA, 23 nt, Artificial Sequence
  RNA Oligomer
uccacgacgaaaugcuaagauga

SEQ ID NO: 53488 - RNA, 23 nt, Artificial Sequence
  RNA Oligomer
uuccacgacgaaaugcuaagaug

SEQ ID NO: 53489 - RNA, 23 nt, Artificial Sequence
  RNA Oligomer
uuuccacgacgaaaugcuaagau

SEQ ID NO: 53490 - RNA, 23 nt, Artificial Sequence
  RNA Oligomer
caacaaauuuacacgaccccaaa

SEQ ID NO: 53491 - RNA, 23 nt, Artificial Sequence
  RNA Oligomer
ucaacaaauuuacacgaccccaa

SEQ ID NO: 53492 - RNA, 23 nt, Artificial Sequence
  RNA Oligomer
ggauggacacuaaaggaaucaag

SEQ ID NO: 53493 - RNA, 23 nt, Artificial Sequence
  RNA Oligomer
uggauggacacuaaaggaaucaa

SEQ ID NO: 53494 - RNA, 23 nt, Artificial Sequence
  RNA Oligomer
uuggauggacacuaaaggaauca

SEQ ID NO: 53495 - RNA, 23 nt, Artificial Sequence
  RNA Oligomer
guuggauggacacuaaaggaauc

SEQ ID NO: 53496 - RNA, 23 nt, Artificial Sequence
  RNA Oligomer
aguuggauggacacuaaaggaau

SEQ ID NO: 53497 - RNA, 23 nt, Artificial Sequence
  RNA Oligomer
agccugaauguagaaugcagaaa

SEQ ID NO: 53498 - RNA, 23 nt, Artificial Sequence
  RNA Oligomer
uagccugaauguagaaugcagaa

SEQ ID NO: 53499 - RNA, 23 nt, Artificial Sequence
  RNA Oligomer
cuagccugaauguagaaugcaga

SEQ ID NO: 53500 - RNA, 23 nt, Artificial Sequence
  RNA Oligomer
ucuagccugaauguagaaugcag

SEQ ID NO: 53501 - RNA, 23 nt, Artificial Sequence
  RNA Oligomer
cggugaaguuagauuacauuucc

SEQ ID NO: 53502 - RNA, 23 nt, Artificial Sequence
  RNA Oligomer
gcggugaaguuagauuacauuuc

SEQ ID NO: 53503 - RNA, 23 nt, Artificial Sequence
  RNA Oligomer
ggcggugaaguuagauuacauuu

SEQ ID NO: 53504 - RNA, 23 nt, Artificial Sequence
  RNA Oligomer
gggcggugaaguuagauuacauu

SEQ ID NO: 53505 - RNA, 23 nt, Artificial Sequence
  RNA Oligomer
agggcggugaaguuagauuacau

SEQ ID NO: 53506 - RNA, 23 nt, Artificial Sequence
  RNA Oligomer
aagggcggugaaguuagauuaca

SEQ ID NO: 53507 - RNA, 23 nt, Artificial Sequence
  RNA Oligomer
uaagggcggugaaguuagauuac

SEQ ID NO: 53508 - RNA, 23 nt, Artificial Sequence
  RNA Oligomer
cuaagggcggugaaguuagauua

SEQ ID NO: 53509 - RNA, 23 nt, Artificial Sequence
  RNA Oligomer
ggaaacgguacucuacuaagggc

SEQ ID NO: 53510 - RNA, 23 nt, Artificial Sequence
  RNA Oligomer
aggaaacgguacucuacuaaggg

SEQ ID NO: 53511 - RNA, 23 nt, Artificial Sequence
  RNA Oligomer
uaggaaacgguacucuacuaagg

SEQ ID NO: 53512 - RNA, 23 nt, Artificial Sequence
  RNA Oligomer
uuaggaaacgguacucuacuaag

SEQ ID NO: 53513 - RNA, 23 nt, Artificial Sequence
  RNA Oligomer
uuuaggaaacgguacucuacuaa

SEQ ID NO: 53514 - RNA, 23 nt, Artificial Sequence
  RNA Oligomer
agugaagagaauagagacaauca

SEQ ID NO: 53515 - RNA, 23 nt, Artificial Sequence
  RNA Oligomer
uagugaagagaauagagacaauc

SEQ ID NO: 53516 - RNA, 23 nt, Artificial Sequence
  RNA Oligomer
auagugaagagaauagagacaau

SEQ ID NO: 53517 - RNA, 23 nt, Artificial Sequence
  RNA Oligomer
gggaacuucaugcugauuuguac

SEQ ID NO: 53518 - RNA, 23 nt, Artificial Sequence
  RNA Oligomer
ugggaacuucaugcugauuugua

SEQ ID NO: 53519 - RNA, 23 nt, Artificial Sequence
  RNA Oligomer
cugggaacuucaugcugauuugu

SEQ ID NO: 53520 - RNA, 23 nt, Artificial Sequence
  RNA Oligomer
acugggaacuucaugcugauuug

SEQ ID NO: 53521 - RNA, 23 nt, Artificial Sequence
  RNA Oligomer
aacugggaacuucaugcugauuu

SEQ ID NO: 53522 - RNA, 23 nt, Artificial Sequence
  RNA Oligomer
uggaauaaaaggagguuuuccug

SEQ ID NO: 53523 - RNA, 23 nt, Artificial Sequence
  RNA Oligomer
guggaauaaaaggagguuuuccu

SEQ ID NO: 53524 - RNA, 23 nt, Artificial Sequence
  RNA Oligomer
uguggaauaaaaggagguuuucc

SEQ ID NO: 53525 - RNA, 23 nt, Artificial Sequence
  RNA Oligomer
auguggaauaaaaggagguuuuc

SEQ ID NO: 53526 - RNA, 23 nt, Artificial Sequence
  RNA Oligomer
aauguggaauaaaaggagguuuu

SEQ ID NO: 53527 - RNA, 23 nt, Artificial Sequence
  RNA Oligomer
gcauaaugcaaaccuccuagguu

SEQ ID NO: 53528 - RNA, 23 nt, Artificial Sequence
  RNA Oligomer
ugcauaaugcaaaccuccuaggu

SEQ ID NO: 53529 - RNA, 23 nt, Artificial Sequence
  RNA Oligomer
uugcauaaugcaaaccuccuagg

SEQ ID NO: 53530 - RNA, 23 nt, Artificial Sequence
  RNA Oligomer
guugcauaaugcaaaccuccuag

SEQ ID NO: 53531 - RNA, 23 nt, Artificial Sequence
  RNA Oligomer
uguugcauaaugcaaaccuccua

SEQ ID NO: 53532 - RNA, 23 nt, Artificial Sequence
  RNA Oligomer
cucaacucuuaauaugcuugcau

SEQ ID NO: 53533 - RNA, 23 nt, Artificial Sequence
  RNA Oligomer
acucaacucuuaauaugcuugca

SEQ ID NO: 53534 - RNA, 23 nt, Artificial Sequence
  RNA Oligomer
cacucaacucuuaauaugcuugc

SEQ ID NO: 53535 - RNA, 23 nt, Artificial Sequence
  RNA Oligomer
cgauacuacaaugaagaaugcag

SEQ ID NO: 53536 - RNA, 23 nt, Artificial Sequence
  RNA Oligomer
acgauacuacaaugaagaaugca

SEQ ID NO: 53537 - RNA, 23 nt, Artificial Sequence
  RNA Oligomer
uacgauacuacaaugaagaaugc

SEQ ID NO: 53538 - RNA, 23 nt, Artificial Sequence
  RNA Oligomer
cuacgauacuacaaugaagaaug

SEQ ID NO: 53539 - RNA, 23 nt, Artificial Sequence
  RNA Oligomer
gcuacgauacuacaaugaagaau

SEQ ID NO: 53540 - RNA, 23 nt, Artificial Sequence
  RNA Oligomer
agccuuaauacagauauuggcag

SEQ ID NO: 53541 - RNA, 23 nt, Artificial Sequence
  RNA Oligomer
aagccuuaauacagauauuggca

SEQ ID NO: 53542 - RNA, 23 nt, Artificial Sequence
  RNA Oligomer
aaagccuuaauacagauauuggc

SEQ ID NO: 53543 - RNA, 23 nt, Artificial Sequence
  RNA Oligomer
aaaagccuuaauacagauauugg

SEQ ID NO: 53544 - RNA, 23 nt, Artificial Sequence
  RNA Oligomer
uaaaagccuuaauacagauauug

SEQ ID NO: 53545 - RNA, 23 nt, Artificial Sequence
  RNA Oligomer
gcaugcuacagguggauuuugca

SEQ ID NO: 53546 - RNA, 23 nt, Artificial Sequence
  RNA Oligomer
ggcaugcuacagguggauuuugc

SEQ ID NO: 53547 - RNA, 23 nt, Artificial Sequence
  RNA Oligomer
aggcaugcuacagguggauuuug

SEQ ID NO: 53548 - RNA, 23 nt, Artificial Sequence
  RNA Oligomer
aaggcaugcuacagguggauuuu

SEQ ID NO: 53549 - RNA, 23 nt, Artificial Sequence
  RNA Oligomer
caaggcaugcuacagguggauuu

SEQ ID NO: 53550 - RNA, 23 nt, Artificial Sequence
  RNA Oligomer
aguuacccagacauuaacuucaa

SEQ ID NO: 53551 - RNA, 23 nt, Artificial Sequence
  RNA Oligomer
caagaauagaauccaugaugagu

SEQ ID NO: 53552 - RNA, 23 nt, Artificial Sequence
  RNA Oligomer
acaagaauagaauccaugaugag

SEQ ID NO: 53553 - RNA, 23 nt, Artificial Sequence
  RNA Oligomer
uacaagaauagaauccaugauga

SEQ ID NO: 53554 - RNA, 23 nt, Artificial Sequence
  RNA Oligomer
auacaagaauagaauccaugaug

SEQ ID NO: 53555 - RNA, 23 nt, Artificial Sequence
  RNA Oligomer
aauacaagaauagaauccaugau

SEQ ID NO: 53556 - RNA, 23 nt, Artificial Sequence
  RNA Oligomer
ggaacagauugccagucuuuuag

SEQ ID NO: 53557 - RNA, 23 nt, Artificial Sequence
  RNA Oligomer
aggaacagauugccagucuuuua

SEQ ID NO: 53558 - RNA, 23 nt, Artificial Sequence
  RNA Oligomer
caggaacagauugccagucuuuu

SEQ ID NO: 53559 - RNA, 23 nt, Artificial Sequence
  RNA Oligomer
gcaggaacagauugccagucuuu

SEQ ID NO: 53560 - RNA, 23 nt, Artificial Sequence
  RNA Oligomer
cgcaggaacagauugccagucuu

SEQ ID NO: 53561 - RNA, 23 nt, Artificial Sequence
  RNA Oligomer
ggaaucagaaaguuuggauagua

SEQ ID NO: 53562 - RNA, 23 nt, Artificial Sequence
  RNA Oligomer
cggaaucagaaaguuuggauagu

SEQ ID NO: 53563 - RNA, 23 nt, Artificial Sequence
  RNA Oligomer
gcggaaucagaaaguuuggauag

SEQ ID NO: 53564 - RNA, 23 nt, Artificial Sequence
  RNA Oligomer
agcggaaucagaaaguuuggaua

SEQ ID NO: 53565 - RNA, 23 nt, Artificial Sequence
  RNA Oligomer
cagcggaaucagaaaguuuggau

SEQ ID NO: 53566 - RNA, 23 nt, Artificial Sequence
  RNA Oligomer
cacuucucaacaaauuuacacga

SEQ ID NO: 53567 - RNA, 23 nt, Artificial Sequence
  RNA Oligomer
ggacacuaaaggaaucaagacag

SEQ ID NO: 53568 - RNA, 23 nt, Artificial Sequence
  RNA Oligomer
uggacacuaaaggaaucaagaca

SEQ ID NO: 53569 - RNA, 23 nt, Artificial Sequence
  RNA Oligomer
auggacacuaaaggaaucaagac

SEQ ID NO: 53570 - RNA, 23 nt, Artificial Sequence
  RNA Oligomer
gauggacacuaaaggaaucaaga

SEQ ID NO: 53571 - RNA, 23 nt, Artificial Sequence
  RNA Oligomer
caguuggauggacacuaaaggaa

SEQ ID NO: 53572 - RNA, 23 nt, Artificial Sequence
  RNA Oligomer
ggaaauauuucuagccugaaugu

SEQ ID NO: 53573 - RNA, 23 nt, Artificial Sequence
  RNA Oligomer
uggaaauauuucuagccugaaug

SEQ ID NO: 53574 - RNA, 23 nt, Artificial Sequence
  RNA Oligomer
cuggaaauauuucuagccugaau

SEQ ID NO: 53575 - RNA, 23 nt, Artificial Sequence
  RNA Oligomer
ccuggaaauauuucuagccugaa

SEQ ID NO: 53576 - RNA, 23 nt, Artificial Sequence
  RNA Oligomer
accuggaaauauuucuagccuga

SEQ ID NO: 53577 - RNA, 23 nt, Artificial Sequence
  RNA Oligomer
cgcacuggaaugaaugauuuaaa

SEQ ID NO: 53578 - RNA, 23 nt, Artificial Sequence
  RNA Oligomer
ucgcacuggaaugaaugauuuaa

SEQ ID NO: 53579 - RNA, 23 nt, Artificial Sequence
  RNA Oligomer
gucgcacuggaaugaaugauuua

SEQ ID NO: 53580 - RNA, 23 nt, Artificial Sequence
  RNA Oligomer
agucgcacuggaaugaaugauuu

SEQ ID NO: 53581 - RNA, 23 nt, Artificial Sequence
  RNA Oligomer
gagucgcacuggaaugaaugauu

SEQ ID NO: 53582 - RNA, 23 nt, Artificial Sequence
  RNA Oligomer
ccuucaagguuccaagcaagaga

SEQ ID NO: 53583 - RNA, 23 nt, Artificial Sequence
  RNA Oligomer
accuucaagguuccaagcaagag

SEQ ID NO: 53584 - RNA, 23 nt, Artificial Sequence
  RNA Oligomer
aaccuucaagguuccaagcaaga

SEQ ID NO: 53585 - RNA, 23 nt, Artificial Sequence
  RNA Oligomer
aaaccuucaagguuccaagcaag

SEQ ID NO: 53586 - RNA, 23 nt, Artificial Sequence
  RNA Oligomer
uaaaccuucaagguuccaagcaa

SEQ ID NO: 53587 - RNA, 23 nt, Artificial Sequence
  RNA Oligomer
caaauugacuagacaagaaaguu

SEQ ID NO: 53588 - RNA, 23 nt, Artificial Sequence
  RNA Oligomer
acaaauugacuagacaagaaagu

SEQ ID NO: 53589 - RNA, 23 nt, Artificial Sequence
  RNA Oligomer
aacaaauugacuagacaagaaag

SEQ ID NO: 53590 - RNA, 23 nt, Artificial Sequence
  RNA Oligomer
caacaaauugacuagacaagaaa

SEQ ID NO: 53591 - RNA, 23 nt, Artificial Sequence
  RNA Oligomer
acaacaaauugacuagacaagaa

SEQ ID NO: 53592 - RNA, 23 nt, Artificial Sequence
  RNA Oligomer
cucugaggauguugguacugggc

SEQ ID NO: 53593 - RNA, 23 nt, Artificial Sequence
  RNA Oligomer
gcucugaggauguugguacuggg

SEQ ID NO: 53594 - RNA, 23 nt, Artificial Sequence
  RNA Oligomer
ggcucugaggauguugguacugg

SEQ ID NO: 53595 - RNA, 23 nt, Artificial Sequence
  RNA Oligomer
uggcucugaggauguugguacug

SEQ ID NO: 53596 - RNA, 23 nt, Artificial Sequence
  RNA Oligomer
uuggcucugaggauguugguacu

SEQ ID NO: 53597 - RNA, 23 nt, Artificial Sequence
  RNA Oligomer
gugagcacauaaaaucuaaauaa

SEQ ID NO: 53598 - RNA, 23 nt, Artificial Sequence
  RNA Oligomer
ugugagcacauaaaaucuaaaua

SEQ ID NO: 53599 - RNA, 23 nt, Artificial Sequence
  RNA Oligomer
augugagcacauaaaaucuaaau

SEQ ID NO: 53600 - RNA, 23 nt, Artificial Sequence
  RNA Oligomer
uaugugagcacauaaaaucuaaa

SEQ ID NO: 53601 - RNA, 23 nt, Artificial Sequence
  RNA Oligomer
auaugugagcacauaaaaucuaa

SEQ ID NO: 53602 - RNA, 23 nt, Artificial Sequence
  RNA Oligomer
cucuuuaagugugucuauaugug

SEQ ID NO: 53603 - RNA, 23 nt, Artificial Sequence
  RNA Oligomer
gcucuuuaagugugucuauaugu

SEQ ID NO: 53604 - RNA, 23 nt, Artificial Sequence
  RNA Oligomer
ugcucuuuaagugugucuauaug

SEQ ID NO: 53605 - RNA, 23 nt, Artificial Sequence
  RNA Oligomer
augcucuuuaagugugucuauau

SEQ ID NO: 53606 - RNA, 23 nt, Artificial Sequence
  RNA Oligomer
uaugcucuuuaagugugucuaua

SEQ ID NO: 53607 - RNA, 23 nt, Artificial Sequence
  RNA Oligomer
ugaggcauauucauauaaccaaa

SEQ ID NO: 53608 - RNA, 23 nt, Artificial Sequence
  RNA Oligomer
uugaggcauauucauauaaccaa

SEQ ID NO: 53609 - RNA, 23 nt, Artificial Sequence
  RNA Oligomer
cuugaggcauauucauauaacca

SEQ ID NO: 53610 - RNA, 23 nt, Artificial Sequence
  RNA Oligomer
gcuugaggcauauucauauaacc

SEQ ID NO: 53611 - RNA, 23 nt, Artificial Sequence
  RNA Oligomer
ugcuugaggcauauucauauaac

SEQ ID NO: 53612 - RNA, 23 nt, Artificial Sequence
  RNA Oligomer
aaauguggaauaaaaggagguuu

SEQ ID NO: 53613 - RNA, 23 nt, Artificial Sequence
  RNA Oligomer
cugucuuuuuuccucugaucagu

SEQ ID NO: 53614 - RNA, 23 nt, Artificial Sequence
  RNA Oligomer
ucugucuuuuuuccucugaucag

SEQ ID NO: 53615 - RNA, 23 nt, Artificial Sequence
  RNA Oligomer
gucugucuuuuuuccucugauca

SEQ ID NO: 53616 - RNA, 23 nt, Artificial Sequence
  RNA Oligomer
ugucugucuuuuuuccucugauc

SEQ ID NO: 53617 - RNA, 23 nt, Artificial Sequence
  RNA Oligomer
uugucugucuuuuuuccucugau

SEQ ID NO: 53618 - RNA, 23 nt, Artificial Sequence
  RNA Oligomer
aggguuuuuuucauauguguugc

SEQ ID NO: 53619 - RNA, 23 nt, Artificial Sequence
  RNA Oligomer
uaggguuuuuuucauauguguug

SEQ ID NO: 53620 - RNA, 23 nt, Artificial Sequence
  RNA Oligomer
uuaggguuuuuuucauauguguu

SEQ ID NO: 53621 - RNA, 23 nt, Artificial Sequence
  RNA Oligomer
auuaggguuuuuuucauaugugu

SEQ ID NO: 53622 - RNA, 23 nt, Artificial Sequence
  RNA Oligomer
aauuaggguuuuuuucauaugug

SEQ ID NO: 53623 - RNA, 23 nt, Artificial Sequence
  RNA Oligomer
gccuuccacucaacucuuaauau

SEQ ID NO: 53624 - RNA, 23 nt, Artificial Sequence
  RNA Oligomer
agccuuccacucaacucuuaaua

SEQ ID NO: 53625 - RNA, 23 nt, Artificial Sequence
  RNA Oligomer
gagccuuccacucaacucuuaau

SEQ ID NO: 53626 - RNA, 23 nt, Artificial Sequence
  RNA Oligomer
ugagccuuccacucaacucuuaa

SEQ ID NO: 53627 - RNA, 23 nt, Artificial Sequence
  RNA Oligomer
gugagccuuccacucaacucuua

SEQ ID NO: 53628 - RNA, 23 nt, Artificial Sequence
  RNA Oligomer
gcaauguguaaguggcaaaauga

SEQ ID NO: 53629 - RNA, 23 nt, Artificial Sequence
  RNA Oligomer
agcaauguguaaguggcaaaaug

SEQ ID NO: 53630 - RNA, 23 nt, Artificial Sequence
  RNA Oligomer
cagcaauguguaaguggcaaaau

SEQ ID NO: 53631 - RNA, 23 nt, Artificial Sequence
  RNA Oligomer
gcagcaauguguaaguggcaaaa

SEQ ID NO: 53632 - RNA, 23 nt, Artificial Sequence
  RNA Oligomer
ugcagcaauguguaaguggcaaa

SEQ ID NO: 53633 - RNA, 23 nt, Artificial Sequence
  RNA Oligomer
acaucuaaacucccuccauccug

SEQ ID NO: 53634 - RNA, 23 nt, Artificial Sequence
  RNA Oligomer
uacaucuaaacucccuccauccu

SEQ ID NO: 53635 - RNA, 23 nt, Artificial Sequence
  RNA Oligomer
guacaucuaaacucccuccaucc

SEQ ID NO: 53636 - RNA, 23 nt, Artificial Sequence
  RNA Oligomer
gguacaucuaaacucccuccauc

SEQ ID NO: 53637 - RNA, 23 nt, Artificial Sequence
  RNA Oligomer
ugguacaucuaaacucccuccau

SEQ ID NO: 53638 - RNA, 23 nt, Artificial Sequence
  RNA Oligomer
cggagaaacuuaaaacgcucuuc

SEQ ID NO: 53639 - RNA, 23 nt, Artificial Sequence
  RNA Oligomer
ccggagaaacuuaaaacgcucuu

SEQ ID NO: 53640 - RNA, 23 nt, Artificial Sequence
  RNA Oligomer
accggagaaacuuaaaacgcucu

SEQ ID NO: 53641 - RNA, 23 nt, Artificial Sequence
  RNA Oligomer
aaccggagaaacuuaaaacgcuc

SEQ ID NO: 53642 - RNA, 23 nt, Artificial Sequence
  RNA Oligomer
aaaccggagaaacuuaaaacgcu

SEQ ID NO: 53643 - RNA, 23 nt, Artificial Sequence
  RNA Oligomer
cuaagaugaaaucggaguauucu

SEQ ID NO: 53644 - RNA, 23 nt, Artificial Sequence
  RNA Oligomer
gcuaagaugaaaucggaguauuc

SEQ ID NO: 53645 - RNA, 23 nt, Artificial Sequence
  RNA Oligomer
ugcuaagaugaaaucggaguauu

SEQ ID NO: 53646 - RNA, 23 nt, Artificial Sequence
  RNA Oligomer
augcuaagaugaaaucggaguau

SEQ ID NO: 53647 - RNA, 23 nt, Artificial Sequence
  RNA Oligomer
aaugcuaagaugaaaucggagua

SEQ ID NO: 53648 - RNA, 23 nt, Artificial Sequence
  RNA Oligomer
auuuccacgacgaaaugcuaaga

SEQ ID NO: 53649 - RNA, 23 nt, Artificial Sequence
  RNA Oligomer
cagaaaguuuggauaguaaagaa

SEQ ID NO: 53650 - RNA, 23 nt, Artificial Sequence
  RNA Oligomer
ucagaaaguuuggauaguaaaga

SEQ ID NO: 53651 - RNA, 23 nt, Artificial Sequence
  RNA Oligomer
aucagaaaguuuggauaguaaag

SEQ ID NO: 53652 - RNA, 23 nt, Artificial Sequence
  RNA Oligomer
aaucagaaaguuuggauaguaaa

SEQ ID NO: 53653 - RNA, 23 nt, Artificial Sequence
  RNA Oligomer
gaaucagaaaguuuggauaguaa

SEQ ID NO: 53654 - RNA, 23 nt, Artificial Sequence
  RNA Oligomer
aggaugcuauucugaaauacaau

SEQ ID NO: 53655 - RNA, 23 nt, Artificial Sequence
  RNA Oligomer
aaggaugcuauucugaaauacaa

SEQ ID NO: 53656 - RNA, 23 nt, Artificial Sequence
  RNA Oligomer
gaaggaugcuauucugaaauaca

SEQ ID NO: 53657 - RNA, 23 nt, Artificial Sequence
  RNA Oligomer
ugaaggaugcuauucugaaauac

SEQ ID NO: 53658 - RNA, 23 nt, Artificial Sequence
  RNA Oligomer
uugaaggaugcuauucugaaaua

SEQ ID NO: 53659 - RNA, 23 nt, Artificial Sequence
  RNA Oligomer
ccuuuuccaacacauuauaaaga

SEQ ID NO: 53660 - RNA, 23 nt, Artificial Sequence
  RNA Oligomer
accuuuuccaacacauuauaaag

SEQ ID NO: 53661 - RNA, 23 nt, Artificial Sequence
  RNA Oligomer
aaccuuuuccaacacauuauaaa

SEQ ID NO: 53662 - RNA, 23 nt, Artificial Sequence
  RNA Oligomer
aaaccuuuuccaacacauuauaa

SEQ ID NO: 53663 - RNA, 23 nt, Artificial Sequence
  RNA Oligomer
uaaaccuuuuccaacacauuaua

SEQ ID NO: 53664 - RNA, 23 nt, Artificial Sequence
  RNA Oligomer
ugcuaaacuaccuggaaauauuu

SEQ ID NO: 53665 - RNA, 23 nt, Artificial Sequence
  RNA Oligomer
augcuaaacuaccuggaaauauu

SEQ ID NO: 53666 - RNA, 23 nt, Artificial Sequence
  RNA Oligomer
aaugcuaaacuaccuggaaauau

SEQ ID NO: 53667 - RNA, 23 nt, Artificial Sequence
  RNA Oligomer
aaaugcuaaacuaccuggaaaua

SEQ ID NO: 53668 - RNA, 23 nt, Artificial Sequence
  RNA Oligomer
uaaaugcuaaacuaccuggaaau

SEQ ID NO: 53669 - RNA, 23 nt, Artificial Sequence
  RNA Oligomer
uccucccaaacagcaaauaaacc

SEQ ID NO: 53670 - RNA, 23 nt, Artificial Sequence
  RNA Oligomer
uuccucccaaacagcaaauaaac

SEQ ID NO: 53671 - RNA, 23 nt, Artificial Sequence
  RNA Oligomer
guuccucccaaacagcaaauaaa

SEQ ID NO: 53672 - RNA, 23 nt, Artificial Sequence
  RNA Oligomer
aguuccucccaaacagcaaauaa

SEQ ID NO: 53673 - RNA, 23 nt, Artificial Sequence
  RNA Oligomer
uaguuccucccaaacagcaaaua

SEQ ID NO: 53674 - RNA, 23 nt, Artificial Sequence
  RNA Oligomer
ucaagacucagaagcagaugagg

SEQ ID NO: 53675 - RNA, 23 nt, Artificial Sequence
  RNA Oligomer
gucaagacucagaagcagaugag

SEQ ID NO: 53676 - RNA, 23 nt, Artificial Sequence
  RNA Oligomer
ugucaagacucagaagcagauga

SEQ ID NO: 53677 - RNA, 23 nt, Artificial Sequence
  RNA Oligomer
uugucaagacucagaagcagaug

SEQ ID NO: 53678 - RNA, 23 nt, Artificial Sequence
  RNA Oligomer
guugucaagacucagaagcagau

SEQ ID NO: 53679 - RNA, 23 nt, Artificial Sequence
  RNA Oligomer
guuggcucugaggauguugguac

SEQ ID NO: 53680 - RNA, 23 nt, Artificial Sequence
  RNA Oligomer
uguuggcucugaggauguuggua

SEQ ID NO: 53681 - RNA, 23 nt, Artificial Sequence
  RNA Oligomer
ucagcaagaugagauagaugugg

SEQ ID NO: 53682 - RNA, 23 nt, Artificial Sequence
  RNA Oligomer
gucagcaagaugagauagaugug

SEQ ID NO: 53683 - RNA, 23 nt, Artificial Sequence
  RNA Oligomer
ugucagcaagaugagauagaugu

SEQ ID NO: 53684 - RNA, 23 nt, Artificial Sequence
  RNA Oligomer
uugucagcaagaugagauagaug

SEQ ID NO: 53685 - RNA, 23 nt, Artificial Sequence
  RNA Oligomer
guugucagcaagaugagauagau

SEQ ID NO: 53686 - RNA, 23 nt, Artificial Sequence
  RNA Oligomer
ggaacuucaugcugauuuguaca

SEQ ID NO: 53687 - RNA, 23 nt, Artificial Sequence
  RNA Oligomer
uguaaguggcaaaaugaagggaa

SEQ ID NO: 53688 - RNA, 23 nt, Artificial Sequence
  RNA Oligomer
ugguuugucugucuuuuuuccuc

SEQ ID NO: 53689 - RNA, 23 nt, Artificial Sequence
  RNA Oligomer
augguuugucugucuuuuuuccu

SEQ ID NO: 53690 - RNA, 23 nt, Artificial Sequence
  RNA Oligomer
aaugguuugucugucuuuuuucc

SEQ ID NO: 53691 - RNA, 23 nt, Artificial Sequence
  RNA Oligomer
uaaugguuugucugucuuuuuuc

SEQ ID NO: 53692 - RNA, 23 nt, Artificial Sequence
  RNA Oligomer
guaaugguuugucugucuuuuuu

SEQ ID NO: 53693 - RNA, 23 nt, Artificial Sequence
  RNA Oligomer
ccugcccauauauuauaccaguu

SEQ ID NO: 53694 - RNA, 23 nt, Artificial Sequence
  RNA Oligomer
uccugcccauauauuauaccagu

SEQ ID NO: 53695 - RNA, 23 nt, Artificial Sequence
  RNA Oligomer
uuccugcccauauauuauaccag

SEQ ID NO: 53696 - RNA, 23 nt, Artificial Sequence
  RNA Oligomer
cuuccugcccauauauuauacca

SEQ ID NO: 53697 - RNA, 23 nt, Artificial Sequence
  RNA Oligomer
ggacuuagauauguuuuguuucu

SEQ ID NO: 53698 - RNA, 23 nt, Artificial Sequence
  RNA Oligomer
uggacuuagauauguuuuguuuc

SEQ ID NO: 53699 - RNA, 23 nt, Artificial Sequence
  RNA Oligomer
guggacuuagauauguuuuguuu

SEQ ID NO: 53700 - RNA, 23 nt, Artificial Sequence
  RNA Oligomer
cguggacuuagauauguuuuguu

SEQ ID NO: 53701 - RNA, 23 nt, Artificial Sequence
  RNA Oligomer
acguggacuuagauauguuuugu

SEQ ID NO: 53702 - RNA, 23 nt, Artificial Sequence
  RNA Oligomer
cacguggacuuagauauguuuug

SEQ ID NO: 53703 - RNA, 23 nt, Artificial Sequence
  RNA Oligomer
ucacguggacuuagauauguuuu

SEQ ID NO: 53704 - RNA, 23 nt, Artificial Sequence
  RNA Oligomer
cucacguggacuuagauauguuu

SEQ ID NO: 53705 - RNA, 23 nt, Artificial Sequence
  RNA Oligomer
gcugucagguguaauauaugaau

SEQ ID NO: 53706 - RNA, 23 nt, Artificial Sequence
  RNA Oligomer
agcugucagguguaauauaugaa

SEQ ID NO: 53707 - RNA, 23 nt, Artificial Sequence
  RNA Oligomer
gagcugucagguguaauauauga

SEQ ID NO: 53708 - RNA, 23 nt, Artificial Sequence
  RNA Oligomer
ugagcugucagguguaauauaug

SEQ ID NO: 53709 - RNA, 23 nt, Artificial Sequence
  RNA Oligomer
uugagcugucagguguaauauau

SEQ ID NO: 53710 - RNA, 23 nt, Artificial Sequence
  RNA Oligomer
uuuauccauucauauaccaugcu

SEQ ID NO: 53711 - RNA, 23 nt, Artificial Sequence
  RNA Oligomer
gaauugaugagagacauuuacag

SEQ ID NO: 53712 - RNA, 23 nt, Artificial Sequence
  RNA Oligomer
agaauugaugagagacauuuaca

SEQ ID NO: 53713 - RNA, 23 nt, Artificial Sequence
  RNA Oligomer
cagaauugaugagagacauuuac

SEQ ID NO: 53714 - RNA, 23 nt, Artificial Sequence
  RNA Oligomer
ucagaauugaugagagacauuua

SEQ ID NO: 53715 - RNA, 23 nt, Artificial Sequence
  RNA Oligomer
cucagaauugaugagagacauuu

SEQ ID NO: 53716 - RNA, 23 nt, Artificial Sequence
  RNA Oligomer
gacgaaaugcuaagaugaaaucg

SEQ ID NO: 53717 - RNA, 23 nt, Artificial Sequence
  RNA Oligomer
cgacgaaaugcuaagaugaaauc

SEQ ID NO: 53718 - RNA, 23 nt, Artificial Sequence
  RNA Oligomer
acgacgaaaugcuaagaugaaau

SEQ ID NO: 53719 - RNA, 23 nt, Artificial Sequence
  RNA Oligomer
gccaauaccacuccugaaacaga

SEQ ID NO: 53720 - RNA, 23 nt, Artificial Sequence
  RNA Oligomer
agccaauaccacuccugaaacag

SEQ ID NO: 53721 - RNA, 23 nt, Artificial Sequence
  RNA Oligomer
cagccaauaccacuccugaaaca

SEQ ID NO: 53722 - RNA, 23 nt, Artificial Sequence
  RNA Oligomer
ccagccaauaccacuccugaaac

SEQ ID NO: 53723 - RNA, 23 nt, Artificial Sequence
  RNA Oligomer
cccagccaauaccacuccugaaa

SEQ ID NO: 53724 - RNA, 23 nt, Artificial Sequence
  RNA Oligomer
ggaugcuauucugaaauacaaug

SEQ ID NO: 53725 - RNA, 23 nt, Artificial Sequence
  RNA Oligomer
agacugcacuucucaacaaauuu

SEQ ID NO: 53726 - RNA, 23 nt, Artificial Sequence
  RNA Oligomer
cuaaaccuuuuccaacacauuau

SEQ ID NO: 53727 - RNA, 23 nt, Artificial Sequence
  RNA Oligomer
ccuaaaccuuuuccaacacauua

SEQ ID NO: 53728 - RNA, 23 nt, Artificial Sequence
  RNA Oligomer
uccuaaaccuuuuccaacacauu

SEQ ID NO: 53729 - RNA, 23 nt, Artificial Sequence
  RNA Oligomer
uuccuaaaccuuuuccaacacau

SEQ ID NO: 53730 - RNA, 23 nt, Artificial Sequence
  RNA Oligomer
guuccuaaaccuuuuccaacaca

SEQ ID NO: 53731 - RNA, 23 nt, Artificial Sequence
  RNA Oligomer
aguuccuaaaccuuuuccaacac

SEQ ID NO: 53732 - RNA, 23 nt, Artificial Sequence
  RNA Oligomer
ccagauaagaaguggcuuggaac

SEQ ID NO: 53733 - RNA, 23 nt, Artificial Sequence
  RNA Oligomer
uccagauaagaaguggcuuggaa

SEQ ID NO: 53734 - RNA, 23 nt, Artificial Sequence
  RNA Oligomer
cuccagauaagaaguggcuugga

SEQ ID NO: 53735 - RNA, 23 nt, Artificial Sequence
  RNA Oligomer
ucuccagauaagaaguggcuugg

SEQ ID NO: 53736 - RNA, 23 nt, Artificial Sequence
  RNA Oligomer
uucuccagauaagaaguggcuug

SEQ ID NO: 53737 - RNA, 23 nt, Artificial Sequence
  RNA Oligomer
cuaaacuaccuggaaauauuucu

SEQ ID NO: 53738 - RNA, 23 nt, Artificial Sequence
  RNA Oligomer
gcuaaacuaccuggaaauauuuc

SEQ ID NO: 53739 - RNA, 23 nt, Artificial Sequence
  RNA Oligomer
ggugaaguuagauuacauuucca

SEQ ID NO: 53740 - RNA, 23 nt, Artificial Sequence
  RNA Oligomer
agguuuugaugaacaagaagaug

SEQ ID NO: 53741 - RNA, 23 nt, Artificial Sequence
  RNA Oligomer
cagguuuugaugaacaagaagau

SEQ ID NO: 53742 - RNA, 23 nt, Artificial Sequence
  RNA Oligomer
ccagguuuugaugaacaagaaga

SEQ ID NO: 53743 - RNA, 23 nt, Artificial Sequence
  RNA Oligomer
uccagguuuugaugaacaagaag

SEQ ID NO: 53744 - RNA, 23 nt, Artificial Sequence
  RNA Oligomer
guccagguuuugaugaacaagaa

SEQ ID NO: 53745 - RNA, 23 nt, Artificial Sequence
  RNA Oligomer
ggauguggauaauucuaaaaaua

SEQ ID NO: 53746 - RNA, 23 nt, Artificial Sequence
  RNA Oligomer
uggauguggauaauucuaaaaau

SEQ ID NO: 53747 - RNA, 23 nt, Artificial Sequence
  RNA Oligomer
auggauguggauaauucuaaaaa

SEQ ID NO: 53748 - RNA, 23 nt, Artificial Sequence
  RNA Oligomer
gauggauguggauaauucuaaaa

SEQ ID NO: 53749 - RNA, 23 nt, Artificial Sequence
  RNA Oligomer
cgauggauguggauaauucuaaa

SEQ ID NO: 53750 - RNA, 23 nt, Artificial Sequence
  RNA Oligomer
gcaaaugcaaagcagacuacgga

SEQ ID NO: 53751 - RNA, 23 nt, Artificial Sequence
  RNA Oligomer
ugcaaaugcaaagcagacuacgg

SEQ ID NO: 53752 - RNA, 23 nt, Artificial Sequence
  RNA Oligomer
uugcaaaugcaaagcagacuacg

SEQ ID NO: 53753 - RNA, 23 nt, Artificial Sequence
  RNA Oligomer
cuugcaaaugcaaagcagacuac

SEQ ID NO: 53754 - RNA, 23 nt, Artificial Sequence
  RNA Oligomer
gcuugcaaaugcaaagcagacua

SEQ ID NO: 53755 - RNA, 23 nt, Artificial Sequence
  RNA Oligomer
agaauagagacaaucaacaguuu

SEQ ID NO: 53756 - RNA, 23 nt, Artificial Sequence
  RNA Oligomer
gagaauagagacaaucaacaguu

SEQ ID NO: 53757 - RNA, 23 nt, Artificial Sequence
  RNA Oligomer
gauagugaagagaauagagacaa

SEQ ID NO: 53758 - RNA, 23 nt, Artificial Sequence
  RNA Oligomer
guaugcucuuuaagugugucuau

SEQ ID NO: 53759 - RNA, 23 nt, Artificial Sequence
  RNA Oligomer
gaaaggaaauguggaauaaaagg

SEQ ID NO: 53760 - RNA, 23 nt, Artificial Sequence
  RNA Oligomer
ugaaaggaaauguggaauaaaag

SEQ ID NO: 53761 - RNA, 23 nt, Artificial Sequence
  RNA Oligomer
augaaaggaaauguggaauaaaa

SEQ ID NO: 53762 - RNA, 23 nt, Artificial Sequence
  RNA Oligomer
gaugaaaggaaauguggaauaaa

SEQ ID NO: 53763 - RNA, 23 nt, Artificial Sequence
  RNA Oligomer
agaugaaaggaaauguggaauaa

SEQ ID NO: 53764 - RNA, 23 nt, Artificial Sequence
  RNA Oligomer
uguaaugguuugucugucuuuuu

SEQ ID NO: 53765 - RNA, 23 nt, Artificial Sequence
  RNA Oligomer
cuguaaugguuugucugucuuuu

SEQ ID NO: 53766 - RNA, 23 nt, Artificial Sequence
  RNA Oligomer
ucuguaaugguuugucugucuuu

SEQ ID NO: 53767 - RNA, 23 nt, Artificial Sequence
  RNA Oligomer
aucuguaaugguuugucugucuu

SEQ ID NO: 53768 - RNA, 23 nt, Artificial Sequence
  RNA Oligomer
auccaggaaucucuuuaacugau

SEQ ID NO: 53769 - RNA, 23 nt, Artificial Sequence
  RNA Oligomer
caaguugaaauccaggaaucucu

SEQ ID NO: 53770 - RNA, 23 nt, Artificial Sequence
  RNA Oligomer
acaaguugaaauccaggaaucuc

SEQ ID NO: 53771 - RNA, 23 nt, Artificial Sequence
  RNA Oligomer
aacaaguugaaauccaggaaucu

SEQ ID NO: 53772 - RNA, 23 nt, Artificial Sequence
  RNA Oligomer
aaacaaguugaaauccaggaauc

SEQ ID NO: 53773 - RNA, 23 nt, Artificial Sequence
  RNA Oligomer
gaaacaaguugaaauccaggaau

SEQ ID NO: 53774 - RNA, 23 nt, Artificial Sequence
  RNA Oligomer
acucacguggacuuagauauguu

SEQ ID NO: 53775 - RNA, 23 nt, Artificial Sequence
  RNA Oligomer
cgcaaucucuuccacacaugugc

SEQ ID NO: 53776 - RNA, 23 nt, Artificial Sequence
  RNA Oligomer
acgcaaucucuuccacacaugug

SEQ ID NO: 53777 - RNA, 23 nt, Artificial Sequence
  RNA Oligomer
gacgcaaucucuuccacacaugu

SEQ ID NO: 53778 - RNA, 23 nt, Artificial Sequence
  RNA Oligomer
ggacgcaaucucuuccacacaug

SEQ ID NO: 53779 - RNA, 23 nt, Artificial Sequence
  RNA Oligomer
aggacgcaaucucuuccacacau

SEQ ID NO: 53780 - RNA, 23 nt, Artificial Sequence
  RNA Oligomer
caagcuuuauccauucauauacc

SEQ ID NO: 53781 - RNA, 23 nt, Artificial Sequence
  RNA Oligomer
ucaagcuuuauccauucauauac

SEQ ID NO: 53782 - RNA, 23 nt, Artificial Sequence
  RNA Oligomer
aucaagcuuuauccauucauaua

SEQ ID NO: 53783 - RNA, 23 nt, Artificial Sequence
  RNA Oligomer
caucaagcuuuauccauucauau

SEQ ID NO: 53784 - RNA, 23 nt, Artificial Sequence
  RNA Oligomer
acaucaagcuuuauccauucaua

SEQ ID NO: 53785 - RNA, 23 nt, Artificial Sequence
  RNA Oligomer
acucagaauugaugagagacauu

SEQ ID NO: 53786 - RNA, 23 nt, Artificial Sequence
  RNA Oligomer
gacucagaauugaugagagacau

SEQ ID NO: 53787 - RNA, 23 nt, Artificial Sequence
  RNA Oligomer
gccuuaauacagauauuggcagc

SEQ ID NO: 53788 - RNA, 23 nt, Artificial Sequence
  RNA Oligomer
gaaaauguuucucagcuaagucu

SEQ ID NO: 53789 - RNA, 23 nt, Artificial Sequence
  RNA Oligomer
agaaaauguuucucagcuaaguc

SEQ ID NO: 53790 - RNA, 23 nt, Artificial Sequence
  RNA Oligomer
uagaaaauguuucucagcuaagu

SEQ ID NO: 53791 - RNA, 23 nt, Artificial Sequence
  RNA Oligomer
uuagaaaauguuucucagcuaag

SEQ ID NO: 53792 - RNA, 23 nt, Artificial Sequence
  RNA Oligomer
auuagaaaauguuucucagcuaa

SEQ ID NO: 53793 - RNA, 23 nt, Artificial Sequence
  RNA Oligomer
gaaaaacccuugacacgauugca

SEQ ID NO: 53794 - RNA, 23 nt, Artificial Sequence
  RNA Oligomer
ugaaaaacccuugacacgauugc

SEQ ID NO: 53795 - RNA, 23 nt, Artificial Sequence
  RNA Oligomer
gugaaaaacccuugacacgauug

SEQ ID NO: 53796 - RNA, 23 nt, Artificial Sequence
  RNA Oligomer
ugugaaaaacccuugacacgauu

SEQ ID NO: 53797 - RNA, 23 nt, Artificial Sequence
  RNA Oligomer
augugaaaaacccuugacacgau

SEQ ID NO: 53798 - RNA, 23 nt, Artificial Sequence
  RNA Oligomer
acagagucuugaagauuuuccag

SEQ ID NO: 53799 - RNA, 23 nt, Artificial Sequence
  RNA Oligomer
gacagagucuugaagauuuucca

SEQ ID NO: 53800 - RNA, 23 nt, Artificial Sequence
  RNA Oligomer
agacagagucuugaagauuuucc

SEQ ID NO: 53801 - RNA, 23 nt, Artificial Sequence
  RNA Oligomer
aagacagagucuugaagauuuuc

SEQ ID NO: 53802 - RNA, 23 nt, Artificial Sequence
  RNA Oligomer
caagacagagucuugaagauuuu

SEQ ID NO: 53803 - RNA, 23 nt, Artificial Sequence
  RNA Oligomer
ugaaucauuccaucacaaugucg

SEQ ID NO: 53804 - RNA, 23 nt, Artificial Sequence
  RNA Oligomer
augaaucauuccaucacaauguc

SEQ ID NO: 53805 - RNA, 23 nt, Artificial Sequence
  RNA Oligomer
gaugaaucauuccaucacaaugu

SEQ ID NO: 53806 - RNA, 23 nt, Artificial Sequence
  RNA Oligomer
agaugaaucauuccaucacaaug

SEQ ID NO: 53807 - RNA, 23 nt, Artificial Sequence
  RNA Oligomer
aagaugaaucauuccaucacaau

SEQ ID NO: 53808 - RNA, 23 nt, Artificial Sequence
  RNA Oligomer
ugaucgauuucugggauaaggua

SEQ ID NO: 53809 - RNA, 23 nt, Artificial Sequence
  RNA Oligomer
uugaucgauuucugggauaaggu

SEQ ID NO: 53810 - RNA, 23 nt, Artificial Sequence
  RNA Oligomer
uuugaucgauuucugggauaagg

SEQ ID NO: 53811 - RNA, 23 nt, Artificial Sequence
  RNA Oligomer
cuuugaucgauuucugggauaag

SEQ ID NO: 53812 - RNA, 23 nt, Artificial Sequence
  RNA Oligomer
gcuuugaucgauuucugggauaa

SEQ ID NO: 53813 - RNA, 23 nt, Artificial Sequence
  RNA Oligomer
gaaauacaauguggcauauucua

SEQ ID NO: 53814 - RNA, 23 nt, Artificial Sequence
  RNA Oligomer
ugaaauacaauguggcauauucu

SEQ ID NO: 53815 - RNA, 23 nt, Artificial Sequence
  RNA Oligomer
cugaaauacaauguggcauauuc

SEQ ID NO: 53816 - RNA, 23 nt, Artificial Sequence
  RNA Oligomer
ucugaaauacaauguggcauauu

SEQ ID NO: 53817 - RNA, 23 nt, Artificial Sequence
  RNA Oligomer
uucugaaauacaauguggcauau

SEQ ID NO: 53818 - RNA, 23 nt, Artificial Sequence
  RNA Oligomer
auucugaaauacaauguggcaua

SEQ ID NO: 53819 - RNA, 23 nt, Artificial Sequence
  RNA Oligomer
aguaacuauucggguagaucuuu

SEQ ID NO: 53820 - RNA, 23 nt, Artificial Sequence
  RNA Oligomer
caguaacuauucggguagaucuu

SEQ ID NO: 53821 - RNA, 23 nt, Artificial Sequence
  RNA Oligomer
acaguaacuauucggguagaucu

SEQ ID NO: 53822 - RNA, 23 nt, Artificial Sequence
  RNA Oligomer
cacaguaacuauucggguagauc

SEQ ID NO: 53823 - RNA, 23 nt, Artificial Sequence
  RNA Oligomer
acacaguaacuauucggguagau

SEQ ID NO: 53824 - RNA, 23 nt, Artificial Sequence
  RNA Oligomer
cacacaguaacuauucggguaga

SEQ ID NO: 53825 - RNA, 23 nt, Artificial Sequence
  RNA Oligomer
ccaguuggauggacacuaaagga

SEQ ID NO: 53826 - RNA, 23 nt, Artificial Sequence
  RNA Oligomer
accaguuggauggacacuaaagg

SEQ ID NO: 53827 - RNA, 23 nt, Artificial Sequence
  RNA Oligomer
uaccaguuggauggacacuaaag

SEQ ID NO: 53828 - RNA, 23 nt, Artificial Sequence
  RNA Oligomer
uuaccaguuggauggacacuaaa

SEQ ID NO: 53829 - RNA, 23 nt, Artificial Sequence
  RNA Oligomer
ggagaugagaagaaugccucggu

SEQ ID NO: 53830 - RNA, 23 nt, Artificial Sequence
  RNA Oligomer
aggagaugagaagaaugccucgg

SEQ ID NO: 53831 - RNA, 23 nt, Artificial Sequence
  RNA Oligomer
gaggagaugagaagaaugccucg

SEQ ID NO: 53832 - RNA, 23 nt, Artificial Sequence
  RNA Oligomer
ugaggagaugagaagaaugccuc

SEQ ID NO: 53833 - RNA, 23 nt, Artificial Sequence
  RNA Oligomer
uugaggagaugagaagaaugccu

SEQ ID NO: 53834 - RNA, 23 nt, Artificial Sequence
  RNA Oligomer
ccauugaggagaugagaagaaug

SEQ ID NO: 53835 - RNA, 23 nt, Artificial Sequence
  RNA Oligomer
cccauugaggagaugagaagaau

SEQ ID NO: 53836 - RNA, 23 nt, Artificial Sequence
  RNA Oligomer
ucccauugaggagaugagaagaa

SEQ ID NO: 53837 - RNA, 23 nt, Artificial Sequence
  RNA Oligomer
cucccauugaggagaugagaaga

SEQ ID NO: 53838 - RNA, 23 nt, Artificial Sequence
  RNA Oligomer
acucccauugaggagaugagaag

SEQ ID NO: 53839 - RNA, 23 nt, Artificial Sequence
  RNA Oligomer
uucuagccugaauguagaaugca

SEQ ID NO: 53840 - RNA, 23 nt, Artificial Sequence
  RNA Oligomer
uuucuagccugaauguagaaugc

SEQ ID NO: 53841 - RNA, 23 nt, Artificial Sequence
  RNA Oligomer
auuucuagccugaauguagaaug

SEQ ID NO: 53842 - RNA, 23 nt, Artificial Sequence
  RNA Oligomer
ccaccucgcuuguuuucaaacaa

SEQ ID NO: 53843 - RNA, 23 nt, Artificial Sequence
  RNA Oligomer
gccaccucgcuuguuuucaaaca

SEQ ID NO: 53844 - RNA, 23 nt, Artificial Sequence
  RNA Oligomer
cgccaccucgcuuguuuucaaac

SEQ ID NO: 53845 - RNA, 23 nt, Artificial Sequence
  RNA Oligomer
gcgccaccucgcuuguuuucaaa

SEQ ID NO: 53846 - RNA, 23 nt, Artificial Sequence
  RNA Oligomer
agcgccaccucgcuuguuuucaa

SEQ ID NO: 53847 - RNA, 23 nt, Artificial Sequence
  RNA Oligomer
acuaagggcggugaaguuagauu

SEQ ID NO: 53848 - RNA, 23 nt, Artificial Sequence
  RNA Oligomer
aguccagguuuugaugaacaaga

SEQ ID NO: 53849 - RNA, 23 nt, Artificial Sequence
  RNA Oligomer
aaguccagguuuugaugaacaag

SEQ ID NO: 53850 - RNA, 23 nt, Artificial Sequence
  RNA Oligomer
caaguccagguuuugaugaacaa

SEQ ID NO: 53851 - RNA, 23 nt, Artificial Sequence
  RNA Oligomer
gacaaguccagguuuugaugaac

SEQ ID NO: 53852 - RNA, 23 nt, Artificial Sequence
  RNA Oligomer
agacaaguccagguuuugaugaa

SEQ ID NO: 53853 - RNA, 23 nt, Artificial Sequence
  RNA Oligomer
gagacaaguccagguuuugauga

SEQ ID NO: 53854 - RNA, 23 nt, Artificial Sequence
  RNA Oligomer
ggagacaaguccagguuuugaug

SEQ ID NO: 53855 - RNA, 23 nt, Artificial Sequence
  RNA Oligomer
aggagacaaguccagguuuugau

SEQ ID NO: 53856 - RNA, 23 nt, Artificial Sequence
  RNA Oligomer
gcagaugaggagacaaguccagg

SEQ ID NO: 53857 - RNA, 23 nt, Artificial Sequence
  RNA Oligomer
agcagaugaggagacaaguccag

SEQ ID NO: 53858 - RNA, 23 nt, Artificial Sequence
  RNA Oligomer
aagcagaugaggagacaagucca

SEQ ID NO: 53859 - RNA, 23 nt, Artificial Sequence
  RNA Oligomer
gaagcagaugaggagacaagucc

SEQ ID NO: 53860 - RNA, 23 nt, Artificial Sequence
  RNA Oligomer
agaagcagaugaggagacaaguc

SEQ ID NO: 53861 - RNA, 23 nt, Artificial Sequence
  RNA Oligomer
ccgauggauguggauaauucuaa

SEQ ID NO: 53862 - RNA, 23 nt, Artificial Sequence
  RNA Oligomer
accgauggauguggauaauucua

SEQ ID NO: 53863 - RNA, 23 nt, Artificial Sequence
  RNA Oligomer
caccgauggauguggauaauucu

SEQ ID NO: 53864 - RNA, 23 nt, Artificial Sequence
  RNA Oligomer
ucaccgauggauguggauaauuc

SEQ ID NO: 53865 - RNA, 23 nt, Artificial Sequence
  RNA Oligomer
ccaucucucucagguuagugaaa

SEQ ID NO: 53866 - RNA, 23 nt, Artificial Sequence
  RNA Oligomer
uccaucucucucagguuagugaa

SEQ ID NO: 53867 - RNA, 23 nt, Artificial Sequence
  RNA Oligomer
guccaucucucucagguuaguga

SEQ ID NO: 53868 - RNA, 23 nt, Artificial Sequence
  RNA Oligomer
aguccaucucucucagguuagug

SEQ ID NO: 53869 - RNA, 23 nt, Artificial Sequence
  RNA Oligomer
caguccaucucucucagguuagu

SEQ ID NO: 53870 - RNA, 23 nt, Artificial Sequence
  RNA Oligomer
uauaugugagcacauaaaaucua

SEQ ID NO: 53871 - RNA, 23 nt, Artificial Sequence
  RNA Oligomer
gugcuugaggcauauucauauaa

SEQ ID NO: 53872 - RNA, 23 nt, Artificial Sequence
  RNA Oligomer
ggugcuugaggcauauucauaua

SEQ ID NO: 53873 - RNA, 23 nt, Artificial Sequence
  RNA Oligomer
uggugcuugaggcauauucauau

SEQ ID NO: 53874 - RNA, 23 nt, Artificial Sequence
  RNA Oligomer
ggacuaauguuucuuuuguggug

SEQ ID NO: 53875 - RNA, 23 nt, Artificial Sequence
  RNA Oligomer
aggacuaauguuucuuuuguggu

SEQ ID NO: 53876 - RNA, 23 nt, Artificial Sequence
  RNA Oligomer
uaggacuaauguuucuuuugugg

SEQ ID NO: 53877 - RNA, 23 nt, Artificial Sequence
  RNA Oligomer
uuaggacuaauguuucuuuugug

SEQ ID NO: 53878 - RNA, 23 nt, Artificial Sequence
  RNA Oligomer
auuaggacuaauguuucuuuugu

SEQ ID NO: 53879 - RNA, 23 nt, Artificial Sequence
  RNA Oligomer
ggaauaaaaggagguuuuccuga

SEQ ID NO: 53880 - RNA, 23 nt, Artificial Sequence
  RNA Oligomer
gagaugaaaggaaauguggaaua

SEQ ID NO: 53881 - RNA, 23 nt, Artificial Sequence
  RNA Oligomer
ugcuaaaaaucucccugugagcc

SEQ ID NO: 53882 - RNA, 23 nt, Artificial Sequence
  RNA Oligomer
uugcuaaaaaucucccugugagc

SEQ ID NO: 53883 - RNA, 23 nt, Artificial Sequence
  RNA Oligomer
uuugcuaaaaaucucccugugag

SEQ ID NO: 53884 - RNA, 23 nt, Artificial Sequence
  RNA Oligomer
uuuugcuaaaaaucucccuguga

SEQ ID NO: 53885 - RNA, 23 nt, Artificial Sequence
  RNA Oligomer
auuuugcuaaaaaucucccugug

SEQ ID NO: 53886 - RNA, 23 nt, Artificial Sequence
  RNA Oligomer
caggaaacaaguugaaauccagg

SEQ ID NO: 53887 - RNA, 23 nt, Artificial Sequence
  RNA Oligomer
gucaguugguacaucuaaacucc

SEQ ID NO: 53888 - RNA, 23 nt, Artificial Sequence
  RNA Oligomer
ugucaguugguacaucuaaacuc

SEQ ID NO: 53889 - RNA, 23 nt, Artificial Sequence
  RNA Oligomer
uugucaguugguacaucuaaacu

SEQ ID NO: 53890 - RNA, 23 nt, Artificial Sequence
  RNA Oligomer
guugucaguugguacaucuaaac

SEQ ID NO: 53891 - RNA, 23 nt, Artificial Sequence
  RNA Oligomer
aguugucaguugguacaucuaaa

SEQ ID NO: 53892 - RNA, 23 nt, Artificial Sequence
  RNA Oligomer
gucagguguaauauaugaauuga

SEQ ID NO: 53893 - RNA, 23 nt, Artificial Sequence
  RNA Oligomer
ugucagguguaauauaugaauug

SEQ ID NO: 53894 - RNA, 23 nt, Artificial Sequence
  RNA Oligomer
cugucagguguaauauaugaauu

SEQ ID NO: 53895 - RNA, 23 nt, Artificial Sequence
  RNA Oligomer
cgaauagcaucuccucccaccuc

SEQ ID NO: 53896 - RNA, 23 nt, Artificial Sequence
  RNA Oligomer
gcgaauagcaucuccucccaccu

SEQ ID NO: 53897 - RNA, 23 nt, Artificial Sequence
  RNA Oligomer
agcgaauagcaucuccucccacc

SEQ ID NO: 53898 - RNA, 23 nt, Artificial Sequence
  RNA Oligomer
gagcgaauagcaucuccucccac

SEQ ID NO: 53899 - RNA, 23 nt, Artificial Sequence
  RNA Oligomer
cgagcgaauagcaucuccuccca

SEQ ID NO: 53900 - RNA, 23 nt, Artificial Sequence
  RNA Oligomer
ucauauaccaugcugucgagucc

SEQ ID NO: 53901 - RNA, 23 nt, Artificial Sequence
  RNA Oligomer
uucauauaccaugcugucgaguc

SEQ ID NO: 53902 - RNA, 23 nt, Artificial Sequence
  RNA Oligomer
auucauauaccaugcugucgagu

SEQ ID NO: 53903 - RNA, 23 nt, Artificial Sequence
  RNA Oligomer
cauucauauaccaugcugucgag

SEQ ID NO: 53904 - RNA, 23 nt, Artificial Sequence
  RNA Oligomer
gcuuuauccauucauauaccaug

SEQ ID NO: 53905 - RNA, 23 nt, Artificial Sequence
  RNA Oligomer
agcuuuauccauucauauaccau

SEQ ID NO: 53906 - RNA, 23 nt, Artificial Sequence
  RNA Oligomer
aagcuuuauccauucauauacca

SEQ ID NO: 53907 - RNA, 23 nt, Artificial Sequence
  RNA Oligomer
acaaugaagaaugcagaaacugu

SEQ ID NO: 53908 - RNA, 23 nt, Artificial Sequence
  RNA Oligomer
uacaaugaagaaugcagaaacug

SEQ ID NO: 53909 - RNA, 23 nt, Artificial Sequence
  RNA Oligomer
cuacaaugaagaaugcagaaacu

SEQ ID NO: 53910 - RNA, 23 nt, Artificial Sequence
  RNA Oligomer
acuacaaugaagaaugcagaaac

SEQ ID NO: 53911 - RNA, 23 nt, Artificial Sequence
  RNA Oligomer
uacuacaaugaagaaugcagaaa

SEQ ID NO: 53912 - RNA, 23 nt, Artificial Sequence
  RNA Oligomer
agagaaucuuucugcaguggcca

SEQ ID NO: 53913 - RNA, 23 nt, Artificial Sequence
  RNA Oligomer
cagagaaucuuucugcaguggcc

SEQ ID NO: 53914 - RNA, 23 nt, Artificial Sequence
  RNA Oligomer
ucagagaaucuuucugcaguggc

SEQ ID NO: 53915 - RNA, 23 nt, Artificial Sequence
  RNA Oligomer
uucagagaaucuuucugcagugg

SEQ ID NO: 53916 - RNA, 23 nt, Artificial Sequence
  RNA Oligomer
cuucagagaaucuuucugcagug

SEQ ID NO: 53917 - RNA, 23 nt, Artificial Sequence
  RNA Oligomer
ccaaggcaugcuacagguggauu

SEQ ID NO: 53918 - RNA, 23 nt, Artificial Sequence
  RNA Oligomer
gccaaggcaugcuacagguggau

SEQ ID NO: 53919 - RNA, 23 nt, Artificial Sequence
  RNA Oligomer
ugaugaguucuguacaaaaagau

SEQ ID NO: 53920 - RNA, 23 nt, Artificial Sequence
  RNA Oligomer
augaugaguucuguacaaaaaga

SEQ ID NO: 53921 - RNA, 23 nt, Artificial Sequence
  RNA Oligomer
caugaugaguucuguacaaaaag

SEQ ID NO: 53922 - RNA, 23 nt, Artificial Sequence
  RNA Oligomer
ccaugaugaguucuguacaaaaa

SEQ ID NO: 53923 - RNA, 23 nt, Artificial Sequence
  RNA Oligomer
gguuaaaagccuuaauacagaua

SEQ ID NO: 53924 - RNA, 23 nt, Artificial Sequence
  RNA Oligomer
uccaugaugaguucuguacaaaa

SEQ ID NO: 53925 - RNA, 23 nt, Artificial Sequence
  RNA Oligomer
gucuuuuuuccucugaucaguau

SEQ ID NO: 53926 - RNA, 23 nt, Artificial Sequence
  RNA Oligomer
caacauuuauaucaguccaucuu

SEQ ID NO: 53927 - RNA, 23 nt, Artificial Sequence
  RNA Oligomer
caauguguaaguggcaaaaugaa

SEQ ID NO: 53928 - RNA, 23 nt, Artificial Sequence
  RNA Oligomer
caaucgauuguuugagggacguu

SEQ ID NO: 53929 - RNA, 23 nt, Artificial Sequence
  RNA Oligomer
gaaauauuucuagccugaaugua

SEQ ID NO: 53930 - RNA, 23 nt, Artificial Sequence
  RNA Oligomer
caauacaagaauagaauccauga

SEQ ID NO: 53931 - RNA, 23 nt, Artificial Sequence
  RNA Oligomer
acaauacaagaauagaauccaug

SEQ ID NO: 53932 - RNA, 23 nt, Artificial Sequence
  RNA Oligomer
cgguggugggaaagugaacgaau

SEQ ID NO: 53933 - RNA, 23 nt, Artificial Sequence
  RNA Oligomer
agagagaaagcaggcgaguguuu

SEQ ID NO: 53934 - RNA, 23 nt, Artificial Sequence
  RNA Oligomer
ccuuaauacagauauuggcagcu

SEQ ID NO: 53935 - RNA, 23 nt, Artificial Sequence
  RNA Oligomer
agcuuugaucgauuucugggaua

SEQ ID NO: 53936 - RNA, 23 nt, Artificial Sequence
  RNA Oligomer
ccaaaacuugaaggaugcuauuc

SEQ ID NO: 53937 - RNA, 23 nt, Artificial Sequence
  RNA Oligomer
cagaagaaaagaacagugggaaa

SEQ ID NO: 53938 - RNA, 23 nt, Artificial Sequence
  RNA Oligomer
ucagguuagugaaaugaggcucu

SEQ ID NO: 53939 - RNA, 23 nt, Artificial Sequence
  RNA Oligomer
gaaauguggaauaaaaggagguu

SEQ ID NO: 53940 - RNA, 23 nt, Artificial Sequence
  RNA Oligomer
ccagaaauuguacuuuugaggua

SEQ ID NO: 53941 - RNA, 23 nt, Artificial Sequence
  RNA Oligomer
ugcuacgauacuacaaugaagaa

SEQ ID NO: 53942 - RNA, 23 nt, Artificial Sequence
  RNA Oligomer
ccgcuuuuuaaucaauccugagu

SEQ ID NO: 53943 - RNA, 23 nt, Artificial Sequence
  RNA Oligomer
ucgauuguuugagggacguucau

SEQ ID NO: 53944 - RNA, 23 nt, Artificial Sequence
  RNA Oligomer
ucaaucgauuguuugagggacgu

SEQ ID NO: 53945 - RNA, 23 nt, Artificial Sequence
  RNA Oligomer
cccuaaauacguuccaccucacc

SEQ ID NO: 53946 - RNA, 23 nt, Artificial Sequence
  RNA Oligomer
uuaaaugcuaaacuaccuggaaa

SEQ ID NO: 53947 - RNA, 23 nt, Artificial Sequence
  RNA Oligomer
ugauuuaaaugcuaaacuaccug

SEQ ID NO: 53948 - RNA, 23 nt, Artificial Sequence
  RNA Oligomer
gguacucuacuaagggcggugaa

SEQ ID NO: 53949 - RNA, 23 nt, Artificial Sequence
  RNA Oligomer
cggagcagcuuuuggaaagugaa

SEQ ID NO: 53950 - RNA, 23 nt, Artificial Sequence
  RNA Oligomer
cuuuuuuccucugaucaguauuu

SEQ ID NO: 53951 - RNA, 23 nt, Artificial Sequence
  RNA Oligomer
cauuaacuucaaucgauuguuug

SEQ ID NO: 53952 - RNA, 23 nt, Artificial Sequence
  RNA Oligomer
gcucaacauuuauaucaguccau

SEQ ID NO: 53953 - RNA, 23 nt, Artificial Sequence
  RNA Oligomer
cgauuucugggauaagguacuug

SEQ ID NO: 53954 - RNA, 23 nt, Artificial Sequence
  RNA Oligomer
guaacuauucggguagaucuuuu

SEQ ID NO: 53955 - RNA, 23 nt, Artificial Sequence
  RNA Oligomer
ccuaaauacguuccaccucaccu

SEQ ID NO: 53956 - RNA, 23 nt, Artificial Sequence
  RNA Oligomer
cguaugcucuuuaagugugucua

SEQ ID NO: 53957 - RNA, 23 nt, Artificial Sequence
  RNA Oligomer
acguaugcucuuuaagugugucu

SEQ ID NO: 53958 - RNA, 23 nt, Artificial Sequence
  RNA Oligomer
agaaacucccauaucaucuauau

SEQ ID NO: 53959 - RNA, 23 nt, Artificial Sequence
  RNA Oligomer
acauauugaaguuucucugguau

SEQ ID NO: 53960 - RNA, 23 nt, Artificial Sequence
  RNA Oligomer
gaacugggaacuucaugcugauu

SEQ ID NO: 53961 - RNA, 23 nt, Artificial Sequence
  RNA Oligomer
ggagcagcuuuuggaaagugaac

SEQ ID NO: 53962 - RNA, 23 nt, Artificial Sequence
  RNA Oligomer
gcaugcacauuuuccuuacugaa

SEQ ID NO: 53963 - RNA, 23 nt, Artificial Sequence
  RNA Oligomer
ugaaugucuaauuaucacaggua

SEQ ID NO: 53964 - RNA, 23 nt, Artificial Sequence
  RNA Oligomer
gcaggacuugugcaagaagaaau

SEQ ID NO: 53965 - RNA, 23 nt, Artificial Sequence
  RNA Oligomer
gcuacuuuagaagagucacagag

SEQ ID NO: 53966 - RNA, 23 nt, Artificial Sequence
  RNA Oligomer
ucaacauuuauaucaguccaucu

SEQ ID NO: 53967 - RNA, 23 nt, Artificial Sequence
  RNA Oligomer
acaauguggcauauucuaagaaa

SEQ ID NO: 53968 - RNA, 23 nt, Artificial Sequence
  RNA Oligomer
agaagaaaagaacagugggaaac

SEQ ID NO: 53969 - RNA, 23 nt, Artificial Sequence
  RNA Oligomer
gcagaaauucuaagcaacaugga

SEQ ID NO: 53970 - RNA, 23 nt, Artificial Sequence
  RNA Oligomer
ggagagagucgcacuggaaugaa

SEQ ID NO: 53971 - RNA, 23 nt, Artificial Sequence
  RNA Oligomer
gaaacucccauaucaucuauauu

SEQ ID NO: 53972 - RNA, 23 nt, Artificial Sequence
  RNA Oligomer
cagaaacucccauaucaucuaua

SEQ ID NO: 53973 - RNA, 23 nt, Artificial Sequence
  RNA Oligomer
gaaucucuuuaacugauuuugcu

SEQ ID NO: 53974 - RNA, 23 nt, Artificial Sequence
  RNA Oligomer
cagguguaauauaugaauugacu

SEQ ID NO: 53975 - RNA, 23 nt, Artificial Sequence
  RNA Oligomer
ucagguguaauauaugaauugac

SEQ ID NO: 53976 - RNA, 23 nt, Artificial Sequence
  RNA Oligomer
ugaacaaggcuuacuguggauuu

SEQ ID NO: 53977 - RNA, 23 nt, Artificial Sequence
  RNA Oligomer
gagaaaaugagacgcgagcugaa

SEQ ID NO: 53978 - RNA, 23 nt, Artificial Sequence
  RNA Oligomer
cgcuuuuuaaucaauccugaguu

SEQ ID NO: 53979 - RNA, 23 nt, Artificial Sequence
  RNA Oligomer
gaugaaaucggaguauucuaguu

SEQ ID NO: 53980 - RNA, 23 nt, Artificial Sequence
  RNA Oligomer
gcagaagcucaacauuuauauca

SEQ ID NO: 53981 - RNA, 23 nt, Artificial Sequence
  RNA Oligomer
acaacaauacaagaauagaaucc

SEQ ID NO: 53982 - RNA, 23 nt, Artificial Sequence
  RNA Oligomer
caauguggcauauucuaagaaau

SEQ ID NO: 53983 - RNA, 23 nt, Artificial Sequence
  RNA Oligomer
cagauaagaaguggcuuggaacu

SEQ ID NO: 53984 - RNA, 23 nt, Artificial Sequence
  RNA Oligomer
cuaaauacguuccaccucaccuu

SEQ ID NO: 53985 - RNA, 23 nt, Artificial Sequence
  RNA Oligomer
gcacuggaaugaaugauuuaaau

SEQ ID NO: 53986 - RNA, 23 nt, Artificial Sequence
  RNA Oligomer
gagagagucgcacuggaaugaau

SEQ ID NO: 53987 - RNA, 23 nt, Artificial Sequence
  RNA Oligomer
gacauugaauuuaggaaacggua

SEQ ID NO: 53988 - RNA, 23 nt, Artificial Sequence
  RNA Oligomer
cgcugacauugaauuuaggaaac

SEQ ID NO: 53989 - RNA, 23 nt, Artificial Sequence
  RNA Oligomer
ggaagaugaacaggccagagaag

SEQ ID NO: 53990 - RNA, 23 nt, Artificial Sequence
  RNA Oligomer
acagauagugaagagaauagaga

SEQ ID NO: 53991 - RNA, 23 nt, Artificial Sequence
  RNA Oligomer
gcugauuuguacauauugaaguu

SEQ ID NO: 53992 - RNA, 23 nt, Artificial Sequence
  RNA Oligomer
acacacggagcagcuuuuggaaa

SEQ ID NO: 53993 - RNA, 23 nt, Artificial Sequence
  RNA Oligomer
ucuuuuuuccucugaucaguauu

SEQ ID NO: 53994 - RNA, 23 nt, Artificial Sequence
  RNA Oligomer
ugucuuuuuuccucugaucagua

SEQ ID NO: 53995 - RNA, 23 nt, Artificial Sequence
  RNA Oligomer
uguuugagcugucagguguaaua

SEQ ID NO: 53996 - RNA, 23 nt, Artificial Sequence
  RNA Oligomer
gucuaauuaucacagguacugag

SEQ ID NO: 53997 - RNA, 23 nt, Artificial Sequence
  RNA Oligomer
uuaaaacgcucuucugcuacuuu

SEQ ID NO: 53998 - RNA, 23 nt, Artificial Sequence
  RNA Oligomer
aacaaaauuuguacccaguggaa

SEQ ID NO: 53999 - RNA, 23 nt, Artificial Sequence
  RNA Oligomer
ggguagaucuuuugcgagcagga

SEQ ID NO: 54000 - RNA, 23 nt, Artificial Sequence
  RNA Oligomer
agaucccuaaauacguuccaccu

SEQ ID NO: 54001 - RNA, 23 nt, Artificial Sequence
  RNA Oligomer
gcaacauggaaaaaaggauucua

SEQ ID NO: 54002 - RNA, 23 nt, Artificial Sequence
  RNA Oligomer
cuauuaccaguuggauggacacu

SEQ ID NO: 54003 - RNA, 23 nt, Artificial Sequence
  RNA Oligomer
ugacauugaauuuaggaaacggu

SEQ ID NO: 54004 - RNA, 23 nt, Artificial Sequence
  RNA Oligomer
ccaaacagcaaauaaaccuucaa

SEQ ID NO: 54005 - RNA, 23 nt, Artificial Sequence
  RNA Oligomer
cuaaaaauaguugucaagacuca

SEQ ID NO: 54006 - RNA, 23 nt, Artificial Sequence
  RNA Oligomer
ugagauagauguggugccagaga

SEQ ID NO: 54007 - RNA, 23 nt, Artificial Sequence
  RNA Oligomer
cuaauguuucuuuuguggugcuu

SEQ ID NO: 54008 - RNA, 23 nt, Artificial Sequence
  RNA Oligomer
cucuuaauaugcuugcauuguuu

SEQ ID NO: 54009 - RNA, 23 nt, Artificial Sequence
  RNA Oligomer
uucuuuuguccaucagaucucuu

SEQ ID NO: 54010 - RNA, 23 nt, Artificial Sequence
  RNA Oligomer
gcugagcgagaugugguuuauuu

SEQ ID NO: 54011 - RNA, 23 nt, Artificial Sequence
  RNA Oligomer
cugaaaaaaguacacaguauuug

SEQ ID NO: 54012 - RNA, 23 nt, Artificial Sequence
  RNA Oligomer
uccgcuuuuuaaucaauccugag

SEQ ID NO: 54013 - RNA, 23 nt, Artificial Sequence
  RNA Oligomer
agaaauccgcuuuuuaaucaauc

SEQ ID NO: 54014 - RNA, 23 nt, Artificial Sequence
  RNA Oligomer
gaagaaauccgcuuuuuaaucaa

SEQ ID NO: 54015 - RNA, 23 nt, Artificial Sequence
  RNA Oligomer
ggguuggugacauuuacaagaca

SEQ ID NO: 54016 - RNA, 23 nt, Artificial Sequence
  RNA Oligomer
ugaaaucggaguauucuaguuac

SEQ ID NO: 54017 - RNA, 23 nt, Artificial Sequence
  RNA Oligomer
ucgauuucugggauaagguacuu

SEQ ID NO: 54018 - RNA, 23 nt, Artificial Sequence
  RNA Oligomer
cagcuuugaucgauuucugggau

SEQ ID NO: 54019 - RNA, 23 nt, Artificial Sequence
  RNA Oligomer
gcauauucuaagaaaugggacuu

SEQ ID NO: 54020 - RNA, 23 nt, Artificial Sequence
  RNA Oligomer
ggcauauucuaagaaaugggacu

SEQ ID NO: 54021 - RNA, 23 nt, Artificial Sequence
  RNA Oligomer
cuauucugaaauacaauguggca

SEQ ID NO: 54022 - RNA, 23 nt, Artificial Sequence
  RNA Oligomer
gcucauucagacugcacuucuca

SEQ ID NO: 54023 - RNA, 23 nt, Artificial Sequence
  RNA Oligomer
guggcauauucuaagaaauggga

SEQ ID NO: 54024 - RNA, 23 nt, Artificial Sequence
  RNA Oligomer
uguggcauauucuaagaaauggg

SEQ ID NO: 54025 - RNA, 23 nt, Artificial Sequence
  RNA Oligomer
auguggcauauucuaagaaaugg

SEQ ID NO: 54026 - RNA, 23 nt, Artificial Sequence
  RNA Oligomer
aauguggcauauucuaagaaaug

SEQ ID NO: 54027 - RNA, 23 nt, Artificial Sequence
  RNA Oligomer
caauguggcauauucuaagaaau

SEQ ID NO: 54028 - RNA, 23 nt, Artificial Sequence
  RNA Oligomer
gaagaucccuaaauacguuccac

SEQ ID NO: 54029 - RNA, 23 nt, Artificial Sequence
  RNA Oligomer
ggaagaucccuaaauacguucca

SEQ ID NO: 54030 - RNA, 23 nt, Artificial Sequence
  RNA Oligomer
aggaagaucccuaaauacguucc

SEQ ID NO: 54031 - RNA, 23 nt, Artificial Sequence
  RNA Oligomer
aaggaagaucccuaaauacguuc

SEQ ID NO: 54032 - RNA, 23 nt, Artificial Sequence
  RNA Oligomer
aaaggaagaucccuaaauacguu

SEQ ID NO: 54033 - RNA, 23 nt, Artificial Sequence
  RNA Oligomer
cguguaaauuuguugagaagugc

SEQ ID NO: 54034 - RNA, 23 nt, Artificial Sequence
  RNA Oligomer
guguaaauuuguugagaagugca

SEQ ID NO: 54035 - RNA, 23 nt, Artificial Sequence
  RNA Oligomer
uguaaauuuguugagaagugcag

SEQ ID NO: 54036 - RNA, 23 nt, Artificial Sequence
  RNA Oligomer
guaaauuuguugagaagugcagu

SEQ ID NO: 54037 - RNA, 23 nt, Artificial Sequence
  RNA Oligomer
uaaauuuguugagaagugcaguc

SEQ ID NO: 54038 - RNA, 23 nt, Artificial Sequence
  RNA Oligomer
gaagcaacugguauaauauaugg

SEQ ID NO: 54039 - RNA, 23 nt, Artificial Sequence
  RNA Oligomer
aagcaacugguauaauauauggg

SEQ ID NO: 54040 - RNA, 23 nt, Artificial Sequence
  RNA Oligomer
agcaacugguauaauauaugggc

SEQ ID NO: 54041 - RNA, 23 nt, Artificial Sequence
  RNA Oligomer
gcaacugguauaauauaugggca

SEQ ID NO: 54042 - RNA, 23 nt, Artificial Sequence
  RNA Oligomer
caacugguauaauauaugggcag

SEQ ID NO: 54043 - RNA, 23 nt, Artificial Sequence
  RNA Oligomer
ccguguguuucccuucauuuugc

SEQ ID NO: 54044 - RNA, 23 nt, Artificial Sequence
  RNA Oligomer
cguguguuucccuucauuuugcc

SEQ ID NO: 54045 - RNA, 23 nt, Artificial Sequence
  RNA Oligomer
guguguuucccuucauuuugcca

SEQ ID NO: 54046 - RNA, 23 nt, Artificial Sequence
  RNA Oligomer
uguguuucccuucauuuugccac

SEQ ID NO: 54047 - RNA, 23 nt, Artificial Sequence
  RNA Oligomer
guguuucccuucauuuugccacu

SEQ ID NO: 54048 - RNA, 23 nt, Artificial Sequence
  RNA Oligomer
uguuucccuucauuuugccacuu

SEQ ID NO: 54049 - RNA, 23 nt, Artificial Sequence
  RNA Oligomer
aacaaucgauugaaguuaauguc

SEQ ID NO: 54050 - RNA, 23 nt, Artificial Sequence
  RNA Oligomer
acaaucgauugaaguuaaugucu

SEQ ID NO: 54051 - RNA, 23 nt, Artificial Sequence
  RNA Oligomer
caaucgauugaaguuaaugucug

SEQ ID NO: 54052 - RNA, 23 nt, Artificial Sequence
  RNA Oligomer
aaucgauugaaguuaaugucugg

SEQ ID NO: 54053 - RNA, 23 nt, Artificial Sequence
  RNA Oligomer
aucgauugaaguuaaugucuggg

SEQ ID NO: 54054 - RNA, 23 nt, Artificial Sequence
  RNA Oligomer
uggggucguguaaauuuguugag

SEQ ID NO: 54055 - RNA, 23 nt, Artificial Sequence
  RNA Oligomer
ggggucguguaaauuuguugaga

SEQ ID NO: 54056 - RNA, 23 nt, Artificial Sequence
  RNA Oligomer
gggucguguaaauuuguugagaa

SEQ ID NO: 54057 - RNA, 23 nt, Artificial Sequence
  RNA Oligomer
ggucguguaaauuuguugagaag

SEQ ID NO: 54058 - RNA, 23 nt, Artificial Sequence
  RNA Oligomer
gucguguaaauuuguugagaagu

SEQ ID NO: 54059 - RNA, 23 nt, Artificial Sequence
  RNA Oligomer
guuucccuucauuuugccacuua

SEQ ID NO: 54060 - RNA, 23 nt, Artificial Sequence
  RNA Oligomer
uuucccuucauuuugccacuuac

SEQ ID NO: 54061 - RNA, 23 nt, Artificial Sequence
  RNA Oligomer
ucgauugaaguuaaugucugggu

SEQ ID NO: 54062 - RNA, 23 nt, Artificial Sequence
  RNA Oligomer
cgauugaaguuaaugucugggua

SEQ ID NO: 54063 - RNA, 23 nt, Artificial Sequence
  RNA Oligomer
gauugaaguuaaugucuggguaa

SEQ ID NO: 54064 - RNA, 23 nt, Artificial Sequence
  RNA Oligomer
auugaaguuaaugucuggguaac

SEQ ID NO: 54065 - RNA, 23 nt, Artificial Sequence
  RNA Oligomer
acuguugauugucucuauucucu

SEQ ID NO: 54066 - RNA, 23 nt, Artificial Sequence
  RNA Oligomer
cuguugauugucucuauucucuu

SEQ ID NO: 54067 - RNA, 23 nt, Artificial Sequence
  RNA Oligomer
uguugauugucucuauucucuuc

SEQ ID NO: 54068 - RNA, 23 nt, Artificial Sequence
  RNA Oligomer
guugauugucucuauucucuuca

SEQ ID NO: 54069 - RNA, 23 nt, Artificial Sequence
  RNA Oligomer
uugauugucucuauucucuucac

SEQ ID NO: 54070 - RNA, 23 nt, Artificial Sequence
  RNA Oligomer
gcaaaaucaguuaaagagauucc

SEQ ID NO: 54071 - RNA, 23 nt, Artificial Sequence
  RNA Oligomer
caaaaucaguuaaagagauuccu

SEQ ID NO: 54072 - RNA, 23 nt, Artificial Sequence
  RNA Oligomer
aaaaucaguuaaagagauuccug

SEQ ID NO: 54073 - RNA, 23 nt, Artificial Sequence
  RNA Oligomer
aaaucaguuaaagagauuccugg

SEQ ID NO: 54074 - RNA, 23 nt, Artificial Sequence
  RNA Oligomer
aaucaguuaaagagauuccugga

SEQ ID NO: 54075 - RNA, 23 nt, Artificial Sequence
  RNA Oligomer
cuggauuucaacuuguuuccugg

SEQ ID NO: 54076 - RNA, 23 nt, Artificial Sequence
  RNA Oligomer
uggauuucaacuuguuuccuggc

SEQ ID NO: 54077 - RNA, 23 nt, Artificial Sequence
  RNA Oligomer
ggauuucaacuuguuuccuggca

SEQ ID NO: 54078 - RNA, 23 nt, Artificial Sequence
  RNA Oligomer
gauuucaacuuguuuccuggcau

SEQ ID NO: 54079 - RNA, 23 nt, Artificial Sequence
  RNA Oligomer
auuucaacuuguuuccuggcauc

SEQ ID NO: 54080 - RNA, 23 nt, Artificial Sequence
  RNA Oligomer
ucgacagcaugguauaugaaugg

SEQ ID NO: 54081 - RNA, 23 nt, Artificial Sequence
  RNA Oligomer
cgacagcaugguauaugaaugga

SEQ ID NO: 54082 - RNA, 23 nt, Artificial Sequence
  RNA Oligomer
gacagcaugguauaugaauggau

SEQ ID NO: 54083 - RNA, 23 nt, Artificial Sequence
  RNA Oligomer
acagcaugguauaugaauggaua

SEQ ID NO: 54084 - RNA, 23 nt, Artificial Sequence
  RNA Oligomer
cagcaugguauaugaauggauaa

SEQ ID NO: 54085 - RNA, 23 nt, Artificial Sequence
  RNA Oligomer
uagaauuucugcauucuacauuc

SEQ ID NO: 54086 - RNA, 23 nt, Artificial Sequence
  RNA Oligomer
agaauuucugcauucuacauuca

SEQ ID NO: 54087 - RNA, 23 nt, Artificial Sequence
  RNA Oligomer
gaauuucugcauucuacauucag

SEQ ID NO: 54088 - RNA, 23 nt, Artificial Sequence
  RNA Oligomer
aauuucugcauucuacauucagg

SEQ ID NO: 54089 - RNA, 23 nt, Artificial Sequence
  RNA Oligomer
auuucugcauucuacauucaggc

SEQ ID NO: 54090 - RNA, 23 nt, Artificial Sequence
  RNA Oligomer
caagcauauuaagaguugagugg

SEQ ID NO: 54091 - RNA, 23 nt, Artificial Sequence
  RNA Oligomer
aagcauauuaagaguugagugga

SEQ ID NO: 54092 - RNA, 23 nt, Artificial Sequence
  RNA Oligomer
agcauauuaagaguugaguggaa

SEQ ID NO: 54093 - RNA, 23 nt, Artificial Sequence
  RNA Oligomer
gcauauuaagaguugaguggaag

SEQ ID NO: 54094 - RNA, 23 nt, Artificial Sequence
  RNA Oligomer
cauauuaagaguugaguggaagg

SEQ ID NO: 54095 - RNA, 23 nt, Artificial Sequence
  RNA Oligomer
uuucaucuuagcauuucgucgug

SEQ ID NO: 54096 - RNA, 23 nt, Artificial Sequence
  RNA Oligomer
uucaucuuagcauuucgucgugg

SEQ ID NO: 54097 - RNA, 23 nt, Artificial Sequence
  RNA Oligomer
ucaucuuagcauuucgucgugga

SEQ ID NO: 54098 - RNA, 23 nt, Artificial Sequence
  RNA Oligomer
caucuuagcauuucgucguggaa

SEQ ID NO: 54099 - RNA, 23 nt, Artificial Sequence
  RNA Oligomer
aucuuagcauuucgucguggaaa

SEQ ID NO: 54100 - RNA, 23 nt, Artificial Sequence
  RNA Oligomer
uuuggggucguguaaauuuguug

SEQ ID NO: 54101 - RNA, 23 nt, Artificial Sequence
  RNA Oligomer
uuggggucguguaaauuuguuga

SEQ ID NO: 54102 - RNA, 23 nt, Artificial Sequence
  RNA Oligomer
cuugauuccuuuaguguccaucc

SEQ ID NO: 54103 - RNA, 23 nt, Artificial Sequence
  RNA Oligomer
uugauuccuuuaguguccaucca

SEQ ID NO: 54104 - RNA, 23 nt, Artificial Sequence
  RNA Oligomer
ugauuccuuuaguguccauccaa

SEQ ID NO: 54105 - RNA, 23 nt, Artificial Sequence
  RNA Oligomer
gauuccuuuaguguccauccaac

SEQ ID NO: 54106 - RNA, 23 nt, Artificial Sequence
  RNA Oligomer
auuccuuuaguguccauccaacu

SEQ ID NO: 54107 - RNA, 23 nt, Artificial Sequence
  RNA Oligomer
uuucugcauucuacauucaggcu

SEQ ID NO: 54108 - RNA, 23 nt, Artificial Sequence
  RNA Oligomer
uucugcauucuacauucaggcua

SEQ ID NO: 54109 - RNA, 23 nt, Artificial Sequence
  RNA Oligomer
ucugcauucuacauucaggcuag

SEQ ID NO: 54110 - RNA, 23 nt, Artificial Sequence
  RNA Oligomer
cugcauucuacauucaggcuaga

SEQ ID NO: 54111 - RNA, 23 nt, Artificial Sequence
  RNA Oligomer
ggaaauguaaucuaacuucaccg

SEQ ID NO: 54112 - RNA, 23 nt, Artificial Sequence
  RNA Oligomer
gaaauguaaucuaacuucaccgc

SEQ ID NO: 54113 - RNA, 23 nt, Artificial Sequence
  RNA Oligomer
aaauguaaucuaacuucaccgcc

SEQ ID NO: 54114 - RNA, 23 nt, Artificial Sequence
  RNA Oligomer
aauguaaucuaacuucaccgccc

SEQ ID NO: 54115 - RNA, 23 nt, Artificial Sequence
  RNA Oligomer
auguaaucuaacuucaccgcccu

SEQ ID NO: 54116 - RNA, 23 nt, Artificial Sequence
  RNA Oligomer
uguaaucuaacuucaccgcccuu

SEQ ID NO: 54117 - RNA, 23 nt, Artificial Sequence
  RNA Oligomer
guaaucuaacuucaccgcccuua

SEQ ID NO: 54118 - RNA, 23 nt, Artificial Sequence
  RNA Oligomer
uaaucuaacuucaccgcccuuag

SEQ ID NO: 54119 - RNA, 23 nt, Artificial Sequence
  RNA Oligomer
gcccuuaguagaguaccguuucc

SEQ ID NO: 54120 - RNA, 23 nt, Artificial Sequence
  RNA Oligomer
cccuuaguagaguaccguuuccu

SEQ ID NO: 54121 - RNA, 23 nt, Artificial Sequence
  RNA Oligomer
ccuuaguagaguaccguuuccua

SEQ ID NO: 54122 - RNA, 23 nt, Artificial Sequence
  RNA Oligomer
cuuaguagaguaccguuuccuaa

SEQ ID NO: 54123 - RNA, 23 nt, Artificial Sequence
  RNA Oligomer
uuaguagaguaccguuuccuaaa

SEQ ID NO: 54124 - RNA, 23 nt, Artificial Sequence
  RNA Oligomer
ugauugucucuauucucuucacu

SEQ ID NO: 54125 - RNA, 23 nt, Artificial Sequence
  RNA Oligomer
gauugucucuauucucuucacua

SEQ ID NO: 54126 - RNA, 23 nt, Artificial Sequence
  RNA Oligomer
auugucucuauucucuucacuau

SEQ ID NO: 54127 - RNA, 23 nt, Artificial Sequence
  RNA Oligomer
guacaaaucagcaugaaguuccc

SEQ ID NO: 54128 - RNA, 23 nt, Artificial Sequence
  RNA Oligomer
uacaaaucagcaugaaguuccca

SEQ ID NO: 54129 - RNA, 23 nt, Artificial Sequence
  RNA Oligomer
acaaaucagcaugaaguucccag

SEQ ID NO: 54130 - RNA, 23 nt, Artificial Sequence
  RNA Oligomer
caaaucagcaugaaguucccagu

SEQ ID NO: 54131 - RNA, 23 nt, Artificial Sequence
  RNA Oligomer
aaaucagcaugaaguucccaguu

SEQ ID NO: 54132 - RNA, 23 nt, Artificial Sequence
  RNA Oligomer
caggaaaaccuccuuuuauucca

SEQ ID NO: 54133 - RNA, 23 nt, Artificial Sequence
  RNA Oligomer
aggaaaaccuccuuuuauuccac

SEQ ID NO: 54134 - RNA, 23 nt, Artificial Sequence
  RNA Oligomer
ggaaaaccuccuuuuauuccaca

SEQ ID NO: 54135 - RNA, 23 nt, Artificial Sequence
  RNA Oligomer
gaaaaccuccuuuuauuccacau

SEQ ID NO: 54136 - RNA, 23 nt, Artificial Sequence
  RNA Oligomer
aaaaccuccuuuuauuccacauu

SEQ ID NO: 54137 - RNA, 23 nt, Artificial Sequence
  RNA Oligomer
aaccuaggagguuugcauuaugc

SEQ ID NO: 54138 - RNA, 23 nt, Artificial Sequence
  RNA Oligomer
accuaggagguuugcauuaugca

SEQ ID NO: 54139 - RNA, 23 nt, Artificial Sequence
  RNA Oligomer
ccuaggagguuugcauuaugcaa

SEQ ID NO: 54140 - RNA, 23 nt, Artificial Sequence
  RNA Oligomer
cuaggagguuugcauuaugcaac

SEQ ID NO: 54141 - RNA, 23 nt, Artificial Sequence
  RNA Oligomer
uaggagguuugcauuaugcaaca

SEQ ID NO: 54142 - RNA, 23 nt, Artificial Sequence
  RNA Oligomer
augcaagcauauuaagaguugag

SEQ ID NO: 54143 - RNA, 23 nt, Artificial Sequence
  RNA Oligomer
ugcaagcauauuaagaguugagu

SEQ ID NO: 54144 - RNA, 23 nt, Artificial Sequence
  RNA Oligomer
gcaagcauauuaagaguugagug

SEQ ID NO: 54145 - RNA, 23 nt, Artificial Sequence
  RNA Oligomer
cugcauucuucauuguaguaucg

SEQ ID NO: 54146 - RNA, 23 nt, Artificial Sequence
  RNA Oligomer
ugcauucuucauuguaguaucgu

SEQ ID NO: 54147 - RNA, 23 nt, Artificial Sequence
  RNA Oligomer
gcauucuucauuguaguaucgua

SEQ ID NO: 54148 - RNA, 23 nt, Artificial Sequence
  RNA Oligomer
cauucuucauuguaguaucguag

SEQ ID NO: 54149 - RNA, 23 nt, Artificial Sequence
  RNA Oligomer
auucuucauuguaguaucguagc

SEQ ID NO: 54150 - RNA, 23 nt, Artificial Sequence
  RNA Oligomer
cugccaauaucuguauuaaggcu

SEQ ID NO: 54151 - RNA, 23 nt, Artificial Sequence
  RNA Oligomer
ugccaauaucuguauuaaggcuu

SEQ ID NO: 54152 - RNA, 23 nt, Artificial Sequence
  RNA Oligomer
gccaauaucuguauuaaggcuuu

SEQ ID NO: 54153 - RNA, 23 nt, Artificial Sequence
  RNA Oligomer
ccaauaucuguauuaaggcuuuu

SEQ ID NO: 54154 - RNA, 23 nt, Artificial Sequence
  RNA Oligomer
caauaucuguauuaaggcuuuua

SEQ ID NO: 54155 - RNA, 23 nt, Artificial Sequence
  RNA Oligomer
ugcaaaauccaccuguagcaugc

SEQ ID NO: 54156 - RNA, 23 nt, Artificial Sequence
  RNA Oligomer
gcaaaauccaccuguagcaugcc

SEQ ID NO: 54157 - RNA, 23 nt, Artificial Sequence
  RNA Oligomer
caaaauccaccuguagcaugccu

SEQ ID NO: 54158 - RNA, 23 nt, Artificial Sequence
  RNA Oligomer
aaaauccaccuguagcaugccuu

SEQ ID NO: 54159 - RNA, 23 nt, Artificial Sequence
  RNA Oligomer
aaauccaccuguagcaugccuug

SEQ ID NO: 54160 - RNA, 23 nt, Artificial Sequence
  RNA Oligomer
uugaaguuaaugucuggguaacu

SEQ ID NO: 54161 - RNA, 23 nt, Artificial Sequence
  RNA Oligomer
acucaucauggauucuauucuug

SEQ ID NO: 54162 - RNA, 23 nt, Artificial Sequence
  RNA Oligomer
cucaucauggauucuauucuugu

SEQ ID NO: 54163 - RNA, 23 nt, Artificial Sequence
  RNA Oligomer
ucaucauggauucuauucuugua

SEQ ID NO: 54164 - RNA, 23 nt, Artificial Sequence
  RNA Oligomer
caucauggauucuauucuuguau

SEQ ID NO: 54165 - RNA, 23 nt, Artificial Sequence
  RNA Oligomer
aucauggauucuauucuuguauu

SEQ ID NO: 54166 - RNA, 23 nt, Artificial Sequence
  RNA Oligomer
cuaaaagacuggcaaucuguucc

SEQ ID NO: 54167 - RNA, 23 nt, Artificial Sequence
  RNA Oligomer
uaaaagacuggcaaucuguuccu

SEQ ID NO: 54168 - RNA, 23 nt, Artificial Sequence
  RNA Oligomer
aaaagacuggcaaucuguuccug

SEQ ID NO: 54169 - RNA, 23 nt, Artificial Sequence
  RNA Oligomer
aaagacuggcaaucuguuccugc

SEQ ID NO: 54170 - RNA, 23 nt, Artificial Sequence
  RNA Oligomer
aagacuggcaaucuguuccugcg

SEQ ID NO: 54171 - RNA, 23 nt, Artificial Sequence
  RNA Oligomer
uacuauccaaacuuucugauucc

SEQ ID NO: 54172 - RNA, 23 nt, Artificial Sequence
  RNA Oligomer
acuauccaaacuuucugauuccg

SEQ ID NO: 54173 - RNA, 23 nt, Artificial Sequence
  RNA Oligomer
cuauccaaacuuucugauuccgc

SEQ ID NO: 54174 - RNA, 23 nt, Artificial Sequence
  RNA Oligomer
uauccaaacuuucugauuccgcu

SEQ ID NO: 54175 - RNA, 23 nt, Artificial Sequence
  RNA Oligomer
auccaaacuuucugauuccgcug

SEQ ID NO: 54176 - RNA, 23 nt, Artificial Sequence
  RNA Oligomer
ucguguaaauuuguugagaagug

SEQ ID NO: 54177 - RNA, 23 nt, Artificial Sequence
  RNA Oligomer
cugucuugauuccuuuagugucc

SEQ ID NO: 54178 - RNA, 23 nt, Artificial Sequence
  RNA Oligomer
ugucuugauuccuuuagugucca

SEQ ID NO: 54179 - RNA, 23 nt, Artificial Sequence
  RNA Oligomer
gucuugauuccuuuaguguccau

SEQ ID NO: 54180 - RNA, 23 nt, Artificial Sequence
  RNA Oligomer
ucuugauuccuuuaguguccauc

SEQ ID NO: 54181 - RNA, 23 nt, Artificial Sequence
  RNA Oligomer
uuccuuuaguguccauccaacug

SEQ ID NO: 54182 - RNA, 23 nt, Artificial Sequence
  RNA Oligomer
acauucaggcuagaaauauuucc

SEQ ID NO: 54183 - RNA, 23 nt, Artificial Sequence
  RNA Oligomer
cauucaggcuagaaauauuucca

SEQ ID NO: 54184 - RNA, 23 nt, Artificial Sequence
  RNA Oligomer
auucaggcuagaaauauuuccag

SEQ ID NO: 54185 - RNA, 23 nt, Artificial Sequence
  RNA Oligomer
uucaggcuagaaauauuuccagg

SEQ ID NO: 54186 - RNA, 23 nt, Artificial Sequence
  RNA Oligomer
ucaggcuagaaauauuuccaggu

SEQ ID NO: 54187 - RNA, 23 nt, Artificial Sequence
  RNA Oligomer
uuuaaaucauucauuccagugcg

SEQ ID NO: 54188 - RNA, 23 nt, Artificial Sequence
  RNA Oligomer
uuaaaucauucauuccagugcga

SEQ ID NO: 54189 - RNA, 23 nt, Artificial Sequence
  RNA Oligomer
uaaaucauucauuccagugcgac

SEQ ID NO: 54190 - RNA, 23 nt, Artificial Sequence
  RNA Oligomer
aaaucauucauuccagugcgacu

SEQ ID NO: 54191 - RNA, 23 nt, Artificial Sequence
  RNA Oligomer
aaucauucauuccagugcgacuc

SEQ ID NO: 54192 - RNA, 23 nt, Artificial Sequence
  RNA Oligomer
ucucuugcuuggaaccuugaagg

SEQ ID NO: 54193 - RNA, 23 nt, Artificial Sequence
  RNA Oligomer
cucuugcuuggaaccuugaaggu

SEQ ID NO: 54194 - RNA, 23 nt, Artificial Sequence
  RNA Oligomer
ucuugcuuggaaccuugaagguu

SEQ ID NO: 54195 - RNA, 23 nt, Artificial Sequence
  RNA Oligomer
cuugcuuggaaccuugaagguuu

SEQ ID NO: 54196 - RNA, 23 nt, Artificial Sequence
  RNA Oligomer
uugcuuggaaccuugaagguuua

SEQ ID NO: 54197 - RNA, 23 nt, Artificial Sequence
  RNA Oligomer
aacuuucuugucuagucaauuug

SEQ ID NO: 54198 - RNA, 23 nt, Artificial Sequence
  RNA Oligomer
acuuucuugucuagucaauuugu

SEQ ID NO: 54199 - RNA, 23 nt, Artificial Sequence
  RNA Oligomer
cuuucuugucuagucaauuuguu

SEQ ID NO: 54200 - RNA, 23 nt, Artificial Sequence
  RNA Oligomer
uuucuugucuagucaauuuguug

SEQ ID NO: 54201 - RNA, 23 nt, Artificial Sequence
  RNA Oligomer
uucuugucuagucaauuuguugu

SEQ ID NO: 54202 - RNA, 23 nt, Artificial Sequence
  RNA Oligomer
gcccaguaccaacauccucagag

SEQ ID NO: 54203 - RNA, 23 nt, Artificial Sequence
  RNA Oligomer
cccaguaccaacauccucagagc

SEQ ID NO: 54204 - RNA, 23 nt, Artificial Sequence
  RNA Oligomer
ccaguaccaacauccucagagcc

SEQ ID NO: 54205 - RNA, 23 nt, Artificial Sequence
  RNA Oligomer
caguaccaacauccucagagcca

SEQ ID NO: 54206 - RNA, 23 nt, Artificial Sequence
  RNA Oligomer
aguaccaacauccucagagccaa

SEQ ID NO: 54207 - RNA, 23 nt, Artificial Sequence
  RNA Oligomer
uuauuuagauuuuaugugcucac

SEQ ID NO: 54208 - RNA, 23 nt, Artificial Sequence
  RNA Oligomer
uauuuagauuuuaugugcucaca

SEQ ID NO: 54209 - RNA, 23 nt, Artificial Sequence
  RNA Oligomer
auuuagauuuuaugugcucacau

SEQ ID NO: 54210 - RNA, 23 nt, Artificial Sequence
  RNA Oligomer
uuuagauuuuaugugcucacaua

SEQ ID NO: 54211 - RNA, 23 nt, Artificial Sequence
  RNA Oligomer
uuagauuuuaugugcucacauau

SEQ ID NO: 54212 - RNA, 23 nt, Artificial Sequence
  RNA Oligomer
cacauauagacacacuuaaagag

SEQ ID NO: 54213 - RNA, 23 nt, Artificial Sequence
  RNA Oligomer
acauauagacacacuuaaagagc

SEQ ID NO: 54214 - RNA, 23 nt, Artificial Sequence
  RNA Oligomer
cauauagacacacuuaaagagca

SEQ ID NO: 54215 - RNA, 23 nt, Artificial Sequence
  RNA Oligomer
auauagacacacuuaaagagcau

SEQ ID NO: 54216 - RNA, 23 nt, Artificial Sequence
  RNA Oligomer
uauagacacacuuaaagagcaua

SEQ ID NO: 54217 - RNA, 23 nt, Artificial Sequence
  RNA Oligomer
uuugguuauaugaauaugccuca

SEQ ID NO: 54218 - RNA, 23 nt, Artificial Sequence
  RNA Oligomer
uugguuauaugaauaugccucaa

SEQ ID NO: 54219 - RNA, 23 nt, Artificial Sequence
  RNA Oligomer
ugguuauaugaauaugccucaag

SEQ ID NO: 54220 - RNA, 23 nt, Artificial Sequence
  RNA Oligomer
gguuauaugaauaugccucaagc

SEQ ID NO: 54221 - RNA, 23 nt, Artificial Sequence
  RNA Oligomer
guuauaugaauaugccucaagca

SEQ ID NO: 54222 - RNA, 23 nt, Artificial Sequence
  RNA Oligomer
aaaccuccuuuuauuccacauuu

SEQ ID NO: 54223 - RNA, 23 nt, Artificial Sequence
  RNA Oligomer
acugaucagaggaaaaaagacag

SEQ ID NO: 54224 - RNA, 23 nt, Artificial Sequence
  RNA Oligomer
cugaucagaggaaaaaagacaga

SEQ ID NO: 54225 - RNA, 23 nt, Artificial Sequence
  RNA Oligomer
ugaucagaggaaaaaagacagac

SEQ ID NO: 54226 - RNA, 23 nt, Artificial Sequence
  RNA Oligomer
gaucagaggaaaaaagacagaca

SEQ ID NO: 54227 - RNA, 23 nt, Artificial Sequence
  RNA Oligomer
aucagaggaaaaaagacagacaa

SEQ ID NO: 54228 - RNA, 23 nt, Artificial Sequence
  RNA Oligomer
gcaacacauaugaaaaaaacccu

SEQ ID NO: 54229 - RNA, 23 nt, Artificial Sequence
  RNA Oligomer
caacacauaugaaaaaaacccua

SEQ ID NO: 54230 - RNA, 23 nt, Artificial Sequence
  RNA Oligomer
aacacauaugaaaaaaacccuaa

SEQ ID NO: 54231 - RNA, 23 nt, Artificial Sequence
  RNA Oligomer
acacauaugaaaaaaacccuaau

SEQ ID NO: 54232 - RNA, 23 nt, Artificial Sequence
  RNA Oligomer
cacauaugaaaaaaacccuaauu

SEQ ID NO: 54233 - RNA, 23 nt, Artificial Sequence
  RNA Oligomer
auauuaagaguugaguggaaggc

SEQ ID NO: 54234 - RNA, 23 nt, Artificial Sequence
  RNA Oligomer
uauuaagaguugaguggaaggcu

SEQ ID NO: 54235 - RNA, 23 nt, Artificial Sequence
  RNA Oligomer
auuaagaguugaguggaaggcuc

SEQ ID NO: 54236 - RNA, 23 nt, Artificial Sequence
  RNA Oligomer
uuaagaguugaguggaaggcuca

SEQ ID NO: 54237 - RNA, 23 nt, Artificial Sequence
  RNA Oligomer
uaagaguugaguggaaggcucac

SEQ ID NO: 54238 - RNA, 23 nt, Artificial Sequence
  RNA Oligomer
ucauuuugccacuuacacauugc

SEQ ID NO: 54239 - RNA, 23 nt, Artificial Sequence
  RNA Oligomer
cauuuugccacuuacacauugcu

SEQ ID NO: 54240 - RNA, 23 nt, Artificial Sequence
  RNA Oligomer
auuuugccacuuacacauugcug

SEQ ID NO: 54241 - RNA, 23 nt, Artificial Sequence
  RNA Oligomer
uuuugccacuuacacauugcugc

SEQ ID NO: 54242 - RNA, 23 nt, Artificial Sequence
  RNA Oligomer
uuugccacuuacacauugcugca

SEQ ID NO: 54243 - RNA, 23 nt, Artificial Sequence
  RNA Oligomer
caggauggagggaguuuagaugu

SEQ ID NO: 54244 - RNA, 23 nt, Artificial Sequence
  RNA Oligomer
aggauggagggaguuuagaugua

SEQ ID NO: 54245 - RNA, 23 nt, Artificial Sequence
  RNA Oligomer
ggauggagggaguuuagauguac

SEQ ID NO: 54246 - RNA, 23 nt, Artificial Sequence
  RNA Oligomer
gauggagggaguuuagauguacc

SEQ ID NO: 54247 - RNA, 23 nt, Artificial Sequence
  RNA Oligomer
auggagggaguuuagauguacca

SEQ ID NO: 54248 - RNA, 23 nt, Artificial Sequence
  RNA Oligomer
gaagagcguuuuaaguuucuccg

SEQ ID NO: 54249 - RNA, 23 nt, Artificial Sequence
  RNA Oligomer
aagagcguuuuaaguuucuccgg

SEQ ID NO: 54250 - RNA, 23 nt, Artificial Sequence
  RNA Oligomer
agagcguuuuaaguuucuccggu

SEQ ID NO: 54251 - RNA, 23 nt, Artificial Sequence
  RNA Oligomer
gagcguuuuaaguuucuccgguu

SEQ ID NO: 54252 - RNA, 23 nt, Artificial Sequence
  RNA Oligomer
agcguuuuaaguuucuccgguuu

SEQ ID NO: 54253 - RNA, 23 nt, Artificial Sequence
  RNA Oligomer
agaauacuccgauuucaucuuag

SEQ ID NO: 54254 - RNA, 23 nt, Artificial Sequence
  RNA Oligomer
gaauacuccgauuucaucuuagc

SEQ ID NO: 54255 - RNA, 23 nt, Artificial Sequence
  RNA Oligomer
aauacuccgauuucaucuuagca

SEQ ID NO: 54256 - RNA, 23 nt, Artificial Sequence
  RNA Oligomer
auacuccgauuucaucuuagcau

SEQ ID NO: 54257 - RNA, 23 nt, Artificial Sequence
  RNA Oligomer
uacuccgauuucaucuuagcauu

SEQ ID NO: 54258 - RNA, 23 nt, Artificial Sequence
  RNA Oligomer
ucuuagcauuucgucguggaaau

SEQ ID NO: 54259 - RNA, 23 nt, Artificial Sequence
  RNA Oligomer
uucuuuacuauccaaacuuucug

SEQ ID NO: 54260 - RNA, 23 nt, Artificial Sequence
  RNA Oligomer
ucuuuacuauccaaacuuucuga

SEQ ID NO: 54261 - RNA, 23 nt, Artificial Sequence
  RNA Oligomer
cuuuacuauccaaacuuucugau

SEQ ID NO: 54262 - RNA, 23 nt, Artificial Sequence
  RNA Oligomer
uuuacuauccaaacuuucugauu

SEQ ID NO: 54263 - RNA, 23 nt, Artificial Sequence
  RNA Oligomer
uuacuauccaaacuuucugauuc

SEQ ID NO: 54264 - RNA, 23 nt, Artificial Sequence
  RNA Oligomer
auuguauuucagaauagcauccu

SEQ ID NO: 54265 - RNA, 23 nt, Artificial Sequence
  RNA Oligomer
uuguauuucagaauagcauccuu

SEQ ID NO: 54266 - RNA, 23 nt, Artificial Sequence
  RNA Oligomer
uguauuucagaauagcauccuuc

SEQ ID NO: 54267 - RNA, 23 nt, Artificial Sequence
  RNA Oligomer
guauuucagaauagcauccuuca

SEQ ID NO: 54268 - RNA, 23 nt, Artificial Sequence
  RNA Oligomer
uauuucagaauagcauccuucaa

SEQ ID NO: 54269 - RNA, 23 nt, Artificial Sequence
  RNA Oligomer
ucuuuauaauguguuggaaaagg

SEQ ID NO: 54270 - RNA, 23 nt, Artificial Sequence
  RNA Oligomer
cuuuauaauguguuggaaaaggu

SEQ ID NO: 54271 - RNA, 23 nt, Artificial Sequence
  RNA Oligomer
uuuauaauguguuggaaaagguu

SEQ ID NO: 54272 - RNA, 23 nt, Artificial Sequence
  RNA Oligomer
uuauaauguguuggaaaagguuu

SEQ ID NO: 54273 - RNA, 23 nt, Artificial Sequence
  RNA Oligomer
uauaauguguuggaaaagguuua

SEQ ID NO: 54274 - RNA, 23 nt, Artificial Sequence
  RNA Oligomer
aaauauuuccagguaguuuagca

SEQ ID NO: 54275 - RNA, 23 nt, Artificial Sequence
  RNA Oligomer
aauauuuccagguaguuuagcau

SEQ ID NO: 54276 - RNA, 23 nt, Artificial Sequence
  RNA Oligomer
auauuuccagguaguuuagcauu

SEQ ID NO: 54277 - RNA, 23 nt, Artificial Sequence
  RNA Oligomer
uauuuccagguaguuuagcauuu

SEQ ID NO: 54278 - RNA, 23 nt, Artificial Sequence
  RNA Oligomer
auuuccagguaguuuagcauuua

SEQ ID NO: 54279 - RNA, 23 nt, Artificial Sequence
  RNA Oligomer
gguuuauuugcuguuugggagga

SEQ ID NO: 54280 - RNA, 23 nt, Artificial Sequence
  RNA Oligomer
guuuauuugcuguuugggaggaa

SEQ ID NO: 54281 - RNA, 23 nt, Artificial Sequence
  RNA Oligomer
uuuauuugcuguuugggaggaac

SEQ ID NO: 54282 - RNA, 23 nt, Artificial Sequence
  RNA Oligomer
uuauuugcuguuugggaggaacu

SEQ ID NO: 54283 - RNA, 23 nt, Artificial Sequence
  RNA Oligomer
uauuugcuguuugggaggaacua

SEQ ID NO: 54284 - RNA, 23 nt, Artificial Sequence
  RNA Oligomer
ccucaucugcuucugagucuuga

SEQ ID NO: 54285 - RNA, 23 nt, Artificial Sequence
  RNA Oligomer
cucaucugcuucugagucuugac

SEQ ID NO: 54286 - RNA, 23 nt, Artificial Sequence
  RNA Oligomer
ucaucugcuucugagucuugaca

SEQ ID NO: 54287 - RNA, 23 nt, Artificial Sequence
  RNA Oligomer
caucugcuucugagucuugacaa

SEQ ID NO: 54288 - RNA, 23 nt, Artificial Sequence
  RNA Oligomer
aucugcuucugagucuugacaac

SEQ ID NO: 54289 - RNA, 23 nt, Artificial Sequence
  RNA Oligomer
guaccaacauccucagagccaac

SEQ ID NO: 54290 - RNA, 23 nt, Artificial Sequence
  RNA Oligomer
uaccaacauccucagagccaaca

SEQ ID NO: 54291 - RNA, 23 nt, Artificial Sequence
  RNA Oligomer
ccacaucuaucucaucuugcuga

SEQ ID NO: 54292 - RNA, 23 nt, Artificial Sequence
  RNA Oligomer
cacaucuaucucaucuugcugac

SEQ ID NO: 54293 - RNA, 23 nt, Artificial Sequence
  RNA Oligomer
acaucuaucucaucuugcugaca

SEQ ID NO: 54294 - RNA, 23 nt, Artificial Sequence
  RNA Oligomer
caucuaucucaucuugcugacaa

SEQ ID NO: 54295 - RNA, 23 nt, Artificial Sequence
  RNA Oligomer
aucuaucucaucuugcugacaac

SEQ ID NO: 54296 - RNA, 23 nt, Artificial Sequence
  RNA Oligomer
uguacaaaucagcaugaaguucc

SEQ ID NO: 54297 - RNA, 23 nt, Artificial Sequence
  RNA Oligomer
uucccuucauuuugccacuuaca

SEQ ID NO: 54298 - RNA, 23 nt, Artificial Sequence
  RNA Oligomer
gaggaaaaaagacagacaaacca

SEQ ID NO: 54299 - RNA, 23 nt, Artificial Sequence
  RNA Oligomer
aggaaaaaagacagacaaaccau

SEQ ID NO: 54300 - RNA, 23 nt, Artificial Sequence
  RNA Oligomer
ggaaaaaagacagacaaaccauu

SEQ ID NO: 54301 - RNA, 23 nt, Artificial Sequence
  RNA Oligomer
gaaaaaagacagacaaaccauua

SEQ ID NO: 54302 - RNA, 23 nt, Artificial Sequence
  RNA Oligomer
aaaaaagacagacaaaccauuac

SEQ ID NO: 54303 - RNA, 23 nt, Artificial Sequence
  RNA Oligomer
aacugguauaauauaugggcagg

SEQ ID NO: 54304 - RNA, 23 nt, Artificial Sequence
  RNA Oligomer
acugguauaauauaugggcagga

SEQ ID NO: 54305 - RNA, 23 nt, Artificial Sequence
  RNA Oligomer
cugguauaauauaugggcaggaa

SEQ ID NO: 54306 - RNA, 23 nt, Artificial Sequence
  RNA Oligomer
ugguauaauauaugggcaggaag

SEQ ID NO: 54307 - RNA, 23 nt, Artificial Sequence
  RNA Oligomer
agaaacaaaacauaucuaagucc

SEQ ID NO: 54308 - RNA, 23 nt, Artificial Sequence
  RNA Oligomer
gaaacaaaacauaucuaagucca

SEQ ID NO: 54309 - RNA, 23 nt, Artificial Sequence
  RNA Oligomer
aaacaaaacauaucuaaguccac

SEQ ID NO: 54310 - RNA, 23 nt, Artificial Sequence
  RNA Oligomer
aacaaaacauaucuaaguccacg

SEQ ID NO: 54311 - RNA, 23 nt, Artificial Sequence
  RNA Oligomer
acaaaacauaucuaaguccacgu

SEQ ID NO: 54312 - RNA, 23 nt, Artificial Sequence
  RNA Oligomer
caaaacauaucuaaguccacgug

SEQ ID NO: 54313 - RNA, 23 nt, Artificial Sequence
  RNA Oligomer
aaaacauaucuaaguccacguga

SEQ ID NO: 54314 - RNA, 23 nt, Artificial Sequence
  RNA Oligomer
aaacauaucuaaguccacgugag

SEQ ID NO: 54315 - RNA, 23 nt, Artificial Sequence
  RNA Oligomer
auucauauauuacaccugacagc

SEQ ID NO: 54316 - RNA, 23 nt, Artificial Sequence
  RNA Oligomer
uucauauauuacaccugacagcu

SEQ ID NO: 54317 - RNA, 23 nt, Artificial Sequence
  RNA Oligomer
ucauauauuacaccugacagcuc

SEQ ID NO: 54318 - RNA, 23 nt, Artificial Sequence
  RNA Oligomer
cauauauuacaccugacagcuca

SEQ ID NO: 54319 - RNA, 23 nt, Artificial Sequence
  RNA Oligomer
auauauuacaccugacagcucaa

SEQ ID NO: 54320 - RNA, 23 nt, Artificial Sequence
  RNA Oligomer
agcaugguauaugaauggauaaa

SEQ ID NO: 54321 - RNA, 23 nt, Artificial Sequence
  RNA Oligomer
cuguaaaugucucucaucaauuc

SEQ ID NO: 54322 - RNA, 23 nt, Artificial Sequence
  RNA Oligomer
uguaaaugucucucaucaauucu

SEQ ID NO: 54323 - RNA, 23 nt, Artificial Sequence
  RNA Oligomer
guaaaugucucucaucaauucug

SEQ ID NO: 54324 - RNA, 23 nt, Artificial Sequence
  RNA Oligomer
uaaaugucucucaucaauucuga

SEQ ID NO: 54325 - RNA, 23 nt, Artificial Sequence
  RNA Oligomer
aaaugucucucaucaauucugag

SEQ ID NO: 54326 - RNA, 23 nt, Artificial Sequence
  RNA Oligomer
cgauuucaucuuagcauuucguc

SEQ ID NO: 54327 - RNA, 23 nt, Artificial Sequence
  RNA Oligomer
gauuucaucuuagcauuucgucg

SEQ ID NO: 54328 - RNA, 23 nt, Artificial Sequence
  RNA Oligomer
auuucaucuuagcauuucgucgu

SEQ ID NO: 54329 - RNA, 23 nt, Artificial Sequence
  RNA Oligomer
ucuguuucaggagugguauuggc

SEQ ID NO: 54330 - RNA, 23 nt, Artificial Sequence
  RNA Oligomer
cuguuucaggagugguauuggcu

SEQ ID NO: 54331 - RNA, 23 nt, Artificial Sequence
  RNA Oligomer
uguuucaggagugguauuggcug

SEQ ID NO: 54332 - RNA, 23 nt, Artificial Sequence
  RNA Oligomer
guuucaggagugguauuggcugg

SEQ ID NO: 54333 - RNA, 23 nt, Artificial Sequence
  RNA Oligomer
uuucaggagugguauuggcuggg

SEQ ID NO: 54334 - RNA, 23 nt, Artificial Sequence
  RNA Oligomer
cauuguauuucagaauagcaucc

SEQ ID NO: 54335 - RNA, 23 nt, Artificial Sequence
  RNA Oligomer
aaauuuguugagaagugcagucu

SEQ ID NO: 54336 - RNA, 23 nt, Artificial Sequence
  RNA Oligomer
auaauguguuggaaaagguuuag

SEQ ID NO: 54337 - RNA, 23 nt, Artificial Sequence
  RNA Oligomer
uaauguguuggaaaagguuuagg

SEQ ID NO: 54338 - RNA, 23 nt, Artificial Sequence
  RNA Oligomer
aauguguuggaaaagguuuagga

SEQ ID NO: 54339 - RNA, 23 nt, Artificial Sequence
  RNA Oligomer
auguguuggaaaagguuuaggaa

SEQ ID NO: 54340 - RNA, 23 nt, Artificial Sequence
  RNA Oligomer
uguguuggaaaagguuuaggaac

SEQ ID NO: 54341 - RNA, 23 nt, Artificial Sequence
  RNA Oligomer
guguuggaaaagguuuaggaacu

SEQ ID NO: 54342 - RNA, 23 nt, Artificial Sequence
  RNA Oligomer
guuccaagccacuucuuaucugg

SEQ ID NO: 54343 - RNA, 23 nt, Artificial Sequence
  RNA Oligomer
uuccaagccacuucuuaucugga

SEQ ID NO: 54344 - RNA, 23 nt, Artificial Sequence
  RNA Oligomer
uccaagccacuucuuaucuggag

SEQ ID NO: 54345 - RNA, 23 nt, Artificial Sequence
  RNA Oligomer
ccaagccacuucuuaucuggaga

SEQ ID NO: 54346 - RNA, 23 nt, Artificial Sequence
  RNA Oligomer
caagccacuucuuaucuggagaa

SEQ ID NO: 54347 - RNA, 23 nt, Artificial Sequence
  RNA Oligomer
agaaauauuuccagguaguuuag

SEQ ID NO: 54348 - RNA, 23 nt, Artificial Sequence
  RNA Oligomer
gaaauauuuccagguaguuuagc

SEQ ID NO: 54349 - RNA, 23 nt, Artificial Sequence
  RNA Oligomer
uggaaauguaaucuaacuucacc

SEQ ID NO: 54350 - RNA, 23 nt, Artificial Sequence
  RNA Oligomer
caucuucuuguucaucaaaaccu

SEQ ID NO: 54351 - RNA, 23 nt, Artificial Sequence
  RNA Oligomer
aucuucuuguucaucaaaaccug

SEQ ID NO: 54352 - RNA, 23 nt, Artificial Sequence
  RNA Oligomer
ucuucuuguucaucaaaaccugg

SEQ ID NO: 54353 - RNA, 23 nt, Artificial Sequence
  RNA Oligomer
cuucuuguucaucaaaaccugga

SEQ ID NO: 54354 - RNA, 23 nt, Artificial Sequence
  RNA Oligomer
uucuuguucaucaaaaccuggac

SEQ ID NO: 54355 - RNA, 23 nt, Artificial Sequence
  RNA Oligomer
uauuuuuagaauuauccacaucc

SEQ ID NO: 54356 - RNA, 23 nt, Artificial Sequence
  RNA Oligomer
auuuuuagaauuauccacaucca

SEQ ID NO: 54357 - RNA, 23 nt, Artificial Sequence
  RNA Oligomer
uuuuuagaauuauccacauccau

SEQ ID NO: 54358 - RNA, 23 nt, Artificial Sequence
  RNA Oligomer
uuuuagaauuauccacauccauc

SEQ ID NO: 54359 - RNA, 23 nt, Artificial Sequence
  RNA Oligomer
uuuagaauuauccacauccaucg

SEQ ID NO: 54360 - RNA, 23 nt, Artificial Sequence
  RNA Oligomer
uccguagucugcuuugcauuugc

SEQ ID NO: 54361 - RNA, 23 nt, Artificial Sequence
  RNA Oligomer
ccguagucugcuuugcauuugca

SEQ ID NO: 54362 - RNA, 23 nt, Artificial Sequence
  RNA Oligomer
cguagucugcuuugcauuugcaa

SEQ ID NO: 54363 - RNA, 23 nt, Artificial Sequence
  RNA Oligomer
guagucugcuuugcauuugcaag

SEQ ID NO: 54364 - RNA, 23 nt, Artificial Sequence
  RNA Oligomer
uagucugcuuugcauuugcaagc

SEQ ID NO: 54365 - RNA, 23 nt, Artificial Sequence
  RNA Oligomer
aaacuguugauugucucuauucu

SEQ ID NO: 54366 - RNA, 23 nt, Artificial Sequence
  RNA Oligomer
aacuguugauugucucuauucuc

SEQ ID NO: 54367 - RNA, 23 nt, Artificial Sequence
  RNA Oligomer
uugucucuauucucuucacuauc

SEQ ID NO: 54368 - RNA, 23 nt, Artificial Sequence
  RNA Oligomer
auagacacacuuaaagagcauac

SEQ ID NO: 54369 - RNA, 23 nt, Artificial Sequence
  RNA Oligomer
ccuuuuauuccacauuuccuuuc

SEQ ID NO: 54370 - RNA, 23 nt, Artificial Sequence
  RNA Oligomer
cuuuuauuccacauuuccuuuca

SEQ ID NO: 54371 - RNA, 23 nt, Artificial Sequence
  RNA Oligomer
uuuuauuccacauuuccuuucau

SEQ ID NO: 54372 - RNA, 23 nt, Artificial Sequence
  RNA Oligomer
uuuauuccacauuuccuuucauc

SEQ ID NO: 54373 - RNA, 23 nt, Artificial Sequence
  RNA Oligomer
uuauuccacauuuccuuucaucu

SEQ ID NO: 54374 - RNA, 23 nt, Artificial Sequence
  RNA Oligomer
aaaaagacagacaaaccauuaca

SEQ ID NO: 54375 - RNA, 23 nt, Artificial Sequence
  RNA Oligomer
aaaagacagacaaaccauuacag

SEQ ID NO: 54376 - RNA, 23 nt, Artificial Sequence
  RNA Oligomer
aaagacagacaaaccauuacaga

SEQ ID NO: 54377 - RNA, 23 nt, Artificial Sequence
  RNA Oligomer
aagacagacaaaccauuacagau

SEQ ID NO: 54378 - RNA, 23 nt, Artificial Sequence
  RNA Oligomer
aucaguuaaagagauuccuggau

SEQ ID NO: 54379 - RNA, 23 nt, Artificial Sequence
  RNA Oligomer
agagauuccuggauuucaacuug

SEQ ID NO: 54380 - RNA, 23 nt, Artificial Sequence
  RNA Oligomer
gagauuccuggauuucaacuugu

SEQ ID NO: 54381 - RNA, 23 nt, Artificial Sequence
  RNA Oligomer
agauuccuggauuucaacuuguu

SEQ ID NO: 54382 - RNA, 23 nt, Artificial Sequence
  RNA Oligomer
gauuccuggauuucaacuuguuu

SEQ ID NO: 54383 - RNA, 23 nt, Artificial Sequence
  RNA Oligomer
auuccuggauuucaacuuguuuc

SEQ ID NO: 54384 - RNA, 23 nt, Artificial Sequence
  RNA Oligomer
aacauaucuaaguccacgugagu

SEQ ID NO: 54385 - RNA, 23 nt, Artificial Sequence
  RNA Oligomer
gcacauguguggaagagauugcg

SEQ ID NO: 54386 - RNA, 23 nt, Artificial Sequence
  RNA Oligomer
cacauguguggaagagauugcgu

SEQ ID NO: 54387 - RNA, 23 nt, Artificial Sequence
  RNA Oligomer
acauguguggaagagauugcguc

SEQ ID NO: 54388 - RNA, 23 nt, Artificial Sequence
  RNA Oligomer
cauguguggaagagauugcgucc

SEQ ID NO: 54389 - RNA, 23 nt, Artificial Sequence
  RNA Oligomer
auguguggaagagauugcguccu

SEQ ID NO: 54390 - RNA, 23 nt, Artificial Sequence
  RNA Oligomer
gguauaugaauggauaaagcuug

SEQ ID NO: 54391 - RNA, 23 nt, Artificial Sequence
  RNA Oligomer
guauaugaauggauaaagcuuga

SEQ ID NO: 54392 - RNA, 23 nt, Artificial Sequence
  RNA Oligomer
uauaugaauggauaaagcuugau

SEQ ID NO: 54393 - RNA, 23 nt, Artificial Sequence
  RNA Oligomer
auaugaauggauaaagcuugaug

SEQ ID NO: 54394 - RNA, 23 nt, Artificial Sequence
  RNA Oligomer
uaugaauggauaaagcuugaugu

SEQ ID NO: 54395 - RNA, 23 nt, Artificial Sequence
  RNA Oligomer
aaugucucucaucaauucugagu

SEQ ID NO: 54396 - RNA, 23 nt, Artificial Sequence
  RNA Oligomer
augucucucaucaauucugaguc

SEQ ID NO: 54397 - RNA, 23 nt, Artificial Sequence
  RNA Oligomer
gcugccaauaucuguauuaaggc

SEQ ID NO: 54398 - RNA, 23 nt, Artificial Sequence
  RNA Oligomer
agacuuagcugagaaacauuuuc

SEQ ID NO: 54399 - RNA, 23 nt, Artificial Sequence
  RNA Oligomer
gacuuagcugagaaacauuuucu

SEQ ID NO: 54400 - RNA, 23 nt, Artificial Sequence
  RNA Oligomer
acuuagcugagaaacauuuucua

SEQ ID NO: 54401 - RNA, 23 nt, Artificial Sequence
  RNA Oligomer
cuuagcugagaaacauuuucuaa

SEQ ID NO: 54402 - RNA, 23 nt, Artificial Sequence
  RNA Oligomer
uuagcugagaaacauuuucuaau

SEQ ID NO: 54403 - RNA, 23 nt, Artificial Sequence
  RNA Oligomer
ugcaaucgugucaaggguuuuuc

SEQ ID NO: 54404 - RNA, 23 nt, Artificial Sequence
  RNA Oligomer
gcaaucgugucaaggguuuuuca

SEQ ID NO: 54405 - RNA, 23 nt, Artificial Sequence
  RNA Oligomer
caaucgugucaaggguuuuucac

SEQ ID NO: 54406 - RNA, 23 nt, Artificial Sequence
  RNA Oligomer
aaucgugucaaggguuuuucaca

SEQ ID NO: 54407 - RNA, 23 nt, Artificial Sequence
  RNA Oligomer
aucgugucaaggguuuuucacau

SEQ ID NO: 54408 - RNA, 23 nt, Artificial Sequence
  RNA Oligomer
cuggaaaaucuucaagacucugu

SEQ ID NO: 54409 - RNA, 23 nt, Artificial Sequence
  RNA Oligomer
uggaaaaucuucaagacucuguc

SEQ ID NO: 54410 - RNA, 23 nt, Artificial Sequence
  RNA Oligomer
ggaaaaucuucaagacucugucu

SEQ ID NO: 54411 - RNA, 23 nt, Artificial Sequence
  RNA Oligomer
gaaaaucuucaagacucugucuu

SEQ ID NO: 54412 - RNA, 23 nt, Artificial Sequence
  RNA Oligomer
aaaaucuucaagacucugucuug

SEQ ID NO: 54413 - RNA, 23 nt, Artificial Sequence
  RNA Oligomer
cgacauugugauggaaugauuca

SEQ ID NO: 54414 - RNA, 23 nt, Artificial Sequence
  RNA Oligomer
gacauugugauggaaugauucau

SEQ ID NO: 54415 - RNA, 23 nt, Artificial Sequence
  RNA Oligomer
acauugugauggaaugauucauc

SEQ ID NO: 54416 - RNA, 23 nt, Artificial Sequence
  RNA Oligomer
cauugugauggaaugauucaucu

SEQ ID NO: 54417 - RNA, 23 nt, Artificial Sequence
  RNA Oligomer
auugugauggaaugauucaucuu

SEQ ID NO: 54418 - RNA, 23 nt, Artificial Sequence
  RNA Oligomer
uaccuuaucccagaaaucgauca

SEQ ID NO: 54419 - RNA, 23 nt, Artificial Sequence
  RNA Oligomer
accuuaucccagaaaucgaucaa

SEQ ID NO: 54420 - RNA, 23 nt, Artificial Sequence
  RNA Oligomer
ccuuaucccagaaaucgaucaaa

SEQ ID NO: 54421 - RNA, 23 nt, Artificial Sequence
  RNA Oligomer
cuuaucccagaaaucgaucaaag

SEQ ID NO: 54422 - RNA, 23 nt, Artificial Sequence
  RNA Oligomer
uuaucccagaaaucgaucaaagc

SEQ ID NO: 54423 - RNA, 23 nt, Artificial Sequence
  RNA Oligomer
uagaauaugccacauuguauuuc

SEQ ID NO: 54424 - RNA, 23 nt, Artificial Sequence
  RNA Oligomer
agaauaugccacauuguauuuca

SEQ ID NO: 54425 - RNA, 23 nt, Artificial Sequence
  RNA Oligomer
gaauaugccacauuguauuucag

SEQ ID NO: 54426 - RNA, 23 nt, Artificial Sequence
  RNA Oligomer
aauaugccacauuguauuucaga

SEQ ID NO: 54427 - RNA, 23 nt, Artificial Sequence
  RNA Oligomer
auaugccacauuguauuucagaa

SEQ ID NO: 54428 - RNA, 23 nt, Artificial Sequence
  RNA Oligomer
uaugccacauuguauuucagaau

SEQ ID NO: 54429 - RNA, 23 nt, Artificial Sequence
  RNA Oligomer
aaagaucuacccgaauaguuacu

SEQ ID NO: 54430 - RNA, 23 nt, Artificial Sequence
  RNA Oligomer
aagaucuacccgaauaguuacug

SEQ ID NO: 54431 - RNA, 23 nt, Artificial Sequence
  RNA Oligomer
agaucuacccgaauaguuacugu

SEQ ID NO: 54432 - RNA, 23 nt, Artificial Sequence
  RNA Oligomer
gaucuacccgaauaguuacugug

SEQ ID NO: 54433 - RNA, 23 nt, Artificial Sequence
  RNA Oligomer
aucuacccgaauaguuacugugu

SEQ ID NO: 54434 - RNA, 23 nt, Artificial Sequence
  RNA Oligomer
ucuacccgaauaguuacugugug

SEQ ID NO: 54435 - RNA, 23 nt, Artificial Sequence
  RNA Oligomer
uccuuuaguguccauccaacugg

SEQ ID NO: 54436 - RNA, 23 nt, Artificial Sequence
  RNA Oligomer
ccuuuaguguccauccaacuggu

SEQ ID NO: 54437 - RNA, 23 nt, Artificial Sequence
  RNA Oligomer
cuuuaguguccauccaacuggua

SEQ ID NO: 54438 - RNA, 23 nt, Artificial Sequence
  RNA Oligomer
uuuaguguccauccaacugguaa

SEQ ID NO: 54439 - RNA, 23 nt, Artificial Sequence
  RNA Oligomer
accgaggcauucuucucaucucc

SEQ ID NO: 54440 - RNA, 23 nt, Artificial Sequence
  RNA Oligomer
ccgaggcauucuucucaucuccu

SEQ ID NO: 54441 - RNA, 23 nt, Artificial Sequence
  RNA Oligomer
cgaggcauucuucucaucuccuc

SEQ ID NO: 54442 - RNA, 23 nt, Artificial Sequence
  RNA Oligomer
gaggcauucuucucaucuccuca

SEQ ID NO: 54443 - RNA, 23 nt, Artificial Sequence
  RNA Oligomer
aggcauucuucucaucuccucaa

SEQ ID NO: 54444 - RNA, 23 nt, Artificial Sequence
  RNA Oligomer
cauucuucucaucuccucaaugg

SEQ ID NO: 54445 - RNA, 23 nt, Artificial Sequence
  RNA Oligomer
auucuucucaucuccucaauggg

SEQ ID NO: 54446 - RNA, 23 nt, Artificial Sequence
  RNA Oligomer
uucuucucaucuccucaauggga

SEQ ID NO: 54447 - RNA, 23 nt, Artificial Sequence
  RNA Oligomer
ucuucucaucuccucaaugggag

SEQ ID NO: 54448 - RNA, 23 nt, Artificial Sequence
  RNA Oligomer
cuucucaucuccucaaugggagu

SEQ ID NO: 54449 - RNA, 23 nt, Artificial Sequence
  RNA Oligomer
ugcauucuacauucaggcuagaa

SEQ ID NO: 54450 - RNA, 23 nt, Artificial Sequence
  RNA Oligomer
gcauucuacauucaggcuagaaa

SEQ ID NO: 54451 - RNA, 23 nt, Artificial Sequence
  RNA Oligomer
cauucuacauucaggcuagaaau

SEQ ID NO: 54452 - RNA, 23 nt, Artificial Sequence
  RNA Oligomer
uuguuugaaaacaagcgaggugg

SEQ ID NO: 54453 - RNA, 23 nt, Artificial Sequence
  RNA Oligomer
uguuugaaaacaagcgagguggc

SEQ ID NO: 54454 - RNA, 23 nt, Artificial Sequence
  RNA Oligomer
guuugaaaacaagcgagguggcg

SEQ ID NO: 54455 - RNA, 23 nt, Artificial Sequence
  RNA Oligomer
uuugaaaacaagcgagguggcgc

SEQ ID NO: 54456 - RNA, 23 nt, Artificial Sequence
  RNA Oligomer
uugaaaacaagcgagguggcgcu

SEQ ID NO: 54457 - RNA, 23 nt, Artificial Sequence
  RNA Oligomer
aaucuaacuucaccgcccuuagu

SEQ ID NO: 54458 - RNA, 23 nt, Artificial Sequence
  RNA Oligomer
ucuuguucaucaaaaccuggacu

SEQ ID NO: 54459 - RNA, 23 nt, Artificial Sequence
  RNA Oligomer
cuuguucaucaaaaccuggacuu

SEQ ID NO: 54460 - RNA, 23 nt, Artificial Sequence
  RNA Oligomer
uuguucaucaaaaccuggacuug

SEQ ID NO: 54461 - RNA, 23 nt, Artificial Sequence
  RNA Oligomer
guucaucaaaaccuggacuuguc

SEQ ID NO: 54462 - RNA, 23 nt, Artificial Sequence
  RNA Oligomer
uucaucaaaaccuggacuugucu

SEQ ID NO: 54463 - RNA, 23 nt, Artificial Sequence
  RNA Oligomer
ucaucaaaaccuggacuugucuc

SEQ ID NO: 54464 - RNA, 23 nt, Artificial Sequence
  RNA Oligomer
caucaaaaccuggacuugucucc

SEQ ID NO: 54465 - RNA, 23 nt, Artificial Sequence
  RNA Oligomer
aucaaaaccuggacuugucuccu

SEQ ID NO: 54466 - RNA, 23 nt, Artificial Sequence
  RNA Oligomer
ccuggacuugucuccucaucugc

SEQ ID NO: 54467 - RNA, 23 nt, Artificial Sequence
  RNA Oligomer
cuggacuugucuccucaucugcu

SEQ ID NO: 54468 - RNA, 23 nt, Artificial Sequence
  RNA Oligomer
uggacuugucuccucaucugcuu

SEQ ID NO: 54469 - RNA, 23 nt, Artificial Sequence
  RNA Oligomer
ggacuugucuccucaucugcuuc

SEQ ID NO: 54470 - RNA, 23 nt, Artificial Sequence
  RNA Oligomer
gacuugucuccucaucugcuucu

SEQ ID NO: 54471 - RNA, 23 nt, Artificial Sequence
  RNA Oligomer
uuagaauuauccacauccaucgg

SEQ ID NO: 54472 - RNA, 23 nt, Artificial Sequence
  RNA Oligomer
uagaauuauccacauccaucggu

SEQ ID NO: 54473 - RNA, 23 nt, Artificial Sequence
  RNA Oligomer
agaauuauccacauccaucggug

SEQ ID NO: 54474 - RNA, 23 nt, Artificial Sequence
  RNA Oligomer
gaauuauccacauccaucgguga

SEQ ID NO: 54475 - RNA, 23 nt, Artificial Sequence
  RNA Oligomer
uuucacuaaccugagagagaugg

SEQ ID NO: 54476 - RNA, 23 nt, Artificial Sequence
  RNA Oligomer
uucacuaaccugagagagaugga

SEQ ID NO: 54477 - RNA, 23 nt, Artificial Sequence
  RNA Oligomer
ucacuaaccugagagagauggac

SEQ ID NO: 54478 - RNA, 23 nt, Artificial Sequence
  RNA Oligomer
cacuaaccugagagagauggacu

SEQ ID NO: 54479 - RNA, 23 nt, Artificial Sequence
  RNA Oligomer
acuaaccugagagagauggacug

SEQ ID NO: 54480 - RNA, 23 nt, Artificial Sequence
  RNA Oligomer
uagauuuuaugugcucacauaua

SEQ ID NO: 54481 - RNA, 23 nt, Artificial Sequence
  RNA Oligomer
uuauaugaauaugccucaagcac

SEQ ID NO: 54482 - RNA, 23 nt, Artificial Sequence
  RNA Oligomer
uauaugaauaugccucaagcacc

SEQ ID NO: 54483 - RNA, 23 nt, Artificial Sequence
  RNA Oligomer
auaugaauaugccucaagcacca

SEQ ID NO: 54484 - RNA, 23 nt, Artificial Sequence
  RNA Oligomer
caccacaaaagaaacauuagucc

SEQ ID NO: 54485 - RNA, 23 nt, Artificial Sequence
  RNA Oligomer
accacaaaagaaacauuaguccu

SEQ ID NO: 54486 - RNA, 23 nt, Artificial Sequence
  RNA Oligomer
ccacaaaagaaacauuaguccua

SEQ ID NO: 54487 - RNA, 23 nt, Artificial Sequence
  RNA Oligomer
cacaaaagaaacauuaguccuaa

SEQ ID NO: 54488 - RNA, 23 nt, Artificial Sequence
  RNA Oligomer
acaaaagaaacauuaguccuaau

SEQ ID NO: 54489 - RNA, 23 nt, Artificial Sequence
  RNA Oligomer
ucaggaaaaccuccuuuuauucc

SEQ ID NO: 54490 - RNA, 23 nt, Artificial Sequence
  RNA Oligomer
uauuccacauuuccuuucaucuc

SEQ ID NO: 54491 - RNA, 23 nt, Artificial Sequence
  RNA Oligomer
ggcucacagggagauuuuuagca

SEQ ID NO: 54492 - RNA, 23 nt, Artificial Sequence
  RNA Oligomer
gcucacagggagauuuuuagcaa

SEQ ID NO: 54493 - RNA, 23 nt, Artificial Sequence
  RNA Oligomer
cucacagggagauuuuuagcaaa

SEQ ID NO: 54494 - RNA, 23 nt, Artificial Sequence
  RNA Oligomer
ucacagggagauuuuuagcaaaa

SEQ ID NO: 54495 - RNA, 23 nt, Artificial Sequence
  RNA Oligomer
cacagggagauuuuuagcaaaau

SEQ ID NO: 54496 - RNA, 23 nt, Artificial Sequence
  RNA Oligomer
ccuggauuucaacuuguuuccug

SEQ ID NO: 54497 - RNA, 23 nt, Artificial Sequence
  RNA Oligomer
ggaguuuagauguaccaacugac

SEQ ID NO: 54498 - RNA, 23 nt, Artificial Sequence
  RNA Oligomer
gaguuuagauguaccaacugaca

SEQ ID NO: 54499 - RNA, 23 nt, Artificial Sequence
  RNA Oligomer
aguuuagauguaccaacugacaa

SEQ ID NO: 54500 - RNA, 23 nt, Artificial Sequence
  RNA Oligomer
guuuagauguaccaacugacaac

SEQ ID NO: 54501 - RNA, 23 nt, Artificial Sequence
  RNA Oligomer
uuuagauguaccaacugacaacu

SEQ ID NO: 54502 - RNA, 23 nt, Artificial Sequence
  RNA Oligomer
ucaauucauauauuacaccugac

SEQ ID NO: 54503 - RNA, 23 nt, Artificial Sequence
  RNA Oligomer
caauucauauauuacaccugaca

SEQ ID NO: 54504 - RNA, 23 nt, Artificial Sequence
  RNA Oligomer
aauucauauauuacaccugacag

SEQ ID NO: 54505 - RNA, 23 nt, Artificial Sequence
  RNA Oligomer
gaggugggaggagaugcuauucg

SEQ ID NO: 54506 - RNA, 23 nt, Artificial Sequence
  RNA Oligomer
aggugggaggagaugcuauucgc

SEQ ID NO: 54507 - RNA, 23 nt, Artificial Sequence
  RNA Oligomer
ggugggaggagaugcuauucgcu

SEQ ID NO: 54508 - RNA, 23 nt, Artificial Sequence
  RNA Oligomer
gugggaggagaugcuauucgcuc

SEQ ID NO: 54509 - RNA, 23 nt, Artificial Sequence
  RNA Oligomer
ugggaggagaugcuauucgcucg

SEQ ID NO: 54510 - RNA, 23 nt, Artificial Sequence
  RNA Oligomer
ggacucgacagcaugguauauga

SEQ ID NO: 54511 - RNA, 23 nt, Artificial Sequence
  RNA Oligomer
gacucgacagcaugguauaugaa

SEQ ID NO: 54512 - RNA, 23 nt, Artificial Sequence
  RNA Oligomer
acucgacagcaugguauaugaau

SEQ ID NO: 54513 - RNA, 23 nt, Artificial Sequence
  RNA Oligomer
cucgacagcaugguauaugaaug

SEQ ID NO: 54514 - RNA, 23 nt, Artificial Sequence
  RNA Oligomer
caugguauaugaauggauaaagc

SEQ ID NO: 54515 - RNA, 23 nt, Artificial Sequence
  RNA Oligomer
augguauaugaauggauaaagcu

SEQ ID NO: 54516 - RNA, 23 nt, Artificial Sequence
  RNA Oligomer
ugguauaugaauggauaaagcuu

SEQ ID NO: 54517 - RNA, 23 nt, Artificial Sequence
  RNA Oligomer
acaguuucugcauucuucauugu

SEQ ID NO: 54518 - RNA, 23 nt, Artificial Sequence
  RNA Oligomer
caguuucugcauucuucauugua

SEQ ID NO: 54519 - RNA, 23 nt, Artificial Sequence
  RNA Oligomer
aguuucugcauucuucauuguag

SEQ ID NO: 54520 - RNA, 23 nt, Artificial Sequence
  RNA Oligomer
guuucugcauucuucauuguagu

SEQ ID NO: 54521 - RNA, 23 nt, Artificial Sequence
  RNA Oligomer
uuucugcauucuucauuguagua

SEQ ID NO: 54522 - RNA, 23 nt, Artificial Sequence
  RNA Oligomer
uggccacugcagaaagauucucu

SEQ ID NO: 54523 - RNA, 23 nt, Artificial Sequence
  RNA Oligomer
ggccacugcagaaagauucucug

SEQ ID NO: 54524 - RNA, 23 nt, Artificial Sequence
  RNA Oligomer
gccacugcagaaagauucucuga

SEQ ID NO: 54525 - RNA, 23 nt, Artificial Sequence
  RNA Oligomer
ccacugcagaaagauucucugaa

SEQ ID NO: 54526 - RNA, 23 nt, Artificial Sequence
  RNA Oligomer
cacugcagaaagauucucugaag

SEQ ID NO: 54527 - RNA, 23 nt, Artificial Sequence
  RNA Oligomer
aauccaccuguagcaugccuugg

SEQ ID NO: 54528 - RNA, 23 nt, Artificial Sequence
  RNA Oligomer
auccaccuguagcaugccuuggc

SEQ ID NO: 54529 - RNA, 23 nt, Artificial Sequence
  RNA Oligomer
aucuuuuuguacagaacucauca

SEQ ID NO: 54530 - RNA, 23 nt, Artificial Sequence
  RNA Oligomer
ucuuuuuguacagaacucaucau

SEQ ID NO: 54531 - RNA, 23 nt, Artificial Sequence
  RNA Oligomer
cuuuuuguacagaacucaucaug

SEQ ID NO: 54532 - RNA, 23 nt, Artificial Sequence
  RNA Oligomer
uuuuuguacagaacucaucaugg

SEQ ID NO: 54533 - RNA, 23 nt, Artificial Sequence
  RNA Oligomer
uaucuguauuaaggcuuuuaacc

SEQ ID NO: 54534 - RNA, 23 nt, Artificial Sequence
  RNA Oligomer
uuuuguacagaacucaucaugga

SEQ ID NO: 54535 - RNA, 23 nt, Artificial Sequence
  RNA Oligomer
auacugaucagaggaaaaaagac

SEQ ID NO: 54536 - RNA, 23 nt, Artificial Sequence
  RNA Oligomer
aagauggacugauauaaauguug

SEQ ID NO: 54537 - RNA, 23 nt, Artificial Sequence
  RNA Oligomer
uucauuuugccacuuacacauug

SEQ ID NO: 54538 - RNA, 23 nt, Artificial Sequence
  RNA Oligomer
aacgucccucaaacaaucgauug

SEQ ID NO: 54539 - RNA, 23 nt, Artificial Sequence
  RNA Oligomer
uacauucaggcuagaaauauuuc

SEQ ID NO: 54540 - RNA, 23 nt, Artificial Sequence
  RNA Oligomer
ucauggauucuauucuuguauug

SEQ ID NO: 54541 - RNA, 23 nt, Artificial Sequence
  RNA Oligomer
cauggauucuauucuuguauugu

SEQ ID NO: 54542 - RNA, 23 nt, Artificial Sequence
  RNA Oligomer
auucguucacuuucccaccaccg

SEQ ID NO: 54543 - RNA, 23 nt, Artificial Sequence
  RNA Oligomer
aaacacucgccugcuuucucucu

SEQ ID NO: 54544 - RNA, 23 nt, Artificial Sequence
  RNA Oligomer
agcugccaauaucuguauuaagg

SEQ ID NO: 54545 - RNA, 23 nt, Artificial Sequence
  RNA Oligomer
uaucccagaaaucgaucaaagcu

SEQ ID NO: 54546 - RNA, 23 nt, Artificial Sequence
  RNA Oligomer
gaauagcauccuucaaguuuugg

SEQ ID NO: 54547 - RNA, 23 nt, Artificial Sequence
  RNA Oligomer
uuucccacuguucuuuucuucug

SEQ ID NO: 54548 - RNA, 23 nt, Artificial Sequence
  RNA Oligomer
agagccucauuucacuaaccuga

SEQ ID NO: 54549 - RNA, 23 nt, Artificial Sequence
  RNA Oligomer
aaccuccuuuuauuccacauuuc

SEQ ID NO: 54550 - RNA, 23 nt, Artificial Sequence
  RNA Oligomer
uaccucaaaaguacaauuucugg

SEQ ID NO: 54551 - RNA, 23 nt, Artificial Sequence
  RNA Oligomer
uucuucauuguaguaucguagca

SEQ ID NO: 54552 - RNA, 23 nt, Artificial Sequence
  RNA Oligomer
acucaggauugauuaaaaagcgg

SEQ ID NO: 54553 - RNA, 23 nt, Artificial Sequence
  RNA Oligomer
augaacgucccucaaacaaucga

SEQ ID NO: 54554 - RNA, 23 nt, Artificial Sequence
  RNA Oligomer
acgucccucaaacaaucgauuga

SEQ ID NO: 54555 - RNA, 23 nt, Artificial Sequence
  RNA Oligomer
ggugagguggaacguauuuaggg

SEQ ID NO: 54556 - RNA, 23 nt, Artificial Sequence
  RNA Oligomer
uuuccagguaguuuagcauuuaa

SEQ ID NO: 54557 - RNA, 23 nt, Artificial Sequence
  RNA Oligomer
cagguaguuuagcauuuaaauca

SEQ ID NO: 54558 - RNA, 23 nt, Artificial Sequence
  RNA Oligomer
uucaccgcccuuaguagaguacc

SEQ ID NO: 54559 - RNA, 23 nt, Artificial Sequence
  RNA Oligomer
uucacuuuccaaaagcugcuccg

SEQ ID NO: 54560 - RNA, 23 nt, Artificial Sequence
  RNA Oligomer
aaauacugaucagaggaaaaaag

SEQ ID NO: 54561 - RNA, 23 nt, Artificial Sequence
  RNA Oligomer
caaacaaucgauugaaguuaaug

SEQ ID NO: 54562 - RNA, 23 nt, Artificial Sequence
  RNA Oligomer
auggacugauauaaauguugagc

SEQ ID NO: 54563 - RNA, 23 nt, Artificial Sequence
  RNA Oligomer
caaguaccuuaucccagaaaucg

SEQ ID NO: 54564 - RNA, 23 nt, Artificial Sequence
  RNA Oligomer
aaaagaucuacccgaauaguuac

SEQ ID NO: 54565 - RNA, 23 nt, Artificial Sequence
  RNA Oligomer
aggugagguggaacguauuuagg

SEQ ID NO: 54566 - RNA, 23 nt, Artificial Sequence
  RNA Oligomer
uagacacacuuaaagagcauacg

SEQ ID NO: 54567 - RNA, 23 nt, Artificial Sequence
  RNA Oligomer
agacacacuuaaagagcauacgu

SEQ ID NO: 54568 - RNA, 23 nt, Artificial Sequence
  RNA Oligomer
auauagaugauaugggaguuucu

SEQ ID NO: 54569 - RNA, 23 nt, Artificial Sequence
  RNA Oligomer
auaccagagaaacuucaauaugu

SEQ ID NO: 54570 - RNA, 23 nt, Artificial Sequence
  RNA Oligomer
aaucagcaugaaguucccaguuc

SEQ ID NO: 54571 - RNA, 23 nt, Artificial Sequence
  RNA Oligomer
guucacuuuccaaaagcugcucc

SEQ ID NO: 54572 - RNA, 23 nt, Artificial Sequence
  RNA Oligomer
uucaguaaggaaaaugugcaugc

SEQ ID NO: 54573 - RNA, 23 nt, Artificial Sequence
  RNA Oligomer
uaccugugauaauuagacauuca

SEQ ID NO: 54574 - RNA, 23 nt, Artificial Sequence
  RNA Oligomer
auuucuucuugcacaaguccugc

SEQ ID NO: 54575 - RNA, 23 nt, Artificial Sequence
  RNA Oligomer
cucugugacucuucuaaaguagc

SEQ ID NO: 54576 - RNA, 23 nt, Artificial Sequence
  RNA Oligomer
agauggacugauauaaauguuga

SEQ ID NO: 54577 - RNA, 23 nt, Artificial Sequence
  RNA Oligomer
uuucuuagaauaugccacauugu

SEQ ID NO: 54578 - RNA, 23 nt, Artificial Sequence
  RNA Oligomer
guuucccacuguucuuuucuucu

SEQ ID NO: 54579 - RNA, 23 nt, Artificial Sequence
  RNA Oligomer
uccauguugcuuagaauuucugc

SEQ ID NO: 54580 - RNA, 23 nt, Artificial Sequence
  RNA Oligomer
uucauuccagugcgacucucucc

SEQ ID NO: 54581 - RNA, 23 nt, Artificial Sequence
  RNA Oligomer
aauauagaugauaugggaguuuc

SEQ ID NO: 54582 - RNA, 23 nt, Artificial Sequence
  RNA Oligomer
uauagaugauaugggaguuucug

SEQ ID NO: 54583 - RNA, 23 nt, Artificial Sequence
  RNA Oligomer
agcaaaaucaguuaaagagauuc

SEQ ID NO: 54584 - RNA, 23 nt, Artificial Sequence
  RNA Oligomer
agucaauucauauauuacaccug

SEQ ID NO: 54585 - RNA, 23 nt, Artificial Sequence
  RNA Oligomer
gucaauucauauauuacaccuga

SEQ ID NO: 54586 - RNA, 23 nt, Artificial Sequence
  RNA Oligomer
aaauccacaguaagccuuguuca

SEQ ID NO: 54587 - RNA, 23 nt, Artificial Sequence
  RNA Oligomer
uucagcucgcgucucauuuucuc

SEQ ID NO: 54588 - RNA, 23 nt, Artificial Sequence
  RNA Oligomer
aacucaggauugauuaaaaagcg

SEQ ID NO: 54589 - RNA, 23 nt, Artificial Sequence
  RNA Oligomer
aacuagaauacuccgauuucauc

SEQ ID NO: 54590 - RNA, 23 nt, Artificial Sequence
  RNA Oligomer
ugauauaaauguugagcuucugc

SEQ ID NO: 54591 - RNA, 23 nt, Artificial Sequence
  RNA Oligomer
ggauucuauucuuguauuguugu

SEQ ID NO: 54592 - RNA, 23 nt, Artificial Sequence
  RNA Oligomer
auuucuuagaauaugccacauug

SEQ ID NO: 54593 - RNA, 23 nt, Artificial Sequence
  RNA Oligomer
aguuccaagccacuucuuaucug

SEQ ID NO: 54594 - RNA, 23 nt, Artificial Sequence
  RNA Oligomer
aaggugagguggaacguauuuag

SEQ ID NO: 54595 - RNA, 23 nt, Artificial Sequence
  RNA Oligomer
auuuaaaucauucauuccagugc

SEQ ID NO: 54596 - RNA, 23 nt, Artificial Sequence
  RNA Oligomer
auucauuccagugcgacucucuc

SEQ ID NO: 54597 - RNA, 23 nt, Artificial Sequence
  RNA Oligomer
uaccguuuccuaaauucaauguc

SEQ ID NO: 54598 - RNA, 23 nt, Artificial Sequence
  RNA Oligomer
guuuccuaaauucaaugucagcg

SEQ ID NO: 54599 - RNA, 23 nt, Artificial Sequence
  RNA Oligomer
cuucucuggccuguucaucuucc

SEQ ID NO: 54600 - RNA, 23 nt, Artificial Sequence
  RNA Oligomer
ucucuauucucuucacuaucugu

SEQ ID NO: 54601 - RNA, 23 nt, Artificial Sequence
  RNA Oligomer
aacuucaauauguacaaaucagc

SEQ ID NO: 54602 - RNA, 23 nt, Artificial Sequence
  RNA Oligomer
uuuccaaaagcugcuccgugugu

SEQ ID NO: 54603 - RNA, 23 nt, Artificial Sequence
  RNA Oligomer
aauacugaucagaggaaaaaaga

SEQ ID NO: 54604 - RNA, 23 nt, Artificial Sequence
  RNA Oligomer
uacugaucagaggaaaaaagaca

SEQ ID NO: 54605 - RNA, 23 nt, Artificial Sequence
  RNA Oligomer
uauuacaccugacagcucaaaca

SEQ ID NO: 54606 - RNA, 23 nt, Artificial Sequence
  RNA Oligomer
cucaguaccugugauaauuagac

SEQ ID NO: 54607 - RNA, 23 nt, Artificial Sequence
  RNA Oligomer
aaaguagcagaagagcguuuuaa

SEQ ID NO: 54608 - RNA, 23 nt, Artificial Sequence
  RNA Oligomer
uuccacuggguacaaauuuuguu

SEQ ID NO: 54609 - RNA, 23 nt, Artificial Sequence
  RNA Oligomer
uccugcucgcaaaagaucuaccc

SEQ ID NO: 54610 - RNA, 23 nt, Artificial Sequence
  RNA Oligomer
agguggaacguauuuagggaucu

SEQ ID NO: 54611 - RNA, 23 nt, Artificial Sequence
  RNA Oligomer
uagaauccuuuuuuccauguugc

SEQ ID NO: 54612 - RNA, 23 nt, Artificial Sequence
  RNA Oligomer
aguguccauccaacugguaauag

SEQ ID NO: 54613 - RNA, 23 nt, Artificial Sequence
  RNA Oligomer
accguuuccuaaauucaauguca

SEQ ID NO: 54614 - RNA, 23 nt, Artificial Sequence
  RNA Oligomer
uugaagguuuauuugcuguuugg

SEQ ID NO: 54615 - RNA, 23 nt, Artificial Sequence
  RNA Oligomer
ugagucuugacaacuauuuuuag

SEQ ID NO: 54616 - RNA, 23 nt, Artificial Sequence
  RNA Oligomer
ucucuggcaccacaucuaucuca

SEQ ID NO: 54617 - RNA, 23 nt, Artificial Sequence
  RNA Oligomer
aagcaccacaaaagaaacauuag

SEQ ID NO: 54618 - RNA, 23 nt, Artificial Sequence
  RNA Oligomer
aaacaaugcaagcauauuaagag

SEQ ID NO: 54619 - RNA, 23 nt, Artificial Sequence
  RNA Oligomer
aagagaucugauggacaaaagaa

SEQ ID NO: 54620 - RNA, 23 nt, Artificial Sequence
  RNA Oligomer
aaauaaaccacaucucgcucagc

SEQ ID NO: 54621 - RNA, 23 nt, Artificial Sequence
  RNA Oligomer
caaauacuguguacuuuuuucag

SEQ ID NO: 54622 - RNA, 23 nt, Artificial Sequence
  RNA Oligomer
cucaggauugauuaaaaagcgga

SEQ ID NO: 54623 - RNA, 23 nt, Artificial Sequence
  RNA Oligomer
gauugauuaaaaagcggauuucu

SEQ ID NO: 54624 - RNA, 23 nt, Artificial Sequence
  RNA Oligomer
uugauuaaaaagcggauuucuuc

SEQ ID NO: 54625 - RNA, 23 nt, Artificial Sequence
  RNA Oligomer
ugucuuguaaaugucaccaaccc

SEQ ID NO: 54626 - RNA, 23 nt, Artificial Sequence
  RNA Oligomer
guaacuagaauacuccgauuuca

SEQ ID NO: 54627 - RNA, 23 nt, Artificial Sequence
  RNA Oligomer
aaguaccuuaucccagaaaucga

SEQ ID NO: 54628 - RNA, 23 nt, Artificial Sequence
  RNA Oligomer
aucccagaaaucgaucaaagcug

SEQ ID NO: 54629 - RNA, 23 nt, Artificial Sequence
  RNA Oligomer
aagucccauuucuuagaauaugc

SEQ ID NO: 54630 - RNA, 23 nt, Artificial Sequence
  RNA Oligomer
agucccauuucuuagaauaugcc

SEQ ID NO: 54631 - RNA, 23 nt, Artificial Sequence
  RNA Oligomer
ugccacauuguauuucagaauag

SEQ ID NO: 54632 - RNA, 23 nt, Artificial Sequence
  RNA Oligomer
ugagaagugcagucugaaugagc

SEQ ID NO: 54633 - RNA, 23 nt, Artificial Sequence
  RNA Oligomer
ucccauuucuuagaauaugccac

SEQ ID NO: 54634 - RNA, 23 nt, Artificial Sequence
  RNA Oligomer
cccauuucuuagaauaugccaca

SEQ ID NO: 54635 - RNA, 23 nt, Artificial Sequence
  RNA Oligomer
ccauuucuuagaauaugccacau

SEQ ID NO: 54636 - RNA, 23 nt, Artificial Sequence
  RNA Oligomer
cauuucuuagaauaugccacauu

SEQ ID NO: 54637 - RNA, 23 nt, Artificial Sequence
  RNA Oligomer
auuucuuagaauaugccacauug

SEQ ID NO: 54638 - RNA, 23 nt, Artificial Sequence
  RNA Oligomer
guggaacguauuuagggaucuuc

SEQ ID NO: 54639 - RNA, 23 nt, Artificial Sequence
  RNA Oligomer
uggaacguauuuagggaucuucc

SEQ ID NO: 54640 - RNA, 23 nt, Artificial Sequence
  RNA Oligomer
ggaacguauuuagggaucuuccu

SEQ ID NO: 54641 - RNA, 23 nt, Artificial Sequence
  RNA Oligomer
gaacguauuuagggaucuuccuu

SEQ ID NO: 54642 - RNA, 23 nt, Artificial Sequence
  RNA Oligomer
aacguauuuagggaucuuccuuu

SEQ ID NO: 54643 - RNA, 23 nt, Artificial Sequence
  RNA Oligomer
gggugcauuuauuucaaaacauc

SEQ ID NO: 54644 - RNA, 23 nt, Artificial Sequence
  RNA Oligomer
agggugcauuuauuucaaaacau

SEQ ID NO: 54645 - RNA, 23 nt, Artificial Sequence
  RNA Oligomer
aagggugcauuuauuucaaaaca

SEQ ID NO: 54646 - RNA, 23 nt, Artificial Sequence
  RNA Oligomer
caagggugcauuuauuucaaaac

SEQ ID NO: 54647 - RNA, 23 nt, Artificial Sequence
  RNA Oligomer
ucaagggugcauuuauuucaaaa

SEQ ID NO: 54648 - RNA, 23 nt, Artificial Sequence
  RNA Oligomer
gcaugauguauuuuuguacccuu

SEQ ID NO: 54649 - RNA, 23 nt, Artificial Sequence
  RNA Oligomer
ugcaugauguauuuuuguacccu

SEQ ID NO: 54650 - RNA, 23 nt, Artificial Sequence
  RNA Oligomer
uugcaugauguauuuuuguaccc

SEQ ID NO: 54651 - RNA, 23 nt, Artificial Sequence
  RNA Oligomer
guugcaugauguauuuuuguacc

SEQ ID NO: 54652 - RNA, 23 nt, Artificial Sequence
  RNA Oligomer
uguugcaugauguauuuuuguac

SEQ ID NO: 54653 - RNA, 23 nt, Artificial Sequence
  RNA Oligomer
ugcucaaguuuuucagaaagcau

SEQ ID NO: 54654 - RNA, 23 nt, Artificial Sequence
  RNA Oligomer
augcucaaguuuuucagaaagca

SEQ ID NO: 54655 - RNA, 23 nt, Artificial Sequence
  RNA Oligomer
aaugcucaaguuuuucagaaagc

SEQ ID NO: 54656 - RNA, 23 nt, Artificial Sequence
  RNA Oligomer
gaaugcucaaguuuuucagaaag

SEQ ID NO: 54657 - RNA, 23 nt, Artificial Sequence
  RNA Oligomer
ugaaugcucaaguuuuucagaaa

SEQ ID NO: 54658 - RNA, 23 nt, Artificial Sequence
  RNA Oligomer
cuacagaccugacaaguuucuuc

SEQ ID NO: 54659 - RNA, 23 nt, Artificial Sequence
  RNA Oligomer
ucuacagaccugacaaguuucuu

SEQ ID NO: 54660 - RNA, 23 nt, Artificial Sequence
  RNA Oligomer
aucuacagaccugacaaguuucu

SEQ ID NO: 54661 - RNA, 23 nt, Artificial Sequence
  RNA Oligomer
uaucuacagaccugacaaguuuc

SEQ ID NO: 54662 - RNA, 23 nt, Artificial Sequence
  RNA Oligomer
auaucuacagaccugacaaguuu

SEQ ID NO: 54663 - RNA, 23 nt, Artificial Sequence
  RNA Oligomer
ggaaucgauuauaagcaaaagga

SEQ ID NO: 54664 - RNA, 23 nt, Artificial Sequence
  RNA Oligomer
uggaaucgauuauaagcaaaagg

SEQ ID NO: 54665 - RNA, 23 nt, Artificial Sequence
  RNA Oligomer
cuggaaucgauuauaagcaaaag

SEQ ID NO: 54666 - RNA, 23 nt, Artificial Sequence
  RNA Oligomer
gcuggaaucgauuauaagcaaaa

SEQ ID NO: 54667 - RNA, 23 nt, Artificial Sequence
  RNA Oligomer
agcuggaaucgauuauaagcaaa

SEQ ID NO: 54668 - RNA, 23 nt, Artificial Sequence
  RNA Oligomer
ggaaguccauaauuugcaaccag

SEQ ID NO: 54669 - RNA, 23 nt, Artificial Sequence
  RNA Oligomer
uggaaguccauaauuugcaacca

SEQ ID NO: 54670 - RNA, 23 nt, Artificial Sequence
  RNA Oligomer
guggaaguccauaauuugcaacc

SEQ ID NO: 54671 - RNA, 23 nt, Artificial Sequence
  RNA Oligomer
uguggaaguccauaauuugcaac

SEQ ID NO: 54672 - RNA, 23 nt, Artificial Sequence
  RNA Oligomer
guguggaaguccauaauuugcaa

SEQ ID NO: 54673 - RNA, 23 nt, Artificial Sequence
  RNA Oligomer
gcaguaaaaucuuugacaaaaac

SEQ ID NO: 54674 - RNA, 23 nt, Artificial Sequence
  RNA Oligomer
cgcaguaaaaucuuugacaaaaa

SEQ ID NO: 54675 - RNA, 23 nt, Artificial Sequence
  RNA Oligomer
ccgcaguaaaaucuuugacaaaa

SEQ ID NO: 54676 - RNA, 23 nt, Artificial Sequence
  RNA Oligomer
cccgcaguaaaaucuuugacaaa

SEQ ID NO: 54677 - RNA, 23 nt, Artificial Sequence
  RNA Oligomer
ucccgcaguaaaaucuuugacaa

SEQ ID NO: 54678 - RNA, 23 nt, Artificial Sequence
  RNA Oligomer
uucaagggugcauuuauuucaaa

SEQ ID NO: 54679 - RNA, 23 nt, Artificial Sequence
  RNA Oligomer
gcucaaguuuuucagaaagcauu

SEQ ID NO: 54680 - RNA, 23 nt, Artificial Sequence
  RNA Oligomer
ucucaugugauccuuuuauguua

SEQ ID NO: 54681 - RNA, 23 nt, Artificial Sequence
  RNA Oligomer
uucucaugugauccuuuuauguu

SEQ ID NO: 54682 - RNA, 23 nt, Artificial Sequence
  RNA Oligomer
auucucaugugauccuuuuaugu

SEQ ID NO: 54683 - RNA, 23 nt, Artificial Sequence
  RNA Oligomer
aauucucaugugauccuuuuaug

SEQ ID NO: 54684 - RNA, 23 nt, Artificial Sequence
  RNA Oligomer
uaauucucaugugauccuuuuau

SEQ ID NO: 54685 - RNA, 23 nt, Artificial Sequence
  RNA Oligomer
gauguauuuuuguacccuuccua

SEQ ID NO: 54686 - RNA, 23 nt, Artificial Sequence
  RNA Oligomer
ugauguauuuuuguacccuuccu

SEQ ID NO: 54687 - RNA, 23 nt, Artificial Sequence
  RNA Oligomer
augauguauuuuuguacccuucc

SEQ ID NO: 54688 - RNA, 23 nt, Artificial Sequence
  RNA Oligomer
caugauguauuuuuguacccuuc

SEQ ID NO: 54689 - RNA, 23 nt, Artificial Sequence
  RNA Oligomer
cgauuauaagcaaaaggaauauu

SEQ ID NO: 54690 - RNA, 23 nt, Artificial Sequence
  RNA Oligomer
ucgauuauaagcaaaaggaauau

SEQ ID NO: 54691 - RNA, 23 nt, Artificial Sequence
  RNA Oligomer
aucgauuauaagcaaaaggaaua

SEQ ID NO: 54692 - RNA, 23 nt, Artificial Sequence
  RNA Oligomer
aaucgauuauaagcaaaaggaau

SEQ ID NO: 54693 - RNA, 23 nt, Artificial Sequence
  RNA Oligomer
gaaucgauuauaagcaaaaggaa

SEQ ID NO: 54694 - RNA, 23 nt, Artificial Sequence
  RNA Oligomer
gagcuggaaucgauuauaagcaa

SEQ ID NO: 54695 - RNA, 23 nt, Artificial Sequence
  RNA Oligomer
agagcuggaaucgauuauaagca

SEQ ID NO: 54696 - RNA, 23 nt, Artificial Sequence
  RNA Oligomer
aagagcuggaaucgauuauaagc

SEQ ID NO: 54697 - RNA, 23 nt, Artificial Sequence
  RNA Oligomer
aaagagcuggaaucgauuauaag

SEQ ID NO: 54698 - RNA, 23 nt, Artificial Sequence
  RNA Oligomer
aaaagagcuggaaucgauuauaa

SEQ ID NO: 54699 - RNA, 23 nt, Artificial Sequence
  RNA Oligomer
guauuuuuguacccuuccuacag

SEQ ID NO: 54700 - RNA, 23 nt, Artificial Sequence
  RNA Oligomer
uguauuuuuguacccuuccuaca

SEQ ID NO: 54701 - RNA, 23 nt, Artificial Sequence
  RNA Oligomer
auguauuuuuguacccuuccuac

SEQ ID NO: 54702 - RNA, 23 nt, Artificial Sequence
  RNA Oligomer
cucaugugauccuuuuauguuau

SEQ ID NO: 54703 - RNA, 23 nt, Artificial Sequence
  RNA Oligomer
uaaaagagcuggaaucgauuaua

SEQ ID NO: 54704 - RNA, 23 nt, Artificial Sequence
  RNA Oligomer
ccuuguugcaugauguauuuuug

SEQ ID NO: 54705 - RNA, 23 nt, Artificial Sequence
  RNA Oligomer
accuuguugcaugauguauuuuu

SEQ ID NO: 54706 - RNA, 23 nt, Artificial Sequence
  RNA Oligomer
gaccuuguugcaugauguauuuu

SEQ ID NO: 54707 - RNA, 23 nt, Artificial Sequence
  RNA Oligomer
ugaccuuguugcaugauguauuu

SEQ ID NO: 54708 - RNA, 23 nt, Artificial Sequence
  RNA Oligomer
augaccuuguugcaugauguauu

SEQ ID NO: 54709 - RNA, 23 nt, Artificial Sequence
  RNA Oligomer
gugaaugcucaaguuuuucagaa

SEQ ID NO: 54710 - RNA, 23 nt, Artificial Sequence
  RNA Oligomer
uuaauucucaugugauccuuuua

SEQ ID NO: 54711 - RNA, 23 nt, Artificial Sequence
  RNA Oligomer
uuuaauucucaugugauccuuuu

SEQ ID NO: 54712 - RNA, 23 nt, Artificial Sequence
  RNA Oligomer
cuuuaauucucaugugauccuuu

SEQ ID NO: 54713 - RNA, 23 nt, Artificial Sequence
  RNA Oligomer
acuuuaauucucaugugauccuu

SEQ ID NO: 54714 - RNA, 23 nt, Artificial Sequence
  RNA Oligomer
cacuuuaauucucaugugauccu

SEQ ID NO: 54715 - RNA, 23 nt, Artificial Sequence
  RNA Oligomer
ucacuuuaauucucaugugaucc

SEQ ID NO: 54716 - RNA, 23 nt, Artificial Sequence
  RNA Oligomer
uucacuuuaauucucaugugauc

SEQ ID NO: 54717 - RNA, 23 nt, Artificial Sequence
  RNA Oligomer
cuucacuuuaauucucaugugau

SEQ ID NO: 54718 - RNA, 23 nt, Artificial Sequence
  RNA Oligomer
acuucacuuuaauucucauguga

SEQ ID NO: 54719 - RNA, 23 nt, Artificial Sequence
  RNA Oligomer
acagaccugacaaguuucuucag

SEQ ID NO: 54720 - RNA, 23 nt, Artificial Sequence
  RNA Oligomer
uacagaccugacaaguuucuuca

SEQ ID NO: 54721 - RNA, 23 nt, Artificial Sequence
  RNA Oligomer
aucccgcaguaaaaucuuugaca

SEQ ID NO: 54722 - RNA, 23 nt, Artificial Sequence
  RNA Oligomer
gaucccgcaguaaaaucuuugac

SEQ ID NO: 54723 - RNA, 23 nt, Artificial Sequence
  RNA Oligomer
ggaucccgcaguaaaaucuuuga

SEQ ID NO: 54724 - RNA, 23 nt, Artificial Sequence
  RNA Oligomer
gucaaaccauaaacuucaugguc

SEQ ID NO: 54725 - RNA, 23 nt, Artificial Sequence
  RNA Oligomer
agucaaaccauaaacuucauggu

SEQ ID NO: 54726 - RNA, 23 nt, Artificial Sequence
  RNA Oligomer
uagucaaaccauaaacuucaugg

SEQ ID NO: 54727 - RNA, 23 nt, Artificial Sequence
  RNA Oligomer
auagucaaaccauaaacuucaug

SEQ ID NO: 54728 - RNA, 23 nt, Artificial Sequence
  RNA Oligomer
gauagucaaaccauaaacuucau

SEQ ID NO: 54729 - RNA, 23 nt, Artificial Sequence
  RNA Oligomer
cucaaguuuuucagaaagcauua

SEQ ID NO: 54730 - RNA, 23 nt, Artificial Sequence
  RNA Oligomer
ccacaccaaaccucucuuauuag

SEQ ID NO: 54731 - RNA, 23 nt, Artificial Sequence
  RNA Oligomer
accacaccaaaccucucuuauua

SEQ ID NO: 54732 - RNA, 23 nt, Artificial Sequence
  RNA Oligomer
caccacaccaaaccucucuuauu

SEQ ID NO: 54733 - RNA, 23 nt, Artificial Sequence
  RNA Oligomer
ucaccacaccaaaccucucuuau

SEQ ID NO: 54734 - RNA, 23 nt, Artificial Sequence
  RNA Oligomer
aucaccacaccaaaccucucuua

SEQ ID NO: 54735 - RNA, 23 nt, Artificial Sequence
  RNA Oligomer
acaaguuucuucagugugugaaa

SEQ ID NO: 54736 - RNA, 23 nt, Artificial Sequence
  RNA Oligomer
gacaaguuucuucagugugugaa

SEQ ID NO: 54737 - RNA, 23 nt, Artificial Sequence
  RNA Oligomer
ugacaaguuucuucaguguguga

SEQ ID NO: 54738 - RNA, 23 nt, Artificial Sequence
  RNA Oligomer
cugacaaguuucuucagugugug

SEQ ID NO: 54739 - RNA, 23 nt, Artificial Sequence
  RNA Oligomer
ccugacaaguuucuucagugugu

SEQ ID NO: 54740 - RNA, 23 nt, Artificial Sequence
  RNA Oligomer
accugacaaguuucuucagugug

SEQ ID NO: 54741 - RNA, 23 nt, Artificial Sequence
  RNA Oligomer
gaccugacaaguuucuucagugu

SEQ ID NO: 54742 - RNA, 23 nt, Artificial Sequence
  RNA Oligomer
agaccugacaaguuucuucagug

SEQ ID NO: 54743 - RNA, 23 nt, Artificial Sequence
  RNA Oligomer
cagaccugacaaguuucuucagu

SEQ ID NO: 54744 - RNA, 23 nt, Artificial Sequence
  RNA Oligomer
acaugguggaagagaagauucca

SEQ ID NO: 54745 - RNA, 23 nt, Artificial Sequence
  RNA Oligomer
uacaugguggaagagaagauucc

SEQ ID NO: 54746 - RNA, 23 nt, Artificial Sequence
  RNA Oligomer
auacaugguggaagagaagauuc

SEQ ID NO: 54747 - RNA, 23 nt, Artificial Sequence
  RNA Oligomer
gauacaugguggaagagaagauu

SEQ ID NO: 54748 - RNA, 23 nt, Artificial Sequence
  RNA Oligomer
ugauacaugguggaagagaagau

SEQ ID NO: 54749 - RNA, 23 nt, Artificial Sequence
  RNA Oligomer
cuuguugcaugauguauuuuugu

SEQ ID NO: 54750 - RNA, 23 nt, Artificial Sequence
  RNA Oligomer
caagugaagaaaagugaaugcuc

SEQ ID NO: 54751 - RNA, 23 nt, Artificial Sequence
  RNA Oligomer
gcaagugaagaaaagugaaugcu

SEQ ID NO: 54752 - RNA, 23 nt, Artificial Sequence
  RNA Oligomer
ggcaagugaagaaaagugaaugc

SEQ ID NO: 54753 - RNA, 23 nt, Artificial Sequence
  RNA Oligomer
aggcaagugaagaaaagugaaug

SEQ ID NO: 54754 - RNA, 23 nt, Artificial Sequence
  RNA Oligomer
caggcaagugaagaaaagugaau

SEQ ID NO: 54755 - RNA, 23 nt, Artificial Sequence
  RNA Oligomer
gaacaggcaagugaagaaaagug

SEQ ID NO: 54756 - RNA, 23 nt, Artificial Sequence
  RNA Oligomer
agaacaggcaagugaagaaaagu

SEQ ID NO: 54757 - RNA, 23 nt, Artificial Sequence
  RNA Oligomer
uagaacaggcaagugaagaaaag

SEQ ID NO: 54758 - RNA, 23 nt, Artificial Sequence
  RNA Oligomer
uuagaacaggcaagugaagaaaa

SEQ ID NO: 54759 - RNA, 23 nt, Artificial Sequence
  RNA Oligomer
auuagaacaggcaagugaagaaa

SEQ ID NO: 54760 - RNA, 23 nt, Artificial Sequence
  RNA Oligomer
ccaaaccucucuuauuagaacag

SEQ ID NO: 54761 - RNA, 23 nt, Artificial Sequence
  RNA Oligomer
accaaaccucucuuauuagaaca

SEQ ID NO: 54762 - RNA, 23 nt, Artificial Sequence
  RNA Oligomer
caccaaaccucucuuauuagaac

SEQ ID NO: 54763 - RNA, 23 nt, Artificial Sequence
  RNA Oligomer
acaccaaaccucucuuauuagaa

SEQ ID NO: 54764 - RNA, 23 nt, Artificial Sequence
  RNA Oligomer
cacaccaaaccucucuuauuaga

SEQ ID NO: 54765 - RNA, 23 nt, Artificial Sequence
  RNA Oligomer
cccaaagucuuaaaauaacuuau

SEQ ID NO: 54766 - RNA, 23 nt, Artificial Sequence
  RNA Oligomer
ccccaaagucuuaaaauaacuua

SEQ ID NO: 54767 - RNA, 23 nt, Artificial Sequence
  RNA Oligomer
uccccaaagucuuaaaauaacuu

SEQ ID NO: 54768 - RNA, 23 nt, Artificial Sequence
  RNA Oligomer
uuccccaaagucuuaaaauaacu

SEQ ID NO: 54769 - RNA, 23 nt, Artificial Sequence
  RNA Oligomer
uuuccccaaagucuuaaaauaac

SEQ ID NO: 54770 - RNA, 23 nt, Artificial Sequence
  RNA Oligomer
agagaagauuccagagacuuaug

SEQ ID NO: 54771 - RNA, 23 nt, Artificial Sequence
  RNA Oligomer
aagagaagauuccagagacuuau

SEQ ID NO: 54772 - RNA, 23 nt, Artificial Sequence
  RNA Oligomer
gaagagaagauuccagagacuua

SEQ ID NO: 54773 - RNA, 23 nt, Artificial Sequence
  RNA Oligomer
ggaagagaagauuccagagacuu

SEQ ID NO: 54774 - RNA, 23 nt, Artificial Sequence
  RNA Oligomer
uggaagagaagauuccagagacu

SEQ ID NO: 54775 - RNA, 23 nt, Artificial Sequence
  RNA Oligomer
gaauucaacacuuccaaaauaaa

SEQ ID NO: 54776 - RNA, 23 nt, Artificial Sequence
  RNA Oligomer
ugaauucaacacuuccaaaauaa

SEQ ID NO: 54777 - RNA, 23 nt, Artificial Sequence
  RNA Oligomer
gugaauucaacacuuccaaaaua

SEQ ID NO: 54778 - RNA, 23 nt, Artificial Sequence
  RNA Oligomer
ggugaauucaacacuuccaaaau

SEQ ID NO: 54779 - RNA, 23 nt, Artificial Sequence
  RNA Oligomer
uggugaauucaacacuuccaaaa

SEQ ID NO: 54780 - RNA, 23 nt, Artificial Sequence
  RNA Oligomer
uuucaagggugcauuuauuucaa

SEQ ID NO: 54781 - RNA, 23 nt, Artificial Sequence
  RNA Oligomer
agugaaugcucaaguuuuucaga

SEQ ID NO: 54782 - RNA, 23 nt, Artificial Sequence
  RNA Oligomer
aagugaaugcucaaguuuuucag

SEQ ID NO: 54783 - RNA, 23 nt, Artificial Sequence
  RNA Oligomer
aaagugaaugcucaaguuuuuca

SEQ ID NO: 54784 - RNA, 23 nt, Artificial Sequence
  RNA Oligomer
aaaagugaaugcucaaguuuuuc

SEQ ID NO: 54785 - RNA, 23 nt, Artificial Sequence
  RNA Oligomer
gaaaagugaaugcucaaguuuuu

SEQ ID NO: 54786 - RNA, 23 nt, Artificial Sequence
  RNA Oligomer
acaggcaagugaagaaaagugaa

SEQ ID NO: 54787 - RNA, 23 nt, Artificial Sequence
  RNA Oligomer
aacaggcaagugaagaaaaguga

SEQ ID NO: 54788 - RNA, 23 nt, Artificial Sequence
  RNA Oligomer
uauuagaacaggcaagugaagaa

SEQ ID NO: 54789 - RNA, 23 nt, Artificial Sequence
  RNA Oligomer
ucaucagcauaccuuuauuguga

SEQ ID NO: 54790 - RNA, 23 nt, Artificial Sequence
  RNA Oligomer
aucaucagcauaccuuuauugug

SEQ ID NO: 54791 - RNA, 23 nt, Artificial Sequence
  RNA Oligomer
uaucaucagcauaccuuuauugu

SEQ ID NO: 54792 - RNA, 23 nt, Artificial Sequence
  RNA Oligomer
auaucaucagcauaccuuuauug

SEQ ID NO: 54793 - RNA, 23 nt, Artificial Sequence
  RNA Oligomer
uauaucaucagcauaccuuuauu

SEQ ID NO: 54794 - RNA, 23 nt, Artificial Sequence
  RNA Oligomer
ugagaugagacauguagacugcc

SEQ ID NO: 54795 - RNA, 23 nt, Artificial Sequence
  RNA Oligomer
cugagaugagacauguagacugc

SEQ ID NO: 54796 - RNA, 23 nt, Artificial Sequence
  RNA Oligomer
ccugagaugagacauguagacug

SEQ ID NO: 54797 - RNA, 23 nt, Artificial Sequence
  RNA Oligomer
uccugagaugagacauguagacu

SEQ ID NO: 54798 - RNA, 23 nt, Artificial Sequence
  RNA Oligomer
auccugagaugagacauguagac

SEQ ID NO: 54799 - RNA, 23 nt, Artificial Sequence
  RNA Oligomer
uugugguuuaugucaucauacau

SEQ ID NO: 54800 - RNA, 23 nt, Artificial Sequence
  RNA Oligomer
cuugugguuuaugucaucauaca

SEQ ID NO: 54801 - RNA, 23 nt, Artificial Sequence
  RNA Oligomer
ccuugugguuuaugucaucauac

SEQ ID NO: 54802 - RNA, 23 nt, Artificial Sequence
  RNA Oligomer
uccuugugguuuaugucaucaua

SEQ ID NO: 54803 - RNA, 23 nt, Artificial Sequence
  RNA Oligomer
cuccuugugguuuaugucaucau

SEQ ID NO: 54804 - RNA, 23 nt, Artificial Sequence
  RNA Oligomer
ggauucaucuugcacaucugaga

SEQ ID NO: 54805 - RNA, 23 nt, Artificial Sequence
  RNA Oligomer
aggauucaucuugcacaucugag

SEQ ID NO: 54806 - RNA, 23 nt, Artificial Sequence
  RNA Oligomer
gaggauucaucuugcacaucuga

SEQ ID NO: 54807 - RNA, 23 nt, Artificial Sequence
  RNA Oligomer
ugaggauucaucuugcacaucug

SEQ ID NO: 54808 - RNA, 23 nt, Artificial Sequence
  RNA Oligomer
cugaggauucaucuugcacaucu

SEQ ID NO: 54809 - RNA, 23 nt, Artificial Sequence
  RNA Oligomer
caaguuucuucagugugugaaaa

SEQ ID NO: 54810 - RNA, 23 nt, Artificial Sequence
  RNA Oligomer
gugauacaugguggaagagaaga

SEQ ID NO: 54811 - RNA, 23 nt, Artificial Sequence
  RNA Oligomer
ggugauacaugguggaagagaag

SEQ ID NO: 54812 - RNA, 23 nt, Artificial Sequence
  RNA Oligomer
gggugauacaugguggaagagaa

SEQ ID NO: 54813 - RNA, 23 nt, Artificial Sequence
  RNA Oligomer
ugggugauacaugguggaagaga

SEQ ID NO: 54814 - RNA, 23 nt, Artificial Sequence
  RNA Oligomer
cugggugauacaugguggaagag

SEQ ID NO: 54815 - RNA, 23 nt, Artificial Sequence
  RNA Oligomer
ccugggugauacaugguggaaga

SEQ ID NO: 54816 - RNA, 23 nt, Artificial Sequence
  RNA Oligomer
caaguacacugaaauucauccug

SEQ ID NO: 54817 - RNA, 23 nt, Artificial Sequence
  RNA Oligomer
ucaaguacacugaaauucauccu

SEQ ID NO: 54818 - RNA, 23 nt, Artificial Sequence
  RNA Oligomer
gucaaguacacugaaauucaucc

SEQ ID NO: 54819 - RNA, 23 nt, Artificial Sequence
  RNA Oligomer
cgucaaguacacugaaauucauc

SEQ ID NO: 54820 - RNA, 23 nt, Artificial Sequence
  RNA Oligomer
gcgucaaguacacugaaauucau

SEQ ID NO: 54821 - RNA, 23 nt, Artificial Sequence
  RNA Oligomer
guccauaauuugcaaccagagaa

SEQ ID NO: 54822 - RNA, 23 nt, Artificial Sequence
  RNA Oligomer
aguccauaauuugcaaccagaga

SEQ ID NO: 54823 - RNA, 23 nt, Artificial Sequence
  RNA Oligomer
aaguccauaauuugcaaccagag

SEQ ID NO: 54824 - RNA, 23 nt, Artificial Sequence
  RNA Oligomer
gaaguccauaauuugcaaccaga

SEQ ID NO: 54825 - RNA, 23 nt, Artificial Sequence
  RNA Oligomer
gaauaaaagaucuggcccaucag

SEQ ID NO: 54826 - RNA, 23 nt, Artificial Sequence
  RNA Oligomer
agaauaaaagaucuggcccauca

SEQ ID NO: 54827 - RNA, 23 nt, Artificial Sequence
  RNA Oligomer
cagaauaaaagaucuggcccauc

SEQ ID NO: 54828 - RNA, 23 nt, Artificial Sequence
  RNA Oligomer
gcagaauaaaagaucuggcccau

SEQ ID NO: 54829 - RNA, 23 nt, Artificial Sequence
  RNA Oligomer
agcagaauaaaagaucuggccca

SEQ ID NO: 54830 - RNA, 23 nt, Artificial Sequence
  RNA Oligomer
cuuucaagggugcauuuauuuca

SEQ ID NO: 54831 - RNA, 23 nt, Artificial Sequence
  RNA Oligomer
caaaguguaugggaugcuuucaa

SEQ ID NO: 54832 - RNA, 23 nt, Artificial Sequence
  RNA Oligomer
ccaaaguguaugggaugcuuuca

SEQ ID NO: 54833 - RNA, 23 nt, Artificial Sequence
  RNA Oligomer
gccaaaguguaugggaugcuuuc

SEQ ID NO: 54834 - RNA, 23 nt, Artificial Sequence
  RNA Oligomer
ugccaaaguguaugggaugcuuu

SEQ ID NO: 54835 - RNA, 23 nt, Artificial Sequence
  RNA Oligomer
cugccaaaguguaugggaugcuu

SEQ ID NO: 54836 - RNA, 23 nt, Artificial Sequence
  RNA Oligomer
gcauuacauuuccaaaugaauga

SEQ ID NO: 54837 - RNA, 23 nt, Artificial Sequence
  RNA Oligomer
agcauuacauuuccaaaugaaug

SEQ ID NO: 54838 - RNA, 23 nt, Artificial Sequence
  RNA Oligomer
aagcauuacauuuccaaaugaau

SEQ ID NO: 54839 - RNA, 23 nt, Artificial Sequence
  RNA Oligomer
aaagcauuacauuuccaaaugaa

SEQ ID NO: 54840 - RNA, 23 nt, Artificial Sequence
  RNA Oligomer
gaaagcauuacauuuccaaauga

SEQ ID NO: 54841 - RNA, 23 nt, Artificial Sequence
  RNA Oligomer
agaaaagugaaugcucaaguuuu

SEQ ID NO: 54842 - RNA, 23 nt, Artificial Sequence
  RNA Oligomer
aagaaaagugaaugcucaaguuu

SEQ ID NO: 54843 - RNA, 23 nt, Artificial Sequence
  RNA Oligomer
gaagaaaagugaaugcucaaguu

SEQ ID NO: 54844 - RNA, 23 nt, Artificial Sequence
  RNA Oligomer
ugaagaaaagugaaugcucaagu

SEQ ID NO: 54845 - RNA, 23 nt, Artificial Sequence
  RNA Oligomer
ugaaaaaucaccacaccaaaccu

SEQ ID NO: 54846 - RNA, 23 nt, Artificial Sequence
  RNA Oligomer
uugaaaaaucaccacaccaaacc

SEQ ID NO: 54847 - RNA, 23 nt, Artificial Sequence
  RNA Oligomer
auugaaaaaucaccacaccaaac

SEQ ID NO: 54848 - RNA, 23 nt, Artificial Sequence
  RNA Oligomer
uauugaaaaaucaccacaccaaa

SEQ ID NO: 54849 - RNA, 23 nt, Artificial Sequence
  RNA Oligomer
cuauugaaaaaucaccacaccaa

SEQ ID NO: 54850 - RNA, 23 nt, Artificial Sequence
  RNA Oligomer
guaacauccuuucuauugaaaaa

SEQ ID NO: 54851 - RNA, 23 nt, Artificial Sequence
  RNA Oligomer
gguaacauccuuucuauugaaaa

SEQ ID NO: 54852 - RNA, 23 nt, Artificial Sequence
  RNA Oligomer
ugguaacauccuuucuauugaaa

SEQ ID NO: 54853 - RNA, 23 nt, Artificial Sequence
  RNA Oligomer
uugguaacauccuuucuauugaa

SEQ ID NO: 54854 - RNA, 23 nt, Artificial Sequence
  RNA Oligomer
auugguaacauccuuucuauuga

SEQ ID NO: 54855 - RNA, 23 nt, Artificial Sequence
  RNA Oligomer
acauguagacugccaaaguguau

SEQ ID NO: 54856 - RNA, 23 nt, Artificial Sequence
  RNA Oligomer
gacauguagacugccaaagugua

SEQ ID NO: 54857 - RNA, 23 nt, Artificial Sequence
  RNA Oligomer
agacauguagacugccaaagugu

SEQ ID NO: 54858 - RNA, 23 nt, Artificial Sequence
  RNA Oligomer
gagacauguagacugccaaagug

SEQ ID NO: 54859 - RNA, 23 nt, Artificial Sequence
  RNA Oligomer
ugagacauguagacugccaaagu

SEQ ID NO: 54860 - RNA, 23 nt, Artificial Sequence
  RNA Oligomer
acuccuugugguuuaugucauca

SEQ ID NO: 54861 - RNA, 23 nt, Artificial Sequence
  RNA Oligomer
gacuccuugugguuuaugucauc

SEQ ID NO: 54862 - RNA, 23 nt, Artificial Sequence
  RNA Oligomer
cauccugagaugagacauguaga

SEQ ID NO: 54863 - RNA, 23 nt, Artificial Sequence
  RNA Oligomer
ucauccugagaugagacauguag

SEQ ID NO: 54864 - RNA, 23 nt, Artificial Sequence
  RNA Oligomer
cagucgcugugguuguuuuagcu

SEQ ID NO: 54865 - RNA, 23 nt, Artificial Sequence
  RNA Oligomer
ccagucgcugugguuguuuuagc

SEQ ID NO: 54866 - RNA, 23 nt, Artificial Sequence
  RNA Oligomer
gccagucgcugugguuguuuuag

SEQ ID NO: 54867 - RNA, 23 nt, Artificial Sequence
  RNA Oligomer
agccagucgcugugguuguuuua

SEQ ID NO: 54868 - RNA, 23 nt, Artificial Sequence
  RNA Oligomer
gagccagucgcugugguuguuuu

SEQ ID NO: 54869 - RNA, 23 nt, Artificial Sequence
  RNA Oligomer
gaagauuccagagacuuaugcca

SEQ ID NO: 54870 - RNA, 23 nt, Artificial Sequence
  RNA Oligomer
agaagauuccagagacuuaugcc

SEQ ID NO: 54871 - RNA, 23 nt, Artificial Sequence
  RNA Oligomer
gagaagauuccagagacuuaugc

SEQ ID NO: 54872 - RNA, 23 nt, Artificial Sequence
  RNA Oligomer
gccugggugauacaugguggaag

SEQ ID NO: 54873 - RNA, 23 nt, Artificial Sequence
  RNA Oligomer
guauucuggaaaacgguuucccg

SEQ ID NO: 54874 - RNA, 23 nt, Artificial Sequence
  RNA Oligomer
aguauucuggaaaacgguuuccc

SEQ ID NO: 54875 - RNA, 23 nt, Artificial Sequence
  RNA Oligomer
caguauucuggaaaacgguuucc

SEQ ID NO: 54876 - RNA, 23 nt, Artificial Sequence
  RNA Oligomer
ucaguauucuggaaaacgguuuc

SEQ ID NO: 54877 - RNA, 23 nt, Artificial Sequence
  RNA Oligomer
uucaguauucuggaaaacgguuu

SEQ ID NO: 54878 - RNA, 23 nt, Artificial Sequence
  RNA Oligomer
gcuuucaagggugcauuuauuuc

SEQ ID NO: 54879 - RNA, 23 nt, Artificial Sequence
  RNA Oligomer
ugcuuucaagggugcauuuauuu

SEQ ID NO: 54880 - RNA, 23 nt, Artificial Sequence
  RNA Oligomer
augcuuucaagggugcauuuauu

SEQ ID NO: 54881 - RNA, 23 nt, Artificial Sequence
  RNA Oligomer
gaugcuuucaagggugcauuuau

SEQ ID NO: 54882 - RNA, 23 nt, Artificial Sequence
  RNA Oligomer
ggaugcuuucaagggugcauuua

SEQ ID NO: 54883 - RNA, 23 nt, Artificial Sequence
  RNA Oligomer
aaugaccuuguugcaugauguau

SEQ ID NO: 54884 - RNA, 23 nt, Artificial Sequence
  RNA Oligomer
gaaugaccuuguugcaugaugua

SEQ ID NO: 54885 - RNA, 23 nt, Artificial Sequence
  RNA Oligomer
ugaaugaccuuguugcaugaugu

SEQ ID NO: 54886 - RNA, 23 nt, Artificial Sequence
  RNA Oligomer
cucuuauuagaacaggcaaguga

SEQ ID NO: 54887 - RNA, 23 nt, Artificial Sequence
  RNA Oligomer
ucucuuauuagaacaggcaagug

SEQ ID NO: 54888 - RNA, 23 nt, Artificial Sequence
  RNA Oligomer
cucucuuauuagaacaggcaagu

SEQ ID NO: 54889 - RNA, 23 nt, Artificial Sequence
  RNA Oligomer
ccucucuuauuagaacaggcaag

SEQ ID NO: 54890 - RNA, 23 nt, Artificial Sequence
  RNA Oligomer
accucucuuauuagaacaggcaa

SEQ ID NO: 54891 - RNA, 23 nt, Artificial Sequence
  RNA Oligomer
agaugagacauguagacugccaa

SEQ ID NO: 54892 - RNA, 23 nt, Artificial Sequence
  RNA Oligomer
gagaugagacauguagacugcca

SEQ ID NO: 54893 - RNA, 23 nt, Artificial Sequence
  RNA Oligomer
gugguuguuuuagcuccuugacu

SEQ ID NO: 54894 - RNA, 23 nt, Artificial Sequence
  RNA Oligomer
ugugguuguuuuagcuccuugac

SEQ ID NO: 54895 - RNA, 23 nt, Artificial Sequence
  RNA Oligomer
cugugguuguuuuagcuccuuga

SEQ ID NO: 54896 - RNA, 23 nt, Artificial Sequence
  RNA Oligomer
gcugugguuguuuuagcuccuug

SEQ ID NO: 54897 - RNA, 23 nt, Artificial Sequence
  RNA Oligomer
cgcugugguuguuuuagcuccuu

SEQ ID NO: 54898 - RNA, 23 nt, Artificial Sequence
  RNA Oligomer
ccugaggauucaucuugcacauc

SEQ ID NO: 54899 - RNA, 23 nt, Artificial Sequence
  RNA Oligomer
uccugaggauucaucuugcacau

SEQ ID NO: 54900 - RNA, 23 nt, Artificial Sequence
  RNA Oligomer
gugugugaaaaauccugaggauu

SEQ ID NO: 54901 - RNA, 23 nt, Artificial Sequence
  RNA Oligomer
agugugugaaaaauccugaggau

SEQ ID NO: 54902 - RNA, 23 nt, Artificial Sequence
  RNA Oligomer
cagugugugaaaaauccugagga

SEQ ID NO: 54903 - RNA, 23 nt, Artificial Sequence
  RNA Oligomer
ucagugugugaaaaauccugagg

SEQ ID NO: 54904 - RNA, 23 nt, Artificial Sequence
  RNA Oligomer
uucagugugugaaaaauccugag

SEQ ID NO: 54905 - RNA, 23 nt, Artificial Sequence
  RNA Oligomer
auaaaagagcuggaaucgauuau

SEQ ID NO: 54906 - RNA, 23 nt, Artificial Sequence
  RNA Oligomer
uccauaauuugcaaccagagaag

SEQ ID NO: 54907 - RNA, 23 nt, Artificial Sequence
  RNA Oligomer
cucaauggaucccgcaguaaaau

SEQ ID NO: 54908 - RNA, 23 nt, Artificial Sequence
  RNA Oligomer
gcucaauggaucccgcaguaaaa

SEQ ID NO: 54909 - RNA, 23 nt, Artificial Sequence
  RNA Oligomer
ugcucaauggaucccgcaguaaa

SEQ ID NO: 54910 - RNA, 23 nt, Artificial Sequence
  RNA Oligomer
augcucaauggaucccgcaguaa

SEQ ID NO: 54911 - RNA, 23 nt, Artificial Sequence
  RNA Oligomer
gaugcucaauggaucccgcagua

SEQ ID NO: 54912 - RNA, 23 nt, Artificial Sequence
  RNA Oligomer
ggagaaaggacugcagcaacaac

SEQ ID NO: 54913 - RNA, 23 nt, Artificial Sequence
  RNA Oligomer
uggagaaaggacugcagcaacaa

SEQ ID NO: 54914 - RNA, 23 nt, Artificial Sequence
  RNA Oligomer
cuggagaaaggacugcagcaaca

SEQ ID NO: 54915 - RNA, 23 nt, Artificial Sequence
  RNA Oligomer
acuggagaaaggacugcagcaac

SEQ ID NO: 54916 - RNA, 23 nt, Artificial Sequence
  RNA Oligomer
gacuggagaaaggacugcagcaa

SEQ ID NO: 54917 - RNA, 23 nt, Artificial Sequence
  RNA Oligomer
acauuacugaagaagacuaucag

SEQ ID NO: 54918 - RNA, 23 nt, Artificial Sequence
  RNA Oligomer
aacauuacugaagaagacuauca

SEQ ID NO: 54919 - RNA, 23 nt, Artificial Sequence
  RNA Oligomer
caacauuacugaagaagacuauc

SEQ ID NO: 54920 - RNA, 23 nt, Artificial Sequence
  RNA Oligomer
gcaacauuacugaagaagacuau

SEQ ID NO: 54921 - RNA, 23 nt, Artificial Sequence
  RNA Oligomer
ugcaacauuacugaagaagacua

SEQ ID NO: 54922 - RNA, 23 nt, Artificial Sequence
  RNA Oligomer
uugcaacauuacugaagaagacu

SEQ ID NO: 54923 - RNA, 23 nt, Artificial Sequence
  RNA Oligomer
cuugcaacauuacugaagaagac

SEQ ID NO: 54924 - RNA, 23 nt, Artificial Sequence
  RNA Oligomer
ccuugcaacauuacugaagaaga

SEQ ID NO: 54925 - RNA, 23 nt, Artificial Sequence
  RNA Oligomer
gggaggugcaguuucagaaccca

SEQ ID NO: 54926 - RNA, 23 nt, Artificial Sequence
  RNA Oligomer
ggggaggugcaguuucagaaccc

SEQ ID NO: 54927 - RNA, 23 nt, Artificial Sequence
  RNA Oligomer
aggggaggugcaguuucagaacc

SEQ ID NO: 54928 - RNA, 23 nt, Artificial Sequence
  RNA Oligomer
aaggggaggugcaguuucagaac

SEQ ID NO: 54929 - RNA, 23 nt, Artificial Sequence
  RNA Oligomer
gaaggggaggugcaguuucagaa

SEQ ID NO: 54930 - RNA, 23 nt, Artificial Sequence
  RNA Oligomer
guguaugggaugcuuucaagggu

SEQ ID NO: 54931 - RNA, 23 nt, Artificial Sequence
  RNA Oligomer
aguguaugggaugcuuucaaggg

SEQ ID NO: 54932 - RNA, 23 nt, Artificial Sequence
  RNA Oligomer
aaguguaugggaugcuuucaagg

SEQ ID NO: 54933 - RNA, 23 nt, Artificial Sequence
  RNA Oligomer
aaaguguaugggaugcuuucaag

SEQ ID NO: 54934 - RNA, 23 nt, Artificial Sequence
  RNA Oligomer
gugaagaaaagugaaugcucaag

SEQ ID NO: 54935 - RNA, 23 nt, Artificial Sequence
  RNA Oligomer
agugaagaaaagugaaugcucaa

SEQ ID NO: 54936 - RNA, 23 nt, Artificial Sequence
  RNA Oligomer
aagugaagaaaagugaaugcuca

SEQ ID NO: 54937 - RNA, 23 nt, Artificial Sequence
  RNA Oligomer
acuuauaucaucagcauaccuuu

SEQ ID NO: 54938 - RNA, 23 nt, Artificial Sequence
  RNA Oligomer
aacuuauaucaucagcauaccuu

SEQ ID NO: 54939 - RNA, 23 nt, Artificial Sequence
  RNA Oligomer
uaacuuauaucaucagcauaccu

SEQ ID NO: 54940 - RNA, 23 nt, Artificial Sequence
  RNA Oligomer
auaacuuauaucaucagcauacc

SEQ ID NO: 54941 - RNA, 23 nt, Artificial Sequence
  RNA Oligomer
aauaacuuauaucaucagcauac

SEQ ID NO: 54942 - RNA, 23 nt, Artificial Sequence
  RNA Oligomer
uucauccugagaugagacaugua

SEQ ID NO: 54943 - RNA, 23 nt, Artificial Sequence
  RNA Oligomer
gguuguuuuagcuccuugacucc

SEQ ID NO: 54944 - RNA, 23 nt, Artificial Sequence
  RNA Oligomer
ugguuguuuuagcuccuugacuc

SEQ ID NO: 54945 - RNA, 23 nt, Artificial Sequence
  RNA Oligomer
caugguggaagagaagauuccag

SEQ ID NO: 54946 - RNA, 23 nt, Artificial Sequence
  RNA Oligomer
agagaagguucagacacuagagg

SEQ ID NO: 54947 - RNA, 23 nt, Artificial Sequence
  RNA Oligomer
cagagaagguucagacacuagag

SEQ ID NO: 54948 - RNA, 23 nt, Artificial Sequence
  RNA Oligomer
ccagagaagguucagacacuaga

SEQ ID NO: 54949 - RNA, 23 nt, Artificial Sequence
  RNA Oligomer
accagagaagguucagacacuag

SEQ ID NO: 54950 - RNA, 23 nt, Artificial Sequence
  RNA Oligomer
aaccagagaagguucagacacua

SEQ ID NO: 54951 - RNA, 23 nt, Artificial Sequence
  RNA Oligomer
auaauuugcaaccagagaagguu

SEQ ID NO: 54952 - RNA, 23 nt, Artificial Sequence
  RNA Oligomer
cauaauuugcaaccagagaaggu

SEQ ID NO: 54953 - RNA, 23 nt, Artificial Sequence
  RNA Oligomer
ccauaauuugcaaccagagaagg

SEQ ID NO: 54954 - RNA, 23 nt, Artificial Sequence
  RNA Oligomer
ugcgucaaguacacugaaauuca

SEQ ID NO: 54955 - RNA, 23 nt, Artificial Sequence
  RNA Oligomer
augcgucaaguacacugaaauuc

SEQ ID NO: 54956 - RNA, 23 nt, Artificial Sequence
  RNA Oligomer
gaugcgucaaguacacugaaauu

SEQ ID NO: 54957 - RNA, 23 nt, Artificial Sequence
  RNA Oligomer
uggaucccgcaguaaaaucuuug

SEQ ID NO: 54958 - RNA, 23 nt, Artificial Sequence
  RNA Oligomer
auggaucccgcaguaaaaucuuu

SEQ ID NO: 54959 - RNA, 23 nt, Artificial Sequence
  RNA Oligomer
ugguccaugugaugcucaaugga

SEQ ID NO: 54960 - RNA, 23 nt, Artificial Sequence
  RNA Oligomer
gugguccaugugaugcucaaugg

SEQ ID NO: 54961 - RNA, 23 nt, Artificial Sequence
  RNA Oligomer
ugugguccaugugaugcucaaug

SEQ ID NO: 54962 - RNA, 23 nt, Artificial Sequence
  RNA Oligomer
augugguccaugugaugcucaau

SEQ ID NO: 54963 - RNA, 23 nt, Artificial Sequence
  RNA Oligomer
gaugugguccaugugaugcucaa

SEQ ID NO: 54964 - RNA, 23 nt, Artificial Sequence
  RNA Oligomer
uggcccaucaguucacacagguc

SEQ ID NO: 54965 - RNA, 23 nt, Artificial Sequence
  RNA Oligomer
cuggcccaucaguucacacaggu

SEQ ID NO: 54966 - RNA, 23 nt, Artificial Sequence
  RNA Oligomer
ucuggcccaucaguucacacagg

SEQ ID NO: 54967 - RNA, 23 nt, Artificial Sequence
  RNA Oligomer
aucuggcccaucaguucacacag

SEQ ID NO: 54968 - RNA, 23 nt, Artificial Sequence
  RNA Oligomer
gaucuggcccaucaguucacaca

SEQ ID NO: 54969 - RNA, 23 nt, Artificial Sequence
  RNA Oligomer
aaaacauccuugcaacauuacug

SEQ ID NO: 54970 - RNA, 23 nt, Artificial Sequence
  RNA Oligomer
caaaacauccuugcaacauuacu

SEQ ID NO: 54971 - RNA, 23 nt, Artificial Sequence
  RNA Oligomer
ucaaaacauccuugcaacauuac

SEQ ID NO: 54972 - RNA, 23 nt, Artificial Sequence
  RNA Oligomer
uucaaaacauccuugcaacauua

SEQ ID NO: 54973 - RNA, 23 nt, Artificial Sequence
  RNA Oligomer
uuucaaaacauccuugcaacauu

SEQ ID NO: 54974 - RNA, 23 nt, Artificial Sequence
  RNA Oligomer
auuucaaaacauccuugcaacau

SEQ ID NO: 54975 - RNA, 23 nt, Artificial Sequence
  RNA Oligomer
agaaagcauuacauuuccaaaug

SEQ ID NO: 54976 - RNA, 23 nt, Artificial Sequence
  RNA Oligomer
cagaaagcauuacauuuccaaau

SEQ ID NO: 54977 - RNA, 23 nt, Artificial Sequence
  RNA Oligomer
ucagaaagcauuacauuuccaaa

SEQ ID NO: 54978 - RNA, 23 nt, Artificial Sequence
  RNA Oligomer
uucagaaagcauuacauuuccaa

SEQ ID NO: 54979 - RNA, 23 nt, Artificial Sequence
  RNA Oligomer
guagacugccaaaguguauggga

SEQ ID NO: 54980 - RNA, 23 nt, Artificial Sequence
  RNA Oligomer
uguagacugccaaaguguauggg

SEQ ID NO: 54981 - RNA, 23 nt, Artificial Sequence
  RNA Oligomer
auguagacugccaaaguguaugg

SEQ ID NO: 54982 - RNA, 23 nt, Artificial Sequence
  RNA Oligomer
cauguagacugccaaaguguaug

SEQ ID NO: 54983 - RNA, 23 nt, Artificial Sequence
  RNA Oligomer
gaaaaaucaccacaccaaaccuc

SEQ ID NO: 54984 - RNA, 23 nt, Artificial Sequence
  RNA Oligomer
gcauaccuuuauugugaucuauc

SEQ ID NO: 54985 - RNA, 23 nt, Artificial Sequence
  RNA Oligomer
agcauaccuuuauugugaucuau

SEQ ID NO: 54986 - RNA, 23 nt, Artificial Sequence
  RNA Oligomer
cagcauaccuuuauugugaucua

SEQ ID NO: 54987 - RNA, 23 nt, Artificial Sequence
  RNA Oligomer
ucagcauaccuuuauugugaucu

SEQ ID NO: 54988 - RNA, 23 nt, Artificial Sequence
  RNA Oligomer
aucagcauaccuuuauugugauc

SEQ ID NO: 54989 - RNA, 23 nt, Artificial Sequence
  RNA Oligomer
uuauaucaucagcauaccuuuau

SEQ ID NO: 54990 - RNA, 23 nt, Artificial Sequence
  RNA Oligomer
gugcagagcugaagauuuuggag

SEQ ID NO: 54991 - RNA, 23 nt, Artificial Sequence
  RNA Oligomer
ggugcagagcugaagauuuugga

SEQ ID NO: 54992 - RNA, 23 nt, Artificial Sequence
  RNA Oligomer
uggugcagagcugaagauuuugg

SEQ ID NO: 54993 - RNA, 23 nt, Artificial Sequence
  RNA Oligomer
cuggugcagagcugaagauuuug

SEQ ID NO: 54994 - RNA, 23 nt, Artificial Sequence
  RNA Oligomer
gcuggugcagagcugaagauuuu

SEQ ID NO: 54995 - RNA, 23 nt, Artificial Sequence
  RNA Oligomer
cauaaaagagcuggaaucgauua

SEQ ID NO: 54996 - RNA, 23 nt, Artificial Sequence
  RNA Oligomer
ccauaaaagagcuggaaucgauu

SEQ ID NO: 54997 - RNA, 23 nt, Artificial Sequence
  RNA Oligomer
accauaaaagagcuggaaucgau

SEQ ID NO: 54998 - RNA, 23 nt, Artificial Sequence
  RNA Oligomer
ugacaaaaacagcacuuuuggga

SEQ ID NO: 54999 - RNA, 23 nt, Artificial Sequence
  RNA Oligomer
uugacaaaaacagcacuuuuggg

SEQ ID NO: 55000 - RNA, 23 nt, Artificial Sequence
  RNA Oligomer
uuugacaaaaacagcacuuuugg

SEQ ID NO: 55001 - RNA, 23 nt, Artificial Sequence
  RNA Oligomer
cuuugacaaaaacagcacuuuug

SEQ ID NO: 55002 - RNA, 23 nt, Artificial Sequence
  RNA Oligomer
ucuuugacaaaaacagcacuuuu

SEQ ID NO: 55003 - RNA, 23 nt, Artificial Sequence
  RNA Oligomer
cuaccuugcugaugaccucacau

SEQ ID NO: 55004 - RNA, 23 nt, Artificial Sequence
  RNA Oligomer
gcuaccuugcugaugaccucaca

SEQ ID NO: 55005 - RNA, 23 nt, Artificial Sequence
  RNA Oligomer
ggcuaccuugcugaugaccucac

SEQ ID NO: 55006 - RNA, 23 nt, Artificial Sequence
  RNA Oligomer
aggcuaccuugcugaugaccuca

SEQ ID NO: 55007 - RNA, 23 nt, Artificial Sequence
  RNA Oligomer
uaggcuaccuugcugaugaccuc

SEQ ID NO: 55008 - RNA, 23 nt, Artificial Sequence
  RNA Oligomer
cuaaugaaguugggaacucagac

SEQ ID NO: 55009 - RNA, 23 nt, Artificial Sequence
  RNA Oligomer
acuaaugaaguugggaacucaga

SEQ ID NO: 55010 - RNA, 23 nt, Artificial Sequence
  RNA Oligomer
cacuaaugaaguugggaacucag

SEQ ID NO: 55011 - RNA, 23 nt, Artificial Sequence
  RNA Oligomer
ccacuaaugaaguugggaacuca

SEQ ID NO: 55012 - RNA, 23 nt, Artificial Sequence
  RNA Oligomer
gccacuaaugaaguugggaacuc

SEQ ID NO: 55013 - RNA, 23 nt, Artificial Sequence
  RNA Oligomer
aaacauccuugcaacauuacuga

SEQ ID NO: 55014 - RNA, 23 nt, Artificial Sequence
  RNA Oligomer
ggugcauuuauuucaaaacaucc

SEQ ID NO: 55015 - RNA, 23 nt, Artificial Sequence
  RNA Oligomer
guauguuaaguuacuucacuuua

SEQ ID NO: 55016 - RNA, 23 nt, Artificial Sequence
  RNA Oligomer
uguauguuaaguuacuucacuuu

SEQ ID NO: 55017 - RNA, 23 nt, Artificial Sequence
  RNA Oligomer
uuguauguuaaguuacuucacuu

SEQ ID NO: 55018 - RNA, 23 nt, Artificial Sequence
  RNA Oligomer
auuguauguuaaguuacuucacu

SEQ ID NO: 55019 - RNA, 23 nt, Artificial Sequence
  RNA Oligomer
aauuguauguuaaguuacuucac

SEQ ID NO: 55020 - RNA, 23 nt, Artificial Sequence
  RNA Oligomer
caucagcauaccuuuauugugau

SEQ ID NO: 55021 - RNA, 23 nt, Artificial Sequence
  RNA Oligomer
acaucugagaucugagccagucg

SEQ ID NO: 55022 - RNA, 23 nt, Artificial Sequence
  RNA Oligomer
cacaucugagaucugagccaguc

SEQ ID NO: 55023 - RNA, 23 nt, Artificial Sequence
  RNA Oligomer
gcacaucugagaucugagccagu

SEQ ID NO: 55024 - RNA, 23 nt, Artificial Sequence
  RNA Oligomer
ugcacaucugagaucugagccag

SEQ ID NO: 55025 - RNA, 23 nt, Artificial Sequence
  RNA Oligomer
uugcacaucugagaucugagcca

SEQ ID NO: 55026 - RNA, 23 nt, Artificial Sequence
  RNA Oligomer
ucaucuugcacaucugagaucug

SEQ ID NO: 55027 - RNA, 23 nt, Artificial Sequence
  RNA Oligomer
uucaucuugcacaucugagaucu

SEQ ID NO: 55028 - RNA, 23 nt, Artificial Sequence
  RNA Oligomer
auucaucuugcacaucugagauc

SEQ ID NO: 55029 - RNA, 23 nt, Artificial Sequence
  RNA Oligomer
gauucaucuugcacaucugagau

SEQ ID NO: 55030 - RNA, 23 nt, Artificial Sequence
  RNA Oligomer
ggccugggugauacaugguggaa

SEQ ID NO: 55031 - RNA, 23 nt, Artificial Sequence
  RNA Oligomer
aggccugggugauacauggugga

SEQ ID NO: 55032 - RNA, 23 nt, Artificial Sequence
  RNA Oligomer
gugaugugguccaugugaugcuc

SEQ ID NO: 55033 - RNA, 23 nt, Artificial Sequence
  RNA Oligomer
ugugaugugguccaugugaugcu

SEQ ID NO: 55034 - RNA, 23 nt, Artificial Sequence
  RNA Oligomer
cugugaugugguccaugugaugc

SEQ ID NO: 55035 - RNA, 23 nt, Artificial Sequence
  RNA Oligomer
ccugugaugugguccaugugaug

SEQ ID NO: 55036 - RNA, 23 nt, Artificial Sequence
  RNA Oligomer
gccugugaugugguccaugugau

SEQ ID NO: 55037 - RNA, 23 nt, Artificial Sequence
  RNA Oligomer
ccagacuggagaaaggacugcag

SEQ ID NO: 55038 - RNA, 23 nt, Artificial Sequence
  RNA Oligomer
cccagacuggagaaaggacugca

SEQ ID NO: 55039 - RNA, 23 nt, Artificial Sequence
  RNA Oligomer
gcccagacuggagaaaggacugc

SEQ ID NO: 55040 - RNA, 23 nt, Artificial Sequence
  RNA Oligomer
ugcccagacuggagaaaggacug

SEQ ID NO: 55041 - RNA, 23 nt, Artificial Sequence
  RNA Oligomer
uugcccagacuggagaaaggacu

SEQ ID NO: 55042 - RNA, 23 nt, Artificial Sequence
  RNA Oligomer
ucaguucacacagguccagcggg

SEQ ID NO: 55043 - RNA, 23 nt, Artificial Sequence
  RNA Oligomer
aucaguucacacagguccagcgg

SEQ ID NO: 55044 - RNA, 23 nt, Artificial Sequence
  RNA Oligomer
caucaguucacacagguccagcg

SEQ ID NO: 55045 - RNA, 23 nt, Artificial Sequence
  RNA Oligomer
ccaucaguucacacagguccagc

SEQ ID NO: 55046 - RNA, 23 nt, Artificial Sequence
  RNA Oligomer
cccaucaguucacacagguccag

SEQ ID NO: 55047 - RNA, 23 nt, Artificial Sequence
  RNA Oligomer
agccacuaaugaaguugggaacu

SEQ ID NO: 55048 - RNA, 23 nt, Artificial Sequence
  RNA Oligomer
cagccacuaaugaaguugggaac

SEQ ID NO: 55049 - RNA, 23 nt, Artificial Sequence
  RNA Oligomer
augaaugaccuuguugcaugaug

SEQ ID NO: 55050 - RNA, 23 nt, Artificial Sequence
  RNA Oligomer
aaugaaugaccuuguugcaugau

SEQ ID NO: 55051 - RNA, 23 nt, Artificial Sequence
  RNA Oligomer
aaaugaaugaccuuguugcauga

SEQ ID NO: 55052 - RNA, 23 nt, Artificial Sequence
  RNA Oligomer
caaaugaaugaccuuguugcaug

SEQ ID NO: 55053 - RNA, 23 nt, Artificial Sequence
  RNA Oligomer
caaguuuuucagaaagcauuaca

SEQ ID NO: 55054 - RNA, 23 nt, Artificial Sequence
  RNA Oligomer
ucaaguuuuucagaaagcauuac

SEQ ID NO: 55055 - RNA, 23 nt, Artificial Sequence
  RNA Oligomer
aaucaccacaccaaaccucucuu

SEQ ID NO: 55056 - RNA, 23 nt, Artificial Sequence
  RNA Oligomer
uauugguaacauccuuucuauug

SEQ ID NO: 55057 - RNA, 23 nt, Artificial Sequence
  RNA Oligomer
ccuuuauugugaucuaucaauag

SEQ ID NO: 55058 - RNA, 23 nt, Artificial Sequence
  RNA Oligomer
accuuuauugugaucuaucaaua

SEQ ID NO: 55059 - RNA, 23 nt, Artificial Sequence
  RNA Oligomer
uaccuuuauugugaucuaucaau

SEQ ID NO: 55060 - RNA, 23 nt, Artificial Sequence
  RNA Oligomer
auaccuuuauugugaucuaucaa

SEQ ID NO: 55061 - RNA, 23 nt, Artificial Sequence
  RNA Oligomer
cauaccuuuauugugaucuauca

SEQ ID NO: 55062 - RNA, 23 nt, Artificial Sequence
  RNA Oligomer
gcugaagauuuuggaggguccuc

SEQ ID NO: 55063 - RNA, 23 nt, Artificial Sequence
  RNA Oligomer
agcugaagauuuuggaggguccu

SEQ ID NO: 55064 - RNA, 23 nt, Artificial Sequence
  RNA Oligomer
gagcugaagauuuuggagggucc

SEQ ID NO: 55065 - RNA, 23 nt, Artificial Sequence
  RNA Oligomer
agagcugaagauuuuggaggguc

SEQ ID NO: 55066 - RNA, 23 nt, Artificial Sequence
  RNA Oligomer
cagagcugaagauuuuggagggu

SEQ ID NO: 55067 - RNA, 23 nt, Artificial Sequence
  RNA Oligomer
ugcuggugcagagcugaagauuu

SEQ ID NO: 55068 - RNA, 23 nt, Artificial Sequence
  RNA Oligomer
cugcuggugcagagcugaagauu

SEQ ID NO: 55069 - RNA, 23 nt, Artificial Sequence
  RNA Oligomer
ccugcuggugcagagcugaagau

SEQ ID NO: 55070 - RNA, 23 nt, Artificial Sequence
  RNA Oligomer
uugacuccuugugguuuauguca

SEQ ID NO: 55071 - RNA, 23 nt, Artificial Sequence
  RNA Oligomer
cuugacuccuugugguuuauguc

SEQ ID NO: 55072 - RNA, 23 nt, Artificial Sequence
  RNA Oligomer
ccuugacuccuugugguuuaugu

SEQ ID NO: 55073 - RNA, 23 nt, Artificial Sequence
  RNA Oligomer
uccuugacuccuugugguuuaug

SEQ ID NO: 55074 - RNA, 23 nt, Artificial Sequence
  RNA Oligomer
cuccuugacuccuugugguuuau

SEQ ID NO: 55075 - RNA, 23 nt, Artificial Sequence
  RNA Oligomer
agcuccuugacuccuugugguuu

SEQ ID NO: 55076 - RNA, 23 nt, Artificial Sequence
  RNA Oligomer
uagcuccuugacuccuugugguu

SEQ ID NO: 55077 - RNA, 23 nt, Artificial Sequence
  RNA Oligomer
uuagcuccuugacuccuuguggu

SEQ ID NO: 55078 - RNA, 23 nt, Artificial Sequence
  RNA Oligomer
uuuagcuccuugacuccuugugg

SEQ ID NO: 55079 - RNA, 23 nt, Artificial Sequence
  RNA Oligomer
uuuuagcuccuugacuccuugug

SEQ ID NO: 55080 - RNA, 23 nt, Artificial Sequence
  RNA Oligomer
auccugaggauucaucuugcaca

SEQ ID NO: 55081 - RNA, 23 nt, Artificial Sequence
  RNA Oligomer
aauccugaggauucaucuugcac

SEQ ID NO: 55082 - RNA, 23 nt, Artificial Sequence
  RNA Oligomer
aaauccugaggauucaucuugca

SEQ ID NO: 55083 - RNA, 23 nt, Artificial Sequence
  RNA Oligomer
caaccagagaagguucagacacu

SEQ ID NO: 55084 - RNA, 23 nt, Artificial Sequence
  RNA Oligomer
aucuuugacaaaaacagcacuuu

SEQ ID NO: 55085 - RNA, 23 nt, Artificial Sequence
  RNA Oligomer
caauggaucccgcaguaaaaucu

SEQ ID NO: 55086 - RNA, 23 nt, Artificial Sequence
  RNA Oligomer
ucaauggaucccgcaguaaaauc

SEQ ID NO: 55087 - RNA, 23 nt, Artificial Sequence
  RNA Oligomer
gguccaugugaugcucaauggau

SEQ ID NO: 55088 - RNA, 23 nt, Artificial Sequence
  RNA Oligomer
aucagccacuaaugaaguuggga

SEQ ID NO: 55089 - RNA, 23 nt, Artificial Sequence
  RNA Oligomer
uaucagccacuaaugaaguuggg

SEQ ID NO: 55090 - RNA, 23 nt, Artificial Sequence
  RNA Oligomer
cuaucagccacuaaugaaguugg

SEQ ID NO: 55091 - RNA, 23 nt, Artificial Sequence
  RNA Oligomer
acuaucagccacuaaugaaguug

SEQ ID NO: 55092 - RNA, 23 nt, Artificial Sequence
  RNA Oligomer
gacuaucagccacuaaugaaguu

SEQ ID NO: 55093 - RNA, 23 nt, Artificial Sequence
  RNA Oligomer
cauuacugaagaagacuaucagc

SEQ ID NO: 55094 - RNA, 23 nt, Artificial Sequence
  RNA Oligomer
ggaggugcaguuucagaacccag

SEQ ID NO: 55095 - RNA, 23 nt, Artificial Sequence
  RNA Oligomer
ugggaugcuuucaagggugcauu

SEQ ID NO: 55096 - RNA, 23 nt, Artificial Sequence
  RNA Oligomer
augggaugcuuucaagggugcau

SEQ ID NO: 55097 - RNA, 23 nt, Artificial Sequence
  RNA Oligomer
uaugggaugcuuucaagggugca

SEQ ID NO: 55098 - RNA, 23 nt, Artificial Sequence
  RNA Oligomer
guaugggaugcuuucaagggugc

SEQ ID NO: 55099 - RNA, 23 nt, Artificial Sequence
  RNA Oligomer
uguaugggaugcuuucaagggug

SEQ ID NO: 55100 - RNA, 23 nt, Artificial Sequence
  RNA Oligomer
agaagguucagacacuagaggcc

SEQ ID NO: 55101 - RNA, 23 nt, Artificial Sequence
  RNA Oligomer
gagaagguucagacacuagaggc

SEQ ID NO: 55102 - RNA, 23 nt, Artificial Sequence
  RNA Oligomer
ucagccacuaaugaaguugggaa

SEQ ID NO: 55103 - RNA, 23 nt, Artificial Sequence
  RNA Oligomer
acauuuccaaaugaaugaccuug

SEQ ID NO: 55104 - RNA, 23 nt, Artificial Sequence
  RNA Oligomer
uacauuuccaaaugaaugaccuu

SEQ ID NO: 55105 - RNA, 23 nt, Artificial Sequence
  RNA Oligomer
uuacauuuccaaaugaaugaccu

SEQ ID NO: 55106 - RNA, 23 nt, Artificial Sequence
  RNA Oligomer
auuacauuuccaaaugaaugacc

SEQ ID NO: 55107 - RNA, 23 nt, Artificial Sequence
  RNA Oligomer
cauuacauuuccaaaugaaugac

SEQ ID NO: 55108 - RNA, 23 nt, Artificial Sequence
  RNA Oligomer
cugaagauuuuggaggguccucc

SEQ ID NO: 55109 - RNA, 23 nt, Artificial Sequence
  RNA Oligomer
caauuuuccugcaagaauaucua

SEQ ID NO: 55110 - RNA, 23 nt, Artificial Sequence
  RNA Oligomer
ucaauuuuccugcaagaauaucu

SEQ ID NO: 55111 - RNA, 23 nt, Artificial Sequence
  RNA Oligomer
uucaauuuuccugcaagaauauc

SEQ ID NO: 55112 - RNA, 23 nt, Artificial Sequence
  RNA Oligomer
auucaauuuuccugcaagaauau

SEQ ID NO: 55113 - RNA, 23 nt, Artificial Sequence
  RNA Oligomer
uauucaauuuuccugcaagaaua

SEQ ID NO: 55114 - RNA, 23 nt, Artificial Sequence
  RNA Oligomer
ugccugugaugugguccauguga

SEQ ID NO: 55115 - RNA, 23 nt, Artificial Sequence
  RNA Oligomer
cugccugugaugugguccaugug

SEQ ID NO: 55116 - RNA, 23 nt, Artificial Sequence
  RNA Oligomer
gcugccugugaugugguccaugu

SEQ ID NO: 55117 - RNA, 23 nt, Artificial Sequence
  RNA Oligomer
agauucuucuuuggagcagaaua

SEQ ID NO: 55118 - RNA, 23 nt, Artificial Sequence
  RNA Oligomer
aagauucuucuuuggagcagaau

SEQ ID NO: 55119 - RNA, 23 nt, Artificial Sequence
  RNA Oligomer
caagauucuucuuuggagcagaa

SEQ ID NO: 55120 - RNA, 23 nt, Artificial Sequence
  RNA Oligomer
acaagauucuucuuuggagcaga

SEQ ID NO: 55121 - RNA, 23 nt, Artificial Sequence
  RNA Oligomer
aacaagauucuucuuuggagcag

SEQ ID NO: 55122 - RNA, 23 nt, Artificial Sequence
  RNA Oligomer
cucagaccguaccuugcaacaag

SEQ ID NO: 55123 - RNA, 23 nt, Artificial Sequence
  RNA Oligomer
acucagaccguaccuugcaacaa

SEQ ID NO: 55124 - RNA, 23 nt, Artificial Sequence
  RNA Oligomer
aacucagaccguaccuugcaaca

SEQ ID NO: 55125 - RNA, 23 nt, Artificial Sequence
  RNA Oligomer
gaacucagaccguaccuugcaac

SEQ ID NO: 55126 - RNA, 23 nt, Artificial Sequence
  RNA Oligomer
ggaacucagaccguaccuugcaa

SEQ ID NO: 55127 - RNA, 23 nt, Artificial Sequence
  RNA Oligomer
gcagagcugaagauuuuggaggg

SEQ ID NO: 55128 - RNA, 23 nt, Artificial Sequence
  RNA Oligomer
ugcagagcugaagauuuuggagg

SEQ ID NO: 55129 - RNA, 23 nt, Artificial Sequence
  RNA Oligomer
uuguugcaugauguauuuuugua

SEQ ID NO: 55130 - RNA, 23 nt, Artificial Sequence
  RNA Oligomer
aaaucaccacaccaaaccucucu

SEQ ID NO: 55131 - RNA, 23 nt, Artificial Sequence
  RNA Oligomer
ggaguguggaaguccauaauuug

SEQ ID NO: 55132 - RNA, 23 nt, Artificial Sequence
  RNA Oligomer
gggaguguggaaguccauaauuu

SEQ ID NO: 55133 - RNA, 23 nt, Artificial Sequence
  RNA Oligomer
ugggaguguggaaguccauaauu

SEQ ID NO: 55134 - RNA, 23 nt, Artificial Sequence
  RNA Oligomer
uugggaguguggaaguccauaau

SEQ ID NO: 55135 - RNA, 23 nt, Artificial Sequence
  RNA Oligomer
uuugggaguguggaaguccauaa

SEQ ID NO: 55136 - RNA, 23 nt, Artificial Sequence
  RNA Oligomer
cuauggccaacugcgaguucagc

SEQ ID NO: 55137 - RNA, 23 nt, Artificial Sequence
  RNA Oligomer
ccuauggccaacugcgaguucag

SEQ ID NO: 55138 - RNA, 23 nt, Artificial Sequence
  RNA Oligomer
cccuauggccaacugcgaguuca

SEQ ID NO: 55139 - RNA, 23 nt, Artificial Sequence
  RNA Oligomer
gcccuauggccaacugcgaguuc

SEQ ID NO: 55140 - RNA, 23 nt, Artificial Sequence
  RNA Oligomer
agcccuauggccaacugcgaguu

SEQ ID NO: 55141 - RNA, 23 nt, Artificial Sequence
  RNA Oligomer
ccaggaucccaccauaaaagagc

SEQ ID NO: 55142 - RNA, 23 nt, Artificial Sequence
  RNA Oligomer
gccaggaucccaccauaaaagag

SEQ ID NO: 55143 - RNA, 23 nt, Artificial Sequence
  RNA Oligomer
ugccaggaucccaccauaaaaga

SEQ ID NO: 55144 - RNA, 23 nt, Artificial Sequence
  RNA Oligomer
augccaggaucccaccauaaaag

SEQ ID NO: 55145 - RNA, 23 nt, Artificial Sequence
  RNA Oligomer
uaugccaggaucccaccauaaaa

SEQ ID NO: 55146 - RNA, 23 nt, Artificial Sequence
  RNA Oligomer
guggaagagaagauuccagagac

SEQ ID NO: 55147 - RNA, 23 nt, Artificial Sequence
  RNA Oligomer
gguggaagagaagauuccagaga

SEQ ID NO: 55148 - RNA, 23 nt, Artificial Sequence
  RNA Oligomer
agaccguaccuugcaacaagauu

SEQ ID NO: 55149 - RNA, 23 nt, Artificial Sequence
  RNA Oligomer
cagaccguaccuugcaacaagau

SEQ ID NO: 55150 - RNA, 23 nt, Artificial Sequence
  RNA Oligomer
ucagaccguaccuugcaacaaga

SEQ ID NO: 55151 - RNA, 23 nt, Artificial Sequence
  RNA Oligomer
ccauaaacuucauggucaugggu

SEQ ID NO: 55152 - RNA, 23 nt, Artificial Sequence
  RNA Oligomer
accauaaacuucauggucauggg

SEQ ID NO: 55153 - RNA, 23 nt, Artificial Sequence
  RNA Oligomer
aaccauaaacuucauggucaugg

SEQ ID NO: 55154 - RNA, 23 nt, Artificial Sequence
  RNA Oligomer
aaaccauaaacuucauggucaug

SEQ ID NO: 55155 - RNA, 23 nt, Artificial Sequence
  RNA Oligomer
caaaccauaaacuucauggucau

SEQ ID NO: 55156 - RNA, 23 nt, Artificial Sequence
  RNA Oligomer
cagauagucaaaccauaaacuuc

SEQ ID NO: 55157 - RNA, 23 nt, Artificial Sequence
  RNA Oligomer
acagauagucaaaccauaaacuu

SEQ ID NO: 55158 - RNA, 23 nt, Artificial Sequence
  RNA Oligomer
uacagauagucaaaccauaaacu

SEQ ID NO: 55159 - RNA, 23 nt, Artificial Sequence
  RNA Oligomer
cuacagauagucaaaccauaaac

SEQ ID NO: 55160 - RNA, 23 nt, Artificial Sequence
  RNA Oligomer
ccuacagauagucaaaccauaaa

SEQ ID NO: 55161 - RNA, 23 nt, Artificial Sequence
  RNA Oligomer
augagacauguagacugccaaag

SEQ ID NO: 55162 - RNA, 23 nt, Artificial Sequence
  RNA Oligomer
gaugagacauguagacugccaaa

SEQ ID NO: 55163 - RNA, 23 nt, Artificial Sequence
  RNA Oligomer
agaauaucuacagaccugacaag

SEQ ID NO: 55164 - RNA, 23 nt, Artificial Sequence
  RNA Oligomer
aagaauaucuacagaccugacaa

SEQ ID NO: 55165 - RNA, 23 nt, Artificial Sequence
  RNA Oligomer
caagaauaucuacagaccugaca

SEQ ID NO: 55166 - RNA, 23 nt, Artificial Sequence
  RNA Oligomer
gcaagaauaucuacagaccugac

SEQ ID NO: 55167 - RNA, 23 nt, Artificial Sequence
  RNA Oligomer
ugcaagaauaucuacagaccuga

SEQ ID NO: 55168 - RNA, 23 nt, Artificial Sequence
  RNA Oligomer
aguguggaaguccauaauuugca

SEQ ID NO: 55169 - RNA, 23 nt, Artificial Sequence
  RNA Oligomer
gaguguggaaguccauaauuugc

SEQ ID NO: 55170 - RNA, 23 nt, Artificial Sequence
  RNA Oligomer
acaacccuguuucaguauucugg

SEQ ID NO: 55171 - RNA, 23 nt, Artificial Sequence
  RNA Oligomer
aacaacccuguuucaguauucug

SEQ ID NO: 55172 - RNA, 23 nt, Artificial Sequence
  RNA Oligomer
caacaacccuguuucaguauucu

SEQ ID NO: 55173 - RNA, 23 nt, Artificial Sequence
  RNA Oligomer
gcaacaacccuguuucaguauuc

SEQ ID NO: 55174 - RNA, 23 nt, Artificial Sequence
  RNA Oligomer
agcaacaacccuguuucaguauu

SEQ ID NO: 55175 - RNA, 23 nt, Artificial Sequence
  RNA Oligomer
ugguuuaugucaucauacaugac

SEQ ID NO: 55176 - RNA, 23 nt, Artificial Sequence
  RNA Oligomer
gugguuuaugucaucauacauga

SEQ ID NO: 55177 - RNA, 23 nt, Artificial Sequence
  RNA Oligomer
ugugguuuaugucaucauacaug

SEQ ID NO: 55178 - RNA, 23 nt, Artificial Sequence
  RNA Oligomer
cugaaauucauccugagaugaga

SEQ ID NO: 55179 - RNA, 23 nt, Artificial Sequence
  RNA Oligomer
acugaaauucauccugagaugag

SEQ ID NO: 55180 - RNA, 23 nt, Artificial Sequence
  RNA Oligomer
cacugaaauucauccugagauga

SEQ ID NO: 55181 - RNA, 23 nt, Artificial Sequence
  RNA Oligomer
acacugaaauucauccugagaug

SEQ ID NO: 55182 - RNA, 23 nt, Artificial Sequence
  RNA Oligomer
uacacugaaauucauccugagau

SEQ ID NO: 55183 - RNA, 23 nt, Artificial Sequence
  RNA Oligomer
uuaugccaggaucccaccauaaa

SEQ ID NO: 55184 - RNA, 23 nt, Artificial Sequence
  RNA Oligomer
cagagacuuaugccaggauccca

SEQ ID NO: 55185 - RNA, 23 nt, Artificial Sequence
  RNA Oligomer
ccagagacuuaugccaggauccc

SEQ ID NO: 55186 - RNA, 23 nt, Artificial Sequence
  RNA Oligomer
uccagagacuuaugccaggaucc

SEQ ID NO: 55187 - RNA, 23 nt, Artificial Sequence
  RNA Oligomer
uuccagagacuuaugccaggauc

SEQ ID NO: 55188 - RNA, 23 nt, Artificial Sequence
  RNA Oligomer
auuccagagacuuaugccaggau

SEQ ID NO: 55189 - RNA, 23 nt, Artificial Sequence
  RNA Oligomer
uggagcagaauaaaagaucuggc

SEQ ID NO: 55190 - RNA, 23 nt, Artificial Sequence
  RNA Oligomer
uuggagcagaauaaaagaucugg

SEQ ID NO: 55191 - RNA, 23 nt, Artificial Sequence
  RNA Oligomer
uuuggagcagaauaaaagaucug

SEQ ID NO: 55192 - RNA, 23 nt, Artificial Sequence
  RNA Oligomer
cuuuggagcagaauaaaagaucu

SEQ ID NO: 55193 - RNA, 23 nt, Artificial Sequence
  RNA Oligomer
ucuuuggagcagaauaaaagauc

SEQ ID NO: 55194 - RNA, 23 nt, Artificial Sequence
  RNA Oligomer
agaagacuaucagccacuaauga

SEQ ID NO: 55195 - RNA, 23 nt, Artificial Sequence
  RNA Oligomer
aagaagacuaucagccacuaaug

SEQ ID NO: 55196 - RNA, 23 nt, Artificial Sequence
  RNA Oligomer
gaagaagacuaucagccacuaau

SEQ ID NO: 55197 - RNA, 23 nt, Artificial Sequence
  RNA Oligomer
ugaagaagacuaucagccacuaa

SEQ ID NO: 55198 - RNA, 23 nt, Artificial Sequence
  RNA Oligomer
cugaagaagacuaucagccacua

SEQ ID NO: 55199 - RNA, 23 nt, Artificial Sequence
  RNA Oligomer
ccuuccuacagauagucaaacca

SEQ ID NO: 55200 - RNA, 23 nt, Artificial Sequence
  RNA Oligomer
cccuuccuacagauagucaaacc

SEQ ID NO: 55201 - RNA, 23 nt, Artificial Sequence
  RNA Oligomer
acccuuccuacagauagucaaac

SEQ ID NO: 55202 - RNA, 23 nt, Artificial Sequence
  RNA Oligomer
uacccuuccuacagauagucaaa

SEQ ID NO: 55203 - RNA, 23 nt, Artificial Sequence
  RNA Oligomer
guacccuuccuacagauagucaa

SEQ ID NO: 55204 - RNA, 23 nt, Artificial Sequence
  RNA Oligomer
uacuucacuuuaauucucaugug

SEQ ID NO: 55205 - RNA, 23 nt, Artificial Sequence
  RNA Oligomer
ggaggguccuccacaauaagguc

SEQ ID NO: 55206 - RNA, 23 nt, Artificial Sequence
  RNA Oligomer
uggaggguccuccacaauaaggu

SEQ ID NO: 55207 - RNA, 23 nt, Artificial Sequence
  RNA Oligomer
uuggaggguccuccacaauaagg

SEQ ID NO: 55208 - RNA, 23 nt, Artificial Sequence
  RNA Oligomer
uuuggaggguccuccacaauaag

SEQ ID NO: 55209 - RNA, 23 nt, Artificial Sequence
  RNA Oligomer
uuuuggaggguccuccacaauaa

SEQ ID NO: 55210 - RNA, 23 nt, Artificial Sequence
  RNA Oligomer
cugcaagaauaucuacagaccug

SEQ ID NO: 55211 - RNA, 23 nt, Artificial Sequence
  RNA Oligomer
ccugcaagaauaucuacagaccu

SEQ ID NO: 55212 - RNA, 23 nt, Artificial Sequence
  RNA Oligomer
agagacuuaugccaggaucccac

SEQ ID NO: 55213 - RNA, 23 nt, Artificial Sequence
  RNA Oligomer
guggugaauucaacacuuccaaa

SEQ ID NO: 55214 - RNA, 23 nt, Artificial Sequence
  RNA Oligomer
uguggugaauucaacacuuccaa

SEQ ID NO: 55215 - RNA, 23 nt, Artificial Sequence
  RNA Oligomer
uucuuuggagcagaauaaaagau

SEQ ID NO: 55216 - RNA, 23 nt, Artificial Sequence
  RNA Oligomer
agauagucaaaccauaaacuuca

SEQ ID NO: 55217 - RNA, 23 nt, Artificial Sequence
  RNA Oligomer
uccuacagauagucaaaccauaa

SEQ ID NO: 55218 - RNA, 23 nt, Artificial Sequence
  RNA Oligomer
ucauacaugacucagcauaccug

SEQ ID NO: 55219 - RNA, 23 nt, Artificial Sequence
  RNA Oligomer
aucauacaugacucagcauaccu

SEQ ID NO: 55220 - RNA, 23 nt, Artificial Sequence
  RNA Oligomer
caucauacaugacucagcauacc

SEQ ID NO: 55221 - RNA, 23 nt, Artificial Sequence
  RNA Oligomer
ucaucauacaugacucagcauac

SEQ ID NO: 55222 - RNA, 23 nt, Artificial Sequence
  RNA Oligomer
gucaucauacaugacucagcaua

SEQ ID NO: 55223 - RNA, 23 nt, Artificial Sequence
  RNA Oligomer
ugacuccuugugguuuaugucau

SEQ ID NO: 55224 - RNA, 23 nt, Artificial Sequence
  RNA Oligomer
gcuccuugacuccuugugguuua

SEQ ID NO: 55225 - RNA, 23 nt, Artificial Sequence
  RNA Oligomer
caccauaaaagagcuggaaucga

SEQ ID NO: 55226 - RNA, 23 nt, Artificial Sequence
  RNA Oligomer
ccaccauaaaagagcuggaaucg

SEQ ID NO: 55227 - RNA, 23 nt, Artificial Sequence
  RNA Oligomer
cccaccauaaaagagcuggaauc

SEQ ID NO: 55228 - RNA, 23 nt, Artificial Sequence
  RNA Oligomer
ucccaccauaaaagagcuggaau

SEQ ID NO: 55229 - RNA, 23 nt, Artificial Sequence
  RNA Oligomer
aucccaccauaaaagagcuggaa

SEQ ID NO: 55230 - RNA, 23 nt, Artificial Sequence
  RNA Oligomer
guacacugaaauucauccugaga

SEQ ID NO: 55231 - RNA, 23 nt, Artificial Sequence
  RNA Oligomer
aguacacugaaauucauccugag

SEQ ID NO: 55232 - RNA, 23 nt, Artificial Sequence
  RNA Oligomer
aaguacacugaaauucauccuga

SEQ ID NO: 55233 - RNA, 23 nt, Artificial Sequence
  RNA Oligomer
cagcaacaacccuguuucaguau

SEQ ID NO: 55234 - RNA, 23 nt, Artificial Sequence
  RNA Oligomer
gcagcaacaacccuguuucagua

SEQ ID NO: 55235 - RNA, 23 nt, Artificial Sequence
  RNA Oligomer
gaagacuaucagccacuaaugaa

SEQ ID NO: 55236 - RNA, 23 nt, Artificial Sequence
  RNA Oligomer
acugccaaaguguaugggaugcu

SEQ ID NO: 55237 - RNA, 23 nt, Artificial Sequence
  RNA Oligomer
gacugccaaaguguaugggaugc

SEQ ID NO: 55238 - RNA, 23 nt, Artificial Sequence
  RNA Oligomer
agacugccaaaguguaugggaug

SEQ ID NO: 55239 - RNA, 23 nt, Artificial Sequence
  RNA Oligomer
uagacugccaaaguguaugggau

SEQ ID NO: 55240 - RNA, 23 nt, Artificial Sequence
  RNA Oligomer
auauugguaacauccuuucuauu

SEQ ID NO: 55241 - RNA, 23 nt, Artificial Sequence
  RNA Oligomer
uauauugguaacauccuuucuau

SEQ ID NO: 55242 - RNA, 23 nt, Artificial Sequence
  RNA Oligomer
ccuccacaauaaggucaaugcca

SEQ ID NO: 55243 - RNA, 23 nt, Artificial Sequence
  RNA Oligomer
uccuccacaauaaggucaaugcc

SEQ ID NO: 55244 - RNA, 23 nt, Artificial Sequence
  RNA Oligomer
guccuccacaauaaggucaaugc

SEQ ID NO: 55245 - RNA, 23 nt, Artificial Sequence
  RNA Oligomer
gguccuccacaauaaggucaaug

SEQ ID NO: 55246 - RNA, 23 nt, Artificial Sequence
  RNA Oligomer
ggguccuccacaauaaggucaau

SEQ ID NO: 55247 - RNA, 23 nt, Artificial Sequence
  RNA Oligomer
uccugcaagaauaucuacagacc

SEQ ID NO: 55248 - RNA, 23 nt, Artificial Sequence
  RNA Oligomer
auauucaauuuuccugcaagaau

SEQ ID NO: 55249 - RNA, 23 nt, Artificial Sequence
  RNA Oligomer
caggaucccaccauaaaagagcu

SEQ ID NO: 55250 - RNA, 23 nt, Artificial Sequence
  RNA Oligomer
ucaguauccugguccugauccuc

SEQ ID NO: 55251 - RNA, 23 nt, Artificial Sequence
  RNA Oligomer
gucaguauccugguccugauccu

SEQ ID NO: 55252 - RNA, 23 nt, Artificial Sequence
  RNA Oligomer
cgucaguauccugguccugaucc

SEQ ID NO: 55253 - RNA, 23 nt, Artificial Sequence
  RNA Oligomer
gcgucaguauccugguccugauc

SEQ ID NO: 55254 - RNA, 23 nt, Artificial Sequence
  RNA Oligomer
ggcgucaguauccugguccugau

SEQ ID NO: 55255 - RNA, 23 nt, Artificial Sequence
  RNA Oligomer
ccaaaugaaugaccuuguugcau

SEQ ID NO: 55256 - RNA, 23 nt, Artificial Sequence
  RNA Oligomer
uccaaaugaaugaccuuguugca

SEQ ID NO: 55257 - RNA, 23 nt, Artificial Sequence
  RNA Oligomer
uuccaaaugaaugaccuuguugc

SEQ ID NO: 55258 - RNA, 23 nt, Artificial Sequence
  RNA Oligomer
uuuccaaaugaaugaccuuguug

SEQ ID NO: 55259 - RNA, 23 nt, Artificial Sequence
  RNA Oligomer
auuuccaaaugaaugaccuuguu

SEQ ID NO: 55260 - RNA, 23 nt, Artificial Sequence
  RNA Oligomer
cuccacaauaaggucaaugccag

SEQ ID NO: 55261 - RNA, 23 nt, Artificial Sequence
  RNA Oligomer
aggguccuccacaauaaggucaa

SEQ ID NO: 55262 - RNA, 23 nt, Artificial Sequence
  RNA Oligomer
ggaauauucaauuuuccugcaag

SEQ ID NO: 55263 - RNA, 23 nt, Artificial Sequence
  RNA Oligomer
aggaauauucaauuuuccugcaa

SEQ ID NO: 55264 - RNA, 23 nt, Artificial Sequence
  RNA Oligomer
aaggaauauucaauuuuccugca

SEQ ID NO: 55265 - RNA, 23 nt, Artificial Sequence
  RNA Oligomer
aaaggaauauucaauuuuccugc

SEQ ID NO: 55266 - RNA, 23 nt, Artificial Sequence
  RNA Oligomer
aaaaggaauauucaauuuuccug

SEQ ID NO: 55267 - RNA, 23 nt, Artificial Sequence
  RNA Oligomer
cgaugcgucaaguacacugaaau

SEQ ID NO: 55268 - RNA, 23 nt, Artificial Sequence
  RNA Oligomer
ugcagcaacaacccuguuucagu

SEQ ID NO: 55269 - RNA, 23 nt, Artificial Sequence
  RNA Oligomer
cugcagcaacaacccuguuucag

SEQ ID NO: 55270 - RNA, 23 nt, Artificial Sequence
  RNA Oligomer
acugcagcaacaacccuguuuca

SEQ ID NO: 55271 - RNA, 23 nt, Artificial Sequence
  RNA Oligomer
gacugcagcaacaacccuguuuc

SEQ ID NO: 55272 - RNA, 23 nt, Artificial Sequence
  RNA Oligomer
ggacugcagcaacaacccuguuu

SEQ ID NO: 55273 - RNA, 23 nt, Artificial Sequence
  RNA Oligomer
gcaacaagauucuucuuuggagc

SEQ ID NO: 55274 - RNA, 23 nt, Artificial Sequence
  RNA Oligomer
ugcaacaagauucuucuuuggag

SEQ ID NO: 55275 - RNA, 23 nt, Artificial Sequence
  RNA Oligomer
uugcaacaagauucuucuuugga

SEQ ID NO: 55276 - RNA, 23 nt, Artificial Sequence
  RNA Oligomer
cuugcaacaagauucuucuuugg

SEQ ID NO: 55277 - RNA, 23 nt, Artificial Sequence
  RNA Oligomer
ccuugcaacaagauucuucuuug

SEQ ID NO: 55278 - RNA, 23 nt, Artificial Sequence
  RNA Oligomer
aagacuaucagccacuaaugaag

SEQ ID NO: 55279 - RNA, 23 nt, Artificial Sequence
  RNA Oligomer
acugaagaagacuaucagccacu

SEQ ID NO: 55280 - RNA, 23 nt, Artificial Sequence
  RNA Oligomer
uacugaagaagacuaucagccac

SEQ ID NO: 55281 - RNA, 23 nt, Artificial Sequence
  RNA Oligomer
uguacccuuccuacagauaguca

SEQ ID NO: 55282 - RNA, 23 nt, Artificial Sequence
  RNA Oligomer
uuguacccuuccuacagauaguc

SEQ ID NO: 55283 - RNA, 23 nt, Artificial Sequence
  RNA Oligomer
ugugaaaaauccugaggauucau

SEQ ID NO: 55284 - RNA, 23 nt, Artificial Sequence
  RNA Oligomer
gugugaaaaauccugaggauuca

SEQ ID NO: 55285 - RNA, 23 nt, Artificial Sequence
  RNA Oligomer
ugugugaaaaauccugaggauuc

SEQ ID NO: 55286 - RNA, 23 nt, Artificial Sequence
  RNA Oligomer
uuuugggaguguggaaguccaua

SEQ ID NO: 55287 - RNA, 23 nt, Artificial Sequence
  RNA Oligomer
gcccaucaguucacacaggucca

SEQ ID NO: 55288 - RNA, 23 nt, Artificial Sequence
  RNA Oligomer
ggcccaucaguucacacaggucc

SEQ ID NO: 55289 - RNA, 23 nt, Artificial Sequence
  RNA Oligomer
gagcagaauaaaagaucuggccc

SEQ ID NO: 55290 - RNA, 23 nt, Artificial Sequence
  RNA Oligomer
ggagcagaauaaaagaucuggcc

SEQ ID NO: 55291 - RNA, 23 nt, Artificial Sequence
  RNA Oligomer
gagagcccaacucugucuuggcg

SEQ ID NO: 55292 - RNA, 23 nt, Artificial Sequence
  RNA Oligomer
ggagagcccaacucugucuuggc

SEQ ID NO: 55293 - RNA, 23 nt, Artificial Sequence
  RNA Oligomer
aggagagcccaacucugucuugg

SEQ ID NO: 55294 - RNA, 23 nt, Artificial Sequence
  RNA Oligomer
uaggagagcccaacucugucuug

SEQ ID NO: 55295 - RNA, 23 nt, Artificial Sequence
  RNA Oligomer
cuaggagagcccaacucugucuu

SEQ ID NO: 55296 - RNA, 23 nt, Artificial Sequence
  RNA Oligomer
ucuauugaaaaaucaccacacca

SEQ ID NO: 55297 - RNA, 23 nt, Artificial Sequence
  RNA Oligomer
uucuauugaaaaaucaccacacc

SEQ ID NO: 55298 - RNA, 23 nt, Artificial Sequence
  RNA Oligomer
uuucuauugaaaaaucaccacac

SEQ ID NO: 55299 - RNA, 23 nt, Artificial Sequence
  RNA Oligomer
cuuucuauugaaaaaucaccaca

SEQ ID NO: 55300 - RNA, 23 nt, Artificial Sequence
  RNA Oligomer
cagagacggaagccuuuuucccc

SEQ ID NO: 55301 - RNA, 23 nt, Artificial Sequence
  RNA Oligomer
ccagagacggaagccuuuuuccc

SEQ ID NO: 55302 - RNA, 23 nt, Artificial Sequence
  RNA Oligomer
gccagagacggaagccuuuuucc

SEQ ID NO: 55303 - RNA, 23 nt, Artificial Sequence
  RNA Oligomer
ugccagagacggaagccuuuuuc

SEQ ID NO: 55304 - RNA, 23 nt, Artificial Sequence
  RNA Oligomer
augccagagacggaagccuuuuu

SEQ ID NO: 55305 - RNA, 23 nt, Artificial Sequence
  RNA Oligomer
aaugccagagacggaagccuuuu

SEQ ID NO: 55306 - RNA, 23 nt, Artificial Sequence
  RNA Oligomer
uuccugcaagaauaucuacagac

SEQ ID NO: 55307 - RNA, 23 nt, Artificial Sequence
  RNA Oligomer
uuuccugcaagaauaucuacaga

SEQ ID NO: 55308 - RNA, 23 nt, Artificial Sequence
  RNA Oligomer
gaucccaccauaaaagagcugga

SEQ ID NO: 55309 - RNA, 23 nt, Artificial Sequence
  RNA Oligomer
gauuccagagacuuaugccagga

SEQ ID NO: 55310 - RNA, 23 nt, Artificial Sequence
  RNA Oligomer
gcgaugcgucaaguacacugaaa

SEQ ID NO: 55311 - RNA, 23 nt, Artificial Sequence
  RNA Oligomer
uccuugcaacauuacugaagaag

SEQ ID NO: 55312 - RNA, 23 nt, Artificial Sequence
  RNA Oligomer
auccuugcaacauuacugaagaa

SEQ ID NO: 55313 - RNA, 23 nt, Artificial Sequence
  RNA Oligomer
ucaaaccauaaacuucaugguca

SEQ ID NO: 55314 - RNA, 23 nt, Artificial Sequence
  RNA Oligomer
uuccuacagauagucaaaccaua

SEQ ID NO: 55315 - RNA, 23 nt, Artificial Sequence
  RNA Oligomer
cuuccuacagauagucaaaccau

SEQ ID NO: 55316 - RNA, 23 nt, Artificial Sequence
  RNA Oligomer
uuuguacccuuccuacagauagu

SEQ ID NO: 55317 - RNA, 23 nt, Artificial Sequence
  RNA Oligomer
uuuuguacccuuccuacagauag

SEQ ID NO: 55318 - RNA, 23 nt, Artificial Sequence
  RNA Oligomer
uuuuuguacccuuccuacagaua

SEQ ID NO: 55319 - RNA, 23 nt, Artificial Sequence
  RNA Oligomer
auuuuuguacccuuccuacagau

SEQ ID NO: 55320 - RNA, 23 nt, Artificial Sequence
  RNA Oligomer
gaggguccuccacaauaagguca

SEQ ID NO: 55321 - RNA, 23 nt, Artificial Sequence
  RNA Oligomer
gguuuaugucaucauacaugacu

SEQ ID NO: 55322 - RNA, 23 nt, Artificial Sequence
  RNA Oligomer
ugagccagucgcugugguuguuu

SEQ ID NO: 55323 - RNA, 23 nt, Artificial Sequence
  RNA Oligomer
uuuuccugcaagaauaucuacag

SEQ ID NO: 55324 - RNA, 23 nt, Artificial Sequence
  RNA Oligomer
ugaaauucauccugagaugagac

SEQ ID NO: 55325 - RNA, 23 nt, Artificial Sequence
  RNA Oligomer
aauggaucccgcaguaaaaucuu

SEQ ID NO: 55326 - RNA, 23 nt, Artificial Sequence
  RNA Oligomer
cgcgaugcgucaaguacacugaa

SEQ ID NO: 55327 - RNA, 23 nt, Artificial Sequence
  RNA Oligomer
gcgcgaugcgucaaguacacuga

SEQ ID NO: 55328 - RNA, 23 nt, Artificial Sequence
  RNA Oligomer
ggcgcgaugcgucaaguacacug

SEQ ID NO: 55329 - RNA, 23 nt, Artificial Sequence
  RNA Oligomer
caacccuguuucaguauucugga

SEQ ID NO: 55330 - RNA, 23 nt, Artificial Sequence
  RNA Oligomer
agacuaucagccacuaaugaagu

SEQ ID NO: 55331 - RNA, 23 nt, Artificial Sequence
  RNA Oligomer
uuucagaaagcauuacauuucca

SEQ ID NO: 55332 - RNA, 23 nt, Artificial Sequence
  RNA Oligomer
uuuucagaaagcauuacauuucc

SEQ ID NO: 55333 - RNA, 23 nt, Artificial Sequence
  RNA Oligomer
uuuuucagaaagcauuacauuuc

SEQ ID NO: 55334 - RNA, 23 nt, Artificial Sequence
  RNA Oligomer
agagacggaagccuuuuucccca

SEQ ID NO: 55335 - RNA, 23 nt, Artificial Sequence
  RNA Oligomer
acaauaaggucaaugccagagac

SEQ ID NO: 55336 - RNA, 23 nt, Artificial Sequence
  RNA Oligomer
cacaauaaggucaaugccagaga

SEQ ID NO: 55337 - RNA, 23 nt, Artificial Sequence
  RNA Oligomer
ccacaauaaggucaaugccagag

SEQ ID NO: 55338 - RNA, 23 nt, Artificial Sequence
  RNA Oligomer
uccacaauaaggucaaugccaga

SEQ ID NO: 55339 - RNA, 23 nt, Artificial Sequence
  RNA Oligomer
acaugacucagcauaccugcugg

SEQ ID NO: 55340 - RNA, 23 nt, Artificial Sequence
  RNA Oligomer
uacaugacucagcauaccugcug

SEQ ID NO: 55341 - RNA, 23 nt, Artificial Sequence
  RNA Oligomer
auacaugacucagcauaccugcu

SEQ ID NO: 55342 - RNA, 23 nt, Artificial Sequence
  RNA Oligomer
cauacaugacucagcauaccugc

SEQ ID NO: 55343 - RNA, 23 nt, Artificial Sequence
  RNA Oligomer
ucgcugugguuguuuuagcuccu

SEQ ID NO: 55344 - RNA, 23 nt, Artificial Sequence
  RNA Oligomer
gucgcugugguuguuuuagcucc

SEQ ID NO: 55345 - RNA, 23 nt, Artificial Sequence
  RNA Oligomer
agucgcugugguuguuuuagcuc

SEQ ID NO: 55346 - RNA, 23 nt, Artificial Sequence
  RNA Oligomer
gugaaaaauccugaggauucauc

SEQ ID NO: 55347 - RNA, 23 nt, Artificial Sequence
  RNA Oligomer
aggacugcagcaacaacccuguu

SEQ ID NO: 55348 - RNA, 23 nt, Artificial Sequence
  RNA Oligomer
guguggugaauucaacacuucca

SEQ ID NO: 55349 - RNA, 23 nt, Artificial Sequence
  RNA Oligomer
gguguggugaauucaacacuucc

SEQ ID NO: 55350 - RNA, 23 nt, Artificial Sequence
  RNA Oligomer
ugguguggugaauucaacacuuc

SEQ ID NO: 55351 - RNA, 23 nt, Artificial Sequence
  RNA Oligomer
augguguggugaauucaacacuu

SEQ ID NO: 55352 - RNA, 23 nt, Artificial Sequence
  RNA Oligomer
caacaagauucuucuuuggagca

SEQ ID NO: 55353 - RNA, 23 nt, Artificial Sequence
  RNA Oligomer
gggaacucagaccguaccuugca

SEQ ID NO: 55354 - RNA, 23 nt, Artificial Sequence
  RNA Oligomer
ugggaacucagaccguaccuugc

SEQ ID NO: 55355 - RNA, 23 nt, Artificial Sequence
  RNA Oligomer
uugggaacucagaccguaccuug

SEQ ID NO: 55356 - RNA, 23 nt, Artificial Sequence
  RNA Oligomer
guugggaacucagaccguaccuu

SEQ ID NO: 55357 - RNA, 23 nt, Artificial Sequence
  RNA Oligomer
gggaugcuuucaagggugcauuu

SEQ ID NO: 55358 - RNA, 23 nt, Artificial Sequence
  RNA Oligomer
aaccucucuuauuagaacaggca

SEQ ID NO: 55359 - RNA, 23 nt, Artificial Sequence
  RNA Oligomer
aaaccucucuuauuagaacaggc

SEQ ID NO: 55360 - RNA, 23 nt, Artificial Sequence
  RNA Oligomer
caaaccucucuuauuagaacagg

SEQ ID NO: 55361 - RNA, 23 nt, Artificial Sequence
  RNA Oligomer
gucaaugccagagacggaagccu

SEQ ID NO: 55362 - RNA, 23 nt, Artificial Sequence
  RNA Oligomer
ggucaaugccagagacggaagcc

SEQ ID NO: 55363 - RNA, 23 nt, Artificial Sequence
  RNA Oligomer
aggucaaugccagagacggaagc

SEQ ID NO: 55364 - RNA, 23 nt, Artificial Sequence
  RNA Oligomer
aaggucaaugccagagacggaag

SEQ ID NO: 55365 - RNA, 23 nt, Artificial Sequence
  RNA Oligomer
uaaggucaaugccagagacggaa

SEQ ID NO: 55366 - RNA, 23 nt, Artificial Sequence
  RNA Oligomer
ugacucagcauaccugcuggugc

SEQ ID NO: 55367 - RNA, 23 nt, Artificial Sequence
  RNA Oligomer
augacucagcauaccugcuggug

SEQ ID NO: 55368 - RNA, 23 nt, Artificial Sequence
  RNA Oligomer
caugacucagcauaccugcuggu

SEQ ID NO: 55369 - RNA, 23 nt, Artificial Sequence
  RNA Oligomer
ggaucccaccauaaaagagcugg

SEQ ID NO: 55370 - RNA, 23 nt, Artificial Sequence
  RNA Oligomer
aggaucccaccauaaaagagcug

SEQ ID NO: 55371 - RNA, 23 nt, Artificial Sequence
  RNA Oligomer
ugcaaccagagaagguucagaca

SEQ ID NO: 55372 - RNA, 23 nt, Artificial Sequence
  RNA Oligomer
uugcaaccagagaagguucagac

SEQ ID NO: 55373 - RNA, 23 nt, Artificial Sequence
  RNA Oligomer
uuugcaaccagagaagguucaga

SEQ ID NO: 55374 - RNA, 23 nt, Artificial Sequence
  RNA Oligomer
auuugcaaccagagaagguucag

SEQ ID NO: 55375 - RNA, 23 nt, Artificial Sequence
  RNA Oligomer
aauuugcaaccagagaagguuca

SEQ ID NO: 55376 - RNA, 23 nt, Artificial Sequence
  RNA Oligomer
cagcacuuuugggaguguggaag

SEQ ID NO: 55377 - RNA, 23 nt, Artificial Sequence
  RNA Oligomer
acagcacuuuugggaguguggaa

SEQ ID NO: 55378 - RNA, 23 nt, Artificial Sequence
  RNA Oligomer
aacagcacuuuugggagugugga

SEQ ID NO: 55379 - RNA, 23 nt, Artificial Sequence
  RNA Oligomer
aaacagcacuuuugggagugugg

SEQ ID NO: 55380 - RNA, 23 nt, Artificial Sequence
  RNA Oligomer
aaaacagcacuuuugggagugug

SEQ ID NO: 55381 - RNA, 23 nt, Artificial Sequence
  RNA Oligomer
guauccugguccugauccucguc

SEQ ID NO: 55382 - RNA, 23 nt, Artificial Sequence
  RNA Oligomer
aguauccugguccugauccucgu

SEQ ID NO: 55383 - RNA, 23 nt, Artificial Sequence
  RNA Oligomer
caguauccugguccugauccucg

SEQ ID NO: 55384 - RNA, 23 nt, Artificial Sequence
  RNA Oligomer
ccuugcugaugaccucacauggu

SEQ ID NO: 55385 - RNA, 23 nt, Artificial Sequence
  RNA Oligomer
accuugcugaugaccucacaugg

SEQ ID NO: 55386 - RNA, 23 nt, Artificial Sequence
  RNA Oligomer
uaccuugcugaugaccucacaug

SEQ ID NO: 55387 - RNA, 23 nt, Artificial Sequence
  RNA Oligomer
cuaggcuaccuugcugaugaccu

SEQ ID NO: 55388 - RNA, 23 nt, Artificial Sequence
  RNA Oligomer
gcuaggcuaccuugcugaugacc

SEQ ID NO: 55389 - RNA, 23 nt, Artificial Sequence
  RNA Oligomer
ugcuaggcuaccuugcugaugac

SEQ ID NO: 55390 - RNA, 23 nt, Artificial Sequence
  RNA Oligomer
ugaaaaauccugaggauucaucu

SEQ ID NO: 55391 - RNA, 23 nt, Artificial Sequence
  RNA Oligomer
cuuaugccaggaucccaccauaa

SEQ ID NO: 55392 - RNA, 23 nt, Artificial Sequence
  RNA Oligomer
gcaaccagagaagguucagacac

SEQ ID NO: 55393 - RNA, 23 nt, Artificial Sequence
  RNA Oligomer
caugguguggugaauucaacacu

SEQ ID NO: 55394 - RNA, 23 nt, Artificial Sequence
  RNA Oligomer
acaugguguggugaauucaacac

SEQ ID NO: 55395 - RNA, 23 nt, Artificial Sequence
  RNA Oligomer
cuucuuuggagcagaauaaaaga

SEQ ID NO: 55396 - RNA, 23 nt, Artificial Sequence
  RNA Oligomer
ucuucuuuggagcagaauaaaag

SEQ ID NO: 55397 - RNA, 23 nt, Artificial Sequence
  RNA Oligomer
uucuucuuuggagcagaauaaaa

SEQ ID NO: 55398 - RNA, 23 nt, Artificial Sequence
  RNA Oligomer
auucuucuuuggagcagaauaaa

SEQ ID NO: 55399 - RNA, 23 nt, Artificial Sequence
  RNA Oligomer
gauucuucuuuggagcagaauaa

SEQ ID NO: 55400 - RNA, 23 nt, Artificial Sequence
  RNA Oligomer
cauccuugcaacauuacugaaga

SEQ ID NO: 55401 - RNA, 23 nt, Artificial Sequence
  RNA Oligomer
auuuuggaggguccuccacaaua

SEQ ID NO: 55402 - RNA, 23 nt, Artificial Sequence
  RNA Oligomer
cuugcacaucugagaucugagcc

SEQ ID NO: 55403 - RNA, 23 nt, Artificial Sequence
  RNA Oligomer
ucuugcacaucugagaucugagc

SEQ ID NO: 55404 - RNA, 23 nt, Artificial Sequence
  RNA Oligomer
auuuuccugcaagaauaucuaca

SEQ ID NO: 55405 - RNA, 23 nt, Artificial Sequence
  RNA Oligomer
acuuaugccaggaucccaccaua

SEQ ID NO: 55406 - RNA, 23 nt, Artificial Sequence
  RNA Oligomer
ccaugugaugcucaauggauccc

SEQ ID NO: 55407 - RNA, 23 nt, Artificial Sequence
  RNA Oligomer
uccaugugaugcucaauggaucc

SEQ ID NO: 55408 - RNA, 23 nt, Artificial Sequence
  RNA Oligomer
guccaugugaugcucaauggauc

SEQ ID NO: 55409 - RNA, 23 nt, Artificial Sequence
  RNA Oligomer
cccuguuucaguauucuggaaaa

SEQ ID NO: 55410 - RNA, 23 nt, Artificial Sequence
  RNA Oligomer
acccuguuucaguauucuggaaa

SEQ ID NO: 55411 - RNA, 23 nt, Artificial Sequence
  RNA Oligomer
aacccuguuucaguauucuggaa

SEQ ID NO: 55412 - RNA, 23 nt, Artificial Sequence
  RNA Oligomer
cuaucaaucuugcccagacugga

SEQ ID NO: 55413 - RNA, 23 nt, Artificial Sequence
  RNA Oligomer
acuaucaaucuugcccagacugg

SEQ ID NO: 55414 - RNA, 23 nt, Artificial Sequence
  RNA Oligomer
aacuaucaaucuugcccagacug

SEQ ID NO: 55415 - RNA, 23 nt, Artificial Sequence
  RNA Oligomer
aaacuaucaaucuugcccagacu

SEQ ID NO: 55416 - RNA, 23 nt, Artificial Sequence
  RNA Oligomer
uaaacuaucaaucuugcccagac

SEQ ID NO: 55417 - RNA, 23 nt, Artificial Sequence
  RNA Oligomer
cucacaugguguggugaauucaa

SEQ ID NO: 55418 - RNA, 23 nt, Artificial Sequence
  RNA Oligomer
ccucacaugguguggugaauuca

SEQ ID NO: 55419 - RNA, 23 nt, Artificial Sequence
  RNA Oligomer
accucacaugguguggugaauuc

SEQ ID NO: 55420 - RNA, 23 nt, Artificial Sequence
  RNA Oligomer
gaccucacaugguguggugaauu

SEQ ID NO: 55421 - RNA, 23 nt, Artificial Sequence
  RNA Oligomer
ugaccucacaugguguggugaau

SEQ ID NO: 55422 - RNA, 23 nt, Artificial Sequence
  RNA Oligomer
accuugcaacaagauucuucuuu

SEQ ID NO: 55423 - RNA, 23 nt, Artificial Sequence
  RNA Oligomer
guaccuugcaacaagauucuucu

SEQ ID NO: 55424 - RNA, 23 nt, Artificial Sequence
  RNA Oligomer
cguaccuugcaacaagauucuuc

SEQ ID NO: 55425 - RNA, 23 nt, Artificial Sequence
  RNA Oligomer
ccguaccuugcaacaagauucuu

SEQ ID NO: 55426 - RNA, 23 nt, Artificial Sequence
  RNA Oligomer
accguaccuugcaacaagauucu

SEQ ID NO: 55427 - RNA, 23 nt, Artificial Sequence
  RNA Oligomer
gaccguaccuugcaacaagauuc

SEQ ID NO: 55428 - RNA, 23 nt, Artificial Sequence
  RNA Oligomer
acauccuugcaacauuacugaag

SEQ ID NO: 55429 - RNA, 23 nt, Artificial Sequence
  RNA Oligomer
aacauccuugcaacauuacugaa

SEQ ID NO: 55430 - RNA, 23 nt, Artificial Sequence
  RNA Oligomer
aaaaacagcacuuuugggagugu

SEQ ID NO: 55431 - RNA, 23 nt, Artificial Sequence
  RNA Oligomer
gacaaaaacagcacuuuugggag

SEQ ID NO: 55432 - RNA, 23 nt, Artificial Sequence
  RNA Oligomer
uuucaguauucuggaaaacgguu

SEQ ID NO: 55433 - RNA, 23 nt, Artificial Sequence
  RNA Oligomer
guuucaguauucuggaaaacggu

SEQ ID NO: 55434 - RNA, 23 nt, Artificial Sequence
  RNA Oligomer
uguuucaguauucuggaaaacgg

SEQ ID NO: 55435 - RNA, 23 nt, Artificial Sequence
  RNA Oligomer
cuguuucaguauucuggaaaacg

SEQ ID NO: 55436 - RNA, 23 nt, Artificial Sequence
  RNA Oligomer
ccuguuucaguauucuggaaaac

SEQ ID NO: 55437 - RNA, 23 nt, Artificial Sequence
  RNA Oligomer
cacaugguguggugaauucaaca

SEQ ID NO: 55438 - RNA, 23 nt, Artificial Sequence
  RNA Oligomer
ucacaugguguggugaauucaac

SEQ ID NO: 55439 - RNA, 23 nt, Artificial Sequence
  RNA Oligomer
cauuuccaaaugaaugaccuugu

SEQ ID NO: 55440 - RNA, 23 nt, Artificial Sequence
  RNA Oligomer
ugaucuaucaauagucaagaaaa

SEQ ID NO: 55441 - RNA, 23 nt, Artificial Sequence
  RNA Oligomer
gugaucuaucaauagucaagaaa

SEQ ID NO: 55442 - RNA, 23 nt, Artificial Sequence
  RNA Oligomer
ugugaucuaucaauagucaagaa

SEQ ID NO: 55443 - RNA, 23 nt, Artificial Sequence
  RNA Oligomer
uugugaucuaucaauagucaaga

SEQ ID NO: 55444 - RNA, 23 nt, Artificial Sequence
  RNA Oligomer
auugugaucuaucaauagucaag

SEQ ID NO: 55445 - RNA, 23 nt, Artificial Sequence
  RNA Oligomer
caguuucagaacccagccagccu

SEQ ID NO: 55446 - RNA, 23 nt, Artificial Sequence
  RNA Oligomer
gcaguuucagaacccagccagcc

SEQ ID NO: 55447 - RNA, 23 nt, Artificial Sequence
  RNA Oligomer
ugcaguuucagaacccagccagc

SEQ ID NO: 55448 - RNA, 23 nt, Artificial Sequence
  RNA Oligomer
gugcaguuucagaacccagccag

SEQ ID NO: 55449 - RNA, 23 nt, Artificial Sequence
  RNA Oligomer
ggugcaguuucagaacccagcca

SEQ ID NO: 55450 - RNA, 23 nt, Artificial Sequence
  RNA Oligomer
cuuuugggaguguggaaguccau

SEQ ID NO: 55451 - RNA, 23 nt, Artificial Sequence
  RNA Oligomer
cacuuuugggaguguggaagucc

SEQ ID NO: 55452 - RNA, 23 nt, Artificial Sequence
  RNA Oligomer
gcacuuuugggaguguggaaguc

SEQ ID NO: 55453 - RNA, 23 nt, Artificial Sequence
  RNA Oligomer
agcacuuuugggaguguggaagu

SEQ ID NO: 55454 - RNA, 23 nt, Artificial Sequence
  RNA Oligomer
agaaaggacugcagcaacaaccc

SEQ ID NO: 55455 - RNA, 23 nt, Artificial Sequence
  RNA Oligomer
gagaaaggacugcagcaacaacc

SEQ ID NO: 55456 - RNA, 23 nt, Artificial Sequence
  RNA Oligomer
augaccucacaugguguggugaa

SEQ ID NO: 55457 - RNA, 23 nt, Artificial Sequence
  RNA Oligomer
cugcuaggcuaccuugcugauga

SEQ ID NO: 55458 - RNA, 23 nt, Artificial Sequence
  RNA Oligomer
gcugcuaggcuaccuugcugaug

SEQ ID NO: 55459 - RNA, 23 nt, Artificial Sequence
  RNA Oligomer
cgcugcuaggcuaccuugcugau

SEQ ID NO: 55460 - RNA, 23 nt, Artificial Sequence
  RNA Oligomer
uaaacuucauggucauggguaaa

SEQ ID NO: 55461 - RNA, 23 nt, Artificial Sequence
  RNA Oligomer
auaaacuucauggucauggguaa

SEQ ID NO: 55462 - RNA, 23 nt, Artificial Sequence
  RNA Oligomer
uauugugaucuaucaauagucaa

SEQ ID NO: 55463 - RNA, 23 nt, Artificial Sequence
  RNA Oligomer
aggugcaguuucagaacccagcc

SEQ ID NO: 55464 - RNA, 23 nt, Artificial Sequence
  RNA Oligomer
gaggugcaguuucagaacccagc

SEQ ID NO: 55465 - RNA, 23 nt, Artificial Sequence
  RNA Oligomer
gaaaggacugcagcaacaacccu

SEQ ID NO: 55466 - RNA, 23 nt, Artificial Sequence
  RNA Oligomer
gaugaccucacauggugugguga

SEQ ID NO: 55467 - RNA, 23 nt, Artificial Sequence
  RNA Oligomer
ugaugaccucacaugguguggug

SEQ ID NO: 55468 - RNA, 23 nt, Artificial Sequence
  RNA Oligomer
cugaugaccucacaugguguggu

SEQ ID NO: 55469 - RNA, 23 nt, Artificial Sequence
  RNA Oligomer
gcugaugaccucacauggugugg

SEQ ID NO: 55470 - RNA, 23 nt, Artificial Sequence
  RNA Oligomer
ugcugaugaccucacauggugug

SEQ ID NO: 55471 - RNA, 23 nt, Artificial Sequence
  RNA Oligomer
uugcugaugaccucacauggugu

SEQ ID NO: 55472 - RNA, 23 nt, Artificial Sequence
  RNA Oligomer
cuugcugaugaccucacauggug

SEQ ID NO: 55473 - RNA, 23 nt, Artificial Sequence
  RNA Oligomer
uuauugugaucuaucaauaguca

SEQ ID NO: 55474 - RNA, 23 nt, Artificial Sequence
  RNA Oligomer
uaccuugcaacaagauucuucuu

SEQ ID NO: 55475 - RNA, 23 nt, Artificial Sequence
  RNA Oligomer
ucuucagugugugaaaaauccug

SEQ ID NO: 55476 - RNA, 23 nt, Artificial Sequence
  RNA Oligomer
uucuucagugugugaaaaauccu

SEQ ID NO: 55477 - RNA, 23 nt, Artificial Sequence
  RNA Oligomer
uuucuucagugugugaaaaaucc

SEQ ID NO: 55478 - RNA, 23 nt, Artificial Sequence
  RNA Oligomer
guuucuucagugugugaaaaauc

SEQ ID NO: 55479 - RNA, 23 nt, Artificial Sequence
  RNA Oligomer
aguuucuucagugugugaaaaau

SEQ ID NO: 55480 - RNA, 23 nt, Artificial Sequence
  RNA Oligomer
gaaaaauccugaggauucaucuu

SEQ ID NO: 55481 - RNA, 23 nt, Artificial Sequence
  RNA Oligomer
aaguuucuucagugugugaaaaa

SEQ ID NO: 55482 - RNA, 23 nt, Artificial Sequence
  RNA Oligomer
ugcagaagcugccugugaugugg

SEQ ID NO: 55483 - RNA, 23 nt, Artificial Sequence
  RNA Oligomer
uugcagaagcugccugugaugug

SEQ ID NO: 55484 - RNA, 23 nt, Artificial Sequence
  RNA Oligomer
uuugcagaagcugccugugaugu

SEQ ID NO: 55485 - RNA, 23 nt, Artificial Sequence
  RNA Oligomer
guuugcagaagcugccugugaug

SEQ ID NO: 55486 - RNA, 23 nt, Artificial Sequence
  RNA Oligomer
gguuugcagaagcugccugugau

SEQ ID NO: 55487 - RNA, 23 nt, Artificial Sequence
  RNA Oligomer
ugguggaagagaagauuccagag

SEQ ID NO: 55488 - RNA, 23 nt, Artificial Sequence
  RNA Oligomer
augguggaagagaagauuccaga

SEQ ID NO: 55489 - RNA, 23 nt, Artificial Sequence
  RNA Oligomer
agcugccugugaugugguccaug

SEQ ID NO: 55490 - RNA, 23 nt, Artificial Sequence
  RNA Oligomer
aagcugccugugaugugguccau

SEQ ID NO: 55491 - RNA, 23 nt, Artificial Sequence
  RNA Oligomer
guuacuucacuuuaauucucaug

SEQ ID NO: 55492 - RNA, 23 nt, Artificial Sequence
  RNA Oligomer
gaauauucaauuuuccugcaaga

SEQ ID NO: 55493 - RNA, 23 nt, Artificial Sequence
  RNA Oligomer
gcaagaauaucuacagaccugac

SEQ ID NO: 55494 - RNA, 23 nt, Artificial Sequence
  RNA Oligomer
agaauaucuacagaccugacaag

SEQ ID NO: 55495 - RNA, 23 nt, Artificial Sequence
  RNA Oligomer
caagaauaucuacagaccugaca

SEQ ID NO: 55496 - RNA, 23 nt, Artificial Sequence
  RNA Oligomer
cacuagaggccugggugauacau

SEQ ID NO: 55497 - RNA, 23 nt, Artificial Sequence
  RNA Oligomer
cuuauaucaucagcauaccuuua

SEQ ID NO: 55498 - RNA, 23 nt, Artificial Sequence
  RNA Oligomer
gcauuuauuucaaaacauccuug

SEQ ID NO: 55499 - RNA, 23 nt, Artificial Sequence
  RNA Oligomer
gaagaagacuaucagccacuaau

SEQ ID NO: 55500 - RNA, 23 nt, Artificial Sequence
  RNA Oligomer
ugaagaagacuaucagccacuaa

SEQ ID NO: 55501 - RNA, 23 nt, Artificial Sequence
  RNA Oligomer
guuuuagcuccuugacuccuugu

SEQ ID NO: 55502 - RNA, 23 nt, Artificial Sequence
  RNA Oligomer
ggaaaacgguuucccgcagguuu

SEQ ID NO: 55503 - RNA, 23 nt, Artificial Sequence
  RNA Oligomer
ugaugugguccaugugaugcuca

SEQ ID NO: 55504 - RNA, 23 nt, Artificial Sequence
  RNA Oligomer
cuaggagagcccaacucugucuu

SEQ ID NO: 55505 - RNA, 23 nt, Artificial Sequence
  RNA Oligomer
gcgaugcgucaaguacacugaaa

SEQ ID NO: 55506 - RNA, 23 nt, Artificial Sequence
  RNA Oligomer
guacacugaaauucauccugaga

SEQ ID NO: 55507 - RNA, 23 nt, Artificial Sequence
  RNA Oligomer
caacucugucuuggcgucaguau

SEQ ID NO: 55508 - RNA, 23 nt, Artificial Sequence
  RNA Oligomer
uggaaaacgguuucccgcagguu

SEQ ID NO: 55509 - RNA, 23 nt, Artificial Sequence
  RNA Oligomer
cccuguuucaguauucuggaaaa

SEQ ID NO: 55510 - RNA, 23 nt, Artificial Sequence
  RNA Oligomer
uacacugaaauucauccugagau

SEQ ID NO: 55511 - RNA, 23 nt, Artificial Sequence
  RNA Oligomer
gggaugcuuucaagggugcauuu

SEQ ID NO: 55512 - RNA, 23 nt, Artificial Sequence
  RNA Oligomer
ccaacucugucuuggcgucagua

SEQ ID NO: 55513 - RNA, 23 nt, Artificial Sequence
  RNA Oligomer
ggguccuccacaauaaggucaau

SEQ ID NO: 55514 - RNA, 23 nt, Artificial Sequence
  RNA Oligomer
agcaacaacccuguuucaguauu

SEQ ID NO: 55515 - RNA, 23 nt, Artificial Sequence
  RNA Oligomer
acagauagucaaaccauaaacuu

SEQ ID NO: 55516 - RNA, 23 nt, Artificial Sequence
  RNA Oligomer
ccuacagauagucaaaccauaaa

SEQ ID NO: 55517 - RNA, 23 nt, Artificial Sequence
  RNA Oligomer
ggaauauucaauuuuccugcaag

SEQ ID NO: 55518 - RNA, 23 nt, Artificial Sequence
  RNA Oligomer
gaaauucauccugagaugagaca

SEQ ID NO: 55519 - RNA, 23 nt, Artificial Sequence
  RNA Oligomer
ccacaauaaggucaaugccagag

SEQ ID NO: 55520 - RNA, 23 nt, Artificial Sequence
  RNA Oligomer
aggaauauucaauuuuccugcaa

SEQ ID NO: 55521 - RNA, 23 nt, Artificial Sequence
  RNA Oligomer
gaugagacauguagacugccaaa

SEQ ID NO: 55522 - RNA, 23 nt, Artificial Sequence
  RNA Oligomer
ugcaacaagauucuucuuuggag

SEQ ID NO: 55523 - RNA, 23 nt, Artificial Sequence
  RNA Oligomer
gaagacuaucagccacuaaugaa

SEQ ID NO: 55524 - RNA, 23 nt, Artificial Sequence
  RNA Oligomer
cuacagauagucaaaccauaaac

SEQ ID NO: 55525 - RNA, 23 nt, Artificial Sequence
  RNA Oligomer
gguccuccacaauaaggucaaug

SEQ ID NO: 55526 - RNA, 23 nt, Artificial Sequence
  RNA Oligomer
gucaucauacaugacucagcaua

SEQ ID NO: 55527 - RNA, 23 nt, Artificial Sequence
  RNA Oligomer
cgcgaugcgucaaguacacugaa

SEQ ID NO: 55528 - RNA, 23 nt, Artificial Sequence
  RNA Oligomer
agaagacuaucagccacuaauga

SEQ ID NO: 55529 - RNA, 23 nt, Artificial Sequence
  RNA Oligomer
ccauaaacuucauggucaugggu

SEQ ID NO: 55530 - RNA, 23 nt, Artificial Sequence
  RNA Oligomer
caaaccauaaacuucauggucau

SEQ ID NO: 55531 - RNA, 23 nt, Artificial Sequence
  RNA Oligomer
gcuccuugacuccuugugguuua

SEQ ID NO: 55532 - RNA, 23 nt, Artificial Sequence
  RNA Oligomer
caacaacccuguuucaguauucu

SEQ ID NO: 55533 - RNA, 23 nt, Artificial Sequence
  RNA Oligomer
cgaugcgucaaguacacugaaau

SEQ ID NO: 55534 - RNA, 23 nt, Artificial Sequence
  RNA Oligomer
cuuccuacagauagucaaaccau

SEQ ID NO: 55535 - RNA, 23 nt, Artificial Sequence
  RNA Oligomer
guacccuuccuacagauagucaa

SEQ ID NO: 55536 - RNA, 23 nt, Artificial Sequence
  RNA Oligomer
cauccuuucuauugaaaaaucac

SEQ ID NO: 55537 - RNA, 23 nt, Artificial Sequence
  RNA Oligomer
ucauacaugacucagcauaccug

SEQ ID NO: 55538 - RNA, 23 nt, Artificial Sequence
  RNA Oligomer
ugucaucauacaugacucagcau

SEQ ID NO: 55539 - RNA, 23 nt, Artificial Sequence
  RNA Oligomer
cugcaagaauaucuacagaccug

SEQ ID NO: 55540 - RNA, 23 nt, Artificial Sequence
  RNA Oligomer
caccauaaaagagcuggaaucga

SEQ ID NO: 55541 - RNA, 23 nt, Artificial Sequence
  RNA Oligomer
uucuucuuuggagcagaauaaaa

SEQ ID NO: 55542 - RNA, 23 nt, Artificial Sequence
  RNA Oligomer
ccguaccuugcaacaagauucuu

SEQ ID NO: 55543 - RNA, 23 nt, Artificial Sequence
  RNA Oligomer
uuuuuguacccuuccuacagaua

SEQ ID NO: 55544 - RNA, 23 nt, Artificial Sequence
  RNA Oligomer
gugaucuaucaauagucaagaaa

SEQ ID NO: 55545 - RNA, 23 nt, Artificial Sequence
  RNA Oligomer
ugugaucuaucaauagucaagaa

SEQ ID NO: 55546 - RNA, 23 nt, Artificial Sequence
  RNA Oligomer
caaugccagagacggaagccuuu

SEQ ID NO: 55547 - RNA, 23 nt, Artificial Sequence
  RNA Oligomer
ccugcaagaauaucuacagaccu

SEQ ID NO: 55548 - RNA, 23 nt, Artificial Sequence
  RNA Oligomer
ggacugcagcaacaacccuguuu

SEQ ID NO: 55549 - RNA, 23 nt, Artificial Sequence
  RNA Oligomer
cagauagucaaaccauaaacuuc

SEQ ID NO: 55550 - RNA, 23 nt, Artificial Sequence
  RNA Oligomer
gguuuaugucaucauacaugacu

SEQ ID NO: 55551 - RNA, 23 nt, Artificial Sequence
  RNA Oligomer
agacuuaugccaggaucccacca

SEQ ID NO: 55552 - RNA, 23 nt, Artificial Sequence
  RNA Oligomer
agguuugcagaagcugccuguga

SEQ ID NO: 55553 - RNA, 23 nt, Artificial Sequence
  RNA Oligomer
guguggugaauucaacacuucca

SEQ ID NO: 55554 - RNA, 23 nt, Artificial Sequence
  RNA Oligomer
ugguguggugaauucaacacuuc

SEQ ID NO: 55555 - RNA, 23 nt, Artificial Sequence
  RNA Oligomer
uccuacagauagucaaaccauaa

SEQ ID NO: 55556 - RNA, 23 nt, Artificial Sequence
  RNA Oligomer
ccaaaugaaugaccuuguugcau

SEQ ID NO: 55557 - RNA, 23 nt, Artificial Sequence
  RNA Oligomer
ugguuuaugucaucauacaugac

SEQ ID NO: 55558 - RNA, 23 nt, Artificial Sequence
  RNA Oligomer
ugagccagucgcugugguuguuu

SEQ ID NO: 55559 - RNA, 23 nt, Artificial Sequence
  RNA Oligomer
cccaccauaaaagagcuggaauc

SEQ ID NO: 55560 - RNA, 23 nt, Artificial Sequence
  RNA Oligomer
ucccaccauaaaagagcuggaau

SEQ ID NO: 55561 - RNA, 23 nt, Artificial Sequence
  RNA Oligomer
gguuugcagaagcugccugugau

SEQ ID NO: 55562 - RNA, 23 nt, Artificial Sequence
  RNA Oligomer
gcagcaacaacccuguuucagua

SEQ ID NO: 55563 - RNA, 23 nt, Artificial Sequence
  RNA Oligomer
guggugaauucaacacuuccaaa

SEQ ID NO: 55564 - RNA, 23 nt, Artificial Sequence
  RNA Oligomer
cucacaugguguggugaauucaa

SEQ ID NO: 55565 - RNA, 23 nt, Artificial Sequence
  RNA Oligomer
ugaaguugggaacucagaccgua

SEQ ID NO: 55566 - RNA, 23 nt, Artificial Sequence
  RNA Oligomer
cugaagaagacuaucagccacua

SEQ ID NO: 55567 - RNA, 23 nt, Artificial Sequence
  RNA Oligomer
ugugguuuaugucaucauacaug

SEQ ID NO: 55568 - RNA, 23 nt, Artificial Sequence
  RNA Oligomer
ugugugaaaaauccugaggauuc

SEQ ID NO: 55569 - RNA, 23 nt, Artificial Sequence
  RNA Oligomer
gcaacaacccuguuucaguauuc

SEQ ID NO: 55570 - RNA, 23 nt, Artificial Sequence
  RNA Oligomer
cagcaacaacccuguuucaguau

SEQ ID NO: 55571 - RNA, 23 nt, Artificial Sequence
  RNA Oligomer
agaucuggcccaucaguucacac

SEQ ID NO: 55572 - RNA, 23 nt, Artificial Sequence
  RNA Oligomer
caacaagauucuucuuuggagca

SEQ ID NO: 55573 - RNA, 23 nt, Artificial Sequence
  RNA Oligomer
ucaaaccauaaacuucaugguca

SEQ ID NO: 55574 - RNA, 23 nt, Artificial Sequence
  RNA Oligomer
ccuuccuacagauagucaaacca

SEQ ID NO: 55575 - RNA, 23 nt, Artificial Sequence
  RNA Oligomer
ccuccacaauaaggucaaugcca

SEQ ID NO: 55576 - RNA, 23 nt, Artificial Sequence
  RNA Oligomer
gaagauuuuggaggguccuccac

SEQ ID NO: 55577 - RNA, 23 nt, Artificial Sequence
  RNA Oligomer
ugacuccuugugguuuaugucau

SEQ ID NO: 55578 - RNA, 23 nt, Artificial Sequence
  RNA Oligomer
aggaucccaccauaaaagagcug

SEQ ID NO: 55579 - RNA, 23 nt, Artificial Sequence
  RNA Oligomer
uuaugccaggaucccaccauaaa

SEQ ID NO: 55580 - RNA, 23 nt, Artificial Sequence
  RNA Oligomer
cuuaugccaggaucccaccauaa

SEQ ID NO: 55581 - RNA, 23 nt, Artificial Sequence
  RNA Oligomer
gacuuaugccaggaucccaccau

SEQ ID NO: 55582 - RNA, 23 nt, Artificial Sequence
  RNA Oligomer
ccaaaauaaacuaucaaucuugc

SEQ ID NO: 55583 - RNA, 23 nt, Artificial Sequence
  RNA Oligomer
acaugguguggugaauucaacac

SEQ ID NO: 55584 - RNA, 23 nt, Artificial Sequence
  RNA Oligomer
accucacaugguguggugaauuc

SEQ ID NO: 55585 - RNA, 23 nt, Artificial Sequence
  RNA Oligomer
ugaccucacaugguguggugaau

SEQ ID NO: 55586 - RNA, 23 nt, Artificial Sequence
  RNA Oligomer
aaaccauaaacuucauggucaug

SEQ ID NO: 55587 - RNA, 23 nt, Artificial Sequence
  RNA Oligomer
uuccuacagauagucaaaccaua

SEQ ID NO: 55588 - RNA, 23 nt, Artificial Sequence
  RNA Oligomer
acccuuccuacagauagucaaac

SEQ ID NO: 55589 - RNA, 23 nt, Artificial Sequence
  RNA Oligomer
ccuuucuauugaaaaaucaccac

SEQ ID NO: 55590 - RNA, 23 nt, Artificial Sequence
  RNA Oligomer
acacuagaggccugggugauaca

SEQ ID NO: 55591 - RNA, 23 nt, Artificial Sequence
  RNA Oligomer
gauguuuugaaauaaaugcaccc

SEQ ID NO: 55592 - RNA, 23 nt, Artificial Sequence
  RNA Oligomer
auguuuugaaauaaaugcacccu

SEQ ID NO: 55593 - RNA, 23 nt, Artificial Sequence
  RNA Oligomer
uguuuugaaauaaaugcacccuu

SEQ ID NO: 55594 - RNA, 23 nt, Artificial Sequence
  RNA Oligomer
guuuugaaauaaaugcacccuug

SEQ ID NO: 55595 - RNA, 23 nt, Artificial Sequence
  RNA Oligomer
uuuugaaauaaaugcacccuuga

SEQ ID NO: 55596 - RNA, 23 nt, Artificial Sequence
  RNA Oligomer
aaggguacaaaaauacaucaugc

SEQ ID NO: 55597 - RNA, 23 nt, Artificial Sequence
  RNA Oligomer
aggguacaaaaauacaucaugca

SEQ ID NO: 55598 - RNA, 23 nt, Artificial Sequence
  RNA Oligomer
ggguacaaaaauacaucaugcaa

SEQ ID NO: 55599 - RNA, 23 nt, Artificial Sequence
  RNA Oligomer
gguacaaaaauacaucaugcaac

SEQ ID NO: 55600 - RNA, 23 nt, Artificial Sequence
  RNA Oligomer
guacaaaaauacaucaugcaaca

SEQ ID NO: 55601 - RNA, 23 nt, Artificial Sequence
  RNA Oligomer
augcuuucugaaaaacuugagca

SEQ ID NO: 55602 - RNA, 23 nt, Artificial Sequence
  RNA Oligomer
ugcuuucugaaaaacuugagcau

SEQ ID NO: 55603 - RNA, 23 nt, Artificial Sequence
  RNA Oligomer
gcuuucugaaaaacuugagcauu

SEQ ID NO: 55604 - RNA, 23 nt, Artificial Sequence
  RNA Oligomer
cuuucugaaaaacuugagcauuc

SEQ ID NO: 55605 - RNA, 23 nt, Artificial Sequence
  RNA Oligomer
uuucugaaaaacuugagcauuca

SEQ ID NO: 55606 - RNA, 23 nt, Artificial Sequence
  RNA Oligomer
gaagaaacuugucaggucuguag

SEQ ID NO: 55607 - RNA, 23 nt, Artificial Sequence
  RNA Oligomer
aagaaacuugucaggucuguaga

SEQ ID NO: 55608 - RNA, 23 nt, Artificial Sequence
  RNA Oligomer
agaaacuugucaggucuguagau

SEQ ID NO: 55609 - RNA, 23 nt, Artificial Sequence
  RNA Oligomer
gaaacuugucaggucuguagaua

SEQ ID NO: 55610 - RNA, 23 nt, Artificial Sequence
  RNA Oligomer
aaacuugucaggucuguagauau

SEQ ID NO: 55611 - RNA, 23 nt, Artificial Sequence
  RNA Oligomer
uccuuuugcuuauaaucgauucc

SEQ ID NO: 55612 - RNA, 23 nt, Artificial Sequence
  RNA Oligomer
ccuuuugcuuauaaucgauucca

SEQ ID NO: 55613 - RNA, 23 nt, Artificial Sequence
  RNA Oligomer
cuuuugcuuauaaucgauuccag

SEQ ID NO: 55614 - RNA, 23 nt, Artificial Sequence
  RNA Oligomer
uuuugcuuauaaucgauuccagc

SEQ ID NO: 55615 - RNA, 23 nt, Artificial Sequence
  RNA Oligomer
uuugcuuauaaucgauuccagcu

SEQ ID NO: 55616 - RNA, 23 nt, Artificial Sequence
  RNA Oligomer
cugguugcaaauuauggacuucc

SEQ ID NO: 55617 - RNA, 23 nt, Artificial Sequence
  RNA Oligomer
ugguugcaaauuauggacuucca

SEQ ID NO: 55618 - RNA, 23 nt, Artificial Sequence
  RNA Oligomer
gguugcaaauuauggacuuccac

SEQ ID NO: 55619 - RNA, 23 nt, Artificial Sequence
  RNA Oligomer
guugcaaauuauggacuuccaca

SEQ ID NO: 55620 - RNA, 23 nt, Artificial Sequence
  RNA Oligomer
uugcaaauuauggacuuccacac

SEQ ID NO: 55621 - RNA, 23 nt, Artificial Sequence
  RNA Oligomer
guuuuugucaaagauuuuacugc

SEQ ID NO: 55622 - RNA, 23 nt, Artificial Sequence
  RNA Oligomer
uuuuugucaaagauuuuacugcg

SEQ ID NO: 55623 - RNA, 23 nt, Artificial Sequence
  RNA Oligomer
uuuugucaaagauuuuacugcgg

SEQ ID NO: 55624 - RNA, 23 nt, Artificial Sequence
  RNA Oligomer
uuugucaaagauuuuacugcggg

SEQ ID NO: 55625 - RNA, 23 nt, Artificial Sequence
  RNA Oligomer
uugucaaagauuuuacugcggga

SEQ ID NO: 55626 - RNA, 23 nt, Artificial Sequence
  RNA Oligomer
uuugaaauaaaugcacccuugaa

SEQ ID NO: 55627 - RNA, 23 nt, Artificial Sequence
  RNA Oligomer
aaugcuuucugaaaaacuugagc

SEQ ID NO: 55628 - RNA, 23 nt, Artificial Sequence
  RNA Oligomer
uaacauaaaaggaucacaugaga

SEQ ID NO: 55629 - RNA, 23 nt, Artificial Sequence
  RNA Oligomer
aacauaaaaggaucacaugagaa

SEQ ID NO: 55630 - RNA, 23 nt, Artificial Sequence
  RNA Oligomer
acauaaaaggaucacaugagaau

SEQ ID NO: 55631 - RNA, 23 nt, Artificial Sequence
  RNA Oligomer
cauaaaaggaucacaugagaauu

SEQ ID NO: 55632 - RNA, 23 nt, Artificial Sequence
  RNA Oligomer
auaaaaggaucacaugagaauua

SEQ ID NO: 55633 - RNA, 23 nt, Artificial Sequence
  RNA Oligomer
uaggaaggguacaaaaauacauc

SEQ ID NO: 55634 - RNA, 23 nt, Artificial Sequence
  RNA Oligomer
aggaaggguacaaaaauacauca

SEQ ID NO: 55635 - RNA, 23 nt, Artificial Sequence
  RNA Oligomer
ggaaggguacaaaaauacaucau

SEQ ID NO: 55636 - RNA, 23 nt, Artificial Sequence
  RNA Oligomer
gaaggguacaaaaauacaucaug

SEQ ID NO: 55637 - RNA, 23 nt, Artificial Sequence
  RNA Oligomer
aauauuccuuuugcuuauaaucg

SEQ ID NO: 55638 - RNA, 23 nt, Artificial Sequence
  RNA Oligomer
auauuccuuuugcuuauaaucga

SEQ ID NO: 55639 - RNA, 23 nt, Artificial Sequence
  RNA Oligomer
uauuccuuuugcuuauaaucgau

SEQ ID NO: 55640 - RNA, 23 nt, Artificial Sequence
  RNA Oligomer
auuccuuuugcuuauaaucgauu

SEQ ID NO: 55641 - RNA, 23 nt, Artificial Sequence
  RNA Oligomer
uuccuuuugcuuauaaucgauuc

SEQ ID NO: 55642 - RNA, 23 nt, Artificial Sequence
  RNA Oligomer
uugcuuauaaucgauuccagcuc

SEQ ID NO: 55643 - RNA, 23 nt, Artificial Sequence
  RNA Oligomer
ugcuuauaaucgauuccagcucu

SEQ ID NO: 55644 - RNA, 23 nt, Artificial Sequence
  RNA Oligomer
gcuuauaaucgauuccagcucuu

SEQ ID NO: 55645 - RNA, 23 nt, Artificial Sequence
  RNA Oligomer
cuuauaaucgauuccagcucuuu

SEQ ID NO: 55646 - RNA, 23 nt, Artificial Sequence
  RNA Oligomer
uuauaaucgauuccagcucuuuu

SEQ ID NO: 55647 - RNA, 23 nt, Artificial Sequence
  RNA Oligomer
cuguaggaaggguacaaaaauac

SEQ ID NO: 55648 - RNA, 23 nt, Artificial Sequence
  RNA Oligomer
uguaggaaggguacaaaaauaca

SEQ ID NO: 55649 - RNA, 23 nt, Artificial Sequence
  RNA Oligomer
guaggaaggguacaaaaauacau

SEQ ID NO: 55650 - RNA, 23 nt, Artificial Sequence
  RNA Oligomer
auaacauaaaaggaucacaugag

SEQ ID NO: 55651 - RNA, 23 nt, Artificial Sequence
  RNA Oligomer
uauaaucgauuccagcucuuuua

SEQ ID NO: 55652 - RNA, 23 nt, Artificial Sequence
  RNA Oligomer
caaaaauacaucaugcaacaagg

SEQ ID NO: 55653 - RNA, 23 nt, Artificial Sequence
  RNA Oligomer
aaaaauacaucaugcaacaaggu

SEQ ID NO: 55654 - RNA, 23 nt, Artificial Sequence
  RNA Oligomer
aaaauacaucaugcaacaagguc

SEQ ID NO: 55655 - RNA, 23 nt, Artificial Sequence
  RNA Oligomer
aaauacaucaugcaacaagguca

SEQ ID NO: 55656 - RNA, 23 nt, Artificial Sequence
  RNA Oligomer
aauacaucaugcaacaaggucau

SEQ ID NO: 55657 - RNA, 23 nt, Artificial Sequence
  RNA Oligomer
uucugaaaaacuugagcauucac

SEQ ID NO: 55658 - RNA, 23 nt, Artificial Sequence
  RNA Oligomer
uaaaaggaucacaugagaauuaa

SEQ ID NO: 55659 - RNA, 23 nt, Artificial Sequence
  RNA Oligomer
aaaaggaucacaugagaauuaaa

SEQ ID NO: 55660 - RNA, 23 nt, Artificial Sequence
  RNA Oligomer
aaaggaucacaugagaauuaaag

SEQ ID NO: 55661 - RNA, 23 nt, Artificial Sequence
  RNA Oligomer
aaggaucacaugagaauuaaagu

SEQ ID NO: 55662 - RNA, 23 nt, Artificial Sequence
  RNA Oligomer
aggaucacaugagaauuaaagug

SEQ ID NO: 55663 - RNA, 23 nt, Artificial Sequence
  RNA Oligomer
ggaucacaugagaauuaaaguga

SEQ ID NO: 55664 - RNA, 23 nt, Artificial Sequence
  RNA Oligomer
gaucacaugagaauuaaagugaa

SEQ ID NO: 55665 - RNA, 23 nt, Artificial Sequence
  RNA Oligomer
aucacaugagaauuaaagugaag

SEQ ID NO: 55666 - RNA, 23 nt, Artificial Sequence
  RNA Oligomer
ucacaugagaauuaaagugaagu

SEQ ID NO: 55667 - RNA, 23 nt, Artificial Sequence
  RNA Oligomer
cugaagaaacuugucaggucugu

SEQ ID NO: 55668 - RNA, 23 nt, Artificial Sequence
  RNA Oligomer
ugaagaaacuugucaggucugua

SEQ ID NO: 55669 - RNA, 23 nt, Artificial Sequence
  RNA Oligomer
ugucaaagauuuuacugcgggau

SEQ ID NO: 55670 - RNA, 23 nt, Artificial Sequence
  RNA Oligomer
gucaaagauuuuacugcgggauc

SEQ ID NO: 55671 - RNA, 23 nt, Artificial Sequence
  RNA Oligomer
ucaaagauuuuacugcgggaucc

SEQ ID NO: 55672 - RNA, 23 nt, Artificial Sequence
  RNA Oligomer
gaccaugaaguuuaugguuugac

SEQ ID NO: 55673 - RNA, 23 nt, Artificial Sequence
  RNA Oligomer
accaugaaguuuaugguuugacu

SEQ ID NO: 55674 - RNA, 23 nt, Artificial Sequence
  RNA Oligomer
ccaugaaguuuaugguuugacua

SEQ ID NO: 55675 - RNA, 23 nt, Artificial Sequence
  RNA Oligomer
caugaaguuuaugguuugacuau

SEQ ID NO: 55676 - RNA, 23 nt, Artificial Sequence
  RNA Oligomer
augaaguuuaugguuugacuauc

SEQ ID NO: 55677 - RNA, 23 nt, Artificial Sequence
  RNA Oligomer
uaaugcuuucugaaaaacuugag

SEQ ID NO: 55678 - RNA, 23 nt, Artificial Sequence
  RNA Oligomer
cuaauaagagagguuuggugugg

SEQ ID NO: 55679 - RNA, 23 nt, Artificial Sequence
  RNA Oligomer
uaauaagagagguuugguguggu

SEQ ID NO: 55680 - RNA, 23 nt, Artificial Sequence
  RNA Oligomer
aauaagagagguuugguguggug

SEQ ID NO: 55681 - RNA, 23 nt, Artificial Sequence
  RNA Oligomer
auaagagagguuuggugugguga

SEQ ID NO: 55682 - RNA, 23 nt, Artificial Sequence
  RNA Oligomer
uaagagagguuugguguggugau

SEQ ID NO: 55683 - RNA, 23 nt, Artificial Sequence
  RNA Oligomer
uuucacacacugaagaaacuugu

SEQ ID NO: 55684 - RNA, 23 nt, Artificial Sequence
  RNA Oligomer
uucacacacugaagaaacuuguc

SEQ ID NO: 55685 - RNA, 23 nt, Artificial Sequence
  RNA Oligomer
ucacacacugaagaaacuuguca

SEQ ID NO: 55686 - RNA, 23 nt, Artificial Sequence
  RNA Oligomer
cacacacugaagaaacuugucag

SEQ ID NO: 55687 - RNA, 23 nt, Artificial Sequence
  RNA Oligomer
acacacugaagaaacuugucagg

SEQ ID NO: 55688 - RNA, 23 nt, Artificial Sequence
  RNA Oligomer
cacacugaagaaacuugucaggu

SEQ ID NO: 55689 - RNA, 23 nt, Artificial Sequence
  RNA Oligomer
acacugaagaaacuugucagguc

SEQ ID NO: 55690 - RNA, 23 nt, Artificial Sequence
  RNA Oligomer
cacugaagaaacuugucaggucu

SEQ ID NO: 55691 - RNA, 23 nt, Artificial Sequence
  RNA Oligomer
acugaagaaacuugucaggucug

SEQ ID NO: 55692 - RNA, 23 nt, Artificial Sequence
  RNA Oligomer
uggaaucuucucuuccaccaugu

SEQ ID NO: 55693 - RNA, 23 nt, Artificial Sequence
  RNA Oligomer
ggaaucuucucuuccaccaugua

SEQ ID NO: 55694 - RNA, 23 nt, Artificial Sequence
  RNA Oligomer
gaaucuucucuuccaccauguau

SEQ ID NO: 55695 - RNA, 23 nt, Artificial Sequence
  RNA Oligomer
aaucuucucuuccaccauguauc

SEQ ID NO: 55696 - RNA, 23 nt, Artificial Sequence
  RNA Oligomer
aucuucucuuccaccauguauca

SEQ ID NO: 55697 - RNA, 23 nt, Artificial Sequence
  RNA Oligomer
acaaaaauacaucaugcaacaag

SEQ ID NO: 55698 - RNA, 23 nt, Artificial Sequence
  RNA Oligomer
gagcauucacuuuucuucacuug

SEQ ID NO: 55699 - RNA, 23 nt, Artificial Sequence
  RNA Oligomer
agcauucacuuuucuucacuugc

SEQ ID NO: 55700 - RNA, 23 nt, Artificial Sequence
  RNA Oligomer
gcauucacuuuucuucacuugcc

SEQ ID NO: 55701 - RNA, 23 nt, Artificial Sequence
  RNA Oligomer
cauucacuuuucuucacuugccu

SEQ ID NO: 55702 - RNA, 23 nt, Artificial Sequence
  RNA Oligomer
auucacuuuucuucacuugccug

SEQ ID NO: 55703 - RNA, 23 nt, Artificial Sequence
  RNA Oligomer
cacuuuucuucacuugccuguuc

SEQ ID NO: 55704 - RNA, 23 nt, Artificial Sequence
  RNA Oligomer
acuuuucuucacuugccuguucu

SEQ ID NO: 55705 - RNA, 23 nt, Artificial Sequence
  RNA Oligomer
cuuuucuucacuugccuguucua

SEQ ID NO: 55706 - RNA, 23 nt, Artificial Sequence
  RNA Oligomer
uuuucuucacuugccuguucuaa

SEQ ID NO: 55707 - RNA, 23 nt, Artificial Sequence
  RNA Oligomer
uuucuucacuugccuguucuaau

SEQ ID NO: 55708 - RNA, 23 nt, Artificial Sequence
  RNA Oligomer
cuguucuaauaagagagguuugg

SEQ ID NO: 55709 - RNA, 23 nt, Artificial Sequence
  RNA Oligomer
uguucuaauaagagagguuuggu

SEQ ID NO: 55710 - RNA, 23 nt, Artificial Sequence
  RNA Oligomer
guucuaauaagagagguuuggug

SEQ ID NO: 55711 - RNA, 23 nt, Artificial Sequence
  RNA Oligomer
uucuaauaagagagguuuggugu

SEQ ID NO: 55712 - RNA, 23 nt, Artificial Sequence
  RNA Oligomer
ucuaauaagagagguuuggugug

SEQ ID NO: 55713 - RNA, 23 nt, Artificial Sequence
  RNA Oligomer
auaaguuauuuuaagacuuuggg

SEQ ID NO: 55714 - RNA, 23 nt, Artificial Sequence
  RNA Oligomer
uaaguuauuuuaagacuuugggg

SEQ ID NO: 55715 - RNA, 23 nt, Artificial Sequence
  RNA Oligomer
aaguuauuuuaagacuuugggga

SEQ ID NO: 55716 - RNA, 23 nt, Artificial Sequence
  RNA Oligomer
aguuauuuuaagacuuuggggaa

SEQ ID NO: 55717 - RNA, 23 nt, Artificial Sequence
  RNA Oligomer
guuauuuuaagacuuuggggaaa

SEQ ID NO: 55718 - RNA, 23 nt, Artificial Sequence
  RNA Oligomer
cauaagucucuggaaucuucucu

SEQ ID NO: 55719 - RNA, 23 nt, Artificial Sequence
  RNA Oligomer
auaagucucuggaaucuucucuu

SEQ ID NO: 55720 - RNA, 23 nt, Artificial Sequence
  RNA Oligomer
uaagucucuggaaucuucucuuc

SEQ ID NO: 55721 - RNA, 23 nt, Artificial Sequence
  RNA Oligomer
aagucucuggaaucuucucuucc

SEQ ID NO: 55722 - RNA, 23 nt, Artificial Sequence
  RNA Oligomer
agucucuggaaucuucucuucca

SEQ ID NO: 55723 - RNA, 23 nt, Artificial Sequence
  RNA Oligomer
uuuauuuuggaaguguugaauuc

SEQ ID NO: 55724 - RNA, 23 nt, Artificial Sequence
  RNA Oligomer
uuauuuuggaaguguugaauuca

SEQ ID NO: 55725 - RNA, 23 nt, Artificial Sequence
  RNA Oligomer
uauuuuggaaguguugaauucac

SEQ ID NO: 55726 - RNA, 23 nt, Artificial Sequence
  RNA Oligomer
auuuuggaaguguugaauucacc

SEQ ID NO: 55727 - RNA, 23 nt, Artificial Sequence
  RNA Oligomer
uuuuggaaguguugaauucacca

SEQ ID NO: 55728 - RNA, 23 nt, Artificial Sequence
  RNA Oligomer
uugaaauaaaugcacccuugaaa

SEQ ID NO: 55729 - RNA, 23 nt, Artificial Sequence
  RNA Oligomer
ucugaaaaacuugagcauucacu

SEQ ID NO: 55730 - RNA, 23 nt, Artificial Sequence
  RNA Oligomer
cugaaaaacuugagcauucacuu

SEQ ID NO: 55731 - RNA, 23 nt, Artificial Sequence
  RNA Oligomer
ugaaaaacuugagcauucacuuu

SEQ ID NO: 55732 - RNA, 23 nt, Artificial Sequence
  RNA Oligomer
gaaaaacuugagcauucacuuuu

SEQ ID NO: 55733 - RNA, 23 nt, Artificial Sequence
  RNA Oligomer
aaaaacuugagcauucacuuuuc

SEQ ID NO: 55734 - RNA, 23 nt, Artificial Sequence
  RNA Oligomer
uucacuuuucuucacuugccugu

SEQ ID NO: 55735 - RNA, 23 nt, Artificial Sequence
  RNA Oligomer
ucacuuuucuucacuugccuguu

SEQ ID NO: 55736 - RNA, 23 nt, Artificial Sequence
  RNA Oligomer
uucuucacuugccuguucuaaua

SEQ ID NO: 55737 - RNA, 23 nt, Artificial Sequence
  RNA Oligomer
ucacaauaaagguaugcugauga

SEQ ID NO: 55738 - RNA, 23 nt, Artificial Sequence
  RNA Oligomer
cacaauaaagguaugcugaugau

SEQ ID NO: 55739 - RNA, 23 nt, Artificial Sequence
  RNA Oligomer
acaauaaagguaugcugaugaua

SEQ ID NO: 55740 - RNA, 23 nt, Artificial Sequence
  RNA Oligomer
caauaaagguaugcugaugauau

SEQ ID NO: 55741 - RNA, 23 nt, Artificial Sequence
  RNA Oligomer
aauaaagguaugcugaugauaua

SEQ ID NO: 55742 - RNA, 23 nt, Artificial Sequence
  RNA Oligomer
ggcagucuacaugucucaucuca

SEQ ID NO: 55743 - RNA, 23 nt, Artificial Sequence
  RNA Oligomer
gcagucuacaugucucaucucag

SEQ ID NO: 55744 - RNA, 23 nt, Artificial Sequence
  RNA Oligomer
cagucuacaugucucaucucagg

SEQ ID NO: 55745 - RNA, 23 nt, Artificial Sequence
  RNA Oligomer
agucuacaugucucaucucagga

SEQ ID NO: 55746 - RNA, 23 nt, Artificial Sequence
  RNA Oligomer
gucuacaugucucaucucaggau

SEQ ID NO: 55747 - RNA, 23 nt, Artificial Sequence
  RNA Oligomer
auguaugaugacauaaaccacaa

SEQ ID NO: 55748 - RNA, 23 nt, Artificial Sequence
  RNA Oligomer
uguaugaugacauaaaccacaag

SEQ ID NO: 55749 - RNA, 23 nt, Artificial Sequence
  RNA Oligomer
guaugaugacauaaaccacaagg

SEQ ID NO: 55750 - RNA, 23 nt, Artificial Sequence
  RNA Oligomer
uaugaugacauaaaccacaagga

SEQ ID NO: 55751 - RNA, 23 nt, Artificial Sequence
  RNA Oligomer
augaugacauaaaccacaaggag

SEQ ID NO: 55752 - RNA, 23 nt, Artificial Sequence
  RNA Oligomer
ucucagaugugcaagaugaaucc

SEQ ID NO: 55753 - RNA, 23 nt, Artificial Sequence
  RNA Oligomer
cucagaugugcaagaugaauccu

SEQ ID NO: 55754 - RNA, 23 nt, Artificial Sequence
  RNA Oligomer
ucagaugugcaagaugaauccuc

SEQ ID NO: 55755 - RNA, 23 nt, Artificial Sequence
  RNA Oligomer
cagaugugcaagaugaauccuca

SEQ ID NO: 55756 - RNA, 23 nt, Artificial Sequence
  RNA Oligomer
agaugugcaagaugaauccucag

SEQ ID NO: 55757 - RNA, 23 nt, Artificial Sequence
  RNA Oligomer
uuuucacacacugaagaaacuug

SEQ ID NO: 55758 - RNA, 23 nt, Artificial Sequence
  RNA Oligomer
ucuucucuuccaccauguaucac

SEQ ID NO: 55759 - RNA, 23 nt, Artificial Sequence
  RNA Oligomer
cuucucuuccaccauguaucacc

SEQ ID NO: 55760 - RNA, 23 nt, Artificial Sequence
  RNA Oligomer
uucucuuccaccauguaucaccc

SEQ ID NO: 55761 - RNA, 23 nt, Artificial Sequence
  RNA Oligomer
ucucuuccaccauguaucaccca

SEQ ID NO: 55762 - RNA, 23 nt, Artificial Sequence
  RNA Oligomer
cucuuccaccauguaucacccag

SEQ ID NO: 55763 - RNA, 23 nt, Artificial Sequence
  RNA Oligomer
ucuuccaccauguaucacccagg

SEQ ID NO: 55764 - RNA, 23 nt, Artificial Sequence
  RNA Oligomer
caggaugaauuucaguguacuug

SEQ ID NO: 55765 - RNA, 23 nt, Artificial Sequence
  RNA Oligomer
aggaugaauuucaguguacuuga

SEQ ID NO: 55766 - RNA, 23 nt, Artificial Sequence
  RNA Oligomer
ggaugaauuucaguguacuugac

SEQ ID NO: 55767 - RNA, 23 nt, Artificial Sequence
  RNA Oligomer
gaugaauuucaguguacuugacg

SEQ ID NO: 55768 - RNA, 23 nt, Artificial Sequence
  RNA Oligomer
augaauuucaguguacuugacgc

SEQ ID NO: 55769 - RNA, 23 nt, Artificial Sequence
  RNA Oligomer
uucucugguugcaaauuauggac

SEQ ID NO: 55770 - RNA, 23 nt, Artificial Sequence
  RNA Oligomer
ucucugguugcaaauuauggacu

SEQ ID NO: 55771 - RNA, 23 nt, Artificial Sequence
  RNA Oligomer
cucugguugcaaauuauggacuu

SEQ ID NO: 55772 - RNA, 23 nt, Artificial Sequence
  RNA Oligomer
ucugguugcaaauuauggacuuc

SEQ ID NO: 55773 - RNA, 23 nt, Artificial Sequence
  RNA Oligomer
cugaugggccagaucuuuuauuc

SEQ ID NO: 55774 - RNA, 23 nt, Artificial Sequence
  RNA Oligomer
ugaugggccagaucuuuuauucu

SEQ ID NO: 55775 - RNA, 23 nt, Artificial Sequence
  RNA Oligomer
gaugggccagaucuuuuauucug

SEQ ID NO: 55776 - RNA, 23 nt, Artificial Sequence
  RNA Oligomer
augggccagaucuuuuauucugc

SEQ ID NO: 55777 - RNA, 23 nt, Artificial Sequence
  RNA Oligomer
ugggccagaucuuuuauucugcu

SEQ ID NO: 55778 - RNA, 23 nt, Artificial Sequence
  RNA Oligomer
ugaaauaaaugcacccuugaaag

SEQ ID NO: 55779 - RNA, 23 nt, Artificial Sequence
  RNA Oligomer
uugaaagcaucccauacacuuug

SEQ ID NO: 55780 - RNA, 23 nt, Artificial Sequence
  RNA Oligomer
ugaaagcaucccauacacuuugg

SEQ ID NO: 55781 - RNA, 23 nt, Artificial Sequence
  RNA Oligomer
gaaagcaucccauacacuuuggc

SEQ ID NO: 55782 - RNA, 23 nt, Artificial Sequence
  RNA Oligomer
aaagcaucccauacacuuuggca

SEQ ID NO: 55783 - RNA, 23 nt, Artificial Sequence
  RNA Oligomer
aagcaucccauacacuuuggcag

SEQ ID NO: 55784 - RNA, 23 nt, Artificial Sequence
  RNA Oligomer
ucauucauuuggaaauguaaugc

SEQ ID NO: 55785 - RNA, 23 nt, Artificial Sequence
  RNA Oligomer
cauucauuuggaaauguaaugcu

SEQ ID NO: 55786 - RNA, 23 nt, Artificial Sequence
  RNA Oligomer
auucauuuggaaauguaaugcuu

SEQ ID NO: 55787 - RNA, 23 nt, Artificial Sequence
  RNA Oligomer
uucauuuggaaauguaaugcuuu

SEQ ID NO: 55788 - RNA, 23 nt, Artificial Sequence
  RNA Oligomer
ucauuuggaaauguaaugcuuuc

SEQ ID NO: 55789 - RNA, 23 nt, Artificial Sequence
  RNA Oligomer
aaaacuugagcauucacuuuucu

SEQ ID NO: 55790 - RNA, 23 nt, Artificial Sequence
  RNA Oligomer
aaacuugagcauucacuuuucuu

SEQ ID NO: 55791 - RNA, 23 nt, Artificial Sequence
  RNA Oligomer
aacuugagcauucacuuuucuuc

SEQ ID NO: 55792 - RNA, 23 nt, Artificial Sequence
  RNA Oligomer
acuugagcauucacuuuucuuca

SEQ ID NO: 55793 - RNA, 23 nt, Artificial Sequence
  RNA Oligomer
agguuugguguggugauuuuuca

SEQ ID NO: 55794 - RNA, 23 nt, Artificial Sequence
  RNA Oligomer
gguuugguguggugauuuuucaa

SEQ ID NO: 55795 - RNA, 23 nt, Artificial Sequence
  RNA Oligomer
guuugguguggugauuuuucaau

SEQ ID NO: 55796 - RNA, 23 nt, Artificial Sequence
  RNA Oligomer
uuugguguggugauuuuucaaua

SEQ ID NO: 55797 - RNA, 23 nt, Artificial Sequence
  RNA Oligomer
uugguguggugauuuuucaauag

SEQ ID NO: 55798 - RNA, 23 nt, Artificial Sequence
  RNA Oligomer
uuuuucaauagaaaggauguuac

SEQ ID NO: 55799 - RNA, 23 nt, Artificial Sequence
  RNA Oligomer
uuuucaauagaaaggauguuacc

SEQ ID NO: 55800 - RNA, 23 nt, Artificial Sequence
  RNA Oligomer
uuucaauagaaaggauguuacca

SEQ ID NO: 55801 - RNA, 23 nt, Artificial Sequence
  RNA Oligomer
uucaauagaaaggauguuaccaa

SEQ ID NO: 55802 - RNA, 23 nt, Artificial Sequence
  RNA Oligomer
ucaauagaaaggauguuaccaau

SEQ ID NO: 55803 - RNA, 23 nt, Artificial Sequence
  RNA Oligomer
auacacuuuggcagucuacaugu

SEQ ID NO: 55804 - RNA, 23 nt, Artificial Sequence
  RNA Oligomer
uacacuuuggcagucuacauguc

SEQ ID NO: 55805 - RNA, 23 nt, Artificial Sequence
  RNA Oligomer
acacuuuggcagucuacaugucu

SEQ ID NO: 55806 - RNA, 23 nt, Artificial Sequence
  RNA Oligomer
cacuuuggcagucuacaugucuc

SEQ ID NO: 55807 - RNA, 23 nt, Artificial Sequence
  RNA Oligomer
acuuuggcagucuacaugucuca

SEQ ID NO: 55808 - RNA, 23 nt, Artificial Sequence
  RNA Oligomer
ugaugacauaaaccacaaggagu

SEQ ID NO: 55809 - RNA, 23 nt, Artificial Sequence
  RNA Oligomer
gaugacauaaaccacaaggaguc

SEQ ID NO: 55810 - RNA, 23 nt, Artificial Sequence
  RNA Oligomer
ucuacaugucucaucucaggaug

SEQ ID NO: 55811 - RNA, 23 nt, Artificial Sequence
  RNA Oligomer
cuacaugucucaucucaggauga

SEQ ID NO: 55812 - RNA, 23 nt, Artificial Sequence
  RNA Oligomer
agcuaaaacaaccacagcgacug

SEQ ID NO: 55813 - RNA, 23 nt, Artificial Sequence
  RNA Oligomer
gcuaaaacaaccacagcgacugg

SEQ ID NO: 55814 - RNA, 23 nt, Artificial Sequence
  RNA Oligomer
cuaaaacaaccacagcgacuggc

SEQ ID NO: 55815 - RNA, 23 nt, Artificial Sequence
  RNA Oligomer
uaaaacaaccacagcgacuggcu

SEQ ID NO: 55816 - RNA, 23 nt, Artificial Sequence
  RNA Oligomer
aaaacaaccacagcgacuggcuc

SEQ ID NO: 55817 - RNA, 23 nt, Artificial Sequence
  RNA Oligomer
uggcauaagucucuggaaucuuc

SEQ ID NO: 55818 - RNA, 23 nt, Artificial Sequence
  RNA Oligomer
ggcauaagucucuggaaucuucu

SEQ ID NO: 55819 - RNA, 23 nt, Artificial Sequence
  RNA Oligomer
gcauaagucucuggaaucuucuc

SEQ ID NO: 55820 - RNA, 23 nt, Artificial Sequence
  RNA Oligomer
cuuccaccauguaucacccaggc

SEQ ID NO: 55821 - RNA, 23 nt, Artificial Sequence
  RNA Oligomer
cgggaaaccguuuuccagaauac

SEQ ID NO: 55822 - RNA, 23 nt, Artificial Sequence
  RNA Oligomer
gggaaaccguuuuccagaauacu

SEQ ID NO: 55823 - RNA, 23 nt, Artificial Sequence
  RNA Oligomer
ggaaaccguuuuccagaauacug

SEQ ID NO: 55824 - RNA, 23 nt, Artificial Sequence
  RNA Oligomer
gaaaccguuuuccagaauacuga

SEQ ID NO: 55825 - RNA, 23 nt, Artificial Sequence
  RNA Oligomer
aaaccguuuuccagaauacugaa

SEQ ID NO: 55826 - RNA, 23 nt, Artificial Sequence
  RNA Oligomer
gaaauaaaugcacccuugaaagc

SEQ ID NO: 55827 - RNA, 23 nt, Artificial Sequence
  RNA Oligomer
aaauaaaugcacccuugaaagca

SEQ ID NO: 55828 - RNA, 23 nt, Artificial Sequence
  RNA Oligomer
aauaaaugcacccuugaaagcau

SEQ ID NO: 55829 - RNA, 23 nt, Artificial Sequence
  RNA Oligomer
auaaaugcacccuugaaagcauc

SEQ ID NO: 55830 - RNA, 23 nt, Artificial Sequence
  RNA Oligomer
uaaaugcacccuugaaagcaucc

SEQ ID NO: 55831 - RNA, 23 nt, Artificial Sequence
  RNA Oligomer
auacaucaugcaacaaggucauu

SEQ ID NO: 55832 - RNA, 23 nt, Artificial Sequence
  RNA Oligomer
uacaucaugcaacaaggucauuc

SEQ ID NO: 55833 - RNA, 23 nt, Artificial Sequence
  RNA Oligomer
acaucaugcaacaaggucauuca

SEQ ID NO: 55834 - RNA, 23 nt, Artificial Sequence
  RNA Oligomer
ucacuugccuguucuaauaagag

SEQ ID NO: 55835 - RNA, 23 nt, Artificial Sequence
  RNA Oligomer
cacuugccuguucuaauaagaga

SEQ ID NO: 55836 - RNA, 23 nt, Artificial Sequence
  RNA Oligomer
acuugccuguucuaauaagagag

SEQ ID NO: 55837 - RNA, 23 nt, Artificial Sequence
  RNA Oligomer
cuugccuguucuaauaagagagg

SEQ ID NO: 55838 - RNA, 23 nt, Artificial Sequence
  RNA Oligomer
uugccuguucuaauaagagaggu

SEQ ID NO: 55839 - RNA, 23 nt, Artificial Sequence
  RNA Oligomer
uuggcagucuacaugucucaucu

SEQ ID NO: 55840 - RNA, 23 nt, Artificial Sequence
  RNA Oligomer
uggcagucuacaugucucaucuc

SEQ ID NO: 55841 - RNA, 23 nt, Artificial Sequence
  RNA Oligomer
agucaaggagcuaaaacaaccac

SEQ ID NO: 55842 - RNA, 23 nt, Artificial Sequence
  RNA Oligomer
gucaaggagcuaaaacaaccaca

SEQ ID NO: 55843 - RNA, 23 nt, Artificial Sequence
  RNA Oligomer
ucaaggagcuaaaacaaccacag

SEQ ID NO: 55844 - RNA, 23 nt, Artificial Sequence
  RNA Oligomer
caaggagcuaaaacaaccacagc

SEQ ID NO: 55845 - RNA, 23 nt, Artificial Sequence
  RNA Oligomer
aaggagcuaaaacaaccacagcg

SEQ ID NO: 55846 - RNA, 23 nt, Artificial Sequence
  RNA Oligomer
gaugugcaagaugaauccucagg

SEQ ID NO: 55847 - RNA, 23 nt, Artificial Sequence
  RNA Oligomer
augugcaagaugaauccucagga

SEQ ID NO: 55848 - RNA, 23 nt, Artificial Sequence
  RNA Oligomer
aauccucaggauuuuucacacac

SEQ ID NO: 55849 - RNA, 23 nt, Artificial Sequence
  RNA Oligomer
auccucaggauuuuucacacacu

SEQ ID NO: 55850 - RNA, 23 nt, Artificial Sequence
  RNA Oligomer
uccucaggauuuuucacacacug

SEQ ID NO: 55851 - RNA, 23 nt, Artificial Sequence
  RNA Oligomer
ccucaggauuuuucacacacuga

SEQ ID NO: 55852 - RNA, 23 nt, Artificial Sequence
  RNA Oligomer
cucaggauuuuucacacacugaa

SEQ ID NO: 55853 - RNA, 23 nt, Artificial Sequence
  RNA Oligomer
auaaucgauuccagcucuuuuau

SEQ ID NO: 55854 - RNA, 23 nt, Artificial Sequence
  RNA Oligomer
cuucucugguugcaaauuaugga

SEQ ID NO: 55855 - RNA, 23 nt, Artificial Sequence
  RNA Oligomer
auuuuacugcgggauccauugag

SEQ ID NO: 55856 - RNA, 23 nt, Artificial Sequence
  RNA Oligomer
uuuuacugcgggauccauugagc

SEQ ID NO: 55857 - RNA, 23 nt, Artificial Sequence
  RNA Oligomer
uuuacugcgggauccauugagca

SEQ ID NO: 55858 - RNA, 23 nt, Artificial Sequence
  RNA Oligomer
uuacugcgggauccauugagcau

SEQ ID NO: 55859 - RNA, 23 nt, Artificial Sequence
  RNA Oligomer
uacugcgggauccauugagcauc

SEQ ID NO: 55860 - RNA, 23 nt, Artificial Sequence
  RNA Oligomer
guuguugcugcaguccuuucucc

SEQ ID NO: 55861 - RNA, 23 nt, Artificial Sequence
  RNA Oligomer
uuguugcugcaguccuuucucca

SEQ ID NO: 55862 - RNA, 23 nt, Artificial Sequence
  RNA Oligomer
uguugcugcaguccuuucuccag

SEQ ID NO: 55863 - RNA, 23 nt, Artificial Sequence
  RNA Oligomer
guugcugcaguccuuucuccagu

SEQ ID NO: 55864 - RNA, 23 nt, Artificial Sequence
  RNA Oligomer
uugcugcaguccuuucuccaguc

SEQ ID NO: 55865 - RNA, 23 nt, Artificial Sequence
  RNA Oligomer
cugauagucuucuucaguaaugu

SEQ ID NO: 55866 - RNA, 23 nt, Artificial Sequence
  RNA Oligomer
ugauagucuucuucaguaauguu

SEQ ID NO: 55867 - RNA, 23 nt, Artificial Sequence
  RNA Oligomer
gauagucuucuucaguaauguug

SEQ ID NO: 55868 - RNA, 23 nt, Artificial Sequence
  RNA Oligomer
auagucuucuucaguaauguugc

SEQ ID NO: 55869 - RNA, 23 nt, Artificial Sequence
  RNA Oligomer
uagucuucuucaguaauguugca

SEQ ID NO: 55870 - RNA, 23 nt, Artificial Sequence
  RNA Oligomer
agucuucuucaguaauguugcaa

SEQ ID NO: 55871 - RNA, 23 nt, Artificial Sequence
  RNA Oligomer
gucuucuucaguaauguugcaag

SEQ ID NO: 55872 - RNA, 23 nt, Artificial Sequence
  RNA Oligomer
ucuucuucaguaauguugcaagg

SEQ ID NO: 55873 - RNA, 23 nt, Artificial Sequence
  RNA Oligomer
uggguucugaaacugcaccuccc

SEQ ID NO: 55874 - RNA, 23 nt, Artificial Sequence
  RNA Oligomer
ggguucugaaacugcaccucccc

SEQ ID NO: 55875 - RNA, 23 nt, Artificial Sequence
  RNA Oligomer
gguucugaaacugcaccuccccu

SEQ ID NO: 55876 - RNA, 23 nt, Artificial Sequence
  RNA Oligomer
guucugaaacugcaccuccccuu

SEQ ID NO: 55877 - RNA, 23 nt, Artificial Sequence
  RNA Oligomer
uucugaaacugcaccuccccuuc

SEQ ID NO: 55878 - RNA, 23 nt, Artificial Sequence
  RNA Oligomer
acccuugaaagcaucccauacac

SEQ ID NO: 55879 - RNA, 23 nt, Artificial Sequence
  RNA Oligomer
cccuugaaagcaucccauacacu

SEQ ID NO: 55880 - RNA, 23 nt, Artificial Sequence
  RNA Oligomer
ccuugaaagcaucccauacacuu

SEQ ID NO: 55881 - RNA, 23 nt, Artificial Sequence
  RNA Oligomer
cuugaaagcaucccauacacuuu

SEQ ID NO: 55882 - RNA, 23 nt, Artificial Sequence
  RNA Oligomer
cuugagcauucacuuuucuucac

SEQ ID NO: 55883 - RNA, 23 nt, Artificial Sequence
  RNA Oligomer
uugagcauucacuuuucuucacu

SEQ ID NO: 55884 - RNA, 23 nt, Artificial Sequence
  RNA Oligomer
ugagcauucacuuuucuucacuu

SEQ ID NO: 55885 - RNA, 23 nt, Artificial Sequence
  RNA Oligomer
aaagguaugcugaugauauaagu

SEQ ID NO: 55886 - RNA, 23 nt, Artificial Sequence
  RNA Oligomer
aagguaugcugaugauauaaguu

SEQ ID NO: 55887 - RNA, 23 nt, Artificial Sequence
  RNA Oligomer
agguaugcugaugauauaaguua

SEQ ID NO: 55888 - RNA, 23 nt, Artificial Sequence
  RNA Oligomer
gguaugcugaugauauaaguuau

SEQ ID NO: 55889 - RNA, 23 nt, Artificial Sequence
  RNA Oligomer
guaugcugaugauauaaguuauu

SEQ ID NO: 55890 - RNA, 23 nt, Artificial Sequence
  RNA Oligomer
uacaugucucaucucaggaugaa

SEQ ID NO: 55891 - RNA, 23 nt, Artificial Sequence
  RNA Oligomer
ggagucaaggagcuaaaacaacc

SEQ ID NO: 55892 - RNA, 23 nt, Artificial Sequence
  RNA Oligomer
gagucaaggagcuaaaacaacca

SEQ ID NO: 55893 - RNA, 23 nt, Artificial Sequence
  RNA Oligomer
cuggaaucuucucuuccaccaug

SEQ ID NO: 55894 - RNA, 23 nt, Artificial Sequence
  RNA Oligomer
ccucuagugucugaaccuucucu

SEQ ID NO: 55895 - RNA, 23 nt, Artificial Sequence
  RNA Oligomer
cucuagugucugaaccuucucug

SEQ ID NO: 55896 - RNA, 23 nt, Artificial Sequence
  RNA Oligomer
ucuagugucugaaccuucucugg

SEQ ID NO: 55897 - RNA, 23 nt, Artificial Sequence
  RNA Oligomer
cuagugucugaaccuucucuggu

SEQ ID NO: 55898 - RNA, 23 nt, Artificial Sequence
  RNA Oligomer
uagugucugaaccuucucugguu

SEQ ID NO: 55899 - RNA, 23 nt, Artificial Sequence
  RNA Oligomer
aaccuucucugguugcaaauuau

SEQ ID NO: 55900 - RNA, 23 nt, Artificial Sequence
  RNA Oligomer
accuucucugguugcaaauuaug

SEQ ID NO: 55901 - RNA, 23 nt, Artificial Sequence
  RNA Oligomer
ccuucucugguugcaaauuaugg

SEQ ID NO: 55902 - RNA, 23 nt, Artificial Sequence
  RNA Oligomer
ugaauuucaguguacuugacgca

SEQ ID NO: 55903 - RNA, 23 nt, Artificial Sequence
  RNA Oligomer
gaauuucaguguacuugacgcau

SEQ ID NO: 55904 - RNA, 23 nt, Artificial Sequence
  RNA Oligomer
aauuucaguguacuugacgcauc

SEQ ID NO: 55905 - RNA, 23 nt, Artificial Sequence
  RNA Oligomer
caaagauuuuacugcgggaucca

SEQ ID NO: 55906 - RNA, 23 nt, Artificial Sequence
  RNA Oligomer
aaagauuuuacugcgggauccau

SEQ ID NO: 55907 - RNA, 23 nt, Artificial Sequence
  RNA Oligomer
uccauugagcaucacauggacca

SEQ ID NO: 55908 - RNA, 23 nt, Artificial Sequence
  RNA Oligomer
ccauugagcaucacauggaccac

SEQ ID NO: 55909 - RNA, 23 nt, Artificial Sequence
  RNA Oligomer
cauugagcaucacauggaccaca

SEQ ID NO: 55910 - RNA, 23 nt, Artificial Sequence
  RNA Oligomer
auugagcaucacauggaccacau

SEQ ID NO: 55911 - RNA, 23 nt, Artificial Sequence
  RNA Oligomer
uugagcaucacauggaccacauc

SEQ ID NO: 55912 - RNA, 23 nt, Artificial Sequence
  RNA Oligomer
gaccugugugaacugaugggcca

SEQ ID NO: 55913 - RNA, 23 nt, Artificial Sequence
  RNA Oligomer
accugugugaacugaugggccag

SEQ ID NO: 55914 - RNA, 23 nt, Artificial Sequence
  RNA Oligomer
ccugugugaacugaugggccaga

SEQ ID NO: 55915 - RNA, 23 nt, Artificial Sequence
  RNA Oligomer
cugugugaacugaugggccagau

SEQ ID NO: 55916 - RNA, 23 nt, Artificial Sequence
  RNA Oligomer
ugugugaacugaugggccagauc

SEQ ID NO: 55917 - RNA, 23 nt, Artificial Sequence
  RNA Oligomer
caguaauguugcaaggauguuuu

SEQ ID NO: 55918 - RNA, 23 nt, Artificial Sequence
  RNA Oligomer
aguaauguugcaaggauguuuug

SEQ ID NO: 55919 - RNA, 23 nt, Artificial Sequence
  RNA Oligomer
guaauguugcaaggauguuuuga

SEQ ID NO: 55920 - RNA, 23 nt, Artificial Sequence
  RNA Oligomer
uaauguugcaaggauguuuugaa

SEQ ID NO: 55921 - RNA, 23 nt, Artificial Sequence
  RNA Oligomer
aauguugcaaggauguuuugaaa

SEQ ID NO: 55922 - RNA, 23 nt, Artificial Sequence
  RNA Oligomer
auguugcaaggauguuuugaaau

SEQ ID NO: 55923 - RNA, 23 nt, Artificial Sequence
  RNA Oligomer
cauuuggaaauguaaugcuuucu

SEQ ID NO: 55924 - RNA, 23 nt, Artificial Sequence
  RNA Oligomer
auuuggaaauguaaugcuuucug

SEQ ID NO: 55925 - RNA, 23 nt, Artificial Sequence
  RNA Oligomer
uuuggaaauguaaugcuuucuga

SEQ ID NO: 55926 - RNA, 23 nt, Artificial Sequence
  RNA Oligomer
uuggaaauguaaugcuuucugaa

SEQ ID NO: 55927 - RNA, 23 nt, Artificial Sequence
  RNA Oligomer
ucccauacacuuuggcagucuac

SEQ ID NO: 55928 - RNA, 23 nt, Artificial Sequence
  RNA Oligomer
cccauacacuuuggcagucuaca

SEQ ID NO: 55929 - RNA, 23 nt, Artificial Sequence
  RNA Oligomer
ccauacacuuuggcagucuacau

SEQ ID NO: 55930 - RNA, 23 nt, Artificial Sequence
  RNA Oligomer
cauacacuuuggcagucuacaug

SEQ ID NO: 55931 - RNA, 23 nt, Artificial Sequence
  RNA Oligomer
gagguuugguguggugauuuuuc

SEQ ID NO: 55932 - RNA, 23 nt, Artificial Sequence
  RNA Oligomer
gauagaucacaauaaagguaugc

SEQ ID NO: 55933 - RNA, 23 nt, Artificial Sequence
  RNA Oligomer
auagaucacaauaaagguaugcu

SEQ ID NO: 55934 - RNA, 23 nt, Artificial Sequence
  RNA Oligomer
uagaucacaauaaagguaugcug

SEQ ID NO: 55935 - RNA, 23 nt, Artificial Sequence
  RNA Oligomer
agaucacaauaaagguaugcuga

SEQ ID NO: 55936 - RNA, 23 nt, Artificial Sequence
  RNA Oligomer
gaucacaauaaagguaugcugau

SEQ ID NO: 55937 - RNA, 23 nt, Artificial Sequence
  RNA Oligomer
auaaagguaugcugaugauauaa

SEQ ID NO: 55938 - RNA, 23 nt, Artificial Sequence
  RNA Oligomer
cuccaaaaucuucagcucugcac

SEQ ID NO: 55939 - RNA, 23 nt, Artificial Sequence
  RNA Oligomer
uccaaaaucuucagcucugcacc

SEQ ID NO: 55940 - RNA, 23 nt, Artificial Sequence
  RNA Oligomer
ccaaaaucuucagcucugcacca

SEQ ID NO: 55941 - RNA, 23 nt, Artificial Sequence
  RNA Oligomer
caaaaucuucagcucugcaccag

SEQ ID NO: 55942 - RNA, 23 nt, Artificial Sequence
  RNA Oligomer
aaaaucuucagcucugcaccagc

SEQ ID NO: 55943 - RNA, 23 nt, Artificial Sequence
  RNA Oligomer
uaaucgauuccagcucuuuuaug

SEQ ID NO: 55944 - RNA, 23 nt, Artificial Sequence
  RNA Oligomer
aaucgauuccagcucuuuuaugg

SEQ ID NO: 55945 - RNA, 23 nt, Artificial Sequence
  RNA Oligomer
aucgauuccagcucuuuuauggu

SEQ ID NO: 55946 - RNA, 23 nt, Artificial Sequence
  RNA Oligomer
ucccaaaagugcuguuuuuguca

SEQ ID NO: 55947 - RNA, 23 nt, Artificial Sequence
  RNA Oligomer
cccaaaagugcuguuuuugucaa

SEQ ID NO: 55948 - RNA, 23 nt, Artificial Sequence
  RNA Oligomer
ccaaaagugcuguuuuugucaaa

SEQ ID NO: 55949 - RNA, 23 nt, Artificial Sequence
  RNA Oligomer
caaaagugcuguuuuugucaaag

SEQ ID NO: 55950 - RNA, 23 nt, Artificial Sequence
  RNA Oligomer
aaaagugcuguuuuugucaaaga

SEQ ID NO: 55951 - RNA, 23 nt, Artificial Sequence
  RNA Oligomer
augugaggucaucagcaagguag

SEQ ID NO: 55952 - RNA, 23 nt, Artificial Sequence
  RNA Oligomer
ugugaggucaucagcaagguagc

SEQ ID NO: 55953 - RNA, 23 nt, Artificial Sequence
  RNA Oligomer
gugaggucaucagcaagguagcc

SEQ ID NO: 55954 - RNA, 23 nt, Artificial Sequence
  RNA Oligomer
ugaggucaucagcaagguagccu

SEQ ID NO: 55955 - RNA, 23 nt, Artificial Sequence
  RNA Oligomer
gaggucaucagcaagguagccua

SEQ ID NO: 55956 - RNA, 23 nt, Artificial Sequence
  RNA Oligomer
gucugaguucccaacuucauuag

SEQ ID NO: 55957 - RNA, 23 nt, Artificial Sequence
  RNA Oligomer
ucugaguucccaacuucauuagu

SEQ ID NO: 55958 - RNA, 23 nt, Artificial Sequence
  RNA Oligomer
cugaguucccaacuucauuagug

SEQ ID NO: 55959 - RNA, 23 nt, Artificial Sequence
  RNA Oligomer
ugaguucccaacuucauuagugg

SEQ ID NO: 55960 - RNA, 23 nt, Artificial Sequence
  RNA Oligomer
gaguucccaacuucauuaguggc

SEQ ID NO: 55961 - RNA, 23 nt, Artificial Sequence
  RNA Oligomer
ucaguaauguugcaaggauguuu

SEQ ID NO: 55962 - RNA, 23 nt, Artificial Sequence
  RNA Oligomer
ggauguuuugaaauaaaugcacc

SEQ ID NO: 55963 - RNA, 23 nt, Artificial Sequence
  RNA Oligomer
uaaagugaaguaacuuaacauac

SEQ ID NO: 55964 - RNA, 23 nt, Artificial Sequence
  RNA Oligomer
aaagugaaguaacuuaacauaca

SEQ ID NO: 55965 - RNA, 23 nt, Artificial Sequence
  RNA Oligomer
aagugaaguaacuuaacauacaa

SEQ ID NO: 55966 - RNA, 23 nt, Artificial Sequence
  RNA Oligomer
agugaaguaacuuaacauacaau

SEQ ID NO: 55967 - RNA, 23 nt, Artificial Sequence
  RNA Oligomer
gugaaguaacuuaacauacaauu

SEQ ID NO: 55968 - RNA, 23 nt, Artificial Sequence
  RNA Oligomer
aucacaauaaagguaugcugaug

SEQ ID NO: 55969 - RNA, 23 nt, Artificial Sequence
  RNA Oligomer
cgacuggcucagaucucagaugu

SEQ ID NO: 55970 - RNA, 23 nt, Artificial Sequence
  RNA Oligomer
gacuggcucagaucucagaugug

SEQ ID NO: 55971 - RNA, 23 nt, Artificial Sequence
  RNA Oligomer
acuggcucagaucucagaugugc

SEQ ID NO: 55972 - RNA, 23 nt, Artificial Sequence
  RNA Oligomer
cuggcucagaucucagaugugca

SEQ ID NO: 55973 - RNA, 23 nt, Artificial Sequence
  RNA Oligomer
uggcucagaucucagaugugcaa

SEQ ID NO: 55974 - RNA, 23 nt, Artificial Sequence
  RNA Oligomer
cagaucucagaugugcaagauga

SEQ ID NO: 55975 - RNA, 23 nt, Artificial Sequence
  RNA Oligomer
agaucucagaugugcaagaugaa

SEQ ID NO: 55976 - RNA, 23 nt, Artificial Sequence
  RNA Oligomer
gaucucagaugugcaagaugaau

SEQ ID NO: 55977 - RNA, 23 nt, Artificial Sequence
  RNA Oligomer
aucucagaugugcaagaugaauc

SEQ ID NO: 55978 - RNA, 23 nt, Artificial Sequence
  RNA Oligomer
uuccaccauguaucacccaggcc

SEQ ID NO: 55979 - RNA, 23 nt, Artificial Sequence
  RNA Oligomer
uccaccauguaucacccaggccu

SEQ ID NO: 55980 - RNA, 23 nt, Artificial Sequence
  RNA Oligomer
gagcaucacauggaccacaucac

SEQ ID NO: 55981 - RNA, 23 nt, Artificial Sequence
  RNA Oligomer
agcaucacauggaccacaucaca

SEQ ID NO: 55982 - RNA, 23 nt, Artificial Sequence
  RNA Oligomer
gcaucacauggaccacaucacag

SEQ ID NO: 55983 - RNA, 23 nt, Artificial Sequence
  RNA Oligomer
caucacauggaccacaucacagg

SEQ ID NO: 55984 - RNA, 23 nt, Artificial Sequence
  RNA Oligomer
aucacauggaccacaucacaggc

SEQ ID NO: 55985 - RNA, 23 nt, Artificial Sequence
  RNA Oligomer
cugcaguccuuucuccagucugg

SEQ ID NO: 55986 - RNA, 23 nt, Artificial Sequence
  RNA Oligomer
ugcaguccuuucuccagucuggg

SEQ ID NO: 55987 - RNA, 23 nt, Artificial Sequence
  RNA Oligomer
gcaguccuuucuccagucugggc

SEQ ID NO: 55988 - RNA, 23 nt, Artificial Sequence
  RNA Oligomer
caguccuuucuccagucugggca

SEQ ID NO: 55989 - RNA, 23 nt, Artificial Sequence
  RNA Oligomer
aguccuuucuccagucugggcaa

SEQ ID NO: 55990 - RNA, 23 nt, Artificial Sequence
  RNA Oligomer
cccgcuggaccugugugaacuga

SEQ ID NO: 55991 - RNA, 23 nt, Artificial Sequence
  RNA Oligomer
ccgcuggaccugugugaacugau

SEQ ID NO: 55992 - RNA, 23 nt, Artificial Sequence
  RNA Oligomer
cgcuggaccugugugaacugaug

SEQ ID NO: 55993 - RNA, 23 nt, Artificial Sequence
  RNA Oligomer
gcuggaccugugugaacugaugg

SEQ ID NO: 55994 - RNA, 23 nt, Artificial Sequence
  RNA Oligomer
cuggaccugugugaacugauggg

SEQ ID NO: 55995 - RNA, 23 nt, Artificial Sequence
  RNA Oligomer
aguucccaacuucauuaguggcu

SEQ ID NO: 55996 - RNA, 23 nt, Artificial Sequence
  RNA Oligomer
guucccaacuucauuaguggcug

SEQ ID NO: 55997 - RNA, 23 nt, Artificial Sequence
  RNA Oligomer
caucaugcaacaaggucauucau

SEQ ID NO: 55998 - RNA, 23 nt, Artificial Sequence
  RNA Oligomer
aucaugcaacaaggucauucauu

SEQ ID NO: 55999 - RNA, 23 nt, Artificial Sequence
  RNA Oligomer
ucaugcaacaaggucauucauuu

SEQ ID NO: 56000 - RNA, 23 nt, Artificial Sequence
  RNA Oligomer
caugcaacaaggucauucauuug

SEQ ID NO: 56001 - RNA, 23 nt, Artificial Sequence
  RNA Oligomer
uguaaugcuuucugaaaaacuug

SEQ ID NO: 56002 - RNA, 23 nt, Artificial Sequence
  RNA Oligomer
guaaugcuuucugaaaaacuuga

SEQ ID NO: 56003 - RNA, 23 nt, Artificial Sequence
  RNA Oligomer
aagagagguuugguguggugauu

SEQ ID NO: 56004 - RNA, 23 nt, Artificial Sequence
  RNA Oligomer
caauagaaaggauguuaccaaua

SEQ ID NO: 56005 - RNA, 23 nt, Artificial Sequence
  RNA Oligomer
cuauugauagaucacaauaaagg

SEQ ID NO: 56006 - RNA, 23 nt, Artificial Sequence
  RNA Oligomer
uauugauagaucacaauaaaggu

SEQ ID NO: 56007 - RNA, 23 nt, Artificial Sequence
  RNA Oligomer
auugauagaucacaauaaaggua

SEQ ID NO: 56008 - RNA, 23 nt, Artificial Sequence
  RNA Oligomer
uugauagaucacaauaaagguau

SEQ ID NO: 56009 - RNA, 23 nt, Artificial Sequence
  RNA Oligomer
ugauagaucacaauaaagguaug

SEQ ID NO: 56010 - RNA, 23 nt, Artificial Sequence
  RNA Oligomer
gaggacccuccaaaaucuucagc

SEQ ID NO: 56011 - RNA, 23 nt, Artificial Sequence
  RNA Oligomer
aggacccuccaaaaucuucagcu

SEQ ID NO: 56012 - RNA, 23 nt, Artificial Sequence
  RNA Oligomer
ggacccuccaaaaucuucagcuc

SEQ ID NO: 56013 - RNA, 23 nt, Artificial Sequence
  RNA Oligomer
gacccuccaaaaucuucagcucu

SEQ ID NO: 56014 - RNA, 23 nt, Artificial Sequence
  RNA Oligomer
acccuccaaaaucuucagcucug

SEQ ID NO: 56015 - RNA, 23 nt, Artificial Sequence
  RNA Oligomer
aaaucuucagcucugcaccagca

SEQ ID NO: 56016 - RNA, 23 nt, Artificial Sequence
  RNA Oligomer
aaucuucagcucugcaccagcag

SEQ ID NO: 56017 - RNA, 23 nt, Artificial Sequence
  RNA Oligomer
aucuucagcucugcaccagcagg

SEQ ID NO: 56018 - RNA, 23 nt, Artificial Sequence
  RNA Oligomer
ugacauaaaccacaaggagucaa

SEQ ID NO: 56019 - RNA, 23 nt, Artificial Sequence
  RNA Oligomer
gacauaaaccacaaggagucaag

SEQ ID NO: 56020 - RNA, 23 nt, Artificial Sequence
  RNA Oligomer
acauaaaccacaaggagucaagg

SEQ ID NO: 56021 - RNA, 23 nt, Artificial Sequence
  RNA Oligomer
cauaaaccacaaggagucaagga

SEQ ID NO: 56022 - RNA, 23 nt, Artificial Sequence
  RNA Oligomer
auaaaccacaaggagucaaggag

SEQ ID NO: 56023 - RNA, 23 nt, Artificial Sequence
  RNA Oligomer
aaaccacaaggagucaaggagcu

SEQ ID NO: 56024 - RNA, 23 nt, Artificial Sequence
  RNA Oligomer
aaccacaaggagucaaggagcua

SEQ ID NO: 56025 - RNA, 23 nt, Artificial Sequence
  RNA Oligomer
accacaaggagucaaggagcuaa

SEQ ID NO: 56026 - RNA, 23 nt, Artificial Sequence
  RNA Oligomer
ccacaaggagucaaggagcuaaa

SEQ ID NO: 56027 - RNA, 23 nt, Artificial Sequence
  RNA Oligomer
cacaaggagucaaggagcuaaaa

SEQ ID NO: 56028 - RNA, 23 nt, Artificial Sequence
  RNA Oligomer
ugugcaagaugaauccucaggau

SEQ ID NO: 56029 - RNA, 23 nt, Artificial Sequence
  RNA Oligomer
gugcaagaugaauccucaggauu

SEQ ID NO: 56030 - RNA, 23 nt, Artificial Sequence
  RNA Oligomer
ugcaagaugaauccucaggauuu

SEQ ID NO: 56031 - RNA, 23 nt, Artificial Sequence
  RNA Oligomer
agugucugaaccuucucugguug

SEQ ID NO: 56032 - RNA, 23 nt, Artificial Sequence
  RNA Oligomer
aaagugcuguuuuugucaaagau

SEQ ID NO: 56033 - RNA, 23 nt, Artificial Sequence
  RNA Oligomer
agauuuuacugcgggauccauug

SEQ ID NO: 56034 - RNA, 23 nt, Artificial Sequence
  RNA Oligomer
gauuuuacugcgggauccauuga

SEQ ID NO: 56035 - RNA, 23 nt, Artificial Sequence
  RNA Oligomer
auccauugagcaucacauggacc

SEQ ID NO: 56036 - RNA, 23 nt, Artificial Sequence
  RNA Oligomer
ucccaacuucauuaguggcugau

SEQ ID NO: 56037 - RNA, 23 nt, Artificial Sequence
  RNA Oligomer
cccaacuucauuaguggcugaua

SEQ ID NO: 56038 - RNA, 23 nt, Artificial Sequence
  RNA Oligomer
ccaacuucauuaguggcugauag

SEQ ID NO: 56039 - RNA, 23 nt, Artificial Sequence
  RNA Oligomer
caacuucauuaguggcugauagu

SEQ ID NO: 56040 - RNA, 23 nt, Artificial Sequence
  RNA Oligomer
aacuucauuaguggcugauaguc

SEQ ID NO: 56041 - RNA, 23 nt, Artificial Sequence
  RNA Oligomer
gcugauagucuucuucaguaaug

SEQ ID NO: 56042 - RNA, 23 nt, Artificial Sequence
  RNA Oligomer
cuggguucugaaacugcaccucc

SEQ ID NO: 56043 - RNA, 23 nt, Artificial Sequence
  RNA Oligomer
aaugcacccuugaaagcauccca

SEQ ID NO: 56044 - RNA, 23 nt, Artificial Sequence
  RNA Oligomer
augcacccuugaaagcaucccau

SEQ ID NO: 56045 - RNA, 23 nt, Artificial Sequence
  RNA Oligomer
ugcacccuugaaagcaucccaua

SEQ ID NO: 56046 - RNA, 23 nt, Artificial Sequence
  RNA Oligomer
gcacccuugaaagcaucccauac

SEQ ID NO: 56047 - RNA, 23 nt, Artificial Sequence
  RNA Oligomer
cacccuugaaagcaucccauaca

SEQ ID NO: 56048 - RNA, 23 nt, Artificial Sequence
  RNA Oligomer
ggccucuagugucugaaccuucu

SEQ ID NO: 56049 - RNA, 23 nt, Artificial Sequence
  RNA Oligomer
gccucuagugucugaaccuucuc

SEQ ID NO: 56050 - RNA, 23 nt, Artificial Sequence
  RNA Oligomer
uucccaacuucauuaguggcuga

SEQ ID NO: 56051 - RNA, 23 nt, Artificial Sequence
  RNA Oligomer
caaggucauucauuuggaaaugu

SEQ ID NO: 56052 - RNA, 23 nt, Artificial Sequence
  RNA Oligomer
aaggucauucauuuggaaaugua

SEQ ID NO: 56053 - RNA, 23 nt, Artificial Sequence
  RNA Oligomer
aggucauucauuuggaaauguaa

SEQ ID NO: 56054 - RNA, 23 nt, Artificial Sequence
  RNA Oligomer
ggucauucauuuggaaauguaau

SEQ ID NO: 56055 - RNA, 23 nt, Artificial Sequence
  RNA Oligomer
gucauucauuuggaaauguaaug

SEQ ID NO: 56056 - RNA, 23 nt, Artificial Sequence
  RNA Oligomer
ggaggacccuccaaaaucuucag

SEQ ID NO: 56057 - RNA, 23 nt, Artificial Sequence
  RNA Oligomer
uagauauucuugcaggaaaauug

SEQ ID NO: 56058 - RNA, 23 nt, Artificial Sequence
  RNA Oligomer
agauauucuugcaggaaaauuga

SEQ ID NO: 56059 - RNA, 23 nt, Artificial Sequence
  RNA Oligomer
gauauucuugcaggaaaauugaa

SEQ ID NO: 56060 - RNA, 23 nt, Artificial Sequence
  RNA Oligomer
auauucuugcaggaaaauugaau

SEQ ID NO: 56061 - RNA, 23 nt, Artificial Sequence
  RNA Oligomer
uauucuugcaggaaaauugaaua

SEQ ID NO: 56062 - RNA, 23 nt, Artificial Sequence
  RNA Oligomer
ucacauggaccacaucacaggca

SEQ ID NO: 56063 - RNA, 23 nt, Artificial Sequence
  RNA Oligomer
cacauggaccacaucacaggcag

SEQ ID NO: 56064 - RNA, 23 nt, Artificial Sequence
  RNA Oligomer
acauggaccacaucacaggcagc

SEQ ID NO: 56065 - RNA, 23 nt, Artificial Sequence
  RNA Oligomer
uauucugcuccaaagaagaaucu

SEQ ID NO: 56066 - RNA, 23 nt, Artificial Sequence
  RNA Oligomer
auucugcuccaaagaagaaucuu

SEQ ID NO: 56067 - RNA, 23 nt, Artificial Sequence
  RNA Oligomer
uucugcuccaaagaagaaucuug

SEQ ID NO: 56068 - RNA, 23 nt, Artificial Sequence
  RNA Oligomer
ucugcuccaaagaagaaucuugu

SEQ ID NO: 56069 - RNA, 23 nt, Artificial Sequence
  RNA Oligomer
cugcuccaaagaagaaucuuguu

SEQ ID NO: 56070 - RNA, 23 nt, Artificial Sequence
  RNA Oligomer
cuuguugcaagguacggucugag

SEQ ID NO: 56071 - RNA, 23 nt, Artificial Sequence
  RNA Oligomer
uuguugcaagguacggucugagu

SEQ ID NO: 56072 - RNA, 23 nt, Artificial Sequence
  RNA Oligomer
uguugcaagguacggucugaguu

SEQ ID NO: 56073 - RNA, 23 nt, Artificial Sequence
  RNA Oligomer
guugcaagguacggucugaguuc

SEQ ID NO: 56074 - RNA, 23 nt, Artificial Sequence
  RNA Oligomer
uugcaagguacggucugaguucc

SEQ ID NO: 56075 - RNA, 23 nt, Artificial Sequence
  RNA Oligomer
cccuccaaaaucuucagcucugc

SEQ ID NO: 56076 - RNA, 23 nt, Artificial Sequence
  RNA Oligomer
ccuccaaaaucuucagcucugca

SEQ ID NO: 56077 - RNA, 23 nt, Artificial Sequence
  RNA Oligomer
uacaaaaauacaucaugcaacaa

SEQ ID NO: 56078 - RNA, 23 nt, Artificial Sequence
  RNA Oligomer
agagagguuugguguggugauuu

SEQ ID NO: 56079 - RNA, 23 nt, Artificial Sequence
  RNA Oligomer
caaauuauggacuuccacacucc

SEQ ID NO: 56080 - RNA, 23 nt, Artificial Sequence
  RNA Oligomer
aaauuauggacuuccacacuccc

SEQ ID NO: 56081 - RNA, 23 nt, Artificial Sequence
  RNA Oligomer
aauuauggacuuccacacuccca

SEQ ID NO: 56082 - RNA, 23 nt, Artificial Sequence
  RNA Oligomer
auuauggacuuccacacucccaa

SEQ ID NO: 56083 - RNA, 23 nt, Artificial Sequence
  RNA Oligomer
uuauggacuuccacacucccaaa

SEQ ID NO: 56084 - RNA, 23 nt, Artificial Sequence
  RNA Oligomer
gcugaacucgcaguuggccauag

SEQ ID NO: 56085 - RNA, 23 nt, Artificial Sequence
  RNA Oligomer
cugaacucgcaguuggccauagg

SEQ ID NO: 56086 - RNA, 23 nt, Artificial Sequence
  RNA Oligomer
ugaacucgcaguuggccauaggg

SEQ ID NO: 56087 - RNA, 23 nt, Artificial Sequence
  RNA Oligomer
gaacucgcaguuggccauagggc

SEQ ID NO: 56088 - RNA, 23 nt, Artificial Sequence
  RNA Oligomer
aacucgcaguuggccauagggcu

SEQ ID NO: 56089 - RNA, 23 nt, Artificial Sequence
  RNA Oligomer
gcucuuuuauggugggauccugg

SEQ ID NO: 56090 - RNA, 23 nt, Artificial Sequence
  RNA Oligomer
cucuuuuauggugggauccuggc

SEQ ID NO: 56091 - RNA, 23 nt, Artificial Sequence
  RNA Oligomer
ucuuuuauggugggauccuggca

SEQ ID NO: 56092 - RNA, 23 nt, Artificial Sequence
  RNA Oligomer
cuuuuauggugggauccuggcau

SEQ ID NO: 56093 - RNA, 23 nt, Artificial Sequence
  RNA Oligomer
uuuuauggugggauccuggcaua

SEQ ID NO: 56094 - RNA, 23 nt, Artificial Sequence
  RNA Oligomer
gucucuggaaucuucucuuccac

SEQ ID NO: 56095 - RNA, 23 nt, Artificial Sequence
  RNA Oligomer
ucucuggaaucuucucuuccacc

SEQ ID NO: 56096 - RNA, 23 nt, Artificial Sequence
  RNA Oligomer
aaucuuguugcaagguacggucu

SEQ ID NO: 56097 - RNA, 23 nt, Artificial Sequence
  RNA Oligomer
aucuuguugcaagguacggucug

SEQ ID NO: 56098 - RNA, 23 nt, Artificial Sequence
  RNA Oligomer
ucuuguugcaagguacggucuga

SEQ ID NO: 56099 - RNA, 23 nt, Artificial Sequence
  RNA Oligomer
acccaugaccaugaaguuuaugg

SEQ ID NO: 56100 - RNA, 23 nt, Artificial Sequence
  RNA Oligomer
cccaugaccaugaaguuuauggu

SEQ ID NO: 56101 - RNA, 23 nt, Artificial Sequence
  RNA Oligomer
ccaugaccaugaaguuuaugguu

SEQ ID NO: 56102 - RNA, 23 nt, Artificial Sequence
  RNA Oligomer
caugaccaugaaguuuaugguuu

SEQ ID NO: 56103 - RNA, 23 nt, Artificial Sequence
  RNA Oligomer
augaccaugaaguuuaugguuug

SEQ ID NO: 56104 - RNA, 23 nt, Artificial Sequence
  RNA Oligomer
gaaguuuaugguuugacuaucug

SEQ ID NO: 56105 - RNA, 23 nt, Artificial Sequence
  RNA Oligomer
aaguuuaugguuugacuaucugu

SEQ ID NO: 56106 - RNA, 23 nt, Artificial Sequence
  RNA Oligomer
aguuuaugguuugacuaucugua

SEQ ID NO: 56107 - RNA, 23 nt, Artificial Sequence
  RNA Oligomer
guuuaugguuugacuaucuguag

SEQ ID NO: 56108 - RNA, 23 nt, Artificial Sequence
  RNA Oligomer
uuuaugguuugacuaucuguagg

SEQ ID NO: 56109 - RNA, 23 nt, Artificial Sequence
  RNA Oligomer
cuuuggcagucuacaugucucau

SEQ ID NO: 56110 - RNA, 23 nt, Artificial Sequence
  RNA Oligomer
uuuggcagucuacaugucucauc

SEQ ID NO: 56111 - RNA, 23 nt, Artificial Sequence
  RNA Oligomer
cuugucaggucuguagauauucu

SEQ ID NO: 56112 - RNA, 23 nt, Artificial Sequence
  RNA Oligomer
uugucaggucuguagauauucuu

SEQ ID NO: 56113 - RNA, 23 nt, Artificial Sequence
  RNA Oligomer
ugucaggucuguagauauucuug

SEQ ID NO: 56114 - RNA, 23 nt, Artificial Sequence
  RNA Oligomer
gucaggucuguagauauucuugc

SEQ ID NO: 56115 - RNA, 23 nt, Artificial Sequence
  RNA Oligomer
ucaggucuguagauauucuugca

SEQ ID NO: 56116 - RNA, 23 nt, Artificial Sequence
  RNA Oligomer
ugcaaauuauggacuuccacacu

SEQ ID NO: 56117 - RNA, 23 nt, Artificial Sequence
  RNA Oligomer
gcaaauuauggacuuccacacuc

SEQ ID NO: 56118 - RNA, 23 nt, Artificial Sequence
  RNA Oligomer
ccagaauacugaaacaggguugu

SEQ ID NO: 56119 - RNA, 23 nt, Artificial Sequence
  RNA Oligomer
cagaauacugaaacaggguuguu

SEQ ID NO: 56120 - RNA, 23 nt, Artificial Sequence
  RNA Oligomer
agaauacugaaacaggguuguug

SEQ ID NO: 56121 - RNA, 23 nt, Artificial Sequence
  RNA Oligomer
gaauacugaaacaggguuguugc

SEQ ID NO: 56122 - RNA, 23 nt, Artificial Sequence
  RNA Oligomer
aauacugaaacaggguuguugcu

SEQ ID NO: 56123 - RNA, 23 nt, Artificial Sequence
  RNA Oligomer
gucauguaugaugacauaaacca

SEQ ID NO: 56124 - RNA, 23 nt, Artificial Sequence
  RNA Oligomer
ucauguaugaugacauaaaccac

SEQ ID NO: 56125 - RNA, 23 nt, Artificial Sequence
  RNA Oligomer
cauguaugaugacauaaaccaca

SEQ ID NO: 56126 - RNA, 23 nt, Artificial Sequence
  RNA Oligomer
ucucaucucaggaugaauuucag

SEQ ID NO: 56127 - RNA, 23 nt, Artificial Sequence
  RNA Oligomer
cucaucucaggaugaauuucagu

SEQ ID NO: 56128 - RNA, 23 nt, Artificial Sequence
  RNA Oligomer
ucaucucaggaugaauuucagug

SEQ ID NO: 56129 - RNA, 23 nt, Artificial Sequence
  RNA Oligomer
caucucaggaugaauuucagugu

SEQ ID NO: 56130 - RNA, 23 nt, Artificial Sequence
  RNA Oligomer
aucucaggaugaauuucagugua

SEQ ID NO: 56131 - RNA, 23 nt, Artificial Sequence
  RNA Oligomer
uuuauggugggauccuggcauaa

SEQ ID NO: 56132 - RNA, 23 nt, Artificial Sequence
  RNA Oligomer
ugggauccuggcauaagucucug

SEQ ID NO: 56133 - RNA, 23 nt, Artificial Sequence
  RNA Oligomer
gggauccuggcauaagucucugg

SEQ ID NO: 56134 - RNA, 23 nt, Artificial Sequence
  RNA Oligomer
ggauccuggcauaagucucugga

SEQ ID NO: 56135 - RNA, 23 nt, Artificial Sequence
  RNA Oligomer
gauccuggcauaagucucuggaa

SEQ ID NO: 56136 - RNA, 23 nt, Artificial Sequence
  RNA Oligomer
auccuggcauaagucucuggaau

SEQ ID NO: 56137 - RNA, 23 nt, Artificial Sequence
  RNA Oligomer
gccagaucuuuuauucugcucca

SEQ ID NO: 56138 - RNA, 23 nt, Artificial Sequence
  RNA Oligomer
ccagaucuuuuauucugcuccaa

SEQ ID NO: 56139 - RNA, 23 nt, Artificial Sequence
  RNA Oligomer
cagaucuuuuauucugcuccaaa

SEQ ID NO: 56140 - RNA, 23 nt, Artificial Sequence
  RNA Oligomer
agaucuuuuauucugcuccaaag

SEQ ID NO: 56141 - RNA, 23 nt, Artificial Sequence
  RNA Oligomer
gaucuuuuauucugcuccaaaga

SEQ ID NO: 56142 - RNA, 23 nt, Artificial Sequence
  RNA Oligomer
ucauuaguggcugauagucuucu

SEQ ID NO: 56143 - RNA, 23 nt, Artificial Sequence
  RNA Oligomer
cauuaguggcugauagucuucuu

SEQ ID NO: 56144 - RNA, 23 nt, Artificial Sequence
  RNA Oligomer
auuaguggcugauagucuucuuc

SEQ ID NO: 56145 - RNA, 23 nt, Artificial Sequence
  RNA Oligomer
uuaguggcugauagucuucuuca

SEQ ID NO: 56146 - RNA, 23 nt, Artificial Sequence
  RNA Oligomer
uaguggcugauagucuucuucag

SEQ ID NO: 56147 - RNA, 23 nt, Artificial Sequence
  RNA Oligomer
ugguuugacuaucuguaggaagg

SEQ ID NO: 56148 - RNA, 23 nt, Artificial Sequence
  RNA Oligomer
gguuugacuaucuguaggaaggg

SEQ ID NO: 56149 - RNA, 23 nt, Artificial Sequence
  RNA Oligomer
guuugacuaucuguaggaagggu

SEQ ID NO: 56150 - RNA, 23 nt, Artificial Sequence
  RNA Oligomer
uuugacuaucuguaggaagggua

SEQ ID NO: 56151 - RNA, 23 nt, Artificial Sequence
  RNA Oligomer
uugacuaucuguaggaaggguac

SEQ ID NO: 56152 - RNA, 23 nt, Artificial Sequence
  RNA Oligomer
cacaugagaauuaaagugaagua

SEQ ID NO: 56153 - RNA, 23 nt, Artificial Sequence
  RNA Oligomer
gaccuuauuguggaggacccucc

SEQ ID NO: 56154 - RNA, 23 nt, Artificial Sequence
  RNA Oligomer
accuuauuguggaggacccucca

SEQ ID NO: 56155 - RNA, 23 nt, Artificial Sequence
  RNA Oligomer
ccuuauuguggaggacccuccaa

SEQ ID NO: 56156 - RNA, 23 nt, Artificial Sequence
  RNA Oligomer
cuuauuguggaggacccuccaaa

SEQ ID NO: 56157 - RNA, 23 nt, Artificial Sequence
  RNA Oligomer
uuauuguggaggacccuccaaaa

SEQ ID NO: 56158 - RNA, 23 nt, Artificial Sequence
  RNA Oligomer
caggucuguagauauucuugcag

SEQ ID NO: 56159 - RNA, 23 nt, Artificial Sequence
  RNA Oligomer
aggucuguagauauucuugcagg

SEQ ID NO: 56160 - RNA, 23 nt, Artificial Sequence
  RNA Oligomer
gugggauccuggcauaagucucu

SEQ ID NO: 56161 - RNA, 23 nt, Artificial Sequence
  RNA Oligomer
uuuggaaguguugaauucaccac

SEQ ID NO: 56162 - RNA, 23 nt, Artificial Sequence
  RNA Oligomer
uuggaaguguugaauucaccaca

SEQ ID NO: 56163 - RNA, 23 nt, Artificial Sequence
  RNA Oligomer
aucuuuuauucugcuccaaagaa

SEQ ID NO: 56164 - RNA, 23 nt, Artificial Sequence
  RNA Oligomer
ugaaguuuaugguuugacuaucu

SEQ ID NO: 56165 - RNA, 23 nt, Artificial Sequence
  RNA Oligomer
uuaugguuugacuaucuguagga

SEQ ID NO: 56166 - RNA, 23 nt, Artificial Sequence
  RNA Oligomer
cagguaugcugagucauguauga

SEQ ID NO: 56167 - RNA, 23 nt, Artificial Sequence
  RNA Oligomer
agguaugcugagucauguaugau

SEQ ID NO: 56168 - RNA, 23 nt, Artificial Sequence
  RNA Oligomer
gguaugcugagucauguaugaug

SEQ ID NO: 56169 - RNA, 23 nt, Artificial Sequence
  RNA Oligomer
guaugcugagucauguaugauga

SEQ ID NO: 56170 - RNA, 23 nt, Artificial Sequence
  RNA Oligomer
uaugcugagucauguaugaugac

SEQ ID NO: 56171 - RNA, 23 nt, Artificial Sequence
  RNA Oligomer
augacauaaaccacaaggaguca

SEQ ID NO: 56172 - RNA, 23 nt, Artificial Sequence
  RNA Oligomer
uaaaccacaaggagucaaggagc

SEQ ID NO: 56173 - RNA, 23 nt, Artificial Sequence
  RNA Oligomer
ucgauuccagcucuuuuauggug

SEQ ID NO: 56174 - RNA, 23 nt, Artificial Sequence
  RNA Oligomer
cgauuccagcucuuuuauggugg

SEQ ID NO: 56175 - RNA, 23 nt, Artificial Sequence
  RNA Oligomer
gauuccagcucuuuuaugguggg

SEQ ID NO: 56176 - RNA, 23 nt, Artificial Sequence
  RNA Oligomer
auuccagcucuuuuaugguggga

SEQ ID NO: 56177 - RNA, 23 nt, Artificial Sequence
  RNA Oligomer
uuccagcucuuuuauggugggau

SEQ ID NO: 56178 - RNA, 23 nt, Artificial Sequence
  RNA Oligomer
ucucaggaugaauuucaguguac

SEQ ID NO: 56179 - RNA, 23 nt, Artificial Sequence
  RNA Oligomer
cucaggaugaauuucaguguacu

SEQ ID NO: 56180 - RNA, 23 nt, Artificial Sequence
  RNA Oligomer
ucaggaugaauuucaguguacuu

SEQ ID NO: 56181 - RNA, 23 nt, Artificial Sequence
  RNA Oligomer
auacugaaacaggguuguugcug

SEQ ID NO: 56182 - RNA, 23 nt, Artificial Sequence
  RNA Oligomer
uacugaaacaggguuguugcugc

SEQ ID NO: 56183 - RNA, 23 nt, Artificial Sequence
  RNA Oligomer
uucauuaguggcugauagucuuc

SEQ ID NO: 56184 - RNA, 23 nt, Artificial Sequence
  RNA Oligomer
agcaucccauacacuuuggcagu

SEQ ID NO: 56185 - RNA, 23 nt, Artificial Sequence
  RNA Oligomer
gcaucccauacacuuuggcaguc

SEQ ID NO: 56186 - RNA, 23 nt, Artificial Sequence
  RNA Oligomer
caucccauacacuuuggcagucu

SEQ ID NO: 56187 - RNA, 23 nt, Artificial Sequence
  RNA Oligomer
aucccauacacuuuggcagucua

SEQ ID NO: 56188 - RNA, 23 nt, Artificial Sequence
  RNA Oligomer
aauagaaaggauguuaccaauau

SEQ ID NO: 56189 - RNA, 23 nt, Artificial Sequence
  RNA Oligomer
auagaaaggauguuaccaauaua

SEQ ID NO: 56190 - RNA, 23 nt, Artificial Sequence
  RNA Oligomer
uggcauugaccuuauuguggagg

SEQ ID NO: 56191 - RNA, 23 nt, Artificial Sequence
  RNA Oligomer
ggcauugaccuuauuguggagga

SEQ ID NO: 56192 - RNA, 23 nt, Artificial Sequence
  RNA Oligomer
gcauugaccuuauuguggaggac

SEQ ID NO: 56193 - RNA, 23 nt, Artificial Sequence
  RNA Oligomer
cauugaccuuauuguggaggacc

SEQ ID NO: 56194 - RNA, 23 nt, Artificial Sequence
  RNA Oligomer
auugaccuuauuguggaggaccc

SEQ ID NO: 56195 - RNA, 23 nt, Artificial Sequence
  RNA Oligomer
ggucuguagauauucuugcagga

SEQ ID NO: 56196 - RNA, 23 nt, Artificial Sequence
  RNA Oligomer
auucuugcaggaaaauugaauau

SEQ ID NO: 56197 - RNA, 23 nt, Artificial Sequence
  RNA Oligomer
agcucuuuuauggugggauccug

SEQ ID NO: 56198 - RNA, 23 nt, Artificial Sequence
  RNA Oligomer
gaggaucaggaccaggauacuga

SEQ ID NO: 56199 - RNA, 23 nt, Artificial Sequence
  RNA Oligomer
aggaucaggaccaggauacugac

SEQ ID NO: 56200 - RNA, 23 nt, Artificial Sequence
  RNA Oligomer
ggaucaggaccaggauacugacg

SEQ ID NO: 56201 - RNA, 23 nt, Artificial Sequence
  RNA Oligomer
gaucaggaccaggauacugacgc

SEQ ID NO: 56202 - RNA, 23 nt, Artificial Sequence
  RNA Oligomer
aucaggaccaggauacugacgcc

SEQ ID NO: 56203 - RNA, 23 nt, Artificial Sequence
  RNA Oligomer
augcaacaaggucauucauuugg

SEQ ID NO: 56204 - RNA, 23 nt, Artificial Sequence
  RNA Oligomer
ugcaacaaggucauucauuugga

SEQ ID NO: 56205 - RNA, 23 nt, Artificial Sequence
  RNA Oligomer
gcaacaaggucauucauuuggaa

SEQ ID NO: 56206 - RNA, 23 nt, Artificial Sequence
  RNA Oligomer
caacaaggucauucauuuggaaa

SEQ ID NO: 56207 - RNA, 23 nt, Artificial Sequence
  RNA Oligomer
aacaaggucauucauuuggaaau

SEQ ID NO: 56208 - RNA, 23 nt, Artificial Sequence
  RNA Oligomer
cuggcauugaccuuauuguggag

SEQ ID NO: 56209 - RNA, 23 nt, Artificial Sequence
  RNA Oligomer
uugaccuuauuguggaggacccu

SEQ ID NO: 56210 - RNA, 23 nt, Artificial Sequence
  RNA Oligomer
cuugcaggaaaauugaauauucc

SEQ ID NO: 56211 - RNA, 23 nt, Artificial Sequence
  RNA Oligomer
uugcaggaaaauugaauauuccu

SEQ ID NO: 56212 - RNA, 23 nt, Artificial Sequence
  RNA Oligomer
ugcaggaaaauugaauauuccuu

SEQ ID NO: 56213 - RNA, 23 nt, Artificial Sequence
  RNA Oligomer
gcaggaaaauugaauauuccuuu

SEQ ID NO: 56214 - RNA, 23 nt, Artificial Sequence
  RNA Oligomer
caggaaaauugaauauuccuuuu

SEQ ID NO: 56215 - RNA, 23 nt, Artificial Sequence
  RNA Oligomer
auuucaguguacuugacgcaucg

SEQ ID NO: 56216 - RNA, 23 nt, Artificial Sequence
  RNA Oligomer
acugaaacaggguuguugcugca

SEQ ID NO: 56217 - RNA, 23 nt, Artificial Sequence
  RNA Oligomer
cugaaacaggguuguugcugcag

SEQ ID NO: 56218 - RNA, 23 nt, Artificial Sequence
  RNA Oligomer
ugaaacaggguuguugcugcagu

SEQ ID NO: 56219 - RNA, 23 nt, Artificial Sequence
  RNA Oligomer
gaaacaggguuguugcugcaguc

SEQ ID NO: 56220 - RNA, 23 nt, Artificial Sequence
  RNA Oligomer
aaacaggguuguugcugcagucc

SEQ ID NO: 56221 - RNA, 23 nt, Artificial Sequence
  RNA Oligomer
gcuccaaagaagaaucuuguugc

SEQ ID NO: 56222 - RNA, 23 nt, Artificial Sequence
  RNA Oligomer
cuccaaagaagaaucuuguugca

SEQ ID NO: 56223 - RNA, 23 nt, Artificial Sequence
  RNA Oligomer
uccaaagaagaaucuuguugcaa

SEQ ID NO: 56224 - RNA, 23 nt, Artificial Sequence
  RNA Oligomer
ccaaagaagaaucuuguugcaag

SEQ ID NO: 56225 - RNA, 23 nt, Artificial Sequence
  RNA Oligomer
caaagaagaaucuuguugcaagg

SEQ ID NO: 56226 - RNA, 23 nt, Artificial Sequence
  RNA Oligomer
cuucauuaguggcugauagucuu

SEQ ID NO: 56227 - RNA, 23 nt, Artificial Sequence
  RNA Oligomer
aguggcugauagucuucuucagu

SEQ ID NO: 56228 - RNA, 23 nt, Artificial Sequence
  RNA Oligomer
guggcugauagucuucuucagua

SEQ ID NO: 56229 - RNA, 23 nt, Artificial Sequence
  RNA Oligomer
ugacuaucuguaggaaggguaca

SEQ ID NO: 56230 - RNA, 23 nt, Artificial Sequence
  RNA Oligomer
gacuaucuguaggaaggguacaa

SEQ ID NO: 56231 - RNA, 23 nt, Artificial Sequence
  RNA Oligomer
augaauccucaggauuuuucaca

SEQ ID NO: 56232 - RNA, 23 nt, Artificial Sequence
  RNA Oligomer
ugaauccucaggauuuuucacac

SEQ ID NO: 56233 - RNA, 23 nt, Artificial Sequence
  RNA Oligomer
gaauccucaggauuuuucacaca

SEQ ID NO: 56234 - RNA, 23 nt, Artificial Sequence
  RNA Oligomer
uauggacuuccacacucccaaaa

SEQ ID NO: 56235 - RNA, 23 nt, Artificial Sequence
  RNA Oligomer
uggaccugugugaacugaugggc

SEQ ID NO: 56236 - RNA, 23 nt, Artificial Sequence
  RNA Oligomer
ggaccugugugaacugaugggcc

SEQ ID NO: 56237 - RNA, 23 nt, Artificial Sequence
  RNA Oligomer
gggccagaucuuuuauucugcuc

SEQ ID NO: 56238 - RNA, 23 nt, Artificial Sequence
  RNA Oligomer
ggccagaucuuuuauucugcucc

SEQ ID NO: 56239 - RNA, 23 nt, Artificial Sequence
  RNA Oligomer
cgccaagacagaguugggcucuc

SEQ ID NO: 56240 - RNA, 23 nt, Artificial Sequence
  RNA Oligomer
gccaagacagaguugggcucucc

SEQ ID NO: 56241 - RNA, 23 nt, Artificial Sequence
  RNA Oligomer
ccaagacagaguugggcucuccu

SEQ ID NO: 56242 - RNA, 23 nt, Artificial Sequence
  RNA Oligomer
caagacagaguugggcucuccua

SEQ ID NO: 56243 - RNA, 23 nt, Artificial Sequence
  RNA Oligomer
aagacagaguugggcucuccuag

SEQ ID NO: 56244 - RNA, 23 nt, Artificial Sequence
  RNA Oligomer
ugguguggugauuuuucaauaga

SEQ ID NO: 56245 - RNA, 23 nt, Artificial Sequence
  RNA Oligomer
gguguggugauuuuucaauagaa

SEQ ID NO: 56246 - RNA, 23 nt, Artificial Sequence
  RNA Oligomer
guguggugauuuuucaauagaaa

SEQ ID NO: 56247 - RNA, 23 nt, Artificial Sequence
  RNA Oligomer
uguggugauuuuucaauagaaag

SEQ ID NO: 56248 - RNA, 23 nt, Artificial Sequence
  RNA Oligomer
ggggaaaaaggcuuccgucucug

SEQ ID NO: 56249 - RNA, 23 nt, Artificial Sequence
  RNA Oligomer
gggaaaaaggcuuccgucucugg

SEQ ID NO: 56250 - RNA, 23 nt, Artificial Sequence
  RNA Oligomer
ggaaaaaggcuuccgucucuggc

SEQ ID NO: 56251 - RNA, 23 nt, Artificial Sequence
  RNA Oligomer
gaaaaaggcuuccgucucuggca

SEQ ID NO: 56252 - RNA, 23 nt, Artificial Sequence
  RNA Oligomer
aaaaaggcuuccgucucuggcau

SEQ ID NO: 56253 - RNA, 23 nt, Artificial Sequence
  RNA Oligomer
aaaaggcuuccgucucuggcauu

SEQ ID NO: 56254 - RNA, 23 nt, Artificial Sequence
  RNA Oligomer
gucuguagauauucuugcaggaa

SEQ ID NO: 56255 - RNA, 23 nt, Artificial Sequence
  RNA Oligomer
ucuguagauauucuugcaggaaa

SEQ ID NO: 56256 - RNA, 23 nt, Artificial Sequence
  RNA Oligomer
uccagcucuuuuauggugggauc

SEQ ID NO: 56257 - RNA, 23 nt, Artificial Sequence
  RNA Oligomer
uccuggcauaagucucuggaauc

SEQ ID NO: 56258 - RNA, 23 nt, Artificial Sequence
  RNA Oligomer
uuucaguguacuugacgcaucgc

SEQ ID NO: 56259 - RNA, 23 nt, Artificial Sequence
  RNA Oligomer
cuucuucaguaauguugcaagga

SEQ ID NO: 56260 - RNA, 23 nt, Artificial Sequence
  RNA Oligomer
uucuucaguaauguugcaaggau

SEQ ID NO: 56261 - RNA, 23 nt, Artificial Sequence
  RNA Oligomer
ugaccaugaaguuuaugguuuga

SEQ ID NO: 56262 - RNA, 23 nt, Artificial Sequence
  RNA Oligomer
uaugguuugacuaucuguaggaa

SEQ ID NO: 56263 - RNA, 23 nt, Artificial Sequence
  RNA Oligomer
augguuugacuaucuguaggaag

SEQ ID NO: 56264 - RNA, 23 nt, Artificial Sequence
  RNA Oligomer
acuaucuguaggaaggguacaaa

SEQ ID NO: 56265 - RNA, 23 nt, Artificial Sequence
  RNA Oligomer
cuaucuguaggaaggguacaaaa

SEQ ID NO: 56266 - RNA, 23 nt, Artificial Sequence
  RNA Oligomer
uaucuguaggaaggguacaaaaa

SEQ ID NO: 56267 - RNA, 23 nt, Artificial Sequence
  RNA Oligomer
aucuguaggaaggguacaaaaau

SEQ ID NO: 56268 - RNA, 23 nt, Artificial Sequence
  RNA Oligomer
ugaccuuauuguggaggacccuc

SEQ ID NO: 56269 - RNA, 23 nt, Artificial Sequence
  RNA Oligomer
agucauguaugaugacauaaacc

SEQ ID NO: 56270 - RNA, 23 nt, Artificial Sequence
  RNA Oligomer
aaacaaccacagcgacuggcuca

SEQ ID NO: 56271 - RNA, 23 nt, Artificial Sequence
  RNA Oligomer
cuguagauauucuugcaggaaaa

SEQ ID NO: 56272 - RNA, 23 nt, Artificial Sequence
  RNA Oligomer
gucucaucucaggaugaauuuca

SEQ ID NO: 56273 - RNA, 23 nt, Artificial Sequence
  RNA Oligomer
aagauuuuacugcgggauccauu

SEQ ID NO: 56274 - RNA, 23 nt, Artificial Sequence
  RNA Oligomer
uucaguguacuugacgcaucgcg

SEQ ID NO: 56275 - RNA, 23 nt, Artificial Sequence
  RNA Oligomer
ucaguguacuugacgcaucgcgc

SEQ ID NO: 56276 - RNA, 23 nt, Artificial Sequence
  RNA Oligomer
caguguacuugacgcaucgcgcc

SEQ ID NO: 56277 - RNA, 23 nt, Artificial Sequence
  RNA Oligomer
uccagaauacugaaacaggguug

SEQ ID NO: 56278 - RNA, 23 nt, Artificial Sequence
  RNA Oligomer
acuucauuaguggcugauagucu

SEQ ID NO: 56279 - RNA, 23 nt, Artificial Sequence
  RNA Oligomer
uggaaauguaaugcuuucugaaa

SEQ ID NO: 56280 - RNA, 23 nt, Artificial Sequence
  RNA Oligomer
ggaaauguaaugcuuucugaaaa

SEQ ID NO: 56281 - RNA, 23 nt, Artificial Sequence
  RNA Oligomer
gaaauguaaugcuuucugaaaaa

SEQ ID NO: 56282 - RNA, 23 nt, Artificial Sequence
  RNA Oligomer
uggggaaaaaggcuuccgucucu

SEQ ID NO: 56283 - RNA, 23 nt, Artificial Sequence
  RNA Oligomer
gucucuggcauugaccuuauugu

SEQ ID NO: 56284 - RNA, 23 nt, Artificial Sequence
  RNA Oligomer
ucucuggcauugaccuuauugug

SEQ ID NO: 56285 - RNA, 23 nt, Artificial Sequence
  RNA Oligomer
cucuggcauugaccuuauugugg

SEQ ID NO: 56286 - RNA, 23 nt, Artificial Sequence
  RNA Oligomer
ucuggcauugaccuuauugugga

SEQ ID NO: 56287 - RNA, 23 nt, Artificial Sequence
  RNA Oligomer
ccagcagguaugcugagucaugu

SEQ ID NO: 56288 - RNA, 23 nt, Artificial Sequence
  RNA Oligomer
cagcagguaugcugagucaugua

SEQ ID NO: 56289 - RNA, 23 nt, Artificial Sequence
  RNA Oligomer
agcagguaugcugagucauguau

SEQ ID NO: 56290 - RNA, 23 nt, Artificial Sequence
  RNA Oligomer
gcagguaugcugagucauguaug

SEQ ID NO: 56291 - RNA, 23 nt, Artificial Sequence
  RNA Oligomer
aggagcuaaaacaaccacagcga

SEQ ID NO: 56292 - RNA, 23 nt, Artificial Sequence
  RNA Oligomer
ggagcuaaaacaaccacagcgac

SEQ ID NO: 56293 - RNA, 23 nt, Artificial Sequence
  RNA Oligomer
gagcuaaaacaaccacagcgacu

SEQ ID NO: 56294 - RNA, 23 nt, Artificial Sequence
  RNA Oligomer
gaugaauccucaggauuuuucac

SEQ ID NO: 56295 - RNA, 23 nt, Artificial Sequence
  RNA Oligomer
aacaggguuguugcugcaguccu

SEQ ID NO: 56296 - RNA, 23 nt, Artificial Sequence
  RNA Oligomer
uggaaguguugaauucaccacac

SEQ ID NO: 56297 - RNA, 23 nt, Artificial Sequence
  RNA Oligomer
ggaaguguugaauucaccacacc

SEQ ID NO: 56298 - RNA, 23 nt, Artificial Sequence
  RNA Oligomer
gaaguguugaauucaccacacca

SEQ ID NO: 56299 - RNA, 23 nt, Artificial Sequence
  RNA Oligomer
aaguguugaauucaccacaccau

SEQ ID NO: 56300 - RNA, 23 nt, Artificial Sequence
  RNA Oligomer
ugcuccaaagaagaaucuuguug

SEQ ID NO: 56301 - RNA, 23 nt, Artificial Sequence
  RNA Oligomer
ugcaagguacggucugaguuccc

SEQ ID NO: 56302 - RNA, 23 nt, Artificial Sequence
  RNA Oligomer
gcaagguacggucugaguuccca

SEQ ID NO: 56303 - RNA, 23 nt, Artificial Sequence
  RNA Oligomer
caagguacggucugaguucccaa

SEQ ID NO: 56304 - RNA, 23 nt, Artificial Sequence
  RNA Oligomer
aagguacggucugaguucccaac

SEQ ID NO: 56305 - RNA, 23 nt, Artificial Sequence
  RNA Oligomer
aaaugcacccuugaaagcauccc

SEQ ID NO: 56306 - RNA, 23 nt, Artificial Sequence
  RNA Oligomer
ugccuguucuaauaagagagguu

SEQ ID NO: 56307 - RNA, 23 nt, Artificial Sequence
  RNA Oligomer
gccuguucuaauaagagagguuu

SEQ ID NO: 56308 - RNA, 23 nt, Artificial Sequence
  RNA Oligomer
ccuguucuaauaagagagguuug

SEQ ID NO: 56309 - RNA, 23 nt, Artificial Sequence
  RNA Oligomer
aggcuuccgucucuggcauugac

SEQ ID NO: 56310 - RNA, 23 nt, Artificial Sequence
  RNA Oligomer
ggcuuccgucucuggcauugacc

SEQ ID NO: 56311 - RNA, 23 nt, Artificial Sequence
  RNA Oligomer
gcuuccgucucuggcauugaccu

SEQ ID NO: 56312 - RNA, 23 nt, Artificial Sequence
  RNA Oligomer
cuuccgucucuggcauugaccuu

SEQ ID NO: 56313 - RNA, 23 nt, Artificial Sequence
  RNA Oligomer
uuccgucucuggcauugaccuua

SEQ ID NO: 56314 - RNA, 23 nt, Artificial Sequence
  RNA Oligomer
gcaccagcagguaugcugaguca

SEQ ID NO: 56315 - RNA, 23 nt, Artificial Sequence
  RNA Oligomer
caccagcagguaugcugagucau

SEQ ID NO: 56316 - RNA, 23 nt, Artificial Sequence
  RNA Oligomer
accagcagguaugcugagucaug

SEQ ID NO: 56317 - RNA, 23 nt, Artificial Sequence
  RNA Oligomer
ccagcucuuuuauggugggaucc

SEQ ID NO: 56318 - RNA, 23 nt, Artificial Sequence
  RNA Oligomer
cagcucuuuuauggugggauccu

SEQ ID NO: 56319 - RNA, 23 nt, Artificial Sequence
  RNA Oligomer
ugucugaaccuucucugguugca

SEQ ID NO: 56320 - RNA, 23 nt, Artificial Sequence
  RNA Oligomer
gucugaaccuucucugguugcaa

SEQ ID NO: 56321 - RNA, 23 nt, Artificial Sequence
  RNA Oligomer
ucugaaccuucucugguugcaaa

SEQ ID NO: 56322 - RNA, 23 nt, Artificial Sequence
  RNA Oligomer
cugaaccuucucugguugcaaau

SEQ ID NO: 56323 - RNA, 23 nt, Artificial Sequence
  RNA Oligomer
ugaaccuucucugguugcaaauu

SEQ ID NO: 56324 - RNA, 23 nt, Artificial Sequence
  RNA Oligomer
cuuccacacucccaaaagugcug

SEQ ID NO: 56325 - RNA, 23 nt, Artificial Sequence
  RNA Oligomer
uuccacacucccaaaagugcugu

SEQ ID NO: 56326 - RNA, 23 nt, Artificial Sequence
  RNA Oligomer
uccacacucccaaaagugcuguu

SEQ ID NO: 56327 - RNA, 23 nt, Artificial Sequence
  RNA Oligomer
ccacacucccaaaagugcuguuu

SEQ ID NO: 56328 - RNA, 23 nt, Artificial Sequence
  RNA Oligomer
cacacucccaaaagugcuguuuu

SEQ ID NO: 56329 - RNA, 23 nt, Artificial Sequence
  RNA Oligomer
gacgaggaucaggaccaggauac

SEQ ID NO: 56330 - RNA, 23 nt, Artificial Sequence
  RNA Oligomer
acgaggaucaggaccaggauacu

SEQ ID NO: 56331 - RNA, 23 nt, Artificial Sequence
  RNA Oligomer
cgaggaucaggaccaggauacug

SEQ ID NO: 56332 - RNA, 23 nt, Artificial Sequence
  RNA Oligomer
accaugugaggucaucagcaagg

SEQ ID NO: 56333 - RNA, 23 nt, Artificial Sequence
  RNA Oligomer
ccaugugaggucaucagcaaggu

SEQ ID NO: 56334 - RNA, 23 nt, Artificial Sequence
  RNA Oligomer
caugugaggucaucagcaaggua

SEQ ID NO: 56335 - RNA, 23 nt, Artificial Sequence
  RNA Oligomer
aggucaucagcaagguagccuag

SEQ ID NO: 56336 - RNA, 23 nt, Artificial Sequence
  RNA Oligomer
ggucaucagcaagguagccuagc

SEQ ID NO: 56337 - RNA, 23 nt, Artificial Sequence
  RNA Oligomer
gucaucagcaagguagccuagca

SEQ ID NO: 56338 - RNA, 23 nt, Artificial Sequence
  RNA Oligomer
agaugaauccucaggauuuuuca

SEQ ID NO: 56339 - RNA, 23 nt, Artificial Sequence
  RNA Oligomer
uuauggugggauccuggcauaag

SEQ ID NO: 56340 - RNA, 23 nt, Artificial Sequence
  RNA Oligomer
gugucugaaccuucucugguugc

SEQ ID NO: 56341 - RNA, 23 nt, Artificial Sequence
  RNA Oligomer
aguguugaauucaccacaccaug

SEQ ID NO: 56342 - RNA, 23 nt, Artificial Sequence
  RNA Oligomer
guguugaauucaccacaccaugu

SEQ ID NO: 56343 - RNA, 23 nt, Artificial Sequence
  RNA Oligomer
ucuuuuauucugcuccaaagaag

SEQ ID NO: 56344 - RNA, 23 nt, Artificial Sequence
  RNA Oligomer
cuuuuauucugcuccaaagaaga

SEQ ID NO: 56345 - RNA, 23 nt, Artificial Sequence
  RNA Oligomer
uuuuauucugcuccaaagaagaa

SEQ ID NO: 56346 - RNA, 23 nt, Artificial Sequence
  RNA Oligomer
uuuauucugcuccaaagaagaau

SEQ ID NO: 56347 - RNA, 23 nt, Artificial Sequence
  RNA Oligomer
uuauucugcuccaaagaagaauc

SEQ ID NO: 56348 - RNA, 23 nt, Artificial Sequence
  RNA Oligomer
ucuucaguaauguugcaaggaug

SEQ ID NO: 56349 - RNA, 23 nt, Artificial Sequence
  RNA Oligomer
uauuguggaggacccuccaaaau

SEQ ID NO: 56350 - RNA, 23 nt, Artificial Sequence
  RNA Oligomer
ggcucagaucucagaugugcaag

SEQ ID NO: 56351 - RNA, 23 nt, Artificial Sequence
  RNA Oligomer
gcucagaucucagaugugcaaga

SEQ ID NO: 56352 - RNA, 23 nt, Artificial Sequence
  RNA Oligomer
uguagauauucuugcaggaaaau

SEQ ID NO: 56353 - RNA, 23 nt, Artificial Sequence
  RNA Oligomer
uauggugggauccuggcauaagu

SEQ ID NO: 56354 - RNA, 23 nt, Artificial Sequence
  RNA Oligomer
gggauccauugagcaucacaugg

SEQ ID NO: 56355 - RNA, 23 nt, Artificial Sequence
  RNA Oligomer
ggauccauugagcaucacaugga

SEQ ID NO: 56356 - RNA, 23 nt, Artificial Sequence
  RNA Oligomer
gauccauugagcaucacauggac

SEQ ID NO: 56357 - RNA, 23 nt, Artificial Sequence
  RNA Oligomer
uuuuccagaauacugaaacaggg

SEQ ID NO: 56358 - RNA, 23 nt, Artificial Sequence
  RNA Oligomer
uuuccagaauacugaaacagggu

SEQ ID NO: 56359 - RNA, 23 nt, Artificial Sequence
  RNA Oligomer
uuccagaauacugaaacaggguu

SEQ ID NO: 56360 - RNA, 23 nt, Artificial Sequence
  RNA Oligomer
uccagucugggcaagauugauag

SEQ ID NO: 56361 - RNA, 23 nt, Artificial Sequence
  RNA Oligomer
ccagucugggcaagauugauagu

SEQ ID NO: 56362 - RNA, 23 nt, Artificial Sequence
  RNA Oligomer
cagucugggcaagauugauaguu

SEQ ID NO: 56363 - RNA, 23 nt, Artificial Sequence
  RNA Oligomer
agucugggcaagauugauaguuu

SEQ ID NO: 56364 - RNA, 23 nt, Artificial Sequence
  RNA Oligomer
gucugggcaagauugauaguuua

SEQ ID NO: 56365 - RNA, 23 nt, Artificial Sequence
  RNA Oligomer
uugaauucaccacaccaugugag

SEQ ID NO: 56366 - RNA, 23 nt, Artificial Sequence
  RNA Oligomer
ugaauucaccacaccaugugagg

SEQ ID NO: 56367 - RNA, 23 nt, Artificial Sequence
  RNA Oligomer
gaauucaccacaccaugugaggu

SEQ ID NO: 56368 - RNA, 23 nt, Artificial Sequence
  RNA Oligomer
aauucaccacaccaugugagguc

SEQ ID NO: 56369 - RNA, 23 nt, Artificial Sequence
  RNA Oligomer
auucaccacaccaugugagguca

SEQ ID NO: 56370 - RNA, 23 nt, Artificial Sequence
  RNA Oligomer
aaagaagaaucuuguugcaaggu

SEQ ID NO: 56371 - RNA, 23 nt, Artificial Sequence
  RNA Oligomer
agaagaaucuuguugcaagguac

SEQ ID NO: 56372 - RNA, 23 nt, Artificial Sequence
  RNA Oligomer
gaagaaucuuguugcaagguacg

SEQ ID NO: 56373 - RNA, 23 nt, Artificial Sequence
  RNA Oligomer
aagaaucuuguugcaagguacgg

SEQ ID NO: 56374 - RNA, 23 nt, Artificial Sequence
  RNA Oligomer
agaaucuuguugcaagguacggu

SEQ ID NO: 56375 - RNA, 23 nt, Artificial Sequence
  RNA Oligomer
gaaucuuguugcaagguacgguc

SEQ ID NO: 56376 - RNA, 23 nt, Artificial Sequence
  RNA Oligomer
cuucaguaauguugcaaggaugu

SEQ ID NO: 56377 - RNA, 23 nt, Artificial Sequence
  RNA Oligomer
uucaguaauguugcaaggauguu

SEQ ID NO: 56378 - RNA, 23 nt, Artificial Sequence
  RNA Oligomer
acacucccaaaagugcuguuuuu

SEQ ID NO: 56379 - RNA, 23 nt, Artificial Sequence
  RNA Oligomer
cucccaaaagugcuguuuuuguc

SEQ ID NO: 56380 - RNA, 23 nt, Artificial Sequence
  RNA Oligomer
aaccguuuuccagaauacugaaa

SEQ ID NO: 56381 - RNA, 23 nt, Artificial Sequence
  RNA Oligomer
accguuuuccagaauacugaaac

SEQ ID NO: 56382 - RNA, 23 nt, Artificial Sequence
  RNA Oligomer
ccguuuuccagaauacugaaaca

SEQ ID NO: 56383 - RNA, 23 nt, Artificial Sequence
  RNA Oligomer
cguuuuccagaauacugaaacag

SEQ ID NO: 56384 - RNA, 23 nt, Artificial Sequence
  RNA Oligomer
guuuuccagaauacugaaacagg

SEQ ID NO: 56385 - RNA, 23 nt, Artificial Sequence
  RNA Oligomer
uguugaauucaccacaccaugug

SEQ ID NO: 56386 - RNA, 23 nt, Artificial Sequence
  RNA Oligomer
guugaauucaccacaccauguga

SEQ ID NO: 56387 - RNA, 23 nt, Artificial Sequence
  RNA Oligomer
acaaggucauucauuuggaaaug

SEQ ID NO: 56388 - RNA, 23 nt, Artificial Sequence
  RNA Oligomer
uuuucuugacuauugauagauca

SEQ ID NO: 56389 - RNA, 23 nt, Artificial Sequence
  RNA Oligomer
uuucuugacuauugauagaucac

SEQ ID NO: 56390 - RNA, 23 nt, Artificial Sequence
  RNA Oligomer
uucuugacuauugauagaucaca

SEQ ID NO: 56391 - RNA, 23 nt, Artificial Sequence
  RNA Oligomer
ucuugacuauugauagaucacaa

SEQ ID NO: 56392 - RNA, 23 nt, Artificial Sequence
  RNA Oligomer
cuugacuauugauagaucacaau

SEQ ID NO: 56393 - RNA, 23 nt, Artificial Sequence
  RNA Oligomer
aggcuggcuggguucugaaacug

SEQ ID NO: 56394 - RNA, 23 nt, Artificial Sequence
  RNA Oligomer
ggcuggcuggguucugaaacugc

SEQ ID NO: 56395 - RNA, 23 nt, Artificial Sequence
  RNA Oligomer
gcuggcuggguucugaaacugca

SEQ ID NO: 56396 - RNA, 23 nt, Artificial Sequence
  RNA Oligomer
cuggcuggguucugaaacugcac

SEQ ID NO: 56397 - RNA, 23 nt, Artificial Sequence
  RNA Oligomer
uggcuggguucugaaacugcacc

SEQ ID NO: 56398 - RNA, 23 nt, Artificial Sequence
  RNA Oligomer
auggacuuccacacucccaaaag

SEQ ID NO: 56399 - RNA, 23 nt, Artificial Sequence
  RNA Oligomer
ggacuuccacacucccaaaagug

SEQ ID NO: 56400 - RNA, 23 nt, Artificial Sequence
  RNA Oligomer
gacuuccacacucccaaaagugc

SEQ ID NO: 56401 - RNA, 23 nt, Artificial Sequence
  RNA Oligomer
acuuccacacucccaaaagugcu

SEQ ID NO: 56402 - RNA, 23 nt, Artificial Sequence
  RNA Oligomer
ggguuguugcugcaguccuuucu

SEQ ID NO: 56403 - RNA, 23 nt, Artificial Sequence
  RNA Oligomer
gguuguugcugcaguccuuucuc

SEQ ID NO: 56404 - RNA, 23 nt, Artificial Sequence
  RNA Oligomer
uucaccacaccaugugaggucau

SEQ ID NO: 56405 - RNA, 23 nt, Artificial Sequence
  RNA Oligomer
ucaucagcaagguagccuagcag

SEQ ID NO: 56406 - RNA, 23 nt, Artificial Sequence
  RNA Oligomer
caucagcaagguagccuagcagc

SEQ ID NO: 56407 - RNA, 23 nt, Artificial Sequence
  RNA Oligomer
aucagcaagguagccuagcagcg

SEQ ID NO: 56408 - RNA, 23 nt, Artificial Sequence
  RNA Oligomer
uuuacccaugaccaugaaguuua

SEQ ID NO: 56409 - RNA, 23 nt, Artificial Sequence
  RNA Oligomer
uuacccaugaccaugaaguuuau

SEQ ID NO: 56410 - RNA, 23 nt, Artificial Sequence
  RNA Oligomer
uugacuauugauagaucacaaua

SEQ ID NO: 56411 - RNA, 23 nt, Artificial Sequence
  RNA Oligomer
ggcuggguucugaaacugcaccu

SEQ ID NO: 56412 - RNA, 23 nt, Artificial Sequence
  RNA Oligomer
gcuggguucugaaacugcaccuc

SEQ ID NO: 56413 - RNA, 23 nt, Artificial Sequence
  RNA Oligomer
aggguuguugcugcaguccuuuc

SEQ ID NO: 56414 - RNA, 23 nt, Artificial Sequence
  RNA Oligomer
ucaccacaccaugugaggucauc

SEQ ID NO: 56415 - RNA, 23 nt, Artificial Sequence
  RNA Oligomer
caccacaccaugugaggucauca

SEQ ID NO: 56416 - RNA, 23 nt, Artificial Sequence
  RNA Oligomer
accacaccaugugaggucaucag

SEQ ID NO: 56417 - RNA, 23 nt, Artificial Sequence
  RNA Oligomer
ccacaccaugugaggucaucagc

SEQ ID NO: 56418 - RNA, 23 nt, Artificial Sequence
  RNA Oligomer
cacaccaugugaggucaucagca

SEQ ID NO: 56419 - RNA, 23 nt, Artificial Sequence
  RNA Oligomer
acaccaugugaggucaucagcaa

SEQ ID NO: 56420 - RNA, 23 nt, Artificial Sequence
  RNA Oligomer
caccaugugaggucaucagcaag

SEQ ID NO: 56421 - RNA, 23 nt, Artificial Sequence
  RNA Oligomer
ugacuauugauagaucacaauaa

SEQ ID NO: 56422 - RNA, 23 nt, Artificial Sequence
  RNA Oligomer
aagaagaaucuuguugcaaggua

SEQ ID NO: 56423 - RNA, 23 nt, Artificial Sequence
  RNA Oligomer
caggauuuuucacacacugaaga

SEQ ID NO: 56424 - RNA, 23 nt, Artificial Sequence
  RNA Oligomer
aggauuuuucacacacugaagaa

SEQ ID NO: 56425 - RNA, 23 nt, Artificial Sequence
  RNA Oligomer
ggauuuuucacacacugaagaaa

SEQ ID NO: 56426 - RNA, 23 nt, Artificial Sequence
  RNA Oligomer
gauuuuucacacacugaagaaac

SEQ ID NO: 56427 - RNA, 23 nt, Artificial Sequence
  RNA Oligomer
auuuuucacacacugaagaaacu

SEQ ID NO: 56428 - RNA, 23 nt, Artificial Sequence
  RNA Oligomer
aagaugaauccucaggauuuuuc

SEQ ID NO: 56429 - RNA, 23 nt, Artificial Sequence
  RNA Oligomer
uuuuucacacacugaagaaacuu

SEQ ID NO: 56430 - RNA, 23 nt, Artificial Sequence
  RNA Oligomer
ccacaucacaggcagcuucugca

SEQ ID NO: 56431 - RNA, 23 nt, Artificial Sequence
  RNA Oligomer
cacaucacaggcagcuucugcaa

SEQ ID NO: 56432 - RNA, 23 nt, Artificial Sequence
  RNA Oligomer
acaucacaggcagcuucugcaaa

SEQ ID NO: 56433 - RNA, 23 nt, Artificial Sequence
  RNA Oligomer
caucacaggcagcuucugcaaac

SEQ ID NO: 56434 - RNA, 23 nt, Artificial Sequence
  RNA Oligomer
aucacaggcagcuucugcaaacc

SEQ ID NO: 56435 - RNA, 23 nt, Artificial Sequence
  RNA Oligomer
cucuggaaucuucucuuccacca

SEQ ID NO: 56436 - RNA, 23 nt, Artificial Sequence
  RNA Oligomer
ucuggaaucuucucuuccaccau

SEQ ID NO: 56437 - RNA, 23 nt, Artificial Sequence
  RNA Oligomer
cauggaccacaucacaggcagcu

SEQ ID NO: 56438 - RNA, 23 nt, Artificial Sequence
  RNA Oligomer
auggaccacaucacaggcagcuu

SEQ ID NO: 56439 - RNA, 23 nt, Artificial Sequence
  RNA Oligomer
caugagaauuaaagugaaguaac

SEQ ID NO: 56440 - RNA, 23 nt, Artificial Sequence
  RNA Oligomer
ucuugcaggaaaauugaauauuc

SEQ ID NO: 56441 - RNA, 23 nt, Artificial Sequence
  RNA Oligomer
gucaggucuguagauauucuugc

SEQ ID NO: 56442 - RNA, 23 nt, Artificial Sequence
  RNA Oligomer
cuugucaggucuguagauauucu

SEQ ID NO: 56443 - RNA, 23 nt, Artificial Sequence
  RNA Oligomer
ugucaggucuguagauauucuug

SEQ ID NO: 56444 - RNA, 23 nt, Artificial Sequence
  RNA Oligomer
auguaucacccaggccucuagug

SEQ ID NO: 56445 - RNA, 23 nt, Artificial Sequence
  RNA Oligomer
uaaagguaugcugaugauauaag

SEQ ID NO: 56446 - RNA, 23 nt, Artificial Sequence
  RNA Oligomer
caaggauguuuugaaauaaaugc

SEQ ID NO: 56447 - RNA, 23 nt, Artificial Sequence
  RNA Oligomer
auuaguggcugauagucuucuuc

SEQ ID NO: 56448 - RNA, 23 nt, Artificial Sequence
  RNA Oligomer
uuaguggcugauagucuucuuca

SEQ ID NO: 56449 - RNA, 23 nt, Artificial Sequence
  RNA Oligomer
acaaggagucaaggagcuaaaac

SEQ ID NO: 56450 - RNA, 23 nt, Artificial Sequence
  RNA Oligomer
aaaccugcgggaaaccguuuucc

SEQ ID NO: 56451 - RNA, 23 nt, Artificial Sequence
  RNA Oligomer
ugagcaucacauggaccacauca

SEQ ID NO: 56452 - RNA, 23 nt, Artificial Sequence
  RNA Oligomer
aagacagaguugggcucuccuag

SEQ ID NO: 56453 - RNA, 23 nt, Artificial Sequence
  RNA Oligomer
uuucaguguacuugacgcaucgc

SEQ ID NO: 56454 - RNA, 23 nt, Artificial Sequence
  RNA Oligomer
ucucaggaugaauuucaguguac

SEQ ID NO: 56455 - RNA, 23 nt, Artificial Sequence
  RNA Oligomer
auacugacgccaagacagaguug

SEQ ID NO: 56456 - RNA, 23 nt, Artificial Sequence
  RNA Oligomer
aaccugcgggaaaccguuuucca

SEQ ID NO: 56457 - RNA, 23 nt, Artificial Sequence
  RNA Oligomer
uuuuccagaauacugaaacaggg

SEQ ID NO: 56458 - RNA, 23 nt, Artificial Sequence
  RNA Oligomer
aucucaggaugaauuucagugua

SEQ ID NO: 56459 - RNA, 23 nt, Artificial Sequence
  RNA Oligomer
aaaugcacccuugaaagcauccc

SEQ ID NO: 56460 - RNA, 23 nt, Artificial Sequence
  RNA Oligomer
uacugacgccaagacagaguugg

SEQ ID NO: 56461 - RNA, 23 nt, Artificial Sequence
  RNA Oligomer
auugaccuuauuguggaggaccc

SEQ ID NO: 56462 - RNA, 23 nt, Artificial Sequence
  RNA Oligomer
aauacugaaacaggguuguugcu

SEQ ID NO: 56463 - RNA, 23 nt, Artificial Sequence
  RNA Oligomer
aaguuuaugguuugacuaucugu

SEQ ID NO: 56464 - RNA, 23 nt, Artificial Sequence
  RNA Oligomer
uuuaugguuugacuaucuguagg

SEQ ID NO: 56465 - RNA, 23 nt, Artificial Sequence
  RNA Oligomer
cuugcaggaaaauugaauauucc

SEQ ID NO: 56466 - RNA, 23 nt, Artificial Sequence
  RNA Oligomer
ugucucaucucaggaugaauuuc

SEQ ID NO: 56467 - RNA, 23 nt, Artificial Sequence
  RNA Oligomer
cucuggcauugaccuuauugugg

SEQ ID NO: 56468 - RNA, 23 nt, Artificial Sequence
  RNA Oligomer
uugcaggaaaauugaauauuccu

SEQ ID NO: 56469 - RNA, 23 nt, Artificial Sequence
  RNA Oligomer
uuuggcagucuacaugucucauc

SEQ ID NO: 56470 - RNA, 23 nt, Artificial Sequence
  RNA Oligomer
cuccaaagaagaaucuuguugca

SEQ ID NO: 56471 - RNA, 23 nt, Artificial Sequence
  RNA Oligomer
uucauuaguggcugauagucuuc

SEQ ID NO: 56472 - RNA, 23 nt, Artificial Sequence
  RNA Oligomer
guuuaugguuugacuaucuguag

SEQ ID NO: 56473 - RNA, 23 nt, Artificial Sequence
  RNA Oligomer
cauugaccuuauuguggaggacc

SEQ ID NO: 56474 - RNA, 23 nt, Artificial Sequence
  RNA Oligomer
uaugcugagucauguaugaugac

SEQ ID NO: 56475 - RNA, 23 nt, Artificial Sequence
  RNA Oligomer
uucaguguacuugacgcaucgcg

SEQ ID NO: 56476 - RNA, 23 nt, Artificial Sequence
  RNA Oligomer
ucauuaguggcugauagucuucu

SEQ ID NO: 56477 - RNA, 23 nt, Artificial Sequence
  RNA Oligomer
acccaugaccaugaaguuuaugg

SEQ ID NO: 56478 - RNA, 23 nt, Artificial Sequence
  RNA Oligomer
augaccaugaaguuuaugguuug

SEQ ID NO: 56479 - RNA, 23 nt, Artificial Sequence
  RNA Oligomer
uaaaccacaaggagucaaggagc

SEQ ID NO: 56480 - RNA, 23 nt, Artificial Sequence
  RNA Oligomer
agaauacugaaacaggguuguug

SEQ ID NO: 56481 - RNA, 23 nt, Artificial Sequence
  RNA Oligomer
auuucaguguacuugacgcaucg

SEQ ID NO: 56482 - RNA, 23 nt, Artificial Sequence
  RNA Oligomer
augguuugacuaucuguaggaag

SEQ ID NO: 56483 - RNA, 23 nt, Artificial Sequence
  RNA Oligomer
uugacuaucuguaggaaggguac

SEQ ID NO: 56484 - RNA, 23 nt, Artificial Sequence
  RNA Oligomer
gugauuuuucaauagaaaggaug

SEQ ID NO: 56485 - RNA, 23 nt, Artificial Sequence
  RNA Oligomer
cagguaugcugagucauguauga

SEQ ID NO: 56486 - RNA, 23 nt, Artificial Sequence
  RNA Oligomer
augcugagucauguaugaugaca

SEQ ID NO: 56487 - RNA, 23 nt, Artificial Sequence
  RNA Oligomer
caggucuguagauauucuugcag

SEQ ID NO: 56488 - RNA, 23 nt, Artificial Sequence
  RNA Oligomer
ucgauuccagcucuuuuauggug

SEQ ID NO: 56489 - RNA, 23 nt, Artificial Sequence
  RNA Oligomer
uuuuauucugcuccaaagaagaa

SEQ ID NO: 56490 - RNA, 23 nt, Artificial Sequence
  RNA Oligomer
aagaaucuuguugcaagguacgg

SEQ ID NO: 56491 - RNA, 23 nt, Artificial Sequence
  RNA Oligomer
uaucuguaggaaggguacaaaaa

SEQ ID NO: 56492 - RNA, 23 nt, Artificial Sequence
  RNA Oligomer
uuucuugacuauugauagaucac

SEQ ID NO: 56493 - RNA, 23 nt, Artificial Sequence
  RNA Oligomer
uucuugacuauugauagaucaca

SEQ ID NO: 56494 - RNA, 23 nt, Artificial Sequence
  RNA Oligomer
aaaggcuuccgucucuggcauug

SEQ ID NO: 56495 - RNA, 23 nt, Artificial Sequence
  RNA Oligomer
aggucuguagauauucuugcagg

SEQ ID NO: 56496 - RNA, 23 nt, Artificial Sequence
  RNA Oligomer
aaacaggguuguugcugcagucc

SEQ ID NO: 56497 - RNA, 23 nt, Artificial Sequence
  RNA Oligomer
gaaguuuaugguuugacuaucug

SEQ ID NO: 56498 - RNA, 23 nt, Artificial Sequence
  RNA Oligomer
agucauguaugaugacauaaacc

SEQ ID NO: 56499 - RNA, 23 nt, Artificial Sequence
  RNA Oligomer
uggugggauccuggcauaagucu

SEQ ID NO: 56500 - RNA, 23 nt, Artificial Sequence
  RNA Oligomer
ucacaggcagcuucugcaaaccu

SEQ ID NO: 56501 - RNA, 23 nt, Artificial Sequence
  RNA Oligomer
uggaaguguugaauucaccacac

SEQ ID NO: 56502 - RNA, 23 nt, Artificial Sequence
  RNA Oligomer
gaaguguugaauucaccacacca

SEQ ID NO: 56503 - RNA, 23 nt, Artificial Sequence
  RNA Oligomer
uuaugguuugacuaucuguagga

SEQ ID NO: 56504 - RNA, 23 nt, Artificial Sequence
  RNA Oligomer
augcaacaaggucauucauuugg

SEQ ID NO: 56505 - RNA, 23 nt, Artificial Sequence
  RNA Oligomer
gucauguaugaugacauaaacca

SEQ ID NO: 56506 - RNA, 23 nt, Artificial Sequence
  RNA Oligomer
aaacaaccacagcgacuggcuca

SEQ ID NO: 56507 - RNA, 23 nt, Artificial Sequence
  RNA Oligomer
gauuccagcucuuuuaugguggg

SEQ ID NO: 56508 - RNA, 23 nt, Artificial Sequence
  RNA Oligomer
auuccagcucuuuuaugguggga

SEQ ID NO: 56509 - RNA, 23 nt, Artificial Sequence
  RNA Oligomer
aucacaggcagcuucugcaaacc

SEQ ID NO: 56510 - RNA, 23 nt, Artificial Sequence
  RNA Oligomer
uacugaaacaggguuguugcugc

SEQ ID NO: 56511 - RNA, 23 nt, Artificial Sequence
  RNA Oligomer
uuuggaaguguugaauucaccac

SEQ ID NO: 56512 - RNA, 23 nt, Artificial Sequence
  RNA Oligomer
uugaauucaccacaccaugugag

SEQ ID NO: 56513 - RNA, 23 nt, Artificial Sequence
  RNA Oligomer
uacggucugaguucccaacuuca

SEQ ID NO: 56514 - RNA, 23 nt, Artificial Sequence
  RNA Oligomer
uaguggcugauagucuucuucag

SEQ ID NO: 56515 - RNA, 23 nt, Artificial Sequence
  RNA Oligomer
cauguaugaugacauaaaccaca

SEQ ID NO: 56516 - RNA, 23 nt, Artificial Sequence
  RNA Oligomer
gaauccucaggauuuuucacaca

SEQ ID NO: 56517 - RNA, 23 nt, Artificial Sequence
  RNA Oligomer
gaauacugaaacaggguuguugc

SEQ ID NO: 56518 - RNA, 23 nt, Artificial Sequence
  RNA Oligomer
auacugaaacaggguuguugcug

SEQ ID NO: 56519 - RNA, 23 nt, Artificial Sequence
  RNA Oligomer
gugugaacugaugggccagaucu

SEQ ID NO: 56520 - RNA, 23 nt, Artificial Sequence
  RNA Oligomer
ugcuccaaagaagaaucuuguug

SEQ ID NO: 56521 - RNA, 23 nt, Artificial Sequence
  RNA Oligomer
ugaccaugaaguuuaugguuuga

SEQ ID NO: 56522 - RNA, 23 nt, Artificial Sequence
  RNA Oligomer
ugguuugacuaucuguaggaagg

SEQ ID NO: 56523 - RNA, 23 nt, Artificial Sequence
  RNA Oligomer
uggcauugaccuuauuguggagg

SEQ ID NO: 56524 - RNA, 23 nt, Artificial Sequence
  RNA Oligomer
guggaggacccuccaaaaucuuc

SEQ ID NO: 56525 - RNA, 23 nt, Artificial Sequence
  RNA Oligomer
augacauaaaccacaaggaguca

SEQ ID NO: 56526 - RNA, 23 nt, Artificial Sequence
  RNA Oligomer
cagcucuuuuauggugggauccu

SEQ ID NO: 56527 - RNA, 23 nt, Artificial Sequence
  RNA Oligomer
uuuauggugggauccuggcauaa

SEQ ID NO: 56528 - RNA, 23 nt, Artificial Sequence
  RNA Oligomer
uuauggugggauccuggcauaag

SEQ ID NO: 56529 - RNA, 23 nt, Artificial Sequence
  RNA Oligomer
auggugggauccuggcauaaguc

SEQ ID NO: 56530 - RNA, 23 nt, Artificial Sequence
  RNA Oligomer
gcaagauugauaguuuauuuugg

SEQ ID NO: 56531 - RNA, 23 nt, Artificial Sequence
  RNA Oligomer
guguugaauucaccacaccaugu

SEQ ID NO: 56532 - RNA, 23 nt, Artificial Sequence
  RNA Oligomer
gaauucaccacaccaugugaggu

SEQ ID NO: 56533 - RNA, 23 nt, Artificial Sequence
  RNA Oligomer
auucaccacaccaugugagguca

SEQ ID NO: 56534 - RNA, 23 nt, Artificial Sequence
  RNA Oligomer
caugaccaugaaguuuaugguuu

SEQ ID NO: 56535 - RNA, 23 nt, Artificial Sequence
  RNA Oligomer
uaugguuugacuaucuguaggaa

SEQ ID NO: 56536 - RNA, 23 nt, Artificial Sequence
  RNA Oligomer
guuugacuaucuguaggaagggu

SEQ ID NO: 56537 - RNA, 23 nt, Artificial Sequence
  RNA Oligomer
guggugauuuuucaauagaaagg

SEQ ID NO: 56538 - RNA, 23 nt, Artificial Sequence
  RNA Oligomer
uguaucacccaggccucuagugu

SEQ ID NO: 56539 - RNA, 23 nt, Artificial Sequence
  RNA Oligomer
gcaacaaccucaaaaucaaucaa

SEQ ID NO: 56540 - RNA, 23 nt, Artificial Sequence
  RNA Oligomer
agcaacaaccucaaaaucaauca

SEQ ID NO: 56541 - RNA, 23 nt, Artificial Sequence
  RNA Oligomer
cagcaacaaccucaaaaucaauc

SEQ ID NO: 56542 - RNA, 23 nt, Artificial Sequence
  RNA Oligomer
ucagcaacaaccucaaaaucaau

SEQ ID NO: 56543 - RNA, 23 nt, Artificial Sequence
  RNA Oligomer
aucagcaacaaccucaaaaucaa

SEQ ID NO: 56544 - RNA, 23 nt, Artificial Sequence
  RNA Oligomer
gcauagaugaucgaaaauuacgg

SEQ ID NO: 56545 - RNA, 23 nt, Artificial Sequence
  RNA Oligomer
ugcauagaugaucgaaaauuacg

SEQ ID NO: 56546 - RNA, 23 nt, Artificial Sequence
  RNA Oligomer
augcauagaugaucgaaaauuac

SEQ ID NO: 56547 - RNA, 23 nt, Artificial Sequence
  RNA Oligomer
aaugcauagaugaucgaaaauua

SEQ ID NO: 56548 - RNA, 23 nt, Artificial Sequence
  RNA Oligomer
caaugcauagaugaucgaaaauu

SEQ ID NO: 56549 - RNA, 23 nt, Artificial Sequence
  RNA Oligomer
gcaaaauccaauagaaguauugc

SEQ ID NO: 56550 - RNA, 23 nt, Artificial Sequence
  RNA Oligomer
ugcaaaauccaauagaaguauug

SEQ ID NO: 56551 - RNA, 23 nt, Artificial Sequence
  RNA Oligomer
uugcaaaauccaauagaaguauu

SEQ ID NO: 56552 - RNA, 23 nt, Artificial Sequence
  RNA Oligomer
cuugcaaaauccaauagaaguau

SEQ ID NO: 56553 - RNA, 23 nt, Artificial Sequence
  RNA Oligomer
ucuugcaaaauccaauagaagua

SEQ ID NO: 56554 - RNA, 23 nt, Artificial Sequence
  RNA Oligomer
ggauauuguucguaaucuuggac

SEQ ID NO: 56555 - RNA, 23 nt, Artificial Sequence
  RNA Oligomer
uggauauuguucguaaucuugga

SEQ ID NO: 56556 - RNA, 23 nt, Artificial Sequence
  RNA Oligomer
auggauauuguucguaaucuugg

SEQ ID NO: 56557 - RNA, 23 nt, Artificial Sequence
  RNA Oligomer
gauggauauuguucguaaucuug

SEQ ID NO: 56558 - RNA, 23 nt, Artificial Sequence
  RNA Oligomer
ugauggauauuguucguaaucuu

SEQ ID NO: 56559 - RNA, 23 nt, Artificial Sequence
  RNA Oligomer
ccauuucuaaagugaccuuauca

SEQ ID NO: 56560 - RNA, 23 nt, Artificial Sequence
  RNA Oligomer
gccauuucuaaagugaccuuauc

SEQ ID NO: 56561 - RNA, 23 nt, Artificial Sequence
  RNA Oligomer
agccauuucuaaagugaccuuau

SEQ ID NO: 56562 - RNA, 23 nt, Artificial Sequence
  RNA Oligomer
aagccauuucuaaagugaccuua

SEQ ID NO: 56563 - RNA, 23 nt, Artificial Sequence
  RNA Oligomer
caagccauuucuaaagugaccuu

SEQ ID NO: 56564 - RNA, 23 nt, Artificial Sequence
  RNA Oligomer
ccauuguagauugucuuuuuuau

SEQ ID NO: 56565 - RNA, 23 nt, Artificial Sequence
  RNA Oligomer
accauuguagauugucuuuuuua

SEQ ID NO: 56566 - RNA, 23 nt, Artificial Sequence
  RNA Oligomer
caccauuguagauugucuuuuuu

SEQ ID NO: 56567 - RNA, 23 nt, Artificial Sequence
  RNA Oligomer
gcaccauuguagauugucuuuuu

SEQ ID NO: 56568 - RNA, 23 nt, Artificial Sequence
  RNA Oligomer
cgcaccauuguagauugucuuuu

SEQ ID NO: 56569 - RNA, 23 nt, Artificial Sequence
  RNA Oligomer
ccuuauuaaacauguagacuaua

SEQ ID NO: 56570 - RNA, 23 nt, Artificial Sequence
  RNA Oligomer
uccuuauuaaacauguagacuau

SEQ ID NO: 56571 - RNA, 23 nt, Artificial Sequence
  RNA Oligomer
uuccuuauuaaacauguagacua

SEQ ID NO: 56572 - RNA, 23 nt, Artificial Sequence
  RNA Oligomer
uuuccuuauuaaacauguagacu

SEQ ID NO: 56573 - RNA, 23 nt, Artificial Sequence
  RNA Oligomer
cuuuccuuauuaaacauguagac

SEQ ID NO: 56574 - RNA, 23 nt, Artificial Sequence
  RNA Oligomer
gcagaagucuugagcuauucaga

SEQ ID NO: 56575 - RNA, 23 nt, Artificial Sequence
  RNA Oligomer
ugcagaagucuugagcuauucag

SEQ ID NO: 56576 - RNA, 23 nt, Artificial Sequence
  RNA Oligomer
gugcagaagucuugagcuauuca

SEQ ID NO: 56577 - RNA, 23 nt, Artificial Sequence
  RNA Oligomer
ggugcagaagucuugagcuauuc

SEQ ID NO: 56578 - RNA, 23 nt, Artificial Sequence
  RNA Oligomer
uggugcagaagucuugagcuauu

SEQ ID NO: 56579 - RNA, 23 nt, Artificial Sequence
  RNA Oligomer
ccacugauaaaggcuuuauuagg

SEQ ID NO: 56580 - RNA, 23 nt, Artificial Sequence
  RNA Oligomer
accacugauaaaggcuuuauuag

SEQ ID NO: 56581 - RNA, 23 nt, Artificial Sequence
  RNA Oligomer
gaccacugauaaaggcuuuauua

SEQ ID NO: 56582 - RNA, 23 nt, Artificial Sequence
  RNA Oligomer
ugaccacugauaaaggcuuuauu

SEQ ID NO: 56583 - RNA, 23 nt, Artificial Sequence
  RNA Oligomer
gugaccacugauaaaggcuuuau

SEQ ID NO: 56584 - RNA, 23 nt, Artificial Sequence
  RNA Oligomer
cccaggcaauacucaagaaggag

SEQ ID NO: 56585 - RNA, 23 nt, Artificial Sequence
  RNA Oligomer
acccaggcaauacucaagaagga

SEQ ID NO: 56586 - RNA, 23 nt, Artificial Sequence
  RNA Oligomer
uacccaggcaauacucaagaagg

SEQ ID NO: 56587 - RNA, 23 nt, Artificial Sequence
  RNA Oligomer
uuacccaggcaauacucaagaag

SEQ ID NO: 56588 - RNA, 23 nt, Artificial Sequence
  RNA Oligomer
guuacccaggcaauacucaagaa

SEQ ID NO: 56589 - RNA, 23 nt, Artificial Sequence
  RNA Oligomer
gcguuuauuuauaacugguugca

SEQ ID NO: 56590 - RNA, 23 nt, Artificial Sequence
  RNA Oligomer
ugcguuuauuuauaacugguugc

SEQ ID NO: 56591 - RNA, 23 nt, Artificial Sequence
  RNA Oligomer
uugcguuuauuuauaacugguug

SEQ ID NO: 56592 - RNA, 23 nt, Artificial Sequence
  RNA Oligomer
uuugcguuuauuuauaacugguu

SEQ ID NO: 56593 - RNA, 23 nt, Artificial Sequence
  RNA Oligomer
auuugcguuuauuuauaacuggu

SEQ ID NO: 56594 - RNA, 23 nt, Artificial Sequence
  RNA Oligomer
gccaagccauuucuaaagugacc

SEQ ID NO: 56595 - RNA, 23 nt, Artificial Sequence
  RNA Oligomer
ugccaagccauuucuaaagugac

SEQ ID NO: 56596 - RNA, 23 nt, Artificial Sequence
  RNA Oligomer
uugccaagccauuucuaaaguga

SEQ ID NO: 56597 - RNA, 23 nt, Artificial Sequence
  RNA Oligomer
guugccaagccauuucuaaagug

SEQ ID NO: 56598 - RNA, 23 nt, Artificial Sequence
  RNA Oligomer
uguugccaagccauuucuaaagu

SEQ ID NO: 56599 - RNA, 23 nt, Artificial Sequence
  RNA Oligomer
caacaauccaggauauuuuucua

SEQ ID NO: 56600 - RNA, 23 nt, Artificial Sequence
  RNA Oligomer
ucaacaauccaggauauuuuucu

SEQ ID NO: 56601 - RNA, 23 nt, Artificial Sequence
  RNA Oligomer
aucaacaauccaggauauuuuuc

SEQ ID NO: 56602 - RNA, 23 nt, Artificial Sequence
  RNA Oligomer
caucaacaauccaggauauuuuu

SEQ ID NO: 56603 - RNA, 23 nt, Artificial Sequence
  RNA Oligomer
acaucaacaauccaggauauuuu

SEQ ID NO: 56604 - RNA, 23 nt, Artificial Sequence
  RNA Oligomer
aacaucaacaauccaggauauuu

SEQ ID NO: 56605 - RNA, 23 nt, Artificial Sequence
  RNA Oligomer
caacaucaacaauccaggauauu

SEQ ID NO: 56606 - RNA, 23 nt, Artificial Sequence
  RNA Oligomer
acaacaucaacaauccaggauau

SEQ ID NO: 56607 - RNA, 23 nt, Artificial Sequence
  RNA Oligomer
aacaacaucaacaauccaggaua

SEQ ID NO: 56608 - RNA, 23 nt, Artificial Sequence
  RNA Oligomer
gcaucauaaucauagcaauccac

SEQ ID NO: 56609 - RNA, 23 nt, Artificial Sequence
  RNA Oligomer
ggcaucauaaucauagcaaucca

SEQ ID NO: 56610 - RNA, 23 nt, Artificial Sequence
  RNA Oligomer
uggcaucauaaucauagcaaucc

SEQ ID NO: 56611 - RNA, 23 nt, Artificial Sequence
  RNA Oligomer
cuggcaucauaaucauagcaauc

SEQ ID NO: 56612 - RNA, 23 nt, Artificial Sequence
  RNA Oligomer
ucuggcaucauaaucauagcaau

SEQ ID NO: 56613 - RNA, 23 nt, Artificial Sequence
  RNA Oligomer
gcacugaguuuggcauuuuucug

SEQ ID NO: 56614 - RNA, 23 nt, Artificial Sequence
  RNA Oligomer
ggcacugaguuuggcauuuuucu

SEQ ID NO: 56615 - RNA, 23 nt, Artificial Sequence
  RNA Oligomer
aggcacugaguuuggcauuuuuc

SEQ ID NO: 56616 - RNA, 23 nt, Artificial Sequence
  RNA Oligomer
aaggcacugaguuuggcauuuuu

SEQ ID NO: 56617 - RNA, 23 nt, Artificial Sequence
  RNA Oligomer
aaaggcacugaguuuggcauuuu

SEQ ID NO: 56618 - RNA, 23 nt, Artificial Sequence
  RNA Oligomer
ccuuccuucauguccucuacaca

SEQ ID NO: 56619 - RNA, 23 nt, Artificial Sequence
  RNA Oligomer
gccuuccuucauguccucuacac

SEQ ID NO: 56620 - RNA, 23 nt, Artificial Sequence
  RNA Oligomer
ugccuuccuucauguccucuaca

SEQ ID NO: 56621 - RNA, 23 nt, Artificial Sequence
  RNA Oligomer
uugccuuccuucauguccucuac

SEQ ID NO: 56622 - RNA, 23 nt, Artificial Sequence
  RNA Oligomer
uuugccuuccuucauguccucua

SEQ ID NO: 56623 - RNA, 23 nt, Artificial Sequence
  RNA Oligomer
cccuuauguuuaugaaaagaaag

SEQ ID NO: 56624 - RNA, 23 nt, Artificial Sequence
  RNA Oligomer
acccuuauguuuaugaaaagaaa

SEQ ID NO: 56625 - RNA, 23 nt, Artificial Sequence
  RNA Oligomer
uacccuuauguuuaugaaaagaa

SEQ ID NO: 56626 - RNA, 23 nt, Artificial Sequence
  RNA Oligomer
cuacccuuauguuuaugaaaaga

SEQ ID NO: 56627 - RNA, 23 nt, Artificial Sequence
  RNA Oligomer
ucuacccuuauguuuaugaaaag

SEQ ID NO: 56628 - RNA, 23 nt, Artificial Sequence
  RNA Oligomer
caaaccucuuuccuuauuaaaca

SEQ ID NO: 56629 - RNA, 23 nt, Artificial Sequence
  RNA Oligomer
ucaaaccucuuuccuuauuaaac

SEQ ID NO: 56630 - RNA, 23 nt, Artificial Sequence
  RNA Oligomer
uucaaaccucuuuccuuauuaaa

SEQ ID NO: 56631 - RNA, 23 nt, Artificial Sequence
  RNA Oligomer
uuucaaaccucuuuccuuauuaa

SEQ ID NO: 56632 - RNA, 23 nt, Artificial Sequence
  RNA Oligomer
uuuucaaaccucuuuccuuauua

SEQ ID NO: 56633 - RNA, 23 nt, Artificial Sequence
  RNA Oligomer
gucuggcaucauaaucauagcaa

SEQ ID NO: 56634 - RNA, 23 nt, Artificial Sequence
  RNA Oligomer
ccaggcaauacucaagaaggaga

SEQ ID NO: 56635 - RNA, 23 nt, Artificial Sequence
  RNA Oligomer
gcaagagacuguauguauuuuug

SEQ ID NO: 56636 - RNA, 23 nt, Artificial Sequence
  RNA Oligomer
agcaagagacuguauguauuuuu

SEQ ID NO: 56637 - RNA, 23 nt, Artificial Sequence
  RNA Oligomer
aagcaagagacuguauguauuuu

SEQ ID NO: 56638 - RNA, 23 nt, Artificial Sequence
  RNA Oligomer
aaagcaagagacuguauguauuu

SEQ ID NO: 56639 - RNA, 23 nt, Artificial Sequence
  RNA Oligomer
aaaagcaagagacuguauguauu

SEQ ID NO: 56640 - RNA, 23 nt, Artificial Sequence
  RNA Oligomer
aucuacccuuauguuuaugaaaa

SEQ ID NO: 56641 - RNA, 23 nt, Artificial Sequence
  RNA Oligomer
aaucuacccuuauguuuaugaaa

SEQ ID NO: 56642 - RNA, 23 nt, Artificial Sequence
  RNA Oligomer
uaaucuacccuuauguuuaugaa

SEQ ID NO: 56643 - RNA, 23 nt, Artificial Sequence
  RNA Oligomer
cagaaucuaaugcagaguaccuu

SEQ ID NO: 56644 - RNA, 23 nt, Artificial Sequence
  RNA Oligomer
ccagaaucuaaugcagaguaccu

SEQ ID NO: 56645 - RNA, 23 nt, Artificial Sequence
  RNA Oligomer
uccagaaucuaaugcagaguacc

SEQ ID NO: 56646 - RNA, 23 nt, Artificial Sequence
  RNA Oligomer
auccagaaucuaaugcagaguac

SEQ ID NO: 56647 - RNA, 23 nt, Artificial Sequence
  RNA Oligomer
uauccagaaucuaaugcagagua

SEQ ID NO: 56648 - RNA, 23 nt, Artificial Sequence
  RNA Oligomer
auauccagaaucuaaugcagagu

SEQ ID NO: 56649 - RNA, 23 nt, Artificial Sequence
  RNA Oligomer
caaccucaaaaucaaucaauauc

SEQ ID NO: 56650 - RNA, 23 nt, Artificial Sequence
  RNA Oligomer
acaaccucaaaaucaaucaauau

SEQ ID NO: 56651 - RNA, 23 nt, Artificial Sequence
  RNA Oligomer
aacaaccucaaaaucaaucaaua

SEQ ID NO: 56652 - RNA, 23 nt, Artificial Sequence
  RNA Oligomer
caacaaccucaaaaucaaucaau

SEQ ID NO: 56653 - RNA, 23 nt, Artificial Sequence
  RNA Oligomer
ggaugauggcuuuuauaaaugug

SEQ ID NO: 56654 - RNA, 23 nt, Artificial Sequence
  RNA Oligomer
gggaugauggcuuuuauaaaugu

SEQ ID NO: 56655 - RNA, 23 nt, Artificial Sequence
  RNA Oligomer
agggaugauggcuuuuauaaaug

SEQ ID NO: 56656 - RNA, 23 nt, Artificial Sequence
  RNA Oligomer
aagggaugauggcuuuuauaaau

SEQ ID NO: 56657 - RNA, 23 nt, Artificial Sequence
  RNA Oligomer
uaagggaugauggcuuuuauaaa

SEQ ID NO: 56658 - RNA, 23 nt, Artificial Sequence
  RNA Oligomer
gaacuguauuccuuuuaacagau

SEQ ID NO: 56659 - RNA, 23 nt, Artificial Sequence
  RNA Oligomer
cgaacuguauuccuuuuaacaga

SEQ ID NO: 56660 - RNA, 23 nt, Artificial Sequence
  RNA Oligomer
gcgaacuguauuccuuuuaacag

SEQ ID NO: 56661 - RNA, 23 nt, Artificial Sequence
  RNA Oligomer
ggcgaacuguauuccuuuuaaca

SEQ ID NO: 56662 - RNA, 23 nt, Artificial Sequence
  RNA Oligomer
gggcgaacuguauuccuuuuaac

SEQ ID NO: 56663 - RNA, 23 nt, Artificial Sequence
  RNA Oligomer
ccaguuuacuuaagguagaaaga

SEQ ID NO: 56664 - RNA, 23 nt, Artificial Sequence
  RNA Oligomer
uccaguuuacuuaagguagaaag

SEQ ID NO: 56665 - RNA, 23 nt, Artificial Sequence
  RNA Oligomer
cuccaguuuacuuaagguagaaa

SEQ ID NO: 56666 - RNA, 23 nt, Artificial Sequence
  RNA Oligomer
ccuccaguuuacuuaagguagaa

SEQ ID NO: 56667 - RNA, 23 nt, Artificial Sequence
  RNA Oligomer
uccuccaguuuacuuaagguaga

SEQ ID NO: 56668 - RNA, 23 nt, Artificial Sequence
  RNA Oligomer
ccauauuaacacagcugacuccu

SEQ ID NO: 56669 - RNA, 23 nt, Artificial Sequence
  RNA Oligomer
accauauuaacacagcugacucc

SEQ ID NO: 56670 - RNA, 23 nt, Artificial Sequence
  RNA Oligomer
gaccauauuaacacagcugacuc

SEQ ID NO: 56671 - RNA, 23 nt, Artificial Sequence
  RNA Oligomer
ugaccauauuaacacagcugacu

SEQ ID NO: 56672 - RNA, 23 nt, Artificial Sequence
  RNA Oligomer
uugaccauauuaacacagcugac

SEQ ID NO: 56673 - RNA, 23 nt, Artificial Sequence
  RNA Oligomer
ugguagacaucagcaacaaccuc

SEQ ID NO: 56674 - RNA, 23 nt, Artificial Sequence
  RNA Oligomer
uugguagacaucagcaacaaccu

SEQ ID NO: 56675 - RNA, 23 nt, Artificial Sequence
  RNA Oligomer
auugguagacaucagcaacaacc

SEQ ID NO: 56676 - RNA, 23 nt, Artificial Sequence
  RNA Oligomer
uauugguagacaucagcaacaac

SEQ ID NO: 56677 - RNA, 23 nt, Artificial Sequence
  RNA Oligomer
auauugguagacaucagcaacaa

SEQ ID NO: 56678 - RNA, 23 nt, Artificial Sequence
  RNA Oligomer
ccaugcucuuuuuguuaaagaag

SEQ ID NO: 56679 - RNA, 23 nt, Artificial Sequence
  RNA Oligomer
accaugcucuuuuuguuaaagaa

SEQ ID NO: 56680 - RNA, 23 nt, Artificial Sequence
  RNA Oligomer
aaccaugcucuuuuuguuaaaga

SEQ ID NO: 56681 - RNA, 23 nt, Artificial Sequence
  RNA Oligomer
uaaccaugcucuuuuuguuaaag

SEQ ID NO: 56682 - RNA, 23 nt, Artificial Sequence
  RNA Oligomer
uuaaccaugcucuuuuuguuaaa

SEQ ID NO: 56683 - RNA, 23 nt, Artificial Sequence
  RNA Oligomer
ggauacugcucuuuuacuugagc

SEQ ID NO: 56684 - RNA, 23 nt, Artificial Sequence
  RNA Oligomer
uggauacugcucuuuuacuugag

SEQ ID NO: 56685 - RNA, 23 nt, Artificial Sequence
  RNA Oligomer
cuggauacugcucuuuuacuuga

SEQ ID NO: 56686 - RNA, 23 nt, Artificial Sequence
  RNA Oligomer
gcuggauacugcucuuuuacuug

SEQ ID NO: 56687 - RNA, 23 nt, Artificial Sequence
  RNA Oligomer
ggcuggauacugcucuuuuacuu

SEQ ID NO: 56688 - RNA, 23 nt, Artificial Sequence
  RNA Oligomer
ucgcaccauuguagauugucuuu

SEQ ID NO: 56689 - RNA, 23 nt, Artificial Sequence
  RNA Oligomer
aucgcaccauuguagauugucuu

SEQ ID NO: 56690 - RNA, 23 nt, Artificial Sequence
  RNA Oligomer
caucgcaccauuguagauugucu

SEQ ID NO: 56691 - RNA, 23 nt, Artificial Sequence
  RNA Oligomer
uuuuucaaaccucuuuccuuauu

SEQ ID NO: 56692 - RNA, 23 nt, Artificial Sequence
  RNA Oligomer
ccagaauuuuagacagcaagcua

SEQ ID NO: 56693 - RNA, 23 nt, Artificial Sequence
  RNA Oligomer
accagaauuuuagacagcaagcu

SEQ ID NO: 56694 - RNA, 23 nt, Artificial Sequence
  RNA Oligomer
aaccagaauuuuagacagcaagc

SEQ ID NO: 56695 - RNA, 23 nt, Artificial Sequence
  RNA Oligomer
aaaccagaauuuuagacagcaag

SEQ ID NO: 56696 - RNA, 23 nt, Artificial Sequence
  RNA Oligomer
gaaaccagaauuuuagacagcaa

SEQ ID NO: 56697 - RNA, 23 nt, Artificial Sequence
  RNA Oligomer
gcauguaauucuuccucuauaaa

SEQ ID NO: 56698 - RNA, 23 nt, Artificial Sequence
  RNA Oligomer
ggcauguaauucuuccucuauaa

SEQ ID NO: 56699 - RNA, 23 nt, Artificial Sequence
  RNA Oligomer
uggcauguaauucuuccucuaua

SEQ ID NO: 56700 - RNA, 23 nt, Artificial Sequence
  RNA Oligomer
cuggcauguaauucuuccucuau

SEQ ID NO: 56701 - RNA, 23 nt, Artificial Sequence
  RNA Oligomer
gcuggcauguaauucuuccucua

SEQ ID NO: 56702 - RNA, 23 nt, Artificial Sequence
  RNA Oligomer
ggcuuuauuagguauaucugagg

SEQ ID NO: 56703 - RNA, 23 nt, Artificial Sequence
  RNA Oligomer
aggcuuuauuagguauaucugag

SEQ ID NO: 56704 - RNA, 23 nt, Artificial Sequence
  RNA Oligomer
aaggcuuuauuagguauaucuga

SEQ ID NO: 56705 - RNA, 23 nt, Artificial Sequence
  RNA Oligomer
aaaggcuuuauuagguauaucug

SEQ ID NO: 56706 - RNA, 23 nt, Artificial Sequence
  RNA Oligomer
uaaaggcuuuauuagguauaucu

SEQ ID NO: 56707 - RNA, 23 nt, Artificial Sequence
  RNA Oligomer
cacugauaaaggcuuuauuaggu

SEQ ID NO: 56708 - RNA, 23 nt, Artificial Sequence
  RNA Oligomer
acauuucguauggcuauuuccau

SEQ ID NO: 56709 - RNA, 23 nt, Artificial Sequence
  RNA Oligomer
uacauuucguauggcuauuucca

SEQ ID NO: 56710 - RNA, 23 nt, Artificial Sequence
  RNA Oligomer
auacauuucguauggcuauuucc

SEQ ID NO: 56711 - RNA, 23 nt, Artificial Sequence
  RNA Oligomer
aauacauuucguauggcuauuuc

SEQ ID NO: 56712 - RNA, 23 nt, Artificial Sequence
  RNA Oligomer
uaauacauuucguauggcuauuu

SEQ ID NO: 56713 - RNA, 23 nt, Artificial Sequence
  RNA Oligomer
ucaccuauguuaugcaaaacagu

SEQ ID NO: 56714 - RNA, 23 nt, Artificial Sequence
  RNA Oligomer
cucaccuauguuaugcaaaacag

SEQ ID NO: 56715 - RNA, 23 nt, Artificial Sequence
  RNA Oligomer
acucaccuauguuaugcaaaaca

SEQ ID NO: 56716 - RNA, 23 nt, Artificial Sequence
  RNA Oligomer
uacucaccuauguuaugcaaaac

SEQ ID NO: 56717 - RNA, 23 nt, Artificial Sequence
  RNA Oligomer
cuacucaccuauguuaugcaaaa

SEQ ID NO: 56718 - RNA, 23 nt, Artificial Sequence
  RNA Oligomer
ucacuacucaccuauguuaugca

SEQ ID NO: 56719 - RNA, 23 nt, Artificial Sequence
  RNA Oligomer
gucacuacucaccuauguuaugc

SEQ ID NO: 56720 - RNA, 23 nt, Artificial Sequence
  RNA Oligomer
ugucacuacucaccuauguuaug

SEQ ID NO: 56721 - RNA, 23 nt, Artificial Sequence
  RNA Oligomer
augucacuacucaccuauguuau

SEQ ID NO: 56722 - RNA, 23 nt, Artificial Sequence
  RNA Oligomer
aaugucacuacucaccuauguua

SEQ ID NO: 56723 - RNA, 23 nt, Artificial Sequence
  RNA Oligomer
ggaugguucucacuguuuuucug

SEQ ID NO: 56724 - RNA, 23 nt, Artificial Sequence
  RNA Oligomer
aggaugguucucacuguuuuucu

SEQ ID NO: 56725 - RNA, 23 nt, Artificial Sequence
  RNA Oligomer
uaggaugguucucacuguuuuuc

SEQ ID NO: 56726 - RNA, 23 nt, Artificial Sequence
  RNA Oligomer
uuaggaugguucucacuguuuuu

SEQ ID NO: 56727 - RNA, 23 nt, Artificial Sequence
  RNA Oligomer
uuuaggaugguucucacuguuuu

SEQ ID NO: 56728 - RNA, 23 nt, Artificial Sequence
  RNA Oligomer
gcacuauauuagguuaaguauua

SEQ ID NO: 56729 - RNA, 23 nt, Artificial Sequence
  RNA Oligomer
ugcacuauauuagguuaaguauu

SEQ ID NO: 56730 - RNA, 23 nt, Artificial Sequence
  RNA Oligomer
uugcacuauauuagguuaaguau

SEQ ID NO: 56731 - RNA, 23 nt, Artificial Sequence
  RNA Oligomer
auugcacuauauuagguuaagua

SEQ ID NO: 56732 - RNA, 23 nt, Artificial Sequence
  RNA Oligomer
aauugcacuauauuagguuaagu

SEQ ID NO: 56733 - RNA, 23 nt, Artificial Sequence
  RNA Oligomer
ccaugaugaauucuagugaaaug

SEQ ID NO: 56734 - RNA, 23 nt, Artificial Sequence
  RNA Oligomer
accaugaugaauucuagugaaau

SEQ ID NO: 56735 - RNA, 23 nt, Artificial Sequence
  RNA Oligomer
uaccaugaugaauucuagugaaa

SEQ ID NO: 56736 - RNA, 23 nt, Artificial Sequence
  RNA Oligomer
uuaccaugaugaauucuagugaa

SEQ ID NO: 56737 - RNA, 23 nt, Artificial Sequence
  RNA Oligomer
auuaccaugaugaauucuaguga

SEQ ID NO: 56738 - RNA, 23 nt, Artificial Sequence
  RNA Oligomer
gaaugagguuuuuguuguuuuuu

SEQ ID NO: 56739 - RNA, 23 nt, Artificial Sequence
  RNA Oligomer
ggaaugagguuuuuguuguuuuu

SEQ ID NO: 56740 - RNA, 23 nt, Artificial Sequence
  RNA Oligomer
gggaaugagguuuuuguuguuuu

SEQ ID NO: 56741 - RNA, 23 nt, Artificial Sequence
  RNA Oligomer
agggaaugagguuuuuguuguuu

SEQ ID NO: 56742 - RNA, 23 nt, Artificial Sequence
  RNA Oligomer
aagggaaugagguuuuuguuguu

SEQ ID NO: 56743 - RNA, 23 nt, Artificial Sequence
  RNA Oligomer
aaagggaaugagguuuuuguugu

SEQ ID NO: 56744 - RNA, 23 nt, Artificial Sequence
  RNA Oligomer
ggagaaaacuuguauagaugcac

SEQ ID NO: 56745 - RNA, 23 nt, Artificial Sequence
  RNA Oligomer
uggagaaaacuuguauagaugca

SEQ ID NO: 56746 - RNA, 23 nt, Artificial Sequence
  RNA Oligomer
auggagaaaacuuguauagaugc

SEQ ID NO: 56747 - RNA, 23 nt, Artificial Sequence
  RNA Oligomer
uauggagaaaacuuguauagaug

SEQ ID NO: 56748 - RNA, 23 nt, Artificial Sequence
  RNA Oligomer
uuauggagaaaacuuguauagau

SEQ ID NO: 56749 - RNA, 23 nt, Artificial Sequence
  RNA Oligomer
ggaacucaaaacacuagaaaaag

SEQ ID NO: 56750 - RNA, 23 nt, Artificial Sequence
  RNA Oligomer
aggaacucaaaacacuagaaaaa

SEQ ID NO: 56751 - RNA, 23 nt, Artificial Sequence
  RNA Oligomer
aaggaacucaaaacacuagaaaa

SEQ ID NO: 56752 - RNA, 23 nt, Artificial Sequence
  RNA Oligomer
aaaggaacucaaaacacuagaaa

SEQ ID NO: 56753 - RNA, 23 nt, Artificial Sequence
  RNA Oligomer
gaaaggaacucaaaacacuagaa

SEQ ID NO: 56754 - RNA, 23 nt, Artificial Sequence
  RNA Oligomer
gcacugugcuggugaucaaguuu

SEQ ID NO: 56755 - RNA, 23 nt, Artificial Sequence
  RNA Oligomer
ugcacugugcuggugaucaaguu

SEQ ID NO: 56756 - RNA, 23 nt, Artificial Sequence
  RNA Oligomer
uugcacugugcuggugaucaagu

SEQ ID NO: 56757 - RNA, 23 nt, Artificial Sequence
  RNA Oligomer
cuugcacugugcuggugaucaag

SEQ ID NO: 56758 - RNA, 23 nt, Artificial Sequence
  RNA Oligomer
ccuugcacugugcuggugaucaa

SEQ ID NO: 56759 - RNA, 23 nt, Artificial Sequence
  RNA Oligomer
ggcuuaucauuccuugcacugug

SEQ ID NO: 56760 - RNA, 23 nt, Artificial Sequence
  RNA Oligomer
gggcuuaucauuccuugcacugu

SEQ ID NO: 56761 - RNA, 23 nt, Artificial Sequence
  RNA Oligomer
agggcuuaucauuccuugcacug

SEQ ID NO: 56762 - RNA, 23 nt, Artificial Sequence
  RNA Oligomer
uagggcuuaucauuccuugcacu

SEQ ID NO: 56763 - RNA, 23 nt, Artificial Sequence
  RNA Oligomer
uuagggcuuaucauuccuugcac

SEQ ID NO: 56764 - RNA, 23 nt, Artificial Sequence
  RNA Oligomer
guuagggcuuaucauuccuugca

SEQ ID NO: 56765 - RNA, 23 nt, Artificial Sequence
  RNA Oligomer
ccaaaucguaucuuuccaauaac

SEQ ID NO: 56766 - RNA, 23 nt, Artificial Sequence
  RNA Oligomer
uccaaaucguaucuuuccaauaa

SEQ ID NO: 56767 - RNA, 23 nt, Artificial Sequence
  RNA Oligomer
uuccaaaucguaucuuuccaaua

SEQ ID NO: 56768 - RNA, 23 nt, Artificial Sequence
  RNA Oligomer
auuccaaaucguaucuuuccaau

SEQ ID NO: 56769 - RNA, 23 nt, Artificial Sequence
  RNA Oligomer
cauuccaaaucguaucuuuccaa

SEQ ID NO: 56770 - RNA, 23 nt, Artificial Sequence
  RNA Oligomer
cugugugucuucuuguuuuucua

SEQ ID NO: 56771 - RNA, 23 nt, Artificial Sequence
  RNA Oligomer
gcugugugucuucuuguuuuucu

SEQ ID NO: 56772 - RNA, 23 nt, Artificial Sequence
  RNA Oligomer
ugcugugugucuucuuguuuuuc

SEQ ID NO: 56773 - RNA, 23 nt, Artificial Sequence
  RNA Oligomer
gugcugugugucuucuuguuuuu

SEQ ID NO: 56774 - RNA, 23 nt, Artificial Sequence
  RNA Oligomer
ugugcugugugucuucuuguuuu

SEQ ID NO: 56775 - RNA, 23 nt, Artificial Sequence
  RNA Oligomer
cugcagcuauuuccaauguggag

SEQ ID NO: 56776 - RNA, 23 nt, Artificial Sequence
  RNA Oligomer
ccugcagcuauuuccaaugugga

SEQ ID NO: 56777 - RNA, 23 nt, Artificial Sequence
  RNA Oligomer
cccugcagcuauuuccaaugugg

SEQ ID NO: 56778 - RNA, 23 nt, Artificial Sequence
  RNA Oligomer
ccccugcagcuauuuccaaugug

SEQ ID NO: 56779 - RNA, 23 nt, Artificial Sequence
  RNA Oligomer
cccccugcagcuauuuccaaugu

SEQ ID NO: 56780 - RNA, 23 nt, Artificial Sequence
  RNA Oligomer
agaaucuaaugcagaguaccuug

SEQ ID NO: 56781 - RNA, 23 nt, Artificial Sequence
  RNA Oligomer
uuaagggaugauggcuuuuauaa

SEQ ID NO: 56782 - RNA, 23 nt, Artificial Sequence
  RNA Oligomer
ugaugguuuuggcauaauagcug

SEQ ID NO: 56783 - RNA, 23 nt, Artificial Sequence
  RNA Oligomer
cugaugguuuuggcauaauagcu

SEQ ID NO: 56784 - RNA, 23 nt, Artificial Sequence
  RNA Oligomer
ucugaugguuuuggcauaauagc

SEQ ID NO: 56785 - RNA, 23 nt, Artificial Sequence
  RNA Oligomer
cucugaugguuuuggcauaauag

SEQ ID NO: 56786 - RNA, 23 nt, Artificial Sequence
  RNA Oligomer
acucugaugguuuuggcauaaua

SEQ ID NO: 56787 - RNA, 23 nt, Artificial Sequence
  RNA Oligomer
gccuaguaaaaaugcucuaccug

SEQ ID NO: 56788 - RNA, 23 nt, Artificial Sequence
  RNA Oligomer
agccuaguaaaaaugcucuaccu

SEQ ID NO: 56789 - RNA, 23 nt, Artificial Sequence
  RNA Oligomer
uagccuaguaaaaaugcucuacc

SEQ ID NO: 56790 - RNA, 23 nt, Artificial Sequence
  RNA Oligomer
auagccuaguaaaaaugcucuac

SEQ ID NO: 56791 - RNA, 23 nt, Artificial Sequence
  RNA Oligomer
uauagccuaguaaaaaugcucua

SEQ ID NO: 56792 - RNA, 23 nt, Artificial Sequence
  RNA Oligomer
agagaagucuuuggaguuaacca

SEQ ID NO: 56793 - RNA, 23 nt, Artificial Sequence
  RNA Oligomer
uagagaagucuuuggaguuaacc

SEQ ID NO: 56794 - RNA, 23 nt, Artificial Sequence
  RNA Oligomer
cuagagaagucuuuggaguuaac

SEQ ID NO: 56795 - RNA, 23 nt, Artificial Sequence
  RNA Oligomer
ucuagagaagucuuuggaguuaa

SEQ ID NO: 56796 - RNA, 23 nt, Artificial Sequence
  RNA Oligomer
gucuagagaagucuuuggaguua

SEQ ID NO: 56797 - RNA, 23 nt, Artificial Sequence
  RNA Oligomer
ccaagccauuucuaaagugaccu

SEQ ID NO: 56798 - RNA, 23 nt, Artificial Sequence
  RNA Oligomer
gcauuuuucaaaccucuuuccuu

SEQ ID NO: 56799 - RNA, 23 nt, Artificial Sequence
  RNA Oligomer
ggcauuuuucaaaccucuuuccu

SEQ ID NO: 56800 - RNA, 23 nt, Artificial Sequence
  RNA Oligomer
aggcauuuuucaaaccucuuucc

SEQ ID NO: 56801 - RNA, 23 nt, Artificial Sequence
  RNA Oligomer
uaggcauuuuucaaaccucuuuc

SEQ ID NO: 56802 - RNA, 23 nt, Artificial Sequence
  RNA Oligomer
auaggcauuuuucaaaccucuuu

SEQ ID NO: 56803 - RNA, 23 nt, Artificial Sequence
  RNA Oligomer
cacugaguuuggcauuuuucugc

SEQ ID NO: 56804 - RNA, 23 nt, Artificial Sequence
  RNA Oligomer
caaaauaacuaaaaggcacugag

SEQ ID NO: 56805 - RNA, 23 nt, Artificial Sequence
  RNA Oligomer
ucaaaauaacuaaaaggcacuga

SEQ ID NO: 56806 - RNA, 23 nt, Artificial Sequence
  RNA Oligomer
aucaaaauaacuaaaaggcacug

SEQ ID NO: 56807 - RNA, 23 nt, Artificial Sequence
  RNA Oligomer
uaucaaaauaacuaaaaggcacu

SEQ ID NO: 56808 - RNA, 23 nt, Artificial Sequence
  RNA Oligomer
auaucaaaauaacuaaaaggcac

SEQ ID NO: 56809 - RNA, 23 nt, Artificial Sequence
  RNA Oligomer
agcuucuauaucugucuuagucu

SEQ ID NO: 56810 - RNA, 23 nt, Artificial Sequence
  RNA Oligomer
uagcuucuauaucugucuuaguc

SEQ ID NO: 56811 - RNA, 23 nt, Artificial Sequence
  RNA Oligomer
guagcuucuauaucugucuuagu

SEQ ID NO: 56812 - RNA, 23 nt, Artificial Sequence
  RNA Oligomer
aguagcuucuauaucugucuuag

SEQ ID NO: 56813 - RNA, 23 nt, Artificial Sequence
  RNA Oligomer
aaguagcuucuauaucugucuua

SEQ ID NO: 56814 - RNA, 23 nt, Artificial Sequence
  RNA Oligomer
aggguugauaaaaguucuugauc

SEQ ID NO: 56815 - RNA, 23 nt, Artificial Sequence
  RNA Oligomer
aaggguugauaaaaguucuugau

SEQ ID NO: 56816 - RNA, 23 nt, Artificial Sequence
  RNA Oligomer
gaaggguugauaaaaguucuuga

SEQ ID NO: 56817 - RNA, 23 nt, Artificial Sequence
  RNA Oligomer
agaaggguugauaaaaguucuug

SEQ ID NO: 56818 - RNA, 23 nt, Artificial Sequence
  RNA Oligomer
aagaaggguugauaaaaguucuu

SEQ ID NO: 56819 - RNA, 23 nt, Artificial Sequence
  RNA Oligomer
ugaauaaaaauggagggauaucc

SEQ ID NO: 56820 - RNA, 23 nt, Artificial Sequence
  RNA Oligomer
cugaauaaaaauggagggauauc

SEQ ID NO: 56821 - RNA, 23 nt, Artificial Sequence
  RNA Oligomer
acugaauaaaaauggagggauau

SEQ ID NO: 56822 - RNA, 23 nt, Artificial Sequence
  RNA Oligomer
gacugaauaaaaauggagggaua

SEQ ID NO: 56823 - RNA, 23 nt, Artificial Sequence
  RNA Oligomer
agacugaauaaaaauggagggau

SEQ ID NO: 56824 - RNA, 23 nt, Artificial Sequence
  RNA Oligomer
gagcuggcauguaauucuuccuc

SEQ ID NO: 56825 - RNA, 23 nt, Artificial Sequence
  RNA Oligomer
agagcuggcauguaauucuuccu

SEQ ID NO: 56826 - RNA, 23 nt, Artificial Sequence
  RNA Oligomer
uagagcuggcauguaauucuucc

SEQ ID NO: 56827 - RNA, 23 nt, Artificial Sequence
  RNA Oligomer
auagagcuggcauguaauucuuc

SEQ ID NO: 56828 - RNA, 23 nt, Artificial Sequence
  RNA Oligomer
uauagagcuggcauguaauucuu

SEQ ID NO: 56829 - RNA, 23 nt, Artificial Sequence
  RNA Oligomer
cuauagagcuggcauguaauucu

SEQ ID NO: 56830 - RNA, 23 nt, Artificial Sequence
  RNA Oligomer
ucuauagagcuggcauguaauuc

SEQ ID NO: 56831 - RNA, 23 nt, Artificial Sequence
  RNA Oligomer
aucuauagagcuggcauguaauu

SEQ ID NO: 56832 - RNA, 23 nt, Artificial Sequence
  RNA Oligomer
uaucuauagagcuggcauguaau

SEQ ID NO: 56833 - RNA, 23 nt, Artificial Sequence
  RNA Oligomer
guaucuauagagcuggcauguaa

SEQ ID NO: 56834 - RNA, 23 nt, Artificial Sequence
  RNA Oligomer
ccuaaugucuugcaaaauccaau

SEQ ID NO: 56835 - RNA, 23 nt, Artificial Sequence
  RNA Oligomer
accuaaugucuugcaaaauccaa

SEQ ID NO: 56836 - RNA, 23 nt, Artificial Sequence
  RNA Oligomer
gaccuaaugucuugcaaaaucca

SEQ ID NO: 56837 - RNA, 23 nt, Artificial Sequence
  RNA Oligomer
ugaccuaaugucuugcaaaaucc

SEQ ID NO: 56838 - RNA, 23 nt, Artificial Sequence
  RNA Oligomer
augaccuaaugucuugcaaaauc

SEQ ID NO: 56839 - RNA, 23 nt, Artificial Sequence
  RNA Oligomer
ggugaucaaguuuguccuaauca

SEQ ID NO: 56840 - RNA, 23 nt, Artificial Sequence
  RNA Oligomer
uggugaucaaguuuguccuaauc

SEQ ID NO: 56841 - RNA, 23 nt, Artificial Sequence
  RNA Oligomer
cuggugaucaaguuuguccuaau

SEQ ID NO: 56842 - RNA, 23 nt, Artificial Sequence
  RNA Oligomer
gcuggugaucaaguuuguccuaa

SEQ ID NO: 56843 - RNA, 23 nt, Artificial Sequence
  RNA Oligomer
ugcuggugaucaaguuuguccua

SEQ ID NO: 56844 - RNA, 23 nt, Artificial Sequence
  RNA Oligomer
ggcucagugauucauauguggcu

SEQ ID NO: 56845 - RNA, 23 nt, Artificial Sequence
  RNA Oligomer
uggcucagugauucauauguggc

SEQ ID NO: 56846 - RNA, 23 nt, Artificial Sequence
  RNA Oligomer
cuggcucagugauucauaugugg

SEQ ID NO: 56847 - RNA, 23 nt, Artificial Sequence
  RNA Oligomer
ccuggcucagugauucauaugug

SEQ ID NO: 56848 - RNA, 23 nt, Artificial Sequence
  RNA Oligomer
gccuggcucagugauucauaugu

SEQ ID NO: 56849 - RNA, 23 nt, Artificial Sequence
  RNA Oligomer
aggcaauacucaagaaggagaau

SEQ ID NO: 56850 - RNA, 23 nt, Artificial Sequence
  RNA Oligomer
caggcaauacucaagaaggagaa

SEQ ID NO: 56851 - RNA, 23 nt, Artificial Sequence
  RNA Oligomer
gugauuccuauucgauauuaugu

SEQ ID NO: 56852 - RNA, 23 nt, Artificial Sequence
  RNA Oligomer
ugugauuccuauucgauauuaug

SEQ ID NO: 56853 - RNA, 23 nt, Artificial Sequence
  RNA Oligomer
uugugauuccuauucgauauuau

SEQ ID NO: 56854 - RNA, 23 nt, Artificial Sequence
  RNA Oligomer
cuugugauuccuauucgauauua

SEQ ID NO: 56855 - RNA, 23 nt, Artificial Sequence
  RNA Oligomer
acuugugauuccuauucgauauu

SEQ ID NO: 56856 - RNA, 23 nt, Artificial Sequence
  RNA Oligomer
ugcagcuauuuccaauguggagg

SEQ ID NO: 56857 - RNA, 23 nt, Artificial Sequence
  RNA Oligomer
ccucuuacuaugaauucuucaga

SEQ ID NO: 56858 - RNA, 23 nt, Artificial Sequence
  RNA Oligomer
uccucuuacuaugaauucuucag

SEQ ID NO: 56859 - RNA, 23 nt, Artificial Sequence
  RNA Oligomer
uuccucuuacuaugaauucuuca

SEQ ID NO: 56860 - RNA, 23 nt, Artificial Sequence
  RNA Oligomer
cuuccucuuacuaugaauucuuc

SEQ ID NO: 56861 - RNA, 23 nt, Artificial Sequence
  RNA Oligomer
acuuccucuuacuaugaauucuu

SEQ ID NO: 56862 - RNA, 23 nt, Artificial Sequence
  RNA Oligomer
gugauggauauuguucguaaucu

SEQ ID NO: 56863 - RNA, 23 nt, Artificial Sequence
  RNA Oligomer
agugauggauauuguucguaauc

SEQ ID NO: 56864 - RNA, 23 nt, Artificial Sequence
  RNA Oligomer
gagugauggauauuguucguaau

SEQ ID NO: 56865 - RNA, 23 nt, Artificial Sequence
  RNA Oligomer
agagugauggauauuguucguaa

SEQ ID NO: 56866 - RNA, 23 nt, Artificial Sequence
  RNA Oligomer
caaucaauauccagaaucuaaug

SEQ ID NO: 56867 - RNA, 23 nt, Artificial Sequence
  RNA Oligomer
ucaaucaauauccagaaucuaau

SEQ ID NO: 56868 - RNA, 23 nt, Artificial Sequence
  RNA Oligomer
aucaaucaauauccagaaucuaa

SEQ ID NO: 56869 - RNA, 23 nt, Artificial Sequence
  RNA Oligomer
aaucaaucaauauccagaaucua

SEQ ID NO: 56870 - RNA, 23 nt, Artificial Sequence
  RNA Oligomer
aaaucaaucaauauccagaaucu

SEQ ID NO: 56871 - RNA, 23 nt, Artificial Sequence
  RNA Oligomer
gaaugaguuuacaacagaugaaa

SEQ ID NO: 56872 - RNA, 23 nt, Artificial Sequence
  RNA Oligomer
agaaugaguuuacaacagaugaa

SEQ ID NO: 56873 - RNA, 23 nt, Artificial Sequence
  RNA Oligomer
aagaaugaguuuacaacagauga

SEQ ID NO: 56874 - RNA, 23 nt, Artificial Sequence
  RNA Oligomer
aaagaaugaguuuacaacagaug

SEQ ID NO: 56875 - RNA, 23 nt, Artificial Sequence
  RNA Oligomer
gaaagaaugaguuuacaacagau

SEQ ID NO: 56876 - RNA, 23 nt, Artificial Sequence
  RNA Oligomer
caguuuacuuaagguagaaagaa

SEQ ID NO: 56877 - RNA, 23 nt, Artificial Sequence
  RNA Oligomer
ggaaaaauauugguagacaucag

SEQ ID NO: 56878 - RNA, 23 nt, Artificial Sequence
  RNA Oligomer
uggaaaaauauugguagacauca

SEQ ID NO: 56879 - RNA, 23 nt, Artificial Sequence
  RNA Oligomer
auggaaaaauauugguagacauc

SEQ ID NO: 56880 - RNA, 23 nt, Artificial Sequence
  RNA Oligomer
aauggaaaaauauugguagacau

SEQ ID NO: 56881 - RNA, 23 nt, Artificial Sequence
  RNA Oligomer
caauggaaaaauauugguagaca

SEQ ID NO: 56882 - RNA, 23 nt, Artificial Sequence
  RNA Oligomer
gcugaccuauagaaaaaaaugaa

SEQ ID NO: 56883 - RNA, 23 nt, Artificial Sequence
  RNA Oligomer
ugcugaccuauagaaaaaaauga

SEQ ID NO: 56884 - RNA, 23 nt, Artificial Sequence
  RNA Oligomer
augcugaccuauagaaaaaaaug

SEQ ID NO: 56885 - RNA, 23 nt, Artificial Sequence
  RNA Oligomer
aaugcugaccuauagaaaaaaau

SEQ ID NO: 56886 - RNA, 23 nt, Artificial Sequence
  RNA Oligomer
aaaugcugaccuauagaaaaaaa

SEQ ID NO: 56887 - RNA, 23 nt, Artificial Sequence
  RNA Oligomer
cgaaaauagaaaaugccauccau

SEQ ID NO: 56888 - RNA, 23 nt, Artificial Sequence
  RNA Oligomer
ccgaaaauagaaaaugccaucca

SEQ ID NO: 56889 - RNA, 23 nt, Artificial Sequence
  RNA Oligomer
accgaaaauagaaaaugccaucc

SEQ ID NO: 56890 - RNA, 23 nt, Artificial Sequence
  RNA Oligomer
caccgaaaauagaaaaugccauc

SEQ ID NO: 56891 - RNA, 23 nt, Artificial Sequence
  RNA Oligomer
ucaccgaaaauagaaaaugccau

SEQ ID NO: 56892 - RNA, 23 nt, Artificial Sequence
  RNA Oligomer
gagaagucuuuggaguuaaccau

SEQ ID NO: 56893 - RNA, 23 nt, Artificial Sequence
  RNA Oligomer
acaaaaaguuggacgacauugag

SEQ ID NO: 56894 - RNA, 23 nt, Artificial Sequence
  RNA Oligomer
uacaaaaaguuggacgacauuga

SEQ ID NO: 56895 - RNA, 23 nt, Artificial Sequence
  RNA Oligomer
auacaaaaaguuggacgacauug

SEQ ID NO: 56896 - RNA, 23 nt, Artificial Sequence
  RNA Oligomer
gauacaaaaaguuggacgacauu

SEQ ID NO: 56897 - RNA, 23 nt, Artificial Sequence
  RNA Oligomer
ggauacaaaaaguuggacgacau

SEQ ID NO: 56898 - RNA, 23 nt, Artificial Sequence
  RNA Oligomer
auguugccaagccauuucuaaag

SEQ ID NO: 56899 - RNA, 23 nt, Artificial Sequence
  RNA Oligomer
aaacaacaucaacaauccaggau

SEQ ID NO: 56900 - RNA, 23 nt, Artificial Sequence
  RNA Oligomer
cccacauaucaaaauaacuaaaa

SEQ ID NO: 56901 - RNA, 23 nt, Artificial Sequence
  RNA Oligomer
ucccacauaucaaaauaacuaaa

SEQ ID NO: 56902 - RNA, 23 nt, Artificial Sequence
  RNA Oligomer
uucccacauaucaaaauaacuaa

SEQ ID NO: 56903 - RNA, 23 nt, Artificial Sequence
  RNA Oligomer
cuucccacauaucaaaauaacua

SEQ ID NO: 56904 - RNA, 23 nt, Artificial Sequence
  RNA Oligomer
ucuucccacauaucaaaauaacu

SEQ ID NO: 56905 - RNA, 23 nt, Artificial Sequence
  RNA Oligomer
aucuucccacauaucaaaauaac

SEQ ID NO: 56906 - RNA, 23 nt, Artificial Sequence
  RNA Oligomer
gcugaaauuuaggaugguucuca

SEQ ID NO: 56907 - RNA, 23 nt, Artificial Sequence
  RNA Oligomer
ugcugaaauuuaggaugguucuc

SEQ ID NO: 56908 - RNA, 23 nt, Artificial Sequence
  RNA Oligomer
uugcugaaauuuaggaugguucu

SEQ ID NO: 56909 - RNA, 23 nt, Artificial Sequence
  RNA Oligomer
cuugcugaaauuuaggaugguuc

SEQ ID NO: 56910 - RNA, 23 nt, Artificial Sequence
  RNA Oligomer
ccuugcugaaauuuaggaugguu

SEQ ID NO: 56911 - RNA, 23 nt, Artificial Sequence
  RNA Oligomer
gugugaagauucaucauuaugug

SEQ ID NO: 56912 - RNA, 23 nt, Artificial Sequence
  RNA Oligomer
ggugugaagauucaucauuaugu

SEQ ID NO: 56913 - RNA, 23 nt, Artificial Sequence
  RNA Oligomer
aggugugaagauucaucauuaug

SEQ ID NO: 56914 - RNA, 23 nt, Artificial Sequence
  RNA Oligomer
gaggugugaagauucaucauuau

SEQ ID NO: 56915 - RNA, 23 nt, Artificial Sequence
  RNA Oligomer
agaggugugaagauucaucauua

SEQ ID NO: 56916 - RNA, 23 nt, Artificial Sequence
  RNA Oligomer
acaaugcauagaugaucgaaaau

SEQ ID NO: 56917 - RNA, 23 nt, Artificial Sequence
  RNA Oligomer
aacaaugcauagaugaucgaaaa

SEQ ID NO: 56918 - RNA, 23 nt, Artificial Sequence
  RNA Oligomer
guguaaauaaguagcuucuauau

SEQ ID NO: 56919 - RNA, 23 nt, Artificial Sequence
  RNA Oligomer
aguguaaauaaguagcuucuaua

SEQ ID NO: 56920 - RNA, 23 nt, Artificial Sequence
  RNA Oligomer
uaguguaaauaaguagcuucuau

SEQ ID NO: 56921 - RNA, 23 nt, Artificial Sequence
  RNA Oligomer
cuaguguaaauaaguagcuucua

SEQ ID NO: 56922 - RNA, 23 nt, Artificial Sequence
  RNA Oligomer
ucuaguguaaauaaguagcuucu

SEQ ID NO: 56923 - RNA, 23 nt, Artificial Sequence
  RNA Oligomer
ggguugauaaaaguucuugauca

SEQ ID NO: 56924 - RNA, 23 nt, Artificial Sequence
  RNA Oligomer
gcaaagaaggguugauaaaaguu

SEQ ID NO: 56925 - RNA, 23 nt, Artificial Sequence
  RNA Oligomer
agcaaagaaggguugauaaaagu

SEQ ID NO: 56926 - RNA, 23 nt, Artificial Sequence
  RNA Oligomer
aagcaaagaaggguugauaaaag

SEQ ID NO: 56927 - RNA, 23 nt, Artificial Sequence
  RNA Oligomer
uaagcaaagaaggguugauaaaa

SEQ ID NO: 56928 - RNA, 23 nt, Artificial Sequence
  RNA Oligomer
auaagcaaagaaggguugauaaa

SEQ ID NO: 56929 - RNA, 23 nt, Artificial Sequence
  RNA Oligomer
guauaggaaagacugaauaaaaa

SEQ ID NO: 56930 - RNA, 23 nt, Artificial Sequence
  RNA Oligomer
gguauaggaaagacugaauaaaa

SEQ ID NO: 56931 - RNA, 23 nt, Artificial Sequence
  RNA Oligomer
agguauaggaaagacugaauaaa

SEQ ID NO: 56932 - RNA, 23 nt, Artificial Sequence
  RNA Oligomer
uagguauaggaaagacugaauaa

SEQ ID NO: 56933 - RNA, 23 nt, Artificial Sequence
  RNA Oligomer
auagguauaggaaagacugaaua

SEQ ID NO: 56934 - RNA, 23 nt, Artificial Sequence
  RNA Oligomer
aauagguauaggaaagacugaau

SEQ ID NO: 56935 - RNA, 23 nt, Artificial Sequence
  RNA Oligomer
gucuugcaaaauccaauagaagu

SEQ ID NO: 56936 - RNA, 23 nt, Artificial Sequence
  RNA Oligomer
ugucuugcaaaauccaauagaag

SEQ ID NO: 56937 - RNA, 23 nt, Artificial Sequence
  RNA Oligomer
augucuugcaaaauccaauagaa

SEQ ID NO: 56938 - RNA, 23 nt, Artificial Sequence
  RNA Oligomer
gaagagaacaccauuuuaucuca

SEQ ID NO: 56939 - RNA, 23 nt, Artificial Sequence
  RNA Oligomer
ggaagagaacaccauuuuaucuc

SEQ ID NO: 56940 - RNA, 23 nt, Artificial Sequence
  RNA Oligomer
uggaagagaacaccauuuuaucu

SEQ ID NO: 56941 - RNA, 23 nt, Artificial Sequence
  RNA Oligomer
cuggaagagaacaccauuuuauc

SEQ ID NO: 56942 - RNA, 23 nt, Artificial Sequence
  RNA Oligomer
acuggaagagaacaccauuuuau

SEQ ID NO: 56943 - RNA, 23 nt, Artificial Sequence
  RNA Oligomer
uacuggaagagaacaccauuuua

SEQ ID NO: 56944 - RNA, 23 nt, Artificial Sequence
  RNA Oligomer
ugcuugucuuugagaaauugacu

SEQ ID NO: 56945 - RNA, 23 nt, Artificial Sequence
  RNA Oligomer
uugcuugucuuugagaaauugac

SEQ ID NO: 56946 - RNA, 23 nt, Artificial Sequence
  RNA Oligomer
auugcuugucuuugagaaauuga

SEQ ID NO: 56947 - RNA, 23 nt, Artificial Sequence
  RNA Oligomer
cauugcuugucuuugagaaauug

SEQ ID NO: 56948 - RNA, 23 nt, Artificial Sequence
  RNA Oligomer
acauugcuugucuuugagaaauu

SEQ ID NO: 56949 - RNA, 23 nt, Artificial Sequence
  RNA Oligomer
ggauuucugaacuaugguuuuga

SEQ ID NO: 56950 - RNA, 23 nt, Artificial Sequence
  RNA Oligomer
uggauuucugaacuaugguuuug

SEQ ID NO: 56951 - RNA, 23 nt, Artificial Sequence
  RNA Oligomer
cuggauuucugaacuaugguuuu

SEQ ID NO: 56952 - RNA, 23 nt, Artificial Sequence
  RNA Oligomer
gcuggauuucugaacuaugguuu

SEQ ID NO: 56953 - RNA, 23 nt, Artificial Sequence
  RNA Oligomer
agcuggauuucugaacuaugguu

SEQ ID NO: 56954 - RNA, 23 nt, Artificial Sequence
  RNA Oligomer
gaacucaaaacacuagaaaaagc

SEQ ID NO: 56955 - RNA, 23 nt, Artificial Sequence
  RNA Oligomer
guagacaacacccuuacaaggau

SEQ ID NO: 56956 - RNA, 23 nt, Artificial Sequence
  RNA Oligomer
uguagacaacacccuuacaagga

SEQ ID NO: 56957 - RNA, 23 nt, Artificial Sequence
  RNA Oligomer
guguagacaacacccuuacaagg

SEQ ID NO: 56958 - RNA, 23 nt, Artificial Sequence
  RNA Oligomer
uguguagacaacacccuuacaag

SEQ ID NO: 56959 - RNA, 23 nt, Artificial Sequence
  RNA Oligomer
auguguagacaacacccuuacaa

SEQ ID NO: 56960 - RNA, 23 nt, Artificial Sequence
  RNA Oligomer
gaagaucacugggauugaaaaug

SEQ ID NO: 56961 - RNA, 23 nt, Artificial Sequence
  RNA Oligomer
ggaagaucacugggauugaaaau

SEQ ID NO: 56962 - RNA, 23 nt, Artificial Sequence
  RNA Oligomer
uggaagaucacugggauugaaaa

SEQ ID NO: 56963 - RNA, 23 nt, Artificial Sequence
  RNA Oligomer
uuggaagaucacugggauugaaa

SEQ ID NO: 56964 - RNA, 23 nt, Artificial Sequence
  RNA Oligomer
uuuggaagaucacugggauugaa

SEQ ID NO: 56965 - RNA, 23 nt, Artificial Sequence
  RNA Oligomer
agauuccucagcccuucaaaucu

SEQ ID NO: 56966 - RNA, 23 nt, Artificial Sequence
  RNA Oligomer
gagauuccucagcccuucaaauc

SEQ ID NO: 56967 - RNA, 23 nt, Artificial Sequence
  RNA Oligomer
agagauuccucagcccuucaaau

SEQ ID NO: 56968 - RNA, 23 nt, Artificial Sequence
  RNA Oligomer
aagagauuccucagcccuucaaa

SEQ ID NO: 56969 - RNA, 23 nt, Artificial Sequence
  RNA Oligomer
gaagagauuccucagcccuucaa

SEQ ID NO: 56970 - RNA, 23 nt, Artificial Sequence
  RNA Oligomer
gugauucauauguggcuuuggga

SEQ ID NO: 56971 - RNA, 23 nt, Artificial Sequence
  RNA Oligomer
agugauucauauguggcuuuggg

SEQ ID NO: 56972 - RNA, 23 nt, Artificial Sequence
  RNA Oligomer
cagugauucauauguggcuuugg

SEQ ID NO: 56973 - RNA, 23 nt, Artificial Sequence
  RNA Oligomer
ucagugauucauauguggcuuug

SEQ ID NO: 56974 - RNA, 23 nt, Artificial Sequence
  RNA Oligomer
cucagugauucauauguggcuuu

SEQ ID NO: 56975 - RNA, 23 nt, Artificial Sequence
  RNA Oligomer
agccuggcucagugauucauaug

SEQ ID NO: 56976 - RNA, 23 nt, Artificial Sequence
  RNA Oligomer
cagccuggcucagugauucauau

SEQ ID NO: 56977 - RNA, 23 nt, Artificial Sequence
  RNA Oligomer
ccauuccaaaucguaucuuucca

SEQ ID NO: 56978 - RNA, 23 nt, Artificial Sequence
  RNA Oligomer
uccauuccaaaucguaucuuucc

SEQ ID NO: 56979 - RNA, 23 nt, Artificial Sequence
  RNA Oligomer
uuccauuccaaaucguaucuuuc

SEQ ID NO: 56980 - RNA, 23 nt, Artificial Sequence
  RNA Oligomer
uuuccauuccaaaucguaucuuu

SEQ ID NO: 56981 - RNA, 23 nt, Artificial Sequence
  RNA Oligomer
auuuccauuccaaaucguaucuu

SEQ ID NO: 56982 - RNA, 23 nt, Artificial Sequence
  RNA Oligomer
ggcuauuuccauuccaaaucgua

SEQ ID NO: 56983 - RNA, 23 nt, Artificial Sequence
  RNA Oligomer
uggcuauuuccauuccaaaucgu

SEQ ID NO: 56984 - RNA, 23 nt, Artificial Sequence
  RNA Oligomer
auggcuauuuccauuccaaaucg

SEQ ID NO: 56985 - RNA, 23 nt, Artificial Sequence
  RNA Oligomer
uauggcuauuuccauuccaaauc

SEQ ID NO: 56986 - RNA, 23 nt, Artificial Sequence
  RNA Oligomer
guauggcuauuuccauuccaaau

SEQ ID NO: 56987 - RNA, 23 nt, Artificial Sequence
  RNA Oligomer
gugucuucuuguuuuucuauugu

SEQ ID NO: 56988 - RNA, 23 nt, Artificial Sequence
  RNA Oligomer
ugugucuucuuguuuuucuauug

SEQ ID NO: 56989 - RNA, 23 nt, Artificial Sequence
  RNA Oligomer
gugugucuucuuguuuuucuauu

SEQ ID NO: 56990 - RNA, 23 nt, Artificial Sequence
  RNA Oligomer
ugugugucuucuuguuuuucuau

SEQ ID NO: 56991 - RNA, 23 nt, Artificial Sequence
  RNA Oligomer
acccccugcagcuauuuccaaug

SEQ ID NO: 56992 - RNA, 23 nt, Artificial Sequence
  RNA Oligomer
agaaagaaugaguuuacaacaga

SEQ ID NO: 56993 - RNA, 23 nt, Artificial Sequence
  RNA Oligomer
gguagaaagaaugaguuuacaac

SEQ ID NO: 56994 - RNA, 23 nt, Artificial Sequence
  RNA Oligomer
agguagaaagaaugaguuuacaa

SEQ ID NO: 56995 - RNA, 23 nt, Artificial Sequence
  RNA Oligomer
aagguagaaagaaugaguuuaca

SEQ ID NO: 56996 - RNA, 23 nt, Artificial Sequence
  RNA Oligomer
uaagguagaaagaaugaguuuac

SEQ ID NO: 56997 - RNA, 23 nt, Artificial Sequence
  RNA Oligomer
uuaagguagaaagaaugaguuua

SEQ ID NO: 56998 - RNA, 23 nt, Artificial Sequence
  RNA Oligomer
cacucugaugguuuuggcauaau

SEQ ID NO: 56999 - RNA, 23 nt, Artificial Sequence
  RNA Oligomer
aauuugcguuuauuuauaacugg

SEQ ID NO: 57000 - RNA, 23 nt, Artificial Sequence
  RNA Oligomer
caauccaggauauuuuucuauaa

SEQ ID NO: 57001 - RNA, 23 nt, Artificial Sequence
  RNA Oligomer
acaauccaggauauuuuucuaua

SEQ ID NO: 57002 - RNA, 23 nt, Artificial Sequence
  RNA Oligomer
aacaauccaggauauuuuucuau

SEQ ID NO: 57003 - RNA, 23 nt, Artificial Sequence
  RNA Oligomer
gagaggugugaagauucaucauu

SEQ ID NO: 57004 - RNA, 23 nt, Artificial Sequence
  RNA Oligomer
ugaucgaaaauuacggaaaauca

SEQ ID NO: 57005 - RNA, 23 nt, Artificial Sequence
  RNA Oligomer
augaucgaaaauuacggaaaauc

SEQ ID NO: 57006 - RNA, 23 nt, Artificial Sequence
  RNA Oligomer
gaugaucgaaaauuacggaaaau

SEQ ID NO: 57007 - RNA, 23 nt, Artificial Sequence
  RNA Oligomer
agaugaucgaaaauuacggaaaa

SEQ ID NO: 57008 - RNA, 23 nt, Artificial Sequence
  RNA Oligomer
uagaugaucgaaaauuacggaaa

SEQ ID NO: 57009 - RNA, 23 nt, Artificial Sequence
  RNA Oligomer
gcagguauaaauuugaacaaugc

SEQ ID NO: 57010 - RNA, 23 nt, Artificial Sequence
  RNA Oligomer
ugcagguauaaauuugaacaaug

SEQ ID NO: 57011 - RNA, 23 nt, Artificial Sequence
  RNA Oligomer
cugcagguauaaauuugaacaau

SEQ ID NO: 57012 - RNA, 23 nt, Artificial Sequence
  RNA Oligomer
ucugcagguauaaauuugaacaa

SEQ ID NO: 57013 - RNA, 23 nt, Artificial Sequence
  RNA Oligomer
gucugcagguauaaauuugaaca

SEQ ID NO: 57014 - RNA, 23 nt, Artificial Sequence
  RNA Oligomer
ugaauagucugcagguauaaauu

SEQ ID NO: 57015 - RNA, 23 nt, Artificial Sequence
  RNA Oligomer
augaauagucugcagguauaaau

SEQ ID NO: 57016 - RNA, 23 nt, Artificial Sequence
  RNA Oligomer
aaugaauagucugcagguauaaa

SEQ ID NO: 57017 - RNA, 23 nt, Artificial Sequence
  RNA Oligomer
aaaugaauagucugcagguauaa

SEQ ID NO: 57018 - RNA, 23 nt, Artificial Sequence
  RNA Oligomer
uaaaugaauagucugcagguaua

SEQ ID NO: 57019 - RNA, 23 nt, Artificial Sequence
  RNA Oligomer
cuauaucugucuuagucuauuau

SEQ ID NO: 57020 - RNA, 23 nt, Artificial Sequence
  RNA Oligomer
ucuauaucugucuuagucuauua

SEQ ID NO: 57021 - RNA, 23 nt, Artificial Sequence
  RNA Oligomer
uucuauaucugucuuagucuauu

SEQ ID NO: 57022 - RNA, 23 nt, Artificial Sequence
  RNA Oligomer
cuucuauaucugucuuagucuau

SEQ ID NO: 57023 - RNA, 23 nt, Artificial Sequence
  RNA Oligomer
gcuucuauaucugucuuagucua

SEQ ID NO: 57024 - RNA, 23 nt, Artificial Sequence
  RNA Oligomer
cccuuggauuucacuugcauugu

SEQ ID NO: 57025 - RNA, 23 nt, Artificial Sequence
  RNA Oligomer
ccccuuggauuucacuugcauug

SEQ ID NO: 57026 - RNA, 23 nt, Artificial Sequence
  RNA Oligomer
uccccuuggauuucacuugcauu

SEQ ID NO: 57027 - RNA, 23 nt, Artificial Sequence
  RNA Oligomer
auccccuuggauuucacuugcau

SEQ ID NO: 57028 - RNA, 23 nt, Artificial Sequence
  RNA Oligomer
uauccccuuggauuucacuugca

SEQ ID NO: 57029 - RNA, 23 nt, Artificial Sequence
  RNA Oligomer
caugaugaauucuagugaaauga

SEQ ID NO: 57030 - RNA, 23 nt, Artificial Sequence
  RNA Oligomer
auaaaggcuuuauuagguauauc

SEQ ID NO: 57031 - RNA, 23 nt, Artificial Sequence
  RNA Oligomer
uagcuggauuucugaacuauggu

SEQ ID NO: 57032 - RNA, 23 nt, Artificial Sequence
  RNA Oligomer
uuagcuggauuucugaacuaugg

SEQ ID NO: 57033 - RNA, 23 nt, Artificial Sequence
  RNA Oligomer
uuuagcuggauuucugaacuaug

SEQ ID NO: 57034 - RNA, 23 nt, Artificial Sequence
  RNA Oligomer
auuuagcuggauuucugaacuau

SEQ ID NO: 57035 - RNA, 23 nt, Artificial Sequence
  RNA Oligomer
gaaaaagcauugaauggaaaauc

SEQ ID NO: 57036 - RNA, 23 nt, Artificial Sequence
  RNA Oligomer
agaaaaagcauugaauggaaaau

SEQ ID NO: 57037 - RNA, 23 nt, Artificial Sequence
  RNA Oligomer
uagaaaaagcauugaauggaaaa

SEQ ID NO: 57038 - RNA, 23 nt, Artificial Sequence
  RNA Oligomer
cuagaaaaagcauugaauggaaa

SEQ ID NO: 57039 - RNA, 23 nt, Artificial Sequence
  RNA Oligomer
cgauauuauguacgauggagauu

SEQ ID NO: 57040 - RNA, 23 nt, Artificial Sequence
  RNA Oligomer
cugauaaaggcuuuauuagguau

SEQ ID NO: 57041 - RNA, 23 nt, Artificial Sequence
  RNA Oligomer
cguuuauuuauaacugguugcaa

SEQ ID NO: 57042 - RNA, 23 nt, Artificial Sequence
  RNA Oligomer
ugaaucuggccuuacguaauaua

SEQ ID NO: 57043 - RNA, 23 nt, Artificial Sequence
  RNA Oligomer
caaguuuguccuaaucaugccau

SEQ ID NO: 57044 - RNA, 23 nt, Artificial Sequence
  RNA Oligomer
ucgauauuauguacgauggagau

SEQ ID NO: 57045 - RNA, 23 nt, Artificial Sequence
  RNA Oligomer
cuggccuuacguaauauauuuuc

SEQ ID NO: 57046 - RNA, 23 nt, Artificial Sequence
  RNA Oligomer
gaaucuggccuuacguaauauau

SEQ ID NO: 57047 - RNA, 23 nt, Artificial Sequence
  RNA Oligomer
aaauaacuaaaaggcacugaguu

SEQ ID NO: 57048 - RNA, 23 nt, Artificial Sequence
  RNA Oligomer
gaacaaugcauagaugaucgaaa

SEQ ID NO: 57049 - RNA, 23 nt, Artificial Sequence
  RNA Oligomer
ggaaguaaaggcaaacauaaaua

SEQ ID NO: 57050 - RNA, 23 nt, Artificial Sequence
  RNA Oligomer
cugguguacggugggaagagauu

SEQ ID NO: 57051 - RNA, 23 nt, Artificial Sequence
  RNA Oligomer
acacuugugauuccuauucgaua

SEQ ID NO: 57052 - RNA, 23 nt, Artificial Sequence
  RNA Oligomer
gcuauuuccauuccaaaucguau

SEQ ID NO: 57053 - RNA, 23 nt, Artificial Sequence
  RNA Oligomer
agauaauacauuucguauggcua

SEQ ID NO: 57054 - RNA, 23 nt, Artificial Sequence
  RNA Oligomer
guaaucuacccuuauguuuauga

SEQ ID NO: 57055 - RNA, 23 nt, Artificial Sequence
  RNA Oligomer
acaucagcaacaaccucaaaauc

SEQ ID NO: 57056 - RNA, 23 nt, Artificial Sequence
  RNA Oligomer
cauuucuaaagugaccuuaucaa

SEQ ID NO: 57057 - RNA, 23 nt, Artificial Sequence
  RNA Oligomer
agaagucuggcaucauaaucaua

SEQ ID NO: 57058 - RNA, 23 nt, Artificial Sequence
  RNA Oligomer
cagguauaaauuugaacaaugca

SEQ ID NO: 57059 - RNA, 23 nt, Artificial Sequence
  RNA Oligomer
cguaucuauagagcuggcaugua

SEQ ID NO: 57060 - RNA, 23 nt, Artificial Sequence
  RNA Oligomer
cuaaugucuugcaaaauccaaua

SEQ ID NO: 57061 - RNA, 23 nt, Artificial Sequence
  RNA Oligomer
caaaguucaauuuagcuggauuu

SEQ ID NO: 57062 - RNA, 23 nt, Artificial Sequence
  RNA Oligomer
ggaacuggugauuuuggaagauc

SEQ ID NO: 57063 - RNA, 23 nt, Artificial Sequence
  RNA Oligomer
guauuuuuggaacuggugauuuu

SEQ ID NO: 57064 - RNA, 23 nt, Artificial Sequence
  RNA Oligomer
agaaaagcaagagacuguaugua

SEQ ID NO: 57065 - RNA, 23 nt, Artificial Sequence
  RNA Oligomer
gcacuuccucuuacuaugaauuc

SEQ ID NO: 57066 - RNA, 23 nt, Artificial Sequence
  RNA Oligomer
cucaaaaucaaucaauauccaga

SEQ ID NO: 57067 - RNA, 23 nt, Artificial Sequence
  RNA Oligomer
accucaaaaucaaucaauaucca

SEQ ID NO: 57068 - RNA, 23 nt, Artificial Sequence
  RNA Oligomer
guuaagggaugauggcuuuuaua

SEQ ID NO: 57069 - RNA, 23 nt, Artificial Sequence
  RNA Oligomer
aaaauauugguagacaucagcaa

SEQ ID NO: 57070 - RNA, 23 nt, Artificial Sequence
  RNA Oligomer
guaaaaugcugaccuauagaaaa

SEQ ID NO: 57071 - RNA, 23 nt, Artificial Sequence
  RNA Oligomer
ccuacaguaucaguggaaaagau

SEQ ID NO: 57072 - RNA, 23 nt, Artificial Sequence
  RNA Oligomer
ugaaauuuaggaugguucucacu

SEQ ID NO: 57073 - RNA, 23 nt, Artificial Sequence
  RNA Oligomer
gaauagucugcagguauaaauuu

SEQ ID NO: 57074 - RNA, 23 nt, Artificial Sequence
  RNA Oligomer
cagauauuuacugagaggaacua

SEQ ID NO: 57075 - RNA, 23 nt, Artificial Sequence
  RNA Oligomer
uggaacuggugauuuuggaagau

SEQ ID NO: 57076 - RNA, 23 nt, Artificial Sequence
  RNA Oligomer
ggcuuugggaauacuuggguuuu

SEQ ID NO: 57077 - RNA, 23 nt, Artificial Sequence
  RNA Oligomer
ucauauguggcuuugggaauacu

SEQ ID NO: 57078 - RNA, 23 nt, Artificial Sequence
  RNA Oligomer
ugauucauauguggcuuugggaa

SEQ ID NO: 57079 - RNA, 23 nt, Artificial Sequence
  RNA Oligomer
acgauggagauugggaaacuuaa

SEQ ID NO: 57080 - RNA, 23 nt, Artificial Sequence
  RNA Oligomer
ccucuacacacuugugauuccua

SEQ ID NO: 57081 - RNA, 23 nt, Artificial Sequence
  RNA Oligomer
agacuguauguauuuuuggaacu

SEQ ID NO: 57082 - RNA, 23 nt, Artificial Sequence
  RNA Oligomer
agacguaaucuacccuuauguuu

SEQ ID NO: 57083 - RNA, 23 nt, Artificial Sequence
  RNA Oligomer
gagacguaaucuacccuuauguu

SEQ ID NO: 57084 - RNA, 23 nt, Artificial Sequence
  RNA Oligomer
uguguuauaagagacguaaucua

SEQ ID NO: 57085 - RNA, 23 nt, Artificial Sequence
  RNA Oligomer
gcugugcugugugucuucuuguu

SEQ ID NO: 57086 - RNA, 23 nt, Artificial Sequence
  RNA Oligomer
cucuuacuaugaauucuucagaa

SEQ ID NO: 57087 - RNA, 23 nt, Artificial Sequence
  RNA Oligomer
gcaaagagugauggauauuguuc

SEQ ID NO: 57088 - RNA, 23 nt, Artificial Sequence
  RNA Oligomer
caauauccagaaucuaaugcaga

SEQ ID NO: 57089 - RNA, 23 nt, Artificial Sequence
  RNA Oligomer
cuaaacuucuuuacugcugauau

SEQ ID NO: 57090 - RNA, 23 nt, Artificial Sequence
  RNA Oligomer
cuuaagguagaaagaaugaguuu

SEQ ID NO: 57091 - RNA, 23 nt, Artificial Sequence
  RNA Oligomer
caggcuggucuagagaagucuuu

SEQ ID NO: 57092 - RNA, 23 nt, Artificial Sequence
  RNA Oligomer
gaaaaugucacuacucaccuaug

SEQ ID NO: 57093 - RNA, 23 nt, Artificial Sequence
  RNA Oligomer
gaucuucccacauaucaaaauaa

SEQ ID NO: 57094 - RNA, 23 nt, Artificial Sequence
  RNA Oligomer
ucuuugagaaauugacugacaua

SEQ ID NO: 57095 - RNA, 23 nt, Artificial Sequence
  RNA Oligomer
gucuuugagaaauugacugacau

SEQ ID NO: 57096 - RNA, 23 nt, Artificial Sequence
  RNA Oligomer
acaaaguucaauuuagcuggauu

SEQ ID NO: 57097 - RNA, 23 nt, Artificial Sequence
  RNA Oligomer
gggaaaggaacucaaaacacuag

SEQ ID NO: 57098 - RNA, 23 nt, Artificial Sequence
  RNA Oligomer
cauauguggcuuugggaauacuu

SEQ ID NO: 57099 - RNA, 23 nt, Artificial Sequence
  RNA Oligomer
agagacuguauguauuuuuggaa

SEQ ID NO: 57100 - RNA, 23 nt, Artificial Sequence
  RNA Oligomer
gauaauacauuucguauggcuau

SEQ ID NO: 57101 - RNA, 23 nt, Artificial Sequence
  RNA Oligomer
auauuguucguaaucuuggacuu

SEQ ID NO: 57102 - RNA, 23 nt, Artificial Sequence
  RNA Oligomer
agcaaagagugauggauauuguu

SEQ ID NO: 57103 - RNA, 23 nt, Artificial Sequence
  RNA Oligomer
ucaauauccagaaucuaaugcag

SEQ ID NO: 57104 - RNA, 23 nt, Artificial Sequence
  RNA Oligomer
gcacucugaugguuuuggcauaa

SEQ ID NO: 57105 - RNA, 23 nt, Artificial Sequence
  RNA Oligomer
caaaaaguuggacgacauugagu

SEQ ID NO: 57106 - RNA, 23 nt, Artificial Sequence
  RNA Oligomer
ccauuggaugaggguguugcuuu

SEQ ID NO: 57107 - RNA, 23 nt, Artificial Sequence
  RNA Oligomer
ccucuuuccuuauuaaacaugua

SEQ ID NO: 57108 - RNA, 23 nt, Artificial Sequence
  RNA Oligomer
auagaugaucgaaaauuacggaa

SEQ ID NO: 57109 - RNA, 23 nt, Artificial Sequence
  RNA Oligomer
gcuuuauuagguauaucugagga

SEQ ID NO: 57110 - RNA, 23 nt, Artificial Sequence
  RNA Oligomer
gcugaguuaagugaaaggaaaaa

SEQ ID NO: 57111 - RNA, 23 nt, Artificial Sequence
  RNA Oligomer
gggcugaguuaagugaaaggaaa

SEQ ID NO: 57112 - RNA, 23 nt, Artificial Sequence
  RNA Oligomer
guauguauuuuuggaacugguga

SEQ ID NO: 57113 - RNA, 23 nt, Artificial Sequence
  RNA Oligomer
guacgauggagauugggaaacuu

SEQ ID NO: 57114 - RNA, 23 nt, Artificial Sequence
  RNA Oligomer
cuguauguauuuuuggaacuggu

SEQ ID NO: 57115 - RNA, 23 nt, Artificial Sequence
  RNA Oligomer
cacuugugauuccuauucgauau

SEQ ID NO: 57116 - RNA, 23 nt, Artificial Sequence
  RNA Oligomer
gacuguauguauuuuuggaacug

SEQ ID NO: 57117 - RNA, 23 nt, Artificial Sequence
  RNA Oligomer
ccuucauguccucuacacacuug

SEQ ID NO: 57118 - RNA, 23 nt, Artificial Sequence
  RNA Oligomer
gaaaagcaagagacuguauguau

SEQ ID NO: 57119 - RNA, 23 nt, Artificial Sequence
  RNA Oligomer
acguaaucuacccuuauguuuau

SEQ ID NO: 57120 - RNA, 23 nt, Artificial Sequence
  RNA Oligomer
cuauuguguuauaagagacguaa

SEQ ID NO: 57121 - RNA, 23 nt, Artificial Sequence
  RNA Oligomer
ccacgugguaaaagcauuuaaca

SEQ ID NO: 57122 - RNA, 23 nt, Artificial Sequence
  RNA Oligomer
auguuaagggaugauggcuuuua

SEQ ID NO: 57123 - RNA, 23 nt, Artificial Sequence
  RNA Oligomer
cauguuaagggaugauggcuuuu

SEQ ID NO: 57124 - RNA, 23 nt, Artificial Sequence
  RNA Oligomer
acuaaacuucuuuacugcugaua

SEQ ID NO: 57125 - RNA, 23 nt, Artificial Sequence
  RNA Oligomer
aacuaaacuucuuuacugcugau

SEQ ID NO: 57126 - RNA, 23 nt, Artificial Sequence
  RNA Oligomer
ugggcgaacuguauuccuuuuaa

SEQ ID NO: 57127 - RNA, 23 nt, Artificial Sequence
  RNA Oligomer
acaacagaugaaaauaagugcuu

SEQ ID NO: 57128 - RNA, 23 nt, Artificial Sequence
  RNA Oligomer
acuuaagguagaaagaaugaguu

SEQ ID NO: 57129 - RNA, 23 nt, Artificial Sequence
  RNA Oligomer
aaaaauauugguagacaucagca

SEQ ID NO: 57130 - RNA, 23 nt, Artificial Sequence
  RNA Oligomer
ugagcauugguugauuaaaguuu

SEQ ID NO: 57131 - RNA, 23 nt, Artificial Sequence
  RNA Oligomer
acauugaguagagucaugguaua

SEQ ID NO: 57132 - RNA, 23 nt, Artificial Sequence
  RNA Oligomer
ugaucuucccacauaucaaaaua

SEQ ID NO: 57133 - RNA, 23 nt, Artificial Sequence
  RNA Oligomer
gaagucuggcaucauaaucauag

SEQ ID NO: 57134 - RNA, 23 nt, Artificial Sequence
  RNA Oligomer
agaaaacuuguauagaugcacuu

SEQ ID NO: 57135 - RNA, 23 nt, Artificial Sequence
  RNA Oligomer
agagaggugugaagauucaucau

SEQ ID NO: 57136 - RNA, 23 nt, Artificial Sequence
  RNA Oligomer
caaagaaggguugauaaaaguuc

SEQ ID NO: 57137 - RNA, 23 nt, Artificial Sequence
  RNA Oligomer
auacguaucuauagagcuggcau

SEQ ID NO: 57138 - RNA, 23 nt, Artificial Sequence
  RNA Oligomer
cuuuauuagguauaucugaggaa

SEQ ID NO: 57139 - RNA, 23 nt, Artificial Sequence
  RNA Oligomer
gggaaaggaacucaaaacacuag

SEQ ID NO: 57140 - RNA, 23 nt, Artificial Sequence
  RNA Oligomer
ugggaaaggaacucaaaacacua

SEQ ID NO: 57141 - RNA, 23 nt, Artificial Sequence
  RNA Oligomer
cugggaaaggaacucaaaacacu

SEQ ID NO: 57142 - RNA, 23 nt, Artificial Sequence
  RNA Oligomer
gcugggaaaggaacucaaaacac

SEQ ID NO: 57143 - RNA, 23 nt, Artificial Sequence
  RNA Oligomer
ggcugggaaaggaacucaaaaca

SEQ ID NO: 57144 - RNA, 23 nt, Artificial Sequence
  RNA Oligomer
uugauugauuuugagguuguugc

SEQ ID NO: 57145 - RNA, 23 nt, Artificial Sequence
  RNA Oligomer
ugauugauuuugagguuguugcu

SEQ ID NO: 57146 - RNA, 23 nt, Artificial Sequence
  RNA Oligomer
gauugauuuugagguuguugcug

SEQ ID NO: 57147 - RNA, 23 nt, Artificial Sequence
  RNA Oligomer
auugauuuugagguuguugcuga

SEQ ID NO: 57148 - RNA, 23 nt, Artificial Sequence
  RNA Oligomer
uugauuuugagguuguugcugau

SEQ ID NO: 57149 - RNA, 23 nt, Artificial Sequence
  RNA Oligomer
ccguaauuuucgaucaucuaugc

SEQ ID NO: 57150 - RNA, 23 nt, Artificial Sequence
  RNA Oligomer
cguaauuuucgaucaucuaugca

SEQ ID NO: 57151 - RNA, 23 nt, Artificial Sequence
  RNA Oligomer
guaauuuucgaucaucuaugcau

SEQ ID NO: 57152 - RNA, 23 nt, Artificial Sequence
  RNA Oligomer
uaauuuucgaucaucuaugcauu

SEQ ID NO: 57153 - RNA, 23 nt, Artificial Sequence
  RNA Oligomer
aauuuucgaucaucuaugcauug

SEQ ID NO: 57154 - RNA, 23 nt, Artificial Sequence
  RNA Oligomer
gcaauacuucuauuggauuuugc

SEQ ID NO: 57155 - RNA, 23 nt, Artificial Sequence
  RNA Oligomer
caauacuucuauuggauuuugca

SEQ ID NO: 57156 - RNA, 23 nt, Artificial Sequence
  RNA Oligomer
aauacuucuauuggauuuugcaa

SEQ ID NO: 57157 - RNA, 23 nt, Artificial Sequence
  RNA Oligomer
auacuucuauuggauuuugcaag

SEQ ID NO: 57158 - RNA, 23 nt, Artificial Sequence
  RNA Oligomer
uacuucuauuggauuuugcaaga

SEQ ID NO: 57159 - RNA, 23 nt, Artificial Sequence
  RNA Oligomer
guccaagauuacgaacaauaucc

SEQ ID NO: 57160 - RNA, 23 nt, Artificial Sequence
  RNA Oligomer
uccaagauuacgaacaauaucca

SEQ ID NO: 57161 - RNA, 23 nt, Artificial Sequence
  RNA Oligomer
ccaagauuacgaacaauauccau

SEQ ID NO: 57162 - RNA, 23 nt, Artificial Sequence
  RNA Oligomer
caagauuacgaacaauauccauc

SEQ ID NO: 57163 - RNA, 23 nt, Artificial Sequence
  RNA Oligomer
aagauuacgaacaauauccauca

SEQ ID NO: 57164 - RNA, 23 nt, Artificial Sequence
  RNA Oligomer
ugauaaggucacuuuagaaaugg

SEQ ID NO: 57165 - RNA, 23 nt, Artificial Sequence
  RNA Oligomer
gauaaggucacuuuagaaauggc

SEQ ID NO: 57166 - RNA, 23 nt, Artificial Sequence
  RNA Oligomer
auaaggucacuuuagaaauggcu

SEQ ID NO: 57167 - RNA, 23 nt, Artificial Sequence
  RNA Oligomer
uaaggucacuuuagaaauggcuu

SEQ ID NO: 57168 - RNA, 23 nt, Artificial Sequence
  RNA Oligomer
aaggucacuuuagaaauggcuug

SEQ ID NO: 57169 - RNA, 23 nt, Artificial Sequence
  RNA Oligomer
auaaaaaagacaaucuacaaugg

SEQ ID NO: 57170 - RNA, 23 nt, Artificial Sequence
  RNA Oligomer
uaaaaaagacaaucuacaauggu

SEQ ID NO: 57171 - RNA, 23 nt, Artificial Sequence
  RNA Oligomer
aaaaaagacaaucuacaauggug

SEQ ID NO: 57172 - RNA, 23 nt, Artificial Sequence
  RNA Oligomer
aaaaagacaaucuacaauggugc

SEQ ID NO: 57173 - RNA, 23 nt, Artificial Sequence
  RNA Oligomer
aaaagacaaucuacaauggugcg

SEQ ID NO: 57174 - RNA, 23 nt, Artificial Sequence
  RNA Oligomer
uauagucuacauguuuaauaagg

SEQ ID NO: 57175 - RNA, 23 nt, Artificial Sequence
  RNA Oligomer
auagucuacauguuuaauaagga

SEQ ID NO: 57176 - RNA, 23 nt, Artificial Sequence
  RNA Oligomer
uagucuacauguuuaauaaggaa

SEQ ID NO: 57177 - RNA, 23 nt, Artificial Sequence
  RNA Oligomer
agucuacauguuuaauaaggaaa

SEQ ID NO: 57178 - RNA, 23 nt, Artificial Sequence
  RNA Oligomer
gucuacauguuuaauaaggaaag

SEQ ID NO: 57179 - RNA, 23 nt, Artificial Sequence
  RNA Oligomer
ucugaauagcucaagacuucugc

SEQ ID NO: 57180 - RNA, 23 nt, Artificial Sequence
  RNA Oligomer
cugaauagcucaagacuucugca

SEQ ID NO: 57181 - RNA, 23 nt, Artificial Sequence
  RNA Oligomer
ugaauagcucaagacuucugcac

SEQ ID NO: 57182 - RNA, 23 nt, Artificial Sequence
  RNA Oligomer
gaauagcucaagacuucugcacc

SEQ ID NO: 57183 - RNA, 23 nt, Artificial Sequence
  RNA Oligomer
aauagcucaagacuucugcacca

SEQ ID NO: 57184 - RNA, 23 nt, Artificial Sequence
  RNA Oligomer
ccuaauaaagccuuuaucagugg

SEQ ID NO: 57185 - RNA, 23 nt, Artificial Sequence
  RNA Oligomer
cuaauaaagccuuuaucaguggu

SEQ ID NO: 57186 - RNA, 23 nt, Artificial Sequence
  RNA Oligomer
uaauaaagccuuuaucagugguc

SEQ ID NO: 57187 - RNA, 23 nt, Artificial Sequence
  RNA Oligomer
aauaaagccuuuaucagugguca

SEQ ID NO: 57188 - RNA, 23 nt, Artificial Sequence
  RNA Oligomer
auaaagccuuuaucaguggucac

SEQ ID NO: 57189 - RNA, 23 nt, Artificial Sequence
  RNA Oligomer
cuccuucuugaguauugccuggg

SEQ ID NO: 57190 - RNA, 23 nt, Artificial Sequence
  RNA Oligomer
uccuucuugaguauugccugggu

SEQ ID NO: 57191 - RNA, 23 nt, Artificial Sequence
  RNA Oligomer
ccuucuugaguauugccugggua

SEQ ID NO: 57192 - RNA, 23 nt, Artificial Sequence
  RNA Oligomer
cuucuugaguauugccuggguaa

SEQ ID NO: 57193 - RNA, 23 nt, Artificial Sequence
  RNA Oligomer
uucuugaguauugccuggguaac

SEQ ID NO: 57194 - RNA, 23 nt, Artificial Sequence
  RNA Oligomer
ugcaaccaguuauaaauaaacgc

SEQ ID NO: 57195 - RNA, 23 nt, Artificial Sequence
  RNA Oligomer
gcaaccaguuauaaauaaacgca

SEQ ID NO: 57196 - RNA, 23 nt, Artificial Sequence
  RNA Oligomer
caaccaguuauaaauaaacgcaa

SEQ ID NO: 57197 - RNA, 23 nt, Artificial Sequence
  RNA Oligomer
aaccaguuauaaauaaacgcaaa

SEQ ID NO: 57198 - RNA, 23 nt, Artificial Sequence
  RNA Oligomer
accaguuauaaauaaacgcaaau

SEQ ID NO: 57199 - RNA, 23 nt, Artificial Sequence
  RNA Oligomer
ggucacuuuagaaauggcuuggc

SEQ ID NO: 57200 - RNA, 23 nt, Artificial Sequence
  RNA Oligomer
gucacuuuagaaauggcuuggca

SEQ ID NO: 57201 - RNA, 23 nt, Artificial Sequence
  RNA Oligomer
ucacuuuagaaauggcuuggcaa

SEQ ID NO: 57202 - RNA, 23 nt, Artificial Sequence
  RNA Oligomer
cacuuuagaaauggcuuggcaac

SEQ ID NO: 57203 - RNA, 23 nt, Artificial Sequence
  RNA Oligomer
acuuuagaaauggcuuggcaaca

SEQ ID NO: 57204 - RNA, 23 nt, Artificial Sequence
  RNA Oligomer
uagaaaaauauccuggauuguug

SEQ ID NO: 57205 - RNA, 23 nt, Artificial Sequence
  RNA Oligomer
agaaaaauauccuggauuguuga

SEQ ID NO: 57206 - RNA, 23 nt, Artificial Sequence
  RNA Oligomer
gaaaaauauccuggauuguugau

SEQ ID NO: 57207 - RNA, 23 nt, Artificial Sequence
  RNA Oligomer
aaaaauauccuggauuguugaug

SEQ ID NO: 57208 - RNA, 23 nt, Artificial Sequence
  RNA Oligomer
aaaauauccuggauuguugaugu

SEQ ID NO: 57209 - RNA, 23 nt, Artificial Sequence
  RNA Oligomer
aaauauccuggauuguugauguu

SEQ ID NO: 57210 - RNA, 23 nt, Artificial Sequence
  RNA Oligomer
aauauccuggauuguugauguug

SEQ ID NO: 57211 - RNA, 23 nt, Artificial Sequence
  RNA Oligomer
auauccuggauuguugauguugu

SEQ ID NO: 57212 - RNA, 23 nt, Artificial Sequence
  RNA Oligomer
uauccuggauuguugauguuguu

SEQ ID NO: 57213 - RNA, 23 nt, Artificial Sequence
  RNA Oligomer
guggauugcuaugauuaugaugc

SEQ ID NO: 57214 - RNA, 23 nt, Artificial Sequence
  RNA Oligomer
uggauugcuaugauuaugaugcc

SEQ ID NO: 57215 - RNA, 23 nt, Artificial Sequence
  RNA Oligomer
ggauugcuaugauuaugaugcca

SEQ ID NO: 57216 - RNA, 23 nt, Artificial Sequence
  RNA Oligomer
gauugcuaugauuaugaugccag

SEQ ID NO: 57217 - RNA, 23 nt, Artificial Sequence
  RNA Oligomer
auugcuaugauuaugaugccaga

SEQ ID NO: 57218 - RNA, 23 nt, Artificial Sequence
  RNA Oligomer
cagaaaaaugccaaacucagugc

SEQ ID NO: 57219 - RNA, 23 nt, Artificial Sequence
  RNA Oligomer
agaaaaaugccaaacucagugcc

SEQ ID NO: 57220 - RNA, 23 nt, Artificial Sequence
  RNA Oligomer
gaaaaaugccaaacucagugccu

SEQ ID NO: 57221 - RNA, 23 nt, Artificial Sequence
  RNA Oligomer
aaaaaugccaaacucagugccuu

SEQ ID NO: 57222 - RNA, 23 nt, Artificial Sequence
  RNA Oligomer
aaaaugccaaacucagugccuuu

SEQ ID NO: 57223 - RNA, 23 nt, Artificial Sequence
  RNA Oligomer
uguguagaggacaugaaggaagg

SEQ ID NO: 57224 - RNA, 23 nt, Artificial Sequence
  RNA Oligomer
guguagaggacaugaaggaaggc

SEQ ID NO: 57225 - RNA, 23 nt, Artificial Sequence
  RNA Oligomer
uguagaggacaugaaggaaggca

SEQ ID NO: 57226 - RNA, 23 nt, Artificial Sequence
  RNA Oligomer
guagaggacaugaaggaaggcaa

SEQ ID NO: 57227 - RNA, 23 nt, Artificial Sequence
  RNA Oligomer
uagaggacaugaaggaaggcaaa

SEQ ID NO: 57228 - RNA, 23 nt, Artificial Sequence
  RNA Oligomer
cuuucuuuucauaaacauaaggg

SEQ ID NO: 57229 - RNA, 23 nt, Artificial Sequence
  RNA Oligomer
uuucuuuucauaaacauaagggu

SEQ ID NO: 57230 - RNA, 23 nt, Artificial Sequence
  RNA Oligomer
uucuuuucauaaacauaagggua

SEQ ID NO: 57231 - RNA, 23 nt, Artificial Sequence
  RNA Oligomer
ucuuuucauaaacauaaggguag

SEQ ID NO: 57232 - RNA, 23 nt, Artificial Sequence
  RNA Oligomer
cuuuucauaaacauaaggguaga

SEQ ID NO: 57233 - RNA, 23 nt, Artificial Sequence
  RNA Oligomer
uguuuaauaaggaaagagguuug

SEQ ID NO: 57234 - RNA, 23 nt, Artificial Sequence
  RNA Oligomer
guuuaauaaggaaagagguuuga

SEQ ID NO: 57235 - RNA, 23 nt, Artificial Sequence
  RNA Oligomer
uuuaauaaggaaagagguuugaa

SEQ ID NO: 57236 - RNA, 23 nt, Artificial Sequence
  RNA Oligomer
uuaauaaggaaagagguuugaaa

SEQ ID NO: 57237 - RNA, 23 nt, Artificial Sequence
  RNA Oligomer
uaauaaggaaagagguuugaaaa

SEQ ID NO: 57238 - RNA, 23 nt, Artificial Sequence
  RNA Oligomer
uugcuaugauuaugaugccagac

SEQ ID NO: 57239 - RNA, 23 nt, Artificial Sequence
  RNA Oligomer
ucuccuucuugaguauugccugg

SEQ ID NO: 57240 - RNA, 23 nt, Artificial Sequence
  RNA Oligomer
caaaaauacauacagucucuugc

SEQ ID NO: 57241 - RNA, 23 nt, Artificial Sequence
  RNA Oligomer
aaaaauacauacagucucuugcu

SEQ ID NO: 57242 - RNA, 23 nt, Artificial Sequence
  RNA Oligomer
aaaauacauacagucucuugcuu

SEQ ID NO: 57243 - RNA, 23 nt, Artificial Sequence
  RNA Oligomer
aaauacauacagucucuugcuuu

SEQ ID NO: 57244 - RNA, 23 nt, Artificial Sequence
  RNA Oligomer
aauacauacagucucuugcuuuu

SEQ ID NO: 57245 - RNA, 23 nt, Artificial Sequence
  RNA Oligomer
uuuucauaaacauaaggguagau

SEQ ID NO: 57246 - RNA, 23 nt, Artificial Sequence
  RNA Oligomer
uuucauaaacauaaggguagauu

SEQ ID NO: 57247 - RNA, 23 nt, Artificial Sequence
  RNA Oligomer
uucauaaacauaaggguagauua

SEQ ID NO: 57248 - RNA, 23 nt, Artificial Sequence
  RNA Oligomer
aagguacucugcauuagauucug

SEQ ID NO: 57249 - RNA, 23 nt, Artificial Sequence
  RNA Oligomer
agguacucugcauuagauucugg

SEQ ID NO: 57250 - RNA, 23 nt, Artificial Sequence
  RNA Oligomer
gguacucugcauuagauucugga

SEQ ID NO: 57251 - RNA, 23 nt, Artificial Sequence
  RNA Oligomer
guacucugcauuagauucuggau

SEQ ID NO: 57252 - RNA, 23 nt, Artificial Sequence
  RNA Oligomer
uacucugcauuagauucuggaua

SEQ ID NO: 57253 - RNA, 23 nt, Artificial Sequence
  RNA Oligomer
acucugcauuagauucuggauau

SEQ ID NO: 57254 - RNA, 23 nt, Artificial Sequence
  RNA Oligomer
gauauugauugauuuugagguug

SEQ ID NO: 57255 - RNA, 23 nt, Artificial Sequence
  RNA Oligomer
auauugauugauuuugagguugu

SEQ ID NO: 57256 - RNA, 23 nt, Artificial Sequence
  RNA Oligomer
uauugauugauuuugagguuguu

SEQ ID NO: 57257 - RNA, 23 nt, Artificial Sequence
  RNA Oligomer
auugauugauuuugagguuguug

SEQ ID NO: 57258 - RNA, 23 nt, Artificial Sequence
  RNA Oligomer
cacauuuauaaaagccaucaucc

SEQ ID NO: 57259 - RNA, 23 nt, Artificial Sequence
  RNA Oligomer
acauuuauaaaagccaucauccc

SEQ ID NO: 57260 - RNA, 23 nt, Artificial Sequence
  RNA Oligomer
cauuuauaaaagccaucaucccu

SEQ ID NO: 57261 - RNA, 23 nt, Artificial Sequence
  RNA Oligomer
auuuauaaaagccaucaucccuu

SEQ ID NO: 57262 - RNA, 23 nt, Artificial Sequence
  RNA Oligomer
uuuauaaaagccaucaucccuua

SEQ ID NO: 57263 - RNA, 23 nt, Artificial Sequence
  RNA Oligomer
aucuguuaaaaggaauacaguuc

SEQ ID NO: 57264 - RNA, 23 nt, Artificial Sequence
  RNA Oligomer
ucuguuaaaaggaauacaguucg

SEQ ID NO: 57265 - RNA, 23 nt, Artificial Sequence
  RNA Oligomer
cuguuaaaaggaauacaguucgc

SEQ ID NO: 57266 - RNA, 23 nt, Artificial Sequence
  RNA Oligomer
uguuaaaaggaauacaguucgcc

SEQ ID NO: 57267 - RNA, 23 nt, Artificial Sequence
  RNA Oligomer
guuaaaaggaauacaguucgccc

SEQ ID NO: 57268 - RNA, 23 nt, Artificial Sequence
  RNA Oligomer
ucuuucuaccuuaaguaaacugg

SEQ ID NO: 57269 - RNA, 23 nt, Artificial Sequence
  RNA Oligomer
cuuucuaccuuaaguaaacugga

SEQ ID NO: 57270 - RNA, 23 nt, Artificial Sequence
  RNA Oligomer
uuucuaccuuaaguaaacuggag

SEQ ID NO: 57271 - RNA, 23 nt, Artificial Sequence
  RNA Oligomer
uucuaccuuaaguaaacuggagg

SEQ ID NO: 57272 - RNA, 23 nt, Artificial Sequence
  RNA Oligomer
ucuaccuuaaguaaacuggagga

SEQ ID NO: 57273 - RNA, 23 nt, Artificial Sequence
  RNA Oligomer
aggagucagcuguguuaauaugg

SEQ ID NO: 57274 - RNA, 23 nt, Artificial Sequence
  RNA Oligomer
ggagucagcuguguuaauauggu

SEQ ID NO: 57275 - RNA, 23 nt, Artificial Sequence
  RNA Oligomer
gagucagcuguguuaauaugguc

SEQ ID NO: 57276 - RNA, 23 nt, Artificial Sequence
  RNA Oligomer
agucagcuguguuaauaugguca

SEQ ID NO: 57277 - RNA, 23 nt, Artificial Sequence
  RNA Oligomer
gucagcuguguuaauauggucaa

SEQ ID NO: 57278 - RNA, 23 nt, Artificial Sequence
  RNA Oligomer
gagguuguugcugaugucuacca

SEQ ID NO: 57279 - RNA, 23 nt, Artificial Sequence
  RNA Oligomer
agguuguugcugaugucuaccaa

SEQ ID NO: 57280 - RNA, 23 nt, Artificial Sequence
  RNA Oligomer
gguuguugcugaugucuaccaau

SEQ ID NO: 57281 - RNA, 23 nt, Artificial Sequence
  RNA Oligomer
guuguugcugaugucuaccaaua

SEQ ID NO: 57282 - RNA, 23 nt, Artificial Sequence
  RNA Oligomer
uuguugcugaugucuaccaauau

SEQ ID NO: 57283 - RNA, 23 nt, Artificial Sequence
  RNA Oligomer
cuucuuuaacaaaaagagcaugg

SEQ ID NO: 57284 - RNA, 23 nt, Artificial Sequence
  RNA Oligomer
uucuuuaacaaaaagagcauggu

SEQ ID NO: 57285 - RNA, 23 nt, Artificial Sequence
  RNA Oligomer
ucuuuaacaaaaagagcaugguu

SEQ ID NO: 57286 - RNA, 23 nt, Artificial Sequence
  RNA Oligomer
cuuuaacaaaaagagcaugguua

SEQ ID NO: 57287 - RNA, 23 nt, Artificial Sequence
  RNA Oligomer
uuuaacaaaaagagcaugguuaa

SEQ ID NO: 57288 - RNA, 23 nt, Artificial Sequence
  RNA Oligomer
gcucaaguaaaagagcaguaucc

SEQ ID NO: 57289 - RNA, 23 nt, Artificial Sequence
  RNA Oligomer
cucaaguaaaagagcaguaucca

SEQ ID NO: 57290 - RNA, 23 nt, Artificial Sequence
  RNA Oligomer
ucaaguaaaagagcaguauccag

SEQ ID NO: 57291 - RNA, 23 nt, Artificial Sequence
  RNA Oligomer
caaguaaaagagcaguauccagc

SEQ ID NO: 57292 - RNA, 23 nt, Artificial Sequence
  RNA Oligomer
aaguaaaagagcaguauccagcc

SEQ ID NO: 57293 - RNA, 23 nt, Artificial Sequence
  RNA Oligomer
aaagacaaucuacaauggugcga

SEQ ID NO: 57294 - RNA, 23 nt, Artificial Sequence
  RNA Oligomer
aagacaaucuacaauggugcgau

SEQ ID NO: 57295 - RNA, 23 nt, Artificial Sequence
  RNA Oligomer
agacaaucuacaauggugcgaug

SEQ ID NO: 57296 - RNA, 23 nt, Artificial Sequence
  RNA Oligomer
aauaaggaaagagguuugaaaaa

SEQ ID NO: 57297 - RNA, 23 nt, Artificial Sequence
  RNA Oligomer
uagcuugcugucuaaaauucugg

SEQ ID NO: 57298 - RNA, 23 nt, Artificial Sequence
  RNA Oligomer
agcuugcugucuaaaauucuggu

SEQ ID NO: 57299 - RNA, 23 nt, Artificial Sequence
  RNA Oligomer
gcuugcugucuaaaauucugguu

SEQ ID NO: 57300 - RNA, 23 nt, Artificial Sequence
  RNA Oligomer
cuugcugucuaaaauucugguuu

SEQ ID NO: 57301 - RNA, 23 nt, Artificial Sequence
  RNA Oligomer
uugcugucuaaaauucugguuuc

SEQ ID NO: 57302 - RNA, 23 nt, Artificial Sequence
  RNA Oligomer
uuuauagaggaagaauuacaugc

SEQ ID NO: 57303 - RNA, 23 nt, Artificial Sequence
  RNA Oligomer
uuauagaggaagaauuacaugcc

SEQ ID NO: 57304 - RNA, 23 nt, Artificial Sequence
  RNA Oligomer
uauagaggaagaauuacaugcca

SEQ ID NO: 57305 - RNA, 23 nt, Artificial Sequence
  RNA Oligomer
auagaggaagaauuacaugccag

SEQ ID NO: 57306 - RNA, 23 nt, Artificial Sequence
  RNA Oligomer
uagaggaagaauuacaugccagc

SEQ ID NO: 57307 - RNA, 23 nt, Artificial Sequence
  RNA Oligomer
ccucagauauaccuaauaaagcc

SEQ ID NO: 57308 - RNA, 23 nt, Artificial Sequence
  RNA Oligomer
cucagauauaccuaauaaagccu

SEQ ID NO: 57309 - RNA, 23 nt, Artificial Sequence
  RNA Oligomer
ucagauauaccuaauaaagccuu

SEQ ID NO: 57310 - RNA, 23 nt, Artificial Sequence
  RNA Oligomer
cagauauaccuaauaaagccuuu

SEQ ID NO: 57311 - RNA, 23 nt, Artificial Sequence
  RNA Oligomer
agauauaccuaauaaagccuuua

SEQ ID NO: 57312 - RNA, 23 nt, Artificial Sequence
  RNA Oligomer
accuaauaaagccuuuaucagug

SEQ ID NO: 57313 - RNA, 23 nt, Artificial Sequence
  RNA Oligomer
auggaaauagccauacgaaaugu

SEQ ID NO: 57314 - RNA, 23 nt, Artificial Sequence
  RNA Oligomer
uggaaauagccauacgaaaugua

SEQ ID NO: 57315 - RNA, 23 nt, Artificial Sequence
  RNA Oligomer
ggaaauagccauacgaaauguau

SEQ ID NO: 57316 - RNA, 23 nt, Artificial Sequence
  RNA Oligomer
gaaauagccauacgaaauguauu

SEQ ID NO: 57317 - RNA, 23 nt, Artificial Sequence
  RNA Oligomer
aaauagccauacgaaauguauua

SEQ ID NO: 57318 - RNA, 23 nt, Artificial Sequence
  RNA Oligomer
acuguuuugcauaacauagguga

SEQ ID NO: 57319 - RNA, 23 nt, Artificial Sequence
  RNA Oligomer
cuguuuugcauaacauaggugag

SEQ ID NO: 57320 - RNA, 23 nt, Artificial Sequence
  RNA Oligomer
uguuuugcauaacauaggugagu

SEQ ID NO: 57321 - RNA, 23 nt, Artificial Sequence
  RNA Oligomer
guuuugcauaacauaggugagua

SEQ ID NO: 57322 - RNA, 23 nt, Artificial Sequence
  RNA Oligomer
uuuugcauaacauaggugaguag

SEQ ID NO: 57323 - RNA, 23 nt, Artificial Sequence
  RNA Oligomer
ugcauaacauaggugaguaguga

SEQ ID NO: 57324 - RNA, 23 nt, Artificial Sequence
  RNA Oligomer
gcauaacauaggugaguagugac

SEQ ID NO: 57325 - RNA, 23 nt, Artificial Sequence
  RNA Oligomer
cauaacauaggugaguagugaca

SEQ ID NO: 57326 - RNA, 23 nt, Artificial Sequence
  RNA Oligomer
auaacauaggugaguagugacau

SEQ ID NO: 57327 - RNA, 23 nt, Artificial Sequence
  RNA Oligomer
uaacauaggugaguagugacauu

SEQ ID NO: 57328 - RNA, 23 nt, Artificial Sequence
  RNA Oligomer
cagaaaaacagugagaaccaucc

SEQ ID NO: 57329 - RNA, 23 nt, Artificial Sequence
  RNA Oligomer
agaaaaacagugagaaccauccu

SEQ ID NO: 57330 - RNA, 23 nt, Artificial Sequence
  RNA Oligomer
gaaaaacagugagaaccauccua

SEQ ID NO: 57331 - RNA, 23 nt, Artificial Sequence
  RNA Oligomer
aaaaacagugagaaccauccuaa

SEQ ID NO: 57332 - RNA, 23 nt, Artificial Sequence
  RNA Oligomer
aaaacagugagaaccauccuaaa

SEQ ID NO: 57333 - RNA, 23 nt, Artificial Sequence
  RNA Oligomer
uaauacuuaaccuaauauagugc

SEQ ID NO: 57334 - RNA, 23 nt, Artificial Sequence
  RNA Oligomer
aauacuuaaccuaauauagugca

SEQ ID NO: 57335 - RNA, 23 nt, Artificial Sequence
  RNA Oligomer
auacuuaaccuaauauagugcaa

SEQ ID NO: 57336 - RNA, 23 nt, Artificial Sequence
  RNA Oligomer
uacuuaaccuaauauagugcaau

SEQ ID NO: 57337 - RNA, 23 nt, Artificial Sequence
  RNA Oligomer
acuuaaccuaauauagugcaauu

SEQ ID NO: 57338 - RNA, 23 nt, Artificial Sequence
  RNA Oligomer
cauuucacuagaauucaucaugg

SEQ ID NO: 57339 - RNA, 23 nt, Artificial Sequence
  RNA Oligomer
auuucacuagaauucaucauggu

SEQ ID NO: 57340 - RNA, 23 nt, Artificial Sequence
  RNA Oligomer
uuucacuagaauucaucauggua

SEQ ID NO: 57341 - RNA, 23 nt, Artificial Sequence
  RNA Oligomer
uucacuagaauucaucaugguaa

SEQ ID NO: 57342 - RNA, 23 nt, Artificial Sequence
  RNA Oligomer
ucacuagaauucaucaugguaau

SEQ ID NO: 57343 - RNA, 23 nt, Artificial Sequence
  RNA Oligomer
aaaaaacaacaaaaaccucauuc

SEQ ID NO: 57344 - RNA, 23 nt, Artificial Sequence
  RNA Oligomer
aaaaacaacaaaaaccucauucc

SEQ ID NO: 57345 - RNA, 23 nt, Artificial Sequence
  RNA Oligomer
aaaacaacaaaaaccucauuccc

SEQ ID NO: 57346 - RNA, 23 nt, Artificial Sequence
  RNA Oligomer
aaacaacaaaaaccucauucccu

SEQ ID NO: 57347 - RNA, 23 nt, Artificial Sequence
  RNA Oligomer
aacaacaaaaaccucauucccuu

SEQ ID NO: 57348 - RNA, 23 nt, Artificial Sequence
  RNA Oligomer
acaacaaaaaccucauucccuuu

SEQ ID NO: 57349 - RNA, 23 nt, Artificial Sequence
  RNA Oligomer
gugcaucuauacaaguuuucucc

SEQ ID NO: 57350 - RNA, 23 nt, Artificial Sequence
  RNA Oligomer
ugcaucuauacaaguuuucucca

SEQ ID NO: 57351 - RNA, 23 nt, Artificial Sequence
  RNA Oligomer
gcaucuauacaaguuuucuccau

SEQ ID NO: 57352 - RNA, 23 nt, Artificial Sequence
  RNA Oligomer
caucuauacaaguuuucuccaua

SEQ ID NO: 57353 - RNA, 23 nt, Artificial Sequence
  RNA Oligomer
aucuauacaaguuuucuccauaa

SEQ ID NO: 57354 - RNA, 23 nt, Artificial Sequence
  RNA Oligomer
cuuuuucuaguguuuugaguucc

SEQ ID NO: 57355 - RNA, 23 nt, Artificial Sequence
  RNA Oligomer
uuuuucuaguguuuugaguuccu

SEQ ID NO: 57356 - RNA, 23 nt, Artificial Sequence
  RNA Oligomer
uuuucuaguguuuugaguuccuu

SEQ ID NO: 57357 - RNA, 23 nt, Artificial Sequence
  RNA Oligomer
uuucuaguguuuugaguuccuuu

SEQ ID NO: 57358 - RNA, 23 nt, Artificial Sequence
  RNA Oligomer
uucuaguguuuugaguuccuuuc

SEQ ID NO: 57359 - RNA, 23 nt, Artificial Sequence
  RNA Oligomer
aaacuugaucaccagcacagugc

SEQ ID NO: 57360 - RNA, 23 nt, Artificial Sequence
  RNA Oligomer
aacuugaucaccagcacagugca

SEQ ID NO: 57361 - RNA, 23 nt, Artificial Sequence
  RNA Oligomer
acuugaucaccagcacagugcaa

SEQ ID NO: 57362 - RNA, 23 nt, Artificial Sequence
  RNA Oligomer
cuugaucaccagcacagugcaag

SEQ ID NO: 57363 - RNA, 23 nt, Artificial Sequence
  RNA Oligomer
uugaucaccagcacagugcaagg

SEQ ID NO: 57364 - RNA, 23 nt, Artificial Sequence
  RNA Oligomer
cacagugcaaggaaugauaagcc

SEQ ID NO: 57365 - RNA, 23 nt, Artificial Sequence
  RNA Oligomer
acagugcaaggaaugauaagccc

SEQ ID NO: 57366 - RNA, 23 nt, Artificial Sequence
  RNA Oligomer
cagugcaaggaaugauaagcccu

SEQ ID NO: 57367 - RNA, 23 nt, Artificial Sequence
  RNA Oligomer
agugcaaggaaugauaagcccua

SEQ ID NO: 57368 - RNA, 23 nt, Artificial Sequence
  RNA Oligomer
gugcaaggaaugauaagcccuaa

SEQ ID NO: 57369 - RNA, 23 nt, Artificial Sequence
  RNA Oligomer
ugcaaggaaugauaagcccuaac

SEQ ID NO: 57370 - RNA, 23 nt, Artificial Sequence
  RNA Oligomer
guuauuggaaagauacgauuugg

SEQ ID NO: 57371 - RNA, 23 nt, Artificial Sequence
  RNA Oligomer
uuauuggaaagauacgauuugga

SEQ ID NO: 57372 - RNA, 23 nt, Artificial Sequence
  RNA Oligomer
uauuggaaagauacgauuuggaa

SEQ ID NO: 57373 - RNA, 23 nt, Artificial Sequence
  RNA Oligomer
auuggaaagauacgauuuggaau

SEQ ID NO: 57374 - RNA, 23 nt, Artificial Sequence
  RNA Oligomer
uuggaaagauacgauuuggaaug

SEQ ID NO: 57375 - RNA, 23 nt, Artificial Sequence
  RNA Oligomer
uagaaaaacaagaagacacacag

SEQ ID NO: 57376 - RNA, 23 nt, Artificial Sequence
  RNA Oligomer
agaaaaacaagaagacacacagc

SEQ ID NO: 57377 - RNA, 23 nt, Artificial Sequence
  RNA Oligomer
gaaaaacaagaagacacacagca

SEQ ID NO: 57378 - RNA, 23 nt, Artificial Sequence
  RNA Oligomer
aaaaacaagaagacacacagcac

SEQ ID NO: 57379 - RNA, 23 nt, Artificial Sequence
  RNA Oligomer
aaaacaagaagacacacagcaca

SEQ ID NO: 57380 - RNA, 23 nt, Artificial Sequence
  RNA Oligomer
cuccacauuggaaauagcugcag

SEQ ID NO: 57381 - RNA, 23 nt, Artificial Sequence
  RNA Oligomer
uccacauuggaaauagcugcagg

SEQ ID NO: 57382 - RNA, 23 nt, Artificial Sequence
  RNA Oligomer
ccacauuggaaauagcugcaggg

SEQ ID NO: 57383 - RNA, 23 nt, Artificial Sequence
  RNA Oligomer
cacauuggaaauagcugcagggg

SEQ ID NO: 57384 - RNA, 23 nt, Artificial Sequence
  RNA Oligomer
acauuggaaauagcugcaggggg

SEQ ID NO: 57385 - RNA, 23 nt, Artificial Sequence
  RNA Oligomer
caagguacucugcauuagauucu

SEQ ID NO: 57386 - RNA, 23 nt, Artificial Sequence
  RNA Oligomer
uuauaaaagccaucaucccuuaa

SEQ ID NO: 57387 - RNA, 23 nt, Artificial Sequence
  RNA Oligomer
cagcuauuaugccaaaaccauca

SEQ ID NO: 57388 - RNA, 23 nt, Artificial Sequence
  RNA Oligomer
agcuauuaugccaaaaccaucag

SEQ ID NO: 57389 - RNA, 23 nt, Artificial Sequence
  RNA Oligomer
gcuauuaugccaaaaccaucaga

SEQ ID NO: 57390 - RNA, 23 nt, Artificial Sequence
  RNA Oligomer
cuauuaugccaaaaccaucagag

SEQ ID NO: 57391 - RNA, 23 nt, Artificial Sequence
  RNA Oligomer
uauuaugccaaaaccaucagagu

SEQ ID NO: 57392 - RNA, 23 nt, Artificial Sequence
  RNA Oligomer
cagguagagcauuuuuacuaggc

SEQ ID NO: 57393 - RNA, 23 nt, Artificial Sequence
  RNA Oligomer
agguagagcauuuuuacuaggcu

SEQ ID NO: 57394 - RNA, 23 nt, Artificial Sequence
  RNA Oligomer
gguagagcauuuuuacuaggcua

SEQ ID NO: 57395 - RNA, 23 nt, Artificial Sequence
  RNA Oligomer
guagagcauuuuuacuaggcuau

SEQ ID NO: 57396 - RNA, 23 nt, Artificial Sequence
  RNA Oligomer
uagagcauuuuuacuaggcuaua

SEQ ID NO: 57397 - RNA, 23 nt, Artificial Sequence
  RNA Oligomer
ugguuaacuccaaagacuucucu

SEQ ID NO: 57398 - RNA, 23 nt, Artificial Sequence
  RNA Oligomer
gguuaacuccaaagacuucucua

SEQ ID NO: 57399 - RNA, 23 nt, Artificial Sequence
  RNA Oligomer
guuaacuccaaagacuucucuag

SEQ ID NO: 57400 - RNA, 23 nt, Artificial Sequence
  RNA Oligomer
uuaacuccaaagacuucucuaga

SEQ ID NO: 57401 - RNA, 23 nt, Artificial Sequence
  RNA Oligomer
uaacuccaaagacuucucuagac

SEQ ID NO: 57402 - RNA, 23 nt, Artificial Sequence
  RNA Oligomer
aggucacuuuagaaauggcuugg

SEQ ID NO: 57403 - RNA, 23 nt, Artificial Sequence
  RNA Oligomer
aaggaaagagguuugaaaaaugc

SEQ ID NO: 57404 - RNA, 23 nt, Artificial Sequence
  RNA Oligomer
aggaaagagguuugaaaaaugcc

SEQ ID NO: 57405 - RNA, 23 nt, Artificial Sequence
  RNA Oligomer
ggaaagagguuugaaaaaugccu

SEQ ID NO: 57406 - RNA, 23 nt, Artificial Sequence
  RNA Oligomer
gaaagagguuugaaaaaugccua

SEQ ID NO: 57407 - RNA, 23 nt, Artificial Sequence
  RNA Oligomer
aaagagguuugaaaaaugccuau

SEQ ID NO: 57408 - RNA, 23 nt, Artificial Sequence
  RNA Oligomer
gcagaaaaaugccaaacucagug

SEQ ID NO: 57409 - RNA, 23 nt, Artificial Sequence
  RNA Oligomer
cucagugccuuuuaguuauuuug

SEQ ID NO: 57410 - RNA, 23 nt, Artificial Sequence
  RNA Oligomer
ucagugccuuuuaguuauuuuga

SEQ ID NO: 57411 - RNA, 23 nt, Artificial Sequence
  RNA Oligomer
cagugccuuuuaguuauuuugau

SEQ ID NO: 57412 - RNA, 23 nt, Artificial Sequence
  RNA Oligomer
agugccuuuuaguuauuuugaua

SEQ ID NO: 57413 - RNA, 23 nt, Artificial Sequence
  RNA Oligomer
gugccuuuuaguuauuuugauau

SEQ ID NO: 57414 - RNA, 23 nt, Artificial Sequence
  RNA Oligomer
agacuaagacagauauagaagcu

SEQ ID NO: 57415 - RNA, 23 nt, Artificial Sequence
  RNA Oligomer
gacuaagacagauauagaagcua

SEQ ID NO: 57416 - RNA, 23 nt, Artificial Sequence
  RNA Oligomer
acuaagacagauauagaagcuac

SEQ ID NO: 57417 - RNA, 23 nt, Artificial Sequence
  RNA Oligomer
cuaagacagauauagaagcuacu

SEQ ID NO: 57418 - RNA, 23 nt, Artificial Sequence
  RNA Oligomer
uaagacagauauagaagcuacuu

SEQ ID NO: 57419 - RNA, 23 nt, Artificial Sequence
  RNA Oligomer
gaucaagaacuuuuaucaacccu

SEQ ID NO: 57420 - RNA, 23 nt, Artificial Sequence
  RNA Oligomer
aucaagaacuuuuaucaacccuu

SEQ ID NO: 57421 - RNA, 23 nt, Artificial Sequence
  RNA Oligomer
ucaagaacuuuuaucaacccuuc

SEQ ID NO: 57422 - RNA, 23 nt, Artificial Sequence
  RNA Oligomer
caagaacuuuuaucaacccuucu

SEQ ID NO: 57423 - RNA, 23 nt, Artificial Sequence
  RNA Oligomer
aagaacuuuuaucaacccuucuu

SEQ ID NO: 57424 - RNA, 23 nt, Artificial Sequence
  RNA Oligomer
ggauaucccuccauuuuuauuca

SEQ ID NO: 57425 - RNA, 23 nt, Artificial Sequence
  RNA Oligomer
gauaucccuccauuuuuauucag

SEQ ID NO: 57426 - RNA, 23 nt, Artificial Sequence
  RNA Oligomer
auaucccuccauuuuuauucagu

SEQ ID NO: 57427 - RNA, 23 nt, Artificial Sequence
  RNA Oligomer
uaucccuccauuuuuauucaguc

SEQ ID NO: 57428 - RNA, 23 nt, Artificial Sequence
  RNA Oligomer
aucccuccauuuuuauucagucu

SEQ ID NO: 57429 - RNA, 23 nt, Artificial Sequence
  RNA Oligomer
gaggaagaauuacaugccagcuc

SEQ ID NO: 57430 - RNA, 23 nt, Artificial Sequence
  RNA Oligomer
aggaagaauuacaugccagcucu

SEQ ID NO: 57431 - RNA, 23 nt, Artificial Sequence
  RNA Oligomer
ggaagaauuacaugccagcucua

SEQ ID NO: 57432 - RNA, 23 nt, Artificial Sequence
  RNA Oligomer
gaagaauuacaugccagcucuau

SEQ ID NO: 57433 - RNA, 23 nt, Artificial Sequence
  RNA Oligomer
aagaauuacaugccagcucuaua

SEQ ID NO: 57434 - RNA, 23 nt, Artificial Sequence
  RNA Oligomer
agaauuacaugccagcucuauag

SEQ ID NO: 57435 - RNA, 23 nt, Artificial Sequence
  RNA Oligomer
gaauuacaugccagcucuauaga

SEQ ID NO: 57436 - RNA, 23 nt, Artificial Sequence
  RNA Oligomer
aauuacaugccagcucuauagau

SEQ ID NO: 57437 - RNA, 23 nt, Artificial Sequence
  RNA Oligomer
auuacaugccagcucuauagaua

SEQ ID NO: 57438 - RNA, 23 nt, Artificial Sequence
  RNA Oligomer
uuacaugccagcucuauagauac

SEQ ID NO: 57439 - RNA, 23 nt, Artificial Sequence
  RNA Oligomer
auuggauuuugcaagacauuagg

SEQ ID NO: 57440 - RNA, 23 nt, Artificial Sequence
  RNA Oligomer
uuggauuuugcaagacauuaggu

SEQ ID NO: 57441 - RNA, 23 nt, Artificial Sequence
  RNA Oligomer
uggauuuugcaagacauuagguc

SEQ ID NO: 57442 - RNA, 23 nt, Artificial Sequence
  RNA Oligomer
ggauuuugcaagacauuagguca

SEQ ID NO: 57443 - RNA, 23 nt, Artificial Sequence
  RNA Oligomer
gauuuugcaagacauuaggucau

SEQ ID NO: 57444 - RNA, 23 nt, Artificial Sequence
  RNA Oligomer
ugauuaggacaaacuugaucacc

SEQ ID NO: 57445 - RNA, 23 nt, Artificial Sequence
  RNA Oligomer
gauuaggacaaacuugaucacca

SEQ ID NO: 57446 - RNA, 23 nt, Artificial Sequence
  RNA Oligomer
auuaggacaaacuugaucaccag

SEQ ID NO: 57447 - RNA, 23 nt, Artificial Sequence
  RNA Oligomer
uuaggacaaacuugaucaccagc

SEQ ID NO: 57448 - RNA, 23 nt, Artificial Sequence
  RNA Oligomer
uaggacaaacuugaucaccagca

SEQ ID NO: 57449 - RNA, 23 nt, Artificial Sequence
  RNA Oligomer
agccacauaugaaucacugagcc

SEQ ID NO: 57450 - RNA, 23 nt, Artificial Sequence
  RNA Oligomer
gccacauaugaaucacugagcca

SEQ ID NO: 57451 - RNA, 23 nt, Artificial Sequence
  RNA Oligomer
ccacauaugaaucacugagccag

SEQ ID NO: 57452 - RNA, 23 nt, Artificial Sequence
  RNA Oligomer
cacauaugaaucacugagccagg

SEQ ID NO: 57453 - RNA, 23 nt, Artificial Sequence
  RNA Oligomer
acauaugaaucacugagccaggc

SEQ ID NO: 57454 - RNA, 23 nt, Artificial Sequence
  RNA Oligomer
auucuccuucuugaguauugccu

SEQ ID NO: 57455 - RNA, 23 nt, Artificial Sequence
  RNA Oligomer
uucuccuucuugaguauugccug

SEQ ID NO: 57456 - RNA, 23 nt, Artificial Sequence
  RNA Oligomer
acauaauaucgaauaggaaucac

SEQ ID NO: 57457 - RNA, 23 nt, Artificial Sequence
  RNA Oligomer
cauaauaucgaauaggaaucaca

SEQ ID NO: 57458 - RNA, 23 nt, Artificial Sequence
  RNA Oligomer
auaauaucgaauaggaaucacaa

SEQ ID NO: 57459 - RNA, 23 nt, Artificial Sequence
  RNA Oligomer
uaauaucgaauaggaaucacaag

SEQ ID NO: 57460 - RNA, 23 nt, Artificial Sequence
  RNA Oligomer
aauaucgaauaggaaucacaagu

SEQ ID NO: 57461 - RNA, 23 nt, Artificial Sequence
  RNA Oligomer
ccuccacauuggaaauagcugca

SEQ ID NO: 57462 - RNA, 23 nt, Artificial Sequence
  RNA Oligomer
ucugaagaauucauaguaagagg

SEQ ID NO: 57463 - RNA, 23 nt, Artificial Sequence
  RNA Oligomer
cugaagaauucauaguaagagga

SEQ ID NO: 57464 - RNA, 23 nt, Artificial Sequence
  RNA Oligomer
ugaagaauucauaguaagaggaa

SEQ ID NO: 57465 - RNA, 23 nt, Artificial Sequence
  RNA Oligomer
gaagaauucauaguaagaggaag

SEQ ID NO: 57466 - RNA, 23 nt, Artificial Sequence
  RNA Oligomer
aagaauucauaguaagaggaagu

SEQ ID NO: 57467 - RNA, 23 nt, Artificial Sequence
  RNA Oligomer
agauuacgaacaauauccaucac

SEQ ID NO: 57468 - RNA, 23 nt, Artificial Sequence
  RNA Oligomer
gauuacgaacaauauccaucacu

SEQ ID NO: 57469 - RNA, 23 nt, Artificial Sequence
  RNA Oligomer
auuacgaacaauauccaucacuc

SEQ ID NO: 57470 - RNA, 23 nt, Artificial Sequence
  RNA Oligomer
uuacgaacaauauccaucacucu

SEQ ID NO: 57471 - RNA, 23 nt, Artificial Sequence
  RNA Oligomer
cauuagauucuggauauugauug

SEQ ID NO: 57472 - RNA, 23 nt, Artificial Sequence
  RNA Oligomer
auuagauucuggauauugauuga

SEQ ID NO: 57473 - RNA, 23 nt, Artificial Sequence
  RNA Oligomer
uuagauucuggauauugauugau

SEQ ID NO: 57474 - RNA, 23 nt, Artificial Sequence
  RNA Oligomer
uagauucuggauauugauugauu

SEQ ID NO: 57475 - RNA, 23 nt, Artificial Sequence
  RNA Oligomer
agauucuggauauugauugauuu

SEQ ID NO: 57476 - RNA, 23 nt, Artificial Sequence
  RNA Oligomer
uuucaucuguuguaaacucauuc

SEQ ID NO: 57477 - RNA, 23 nt, Artificial Sequence
  RNA Oligomer
uucaucuguuguaaacucauucu

SEQ ID NO: 57478 - RNA, 23 nt, Artificial Sequence
  RNA Oligomer
ucaucuguuguaaacucauucuu

SEQ ID NO: 57479 - RNA, 23 nt, Artificial Sequence
  RNA Oligomer
caucuguuguaaacucauucuuu

SEQ ID NO: 57480 - RNA, 23 nt, Artificial Sequence
  RNA Oligomer
aucuguuguaaacucauucuuuc

SEQ ID NO: 57481 - RNA, 23 nt, Artificial Sequence
  RNA Oligomer
uucuuucuaccuuaaguaaacug

SEQ ID NO: 57482 - RNA, 23 nt, Artificial Sequence
  RNA Oligomer
cugaugucuaccaauauuuuucc

SEQ ID NO: 57483 - RNA, 23 nt, Artificial Sequence
  RNA Oligomer
ugaugucuaccaauauuuuucca

SEQ ID NO: 57484 - RNA, 23 nt, Artificial Sequence
  RNA Oligomer
gaugucuaccaauauuuuuccau

SEQ ID NO: 57485 - RNA, 23 nt, Artificial Sequence
  RNA Oligomer
augucuaccaauauuuuuccauu

SEQ ID NO: 57486 - RNA, 23 nt, Artificial Sequence
  RNA Oligomer
ugucuaccaauauuuuuccauug

SEQ ID NO: 57487 - RNA, 23 nt, Artificial Sequence
  RNA Oligomer
uucauuuuuuucuauaggucagc

SEQ ID NO: 57488 - RNA, 23 nt, Artificial Sequence
  RNA Oligomer
ucauuuuuuucuauaggucagca

SEQ ID NO: 57489 - RNA, 23 nt, Artificial Sequence
  RNA Oligomer
cauuuuuuucuauaggucagcau

SEQ ID NO: 57490 - RNA, 23 nt, Artificial Sequence
  RNA Oligomer
auuuuuuucuauaggucagcauu

SEQ ID NO: 57491 - RNA, 23 nt, Artificial Sequence
  RNA Oligomer
uuuuuuucuauaggucagcauuu

SEQ ID NO: 57492 - RNA, 23 nt, Artificial Sequence
  RNA Oligomer
auggauggcauuuucuauuuucg

SEQ ID NO: 57493 - RNA, 23 nt, Artificial Sequence
  RNA Oligomer
uggauggcauuuucuauuuucgg

SEQ ID NO: 57494 - RNA, 23 nt, Artificial Sequence
  RNA Oligomer
ggauggcauuuucuauuuucggu

SEQ ID NO: 57495 - RNA, 23 nt, Artificial Sequence
  RNA Oligomer
gauggcauuuucuauuuucggug

SEQ ID NO: 57496 - RNA, 23 nt, Artificial Sequence
  RNA Oligomer
auggcauuuucuauuuucgguga

SEQ ID NO: 57497 - RNA, 23 nt, Artificial Sequence
  RNA Oligomer
augguuaacuccaaagacuucuc

SEQ ID NO: 57498 - RNA, 23 nt, Artificial Sequence
  RNA Oligomer
cucaaugucguccaacuuuuugu

SEQ ID NO: 57499 - RNA, 23 nt, Artificial Sequence
  RNA Oligomer
ucaaugucguccaacuuuuugua

SEQ ID NO: 57500 - RNA, 23 nt, Artificial Sequence
  RNA Oligomer
caaugucguccaacuuuuuguau

SEQ ID NO: 57501 - RNA, 23 nt, Artificial Sequence
  RNA Oligomer
aaugucguccaacuuuuuguauc

SEQ ID NO: 57502 - RNA, 23 nt, Artificial Sequence
  RNA Oligomer
augucguccaacuuuuuguaucc

SEQ ID NO: 57503 - RNA, 23 nt, Artificial Sequence
  RNA Oligomer
cuuuagaaauggcuuggcaacau

SEQ ID NO: 57504 - RNA, 23 nt, Artificial Sequence
  RNA Oligomer
auccuggauuguugauguuguuu

SEQ ID NO: 57505 - RNA, 23 nt, Artificial Sequence
  RNA Oligomer
uuuuaguuauuuugauauguggg

SEQ ID NO: 57506 - RNA, 23 nt, Artificial Sequence
  RNA Oligomer
uuuaguuauuuugauauguggga

SEQ ID NO: 57507 - RNA, 23 nt, Artificial Sequence
  RNA Oligomer
uuaguuauuuugauaugugggaa

SEQ ID NO: 57508 - RNA, 23 nt, Artificial Sequence
  RNA Oligomer
uaguuauuuugauaugugggaag

SEQ ID NO: 57509 - RNA, 23 nt, Artificial Sequence
  RNA Oligomer
aguuauuuugauaugugggaaga

SEQ ID NO: 57510 - RNA, 23 nt, Artificial Sequence
  RNA Oligomer
guuauuuugauaugugggaagau

SEQ ID NO: 57511 - RNA, 23 nt, Artificial Sequence
  RNA Oligomer
ugagaaccauccuaaauuucagc

SEQ ID NO: 57512 - RNA, 23 nt, Artificial Sequence
  RNA Oligomer
gagaaccauccuaaauuucagca

SEQ ID NO: 57513 - RNA, 23 nt, Artificial Sequence
  RNA Oligomer
agaaccauccuaaauuucagcaa

SEQ ID NO: 57514 - RNA, 23 nt, Artificial Sequence
  RNA Oligomer
gaaccauccuaaauuucagcaag

SEQ ID NO: 57515 - RNA, 23 nt, Artificial Sequence
  RNA Oligomer
aaccauccuaaauuucagcaagg

SEQ ID NO: 57516 - RNA, 23 nt, Artificial Sequence
  RNA Oligomer
cacauaaugaugaaucuucacac

SEQ ID NO: 57517 - RNA, 23 nt, Artificial Sequence
  RNA Oligomer
acauaaugaugaaucuucacacc

SEQ ID NO: 57518 - RNA, 23 nt, Artificial Sequence
  RNA Oligomer
cauaaugaugaaucuucacaccu

SEQ ID NO: 57519 - RNA, 23 nt, Artificial Sequence
  RNA Oligomer
auaaugaugaaucuucacaccuc

SEQ ID NO: 57520 - RNA, 23 nt, Artificial Sequence
  RNA Oligomer
uaaugaugaaucuucacaccucu

SEQ ID NO: 57521 - RNA, 23 nt, Artificial Sequence
  RNA Oligomer
auuuucgaucaucuaugcauugu

SEQ ID NO: 57522 - RNA, 23 nt, Artificial Sequence
  RNA Oligomer
uuuucgaucaucuaugcauuguu

SEQ ID NO: 57523 - RNA, 23 nt, Artificial Sequence
  RNA Oligomer
auauagaagcuacuuauuuacac

SEQ ID NO: 57524 - RNA, 23 nt, Artificial Sequence
  RNA Oligomer
uauagaagcuacuuauuuacacu

SEQ ID NO: 57525 - RNA, 23 nt, Artificial Sequence
  RNA Oligomer
auagaagcuacuuauuuacacua

SEQ ID NO: 57526 - RNA, 23 nt, Artificial Sequence
  RNA Oligomer
uagaagcuacuuauuuacacuag

SEQ ID NO: 57527 - RNA, 23 nt, Artificial Sequence
  RNA Oligomer
agaagcuacuuauuuacacuaga

SEQ ID NO: 57528 - RNA, 23 nt, Artificial Sequence
  RNA Oligomer
ugaucaagaacuuuuaucaaccc

SEQ ID NO: 57529 - RNA, 23 nt, Artificial Sequence
  RNA Oligomer
aacuuuuaucaacccuucuuugc

SEQ ID NO: 57530 - RNA, 23 nt, Artificial Sequence
  RNA Oligomer
acuuuuaucaacccuucuuugcu

SEQ ID NO: 57531 - RNA, 23 nt, Artificial Sequence
  RNA Oligomer
cuuuuaucaacccuucuuugcuu

SEQ ID NO: 57532 - RNA, 23 nt, Artificial Sequence
  RNA Oligomer
uuuuaucaacccuucuuugcuua

SEQ ID NO: 57533 - RNA, 23 nt, Artificial Sequence
  RNA Oligomer
uuuaucaacccuucuuugcuuau

SEQ ID NO: 57534 - RNA, 23 nt, Artificial Sequence
  RNA Oligomer
uuuuuauucagucuuuccuauac

SEQ ID NO: 57535 - RNA, 23 nt, Artificial Sequence
  RNA Oligomer
uuuuauucagucuuuccuauacc

SEQ ID NO: 57536 - RNA, 23 nt, Artificial Sequence
  RNA Oligomer
uuuauucagucuuuccuauaccu

SEQ ID NO: 57537 - RNA, 23 nt, Artificial Sequence
  RNA Oligomer
uuauucagucuuuccuauaccua

SEQ ID NO: 57538 - RNA, 23 nt, Artificial Sequence
  RNA Oligomer
uauucagucuuuccuauaccuau

SEQ ID NO: 57539 - RNA, 23 nt, Artificial Sequence
  RNA Oligomer
auucagucuuuccuauaccuauu

SEQ ID NO: 57540 - RNA, 23 nt, Artificial Sequence
  RNA Oligomer
acuucuauuggauuuugcaagac

SEQ ID NO: 57541 - RNA, 23 nt, Artificial Sequence
  RNA Oligomer
cuucuauuggauuuugcaagaca

SEQ ID NO: 57542 - RNA, 23 nt, Artificial Sequence
  RNA Oligomer
uucuauuggauuuugcaagacau

SEQ ID NO: 57543 - RNA, 23 nt, Artificial Sequence
  RNA Oligomer
ugagauaaaaugguguucucuuc

SEQ ID NO: 57544 - RNA, 23 nt, Artificial Sequence
  RNA Oligomer
gagauaaaaugguguucucuucc

SEQ ID NO: 57545 - RNA, 23 nt, Artificial Sequence
  RNA Oligomer
agauaaaaugguguucucuucca

SEQ ID NO: 57546 - RNA, 23 nt, Artificial Sequence
  RNA Oligomer
gauaaaaugguguucucuuccag

SEQ ID NO: 57547 - RNA, 23 nt, Artificial Sequence
  RNA Oligomer
auaaaaugguguucucuuccagu

SEQ ID NO: 57548 - RNA, 23 nt, Artificial Sequence
  RNA Oligomer
uaaaaugguguucucuuccagua

SEQ ID NO: 57549 - RNA, 23 nt, Artificial Sequence
  RNA Oligomer
agucaauuucucaaagacaagca

SEQ ID NO: 57550 - RNA, 23 nt, Artificial Sequence
  RNA Oligomer
gucaauuucucaaagacaagcaa

SEQ ID NO: 57551 - RNA, 23 nt, Artificial Sequence
  RNA Oligomer
ucaauuucucaaagacaagcaau

SEQ ID NO: 57552 - RNA, 23 nt, Artificial Sequence
  RNA Oligomer
caauuucucaaagacaagcaaug

SEQ ID NO: 57553 - RNA, 23 nt, Artificial Sequence
  RNA Oligomer
aauuucucaaagacaagcaaugu

SEQ ID NO: 57554 - RNA, 23 nt, Artificial Sequence
  RNA Oligomer
ucaaaaccauaguucagaaaucc

SEQ ID NO: 57555 - RNA, 23 nt, Artificial Sequence
  RNA Oligomer
caaaaccauaguucagaaaucca

SEQ ID NO: 57556 - RNA, 23 nt, Artificial Sequence
  RNA Oligomer
aaaaccauaguucagaaauccag

SEQ ID NO: 57557 - RNA, 23 nt, Artificial Sequence
  RNA Oligomer
aaaccauaguucagaaauccagc

SEQ ID NO: 57558 - RNA, 23 nt, Artificial Sequence
  RNA Oligomer
aaccauaguucagaaauccagcu

SEQ ID NO: 57559 - RNA, 23 nt, Artificial Sequence
  RNA Oligomer
gcuuuuucuaguguuuugaguuc

SEQ ID NO: 57560 - RNA, 23 nt, Artificial Sequence
  RNA Oligomer
auccuuguaaggguguugucuac

SEQ ID NO: 57561 - RNA, 23 nt, Artificial Sequence
  RNA Oligomer
uccuuguaaggguguugucuaca

SEQ ID NO: 57562 - RNA, 23 nt, Artificial Sequence
  RNA Oligomer
ccuuguaaggguguugucuacac

SEQ ID NO: 57563 - RNA, 23 nt, Artificial Sequence
  RNA Oligomer
cuuguaaggguguugucuacaca

SEQ ID NO: 57564 - RNA, 23 nt, Artificial Sequence
  RNA Oligomer
uuguaaggguguugucuacacau

SEQ ID NO: 57565 - RNA, 23 nt, Artificial Sequence
  RNA Oligomer
cauuuucaaucccagugaucuuc

SEQ ID NO: 57566 - RNA, 23 nt, Artificial Sequence
  RNA Oligomer
auuuucaaucccagugaucuucc

SEQ ID NO: 57567 - RNA, 23 nt, Artificial Sequence
  RNA Oligomer
uuuucaaucccagugaucuucca

SEQ ID NO: 57568 - RNA, 23 nt, Artificial Sequence
  RNA Oligomer
uuucaaucccagugaucuuccaa

SEQ ID NO: 57569 - RNA, 23 nt, Artificial Sequence
  RNA Oligomer
uucaaucccagugaucuuccaaa

SEQ ID NO: 57570 - RNA, 23 nt, Artificial Sequence
  RNA Oligomer
agauuugaagggcugaggaaucu

SEQ ID NO: 57571 - RNA, 23 nt, Artificial Sequence
  RNA Oligomer
gauuugaagggcugaggaaucuc

SEQ ID NO: 57572 - RNA, 23 nt, Artificial Sequence
  RNA Oligomer
auuugaagggcugaggaaucucu

SEQ ID NO: 57573 - RNA, 23 nt, Artificial Sequence
  RNA Oligomer
uuugaagggcugaggaaucucuu

SEQ ID NO: 57574 - RNA, 23 nt, Artificial Sequence
  RNA Oligomer
uugaagggcugaggaaucucuuc

SEQ ID NO: 57575 - RNA, 23 nt, Artificial Sequence
  RNA Oligomer
ucccaaagccacauaugaaucac

SEQ ID NO: 57576 - RNA, 23 nt, Artificial Sequence
  RNA Oligomer
cccaaagccacauaugaaucacu

SEQ ID NO: 57577 - RNA, 23 nt, Artificial Sequence
  RNA Oligomer
ccaaagccacauaugaaucacug

SEQ ID NO: 57578 - RNA, 23 nt, Artificial Sequence
  RNA Oligomer
caaagccacauaugaaucacuga

SEQ ID NO: 57579 - RNA, 23 nt, Artificial Sequence
  RNA Oligomer
aaagccacauaugaaucacugag

SEQ ID NO: 57580 - RNA, 23 nt, Artificial Sequence
  RNA Oligomer
cauaugaaucacugagccaggcu

SEQ ID NO: 57581 - RNA, 23 nt, Artificial Sequence
  RNA Oligomer
auaugaaucacugagccaggcug

SEQ ID NO: 57582 - RNA, 23 nt, Artificial Sequence
  RNA Oligomer
uggaaagauacgauuuggaaugg

SEQ ID NO: 57583 - RNA, 23 nt, Artificial Sequence
  RNA Oligomer
ggaaagauacgauuuggaaugga

SEQ ID NO: 57584 - RNA, 23 nt, Artificial Sequence
  RNA Oligomer
gaaagauacgauuuggaauggaa

SEQ ID NO: 57585 - RNA, 23 nt, Artificial Sequence
  RNA Oligomer
aaagauacgauuuggaauggaaa

SEQ ID NO: 57586 - RNA, 23 nt, Artificial Sequence
  RNA Oligomer
aagauacgauuuggaauggaaau

SEQ ID NO: 57587 - RNA, 23 nt, Artificial Sequence
  RNA Oligomer
uacgauuuggaauggaaauagcc

SEQ ID NO: 57588 - RNA, 23 nt, Artificial Sequence
  RNA Oligomer
acgauuuggaauggaaauagcca

SEQ ID NO: 57589 - RNA, 23 nt, Artificial Sequence
  RNA Oligomer
cgauuuggaauggaaauagccau

SEQ ID NO: 57590 - RNA, 23 nt, Artificial Sequence
  RNA Oligomer
gauuuggaauggaaauagccaua

SEQ ID NO: 57591 - RNA, 23 nt, Artificial Sequence
  RNA Oligomer
auuuggaauggaaauagccauac

SEQ ID NO: 57592 - RNA, 23 nt, Artificial Sequence
  RNA Oligomer
acaauagaaaaacaagaagacac

SEQ ID NO: 57593 - RNA, 23 nt, Artificial Sequence
  RNA Oligomer
caauagaaaaacaagaagacaca

SEQ ID NO: 57594 - RNA, 23 nt, Artificial Sequence
  RNA Oligomer
aauagaaaaacaagaagacacac

SEQ ID NO: 57595 - RNA, 23 nt, Artificial Sequence
  RNA Oligomer
auagaaaaacaagaagacacaca

SEQ ID NO: 57596 - RNA, 23 nt, Artificial Sequence
  RNA Oligomer
cauuggaaauagcugcagggggu

SEQ ID NO: 57597 - RNA, 23 nt, Artificial Sequence
  RNA Oligomer
ucuguuguaaacucauucuuucu

SEQ ID NO: 57598 - RNA, 23 nt, Artificial Sequence
  RNA Oligomer
guuguaaacucauucuuucuacc

SEQ ID NO: 57599 - RNA, 23 nt, Artificial Sequence
  RNA Oligomer
uuguaaacucauucuuucuaccu

SEQ ID NO: 57600 - RNA, 23 nt, Artificial Sequence
  RNA Oligomer
uguaaacucauucuuucuaccuu

SEQ ID NO: 57601 - RNA, 23 nt, Artificial Sequence
  RNA Oligomer
guaaacucauucuuucuaccuua

SEQ ID NO: 57602 - RNA, 23 nt, Artificial Sequence
  RNA Oligomer
uaaacucauucuuucuaccuuaa

SEQ ID NO: 57603 - RNA, 23 nt, Artificial Sequence
  RNA Oligomer
auuaugccaaaaccaucagagug

SEQ ID NO: 57604 - RNA, 23 nt, Artificial Sequence
  RNA Oligomer
ccaguuauaaauaaacgcaaauu

SEQ ID NO: 57605 - RNA, 23 nt, Artificial Sequence
  RNA Oligomer
uuauagaaaaauauccuggauug

SEQ ID NO: 57606 - RNA, 23 nt, Artificial Sequence
  RNA Oligomer
uauagaaaaauauccuggauugu

SEQ ID NO: 57607 - RNA, 23 nt, Artificial Sequence
  RNA Oligomer
auagaaaaauauccuggauuguu

SEQ ID NO: 57608 - RNA, 23 nt, Artificial Sequence
  RNA Oligomer
aaugaugaaucuucacaccucuc

SEQ ID NO: 57609 - RNA, 23 nt, Artificial Sequence
  RNA Oligomer
ugauuuuccguaauuuucgauca

SEQ ID NO: 57610 - RNA, 23 nt, Artificial Sequence
  RNA Oligomer
gauuuuccguaauuuucgaucau

SEQ ID NO: 57611 - RNA, 23 nt, Artificial Sequence
  RNA Oligomer
auuuuccguaauuuucgaucauc

SEQ ID NO: 57612 - RNA, 23 nt, Artificial Sequence
  RNA Oligomer
uuuuccguaauuuucgaucaucu

SEQ ID NO: 57613 - RNA, 23 nt, Artificial Sequence
  RNA Oligomer
uuuccguaauuuucgaucaucua

SEQ ID NO: 57614 - RNA, 23 nt, Artificial Sequence
  RNA Oligomer
gcauuguucaaauuuauaccugc

SEQ ID NO: 57615 - RNA, 23 nt, Artificial Sequence
  RNA Oligomer
cauuguucaaauuuauaccugca

SEQ ID NO: 57616 - RNA, 23 nt, Artificial Sequence
  RNA Oligomer
auuguucaaauuuauaccugcag

SEQ ID NO: 57617 - RNA, 23 nt, Artificial Sequence
  RNA Oligomer
uuguucaaauuuauaccugcaga

SEQ ID NO: 57618 - RNA, 23 nt, Artificial Sequence
  RNA Oligomer
uguucaaauuuauaccugcagac

SEQ ID NO: 57619 - RNA, 23 nt, Artificial Sequence
  RNA Oligomer
aauuuauaccugcagacuauuca

SEQ ID NO: 57620 - RNA, 23 nt, Artificial Sequence
  RNA Oligomer
auuuauaccugcagacuauucau

SEQ ID NO: 57621 - RNA, 23 nt, Artificial Sequence
  RNA Oligomer
uuuauaccugcagacuauucauu

SEQ ID NO: 57622 - RNA, 23 nt, Artificial Sequence
  RNA Oligomer
uuauaccugcagacuauucauuu

SEQ ID NO: 57623 - RNA, 23 nt, Artificial Sequence
  RNA Oligomer
uauaccugcagacuauucauuua

SEQ ID NO: 57624 - RNA, 23 nt, Artificial Sequence
  RNA Oligomer
auaauagacuaagacagauauag

SEQ ID NO: 57625 - RNA, 23 nt, Artificial Sequence
  RNA Oligomer
uaauagacuaagacagauauaga

SEQ ID NO: 57626 - RNA, 23 nt, Artificial Sequence
  RNA Oligomer
aauagacuaagacagauauagaa

SEQ ID NO: 57627 - RNA, 23 nt, Artificial Sequence
  RNA Oligomer
auagacuaagacagauauagaag

SEQ ID NO: 57628 - RNA, 23 nt, Artificial Sequence
  RNA Oligomer
uagacuaagacagauauagaagc

SEQ ID NO: 57629 - RNA, 23 nt, Artificial Sequence
  RNA Oligomer
acaaugcaagugaaauccaaggg

SEQ ID NO: 57630 - RNA, 23 nt, Artificial Sequence
  RNA Oligomer
caaugcaagugaaauccaagggg

SEQ ID NO: 57631 - RNA, 23 nt, Artificial Sequence
  RNA Oligomer
aaugcaagugaaauccaagggga

SEQ ID NO: 57632 - RNA, 23 nt, Artificial Sequence
  RNA Oligomer
augcaagugaaauccaaggggau

SEQ ID NO: 57633 - RNA, 23 nt, Artificial Sequence
  RNA Oligomer
ugcaagugaaauccaaggggaua

SEQ ID NO: 57634 - RNA, 23 nt, Artificial Sequence
  RNA Oligomer
ucauuucacuagaauucaucaug

SEQ ID NO: 57635 - RNA, 23 nt, Artificial Sequence
  RNA Oligomer
gauauaccuaauaaagccuuuau

SEQ ID NO: 57636 - RNA, 23 nt, Artificial Sequence
  RNA Oligomer
accauaguucagaaauccagcua

SEQ ID NO: 57637 - RNA, 23 nt, Artificial Sequence
  RNA Oligomer
ccauaguucagaaauccagcuaa

SEQ ID NO: 57638 - RNA, 23 nt, Artificial Sequence
  RNA Oligomer
cauaguucagaaauccagcuaaa

SEQ ID NO: 57639 - RNA, 23 nt, Artificial Sequence
  RNA Oligomer
auaguucagaaauccagcuaaau

SEQ ID NO: 57640 - RNA, 23 nt, Artificial Sequence
  RNA Oligomer
gauuuuccauucaaugcuuuuuc

SEQ ID NO: 57641 - RNA, 23 nt, Artificial Sequence
  RNA Oligomer
auuuuccauucaaugcuuuuucu

SEQ ID NO: 57642 - RNA, 23 nt, Artificial Sequence
  RNA Oligomer
uuuuccauucaaugcuuuuucua

SEQ ID NO: 57643 - RNA, 23 nt, Artificial Sequence
  RNA Oligomer
uuuccauucaaugcuuuuucuag

SEQ ID NO: 57644 - RNA, 23 nt, Artificial Sequence
  RNA Oligomer
aaucuccaucguacauaauaucg

SEQ ID NO: 57645 - RNA, 23 nt, Artificial Sequence
  RNA Oligomer
auaccuaauaaagccuuuaucag

SEQ ID NO: 57646 - RNA, 23 nt, Artificial Sequence
  RNA Oligomer
uugcaaccaguuauaaauaaacg

SEQ ID NO: 57647 - RNA, 23 nt, Artificial Sequence
  RNA Oligomer
uauauuacguaaggccagauuca

SEQ ID NO: 57648 - RNA, 23 nt, Artificial Sequence
  RNA Oligomer
auggcaugauuaggacaaacuug

SEQ ID NO: 57649 - RNA, 23 nt, Artificial Sequence
  RNA Oligomer
aucuccaucguacauaauaucga

SEQ ID NO: 57650 - RNA, 23 nt, Artificial Sequence
  RNA Oligomer
gaaaauauauuacguaaggccag

SEQ ID NO: 57651 - RNA, 23 nt, Artificial Sequence
  RNA Oligomer
auauauuacguaaggccagauuc

SEQ ID NO: 57652 - RNA, 23 nt, Artificial Sequence
  RNA Oligomer
aacucagugccuuuuaguuauuu

SEQ ID NO: 57653 - RNA, 23 nt, Artificial Sequence
  RNA Oligomer
uuucgaucaucuaugcauuguuc

SEQ ID NO: 57654 - RNA, 23 nt, Artificial Sequence
  RNA Oligomer
uauuuauguuugccuuuacuucc

SEQ ID NO: 57655 - RNA, 23 nt, Artificial Sequence
  RNA Oligomer
aaucucuucccaccguacaccag

SEQ ID NO: 57656 - RNA, 23 nt, Artificial Sequence
  RNA Oligomer
uaucgaauaggaaucacaagugu

SEQ ID NO: 57657 - RNA, 23 nt, Artificial Sequence
  RNA Oligomer
auacgauuuggaauggaaauagc

SEQ ID NO: 57658 - RNA, 23 nt, Artificial Sequence
  RNA Oligomer
uagccauacgaaauguauuaucu

SEQ ID NO: 57659 - RNA, 23 nt, Artificial Sequence
  RNA Oligomer
ucauaaacauaaggguagauuac

SEQ ID NO: 57660 - RNA, 23 nt, Artificial Sequence
  RNA Oligomer
gauuuugagguuguugcugaugu

SEQ ID NO: 57661 - RNA, 23 nt, Artificial Sequence
  RNA Oligomer
uugauaaggucacuuuagaaaug

SEQ ID NO: 57662 - RNA, 23 nt, Artificial Sequence
  RNA Oligomer
uaugauuaugaugccagacuucu

SEQ ID NO: 57663 - RNA, 23 nt, Artificial Sequence
  RNA Oligomer
ugcauuguucaaauuuauaccug

SEQ ID NO: 57664 - RNA, 23 nt, Artificial Sequence
  RNA Oligomer
uacaugccagcucuauagauacg

SEQ ID NO: 57665 - RNA, 23 nt, Artificial Sequence
  RNA Oligomer
uauuggauuuugcaagacauuag

SEQ ID NO: 57666 - RNA, 23 nt, Artificial Sequence
  RNA Oligomer
aaauccagcuaaauugaacuuug

SEQ ID NO: 57667 - RNA, 23 nt, Artificial Sequence
  RNA Oligomer
gaucuuccaaaaucaccaguucc

SEQ ID NO: 57668 - RNA, 23 nt, Artificial Sequence
  RNA Oligomer
aaaaucaccaguuccaaaaauac

SEQ ID NO: 57669 - RNA, 23 nt, Artificial Sequence
  RNA Oligomer
uacauacagucucuugcuuuucu

SEQ ID NO: 57670 - RNA, 23 nt, Artificial Sequence
  RNA Oligomer
gaauucauaguaagaggaagugc

SEQ ID NO: 57671 - RNA, 23 nt, Artificial Sequence
  RNA Oligomer
ucuggauauugauugauuuugag

SEQ ID NO: 57672 - RNA, 23 nt, Artificial Sequence
  RNA Oligomer
uggauauugauugauuuugaggu

SEQ ID NO: 57673 - RNA, 23 nt, Artificial Sequence
  RNA Oligomer
uauaaaagccaucaucccuuaac

SEQ ID NO: 57674 - RNA, 23 nt, Artificial Sequence
  RNA Oligomer
uugcugaugucuaccaauauuuu

SEQ ID NO: 57675 - RNA, 23 nt, Artificial Sequence
  RNA Oligomer
uuuucuauaggucagcauuuuac

SEQ ID NO: 57676 - RNA, 23 nt, Artificial Sequence
  RNA Oligomer
aucuuuuccacugauacuguagg

SEQ ID NO: 57677 - RNA, 23 nt, Artificial Sequence
  RNA Oligomer
agugagaaccauccuaaauuuca

SEQ ID NO: 57678 - RNA, 23 nt, Artificial Sequence
  RNA Oligomer
aaauuuauaccugcagacuauuc

SEQ ID NO: 57679 - RNA, 23 nt, Artificial Sequence
  RNA Oligomer
uaguuccucucaguaaauaucug

SEQ ID NO: 57680 - RNA, 23 nt, Artificial Sequence
  RNA Oligomer
aucuuccaaaaucaccaguucca

SEQ ID NO: 57681 - RNA, 23 nt, Artificial Sequence
  RNA Oligomer
aaaacccaaguauucccaaagcc

SEQ ID NO: 57682 - RNA, 23 nt, Artificial Sequence
  RNA Oligomer
aguauucccaaagccacauauga

SEQ ID NO: 57683 - RNA, 23 nt, Artificial Sequence
  RNA Oligomer
uucccaaagccacauaugaauca

SEQ ID NO: 57684 - RNA, 23 nt, Artificial Sequence
  RNA Oligomer
uuaaguuucccaaucuccaucgu

SEQ ID NO: 57685 - RNA, 23 nt, Artificial Sequence
  RNA Oligomer
uaggaaucacaaguguguagagg

SEQ ID NO: 57686 - RNA, 23 nt, Artificial Sequence
  RNA Oligomer
aguuccaaaaauacauacagucu

SEQ ID NO: 57687 - RNA, 23 nt, Artificial Sequence
  RNA Oligomer
aaacauaaggguagauuacgucu

SEQ ID NO: 57688 - RNA, 23 nt, Artificial Sequence
  RNA Oligomer
aacauaaggguagauuacgucuc

SEQ ID NO: 57689 - RNA, 23 nt, Artificial Sequence
  RNA Oligomer
uagauuacgucucuuauaacaca

SEQ ID NO: 57690 - RNA, 23 nt, Artificial Sequence
  RNA Oligomer
aacaagaagacacacagcacagc

SEQ ID NO: 57691 - RNA, 23 nt, Artificial Sequence
  RNA Oligomer
uucugaagaauucauaguaagag

SEQ ID NO: 57692 - RNA, 23 nt, Artificial Sequence
  RNA Oligomer
gaacaauauccaucacucuuugc

SEQ ID NO: 57693 - RNA, 23 nt, Artificial Sequence
  RNA Oligomer
ucugcauuagauucuggauauug

SEQ ID NO: 57694 - RNA, 23 nt, Artificial Sequence
  RNA Oligomer
auaucagcaguaaagaaguuuag

SEQ ID NO: 57695 - RNA, 23 nt, Artificial Sequence
  RNA Oligomer
aaacucauucuuucuaccuuaag

SEQ ID NO: 57696 - RNA, 23 nt, Artificial Sequence
  RNA Oligomer
aaagacuucucuagaccagccug

SEQ ID NO: 57697 - RNA, 23 nt, Artificial Sequence
  RNA Oligomer
cauaggugaguagugacauuuuc

SEQ ID NO: 57698 - RNA, 23 nt, Artificial Sequence
  RNA Oligomer
uuauuuugauaugugggaagauc

SEQ ID NO: 57699 - RNA, 23 nt, Artificial Sequence
  RNA Oligomer
uaugucagucaauuucucaaaga

SEQ ID NO: 57700 - RNA, 23 nt, Artificial Sequence
  RNA Oligomer
augucagucaauuucucaaagac

SEQ ID NO: 57701 - RNA, 23 nt, Artificial Sequence
  RNA Oligomer
aauccagcuaaauugaacuuugu

SEQ ID NO: 57702 - RNA, 23 nt, Artificial Sequence
  RNA Oligomer
cuaguguuuugaguuccuuuccc

SEQ ID NO: 57703 - RNA, 23 nt, Artificial Sequence
  RNA Oligomer
aaguauucccaaagccacauaug

SEQ ID NO: 57704 - RNA, 23 nt, Artificial Sequence
  RNA Oligomer
uuccaaaaauacauacagucucu

SEQ ID NO: 57705 - RNA, 23 nt, Artificial Sequence
  RNA Oligomer
auagccauacgaaauguauuauc

SEQ ID NO: 57706 - RNA, 23 nt, Artificial Sequence
  RNA Oligomer
aaguccaagauuacgaacaauau

SEQ ID NO: 57707 - RNA, 23 nt, Artificial Sequence
  RNA Oligomer
aacaauauccaucacucuuugcu

SEQ ID NO: 57708 - RNA, 23 nt, Artificial Sequence
  RNA Oligomer
cugcauuagauucuggauauuga

SEQ ID NO: 57709 - RNA, 23 nt, Artificial Sequence
  RNA Oligomer
uuaugccaaaaccaucagagugc

SEQ ID NO: 57710 - RNA, 23 nt, Artificial Sequence
  RNA Oligomer
acucaaugucguccaacuuuuug

SEQ ID NO: 57711 - RNA, 23 nt, Artificial Sequence
  RNA Oligomer
aaagcaacacccucauccaaugg

SEQ ID NO: 57712 - RNA, 23 nt, Artificial Sequence
  RNA Oligomer
uacauguuuaauaaggaaagagg

SEQ ID NO: 57713 - RNA, 23 nt, Artificial Sequence
  RNA Oligomer
uuccguaauuuucgaucaucuau

SEQ ID NO: 57714 - RNA, 23 nt, Artificial Sequence
  RNA Oligomer
uccucagauauaccuaauaaagc

SEQ ID NO: 57715 - RNA, 23 nt, Artificial Sequence
  RNA Oligomer
uuuuuccuuucacuuaacucagc

SEQ ID NO: 57716 - RNA, 23 nt, Artificial Sequence
  RNA Oligomer
uuuccuuucacuuaacucagccc

SEQ ID NO: 57717 - RNA, 23 nt, Artificial Sequence
  RNA Oligomer
ucaccaguuccaaaaauacauac

SEQ ID NO: 57718 - RNA, 23 nt, Artificial Sequence
  RNA Oligomer
aaguuucccaaucuccaucguac

SEQ ID NO: 57719 - RNA, 23 nt, Artificial Sequence
  RNA Oligomer
accaguuccaaaaauacauacag

SEQ ID NO: 57720 - RNA, 23 nt, Artificial Sequence
  RNA Oligomer
auaucgaauaggaaucacaagug

SEQ ID NO: 57721 - RNA, 23 nt, Artificial Sequence
  RNA Oligomer
caguuccaaaaauacauacaguc

SEQ ID NO: 57722 - RNA, 23 nt, Artificial Sequence
  RNA Oligomer
caaguguguagaggacaugaagg

SEQ ID NO: 57723 - RNA, 23 nt, Artificial Sequence
  RNA Oligomer
auacauacagucucuugcuuuuc

SEQ ID NO: 57724 - RNA, 23 nt, Artificial Sequence
  RNA Oligomer
auaaacauaaggguagauuacgu

SEQ ID NO: 57725 - RNA, 23 nt, Artificial Sequence
  RNA Oligomer
uuacgucucuuauaacacaauag

SEQ ID NO: 57726 - RNA, 23 nt, Artificial Sequence
  RNA Oligomer
uguuaaaugcuuuuaccacgugg

SEQ ID NO: 57727 - RNA, 23 nt, Artificial Sequence
  RNA Oligomer
uaaaagccaucaucccuuaacau

SEQ ID NO: 57728 - RNA, 23 nt, Artificial Sequence
  RNA Oligomer
aaaagccaucaucccuuaacaug

SEQ ID NO: 57729 - RNA, 23 nt, Artificial Sequence
  RNA Oligomer
uaucagcaguaaagaaguuuagu

SEQ ID NO: 57730 - RNA, 23 nt, Artificial Sequence
  RNA Oligomer
aucagcaguaaagaaguuuaguu

SEQ ID NO: 57731 - RNA, 23 nt, Artificial Sequence
  RNA Oligomer
uuaaaaggaauacaguucgccca

SEQ ID NO: 57732 - RNA, 23 nt, Artificial Sequence
  RNA Oligomer
aagcacuuauuuucaucuguugu

SEQ ID NO: 57733 - RNA, 23 nt, Artificial Sequence
  RNA Oligomer
aacucauucuuucuaccuuaagu

SEQ ID NO: 57734 - RNA, 23 nt, Artificial Sequence
  RNA Oligomer
ugcugaugucuaccaauauuuuu

SEQ ID NO: 57735 - RNA, 23 nt, Artificial Sequence
  RNA Oligomer
aaacuuuaaucaaccaaugcuca

SEQ ID NO: 57736 - RNA, 23 nt, Artificial Sequence
  RNA Oligomer
uauaccaugacucuacucaaugu

SEQ ID NO: 57737 - RNA, 23 nt, Artificial Sequence
  RNA Oligomer
uauuuugauaugugggaagauca

SEQ ID NO: 57738 - RNA, 23 nt, Artificial Sequence
  RNA Oligomer
cuaugauuaugaugccagacuuc

SEQ ID NO: 57739 - RNA, 23 nt, Artificial Sequence
  RNA Oligomer
aagugcaucuauacaaguuuucu

SEQ ID NO: 57740 - RNA, 23 nt, Artificial Sequence
  RNA Oligomer
augaugaaucuucacaccucucu

SEQ ID NO: 57741 - RNA, 23 nt, Artificial Sequence
  RNA Oligomer
gaacuuuuaucaacccuucuuug

SEQ ID NO: 57742 - RNA, 23 nt, Artificial Sequence
  RNA Oligomer
augccagcucuauagauacguau

SEQ ID NO: 57743 - RNA, 23 nt, Artificial Sequence
  RNA Oligomer
uuccucagauauaccuaauaaag

SEQ ID NO: 57744 - RNA, 23 nt, Artificial Sequence
  RNA Oligomer
cuaguguuuugaguuccuuuccc

SEQ ID NO: 57745 - RNA, 23 nt, Artificial Sequence
  RNA Oligomer
uaguguuuugaguuccuuuccca

SEQ ID NO: 57746 - RNA, 23 nt, Artificial Sequence
  RNA Oligomer
aguguuuugaguuccuuucccag

SEQ ID NO: 57747 - RNA, 23 nt, Artificial Sequence
  RNA Oligomer
guguuuugaguuccuuucccagc

SEQ ID NO: 57748 - RNA, 23 nt, Artificial Sequence
  RNA Oligomer
uguuuugaguuccuuucccagcc

SEQ ID NO: 57749 - RNA, 23 nt, Artificial Sequence
  RNA Oligomer
ccacaaaagagaaaaacgucaag

SEQ ID NO: 57750 - RNA, 23 nt, Artificial Sequence
  RNA Oligomer
uccacaaaagagaaaaacgucaa

SEQ ID NO: 57751 - RNA, 23 nt, Artificial Sequence
  RNA Oligomer
cuccacaaaagagaaaaacguca

SEQ ID NO: 57752 - RNA, 23 nt, Artificial Sequence
  RNA Oligomer
ucuccacaaaagagaaaaacguc

SEQ ID NO: 57753 - RNA, 23 nt, Artificial Sequence
  RNA Oligomer
cucuccacaaaagagaaaaacgu

SEQ ID NO: 57754 - RNA, 23 nt, Artificial Sequence
  RNA Oligomer
cgacagaacucagugcuaucucg

SEQ ID NO: 57755 - RNA, 23 nt, Artificial Sequence
  RNA Oligomer
ccgacagaacucagugcuaucuc

SEQ ID NO: 57756 - RNA, 23 nt, Artificial Sequence
  RNA Oligomer
cccgacagaacucagugcuaucu

SEQ ID NO: 57757 - RNA, 23 nt, Artificial Sequence
  RNA Oligomer
ucccgacagaacucagugcuauc

SEQ ID NO: 57758 - RNA, 23 nt, Artificial Sequence
  RNA Oligomer
gucccgacagaacucagugcuau

SEQ ID NO: 57759 - RNA, 23 nt, Artificial Sequence
  RNA Oligomer
ugacgagaaugaaaagguuguau

SEQ ID NO: 57760 - RNA, 23 nt, Artificial Sequence
  RNA Oligomer
uugacgagaaugaaaagguugua

SEQ ID NO: 57761 - RNA, 23 nt, Artificial Sequence
  RNA Oligomer
cuugacgagaaugaaaagguugu

SEQ ID NO: 57762 - RNA, 23 nt, Artificial Sequence
  RNA Oligomer
ccuugacgagaaugaaaagguug

SEQ ID NO: 57763 - RNA, 23 nt, Artificial Sequence
  RNA Oligomer
accuugacgagaaugaaaagguu

SEQ ID NO: 57764 - RNA, 23 nt, Artificial Sequence
  RNA Oligomer
gcuguaccuugacgagaaugaaa

SEQ ID NO: 57765 - RNA, 23 nt, Artificial Sequence
  RNA Oligomer
ugcuguaccuugacgagaaugaa

SEQ ID NO: 57766 - RNA, 23 nt, Artificial Sequence
  RNA Oligomer
augcuguaccuugacgagaauga

SEQ ID NO: 57767 - RNA, 23 nt, Artificial Sequence
  RNA Oligomer
gaugcuguaccuugacgagaaug

SEQ ID NO: 57768 - RNA, 23 nt, Artificial Sequence
  RNA Oligomer
cgaugcuguaccuugacgagaau

SEQ ID NO: 57769 - RNA, 23 nt, Artificial Sequence
  RNA Oligomer
cggagauucuucuuuaauuuaag

SEQ ID NO: 57770 - RNA, 23 nt, Artificial Sequence
  RNA Oligomer
ccggagauucuucuuuaauuuaa

SEQ ID NO: 57771 - RNA, 23 nt, Artificial Sequence
  RNA Oligomer
cccggagauucuucuuuaauuua

SEQ ID NO: 57772 - RNA, 23 nt, Artificial Sequence
  RNA Oligomer
acccggagauucuucuuuaauuu

SEQ ID NO: 57773 - RNA, 23 nt, Artificial Sequence
  RNA Oligomer
aacccggagauucuucuuuaauu

SEQ ID NO: 57774 - RNA, 23 nt, Artificial Sequence
  RNA Oligomer
agaaaaacgucaagccaaacaca

SEQ ID NO: 57775 - RNA, 23 nt, Artificial Sequence
  RNA Oligomer
gagaaaaacgucaagccaaacac

SEQ ID NO: 57776 - RNA, 23 nt, Artificial Sequence
  RNA Oligomer
agagaaaaacgucaagccaaaca

SEQ ID NO: 57777 - RNA, 23 nt, Artificial Sequence
  RNA Oligomer
aagagaaaaacgucaagccaaac

SEQ ID NO: 57778 - RNA, 23 nt, Artificial Sequence
  RNA Oligomer
aaagagaaaaacgucaagccaaa

SEQ ID NO: 57779 - RNA, 23 nt, Artificial Sequence
  RNA Oligomer
ccaagagacauguuaggauaagc

SEQ ID NO: 57780 - RNA, 23 nt, Artificial Sequence
  RNA Oligomer
uccaagagacauguuaggauaag

SEQ ID NO: 57781 - RNA, 23 nt, Artificial Sequence
  RNA Oligomer
cuccaagagacauguuaggauaa

SEQ ID NO: 57782 - RNA, 23 nt, Artificial Sequence
  RNA Oligomer
ucuccaagagacauguuaggaua

SEQ ID NO: 57783 - RNA, 23 nt, Artificial Sequence
  RNA Oligomer
gucuccaagagacauguuaggau

SEQ ID NO: 57784 - RNA, 23 nt, Artificial Sequence
  RNA Oligomer
gcaacagccaacucgaaauuccc

SEQ ID NO: 57785 - RNA, 23 nt, Artificial Sequence
  RNA Oligomer
ugcaacagccaacucgaaauucc

SEQ ID NO: 57786 - RNA, 23 nt, Artificial Sequence
  RNA Oligomer
cugcaacagccaacucgaaauuc

SEQ ID NO: 57787 - RNA, 23 nt, Artificial Sequence
  RNA Oligomer
ccugcaacagccaacucgaaauu

SEQ ID NO: 57788 - RNA, 23 nt, Artificial Sequence
  RNA Oligomer
accugcaacagccaacucgaaau

SEQ ID NO: 57789 - RNA, 23 nt, Artificial Sequence
  RNA Oligomer
caacccggagauucuucuuuaau

SEQ ID NO: 57790 - RNA, 23 nt, Artificial Sequence
  RNA Oligomer
acaacccggagauucuucuuuaa

SEQ ID NO: 57791 - RNA, 23 nt, Artificial Sequence
  RNA Oligomer
gaaacgagugggaaaacaacccg

SEQ ID NO: 57792 - RNA, 23 nt, Artificial Sequence
  RNA Oligomer
agaaacgagugggaaaacaaccc

SEQ ID NO: 57793 - RNA, 23 nt, Artificial Sequence
  RNA Oligomer
cagaaacgagugggaaaacaacc

SEQ ID NO: 57794 - RNA, 23 nt, Artificial Sequence
  RNA Oligomer
ccagaaacgagugggaaaacaac

SEQ ID NO: 57795 - RNA, 23 nt, Artificial Sequence
  RNA Oligomer
accagaaacgagugggaaaacaa

SEQ ID NO: 57796 - RNA, 23 nt, Artificial Sequence
  RNA Oligomer
uaccagaaacgagugggaaaaca

SEQ ID NO: 57797 - RNA, 23 nt, Artificial Sequence
  RNA Oligomer
ggaagaacuaccagaaacgagug

SEQ ID NO: 57798 - RNA, 23 nt, Artificial Sequence
  RNA Oligomer
uggaagaacuaccagaaacgagu

SEQ ID NO: 57799 - RNA, 23 nt, Artificial Sequence
  RNA Oligomer
uuggaagaacuaccagaaacgag

SEQ ID NO: 57800 - RNA, 23 nt, Artificial Sequence
  RNA Oligomer
uuuggaagaacuaccagaaacga

SEQ ID NO: 57801 - RNA, 23 nt, Artificial Sequence
  RNA Oligomer
cuuuggaagaacuaccagaaacg

SEQ ID NO: 57802 - RNA, 23 nt, Artificial Sequence
  RNA Oligomer
uaccuugacgagaaugaaaaggu

SEQ ID NO: 57803 - RNA, 23 nt, Artificial Sequence
  RNA Oligomer
guaccuugacgagaaugaaaagg

SEQ ID NO: 57804 - RNA, 23 nt, Artificial Sequence
  RNA Oligomer
uguaccuugacgagaaugaaaag

SEQ ID NO: 57805 - RNA, 23 nt, Artificial Sequence
  RNA Oligomer
cuguaccuugacgagaaugaaaa

SEQ ID NO: 57806 - RNA, 23 nt, Artificial Sequence
  RNA Oligomer
ucgaugcuguaccuugacgagaa

SEQ ID NO: 57807 - RNA, 23 nt, Artificial Sequence
  RNA Oligomer
gcaagcaggugggaaaguuuuga

SEQ ID NO: 57808 - RNA, 23 nt, Artificial Sequence
  RNA Oligomer
ugcaagcaggugggaaaguuuug

SEQ ID NO: 57809 - RNA, 23 nt, Artificial Sequence
  RNA Oligomer
augcaagcaggugggaaaguuuu

SEQ ID NO: 57810 - RNA, 23 nt, Artificial Sequence
  RNA Oligomer
aaugcaagcaggugggaaaguuu

SEQ ID NO: 57811 - RNA, 23 nt, Artificial Sequence
  RNA Oligomer
gaaugcaagcaggugggaaaguu

SEQ ID NO: 57812 - RNA, 23 nt, Artificial Sequence
  RNA Oligomer
ccagguuggugaaucagaaugca

SEQ ID NO: 57813 - RNA, 23 nt, Artificial Sequence
  RNA Oligomer
accagguuggugaaucagaaugc

SEQ ID NO: 57814 - RNA, 23 nt, Artificial Sequence
  RNA Oligomer
caccagguuggugaaucagaaug

SEQ ID NO: 57815 - RNA, 23 nt, Artificial Sequence
  RNA Oligomer
acaccagguuggugaaucagaau

SEQ ID NO: 57816 - RNA, 23 nt, Artificial Sequence
  RNA Oligomer
gacaccagguuggugaaucagaa

SEQ ID NO: 57817 - RNA, 23 nt, Artificial Sequence
  RNA Oligomer
ccaucaccgaauuaauauuuaug

SEQ ID NO: 57818 - RNA, 23 nt, Artificial Sequence
  RNA Oligomer
uccaucaccgaauuaauauuuau

SEQ ID NO: 57819 - RNA, 23 nt, Artificial Sequence
  RNA Oligomer
uuccaucaccgaauuaauauuua

SEQ ID NO: 57820 - RNA, 23 nt, Artificial Sequence
  RNA Oligomer
uuuccaucaccgaauuaauauuu

SEQ ID NO: 57821 - RNA, 23 nt, Artificial Sequence
  RNA Oligomer
guuuccaucaccgaauuaauauu

SEQ ID NO: 57822 - RNA, 23 nt, Artificial Sequence
  RNA Oligomer
cgagaacagaugcaagaugcuuu

SEQ ID NO: 57823 - RNA, 23 nt, Artificial Sequence
  RNA Oligomer
ccgagaacagaugcaagaugcuu

SEQ ID NO: 57824 - RNA, 23 nt, Artificial Sequence
  RNA Oligomer
uccgagaacagaugcaagaugcu

SEQ ID NO: 57825 - RNA, 23 nt, Artificial Sequence
  RNA Oligomer
uuccgagaacagaugcaagaugc

SEQ ID NO: 57826 - RNA, 23 nt, Artificial Sequence
  RNA Oligomer
uuuccgagaacagaugcaagaug

SEQ ID NO: 57827 - RNA, 23 nt, Artificial Sequence
  RNA Oligomer
ucaacucuguuaacucuaagauu

SEQ ID NO: 57828 - RNA, 23 nt, Artificial Sequence
  RNA Oligomer
gucaacucuguuaacucuaagau

SEQ ID NO: 57829 - RNA, 23 nt, Artificial Sequence
  RNA Oligomer
ggucaacucuguuaacucuaaga

SEQ ID NO: 57830 - RNA, 23 nt, Artificial Sequence
  RNA Oligomer
uggucaacucuguuaacucuaag

SEQ ID NO: 57831 - RNA, 23 nt, Artificial Sequence
  RNA Oligomer
uuggucaacucuguuaacucuaa

SEQ ID NO: 57832 - RNA, 23 nt, Artificial Sequence
  RNA Oligomer
cacuaaucaugccauuguucaga

SEQ ID NO: 57833 - RNA, 23 nt, Artificial Sequence
  RNA Oligomer
ccacuaaucaugccauuguucag

SEQ ID NO: 57834 - RNA, 23 nt, Artificial Sequence
  RNA Oligomer
uccacuaaucaugccauuguuca

SEQ ID NO: 57835 - RNA, 23 nt, Artificial Sequence
  RNA Oligomer
cuccacuaaucaugccauuguuc

SEQ ID NO: 57836 - RNA, 23 nt, Artificial Sequence
  RNA Oligomer
acuccacuaaucaugccauuguu

SEQ ID NO: 57837 - RNA, 23 nt, Artificial Sequence
  RNA Oligomer
gcaaagaaaaggaacggacauuc

SEQ ID NO: 57838 - RNA, 23 nt, Artificial Sequence
  RNA Oligomer
ggcaaagaaaaggaacggacauu

SEQ ID NO: 57839 - RNA, 23 nt, Artificial Sequence
  RNA Oligomer
aggcaaagaaaaggaacggacau

SEQ ID NO: 57840 - RNA, 23 nt, Artificial Sequence
  RNA Oligomer
gaggcaaagaaaaggaacggaca

SEQ ID NO: 57841 - RNA, 23 nt, Artificial Sequence
  RNA Oligomer
ggaggcaaagaaaaggaacggac

SEQ ID NO: 57842 - RNA, 23 nt, Artificial Sequence
  RNA Oligomer
gcuaguaacuuuuggccaugaug

SEQ ID NO: 57843 - RNA, 23 nt, Artificial Sequence
  RNA Oligomer
ugcuaguaacuuuuggccaugau

SEQ ID NO: 57844 - RNA, 23 nt, Artificial Sequence
  RNA Oligomer
uugcuaguaacuuuuggccauga

SEQ ID NO: 57845 - RNA, 23 nt, Artificial Sequence
  RNA Oligomer
auugcuaguaacuuuuggccaug

SEQ ID NO: 57846 - RNA, 23 nt, Artificial Sequence
  RNA Oligomer
cauugcuaguaacuuuuggccau

SEQ ID NO: 57847 - RNA, 23 nt, Artificial Sequence
  RNA Oligomer
ggucacagauaaggccauugcua

SEQ ID NO: 57848 - RNA, 23 nt, Artificial Sequence
  RNA Oligomer
uggucacagauaaggccauugcu

SEQ ID NO: 57849 - RNA, 23 nt, Artificial Sequence
  RNA Oligomer
cuggucacagauaaggccauugc

SEQ ID NO: 57850 - RNA, 23 nt, Artificial Sequence
  RNA Oligomer
gcuggucacagauaaggccauug

SEQ ID NO: 57851 - RNA, 23 nt, Artificial Sequence
  RNA Oligomer
agcuggucacagauaaggccauu

SEQ ID NO: 57852 - RNA, 23 nt, Artificial Sequence
  RNA Oligomer
caagagacauguuaggauaagca

SEQ ID NO: 57853 - RNA, 23 nt, Artificial Sequence
  RNA Oligomer
caacagccaacucgaaauucccc

SEQ ID NO: 57854 - RNA, 23 nt, Artificial Sequence
  RNA Oligomer
agaacuaccagaaacgaguggga

SEQ ID NO: 57855 - RNA, 23 nt, Artificial Sequence
  RNA Oligomer
aagaacuaccagaaacgaguggg

SEQ ID NO: 57856 - RNA, 23 nt, Artificial Sequence
  RNA Oligomer
gaagaacuaccagaaacgagugg

SEQ ID NO: 57857 - RNA, 23 nt, Artificial Sequence
  RNA Oligomer
gggcauccucuccacaaaagaga

SEQ ID NO: 57858 - RNA, 23 nt, Artificial Sequence
  RNA Oligomer
agggcauccucuccacaaaagag

SEQ ID NO: 57859 - RNA, 23 nt, Artificial Sequence
  RNA Oligomer
aagggcauccucuccacaaaaga

SEQ ID NO: 57860 - RNA, 23 nt, Artificial Sequence
  RNA Oligomer
aaagggcauccucuccacaaaag

SEQ ID NO: 57861 - RNA, 23 nt, Artificial Sequence
  RNA Oligomer
aaaagggcauccucuccacaaaa

SEQ ID NO: 57862 - RNA, 23 nt, Artificial Sequence
  RNA Oligomer
aggaggcaaagaaaaggaacgga

SEQ ID NO: 57863 - RNA, 23 nt, Artificial Sequence
  RNA Oligomer
ccagcgugaaaagagagacugcg

SEQ ID NO: 57864 - RNA, 23 nt, Artificial Sequence
  RNA Oligomer
cccagcgugaaaagagagacugc

SEQ ID NO: 57865 - RNA, 23 nt, Artificial Sequence
  RNA Oligomer
ucccagcgugaaaagagagacug

SEQ ID NO: 57866 - RNA, 23 nt, Artificial Sequence
  RNA Oligomer
uucccagcgugaaaagagagacu

SEQ ID NO: 57867 - RNA, 23 nt, Artificial Sequence
  RNA Oligomer
guucccagcgugaaaagagagac

SEQ ID NO: 57868 - RNA, 23 nt, Artificial Sequence
  RNA Oligomer
uguucccagcgugaaaagagaga

SEQ ID NO: 57869 - RNA, 23 nt, Artificial Sequence
  RNA Oligomer
gggacuucuugaacuugcaggga

SEQ ID NO: 57870 - RNA, 23 nt, Artificial Sequence
  RNA Oligomer
ggggacuucuugaacuugcaggg

SEQ ID NO: 57871 - RNA, 23 nt, Artificial Sequence
  RNA Oligomer
cucgaugcuguaccuugacgaga

SEQ ID NO: 57872 - RNA, 23 nt, Artificial Sequence
  RNA Oligomer
ucucgaugcuguaccuugacgag

SEQ ID NO: 57873 - RNA, 23 nt, Artificial Sequence
  RNA Oligomer
aucucgaugcuguaccuugacga

SEQ ID NO: 57874 - RNA, 23 nt, Artificial Sequence
  RNA Oligomer
aaaagagaaaaacgucaagccaa

SEQ ID NO: 57875 - RNA, 23 nt, Artificial Sequence
  RNA Oligomer
gaggaggcaaagaaaaggaacgg

SEQ ID NO: 57876 - RNA, 23 nt, Artificial Sequence
  RNA Oligomer
ggaggaggcaaagaaaaggaacg

SEQ ID NO: 57877 - RNA, 23 nt, Artificial Sequence
  RNA Oligomer
aggaggaggcaaagaaaaggaac

SEQ ID NO: 57878 - RNA, 23 nt, Artificial Sequence
  RNA Oligomer
aaggaggaggcaaagaaaaggaa

SEQ ID NO: 57879 - RNA, 23 nt, Artificial Sequence
  RNA Oligomer
agaaggaggaggcaaagaaaagg

SEQ ID NO: 57880 - RNA, 23 nt, Artificial Sequence
  RNA Oligomer
gagaaggaggaggcaaagaaaag

SEQ ID NO: 57881 - RNA, 23 nt, Artificial Sequence
  RNA Oligomer
ggagaaggaggaggcaaagaaaa

SEQ ID NO: 57882 - RNA, 23 nt, Artificial Sequence
  RNA Oligomer
gggagaaggaggaggcaaagaaa

SEQ ID NO: 57883 - RNA, 23 nt, Artificial Sequence
  RNA Oligomer
cgggagaaggaggaggcaaagaa

SEQ ID NO: 57884 - RNA, 23 nt, Artificial Sequence
  RNA Oligomer
ggaggagaaacaaggugucucca

SEQ ID NO: 57885 - RNA, 23 nt, Artificial Sequence
  RNA Oligomer
uggaggagaaacaaggugucucc

SEQ ID NO: 57886 - RNA, 23 nt, Artificial Sequence
  RNA Oligomer
uuggaggagaaacaaggugucuc

SEQ ID NO: 57887 - RNA, 23 nt, Artificial Sequence
  RNA Oligomer
cuuggaggagaaacaaggugucu

SEQ ID NO: 57888 - RNA, 23 nt, Artificial Sequence
  RNA Oligomer
acuuggaggagaaacaagguguc

SEQ ID NO: 57889 - RNA, 23 nt, Artificial Sequence
  RNA Oligomer
gaaaucauaaaaccugcaacagc

SEQ ID NO: 57890 - RNA, 23 nt, Artificial Sequence
  RNA Oligomer
ugaaaucauaaaaccugcaacag

SEQ ID NO: 57891 - RNA, 23 nt, Artificial Sequence
  RNA Oligomer
augaaaucauaaaaccugcaaca

SEQ ID NO: 57892 - RNA, 23 nt, Artificial Sequence
  RNA Oligomer
uaugaaaucauaaaaccugcaac

SEQ ID NO: 57893 - RNA, 23 nt, Artificial Sequence
  RNA Oligomer
uuaugaaaucauaaaaccugcaa

SEQ ID NO: 57894 - RNA, 23 nt, Artificial Sequence
  RNA Oligomer
uuuuccgagaacagaugcaagau

SEQ ID NO: 57895 - RNA, 23 nt, Artificial Sequence
  RNA Oligomer
ugaagaaucuuuggaagaacuac

SEQ ID NO: 57896 - RNA, 23 nt, Artificial Sequence
  RNA Oligomer
augaagaaucuuuggaagaacua

SEQ ID NO: 57897 - RNA, 23 nt, Artificial Sequence
  RNA Oligomer
caugaagaaucuuuggaagaacu

SEQ ID NO: 57898 - RNA, 23 nt, Artificial Sequence
  RNA Oligomer
ccaugaagaaucuuuggaagaac

SEQ ID NO: 57899 - RNA, 23 nt, Artificial Sequence
  RNA Oligomer
accaugaagaaucuuuggaagaa

SEQ ID NO: 57900 - RNA, 23 nt, Artificial Sequence
  RNA Oligomer
gugcuucuuagacggacugcggu

SEQ ID NO: 57901 - RNA, 23 nt, Artificial Sequence
  RNA Oligomer
cgugcuucuuagacggacugcgg

SEQ ID NO: 57902 - RNA, 23 nt, Artificial Sequence
  RNA Oligomer
gcgugcuucuuagacggacugcg

SEQ ID NO: 57903 - RNA, 23 nt, Artificial Sequence
  RNA Oligomer
cgcgugcuucuuagacggacugc

SEQ ID NO: 57904 - RNA, 23 nt, Artificial Sequence
  RNA Oligomer
ccgcgugcuucuuagacggacug

SEQ ID NO: 57905 - RNA, 23 nt, Artificial Sequence
  RNA Oligomer
accagaguuuuuccauguggacg

SEQ ID NO: 57906 - RNA, 23 nt, Artificial Sequence
  RNA Oligomer
gaccagaguuuuuccauguggac

SEQ ID NO: 57907 - RNA, 23 nt, Artificial Sequence
  RNA Oligomer
ugaccagaguuuuuccaugugga

SEQ ID NO: 57908 - RNA, 23 nt, Artificial Sequence
  RNA Oligomer
uugaccagaguuuuuccaugugg

SEQ ID NO: 57909 - RNA, 23 nt, Artificial Sequence
  RNA Oligomer
uuugaccagaguuuuuccaugug

SEQ ID NO: 57910 - RNA, 23 nt, Artificial Sequence
  RNA Oligomer
cuuugaccagaguuuuuccaugu

SEQ ID NO: 57911 - RNA, 23 nt, Artificial Sequence
  RNA Oligomer
acagaacucagugcuaucucgau

SEQ ID NO: 57912 - RNA, 23 nt, Artificial Sequence
  RNA Oligomer
gacagaacucagugcuaucucga

SEQ ID NO: 57913 - RNA, 23 nt, Artificial Sequence
  RNA Oligomer
ggguaucacgccuuuuacugcca

SEQ ID NO: 57914 - RNA, 23 nt, Artificial Sequence
  RNA Oligomer
gggguaucacgccuuuuacugcc

SEQ ID NO: 57915 - RNA, 23 nt, Artificial Sequence
  RNA Oligomer
cgggguaucacgccuuuuacugc

SEQ ID NO: 57916 - RNA, 23 nt, Artificial Sequence
  RNA Oligomer
ccgggguaucacgccuuuuacug

SEQ ID NO: 57917 - RNA, 23 nt, Artificial Sequence
  RNA Oligomer
cccgggguaucacgccuuuuacu

SEQ ID NO: 57918 - RNA, 23 nt, Artificial Sequence
  RNA Oligomer
ggguggaaugacuggauuguggc

SEQ ID NO: 57919 - RNA, 23 nt, Artificial Sequence
  RNA Oligomer
gggguggaaugacuggauugugg

SEQ ID NO: 57920 - RNA, 23 nt, Artificial Sequence
  RNA Oligomer
ugggguggaaugacuggauugug

SEQ ID NO: 57921 - RNA, 23 nt, Artificial Sequence
  RNA Oligomer
gugggguggaaugacuggauugu

SEQ ID NO: 57922 - RNA, 23 nt, Artificial Sequence
  RNA Oligomer
cgugggguggaaugacuggauug

SEQ ID NO: 57923 - RNA, 23 nt, Artificial Sequence
  RNA Oligomer
aagaaaaggaacggacauucggu

SEQ ID NO: 57924 - RNA, 23 nt, Artificial Sequence
  RNA Oligomer
aaagaaaaggaacggacauucgg

SEQ ID NO: 57925 - RNA, 23 nt, Artificial Sequence
  RNA Oligomer
caaagaaaaggaacggacauucg

SEQ ID NO: 57926 - RNA, 23 nt, Artificial Sequence
  RNA Oligomer
cuaguaacuuuuggccaugaugg

SEQ ID NO: 57927 - RNA, 23 nt, Artificial Sequence
  RNA Oligomer
cagcgugaaaagagagacugcgc

SEQ ID NO: 57928 - RNA, 23 nt, Artificial Sequence
  RNA Oligomer
uaggaaacaauagcaguuuccau

SEQ ID NO: 57929 - RNA, 23 nt, Artificial Sequence
  RNA Oligomer
uuaggaaacaauagcaguuucca

SEQ ID NO: 57930 - RNA, 23 nt, Artificial Sequence
  RNA Oligomer
uuuaggaaacaauagcaguuucc

SEQ ID NO: 57931 - RNA, 23 nt, Artificial Sequence
  RNA Oligomer
cuuuaggaaacaauagcaguuuc

SEQ ID NO: 57932 - RNA, 23 nt, Artificial Sequence
  RNA Oligomer
gcuuuaggaaacaauagcaguuu

SEQ ID NO: 57933 - RNA, 23 nt, Artificial Sequence
  RNA Oligomer
ugcuuuaggaaacaauagcaguu

SEQ ID NO: 57934 - RNA, 23 nt, Artificial Sequence
  RNA Oligomer
ccacggaggaguuuaucaccuca

SEQ ID NO: 57935 - RNA, 23 nt, Artificial Sequence
  RNA Oligomer
cccacggaggaguuuaucaccuc

SEQ ID NO: 57936 - RNA, 23 nt, Artificial Sequence
  RNA Oligomer
ccccacggaggaguuuaucaccu

SEQ ID NO: 57937 - RNA, 23 nt, Artificial Sequence
  RNA Oligomer
uccccacggaggaguuuaucacc

SEQ ID NO: 57938 - RNA, 23 nt, Artificial Sequence
  RNA Oligomer
auccccacggaggaguuuaucac

SEQ ID NO: 57939 - RNA, 23 nt, Artificial Sequence
  RNA Oligomer
aacaacccggagauucuucuuua

SEQ ID NO: 57940 - RNA, 23 nt, Artificial Sequence
  RNA Oligomer
ugaacuugcagggagaauaacuu

SEQ ID NO: 57941 - RNA, 23 nt, Artificial Sequence
  RNA Oligomer
uugaacuugcagggagaauaacu

SEQ ID NO: 57942 - RNA, 23 nt, Artificial Sequence
  RNA Oligomer
cuugaacuugcagggagaauaac

SEQ ID NO: 57943 - RNA, 23 nt, Artificial Sequence
  RNA Oligomer
ucuugaacuugcagggagaauaa

SEQ ID NO: 57944 - RNA, 23 nt, Artificial Sequence
  RNA Oligomer
uucuugaacuugcagggagaaua

SEQ ID NO: 57945 - RNA, 23 nt, Artificial Sequence
  RNA Oligomer
cgagaaugaaaagguuguauuaa

SEQ ID NO: 57946 - RNA, 23 nt, Artificial Sequence
  RNA Oligomer
acgagaaugaaaagguuguauua

SEQ ID NO: 57947 - RNA, 23 nt, Artificial Sequence
  RNA Oligomer
gacgagaaugaaaagguuguauu

SEQ ID NO: 57948 - RNA, 23 nt, Artificial Sequence
  RNA Oligomer
ggaaacgccuuaaguccagcugu

SEQ ID NO: 57949 - RNA, 23 nt, Artificial Sequence
  RNA Oligomer
cggaaacgccuuaaguccagcug

SEQ ID NO: 57950 - RNA, 23 nt, Artificial Sequence
  RNA Oligomer
gcggaaacgccuuaaguccagcu

SEQ ID NO: 57951 - RNA, 23 nt, Artificial Sequence
  RNA Oligomer
agcggaaacgccuuaaguccagc

SEQ ID NO: 57952 - RNA, 23 nt, Artificial Sequence
  RNA Oligomer
cagcggaaacgccuuaaguccag

SEQ ID NO: 57953 - RNA, 23 nt, Artificial Sequence
  RNA Oligomer
agagacauguuaggauaagcagg

SEQ ID NO: 57954 - RNA, 23 nt, Artificial Sequence
  RNA Oligomer
aagagacauguuaggauaagcag

SEQ ID NO: 57955 - RNA, 23 nt, Artificial Sequence
  RNA Oligomer
gaaggaggaggcaaagaaaagga

SEQ ID NO: 57956 - RNA, 23 nt, Artificial Sequence
  RNA Oligomer
gggaaaguuuugaugucaccccc

SEQ ID NO: 57957 - RNA, 23 nt, Artificial Sequence
  RNA Oligomer
ugggaaaguuuugaugucacccc

SEQ ID NO: 57958 - RNA, 23 nt, Artificial Sequence
  RNA Oligomer
gugggaaaguuuugaugucaccc

SEQ ID NO: 57959 - RNA, 23 nt, Artificial Sequence
  RNA Oligomer
ggugggaaaguuuugaugucacc

SEQ ID NO: 57960 - RNA, 23 nt, Artificial Sequence
  RNA Oligomer
aggugggaaaguuuugaugucac

SEQ ID NO: 57961 - RNA, 23 nt, Artificial Sequence
  RNA Oligomer
ugaaucagaaugcaagcaggugg

SEQ ID NO: 57962 - RNA, 23 nt, Artificial Sequence
  RNA Oligomer
gugaaucagaaugcaagcaggug

SEQ ID NO: 57963 - RNA, 23 nt, Artificial Sequence
  RNA Oligomer
ggugaaucagaaugcaagcaggu

SEQ ID NO: 57964 - RNA, 23 nt, Artificial Sequence
  RNA Oligomer
uggugaaucagaaugcaagcagg

SEQ ID NO: 57965 - RNA, 23 nt, Artificial Sequence
  RNA Oligomer
uuggugaaucagaaugcaagcag

SEQ ID NO: 57966 - RNA, 23 nt, Artificial Sequence
  RNA Oligomer
agcgugaaaagagagacugcgcg

SEQ ID NO: 57967 - RNA, 23 nt, Artificial Sequence
  RNA Oligomer
ccaccaugaagaaucuuuggaag

SEQ ID NO: 57968 - RNA, 23 nt, Artificial Sequence
  RNA Oligomer
uccaccaugaagaaucuuuggaa

SEQ ID NO: 57969 - RNA, 23 nt, Artificial Sequence
  RNA Oligomer
uuccaccaugaagaaucuuugga

SEQ ID NO: 57970 - RNA, 23 nt, Artificial Sequence
  RNA Oligomer
cuuccaccaugaagaaucuuugg

SEQ ID NO: 57971 - RNA, 23 nt, Artificial Sequence
  RNA Oligomer
gcuuccaccaugaagaaucuuug

SEQ ID NO: 57972 - RNA, 23 nt, Artificial Sequence
  RNA Oligomer
ccuuugaccagaguuuuuccaug

SEQ ID NO: 57973 - RNA, 23 nt, Artificial Sequence
  RNA Oligomer
agauuccuaaggcaugcuguguc

SEQ ID NO: 57974 - RNA, 23 nt, Artificial Sequence
  RNA Oligomer
aagauuccuaaggcaugcugugu

SEQ ID NO: 57975 - RNA, 23 nt, Artificial Sequence
  RNA Oligomer
uaagauuccuaaggcaugcugug

SEQ ID NO: 57976 - RNA, 23 nt, Artificial Sequence
  RNA Oligomer
cuaagauuccuaaggcaugcugu

SEQ ID NO: 57977 - RNA, 23 nt, Artificial Sequence
  RNA Oligomer
ucuaagauuccuaaggcaugcug

SEQ ID NO: 57978 - RNA, 23 nt, Artificial Sequence
  RNA Oligomer
cucuaagauuccuaaggcaugcu

SEQ ID NO: 57979 - RNA, 23 nt, Artificial Sequence
  RNA Oligomer
acucuaagauuccuaaggcaugc

SEQ ID NO: 57980 - RNA, 23 nt, Artificial Sequence
  RNA Oligomer
aacucuaagauuccuaaggcaug

SEQ ID NO: 57981 - RNA, 23 nt, Artificial Sequence
  RNA Oligomer
uaacucuaagauuccuaaggcau

SEQ ID NO: 57982 - RNA, 23 nt, Artificial Sequence
  RNA Oligomer
uuaacucuaagauuccuaaggca

SEQ ID NO: 57983 - RNA, 23 nt, Artificial Sequence
  RNA Oligomer
guuaacucuaagauuccuaaggc

SEQ ID NO: 57984 - RNA, 23 nt, Artificial Sequence
  RNA Oligomer
uguuaacucuaagauuccuaagg

SEQ ID NO: 57985 - RNA, 23 nt, Artificial Sequence
  RNA Oligomer
cuguuaacucuaagauuccuaag

SEQ ID NO: 57986 - RNA, 23 nt, Artificial Sequence
  RNA Oligomer
ucuguuaacucuaagauuccuaa

SEQ ID NO: 57987 - RNA, 23 nt, Artificial Sequence
  RNA Oligomer
cucuguuaacucuaagauuccua

SEQ ID NO: 57988 - RNA, 23 nt, Artificial Sequence
  RNA Oligomer
acucuguuaacucuaagauuccu

SEQ ID NO: 57989 - RNA, 23 nt, Artificial Sequence
  RNA Oligomer
aacucuguuaacucuaagauucc

SEQ ID NO: 57990 - RNA, 23 nt, Artificial Sequence
  RNA Oligomer
caacucuguuaacucuaagauuc

SEQ ID NO: 57991 - RNA, 23 nt, Artificial Sequence
  RNA Oligomer
gucaagccaaacacaaacagcgg

SEQ ID NO: 57992 - RNA, 23 nt, Artificial Sequence
  RNA Oligomer
cgucaagccaaacacaaacagcg

SEQ ID NO: 57993 - RNA, 23 nt, Artificial Sequence
  RNA Oligomer
acgucaagccaaacacaaacagc

SEQ ID NO: 57994 - RNA, 23 nt, Artificial Sequence
  RNA Oligomer
aacgucaagccaaacacaaacag

SEQ ID NO: 57995 - RNA, 23 nt, Artificial Sequence
  RNA Oligomer
aaacgucaagccaaacacaaaca

SEQ ID NO: 57996 - RNA, 23 nt, Artificial Sequence
  RNA Oligomer
caaaagagaaaaacgucaagcca

SEQ ID NO: 57997 - RNA, 23 nt, Artificial Sequence
  RNA Oligomer
acaaaagagaaaaacgucaagcc

SEQ ID NO: 57998 - RNA, 23 nt, Artificial Sequence
  RNA Oligomer
cacaaaagagaaaaacgucaagc

SEQ ID NO: 57999 - RNA, 23 nt, Artificial Sequence
  RNA Oligomer
ucacagauaaggccauugcuagu

SEQ ID NO: 58000 - RNA, 23 nt, Artificial Sequence
  RNA Oligomer
gucacagauaaggccauugcuag

SEQ ID NO: 58001 - RNA, 23 nt, Artificial Sequence
  RNA Oligomer
agacauguuaggauaagcagguc

SEQ ID NO: 58002 - RNA, 23 nt, Artificial Sequence
  RNA Oligomer
gagacauguuaggauaagcaggu

SEQ ID NO: 58003 - RNA, 23 nt, Artificial Sequence
  RNA Oligomer
gaacuugcagggagaauaacuug

SEQ ID NO: 58004 - RNA, 23 nt, Artificial Sequence
  RNA Oligomer
ggacuucuugaacuugcagggag

SEQ ID NO: 58005 - RNA, 23 nt, Artificial Sequence
  RNA Oligomer
ggacgcucuuucaauggacgugu

SEQ ID NO: 58006 - RNA, 23 nt, Artificial Sequence
  RNA Oligomer
uggacgcucuuucaauggacgug

SEQ ID NO: 58007 - RNA, 23 nt, Artificial Sequence
  RNA Oligomer
guggacgcucuuucaauggacgu

SEQ ID NO: 58008 - RNA, 23 nt, Artificial Sequence
  RNA Oligomer
uguggacgcucuuucaauggacg

SEQ ID NO: 58009 - RNA, 23 nt, Artificial Sequence
  RNA Oligomer
auguggacgcucuuucaauggac

SEQ ID NO: 58010 - RNA, 23 nt, Artificial Sequence
  RNA Oligomer
ccaugauggaaaagggcauccuc

SEQ ID NO: 58011 - RNA, 23 nt, Artificial Sequence
  RNA Oligomer
gccaugauggaaaagggcauccu

SEQ ID NO: 58012 - RNA, 23 nt, Artificial Sequence
  RNA Oligomer
ggccaugauggaaaagggcaucc

SEQ ID NO: 58013 - RNA, 23 nt, Artificial Sequence
  RNA Oligomer
uggccaugauggaaaagggcauc

SEQ ID NO: 58014 - RNA, 23 nt, Artificial Sequence
  RNA Oligomer
uuggccaugauggaaaagggcau

SEQ ID NO: 58015 - RNA, 23 nt, Artificial Sequence
  RNA Oligomer
guuggugaaucagaaugcaagca

SEQ ID NO: 58016 - RNA, 23 nt, Artificial Sequence
  RNA Oligomer
gguuggugaaucagaaugcaagc

SEQ ID NO: 58017 - RNA, 23 nt, Artificial Sequence
  RNA Oligomer
agguuggugaaucagaaugcaag

SEQ ID NO: 58018 - RNA, 23 nt, Artificial Sequence
  RNA Oligomer
cagguuggugaaucagaaugcaa

SEQ ID NO: 58019 - RNA, 23 nt, Artificial Sequence
  RNA Oligomer
agcuuccaccaugaagaaucuuu

SEQ ID NO: 58020 - RNA, 23 nt, Artificial Sequence
  RNA Oligomer
ccauguggacgcucuuucaaugg

SEQ ID NO: 58021 - RNA, 23 nt, Artificial Sequence
  RNA Oligomer
uccauguggacgcucuuucaaug

SEQ ID NO: 58022 - RNA, 23 nt, Artificial Sequence
  RNA Oligomer
uuccauguggacgcucuuucaau

SEQ ID NO: 58023 - RNA, 23 nt, Artificial Sequence
  RNA Oligomer
uuuccauguggacgcucuuucaa

SEQ ID NO: 58024 - RNA, 23 nt, Artificial Sequence
  RNA Oligomer
uuuuccauguggacgcucuuuca

SEQ ID NO: 58025 - RNA, 23 nt, Artificial Sequence
  RNA Oligomer
cuaucucgaugcuguaccuugac

SEQ ID NO: 58026 - RNA, 23 nt, Artificial Sequence
  RNA Oligomer
gcuaucucgaugcuguaccuuga

SEQ ID NO: 58027 - RNA, 23 nt, Artificial Sequence
  RNA Oligomer
ugcuaucucgaugcuguaccuug

SEQ ID NO: 58028 - RNA, 23 nt, Artificial Sequence
  RNA Oligomer
gugcuaucucgaugcuguaccuu

SEQ ID NO: 58029 - RNA, 23 nt, Artificial Sequence
  RNA Oligomer
agugcuaucucgaugcuguaccu

SEQ ID NO: 58030 - RNA, 23 nt, Artificial Sequence
  RNA Oligomer
uccuuugaccagaguuuuuccau

SEQ ID NO: 58031 - RNA, 23 nt, Artificial Sequence
  RNA Oligomer
guccuuugaccagaguuuuucca

SEQ ID NO: 58032 - RNA, 23 nt, Artificial Sequence
  RNA Oligomer
gguccuuugaccagaguuuuucc

SEQ ID NO: 58033 - RNA, 23 nt, Artificial Sequence
  RNA Oligomer
agguccuuugaccagaguuuuuc

SEQ ID NO: 58034 - RNA, 23 nt, Artificial Sequence
  RNA Oligomer
cagguccuuugaccagaguuuuu

SEQ ID NO: 58035 - RNA, 23 nt, Artificial Sequence
  RNA Oligomer
cugaacuccacuaaucaugccau

SEQ ID NO: 58036 - RNA, 23 nt, Artificial Sequence
  RNA Oligomer
ucugaacuccacuaaucaugcca

SEQ ID NO: 58037 - RNA, 23 nt, Artificial Sequence
  RNA Oligomer
aucugaacuccacuaaucaugcc

SEQ ID NO: 58038 - RNA, 23 nt, Artificial Sequence
  RNA Oligomer
caucugaacuccacuaaucaugc

SEQ ID NO: 58039 - RNA, 23 nt, Artificial Sequence
  RNA Oligomer
ucaucugaacuccacuaaucaug

SEQ ID NO: 58040 - RNA, 23 nt, Artificial Sequence
  RNA Oligomer
cucuggcugaucaucugaacucc

SEQ ID NO: 58041 - RNA, 23 nt, Artificial Sequence
  RNA Oligomer
ccucuggcugaucaucugaacuc

SEQ ID NO: 58042 - RNA, 23 nt, Artificial Sequence
  RNA Oligomer
uccucuggcugaucaucugaacu

SEQ ID NO: 58043 - RNA, 23 nt, Artificial Sequence
  RNA Oligomer
uuccucuggcugaucaucugaac

SEQ ID NO: 58044 - RNA, 23 nt, Artificial Sequence
  RNA Oligomer
uuuccucuggcugaucaucugaa

SEQ ID NO: 58045 - RNA, 23 nt, Artificial Sequence
  RNA Oligomer
guuaggauaagcaggucuuugca

SEQ ID NO: 58046 - RNA, 23 nt, Artificial Sequence
  RNA Oligomer
uguuaggauaagcaggucuuugc

SEQ ID NO: 58047 - RNA, 23 nt, Artificial Sequence
  RNA Oligomer
auguuaggauaagcaggucuuug

SEQ ID NO: 58048 - RNA, 23 nt, Artificial Sequence
  RNA Oligomer
cauguuaggauaagcaggucuuu

SEQ ID NO: 58049 - RNA, 23 nt, Artificial Sequence
  RNA Oligomer
acauguuaggauaagcaggucuu

SEQ ID NO: 58050 - RNA, 23 nt, Artificial Sequence
  RNA Oligomer
caggugggaaaguuuugauguca

SEQ ID NO: 58051 - RNA, 23 nt, Artificial Sequence
  RNA Oligomer
gcaggugggaaaguuuugauguc

SEQ ID NO: 58052 - RNA, 23 nt, Artificial Sequence
  RNA Oligomer
agcaggugggaaaguuuugaugu

SEQ ID NO: 58053 - RNA, 23 nt, Artificial Sequence
  RNA Oligomer
aagcaggugggaaaguuuugaug

SEQ ID NO: 58054 - RNA, 23 nt, Artificial Sequence
  RNA Oligomer
caagcaggugggaaaguuuugau

SEQ ID NO: 58055 - RNA, 23 nt, Artificial Sequence
  RNA Oligomer
uuuaugaaaucauaaaaccugca

SEQ ID NO: 58056 - RNA, 23 nt, Artificial Sequence
  RNA Oligomer
aguuuccaucaccgaauuaauau

SEQ ID NO: 58057 - RNA, 23 nt, Artificial Sequence
  RNA Oligomer
cuugcagggagaauaacuugcgc

SEQ ID NO: 58058 - RNA, 23 nt, Artificial Sequence
  RNA Oligomer
acuugcagggagaauaacuugcg

SEQ ID NO: 58059 - RNA, 23 nt, Artificial Sequence
  RNA Oligomer
aacuugcagggagaauaacuugc

SEQ ID NO: 58060 - RNA, 23 nt, Artificial Sequence
  RNA Oligomer
uaaagaacuaucaggacaugguu

SEQ ID NO: 58061 - RNA, 23 nt, Artificial Sequence
  RNA Oligomer
uuaaagaacuaucaggacauggu

SEQ ID NO: 58062 - RNA, 23 nt, Artificial Sequence
  RNA Oligomer
auuaaagaacuaucaggacaugg

SEQ ID NO: 58063 - RNA, 23 nt, Artificial Sequence
  RNA Oligomer
uauuaaagaacuaucaggacaug

SEQ ID NO: 58064 - RNA, 23 nt, Artificial Sequence
  RNA Oligomer
guauuaaagaacuaucaggacau

SEQ ID NO: 58065 - RNA, 23 nt, Artificial Sequence
  RNA Oligomer
uccuaaggcaugcugugucccga

SEQ ID NO: 58066 - RNA, 23 nt, Artificial Sequence
  RNA Oligomer
uuccuaaggcaugcugugucccg

SEQ ID NO: 58067 - RNA, 23 nt, Artificial Sequence
  RNA Oligomer
auuccuaaggcaugcuguguccc

SEQ ID NO: 58068 - RNA, 23 nt, Artificial Sequence
  RNA Oligomer
gauuccuaaggcaugcugugucc

SEQ ID NO: 58069 - RNA, 23 nt, Artificial Sequence
  RNA Oligomer
cugaucaucugaacuccacuaau

SEQ ID NO: 58070 - RNA, 23 nt, Artificial Sequence
  RNA Oligomer
gcugaucaucugaacuccacuaa

SEQ ID NO: 58071 - RNA, 23 nt, Artificial Sequence
  RNA Oligomer
ggcugaucaucugaacuccacua

SEQ ID NO: 58072 - RNA, 23 nt, Artificial Sequence
  RNA Oligomer
uggcugaucaucugaacuccacu

SEQ ID NO: 58073 - RNA, 23 nt, Artificial Sequence
  RNA Oligomer
cuggcugaucaucugaacuccac

SEQ ID NO: 58074 - RNA, 23 nt, Artificial Sequence
  RNA Oligomer
ucuggcugaucaucugaacucca

SEQ ID NO: 58075 - RNA, 23 nt, Artificial Sequence
  RNA Oligomer
cuuuuggccaugauggaaaaggg

SEQ ID NO: 58076 - RNA, 23 nt, Artificial Sequence
  RNA Oligomer
acuuuuggccaugauggaaaagg

SEQ ID NO: 58077 - RNA, 23 nt, Artificial Sequence
  RNA Oligomer
aacuuuuggccaugauggaaaag

SEQ ID NO: 58078 - RNA, 23 nt, Artificial Sequence
  RNA Oligomer
uaacuuuuggccaugauggaaaa

SEQ ID NO: 58079 - RNA, 23 nt, Artificial Sequence
  RNA Oligomer
guaacuuuuggccaugauggaaa

SEQ ID NO: 58080 - RNA, 23 nt, Artificial Sequence
  RNA Oligomer
agcagagcuucagguuuuccgag

SEQ ID NO: 58081 - RNA, 23 nt, Artificial Sequence
  RNA Oligomer
cagcagagcuucagguuuuccga

SEQ ID NO: 58082 - RNA, 23 nt, Artificial Sequence
  RNA Oligomer
ucagcagagcuucagguuuuccg

SEQ ID NO: 58083 - RNA, 23 nt, Artificial Sequence
  RNA Oligomer
cucagcagagcuucagguuuucc

SEQ ID NO: 58084 - RNA, 23 nt, Artificial Sequence
  RNA Oligomer
ccucagcagagcuucagguuuuc

SEQ ID NO: 58085 - RNA, 23 nt, Artificial Sequence
  RNA Oligomer
cccuacaugcuagaccuguaucg

SEQ ID NO: 58086 - RNA, 23 nt, Artificial Sequence
  RNA Oligomer
ccccuacaugcuagaccuguauc

SEQ ID NO: 58087 - RNA, 23 nt, Artificial Sequence
  RNA Oligomer
cccccuacaugcuagaccuguau

SEQ ID NO: 58088 - RNA, 23 nt, Artificial Sequence
  RNA Oligomer
ccccccuacaugcuagaccugua

SEQ ID NO: 58089 - RNA, 23 nt, Artificial Sequence
  RNA Oligomer
gccccccuacaugcuagaccugu

SEQ ID NO: 58090 - RNA, 23 nt, Artificial Sequence
  RNA Oligomer
aucaucugaacuccacuaaucau

SEQ ID NO: 58091 - RNA, 23 nt, Artificial Sequence
  RNA Oligomer
gaucaucugaacuccacuaauca

SEQ ID NO: 58092 - RNA, 23 nt, Artificial Sequence
  RNA Oligomer
ugaucaucugaacuccacuaauc

SEQ ID NO: 58093 - RNA, 23 nt, Artificial Sequence
  RNA Oligomer
ccacuuggaggagaaacaaggug

SEQ ID NO: 58094 - RNA, 23 nt, Artificial Sequence
  RNA Oligomer
cccacuuggaggagaaacaaggu

SEQ ID NO: 58095 - RNA, 23 nt, Artificial Sequence
  RNA Oligomer
gcccacuuggaggagaaacaagg

SEQ ID NO: 58096 - RNA, 23 nt, Artificial Sequence
  RNA Oligomer
ggcccacuuggaggagaaacaag

SEQ ID NO: 58097 - RNA, 23 nt, Artificial Sequence
  RNA Oligomer
uggcccacuuggaggagaaacaa

SEQ ID NO: 58098 - RNA, 23 nt, Artificial Sequence
  RNA Oligomer
aaacaacccggagauucuucuuu

SEQ ID NO: 58099 - RNA, 23 nt, Artificial Sequence
  RNA Oligomer
cauguggacgcucuuucaaugga

SEQ ID NO: 58100 - RNA, 23 nt, Artificial Sequence
  RNA Oligomer
gagaaugaaaagguuguauuaaa

SEQ ID NO: 58101 - RNA, 23 nt, Artificial Sequence
  RNA Oligomer
cccuuuguacguggacuucagug

SEQ ID NO: 58102 - RNA, 23 nt, Artificial Sequence
  RNA Oligomer
acccuuuguacguggacuucagu

SEQ ID NO: 58103 - RNA, 23 nt, Artificial Sequence
  RNA Oligomer
cacccuuuguacguggacuucag

SEQ ID NO: 58104 - RNA, 23 nt, Artificial Sequence
  RNA Oligomer
acacccuuuguacguggacuuca

SEQ ID NO: 58105 - RNA, 23 nt, Artificial Sequence
  RNA Oligomer
gacacccuuuguacguggacuuc

SEQ ID NO: 58106 - RNA, 23 nt, Artificial Sequence
  RNA Oligomer
cucuuucaauggacguguccccg

SEQ ID NO: 58107 - RNA, 23 nt, Artificial Sequence
  RNA Oligomer
gcucuuucaauggacgugucccc

SEQ ID NO: 58108 - RNA, 23 nt, Artificial Sequence
  RNA Oligomer
cgcucuuucaauggacguguccc

SEQ ID NO: 58109 - RNA, 23 nt, Artificial Sequence
  RNA Oligomer
acgcucuuucaauggacgugucc

SEQ ID NO: 58110 - RNA, 23 nt, Artificial Sequence
  RNA Oligomer
gacgcucuuucaauggacguguc

SEQ ID NO: 58111 - RNA, 23 nt, Artificial Sequence
  RNA Oligomer
cgcuaguacagcaaaauuaaaua

SEQ ID NO: 58112 - RNA, 23 nt, Artificial Sequence
  RNA Oligomer
ucgcuaguacagcaaaauuaaau

SEQ ID NO: 58113 - RNA, 23 nt, Artificial Sequence
  RNA Oligomer
gucgcuaguacagcaaaauuaaa

SEQ ID NO: 58114 - RNA, 23 nt, Artificial Sequence
  RNA Oligomer
ugucgcuaguacagcaaaauuaa

SEQ ID NO: 58115 - RNA, 23 nt, Artificial Sequence
  RNA Oligomer
gugucgcuaguacagcaaaauua

SEQ ID NO: 58116 - RNA, 23 nt, Artificial Sequence
  RNA Oligomer
acaugguuguggaggguuguggg

SEQ ID NO: 58117 - RNA, 23 nt, Artificial Sequence
  RNA Oligomer
gacaugguuguggaggguugugg

SEQ ID NO: 58118 - RNA, 23 nt, Artificial Sequence
  RNA Oligomer
ggacaugguuguggaggguugug

SEQ ID NO: 58119 - RNA, 23 nt, Artificial Sequence
  RNA Oligomer
aggacaugguuguggaggguugu

SEQ ID NO: 58120 - RNA, 23 nt, Artificial Sequence
  RNA Oligomer
caggacaugguuguggaggguug

SEQ ID NO: 58121 - RNA, 23 nt, Artificial Sequence
  RNA Oligomer
ccaaacacaaacagcggaaacgc

SEQ ID NO: 58122 - RNA, 23 nt, Artificial Sequence
  RNA Oligomer
gccaaacacaaacagcggaaacg

SEQ ID NO: 58123 - RNA, 23 nt, Artificial Sequence
  RNA Oligomer
agccaaacacaaacagcggaaac

SEQ ID NO: 58124 - RNA, 23 nt, Artificial Sequence
  RNA Oligomer
aagccaaacacaaacagcggaaa

SEQ ID NO: 58125 - RNA, 23 nt, Artificial Sequence
  RNA Oligomer
caagccaaacacaaacagcggaa

SEQ ID NO: 58126 - RNA, 23 nt, Artificial Sequence
  RNA Oligomer
aguaacuuuuggccaugauggaa

SEQ ID NO: 58127 - RNA, 23 nt, Artificial Sequence
  RNA Oligomer
uaguaacuuuuggccaugaugga

SEQ ID NO: 58128 - RNA, 23 nt, Artificial Sequence
  RNA Oligomer
ggccauugcuaguaacuuuuggc

SEQ ID NO: 58129 - RNA, 23 nt, Artificial Sequence
  RNA Oligomer
aggccauugcuaguaacuuuugg

SEQ ID NO: 58130 - RNA, 23 nt, Artificial Sequence
  RNA Oligomer
aaggccauugcuaguaacuuuug

SEQ ID NO: 58131 - RNA, 23 nt, Artificial Sequence
  RNA Oligomer
uaaggccauugcuaguaacuuuu

SEQ ID NO: 58132 - RNA, 23 nt, Artificial Sequence
  RNA Oligomer
auaaggccauugcuaguaacuuu

SEQ ID NO: 58133 - RNA, 23 nt, Artificial Sequence
  RNA Oligomer
uuuuccucuggcugaucaucuga

SEQ ID NO: 58134 - RNA, 23 nt, Artificial Sequence
  RNA Oligomer
cuuuuccucuggcugaucaucug

SEQ ID NO: 58135 - RNA, 23 nt, Artificial Sequence
  RNA Oligomer
accaagaugaacacagcugguca

SEQ ID NO: 58136 - RNA, 23 nt, Artificial Sequence
  RNA Oligomer
caccaagaugaacacagcugguc

SEQ ID NO: 58137 - RNA, 23 nt, Artificial Sequence
  RNA Oligomer
gcaccaagaugaacacagcuggu

SEQ ID NO: 58138 - RNA, 23 nt, Artificial Sequence
  RNA Oligomer
ugcaccaagaugaacacagcugg

SEQ ID NO: 58139 - RNA, 23 nt, Artificial Sequence
  RNA Oligomer
uugcaccaagaugaacacagcug

SEQ ID NO: 58140 - RNA, 23 nt, Artificial Sequence
  RNA Oligomer
agaugcuuuaggaaacaauagca

SEQ ID NO: 58141 - RNA, 23 nt, Artificial Sequence
  RNA Oligomer
aagaugcuuuaggaaacaauagc

SEQ ID NO: 58142 - RNA, 23 nt, Artificial Sequence
  RNA Oligomer
caagaugcuuuaggaaacaauag

SEQ ID NO: 58143 - RNA, 23 nt, Artificial Sequence
  RNA Oligomer
gcaagaugcuuuaggaaacaaua

SEQ ID NO: 58144 - RNA, 23 nt, Artificial Sequence
  RNA Oligomer
ugcaagaugcuuuaggaaacaau

SEQ ID NO: 58145 - RNA, 23 nt, Artificial Sequence
  RNA Oligomer
cuaccagaaacgagugggaaaac

SEQ ID NO: 58146 - RNA, 23 nt, Artificial Sequence
  RNA Oligomer
acuaccagaaacgagugggaaaa

SEQ ID NO: 58147 - RNA, 23 nt, Artificial Sequence
  RNA Oligomer
gguggaaugacuggauuguggcu

SEQ ID NO: 58148 - RNA, 23 nt, Artificial Sequence
  RNA Oligomer
augcuuuaggaaacaauagcagu

SEQ ID NO: 58149 - RNA, 23 nt, Artificial Sequence
  RNA Oligomer
gaugcuuuaggaaacaauagcag

SEQ ID NO: 58150 - RNA, 23 nt, Artificial Sequence
  RNA Oligomer
ggugucgcuaguacagcaaaauu

SEQ ID NO: 58151 - RNA, 23 nt, Artificial Sequence
  RNA Oligomer
gggugucgcuaguacagcaaaau

SEQ ID NO: 58152 - RNA, 23 nt, Artificial Sequence
  RNA Oligomer
ugggugucgcuaguacagcaaaa

SEQ ID NO: 58153 - RNA, 23 nt, Artificial Sequence
  RNA Oligomer
agaaugcccuuuuccucuggcug

SEQ ID NO: 58154 - RNA, 23 nt, Artificial Sequence
  RNA Oligomer
gagaaugcccuuuuccucuggcu

SEQ ID NO: 58155 - RNA, 23 nt, Artificial Sequence
  RNA Oligomer
ggagaaugcccuuuuccucuggc

SEQ ID NO: 58156 - RNA, 23 nt, Artificial Sequence
  RNA Oligomer
cggagaaugcccuuuuccucugg

SEQ ID NO: 58157 - RNA, 23 nt, Artificial Sequence
  RNA Oligomer
acggagaaugcccuuuuccucug

SEQ ID NO: 58158 - RNA, 23 nt, Artificial Sequence
  RNA Oligomer
gaacggacauucgguccuugcgc

SEQ ID NO: 58159 - RNA, 23 nt, Artificial Sequence
  RNA Oligomer
ggaacggacauucgguccuugcg

SEQ ID NO: 58160 - RNA, 23 nt, Artificial Sequence
  RNA Oligomer
aggaacggacauucgguccuugc

SEQ ID NO: 58161 - RNA, 23 nt, Artificial Sequence
  RNA Oligomer
aaggaacggacauucgguccuug

SEQ ID NO: 58162 - RNA, 23 nt, Artificial Sequence
  RNA Oligomer
aaaggaacggacauucgguccuu

SEQ ID NO: 58163 - RNA, 23 nt, Artificial Sequence
  RNA Oligomer
caaacacaaacagcggaaacgcc

SEQ ID NO: 58164 - RNA, 23 nt, Artificial Sequence
  RNA Oligomer
agaaucuuuggaagaacuaccag

SEQ ID NO: 58165 - RNA, 23 nt, Artificial Sequence
  RNA Oligomer
aagaaucuuuggaagaacuacca

SEQ ID NO: 58166 - RNA, 23 nt, Artificial Sequence
  RNA Oligomer
gaagaaucuuuggaagaacuacc

SEQ ID NO: 58167 - RNA, 23 nt, Artificial Sequence
  RNA Oligomer
cccuuuuccucuggcugaucauc

SEQ ID NO: 58168 - RNA, 23 nt, Artificial Sequence
  RNA Oligomer
gcccuuuuccucuggcugaucau

SEQ ID NO: 58169 - RNA, 23 nt, Artificial Sequence
  RNA Oligomer
ugcccuuuuccucuggcugauca

SEQ ID NO: 58170 - RNA, 23 nt, Artificial Sequence
  RNA Oligomer
augcccuuuuccucuggcugauc

SEQ ID NO: 58171 - RNA, 23 nt, Artificial Sequence
  RNA Oligomer
aaugcccuuuuccucuggcugau

SEQ ID NO: 58172 - RNA, 23 nt, Artificial Sequence
  RNA Oligomer
ucaagccaaacacaaacagcgga

SEQ ID NO: 58173 - RNA, 23 nt, Artificial Sequence
  RNA Oligomer
ccucuccacaaaagagaaaaacg

SEQ ID NO: 58174 - RNA, 23 nt, Artificial Sequence
  RNA Oligomer
uccucuccacaaaagagaaaaac

SEQ ID NO: 58175 - RNA, 23 nt, Artificial Sequence
  RNA Oligomer
auccucuccacaaaagagaaaaa

SEQ ID NO: 58176 - RNA, 23 nt, Artificial Sequence
  RNA Oligomer
cauccucuccacaaaagagaaaa

SEQ ID NO: 58177 - RNA, 23 nt, Artificial Sequence
  RNA Oligomer
gcauccucuccacaaaagagaaa

SEQ ID NO: 58178 - RNA, 23 nt, Artificial Sequence
  RNA Oligomer
acagaugcaagaugcuuuaggaa

SEQ ID NO: 58179 - RNA, 23 nt, Artificial Sequence
  RNA Oligomer
aacagaugcaagaugcuuuagga

SEQ ID NO: 58180 - RNA, 23 nt, Artificial Sequence
  RNA Oligomer
gaacagaugcaagaugcuuuagg

SEQ ID NO: 58181 - RNA, 23 nt, Artificial Sequence
  RNA Oligomer
agaacagaugcaagaugcuuuag

SEQ ID NO: 58182 - RNA, 23 nt, Artificial Sequence
  RNA Oligomer
gagaacagaugcaagaugcuuua

SEQ ID NO: 58183 - RNA, 23 nt, Artificial Sequence
  RNA Oligomer
gcuucagguuuuccgagaacaga

SEQ ID NO: 58184 - RNA, 23 nt, Artificial Sequence
  RNA Oligomer
agcuucagguuuuccgagaacag

SEQ ID NO: 58185 - RNA, 23 nt, Artificial Sequence
  RNA Oligomer
gagcuucagguuuuccgagaaca

SEQ ID NO: 58186 - RNA, 23 nt, Artificial Sequence
  RNA Oligomer
agagcuucagguuuuccgagaac

SEQ ID NO: 58187 - RNA, 23 nt, Artificial Sequence
  RNA Oligomer
cagagcuucagguuuuccgagaa

SEQ ID NO: 58188 - RNA, 23 nt, Artificial Sequence
  RNA Oligomer
aacuaccagaaacgagugggaaa

SEQ ID NO: 58189 - RNA, 23 nt, Artificial Sequence
  RNA Oligomer
gaacuaccagaaacgagugggaa

SEQ ID NO: 58190 - RNA, 23 nt, Artificial Sequence
  RNA Oligomer
gccauugcuaguaacuuuuggcc

SEQ ID NO: 58191 - RNA, 23 nt, Artificial Sequence
  RNA Oligomer
acagauaaggccauugcuaguaa

SEQ ID NO: 58192 - RNA, 23 nt, Artificial Sequence
  RNA Oligomer
cacagauaaggccauugcuagua

SEQ ID NO: 58193 - RNA, 23 nt, Artificial Sequence
  RNA Oligomer
cacagcuggucacagauaaggcc

SEQ ID NO: 58194 - RNA, 23 nt, Artificial Sequence
  RNA Oligomer
acacagcuggucacagauaaggc

SEQ ID NO: 58195 - RNA, 23 nt, Artificial Sequence
  RNA Oligomer
aacacagcuggucacagauaagg

SEQ ID NO: 58196 - RNA, 23 nt, Artificial Sequence
  RNA Oligomer
gaacacagcuggucacagauaag

SEQ ID NO: 58197 - RNA, 23 nt, Artificial Sequence
  RNA Oligomer
ugaacacagcuggucacagauaa

SEQ ID NO: 58198 - RNA, 23 nt, Artificial Sequence
  RNA Oligomer
gacuuuuggacaccagguuggug

SEQ ID NO: 58199 - RNA, 23 nt, Artificial Sequence
  RNA Oligomer
agacuuuuggacaccagguuggu

SEQ ID NO: 58200 - RNA, 23 nt, Artificial Sequence
  RNA Oligomer
cagacuuuuggacaccagguugg

SEQ ID NO: 58201 - RNA, 23 nt, Artificial Sequence
  RNA Oligomer
ccagacuuuuggacaccagguug

SEQ ID NO: 58202 - RNA, 23 nt, Artificial Sequence
  RNA Oligomer
accagacuuuuggacaccagguu

SEQ ID NO: 58203 - RNA, 23 nt, Artificial Sequence
  RNA Oligomer
gggaaaacaacccggagauucuu

SEQ ID NO: 58204 - RNA, 23 nt, Artificial Sequence
  RNA Oligomer
ugggaaaacaacccggagauucu

SEQ ID NO: 58205 - RNA, 23 nt, Artificial Sequence
  RNA Oligomer
gugggaaaacaacccggagauuc

SEQ ID NO: 58206 - RNA, 23 nt, Artificial Sequence
  RNA Oligomer
agugggaaaacaacccggagauu

SEQ ID NO: 58207 - RNA, 23 nt, Artificial Sequence
  RNA Oligomer
gagugggaaaacaacccggagau

SEQ ID NO: 58208 - RNA, 23 nt, Artificial Sequence
  RNA Oligomer
acguuggucaacucuguuaacuc

SEQ ID NO: 58209 - RNA, 23 nt, Artificial Sequence
  RNA Oligomer
gacguuggucaacucuguuaacu

SEQ ID NO: 58210 - RNA, 23 nt, Artificial Sequence
  RNA Oligomer
agacguuggucaacucuguuaac

SEQ ID NO: 58211 - RNA, 23 nt, Artificial Sequence
  RNA Oligomer
cagacguuggucaacucuguuaa

SEQ ID NO: 58212 - RNA, 23 nt, Artificial Sequence
  RNA Oligomer
ucagacguuggucaacucuguua

SEQ ID NO: 58213 - RNA, 23 nt, Artificial Sequence
  RNA Oligomer
gcuaguacagcaaaauuaaauac

SEQ ID NO: 58214 - RNA, 23 nt, Artificial Sequence
  RNA Oligomer
gugggugucgcuaguacagcaaa

SEQ ID NO: 58215 - RNA, 23 nt, Artificial Sequence
  RNA Oligomer
ugugggugucgcuaguacagcaa

SEQ ID NO: 58216 - RNA, 23 nt, Artificial Sequence
  RNA Oligomer
ugucccgacagaacucagugcua

SEQ ID NO: 58217 - RNA, 23 nt, Artificial Sequence
  RNA Oligomer
aacuccacuaaucaugccauugu

SEQ ID NO: 58218 - RNA, 23 nt, Artificial Sequence
  RNA Oligomer
gaacuccacuaaucaugccauug

SEQ ID NO: 58219 - RNA, 23 nt, Artificial Sequence
  RNA Oligomer
ugaacuccacuaaucaugccauu

SEQ ID NO: 58220 - RNA, 23 nt, Artificial Sequence
  RNA Oligomer
gauaaggccauugcuaguaacuu

SEQ ID NO: 58221 - RNA, 23 nt, Artificial Sequence
  RNA Oligomer
agauaaggccauugcuaguaacu

SEQ ID NO: 58222 - RNA, 23 nt, Artificial Sequence
  RNA Oligomer
cagauaaggccauugcuaguaac

SEQ ID NO: 58223 - RNA, 23 nt, Artificial Sequence
  RNA Oligomer
augaacacagcuggucacagaua

SEQ ID NO: 58224 - RNA, 23 nt, Artificial Sequence
  RNA Oligomer
gaccagacuuuuggacaccaggu

SEQ ID NO: 58225 - RNA, 23 nt, Artificial Sequence
  RNA Oligomer
ugaccagacuuuuggacaccagg

SEQ ID NO: 58226 - RNA, 23 nt, Artificial Sequence
  RNA Oligomer
gugaccagacuuuuggacaccag

SEQ ID NO: 58227 - RNA, 23 nt, Artificial Sequence
  RNA Oligomer
gcaguuuccaucaccgaauuaau

SEQ ID NO: 58228 - RNA, 23 nt, Artificial Sequence
  RNA Oligomer
agcaguuuccaucaccgaauuaa

SEQ ID NO: 58229 - RNA, 23 nt, Artificial Sequence
  RNA Oligomer
uagcaguuuccaucaccgaauua

SEQ ID NO: 58230 - RNA, 23 nt, Artificial Sequence
  RNA Oligomer
auagcaguuuccaucaccgaauu

SEQ ID NO: 58231 - RNA, 23 nt, Artificial Sequence
  RNA Oligomer
aauagcaguuuccaucaccgaau

SEQ ID NO: 58232 - RNA, 23 nt, Artificial Sequence
  RNA Oligomer
caccaugaagaaucuuuggaaga

SEQ ID NO: 58233 - RNA, 23 nt, Artificial Sequence
  RNA Oligomer
ccacggagaaugcccuuuuccuc

SEQ ID NO: 58234 - RNA, 23 nt, Artificial Sequence
  RNA Oligomer
gccacggagaaugcccuuuuccu

SEQ ID NO: 58235 - RNA, 23 nt, Artificial Sequence
  RNA Oligomer
ugccacggagaaugcccuuuucc

SEQ ID NO: 58236 - RNA, 23 nt, Artificial Sequence
  RNA Oligomer
cugccacggagaaugcccuuuuc

SEQ ID NO: 58237 - RNA, 23 nt, Artificial Sequence
  RNA Oligomer
acugccacggagaaugcccuuuu

SEQ ID NO: 58238 - RNA, 23 nt, Artificial Sequence
  RNA Oligomer
ucacgccuuuuacugccacggag

SEQ ID NO: 58239 - RNA, 23 nt, Artificial Sequence
  RNA Oligomer
aucacgccuuuuacugccacgga

SEQ ID NO: 58240 - RNA, 23 nt, Artificial Sequence
  RNA Oligomer
uaucacgccuuuuacugccacgg

SEQ ID NO: 58241 - RNA, 23 nt, Artificial Sequence
  RNA Oligomer
guaucacgccuuuuacugccacg

SEQ ID NO: 58242 - RNA, 23 nt, Artificial Sequence
  RNA Oligomer
gguaucacgccuuuuacugccac

SEQ ID NO: 58243 - RNA, 23 nt, Artificial Sequence
  RNA Oligomer
acagcggaaacgccuuaagucca

SEQ ID NO: 58244 - RNA, 23 nt, Artificial Sequence
  RNA Oligomer
aacagcggaaacgccuuaagucc

SEQ ID NO: 58245 - RNA, 23 nt, Artificial Sequence
  RNA Oligomer
aaacagcggaaacgccuuaaguc

SEQ ID NO: 58246 - RNA, 23 nt, Artificial Sequence
  RNA Oligomer
caaacagcggaaacgccuuaagu

SEQ ID NO: 58247 - RNA, 23 nt, Artificial Sequence
  RNA Oligomer
acaaacagcggaaacgccuuaag

SEQ ID NO: 58248 - RNA, 23 nt, Artificial Sequence
  RNA Oligomer
ggcauccucuccacaaaagagaa

SEQ ID NO: 58249 - RNA, 23 nt, Artificial Sequence
  RNA Oligomer
guggcccacuuggaggagaaaca

SEQ ID NO: 58250 - RNA, 23 nt, Artificial Sequence
  RNA Oligomer
gggagaauaacuugcgcacccca

SEQ ID NO: 58251 - RNA, 23 nt, Artificial Sequence
  RNA Oligomer
agggagaauaacuugcgcacccc

SEQ ID NO: 58252 - RNA, 23 nt, Artificial Sequence
  RNA Oligomer
cagggagaauaacuugcgcaccc

SEQ ID NO: 58253 - RNA, 23 nt, Artificial Sequence
  RNA Oligomer
gcagggagaauaacuugcgcacc

SEQ ID NO: 58254 - RNA, 23 nt, Artificial Sequence
  RNA Oligomer
ugcagggagaauaacuugcgcac

SEQ ID NO: 58255 - RNA, 23 nt, Artificial Sequence
  RNA Oligomer
ggaaaacaacccggagauucuuc

SEQ ID NO: 58256 - RNA, 23 nt, Artificial Sequence
  RNA Oligomer
ucuuuggaagaacuaccagaaac

SEQ ID NO: 58257 - RNA, 23 nt, Artificial Sequence
  RNA Oligomer
gaacuaucaggacaugguugugg

SEQ ID NO: 58258 - RNA, 23 nt, Artificial Sequence
  RNA Oligomer
agaacuaucaggacaugguugug

SEQ ID NO: 58259 - RNA, 23 nt, Artificial Sequence
  RNA Oligomer
aagaacuaucaggacaugguugu

SEQ ID NO: 58260 - RNA, 23 nt, Artificial Sequence
  RNA Oligomer
aaagaacuaucaggacaugguug

SEQ ID NO: 58261 - RNA, 23 nt, Artificial Sequence
  RNA Oligomer
ccagaguuuuuccauguggacgc

SEQ ID NO: 58262 - RNA, 23 nt, Artificial Sequence
  RNA Oligomer
cguuggucaacucuguuaacucu

SEQ ID NO: 58263 - RNA, 23 nt, Artificial Sequence
  RNA Oligomer
aaaacgucaagccaaacacaaac

SEQ ID NO: 58264 - RNA, 23 nt, Artificial Sequence
  RNA Oligomer
aaaaacgucaagccaaacacaaa

SEQ ID NO: 58265 - RNA, 23 nt, Artificial Sequence
  RNA Oligomer
ccauugcuaguaacuuuuggcca

SEQ ID NO: 58266 - RNA, 23 nt, Artificial Sequence
  RNA Oligomer
gcaggucuuugcaccaagaugaa

SEQ ID NO: 58267 - RNA, 23 nt, Artificial Sequence
  RNA Oligomer
agcaggucuuugcaccaagauga

SEQ ID NO: 58268 - RNA, 23 nt, Artificial Sequence
  RNA Oligomer
aagcaggucuuugcaccaagaug

SEQ ID NO: 58269 - RNA, 23 nt, Artificial Sequence
  RNA Oligomer
uaagcaggucuuugcaccaagau

SEQ ID NO: 58270 - RNA, 23 nt, Artificial Sequence
  RNA Oligomer
auaagcaggucuuugcaccaaga

SEQ ID NO: 58271 - RNA, 23 nt, Artificial Sequence
  RNA Oligomer
aaccugcaacagccaacucgaaa

SEQ ID NO: 58272 - RNA, 23 nt, Artificial Sequence
  RNA Oligomer
aaaccugcaacagccaacucgaa

SEQ ID NO: 58273 - RNA, 23 nt, Artificial Sequence
  RNA Oligomer
caguuuccaucaccgaauuaaua

SEQ ID NO: 58274 - RNA, 23 nt, Artificial Sequence
  RNA Oligomer
gguuuuccgagaacagaugcaag

SEQ ID NO: 58275 - RNA, 23 nt, Artificial Sequence
  RNA Oligomer
agguuuuccgagaacagaugcaa

SEQ ID NO: 58276 - RNA, 23 nt, Artificial Sequence
  RNA Oligomer
cagguuuuccgagaacagaugca

SEQ ID NO: 58277 - RNA, 23 nt, Artificial Sequence
  RNA Oligomer
ucagguuuuccgagaacagaugc

SEQ ID NO: 58278 - RNA, 23 nt, Artificial Sequence
  RNA Oligomer
uucagguuuuccgagaacagaug

SEQ ID NO: 58279 - RNA, 23 nt, Artificial Sequence
  RNA Oligomer
cuucagguuuuccgagaacagau

SEQ ID NO: 58280 - RNA, 23 nt, Artificial Sequence
  RNA Oligomer
gcagagcuucagguuuuccgaga

SEQ ID NO: 58281 - RNA, 23 nt, Artificial Sequence
  RNA Oligomer
ggaggaguuuaucaccucagcag

SEQ ID NO: 58282 - RNA, 23 nt, Artificial Sequence
  RNA Oligomer
cggaggaguuuaucaccucagca

SEQ ID NO: 58283 - RNA, 23 nt, Artificial Sequence
  RNA Oligomer
acggaggaguuuaucaccucagc

SEQ ID NO: 58284 - RNA, 23 nt, Artificial Sequence
  RNA Oligomer
cacggaggaguuuaucaccucag

SEQ ID NO: 58285 - RNA, 23 nt, Artificial Sequence
  RNA Oligomer
cuacaugcuagaccuguaucgca

SEQ ID NO: 58286 - RNA, 23 nt, Artificial Sequence
  RNA Oligomer
ccuacaugcuagaccuguaucgc

SEQ ID NO: 58287 - RNA, 23 nt, Artificial Sequence
  RNA Oligomer
cccgcgugcuucuuagacggacu

SEQ ID NO: 58288 - RNA, 23 nt, Artificial Sequence
  RNA Oligomer
ccauuguucagacguuggucaac

SEQ ID NO: 58289 - RNA, 23 nt, Artificial Sequence
  RNA Oligomer
gccauuguucagacguuggucaa

SEQ ID NO: 58290 - RNA, 23 nt, Artificial Sequence
  RNA Oligomer
ugccauuguucagacguugguca

SEQ ID NO: 58291 - RNA, 23 nt, Artificial Sequence
  RNA Oligomer
augccauuguucagacguugguc

SEQ ID NO: 58292 - RNA, 23 nt, Artificial Sequence
  RNA Oligomer
caugccauuguucagacguuggu

SEQ ID NO: 58293 - RNA, 23 nt, Artificial Sequence
  RNA Oligomer
ucaugccauuguucagacguugg

SEQ ID NO: 58294 - RNA, 23 nt, Artificial Sequence
  RNA Oligomer
aucaugccauuguucagacguug

SEQ ID NO: 58295 - RNA, 23 nt, Artificial Sequence
  RNA Oligomer
aaucaugccauuguucagacguu

SEQ ID NO: 58296 - RNA, 23 nt, Artificial Sequence
  RNA Oligomer
cuguaagagacacccuuuguacg

SEQ ID NO: 58297 - RNA, 23 nt, Artificial Sequence
  RNA Oligomer
gcuguaagagacacccuuuguac

SEQ ID NO: 58298 - RNA, 23 nt, Artificial Sequence
  RNA Oligomer
agcuguaagagacacccuuugua

SEQ ID NO: 58299 - RNA, 23 nt, Artificial Sequence
  RNA Oligomer
cagcuguaagagacacccuuugu

SEQ ID NO: 58300 - RNA, 23 nt, Artificial Sequence
  RNA Oligomer
ccagcuguaagagacacccuuug

SEQ ID NO: 58301 - RNA, 23 nt, Artificial Sequence
  RNA Oligomer
cgccuuaaguccagcuguaagag

SEQ ID NO: 58302 - RNA, 23 nt, Artificial Sequence
  RNA Oligomer
acgccuuaaguccagcuguaaga

SEQ ID NO: 58303 - RNA, 23 nt, Artificial Sequence
  RNA Oligomer
aacgccuuaaguccagcuguaag

SEQ ID NO: 58304 - RNA, 23 nt, Artificial Sequence
  RNA Oligomer
aaacgccuuaaguccagcuguaa

SEQ ID NO: 58305 - RNA, 23 nt, Artificial Sequence
  RNA Oligomer
gaaacgccuuaaguccagcugua

SEQ ID NO: 58306 - RNA, 23 nt, Artificial Sequence
  RNA Oligomer
agaaaaggaacggacauucgguc

SEQ ID NO: 58307 - RNA, 23 nt, Artificial Sequence
  RNA Oligomer
agaaacaaggugucuccaagaga

SEQ ID NO: 58308 - RNA, 23 nt, Artificial Sequence
  RNA Oligomer
gagaaacaaggugucuccaagag

SEQ ID NO: 58309 - RNA, 23 nt, Artificial Sequence
  RNA Oligomer
ggagaaacaaggugucuccaaga

SEQ ID NO: 58310 - RNA, 23 nt, Artificial Sequence
  RNA Oligomer
aggagaaacaaggugucuccaag

SEQ ID NO: 58311 - RNA, 23 nt, Artificial Sequence
  RNA Oligomer
gaggagaaacaaggugucuccaa

SEQ ID NO: 58312 - RNA, 23 nt, Artificial Sequence
  RNA Oligomer
gacacgccaaccauggauucgug

SEQ ID NO: 58313 - RNA, 23 nt, Artificial Sequence
  RNA Oligomer
ggacacgccaaccauggauucgu

SEQ ID NO: 58314 - RNA, 23 nt, Artificial Sequence
  RNA Oligomer
gggacacgccaaccauggauucg

SEQ ID NO: 58315 - RNA, 23 nt, Artificial Sequence
  RNA Oligomer
agggacacgccaaccauggauuc

SEQ ID NO: 58316 - RNA, 23 nt, Artificial Sequence
  RNA Oligomer
cagggacacgccaaccauggauu

SEQ ID NO: 58317 - RNA, 23 nt, Artificial Sequence
  RNA Oligomer
ggacaccagguuggugaaucaga

SEQ ID NO: 58318 - RNA, 23 nt, Artificial Sequence
  RNA Oligomer
uggacaccagguuggugaaucag

SEQ ID NO: 58319 - RNA, 23 nt, Artificial Sequence
  RNA Oligomer
uuggacaccagguuggugaauca

SEQ ID NO: 58320 - RNA, 23 nt, Artificial Sequence
  RNA Oligomer
uuuggacaccagguuggugaauc

SEQ ID NO: 58321 - RNA, 23 nt, Artificial Sequence
  RNA Oligomer
ggaaacaauagcaguuuccauca

SEQ ID NO: 58322 - RNA, 23 nt, Artificial Sequence
  RNA Oligomer
aggaaacaauagcaguuuccauc

SEQ ID NO: 58323 - RNA, 23 nt, Artificial Sequence
  RNA Oligomer
accucagcagagcuucagguuuu

SEQ ID NO: 58324 - RNA, 23 nt, Artificial Sequence
  RNA Oligomer
caccucagcagagcuucagguuu

SEQ ID NO: 58325 - RNA, 23 nt, Artificial Sequence
  RNA Oligomer
cagugcuaucucgaugcuguacc

SEQ ID NO: 58326 - RNA, 23 nt, Artificial Sequence
  RNA Oligomer
ucagugcuaucucgaugcuguac

SEQ ID NO: 58327 - RNA, 23 nt, Artificial Sequence
  RNA Oligomer
cucagugcuaucucgaugcugua

SEQ ID NO: 58328 - RNA, 23 nt, Artificial Sequence
  RNA Oligomer
guuggucaacucuguuaacucua

SEQ ID NO: 58329 - RNA, 23 nt, Artificial Sequence
  RNA Oligomer
uucagacguuggucaacucuguu

SEQ ID NO: 58330 - RNA, 23 nt, Artificial Sequence
  RNA Oligomer
ccagguccuuugaccagaguuuu

SEQ ID NO: 58331 - RNA, 23 nt, Artificial Sequence
  RNA Oligomer
gccagguccuuugaccagaguuu

SEQ ID NO: 58332 - RNA, 23 nt, Artificial Sequence
  RNA Oligomer
gaaaagggcauccucuccacaaa

SEQ ID NO: 58333 - RNA, 23 nt, Artificial Sequence
  RNA Oligomer
cagcuggucacagauaaggccau

SEQ ID NO: 58334 - RNA, 23 nt, Artificial Sequence
  RNA Oligomer
ggugucuccaagagacauguuag

SEQ ID NO: 58335 - RNA, 23 nt, Artificial Sequence
  RNA Oligomer
aggugucuccaagagacauguua

SEQ ID NO: 58336 - RNA, 23 nt, Artificial Sequence
  RNA Oligomer
aaggugucuccaagagacauguu

SEQ ID NO: 58337 - RNA, 23 nt, Artificial Sequence
  RNA Oligomer
caaggugucuccaagagacaugu

SEQ ID NO: 58338 - RNA, 23 nt, Artificial Sequence
  RNA Oligomer
acaaggugucuccaagagacaug

SEQ ID NO: 58339 - RNA, 23 nt, Artificial Sequence
  RNA Oligomer
gaaacaaggugucuccaagagac

SEQ ID NO: 58340 - RNA, 23 nt, Artificial Sequence
  RNA Oligomer
gcuguucccagcgugaaaagaga

SEQ ID NO: 58341 - RNA, 23 nt, Artificial Sequence
  RNA Oligomer
cgcuguucccagcgugaaaagag

SEQ ID NO: 58342 - RNA, 23 nt, Artificial Sequence
  RNA Oligomer
acgcuguucccagcgugaaaaga

SEQ ID NO: 58343 - RNA, 23 nt, Artificial Sequence
  RNA Oligomer
gacgcuguucccagcgugaaaag

SEQ ID NO: 58344 - RNA, 23 nt, Artificial Sequence
  RNA Oligomer
agacgcuguucccagcgugaaaa

SEQ ID NO: 58345 - RNA, 23 nt, Artificial Sequence
  RNA Oligomer
uccugagcgaguucgaguugcgg

SEQ ID NO: 58346 - RNA, 23 nt, Artificial Sequence
  RNA Oligomer
guccugagcgaguucgaguugcg

SEQ ID NO: 58347 - RNA, 23 nt, Artificial Sequence
  RNA Oligomer
gguccugagcgaguucgaguugc

SEQ ID NO: 58348 - RNA, 23 nt, Artificial Sequence
  RNA Oligomer
agguccugagcgaguucgaguug

SEQ ID NO: 58349 - RNA, 23 nt, Artificial Sequence
  RNA Oligomer
gagguccugagcgaguucgaguu

SEQ ID NO: 58350 - RNA, 23 nt, Artificial Sequence
  RNA Oligomer
cgccagguccuuugaccagaguu

SEQ ID NO: 58351 - RNA, 23 nt, Artificial Sequence
  RNA Oligomer
gcgccagguccuuugaccagagu

SEQ ID NO: 58352 - RNA, 23 nt, Artificial Sequence
  RNA Oligomer
agacacccuuuguacguggacuu

SEQ ID NO: 58353 - RNA, 23 nt, Artificial Sequence
  RNA Oligomer
gagacacccuuuguacguggacu

SEQ ID NO: 58354 - RNA, 23 nt, Artificial Sequence
  RNA Oligomer
agagacacccuuuguacguggac

SEQ ID NO: 58355 - RNA, 23 nt, Artificial Sequence
  RNA Oligomer
aagagacacccuuuguacgugga

SEQ ID NO: 58356 - RNA, 23 nt, Artificial Sequence
  RNA Oligomer
ugucuccaagagacauguuagga

SEQ ID NO: 58357 - RNA, 23 nt, Artificial Sequence
  RNA Oligomer
gugucuccaagagacauguuagg

SEQ ID NO: 58358 - RNA, 23 nt, Artificial Sequence
  RNA Oligomer
ccauggauucgugguggaagugg

SEQ ID NO: 58359 - RNA, 23 nt, Artificial Sequence
  RNA Oligomer
accauggauucgugguggaagug

SEQ ID NO: 58360 - RNA, 23 nt, Artificial Sequence
  RNA Oligomer
aaccauggauucgugguggaagu

SEQ ID NO: 58361 - RNA, 23 nt, Artificial Sequence
  RNA Oligomer
caaccauggauucgugguggaag

SEQ ID NO: 58362 - RNA, 23 nt, Artificial Sequence
  RNA Oligomer
ccaaccauggauucgugguggaa

SEQ ID NO: 58363 - RNA, 23 nt, Artificial Sequence
  RNA Oligomer
ggaguuuaucaccucagcagagc

SEQ ID NO: 58364 - RNA, 23 nt, Artificial Sequence
  RNA Oligomer
aggaguuuaucaccucagcagag

SEQ ID NO: 58365 - RNA, 23 nt, Artificial Sequence
  RNA Oligomer
gaggaguuuaucaccucagcaga

SEQ ID NO: 58366 - RNA, 23 nt, Artificial Sequence
  RNA Oligomer
cagcuuccaccaugaagaaucuu

SEQ ID NO: 58367 - RNA, 23 nt, Artificial Sequence
  RNA Oligomer
gcagcuuccaccaugaagaaucu

SEQ ID NO: 58368 - RNA, 23 nt, Artificial Sequence
  RNA Oligomer
cgcagcuuccaccaugaagaauc

SEQ ID NO: 58369 - RNA, 23 nt, Artificial Sequence
  RNA Oligomer
gcgcagcuuccaccaugaagaau

SEQ ID NO: 58370 - RNA, 23 nt, Artificial Sequence
  RNA Oligomer
ugcgcagcuuccaccaugaagaa

SEQ ID NO: 58371 - RNA, 23 nt, Artificial Sequence
  RNA Oligomer
ucagcauguucggccugaaacag

SEQ ID NO: 58372 - RNA, 23 nt, Artificial Sequence
  RNA Oligomer
cucagcauguucggccugaaaca

SEQ ID NO: 58373 - RNA, 23 nt, Artificial Sequence
  RNA Oligomer
gcucagcauguucggccugaaac

SEQ ID NO: 58374 - RNA, 23 nt, Artificial Sequence
  RNA Oligomer
ugcucagcauguucggccugaaa

SEQ ID NO: 58375 - RNA, 23 nt, Artificial Sequence
  RNA Oligomer
cugcucagcauguucggccugaa

SEQ ID NO: 58376 - RNA, 23 nt, Artificial Sequence
  RNA Oligomer
cagaguuuuuccauguggacgcu

SEQ ID NO: 58377 - RNA, 23 nt, Artificial Sequence
  RNA Oligomer
uccagcuguaagagacacccuuu

SEQ ID NO: 58378 - RNA, 23 nt, Artificial Sequence
  RNA Oligomer
guccagcuguaagagacacccuu

SEQ ID NO: 58379 - RNA, 23 nt, Artificial Sequence
  RNA Oligomer
cgugaccagacuuuuggacacca

SEQ ID NO: 58380 - RNA, 23 nt, Artificial Sequence
  RNA Oligomer
ccgugaccagacuuuuggacacc

SEQ ID NO: 58381 - RNA, 23 nt, Artificial Sequence
  RNA Oligomer
cccgugaccagacuuuuggacac

SEQ ID NO: 58382 - RNA, 23 nt, Artificial Sequence
  RNA Oligomer
guuuuccgagaacagaugcaaga

SEQ ID NO: 58383 - RNA, 23 nt, Artificial Sequence
  RNA Oligomer
gaguuuaucaccucagcagagcu

SEQ ID NO: 58384 - RNA, 23 nt, Artificial Sequence
  RNA Oligomer
cgagugggaaaacaacccggaga

SEQ ID NO: 58385 - RNA, 23 nt, Artificial Sequence
  RNA Oligomer
uugcagggagaauaacuugcgca

SEQ ID NO: 58386 - RNA, 23 nt, Artificial Sequence
  RNA Oligomer
gugcgcagcuuccaccaugaaga

SEQ ID NO: 58387 - RNA, 23 nt, Artificial Sequence
  RNA Oligomer
gcauguucggccugaaacagaga

SEQ ID NO: 58388 - RNA, 23 nt, Artificial Sequence
  RNA Oligomer
agcauguucggccugaaacagag

SEQ ID NO: 58389 - RNA, 23 nt, Artificial Sequence
  RNA Oligomer
cagcauguucggccugaaacaga

SEQ ID NO: 58390 - RNA, 23 nt, Artificial Sequence
  RNA Oligomer
acucagugcuaucucgaugcugu

SEQ ID NO: 58391 - RNA, 23 nt, Artificial Sequence
  RNA Oligomer
aacucagugcuaucucgaugcug

SEQ ID NO: 58392 - RNA, 23 nt, Artificial Sequence
  RNA Oligomer
gaacucagugcuaucucgaugcu

SEQ ID NO: 58393 - RNA, 23 nt, Artificial Sequence
  RNA Oligomer
gaugaacacagcuggucacagau

SEQ ID NO: 58394 - RNA, 23 nt, Artificial Sequence
  RNA Oligomer
agaugaacacagcuggucacaga

SEQ ID NO: 58395 - RNA, 23 nt, Artificial Sequence
  RNA Oligomer
ggucuuugcaccaagaugaacac

SEQ ID NO: 58396 - RNA, 23 nt, Artificial Sequence
  RNA Oligomer
aggucuuugcaccaagaugaaca

SEQ ID NO: 58397 - RNA, 23 nt, Artificial Sequence
  RNA Oligomer
caggucuuugcaccaagaugaac

SEQ ID NO: 58398 - RNA, 23 nt, Artificial Sequence
  RNA Oligomer
aacaaggugucuccaagagacau

SEQ ID NO: 58399 - RNA, 23 nt, Artificial Sequence
  RNA Oligomer
aaacaaggugucuccaagagaca

SEQ ID NO: 58400 - RNA, 23 nt, Artificial Sequence
  RNA Oligomer
gccaaccauggauucguggugga

SEQ ID NO: 58401 - RNA, 23 nt, Artificial Sequence
  RNA Oligomer
cgccaaccauggauucguggugg

SEQ ID NO: 58402 - RNA, 23 nt, Artificial Sequence
  RNA Oligomer
acgccaaccauggauucguggug

SEQ ID NO: 58403 - RNA, 23 nt, Artificial Sequence
  RNA Oligomer
ccccgugaccagacuuuuggaca

SEQ ID NO: 58404 - RNA, 23 nt, Artificial Sequence
  RNA Oligomer
uccccgugaccagacuuuuggac

SEQ ID NO: 58405 - RNA, 23 nt, Artificial Sequence
  RNA Oligomer
uuccccgugaccagacuuuugga

SEQ ID NO: 58406 - RNA, 23 nt, Artificial Sequence
  RNA Oligomer
caauagcaguuuccaucaccgaa

SEQ ID NO: 58407 - RNA, 23 nt, Artificial Sequence
  RNA Oligomer
acaauagcaguuuccaucaccga

SEQ ID NO: 58408 - RNA, 23 nt, Artificial Sequence
  RNA Oligomer
aacaauagcaguuuccaucaccg

SEQ ID NO: 58409 - RNA, 23 nt, Artificial Sequence
  RNA Oligomer
aaacaauagcaguuuccaucacc

SEQ ID NO: 58410 - RNA, 23 nt, Artificial Sequence
  RNA Oligomer
gaaacaauagcaguuuccaucac

SEQ ID NO: 58411 - RNA, 23 nt, Artificial Sequence
  RNA Oligomer
guucagacguuggucaacucugu

SEQ ID NO: 58412 - RNA, 23 nt, Artificial Sequence
  RNA Oligomer
cacggagaaugcccuuuuccucu

SEQ ID NO: 58413 - RNA, 23 nt, Artificial Sequence
  RNA Oligomer
gccuuaaguccagcuguaagaga

SEQ ID NO: 58414 - RNA, 23 nt, Artificial Sequence
  RNA Oligomer
gauaagcaggucuuugcaccaag

SEQ ID NO: 58415 - RNA, 23 nt, Artificial Sequence
  RNA Oligomer
ggauaagcaggucuuugcaccaa

SEQ ID NO: 58416 - RNA, 23 nt, Artificial Sequence
  RNA Oligomer
aggauaagcaggucuuugcacca

SEQ ID NO: 58417 - RNA, 23 nt, Artificial Sequence
  RNA Oligomer
uaggauaagcaggucuuugcacc

SEQ ID NO: 58418 - RNA, 23 nt, Artificial Sequence
  RNA Oligomer
uuaggauaagcaggucuuugcac

SEQ ID NO: 58419 - RNA, 23 nt, Artificial Sequence
  RNA Oligomer
cacgccaaccauggauucguggu

SEQ ID NO: 58420 - RNA, 23 nt, Artificial Sequence
  RNA Oligomer
ggaaaguuuugaugucacccccg

SEQ ID NO: 58421 - RNA, 23 nt, Artificial Sequence
  RNA Oligomer
uuuuggacaccagguuggugaau

SEQ ID NO: 58422 - RNA, 23 nt, Artificial Sequence
  RNA Oligomer
uauccccacggaggaguuuauca

SEQ ID NO: 58423 - RNA, 23 nt, Artificial Sequence
  RNA Oligomer
acacgccaaccauggauucgugg

SEQ ID NO: 58424 - RNA, 23 nt, Artificial Sequence
  RNA Oligomer
gcugucuucuagcguugcugcuu

SEQ ID NO: 58425 - RNA, 23 nt, Artificial Sequence
  RNA Oligomer
cgcugucuucuagcguugcugcu

SEQ ID NO: 58426 - RNA, 23 nt, Artificial Sequence
  RNA Oligomer
ccgcugucuucuagcguugcugc

SEQ ID NO: 58427 - RNA, 23 nt, Artificial Sequence
  RNA Oligomer
cccgcugucuucuagcguugcug

SEQ ID NO: 58428 - RNA, 23 nt, Artificial Sequence
  RNA Oligomer
acccgcugucuucuagcguugcu

SEQ ID NO: 58429 - RNA, 23 nt, Artificial Sequence
  RNA Oligomer
uuuuuccauguggacgcucuuuc

SEQ ID NO: 58430 - RNA, 23 nt, Artificial Sequence
  RNA Oligomer
guaagagacacccuuuguacgug

SEQ ID NO: 58431 - RNA, 23 nt, Artificial Sequence
  RNA Oligomer
uguaagagacacccuuuguacgu

SEQ ID NO: 58432 - RNA, 23 nt, Artificial Sequence
  RNA Oligomer
uuugcaccaagaugaacacagcu

SEQ ID NO: 58433 - RNA, 23 nt, Artificial Sequence
  RNA Oligomer
cuuugcaccaagaugaacacagc

SEQ ID NO: 58434 - RNA, 23 nt, Artificial Sequence
  RNA Oligomer
augcaagaugcuuuaggaaacaa

SEQ ID NO: 58435 - RNA, 23 nt, Artificial Sequence
  RNA Oligomer
gaugcaagaugcuuuaggaaaca

SEQ ID NO: 58436 - RNA, 23 nt, Artificial Sequence
  RNA Oligomer
agaugcaagaugcuuuaggaaac

SEQ ID NO: 58437 - RNA, 23 nt, Artificial Sequence
  RNA Oligomer
aaaacaacccggagauucuucuu

SEQ ID NO: 58438 - RNA, 23 nt, Artificial Sequence
  RNA Oligomer
ugauggaaaagggcauccucucc

SEQ ID NO: 58439 - RNA, 23 nt, Artificial Sequence
  RNA Oligomer
augauggaaaagggcauccucuc

SEQ ID NO: 58440 - RNA, 23 nt, Artificial Sequence
  RNA Oligomer
caugauggaaaagggcauccucu

SEQ ID NO: 58441 - RNA, 23 nt, Artificial Sequence
  RNA Oligomer
gucuccuaaaggucgaccauggu

SEQ ID NO: 58442 - RNA, 23 nt, Artificial Sequence
  RNA Oligomer
ggucuccuaaaggucgaccaugg

SEQ ID NO: 58443 - RNA, 23 nt, Artificial Sequence
  RNA Oligomer
cggucuccuaaaggucgaccaug

SEQ ID NO: 58444 - RNA, 23 nt, Artificial Sequence
  RNA Oligomer
gcggucuccuaaaggucgaccau

SEQ ID NO: 58445 - RNA, 23 nt, Artificial Sequence
  RNA Oligomer
ugcggucuccuaaaggucgacca

SEQ ID NO: 58446 - RNA, 23 nt, Artificial Sequence
  RNA Oligomer
ccaagaugaacacagcuggucac

SEQ ID NO: 58447 - RNA, 23 nt, Artificial Sequence
  RNA Oligomer
ggaaaagggcauccucuccacaa

SEQ ID NO: 58448 - RNA, 23 nt, Artificial Sequence
  RNA Oligomer
uggaaaagggcauccucuccaca

SEQ ID NO: 58449 - RNA, 23 nt, Artificial Sequence
  RNA Oligomer
auggaaaagggcauccucuccac

SEQ ID NO: 58450 - RNA, 23 nt, Artificial Sequence
  RNA Oligomer
gauggaaaagggcauccucucca

SEQ ID NO: 58451 - RNA, 23 nt, Artificial Sequence
  RNA Oligomer
ucuuugcaccaagaugaacacag

SEQ ID NO: 58452 - RNA, 23 nt, Artificial Sequence
  RNA Oligomer
gucuuugcaccaagaugaacaca

SEQ ID NO: 58453 - RNA, 23 nt, Artificial Sequence
  RNA Oligomer
cagaugcaagaugcuuuaggaaa

SEQ ID NO: 58454 - RNA, 23 nt, Artificial Sequence
  RNA Oligomer
cuucuugaacuugcagggagaau

SEQ ID NO: 58455 - RNA, 23 nt, Artificial Sequence
  RNA Oligomer
acuucuugaacuugcagggagaa

SEQ ID NO: 58456 - RNA, 23 nt, Artificial Sequence
  RNA Oligomer
agaaugcaagcaggugggaaagu

SEQ ID NO: 58457 - RNA, 23 nt, Artificial Sequence
  RNA Oligomer
ucagaaugcaagcaggugggaaa

SEQ ID NO: 58458 - RNA, 23 nt, Artificial Sequence
  RNA Oligomer
ucaggacaugguuguggaggguu

SEQ ID NO: 58459 - RNA, 23 nt, Artificial Sequence
  RNA Oligomer
agguuguauuaaagaacuaucag

SEQ ID NO: 58460 - RNA, 23 nt, Artificial Sequence
  RNA Oligomer
aaaccugcaacagccaacucgaa

SEQ ID NO: 58461 - RNA, 23 nt, Artificial Sequence
  RNA Oligomer
ucagugcuaucucgaugcuguac

SEQ ID NO: 58462 - RNA, 23 nt, Artificial Sequence
  RNA Oligomer
gccuuuuacugccacggagaaug

SEQ ID NO: 58463 - RNA, 23 nt, Artificial Sequence
  RNA Oligomer
guuuuuccauguggacgcucuuu

SEQ ID NO: 58464 - RNA, 23 nt, Artificial Sequence
  RNA Oligomer
cagaugcaagaugcuuuaggaaa

SEQ ID NO: 58465 - RNA, 23 nt, Artificial Sequence
  RNA Oligomer
uaagcaggucuuugcaccaagau

SEQ ID NO: 58466 - RNA, 23 nt, Artificial Sequence
  RNA Oligomer
gguuuuccgagaacagaugcaag

SEQ ID NO: 58467 - RNA, 23 nt, Artificial Sequence
  RNA Oligomer
gaaaaacgucaagccaaacacaa

SEQ ID NO: 58468 - RNA, 23 nt, Artificial Sequence
  RNA Oligomer
gaggagaaacaaggugucuccaa

SEQ ID NO: 58469 - RNA, 23 nt, Artificial Sequence
  RNA Oligomer
ggauaagcaggucuuugcaccaa

SEQ ID NO: 58470 - RNA, 23 nt, Artificial Sequence
  RNA Oligomer
ccagcuguaagagacacccuuug

SEQ ID NO: 58471 - RNA, 23 nt, Artificial Sequence
  RNA Oligomer
gccagguccuuugaccagaguuu

SEQ ID NO: 58472 - RNA, 23 nt, Artificial Sequence
  RNA Oligomer
ccaaccauggauucgugguggaa

SEQ ID NO: 58473 - RNA, 23 nt, Artificial Sequence
  RNA Oligomer
aguuuaucaccucagcagagcuu

SEQ ID NO: 58474 - RNA, 23 nt, Artificial Sequence
  RNA Oligomer
gccauuguucagacguuggucaa

SEQ ID NO: 58475 - RNA, 23 nt, Artificial Sequence
  RNA Oligomer
acgccuuuuacugccacggagaa

SEQ ID NO: 58476 - RNA, 23 nt, Artificial Sequence
  RNA Oligomer
acacaaacagcggaaacgccuua

SEQ ID NO: 58477 - RNA, 23 nt, Artificial Sequence
  RNA Oligomer
cggaggaguuuaucaccucagca

SEQ ID NO: 58478 - RNA, 23 nt, Artificial Sequence
  RNA Oligomer
aucuuuggaagaacuaccagaaa

SEQ ID NO: 58479 - RNA, 23 nt, Artificial Sequence
  RNA Oligomer
gcgcagcuuccaccaugaagaau

SEQ ID NO: 58480 - RNA, 23 nt, Artificial Sequence
  RNA Oligomer
aggugucuccaagagacauguua

SEQ ID NO: 58481 - RNA, 23 nt, Artificial Sequence
  RNA Oligomer
caauagcaguuuccaucaccgaa

SEQ ID NO: 58482 - RNA, 23 nt, Artificial Sequence
  RNA Oligomer
cagguuuuccgagaacagaugca

SEQ ID NO: 58483 - RNA, 23 nt, Artificial Sequence
  RNA Oligomer
ugcucagcauguucggccugaaa

SEQ ID NO: 58484 - RNA, 23 nt, Artificial Sequence
  RNA Oligomer
ccagguccuuugaccagaguuuu

SEQ ID NO: 58485 - RNA, 23 nt, Artificial Sequence
  RNA Oligomer
gcagagcuucagguuuuccgaga

SEQ ID NO: 58486 - RNA, 23 nt, Artificial Sequence
  RNA Oligomer
ggaggaguuuaucaccucagcag

SEQ ID NO: 58487 - RNA, 23 nt, Artificial Sequence
  RNA Oligomer
gaaucuuuggaagaacuaccaga

SEQ ID NO: 58488 - RNA, 23 nt, Artificial Sequence
  RNA Oligomer
gcauguucggccugaaacagaga

SEQ ID NO: 58489 - RNA, 23 nt, Artificial Sequence
  RNA Oligomer
gaaacgccuuaaguccagcugua

SEQ ID NO: 58490 - RNA, 23 nt, Artificial Sequence
  RNA Oligomer
cacaaacagcggaaacgccuuaa

SEQ ID NO: 58491 - RNA, 23 nt, Artificial Sequence
  RNA Oligomer
ggaaaagggcauccucuccacaa

SEQ ID NO: 58492 - RNA, 23 nt, Artificial Sequence
  RNA Oligomer
ggagaaacaaggugucuccaaga

SEQ ID NO: 58493 - RNA, 23 nt, Artificial Sequence
  RNA Oligomer
caaccauggauucgugguggaag

SEQ ID NO: 58494 - RNA, 23 nt, Artificial Sequence
  RNA Oligomer
cacggaggaguuuaucaccucag

SEQ ID NO: 58495 - RNA, 23 nt, Artificial Sequence
  RNA Oligomer
agacgcuguucccagcgugaaaa

SEQ ID NO: 58496 - RNA, 23 nt, Artificial Sequence
  RNA Oligomer
cagcuuccaccaugaagaaucuu

SEQ ID NO: 58497 - RNA, 23 nt, Artificial Sequence
  RNA Oligomer
cucagugcuaucucgaugcugua

SEQ ID NO: 58498 - RNA, 23 nt, Artificial Sequence
  RNA Oligomer
guccagcuguaagagacacccuu

SEQ ID NO: 58499 - RNA, 23 nt, Artificial Sequence
  RNA Oligomer
ccauugcuaguaacuuuuggcca

SEQ ID NO: 58500 - RNA, 23 nt, Artificial Sequence
  RNA Oligomer
gcaggucuuugcaccaagaugaa

SEQ ID NO: 58501 - RNA, 23 nt, Artificial Sequence
  RNA Oligomer
aaggugucuccaagagacauguu

SEQ ID NO: 58502 - RNA, 23 nt, Artificial Sequence
  RNA Oligomer
gagaaacaaggugucuccaagag

SEQ ID NO: 58503 - RNA, 23 nt, Artificial Sequence
  RNA Oligomer
caguuuccaucaccgaauuaaua

SEQ ID NO: 58504 - RNA, 23 nt, Artificial Sequence
  RNA Oligomer
ccauuguucagacguuggucaac

SEQ ID NO: 58505 - RNA, 23 nt, Artificial Sequence
  RNA Oligomer
agagacacccuuuguacguggac

SEQ ID NO: 58506 - RNA, 23 nt, Artificial Sequence
  RNA Oligomer
aucauaaaaccugcaacagccaa

SEQ ID NO: 58507 - RNA, 23 nt, Artificial Sequence
  RNA Oligomer
gaaacaauagcaguuuccaucac

SEQ ID NO: 58508 - RNA, 23 nt, Artificial Sequence
  RNA Oligomer
ggaaacaauagcaguuuccauca

SEQ ID NO: 58509 - RNA, 23 nt, Artificial Sequence
  RNA Oligomer
cuacaugcuagaccuguaucgca

SEQ ID NO: 58510 - RNA, 23 nt, Artificial Sequence
  RNA Oligomer
gaacucagugcuaucucgaugcu

SEQ ID NO: 58511 - RNA, 23 nt, Artificial Sequence
  RNA Oligomer
cguuggucaacucuguuaacucu

SEQ ID NO: 58512 - RNA, 23 nt, Artificial Sequence
  RNA Oligomer
cgccuuuuacugccacggagaau

SEQ ID NO: 58513 - RNA, 23 nt, Artificial Sequence
  RNA Oligomer
agacacccuuuguacguggacuu

SEQ ID NO: 58514 - RNA, 23 nt, Artificial Sequence
  RNA Oligomer
gaaacaaggugucuccaagagac

SEQ ID NO: 58515 - RNA, 23 nt, Artificial Sequence
  RNA Oligomer
aggaguuuaucaccucagcagag

SEQ ID NO: 58516 - RNA, 23 nt, Artificial Sequence
  RNA Oligomer
ggaaaacaacccggagauucuuc

SEQ ID NO: 58517 - RNA, 23 nt, Artificial Sequence
  RNA Oligomer
gcagcuuccaccaugaagaaucu

SEQ ID NO: 58518 - RNA, 23 nt, Artificial Sequence
  RNA Oligomer
cagcuggucacagauaaggccau

SEQ ID NO: 58519 - RNA, 23 nt, Artificial Sequence
  RNA Oligomer
cgugaccagacuuuuggacacca

SEQ ID NO: 58520 - RNA, 23 nt, Artificial Sequence
  RNA Oligomer
acaauagcaguuuccaucaccga

SEQ ID NO: 58521 - RNA, 23 nt, Artificial Sequence
  RNA Oligomer
caccucagcagagcuucagguuu

SEQ ID NO: 58522 - RNA, 23 nt, Artificial Sequence
  RNA Oligomer
gaguuuuuccauguggacgcucu

SEQ ID NO: 58523 - RNA, 23 nt, Artificial Sequence
  RNA Oligomer
agaguuuuuccauguggacgcuc

SEQ ID NO: 58524 - RNA, 23 nt, Artificial Sequence
  RNA Oligomer
ugccauuguucagacguugguca

SEQ ID NO: 58525 - RNA, 23 nt, Artificial Sequence
  RNA Oligomer
gccuuaaguccagcuguaagaga

SEQ ID NO: 58526 - RNA, 23 nt, Artificial Sequence
  RNA Oligomer
ccaagaugaacacagcuggucac

SEQ ID NO: 58527 - RNA, 23 nt, Artificial Sequence
  RNA Oligomer
caggucuuugcaccaagaugaac

SEQ ID NO: 58528 - RNA, 23 nt, Artificial Sequence
  RNA Oligomer
gacauguuaggauaagcaggucu

SEQ ID NO: 58529 - RNA, 23 nt, Artificial Sequence
  RNA Oligomer
acgcuguucccagcgugaaaaga

SEQ ID NO: 58530 - RNA, 23 nt, Artificial Sequence
  RNA Oligomer
ggacaccagguuggugaaucaga

SEQ ID NO: 58531 - RNA, 23 nt, Artificial Sequence
  RNA Oligomer
augcaagaugcuuuaggaaacaa

SEQ ID NO: 58532 - RNA, 23 nt, Artificial Sequence
  RNA Oligomer
ucaccucagcagagcuucagguu

SEQ ID NO: 58533 - RNA, 23 nt, Artificial Sequence
  RNA Oligomer
gaaaagggcauccucuccacaaa

SEQ ID NO: 58534 - RNA, 23 nt, Artificial Sequence
  RNA Oligomer
uggaaaagggcauccucuccaca

SEQ ID NO: 58535 - RNA, 23 nt, Artificial Sequence
  RNA Oligomer
accucagcagagcuucagguuuu

SEQ ID NO: 58536 - RNA, 23 nt, Artificial Sequence
  RNA Oligomer
gcugucuucuagcguugcugcuu

SEQ ID NO: 58537 - RNA, 23 nt, Artificial Sequence
  RNA Oligomer
cgcagcuuccaccaugaagaauc

SEQ ID NO: 58538 - RNA, 23 nt, Artificial Sequence
  RNA Oligomer
cgccuuaaguccagcuguaagag

SEQ ID NO: 58539 - RNA, 23 nt, Artificial Sequence
  RNA Oligomer
uggacaccagguuggugaaucag

SEQ ID NO: 58540 - RNA, 23 nt, Artificial Sequence
  RNA Oligomer
agcuguaagagacacccuuugua

SEQ ID NO: 58541 - RNA, 23 nt, Artificial Sequence
  RNA Oligomer
gucuuugcaccaagaugaacaca

SEQ ID NO: 58542 - RNA, 23 nt, Artificial Sequence
  RNA Oligomer
ugcgcagcuuccaccaugaagaa

SEQ ID NO: 58543 - RNA, 23 nt, Artificial Sequence
  RNA Oligomer
gaaugcccuuuuccucuggcuga

SEQ ID NO: 58544 - RNA, 23 nt, Artificial Sequence
  RNA Oligomer
cuugacguuuuucucuuuugugg

SEQ ID NO: 58545 - RNA, 23 nt, Artificial Sequence
  RNA Oligomer
uugacguuuuucucuuuugugga

SEQ ID NO: 58546 - RNA, 23 nt, Artificial Sequence
  RNA Oligomer
ugacguuuuucucuuuuguggag

SEQ ID NO: 58547 - RNA, 23 nt, Artificial Sequence
  RNA Oligomer
gacguuuuucucuuuuguggaga

SEQ ID NO: 58548 - RNA, 23 nt, Artificial Sequence
  RNA Oligomer
acguuuuucucuuuuguggagag

SEQ ID NO: 58549 - RNA, 23 nt, Artificial Sequence
  RNA Oligomer
cgagauagcacugaguucugucg

SEQ ID NO: 58550 - RNA, 23 nt, Artificial Sequence
  RNA Oligomer
gagauagcacugaguucugucgg

SEQ ID NO: 58551 - RNA, 23 nt, Artificial Sequence
  RNA Oligomer
agauagcacugaguucugucggg

SEQ ID NO: 58552 - RNA, 23 nt, Artificial Sequence
  RNA Oligomer
gauagcacugaguucugucggga

SEQ ID NO: 58553 - RNA, 23 nt, Artificial Sequence
  RNA Oligomer
auagcacugaguucugucgggac

SEQ ID NO: 58554 - RNA, 23 nt, Artificial Sequence
  RNA Oligomer
auacaaccuuuucauucucguca

SEQ ID NO: 58555 - RNA, 23 nt, Artificial Sequence
  RNA Oligomer
uacaaccuuuucauucucgucaa

SEQ ID NO: 58556 - RNA, 23 nt, Artificial Sequence
  RNA Oligomer
acaaccuuuucauucucgucaag

SEQ ID NO: 58557 - RNA, 23 nt, Artificial Sequence
  RNA Oligomer
caaccuuuucauucucgucaagg

SEQ ID NO: 58558 - RNA, 23 nt, Artificial Sequence
  RNA Oligomer
aaccuuuucauucucgucaaggu

SEQ ID NO: 58559 - RNA, 23 nt, Artificial Sequence
  RNA Oligomer
uuucauucucgucaagguacagc

SEQ ID NO: 58560 - RNA, 23 nt, Artificial Sequence
  RNA Oligomer
uucauucucgucaagguacagca

SEQ ID NO: 58561 - RNA, 23 nt, Artificial Sequence
  RNA Oligomer
ucauucucgucaagguacagcau

SEQ ID NO: 58562 - RNA, 23 nt, Artificial Sequence
  RNA Oligomer
cauucucgucaagguacagcauc

SEQ ID NO: 58563 - RNA, 23 nt, Artificial Sequence
  RNA Oligomer
auucucgucaagguacagcaucg

SEQ ID NO: 58564 - RNA, 23 nt, Artificial Sequence
  RNA Oligomer
cuuaaauuaaagaagaaucuccg

SEQ ID NO: 58565 - RNA, 23 nt, Artificial Sequence
  RNA Oligomer
uuaaauuaaagaagaaucuccgg

SEQ ID NO: 58566 - RNA, 23 nt, Artificial Sequence
  RNA Oligomer
uaaauuaaagaagaaucuccggg

SEQ ID NO: 58567 - RNA, 23 nt, Artificial Sequence
  RNA Oligomer
aaauuaaagaagaaucuccgggu

SEQ ID NO: 58568 - RNA, 23 nt, Artificial Sequence
  RNA Oligomer
aauuaaagaagaaucuccggguu

SEQ ID NO: 58569 - RNA, 23 nt, Artificial Sequence
  RNA Oligomer
uguguuuggcuugacguuuuucu

SEQ ID NO: 58570 - RNA, 23 nt, Artificial Sequence
  RNA Oligomer
guguuuggcuugacguuuuucuc

SEQ ID NO: 58571 - RNA, 23 nt, Artificial Sequence
  RNA Oligomer
uguuuggcuugacguuuuucucu

SEQ ID NO: 58572 - RNA, 23 nt, Artificial Sequence
  RNA Oligomer
guuuggcuugacguuuuucucuu

SEQ ID NO: 58573 - RNA, 23 nt, Artificial Sequence
  RNA Oligomer
uuuggcuugacguuuuucucuuu

SEQ ID NO: 58574 - RNA, 23 nt, Artificial Sequence
  RNA Oligomer
gcuuauccuaacaugucucuugg

SEQ ID NO: 58575 - RNA, 23 nt, Artificial Sequence
  RNA Oligomer
cuuauccuaacaugucucuugga

SEQ ID NO: 58576 - RNA, 23 nt, Artificial Sequence
  RNA Oligomer
uuauccuaacaugucucuuggag

SEQ ID NO: 58577 - RNA, 23 nt, Artificial Sequence
  RNA Oligomer
uauccuaacaugucucuuggaga

SEQ ID NO: 58578 - RNA, 23 nt, Artificial Sequence
  RNA Oligomer
auccuaacaugucucuuggagac

SEQ ID NO: 58579 - RNA, 23 nt, Artificial Sequence
  RNA Oligomer
gggaauuucgaguuggcuguugc

SEQ ID NO: 58580 - RNA, 23 nt, Artificial Sequence
  RNA Oligomer
ggaauuucgaguuggcuguugca

SEQ ID NO: 58581 - RNA, 23 nt, Artificial Sequence
  RNA Oligomer
gaauuucgaguuggcuguugcag

SEQ ID NO: 58582 - RNA, 23 nt, Artificial Sequence
  RNA Oligomer
aauuucgaguuggcuguugcagg

SEQ ID NO: 58583 - RNA, 23 nt, Artificial Sequence
  RNA Oligomer
auuucgaguuggcuguugcaggu

SEQ ID NO: 58584 - RNA, 23 nt, Artificial Sequence
  RNA Oligomer
auuaaagaagaaucuccggguug

SEQ ID NO: 58585 - RNA, 23 nt, Artificial Sequence
  RNA Oligomer
uuaaagaagaaucuccggguugu

SEQ ID NO: 58586 - RNA, 23 nt, Artificial Sequence
  RNA Oligomer
cggguuguuuucccacucguuuc

SEQ ID NO: 58587 - RNA, 23 nt, Artificial Sequence
  RNA Oligomer
ggguuguuuucccacucguuucu

SEQ ID NO: 58588 - RNA, 23 nt, Artificial Sequence
  RNA Oligomer
gguuguuuucccacucguuucug

SEQ ID NO: 58589 - RNA, 23 nt, Artificial Sequence
  RNA Oligomer
guuguuuucccacucguuucugg

SEQ ID NO: 58590 - RNA, 23 nt, Artificial Sequence
  RNA Oligomer
uuguuuucccacucguuucuggu

SEQ ID NO: 58591 - RNA, 23 nt, Artificial Sequence
  RNA Oligomer
uguuuucccacucguuucuggua

SEQ ID NO: 58592 - RNA, 23 nt, Artificial Sequence
  RNA Oligomer
cacucguuucugguaguucuucc

SEQ ID NO: 58593 - RNA, 23 nt, Artificial Sequence
  RNA Oligomer
acucguuucugguaguucuucca

SEQ ID NO: 58594 - RNA, 23 nt, Artificial Sequence
  RNA Oligomer
cucguuucugguaguucuuccaa

SEQ ID NO: 58595 - RNA, 23 nt, Artificial Sequence
  RNA Oligomer
ucguuucugguaguucuuccaaa

SEQ ID NO: 58596 - RNA, 23 nt, Artificial Sequence
  RNA Oligomer
cguuucugguaguucuuccaaag

SEQ ID NO: 58597 - RNA, 23 nt, Artificial Sequence
  RNA Oligomer
accuuuucauucucgucaaggua

SEQ ID NO: 58598 - RNA, 23 nt, Artificial Sequence
  RNA Oligomer
ccuuuucauucucgucaagguac

SEQ ID NO: 58599 - RNA, 23 nt, Artificial Sequence
  RNA Oligomer
cuuuucauucucgucaagguaca

SEQ ID NO: 58600 - RNA, 23 nt, Artificial Sequence
  RNA Oligomer
uuuucauucucgucaagguacag

SEQ ID NO: 58601 - RNA, 23 nt, Artificial Sequence
  RNA Oligomer
uucucgucaagguacagcaucga

SEQ ID NO: 58602 - RNA, 23 nt, Artificial Sequence
  RNA Oligomer
ucaaaacuuucccaccugcuugc

SEQ ID NO: 58603 - RNA, 23 nt, Artificial Sequence
  RNA Oligomer
caaaacuuucccaccugcuugca

SEQ ID NO: 58604 - RNA, 23 nt, Artificial Sequence
  RNA Oligomer
aaaacuuucccaccugcuugcau

SEQ ID NO: 58605 - RNA, 23 nt, Artificial Sequence
  RNA Oligomer
aaacuuucccaccugcuugcauu

SEQ ID NO: 58606 - RNA, 23 nt, Artificial Sequence
  RNA Oligomer
aacuuucccaccugcuugcauuc

SEQ ID NO: 58607 - RNA, 23 nt, Artificial Sequence
  RNA Oligomer
ugcauucugauucaccaaccugg

SEQ ID NO: 58608 - RNA, 23 nt, Artificial Sequence
  RNA Oligomer
gcauucugauucaccaaccuggu

SEQ ID NO: 58609 - RNA, 23 nt, Artificial Sequence
  RNA Oligomer
cauucugauucaccaaccuggug

SEQ ID NO: 58610 - RNA, 23 nt, Artificial Sequence
  RNA Oligomer
auucugauucaccaaccuggugu

SEQ ID NO: 58611 - RNA, 23 nt, Artificial Sequence
  RNA Oligomer
uucugauucaccaaccugguguc

SEQ ID NO: 58612 - RNA, 23 nt, Artificial Sequence
  RNA Oligomer
cauaaauauuaauucggugaugg

SEQ ID NO: 58613 - RNA, 23 nt, Artificial Sequence
  RNA Oligomer
auaaauauuaauucggugaugga

SEQ ID NO: 58614 - RNA, 23 nt, Artificial Sequence
  RNA Oligomer
uaaauauuaauucggugauggaa

SEQ ID NO: 58615 - RNA, 23 nt, Artificial Sequence
  RNA Oligomer
aaauauuaauucggugauggaaa

SEQ ID NO: 58616 - RNA, 23 nt, Artificial Sequence
  RNA Oligomer
aauauuaauucggugauggaaac

SEQ ID NO: 58617 - RNA, 23 nt, Artificial Sequence
  RNA Oligomer
aaagcaucuugcaucuguucucg

SEQ ID NO: 58618 - RNA, 23 nt, Artificial Sequence
  RNA Oligomer
aagcaucuugcaucuguucucgg

SEQ ID NO: 58619 - RNA, 23 nt, Artificial Sequence
  RNA Oligomer
agcaucuugcaucuguucucgga

SEQ ID NO: 58620 - RNA, 23 nt, Artificial Sequence
  RNA Oligomer
gcaucuugcaucuguucucggaa

SEQ ID NO: 58621 - RNA, 23 nt, Artificial Sequence
  RNA Oligomer
caucuugcaucuguucucggaaa

SEQ ID NO: 58622 - RNA, 23 nt, Artificial Sequence
  RNA Oligomer
aaucuuagaguuaacagaguuga

SEQ ID NO: 58623 - RNA, 23 nt, Artificial Sequence
  RNA Oligomer
aucuuagaguuaacagaguugac

SEQ ID NO: 58624 - RNA, 23 nt, Artificial Sequence
  RNA Oligomer
ucuuagaguuaacagaguugacc

SEQ ID NO: 58625 - RNA, 23 nt, Artificial Sequence
  RNA Oligomer
cuuagaguuaacagaguugacca

SEQ ID NO: 58626 - RNA, 23 nt, Artificial Sequence
  RNA Oligomer
uuagaguuaacagaguugaccaa

SEQ ID NO: 58627 - RNA, 23 nt, Artificial Sequence
  RNA Oligomer
ucugaacaauggcaugauuagug

SEQ ID NO: 58628 - RNA, 23 nt, Artificial Sequence
  RNA Oligomer
cugaacaauggcaugauuagugg

SEQ ID NO: 58629 - RNA, 23 nt, Artificial Sequence
  RNA Oligomer
ugaacaauggcaugauuagugga

SEQ ID NO: 58630 - RNA, 23 nt, Artificial Sequence
  RNA Oligomer
gaacaauggcaugauuaguggag

SEQ ID NO: 58631 - RNA, 23 nt, Artificial Sequence
  RNA Oligomer
aacaauggcaugauuaguggagu

SEQ ID NO: 58632 - RNA, 23 nt, Artificial Sequence
  RNA Oligomer
gaauguccguuccuuuucuuugc

SEQ ID NO: 58633 - RNA, 23 nt, Artificial Sequence
  RNA Oligomer
aauguccguuccuuuucuuugcc

SEQ ID NO: 58634 - RNA, 23 nt, Artificial Sequence
  RNA Oligomer
auguccguuccuuuucuuugccu

SEQ ID NO: 58635 - RNA, 23 nt, Artificial Sequence
  RNA Oligomer
uguccguuccuuuucuuugccuc

SEQ ID NO: 58636 - RNA, 23 nt, Artificial Sequence
  RNA Oligomer
guccguuccuuuucuuugccucc

SEQ ID NO: 58637 - RNA, 23 nt, Artificial Sequence
  RNA Oligomer
caucauggccaaaaguuacuagc

SEQ ID NO: 58638 - RNA, 23 nt, Artificial Sequence
  RNA Oligomer
aucauggccaaaaguuacuagca

SEQ ID NO: 58639 - RNA, 23 nt, Artificial Sequence
  RNA Oligomer
ucauggccaaaaguuacuagcaa

SEQ ID NO: 58640 - RNA, 23 nt, Artificial Sequence
  RNA Oligomer
cauggccaaaaguuacuagcaau

SEQ ID NO: 58641 - RNA, 23 nt, Artificial Sequence
  RNA Oligomer
auggccaaaaguuacuagcaaug

SEQ ID NO: 58642 - RNA, 23 nt, Artificial Sequence
  RNA Oligomer
uagcaauggccuuaucugugacc

SEQ ID NO: 58643 - RNA, 23 nt, Artificial Sequence
  RNA Oligomer
agcaauggccuuaucugugacca

SEQ ID NO: 58644 - RNA, 23 nt, Artificial Sequence
  RNA Oligomer
gcaauggccuuaucugugaccag

SEQ ID NO: 58645 - RNA, 23 nt, Artificial Sequence
  RNA Oligomer
caauggccuuaucugugaccagc

SEQ ID NO: 58646 - RNA, 23 nt, Artificial Sequence
  RNA Oligomer
aauggccuuaucugugaccagcu

SEQ ID NO: 58647 - RNA, 23 nt, Artificial Sequence
  RNA Oligomer
ugcuuauccuaacaugucucuug

SEQ ID NO: 58648 - RNA, 23 nt, Artificial Sequence
  RNA Oligomer
ggggaauuucgaguuggcuguug

SEQ ID NO: 58649 - RNA, 23 nt, Artificial Sequence
  RNA Oligomer
ucccacucguuucugguaguucu

SEQ ID NO: 58650 - RNA, 23 nt, Artificial Sequence
  RNA Oligomer
cccacucguuucugguaguucuu

SEQ ID NO: 58651 - RNA, 23 nt, Artificial Sequence
  RNA Oligomer
ccacucguuucugguaguucuuc

SEQ ID NO: 58652 - RNA, 23 nt, Artificial Sequence
  RNA Oligomer
ucucuuuuguggagaggaugccc

SEQ ID NO: 58653 - RNA, 23 nt, Artificial Sequence
  RNA Oligomer
cucuuuuguggagaggaugcccu

SEQ ID NO: 58654 - RNA, 23 nt, Artificial Sequence
  RNA Oligomer
ucuuuuguggagaggaugcccuu

SEQ ID NO: 58655 - RNA, 23 nt, Artificial Sequence
  RNA Oligomer
cuuuuguggagaggaugcccuuu

SEQ ID NO: 58656 - RNA, 23 nt, Artificial Sequence
  RNA Oligomer
uuuuguggagaggaugcccuuuu

SEQ ID NO: 58657 - RNA, 23 nt, Artificial Sequence
  RNA Oligomer
uccguuccuuuucuuugccuccu

SEQ ID NO: 58658 - RNA, 23 nt, Artificial Sequence
  RNA Oligomer
cgcagucucucuuuucacgcugg

SEQ ID NO: 58659 - RNA, 23 nt, Artificial Sequence
  RNA Oligomer
gcagucucucuuuucacgcuggg

SEQ ID NO: 58660 - RNA, 23 nt, Artificial Sequence
  RNA Oligomer
cagucucucuuuucacgcuggga

SEQ ID NO: 58661 - RNA, 23 nt, Artificial Sequence
  RNA Oligomer
agucucucuuuucacgcugggaa

SEQ ID NO: 58662 - RNA, 23 nt, Artificial Sequence
  RNA Oligomer
gucucucuuuucacgcugggaac

SEQ ID NO: 58663 - RNA, 23 nt, Artificial Sequence
  RNA Oligomer
ucucucuuuucacgcugggaaca

SEQ ID NO: 58664 - RNA, 23 nt, Artificial Sequence
  RNA Oligomer
ucccugcaaguucaagaaguccc

SEQ ID NO: 58665 - RNA, 23 nt, Artificial Sequence
  RNA Oligomer
cccugcaaguucaagaagucccc

SEQ ID NO: 58666 - RNA, 23 nt, Artificial Sequence
  RNA Oligomer
ucucgucaagguacagcaucgag

SEQ ID NO: 58667 - RNA, 23 nt, Artificial Sequence
  RNA Oligomer
cucgucaagguacagcaucgaga

SEQ ID NO: 58668 - RNA, 23 nt, Artificial Sequence
  RNA Oligomer
ucgucaagguacagcaucgagau

SEQ ID NO: 58669 - RNA, 23 nt, Artificial Sequence
  RNA Oligomer
uuggcuugacguuuuucucuuuu

SEQ ID NO: 58670 - RNA, 23 nt, Artificial Sequence
  RNA Oligomer
ccguuccuuuucuuugccuccuc

SEQ ID NO: 58671 - RNA, 23 nt, Artificial Sequence
  RNA Oligomer
cguuccuuuucuuugccuccucc

SEQ ID NO: 58672 - RNA, 23 nt, Artificial Sequence
  RNA Oligomer
guuccuuuucuuugccuccuccu

SEQ ID NO: 58673 - RNA, 23 nt, Artificial Sequence
  RNA Oligomer
uuccuuuucuuugccuccuccuu

SEQ ID NO: 58674 - RNA, 23 nt, Artificial Sequence
  RNA Oligomer
ccuuuucuuugccuccuccuucu

SEQ ID NO: 58675 - RNA, 23 nt, Artificial Sequence
  RNA Oligomer
cuuuucuuugccuccuccuucuc

SEQ ID NO: 58676 - RNA, 23 nt, Artificial Sequence
  RNA Oligomer
uuuucuuugccuccuccuucucc

SEQ ID NO: 58677 - RNA, 23 nt, Artificial Sequence
  RNA Oligomer
uuucuuugccuccuccuucuccc

SEQ ID NO: 58678 - RNA, 23 nt, Artificial Sequence
  RNA Oligomer
uucuuugccuccuccuucucccg

SEQ ID NO: 58679 - RNA, 23 nt, Artificial Sequence
  RNA Oligomer
uggagacaccuuguuucuccucc

SEQ ID NO: 58680 - RNA, 23 nt, Artificial Sequence
  RNA Oligomer
ggagacaccuuguuucuccucca

SEQ ID NO: 58681 - RNA, 23 nt, Artificial Sequence
  RNA Oligomer
gagacaccuuguuucuccuccaa

SEQ ID NO: 58682 - RNA, 23 nt, Artificial Sequence
  RNA Oligomer
agacaccuuguuucuccuccaag

SEQ ID NO: 58683 - RNA, 23 nt, Artificial Sequence
  RNA Oligomer
gacaccuuguuucuccuccaagu

SEQ ID NO: 58684 - RNA, 23 nt, Artificial Sequence
  RNA Oligomer
gcuguugcagguuuuaugauuuc

SEQ ID NO: 58685 - RNA, 23 nt, Artificial Sequence
  RNA Oligomer
cuguugcagguuuuaugauuuca

SEQ ID NO: 58686 - RNA, 23 nt, Artificial Sequence
  RNA Oligomer
uguugcagguuuuaugauuucau

SEQ ID NO: 58687 - RNA, 23 nt, Artificial Sequence
  RNA Oligomer
guugcagguuuuaugauuucaua

SEQ ID NO: 58688 - RNA, 23 nt, Artificial Sequence
  RNA Oligomer
uugcagguuuuaugauuucauaa

SEQ ID NO: 58689 - RNA, 23 nt, Artificial Sequence
  RNA Oligomer
aucuugcaucuguucucggaaaa

SEQ ID NO: 58690 - RNA, 23 nt, Artificial Sequence
  RNA Oligomer
guaguucuuccaaagauucuuca

SEQ ID NO: 58691 - RNA, 23 nt, Artificial Sequence
  RNA Oligomer
uaguucuuccaaagauucuucau

SEQ ID NO: 58692 - RNA, 23 nt, Artificial Sequence
  RNA Oligomer
aguucuuccaaagauucuucaug

SEQ ID NO: 58693 - RNA, 23 nt, Artificial Sequence
  RNA Oligomer
guucuuccaaagauucuucaugg

SEQ ID NO: 58694 - RNA, 23 nt, Artificial Sequence
  RNA Oligomer
uucuuccaaagauucuucauggu

SEQ ID NO: 58695 - RNA, 23 nt, Artificial Sequence
  RNA Oligomer
accgcaguccgucuaagaagcac

SEQ ID NO: 58696 - RNA, 23 nt, Artificial Sequence
  RNA Oligomer
ccgcaguccgucuaagaagcacg

SEQ ID NO: 58697 - RNA, 23 nt, Artificial Sequence
  RNA Oligomer
cgcaguccgucuaagaagcacgc

SEQ ID NO: 58698 - RNA, 23 nt, Artificial Sequence
  RNA Oligomer
gcaguccgucuaagaagcacgcg

SEQ ID NO: 58699 - RNA, 23 nt, Artificial Sequence
  RNA Oligomer
caguccgucuaagaagcacgcgg

SEQ ID NO: 58700 - RNA, 23 nt, Artificial Sequence
  RNA Oligomer
cguccacauggaaaaacucuggu

SEQ ID NO: 58701 - RNA, 23 nt, Artificial Sequence
  RNA Oligomer
guccacauggaaaaacucugguc

SEQ ID NO: 58702 - RNA, 23 nt, Artificial Sequence
  RNA Oligomer
uccacauggaaaaacucugguca

SEQ ID NO: 58703 - RNA, 23 nt, Artificial Sequence
  RNA Oligomer
ccacauggaaaaacucuggucaa

SEQ ID NO: 58704 - RNA, 23 nt, Artificial Sequence
  RNA Oligomer
cacauggaaaaacucuggucaaa

SEQ ID NO: 58705 - RNA, 23 nt, Artificial Sequence
  RNA Oligomer
acauggaaaaacucuggucaaag

SEQ ID NO: 58706 - RNA, 23 nt, Artificial Sequence
  RNA Oligomer
aucgagauagcacugaguucugu

SEQ ID NO: 58707 - RNA, 23 nt, Artificial Sequence
  RNA Oligomer
ucgagauagcacugaguucuguc

SEQ ID NO: 58708 - RNA, 23 nt, Artificial Sequence
  RNA Oligomer
uggcaguaaaaggcgugauaccc

SEQ ID NO: 58709 - RNA, 23 nt, Artificial Sequence
  RNA Oligomer
ggcaguaaaaggcgugauacccc

SEQ ID NO: 58710 - RNA, 23 nt, Artificial Sequence
  RNA Oligomer
gcaguaaaaggcgugauaccccg

SEQ ID NO: 58711 - RNA, 23 nt, Artificial Sequence
  RNA Oligomer
caguaaaaggcgugauaccccgg

SEQ ID NO: 58712 - RNA, 23 nt, Artificial Sequence
  RNA Oligomer
aguaaaaggcgugauaccccggg

SEQ ID NO: 58713 - RNA, 23 nt, Artificial Sequence
  RNA Oligomer
gccacaauccagucauuccaccc

SEQ ID NO: 58714 - RNA, 23 nt, Artificial Sequence
  RNA Oligomer
ccacaauccagucauuccacccc

SEQ ID NO: 58715 - RNA, 23 nt, Artificial Sequence
  RNA Oligomer
cacaauccagucauuccacccca

SEQ ID NO: 58716 - RNA, 23 nt, Artificial Sequence
  RNA Oligomer
acaauccagucauuccaccccac

SEQ ID NO: 58717 - RNA, 23 nt, Artificial Sequence
  RNA Oligomer
caauccagucauuccaccccacg

SEQ ID NO: 58718 - RNA, 23 nt, Artificial Sequence
  RNA Oligomer
accgaauguccguuccuuuucuu

SEQ ID NO: 58719 - RNA, 23 nt, Artificial Sequence
  RNA Oligomer
ccgaauguccguuccuuuucuuu

SEQ ID NO: 58720 - RNA, 23 nt, Artificial Sequence
  RNA Oligomer
cgaauguccguuccuuuucuuug

SEQ ID NO: 58721 - RNA, 23 nt, Artificial Sequence
  RNA Oligomer
ccaucauggccaaaaguuacuag

SEQ ID NO: 58722 - RNA, 23 nt, Artificial Sequence
  RNA Oligomer
gcgcagucucucuuuucacgcug

SEQ ID NO: 58723 - RNA, 23 nt, Artificial Sequence
  RNA Oligomer
auggaaacugcuauuguuuccua

SEQ ID NO: 58724 - RNA, 23 nt, Artificial Sequence
  RNA Oligomer
uggaaacugcuauuguuuccuaa

SEQ ID NO: 58725 - RNA, 23 nt, Artificial Sequence
  RNA Oligomer
ggaaacugcuauuguuuccuaaa

SEQ ID NO: 58726 - RNA, 23 nt, Artificial Sequence
  RNA Oligomer
gaaacugcuauuguuuccuaaag

SEQ ID NO: 58727 - RNA, 23 nt, Artificial Sequence
  RNA Oligomer
aaacugcuauuguuuccuaaagc

SEQ ID NO: 58728 - RNA, 23 nt, Artificial Sequence
  RNA Oligomer
aacugcuauuguuuccuaaagca

SEQ ID NO: 58729 - RNA, 23 nt, Artificial Sequence
  RNA Oligomer
ugaggugauaaacuccuccgugg

SEQ ID NO: 58730 - RNA, 23 nt, Artificial Sequence
  RNA Oligomer
gaggugauaaacuccuccguggg

SEQ ID NO: 58731 - RNA, 23 nt, Artificial Sequence
  RNA Oligomer
aggugauaaacuccuccgugggg

SEQ ID NO: 58732 - RNA, 23 nt, Artificial Sequence
  RNA Oligomer
ggugauaaacuccuccgugggga

SEQ ID NO: 58733 - RNA, 23 nt, Artificial Sequence
  RNA Oligomer
gugauaaacuccuccguggggau

SEQ ID NO: 58734 - RNA, 23 nt, Artificial Sequence
  RNA Oligomer
uaaagaagaaucuccggguuguu

SEQ ID NO: 58735 - RNA, 23 nt, Artificial Sequence
  RNA Oligomer
aaguuauucucccugcaaguuca

SEQ ID NO: 58736 - RNA, 23 nt, Artificial Sequence
  RNA Oligomer
aguuauucucccugcaaguucaa

SEQ ID NO: 58737 - RNA, 23 nt, Artificial Sequence
  RNA Oligomer
guuauucucccugcaaguucaag

SEQ ID NO: 58738 - RNA, 23 nt, Artificial Sequence
  RNA Oligomer
uuauucucccugcaaguucaaga

SEQ ID NO: 58739 - RNA, 23 nt, Artificial Sequence
  RNA Oligomer
uauucucccugcaaguucaagaa

SEQ ID NO: 58740 - RNA, 23 nt, Artificial Sequence
  RNA Oligomer
uuaauacaaccuuuucauucucg

SEQ ID NO: 58741 - RNA, 23 nt, Artificial Sequence
  RNA Oligomer
uaauacaaccuuuucauucucgu

SEQ ID NO: 58742 - RNA, 23 nt, Artificial Sequence
  RNA Oligomer
aauacaaccuuuucauucucguc

SEQ ID NO: 58743 - RNA, 23 nt, Artificial Sequence
  RNA Oligomer
acagcuggacuuaaggcguuucc

SEQ ID NO: 58744 - RNA, 23 nt, Artificial Sequence
  RNA Oligomer
cagcuggacuuaaggcguuuccg

SEQ ID NO: 58745 - RNA, 23 nt, Artificial Sequence
  RNA Oligomer
agcuggacuuaaggcguuuccgc

SEQ ID NO: 58746 - RNA, 23 nt, Artificial Sequence
  RNA Oligomer
gcuggacuuaaggcguuuccgcu

SEQ ID NO: 58747 - RNA, 23 nt, Artificial Sequence
  RNA Oligomer
cuggacuuaaggcguuuccgcug

SEQ ID NO: 58748 - RNA, 23 nt, Artificial Sequence
  RNA Oligomer
ccugcuuauccuaacaugucucu

SEQ ID NO: 58749 - RNA, 23 nt, Artificial Sequence
  RNA Oligomer
cugcuuauccuaacaugucucuu

SEQ ID NO: 58750 - RNA, 23 nt, Artificial Sequence
  RNA Oligomer
uccuuuucuuugccuccuccuuc

SEQ ID NO: 58751 - RNA, 23 nt, Artificial Sequence
  RNA Oligomer
gggggugacaucaaaacuuuccc

SEQ ID NO: 58752 - RNA, 23 nt, Artificial Sequence
  RNA Oligomer
ggggugacaucaaaacuuuccca

SEQ ID NO: 58753 - RNA, 23 nt, Artificial Sequence
  RNA Oligomer
gggugacaucaaaacuuucccac

SEQ ID NO: 58754 - RNA, 23 nt, Artificial Sequence
  RNA Oligomer
ggugacaucaaaacuuucccacc

SEQ ID NO: 58755 - RNA, 23 nt, Artificial Sequence
  RNA Oligomer
gugacaucaaaacuuucccaccu

SEQ ID NO: 58756 - RNA, 23 nt, Artificial Sequence
  RNA Oligomer
ccaccugcuugcauucugauuca

SEQ ID NO: 58757 - RNA, 23 nt, Artificial Sequence
  RNA Oligomer
caccugcuugcauucugauucac

SEQ ID NO: 58758 - RNA, 23 nt, Artificial Sequence
  RNA Oligomer
accugcuugcauucugauucacc

SEQ ID NO: 58759 - RNA, 23 nt, Artificial Sequence
  RNA Oligomer
ccugcuugcauucugauucacca

SEQ ID NO: 58760 - RNA, 23 nt, Artificial Sequence
  RNA Oligomer
cugcuugcauucugauucaccaa

SEQ ID NO: 58761 - RNA, 23 nt, Artificial Sequence
  RNA Oligomer
cgcgcagucucucuuuucacgcu

SEQ ID NO: 58762 - RNA, 23 nt, Artificial Sequence
  RNA Oligomer
cuuccaaagauucuucauggugg

SEQ ID NO: 58763 - RNA, 23 nt, Artificial Sequence
  RNA Oligomer
uuccaaagauucuucauggugga

SEQ ID NO: 58764 - RNA, 23 nt, Artificial Sequence
  RNA Oligomer
uccaaagauucuucaugguggaa

SEQ ID NO: 58765 - RNA, 23 nt, Artificial Sequence
  RNA Oligomer
ccaaagauucuucaugguggaag

SEQ ID NO: 58766 - RNA, 23 nt, Artificial Sequence
  RNA Oligomer
caaagauucuucaugguggaagc

SEQ ID NO: 58767 - RNA, 23 nt, Artificial Sequence
  RNA Oligomer
cauggaaaaacucuggucaaagg

SEQ ID NO: 58768 - RNA, 23 nt, Artificial Sequence
  RNA Oligomer
gacacagcaugccuuaggaaucu

SEQ ID NO: 58769 - RNA, 23 nt, Artificial Sequence
  RNA Oligomer
acacagcaugccuuaggaaucuu

SEQ ID NO: 58770 - RNA, 23 nt, Artificial Sequence
  RNA Oligomer
cacagcaugccuuaggaaucuua

SEQ ID NO: 58771 - RNA, 23 nt, Artificial Sequence
  RNA Oligomer
acagcaugccuuaggaaucuuag

SEQ ID NO: 58772 - RNA, 23 nt, Artificial Sequence
  RNA Oligomer
cagcaugccuuaggaaucuuaga

SEQ ID NO: 58773 - RNA, 23 nt, Artificial Sequence
  RNA Oligomer
agcaugccuuaggaaucuuagag

SEQ ID NO: 58774 - RNA, 23 nt, Artificial Sequence
  RNA Oligomer
gcaugccuuaggaaucuuagagu

SEQ ID NO: 58775 - RNA, 23 nt, Artificial Sequence
  RNA Oligomer
caugccuuaggaaucuuagaguu

SEQ ID NO: 58776 - RNA, 23 nt, Artificial Sequence
  RNA Oligomer
augccuuaggaaucuuagaguua

SEQ ID NO: 58777 - RNA, 23 nt, Artificial Sequence
  RNA Oligomer
ugccuuaggaaucuuagaguuaa

SEQ ID NO: 58778 - RNA, 23 nt, Artificial Sequence
  RNA Oligomer
gccuuaggaaucuuagaguuaac

SEQ ID NO: 58779 - RNA, 23 nt, Artificial Sequence
  RNA Oligomer
ccuuaggaaucuuagaguuaaca

SEQ ID NO: 58780 - RNA, 23 nt, Artificial Sequence
  RNA Oligomer
cuuaggaaucuuagaguuaacag

SEQ ID NO: 58781 - RNA, 23 nt, Artificial Sequence
  RNA Oligomer
uuaggaaucuuagaguuaacaga

SEQ ID NO: 58782 - RNA, 23 nt, Artificial Sequence
  RNA Oligomer
uaggaaucuuagaguuaacagag

SEQ ID NO: 58783 - RNA, 23 nt, Artificial Sequence
  RNA Oligomer
aggaaucuuagaguuaacagagu

SEQ ID NO: 58784 - RNA, 23 nt, Artificial Sequence
  RNA Oligomer
ggaaucuuagaguuaacagaguu

SEQ ID NO: 58785 - RNA, 23 nt, Artificial Sequence
  RNA Oligomer
gaaucuuagaguuaacagaguug

SEQ ID NO: 58786 - RNA, 23 nt, Artificial Sequence
  RNA Oligomer
ccgcuguuuguguuuggcuugac

SEQ ID NO: 58787 - RNA, 23 nt, Artificial Sequence
  RNA Oligomer
cgcuguuuguguuuggcuugacg

SEQ ID NO: 58788 - RNA, 23 nt, Artificial Sequence
  RNA Oligomer
gcuguuuguguuuggcuugacgu

SEQ ID NO: 58789 - RNA, 23 nt, Artificial Sequence
  RNA Oligomer
cuguuuguguuuggcuugacguu

SEQ ID NO: 58790 - RNA, 23 nt, Artificial Sequence
  RNA Oligomer
uguuuguguuuggcuugacguuu

SEQ ID NO: 58791 - RNA, 23 nt, Artificial Sequence
  RNA Oligomer
uggcuugacguuuuucucuuuug

SEQ ID NO: 58792 - RNA, 23 nt, Artificial Sequence
  RNA Oligomer
ggcuugacguuuuucucuuuugu

SEQ ID NO: 58793 - RNA, 23 nt, Artificial Sequence
  RNA Oligomer
gcuugacguuuuucucuuuugug

SEQ ID NO: 58794 - RNA, 23 nt, Artificial Sequence
  RNA Oligomer
acuagcaauggccuuaucuguga

SEQ ID NO: 58795 - RNA, 23 nt, Artificial Sequence
  RNA Oligomer
cuagcaauggccuuaucugugac

SEQ ID NO: 58796 - RNA, 23 nt, Artificial Sequence
  RNA Oligomer
gaccugcuuauccuaacaugucu

SEQ ID NO: 58797 - RNA, 23 nt, Artificial Sequence
  RNA Oligomer
accugcuuauccuaacaugucuc

SEQ ID NO: 58798 - RNA, 23 nt, Artificial Sequence
  RNA Oligomer
caaguuauucucccugcaaguuc

SEQ ID NO: 58799 - RNA, 23 nt, Artificial Sequence
  RNA Oligomer
cucccugcaaguucaagaagucc

SEQ ID NO: 58800 - RNA, 23 nt, Artificial Sequence
  RNA Oligomer
acacguccauugaaagagcgucc

SEQ ID NO: 58801 - RNA, 23 nt, Artificial Sequence
  RNA Oligomer
cacguccauugaaagagcgucca

SEQ ID NO: 58802 - RNA, 23 nt, Artificial Sequence
  RNA Oligomer
acguccauugaaagagcguccac

SEQ ID NO: 58803 - RNA, 23 nt, Artificial Sequence
  RNA Oligomer
cguccauugaaagagcguccaca

SEQ ID NO: 58804 - RNA, 23 nt, Artificial Sequence
  RNA Oligomer
guccauugaaagagcguccacau

SEQ ID NO: 58805 - RNA, 23 nt, Artificial Sequence
  RNA Oligomer
gaggaugcccuuuuccaucaugg

SEQ ID NO: 58806 - RNA, 23 nt, Artificial Sequence
  RNA Oligomer
aggaugcccuuuuccaucauggc

SEQ ID NO: 58807 - RNA, 23 nt, Artificial Sequence
  RNA Oligomer
ggaugcccuuuuccaucauggcc

SEQ ID NO: 58808 - RNA, 23 nt, Artificial Sequence
  RNA Oligomer
gaugcccuuuuccaucauggcca

SEQ ID NO: 58809 - RNA, 23 nt, Artificial Sequence
  RNA Oligomer
augcccuuuuccaucauggccaa

SEQ ID NO: 58810 - RNA, 23 nt, Artificial Sequence
  RNA Oligomer
ugcuugcauucugauucaccaac

SEQ ID NO: 58811 - RNA, 23 nt, Artificial Sequence
  RNA Oligomer
gcuugcauucugauucaccaacc

SEQ ID NO: 58812 - RNA, 23 nt, Artificial Sequence
  RNA Oligomer
cuugcauucugauucaccaaccu

SEQ ID NO: 58813 - RNA, 23 nt, Artificial Sequence
  RNA Oligomer
uugcauucugauucaccaaccug

SEQ ID NO: 58814 - RNA, 23 nt, Artificial Sequence
  RNA Oligomer
aaagauucuucaugguggaagcu

SEQ ID NO: 58815 - RNA, 23 nt, Artificial Sequence
  RNA Oligomer
ccauugaaagagcguccacaugg

SEQ ID NO: 58816 - RNA, 23 nt, Artificial Sequence
  RNA Oligomer
cauugaaagagcguccacaugga

SEQ ID NO: 58817 - RNA, 23 nt, Artificial Sequence
  RNA Oligomer
auugaaagagcguccacauggaa

SEQ ID NO: 58818 - RNA, 23 nt, Artificial Sequence
  RNA Oligomer
uugaaagagcguccacauggaaa

SEQ ID NO: 58819 - RNA, 23 nt, Artificial Sequence
  RNA Oligomer
ugaaagagcguccacauggaaaa

SEQ ID NO: 58820 - RNA, 23 nt, Artificial Sequence
  RNA Oligomer
gucaagguacagcaucgagauag

SEQ ID NO: 58821 - RNA, 23 nt, Artificial Sequence
  RNA Oligomer
ucaagguacagcaucgagauagc

SEQ ID NO: 58822 - RNA, 23 nt, Artificial Sequence
  RNA Oligomer
caagguacagcaucgagauagca

SEQ ID NO: 58823 - RNA, 23 nt, Artificial Sequence
  RNA Oligomer
aagguacagcaucgagauagcac

SEQ ID NO: 58824 - RNA, 23 nt, Artificial Sequence
  RNA Oligomer
agguacagcaucgagauagcacu

SEQ ID NO: 58825 - RNA, 23 nt, Artificial Sequence
  RNA Oligomer
auggaaaaacucuggucaaagga

SEQ ID NO: 58826 - RNA, 23 nt, Artificial Sequence
  RNA Oligomer
uggaaaaacucuggucaaaggac

SEQ ID NO: 58827 - RNA, 23 nt, Artificial Sequence
  RNA Oligomer
ggaaaaacucuggucaaaggacc

SEQ ID NO: 58828 - RNA, 23 nt, Artificial Sequence
  RNA Oligomer
gaaaaacucuggucaaaggaccu

SEQ ID NO: 58829 - RNA, 23 nt, Artificial Sequence
  RNA Oligomer
aaaaacucuggucaaaggaccug

SEQ ID NO: 58830 - RNA, 23 nt, Artificial Sequence
  RNA Oligomer
auggcaugauuaguggaguucag

SEQ ID NO: 58831 - RNA, 23 nt, Artificial Sequence
  RNA Oligomer
uggcaugauuaguggaguucaga

SEQ ID NO: 58832 - RNA, 23 nt, Artificial Sequence
  RNA Oligomer
ggcaugauuaguggaguucagau

SEQ ID NO: 58833 - RNA, 23 nt, Artificial Sequence
  RNA Oligomer
gcaugauuaguggaguucagaug

SEQ ID NO: 58834 - RNA, 23 nt, Artificial Sequence
  RNA Oligomer
caugauuaguggaguucagauga

SEQ ID NO: 58835 - RNA, 23 nt, Artificial Sequence
  RNA Oligomer
ggaguucagaugaucagccagag

SEQ ID NO: 58836 - RNA, 23 nt, Artificial Sequence
  RNA Oligomer
gaguucagaugaucagccagagg

SEQ ID NO: 58837 - RNA, 23 nt, Artificial Sequence
  RNA Oligomer
aguucagaugaucagccagagga

SEQ ID NO: 58838 - RNA, 23 nt, Artificial Sequence
  RNA Oligomer
guucagaugaucagccagaggaa

SEQ ID NO: 58839 - RNA, 23 nt, Artificial Sequence
  RNA Oligomer
uucagaugaucagccagaggaaa

SEQ ID NO: 58840 - RNA, 23 nt, Artificial Sequence
  RNA Oligomer
ugcaaagaccugcuuauccuaac

SEQ ID NO: 58841 - RNA, 23 nt, Artificial Sequence
  RNA Oligomer
gcaaagaccugcuuauccuaaca

SEQ ID NO: 58842 - RNA, 23 nt, Artificial Sequence
  RNA Oligomer
caaagaccugcuuauccuaacau

SEQ ID NO: 58843 - RNA, 23 nt, Artificial Sequence
  RNA Oligomer
aaagaccugcuuauccuaacaug

SEQ ID NO: 58844 - RNA, 23 nt, Artificial Sequence
  RNA Oligomer
aagaccugcuuauccuaacaugu

SEQ ID NO: 58845 - RNA, 23 nt, Artificial Sequence
  RNA Oligomer
ugacaucaaaacuuucccaccug

SEQ ID NO: 58846 - RNA, 23 nt, Artificial Sequence
  RNA Oligomer
gacaucaaaacuuucccaccugc

SEQ ID NO: 58847 - RNA, 23 nt, Artificial Sequence
  RNA Oligomer
acaucaaaacuuucccaccugcu

SEQ ID NO: 58848 - RNA, 23 nt, Artificial Sequence
  RNA Oligomer
caucaaaacuuucccaccugcuu

SEQ ID NO: 58849 - RNA, 23 nt, Artificial Sequence
  RNA Oligomer
aucaaaacuuucccaccugcuug

SEQ ID NO: 58850 - RNA, 23 nt, Artificial Sequence
  RNA Oligomer
ugcagguuuuaugauuucauaaa

SEQ ID NO: 58851 - RNA, 23 nt, Artificial Sequence
  RNA Oligomer
auauuaauucggugauggaaacu

SEQ ID NO: 58852 - RNA, 23 nt, Artificial Sequence
  RNA Oligomer
gcgcaaguuauucucccugcaag

SEQ ID NO: 58853 - RNA, 23 nt, Artificial Sequence
  RNA Oligomer
cgcaaguuauucucccugcaagu

SEQ ID NO: 58854 - RNA, 23 nt, Artificial Sequence
  RNA Oligomer
gcaaguuauucucccugcaaguu

SEQ ID NO: 58855 - RNA, 23 nt, Artificial Sequence
  RNA Oligomer
aaccauguccugauaguucuuua

SEQ ID NO: 58856 - RNA, 23 nt, Artificial Sequence
  RNA Oligomer
accauguccugauaguucuuuaa

SEQ ID NO: 58857 - RNA, 23 nt, Artificial Sequence
  RNA Oligomer
ccauguccugauaguucuuuaau

SEQ ID NO: 58858 - RNA, 23 nt, Artificial Sequence
  RNA Oligomer
cauguccugauaguucuuuaaua

SEQ ID NO: 58859 - RNA, 23 nt, Artificial Sequence
  RNA Oligomer
auguccugauaguucuuuaauac

SEQ ID NO: 58860 - RNA, 23 nt, Artificial Sequence
  RNA Oligomer
ucgggacacagcaugccuuagga

SEQ ID NO: 58861 - RNA, 23 nt, Artificial Sequence
  RNA Oligomer
cgggacacagcaugccuuaggaa

SEQ ID NO: 58862 - RNA, 23 nt, Artificial Sequence
  RNA Oligomer
gggacacagcaugccuuaggaau

SEQ ID NO: 58863 - RNA, 23 nt, Artificial Sequence
  RNA Oligomer
ggacacagcaugccuuaggaauc

SEQ ID NO: 58864 - RNA, 23 nt, Artificial Sequence
  RNA Oligomer
auuaguggaguucagaugaucag

SEQ ID NO: 58865 - RNA, 23 nt, Artificial Sequence
  RNA Oligomer
uuaguggaguucagaugaucagc

SEQ ID NO: 58866 - RNA, 23 nt, Artificial Sequence
  RNA Oligomer
uaguggaguucagaugaucagcc

SEQ ID NO: 58867 - RNA, 23 nt, Artificial Sequence
  RNA Oligomer
aguggaguucagaugaucagcca

SEQ ID NO: 58868 - RNA, 23 nt, Artificial Sequence
  RNA Oligomer
guggaguucagaugaucagccag

SEQ ID NO: 58869 - RNA, 23 nt, Artificial Sequence
  RNA Oligomer
uggaguucagaugaucagccaga

SEQ ID NO: 58870 - RNA, 23 nt, Artificial Sequence
  RNA Oligomer
cccuuuuccaucauggccaaaag

SEQ ID NO: 58871 - RNA, 23 nt, Artificial Sequence
  RNA Oligomer
ccuuuuccaucauggccaaaagu

SEQ ID NO: 58872 - RNA, 23 nt, Artificial Sequence
  RNA Oligomer
cuuuuccaucauggccaaaaguu

SEQ ID NO: 58873 - RNA, 23 nt, Artificial Sequence
  RNA Oligomer
uuuuccaucauggccaaaaguua

SEQ ID NO: 58874 - RNA, 23 nt, Artificial Sequence
  RNA Oligomer
uuuccaucauggccaaaaguuac

SEQ ID NO: 58875 - RNA, 23 nt, Artificial Sequence
  RNA Oligomer
cucggaaaaccugaagcucugcu

SEQ ID NO: 58876 - RNA, 23 nt, Artificial Sequence
  RNA Oligomer
ucggaaaaccugaagcucugcug

SEQ ID NO: 58877 - RNA, 23 nt, Artificial Sequence
  RNA Oligomer
cggaaaaccugaagcucugcuga

SEQ ID NO: 58878 - RNA, 23 nt, Artificial Sequence
  RNA Oligomer
ggaaaaccugaagcucugcugag

SEQ ID NO: 58879 - RNA, 23 nt, Artificial Sequence
  RNA Oligomer
gaaaaccugaagcucugcugagg

SEQ ID NO: 58880 - RNA, 23 nt, Artificial Sequence
  RNA Oligomer
cgauacaggucuagcauguaggg

SEQ ID NO: 58881 - RNA, 23 nt, Artificial Sequence
  RNA Oligomer
gauacaggucuagcauguagggg

SEQ ID NO: 58882 - RNA, 23 nt, Artificial Sequence
  RNA Oligomer
auacaggucuagcauguaggggg

SEQ ID NO: 58883 - RNA, 23 nt, Artificial Sequence
  RNA Oligomer
uacaggucuagcauguagggggg

SEQ ID NO: 58884 - RNA, 23 nt, Artificial Sequence
  RNA Oligomer
acaggucuagcauguaggggggc

SEQ ID NO: 58885 - RNA, 23 nt, Artificial Sequence
  RNA Oligomer
augauuaguggaguucagaugau

SEQ ID NO: 58886 - RNA, 23 nt, Artificial Sequence
  RNA Oligomer
ugauuaguggaguucagaugauc

SEQ ID NO: 58887 - RNA, 23 nt, Artificial Sequence
  RNA Oligomer
gauuaguggaguucagaugauca

SEQ ID NO: 58888 - RNA, 23 nt, Artificial Sequence
  RNA Oligomer
caccuuguuucuccuccaagugg

SEQ ID NO: 58889 - RNA, 23 nt, Artificial Sequence
  RNA Oligomer
accuuguuucuccuccaaguggg

SEQ ID NO: 58890 - RNA, 23 nt, Artificial Sequence
  RNA Oligomer
ccuuguuucuccuccaagugggc

SEQ ID NO: 58891 - RNA, 23 nt, Artificial Sequence
  RNA Oligomer
cuuguuucuccuccaagugggcc

SEQ ID NO: 58892 - RNA, 23 nt, Artificial Sequence
  RNA Oligomer
uuguuucuccuccaagugggcca

SEQ ID NO: 58893 - RNA, 23 nt, Artificial Sequence
  RNA Oligomer
aaagaagaaucuccggguuguuu

SEQ ID NO: 58894 - RNA, 23 nt, Artificial Sequence
  RNA Oligomer
uccauugaaagagcguccacaug

SEQ ID NO: 58895 - RNA, 23 nt, Artificial Sequence
  RNA Oligomer
uuuaauacaaccuuuucauucuc

SEQ ID NO: 58896 - RNA, 23 nt, Artificial Sequence
  RNA Oligomer
cacugaaguccacguacaaaggg

SEQ ID NO: 58897 - RNA, 23 nt, Artificial Sequence
  RNA Oligomer
acugaaguccacguacaaagggu

SEQ ID NO: 58898 - RNA, 23 nt, Artificial Sequence
  RNA Oligomer
cugaaguccacguacaaagggug

SEQ ID NO: 58899 - RNA, 23 nt, Artificial Sequence
  RNA Oligomer
ugaaguccacguacaaagggugu

SEQ ID NO: 58900 - RNA, 23 nt, Artificial Sequence
  RNA Oligomer
gaaguccacguacaaaggguguc

SEQ ID NO: 58901 - RNA, 23 nt, Artificial Sequence
  RNA Oligomer
cggggacacguccauugaaagag

SEQ ID NO: 58902 - RNA, 23 nt, Artificial Sequence
  RNA Oligomer
ggggacacguccauugaaagagc

SEQ ID NO: 58903 - RNA, 23 nt, Artificial Sequence
  RNA Oligomer
gggacacguccauugaaagagcg

SEQ ID NO: 58904 - RNA, 23 nt, Artificial Sequence
  RNA Oligomer
ggacacguccauugaaagagcgu

SEQ ID NO: 58905 - RNA, 23 nt, Artificial Sequence
  RNA Oligomer
gacacguccauugaaagagcguc

SEQ ID NO: 58906 - RNA, 23 nt, Artificial Sequence
  RNA Oligomer
uauuuaauuuugcuguacuagcg

SEQ ID NO: 58907 - RNA, 23 nt, Artificial Sequence
  RNA Oligomer
auuuaauuuugcuguacuagcga

SEQ ID NO: 58908 - RNA, 23 nt, Artificial Sequence
  RNA Oligomer
uuuaauuuugcuguacuagcgac

SEQ ID NO: 58909 - RNA, 23 nt, Artificial Sequence
  RNA Oligomer
uuaauuuugcuguacuagcgaca

SEQ ID NO: 58910 - RNA, 23 nt, Artificial Sequence
  RNA Oligomer
uaauuuugcuguacuagcgacac

SEQ ID NO: 58911 - RNA, 23 nt, Artificial Sequence
  RNA Oligomer
cccacaacccuccacaaccaugu

SEQ ID NO: 58912 - RNA, 23 nt, Artificial Sequence
  RNA Oligomer
ccacaacccuccacaaccauguc

SEQ ID NO: 58913 - RNA, 23 nt, Artificial Sequence
  RNA Oligomer
cacaacccuccacaaccaugucc

SEQ ID NO: 58914 - RNA, 23 nt, Artificial Sequence
  RNA Oligomer
acaacccuccacaaccauguccu

SEQ ID NO: 58915 - RNA, 23 nt, Artificial Sequence
  RNA Oligomer
caacccuccacaaccauguccug

SEQ ID NO: 58916 - RNA, 23 nt, Artificial Sequence
  RNA Oligomer
gcguuuccgcuguuuguguuugg

SEQ ID NO: 58917 - RNA, 23 nt, Artificial Sequence
  RNA Oligomer
cguuuccgcuguuuguguuuggc

SEQ ID NO: 58918 - RNA, 23 nt, Artificial Sequence
  RNA Oligomer
guuuccgcuguuuguguuuggcu

SEQ ID NO: 58919 - RNA, 23 nt, Artificial Sequence
  RNA Oligomer
uuuccgcuguuuguguuuggcuu

SEQ ID NO: 58920 - RNA, 23 nt, Artificial Sequence
  RNA Oligomer
uuccgcuguuuguguuuggcuug

SEQ ID NO: 58921 - RNA, 23 nt, Artificial Sequence
  RNA Oligomer
uuccaucauggccaaaaguuacu

SEQ ID NO: 58922 - RNA, 23 nt, Artificial Sequence
  RNA Oligomer
uccaucauggccaaaaguuacua

SEQ ID NO: 58923 - RNA, 23 nt, Artificial Sequence
  RNA Oligomer
gccaaaaguuacuagcaauggcc

SEQ ID NO: 58924 - RNA, 23 nt, Artificial Sequence
  RNA Oligomer
ccaaaaguuacuagcaauggccu

SEQ ID NO: 58925 - RNA, 23 nt, Artificial Sequence
  RNA Oligomer
caaaaguuacuagcaauggccuu

SEQ ID NO: 58926 - RNA, 23 nt, Artificial Sequence
  RNA Oligomer
aaaaguuacuagcaauggccuua

SEQ ID NO: 58927 - RNA, 23 nt, Artificial Sequence
  RNA Oligomer
aaaguuacuagcaauggccuuau

SEQ ID NO: 58928 - RNA, 23 nt, Artificial Sequence
  RNA Oligomer
ucagaugaucagccagaggaaaa

SEQ ID NO: 58929 - RNA, 23 nt, Artificial Sequence
  RNA Oligomer
cagaugaucagccagaggaaaag

SEQ ID NO: 58930 - RNA, 23 nt, Artificial Sequence
  RNA Oligomer
ugaccagcuguguucaucuuggu

SEQ ID NO: 58931 - RNA, 23 nt, Artificial Sequence
  RNA Oligomer
gaccagcuguguucaucuuggug

SEQ ID NO: 58932 - RNA, 23 nt, Artificial Sequence
  RNA Oligomer
accagcuguguucaucuuggugc

SEQ ID NO: 58933 - RNA, 23 nt, Artificial Sequence
  RNA Oligomer
ccagcuguguucaucuuggugca

SEQ ID NO: 58934 - RNA, 23 nt, Artificial Sequence
  RNA Oligomer
cagcuguguucaucuuggugcaa

SEQ ID NO: 58935 - RNA, 23 nt, Artificial Sequence
  RNA Oligomer
ugcuauuguuuccuaaagcaucu

SEQ ID NO: 58936 - RNA, 23 nt, Artificial Sequence
  RNA Oligomer
gcuauuguuuccuaaagcaucuu

SEQ ID NO: 58937 - RNA, 23 nt, Artificial Sequence
  RNA Oligomer
cuauuguuuccuaaagcaucuug

SEQ ID NO: 58938 - RNA, 23 nt, Artificial Sequence
  RNA Oligomer
uauuguuuccuaaagcaucuugc

SEQ ID NO: 58939 - RNA, 23 nt, Artificial Sequence
  RNA Oligomer
auuguuuccuaaagcaucuugca

SEQ ID NO: 58940 - RNA, 23 nt, Artificial Sequence
  RNA Oligomer
guuuucccacucguuucugguag

SEQ ID NO: 58941 - RNA, 23 nt, Artificial Sequence
  RNA Oligomer
uuuucccacucguuucugguagu

SEQ ID NO: 58942 - RNA, 23 nt, Artificial Sequence
  RNA Oligomer
agccacaauccagucauuccacc

SEQ ID NO: 58943 - RNA, 23 nt, Artificial Sequence
  RNA Oligomer
acugcuauuguuuccuaaagcau

SEQ ID NO: 58944 - RNA, 23 nt, Artificial Sequence
  RNA Oligomer
cugcuauuguuuccuaaagcauc

SEQ ID NO: 58945 - RNA, 23 nt, Artificial Sequence
  RNA Oligomer
aauuuugcuguacuagcgacacc

SEQ ID NO: 58946 - RNA, 23 nt, Artificial Sequence
  RNA Oligomer
auuuugcuguacuagcgacaccc

SEQ ID NO: 58947 - RNA, 23 nt, Artificial Sequence
  RNA Oligomer
uuuugcuguacuagcgacaccca

SEQ ID NO: 58948 - RNA, 23 nt, Artificial Sequence
  RNA Oligomer
cagccagaggaaaagggcauucu

SEQ ID NO: 58949 - RNA, 23 nt, Artificial Sequence
  RNA Oligomer
agccagaggaaaagggcauucuc

SEQ ID NO: 58950 - RNA, 23 nt, Artificial Sequence
  RNA Oligomer
gccagaggaaaagggcauucucc

SEQ ID NO: 58951 - RNA, 23 nt, Artificial Sequence
  RNA Oligomer
ccagaggaaaagggcauucuccg

SEQ ID NO: 58952 - RNA, 23 nt, Artificial Sequence
  RNA Oligomer
cagaggaaaagggcauucuccgu

SEQ ID NO: 58953 - RNA, 23 nt, Artificial Sequence
  RNA Oligomer
gcgcaaggaccgaauguccguuc

SEQ ID NO: 58954 - RNA, 23 nt, Artificial Sequence
  RNA Oligomer
cgcaaggaccgaauguccguucc

SEQ ID NO: 58955 - RNA, 23 nt, Artificial Sequence
  RNA Oligomer
gcaaggaccgaauguccguuccu

SEQ ID NO: 58956 - RNA, 23 nt, Artificial Sequence
  RNA Oligomer
caaggaccgaauguccguuccuu

SEQ ID NO: 58957 - RNA, 23 nt, Artificial Sequence
  RNA Oligomer
aaggaccgaauguccguuccuuu

SEQ ID NO: 58958 - RNA, 23 nt, Artificial Sequence
  RNA Oligomer
ggcguuuccgcuguuuguguuug

SEQ ID NO: 58959 - RNA, 23 nt, Artificial Sequence
  RNA Oligomer
cugguaguucuuccaaagauucu

SEQ ID NO: 58960 - RNA, 23 nt, Artificial Sequence
  RNA Oligomer
ugguaguucuuccaaagauucuu

SEQ ID NO: 58961 - RNA, 23 nt, Artificial Sequence
  RNA Oligomer
gguaguucuuccaaagauucuuc

SEQ ID NO: 58962 - RNA, 23 nt, Artificial Sequence
  RNA Oligomer
gaugaucagccagaggaaaaggg

SEQ ID NO: 58963 - RNA, 23 nt, Artificial Sequence
  RNA Oligomer
augaucagccagaggaaaagggc

SEQ ID NO: 58964 - RNA, 23 nt, Artificial Sequence
  RNA Oligomer
ugaucagccagaggaaaagggca

SEQ ID NO: 58965 - RNA, 23 nt, Artificial Sequence
  RNA Oligomer
gaucagccagaggaaaagggcau

SEQ ID NO: 58966 - RNA, 23 nt, Artificial Sequence
  RNA Oligomer
aucagccagaggaaaagggcauu

SEQ ID NO: 58967 - RNA, 23 nt, Artificial Sequence
  RNA Oligomer
uccgcuguuuguguuuggcuuga

SEQ ID NO: 58968 - RNA, 23 nt, Artificial Sequence
  RNA Oligomer
cguuuuucucuuuuguggagagg

SEQ ID NO: 58969 - RNA, 23 nt, Artificial Sequence
  RNA Oligomer
guuuuucucuuuuguggagagga

SEQ ID NO: 58970 - RNA, 23 nt, Artificial Sequence
  RNA Oligomer
uuuuucucuuuuguggagaggau

SEQ ID NO: 58971 - RNA, 23 nt, Artificial Sequence
  RNA Oligomer
uuuucucuuuuguggagaggaug

SEQ ID NO: 58972 - RNA, 23 nt, Artificial Sequence
  RNA Oligomer
uuucucuuuuguggagaggaugc

SEQ ID NO: 58973 - RNA, 23 nt, Artificial Sequence
  RNA Oligomer
uuccuaaagcaucuugcaucugu

SEQ ID NO: 58974 - RNA, 23 nt, Artificial Sequence
  RNA Oligomer
uccuaaagcaucuugcaucuguu

SEQ ID NO: 58975 - RNA, 23 nt, Artificial Sequence
  RNA Oligomer
ccuaaagcaucuugcaucuguuc

SEQ ID NO: 58976 - RNA, 23 nt, Artificial Sequence
  RNA Oligomer
cuaaagcaucuugcaucuguucu

SEQ ID NO: 58977 - RNA, 23 nt, Artificial Sequence
  RNA Oligomer
uaaagcaucuugcaucuguucuc

SEQ ID NO: 58978 - RNA, 23 nt, Artificial Sequence
  RNA Oligomer
ucuguucucggaaaaccugaagc

SEQ ID NO: 58979 - RNA, 23 nt, Artificial Sequence
  RNA Oligomer
cuguucucggaaaaccugaagcu

SEQ ID NO: 58980 - RNA, 23 nt, Artificial Sequence
  RNA Oligomer
uguucucggaaaaccugaagcuc

SEQ ID NO: 58981 - RNA, 23 nt, Artificial Sequence
  RNA Oligomer
guucucggaaaaccugaagcucu

SEQ ID NO: 58982 - RNA, 23 nt, Artificial Sequence
  RNA Oligomer
uucucggaaaaccugaagcucug

SEQ ID NO: 58983 - RNA, 23 nt, Artificial Sequence
  RNA Oligomer
uuucccacucguuucugguaguu

SEQ ID NO: 58984 - RNA, 23 nt, Artificial Sequence
  RNA Oligomer
uucccacucguuucugguaguuc

SEQ ID NO: 58985 - RNA, 23 nt, Artificial Sequence
  RNA Oligomer
ggccaaaaguuacuagcaauggc

SEQ ID NO: 58986 - RNA, 23 nt, Artificial Sequence
  RNA Oligomer
uuacuagcaauggccuuaucugu

SEQ ID NO: 58987 - RNA, 23 nt, Artificial Sequence
  RNA Oligomer
uacuagcaauggccuuaucugug

SEQ ID NO: 58988 - RNA, 23 nt, Artificial Sequence
  RNA Oligomer
ggccuuaucugugaccagcugug
